United States Patent 7,888,497 (BIOINFORMATICALLY DETECTABLE GROUP OF NOVEL REGULATORY OLIGONUCLEOTIDES AND USES THEREOF) - sequence listing, part 110

SEQ ID NO: 4655665 - DNA, 19 bp, Homo sapiens
tgtgaccacaggctggtgt

SEQ ID NO: 4655666 - DNA, 20 bp, Homo sapiens
tgtgacccccagctccggcc

SEQ ID NO: 4655667 - DNA, 16 bp, Homo sapiens
tgtgacccctccttgt

SEQ ID NO: 4655668 - DNA, 14 bp, Homo sapiens
tgtgacctgctgag

SEQ ID NO: 4655669 - DNA, 14 bp, Homo sapiens
tgtgactgtcactt

SEQ ID NO: 4655670 - DNA, 18 bp, Homo sapiens
tgtgagcccagctgggtc

SEQ ID NO: 4655671 - DNA, 15 bp, Homo sapiens
tgtgagggtgctgac

SEQ ID NO: 4655672 - DNA, 16 bp, Homo sapiens
tgtgagtatttctgtt

SEQ ID NO: 4655673 - DNA, 20 bp, Homo sapiens
tgtgagtatttctgttcctt

SEQ ID NO: 4655674 - DNA, 12 bp, Homo sapiens
tgtgagtgtgac

SEQ ID NO: 4655675 - DNA, 21 bp, Homo sapiens
tgtgataatagcatttttgta

SEQ ID NO: 4655676 - DNA, 14 bp, Homo sapiens
tgtgatcaggcccc

SEQ ID NO: 4655677 - DNA, 15 bp, Homo sapiens
tgtgatcaggcccca

SEQ ID NO: 4655678 - DNA, 20 bp, Homo sapiens
tgtgatcaggccccacccct

SEQ ID NO: 4655679 - DNA, 13 bp, Homo sapiens
tgtgatggagggg

SEQ ID NO: 4655680 - DNA, 21 bp, Homo sapiens
tgtgatgtttaggggcaaaca

SEQ ID NO: 4655681 - DNA, 17 bp, Homo sapiens
tgtgatgttttatcctt

SEQ ID NO: 4655682 - DNA, 18 bp, Homo sapiens
tgtgatgttttatcctta

SEQ ID NO: 4655683 - DNA, 15 bp, Homo sapiens
tgtgattaatgtttt

SEQ ID NO: 4655684 - DNA, 14 bp, Homo sapiens
tgtgatttatcttt

SEQ ID NO: 4655685 - DNA, 21 bp, Homo sapiens
tgtgatttctttaaaagaatg

SEQ ID NO: 4655686 - DNA, 14 bp, Homo sapiens
tgtgattttaactc

SEQ ID NO: 4655687 - DNA, 17 bp, Homo sapiens
tgtgattttaactctgt

SEQ ID NO: 4655688 - DNA, 18 bp, Homo sapiens
tgtgattttaactctgtc

SEQ ID NO: 4655689 - DNA, 19 bp, Homo sapiens
tgtgattttaactctgtct

SEQ ID NO: 4655690 - DNA, 17 bp, Homo sapiens
tgtgcacaaagtggcat

SEQ ID NO: 4655691 - DNA, 19 bp, Homo sapiens
tgtgcaccaccacacccgg

SEQ ID NO: 4655692 - DNA, 17 bp, Homo sapiens
tgtgcacttagccatga

SEQ ID NO: 4655693 - DNA, 16 bp, Homo sapiens
tgtgcagagcagacag

SEQ ID NO: 4655694 - DNA, 19 bp, Homo sapiens
tgtgcagcatggaattcct

SEQ ID NO: 4655695 - DNA, 19 bp, Homo sapiens
tgtgcatggaggccctcct

SEQ ID NO: 4655696 - DNA, 22 bp, Homo sapiens
tgtgcatggaggccctcctgtg

SEQ ID NO: 4655697 - DNA, 15 bp, Homo sapiens
tgtgcattctggatt

SEQ ID NO: 4655698 - DNA, 21 bp, Homo sapiens
tgtgcattttttttttcattg

SEQ ID NO: 4655699 - DNA, 17 bp, Homo sapiens
tgtgccaacctgttctt

SEQ ID NO: 4655700 - DNA, 21 bp, Homo sapiens
tgtgccacacttcgctcttga

SEQ ID NO: 4655701 - DNA, 17 bp, Homo sapiens
tgtgccaccatgcctca

SEQ ID NO: 4655702 - DNA, 15 bp, Homo sapiens
tgtgccagagcctgg

SEQ ID NO: 4655703 - DNA, 17 bp, Homo sapiens
tgtgccagagcctgggg

SEQ ID NO: 4655704 - DNA, 22 bp, Homo sapiens
tgtgccagagcctggggctcta

SEQ ID NO: 4655705 - DNA, 14 bp, Homo sapiens
tgtgccatagaaca

SEQ ID NO: 4655706 - DNA, 14 bp, Homo sapiens
tgtgccatgctggg

SEQ ID NO: 4655707 - DNA, 13 bp, Homo sapiens
tgtgccccaccac

SEQ ID NO: 4655708 - DNA, 21 bp, Homo sapiens
tgtgcccttttataaggaaac

SEQ ID NO: 4655709 - DNA, 17 bp, Homo sapiens
tgtgcgtcccagctgaa

SEQ ID NO: 4655710 - DNA, 14 bp, Homo sapiens
tgtgctaaatatca

SEQ ID NO: 4655711 - DNA, 21 bp, Homo sapiens
tgtgctacgtgtgaaatctgt

SEQ ID NO: 4655712 - DNA, 16 bp, Homo sapiens
tgtgctgggggaatga

SEQ ID NO: 4655713 - DNA, 23 bp, Homo sapiens
tgtgctgggggaatgagcccaga

SEQ ID NO: 4655714 - DNA, 24 bp, Homo sapiens
tgtgctgggggaatgagcccagag

SEQ ID NO: 4655715 - DNA, 15 bp, Homo sapiens
tgtggaaaaaatatt

SEQ ID NO: 4655716 - DNA, 18 bp, Homo sapiens
tgtggaaggcctccctct

SEQ ID NO: 4655717 - DNA, 20 bp, Homo sapiens
tgtggaattttgagaaaaat

SEQ ID NO: 4655718 - DNA, 17 bp, Homo sapiens
tgtggagatcacagccc

SEQ ID NO: 4655719 - DNA, 16 bp, Homo sapiens
tgtggaggaagagcca

SEQ ID NO: 4655720 - DNA, 17 bp, Homo sapiens
tgtggaggaagagccac

SEQ ID NO: 4655721 - DNA, 23 bp, Homo sapiens
tgtggaggaagagccacctgcaa

SEQ ID NO: 4655722 - DNA, 15 bp, Homo sapiens
tgtggaggaggtgaa

SEQ ID NO: 4655723 - DNA, 14 bp, Homo sapiens
tgtggatccaatgt

SEQ ID NO: 4655724 - DNA, 17 bp, Homo sapiens
tgtggatccaatgttag

SEQ ID NO: 4655725 - DNA, 18 bp, Homo sapiens
tgtggccaagttcttagt

SEQ ID NO: 4655726 - DNA, 15 bp, Homo sapiens
tgtggcgtctccctc

SEQ ID NO: 4655727 - DNA, 14 bp, Homo sapiens
tgtggctccaagct

SEQ ID NO: 4655728 - DNA, 13 bp, Homo sapiens
tgtggctccctct

SEQ ID NO: 4655729 - DNA, 15 bp, Homo sapiens
tgtggctccctctct

SEQ ID NO: 4655730 - DNA, 19 bp, Homo sapiens
tgtggctccctctctcctg

SEQ ID NO: 4655731 - DNA, 14 bp, Homo sapiens
tgtgggcactggcc

SEQ ID NO: 4655732 - DNA, 18 bp, Homo sapiens
tgtgggcactggcccagg

SEQ ID NO: 4655733 - DNA, 15 bp, Homo sapiens
tgtgggtatttcttg

SEQ ID NO: 4655734 - DNA, 12 bp, Homo sapiens
tgtgggtctctg

SEQ ID NO: 4655735 - DNA, 13 bp, Homo sapiens
tgtgggtctctga

SEQ ID NO: 4655736 - DNA, 14 bp, Homo sapiens
tgtgggtctctgaa

SEQ ID NO: 4655737 - DNA, 12 bp, Homo sapiens
tgtgggtgtagc

SEQ ID NO: 4655738 - DNA, 15 bp, Homo sapiens
tgtgggtgtagccag

SEQ ID NO: 4655739 - DNA, 21 bp, Homo sapiens
tgtggtattcaactaatacat

SEQ ID NO: 4655740 - DNA, 19 bp, Homo sapiens
tgtggtctggtgttccagc

SEQ ID NO: 4655741 - DNA, 19 bp, Homo sapiens
tgtggttgcagtctttccc

SEQ ID NO: 4655742 - DNA, 19 bp, Homo sapiens
tgtgtacaaagaaataaca

SEQ ID NO: 4655743 - DNA, 19 bp, Homo sapiens
tgtgtacaaatacatgtgt

SEQ ID NO: 4655744 - DNA, 15 bp, Homo sapiens
tgtgtagcctgtgca

SEQ ID NO: 4655745 - DNA, 22 bp, Homo sapiens
tgtgtagctgtgacctgctgag

SEQ ID NO: 4655746 - DNA, 18 bp, Homo sapiens
tgtgtagttccctctgcc

SEQ ID NO: 4655747 - DNA, 14 bp, Homo sapiens
tgtgtatttctctg

SEQ ID NO: 4655748 - DNA, 21 bp, Homo sapiens
tgtgtcagtggggctctctga

SEQ ID NO: 4655749 - DNA, 16 bp, Homo sapiens
tgtgtccacctgtggg

SEQ ID NO: 4655750 - DNA, 19 bp, Homo sapiens
tgtgtccacctgtgggtgt

SEQ ID NO: 4655751 - DNA, 15 bp, Homo sapiens
tgtgtctaggcaggc

SEQ ID NO: 4655752 - DNA, 17 bp, Homo sapiens
tgtgtctgaatcatgtc

SEQ ID NO: 4655753 - DNA, 20 bp, Homo sapiens
tgtgtctgaatcatgtctgt

SEQ ID NO: 4655754 - DNA, 14 bp, Homo sapiens
tgtgtgacaattct

SEQ ID NO: 4655755 - DNA, 20 bp, Homo sapiens
tgtgtgacaattctgttttt

SEQ ID NO: 4655756 - DNA, 14 bp, Homo sapiens
tgtgtgcacaccca

SEQ ID NO: 4655757 - DNA, 14 bp, Homo sapiens
tgtgtgcagagcag

SEQ ID NO: 4655758 - DNA, 19 bp, Homo sapiens
tgtgtgggccaccgtgcct

SEQ ID NO: 4655759 - DNA, 22 bp, Homo sapiens
tgtgtgtctaggcaggacctgt

SEQ ID NO: 4655760 - DNA, 14 bp, Homo sapiens
tgtgtgtctgtcct

SEQ ID NO: 4655761 - DNA, 13 bp, Homo sapiens
tgccagcaggaat

SEQ ID NO: 4655762 - DNA, 16 bp, Homo sapiens
tgccagcaggaataaa

SEQ ID NO: 4655763 - DNA, 15 bp, Homo sapiens
tgccaggaagggcca

SEQ ID NO: 4655764 - DNA, 13 bp, Homo sapiens
tgccaggagggac

SEQ ID NO: 4655765 - DNA, 23 bp, Homo sapiens
tgccaggagggacaaaggagcct

SEQ ID NO: 4655766 - DNA, 19 bp, Homo sapiens
tgccagtgctaaactactg

SEQ ID NO: 4655767 - DNA, 23 bp, Homo sapiens
tgccataccttctcccaggcctc

SEQ ID NO: 4655768 - DNA, 17 bp, Homo sapiens
tgccatagtcacatggc

SEQ ID NO: 4655769 - DNA, 20 bp, Homo sapiens
tgccatctcacctcctgctg

SEQ ID NO: 4655770 - DNA, 14 bp, Homo sapiens
tgccatgctgggcc

SEQ ID NO: 4655771 - DNA, 19 bp, Homo sapiens
tgccatgctgggccactgg

SEQ ID NO: 4655772 - DNA, 23 bp, Homo sapiens
tgccatgctgggccactggggac

SEQ ID NO: 4655773 - DNA, 14 bp, Homo sapiens
tgcccacaggccgc

SEQ ID NO: 4655774 - DNA, 21 bp, Homo sapiens
tgcccacaggccgccctgcgg

SEQ ID NO: 4655775 - DNA, 16 bp, Homo sapiens
tgcccaccccaccccc

SEQ ID NO: 4655776 - DNA, 17 bp, Homo sapiens
tgcccaccccaccccca

SEQ ID NO: 4655777 - DNA, 19 bp, Homo sapiens
tgcccaccccacccccacc

SEQ ID NO: 4655778 - DNA, 14 bp, Homo sapiens
tgcccactccgcca

SEQ ID NO: 4655779 - DNA, 18 bp, Homo sapiens
tgcccagcggacagtggc

SEQ ID NO: 4655780 - DNA, 19 bp, Homo sapiens
tgcccagcggacagtggca

SEQ ID NO: 4655781 - DNA, 20 bp, Homo sapiens
tgcccagcggacagtggcag

SEQ ID NO: 4655782 - DNA, 22 bp, Homo sapiens
tgcccagcggacagtggcagga

SEQ ID NO: 4655783 - DNA, 15 bp, Homo sapiens
tgcccaggcaaggaa

SEQ ID NO: 4655784 - DNA, 19 bp, Homo sapiens
tgcccaggcctatctggaa

SEQ ID NO: 4655785 - DNA, 15 bp, Homo sapiens
tgcccaggtgaggga

SEQ ID NO: 4655786 - DNA, 18 bp, Homo sapiens
tgcccaggtgagggaagg

SEQ ID NO: 4655787 - DNA, 20 bp, Homo sapiens
tgcccaggtgagggaaggag

SEQ ID NO: 4655788 - DNA, 22 bp, Homo sapiens
tgcccatcatgtggccccaccc

SEQ ID NO: 4655789 - DNA, 24 bp, Homo sapiens
tgcccatggacaggctggctccag

SEQ ID NO: 4655790 - DNA, 23 bp, Homo sapiens
tgcccatggcttctggtcatgaa

SEQ ID NO: 4655791 - DNA, 17 bp, Homo sapiens
tgcccattagagaagta

SEQ ID NO: 4655792 - DNA, 16 bp, Homo sapiens
tgccccaactccttcc

SEQ ID NO: 4655793 - DNA, 20 bp, Homo sapiens
tgccccacccctccccatta

SEQ ID NO: 4655794 - DNA, 16 bp, Homo sapiens
tgccccacgttgtccc

SEQ ID NO: 4655795 - DNA, 23 bp, Homo sapiens
tgcccccaccccatgcccccacc

SEQ ID NO: 4655796 - DNA, 14 bp, Homo sapiens
tgcccccagctggc

SEQ ID NO: 4655797 - DNA, 16 bp, Homo sapiens
tgcccccagctggccc

SEQ ID NO: 4655798 - DNA, 23 bp, Homo sapiens
tgccccccaccccaccctcccta

SEQ ID NO: 4655799 - DNA, 18 bp, Homo sapiens
tgccccccctaagagaca

SEQ ID NO: 4655800 - DNA, 13 bp, Homo sapiens
tgccccctccagg

SEQ ID NO: 4655801 - DNA, 15 bp, Homo sapiens
tgccccgtagagaat

SEQ ID NO: 4655802 - DNA, 17 bp, Homo sapiens
tgcccctaccctggact

SEQ ID NO: 4655803 - DNA, 14 bp, Homo sapiens
tgcccctctctggg

SEQ ID NO: 4655804 - DNA, 23 bp, Homo sapiens
tgcccctgtgggactcatccttg

SEQ ID NO: 4655805 - DNA, 20 bp, Homo sapiens
tgcccggtgcagggcctggc

SEQ ID NO: 4655806 - DNA, 21 bp, Homo sapiens
tgcccggtgcagggcctggca

SEQ ID NO: 4655807 - DNA, 23 bp, Homo sapiens
tgcccggtgcagggcctggcata

SEQ ID NO: 4655808 - DNA, 16 bp, Homo sapiens
tgccctaatgtctgta

SEQ ID NO: 4655809 - DNA, 12 bp, Homo sapiens
tgccctcctctc

SEQ ID NO: 4655810 - DNA, 15 bp, Homo sapiens
tgccctgagaagctg

SEQ ID NO: 4655811 - DNA, 15 bp, Homo sapiens
tgccctgcccaggta

SEQ ID NO: 4655812 - DNA, 16 bp, Homo sapiens
tgcaagcactcggggt

SEQ ID NO: 4655813 - DNA, 18 bp, Homo sapiens
tgcaaggcggtacactac

SEQ ID NO: 4655814 - DNA, 13 bp, Homo sapiens
tgcaatggatttt

SEQ ID NO: 4655815 - DNA, 19 bp, Homo sapiens
tgcaattagcctcatagtt

SEQ ID NO: 4655816 - DNA, 14 bp, Homo sapiens
tgcacaaagtggca

SEQ ID NO: 4655817 - DNA, 15 bp, Homo sapiens
tgcacaaagtggcat

SEQ ID NO: 4655818 - DNA, 12 bp, Homo sapiens
tgcacaaataca

SEQ ID NO: 4655819 - DNA, 22 bp, Homo sapiens
tgcacacacggttttggcagct

SEQ ID NO: 4655820 - DNA, 13 bp, Homo sapiens
tgcacaccaaggc

SEQ ID NO: 4655821 - DNA, 22 bp, Homo sapiens
tgcacaccaaggccctgcatct

SEQ ID NO: 4655822 - DNA, 15 bp, Homo sapiens
tgcacagacaagcag

SEQ ID NO: 4655823 - DNA, 15 bp, Homo sapiens
tgcacagctgtttga

SEQ ID NO: 4655824 - DNA, 20 bp, Homo sapiens
tgcacatacgggctttaata

SEQ ID NO: 4655825 - DNA, 23 bp, Homo sapiens
tgcacatgaatcccacccacatg

SEQ ID NO: 4655826 - DNA, 22 bp, Homo sapiens
tgcacatttgctcagaattgca

SEQ ID NO: 4655827 - DNA, 21 bp, Homo sapiens
tgcacctagaacctccctcct

SEQ ID NO: 4655828 - DNA, 20 bp, Homo sapiens
tgcacctctgttcatttcac

SEQ ID NO: 4655829 - DNA, 21 bp, Homo sapiens
tgcaccttcactctccagggt

SEQ ID NO: 4655830 - DNA, 15 bp, Homo sapiens
tgcaccttgtgtctg

SEQ ID NO: 4655831 - DNA, 21 bp, Homo sapiens
tgcactagtgcaattccaaga

SEQ ID NO: 4655832 - DNA, 17 bp, Homo sapiens
tgcactcatcatatttt

SEQ ID NO: 4655833 - DNA, 17 bp, Homo sapiens
tgcactccagcctgggg

SEQ ID NO: 4655834 - DNA, 21 bp, Homo sapiens
tgcactgatgttgtgttttta

SEQ ID NO: 4655835 - DNA, 12 bp, Homo sapiens
tgcactgtgaac

SEQ ID NO: 4655836 - DNA, 21 bp, Homo sapiens
tgcacttgattaagcttttgt

SEQ ID NO: 4655837 - DNA, 22 bp, Homo sapiens
tgcactttctcggtccactctt

SEQ ID NO: 4655838 - DNA, 14 bp, Homo sapiens
tgcagaaggaaaga

SEQ ID NO: 4655839 - DNA, 19 bp, Homo sapiens
tgcagacagaagtctcctc

SEQ ID NO: 4655840 - DNA, 21 bp, Homo sapiens
tgcagacagaagtctcctcaa

SEQ ID NO: 4655841 - DNA, 14 bp, Homo sapiens
tgcagacgcccaga

SEQ ID NO: 4655842 - DNA, 17 bp, Homo sapiens
tgcagagcagacaggct

SEQ ID NO: 4655843 - DNA, 15 bp, Homo sapiens
tgcagataaaatatt

SEQ ID NO: 4655844 - DNA, 19 bp, Homo sapiens
tgcagcaaacactccaccc

SEQ ID NO: 4655845 - DNA, 18 bp, Homo sapiens
tgcagcccctaagtgcaa

SEQ ID NO: 4655846 - DNA, 14 bp, Homo sapiens
tgcagcttgtagcc

SEQ ID NO: 4655847 - DNA, 16 bp, Homo sapiens
tgcagcttgtagccag

SEQ ID NO: 4655848 - DNA, 20 bp, Homo sapiens
tgcagcttgtagccagccgg

SEQ ID NO: 4655849 - DNA, 22 bp, Homo sapiens
tgcagcttgtagccagccgggg

SEQ ID NO: 4655850 - DNA, 19 bp, Homo sapiens
tgcaggagtgtcctgccca

SEQ ID NO: 4655851 - DNA, 14 bp, Homo sapiens
tgcaggcaggaaca

SEQ ID NO: 4655852 - DNA, 20 bp, Homo sapiens
tgcaggcaggaacaaacagg

SEQ ID NO: 4655853 - DNA, 14 bp, Homo sapiens
tgcagggcctggca

SEQ ID NO: 4655854 - DNA, 15 bp, Homo sapiens
tgcagggcctggcat

SEQ ID NO: 4655855 - DNA, 18 bp, Homo sapiens
tgcaggggatggggtggg

SEQ ID NO: 4655856 - DNA, 22 bp, Homo sapiens
tgcaggtatttcagaaggagaa

SEQ ID NO: 4655857 - DNA, 15 bp, Homo sapiens
tgcaggtcagcccat

SEQ ID NO: 4655858 - DNA, 22 bp, Homo sapiens
tgcaggtcagcccatggaggca

SEQ ID NO: 4655859 - DNA, 23 bp, Homo sapiens
tgcaggtcagcccatggaggcag

SEQ ID NO: 4655860 - DNA, 13 bp, Homo sapiens
tgcagtctgggtg

SEQ ID NO: 4655861 - DNA, 16 bp, Homo sapiens
tgcagtctttccccca

SEQ ID NO: 4655862 - DNA, 20 bp, Homo sapiens
tgcagtctttcccccaggaa

SEQ ID NO: 4655863 - DNA, 23 bp, Homo sapiens
tgcagtggtgcgatctcggctca

SEQ ID NO: 4655864 - DNA, 12 bp, Homo sapiens
tgcagtttcttt

SEQ ID NO: 4655865 - DNA, 17 bp, Homo sapiens
tgcagtttcttttcaca

SEQ ID NO: 4655866 - DNA, 20 bp, Homo sapiens
tgagggggggctccctgggg

SEQ ID NO: 4655867 - DNA, 11 bp, Homo sapiens
tgaggggtctc

SEQ ID NO: 4655868 - DNA, 15 bp, Homo sapiens
tgaggggtctcggat

SEQ ID NO: 4655869 - DNA, 16 bp, Homo sapiens
tgaggggtctcggatg

SEQ ID NO: 4655870 - DNA, 20 bp, Homo sapiens
tgagggtcattctttattct

SEQ ID NO: 4655871 - DNA, 13 bp, Homo sapiens
tgaggtcaccagg

SEQ ID NO: 4655872 - DNA, 12 bp, Homo sapiens
tgaggtcaggga

SEQ ID NO: 4655873 - DNA, 23 bp, Homo sapiens
tgaggtgacactccagttgcaga

SEQ ID NO: 4655874 - DNA, 13 bp, Homo sapiens
tgaggtgcccagg

SEQ ID NO: 4655875 - DNA, 17 bp, Homo sapiens
tgaggtgcccaggagaa

SEQ ID NO: 4655876 - DNA, 16 bp, Homo sapiens
tgaggtttttaaatat

SEQ ID NO: 4655877 - DNA, 14 bp, Homo sapiens
tgagtaagaacatc

SEQ ID NO: 4655878 - DNA, 21 bp, Homo sapiens
tgagtacaaatgccttaaaat

SEQ ID NO: 4655879 - DNA, 19 bp, Homo sapiens
tgagtagctgggattacag

SEQ ID NO: 4655880 - DNA, 22 bp, Homo sapiens
tgagtatgccactgcactccag

SEQ ID NO: 4655881 - DNA, 16 bp, Homo sapiens
tgagtatttttaaaaa

SEQ ID NO: 4655882 - DNA, 14 bp, Homo sapiens
tgagtcagtgaagt

SEQ ID NO: 4655883 - DNA, 13 bp, Homo sapiens
tgagtcctggccc

SEQ ID NO: 4655884 - DNA, 14 bp, Homo sapiens
tgagtctatgttca

SEQ ID NO: 4655885 - DNA, 14 bp, Homo sapiens
tgagtctgtttccc

SEQ ID NO: 4655886 - DNA, 17 bp, Homo sapiens
tgagtctgttttgtaaa

SEQ ID NO: 4655887 - DNA, 17 bp, Homo sapiens
tgagttggggtctggca

SEQ ID NO: 4655888 - DNA, 15 bp, Homo sapiens
tgataaaagttttga

SEQ ID NO: 4655889 - DNA, 14 bp, Homo sapiens
tgataaaatagcca

SEQ ID NO: 4655890 - DNA, 16 bp, Homo sapiens
tgataaaatgttgaac

SEQ ID NO: 4655891 - DNA, 16 bp, Homo sapiens
tgataacagaactttt

SEQ ID NO: 4655892 - DNA, 22 bp, Homo sapiens
tgatacagttttgagtaaaaag

SEQ ID NO: 4655893 - DNA, 16 bp, Homo sapiens
tgatacatccaaagca

SEQ ID NO: 4655894 - DNA, 16 bp, Homo sapiens
tgatcaagatatatgt

SEQ ID NO: 4655895 - DNA, 16 bp, Homo sapiens
tgatcaatatttttat

SEQ ID NO: 4655896 - DNA, 13 bp, Homo sapiens
tgatcaggcccca

SEQ ID NO: 4655897 - DNA, 17 bp, Homo sapiens
tgatcatgtacttttta

SEQ ID NO: 4655898 - DNA, 19 bp, Homo sapiens
tgatcatgtactttttagt

SEQ ID NO: 4655899 - DNA, 18 bp, Homo sapiens
tgatccgcccacctcagc

SEQ ID NO: 4655900 - DNA, 20 bp, Homo sapiens
tgatccgcccacctcagcct

SEQ ID NO: 4655901 - DNA, 22 bp, Homo sapiens
tgatccgcccacctcagcctcc

SEQ ID NO: 4655902 - DNA, 13 bp, Homo sapiens
tgatcctcagtgc

SEQ ID NO: 4655903 - DNA, 14 bp, Homo sapiens
tgatcctctcacct

SEQ ID NO: 4655904 - DNA, 17 bp, Homo sapiens
tgatccttttttgtcat

SEQ ID NO: 4655905 - DNA, 18 bp, Homo sapiens
tgatccttttttgtcatt

SEQ ID NO: 4655906 - DNA, 19 bp, Homo sapiens
tgatccttttttgtcattt

SEQ ID NO: 4655907 - DNA, 13 bp, Homo sapiens
tgatcgctgtatt

SEQ ID NO: 4655908 - DNA, 13 bp, Homo sapiens
tgatctagataca

SEQ ID NO: 4655909 - DNA, 16 bp, Homo sapiens
tgatctcaaactatga

SEQ ID NO: 4655910 - DNA, 18 bp, Homo sapiens
tgatgacaaaaaatgttt

SEQ ID NO: 4655911 - DNA, 19 bp, Homo sapiens
tgatgagctgtgcacaaag

SEQ ID NO: 4655912 - DNA, 13 bp, Homo sapiens
tgatgagggcagc

SEQ ID NO: 4655913 - DNA, 17 bp, Homo sapiens
tgatgagggcagcagcc

SEQ ID NO: 4655914 - DNA, 22 bp, Homo sapiens
tgatgagggcagcagccagccc

SEQ ID NO: 4655915 - DNA, 13 bp, Homo sapiens
tgatgaggtattt

SEQ ID NO: 4655916 - DNA, 19 bp, Homo sapiens
tgatgaggtattttttcct

SEQ ID NO: 4655917 - DNA, 20 bp, Homo sapiens
tgatgagtaaactgaggccc

SEQ ID NO: 4655918 - DNA, 21 bp, Homo sapiens
tgatgagtaaactgaggccca

SEQ ID NO: 4655919 - DNA, 16 bp, Homo sapiens
tgatggaggggagagg

SEQ ID NO: 4655920 - DNA, 21 bp, Homo sapiens
tgatggaggggagaggggtca

SEQ ID NO: 4655921 - DNA, 21 bp, Homo sapiens
tgatggcaacagaaaccaaga

SEQ ID NO: 4655922 - DNA, 12 bp, Homo sapiens
tgatggcagagg

SEQ ID NO: 4655923 - DNA, 18 bp, Homo sapiens
tgatggtcaatcagtgtt

SEQ ID NO: 4655924 - DNA, 22 bp, Homo sapiens
tgacaagctggccaaagtcact

SEQ ID NO: 4655925 - DNA, 18 bp, Homo sapiens
tgacaatccgagcagtgg

SEQ ID NO: 4655926 - DNA, 15 bp, Homo sapiens
tgacacatatgaaca

SEQ ID NO: 4655927 - DNA, 15 bp, Homo sapiens
tgacaccctggcctg

SEQ ID NO: 4655928 - DNA, 19 bp, Homo sapiens
tgacagactcaagagaaac

SEQ ID NO: 4655929 - DNA, 20 bp, Homo sapiens
tgacaggcagcctggacata

SEQ ID NO: 4655930 - DNA, 18 bp, Homo sapiens
tgacagggccagtggggc

SEQ ID NO: 4655931 - DNA, 20 bp, Homo sapiens
tgacagggccagtggggcct

SEQ ID NO: 4655932 - DNA, 22 bp, Homo sapiens
tgacagggccagtggggcctgt

SEQ ID NO: 4655933 - DNA, 23 bp, Homo sapiens
tgacagggccagtggggcctgtg

SEQ ID NO: 4655934 - DNA, 19 bp, Homo sapiens
tgacagtagctcttagact

SEQ ID NO: 4655935 - DNA, 14 bp, Homo sapiens
tgacagtcatcatc

SEQ ID NO: 4655936 - DNA, 22 bp, Homo sapiens
tgacagtcatcatcagggcctg

SEQ ID NO: 4655937 - DNA, 20 bp, Homo sapiens
tgacataaccaatttgtaat

SEQ ID NO: 4655938 - DNA, 17 bp, Homo sapiens
tgacatgtagcttcttc

SEQ ID NO: 4655939 - DNA, 18 bp, Homo sapiens
tgacattcacctgcccca

SEQ ID NO: 4655940 - DNA, 12 bp, Homo sapiens
tgacattgtctc

SEQ ID NO: 4655941 - DNA, 17 bp, Homo sapiens
tgaccaatattgtacag

SEQ ID NO: 4655942 - DNA, 18 bp, Homo sapiens
tgaccaatattgtacagt

SEQ ID NO: 4655943 - DNA, 16 bp, Homo sapiens
tgaccacagcacagcc

SEQ ID NO: 4655944 - DNA, 21 bp, Homo sapiens
tgaccacatagcatgaggcca

SEQ ID NO: 4655945 - DNA, 22 bp, Homo sapiens
tgaccacccctctcgcctcatt

SEQ ID NO: 4655946 - DNA, 23 bp, Homo sapiens
tgaccacccctctcgcctcatta

SEQ ID NO: 4655947 - DNA, 20 bp, Homo sapiens
tgaccaggatggagcaagct

SEQ ID NO: 4655948 - DNA, 20 bp, Homo sapiens
tgaccagggatgctgggctg

SEQ ID NO: 4655949 - DNA, 23 bp, Homo sapiens
tgaccagggatgctgggctgggc

SEQ ID NO: 4655950 - DNA, 15 bp, Homo sapiens
tgaccagtctgaccc

SEQ ID NO: 4655951 - DNA, 14 bp, Homo sapiens
tgacccacatgcca

SEQ ID NO: 4655952 - DNA, 16 bp, Homo sapiens
tgacccagagccacca

SEQ ID NO: 4655953 - DNA, 13 bp, Homo sapiens
tgaccccagggca

SEQ ID NO: 4655954 - DNA, 18 bp, Homo sapiens
tgacccctggccacagcc

SEQ ID NO: 4655955 - DNA, 21 bp, Homo sapiens
tgacccctggccacagccttc

SEQ ID NO: 4655956 - DNA, 21 bp, Homo sapiens
tgaccctatgggtctaggaca

SEQ ID NO: 4655957 - DNA, 13 bp, Homo sapiens
tgaccggtgcttt

SEQ ID NO: 4655958 - DNA, 15 bp, Homo sapiens
tgaccggtgctttta

SEQ ID NO: 4655959 - DNA, 13 bp, Homo sapiens
tgacctccagctt

SEQ ID NO: 4655960 - DNA, 20 bp, Homo sapiens
tgacctccttctgcaaagtg

SEQ ID NO: 4655961 - DNA, 12 bp, Homo sapiens
tgacctgctgag

SEQ ID NO: 4655962 - DNA, 14 bp, Homo sapiens
tgacctgctgagct

SEQ ID NO: 4655963 - DNA, 15 bp, Homo sapiens
tgacctgctgagctc

SEQ ID NO: 4655964 - DNA, 14 bp, Homo sapiens
tgacctggagggga

SEQ ID NO: 4655965 - DNA, 17 bp, Homo sapiens
tgaccttgatgagctgt

SEQ ID NO: 4655966 - DNA, 18 bp, Homo sapiens
tgaccttgatgagctgtg

SEQ ID NO: 4655967 - DNA, 19 bp, Homo sapiens
tgaccttgatgagctgtgc

SEQ ID NO: 4655968 - DNA, 20 bp, Homo sapiens
tgacggccctcatctatgag

SEQ ID NO: 4655969 - DNA, 17 bp, Homo sapiens
tgacggtgcagtctggg

SEQ ID NO: 4655970 - DNA, 18 bp, Homo sapiens
tgacggtgcagtctgggt

SEQ ID NO: 4655971 - DNA, 20 bp, Homo sapiens
tgacgtgtaaatgctggtat

SEQ ID NO: 4655972 - DNA, 21 bp, Homo sapiens
tgactagtagatttctatgat

SEQ ID NO: 4655973 - DNA, 14 bp, Homo sapiens
tgactatcataaaa

SEQ ID NO: 4655974 - DNA, 18 bp, Homo sapiens
tgactcctcagtccctct

SEQ ID NO: 4655975 - DNA, 17 bp, Homo sapiens
tgactcctgctggtacc

SEQ ID NO: 4655976 - DNA, 14 bp, Homo sapiens
tgactcctttccaa

SEQ ID NO: 4655977 - DNA, 14 bp, Homo sapiens
tgactctccaggga

SEQ ID NO: 4655978 - DNA, 22 bp, Homo sapiens
tgactcttgaataaaaataact

SEQ ID NO: 4655979 - DNA, 21 bp, Homo sapiens
tgactgaagcgaacatcttca

SEQ ID NO: 4655980 - DNA, 23 bp, Homo sapiens
tgactgaagcgaacatcttcata

SEQ ID NO: 4655981 - DNA, 15 bp, Homo sapiens
tgactgaaggaaaag

SEQ ID NO: 4655982 - DNA, 12 bp, Homo sapiens
tgactgaatgca

SEQ ID NO: 4655983 - DNA, 14 bp, Homo sapiens
tgactgccaagcca

SEQ ID NO: 4655984 - DNA, 14 bp, Homo sapiens
tgactgccccctcc

SEQ ID NO: 4655985 - DNA, 17 bp, Homo sapiens
tgactgggtgagaccca

SEQ ID NO: 4655986 - DNA, 16 bp, Homo sapiens
tgactgtatggcactc

SEQ ID NO: 4655987 - DNA, 19 bp, Homo sapiens
tgactgtcacttgctgctt

SEQ ID NO: 4655988 - DNA, 19 bp, Homo sapiens
tgactgtcgccacacgcct

SEQ ID NO: 4655989 - DNA, 22 bp, Homo sapiens
tgactgttgagggcctggggaa

SEQ ID NO: 4655990 - DNA, 13 bp, Homo sapiens
tgacttagaaact

SEQ ID NO: 4655991 - DNA, 18 bp, Homo sapiens
tgacttctgctgctggcc

SEQ ID NO: 4655992 - DNA, 17 bp, Homo sapiens
tgacttgggcaccccca

SEQ ID NO: 4655993 - DNA, 19 bp, Homo sapiens
tgacttgggcacccccagc

SEQ ID NO: 4655994 - DNA, 19 bp, Homo sapiens
tgacttggggagatggagt

SEQ ID NO: 4655995 - DNA, 19 bp, Homo sapiens
tgacttggttctgaagcca

SEQ ID NO: 4655996 - DNA, 22 bp, Homo sapiens
tgacttggttctgaagccatgt

SEQ ID NO: 4655997 - DNA, 22 bp, Homo sapiens
tgacttgtctgcctcctgcttt

SEQ ID NO: 4655998 - DNA, 13 bp, Homo sapiens
tgactttttataa

SEQ ID NO: 4655999 - DNA, 19 bp, Homo sapiens
tgactttttataaaatggc

SEQ ID NO: 4656000 - DNA, 22 bp, Homo sapiens
tgagaaaaatagagcaaaatca

SEQ ID NO: 4656001 - DNA, 23 bp, Homo sapiens
tgagaaacagctcagccagtggg

SEQ ID NO: 4656002 - DNA, 14 bp, Homo sapiens
tgagaacctggcct

SEQ ID NO: 4656003 - DNA, 17 bp, Homo sapiens
tgagaagatcattgcca

SEQ ID NO: 4656004 - DNA, 22 bp, Homo sapiens
tgagaagatcattggagtttag

SEQ ID NO: 4656005 - DNA, 15 bp, Homo sapiens
tgagaagctgctcca

SEQ ID NO: 4656006 - DNA, 13 bp, Homo sapiens
tgagacagaatct

SEQ ID NO: 4656007 - DNA, 14 bp, Homo sapiens
tgagacagaatctc

SEQ ID NO: 4656008 - DNA, 21 bp, Homo sapiens
tgagaccacagagagagggga

SEQ ID NO: 4656009 - DNA, 17 bp, Homo sapiens
tgagacccagccccttc

SEQ ID NO: 4656010 - DNA, 19 bp, Homo sapiens
tgagacccagccccttccc

SEQ ID NO: 4656011 - DNA, 20 bp, Homo sapiens
tgagacccagccccttcccc

SEQ ID NO: 4656012 - DNA, 20 bp, Homo sapiens
tgagaccccagtgcctgcac

SEQ ID NO: 4656013 - DNA, 15 bp, Homo sapiens
tgagactgccctgcc

SEQ ID NO: 4656014 - DNA, 14 bp, Homo sapiens
tgagactgtcctgt

SEQ ID NO: 4656015 - DNA, 20 bp, Homo sapiens
tgagactttccgactgcttt

SEQ ID NO: 4656016 - DNA, 16 bp, Homo sapiens
tgagagaaagagagaa

SEQ ID NO: 4656017 - DNA, 19 bp, Homo sapiens
tgagagaaagagagaagcc

SEQ ID NO: 4656018 - DNA, 23 bp, Homo sapiens
tgagagaaagagagaagccagcc

SEQ ID NO: 4656019 - DNA, 14 bp, Homo sapiens
tgagagaattggct

SEQ ID NO: 4656020 - DNA, 17 bp, Homo sapiens
tgagagacctctgccta

SEQ ID NO: 4656021 - DNA, 15 bp, Homo sapiens
tgagagagagagtgt

SEQ ID NO: 4656022 - DNA, 15 bp, Homo sapiens
tgagagcgacacaga

SEQ ID NO: 4656023 - DNA, 12 bp, Homo sapiens
tgagaggccccc

SEQ ID NO: 4656024 - DNA, 16 bp, Homo sapiens
tgagaggcccccaccc

SEQ ID NO: 4656025 - DNA, 17 bp, Homo sapiens
tgagagggccgggcaga

SEQ ID NO: 4656026 - DNA, 15 bp, Homo sapiens
tgagatcagggcctg

SEQ ID NO: 4656027 - DNA, 18 bp, Homo sapiens
tgagatcagggcctgccc

SEQ ID NO: 4656028 - DNA, 22 bp, Homo sapiens
tgagatcagggcctgccccctg

SEQ ID NO: 4656029 - DNA, 16 bp, Homo sapiens
tgagatctaatgtgaa

SEQ ID NO: 4656030 - DNA, 13 bp, Homo sapiens
tgagatctgggga

SEQ ID NO: 4656031 - DNA, 14 bp, Homo sapiens
tgagattgtactgt

SEQ ID NO: 4656032 - DNA, 17 bp, Homo sapiens
tctttgtttacatgagt

SEQ ID NO: 4656033 - DNA, 18 bp, Homo sapiens
tcttttaatggcatttct

SEQ ID NO: 4656034 - DNA, 13 bp, Homo sapiens
tcttttacagact

SEQ ID NO: 4656035 - DNA, 12 bp, Homo sapiens
tcttttatctgt

SEQ ID NO: 4656036 - DNA, 15 bp, Homo sapiens
tcttttatctgttta

SEQ ID NO: 4656037 - DNA, 21 bp, Homo sapiens
tcttttatctgtttaaagcat

SEQ ID NO: 4656038 - DNA, 18 bp, Homo sapiens
tcttttatttaacaaaaa

SEQ ID NO: 4656039 - DNA, 18 bp, Homo sapiens
tcttttcatctgggaaag

SEQ ID NO: 4656040 - DNA, 20 bp, Homo sapiens
tcttttggggaagtgaggaa

SEQ ID NO: 4656041 - DNA, 15 bp, Homo sapiens
tctttttgttgtaaa

SEQ ID NO: 4656042 - DNA, 22 bp, Homo sapiens
tcttttttgtttgtttctttgt

SEQ ID NO: 4656043 - DNA, 22 bp, Homo sapiens
tgaaaaagctgcttcttattaa

SEQ ID NO: 4656044 - DNA, 17 bp, Homo sapiens
tgaaaaattaacttttt

SEQ ID NO: 4656045 - DNA, 13 bp, Homo sapiens
tgaaaacatctgg

SEQ ID NO: 4656046 - DNA, 16 bp, Homo sapiens
tgaaaagatgttgtgt

SEQ ID NO: 4656047 - DNA, 19 bp, Homo sapiens
tgaaaagggcactcccaac

SEQ ID NO: 4656048 - DNA, 22 bp, Homo sapiens
tgaaaatatagacattctcaca

SEQ ID NO: 4656049 - DNA, 23 bp, Homo sapiens
tgaaaatatagacattctcacat

SEQ ID NO: 4656050 - DNA, 15 bp, Homo sapiens
tgaaaatgaaagtgt

SEQ ID NO: 4656051 - DNA, 20 bp, Homo sapiens
tgaaacaaagtactctttaa

SEQ ID NO: 4656052 - DNA, 22 bp, Homo sapiens
tgaaacaaagtactctttaaca

SEQ ID NO: 4656053 - DNA, 17 bp, Homo sapiens
tgaaacagttgctgtga

SEQ ID NO: 4656054 - DNA, 19 bp, Homo sapiens
tgaaacctgttaaaacaac

SEQ ID NO: 4656055 - DNA, 18 bp, Homo sapiens
tgaaactcatagacactg

SEQ ID NO: 4656056 - DNA, 16 bp, Homo sapiens
tgaaagaaagggaccc

SEQ ID NO: 4656057 - DNA, 14 bp, Homo sapiens
tgaaagaacataca

SEQ ID NO: 4656058 - DNA, 15 bp, Homo sapiens
tgaaagaagcaagac

SEQ ID NO: 4656059 - DNA, 17 bp, Homo sapiens
tgaaaggccaacagcaa

SEQ ID NO: 4656060 - DNA, 14 bp, Homo sapiens
tgaaagtgttaatt

SEQ ID NO: 4656061 - DNA, 15 bp, Homo sapiens
tgaaataaattctga

SEQ ID NO: 4656062 - DNA, 23 bp, Homo sapiens
tgaaataaattctgacttatgaa

SEQ ID NO: 4656063 - DNA, 16 bp, Homo sapiens
tgaaataacaaaatgg

SEQ ID NO: 4656064 - DNA, 17 bp, Homo sapiens
tgaaataacaaaatgga

SEQ ID NO: 4656065 - DNA, 21 bp, Homo sapiens
tgaaataccaacctgaagaca

SEQ ID NO: 4656066 - DNA, 24 bp, Homo sapiens
tgaaatacctattaattcttaata

SEQ ID NO: 4656067 - DNA, 23 bp, Homo sapiens
tgaaatagttattttaatacctt

SEQ ID NO: 4656068 - DNA, 14 bp, Homo sapiens
tgaaatattcagaa

SEQ ID NO: 4656069 - DNA, 17 bp, Homo sapiens
tgaaatattcagaaatt

SEQ ID NO: 4656070 - DNA, 13 bp, Homo sapiens
tgaaatctgtctt

SEQ ID NO: 4656071 - DNA, 14 bp, Homo sapiens
tgaaatggcattta

SEQ ID NO: 4656072 - DNA, 13 bp, Homo sapiens
tgaaatgttctta

SEQ ID NO: 4656073 - DNA, 19 bp, Homo sapiens
tgaaatgtttaataaagct

SEQ ID NO: 4656074 - DNA, 13 bp, Homo sapiens
tgaaattaacaca

SEQ ID NO: 4656075 - DNA, 15 bp, Homo sapiens
tgaacaaagcagcca

SEQ ID NO: 4656076 - DNA, 17 bp, Homo sapiens
tgaacaaagcagccacg

SEQ ID NO: 4656077 - DNA, 23 bp, Homo sapiens
tctgttgcctcctctctccctgc

SEQ ID NO: 4656078 - DNA, 18 bp, Homo sapiens
tctgtttacatccagagt

SEQ ID NO: 4656079 - DNA, 16 bp, Homo sapiens
tctgtttcctgacatt

SEQ ID NO: 4656080 - DNA, 15 bp, Homo sapiens
tctgtttcctggcct

SEQ ID NO: 4656081 - DNA, 20 bp, Homo sapiens
tctgtttcctggcctcagag

SEQ ID NO: 4656082 - DNA, 21 bp, Homo sapiens
tctgtttcctggcctcagagc

SEQ ID NO: 4656083 - DNA, 22 bp, Homo sapiens
tctgtttcctggcctcagagct

SEQ ID NO: 4656084 - DNA, 13 bp, Homo sapiens
tctgtttgaaact

SEQ ID NO: 4656085 - DNA, 18 bp, Homo sapiens
tctgttttgtatcttaaa

SEQ ID NO: 4656086 - DNA, 20 bp, Homo sapiens
tcttaaaactttattaaaag

SEQ ID NO: 4656087 - DNA, 16 bp, Homo sapiens
tcttaaatctaaacaa

SEQ ID NO: 4656088 - DNA, 17 bp, Homo sapiens
tcttaaatctaaacaaa

SEQ ID NO: 4656089 - DNA, 19 bp, Homo sapiens
tcttaacaagttagaaaat

SEQ ID NO: 4656090 - DNA, 22 bp, Homo sapiens
tcttaactggcctaaatttctt

SEQ ID NO: 4656091 - DNA, 17 bp, Homo sapiens
tcttaatatatacattt

SEQ ID NO: 4656092 - DNA, 19 bp, Homo sapiens
tcttaatatatacattttt

SEQ ID NO: 4656093 - DNA, 11 bp, Homo sapiens
tcttaatcttt

SEQ ID NO: 4656094 - DNA, 19 bp, Homo sapiens
tcttacagtgtttggacag

SEQ ID NO: 4656095 - DNA, 22 bp, Homo sapiens
tcttaccctgtacatatgtaaa

SEQ ID NO: 4656096 - DNA, 15 bp, Homo sapiens
tcttactaatgtaaa

SEQ ID NO: 4656097 - DNA, 21 bp, Homo sapiens
tcttactaatgtaaaatgatt

SEQ ID NO: 4656098 - DNA, 22 bp, Homo sapiens
tcttacttttcctggacttaaa

SEQ ID NO: 4656099 - DNA, 12 bp, Homo sapiens
tcttagctttac

SEQ ID NO: 4656100 - DNA, 15 bp, Homo sapiens
tcttagctttacatt

SEQ ID NO: 4656101 - DNA, 23 bp, Homo sapiens
tcttagggcacatgaaaaatttt

SEQ ID NO: 4656102 - DNA, 19 bp, Homo sapiens
tcttaggtcttcctgtggc

SEQ ID NO: 4656103 - DNA, 21 bp, Homo sapiens
tcttaggtcttcctgtggctc

SEQ ID NO: 4656104 - DNA, 13 bp, Homo sapiens
tcttagtgaatgg

SEQ ID NO: 4656105 - DNA, 13 bp, Homo sapiens
tcttataaaatca

SEQ ID NO: 4656106 - DNA, 15 bp, Homo sapiens
tcttatgtgaaaaat

SEQ ID NO: 4656107 - DNA, 17 bp, Homo sapiens
tcttatgtgaaaaatta

SEQ ID NO: 4656108 - DNA, 16 bp, Homo sapiens
tcttcaccctcccctt

SEQ ID NO: 4656109 - DNA, 17 bp, Homo sapiens
tcttcacctcttccact

SEQ ID NO: 4656110 - DNA, 18 bp, Homo sapiens
tcttcacctcttccactc

SEQ ID NO: 4656111 - DNA, 16 bp, Homo sapiens
tcttcagcgtaaaatg

SEQ ID NO: 4656112 - DNA, 20 bp, Homo sapiens
tcttcagtgactcctgctgg

SEQ ID NO: 4656113 - DNA, 21 bp, Homo sapiens
tcttcagtgactcctgctggt

SEQ ID NO: 4656114 - DNA, 21 bp, Homo sapiens
tcttcatggcatcttcaatat

SEQ ID NO: 4656115 - DNA, 22 bp, Homo sapiens
tcttcatggcatcttcaatatg

SEQ ID NO: 4656116 - DNA, 16 bp, Homo sapiens
tcttcctaatcgctaa

SEQ ID NO: 4656117 - DNA, 11 bp, Homo sapiens
tcttcctgccc

SEQ ID NO: 4656118 - DNA, 14 bp, Homo sapiens
tcttccttgagggg

SEQ ID NO: 4656119 - DNA, 22 bp, Homo sapiens
tctgaagccatgtagccaccca

SEQ ID NO: 4656120 - DNA, 19 bp, Homo sapiens
tctgaagcccaaagcctga

SEQ ID NO: 4656121 - DNA, 21 bp, Homo sapiens
tctgaagctgacgaacttcca

SEQ ID NO: 4656122 - DNA, 13 bp, Homo sapiens
tctgaagggaccc

SEQ ID NO: 4656123 - DNA, 17 bp, Homo sapiens
tctgaatcatgtctgta

SEQ ID NO: 4656124 - DNA, 16 bp, Homo sapiens
tctgaatgtttgtgtc

SEQ ID NO: 4656125 - DNA, 18 bp, Homo sapiens
tctgaatgtttgtgtctg

SEQ ID NO: 4656126 - DNA, 23 bp, Homo sapiens
tctgaatgtttgtgtctgtggtt

SEQ ID NO: 4656127 - DNA, 22 bp, Homo sapiens
tctgacaagctggccaaagtca

SEQ ID NO: 4656128 - DNA, 16 bp, Homo sapiens
tctgacagtagctctt

SEQ ID NO: 4656129 - DNA, 21 bp, Homo sapiens
tctgaccccagtggaaaacaa

SEQ ID NO: 4656130 - DNA, 17 bp, Homo sapiens
tctgactgccccctcct

SEQ ID NO: 4656131 - DNA, 16 bp, Homo sapiens
tctgagaagctctgaa

SEQ ID NO: 4656132 - DNA, 16 bp, Homo sapiens
tctgagatgctcactt

SEQ ID NO: 4656133 - DNA, 15 bp, Homo sapiens
tctgagccaaccttg

SEQ ID NO: 4656134 - DNA, 12 bp, Homo sapiens
tctgaggccagc

SEQ ID NO: 4656135 - DNA, 18 bp, Homo sapiens
tctgaggtcctgagcact

SEQ ID NO: 4656136 - DNA, 20 bp, Homo sapiens
tctgagtctatgttcaaaga

SEQ ID NO: 4656137 - DNA, 22 bp, Homo sapiens
tctgagtggcttcactcctgct

SEQ ID NO: 4656138 - DNA, 18 bp, Homo sapiens
tctgatagctgtttcaaa

SEQ ID NO: 4656139 - DNA, 12 bp, Homo sapiens
tctgatgtttat

SEQ ID NO: 4656140 - DNA, 14 bp, Homo sapiens
tctgattaagcatt

SEQ ID NO: 4656141 - DNA, 15 bp, Homo sapiens
tctgattaagcattc

SEQ ID NO: 4656142 - DNA, 17 bp, Homo sapiens
tctgattttgaggttta

SEQ ID NO: 4656143 - DNA, 15 bp, Homo sapiens
tctgcaaagtggcag

SEQ ID NO: 4656144 - DNA, 22 bp, Homo sapiens
tctgcacaccctccagagacaa

SEQ ID NO: 4656145 - DNA, 20 bp, Homo sapiens
tctgcacactctcttctcca

SEQ ID NO: 4656146 - DNA, 19 bp, Homo sapiens
tctgcacagacaagcagcc

SEQ ID NO: 4656147 - DNA, 21 bp, Homo sapiens
tctgcacagacaagcagccct

SEQ ID NO: 4656148 - DNA, 12 bp, Homo sapiens
tctgcacatgaa

SEQ ID NO: 4656149 - DNA, 20 bp, Homo sapiens
tctgcacatgtcttgtacat

SEQ ID NO: 4656150 - DNA, 21 bp, Homo sapiens
tctgcacatgtcttgtacatg

SEQ ID NO: 4656151 - DNA, 22 bp, Homo sapiens
tctgcacatgtcttgtacatgt

SEQ ID NO: 4656152 - DNA, 21 bp, Homo sapiens
tctgcaggttcttcttcctga

SEQ ID NO: 4656153 - DNA, 17 bp, Homo sapiens
tctgcatcttggggaca

SEQ ID NO: 4656154 - DNA, 14 bp, Homo sapiens
tctgcatgagctga

SEQ ID NO: 4656155 - DNA, 12 bp, Homo sapiens
tctgcatgtttg

SEQ ID NO: 4656156 - DNA, 16 bp, Homo sapiens
tctgcattcattttta

SEQ ID NO: 4656157 - DNA, 13 bp, Homo sapiens
tctgccagacctg

SEQ ID NO: 4656158 - DNA, 13 bp, Homo sapiens
tctcaaacctcca

SEQ ID NO: 4656159 - DNA, 17 bp, Homo sapiens
tctcaaagtataatctt

SEQ ID NO: 4656160 - DNA, 20 bp, Homo sapiens
tctcaacatactgtaatcaa

SEQ ID NO: 4656161 - DNA, 14 bp, Homo sapiens
tctcaactgtccca

SEQ ID NO: 4656162 - DNA, 18 bp, Homo sapiens
tctcacaggctgagaact

SEQ ID NO: 4656163 - DNA, 19 bp, Homo sapiens
tctcacaggctgagaactc

SEQ ID NO: 4656164 - DNA, 12 bp, Homo sapiens
tctcacctcagc

SEQ ID NO: 4656165 - DNA, 20 bp, Homo sapiens
tctcactctaggagttcagt

SEQ ID NO: 4656166 - DNA, 12 bp, Homo sapiens
tctcactcttgt

SEQ ID NO: 4656167 - DNA, 18 bp, Homo sapiens
tctcactcttgtcaccca

SEQ ID NO: 4656168 - DNA, 13 bp, Homo sapiens
tctcactgtgtcc

SEQ ID NO: 4656169 - DNA, 15 bp, Homo sapiens
tctcactgtttgttt

SEQ ID NO: 4656170 - DNA, 22 bp, Homo sapiens
tctcagactttggaaaatgcat

SEQ ID NO: 4656171 - DNA, 18 bp, Homo sapiens
tctcaggacacaggcctg

SEQ ID NO: 4656172 - DNA, 22 bp, Homo sapiens
tctcaggagatggagggcttgg

SEQ ID NO: 4656173 - DNA, 19 bp, Homo sapiens
tctcaggtaatcattttaa

SEQ ID NO: 4656174 - DNA, 15 bp, Homo sapiens
tctcagtttctgcct

SEQ ID NO: 4656175 - DNA, 16 bp, Homo sapiens
tctcagtttctgcctg

SEQ ID NO: 4656176 - DNA, 18 bp, Homo sapiens
tctcagtttctgcctggg

SEQ ID NO: 4656177 - DNA, 19 bp, Homo sapiens
tctcagtttctgcctgggc

SEQ ID NO: 4656178 - DNA, 14 bp, Homo sapiens
tctcatgtcaatga

SEQ ID NO: 4656179 - DNA, 18 bp, Homo sapiens
tctcatgttttccattgt

SEQ ID NO: 4656180 - DNA, 14 bp, Homo sapiens
tctcatttccagct

SEQ ID NO: 4656181 - DNA, 16 bp, Homo sapiens
tctcatttccagcttc

SEQ ID NO: 4656182 - DNA, 16 bp, Homo sapiens
tctccaaactgattaa

SEQ ID NO: 4656183 - DNA, 21 bp, Homo sapiens
tctccaggattttaatttcag

SEQ ID NO: 4656184 - DNA, 12 bp, Homo sapiens
tctccaggggcc

SEQ ID NO: 4656185 - DNA, 20 bp, Homo sapiens
tctccataaccccacccttg

SEQ ID NO: 4656186 - DNA, 16 bp, Homo sapiens
tctccatttaagacac

SEQ ID NO: 4656187 - DNA, 17 bp, Homo sapiens
tctcccacatgaggcca

SEQ ID NO: 4656188 - DNA, 22 bp, Homo sapiens
tctcccacatgaggccatctca

SEQ ID NO: 4656189 - DNA, 12 bp, Homo sapiens
tctcccaggccc

SEQ ID NO: 4656190 - DNA, 17 bp, Homo sapiens
tctcccaggccccatga

SEQ ID NO: 4656191 - DNA, 21 bp, Homo sapiens
tctcccaggccccatgacctc

SEQ ID NO: 4656192 - DNA, 16 bp, Homo sapiens
tctcccaggcctctgc

SEQ ID NO: 4656193 - DNA, 22 bp, Homo sapiens
tctcccccttgccctcattctt

SEQ ID NO: 4656194 - DNA, 23 bp, Homo sapiens
tcctggcctcagagcttcctggg

SEQ ID NO: 4656195 - DNA, 21 bp, Homo sapiens
tcctggcttcccatccccagc

SEQ ID NO: 4656196 - DNA, 24 bp, Homo sapiens
tcctgggaaagggagatgtcagga

SEQ ID NO: 4656197 - DNA, 16 bp, Homo sapiens
tcctggggaccaagat

SEQ ID NO: 4656198 - DNA, 17 bp, Homo sapiens
tcctggggcagcactcc

SEQ ID NO: 4656199 - DNA, 14 bp, Homo sapiens
tcctgggggaagag

SEQ ID NO: 4656200 - DNA, 19 bp, Homo sapiens
tcctgggggaagaggagat

SEQ ID NO: 4656201 - DNA, 15 bp, Homo sapiens
tcctgggtggctact

SEQ ID NO: 4656202 - DNA, 13 bp, Homo sapiens
tcctggtggggca

SEQ ID NO: 4656203 - DNA, 16 bp, Homo sapiens
tcctggtggggcagct

SEQ ID NO: 4656204 - DNA, 17 bp, Homo sapiens
tcctggtggggcagctc

SEQ ID NO: 4656205 - DNA, 14 bp, Homo sapiens
tcctggtgtgaagg

SEQ ID NO: 4656206 - DNA, 22 bp, Homo sapiens
tcctgtagccttctgtaggaat

SEQ ID NO: 4656207 - DNA, 21 bp, Homo sapiens
tcctgtatttgttcccaagag

SEQ ID NO: 4656208 - DNA, 24 bp, Homo sapiens
tcctgtcctgctcattatgccact

SEQ ID NO: 4656209 - DNA, 21 bp, Homo sapiens
tcctgtggctccctctctcct

SEQ ID NO: 4656210 - DNA, 15 bp, Homo sapiens
tcctgtgggagcctc

SEQ ID NO: 4656211 - DNA, 13 bp, Homo sapiens
tcctgtggggaaa

SEQ ID NO: 4656212 - DNA, 18 bp, Homo sapiens
tcctgttcagtaataaaa

SEQ ID NO: 4656213 - DNA, 15 bp, Homo sapiens
tcctgtttccagggt

SEQ ID NO: 4656214 - DNA, 16 bp, Homo sapiens
tccttacaatgtgaat

SEQ ID NO: 4656215 - DNA, 19 bp, Homo sapiens
tccttacaatgtgaataat

SEQ ID NO: 4656216 - DNA, 23 bp, Homo sapiens
tccttactcctgtgggagcctcg

SEQ ID NO: 4656217 - DNA, 22 bp, Homo sapiens
tccttatcagagctaagggtgg

SEQ ID NO: 4656218 - DNA, 19 bp, Homo sapiens
tccttcacctcactgaaaa

SEQ ID NO: 4656219 - DNA, 15 bp, Homo sapiens
tccttccaccaagtt

SEQ ID NO: 4656220 - DNA, 13 bp, Homo sapiens
tccttccagcctt

SEQ ID NO: 4656221 - DNA, 14 bp, Homo sapiens
tccttccagccttt

SEQ ID NO: 4656222 - DNA, 13 bp, Homo sapiens
tccttccatgctc

SEQ ID NO: 4656223 - DNA, 15 bp, Homo sapiens
tccttccatgctccc

SEQ ID NO: 4656224 - DNA, 17 bp, Homo sapiens
tccttccatgctcccaa

SEQ ID NO: 4656225 - DNA, 16 bp, Homo sapiens
tccttccccagctccc

SEQ ID NO: 4656226 - DNA, 22 bp, Homo sapiens
tccttccccagctcccccaggc

SEQ ID NO: 4656227 - DNA, 23 bp, Homo sapiens
tccttccccagctcccccaggca

SEQ ID NO: 4656228 - DNA, 10 bp, Homo sapiens
tccttcctgc

SEQ ID NO: 4656229 - DNA, 14 bp, Homo sapiens
tccttcctgcccca

SEQ ID NO: 4656230 - DNA, 20 bp, Homo sapiens
tccttctgcaaagtggcagg

SEQ ID NO: 4656231 - DNA, 20 bp, Homo sapiens
tccttctggcagattcaaat

SEQ ID NO: 4656232 - DNA, 13 bp, Homo sapiens
tccttctttcctt

SEQ ID NO: 4656233 - DNA, 17 bp, Homo sapiens
tccttctttccttgttc

SEQ ID NO: 4656234 - DNA, 22 bp, Homo sapiens
tccttctttctagttcagctgc

SEQ ID NO: 4656235 - DNA, 22 bp, Homo sapiens
tccttgactgaagcgaacatct

SEQ ID NO: 4656236 - DNA, 23 bp, Homo sapiens
tccttgactgaagcgaacatctt

SEQ ID NO: 4656237 - DNA, 14 bp, Homo sapiens
tccttgcccaggtg

SEQ ID NO: 4656238 - DNA, 22 bp, Homo sapiens
tccttgcccaggtgagggaagg

SEQ ID NO: 4656239 - DNA, 15 bp, Homo sapiens
tccttgctatgatga

SEQ ID NO: 4656240 - DNA, 21 bp, Homo sapiens
tccttgtcagggtctccttcc

SEQ ID NO: 4656241 - DNA, 15 bp, Homo sapiens
tcctttacctttcag

SEQ ID NO: 4656242 - DNA, 14 bp, Homo sapiens
tcctttcaataaag

SEQ ID NO: 4656243 - DNA, 16 bp, Homo sapiens
tcctttcaataaagtt

SEQ ID NO: 4656244 - DNA, 18 bp, Homo sapiens
tcctttcaataaagttgt

SEQ ID NO: 4656245 - DNA, 19 bp, Homo sapiens
tcctttccaatagaaagaa

SEQ ID NO: 4656246 - DNA, 13 bp, Homo sapiens
tcctttgaggccc

SEQ ID NO: 4656247 - DNA, 12 bp, Homo sapiens
tcctttgccctt

SEQ ID NO: 4656248 - DNA, 21 bp, Homo sapiens
tcctttgcccttacctgtctc

SEQ ID NO: 4656249 - DNA, 22 bp, Homo sapiens
tcctttgcccttcctcctgcct

SEQ ID NO: 4656250 - DNA, 13 bp, Homo sapiens
tcctttgtagcta

SEQ ID NO: 4656251 - DNA, 13 bp, Homo sapiens
tccttttaaagaa

SEQ ID NO: 4656252 - DNA, 15 bp, Homo sapiens
tcctttttgtaaata

SEQ ID NO: 4656253 - DNA, 20 bp, Homo sapiens
tcctttttgtaaatatgtga

SEQ ID NO: 4656254 - DNA, 13 bp, Homo sapiens
tccttttttgtca

SEQ ID NO: 4656255 - DNA, 15 bp, Homo sapiens
tccttttttgtcatt

SEQ ID NO: 4656256 - DNA, 20 bp, Homo sapiens
tcgaaacctacaagatttcc

SEQ ID NO: 4656257 - DNA, 12 bp, Homo sapiens
tcgaaaggcctt

SEQ ID NO: 4656258 - DNA, 21 bp, Homo sapiens
tcgaatcttaatttattattt

SEQ ID NO: 4656259 - DNA, 17 bp, Homo sapiens
tcgaatttgaagagatt

SEQ ID NO: 4656260 - DNA, 12 bp, Homo sapiens
tcgacagacagc

SEQ ID NO: 4656261 - DNA, 21 bp, Homo sapiens
tcgacagggcctggagcccca

SEQ ID NO: 4656262 - DNA, 16 bp, Homo sapiens
tcgaccctgtccccta

SEQ ID NO: 4656263 - DNA, 15 bp, Homo sapiens
tcgaccggccctgca

SEQ ID NO: 4656264 - DNA, 14 bp, Homo sapiens
tcgagacagaacct

SEQ ID NO: 4656265 - DNA, 16 bp, Homo sapiens
tcgagcgccctgcaga

SEQ ID NO: 4656266 - DNA, 19 bp, Homo sapiens
tcgagcgccctgcagaccc

SEQ ID NO: 4656267 - DNA, 20 bp, Homo sapiens
tcgcaacccgtgccaagtcc

SEQ ID NO: 4656268 - DNA, 16 bp, Homo sapiens
tcgcagccaccctgag

SEQ ID NO: 4656269 - DNA, 17 bp, Homo sapiens
tcgcagccaccctgagg

SEQ ID NO: 4656270 - DNA, 18 bp, Homo sapiens
tcgcagccaccctgagga

SEQ ID NO: 4656271 - DNA, 19 bp, Homo sapiens
tcgcagccaccctgaggag

SEQ ID NO: 4656272 - DNA, 23 bp, Homo sapiens
tcgcagccaccctgaggagtctg

SEQ ID NO: 4656273 - DNA, 20 bp, Homo sapiens
tcgcaggaagacccaacaca

SEQ ID NO: 4656274 - DNA, 14 bp, Homo sapiens
tcgcatcttcccaa

SEQ ID NO: 4656275 - DNA, 21 bp, Homo sapiens
tcgccacacgcctctgtgtac

SEQ ID NO: 4656276 - DNA, 14 bp, Homo sapiens
tcgccccagcaggt

SEQ ID NO: 4656277 - DNA, 21 bp, Homo sapiens
tcgctccccactctgctctga

SEQ ID NO: 4656278 - DNA, 19 bp, Homo sapiens
tcgctctgttacccagggt

SEQ ID NO: 4656279 - DNA, 17 bp, Homo sapiens
tcgctgaaattgcttat

SEQ ID NO: 4656280 - DNA, 16 bp, Homo sapiens
tcgctgcttcgtggga

SEQ ID NO: 4656281 - DNA, 15 bp, Homo sapiens
tcggacattctaatg

SEQ ID NO: 4656282 - DNA, 21 bp, Homo sapiens
tcggacattctaatgcatatt

SEQ ID NO: 4656283 - DNA, 11 bp, Homo sapiens
tcggactgcca

SEQ ID NO: 4656284 - DNA, 17 bp, Homo sapiens
tcggacttactgcctga

SEQ ID NO: 4656285 - DNA, 23 bp, Homo sapiens
tcggacttactgcctgaccttgg

SEQ ID NO: 4656286 - DNA, 19 bp, Homo sapiens
tcggagggaaattgtaaat

SEQ ID NO: 4656287 - DNA, 19 bp, Homo sapiens
tcggatatgattgtttctc

SEQ ID NO: 4656288 - DNA, 18 bp, Homo sapiens
tcggatctcacaggctga

SEQ ID NO: 4656289 - DNA, 16 bp, Homo sapiens
tcggatgacaccctgg

SEQ ID NO: 4656290 - DNA, 16 bp, Homo sapiens
tcgggcatgagtctgt

SEQ ID NO: 4656291 - DNA, 19 bp, Homo sapiens
tcgggctggagcctccgac

SEQ ID NO: 4656292 - DNA, 22 bp, Homo sapiens
tcggggtgcacaggagggggtc

SEQ ID NO: 4656293 - DNA, 15 bp, Homo sapiens
tcggtccactcttgt

SEQ ID NO: 4656294 - DNA, 16 bp, Homo sapiens
tcgtcatgttggccag

SEQ ID NO: 4656295 - DNA, 19 bp, Homo sapiens
tcgtcatgttggccaggct

SEQ ID NO: 4656296 - DNA, 20 bp, Homo sapiens
tcgtcatgttggccaggctg

SEQ ID NO: 4656297 - DNA, 15 bp, Homo sapiens
tcgtgagctggggac

SEQ ID NO: 4656298 - DNA, 12 bp, Homo sapiens
tcgtgatgtgga

SEQ ID NO: 4656299 - DNA, 23 bp, Homo sapiens
tcgtgatgtggaggaagagccac

SEQ ID NO: 4656300 - DNA, 12 bp, Homo sapiens
tcgtggagagct

SEQ ID NO: 4656301 - DNA, 13 bp, Homo sapiens
tcgttctccctgg

SEQ ID NO: 4656302 - DNA, 16 bp, Homo sapiens
tcgtttggtcttaggt

SEQ ID NO: 4656303 - DNA, 11 bp, Homo sapiens
tctaaaacaat

SEQ ID NO: 4656304 - DNA, 17 bp, Homo sapiens
tctaaaatagcaataac

SEQ ID NO: 4656305 - DNA, 16 bp, Homo sapiens
tccctgggccagggtc

SEQ ID NO: 4656306 - DNA, 21 bp, Homo sapiens
tccctgggcctgctgctgaga

SEQ ID NO: 4656307 - DNA, 23 bp, Homo sapiens
tccctggtgagagggccgggcag

SEQ ID NO: 4656308 - DNA, 20 bp, Homo sapiens
tccctgtgtccacctgtggg

SEQ ID NO: 4656309 - DNA, 23 bp, Homo sapiens
tccctgtttattccaaatgccat

SEQ ID NO: 4656310 - DNA, 16 bp, Homo sapiens
tcccttagtgactctt

SEQ ID NO: 4656311 - DNA, 14 bp, Homo sapiens
tcccttcctcttcc

SEQ ID NO: 4656312 - DNA, 18 bp, Homo sapiens
tcccttcctcttcctgcc

SEQ ID NO: 4656313 - DNA, 12 bp, Homo sapiens
tcccttctgctt

SEQ ID NO: 4656314 - DNA, 13 bp, Homo sapiens
tcccttcttggtt

SEQ ID NO: 4656315 - DNA, 13 bp, Homo sapiens
tcccttgctcatg

SEQ ID NO: 4656316 - DNA, 20 bp, Homo sapiens
tcccttgctcatgagctcct

SEQ ID NO: 4656317 - DNA, 22 bp, Homo sapiens
tcccttgctcatgagctcctga

SEQ ID NO: 4656318 - DNA, 22 bp, Homo sapiens
tcccttgtcagttccaaacaga

SEQ ID NO: 4656319 - DNA, 18 bp, Homo sapiens
tcccttttatctattaga

SEQ ID NO: 4656320 - DNA, 16 bp, Homo sapiens
tccgaacctcctctgt

SEQ ID NO: 4656321 - DNA, 22 bp, Homo sapiens
tccgaacctcctctgtgaagca

SEQ ID NO: 4656322 - DNA, 21 bp, Homo sapiens
tccgcatgatgtttccctctc

SEQ ID NO: 4656323 - DNA, 12 bp, Homo sapiens
tccgccagccac

SEQ ID NO: 4656324 - DNA, 20 bp, Homo sapiens
tccgccagccacaggaccac

SEQ ID NO: 4656325 - DNA, 22 bp, Homo sapiens
tccgccagccacaggaccacct

SEQ ID NO: 4656326 - DNA, 17 bp, Homo sapiens
tccgccagtgtttctga

SEQ ID NO: 4656327 - DNA, 17 bp, Homo sapiens
tccgcccacctcagcct

SEQ ID NO: 4656328 - DNA, 23 bp, Homo sapiens
tccgcttctctcttttaaagtat

SEQ ID NO: 4656329 - DNA, 19 bp, Homo sapiens
tccggccaaggtgccacca

SEQ ID NO: 4656330 - DNA, 13 bp, Homo sapiens
tccgtcctggcac

SEQ ID NO: 4656331 - DNA, 19 bp, Homo sapiens
tccgtgcgggaaattcagt

SEQ ID NO: 4656332 - DNA, 16 bp, Homo sapiens
tccgtgtggatccaat

SEQ ID NO: 4656333 - DNA, 17 bp, Homo sapiens
tccgtgtggatccaatg

SEQ ID NO: 4656334 - DNA, 21 bp, Homo sapiens
tccgttcctccccctgctccc

SEQ ID NO: 4656335 - DNA, 23 bp, Homo sapiens
tcctaaagaaaaatatcttggcc

SEQ ID NO: 4656336 - DNA, 16 bp, Homo sapiens
tcctaaagaagacatt

SEQ ID NO: 4656337 - DNA, 20 bp, Homo sapiens
tcctaacatgcaccttgctc

SEQ ID NO: 4656338 - DNA, 21 bp, Homo sapiens
tcctaacatgcaccttgctcc

SEQ ID NO: 4656339 - DNA, 13 bp, Homo sapiens
tcctaatcgctaa

SEQ ID NO: 4656340 - DNA, 13 bp, Homo sapiens
tcctacagcacta

SEQ ID NO: 4656341 - DNA, 20 bp, Homo sapiens
tcctaccaatggattcatgg

SEQ ID NO: 4656342 - DNA, 15 bp, Homo sapiens
tcctagcctttgggc

SEQ ID NO: 4656343 - DNA, 15 bp, Homo sapiens
tcctagggtgggaag

SEQ ID NO: 4656344 - DNA, 22 bp, Homo sapiens
tcctagtgctttccttttttaa

SEQ ID NO: 4656345 - DNA, 13 bp, Homo sapiens
tcctatgatggat

SEQ ID NO: 4656346 - DNA, 20 bp, Homo sapiens
tcctatgatggatggcagac

SEQ ID NO: 4656347 - DNA, 19 bp, Homo sapiens
tcctattactgatgtgtgc

SEQ ID NO: 4656348 - DNA, 17 bp, Homo sapiens
tcctcagtccctcttct

SEQ ID NO: 4656349 - DNA, 14 bp, Homo sapiens
tcctcagtgcaaaa

SEQ ID NO: 4656350 - DNA, 12 bp, Homo sapiens
tcctcatccctg

SEQ ID NO: 4656351 - DNA, 20 bp, Homo sapiens
tcctcatgcccaagagatct

SEQ ID NO: 4656352 - DNA, 17 bp, Homo sapiens
tcctccaacaccaagca

SEQ ID NO: 4656353 - DNA, 14 bp, Homo sapiens
tcctccagcccctg

SEQ ID NO: 4656354 - DNA, 18 bp, Homo sapiens
tcctccagcccctgtccc

SEQ ID NO: 4656355 - DNA, 22 bp, Homo sapiens
tcctccatcttactctgcccta

SEQ ID NO: 4656356 - DNA, 22 bp, Homo sapiens
tcctccccaccttcaatgactt

SEQ ID NO: 4656357 - DNA, 14 bp, Homo sapiens
tcctccccctgctc

SEQ ID NO: 4656358 - DNA, 12 bp, Homo sapiens
tcctccctagct

SEQ ID NO: 4656359 - DNA, 18 bp, Homo sapiens
tcctccctcctcactccc

SEQ ID NO: 4656360 - DNA, 19 bp, Homo sapiens
tcctcctccctcctcactc

SEQ ID NO: 4656361 - DNA, 15 bp, Homo sapiens
tcctcctgcctttct

SEQ ID NO: 4656362 - DNA, 16 bp, Homo sapiens
tcctcctgttcatctg

SEQ ID NO: 4656363 - DNA, 22 bp, Homo sapiens
tcctcctgttcatctgtgcacc

SEQ ID NO: 4656364 - DNA, 15 bp, Homo sapiens
tcctcgttctccctg

SEQ ID NO: 4656365 - DNA, 17 bp, Homo sapiens
tcctctcacctcagcct

SEQ ID NO: 4656366 - DNA, 17 bp, Homo sapiens
tcctctcatttccagct

SEQ ID NO: 4656367 - DNA, 19 bp, Homo sapiens
tcctctcatttccagcttc

SEQ ID NO: 4656368 - DNA, 16 bp, Homo sapiens
tcctctccaccctccc

SEQ ID NO: 4656369 - DNA, 14 bp, Homo sapiens
tcctctccatttta

SEQ ID NO: 4656370 - DNA, 19 bp, Homo sapiens
tcctctccattttagccca

SEQ ID NO: 4656371 - DNA, 14 bp, Homo sapiens
tcctctctccctgc

SEQ ID NO: 4656372 - DNA, 15 bp, Homo sapiens
tcctctctccctgcc

SEQ ID NO: 4656373 - DNA, 16 bp, Homo sapiens
tcctctctccctgcct

SEQ ID NO: 4656374 - DNA, 18 bp, Homo sapiens
tcctctctccctgcctca

SEQ ID NO: 4656375 - DNA, 19 bp, Homo sapiens
tcctctctccctgcctcac

SEQ ID NO: 4656376 - DNA, 13 bp, Homo sapiens
tcctctgccagca

SEQ ID NO: 4656377 - DNA, 15 bp, Homo sapiens
tcctctgccagcagg

SEQ ID NO: 4656378 - DNA, 17 bp, Homo sapiens
tcctctgccagcaggaa

SEQ ID NO: 4656379 - DNA, 23 bp, Homo sapiens
tcctctgtgaactgtgtgtgaat

SEQ ID NO: 4656380 - DNA, 13 bp, Homo sapiens
tcctctttgagac

SEQ ID NO: 4656381 - DNA, 15 bp, Homo sapiens
tcctctttttttaaa

SEQ ID NO: 4656382 - DNA, 15 bp, Homo sapiens
tcctgaaagggcact

SEQ ID NO: 4656383 - DNA, 14 bp, Homo sapiens
tcctgaaccatgtg

SEQ ID NO: 4656384 - DNA, 18 bp, Homo sapiens
tcctgaagctgaggctca

SEQ ID NO: 4656385 - DNA, 20 bp, Homo sapiens
tcctgacctcgtgatctacc

SEQ ID NO: 4656386 - DNA, 20 bp, Homo sapiens
tcctgactctcacctgtact

SEQ ID NO: 4656387 - DNA, 20 bp, Homo sapiens
tcctgagcactgccaggagg

SEQ ID NO: 4656388 - DNA, 15 bp, Homo sapiens
tcctgagtagctggg

SEQ ID NO: 4656389 - DNA, 15 bp, Homo sapiens
tcctgcagcagagcc

SEQ ID NO: 4656390 - DNA, 17 bp, Homo sapiens
tcctgcaggcaggaaca

SEQ ID NO: 4656391 - DNA, 22 bp, Homo sapiens
tcctgcaggcaggaacaaacag

SEQ ID NO: 4656392 - DNA, 13 bp, Homo sapiens
tcctgccagccca

SEQ ID NO: 4656393 - DNA, 17 bp, Homo sapiens
tcctgcccgagggcagc

SEQ ID NO: 4656394 - DNA, 21 bp, Homo sapiens
tcctgcccgcagacctctgga

SEQ ID NO: 4656395 - DNA, 12 bp, Homo sapiens
tcctgcccttga

SEQ ID NO: 4656396 - DNA, 17 bp, Homo sapiens
tcctgcctctactggga

SEQ ID NO: 4656397 - DNA, 21 bp, Homo sapiens
tcctgcctctactgggaaggc

SEQ ID NO: 4656398 - DNA, 21 bp, Homo sapiens
tcctgccttcttccttgaggg

SEQ ID NO: 4656399 - DNA, 19 bp, Homo sapiens
tcctgcctttctcaactgt

SEQ ID NO: 4656400 - DNA, 10 bp, Homo sapiens
tcctgctgcc

SEQ ID NO: 4656401 - DNA, 13 bp, Homo sapiens
tcctgctgcctgg

SEQ ID NO: 4656402 - DNA, 17 bp, Homo sapiens
tcctgctggggccgcca

SEQ ID NO: 4656403 - DNA, 23 bp, Homo sapiens
tcctgctggtacctgccctctat

SEQ ID NO: 4656404 - DNA, 22 bp, Homo sapiens
tcctgctgtaaatttggcttct

SEQ ID NO: 4656405 - DNA, 18 bp, Homo sapiens
tcctgctttgggaagact

SEQ ID NO: 4656406 - DNA, 13 bp, Homo sapiens
tcctggacagctg

SEQ ID NO: 4656407 - DNA, 16 bp, Homo sapiens
tcctggacagctgtgc

SEQ ID NO: 4656408 - DNA, 19 bp, Homo sapiens
tcctggacagctgtgcctc

SEQ ID NO: 4656409 - DNA, 19 bp, Homo sapiens
tcctggactggttatcttg

SEQ ID NO: 4656410 - DNA, 20 bp, Homo sapiens
tcctggactggttatcttgt

SEQ ID NO: 4656411 - DNA, 16 bp, Homo sapiens
tcctggacttaaagaa

SEQ ID NO: 4656412 - DNA, 15 bp, Homo sapiens
tcctggcccctgcct

SEQ ID NO: 4656413 - DNA, 18 bp, Homo sapiens
tcctggcccctgcctgct

SEQ ID NO: 4656414 - DNA, 13 bp, Homo sapiens
tcctggcctcaga

SEQ ID NO: 4656415 - DNA, 15 bp, Homo sapiens
tcctggcctcagagc

SEQ ID NO: 4656416 - DNA, 16 bp, Homo sapiens
tccatctctctcttgc

SEQ ID NO: 4656417 - DNA, 17 bp, Homo sapiens
tccatcttgtttcattt

SEQ ID NO: 4656418 - DNA, 22 bp, Homo sapiens
tccatcttgtttcatttgcttg

SEQ ID NO: 4656419 - DNA, 19 bp, Homo sapiens
tccatgctgcaaaggagaa

SEQ ID NO: 4656420 - DNA, 15 bp, Homo sapiens
tccatgggtctggct

SEQ ID NO: 4656421 - DNA, 16 bp, Homo sapiens
tccatgggtctggcta

SEQ ID NO: 4656422 - DNA, 23 bp, Homo sapiens
tccatgttagtaatggcagagca

SEQ ID NO: 4656423 - DNA, 14 bp, Homo sapiens
tccattaggccagc

SEQ ID NO: 4656424 - DNA, 20 bp, Homo sapiens
tccattaggccagcaacgct

SEQ ID NO: 4656425 - DNA, 13 bp, Homo sapiens
tccattcactccc

SEQ ID NO: 4656426 - DNA, 14 bp, Homo sapiens
tccattcactccca

SEQ ID NO: 4656427 - DNA, 15 bp, Homo sapiens
tccattccctagcag

SEQ ID NO: 4656428 - DNA, 22 bp, Homo sapiens
tccattgaagccgactctggcc

SEQ ID NO: 4656429 - DNA, 21 bp, Homo sapiens
tccattgtttgaaacaaagaa

SEQ ID NO: 4656430 - DNA, 16 bp, Homo sapiens
tccatttaagacacat

SEQ ID NO: 4656431 - DNA, 17 bp, Homo sapiens
tccatttctcatgtttt

SEQ ID NO: 4656432 - DNA, 22 bp, Homo sapiens
tcccaaacccagtctcctctcc

SEQ ID NO: 4656433 - DNA, 16 bp, Homo sapiens
tcccaaatccgccagt

SEQ ID NO: 4656434 - DNA, 14 bp, Homo sapiens
tcccaaatgagcca

SEQ ID NO: 4656435 - DNA, 19 bp, Homo sapiens
tcccaaccagtgccaagga

SEQ ID NO: 4656436 - DNA, 20 bp, Homo sapiens
tcccaaccagtgccaaggac

SEQ ID NO: 4656437 - DNA, 23 bp, Homo sapiens
tcccaaccctgggctggggagga

SEQ ID NO: 4656438 - DNA, 18 bp, Homo sapiens
tcccaactcccttctgct

SEQ ID NO: 4656439 - DNA, 17 bp, Homo sapiens
tcccaagctagactgtg

SEQ ID NO: 4656440 - DNA, 16 bp, Homo sapiens
tcccacatccctgggc

SEQ ID NO: 4656441 - DNA, 20 bp, Homo sapiens
tcccacatccctgggcctgc

SEQ ID NO: 4656442 - DNA, 13 bp, Homo sapiens
tcccacatgaggc

SEQ ID NO: 4656443 - DNA, 16 bp, Homo sapiens
tcccaccattcctgcc

SEQ ID NO: 4656444 - DNA, 17 bp, Homo sapiens
tcccacctagcagcacc

SEQ ID NO: 4656445 - DNA, 20 bp, Homo sapiens
tcccactatctgggtgcatg

SEQ ID NO: 4656446 - DNA, 22 bp, Homo sapiens
tcccagcaagacctcatctgtg

SEQ ID NO: 4656447 - DNA, 13 bp, Homo sapiens
tcccagcactttg

SEQ ID NO: 4656448 - DNA, 21 bp, Homo sapiens
tcccagcatccctggagcagg

SEQ ID NO: 4656449 - DNA, 19 bp, Homo sapiens
tcccagcccattgctgcca

SEQ ID NO: 4656450 - DNA, 13 bp, Homo sapiens
tcccagccctggg

SEQ ID NO: 4656451 - DNA, 11 bp, Homo sapiens
tcccaggaggt

SEQ ID NO: 4656452 - DNA, 12 bp, Homo sapiens
tcccaggatctc

SEQ ID NO: 4656453 - DNA, 23 bp, Homo sapiens
tcccaggccccatgacctccagc

SEQ ID NO: 4656454 - DNA, 14 bp, Homo sapiens
tcccaggcctctgc

SEQ ID NO: 4656455 - DNA, 17 bp, Homo sapiens
tcccagggccctcccag

SEQ ID NO: 4656456 - DNA, 16 bp, Homo sapiens
tcccaggtgagaattc

SEQ ID NO: 4656457 - DNA, 17 bp, Homo sapiens
tcccaggtgagaattca

SEQ ID NO: 4656458 - DNA, 18 bp, Homo sapiens
tcccatcccactgctccc

SEQ ID NO: 4656459 - DNA, 15 bp, Homo sapiens
tcccatcctggggca

SEQ ID NO: 4656460 - DNA, 17 bp, Homo sapiens
tcccatcctggggcagc

SEQ ID NO: 4656461 - DNA, 18 bp, Homo sapiens
tcccatcctggggcagca

SEQ ID NO: 4656462 - DNA, 21 bp, Homo sapiens
tcccatggagttgccaactat

SEQ ID NO: 4656463 - DNA, 19 bp, Homo sapiens
tccccaaatccgaacctcc

SEQ ID NO: 4656464 - DNA, 14 bp, Homo sapiens
tccccaagatctgc

SEQ ID NO: 4656465 - DNA, 16 bp, Homo sapiens
tccccaagatctgcca

SEQ ID NO: 4656466 - DNA, 20 bp, Homo sapiens
tccccaagatctgccagacc

SEQ ID NO: 4656467 - DNA, 20 bp, Homo sapiens
tccccaaggacccagccctc

SEQ ID NO: 4656468 - DNA, 19 bp, Homo sapiens
tccccaagggccctggcac

SEQ ID NO: 4656469 - DNA, 14 bp, Homo sapiens
tccccaccctccac

SEQ ID NO: 4656470 - DNA, 16 bp, Homo sapiens
tccccaccctccactc

SEQ ID NO: 4656471 - DNA, 17 bp, Homo sapiens
tccccactctgctctga

SEQ ID NO: 4656472 - DNA, 17 bp, Homo sapiens
tccccagagaaagcgca

SEQ ID NO: 4656473 - DNA, 16 bp, Homo sapiens
tccccagagctgtgcc

SEQ ID NO: 4656474 - DNA, 22 bp, Homo sapiens
tccccagcagggtcttttcatc

SEQ ID NO: 4656475 - DNA, 18 bp, Homo sapiens
tccccagctcccccaggc

SEQ ID NO: 4656476 - DNA, 14 bp, Homo sapiens
tccccaggggcatg

SEQ ID NO: 4656477 - DNA, 22 bp, Homo sapiens
tcccccaccagctaaggacatt

SEQ ID NO: 4656478 - DNA, 11 bp, Homo sapiens
tcccccaccct

SEQ ID NO: 4656479 - DNA, 18 bp, Homo sapiens
tcccccactactgcagca

SEQ ID NO: 4656480 - DNA, 24 bp, Homo sapiens
tcccccactactgcagcacctcca

SEQ ID NO: 4656481 - DNA, 21 bp, Homo sapiens
tcccccctccattcccacccc

SEQ ID NO: 4656482 - DNA, 11 bp, Homo sapiens
tccccctgcaa

SEQ ID NO: 4656483 - DNA, 12 bp, Homo sapiens
tccccctgcaac

SEQ ID NO: 4656484 - DNA, 20 bp, Homo sapiens
tcccccttccaaataataaa

SEQ ID NO: 4656485 - DNA, 18 bp, Homo sapiens
tccccgaagagtcagccc

SEQ ID NO: 4656486 - DNA, 13 bp, Homo sapiens
tccccgctctgcc

SEQ ID NO: 4656487 - DNA, 22 bp, Homo sapiens
tcccctagggactgtcctagcc

SEQ ID NO: 4656488 - DNA, 12 bp, Homo sapiens
tcccctccccat

SEQ ID NO: 4656489 - DNA, 16 bp, Homo sapiens
tcccctccccatctgt

SEQ ID NO: 4656490 - DNA, 22 bp, Homo sapiens
tcccctgccttaacctgggacc

SEQ ID NO: 4656491 - DNA, 18 bp, Homo sapiens
tccccttcgctgaaattg

SEQ ID NO: 4656492 - DNA, 17 bp, Homo sapiens
tcccctttatgtacagg

SEQ ID NO: 4656493 - DNA, 20 bp, Homo sapiens
tcccctttatgtacaggatg

SEQ ID NO: 4656494 - DNA, 21 bp, Homo sapiens
tcccgagtagctgggattaca

SEQ ID NO: 4656495 - DNA, 17 bp, Homo sapiens
tcccgccaggagcttct

SEQ ID NO: 4656496 - DNA, 22 bp, Homo sapiens
tcccgtggaacgtttttcctgt

SEQ ID NO: 4656497 - DNA, 15 bp, Homo sapiens
tccctacacagggcc

SEQ ID NO: 4656498 - DNA, 12 bp, Homo sapiens
tccctacccctc

SEQ ID NO: 4656499 - DNA, 24 bp, Homo sapiens
tccctagcaggaacttctagctca

SEQ ID NO: 4656500 - DNA, 14 bp, Homo sapiens
tccctagctctgaa

SEQ ID NO: 4656501 - DNA, 19 bp, Homo sapiens
tccctagctcttccccatc

SEQ ID NO: 4656502 - DNA, 14 bp, Homo sapiens
tccctccaccagcc

SEQ ID NO: 4656503 - DNA, 17 bp, Homo sapiens
tccctccaccagcctgc

SEQ ID NO: 4656504 - DNA, 20 bp, Homo sapiens
tccctccaccagcctgctga

SEQ ID NO: 4656505 - DNA, 13 bp, Homo sapiens
tccctcctttcct

SEQ ID NO: 4656506 - DNA, 12 bp, Homo sapiens
tccctctcccag

SEQ ID NO: 4656507 - DNA, 16 bp, Homo sapiens
tccctctcccaggccc

SEQ ID NO: 4656508 - DNA, 20 bp, Homo sapiens
tccctctcccaggccccatg

SEQ ID NO: 4656509 - DNA, 12 bp, Homo sapiens
tccctctctctg

SEQ ID NO: 4656510 - DNA, 16 bp, Homo sapiens
tccctctctctggaaa

SEQ ID NO: 4656511 - DNA, 18 bp, Homo sapiens
tccctctgcattgacctg

SEQ ID NO: 4656512 - DNA, 10 bp, Homo sapiens
tccctctgcc

SEQ ID NO: 4656513 - DNA, 12 bp, Homo sapiens
tccctctgcctg

SEQ ID NO: 4656514 - DNA, 13 bp, Homo sapiens
tccctctgcctgg

SEQ ID NO: 4656515 - DNA, 14 bp, Homo sapiens
tccctctgcctggg

SEQ ID NO: 4656516 - DNA, 17 bp, Homo sapiens
tccctctgcctgggatg

SEQ ID NO: 4656517 - DNA, 22 bp, Homo sapiens
tccctctgcctgggatgccctt

SEQ ID NO: 4656518 - DNA, 21 bp, Homo sapiens
tccctgagatttaacccctcc

SEQ ID NO: 4656519 - DNA, 11 bp, Homo sapiens
tccctgcctca

SEQ ID NO: 4656520 - DNA, 13 bp, Homo sapiens
tccctgcctcaca

SEQ ID NO: 4656521 - DNA, 17 bp, Homo sapiens
tccctgcctcaggcctc

SEQ ID NO: 4656522 - DNA, 15 bp, Homo sapiens
tccctgcgagacgca

SEQ ID NO: 4656523 - DNA, 19 bp, Homo sapiens
tccctgcgagacgcacaca

SEQ ID NO: 4656524 - DNA, 23 bp, Homo sapiens
tccctgcgagacgcacacagctg

SEQ ID NO: 4656525 - DNA, 14 bp, Homo sapiens
tccctgctgaatgc

SEQ ID NO: 4656526 - DNA, 20 bp, Homo sapiens
tccctgctgtgccatgctgg

SEQ ID NO: 4656527 - DNA, 17 bp, Homo sapiens
tccctgggcattgcttt

SEQ ID NO: 4656528 - DNA, 17 bp, Homo sapiens
taatttcctggtgtgaa

SEQ ID NO: 4656529 - DNA, 17 bp, Homo sapiens
taatttctttttttcct

SEQ ID NO: 4656530 - DNA, 20 bp, Homo sapiens
taatttgtaaacttctgaag

SEQ ID NO: 4656531 - DNA, 23 bp, Homo sapiens
taatttgtaaacttctgaagact

SEQ ID NO: 4656532 - DNA, 22 bp, Homo sapiens
taattttacatgtttataaatc

SEQ ID NO: 4656533 - DNA, 20 bp, Homo sapiens
taattttcttggttctttca

SEQ ID NO: 4656534 - DNA, 18 bp, Homo sapiens
taattttgcatactgaaa

SEQ ID NO: 4656535 - DNA, 17 bp, Homo sapiens
taatttttgtattattt

SEQ ID NO: 4656536 - DNA, 13 bp, Homo sapiens
taattttttctta

SEQ ID NO: 4656537 - DNA, 18 bp, Homo sapiens
tacaaaacctcaaaccag

SEQ ID NO: 4656538 - DNA, 12 bp, Homo sapiens
tacaaaatttat

SEQ ID NO: 4656539 - DNA, 22 bp, Homo sapiens
tacaaacaagtggatgttttta

SEQ ID NO: 4656540 - DNA, 18 bp, Homo sapiens
tccagcttgcctgtttct

SEQ ID NO: 4656541 - DNA, 17 bp, Homo sapiens
tccaggagagagccagg

SEQ ID NO: 4656542 - DNA, 19 bp, Homo sapiens
tccaggattttaatttcag

SEQ ID NO: 4656543 - DNA, 14 bp, Homo sapiens
tccaggcctgcagc

SEQ ID NO: 4656544 - DNA, 13 bp, Homo sapiens
tccagggatggcc

SEQ ID NO: 4656545 - DNA, 17 bp, Homo sapiens
tccagggcccccatctc

SEQ ID NO: 4656546 - DNA, 13 bp, Homo sapiens
tccagggtctgag

SEQ ID NO: 4656547 - DNA, 18 bp, Homo sapiens
tccaggttgatcttgaac

SEQ ID NO: 4656548 - DNA, 21 bp, Homo sapiens
tccaggttgatcttgaactcc

SEQ ID NO: 4656549 - DNA, 18 bp, Homo sapiens
tccagtgccaacaatcct

SEQ ID NO: 4656550 - DNA, 15 bp, Homo sapiens
tccagttgcagacca

SEQ ID NO: 4656551 - DNA, 19 bp, Homo sapiens
tccagtttgtgtttttcta

SEQ ID NO: 4656552 - DNA, 24 bp, Homo sapiens
tccataaagtacaaatgaagaaag

SEQ ID NO: 4656553 - DNA, 14 bp, Homo sapiens
tccataatttggtc

SEQ ID NO: 4656554 - DNA, 16 bp, Homo sapiens
tccatactgtagacac

SEQ ID NO: 4656555 - DNA, 21 bp, Homo sapiens
tccatactgtagacactctga

SEQ ID NO: 4656556 - DNA, 23 bp, Homo sapiens
tccatactgtagacactctgaca

SEQ ID NO: 4656557 - DNA, 18 bp, Homo sapiens
tccatatttgatttctaa

SEQ ID NO: 4656558 - DNA, 21 bp, Homo sapiens
tccatcccaaccagtgccaag

SEQ ID NO: 4656559 - DNA, 21 bp, Homo sapiens
tccatctatcactgcattatc

SEQ ID NO: 4656560 - DNA, 21 bp, Homo sapiens
taaggcaggtgggcagacagt

SEQ ID NO: 4656561 - DNA, 14 bp, Homo sapiens
taagggagaaaaaa

SEQ ID NO: 4656562 - DNA, 12 bp, Homo sapiens
taagggcagagt

SEQ ID NO: 4656563 - DNA, 19 bp, Homo sapiens
taagggtgggtgctcagaa

SEQ ID NO: 4656564 - DNA, 13 bp, Homo sapiens
taaggtactgtgg

SEQ ID NO: 4656565 - DNA, 21 bp, Homo sapiens
taaggtctttcagtacttttt

SEQ ID NO: 4656566 - DNA, 17 bp, Homo sapiens
taaggtttcaacaaatt

SEQ ID NO: 4656567 - DNA, 21 bp, Homo sapiens
taaggtttcaacaaatttcat

SEQ ID NO: 4656568 - DNA, 19 bp, Homo sapiens
taagtaaacctagtaaaac

SEQ ID NO: 4656569 - DNA, 20 bp, Homo sapiens
taagtagggctaagccagtt

SEQ ID NO: 4656570 - DNA, 20 bp, Homo sapiens
taagtagtaaatcagaaagt

SEQ ID NO: 4656571 - DNA, 15 bp, Homo sapiens
taagtatatcatgta

SEQ ID NO: 4656572 - DNA, 16 bp, Homo sapiens
taagtcaggacagctt

SEQ ID NO: 4656573 - DNA, 18 bp, Homo sapiens
taagtcctttcaattcca

SEQ ID NO: 4656574 - DNA, 19 bp, Homo sapiens
taagtctgtcttgccttca

SEQ ID NO: 4656575 - DNA, 14 bp, Homo sapiens
taagttcctgctgc

SEQ ID NO: 4656576 - DNA, 20 bp, Homo sapiens
taagttcctgctgcctgggt

SEQ ID NO: 4656577 - DNA, 22 bp, Homo sapiens
taagttgtataggctaaatgtt

SEQ ID NO: 4656578 - DNA, 19 bp, Homo sapiens
taagtttacctatgtaaca

SEQ ID NO: 4656579 - DNA, 20 bp, Homo sapiens
taagtttttgctaaatgtga

SEQ ID NO: 4656580 - DNA, 17 bp, Homo sapiens
taataaaagtacatgtt

SEQ ID NO: 4656581 - DNA, 14 bp, Homo sapiens
taataaagccattt

SEQ ID NO: 4656582 - DNA, 14 bp, Homo sapiens
taataaagctttat

SEQ ID NO: 4656583 - DNA, 20 bp, Homo sapiens
taataaagctttataaactt

SEQ ID NO: 4656584 - DNA, 17 bp, Homo sapiens
taataacgtgaaactta

SEQ ID NO: 4656585 - DNA, 19 bp, Homo sapiens
taataagcatggtgtcagt

SEQ ID NO: 4656586 - DNA, 13 bp, Homo sapiens
taataatgggttt

SEQ ID NO: 4656587 - DNA, 18 bp, Homo sapiens
taataatgttaaccaagg

SEQ ID NO: 4656588 - DNA, 15 bp, Homo sapiens
taataattgtatcta

SEQ ID NO: 4656589 - DNA, 22 bp, Homo sapiens
taataattgtatctacattaaa

SEQ ID NO: 4656590 - DNA, 16 bp, Homo sapiens
taatacccatgctttg

SEQ ID NO: 4656591 - DNA, 16 bp, Homo sapiens
taatactgttttaaaa

SEQ ID NO: 4656592 - DNA, 14 bp, Homo sapiens
taatagagtactta

SEQ ID NO: 4656593 - DNA, 13 bp, Homo sapiens
taatagcattttt

SEQ ID NO: 4656594 - DNA, 14 bp, Homo sapiens
taatagcatttttg

SEQ ID NO: 4656595 - DNA, 16 bp, Homo sapiens
taatagggaatatatc

SEQ ID NO: 4656596 - DNA, 16 bp, Homo sapiens
taatatagtagatttt

SEQ ID NO: 4656597 - DNA, 18 bp, Homo sapiens
taatatcaaagcatttta

SEQ ID NO: 4656598 - DNA, 15 bp, Homo sapiens
taatatcattttatt

SEQ ID NO: 4656599 - DNA, 19 bp, Homo sapiens
taatatcattttattcaca

SEQ ID NO: 4656600 - DNA, 14 bp, Homo sapiens
taatatctttcagt

SEQ ID NO: 4656601 - DNA, 13 bp, Homo sapiens
taatatgacagat

SEQ ID NO: 4656602 - DNA, 12 bp, Homo sapiens
taatatgtttag

SEQ ID NO: 4656603 - DNA, 22 bp, Homo sapiens
taatattaattttctacaaata

SEQ ID NO: 4656604 - DNA, 18 bp, Homo sapiens
taatcaaagccagggtct

SEQ ID NO: 4656605 - DNA, 20 bp, Homo sapiens
taatcagcaagaatttgatc

SEQ ID NO: 4656606 - DNA, 20 bp, Homo sapiens
taatcaggcaaggaggagga

SEQ ID NO: 4656607 - DNA, 14 bp, Homo sapiens
taatcatacaaact

SEQ ID NO: 4656608 - DNA, 15 bp, Homo sapiens
taatcatacaaactc

SEQ ID NO: 4656609 - DNA, 22 bp, Homo sapiens
taatcatacaaactctcaccat

SEQ ID NO: 4656610 - DNA, 14 bp, Homo sapiens
taatcattatttga

SEQ ID NO: 4656611 - DNA, 15 bp, Homo sapiens
taatcattatttgag

SEQ ID NO: 4656612 - DNA, 19 bp, Homo sapiens
taatcattttaataaagtt

SEQ ID NO: 4656613 - DNA, 18 bp, Homo sapiens
taatcattttcattccta

SEQ ID NO: 4656614 - DNA, 14 bp, Homo sapiens
taatccctgggcat

SEQ ID NO: 4656615 - DNA, 13 bp, Homo sapiens
taatcctcctgag

SEQ ID NO: 4656616 - DNA, 22 bp, Homo sapiens
taatctgattatacaccatttt

SEQ ID NO: 4656617 - DNA, 14 bp, Homo sapiens
taatctgtgtacaa

SEQ ID NO: 4656618 - DNA, 13 bp, Homo sapiens
taatcttatacaa

SEQ ID NO: 4656619 - DNA, 15 bp, Homo sapiens
taatcttgctttctt

SEQ ID NO: 4656620 - DNA, 16 bp, Homo sapiens
taatctttattttatt

SEQ ID NO: 4656621 - DNA, 20 bp, Homo sapiens
taatctttattttattattc

SEQ ID NO: 4656622 - DNA, 20 bp, Homo sapiens
taatctttctatagccaact

SEQ ID NO: 4656623 - DNA, 16 bp, Homo sapiens
taatgaaaataaaaca

SEQ ID NO: 4656624 - DNA, 16 bp, Homo sapiens
taatgaaatgtttact

SEQ ID NO: 4656625 - DNA, 16 bp, Homo sapiens
taatgacttagaaact

SEQ ID NO: 4656626 - DNA, 17 bp, Homo sapiens
taatgagggaaatctgt

SEQ ID NO: 4656627 - DNA, 20 bp, Homo sapiens
taatgagggaaatctgtaaa

SEQ ID NO: 4656628 - DNA, 22 bp, Homo sapiens
taatgatgacaaaaaatgtttt

SEQ ID NO: 4656629 - DNA, 15 bp, Homo sapiens
taatgatggcagagg

SEQ ID NO: 4656630 - DNA, 22 bp, Homo sapiens
taatgcaaattaaaacatattt

SEQ ID NO: 4656631 - DNA, 17 bp, Homo sapiens
taatgcatatttataag

SEQ ID NO: 4656632 - DNA, 14 bp, Homo sapiens
taatgcctttttgg

SEQ ID NO: 4656633 - DNA, 15 bp, Homo sapiens
taatgcgaatagtgc

SEQ ID NO: 4656634 - DNA, 22 bp, Homo sapiens
taatgctctatgtttgtatttg

SEQ ID NO: 4656635 - DNA, 15 bp, Homo sapiens
taatgctgtttctaa

SEQ ID NO: 4656636 - DNA, 21 bp, Homo sapiens
taatggaggtcccagccctgg

SEQ ID NO: 4656637 - DNA, 23 bp, Homo sapiens
taatggaggtcccagccctgggg

SEQ ID NO: 4656638 - DNA, 14 bp, Homo sapiens
taatggattaaatt

SEQ ID NO: 4656639 - DNA, 17 bp, Homo sapiens
taatggcacttatcatt

SEQ ID NO: 4656640 - DNA, 15 bp, Homo sapiens
taatggcatttctct

SEQ ID NO: 4656641 - DNA, 17 bp, Homo sapiens
taatggccggctggaaa

SEQ ID NO: 4656642 - DNA, 23 bp, Homo sapiens
taatggccggctggaaatgctgg

SEQ ID NO: 4656643 - DNA, 10 bp, Homo sapiens
taatgtatct

SEQ ID NO: 4656644 - DNA, 22 bp, Homo sapiens
taatgtctgtatcactctgtgt

SEQ ID NO: 4656645 - DNA, 20 bp, Homo sapiens
taatgtgatcatatgaggac

SEQ ID NO: 4656646 - DNA, 19 bp, Homo sapiens
taatgtgtggtggcctcag

SEQ ID NO: 4656647 - DNA, 22 bp, Homo sapiens
taatgttcttatgcaaaatgga

SEQ ID NO: 4656648 - DNA, 21 bp, Homo sapiens
taatgttgggtagaaagagat

SEQ ID NO: 4656649 - DNA, 18 bp, Homo sapiens
taattaaccttactaatt

SEQ ID NO: 4656650 - DNA, 16 bp, Homo sapiens
taattaagcagaaaca

SEQ ID NO: 4656651 - DNA, 15 bp, Homo sapiens
taattaccagttttc

SEQ ID NO: 4656652 - DNA, 14 bp, Homo sapiens
taattatgaaaact

SEQ ID NO: 4656653 - DNA, 13 bp, Homo sapiens
taattatgaaaag

SEQ ID NO: 4656654 - DNA, 13 bp, Homo sapiens
taattattattat

SEQ ID NO: 4656655 - DNA, 15 bp, Homo sapiens
taattccgcatgatg

SEQ ID NO: 4656656 - DNA, 21 bp, Homo sapiens
taattcctacagcactactgg

SEQ ID NO: 4656657 - DNA, 21 bp, Homo sapiens
taattccttatcctagccttt

SEQ ID NO: 4656658 - DNA, 16 bp, Homo sapiens
taattctctttcaaag

SEQ ID NO: 4656659 - DNA, 14 bp, Homo sapiens
taattggatgttca

SEQ ID NO: 4656660 - DNA, 22 bp, Homo sapiens
taattggttattaaactgaata

SEQ ID NO: 4656661 - DNA, 18 bp, Homo sapiens
taattgtaagtgaaatta

SEQ ID NO: 4656662 - DNA, 16 bp, Homo sapiens
taattgtatctacatt

SEQ ID NO: 4656663 - DNA, 18 bp, Homo sapiens
taattgttttgcactttt

SEQ ID NO: 4656664 - DNA, 15 bp, Homo sapiens
taatttataaataca

SEQ ID NO: 4656665 - DNA, 19 bp, Homo sapiens
taatttatactggcatgct

SEQ ID NO: 4656666 - DNA, 20 bp, Homo sapiens
taatttatactttaaagtat

SEQ ID NO: 4656667 - DNA, 14 bp, Homo sapiens
taatttatagcaag

SEQ ID NO: 4656668 - DNA, 14 bp, Homo sapiens
taatttatatctaa

SEQ ID NO: 4656669 - DNA, 21 bp, Homo sapiens
taatttcaaaatacatttgta

SEQ ID NO: 4656670 - DNA, 13 bp, Homo sapiens
taatttcaggaaa

SEQ ID NO: 4656671 - DNA, 17 bp, Homo sapiens
taaatatggggatagtc

SEQ ID NO: 4656672 - DNA, 23 bp, Homo sapiens
taaatatggggatagtctgggtc

SEQ ID NO: 4656673 - DNA, 18 bp, Homo sapiens
taaatattagttaatgga

SEQ ID NO: 4656674 - DNA, 21 bp, Homo sapiens
taaatattagttaatggatta

SEQ ID NO: 4656675 - DNA, 16 bp, Homo sapiens
taaatattgtaatatg

SEQ ID NO: 4656676 - DNA, 19 bp, Homo sapiens
taaatatttactctttgca

SEQ ID NO: 4656677 - DNA, 23 bp, Homo sapiens
taaatcacagaaaatttaactta

SEQ ID NO: 4656678 - DNA, 12 bp, Homo sapiens
taaatcagaaag

SEQ ID NO: 4656679 - DNA, 17 bp, Homo sapiens
taaatcagaaagtaaca

SEQ ID NO: 4656680 - DNA, 20 bp, Homo sapiens
taaatcatattagtattaat

SEQ ID NO: 4656681 - DNA, 21 bp, Homo sapiens
taaatcatattagtattaata

SEQ ID NO: 4656682 - DNA, 20 bp, Homo sapiens
taaatcccacatcccagttt

SEQ ID NO: 4656683 - DNA, 12 bp, Homo sapiens
taaatcctgtgt

SEQ ID NO: 4656684 - DNA, 18 bp, Homo sapiens
taaatctaaacaaaaaat

SEQ ID NO: 4656685 - DNA, 14 bp, Homo sapiens
taaatctaaatgat

SEQ ID NO: 4656686 - DNA, 16 bp, Homo sapiens
taaatctagacattct

SEQ ID NO: 4656687 - DNA, 15 bp, Homo sapiens
taaatgattatcttg

SEQ ID NO: 4656688 - DNA, 11 bp, Homo sapiens
taaatgctgct

SEQ ID NO: 4656689 - DNA, 12 bp, Homo sapiens
taaatgtctgtt

SEQ ID NO: 4656690 - DNA, 23 bp, Homo sapiens
taaatgtgatatgattggcaata

SEQ ID NO: 4656691 - DNA, 17 bp, Homo sapiens
taaatgttaactacata

SEQ ID NO: 4656692 - DNA, 14 bp, Homo sapiens
taaatgtttccccc

SEQ ID NO: 4656693 - DNA, 15 bp, Homo sapiens
taaatgtttccccca

SEQ ID NO: 4656694 - DNA, 14 bp, Homo sapiens
taaattacaatttt

SEQ ID NO: 4656695 - DNA, 23 bp, Homo sapiens
taaattacaattttatctgtttc

SEQ ID NO: 4656696 - DNA, 14 bp, Homo sapiens
taaattctctttca

SEQ ID NO: 4656697 - DNA, 15 bp, Homo sapiens
taaattgaagaaagt

SEQ ID NO: 4656698 - DNA, 13 bp, Homo sapiens
taaattgtacatt

SEQ ID NO: 4656699 - DNA, 18 bp, Homo sapiens
taaattgtacattttgta

SEQ ID NO: 4656700 - DNA, 19 bp, Homo sapiens
taaattgtacattttgtaa

SEQ ID NO: 4656701 - DNA, 21 bp, Homo sapiens
taaattgtacattttgtaaaa

SEQ ID NO: 4656702 - DNA, 21 bp, Homo sapiens
taaattgttagcttccttaag

SEQ ID NO: 4656703 - DNA, 19 bp, Homo sapiens
taaattgttcctctttgtt

SEQ ID NO: 4656704 - DNA, 14 bp, Homo sapiens
taaatttaagaaaa

SEQ ID NO: 4656705 - DNA, 15 bp, Homo sapiens
taaatttaattcttc

SEQ ID NO: 4656706 - DNA, 19 bp, Homo sapiens
taaattttttttgtttcat

SEQ ID NO: 4656707 - DNA, 11 bp, Homo sapiens
taacaaaatgg

SEQ ID NO: 4656708 - DNA, 15 bp, Homo sapiens
taacaaaatggacat

SEQ ID NO: 4656709 - DNA, 15 bp, Homo sapiens
taacaatagttctta

SEQ ID NO: 4656710 - DNA, 23 bp, Homo sapiens
taacaatctatggcttatttcta

SEQ ID NO: 4656711 - DNA, 18 bp, Homo sapiens
taacacaaagagatattt

SEQ ID NO: 4656712 - DNA, 16 bp, Homo sapiens
taacaccttggactgt

SEQ ID NO: 4656713 - DNA, 19 bp, Homo sapiens
taacactatgtttatttac

SEQ ID NO: 4656714 - DNA, 20 bp, Homo sapiens
taacactcagaagcctgggg

SEQ ID NO: 4656715 - DNA, 22 bp, Homo sapiens
taacagataaagaaactgaggc

SEQ ID NO: 4656716 - DNA, 12 bp, Homo sapiens
taacagatgcaa

SEQ ID NO: 4656717 - DNA, 16 bp, Homo sapiens
taacagggaaggcagg

SEQ ID NO: 4656718 - DNA, 22 bp, Homo sapiens
taacagggaaggcaggcagggc

SEQ ID NO: 4656719 - DNA, 15 bp, Homo sapiens
taacatgatttcaaa

SEQ ID NO: 4656720 - DNA, 15 bp, Homo sapiens
taacatgcaccttgc

SEQ ID NO: 4656721 - DNA, 14 bp, Homo sapiens
taacatgcatactt

SEQ ID NO: 4656722 - DNA, 12 bp, Homo sapiens
taacatttaaat

SEQ ID NO: 4656723 - DNA, 13 bp, Homo sapiens
taacatttaaatt

SEQ ID NO: 4656724 - DNA, 20 bp, Homo sapiens
taaccaaggaaatatatttt

SEQ ID NO: 4656725 - DNA, 21 bp, Homo sapiens
taaccaaggccctgtctctgg

SEQ ID NO: 4656726 - DNA, 20 bp, Homo sapiens
taaccatggagtagaggtac

SEQ ID NO: 4656727 - DNA, 12 bp, Homo sapiens
taacctaataat

SEQ ID NO: 4656728 - DNA, 17 bp, Homo sapiens
taacctgcacaggcttg

SEQ ID NO: 4656729 - DNA, 12 bp, Homo sapiens
taacctgggacc

SEQ ID NO: 4656730 - DNA, 17 bp, Homo sapiens
taacctgggcttaagtt

SEQ ID NO: 4656731 - DNA, 15 bp, Homo sapiens
taaccttttttgtct

SEQ ID NO: 4656732 - DNA, 21 bp, Homo sapiens
taacgactacaaaataaaact

SEQ ID NO: 4656733 - DNA, 13 bp, Homo sapiens
taacggtgctaaa

SEQ ID NO: 4656734 - DNA, 20 bp, Homo sapiens
taactagaaccaccaaatat

SEQ ID NO: 4656735 - DNA, 21 bp, Homo sapiens
taactagacacagataataat

SEQ ID NO: 4656736 - DNA, 14 bp, Homo sapiens
taactattaacctt

SEQ ID NO: 4656737 - DNA, 19 bp, Homo sapiens
taactccctccaccagcct

SEQ ID NO: 4656738 - DNA, 18 bp, Homo sapiens
taactctgcccaccctcc

SEQ ID NO: 4656739 - DNA, 18 bp, Homo sapiens
taactcttgttttctggt

SEQ ID NO: 4656740 - DNA, 14 bp, Homo sapiens
taactgaaaatgaa

SEQ ID NO: 4656741 - DNA, 14 bp, Homo sapiens
taactgagagaaag

SEQ ID NO: 4656742 - DNA, 17 bp, Homo sapiens
taactgcccagcggaca

SEQ ID NO: 4656743 - DNA, 19 bp, Homo sapiens
taactggcctaaatttctt

SEQ ID NO: 4656744 - DNA, 21 bp, Homo sapiens
taactggtaagcgatttgaaa

SEQ ID NO: 4656745 - DNA, 22 bp, Homo sapiens
taactggttaaaaaacaaatgt

SEQ ID NO: 4656746 - DNA, 12 bp, Homo sapiens
taactgtaaatc

SEQ ID NO: 4656747 - DNA, 13 bp, Homo sapiens
taactgtaaatca

SEQ ID NO: 4656748 - DNA, 11 bp, Homo sapiens
taactgtcctg

SEQ ID NO: 4656749 - DNA, 17 bp, Homo sapiens
taacttattacctcagg

SEQ ID NO: 4656750 - DNA, 22 bp, Homo sapiens
taactttaattctctttcaaag

SEQ ID NO: 4656751 - DNA, 21 bp, Homo sapiens
taagaaaaaaagctgcaaaaa

SEQ ID NO: 4656752 - DNA, 14 bp, Homo sapiens
taagaaaacaagta

SEQ ID NO: 4656753 - DNA, 16 bp, Homo sapiens
taagaaaagtaatgaa

SEQ ID NO: 4656754 - DNA, 21 bp, Homo sapiens
taagaaaataaaggaaaatga

SEQ ID NO: 4656755 - DNA, 12 bp, Homo sapiens
taagaaaattta

SEQ ID NO: 4656756 - DNA, 16 bp, Homo sapiens
taagaacaactacctg

SEQ ID NO: 4656757 - DNA, 22 bp, Homo sapiens
taagaactgcttcatgtgaaca

SEQ ID NO: 4656758 - DNA, 20 bp, Homo sapiens
taagactttgggataggaaa

SEQ ID NO: 4656759 - DNA, 13 bp, Homo sapiens
taagagaaatgga

SEQ ID NO: 4656760 - DNA, 16 bp, Homo sapiens
taagaggattgcttga

SEQ ID NO: 4656761 - DNA, 23 bp, Homo sapiens
taagaggattgcttgagcccaga

SEQ ID NO: 4656762 - DNA, 15 bp, Homo sapiens
taagagggcagactg

SEQ ID NO: 4656763 - DNA, 12 bp, Homo sapiens
taagatagaaca

SEQ ID NO: 4656764 - DNA, 15 bp, Homo sapiens
taagatagaacacaa

SEQ ID NO: 4656765 - DNA, 13 bp, Homo sapiens
taagatattcttt

SEQ ID NO: 4656766 - DNA, 16 bp, Homo sapiens
taagcagattgcttta

SEQ ID NO: 4656767 - DNA, 20 bp, Homo sapiens
taagcataatctgaaaacat

SEQ ID NO: 4656768 - DNA, 17 bp, Homo sapiens
taagcatactttgtaaa

SEQ ID NO: 4656769 - DNA, 19 bp, Homo sapiens
taagcattttgaaacaaag

SEQ ID NO: 4656770 - DNA, 23 bp, Homo sapiens
taagccaaagaaacaagctgtgc

SEQ ID NO: 4656771 - DNA, 17 bp, Homo sapiens
taagcgttaagggcaga

SEQ ID NO: 4656772 - DNA, 20 bp, Homo sapiens
taagctcaggatatggctta

SEQ ID NO: 4656773 - DNA, 13 bp, Homo sapiens
taagctcccctgc

SEQ ID NO: 4656774 - DNA, 14 bp, Homo sapiens
taagctcccctgcc

SEQ ID NO: 4656775 - DNA, 15 bp, Homo sapiens
taaggaaaaggattt

SEQ ID NO: 4656776 - DNA, 22 bp, Homo sapiens
taaggaaacttctgatgtttat

SEQ ID NO: 4656777 - DNA, 18 bp, Homo sapiens
taaggacatttcccaggg

SEQ ID NO: 4656778 - DNA, 20 bp, Homo sapiens
taaggagtaatctgtgtaca

SEQ ID NO: 4656779 - DNA, 13 bp, Homo sapiens
taaggatgtgtga

SEQ ID NO: 4656780 - DNA, 20 bp, Homo sapiens
taaggcacagtgggagctga

SEQ ID NO: 4656781 - DNA, 14 bp, Homo sapiens
taaggcaggcattg

SEQ ID NO: 4656782 - DNA, 18 bp, Homo sapiens
taaggcaggtgggcagac

SEQ ID NO: 4656783 - DNA, 20 bp, Homo sapiens
gtgtagccagccaggtgcat

SEQ ID NO: 4656784 - DNA, 21 bp, Homo sapiens
gtgtagccagccaggtgcatg

SEQ ID NO: 4656785 - DNA, 18 bp, Homo sapiens
gtgtagcctaaagggcag

SEQ ID NO: 4656786 - DNA, 19 bp, Homo sapiens
gtgtagcctaaagggcagg

SEQ ID NO: 4656787 - DNA, 20 bp, Homo sapiens
gtgtagcctaaagggcaggg

SEQ ID NO: 4656788 - DNA, 22 bp, Homo sapiens
gtgtagcctaaagggcagggcc

SEQ ID NO: 4656789 - DNA, 16 bp, Homo sapiens
gtgtagctgtaagggc

SEQ ID NO: 4656790 - DNA, 19 bp, Homo sapiens
gtgtagctgtgacctgctg

SEQ ID NO: 4656791 - DNA, 21 bp, Homo sapiens
gtgtagttccctctgcctggg

SEQ ID NO: 4656792 - DNA, 21 bp, Homo sapiens
gtgtatattccttttaaagaa

SEQ ID NO: 4656793 - DNA, 19 bp, Homo sapiens
gtgtatgccacacctggcc

SEQ ID NO: 4656794 - DNA, 19 bp, Homo sapiens
gtgtcacctccttccccag

SEQ ID NO: 4656795 - DNA, 20 bp, Homo sapiens
gtgtcagtggggctctctga

SEQ ID NO: 4656796 - DNA, 21 bp, Homo sapiens
gtgtcatataaactcatttat

SEQ ID NO: 4656797 - DNA, 15 bp, Homo sapiens
gtgtccacctgtggg

SEQ ID NO: 4656798 - DNA, 20 bp, Homo sapiens
gtgtcccttcccagcgctgc

SEQ ID NO: 4656799 - DNA, 19 bp, Homo sapiens
gtgtctaggcaggacctgt

SEQ ID NO: 4656800 - DNA, 23 bp, Homo sapiens
gtgtctgaatcatgtctgtatcc

SEQ ID NO: 4656801 - DNA, 13 bp, Homo sapiens
gtgtctgtacacg

SEQ ID NO: 4656802 - DNA, 22 bp, Homo sapiens
gtgtctgtacacgtgtcctgta

SEQ ID NO: 4656803 - DNA, 17 bp, Homo sapiens
gtgtgaaatctgtcttt

SEQ ID NO: 4656804 - DNA, 18 bp, Homo sapiens
gtgtgaaatctgtctttg

SEQ ID NO: 4656805 - DNA, 13 bp, Homo sapiens
gtgtgaaggtcct

SEQ ID NO: 4656806 - DNA, 16 bp, Homo sapiens
gtgtgaataaagtgct

SEQ ID NO: 4656807 - DNA, 11 bp, Homo sapiens
gtgtgaatgtg

SEQ ID NO: 4656808 - DNA, 13 bp, Homo sapiens
gtgtgacagggcc

SEQ ID NO: 4656809 - DNA, 23 bp, Homo sapiens
gtgtgacagggccagtggggcct

SEQ ID NO: 4656810 - DNA, 19 bp, Homo sapiens
gtgtgacagtttccaaatt

SEQ ID NO: 4656811 - DNA, 14 bp, Homo sapiens
gtgtgcacacccat

SEQ ID NO: 4656812 - DNA, 13 bp, Homo sapiens
gtgtgcagagcag

SEQ ID NO: 4656813 - DNA, 19 bp, Homo sapiens
taaaaccttgttctatttt

SEQ ID NO: 4656814 - DNA, 22 bp, Homo sapiens
taaaactaaggcttttatttct

SEQ ID NO: 4656815 - DNA, 16 bp, Homo sapiens
taaaactttattaaaa

SEQ ID NO: 4656816 - DNA, 20 bp, Homo sapiens
taaaagaatgagtgaagtat

SEQ ID NO: 4656817 - DNA, 13 bp, Homo sapiens
taaaagacttttt

SEQ ID NO: 4656818 - DNA, 19 bp, Homo sapiens
taaaagcacaatcactaaa

SEQ ID NO: 4656819 - DNA, 15 bp, Homo sapiens
taaaagcagggcagc

SEQ ID NO: 4656820 - DNA, 16 bp, Homo sapiens
taaaagcagggcagca

SEQ ID NO: 4656821 - DNA, 20 bp, Homo sapiens
taaaagtacatgttaaactt

SEQ ID NO: 4656822 - DNA, 19 bp, Homo sapiens
taaaagttttgaaggaaac

SEQ ID NO: 4656823 - DNA, 16 bp, Homo sapiens
taaaataaaatgaaaa

SEQ ID NO: 4656824 - DNA, 20 bp, Homo sapiens
taaaataaaatgaaaattgt

SEQ ID NO: 4656825 - DNA, 21 bp, Homo sapiens
taaaataaaatgaaaattgta

SEQ ID NO: 4656826 - DNA, 18 bp, Homo sapiens
taaaatagaataattctt

SEQ ID NO: 4656827 - DNA, 15 bp, Homo sapiens
taaaatagcaataac

SEQ ID NO: 4656828 - DNA, 21 bp, Homo sapiens
taaaatagcaataactgaaaa

SEQ ID NO: 4656829 - DNA, 23 bp, Homo sapiens
taaaatattttgttaacttttgt

SEQ ID NO: 4656830 - DNA, 17 bp, Homo sapiens
taaaatgaacatctctt

SEQ ID NO: 4656831 - DNA, 17 bp, Homo sapiens
taaaatgacaaacatga

SEQ ID NO: 4656832 - DNA, 15 bp, Homo sapiens
taaaatgcaatgtaa

SEQ ID NO: 4656833 - DNA, 15 bp, Homo sapiens
taaaatggaattgaa

SEQ ID NO: 4656834 - DNA, 21 bp, Homo sapiens
taaaatggtgaagaactagca

SEQ ID NO: 4656835 - DNA, 17 bp, Homo sapiens
taaaatgtttcattatg

SEQ ID NO: 4656836 - DNA, 23 bp, Homo sapiens
taaaattgagtttgtagaacttt

SEQ ID NO: 4656837 - DNA, 16 bp, Homo sapiens
taaaatttaaaaactt

SEQ ID NO: 4656838 - DNA, 23 bp, Homo sapiens
taaacacaacaataacttttata

SEQ ID NO: 4656839 - DNA, 13 bp, Homo sapiens
taaacagaaaact

SEQ ID NO: 4656840 - DNA, 19 bp, Homo sapiens
taaacagaaaactcccaat

SEQ ID NO: 4656841 - DNA, 19 bp, Homo sapiens
taaacagaagcctgtttca

SEQ ID NO: 4656842 - DNA, 15 bp, Homo sapiens
taaacataagtgtac

SEQ ID NO: 4656843 - DNA, 15 bp, Homo sapiens
taaacataatgaaaa

SEQ ID NO: 4656844 - DNA, 15 bp, Homo sapiens
taaacatatggcttt

SEQ ID NO: 4656845 - DNA, 18 bp, Homo sapiens
taaacatgtttaaagtgt

SEQ ID NO: 4656846 - DNA, 23 bp, Homo sapiens
taaaccagggatgtctgttgaaa

SEQ ID NO: 4656847 - DNA, 15 bp, Homo sapiens
taaaccattgtaact

SEQ ID NO: 4656848 - DNA, 15 bp, Homo sapiens
taaacctcagttatt

SEQ ID NO: 4656849 - DNA, 15 bp, Homo sapiens
taaacgtatgcatgt

SEQ ID NO: 4656850 - DNA, 20 bp, Homo sapiens
taaacgtatgcatgtgaaga

SEQ ID NO: 4656851 - DNA, 19 bp, Homo sapiens
taaactaggattggagtat

SEQ ID NO: 4656852 - DNA, 16 bp, Homo sapiens
taaactatttttttct

SEQ ID NO: 4656853 - DNA, 18 bp, Homo sapiens
taaactatttttttctta

SEQ ID NO: 4656854 - DNA, 21 bp, Homo sapiens
taaactcaaatgtaatagttt

SEQ ID NO: 4656855 - DNA, 15 bp, Homo sapiens
taaactgactatcat

SEQ ID NO: 4656856 - DNA, 14 bp, Homo sapiens
taaacttctgaaga

SEQ ID NO: 4656857 - DNA, 23 bp, Homo sapiens
taaacttctgaagactgagaact

SEQ ID NO: 4656858 - DNA, 22 bp, Homo sapiens
taaactttatttgtaaaccatt

SEQ ID NO: 4656859 - DNA, 23 bp, Homo sapiens
taaactttatttgtaaaccattg

SEQ ID NO: 4656860 - DNA, 14 bp, Homo sapiens
taaactttctccat

SEQ ID NO: 4656861 - DNA, 18 bp, Homo sapiens
taaactttctccatttaa

SEQ ID NO: 4656862 - DNA, 15 bp, Homo sapiens
taaagaaatgtctta

SEQ ID NO: 4656863 - DNA, 17 bp, Homo sapiens
taaagaaatgtcttaat

SEQ ID NO: 4656864 - DNA, 14 bp, Homo sapiens
taaagaagctttat

SEQ ID NO: 4656865 - DNA, 21 bp, Homo sapiens
taaagaagttcaaaccctgta

SEQ ID NO: 4656866 - DNA, 19 bp, Homo sapiens
taaagaatatgacttttta

SEQ ID NO: 4656867 - DNA, 13 bp, Homo sapiens
taaagactggttt

SEQ ID NO: 4656868 - DNA, 20 bp, Homo sapiens
taaagacttgtgcatccctc

SEQ ID NO: 4656869 - DNA, 20 bp, Homo sapiens
taaagattacccccagtcct

SEQ ID NO: 4656870 - DNA, 20 bp, Homo sapiens
taaagcaaactatgatttat

SEQ ID NO: 4656871 - DNA, 23 bp, Homo sapiens
taaagccacttctggcttcagcc

SEQ ID NO: 4656872 - DNA, 16 bp, Homo sapiens
taaagccatttcttat

SEQ ID NO: 4656873 - DNA, 18 bp, Homo sapiens
taaagccttttgctttat

SEQ ID NO: 4656874 - DNA, 16 bp, Homo sapiens
taaagctaaaaatatt

SEQ ID NO: 4656875 - DNA, 15 bp, Homo sapiens
taaagctagaaatga

SEQ ID NO: 4656876 - DNA, 12 bp, Homo sapiens
taaagctttata

SEQ ID NO: 4656877 - DNA, 15 bp, Homo sapiens
taaaggataactctg

SEQ ID NO: 4656878 - DNA, 14 bp, Homo sapiens
taaaggcttctctc

SEQ ID NO: 4656879 - DNA, 15 bp, Homo sapiens
taaaggcttctctct

SEQ ID NO: 4656880 - DNA, 13 bp, Homo sapiens
taaagggcagggc

SEQ ID NO: 4656881 - DNA, 22 bp, Homo sapiens
taaaggggagacctcagaagta

SEQ ID NO: 4656882 - DNA, 23 bp, Homo sapiens
taaaggtacgattatacttgaga

SEQ ID NO: 4656883 - DNA, 12 bp, Homo sapiens
taaagtacaaat

SEQ ID NO: 4656884 - DNA, 10 bp, Homo sapiens
taaagtattt

SEQ ID NO: 4656885 - DNA, 15 bp, Homo sapiens
taaagtatttataaa

SEQ ID NO: 4656886 - DNA, 17 bp, Homo sapiens
taaagtcaggtccaatt

SEQ ID NO: 4656887 - DNA, 13 bp, Homo sapiens
taaagtgttagat

SEQ ID NO: 4656888 - DNA, 16 bp, Homo sapiens
taaagttactttgtca

SEQ ID NO: 4656889 - DNA, 16 bp, Homo sapiens
taaagttgttgcattc

SEQ ID NO: 4656890 - DNA, 17 bp, Homo sapiens
taaagttgttgcattcc

SEQ ID NO: 4656891 - DNA, 15 bp, Homo sapiens
taaataaaaatatgt

SEQ ID NO: 4656892 - DNA, 21 bp, Homo sapiens
taaataaaacttaaatctcac

SEQ ID NO: 4656893 - DNA, 13 bp, Homo sapiens
taaataacttttt

SEQ ID NO: 4656894 - DNA, 16 bp, Homo sapiens
taaatacagcatactt

SEQ ID NO: 4656895 - DNA, 20 bp, Homo sapiens
taaatacagcatacttcaaa

SEQ ID NO: 4656896 - DNA, 15 bp, Homo sapiens
taaatagatgatttc

SEQ ID NO: 4656897 - DNA, 14 bp, Homo sapiens
taaatagcataaaa

SEQ ID NO: 4656898 - DNA, 18 bp, Homo sapiens
taaatagtgtcatataaa

SEQ ID NO: 4656899 - DNA, 22 bp, Homo sapiens
taaatatcaatcaagccatgta

SEQ ID NO: 4656900 - DNA, 15 bp, Homo sapiens
taaatatcattcttt

SEQ ID NO: 4656901 - DNA, 14 bp, Homo sapiens
taaatatggggata

SEQ ID NO: 4656902 - DNA, 22 bp, Homo sapiens
gtcacacccaccccctgcctgg

SEQ ID NO: 4656903 - DNA, 19 bp, Homo sapiens
gtcacagccgtttgaatat

SEQ ID NO: 4656904 - DNA, 20 bp, Homo sapiens
gtcacattatttattaaaaa

SEQ ID NO: 4656905 - DNA, 22 bp, Homo sapiens
gtcaccaatgtacccaccgggc

SEQ ID NO: 4656906 - DNA, 14 bp, Homo sapiens
gtcaccagctgctg

SEQ ID NO: 4656907 - DNA, 16 bp, Homo sapiens
gtcaccagctgctgtg

SEQ ID NO: 4656908 - DNA, 17 bp, Homo sapiens
gtcaccagctgctgtgc

SEQ ID NO: 4656909 - DNA, 16 bp, Homo sapiens
gtcaccaggggaggag

SEQ ID NO: 4656910 - DNA, 18 bp, Homo sapiens
gtcaccaggggaggagcc

SEQ ID NO: 4656911 - DNA, 22 bp, Homo sapiens
gtcaccaggggaggagcctgtg

SEQ ID NO: 4656912 - DNA, 13 bp, Homo sapiens
gtcacccagggac

SEQ ID NO: 4656913 - DNA, 13 bp, Homo sapiens
gtcacctcccatc

SEQ ID NO: 4656914 - DNA, 18 bp, Homo sapiens
gtcacctcgctgggctct

SEQ ID NO: 4656915 - DNA, 17 bp, Homo sapiens
gtcacttcttcacctct

SEQ ID NO: 4656916 - DNA, 22 bp, Homo sapiens
gtcacttcttcacctcttccac

SEQ ID NO: 4656917 - DNA, 21 bp, Homo sapiens
gtcacttgatcatgctgcagt

SEQ ID NO: 4656918 - DNA, 21 bp, Homo sapiens
gtcacttgctgctttttctgc

SEQ ID NO: 4656919 - DNA, 23 bp, Homo sapiens
gtcacttgctgctttttctgcgc

SEQ ID NO: 4656920 - DNA, 23 bp, Homo sapiens
gtcagaaaattggcagtggcaga

SEQ ID NO: 4656921 - DNA, 21 bp, Homo sapiens
gtcagaacaggtttttttgtt

SEQ ID NO: 4656922 - DNA, 20 bp, Homo sapiens
gtcagacataaagccatgtt

SEQ ID NO: 4656923 - DNA, 22 bp, Homo sapiens
gtcagactttgtgttcatttca

SEQ ID NO: 4656924 - DNA, 13 bp, Homo sapiens
gtcagccagggcc

SEQ ID NO: 4656925 - DNA, 16 bp, Homo sapiens
gtcagccagggcctgc

SEQ ID NO: 4656926 - DNA, 19 bp, Homo sapiens
gtcagcccatggaggcaga

SEQ ID NO: 4656927 - DNA, 10 bp, Homo sapiens
gtcagccttg

SEQ ID NO: 4656928 - DNA, 22 bp, Homo sapiens
gtcagctttggattgctggggc

SEQ ID NO: 4656929 - DNA, 20 bp, Homo sapiens
gtcaggatgttgctccatcc

SEQ ID NO: 4656930 - DNA, 13 bp, Homo sapiens
gtcagggagtgct

SEQ ID NO: 4656931 - DNA, 19 bp, Homo sapiens
gtcagggagtgctggctca

SEQ ID NO: 4656932 - DNA, 16 bp, Homo sapiens
gtcagggtttgtcaga

SEQ ID NO: 4656933 - DNA, 14 bp, Homo sapiens
gtcagtcacagcca

SEQ ID NO: 4656934 - DNA, 16 bp, Homo sapiens
gtcagtcacagccacc

SEQ ID NO: 4656935 - DNA, 18 bp, Homo sapiens
gtcagtggggctctctga

SEQ ID NO: 4656936 - DNA, 20 bp, Homo sapiens
gtcatatcactaaataaaca

SEQ ID NO: 4656937 - DNA, 16 bp, Homo sapiens
gtcatcagccagcaag

SEQ ID NO: 4656938 - DNA, 20 bp, Homo sapiens
gtcatcatcagggcctgggg

SEQ ID NO: 4656939 - DNA, 20 bp, Homo sapiens
gtcatgaattcatactctgt

SEQ ID NO: 4656940 - DNA, 22 bp, Homo sapiens
gtcatgaattcatactctgttg

SEQ ID NO: 4656941 - DNA, 20 bp, Homo sapiens
gtcatgagcgtcaaagaaaa

SEQ ID NO: 4656942 - DNA, 14 bp, Homo sapiens
gtcatgtctgcttg

SEQ ID NO: 4656943 - DNA, 12 bp, Homo sapiens
gtcattatgaca

SEQ ID NO: 4656944 - DNA, 21 bp, Homo sapiens
gtcattatgacatttcttaaa

SEQ ID NO: 4656945 - DNA, 13 bp, Homo sapiens
gtcattctttatt

SEQ ID NO: 4656946 - DNA, 12 bp, Homo sapiens
gtcattgtcata

SEQ ID NO: 4656947 - DNA, 12 bp, Homo sapiens
gtcatttcattc

SEQ ID NO: 4656948 - DNA, 15 bp, Homo sapiens
gtcatttcattccat

SEQ ID NO: 4656949 - DNA, 20 bp, Homo sapiens
gtcatttcattccattgcct

SEQ ID NO: 4656950 - DNA, 20 bp, Homo sapiens
gtcattttatgaatatcatt

SEQ ID NO: 4656951 - DNA, 16 bp, Homo sapiens
gtcattttattttgta

SEQ ID NO: 4656952 - DNA, 15 bp, Homo sapiens
gtccaagctgggaga

SEQ ID NO: 4656953 - DNA, 23 bp, Homo sapiens
gtccacctgtgggtgtagccagg

SEQ ID NO: 4656954 - DNA, 17 bp, Homo sapiens
gtccagctgagcgccag

SEQ ID NO: 4656955 - DNA, 15 bp, Homo sapiens
gtccaggtcctggtg

SEQ ID NO: 4656956 - DNA, 21 bp, Homo sapiens
gtccaggtcctggtggggcag

SEQ ID NO: 4656957 - DNA, 22 bp, Homo sapiens
gtccaggtcctggtggggcagc

SEQ ID NO: 4656958 - DNA, 11 bp, Homo sapiens
gtccatcttgt

SEQ ID NO: 4656959 - DNA, 23 bp, Homo sapiens
gtcccaaggagggggcctcattg

SEQ ID NO: 4656960 - DNA, 15 bp, Homo sapiens
gtcccacatccctgg

SEQ ID NO: 4656961 - DNA, 17 bp, Homo sapiens
gtcccacatccctgggc

SEQ ID NO: 4656962 - DNA, 18 bp, Homo sapiens
gtcccacatccctgggcc

SEQ ID NO: 4656963 - DNA, 22 bp, Homo sapiens
gtcccacatccctgggcctgct

SEQ ID NO: 4656964 - DNA, 22 bp, Homo sapiens
gtcccagcatccctggagcagg

SEQ ID NO: 4656965 - DNA, 15 bp, Homo sapiens
gtcccagccctgggg

SEQ ID NO: 4656966 - DNA, 14 bp, Homo sapiens
gtacatgtgtgcag

SEQ ID NO: 4656967 - DNA, 22 bp, Homo sapiens
gtacatgtgtgcagagcagaca

SEQ ID NO: 4656968 - DNA, 23 bp, Homo sapiens
gtacatgtgtgcagagcagacag

SEQ ID NO: 4656969 - DNA, 15 bp, Homo sapiens
gtacattatgaagaa

SEQ ID NO: 4656970 - DNA, 14 bp, Homo sapiens
gtacattctagctg

SEQ ID NO: 4656971 - DNA, 14 bp, Homo sapiens
gtacattctgccta

SEQ ID NO: 4656972 - DNA, 21 bp, Homo sapiens
gtacattctgcctagagtgta

SEQ ID NO: 4656973 - DNA, 19 bp, Homo sapiens
gtaccaaagaaacaccact

SEQ ID NO: 4656974 - DNA, 19 bp, Homo sapiens
gtacccaccgggccactcc

SEQ ID NO: 4656975 - DNA, 12 bp, Homo sapiens
gtacctgtgtgt

SEQ ID NO: 4656976 - DNA, 20 bp, Homo sapiens
gtactaagggaacaatccat

SEQ ID NO: 4656977 - DNA, 14 bp, Homo sapiens
gtactctttaacat

SEQ ID NO: 4656978 - DNA, 15 bp, Homo sapiens
gtactgatgagtctt

SEQ ID NO: 4656979 - DNA, 15 bp, Homo sapiens
gtactgttcatacag

SEQ ID NO: 4656980 - DNA, 13 bp, Homo sapiens
gtacttcctctgt

SEQ ID NO: 4656981 - DNA, 21 bp, Homo sapiens
gtacttcctctgtgaactgtg

SEQ ID NO: 4656982 - DNA, 16 bp, Homo sapiens
gtacttgtcaaagaag

SEQ ID NO: 4656983 - DNA, 19 bp, Homo sapiens
gtactttggaaagccaagg

SEQ ID NO: 4656984 - DNA, 20 bp, Homo sapiens
gtacttttcattctctttta

SEQ ID NO: 4656985 - DNA, 21 bp, Homo sapiens
gtacttttcattctcttttaa

SEQ ID NO: 4656986 - DNA, 16 bp, Homo sapiens
gtagaactcactctgg

SEQ ID NO: 4656987 - DNA, 17 bp, Homo sapiens
gtagaactcactctggg

SEQ ID NO: 4656988 - DNA, 19 bp, Homo sapiens
gtagaactcactctgggct

SEQ ID NO: 4656989 - DNA, 20 bp, Homo sapiens
gtagaactcactctgggctg

SEQ ID NO: 4656990 - DNA, 22 bp, Homo sapiens
gtagaactcactctgggctgta

SEQ ID NO: 4656991 - DNA, 19 bp, Homo sapiens
gtagaatagcctgtggcct

SEQ ID NO: 4656992 - DNA, 19 bp, Homo sapiens
gtagactcttgctcctgct

SEQ ID NO: 4656993 - DNA, 12 bp, Homo sapiens
gtagagaatgtg

SEQ ID NO: 4656994 - DNA, 14 bp, Homo sapiens
gtagagaatgtgtg

SEQ ID NO: 4656995 - DNA, 21 bp, Homo sapiens
gtagagaatgtgtgtagatac

SEQ ID NO: 4656996 - DNA, 21 bp, Homo sapiens
gtagatgggagggaggctcag

SEQ ID NO: 4656997 - DNA, 15 bp, Homo sapiens
gtagccagcacacag

SEQ ID NO: 4656998 - DNA, 18 bp, Homo sapiens
gtagccagcacacagggc

SEQ ID NO: 4656999 - DNA, 21 bp, Homo sapiens
gtagccagccggggcgagtgg

SEQ ID NO: 4657000 - DNA, 18 bp, Homo sapiens
gtagccaggtatggctct

SEQ ID NO: 4657001 - DNA, 20 bp, Homo sapiens
gtagcctaaagggcagggcc

SEQ ID NO: 4657002 - DNA, 15 bp, Homo sapiens
gtagctatagttgca

SEQ ID NO: 4657003 - DNA, 21 bp, Homo sapiens
gtagctatagttgcagcccaa

SEQ ID NO: 4657004 - DNA, 13 bp, Homo sapiens
gtagctcaaaaat

SEQ ID NO: 4657005 - DNA, 13 bp, Homo sapiens
gtagctcttagac

SEQ ID NO: 4657006 - DNA, 11 bp, Homo sapiens
gtagctgagct

SEQ ID NO: 4657007 - DNA, 21 bp, Homo sapiens
gtagctgagctcacaaggcag

SEQ ID NO: 4657008 - DNA, 20 bp, Homo sapiens
gtagctgtaagggcagtgcc

SEQ ID NO: 4657009 - DNA, 21 bp, Homo sapiens
gtagcttctcttgctctcgac

SEQ ID NO: 4657010 - DNA, 21 bp, Homo sapiens
gtaggatttttttcctcccca

SEQ ID NO: 4657011 - DNA, 19 bp, Homo sapiens
gtaggccccacaaggcctg

SEQ ID NO: 4657012 - DNA, 19 bp, Homo sapiens
gtaggttgggacaccaggg

SEQ ID NO: 4657013 - DNA, 14 bp, Homo sapiens
gtagtccttggcat

SEQ ID NO: 4657014 - DNA, 15 bp, Homo sapiens
gtagttaaataactg

SEQ ID NO: 4657015 - DNA, 15 bp, Homo sapiens
gtagttccctctgcc

SEQ ID NO: 4657016 - DNA, 20 bp, Homo sapiens
gtagttccctctgcctggga

SEQ ID NO: 4657017 - DNA, 22 bp, Homo sapiens
gtataattttttaaagttactt

SEQ ID NO: 4657018 - DNA, 17 bp, Homo sapiens
gtataggagccccaggc

SEQ ID NO: 4657019 - DNA, 15 bp, Homo sapiens
gtatagtatctgtat

SEQ ID NO: 4657020 - DNA, 12 bp, Homo sapiens
gtatatgtatta

SEQ ID NO: 4657021 - DNA, 19 bp, Homo sapiens
gtatattatgtttatttca

SEQ ID NO: 4657022 - DNA, 18 bp, Homo sapiens
gtatatttgttgggaaag

SEQ ID NO: 4657023 - DNA, 17 bp, Homo sapiens
gtatcatgccctgtgca

SEQ ID NO: 4657024 - DNA, 21 bp, Homo sapiens
gtatccaaggaaacattttat

SEQ ID NO: 4657025 - DNA, 16 bp, Homo sapiens
gtatccccagtgcccg

SEQ ID NO: 4657026 - DNA, 11 bp, Homo sapiens
gggctctggac

SEQ ID NO: 4657027 - DNA, 15 bp, Homo sapiens
gggctctggactcca

SEQ ID NO: 4657028 - DNA, 17 bp, Homo sapiens
gggctgaatcttctgga

SEQ ID NO: 4657029 - DNA, 22 bp, Homo sapiens
gggctgactctccagggagctg

SEQ ID NO: 4657030 - DNA, 14 bp, Homo sapiens
gggctgccctgaga

SEQ ID NO: 4657031 - DNA, 17 bp, Homo sapiens
gggctgccttctggcct

SEQ ID NO: 4657032 - DNA, 14 bp, Homo sapiens
gggctggagaaaga

SEQ ID NO: 4657033 - DNA, 21 bp, Homo sapiens
gggctggagaaagagctgcct

SEQ ID NO: 4657034 - DNA, 24 bp, Homo sapiens
gggctggagaaagagctgcctgga

SEQ ID NO: 4657035 - DNA, 13 bp, Homo sapiens
gggctgggaagtc

SEQ ID NO: 4657036 - DNA, 23 bp, Homo sapiens
gggctgggccctctttccctgcg

SEQ ID NO: 4657037 - DNA, 16 bp, Homo sapiens
gggctggggatgcgcc

SEQ ID NO: 4657038 - DNA, 14 bp, Homo sapiens
gggctggttctgta

SEQ ID NO: 4657039 - DNA, 19 bp, Homo sapiens
gggctgtaacgtggcactg

SEQ ID NO: 4657040 - DNA, 15 bp, Homo sapiens
gggcttggcccagcg

SEQ ID NO: 4657041 - DNA, 21 bp, Homo sapiens
ggggaatgagcccagagaaca

SEQ ID NO: 4657042 - DNA, 23 bp, Homo sapiens
ggggaatgagcccagagaacagc

SEQ ID NO: 4657043 - DNA, 15 bp, Homo sapiens
ggggactagacagtt

SEQ ID NO: 4657044 - DNA, 22 bp, Homo sapiens
ggggagaggggtcacacccacc

SEQ ID NO: 4657045 - DNA, 14 bp, Homo sapiens
ggggagcagtggcc

SEQ ID NO: 4657046 - DNA, 17 bp, Homo sapiens
ggggatagtctgggtca

SEQ ID NO: 4657047 - DNA, 13 bp, Homo sapiens
ggggatccagcca

SEQ ID NO: 4657048 - DNA, 17 bp, Homo sapiens
ggggattttaaaactct

SEQ ID NO: 4657049 - DNA, 23 bp, Homo sapiens
ggggccactttcagagcccccag

SEQ ID NO: 4657050 - DNA, 17 bp, Homo sapiens
ggggcccatgaaagagg

SEQ ID NO: 4657051 - DNA, 18 bp, Homo sapiens
ggggccccgccagggctg

SEQ ID NO: 4657052 - DNA, 20 bp, Homo sapiens
ggggccccgccagggctggg

SEQ ID NO: 4657053 - DNA, 21 bp, Homo sapiens
ggggccccgccagggctgggg

SEQ ID NO: 4657054 - DNA, 10 bp, Homo sapiens
ggggccctgc

SEQ ID NO: 4657055 - DNA, 11 bp, Homo sapiens
ggggccctgct

SEQ ID NO: 4657056 - DNA, 18 bp, Homo sapiens
ggggccgccacggcctgg

SEQ ID NO: 4657057 - DNA, 19 bp, Homo sapiens
ggggccgccacggcctggc

SEQ ID NO: 4657058 - DNA, 11 bp, Homo sapiens
ggggcctggct

SEQ ID NO: 4657059 - DNA, 22 bp, Homo sapiens
ggggcctggctggctgagggca

SEQ ID NO: 4657060 - DNA, 19 bp, Homo sapiens
ggggcctgtactgcctgct

SEQ ID NO: 4657061 - DNA, 20 bp, Homo sapiens
ggggccttagggcactgggc

SEQ ID NO: 4657062 - DNA, 19 bp, Homo sapiens
ggggcgggcggagggaggg

SEQ ID NO: 4657063 - DNA, 20 bp, Homo sapiens
ggggctctaacgcctgagcc

SEQ ID NO: 4657064 - DNA, 21 bp, Homo sapiens
ggggctctaacgcctgagccc

SEQ ID NO: 4657065 - DNA, 16 bp, Homo sapiens
ggggctctgccccagg

SEQ ID NO: 4657066 - DNA, 20 bp, Homo sapiens
ggggctctgggtgctgccct

SEQ ID NO: 4657067 - DNA, 21 bp, Homo sapiens
gggggaatgagcccagagaac

SEQ ID NO: 4657068 - DNA, 22 bp, Homo sapiens
gggggagccccttctgctcagc

SEQ ID NO: 4657069 - DNA, 22 bp, Homo sapiens
gggggccccgccagggctgggg

SEQ ID NO: 4657070 - DNA, 11 bp, Homo sapiens
gggggccctgc

SEQ ID NO: 4657071 - DNA, 12 bp, Homo sapiens
gggggcctggct

SEQ ID NO: 4657072 - DNA, 15 bp, Homo sapiens
gggggcctggctggc

SEQ ID NO: 4657073 - DNA, 17 bp, Homo sapiens
gggggcctggctggctg

SEQ ID NO: 4657074 - DNA, 12 bp, Homo sapiens
gggggctgtgcc

SEQ ID NO: 4657075 - DNA, 13 bp, Homo sapiens
gggggctgtgcca

SEQ ID NO: 4657076 - DNA, 22 bp, Homo sapiens
gggggtgatgagggcagcagcc

SEQ ID NO: 4657077 - DNA, 19 bp, Homo sapiens
gggggtgtttctatctctt

SEQ ID NO: 4657078 - DNA, 16 bp, Homo sapiens
ggggtcaagctgagct

SEQ ID NO: 4657079 - DNA, 18 bp, Homo sapiens
ggggtcgtggagagctag

SEQ ID NO: 4657080 - DNA, 19 bp, Homo sapiens
ggggtcgtggagagctagg

SEQ ID NO: 4657081 - DNA, 23 bp, Homo sapiens
ggggtgacccggcaccccctgca

SEQ ID NO: 4657082 - DNA, 23 bp, Homo sapiens
ggtgcagacagaagtctcctcaa

SEQ ID NO: 4657083 - DNA, 14 bp, Homo sapiens
ggtgcagggcctgg

SEQ ID NO: 4657084 - DNA, 15 bp, Homo sapiens
ggtgccaccaccctg

SEQ ID NO: 4657085 - DNA, 21 bp, Homo sapiens
ggtgccaccaccctgcccccc

SEQ ID NO: 4657086 - DNA, 20 bp, Homo sapiens
ggtgccacccagtagcccag

SEQ ID NO: 4657087 - DNA, 10 bp, Homo sapiens
ggtgccacct

SEQ ID NO: 4657088 - DNA, 17 bp, Homo sapiens
ggtgcccactccgccag

SEQ ID NO: 4657089 - DNA, 18 bp, Homo sapiens
ggtgcccactccgccagc

SEQ ID NO: 4657090 - DNA, 21 bp, Homo sapiens
ggtgcccactccgccagccac

SEQ ID NO: 4657091 - DNA, 16 bp, Homo sapiens
ggtgcctttgagttct

SEQ ID NO: 4657092 - DNA, 21 bp, Homo sapiens
ggtgctgacttcatctcccac

SEQ ID NO: 4657093 - DNA, 12 bp, Homo sapiens
ggtgctgcagga

SEQ ID NO: 4657094 - DNA, 22 bp, Homo sapiens
ggtgctgtcttttgttctctga

SEQ ID NO: 4657095 - DNA, 13 bp, Homo sapiens
ggtgcttggaggg

SEQ ID NO: 4657096 - DNA, 14 bp, Homo sapiens
ggtgcttggagggg

SEQ ID NO: 4657097 - DNA, 18 bp, Homo sapiens
ggtgcttggagggggaag

SEQ ID NO: 4657098 - DNA, 22 bp, Homo sapiens
ggtggcacttccacctccagcc

SEQ ID NO: 4657099 - DNA, 11 bp, Homo sapiens
ggtggcctcag

SEQ ID NO: 4657100 - DNA, 14 bp, Homo sapiens
ggtggctactctgt

SEQ ID NO: 4657101 - DNA, 22 bp, Homo sapiens
ggtggctactctgtgccagagc

SEQ ID NO: 4657102 - DNA, 18 bp, Homo sapiens
ggtgggcctggccctgct

SEQ ID NO: 4657103 - DNA, 13 bp, Homo sapiens
ggtggggcagctc

SEQ ID NO: 4657104 - DNA, 15 bp, Homo sapiens
ggtggggcagctcct

SEQ ID NO: 4657105 - DNA, 14 bp, Homo sapiens
ggtggggggacagg

SEQ ID NO: 4657106 - DNA, 14 bp, Homo sapiens
ggtgggtgctcaga

SEQ ID NO: 4657107 - DNA, 15 bp, Homo sapiens
ggtgtcacattcctg

SEQ ID NO: 4657108 - DNA, 17 bp, Homo sapiens
ggtgtcatttcattcca

SEQ ID NO: 4657109 - DNA, 19 bp, Homo sapiens
ggtgttcaccaaaaccaaa

SEQ ID NO: 4657110 - DNA, 19 bp, Homo sapiens
ggtgttttttatgaagtgc

SEQ ID NO: 4657111 - DNA, 22 bp, Homo sapiens
ggttaccactcttttgctgtgc

SEQ ID NO: 4657112 - DNA, 13 bp, Homo sapiens
ggttatacaataa

SEQ ID NO: 4657113 - DNA, 23 bp, Homo sapiens
ggttatacaataacccagttact

SEQ ID NO: 4657114 - DNA, 15 bp, Homo sapiens
ggttatcttgttatt

SEQ ID NO: 4657115 - DNA, 17 bp, Homo sapiens
ggttattaaactgaata

SEQ ID NO: 4657116 - DNA, 11 bp, Homo sapiens
ggttcatgctt

SEQ ID NO: 4657117 - DNA, 15 bp, Homo sapiens
ggttcatgcttctac

SEQ ID NO: 4657118 - DNA, 20 bp, Homo sapiens
ggttccccaagggccctggc

SEQ ID NO: 4657119 - DNA, 12 bp, Homo sapiens
ggttctgaagcc

SEQ ID NO: 4657120 - DNA, 12 bp, Homo sapiens
ggttctgcctct

SEQ ID NO: 4657121 - DNA, 22 bp, Homo sapiens
ggttgacctttaaatgcaacag

SEQ ID NO: 4657122 - DNA, 13 bp, Homo sapiens
ggttgcctggggg

SEQ ID NO: 4657123 - DNA, 17 bp, Homo sapiens
ggtttaattctgtcttg

SEQ ID NO: 4657124 - DNA, 21 bp, Homo sapiens
ggtttcaaactcctgacctca

SEQ ID NO: 4657125 - DNA, 21 bp, Homo sapiens
ggtttcaacaaatttcattgc

SEQ ID NO: 4657126 - DNA, 19 bp, Homo sapiens
ggtttccaaagaatatttt

SEQ ID NO: 4657127 - DNA, 17 bp, Homo sapiens
ggtttgccggtggtgca

SEQ ID NO: 4657128 - DNA, 18 bp, Homo sapiens
ggtttgtggcgtctccct

SEQ ID NO: 4657129 - DNA, 12 bp, Homo sapiens
ggtttttagaga

SEQ ID NO: 4657130 - DNA, 15 bp, Homo sapiens
ggtttttagagaatg

SEQ ID NO: 4657131 - DNA, 22 bp, Homo sapiens
ggtttttagagaatgtgtttca

SEQ ID NO: 4657132 - DNA, 17 bp, Homo sapiens
gtaaaacctgttctcca

SEQ ID NO: 4657133 - DNA, 15 bp, Homo sapiens
gtaaaagactttttt

SEQ ID NO: 4657134 - DNA, 19 bp, Homo sapiens
gtaaacagcctctttttga

SEQ ID NO: 4657135 - DNA, 15 bp, Homo sapiens
gtaaactatttatct

SEQ ID NO: 4657136 - DNA, 15 bp, Homo sapiens
gtaaacttggaatca

SEQ ID NO: 4657137 - DNA, 13 bp, Homo sapiens
gtaaagaaatgtc

SEQ ID NO: 4657138 - DNA, 19 bp, Homo sapiens
gtaaagactggttttctgc

SEQ ID NO: 4657139 - DNA, 18 bp, Homo sapiens
ggcgccccaacccgtgga

SEQ ID NO: 4657140 - DNA, 23 bp, Homo sapiens
ggcgccccaacccgtggaggctg

SEQ ID NO: 4657141 - DNA, 17 bp, Homo sapiens
ggcgcctttttggcctg

SEQ ID NO: 4657142 - DNA, 15 bp, Homo sapiens
ggcggagggagggga

SEQ ID NO: 4657143 - DNA, 20 bp, Homo sapiens
ggcggaggggatccagccac

SEQ ID NO: 4657144 - DNA, 21 bp, Homo sapiens
ggcggaggggatccagccact

SEQ ID NO: 4657145 - DNA, 18 bp, Homo sapiens
ggcggctcggaggaagcc

SEQ ID NO: 4657146 - DNA, 19 bp, Homo sapiens
ggcggctctagccccagcg

SEQ ID NO: 4657147 - DNA, 16 bp, Homo sapiens
ggctacaaagcagaga

SEQ ID NO: 4657148 - DNA, 21 bp, Homo sapiens
ggctaccagaagaggggcagc

SEQ ID NO: 4657149 - DNA, 20 bp, Homo sapiens
ggctactccctggaccacga

SEQ ID NO: 4657150 - DNA, 13 bp, Homo sapiens
ggctactctgtgc

SEQ ID NO: 4657151 - DNA, 15 bp, Homo sapiens
ggctactctgtgcca

SEQ ID NO: 4657152 - DNA, 20 bp, Homo sapiens
ggctactctgtgccagagcc

SEQ ID NO: 4657153 - DNA, 23 bp, Homo sapiens
ggctacttcggggctgggaagtc

SEQ ID NO: 4657154 - DNA, 13 bp, Homo sapiens
ggctagagggccc

SEQ ID NO: 4657155 - DNA, 13 bp, Homo sapiens
ggctatcctggga

SEQ ID NO: 4657156 - DNA, 14 bp, Homo sapiens
ggctatcctgggac

SEQ ID NO: 4657157 - DNA, 18 bp, Homo sapiens
ggctcaagctttcccgcc

SEQ ID NO: 4657158 - DNA, 22 bp, Homo sapiens
ggctcactgcaacctctgcctc

SEQ ID NO: 4657159 - DNA, 15 bp, Homo sapiens
ggctcagcagggctg

SEQ ID NO: 4657160 - DNA, 21 bp, Homo sapiens
ggctcagtgcaacctctgctt

SEQ ID NO: 4657161 - DNA, 16 bp, Homo sapiens
ggctcatttttgcact

SEQ ID NO: 4657162 - DNA, 17 bp, Homo sapiens
ggctccagatgcagggc

SEQ ID NO: 4657163 - DNA, 12 bp, Homo sapiens
ggctccctctct

SEQ ID NO: 4657164 - DNA, 14 bp, Homo sapiens
ggctccctctctcc

SEQ ID NO: 4657165 - DNA, 16 bp, Homo sapiens
ggctccctggggggag

SEQ ID NO: 4657166 - DNA, 21 bp, Homo sapiens
ggctcgaggggctcagggcct

SEQ ID NO: 4657167 - DNA, 16 bp, Homo sapiens
ggctctcctggcttcc

SEQ ID NO: 4657168 - DNA, 12 bp, Homo sapiens
ggctctctgagt

SEQ ID NO: 4657169 - DNA, 19 bp, Homo sapiens
ggctctgagttctggggtg

SEQ ID NO: 4657170 - DNA, 18 bp, Homo sapiens
ggctgaactacaagtgta

SEQ ID NO: 4657171 - DNA, 13 bp, Homo sapiens
ggctgaagagagg

SEQ ID NO: 4657172 - DNA, 15 bp, Homo sapiens
ggctgaccacagcac

SEQ ID NO: 4657173 - DNA, 17 bp, Homo sapiens
ggctgacccagcatctc

SEQ ID NO: 4657174 - DNA, 20 bp, Homo sapiens
ggctgacccagcatctccca

SEQ ID NO: 4657175 - DNA, 22 bp, Homo sapiens
ggctgacggtgcagtctgggtg

SEQ ID NO: 4657176 - DNA, 17 bp, Homo sapiens
ggctgactctccaggga

SEQ ID NO: 4657177 - DNA, 18 bp, Homo sapiens
ggctgaggctggcacagg

SEQ ID NO: 4657178 - DNA, 21 bp, Homo sapiens
ggctgagggcagttcgcagcc

SEQ ID NO: 4657179 - DNA, 20 bp, Homo sapiens
ggctgattcagcatttttta

SEQ ID NO: 4657180 - DNA, 21 bp, Homo sapiens
ggctgccatctcacctcctgc

SEQ ID NO: 4657181 - DNA, 19 bp, Homo sapiens
ggctgcccatcatgtggcc

SEQ ID NO: 4657182 - DNA, 14 bp, Homo sapiens
ggctgccctgagaa

SEQ ID NO: 4657183 - DNA, 19 bp, Homo sapiens
ggctgctctttccacttgc

SEQ ID NO: 4657184 - DNA, 20 bp, Homo sapiens
ggctgctgcacaccaaggcc

SEQ ID NO: 4657185 - DNA, 23 bp, Homo sapiens
ggctgctgcacaccaaggccctg

SEQ ID NO: 4657186 - DNA, 19 bp, Homo sapiens
ggctggagaaagagctgcc

SEQ ID NO: 4657187 - DNA, 19 bp, Homo sapiens
ggctggagtgcagtggcgt

SEQ ID NO: 4657188 - DNA, 14 bp, Homo sapiens
ggctggcacaggac

SEQ ID NO: 4657189 - DNA, 15 bp, Homo sapiens
ggctggcacaggaca

SEQ ID NO: 4657190 - DNA, 24 bp, Homo sapiens
ggctggctccagatgcagggcagt

SEQ ID NO: 4657191 - DNA, 23 bp, Homo sapiens
ggctgggacgtggctcagccagc

SEQ ID NO: 4657192 - DNA, 18 bp, Homo sapiens
ggctgggccctctttccc

SEQ ID NO: 4657193 - DNA, 16 bp, Homo sapiens
ggctggtcacctccca

SEQ ID NO: 4657194 - DNA, 17 bp, Homo sapiens
ggctggtcacctcccat

SEQ ID NO: 4657195 - DNA, 17 bp, Homo sapiens
ggctggtggtcatgaat

SEQ ID NO: 4657196 - DNA, 20 bp, Homo sapiens
ggctgtgttatgaaaatata

SEQ ID NO: 4657197 - DNA, 16 bp, Homo sapiens
ggcttccctacacagg

SEQ ID NO: 4657198 - DNA, 16 bp, Homo sapiens
ggcttctcctcctctg

SEQ ID NO: 4657199 - DNA, 12 bp, Homo sapiens
ggcttctctctc

SEQ ID NO: 4657200 - DNA, 15 bp, Homo sapiens
ggcttctctctcacc

SEQ ID NO: 4657201 - DNA, 18 bp, Homo sapiens
ggctttatgcaaatacaa

SEQ ID NO: 4657202 - DNA, 14 bp, Homo sapiens
ggctttcctgctgg

SEQ ID NO: 4657203 - DNA, 14 bp, Homo sapiens
ggctttctgggctc

SEQ ID NO: 4657204 - DNA, 20 bp, Homo sapiens
ggctttctgggctctggact

SEQ ID NO: 4657205 - DNA, 13 bp, Homo sapiens
gggccagagcagc

SEQ ID NO: 4657206 - DNA, 17 bp, Homo sapiens
gggccaggagtggggag

SEQ ID NO: 4657207 - DNA, 12 bp, Homo sapiens
gggccaggcccc

SEQ ID NO: 4657208 - DNA, 13 bp, Homo sapiens
gggccaggcccca

SEQ ID NO: 4657209 - DNA, 14 bp, Homo sapiens
gggccaggccccat

SEQ ID NO: 4657210 - DNA, 12 bp, Homo sapiens
gggccagggctg

SEQ ID NO: 4657211 - DNA, 16 bp, Homo sapiens
gggccagtggggcctg

SEQ ID NO: 4657212 - DNA, 18 bp, Homo sapiens
gggccagtggggcctgtg

SEQ ID NO: 4657213 - DNA, 20 bp, Homo sapiens
gggccagtggggcctgtgga

SEQ ID NO: 4657214 - DNA, 17 bp, Homo sapiens
gggccatctgactgcca

SEQ ID NO: 4657215 - DNA, 23 bp, Homo sapiens
gggccatctgactgccaagccag

SEQ ID NO: 4657216 - DNA, 15 bp, Homo sapiens
gggccatgaactttg

SEQ ID NO: 4657217 - DNA, 14 bp, Homo sapiens
gggcccccatctca

SEQ ID NO: 4657218 - DNA, 21 bp, Homo sapiens
gggccccgccagggctgggga

SEQ ID NO: 4657219 - DNA, 13 bp, Homo sapiens
gggccctcccagc

SEQ ID NO: 4657220 - DNA, 12 bp, Homo sapiens
gggccctggggc

SEQ ID NO: 4657221 - DNA, 17 bp, Homo sapiens
gggccctggggcctgta

SEQ ID NO: 4657222 - DNA, 14 bp, Homo sapiens
gggccgccacggcc

SEQ ID NO: 4657223 - DNA, 17 bp, Homo sapiens
gggccgccacggcctgg

SEQ ID NO: 4657224 - DNA, 18 bp, Homo sapiens
gggccgccacggcctggc

SEQ ID NO: 4657225 - DNA, 16 bp, Homo sapiens
gggcctatggagagcc

SEQ ID NO: 4657226 - DNA, 21 bp, Homo sapiens
gggcctatggagagccctggg

SEQ ID NO: 4657227 - DNA, 22 bp, Homo sapiens
gggcctatggagagccctggga

SEQ ID NO: 4657228 - DNA, 14 bp, Homo sapiens
gggcctcaggctct

SEQ ID NO: 4657229 - DNA, 17 bp, Homo sapiens
gggcctcaggctctgca

SEQ ID NO: 4657230 - DNA, 12 bp, Homo sapiens
gggcctgctgct

SEQ ID NO: 4657231 - DNA, 18 bp, Homo sapiens
gggcctgctgctgagaac

SEQ ID NO: 4657232 - DNA, 22 bp, Homo sapiens
gggcctgctgctgagaacctgg

SEQ ID NO: 4657233 - DNA, 15 bp, Homo sapiens
gggcctggagcccca

SEQ ID NO: 4657234 - DNA, 14 bp, Homo sapiens
gggcctggcataga

SEQ ID NO: 4657235 - DNA, 15 bp, Homo sapiens
gggcctggccctgct

SEQ ID NO: 4657236 - DNA, 15 bp, Homo sapiens
gggcctggctggctg

SEQ ID NO: 4657237 - DNA, 18 bp, Homo sapiens
gggcctggctggctgagg

SEQ ID NO: 4657238 - DNA, 22 bp, Homo sapiens
gggcctggctggctgagggcag

SEQ ID NO: 4657239 - DNA, 23 bp, Homo sapiens
gggcctggctggctgagggcagt

SEQ ID NO: 4657240 - DNA, 13 bp, Homo sapiens
gggcctggggcct

SEQ ID NO: 4657241 - DNA, 17 bp, Homo sapiens
gggcctggggcctgaga

SEQ ID NO: 4657242 - DNA, 18 bp, Homo sapiens
gggcctggggcctgagag

SEQ ID NO: 4657243 - DNA, 17 bp, Homo sapiens
gggcctgtactgcctgc

SEQ ID NO: 4657244 - DNA, 22 bp, Homo sapiens
gggcctgtggaatgagtgtgca

SEQ ID NO: 4657245 - DNA, 17 bp, Homo sapiens
gggccttagggcactgg

SEQ ID NO: 4657246 - DNA, 17 bp, Homo sapiens
gggccttagtgggccag

SEQ ID NO: 4657247 - DNA, 16 bp, Homo sapiens
gggctagggaggacca

SEQ ID NO: 4657248 - DNA, 19 bp, Homo sapiens
gggctatgtagtcataata

SEQ ID NO: 4657249 - DNA, 16 bp, Homo sapiens
gggctcagcagggctg

SEQ ID NO: 4657250 - DNA, 19 bp, Homo sapiens
gggctctaacgcctgagcc

SEQ ID NO: 4657251 - DNA, 22 bp, Homo sapiens
gggctctaacgcctgagcccag

SEQ ID NO: 4657252 - DNA, 12 bp, Homo sapiens
gggctctcctgg

SEQ ID NO: 4657253 - DNA, 11 bp, Homo sapiens
gggctctgagg

SEQ ID NO: 4657254 - DNA, 20 bp, Homo sapiens
gggctctgagttctggggtg

SEQ ID NO: 4657255 - DNA, 16 bp, Homo sapiens
ggcaggccgggcctgc

SEQ ID NO: 4657256 - DNA, 14 bp, Homo sapiens
ggcagggcccacgt

SEQ ID NO: 4657257 - DNA, 13 bp, Homo sapiens
ggcagggctctcc

SEQ ID NO: 4657258 - DNA, 20 bp, Homo sapiens
ggcagggctctcctggcttc

SEQ ID NO: 4657259 - DNA, 22 bp, Homo sapiens
ggcaggggagggtcagccaggg

SEQ ID NO: 4657260 - DNA, 22 bp, Homo sapiens
ggcagggggccccgccagggct

SEQ ID NO: 4657261 - DNA, 20 bp, Homo sapiens
ggcagtcattggctgtctcc

SEQ ID NO: 4657262 - DNA, 16 bp, Homo sapiens
ggcagtgagggagggc

SEQ ID NO: 4657263 - DNA, 13 bp, Homo sapiens
ggcagtgcccttt

SEQ ID NO: 4657264 - DNA, 18 bp, Homo sapiens
ggcagttcgcagccaccc

SEQ ID NO: 4657265 - DNA, 20 bp, Homo sapiens
ggcagttcgcagccaccctg

SEQ ID NO: 4657266 - DNA, 14 bp, Homo sapiens
ggcagttgcttgtg

SEQ ID NO: 4657267 - DNA, 14 bp, Homo sapiens
ggcatgagtctgtt

SEQ ID NO: 4657268 - DNA, 22 bp, Homo sapiens
ggcatgagtctgtttcccaagc

SEQ ID NO: 4657269 - DNA, 18 bp, Homo sapiens
ggcatgggaaggtgggcg

SEQ ID NO: 4657270 - DNA, 19 bp, Homo sapiens
ggcatggtggctcccgcct

SEQ ID NO: 4657271 - DNA, 20 bp, Homo sapiens
ggcattacttgctttcaatt

SEQ ID NO: 4657272 - DNA, 16 bp, Homo sapiens
ggcattcctgaaggga

SEQ ID NO: 4657273 - DNA, 15 bp, Homo sapiens
ggcattgacataggt

SEQ ID NO: 4657274 - DNA, 17 bp, Homo sapiens
ggcattgcactgcttat

SEQ ID NO: 4657275 - DNA, 16 bp, Homo sapiens
ggcatttcctgctgaa

SEQ ID NO: 4657276 - DNA, 12 bp, Homo sapiens
ggcatttcctgg

SEQ ID NO: 4657277 - DNA, 14 bp, Homo sapiens
ggcatttttgcttc

SEQ ID NO: 4657278 - DNA, 15 bp, Homo sapiens
ggccaaacccttgct

SEQ ID NO: 4657279 - DNA, 15 bp, Homo sapiens
ggccaaacctctgtt

SEQ ID NO: 4657280 - DNA, 16 bp, Homo sapiens
ggccaaacctctgttc

SEQ ID NO: 4657281 - DNA, 14 bp, Homo sapiens
ggccaaccagcccg

SEQ ID NO: 4657282 - DNA, 22 bp, Homo sapiens
ggccaagctgaggtgcccagga

SEQ ID NO: 4657283 - DNA, 13 bp, Homo sapiens
ggccacagccttc

SEQ ID NO: 4657284 - DNA, 16 bp, Homo sapiens
ggccacagccttccct

SEQ ID NO: 4657285 - DNA, 22 bp, Homo sapiens
ggccacagccttccctctgcat

SEQ ID NO: 4657286 - DNA, 14 bp, Homo sapiens
ggccaccgtgcctg

SEQ ID NO: 4657287 - DNA, 17 bp, Homo sapiens
ggccaccgtgcctggct

SEQ ID NO: 4657288 - DNA, 18 bp, Homo sapiens
ggccaccgtgcctggctg

SEQ ID NO: 4657289 - DNA, 14 bp, Homo sapiens
ggccaccttttcag

SEQ ID NO: 4657290 - DNA, 14 bp, Homo sapiens
ggccactccttcct

SEQ ID NO: 4657291 - DNA, 16 bp, Homo sapiens
ggccactccttcctgc

SEQ ID NO: 4657292 - DNA, 17 bp, Homo sapiens
ggccactccttcctgcc

SEQ ID NO: 4657293 - DNA, 17 bp, Homo sapiens
gcctgtggaatgagtgt

SEQ ID NO: 4657294 - DNA, 14 bp, Homo sapiens
gcctgtgggtctct

SEQ ID NO: 4657295 - DNA, 17 bp, Homo sapiens
gcctgtgggtctctgaa

SEQ ID NO: 4657296 - DNA, 18 bp, Homo sapiens
gcctgtgggtctctgaag

SEQ ID NO: 4657297 - DNA, 20 bp, Homo sapiens
gcctgtgtagctgtgacctg

SEQ ID NO: 4657298 - DNA, 21 bp, Homo sapiens
gcctgtgtagctgtgacctgc

SEQ ID NO: 4657299 - DNA, 14 bp, Homo sapiens
gcctgtgtctttaa

SEQ ID NO: 4657300 - DNA, 13 bp, Homo sapiens
gccttaaaatgga

SEQ ID NO: 4657301 - DNA, 19 bp, Homo sapiens
gccttaaaatggaattgaa

SEQ ID NO: 4657302 - DNA, 19 bp, Homo sapiens
gccttaaagagggacaggc

SEQ ID NO: 4657303 - DNA, 15 bp, Homo sapiens
gccttaacctgggac

SEQ ID NO: 4657304 - DNA, 17 bp, Homo sapiens
gccttaacctgggacca

SEQ ID NO: 4657305 - DNA, 17 bp, Homo sapiens
gccttagggcactgggc

SEQ ID NO: 4657306 - DNA, 23 bp, Homo sapiens
gccttataaacagataatgcttt

SEQ ID NO: 4657307 - DNA, 19 bp, Homo sapiens
gccttcagtttatttccac

SEQ ID NO: 4657308 - DNA, 14 bp, Homo sapiens
gccttccagttttg

SEQ ID NO: 4657309 - DNA, 22 bp, Homo sapiens
gccttgacaatgttgtcctcct

SEQ ID NO: 4657310 - DNA, 17 bp, Homo sapiens
gccttgggccctctggt

SEQ ID NO: 4657311 - DNA, 23 bp, Homo sapiens
gccttggggaggacaaaacttct

SEQ ID NO: 4657312 - DNA, 12 bp, Homo sapiens
gcctttaagcca

SEQ ID NO: 4657313 - DNA, 16 bp, Homo sapiens
gcctttaagccaaaga

SEQ ID NO: 4657314 - DNA, 18 bp, Homo sapiens
gcctttgcaagatgcttg

SEQ ID NO: 4657315 - DNA, 13 bp, Homo sapiens
gcctttgggcaca

SEQ ID NO: 4657316 - DNA, 17 bp, Homo sapiens
gccttttccacacgcat

SEQ ID NO: 4657317 - DNA, 12 bp, Homo sapiens
gccttttcctga

SEQ ID NO: 4657318 - DNA, 15 bp, Homo sapiens
gcgagtggatgctgt

SEQ ID NO: 4657319 - DNA, 19 bp, Homo sapiens
gcgagtggatgctgtgcta

SEQ ID NO: 4657320 - DNA, 13 bp, Homo sapiens
gcgatttgaaaca

SEQ ID NO: 4657321 - DNA, 15 bp, Homo sapiens
gcgcaacgctctgcg

SEQ ID NO: 4657322 - DNA, 13 bp, Homo sapiens
gcgcactgcctct

SEQ ID NO: 4657323 - DNA, 22 bp, Homo sapiens
gcgcactgtgacccccagctcc

SEQ ID NO: 4657324 - DNA, 12 bp, Homo sapiens
gcgcagctgcct

SEQ ID NO: 4657325 - DNA, 22 bp, Homo sapiens
gcgcatcctgcagggcttctcc

SEQ ID NO: 4657326 - DNA, 15 bp, Homo sapiens
gcgccatctcggctc

SEQ ID NO: 4657327 - DNA, 18 bp, Homo sapiens
gcgccccaacccgtggag

SEQ ID NO: 4657328 - DNA, 21 bp, Homo sapiens
gcgccccaacccgtggaggct

SEQ ID NO: 4657329 - DNA, 14 bp, Homo sapiens
gcgccctgcagacc

SEQ ID NO: 4657330 - DNA, 13 bp, Homo sapiens
gcgccgatgccac

SEQ ID NO: 4657331 - DNA, 14 bp, Homo sapiens
gcgccgatgccacc

SEQ ID NO: 4657332 - DNA, 18 bp, Homo sapiens
gcgccgatgccaccggcc

SEQ ID NO: 4657333 - DNA, 22 bp, Homo sapiens
gcgcctggcttacctatctgtg

SEQ ID NO: 4657334 - DNA, 19 bp, Homo sapiens
gcggacagtggcaggacag

SEQ ID NO: 4657335 - DNA, 17 bp, Homo sapiens
gcggagcaagaggaggc

SEQ ID NO: 4657336 - DNA, 21 bp, Homo sapiens
gcggaggggatccagccactt

SEQ ID NO: 4657337 - DNA, 13 bp, Homo sapiens
gcggatcctgctg

SEQ ID NO: 4657338 - DNA, 16 bp, Homo sapiens
gcggcccgcgcagctg

SEQ ID NO: 4657339 - DNA, 18 bp, Homo sapiens
gcggcctatgacttgggc

SEQ ID NO: 4657340 - DNA, 18 bp, Homo sapiens
gcgggcaggggagggtca

SEQ ID NO: 4657341 - DNA, 23 bp, Homo sapiens
gcggggatcagagcgcacaggga

SEQ ID NO: 4657342 - DNA, 15 bp, Homo sapiens
gcggggcctgtctca

SEQ ID NO: 4657343 - DNA, 13 bp, Homo sapiens
gcgggggcaggcc

SEQ ID NO: 4657344 - DNA, 22 bp, Homo sapiens
gcgggtgcaagcactcggggtc

SEQ ID NO: 4657345 - DNA, 15 bp, Homo sapiens
gcggtagccagcaca

SEQ ID NO: 4657346 - DNA, 21 bp, Homo sapiens
gcggtagccagcacacagggc

SEQ ID NO: 4657347 - DNA, 22 bp, Homo sapiens
gcggtagccagcacacagggca

SEQ ID NO: 4657348 - DNA, 23 bp, Homo sapiens
gcggtagccagcacacagggcag

SEQ ID NO: 4657349 - DNA, 13 bp, Homo sapiens
gcgtacacagaga

SEQ ID NO: 4657350 - DNA, 14 bp, Homo sapiens
gcgtacacagagaa

SEQ ID NO: 4657351 - DNA, 16 bp, Homo sapiens
gcgtcattacagggca

SEQ ID NO: 4657352 - DNA, 23 bp, Homo sapiens
gcgtcattacagggcacaggcca

SEQ ID NO: 4657353 - DNA, 12 bp, Homo sapiens
gcgtcccagctg

SEQ ID NO: 4657354 - DNA, 23 bp, Homo sapiens
gcgtcccagctgaaggcagtggc

SEQ ID NO: 4657355 - DNA, 15 bp, Homo sapiens
gcgtctaccctggga

SEQ ID NO: 4657356 - DNA, 14 bp, Homo sapiens
gcgtgccgtgtgag

SEQ ID NO: 4657357 - DNA, 17 bp, Homo sapiens
gcgtgccgtgtgagtgt

SEQ ID NO: 4657358 - DNA, 17 bp, Homo sapiens
gcgtggactctgcacat

SEQ ID NO: 4657359 - DNA, 13 bp, Homo sapiens
gcgtgggcagagg

SEQ ID NO: 4657360 - DNA, 14 bp, Homo sapiens
gcgttaagggcaga

SEQ ID NO: 4657361 - DNA, 15 bp, Homo sapiens
gcgttaagggcagag

SEQ ID NO: 4657362 - DNA, 16 bp, Homo sapiens
gctaaaaataaaacat

SEQ ID NO: 4657363 - DNA, 17 bp, Homo sapiens
gctaaatgtgagtattt

SEQ ID NO: 4657364 - DNA, 16 bp, Homo sapiens
gctaacagggaaggca

SEQ ID NO: 4657365 - DNA, 16 bp, Homo sapiens
gctaactgtaaatcat

SEQ ID NO: 4657366 - DNA, 17 bp, Homo sapiens
gctaaggacatttccca

SEQ ID NO: 4657367 - DNA, 20 bp, Homo sapiens
gctaaggacatttcccaggg

SEQ ID NO: 4657368 - DNA, 22 bp, Homo sapiens
gctaagggtgggtgctcagaat

SEQ ID NO: 4657369 - DNA, 15 bp, Homo sapiens
gctaatttatagcaa

SEQ ID NO: 4657370 - DNA, 20 bp, Homo sapiens
gctaatttttgtatttttag

SEQ ID NO: 4657371 - DNA, 16 bp, Homo sapiens
gctacaccactctggc

SEQ ID NO: 4657372 - DNA, 18 bp, Homo sapiens
gctacaccactctggcag

SEQ ID NO: 4657373 - DNA, 20 bp, Homo sapiens
gctacaccactctggcagcc

SEQ ID NO: 4657374 - DNA, 21 bp, Homo sapiens
gctacaccactctggcagcca

SEQ ID NO: 4657375 - DNA, 20 bp, Homo sapiens
gctacattataatgtacaga

SEQ ID NO: 4657376 - DNA, 13 bp, Homo sapiens
gctacctcagaaa

SEQ ID NO: 4657377 - DNA, 14 bp, Homo sapiens
gctacctgtgtgga

SEQ ID NO: 4657378 - DNA, 17 bp, Homo sapiens
gctacctgtgtggacag

SEQ ID NO: 4657379 - DNA, 18 bp, Homo sapiens
gctacctgtgtggacagg

SEQ ID NO: 4657380 - DNA, 13 bp, Homo sapiens
gctacgtgtgaaa

SEQ ID NO: 4657381 - DNA, 17 bp, Homo sapiens
gctacgtgtgaaatctg

SEQ ID NO: 4657382 - DNA, 22 bp, Homo sapiens
gctactccctggaccacgaggc

SEQ ID NO: 4657383 - DNA, 14 bp, Homo sapiens
gctactctgtgcca

SEQ ID NO: 4657384 - DNA, 19 bp, Homo sapiens
gctactctgtgccagagcc

SEQ ID NO: 4657385 - DNA, 20 bp, Homo sapiens
gctactctgtgccagagcct

SEQ ID NO: 4657386 - DNA, 21 bp, Homo sapiens
gctactctgtgccagagcctg

SEQ ID NO: 4657387 - DNA, 15 bp, Homo sapiens
gctgactgaatgcag

SEQ ID NO: 4657388 - DNA, 19 bp, Homo sapiens
gctgacttggttctgaagc

SEQ ID NO: 4657389 - DNA, 21 bp, Homo sapiens
gctgagaacctggccttcagt

SEQ ID NO: 4657390 - DNA, 21 bp, Homo sapiens
gctgagatctgctgtcctgtt

SEQ ID NO: 4657391 - DNA, 23 bp, Homo sapiens
gctgagctcacaaggcagcaagg

SEQ ID NO: 4657392 - DNA, 13 bp, Homo sapiens
gctgagctctgag

SEQ ID NO: 4657393 - DNA, 14 bp, Homo sapiens
gctgagctctgaga

SEQ ID NO: 4657394 - DNA, 16 bp, Homo sapiens
gctgagctctgagagg

SEQ ID NO: 4657395 - DNA, 21 bp, Homo sapiens
gctgagctctgagaggccctg

SEQ ID NO: 4657396 - DNA, 13 bp, Homo sapiens
gctgagctggctt

SEQ ID NO: 4657397 - DNA, 19 bp, Homo sapiens
gctgaggccacactcagca

SEQ ID NO: 4657398 - DNA, 13 bp, Homo sapiens
gctgaggctggca

SEQ ID NO: 4657399 - DNA, 15 bp, Homo sapiens
gctgaggctggcaca

SEQ ID NO: 4657400 - DNA, 20 bp, Homo sapiens
gctgagggcagttcgcagcc

SEQ ID NO: 4657401 - DNA, 16 bp, Homo sapiens
gctgaggtgcccagga

SEQ ID NO: 4657402 - DNA, 20 bp, Homo sapiens
gctgaggtgcccaggagaag

SEQ ID NO: 4657403 - DNA, 17 bp, Homo sapiens
gctgagtctgcagatga

SEQ ID NO: 4657404 - DNA, 18 bp, Homo sapiens
gctgagttgttgagtctg

SEQ ID NO: 4657405 - DNA, 17 bp, Homo sapiens
gctgatggagccttccc

SEQ ID NO: 4657406 - DNA, 14 bp, Homo sapiens
gcctagagtgtagc

SEQ ID NO: 4657407 - DNA, 16 bp, Homo sapiens
gcctagagtgtagcct

SEQ ID NO: 4657408 - DNA, 13 bp, Homo sapiens
gcctaggccaggt

SEQ ID NO: 4657409 - DNA, 14 bp, Homo sapiens
gcctaggccaggtg

SEQ ID NO: 4657410 - DNA, 17 bp, Homo sapiens
gcctagtaaccaaggcc

SEQ ID NO: 4657411 - DNA, 20 bp, Homo sapiens
gcctagtacaatcttgggaa

SEQ ID NO: 4657412 - DNA, 19 bp, Homo sapiens
gcctataatcttatacaac

SEQ ID NO: 4657413 - DNA, 12 bp, Homo sapiens
gcctatcttagg

SEQ ID NO: 4657414 - DNA, 18 bp, Homo sapiens
gcctatgacttgggcacc

SEQ ID NO: 4657415 - DNA, 22 bp, Homo sapiens
gcctatgcacatatggactctg

SEQ ID NO: 4657416 - DNA, 13 bp, Homo sapiens
gcctatggagagc

SEQ ID NO: 4657417 - DNA, 14 bp, Homo sapiens
gcctatggagagcc

SEQ ID NO: 4657418 - DNA, 20 bp, Homo sapiens
gcctatggagagccctggga

SEQ ID NO: 4657419 - DNA, 21 bp, Homo sapiens
gcctatggagagccctgggac

SEQ ID NO: 4657420 - DNA, 22 bp, Homo sapiens
gcctatggagagccctgggacc

SEQ ID NO: 4657421 - DNA, 13 bp, Homo sapiens
gcctcaaaatgtg

SEQ ID NO: 4657422 - DNA, 14 bp, Homo sapiens
gcctcaaaatgtgt

SEQ ID NO: 4657423 - DNA, 20 bp, Homo sapiens
gcctcacccctcccctggga

SEQ ID NO: 4657424 - DNA, 22 bp, Homo sapiens
gcctcacccctcccctgggact

SEQ ID NO: 4657425 - DNA, 22 bp, Homo sapiens
gcctcacccctgcccctgtggg

SEQ ID NO: 4657426 - DNA, 10 bp, Homo sapiens
gcctcagagc

SEQ ID NO: 4657427 - DNA, 17 bp, Homo sapiens
gcctcagagcttcctgg

SEQ ID NO: 4657428 - DNA, 18 bp, Homo sapiens
gcctcagagcttcctggg

SEQ ID NO: 4657429 - DNA, 19 bp, Homo sapiens
gcctcagagcttcctgggg

SEQ ID NO: 4657430 - DNA, 15 bp, Homo sapiens
gcctcagcctcccga

SEQ ID NO: 4657431 - DNA, 19 bp, Homo sapiens
gcctcagctgaatgcctcc

SEQ ID NO: 4657432 - DNA, 15 bp, Homo sapiens
gcctcaggcctctgt

SEQ ID NO: 4657433 - DNA, 15 bp, Homo sapiens
gcctcaggctctgca

SEQ ID NO: 4657434 - DNA, 21 bp, Homo sapiens
gcctccagccctctcactgtg

SEQ ID NO: 4657435 - DNA, 17 bp, Homo sapiens
gcctccatctttttctt

SEQ ID NO: 4657436 - DNA, 15 bp, Homo sapiens
gcctcccaaatgagc

SEQ ID NO: 4657437 - DNA, 18 bp, Homo sapiens
gcctcccaggttcaagca

SEQ ID NO: 4657438 - DNA, 11 bp, Homo sapiens
gcctccctgct

SEQ ID NO: 4657439 - DNA, 14 bp, Homo sapiens
gcctccgacgctgc

SEQ ID NO: 4657440 - DNA, 18 bp, Homo sapiens
gcctcctctctccctgcc

SEQ ID NO: 4657441 - DNA, 22 bp, Homo sapiens
gcctcctctctccctgcctcac

SEQ ID NO: 4657442 - DNA, 19 bp, Homo sapiens
gcctcctgctttgggaaga

SEQ ID NO: 4657443 - DNA, 18 bp, Homo sapiens
gcctcgcaacccgtgcca

SEQ ID NO: 4657444 - DNA, 23 bp, Homo sapiens
gcctcgcgggtgtcacattcctg

SEQ ID NO: 4657445 - DNA, 14 bp, Homo sapiens
gcctcgctccccac

SEQ ID NO: 4657446 - DNA, 14 bp, Homo sapiens
gcctcgctttttca

SEQ ID NO: 4657447 - DNA, 14 bp, Homo sapiens
gcctcgtgaggggc

SEQ ID NO: 4657448 - DNA, 15 bp, Homo sapiens
gcctctactgggaag

SEQ ID NO: 4657449 - DNA, 21 bp, Homo sapiens
gcctctccagtttgcacctgt

SEQ ID NO: 4657450 - DNA, 14 bp, Homo sapiens
gcctctgaggccag

SEQ ID NO: 4657451 - DNA, 20 bp, Homo sapiens
gcctctgaggccagcctggc

SEQ ID NO: 4657452 - DNA, 16 bp, Homo sapiens
gcctctgccccaagag

SEQ ID NO: 4657453 - DNA, 21 bp, Homo sapiens
gcctctgcgagaatgaacata

SEQ ID NO: 4657454 - DNA, 19 bp, Homo sapiens
gcctctgtgtacatgtgtg

SEQ ID NO: 4657455 - DNA, 17 bp, Homo sapiens
gcctcttactaatgtaa

SEQ ID NO: 4657456 - DNA, 19 bp, Homo sapiens
gcctcttactaatgtaaaa

SEQ ID NO: 4657457 - DNA, 20 bp, Homo sapiens
gcctcttattccaggagaag

SEQ ID NO: 4657458 - DNA, 16 bp, Homo sapiens
gcctcttccccctgct

SEQ ID NO: 4657459 - DNA, 15 bp, Homo sapiens
gcctgaactgaggag

SEQ ID NO: 4657460 - DNA, 15 bp, Homo sapiens
gcctgaaggcacagc

SEQ ID NO: 4657461 - DNA, 14 bp, Homo sapiens
gcctgaccttggaa

SEQ ID NO: 4657462 - DNA, 19 bp, Homo sapiens
gcctgagagaattggctca

SEQ ID NO: 4657463 - DNA, 16 bp, Homo sapiens
gcctgagcccagggag

SEQ ID NO: 4657464 - DNA, 21 bp, Homo sapiens
gcctgagcccctttgcctgtc

SEQ ID NO: 4657465 - DNA, 20 bp, Homo sapiens
gcctgaggggaaagagagat

SEQ ID NO: 4657466 - DNA, 14 bp, Homo sapiens
gcctgaggtgccca

SEQ ID NO: 4657467 - DNA, 16 bp, Homo sapiens
gcctgatcagaccacg

SEQ ID NO: 4657468 - DNA, 15 bp, Homo sapiens
gcctgattattttag

SEQ ID NO: 4657469 - DNA, 16 bp, Homo sapiens
gcctgcattgagcttg

SEQ ID NO: 4657470 - DNA, 16 bp, Homo sapiens
gcctgccaccacgctg

SEQ ID NO: 4657471 - DNA, 20 bp, Homo sapiens
gcctgccgagcaaccgtggc

SEQ ID NO: 4657472 - DNA, 14 bp, Homo sapiens
gcctgcgagggcag

SEQ ID NO: 4657473 - DNA, 14 bp, Homo sapiens
gcctgctattgcag

SEQ ID NO: 4657474 - DNA, 15 bp, Homo sapiens
gcctgctgctgagaa

SEQ ID NO: 4657475 - DNA, 19 bp, Homo sapiens
gcctgctgctgagaacctg

SEQ ID NO: 4657476 - DNA, 21 bp, Homo sapiens
gcctgctgctgagaacctggc

SEQ ID NO: 4657477 - DNA, 22 bp, Homo sapiens
gcctgctgctgagaacctggcc

SEQ ID NO: 4657478 - DNA, 19 bp, Homo sapiens
gcctggaagagccgagcac

SEQ ID NO: 4657479 - DNA, 13 bp, Homo sapiens
gcctggactgttt

SEQ ID NO: 4657480 - DNA, 15 bp, Homo sapiens
gcctggactgtttca

SEQ ID NO: 4657481 - DNA, 13 bp, Homo sapiens
gcctggagctaat

SEQ ID NO: 4657482 - DNA, 13 bp, Homo sapiens
gcctggaggacct

SEQ ID NO: 4657483 - DNA, 18 bp, Homo sapiens
gcctggaggacctgagcc

SEQ ID NO: 4657484 - DNA, 12 bp, Homo sapiens
gcctggatgaga

SEQ ID NO: 4657485 - DNA, 16 bp, Homo sapiens
gcctggatgagaaaca

SEQ ID NO: 4657486 - DNA, 13 bp, Homo sapiens
gcctggcacacat

SEQ ID NO: 4657487 - DNA, 16 bp, Homo sapiens
gcctggcacacatcag

SEQ ID NO: 4657488 - DNA, 14 bp, Homo sapiens
gcctggcccccagc

SEQ ID NO: 4657489 - DNA, 18 bp, Homo sapiens
gcctggctgattcagcat

SEQ ID NO: 4657490 - DNA, 20 bp, Homo sapiens
gcctggctgattcagcattt

SEQ ID NO: 4657491 - DNA, 12 bp, Homo sapiens
gcctggctggct

SEQ ID NO: 4657492 - DNA, 14 bp, Homo sapiens
gcctggctggctga

SEQ ID NO: 4657493 - DNA, 20 bp, Homo sapiens
gcctggctggctgagggcag

SEQ ID NO: 4657494 - DNA, 19 bp, Homo sapiens
gcctgggcaatggccaggg

SEQ ID NO: 4657495 - DNA, 18 bp, Homo sapiens
gcctgggcctatggagag

SEQ ID NO: 4657496 - DNA, 22 bp, Homo sapiens
gcctgggcctatggagagccct

SEQ ID NO: 4657497 - DNA, 18 bp, Homo sapiens
gcctggggcctgagagaa

SEQ ID NO: 4657498 - DNA, 14 bp, Homo sapiens
gcctggggctggcc

SEQ ID NO: 4657499 - DNA, 20 bp, Homo sapiens
gcctgggggacagagcaaga

SEQ ID NO: 4657500 - DNA, 13 bp, Homo sapiens
gcctgggggcctg

SEQ ID NO: 4657501 - DNA, 14 bp, Homo sapiens
gcctgggggcctgg

SEQ ID NO: 4657502 - DNA, 15 bp, Homo sapiens
gcctgggggcctggc

SEQ ID NO: 4657503 - DNA, 19 bp, Homo sapiens
gcctgggggttttccaagc

SEQ ID NO: 4657504 - DNA, 20 bp, Homo sapiens
gcctgggggttttccaagcc

SEQ ID NO: 4657505 - DNA, 15 bp, Homo sapiens
gccccacatggctta

SEQ ID NO: 4657506 - DNA, 19 bp, Homo sapiens
gccccagagaaactgccac

SEQ ID NO: 4657507 - DNA, 14 bp, Homo sapiens
gccccagaggccct

SEQ ID NO: 4657508 - DNA, 19 bp, Homo sapiens
gccccagaggccctggagg

SEQ ID NO: 4657509 - DNA, 22 bp, Homo sapiens
gccccagaggccctggaggtct

SEQ ID NO: 4657510 - DNA, 20 bp, Homo sapiens
gccccagtcggccccatctc

SEQ ID NO: 4657511 - DNA, 12 bp, Homo sapiens
gccccatcctca

SEQ ID NO: 4657512 - DNA, 18 bp, Homo sapiens
gccccatcctcatccctg

SEQ ID NO: 4657513 - DNA, 16 bp, Homo sapiens
gccccatcggccaaga

SEQ ID NO: 4657514 - DNA, 11 bp, Homo sapiens
gcccccaccct

SEQ ID NO: 4657515 - DNA, 13 bp, Homo sapiens
gcccccacccttg

SEQ ID NO: 4657516 - DNA, 17 bp, Homo sapiens
gcccccaccgtgggcag

SEQ ID NO: 4657517 - DNA, 20 bp, Homo sapiens
gcccccaccgtgggcaggga

SEQ ID NO: 4657518 - DNA, 17 bp, Homo sapiens
gcccccagccctgggaa

SEQ ID NO: 4657519 - DNA, 19 bp, Homo sapiens
gcccccatcagccctgcta

SEQ ID NO: 4657520 - DNA, 12 bp, Homo sapiens
gccccctgccct

SEQ ID NO: 4657521 - DNA, 14 bp, Homo sapiens
gccccgccagggct

SEQ ID NO: 4657522 - DNA, 13 bp, Homo sapiens
gccccgggatatt

SEQ ID NO: 4657523 - DNA, 12 bp, Homo sapiens
gccccgtgggtg

SEQ ID NO: 4657524 - DNA, 22 bp, Homo sapiens
gcccctaagtgcaaacacagca

SEQ ID NO: 4657525 - DNA, 18 bp, Homo sapiens
gcccctaccctggacttg

SEQ ID NO: 4657526 - DNA, 15 bp, Homo sapiens
gcccctaggctgctg

SEQ ID NO: 4657527 - DNA, 14 bp, Homo sapiens
gcccctcacaacag

SEQ ID NO: 4657528 - DNA, 12 bp, Homo sapiens
gcccctcagagc

SEQ ID NO: 4657529 - DNA, 15 bp, Homo sapiens
gcccctcagagcatg

SEQ ID NO: 4657530 - DNA, 13 bp, Homo sapiens
gcccctcctccag

SEQ ID NO: 4657531 - DNA, 15 bp, Homo sapiens
gcccctcctccagcc

SEQ ID NO: 4657532 - DNA, 18 bp, Homo sapiens
gcccctcctccagcccct

SEQ ID NO: 4657533 - DNA, 21 bp, Homo sapiens
gcccctcctccagcccctgtc

SEQ ID NO: 4657534 - DNA, 13 bp, Homo sapiens
gcccctggagcca

SEQ ID NO: 4657535 - DNA, 13 bp, Homo sapiens
gcccctggcccca

SEQ ID NO: 4657536 - DNA, 15 bp, Homo sapiens
gcccctgtcccaccc

SEQ ID NO: 4657537 - DNA, 16 bp, Homo sapiens
gccccttcccctggga

SEQ ID NO: 4657538 - DNA, 17 bp, Homo sapiens
gccccttcccctgggaa

SEQ ID NO: 4657539 - DNA, 19 bp, Homo sapiens
gccccttctgctcagctct

SEQ ID NO: 4657540 - DNA, 15 bp, Homo sapiens
gcccctttgcctgtc

SEQ ID NO: 4657541 - DNA, 14 bp, Homo sapiens
gcccgacagtgcca

SEQ ID NO: 4657542 - DNA, 20 bp, Homo sapiens
gcccgagcagctgagcaggg

SEQ ID NO: 4657543 - DNA, 22 bp, Homo sapiens
gcccgagcagctgagcagggcc

SEQ ID NO: 4657544 - DNA, 16 bp, Homo sapiens
gcccgagggcagcccc

SEQ ID NO: 4657545 - DNA, 16 bp, Homo sapiens
gcccgcagacctctgg

SEQ ID NO: 4657546 - DNA, 17 bp, Homo sapiens
gcccgcagacctctgga

SEQ ID NO: 4657547 - DNA, 14 bp, Homo sapiens
gcccgctggggacc

SEQ ID NO: 4657548 - DNA, 18 bp, Homo sapiens
gcccggtgcagggcctgg

SEQ ID NO: 4657549 - DNA, 13 bp, Homo sapiens
gcccgtgacagac

SEQ ID NO: 4657550 - DNA, 21 bp, Homo sapiens
gcccgtgccacccccagccct

SEQ ID NO: 4657551 - DNA, 21 bp, Homo sapiens
gccctcattactgggccttag

SEQ ID NO: 4657552 - DNA, 12 bp, Homo sapiens
gccctcccagcc

SEQ ID NO: 4657553 - DNA, 20 bp, Homo sapiens
gccctcccagcccattgctg

SEQ ID NO: 4657554 - DNA, 22 bp, Homo sapiens
gccctcccctgcccctcacaac

SEQ ID NO: 4657555 - DNA, 23 bp, Homo sapiens
gccctctatttattagccaactg

SEQ ID NO: 4657556 - DNA, 14 bp, Homo sapiens
gccctctttccctg

SEQ ID NO: 4657557 - DNA, 15 bp, Homo sapiens
gccctctttccctgc

SEQ ID NO: 4657558 - DNA, 16 bp, Homo sapiens
gccctctttccctgcg

SEQ ID NO: 4657559 - DNA, 19 bp, Homo sapiens
gccctctttccctgcgaga

SEQ ID NO: 4657560 - DNA, 20 bp, Homo sapiens
gccctgaggcctagactctg

SEQ ID NO: 4657561 - DNA, 22 bp, Homo sapiens
gccctgcccaggtatcctgggg

SEQ ID NO: 4657562 - DNA, 11 bp, Homo sapiens
gccctgcctgg

SEQ ID NO: 4657563 - DNA, 12 bp, Homo sapiens
gccctgcctgga

SEQ ID NO: 4657564 - DNA, 13 bp, Homo sapiens
gccctgcctggag

SEQ ID NO: 4657565 - DNA, 18 bp, Homo sapiens
gccctgcggtagatggga

SEQ ID NO: 4657566 - DNA, 13 bp, Homo sapiens
gccctgctacctg

SEQ ID NO: 4657567 - DNA, 18 bp, Homo sapiens
gccctggaggtctccagg

SEQ ID NO: 4657568 - DNA, 20 bp, Homo sapiens
gccctggaggtctccagggg

SEQ ID NO: 4657569 - DNA, 18 bp, Homo sapiens
gccctggatcagcgtggc

SEQ ID NO: 4657570 - DNA, 20 bp, Homo sapiens
gccctggatcagcgtggcct

SEQ ID NO: 4657571 - DNA, 22 bp, Homo sapiens
gccctggatcagcgtggccttg

SEQ ID NO: 4657572 - DNA, 22 bp, Homo sapiens
gccctggcccccatcagccctg

SEQ ID NO: 4657573 - DNA, 20 bp, Homo sapiens
gccctggccttgggccctct

SEQ ID NO: 4657574 - DNA, 22 bp, Homo sapiens
gccctgggaaccactcccacca

SEQ ID NO: 4657575 - DNA, 14 bp, Homo sapiens
gccctgggaccgct

SEQ ID NO: 4657576 - DNA, 12 bp, Homo sapiens
gccctggggcct

SEQ ID NO: 4657577 - DNA, 13 bp, Homo sapiens
gccctggggcctg

SEQ ID NO: 4657578 - DNA, 19 bp, Homo sapiens
gccctggggcctgtactgc

SEQ ID NO: 4657579 - DNA, 15 bp, Homo sapiens
gccctgtctctggct

SEQ ID NO: 4657580 - DNA, 17 bp, Homo sapiens
gccctgtctctggctac

SEQ ID NO: 4657581 - DNA, 21 bp, Homo sapiens
gccctgtgcaacctcttggcc

SEQ ID NO: 4657582 - DNA, 12 bp, Homo sapiens
gccctgtgtgtg

SEQ ID NO: 4657583 - DNA, 19 bp, Homo sapiens
gccctgtgttctttcccca

SEQ ID NO: 4657584 - DNA, 14 bp, Homo sapiens
gcccttcccccttt

SEQ ID NO: 4657585 - DNA, 13 bp, Homo sapiens
gcccttcctcctg

SEQ ID NO: 4657586 - DNA, 22 bp, Homo sapiens
gcccttcctctccaccctccca

SEQ ID NO: 4657587 - DNA, 18 bp, Homo sapiens
gcccttcctggacagctg

SEQ ID NO: 4657588 - DNA, 21 bp, Homo sapiens
gcccttgctgggcctgggggt

SEQ ID NO: 4657589 - DNA, 17 bp, Homo sapiens
gcccttgtttggggcag

SEQ ID NO: 4657590 - DNA, 23 bp, Homo sapiens
gcccttgtttggggcaggagtag

SEQ ID NO: 4657591 - DNA, 15 bp, Homo sapiens
gccgaagctaacagg

SEQ ID NO: 4657592 - DNA, 13 bp, Homo sapiens
gccgaccttccct

SEQ ID NO: 4657593 - DNA, 17 bp, Homo sapiens
gccgactctggccctgg

SEQ ID NO: 4657594 - DNA, 18 bp, Homo sapiens
gccgactctggccctggc

SEQ ID NO: 4657595 - DNA, 19 bp, Homo sapiens
gccgagcaaccgtggccct

SEQ ID NO: 4657596 - DNA, 20 bp, Homo sapiens
gccgagcaaccgtggccctt

SEQ ID NO: 4657597 - DNA, 21 bp, Homo sapiens
gccgcagtggggtcaagctga

SEQ ID NO: 4657598 - DNA, 24 bp, Homo sapiens
gccgcagtggggtcaagctgagct

SEQ ID NO: 4657599 - DNA, 20 bp, Homo sapiens
gccgcctctcctccatcttc

SEQ ID NO: 4657600 - DNA, 12 bp, Homo sapiens
gccggccagccc

SEQ ID NO: 4657601 - DNA, 23 bp, Homo sapiens
gccgggcctgctgtcacctcgct

SEQ ID NO: 4657602 - DNA, 21 bp, Homo sapiens
gccgggcttggcctcctgctt

SEQ ID NO: 4657603 - DNA, 17 bp, Homo sapiens
gccggggaactggccaa

SEQ ID NO: 4657604 - DNA, 20 bp, Homo sapiens
gccggggaactggccaagct

SEQ ID NO: 4657605 - DNA, 16 bp, Homo sapiens
gccggtaactgtcctg

SEQ ID NO: 4657606 - DNA, 18 bp, Homo sapiens
gccggtgggctagaaagt

SEQ ID NO: 4657607 - DNA, 20 bp, Homo sapiens
gccgtgctcgccccagcagg

SEQ ID NO: 4657608 - DNA, 15 bp, Homo sapiens
gccgtggccagaggc

SEQ ID NO: 4657609 - DNA, 18 bp, Homo sapiens
gccgtgtgagtgtgacag

SEQ ID NO: 4657610 - DNA, 14 bp, Homo sapiens
gcctaaagggcagg

SEQ ID NO: 4657611 - DNA, 15 bp, Homo sapiens
gcctaaatttcttct

SEQ ID NO: 4657612 - DNA, 13 bp, Homo sapiens
gcctaatttacaa

SEQ ID NO: 4657613 - DNA, 14 bp, Homo sapiens
gcctaatttacaag

SEQ ID NO: 4657614 - DNA, 13 bp, Homo sapiens
gcctagactctgt

SEQ ID NO: 4657615 - DNA, 12 bp, Homo sapiens
gcctagagatat

SEQ ID NO: 4657616 - DNA, 12 bp, Homo sapiens
gcctagagtgta

SEQ ID NO: 4657617 - DNA, 22 bp, Homo sapiens
gccagcacacagggcagtgagg

SEQ ID NO: 4657618 - DNA, 19 bp, Homo sapiens
gccagcacttgtccagctg

SEQ ID NO: 4657619 - DNA, 16 bp, Homo sapiens
gccagcaggaataaag

SEQ ID NO: 4657620 - DNA, 20 bp, Homo sapiens
gccagcaggaataaagactt

SEQ ID NO: 4657621 - DNA, 14 bp, Homo sapiens
gccagcaggggggc

SEQ ID NO: 4657622 - DNA, 16 bp, Homo sapiens
gccagcaggggggctg

SEQ ID NO: 4657623 - DNA, 22 bp, Homo sapiens
gccagccacagacccctgggag

SEQ ID NO: 4657624 - DNA, 12 bp, Homo sapiens
gccagccacagg

SEQ ID NO: 4657625 - DNA, 13 bp, Homo sapiens
gccagccacagga

SEQ ID NO: 4657626 - DNA, 18 bp, Homo sapiens
gccagccacaggaccacc

SEQ ID NO: 4657627 - DNA, 21 bp, Homo sapiens
gccagccacaggaccacctcc

SEQ ID NO: 4657628 - DNA, 13 bp, Homo sapiens
gccagcccagctg

SEQ ID NO: 4657629 - DNA, 14 bp, Homo sapiens
gccagcccagctgg

SEQ ID NO: 4657630 - DNA, 10 bp, Homo sapiens
gccagccctg

SEQ ID NO: 4657631 - DNA, 15 bp, Homo sapiens
gccagccctgcctgg

SEQ ID NO: 4657632 - DNA, 16 bp, Homo sapiens
gccagccctgcctgga

SEQ ID NO: 4657633 - DNA, 17 bp, Homo sapiens
gccagccctgcctggag

SEQ ID NO: 4657634 - DNA, 18 bp, Homo sapiens
gccagccctgcctggagg

SEQ ID NO: 4657635 - DNA, 17 bp, Homo sapiens
gccagcctggcctcctg

SEQ ID NO: 4657636 - DNA, 19 bp, Homo sapiens
gccagcctggcctcctgcc

SEQ ID NO: 4657637 - DNA, 22 bp, Homo sapiens
gccagcctggcctcctgcctct

SEQ ID NO: 4657638 - DNA, 15 bp, Homo sapiens
gccagctgctcccca

SEQ ID NO: 4657639 - DNA, 22 bp, Homo sapiens
gccaggagcagccctggccccc

SEQ ID NO: 4657640 - DNA, 13 bp, Homo sapiens
gccaggagggaca

SEQ ID NO: 4657641 - DNA, 19 bp, Homo sapiens
gccaggagggacaaaggag

SEQ ID NO: 4657642 - DNA, 14 bp, Homo sapiens
gccaggatgcccag

SEQ ID NO: 4657643 - DNA, 20 bp, Homo sapiens
gccaggatggaacacggcca

SEQ ID NO: 4657644 - DNA, 10 bp, Homo sapiens
gccaggcccc

SEQ ID NO: 4657645 - DNA, 12 bp, Homo sapiens
gccaggccccac

SEQ ID NO: 4657646 - DNA, 18 bp, Homo sapiens
gccaggccccatggaggg

SEQ ID NO: 4657647 - DNA, 13 bp, Homo sapiens
gccaggcctagta

SEQ ID NO: 4657648 - DNA, 15 bp, Homo sapiens
gccaggctgaccaca

SEQ ID NO: 4657649 - DNA, 17 bp, Homo sapiens
gccaggctgaccacagc

SEQ ID NO: 4657650 - DNA, 18 bp, Homo sapiens
gccaggctgaccacagca

SEQ ID NO: 4657651 - DNA, 19 bp, Homo sapiens
gccaggctgaccacagcac

SEQ ID NO: 4657652 - DNA, 15 bp, Homo sapiens
gccaggctgatctcg

SEQ ID NO: 4657653 - DNA, 14 bp, Homo sapiens
gccagggcctgcga

SEQ ID NO: 4657654 - DNA, 14 bp, Homo sapiens
gccagggctgggga

SEQ ID NO: 4657655 - DNA, 21 bp, Homo sapiens
gccagggctggggacagaggg

SEQ ID NO: 4657656 - DNA, 22 bp, Homo sapiens
gccagggtctctccctcaggtg

SEQ ID NO: 4657657 - DNA, 23 bp, Homo sapiens
gccagggtctctccctcaggtgt

SEQ ID NO: 4657658 - DNA, 14 bp, Homo sapiens
gccaggtctcctgg

SEQ ID NO: 4657659 - DNA, 16 bp, Homo sapiens
gccaggtctcctggga

SEQ ID NO: 4657660 - DNA, 19 bp, Homo sapiens
gccaggtctcctgggaaag

SEQ ID NO: 4657661 - DNA, 19 bp, Homo sapiens
gccagtgaacttggctttc

SEQ ID NO: 4657662 - DNA, 14 bp, Homo sapiens
gccagtggggcctg

SEQ ID NO: 4657663 - DNA, 16 bp, Homo sapiens
gccagtggggcctgtg

SEQ ID NO: 4657664 - DNA, 15 bp, Homo sapiens
gccagtgtttctgaa

SEQ ID NO: 4657665 - DNA, 18 bp, Homo sapiens
gccagtgtttctgaatgt

SEQ ID NO: 4657666 - DNA, 16 bp, Homo sapiens
gccataattttgcata

SEQ ID NO: 4657667 - DNA, 19 bp, Homo sapiens
gccataccattcccatgga

SEQ ID NO: 4657668 - DNA, 15 bp, Homo sapiens
gccataccttctccc

SEQ ID NO: 4657669 - DNA, 16 bp, Homo sapiens
gccataccttctccca

SEQ ID NO: 4657670 - DNA, 19 bp, Homo sapiens
gccataccttctcccaggc

SEQ ID NO: 4657671 - DNA, 16 bp, Homo sapiens
gccatagtcacatggc

SEQ ID NO: 4657672 - DNA, 21 bp, Homo sapiens
gccatccttgactttgaacta

SEQ ID NO: 4657673 - DNA, 15 bp, Homo sapiens
gccatctcaggagat

SEQ ID NO: 4657674 - DNA, 17 bp, Homo sapiens
gccatctcaggagatgg

SEQ ID NO: 4657675 - DNA, 13 bp, Homo sapiens
gccatgaactttg

SEQ ID NO: 4657676 - DNA, 17 bp, Homo sapiens
gccatgatggcaacaga

SEQ ID NO: 4657677 - DNA, 16 bp, Homo sapiens
gccatggtaatcagaa

SEQ ID NO: 4657678 - DNA, 17 bp, Homo sapiens
gccatgtataaatgtga

SEQ ID NO: 4657679 - DNA, 19 bp, Homo sapiens
gccatgttgtgcctccctg

SEQ ID NO: 4657680 - DNA, 12 bp, Homo sapiens
gccatttcttat

SEQ ID NO: 4657681 - DNA, 15 bp, Homo sapiens
gccattttggtgctt

SEQ ID NO: 4657682 - DNA, 17 bp, Homo sapiens
gcccaaagcttgtaaat

SEQ ID NO: 4657683 - DNA, 18 bp, Homo sapiens
gcccaaagcttgtaaata

SEQ ID NO: 4657684 - DNA, 15 bp, Homo sapiens
gcccaaggacagttc

SEQ ID NO: 4657685 - DNA, 22 bp, Homo sapiens
gcccaaggacagttcagagatc

SEQ ID NO: 4657686 - DNA, 16 bp, Homo sapiens
gcccaagtctcctagg

SEQ ID NO: 4657687 - DNA, 20 bp, Homo sapiens
gcccacagaaagccaggagc

SEQ ID NO: 4657688 - DNA, 16 bp, Homo sapiens
gcccacctcagcctcc

SEQ ID NO: 4657689 - DNA, 18 bp, Homo sapiens
gcccacctcagcctccca

SEQ ID NO: 4657690 - DNA, 22 bp, Homo sapiens
gcccacttgtcccactatctgg

SEQ ID NO: 4657691 - DNA, 16 bp, Homo sapiens
gcccagaggagcccag

SEQ ID NO: 4657692 - DNA, 20 bp, Homo sapiens
gcccagagtgagctttagct

SEQ ID NO: 4657693 - DNA, 22 bp, Homo sapiens
gcccagattatgagacacagga

SEQ ID NO: 4657694 - DNA, 17 bp, Homo sapiens
gcccagcacaggtattt

SEQ ID NO: 4657695 - DNA, 15 bp, Homo sapiens
gcccagcgccaagta

SEQ ID NO: 4657696 - DNA, 16 bp, Homo sapiens
gcccagcgccatcctg

SEQ ID NO: 4657697 - DNA, 18 bp, Homo sapiens
gcccagcggacagtggca

SEQ ID NO: 4657698 - DNA, 21 bp, Homo sapiens
gcccagcggacagtggcagga

SEQ ID NO: 4657699 - DNA, 15 bp, Homo sapiens
gcccagcggcccaag

SEQ ID NO: 4657700 - DNA, 17 bp, Homo sapiens
gcccagcggcccaagag

SEQ ID NO: 4657701 - DNA, 18 bp, Homo sapiens
gcccagcggcccaagagc

SEQ ID NO: 4657702 - DNA, 20 bp, Homo sapiens
gcccagcggcccaagagccc

SEQ ID NO: 4657703 - DNA, 14 bp, Homo sapiens
gcccagctggcctg

SEQ ID NO: 4657704 - DNA, 13 bp, Homo sapiens
gcccagctgggtc

SEQ ID NO: 4657705 - DNA, 14 bp, Homo sapiens
gcccagctgggtca

SEQ ID NO: 4657706 - DNA, 15 bp, Homo sapiens
gcccagctgggtcag

SEQ ID NO: 4657707 - DNA, 19 bp, Homo sapiens
gcccaggaaaaactggaag

SEQ ID NO: 4657708 - DNA, 20 bp, Homo sapiens
gcccaggatactggcacaga

SEQ ID NO: 4657709 - DNA, 19 bp, Homo sapiens
gcccaggctggagtgcagt

SEQ ID NO: 4657710 - DNA, 13 bp, Homo sapiens
gcccagggaggcc

SEQ ID NO: 4657711 - DNA, 21 bp, Homo sapiens
gcccagggaggccgaagctaa

SEQ ID NO: 4657712 - DNA, 20 bp, Homo sapiens
gcccaggggagcgtgttcct

SEQ ID NO: 4657713 - DNA, 23 bp, Homo sapiens
gcccaggtcaccaagcagtggcc

SEQ ID NO: 4657714 - DNA, 19 bp, Homo sapiens
gcccaggtgagggaaggag

SEQ ID NO: 4657715 - DNA, 18 bp, Homo sapiens
gcccagtgcaaaccactt

SEQ ID NO: 4657716 - DNA, 14 bp, Homo sapiens
gcccatggaggcag

SEQ ID NO: 4657717 - DNA, 20 bp, Homo sapiens
gcccatgtgtacattctgcc

SEQ ID NO: 4657718 - DNA, 14 bp, Homo sapiens
gcccattaatcttg

SEQ ID NO: 4657719 - DNA, 15 bp, Homo sapiens
gcccattagagaagt

SEQ ID NO: 4657720 - DNA, 12 bp, Homo sapiens
gcccattgctgc

SEQ ID NO: 4657721 - DNA, 17 bp, Homo sapiens
gcccattgctgccaagg

SEQ ID NO: 4657722 - DNA, 19 bp, Homo sapiens
gccccaacccgtggaggct

SEQ ID NO: 4657723 - DNA, 21 bp, Homo sapiens
gccccaacccgtggaggctgc

SEQ ID NO: 4657724 - DNA, 17 bp, Homo sapiens
gccccaactccttccag

SEQ ID NO: 4657725 - DNA, 20 bp, Homo sapiens
gccccaactccttccagcta

SEQ ID NO: 4657726 - DNA, 21 bp, Homo sapiens
gccccaactccttccagctag

SEQ ID NO: 4657727 - DNA, 14 bp, Homo sapiens
gccccacaaggcct

SEQ ID NO: 4657728 - DNA, 20 bp, Homo sapiens
gccccacaaggcctggtctg

SEQ ID NO: 4657729 - DNA, 20 bp, Homo sapiens
gccagatttgtctttttgtt

SEQ ID NO: 4657730 - DNA, 16 bp, Homo sapiens
gcagcaaggcccgagc

SEQ ID NO: 4657731 - DNA, 17 bp, Homo sapiens
gcagcaaggcccgagca

SEQ ID NO: 4657732 - DNA, 16 bp, Homo sapiens
gcagcaatattttgta

SEQ ID NO: 4657733 - DNA, 14 bp, Homo sapiens
gcagcacctccagg

SEQ ID NO: 4657734 - DNA, 13 bp, Homo sapiens
gatactgctgctt

SEQ ID NO: 4657735 - DNA, 21 bp, Homo sapiens
gatacttcctgccctaactct

SEQ ID NO: 4657736 - DNA, 21 bp, Homo sapiens
gatagaacacaaaacttgaaa

SEQ ID NO: 4657737 - DNA, 16 bp, Homo sapiens
gatagatgttgctctt

SEQ ID NO: 4657738 - DNA, 22 bp, Homo sapiens
gatagcattgttttcttttaca

SEQ ID NO: 4657739 - DNA, 16 bp, Homo sapiens
gatagctaactgtaaa

SEQ ID NO: 4657740 - DNA, 19 bp, Homo sapiens
gatagctaactgtaaatca

SEQ ID NO: 4657741 - DNA, 18 bp, Homo sapiens
gatatccttatcagagct

SEQ ID NO: 4657742 - DNA, 21 bp, Homo sapiens
gatatctagctagtaatatat

SEQ ID NO: 4657743 - DNA, 23 bp, Homo sapiens
gatatgattgtttctcaaatctt

SEQ ID NO: 4657744 - DNA, 19 bp, Homo sapiens
gatatgccactaacttcta

SEQ ID NO: 4657745 - DNA, 22 bp, Homo sapiens
gatatggcattgcactgcttat

SEQ ID NO: 4657746 - DNA, 12 bp, Homo sapiens
gatattatagaa

SEQ ID NO: 4657747 - DNA, 13 bp, Homo sapiens
gatattctttaca

SEQ ID NO: 4657748 - DNA, 14 bp, Homo sapiens
gatattctttacaa

SEQ ID NO: 4657749 - DNA, 18 bp, Homo sapiens
gatatttcaagctcatgt

SEQ ID NO: 4657750 - DNA, 20 bp, Homo sapiens
gatatttcgtttggtcttag

SEQ ID NO: 4657751 - DNA, 17 bp, Homo sapiens
gatcaaaggcacacagc

SEQ ID NO: 4657752 - DNA, 14 bp, Homo sapiens
gatcaagctgtgag

SEQ ID NO: 4657753 - DNA, 15 bp, Homo sapiens
gatcagaaagtgaca

SEQ ID NO: 4657754 - DNA, 16 bp, Homo sapiens
gatcagaaagtgacat

SEQ ID NO: 4657755 - DNA, 13 bp, Homo sapiens
gatcagaatccca

SEQ ID NO: 4657756 - DNA, 23 bp, Homo sapiens
gatcagaggcatttgagcagctg

SEQ ID NO: 4657757 - DNA, 24 bp, Homo sapiens
gatcagaggcatttgagcagctga

SEQ ID NO: 4657758 - DNA, 18 bp, Homo sapiens
gatcagcatgcctgtcct

SEQ ID NO: 4657759 - DNA, 13 bp, Homo sapiens
gatcagcgtggcc

SEQ ID NO: 4657760 - DNA, 15 bp, Homo sapiens
gatcaggccccaccc

SEQ ID NO: 4657761 - DNA, 15 bp, Homo sapiens
gatcaggctagccct

SEQ ID NO: 4657762 - DNA, 16 bp, Homo sapiens
gatcagggcctgcccc

SEQ ID NO: 4657763 - DNA, 18 bp, Homo sapiens
gatcagggcctgccccct

SEQ ID NO: 4657764 - DNA, 20 bp, Homo sapiens
gatcagggcctgccccctgg

SEQ ID NO: 4657765 - DNA, 21 bp, Homo sapiens
gatcagggcctgccccctggg

SEQ ID NO: 4657766 - DNA, 20 bp, Homo sapiens
gatcagtataattttttaaa

SEQ ID NO: 4657767 - DNA, 20 bp, Homo sapiens
gatcatttataatactgttt

SEQ ID NO: 4657768 - DNA, 14 bp, Homo sapiens
gatccagccacttc

SEQ ID NO: 4657769 - DNA, 20 bp, Homo sapiens
gatccgcccacctcagcctc

SEQ ID NO: 4657770 - DNA, 21 bp, Homo sapiens
gatccgcccacctcagcctcc

SEQ ID NO: 4657771 - DNA, 12 bp, Homo sapiens
gatcctgctggg

SEQ ID NO: 4657772 - DNA, 20 bp, Homo sapiens
gatcctggttaccactcttt

SEQ ID NO: 4657773 - DNA, 21 bp, Homo sapiens
gatccttttttgtcattttat

SEQ ID NO: 4657774 - DNA, 19 bp, Homo sapiens
gatcgacagacagccaggt

SEQ ID NO: 4657775 - DNA, 21 bp, Homo sapiens
gatctcctgccagcccagctg

SEQ ID NO: 4657776 - DNA, 14 bp, Homo sapiens
gatctcggtttgcc

SEQ ID NO: 4657777 - DNA, 19 bp, Homo sapiens
gatctctctagctttgtca

SEQ ID NO: 4657778 - DNA, 13 bp, Homo sapiens
gatctggctgcag

SEQ ID NO: 4657779 - DNA, 16 bp, Homo sapiens
gatctggggaggcagg

SEQ ID NO: 4657780 - DNA, 13 bp, Homo sapiens
gatcttgaactcc

SEQ ID NO: 4657781 - DNA, 13 bp, Homo sapiens
gatcttgaatgtg

SEQ ID NO: 4657782 - DNA, 16 bp, Homo sapiens
gatcttttaaaatcat

SEQ ID NO: 4657783 - DNA, 21 bp, Homo sapiens
gatgaaaacctacatattcca

SEQ ID NO: 4657784 - DNA, 15 bp, Homo sapiens
gatgaagcatttaca

SEQ ID NO: 4657785 - DNA, 19 bp, Homo sapiens
gatgaattttccagaccta

SEQ ID NO: 4657786 - DNA, 18 bp, Homo sapiens
gatgacaccctggcctga

SEQ ID NO: 4657787 - DNA, 17 bp, Homo sapiens
gatgaccagggatgctg

SEQ ID NO: 4657788 - DNA, 18 bp, Homo sapiens
gatgaccagggatgctgg

SEQ ID NO: 4657789 - DNA, 23 bp, Homo sapiens
gatgaccagggatgctgggctgg

SEQ ID NO: 4657790 - DNA, 13 bp, Homo sapiens
gatgagaaacagc

SEQ ID NO: 4657791 - DNA, 16 bp, Homo sapiens
gatgagacccagcccc

SEQ ID NO: 4657792 - DNA, 17 bp, Homo sapiens
gatgaggccccgccttt

SEQ ID NO: 4657793 - DNA, 20 bp, Homo sapiens
gatgaggccccgccttttcc

SEQ ID NO: 4657794 - DNA, 23 bp, Homo sapiens
gatgaggccctgcaccttcccca

SEQ ID NO: 4657795 - DNA, 15 bp, Homo sapiens
gatgagggcagcagc

SEQ ID NO: 4657796 - DNA, 17 bp, Homo sapiens
gatgagggcagcagcca

SEQ ID NO: 4657797 - DNA, 18 bp, Homo sapiens
gatgagggcagcagccag

SEQ ID NO: 4657798 - DNA, 21 bp, Homo sapiens
gatgagggcagcagccagccc

SEQ ID NO: 4657799 - DNA, 16 bp, Homo sapiens
gatgaggtattttttc

SEQ ID NO: 4657800 - DNA, 23 bp, Homo sapiens
gatgagtcttgatctagatacag

SEQ ID NO: 4657801 - DNA, 15 bp, Homo sapiens
gatgcagggcagtca

SEQ ID NO: 4657802 - DNA, 17 bp, Homo sapiens
gatgcaggtcagcccat

SEQ ID NO: 4657803 - DNA, 16 bp, Homo sapiens
gatgccccctccagga

SEQ ID NO: 4657804 - DNA, 18 bp, Homo sapiens
gatgccccctccaggaga

SEQ ID NO: 4657805 - DNA, 24 bp, Homo sapiens
gatgccccctccaggagagagcca

SEQ ID NO: 4657806 - DNA, 13 bp, Homo sapiens
gatgcccttcccc

SEQ ID NO: 4657807 - DNA, 14 bp, Homo sapiens
gatgcccttccccc

SEQ ID NO: 4657808 - DNA, 19 bp, Homo sapiens
gatgcccttgctgggcctg

SEQ ID NO: 4657809 - DNA, 22 bp, Homo sapiens
gatgcccttgctgggcctgggg

SEQ ID NO: 4657810 - DNA, 15 bp, Homo sapiens
gatgcggatcctgct

SEQ ID NO: 4657811 - DNA, 13 bp, Homo sapiens
gatgcgtgggcag

SEQ ID NO: 4657812 - DNA, 12 bp, Homo sapiens
gatgctgtgcta

SEQ ID NO: 4657813 - DNA, 21 bp, Homo sapiens
gatgctgtgctacgtgtgaaa

SEQ ID NO: 4657814 - DNA, 18 bp, Homo sapiens
gatggagaaagaagtgga

SEQ ID NO: 4657815 - DNA, 19 bp, Homo sapiens
gatggagaaagaagtggag

SEQ ID NO: 4657816 - DNA, 19 bp, Homo sapiens
gatggagcaaacctagccc

SEQ ID NO: 4657817 - DNA, 15 bp, Homo sapiens
gatggagcaagctct

SEQ ID NO: 4657818 - DNA, 22 bp, Homo sapiens
gatggagcaagctcttcccttg

SEQ ID NO: 4657819 - DNA, 16 bp, Homo sapiens
gatggagttcttgtgc

SEQ ID NO: 4657820 - DNA, 15 bp, Homo sapiens
gatggatggcagact

SEQ ID NO: 4657821 - DNA, 21 bp, Homo sapiens
gatggcacttataaccaaagc

SEQ ID NO: 4657822 - DNA, 11 bp, Homo sapiens
gatggcagagg

SEQ ID NO: 4657823 - DNA, 21 bp, Homo sapiens
gatggcatcctgtgaagtcct

SEQ ID NO: 4657824 - DNA, 14 bp, Homo sapiens
gatggctttcaggg

SEQ ID NO: 4657825 - DNA, 17 bp, Homo sapiens
gatggctttcagggcag

SEQ ID NO: 4657826 - DNA, 17 bp, Homo sapiens
gatgggaggtgtgccag

SEQ ID NO: 4657827 - DNA, 20 bp, Homo sapiens
gatgggcatatgtgtcagtg

SEQ ID NO: 4657828 - DNA, 12 bp, Homo sapiens
gatggggtgggg

SEQ ID NO: 4657829 - DNA, 22 bp, Homo sapiens
gatgggtgggtggggtattttt

SEQ ID NO: 4657830 - DNA, 14 bp, Homo sapiens
gatggtgttatctt

SEQ ID NO: 4657831 - DNA, 18 bp, Homo sapiens
gatgtaaaagactttttt

SEQ ID NO: 4657832 - DNA, 14 bp, Homo sapiens
gatgtataatacat

SEQ ID NO: 4657833 - DNA, 16 bp, Homo sapiens
gatgtccctgggccag

SEQ ID NO: 4657834 - DNA, 18 bp, Homo sapiens
gatgtgatcaggccccac

SEQ ID NO: 4657835 - DNA, 13 bp, Homo sapiens
gatgtggaggaag

SEQ ID NO: 4657836 - DNA, 17 bp, Homo sapiens
gatgtggaggaagagcc

SEQ ID NO: 4657837 - DNA, 20 bp, Homo sapiens
gatgtggaggaagagccacc

SEQ ID NO: 4657838 - DNA, 17 bp, Homo sapiens
gatgtgtgcaatgtggc

SEQ ID NO: 4657839 - DNA, 22 bp, Homo sapiens
gatgttctgggctaatatactt

SEQ ID NO: 4657840 - DNA, 12 bp, Homo sapiens
gatgttgctgtt

SEQ ID NO: 4657841 - DNA, 18 bp, Homo sapiens
gatgtttccctctccttc

SEQ ID NO: 4657842 - DNA, 17 bp, Homo sapiens
gatgttttatccttaca

SEQ ID NO: 4657843 - DNA, 21 bp, Homo sapiens
gatgttttatccttacaatgt

SEQ ID NO: 4657844 - DNA, 22 bp, Homo sapiens
gattaacctgaaagaacataca

SEQ ID NO: 4657845 - DNA, 20 bp, Homo sapiens
gattatcttgaaaaagtatt

SEQ ID NO: 4657846 - DNA, 18 bp, Homo sapiens
gattatttgggagggaaa

SEQ ID NO: 4657847 - DNA, 21 bp, Homo sapiens
gattatttgggagggaaaagg

SEQ ID NO: 4657848 - DNA, 21 bp, Homo sapiens
gattcaggaaaaggcctgggg

SEQ ID NO: 4657849 - DNA, 19 bp, Homo sapiens
gattcatggagtagcctgg

SEQ ID NO: 4657850 - DNA, 15 bp, Homo sapiens
gattcccaagctccc

SEQ ID NO: 4657851 - DNA, 17 bp, Homo sapiens
gattcctctcatttcca

SEQ ID NO: 4657852 - DNA, 22 bp, Homo sapiens
gattccttctaagtgtacttca

SEQ ID NO: 4657853 - DNA, 15 bp, Homo sapiens
gattcgcttttggta

SEQ ID NO: 4657854 - DNA, 21 bp, Homo sapiens
gattctatctacataagtcct

SEQ ID NO: 4657855 - DNA, 15 bp, Homo sapiens
gattctcctgcctca

SEQ ID NO: 4657856 - DNA, 15 bp, Homo sapiens
gattctctattggct

SEQ ID NO: 4657857 - DNA, 15 bp, Homo sapiens
gattgacattctaca

SEQ ID NO: 4657858 - DNA, 17 bp, Homo sapiens
gattgcatgtgactctg

SEQ ID NO: 4657859 - DNA, 19 bp, Homo sapiens
gattgctggggccaggccc

SEQ ID NO: 4657860 - DNA, 16 bp, Homo sapiens
gattgtactgttcata

SEQ ID NO: 4657861 - DNA, 20 bp, Homo sapiens
gattgttggtgaattttcaa

SEQ ID NO: 4657862 - DNA, 16 bp, Homo sapiens
gatttaagttcctgct

SEQ ID NO: 4657863 - DNA, 18 bp, Homo sapiens
gatttagtgtaataagac

SEQ ID NO: 4657864 - DNA, 22 bp, Homo sapiens
gatttagtgtttttacctctgt

SEQ ID NO: 4657865 - DNA, 16 bp, Homo sapiens
gatttcacatttctac

SEQ ID NO: 4657866 - DNA, 22 bp, Homo sapiens
gatttcctgctttgggaagccg

SEQ ID NO: 4657867 - DNA, 10 bp, Homo sapiens
gatttctaat

SEQ ID NO: 4657868 - DNA, 20 bp, Homo sapiens
gatttctttaaaagaatgac

SEQ ID NO: 4657869 - DNA, 16 bp, Homo sapiens
gatttggccaggccta

SEQ ID NO: 4657870 - DNA, 17 bp, Homo sapiens
gatttgtctcatatatt

SEQ ID NO: 4657871 - DNA, 23 bp, Homo sapiens
gattttaatagggaatatatctc

SEQ ID NO: 4657872 - DNA, 18 bp, Homo sapiens
gattttaatttcaggaaa

SEQ ID NO: 4657873 - DNA, 12 bp, Homo sapiens
gattttcatttt

SEQ ID NO: 4657874 - DNA, 20 bp, Homo sapiens
gattttcctttgtagctact

SEQ ID NO: 4657875 - DNA, 19 bp, Homo sapiens
gatttttaaagtttaaata

SEQ ID NO: 4657876 - DNA, 18 bp, Homo sapiens
gatttttgtttttgtaat

SEQ ID NO: 4657877 - DNA, 16 bp, Homo sapiens
gatttttttgtaaggg

SEQ ID NO: 4657878 - DNA, 19 bp, Homo sapiens
gatttttttttccactttt

SEQ ID NO: 4657879 - DNA, 22 bp, Homo sapiens
gatttttttttccacttttgtt

SEQ ID NO: 4657880 - DNA, 16 bp, Homo sapiens
gcaaaacagccctcag

SEQ ID NO: 4657881 - DNA, 23 bp, Homo sapiens
gcaaaaggcctcttgtaaagact

SEQ ID NO: 4657882 - DNA, 16 bp, Homo sapiens
gcaaaatcaacatgac

SEQ ID NO: 4657883 - DNA, 22 bp, Homo sapiens
gcaaaatggaacgctaatgaaa

SEQ ID NO: 4657884 - DNA, 19 bp, Homo sapiens
gcaaaatgtcttgtgtatt

SEQ ID NO: 4657885 - DNA, 15 bp, Homo sapiens
gcaaacactccaccc

SEQ ID NO: 4657886 - DNA, 17 bp, Homo sapiens
gcaaacactccaccctc

SEQ ID NO: 4657887 - DNA, 16 bp, Homo sapiens
gcaaacagaacagggt

SEQ ID NO: 4657888 - DNA, 19 bp, Homo sapiens
gcaaaccctggtggtattt

SEQ ID NO: 4657889 - DNA, 23 bp, Homo sapiens
gcaaaccctggtggtattttatt

SEQ ID NO: 4657890 - DNA, 16 bp, Homo sapiens
gcaaacctagccccca

SEQ ID NO: 4657891 - DNA, 19 bp, Homo sapiens
gcaaacctagcccccaagc

SEQ ID NO: 4657892 - DNA, 14 bp, Homo sapiens
gcaaactatgattt

SEQ ID NO: 4657893 - DNA, 13 bp, Homo sapiens
gcaaactctgctg

SEQ ID NO: 4657894 - DNA, 21 bp, Homo sapiens
gcaaactgaagctgcacagtg

SEQ ID NO: 4657895 - DNA, 11 bp, Homo sapiens
gcaaagcctgt

SEQ ID NO: 4657896 - DNA, 12 bp, Homo sapiens
gcaaagcctgtt

SEQ ID NO: 4657897 - DNA, 20 bp, Homo sapiens
gcaaagcctgttcatggcag

SEQ ID NO: 4657898 - DNA, 14 bp, Homo sapiens
gcaaagcctttaaa

SEQ ID NO: 4657899 - DNA, 16 bp, Homo sapiens
gcaaagcctttaaatt

SEQ ID NO: 4657900 - DNA, 11 bp, Homo sapiens
gcaaagcttgt

SEQ ID NO: 4657901 - DNA, 17 bp, Homo sapiens
gcaaaggctggctgtgt

SEQ ID NO: 4657902 - DNA, 15 bp, Homo sapiens
gcaaagtggcaggga

SEQ ID NO: 4657903 - DNA, 17 bp, Homo sapiens
gcaaagtggcagggacc

SEQ ID NO: 4657904 - DNA, 18 bp, Homo sapiens
gcaaagtggcagggaccg

SEQ ID NO: 4657905 - DNA, 22 bp, Homo sapiens
gcaaataatttcctggtgtgaa

SEQ ID NO: 4657906 - DNA, 19 bp, Homo sapiens
gcaaatcctatgtgatttt

SEQ ID NO: 4657907 - DNA, 21 bp, Homo sapiens
gcaaattaaaacatatttcat

SEQ ID NO: 4657908 - DNA, 22 bp, Homo sapiens
gcaaattaaaacatatttcatt

SEQ ID NO: 4657909 - DNA, 21 bp, Homo sapiens
gcaaatttttattttttagtg

SEQ ID NO: 4657910 - DNA, 15 bp, Homo sapiens
gcaacaacaattggt

SEQ ID NO: 4657911 - DNA, 20 bp, Homo sapiens
gcaacaaggtcctctgtcag

SEQ ID NO: 4657912 - DNA, 15 bp, Homo sapiens
gcaacacagaggaat

SEQ ID NO: 4657913 - DNA, 14 bp, Homo sapiens
gcaacattggacag

SEQ ID NO: 4657914 - DNA, 18 bp, Homo sapiens
gcaacccgtgccaagtcc

SEQ ID NO: 4657915 - DNA, 22 bp, Homo sapiens
gcaacccgtgccaagtccaggt

SEQ ID NO: 4657916 - DNA, 20 bp, Homo sapiens
gcaaccgtggcccttcctgg

SEQ ID NO: 4657917 - DNA, 23 bp, Homo sapiens
gcaaccgtggcccttcctggaca

SEQ ID NO: 4657918 - DNA, 24 bp, Homo sapiens
gcaaccgtggcccttcctggacag

SEQ ID NO: 4657919 - DNA, 15 bp, Homo sapiens
gcaacctctgcctcc

SEQ ID NO: 4657920 - DNA, 17 bp, Homo sapiens
gcaacggccccagcgcg

SEQ ID NO: 4657921 - DNA, 19 bp, Homo sapiens
gcaactaatgtttgaacaa

SEQ ID NO: 4657922 - DNA, 12 bp, Homo sapiens
gcaagacctcat

SEQ ID NO: 4657923 - DNA, 18 bp, Homo sapiens
gcaagaggatgaaggaag

SEQ ID NO: 4657924 - DNA, 17 bp, Homo sapiens
gcaagagggaacaaaac

SEQ ID NO: 4657925 - DNA, 21 bp, Homo sapiens
gcaagatggacacgagccaca

SEQ ID NO: 4657926 - DNA, 11 bp, Homo sapiens
gcaagccctgc

SEQ ID NO: 4657927 - DNA, 13 bp, Homo sapiens
gcaagccctgccc

SEQ ID NO: 4657928 - DNA, 19 bp, Homo sapiens
gcaagcctaagggatcctg

SEQ ID NO: 4657929 - DNA, 21 bp, Homo sapiens
gcaagctaggccccagaggcc

SEQ ID NO: 4657930 - DNA, 22 bp, Homo sapiens
gcaagctaggccccagaggccc

SEQ ID NO: 4657931 - DNA, 23 bp, Homo sapiens
gcaagctaggccccagaggccct

SEQ ID NO: 4657932 - DNA, 14 bp, Homo sapiens
gcaagctcttccct

SEQ ID NO: 4657933 - DNA, 19 bp, Homo sapiens
gcaagctttgctccttcag

SEQ ID NO: 4657934 - DNA, 16 bp, Homo sapiens
gcaaggaggaggagtc

SEQ ID NO: 4657935 - DNA, 23 bp, Homo sapiens
gcaaggcccgagcagctgagcag

SEQ ID NO: 4657936 - DNA, 13 bp, Homo sapiens
gcaagtcagggtt

SEQ ID NO: 4657937 - DNA, 15 bp, Homo sapiens
gcaagtgtttgtggg

SEQ ID NO: 4657938 - DNA, 15 bp, Homo sapiens
gcaatattttgtata

SEQ ID NO: 4657939 - DNA, 16 bp, Homo sapiens
gcaatgctgtactttt

SEQ ID NO: 4657940 - DNA, 13 bp, Homo sapiens
gcaatggccaggg

SEQ ID NO: 4657941 - DNA, 16 bp, Homo sapiens
gcaatggccaggggcc

SEQ ID NO: 4657942 - DNA, 17 bp, Homo sapiens
gcaatggccaggggcca

SEQ ID NO: 4657943 - DNA, 19 bp, Homo sapiens
gcaatggccaggggccagg

SEQ ID NO: 4657944 - DNA, 19 bp, Homo sapiens
gcaatgggagctgaggcca

SEQ ID NO: 4657945 - DNA, 20 bp, Homo sapiens
gcaatgggagctgaggccac

SEQ ID NO: 4657946 - DNA, 16 bp, Homo sapiens
gcaatgggtcactcat

SEQ ID NO: 4657947 - DNA, 19 bp, Homo sapiens
gcaatgggtcactcattaa

SEQ ID NO: 4657948 - DNA, 17 bp, Homo sapiens
gcaatgtaagcatactt

SEQ ID NO: 4657949 - DNA, 15 bp, Homo sapiens
gcaatgtgttttttc

SEQ ID NO: 4657950 - DNA, 21 bp, Homo sapiens
gcaattcagtcctgggcaaag

SEQ ID NO: 4657951 - DNA, 23 bp, Homo sapiens
gcaattttacctagtttgcacta

SEQ ID NO: 4657952 - DNA, 13 bp, Homo sapiens
gcacaaaacccag

SEQ ID NO: 4657953 - DNA, 16 bp, Homo sapiens
gaacttatgtacagaa

SEQ ID NO: 4657954 - DNA, 19 bp, Homo sapiens
gaacttcaagatgagcctg

SEQ ID NO: 4657955 - DNA, 20 bp, Homo sapiens
gaacttcaagatgagcctgg

SEQ ID NO: 4657956 - DNA, 21 bp, Homo sapiens
gaacttgaagggttactgacg

SEQ ID NO: 4657957 - DNA, 21 bp, Homo sapiens
gaacttggctttcctgtttct

SEQ ID NO: 4657958 - DNA, 16 bp, Homo sapiens
gaactttattaagtaa

SEQ ID NO: 4657959 - DNA, 21 bp, Homo sapiens
gaactttctgttccctatgga

SEQ ID NO: 4657960 - DNA, 22 bp, Homo sapiens
gaacttttcctctgtatcactg

SEQ ID NO: 4657961 - DNA, 22 bp, Homo sapiens
gaagaaagtcaaaaaattattt

SEQ ID NO: 4657962 - DNA, 16 bp, Homo sapiens
gaagaagacacctcta

SEQ ID NO: 4657963 - DNA, 22 bp, Homo sapiens
gaagaaggaaggcctgagcccc

SEQ ID NO: 4657964 - DNA, 14 bp, Homo sapiens
gaagaagtcagaga

SEQ ID NO: 4657965 - DNA, 20 bp, Homo sapiens
gaagaatacccaggaagact

SEQ ID NO: 4657966 - DNA, 19 bp, Homo sapiens
gaagacccaacacatggga

SEQ ID NO: 4657967 - DNA, 23 bp, Homo sapiens
gaagacgggaggggaggcattga

SEQ ID NO: 4657968 - DNA, 22 bp, Homo sapiens
gaagactttgtgactgtcactt

SEQ ID NO: 4657969 - DNA, 16 bp, Homo sapiens
gaagagatcccaggag

SEQ ID NO: 4657970 - DNA, 21 bp, Homo sapiens
gaagagatccttccattccat

SEQ ID NO: 4657971 - DNA, 12 bp, Homo sapiens
gaagagccacct

SEQ ID NO: 4657972 - DNA, 14 bp, Homo sapiens
gaagaggggcagct

SEQ ID NO: 4657973 - DNA, 20 bp, Homo sapiens
gaagaggggcagctttttca

SEQ ID NO: 4657974 - DNA, 17 bp, Homo sapiens
gaagatatgccactaac

SEQ ID NO: 4657975 - DNA, 22 bp, Homo sapiens
gaagatatgccactaacttcta

SEQ ID NO: 4657976 - DNA, 21 bp, Homo sapiens
gaagatcatatacgtgaaaat

SEQ ID NO: 4657977 - DNA, 17 bp, Homo sapiens
gaagcaagacacgtggc

SEQ ID NO: 4657978 - DNA, 18 bp, Homo sapiens
gaagcaagacacgtggcc

SEQ ID NO: 4657979 - DNA, 19 bp, Homo sapiens
gaagcaataaagaagagtg

SEQ ID NO: 4657980 - DNA, 18 bp, Homo sapiens
gaagcacagctcctgcca

SEQ ID NO: 4657981 - DNA, 19 bp, Homo sapiens
gaagcacagctcctgccag

SEQ ID NO: 4657982 - DNA, 22 bp, Homo sapiens
gagcatgatgggaggtgtgcca

SEQ ID NO: 4657983 - DNA, 13 bp, Homo sapiens
gagccacaagctg

SEQ ID NO: 4657984 - DNA, 17 bp, Homo sapiens
gagccacaagctgcact

SEQ ID NO: 4657985 - DNA, 21 bp, Homo sapiens
gagccacaagctgcactgtga

SEQ ID NO: 4657986 - DNA, 17 bp, Homo sapiens
gagccaccaaagtcaca

SEQ ID NO: 4657987 - DNA, 11 bp, Homo sapiens
gagccacctgc

SEQ ID NO: 4657988 - DNA, 18 bp, Homo sapiens
gagccacctgcaagatgg

SEQ ID NO: 4657989 - DNA, 19 bp, Homo sapiens
gagccacctgcaagatgga

SEQ ID NO: 4657990 - DNA, 15 bp, Homo sapiens
gagccagatggcaag

SEQ ID NO: 4657991 - DNA, 15 bp, Homo sapiens
gagccagccacactt

SEQ ID NO: 4657992 - DNA, 17 bp, Homo sapiens
gagccaggatgcccaga

SEQ ID NO: 4657993 - DNA, 18 bp, Homo sapiens
gagcccagcggcccaaga

SEQ ID NO: 4657994 - DNA, 13 bp, Homo sapiens
gagcccagctggg

SEQ ID NO: 4657995 - DNA, 11 bp, Homo sapiens
gagcccaggga

SEQ ID NO: 4657996 - DNA, 15 bp, Homo sapiens
gagcccagggaggcc

SEQ ID NO: 4657997 - DNA, 12 bp, Homo sapiens
gagccccaggca

SEQ ID NO: 4657998 - DNA, 14 bp, Homo sapiens
gagccccaggcagg

SEQ ID NO: 4657999 - DNA, 15 bp, Homo sapiens
gagcccccagccctg

SEQ ID NO: 4658000 - DNA, 15 bp, Homo sapiens
gagcccctcctccag

SEQ ID NO: 4658001 - DNA, 17 bp, Homo sapiens
gagcccctcctccagcc

SEQ ID NO: 4658002 - DNA, 21 bp, Homo sapiens
gagcccctttgcctgtcaagt

SEQ ID NO: 4658003 - DNA, 17 bp, Homo sapiens
gagccggtaactgtcct

SEQ ID NO: 4658004 - DNA, 21 bp, Homo sapiens
gagccggtaactgtcctgtcc

SEQ ID NO: 4658005 - DNA, 20 bp, Homo sapiens
gagcctacctgtatgtcaat

SEQ ID NO: 4658006 - DNA, 14 bp, Homo sapiens
gagcctaggccagg

SEQ ID NO: 4658007 - DNA, 14 bp, Homo sapiens
gagcctccctgcct

SEQ ID NO: 4658008 - DNA, 18 bp, Homo sapiens
gagcctgccgagcaaccg

SEQ ID NO: 4658009 - DNA, 23 bp, Homo sapiens
gagcctgccgagcaaccgtggcc

SEQ ID NO: 4658010 - DNA, 17 bp, Homo sapiens
gagcctgtgaacccagg

SEQ ID NO: 4658011 - DNA, 16 bp, Homo sapiens
gagccttcagtcaggg

SEQ ID NO: 4658012 - DNA, 21 bp, Homo sapiens
gagcgagtggatgctgtgcta

SEQ ID NO: 4658013 - DNA, 21 bp, Homo sapiens
gagcgcacagggagtgcacat

SEQ ID NO: 4658014 - DNA, 17 bp, Homo sapiens
gagcgccatcatgtctt

SEQ ID NO: 4658015 - DNA, 13 bp, Homo sapiens
gagcgccctgcag

SEQ ID NO: 4658016 - DNA, 19 bp, Homo sapiens
gagcgccctgcagaccctg

SEQ ID NO: 4658017 - DNA, 23 bp, Homo sapiens
gagcgccctgcagaccctgccct

SEQ ID NO: 4658018 - DNA, 12 bp, Homo sapiens
gagcgtccttgg

SEQ ID NO: 4658019 - DNA, 20 bp, Homo sapiens
gagctaagggtgggtgctca

SEQ ID NO: 4658020 - DNA, 18 bp, Homo sapiens
gagctacccgcagagttc

SEQ ID NO: 4658021 - DNA, 22 bp, Homo sapiens
gagctacctgtgtggacaggac

SEQ ID NO: 4658022 - DNA, 21 bp, Homo sapiens
gagctaggagcaaagcctgtt

SEQ ID NO: 4658023 - DNA, 21 bp, Homo sapiens
gagctcaacggtctggcaggg

SEQ ID NO: 4658024 - DNA, 14 bp, Homo sapiens
gagctcatcccccc

SEQ ID NO: 4658025 - DNA, 14 bp, Homo sapiens
gagctcctgatcag

SEQ ID NO: 4658026 - DNA, 19 bp, Homo sapiens
gagctctacaggcctgcag

SEQ ID NO: 4658027 - DNA, 20 bp, Homo sapiens
gagctctgagaggccctgga

SEQ ID NO: 4658028 - DNA, 21 bp, Homo sapiens
gagctctgagaggccctggat

SEQ ID NO: 4658029 - DNA, 22 bp, Homo sapiens
gagctctgagaggccctggatc

SEQ ID NO: 4658030 - DNA, 13 bp, Homo sapiens
gagctgagctgga

SEQ ID NO: 4658031 - DNA, 17 bp, Homo sapiens
gagctgaggccacactc

SEQ ID NO: 4658032 - DNA, 13 bp, Homo sapiens
gagctgccacaga

SEQ ID NO: 4658033 - DNA, 16 bp, Homo sapiens
gagctgccacagagaa

SEQ ID NO: 4658034 - DNA, 21 bp, Homo sapiens
gagctgcctggatgagaaaca

SEQ ID NO: 4658035 - DNA, 15 bp, Homo sapiens
gagctggaaggggcc

SEQ ID NO: 4658036 - DNA, 22 bp, Homo sapiens
gagctggaaggggccacgtgga

SEQ ID NO: 4658037 - DNA, 16 bp, Homo sapiens
gagctggggactcagg

SEQ ID NO: 4658038 - DNA, 18 bp, Homo sapiens
gagctgtgccagcagggg

SEQ ID NO: 4658039 - DNA, 22 bp, Homo sapiens
gagcttcccttcctaaaggtaa

SEQ ID NO: 4658040 - DNA, 21 bp, Homo sapiens
gagcttccgctttgaaagaag

SEQ ID NO: 4658041 - DNA, 12 bp, Homo sapiens
gagcttcctggg

SEQ ID NO: 4658042 - DNA, 15 bp, Homo sapiens
gaggaaaagaaacct

SEQ ID NO: 4658043 - DNA, 14 bp, Homo sapiens
gaggaagagccacc

SEQ ID NO: 4658044 - DNA, 14 bp, Homo sapiens
gaggaatcacccca

SEQ ID NO: 4658045 - DNA, 14 bp, Homo sapiens
gaggacaaaacttc

SEQ ID NO: 4658046 - DNA, 15 bp, Homo sapiens
gaggacaaaacttct

SEQ ID NO: 4658047 - DNA, 22 bp, Homo sapiens
gaggacaaaacttcttgtcaga

SEQ ID NO: 4658048 - DNA, 13 bp, Homo sapiens
gaggacagctgtc

SEQ ID NO: 4658049 - DNA, 14 bp, Homo sapiens
gaggaccccttaat

SEQ ID NO: 4658050 - DNA, 14 bp, Homo sapiens
gaggacctgagcct

SEQ ID NO: 4658051 - DNA, 18 bp, Homo sapiens
gaggacctgagcctgccg

SEQ ID NO: 4658052 - DNA, 22 bp, Homo sapiens
gaggacctgagcctgccgagca

SEQ ID NO: 4658053 - DNA, 17 bp, Homo sapiens
gaggactcccaaccctg

SEQ ID NO: 4658054 - DNA, 21 bp, Homo sapiens
gaggactcccaaccctggctt

SEQ ID NO: 4658055 - DNA, 15 bp, Homo sapiens
gaggagagaagaatg

SEQ ID NO: 4658056 - DNA, 15 bp, Homo sapiens
gaggagagagacccc

SEQ ID NO: 4658057 - DNA, 17 bp, Homo sapiens
gaggagagagaccccgc

SEQ ID NO: 4658058 - DNA, 21 bp, Homo sapiens
gaggagatgtgatcaggcccc

SEQ ID NO: 4658059 - DNA, 22 bp, Homo sapiens
gaggagatgtgatcaggcccca

SEQ ID NO: 4658060 - DNA, 19 bp, Homo sapiens
gaggagccaggccccaccc

SEQ ID NO: 4658061 - DNA, 21 bp, Homo sapiens
gaggagccaggccccacccct

SEQ ID NO: 4658062 - DNA, 10 bp, Homo sapiens
gaggagctca

SEQ ID NO: 4658063 - DNA, 19 bp, Homo sapiens
gaggagctcaacggtctgg

SEQ ID NO: 4658064 - DNA, 23 bp, Homo sapiens
gaggagctcaacggtctggcagg

SEQ ID NO: 4658065 - DNA, 19 bp, Homo sapiens
gaggaggtaatgaattaaa

SEQ ID NO: 4658066 - DNA, 14 bp, Homo sapiens
gaggagtcagatga

SEQ ID NO: 4658067 - DNA, 15 bp, Homo sapiens
gaggagtctgaggtc

SEQ ID NO: 4658068 - DNA, 22 bp, Homo sapiens
gaggagtctgaggtcctgagca

SEQ ID NO: 4658069 - DNA, 14 bp, Homo sapiens
gaggatgagaccca

SEQ ID NO: 4658070 - DNA, 15 bp, Homo sapiens
gaggatgagacccag

SEQ ID NO: 4658071 - DNA, 17 bp, Homo sapiens
gaggatgagacccagcc

SEQ ID NO: 4658072 - DNA, 17 bp, Homo sapiens
gaggattgttgaatcta

SEQ ID NO: 4658073 - DNA, 13 bp, Homo sapiens
gaggcagactcct

SEQ ID NO: 4658074 - DNA, 13 bp, Homo sapiens
gaggcagggacaa

SEQ ID NO: 4658075 - DNA, 15 bp, Homo sapiens
gaggcatttgagcag

SEQ ID NO: 4658076 - DNA, 16 bp, Homo sapiens
gaggccaaccagcccg

SEQ ID NO: 4658077 - DNA, 21 bp, Homo sapiens
gaggccacactcagcacaagg

SEQ ID NO: 4658078 - DNA, 18 bp, Homo sapiens
gaggccagcctggcctcc

SEQ ID NO: 4658079 - DNA, 17 bp, Homo sapiens
gaggccatctcaggaga

SEQ ID NO: 4658080 - DNA, 21 bp, Homo sapiens
gaggcccactgtgtctaggca

SEQ ID NO: 4658081 - DNA, 16 bp, Homo sapiens
gaggcccccacccttg

SEQ ID NO: 4658082 - DNA, 19 bp, Homo sapiens
gaggcccccatctccttaa

SEQ ID NO: 4658083 - DNA, 14 bp, Homo sapiens
gaggccctcctgtg

SEQ ID NO: 4658084 - DNA, 12 bp, Homo sapiens
gaggccctggag

SEQ ID NO: 4658085 - DNA, 21 bp, Homo sapiens
gaggccctggaggtctccagg

SEQ ID NO: 4658086 - DNA, 15 bp, Homo sapiens
gaggcctagactctg

SEQ ID NO: 4658087 - DNA, 17 bp, Homo sapiens
gaggcgccccaacccgt

SEQ ID NO: 4658088 - DNA, 20 bp, Homo sapiens
gaggcgccccaacccgtgga

SEQ ID NO: 4658089 - DNA, 10 bp, Homo sapiens
gaggctcagg

SEQ ID NO: 4658090 - DNA, 16 bp, Homo sapiens
gaggctgaggctggca

SEQ ID NO: 4658091 - DNA, 19 bp, Homo sapiens
gaggctgcagtgagccatg

SEQ ID NO: 4658092 - DNA, 13 bp, Homo sapiens
gaggctgctcggg

SEQ ID NO: 4658093 - DNA, 21 bp, Homo sapiens
gaggctgctcggggtgcacag

SEQ ID NO: 4658094 - DNA, 22 bp, Homo sapiens
gaggctgctcggggtgcacagg

SEQ ID NO: 4658095 - DNA, 23 bp, Homo sapiens
gaggctgctcggggtgcacagga

SEQ ID NO: 4658096 - DNA, 21 bp, Homo sapiens
gaggctgtaactgagagaaag

SEQ ID NO: 4658097 - DNA, 18 bp, Homo sapiens
gaggcttccctacacagg

SEQ ID NO: 4658098 - DNA, 16 bp, Homo sapiens
gaggctttctgggctc

SEQ ID NO: 4658099 - DNA, 18 bp, Homo sapiens
gaggctttctgggctctg

SEQ ID NO: 4658100 - DNA, 20 bp, Homo sapiens
gaggctttctgggctctgga

SEQ ID NO: 4658101 - DNA, 23 bp, Homo sapiens
gaggctttggtaaaacagtttca

SEQ ID NO: 4658102 - DNA, 21 bp, Homo sapiens
gagggaaatctgtaaagccag

SEQ ID NO: 4658103 - DNA, 17 bp, Homo sapiens
gagggacaaaggagcct

SEQ ID NO: 4658104 - DNA, 17 bp, Homo sapiens
gagggacaaccagaagg

SEQ ID NO: 4658105 - DNA, 14 bp, Homo sapiens
gagggaggggaggg

SEQ ID NO: 4658106 - DNA, 17 bp, Homo sapiens
gagggcagcagccagcc

SEQ ID NO: 4658107 - DNA, 16 bp, Homo sapiens
gagggcagcgggagcc

SEQ ID NO: 4658108 - DNA, 23 bp, Homo sapiens
gagggcagcgggagcctccctgc

SEQ ID NO: 4658109 - DNA, 15 bp, Homo sapiens
gagggcagtgccctt

SEQ ID NO: 4658110 - DNA, 19 bp, Homo sapiens
gagggcagttcgcagccac

SEQ ID NO: 4658111 - DNA, 20 bp, Homo sapiens
gagggcagttcgcagccacc

SEQ ID NO: 4658112 - DNA, 12 bp, Homo sapiens
gaggggaggcat

SEQ ID NO: 4658113 - DNA, 23 bp, Homo sapiens
gaggggctggggacttgtgtctg

SEQ ID NO: 4658114 - DNA, 22 bp, Homo sapiens
gagggggaagagatcccaggag

SEQ ID NO: 4658115 - DNA, 23 bp, Homo sapiens
gaggtagctatagttgcagccca

SEQ ID NO: 4658116 - DNA, 15 bp, Homo sapiens
gaggtcaccagctgc

SEQ ID NO: 4658117 - DNA, 16 bp, Homo sapiens
gaggtcaccaggggag

SEQ ID NO: 4658118 - DNA, 20 bp, Homo sapiens
gaggtcaccaggggaggagc

SEQ ID NO: 4658119 - DNA, 14 bp, Homo sapiens
gaggtcagggagtg

SEQ ID NO: 4658120 - DNA, 23 bp, Homo sapiens
gaggtcagggagtgctggctcac

SEQ ID NO: 4658121 - DNA, 16 bp, Homo sapiens
gaggtcccagccctgg

SEQ ID NO: 4658122 - DNA, 12 bp, Homo sapiens
gaggtcctgagc

SEQ ID NO: 4658123 - DNA, 19 bp, Homo sapiens
gaggtcctgagcactgcca

SEQ ID NO: 4658124 - DNA, 22 bp, Homo sapiens
gaggtcctgagcactgccagga

SEQ ID NO: 4658125 - DNA, 19 bp, Homo sapiens
gaggtccttaggcctctga

SEQ ID NO: 4658126 - DNA, 12 bp, Homo sapiens
gaggtctccagg

SEQ ID NO: 4658127 - DNA, 13 bp, Homo sapiens
gaggtctccaggg

SEQ ID NO: 4658128 - DNA, 17 bp, Homo sapiens
gaggtctccaggggcct

SEQ ID NO: 4658129 - DNA, 21 bp, Homo sapiens
gaggtctccaggggcctgcag

SEQ ID NO: 4658130 - DNA, 21 bp, Homo sapiens
gaggtctcgaccctgtcccct

SEQ ID NO: 4658131 - DNA, 19 bp, Homo sapiens
gaggtgaatactcttgaaa

SEQ ID NO: 4658132 - DNA, 19 bp, Homo sapiens
gaggtgaccccagggcaca

SEQ ID NO: 4658133 - DNA, 22 bp, Homo sapiens
gaggtgaccccagggcacagga

SEQ ID NO: 4658134 - DNA, 21 bp, Homo sapiens
gaggtgccacccagtagccca

SEQ ID NO: 4658135 - DNA, 18 bp, Homo sapiens
gaggtgcccactccgcca

SEQ ID NO: 4658136 - DNA, 21 bp, Homo sapiens
gaggtgcccactccgccagcc

SEQ ID NO: 4658137 - DNA, 22 bp, Homo sapiens
gaggtgcccactccgccagcca

SEQ ID NO: 4658138 - DNA, 19 bp, Homo sapiens
gaggtgctgtccccactgc

SEQ ID NO: 4658139 - DNA, 23 bp, Homo sapiens
gaggtggttcagacaagacagag

SEQ ID NO: 4658140 - DNA, 17 bp, Homo sapiens
gaggtgttacagaggac

SEQ ID NO: 4658141 - DNA, 14 bp, Homo sapiens
gaggtttagcaata

SEQ ID NO: 4658142 - DNA, 17 bp, Homo sapiens
gagtaaaaagacatttt

SEQ ID NO: 4658143 - DNA, 13 bp, Homo sapiens
gagtaatctgtgt

SEQ ID NO: 4658144 - DNA, 22 bp, Homo sapiens
gagtaatctgtgtacaaagaaa

SEQ ID NO: 4658145 - DNA, 12 bp, Homo sapiens
gagtacctgtgt

SEQ ID NO: 4658146 - DNA, 20 bp, Homo sapiens
gagtagcggtccaagcctgc

SEQ ID NO: 4658147 - DNA, 17 bp, Homo sapiens
gagtagctagtttgctt

SEQ ID NO: 4658148 - DNA, 13 bp, Homo sapiens
gagtagctgagct

SEQ ID NO: 4658149 - DNA, 15 bp, Homo sapiens
gagtataagaaatgc

SEQ ID NO: 4658150 - DNA, 17 bp, Homo sapiens
gagtataagaaatgcat

SEQ ID NO: 4658151 - DNA, 15 bp, Homo sapiens
gagtatacggaaaca

SEQ ID NO: 4658152 - DNA, 22 bp, Homo sapiens
gagtcaagtaatggaggtccca

SEQ ID NO: 4658153 - DNA, 18 bp, Homo sapiens
gagtcagatgaggccctg

SEQ ID NO: 4658154 - DNA, 21 bp, Homo sapiens
gagtcagccccgacttcctga

SEQ ID NO: 4658155 - DNA, 18 bp, Homo sapiens
gagtctaatagtctttgc

SEQ ID NO: 4658156 - DNA, 19 bp, Homo sapiens
gagtctaatagtctttgcc

SEQ ID NO: 4658157 - DNA, 17 bp, Homo sapiens
gagtctatgttcaaaga

SEQ ID NO: 4658158 - DNA, 21 bp, Homo sapiens
gagtctatgttcaaagactgt

SEQ ID NO: 4658159 - DNA, 15 bp, Homo sapiens
gagtctctcttccaa

SEQ ID NO: 4658160 - DNA, 15 bp, Homo sapiens
gagtctgaggtcctg

SEQ ID NO: 4658161 - DNA, 20 bp, Homo sapiens
gagtctgggtccatcctggt

SEQ ID NO: 4658162 - DNA, 19 bp, Homo sapiens
gagtctgtttcccaagcta

SEQ ID NO: 4658163 - DNA, 20 bp, Homo sapiens
gagtctgtttcccaagctag

SEQ ID NO: 4658164 - DNA, 16 bp, Homo sapiens
gagtctgttttgtaaa

SEQ ID NO: 4658165 - DNA, 19 bp, Homo sapiens
gagtcttggtttctctcta

SEQ ID NO: 4658166 - DNA, 15 bp, Homo sapiens
gagtgacggctggca

SEQ ID NO: 4658167 - DNA, 19 bp, Homo sapiens
gagtgagatgtagaaagtt

SEQ ID NO: 4658168 - DNA, 20 bp, Homo sapiens
gagtgccataccttctccca

SEQ ID NO: 4658169 - DNA, 23 bp, Homo sapiens
gagtgccataccttctcccaggc

SEQ ID NO: 4658170 - DNA, 18 bp, Homo sapiens
gagtggatgctgtgctac

SEQ ID NO: 4658171 - DNA, 17 bp, Homo sapiens
gagtggcctccctgctg

SEQ ID NO: 4658172 - DNA, 19 bp, Homo sapiens
gagtggcttcactcctgct

SEQ ID NO: 4658173 - DNA, 23 bp, Homo sapiens
gagtgggagagtacctgtgtgtt

SEQ ID NO: 4658174 - DNA, 15 bp, Homo sapiens
gagtgggttgatttc

SEQ ID NO: 4658175 - DNA, 14 bp, Homo sapiens
gagtggttcctgtg

SEQ ID NO: 4658176 - DNA, 18 bp, Homo sapiens
gagtgtagcctaaagggc

SEQ ID NO: 4658177 - DNA, 23 bp, Homo sapiens
gagtgtagcctaaagggcagggc

SEQ ID NO: 4658178 - DNA, 18 bp, Homo sapiens
gagtgtcctgcccatgcc

SEQ ID NO: 4658179 - DNA, 11 bp, Homo sapiens
gagtgtgacag

SEQ ID NO: 4658180 - DNA, 14 bp, Homo sapiens
gagtgtgacagggc

SEQ ID NO: 4658181 - DNA, 15 bp, Homo sapiens
gagtgtgacagggcc

SEQ ID NO: 4658182 - DNA, 20 bp, Homo sapiens
gagtgtgcatggaggccctc

SEQ ID NO: 4658183 - DNA, 18 bp, Homo sapiens
gagttatcaagagacact

SEQ ID NO: 4658184 - DNA, 21 bp, Homo sapiens
gagttgccaactattctcagg

SEQ ID NO: 4658185 - DNA, 15 bp, Homo sapiens
gagttgtgatggagg

SEQ ID NO: 4658186 - DNA, 22 bp, Homo sapiens
gagttgtgatggaggggagagg

SEQ ID NO: 4658187 - DNA, 18 bp, Homo sapiens
gagtttaatacaggaaat

SEQ ID NO: 4658188 - DNA, 14 bp, Homo sapiens
gagtttcagctgga

SEQ ID NO: 4658189 - DNA, 16 bp, Homo sapiens
gagtttcagctggaaa

SEQ ID NO: 4658190 - DNA, 12 bp, Homo sapiens
gaaaattgtatt

SEQ ID NO: 4658191 - DNA, 18 bp, Homo sapiens
gaaaatttacaaaattta

SEQ ID NO: 4658192 - DNA, 22 bp, Homo sapiens
gaaacaaaaatgatcctcagtg

SEQ ID NO: 4658193 - DNA, 14 bp, Homo sapiens
gaaacaaagaaggt

SEQ ID NO: 4658194 - DNA, 17 bp, Homo sapiens
gaaacaaagtactcttt

SEQ ID NO: 4658195 - DNA, 13 bp, Homo sapiens
gaaacaagctgtg

SEQ ID NO: 4658196 - DNA, 15 bp, Homo sapiens
gaaacaagctgtgca

SEQ ID NO: 4658197 - DNA, 19 bp, Homo sapiens
gaaacaccacttaatcttc

SEQ ID NO: 4658198 - DNA, 12 bp, Homo sapiens
gaaacagctcag

SEQ ID NO: 4658199 - DNA, 15 bp, Homo sapiens
gaaacagctcagcca

SEQ ID NO: 4658200 - DNA, 21 bp, Homo sapiens
gaaacagttgctgtgaacttt

SEQ ID NO: 4658201 - DNA, 13 bp, Homo sapiens
gaaacatgtcttg

SEQ ID NO: 4658202 - DNA, 20 bp, Homo sapiens
gaaacattttatcattaaaa

SEQ ID NO: 4658203 - DNA, 14 bp, Homo sapiens
gaaaccaagagaca

SEQ ID NO: 4658204 - DNA, 17 bp, Homo sapiens
gaaacctacaagatttc

SEQ ID NO: 4658205 - DNA, 15 bp, Homo sapiens
gaaactgaggcccac

SEQ ID NO: 4658206 - DNA, 16 bp, Homo sapiens
gaaacttacactgttt

SEQ ID NO: 4658207 - DNA, 22 bp, Homo sapiens
gaaacttacactgtttcatctc

SEQ ID NO: 4658208 - DNA, 19 bp, Homo sapiens
gaaacttctgtaaggggca

SEQ ID NO: 4658209 - DNA, 15 bp, Homo sapiens
gaaagaaagggaccc

SEQ ID NO: 4658210 - DNA, 16 bp, Homo sapiens
gaaagaagggggccct

SEQ ID NO: 4658211 - DNA, 23 bp, Homo sapiens
gaaagaagggggccctgctacct

SEQ ID NO: 4658212 - DNA, 21 bp, Homo sapiens
gaaagaatcagtaggaccagg

SEQ ID NO: 4658213 - DNA, 22 bp, Homo sapiens
gaaagacatccataaagaagca

SEQ ID NO: 4658214 - DNA, 23 bp, Homo sapiens
gaaagacatccataaagaagcaa

SEQ ID NO: 4658215 - DNA, 22 bp, Homo sapiens
gaaagaccctgatgcaggtcag

SEQ ID NO: 4658216 - DNA, 16 bp, Homo sapiens
gaaagagagaagccag

SEQ ID NO: 4658217 - DNA, 18 bp, Homo sapiens
gaaagagagaagccagcc

SEQ ID NO: 4658218 - DNA, 15 bp, Homo sapiens
gaaagagctgcctgg

SEQ ID NO: 4658219 - DNA, 14 bp, Homo sapiens
gaaagaggtgaccc

SEQ ID NO: 4658220 - DNA, 20 bp, Homo sapiens
gaaagaggtgaccccagggc

SEQ ID NO: 4658221 - DNA, 21 bp, Homo sapiens
gaaagaggtgaccccagggca

SEQ ID NO: 4658222 - DNA, 23 bp, Homo sapiens
gaaagaggtgaccccagggcaca

SEQ ID NO: 4658223 - DNA, 12 bp, Homo sapiens
gaaagatactaa

SEQ ID NO: 4658224 - DNA, 20 bp, Homo sapiens
gaaagccaggagcagccctg

SEQ ID NO: 4658225 - DNA, 14 bp, Homo sapiens
gaaagcgcagatgc

SEQ ID NO: 4658226 - DNA, 17 bp, Homo sapiens
gaaaggaaaagaggccc

SEQ ID NO: 4658227 - DNA, 11 bp, Homo sapiens
gaaaggaagca

SEQ ID NO: 4658228 - DNA, 13 bp, Homo sapiens
gaaaggaagcaac

SEQ ID NO: 4658229 - DNA, 18 bp, Homo sapiens
gaaaggctattttcagat

SEQ ID NO: 4658230 - DNA, 13 bp, Homo sapiens
gaaagggagggct

SEQ ID NO: 4658231 - DNA, 18 bp, Homo sapiens
gaaagggagggctctgag

SEQ ID NO: 4658232 - DNA, 20 bp, Homo sapiens
gaaagggagggctctgaggc

SEQ ID NO: 4658233 - DNA, 21 bp, Homo sapiens
gaaagggagggctctgaggcg

SEQ ID NO: 4658234 - DNA, 16 bp, Homo sapiens
gaaaggggttggggtg

SEQ ID NO: 4658235 - DNA, 21 bp, Homo sapiens
gaaaggggttggggtgacagt

SEQ ID NO: 4658236 - DNA, 13 bp, Homo sapiens
gaaaggttttgga

SEQ ID NO: 4658237 - DNA, 17 bp, Homo sapiens
gaaagtcaaaaaattat

SEQ ID NO: 4658238 - DNA, 18 bp, Homo sapiens
gaaagtcaaaaaattatt

SEQ ID NO: 4658239 - DNA, 19 bp, Homo sapiens
gaaataaaaggaagccaaa

SEQ ID NO: 4658240 - DNA, 14 bp, Homo sapiens
gaaataacagagag

SEQ ID NO: 4658241 - DNA, 21 bp, Homo sapiens
gaaatagctgaaaagggcact

SEQ ID NO: 4658242 - DNA, 16 bp, Homo sapiens
gaaatagttgtctgtg

SEQ ID NO: 4658243 - DNA, 18 bp, Homo sapiens
gaaatagttgtctgtgct

SEQ ID NO: 4658244 - DNA, 19 bp, Homo sapiens
gaaatagttgtctgtgctt

SEQ ID NO: 4658245 - DNA, 15 bp, Homo sapiens
gaaatattcagaaat

SEQ ID NO: 4658246 - DNA, 14 bp, Homo sapiens
gaaatcctctgtta

SEQ ID NO: 4658247 - DNA, 16 bp, Homo sapiens
gaaatctgtaaagcca

SEQ ID NO: 4658248 - DNA, 18 bp, Homo sapiens
gaaatctgtaaagccagt

SEQ ID NO: 4658249 - DNA, 22 bp, Homo sapiens
gaaatgatagagaactgaagga

SEQ ID NO: 4658250 - DNA, 13 bp, Homo sapiens
gaaatgcttaaaa

SEQ ID NO: 4658251 - DNA, 10 bp, Homo sapiens
gaaattcagt

SEQ ID NO: 4658252 - DNA, 16 bp, Homo sapiens
gaaattcgcatgttta

SEQ ID NO: 4658253 - DNA, 15 bp, Homo sapiens
gaaattctccaggat

SEQ ID NO: 4658254 - DNA, 13 bp, Homo sapiens
gaaattttgctat

SEQ ID NO: 4658255 - DNA, 20 bp, Homo sapiens
gaaatttttcagatgcttct

SEQ ID NO: 4658256 - DNA, 20 bp, Homo sapiens
gaaattttttagtatgttca

SEQ ID NO: 4658257 - DNA, 15 bp, Homo sapiens
gaacaaaactccaga

SEQ ID NO: 4658258 - DNA, 16 bp, Homo sapiens
gaacaaagcagccacg

SEQ ID NO: 4658259 - DNA, 19 bp, Homo sapiens
gaacaaagcagccacgagg

SEQ ID NO: 4658260 - DNA, 16 bp, Homo sapiens
gaacacaaaacttgaa

SEQ ID NO: 4658261 - DNA, 15 bp, Homo sapiens
gaacagaagtgagga

SEQ ID NO: 4658262 - DNA, 21 bp, Homo sapiens
gaacagcgaagtagcttgctc

SEQ ID NO: 4658263 - DNA, 16 bp, Homo sapiens
gaacagctttgtatgt

SEQ ID NO: 4658264 - DNA, 17 bp, Homo sapiens
gaacagctttgtatgtt

SEQ ID NO: 4658265 - DNA, 18 bp, Homo sapiens
gaacaggaggtgtgaatg

SEQ ID NO: 4658266 - DNA, 20 bp, Homo sapiens
gaacaggaggtgtgaatgca

SEQ ID NO: 4658267 - DNA, 21 bp, Homo sapiens
gaacaggaggtgtgaatgcac

SEQ ID NO: 4658268 - DNA, 18 bp, Homo sapiens
gaacagtggttgcctggg

SEQ ID NO: 4658269 - DNA, 21 bp, Homo sapiens
gaacatacatgatacattttt

SEQ ID NO: 4658270 - DNA, 17 bp, Homo sapiens
gaacatctatagagata

SEQ ID NO: 4658271 - DNA, 12 bp, Homo sapiens
gaacatcttcat

SEQ ID NO: 4658272 - DNA, 16 bp, Homo sapiens
gaacattcagctctgg

SEQ ID NO: 4658273 - DNA, 14 bp, Homo sapiens
gaaccaacatcttt

SEQ ID NO: 4658274 - DNA, 12 bp, Homo sapiens
gaacccaggaca

SEQ ID NO: 4658275 - DNA, 19 bp, Homo sapiens
gaacccaggacaagcatgg

SEQ ID NO: 4658276 - DNA, 14 bp, Homo sapiens
gaaccccctccctg

SEQ ID NO: 4658277 - DNA, 18 bp, Homo sapiens
gaaccccctccctgtccc

SEQ ID NO: 4658278 - DNA, 11 bp, Homo sapiens
gaaccctgccc

SEQ ID NO: 4658279 - DNA, 12 bp, Homo sapiens
gaaccctgccct

SEQ ID NO: 4658280 - DNA, 14 bp, Homo sapiens
gaacctaataccct

SEQ ID NO: 4658281 - DNA, 15 bp, Homo sapiens
gaacctcctctgtga

SEQ ID NO: 4658282 - DNA, 12 bp, Homo sapiens
gaacctggcctt

SEQ ID NO: 4658283 - DNA, 12 bp, Homo sapiens
gaacgtttttcc

SEQ ID NO: 4658284 - DNA, 18 bp, Homo sapiens
gaactattccccagcagg

SEQ ID NO: 4658285 - DNA, 20 bp, Homo sapiens
gaactattccccagcagggt

SEQ ID NO: 4658286 - DNA, 17 bp, Homo sapiens
gaactcactctgggctg

SEQ ID NO: 4658287 - DNA, 15 bp, Homo sapiens
gaactcctgacctcg

SEQ ID NO: 4658288 - DNA, 23 bp, Homo sapiens
gaactcctgacctcgtgatctac

SEQ ID NO: 4658289 - DNA, 15 bp, Homo sapiens
gaactctcccctccc

SEQ ID NO: 4658290 - DNA, 16 bp, Homo sapiens
gaactctcctcttttt

SEQ ID NO: 4658291 - DNA, 22 bp, Homo sapiens
gaactctcctctttttttaaaa

SEQ ID NO: 4658292 - DNA, 18 bp, Homo sapiens
gaactgaactaatccttc

SEQ ID NO: 4658293 - DNA, 16 bp, Homo sapiens
gaactgactgaaggaa

SEQ ID NO: 4658294 - DNA, 23 bp, Homo sapiens
gaactgattgctcccaggatctc

SEQ ID NO: 4658295 - DNA, 15 bp, Homo sapiens
gaactgcttcatgtg

SEQ ID NO: 4658296 - DNA, 18 bp, Homo sapiens
gaactgcttcatgtgaac

SEQ ID NO: 4658297 - DNA, 16 bp, Homo sapiens
gaactggccaagctga

SEQ ID NO: 4658298 - DNA, 18 bp, Homo sapiens
gaactggccaagctgagg

SEQ ID NO: 4658299 - DNA, 17 bp, Homo sapiens
gaactgtgtgtgaatct

SEQ ID NO: 4658300 - DNA, 14 bp, Homo sapiens
gaactgtgtttcaa

SEQ ID NO: 4658301 - DNA, 23 bp, Homo sapiens
gaactgtgtttcaaatggactgt

SEQ ID NO: 4658302 - DNA, 15 bp, Homo sapiens
ctttcagggcctcca

SEQ ID NO: 4658303 - DNA, 21 bp, Homo sapiens
ctttcagtgcagtttcttttc

SEQ ID NO: 4658304 - DNA, 22 bp, Homo sapiens
ctttcagtgcagtttcttttca

SEQ ID NO: 4658305 - DNA, 23 bp, Homo sapiens
ctttcagtggaaaccctgagagt

SEQ ID NO: 4658306 - DNA, 10 bp, Homo sapiens
ctttccaaat

SEQ ID NO: 4658307 - DNA, 18 bp, Homo sapiens
ctttccaaattaaaacaa

SEQ ID NO: 4658308 - DNA, 16 bp, Homo sapiens
ctttccaaggaagcag

SEQ ID NO: 4658309 - DNA, 18 bp, Homo sapiens
ctttccaaggaagcagaa

SEQ ID NO: 4658310 - DNA, 16 bp, Homo sapiens
ctttccaatagaaaga

SEQ ID NO: 4658311 - DNA, 21 bp, Homo sapiens
ctttccatctatcactgcatt

SEQ ID NO: 4658312 - DNA, 21 bp, Homo sapiens
ctttcccaccattcctgcctt

SEQ ID NO: 4658313 - DNA, 14 bp, Homo sapiens
ctttccccaaggac

SEQ ID NO: 4658314 - DNA, 16 bp, Homo sapiens
ctttccccaggggcat

SEQ ID NO: 4658315 - DNA, 19 bp, Homo sapiens
ctttcccccaccagctaag

SEQ ID NO: 4658316 - DNA, 18 bp, Homo sapiens
ctttcccgcccagcctca

SEQ ID NO: 4658317 - DNA, 22 bp, Homo sapiens
ctttccggccaaggtgccacca

SEQ ID NO: 4658318 - DNA, 16 bp, Homo sapiens
ctttcctccccctgca

SEQ ID NO: 4658319 - DNA, 12 bp, Homo sapiens
ctttcctgctgg

SEQ ID NO: 4658320 - DNA, 20 bp, Homo sapiens
ctttcctgtagccttctgta

SEQ ID NO: 4658321 - DNA, 14 bp, Homo sapiens
ctttcctttcaata

SEQ ID NO: 4658322 - DNA, 23 bp, Homo sapiens
ctttctagacatcattgtcagcc

SEQ ID NO: 4658323 - DNA, 17 bp, Homo sapiens
ctttctagttcagctgc

SEQ ID NO: 4658324 - DNA, 20 bp, Homo sapiens
ctttctcggtccactcttgt

SEQ ID NO: 4658325 - DNA, 15 bp, Homo sapiens
ctttctctgcctggc

SEQ ID NO: 4658326 - DNA, 20 bp, Homo sapiens
ctttctcttttcctctacca

SEQ ID NO: 4658327 - DNA, 13 bp, Homo sapiens
ctttctggctctc

SEQ ID NO: 4658328 - DNA, 18 bp, Homo sapiens
ctttctgtttcctggcct

SEQ ID NO: 4658329 - DNA, 21 bp, Homo sapiens
ctttctgtttcctggcctcag

SEQ ID NO: 4658330 - DNA, 17 bp, Homo sapiens
ctttgaaagaagcaaga

SEQ ID NO: 4658331 - DNA, 23 bp, Homo sapiens
ctttgaatgctaagaatgcatta

SEQ ID NO: 4658332 - DNA, 17 bp, Homo sapiens
ctttgaattttctgtgt

SEQ ID NO: 4658333 - DNA, 18 bp, Homo sapiens
ctttgacaattgggagct

SEQ ID NO: 4658334 - DNA, 23 bp, Homo sapiens
ctttgacaattgggagctgccaa

SEQ ID NO: 4658335 - DNA, 18 bp, Homo sapiens
ctttgacttcttgcttca

SEQ ID NO: 4658336 - DNA, 19 bp, Homo sapiens
ctttgagatctggggaggc

SEQ ID NO: 4658337 - DNA, 17 bp, Homo sapiens
ctttgcggggcctgtct

SEQ ID NO: 4658338 - DNA, 21 bp, Homo sapiens
ctttgcggggcctgtctcagt

SEQ ID NO: 4658339 - DNA, 14 bp, Homo sapiens
ctttgctccttcag

SEQ ID NO: 4658340 - DNA, 14 bp, Homo sapiens
ctttgctggaagaa

SEQ ID NO: 4658341 - DNA, 13 bp, Homo sapiens
ctttggaaagcca

SEQ ID NO: 4658342 - DNA, 13 bp, Homo sapiens
ctttggacagctg

SEQ ID NO: 4658343 - DNA, 22 bp, Homo sapiens
ctttggattgctggggccaggc

SEQ ID NO: 4658344 - DNA, 16 bp, Homo sapiens
ctttgggaaagctctt

SEQ ID NO: 4658345 - DNA, 15 bp, Homo sapiens
ctttgggaagactga

SEQ ID NO: 4658346 - DNA, 14 bp, Homo sapiens
ctttggtaaaacag

SEQ ID NO: 4658347 - DNA, 12 bp, Homo sapiens
ctttgtaaatag

SEQ ID NO: 4658348 - DNA, 14 bp, Homo sapiens
ctttgtagctactt

SEQ ID NO: 4658349 - DNA, 20 bp, Homo sapiens
ctttgtcatagttatgtgat

SEQ ID NO: 4658350 - DNA, 14 bp, Homo sapiens
ctttgtcattttca

SEQ ID NO: 4658351 - DNA, 19 bp, Homo sapiens
ctttgtctaaaacaataaa

SEQ ID NO: 4658352 - DNA, 20 bp, Homo sapiens
ctttgtctcaaaataaagca

SEQ ID NO: 4658353 - DNA, 15 bp, Homo sapiens
ctttgtggtttagtt

SEQ ID NO: 4658354 - DNA, 20 bp, Homo sapiens
ctttgtgttgggagggatta

SEQ ID NO: 4658355 - DNA, 23 bp, Homo sapiens
ctttgtttatgaagaaagatact

SEQ ID NO: 4658356 - DNA, 17 bp, Homo sapiens
cttttaagcatgtgatg

SEQ ID NO: 4658357 - DNA, 23 bp, Homo sapiens
cttttaagcatgtgatgttgtct

SEQ ID NO: 4658358 - DNA, 15 bp, Homo sapiens
cttttaatcctggct

SEQ ID NO: 4658359 - DNA, 15 bp, Homo sapiens
cttttaatggcattt

SEQ ID NO: 4658360 - DNA, 23 bp, Homo sapiens
cttttaatggcatttctctttaa

SEQ ID NO: 4658361 - DNA, 14 bp, Homo sapiens
cttttagaaatgca

SEQ ID NO: 4658362 - DNA, 18 bp, Homo sapiens
cttttataattaatgttt

SEQ ID NO: 4658363 - DNA, 12 bp, Homo sapiens
cttttattattt

SEQ ID NO: 4658364 - DNA, 17 bp, Homo sapiens
cttttatttggtgtgtt

SEQ ID NO: 4658365 - DNA, 16 bp, Homo sapiens
cttttcatctgggaaa

SEQ ID NO: 4658366 - DNA, 23 bp, Homo sapiens
cttttccacagatttttttgtaa

SEQ ID NO: 4658367 - DNA, 22 bp, Homo sapiens
cttttcccccaccctcccatga

SEQ ID NO: 4658368 - DNA, 23 bp, Homo sapiens
cttttcctaacatgcaccttgct

SEQ ID NO: 4658369 - DNA, 12 bp, Homo sapiens
cttttccttttt

SEQ ID NO: 4658370 - DNA, 13 bp, Homo sapiens
cttttctgtaatg

SEQ ID NO: 4658371 - DNA, 12 bp, Homo sapiens
cttttcttgata

SEQ ID NO: 4658372 - DNA, 17 bp, Homo sapiens
cttttgaattcttgata

SEQ ID NO: 4658373 - DNA, 14 bp, Homo sapiens
cttttgaattgttt

SEQ ID NO: 4658374 - DNA, 15 bp, Homo sapiens
cttttgcaggataat

SEQ ID NO: 4658375 - DNA, 21 bp, Homo sapiens
cttttgtgtccctgaagtatt

SEQ ID NO: 4658376 - DNA, 12 bp, Homo sapiens
cttttgtgtcta

SEQ ID NO: 4658377 - DNA, 20 bp, Homo sapiens
ctttttaaggtctttcagta

SEQ ID NO: 4658378 - DNA, 19 bp, Homo sapiens
ctttttacagcagcaatat

SEQ ID NO: 4658379 - DNA, 16 bp, Homo sapiens
ctttttagggcagatt

SEQ ID NO: 4658380 - DNA, 16 bp, Homo sapiens
ctttttagtaatttct

SEQ ID NO: 4658381 - DNA, 20 bp, Homo sapiens
ctttttcatccttctttcct

SEQ ID NO: 4658382 - DNA, 22 bp, Homo sapiens
ctttttgctgtgtagttccctc

SEQ ID NO: 4658383 - DNA, 23 bp, Homo sapiens
ctttttggactagccagaattct

SEQ ID NO: 4658384 - DNA, 12 bp, Homo sapiens
ctttttggcctg

SEQ ID NO: 4658385 - DNA, 18 bp, Homo sapiens
cttttttaaatattttct

SEQ ID NO: 4658386 - DNA, 22 bp, Homo sapiens
cttttttaaatattttctattt

SEQ ID NO: 4658387 - DNA, 20 bp, Homo sapiens
cttttttggggagtacctgt

SEQ ID NO: 4658388 - DNA, 15 bp, Homo sapiens
cttttttgtttgttt

SEQ ID NO: 4658389 - DNA, 17 bp, Homo sapiens
cttttttgtttgtttct

SEQ ID NO: 4658390 - DNA, 20 bp, Homo sapiens
ctttttttaaaaataaatct

SEQ ID NO: 4658391 - DNA, 22 bp, Homo sapiens
gaaaaaaatgtacatttattca

SEQ ID NO: 4658392 - DNA, 12 bp, Homo sapiens
gaaaaatagagc

SEQ ID NO: 4658393 - DNA, 21 bp, Homo sapiens
gaaaaatataatgttgataat

SEQ ID NO: 4658394 - DNA, 11 bp, Homo sapiens
gaaaaattaac

SEQ ID NO: 4658395 - DNA, 22 bp, Homo sapiens
gaaaacatctagcccaaaggta

SEQ ID NO: 4658396 - DNA, 21 bp, Homo sapiens
gaaaactgggtatgcgtttca

SEQ ID NO: 4658397 - DNA, 23 bp, Homo sapiens
gaaaagaaacctggggtgaatac

SEQ ID NO: 4658398 - DNA, 18 bp, Homo sapiens
gaaaagggaactgaacat

SEQ ID NO: 4658399 - DNA, 17 bp, Homo sapiens
gaaaagggcactcccaa

SEQ ID NO: 4658400 - DNA, 19 bp, Homo sapiens
gaaaagtaatgaagaatca

SEQ ID NO: 4658401 - DNA, 18 bp, Homo sapiens
gaaaagtaattttgtcac

SEQ ID NO: 4658402 - DNA, 23 bp, Homo sapiens
gaaaagtaattttgtcacattat

SEQ ID NO: 4658403 - DNA, 18 bp, Homo sapiens
gaaaagtcacttactatt

SEQ ID NO: 4658404 - DNA, 15 bp, Homo sapiens
gaaaataaaacacac

SEQ ID NO: 4658405 - DNA, 18 bp, Homo sapiens
gaaaataaaacacacctc

SEQ ID NO: 4658406 - DNA, 20 bp, Homo sapiens
gaaaataaaggaaaatgact

SEQ ID NO: 4658407 - DNA, 22 bp, Homo sapiens
gaaaatacgagaaaatctgcat

SEQ ID NO: 4658408 - DNA, 13 bp, Homo sapiens
gaaaatagattag

SEQ ID NO: 4658409 - DNA, 14 bp, Homo sapiens
gaaaatagtgttcc

SEQ ID NO: 4658410 - DNA, 16 bp, Homo sapiens
gaaaatgacttatttc

SEQ ID NO: 4658411 - DNA, 15 bp, Homo sapiens
gaaaattcagctcct

SEQ ID NO: 4658412 - DNA, 22 bp, Homo sapiens
gaaaattctaacccaggtatcc

SEQ ID NO: 4658413 - DNA, 13 bp, Homo sapiens
cttgctgcttttt

SEQ ID NO: 4658414 - DNA, 14 bp, Homo sapiens
cttgctgggcctgg

SEQ ID NO: 4658415 - DNA, 22 bp, Homo sapiens
cttgctgtatgacccctggcca

SEQ ID NO: 4658416 - DNA, 19 bp, Homo sapiens
cttgcttggaagccaggta

SEQ ID NO: 4658417 - DNA, 12 bp, Homo sapiens
cttgctttcctg

SEQ ID NO: 4658418 - DNA, 15 bp, Homo sapiens
cttgctttcctgggc

SEQ ID NO: 4658419 - DNA, 17 bp, Homo sapiens
cttgctttttgctgtgt

SEQ ID NO: 4658420 - DNA, 18 bp, Homo sapiens
cttgctttttgctgtgta

SEQ ID NO: 4658421 - DNA, 18 bp, Homo sapiens
cttggaaccaccagtcta

SEQ ID NO: 4658422 - DNA, 11 bp, Homo sapiens
cttggcaggct

SEQ ID NO: 4658423 - DNA, 15 bp, Homo sapiens
cttggcatagacatg

SEQ ID NO: 4658424 - DNA, 15 bp, Homo sapiens
cttggcggctctagc

SEQ ID NO: 4658425 - DNA, 21 bp, Homo sapiens
cttggctgcctgtgggcttcc

SEQ ID NO: 4658426 - DNA, 16 bp, Homo sapiens
cttggcttgtgttatc

SEQ ID NO: 4658427 - DNA, 19 bp, Homo sapiens
cttgggcacccccagcctg

SEQ ID NO: 4658428 - DNA, 22 bp, Homo sapiens
cttgggcacccccagcctgggc

SEQ ID NO: 4658429 - DNA, 14 bp, Homo sapiens
cttgggcagagtcc

SEQ ID NO: 4658430 - DNA, 19 bp, Homo sapiens
cttgggcagagtcctgcct

SEQ ID NO: 4658431 - DNA, 18 bp, Homo sapiens
cttgggcctcaggctctg

SEQ ID NO: 4658432 - DNA, 19 bp, Homo sapiens
cttgggcctcaggctctgc

SEQ ID NO: 4658433 - DNA, 20 bp, Homo sapiens
cttgggcctcaggctctgca

SEQ ID NO: 4658434 - DNA, 20 bp, Homo sapiens
cttggggggtgatgagggca

SEQ ID NO: 4658435 - DNA, 22 bp, Homo sapiens
cttggggggtgatgagggcagc

SEQ ID NO: 4658436 - DNA, 15 bp, Homo sapiens
cttggggtcaagaaa

SEQ ID NO: 4658437 - DNA, 14 bp, Homo sapiens
cttgggtgaatttc

SEQ ID NO: 4658438 - DNA, 14 bp, Homo sapiens
cttgggtgaggaca

SEQ ID NO: 4658439 - DNA, 19 bp, Homo sapiens
cttggtcctagggtgggaa

SEQ ID NO: 4658440 - DNA, 22 bp, Homo sapiens
cttggtcctagggtgggaaggg

SEQ ID NO: 4658441 - DNA, 22 bp, Homo sapiens
cttggtctaacttttgtgtgaa

SEQ ID NO: 4658442 - DNA, 14 bp, Homo sapiens
cttggttcatgctt

SEQ ID NO: 4658443 - DNA, 17 bp, Homo sapiens
cttggtttccaaaggca

SEQ ID NO: 4658444 - DNA, 23 bp, Homo sapiens
cttggtttctctctacagtgcca

SEQ ID NO: 4658445 - DNA, 12 bp, Homo sapiens
cttgtaaagact

SEQ ID NO: 4658446 - DNA, 14 bp, Homo sapiens
cttgtaaagactgg

SEQ ID NO: 4658447 - DNA, 14 bp, Homo sapiens
cttgtaagaccctt

SEQ ID NO: 4658448 - DNA, 14 bp, Homo sapiens
cttgtacatgtgta

SEQ ID NO: 4658449 - DNA, 13 bp, Homo sapiens
cttgtactgggac

SEQ ID NO: 4658450 - DNA, 14 bp, Homo sapiens
cttgtactgggaca

SEQ ID NO: 4658451 - DNA, 16 bp, Homo sapiens
cttgtagccagccggg

SEQ ID NO: 4658452 - DNA, 13 bp, Homo sapiens
cttgtattaagtt

SEQ ID NO: 4658453 - DNA, 13 bp, Homo sapiens
cttgtcaaagaag

SEQ ID NO: 4658454 - DNA, 14 bp, Homo sapiens
cttgtcaaagaagg

SEQ ID NO: 4658455 - DNA, 15 bp, Homo sapiens
cttgtcaaagaaggt

SEQ ID NO: 4658456 - DNA, 19 bp, Homo sapiens
cttgtcacccaggctggag

SEQ ID NO: 4658457 - DNA, 17 bp, Homo sapiens
cttgtcagacataaagc

SEQ ID NO: 4658458 - DNA, 20 bp, Homo sapiens
cttgtcagacataaagccat

SEQ ID NO: 4658459 - DNA, 21 bp, Homo sapiens
cttgtcagtgtagacacaggt

SEQ ID NO: 4658460 - DNA, 22 bp, Homo sapiens
cttgtcagtgtagacacaggtc

SEQ ID NO: 4658461 - DNA, 23 bp, Homo sapiens
cttgtcagtgtagacacaggtca

SEQ ID NO: 4658462 - DNA, 19 bp, Homo sapiens
cttgtcatatcactaaata

SEQ ID NO: 4658463 - DNA, 19 bp, Homo sapiens
cttgtcccatgtggcttgt

SEQ ID NO: 4658464 - DNA, 23 bp, Homo sapiens
cttgtcccccgtgatctcccctc

SEQ ID NO: 4658465 - DNA, 11 bp, Homo sapiens
cttgtctgcct

SEQ ID NO: 4658466 - DNA, 12 bp, Homo sapiens
cttgtctgcctc

SEQ ID NO: 4658467 - DNA, 18 bp, Homo sapiens
cttgtctgcctcctgctt

SEQ ID NO: 4658468 - DNA, 20 bp, Homo sapiens
cttgtgaaacgtctggactg

SEQ ID NO: 4658469 - DNA, 21 bp, Homo sapiens
cttgtgatttctttaaaagaa

SEQ ID NO: 4658470 - DNA, 24 bp, Homo sapiens
cttgtgggtccatgctaacaaaga

SEQ ID NO: 4658471 - DNA, 17 bp, Homo sapiens
cttgtggttgtgtgtgt

SEQ ID NO: 4658472 - DNA, 10 bp, Homo sapiens
cttgtgtctg

SEQ ID NO: 4658473 - DNA, 21 bp, Homo sapiens
cttgtgttaacttgcctccat

SEQ ID NO: 4658474 - DNA, 23 bp, Homo sapiens
cttgtgttaacttgcctccatct

SEQ ID NO: 4658475 - DNA, 22 bp, Homo sapiens
cttgtgttcagctctttccaaa

SEQ ID NO: 4658476 - DNA, 23 bp, Homo sapiens
cttgtgttcagctctttccaaat

SEQ ID NO: 4658477 - DNA, 20 bp, Homo sapiens
cttgtgtttaactgtgaaca

SEQ ID NO: 4658478 - DNA, 21 bp, Homo sapiens
cttgtgtttctttagtttttg

SEQ ID NO: 4658479 - DNA, 12 bp, Homo sapiens
cttgttcattta

SEQ ID NO: 4658480 - DNA, 12 bp, Homo sapiens
cttgttcatttt

SEQ ID NO: 4658481 - DNA, 13 bp, Homo sapiens
cttgttctgtcac

SEQ ID NO: 4658482 - DNA, 16 bp, Homo sapiens
cttgttgaagtgctgt

SEQ ID NO: 4658483 - DNA, 17 bp, Homo sapiens
cttgttgaagtgctgtt

SEQ ID NO: 4658484 - DNA, 21 bp, Homo sapiens
cttgttggatttttgtcttgt

SEQ ID NO: 4658485 - DNA, 18 bp, Homo sapiens
cttgtttggggcaggagt

SEQ ID NO: 4658486 - DNA, 12 bp, Homo sapiens
ctttaaaagaat

SEQ ID NO: 4658487 - DNA, 23 bp, Homo sapiens
ctttaaactatgttcctaacaaa

SEQ ID NO: 4658488 - DNA, 13 bp, Homo sapiens
ctttaaatatcat

SEQ ID NO: 4658489 - DNA, 15 bp, Homo sapiens
ctttaaatgctgctt

SEQ ID NO: 4658490 - DNA, 19 bp, Homo sapiens
ctttaaattgttcctcttt

SEQ ID NO: 4658491 - DNA, 21 bp, Homo sapiens
ctttaacatacaagaaaatgt

SEQ ID NO: 4658492 - DNA, 17 bp, Homo sapiens
ctttaagccaaagaaac

SEQ ID NO: 4658493 - DNA, 18 bp, Homo sapiens
ctttaagccaaagaaaca

SEQ ID NO: 4658494 - DNA, 21 bp, Homo sapiens
ctttaagccaaagaaacaagc

SEQ ID NO: 4658495 - DNA, 21 bp, Homo sapiens
ctttaagggagtgtactccca

SEQ ID NO: 4658496 - DNA, 23 bp, Homo sapiens
ctttaagggagtgtactcccagg

SEQ ID NO: 4658497 - DNA, 22 bp, Homo sapiens
ctttactattaaaatattttgg

SEQ ID NO: 4658498 - DNA, 16 bp, Homo sapiens
ctttagcttcatttta

SEQ ID NO: 4658499 - DNA, 15 bp, Homo sapiens
ctttagtgttctgtt

SEQ ID NO: 4658500 - DNA, 19 bp, Homo sapiens
ctttagtgttctgtttgaa

SEQ ID NO: 4658501 - DNA, 23 bp, Homo sapiens
ctttagtgttctgtttgaaacta

SEQ ID NO: 4658502 - DNA, 13 bp, Homo sapiens
ctttagtttttgt

SEQ ID NO: 4658503 - DNA, 19 bp, Homo sapiens
ctttataaggaaatgtatt

SEQ ID NO: 4658504 - DNA, 15 bp, Homo sapiens
ctttatatttatcca

SEQ ID NO: 4658505 - DNA, 18 bp, Homo sapiens
ctttatatttatccacta

SEQ ID NO: 4658506 - DNA, 21 bp, Homo sapiens
ctttatctaatacctctgtgt

SEQ ID NO: 4658507 - DNA, 22 bp, Homo sapiens
ctttatctaatacctctgtgtg

SEQ ID NO: 4658508 - DNA, 21 bp, Homo sapiens
ctttatgcaaatacaatcagc

SEQ ID NO: 4658509 - DNA, 21 bp, Homo sapiens
ctttatgtacaggatgctttg

SEQ ID NO: 4658510 - DNA, 13 bp, Homo sapiens
ctttattaaaaga

SEQ ID NO: 4658511 - DNA, 16 bp, Homo sapiens
ctttattaagtaaaat

SEQ ID NO: 4658512 - DNA, 23 bp, Homo sapiens
ctttattgtgggccatgaaccaa

SEQ ID NO: 4658513 - DNA, 10 bp, Homo sapiens
ctttatttat

SEQ ID NO: 4658514 - DNA, 14 bp, Homo sapiens
ctttatttctcttc

SEQ ID NO: 4658515 - DNA, 15 bp, Homo sapiens
ctttatttctcttct

SEQ ID NO: 4658516 - DNA, 22 bp, Homo sapiens
ctttatttgtaaaccattgtaa

SEQ ID NO: 4658517 - DNA, 13 bp, Homo sapiens
ctttcaataaagt

SEQ ID NO: 4658518 - DNA, 14 bp, Homo sapiens
ctttcaataaagtt

SEQ ID NO: 4658519 - DNA, 15 bp, Homo sapiens
ctttcaataaagttg

SEQ ID NO: 4658520 - DNA, 17 bp, Homo sapiens
ctttcaataaagttgtt

SEQ ID NO: 4658521 - DNA, 20 bp, Homo sapiens
ctttcaataaagttgttgca

SEQ ID NO: 4658522 - DNA, 21 bp, Homo sapiens
ctttcaattccaccagggcca

SEQ ID NO: 4658523 - DNA, 21 bp, Homo sapiens
ctttcaattccgtagccagct

SEQ ID NO: 4658524 - DNA, 19 bp, Homo sapiens
cttctcccaggcctctgcc

SEQ ID NO: 4658525 - DNA, 19 bp, Homo sapiens
cttctcctcctctgtcttt

SEQ ID NO: 4658526 - DNA, 17 bp, Homo sapiens
cttctcctgatcctgca

SEQ ID NO: 4658527 - DNA, 13 bp, Homo sapiens
cttctctcttgat

SEQ ID NO: 4658528 - DNA, 19 bp, Homo sapiens
cttctctcttgattgattt

SEQ ID NO: 4658529 - DNA, 20 bp, Homo sapiens
cttctctcttgattgatttt

SEQ ID NO: 4658530 - DNA, 13 bp, Homo sapiens
cttctcttgctct

SEQ ID NO: 4658531 - DNA, 21 bp, Homo sapiens
cttctgaagactgagaacttt

SEQ ID NO: 4658532 - DNA, 15 bp, Homo sapiens
cttctgactgccccc

SEQ ID NO: 4658533 - DNA, 20 bp, Homo sapiens
cttctgactgccccctcctg

SEQ ID NO: 4658534 - DNA, 17 bp, Homo sapiens
cttctgcaaagtggcag

SEQ ID NO: 4658535 - DNA, 22 bp, Homo sapiens
cttctgcaaagtggcagggacc

SEQ ID NO: 4658536 - DNA, 18 bp, Homo sapiens
cttctggcagattcaaat

SEQ ID NO: 4658537 - DNA, 23 bp, Homo sapiens
cttctggggttggaagtgtgact

SEQ ID NO: 4658538 - DNA, 14 bp, Homo sapiens
cttctggtttccct

SEQ ID NO: 4658539 - DNA, 16 bp, Homo sapiens
cttcttcacctcttcc

SEQ ID NO: 4658540 - DNA, 22 bp, Homo sapiens
cttcttctgaagatcagaacat

SEQ ID NO: 4658541 - DNA, 22 bp, Homo sapiens
cttcttgtcagacataaagcca

SEQ ID NO: 4658542 - DNA, 19 bp, Homo sapiens
cttctttagaccctcgggc

SEQ ID NO: 4658543 - DNA, 19 bp, Homo sapiens
cttctttcccttagtgact

SEQ ID NO: 4658544 - DNA, 13 bp, Homo sapiens
cttcttttcctaa

SEQ ID NO: 4658545 - DNA, 20 bp, Homo sapiens
cttgaaacctgttaaaacaa

SEQ ID NO: 4658546 - DNA, 15 bp, Homo sapiens
cttgaaatattcaga

SEQ ID NO: 4658547 - DNA, 18 bp, Homo sapiens
cttgaaatattcagaaat

SEQ ID NO: 4658548 - DNA, 18 bp, Homo sapiens
cttgaactcctggactca

SEQ ID NO: 4658549 - DNA, 16 bp, Homo sapiens
cttgaatcctatgtat

SEQ ID NO: 4658550 - DNA, 21 bp, Homo sapiens
cttgaatgtggtctcaggata

SEQ ID NO: 4658551 - DNA, 23 bp, Homo sapiens
cttgacaatgttgtcctcctgtt

SEQ ID NO: 4658552 - DNA, 19 bp, Homo sapiens
cttgacatctggaaacctc

SEQ ID NO: 4658553 - DNA, 20 bp, Homo sapiens
cttgacatgtagcttcttct

SEQ ID NO: 4658554 - DNA, 14 bp, Homo sapiens
cttgactcttgaat

SEQ ID NO: 4658555 - DNA, 16 bp, Homo sapiens
cttgactcttgaataa

SEQ ID NO: 4658556 - DNA, 19 bp, Homo sapiens
cttgactgggtgagaccca

SEQ ID NO: 4658557 - DNA, 19 bp, Homo sapiens
cttgagcaagttccttctg

SEQ ID NO: 4658558 - DNA, 21 bp, Homo sapiens
cttgagcaagttccttctggt

SEQ ID NO: 4658559 - DNA, 12 bp, Homo sapiens
cttgagcccaga

SEQ ID NO: 4658560 - DNA, 20 bp, Homo sapiens
cttgaggagctcaacggtct

SEQ ID NO: 4658561 - DNA, 15 bp, Homo sapiens
cttgaggggcagttt

SEQ ID NO: 4658562 - DNA, 18 bp, Homo sapiens
cttgagtataagaaatgc

SEQ ID NO: 4658563 - DNA, 15 bp, Homo sapiens
cttgataggcctagt

SEQ ID NO: 4658564 - DNA, 17 bp, Homo sapiens
cttgatcatgctgcagt

SEQ ID NO: 4658565 - DNA, 21 bp, Homo sapiens
cttgatgagctgtgcacaaag

SEQ ID NO: 4658566 - DNA, 19 bp, Homo sapiens
cttgattgatttttaaagt

SEQ ID NO: 4658567 - DNA, 20 bp, Homo sapiens
cttgattgatttttaaagtt

SEQ ID NO: 4658568 - DNA, 18 bp, Homo sapiens
cttgatttttttaaacat

SEQ ID NO: 4658569 - DNA, 19 bp, Homo sapiens
cttgatttttttaaacata

SEQ ID NO: 4658570 - DNA, 21 bp, Homo sapiens
cttgcatattgttggcacaga

SEQ ID NO: 4658571 - DNA, 16 bp, Homo sapiens
cttgccatttgtagct

SEQ ID NO: 4658572 - DNA, 20 bp, Homo sapiens
cttgcccaggtcaccaagca

SEQ ID NO: 4658573 - DNA, 17 bp, Homo sapiens
cttgcccaggtgaggga

SEQ ID NO: 4658574 - DNA, 14 bp, Homo sapiens
cttgccctgtgttc

SEQ ID NO: 4658575 - DNA, 19 bp, Homo sapiens
cttgccctgtgttctttcc

SEQ ID NO: 4658576 - DNA, 21 bp, Homo sapiens
cttgccctgtgttctttcccc

SEQ ID NO: 4658577 - DNA, 23 bp, Homo sapiens
cttgccggctccccctccagcca

SEQ ID NO: 4658578 - DNA, 15 bp, Homo sapiens
cttgcctccatcttt

SEQ ID NO: 4658579 - DNA, 22 bp, Homo sapiens
cttgcctccatctttttcttgg

SEQ ID NO: 4658580 - DNA, 15 bp, Homo sapiens
cttgcctctgcacac

SEQ ID NO: 4658581 - DNA, 13 bp, Homo sapiens
cttgcctgagggg

SEQ ID NO: 4658582 - DNA, 14 bp, Homo sapiens
cttgcctgagggga

SEQ ID NO: 4658583 - DNA, 17 bp, Homo sapiens
cttgctcccaagcccct

SEQ ID NO: 4658584 - DNA, 19 bp, Homo sapiens
cttgctcccaatggtgctt

SEQ ID NO: 4658585 - DNA, 20 bp, Homo sapiens
cttgctcctgcttctcctga

SEQ ID NO: 4658586 - DNA, 14 bp, Homo sapiens
cttgctcttgggga

SEQ ID NO: 4658587 - DNA, 17 bp, Homo sapiens
cttgctcttggggaagg

SEQ ID NO: 4658588 - DNA, 18 bp, Homo sapiens
cttgctcttggggaaggg

SEQ ID NO: 4658589 - DNA, 18 bp, Homo sapiens
cttgctgagctgtttata

SEQ ID NO: 4658590 - DNA, 13 bp, Homo sapiens
ctgtattttgagt

SEQ ID NO: 4658591 - DNA, 21 bp, Homo sapiens
ctgtattttgagtttcagctg

SEQ ID NO: 4658592 - DNA, 23 bp, Homo sapiens
ctgtattttgagtttcagctgga

SEQ ID NO: 4658593 - DNA, 13 bp, Homo sapiens
ctgtcaagctggt

SEQ ID NO: 4658594 - DNA, 14 bp, Homo sapiens
ctgtcagtcacagc

SEQ ID NO: 4658595 - DNA, 17 bp, Homo sapiens
ctgtcagtcacagccac

SEQ ID NO: 4658596 - DNA, 15 bp, Homo sapiens
ctgtcatctgtgcac

SEQ ID NO: 4658597 - DNA, 14 bp, Homo sapiens
ctgtccaagacagg

SEQ ID NO: 4658598 - DNA, 20 bp, Homo sapiens
ctgtcccagggccctcccag

SEQ ID NO: 4658599 - DNA, 21 bp, Homo sapiens
ctgtcccagggccctcccagc

SEQ ID NO: 4658600 - DNA, 12 bp, Homo sapiens
ctgtccccaccc

SEQ ID NO: 4658601 - DNA, 18 bp, Homo sapiens
ctgtccccaccctccact

SEQ ID NO: 4658602 - DNA, 19 bp, Homo sapiens
ctgtccccaccctccactc

SEQ ID NO: 4658603 - DNA, 14 bp, Homo sapiens
ctgtccccactgcc

SEQ ID NO: 4658604 - DNA, 16 bp, Homo sapiens
ctgtccccactgcccc

SEQ ID NO: 4658605 - DNA, 22 bp, Homo sapiens
ctgtccccatctaggtcctggc

SEQ ID NO: 4658606 - DNA, 21 bp, Homo sapiens
ctgtccgttcacatgtgtggt

SEQ ID NO: 4658607 - DNA, 14 bp, Homo sapiens
ctgtcctagccagg

SEQ ID NO: 4658608 - DNA, 23 bp, Homo sapiens
ctgtcctagccaggtctcctggg

SEQ ID NO: 4658609 - DNA, 13 bp, Homo sapiens
ctgtcctgcagca

SEQ ID NO: 4658610 - DNA, 14 bp, Homo sapiens
ctgtcctgcagcaa

SEQ ID NO: 4658611 - DNA, 15 bp, Homo sapiens
ctgtcctgcagcaaa

SEQ ID NO: 4658612 - DNA, 13 bp, Homo sapiens
ctgtcctggagct

SEQ ID NO: 4658613 - DNA, 12 bp, Homo sapiens
ctgtcctgtcct

SEQ ID NO: 4658614 - DNA, 17 bp, Homo sapiens
ctgtcctttcagtctga

SEQ ID NO: 4658615 - DNA, 19 bp, Homo sapiens
ctgtcgagaaacagcctgt

SEQ ID NO: 4658616 - DNA, 15 bp, Homo sapiens
ctgtcgccacacgcc

SEQ ID NO: 4658617 - DNA, 16 bp, Homo sapiens
ctgtctcgagcgccct

SEQ ID NO: 4658618 - DNA, 20 bp, Homo sapiens
ctgtctcgagcgccctgcag

SEQ ID NO: 4658619 - DNA, 22 bp, Homo sapiens
ctgtctcgagcgccctgcagac

SEQ ID NO: 4658620 - DNA, 12 bp, Homo sapiens
ctgtctctggct

SEQ ID NO: 4658621 - DNA, 14 bp, Homo sapiens
ctgtctctggctac

SEQ ID NO: 4658622 - DNA, 15 bp, Homo sapiens
ctgtctctggctact

SEQ ID NO: 4658623 - DNA, 20 bp, Homo sapiens
ctgtctctggctactccctg

SEQ ID NO: 4658624 - DNA, 14 bp, Homo sapiens
ctgtctgctctgca

SEQ ID NO: 4658625 - DNA, 18 bp, Homo sapiens
ctgtctgttacactggag

SEQ ID NO: 4658626 - DNA, 18 bp, Homo sapiens
ctgtcttcacctgattca

SEQ ID NO: 4658627 - DNA, 18 bp, Homo sapiens
ctgtctttcctgaaccat

SEQ ID NO: 4658628 - DNA, 14 bp, Homo sapiens
ctgtctttgcgggg

SEQ ID NO: 4658629 - DNA, 19 bp, Homo sapiens
ctgtctttgcggggcctgt

SEQ ID NO: 4658630 - DNA, 21 bp, Homo sapiens
ctgtctttgcggggcctgtct

SEQ ID NO: 4658631 - DNA, 23 bp, Homo sapiens
ctgtctttgcggggcctgtctca

SEQ ID NO: 4658632 - DNA, 18 bp, Homo sapiens
ctgtcttttgttctctga

SEQ ID NO: 4658633 - DNA, 19 bp, Homo sapiens
ctgtgaacagagagaccct

SEQ ID NO: 4658634 - DNA, 21 bp, Homo sapiens
ctgtgaagcattcgagacaga

SEQ ID NO: 4658635 - DNA, 18 bp, Homo sapiens
ctgtgaagtccttcacct

SEQ ID NO: 4658636 - DNA, 22 bp, Homo sapiens
ctgtgacaagccaatgtgaatt

SEQ ID NO: 4658637 - DNA, 13 bp, Homo sapiens
ctgtgacccccag

SEQ ID NO: 4658638 - DNA, 17 bp, Homo sapiens
ctgtgacctgctgagct

SEQ ID NO: 4658639 - DNA, 20 bp, Homo sapiens
ctgtgacctgctgagctctg

SEQ ID NO: 4658640 - DNA, 22 bp, Homo sapiens
ctgtgacctgctgagctctgag

SEQ ID NO: 4658641 - DNA, 12 bp, Homo sapiens
ctgtgagacagt

SEQ ID NO: 4658642 - DNA, 15 bp, Homo sapiens
ctgtgagacagtggg

SEQ ID NO: 4658643 - DNA, 14 bp, Homo sapiens
ctgtgagcccagct

SEQ ID NO: 4658644 - DNA, 15 bp, Homo sapiens
ctgtgaggagtctgg

SEQ ID NO: 4658645 - DNA, 21 bp, Homo sapiens
ctgtgcaacctcttggcctga

SEQ ID NO: 4658646 - DNA, 22 bp, Homo sapiens
ctgtgcacaaaacccagacctg

SEQ ID NO: 4658647 - DNA, 20 bp, Homo sapiens
ctgggcctatggagagccct

SEQ ID NO: 4658648 - DNA, 12 bp, Homo sapiens
ctgggcctgctg

SEQ ID NO: 4658649 - DNA, 15 bp, Homo sapiens
ctgggcctgctgctg

SEQ ID NO: 4658650 - DNA, 16 bp, Homo sapiens
ctgggcctgctgctga

SEQ ID NO: 4658651 - DNA, 19 bp, Homo sapiens
ctgggcctgctgctgagaa

SEQ ID NO: 4658652 - DNA, 12 bp, Homo sapiens
ctgggcctgggg

SEQ ID NO: 4658653 - DNA, 15 bp, Homo sapiens
ctgggctcctccagg

SEQ ID NO: 4658654 - DNA, 20 bp, Homo sapiens
ctgggctctgcctgtctggt

SEQ ID NO: 4658655 - DNA, 12 bp, Homo sapiens
ctgggctctgga

SEQ ID NO: 4658656 - DNA, 13 bp, Homo sapiens
ctgggctctggac

SEQ ID NO: 4658657 - DNA, 16 bp, Homo sapiens
ctgggctctggactcc

SEQ ID NO: 4658658 - DNA, 18 bp, Homo sapiens
ctgggctctggactccac

SEQ ID NO: 4658659 - DNA, 14 bp, Homo sapiens
ctgggctgcagaga

SEQ ID NO: 4658660 - DNA, 16 bp, Homo sapiens
ctgggctgggccctct

SEQ ID NO: 4658661 - DNA, 17 bp, Homo sapiens
ctgggctgggccctctt

SEQ ID NO: 4658662 - DNA, 21 bp, Homo sapiens
ctgggctgggccctctttccc

SEQ ID NO: 4658663 - DNA, 13 bp, Homo sapiens
ctgggctggggag

SEQ ID NO: 4658664 - DNA, 15 bp, Homo sapiens
ctgggctggggagga

SEQ ID NO: 4658665 - DNA, 23 bp, Homo sapiens
ctgggctgtaacgtggcactggt

SEQ ID NO: 4658666 - DNA, 12 bp, Homo sapiens
ctgggctgttgt

SEQ ID NO: 4658667 - DNA, 12 bp, Homo sapiens
ctggggaccaag

SEQ ID NO: 4658668 - DNA, 17 bp, Homo sapiens
ctggggaccggttccca

SEQ ID NO: 4658669 - DNA, 14 bp, Homo sapiens
ctggggactcaggg

SEQ ID NO: 4658670 - DNA, 13 bp, Homo sapiens
ctggggaggcagg

SEQ ID NO: 4658671 - DNA, 19 bp, Homo sapiens
ctggggcagcactccccag

SEQ ID NO: 4658672 - DNA, 21 bp, Homo sapiens
ctggggcagcactccccagag

SEQ ID NO: 4658673 - DNA, 16 bp, Homo sapiens
ctggggccaggcccca

SEQ ID NO: 4658674 - DNA, 22 bp, Homo sapiens
ctggggccaggccccatggagg

SEQ ID NO: 4658675 - DNA, 19 bp, Homo sapiens
ctggggccgccacggcctg

SEQ ID NO: 4658676 - DNA, 14 bp, Homo sapiens
ctggggcctgagag

SEQ ID NO: 4658677 - DNA, 14 bp, Homo sapiens
ctggggcctgggcc

SEQ ID NO: 4658678 - DNA, 18 bp, Homo sapiens
ctggggcctgtactgcct

SEQ ID NO: 4658679 - DNA, 19 bp, Homo sapiens
ctggggcctgtactgcctg

SEQ ID NO: 4658680 - DNA, 21 bp, Homo sapiens
ctggggcctgtactgcctgct

SEQ ID NO: 4658681 - DNA, 20 bp, Homo sapiens
ctgggggaatgagcccagag

SEQ ID NO: 4658682 - DNA, 21 bp, Homo sapiens
ctgggggtttaagctctgccc

SEQ ID NO: 4658683 - DNA, 20 bp, Homo sapiens
ctgggggttttccaagccct

SEQ ID NO: 4658684 - DNA, 21 bp, Homo sapiens
ctggggtgacccggcaccccc

SEQ ID NO: 4658685 - DNA, 20 bp, Homo sapiens
ctgggtaggccccacaaggc

SEQ ID NO: 4658686 - DNA, 21 bp, Homo sapiens
ctgggtaggccccacaaggcc

SEQ ID NO: 4658687 - DNA, 22 bp, Homo sapiens
ctgggtaggccccacaaggcct

SEQ ID NO: 4658688 - DNA, 18 bp, Homo sapiens
ctgggtcagacccatctc

SEQ ID NO: 4658689 - DNA, 23 bp, Homo sapiens
ctgggtcagacccatctctccct

SEQ ID NO: 4658690 - DNA, 17 bp, Homo sapiens
ctgggtccatcctggtc

SEQ ID NO: 4658691 - DNA, 19 bp, Homo sapiens
ctgggtggctactctgtgc

SEQ ID NO: 4658692 - DNA, 20 bp, Homo sapiens
ctgggtggctactctgtgcc

SEQ ID NO: 4658693 - DNA, 13 bp, Homo sapiens
ctgggtgtttttt

SEQ ID NO: 4658694 - DNA, 14 bp, Homo sapiens
ctgggttcacgtaa

SEQ ID NO: 4658695 - DNA, 22 bp, Homo sapiens
ctgggttcacgtaatcctcctg

SEQ ID NO: 4658696 - DNA, 20 bp, Homo sapiens
ctggtaagcgatttgaaaca

SEQ ID NO: 4658697 - DNA, 19 bp, Homo sapiens
ctggacttaaagaaaaaaa

SEQ ID NO: 4658698 - DNA, 18 bp, Homo sapiens
ctggagaaaaaggtgcca

SEQ ID NO: 4658699 - DNA, 18 bp, Homo sapiens
ctggagaaagagctgcct

SEQ ID NO: 4658700 - DNA, 23 bp, Homo sapiens
ctggagaaagagctgcctggatg

SEQ ID NO: 4658701 - DNA, 24 bp, Homo sapiens
ctggagaaagagctgcctggatga

SEQ ID NO: 4658702 - DNA, 14 bp, Homo sapiens
ctggagaacagtgg

SEQ ID NO: 4658703 - DNA, 18 bp, Homo sapiens
ctggagacaaggtgctaa

SEQ ID NO: 4658704 - DNA, 16 bp, Homo sapiens
ctggagatactggtgg

SEQ ID NO: 4658705 - DNA, 22 bp, Homo sapiens
ctggagatactggtggaagttc

SEQ ID NO: 4658706 - DNA, 20 bp, Homo sapiens
ctggagatcagcatgcctgt

SEQ ID NO: 4658707 - DNA, 24 bp, Homo sapiens
ctggagcctccgacgctgcctctc

SEQ ID NO: 4658708 - DNA, 20 bp, Homo sapiens
ctggagctcatctgcaaaag

SEQ ID NO: 4658709 - DNA, 20 bp, Homo sapiens
ctggaggacctgagcctgcc

SEQ ID NO: 4658710 - DNA, 21 bp, Homo sapiens
ctggaggacctgagcctgccg

SEQ ID NO: 4658711 - DNA, 16 bp, Homo sapiens
ctggaggcagagggca

SEQ ID NO: 4658712 - DNA, 17 bp, Homo sapiens
ctggaggcccctggagc

SEQ ID NO: 4658713 - DNA, 14 bp, Homo sapiens
ctggaggggagagg

SEQ ID NO: 4658714 - DNA, 22 bp, Homo sapiens
ctggagtgagaggcccccaccc

SEQ ID NO: 4658715 - DNA, 13 bp, Homo sapiens
ctggatcagtcct

SEQ ID NO: 4658716 - DNA, 20 bp, Homo sapiens
ctggatcagtcctttgatca

SEQ ID NO: 4658717 - DNA, 16 bp, Homo sapiens
ctggatgagaaacagc

SEQ ID NO: 4658718 - DNA, 20 bp, Homo sapiens
ctggatgagaaacagctcag

SEQ ID NO: 4658719 - DNA, 21 bp, Homo sapiens
ctggatgagaaacagctcagc

SEQ ID NO: 4658720 - DNA, 16 bp, Homo sapiens
ctggattgtttttaaa

SEQ ID NO: 4658721 - DNA, 18 bp, Homo sapiens
ctggcaaggacagaggcg

SEQ ID NO: 4658722 - DNA, 16 bp, Homo sapiens
ctggcacagaagagga

SEQ ID NO: 4658723 - DNA, 17 bp, Homo sapiens
ctggcacagaagaggag

SEQ ID NO: 4658724 - DNA, 19 bp, Homo sapiens
ctggcacagaagaggagtc

SEQ ID NO: 4658725 - DNA, 13 bp, Homo sapiens
ctggcagaaggga

SEQ ID NO: 4658726 - DNA, 15 bp, Homo sapiens
ctggcagattcaaat

SEQ ID NO: 4658727 - DNA, 15 bp, Homo sapiens
ctggcagccacactt

SEQ ID NO: 4658728 - DNA, 14 bp, Homo sapiens
ctggcagggcagca

SEQ ID NO: 4658729 - DNA, 18 bp, Homo sapiens
ctggcagggcagcaggag

SEQ ID NO: 4658730 - DNA, 14 bp, Homo sapiens
ctggcatagagtag

SEQ ID NO: 4658731 - DNA, 13 bp, Homo sapiens
ctggccaaagtca

SEQ ID NO: 4658732 - DNA, 22 bp, Homo sapiens
ctggccaaagtcacttccccaa

SEQ ID NO: 4658733 - DNA, 13 bp, Homo sapiens
ctggccaagctga

SEQ ID NO: 4658734 - DNA, 17 bp, Homo sapiens
ctggccaagctgaggtg

SEQ ID NO: 4658735 - DNA, 22 bp, Homo sapiens
ctggccaagctgaggtgcccag

SEQ ID NO: 4658736 - DNA, 16 bp, Homo sapiens
ctggccacagccttcc

SEQ ID NO: 4658737 - DNA, 23 bp, Homo sapiens
ctggcccccagcttcacctctgg

SEQ ID NO: 4658738 - DNA, 16 bp, Homo sapiens
ctggcccccatcagcc

SEQ ID NO: 4658739 - DNA, 20 bp, Homo sapiens
ctggcccccatcagccctgc

SEQ ID NO: 4658740 - DNA, 22 bp, Homo sapiens
ctggcccctaggctgctgctgt

SEQ ID NO: 4658741 - DNA, 17 bp, Homo sapiens
ctggccgagtccaagct

SEQ ID NO: 4658742 - DNA, 18 bp, Homo sapiens
ctggccgagtccaagctg

SEQ ID NO: 4658743 - DNA, 20 bp, Homo sapiens
ctgaagcaggttcccaagct

SEQ ID NO: 4658744 - DNA, 20 bp, Homo sapiens
ctgaagccatgtagccaccc

SEQ ID NO: 4658745 - DNA, 21 bp, Homo sapiens
ctgaagccatgtagccaccca

SEQ ID NO: 4658746 - DNA, 14 bp, Homo sapiens
ctgaagcccaaagc

SEQ ID NO: 4658747 - DNA, 19 bp, Homo sapiens
ctgaagcgaacatcttcat

SEQ ID NO: 4658748 - DNA, 12 bp, Homo sapiens
ctgaagctgagg

SEQ ID NO: 4658749 - DNA, 17 bp, Homo sapiens
ctgaaggaaaagcaaga

SEQ ID NO: 4658750 - DNA, 21 bp, Homo sapiens
ctgaaggcagtggcaggggag

SEQ ID NO: 4658751 - DNA, 14 bp, Homo sapiens
ctgaaggtctgaca

SEQ ID NO: 4658752 - DNA, 11 bp, Homo sapiens
ctgaagttcag

SEQ ID NO: 4658753 - DNA, 14 bp, Homo sapiens
ctgaataacctgca

SEQ ID NO: 4658754 - DNA, 16 bp, Homo sapiens
ctgaataacctgcaca

SEQ ID NO: 4658755 - DNA, 17 bp, Homo sapiens
ctgaataacctgcacag

SEQ ID NO: 4658756 - DNA, 22 bp, Homo sapiens
ctgaatataaagcttaataaaa

SEQ ID NO: 4658757 - DNA, 16 bp, Homo sapiens
ctgaatcatgtctgta

SEQ ID NO: 4658758 - DNA, 16 bp, Homo sapiens
ctgaatgcagaacggt

SEQ ID NO: 4658759 - DNA, 18 bp, Homo sapiens
ctgaatgcctcctgtggg

SEQ ID NO: 4658760 - DNA, 18 bp, Homo sapiens
ctgaatgcctcgctccct

SEQ ID NO: 4658761 - DNA, 20 bp, Homo sapiens
ctgaatgcctcgctcccttc

SEQ ID NO: 4658762 - DNA, 22 bp, Homo sapiens
ctgaatgtttgtgtctgtggtt

SEQ ID NO: 4658763 - DNA, 15 bp, Homo sapiens
ctgacaagctggcca

SEQ ID NO: 4658764 - DNA, 19 bp, Homo sapiens
ctgacaagctggccaaagt

SEQ ID NO: 4658765 - DNA, 18 bp, Homo sapiens
ctgacactaaccagagtc

SEQ ID NO: 4658766 - DNA, 19 bp, Homo sapiens
ctgacactaaccagagtca

SEQ ID NO: 4658767 - DNA, 17 bp, Homo sapiens
ctgacagaagttatttc

SEQ ID NO: 4658768 - DNA, 21 bp, Homo sapiens
ctgacaggcactataatttct

SEQ ID NO: 4658769 - DNA, 20 bp, Homo sapiens
ctgacaggcagcctggacat

SEQ ID NO: 4658770 - DNA, 23 bp, Homo sapiens
ctgacattcacctgccccaactc

SEQ ID NO: 4658771 - DNA, 15 bp, Homo sapiens
ctgaccaatattgta

SEQ ID NO: 4658772 - DNA, 14 bp, Homo sapiens
ctgaccacagcaca

SEQ ID NO: 4658773 - DNA, 18 bp, Homo sapiens
ctgaccacagcacagcca

SEQ ID NO: 4658774 - DNA, 24 bp, Homo sapiens
ctgaccaggatggagcaagctctt

SEQ ID NO: 4658775 - DNA, 16 bp, Homo sapiens
ctgacccagcatctcc

SEQ ID NO: 4658776 - DNA, 20 bp, Homo sapiens
ctgaccccagtggaaaacaa

SEQ ID NO: 4658777 - DNA, 18 bp, Homo sapiens
ctgaccccatcacctact

SEQ ID NO: 4658778 - DNA, 23 bp, Homo sapiens
ctgacccgctcggacttactgcc

SEQ ID NO: 4658779 - DNA, 23 bp, Homo sapiens
ctgacccttacagcctctgactt

SEQ ID NO: 4658780 - DNA, 16 bp, Homo sapiens
ctgaccggtgctttta

SEQ ID NO: 4658781 - DNA, 21 bp, Homo sapiens
ctgacctgtgagcccagctgg

SEQ ID NO: 4658782 - DNA, 17 bp, Homo sapiens
ctgaccttgatgagctg

SEQ ID NO: 4658783 - DNA, 18 bp, Homo sapiens
ctgacggtgcagtctggg

SEQ ID NO: 4658784 - DNA, 16 bp, Homo sapiens
ctgactagtagatttc

SEQ ID NO: 4658785 - DNA, 17 bp, Homo sapiens
ctgactagtagatttct

SEQ ID NO: 4658786 - DNA, 20 bp, Homo sapiens
ctgactgccaagccagattc

SEQ ID NO: 4658787 - DNA, 21 bp, Homo sapiens
ctgactggattcattctcata

SEQ ID NO: 4658788 - DNA, 21 bp, Homo sapiens
ctgacttcactaggcattgtg

SEQ ID NO: 4658789 - DNA, 21 bp, Homo sapiens
ctgacttggttctgaagccat

SEQ ID NO: 4658790 - DNA, 15 bp, Homo sapiens
ctgagaacataaaat

SEQ ID NO: 4658791 - DNA, 13 bp, Homo sapiens
ctgagaacctggc

SEQ ID NO: 4658792 - DNA, 18 bp, Homo sapiens
ctgagaacctggccttca

SEQ ID NO: 4658793 - DNA, 22 bp, Homo sapiens
ctgagaatctaggccaccccaa

SEQ ID NO: 4658794 - DNA, 14 bp, Homo sapiens
ctgagaggccctgg

SEQ ID NO: 4658795 - DNA, 17 bp, Homo sapiens
ctgagatatggcattgc

SEQ ID NO: 4658796 - DNA, 20 bp, Homo sapiens
ctgagatatggcattgcact

SEQ ID NO: 4658797 - DNA, 19 bp, Homo sapiens
ctgagatgctcactttatt

SEQ ID NO: 4658798 - DNA, 22 bp, Homo sapiens
ctgagatgctcactttattatc

SEQ ID NO: 4658799 - DNA, 14 bp, Homo sapiens
ctgagcactgccag

SEQ ID NO: 4658800 - DNA, 19 bp, Homo sapiens
ctgagcactgccaggaggg

SEQ ID NO: 4658801 - DNA, 12 bp, Homo sapiens
ctgagcccaggg

SEQ ID NO: 4658802 - DNA, 14 bp, Homo sapiens
ctgagctcacaagg

SEQ ID NO: 4658803 - DNA, 21 bp, Homo sapiens
ctgagctctgagaggccctgg

SEQ ID NO: 4658804 - DNA, 17 bp, Homo sapiens
ctgagctggaaggggcc

SEQ ID NO: 4658805 - DNA, 16 bp, Homo sapiens
ctgaggacagctgtcc

SEQ ID NO: 4658806 - DNA, 17 bp, Homo sapiens
ctgaggacagctgtcct

SEQ ID NO: 4658807 - DNA, 15 bp, Homo sapiens
ctgaggagtctgagg

SEQ ID NO: 4658808 - DNA, 20 bp, Homo sapiens
ctgaggagtctgaggtcctg

SEQ ID NO: 4658809 - DNA, 14 bp, Homo sapiens
ctgaggccacactc

SEQ ID NO: 4658810 - DNA, 23 bp, Homo sapiens
ctgaggccagcctggcctcctgc

SEQ ID NO: 4658811 - DNA, 23 bp, Homo sapiens
ctgaggcgccccaacccgtggag

SEQ ID NO: 4658812 - DNA, 13 bp, Homo sapiens
ctgaggctggcac

SEQ ID NO: 4658813 - DNA, 19 bp, Homo sapiens
ctgaggctggcacaggaca

SEQ ID NO: 4658814 - DNA, 20 bp, Homo sapiens
ctgaggctggcacaggacat

SEQ ID NO: 4658815 - DNA, 20 bp, Homo sapiens
ctgccaggagggacaaagga

SEQ ID NO: 4658816 - DNA, 13 bp, Homo sapiens
ctgccaggctgtt

SEQ ID NO: 4658817 - DNA, 15 bp, Homo sapiens
ctgccaggctgtttc

SEQ ID NO: 4658818 - DNA, 20 bp, Homo sapiens
ctgccatctcacctcctgct

SEQ ID NO: 4658819 - DNA, 21 bp, Homo sapiens
ctgccattctgcatgagctga

SEQ ID NO: 4658820 - DNA, 14 bp, Homo sapiens
ctgcccaccctcct

SEQ ID NO: 4658821 - DNA, 19 bp, Homo sapiens
ctgcccaccctcctgtacc

SEQ ID NO: 4658822 - DNA, 22 bp, Homo sapiens
ctgcccagcggacagtggcagg

SEQ ID NO: 4658823 - DNA, 15 bp, Homo sapiens
ctgcccaggcaagga

SEQ ID NO: 4658824 - DNA, 16 bp, Homo sapiens
ctgcccaggcaaggaa

SEQ ID NO: 4658825 - DNA, 21 bp, Homo sapiens
ctgcccaggtatcctggggga

SEQ ID NO: 4658826 - DNA, 19 bp, Homo sapiens
ctgcccagtgcaaaccact

SEQ ID NO: 4658827 - DNA, 18 bp, Homo sapiens
ctgcccatcatgtggccc

SEQ ID NO: 4658828 - DNA, 22 bp, Homo sapiens
ctgccccaactccttccagcta

SEQ ID NO: 4658829 - DNA, 19 bp, Homo sapiens
ctgccccaatgtgacctgg

SEQ ID NO: 4658830 - DNA, 18 bp, Homo sapiens
ctgccccacgttgtccct

SEQ ID NO: 4658831 - DNA, 15 bp, Homo sapiens
ctgccccccctaaga

SEQ ID NO: 4658832 - DNA, 20 bp, Homo sapiens
ctgccccccctaagagacac

SEQ ID NO: 4658833 - DNA, 15 bp, Homo sapiens
ctgccccctcctgtg

SEQ ID NO: 4658834 - DNA, 17 bp, Homo sapiens
ctgccccgtagagaatg

SEQ ID NO: 4658835 - DNA, 12 bp, Homo sapiens
ctgcccctctct

SEQ ID NO: 4658836 - DNA, 14 bp, Homo sapiens
ctgcccctgtggga

SEQ ID NO: 4658837 - DNA, 16 bp, Homo sapiens
ctgcccctgtgggact

SEQ ID NO: 4658838 - DNA, 21 bp, Homo sapiens
ctgccctcattactgggcctt

SEQ ID NO: 4658839 - DNA, 12 bp, Homo sapiens
ctgccctgagaa

SEQ ID NO: 4658840 - DNA, 16 bp, Homo sapiens
ctgccctgcccaggta

SEQ ID NO: 4658841 - DNA, 21 bp, Homo sapiens
ctgcccttcagcatcctcagt

SEQ ID NO: 4658842 - DNA, 15 bp, Homo sapiens
ctgcccttcctgcag

SEQ ID NO: 4658843 - DNA, 12 bp, Homo sapiens
ctgcccttgttt

SEQ ID NO: 4658844 - DNA, 20 bp, Homo sapiens
ctgcccttgtttggggcagg

SEQ ID NO: 4658845 - DNA, 14 bp, Homo sapiens
ctgccgagcaaccg

SEQ ID NO: 4658846 - DNA, 19 bp, Homo sapiens
ctgcctcacatctcccttc

SEQ ID NO: 4658847 - DNA, 10 bp, Homo sapiens
ctgcctcagg

SEQ ID NO: 4658848 - DNA, 12 bp, Homo sapiens
ctgcctcaggac

SEQ ID NO: 4658849 - DNA, 15 bp, Homo sapiens
ctgcctcaggcctct

SEQ ID NO: 4658850 - DNA, 13 bp, Homo sapiens
ctgcctcccatgc

SEQ ID NO: 4658851 - DNA, 11 bp, Homo sapiens
ctgcctcctgc

SEQ ID NO: 4658852 - DNA, 14 bp, Homo sapiens
ctgcctcctgggtt

SEQ ID NO: 4658853 - DNA, 15 bp, Homo sapiens
ctgcctcctgggttc

SEQ ID NO: 4658854 - DNA, 22 bp, Homo sapiens
ctgcctctactgggaaggctac

SEQ ID NO: 4658855 - DNA, 14 bp, Homo sapiens
ctgcctctcacagc

SEQ ID NO: 4658856 - DNA, 15 bp, Homo sapiens
ctgcctcttccccct

SEQ ID NO: 4658857 - DNA, 18 bp, Homo sapiens
ctgcctgctcgctccctg

SEQ ID NO: 4658858 - DNA, 19 bp, Homo sapiens
ctctaggttatacaataac

SEQ ID NO: 4658859 - DNA, 16 bp, Homo sapiens
ctctagtgggacagcc

SEQ ID NO: 4658860 - DNA, 18 bp, Homo sapiens
ctctagtgggacagccca

SEQ ID NO: 4658861 - DNA, 22 bp, Homo sapiens
ctctatgttagtataagctttt

SEQ ID NO: 4658862 - DNA, 16 bp, Homo sapiens
ctctatttattagcca

SEQ ID NO: 4658863 - DNA, 13 bp, Homo sapiens
ctctatttttgtt

SEQ ID NO: 4658864 - DNA, 14 bp, Homo sapiens
ctctcaagtaatat

SEQ ID NO: 4658865 - DNA, 13 bp, Homo sapiens
ctctcacctcagc

SEQ ID NO: 4658866 - DNA, 14 bp, Homo sapiens
ctctcactgtgtcc

SEQ ID NO: 4658867 - DNA, 19 bp, Homo sapiens
ctctcactgtgttactgct

SEQ ID NO: 4658868 - DNA, 19 bp, Homo sapiens
ctctccagtttgcacctgt

SEQ ID NO: 4658869 - DNA, 20 bp, Homo sapiens
ctctccagtttgcacctgtc

SEQ ID NO: 4658870 - DNA, 16 bp, Homo sapiens
ctctccataaccccac

SEQ ID NO: 4658871 - DNA, 13 bp, Homo sapiens
ctctcccaggccc

SEQ ID NO: 4658872 - DNA, 16 bp, Homo sapiens
ctctcccaggccccat

SEQ ID NO: 4658873 - DNA, 13 bp, Homo sapiens
ctctcccatcctg

SEQ ID NO: 4658874 - DNA, 20 bp, Homo sapiens
ctctcccctccccatctgtg

SEQ ID NO: 4658875 - DNA, 22 bp, Homo sapiens
ctctcccctccccatctgtgtt

SEQ ID NO: 4658876 - DNA, 15 bp, Homo sapiens
ctctcccctgacctg

SEQ ID NO: 4658877 - DNA, 13 bp, Homo sapiens
ctctcctggcttc

SEQ ID NO: 4658878 - DNA, 17 bp, Homo sapiens
ctctcctggcttcccat

SEQ ID NO: 4658879 - DNA, 22 bp, Homo sapiens
ctctcctggcttcccatcccca

SEQ ID NO: 4658880 - DNA, 18 bp, Homo sapiens
ctctcgaccggccctgca

SEQ ID NO: 4658881 - DNA, 15 bp, Homo sapiens
ctctcgcatcttccc

SEQ ID NO: 4658882 - DNA, 17 bp, Homo sapiens
ctctcgcatcttcccaa

SEQ ID NO: 4658883 - DNA, 13 bp, Homo sapiens
ctctcgcctcatt

SEQ ID NO: 4658884 - DNA, 17 bp, Homo sapiens
ctctcgcctcattactg

SEQ ID NO: 4658885 - DNA, 14 bp, Homo sapiens
ctctctccctgcct

SEQ ID NO: 4658886 - DNA, 13 bp, Homo sapiens
ctctctcctggac

SEQ ID NO: 4658887 - DNA, 21 bp, Homo sapiens
ctctcttcggtcgtatccacc

SEQ ID NO: 4658888 - DNA, 17 bp, Homo sapiens
ctctctttaaccctccc

SEQ ID NO: 4658889 - DNA, 19 bp, Homo sapiens
ctccctagagcgggatggg

SEQ ID NO: 4658890 - DNA, 22 bp, Homo sapiens
ctccctagctctgaaatcaact

SEQ ID NO: 4658891 - DNA, 21 bp, Homo sapiens
ctccctagctcttccccatct

SEQ ID NO: 4658892 - DNA, 13 bp, Homo sapiens
ctccctaggccca

SEQ ID NO: 4658893 - DNA, 15 bp, Homo sapiens
ctccctaggcccaag

SEQ ID NO: 4658894 - DNA, 17 bp, Homo sapiens
ctccctccaccagcctg

SEQ ID NO: 4658895 - DNA, 13 bp, Homo sapiens
ctccctcctcact

SEQ ID NO: 4658896 - DNA, 17 bp, Homo sapiens
ctccctcctcactccct

SEQ ID NO: 4658897 - DNA, 19 bp, Homo sapiens
ctccctcctcactccctag

SEQ ID NO: 4658898 - DNA, 21 bp, Homo sapiens
ctccctcctcactccctaggc

SEQ ID NO: 4658899 - DNA, 18 bp, Homo sapiens
ctccctcctttcctttgc

SEQ ID NO: 4658900 - DNA, 22 bp, Homo sapiens
ctccctcctttcctttgccctt

SEQ ID NO: 4658901 - DNA, 14 bp, Homo sapiens
ctccctctctcctg

SEQ ID NO: 4658902 - DNA, 16 bp, Homo sapiens
ctccctctctcctgga

SEQ ID NO: 4658903 - DNA, 22 bp, Homo sapiens
ctccctctctcctggactggtt

SEQ ID NO: 4658904 - DNA, 17 bp, Homo sapiens
ctccctgcctcacatct

SEQ ID NO: 4658905 - DNA, 18 bp, Homo sapiens
ctccctgcctcaggcctc

SEQ ID NO: 4658906 - DNA, 13 bp, Homo sapiens
ctccctgctgtgc

SEQ ID NO: 4658907 - DNA, 15 bp, Homo sapiens
ctccctgctgtgcca

SEQ ID NO: 4658908 - DNA, 22 bp, Homo sapiens
ctccctgctgtgccatgctggg

SEQ ID NO: 4658909 - DNA, 21 bp, Homo sapiens
ctccctgggcctcttcttcct

SEQ ID NO: 4658910 - DNA, 19 bp, Homo sapiens
ctccctggtgagagggccg

SEQ ID NO: 4658911 - DNA, 14 bp, Homo sapiens
ctcccttccacctc

SEQ ID NO: 4658912 - DNA, 13 bp, Homo sapiens
ctcccttctgctt

SEQ ID NO: 4658913 - DNA, 20 bp, Homo sapiens
ctcccttttaatcctggctg

SEQ ID NO: 4658914 - DNA, 16 bp, Homo sapiens
ctccgaggtggttcag

SEQ ID NO: 4658915 - DNA, 13 bp, Homo sapiens
ctccgccagccac

SEQ ID NO: 4658916 - DNA, 15 bp, Homo sapiens
ctccgcgccgatgcc

SEQ ID NO: 4658917 - DNA, 18 bp, Homo sapiens
ctagtcgcccctcagagc

SEQ ID NO: 4658918 - DNA, 20 bp, Homo sapiens
ctagtcgcccctcagagcat

SEQ ID NO: 4658919 - DNA, 18 bp, Homo sapiens
ctagtgacccacatgcca

SEQ ID NO: 4658920 - DNA, 19 bp, Homo sapiens
ctagtgacccacatgccat

SEQ ID NO: 4658921 - DNA, 20 bp, Homo sapiens
ctagtgcaattccaagaaaa

SEQ ID NO: 4658922 - DNA, 13 bp, Homo sapiens
ctagtgctttcct

SEQ ID NO: 4658923 - DNA, 22 bp, Homo sapiens
ctagtgggacagcccagagcct

SEQ ID NO: 4658924 - DNA, 13 bp, Homo sapiens
ctagttctttcct

SEQ ID NO: 4658925 - DNA, 16 bp, Homo sapiens
ctagttctttcctccc

SEQ ID NO: 4658926 - DNA, 23 bp, Homo sapiens
ctagttctttcctccccctgcaa

SEQ ID NO: 4658927 - DNA, 15 bp, Homo sapiens
ctagtttgctttttg

SEQ ID NO: 4658928 - DNA, 17 bp, Homo sapiens
ctataaatttaagaaaa

SEQ ID NO: 4658929 - DNA, 18 bp, Homo sapiens
ctataatcttatacaaca

SEQ ID NO: 4658930 - DNA, 21 bp, Homo sapiens
ctatacaaaaaatttttaaaa

SEQ ID NO: 4658931 - DNA, 13 bp, Homo sapiens
ctataggaacagc

SEQ ID NO: 4658932 - DNA, 19 bp, Homo sapiens
ctataggaacagcccagca

SEQ ID NO: 4658933 - DNA, 12 bp, Homo sapiens
ctatagttgcag

SEQ ID NO: 4658934 - DNA, 18 bp, Homo sapiens
ctatagttgcagcccaag

SEQ ID NO: 4658935 - DNA, 19 bp, Homo sapiens
ctatagttgcagcccaagg

SEQ ID NO: 4658936 - DNA, 17 bp, Homo sapiens
ctatatagaatgctgca

SEQ ID NO: 4658937 - DNA, 14 bp, Homo sapiens
ctatatatttctat

SEQ ID NO: 4658938 - DNA, 22 bp, Homo sapiens
cctcctgggttcacaccattct

SEQ ID NO: 4658939 - DNA, 18 bp, Homo sapiens
cctcctgtggggaaaggg

SEQ ID NO: 4658940 - DNA, 13 bp, Homo sapiens
cctccttccccag

SEQ ID NO: 4658941 - DNA, 23 bp, Homo sapiens
cctccttccccagctcccccagg

SEQ ID NO: 4658942 - DNA, 15 bp, Homo sapiens
cctccttctgcaaag

SEQ ID NO: 4658943 - DNA, 17 bp, Homo sapiens
cctccttggtgcctggc

SEQ ID NO: 4658944 - DNA, 19 bp, Homo sapiens
cctcgacagggcctggagc

SEQ ID NO: 4658945 - DNA, 20 bp, Homo sapiens
cctcgacagggcctggagcc

SEQ ID NO: 4658946 - DNA, 22 bp, Homo sapiens
cctcgacagggcctggagcccc

SEQ ID NO: 4658947 - DNA, 14 bp, Homo sapiens
cctcgagcagagag

SEQ ID NO: 4658948 - DNA, 21 bp, Homo sapiens
cctcgcgggtgtcacattcct

SEQ ID NO: 4658949 - DNA, 18 bp, Homo sapiens
cctcgctccccactctgc

SEQ ID NO: 4658950 - DNA, 23 bp, Homo sapiens
cctcgctccccactctgctctga

SEQ ID NO: 4658951 - DNA, 12 bp, Homo sapiens
cctcgctctgtt

SEQ ID NO: 4658952 - DNA, 12 bp, Homo sapiens
cctcgctgggct

SEQ ID NO: 4658953 - DNA, 14 bp, Homo sapiens
cctcggactaggtt

SEQ ID NO: 4658954 - DNA, 18 bp, Homo sapiens
cctcgttctccctgggag

SEQ ID NO: 4658955 - DNA, 14 bp, Homo sapiens
cctctactgggaag

SEQ ID NO: 4658956 - DNA, 19 bp, Homo sapiens
cctctagaaatttttcaga

SEQ ID NO: 4658957 - DNA, 13 bp, Homo sapiens
cctctagtgcctt

SEQ ID NO: 4658958 - DNA, 15 bp, Homo sapiens
cctctagtgccttct

SEQ ID NO: 4658959 - DNA, 17 bp, Homo sapiens
cctctcatttccagctt

SEQ ID NO: 4658960 - DNA, 21 bp, Homo sapiens
cctctcatttccagcttctca

SEQ ID NO: 4658961 - DNA, 18 bp, Homo sapiens
cctctccagtttgcacct

SEQ ID NO: 4658962 - DNA, 19 bp, Homo sapiens
cctctccagtttgcacctg

SEQ ID NO: 4658963 - DNA, 21 bp, Homo sapiens
cctctccagtttgcacctgtc

SEQ ID NO: 4658964 - DNA, 14 bp, Homo sapiens
cctctcccaggccc

SEQ ID NO: 4658965 - DNA, 12 bp, Homo sapiens
cctctcgcctca

SEQ ID NO: 4658966 - DNA, 13 bp, Homo sapiens
cctctctccctgc

SEQ ID NO: 4658967 - DNA, 16 bp, Homo sapiens
cctctctccctgcctc

SEQ ID NO: 4658968 - DNA, 17 bp, Homo sapiens
cctctctccctgcctca

SEQ ID NO: 4658969 - DNA, 19 bp, Homo sapiens
cctctctccctgcctcaca

SEQ ID NO: 4658970 - DNA, 21 bp, Homo sapiens
cctctctccctgcctcacatc

SEQ ID NO: 4658971 - DNA, 23 bp, Homo sapiens
cctctctccctgcctcacatctc

SEQ ID NO: 4658972 - DNA, 13 bp, Homo sapiens
cctctctcctgga

SEQ ID NO: 4658973 - DNA, 15 bp, Homo sapiens
cctctctcctggact

SEQ ID NO: 4658974 - DNA, 20 bp, Homo sapiens
cctctgactagtagatttct

SEQ ID NO: 4658975 - DNA, 20 bp, Homo sapiens
cctctgagaagctctgaaga

SEQ ID NO: 4658976 - DNA, 16 bp, Homo sapiens
cctctgaggccagcct

SEQ ID NO: 4658977 - DNA, 17 bp, Homo sapiens
cctctgccagcaggaat

SEQ ID NO: 4658978 - DNA, 21 bp, Homo sapiens
cctctgccagcaggaataaag

SEQ ID NO: 4658979 - DNA, 23 bp, Homo sapiens
cctctgccctcattactgggcct

SEQ ID NO: 4658980 - DNA, 19 bp, Homo sapiens
cctctgcccttcctgcagg

SEQ ID NO: 4658981 - DNA, 15 bp, Homo sapiens
cctctgcctcctggg

SEQ ID NO: 4658982 - DNA, 13 bp, Homo sapiens
cctctgcctggga

SEQ ID NO: 4658983 - DNA, 16 bp, Homo sapiens
cctctgcctgggatgc

SEQ ID NO: 4658984 - DNA, 22 bp, Homo sapiens
cctctgcctgggatgcccttcc

SEQ ID NO: 4658985 - DNA, 14 bp, Homo sapiens
cctctgcttcccag

SEQ ID NO: 4658986 - DNA, 15 bp, Homo sapiens
cctctgcttcccagg

SEQ ID NO: 4658987 - DNA, 20 bp, Homo sapiens
cctctgggaccccagctgct

SEQ ID NO: 4658988 - DNA, 15 bp, Homo sapiens
cctctgtcagtcaca

SEQ ID NO: 4658989 - DNA, 20 bp, Homo sapiens
cctctgtctcgagcgccctg

SEQ ID NO: 4658990 - DNA, 21 bp, Homo sapiens
cctctgtctcgagcgccctgc

SEQ ID NO: 4658991 - DNA, 23 bp, Homo sapiens
cctctgtctcgagcgccctgcag

SEQ ID NO: 4658992 - DNA, 22 bp, Homo sapiens
cctctgtcttggctttcatgtt

SEQ ID NO: 4658993 - DNA, 19 bp, Homo sapiens
cctctgtgtgctcctcctt

SEQ ID NO: 4658994 - DNA, 16 bp, Homo sapiens
cctctgttcagtgtaa

SEQ ID NO: 4658995 - DNA, 14 bp, Homo sapiens
cctcttcctgccct

SEQ ID NO: 4658996 - DNA, 15 bp, Homo sapiens
cctcttcctgccctt

SEQ ID NO: 4658997 - DNA, 21 bp, Homo sapiens
cctcttctggtttccctttat

SEQ ID NO: 4658998 - DNA, 13 bp, Homo sapiens
cctcttcttctga

SEQ ID NO: 4658999 - DNA, 17 bp, Homo sapiens
cctcttgtaaagactgg

SEQ ID NO: 4659000 - DNA, 14 bp, Homo sapiens
cctctttccctgcg

SEQ ID NO: 4659001 - DNA, 22 bp, Homo sapiens
cctctttgagaccccagtgcct

SEQ ID NO: 4659002 - DNA, 14 bp, Homo sapiens
cctctttgtctaaa

SEQ ID NO: 4659003 - DNA, 21 bp, Homo sapiens
cctgaaaagatgttgtgtctt

SEQ ID NO: 4659004 - DNA, 22 bp, Homo sapiens
cctgaaagctgggagcgtgggc

SEQ ID NO: 4659005 - DNA, 14 bp, Homo sapiens
cctgaactgaggag

SEQ ID NO: 4659006 - DNA, 21 bp, Homo sapiens
cctgacctaacctaggagggc

SEQ ID NO: 4659007 - DNA, 18 bp, Homo sapiens
cctgacctgtgagcccag

SEQ ID NO: 4659008 - DNA, 19 bp, Homo sapiens
cctgacttggggagatgga

SEQ ID NO: 4659009 - DNA, 23 bp, Homo sapiens
cctgacttggggagatggagttc

SEQ ID NO: 4659010 - DNA, 22 bp, Homo sapiens
cctgagaagctgctccaggcct

SEQ ID NO: 4659011 - DNA, 20 bp, Homo sapiens
cctgagatttaacccctcca

SEQ ID NO: 4659012 - DNA, 12 bp, Homo sapiens
cctgagcactgc

SEQ ID NO: 4659013 - DNA, 15 bp, Homo sapiens
cctgagcactgccag

SEQ ID NO: 4659014 - DNA, 17 bp, Homo sapiens
cctgagcactgccagga

SEQ ID NO: 4659015 - DNA, 19 bp, Homo sapiens
cctgagcactgccaggagg

SEQ ID NO: 4659016 - DNA, 12 bp, Homo sapiens
cctgagcccagg

SEQ ID NO: 4659017 - DNA, 15 bp, Homo sapiens
cctgagcccagggag

SEQ ID NO: 4659018 - DNA, 17 bp, Homo sapiens
cctgagcctgccgagca

SEQ ID NO: 4659019 - DNA, 20 bp, Homo sapiens
cctgagcctgccgagcaacc

SEQ ID NO: 4659020 - DNA, 16 bp, Homo sapiens
cctgaggagtctgagg

SEQ ID NO: 4659021 - DNA, 18 bp, Homo sapiens
cctgaggagtctgaggtc

SEQ ID NO: 4659022 - DNA, 11 bp, Homo sapiens
cctgaggggaa

SEQ ID NO: 4659023 - DNA, 22 bp, Homo sapiens
cctgaggtcagggagtgctggc

SEQ ID NO: 4659024 - DNA, 15 bp, Homo sapiens
cctgagtagctggga

SEQ ID NO: 4659025 - DNA, 21 bp, Homo sapiens
cctgagtgacctccttctgca

SEQ ID NO: 4659026 - DNA, 23 bp, Homo sapiens
cctgagtttccttttctgtctct

SEQ ID NO: 4659027 - DNA, 13 bp, Homo sapiens
cctgatagaagat

SEQ ID NO: 4659028 - DNA, 15 bp, Homo sapiens
cctgatcagaggcat

SEQ ID NO: 4659029 - DNA, 17 bp, Homo sapiens
cctgatgagatttttaa

SEQ ID NO: 4659030 - DNA, 22 bp, Homo sapiens
cctgatgcaggtcagcccatgg

SEQ ID NO: 4659031 - DNA, 20 bp, Homo sapiens
cctgcaaacagaacagggtc

SEQ ID NO: 4659032 - DNA, 12 bp, Homo sapiens
cctgcaactcat

SEQ ID NO: 4659033 - DNA, 13 bp, Homo sapiens
cctgcaagatgga

SEQ ID NO: 4659034 - DNA, 13 bp, Homo sapiens
cctgcaccttccc

SEQ ID NO: 4659035 - DNA, 21 bp, Homo sapiens
cctgcaccttccccaaaggaa

SEQ ID NO: 4659036 - DNA, 19 bp, Homo sapiens
cctgcactctttaagggag

SEQ ID NO: 4659037 - DNA, 17 bp, Homo sapiens
cctgcagaaggaaagaa

SEQ ID NO: 4659038 - DNA, 13 bp, Homo sapiens
cctgcagaccctg

SEQ ID NO: 4659039 - DNA, 24 bp, Homo sapiens
cctgcagcaaacactccaccctcc

SEQ ID NO: 4659040 - DNA, 19 bp, Homo sapiens
cctgcagcttgtagccagc

SEQ ID NO: 4659041 - DNA, 21 bp, Homo sapiens
cctgcagcttgtagccagccg

SEQ ID NO: 4659042 - DNA, 17 bp, Homo sapiens
cctgcatctgtctgctc

SEQ ID NO: 4659043 - DNA, 17 bp, Homo sapiens
cctgcatggtcaagcct

SEQ ID NO: 4659044 - DNA, 13 bp, Homo sapiens
cctgccagccact

SEQ ID NO: 4659045 - DNA, 20 bp, Homo sapiens
cctgccagcccagctggcct

SEQ ID NO: 4659046 - DNA, 13 bp, Homo sapiens
cctgcccacagaa

SEQ ID NO: 4659047 - DNA, 16 bp, Homo sapiens
cctgcccatgccccag

SEQ ID NO: 4659048 - DNA, 17 bp, Homo sapiens
cctgcccatgccccagt

SEQ ID NO: 4659049 - DNA, 17 bp, Homo sapiens
ccgtgctcgccccagca

SEQ ID NO: 4659050 - DNA, 11 bp, Homo sapiens
ccgtggaggct

SEQ ID NO: 4659051 - DNA, 22 bp, Homo sapiens
ccgtggaggctgctcggggtgc

SEQ ID NO: 4659052 - DNA, 15 bp, Homo sapiens
ccgtgggccatggca

SEQ ID NO: 4659053 - DNA, 21 bp, Homo sapiens
ccgtgggtgggcctggccctg

SEQ ID NO: 4659054 - DNA, 18 bp, Homo sapiens
ccgtgtgagtgtgacagg

SEQ ID NO: 4659055 - DNA, 14 bp, Homo sapiens
ccgttcctccccct

SEQ ID NO: 4659056 - DNA, 18 bp, Homo sapiens
ccgtttcgcgctggccgg

SEQ ID NO: 4659057 - DNA, 20 bp, Homo sapiens
cctaaataaaaaaagacaaa

SEQ ID NO: 4659058 - DNA, 18 bp, Homo sapiens
cctaagggatcctgcctg

SEQ ID NO: 4659059 - DNA, 13 bp, Homo sapiens
cctaatatcattt

SEQ ID NO: 4659060 - DNA, 21 bp, Homo sapiens
cctaatccctgggcattgctt

SEQ ID NO: 4659061 - DNA, 17 bp, Homo sapiens
cctaatgtggcagctgt

SEQ ID NO: 4659062 - DNA, 18 bp, Homo sapiens
cctaatgtggcagctgtc

SEQ ID NO: 4659063 - DNA, 22 bp, Homo sapiens
cctactcacacaggcatttcct

SEQ ID NO: 4659064 - DNA, 22 bp, Homo sapiens
cctactgagcatttgcacctct

SEQ ID NO: 4659065 - DNA, 22 bp, Homo sapiens
cctacttctcagtccccttcaa

SEQ ID NO: 4659066 - DNA, 15 bp, Homo sapiens
cctagaaagttctgt

SEQ ID NO: 4659067 - DNA, 15 bp, Homo sapiens
cctagagtgtagcct

SEQ ID NO: 4659068 - DNA, 20 bp, Homo sapiens
cctagcagcaccgttctgtg

SEQ ID NO: 4659069 - DNA, 23 bp, Homo sapiens
cctagcagcaccgttctgtgcac

SEQ ID NO: 4659070 - DNA, 20 bp, Homo sapiens
cctagccaggtctcctggga

SEQ ID NO: 4659071 - DNA, 14 bp, Homo sapiens
cctagcccctcact

SEQ ID NO: 4659072 - DNA, 18 bp, Homo sapiens
cctagcccctcacttcca

SEQ ID NO: 4659073 - DNA, 15 bp, Homo sapiens
cctagctggctctgt

SEQ ID NO: 4659074 - DNA, 12 bp, Homo sapiens
cctaggccaggt

SEQ ID NO: 4659075 - DNA, 13 bp, Homo sapiens
cctaggctgctgc

SEQ ID NO: 4659076 - DNA, 16 bp, Homo sapiens
cctaggctgctgctgt

SEQ ID NO: 4659077 - DNA, 24 bp, Homo sapiens
cctagggactgtcctagccaggtc

SEQ ID NO: 4659078 - DNA, 17 bp, Homo sapiens
cctaggggcttggtcct

SEQ ID NO: 4659079 - DNA, 19 bp, Homo sapiens
cctagtaaccaaggccctg

SEQ ID NO: 4659080 - DNA, 19 bp, Homo sapiens
cctagtacaatcttgggaa

SEQ ID NO: 4659081 - DNA, 14 bp, Homo sapiens
cctagtgggagtta

SEQ ID NO: 4659082 - DNA, 17 bp, Homo sapiens
cctataatcttatacaa

SEQ ID NO: 4659083 - DNA, 14 bp, Homo sapiens
cctataggaacagc

SEQ ID NO: 4659084 - DNA, 21 bp, Homo sapiens
cctataggaacagcccagcac

SEQ ID NO: 4659085 - DNA, 15 bp, Homo sapiens
cctatatcagggcct

SEQ ID NO: 4659086 - DNA, 17 bp, Homo sapiens
cctatatcagggcctga

SEQ ID NO: 4659087 - DNA, 16 bp, Homo sapiens
cctatatctggagtga

SEQ ID NO: 4659088 - DNA, 22 bp, Homo sapiens
cctatatctggagtgagaggcc

SEQ ID NO: 4659089 - DNA, 13 bp, Homo sapiens
cctatgacacagt

SEQ ID NO: 4659090 - DNA, 17 bp, Homo sapiens
cctatgacttgggcacc

SEQ ID NO: 4659091 - DNA, 22 bp, Homo sapiens
cctatgacttgggcacccccag

SEQ ID NO: 4659092 - DNA, 19 bp, Homo sapiens
cctatgatggatggcagac

SEQ ID NO: 4659093 - DNA, 21 bp, Homo sapiens
cctatgcacatatggactctg

SEQ ID NO: 4659094 - DNA, 15 bp, Homo sapiens
cctatggagagccct

SEQ ID NO: 4659095 - DNA, 16 bp, Homo sapiens
cctatggagagccctg

SEQ ID NO: 4659096 - DNA, 21 bp, Homo sapiens
cctatggagagccctgggacc

SEQ ID NO: 4659097 - DNA, 16 bp, Homo sapiens
cctatggagaggcttc

SEQ ID NO: 4659098 - DNA, 17 bp, Homo sapiens
cctatggagaggcttcc

SEQ ID NO: 4659099 - DNA, 17 bp, Homo sapiens
cctatgtgattttaact

SEQ ID NO: 4659100 - DNA, 22 bp, Homo sapiens
cctattagatacacttcttaaa

SEQ ID NO: 4659101 - DNA, 16 bp, Homo sapiens
cctcaagaaataaaag

SEQ ID NO: 4659102 - DNA, 18 bp, Homo sapiens
cctcaagccccatttcct

SEQ ID NO: 4659103 - DNA, 19 bp, Homo sapiens
cctcaatttttgtctcaga

SEQ ID NO: 4659104 - DNA, 21 bp, Homo sapiens
cctcaatttttgtctcagaag

SEQ ID NO: 4659105 - DNA, 15 bp, Homo sapiens
cctcacaactccttc

SEQ ID NO: 4659106 - DNA, 16 bp, Homo sapiens
cctcacatctcccttc

SEQ ID NO: 4659107 - DNA, 16 bp, Homo sapiens
cctcacccctgcccct

SEQ ID NO: 4659108 - DNA, 23 bp, Homo sapiens
cctcactccctaggcccaagtct

SEQ ID NO: 4659109 - DNA, 21 bp, Homo sapiens
cctcacttcctttgcccttcc

SEQ ID NO: 4659110 - DNA, 18 bp, Homo sapiens
cctcagagcatgatggga

SEQ ID NO: 4659111 - DNA, 11 bp, Homo sapiens
cctcagagctt

SEQ ID NO: 4659112 - DNA, 14 bp, Homo sapiens
cctcagagcttcct

SEQ ID NO: 4659113 - DNA, 17 bp, Homo sapiens
cctcagagcttcctggg

SEQ ID NO: 4659114 - DNA, 19 bp, Homo sapiens
cctcagagcttcctgggga

SEQ ID NO: 4659115 - DNA, 19 bp, Homo sapiens
cctcagcctcccaaaatgg

SEQ ID NO: 4659116 - DNA, 20 bp, Homo sapiens
cctcagctggtcctgaccag

SEQ ID NO: 4659117 - DNA, 13 bp, Homo sapiens
cctcaggctctgc

SEQ ID NO: 4659118 - DNA, 15 bp, Homo sapiens
cctcaggctctgcac

SEQ ID NO: 4659119 - DNA, 19 bp, Homo sapiens
cctcaggctctgcacagac

SEQ ID NO: 4659120 - DNA, 16 bp, Homo sapiens
cctcagtccctcttct

SEQ ID NO: 4659121 - DNA, 21 bp, Homo sapiens
cctcagtgcaaaatgtcttgt

SEQ ID NO: 4659122 - DNA, 23 bp, Homo sapiens
cctcataaaaatctagcacactc

SEQ ID NO: 4659123 - DNA, 20 bp, Homo sapiens
cctcatacctacacccaagg

SEQ ID NO: 4659124 - DNA, 21 bp, Homo sapiens
cctcatctatgaggaaaggtt

SEQ ID NO: 4659125 - DNA, 19 bp, Homo sapiens
cctccaacaccaagcacag

SEQ ID NO: 4659126 - DNA, 14 bp, Homo sapiens
cctccaatcctccc

SEQ ID NO: 4659127 - DNA, 12 bp, Homo sapiens
cctccaccagcc

SEQ ID NO: 4659128 - DNA, 14 bp, Homo sapiens
cctccaccagcctg

SEQ ID NO: 4659129 - DNA, 18 bp, Homo sapiens
cctccaccagcctgctga

SEQ ID NO: 4659130 - DNA, 22 bp, Homo sapiens
cctccaccagcctgctgacaga

SEQ ID NO: 4659131 - DNA, 13 bp, Homo sapiens
cctccaccttcca

SEQ ID NO: 4659132 - DNA, 14 bp, Homo sapiens
cctccaccttccat

SEQ ID NO: 4659133 - DNA, 17 bp, Homo sapiens
cctccaccttccgttcc

SEQ ID NO: 4659134 - DNA, 17 bp, Homo sapiens
cctccagagacaacagg

SEQ ID NO: 4659135 - DNA, 15 bp, Homo sapiens
cctccagcccctgtc

SEQ ID NO: 4659136 - DNA, 17 bp, Homo sapiens
cctccagcccctgtccc

SEQ ID NO: 4659137 - DNA, 22 bp, Homo sapiens
cctccagccctctcactgtgtc

SEQ ID NO: 4659138 - DNA, 15 bp, Homo sapiens
cctccaggagagagc

SEQ ID NO: 4659139 - DNA, 19 bp, Homo sapiens
cctccaggagagagccagg

SEQ ID NO: 4659140 - DNA, 12 bp, Homo sapiens
cctccaggcctg

SEQ ID NO: 4659141 - DNA, 18 bp, Homo sapiens
cctccattcccacccctc

SEQ ID NO: 4659142 - DNA, 15 bp, Homo sapiens
cctcccagcccattg

SEQ ID NO: 4659143 - DNA, 23 bp, Homo sapiens
cctccccatctgtgttctaactt

SEQ ID NO: 4659144 - DNA, 18 bp, Homo sapiens
cctccccttaaaggggag

SEQ ID NO: 4659145 - DNA, 17 bp, Homo sapiens
cctccgacgctgcctct

SEQ ID NO: 4659146 - DNA, 20 bp, Homo sapiens
cctcctcactccctaggccc

SEQ ID NO: 4659147 - DNA, 21 bp, Homo sapiens
cctcctccctcctcactccct

SEQ ID NO: 4659148 - DNA, 14 bp, Homo sapiens
cctcctcctccctc

SEQ ID NO: 4659149 - DNA, 15 bp, Homo sapiens
cctcctcctccctcc

SEQ ID NO: 4659150 - DNA, 20 bp, Homo sapiens
cctcctctctccctgcctca

SEQ ID NO: 4659151 - DNA, 22 bp, Homo sapiens
cctcctctctccctgcctcaca

SEQ ID NO: 4659152 - DNA, 15 bp, Homo sapiens
cctcctctgccagca

SEQ ID NO: 4659153 - DNA, 18 bp, Homo sapiens
cctcctctgccagcagga

SEQ ID NO: 4659154 - DNA, 21 bp, Homo sapiens
cctcctctgccagcaggaata

SEQ ID NO: 4659155 - DNA, 11 bp, Homo sapiens
cctcctctgtg

SEQ ID NO: 4659156 - DNA, 13 bp, Homo sapiens
cctcctctgtgaa

SEQ ID NO: 4659157 - DNA, 12 bp, Homo sapiens
cctcctgcctct

SEQ ID NO: 4659158 - DNA, 13 bp, Homo sapiens
cccctggccacag

SEQ ID NO: 4659159 - DNA, 18 bp, Homo sapiens
cccctggccacagccttc

SEQ ID NO: 4659160 - DNA, 21 bp, Homo sapiens
cccctgggaactctcctggcc

SEQ ID NO: 4659161 - DNA, 18 bp, Homo sapiens
cccctggggatcacagcc

SEQ ID NO: 4659162 - DNA, 17 bp, Homo sapiens
cccctgttttctgctgt

SEQ ID NO: 4659163 - DNA, 19 bp, Homo sapiens
cccctgttttctgctgttt

SEQ ID NO: 4659164 - DNA, 16 bp, Homo sapiens
ccccttaagccctggc

SEQ ID NO: 4659165 - DNA, 21 bp, Homo sapiens
ccccttaatcttgctttcttt

SEQ ID NO: 4659166 - DNA, 17 bp, Homo sapiens
ccccttccaaataataa

SEQ ID NO: 4659167 - DNA, 15 bp, Homo sapiens
ccccttcccctggga

SEQ ID NO: 4659168 - DNA, 21 bp, Homo sapiens
ccccttctgctcagctctggg

SEQ ID NO: 4659169 - DNA, 21 bp, Homo sapiens
cccctttatgtacaggatgct

SEQ ID NO: 4659170 - DNA, 19 bp, Homo sapiens
cccctttctctgcctggca

SEQ ID NO: 4659171 - DNA, 17 bp, Homo sapiens
cccgaagagtcagcccc

SEQ ID NO: 4659172 - DNA, 15 bp, Homo sapiens
cccgaccgggccagg

SEQ ID NO: 4659173 - DNA, 15 bp, Homo sapiens
cccgagagcctcgct

SEQ ID NO: 4659174 - DNA, 12 bp, Homo sapiens
cccgagcagctg

SEQ ID NO: 4659175 - DNA, 21 bp, Homo sapiens
cccgagcagctgagcagggcc

SEQ ID NO: 4659176 - DNA, 22 bp, Homo sapiens
cccgagcagctgagcagggccg

SEQ ID NO: 4659177 - DNA, 23 bp, Homo sapiens
cccgagtcattcgttctgtggag

SEQ ID NO: 4659178 - DNA, 18 bp, Homo sapiens
cccgccaggagcttcttc

SEQ ID NO: 4659179 - DNA, 17 bp, Homo sapiens
cccgccagggctgggga

SEQ ID NO: 4659180 - DNA, 19 bp, Homo sapiens
cccgcccagaggagcccag

SEQ ID NO: 4659181 - DNA, 17 bp, Homo sapiens
cccgcgcagctgcctag

SEQ ID NO: 4659182 - DNA, 22 bp, Homo sapiens
cccgctcggacttactgcctga

SEQ ID NO: 4659183 - DNA, 13 bp, Homo sapiens
cccggcaccccct

SEQ ID NO: 4659184 - DNA, 15 bp, Homo sapiens
cccggcaccccctgc

SEQ ID NO: 4659185 - DNA, 16 bp, Homo sapiens
cccggcaccccctgca

SEQ ID NO: 4659186 - DNA, 13 bp, Homo sapiens
cccgggctggaga

SEQ ID NO: 4659187 - DNA, 17 bp, Homo sapiens
cccggtgcagggcctgg

SEQ ID NO: 4659188 - DNA, 22 bp, Homo sapiens
cccgtgggtgggcctggccctg

SEQ ID NO: 4659189 - DNA, 20 bp, Homo sapiens
ccctaactctgcccaccctc

SEQ ID NO: 4659190 - DNA, 23 bp, Homo sapiens
ccctagcaggaacttctagctca

SEQ ID NO: 4659191 - DNA, 18 bp, Homo sapiens
ccctataggaacagccca

SEQ ID NO: 4659192 - DNA, 16 bp, Homo sapiens
ccctatatcagggcct

SEQ ID NO: 4659193 - DNA, 17 bp, Homo sapiens
ccctatatcagggcctg

SEQ ID NO: 4659194 - DNA, 21 bp, Homo sapiens
ccctcacaacagtcacctcac

SEQ ID NO: 4659195 - DNA, 23 bp, Homo sapiens
ccctcacactttgccatttgctt

SEQ ID NO: 4659196 - DNA, 16 bp, Homo sapiens
ccctcagctggtcctg

SEQ ID NO: 4659197 - DNA, 21 bp, Homo sapiens
ccctcaggaattcagtgcctt

SEQ ID NO: 4659198 - DNA, 17 bp, Homo sapiens
ccctccaccagcctgct

SEQ ID NO: 4659199 - DNA, 14 bp, Homo sapiens
ccctccaccttccg

SEQ ID NO: 4659200 - DNA, 17 bp, Homo sapiens
ccctccactcagctgtc

SEQ ID NO: 4659201 - DNA, 13 bp, Homo sapiens
ccctccagagaca

SEQ ID NO: 4659202 - DNA, 19 bp, Homo sapiens
ccctccaggagagagccag

SEQ ID NO: 4659203 - DNA, 17 bp, Homo sapiens
ccctccattcccacccc

SEQ ID NO: 4659204 - DNA, 12 bp, Homo sapiens
ccctcccagccc

SEQ ID NO: 4659205 - DNA, 14 bp, Homo sapiens
ccctcccagcccat

SEQ ID NO: 4659206 - DNA, 18 bp, Homo sapiens
ccctccccatctgtgttc

SEQ ID NO: 4659207 - DNA, 23 bp, Homo sapiens
ccctcccctgggactttcccacc

SEQ ID NO: 4659208 - DNA, 15 bp, Homo sapiens
ccctcctcactccct

SEQ ID NO: 4659209 - DNA, 17 bp, Homo sapiens
ccctcctcactccctag

SEQ ID NO: 4659210 - DNA, 19 bp, Homo sapiens
ccctcctccagcccctgtc

SEQ ID NO: 4659211 - DNA, 17 bp, Homo sapiens
ccctcctggtgccacct

SEQ ID NO: 4659212 - DNA, 19 bp, Homo sapiens
ccctcgggccccatcctca

SEQ ID NO: 4659213 - DNA, 14 bp, Homo sapiens
ccctctagtgcctt

SEQ ID NO: 4659214 - DNA, 17 bp, Homo sapiens
ccctctagtgccttctt

SEQ ID NO: 4659215 - DNA, 12 bp, Homo sapiens
ccctctatttat

SEQ ID NO: 4659216 - DNA, 20 bp, Homo sapiens
ccctctatttattagccaac

SEQ ID NO: 4659217 - DNA, 16 bp, Homo sapiens
ccctctcgcctcatta

SEQ ID NO: 4659218 - DNA, 12 bp, Homo sapiens
ccctctctcctg

SEQ ID NO: 4659219 - DNA, 22 bp, Homo sapiens
ccctctctcctggactggttat

SEQ ID NO: 4659220 - DNA, 23 bp, Homo sapiens
ccctctgcattgacctggagggg

SEQ ID NO: 4659221 - DNA, 10 bp, Homo sapiens
ccctctgcct

SEQ ID NO: 4659222 - DNA, 11 bp, Homo sapiens
ccctctgcctg

SEQ ID NO: 4659223 - DNA, 13 bp, Homo sapiens
ccctctgcctggg

SEQ ID NO: 4659224 - DNA, 18 bp, Homo sapiens
ccctctggtttgccggtg

SEQ ID NO: 4659225 - DNA, 12 bp, Homo sapiens
ccctctttccct

SEQ ID NO: 4659226 - DNA, 15 bp, Homo sapiens
ccctctttccctgcg

SEQ ID NO: 4659227 - DNA, 16 bp, Homo sapiens
ccctgagaagctgctc

SEQ ID NO: 4659228 - DNA, 13 bp, Homo sapiens
ccctgaggagtct

SEQ ID NO: 4659229 - DNA, 15 bp, Homo sapiens
ccctgaggagtctga

SEQ ID NO: 4659230 - DNA, 17 bp, Homo sapiens
ccctgatagaagattgt

SEQ ID NO: 4659231 - DNA, 16 bp, Homo sapiens
ccctgatgcaggtcag

SEQ ID NO: 4659232 - DNA, 18 bp, Homo sapiens
ccctgcaaacagaacagg

SEQ ID NO: 4659233 - DNA, 13 bp, Homo sapiens
ccctgcaccttcc

SEQ ID NO: 4659234 - DNA, 15 bp, Homo sapiens
ccctgcagaccctgc

SEQ ID NO: 4659235 - DNA, 14 bp, Homo sapiens
ccctgcatctgtct

SEQ ID NO: 4659236 - DNA, 17 bp, Homo sapiens
ccctgcatctgtctgct

SEQ ID NO: 4659237 - DNA, 20 bp, Homo sapiens
ccctgcatctgtctgctctg

SEQ ID NO: 4659238 - DNA, 21 bp, Homo sapiens
ccctgcccaggtatcctgggg

SEQ ID NO: 4659239 - DNA, 15 bp, Homo sapiens
ccctgcccccacccc

SEQ ID NO: 4659240 - DNA, 13 bp, Homo sapiens
ccctgcccctgtg

SEQ ID NO: 4659241 - DNA, 16 bp, Homo sapiens
ccctgcccctgtggga

SEQ ID NO: 4659242 - DNA, 14 bp, Homo sapiens
ccctgccccttaac

SEQ ID NO: 4659243 - DNA, 20 bp, Homo sapiens
ccctgccccttaaccccaag

SEQ ID NO: 4659244 - DNA, 12 bp, Homo sapiens
ccctgccctgct

SEQ ID NO: 4659245 - DNA, 18 bp, Homo sapiens
ccctgccctgctctgccc

SEQ ID NO: 4659246 - DNA, 23 bp, Homo sapiens
ccctgcccttgtttggggcagga

SEQ ID NO: 4659247 - DNA, 14 bp, Homo sapiens
ccctgccgtttccc

SEQ ID NO: 4659248 - DNA, 17 bp, Homo sapiens
ccctgcctcacatctcc

SEQ ID NO: 4659249 - DNA, 18 bp, Homo sapiens
ccctgcctcacatctccc

SEQ ID NO: 4659250 - DNA, 20 bp, Homo sapiens
ccctgcctcacatctccctt

SEQ ID NO: 4659251 - DNA, 16 bp, Homo sapiens
ccctgcctcaggcctc

SEQ ID NO: 4659252 - DNA, 21 bp, Homo sapiens
ccctgcctggaggacctgagc

SEQ ID NO: 4659253 - DNA, 22 bp, Homo sapiens
ccctgcctggaggacctgagcc

SEQ ID NO: 4659254 - DNA, 24 bp, Homo sapiens
ccctgcctggaggacctgagcctg

SEQ ID NO: 4659255 - DNA, 21 bp, Homo sapiens
ccctgcctggttctaggctgc

SEQ ID NO: 4659256 - DNA, 20 bp, Homo sapiens
ccctgccttaacctgggacc

SEQ ID NO: 4659257 - DNA, 13 bp, Homo sapiens
ccctgctacctgt

SEQ ID NO: 4659258 - DNA, 21 bp, Homo sapiens
ccctgctagacgcaccgcctg

SEQ ID NO: 4659259 - DNA, 17 bp, Homo sapiens
ccctgctcccacagaac

SEQ ID NO: 4659260 - DNA, 21 bp, Homo sapiens
ccctgctctgcccaggcaagg

SEQ ID NO: 4659261 - DNA, 17 bp, Homo sapiens
ccctgctgaatgcctcg

SEQ ID NO: 4659262 - DNA, 13 bp, Homo sapiens
ccctgctgcccag

SEQ ID NO: 4659263 - DNA, 20 bp, Homo sapiens
ccattgaagccgactctggc

SEQ ID NO: 4659264 - DNA, 18 bp, Homo sapiens
ccattgcttaaaagaaag

SEQ ID NO: 4659265 - DNA, 16 bp, Homo sapiens
ccattgtaactattaa

SEQ ID NO: 4659266 - DNA, 15 bp, Homo sapiens
ccattgttcccttcc

SEQ ID NO: 4659267 - DNA, 21 bp, Homo sapiens
ccattgtttgaaacaaagaag

SEQ ID NO: 4659268 - DNA, 12 bp, Homo sapiens
ccatttcttata

SEQ ID NO: 4659269 - DNA, 12 bp, Homo sapiens
ccatttgtagtg

SEQ ID NO: 4659270 - DNA, 15 bp, Homo sapiens
ccatttgtagtgagc

SEQ ID NO: 4659271 - DNA, 19 bp, Homo sapiens
ccattttgcccttccatag

SEQ ID NO: 4659272 - DNA, 14 bp, Homo sapiens
ccatttttctcttg

SEQ ID NO: 4659273 - DNA, 19 bp, Homo sapiens
cccaaaggaaccgcccagt

SEQ ID NO: 4659274 - DNA, 21 bp, Homo sapiens
cccaaagtggtatagaaatgc

SEQ ID NO: 4659275 - DNA, 22 bp, Homo sapiens
cccaaagttgctcaccgactca

SEQ ID NO: 4659276 - DNA, 23 bp, Homo sapiens
cccaaatccgccagtgtttctga

SEQ ID NO: 4659277 - DNA, 17 bp, Homo sapiens
cccaaccagtgccaagg

SEQ ID NO: 4659278 - DNA, 20 bp, Homo sapiens
cccaacccgtggaggctgct

SEQ ID NO: 4659279 - DNA, 22 bp, Homo sapiens
cccaacccgtggaggctgctcg

SEQ ID NO: 4659280 - DNA, 23 bp, Homo sapiens
cccaacccgtggaggctgctcgg

SEQ ID NO: 4659281 - DNA, 13 bp, Homo sapiens
cccaaccctgggc

SEQ ID NO: 4659282 - DNA, 19 bp, Homo sapiens
cccaaccctgggctgggga

SEQ ID NO: 4659283 - DNA, 19 bp, Homo sapiens
cccaacgaaaagcacatcc

SEQ ID NO: 4659284 - DNA, 21 bp, Homo sapiens
cccaactcaagtgtcacctcc

SEQ ID NO: 4659285 - DNA, 16 bp, Homo sapiens
cccaactccttccagc

SEQ ID NO: 4659286 - DNA, 15 bp, Homo sapiens
cccaactctcccctg

SEQ ID NO: 4659287 - DNA, 20 bp, Homo sapiens
cccaactctcccctgacctg

SEQ ID NO: 4659288 - DNA, 22 bp, Homo sapiens
cccaagagcatcatgcctctga

SEQ ID NO: 4659289 - DNA, 20 bp, Homo sapiens
cccaagatctgccagacctg

SEQ ID NO: 4659290 - DNA, 19 bp, Homo sapiens
cccaagctagactgtgtct

SEQ ID NO: 4659291 - DNA, 20 bp, Homo sapiens
cccaagctagactgtgtctg

SEQ ID NO: 4659292 - DNA, 16 bp, Homo sapiens
cccaaggacccagccc

SEQ ID NO: 4659293 - DNA, 16 bp, Homo sapiens
cccaaggactgagggc

SEQ ID NO: 4659294 - DNA, 18 bp, Homo sapiens
cccaaggactgagggcag

SEQ ID NO: 4659295 - DNA, 13 bp, Homo sapiens
cccaaggaggggg

SEQ ID NO: 4659296 - DNA, 21 bp, Homo sapiens
cccaaggagggggcctcattg

SEQ ID NO: 4659297 - DNA, 16 bp, Homo sapiens
cccaagttttttaatt

SEQ ID NO: 4659298 - DNA, 16 bp, Homo sapiens
cccaatcggactgcca

SEQ ID NO: 4659299 - DNA, 18 bp, Homo sapiens
cccaatcggactgccaaa

SEQ ID NO: 4659300 - DNA, 14 bp, Homo sapiens
cccacaagcctgcc

SEQ ID NO: 4659301 - DNA, 21 bp, Homo sapiens
cccacaagcctgcctcgcctt

SEQ ID NO: 4659302 - DNA, 21 bp, Homo sapiens
cccacaagctgtccctgcagg

SEQ ID NO: 4659303 - DNA, 16 bp, Homo sapiens
cccacactttatatac

SEQ ID NO: 4659304 - DNA, 19 bp, Homo sapiens
cccacagaaagccaggagc

SEQ ID NO: 4659305 - DNA, 14 bp, Homo sapiens
cccacatccctggg

SEQ ID NO: 4659306 - DNA, 22 bp, Homo sapiens
cccacatccctgggcctgctgc

SEQ ID NO: 4659307 - DNA, 14 bp, Homo sapiens
cccacatgaggcca

SEQ ID NO: 4659308 - DNA, 18 bp, Homo sapiens
cccacatgaggccatctc

SEQ ID NO: 4659309 - DNA, 23 bp, Homo sapiens
cccacatgaggccatctcaggag

SEQ ID NO: 4659310 - DNA, 23 bp, Homo sapiens
cccaccacgtctggctccctgcc

SEQ ID NO: 4659311 - DNA, 14 bp, Homo sapiens
cccacccacatgtg

SEQ ID NO: 4659312 - DNA, 17 bp, Homo sapiens
cccaccccacccccacc

SEQ ID NO: 4659313 - DNA, 18 bp, Homo sapiens
cccacccccacccccacc

SEQ ID NO: 4659314 - DNA, 16 bp, Homo sapiens
cccaccccctgcctgg

SEQ ID NO: 4659315 - DNA, 12 bp, Homo sapiens
cccaccccttcc

SEQ ID NO: 4659316 - DNA, 20 bp, Homo sapiens
cccaccccttggaggagaga

SEQ ID NO: 4659317 - DNA, 13 bp, Homo sapiens
cccaccctccact

SEQ ID NO: 4659318 - DNA, 14 bp, Homo sapiens
cccaccctccactc

SEQ ID NO: 4659319 - DNA, 17 bp, Homo sapiens
cccaccgggccactcct

SEQ ID NO: 4659320 - DNA, 15 bp, Homo sapiens
cccacggtttcagct

SEQ ID NO: 4659321 - DNA, 16 bp, Homo sapiens
cccacgttgtccctga

SEQ ID NO: 4659322 - DNA, 21 bp, Homo sapiens
cccactccgccagccacagga

SEQ ID NO: 4659323 - DNA, 16 bp, Homo sapiens
cccactctgctctgat

SEQ ID NO: 4659324 - DNA, 17 bp, Homo sapiens
cccactctgctctgatg

SEQ ID NO: 4659325 - DNA, 14 bp, Homo sapiens
cccagacctgcctc

SEQ ID NO: 4659326 - DNA, 21 bp, Homo sapiens
cccagacctgttagcagacag

SEQ ID NO: 4659327 - DNA, 18 bp, Homo sapiens
cccagactactattttct

SEQ ID NO: 4659328 - DNA, 17 bp, Homo sapiens
cccagagaacagcgaag

SEQ ID NO: 4659329 - DNA, 20 bp, Homo sapiens
cccagagcccctcctccagc

SEQ ID NO: 4659330 - DNA, 22 bp, Homo sapiens
cccagagctcatcccccctgct

SEQ ID NO: 4659331 - DNA, 15 bp, Homo sapiens
cccagagctgtgcca

SEQ ID NO: 4659332 - DNA, 17 bp, Homo sapiens
cccagagctgtgccagc

SEQ ID NO: 4659333 - DNA, 12 bp, Homo sapiens
cccagaggccct

SEQ ID NO: 4659334 - DNA, 13 bp, Homo sapiens
cccagaggccctg

SEQ ID NO: 4659335 - DNA, 17 bp, Homo sapiens
cccagaggccctggagg

SEQ ID NO: 4659336 - DNA, 16 bp, Homo sapiens
cccagaggctgcccca

SEQ ID NO: 4659337 - DNA, 22 bp, Homo sapiens
cccagatgttttacgtctggga

SEQ ID NO: 4659338 - DNA, 13 bp, Homo sapiens
cccagcaaggcag

SEQ ID NO: 4659339 - DNA, 14 bp, Homo sapiens
cccagcatccctgg

SEQ ID NO: 4659340 - DNA, 13 bp, Homo sapiens
cccagcatctccc

SEQ ID NO: 4659341 - DNA, 17 bp, Homo sapiens
cccagcatctcccagca

SEQ ID NO: 4659342 - DNA, 19 bp, Homo sapiens
cccagcatctcccagcaag

SEQ ID NO: 4659343 - DNA, 16 bp, Homo sapiens
cccagccccttcccct

SEQ ID NO: 4659344 - DNA, 22 bp, Homo sapiens
cccagccctcgcctctgcgaga

SEQ ID NO: 4659345 - DNA, 15 bp, Homo sapiens
cccagccctggcccc

SEQ ID NO: 4659346 - DNA, 13 bp, Homo sapiens
cccagccctgggg

SEQ ID NO: 4659347 - DNA, 12 bp, Homo sapiens
cccagcctcact

SEQ ID NO: 4659348 - DNA, 16 bp, Homo sapiens
cccagcctcacttcct

SEQ ID NO: 4659349 - DNA, 21 bp, Homo sapiens
cccagcgattccctctcccag

SEQ ID NO: 4659350 - DNA, 15 bp, Homo sapiens
cccagcgccatcctg

SEQ ID NO: 4659351 - DNA, 13 bp, Homo sapiens
cccagcgctgctg

SEQ ID NO: 4659352 - DNA, 18 bp, Homo sapiens
cccagctcccccaggcag

SEQ ID NO: 4659353 - DNA, 17 bp, Homo sapiens
cccagctgaaggcagtg

SEQ ID NO: 4659354 - DNA, 22 bp, Homo sapiens
cccagctgctctaagcccagga

SEQ ID NO: 4659355 - DNA, 19 bp, Homo sapiens
cccagcttcacctctggga

SEQ ID NO: 4659356 - DNA, 17 bp, Homo sapiens
cccaggaaaggaggacc

SEQ ID NO: 4659357 - DNA, 15 bp, Homo sapiens
cccaggaggtgcagt

SEQ ID NO: 4659358 - DNA, 16 bp, Homo sapiens
cccaggaggtgcagtg

SEQ ID NO: 4659359 - DNA, 20 bp, Homo sapiens
cccaggaggtgcagtggagg

SEQ ID NO: 4659360 - DNA, 21 bp, Homo sapiens
cccaggaggtgcagtggaggg

SEQ ID NO: 4659361 - DNA, 19 bp, Homo sapiens
cccaggatactggcacaga

SEQ ID NO: 4659362 - DNA, 20 bp, Homo sapiens
cccaggccccatgacctcca

SEQ ID NO: 4659363 - DNA, 21 bp, Homo sapiens
cccaggccccatgacctccag

SEQ ID NO: 4659364 - DNA, 15 bp, Homo sapiens
cccaggcctctgccc

SEQ ID NO: 4659365 - DNA, 22 bp, Homo sapiens
cccaggcctctgccccaagagc

SEQ ID NO: 4659366 - DNA, 19 bp, Homo sapiens
cccaggctggagtgcagtg

SEQ ID NO: 4659367 - DNA, 14 bp, Homo sapiens
cccagggcacagga

SEQ ID NO: 4659368 - DNA, 22 bp, Homo sapiens
cccagggcacaggagctacctg

SEQ ID NO: 4659369 - DNA, 16 bp, Homo sapiens
cccagggccctcccag

SEQ ID NO: 4659370 - DNA, 17 bp, Homo sapiens
cccagggccctcccagc

SEQ ID NO: 4659371 - DNA, 16 bp, Homo sapiens
cccaggggcatgactg

SEQ ID NO: 4659372 - DNA, 20 bp, Homo sapiens
cccaggtgagggaaggagac

SEQ ID NO: 4659373 - DNA, 21 bp, Homo sapiens
cccaggtggaaggcagacagc

SEQ ID NO: 4659374 - DNA, 18 bp, Homo sapiens
cccagtcggccccatctc

SEQ ID NO: 4659375 - DNA, 23 bp, Homo sapiens
cccagtcgtgatgtggaggaaga

SEQ ID NO: 4659376 - DNA, 20 bp, Homo sapiens
cccagtctcctctccatttt

SEQ ID NO: 4659377 - DNA, 21 bp, Homo sapiens
cccagtgcaaaccacttctcc

SEQ ID NO: 4659378 - DNA, 21 bp, Homo sapiens
cccagttcttcatttggagga

SEQ ID NO: 4659379 - DNA, 20 bp, Homo sapiens
cccatagggtcggaggtgct

SEQ ID NO: 4659380 - DNA, 21 bp, Homo sapiens
cccatagggtcggaggtgctg

SEQ ID NO: 4659381 - DNA, 12 bp, Homo sapiens
cccatatattac

SEQ ID NO: 4659382 - DNA, 21 bp, Homo sapiens
cccatcacctactcacacagg

SEQ ID NO: 4659383 - DNA, 23 bp, Homo sapiens
cccatcacctactcacacaggca

SEQ ID NO: 4659384 - DNA, 16 bp, Homo sapiens
cccatcctcatccctg

SEQ ID NO: 4659385 - DNA, 17 bp, Homo sapiens
cccatcctcatccctga

SEQ ID NO: 4659386 - DNA, 13 bp, Homo sapiens
cccatcctggggc

SEQ ID NO: 4659387 - DNA, 16 bp, Homo sapiens
cccatcctggggcagc

SEQ ID NO: 4659388 - DNA, 15 bp, Homo sapiens
cccatcttgcttcca

SEQ ID NO: 4659389 - DNA, 17 bp, Homo sapiens
cccatgaaccctgccct

SEQ ID NO: 4659390 - DNA, 19 bp, Homo sapiens
cccatgagactgccctgcc

SEQ ID NO: 4659391 - DNA, 20 bp, Homo sapiens
cccatgagactgccctgccc

SEQ ID NO: 4659392 - DNA, 23 bp, Homo sapiens
cccatgagttggggtctggcagc

SEQ ID NO: 4659393 - DNA, 14 bp, Homo sapiens
cccatgccccagtc

SEQ ID NO: 4659394 - DNA, 20 bp, Homo sapiens
cccatgcttacgtgatcctc

SEQ ID NO: 4659395 - DNA, 20 bp, Homo sapiens
cccatggacaggctggctcc

SEQ ID NO: 4659396 - DNA, 22 bp, Homo sapiens
cccatggacaggctggctccag

SEQ ID NO: 4659397 - DNA, 19 bp, Homo sapiens
cccatgtgtacattctgcc

SEQ ID NO: 4659398 - DNA, 16 bp, Homo sapiens
cccattaatcttgatc

SEQ ID NO: 4659399 - DNA, 21 bp, Homo sapiens
cccattaatcttgatcattcc

SEQ ID NO: 4659400 - DNA, 14 bp, Homo sapiens
cccattagagaagt

SEQ ID NO: 4659401 - DNA, 13 bp, Homo sapiens
cccattgctgcca

SEQ ID NO: 4659402 - DNA, 23 bp, Homo sapiens
cccattgctgccaaggtggaggg

SEQ ID NO: 4659403 - DNA, 14 bp, Homo sapiens
cccattttctgtgg

SEQ ID NO: 4659404 - DNA, 16 bp, Homo sapiens
ccccaacatgcactga

SEQ ID NO: 4659405 - DNA, 23 bp, Homo sapiens
ccccaactcaagtgtcacctcct

SEQ ID NO: 4659406 - DNA, 16 bp, Homo sapiens
ccccaagagcaggagg

SEQ ID NO: 4659407 - DNA, 21 bp, Homo sapiens
ccccaagatctgccagacctg

SEQ ID NO: 4659408 - DNA, 18 bp, Homo sapiens
ccccaaggacccagccct

SEQ ID NO: 4659409 - DNA, 19 bp, Homo sapiens
ccccaaggacccagccctc

SEQ ID NO: 4659410 - DNA, 15 bp, Homo sapiens
ccccaagggccctgg

SEQ ID NO: 4659411 - DNA, 16 bp, Homo sapiens
ccccaatgtgacctgg

SEQ ID NO: 4659412 - DNA, 16 bp, Homo sapiens
ccccacaaggcctggt

SEQ ID NO: 4659413 - DNA, 19 bp, Homo sapiens
ccccacaaggcctggtctg

SEQ ID NO: 4659414 - DNA, 19 bp, Homo sapiens
ccccaccaagggcgcaaga

SEQ ID NO: 4659415 - DNA, 14 bp, Homo sapiens
ccccacccctgtaa

SEQ ID NO: 4659416 - DNA, 14 bp, Homo sapiens
ccccaccctcccct

SEQ ID NO: 4659417 - DNA, 13 bp, Homo sapiens
ccccactccagct

SEQ ID NO: 4659418 - DNA, 19 bp, Homo sapiens
ccccactctgctctgatgc

SEQ ID NO: 4659419 - DNA, 21 bp, Homo sapiens
ccccagagcccctcctccagc

SEQ ID NO: 4659420 - DNA, 14 bp, Homo sapiens
ccccagagctgtgc

SEQ ID NO: 4659421 - DNA, 15 bp, Homo sapiens
ccccagaggccctgg

SEQ ID NO: 4659422 - DNA, 17 bp, Homo sapiens
ccccagaggccctggag

SEQ ID NO: 4659423 - DNA, 18 bp, Homo sapiens
ccccagaggccctggagg

SEQ ID NO: 4659424 - DNA, 11 bp, Homo sapiens
ccccagcctgg

SEQ ID NO: 4659425 - DNA, 15 bp, Homo sapiens
ccccagcctgggcct

SEQ ID NO: 4659426 - DNA, 16 bp, Homo sapiens
ccccagcctgggccta

SEQ ID NO: 4659427 - DNA, 17 bp, Homo sapiens
ccccagctcccccaggc

SEQ ID NO: 4659428 - DNA, 18 bp, Homo sapiens
ccccagctcccccaggca

SEQ ID NO: 4659429 - DNA, 16 bp, Homo sapiens
ccccagctgctctaag

SEQ ID NO: 4659430 - DNA, 23 bp, Homo sapiens
ccccagctgctctaagcccagga

SEQ ID NO: 4659431 - DNA, 15 bp, Homo sapiens
ccccaggacctggct

SEQ ID NO: 4659432 - DNA, 17 bp, Homo sapiens
ccccaggacctggctgc

SEQ ID NO: 4659433 - DNA, 12 bp, Homo sapiens
ccccagggcaca

SEQ ID NO: 4659434 - DNA, 18 bp, Homo sapiens
ccccagggcacaggagct

SEQ ID NO: 4659435 - DNA, 11 bp, Homo sapiens
ccccagtgccc

SEQ ID NO: 4659436 - DNA, 18 bp, Homo sapiens
ccccagtgcccggtgcag

SEQ ID NO: 4659437 - DNA, 22 bp, Homo sapiens
ccccatacttggctgcttcctg

SEQ ID NO: 4659438 - DNA, 15 bp, Homo sapiens
ccccatctctcatcc

SEQ ID NO: 4659439 - DNA, 15 bp, Homo sapiens
ccccatgacctccag

SEQ ID NO: 4659440 - DNA, 23 bp, Homo sapiens
ccccattagctttcaattccgta

SEQ ID NO: 4659441 - DNA, 21 bp, Homo sapiens
ccccatttcagagttatcaag

SEQ ID NO: 4659442 - DNA, 21 bp, Homo sapiens
cccccacaagctgtccctgca

SEQ ID NO: 4659443 - DNA, 12 bp, Homo sapiens
cccccacccttg

SEQ ID NO: 4659444 - DNA, 17 bp, Homo sapiens
cccccagagcgtccttg

SEQ ID NO: 4659445 - DNA, 13 bp, Homo sapiens
cccccagccctgg

SEQ ID NO: 4659446 - DNA, 14 bp, Homo sapiens
cccccagccctggc

SEQ ID NO: 4659447 - DNA, 15 bp, Homo sapiens
cccccagcctgggcc

SEQ ID NO: 4659448 - DNA, 16 bp, Homo sapiens
cccccagcctgggcct

SEQ ID NO: 4659449 - DNA, 11 bp, Homo sapiens
cccccagctgg

SEQ ID NO: 4659450 - DNA, 19 bp, Homo sapiens
ccccctcttcttctgaaga

SEQ ID NO: 4659451 - DNA, 14 bp, Homo sapiens
ccccctgcagcttg

SEQ ID NO: 4659452 - DNA, 11 bp, Homo sapiens
ccccctgcctg

SEQ ID NO: 4659453 - DNA, 12 bp, Homo sapiens
ccccctgctgcc

SEQ ID NO: 4659454 - DNA, 13 bp, Homo sapiens
ccccctgctgccc

SEQ ID NO: 4659455 - DNA, 12 bp, Homo sapiens
ccccctggggat

SEQ ID NO: 4659456 - DNA, 17 bp, Homo sapiens
ccccctttctctgcctg

SEQ ID NO: 4659457 - DNA, 19 bp, Homo sapiens
ccccctttctctgcctggc

SEQ ID NO: 4659458 - DNA, 15 bp, Homo sapiens
ccccgcacccggctc

SEQ ID NO: 4659459 - DNA, 21 bp, Homo sapiens
ccccgggctggagaaagagct

SEQ ID NO: 4659460 - DNA, 24 bp, Homo sapiens
cccctaagtgcaaacacagcatgg

SEQ ID NO: 4659461 - DNA, 17 bp, Homo sapiens
cccctagggactgtcct

SEQ ID NO: 4659462 - DNA, 14 bp, Homo sapiens
cccctcagagcatg

SEQ ID NO: 4659463 - DNA, 20 bp, Homo sapiens
cccctcagagcatgatggga

SEQ ID NO: 4659464 - DNA, 18 bp, Homo sapiens
cccctcatacctacaccc

SEQ ID NO: 4659465 - DNA, 14 bp, Homo sapiens
cccctccccatctg

SEQ ID NO: 4659466 - DNA, 12 bp, Homo sapiens
cccctcccctgg

SEQ ID NO: 4659467 - DNA, 14 bp, Homo sapiens
cccctcccctggga

SEQ ID NO: 4659468 - DNA, 19 bp, Homo sapiens
cccctccctgtcccagggc

SEQ ID NO: 4659469 - DNA, 12 bp, Homo sapiens
cccctccttgtc

SEQ ID NO: 4659470 - DNA, 23 bp, Homo sapiens
cccctcttcttctgaagatcaga

SEQ ID NO: 4659471 - DNA, 20 bp, Homo sapiens
cccctgacctgtgagcccag

SEQ ID NO: 4659472 - DNA, 21 bp, Homo sapiens
cccctgcaacttccgctgagg

SEQ ID NO: 4659473 - DNA, 14 bp, Homo sapiens
ccacagacccctgg

SEQ ID NO: 4659474 - DNA, 18 bp, Homo sapiens
ccacagacccctgggagc

SEQ ID NO: 4659475 - DNA, 20 bp, Homo sapiens
ccacagagaagtttgtagcc

SEQ ID NO: 4659476 - DNA, 22 bp, Homo sapiens
ccacagagaagtttgtagccag

SEQ ID NO: 4659477 - DNA, 22 bp, Homo sapiens
ccacagatggctttcagggcag

SEQ ID NO: 4659478 - DNA, 14 bp, Homo sapiens
ccacagccttccct

SEQ ID NO: 4659479 - DNA, 18 bp, Homo sapiens
ccacagccttccctctgc

SEQ ID NO: 4659480 - DNA, 19 bp, Homo sapiens
ccacagccttccctctgca

SEQ ID NO: 4659481 - DNA, 20 bp, Homo sapiens
ccacagccttccctctgcat

SEQ ID NO: 4659482 - DNA, 21 bp, Homo sapiens
ccacagccttccctctgcatt

SEQ ID NO: 4659483 - DNA, 15 bp, Homo sapiens
ccacaggcataagct

SEQ ID NO: 4659484 - DNA, 16 bp, Homo sapiens
ccacaggccgccctgc

SEQ ID NO: 4659485 - DNA, 17 bp, Homo sapiens
ccacaggccgccctgcg

SEQ ID NO: 4659486 - DNA, 10 bp, Homo sapiens
ccacatccct

SEQ ID NO: 4659487 - DNA, 14 bp, Homo sapiens
ccacatccctgggc

SEQ ID NO: 4659488 - DNA, 17 bp, Homo sapiens
ccacatccctgggcctg

SEQ ID NO: 4659489 - DNA, 21 bp, Homo sapiens
ccacatccctgggcctgctgc

SEQ ID NO: 4659490 - DNA, 21 bp, Homo sapiens
ccacatgaggccatctcagga

SEQ ID NO: 4659491 - DNA, 20 bp, Homo sapiens
ccacatgccatttgtactga

SEQ ID NO: 4659492 - DNA, 23 bp, Homo sapiens
ccaccacgtctggctccctgccc

SEQ ID NO: 4659493 - DNA, 18 bp, Homo sapiens
ccaccagggccagagcag

SEQ ID NO: 4659494 - DNA, 20 bp, Homo sapiens
ccaccagggccagagcagct

SEQ ID NO: 4659495 - DNA, 21 bp, Homo sapiens
ccaccagggccagagcagctc

SEQ ID NO: 4659496 - DNA, 16 bp, Homo sapiens
ccaccattcctgcctt

SEQ ID NO: 4659497 - DNA, 19 bp, Homo sapiens
ccaccattcctgcctttaa

SEQ ID NO: 4659498 - DNA, 23 bp, Homo sapiens
ccaccattcctgcctttaagcca

SEQ ID NO: 4659499 - DNA, 15 bp, Homo sapiens
ccacccaggaaagga

SEQ ID NO: 4659500 - DNA, 15 bp, Homo sapiens
ccacccccaccaagg

SEQ ID NO: 4659501 - DNA, 21 bp, Homo sapiens
ccacccccaccaagggcgcaa

SEQ ID NO: 4659502 - DNA, 16 bp, Homo sapiens
ccacccccagccctgg

SEQ ID NO: 4659503 - DNA, 13 bp, Homo sapiens
ccacccccagttc

SEQ ID NO: 4659504 - DNA, 15 bp, Homo sapiens
ccaccccctgcctgg

SEQ ID NO: 4659505 - DNA, 22 bp, Homo sapiens
ccaccccttggaggagagagac

SEQ ID NO: 4659506 - DNA, 19 bp, Homo sapiens
ccaccctccaccttccatt

SEQ ID NO: 4659507 - DNA, 13 bp, Homo sapiens
ccaccctccactc

SEQ ID NO: 4659508 - DNA, 12 bp, Homo sapiens
ccaccctcccat

SEQ ID NO: 4659509 - DNA, 20 bp, Homo sapiens
ccaccctggccgagtccaag

SEQ ID NO: 4659510 - DNA, 12 bp, Homo sapiens
ccacccttgccc

SEQ ID NO: 4659511 - DNA, 14 bp, Homo sapiens
ccaccggcctgtgg

SEQ ID NO: 4659512 - DNA, 19 bp, Homo sapiens
ccaccgggccactccttcc

SEQ ID NO: 4659513 - DNA, 15 bp, Homo sapiens
ccaccgtgcctggct

SEQ ID NO: 4659514 - DNA, 16 bp, Homo sapiens
ccacctcacaactcct

SEQ ID NO: 4659515 - DNA, 12 bp, Homo sapiens
ccacctcacccc

SEQ ID NO: 4659516 - DNA, 14 bp, Homo sapiens
ccacctcaccccac

SEQ ID NO: 4659517 - DNA, 19 bp, Homo sapiens
ccacctcacctagcctgat

SEQ ID NO: 4659518 - DNA, 11 bp, Homo sapiens
ccacctgcaag

SEQ ID NO: 4659519 - DNA, 11 bp, Homo sapiens
ccacctgtggg

SEQ ID NO: 4659520 - DNA, 18 bp, Homo sapiens
ccacctgtggttttacct

SEQ ID NO: 4659521 - DNA, 15 bp, Homo sapiens
ccaccttcccttcct

SEQ ID NO: 4659522 - DNA, 19 bp, Homo sapiens
ccaccttccgttccccgct

SEQ ID NO: 4659523 - DNA, 23 bp, Homo sapiens
ccacgcagagaagccccgggctt

SEQ ID NO: 4659524 - DNA, 20 bp, Homo sapiens
ccacgctggccaatttttgt

SEQ ID NO: 4659525 - DNA, 19 bp, Homo sapiens
ccacggcacctgggccctg

SEQ ID NO: 4659526 - DNA, 20 bp, Homo sapiens
ccacggcacctgggccctgg

SEQ ID NO: 4659527 - DNA, 23 bp, Homo sapiens
ccacggcctggctggtgggaagg

SEQ ID NO: 4659528 - DNA, 17 bp, Homo sapiens
ccacggtctgttcttga

SEQ ID NO: 4659529 - DNA, 18 bp, Homo sapiens
ccacgtagggggcagggg

SEQ ID NO: 4659530 - DNA, 21 bp, Homo sapiens
ccacgtcccagcatccctgga

SEQ ID NO: 4659531 - DNA, 22 bp, Homo sapiens
ccacgtcccagcatccctggag

SEQ ID NO: 4659532 - DNA, 14 bp, Homo sapiens
ccacgtctggctcc

SEQ ID NO: 4659533 - DNA, 15 bp, Homo sapiens
ccacgttgtccctga

SEQ ID NO: 4659534 - DNA, 14 bp, Homo sapiens
ccactaacttctaa

SEQ ID NO: 4659535 - DNA, 12 bp, Homo sapiens
ccactactgcag

SEQ ID NO: 4659536 - DNA, 12 bp, Homo sapiens
ccactattttca

SEQ ID NO: 4659537 - DNA, 16 bp, Homo sapiens
ccactccgccagccac

SEQ ID NO: 4659538 - DNA, 19 bp, Homo sapiens
ccactccgccagccacagg

SEQ ID NO: 4659539 - DNA, 20 bp, Homo sapiens
ccactccgccagccacagga

SEQ ID NO: 4659540 - DNA, 13 bp, Homo sapiens
ccactccttcctg

SEQ ID NO: 4659541 - DNA, 16 bp, Homo sapiens
ccactccttcctgccc

SEQ ID NO: 4659542 - DNA, 14 bp, Homo sapiens
ccactctgctctga

SEQ ID NO: 4659543 - DNA, 15 bp, Homo sapiens
ccactctgctctgat

SEQ ID NO: 4659544 - DNA, 13 bp, Homo sapiens
ccactctggcagc

SEQ ID NO: 4659545 - DNA, 14 bp, Homo sapiens
ccactgcactccag

SEQ ID NO: 4659546 - DNA, 18 bp, Homo sapiens
ccactgcactccagcctg

SEQ ID NO: 4659547 - DNA, 19 bp, Homo sapiens
ccactgcactccagcctgg

SEQ ID NO: 4659548 - DNA, 11 bp, Homo sapiens
ccacttaatct

SEQ ID NO: 4659549 - DNA, 14 bp, Homo sapiens
ccacttaatcttct

SEQ ID NO: 4659550 - DNA, 20 bp, Homo sapiens
ccacttacatatatttttaa

SEQ ID NO: 4659551 - DNA, 17 bp, Homo sapiens
ccacttatccctctcca

SEQ ID NO: 4659552 - DNA, 23 bp, Homo sapiens
ccacttccccctcttcttctgaa

SEQ ID NO: 4659553 - DNA, 18 bp, Homo sapiens
ccacttcgcacacaccca

SEQ ID NO: 4659554 - DNA, 14 bp, Homo sapiens
ccacttctccatgc

SEQ ID NO: 4659555 - DNA, 12 bp, Homo sapiens
ccacttctggct

SEQ ID NO: 4659556 - DNA, 18 bp, Homo sapiens
ccacttctggcttcagcc

SEQ ID NO: 4659557 - DNA, 12 bp, Homo sapiens
ccacttgccctg

SEQ ID NO: 4659558 - DNA, 13 bp, Homo sapiens
ccacttgccctgt

SEQ ID NO: 4659559 - DNA, 14 bp, Homo sapiens
ccacttgccctgtg

SEQ ID NO: 4659560 - DNA, 23 bp, Homo sapiens
ccactttcagagcccccagccct

SEQ ID NO: 4659561 - DNA, 21 bp, Homo sapiens
ccagaacttcaagatgagcct

SEQ ID NO: 4659562 - DNA, 15 bp, Homo sapiens
catctcggctcactg

SEQ ID NO: 4659563 - DNA, 13 bp, Homo sapiens
catctctttgaat

SEQ ID NO: 4659564 - DNA, 19 bp, Homo sapiens
catctctttgaattttctg

SEQ ID NO: 4659565 - DNA, 22 bp, Homo sapiens
catctctttgaattttctgtgt

SEQ ID NO: 4659566 - DNA, 19 bp, Homo sapiens
catctgactgccaagccag

SEQ ID NO: 4659567 - DNA, 21 bp, Homo sapiens
catctgactgccaagccagat

SEQ ID NO: 4659568 - DNA, 23 bp, Homo sapiens
catctgcaaaaggcctcttgtaa

SEQ ID NO: 4659569 - DNA, 16 bp, Homo sapiens
catctgcacactctct

SEQ ID NO: 4659570 - DNA, 21 bp, Homo sapiens
catctgcacactctcttctcc

SEQ ID NO: 4659571 - DNA, 22 bp, Homo sapiens
catctgcacactctcttctcca

SEQ ID NO: 4659572 - DNA, 11 bp, Homo sapiens
catctgctttt

SEQ ID NO: 4659573 - DNA, 13 bp, Homo sapiens
catctgtctgctc

SEQ ID NO: 4659574 - DNA, 18 bp, Homo sapiens
catctgtgcactgcccat

SEQ ID NO: 4659575 - DNA, 19 bp, Homo sapiens
catctgtggagctgccaca

SEQ ID NO: 4659576 - DNA, 20 bp, Homo sapiens
catctgtggagctgccacag

SEQ ID NO: 4659577 - DNA, 22 bp, Homo sapiens
catctgtggagctgccacagag

SEQ ID NO: 4659578 - DNA, 12 bp, Homo sapiens
catcttaatctt

SEQ ID NO: 4659579 - DNA, 13 bp, Homo sapiens
catcttaatcttt

SEQ ID NO: 4659580 - DNA, 16 bp, Homo sapiens
catcttaatctttatt

SEQ ID NO: 4659581 - DNA, 16 bp, Homo sapiens
catcttcaatatgaat

SEQ ID NO: 4659582 - DNA, 11 bp, Homo sapiens
catcttcatat

SEQ ID NO: 4659583 - DNA, 23 bp, Homo sapiens
catcttccccaacgaaaagcaca

SEQ ID NO: 4659584 - DNA, 16 bp, Homo sapiens
catctttaattcctta

SEQ ID NO: 4659585 - DNA, 14 bp, Homo sapiens
catctttgtgaagg

SEQ ID NO: 4659586 - DNA, 13 bp, Homo sapiens
catctttttcttg

SEQ ID NO: 4659587 - DNA, 15 bp, Homo sapiens
catgaaaaagctgct

SEQ ID NO: 4659588 - DNA, 23 bp, Homo sapiens
catgaaccaaatggttcttactt

SEQ ID NO: 4659589 - DNA, 15 bp, Homo sapiens
catgaattcatactc

SEQ ID NO: 4659590 - DNA, 16 bp, Homo sapiens
catgaattcatactct

SEQ ID NO: 4659591 - DNA, 13 bp, Homo sapiens
catgacctccagc

SEQ ID NO: 4659592 - DNA, 15 bp, Homo sapiens
catgacctccagctt

SEQ ID NO: 4659593 - DNA, 19 bp, Homo sapiens
catgactgtcgccacacgc

SEQ ID NO: 4659594 - DNA, 21 bp, Homo sapiens
catgactgtcgccacacgcct

SEQ ID NO: 4659595 - DNA, 12 bp, Homo sapiens
catttcaatcat

SEQ ID NO: 4659596 - DNA, 16 bp, Homo sapiens
catttcaatcattgaa

SEQ ID NO: 4659597 - DNA, 15 bp, Homo sapiens
catttcataaactaa

SEQ ID NO: 4659598 - DNA, 23 bp, Homo sapiens
catttcatgaaaaagctgcttct

SEQ ID NO: 4659599 - DNA, 18 bp, Homo sapiens
catttcattccattgcct

SEQ ID NO: 4659600 - DNA, 15 bp, Homo sapiens
catttcattgtacaa

SEQ ID NO: 4659601 - DNA, 13 bp, Homo sapiens
catttccagcttc

SEQ ID NO: 4659602 - DNA, 14 bp, Homo sapiens
catttccagcttct

SEQ ID NO: 4659603 - DNA, 14 bp, Homo sapiens
catttcctgctgaa

SEQ ID NO: 4659604 - DNA, 13 bp, Homo sapiens
catttctaattaa

SEQ ID NO: 4659605 - DNA, 21 bp, Homo sapiens
catttcttagatggagaagtt

SEQ ID NO: 4659606 - DNA, 23 bp, Homo sapiens
catttgacttctagaaaacattt

SEQ ID NO: 4659607 - DNA, 15 bp, Homo sapiens
catttgcacctctgt

SEQ ID NO: 4659608 - DNA, 19 bp, Homo sapiens
catttgctctttcatctct

SEQ ID NO: 4659609 - DNA, 21 bp, Homo sapiens
catttggaggaatcaccccat

SEQ ID NO: 4659610 - DNA, 23 bp, Homo sapiens
catttggtggcctaatttacaag

SEQ ID NO: 4659611 - DNA, 13 bp, Homo sapiens
catttgtagtgag

SEQ ID NO: 4659612 - DNA, 20 bp, Homo sapiens
catttgtgctagaaattttc

SEQ ID NO: 4659613 - DNA, 16 bp, Homo sapiens
cattttaaaaacttta

SEQ ID NO: 4659614 - DNA, 19 bp, Homo sapiens
cattttaaaaactttattg

SEQ ID NO: 4659615 - DNA, 19 bp, Homo sapiens
cattttataaatgatatca

SEQ ID NO: 4659616 - DNA, 17 bp, Homo sapiens
cattttatgctgtttat

SEQ ID NO: 4659617 - DNA, 21 bp, Homo sapiens
cattttattcacatatgtctt

SEQ ID NO: 4659618 - DNA, 14 bp, Homo sapiens
cattttattgcttg

SEQ ID NO: 4659619 - DNA, 18 bp, Homo sapiens
cattttcagtaccaaaga

SEQ ID NO: 4659620 - DNA, 12 bp, Homo sapiens
cattttctaaat

SEQ ID NO: 4659621 - DNA, 14 bp, Homo sapiens
cattttgaaacaaa

SEQ ID NO: 4659622 - DNA, 15 bp, Homo sapiens
cattttgagtatttt

SEQ ID NO: 4659623 - DNA, 14 bp, Homo sapiens
cattttggtgctta

SEQ ID NO: 4659624 - DNA, 14 bp, Homo sapiens
catttttgcttcct

SEQ ID NO: 4659625 - DNA, 15 bp, Homo sapiens
catttttgcttccta

SEQ ID NO: 4659626 - DNA, 17 bp, Homo sapiens
cattttttaaaagcctt

SEQ ID NO: 4659627 - DNA, 21 bp, Homo sapiens
cattttttaaaagccttccag

SEQ ID NO: 4659628 - DNA, 17 bp, Homo sapiens
cattttttttttaaatc

SEQ ID NO: 4659629 - DNA, 22 bp, Homo sapiens
cattttttttttcattggtgta

SEQ ID NO: 4659630 - DNA, 12 bp, Homo sapiens
ccaaaatcaaga

SEQ ID NO: 4659631 - DNA, 14 bp, Homo sapiens
ccaaaatcaagagt

SEQ ID NO: 4659632 - DNA, 14 bp, Homo sapiens
ccaaacagacaaaa

SEQ ID NO: 4659633 - DNA, 16 bp, Homo sapiens
ccaaaccaggaccctg

SEQ ID NO: 4659634 - DNA, 11 bp, Homo sapiens
ccaaacctctg

SEQ ID NO: 4659635 - DNA, 12 bp, Homo sapiens
ccaaacctctgt

SEQ ID NO: 4659636 - DNA, 13 bp, Homo sapiens
ccaaacctctgtt

SEQ ID NO: 4659637 - DNA, 14 bp, Homo sapiens
ccaaacctctgttc

SEQ ID NO: 4659638 - DNA, 18 bp, Homo sapiens
ccaaaccttcacacacag

SEQ ID NO: 4659639 - DNA, 17 bp, Homo sapiens
ccaaacttgttcattta

SEQ ID NO: 4659640 - DNA, 17 bp, Homo sapiens
ccaaagaaacaagctgt

SEQ ID NO: 4659641 - DNA, 13 bp, Homo sapiens
ccaaagcagacag

SEQ ID NO: 4659642 - DNA, 14 bp, Homo sapiens
ccaaagcctgagga

SEQ ID NO: 4659643 - DNA, 23 bp, Homo sapiens
ccaaaggagacccgccccagggc

SEQ ID NO: 4659644 - DNA, 13 bp, Homo sapiens
ccaaataataaag

SEQ ID NO: 4659645 - DNA, 23 bp, Homo sapiens
ccaaatccgaacctcctctgtga

SEQ ID NO: 4659646 - DNA, 24 bp, Homo sapiens
ccaaatccgaacctcctctgtgaa

SEQ ID NO: 4659647 - DNA, 18 bp, Homo sapiens
ccaaatccgccagtgttt

SEQ ID NO: 4659648 - DNA, 14 bp, Homo sapiens
ccaaattaaaacaa

SEQ ID NO: 4659649 - DNA, 22 bp, Homo sapiens
ccaacaatcctagtgctttcct

SEQ ID NO: 4659650 - DNA, 16 bp, Homo sapiens
ccaacacgcacctgcc

SEQ ID NO: 4659651 - DNA, 21 bp, Homo sapiens
ccaaccagcccgacagtgcca

SEQ ID NO: 4659652 - DNA, 15 bp, Homo sapiens
ccaacccgtggaggc

SEQ ID NO: 4659653 - DNA, 18 bp, Homo sapiens
ccaacccgtggaggctgc

SEQ ID NO: 4659654 - DNA, 21 bp, Homo sapiens
ccaacccgtggaggctgctcg

SEQ ID NO: 4659655 - DNA, 20 bp, Homo sapiens
ccaaccctgggctggggagg

SEQ ID NO: 4659656 - DNA, 13 bp, Homo sapiens
ccaacctgaccta

SEQ ID NO: 4659657 - DNA, 19 bp, Homo sapiens
ccaaccttgctcttgggga

SEQ ID NO: 4659658 - DNA, 21 bp, Homo sapiens
ccaactcaagtgtcacctcct

SEQ ID NO: 4659659 - DNA, 14 bp, Homo sapiens
ccaactccttccag

SEQ ID NO: 4659660 - DNA, 15 bp, Homo sapiens
ccaactccttccagc

SEQ ID NO: 4659661 - DNA, 16 bp, Homo sapiens
ccaactgtttccctgc

SEQ ID NO: 4659662 - DNA, 18 bp, Homo sapiens
ccaactgtttccctgctg

SEQ ID NO: 4659663 - DNA, 19 bp, Homo sapiens
ccaactgtttccctgctga

SEQ ID NO: 4659664 - DNA, 20 bp, Homo sapiens
ccaactgtttccctgctgaa

SEQ ID NO: 4659665 - DNA, 20 bp, Homo sapiens
ccaagagcaggaggtgcctg

SEQ ID NO: 4659666 - DNA, 19 bp, Homo sapiens
ccaagagcatcatgcctct

SEQ ID NO: 4659667 - DNA, 23 bp, Homo sapiens
ccaagagcatcatgcctctgagg

SEQ ID NO: 4659668 - DNA, 13 bp, Homo sapiens
ccaagatctgcca

SEQ ID NO: 4659669 - DNA, 16 bp, Homo sapiens
ccaagattttcctctt

SEQ ID NO: 4659670 - DNA, 14 bp, Homo sapiens
ccaagcacagcagc

SEQ ID NO: 4659671 - DNA, 13 bp, Homo sapiens
ccaagcatttcat

SEQ ID NO: 4659672 - DNA, 14 bp, Homo sapiens
ccaagcatttcatg

SEQ ID NO: 4659673 - DNA, 19 bp, Homo sapiens
ccaagccagattctcttga

SEQ ID NO: 4659674 - DNA, 12 bp, Homo sapiens
ccaagccctcag

SEQ ID NO: 4659675 - DNA, 13 bp, Homo sapiens
ccaagccctcagc

SEQ ID NO: 4659676 - DNA, 13 bp, Homo sapiens
ccaagctgaggtg

SEQ ID NO: 4659677 - DNA, 15 bp, Homo sapiens
ccaagctgaggtgcc

SEQ ID NO: 4659678 - DNA, 20 bp, Homo sapiens
ccaagctgaggtgcccagga

SEQ ID NO: 4659679 - DNA, 12 bp, Homo sapiens
ccaaggaagcag

SEQ ID NO: 4659680 - DNA, 17 bp, Homo sapiens
ccaaggacagttcagag

SEQ ID NO: 4659681 - DNA, 20 bp, Homo sapiens
ccaaggacagttcagagatc

SEQ ID NO: 4659682 - DNA, 14 bp, Homo sapiens
ccaaggacccagcc

SEQ ID NO: 4659683 - DNA, 15 bp, Homo sapiens
ccaaggacccagccc

SEQ ID NO: 4659684 - DNA, 22 bp, Homo sapiens
ccaaggaccttggaagagcaag

SEQ ID NO: 4659685 - DNA, 15 bp, Homo sapiens
ccaaggactgagggc

SEQ ID NO: 4659686 - DNA, 12 bp, Homo sapiens
ccaaggaggggg

SEQ ID NO: 4659687 - DNA, 18 bp, Homo sapiens
ccaaggagggggcctcat

SEQ ID NO: 4659688 - DNA, 21 bp, Homo sapiens
ccaaggagggggcctcattgt

SEQ ID NO: 4659689 - DNA, 16 bp, Homo sapiens
ccaaggccctgtctct

SEQ ID NO: 4659690 - DNA, 17 bp, Homo sapiens
ccaaggccctgtctctg

SEQ ID NO: 4659691 - DNA, 14 bp, Homo sapiens
ccaagggccctggc

SEQ ID NO: 4659692 - DNA, 14 bp, Homo sapiens
ccaaggtggaggga

SEQ ID NO: 4659693 - DNA, 18 bp, Homo sapiens
ccaagtaaacagggtacc

SEQ ID NO: 4659694 - DNA, 19 bp, Homo sapiens
ccaagtcagcccaacaggc

SEQ ID NO: 4659695 - DNA, 17 bp, Homo sapiens
ccaagtccaggtcctgg

SEQ ID NO: 4659696 - DNA, 19 bp, Homo sapiens
ccaagtccaggtcctggtg

SEQ ID NO: 4659697 - DNA, 22 bp, Homo sapiens
ccaagttgtgcttgagccagga

SEQ ID NO: 4659698 - DNA, 17 bp, Homo sapiens
ccaatattaccatctta

SEQ ID NO: 4659699 - DNA, 20 bp, Homo sapiens
ccaatattaccatcttaatc

SEQ ID NO: 4659700 - DNA, 12 bp, Homo sapiens
ccaatcctcccc

SEQ ID NO: 4659701 - DNA, 17 bp, Homo sapiens
ccaatcctccccgctct

SEQ ID NO: 4659702 - DNA, 15 bp, Homo sapiens
ccaatcggactgcca

SEQ ID NO: 4659703 - DNA, 14 bp, Homo sapiens
ccaatgccacagac

SEQ ID NO: 4659704 - DNA, 18 bp, Homo sapiens
ccaatggattcatggagt

SEQ ID NO: 4659705 - DNA, 21 bp, Homo sapiens
ccaatggattcatggagtagc

SEQ ID NO: 4659706 - DNA, 21 bp, Homo sapiens
ccaatgttatgccagctccat

SEQ ID NO: 4659707 - DNA, 16 bp, Homo sapiens
cataaagtacaaatga

SEQ ID NO: 4659708 - DNA, 20 bp, Homo sapiens
cataaataaaggtgtagaaa

SEQ ID NO: 4659709 - DNA, 16 bp, Homo sapiens
cataaatcacagaaaa

SEQ ID NO: 4659710 - DNA, 18 bp, Homo sapiens
cataaccaatttgtaatg

SEQ ID NO: 4659711 - DNA, 13 bp, Homo sapiens
cataaccccaccc

SEQ ID NO: 4659712 - DNA, 18 bp, Homo sapiens
cataactcacacccctgc

SEQ ID NO: 4659713 - DNA, 19 bp, Homo sapiens
cataactcacacccctgcc

SEQ ID NO: 4659714 - DNA, 14 bp, Homo sapiens
cataagatattctt

SEQ ID NO: 4659715 - DNA, 16 bp, Homo sapiens
cataagatattcttta

SEQ ID NO: 4659716 - DNA, 20 bp, Homo sapiens
cataagtcctttcaattcca

SEQ ID NO: 4659717 - DNA, 14 bp, Homo sapiens
cataatcagtaaat

SEQ ID NO: 4659718 - DNA, 22 bp, Homo sapiens
cataatgaaaatattttttaca

SEQ ID NO: 4659719 - DNA, 15 bp, Homo sapiens
cataattatgaaaac

SEQ ID NO: 4659720 - DNA, 12 bp, Homo sapiens
cataatttggtc

SEQ ID NO: 4659721 - DNA, 20 bp, Homo sapiens
cataattttgcatactgaaa

SEQ ID NO: 4659722 - DNA, 17 bp, Homo sapiens
catacaaactctcacca

SEQ ID NO: 4659723 - DNA, 14 bp, Homo sapiens
catacaccacaaaa

SEQ ID NO: 4659724 - DNA, 18 bp, Homo sapiens
catacacgttaactgcag

SEQ ID NO: 4659725 - DNA, 15 bp, Homo sapiens
catacatgctacttt

SEQ ID NO: 4659726 - DNA, 13 bp, Homo sapiens
catacctgtctca

SEQ ID NO: 4659727 - DNA, 12 bp, Homo sapiens
cataccttctcc

SEQ ID NO: 4659728 - DNA, 18 bp, Homo sapiens
cataccttctcccaggcc

SEQ ID NO: 4659729 - DNA, 19 bp, Homo sapiens
catacgcctcttgttcatg

SEQ ID NO: 4659730 - DNA, 18 bp, Homo sapiens
catactcaagctgtctct

SEQ ID NO: 4659731 - DNA, 12 bp, Homo sapiens
catactctgttg

SEQ ID NO: 4659732 - DNA, 16 bp, Homo sapiens
catactctgttgcctc

SEQ ID NO: 4659733 - DNA, 17 bp, Homo sapiens
catactctgttgcctcc

SEQ ID NO: 4659734 - DNA, 15 bp, Homo sapiens
catactgaaaatcca

SEQ ID NO: 4659735 - DNA, 16 bp, Homo sapiens
catactgaaaatccaa

SEQ ID NO: 4659736 - DNA, 17 bp, Homo sapiens
catactgaaaatccaat

SEQ ID NO: 4659737 - DNA, 16 bp, Homo sapiens
catactgtagacactc

SEQ ID NO: 4659738 - DNA, 14 bp, Homo sapiens
catacttgtgaaac

SEQ ID NO: 4659739 - DNA, 17 bp, Homo sapiens
catacttgtgaaacgtc

SEQ ID NO: 4659740 - DNA, 12 bp, Homo sapiens
catactttattg

SEQ ID NO: 4659741 - DNA, 14 bp, Homo sapiens
catactttcctgta

SEQ ID NO: 4659742 - DNA, 22 bp, Homo sapiens
catactttgtaaataggatttt

SEQ ID NO: 4659743 - DNA, 23 bp, Homo sapiens
catagaaatggaaattttgctat

SEQ ID NO: 4659744 - DNA, 19 bp, Homo sapiens
caggtagacctgtctcctg

SEQ ID NO: 4659745 - DNA, 14 bp, Homo sapiens
caggtatcctgggg

SEQ ID NO: 4659746 - DNA, 16 bp, Homo sapiens
caggtatcctggggga

SEQ ID NO: 4659747 - DNA, 19 bp, Homo sapiens
caggtatcctgggggaaga

SEQ ID NO: 4659748 - DNA, 16 bp, Homo sapiens
caggtatggctctgca

SEQ ID NO: 4659749 - DNA, 19 bp, Homo sapiens
caggtattacacaagccaa

SEQ ID NO: 4659750 - DNA, 18 bp, Homo sapiens
caggtattattatcttta

SEQ ID NO: 4659751 - DNA, 17 bp, Homo sapiens
caggtcaccattatgct

SEQ ID NO: 4659752 - DNA, 13 bp, Homo sapiens
caggtcagcccat

SEQ ID NO: 4659753 - DNA, 14 bp, Homo sapiens
caggtcagcccatg

SEQ ID NO: 4659754 - DNA, 15 bp, Homo sapiens
caggtcagcccatgg

SEQ ID NO: 4659755 - DNA, 22 bp, Homo sapiens
caggtcagcccatggaggcaga

SEQ ID NO: 4659756 - DNA, 20 bp, Homo sapiens
caggtcctggtggggcagct

SEQ ID NO: 4659757 - DNA, 21 bp, Homo sapiens
caggtcctggtggggcagctc

SEQ ID NO: 4659758 - DNA, 23 bp, Homo sapiens
caggtcctggtggggcagctcct

SEQ ID NO: 4659759 - DNA, 20 bp, Homo sapiens
caggtgctgacttcatctcc

SEQ ID NO: 4659760 - DNA, 16 bp, Homo sapiens
caggtggaaggcagac

SEQ ID NO: 4659761 - DNA, 22 bp, Homo sapiens
caggttaccagaaccagtacct

SEQ ID NO: 4659762 - DNA, 14 bp, Homo sapiens
caggttccccaagg

SEQ ID NO: 4659763 - DNA, 20 bp, Homo sapiens
caggttcttcttcctgaagc

SEQ ID NO: 4659764 - DNA, 14 bp, Homo sapiens
caggttgatcttga

SEQ ID NO: 4659765 - DNA, 15 bp, Homo sapiens
cagtaatgaaatgtt

SEQ ID NO: 4659766 - DNA, 15 bp, Homo sapiens
cagtacttttttaaa

SEQ ID NO: 4659767 - DNA, 23 bp, Homo sapiens
cagtacttttttaaatattttct

SEQ ID NO: 4659768 - DNA, 12 bp, Homo sapiens
cagtagaactgt

SEQ ID NO: 4659769 - DNA, 18 bp, Homo sapiens
cagtagccagtatctatt

SEQ ID NO: 4659770 - DNA, 16 bp, Homo sapiens
cagtatcatgccctgt

SEQ ID NO: 4659771 - DNA, 20 bp, Homo sapiens
cagtatcatgccctgtgcaa

SEQ ID NO: 4659772 - DNA, 22 bp, Homo sapiens
cagtatttttgttgtgttctgt

SEQ ID NO: 4659773 - DNA, 18 bp, Homo sapiens
cagtcaagtgaggtgaca

SEQ ID NO: 4659774 - DNA, 16 bp, Homo sapiens
cagtcacagccacccc

SEQ ID NO: 4659775 - DNA, 22 bp, Homo sapiens
cagtcagggtttgtcagaggaa

SEQ ID NO: 4659776 - DNA, 14 bp, Homo sapiens
cagtcatcatcagg

SEQ ID NO: 4659777 - DNA, 18 bp, Homo sapiens
cagtcatcatcagggcct

SEQ ID NO: 4659778 - DNA, 22 bp, Homo sapiens
cagtcatcatcagggcctgggg

SEQ ID NO: 4659779 - DNA, 22 bp, Homo sapiens
cagtccctcttctggtttccct

SEQ ID NO: 4659780 - DNA, 19 bp, Homo sapiens
cagtccgtgtggatccaat

SEQ ID NO: 4659781 - DNA, 17 bp, Homo sapiens
cagtcctccctagctct

SEQ ID NO: 4659782 - DNA, 16 bp, Homo sapiens
cagtcctgggcaaagg

SEQ ID NO: 4659783 - DNA, 19 bp, Homo sapiens
caggcaaggaggaggagtc

SEQ ID NO: 4659784 - DNA, 18 bp, Homo sapiens
caggcacccgtccccaca

SEQ ID NO: 4659785 - DNA, 12 bp, Homo sapiens
caggcactccaa

SEQ ID NO: 4659786 - DNA, 16 bp, Homo sapiens
caggcagccagccgtg

SEQ ID NO: 4659787 - DNA, 13 bp, Homo sapiens
caggcagcctgga

SEQ ID NO: 4659788 - DNA, 13 bp, Homo sapiens
caggcagcgccaa

SEQ ID NO: 4659789 - DNA, 19 bp, Homo sapiens
caggcagcgccaagtgcgt

SEQ ID NO: 4659790 - DNA, 17 bp, Homo sapiens
caggcagggctctcctg

SEQ ID NO: 4659791 - DNA, 23 bp, Homo sapiens
caggcataagctatcacctagca

SEQ ID NO: 4659792 - DNA, 20 bp, Homo sapiens
caggcattgaggaagagtct

SEQ ID NO: 4659793 - DNA, 19 bp, Homo sapiens
caggcatttcctgggtggc

SEQ ID NO: 4659794 - DNA, 19 bp, Homo sapiens
caggccaaacatggccaga

SEQ ID NO: 4659795 - DNA, 15 bp, Homo sapiens
caggccccacccctg

SEQ ID NO: 4659796 - DNA, 18 bp, Homo sapiens
caggccccaccccttccc

SEQ ID NO: 4659797 - DNA, 14 bp, Homo sapiens
caggccccatgacc

SEQ ID NO: 4659798 - DNA, 17 bp, Homo sapiens
caggccccatgacctcc

SEQ ID NO: 4659799 - DNA, 21 bp, Homo sapiens
caggccccgtgaggcaatggg

SEQ ID NO: 4659800 - DNA, 19 bp, Homo sapiens
caggcctagtaaccaaggc

SEQ ID NO: 4659801 - DNA, 20 bp, Homo sapiens
caggcctagtaaccaaggcc

SEQ ID NO: 4659802 - DNA, 23 bp, Homo sapiens
caggcctcacccctcccctggga

SEQ ID NO: 4659803 - DNA, 16 bp, Homo sapiens
caggcctctgccccaa

SEQ ID NO: 4659804 - DNA, 15 bp, Homo sapiens
caggcctgcagcccc

SEQ ID NO: 4659805 - DNA, 20 bp, Homo sapiens
caggcctgcagcccctaagt

SEQ ID NO: 4659806 - DNA, 20 bp, Homo sapiens
caggcctgtgtagctgtgac

SEQ ID NO: 4659807 - DNA, 23 bp, Homo sapiens
caggcctgtgtagctgtgacctg

SEQ ID NO: 4659808 - DNA, 13 bp, Homo sapiens
caggcctgttgct

SEQ ID NO: 4659809 - DNA, 14 bp, Homo sapiens
caggctactagaat

SEQ ID NO: 4659810 - DNA, 23 bp, Homo sapiens
caggctagacagaaacatgtctt

SEQ ID NO: 4659811 - DNA, 16 bp, Homo sapiens
caggctagccctgccc

SEQ ID NO: 4659812 - DNA, 21 bp, Homo sapiens
caggctctgcacagacaagca

SEQ ID NO: 4659813 - DNA, 12 bp, Homo sapiens
caggctgaagag

SEQ ID NO: 4659814 - DNA, 17 bp, Homo sapiens
caggctgaagagaggga

SEQ ID NO: 4659815 - DNA, 16 bp, Homo sapiens
caggctggctccagat

SEQ ID NO: 4659816 - DNA, 18 bp, Homo sapiens
caggctggctccagatgc

SEQ ID NO: 4659817 - DNA, 22 bp, Homo sapiens
caggctgggctctgcctgtctg

SEQ ID NO: 4659818 - DNA, 16 bp, Homo sapiens
caggctggtttcaaac

SEQ ID NO: 4659819 - DNA, 15 bp, Homo sapiens
caggcttgctgtatg

SEQ ID NO: 4659820 - DNA, 20 bp, Homo sapiens
caggcttgctgtatgacccc

SEQ ID NO: 4659821 - DNA, 22 bp, Homo sapiens
caggcttgctgtatgacccctg

SEQ ID NO: 4659822 - DNA, 15 bp, Homo sapiens
cagggaaggcaggca

SEQ ID NO: 4659823 - DNA, 20 bp, Homo sapiens
cagggaaggcaggcagggct

SEQ ID NO: 4659824 - DNA, 15 bp, Homo sapiens
cagggaccggcagag

SEQ ID NO: 4659825 - DNA, 18 bp, Homo sapiens
cagggagctgcaggggca

SEQ ID NO: 4659826 - DNA, 16 bp, Homo sapiens
cagcccattgctgcca

SEQ ID NO: 4659827 - DNA, 17 bp, Homo sapiens
cagccccacccttgtcc

SEQ ID NO: 4659828 - DNA, 13 bp, Homo sapiens
cagcccccaccag

SEQ ID NO: 4659829 - DNA, 17 bp, Homo sapiens
cagcccccaccagggga

SEQ ID NO: 4659830 - DNA, 14 bp, Homo sapiens
cagcccctgtccca

SEQ ID NO: 4659831 - DNA, 19 bp, Homo sapiens
cagccccttcccctgggaa

SEQ ID NO: 4659832 - DNA, 15 bp, Homo sapiens
cagcccgacagtgcc

SEQ ID NO: 4659833 - DNA, 18 bp, Homo sapiens
cagcccgacagtgccatc

SEQ ID NO: 4659834 - DNA, 15 bp, Homo sapiens
cagccctctcactgt

SEQ ID NO: 4659835 - DNA, 13 bp, Homo sapiens
cagccctgccctt

SEQ ID NO: 4659836 - DNA, 13 bp, Homo sapiens
cagccctgcctgg

SEQ ID NO: 4659837 - DNA, 17 bp, Homo sapiens
cagccctgcctggagga

SEQ ID NO: 4659838 - DNA, 19 bp, Homo sapiens
cagccctgcctggaggacc

SEQ ID NO: 4659839 - DNA, 21 bp, Homo sapiens
cagccctgcctggaggacctg

SEQ ID NO: 4659840 - DNA, 23 bp, Homo sapiens
cagccctggcccccatcagccct

SEQ ID NO: 4659841 - DNA, 20 bp, Homo sapiens
cagccggggcgagtggcacg

SEQ ID NO: 4659842 - DNA, 12 bp, Homo sapiens
cagcctcacccc

SEQ ID NO: 4659843 - DNA, 21 bp, Homo sapiens
cagcctcacccctgcccctgt

SEQ ID NO: 4659844 - DNA, 20 bp, Homo sapiens
cagcctcacttcctttgccc

SEQ ID NO: 4659845 - DNA, 14 bp, Homo sapiens
cagcctcccatcca

SEQ ID NO: 4659846 - DNA, 18 bp, Homo sapiens
cagcctcccatccagggc

SEQ ID NO: 4659847 - DNA, 14 bp, Homo sapiens
cagcctctggtcct

SEQ ID NO: 4659848 - DNA, 20 bp, Homo sapiens
cagcctgaggtgcccactcc

SEQ ID NO: 4659849 - DNA, 21 bp, Homo sapiens
cagcctgctctagtgggacag

SEQ ID NO: 4659850 - DNA, 14 bp, Homo sapiens
cagcctgctgacag

SEQ ID NO: 4659851 - DNA, 12 bp, Homo sapiens
cagcctggcctc

SEQ ID NO: 4659852 - DNA, 14 bp, Homo sapiens
cagcctggcctcct

SEQ ID NO: 4659853 - DNA, 16 bp, Homo sapiens
cagcctggcctcctgc

SEQ ID NO: 4659854 - DNA, 20 bp, Homo sapiens
cagcctggcctcctgcctct

SEQ ID NO: 4659855 - DNA, 11 bp, Homo sapiens
cagcctgggcc

SEQ ID NO: 4659856 - DNA, 12 bp, Homo sapiens
cagcctgggcct

SEQ ID NO: 4659857 - DNA, 16 bp, Homo sapiens
cagcctgggcctatgg

SEQ ID NO: 4659858 - DNA, 20 bp, Homo sapiens
cagcctgggcctatggagag

SEQ ID NO: 4659859 - DNA, 17 bp, Homo sapiens
cagcctggggctggcct

SEQ ID NO: 4659860 - DNA, 21 bp, Homo sapiens
cagcctggggctggcctccca

SEQ ID NO: 4659861 - DNA, 14 bp, Homo sapiens
cagcctgtgtcttt

SEQ ID NO: 4659862 - DNA, 23 bp, Homo sapiens
cagcctgtgtctttaaatgctgc

SEQ ID NO: 4659863 - DNA, 14 bp, Homo sapiens
cagccttccctctg

SEQ ID NO: 4659864 - DNA, 18 bp, Homo sapiens
cagccttccctctgcatt

SEQ ID NO: 4659865 - DNA, 12 bp, Homo sapiens
cagccttgacct

SEQ ID NO: 4659866 - DNA, 13 bp, Homo sapiens
cagccttgaccta

SEQ ID NO: 4659867 - DNA, 23 bp, Homo sapiens
cagccttgctacttgaaggtaca

SEQ ID NO: 4659868 - DNA, 23 bp, Homo sapiens
cagccttttttcctgggccagaa

SEQ ID NO: 4659869 - DNA, 19 bp, Homo sapiens
cagcgaagtagcttgctcc

SEQ ID NO: 4659870 - DNA, 22 bp, Homo sapiens
cagcgaagtagcttgctccctg

SEQ ID NO: 4659871 - DNA, 22 bp, Homo sapiens
cagcgatgtatgcagctatctg

SEQ ID NO: 4659872 - DNA, 20 bp, Homo sapiens
cagcgattccctctcccagg

SEQ ID NO: 4659873 - DNA, 21 bp, Homo sapiens
cagcgattccctctcccaggc

SEQ ID NO: 4659874 - DNA, 22 bp, Homo sapiens
cagcgattccctctcccaggcc

SEQ ID NO: 4659875 - DNA, 23 bp, Homo sapiens
cagcgccaagtgcgtgccgtgtg

SEQ ID NO: 4659876 - DNA, 12 bp, Homo sapiens
cagcgccaggct

SEQ ID NO: 4659877 - DNA, 12 bp, Homo sapiens
cagcgcccttcc

SEQ ID NO: 4659878 - DNA, 18 bp, Homo sapiens
cagcgcccttcctctcca

SEQ ID NO: 4659879 - DNA, 21 bp, Homo sapiens
cagcggcttgcctgcctgctc

SEQ ID NO: 4659880 - DNA, 23 bp, Homo sapiens
cagcgggcggaggggatccagcc

SEQ ID NO: 4659881 - DNA, 15 bp, Homo sapiens
cagcgtaaaatggtg

SEQ ID NO: 4659882 - DNA, 17 bp, Homo sapiens
cagcgtaaaatggtgaa

SEQ ID NO: 4659883 - DNA, 22 bp, Homo sapiens
cagctaaccacttcgcacacac

SEQ ID NO: 4659884 - DNA, 19 bp, Homo sapiens
cagctaaggacatttccca

SEQ ID NO: 4659885 - DNA, 21 bp, Homo sapiens
cagctagacaatgatttggcc

SEQ ID NO: 4659886 - DNA, 15 bp, Homo sapiens
cagctagtgacccac

SEQ ID NO: 4659887 - DNA, 13 bp, Homo sapiens
cagctccaccctg

SEQ ID NO: 4659888 - DNA, 16 bp, Homo sapiens
tttaacatgatttcaa

SEQ ID NO: 4659889 - DNA, 15 bp, Homo sapiens
tttaacggactgctt

SEQ ID NO: 4659890 - DNA, 13 bp, Homo sapiens
tttaactctgtct

SEQ ID NO: 4659891 - DNA, 14 bp, Homo sapiens
tttaactctgtctt

SEQ ID NO: 4659892 - DNA, 18 bp, Homo sapiens
tttaagaaaaaaagctgc

SEQ ID NO: 4659893 - DNA, 17 bp, Homo sapiens
tttaagaaaggaagcaa

SEQ ID NO: 4659894 - DNA, 18 bp, Homo sapiens
tttaagcataatctgaaa

SEQ ID NO: 4659895 - DNA, 14 bp, Homo sapiens
tttaagctctgccc

SEQ ID NO: 4659896 - DNA, 15 bp, Homo sapiens
tttaagctctgcccc

SEQ ID NO: 4659897 - DNA, 22 bp, Homo sapiens
tttaagggagtgtactcccagg

SEQ ID NO: 4659898 - DNA, 15 bp, Homo sapiens
tttaagttcctgctg

SEQ ID NO: 4659899 - DNA, 19 bp, Homo sapiens
tttaagttcctgctgcctg

SEQ ID NO: 4659900 - DNA, 12 bp, Homo sapiens
tttaagtttgtt

SEQ ID NO: 4659901 - DNA, 12 bp, Homo sapiens
tttaataaagct

SEQ ID NO: 4659902 - DNA, 13 bp, Homo sapiens
tttaataaagctt

SEQ ID NO: 4659903 - DNA, 16 bp, Homo sapiens
tttaataaagctttat

SEQ ID NO: 4659904 - DNA, 15 bp, Homo sapiens
tttaatacaggaaat

SEQ ID NO: 4659905 - DNA, 17 bp, Homo sapiens
tttaatacaggaaattg

SEQ ID NO: 4659906 - DNA, 13 bp, Homo sapiens
tttaatatatata

SEQ ID NO: 4659907 - DNA, 16 bp, Homo sapiens
tttaatcagttctgtg

SEQ ID NO: 4659908 - DNA, 19 bp, Homo sapiens
tttaatctctctctctttt

SEQ ID NO: 4659909 - DNA, 21 bp, Homo sapiens
tttaatgtaatagggaaaatt

SEQ ID NO: 4659910 - DNA, 15 bp, Homo sapiens
tttaatgtatcttaa

SEQ ID NO: 4659911 - DNA, 19 bp, Homo sapiens
tttaatgtatcttaaagga

SEQ ID NO: 4659912 - DNA, 21 bp, Homo sapiens
tttaatgtatcttaaaggaca

SEQ ID NO: 4659913 - DNA, 18 bp, Homo sapiens
tttaattatttaagattt

SEQ ID NO: 4659914 - DNA, 13 bp, Homo sapiens
tttaattttaatg

SEQ ID NO: 4659915 - DNA, 16 bp, Homo sapiens
tttacagcccttggct

SEQ ID NO: 4659916 - DNA, 14 bp, Homo sapiens
tttacatagttgag

SEQ ID NO: 4659917 - DNA, 16 bp, Homo sapiens
tttacatagttgagat

SEQ ID NO: 4659918 - DNA, 22 bp, Homo sapiens
tttaccaattcacccactccct

SEQ ID NO: 4659919 - DNA, 15 bp, Homo sapiens
tttacctatgtaaca

SEQ ID NO: 4659920 - DNA, 18 bp, Homo sapiens
tttacgtctgggagaaat

SEQ ID NO: 4659921 - DNA, 14 bp, Homo sapiens
tttactaactaaat

SEQ ID NO: 4659922 - DNA, 14 bp, Homo sapiens
tttactctttgcaa

SEQ ID NO: 4659923 - DNA, 13 bp, Homo sapiens
tttagaattaaaa

SEQ ID NO: 4659924 - DNA, 17 bp, Homo sapiens
tttagagaatgtgtttc

SEQ ID NO: 4659925 - DNA, 21 bp, Homo sapiens
tttagagaatgtgtttcaaaa

SEQ ID NO: 4659926 - DNA, 22 bp, Homo sapiens
tttagcaatagctagctatata

SEQ ID NO: 4659927 - DNA, 16 bp, Homo sapiens
tttagcataaaatttt

SEQ ID NO: 4659928 - DNA, 14 bp, Homo sapiens
tttagcccagtgtt

SEQ ID NO: 4659929 - DNA, 22 bp, Homo sapiens
tttagcccagtgttttctttga

SEQ ID NO: 4659930 - DNA, 13 bp, Homo sapiens
tttagtaatttct

SEQ ID NO: 4659931 - DNA, 16 bp, Homo sapiens
tttagtgtaataagac

SEQ ID NO: 4659932 - DNA, 18 bp, Homo sapiens
tttagttttacattttaa

SEQ ID NO: 4659933 - DNA, 16 bp, Homo sapiens
tttataaaatggctgt

SEQ ID NO: 4659934 - DNA, 18 bp, Homo sapiens
tttataagaattttgctt

SEQ ID NO: 4659935 - DNA, 18 bp, Homo sapiens
tttataattggtgctatt

SEQ ID NO: 4659936 - DNA, 23 bp, Homo sapiens
tttataattggtgctatttgaag

SEQ ID NO: 4659937 - DNA, 17 bp, Homo sapiens
tttatactggcatgcta

SEQ ID NO: 4659938 - DNA, 22 bp, Homo sapiens
tttatagaatttaatatatata

SEQ ID NO: 4659939 - DNA, 18 bp, Homo sapiens
tttatagcaagatattga

SEQ ID NO: 4659940 - DNA, 15 bp, Homo sapiens
tttatatcatgcaaa

SEQ ID NO: 4659941 - DNA, 17 bp, Homo sapiens
tttatatgtcttgcaaa

SEQ ID NO: 4659942 - DNA, 14 bp, Homo sapiens
tttatattatccat

SEQ ID NO: 4659943 - DNA, 15 bp, Homo sapiens
tttatatttattgtt

SEQ ID NO: 4659944 - DNA, 15 bp, Homo sapiens
tttatcattaaaaat

SEQ ID NO: 4659945 - DNA, 17 bp, Homo sapiens
tttatccttacaatgtg

SEQ ID NO: 4659946 - DNA, 16 bp, Homo sapiens
tttatctgtagtaaac

SEQ ID NO: 4659947 - DNA, 18 bp, Homo sapiens
tttatgaagaaagatact

SEQ ID NO: 4659948 - DNA, 17 bp, Homo sapiens
tttatgaatatcattga

SEQ ID NO: 4659949 - DNA, 14 bp, Homo sapiens
tttatgcaaataca

SEQ ID NO: 4659950 - DNA, 20 bp, Homo sapiens
tttatgcatttgcatttgct

SEQ ID NO: 4659951 - DNA, 18 bp, Homo sapiens
tttatgtttaaaagaaat

SEQ ID NO: 4659952 - DNA, 22 bp, Homo sapiens
tttattaaaaatgttctcaaat

SEQ ID NO: 4659953 - DNA, 18 bp, Homo sapiens
tttattactgtttctaaa

SEQ ID NO: 4659954 - DNA, 16 bp, Homo sapiens
tttattatgcattata

SEQ ID NO: 4659955 - DNA, 12 bp, Homo sapiens
tttattattcag

SEQ ID NO: 4659956 - DNA, 20 bp, Homo sapiens
tttattctcaggtaatcatt

SEQ ID NO: 4659957 - DNA, 19 bp, Homo sapiens
tttattgattaaaaatgtg

SEQ ID NO: 4659958 - DNA, 16 bp, Homo sapiens
tttattgcagaatgtg

SEQ ID NO: 4659959 - DNA, 14 bp, Homo sapiens
tttattgttagaaa

SEQ ID NO: 4659960 - DNA, 20 bp, Homo sapiens
tttatttccactaaaaatat

SEQ ID NO: 4659961 - DNA, 17 bp, Homo sapiens
tttatttggtgtgttcg

SEQ ID NO: 4659962 - DNA, 10 bp, Homo sapiens
tttattttct

SEQ ID NO: 4659963 - DNA, 12 bp, Homo sapiens
tttcaaaagcat

SEQ ID NO: 4659964 - DNA, 13 bp, Homo sapiens
tttcaaaatacat

SEQ ID NO: 4659965 - DNA, 19 bp, Homo sapiens
tttcaaaatcagtttttca

SEQ ID NO: 4659966 - DNA, 21 bp, Homo sapiens
tttcaaaatcagtttttcata

SEQ ID NO: 4659967 - DNA, 23 bp, Homo sapiens
tttcaaagtgtctcattctcaga

SEQ ID NO: 4659968 - DNA, 18 bp, Homo sapiens
tttcaaatgagtttaatg

SEQ ID NO: 4659969 - DNA, 15 bp, Homo sapiens
tttcaaatggactgt

SEQ ID NO: 4659970 - DNA, 22 bp, Homo sapiens
tttcaacaaatttcattgcact

SEQ ID NO: 4659971 - DNA, 19 bp, Homo sapiens
tttcaaccataaaagaagt

SEQ ID NO: 4659972 - DNA, 22 bp, Homo sapiens
tttcaagctcatgtcattatga

SEQ ID NO: 4659973 - DNA, 12 bp, Homo sapiens
tttcaaggcctt

SEQ ID NO: 4659974 - DNA, 21 bp, Homo sapiens
tttcaaggccttcagtttatt

SEQ ID NO: 4659975 - DNA, 23 bp, Homo sapiens
tttcaattaatattaattttcta

SEQ ID NO: 4659976 - DNA, 20 bp, Homo sapiens
tttcacaaatccttcaaaat

SEQ ID NO: 4659977 - DNA, 20 bp, Homo sapiens
tttgcttcctagtaagtcag

SEQ ID NO: 4659978 - DNA, 19 bp, Homo sapiens
tttgctttcggtactgtaa

SEQ ID NO: 4659979 - DNA, 20 bp, Homo sapiens
tttgctttttgcgtacacag

SEQ ID NO: 4659980 - DNA, 15 bp, Homo sapiens
tttggaaaaaccttg

SEQ ID NO: 4659981 - DNA, 15 bp, Homo sapiens
tttggaaaatgcatt

SEQ ID NO: 4659982 - DNA, 14 bp, Homo sapiens
tttggaatatttga

SEQ ID NO: 4659983 - DNA, 18 bp, Homo sapiens
tttggaatatttgaataa

SEQ ID NO: 4659984 - DNA, 15 bp, Homo sapiens
tttggatcttgaatg

SEQ ID NO: 4659985 - DNA, 13 bp, Homo sapiens
tttggcagagttc

SEQ ID NO: 4659986 - DNA, 12 bp, Homo sapiens
tttgggcagagc

SEQ ID NO: 4659987 - DNA, 23 bp, Homo sapiens
tttggtatttgtttgtagctttc

SEQ ID NO: 4659988 - DNA, 23 bp, Homo sapiens
tttggtcatttggcagcccctgt

SEQ ID NO: 4659989 - DNA, 16 bp, Homo sapiens
tttggtcttagcttta

SEQ ID NO: 4659990 - DNA, 19 bp, Homo sapiens
tttggtcttagctttacat

SEQ ID NO: 4659991 - DNA, 13 bp, Homo sapiens
tttggtgtgttcg

SEQ ID NO: 4659992 - DNA, 22 bp, Homo sapiens
tttgtaaaaacagcattgcttt

SEQ ID NO: 4659993 - DNA, 15 bp, Homo sapiens
tttgtaactaataga

SEQ ID NO: 4659994 - DNA, 20 bp, Homo sapiens
tttgtaagtgtaaaaaatgt

SEQ ID NO: 4659995 - DNA, 19 bp, Homo sapiens
tttgtagctttcctggaag

SEQ ID NO: 4659996 - DNA, 18 bp, Homo sapiens
tttgtaggaagcattttt

SEQ ID NO: 4659997 - DNA, 23 bp, Homo sapiens
tttgtagtgagcgagtggatgct

SEQ ID NO: 4659998 - DNA, 21 bp, Homo sapiens
tttgtataggagccccaggca

SEQ ID NO: 4659999 - DNA, 17 bp, Homo sapiens
tttgtatcttaaatttg

SEQ ID NO: 4660000 - DNA, 13 bp, Homo sapiens
tttgtatttggaa

SEQ ID NO: 4660001 - DNA, 16 bp, Homo sapiens
tttgtcacattattta

SEQ ID NO: 4660002 - DNA, 17 bp, Homo sapiens
tttgtcacattatttat

SEQ ID NO: 4660003 - DNA, 20 bp, Homo sapiens
ttggttttaaaaaagcatta

SEQ ID NO: 4660004 - DNA, 19 bp, Homo sapiens
ttggttttaaaagcacaat

SEQ ID NO: 4660005 - DNA, 20 bp, Homo sapiens
ttgtaaaaacagcattgctt

SEQ ID NO: 4660006 - DNA, 21 bp, Homo sapiens
ttgtaaaaacagcattgcttt

SEQ ID NO: 4660007 - DNA, 18 bp, Homo sapiens
ttgtaaaatattatgttt

SEQ ID NO: 4660008 - DNA, 13 bp, Homo sapiens
ttgtaaacttctg

SEQ ID NO: 4660009 - DNA, 14 bp, Homo sapiens
ttgtaaacttctga

SEQ ID NO: 4660010 - DNA, 15 bp, Homo sapiens
ttgtaaacttctgaa

SEQ ID NO: 4660011 - DNA, 12 bp, Homo sapiens
ttgtaaagactg

SEQ ID NO: 4660012 - DNA, 13 bp, Homo sapiens
ttgtaaagactgg

SEQ ID NO: 4660013 - DNA, 16 bp, Homo sapiens
ttgtaaagtccccaga

SEQ ID NO: 4660014 - DNA, 22 bp, Homo sapiens
ttgtaaagtccccagagaaagc

SEQ ID NO: 4660015 - DNA, 18 bp, Homo sapiens
ttgtaaataggattttta

SEQ ID NO: 4660016 - DNA, 19 bp, Homo sapiens
ttgtaaatttcagggtttt

SEQ ID NO: 4660017 - DNA, 16 bp, Homo sapiens
ttgtaactaatagatt

SEQ ID NO: 4660018 - DNA, 13 bp, Homo sapiens
ttgtaacttgttg

SEQ ID NO: 4660019 - DNA, 23 bp, Homo sapiens
ttgtaaggggaagagggaaatgt

SEQ ID NO: 4660020 - DNA, 18 bp, Homo sapiens
ttgtaagtgtaaaaaatg

SEQ ID NO: 4660021 - DNA, 19 bp, Homo sapiens
ttgtaagtgtaaaaaatgt

SEQ ID NO: 4660022 - DNA, 13 bp, Homo sapiens
ttgtaatatctaa

SEQ ID NO: 4660023 - DNA, 12 bp, Homo sapiens
ttgtaattgctt

SEQ ID NO: 4660024 - DNA, 22 bp, Homo sapiens
ttgtaattgcttttttaaatat

SEQ ID NO: 4660025 - DNA, 13 bp, Homo sapiens
ttgtacagttttt

SEQ ID NO: 4660026 - DNA, 20 bp, Homo sapiens
ttgtacatgtgtagcctgtg

SEQ ID NO: 4660027 - DNA, 21 bp, Homo sapiens
ttgtacatgtgtagcctgtgc

SEQ ID NO: 4660028 - DNA, 13 bp, Homo sapiens
ttgtactgttcat

SEQ ID NO: 4660029 - DNA, 21 bp, Homo sapiens
ttgtactgttcatacagtttt

SEQ ID NO: 4660030 - DNA, 22 bp, Homo sapiens
ttgtacttttagtagagacagt

SEQ ID NO: 4660031 - DNA, 19 bp, Homo sapiens
ttgtagaaaaatccctcca

SEQ ID NO: 4660032 - DNA, 17 bp, Homo sapiens
ttgtagaactcactctg

SEQ ID NO: 4660033 - DNA, 20 bp, Homo sapiens
ttgtagaactcactctgggc

SEQ ID NO: 4660034 - DNA, 22 bp, Homo sapiens
ttgtagaactcactctgggctg

SEQ ID NO: 4660035 - DNA, 13 bp, Homo sapiens
ttgtagaacttta

SEQ ID NO: 4660036 - DNA, 15 bp, Homo sapiens
ttgtagatttagtgt

SEQ ID NO: 4660037 - DNA, 17 bp, Homo sapiens
ttgtagcatcctcttta

SEQ ID NO: 4660038 - DNA, 12 bp, Homo sapiens
ttgtagccagcc

SEQ ID NO: 4660039 - DNA, 18 bp, Homo sapiens
ttgtagctttcctggaag

SEQ ID NO: 4660040 - DNA, 16 bp, Homo sapiens
ttgtatctacagtaat

SEQ ID NO: 4660041 - DNA, 20 bp, Homo sapiens
ttgtatctacagtaatgaaa

SEQ ID NO: 4660042 - DNA, 12 bp, Homo sapiens
ttgtattcagat

SEQ ID NO: 4660043 - DNA, 23 bp, Homo sapiens
ttgtatttggaatatttgaataa

SEQ ID NO: 4660044 - DNA, 23 bp, Homo sapiens
ttgtcaaggatggttttgggact

SEQ ID NO: 4660045 - DNA, 22 bp, Homo sapiens
ttgtcacctctgtgacccctcc

SEQ ID NO: 4660046 - DNA, 16 bp, Homo sapiens
ttgtcagacataaagc

SEQ ID NO: 4660047 - DNA, 18 bp, Homo sapiens
ttgtcagacataaagcca

SEQ ID NO: 4660048 - DNA, 15 bp, Homo sapiens
ttgtcagccttgcta

SEQ ID NO: 4660049 - DNA, 19 bp, Homo sapiens
ttgtcagggtctccttcct

SEQ ID NO: 4660050 - DNA, 15 bp, Homo sapiens
ttgtcagtgtagaca

SEQ ID NO: 4660051 - DNA, 23 bp, Homo sapiens
ttgtcatatcagcacatattttc

SEQ ID NO: 4660052 - DNA, 20 bp, Homo sapiens
ttgtccaaaggaaagcttaa

SEQ ID NO: 4660053 - DNA, 19 bp, Homo sapiens
ttgtccagctgagcgccag

SEQ ID NO: 4660054 - DNA, 20 bp, Homo sapiens
ttgtccaggttgatcttgaa

SEQ ID NO: 4660055 - DNA, 11 bp, Homo sapiens
ttgtccatctt

SEQ ID NO: 4660056 - DNA, 13 bp, Homo sapiens
ttgtccatcttgt

SEQ ID NO: 4660057 - DNA, 19 bp, Homo sapiens
ttgtcccactatctgggtg

SEQ ID NO: 4660058 - DNA, 23 bp, Homo sapiens
ttgtccccaaatccgaacctcct

SEQ ID NO: 4660059 - DNA, 11 bp, Homo sapiens
ttgtctcagaa

SEQ ID NO: 4660060 - DNA, 18 bp, Homo sapiens
ttgtcttatgtgaaaaat

SEQ ID NO: 4660061 - DNA, 20 bp, Homo sapiens
ttgtcttatgtgaaaaatta

SEQ ID NO: 4660062 - DNA, 22 bp, Homo sapiens
ttgtgaaggcctcgcaggaaga

SEQ ID NO: 4660063 - DNA, 17 bp, Homo sapiens
ttgtgaatctattgttt

SEQ ID NO: 4660064 - DNA, 16 bp, Homo sapiens
ttgtgataatagcatt

SEQ ID NO: 4660065 - DNA, 14 bp, Homo sapiens
ttgtgcattctgga

SEQ ID NO: 4660066 - DNA, 22 bp, Homo sapiens
ttgtgcctttgggcacggccct

SEQ ID NO: 4660067 - DNA, 18 bp, Homo sapiens
ttgtgctagaaattttca

SEQ ID NO: 4660068 - DNA, 19 bp, Homo sapiens
ttgtggagatcacagcccc

SEQ ID NO: 4660069 - DNA, 16 bp, Homo sapiens
ttgtggttgaaatctg

SEQ ID NO: 4660070 - DNA, 17 bp, Homo sapiens
ttgtgtatttctctgtg

SEQ ID NO: 4660071 - DNA, 18 bp, Homo sapiens
ttgtgtatttctctgtga

SEQ ID NO: 4660072 - DNA, 20 bp, Homo sapiens
ttgtgtatttctctgtgaat

SEQ ID NO: 4660073 - DNA, 20 bp, Homo sapiens
ttgtgtctatgatgttgctg

SEQ ID NO: 4660074 - DNA, 12 bp, Homo sapiens
ttgtgtctgtgg

SEQ ID NO: 4660075 - DNA, 14 bp, Homo sapiens
ttgtgtctgtggtt

SEQ ID NO: 4660076 - DNA, 13 bp, Homo sapiens
ttgtgtgtgttct

SEQ ID NO: 4660077 - DNA, 20 bp, Homo sapiens
ttgtgtgtgttctgtcccca

SEQ ID NO: 4660078 - DNA, 18 bp, Homo sapiens
ttgttaataataattatt

SEQ ID NO: 4660079 - DNA, 12 bp, Homo sapiens
ttgttagaaagt

SEQ ID NO: 4660080 - DNA, 17 bp, Homo sapiens
ttgttagaaagtgctta

SEQ ID NO: 4660081 - DNA, 16 bp, Homo sapiens
ttgttaggttacagat

SEQ ID NO: 4660082 - DNA, 13 bp, Homo sapiens
ttgttatgacagt

SEQ ID NO: 4660083 - DNA, 11 bp, Homo sapiens
ttgttcattta

SEQ ID NO: 4660084 - DNA, 12 bp, Homo sapiens
ttgttcatttag

SEQ ID NO: 4660085 - DNA, 13 bp, Homo sapiens
ttgttcattttga

SEQ ID NO: 4660086 - DNA, 13 bp, Homo sapiens
ttgttcccttcct

SEQ ID NO: 4660087 - DNA, 23 bp, Homo sapiens
ttgttcccttcctcttcctgccc

SEQ ID NO: 4660088 - DNA, 19 bp, Homo sapiens
ttgttctatttttcaatca

SEQ ID NO: 4660089 - DNA, 12 bp, Homo sapiens
ttgttgcattcc

SEQ ID NO: 4660090 - DNA, 23 bp, Homo sapiens
ttgtttctcaaatcttggcaata

SEQ ID NO: 4660091 - DNA, 21 bp, Homo sapiens
ttgtttgaaacaaagaaggtt

SEQ ID NO: 4660092 - DNA, 17 bp, Homo sapiens
ttgtttggggcaggagt

SEQ ID NO: 4660093 - DNA, 16 bp, Homo sapiens
ttgttttggtctcaaa

SEQ ID NO: 4660094 - DNA, 17 bp, Homo sapiens
ttgtttttgtaatgcac

SEQ ID NO: 4660095 - DNA, 21 bp, Homo sapiens
tttaaaaaaatctccccagta

SEQ ID NO: 4660096 - DNA, 17 bp, Homo sapiens
tttaaaaacttaaatat

SEQ ID NO: 4660097 - DNA, 17 bp, Homo sapiens
tttaaaaatacacttgt

SEQ ID NO: 4660098 - DNA, 13 bp, Homo sapiens
tttaaaagaatga

SEQ ID NO: 4660099 - DNA, 20 bp, Homo sapiens
tttaaaagcacaatcactaa

SEQ ID NO: 4660100 - DNA, 22 bp, Homo sapiens
tttaaaagcacaatcactaaac

SEQ ID NO: 4660101 - DNA, 21 bp, Homo sapiens
tttaaaagttttgaaggaaac

SEQ ID NO: 4660102 - DNA, 15 bp, Homo sapiens
tttaaaataaaatga

SEQ ID NO: 4660103 - DNA, 15 bp, Homo sapiens
tttaaactgattcat

SEQ ID NO: 4660104 - DNA, 18 bp, Homo sapiens
tttaaagaatatgacttt

SEQ ID NO: 4660105 - DNA, 13 bp, Homo sapiens
tttaaatatcatt

SEQ ID NO: 4660106 - DNA, 13 bp, Homo sapiens
tttaaatattttc

SEQ ID NO: 4660107 - DNA, 19 bp, Homo sapiens
tttaaatattttctatttt

SEQ ID NO: 4660108 - DNA, 19 bp, Homo sapiens
tttaaatcaagtattttgt

SEQ ID NO: 4660109 - DNA, 15 bp, Homo sapiens
tttaaatgcaacagt

SEQ ID NO: 4660110 - DNA, 14 bp, Homo sapiens
tttaaatgctgctt

SEQ ID NO: 4660111 - DNA, 14 bp, Homo sapiens
tttaaattgttcct

SEQ ID NO: 4660112 - DNA, 19 bp, Homo sapiens
tttaacaagtatttattcc

SEQ ID NO: 4660113 - DNA, 21 bp, Homo sapiens
tttaacatacaagaaaatgta

SEQ ID NO: 4660114 - DNA, 17 bp, Homo sapiens
ttttttaggacatctta

SEQ ID NO: 4660115 - DNA, 20 bp, Homo sapiens
ttttttcatgttttaacaaa

SEQ ID NO: 4660116 - DNA, 20 bp, Homo sapiens
ttttttgaaccaacatcttt

SEQ ID NO: 4660117 - DNA, 12 bp, Homo sapiens
ttttttgtaact

SEQ ID NO: 4660118 - DNA, 13 bp, Homo sapiens
tttttttcctttt

SEQ ID NO: 4660119 - DNA, 14 bp, Homo sapiens
aaaaaaagtattat

SEQ ID NO: 4660120 - DNA, 12 bp, Homo sapiens
aaaaaatatttt

SEQ ID NO: 4660121 - DNA, 13 bp, Homo sapiens
aaaaaatatttta

SEQ ID NO: 4660122 - DNA, 15 bp, Homo sapiens
aaaaacagcattgct

SEQ ID NO: 4660123 - DNA, 17 bp, Homo sapiens
aaaaacagcattgcttt

SEQ ID NO: 4660124 - DNA, 19 bp, Homo sapiens
aaaaacagcattgctttct

SEQ ID NO: 4660125 - DNA, 23 bp, Homo sapiens
aaaaacttaaatattgtaatatg

SEQ ID NO: 4660126 - DNA, 22 bp, Homo sapiens
aaaaagaaattcgcatgtttaa

SEQ ID NO: 4660127 - DNA, 17 bp, Homo sapiens
aaaaaggaaacttcctt

SEQ ID NO: 4660128 - DNA, 13 bp, Homo sapiens
aaaaagtattatt

SEQ ID NO: 4660129 - DNA, 18 bp, Homo sapiens
aaaaagtctaccaaagga

SEQ ID NO: 4660130 - DNA, 16 bp, Homo sapiens
aaaaatataatgttga

SEQ ID NO: 4660131 - DNA, 11 bp, Homo sapiens
aaaaatattgt

SEQ ID NO: 4660132 - DNA, 12 bp, Homo sapiens
aaaaatattgtt

SEQ ID NO: 4660133 - DNA, 15 bp, Homo sapiens
aaaaatgattttgct

SEQ ID NO: 4660134 - DNA, 22 bp, Homo sapiens
aaaaatgcaaatcctatgtgat

SEQ ID NO: 4660135 - DNA, 13 bp, Homo sapiens
aaaaatgtacatt

SEQ ID NO: 4660136 - DNA, 17 bp, Homo sapiens
aaaaatgtacatttatt

SEQ ID NO: 4660137 - DNA, 21 bp, Homo sapiens
aaaaatgtacatttattcata

SEQ ID NO: 4660138 - DNA, 20 bp, Homo sapiens
aaaaatgtatccagtctgaa

SEQ ID NO: 4660139 - DNA, 16 bp, Homo sapiens
aaaaatgttgagaagc

SEQ ID NO: 4660140 - DNA, 14 bp, Homo sapiens
aaaaattaactttt

SEQ ID NO: 4660141 - DNA, 17 bp, Homo sapiens
aaaacaaatatacattt

SEQ ID NO: 4660142 - DNA, 16 bp, Homo sapiens
aaaacaataaaatttt

SEQ ID NO: 4660143 - DNA, 13 bp, Homo sapiens
aaaacatatttca

SEQ ID NO: 4660144 - DNA, 16 bp, Homo sapiens
aaaacatatttcattt

SEQ ID NO: 4660145 - DNA, 21 bp, Homo sapiens
aaaacatatttcattttaaca

SEQ ID NO: 4660146 - DNA, 11 bp, Homo sapiens
aaaacatctgg

SEQ ID NO: 4660147 - DNA, 21 bp, Homo sapiens
aaaacattttttttttaaatc

SEQ ID NO: 4660148 - DNA, 21 bp, Homo sapiens
aaaaccaaacttgttcattta

SEQ ID NO: 4660149 - DNA, 20 bp, Homo sapiens
aaaaccatgcctggtatttt

SEQ ID NO: 4660150 - DNA, 16 bp, Homo sapiens
aaaacctacatattcc

SEQ ID NO: 4660151 - DNA, 16 bp, Homo sapiens
aaaaccttgttctatt

SEQ ID NO: 4660152 - DNA, 15 bp, Homo sapiens
aaaactcactgtgat

SEQ ID NO: 4660153 - DNA, 17 bp, Homo sapiens
aaaactcatgatcaaga

SEQ ID NO: 4660154 - DNA, 17 bp, Homo sapiens
aaaactcccaatacaaa

SEQ ID NO: 4660155 - DNA, 12 bp, Homo sapiens
aaaactgtgttg

SEQ ID NO: 4660156 - DNA, 17 bp, Homo sapiens
aaaactgtgttgccaca

SEQ ID NO: 4660157 - DNA, 15 bp, Homo sapiens
aaaactgttcttttg

SEQ ID NO: 4660158 - DNA, 16 bp, Homo sapiens
aaaactgttcttttgc

SEQ ID NO: 4660159 - DNA, 15 bp, Homo sapiens
aaaacttaaatattg

SEQ ID NO: 4660160 - DNA, 14 bp, Homo sapiens
aaactcatttatct

SEQ ID NO: 4660161 - DNA, 12 bp, Homo sapiens
aaactcctgacc

SEQ ID NO: 4660162 - DNA, 16 bp, Homo sapiens
aaactctagcagttgt

SEQ ID NO: 4660163 - DNA, 17 bp, Homo sapiens
aaactgaatataaagct

SEQ ID NO: 4660164 - DNA, 21 bp, Homo sapiens
aaactgaatataaagcttaat

SEQ ID NO: 4660165 - DNA, 15 bp, Homo sapiens
aaactgtatgctcac

SEQ ID NO: 4660166 - DNA, 16 bp, Homo sapiens
aaactgtgttgccaca

SEQ ID NO: 4660167 - DNA, 17 bp, Homo sapiens
aaactgtgttgccacag

SEQ ID NO: 4660168 - DNA, 15 bp, Homo sapiens
aaacttctgaagact

SEQ ID NO: 4660169 - DNA, 18 bp, Homo sapiens
aaacttctgtaaggggca

SEQ ID NO: 4660170 - DNA, 15 bp, Homo sapiens
aaacttcttgtcaga

SEQ ID NO: 4660171 - DNA, 17 bp, Homo sapiens
aaacttcttgtcagaca

SEQ ID NO: 4660172 - DNA, 14 bp, Homo sapiens
aaacttgttcattt

SEQ ID NO: 4660173 - DNA, 15 bp, Homo sapiens
aaacttgttcattta

SEQ ID NO: 4660174 - DNA, 19 bp, Homo sapiens
aaactttattgggttttta

SEQ ID NO: 4660175 - DNA, 20 bp, Homo sapiens
aaactttatttgtaaaccat

SEQ ID NO: 4660176 - DNA, 13 bp, Homo sapiens
aaagaaacaagct

SEQ ID NO: 4660177 - DNA, 16 bp, Homo sapiens
aaagaaacaagctgtg

SEQ ID NO: 4660178 - DNA, 20 bp, Homo sapiens
aaagaaacaagctgtgcagg

SEQ ID NO: 4660179 - DNA, 14 bp, Homo sapiens
aaagaaagggaccc

SEQ ID NO: 4660180 - DNA, 15 bp, Homo sapiens
aaagaaagggaccca

SEQ ID NO: 4660181 - DNA, 18 bp, Homo sapiens
aaagaaagggacccacct

SEQ ID NO: 4660182 - DNA, 18 bp, Homo sapiens
aaagaaatatattttttg

SEQ ID NO: 4660183 - DNA, 17 bp, Homo sapiens
aaagaaatgtcttaatt

SEQ ID NO: 4660184 - DNA, 20 bp, Homo sapiens
aaagaaattcgcatgtttaa

SEQ ID NO: 4660185 - DNA, 13 bp, Homo sapiens
aaagaagctttat

SEQ ID NO: 4660186 - DNA, 23 bp, Homo sapiens
aaagaaggaccctttttggacta

SEQ ID NO: 4660187 - DNA, 18 bp, Homo sapiens
aaagaagggggccctgct

SEQ ID NO: 4660188 - DNA, 19 bp, Homo sapiens
aaagaagggggccctgcta

SEQ ID NO: 4660189 - DNA, 13 bp, Homo sapiens
aaagaagtggaga

SEQ ID NO: 4660190 - DNA, 15 bp, Homo sapiens
aaagaatagaaggat

SEQ ID NO: 4660191 - DNA, 22 bp, Homo sapiens
aaagaatggctgactgttgcct

SEQ ID NO: 4660192 - DNA, 16 bp, Homo sapiens
aaagaattatttgcct

SEQ ID NO: 4660193 - DNA, 23 bp, Homo sapiens
aaagaattgatcagaatcccaaa

SEQ ID NO: 4660194 - DNA, 19 bp, Homo sapiens
aaagactgaccaatattgt

SEQ ID NO: 4660195 - DNA, 14 bp, Homo sapiens
aaagactgtgaaca

SEQ ID NO: 4660196 - DNA, 22 bp, Homo sapiens
aaagactgtgaacagcttgctg

SEQ ID NO: 4660197 - DNA, 15 bp, Homo sapiens
aaagacttgtgcatc

SEQ ID NO: 4660198 - DNA, 19 bp, Homo sapiens
aaagagagaagccagccac

SEQ ID NO: 4660199 - DNA, 19 bp, Homo sapiens
aaagagctgcctggatgag

SEQ ID NO: 4660200 - DNA, 19 bp, Homo sapiens
aaagaggctgaggctggca

SEQ ID NO: 4660201 - DNA, 15 bp, Homo sapiens
aaagatgatcgctgt

SEQ ID NO: 4660202 - DNA, 17 bp, Homo sapiens
aaagattaatctttaaa

SEQ ID NO: 4660203 - DNA, 14 bp, Homo sapiens
aaagcaattgtgaa

SEQ ID NO: 4660204 - DNA, 12 bp, Homo sapiens
aaagcagccacg

SEQ ID NO: 4660205 - DNA, 16 bp, Homo sapiens
aaagcatgatttttaa

SEQ ID NO: 4660206 - DNA, 22 bp, Homo sapiens
aaagcattaattttttttcatt

SEQ ID NO: 4660207 - DNA, 16 bp, Homo sapiens
aaagccaggagcagcc

SEQ ID NO: 4660208 - DNA, 18 bp, Homo sapiens
aaagccaggagcagccct

SEQ ID NO: 4660209 - DNA, 19 bp, Homo sapiens
aaagccaggagcagccctg

SEQ ID NO: 4660210 - DNA, 19 bp, Homo sapiens
aaagccagggtctctccct

SEQ ID NO: 4660211 - DNA, 18 bp, Homo sapiens
aaagcccaaagtggtata

SEQ ID NO: 4660212 - DNA, 15 bp, Homo sapiens
aaagcccagagacag

SEQ ID NO: 4660213 - DNA, 14 bp, Homo sapiens
aaagcctaaaattg

SEQ ID NO: 4660214 - DNA, 18 bp, Homo sapiens
aaagcctgttcatggcag

SEQ ID NO: 4660215 - DNA, 13 bp, Homo sapiens
aaagcctttaaat

SEQ ID NO: 4660216 - DNA, 21 bp, Homo sapiens
aaagccttttgctttatgctt

SEQ ID NO: 4660217 - DNA, 14 bp, Homo sapiens
aaagctagaaatga

SEQ ID NO: 4660218 - DNA, 12 bp, Homo sapiens
aaagctcttcct

SEQ ID NO: 4660219 - DNA, 16 bp, Homo sapiens
aaagcttaatgattct

SEQ ID NO: 4660220 - DNA, 13 bp, Homo sapiens
aaagcttgtaaat

SEQ ID NO: 4660221 - DNA, 17 bp, Homo sapiens
aaagcttgtaaatatgg

SEQ ID NO: 4660222 - DNA, 18 bp, Homo sapiens
aaaggaggaccagtcagg

SEQ ID NO: 4660223 - DNA, 15 bp, Homo sapiens
aaaggatctctgaga

SEQ ID NO: 4660224 - DNA, 21 bp, Homo sapiens
aaaggcctcttgtaaagactg

SEQ ID NO: 4660225 - DNA, 21 bp, Homo sapiens
aaaggccttcagacacatgct

SEQ ID NO: 4660226 - DNA, 14 bp, Homo sapiens
aaaggctaaacata

SEQ ID NO: 4660227 - DNA, 15 bp, Homo sapiens
aaaggcttctctctc

SEQ ID NO: 4660228 - DNA, 17 bp, Homo sapiens
aaaggcttctctctcac

SEQ ID NO: 4660229 - DNA, 15 bp, Homo sapiens
aaagggaagaaagga

SEQ ID NO: 4660230 - DNA, 10 bp, Homo sapiens
aaagggaccc

SEQ ID NO: 4660231 - DNA, 15 bp, Homo sapiens
aaagggaggaacact

SEQ ID NO: 4660232 - DNA, 12 bp, Homo sapiens
aaagggcactta

SEQ ID NO: 4660233 - DNA, 23 bp, Homo sapiens
aaagggcacttaatttgtaaact

SEQ ID NO: 4660234 - DNA, 20 bp, Homo sapiens
aaagggcagggcccacgtgt

SEQ ID NO: 4660235 - DNA, 11 bp, Homo sapiens
aaaggggagac

SEQ ID NO: 4660236 - DNA, 22 bp, Homo sapiens
aaaggggttggggtgacagtca

SEQ ID NO: 4660237 - DNA, 17 bp, Homo sapiens
aaagggtcttgggaaat

SEQ ID NO: 4660238 - DNA, 14 bp, Homo sapiens
aaagggtgaagcta

SEQ ID NO: 4660239 - DNA, 21 bp, Homo sapiens
aaagggtgaagctatttatct

SEQ ID NO: 4660240 - DNA, 14 bp, Homo sapiens
aaagtaacaatcta

SEQ ID NO: 4660241 - DNA, 21 bp, Homo sapiens
aaagtaatgaagaatcacgat

SEQ ID NO: 4660242 - DNA, 14 bp, Homo sapiens
aaagtaattttgtc

SEQ ID NO: 4660243 - DNA, 15 bp, Homo sapiens
aaagtacaaatgaag

SEQ ID NO: 4660244 - DNA, 21 bp, Homo sapiens
aaagtactctttaacatacaa

SEQ ID NO: 4660245 - DNA, 14 bp, Homo sapiens
aaagtataatcttt

SEQ ID NO: 4660246 - DNA, 13 bp, Homo sapiens
aaagtatgtgttt

SEQ ID NO: 4660247 - DNA, 17 bp, Homo sapiens
aaagtattatcattgct

SEQ ID NO: 4660248 - DNA, 15 bp, Homo sapiens
aaagtattattttcc

SEQ ID NO: 4660249 - DNA, 21 bp, Homo sapiens
aaagtcacccagggacactcc

SEQ ID NO: 4660250 - DNA, 16 bp, Homo sapiens
aaagtctgtctttcct

SEQ ID NO: 4660251 - DNA, 18 bp, Homo sapiens
aaagtgctttgacttctt

SEQ ID NO: 4660252 - DNA, 16 bp, Homo sapiens
aaagtggcctctttgt

SEQ ID NO: 4660253 - DNA, 18 bp, Homo sapiens
aaagttgtaaaatagaaa

SEQ ID NO: 4660254 - DNA, 14 bp, Homo sapiens
aaagttgttgcatt

SEQ ID NO: 4660255 - DNA, 17 bp, Homo sapiens
aaagtttaaataccagt

SEQ ID NO: 4660256 - DNA, 22 bp, Homo sapiens
aaagtttcctaggatgtcatgt

SEQ ID NO: 4660257 - DNA, 22 bp, Homo sapiens
aaagttttttattatgcattat

SEQ ID NO: 4660258 - DNA, 17 bp, Homo sapiens
aaataaaacacacctcg

SEQ ID NO: 4660259 - DNA, 18 bp, Homo sapiens
aaataaaacacacctcgt

SEQ ID NO: 4660260 - DNA, 14 bp, Homo sapiens
aaataaaatgaaaa

SEQ ID NO: 4660261 - DNA, 21 bp, Homo sapiens
aaataaaatgaaaattgtatt

SEQ ID NO: 4660262 - DNA, 20 bp, Homo sapiens
aaataaaatgaacatctctt

SEQ ID NO: 4660263 - DNA, 16 bp, Homo sapiens
aaataaaatgtttcat

SEQ ID NO: 4660264 - DNA, 15 bp, Homo sapiens
aaataaacacgattt

SEQ ID NO: 4660265 - DNA, 19 bp, Homo sapiens
aaataaagggaagaaagga

SEQ ID NO: 4660266 - DNA, 14 bp, Homo sapiens
aaataaatgtttcc

SEQ ID NO: 4660267 - DNA, 22 bp, Homo sapiens
aaataaatgtttcccccactcc

SEQ ID NO: 4660268 - DNA, 15 bp, Homo sapiens
aaataacaaaatgga

SEQ ID NO: 4660269 - DNA, 20 bp, Homo sapiens
aaataactggaacaaattat

SEQ ID NO: 4660270 - DNA, 13 bp, Homo sapiens
aaataatgctgca

SEQ ID NO: 4660271 - DNA, 22 bp, Homo sapiens
aacaaatgtggccaagcctatc

SEQ ID NO: 4660272 - DNA, 15 bp, Homo sapiens
aacaaattatttttg

SEQ ID NO: 4660273 - DNA, 18 bp, Homo sapiens
aacaaatttcattgcact

SEQ ID NO: 4660274 - DNA, 19 bp, Homo sapiens
aacaaatttcattgcactt

SEQ ID NO: 4660275 - DNA, 19 bp, Homo sapiens
aacaaccagttaaagccac

SEQ ID NO: 4660276 - DNA, 19 bp, Homo sapiens
aacaagaaatggatgtaag

SEQ ID NO: 4660277 - DNA, 20 bp, Homo sapiens
aacaagtgctcctgaaagaa

SEQ ID NO: 4660278 - DNA, 16 bp, Homo sapiens
aacaataaaatttttt

SEQ ID NO: 4660279 - DNA, 16 bp, Homo sapiens
aacaataacttttata

SEQ ID NO: 4660280 - DNA, 22 bp, Homo sapiens
aacaatagttcttagctttgaa

SEQ ID NO: 4660281 - DNA, 17 bp, Homo sapiens
aacaatcctagtgcttt

SEQ ID NO: 4660282 - DNA, 19 bp, Homo sapiens
aacaatttggtcttagctt

SEQ ID NO: 4660283 - DNA, 16 bp, Homo sapiens
aacacaaaacttgaaa

SEQ ID NO: 4660284 - DNA, 17 bp, Homo sapiens
aacacaaacccccactc

SEQ ID NO: 4660285 - DNA, 17 bp, Homo sapiens
aacacaacaataacttt

SEQ ID NO: 4660286 - DNA, 21 bp, Homo sapiens
aacacagcatgggtccagaag

SEQ ID NO: 4660287 - DNA, 20 bp, Homo sapiens
aacacagcttacaatcgcaa

SEQ ID NO: 4660288 - DNA, 16 bp, Homo sapiens
aacactatgtttattt

SEQ ID NO: 4660289 - DNA, 18 bp, Homo sapiens
aacactcagaagcctggg

SEQ ID NO: 4660290 - DNA, 20 bp, Homo sapiens
aacactgataatcacactgc

SEQ ID NO: 4660291 - DNA, 18 bp, Homo sapiens
aacactgtgatttatctt

SEQ ID NO: 4660292 - DNA, 12 bp, Homo sapiens
aacagaacaggg

SEQ ID NO: 4660293 - DNA, 13 bp, Homo sapiens
aacagaagtgagg

SEQ ID NO: 4660294 - DNA, 19 bp, Homo sapiens
aacagagtggcctccctgc

SEQ ID NO: 4660295 - DNA, 12 bp, Homo sapiens
aacagcattgct

SEQ ID NO: 4660296 - DNA, 16 bp, Homo sapiens
aacagcattgctttct

SEQ ID NO: 4660297 - DNA, 18 bp, Homo sapiens
aacagccactacattact

SEQ ID NO: 4660298 - DNA, 16 bp, Homo sapiens
aacagcctctttttga

SEQ ID NO: 4660299 - DNA, 15 bp, Homo sapiens
aacagctcagccagt

SEQ ID NO: 4660300 - DNA, 13 bp, Homo sapiens
aacagcttgctgt

SEQ ID NO: 4660301 - DNA, 20 bp, Homo sapiens
aacaggaggtgtgaatgcac

SEQ ID NO: 4660302 - DNA, 13 bp, Homo sapiens
aacagggaaggca

SEQ ID NO: 4660303 - DNA, 20 bp, Homo sapiens
aacagggactacgtattttt

SEQ ID NO: 4660304 - DNA, 21 bp, Homo sapiens
aacagggctgccttctggcct

SEQ ID NO: 4660305 - DNA, 14 bp, Homo sapiens
aacaggtattttgt

SEQ ID NO: 4660306 - DNA, 18 bp, Homo sapiens
aacaggtattttgtttct

SEQ ID NO: 4660307 - DNA, 22 bp, Homo sapiens
aacaggttcttaaaaaggaaca

SEQ ID NO: 4660308 - DNA, 13 bp, Homo sapiens
aacaggttttttt

SEQ ID NO: 4660309 - DNA, 19 bp, Homo sapiens
aacagtggttgcctggggg

SEQ ID NO: 4660310 - DNA, 17 bp, Homo sapiens
aacagttgcatttagct

SEQ ID NO: 4660311 - DNA, 19 bp, Homo sapiens
aacatacacgttaactgca

SEQ ID NO: 4660312 - DNA, 23 bp, Homo sapiens
aacatagaaatggaaattttgct

SEQ ID NO: 4660313 - DNA, 15 bp, Homo sapiens
aacatatttcatttt

SEQ ID NO: 4660314 - DNA, 18 bp, Homo sapiens
aacatatttcattttaac

SEQ ID NO: 4660315 - DNA, 13 bp, Homo sapiens
aacatatttgata

SEQ ID NO: 4660316 - DNA, 19 bp, Homo sapiens
aacatccctgtcttaactg

SEQ ID NO: 4660317 - DNA, 12 bp, Homo sapiens
aacatcttcata

SEQ ID NO: 4660318 - DNA, 14 bp, Homo sapiens
aacatcttcatata

SEQ ID NO: 4660319 - DNA, 16 bp, Homo sapiens
aacatcttcatataaa

SEQ ID NO: 4660320 - DNA, 17 bp, Homo sapiens
aacatcttcatataaac

SEQ ID NO: 4660321 - DNA, 18 bp, Homo sapiens
aacatcttcatataaact

SEQ ID NO: 4660322 - DNA, 15 bp, Homo sapiens
aacatgatttcaaaa

SEQ ID NO: 4660323 - DNA, 14 bp, Homo sapiens
aacatgcactgatg

SEQ ID NO: 4660324 - DNA, 22 bp, Homo sapiens
aacatgcagctcttcaacatga

SEQ ID NO: 4660325 - DNA, 16 bp, Homo sapiens
aacatgcatactttat

SEQ ID NO: 4660326 - DNA, 14 bp, Homo sapiens
aacatgccctgttc

SEQ ID NO: 4660327 - DNA, 17 bp, Homo sapiens
aacatggccagactccc

SEQ ID NO: 4660328 - DNA, 20 bp, Homo sapiens
aacatggccagactcccttg

SEQ ID NO: 4660329 - DNA, 20 bp, Homo sapiens
aacatgtcttgactgttagt

SEQ ID NO: 4660330 - DNA, 15 bp, Homo sapiens
aacattcagctctgg

SEQ ID NO: 4660331 - DNA, 16 bp, Homo sapiens
aacattcagctctgga

SEQ ID NO: 4660332 - DNA, 22 bp, Homo sapiens
aacattcagctctggagaacag

SEQ ID NO: 4660333 - DNA, 20 bp, Homo sapiens
aacattgagattatgatgaa

SEQ ID NO: 4660334 - DNA, 12 bp, Homo sapiens
aacattggacag

SEQ ID NO: 4660335 - DNA, 21 bp, Homo sapiens
aacattggacagaaaatgcaa

SEQ ID NO: 4660336 - DNA, 13 bp, Homo sapiens
aacatttaaattc

SEQ ID NO: 4660337 - DNA, 14 bp, Homo sapiens
aacatttaaattcc

SEQ ID NO: 4660338 - DNA, 14 bp, Homo sapiens
aaccaaatggttct

SEQ ID NO: 4660339 - DNA, 13 bp, Homo sapiens
aaccaaggccctg

SEQ ID NO: 4660340 - DNA, 18 bp, Homo sapiens
aaccaaggccctgtctct

SEQ ID NO: 4660341 - DNA, 14 bp, Homo sapiens
aaccaatttgtaat

SEQ ID NO: 4660342 - DNA, 14 bp, Homo sapiens
aaccagaaggccct

SEQ ID NO: 4660343 - DNA, 18 bp, Homo sapiens
aaccagagtcagcacagg

SEQ ID NO: 4660344 - DNA, 13 bp, Homo sapiens
aaccagataacat

SEQ ID NO: 4660345 - DNA, 19 bp, Homo sapiens
aaccagcccgacagtgcca

SEQ ID NO: 4660346 - DNA, 16 bp, Homo sapiens
aaccagttaaagccac

SEQ ID NO: 4660347 - DNA, 17 bp, Homo sapiens
aaccagttaaagccaca

SEQ ID NO: 4660348 - DNA, 11 bp, Homo sapiens
aaccattgtaa

SEQ ID NO: 4660349 - DNA, 21 bp, Homo sapiens
aaccattgtaactattaacct

SEQ ID NO: 4660350 - DNA, 22 bp, Homo sapiens
aacccagacctgttagcagaca

SEQ ID NO: 4660351 - DNA, 20 bp, Homo sapiens
aaccccacccttgcccaccc

SEQ ID NO: 4660352 - DNA, 23 bp, Homo sapiens
aaccccactgtagacaggaaagc

SEQ ID NO: 4660353 - DNA, 15 bp, Homo sapiens
aaccccctccctgtc

SEQ ID NO: 4660354 - DNA, 20 bp, Homo sapiens
aaccccttaagccctggccc

SEQ ID NO: 4660355 - DNA, 14 bp, Homo sapiens
aacccgtggaggct

SEQ ID NO: 4660356 - DNA, 17 bp, Homo sapiens
aacccgtggaggctgct

SEQ ID NO: 4660357 - DNA, 16 bp, Homo sapiens
aaccggaaggaggcca

SEQ ID NO: 4660358 - DNA, 23 bp, Homo sapiens
aaccggaaggaggccaaccagcc

SEQ ID NO: 4660359 - DNA, 18 bp, Homo sapiens
aaccgtggcccttcctgg

SEQ ID NO: 4660360 - DNA, 16 bp, Homo sapiens
aacctaataattgtat

SEQ ID NO: 4660361 - DNA, 21 bp, Homo sapiens
aacctaataattgtatctaca

SEQ ID NO: 4660362 - DNA, 15 bp, Homo sapiens
aacctacatattcca

SEQ ID NO: 4660363 - DNA, 16 bp, Homo sapiens
aacctagtaaaacctt

SEQ ID NO: 4660364 - DNA, 17 bp, Homo sapiens
aacctagtaaaaccttg

SEQ ID NO: 4660365 - DNA, 21 bp, Homo sapiens
aacctagtaaaaccttgttct

SEQ ID NO: 4660366 - DNA, 18 bp, Homo sapiens
aacctccatactcaagct

SEQ ID NO: 4660367 - DNA, 20 bp, Homo sapiens
aacctccctcctttcctttg

SEQ ID NO: 4660368 - DNA, 15 bp, Homo sapiens
aacctcctctgtgaa

SEQ ID NO: 4660369 - DNA, 13 bp, Homo sapiens
aacctctgcctcc

SEQ ID NO: 4660370 - DNA, 17 bp, Homo sapiens
aacctctgcctcctggg

SEQ ID NO: 4660371 - DNA, 15 bp, Homo sapiens
aacctctgttcagtg

SEQ ID NO: 4660372 - DNA, 23 bp, Homo sapiens
aacctgacctaacctaggagggc

SEQ ID NO: 4660373 - DNA, 19 bp, Homo sapiens
aacctgcacaggcttgctg

SEQ ID NO: 4660374 - DNA, 11 bp, Homo sapiens
aacctggcctt

SEQ ID NO: 4660375 - DNA, 19 bp, Homo sapiens
aacctgtcttggggccact

SEQ ID NO: 4660376 - DNA, 16 bp, Homo sapiens
aacctgttcaggcagg

SEQ ID NO: 4660377 - DNA, 12 bp, Homo sapiens
aacctgttttgt

SEQ ID NO: 4660378 - DNA, 15 bp, Homo sapiens
aacctgttttgttaa

SEQ ID NO: 4660379 - DNA, 22 bp, Homo sapiens
aacctgttttgttaatgctcta

SEQ ID NO: 4660380 - DNA, 20 bp, Homo sapiens
aaccttgttctatttttcaa

SEQ ID NO: 4660381 - DNA, 12 bp, Homo sapiens
aagaatgagtga

SEQ ID NO: 4660382 - DNA, 23 bp, Homo sapiens
aagaatgagtgaagtattgctga

SEQ ID NO: 4660383 - DNA, 14 bp, Homo sapiens
aagacaaaagtctg

SEQ ID NO: 4660384 - DNA, 22 bp, Homo sapiens
aagacaaaagtctgtctttcct

SEQ ID NO: 4660385 - DNA, 11 bp, Homo sapiens
aagacacattg

SEQ ID NO: 4660386 - DNA, 15 bp, Homo sapiens
aagacattttttaaa

SEQ ID NO: 4660387 - DNA, 16 bp, Homo sapiens
aagacattttttaaaa

SEQ ID NO: 4660388 - DNA, 13 bp, Homo sapiens
aagaccaccttcc

SEQ ID NO: 4660389 - DNA, 16 bp, Homo sapiens
aagacgggaggggagg

SEQ ID NO: 4660390 - DNA, 23 bp, Homo sapiens
aagacgtgattttgctgtagaag

SEQ ID NO: 4660391 - DNA, 23 bp, Homo sapiens
aagacgtggtctagaccagggct

SEQ ID NO: 4660392 - DNA, 16 bp, Homo sapiens
aagactggttttctgc

SEQ ID NO: 4660393 - DNA, 18 bp, Homo sapiens
aagacttgtgcatccctc

SEQ ID NO: 4660394 - DNA, 19 bp, Homo sapiens
aagactttgggataggaaa

SEQ ID NO: 4660395 - DNA, 15 bp, Homo sapiens
aagagaagtttaaca

SEQ ID NO: 4660396 - DNA, 23 bp, Homo sapiens
aagagaagtttaacaagtattta

SEQ ID NO: 4660397 - DNA, 23 bp, Homo sapiens
aagagacactcccccctccattc

SEQ ID NO: 4660398 - DNA, 13 bp, Homo sapiens
aagagagaagcca

SEQ ID NO: 4660399 - DNA, 14 bp, Homo sapiens
aagagagaagccag

SEQ ID NO: 4660400 - DNA, 15 bp, Homo sapiens
aagagagaagccagc

SEQ ID NO: 4660401 - DNA, 15 bp, Homo sapiens
aagagagggacaggc

SEQ ID NO: 4660402 - DNA, 20 bp, Homo sapiens
aagagatattgatattgaag

SEQ ID NO: 4660403 - DNA, 17 bp, Homo sapiens
aagagcatcatgcctct

SEQ ID NO: 4660404 - DNA, 18 bp, Homo sapiens
aagagcatcatgcctctg

SEQ ID NO: 4660405 - DNA, 19 bp, Homo sapiens
aagagcatcatgcctctga

SEQ ID NO: 4660406 - DNA, 20 bp, Homo sapiens
aagagcatcatgcctctgag

SEQ ID NO: 4660407 - DNA, 18 bp, Homo sapiens
aagagcatgaaattttta

SEQ ID NO: 4660408 - DNA, 19 bp, Homo sapiens
aagagccacctgcaagatg

SEQ ID NO: 4660409 - DNA, 18 bp, Homo sapiens
aagagcccgtgccacccc

SEQ ID NO: 4660410 - DNA, 23 bp, Homo sapiens
aagagcccgtgccacccccagcc

SEQ ID NO: 4660411 - DNA, 16 bp, Homo sapiens
aagagctagaaaaata

SEQ ID NO: 4660412 - DNA, 17 bp, Homo sapiens
aagaggatgaaggaagg

SEQ ID NO: 4660413 - DNA, 21 bp, Homo sapiens
aagaggatgaaggaaggggct

SEQ ID NO: 4660414 - DNA, 11 bp, Homo sapiens
aagagggacag

SEQ ID NO: 4660415 - DNA, 14 bp, Homo sapiens
aagagggacaggct

SEQ ID NO: 4660416 - DNA, 18 bp, Homo sapiens
aagaggtgaccccagggc

SEQ ID NO: 4660417 - DNA, 20 bp, Homo sapiens
aagaggtgaccccagggcac

SEQ ID NO: 4660418 - DNA, 24 bp, Homo sapiens
aagaggtgaccccagggcacagga

SEQ ID NO: 4660419 - DNA, 22 bp, Homo sapiens
aagataatgaaatagttatttt

SEQ ID NO: 4660420 - DNA, 12 bp, Homo sapiens
aagatatggaca

SEQ ID NO: 4660421 - DNA, 15 bp, Homo sapiens
aagatattctttaca

SEQ ID NO: 4660422 - DNA, 16 bp, Homo sapiens
aagatattctttacaa

SEQ ID NO: 4660423 - DNA, 13 bp, Homo sapiens
aagatatttttga

SEQ ID NO: 4660424 - DNA, 22 bp, Homo sapiens
aagatatttttgaagtaaatta

SEQ ID NO: 4660425 - DNA, 21 bp, Homo sapiens
aagatcttttcgaagctgtta

SEQ ID NO: 4660426 - DNA, 18 bp, Homo sapiens
aagatgagcctgggctca

SEQ ID NO: 4660427 - DNA, 21 bp, Homo sapiens
aagatggacacgagccacaag

SEQ ID NO: 4660428 - DNA, 21 bp, Homo sapiens
aagatggagcaaacctagccc

SEQ ID NO: 4660429 - DNA, 23 bp, Homo sapiens
aagatggcacttataaccaaagc

SEQ ID NO: 4660430 - DNA, 18 bp, Homo sapiens
aagatggcatcctgtgaa

SEQ ID NO: 4660431 - DNA, 19 bp, Homo sapiens
aagattaatctttaaacca

SEQ ID NO: 4660432 - DNA, 18 bp, Homo sapiens
aagattcaaatctcttgc

SEQ ID NO: 4660433 - DNA, 22 bp, Homo sapiens
aagattgttggtgaattttcaa

SEQ ID NO: 4660434 - DNA, 16 bp, Homo sapiens
aagattttcctcttgt

SEQ ID NO: 4660435 - DNA, 15 bp, Homo sapiens
aagcaagacacgtgg

SEQ ID NO: 4660436 - DNA, 12 bp, Homo sapiens
aagcaagtgttg

SEQ ID NO: 4660437 - DNA, 15 bp, Homo sapiens
aagcaatcattttat

SEQ ID NO: 4660438 - DNA, 13 bp, Homo sapiens
aagcaatgtgttt

SEQ ID NO: 4660439 - DNA, 20 bp, Homo sapiens
aagcacaatcactaaacttt

SEQ ID NO: 4660440 - DNA, 11 bp, Homo sapiens
aagcacagcag

SEQ ID NO: 4660441 - DNA, 17 bp, Homo sapiens
aagcacagctcctgcca

SEQ ID NO: 4660442 - DNA, 14 bp, Homo sapiens
aagcactaagaggt

SEQ ID NO: 4660443 - DNA, 23 bp, Homo sapiens
aagcagaagacgggaggggaggc

SEQ ID NO: 4660444 - DNA, 14 bp, Homo sapiens
aagcagacagctcc

SEQ ID NO: 4660445 - DNA, 19 bp, Homo sapiens
aagcagagatcgacagaca

SEQ ID NO: 4660446 - DNA, 16 bp, Homo sapiens
aagcaggactgtgcct

SEQ ID NO: 4660447 - DNA, 18 bp, Homo sapiens
aagcaggttcccaagctc

SEQ ID NO: 4660448 - DNA, 17 bp, Homo sapiens
aagcataatctgaaaac

SEQ ID NO: 4660449 - DNA, 17 bp, Homo sapiens
aagcatactttgtaaat

SEQ ID NO: 4660450 - DNA, 23 bp, Homo sapiens
aagcatgaataacatttaaattc

SEQ ID NO: 4660451 - DNA, 17 bp, Homo sapiens
aagcattccacactgca

SEQ ID NO: 4660452 - DNA, 20 bp, Homo sapiens
aagcattggagtttcaaatc

SEQ ID NO: 4660453 - DNA, 16 bp, Homo sapiens
aagcattttataaatg

SEQ ID NO: 4660454 - DNA, 13 bp, Homo sapiens
aagcattttttat

SEQ ID NO: 4660455 - DNA, 16 bp, Homo sapiens
aagccaaacaaaactg

SEQ ID NO: 4660456 - DNA, 17 bp, Homo sapiens
aagccaaagaaacaagc

SEQ ID NO: 4660457 - DNA, 12 bp, Homo sapiens
aagccaaagagt

SEQ ID NO: 4660458 - DNA, 15 bp, Homo sapiens
aagccaatgtgaatt

SEQ ID NO: 4660459 - DNA, 17 bp, Homo sapiens
aagccagattctcttga

SEQ ID NO: 4660460 - DNA, 11 bp, Homo sapiens
aagccagccac

SEQ ID NO: 4660461 - DNA, 12 bp, Homo sapiens
aagccagccaca

SEQ ID NO: 4660462 - DNA, 21 bp, Homo sapiens
aagccagggtctctccctcag

SEQ ID NO: 4660463 - DNA, 16 bp, Homo sapiens
aagccagtgctgtctg

SEQ ID NO: 4660464 - DNA, 17 bp, Homo sapiens
aagccatttagagggtg

SEQ ID NO: 4660465 - DNA, 22 bp, Homo sapiens
aagccatttagagggtgaagga

SEQ ID NO: 4660466 - DNA, 14 bp, Homo sapiens
aagcccaaagcctg

SEQ ID NO: 4660467 - DNA, 13 bp, Homo sapiens
aagccccttattt

SEQ ID NO: 4660468 - DNA, 11 bp, Homo sapiens
aagccctcagc

SEQ ID NO: 4660469 - DNA, 14 bp, Homo sapiens
aagccctcagctgg

SEQ ID NO: 4660470 - DNA, 13 bp, Homo sapiens
aagccctgcccac

SEQ ID NO: 4660471 - DNA, 12 bp, Homo sapiens
aagccctggccc

SEQ ID NO: 4660472 - DNA, 14 bp, Homo sapiens
aagccgactctggc

SEQ ID NO: 4660473 - DNA, 16 bp, Homo sapiens
aagccgactctggccc

SEQ ID NO: 4660474 - DNA, 21 bp, Homo sapiens
aagccgactctggccctggcc

SEQ ID NO: 4660475 - DNA, 14 bp, Homo sapiens
aagccggtgggcta

SEQ ID NO: 4660476 - DNA, 19 bp, Homo sapiens
aagccggtgggctagaaag

SEQ ID NO: 4660477 - DNA, 21 bp, Homo sapiens
aagcctatcaaaggaaatgag

SEQ ID NO: 4660478 - DNA, 15 bp, Homo sapiens
aagcctcttatgggg

SEQ ID NO: 4660479 - DNA, 23 bp, Homo sapiens
aagcctcttatgggggtgtttct

SEQ ID NO: 4660480 - DNA, 21 bp, Homo sapiens
aagcctcttattccaggagaa

SEQ ID NO: 4660481 - DNA, 15 bp, Homo sapiens
aagcctgatgctgac

SEQ ID NO: 4660482 - DNA, 18 bp, Homo sapiens
aagcctgcctcgccttgt

SEQ ID NO: 4660483 - DNA, 19 bp, Homo sapiens
aagcctgcctcgccttgtg

SEQ ID NO: 4660484 - DNA, 17 bp, Homo sapiens
aagcctgggattgacag

SEQ ID NO: 4660485 - DNA, 17 bp, Homo sapiens
aagcctgttcatggcag

SEQ ID NO: 4660486 - DNA, 18 bp, Homo sapiens
aagcctgttcatggcaga

SEQ ID NO: 4660487 - DNA, 13 bp, Homo sapiens
aagcctttaaatt

SEQ ID NO: 4660488 - DNA, 21 bp, Homo sapiens
aagcgaacatcttcatataaa

SEQ ID NO: 4660489 - DNA, 18 bp, Homo sapiens
aagcgttaagggcagagt

SEQ ID NO: 4660490 - DNA, 15 bp, Homo sapiens
aagctaaaaatatta

SEQ ID NO: 4660491 - DNA, 23 bp, Homo sapiens
aagtattacaaccatatattgag

SEQ ID NO: 4660492 - DNA, 15 bp, Homo sapiens
aagtattattttcca

SEQ ID NO: 4660493 - DNA, 15 bp, Homo sapiens
aagtattgctgaaaa

SEQ ID NO: 4660494 - DNA, 15 bp, Homo sapiens
aagtatttataaaaa

SEQ ID NO: 4660495 - DNA, 15 bp, Homo sapiens
aagtcaattctgtgt

SEQ ID NO: 4660496 - DNA, 22 bp, Homo sapiens
aagtcaattctgtgtggtatat

SEQ ID NO: 4660497 - DNA, 18 bp, Homo sapiens
aagtcacagccgtttgaa

SEQ ID NO: 4660498 - DNA, 12 bp, Homo sapiens
aagtcacccagg

SEQ ID NO: 4660499 - DNA, 20 bp, Homo sapiens
aagtcacttactattgttgc

SEQ ID NO: 4660500 - DNA, 14 bp, Homo sapiens
aagtccaataagac

SEQ ID NO: 4660501 - DNA, 15 bp, Homo sapiens
aagtccaataagaca

SEQ ID NO: 4660502 - DNA, 13 bp, Homo sapiens
aagtctagaatca

SEQ ID NO: 4660503 - DNA, 14 bp, Homo sapiens
aagtctagaatcat

SEQ ID NO: 4660504 - DNA, 13 bp, Homo sapiens
aagtctgctgctg

SEQ ID NO: 4660505 - DNA, 12 bp, Homo sapiens
aagtctttctcc

SEQ ID NO: 4660506 - DNA, 19 bp, Homo sapiens
aagtgaaataacaaaatgg

SEQ ID NO: 4660507 - DNA, 18 bp, Homo sapiens
aagtgacttctggagaaa

SEQ ID NO: 4660508 - DNA, 19 bp, Homo sapiens
aagtgaggatgagacccag

SEQ ID NO: 4660509 - DNA, 22 bp, Homo sapiens
aagtgaggatgagacccagccc

SEQ ID NO: 4660510 - DNA, 23 bp, Homo sapiens
aagtgaggatgagacccagcccc

SEQ ID NO: 4660511 - DNA, 17 bp, Homo sapiens
aagtgcaaacacagcat

SEQ ID NO: 4660512 - DNA, 17 bp, Homo sapiens
aagtgccaaatgctctc

SEQ ID NO: 4660513 - DNA, 20 bp, Homo sapiens
aagtgctgttttattactgt

SEQ ID NO: 4660514 - DNA, 17 bp, Homo sapiens
aagtgcttaaaaatact

SEQ ID NO: 4660515 - DNA, 12 bp, Homo sapiens
aagtggcaggga

SEQ ID NO: 4660516 - DNA, 14 bp, Homo sapiens
aagtggcagggacc

SEQ ID NO: 4660517 - DNA, 15 bp, Homo sapiens
aagtggcagggaccg

SEQ ID NO: 4660518 - DNA, 14 bp, Homo sapiens
aagtggcataaaaa

SEQ ID NO: 4660519 - DNA, 13 bp, Homo sapiens
aagtggtatagaa

SEQ ID NO: 4660520 - DNA, 12 bp, Homo sapiens
aagtgtaaaaaa

SEQ ID NO: 4660521 - DNA, 20 bp, Homo sapiens
aagtgtcacctccttcccca

SEQ ID NO: 4660522 - DNA, 21 bp, Homo sapiens
aagtgtcacctccttccccag

SEQ ID NO: 4660523 - DNA, 22 bp, Homo sapiens
aagtgtcacctccttccccagc

SEQ ID NO: 4660524 - DNA, 23 bp, Homo sapiens
aagtgtcacctccttccccagct

SEQ ID NO: 4660525 - DNA, 21 bp, Homo sapiens
aagtgttaattttaccttgtt

SEQ ID NO: 4660526 - DNA, 22 bp, Homo sapiens
aagtgttggcaaacgagacttt

SEQ ID NO: 4660527 - DNA, 17 bp, Homo sapiens
aagttacacatttttca

SEQ ID NO: 4660528 - DNA, 12 bp, Homo sapiens
aagttactttgt

SEQ ID NO: 4660529 - DNA, 23 bp, Homo sapiens
aagttcatgtgtggaaatgggac

SEQ ID NO: 4660530 - DNA, 12 bp, Homo sapiens
aagttcctgctg

SEQ ID NO: 4660531 - DNA, 13 bp, Homo sapiens
aagttcctgctgc

SEQ ID NO: 4660532 - DNA, 15 bp, Homo sapiens
aagttcctgctgcct

SEQ ID NO: 4660533 - DNA, 16 bp, Homo sapiens
aagttcctgctgcctg

SEQ ID NO: 4660534 - DNA, 17 bp, Homo sapiens
aagttctgcaaaataca

SEQ ID NO: 4660535 - DNA, 22 bp, Homo sapiens
aagttcttagttgctgtatgtc

SEQ ID NO: 4660536 - DNA, 17 bp, Homo sapiens
aagttgaggattgttga

SEQ ID NO: 4660537 - DNA, 15 bp, Homo sapiens
aagtttaaataccag

SEQ ID NO: 4660538 - DNA, 16 bp, Homo sapiens
aagtttaaataccagt

SEQ ID NO: 4660539 - DNA, 14 bp, Homo sapiens
aagtttctattctg

SEQ ID NO: 4660540 - DNA, 17 bp, Homo sapiens
aagtttctattctgtca

SEQ ID NO: 4660541 - DNA, 20 bp, Homo sapiens
aagtttgatttttgtttttg

SEQ ID NO: 4660542 - DNA, 20 bp, Homo sapiens
aagtttgcctttgtaccata

SEQ ID NO: 4660543 - DNA, 12 bp, Homo sapiens
aagtttgtagcc

SEQ ID NO: 4660544 - DNA, 16 bp, Homo sapiens
aataaaacttggttct

SEQ ID NO: 4660545 - DNA, 20 bp, Homo sapiens
aataaaaggaagccaaagag

SEQ ID NO: 4660546 - DNA, 14 bp, Homo sapiens
aataaaatgaacat

SEQ ID NO: 4660547 - DNA, 17 bp, Homo sapiens
aataaacacacagatct

SEQ ID NO: 4660548 - DNA, 14 bp, Homo sapiens
aataaagtattcta

SEQ ID NO: 4660549 - DNA, 19 bp, Homo sapiens
aataaagttgttgcattcc

SEQ ID NO: 4660550 - DNA, 21 bp, Homo sapiens
aataaattgcttactgatatt

SEQ ID NO: 4660551 - DNA, 14 bp, Homo sapiens
aataacaaaatgga

SEQ ID NO: 4660552 - DNA, 11 bp, Homo sapiens
aataacattta

SEQ ID NO: 4660553 - DNA, 13 bp, Homo sapiens
aataactgtgtgg

SEQ ID NO: 4660554 - DNA, 14 bp, Homo sapiens
aataactttcttac

SEQ ID NO: 4660555 - DNA, 23 bp, Homo sapiens
aataatccctgtaatatttagct

SEQ ID NO: 4660556 - DNA, 16 bp, Homo sapiens
aataattcttttctga

SEQ ID NO: 4660557 - DNA, 17 bp, Homo sapiens
aataattcttttctgag

SEQ ID NO: 4660558 - DNA, 14 bp, Homo sapiens
aataattgtatcta

SEQ ID NO: 4660559 - DNA, 13 bp, Homo sapiens
aatacaaagatga

SEQ ID NO: 4660560 - DNA, 14 bp, Homo sapiens
aatacaaagatgac

SEQ ID NO: 4660561 - DNA, 18 bp, Homo sapiens
aatacaaagtggaaactt

SEQ ID NO: 4660562 - DNA, 22 bp, Homo sapiens
aatacacttgtgattataaaat

SEQ ID NO: 4660563 - DNA, 17 bp, Homo sapiens
aatacagcatacttcaa

SEQ ID NO: 4660564 - DNA, 18 bp, Homo sapiens
aatacagtctagtttcct

SEQ ID NO: 4660565 - DNA, 16 bp, Homo sapiens
aatacatgtgtatatt

SEQ ID NO: 4660566 - DNA, 20 bp, Homo sapiens
aatacatgtgtatattcctt

SEQ ID NO: 4660567 - DNA, 18 bp, Homo sapiens
aatacattttaagccttt

SEQ ID NO: 4660568 - DNA, 13 bp, Homo sapiens
aatacctctgtgt

SEQ ID NO: 4660569 - DNA, 16 bp, Homo sapiens
aatacctttaaatatc

SEQ ID NO: 4660570 - DNA, 19 bp, Homo sapiens
aatacctttaaatatcatt

SEQ ID NO: 4660571 - DNA, 20 bp, Homo sapiens
aatacgacactgaaatatgt

SEQ ID NO: 4660572 - DNA, 15 bp, Homo sapiens
aatactcttgaaagg

SEQ ID NO: 4660573 - DNA, 18 bp, Homo sapiens
aatactcttgaaaggcca

SEQ ID NO: 4660574 - DNA, 18 bp, Homo sapiens
aatactcttgatttcaca

SEQ ID NO: 4660575 - DNA, 13 bp, Homo sapiens
aatactgttttaa

SEQ ID NO: 4660576 - DNA, 20 bp, Homo sapiens
aatagaaaatgtaataactt

SEQ ID NO: 4660577 - DNA, 11 bp, Homo sapiens
aatagaaagaa

SEQ ID NO: 4660578 - DNA, 14 bp, Homo sapiens
aatagaaagaaact

SEQ ID NO: 4660579 - DNA, 13 bp, Homo sapiens
aatagaataattc

SEQ ID NO: 4660580 - DNA, 15 bp, Homo sapiens
aatagagtacttaat

SEQ ID NO: 4660581 - DNA, 12 bp, Homo sapiens
aatagcaataac

SEQ ID NO: 4660582 - DNA, 11 bp, Homo sapiens
aatagcttttt

SEQ ID NO: 4660583 - DNA, 15 bp, Homo sapiens
aataggatttttaga

SEQ ID NO: 4660584 - DNA, 16 bp, Homo sapiens
aataggatttttagaa

SEQ ID NO: 4660585 - DNA, 19 bp, Homo sapiens
aatagtcaccttcatgatt

SEQ ID NO: 4660586 - DNA, 16 bp, Homo sapiens
aatagtctttgccagt

SEQ ID NO: 4660587 - DNA, 18 bp, Homo sapiens
aatagtgtcatataaact

SEQ ID NO: 4660588 - DNA, 17 bp, Homo sapiens
aatagttgtctgtgctt

SEQ ID NO: 4660589 - DNA, 13 bp, Homo sapiens
aatataaagctta

SEQ ID NO: 4660590 - DNA, 16 bp, Homo sapiens
aatataaattgtacat

SEQ ID NO: 4660591 - DNA, 22 bp, Homo sapiens
aatatacatagtctttgtttac

SEQ ID NO: 4660592 - DNA, 15 bp, Homo sapiens
aatatacattttcta

SEQ ID NO: 4660593 - DNA, 16 bp, Homo sapiens
aatatacattttctaa

SEQ ID NO: 4660594 - DNA, 21 bp, Homo sapiens
aatatactcagggattccttc

SEQ ID NO: 4660595 - DNA, 22 bp, Homo sapiens
aatatagaaagttgatattcaa

SEQ ID NO: 4660596 - DNA, 18 bp, Homo sapiens
aatatagcaaatgcagaa

SEQ ID NO: 4660597 - DNA, 13 bp, Homo sapiens
aatatatacattt

SEQ ID NO: 4660598 - DNA, 16 bp, Homo sapiens
aatatatatcactcta

SEQ ID NO: 4660599 - DNA, 20 bp, Homo sapiens
aatatatatcactctagaaa

SEQ ID NO: 4660600 - DNA, 21 bp, Homo sapiens
aatatattttttgttattatt

SEQ ID NO: 4660601 - DNA, 15 bp, Homo sapiens
aatatcaaataaaat

SEQ ID NO: 4660602 - DNA, 17 bp, Homo sapiens
aatgcatatttataaga

SEQ ID NO: 4660603 - DNA, 13 bp, Homo sapiens
aatgcatgagtaa

SEQ ID NO: 4660604 - DNA, 18 bp, Homo sapiens
aatgcattgtatcgatgt

SEQ ID NO: 4660605 - DNA, 21 bp, Homo sapiens
aatgcattgtatcgatgttat

SEQ ID NO: 4660606 - DNA, 17 bp, Homo sapiens
aatgccagtctcattgt

SEQ ID NO: 4660607 - DNA, 19 bp, Homo sapiens
aatgctctatgtttgtatt

SEQ ID NO: 4660608 - DNA, 20 bp, Homo sapiens
aatgctctatgtttgtattt

SEQ ID NO: 4660609 - DNA, 15 bp, Homo sapiens
aatgctgtttctaag

SEQ ID NO: 4660610 - DNA, 19 bp, Homo sapiens
aatgctgtttctaagaaaa

SEQ ID NO: 4660611 - DNA, 14 bp, Homo sapiens
aatgcttcattatt

SEQ ID NO: 4660612 - DNA, 16 bp, Homo sapiens
aatggaaattttgcta

SEQ ID NO: 4660613 - DNA, 20 bp, Homo sapiens
aatggacaaataagtttttg

SEQ ID NO: 4660614 - DNA, 15 bp, Homo sapiens
aatggaggagccagg

SEQ ID NO: 4660615 - DNA, 19 bp, Homo sapiens
aatggaggagccaggcccc

SEQ ID NO: 4660616 - DNA, 20 bp, Homo sapiens
aatggaggagccaggcccca

SEQ ID NO: 4660617 - DNA, 23 bp, Homo sapiens
aatggattcatggagtagcctgg

SEQ ID NO: 4660618 - DNA, 18 bp, Homo sapiens
aatggcatttctctttaa

SEQ ID NO: 4660619 - DNA, 17 bp, Homo sapiens
aatggctgtaatcattt

SEQ ID NO: 4660620 - DNA, 21 bp, Homo sapiens
aatgggagctgaggccacact

SEQ ID NO: 4660621 - DNA, 22 bp, Homo sapiens
aatgggatggtcggatctcaca

SEQ ID NO: 4660622 - DNA, 22 bp, Homo sapiens
aatggggaagggagtctctctt

SEQ ID NO: 4660623 - DNA, 18 bp, Homo sapiens
aatggtgcttggaggggg

SEQ ID NO: 4660624 - DNA, 11 bp, Homo sapiens
aatgtacactt

SEQ ID NO: 4660625 - DNA, 14 bp, Homo sapiens
aatgtacacttttt

SEQ ID NO: 4660626 - DNA, 18 bp, Homo sapiens
aatgtacccaccgggcca

SEQ ID NO: 4660627 - DNA, 15 bp, Homo sapiens
aatgtacttttggat

SEQ ID NO: 4660628 - DNA, 20 bp, Homo sapiens
aatgtacttttggataagta

SEQ ID NO: 4660629 - DNA, 22 bp, Homo sapiens
aatgtagttagctccataaagt

SEQ ID NO: 4660630 - DNA, 23 bp, Homo sapiens
aatgtatccaaggaaacatttta

SEQ ID NO: 4660631 - DNA, 12 bp, Homo sapiens
aatgtatcttaa

SEQ ID NO: 4660632 - DNA, 13 bp, Homo sapiens
aatgtatcttaaa

SEQ ID NO: 4660633 - DNA, 14 bp, Homo sapiens
aatgtattgattca

SEQ ID NO: 4660634 - DNA, 15 bp, Homo sapiens
aatgtcaaaattgtt

SEQ ID NO: 4660635 - DNA, 19 bp, Homo sapiens
aatgtcatggccttgaaac

SEQ ID NO: 4660636 - DNA, 17 bp, Homo sapiens
aatgtcgaaacctacaa

SEQ ID NO: 4660637 - DNA, 18 bp, Homo sapiens
aatgtcttaatttttgaa

SEQ ID NO: 4660638 - DNA, 12 bp, Homo sapiens
aatgtcttgtgt

SEQ ID NO: 4660639 - DNA, 16 bp, Homo sapiens
aatgtgaactctcccc

SEQ ID NO: 4660640 - DNA, 13 bp, Homo sapiens
aatgtgatcatat

SEQ ID NO: 4660641 - DNA, 20 bp, Homo sapiens
aatgtggaaaaaatatttta

SEQ ID NO: 4660642 - DNA, 13 bp, Homo sapiens
aatgtgggcactg

SEQ ID NO: 4660643 - DNA, 13 bp, Homo sapiens
aatgtgggctatg

SEQ ID NO: 4660644 - DNA, 18 bp, Homo sapiens
aatgtggtttcaatctaa

SEQ ID NO: 4660645 - DNA, 20 bp, Homo sapiens
aatgtgtacagtgaacaaat

SEQ ID NO: 4660646 - DNA, 21 bp, Homo sapiens
aatgtgtgtgtgtggcagggg

SEQ ID NO: 4660647 - DNA, 18 bp, Homo sapiens
aatgttagagtttaattt

SEQ ID NO: 4660648 - DNA, 15 bp, Homo sapiens
aatgtttaataaagc

SEQ ID NO: 4660649 - DNA, 15 bp, Homo sapiens
aatgtttggatggtt

SEQ ID NO: 4660650 - DNA, 18 bp, Homo sapiens
aatgtttgtgtctgtggt

SEQ ID NO: 4660651 - DNA, 14 bp, Homo sapiens
aattaaaacaaata

SEQ ID NO: 4660652 - DNA, 19 bp, Homo sapiens
aattaaaacatatttcatt

SEQ ID NO: 4660653 - DNA, 22 bp, Homo sapiens
aattaaaacatatttcatttta

SEQ ID NO: 4660654 - DNA, 21 bp, Homo sapiens
aattaagcattttgaaacaaa

SEQ ID NO: 4660655 - DNA, 16 bp, Homo sapiens
aattaatgcttagtga

SEQ ID NO: 4660656 - DNA, 14 bp, Homo sapiens
aattaattaaatga

SEQ ID NO: 4660657 - DNA, 14 bp, Homo sapiens
aattacaattttat

SEQ ID NO: 4660658 - DNA, 17 bp, Homo sapiens
aattacctttaatttta

SEQ ID NO: 4660659 - DNA, 19 bp, Homo sapiens
aattagatgattatatatt

SEQ ID NO: 4660660 - DNA, 15 bp, Homo sapiens
aattagccacatgta

SEQ ID NO: 4660661 - DNA, 16 bp, Homo sapiens
aattagccacatgtac

SEQ ID NO: 4660662 - DNA, 21 bp, Homo sapiens
aattagtggtcataaaataga

SEQ ID NO: 4660663 - DNA, 20 bp, Homo sapiens
aattagtgtgacagtttcca

SEQ ID NO: 4660664 - DNA, 21 bp, Homo sapiens
aattagtgtgacagtttccaa

SEQ ID NO: 4660665 - DNA, 16 bp, Homo sapiens
aattataaatgtgttt

SEQ ID NO: 4660666 - DNA, 22 bp, Homo sapiens
aattataaatgtgtttatagct

SEQ ID NO: 4660667 - DNA, 21 bp, Homo sapiens
aattatacagacctaatatca

SEQ ID NO: 4660668 - DNA, 23 bp, Homo sapiens
aattatacagacctaatatcatt

SEQ ID NO: 4660669 - DNA, 15 bp, Homo sapiens
aattatttaagattt

SEQ ID NO: 4660670 - DNA, 19 bp, Homo sapiens
aattatttaagatttcttt

SEQ ID NO: 4660671 - DNA, 23 bp, Homo sapiens
aattcaatgcttctatcagactc

SEQ ID NO: 4660672 - DNA, 13 bp, Homo sapiens
aattcatttctaa

SEQ ID NO: 4660673 - DNA, 18 bp, Homo sapiens
aattccaccagggccaga

SEQ ID NO: 4660674 - DNA, 19 bp, Homo sapiens
aattccaccagggccagag

SEQ ID NO: 4660675 - DNA, 22 bp, Homo sapiens
aattccaccagggccagagcag

SEQ ID NO: 4660676 - DNA, 10 bp, Homo sapiens
aattcctaca

SEQ ID NO: 4660677 - DNA, 13 bp, Homo sapiens
aattcctacagca

SEQ ID NO: 4660678 - DNA, 15 bp, Homo sapiens
aattcctacagcact

SEQ ID NO: 4660679 - DNA, 19 bp, Homo sapiens
aattcctacagcactactg

SEQ ID NO: 4660680 - DNA, 14 bp, Homo sapiens
aattcctgtgctca

SEQ ID NO: 4660681 - DNA, 19 bp, Homo sapiens
aattccttatcctagcctt

SEQ ID NO: 4660682 - DNA, 16 bp, Homo sapiens
aattctccaggatttt

SEQ ID NO: 4660683 - DNA, 22 bp, Homo sapiens
aattctccaggattttaatttc

SEQ ID NO: 4660684 - DNA, 23 bp, Homo sapiens
aattctccaggattttaatttca

SEQ ID NO: 4660685 - DNA, 22 bp, Homo sapiens
aattctgtttttaatgctattt

SEQ ID NO: 4660686 - DNA, 18 bp, Homo sapiens
aattcttaccctgtacat

SEQ ID NO: 4660687 - DNA, 20 bp, Homo sapiens
aattcttataggctagactt

SEQ ID NO: 4660688 - DNA, 13 bp, Homo sapiens
aattcttgataaa

SEQ ID NO: 4660689 - DNA, 15 bp, Homo sapiens
aattcttttctgagg

SEQ ID NO: 4660690 - DNA, 21 bp, Homo sapiens
aattgacagatcaagctgtga

SEQ ID NO: 4660691 - DNA, 17 bp, Homo sapiens
aattgccctatgctgtg

SEQ ID NO: 4660692 - DNA, 21 bp, Homo sapiens
aattgcttactgatattatct

SEQ ID NO: 4660693 - DNA, 18 bp, Homo sapiens
aattggtgctatttgaag

SEQ ID NO: 4660694 - DNA, 11 bp, Homo sapiens
aattgtatcta

SEQ ID NO: 4660695 - DNA, 19 bp, Homo sapiens
aattgtatctacattaaaa

SEQ ID NO: 4660696 - DNA, 20 bp, Homo sapiens
aattgtatctacattaaaat

SEQ ID NO: 4660697 - DNA, 15 bp, Homo sapiens
aattgtcgtttttat

SEQ ID NO: 4660698 - DNA, 19 bp, Homo sapiens
aattgtcgtttttattcct

SEQ ID NO: 4660699 - DNA, 21 bp, Homo sapiens
aattgtgcagtactttgtgca

SEQ ID NO: 4660700 - DNA, 23 bp, Homo sapiens
aattgtgtgtgatgtgaagccaa

SEQ ID NO: 4660701 - DNA, 15 bp, Homo sapiens
aatttaagaaaacaa

SEQ ID NO: 4660702 - DNA, 19 bp, Homo sapiens
aatttaagaaaacaagtat

SEQ ID NO: 4660703 - DNA, 14 bp, Homo sapiens
aatttaagtatctt

SEQ ID NO: 4660704 - DNA, 15 bp, Homo sapiens
aatttaatatatata

SEQ ID NO: 4660705 - DNA, 16 bp, Homo sapiens
aatttacaaaatttat

SEQ ID NO: 4660706 - DNA, 20 bp, Homo sapiens
aatttatatctaatatgaag

SEQ ID NO: 4660707 - DNA, 14 bp, Homo sapiens
aatttatttccact

SEQ ID NO: 4660708 - DNA, 15 bp, Homo sapiens
aatttcaaaatacat

SEQ ID NO: 4660709 - DNA, 21 bp, Homo sapiens
aatttcaaaatacatttgtaa

SEQ ID NO: 4660710 - DNA, 16 bp, Homo sapiens
aatttcacttatacct

SEQ ID NO: 4660711 - DNA, 20 bp, Homo sapiens
acacgggagccgctggcaga

SEQ ID NO: 4660712 - DNA, 19 bp, Homo sapiens
acacggttttggcagctga

SEQ ID NO: 4660713 - DNA, 20 bp, Homo sapiens
acacggttttggcagctgac

SEQ ID NO: 4660714 - DNA, 18 bp, Homo sapiens
acactacattttttctaa

SEQ ID NO: 4660715 - DNA, 16 bp, Homo sapiens
acactcagaagcctgg

SEQ ID NO: 4660716 - DNA, 17 bp, Homo sapiens
acactcagaagcctggg

SEQ ID NO: 4660717 - DNA, 13 bp, Homo sapiens
acactcagcacaa

SEQ ID NO: 4660718 - DNA, 16 bp, Homo sapiens
acactccaactctaca

SEQ ID NO: 4660719 - DNA, 13 bp, Homo sapiens
acactccagttgc

SEQ ID NO: 4660720 - DNA, 18 bp, Homo sapiens
acactcccccctccattc

SEQ ID NO: 4660721 - DNA, 15 bp, Homo sapiens
acactcgtcacccca

SEQ ID NO: 4660722 - DNA, 23 bp, Homo sapiens
acactcttcagtgactcctgctg

SEQ ID NO: 4660723 - DNA, 18 bp, Homo sapiens
acactgcagggaggagtg

SEQ ID NO: 4660724 - DNA, 21 bp, Homo sapiens
acactgcggtaggtcattctt

SEQ ID NO: 4660725 - DNA, 18 bp, Homo sapiens
acactggaggagagaaga

SEQ ID NO: 4660726 - DNA, 19 bp, Homo sapiens
acactggaggagagaagaa

SEQ ID NO: 4660727 - DNA, 21 bp, Homo sapiens
acactggaggagagaagaatg

SEQ ID NO: 4660728 - DNA, 22 bp, Homo sapiens
acactggaggagagaagaatga

SEQ ID NO: 4660729 - DNA, 17 bp, Homo sapiens
acactgtttcatctcag

SEQ ID NO: 4660730 - DNA, 22 bp, Homo sapiens
acactgtttcatctcagctttt

SEQ ID NO: 4660731 - DNA, 11 bp, Homo sapiens
acacttaacag

SEQ ID NO: 4660732 - DNA, 13 bp, Homo sapiens
acacttaacagat

SEQ ID NO: 4660733 - DNA, 20 bp, Homo sapiens
acacttatctcactgtttta

SEQ ID NO: 4660734 - DNA, 20 bp, Homo sapiens
acacttctcaggacacaggc

SEQ ID NO: 4660735 - DNA, 19 bp, Homo sapiens
acacttgtgattataaaat

SEQ ID NO: 4660736 - DNA, 22 bp, Homo sapiens
acacttgtgattataaaattaa

SEQ ID NO: 4660737 - DNA, 22 bp, Homo sapiens
acagaaaactcccaatacaaag

SEQ ID NO: 4660738 - DNA, 12 bp, Homo sapiens
acagaaaattta

SEQ ID NO: 4660739 - DNA, 13 bp, Homo sapiens
acagaaaatttaa

SEQ ID NO: 4660740 - DNA, 14 bp, Homo sapiens
acagaaagaccctg

SEQ ID NO: 4660741 - DNA, 23 bp, Homo sapiens
acagaaagccaggagcagccctg

SEQ ID NO: 4660742 - DNA, 14 bp, Homo sapiens
acagaacagggtca

SEQ ID NO: 4660743 - DNA, 14 bp, Homo sapiens
acagacaagcagcc

SEQ ID NO: 4660744 - DNA, 18 bp, Homo sapiens
acagacaagcagcccttg

SEQ ID NO: 4660745 - DNA, 14 bp, Homo sapiens
acagacactaactt

SEQ ID NO: 4660746 - DNA, 20 bp, Homo sapiens
acagacgttaggcatttcct

SEQ ID NO: 4660747 - DNA, 21 bp, Homo sapiens
acagacgttaggcatttcctg

SEQ ID NO: 4660748 - DNA, 17 bp, Homo sapiens
acagactcctgaggaca

SEQ ID NO: 4660749 - DNA, 23 bp, Homo sapiens
acagactcctgaggacagctgtc

SEQ ID NO: 4660750 - DNA, 13 bp, Homo sapiens
acagactgaaagg

SEQ ID NO: 4660751 - DNA, 19 bp, Homo sapiens
acagactgaccttgatgag

SEQ ID NO: 4660752 - DNA, 12 bp, Homo sapiens
acagactgtagc

SEQ ID NO: 4660753 - DNA, 19 bp, Homo sapiens
acagactgttgtccctgca

SEQ ID NO: 4660754 - DNA, 20 bp, Homo sapiens
acagacttgaaggagtttaa

SEQ ID NO: 4660755 - DNA, 22 bp, Homo sapiens
acagagaagtttgtagccaggt

SEQ ID NO: 4660756 - DNA, 12 bp, Homo sapiens
acagaggggagc

SEQ ID NO: 4660757 - DNA, 18 bp, Homo sapiens
acagagtggcctccctgc

SEQ ID NO: 4660758 - DNA, 20 bp, Homo sapiens
acagagtggcctccctgctg

SEQ ID NO: 4660759 - DNA, 21 bp, Homo sapiens
acagagtggcctccctgctgt

SEQ ID NO: 4660760 - DNA, 15 bp, Homo sapiens
acagagtgggccccg

SEQ ID NO: 4660761 - DNA, 20 bp, Homo sapiens
acagatgcaatgtgctactg

SEQ ID NO: 4660762 - DNA, 20 bp, Homo sapiens
acagatgtttgttttcaaaa

SEQ ID NO: 4660763 - DNA, 17 bp, Homo sapiens
acagattatcacattaa

SEQ ID NO: 4660764 - DNA, 16 bp, Homo sapiens
acagcaagtcagggtt

SEQ ID NO: 4660765 - DNA, 15 bp, Homo sapiens
acagcaattcctcag

SEQ ID NO: 4660766 - DNA, 17 bp, Homo sapiens
acagcaattcctcaggc

SEQ ID NO: 4660767 - DNA, 19 bp, Homo sapiens
acagcaattcctcaggcta

SEQ ID NO: 4660768 - DNA, 18 bp, Homo sapiens
acagcaccaaaggctcag

SEQ ID NO: 4660769 - DNA, 16 bp, Homo sapiens
acagcactactgggtg

SEQ ID NO: 4660770 - DNA, 17 bp, Homo sapiens
acagcactactgggtgt

SEQ ID NO: 4660771 - DNA, 22 bp, Homo sapiens
acagcagcctggggctggcctc

SEQ ID NO: 4660772 - DNA, 21 bp, Homo sapiens
acagcaggatcgaagggtttt

SEQ ID NO: 4660773 - DNA, 12 bp, Homo sapiens
acagcaggcagc

SEQ ID NO: 4660774 - DNA, 20 bp, Homo sapiens
acagccaacacgcacctgcc

SEQ ID NO: 4660775 - DNA, 15 bp, Homo sapiens
acagccaagtgccaa

SEQ ID NO: 4660776 - DNA, 15 bp, Homo sapiens
acagcccaggatact

SEQ ID NO: 4660777 - DNA, 21 bp, Homo sapiens
acagcccaggatactggcaca

SEQ ID NO: 4660778 - DNA, 18 bp, Homo sapiens
acagcccttggcttgtgt

SEQ ID NO: 4660779 - DNA, 13 bp, Homo sapiens
acagcctctgact

SEQ ID NO: 4660780 - DNA, 15 bp, Homo sapiens
acagccttccctctg

SEQ ID NO: 4660781 - DNA, 18 bp, Homo sapiens
acagccttccctctgcat

SEQ ID NO: 4660782 - DNA, 21 bp, Homo sapiens
acagccttttttcctgggcca

SEQ ID NO: 4660783 - DNA, 22 bp, Homo sapiens
acagctaaccacttcgcacaca

SEQ ID NO: 4660784 - DNA, 19 bp, Homo sapiens
acagctcagcagacatcca

SEQ ID NO: 4660785 - DNA, 16 bp, Homo sapiens
acagctcagccagtgg

SEQ ID NO: 4660786 - DNA, 12 bp, Homo sapiens
acagctcctgcc

SEQ ID NO: 4660787 - DNA, 13 bp, Homo sapiens
acagctcctgcca

SEQ ID NO: 4660788 - DNA, 16 bp, Homo sapiens
acagctgagcacttag

SEQ ID NO: 4660789 - DNA, 18 bp, Homo sapiens
acagctggaggaatacat

SEQ ID NO: 4660790 - DNA, 13 bp, Homo sapiens
acagctgtgcctc

SEQ ID NO: 4660791 - DNA, 18 bp, Homo sapiens
acagcttcctttcctgtg

SEQ ID NO: 4660792 - DNA, 20 bp, Homo sapiens
acagctttgtatgtttatga

SEQ ID NO: 4660793 - DNA, 14 bp, Homo sapiens
acagcttttcttga

SEQ ID NO: 4660794 - DNA, 17 bp, Homo sapiens
acaggaaaagagggaga

SEQ ID NO: 4660795 - DNA, 14 bp, Homo sapiens
acaggaccctcagg

SEQ ID NO: 4660796 - DNA, 15 bp, Homo sapiens
acaggaccctcagga

SEQ ID NO: 4660797 - DNA, 17 bp, Homo sapiens
acaggaccctcaggaat

SEQ ID NO: 4660798 - DNA, 22 bp, Homo sapiens
acaggactaacactcagaagcc

SEQ ID NO: 4660799 - DNA, 22 bp, Homo sapiens
acaggactggttccttccttag

SEQ ID NO: 4660800 - DNA, 13 bp, Homo sapiens
acaggagctacct

SEQ ID NO: 4660801 - DNA, 15 bp, Homo sapiens
acaggatgctttggt

SEQ ID NO: 4660802 - DNA, 17 bp, Homo sapiens
acaggcatttcctgggt

SEQ ID NO: 4660803 - DNA, 13 bp, Homo sapiens
acaggcctgcagc

SEQ ID NO: 4660804 - DNA, 16 bp, Homo sapiens
acaggcctgcagcccc

SEQ ID NO: 4660805 - DNA, 20 bp, Homo sapiens
acaggcctgtgtagctgtga

SEQ ID NO: 4660806 - DNA, 14 bp, Homo sapiens
acaggctgaagaga

SEQ ID NO: 4660807 - DNA, 12 bp, Homo sapiens
acagggaaggca

SEQ ID NO: 4660808 - DNA, 14 bp, Homo sapiens
acagggaaggcagg

SEQ ID NO: 4660809 - DNA, 17 bp, Homo sapiens
acagggaaggcaggcag

SEQ ID NO: 4660810 - DNA, 20 bp, Homo sapiens
acagggaaggcaggcagggc

SEQ ID NO: 4660811 - DNA, 20 bp, Homo sapiens
acagggccagtggggcctgt

SEQ ID NO: 4660812 - DNA, 21 bp, Homo sapiens
acagggccagtggggcctgtg

SEQ ID NO: 4660813 - DNA, 13 bp, Homo sapiens
acaggtgtgcacc

SEQ ID NO: 4660814 - DNA, 19 bp, Homo sapiens
acagtaatgaaatgtttac

SEQ ID NO: 4660815 - DNA, 19 bp, Homo sapiens
acagtacagcatgtgcctt

SEQ ID NO: 4660816 - DNA, 19 bp, Homo sapiens
acagtagaactgtctgtga

SEQ ID NO: 4660817 - DNA, 16 bp, Homo sapiens
acagtagctcttagac

SEQ ID NO: 4660818 - DNA, 19 bp, Homo sapiens
acagtcatcatcagggcct

SEQ ID NO: 4660819 - DNA, 20 bp, Homo sapiens
acagtcatcatcagggcctg

SEQ ID NO: 4660820 - DNA, 21 bp, Homo sapiens
acagtcatcatcagggcctgg

SEQ ID NO: 4660821 - DNA, 18 bp, Homo sapiens
acatttcattgtacaagt

SEQ ID NO: 4660822 - DNA, 17 bp, Homo sapiens
acatttgatgcatgtct

SEQ ID NO: 4660823 - DNA, 16 bp, Homo sapiens
acatttgtaagtgtaa

SEQ ID NO: 4660824 - DNA, 21 bp, Homo sapiens
acatttgtagcatcctcttta

SEQ ID NO: 4660825 - DNA, 23 bp, Homo sapiens
acattttaaaatgtttaaattct

SEQ ID NO: 4660826 - DNA, 14 bp, Homo sapiens
acattttatgagag

SEQ ID NO: 4660827 - DNA, 17 bp, Homo sapiens
acattttcagtaccaaa

SEQ ID NO: 4660828 - DNA, 19 bp, Homo sapiens
acattttcagtaccaaaga

SEQ ID NO: 4660829 - DNA, 19 bp, Homo sapiens
acattttctaaataaaaat

SEQ ID NO: 4660830 - DNA, 12 bp, Homo sapiens
acattttcttaa

SEQ ID NO: 4660831 - DNA, 13 bp, Homo sapiens
acattttcttaat

SEQ ID NO: 4660832 - DNA, 14 bp, Homo sapiens
acattttgtaaaat

SEQ ID NO: 4660833 - DNA, 14 bp, Homo sapiens
acatttttaaattg

SEQ ID NO: 4660834 - DNA, 21 bp, Homo sapiens
acatttttcagatataaaaga

SEQ ID NO: 4660835 - DNA, 18 bp, Homo sapiens
acatttttttatgctctt

SEQ ID NO: 4660836 - DNA, 22 bp, Homo sapiens
acatttttttatgctcttgaaa

SEQ ID NO: 4660837 - DNA, 15 bp, Homo sapiens
accaaagaaacacca

SEQ ID NO: 4660838 - DNA, 19 bp, Homo sapiens
accaaatggttcttacttt

SEQ ID NO: 4660839 - DNA, 19 bp, Homo sapiens
accaacctgaagacaccgt

SEQ ID NO: 4660840 - DNA, 14 bp, Homo sapiens
accaacctgaccta

SEQ ID NO: 4660841 - DNA, 24 bp, Homo sapiens
accaagaagcctttcctgtagcct

SEQ ID NO: 4660842 - DNA, 17 bp, Homo sapiens
accaagcagtggccttt

SEQ ID NO: 4660843 - DNA, 15 bp, Homo sapiens
accaaggccctgcat

SEQ ID NO: 4660844 - DNA, 13 bp, Homo sapiens
accaaggccctgt

SEQ ID NO: 4660845 - DNA, 14 bp, Homo sapiens
accaaggccctgtc

SEQ ID NO: 4660846 - DNA, 22 bp, Homo sapiens
accaatggattcatggagtagc

SEQ ID NO: 4660847 - DNA, 20 bp, Homo sapiens
accaattacatggaactttt

SEQ ID NO: 4660848 - DNA, 20 bp, Homo sapiens
accaattcacccactccctt

SEQ ID NO: 4660849 - DNA, 15 bp, Homo sapiens
accacagcacagcca

SEQ ID NO: 4660850 - DNA, 18 bp, Homo sapiens
accacggttatttaagca

SEQ ID NO: 4660851 - DNA, 17 bp, Homo sapiens
accacgtctggctccct

SEQ ID NO: 4660852 - DNA, 19 bp, Homo sapiens
accacgtctggctccctgc

SEQ ID NO: 4660853 - DNA, 20 bp, Homo sapiens
accacgtctggctccctgcc

SEQ ID NO: 4660854 - DNA, 22 bp, Homo sapiens
accacgtctggctccctgcccc

SEQ ID NO: 4660855 - DNA, 17 bp, Homo sapiens
accactctggcagccac

SEQ ID NO: 4660856 - DNA, 20 bp, Homo sapiens
accactctggcagccacact

SEQ ID NO: 4660857 - DNA, 18 bp, Homo sapiens
accactcttttgctgtgc

SEQ ID NO: 4660858 - DNA, 12 bp, Homo sapiens
accacttaatct

SEQ ID NO: 4660859 - DNA, 16 bp, Homo sapiens
accacttcgcacacac

SEQ ID NO: 4660860 - DNA, 16 bp, Homo sapiens
accacttctccatgct

SEQ ID NO: 4660861 - DNA, 21 bp, Homo sapiens
accagaacgtggtttgcctga

SEQ ID NO: 4660862 - DNA, 21 bp, Homo sapiens
accagactacttgggagcacc

SEQ ID NO: 4660863 - DNA, 14 bp, Homo sapiens
accagcccagatgt

SEQ ID NO: 4660864 - DNA, 22 bp, Homo sapiens
accagcccgacagtgccatccc

SEQ ID NO: 4660865 - DNA, 13 bp, Homo sapiens
accagcctgctga

SEQ ID NO: 4660866 - DNA, 15 bp, Homo sapiens
accagcctgctgaca

SEQ ID NO: 4660867 - DNA, 19 bp, Homo sapiens
accagctgctgtgccccac

SEQ ID NO: 4660868 - DNA, 20 bp, Homo sapiens
accagcttcactctctccgt

SEQ ID NO: 4660869 - DNA, 18 bp, Homo sapiens
accaggatggagcaagct

SEQ ID NO: 4660870 - DNA, 23 bp, Homo sapiens
accagggaagaagatcaacgcct

SEQ ID NO: 4660871 - DNA, 14 bp, Homo sapiens
accagggatgctgg

SEQ ID NO: 4660872 - DNA, 21 bp, Homo sapiens
accagggatgctgggctgggc

SEQ ID NO: 4660873 - DNA, 14 bp, Homo sapiens
accagggccagagc

SEQ ID NO: 4660874 - DNA, 15 bp, Homo sapiens
accagggccagagca

SEQ ID NO: 4660875 - DNA, 18 bp, Homo sapiens
accagggccagagcagct

SEQ ID NO: 4660876 - DNA, 15 bp, Homo sapiens
accagggctgctctt

SEQ ID NO: 4660877 - DNA, 16 bp, Homo sapiens
accaggggaaggaagg

SEQ ID NO: 4660878 - DNA, 17 bp, Homo sapiens
accaggggaggagcctg

SEQ ID NO: 4660879 - DNA, 22 bp, Homo sapiens
accagtctagtccgtcctggca

SEQ ID NO: 4660880 - DNA, 23 bp, Homo sapiens
accagtctagtccgtcctggcac

SEQ ID NO: 4660881 - DNA, 20 bp, Homo sapiens
accagtgcatcacatctgca

SEQ ID NO: 4660882 - DNA, 13 bp, Homo sapiens
accagtgccaagg

SEQ ID NO: 4660883 - DNA, 16 bp, Homo sapiens
accagtgccaaggacc

SEQ ID NO: 4660884 - DNA, 19 bp, Homo sapiens
accagtgggactgtggtga

SEQ ID NO: 4660885 - DNA, 14 bp, Homo sapiens
accatacatttaaa

SEQ ID NO: 4660886 - DNA, 23 bp, Homo sapiens
accatatactgttcttcatttta

SEQ ID NO: 4660887 - DNA, 13 bp, Homo sapiens
accatcttaatct

SEQ ID NO: 4660888 - DNA, 15 bp, Homo sapiens
accatcttaatcttt

SEQ ID NO: 4660889 - DNA, 16 bp, Homo sapiens
accatcttaatcttta

SEQ ID NO: 4660890 - DNA, 21 bp, Homo sapiens
accatcttaatctttatttta

SEQ ID NO: 4660891 - DNA, 19 bp, Homo sapiens
accatgcctggtattttca

SEQ ID NO: 4660892 - DNA, 19 bp, Homo sapiens
accatgccttttttttaag

SEQ ID NO: 4660893 - DNA, 15 bp, Homo sapiens
accattgaactgtac

SEQ ID NO: 4660894 - DNA, 17 bp, Homo sapiens
acccaaagcggtccctg

SEQ ID NO: 4660895 - DNA, 20 bp, Homo sapiens
acccaaagcggtccctgtcc

SEQ ID NO: 4660896 - DNA, 23 bp, Homo sapiens
acccacatgccatttgtactgac

SEQ ID NO: 4660897 - DNA, 22 bp, Homo sapiens
acccacccaaaagtcacccagg

SEQ ID NO: 4660898 - DNA, 17 bp, Homo sapiens
acccaccccctgcctgg

SEQ ID NO: 4660899 - DNA, 21 bp, Homo sapiens
acccaccccctgcctggttct

SEQ ID NO: 4660900 - DNA, 20 bp, Homo sapiens
acccagcatctcccagcaag

SEQ ID NO: 4660901 - DNA, 16 bp, Homo sapiens
acccagccccttcccc

SEQ ID NO: 4660902 - DNA, 17 bp, Homo sapiens
acccagccccttcccct

SEQ ID NO: 4660903 - DNA, 16 bp, Homo sapiens
acccaggaaaggagga

SEQ ID NO: 4660904 - DNA, 16 bp, Homo sapiens
acccaggacaagcatg

SEQ ID NO: 4660905 - DNA, 11 bp, Homo sapiens
acccaggctgg

SEQ ID NO: 4660906 - DNA, 19 bp, Homo sapiens
acccaggctggagtgcagt

SEQ ID NO: 4660907 - DNA, 15 bp, Homo sapiens
acccagggtggagtg

SEQ ID NO: 4660908 - DNA, 20 bp, Homo sapiens
acccagggtggagtgcagtg

SEQ ID NO: 4660909 - DNA, 15 bp, Homo sapiens
acccagtctcctctc

SEQ ID NO: 4660910 - DNA, 19 bp, Homo sapiens
acccagtctcctctccatt

SEQ ID NO: 4660911 - DNA, 14 bp, Homo sapiens
acccatagaaaact

SEQ ID NO: 4660912 - DNA, 15 bp, Homo sapiens
acccatctctccctt

SEQ ID NO: 4660913 - DNA, 20 bp, Homo sapiens
acccatgagttggggtctgg

SEQ ID NO: 4660914 - DNA, 20 bp, Homo sapiens
accccaacctctgttcccca

SEQ ID NO: 4660915 - DNA, 15 bp, Homo sapiens
accccacccttgccc

SEQ ID NO: 4660916 - DNA, 17 bp, Homo sapiens
accccacttatccctct

SEQ ID NO: 4660917 - DNA, 18 bp, Homo sapiens
accccacttatccctctc

SEQ ID NO: 4660918 - DNA, 16 bp, Homo sapiens
accccagctgctctaa

SEQ ID NO: 4660919 - DNA, 19 bp, Homo sapiens
accccagggcacaggagct

SEQ ID NO: 4660920 - DNA, 10 bp, Homo sapiens
accccagtca

SEQ ID NO: 4660921 - DNA, 17 bp, Homo sapiens
accccagtcaagctcct

SEQ ID NO: 4660922 - DNA, 18 bp, Homo sapiens
accccagtcaagctccta

SEQ ID NO: 4660923 - DNA, 23 bp, Homo sapiens
accccatatattaccccttcatg

SEQ ID NO: 4660924 - DNA, 20 bp, Homo sapiens
acccccacaagctgtccctg

SEQ ID NO: 4660925 - DNA, 22 bp, Homo sapiens
acccccacaagctgtccctgca

SEQ ID NO: 4660926 - DNA, 16 bp, Homo sapiens
acccccacccccacca

SEQ ID NO: 4660927 - DNA, 12 bp, Homo sapiens
acccccagcctg

SEQ ID NO: 4660928 - DNA, 17 bp, Homo sapiens
acccccagcctgggcct

SEQ ID NO: 4660929 - DNA, 18 bp, Homo sapiens
acccccagctccggcctg

SEQ ID NO: 4660930 - DNA, 14 bp, Homo sapiens
accccctgcctggt

SEQ ID NO: 4660931 - DNA, 12 bp, Homo sapiens
acctgccctcta

SEQ ID NO: 4660932 - DNA, 18 bp, Homo sapiens
acctgccctctatttatt

SEQ ID NO: 4660933 - DNA, 13 bp, Homo sapiens
acctgcctcagga

SEQ ID NO: 4660934 - DNA, 19 bp, Homo sapiens
acctgcgcaagtgcctggg

SEQ ID NO: 4660935 - DNA, 20 bp, Homo sapiens
acctgcgcaagtgcctggga

SEQ ID NO: 4660936 - DNA, 13 bp, Homo sapiens
acctgctgagctc

SEQ ID NO: 4660937 - DNA, 16 bp, Homo sapiens
acctgctgagctctga

SEQ ID NO: 4660938 - DNA, 17 bp, Homo sapiens
acctgctgagctctgag

SEQ ID NO: 4660939 - DNA, 20 bp, Homo sapiens
acctgctgagctctgagagg

SEQ ID NO: 4660940 - DNA, 17 bp, Homo sapiens
acctggccttaaagagg

SEQ ID NO: 4660941 - DNA, 22 bp, Homo sapiens
acctggccttaaagagggacag

SEQ ID NO: 4660942 - DNA, 16 bp, Homo sapiens
acctggctgccatact

SEQ ID NO: 4660943 - DNA, 12 bp, Homo sapiens
acctgggaccaa

SEQ ID NO: 4660944 - DNA, 19 bp, Homo sapiens
acctgggaccaacctgacc

SEQ ID NO: 4660945 - DNA, 20 bp, Homo sapiens
acctgggaccaacctgacct

SEQ ID NO: 4660946 - DNA, 13 bp, Homo sapiens
acctgggccctgg

SEQ ID NO: 4660947 - DNA, 18 bp, Homo sapiens
acctgggccctggggcct

SEQ ID NO: 4660948 - DNA, 19 bp, Homo sapiens
acctgggccctggggcctg

SEQ ID NO: 4660949 - DNA, 16 bp, Homo sapiens
acctgtccaagacagg

SEQ ID NO: 4660950 - DNA, 20 bp, Homo sapiens
acctgtccccaccctccact

SEQ ID NO: 4660951 - DNA, 12 bp, Homo sapiens
acctgtctctct

SEQ ID NO: 4660952 - DNA, 13 bp, Homo sapiens
acctgtctctctc

SEQ ID NO: 4660953 - DNA, 18 bp, Homo sapiens
acctgtgagcccagctgg

SEQ ID NO: 4660954 - DNA, 13 bp, Homo sapiens
acctgtgggtgta

SEQ ID NO: 4660955 - DNA, 17 bp, Homo sapiens
acctgttcttagagtgt

SEQ ID NO: 4660956 - DNA, 22 bp, Homo sapiens
acctgttcttagagtgtagctg

SEQ ID NO: 4660957 - DNA, 18 bp, Homo sapiens
acctgttttgttaatgct

SEQ ID NO: 4660958 - DNA, 15 bp, Homo sapiens
accttaaaatgtgta

SEQ ID NO: 4660959 - DNA, 20 bp, Homo sapiens
accttagccccattgctcca

SEQ ID NO: 4660960 - DNA, 13 bp, Homo sapiens
accttctcccagg

SEQ ID NO: 4660961 - DNA, 20 bp, Homo sapiens
accttctcccaggcctctgc

SEQ ID NO: 4660962 - DNA, 21 bp, Homo sapiens
accttctcccaggcctctgcc

SEQ ID NO: 4660963 - DNA, 18 bp, Homo sapiens
accttgtggataagtggc

SEQ ID NO: 4660964 - DNA, 21 bp, Homo sapiens
accttgtgtctgtacacgtgt

SEQ ID NO: 4660965 - DNA, 17 bp, Homo sapiens
accttgttatttctcag

SEQ ID NO: 4660966 - DNA, 17 bp, Homo sapiens
acctttgggactaagct

SEQ ID NO: 4660967 - DNA, 22 bp, Homo sapiens
acctttttataaagatcattta

SEQ ID NO: 4660968 - DNA, 15 bp, Homo sapiens
acgaataaacgcaga

SEQ ID NO: 4660969 - DNA, 20 bp, Homo sapiens
acgaataaacgcagaagagg

SEQ ID NO: 4660970 - DNA, 21 bp, Homo sapiens
acgaataaacgcagaagaggg

SEQ ID NO: 4660971 - DNA, 12 bp, Homo sapiens
acgagacaacag

SEQ ID NO: 4660972 - DNA, 22 bp, Homo sapiens
acgagacaacagcacacaggca

SEQ ID NO: 4660973 - DNA, 18 bp, Homo sapiens
acgagccacaagctgcac

SEQ ID NO: 4660974 - DNA, 14 bp, Homo sapiens
acgagggcaacagg

SEQ ID NO: 4660975 - DNA, 18 bp, Homo sapiens
acgcaattttacctagtt

SEQ ID NO: 4660976 - DNA, 19 bp, Homo sapiens
acgcaattttacctagttt

SEQ ID NO: 4660977 - DNA, 16 bp, Homo sapiens
acgcacacagctgagc

SEQ ID NO: 4660978 - DNA, 16 bp, Homo sapiens
acgcacctgcctcagg

SEQ ID NO: 4660979 - DNA, 17 bp, Homo sapiens
acgcacctgcctcagga

SEQ ID NO: 4660980 - DNA, 23 bp, Homo sapiens
acgcaggtatttagaagcagagg

SEQ ID NO: 4660981 - DNA, 19 bp, Homo sapiens
acgccaatgttatgccagc

SEQ ID NO: 4660982 - DNA, 21 bp, Homo sapiens
acgccaatgttatgccagctc

SEQ ID NO: 4660983 - DNA, 23 bp, Homo sapiens
acgccaatgttatgccagctcca

SEQ ID NO: 4660984 - DNA, 18 bp, Homo sapiens
acgccagataaaatgttc

SEQ ID NO: 4660985 - DNA, 21 bp, Homo sapiens
acgccgtcccaccagcttcac

SEQ ID NO: 4660986 - DNA, 18 bp, Homo sapiens
acgcctcactgaaacatg

SEQ ID NO: 4660987 - DNA, 15 bp, Homo sapiens
acgcctgagcccagg

SEQ ID NO: 4660988 - DNA, 16 bp, Homo sapiens
acgcctgagcccaggg

SEQ ID NO: 4660989 - DNA, 19 bp, Homo sapiens
acgcctgagcccagggagg

SEQ ID NO: 4660990 - DNA, 12 bp, Homo sapiens
acgcgggagcca

SEQ ID NO: 4660991 - DNA, 15 bp, Homo sapiens
acgctctctactctg

SEQ ID NO: 4660992 - DNA, 11 bp, Homo sapiens
acgctgcctct

SEQ ID NO: 4660993 - DNA, 20 bp, Homo sapiens
acgctgcctctcattggcac

SEQ ID NO: 4660994 - DNA, 21 bp, Homo sapiens
acgctggccaatttttgtact

SEQ ID NO: 4660995 - DNA, 19 bp, Homo sapiens
acggaggtcctttggacag

SEQ ID NO: 4660996 - DNA, 19 bp, Homo sapiens
acggatgcgtgggcagagg

SEQ ID NO: 4660997 - DNA, 20 bp, Homo sapiens
acggatgcgtgggcagagga

SEQ ID NO: 4660998 - DNA, 21 bp, Homo sapiens
acggatgcgtgggcagaggaa

SEQ ID NO: 4660999 - DNA, 15 bp, Homo sapiens
acggcactgtggcct

SEQ ID NO: 4661000 - DNA, 15 bp, Homo sapiens
acggccatctctttg

SEQ ID NO: 4661001 - DNA, 20 bp, Homo sapiens
acggccatctctttgtacag

SEQ ID NO: 4661002 - DNA, 20 bp, Homo sapiens
acggccctccttcttttcct

SEQ ID NO: 4661003 - DNA, 22 bp, Homo sapiens
acggcctggctggtgggaaggc

SEQ ID NO: 4661004 - DNA, 22 bp, Homo sapiens
acggcgcctttttggcctgtga

SEQ ID NO: 4661005 - DNA, 21 bp, Homo sapiens
acggctggcatggtggctccc

SEQ ID NO: 4661006 - DNA, 19 bp, Homo sapiens
acggtctggcagggcagca

SEQ ID NO: 4661007 - DNA, 15 bp, Homo sapiens
acggtgttttgccat

SEQ ID NO: 4661008 - DNA, 17 bp, Homo sapiens
acggtgttttgccatgt

SEQ ID NO: 4661009 - DNA, 15 bp, Homo sapiens
acggtttcagctaga

SEQ ID NO: 4661010 - DNA, 17 bp, Homo sapiens
acggttttggcagctga

SEQ ID NO: 4661011 - DNA, 15 bp, Homo sapiens
acgtaatcctcctga

SEQ ID NO: 4661012 - DNA, 16 bp, Homo sapiens
acgtaatcctcctgag

SEQ ID NO: 4661013 - DNA, 18 bp, Homo sapiens
acgtagggggcaggggca

SEQ ID NO: 4661014 - DNA, 14 bp, Homo sapiens
acgtatgcatgtga

SEQ ID NO: 4661015 - DNA, 15 bp, Homo sapiens
acgtattacaaacaa

SEQ ID NO: 4661016 - DNA, 15 bp, Homo sapiens
acgtatttttctgac

SEQ ID NO: 4661017 - DNA, 17 bp, Homo sapiens
acgtcatgagcgtcaaa

SEQ ID NO: 4661018 - DNA, 21 bp, Homo sapiens
acgtcccagcatccctggagc

SEQ ID NO: 4661019 - DNA, 17 bp, Homo sapiens
acgtctggactgctatt

SEQ ID NO: 4661020 - DNA, 16 bp, Homo sapiens
acgtctggctccctgc

SEQ ID NO: 4661021 - DNA, 17 bp, Homo sapiens
acgtctggctccctgcc

SEQ ID NO: 4661022 - DNA, 20 bp, Homo sapiens
acgtctggctccctgcccct

SEQ ID NO: 4661023 - DNA, 15 bp, Homo sapiens
acgtgagagaaagag

SEQ ID NO: 4661024 - DNA, 20 bp, Homo sapiens
acgtgagagaaagagagaag

SEQ ID NO: 4661025 - DNA, 22 bp, Homo sapiens
acgtgagagaaagagagaagcc

SEQ ID NO: 4661026 - DNA, 19 bp, Homo sapiens
acgtgattttgctgtagaa

SEQ ID NO: 4661027 - DNA, 22 bp, Homo sapiens
acgtggatgggcaaagcttgtc

SEQ ID NO: 4661028 - DNA, 17 bp, Homo sapiens
acgtggctcagccagca

SEQ ID NO: 4661029 - DNA, 19 bp, Homo sapiens
acgtggctcagccagcact

SEQ ID NO: 4661030 - DNA, 20 bp, Homo sapiens
acgtggtctagaccagggct

SEQ ID NO: 4661031 - DNA, 17 bp, Homo sapiens
acgtgtatagtatctgt

SEQ ID NO: 4661032 - DNA, 15 bp, Homo sapiens
acgtgtgaaatctgt

SEQ ID NO: 4661033 - DNA, 21 bp, Homo sapiens
acgtgtgaaatctgtctttgc

SEQ ID NO: 4661034 - DNA, 16 bp, Homo sapiens
acgttaggcatttcct

SEQ ID NO: 4661035 - DNA, 19 bp, Homo sapiens
acgttaggcatttcctgct

SEQ ID NO: 4661036 - DNA, 18 bp, Homo sapiens
acgtttccccgaagagtc

SEQ ID NO: 4661037 - DNA, 13 bp, Homo sapiens
actaaactttatt

SEQ ID NO: 4661038 - DNA, 18 bp, Homo sapiens
actaaactttatttgtaa

SEQ ID NO: 4661039 - DNA, 16 bp, Homo sapiens
actaaataaacacgat

SEQ ID NO: 4661040 - DNA, 18 bp, Homo sapiens
actgaaaacatctggaag

SEQ ID NO: 4661041 - DNA, 11 bp, Homo sapiens
actgaaaatga

SEQ ID NO: 4661042 - DNA, 23 bp, Homo sapiens
actgaaccacaaaaaaaaaggct

SEQ ID NO: 4661043 - DNA, 22 bp, Homo sapiens
actgaagataatgaaatagtta

SEQ ID NO: 4661044 - DNA, 17 bp, Homo sapiens
actgaagcgaacatctt

SEQ ID NO: 4661045 - DNA, 19 bp, Homo sapiens
actgaaggaaaagcaagaa

SEQ ID NO: 4661046 - DNA, 20 bp, Homo sapiens
actgaaggaaaagcaagaaa

SEQ ID NO: 4661047 - DNA, 23 bp, Homo sapiens
actgaaggaaaagcaagaaacag

SEQ ID NO: 4661048 - DNA, 14 bp, Homo sapiens
actgaaggctttca

SEQ ID NO: 4661049 - DNA, 18 bp, Homo sapiens
actgaataatatcaaata

SEQ ID NO: 4661050 - DNA, 22 bp, Homo sapiens
actgaccaatattgtacagttt

SEQ ID NO: 4661051 - DNA, 17 bp, Homo sapiens
actgaccggtgctttta

SEQ ID NO: 4661052 - DNA, 19 bp, Homo sapiens
actgaccggtgcttttatt

SEQ ID NO: 4661053 - DNA, 13 bp, Homo sapiens
actgaccttgatg

SEQ ID NO: 4661054 - DNA, 21 bp, Homo sapiens
actgactatcataaaatcaaa

SEQ ID NO: 4661055 - DNA, 14 bp, Homo sapiens
actgagagaaagat

SEQ ID NO: 4661056 - DNA, 20 bp, Homo sapiens
actgagatccttccttttga

SEQ ID NO: 4661057 - DNA, 12 bp, Homo sapiens
actgaggcccac

SEQ ID NO: 4661058 - DNA, 17 bp, Homo sapiens
actgatgttgtgttttt

SEQ ID NO: 4661059 - DNA, 18 bp, Homo sapiens
actgatgttgtgttttta

SEQ ID NO: 4661060 - DNA, 13 bp, Homo sapiens
actgattaaatat

SEQ ID NO: 4661061 - DNA, 18 bp, Homo sapiens
actgattgctcccaggat

SEQ ID NO: 4661062 - DNA, 16 bp, Homo sapiens
actgcactccagcctg

SEQ ID NO: 4661063 - DNA, 19 bp, Homo sapiens
actgcactttccaatgcca

SEQ ID NO: 4661064 - DNA, 23 bp, Homo sapiens
actgcactttccaatgccacaga

SEQ ID NO: 4661065 - DNA, 17 bp, Homo sapiens
actgcagagtaaattgc

SEQ ID NO: 4661066 - DNA, 20 bp, Homo sapiens
actgcagagtaaattgctct

SEQ ID NO: 4661067 - DNA, 15 bp, Homo sapiens
actgcagcacctcca

SEQ ID NO: 4661068 - DNA, 16 bp, Homo sapiens
actgcagcacctccag

SEQ ID NO: 4661069 - DNA, 15 bp, Homo sapiens
actgcattattctct

SEQ ID NO: 4661070 - DNA, 16 bp, Homo sapiens
actgcattctctccca

SEQ ID NO: 4661071 - DNA, 17 bp, Homo sapiens
actgcattctctcccat

SEQ ID NO: 4661072 - DNA, 21 bp, Homo sapiens
actgcattctctcccatcctg

SEQ ID NO: 4661073 - DNA, 21 bp, Homo sapiens
actgcattgactttcagtaaa

SEQ ID NO: 4661074 - DNA, 18 bp, Homo sapiens
actgccaagccagattct

SEQ ID NO: 4661075 - DNA, 22 bp, Homo sapiens
actgccaagccagattctcttg

SEQ ID NO: 4661076 - DNA, 19 bp, Homo sapiens
actgcccatggacaggctg

SEQ ID NO: 4661077 - DNA, 20 bp, Homo sapiens
actgccccacgttgtccctg

SEQ ID NO: 4661078 - DNA, 16 bp, Homo sapiens
actgccctgcccaggt

SEQ ID NO: 4661079 - DNA, 22 bp, Homo sapiens
actgcctataatcttatacaac

SEQ ID NO: 4661080 - DNA, 9 bp, Homo sapiens
actgcctgc

SEQ ID NO: 4661081 - DNA, 15 bp, Homo sapiens
actgctaatgcaaat

SEQ ID NO: 4661082 - DNA, 18 bp, Homo sapiens
actgctattctagagctt

SEQ ID NO: 4661083 - DNA, 19 bp, Homo sapiens
actgctattctagagcttt

SEQ ID NO: 4661084 - DNA, 21 bp, Homo sapiens
actgctattctagagctttta

SEQ ID NO: 4661085 - DNA, 23 bp, Homo sapiens
actgctattctagagcttttatt

SEQ ID NO: 4661086 - DNA, 22 bp, Homo sapiens
actgctgcgtcattacagggca

SEQ ID NO: 4661087 - DNA, 16 bp, Homo sapiens
actgctgcttgtcaaa

SEQ ID NO: 4661088 - DNA, 20 bp, Homo sapiens
actgctgggggtgagctgta

SEQ ID NO: 4661089 - DNA, 16 bp, Homo sapiens
actgctttgcaaagac

SEQ ID NO: 4661090 - DNA, 13 bp, Homo sapiens
actggacagcatc

SEQ ID NO: 4661091 - DNA, 18 bp, Homo sapiens
actggacataacattttc

SEQ ID NO: 4661092 - DNA, 15 bp, Homo sapiens
actggaggcccctgg

SEQ ID NO: 4661093 - DNA, 18 bp, Homo sapiens
actggaggcccctggagc

SEQ ID NO: 4661094 - DNA, 21 bp, Homo sapiens
actggaggcccctggagccag

SEQ ID NO: 4661095 - DNA, 22 bp, Homo sapiens
actggaggcccctggagccaga

SEQ ID NO: 4661096 - DNA, 12 bp, Homo sapiens
actggcacagag

SEQ ID NO: 4661097 - DNA, 16 bp, Homo sapiens
actggccaagctgagg

SEQ ID NO: 4661098 - DNA, 16 bp, Homo sapiens
actggctgtgtgacct

SEQ ID NO: 4661099 - DNA, 20 bp, Homo sapiens
actgggccatgttgtgcctc

SEQ ID NO: 4661100 - DNA, 21 bp, Homo sapiens
actgggccttagtgggccagg

SEQ ID NO: 4661101 - DNA, 21 bp, Homo sapiens
actgggtaaaagcagggcagc

SEQ ID NO: 4661102 - DNA, 17 bp, Homo sapiens
actgggtatgcgtttca

SEQ ID NO: 4661103 - DNA, 17 bp, Homo sapiens
actgggtgtcatttcat

SEQ ID NO: 4661104 - DNA, 16 bp, Homo sapiens
actgggttcccatgct

SEQ ID NO: 4661105 - DNA, 22 bp, Homo sapiens
actggttaaaaaacaaatgttc

SEQ ID NO: 4661106 - DNA, 20 bp, Homo sapiens
actggttatcttgttattat

SEQ ID NO: 4661107 - DNA, 17 bp, Homo sapiens
actggttccttccttag

SEQ ID NO: 4661108 - DNA, 13 bp, Homo sapiens
actggttttctgc

SEQ ID NO: 4661109 - DNA, 20 bp, Homo sapiens
actgtaaagagaagtaattt

SEQ ID NO: 4661110 - DNA, 11 bp, Homo sapiens
actgtaaatca

SEQ ID NO: 4661111 - DNA, 15 bp, Homo sapiens
actgtagacactctg

SEQ ID NO: 4661112 - DNA, 18 bp, Homo sapiens
actgtagcttctcttgct

SEQ ID NO: 4661113 - DNA, 11 bp, Homo sapiens
actgtatactg

SEQ ID NO: 4661114 - DNA, 12 bp, Homo sapiens
actgtcctgtcc

SEQ ID NO: 4661115 - DNA, 17 bp, Homo sapiens
actgtcgccacacgcct

SEQ ID NO: 4661116 - DNA, 14 bp, Homo sapiens
actgtcgctgcttc

SEQ ID NO: 4661117 - DNA, 15 bp, Homo sapiens
actgtctgtgaacag

SEQ ID NO: 4661118 - DNA, 18 bp, Homo sapiens
actgtgaacagcttgctg

SEQ ID NO: 4661119 - DNA, 21 bp, Homo sapiens
actgtgaacttgactgggtga

SEQ ID NO: 4661120 - DNA, 16 bp, Homo sapiens
actgtggggtggacct

SEQ ID NO: 4661121 - DNA, 23 bp, Homo sapiens
actgtgggtcgtagagccttgac

SEQ ID NO: 4661122 - DNA, 23 bp, Homo sapiens
actgtgtctgaatcatgtctgta

SEQ ID NO: 4661123 - DNA, 13 bp, Homo sapiens
actgtgtgtgaat

SEQ ID NO: 4661124 - DNA, 14 bp, Homo sapiens
actgtgttactgct

SEQ ID NO: 4661125 - DNA, 19 bp, Homo sapiens
actgtgtttatatgtcttg

SEQ ID NO: 4661126 - DNA, 20 bp, Homo sapiens
actgtgtttgatttgtctca

SEQ ID NO: 4661127 - DNA, 12 bp, Homo sapiens
actgttacagac

SEQ ID NO: 4661128 - DNA, 15 bp, Homo sapiens
actgttcatacagtt

SEQ ID NO: 4661129 - DNA, 17 bp, Homo sapiens
actgttcatacagtttt

SEQ ID NO: 4661130 - DNA, 18 bp, Homo sapiens
actgttccagattcctat

SEQ ID NO: 4661131 - DNA, 19 bp, Homo sapiens
actgttctcaacatactgt

SEQ ID NO: 4661132 - DNA, 13 bp, Homo sapiens
actgttctgagaa

SEQ ID NO: 4661133 - DNA, 15 bp, Homo sapiens
actgttctgttctca

SEQ ID NO: 4661134 - DNA, 20 bp, Homo sapiens
actgtttcatctcagctttt

SEQ ID NO: 4661135 - DNA, 17 bp, Homo sapiens
actgtttccctgctgaa

SEQ ID NO: 4661136 - DNA, 22 bp, Homo sapiens
actgtttgtttttatttaaatt

SEQ ID NO: 4661137 - DNA, 17 bp, Homo sapiens
acttaaatattgtaata

SEQ ID NO: 4661138 - DNA, 18 bp, Homo sapiens
acttaaatattgtaatat

SEQ ID NO: 4661139 - DNA, 17 bp, Homo sapiens
acttaacatttcattgt

SEQ ID NO: 4661140 - DNA, 13 bp, Homo sapiens
acttaagctcccc

SEQ ID NO: 4661141 - DNA, 17 bp, Homo sapiens
acttaagctcccctgcc

SEQ ID NO: 4661142 - DNA, 10 bp, Homo sapiens
acttaatctt

SEQ ID NO: 4661143 - DNA, 14 bp, Homo sapiens
acttaatcttctct

SEQ ID NO: 4661144 - DNA, 23 bp, Homo sapiens
acttaatcttctctcttgattga

SEQ ID NO: 4661145 - DNA, 20 bp, Homo sapiens
acttaatttgtaaacttctg

SEQ ID NO: 4661146 - DNA, 17 bp, Homo sapiens
acttagacctgccagcc

SEQ ID NO: 4661147 - DNA, 18 bp, Homo sapiens
acttagacctgccagcca

SEQ ID NO: 4661148 - DNA, 22 bp, Homo sapiens
acttagccatgatggcaacaga

SEQ ID NO: 4661149 - DNA, 19 bp, Homo sapiens
acttatagttaatattttg

SEQ ID NO: 4661150 - DNA, 23 bp, Homo sapiens
acttatctcgaatttgaagagat

SEQ ID NO: 4661151 - DNA, 16 bp, Homo sapiens
acttatttataaaaag

SEQ ID NO: 4661152 - DNA, 11 bp, Homo sapiens
acttatttctg

SEQ ID NO: 4661153 - DNA, 20 bp, Homo sapiens
acttattttcagtgcatcat

SEQ ID NO: 4661154 - DNA, 21 bp, Homo sapiens
acttattttcagtgcatcatt

SEQ ID NO: 4661155 - DNA, 16 bp, Homo sapiens
acttcaaactgagatc

SEQ ID NO: 4661156 - DNA, 17 bp, Homo sapiens
acttcaagatgagcctg

SEQ ID NO: 4661157 - DNA, 21 bp, Homo sapiens
acttcaagatgagcctgggct

SEQ ID NO: 4661158 - DNA, 23 bp, Homo sapiens
acttcaagatgagcctgggctca

SEQ ID NO: 4661159 - DNA, 12 bp, Homo sapiens
acttcattttta

SEQ ID NO: 4661160 - DNA, 20 bp, Homo sapiens
acttcatttttaagaaagga

SEQ ID NO: 4661161 - DNA, 17 bp, Homo sapiens
acttccatggccctcat

SEQ ID NO: 4661162 - DNA, 20 bp, Homo sapiens
acttccccaagatctgccag

SEQ ID NO: 4661163 - DNA, 19 bp, Homo sapiens
acttccccctcttcttctg

SEQ ID NO: 4661164 - DNA, 19 bp, Homo sapiens
acttcctgactctcacctg

SEQ ID NO: 4661165 - DNA, 14 bp, Homo sapiens
acttccttttaact

SEQ ID NO: 4661166 - DNA, 13 bp, Homo sapiens
acttcgctcttga

SEQ ID NO: 4661167 - DNA, 14 bp, Homo sapiens
acttctaatttata

SEQ ID NO: 4661168 - DNA, 18 bp, Homo sapiens
acttctcaggacacaggc

SEQ ID NO: 4661169 - DNA, 14 bp, Homo sapiens
acttctccatgctg

SEQ ID NO: 4661170 - DNA, 13 bp, Homo sapiens
acttctgaagact

SEQ ID NO: 4661171 - DNA, 19 bp, Homo sapiens
acttctgatgtttattaaa

SEQ ID NO: 4661172 - DNA, 11 bp, Homo sapiens
acttctgctgc

SEQ ID NO: 4661173 - DNA, 13 bp, Homo sapiens
acttcttgtcaga

SEQ ID NO: 4661174 - DNA, 16 bp, Homo sapiens
acttcttgtcagacat

SEQ ID NO: 4661175 - DNA, 20 bp, Homo sapiens
acttcttgtcagacataaag

SEQ ID NO: 4661176 - DNA, 22 bp, Homo sapiens
acttcttgtcagacataaagcc

SEQ ID NO: 4661177 - DNA, 15 bp, Homo sapiens
acttctttttcatta

SEQ ID NO: 4661178 - DNA, 23 bp, Homo sapiens
acttgaagaaacagagtggcctc

SEQ ID NO: 4661179 - DNA, 17 bp, Homo sapiens
acttgactcttgaataa

SEQ ID NO: 4661180 - DNA, 14 bp, Homo sapiens
acttgagtgataat

SEQ ID NO: 4661181 - DNA, 14 bp, Homo sapiens
acttgcatttgatt

SEQ ID NO: 4661182 - DNA, 21 bp, Homo sapiens
acttgccctgtgttctttccc

SEQ ID NO: 4661183 - DNA, 11 bp, Homo sapiens
acttgcctcca

SEQ ID NO: 4661184 - DNA, 20 bp, Homo sapiens
acttgcctccatctttttct

SEQ ID NO: 4661185 - DNA, 22 bp, Homo sapiens
acttggaatcaaggtaagctca

SEQ ID NO: 4661186 - DNA, 23 bp, Homo sapiens
acttggaatcaaggtaagctcag

SEQ ID NO: 4661187 - DNA, 15 bp, Homo sapiens
acttgtcaaagaagg

SEQ ID NO: 4661188 - DNA, 16 bp, Homo sapiens
acttgtcaaagaaggt

SEQ ID NO: 4661189 - DNA, 18 bp, Homo sapiens
acttgtcaaagaaggttt

SEQ ID NO: 4661190 - DNA, 17 bp, Homo sapiens
acttgtcatatcactaa

SEQ ID NO: 4661191 - DNA, 18 bp, Homo sapiens
acttgtcccactatctgg

SEQ ID NO: 4661192 - DNA, 15 bp, Homo sapiens
acttgtctgcctcct

SEQ ID NO: 4661193 - DNA, 19 bp, Homo sapiens
acttgtctgcctcctgctt

SEQ ID NO: 4661194 - DNA, 20 bp, Homo sapiens
acttgtctgcctcctgcttt

SEQ ID NO: 4661195 - DNA, 18 bp, Homo sapiens
actttaaatcctaccaaa

SEQ ID NO: 4661196 - DNA, 15 bp, Homo sapiens
actttacaaaccttt

SEQ ID NO: 4661197 - DNA, 22 bp, Homo sapiens
actttacaaacctttgtttcaa

SEQ ID NO: 4661198 - DNA, 13 bp, Homo sapiens
actttatgtagtt

SEQ ID NO: 4661199 - DNA, 17 bp, Homo sapiens
actttattaaaagaatg

SEQ ID NO: 4661200 - DNA, 17 bp, Homo sapiens
actttattaagtaaaat

SEQ ID NO: 4661201 - DNA, 18 bp, Homo sapiens
actttattaagtaaaatc

SEQ ID NO: 4661202 - DNA, 12 bp, Homo sapiens
actttattatcc

SEQ ID NO: 4661203 - DNA, 15 bp, Homo sapiens
actttatttatttct

SEQ ID NO: 4661204 - DNA, 23 bp, Homo sapiens
actttatttgtaaaccattgtaa

SEQ ID NO: 4661205 - DNA, 20 bp, Homo sapiens
actttcagagcccccagccc

SEQ ID NO: 4661206 - DNA, 13 bp, Homo sapiens
actttcaggggct

SEQ ID NO: 4661207 - DNA, 16 bp, Homo sapiens
actttcccacccagga

SEQ ID NO: 4661208 - DNA, 14 bp, Homo sapiens
actttcctttcaat

SEQ ID NO: 4661209 - DNA, 18 bp, Homo sapiens
actttcctttcaataaag

SEQ ID NO: 4661210 - DNA, 21 bp, Homo sapiens
actttcctttcaataaagttg

SEQ ID NO: 4661211 - DNA, 21 bp, Homo sapiens
actttctccatttaagacaca

SEQ ID NO: 4661212 - DNA, 13 bp, Homo sapiens
actttctcttaag

SEQ ID NO: 4661213 - DNA, 18 bp, Homo sapiens
actttggaaaatgcattg

SEQ ID NO: 4661214 - DNA, 17 bp, Homo sapiens
actttggaaagccaagg

SEQ ID NO: 4661215 - DNA, 20 bp, Homo sapiens
actttgggataggaaaaatg

SEQ ID NO: 4661216 - DNA, 15 bp, Homo sapiens
actttgtcagaggca

SEQ ID NO: 4661217 - DNA, 13 bp, Homo sapiens
actttgtgactgt

SEQ ID NO: 4661218 - DNA, 18 bp, Homo sapiens
actttgtgcattctggat

SEQ ID NO: 4661219 - DNA, 15 bp, Homo sapiens
actttgtgttcattt

SEQ ID NO: 4661220 - DNA, 18 bp, Homo sapiens
actttgtgttcatttcat

SEQ ID NO: 4661221 - DNA, 16 bp, Homo sapiens
actttgttttcaagat

SEQ ID NO: 4661222 - DNA, 16 bp, Homo sapiens
acttttagtaaagtca

SEQ ID NO: 4661223 - DNA, 21 bp, Homo sapiens
acttttagtagagacagtgtt

SEQ ID NO: 4661224 - DNA, 20 bp, Homo sapiens
acttttcattctcttttaat

SEQ ID NO: 4661225 - DNA, 12 bp, Homo sapiens
acttttctcttt

SEQ ID NO: 4661226 - DNA, 14 bp, Homo sapiens
acttttctgtttag

SEQ ID NO: 4661227 - DNA, 12 bp, Homo sapiens
acttttgttcta

SEQ ID NO: 4661228 - DNA, 15 bp, Homo sapiens
actttttagtaattt

SEQ ID NO: 4661229 - DNA, 17 bp, Homo sapiens
actttttagtaatttct

SEQ ID NO: 4661230 - DNA, 16 bp, Homo sapiens
acttttttaaatattt

SEQ ID NO: 4661231 - DNA, 18 bp, Homo sapiens
acttttttaaatattttc

SEQ ID NO: 4661232 - DNA, 19 bp, Homo sapiens
acttttttaaatattttct

SEQ ID NO: 4661233 - DNA, 15 bp, Homo sapiens
acttttttacactga

SEQ ID NO: 4661234 - DNA, 19 bp, Homo sapiens
acttttttagaaatgcaaa

SEQ ID NO: 4661235 - DNA, 15 bp, Homo sapiens
acttttttttaagtt

SEQ ID NO: 4661236 - DNA, 19 bp, Homo sapiens
agaaaaaaagaggtttaag

SEQ ID NO: 4661237 - DNA, 19 bp, Homo sapiens
agaaaaaaagctgcaaaaa

SEQ ID NO: 4661238 - DNA, 16 bp, Homo sapiens
agaaaaataaaatgtt

SEQ ID NO: 4661239 - DNA, 17 bp, Homo sapiens
agaaaaatagagcaaaa

SEQ ID NO: 4661240 - DNA, 21 bp, Homo sapiens
agaaaactcccaatacaaaga

SEQ ID NO: 4661241 - DNA, 15 bp, Homo sapiens
agaaaagtaattttg

SEQ ID NO: 4661242 - DNA, 22 bp, Homo sapiens
agaaaatctgcatgtttgatta

SEQ ID NO: 4661243 - DNA, 13 bp, Homo sapiens
agaaaatgcaatg

SEQ ID NO: 4661244 - DNA, 17 bp, Homo sapiens
agaaaattcagctcctt

SEQ ID NO: 4661245 - DNA, 23 bp, Homo sapiens
agaaaatttacaaaatttattct

SEQ ID NO: 4661246 - DNA, 16 bp, Homo sapiens
agaaacaccacttaat

SEQ ID NO: 4661247 - DNA, 18 bp, Homo sapiens
agaaacaccacttaatct

SEQ ID NO: 4661248 - DNA, 21 bp, Homo sapiens
agaaacaccacttaatcttct

SEQ ID NO: 4661249 - DNA, 21 bp, Homo sapiens
agaaacagagtggcctccctg

SEQ ID NO: 4661250 - DNA, 15 bp, Homo sapiens
agaaacagccagcaa

SEQ ID NO: 4661251 - DNA, 19 bp, Homo sapiens
agaaacagtttcttgcttg

SEQ ID NO: 4661252 - DNA, 14 bp, Homo sapiens
agaaacattgtaaa

SEQ ID NO: 4661253 - DNA, 18 bp, Homo sapiens
agaaacattgtaaatatt

SEQ ID NO: 4661254 - DNA, 20 bp, Homo sapiens
agaaacatttggaaaagaca

SEQ ID NO: 4661255 - DNA, 23 bp, Homo sapiens
agaaacctggggtgaatacttat

SEQ ID NO: 4661256 - DNA, 13 bp, Homo sapiens
agaaactgaggcc

SEQ ID NO: 4661257 - DNA, 19 bp, Homo sapiens
agaaactgaggcccacggt

SEQ ID NO: 4661258 - DNA, 15 bp, Homo sapiens
agaaactgccacata

SEQ ID NO: 4661259 - DNA, 20 bp, Homo sapiens
agaaactgccacatacacca

SEQ ID NO: 4661260 - DNA, 16 bp, Homo sapiens
agaccagggctgctct

SEQ ID NO: 4661261 - DNA, 18 bp, Homo sapiens
agaccatttgtagtgagc

SEQ ID NO: 4661262 - DNA, 17 bp, Homo sapiens
agaccccagtgcctgca

SEQ ID NO: 4661263 - DNA, 19 bp, Homo sapiens
agaccctcgggccccatcc

SEQ ID NO: 4661264 - DNA, 14 bp, Homo sapiens
agaccctgatgcag

SEQ ID NO: 4661265 - DNA, 18 bp, Homo sapiens
agaccctgatgcaggtca

SEQ ID NO: 4661266 - DNA, 19 bp, Homo sapiens
agaccctgatgcaggtcag

SEQ ID NO: 4661267 - DNA, 22 bp, Homo sapiens
agaccctgcaaacagaacaggg

SEQ ID NO: 4661268 - DNA, 14 bp, Homo sapiens
agacctaatatcat

SEQ ID NO: 4661269 - DNA, 14 bp, Homo sapiens
agacctcagaagta

SEQ ID NO: 4661270 - DNA, 15 bp, Homo sapiens
agacctcagaagtaa

SEQ ID NO: 4661271 - DNA, 11 bp, Homo sapiens
agacctgcatg

SEQ ID NO: 4661272 - DNA, 19 bp, Homo sapiens
agacctgttagcagacagg

SEQ ID NO: 4661273 - DNA, 19 bp, Homo sapiens
agacgaggggcagggaagg

SEQ ID NO: 4661274 - DNA, 13 bp, Homo sapiens
agacgggagggga

SEQ ID NO: 4661275 - DNA, 17 bp, Homo sapiens
agacgtgattttgctgt

SEQ ID NO: 4661276 - DNA, 19 bp, Homo sapiens
agactaccggacactcgtc

SEQ ID NO: 4661277 - DNA, 16 bp, Homo sapiens
agactactattttctt

SEQ ID NO: 4661278 - DNA, 14 bp, Homo sapiens
agactcaatgtgga

SEQ ID NO: 4661279 - DNA, 18 bp, Homo sapiens
agactcagttttttgtaa

SEQ ID NO: 4661280 - DNA, 15 bp, Homo sapiens
agactcctgaggaca

SEQ ID NO: 4661281 - DNA, 20 bp, Homo sapiens
agactcgcctatcttaggta

SEQ ID NO: 4661282 - DNA, 21 bp, Homo sapiens
agactctaggttatacaataa

SEQ ID NO: 4661283 - DNA, 21 bp, Homo sapiens
agactgaccaatattgtacag

SEQ ID NO: 4661284 - DNA, 12 bp, Homo sapiens
agactgccctgc

SEQ ID NO: 4661285 - DNA, 14 bp, Homo sapiens
agactggttttctg

SEQ ID NO: 4661286 - DNA, 14 bp, Homo sapiens
agactgtacattat

SEQ ID NO: 4661287 - DNA, 21 bp, Homo sapiens
agactgtgtctgaatcatgtc

SEQ ID NO: 4661288 - DNA, 23 bp, Homo sapiens
agactgtgtctgaatcatgtctg

SEQ ID NO: 4661289 - DNA, 17 bp, Homo sapiens
agactgttgtccctgca

SEQ ID NO: 4661290 - DNA, 15 bp, Homo sapiens
agacttagattcatt

SEQ ID NO: 4661291 - DNA, 16 bp, Homo sapiens
agactttatgtagttt

SEQ ID NO: 4661292 - DNA, 15 bp, Homo sapiens
agactttcacaccat

SEQ ID NO: 4661293 - DNA, 21 bp, Homo sapiens
agactttggaaaatgcattgt

SEQ ID NO: 4661294 - DNA, 14 bp, Homo sapiens
agagaaaattgaga

SEQ ID NO: 4661295 - DNA, 18 bp, Homo sapiens
agagaaagagagaagcca

SEQ ID NO: 4661296 - DNA, 15 bp, Homo sapiens
agagaagaatgagcc

SEQ ID NO: 4661297 - DNA, 17 bp, Homo sapiens
agagaagtttgtagcca

SEQ ID NO: 4661298 - DNA, 16 bp, Homo sapiens
agagaattgaaatgag

SEQ ID NO: 4661299 - DNA, 16 bp, Homo sapiens
agagacagcccaggat

SEQ ID NO: 4661300 - DNA, 13 bp, Homo sapiens
agagacagtgttt

SEQ ID NO: 4661301 - DNA, 21 bp, Homo sapiens
agagacagtgtttcgtcatgt

SEQ ID NO: 4661302 - DNA, 21 bp, Homo sapiens
agagaccccagtcaagctcct

SEQ ID NO: 4661303 - DNA, 12 bp, Homo sapiens
agagagaagcca

SEQ ID NO: 4661304 - DNA, 15 bp, Homo sapiens
agagagaagccagcc

SEQ ID NO: 4661305 - DNA, 18 bp, Homo sapiens
agagagaagccagccaca

SEQ ID NO: 4661306 - DNA, 19 bp, Homo sapiens
agagagaccccgcacccgg

SEQ ID NO: 4661307 - DNA, 12 bp, Homo sapiens
agagagccagga

SEQ ID NO: 4661308 - DNA, 20 bp, Homo sapiens
agagaggcttgaaggccagc

SEQ ID NO: 4661309 - DNA, 18 bp, Homo sapiens
agagagggaattctcttg

SEQ ID NO: 4661310 - DNA, 17 bp, Homo sapiens
agagagtgtgtgtttgt

SEQ ID NO: 4661311 - DNA, 18 bp, Homo sapiens
agagatattgatattgaa

SEQ ID NO: 4661312 - DNA, 21 bp, Homo sapiens
agagatattgatattgaagga

SEQ ID NO: 4661313 - DNA, 22 bp, Homo sapiens
agagatcccaggaggtgcagtg

SEQ ID NO: 4661314 - DNA, 19 bp, Homo sapiens
agagatccctgcagaaccc

SEQ ID NO: 4661315 - DNA, 20 bp, Homo sapiens
agagatccctgcagaaccca

SEQ ID NO: 4661316 - DNA, 19 bp, Homo sapiens
agagatgagcccaccctgc

SEQ ID NO: 4661317 - DNA, 14 bp, Homo sapiens
agagcaagaccctg

SEQ ID NO: 4661318 - DNA, 16 bp, Homo sapiens
agagcaccttgcagtt

SEQ ID NO: 4661319 - DNA, 14 bp, Homo sapiens
agagcacttgagct

SEQ ID NO: 4661320 - DNA, 14 bp, Homo sapiens
agagcagacaggct

SEQ ID NO: 4661321 - DNA, 17 bp, Homo sapiens
agagcagtctaaacaga

SEQ ID NO: 4661322 - DNA, 17 bp, Homo sapiens
agagcatcatgcctctg

SEQ ID NO: 4661323 - DNA, 19 bp, Homo sapiens
agagcatcatgcctctgag

SEQ ID NO: 4661324 - DNA, 23 bp, Homo sapiens
agagcatcatgcctctgaggcca

SEQ ID NO: 4661325 - DNA, 20 bp, Homo sapiens
agagcatgatgggaggtgtg

SEQ ID NO: 4661326 - DNA, 12 bp, Homo sapiens
agagccacctgc

SEQ ID NO: 4661327 - DNA, 13 bp, Homo sapiens
agagccacctgca

SEQ ID NO: 4661328 - DNA, 15 bp, Homo sapiens
agagccacctgcaag

SEQ ID NO: 4661329 - DNA, 16 bp, Homo sapiens
agagccacctgcaaga

SEQ ID NO: 4661330 - DNA, 19 bp, Homo sapiens
agagcccattaatcttgat

SEQ ID NO: 4661331 - DNA, 14 bp, Homo sapiens
agagcccccagccc

SEQ ID NO: 4661332 - DNA, 15 bp, Homo sapiens
agagcccccagccct

SEQ ID NO: 4661333 - DNA, 19 bp, Homo sapiens
agagcccccagccctggga

SEQ ID NO: 4661334 - DNA, 19 bp, Homo sapiens
agagcccctcctccagccc

SEQ ID NO: 4661335 - DNA, 20 bp, Homo sapiens
agagcccctcctccagcccc

SEQ ID NO: 4661336 - DNA, 22 bp, Homo sapiens
agagcccctcctccagcccctg

SEQ ID NO: 4661337 - DNA, 18 bp, Homo sapiens
agagccctgaggcctaga

SEQ ID NO: 4661338 - DNA, 22 bp, Homo sapiens
agagccctgaggcctagactct

SEQ ID NO: 4661339 - DNA, 13 bp, Homo sapiens
agagccctgggac

SEQ ID NO: 4661340 - DNA, 17 bp, Homo sapiens
agagccctgggaccgct

SEQ ID NO: 4661341 - DNA, 22 bp, Homo sapiens
agagcctcgctttttcatcctt

SEQ ID NO: 4661342 - DNA, 13 bp, Homo sapiens
agagcctggggct

SEQ ID NO: 4661343 - DNA, 16 bp, Homo sapiens
agagcctggggctcta

SEQ ID NO: 4661344 - DNA, 17 bp, Homo sapiens
agagcgtccttggctgc

SEQ ID NO: 4661345 - DNA, 18 bp, Homo sapiens
agagctaagggtgggtgc

SEQ ID NO: 4661346 - DNA, 20 bp, Homo sapiens
agagctaggagcaaagcctg

SEQ ID NO: 4661347 - DNA, 23 bp, Homo sapiens
agagctatttaatggccggctgg

SEQ ID NO: 4661348 - DNA, 22 bp, Homo sapiens
agagctcatcccccctgctgcc

SEQ ID NO: 4661349 - DNA, 15 bp, Homo sapiens
agagctgcctggatg

SEQ ID NO: 4661350 - DNA, 13 bp, Homo sapiens
agagctgtgccag

SEQ ID NO: 4661351 - DNA, 17 bp, Homo sapiens
agagctgtgccagcagg

SEQ ID NO: 4661352 - DNA, 21 bp, Homo sapiens
agagcttcctggggaccaaga

SEQ ID NO: 4661353 - DNA, 21 bp, Homo sapiens
agaggaaatctgtaacaggta

SEQ ID NO: 4661354 - DNA, 15 bp, Homo sapiens
agaggaatgtgggct

SEQ ID NO: 4661355 - DNA, 21 bp, Homo sapiens
agaggactcccaaccctggct

SEQ ID NO: 4661356 - DNA, 21 bp, Homo sapiens
agaggagatgtgatcaggccc

SEQ ID NO: 4661357 - DNA, 22 bp, Homo sapiens
agaggagatgtgatcaggcccc

SEQ ID NO: 4661358 - DNA, 16 bp, Homo sapiens
agaggagcccagcggc

SEQ ID NO: 4661359 - DNA, 15 bp, Homo sapiens
agaggatgaaggaag

SEQ ID NO: 4661360 - DNA, 18 bp, Homo sapiens
agaggattgcttgagccc

SEQ ID NO: 4661361 - DNA, 17 bp, Homo sapiens
agaggcagcatgcttgg

SEQ ID NO: 4661362 - DNA, 20 bp, Homo sapiens
agaggcagcatgcttgggct

SEQ ID NO: 4661363 - DNA, 20 bp, Homo sapiens
agaggcatttgagcagctga

SEQ ID NO: 4661364 - DNA, 14 bp, Homo sapiens
agaggcccccaccc

SEQ ID NO: 4661365 - DNA, 15 bp, Homo sapiens
agaggccctggaggt

SEQ ID NO: 4661366 - DNA, 22 bp, Homo sapiens
agaggccctggaggtctccagg

SEQ ID NO: 4661367 - DNA, 13 bp, Homo sapiens
agaggccctggat

SEQ ID NO: 4661368 - DNA, 17 bp, Homo sapiens
agaggccctggatcagc

SEQ ID NO: 4661369 - DNA, 21 bp, Homo sapiens
agaggccctggatcagcgtgg

SEQ ID NO: 4661370 - DNA, 15 bp, Homo sapiens
agcaagctcttccct

SEQ ID NO: 4661371 - DNA, 16 bp, Homo sapiens
agcaagctcttccctt

SEQ ID NO: 4661372 - DNA, 14 bp, Homo sapiens
agcaaggcccgagc

SEQ ID NO: 4661373 - DNA, 20 bp, Homo sapiens
agcaaggcccgagcagctga

SEQ ID NO: 4661374 - DNA, 14 bp, Homo sapiens
agcaagtatattta

SEQ ID NO: 4661375 - DNA, 14 bp, Homo sapiens
agcaataaagaaga

SEQ ID NO: 4661376 - DNA, 14 bp, Homo sapiens
agcaataactgaaa

SEQ ID NO: 4661377 - DNA, 16 bp, Homo sapiens
agcaatgtgttttttc

SEQ ID NO: 4661378 - DNA, 20 bp, Homo sapiens
agcacaatcactaaacttta

SEQ ID NO: 4661379 - DNA, 17 bp, Homo sapiens
agcacacaggcagccag

SEQ ID NO: 4661380 - DNA, 12 bp, Homo sapiens
agcacagcagcc

SEQ ID NO: 4661381 - DNA, 15 bp, Homo sapiens
agcacagcagcctgg

SEQ ID NO: 4661382 - DNA, 23 bp, Homo sapiens
agcacagccaacacgcacctgcc

SEQ ID NO: 4661383 - DNA, 17 bp, Homo sapiens
agcacagctcctgccag

SEQ ID NO: 4661384 - DNA, 14 bp, Homo sapiens
agcacatccaggca

SEQ ID NO: 4661385 - DNA, 23 bp, Homo sapiens
agcacatgccctaatgtctgtat

SEQ ID NO: 4661386 - DNA, 17 bp, Homo sapiens
agcaccgttctgtgcac

SEQ ID NO: 4661387 - DNA, 18 bp, Homo sapiens
agcaccgttctgtgcaca

SEQ ID NO: 4661388 - DNA, 22 bp, Homo sapiens
agcacctacagtgtacagtctt

SEQ ID NO: 4661389 - DNA, 17 bp, Homo sapiens
agcacggactgtcagtt

SEQ ID NO: 4661390 - DNA, 15 bp, Homo sapiens
agcactacctaagta

SEQ ID NO: 4661391 - DNA, 15 bp, Homo sapiens
agcactactgggtgt

SEQ ID NO: 4661392 - DNA, 19 bp, Homo sapiens
agcactactgggtgtcatt

SEQ ID NO: 4661393 - DNA, 20 bp, Homo sapiens
agcactactgggtgtcattt

SEQ ID NO: 4661394 - DNA, 22 bp, Homo sapiens
agcactactgggtgtcatttca

SEQ ID NO: 4661395 - DNA, 23 bp, Homo sapiens
agcactactgggtgtcatttcat

SEQ ID NO: 4661396 - DNA, 14 bp, Homo sapiens
agcactatacagat

SEQ ID NO: 4661397 - DNA, 21 bp, Homo sapiens
agcactccccagagctgtgcc

SEQ ID NO: 4661398 - DNA, 19 bp, Homo sapiens
agcactcggggtccctgga

SEQ ID NO: 4661399 - DNA, 21 bp, Homo sapiens
agcacttagacctgccagcca

SEQ ID NO: 4661400 - DNA, 22 bp, Homo sapiens
agcagaaaacctgttcaggcag

SEQ ID NO: 4661401 - DNA, 16 bp, Homo sapiens
agcagaacatactgtt

SEQ ID NO: 4661402 - DNA, 22 bp, Homo sapiens
agcagaactgaagtgtgctgtg

SEQ ID NO: 4661403 - DNA, 22 bp, Homo sapiens
agcagaagacgggaggggaggc

SEQ ID NO: 4661404 - DNA, 21 bp, Homo sapiens
agcagaatgttgtacttgaaa

SEQ ID NO: 4661405 - DNA, 22 bp, Homo sapiens
agcagacctaaagcaagcctga

SEQ ID NO: 4661406 - DNA, 19 bp, Homo sapiens
agcagagatcgacagacag

SEQ ID NO: 4661407 - DNA, 15 bp, Homo sapiens
agcagcaaattttca

SEQ ID NO: 4661408 - DNA, 20 bp, Homo sapiens
agcagcaaattttcagcatt

SEQ ID NO: 4661409 - DNA, 15 bp, Homo sapiens
agcagcaatattttg

SEQ ID NO: 4661410 - DNA, 20 bp, Homo sapiens
agcagcaccgttctgtgcac

SEQ ID NO: 4661411 - DNA, 10 bp, Homo sapiens
agcagccacg

SEQ ID NO: 4661412 - DNA, 13 bp, Homo sapiens
agcagccacgagg

SEQ ID NO: 4661413 - DNA, 11 bp, Homo sapiens
agcagccagcc

SEQ ID NO: 4661414 - DNA, 19 bp, Homo sapiens
agcagccagccctgcctgg

SEQ ID NO: 4661415 - DNA, 11 bp, Homo sapiens
agcagccctgg

SEQ ID NO: 4661416 - DNA, 22 bp, Homo sapiens
agcagcctcaaaacgggtcagt

SEQ ID NO: 4661417 - DNA, 20 bp, Homo sapiens
agcagctagaaaacattttt

SEQ ID NO: 4661418 - DNA, 17 bp, Homo sapiens
agcagctccaccactgt

SEQ ID NO: 4661419 - DNA, 12 bp, Homo sapiens
agcaggaataaa

SEQ ID NO: 4661420 - DNA, 14 bp, Homo sapiens
agcaggaataaaga

SEQ ID NO: 4661421 - DNA, 17 bp, Homo sapiens
agcaggagccccgccac

SEQ ID NO: 4661422 - DNA, 15 bp, Homo sapiens
agcaggctagacaga

SEQ ID NO: 4661423 - DNA, 14 bp, Homo sapiens
agcagggcagcagg

SEQ ID NO: 4661424 - DNA, 18 bp, Homo sapiens
agcaggggggctgtgcca

SEQ ID NO: 4661425 - DNA, 16 bp, Homo sapiens
agcagggtcttttcat

SEQ ID NO: 4661426 - DNA, 17 bp, Homo sapiens
agcaggttcccaagctc

SEQ ID NO: 4661427 - DNA, 23 bp, Homo sapiens
agcaggttcccaagctcagaggc

SEQ ID NO: 4661428 - DNA, 22 bp, Homo sapiens
agcaggttccccaagggccctg

SEQ ID NO: 4661429 - DNA, 15 bp, Homo sapiens
agcaggttctaggct

SEQ ID NO: 4661430 - DNA, 19 bp, Homo sapiens
agcagtccccagctgagtg

SEQ ID NO: 4661431 - DNA, 15 bp, Homo sapiens
agcagtctaaacaga

SEQ ID NO: 4661432 - DNA, 19 bp, Homo sapiens
agcagtggccatcatcctc

SEQ ID NO: 4661433 - DNA, 15 bp, Homo sapiens
agcataatctgaaaa

SEQ ID NO: 4661434 - DNA, 19 bp, Homo sapiens
agcataatctgaaaacatc

SEQ ID NO: 4661435 - DNA, 13 bp, Homo sapiens
agcatactttgta

SEQ ID NO: 4661436 - DNA, 21 bp, Homo sapiens
agcatattttcttacttttat

SEQ ID NO: 4661437 - DNA, 22 bp, Homo sapiens
agcatattttcttacttttatt

SEQ ID NO: 4661438 - DNA, 18 bp, Homo sapiens
agcatcatgcctctgagg

SEQ ID NO: 4661439 - DNA, 21 bp, Homo sapiens
agcatcatgcctctgaggcca

SEQ ID NO: 4661440 - DNA, 22 bp, Homo sapiens
agcatcatgcctctgaggccag

SEQ ID NO: 4661441 - DNA, 20 bp, Homo sapiens
agcatccctggagcaggagc

SEQ ID NO: 4661442 - DNA, 21 bp, Homo sapiens
agcatccctggagcaggagcc

SEQ ID NO: 4661443 - DNA, 21 bp, Homo sapiens
agcatcctgcccgagggcagc

SEQ ID NO: 4661444 - DNA, 21 bp, Homo sapiens
agcatgaataacatttaaatt

SEQ ID NO: 4661445 - DNA, 15 bp, Homo sapiens
agcatgcattgaaaa

SEQ ID NO: 4661446 - DNA, 20 bp, Homo sapiens
agcatgcattgaaaaatttc

SEQ ID NO: 4661447 - DNA, 18 bp, Homo sapiens
agcatgcttgggctgacc

SEQ ID NO: 4661448 - DNA, 21 bp, Homo sapiens
agcatgcttgggctgacccag

SEQ ID NO: 4661449 - DNA, 11 bp, Homo sapiens
agcatggggat

SEQ ID NO: 4661450 - DNA, 18 bp, Homo sapiens
agcatgggtccagaagac

SEQ ID NO: 4661451 - DNA, 22 bp, Homo sapiens
agcatgttcctccttttcttca

SEQ ID NO: 4661452 - DNA, 18 bp, Homo sapiens
agcattatccttttatct

SEQ ID NO: 4661453 - DNA, 23 bp, Homo sapiens
agcattccacactgcagggagga

SEQ ID NO: 4661454 - DNA, 19 bp, Homo sapiens
agcattcgagacagaacct

SEQ ID NO: 4661455 - DNA, 15 bp, Homo sapiens
agcattgctttctga

SEQ ID NO: 4661456 - DNA, 16 bp, Homo sapiens
agcattgctttctgaa

SEQ ID NO: 4661457 - DNA, 14 bp, Homo sapiens
agcatttcatgaaa

SEQ ID NO: 4661458 - DNA, 21 bp, Homo sapiens
agcattttttatcaggcagga

SEQ ID NO: 4661459 - DNA, 12 bp, Homo sapiens
agccaaaccagg

SEQ ID NO: 4661460 - DNA, 16 bp, Homo sapiens
agccaaagaaacaagc

SEQ ID NO: 4661461 - DNA, 21 bp, Homo sapiens
agccaaagaaacaagctgtgc

SEQ ID NO: 4661462 - DNA, 14 bp, Homo sapiens
agccaaattttatc

SEQ ID NO: 4661463 - DNA, 19 bp, Homo sapiens
agccaacacgcacctgcct

SEQ ID NO: 4661464 - DNA, 22 bp, Homo sapiens
agccaacacgcacctgcctcag

SEQ ID NO: 4661465 - DNA, 18 bp, Homo sapiens
agccaactgtttccctgc

SEQ ID NO: 4661466 - DNA, 23 bp, Homo sapiens
agccaactgtttccctgctgaat

SEQ ID NO: 4661467 - DNA, 20 bp, Homo sapiens
agccaagattttcctcttgt

SEQ ID NO: 4661468 - DNA, 14 bp, Homo sapiens
agccaatgtgaatt

SEQ ID NO: 4661469 - DNA, 17 bp, Homo sapiens
agccaattcagacaggc

SEQ ID NO: 4661470 - DNA, 22 bp, Homo sapiens
agccacaagctgcactgtgaac

SEQ ID NO: 4661471 - DNA, 20 bp, Homo sapiens
agccacacttctcaggacac

SEQ ID NO: 4661472 - DNA, 19 bp, Homo sapiens
agccacagacccctgggag

SEQ ID NO: 4661473 - DNA, 22 bp, Homo sapiens
agccacagacccctgggagctt

SEQ ID NO: 4661474 - DNA, 12 bp, Homo sapiens
agccaccctgag

SEQ ID NO: 4661475 - DNA, 13 bp, Homo sapiens
agccaccctgagg

SEQ ID NO: 4661476 - DNA, 21 bp, Homo sapiens
agccaccctgaggagtctgag

SEQ ID NO: 4661477 - DNA, 22 bp, Homo sapiens
agccaccctgaggagtctgagg

SEQ ID NO: 4661478 - DNA, 11 bp, Homo sapiens
agccacctgca

SEQ ID NO: 4661479 - DNA, 16 bp, Homo sapiens
agcctggggctctaac

SEQ ID NO: 4661480 - DNA, 22 bp, Homo sapiens
agcctggggctctaacgcctga

SEQ ID NO: 4661481 - DNA, 14 bp, Homo sapiens
agcctggggctggc

SEQ ID NO: 4661482 - DNA, 20 bp, Homo sapiens
agcctgggggacagagcaag

SEQ ID NO: 4661483 - DNA, 14 bp, Homo sapiens
agcctgggggcctg

SEQ ID NO: 4661484 - DNA, 17 bp, Homo sapiens
agcctgggggcctggct

SEQ ID NO: 4661485 - DNA, 18 bp, Homo sapiens
agcctgggggcctggctg

SEQ ID NO: 4661486 - DNA, 19 bp, Homo sapiens
agcctgggggcctggctgg

SEQ ID NO: 4661487 - DNA, 19 bp, Homo sapiens
agcctgtgaacccaggaca

SEQ ID NO: 4661488 - DNA, 16 bp, Homo sapiens
ccttagggcactgggc

SEQ ID NO: 4661489 - DNA, 14 bp, Homo sapiens
ccttatcagagcta

SEQ ID NO: 4661490 - DNA, 15 bp, Homo sapiens
ccttatcctagcctt

SEQ ID NO: 4661491 - DNA, 18 bp, Homo sapiens
ccttattgctgtcctgga

SEQ ID NO: 4661492 - DNA, 18 bp, Homo sapiens
ccttcaagacgaggggca

SEQ ID NO: 4661493 - DNA, 19 bp, Homo sapiens
ccttcaagacgaggggcag

SEQ ID NO: 4661494 - DNA, 14 bp, Homo sapiens
ccttcacctcggag

SEQ ID NO: 4661495 - DNA, 19 bp, Homo sapiens
ccttcacctcggagggatg

SEQ ID NO: 4661496 - DNA, 13 bp, Homo sapiens
ccttcagacacat

SEQ ID NO: 4661497 - DNA, 20 bp, Homo sapiens
ccttcagttctgcttgctcc

SEQ ID NO: 4661498 - DNA, 14 bp, Homo sapiens
ccttccacctcaca

SEQ ID NO: 4661499 - DNA, 21 bp, Homo sapiens
ccttccacctcacaactcctt

SEQ ID NO: 4661500 - DNA, 15 bp, Homo sapiens
ccttccatgctccca

SEQ ID NO: 4661501 - DNA, 16 bp, Homo sapiens
ccttccatgctcccaa

SEQ ID NO: 4661502 - DNA, 13 bp, Homo sapiens
ccttccattccat

SEQ ID NO: 4661503 - DNA, 19 bp, Homo sapiens
ccttccattttcccccact

SEQ ID NO: 4661504 - DNA, 12 bp, Homo sapiens
ccttccccagct

SEQ ID NO: 4661505 - DNA, 15 bp, Homo sapiens
ccttccccagctccc

SEQ ID NO: 4661506 - DNA, 21 bp, Homo sapiens
ccttccccagctcccccaggc

SEQ ID NO: 4661507 - DNA, 21 bp, Homo sapiens
ccttccccatgaaccctgccc

SEQ ID NO: 4661508 - DNA, 19 bp, Homo sapiens
ccttccccctttctctgcc

SEQ ID NO: 4661509 - DNA, 20 bp, Homo sapiens
ccttccccctttctctgcct

SEQ ID NO: 4661510 - DNA, 22 bp, Homo sapiens
ccttccccctttctctgcctgg

SEQ ID NO: 4661511 - DNA, 14 bp, Homo sapiens
ccttccctctgcat

SEQ ID NO: 4661512 - DNA, 16 bp, Homo sapiens
ccttcctcagcaggcc

SEQ ID NO: 4661513 - DNA, 14 bp, Homo sapiens
ccttcctcctgcct

SEQ ID NO: 4661514 - DNA, 21 bp, Homo sapiens
ccttcctctccaccctcccag

SEQ ID NO: 4661515 - DNA, 18 bp, Homo sapiens
ccttcctcttcctgccct

SEQ ID NO: 4661516 - DNA, 19 bp, Homo sapiens
ccttcctcttcctgccctt

SEQ ID NO: 4661517 - DNA, 16 bp, Homo sapiens
ccttcctggacagctg

SEQ ID NO: 4661518 - DNA, 21 bp, Homo sapiens
ccttcctggacagctgtgcct

SEQ ID NO: 4661519 - DNA, 16 bp, Homo sapiens
ccttcgaaaggccttc

SEQ ID NO: 4661520 - DNA, 15 bp, Homo sapiens
ccttctattggtctc

SEQ ID NO: 4661521 - DNA, 13 bp, Homo sapiens
ccttctcccaggc

SEQ ID NO: 4661522 - DNA, 16 bp, Homo sapiens
ccttctcccaggcctc

SEQ ID NO: 4661523 - DNA, 20 bp, Homo sapiens
ccttctcccaggcctctgcc

SEQ ID NO: 4661524 - DNA, 12 bp, Homo sapiens
ccttctgctcag

SEQ ID NO: 4661525 - DNA, 10 bp, Homo sapiens
ccttctggcc

SEQ ID NO: 4661526 - DNA, 19 bp, Homo sapiens
ccttgaagttgtggaggag

SEQ ID NO: 4661527 - DNA, 13 bp, Homo sapiens
ccttgactgaagc

SEQ ID NO: 4661528 - DNA, 12 bp, Homo sapiens
ccttgaggggca

SEQ ID NO: 4661529 - DNA, 20 bp, Homo sapiens
ccttgctacttgaaggtaca

SEQ ID NO: 4661530 - DNA, 22 bp, Homo sapiens
ccttgctcccaatggtgcttgg

SEQ ID NO: 4661531 - DNA, 13 bp, Homo sapiens
ccttgctcttggg

SEQ ID NO: 4661532 - DNA, 18 bp, Homo sapiens
ccttgctcttggggaagg

SEQ ID NO: 4661533 - DNA, 11 bp, Homo sapiens
ccttgctgggc

SEQ ID NO: 4661534 - DNA, 17 bp, Homo sapiens
ccttgctgggcctgggg

SEQ ID NO: 4661535 - DNA, 18 bp, Homo sapiens
ccttgctttcctgggcct

SEQ ID NO: 4661536 - DNA, 21 bp, Homo sapiens
ccttgctttcggagctcctgt

SEQ ID NO: 4661537 - DNA, 20 bp, Homo sapiens
ccttgctttttgctgtgtag

SEQ ID NO: 4661538 - DNA, 15 bp, Homo sapiens
ccttggaggagagag

SEQ ID NO: 4661539 - DNA, 17 bp, Homo sapiens
ccttggaggagagagac

SEQ ID NO: 4661540 - DNA, 20 bp, Homo sapiens
ccttggctgacatgaagctg

SEQ ID NO: 4661541 - DNA, 13 bp, Homo sapiens
ccttggcttgtgt

SEQ ID NO: 4661542 - DNA, 21 bp, Homo sapiens
ccttgggcagagtcctgcctt

SEQ ID NO: 4661543 - DNA, 14 bp, Homo sapiens
ccttggtctaactt

SEQ ID NO: 4661544 - DNA, 23 bp, Homo sapiens
ccttggtctaacttttgtgtgaa

SEQ ID NO: 4661545 - DNA, 19 bp, Homo sapiens
ccttgtagaaaaatccctc

SEQ ID NO: 4661546 - DNA, 21 bp, Homo sapiens
ccttgtagaaaaatccctcca

SEQ ID NO: 4661547 - DNA, 14 bp, Homo sapiens
ccttgttctatttt

SEQ ID NO: 4661548 - DNA, 22 bp, Homo sapiens
ccttgttctatttttcaatcat

SEQ ID NO: 4661549 - DNA, 13 bp, Homo sapiens
ccttgttctctgc

SEQ ID NO: 4661550 - DNA, 12 bp, Homo sapiens
ccttgtttatta

SEQ ID NO: 4661551 - DNA, 16 bp, Homo sapiens
ccttgtttggggcagg

SEQ ID NO: 4661552 - DNA, 17 bp, Homo sapiens
ccttgtttggggcagga

SEQ ID NO: 4661553 - DNA, 14 bp, Homo sapiens
cctttaaatatcat

SEQ ID NO: 4661554 - DNA, 16 bp, Homo sapiens
cctttaaatatcattc

SEQ ID NO: 4661555 - DNA, 16 bp, Homo sapiens
cctttaattttcttgt

SEQ ID NO: 4661556 - DNA, 14 bp, Homo sapiens
cctttcaataaagt

SEQ ID NO: 4661557 - DNA, 18 bp, Homo sapiens
cctttcaataaagttgtt

SEQ ID NO: 4661558 - DNA, 15 bp, Homo sapiens
cctttcccaccattc

SEQ ID NO: 4661559 - DNA, 12 bp, Homo sapiens
cctttctctgcc

SEQ ID NO: 4661560 - DNA, 13 bp, Homo sapiens
cctttctctgcct

SEQ ID NO: 4661561 - DNA, 13 bp, Homo sapiens
cctttgaggcccc

SEQ ID NO: 4661562 - DNA, 18 bp, Homo sapiens
cctttgcaagatgcttgg

SEQ ID NO: 4661563 - DNA, 11 bp, Homo sapiens
cctttgcccct

SEQ ID NO: 4661564 - DNA, 20 bp, Homo sapiens
cctttgcccttacctgtctc

SEQ ID NO: 4661565 - DNA, 14 bp, Homo sapiens
cctttgctcttata

SEQ ID NO: 4661566 - DNA, 14 bp, Homo sapiens
ccttttaagcatgt

SEQ ID NO: 4661567 - DNA, 16 bp, Homo sapiens
ccttttataaccttgt

SEQ ID NO: 4661568 - DNA, 16 bp, Homo sapiens
ccttttcccccaccct

SEQ ID NO: 4661569 - DNA, 12 bp, Homo sapiens
ccttttcctttt

SEQ ID NO: 4661570 - DNA, 15 bp, Homo sapiens
cctttttagggcaga

SEQ ID NO: 4661571 - DNA, 16 bp, Homo sapiens
ccttttttaaaaatgc

SEQ ID NO: 4661572 - DNA, 14 bp, Homo sapiens
ccttttttgtctta

SEQ ID NO: 4661573 - DNA, 21 bp, Homo sapiens
ccttttttgtcttattgaaaa

SEQ ID NO: 4661574 - DNA, 14 bp, Homo sapiens
cgaacgtggtctga

SEQ ID NO: 4661575 - DNA, 21 bp, Homo sapiens
cgaagctgcgggggcaggccg

SEQ ID NO: 4661576 - DNA, 22 bp, Homo sapiens
cgaatgacaaaatcatctttgt

SEQ ID NO: 4661577 - DNA, 16 bp, Homo sapiens
cgacagacagccaggt

SEQ ID NO: 4661578 - DNA, 14 bp, Homo sapiens
cgacagggcctgga

SEQ ID NO: 4661579 - DNA, 13 bp, Homo sapiens
cgacccacgcaga

SEQ ID NO: 4661580 - DNA, 19 bp, Homo sapiens
cgaccctgtcccctaggga

SEQ ID NO: 4661581 - DNA, 14 bp, Homo sapiens
cgaccgggccaggc

SEQ ID NO: 4661582 - DNA, 18 bp, Homo sapiens
cgactacaaaataaaact

SEQ ID NO: 4661583 - DNA, 17 bp, Homo sapiens
cgagaaacagcctgtgt

SEQ ID NO: 4661584 - DNA, 23 bp, Homo sapiens
cgagacaacagcacacaggcagc

SEQ ID NO: 4661585 - DNA, 21 bp, Homo sapiens
cgagagcctcgctttttcatc

SEQ ID NO: 4661586 - DNA, 18 bp, Homo sapiens
cgagaggtgagctacttt

SEQ ID NO: 4661587 - DNA, 19 bp, Homo sapiens
cgagatcagtatttaacta

SEQ ID NO: 4661588 - DNA, 14 bp, Homo sapiens
cgagcaaccgtggc

SEQ ID NO: 4661589 - DNA, 18 bp, Homo sapiens
cgagccacaagctgcact

SEQ ID NO: 4661590 - DNA, 12 bp, Homo sapiens
cgaggggcaggg

SEQ ID NO: 4661591 - DNA, 14 bp, Homo sapiens
cgagtcattaaact

SEQ ID NO: 4661592 - DNA, 18 bp, Homo sapiens
cgagtcattcgttctgtg

SEQ ID NO: 4661593 - DNA, 15 bp, Homo sapiens
cgagtccaagctggg

SEQ ID NO: 4661594 - DNA, 14 bp, Homo sapiens
cgagtggatgctgt

SEQ ID NO: 4661595 - DNA, 18 bp, Homo sapiens
cgagtggatgctgtgcta

SEQ ID NO: 4661596 - DNA, 20 bp, Homo sapiens
cgagttaatgatggcagagg

SEQ ID NO: 4661597 - DNA, 19 bp, Homo sapiens
cgatgtatgcagctatctg

SEQ ID NO: 4661598 - DNA, 18 bp, Homo sapiens
cgattccctctcccaggc

SEQ ID NO: 4661599 - DNA, 11 bp, Homo sapiens
cgtacacagag

SEQ ID NO: 4661600 - DNA, 15 bp, Homo sapiens
cgtacacagagaagg

SEQ ID NO: 4661601 - DNA, 23 bp, Homo sapiens
cgtacacagagaaggctatgtaa

SEQ ID NO: 4661602 - DNA, 16 bp, Homo sapiens
cgtagagaatgtgtgt

SEQ ID NO: 4661603 - DNA, 19 bp, Homo sapiens
cgtagccagctgctcccca

SEQ ID NO: 4661604 - DNA, 13 bp, Homo sapiens
cgtagggggcagg

SEQ ID NO: 4661605 - DNA, 14 bp, Homo sapiens
cgtcaaagaaaatg

SEQ ID NO: 4661606 - DNA, 15 bp, Homo sapiens
cgtcacactcttcag

SEQ ID NO: 4661607 - DNA, 21 bp, Homo sapiens
cgtcacccctgtttctggcac

SEQ ID NO: 4661608 - DNA, 13 bp, Homo sapiens
cgtcccaccagct

SEQ ID NO: 4661609 - DNA, 19 bp, Homo sapiens
cgtcccagctgaaggcagt

SEQ ID NO: 4661610 - DNA, 13 bp, Homo sapiens
cgtcctggcacag

SEQ ID NO: 4661611 - DNA, 15 bp, Homo sapiens
cgtccttactcctgt

SEQ ID NO: 4661612 - DNA, 22 bp, Homo sapiens
cgtccttactcctgtgggagcc

SEQ ID NO: 4661613 - DNA, 15 bp, Homo sapiens
cgtctaccctgggat

SEQ ID NO: 4661614 - DNA, 16 bp, Homo sapiens
cgtctggctccctgcc

SEQ ID NO: 4661615 - DNA, 11 bp, Homo sapiens
cgtgaacaaac

SEQ ID NO: 4661616 - DNA, 15 bp, Homo sapiens
cgtgacagactcctg

SEQ ID NO: 4661617 - DNA, 22 bp, Homo sapiens
cgtgagaaatagctgaaaaggg

SEQ ID NO: 4661618 - DNA, 18 bp, Homo sapiens
cgtgagagaaagagagaa

SEQ ID NO: 4661619 - DNA, 15 bp, Homo sapiens
cgtgatctcccctca

SEQ ID NO: 4661620 - DNA, 13 bp, Homo sapiens
cgtgatgtggagg

SEQ ID NO: 4661621 - DNA, 17 bp, Homo sapiens
cgtgatgtggaggaaga

SEQ ID NO: 4661622 - DNA, 22 bp, Homo sapiens
cgtgatgtggaggaagagccac

SEQ ID NO: 4661623 - DNA, 14 bp, Homo sapiens
cgtgcatgctctgc

SEQ ID NO: 4661624 - DNA, 21 bp, Homo sapiens
cgtgccaagtccaggtcctgg

SEQ ID NO: 4661625 - DNA, 17 bp, Homo sapiens
cgtgccacccccagccc

SEQ ID NO: 4661626 - DNA, 15 bp, Homo sapiens
cgtgcctggctgatt

SEQ ID NO: 4661627 - DNA, 18 bp, Homo sapiens
cgtgcgggaaattcagtc

SEQ ID NO: 4661628 - DNA, 19 bp, Homo sapiens
cgtgctcgccccagcaggt

SEQ ID NO: 4661629 - DNA, 14 bp, Homo sapiens
cgtggaggctgctc

SEQ ID NO: 4661630 - DNA, 14 bp, Homo sapiens
cgtggcccttcctg

SEQ ID NO: 4661631 - DNA, 16 bp, Homo sapiens
cgtggcccttcctgga

SEQ ID NO: 4661632 - DNA, 20 bp, Homo sapiens
cgtggcccttcctggacagc

SEQ ID NO: 4661633 - DNA, 21 bp, Homo sapiens
cgtggcctcccaaagtgctgg

SEQ ID NO: 4661634 - DNA, 19 bp, Homo sapiens
cgtggcctcgtgaggggca

SEQ ID NO: 4661635 - DNA, 15 bp, Homo sapiens
cgtggctcagccagc

SEQ ID NO: 4661636 - DNA, 14 bp, Homo sapiens
cgtggctctgctgg

SEQ ID NO: 4661637 - DNA, 22 bp, Homo sapiens
cgtgggcagaggaatgtgggct

SEQ ID NO: 4661638 - DNA, 13 bp, Homo sapiens
cgtgggccatggc

SEQ ID NO: 4661639 - DNA, 15 bp, Homo sapiens
cgtgggctcagcagg

SEQ ID NO: 4661640 - DNA, 18 bp, Homo sapiens
cgtgggtgggcctggccc

SEQ ID NO: 4661641 - DNA, 19 bp, Homo sapiens
cgtggtttgcctgaggctg

SEQ ID NO: 4661642 - DNA, 18 bp, Homo sapiens
cgtgtatagtatctgtat

SEQ ID NO: 4661643 - DNA, 17 bp, Homo sapiens
cgtgtatttattaccgt

SEQ ID NO: 4661644 - DNA, 21 bp, Homo sapiens
cgttaagaatttggggcagga

SEQ ID NO: 4661645 - DNA, 13 bp, Homo sapiens
cgttaagggcaga

SEQ ID NO: 4661646 - DNA, 14 bp, Homo sapiens
cgttaagggcagag

SEQ ID NO: 4661647 - DNA, 15 bp, Homo sapiens
cgttcaataagcatt

SEQ ID NO: 4661648 - DNA, 22 bp, Homo sapiens
cgttcacctccaagcatttcat

SEQ ID NO: 4661649 - DNA, 12 bp, Homo sapiens
cgttgtccctga

SEQ ID NO: 4661650 - DNA, 16 bp, Homo sapiens
cgtttaattttaagaa

SEQ ID NO: 4661651 - DNA, 20 bp, Homo sapiens
ctaaaaaaaaaaaagtatta

SEQ ID NO: 4661652 - DNA, 22 bp, Homo sapiens
ctaaaatagcaataactgaaaa

SEQ ID NO: 4661653 - DNA, 17 bp, Homo sapiens
ctaaactttatttgtaa

SEQ ID NO: 4661654 - DNA, 18 bp, Homo sapiens
ctaaactttatttgtaaa

SEQ ID NO: 4661655 - DNA, 19 bp, Homo sapiens
ctaaagaagttcaaaccct

SEQ ID NO: 4661656 - DNA, 14 bp, Homo sapiens
ctaaataaaaatat

SEQ ID NO: 4661657 - DNA, 22 bp, Homo sapiens
ctaaatactgactgctggacat

SEQ ID NO: 4661658 - DNA, 15 bp, Homo sapiens
ctaaatgattatctt

SEQ ID NO: 4661659 - DNA, 24 bp, Homo sapiens
ctaaatgttaactacatattgtct

SEQ ID NO: 4661660 - DNA, 23 bp, Homo sapiens
ctaacacggtgctcattttttct

SEQ ID NO: 4661661 - DNA, 20 bp, Homo sapiens
ctaacactcagaagcctggg

SEQ ID NO: 4661662 - DNA, 23 bp, Homo sapiens
ctaaccacttcgcacacacccat

SEQ ID NO: 4661663 - DNA, 13 bp, Homo sapiens
ctaactgtaaatc

SEQ ID NO: 4661664 - DNA, 14 bp, Homo sapiens
ctaactgtaaatca

SEQ ID NO: 4661665 - DNA, 17 bp, Homo sapiens
ctaactgtaaatcatgt

SEQ ID NO: 4661666 - DNA, 12 bp, Homo sapiens
ctaacttctaaa

SEQ ID NO: 4661667 - DNA, 13 bp, Homo sapiens
ctaagaaaatgta

SEQ ID NO: 4661668 - DNA, 15 bp, Homo sapiens
ctaagaaaatgtagt

SEQ ID NO: 4661669 - DNA, 20 bp, Homo sapiens
ctaagcccaggatctctttc

SEQ ID NO: 4661670 - DNA, 14 bp, Homo sapiens
ctaagctgcggaat

SEQ ID NO: 4661671 - DNA, 19 bp, Homo sapiens
ctaaggacatttcccaggg

SEQ ID NO: 4661672 - DNA, 22 bp, Homo sapiens
ctaaggatggaaaggtgacagt

SEQ ID NO: 4661673 - DNA, 22 bp, Homo sapiens
ctaaggcaggtgggcagacagt

SEQ ID NO: 4661674 - DNA, 19 bp, Homo sapiens
ctaagggtgggtgctcaga

SEQ ID NO: 4661675 - DNA, 22 bp, Homo sapiens
ctaagggtgggtgctcagaata

SEQ ID NO: 4661676 - DNA, 16 bp, Homo sapiens
ctaagtcgtgcacttt

SEQ ID NO: 4661677 - DNA, 19 bp, Homo sapiens
ctaataaagccatttctta

SEQ ID NO: 4661678 - DNA, 23 bp, Homo sapiens
ctaataattgtatctacattaaa

SEQ ID NO: 4661679 - DNA, 13 bp, Homo sapiens
ctaatacctctgt

SEQ ID NO: 4661680 - DNA, 15 bp, Homo sapiens
ctaatacctctgtgt

SEQ ID NO: 4661681 - DNA, 19 bp, Homo sapiens
ctaatagagtacttaatat

SEQ ID NO: 4661682 - DNA, 22 bp, Homo sapiens
ctaatagagtacttaatatact

SEQ ID NO: 4661683 - DNA, 14 bp, Homo sapiens
ctaatagcttttta

SEQ ID NO: 4661684 - DNA, 14 bp, Homo sapiens
ctaatatcatttta

SEQ ID NO: 4661685 - DNA, 18 bp, Homo sapiens
ctaatatcattttattca

SEQ ID NO: 4661686 - DNA, 13 bp, Homo sapiens
ctaatcaaagcca

SEQ ID NO: 4661687 - DNA, 20 bp, Homo sapiens
ctaatcaaagccagggtctc

SEQ ID NO: 4661688 - DNA, 20 bp, Homo sapiens
ctaatccctgggcattgctt

SEQ ID NO: 4661689 - DNA, 18 bp, Homo sapiens
ctaatgcatatttataag

SEQ ID NO: 4661690 - DNA, 20 bp, Homo sapiens
ctaatgcatatttataagag

SEQ ID NO: 4661691 - DNA, 14 bp, Homo sapiens
ctaatgtaaaatga

SEQ ID NO: 4661692 - DNA, 17 bp, Homo sapiens
ctaattaaccttactaa

SEQ ID NO: 4661693 - DNA, 16 bp, Homo sapiens
ctaattatactacttt

SEQ ID NO: 4661694 - DNA, 21 bp, Homo sapiens
ctaattatactactttgttag

SEQ ID NO: 4661695 - DNA, 16 bp, Homo sapiens
ctaattgtaagtgaaa

SEQ ID NO: 4661696 - DNA, 17 bp, Homo sapiens
ctaattgtaagtgaaat

SEQ ID NO: 4661697 - DNA, 20 bp, Homo sapiens
ctaattgtaagtgaaattaa

SEQ ID NO: 4661698 - DNA, 16 bp, Homo sapiens
ctaatttttgtatttt

SEQ ID NO: 4661699 - DNA, 12 bp, Homo sapiens
ctacaaagcaga

SEQ ID NO: 4661700 - DNA, 14 bp, Homo sapiens
ctacaaagcagaga

SEQ ID NO: 4661701 - DNA, 15 bp, Homo sapiens
ctacaaagcagagat

SEQ ID NO: 4661702 - DNA, 19 bp, Homo sapiens
ctacaagatttccttaaaa

SEQ ID NO: 4661703 - DNA, 22 bp, Homo sapiens
ctacaaggtaggctgcaaaatt

SEQ ID NO: 4661704 - DNA, 18 bp, Homo sapiens
ctacaagtgtaggccacc

SEQ ID NO: 4661705 - DNA, 13 bp, Homo sapiens
ctacacagggcct

SEQ ID NO: 4661706 - DNA, 21 bp, Homo sapiens
ctacacatatgtattcctgat

SEQ ID NO: 4661707 - DNA, 17 bp, Homo sapiens
ctacacatttttaaatt

SEQ ID NO: 4661708 - DNA, 15 bp, Homo sapiens
ctacaccactctggc

SEQ ID NO: 4661709 - DNA, 12 bp, Homo sapiens
ctatggagaggc

SEQ ID NO: 4661710 - DNA, 19 bp, Homo sapiens
ctatggtgagatgcagctg

SEQ ID NO: 4661711 - DNA, 18 bp, Homo sapiens
ctatgtagtcataataaa

SEQ ID NO: 4661712 - DNA, 16 bp, Homo sapiens
ctatgtgattttaact

SEQ ID NO: 4661713 - DNA, 18 bp, Homo sapiens
ctattaatcaagagaaac

SEQ ID NO: 4661714 - DNA, 19 bp, Homo sapiens
ctattaattcttaatatta

SEQ ID NO: 4661715 - DNA, 14 bp, Homo sapiens
ctattactgatgtg

SEQ ID NO: 4661716 - DNA, 15 bp, Homo sapiens
ctattatggaaaact

SEQ ID NO: 4661717 - DNA, 16 bp, Homo sapiens
ctattatggaaaactg

SEQ ID NO: 4661718 - DNA, 18 bp, Homo sapiens
ctattatggaaaactgtg

SEQ ID NO: 4661719 - DNA, 14 bp, Homo sapiens
ctattcatggctac

SEQ ID NO: 4661720 - DNA, 20 bp, Homo sapiens
ctattcatggctacctcaga

SEQ ID NO: 4661721 - DNA, 15 bp, Homo sapiens
ctattctagagcttt

SEQ ID NO: 4661722 - DNA, 17 bp, Homo sapiens
ctattctagcctgcatt

SEQ ID NO: 4661723 - DNA, 14 bp, Homo sapiens
ctattgatactctt

SEQ ID NO: 4661724 - DNA, 21 bp, Homo sapiens
ctatttatctgtagtaaacta

SEQ ID NO: 4661725 - DNA, 22 bp, Homo sapiens
ctatttatctgtgtttttgaaa

SEQ ID NO: 4661726 - DNA, 14 bp, Homo sapiens
ctatttatgccttg

SEQ ID NO: 4661727 - DNA, 21 bp, Homo sapiens
ctatttatgccttgatgattt

SEQ ID NO: 4661728 - DNA, 14 bp, Homo sapiens
ctatttattcctgt

SEQ ID NO: 4661729 - DNA, 17 bp, Homo sapiens
ctatttccttccagcct

SEQ ID NO: 4661730 - DNA, 18 bp, Homo sapiens
ctatttccttccagcctt

SEQ ID NO: 4661731 - DNA, 10 bp, Homo sapiens
ctatttgaag

SEQ ID NO: 4661732 - DNA, 20 bp, Homo sapiens
ctatttgaagaaaaaaatgt

SEQ ID NO: 4661733 - DNA, 22 bp, Homo sapiens
ctatttgttcttcaagaacttt

SEQ ID NO: 4661734 - DNA, 11 bp, Homo sapiens
ctattttaaga

SEQ ID NO: 4661735 - DNA, 18 bp, Homo sapiens
ctattttcataatcagta

SEQ ID NO: 4661736 - DNA, 21 bp, Homo sapiens
ctattttcataatcagtaaat

SEQ ID NO: 4661737 - DNA, 19 bp, Homo sapiens
ctattttcatcacagttgc

SEQ ID NO: 4661738 - DNA, 13 bp, Homo sapiens
ctatttttcaatc

SEQ ID NO: 4661739 - DNA, 15 bp, Homo sapiens
ctatttttcaatcat

SEQ ID NO: 4661740 - DNA, 17 bp, Homo sapiens
ctcaaaaatgagagtga

SEQ ID NO: 4661741 - DNA, 20 bp, Homo sapiens
ctcaaacctccaaaagccct

SEQ ID NO: 4661742 - DNA, 12 bp, Homo sapiens
ctcaaactatga

SEQ ID NO: 4661743 - DNA, 13 bp, Homo sapiens
ctcaaaggccaga

SEQ ID NO: 4661744 - DNA, 16 bp, Homo sapiens
ctcaaagtataatctt

SEQ ID NO: 4661745 - DNA, 17 bp, Homo sapiens
ctcaaattgtcagcaat

SEQ ID NO: 4661746 - DNA, 23 bp, Homo sapiens
ctcaacatactgtaatcaaaagg

SEQ ID NO: 4661747 - DNA, 17 bp, Homo sapiens
ctcaacggtctggcagg

SEQ ID NO: 4661748 - DNA, 22 bp, Homo sapiens
ctcaacggtctggcagggcagc

SEQ ID NO: 4661749 - DNA, 23 bp, Homo sapiens
ctcaacggtctggcagggcagca

SEQ ID NO: 4661750 - DNA, 18 bp, Homo sapiens
ctcaactagcagatacag

SEQ ID NO: 4661751 - DNA, 20 bp, Homo sapiens
ctcaactgtcccaaggaggg

SEQ ID NO: 4661752 - DNA, 15 bp, Homo sapiens
ctcaacttctttcct

SEQ ID NO: 4661753 - DNA, 23 bp, Homo sapiens
ctcaagaaataaaaggaagccaa

SEQ ID NO: 4661754 - DNA, 17 bp, Homo sapiens
ctcaagccccatttcct

SEQ ID NO: 4661755 - DNA, 18 bp, Homo sapiens
ctcaagccccatttcctc

SEQ ID NO: 4661756 - DNA, 15 bp, Homo sapiens
ctcacaaggcagcaa

SEQ ID NO: 4661757 - DNA, 12 bp, Homo sapiens
ctcacacaggca

SEQ ID NO: 4661758 - DNA, 13 bp, Homo sapiens
ctcacacaggcat

SEQ ID NO: 4661759 - DNA, 23 bp, Homo sapiens
ctcacacaggcatttcctgggtg

SEQ ID NO: 4661760 - DNA, 15 bp, Homo sapiens
ctcacagctgagttg

SEQ ID NO: 4661761 - DNA, 14 bp, Homo sapiens
ctcacatctccctt

SEQ ID NO: 4661762 - DNA, 17 bp, Homo sapiens
ctcacatctcccttcca

SEQ ID NO: 4661763 - DNA, 14 bp, Homo sapiens
ctcacccctcccct

SEQ ID NO: 4661764 - DNA, 16 bp, Homo sapiens
ctcacccctcccctgg

SEQ ID NO: 4661765 - DNA, 20 bp, Homo sapiens
ctcacccctcccctgggact

SEQ ID NO: 4661766 - DNA, 15 bp, Homo sapiens
ctcaccgactcacct

SEQ ID NO: 4661767 - DNA, 16 bp, Homo sapiens
ctcaccgactcacctg

SEQ ID NO: 4661768 - DNA, 21 bp, Homo sapiens
ctcacctgcgcaagtgcctgg

SEQ ID NO: 4661769 - DNA, 15 bp, Homo sapiens
ctcactaatttttgt

SEQ ID NO: 4661770 - DNA, 17 bp, Homo sapiens
ctcactaatttttgtat

SEQ ID NO: 4661771 - DNA, 22 bp, Homo sapiens
ctcactccctaggcccaagtct

SEQ ID NO: 4661772 - DNA, 11 bp, Homo sapiens
ctcactctggg

SEQ ID NO: 4661773 - DNA, 15 bp, Homo sapiens
ctcactctgtttcct

SEQ ID NO: 4661774 - DNA, 20 bp, Homo sapiens
ctcactcttgtcacccaggc

SEQ ID NO: 4661775 - DNA, 18 bp, Homo sapiens
ctcactgaaaacatctgg

SEQ ID NO: 4661776 - DNA, 15 bp, Homo sapiens
ctcactgcaacctct

SEQ ID NO: 4661777 - DNA, 19 bp, Homo sapiens
ctcactgcaacctctgcct

SEQ ID NO: 4661778 - DNA, 22 bp, Homo sapiens
ctcactgcaacctctgcctcct

SEQ ID NO: 4661779 - DNA, 17 bp, Homo sapiens
ctcactgcaatctctgc

SEQ ID NO: 4661780 - DNA, 23 bp, Homo sapiens
ctcactgtgttactgctttgcaa

SEQ ID NO: 4661781 - DNA, 21 bp, Homo sapiens
ctcactgttttataattagtc

SEQ ID NO: 4661782 - DNA, 23 bp, Homo sapiens
ctcacttccagcttgcctgtttc

SEQ ID NO: 4661783 - DNA, 15 bp, Homo sapiens
ctcacttgcttctta

SEQ ID NO: 4661784 - DNA, 16 bp, Homo sapiens
ctcagaagcctggggg

SEQ ID NO: 4661785 - DNA, 13 bp, Homo sapiens
ctcagaagtaaag

SEQ ID NO: 4661786 - DNA, 19 bp, Homo sapiens
ctcagaattgcacatctaa

SEQ ID NO: 4661787 - DNA, 12 bp, Homo sapiens
ctcagagcatga

SEQ ID NO: 4661788 - DNA, 15 bp, Homo sapiens
ctcagagcatgatgg

SEQ ID NO: 4661789 - DNA, 19 bp, Homo sapiens
ctcagagcttcctggggac

SEQ ID NO: 4661790 - DNA, 22 bp, Homo sapiens
ctcagagcttcctggggaccaa

SEQ ID NO: 4661791 - DNA, 18 bp, Homo sapiens
ctcagaggcgcactgtga

SEQ ID NO: 4661792 - DNA, 15 bp, Homo sapiens
cagaagtgaggatga

SEQ ID NO: 4661793 - DNA, 19 bp, Homo sapiens
cagaagtgccacttaagga

SEQ ID NO: 4661794 - DNA, 18 bp, Homo sapiens
cagaataaggcaggcatt

SEQ ID NO: 4661795 - DNA, 18 bp, Homo sapiens
cagaataggaagatatgc

SEQ ID NO: 4661796 - DNA, 21 bp, Homo sapiens
cagaatcccaaataaaaccca

SEQ ID NO: 4661797 - DNA, 15 bp, Homo sapiens
cagaatgttgtactt

SEQ ID NO: 4661798 - DNA, 19 bp, Homo sapiens
cagaatgttgtacttgaaa

SEQ ID NO: 4661799 - DNA, 22 bp, Homo sapiens
cagaattatacagacctaatat

SEQ ID NO: 4661800 - DNA, 12 bp, Homo sapiens
cagacaagcagc

SEQ ID NO: 4661801 - DNA, 13 bp, Homo sapiens
cagacagaagtct

SEQ ID NO: 4661802 - DNA, 14 bp, Homo sapiens
cagacagcaggcag

SEQ ID NO: 4661803 - DNA, 19 bp, Homo sapiens
cagacagcaggcagcgcca

SEQ ID NO: 4661804 - DNA, 13 bp, Homo sapiens
cagacagccaggt

SEQ ID NO: 4661805 - DNA, 18 bp, Homo sapiens
cagacaggcaaataaaag

SEQ ID NO: 4661806 - DNA, 21 bp, Homo sapiens
cagacaggctacaaagcagag

SEQ ID NO: 4661807 - DNA, 13 bp, Homo sapiens
cagacataaagcc

SEQ ID NO: 4661808 - DNA, 22 bp, Homo sapiens
cagacataaagccatgtttcct

SEQ ID NO: 4661809 - DNA, 12 bp, Homo sapiens
cagacccctggg

SEQ ID NO: 4661810 - DNA, 16 bp, Homo sapiens
cagacccctgggagct

SEQ ID NO: 4661811 - DNA, 12 bp, Homo sapiens
cagacctctgga

SEQ ID NO: 4661812 - DNA, 21 bp, Homo sapiens
cagacctgcatggtcaagcct

SEQ ID NO: 4661813 - DNA, 13 bp, Homo sapiens
cagacctgcctct

SEQ ID NO: 4661814 - DNA, 15 bp, Homo sapiens
cagacctgtcaccct

SEQ ID NO: 4661815 - DNA, 19 bp, Homo sapiens
cagacctgtcaccctgcag

SEQ ID NO: 4661816 - DNA, 14 bp, Homo sapiens
cagacgagacaaca

SEQ ID NO: 4661817 - DNA, 17 bp, Homo sapiens
cagacgagacaacagca

SEQ ID NO: 4661818 - DNA, 18 bp, Homo sapiens
cagacgagacaacagcac

SEQ ID NO: 4661819 - DNA, 19 bp, Homo sapiens
cagacgttaggcatttcct

SEQ ID NO: 4661820 - DNA, 15 bp, Homo sapiens
cagactactattttc

SEQ ID NO: 4661821 - DNA, 13 bp, Homo sapiens
cagactcagtttt

SEQ ID NO: 4661822 - DNA, 21 bp, Homo sapiens
cagactcctgaggacagctgt

SEQ ID NO: 4661823 - DNA, 14 bp, Homo sapiens
cagactctaggtta

SEQ ID NO: 4661824 - DNA, 18 bp, Homo sapiens
cagactctttaataaatt

SEQ ID NO: 4661825 - DNA, 11 bp, Homo sapiens
cagactgaaag

SEQ ID NO: 4661826 - DNA, 22 bp, Homo sapiens
cagactgaccttgatgagctgt

SEQ ID NO: 4661827 - DNA, 17 bp, Homo sapiens
cagactgtgaacttgac

SEQ ID NO: 4661828 - DNA, 21 bp, Homo sapiens
cagactgtgaacttgactggg

SEQ ID NO: 4661829 - DNA, 18 bp, Homo sapiens
cagacttgcccaggtcac

SEQ ID NO: 4661830 - DNA, 15 bp, Homo sapiens
cagactttcacacca

SEQ ID NO: 4661831 - DNA, 19 bp, Homo sapiens
cagactttggaaaatgcat

SEQ ID NO: 4661832 - DNA, 22 bp, Homo sapiens
cagagaacagaactggaggcag

SEQ ID NO: 4661833 - DNA, 16 bp, Homo sapiens
cagagaaggctatgta

SEQ ID NO: 4661834 - DNA, 17 bp, Homo sapiens
cagagaaggctatgtaa

SEQ ID NO: 4661835 - DNA, 18 bp, Homo sapiens
cagagaagtttgtagcca

SEQ ID NO: 4661836 - DNA, 20 bp, Homo sapiens
cagagaagtttgtagccagg

SEQ ID NO: 4661837 - DNA, 23 bp, Homo sapiens
cagagacaacaggtaaaacaggg

SEQ ID NO: 4661838 - DNA, 15 bp, Homo sapiens
cagagacagaggatg

SEQ ID NO: 4661839 - DNA, 16 bp, Homo sapiens
cagagagaatgagagc

SEQ ID NO: 4661840 - DNA, 19 bp, Homo sapiens
cagagagaatgagagcgac

SEQ ID NO: 4661841 - DNA, 17 bp, Homo sapiens
cagagatcgacagacag

SEQ ID NO: 4661842 - DNA, 22 bp, Homo sapiens
cagagatcgacagacagccagg

SEQ ID NO: 4661843 - DNA, 19 bp, Homo sapiens
cagagcaagaccctgcctc

SEQ ID NO: 4661844 - DNA, 15 bp, Homo sapiens
cagagcagacaggct

SEQ ID NO: 4661845 - DNA, 16 bp, Homo sapiens
cagagcagctccacca

SEQ ID NO: 4661846 - DNA, 22 bp, Homo sapiens
cagagcagctccaccactgtgc

SEQ ID NO: 4661847 - DNA, 15 bp, Homo sapiens
cagagcatgatggga

SEQ ID NO: 4661848 - DNA, 17 bp, Homo sapiens
cagagcatgatgggagg

SEQ ID NO: 4661849 - DNA, 21 bp, Homo sapiens
cagagcccctcctccagcccc

SEQ ID NO: 4661850 - DNA, 17 bp, Homo sapiens
cagagcctggctgccca

SEQ ID NO: 4661851 - DNA, 14 bp, Homo sapiens
cagagcctggggct

SEQ ID NO: 4661852 - DNA, 21 bp, Homo sapiens
cagagcgaagacccggccagg

SEQ ID NO: 4661853 - DNA, 13 bp, Homo sapiens
cagagcgcacagg

SEQ ID NO: 4661854 - DNA, 21 bp, Homo sapiens
cagagcgtccttggctgccgt

SEQ ID NO: 4661855 - DNA, 22 bp, Homo sapiens
cagagctaagggtgggtgctca

SEQ ID NO: 4661856 - DNA, 20 bp, Homo sapiens
cagagctacccgcagagttc

SEQ ID NO: 4661857 - DNA, 15 bp, Homo sapiens
cagagctctacaggc

SEQ ID NO: 4661858 - DNA, 17 bp, Homo sapiens
cagagctctacaggcct

SEQ ID NO: 4661859 - DNA, 11 bp, Homo sapiens
cagagctgtgc

SEQ ID NO: 4661860 - DNA, 14 bp, Homo sapiens
cagagctgtgccag

SEQ ID NO: 4661861 - DNA, 15 bp, Homo sapiens
cagagctgtgccagc

SEQ ID NO: 4661862 - DNA, 17 bp, Homo sapiens
cagagctgtgccagcag

SEQ ID NO: 4661863 - DNA, 16 bp, Homo sapiens
cagagcttcctgggga

SEQ ID NO: 4661864 - DNA, 21 bp, Homo sapiens
cagagcttcctggggaccaag

SEQ ID NO: 4661865 - DNA, 18 bp, Homo sapiens
cagaggaaatctgtaaca

SEQ ID NO: 4661866 - DNA, 17 bp, Homo sapiens
cagaggaatgtgggcta

SEQ ID NO: 4661867 - DNA, 12 bp, Homo sapiens
cagaggaccctt

SEQ ID NO: 4661868 - DNA, 22 bp, Homo sapiens
cagaggacccttacgtgagaaa

SEQ ID NO: 4661869 - DNA, 21 bp, Homo sapiens
cagaggactcccaaccctggc

SEQ ID NO: 4661870 - DNA, 22 bp, Homo sapiens
cagaggactcccaaccctggct

SEQ ID NO: 4661871 - DNA, 21 bp, Homo sapiens
cagaggagcccagcggcccaa

SEQ ID NO: 4661872 - DNA, 19 bp, Homo sapiens
cagaggcatttgagcagct

SEQ ID NO: 4661873 - DNA, 20 bp, Homo sapiens
cagaggcatttgagcagctg

SEQ ID NO: 4661874 - DNA, 21 bp, Homo sapiens
cagaggcatttgagcagctga

SEQ ID NO: 4661875 - DNA, 22 bp, Homo sapiens
cagaggcgaggggacagcccag

SEQ ID NO: 4661876 - DNA, 17 bp, Homo sapiens
cagaggcgcactgtgac

SEQ ID NO: 4661877 - DNA, 18 bp, Homo sapiens
cagaggcgcactgtgacc

SEQ ID NO: 4661878 - DNA, 23 bp, Homo sapiens
cagagggacaaccagaaggccct

SEQ ID NO: 4661879 - DNA, 14 bp, Homo sapiens
cagaggggcagatg

SEQ ID NO: 4661880 - DNA, 16 bp, Homo sapiens
cagagggtgtcaaaca

SEQ ID NO: 4661881 - DNA, 17 bp, Homo sapiens
cagagtaaattgctctg

SEQ ID NO: 4661882 - DNA, 23 bp, Homo sapiens
cagagtaaattgctctgttccca

SEQ ID NO: 4661883 - DNA, 21 bp, Homo sapiens
cagagtgaccagcacactgga

SEQ ID NO: 4661884 - DNA, 17 bp, Homo sapiens
cagagtggcctccctgc

SEQ ID NO: 4661885 - DNA, 19 bp, Homo sapiens
cagagtggcctccctgctg

SEQ ID NO: 4661886 - DNA, 13 bp, Homo sapiens
cagataaaatatt

SEQ ID NO: 4661887 - DNA, 22 bp, Homo sapiens
cagataaaatattttgttaact

SEQ ID NO: 4661888 - DNA, 15 bp, Homo sapiens
cagataatccctgta

SEQ ID NO: 4661889 - DNA, 20 bp, Homo sapiens
cagataatgcttttactaag

SEQ ID NO: 4661890 - DNA, 18 bp, Homo sapiens
cagatagatgttgctctt

SEQ ID NO: 4661891 - DNA, 19 bp, Homo sapiens
cagatagatgttgctcttt

SEQ ID NO: 4661892 - DNA, 19 bp, Homo sapiens
cagatcaagctgtgagaca

SEQ ID NO: 4661893 - DNA, 15 bp, Homo sapiens
cagatcatccagaag

SEQ ID NO: 4661894 - DNA, 13 bp, Homo sapiens
cagatcttggaat

SEQ ID NO: 4661895 - DNA, 16 bp, Homo sapiens
cagatgaactgactga

SEQ ID NO: 4661896 - DNA, 16 bp, Homo sapiens
cagatgaggccctgca

SEQ ID NO: 4661897 - DNA, 19 bp, Homo sapiens
cagatgaggccctgcacct

SEQ ID NO: 4661898 - DNA, 14 bp, Homo sapiens
cagatgcagggcag

SEQ ID NO: 4661899 - DNA, 14 bp, Homo sapiens
cagatgcccttgct

SEQ ID NO: 4661900 - DNA, 16 bp, Homo sapiens
cagatgcccttgctgg

SEQ ID NO: 4661901 - DNA, 23 bp, Homo sapiens
cagatgcccttgctgggcctggg

SEQ ID NO: 4661902 - DNA, 18 bp, Homo sapiens
cagcctcacccctgcccc

SEQ ID NO: 4661903 - DNA, 19 bp, Homo sapiens
cagcctcacccctgcccct

SEQ ID NO: 4661904 - DNA, 16 bp, Homo sapiens
cagcctcacttccttt

SEQ ID NO: 4661905 - DNA, 22 bp, Homo sapiens
cagcctcacttcctttgccctt

SEQ ID NO: 4661906 - DNA, 16 bp, Homo sapiens
cagcctcccatccagg

SEQ ID NO: 4661907 - DNA, 19 bp, Homo sapiens
cagcctcccgagtagctgg

SEQ ID NO: 4661908 - DNA, 19 bp, Homo sapiens
cagcctcgcgggtgtcaca

SEQ ID NO: 4661909 - DNA, 23 bp, Homo sapiens
cagcctctgacttaagctgcctc

SEQ ID NO: 4661910 - DNA, 18 bp, Homo sapiens
cagcctctggtcctacca

SEQ ID NO: 4661911 - DNA, 13 bp, Homo sapiens
cagcctgaggtgc

SEQ ID NO: 4661912 - DNA, 15 bp, Homo sapiens
cagcctgaggtgccc

SEQ ID NO: 4661913 - DNA, 23 bp, Homo sapiens
cagcctgctctagtgggacagcc

SEQ ID NO: 4661914 - DNA, 12 bp, Homo sapiens
cagcctgctgac

SEQ ID NO: 4661915 - DNA, 11 bp, Homo sapiens
cagcctggcct

SEQ ID NO: 4661916 - DNA, 21 bp, Homo sapiens
cagcctggcctcctgcctcta

SEQ ID NO: 4661917 - DNA, 16 bp, Homo sapiens
cagcctgtggcagggc

SEQ ID NO: 4661918 - DNA, 15 bp, Homo sapiens
cagccttccctctgc

SEQ ID NO: 4661919 - DNA, 17 bp, Homo sapiens
cagccttccctctgcat

SEQ ID NO: 4661920 - DNA, 23 bp, Homo sapiens
cagccttgacctaatgaggtagc

SEQ ID NO: 4661921 - DNA, 21 bp, Homo sapiens
cagccttgctacttgaaggta

SEQ ID NO: 4661922 - DNA, 13 bp, Homo sapiens
cagcctttttagg

SEQ ID NO: 4661923 - DNA, 16 bp, Homo sapiens
cagcgaagtagcttgc

SEQ ID NO: 4661924 - DNA, 23 bp, Homo sapiens
cagcgatgtatgcagctatctgg

SEQ ID NO: 4661925 - DNA, 23 bp, Homo sapiens
cagcgattccctctcccaggccc

SEQ ID NO: 4661926 - DNA, 21 bp, Homo sapiens
cagcgccaagtaaacagggta

SEQ ID NO: 4661927 - DNA, 18 bp, Homo sapiens
cagcgccaagtgcgtgcc

SEQ ID NO: 4661928 - DNA, 24 bp, Homo sapiens
cagcgccaagtgcgtgccgtgtga

SEQ ID NO: 4661929 - DNA, 21 bp, Homo sapiens
cagcgccaggctgaccacagc

SEQ ID NO: 4661930 - DNA, 22 bp, Homo sapiens
cagcgccaggctgaccacagca

SEQ ID NO: 4661931 - DNA, 14 bp, Homo sapiens
cagcgccatcctga

SEQ ID NO: 4661932 - DNA, 13 bp, Homo sapiens
cagcggcccaaga

SEQ ID NO: 4661933 - DNA, 19 bp, Homo sapiens
cagcgggagcctccctgcc

SEQ ID NO: 4661934 - DNA, 20 bp, Homo sapiens
cagcgggagcctccctgcct

SEQ ID NO: 4661935 - DNA, 13 bp, Homo sapiens
cagctagtgaccc

SEQ ID NO: 4661936 - DNA, 18 bp, Homo sapiens
cagctagtgacccacatg

SEQ ID NO: 4661937 - DNA, 19 bp, Homo sapiens
cagctagtgacccacatgc

SEQ ID NO: 4661938 - DNA, 21 bp, Homo sapiens
cagctagtgacccacatgcca

SEQ ID NO: 4661939 - DNA, 22 bp, Homo sapiens
cagctagtgacccacatgccat

SEQ ID NO: 4661940 - DNA, 23 bp, Homo sapiens
cagctatctggtcaacctcctgg

SEQ ID NO: 4661941 - DNA, 13 bp, Homo sapiens
cagctcagccagt

SEQ ID NO: 4661942 - DNA, 15 bp, Homo sapiens
cagctccaccactgt

SEQ ID NO: 4661943 - DNA, 17 bp, Homo sapiens
cagctccaccactgtgc

SEQ ID NO: 4661944 - DNA, 20 bp, Homo sapiens
cagctccaccactgtgcact

SEQ ID NO: 4661945 - DNA, 21 bp, Homo sapiens
cagctccggcctgtcctccaa

SEQ ID NO: 4661946 - DNA, 12 bp, Homo sapiens
cagctcctgcca

SEQ ID NO: 4661947 - DNA, 16 bp, Homo sapiens
cagctctggagaacag

SEQ ID NO: 4661948 - DNA, 12 bp, Homo sapiens
cagctctgggcc

SEQ ID NO: 4661949 - DNA, 19 bp, Homo sapiens
cagctctgggccattctcc

SEQ ID NO: 4661950 - DNA, 15 bp, Homo sapiens
cagctctttccaaat

SEQ ID NO: 4661951 - DNA, 18 bp, Homo sapiens
cagctctttccaaattaa

SEQ ID NO: 4661952 - DNA, 14 bp, Homo sapiens
cagctgaaggcagt

SEQ ID NO: 4661953 - DNA, 18 bp, Homo sapiens
cagctgaaggcagtggca

SEQ ID NO: 4661954 - DNA, 19 bp, Homo sapiens
cagctgaaggcagtggcag

SEQ ID NO: 4661955 - DNA, 21 bp, Homo sapiens
cagctgaataacctgcacagg

SEQ ID NO: 4661956 - DNA, 22 bp, Homo sapiens
cagctgaataacctgcacaggc

SEQ ID NO: 4661957 - DNA, 21 bp, Homo sapiens
cagctgaatgcctcctgtggg

SEQ ID NO: 4661958 - DNA, 14 bp, Homo sapiens
cagctgagcagggc

SEQ ID NO: 4661959 - DNA, 20 bp, Homo sapiens
cagctgagcagggccgggga

SEQ ID NO: 4661960 - DNA, 14 bp, Homo sapiens
cagctgagcgccag

SEQ ID NO: 4661961 - DNA, 16 bp, Homo sapiens
cagctgagtgagtggg

SEQ ID NO: 4661962 - DNA, 20 bp, Homo sapiens
cagctgccccaatgtgacct

SEQ ID NO: 4661963 - DNA, 17 bp, Homo sapiens
cagctgctctaagccca

SEQ ID NO: 4661964 - DNA, 22 bp, Homo sapiens
cagctggaaaagggtcttggga

SEQ ID NO: 4661965 - DNA, 18 bp, Homo sapiens
cagctggaaacttctgta

SEQ ID NO: 4661966 - DNA, 19 bp, Homo sapiens
cagctggaaacttctgtaa

SEQ ID NO: 4661967 - DNA, 20 bp, Homo sapiens
cagctggaaacttctgtaag

SEQ ID NO: 4661968 - DNA, 23 bp, Homo sapiens
cagctggcctggcccccagcttc

SEQ ID NO: 4661969 - DNA, 18 bp, Homo sapiens
cagctgggtcaggcaggg

SEQ ID NO: 4661970 - DNA, 14 bp, Homo sapiens
cagctggtccagac

SEQ ID NO: 4661971 - DNA, 16 bp, Homo sapiens
cagctggtcctgacca

SEQ ID NO: 4661972 - DNA, 21 bp, Homo sapiens
cagctggtcctgaccaggatg

SEQ ID NO: 4661973 - DNA, 16 bp, Homo sapiens
cagctgtcctcttctg

SEQ ID NO: 4661974 - DNA, 16 bp, Homo sapiens
cagctgtcctgcagca

SEQ ID NO: 4661975 - DNA, 22 bp, Homo sapiens
cagctgtcctgcagcaaacact

SEQ ID NO: 4661976 - DNA, 20 bp, Homo sapiens
cagctgtgcctcgctcccca

SEQ ID NO: 4661977 - DNA, 21 bp, Homo sapiens
cagctgtttgaaatgtttaat

SEQ ID NO: 4661978 - DNA, 16 bp, Homo sapiens
cagcttcacctctggg

SEQ ID NO: 4661979 - DNA, 20 bp, Homo sapiens
cagcttcctttcctgtgtgt

SEQ ID NO: 4661980 - DNA, 17 bp, Homo sapiens
cagcttctcagtttctg

SEQ ID NO: 4661981 - DNA, 23 bp, Homo sapiens
cagcttgatcaaaggcacacagc

SEQ ID NO: 4661982 - DNA, 15 bp, Homo sapiens
cagcttgcctgtttc

SEQ ID NO: 4661983 - DNA, 20 bp, Homo sapiens
cagcttgctgtcacttcttc

SEQ ID NO: 4661984 - DNA, 21 bp, Homo sapiens
cagcttgctgtcacttcttca

SEQ ID NO: 4661985 - DNA, 23 bp, Homo sapiens
cagcttggtattgcagagaagat

SEQ ID NO: 4661986 - DNA, 16 bp, Homo sapiens
cagcttgtagccagcc

SEQ ID NO: 4661987 - DNA, 19 bp, Homo sapiens
cagcttgtagccagccggg

SEQ ID NO: 4661988 - DNA, 15 bp, Homo sapiens
cagctttgaaggctg

SEQ ID NO: 4661989 - DNA, 20 bp, Homo sapiens
cagctttggattgctggggc

SEQ ID NO: 4661990 - DNA, 18 bp, Homo sapiens
cagcttttgatggtactg

SEQ ID NO: 4661991 - DNA, 16 bp, Homo sapiens
caggaaaaggcctggg

SEQ ID NO: 4661992 - DNA, 17 bp, Homo sapiens
caggaaaaggcctgggg

SEQ ID NO: 4661993 - DNA, 13 bp, Homo sapiens
caggaaaatgtat

SEQ ID NO: 4661994 - DNA, 15 bp, Homo sapiens
caggaaagccaggcc

SEQ ID NO: 4661995 - DNA, 17 bp, Homo sapiens
caggaaaggaggaccag

SEQ ID NO: 4661996 - DNA, 15 bp, Homo sapiens
caggaaatgtttaat

SEQ ID NO: 4661997 - DNA, 22 bp, Homo sapiens
caggaacaaacagggctgcctt

SEQ ID NO: 4661998 - DNA, 20 bp, Homo sapiens
caggaacttctagctcattt

SEQ ID NO: 4661999 - DNA, 13 bp, Homo sapiens
caggaataaagac

SEQ ID NO: 4662000 - DNA, 16 bp, Homo sapiens
caggaatgaccctttt

SEQ ID NO: 4662001 - DNA, 16 bp, Homo sapiens
caggaattcagtgcct

SEQ ID NO: 4662002 - DNA, 14 bp, Homo sapiens
caggacacaggcct

SEQ ID NO: 4662003 - DNA, 16 bp, Homo sapiens
caggacacaggcctgt

SEQ ID NO: 4662004 - DNA, 17 bp, Homo sapiens
caggacagcttgtatgt

SEQ ID NO: 4662005 - DNA, 14 bp, Homo sapiens
caggacaggaaaaa

SEQ ID NO: 4662006 - DNA, 18 bp, Homo sapiens
caggacatgcggtagcca

SEQ ID NO: 4662007 - DNA, 20 bp, Homo sapiens
caggacatgcggtagccagc

SEQ ID NO: 4662008 - DNA, 13 bp, Homo sapiens
caggaccacctcc

SEQ ID NO: 4662009 - DNA, 23 bp, Homo sapiens
caggaccacctcctctgccagca

SEQ ID NO: 4662010 - DNA, 14 bp, Homo sapiens
caggacctggctgc

SEQ ID NO: 4662011 - DNA, 16 bp, Homo sapiens
cagggagatgtctaga

SEQ ID NO: 4662012 - DNA, 15 bp, Homo sapiens
cagggagcggccggc

SEQ ID NO: 4662013 - DNA, 17 bp, Homo sapiens
cagggagcggccggcca

SEQ ID NO: 4662014 - DNA, 19 bp, Homo sapiens
cagggagcggccggccagc

SEQ ID NO: 4662015 - DNA, 17 bp, Homo sapiens
cagggagctgcaggggc

SEQ ID NO: 4662016 - DNA, 12 bp, Homo sapiens
cagggaggccga

SEQ ID NO: 4662017 - DNA, 22 bp, Homo sapiens
cagggagtgctggctcacagta

SEQ ID NO: 4662018 - DNA, 14 bp, Homo sapiens
cagggatgctgggc

SEQ ID NO: 4662019 - DNA, 15 bp, Homo sapiens
cagggatgctgggct

SEQ ID NO: 4662020 - DNA, 20 bp, Homo sapiens
cagggatgctgggctgggcc

SEQ ID NO: 4662021 - DNA, 21 bp, Homo sapiens
cagggatgctgggctgggccc

SEQ ID NO: 4662022 - DNA, 15 bp, Homo sapiens
cagggcaaggccatt

SEQ ID NO: 4662023 - DNA, 13 bp, Homo sapiens
cagggcacaggag

SEQ ID NO: 4662024 - DNA, 18 bp, Homo sapiens
cagggcacaggagctacc

SEQ ID NO: 4662025 - DNA, 20 bp, Homo sapiens
cagggcacaggagctacctg

SEQ ID NO: 4662026 - DNA, 14 bp, Homo sapiens
cagggcagcaggag

SEQ ID NO: 4662027 - DNA, 18 bp, Homo sapiens
cagggcagcgccaggctg

SEQ ID NO: 4662028 - DNA, 21 bp, Homo sapiens
cagggcagtcattggctgtct

SEQ ID NO: 4662029 - DNA, 17 bp, Homo sapiens
cagggccagagcagctc

SEQ ID NO: 4662030 - DNA, 15 bp, Homo sapiens
cagggccagtggggc

SEQ ID NO: 4662031 - DNA, 19 bp, Homo sapiens
cagggccagtggggcctgt

SEQ ID NO: 4662032 - DNA, 22 bp, Homo sapiens
cagggccagtggggcctgtgga

SEQ ID NO: 4662033 - DNA, 21 bp, Homo sapiens
cagggccatctgactgccaag

SEQ ID NO: 4662034 - DNA, 15 bp, Homo sapiens
cagggcccccatctc

SEQ ID NO: 4662035 - DNA, 12 bp, Homo sapiens
cagggccctccc

SEQ ID NO: 4662036 - DNA, 14 bp, Homo sapiens
cagggccctcccag

SEQ ID NO: 4662037 - DNA, 22 bp, Homo sapiens
cagggccggggaactggccaag

SEQ ID NO: 4662038 - DNA, 13 bp, Homo sapiens
cagggcctgagtg

SEQ ID NO: 4662039 - DNA, 15 bp, Homo sapiens
cagggcctgccccct

SEQ ID NO: 4662040 - DNA, 19 bp, Homo sapiens
cagggcctgccccctgggg

SEQ ID NO: 4662041 - DNA, 17 bp, Homo sapiens
cagggcctggagcccca

SEQ ID NO: 4662042 - DNA, 14 bp, Homo sapiens
cagggcctggggcc

SEQ ID NO: 4662043 - DNA, 19 bp, Homo sapiens
cagggcctggggcctgaga

SEQ ID NO: 4662044 - DNA, 20 bp, Homo sapiens
cagggcctggggcctgagag

SEQ ID NO: 4662045 - DNA, 22 bp, Homo sapiens
cagggctcatttttgcacttat

SEQ ID NO: 4662046 - DNA, 19 bp, Homo sapiens
cagggctctcctggcttcc

SEQ ID NO: 4662047 - DNA, 15 bp, Homo sapiens
cagggctgccctgag

SEQ ID NO: 4662048 - DNA, 22 bp, Homo sapiens
cagggctgccctgagaagctgc

SEQ ID NO: 4662049 - DNA, 17 bp, Homo sapiens
cagggctgctctttcca

SEQ ID NO: 4662050 - DNA, 22 bp, Homo sapiens
cagggctgctctttccacttgc

SEQ ID NO: 4662051 - DNA, 12 bp, Homo sapiens
cagggctgggga

SEQ ID NO: 4662052 - DNA, 20 bp, Homo sapiens
cagggcttacggccctggcc

SEQ ID NO: 4662053 - DNA, 20 bp, Homo sapiens
caggggaaggaaggagggca

SEQ ID NO: 4662054 - DNA, 16 bp, Homo sapiens
caggggacactttgtt

SEQ ID NO: 4662055 - DNA, 14 bp, Homo sapiens
caggggaggagcct

SEQ ID NO: 4662056 - DNA, 19 bp, Homo sapiens
caggggagggtcagccagg

SEQ ID NO: 4662057 - DNA, 20 bp, Homo sapiens
caggggatggggtgggggga

SEQ ID NO: 4662058 - DNA, 14 bp, Homo sapiens
caggggccagaaga

SEQ ID NO: 4662059 - DNA, 13 bp, Homo sapiens
caggggccaggag

SEQ ID NO: 4662060 - DNA, 19 bp, Homo sapiens
caggggcgggcggagggag

SEQ ID NO: 4662061 - DNA, 21 bp, Homo sapiens
caggggctgactctccaggga

SEQ ID NO: 4662062 - DNA, 22 bp, Homo sapiens
cagggggccccgccagggctgg

SEQ ID NO: 4662063 - DNA, 20 bp, Homo sapiens
cagggtctctccctcaggtg

SEQ ID NO: 4662064 - DNA, 20 bp, Homo sapiens
cagggtctgtgtgaatgtgg

SEQ ID NO: 4662065 - DNA, 22 bp, Homo sapiens
cagggtcttggctgcctgtggg

SEQ ID NO: 4662066 - DNA, 22 bp, Homo sapiens
cagggtcttttcatctgggaaa

SEQ ID NO: 4662067 - DNA, 15 bp, Homo sapiens
caggtaaaacagggc

SEQ ID NO: 4662068 - DNA, 21 bp, Homo sapiens
caggtagacctgtctcctggc

SEQ ID NO: 4662069 - DNA, 21 bp, Homo sapiens
caggtagttggaactttctgt

SEQ ID NO: 4662070 - DNA, 21 bp, Homo sapiens
caggtatcctgggggaagagg

SEQ ID NO: 4662071 - DNA, 22 bp, Homo sapiens
caggtatcctgggggaagagga

SEQ ID NO: 4662072 - DNA, 14 bp, Homo sapiens
caggtatggctctg

SEQ ID NO: 4662073 - DNA, 18 bp, Homo sapiens
caggtatttagaagcaga

SEQ ID NO: 4662074 - DNA, 22 bp, Homo sapiens
caggtatttagaagcagaggga

SEQ ID NO: 4662075 - DNA, 22 bp, Homo sapiens
caggtatttcagaaggagaagg

SEQ ID NO: 4662076 - DNA, 23 bp, Homo sapiens
caggtatttcagaaggagaaggc

SEQ ID NO: 4662077 - DNA, 17 bp, Homo sapiens
caggtcagcccatggag

SEQ ID NO: 4662078 - DNA, 21 bp, Homo sapiens
caggtcagcccatggaggcag

SEQ ID NO: 4662079 - DNA, 22 bp, Homo sapiens
caggtccacggtctgttcttga

SEQ ID NO: 4662080 - DNA, 14 bp, Homo sapiens
caggtcctggtggg

SEQ ID NO: 4662081 - DNA, 18 bp, Homo sapiens
caggtcctggtggggcag

SEQ ID NO: 4662082 - DNA, 19 bp, Homo sapiens
caggtcctggtggggcagc

SEQ ID NO: 4662083 - DNA, 23 bp, Homo sapiens
caggtgatccgcccacctcagcc

SEQ ID NO: 4662084 - DNA, 18 bp, Homo sapiens
caggtgcaaccagggagc

SEQ ID NO: 4662085 - DNA, 21 bp, Homo sapiens
caggtgctgacttcatctccc

SEQ ID NO: 4662086 - DNA, 15 bp, Homo sapiens
caggtggcctggagg

SEQ ID NO: 4662087 - DNA, 22 bp, Homo sapiens
caggtgtgataaaatgttgaac

SEQ ID NO: 4662088 - DNA, 15 bp, Homo sapiens
caggtgtgtgggcca

SEQ ID NO: 4662089 - DNA, 22 bp, Homo sapiens
caggttcaagcgattctcctgc

SEQ ID NO: 4662090 - DNA, 14 bp, Homo sapiens
caggttcccaagct

SEQ ID NO: 4662091 - DNA, 17 bp, Homo sapiens
caggttccccaagggcc

SEQ ID NO: 4662092 - DNA, 20 bp, Homo sapiens
caggttccccaagggccctg

SEQ ID NO: 4662093 - DNA, 21 bp, Homo sapiens
caggttccccaagggccctgg

SEQ ID NO: 4662094 - DNA, 22 bp, Homo sapiens
caggttccccaagggccctggc

SEQ ID NO: 4662095 - DNA, 18 bp, Homo sapiens
caggttcttcttcctgaa

SEQ ID NO: 4662096 - DNA, 20 bp, Homo sapiens
cagtaaatagtgtcatataa

SEQ ID NO: 4662097 - DNA, 11 bp, Homo sapiens
cagtaatgaaa

SEQ ID NO: 4662098 - DNA, 21 bp, Homo sapiens
cagtaatggggtgagctcaca

SEQ ID NO: 4662099 - DNA, 11 bp, Homo sapiens
cagtaccaaag

SEQ ID NO: 4662100 - DNA, 20 bp, Homo sapiens
cagtacctagctggctctgt

SEQ ID NO: 4662101 - DNA, 20 bp, Homo sapiens
cagtacttgagggaccaata

SEQ ID NO: 4662102 - DNA, 14 bp, Homo sapiens
cagtagaactgtct

SEQ ID NO: 4662103 - DNA, 15 bp, Homo sapiens
cagtagaactgtctg

SEQ ID NO: 4662104 - DNA, 18 bp, Homo sapiens
cagtagcagcagaggcca

SEQ ID NO: 4662105 - DNA, 18 bp, Homo sapiens
cagtagcccagagtgagc

SEQ ID NO: 4662106 - DNA, 14 bp, Homo sapiens
cagtagctcttaga

SEQ ID NO: 4662107 - DNA, 14 bp, Homo sapiens
cagtaggaccaggc

SEQ ID NO: 4662108 - DNA, 17 bp, Homo sapiens
cagtatcatgccctgtg

SEQ ID NO: 4662109 - DNA, 14 bp, Homo sapiens
cagtatttaactaa

SEQ ID NO: 4662110 - DNA, 16 bp, Homo sapiens
cagtatttccacttgt

SEQ ID NO: 4662111 - DNA, 12 bp, Homo sapiens
cagtcacagcca

SEQ ID NO: 4662112 - DNA, 14 bp, Homo sapiens
cagtcacctcacaa

SEQ ID NO: 4662113 - DNA, 24 bp, Homo sapiens
cagtcagggtttgtcagaggaaca

SEQ ID NO: 4662114 - DNA, 13 bp, Homo sapiens
cagtcatcatcag

SEQ ID NO: 4662115 - DNA, 15 bp, Homo sapiens
cagtcatcatcaggg

SEQ ID NO: 4662116 - DNA, 19 bp, Homo sapiens
cagtcatcatcagggcctg

SEQ ID NO: 4662117 - DNA, 17 bp, Homo sapiens
cagtcattggctgtctc

SEQ ID NO: 4662118 - DNA, 21 bp, Homo sapiens
cagtcattggctgtctcctag

SEQ ID NO: 4662119 - DNA, 20 bp, Homo sapiens
cagtccgtgtggatccaatg

SEQ ID NO: 4662120 - DNA, 23 bp, Homo sapiens
catactaccctttgctggaagaa

SEQ ID NO: 4662121 - DNA, 18 bp, Homo sapiens
catactctgttgcctcct

SEQ ID NO: 4662122 - DNA, 22 bp, Homo sapiens
catactctgttgcctcctctct

SEQ ID NO: 4662123 - DNA, 18 bp, Homo sapiens
catactgtagacactctg

SEQ ID NO: 4662124 - DNA, 21 bp, Homo sapiens
catactgtagacactctgaca

SEQ ID NO: 4662125 - DNA, 16 bp, Homo sapiens
catacttaacatttca

SEQ ID NO: 4662126 - DNA, 14 bp, Homo sapiens
catactttgtaaat

SEQ ID NO: 4662127 - DNA, 15 bp, Homo sapiens
catactttgtaaata

SEQ ID NO: 4662128 - DNA, 13 bp, Homo sapiens
catagaaaaggcg

SEQ ID NO: 4662129 - DNA, 20 bp, Homo sapiens
catagaaatggaaattttgc

SEQ ID NO: 4662130 - DNA, 20 bp, Homo sapiens
catagaagggagggaataaa

SEQ ID NO: 4662131 - DNA, 22 bp, Homo sapiens
catagagagggagaagaagtca

SEQ ID NO: 4662132 - DNA, 15 bp, Homo sapiens
catagagatgagccc

SEQ ID NO: 4662133 - DNA, 20 bp, Homo sapiens
catagatttaagtgaataca

SEQ ID NO: 4662134 - DNA, 15 bp, Homo sapiens
catagctaaaggcta

SEQ ID NO: 4662135 - DNA, 14 bp, Homo sapiens
cataggagggaagg

SEQ ID NO: 4662136 - DNA, 19 bp, Homo sapiens
catagggtcggaggtgctg

SEQ ID NO: 4662137 - DNA, 16 bp, Homo sapiens
cataggtttctctccc

SEQ ID NO: 4662138 - DNA, 13 bp, Homo sapiens
catagtaaaagaa

SEQ ID NO: 4662139 - DNA, 13 bp, Homo sapiens
catagtcacatgg

SEQ ID NO: 4662140 - DNA, 22 bp, Homo sapiens
catagtctttgtttacatgagt

SEQ ID NO: 4662141 - DNA, 14 bp, Homo sapiens
catagttttctaaa

SEQ ID NO: 4662142 - DNA, 20 bp, Homo sapiens
catatacattttgttgcagg

SEQ ID NO: 4662143 - DNA, 17 bp, Homo sapiens
catatattaccccttca

SEQ ID NO: 4662144 - DNA, 14 bp, Homo sapiens
catatattgaggtt

SEQ ID NO: 4662145 - DNA, 18 bp, Homo sapiens
catatcagaataggaaga

SEQ ID NO: 4662146 - DNA, 18 bp, Homo sapiens
catatgaattagccaaaa

SEQ ID NO: 4662147 - DNA, 17 bp, Homo sapiens
catatgaggacctttat

SEQ ID NO: 4662148 - DNA, 23 bp, Homo sapiens
catatgaggacctttatatctgt

SEQ ID NO: 4662149 - DNA, 15 bp, Homo sapiens
catatgatctgtttt

SEQ ID NO: 4662150 - DNA, 20 bp, Homo sapiens
catatggactctgcacatga

SEQ ID NO: 4662151 - DNA, 21 bp, Homo sapiens
catatgggatattcccaagcc

SEQ ID NO: 4662152 - DNA, 22 bp, Homo sapiens
catatgggatattcccaagccg

SEQ ID NO: 4662153 - DNA, 14 bp, Homo sapiens
catattaattttct

SEQ ID NO: 4662154 - DNA, 18 bp, Homo sapiens
catattgttggcacagaa

SEQ ID NO: 4662155 - DNA, 22 bp, Homo sapiens
catattgttggcacagaacagg

SEQ ID NO: 4662156 - DNA, 14 bp, Homo sapiens
catatttattttct

SEQ ID NO: 4662157 - DNA, 14 bp, Homo sapiens
catatttcatttta

SEQ ID NO: 4662158 - DNA, 17 bp, Homo sapiens
catatttcattttaaca

SEQ ID NO: 4662159 - DNA, 14 bp, Homo sapiens
catatttgatttct

SEQ ID NO: 4662160 - DNA, 18 bp, Homo sapiens
catatttgatttctaatt

SEQ ID NO: 4662161 - DNA, 22 bp, Homo sapiens
catatttgatttctaattgtaa

SEQ ID NO: 4662162 - DNA, 22 bp, Homo sapiens
catattttaatcattatttgag

SEQ ID NO: 4662163 - DNA, 13 bp, Homo sapiens
catattttcttac

SEQ ID NO: 4662164 - DNA, 20 bp, Homo sapiens
catattttcttacttttatt

SEQ ID NO: 4662165 - DNA, 18 bp, Homo sapiens
catcaaaggaatataaga

SEQ ID NO: 4662166 - DNA, 22 bp, Homo sapiens
catcaaaggaatataagaaaag

SEQ ID NO: 4662167 - DNA, 20 bp, Homo sapiens
catcacctactcacacaggc

SEQ ID NO: 4662168 - DNA, 12 bp, Homo sapiens
catcagaaaggg

SEQ ID NO: 4662169 - DNA, 16 bp, Homo sapiens
catcagaaagggaggg

SEQ ID NO: 4662170 - DNA, 20 bp, Homo sapiens
catcagaaagggagggctct

SEQ ID NO: 4662171 - DNA, 22 bp, Homo sapiens
catcagaaagggagggctctga

SEQ ID NO: 4662172 - DNA, 24 bp, Homo sapiens
catcagaaagggagggctctgagg

SEQ ID NO: 4662173 - DNA, 14 bp, Homo sapiens
catcagccctgcta

SEQ ID NO: 4662174 - DNA, 16 bp, Homo sapiens
catcagggcctggggc

SEQ ID NO: 4662175 - DNA, 23 bp, Homo sapiens
catcagggcctggggcctgagag

SEQ ID NO: 4662176 - DNA, 13 bp, Homo sapiens
catcatcagggcc

SEQ ID NO: 4662177 - DNA, 14 bp, Homo sapiens
catcatcagggcct

SEQ ID NO: 4662178 - DNA, 15 bp, Homo sapiens
catcatcagggcctg

SEQ ID NO: 4662179 - DNA, 20 bp, Homo sapiens
catcatcctcccgccaggag

SEQ ID NO: 4662180 - DNA, 14 bp, Homo sapiens
catcatgcctctga

SEQ ID NO: 4662181 - DNA, 17 bp, Homo sapiens
catcatgcctctgaggc

SEQ ID NO: 4662182 - DNA, 19 bp, Homo sapiens
catcatgcctctgaggcca

SEQ ID NO: 4662183 - DNA, 22 bp, Homo sapiens
catcatgcctctgaggccagcc

SEQ ID NO: 4662184 - DNA, 14 bp, Homo sapiens
catcattactgttc

SEQ ID NO: 4662185 - DNA, 14 bp, Homo sapiens
catcattgtcagcc

SEQ ID NO: 4662186 - DNA, 15 bp, Homo sapiens
catcattgtcagcct

SEQ ID NO: 4662187 - DNA, 17 bp, Homo sapiens
catccaaagcagacagc

SEQ ID NO: 4662188 - DNA, 18 bp, Homo sapiens
catccaaagcagacagct

SEQ ID NO: 4662189 - DNA, 21 bp, Homo sapiens
catccacgtagggggcagggg

SEQ ID NO: 4662190 - DNA, 18 bp, Homo sapiens
catccacttacatatatt

SEQ ID NO: 4662191 - DNA, 20 bp, Homo sapiens
catccagatgtgtgcaatgt

SEQ ID NO: 4662192 - DNA, 14 bp, Homo sapiens
catccagcagcagc

SEQ ID NO: 4662193 - DNA, 11 bp, Homo sapiens
catccagggcc

SEQ ID NO: 4662194 - DNA, 17 bp, Homo sapiens
catccagttaaccaagt

SEQ ID NO: 4662195 - DNA, 14 bp, Homo sapiens
catccataaagaag

SEQ ID NO: 4662196 - DNA, 18 bp, Homo sapiens
catcccaaccagtgccaa

SEQ ID NO: 4662197 - DNA, 13 bp, Homo sapiens
catcccccctgct

SEQ ID NO: 4662198 - DNA, 14 bp, Homo sapiens
catcccccctgctg

SEQ ID NO: 4662199 - DNA, 19 bp, Homo sapiens
catcccccctgctgcccag

SEQ ID NO: 4662200 - DNA, 20 bp, Homo sapiens
catcccgtaagaccaccttc

SEQ ID NO: 4662201 - DNA, 23 bp, Homo sapiens
catcccgtaagaccaccttccct

SEQ ID NO: 4662202 - DNA, 21 bp, Homo sapiens
catccctatagaccactgggt

SEQ ID NO: 4662203 - DNA, 16 bp, Homo sapiens
catccctgactggcca

SEQ ID NO: 4662204 - DNA, 21 bp, Homo sapiens
catccctgactggccaaaccc

SEQ ID NO: 4662205 - DNA, 13 bp, Homo sapiens
catccctggagca

SEQ ID NO: 4662206 - DNA, 22 bp, Homo sapiens
catccctggagcaggagccccg

SEQ ID NO: 4662207 - DNA, 16 bp, Homo sapiens
catccctgggcctgct

SEQ ID NO: 4662208 - DNA, 19 bp, Homo sapiens
catccctgggcctgctgct

SEQ ID NO: 4662209 - DNA, 21 bp, Homo sapiens
catccctgggcctgctgctga

SEQ ID NO: 4662210 - DNA, 22 bp, Homo sapiens
catccctgggcctgctgctgag

SEQ ID NO: 4662211 - DNA, 13 bp, Homo sapiens
catcctcatccct

SEQ ID NO: 4662212 - DNA, 22 bp, Homo sapiens
catcctcccgccaggagcttct

SEQ ID NO: 4662213 - DNA, 17 bp, Homo sapiens
catcctggggcagcact

SEQ ID NO: 4662214 - DNA, 15 bp, Homo sapiens
catcctggtcagctg

SEQ ID NO: 4662215 - DNA, 21 bp, Homo sapiens
catcctttgtcttggaaccac

SEQ ID NO: 4662216 - DNA, 16 bp, Homo sapiens
catctaaagcagcagg

SEQ ID NO: 4662217 - DNA, 15 bp, Homo sapiens
catctaaattctgat

SEQ ID NO: 4662218 - DNA, 15 bp, Homo sapiens
catctaggtcctggc

SEQ ID NO: 4662219 - DNA, 19 bp, Homo sapiens
catctatcactgcattatc

SEQ ID NO: 4662220 - DNA, 16 bp, Homo sapiens
catctcacctcctgct

SEQ ID NO: 4662221 - DNA, 14 bp, Homo sapiens
catctcagcttttg

SEQ ID NO: 4662222 - DNA, 17 bp, Homo sapiens
catctcaggagatggag

SEQ ID NO: 4662223 - DNA, 23 bp, Homo sapiens
catctcaggagatggagggcttg

SEQ ID NO: 4662224 - DNA, 17 bp, Homo sapiens
catctcccttccacctc

SEQ ID NO: 4662225 - DNA, 23 bp, Homo sapiens
catctctctcttgcctgagggga

SEQ ID NO: 4662226 - DNA, 14 bp, Homo sapiens
catctgaaagtaga

SEQ ID NO: 4662227 - DNA, 12 bp, Homo sapiens
catctgcaaaag

SEQ ID NO: 4662228 - DNA, 12 bp, Homo sapiens
catctgggaaag

SEQ ID NO: 4662229 - DNA, 14 bp, Homo sapiens
catctgtctgctct

SEQ ID NO: 4662230 - DNA, 23 bp, Homo sapiens
catgtttaatgtgaactctcccc

SEQ ID NO: 4662231 - DNA, 13 bp, Homo sapiens
catgtttataaat

SEQ ID NO: 4662232 - DNA, 14 bp, Homo sapiens
catgtttggaagac

SEQ ID NO: 4662233 - DNA, 13 bp, Homo sapiens
catgttttaacaa

SEQ ID NO: 4662234 - DNA, 16 bp, Homo sapiens
cattaaaaagaataga

SEQ ID NO: 4662235 - DNA, 20 bp, Homo sapiens
cattaaaatgacaaacatga

SEQ ID NO: 4662236 - DNA, 17 bp, Homo sapiens
cattaactccctccacc

SEQ ID NO: 4662237 - DNA, 22 bp, Homo sapiens
cattaatggcatatggtcctag

SEQ ID NO: 4662238 - DNA, 19 bp, Homo sapiens
cattaatttaattactact

SEQ ID NO: 4662239 - DNA, 22 bp, Homo sapiens
cattacagggcacaggccatgg

SEQ ID NO: 4662240 - DNA, 16 bp, Homo sapiens
cattactgttccagat

SEQ ID NO: 4662241 - DNA, 17 bp, Homo sapiens
cattagagaagtattta

SEQ ID NO: 4662242 - DNA, 18 bp, Homo sapiens
cattatcttgctcattct

SEQ ID NO: 4662243 - DNA, 21 bp, Homo sapiens
cattatgaagaatacccagga

SEQ ID NO: 4662244 - DNA, 16 bp, Homo sapiens
cattatgccacttcct

SEQ ID NO: 4662245 - DNA, 18 bp, Homo sapiens
cattatgccacttccttt

SEQ ID NO: 4662246 - DNA, 13 bp, Homo sapiens
cattatgttcatg

SEQ ID NO: 4662247 - DNA, 14 bp, Homo sapiens
cattatgttcatgt

SEQ ID NO: 4662248 - DNA, 16 bp, Homo sapiens
cattatgttcatgtaa

SEQ ID NO: 4662249 - DNA, 18 bp, Homo sapiens
cattattcaagaatgaaa

SEQ ID NO: 4662250 - DNA, 21 bp, Homo sapiens
cattattcaagaatgaaaaat

SEQ ID NO: 4662251 - DNA, 18 bp, Homo sapiens
cattattctcttttatct

SEQ ID NO: 4662252 - DNA, 12 bp, Homo sapiens
cattatttgaga

SEQ ID NO: 4662253 - DNA, 16 bp, Homo sapiens
cattatttgagactgt

SEQ ID NO: 4662254 - DNA, 22 bp, Homo sapiens
cattcaattagtggtcataaaa

SEQ ID NO: 4662255 - DNA, 13 bp, Homo sapiens
cattcacctgccc

SEQ ID NO: 4662256 - DNA, 15 bp, Homo sapiens
cattcacctgcccca

SEQ ID NO: 4662257 - DNA, 16 bp, Homo sapiens
cattcacctgccccaa

SEQ ID NO: 4662258 - DNA, 15 bp, Homo sapiens
cattcagctctggag

SEQ ID NO: 4662259 - DNA, 16 bp, Homo sapiens
cattcagctctggaga

SEQ ID NO: 4662260 - DNA, 17 bp, Homo sapiens
cattcagctctggagaa

SEQ ID NO: 4662261 - DNA, 22 bp, Homo sapiens
cattccacactgcagggaggag

SEQ ID NO: 4662262 - DNA, 14 bp, Homo sapiens
cattcgttctgtgg

SEQ ID NO: 4662263 - DNA, 14 bp, Homo sapiens
cattctaatgcata

SEQ ID NO: 4662264 - DNA, 17 bp, Homo sapiens
cattctcataattccta

SEQ ID NO: 4662265 - DNA, 18 bp, Homo sapiens
cattctcataattcctac

SEQ ID NO: 4662266 - DNA, 21 bp, Homo sapiens
cattctcataattcctacagc

SEQ ID NO: 4662267 - DNA, 14 bp, Homo sapiens
cattctccacagca

SEQ ID NO: 4662268 - DNA, 20 bp, Homo sapiens
cattctcctcctcctccctc

SEQ ID NO: 4662269 - DNA, 21 bp, Homo sapiens
cattctcctcctcctccctcc

SEQ ID NO: 4662270 - DNA, 16 bp, Homo sapiens
cattctctcccatcct

SEQ ID NO: 4662271 - DNA, 17 bp, Homo sapiens
cattctgcctagagtgt

SEQ ID NO: 4662272 - DNA, 14 bp, Homo sapiens
cattcttcagttct

SEQ ID NO: 4662273 - DNA, 12 bp, Homo sapiens
cattcttggctt

SEQ ID NO: 4662274 - DNA, 17 bp, Homo sapiens
cattctttgtatcttaa

SEQ ID NO: 4662275 - DNA, 15 bp, Homo sapiens
cattcttttgccaca

SEQ ID NO: 4662276 - DNA, 21 bp, Homo sapiens
cattcttttgccacatcccta

SEQ ID NO: 4662277 - DNA, 23 bp, Homo sapiens
cattcttttgccacatccctata

SEQ ID NO: 4662278 - DNA, 16 bp, Homo sapiens
cattgaagccgactct

SEQ ID NO: 4662279 - DNA, 20 bp, Homo sapiens
cattgaagccgactctggcc

SEQ ID NO: 4662280 - DNA, 20 bp, Homo sapiens
cattgaagtatattcttatt

SEQ ID NO: 4662281 - DNA, 11 bp, Homo sapiens
cattgacatag

SEQ ID NO: 4662282 - DNA, 14 bp, Homo sapiens
cattgacctggagg

SEQ ID NO: 4662283 - DNA, 15 bp, Homo sapiens
cattgacctggaggg

SEQ ID NO: 4662284 - DNA, 17 bp, Homo sapiens
cattgacctggagggga

SEQ ID NO: 4662285 - DNA, 22 bp, Homo sapiens
cattgacctggaggggagaggt

SEQ ID NO: 4662286 - DNA, 18 bp, Homo sapiens
cattgactcctttccaat

SEQ ID NO: 4662287 - DNA, 16 bp, Homo sapiens
cattgaggaagagtct

SEQ ID NO: 4662288 - DNA, 17 bp, Homo sapiens
cattgaggaagagtctt

SEQ ID NO: 4662289 - DNA, 16 bp, Homo sapiens
cattgcctagctcttt

SEQ ID NO: 4662290 - DNA, 11 bp, Homo sapiens
cattgctgcca

SEQ ID NO: 4662291 - DNA, 14 bp, Homo sapiens
cattggacagaaaa

SEQ ID NO: 4662292 - DNA, 16 bp, Homo sapiens
cattggtgtactgtgt

SEQ ID NO: 4662293 - DNA, 21 bp, Homo sapiens
cattgtaaaccacaaggctgt

SEQ ID NO: 4662294 - DNA, 20 bp, Homo sapiens
cattgtaactattaaccttt

SEQ ID NO: 4662295 - DNA, 21 bp, Homo sapiens
cattgtatcgatgttatgtaa

SEQ ID NO: 4662296 - DNA, 22 bp, Homo sapiens
cattgtttgaaacaaagaaggt

SEQ ID NO: 4662297 - DNA, 23 bp, Homo sapiens
cattgttttcttttacagactag

SEQ ID NO: 4662298 - DNA, 16 bp, Homo sapiens
catttaaacatgttta

SEQ ID NO: 4662299 - DNA, 15 bp, Homo sapiens
catttaaattccaca

SEQ ID NO: 4662300 - DNA, 14 bp, Homo sapiens
catttaacagataa

SEQ ID NO: 4662301 - DNA, 14 bp, Homo sapiens
catttaactttata

SEQ ID NO: 4662302 - DNA, 17 bp, Homo sapiens
catttacctcgcagtgt

SEQ ID NO: 4662303 - DNA, 17 bp, Homo sapiens
catttagcttctttccc

SEQ ID NO: 4662304 - DNA, 22 bp, Homo sapiens
catttataatactgttttaaaa

SEQ ID NO: 4662305 - DNA, 15 bp, Homo sapiens
catttatatattgga

SEQ ID NO: 4662306 - DNA, 13 bp, Homo sapiens
catttcatgaaaa

SEQ ID NO: 4662307 - DNA, 14 bp, Homo sapiens
catttcatgaaaaa

SEQ ID NO: 4662308 - DNA, 12 bp, Homo sapiens
catttcattcca

SEQ ID NO: 4662309 - DNA, 15 bp, Homo sapiens
catttcattccattg

SEQ ID NO: 4662310 - DNA, 14 bp, Homo sapiens
catttcattgtaca

SEQ ID NO: 4662311 - DNA, 17 bp, Homo sapiens
catttccagcttctcag

SEQ ID NO: 4662312 - DNA, 18 bp, Homo sapiens
catttcctcacactaaga

SEQ ID NO: 4662313 - DNA, 11 bp, Homo sapiens
catttcctgct

SEQ ID NO: 4662314 - DNA, 13 bp, Homo sapiens
catttcctgctga

SEQ ID NO: 4662315 - DNA, 14 bp, Homo sapiens
catttcctgggtgg

SEQ ID NO: 4662316 - DNA, 16 bp, Homo sapiens
catttctactctagat

SEQ ID NO: 4662317 - DNA, 20 bp, Homo sapiens
catttctagcgcatggcctg

SEQ ID NO: 4662318 - DNA, 21 bp, Homo sapiens
catttctcatgttttccattg

SEQ ID NO: 4662319 - DNA, 15 bp, Homo sapiens
catttcttaaaactt

SEQ ID NO: 4662320 - DNA, 17 bp, Homo sapiens
catttgatgcatgtctt

SEQ ID NO: 4662321 - DNA, 19 bp, Homo sapiens
catttgatgcatgtctttt

SEQ ID NO: 4662322 - DNA, 22 bp, Homo sapiens
catttgatgcatgtcttttaaa

SEQ ID NO: 4662323 - DNA, 20 bp, Homo sapiens
catttgcttgtactgggaca

SEQ ID NO: 4662324 - DNA, 16 bp, Homo sapiens
catttgtgctagaaat

SEQ ID NO: 4662325 - DNA, 15 bp, Homo sapiens
cattttaaaaacttt

SEQ ID NO: 4662326 - DNA, 23 bp, Homo sapiens
cattttacccttgcagttttact

SEQ ID NO: 4662327 - DNA, 21 bp, Homo sapiens
cattttagaaacggacagctt

SEQ ID NO: 4662328 - DNA, 21 bp, Homo sapiens
cattttagcccagtgttttct

SEQ ID NO: 4662329 - DNA, 15 bp, Homo sapiens
cattttatcattaaa

SEQ ID NO: 4662330 - DNA, 20 bp, Homo sapiens
cattttatgaatatcattga

SEQ ID NO: 4662331 - DNA, 13 bp, Homo sapiens
cattttattgctt

SEQ ID NO: 4662332 - DNA, 23 bp, Homo sapiens
cattttcaataacaaaacgaaac

SEQ ID NO: 4662333 - DNA, 14 bp, Homo sapiens
cattttcattccta

SEQ ID NO: 4662334 - DNA, 11 bp, Homo sapiens
cattttctaaa

SEQ ID NO: 4662335 - DNA, 13 bp, Homo sapiens
cattttctaaata

SEQ ID NO: 4662336 - DNA, 13 bp, Homo sapiens
cattttctcttag

SEQ ID NO: 4662337 - DNA, 19 bp, Homo sapiens
cattttgtaaaatattatg

SEQ ID NO: 4662338 - DNA, 16 bp, Homo sapiens
catttttaagaaagga

SEQ ID NO: 4662339 - DNA, 21 bp, Homo sapiens
catttttaagaaaggaagcaa

SEQ ID NO: 4662340 - DNA, 22 bp, Homo sapiens
ccacatgccatttgtactgacc

SEQ ID NO: 4662341 - DNA, 21 bp, Homo sapiens
ccaccaccctgccccccctaa

SEQ ID NO: 4662342 - DNA, 15 bp, Homo sapiens
ccaccacgtctggct

SEQ ID NO: 4662343 - DNA, 22 bp, Homo sapiens
ccaccacgtctggctccctgcc

SEQ ID NO: 4662344 - DNA, 23 bp, Homo sapiens
ccaccagcctgctgacagacact

SEQ ID NO: 4662345 - DNA, 21 bp, Homo sapiens
ccaccagggagatgtctagag

SEQ ID NO: 4662346 - DNA, 16 bp, Homo sapiens
ccaccagggccagagc

SEQ ID NO: 4662347 - DNA, 17 bp, Homo sapiens
ccaccagggccagagca

SEQ ID NO: 4662348 - DNA, 18 bp, Homo sapiens
ccaccccattttctgtgg

SEQ ID NO: 4662349 - DNA, 16 bp, Homo sapiens
ccaccccttggaggag

SEQ ID NO: 4662350 - DNA, 13 bp, Homo sapiens
ccacccttgccca

SEQ ID NO: 4662351 - DNA, 13 bp, Homo sapiens
ccacccttgggca

SEQ ID NO: 4662352 - DNA, 22 bp, Homo sapiens
ccaccgctagtgcttgtggaga

SEQ ID NO: 4662353 - DNA, 18 bp, Homo sapiens
ccaccgggccactccttc

SEQ ID NO: 4662354 - DNA, 20 bp, Homo sapiens
ccaccgggccactccttcct

SEQ ID NO: 4662355 - DNA, 22 bp, Homo sapiens
ccaccgtgcccaacctcacttg

SEQ ID NO: 4662356 - DNA, 18 bp, Homo sapiens
ccacctcacaactccttc

SEQ ID NO: 4662357 - DNA, 15 bp, Homo sapiens
ccacctccagcctct

SEQ ID NO: 4662358 - DNA, 16 bp, Homo sapiens
ccacctcccaccaaca

SEQ ID NO: 4662359 - DNA, 20 bp, Homo sapiens
ccacctcctctgccagcagg

SEQ ID NO: 4662360 - DNA, 21 bp, Homo sapiens
ccacctcctctgccagcagga

SEQ ID NO: 4662361 - DNA, 22 bp, Homo sapiens
ccacctcctctgccagcaggaa

SEQ ID NO: 4662362 - DNA, 22 bp, Homo sapiens
ccaccttcaatgacttctaatt

SEQ ID NO: 4662363 - DNA, 20 bp, Homo sapiens
ccacggagcatctcagaaga

SEQ ID NO: 4662364 - DNA, 18 bp, Homo sapiens
ccacggatgcgtgggcag

SEQ ID NO: 4662365 - DNA, 14 bp, Homo sapiens
ccacggtttcagct

SEQ ID NO: 4662366 - DNA, 16 bp, Homo sapiens
ccacggtttcagctag

SEQ ID NO: 4662367 - DNA, 14 bp, Homo sapiens
ccacgtcccagcat

SEQ ID NO: 4662368 - DNA, 18 bp, Homo sapiens
ccacgtcccagcatccct

SEQ ID NO: 4662369 - DNA, 19 bp, Homo sapiens
ccacgtctggctccctgcc

SEQ ID NO: 4662370 - DNA, 14 bp, Homo sapiens
ccacgtggatgggc

SEQ ID NO: 4662371 - DNA, 22 bp, Homo sapiens
ccacgtggatgggcaaagcttg

SEQ ID NO: 4662372 - DNA, 14 bp, Homo sapiens
ccacgtgtatagta

SEQ ID NO: 4662373 - DNA, 17 bp, Homo sapiens
ccacgttgtccctgaga

SEQ ID NO: 4662374 - DNA, 16 bp, Homo sapiens
ccactaaaaatattgt

SEQ ID NO: 4662375 - DNA, 13 bp, Homo sapiens
ccactattttcaa

SEQ ID NO: 4662376 - DNA, 19 bp, Homo sapiens
ccactcaaaggccagacct

SEQ ID NO: 4662377 - DNA, 15 bp, Homo sapiens
ccactcagctgtcct

SEQ ID NO: 4662378 - DNA, 15 bp, Homo sapiens
ccactccgccagcca

SEQ ID NO: 4662379 - DNA, 17 bp, Homo sapiens
ccactccgccagccaca

SEQ ID NO: 4662380 - DNA, 14 bp, Homo sapiens
ccactccttcctgc

SEQ ID NO: 4662381 - DNA, 18 bp, Homo sapiens
ccactccttcctgcccca

SEQ ID NO: 4662382 - DNA, 11 bp, Homo sapiens
ccactccttgt

SEQ ID NO: 4662383 - DNA, 18 bp, Homo sapiens
ccactctgctctgatgca

SEQ ID NO: 4662384 - DNA, 23 bp, Homo sapiens
ccactctgctctgatgcatcaga

SEQ ID NO: 4662385 - DNA, 12 bp, Homo sapiens
ccactctggcag

SEQ ID NO: 4662386 - DNA, 14 bp, Homo sapiens
ccactctggcagcc

SEQ ID NO: 4662387 - DNA, 16 bp, Homo sapiens
ccactctggcagccac

SEQ ID NO: 4662388 - DNA, 18 bp, Homo sapiens
ccactctggcagccacac

SEQ ID NO: 4662389 - DNA, 20 bp, Homo sapiens
ccactgcactccagcctggg

SEQ ID NO: 4662390 - DNA, 19 bp, Homo sapiens
ccactgcactttccaatgc

SEQ ID NO: 4662391 - DNA, 19 bp, Homo sapiens
ccactgctgcttctccatg

SEQ ID NO: 4662392 - DNA, 22 bp, Homo sapiens
ccactgctgggggtgagctgta

SEQ ID NO: 4662393 - DNA, 17 bp, Homo sapiens
ccactggggactttatt

SEQ ID NO: 4662394 - DNA, 12 bp, Homo sapiens
ccacttaatctt

SEQ ID NO: 4662395 - DNA, 18 bp, Homo sapiens
ccacttacatatattttt

SEQ ID NO: 4662396 - DNA, 13 bp, Homo sapiens
ccacttcctttta

SEQ ID NO: 4662397 - DNA, 15 bp, Homo sapiens
ccacttcgcacacac

SEQ ID NO: 4662398 - DNA, 16 bp, Homo sapiens
ccacttcgcacacacc

SEQ ID NO: 4662399 - DNA, 16 bp, Homo sapiens
ccacttctccatgctg

SEQ ID NO: 4662400 - DNA, 21 bp, Homo sapiens
ccacttggaggcctttcatcc

SEQ ID NO: 4662401 - DNA, 19 bp, Homo sapiens
ccacttgtcccactatctg

SEQ ID NO: 4662402 - DNA, 17 bp, Homo sapiens
ccactttggctgaacta

SEQ ID NO: 4662403 - DNA, 20 bp, Homo sapiens
ccagaacgtggctctgctgg

SEQ ID NO: 4662404 - DNA, 16 bp, Homo sapiens
ccagaacgtggtttgc

SEQ ID NO: 4662405 - DNA, 23 bp, Homo sapiens
ccagaatgttactgactcctcag

SEQ ID NO: 4662406 - DNA, 22 bp, Homo sapiens
ccagacctatatctggagtgag

SEQ ID NO: 4662407 - DNA, 12 bp, Homo sapiens
ccagacctgcat

SEQ ID NO: 4662408 - DNA, 20 bp, Homo sapiens
ccagacctgttagcagacag

SEQ ID NO: 4662409 - DNA, 20 bp, Homo sapiens
ccagactatcgtaacctggt

SEQ ID NO: 4662410 - DNA, 21 bp, Homo sapiens
ccagactctaggttatacaat

SEQ ID NO: 4662411 - DNA, 20 bp, Homo sapiens
ccagagcagctccaccactg

SEQ ID NO: 4662412 - DNA, 22 bp, Homo sapiens
ccagagcagctccaccactgtg

SEQ ID NO: 4662413 - DNA, 21 bp, Homo sapiens
ccagagcctggctgcccatca

SEQ ID NO: 4662414 - DNA, 21 bp, Homo sapiens
ccagagctacccgcagagttc

SEQ ID NO: 4662415 - DNA, 20 bp, Homo sapiens
ccagaggactcccaaccctg

SEQ ID NO: 4662416 - DNA, 22 bp, Homo sapiens
ccagaggagcccagcggcccaa

SEQ ID NO: 4662417 - DNA, 14 bp, Homo sapiens
ccagaggccctgga

SEQ ID NO: 4662418 - DNA, 15 bp, Homo sapiens
ccagaggccctggag

SEQ ID NO: 4662419 - DNA, 22 bp, Homo sapiens
ccagataaaatgttcagtgcaa

SEQ ID NO: 4662420 - DNA, 19 bp, Homo sapiens
ccagatgttttacgtctgg

SEQ ID NO: 4662421 - DNA, 14 bp, Homo sapiens
ccagcaagacctca

SEQ ID NO: 4662422 - DNA, 23 bp, Homo sapiens
ccagcaagacctcatctgtggag

SEQ ID NO: 4662423 - DNA, 13 bp, Homo sapiens
ccagcaaggcaga

SEQ ID NO: 4662424 - DNA, 16 bp, Homo sapiens
ccagcacacagggcag

SEQ ID NO: 4662425 - DNA, 19 bp, Homo sapiens
ccagcacttgtccagctga

SEQ ID NO: 4662426 - DNA, 13 bp, Homo sapiens
ccagcagcagcac

SEQ ID NO: 4662427 - DNA, 23 bp, Homo sapiens
ccagcagcagcacttagacctgc

SEQ ID NO: 4662428 - DNA, 24 bp, Homo sapiens
ccagcagcggaaccgcccaggatc

SEQ ID NO: 4662429 - DNA, 11 bp, Homo sapiens
ccagcaggaat

SEQ ID NO: 4662430 - DNA, 13 bp, Homo sapiens
ccagcaggaataa

SEQ ID NO: 4662431 - DNA, 16 bp, Homo sapiens
ccagcaggaataaaga

SEQ ID NO: 4662432 - DNA, 16 bp, Homo sapiens
ccagcaggggggctgt

SEQ ID NO: 4662433 - DNA, 21 bp, Homo sapiens
ccagcaggggggctgtgccaa

SEQ ID NO: 4662434 - DNA, 20 bp, Homo sapiens
ccagcagggtcttttcatct

SEQ ID NO: 4662435 - DNA, 22 bp, Homo sapiens
ccagcagggtcttttcatctgg

SEQ ID NO: 4662436 - DNA, 15 bp, Homo sapiens
ccagcaggtgctgac

SEQ ID NO: 4662437 - DNA, 12 bp, Homo sapiens
ccagcatccctg

SEQ ID NO: 4662438 - DNA, 19 bp, Homo sapiens
ccagcatccctggagcagg

SEQ ID NO: 4662439 - DNA, 23 bp, Homo sapiens
ccagcatccctggagcaggagcc

SEQ ID NO: 4662440 - DNA, 12 bp, Homo sapiens
ccagccacagac

SEQ ID NO: 4662441 - DNA, 19 bp, Homo sapiens
ccagccacagacccctggg

SEQ ID NO: 4662442 - DNA, 14 bp, Homo sapiens
ccagccacaggacc

SEQ ID NO: 4662443 - DNA, 16 bp, Homo sapiens
ccagccacaggaccac

SEQ ID NO: 4662444 - DNA, 18 bp, Homo sapiens
ccagccacaggaccacct

SEQ ID NO: 4662445 - DNA, 19 bp, Homo sapiens
ccagccactgtcaccgagc

SEQ ID NO: 4662446 - DNA, 20 bp, Homo sapiens
ccagccagaggcatctgagg

SEQ ID NO: 4662447 - DNA, 12 bp, Homo sapiens
ccagcccagctg

SEQ ID NO: 4662448 - DNA, 22 bp, Homo sapiens
ccagccccctcctggtgccacc

SEQ ID NO: 4662449 - DNA, 13 bp, Homo sapiens
ccagtagagaaac

SEQ ID NO: 4662450 - DNA, 16 bp, Homo sapiens
ccagtcaagctcctag

SEQ ID NO: 4662451 - DNA, 19 bp, Homo sapiens
ccagtcaggatgaggcccc

SEQ ID NO: 4662452 - DNA, 20 bp, Homo sapiens
ccagtcaggatgaggccccg

SEQ ID NO: 4662453 - DNA, 13 bp, Homo sapiens
ccagtcctcccta

SEQ ID NO: 4662454 - DNA, 14 bp, Homo sapiens
ccagtcctccctag

SEQ ID NO: 4662455 - DNA, 17 bp, Homo sapiens
ccagtcctccctagctc

SEQ ID NO: 4662456 - DNA, 15 bp, Homo sapiens
ccagtctgaagatgt

SEQ ID NO: 4662457 - DNA, 17 bp, Homo sapiens
ccagtgcatcacatctg

SEQ ID NO: 4662458 - DNA, 12 bp, Homo sapiens
ccagtgccaagg

SEQ ID NO: 4662459 - DNA, 16 bp, Homo sapiens
ccagtgccaaggacct

SEQ ID NO: 4662460 - DNA, 23 bp, Homo sapiens
ccagtgcccggtgcagggcctgg

SEQ ID NO: 4662461 - DNA, 18 bp, Homo sapiens
ccagtgcctgcacatcat

SEQ ID NO: 4662462 - DNA, 17 bp, Homo sapiens
ccagtggggcctgtgga

SEQ ID NO: 4662463 - DNA, 18 bp, Homo sapiens
ccagtggggcctgtggaa

SEQ ID NO: 4662464 - DNA, 22 bp, Homo sapiens
ccagtggggcctgtggaatgag

SEQ ID NO: 4662465 - DNA, 12 bp, Homo sapiens
ccagtgtttcca

SEQ ID NO: 4662466 - DNA, 13 bp, Homo sapiens
ccagtgtttctga

SEQ ID NO: 4662467 - DNA, 14 bp, Homo sapiens
ccagtgtttctgaa

SEQ ID NO: 4662468 - DNA, 18 bp, Homo sapiens
ccagtgtttctgaatgtt

SEQ ID NO: 4662469 - DNA, 16 bp, Homo sapiens
ccagtgttttctttga

SEQ ID NO: 4662470 - DNA, 23 bp, Homo sapiens
ccagttagagcccattaatcttg

SEQ ID NO: 4662471 - DNA, 19 bp, Homo sapiens
ccagttcatcaccatttcc

SEQ ID NO: 4662472 - DNA, 17 bp, Homo sapiens
ccagttcctatgacaca

SEQ ID NO: 4662473 - DNA, 14 bp, Homo sapiens
ccataattatgaaa

SEQ ID NO: 4662474 - DNA, 13 bp, Homo sapiens
ccataatttggtc

SEQ ID NO: 4662475 - DNA, 23 bp, Homo sapiens
ccataattttgcatactgaaaat

SEQ ID NO: 4662476 - DNA, 16 bp, Homo sapiens
ccataccttctcccag

SEQ ID NO: 4662477 - DNA, 19 bp, Homo sapiens
ccataccttctcccaggcc

SEQ ID NO: 4662478 - DNA, 19 bp, Homo sapiens
ccatactcaagctgtctct

SEQ ID NO: 4662479 - DNA, 16 bp, Homo sapiens
ccatactgtagacact

SEQ ID NO: 4662480 - DNA, 18 bp, Homo sapiens
ccatagagatgagcccac

SEQ ID NO: 4662481 - DNA, 19 bp, Homo sapiens
ccatagggtcggaggtgct

SEQ ID NO: 4662482 - DNA, 18 bp, Homo sapiens
ccataggtttctctccct

SEQ ID NO: 4662483 - DNA, 18 bp, Homo sapiens
ccatatccttaccctcct

SEQ ID NO: 4662484 - DNA, 16 bp, Homo sapiens
ccatatttgatttcta

SEQ ID NO: 4662485 - DNA, 23 bp, Homo sapiens
ccatcaaaggaatataagaaaag

SEQ ID NO: 4662486 - DNA, 16 bp, Homo sapiens
ccatcaccatttggtg

SEQ ID NO: 4662487 - DNA, 19 bp, Homo sapiens
ccatcacctactcacacag

SEQ ID NO: 4662488 - DNA, 16 bp, Homo sapiens
ccatcagccctgctag

SEQ ID NO: 4662489 - DNA, 14 bp, Homo sapiens
ccatccatctctct

SEQ ID NO: 4662490 - DNA, 16 bp, Homo sapiens
ccatccatctctctct

SEQ ID NO: 4662491 - DNA, 17 bp, Homo sapiens
ccatcccactgctcccc

SEQ ID NO: 4662492 - DNA, 16 bp, Homo sapiens
ccatcccgtaagacca

SEQ ID NO: 4662493 - DNA, 16 bp, Homo sapiens
ccatcctggggcagca

SEQ ID NO: 4662494 - DNA, 20 bp, Homo sapiens
ccatcctggggcagcactcc

SEQ ID NO: 4662495 - DNA, 17 bp, Homo sapiens
ccatcctggtcagctgc

SEQ ID NO: 4662496 - DNA, 20 bp, Homo sapiens
ccatctagggaatgggactg

SEQ ID NO: 4662497 - DNA, 19 bp, Homo sapiens
ccatctcacctcctgctgg

SEQ ID NO: 4662498 - DNA, 23 bp, Homo sapiens
ccatctcacctcctgctgggcag

SEQ ID NO: 4662499 - DNA, 13 bp, Homo sapiens
ccatctcaggaga

SEQ ID NO: 4662500 - DNA, 17 bp, Homo sapiens
ccatctcaggagatgga

SEQ ID NO: 4662501 - DNA, 20 bp, Homo sapiens
ccatctcatgcccctggctg

SEQ ID NO: 4662502 - DNA, 12 bp, Homo sapiens
ccatctctctct

SEQ ID NO: 4662503 - DNA, 16 bp, Homo sapiens
ccatctgggctcctcc

SEQ ID NO: 4662504 - DNA, 19 bp, Homo sapiens
ccatctgtgatatgccata

SEQ ID NO: 4662505 - DNA, 18 bp, Homo sapiens
ccatcttactctgcccta

SEQ ID NO: 4662506 - DNA, 15 bp, Homo sapiens
ccatcttgtttcatt

SEQ ID NO: 4662507 - DNA, 15 bp, Homo sapiens
ccatctttttcttgg

SEQ ID NO: 4662508 - DNA, 16 bp, Homo sapiens
ccatctttttcttggg

SEQ ID NO: 4662509 - DNA, 20 bp, Homo sapiens
ccatgaaccaaatggttctt

SEQ ID NO: 4662510 - DNA, 16 bp, Homo sapiens
ccatgaaccctgccct

SEQ ID NO: 4662511 - DNA, 19 bp, Homo sapiens
ccatgagactgccctgccc

SEQ ID NO: 4662512 - DNA, 23 bp, Homo sapiens
ccatgagatgatacatccaaagc

SEQ ID NO: 4662513 - DNA, 13 bp, Homo sapiens
ccatgccccagtc

SEQ ID NO: 4662514 - DNA, 12 bp, Homo sapiens
ccatgctcccaa

SEQ ID NO: 4662515 - DNA, 21 bp, Homo sapiens
ccatgctcccaactcccttct

SEQ ID NO: 4662516 - DNA, 17 bp, Homo sapiens
ccatgctgggccactgg

SEQ ID NO: 4662517 - DNA, 14 bp, Homo sapiens
ccatggacaggctg

SEQ ID NO: 4662518 - DNA, 13 bp, Homo sapiens
ccatggaggcaga

SEQ ID NO: 4662519 - DNA, 13 bp, Homo sapiens
ccatggcttctgg

SEQ ID NO: 4662520 - DNA, 15 bp, Homo sapiens
ccatgtagccaccca

SEQ ID NO: 4662521 - DNA, 18 bp, Homo sapiens
ccatgtgattaatgtttt

SEQ ID NO: 4662522 - DNA, 21 bp, Homo sapiens
ccatgtggataactttacaga

SEQ ID NO: 4662523 - DNA, 22 bp, Homo sapiens
ccatgtgtacattctgcctaga

SEQ ID NO: 4662524 - DNA, 17 bp, Homo sapiens
ccatgttacttctctga

SEQ ID NO: 4662525 - DNA, 13 bp, Homo sapiens
ccatgttctccca

SEQ ID NO: 4662526 - DNA, 20 bp, Homo sapiens
ccatgttggtcaggatggtc

SEQ ID NO: 4662527 - DNA, 13 bp, Homo sapiens
ccattaacatttt

SEQ ID NO: 4662528 - DNA, 18 bp, Homo sapiens
ccattaatcttgatcatt

SEQ ID NO: 4662529 - DNA, 11 bp, Homo sapiens
ccattccctag

SEQ ID NO: 4662530 - DNA, 16 bp, Homo sapiens
ccattctccacagcaa

SEQ ID NO: 4662531 - DNA, 23 bp, Homo sapiens
ccattgaagccgactctggccct

SEQ ID NO: 4662532 - DNA, 18 bp, Homo sapiens
ccattgatcataaactga

SEQ ID NO: 4662533 - DNA, 14 bp, Homo sapiens
ccattgctccattc

SEQ ID NO: 4662534 - DNA, 21 bp, Homo sapiens
ccattgtaactattaaccttt

SEQ ID NO: 4662535 - DNA, 14 bp, Homo sapiens
ccattgttcccttc

SEQ ID NO: 4662536 - DNA, 24 bp, Homo sapiens
ccattgttcccttcctcttcctgc

SEQ ID NO: 4662537 - DNA, 15 bp, Homo sapiens
ccattgtttgaaaca

SEQ ID NO: 4662538 - DNA, 22 bp, Homo sapiens
ccattgtttgaaacaaagaagg

SEQ ID NO: 4662539 - DNA, 23 bp, Homo sapiens
ccatttgttgagccccagtcctg

SEQ ID NO: 4662540 - DNA, 12 bp, Homo sapiens
ccattttctgtg

SEQ ID NO: 4662541 - DNA, 15 bp, Homo sapiens
ccattttggtgctta

SEQ ID NO: 4662542 - DNA, 18 bp, Homo sapiens
cccaaatccgaacctcct

SEQ ID NO: 4662543 - DNA, 18 bp, Homo sapiens
cccaaatccgccagtgtt

SEQ ID NO: 4662544 - DNA, 19 bp, Homo sapiens
cccaaatccgccagtgttt

SEQ ID NO: 4662545 - DNA, 14 bp, Homo sapiens
cccaaatgagccat

SEQ ID NO: 4662546 - DNA, 12 bp, Homo sapiens
cccaaccagtgc

SEQ ID NO: 4662547 - DNA, 13 bp, Homo sapiens
cccaacccgtgga

SEQ ID NO: 4662548 - DNA, 17 bp, Homo sapiens
cccaacccgtggaggct

SEQ ID NO: 4662549 - DNA, 21 bp, Homo sapiens
cccaacccgtggaggctgctc

SEQ ID NO: 4662550 - DNA, 23 bp, Homo sapiens
cccaaccctgggctggggaggag

SEQ ID NO: 4662551 - DNA, 21 bp, Homo sapiens
cccaacctctgttccccaccc

SEQ ID NO: 4662552 - DNA, 15 bp, Homo sapiens
cccaacgaaaagcac

SEQ ID NO: 4662553 - DNA, 18 bp, Homo sapiens
cccaactccttccagcta

SEQ ID NO: 4662554 - DNA, 15 bp, Homo sapiens
cccaagcccctgacc

SEQ ID NO: 4662555 - DNA, 18 bp, Homo sapiens
cccaagctagactgtgtc

SEQ ID NO: 4662556 - DNA, 21 bp, Homo sapiens
cccaagctagactgtgtctga

SEQ ID NO: 4662557 - DNA, 12 bp, Homo sapiens
cccaagctcaga

SEQ ID NO: 4662558 - DNA, 12 bp, Homo sapiens
cccaagctccct

SEQ ID NO: 4662559 - DNA, 15 bp, Homo sapiens
cccattgctccattc

SEQ ID NO: 4662560 - DNA, 21 bp, Homo sapiens
cccattgctccattcactccc

SEQ ID NO: 4662561 - DNA, 13 bp, Homo sapiens
cccatttttctct

SEQ ID NO: 4662562 - DNA, 19 bp, Homo sapiens
ccccaaatccgaacctcct

SEQ ID NO: 4662563 - DNA, 23 bp, Homo sapiens
ccccaaatccgaacctcctctgt

SEQ ID NO: 4662564 - DNA, 20 bp, Homo sapiens
ccccaacccgtggaggctgc

SEQ ID NO: 4662565 - DNA, 22 bp, Homo sapiens
ccccaactccttccagctagtg

SEQ ID NO: 4662566 - DNA, 14 bp, Homo sapiens
ccccaaggacccag

SEQ ID NO: 4662567 - DNA, 13 bp, Homo sapiens
ccccaagggccct

SEQ ID NO: 4662568 - DNA, 18 bp, Homo sapiens
ccccacaagctgtccctg

SEQ ID NO: 4662569 - DNA, 19 bp, Homo sapiens
ccccacaagctgtccctgc

SEQ ID NO: 4662570 - DNA, 12 bp, Homo sapiens
ccccacaaggcc

SEQ ID NO: 4662571 - DNA, 14 bp, Homo sapiens
ccccacaaggcctg

SEQ ID NO: 4662572 - DNA, 21 bp, Homo sapiens
ccccaccaagggcgcaagagt

SEQ ID NO: 4662573 - DNA, 22 bp, Homo sapiens
ccccaccacgtctggctccctg

SEQ ID NO: 4662574 - DNA, 23 bp, Homo sapiens
ccccaccacgtctggctccctgc

SEQ ID NO: 4662575 - DNA, 13 bp, Homo sapiens
ccccacccctgta

SEQ ID NO: 4662576 - DNA, 15 bp, Homo sapiens
ccccaccctccactc

SEQ ID NO: 4662577 - DNA, 17 bp, Homo sapiens
ccccaccctccactcag

SEQ ID NO: 4662578 - DNA, 13 bp, Homo sapiens
ccccacccttggg

SEQ ID NO: 4662579 - DNA, 17 bp, Homo sapiens
ccccacgttgtccctga

SEQ ID NO: 4662580 - DNA, 14 bp, Homo sapiens
ccccactactgcag

SEQ ID NO: 4662581 - DNA, 15 bp, Homo sapiens
ccccactctgctctg

SEQ ID NO: 4662582 - DNA, 16 bp, Homo sapiens
ccccactctgctctga

SEQ ID NO: 4662583 - DNA, 21 bp, Homo sapiens
ccccactgtagacaggaaagc

SEQ ID NO: 4662584 - DNA, 18 bp, Homo sapiens
ccccacttatccctctcc

SEQ ID NO: 4662585 - DNA, 19 bp, Homo sapiens
ccccagagcccctcctcca

SEQ ID NO: 4662586 - DNA, 14 bp, Homo sapiens
ccccagaggccctg

SEQ ID NO: 4662587 - DNA, 16 bp, Homo sapiens
ccccagaggccctgga

SEQ ID NO: 4662588 - DNA, 12 bp, Homo sapiens
ccccagcaaggc

SEQ ID NO: 4662589 - DNA, 18 bp, Homo sapiens
ccccagcaggtgctgact

SEQ ID NO: 4662590 - DNA, 16 bp, Homo sapiens
ccccagccctgggaac

SEQ ID NO: 4662591 - DNA, 20 bp, Homo sapiens
ccccagcctgggcctatgga

SEQ ID NO: 4662592 - DNA, 13 bp, Homo sapiens
ccccagctggccc

SEQ ID NO: 4662593 - DNA, 21 bp, Homo sapiens
ccccagctggcccgtgacaga

SEQ ID NO: 4662594 - DNA, 20 bp, Homo sapiens
ccccaggacctggctgccat

SEQ ID NO: 4662595 - DNA, 21 bp, Homo sapiens
ccccaggacctggctgccata

SEQ ID NO: 4662596 - DNA, 14 bp, Homo sapiens
ccccagggcacagg

SEQ ID NO: 4662597 - DNA, 19 bp, Homo sapiens
ccccagggcacaggagcta

SEQ ID NO: 4662598 - DNA, 14 bp, Homo sapiens
ccccagtagagaaa

SEQ ID NO: 4662599 - DNA, 17 bp, Homo sapiens
ccccagtcctccctagc

SEQ ID NO: 4662600 - DNA, 19 bp, Homo sapiens
ccccagtcctccctagctc

SEQ ID NO: 4662601 - DNA, 22 bp, Homo sapiens
ccccagtcgtgatgtggaggaa

SEQ ID NO: 4662602 - DNA, 18 bp, Homo sapiens
ccccatcctcatccctga

SEQ ID NO: 4662603 - DNA, 16 bp, Homo sapiens
ccccatgacctccagc

SEQ ID NO: 4662604 - DNA, 17 bp, Homo sapiens
ccccattgctccattca

SEQ ID NO: 4662605 - DNA, 19 bp, Homo sapiens
cccccaatcggactgccaa

SEQ ID NO: 4662606 - DNA, 23 bp, Homo sapiens
cccccacaagctgtccctgcagg

SEQ ID NO: 4662607 - DNA, 20 bp, Homo sapiens
cccccaccaggggaaggaag

SEQ ID NO: 4662608 - DNA, 12 bp, Homo sapiens
cccccagcccca

SEQ ID NO: 4662609 - DNA, 22 bp, Homo sapiens
cccccagccccctcctggtgcc

SEQ ID NO: 4662610 - DNA, 14 bp, Homo sapiens
cccccagcctgggc

SEQ ID NO: 4662611 - DNA, 13 bp, Homo sapiens
cccccagttccta

SEQ ID NO: 4662612 - DNA, 15 bp, Homo sapiens
cccccatcagccctg

SEQ ID NO: 4662613 - DNA, 22 bp, Homo sapiens
ccccctccaggagagagccagg

SEQ ID NO: 4662614 - DNA, 21 bp, Homo sapiens
ccccctccattcccacccctc

SEQ ID NO: 4662615 - DNA, 18 bp, Homo sapiens
ccccgccttttcccccac

SEQ ID NO: 4662616 - DNA, 22 bp, Homo sapiens
ccccgggctggagaaagagctg

SEQ ID NO: 4662617 - DNA, 16 bp, Homo sapiens
ccccgtcagggagagg

SEQ ID NO: 4662618 - DNA, 22 bp, Homo sapiens
cccctaagtgcaaacacagcat

SEQ ID NO: 4662619 - DNA, 23 bp, Homo sapiens
cccctagggactgtcctagccag

SEQ ID NO: 4662620 - DNA, 20 bp, Homo sapiens
cccctcatacctacacccaa

SEQ ID NO: 4662621 - DNA, 12 bp, Homo sapiens
cccctccactgc

SEQ ID NO: 4662622 - DNA, 13 bp, Homo sapiens
cccctccactgct

SEQ ID NO: 4662623 - DNA, 14 bp, Homo sapiens
cccctccactgctg

SEQ ID NO: 4662624 - DNA, 14 bp, Homo sapiens
cccctccaggagag

SEQ ID NO: 4662625 - DNA, 18 bp, Homo sapiens
cccctccccatctgtgtt

SEQ ID NO: 4662626 - DNA, 20 bp, Homo sapiens
cccctccccattagctttca

SEQ ID NO: 4662627 - DNA, 13 bp, Homo sapiens
cccctccctgtcc

SEQ ID NO: 4662628 - DNA, 13 bp, Homo sapiens
cccctcctccagc

SEQ ID NO: 4662629 - DNA, 17 bp, Homo sapiens
cccctcctccagcccct

SEQ ID NO: 4662630 - DNA, 21 bp, Homo sapiens
cccctccttggctttatgcaa

SEQ ID NO: 4662631 - DNA, 11 bp, Homo sapiens
cccctctctgg

SEQ ID NO: 4662632 - DNA, 12 bp, Homo sapiens
cccctctctggg

SEQ ID NO: 4662633 - DNA, 22 bp, Homo sapiens
cccctgcagcttgtagccagcc

SEQ ID NO: 4662634 - DNA, 11 bp, Homo sapiens
cccctgcctgg

SEQ ID NO: 4662635 - DNA, 15 bp, Homo sapiens
cccctgcctggttct

SEQ ID NO: 4662636 - DNA, 19 bp, Homo sapiens
cccctgccttaacctggga

SEQ ID NO: 4662637 - DNA, 16 bp, Homo sapiens
cccctgctgcccagtg

SEQ ID NO: 4662638 - DNA, 11 bp, Homo sapiens
cccctggagcc

SEQ ID NO: 4662639 - DNA, 15 bp, Homo sapiens
cccctggccacagcc

SEQ ID NO: 4662640 - DNA, 23 bp, Homo sapiens
cccctggctgggacgtggctcag

SEQ ID NO: 4662641 - DNA, 18 bp, Homo sapiens
cccctgggaactctcctg

SEQ ID NO: 4662642 - DNA, 22 bp, Homo sapiens
cccctgggactttcccacccag

SEQ ID NO: 4662643 - DNA, 21 bp, Homo sapiens
cccctgtaatcaggcaaggag

SEQ ID NO: 4662644 - DNA, 19 bp, Homo sapiens
ccccttctgctcagctctg

SEQ ID NO: 4662645 - DNA, 18 bp, Homo sapiens
cccctttctctgcctggc

SEQ ID NO: 4662646 - DNA, 20 bp, Homo sapiens
cccctttctctgcctggcaa

SEQ ID NO: 4662647 - DNA, 18 bp, Homo sapiens
ccccttttaaggtttcaa

SEQ ID NO: 4662648 - DNA, 17 bp, Homo sapiens
cccgacagtgccatccc

SEQ ID NO: 4662649 - DNA, 13 bp, Homo sapiens
cccgagagcctcg

SEQ ID NO: 4662650 - DNA, 13 bp, Homo sapiens
cccgagcagctga

SEQ ID NO: 4662651 - DNA, 15 bp, Homo sapiens
cccgcagacctctgg

SEQ ID NO: 4662652 - DNA, 21 bp, Homo sapiens
cccgcagacctctggattagg

SEQ ID NO: 4662653 - DNA, 12 bp, Homo sapiens
cccgcagcctcg

SEQ ID NO: 4662654 - DNA, 12 bp, Homo sapiens
cccgccaggagc

SEQ ID NO: 4662655 - DNA, 16 bp, Homo sapiens
cccgccttttccccca

SEQ ID NO: 4662656 - DNA, 23 bp, Homo sapiens
cccgctggggaccggttcccaca

SEQ ID NO: 4662657 - DNA, 17 bp, Homo sapiens
cccggagctgcccctct

SEQ ID NO: 4662658 - DNA, 11 bp, Homo sapiens
cccggcacccc

SEQ ID NO: 4662659 - DNA, 14 bp, Homo sapiens
cccgggatattata

SEQ ID NO: 4662660 - DNA, 19 bp, Homo sapiens
cccggtgcagggcctggca

SEQ ID NO: 4662661 - DNA, 14 bp, Homo sapiens
cccgtagagaatgt

SEQ ID NO: 4662662 - DNA, 19 bp, Homo sapiens
cccgtagagaatgtgtgta

SEQ ID NO: 4662663 - DNA, 14 bp, Homo sapiens
cccgtcagggagag

SEQ ID NO: 4662664 - DNA, 14 bp, Homo sapiens
cccgtccccacacg

SEQ ID NO: 4662665 - DNA, 15 bp, Homo sapiens
cccgtgccaagtcca

SEQ ID NO: 4662666 - DNA, 21 bp, Homo sapiens
cccgtgccaagtccaggtcct

SEQ ID NO: 4662667 - DNA, 16 bp, Homo sapiens
cccgtgccacccccag

SEQ ID NO: 4662668 - DNA, 13 bp, Homo sapiens
cccgtggaggctg

SEQ ID NO: 4662669 - DNA, 17 bp, Homo sapiens
ccctgttcagctactcc

SEQ ID NO: 4662670 - DNA, 21 bp, Homo sapiens
cccttaactatcaccagtgca

SEQ ID NO: 4662671 - DNA, 17 bp, Homo sapiens
cccttacagcctctgac

SEQ ID NO: 4662672 - DNA, 19 bp, Homo sapiens
cccttattgctgtcctgga

SEQ ID NO: 4662673 - DNA, 15 bp, Homo sapiens
cccttccaaataata

SEQ ID NO: 4662674 - DNA, 18 bp, Homo sapiens
cccttccaaataataaag

SEQ ID NO: 4662675 - DNA, 14 bp, Homo sapiens
cccttccacctcac

SEQ ID NO: 4662676 - DNA, 16 bp, Homo sapiens
cccttcccccagccca

SEQ ID NO: 4662677 - DNA, 13 bp, Homo sapiens
cccttcccctggg

SEQ ID NO: 4662678 - DNA, 16 bp, Homo sapiens
cccttcccctgggaac

SEQ ID NO: 4662679 - DNA, 17 bp, Homo sapiens
cccttcctctccaccct

SEQ ID NO: 4662680 - DNA, 17 bp, Homo sapiens
cccttcctcttcctgcc

SEQ ID NO: 4662681 - DNA, 18 bp, Homo sapiens
cccttcctcttcctgccc

SEQ ID NO: 4662682 - DNA, 18 bp, Homo sapiens
cccttcctggacagctgt

SEQ ID NO: 4662683 - DNA, 23 bp, Homo sapiens
cccttcctggacagctgtgcctc

SEQ ID NO: 4662684 - DNA, 23 bp, Homo sapiens
cccttctgctcagctctgggcca

SEQ ID NO: 4662685 - DNA, 19 bp, Homo sapiens
cccttgctcatgagctcct

SEQ ID NO: 4662686 - DNA, 17 bp, Homo sapiens
cccttgctgggcctggg

SEQ ID NO: 4662687 - DNA, 18 bp, Homo sapiens
cccttgctttcctgggcc

SEQ ID NO: 4662688 - DNA, 22 bp, Homo sapiens
cccttggaggagagagaccccg

SEQ ID NO: 4662689 - DNA, 22 bp, Homo sapiens
cccttgggcagagtcctgcctt

SEQ ID NO: 4662690 - DNA, 23 bp, Homo sapiens
cccttgggcagagtcctgccttc

SEQ ID NO: 4662691 - DNA, 20 bp, Homo sapiens
cccttgtttggggcaggagt

SEQ ID NO: 4662692 - DNA, 13 bp, Homo sapiens
ccctttctctgcc

SEQ ID NO: 4662693 - DNA, 15 bp, Homo sapiens
ccctttctctgcctg

SEQ ID NO: 4662694 - DNA, 14 bp, Homo sapiens
ccctttctggctct

SEQ ID NO: 4662695 - DNA, 18 bp, Homo sapiens
ccctttgagatctgggga

SEQ ID NO: 4662696 - DNA, 17 bp, Homo sapiens
ccgaaaatgtttttaaa

SEQ ID NO: 4662697 - DNA, 14 bp, Homo sapiens
ccgacagtgccatc

SEQ ID NO: 4662698 - DNA, 14 bp, Homo sapiens
ccgaccgggccagg

SEQ ID NO: 4662699 - DNA, 19 bp, Homo sapiens
ccgagatcagtatttaact

SEQ ID NO: 4662700 - DNA, 14 bp, Homo sapiens
ccgagcaaccgtgg

SEQ ID NO: 4662701 - DNA, 12 bp, Homo sapiens
ccgagcagctga

SEQ ID NO: 4662702 - DNA, 20 bp, Homo sapiens
ccgagcagctgagcagggcc

SEQ ID NO: 4662703 - DNA, 21 bp, Homo sapiens
ccgagcagctgagcagggccg

SEQ ID NO: 4662704 - DNA, 14 bp, Homo sapiens
ccgagggcagcccc

SEQ ID NO: 4662705 - DNA, 17 bp, Homo sapiens
ccgagggcagccccctc

SEQ ID NO: 4662706 - DNA, 20 bp, Homo sapiens
ccgagtagctgggactacag

SEQ ID NO: 4662707 - DNA, 20 bp, Homo sapiens
ccgagtcattcgttctgtgg

SEQ ID NO: 4662708 - DNA, 15 bp, Homo sapiens
ccgcaaggcctccag

SEQ ID NO: 4662709 - DNA, 15 bp, Homo sapiens
ccgcagacctctgga

SEQ ID NO: 4662710 - DNA, 22 bp, Homo sapiens
ccgcagtggggtcaagctgagc

SEQ ID NO: 4662711 - DNA, 20 bp, Homo sapiens
ccgcatgatgtttccctctc

SEQ ID NO: 4662712 - DNA, 15 bp, Homo sapiens
ccgccacggcctggc

SEQ ID NO: 4662713 - DNA, 21 bp, Homo sapiens
ccgccacgtcccagcatccct

SEQ ID NO: 4662714 - DNA, 13 bp, Homo sapiens
ccgccagccacag

SEQ ID NO: 4662715 - DNA, 13 bp, Homo sapiens
ccgccagggctgg

SEQ ID NO: 4662716 - DNA, 16 bp, Homo sapiens
ccgccagggctgggga

SEQ ID NO: 4662717 - DNA, 15 bp, Homo sapiens
ccgcccagcctcact

SEQ ID NO: 4662718 - DNA, 23 bp, Homo sapiens
ccgcccagcggcttgcctgcctg

SEQ ID NO: 4662719 - DNA, 12 bp, Homo sapiens
ccgccgcccgct

SEQ ID NO: 4662720 - DNA, 14 bp, Homo sapiens
ccgccgcccgctgg

SEQ ID NO: 4662721 - DNA, 14 bp, Homo sapiens
ccgcctcaaaatgt

SEQ ID NO: 4662722 - DNA, 15 bp, Homo sapiens
ccgcctcaaaatgtg

SEQ ID NO: 4662723 - DNA, 17 bp, Homo sapiens
ccgcctgaaggcacagc

SEQ ID NO: 4662724 - DNA, 16 bp, Homo sapiens
ccgcgccgatgccacc

SEQ ID NO: 4662725 - DNA, 16 bp, Homo sapiens
ccgctacaccactctg

SEQ ID NO: 4662726 - DNA, 21 bp, Homo sapiens
ccgctcggacttactgcctga

SEQ ID NO: 4662727 - DNA, 13 bp, Homo sapiens
ccgctgaggggtc

SEQ ID NO: 4662728 - DNA, 23 bp, Homo sapiens
ccggaaggaggccaaccagcccg

SEQ ID NO: 4662729 - DNA, 14 bp, Homo sapiens
ccggagaggaccgg

SEQ ID NO: 4662730 - DNA, 20 bp, Homo sapiens
ccggagctgcccctctctgg

SEQ ID NO: 4662731 - DNA, 21 bp, Homo sapiens
ccggagctgcccctctctggg

SEQ ID NO: 4662732 - DNA, 22 bp, Homo sapiens
ccggagctgcccctctctgggc

SEQ ID NO: 4662733 - DNA, 23 bp, Homo sapiens
ccggagctgcccctctctgggcc

SEQ ID NO: 4662734 - DNA, 16 bp, Homo sapiens
ccggcaccccctgcag

SEQ ID NO: 4662735 - DNA, 19 bp, Homo sapiens
ccggcaccccctgcagctt

SEQ ID NO: 4662736 - DNA, 15 bp, Homo sapiens
ccggcagagctctac

SEQ ID NO: 4662737 - DNA, 21 bp, Homo sapiens
ccggcagagctctacaggcct

SEQ ID NO: 4662738 - DNA, 15 bp, Homo sapiens
ccggcagcgggcgga

SEQ ID NO: 4662739 - DNA, 16 bp, Homo sapiens
ccggctcgtgtattta

SEQ ID NO: 4662740 - DNA, 18 bp, Homo sapiens
ccggctcgtgtatttatt

SEQ ID NO: 4662741 - DNA, 19 bp, Homo sapiens
ccggctcgtgtatttatta

SEQ ID NO: 4662742 - DNA, 22 bp, Homo sapiens
ccggctcgtgtatttattaccg

SEQ ID NO: 4662743 - DNA, 14 bp, Homo sapiens
ccgggagctggcgg

SEQ ID NO: 4662744 - DNA, 12 bp, Homo sapiens
ccgggcagaggg

SEQ ID NO: 4662745 - DNA, 13 bp, Homo sapiens
ccgggccactcct

SEQ ID NO: 4662746 - DNA, 17 bp, Homo sapiens
ccgggctggagaaagag

SEQ ID NO: 4662747 - DNA, 22 bp, Homo sapiens
ccggggtgagggggggctccct

SEQ ID NO: 4662748 - DNA, 15 bp, Homo sapiens
ccggtaactgtcctg

SEQ ID NO: 4662749 - DNA, 19 bp, Homo sapiens
ccggtaactgtcctgtcct

SEQ ID NO: 4662750 - DNA, 13 bp, Homo sapiens
ccggtgctgcagg

SEQ ID NO: 4662751 - DNA, 22 bp, Homo sapiens
ccggttcactcttctcagccac

SEQ ID NO: 4662752 - DNA, 21 bp, Homo sapiens
ccggttcccacaagcctgcct

SEQ ID NO: 4662753 - DNA, 20 bp, Homo sapiens
ccgtaagaccaccttccctt

SEQ ID NO: 4662754 - DNA, 21 bp, Homo sapiens
ccgtcagggagaggtcaccag

SEQ ID NO: 4662755 - DNA, 18 bp, Homo sapiens
ccgtgacagactcctgag

SEQ ID NO: 4662756 - DNA, 17 bp, Homo sapiens
ccgtgcatgctctgcag

SEQ ID NO: 4662757 - DNA, 14 bp, Homo sapiens
ccgtgccaagtcca

SEQ ID NO: 4662758 - DNA, 20 bp, Homo sapiens
ccgtgccaagtccaggtcct

SEQ ID NO: 4662759 - DNA, 17 bp, Homo sapiens
ccgtgccacccccagcc

SEQ ID NO: 4662760 - DNA, 21 bp, Homo sapiens
ccgtgccacccccagccctgg

SEQ ID NO: 4662761 - DNA, 22 bp, Homo sapiens
ccgtgccacccccagccctggc

SEQ ID NO: 4662762 - DNA, 20 bp, Homo sapiens
ccgtgcctggctgattcagc

SEQ ID NO: 4662763 - DNA, 18 bp, Homo sapiens
ccgtgcgggaaattcagt

SEQ ID NO: 4662764 - DNA, 14 bp, Homo sapiens
ccgtggaggctgct

SEQ ID NO: 4662765 - DNA, 16 bp, Homo sapiens
ccgtggaggctgctcg

SEQ ID NO: 4662766 - DNA, 14 bp, Homo sapiens
ccgtggcccttcct

SEQ ID NO: 4662767 - DNA, 16 bp, Homo sapiens
ccgtggcccttcctgg

SEQ ID NO: 4662768 - DNA, 19 bp, Homo sapiens
ccgtggcccttcctggaca

SEQ ID NO: 4662769 - DNA, 20 bp, Homo sapiens
ccgtggcccttcctggacag

SEQ ID NO: 4662770 - DNA, 21 bp, Homo sapiens
ccgtggcccttcctggacagc

SEQ ID NO: 4662771 - DNA, 19 bp, Homo sapiens
ccgtgggcactgaaggctt

SEQ ID NO: 4662772 - DNA, 18 bp, Homo sapiens
ccgttcctccccctgctc

SEQ ID NO: 4662773 - DNA, 20 bp, Homo sapiens
ccgttcctccccctgctccc

SEQ ID NO: 4662774 - DNA, 15 bp, Homo sapiens
cctaaacctttgccc

SEQ ID NO: 4662775 - DNA, 18 bp, Homo sapiens
cctaaagctaaaaatatt

SEQ ID NO: 4662776 - DNA, 16 bp, Homo sapiens
cctaaagggcagggcc

SEQ ID NO: 4662777 - DNA, 19 bp, Homo sapiens
cctaactctgcccaccctc

SEQ ID NO: 4662778 - DNA, 22 bp, Homo sapiens
cctccttggctttatgcaaata

SEQ ID NO: 4662779 - DNA, 15 bp, Homo sapiens
cctccttggtgcctg

SEQ ID NO: 4662780 - DNA, 13 bp, Homo sapiens
cctccttgtcagg

SEQ ID NO: 4662781 - DNA, 23 bp, Homo sapiens
cctccttgtcagggtctccttcc

SEQ ID NO: 4662782 - DNA, 22 bp, Homo sapiens
cctcctttcctttgcccttacc

SEQ ID NO: 4662783 - DNA, 14 bp, Homo sapiens
cctcgccccaaagt

SEQ ID NO: 4662784 - DNA, 17 bp, Homo sapiens
cctcgctccccactctg

SEQ ID NO: 4662785 - DNA, 21 bp, Homo sapiens
cctcgctccccactctgctct

SEQ ID NO: 4662786 - DNA, 14 bp, Homo sapiens
cctcgctcccttca

SEQ ID NO: 4662787 - DNA, 15 bp, Homo sapiens
cctcgctctgttacc

SEQ ID NO: 4662788 - DNA, 15 bp, Homo sapiens
cctcgctgggctcta

SEQ ID NO: 4662789 - DNA, 18 bp, Homo sapiens
cctcgctttttcatcctt

SEQ ID NO: 4662790 - DNA, 18 bp, Homo sapiens
cctcgggccccatcctca

SEQ ID NO: 4662791 - DNA, 16 bp, Homo sapiens
cctcgttctccctggg

SEQ ID NO: 4662792 - DNA, 22 bp, Homo sapiens
cctctactgggaaggctacttc

SEQ ID NO: 4662793 - DNA, 17 bp, Homo sapiens
cctctagaaatttttca

SEQ ID NO: 4662794 - DNA, 14 bp, Homo sapiens
cctctcacctcagc

SEQ ID NO: 4662795 - DNA, 14 bp, Homo sapiens
cctctcatttccag

SEQ ID NO: 4662796 - DNA, 15 bp, Homo sapiens
cctctcatttccagc

SEQ ID NO: 4662797 - DNA, 18 bp, Homo sapiens
cctctcatttccagcttc

SEQ ID NO: 4662798 - DNA, 20 bp, Homo sapiens
cctctcatttccagcttctc

SEQ ID NO: 4662799 - DNA, 22 bp, Homo sapiens
cctctccattttagcccagtgt

SEQ ID NO: 4662800 - DNA, 12 bp, Homo sapiens
cctctcccaggc

SEQ ID NO: 4662801 - DNA, 13 bp, Homo sapiens
cctctcccaggcc

SEQ ID NO: 4662802 - DNA, 14 bp, Homo sapiens
cctctccgtttatt

SEQ ID NO: 4662803 - DNA, 13 bp, Homo sapiens
cctctcgcctcat

SEQ ID NO: 4662804 - DNA, 14 bp, Homo sapiens
cctctcgcctcatt

SEQ ID NO: 4662805 - DNA, 14 bp, Homo sapiens
cctctctcctggac

SEQ ID NO: 4662806 - DNA, 21 bp, Homo sapiens
cctctctcctggactggttat

SEQ ID NO: 4662807 - DNA, 15 bp, Homo sapiens
cctctctctggaaag

SEQ ID NO: 4662808 - DNA, 12 bp, Homo sapiens
cctctgaggcca

SEQ ID NO: 4662809 - DNA, 21 bp, Homo sapiens
cctctgaggccagcctggcct

SEQ ID NO: 4662810 - DNA, 15 bp, Homo sapiens
cctctgcattgacct

SEQ ID NO: 4662811 - DNA, 18 bp, Homo sapiens
cctctgcattgacctgga

SEQ ID NO: 4662812 - DNA, 19 bp, Homo sapiens
cctctgcattgacctggag

SEQ ID NO: 4662813 - DNA, 23 bp, Homo sapiens
cctctgcattgagcatattttct

SEQ ID NO: 4662814 - DNA, 13 bp, Homo sapiens
cctctgccagcag

SEQ ID NO: 4662815 - DNA, 15 bp, Homo sapiens
cctctgccagcagga

SEQ ID NO: 4662816 - DNA, 18 bp, Homo sapiens
cctctgccagcaggaata

SEQ ID NO: 4662817 - DNA, 14 bp, Homo sapiens
cctctgccccaaga

SEQ ID NO: 4662818 - DNA, 15 bp, Homo sapiens
cctctgcccttcctg

SEQ ID NO: 4662819 - DNA, 15 bp, Homo sapiens
cctctgcctgggatg

SEQ ID NO: 4662820 - DNA, 21 bp, Homo sapiens
cctctggattaggtctctgtt

SEQ ID NO: 4662821 - DNA, 14 bp, Homo sapiens
cctctgggacccca

SEQ ID NO: 4662822 - DNA, 16 bp, Homo sapiens
cctctgtcagtcacag

SEQ ID NO: 4662823 - DNA, 18 bp, Homo sapiens
cctctgtcagtcacagcc

SEQ ID NO: 4662824 - DNA, 19 bp, Homo sapiens
cctctgtctcgagcgccct

SEQ ID NO: 4662825 - DNA, 14 bp, Homo sapiens
cctctgtgaactgt

SEQ ID NO: 4662826 - DNA, 18 bp, Homo sapiens
cctctgtgaactgtgtgt

SEQ ID NO: 4662827 - DNA, 17 bp, Homo sapiens
cctctgtgacccctcct

SEQ ID NO: 4662828 - DNA, 13 bp, Homo sapiens
cctctgttcattt

SEQ ID NO: 4662829 - DNA, 18 bp, Homo sapiens
cctctgttccccacccag

SEQ ID NO: 4662830 - DNA, 19 bp, Homo sapiens
cctcttccactccttctct

SEQ ID NO: 4662831 - DNA, 19 bp, Homo sapiens
cctcttcctgcccttgaac

SEQ ID NO: 4662832 - DNA, 14 bp, Homo sapiens
cctcttctgcatct

SEQ ID NO: 4662833 - DNA, 22 bp, Homo sapiens
cctcttctggtttccctttatt

SEQ ID NO: 4662834 - DNA, 16 bp, Homo sapiens
cctcttgtaaagactg

SEQ ID NO: 4662835 - DNA, 12 bp, Homo sapiens
cctcttgtcagt

SEQ ID NO: 4662836 - DNA, 13 bp, Homo sapiens
cctcttgtcagtg

SEQ ID NO: 4662837 - DNA, 15 bp, Homo sapiens
cctctttccctgcga

SEQ ID NO: 4662838 - DNA, 19 bp, Homo sapiens
cctctttgtctaaaacaat

SEQ ID NO: 4662839 - DNA, 15 bp, Homo sapiens
cctgaaagctgggag

SEQ ID NO: 4662840 - DNA, 14 bp, Homo sapiens
cctgaaagggcact

SEQ ID NO: 4662841 - DNA, 14 bp, Homo sapiens
cctgaaccatgtgg

SEQ ID NO: 4662842 - DNA, 13 bp, Homo sapiens
cctgaactgagga

SEQ ID NO: 4662843 - DNA, 14 bp, Homo sapiens
cctgaaggcacagc

SEQ ID NO: 4662844 - DNA, 15 bp, Homo sapiens
cctgaagggaactag

SEQ ID NO: 4662845 - DNA, 16 bp, Homo sapiens
cctgacctaacctagg

SEQ ID NO: 4662846 - DNA, 17 bp, Homo sapiens
cctgacctaacctagga

SEQ ID NO: 4662847 - DNA, 21 bp, Homo sapiens
cctgacctgtgagcccagctg

SEQ ID NO: 4662848 - DNA, 23 bp, Homo sapiens
cctgacggcgcctttttggcctg

SEQ ID NO: 4662849 - DNA, 19 bp, Homo sapiens
cctgactctcacctgtact

SEQ ID NO: 4662850 - DNA, 17 bp, Homo sapiens
cctgagaagctgctcca

SEQ ID NO: 4662851 - DNA, 19 bp, Homo sapiens
cctgagaagctgctccagg

SEQ ID NO: 4662852 - DNA, 12 bp, Homo sapiens
cctgagaccaca

SEQ ID NO: 4662853 - DNA, 18 bp, Homo sapiens
cctgagaccacagagaga

SEQ ID NO: 4662854 - DNA, 15 bp, Homo sapiens
cctgagagaattggc

SEQ ID NO: 4662855 - DNA, 16 bp, Homo sapiens
cctgagcactgccagg

SEQ ID NO: 4662856 - DNA, 20 bp, Homo sapiens
cctgagcccctttgcctgtc

SEQ ID NO: 4662857 - DNA, 12 bp, Homo sapiens
cctgagcctgcc

SEQ ID NO: 4662858 - DNA, 15 bp, Homo sapiens
cctgaggacagctgt

SEQ ID NO: 4662859 - DNA, 17 bp, Homo sapiens
cctgaggagtctgaggt

SEQ ID NO: 4662860 - DNA, 19 bp, Homo sapiens
cctgaggcctagactctgt

SEQ ID NO: 4662861 - DNA, 20 bp, Homo sapiens
cctgagggaagagtagctgt

SEQ ID NO: 4662862 - DNA, 14 bp, Homo sapiens
cctgaggtcaggga

SEQ ID NO: 4662863 - DNA, 12 bp, Homo sapiens
cctgaggtgccc

SEQ ID NO: 4662864 - DNA, 20 bp, Homo sapiens
cctgaggtgcccactccgcc

SEQ ID NO: 4662865 - DNA, 22 bp, Homo sapiens
cctgaggtgcccactccgccag

SEQ ID NO: 4662866 - DNA, 23 bp, Homo sapiens
cctgaggtgcccactccgccagc

SEQ ID NO: 4662867 - DNA, 14 bp, Homo sapiens
cctgagtgaggtgt

SEQ ID NO: 4662868 - DNA, 19 bp, Homo sapiens
cctgagtttcaagtatcct

SEQ ID NO: 4662869 - DNA, 19 bp, Homo sapiens
cctgatcagaccacggctc

SEQ ID NO: 4662870 - DNA, 22 bp, Homo sapiens
cctgatcagaggcatttgagca

SEQ ID NO: 4662871 - DNA, 23 bp, Homo sapiens
cctgatcgccaacctttccccca

SEQ ID NO: 4662872 - DNA, 19 bp, Homo sapiens
cctgatgcaggtcagccca

SEQ ID NO: 4662873 - DNA, 13 bp, Homo sapiens
cctgatgctgaca

SEQ ID NO: 4662874 - DNA, 14 bp, Homo sapiens
cctgattattttag

SEQ ID NO: 4662875 - DNA, 17 bp, Homo sapiens
cctgcaaacagaacagg

SEQ ID NO: 4662876 - DNA, 19 bp, Homo sapiens
cctgcaaacagaacagggt

SEQ ID NO: 4662877 - DNA, 15 bp, Homo sapiens
cctgcaaagctggtt

SEQ ID NO: 4662878 - DNA, 17 bp, Homo sapiens
cctgcaacttccgctga

SEQ ID NO: 4662879 - DNA, 21 bp, Homo sapiens
cctgcaagatggacacgagcc

SEQ ID NO: 4662880 - DNA, 22 bp, Homo sapiens
cctgcaagatggacacgagcca

SEQ ID NO: 4662881 - DNA, 17 bp, Homo sapiens
cctgcacaggcttgctg

SEQ ID NO: 4662882 - DNA, 16 bp, Homo sapiens
cctgcagaccctgccc

SEQ ID NO: 4662883 - DNA, 18 bp, Homo sapiens
cctgcagaccctgccctt

SEQ ID NO: 4662884 - DNA, 18 bp, Homo sapiens
cctgcagcaaacactcca

SEQ ID NO: 4662885 - DNA, 19 bp, Homo sapiens
cctgcagcaaacactccac

SEQ ID NO: 4662886 - DNA, 15 bp, Homo sapiens
cctgcagcagagcct

SEQ ID NO: 4662887 - DNA, 21 bp, Homo sapiens
cctgcagcagagcctggaaga

SEQ ID NO: 4662888 - DNA, 15 bp, Homo sapiens
cctggctgcccatca

SEQ ID NO: 4662889 - DNA, 23 bp, Homo sapiens
cctggctgcccatcatgtggccc

SEQ ID NO: 4662890 - DNA, 17 bp, Homo sapiens
cctggctggctgagggc

SEQ ID NO: 4662891 - DNA, 20 bp, Homo sapiens
cctggctgggacgtggctca

SEQ ID NO: 4662892 - DNA, 19 bp, Homo sapiens
cctggctggtgggaaggcc

SEQ ID NO: 4662893 - DNA, 19 bp, Homo sapiens
cctgggaaagggagatgtc

SEQ ID NO: 4662894 - DNA, 15 bp, Homo sapiens
cctgggaaccactcc

SEQ ID NO: 4662895 - DNA, 15 bp, Homo sapiens
cctgggaactctcct

SEQ ID NO: 4662896 - DNA, 21 bp, Homo sapiens
cctgggaactctcctggcctt

SEQ ID NO: 4662897 - DNA, 19 bp, Homo sapiens
cctgggacaagcaggccgc

SEQ ID NO: 4662898 - DNA, 19 bp, Homo sapiens
cctgggaccaacctgacct

SEQ ID NO: 4662899 - DNA, 23 bp, Homo sapiens
cctgggaccgctacaccactctg

SEQ ID NO: 4662900 - DNA, 21 bp, Homo sapiens
cctgggactttcccacccagg

SEQ ID NO: 4662901 - DNA, 18 bp, Homo sapiens
cctgggattcaggaaaag

SEQ ID NO: 4662902 - DNA, 17 bp, Homo sapiens
cctgggcactccgcgcc

SEQ ID NO: 4662903 - DNA, 16 bp, Homo sapiens
cctgggcatccttctt

SEQ ID NO: 4662904 - DNA, 21 bp, Homo sapiens
cctgggcccatctctccctgc

SEQ ID NO: 4662905 - DNA, 14 bp, Homo sapiens
cctgggccctgggg

SEQ ID NO: 4662906 - DNA, 22 bp, Homo sapiens
cctgggccctggggcctgtact

SEQ ID NO: 4662907 - DNA, 20 bp, Homo sapiens
cctgggcctatggagagccc

SEQ ID NO: 4662908 - DNA, 21 bp, Homo sapiens
cctgggcctatggagagccct

SEQ ID NO: 4662909 - DNA, 14 bp, Homo sapiens
cctgggcctgctgc

SEQ ID NO: 4662910 - DNA, 15 bp, Homo sapiens
cctgggcctgctgct

SEQ ID NO: 4662911 - DNA, 17 bp, Homo sapiens
cctgggcctgctgctga

SEQ ID NO: 4662912 - DNA, 19 bp, Homo sapiens
cctgggcctttgcaagatg

SEQ ID NO: 4662913 - DNA, 23 bp, Homo sapiens
cctgggcctttgcaagatgcttg

SEQ ID NO: 4662914 - DNA, 15 bp, Homo sapiens
cctgggctggggagg

SEQ ID NO: 4662915 - DNA, 17 bp, Homo sapiens
cctgggctggggaggag

SEQ ID NO: 4662916 - DNA, 21 bp, Homo sapiens
cctgggctggggaggaggaga

SEQ ID NO: 4662917 - DNA, 22 bp, Homo sapiens
cctgggctggggaggaggagag

SEQ ID NO: 4662918 - DNA, 15 bp, Homo sapiens
cctggggatcacagc

SEQ ID NO: 4662919 - DNA, 17 bp, Homo sapiens
cctggggatcacagcct

SEQ ID NO: 4662920 - DNA, 16 bp, Homo sapiens
cctggggcagcactcc

SEQ ID NO: 4662921 - DNA, 18 bp, Homo sapiens
cctggggcctgggccccg

SEQ ID NO: 4662922 - DNA, 18 bp, Homo sapiens
cctggggcctgtactgcc

SEQ ID NO: 4662923 - DNA, 21 bp, Homo sapiens
cctggggcctgtactgcctgc

SEQ ID NO: 4662924 - DNA, 23 bp, Homo sapiens
cctggggcctgtactgcctgctt

SEQ ID NO: 4662925 - DNA, 12 bp, Homo sapiens
cctggggctcta

SEQ ID NO: 4662926 - DNA, 23 bp, Homo sapiens
cctggggctctaacgcctgagcc

SEQ ID NO: 4662927 - DNA, 17 bp, Homo sapiens
cctggggctggcctccc

SEQ ID NO: 4662928 - DNA, 12 bp, Homo sapiens
cctgggggaaga

SEQ ID NO: 4662929 - DNA, 13 bp, Homo sapiens
cctgggggaagag

SEQ ID NO: 4662930 - DNA, 14 bp, Homo sapiens
cctgggggcctggc

SEQ ID NO: 4662931 - DNA, 19 bp, Homo sapiens
cctgggggcttttgccact

SEQ ID NO: 4662932 - DNA, 15 bp, Homo sapiens
cctggggtgacccgg

SEQ ID NO: 4662933 - DNA, 18 bp, Homo sapiens
cctgggtaggccccacaa

SEQ ID NO: 4662934 - DNA, 22 bp, Homo sapiens
cctgggtaggccccacaaggcc

SEQ ID NO: 4662935 - DNA, 14 bp, Homo sapiens
cctgggtggctact

SEQ ID NO: 4662936 - DNA, 17 bp, Homo sapiens
cctgggtggctactctg

SEQ ID NO: 4662937 - DNA, 22 bp, Homo sapiens
cctgggtggctactctgtgcca

SEQ ID NO: 4662938 - DNA, 19 bp, Homo sapiens
cctgggtgtctgggctcaa

SEQ ID NO: 4662939 - DNA, 14 bp, Homo sapiens
cctggtccctggga

SEQ ID NO: 4662940 - DNA, 21 bp, Homo sapiens
cctggtgagagggccgggcag

SEQ ID NO: 4662941 - DNA, 13 bp, Homo sapiens
cctggttctaggc

SEQ ID NO: 4662942 - DNA, 18 bp, Homo sapiens
cctgtaatcaggcaagga

SEQ ID NO: 4662943 - DNA, 22 bp, Homo sapiens
cctgtaatcaggcaaggaggag

SEQ ID NO: 4662944 - DNA, 17 bp, Homo sapiens
cctgtactattgcagac

SEQ ID NO: 4662945 - DNA, 21 bp, Homo sapiens
cctgtagaatagcctgtggcc

SEQ ID NO: 4662946 - DNA, 18 bp, Homo sapiens
cctgtagttgcgtggact

SEQ ID NO: 4662947 - DNA, 21 bp, Homo sapiens
cctgtagttgcgtggactctg

SEQ ID NO: 4662948 - DNA, 19 bp, Homo sapiens
cctgtatttgttcccaaga

SEQ ID NO: 4662949 - DNA, 21 bp, Homo sapiens
cctgtatttgttcccaagagc

SEQ ID NO: 4662950 - DNA, 18 bp, Homo sapiens
cctgtcaccctgcaggac

SEQ ID NO: 4662951 - DNA, 16 bp, Homo sapiens
cctgtcattgtattca

SEQ ID NO: 4662952 - DNA, 16 bp, Homo sapiens
cctgtccaatctttga

SEQ ID NO: 4662953 - DNA, 21 bp, Homo sapiens
cctgtcccagggccctcccag

SEQ ID NO: 4662954 - DNA, 23 bp, Homo sapiens
cctgtcccagggccctcccagcc

SEQ ID NO: 4662955 - DNA, 13 bp, Homo sapiens
cctgtccccaccc

SEQ ID NO: 4662956 - DNA, 14 bp, Homo sapiens
cctgtcccctaggg

SEQ ID NO: 4662957 - DNA, 16 bp, Homo sapiens
cctgtctcctggcggt

SEQ ID NO: 4662958 - DNA, 21 bp, Homo sapiens
cctgtctctggctactccctg

SEQ ID NO: 4662959 - DNA, 16 bp, Homo sapiens
cctgtctggattgttt

SEQ ID NO: 4662960 - DNA, 16 bp, Homo sapiens
agctgctccaggcctg

SEQ ID NO: 4662961 - DNA, 18 bp, Homo sapiens
agctgctctaagcccagg

SEQ ID NO: 4662962 - DNA, 19 bp, Homo sapiens
agctgctctaagcccagga

SEQ ID NO: 4662963 - DNA, 22 bp, Homo sapiens
agctgctctaagcccaggatct

SEQ ID NO: 4662964 - DNA, 16 bp, Homo sapiens
agctgctgtgccccac

SEQ ID NO: 4662965 - DNA, 15 bp, Homo sapiens
agctggccaaagtca

SEQ ID NO: 4662966 - DNA, 15 bp, Homo sapiens
agctggcccgtgaca

SEQ ID NO: 4662967 - DNA, 18 bp, Homo sapiens
agctggcccgtgacagac

SEQ ID NO: 4662968 - DNA, 18 bp, Homo sapiens
agctggcctggcccccag

SEQ ID NO: 4662969 - DNA, 18 bp, Homo sapiens
agctggctctgtgagggt

SEQ ID NO: 4662970 - DNA, 21 bp, Homo sapiens
agctgggattacaggcgcctg

SEQ ID NO: 4662971 - DNA, 22 bp, Homo sapiens
agctgggattacaggcgcctgc

SEQ ID NO: 4662972 - DNA, 18 bp, Homo sapiens
agctggggactcagggac

SEQ ID NO: 4662973 - DNA, 15 bp, Homo sapiens
agctgggtcaggcag

SEQ ID NO: 4662974 - DNA, 17 bp, Homo sapiens
agctgggtcaggcaggg

SEQ ID NO: 4662975 - DNA, 16 bp, Homo sapiens
agctggtcctgaccag

SEQ ID NO: 4662976 - DNA, 19 bp, Homo sapiens
agctggtcctgaccaggat

SEQ ID NO: 4662977 - DNA, 16 bp, Homo sapiens
agctgtaagggcagtg

SEQ ID NO: 4662978 - DNA, 17 bp, Homo sapiens
agctgtaagggcagtgc

SEQ ID NO: 4662979 - DNA, 19 bp, Homo sapiens
agctgtaagggcagtgccc

SEQ ID NO: 4662980 - DNA, 24 bp, Homo sapiens
agctgtaagggcagtgcccatgtg

SEQ ID NO: 4662981 - DNA, 22 bp, Homo sapiens
agctgtactcttctgactgccc

SEQ ID NO: 4662982 - DNA, 21 bp, Homo sapiens
agctgtagctacaagggaagc

SEQ ID NO: 4662983 - DNA, 12 bp, Homo sapiens
agctgtccctgc

SEQ ID NO: 4662984 - DNA, 14 bp, Homo sapiens
agctgtctcttcgg

SEQ ID NO: 4662985 - DNA, 22 bp, Homo sapiens
agctgtctcttcggcagggagg

SEQ ID NO: 4662986 - DNA, 19 bp, Homo sapiens
agctgtctgaagcccaaag

SEQ ID NO: 4662987 - DNA, 14 bp, Homo sapiens
agctgtgacctgct

SEQ ID NO: 4662988 - DNA, 17 bp, Homo sapiens
agctgtgacctgctgag

SEQ ID NO: 4662989 - DNA, 19 bp, Homo sapiens
agctgtgacctgctgagct

SEQ ID NO: 4662990 - DNA, 18 bp, Homo sapiens
agctgtgagacagtggga

SEQ ID NO: 4662991 - DNA, 19 bp, Homo sapiens
agctgtgagacagtgggaa

SEQ ID NO: 4662992 - DNA, 17 bp, Homo sapiens
agctgtgcaggcatggt

SEQ ID NO: 4662993 - DNA, 14 bp, Homo sapiens
agctgtgccagcag

SEQ ID NO: 4662994 - DNA, 18 bp, Homo sapiens
agctgttcctgttcagta

SEQ ID NO: 4662995 - DNA, 19 bp, Homo sapiens
agctgttcctgttcagtaa

SEQ ID NO: 4662996 - DNA, 18 bp, Homo sapiens
agctgtttgaaatgttta

SEQ ID NO: 4662997 - DNA, 14 bp, Homo sapiens
agcttactctctgc

SEQ ID NO: 4662998 - DNA, 17 bp, Homo sapiens
agcttactctctgcttc

SEQ ID NO: 4662999 - DNA, 15 bp, Homo sapiens
agcttcaacttttct

SEQ ID NO: 4663000 - DNA, 22 bp, Homo sapiens
agcttcacctctgggaccccag

SEQ ID NO: 4663001 - DNA, 14 bp, Homo sapiens
agcttccgctttga

SEQ ID NO: 4663002 - DNA, 19 bp, Homo sapiens
agcttccgctttgaaagaa

SEQ ID NO: 4663003 - DNA, 23 bp, Homo sapiens
agcttccgctttgaaagaagcaa

SEQ ID NO: 4663004 - DNA, 12 bp, Homo sapiens
agcttctcagtt

SEQ ID NO: 4663005 - DNA, 20 bp, Homo sapiens
agcttctcagtttctgcctg

SEQ ID NO: 4663006 - DNA, 21 bp, Homo sapiens
agcttctcagtttctgcctgg

SEQ ID NO: 4663007 - DNA, 16 bp, Homo sapiens
agcttcttctgaaaga

SEQ ID NO: 4663008 - DNA, 15 bp, Homo sapiens
agcttgctccctgtg

SEQ ID NO: 4663009 - DNA, 17 bp, Homo sapiens
agcttgctgtcacttct

SEQ ID NO: 4663010 - DNA, 12 bp, Homo sapiens
agcttggaggag

SEQ ID NO: 4663011 - DNA, 15 bp, Homo sapiens
agcttggcttcctct

SEQ ID NO: 4663012 - DNA, 20 bp, Homo sapiens
agcttgtccaggttgatctt

SEQ ID NO: 4663013 - DNA, 17 bp, Homo sapiens
agctttatacagttgaa

SEQ ID NO: 4663014 - DNA, 22 bp, Homo sapiens
agctttatttatagaaatgaca

SEQ ID NO: 4663015 - DNA, 15 bp, Homo sapiens
agctttcaattccgt

SEQ ID NO: 4663016 - DNA, 17 bp, Homo sapiens
agctttccaaggaagca

SEQ ID NO: 4663017 - DNA, 13 bp, Homo sapiens
agctttcctggaa

SEQ ID NO: 4663018 - DNA, 14 bp, Homo sapiens
agctttcctggaag

SEQ ID NO: 4663019 - DNA, 16 bp, Homo sapiens
agctttcctgtttcca

SEQ ID NO: 4663020 - DNA, 20 bp, Homo sapiens
agcttttcacaaacattagt

SEQ ID NO: 4663021 - DNA, 23 bp, Homo sapiens
agcttttcttgataggcctagta

SEQ ID NO: 4663022 - DNA, 18 bp, Homo sapiens
agctttttattattttaa

SEQ ID NO: 4663023 - DNA, 15 bp, Homo sapiens
aggaaaagagggaga

SEQ ID NO: 4663024 - DNA, 13 bp, Homo sapiens
aggaaaaggattt

SEQ ID NO: 4663025 - DNA, 14 bp, Homo sapiens
aggaaaaggcctgg

SEQ ID NO: 4663026 - DNA, 18 bp, Homo sapiens
aggaaaaggcctggggtg

SEQ ID NO: 4663027 - DNA, 14 bp, Homo sapiens
aggaaacattttat

SEQ ID NO: 4663028 - DNA, 21 bp, Homo sapiens
aggaaacttctgatgtttatt

SEQ ID NO: 4663029 - DNA, 18 bp, Homo sapiens
aggaaagaagggggccct

SEQ ID NO: 4663030 - DNA, 20 bp, Homo sapiens
aggaaagaagggggccctgc

SEQ ID NO: 4663031 - DNA, 23 bp, Homo sapiens
aggaaagaagggggccctgctac

SEQ ID NO: 4663032 - DNA, 15 bp, Homo sapiens
aggaaaggaggacca

SEQ ID NO: 4663033 - DNA, 17 bp, Homo sapiens
aggaaataacagagaga

SEQ ID NO: 4663034 - DNA, 13 bp, Homo sapiens
aggaacaaacagg

SEQ ID NO: 4663035 - DNA, 19 bp, Homo sapiens
aggaaccgcccagtgcagg

SEQ ID NO: 4663036 - DNA, 17 bp, Homo sapiens
aggaagaaaaaagatcc

SEQ ID NO: 4663037 - DNA, 18 bp, Homo sapiens
aggaagagccacctgcaa

SEQ ID NO: 4663038 - DNA, 21 bp, Homo sapiens
aggaagagccacctgcaagat

SEQ ID NO: 4663039 - DNA, 15 bp, Homo sapiens
aggaagagtcttggt

SEQ ID NO: 4663040 - DNA, 13 bp, Homo sapiens
aggaagcagaaga

SEQ ID NO: 4663041 - DNA, 18 bp, Homo sapiens
aggaagcagaagacggga

SEQ ID NO: 4663042 - DNA, 22 bp, Homo sapiens
aggaagcccccaccgtgggcag

SEQ ID NO: 4663043 - DNA, 23 bp, Homo sapiens
aggaagcttggcttcctcttctt

SEQ ID NO: 4663044 - DNA, 11 bp, Homo sapiens
aggaaggaaac

SEQ ID NO: 4663045 - DNA, 13 bp, Homo sapiens
aggaaggaaactg

SEQ ID NO: 4663046 - DNA, 20 bp, Homo sapiens
aggaaggggctatcctggga

SEQ ID NO: 4663047 - DNA, 19 bp, Homo sapiens
aggaagtttgatttttgtt

SEQ ID NO: 4663048 - DNA, 15 bp, Homo sapiens
aggaatacattttat

SEQ ID NO: 4663049 - DNA, 18 bp, Homo sapiens
aggaatacattttattct

SEQ ID NO: 4663050 - DNA, 23 bp, Homo sapiens
aggaatgacccttttgtgtctat

SEQ ID NO: 4663051 - DNA, 19 bp, Homo sapiens
aggaatggaggagccaggc

SEQ ID NO: 4663052 - DNA, 17 bp, Homo sapiens
aggaattaagttatctt

SEQ ID NO: 4663053 - DNA, 21 bp, Homo sapiens
aggaattggaggctgcagtga

SEQ ID NO: 4663054 - DNA, 15 bp, Homo sapiens
aggaatttatacctc

SEQ ID NO: 4663055 - DNA, 14 bp, Homo sapiens
aggacaaaacttct

SEQ ID NO: 4663056 - DNA, 15 bp, Homo sapiens
aggacaaaacttctt

SEQ ID NO: 4663057 - DNA, 22 bp, Homo sapiens
aggacaaaacttcttgtcagac

SEQ ID NO: 4663058 - DNA, 13 bp, Homo sapiens
aggacacaggcct

SEQ ID NO: 4663059 - DNA, 16 bp, Homo sapiens
aggacacaggcctgtg

SEQ ID NO: 4663060 - DNA, 19 bp, Homo sapiens
aggacaggaccctcaggaa

SEQ ID NO: 4663061 - DNA, 15 bp, Homo sapiens
aggacagttcagaga

SEQ ID NO: 4663062 - DNA, 21 bp, Homo sapiens
aggacataaaatttaaaaact

SEQ ID NO: 4663063 - DNA, 11 bp, Homo sapiens
aggacatctta

SEQ ID NO: 4663064 - DNA, 20 bp, Homo sapiens
aggaccacctcctctgccag

SEQ ID NO: 4663065 - DNA, 19 bp, Homo sapiens
aggaccaggccaccgctag

SEQ ID NO: 4663066 - DNA, 13 bp, Homo sapiens
aggacccagccct

SEQ ID NO: 4663067 - DNA, 18 bp, Homo sapiens
aggacctgagcctgccga

SEQ ID NO: 4663068 - DNA, 13 bp, Homo sapiens
aggacctggctgc

SEQ ID NO: 4663069 - DNA, 16 bp, Homo sapiens
aggacctgtggccaag

SEQ ID NO: 4663070 - DNA, 22 bp, Homo sapiens
agggcacaggagctacctgtgt

SEQ ID NO: 4663071 - DNA, 19 bp, Homo sapiens
agggcacaggccatggatg

SEQ ID NO: 4663072 - DNA, 21 bp, Homo sapiens
agggcactcccaaccctgggc

SEQ ID NO: 4663073 - DNA, 14 bp, Homo sapiens
agggcactgggctg

SEQ ID NO: 4663074 - DNA, 15 bp, Homo sapiens
agggcactgggctgt

SEQ ID NO: 4663075 - DNA, 21 bp, Homo sapiens
agggcacttaatttgtaaact

SEQ ID NO: 4663076 - DNA, 23 bp, Homo sapiens
agggcacttaatttgtaaacttc

SEQ ID NO: 4663077 - DNA, 15 bp, Homo sapiens
agggcagcagccagc

SEQ ID NO: 4663078 - DNA, 23 bp, Homo sapiens
agggcagcagccagccctgcctg

SEQ ID NO: 4663079 - DNA, 19 bp, Homo sapiens
agggcagccccctccctag

SEQ ID NO: 4663080 - DNA, 14 bp, Homo sapiens
agggcagcgccagg

SEQ ID NO: 4663081 - DNA, 15 bp, Homo sapiens
agggcagtgcccatg

SEQ ID NO: 4663082 - DNA, 22 bp, Homo sapiens
agggcagtgcccatgtgtacat

SEQ ID NO: 4663083 - DNA, 18 bp, Homo sapiens
agggcagttcgcagccac

SEQ ID NO: 4663084 - DNA, 15 bp, Homo sapiens
agggccagagcagct

SEQ ID NO: 4663085 - DNA, 18 bp, Homo sapiens
agggccagagcagctcca

SEQ ID NO: 4663086 - DNA, 19 bp, Homo sapiens
agggccagtggggcctgtg

SEQ ID NO: 4663087 - DNA, 18 bp, Homo sapiens
agggccagttggtgttcc

SEQ ID NO: 4663088 - DNA, 15 bp, Homo sapiens
agggccatctgactg

SEQ ID NO: 4663089 - DNA, 15 bp, Homo sapiens
agggccatgaacttt

SEQ ID NO: 4663090 - DNA, 18 bp, Homo sapiens
agggccattttggtgctt

SEQ ID NO: 4663091 - DNA, 21 bp, Homo sapiens
agggcccaaagcttgtaaata

SEQ ID NO: 4663092 - DNA, 13 bp, Homo sapiens
agggccctcccag

SEQ ID NO: 4663093 - DNA, 15 bp, Homo sapiens
agggccctcccagcc

SEQ ID NO: 4663094 - DNA, 16 bp, Homo sapiens
agggccctcccagccc

SEQ ID NO: 4663095 - DNA, 17 bp, Homo sapiens
agggcctgcgagggcag

SEQ ID NO: 4663096 - DNA, 14 bp, Homo sapiens
agggcctggagccc

SEQ ID NO: 4663097 - DNA, 17 bp, Homo sapiens
agggcctggagccccat

SEQ ID NO: 4663098 - DNA, 17 bp, Homo sapiens
agggcctggggcctgag

SEQ ID NO: 4663099 - DNA, 20 bp, Homo sapiens
agggcctggggcctgagaga

SEQ ID NO: 4663100 - DNA, 21 bp, Homo sapiens
agggcctggggcctgagagaa

SEQ ID NO: 4663101 - DNA, 22 bp, Homo sapiens
agggcctggggcctgagagaat

SEQ ID NO: 4663102 - DNA, 21 bp, Homo sapiens
agggcctggtccctgggagga

SEQ ID NO: 4663103 - DNA, 17 bp, Homo sapiens
agggctctcctggcttc

SEQ ID NO: 4663104 - DNA, 11 bp, Homo sapiens
agggctctgag

SEQ ID NO: 4663105 - DNA, 19 bp, Homo sapiens
agggctctgagccaacctt

SEQ ID NO: 4663106 - DNA, 16 bp, Homo sapiens
agggctctgaggcgcc

SEQ ID NO: 4663107 - DNA, 13 bp, Homo sapiens
agggctgccctga

SEQ ID NO: 4663108 - DNA, 15 bp, Homo sapiens
agggctgccctgaga

SEQ ID NO: 4663109 - DNA, 22 bp, Homo sapiens
agggctgctctttccacttgcc

SEQ ID NO: 4663110 - DNA, 16 bp, Homo sapiens
agggcttctcctcctc

SEQ ID NO: 4663111 - DNA, 15 bp, Homo sapiens
agggcttggcccagc

SEQ ID NO: 4663112 - DNA, 17 bp, Homo sapiens
agggcttggcccagcgc

SEQ ID NO: 4663113 - DNA, 15 bp, Homo sapiens
aggggaaggaaggag

SEQ ID NO: 4663114 - DNA, 16 bp, Homo sapiens
aggggacactttgtta

SEQ ID NO: 4663115 - DNA, 16 bp, Homo sapiens
aggggatatttactgc

SEQ ID NO: 4663116 - DNA, 14 bp, Homo sapiens
aggggcaaacatca

SEQ ID NO: 4663117 - DNA, 16 bp, Homo sapiens
aggggcaagctaggcc

SEQ ID NO: 4663118 - DNA, 13 bp, Homo sapiens
aggggcagggaag

SEQ ID NO: 4663119 - DNA, 23 bp, Homo sapiens
aggggcagggaaggacaggaccc

SEQ ID NO: 4663120 - DNA, 20 bp, Homo sapiens
aggggcagtttgggaaggtg

SEQ ID NO: 4663121 - DNA, 13 bp, Homo sapiens
aggggccagaaga

SEQ ID NO: 4663122 - DNA, 13 bp, Homo sapiens
aggggccaggagt

SEQ ID NO: 4663123 - DNA, 19 bp, Homo sapiens
aggggccaggagtggggag

SEQ ID NO: 4663124 - DNA, 16 bp, Homo sapiens
aggggcctgcagaagg

SEQ ID NO: 4663125 - DNA, 19 bp, Homo sapiens
aggggcgggcggagggagg

SEQ ID NO: 4663126 - DNA, 22 bp, Homo sapiens
aggggcgggcggagggagggga

SEQ ID NO: 4663127 - DNA, 23 bp, Homo sapiens
aggggcgggcggagggaggggag

SEQ ID NO: 4663128 - DNA, 18 bp, Homo sapiens
aggggctagggaggacca

SEQ ID NO: 4663129 - DNA, 16 bp, Homo sapiens
aggggctatcctggga

SEQ ID NO: 4663130 - DNA, 17 bp, Homo sapiens
aggggctatcctgggac

SEQ ID NO: 4663131 - DNA, 22 bp, Homo sapiens
aggggcttggtcctagggtggg

SEQ ID NO: 4663132 - DNA, 16 bp, Homo sapiens
agggggaagagatccc

SEQ ID NO: 4663133 - DNA, 15 bp, Homo sapiens
agggggaggggaagc

SEQ ID NO: 4663134 - DNA, 18 bp, Homo sapiens
agggggcaggggcagggg

SEQ ID NO: 4663135 - DNA, 12 bp, Homo sapiens
agggggccctgc

SEQ ID NO: 4663136 - DNA, 12 bp, Homo sapiens
agggggcggcct

SEQ ID NO: 4663137 - DNA, 13 bp, Homo sapiens
aggggggctgtgc

SEQ ID NO: 4663138 - DNA, 16 bp, Homo sapiens
aggggggctgtgccaa

SEQ ID NO: 4663139 - DNA, 23 bp, Homo sapiens
aggggggggtatttcaattacct

SEQ ID NO: 4663140 - DNA, 16 bp, Homo sapiens
aggggtgacggccctc

SEQ ID NO: 4663141 - DNA, 21 bp, Homo sapiens
aggggttggggtgacagtcat

SEQ ID NO: 4663142 - DNA, 15 bp, Homo sapiens
agggtcagccagggc

SEQ ID NO: 4663143 - DNA, 17 bp, Homo sapiens
agggtcagccagggcct

SEQ ID NO: 4663144 - DNA, 19 bp, Homo sapiens
agggtcagccagggcctgc

SEQ ID NO: 4663145 - DNA, 23 bp, Homo sapiens
agggtcagccagggcctgcgagg

SEQ ID NO: 4663146 - DNA, 16 bp, Homo sapiens
agggtcatgtttgcag

SEQ ID NO: 4663147 - DNA, 15 bp, Homo sapiens
agggtctccttcctt

SEQ ID NO: 4663148 - DNA, 12 bp, Homo sapiens
agggtctctccc

SEQ ID NO: 4663149 - DNA, 16 bp, Homo sapiens
agggtctctccctcag

SEQ ID NO: 4663150 - DNA, 10 bp, Homo sapiens
agggtctgag

SEQ ID NO: 4663151 - DNA, 18 bp, Homo sapiens
agggtctgtgtgaatgtg

SEQ ID NO: 4663152 - DNA, 19 bp, Homo sapiens
agggtcttggctgcctgtg

SEQ ID NO: 4663153 - DNA, 13 bp, Homo sapiens
agggtcttttcat

SEQ ID NO: 4663154 - DNA, 18 bp, Homo sapiens
agggtcttttcatctggg

SEQ ID NO: 4663155 - DNA, 14 bp, Homo sapiens
agggtgaaggagaa

SEQ ID NO: 4663156 - DNA, 17 bp, Homo sapiens
agggtgggaaggggcta

SEQ ID NO: 4663157 - DNA, 16 bp, Homo sapiens
agggtgggtgctcaga

SEQ ID NO: 4663158 - DNA, 20 bp, Homo sapiens
agggtgggtgctcagaataa

SEQ ID NO: 4663159 - DNA, 16 bp, Homo sapiens
agggtttgggcagagc

SEQ ID NO: 4663160 - DNA, 20 bp, Homo sapiens
agggtttgtcagaggaacaa

SEQ ID NO: 4663161 - DNA, 14 bp, Homo sapiens
aggtaaatcccaca

SEQ ID NO: 4663162 - DNA, 17 bp, Homo sapiens
aggtaagctcaggatat

SEQ ID NO: 4663163 - DNA, 17 bp, Homo sapiens
aggtacccctttctggc

SEQ ID NO: 4663164 - DNA, 19 bp, Homo sapiens
aggtacgattatacttgag

SEQ ID NO: 4663165 - DNA, 21 bp, Homo sapiens
aggtactgcattctctcccat

SEQ ID NO: 4663166 - DNA, 20 bp, Homo sapiens
aggtagacctgtctcctggc

SEQ ID NO: 4663167 - DNA, 20 bp, Homo sapiens
aggtagctatagttgcagcc

SEQ ID NO: 4663168 - DNA, 15 bp, Homo sapiens
aggtagtctcactgc

SEQ ID NO: 4663169 - DNA, 20 bp, Homo sapiens
aggtatatcgatgatggaaa

SEQ ID NO: 4663170 - DNA, 18 bp, Homo sapiens
aggtatcctgggggaaga

SEQ ID NO: 4663171 - DNA, 15 bp, Homo sapiens
aggtattattatctt

SEQ ID NO: 4663172 - DNA, 19 bp, Homo sapiens
aggtatttcagaaggagaa

SEQ ID NO: 4663173 - DNA, 21 bp, Homo sapiens
aggtatttcagaaggagaagg

SEQ ID NO: 4663174 - DNA, 21 bp, Homo sapiens
aggtcaccagctgctgtgccc

SEQ ID NO: 4663175 - DNA, 21 bp, Homo sapiens
aggtcaccattatgctggtgt

SEQ ID NO: 4663176 - DNA, 23 bp, Homo sapiens
aggtcacttgatcatgctgcagt

SEQ ID NO: 4663177 - DNA, 12 bp, Homo sapiens
aggtcagcccat

SEQ ID NO: 4663178 - DNA, 17 bp, Homo sapiens
aggtcagcccatggagg

SEQ ID NO: 4663179 - DNA, 20 bp, Homo sapiens
aggtcagcccatggaggcag

SEQ ID NO: 4663180 - DNA, 17 bp, Homo sapiens
agtattttctccacttc

SEQ ID NO: 4663181 - DNA, 22 bp, Homo sapiens
agtattttctccacttcatttt

SEQ ID NO: 4663182 - DNA, 21 bp, Homo sapiens
agtcaaaaaattatttgctat

SEQ ID NO: 4663183 - DNA, 14 bp, Homo sapiens
agtcaaataaatgt

SEQ ID NO: 4663184 - DNA, 21 bp, Homo sapiens
agtcaagtaatggaggtccca

SEQ ID NO: 4663185 - DNA, 23 bp, Homo sapiens
agtcaagtaatggaggtcccagc

SEQ ID NO: 4663186 - DNA, 23 bp, Homo sapiens
agtcacatggcctatgcacatat

SEQ ID NO: 4663187 - DNA, 16 bp, Homo sapiens
agtcacttccccaaga

SEQ ID NO: 4663188 - DNA, 17 bp, Homo sapiens
agtcacttccccaagat

SEQ ID NO: 4663189 - DNA, 20 bp, Homo sapiens
agtcacttccccaagatctg

SEQ ID NO: 4663190 - DNA, 23 bp, Homo sapiens
agtcacttccccaagatctgcca

SEQ ID NO: 4663191 - DNA, 17 bp, Homo sapiens
agtcagatgaggccctg

SEQ ID NO: 4663192 - DNA, 13 bp, Homo sapiens
agtcaggatgagg

SEQ ID NO: 4663193 - DNA, 14 bp, Homo sapiens
agtcaggatgaggc

SEQ ID NO: 4663194 - DNA, 16 bp, Homo sapiens
agtcaggatgaggccc

SEQ ID NO: 4663195 - DNA, 18 bp, Homo sapiens
agtcagggtttgtcagag

SEQ ID NO: 4663196 - DNA, 22 bp, Homo sapiens
agtcagggtttgtcagaggaac

SEQ ID NO: 4663197 - DNA, 21 bp, Homo sapiens
agtcatcatcagggcctgggg

SEQ ID NO: 4663198 - DNA, 21 bp, Homo sapiens
agtcatggctaatttaacacc

SEQ ID NO: 4663199 - DNA, 15 bp, Homo sapiens
agtcattggctgtct

SEQ ID NO: 4663200 - DNA, 15 bp, Homo sapiens
agtcattgtcataag

SEQ ID NO: 4663201 - DNA, 16 bp, Homo sapiens
agtcattttattttgt

SEQ ID NO: 4663202 - DNA, 14 bp, Homo sapiens
agtccaagctggga

SEQ ID NO: 4663203 - DNA, 16 bp, Homo sapiens
agtccaagctgggaga

SEQ ID NO: 4663204 - DNA, 17 bp, Homo sapiens
agtccaggtcctggtgg

SEQ ID NO: 4663205 - DNA, 17 bp, Homo sapiens
agtcccagagctcatcc

SEQ ID NO: 4663206 - DNA, 18 bp, Homo sapiens
agtcccagagctcatccc

SEQ ID NO: 4663207 - DNA, 21 bp, Homo sapiens
agtcccttttcattctcctcc

SEQ ID NO: 4663208 - DNA, 14 bp, Homo sapiens
agtcctccctagct

SEQ ID NO: 4663209 - DNA, 15 bp, Homo sapiens
agtcctccctagctc

SEQ ID NO: 4663210 - DNA, 20 bp, Homo sapiens
agtcctccctagctcttccc

SEQ ID NO: 4663211 - DNA, 20 bp, Homo sapiens
agtcctttcaattccaccag

SEQ ID NO: 4663212 - DNA, 20 bp, Homo sapiens
agtcctttcccaccattcct

SEQ ID NO: 4663213 - DNA, 15 bp, Homo sapiens
agtcgatgaactatt

SEQ ID NO: 4663214 - DNA, 17 bp, Homo sapiens
agtcgcccctcagagca

SEQ ID NO: 4663215 - DNA, 18 bp, Homo sapiens
agtcgcccctcagagcat

SEQ ID NO: 4663216 - DNA, 13 bp, Homo sapiens
agtcgggcatgag

SEQ ID NO: 4663217 - DNA, 16 bp, Homo sapiens
agtcgggcatgagtct

SEQ ID NO: 4663218 - DNA, 21 bp, Homo sapiens
agtcgtccttactcctgtggg

SEQ ID NO: 4663219 - DNA, 22 bp, Homo sapiens
agtcgtccttactcctgtggga

SEQ ID NO: 4663220 - DNA, 17 bp, Homo sapiens
agtcgtgatgtggagga

SEQ ID NO: 4663221 - DNA, 18 bp, Homo sapiens
agtctagtccgtcctggc

SEQ ID NO: 4663222 - DNA, 19 bp, Homo sapiens
agtctatgttcaaagactg

SEQ ID NO: 4663223 - DNA, 16 bp, Homo sapiens
agtctgaggtcctgag

SEQ ID NO: 4663224 - DNA, 18 bp, Homo sapiens
agtctgaggtcctgagca

SEQ ID NO: 4663225 - DNA, 18 bp, Homo sapiens
agtctggaaaacagaaac

SEQ ID NO: 4663226 - DNA, 12 bp, Homo sapiens
agtctgggtcag

SEQ ID NO: 4663227 - DNA, 21 bp, Homo sapiens
agtctgggtcagacccatctc

SEQ ID NO: 4663228 - DNA, 21 bp, Homo sapiens
agtctgtctttcctgaaccat

SEQ ID NO: 4663229 - DNA, 15 bp, Homo sapiens
agtctgtttcccaag

SEQ ID NO: 4663230 - DNA, 15 bp, Homo sapiens
agtctgttttgtaaa

SEQ ID NO: 4663231 - DNA, 12 bp, Homo sapiens
agtctttccccc

SEQ ID NO: 4663232 - DNA, 13 bp, Homo sapiens
agtctttccccca

SEQ ID NO: 4663233 - DNA, 17 bp, Homo sapiens
agtctttctcctctttg

SEQ ID NO: 4663234 - DNA, 21 bp, Homo sapiens
agtctttctcctctttgagac

SEQ ID NO: 4663235 - DNA, 20 bp, Homo sapiens
agtgaaataacaaaatggac

SEQ ID NO: 4663236 - DNA, 23 bp, Homo sapiens
agtgaagggaagagacagcccag

SEQ ID NO: 4663237 - DNA, 15 bp, Homo sapiens
agtgaaggtctttgt

SEQ ID NO: 4663238 - DNA, 23 bp, Homo sapiens
agtgaaggtctttgttatgacag

SEQ ID NO: 4663239 - DNA, 20 bp, Homo sapiens
agtgaagtacacctgtgtgg

SEQ ID NO: 4663240 - DNA, 15 bp, Homo sapiens
agtgaagtattgctg

SEQ ID NO: 4663241 - DNA, 17 bp, Homo sapiens
agtgaagtattgctgaa

SEQ ID NO: 4663242 - DNA, 17 bp, Homo sapiens
agtgaagtctagaatca

SEQ ID NO: 4663243 - DNA, 19 bp, Homo sapiens
agtgaagtctagaatcata

SEQ ID NO: 4663244 - DNA, 22 bp, Homo sapiens
agtgaagtctagaatcatactt

SEQ ID NO: 4663245 - DNA, 15 bp, Homo sapiens
agtgactcctgctgg

SEQ ID NO: 4663246 - DNA, 16 bp, Homo sapiens
agtgactcctgctggt

SEQ ID NO: 4663247 - DNA, 19 bp, Homo sapiens
agtgagagacctctgccta

SEQ ID NO: 4663248 - DNA, 19 bp, Homo sapiens
agtgagaggcccccaccct

SEQ ID NO: 4663249 - DNA, 22 bp, Homo sapiens
agtgagatagcattgtgaactg

SEQ ID NO: 4663250 - DNA, 23 bp, Homo sapiens
agtgagatttaagttcctgctgc

SEQ ID NO: 4663251 - DNA, 21 bp, Homo sapiens
agtgagcgagtggatgctgtg

SEQ ID NO: 4663252 - DNA, 19 bp, Homo sapiens
agtgaggaagccaggtcca

SEQ ID NO: 4663253 - DNA, 16 bp, Homo sapiens
agtgaggatgagaccc

SEQ ID NO: 4663254 - DNA, 19 bp, Homo sapiens
agtgaggatgagacccagc

SEQ ID NO: 4663255 - DNA, 23 bp, Homo sapiens
agtgattcgcttttggtatttgt

SEQ ID NO: 4663256 - DNA, 17 bp, Homo sapiens
agtgcaaaatgtcttgt

SEQ ID NO: 4663257 - DNA, 18 bp, Homo sapiens
agtgcaaacacagcatgg

SEQ ID NO: 4663258 - DNA, 18 bp, Homo sapiens
agtgcaaaccacttctcc

SEQ ID NO: 4663259 - DNA, 19 bp, Homo sapiens
agtgcaaaccacttctcca

SEQ ID NO: 4663260 - DNA, 14 bp, Homo sapiens
agtgcaacctctgc

SEQ ID NO: 4663261 - DNA, 17 bp, Homo sapiens
agtgcaattccaagaaa

SEQ ID NO: 4663262 - DNA, 20 bp, Homo sapiens
agtgcaattccaagaaaata

SEQ ID NO: 4663263 - DNA, 19 bp, Homo sapiens
agtgcatcacatctgcaca

SEQ ID NO: 4663264 - DNA, 13 bp, Homo sapiens
agtgccaaggacc

SEQ ID NO: 4663265 - DNA, 22 bp, Homo sapiens
agtgccaaggacctcctcttcc

SEQ ID NO: 4663266 - DNA, 17 bp, Homo sapiens
agtgccacgtcatgagc

SEQ ID NO: 4663267 - DNA, 18 bp, Homo sapiens
agtgcccatgtgtacatt

SEQ ID NO: 4663268 - DNA, 19 bp, Homo sapiens
agtgcccggtgcagggcct

SEQ ID NO: 4663269 - DNA, 20 bp, Homo sapiens
agtgcccggtgcagggcctg

SEQ ID NO: 4663270 - DNA, 17 bp, Homo sapiens
agtgccctttgagatct

SEQ ID NO: 4663271 - DNA, 19 bp, Homo sapiens
agtgccgcagtggggtcaa

SEQ ID NO: 4663272 - DNA, 10 bp, Homo sapiens
agtgcctggg

SEQ ID NO: 4663273 - DNA, 14 bp, Homo sapiens
agtgcgtgaatgta

SEQ ID NO: 4663274 - DNA, 17 bp, Homo sapiens
agtgcgtgaatgtatgt

SEQ ID NO: 4663275 - DNA, 16 bp, Homo sapiens
agtgctaaactactga

SEQ ID NO: 4663276 - DNA, 21 bp, Homo sapiens
agtgctatgcggaggaaagca

SEQ ID NO: 4663277 - DNA, 17 bp, Homo sapiens
agtgctggctcacagta

SEQ ID NO: 4663278 - DNA, 19 bp, Homo sapiens
agtgctggctcacagtaca

SEQ ID NO: 4663279 - DNA, 21 bp, Homo sapiens
agtgctggctcacagtacagc

SEQ ID NO: 4663280 - DNA, 20 bp, Homo sapiens
agtgctgttttattactgtt

SEQ ID NO: 4663281 - DNA, 23 bp, Homo sapiens
agtgctgttttattactgtttct

SEQ ID NO: 4663282 - DNA, 18 bp, Homo sapiens
agtgcttgtggagatcac

SEQ ID NO: 4663283 - DNA, 22 bp, Homo sapiens
agtgctttccttttttaaaaat

SEQ ID NO: 4663284 - DNA, 17 bp, Homo sapiens
agtgctttgacttcttg

SEQ ID NO: 4663285 - DNA, 13 bp, Homo sapiens
agtggaaaacaaa

SEQ ID NO: 4663286 - DNA, 13 bp, Homo sapiens
agtggactcaggg

SEQ ID NO: 4663287 - DNA, 15 bp, Homo sapiens
agtggagacagtcct

SEQ ID NO: 4663288 - DNA, 17 bp, Homo sapiens
agtggagagaagctctt

SEQ ID NO: 4663289 - DNA, 12 bp, Homo sapiens
ataaagccactt

SEQ ID NO: 4663290 - DNA, 17 bp, Homo sapiens
ataaaggaaaatgactt

SEQ ID NO: 4663291 - DNA, 15 bp, Homo sapiens
ataaaggataactct

SEQ ID NO: 4663292 - DNA, 23 bp, Homo sapiens
ataaaggataactctgtattaca

SEQ ID NO: 4663293 - DNA, 17 bp, Homo sapiens
ataaagggggagggaaa

SEQ ID NO: 4663294 - DNA, 14 bp, Homo sapiens
ataaaggtgtagaa

SEQ ID NO: 4663295 - DNA, 13 bp, Homo sapiens
ataaagtacaaat

SEQ ID NO: 4663296 - DNA, 14 bp, Homo sapiens
ataaagtacaaatg

SEQ ID NO: 4663297 - DNA, 23 bp, Homo sapiens
ataaagtacaaatgaagaaagtc

SEQ ID NO: 4663298 - DNA, 24 bp, Homo sapiens
ataaagtgctgcggagcaagagga

SEQ ID NO: 4663299 - DNA, 14 bp, Homo sapiens
ataaagttgttgca

SEQ ID NO: 4663300 - DNA, 16 bp, Homo sapiens
ataaagttgttgcatt

SEQ ID NO: 4663301 - DNA, 17 bp, Homo sapiens
ataaagttgttgcattc

SEQ ID NO: 4663302 - DNA, 14 bp, Homo sapiens
ataaataacttttt

SEQ ID NO: 4663303 - DNA, 20 bp, Homo sapiens
ataaatacgtattacaaaca

SEQ ID NO: 4663304 - DNA, 20 bp, Homo sapiens
ataaatgtttcccccactcc

SEQ ID NO: 4663305 - DNA, 14 bp, Homo sapiens
ataaattgtacatt

SEQ ID NO: 4663306 - DNA, 16 bp, Homo sapiens
ataaattgtacatttt

SEQ ID NO: 4663307 - DNA, 17 bp, Homo sapiens
ataaattgtacattttg

SEQ ID NO: 4663308 - DNA, 20 bp, Homo sapiens
ataaatttaagaaaacaagt

SEQ ID NO: 4663309 - DNA, 16 bp, Homo sapiens
ataaatttactttaca

SEQ ID NO: 4663310 - DNA, 12 bp, Homo sapiens
ataaatttgaat

SEQ ID NO: 4663311 - DNA, 15 bp, Homo sapiens
ataacccagttactt

SEQ ID NO: 4663312 - DNA, 12 bp, Homo sapiens
ataaccccaccc

SEQ ID NO: 4663313 - DNA, 16 bp, Homo sapiens
ataacctaataattgt

SEQ ID NO: 4663314 - DNA, 22 bp, Homo sapiens
ataacctaataattgtatctac

SEQ ID NO: 4663315 - DNA, 13 bp, Homo sapiens
ataactatgcttt

SEQ ID NO: 4663316 - DNA, 17 bp, Homo sapiens
ataacttaaatattgct

SEQ ID NO: 4663317 - DNA, 13 bp, Homo sapiens
ataagaaaagtaa

SEQ ID NO: 4663318 - DNA, 17 bp, Homo sapiens
ataagaaatgcatatgt

SEQ ID NO: 4663319 - DNA, 22 bp, Homo sapiens
ataagagaagtttaacaagtat

SEQ ID NO: 4663320 - DNA, 23 bp, Homo sapiens
ataagcagaacatactgttctca

SEQ ID NO: 4663321 - DNA, 18 bp, Homo sapiens
ataagcgttaagggcaga

SEQ ID NO: 4663322 - DNA, 23 bp, Homo sapiens
ataagctatcacctagcagcctc

SEQ ID NO: 4663323 - DNA, 16 bp, Homo sapiens
ataagcttttggtaat

SEQ ID NO: 4663324 - DNA, 12 bp, Homo sapiens
ataaggaaactt

SEQ ID NO: 4663325 - DNA, 20 bp, Homo sapiens
ataaggatcaattgtaatat

SEQ ID NO: 4663326 - DNA, 13 bp, Homo sapiens
ataaggcaggcat

SEQ ID NO: 4663327 - DNA, 13 bp, Homo sapiens
ataagtaatatct

SEQ ID NO: 4663328 - DNA, 15 bp, Homo sapiens
ataagtaatatcttt

SEQ ID NO: 4663329 - DNA, 19 bp, Homo sapiens
ataagtaatatctttcagt

SEQ ID NO: 4663330 - DNA, 19 bp, Homo sapiens
ataagtgaggaagagttta

SEQ ID NO: 4663331 - DNA, 14 bp, Homo sapiens
ataagttgctgtgt

SEQ ID NO: 4663332 - DNA, 14 bp, Homo sapiens
ataagtttttgcta

SEQ ID NO: 4663333 - DNA, 12 bp, Homo sapiens
ataatactgttt

SEQ ID NO: 4663334 - DNA, 13 bp, Homo sapiens
ataatactgtttt

SEQ ID NO: 4663335 - DNA, 22 bp, Homo sapiens
ataatactgttttaaaatgtga

SEQ ID NO: 4663336 - DNA, 17 bp, Homo sapiens
ataatagcatttttgta

SEQ ID NO: 4663337 - DNA, 18 bp, Homo sapiens
ataatagcatttttgtaa

SEQ ID NO: 4663338 - DNA, 14 bp, Homo sapiens
ataatatatattaa

SEQ ID NO: 4663339 - DNA, 16 bp, Homo sapiens
ataatatcatttataa

SEQ ID NO: 4663340 - DNA, 15 bp, Homo sapiens
ataatatgtttagtt

SEQ ID NO: 4663341 - DNA, 20 bp, Homo sapiens
ataatatttttgtatttctc

SEQ ID NO: 4663342 - DNA, 19 bp, Homo sapiens
ataatcaagggcactgtga

SEQ ID NO: 4663343 - DNA, 16 bp, Homo sapiens
ataatctgaaaacatc

SEQ ID NO: 4663344 - DNA, 14 bp, Homo sapiens
ataatctgtacaat

SEQ ID NO: 4663345 - DNA, 22 bp, Homo sapiens
ataatgaaaataaaacacacct

SEQ ID NO: 4663346 - DNA, 21 bp, Homo sapiens
ataatgcctttttggttttgt

SEQ ID NO: 4663347 - DNA, 18 bp, Homo sapiens
ataatgcttttactaagc

SEQ ID NO: 4663348 - DNA, 12 bp, Homo sapiens
ataattatgaaa

SEQ ID NO: 4663349 - DNA, 13 bp, Homo sapiens
ataattcttttct

SEQ ID NO: 4663350 - DNA, 22 bp, Homo sapiens
ataattggtgctatttgaagaa

SEQ ID NO: 4663351 - DNA, 22 bp, Homo sapiens
ataattggttattaaactgaat

SEQ ID NO: 4663352 - DNA, 20 bp, Homo sapiens
ataattgtatctacattaaa

SEQ ID NO: 4663353 - DNA, 12 bp, Homo sapiens
ataatttgaaaa

SEQ ID NO: 4663354 - DNA, 13 bp, Homo sapiens
ataatttgaaaaa

SEQ ID NO: 4663355 - DNA, 21 bp, Homo sapiens
ataatttgaaaaagttccata

SEQ ID NO: 4663356 - DNA, 20 bp, Homo sapiens
ataatttggtcatttggcag

SEQ ID NO: 4663357 - DNA, 16 bp, Homo sapiens
ataattttggtaattt

SEQ ID NO: 4663358 - DNA, 14 bp, Homo sapiens
atacaaagatgact

SEQ ID NO: 4663359 - DNA, 15 bp, Homo sapiens
atacaagaaaatgta

SEQ ID NO: 4663360 - DNA, 17 bp, Homo sapiens
atacaagaaaatgtatc

SEQ ID NO: 4663361 - DNA, 15 bp, Homo sapiens
atacaataacccagt

SEQ ID NO: 4663362 - DNA, 19 bp, Homo sapiens
atacaataacccagttact

SEQ ID NO: 4663363 - DNA, 21 bp, Homo sapiens
atacaataacccagttacttt

SEQ ID NO: 4663364 - DNA, 15 bp, Homo sapiens
atacaatcacattaa

SEQ ID NO: 4663365 - DNA, 16 bp, Homo sapiens
atacagacctaatatc

SEQ ID NO: 4663366 - DNA, 14 bp, Homo sapiens
atacaggactggtt

SEQ ID NO: 4663367 - DNA, 14 bp, Homo sapiens
atacatacatgtat

SEQ ID NO: 4663368 - DNA, 17 bp, Homo sapiens
atacatagtctttgttt

SEQ ID NO: 4663369 - DNA, 17 bp, Homo sapiens
atacatgatacattttt

SEQ ID NO: 4663370 - DNA, 13 bp, Homo sapiens
atacatgctactt

SEQ ID NO: 4663371 - DNA, 19 bp, Homo sapiens
atacatgtgtatattcctt

SEQ ID NO: 4663372 - DNA, 21 bp, Homo sapiens
atacatgtgtatattcctttt

SEQ ID NO: 4663373 - DNA, 13 bp, Homo sapiens
atacattaaaata

SEQ ID NO: 4663374 - DNA, 17 bp, Homo sapiens
atacattaacggtgcta

SEQ ID NO: 4663375 - DNA, 14 bp, Homo sapiens
atacattttctaaa

SEQ ID NO: 4663376 - DNA, 22 bp, Homo sapiens
atacattttctaaataaaaata

SEQ ID NO: 4663377 - DNA, 24 bp, Homo sapiens
atacattttctaaataaaaatatg

SEQ ID NO: 4663378 - DNA, 13 bp, Homo sapiens
ataccagtacttg

SEQ ID NO: 4663379 - DNA, 19 bp, Homo sapiens
atacccaccagggagatgt

SEQ ID NO: 4663380 - DNA, 19 bp, Homo sapiens
atacccatgttacttctct

SEQ ID NO: 4663381 - DNA, 14 bp, Homo sapiens
ataccccatatatt

SEQ ID NO: 4663382 - DNA, 12 bp, Homo sapiens
atacctctgtgt

SEQ ID NO: 4663383 - DNA, 17 bp, Homo sapiens
atacctgtctcagctgt

SEQ ID NO: 4663384 - DNA, 21 bp, Homo sapiens
atacctgtgcctgcttctggg

SEQ ID NO: 4663385 - DNA, 12 bp, Homo sapiens
ataccttctccc

SEQ ID NO: 4663386 - DNA, 15 bp, Homo sapiens
ataccttctcccagg

SEQ ID NO: 4663387 - DNA, 16 bp, Homo sapiens
ataccttctcccaggc

SEQ ID NO: 4663388 - DNA, 13 bp, Homo sapiens
atacctttaaata

SEQ ID NO: 4663389 - DNA, 14 bp, Homo sapiens
atacctttaaatat

SEQ ID NO: 4663390 - DNA, 18 bp, Homo sapiens
atacctttaaatatcatt

SEQ ID NO: 4663391 - DNA, 22 bp, Homo sapiens
atacctttaaatatcattcttt

SEQ ID NO: 4663392 - DNA, 19 bp, Homo sapiens
atacgtattacaaacaagt

SEQ ID NO: 4663393 - DNA, 21 bp, Homo sapiens
atacgtgaaaattatttgaaa

SEQ ID NO: 4663394 - DNA, 20 bp, Homo sapiens
atactaatagagtacttaat

SEQ ID NO: 4663395 - DNA, 16 bp, Homo sapiens
atactaccctttgctg

SEQ ID NO: 4663396 - DNA, 14 bp, Homo sapiens
atactcttgaaagg

SEQ ID NO: 4663397 - DNA, 23 bp, Homo sapiens
atactgaaaatccaataatcaga

SEQ ID NO: 4663398 - DNA, 22 bp, Homo sapiens
atactgactgctggacataaat

SEQ ID NO: 4663399 - DNA, 18 bp, Homo sapiens
atactgtagacactctga

SEQ ID NO: 4663400 - DNA, 23 bp, Homo sapiens
atattaccatcttaatctttatt

SEQ ID NO: 4663401 - DNA, 21 bp, Homo sapiens
atattaccccttcatgtccta

SEQ ID NO: 4663402 - DNA, 12 bp, Homo sapiens
atattatagaaa

SEQ ID NO: 4663403 - DNA, 22 bp, Homo sapiens
atattatagaaaattatttgta

SEQ ID NO: 4663404 - DNA, 18 bp, Homo sapiens
atattatgtttaattatt

SEQ ID NO: 4663405 - DNA, 11 bp, Homo sapiens
atattcctttt

SEQ ID NO: 4663406 - DNA, 22 bp, Homo sapiens
atattccttttaaagaagcttt

SEQ ID NO: 4663407 - DNA, 23 bp, Homo sapiens
atattccttttaaagaagcttta

SEQ ID NO: 4663408 - DNA, 13 bp, Homo sapiens
atattctttacaa

SEQ ID NO: 4663409 - DNA, 14 bp, Homo sapiens
atattctttacaaa

SEQ ID NO: 4663410 - DNA, 13 bp, Homo sapiens
atattctttgaaa

SEQ ID NO: 4663411 - DNA, 13 bp, Homo sapiens
atattgatgtgtg

SEQ ID NO: 4663412 - DNA, 23 bp, Homo sapiens
atattggtccagaagttcaaaat

SEQ ID NO: 4663413 - DNA, 15 bp, Homo sapiens
atattgtaatatgac

SEQ ID NO: 4663414 - DNA, 12 bp, Homo sapiens
atattgtacagt

SEQ ID NO: 4663415 - DNA, 21 bp, Homo sapiens
atattgttggcacagaacagg

SEQ ID NO: 4663416 - DNA, 23 bp, Homo sapiens
atattgtttaatcagttctgtgt

SEQ ID NO: 4663417 - DNA, 16 bp, Homo sapiens
atatttactgctcttt

SEQ ID NO: 4663418 - DNA, 15 bp, Homo sapiens
atatttagcaaataa

SEQ ID NO: 4663419 - DNA, 13 bp, Homo sapiens
atatttattgtta

SEQ ID NO: 4663420 - DNA, 16 bp, Homo sapiens
atatttattgttagaa

SEQ ID NO: 4663421 - DNA, 14 bp, Homo sapiens
atatttatttctag

SEQ ID NO: 4663422 - DNA, 13 bp, Homo sapiens
atatttcatttta

SEQ ID NO: 4663423 - DNA, 15 bp, Homo sapiens
atatttcattttaac

SEQ ID NO: 4663424 - DNA, 23 bp, Homo sapiens
atatttcattttaacatgatttc

SEQ ID NO: 4663425 - DNA, 10 bp, Homo sapiens
atatttgaat

SEQ ID NO: 4663426 - DNA, 15 bp, Homo sapiens
atatttgatttctaa

SEQ ID NO: 4663427 - DNA, 16 bp, Homo sapiens
atatttgatttctaat

SEQ ID NO: 4663428 - DNA, 16 bp, Homo sapiens
atattttgttaacttt

SEQ ID NO: 4663429 - DNA, 16 bp, Homo sapiens
atcaaaacaagtgaaa

SEQ ID NO: 4663430 - DNA, 15 bp, Homo sapiens
atcaaagagcacttg

SEQ ID NO: 4663431 - DNA, 17 bp, Homo sapiens
atcaaagcattttataa

SEQ ID NO: 4663432 - DNA, 11 bp, Homo sapiens
atcaaatatag

SEQ ID NO: 4663433 - DNA, 14 bp, Homo sapiens
atcaaatatagaaa

SEQ ID NO: 4663434 - DNA, 15 bp, Homo sapiens
atcaaatatagaaag

SEQ ID NO: 4663435 - DNA, 14 bp, Homo sapiens
atcaactaaaacat

SEQ ID NO: 4663436 - DNA, 12 bp, Homo sapiens
atcaagagaaac

SEQ ID NO: 4663437 - DNA, 15 bp, Homo sapiens
atcaagagaaacttc

SEQ ID NO: 4663438 - DNA, 16 bp, Homo sapiens
atcaagagaaacttca

SEQ ID NO: 4663439 - DNA, 23 bp, Homo sapiens
atcaagagacactcccccctcca

SEQ ID NO: 4663440 - DNA, 11 bp, Homo sapiens
atcaagctgtg

SEQ ID NO: 4663441 - DNA, 13 bp, Homo sapiens
atcaagtattttg

SEQ ID NO: 4663442 - DNA, 19 bp, Homo sapiens
atcacaaatttcacttata

SEQ ID NO: 4663443 - DNA, 14 bp, Homo sapiens
atcacagccccacc

SEQ ID NO: 4663444 - DNA, 16 bp, Homo sapiens
atcacagccccaccct

SEQ ID NO: 4663445 - DNA, 19 bp, Homo sapiens
atcacagcctcacccctgc

SEQ ID NO: 4663446 - DNA, 22 bp, Homo sapiens
atcacagcctcacccctgcccc

SEQ ID NO: 4663447 - DNA, 18 bp, Homo sapiens
atcacatctgcacactct

SEQ ID NO: 4663448 - DNA, 19 bp, Homo sapiens
atcacatctgcacactctc

SEQ ID NO: 4663449 - DNA, 15 bp, Homo sapiens
atcacattaacattt

SEQ ID NO: 4663450 - DNA, 20 bp, Homo sapiens
atcacattaacattttgagc

SEQ ID NO: 4663451 - DNA, 14 bp, Homo sapiens
atcaccatttggtg

SEQ ID NO: 4663452 - DNA, 12 bp, Homo sapiens
atcactaaactt

SEQ ID NO: 4663453 - DNA, 16 bp, Homo sapiens
atcactaaactttatt

SEQ ID NO: 4663454 - DNA, 22 bp, Homo sapiens
atcactaaactttatttgtaaa

SEQ ID NO: 4663455 - DNA, 14 bp, Homo sapiens
atcactctagaaaa

SEQ ID NO: 4663456 - DNA, 20 bp, Homo sapiens
atcactctgtgtctgagtgg

SEQ ID NO: 4663457 - DNA, 22 bp, Homo sapiens
atcactgcattattctctttta

SEQ ID NO: 4663458 - DNA, 22 bp, Homo sapiens
atcagaaagggagggctctgag

SEQ ID NO: 4663459 - DNA, 20 bp, Homo sapiens
atcagaaagtaacaatctat

SEQ ID NO: 4663460 - DNA, 17 bp, Homo sapiens
atcagaaagtgacattt

SEQ ID NO: 4663461 - DNA, 18 bp, Homo sapiens
atcagaacattcagctct

SEQ ID NO: 4663462 - DNA, 15 bp, Homo sapiens
atcagagtgtacaaa

SEQ ID NO: 4663463 - DNA, 21 bp, Homo sapiens
atcagcatgcctgtcctttca

SEQ ID NO: 4663464 - DNA, 11 bp, Homo sapiens
atcagctttga

SEQ ID NO: 4663465 - DNA, 15 bp, Homo sapiens
atcaggagaaggtgg

SEQ ID NO: 4663466 - DNA, 15 bp, Homo sapiens
atcaggcaaggagga

SEQ ID NO: 4663467 - DNA, 16 bp, Homo sapiens
atcaggcaaggaggag

SEQ ID NO: 4663468 - DNA, 17 bp, Homo sapiens
atcaggccccacccctg

SEQ ID NO: 4663469 - DNA, 12 bp, Homo sapiens
atcagggcctga

SEQ ID NO: 4663470 - DNA, 13 bp, Homo sapiens
atcagggcctggg

SEQ ID NO: 4663471 - DNA, 17 bp, Homo sapiens
atcagggcctggggcct

SEQ ID NO: 4663472 - DNA, 19 bp, Homo sapiens
atcagggcctggggcctga

SEQ ID NO: 4663473 - DNA, 20 bp, Homo sapiens
atcagggcctggggcctgag

SEQ ID NO: 4663474 - DNA, 24 bp, Homo sapiens
atcagggcctggggcctgagagaa

SEQ ID NO: 4663475 - DNA, 18 bp, Homo sapiens
atcagtaaatagtgtcat

SEQ ID NO: 4663476 - DNA, 15 bp, Homo sapiens
atcagtaggaccagg

SEQ ID NO: 4663477 - DNA, 16 bp, Homo sapiens
atcagtaggctaatgt

SEQ ID NO: 4663478 - DNA, 23 bp, Homo sapiens
atcagtgtagttaaggagcctaa

SEQ ID NO: 4663479 - DNA, 13 bp, Homo sapiens
atcagtgttactg

SEQ ID NO: 4663480 - DNA, 16 bp, Homo sapiens
atcatacaaactctca

SEQ ID NO: 4663481 - DNA, 21 bp, Homo sapiens
atcatatgaggacctttatat

SEQ ID NO: 4663482 - DNA, 13 bp, Homo sapiens
atcatcagggcct

SEQ ID NO: 4663483 - DNA, 14 bp, Homo sapiens
atcatcagggcctg

SEQ ID NO: 4663484 - DNA, 15 bp, Homo sapiens
atcatcagggcctgg

SEQ ID NO: 4663485 - DNA, 14 bp, Homo sapiens
atcatccagaagtt

SEQ ID NO: 4663486 - DNA, 23 bp, Homo sapiens
atcatcctcccgccaggagcttc

SEQ ID NO: 4663487 - DNA, 17 bp, Homo sapiens
atcatgctgcagtgggt

SEQ ID NO: 4663488 - DNA, 14 bp, Homo sapiens
atcatgtaaagaaa

SEQ ID NO: 4663489 - DNA, 17 bp, Homo sapiens
atcatgtaaagaaatgt

SEQ ID NO: 4663490 - DNA, 17 bp, Homo sapiens
atcatgtactttttagt

SEQ ID NO: 4663491 - DNA, 18 bp, Homo sapiens
atcatgtactttttagta

SEQ ID NO: 4663492 - DNA, 12 bp, Homo sapiens
atcatgtctgta

SEQ ID NO: 4663493 - DNA, 12 bp, Homo sapiens
atcattaaaaat

SEQ ID NO: 4663494 - DNA, 18 bp, Homo sapiens
atcattctttgtatctta

SEQ ID NO: 4663495 - DNA, 23 bp, Homo sapiens
atcattctttgtatcttaaatct

SEQ ID NO: 4663496 - DNA, 15 bp, Homo sapiens
atcatttttgtagga

SEQ ID NO: 4663497 - DNA, 15 bp, Homo sapiens
atccaaagcagacag

SEQ ID NO: 4663498 - DNA, 15 bp, Homo sapiens
atccaataatcagaa

SEQ ID NO: 4663499 - DNA, 12 bp, Homo sapiens
atccaatgttag

SEQ ID NO: 4663500 - DNA, 21 bp, Homo sapiens
atccaatgttagagacttttt

SEQ ID NO: 4663501 - DNA, 11 bp, Homo sapiens
atccagccact

SEQ ID NO: 4663502 - DNA, 19 bp, Homo sapiens
atccagccacttccccctc

SEQ ID NO: 4663503 - DNA, 15 bp, Homo sapiens
atccaggcaccagga

SEQ ID NO: 4663504 - DNA, 20 bp, Homo sapiens
atccagtttgtgtttttcta

SEQ ID NO: 4663505 - DNA, 16 bp, Homo sapiens
atccataaagaagcaa

SEQ ID NO: 4663506 - DNA, 21 bp, Homo sapiens
atccatactgtagacactctg

SEQ ID NO: 4663507 - DNA, 22 bp, Homo sapiens
atccatcaactaaaacattata

SEQ ID NO: 4663508 - DNA, 12 bp, Homo sapiens
atccatccaatc

SEQ ID NO: 4663509 - DNA, 18 bp, Homo sapiens
atccatctctctcttgcc

SEQ ID NO: 4663510 - DNA, 16 bp, Homo sapiens
atccatgggtctggct

SEQ ID NO: 4663511 - DNA, 18 bp, Homo sapiens
atctgttatagctttaaa

SEQ ID NO: 4663512 - DNA, 21 bp, Homo sapiens
atctgtttaaagcatatagag

SEQ ID NO: 4663513 - DNA, 17 bp, Homo sapiens
atcttaaaggacataaa

SEQ ID NO: 4663514 - DNA, 22 bp, Homo sapiens
atcttaaaggacataaaattta

SEQ ID NO: 4663515 - DNA, 16 bp, Homo sapiens
atcttaaatctgtgaa

SEQ ID NO: 4663516 - DNA, 13 bp, Homo sapiens
atcttaatatata

SEQ ID NO: 4663517 - DNA, 12 bp, Homo sapiens
atcttaatcttt

SEQ ID NO: 4663518 - DNA, 13 bp, Homo sapiens
atcttaatgtaaa

SEQ ID NO: 4663519 - DNA, 14 bp, Homo sapiens
atcttatacaacag

SEQ ID NO: 4663520 - DNA, 14 bp, Homo sapiens
atcttcaatatgaa

SEQ ID NO: 4663521 - DNA, 12 bp, Homo sapiens
atcttgaatgtg

SEQ ID NO: 4663522 - DNA, 13 bp, Homo sapiens
atcttgaatgtgg

SEQ ID NO: 4663523 - DNA, 14 bp, Homo sapiens
atcttgaatgtggt

SEQ ID NO: 4663524 - DNA, 21 bp, Homo sapiens
atcttgaatgtggtctcagga

SEQ ID NO: 4663525 - DNA, 22 bp, Homo sapiens
atcttgagcaagttccttctgg

SEQ ID NO: 4663526 - DNA, 19 bp, Homo sapiens
atcttgagtataagaaatg

SEQ ID NO: 4663527 - DNA, 22 bp, Homo sapiens
atcttgagtataagaaatgcat

SEQ ID NO: 4663528 - DNA, 18 bp, Homo sapiens
atcttgcttccaagacca

SEQ ID NO: 4663529 - DNA, 12 bp, Homo sapiens
atcttgctttct

SEQ ID NO: 4663530 - DNA, 22 bp, Homo sapiens
atcttgtgttaacttgcctcca

SEQ ID NO: 4663531 - DNA, 14 bp, Homo sapiens
atcttgttattatt

SEQ ID NO: 4663532 - DNA, 15 bp, Homo sapiens
atcttgtttcatttg

SEQ ID NO: 4663533 - DNA, 20 bp, Homo sapiens
atctttaaaaaaaaatcttg

SEQ ID NO: 4663534 - DNA, 14 bp, Homo sapiens
atctttattttatt

SEQ ID NO: 4663535 - DNA, 21 bp, Homo sapiens
atctttcagttattaaatgat

SEQ ID NO: 4663536 - DNA, 18 bp, Homo sapiens
atctttctatagccaact

SEQ ID NO: 4663537 - DNA, 14 bp, Homo sapiens
atcttttaaaatca

SEQ ID NO: 4663538 - DNA, 17 bp, Homo sapiens
atcttttaaaatcatga

SEQ ID NO: 4663539 - DNA, 15 bp, Homo sapiens
atctttttcttgggt

SEQ ID NO: 4663540 - DNA, 23 bp, Homo sapiens
atcttttttagcataaaattttc

SEQ ID NO: 4663541 - DNA, 13 bp, Homo sapiens
atgaaaaatataa

SEQ ID NO: 4663542 - DNA, 21 bp, Homo sapiens
atgaaaactcatgatcaagat

SEQ ID NO: 4663543 - DNA, 16 bp, Homo sapiens
atgaaaataaaacaca

SEQ ID NO: 4663544 - DNA, 17 bp, Homo sapiens
atgaaaataaaacacac

SEQ ID NO: 4663545 - DNA, 14 bp, Homo sapiens
atgaaaattgtatt

SEQ ID NO: 4663546 - DNA, 22 bp, Homo sapiens
atgaaatagttattttaatacc

SEQ ID NO: 4663547 - DNA, 19 bp, Homo sapiens
atgaacatctcttgaaacc

SEQ ID NO: 4663548 - DNA, 14 bp, Homo sapiens
atgaaccctgccct

SEQ ID NO: 4663549 - DNA, 13 bp, Homo sapiens
atgaactattccc

SEQ ID NO: 4663550 - DNA, 19 bp, Homo sapiens
atgaagaaagatactaata

SEQ ID NO: 4663551 - DNA, 21 bp, Homo sapiens
atgaagaaagtcaaaaaatta

SEQ ID NO: 4663552 - DNA, 13 bp, Homo sapiens
atgaagctgttgt

SEQ ID NO: 4663553 - DNA, 17 bp, Homo sapiens
atgaataacatttaaat

SEQ ID NO: 4663554 - DNA, 19 bp, Homo sapiens
atgaataacatttaaattc

SEQ ID NO: 4663555 - DNA, 21 bp, Homo sapiens
atgaatcccacccacatgtga

SEQ ID NO: 4663556 - DNA, 20 bp, Homo sapiens
atgaatgcccccagctggcc

SEQ ID NO: 4663557 - DNA, 14 bp, Homo sapiens
atgaattagccaaa

SEQ ID NO: 4663558 - DNA, 23 bp, Homo sapiens
atgaattcatactctgttgcctc

SEQ ID NO: 4663559 - DNA, 19 bp, Homo sapiens
atgacaagattaggaatat

SEQ ID NO: 4663560 - DNA, 14 bp, Homo sapiens
atgacaccctggcc

SEQ ID NO: 4663561 - DNA, 22 bp, Homo sapiens
atgacacttgtccccaaatccg

SEQ ID NO: 4663562 - DNA, 21 bp, Homo sapiens
atgacagataacctaataatt

SEQ ID NO: 4663563 - DNA, 15 bp, Homo sapiens
atgacagatggtgaa

SEQ ID NO: 4663564 - DNA, 20 bp, Homo sapiens
atgacagccttttttcctgg

SEQ ID NO: 4663565 - DNA, 15 bp, Homo sapiens
atgacatgacctttc

SEQ ID NO: 4663566 - DNA, 18 bp, Homo sapiens
atgacatttcttaaaact

SEQ ID NO: 4663567 - DNA, 20 bp, Homo sapiens
atgacatttcttaaaacttt

SEQ ID NO: 4663568 - DNA, 19 bp, Homo sapiens
atgaccattgagtccctgc

SEQ ID NO: 4663569 - DNA, 19 bp, Homo sapiens
atgacctccagctttcctg

SEQ ID NO: 4663570 - DNA, 17 bp, Homo sapiens
atgactatataatttat

SEQ ID NO: 4663571 - DNA, 15 bp, Homo sapiens
atgacttagaaactg

SEQ ID NO: 4663572 - DNA, 14 bp, Homo sapiens
atgacttatttctg

SEQ ID NO: 4663573 - DNA, 15 bp, Homo sapiens
atgagaaacagctca

SEQ ID NO: 4663574 - DNA, 17 bp, Homo sapiens
atgagaaacagctcagc

SEQ ID NO: 4663575 - DNA, 19 bp, Homo sapiens
atgagaaacagctcagcca

SEQ ID NO: 4663576 - DNA, 22 bp, Homo sapiens
atgagaaacagctcagccagtg

SEQ ID NO: 4663577 - DNA, 16 bp, Homo sapiens
atgagacccagcccct

SEQ ID NO: 4663578 - DNA, 16 bp, Homo sapiens
atgagactgccctgcc

SEQ ID NO: 4663579 - DNA, 21 bp, Homo sapiens
atgagactgccctgcccaggt

SEQ ID NO: 4663580 - DNA, 23 bp, Homo sapiens
atgagatgatacatccaaagcag

SEQ ID NO: 4663581 - DNA, 16 bp, Homo sapiens
atgagatttttaaaaa

SEQ ID NO: 4663582 - DNA, 20 bp, Homo sapiens
atgagatttttaaaaaatat

SEQ ID NO: 4663583 - DNA, 14 bp, Homo sapiens
atgagcccagagaa

SEQ ID NO: 4663584 - DNA, 16 bp, Homo sapiens
atgagcccagagaaca

SEQ ID NO: 4663585 - DNA, 17 bp, Homo sapiens
atgagcccagagaacag

SEQ ID NO: 4663586 - DNA, 15 bp, Homo sapiens
atgagcctgggctca

SEQ ID NO: 4663587 - DNA, 21 bp, Homo sapiens
atgagctcctgatcagaggca

SEQ ID NO: 4663588 - DNA, 24 bp, Homo sapiens
atgaggaggatgtccctgggccag

SEQ ID NO: 4663589 - DNA, 16 bp, Homo sapiens
atgaggccatctcagg

SEQ ID NO: 4663590 - DNA, 14 bp, Homo sapiens
atgaggccctgcac

SEQ ID NO: 4663591 - DNA, 13 bp, Homo sapiens
atgagggcagcag

SEQ ID NO: 4663592 - DNA, 15 bp, Homo sapiens
atgagggcagcagcc

SEQ ID NO: 4663593 - DNA, 23 bp, Homo sapiens
atgagggcagcagccagccctgc

SEQ ID NO: 4663594 - DNA, 17 bp, Homo sapiens
atgaggtctcgaccctg

SEQ ID NO: 4663595 - DNA, 18 bp, Homo sapiens
atgagtaaactgaggccc

SEQ ID NO: 4663596 - DNA, 16 bp, Homo sapiens
atgagtacaaatgcct

SEQ ID NO: 4663597 - DNA, 22 bp, Homo sapiens
atgagtcagtgaagtctagaat

SEQ ID NO: 4663598 - DNA, 14 bp, Homo sapiens
atgagtctgtttcc

SEQ ID NO: 4663599 - DNA, 20 bp, Homo sapiens
atgagtctgtttcccaagct

SEQ ID NO: 4663600 - DNA, 18 bp, Homo sapiens
atgagtgaagtattgctg

SEQ ID NO: 4663601 - DNA, 21 bp, Homo sapiens
atgatactgctgcttgtcaaa

SEQ ID NO: 4663602 - DNA, 17 bp, Homo sapiens
atgatcagtgttactgc

SEQ ID NO: 4663603 - DNA, 22 bp, Homo sapiens
atgatccttttttgtcatttta

SEQ ID NO: 4663604 - DNA, 12 bp, Homo sapiens
atgatcgctgta

SEQ ID NO: 4663605 - DNA, 15 bp, Homo sapiens
atgatggaaattagc

SEQ ID NO: 4663606 - DNA, 16 bp, Homo sapiens
atgatggatggcagac

SEQ ID NO: 4663607 - DNA, 13 bp, Homo sapiens
atgatgggaggtg

SEQ ID NO: 4663608 - DNA, 20 bp, Homo sapiens
atgatgtaagtttacctatg

SEQ ID NO: 4663609 - DNA, 14 bp, Homo sapiens
atgatgttgctgtt

SEQ ID NO: 4663610 - DNA, 12 bp, Homo sapiens
atgatttcaata

SEQ ID NO: 4663611 - DNA, 13 bp, Homo sapiens
atgatttgtggaa

SEQ ID NO: 4663612 - DNA, 14 bp, Homo sapiens
atgatttttcattg

SEQ ID NO: 4663613 - DNA, 15 bp, Homo sapiens
atgattttttcatga

SEQ ID NO: 4663614 - DNA, 11 bp, Homo sapiens
atgcaaaatgg

SEQ ID NO: 4663615 - DNA, 13 bp, Homo sapiens
atgcaaaatggaa

SEQ ID NO: 4663616 - DNA, 10 bp, Homo sapiens
atgcaaatac

SEQ ID NO: 4663617 - DNA, 11 bp, Homo sapiens
atgcaaataca

SEQ ID NO: 4663618 - DNA, 12 bp, Homo sapiens
atgcaaatacaa

SEQ ID NO: 4663619 - DNA, 11 bp, Homo sapiens
atgcaaatcct

SEQ ID NO: 4663620 - DNA, 15 bp, Homo sapiens
atgcaaattaaaaca

SEQ ID NO: 4663621 - DNA, 23 bp, Homo sapiens
atgcaacaaatgtggccaagcct

SEQ ID NO: 4663622 - DNA, 14 bp, Homo sapiens
atggcttctaacaa

SEQ ID NO: 4663623 - DNA, 18 bp, Homo sapiens
atgggaaaactgccaata

SEQ ID NO: 4663624 - DNA, 16 bp, Homo sapiens
atgggctaatgaagat

SEQ ID NO: 4663625 - DNA, 19 bp, Homo sapiens
atggggaagggagtctctc

SEQ ID NO: 4663626 - DNA, 18 bp, Homo sapiens
atggggatagtctgggtc

SEQ ID NO: 4663627 - DNA, 12 bp, Homo sapiens
atgggtctggct

SEQ ID NO: 4663628 - DNA, 17 bp, Homo sapiens
atgggtggaaagtgctc

SEQ ID NO: 4663629 - DNA, 16 bp, Homo sapiens
atgggtggacacggat

SEQ ID NO: 4663630 - DNA, 14 bp, Homo sapiens
atggtattgagaag

SEQ ID NO: 4663631 - DNA, 18 bp, Homo sapiens
atggtcaagcctcttatg

SEQ ID NO: 4663632 - DNA, 17 bp, Homo sapiens
atggtcccacatccctg

SEQ ID NO: 4663633 - DNA, 20 bp, Homo sapiens
atggtcggatctcacaggct

SEQ ID NO: 4663634 - DNA, 23 bp, Homo sapiens
atggtgcttggagggggaagaga

SEQ ID NO: 4663635 - DNA, 19 bp, Homo sapiens
atggtgggattacaggtgt

SEQ ID NO: 4663636 - DNA, 18 bp, Homo sapiens
atggttgcgtcctttgaa

SEQ ID NO: 4663637 - DNA, 22 bp, Homo sapiens
atggtttgttgttctgcctgga

SEQ ID NO: 4663638 - DNA, 17 bp, Homo sapiens
atgtaaaagactttttt

SEQ ID NO: 4663639 - DNA, 12 bp, Homo sapiens
atgtaaaatgat

SEQ ID NO: 4663640 - DNA, 13 bp, Homo sapiens
atgtaaaatgatt

SEQ ID NO: 4663641 - DNA, 14 bp, Homo sapiens
atgtaaagaaatgt

SEQ ID NO: 4663642 - DNA, 17 bp, Homo sapiens
atgtaaagaaatgtctt

SEQ ID NO: 4663643 - DNA, 14 bp, Homo sapiens
atgtaaccactgca

SEQ ID NO: 4663644 - DNA, 15 bp, Homo sapiens
atgtaagcatacttt

SEQ ID NO: 4663645 - DNA, 19 bp, Homo sapiens
atgtaaggaggtttgtata

SEQ ID NO: 4663646 - DNA, 21 bp, Homo sapiens
atgtaaggaggtttgtataag

SEQ ID NO: 4663647 - DNA, 14 bp, Homo sapiens
atgtaatagtttat

SEQ ID NO: 4663648 - DNA, 22 bp, Homo sapiens
atgtaatgtgtggtggcctcag

SEQ ID NO: 4663649 - DNA, 19 bp, Homo sapiens
atgtaattaactgtaaact

SEQ ID NO: 4663650 - DNA, 17 bp, Homo sapiens
atgtacaaattcttata

SEQ ID NO: 4663651 - DNA, 18 bp, Homo sapiens
atgtacactttttacagc

SEQ ID NO: 4663652 - DNA, 18 bp, Homo sapiens
atgtacagaggtcagcac

SEQ ID NO: 4663653 - DNA, 17 bp, Homo sapiens
atgtacaggatgctttg

SEQ ID NO: 4663654 - DNA, 20 bp, Homo sapiens
atgtacaggatgctttggtt

SEQ ID NO: 4663655 - DNA, 19 bp, Homo sapiens
atgtaccatatgatctgtt

SEQ ID NO: 4663656 - DNA, 20 bp, Homo sapiens
atgtacccaccgggccactc

SEQ ID NO: 4663657 - DNA, 21 bp, Homo sapiens
atgtacccaccgggccactcc

SEQ ID NO: 4663658 - DNA, 18 bp, Homo sapiens
atgtacttgtcaaagaag

SEQ ID NO: 4663659 - DNA, 20 bp, Homo sapiens
atgtagccagcagaactgaa

SEQ ID NO: 4663660 - DNA, 15 bp, Homo sapiens
atgtagggcaagagg

SEQ ID NO: 4663661 - DNA, 20 bp, Homo sapiens
atgtagggcaagaggatgaa

SEQ ID NO: 4663662 - DNA, 21 bp, Homo sapiens
atgtagtttttatatgttgta

SEQ ID NO: 4663663 - DNA, 22 bp, Homo sapiens
atgtatccaaggaaacatttta

SEQ ID NO: 4663664 - DNA, 22 bp, Homo sapiens
atgtatcttaaaggacataaaa

SEQ ID NO: 4663665 - DNA, 22 bp, Homo sapiens
atgtatgatctctctagctttg

SEQ ID NO: 4663666 - DNA, 22 bp, Homo sapiens
atgtattctttctgcctttaat

SEQ ID NO: 4663667 - DNA, 12 bp, Homo sapiens
atgtattgattc

SEQ ID NO: 4663668 - DNA, 22 bp, Homo sapiens
atgtcaaggcagttgcttgtgt

SEQ ID NO: 4663669 - DNA, 23 bp, Homo sapiens
atgtcaatgaccattcaattagt

SEQ ID NO: 4663670 - DNA, 16 bp, Homo sapiens
atgtcacctacatatg

SEQ ID NO: 4663671 - DNA, 18 bp, Homo sapiens
atgtcatggccttgaaac

SEQ ID NO: 4663672 - DNA, 19 bp, Homo sapiens
atgtcatggccttgaaaca

SEQ ID NO: 4663673 - DNA, 14 bp, Homo sapiens
atgtcatgtctgct

SEQ ID NO: 4663674 - DNA, 16 bp, Homo sapiens
atgtcatgtctgcttg

SEQ ID NO: 4663675 - DNA, 18 bp, Homo sapiens
atgtcattatgacatttc

SEQ ID NO: 4663676 - DNA, 22 bp, Homo sapiens
atgtcattatgacatttcttaa

SEQ ID NO: 4663677 - DNA, 14 bp, Homo sapiens
atgtccctgggcca

SEQ ID NO: 4663678 - DNA, 20 bp, Homo sapiens
atgtccctgggccagggtct

SEQ ID NO: 4663679 - DNA, 21 bp, Homo sapiens
atgtccctgggccagggtctg

SEQ ID NO: 4663680 - DNA, 23 bp, Homo sapiens
atgtcctaaagaagacattttct

SEQ ID NO: 4663681 - DNA, 17 bp, Homo sapiens
atgtcgtagaattcctt

SEQ ID NO: 4663682 - DNA, 19 bp, Homo sapiens
atgtcgtagaattccttcg

SEQ ID NO: 4663683 - DNA, 16 bp, Homo sapiens
atgtctcgtggtagga

SEQ ID NO: 4663684 - DNA, 18 bp, Homo sapiens
atgtctgcttgtcaaaag

SEQ ID NO: 4663685 - DNA, 17 bp, Homo sapiens
atgtctgtatccccagt

SEQ ID NO: 4663686 - DNA, 13 bp, Homo sapiens
atgtctgttgaaa

SEQ ID NO: 4663687 - DNA, 17 bp, Homo sapiens
atgtcttaatttttgaa

SEQ ID NO: 4663688 - DNA, 22 bp, Homo sapiens
atgtcttactactttaaatcct

SEQ ID NO: 4663689 - DNA, 19 bp, Homo sapiens
atgtcttggacactgtaca

SEQ ID NO: 4663690 - DNA, 20 bp, Homo sapiens
atgtcttgtgtatttctctg

SEQ ID NO: 4663691 - DNA, 20 bp, Homo sapiens
atgtgaaaaattaacttttt

SEQ ID NO: 4663692 - DNA, 21 bp, Homo sapiens
atgtgaagccaattcagacag

SEQ ID NO: 4663693 - DNA, 16 bp, Homo sapiens
atgtgaataatggcac

SEQ ID NO: 4663694 - DNA, 11 bp, Homo sapiens
atgtgacacat

SEQ ID NO: 4663695 - DNA, 20 bp, Homo sapiens
atgtgacctggggcagataa

SEQ ID NO: 4663696 - DNA, 12 bp, Homo sapiens
atgtgactctga

SEQ ID NO: 4663697 - DNA, 14 bp, Homo sapiens
atgtgatcatatga

SEQ ID NO: 4663698 - DNA, 11 bp, Homo sapiens
atgtgattaat

SEQ ID NO: 4663699 - DNA, 15 bp, Homo sapiens
atgtgattaatgttt

SEQ ID NO: 4663700 - DNA, 15 bp, Homo sapiens
atgtgattttaactc

SEQ ID NO: 4663701 - DNA, 16 bp, Homo sapiens
atgtgattttaactct

SEQ ID NO: 4663702 - DNA, 19 bp, Homo sapiens
atgtgattttaactctgtc

SEQ ID NO: 4663703 - DNA, 11 bp, Homo sapiens
atgtgattttc

SEQ ID NO: 4663704 - DNA, 23 bp, Homo sapiens
atgtgcaaaatctgttatagctt

SEQ ID NO: 4663705 - DNA, 22 bp, Homo sapiens
atgtgcccttttataaggaaac

SEQ ID NO: 4663706 - DNA, 15 bp, Homo sapiens
atgtgctacaggggc

SEQ ID NO: 4663707 - DNA, 23 bp, Homo sapiens
atgtgctacaggggccagaagat

SEQ ID NO: 4663708 - DNA, 14 bp, Homo sapiens
atgtgctactgatt

SEQ ID NO: 4663709 - DNA, 18 bp, Homo sapiens
atgtggactggaacatgg

SEQ ID NO: 4663710 - DNA, 18 bp, Homo sapiens
atgtggaggaagagccac

SEQ ID NO: 4663711 - DNA, 20 bp, Homo sapiens
atgtggaggaagagccacct

SEQ ID NO: 4663712 - DNA, 18 bp, Homo sapiens
atgtgggcactggcccag

SEQ ID NO: 4663713 - DNA, 13 bp, Homo sapiens
atgtggtctcagg

SEQ ID NO: 4663714 - DNA, 15 bp, Homo sapiens
atgtggtctcaggat

SEQ ID NO: 4663715 - DNA, 18 bp, Homo sapiens
atgtgtacattctgccta

SEQ ID NO: 4663716 - DNA, 15 bp, Homo sapiens
atgtgtagcctgtgc

SEQ ID NO: 4663717 - DNA, 22 bp, Homo sapiens
atgtgtcagtggggctctctga

SEQ ID NO: 4663718 - DNA, 15 bp, Homo sapiens
atgtgtgcagagcag

SEQ ID NO: 4663719 - DNA, 19 bp, Homo sapiens
atgtgtggtggcctcagct

SEQ ID NO: 4663720 - DNA, 18 bp, Homo sapiens
atgttaaccaaggaaata

SEQ ID NO: 4663721 - DNA, 21 bp, Homo sapiens
atgttaagaatgaagttctgc

SEQ ID NO: 4663722 - DNA, 23 bp, Homo sapiens
atgttaagaatgaagttctgcta

SEQ ID NO: 4663723 - DNA, 17 bp, Homo sapiens
atgttagtaatggcaga

SEQ ID NO: 4663724 - DNA, 16 bp, Homo sapiens
atgttagtataagctt

SEQ ID NO: 4663725 - DNA, 17 bp, Homo sapiens
atgttatgccagctcca

SEQ ID NO: 4663726 - DNA, 13 bp, Homo sapiens
atgttatgtaaaa

SEQ ID NO: 4663727 - DNA, 14 bp, Homo sapiens
atgttatgtaaaag

SEQ ID NO: 4663728 - DNA, 19 bp, Homo sapiens
atgttcatatttattgatt

SEQ ID NO: 4663729 - DNA, 18 bp, Homo sapiens
atgttcatgtaagaagcc

SEQ ID NO: 4663730 - DNA, 20 bp, Homo sapiens
atgttcttatgcaaaatgga

SEQ ID NO: 4663731 - DNA, 20 bp, Homo sapiens
attattcaagaatgaaaaat

SEQ ID NO: 4663732 - DNA, 21 bp, Homo sapiens
attattcaagaatgaaaaata

SEQ ID NO: 4663733 - DNA, 12 bp, Homo sapiens
attattctcttt

SEQ ID NO: 4663734 - DNA, 15 bp, Homo sapiens
attattgtagacatg

SEQ ID NO: 4663735 - DNA, 13 bp, Homo sapiens
attattgttaata

SEQ ID NO: 4663736 - DNA, 22 bp, Homo sapiens
attatttattaaaaatgttctc

SEQ ID NO: 4663737 - DNA, 14 bp, Homo sapiens
attatttgaaaaca

SEQ ID NO: 4663738 - DNA, 21 bp, Homo sapiens
attatttgccttctgaaatgt

SEQ ID NO: 4663739 - DNA, 13 bp, Homo sapiens
attattttccaaa

SEQ ID NO: 4663740 - DNA, 20 bp, Homo sapiens
attattttccttccatgctc

SEQ ID NO: 4663741 - DNA, 23 bp, Homo sapiens
attcaactaaaaaaaaaaaagta

SEQ ID NO: 4663742 - DNA, 16 bp, Homo sapiens
attcaagaatgaaaaa

SEQ ID NO: 4663743 - DNA, 15 bp, Homo sapiens
attcaatcatttatt

SEQ ID NO: 4663744 - DNA, 12 bp, Homo sapiens
attcaattagtg

SEQ ID NO: 4663745 - DNA, 22 bp, Homo sapiens
attcaattagtggtcataaaat

SEQ ID NO: 4663746 - DNA, 16 bp, Homo sapiens
attcacatatgtctta

SEQ ID NO: 4663747 - DNA, 21 bp, Homo sapiens
attcacatatgtcttactact

SEQ ID NO: 4663748 - DNA, 16 bp, Homo sapiens
attcagaaatgtggca

SEQ ID NO: 4663749 - DNA, 14 bp, Homo sapiens
attcagacaggcaa

SEQ ID NO: 4663750 - DNA, 11 bp, Homo sapiens
attcagcattt

SEQ ID NO: 4663751 - DNA, 20 bp, Homo sapiens
attcaggaaaaggcctgggg

SEQ ID NO: 4663752 - DNA, 17 bp, Homo sapiens
attcagtcctgggcaaa

SEQ ID NO: 4663753 - DNA, 16 bp, Homo sapiens
attcagtgccttcaac

SEQ ID NO: 4663754 - DNA, 11 bp, Homo sapiens
attcataataa

SEQ ID NO: 4663755 - DNA, 17 bp, Homo sapiens
attcatactctgttgcc

SEQ ID NO: 4663756 - DNA, 21 bp, Homo sapiens
attcatactctgttgcctcct

SEQ ID NO: 4663757 - DNA, 16 bp, Homo sapiens
attcatattcttcata

SEQ ID NO: 4663758 - DNA, 12 bp, Homo sapiens
attcattctcat

SEQ ID NO: 4663759 - DNA, 20 bp, Homo sapiens
attcattctcataattccta

SEQ ID NO: 4663760 - DNA, 12 bp, Homo sapiens
attcatttctaa

SEQ ID NO: 4663761 - DNA, 15 bp, Homo sapiens
attccaagaaaatat

SEQ ID NO: 4663762 - DNA, 16 bp, Homo sapiens
attccaagaaaatatc

SEQ ID NO: 4663763 - DNA, 16 bp, Homo sapiens
attccacactgcaggg

SEQ ID NO: 4663764 - DNA, 20 bp, Homo sapiens
attccacactgcagggagga

SEQ ID NO: 4663765 - DNA, 22 bp, Homo sapiens
attccaccacaggaatgtatca

SEQ ID NO: 4663766 - DNA, 15 bp, Homo sapiens
attccaccagggcca

SEQ ID NO: 4663767 - DNA, 16 bp, Homo sapiens
attccaccagggccag

SEQ ID NO: 4663768 - DNA, 21 bp, Homo sapiens
attccaccagggccagagcag

SEQ ID NO: 4663769 - DNA, 19 bp, Homo sapiens
attccagagcgtgtagtga

SEQ ID NO: 4663770 - DNA, 20 bp, Homo sapiens
attccatctagtttttggaa

SEQ ID NO: 4663771 - DNA, 23 bp, Homo sapiens
attccatgtttggaagacccttg

SEQ ID NO: 4663772 - DNA, 19 bp, Homo sapiens
attccattgcctagctctt

SEQ ID NO: 4663773 - DNA, 12 bp, Homo sapiens
attccctcccca

SEQ ID NO: 4663774 - DNA, 22 bp, Homo sapiens
attccgcatgatgtttccctct

SEQ ID NO: 4663775 - DNA, 16 bp, Homo sapiens
attcctacagcactac

SEQ ID NO: 4663776 - DNA, 17 bp, Homo sapiens
attcctacagcactact

SEQ ID NO: 4663777 - DNA, 20 bp, Homo sapiens
attcctactgacaacattat

SEQ ID NO: 4663778 - DNA, 16 bp, Homo sapiens
attcctctcatttcca

SEQ ID NO: 4663779 - DNA, 13 bp, Homo sapiens
attcctcttattg

SEQ ID NO: 4663780 - DNA, 20 bp, Homo sapiens
attcctgcctttaagccaaa

SEQ ID NO: 4663781 - DNA, 21 bp, Homo sapiens
attcctgcctttaagccaaag

SEQ ID NO: 4663782 - DNA, 18 bp, Homo sapiens
attccttcgaaaggcctt

SEQ ID NO: 4663783 - DNA, 22 bp, Homo sapiens
attccttcgaaaggccttcaga

SEQ ID NO: 4663784 - DNA, 15 bp, Homo sapiens
attccttttaaagaa

SEQ ID NO: 4663785 - DNA, 16 bp, Homo sapiens
attccttttaaagaag

SEQ ID NO: 4663786 - DNA, 16 bp, Homo sapiens
attcgagacagaacct

SEQ ID NO: 4663787 - DNA, 18 bp, Homo sapiens
attcgcatgtttaatgtg

SEQ ID NO: 4663788 - DNA, 22 bp, Homo sapiens
attcgtgagctggggactcagg

SEQ ID NO: 4663789 - DNA, 14 bp, Homo sapiens
attctaatgcatat

SEQ ID NO: 4663790 - DNA, 15 bp, Homo sapiens
attctaatgcatatt

SEQ ID NO: 4663791 - DNA, 15 bp, Homo sapiens
attctaccctggaaa

SEQ ID NO: 4663792 - DNA, 13 bp, Homo sapiens
attctatctacat

SEQ ID NO: 4663793 - DNA, 23 bp, Homo sapiens
attctcacataagcccagttcat

SEQ ID NO: 4663794 - DNA, 21 bp, Homo sapiens
attctcaggtaatcattttaa

SEQ ID NO: 4663795 - DNA, 18 bp, Homo sapiens
attctcataattcctaca

SEQ ID NO: 4663796 - DNA, 13 bp, Homo sapiens
attctccacagca

SEQ ID NO: 4663797 - DNA, 20 bp, Homo sapiens
attctcctcctcctccctcc

SEQ ID NO: 4663798 - DNA, 14 bp, Homo sapiens
attctctctctaag

SEQ ID NO: 4663799 - DNA, 15 bp, Homo sapiens
attctgaagcaacat

SEQ ID NO: 4663800 - DNA, 19 bp, Homo sapiens
attctgagcatactcaaca

SEQ ID NO: 4663801 - DNA, 22 bp, Homo sapiens
attctgataatttaaaatccat

SEQ ID NO: 4663802 - DNA, 17 bp, Homo sapiens
attctgctgcttctcca

SEQ ID NO: 4663803 - DNA, 15 bp, Homo sapiens
attcttaaccatgga

SEQ ID NO: 4663804 - DNA, 20 bp, Homo sapiens
attcttcagttctctactcc

SEQ ID NO: 4663805 - DNA, 23 bp, Homo sapiens
attcttccgcaccctccctagct

SEQ ID NO: 4663806 - DNA, 20 bp, Homo sapiens
attctttacaaactgaagat

SEQ ID NO: 4663807 - DNA, 23 bp, Homo sapiens
attctttacaaactgaagataat

SEQ ID NO: 4663808 - DNA, 18 bp, Homo sapiens
attctttactattaaaat

SEQ ID NO: 4663809 - DNA, 18 bp, Homo sapiens
attctttcagctatcagt

SEQ ID NO: 4663810 - DNA, 14 bp, Homo sapiens
attgaaaaaaaaaa

SEQ ID NO: 4663811 - DNA, 16 bp, Homo sapiens
attgaaaaactcttta

SEQ ID NO: 4663812 - DNA, 13 bp, Homo sapiens
attgaagtatatt

SEQ ID NO: 4663813 - DNA, 19 bp, Homo sapiens
attgaagtatggtgtgttc

SEQ ID NO: 4663814 - DNA, 13 bp, Homo sapiens
attgacagaagct

SEQ ID NO: 4663815 - DNA, 21 bp, Homo sapiens
attgacataggtcataaagca

SEQ ID NO: 4663816 - DNA, 17 bp, Homo sapiens
attgacattctacagtt

SEQ ID NO: 4663817 - DNA, 14 bp, Homo sapiens
attgacctggaggg

SEQ ID NO: 4663818 - DNA, 22 bp, Homo sapiens
attgactcctttccaatagaaa

SEQ ID NO: 4663819 - DNA, 15 bp, Homo sapiens
attgattttataatt

SEQ ID NO: 4663820 - DNA, 18 bp, Homo sapiens
attgatttttaaagttta

SEQ ID NO: 4663821 - DNA, 22 bp, Homo sapiens
attgcacttgattaagcttttg

SEQ ID NO: 4663822 - DNA, 11 bp, Homo sapiens
attgcactttc

SEQ ID NO: 4663823 - DNA, 17 bp, Homo sapiens
attgcatgtgactctga

SEQ ID NO: 4663824 - DNA, 18 bp, Homo sapiens
attgcatgtgactctgaa

SEQ ID NO: 4663825 - DNA, 17 bp, Homo sapiens
attgccttttaattttt

SEQ ID NO: 4663826 - DNA, 16 bp, Homo sapiens
attgctcccaggatct

SEQ ID NO: 4663827 - DNA, 17 bp, Homo sapiens
attgctcccaggatctc

SEQ ID NO: 4663828 - DNA, 14 bp, Homo sapiens
attgctctgttccc

SEQ ID NO: 4663829 - DNA, 23 bp, Homo sapiens
attgctgccaaggtggagggaag

SEQ ID NO: 4663830 - DNA, 14 bp, Homo sapiens
attgctggggccag

SEQ ID NO: 4663831 - DNA, 19 bp, Homo sapiens
attgctggggccaggcccc

SEQ ID NO: 4663832 - DNA, 20 bp, Homo sapiens
attgctggggccaggcccca

SEQ ID NO: 4663833 - DNA, 14 bp, Homo sapiens
attgctgtcctgga

SEQ ID NO: 4663834 - DNA, 14 bp, Homo sapiens
attgctttccactg

SEQ ID NO: 4663835 - DNA, 11 bp, Homo sapiens
attgctttctg

SEQ ID NO: 4663836 - DNA, 15 bp, Homo sapiens
attgctttctgaaat

SEQ ID NO: 4663837 - DNA, 15 bp, Homo sapiens
attgctttgtgcctt

SEQ ID NO: 4663838 - DNA, 19 bp, Homo sapiens
attgctttgtgcctttggg

SEQ ID NO: 4663839 - DNA, 14 bp, Homo sapiens
attgcttttttaaa

SEQ ID NO: 4663840 - DNA, 16 bp, Homo sapiens
attgcttttttaaata

SEQ ID NO: 4663841 - DNA, 21 bp, Homo sapiens
atttctttatatttatccact

SEQ ID NO: 4663842 - DNA, 16 bp, Homo sapiens
atttctttatgtggaa

SEQ ID NO: 4663843 - DNA, 16 bp, Homo sapiens
atttgaagaaaaaaat

SEQ ID NO: 4663844 - DNA, 16 bp, Homo sapiens
atttgaataagcagaa

SEQ ID NO: 4663845 - DNA, 18 bp, Homo sapiens
atttgaatgggtccattt

SEQ ID NO: 4663846 - DNA, 12 bp, Homo sapiens
atttgactaatt

SEQ ID NO: 4663847 - DNA, 17 bp, Homo sapiens
atttgactaattttaca

SEQ ID NO: 4663848 - DNA, 13 bp, Homo sapiens
atttgagcagctg

SEQ ID NO: 4663849 - DNA, 20 bp, Homo sapiens
atttgatttctaattgtaag

SEQ ID NO: 4663850 - DNA, 21 bp, Homo sapiens
atttgatttctaattgtaagt

SEQ ID NO: 4663851 - DNA, 14 bp, Homo sapiens
atttgcacctctgt

SEQ ID NO: 4663852 - DNA, 13 bp, Homo sapiens
atttgctgttgat

SEQ ID NO: 4663853 - DNA, 18 bp, Homo sapiens
atttgcttgtactgggac

SEQ ID NO: 4663854 - DNA, 20 bp, Homo sapiens
atttggcagcccctgttttc

SEQ ID NO: 4663855 - DNA, 17 bp, Homo sapiens
atttgggaggaggaaaa

SEQ ID NO: 4663856 - DNA, 17 bp, Homo sapiens
atttggtcttagcttta

SEQ ID NO: 4663857 - DNA, 22 bp, Homo sapiens
atttggtgtttgcttgaatgct

SEQ ID NO: 4663858 - DNA, 22 bp, Homo sapiens
atttgtaaaaacagcattgctt

SEQ ID NO: 4663859 - DNA, 16 bp, Homo sapiens
atttgtaaacttctga

SEQ ID NO: 4663860 - DNA, 18 bp, Homo sapiens
atttgtaaacttctgaag

SEQ ID NO: 4663861 - DNA, 16 bp, Homo sapiens
atttgtagctttgccc

SEQ ID NO: 4663862 - DNA, 16 bp, Homo sapiens
atttgtctcatatatt

SEQ ID NO: 4663863 - DNA, 21 bp, Homo sapiens
atttgtctttttgttgtaaaa

SEQ ID NO: 4663864 - DNA, 22 bp, Homo sapiens
atttgtctttttgttgtaaaac

SEQ ID NO: 4663865 - DNA, 17 bp, Homo sapiens
atttgtgtcacaaagaa

SEQ ID NO: 4663866 - DNA, 17 bp, Homo sapiens
atttgtgtgtatgtgta

SEQ ID NO: 4663867 - DNA, 14 bp, Homo sapiens
atttgttcccaaga

SEQ ID NO: 4663868 - DNA, 15 bp, Homo sapiens
atttgtttgtagctt

SEQ ID NO: 4663869 - DNA, 18 bp, Homo sapiens
attttaaaaaacactgat

SEQ ID NO: 4663870 - DNA, 14 bp, Homo sapiens
attttaaaatgttt

SEQ ID NO: 4663871 - DNA, 13 bp, Homo sapiens
attttaactctgt

SEQ ID NO: 4663872 - DNA, 20 bp, Homo sapiens
attttaatacctttaaatat

SEQ ID NO: 4663873 - DNA, 18 bp, Homo sapiens
attttaatgataaaatag

SEQ ID NO: 4663874 - DNA, 21 bp, Homo sapiens
attttaatgctgtttctaaga

SEQ ID NO: 4663875 - DNA, 18 bp, Homo sapiens
attttaatttcaggaaaa

SEQ ID NO: 4663876 - DNA, 15 bp, Homo sapiens
attttagtgtatctt

SEQ ID NO: 4663877 - DNA, 18 bp, Homo sapiens
attttagtgtatctttaa

SEQ ID NO: 4663878 - DNA, 20 bp, Homo sapiens
attttataagaattttgctt

SEQ ID NO: 4663879 - DNA, 19 bp, Homo sapiens
attttatcattaaaaatta

SEQ ID NO: 4663880 - DNA, 22 bp, Homo sapiens
attttatctgtttcctgacatt

SEQ ID NO: 4663881 - DNA, 17 bp, Homo sapiens
attttatgaatatcatt

SEQ ID NO: 4663882 - DNA, 19 bp, Homo sapiens
attttatgagagtttggaa

SEQ ID NO: 4663883 - DNA, 14 bp, Homo sapiens
attttattgcttga

SEQ ID NO: 4663884 - DNA, 21 bp, Homo sapiens
attttattttggcttcatttc

SEQ ID NO: 4663885 - DNA, 15 bp, Homo sapiens
attttattttgtaat

SEQ ID NO: 4663886 - DNA, 11 bp, Homo sapiens
attttcaaaga

SEQ ID NO: 4663887 - DNA, 14 bp, Homo sapiens
attttcaaggcctt

SEQ ID NO: 4663888 - DNA, 18 bp, Homo sapiens
attttcaaggccttcagt

SEQ ID NO: 4663889 - DNA, 22 bp, Homo sapiens
attttcaaggccttcagtttat

SEQ ID NO: 4663890 - DNA, 20 bp, Homo sapiens
attttcacattcttggctta

SEQ ID NO: 4663891 - DNA, 12 bp, Homo sapiens
attttcagagac

SEQ ID NO: 4663892 - DNA, 16 bp, Homo sapiens
attttcataatcagta

SEQ ID NO: 4663893 - DNA, 17 bp, Homo sapiens
attttcccctatcattt

SEQ ID NO: 4663894 - DNA, 14 bp, Homo sapiens
attttcctcttgtg

SEQ ID NO: 4663895 - DNA, 20 bp, Homo sapiens
attttctaaataaaaatatg

SEQ ID NO: 4663896 - DNA, 22 bp, Homo sapiens
attttctaaataaaaatatgta

SEQ ID NO: 4663897 - DNA, 16 bp, Homo sapiens
attttctccacttcat

SEQ ID NO: 4663898 - DNA, 14 bp, Homo sapiens
attttctctgtact

SEQ ID NO: 4663899 - DNA, 11 bp, Homo sapiens
attttctgtgg

SEQ ID NO: 4663900 - DNA, 16 bp, Homo sapiens
attttcttacttttat

SEQ ID NO: 4663901 - DNA, 20 bp, Homo sapiens
attttcttttgaattgtttt

SEQ ID NO: 4663902 - DNA, 17 bp, Homo sapiens
attttgaaaagatgtac

SEQ ID NO: 4663903 - DNA, 14 bp, Homo sapiens
attttgagctattt

SEQ ID NO: 4663904 - DNA, 16 bp, Homo sapiens
attttgatgcagataa

SEQ ID NO: 4663905 - DNA, 19 bp, Homo sapiens
attttgcataataaatgct

SEQ ID NO: 4663906 - DNA, 16 bp, Homo sapiens
attttggcttcatttc

SEQ ID NO: 4663907 - DNA, 19 bp, Homo sapiens
attttggcttcatttcaat

SEQ ID NO: 4663908 - DNA, 11 bp, Homo sapiens
attttgtaaaa

SEQ ID NO: 4663909 - DNA, 14 bp, Homo sapiens
attttgtactttgt

SEQ ID NO: 4663910 - DNA, 19 bp, Homo sapiens
attttgtatattatgttta

SEQ ID NO: 4663911 - DNA, 20 bp, Homo sapiens
attttgtatattatgtttat

SEQ ID NO: 4663912 - DNA, 16 bp, Homo sapiens
attttgtcacattatt

SEQ ID NO: 4663913 - DNA, 17 bp, Homo sapiens
attttgttaacttttgt

SEQ ID NO: 4663914 - DNA, 20 bp, Homo sapiens
attttgtttcttttaaagca

SEQ ID NO: 4663915 - DNA, 14 bp, Homo sapiens
atttttaaaaaata

SEQ ID NO: 4663916 - DNA, 12 bp, Homo sapiens
atttttaaagtt

SEQ ID NO: 4663917 - DNA, 22 bp, Homo sapiens
atttttagccataattttgcat

SEQ ID NO: 4663918 - DNA, 23 bp, Homo sapiens
atttttagccataattttgcata

SEQ ID NO: 4663919 - DNA, 13 bp, Homo sapiens
atttttatatcat

SEQ ID NO: 4663920 - DNA, 19 bp, Homo sapiens
atttttatatcatgcaaaa

SEQ ID NO: 4663921 - DNA, 11 bp, Homo sapiens
atttttcaatc

SEQ ID NO: 4663922 - DNA, 15 bp, Homo sapiens
atttttcagatgctt

SEQ ID NO: 4663923 - DNA, 17 bp, Homo sapiens
atttttggtttccaaag

SEQ ID NO: 4663924 - DNA, 12 bp, Homo sapiens
atttttgtactt

SEQ ID NO: 4663925 - DNA, 22 bp, Homo sapiens
atttttgttggagccactctgt

SEQ ID NO: 4663926 - DNA, 17 bp, Homo sapiens
atttttgtttttgtaat

SEQ ID NO: 4663927 - DNA, 11 bp, Homo sapiens
attttttaaga

SEQ ID NO: 4663928 - DNA, 16 bp, Homo sapiens
attttttaagaaaaaa

SEQ ID NO: 4663929 - DNA, 17 bp, Homo sapiens
atttttttatgctcttg

SEQ ID NO: 4663930 - DNA, 15 bp, Homo sapiens
atttttttgtaattg

SEQ ID NO: 4663931 - DNA, 21 bp, Homo sapiens
caaaaaatatatatcactcta

SEQ ID NO: 4663932 - DNA, 23 bp, Homo sapiens
caaaaaatatatatcactctaga

SEQ ID NO: 4663933 - DNA, 16 bp, Homo sapiens
caaaaaatgttttaaa

SEQ ID NO: 4663934 - DNA, 20 bp, Homo sapiens
caaaaatactcttgatttca

SEQ ID NO: 4663935 - DNA, 22 bp, Homo sapiens
caaaaccaaacttgttcattta

SEQ ID NO: 4663936 - DNA, 14 bp, Homo sapiens
caaaaccatgcctg

SEQ ID NO: 4663937 - DNA, 23 bp, Homo sapiens
caaaaccatgcctggtattttca

SEQ ID NO: 4663938 - DNA, 16 bp, Homo sapiens
caaaacccatgcattt

SEQ ID NO: 4663939 - DNA, 16 bp, Homo sapiens
caaaacctgtattact

SEQ ID NO: 4663940 - DNA, 15 bp, Homo sapiens
caaaactgttctttt

SEQ ID NO: 4663941 - DNA, 15 bp, Homo sapiens
caaaacttcttgtca

SEQ ID NO: 4663942 - DNA, 20 bp, Homo sapiens
caaaacttcttgtcagacat

SEQ ID NO: 4663943 - DNA, 21 bp, Homo sapiens
caaaacttcttgtcagacata

SEQ ID NO: 4663944 - DNA, 20 bp, Homo sapiens
caaaacttgaaagaagtttt

SEQ ID NO: 4663945 - DNA, 21 bp, Homo sapiens
caaaaggaggaatttcagtgg

SEQ ID NO: 4663946 - DNA, 16 bp, Homo sapiens
caaaaggcctcttgta

SEQ ID NO: 4663947 - DNA, 18 bp, Homo sapiens
caaaagggttcatagaaa

SEQ ID NO: 4663948 - DNA, 18 bp, Homo sapiens
caaaagtggcctctttgt

SEQ ID NO: 4663949 - DNA, 19 bp, Homo sapiens
caaaatacacgtttatctt

SEQ ID NO: 4663950 - DNA, 18 bp, Homo sapiens
caaaatacatttgtaagt

SEQ ID NO: 4663951 - DNA, 20 bp, Homo sapiens
caacattgatccagtcattt

SEQ ID NO: 4663952 - DNA, 16 bp, Homo sapiens
caacattggacagaaa

SEQ ID NO: 4663953 - DNA, 18 bp, Homo sapiens
caacattggacagaaaat

SEQ ID NO: 4663954 - DNA, 16 bp, Homo sapiens
caaccagaaggccctt

SEQ ID NO: 4663955 - DNA, 22 bp, Homo sapiens
caaccagcccgacagtgccatc

SEQ ID NO: 4663956 - DNA, 17 bp, Homo sapiens
caaccagtgccaaggac

SEQ ID NO: 4663957 - DNA, 13 bp, Homo sapiens
caaccccaggctg

SEQ ID NO: 4663958 - DNA, 21 bp, Homo sapiens
caaccccttaagccctggccc

SEQ ID NO: 4663959 - DNA, 21 bp, Homo sapiens
caacccgtggaggctgctcgg

SEQ ID NO: 4663960 - DNA, 20 bp, Homo sapiens
caaccctgggctggggagga

SEQ ID NO: 4663961 - DNA, 15 bp, Homo sapiens
caaccgtggcccttc

SEQ ID NO: 4663962 - DNA, 20 bp, Homo sapiens
caaccgtggcccttcctgga

SEQ ID NO: 4663963 - DNA, 20 bp, Homo sapiens
caacctccaactccctggtt

SEQ ID NO: 4663964 - DNA, 16 bp, Homo sapiens
caacctctgcctcctg

SEQ ID NO: 4663965 - DNA, 20 bp, Homo sapiens
caacctctgcctcctgggtt

SEQ ID NO: 4663966 - DNA, 17 bp, Homo sapiens
caacctctgcttcccag

SEQ ID NO: 4663967 - DNA, 20 bp, Homo sapiens
caacctctgcttcccaggtt

SEQ ID NO: 4663968 - DNA, 14 bp, Homo sapiens
caacctctgttccc

SEQ ID NO: 4663969 - DNA, 13 bp, Homo sapiens
caacctcttggcc

SEQ ID NO: 4663970 - DNA, 15 bp, Homo sapiens
caacctcttggcctg

SEQ ID NO: 4663971 - DNA, 21 bp, Homo sapiens
caacctgacctaacctaggag

SEQ ID NO: 4663972 - DNA, 20 bp, Homo sapiens
caacctgttcttagagtgta

SEQ ID NO: 4663973 - DNA, 22 bp, Homo sapiens
caacctgttcttagagtgtagc

SEQ ID NO: 4663974 - DNA, 18 bp, Homo sapiens
caacgaaaagcacatcca

SEQ ID NO: 4663975 - DNA, 14 bp, Homo sapiens
caacggccccagcg

SEQ ID NO: 4663976 - DNA, 17 bp, Homo sapiens
caacggtctggcagggc

SEQ ID NO: 4663977 - DNA, 21 bp, Homo sapiens
caacggtctggcagggcagca

SEQ ID NO: 4663978 - DNA, 18 bp, Homo sapiens
caacgtgagagaaagaga

SEQ ID NO: 4663979 - DNA, 21 bp, Homo sapiens
caacgtgagagaaagagagaa

SEQ ID NO: 4663980 - DNA, 23 bp, Homo sapiens
caacgtggctttttttttttccc

SEQ ID NO: 4663981 - DNA, 22 bp, Homo sapiens
caactacggttgggagaatgag

SEQ ID NO: 4663982 - DNA, 20 bp, Homo sapiens
caactcaagtgtcacctcct

SEQ ID NO: 4663983 - DNA, 22 bp, Homo sapiens
caactcccttctgcttgtccca

SEQ ID NO: 4663984 - DNA, 15 bp, Homo sapiens
caactccttttactg

SEQ ID NO: 4663985 - DNA, 18 bp, Homo sapiens
caactccttttactgcgt

SEQ ID NO: 4663986 - DNA, 18 bp, Homo sapiens
caactgtttccctgctga

SEQ ID NO: 4663987 - DNA, 15 bp, Homo sapiens
caacttccgctgagg

SEQ ID NO: 4663988 - DNA, 14 bp, Homo sapiens
caagaaacagccag

SEQ ID NO: 4663989 - DNA, 16 bp, Homo sapiens
caagaaacagccagca

SEQ ID NO: 4663990 - DNA, 15 bp, Homo sapiens
caagaagcctttcct

SEQ ID NO: 4663991 - DNA, 14 bp, Homo sapiens
caagaatacttgaa

SEQ ID NO: 4663992 - DNA, 19 bp, Homo sapiens
caagaatgaaaaatataat

SEQ ID NO: 4663993 - DNA, 19 bp, Homo sapiens
caagacacgtggcctcgtg

SEQ ID NO: 4663994 - DNA, 16 bp, Homo sapiens
caagacagaggggagc

SEQ ID NO: 4663995 - DNA, 14 bp, Homo sapiens
caagaccatttgta

SEQ ID NO: 4663996 - DNA, 17 bp, Homo sapiens
caagacctcatctgtgg

SEQ ID NO: 4663997 - DNA, 22 bp, Homo sapiens
caagacgaggggcagggaagga

SEQ ID NO: 4663998 - DNA, 21 bp, Homo sapiens
caagagacactcccccctcca

SEQ ID NO: 4663999 - DNA, 20 bp, Homo sapiens
caagagcaggaggtgcctga

SEQ ID NO: 4664000 - DNA, 18 bp, Homo sapiens
caagagcatcatgcctct

SEQ ID NO: 4664001 - DNA, 21 bp, Homo sapiens
caagagcatcatgcctctgag

SEQ ID NO: 4664002 - DNA, 19 bp, Homo sapiens
caagagctagaaaaataaa

SEQ ID NO: 4664003 - DNA, 14 bp, Homo sapiens
caagaggagatcca

SEQ ID NO: 4664004 - DNA, 21 bp, Homo sapiens
caagagtggagagaagctctt

SEQ ID NO: 4664005 - DNA, 21 bp, Homo sapiens
caagatatatgtgtatacata

SEQ ID NO: 4664006 - DNA, 22 bp, Homo sapiens
caagatctgccagacctgcatg

SEQ ID NO: 4664007 - DNA, 17 bp, Homo sapiens
caagatggacttacctg

SEQ ID NO: 4664008 - DNA, 14 bp, Homo sapiens
caagcacagcagcc

SEQ ID NO: 4664009 - DNA, 14 bp, Homo sapiens
caagcagcccttgc

SEQ ID NO: 4664010 - DNA, 19 bp, Homo sapiens
caagccatgtataaatgtg

SEQ ID NO: 4664011 - DNA, 21 bp, Homo sapiens
caagccatgtataaatgtgat

SEQ ID NO: 4664012 - DNA, 17 bp, Homo sapiens
caagccccatttcctca

SEQ ID NO: 4664013 - DNA, 16 bp, Homo sapiens
caagccctgcccacag

SEQ ID NO: 4664014 - DNA, 19 bp, Homo sapiens
caagccctgcccacagaaa

SEQ ID NO: 4664015 - DNA, 21 bp, Homo sapiens
caagccgaccttccctccgcc

SEQ ID NO: 4664016 - DNA, 19 bp, Homo sapiens
caagcctcttattccagga

SEQ ID NO: 4664017 - DNA, 13 bp, Homo sapiens
caagcctgcaact

SEQ ID NO: 4664018 - DNA, 20 bp, Homo sapiens
caagcgattctcctgcctca

SEQ ID NO: 4664019 - DNA, 15 bp, Homo sapiens
caagctagactgtgt

SEQ ID NO: 4664020 - DNA, 20 bp, Homo sapiens
caagctaggccccagaggcc

SEQ ID NO: 4664021 - DNA, 21 bp, Homo sapiens
caagctaggccccagaggccc

SEQ ID NO: 4664022 - DNA, 23 bp, Homo sapiens
caagctaggccccagaggccctg

SEQ ID NO: 4664023 - DNA, 16 bp, Homo sapiens
caagctcatgtcatta

SEQ ID NO: 4664024 - DNA, 19 bp, Homo sapiens
caagctcatgtcattatga

SEQ ID NO: 4664025 - DNA, 11 bp, Homo sapiens
caagctcttcc

SEQ ID NO: 4664026 - DNA, 13 bp, Homo sapiens
caagctcttccct

SEQ ID NO: 4664027 - DNA, 17 bp, Homo sapiens
caagctcttcccttgct

SEQ ID NO: 4664028 - DNA, 18 bp, Homo sapiens
caagctcttcccttgctc

SEQ ID NO: 4664029 - DNA, 19 bp, Homo sapiens
caagctcttcccttgctca

SEQ ID NO: 4664030 - DNA, 17 bp, Homo sapiens
caagctgaggtgcccag

SEQ ID NO: 4664031 - DNA, 15 bp, Homo sapiens
caagctgcactgtga

SEQ ID NO: 4664032 - DNA, 16 bp, Homo sapiens
caagctgcactgtgaa

SEQ ID NO: 4664033 - DNA, 19 bp, Homo sapiens
caagctggccaaagtcact

SEQ ID NO: 4664034 - DNA, 22 bp, Homo sapiens
caagctggccaaagtcacttcc

SEQ ID NO: 4664035 - DNA, 14 bp, Homo sapiens
caagctgtccctgc

SEQ ID NO: 4664036 - DNA, 16 bp, Homo sapiens
caagctgtccctgcag

SEQ ID NO: 4664037 - DNA, 22 bp, Homo sapiens
caagctgtccctgcagggccat

SEQ ID NO: 4664038 - DNA, 11 bp, Homo sapiens
caagctgtctc

SEQ ID NO: 4664039 - DNA, 18 bp, Homo sapiens
caagctgtgagacagtgg

SEQ ID NO: 4664040 - DNA, 14 bp, Homo sapiens
caagctgtgcaggc

SEQ ID NO: 4664041 - DNA, 14 bp, Homo sapiens
caagctttgctcct

SEQ ID NO: 4664042 - DNA, 23 bp, Homo sapiens
caagctttgctccttcagttctg

SEQ ID NO: 4664043 - DNA, 11 bp, Homo sapiens
caaggaacaga

SEQ ID NO: 4664044 - DNA, 15 bp, Homo sapiens
caaggaagcagaaga

SEQ ID NO: 4664045 - DNA, 20 bp, Homo sapiens
caaggaagcagaagacggga

SEQ ID NO: 4664046 - DNA, 17 bp, Homo sapiens
caaggacagttcagaga

SEQ ID NO: 4664047 - DNA, 22 bp, Homo sapiens
caaggacagttcagagatcagg

SEQ ID NO: 4664048 - DNA, 14 bp, Homo sapiens
caaggacccagccc

SEQ ID NO: 4664049 - DNA, 19 bp, Homo sapiens
caaggacctcctcttcccc

SEQ ID NO: 4664050 - DNA, 14 bp, Homo sapiens
caaggaggaggagt

SEQ ID NO: 4664051 - DNA, 16 bp, Homo sapiens
caaggaggcccactgt

SEQ ID NO: 4664052 - DNA, 20 bp, Homo sapiens
caaggcagaagcttggagga

SEQ ID NO: 4664053 - DNA, 13 bp, Homo sapiens
caaggccctgcat

SEQ ID NO: 4664054 - DNA, 12 bp, Homo sapiens
caaggcctggtc

SEQ ID NO: 4664055 - DNA, 14 bp, Homo sapiens
caaggcctggtctg

SEQ ID NO: 4664056 - DNA, 16 bp, Homo sapiens
caaggcctggtctggg

SEQ ID NO: 4664057 - DNA, 17 bp, Homo sapiens
caaggcctggtctggga

SEQ ID NO: 4664058 - DNA, 23 bp, Homo sapiens
caaggctctgctatacagtctat

SEQ ID NO: 4664059 - DNA, 18 bp, Homo sapiens
caaggctgttgcatgggc

SEQ ID NO: 4664060 - DNA, 17 bp, Homo sapiens
cacagacaagcagccct

SEQ ID NO: 4664061 - DNA, 15 bp, Homo sapiens
cacagacccctggga

SEQ ID NO: 4664062 - DNA, 21 bp, Homo sapiens
cacagacgttaggcatttcct

SEQ ID NO: 4664063 - DNA, 22 bp, Homo sapiens
cacagacgttaggcatttcctg

SEQ ID NO: 4664064 - DNA, 21 bp, Homo sapiens
cacagagtttttcaggagaga

SEQ ID NO: 4664065 - DNA, 17 bp, Homo sapiens
cacagatttttttgtaa

SEQ ID NO: 4664066 - DNA, 18 bp, Homo sapiens
cacagcaattcctcaggc

SEQ ID NO: 4664067 - DNA, 17 bp, Homo sapiens
cacagcaccaaaggctc

SEQ ID NO: 4664068 - DNA, 12 bp, Homo sapiens
cacagcaggatc

SEQ ID NO: 4664069 - DNA, 20 bp, Homo sapiens
cacagcatgggtccagaaga

SEQ ID NO: 4664070 - DNA, 21 bp, Homo sapiens
cacagcatgggtccagaagac

SEQ ID NO: 4664071 - DNA, 13 bp, Homo sapiens
cacagccacccct

SEQ ID NO: 4664072 - DNA, 14 bp, Homo sapiens
cacagccccaccct

SEQ ID NO: 4664073 - DNA, 18 bp, Homo sapiens
cacagccccacccttgtc

SEQ ID NO: 4664074 - DNA, 22 bp, Homo sapiens
cacagcctcacccctgcccctg

SEQ ID NO: 4664075 - DNA, 13 bp, Homo sapiens
cacagccttccct

SEQ ID NO: 4664076 - DNA, 17 bp, Homo sapiens
cacagccttccctctgc

SEQ ID NO: 4664077 - DNA, 19 bp, Homo sapiens
cacagctaaccacttcgca

SEQ ID NO: 4664078 - DNA, 16 bp, Homo sapiens
cacagctcctgccagg

SEQ ID NO: 4664079 - DNA, 17 bp, Homo sapiens
cacagctcctgccaggg

SEQ ID NO: 4664080 - DNA, 14 bp, Homo sapiens
cacaggaccacctc

SEQ ID NO: 4664081 - DNA, 15 bp, Homo sapiens
cacaggaccacctcc

SEQ ID NO: 4664082 - DNA, 24 bp, Homo sapiens
cacaggaccacctcctctgccagc

SEQ ID NO: 4664083 - DNA, 22 bp, Homo sapiens
cacaggagggggtcgtggagag

SEQ ID NO: 4664084 - DNA, 16 bp, Homo sapiens
cacaggatgaagcatt

SEQ ID NO: 4664085 - DNA, 17 bp, Homo sapiens
cacaggcagccagccgt

SEQ ID NO: 4664086 - DNA, 17 bp, Homo sapiens
cacaggcatttcctggg

SEQ ID NO: 4664087 - DNA, 19 bp, Homo sapiens
cacaggcatttcctgggtg

SEQ ID NO: 4664088 - DNA, 23 bp, Homo sapiens
cacaggcatttcctgggtggcta

SEQ ID NO: 4664089 - DNA, 13 bp, Homo sapiens
cacaggcctgtgt

SEQ ID NO: 4664090 - DNA, 22 bp, Homo sapiens
cacaggcctgtgtagctgtgac

SEQ ID NO: 4664091 - DNA, 14 bp, Homo sapiens
cacaggctggtgtg

SEQ ID NO: 4664092 - DNA, 14 bp, Homo sapiens
cacaggcttgctgt

SEQ ID NO: 4664093 - DNA, 12 bp, Homo sapiens
cacagtgaaacg

SEQ ID NO: 4664094 - DNA, 14 bp, Homo sapiens
cacagtgggagctg

SEQ ID NO: 4664095 - DNA, 19 bp, Homo sapiens
cacagtgggagctgagctg

SEQ ID NO: 4664096 - DNA, 14 bp, Homo sapiens
cacagttcctggga

SEQ ID NO: 4664097 - DNA, 18 bp, Homo sapiens
cacataggaaacttttga

SEQ ID NO: 4664098 - DNA, 13 bp, Homo sapiens
cacatatgtctta

SEQ ID NO: 4664099 - DNA, 21 bp, Homo sapiens
cacatatgtcttactacttta

SEQ ID NO: 4664100 - DNA, 18 bp, Homo sapiens
cacatccaggcaatggcc

SEQ ID NO: 4664101 - DNA, 12 bp, Homo sapiens
cacatccctggg

SEQ ID NO: 4664102 - DNA, 14 bp, Homo sapiens
cacatccctgggcc

SEQ ID NO: 4664103 - DNA, 15 bp, Homo sapiens
cacatccctgggcct

SEQ ID NO: 4664104 - DNA, 17 bp, Homo sapiens
cacatccctgggcctgc

SEQ ID NO: 4664105 - DNA, 22 bp, Homo sapiens
cacatctcccttccacctcaca

SEQ ID NO: 4664106 - DNA, 23 bp, Homo sapiens
cacatgaggccatctcaggagat

SEQ ID NO: 4664107 - DNA, 20 bp, Homo sapiens
cacatgccccccagattgct

SEQ ID NO: 4664108 - DNA, 15 bp, Homo sapiens
cacatgctatgttct

SEQ ID NO: 4664109 - DNA, 20 bp, Homo sapiens
cacatgtcttgtacatgtgt

SEQ ID NO: 4664110 - DNA, 15 bp, Homo sapiens
cacatgtgacacata

SEQ ID NO: 4664111 - DNA, 18 bp, Homo sapiens
cacattaacattttgagc

SEQ ID NO: 4664112 - DNA, 14 bp, Homo sapiens
cacattaactccct

SEQ ID NO: 4664113 - DNA, 15 bp, Homo sapiens
cacattaactccctc

SEQ ID NO: 4664114 - DNA, 23 bp, Homo sapiens
cacattaactccctccaccagcc

SEQ ID NO: 4664115 - DNA, 24 bp, Homo sapiens
cacattaactccctccaccagcct

SEQ ID NO: 4664116 - DNA, 24 bp, Homo sapiens
cacattccatttgttgagccccag

SEQ ID NO: 4664117 - DNA, 16 bp, Homo sapiens
cacatttttaaattgt

SEQ ID NO: 4664118 - DNA, 15 bp, Homo sapiens
caccaagcacagcag

SEQ ID NO: 4664119 - DNA, 17 bp, Homo sapiens
caccaagcacagcagcc

SEQ ID NO: 4664120 - DNA, 18 bp, Homo sapiens
caccaagcacagcagcct

SEQ ID NO: 4664121 - DNA, 13 bp, Homo sapiens
caccaagcagtgg

SEQ ID NO: 4664122 - DNA, 14 bp, Homo sapiens
caccaagcagtggc

SEQ ID NO: 4664123 - DNA, 18 bp, Homo sapiens
caccaaggccctgcatct

SEQ ID NO: 4664124 - DNA, 23 bp, Homo sapiens
caccaaggccctgcatctgtctg

SEQ ID NO: 4664125 - DNA, 22 bp, Homo sapiens
caccaatgtacccaccgggcca

SEQ ID NO: 4664126 - DNA, 22 bp, Homo sapiens
caccaccctgccccccctaaga

SEQ ID NO: 4664127 - DNA, 19 bp, Homo sapiens
caccacgtctggctccctg

SEQ ID NO: 4664128 - DNA, 21 bp, Homo sapiens
caccacgtctggctccctgcc

SEQ ID NO: 4664129 - DNA, 22 bp, Homo sapiens
caccacgtctggctccctgccc

SEQ ID NO: 4664130 - DNA, 17 bp, Homo sapiens
caccactctggcagcca

SEQ ID NO: 4664131 - DNA, 16 bp, Homo sapiens
caccacttgacagact

SEQ ID NO: 4664132 - DNA, 14 bp, Homo sapiens
caccagcctgctga

SEQ ID NO: 4664133 - DNA, 15 bp, Homo sapiens
caccagcctgctgac

SEQ ID NO: 4664134 - DNA, 23 bp, Homo sapiens
caccagcctgctgacagacacta

SEQ ID NO: 4664135 - DNA, 12 bp, Homo sapiens
caccagctgctg

SEQ ID NO: 4664136 - DNA, 14 bp, Homo sapiens
caccagctgctgtg

SEQ ID NO: 4664137 - DNA, 14 bp, Homo sapiens
caccagggccagag

SEQ ID NO: 4664138 - DNA, 17 bp, Homo sapiens
caccagggccagagcag

SEQ ID NO: 4664139 - DNA, 21 bp, Homo sapiens
caccagggccagagcagctcc

SEQ ID NO: 4664140 - DNA, 16 bp, Homo sapiens
caccaggggaaggaag

SEQ ID NO: 4664141 - DNA, 18 bp, Homo sapiens
caccaggggaggagcctg

SEQ ID NO: 4664142 - DNA, 21 bp, Homo sapiens
caccagtgcatcacatctgca

SEQ ID NO: 4664143 - DNA, 14 bp, Homo sapiens
caccattatgctgg

SEQ ID NO: 4664144 - DNA, 13 bp, Homo sapiens
caccattcaggtc

SEQ ID NO: 4664145 - DNA, 12 bp, Homo sapiens
caccattcctgc

SEQ ID NO: 4664146 - DNA, 14 bp, Homo sapiens
caccattcctgcct

SEQ ID NO: 4664147 - DNA, 21 bp, Homo sapiens
cacccacatgtgacacatatg

SEQ ID NO: 4664148 - DNA, 13 bp, Homo sapiens
cacccaccccctg

SEQ ID NO: 4664149 - DNA, 14 bp, Homo sapiens
cacccaccccctgc

SEQ ID NO: 4664150 - DNA, 17 bp, Homo sapiens
cacccaccccctgcctg

SEQ ID NO: 4664151 - DNA, 19 bp, Homo sapiens
cacccaccccctgcctggt

SEQ ID NO: 4664152 - DNA, 19 bp, Homo sapiens
cacccaggctggagtgcag

SEQ ID NO: 4664153 - DNA, 17 bp, Homo sapiens
cacccagggacactcca

SEQ ID NO: 4664154 - DNA, 21 bp, Homo sapiens
cacccagggacactccaactc

SEQ ID NO: 4664155 - DNA, 17 bp, Homo sapiens
cacccatgtaaccactg

SEQ ID NO: 4664156 - DNA, 17 bp, Homo sapiens
caccccattttctgtgg

SEQ ID NO: 4664157 - DNA, 11 bp, Homo sapiens
cacccccaccc

SEQ ID NO: 4664158 - DNA, 13 bp, Homo sapiens
cacccccagcctg

SEQ ID NO: 4664159 - DNA, 14 bp, Homo sapiens
cacccccagcctgg

SEQ ID NO: 4664160 - DNA, 17 bp, Homo sapiens
cacccccagcctgggcc

SEQ ID NO: 4664161 - DNA, 18 bp, Homo sapiens
cacccccagcctgggcct

SEQ ID NO: 4664162 - DNA, 17 bp, Homo sapiens
caccccctgcagcttgt

SEQ ID NO: 4664163 - DNA, 15 bp, Homo sapiens
caccccctgcctggt

SEQ ID NO: 4664164 - DNA, 18 bp, Homo sapiens
caccccctgcctggttct

SEQ ID NO: 4664165 - DNA, 13 bp, Homo sapiens
cacccccttcccc

SEQ ID NO: 4664166 - DNA, 16 bp, Homo sapiens
cacccctctgccctca

SEQ ID NO: 4664167 - DNA, 11 bp, Homo sapiens
caccccttccc

SEQ ID NO: 4664168 - DNA, 17 bp, Homo sapiens
caccccttggaggagag

SEQ ID NO: 4664169 - DNA, 21 bp, Homo sapiens
caccccttggaggagagagac

SEQ ID NO: 4664170 - DNA, 18 bp, Homo sapiens
cactgaaaacatctggaa

SEQ ID NO: 4664171 - DNA, 19 bp, Homo sapiens
cactgaccggtgcttttat

SEQ ID NO: 4664172 - DNA, 15 bp, Homo sapiens
cactgactgtatggc

SEQ ID NO: 4664173 - DNA, 17 bp, Homo sapiens
cactgataatcacactg

SEQ ID NO: 4664174 - DNA, 20 bp, Homo sapiens
cactgcaacctccaactccc

SEQ ID NO: 4664175 - DNA, 14 bp, Homo sapiens
cactgcaacctccg

SEQ ID NO: 4664176 - DNA, 14 bp, Homo sapiens
cactgcaacctctg

SEQ ID NO: 4664177 - DNA, 21 bp, Homo sapiens
cactgcaacctctgcctcctg

SEQ ID NO: 4664178 - DNA, 14 bp, Homo sapiens
cactgcactccagc

SEQ ID NO: 4664179 - DNA, 18 bp, Homo sapiens
cactgcactccagcctgg

SEQ ID NO: 4664180 - DNA, 21 bp, Homo sapiens
cactgcactttccaatgccac

SEQ ID NO: 4664181 - DNA, 13 bp, Homo sapiens
cactgcagacttg

SEQ ID NO: 4664182 - DNA, 17 bp, Homo sapiens
cactgcagcagaaaggc

SEQ ID NO: 4664183 - DNA, 16 bp, Homo sapiens
cactgccaggagggac

SEQ ID NO: 4664184 - DNA, 22 bp, Homo sapiens
cactgccaggagggacaaagga

SEQ ID NO: 4664185 - DNA, 17 bp, Homo sapiens
cactgcccatggacagg

SEQ ID NO: 4664186 - DNA, 18 bp, Homo sapiens
cactgcccatggacaggc

SEQ ID NO: 4664187 - DNA, 23 bp, Homo sapiens
cactgctgcttctccatggccac

SEQ ID NO: 4664188 - DNA, 20 bp, Homo sapiens
cactgcttgaactaggctga

SEQ ID NO: 4664189 - DNA, 13 bp, Homo sapiens
cactggacagcat

SEQ ID NO: 4664190 - DNA, 16 bp, Homo sapiens
cactggaggagagaag

SEQ ID NO: 4664191 - DNA, 22 bp, Homo sapiens
cactggaggagagaagaatgag

SEQ ID NO: 4664192 - DNA, 18 bp, Homo sapiens
cactggggactttattta

SEQ ID NO: 4664193 - DNA, 23 bp, Homo sapiens
cactgggtttggcaaaactcagg

SEQ ID NO: 4664194 - DNA, 18 bp, Homo sapiens
cactggtaggttgggaca

SEQ ID NO: 4664195 - DNA, 18 bp, Homo sapiens
cactggtgtttaggtgaa

SEQ ID NO: 4664196 - DNA, 14 bp, Homo sapiens
cactgtagcaggtt

SEQ ID NO: 4664197 - DNA, 15 bp, Homo sapiens
cactgtatgagtgga

SEQ ID NO: 4664198 - DNA, 11 bp, Homo sapiens
cactgtcaccg

SEQ ID NO: 4664199 - DNA, 20 bp, Homo sapiens
cactgtgaacctgggcactc

SEQ ID NO: 4664200 - DNA, 14 bp, Homo sapiens
cactgtgaccccca

SEQ ID NO: 4664201 - DNA, 20 bp, Homo sapiens
cactgtgacccccagctccg

SEQ ID NO: 4664202 - DNA, 23 bp, Homo sapiens
cactgtgacccccagctccggcc

SEQ ID NO: 4664203 - DNA, 16 bp, Homo sapiens
cactgtgatacagttt

SEQ ID NO: 4664204 - DNA, 20 bp, Homo sapiens
cactgtgatacagttttgag

SEQ ID NO: 4664205 - DNA, 18 bp, Homo sapiens
cactgtgcacttagccat

SEQ ID NO: 4664206 - DNA, 18 bp, Homo sapiens
cactgtgttactgctttg

SEQ ID NO: 4664207 - DNA, 16 bp, Homo sapiens
cactgttaagaataga

SEQ ID NO: 4664208 - DNA, 21 bp, Homo sapiens
cactgtttcatctcagctttt

SEQ ID NO: 4664209 - DNA, 13 bp, Homo sapiens
cacttaacagatg

SEQ ID NO: 4664210 - DNA, 12 bp, Homo sapiens
cacttaatcttc

SEQ ID NO: 4664211 - DNA, 20 bp, Homo sapiens
ctcaggtccctggggctagg

SEQ ID NO: 4664212 - DNA, 23 bp, Homo sapiens
ctcaggtgatccgcccacctcag

SEQ ID NO: 4664213 - DNA, 18 bp, Homo sapiens
ctcagtccctcttctggt

SEQ ID NO: 4664214 - DNA, 15 bp, Homo sapiens
ctcagtgattcgctt

SEQ ID NO: 4664215 - DNA, 17 bp, Homo sapiens
ctcagtgcaaaatgtct

SEQ ID NO: 4664216 - DNA, 24 bp, Homo sapiens
ctcagtgcaaaatgtcttgtgtat

SEQ ID NO: 4664217 - DNA, 14 bp, Homo sapiens
ctcagtgcatttgt

SEQ ID NO: 4664218 - DNA, 17 bp, Homo sapiens
ctcagtgcatttgtgct

SEQ ID NO: 4664219 - DNA, 22 bp, Homo sapiens
ctcagtgcatttgtgctagaaa

SEQ ID NO: 4664220 - DNA, 23 bp, Homo sapiens
ctcagttattacatgtaatttga

SEQ ID NO: 4664221 - DNA, 14 bp, Homo sapiens
ctcagtttctgcct

SEQ ID NO: 4664222 - DNA, 15 bp, Homo sapiens
ctcagtttctgcctg

SEQ ID NO: 4664223 - DNA, 16 bp, Homo sapiens
ctcagtttctgcctgg

SEQ ID NO: 4664224 - DNA, 18 bp, Homo sapiens
ctcagtttctgcctgggc

SEQ ID NO: 4664225 - DNA, 19 bp, Homo sapiens
ctcagtttctgcctgggca

SEQ ID NO: 4664226 - DNA, 17 bp, Homo sapiens
ctcatagccctcagaca

SEQ ID NO: 4664227 - DNA, 22 bp, Homo sapiens
ctcatatatttggagtttttct

SEQ ID NO: 4664228 - DNA, 14 bp, Homo sapiens
ctcatcatattttg

SEQ ID NO: 4664229 - DNA, 20 bp, Homo sapiens
ctcatcccccctgctgccca

SEQ ID NO: 4664230 - DNA, 18 bp, Homo sapiens
ctcatccctgactggcca

SEQ ID NO: 4664231 - DNA, 19 bp, Homo sapiens
ctcatccttgcccaggtga

SEQ ID NO: 4664232 - DNA, 15 bp, Homo sapiens
ctcatctaactgatg

SEQ ID NO: 4664233 - DNA, 23 bp, Homo sapiens
ctcatctgtggagctgccacaga

SEQ ID NO: 4664234 - DNA, 18 bp, Homo sapiens
ctcatgttttccattgtt

SEQ ID NO: 4664235 - DNA, 15 bp, Homo sapiens
ctcattaatgacact

SEQ ID NO: 4664236 - DNA, 18 bp, Homo sapiens
ctcattccctccccagaa

SEQ ID NO: 4664237 - DNA, 15 bp, Homo sapiens
ctcattctcagagta

SEQ ID NO: 4664238 - DNA, 18 bp, Homo sapiens
ctcatttccagcttctca

SEQ ID NO: 4664239 - DNA, 14 bp, Homo sapiens
ctcatttttgcact

SEQ ID NO: 4664240 - DNA, 15 bp, Homo sapiens
ctccaaacctgtctt

SEQ ID NO: 4664241 - DNA, 15 bp, Homo sapiens
ctccaaactgattaa

SEQ ID NO: 4664242 - DNA, 19 bp, Homo sapiens
ctccaaatccaaggaaaca

SEQ ID NO: 4664243 - DNA, 15 bp, Homo sapiens
ctccaacaccaagca

SEQ ID NO: 4664244 - DNA, 16 bp, Homo sapiens
ctccaacaccaagcac

SEQ ID NO: 4664245 - DNA, 18 bp, Homo sapiens
ctccaacaccaagcacag

SEQ ID NO: 4664246 - DNA, 22 bp, Homo sapiens
ctccaacaccaagcacagcagc

SEQ ID NO: 4664247 - DNA, 22 bp, Homo sapiens
ctccaagcatttcatgaaaaag

SEQ ID NO: 4664248 - DNA, 13 bp, Homo sapiens
ctccaatcctccc

SEQ ID NO: 4664249 - DNA, 11 bp, Homo sapiens
ctccaccagcc

SEQ ID NO: 4664250 - DNA, 18 bp, Homo sapiens
ctccaccagcctgctgac

SEQ ID NO: 4664251 - DNA, 19 bp, Homo sapiens
ctccaccagcctgctgaca

SEQ ID NO: 4664252 - DNA, 14 bp, Homo sapiens
ctccaccctccacc

SEQ ID NO: 4664253 - DNA, 21 bp, Homo sapiens
ctccacggatgcgtgggcaga

SEQ ID NO: 4664254 - DNA, 15 bp, Homo sapiens
ctccactcagctgtc

SEQ ID NO: 4664255 - DNA, 23 bp, Homo sapiens
ctccactcagctgtcctgcagca

SEQ ID NO: 4664256 - DNA, 16 bp, Homo sapiens
ctccagatgcagggca

SEQ ID NO: 4664257 - DNA, 14 bp, Homo sapiens
ctccagcccctgtc

SEQ ID NO: 4664258 - DNA, 15 bp, Homo sapiens
ctccagcccctgtcc

SEQ ID NO: 4664259 - DNA, 17 bp, Homo sapiens
ctccagcccctgtccca

SEQ ID NO: 4664260 - DNA, 17 bp, Homo sapiens
ctccagcctctggtcct

SEQ ID NO: 4664261 - DNA, 18 bp, Homo sapiens
ctccaggagagagccagg

SEQ ID NO: 4664262 - DNA, 18 bp, Homo sapiens
ctccaggattttaatttc

SEQ ID NO: 4664263 - DNA, 13 bp, Homo sapiens
ctccaggcctgtt

SEQ ID NO: 4664264 - DNA, 20 bp, Homo sapiens
ctccaggcctgttgctatag

SEQ ID NO: 4664265 - DNA, 22 bp, Homo sapiens
ctccaggggcctgcagaaggaa

SEQ ID NO: 4664266 - DNA, 18 bp, Homo sapiens
ctccagtttgcacctgtc

SEQ ID NO: 4664267 - DNA, 14 bp, Homo sapiens
ctccataaccccac

SEQ ID NO: 4664268 - DNA, 15 bp, Homo sapiens
ctccatactcaagct

SEQ ID NO: 4664269 - DNA, 20 bp, Homo sapiens
ctccatatttgatttctaat

SEQ ID NO: 4664270 - DNA, 19 bp, Homo sapiens
ctccatcttactctgccct

SEQ ID NO: 4664271 - DNA, 12 bp, Homo sapiens
ctccatgctgca

SEQ ID NO: 4664272 - DNA, 15 bp, Homo sapiens
ctccatgctgcaaag

SEQ ID NO: 4664273 - DNA, 15 bp, Homo sapiens
ctccattcccacccc

SEQ ID NO: 4664274 - DNA, 16 bp, Homo sapiens
ctccatttaagacaca

SEQ ID NO: 4664275 - DNA, 17 bp, Homo sapiens
ctcccaactcccttctg

SEQ ID NO: 4664276 - DNA, 13 bp, Homo sapiens
ctcccaagcccct

SEQ ID NO: 4664277 - DNA, 21 bp, Homo sapiens
ctcccacatgaggccatctca

SEQ ID NO: 4664278 - DNA, 18 bp, Homo sapiens
ctcccacggagcatctca

SEQ ID NO: 4664279 - DNA, 17 bp, Homo sapiens
ctcccagacctgcctct

SEQ ID NO: 4664280 - DNA, 11 bp, Homo sapiens
ctcccagccca

SEQ ID NO: 4664281 - DNA, 19 bp, Homo sapiens
ctcccaggccccatgacct

SEQ ID NO: 4664282 - DNA, 16 bp, Homo sapiens
ctcccaggcctctgcc

SEQ ID NO: 4664283 - DNA, 12 bp, Homo sapiens
ctcccagggcca

SEQ ID NO: 4664284 - DNA, 14 bp, Homo sapiens
ctcccagggccatg

SEQ ID NO: 4664285 - DNA, 15 bp, Homo sapiens
ctcccatccagggcc

SEQ ID NO: 4664286 - DNA, 22 bp, Homo sapiens
ctcccatccagggcccccatct

SEQ ID NO: 4664287 - DNA, 13 bp, Homo sapiens
ctcccatcctggg

SEQ ID NO: 4664288 - DNA, 21 bp, Homo sapiens
ctcccatcctggggcagcact

SEQ ID NO: 4664289 - DNA, 21 bp, Homo sapiens
ctcccatgagactgccctgcc

SEQ ID NO: 4664290 - DNA, 14 bp, Homo sapiens
ctcccatttcctga

SEQ ID NO: 4664291 - DNA, 17 bp, Homo sapiens
ctccccactctgctctg

SEQ ID NO: 4664292 - DNA, 20 bp, Homo sapiens
ctccccactctgctctgatg

SEQ ID NO: 4664293 - DNA, 18 bp, Homo sapiens
ctccccagagctgtgcca

SEQ ID NO: 4664294 - DNA, 12 bp, Homo sapiens
ctccccagccca

SEQ ID NO: 4664295 - DNA, 14 bp, Homo sapiens
ctccccagcccagg

SEQ ID NO: 4664296 - DNA, 17 bp, Homo sapiens
ctccccatctgtgttct

SEQ ID NO: 4664297 - DNA, 16 bp, Homo sapiens
ctccccattagctttc

SEQ ID NO: 4664298 - DNA, 12 bp, Homo sapiens
ctcccccaggca

SEQ ID NO: 4664299 - DNA, 14 bp, Homo sapiens
ctccccctgcaact

SEQ ID NO: 4664300 - DNA, 13 bp, Homo sapiens
ctccccctgctcc

SEQ ID NO: 4664301 - DNA, 13 bp, Homo sapiens
ctcccctccccat

SEQ ID NO: 4664302 - DNA, 16 bp, Homo sapiens
ctcccctccccatctg

SEQ ID NO: 4664303 - DNA, 22 bp, Homo sapiens
ctcccctgacctgtgagcccag

SEQ ID NO: 4664304 - DNA, 21 bp, Homo sapiens
ctcccctgccttaacctggga

SEQ ID NO: 4664305 - DNA, 22 bp, Homo sapiens
ctcccctgggactttcccaccc

SEQ ID NO: 4664306 - DNA, 22 bp, Homo sapiens
ctcccgagtagctgggattaca

SEQ ID NO: 4664307 - DNA, 18 bp, Homo sapiens
ctccctagctcttcccca

SEQ ID NO: 4664308 - DNA, 14 bp, Homo sapiens
ctccctaggcccaa

SEQ ID NO: 4664309 - DNA, 17 bp, Homo sapiens
ctccctaggcccaagtc

SEQ ID NO: 4664310 - DNA, 23 bp, Homo sapiens
ctccctaggcccaagtctcctag

SEQ ID NO: 4664311 - DNA, 13 bp, Homo sapiens
ctccctccaccag

SEQ ID NO: 4664312 - DNA, 14 bp, Homo sapiens
ctccctccaccagc

SEQ ID NO: 4664313 - DNA, 15 bp, Homo sapiens
ctccctccaccagcc

SEQ ID NO: 4664314 - DNA, 16 bp, Homo sapiens
ctccctccaccagcct

SEQ ID NO: 4664315 - DNA, 20 bp, Homo sapiens
ctccctccaccagcctgctg

SEQ ID NO: 4664316 - DNA, 16 bp, Homo sapiens
ctccctccttctcctt

SEQ ID NO: 4664317 - DNA, 20 bp, Homo sapiens
ctccctgcagaggggctgag

SEQ ID NO: 4664318 - DNA, 18 bp, Homo sapiens
ctccctgccccttaaccc

SEQ ID NO: 4664319 - DNA, 11 bp, Homo sapiens
ctccctggacc

SEQ ID NO: 4664320 - DNA, 10 bp, Homo sapiens
ctccctgggg

SEQ ID NO: 4664321 - DNA, 14 bp, Homo sapiens
tttattataaactg

SEQ ID NO: 4664322 - DNA, 16 bp, Homo sapiens
tttattcctgttagta

SEQ ID NO: 4664323 - DNA, 13 bp, Homo sapiens
tttattgcttgtt

SEQ ID NO: 4664324 - DNA, 22 bp, Homo sapiens
tttattgtgggccatgaaccaa

SEQ ID NO: 4664325 - DNA, 19 bp, Homo sapiens
tttatttaaattacaattt

SEQ ID NO: 4664326 - DNA, 13 bp, Homo sapiens
tttatttatttct

SEQ ID NO: 4664327 - DNA, 20 bp, Homo sapiens
tttatttccactattttcaa

SEQ ID NO: 4664328 - DNA, 17 bp, Homo sapiens
tttatttgtaaaccatt

SEQ ID NO: 4664329 - DNA, 16 bp, Homo sapiens
tttattttattattca

SEQ ID NO: 4664330 - DNA, 14 bp, Homo sapiens
tttattttgtaata

SEQ ID NO: 4664331 - DNA, 16 bp, Homo sapiens
tttattttttaagaaa

SEQ ID NO: 4664332 - DNA, 16 bp, Homo sapiens
tttcaaactcctgacc

SEQ ID NO: 4664333 - DNA, 23 bp, Homo sapiens
tttcaacaaagatcatttaatac

SEQ ID NO: 4664334 - DNA, 13 bp, Homo sapiens
tttcaacaaattt

SEQ ID NO: 4664335 - DNA, 14 bp, Homo sapiens
tttcaacaaatttc

SEQ ID NO: 4664336 - DNA, 15 bp, Homo sapiens
tttcaacaaatttca

SEQ ID NO: 4664337 - DNA, 22 bp, Homo sapiens
tttcaagagtctaatagtcttt

SEQ ID NO: 4664338 - DNA, 17 bp, Homo sapiens
tttcaaggccttcagtt

SEQ ID NO: 4664339 - DNA, 12 bp, Homo sapiens
tttcaataaagt

SEQ ID NO: 4664340 - DNA, 13 bp, Homo sapiens
tttcaataaagtt

SEQ ID NO: 4664341 - DNA, 20 bp, Homo sapiens
tttcaataaagttgttgcat

SEQ ID NO: 4664342 - DNA, 21 bp, Homo sapiens
tttcaataaagttgttgcatt

SEQ ID NO: 4664343 - DNA, 13 bp, Homo sapiens
tttcaatcattga

SEQ ID NO: 4664344 - DNA, 15 bp, Homo sapiens
tttcacttatacctg

SEQ ID NO: 4664345 - DNA, 17 bp, Homo sapiens
tttcagagcccccagcc

SEQ ID NO: 4664346 - DNA, 18 bp, Homo sapiens
tttcagatataaaagact

SEQ ID NO: 4664347 - DNA, 12 bp, Homo sapiens
tttcagatgctt

SEQ ID NO: 4664348 - DNA, 14 bp, Homo sapiens
tttcagatgcttct

SEQ ID NO: 4664349 - DNA, 17 bp, Homo sapiens
tttcagcgatgtatgca

SEQ ID NO: 4664350 - DNA, 22 bp, Homo sapiens
tttcagcgatgtatgcagctat

SEQ ID NO: 4664351 - DNA, 16 bp, Homo sapiens
tttcagctatcagtag

SEQ ID NO: 4664352 - DNA, 11 bp, Homo sapiens
tttcaggaaaa

SEQ ID NO: 4664353 - DNA, 13 bp, Homo sapiens
tttcagtaccaaa

SEQ ID NO: 4664354 - DNA, 17 bp, Homo sapiens
tttcagtgcatcattac

SEQ ID NO: 4664355 - DNA, 22 bp, Homo sapiens
tttcataaataaaggtgtagaa

SEQ ID NO: 4664356 - DNA, 15 bp, Homo sapiens
tttcataatcagtaa

SEQ ID NO: 4664357 - DNA, 17 bp, Homo sapiens
tttcatagttttctaaa

SEQ ID NO: 4664358 - DNA, 13 bp, Homo sapiens
tttcatctaaatg

SEQ ID NO: 4664359 - DNA, 15 bp, Homo sapiens
tttcatctaaatgaa

SEQ ID NO: 4664360 - DNA, 15 bp, Homo sapiens
tttcatctcagcttt

SEQ ID NO: 4664361 - DNA, 14 bp, Homo sapiens
tttcatctgggaaa

SEQ ID NO: 4664362 - DNA, 16 bp, Homo sapiens
tttcatctgggaaaga

SEQ ID NO: 4664363 - DNA, 19 bp, Homo sapiens
tttcatctgggaaagacat

SEQ ID NO: 4664364 - DNA, 16 bp, Homo sapiens
tttcatgttttaacaa

SEQ ID NO: 4664365 - DNA, 16 bp, Homo sapiens
tttcattaaaggcttc

SEQ ID NO: 4664366 - DNA, 15 bp, Homo sapiens
tttcattacttgaat

SEQ ID NO: 4664367 - DNA, 16 bp, Homo sapiens
tttcattccattgcct

SEQ ID NO: 4664368 - DNA, 16 bp, Homo sapiens
tttcattgcactttcc

SEQ ID NO: 4664369 - DNA, 18 bp, Homo sapiens
tttcatttaactttataa

SEQ ID NO: 4664370 - DNA, 16 bp, Homo sapiens
tttcattttaacatga

SEQ ID NO: 4664371 - DNA, 21 bp, Homo sapiens
tttcattttagtgtatcttta

SEQ ID NO: 4664372 - DNA, 22 bp, Homo sapiens
tttcattttagtgtatctttaa

SEQ ID NO: 4664373 - DNA, 14 bp, Homo sapiens
tttccaaaggcatt

SEQ ID NO: 4664374 - DNA, 14 bp, Homo sapiens
tttccaaattaaaa

SEQ ID NO: 4664375 - DNA, 13 bp, Homo sapiens
tttccaaattgcc

SEQ ID NO: 4664376 - DNA, 15 bp, Homo sapiens
tttccaagccctcag

SEQ ID NO: 4664377 - DNA, 17 bp, Homo sapiens
tttccaagccctcagct

SEQ ID NO: 4664378 - DNA, 15 bp, Homo sapiens
tttccaatgccacag

SEQ ID NO: 4664379 - DNA, 13 bp, Homo sapiens
tttccacagattt

SEQ ID NO: 4664380 - DNA, 16 bp, Homo sapiens
tttccactaaaaatat

SEQ ID NO: 4664381 - DNA, 14 bp, Homo sapiens
tttccactattttc

SEQ ID NO: 4664382 - DNA, 20 bp, Homo sapiens
tttccactattttcaaagaa

SEQ ID NO: 4664383 - DNA, 18 bp, Homo sapiens
tttccacttgttctcagg

SEQ ID NO: 4664384 - DNA, 16 bp, Homo sapiens
tttccacttttgttct

SEQ ID NO: 4664385 - DNA, 13 bp, Homo sapiens
tttccagcttctc

SEQ ID NO: 4664386 - DNA, 17 bp, Homo sapiens
tttcccccaccctccca

SEQ ID NO: 4664387 - DNA, 18 bp, Homo sapiens
tttcctgaaccatgtgga

SEQ ID NO: 4664388 - DNA, 15 bp, Homo sapiens
tttcctggacttaaa

SEQ ID NO: 4664389 - DNA, 15 bp, Homo sapiens
tttcctggcctcaga

SEQ ID NO: 4664390 - DNA, 19 bp, Homo sapiens
tttcctggcctcagagctt

SEQ ID NO: 4664391 - DNA, 21 bp, Homo sapiens
tttcctggcctcagagcttcc

SEQ ID NO: 4664392 - DNA, 15 bp, Homo sapiens
tttcctgggccagaa

SEQ ID NO: 4664393 - DNA, 22 bp, Homo sapiens
tttcctgtggttttattacaaa

SEQ ID NO: 4664394 - DNA, 18 bp, Homo sapiens
tttcctgtgtgtgttgcc

SEQ ID NO: 4664395 - DNA, 14 bp, Homo sapiens
tttcctgtttccag

SEQ ID NO: 4664396 - DNA, 17 bp, Homo sapiens
tttccttccagcctttt

SEQ ID NO: 4664397 - DNA, 21 bp, Homo sapiens
tttccttccatgctcccaact

SEQ ID NO: 4664398 - DNA, 15 bp, Homo sapiens
tttccttttttaaaa

SEQ ID NO: 4664399 - DNA, 17 bp, Homo sapiens
tttctaaataaaaatat

SEQ ID NO: 4664400 - DNA, 21 bp, Homo sapiens
tttctaaataaaaatatgtaa

SEQ ID NO: 4664401 - DNA, 22 bp, Homo sapiens
tttctaaccacggttatttaag

SEQ ID NO: 4664402 - DNA, 14 bp, Homo sapiens
tttctaagaaaatg

SEQ ID NO: 4664403 - DNA, 16 bp, Homo sapiens
tttctaagaaaatgta

SEQ ID NO: 4664404 - DNA, 15 bp, Homo sapiens
tttctaataaagcca

SEQ ID NO: 4664405 - DNA, 15 bp, Homo sapiens
tttctaattaacctt

SEQ ID NO: 4664406 - DNA, 12 bp, Homo sapiens
tttctaattgta

SEQ ID NO: 4664407 - DNA, 13 bp, Homo sapiens
tttctaattgtaa

SEQ ID NO: 4664408 - DNA, 16 bp, Homo sapiens
tttctactctagatgg

SEQ ID NO: 4664409 - DNA, 20 bp, Homo sapiens
tttctagtacacttttatga

SEQ ID NO: 4664410 - DNA, 21 bp, Homo sapiens
tttctatagccaactgctaat

SEQ ID NO: 4664411 - DNA, 20 bp, Homo sapiens
tttctattatggaaaactgt

SEQ ID NO: 4664412 - DNA, 18 bp, Homo sapiens
tttctcaaaacccttaaa

SEQ ID NO: 4664413 - DNA, 13 bp, Homo sapiens
tttctcaaatctt

SEQ ID NO: 4664414 - DNA, 12 bp, Homo sapiens
tttctcctcttt

SEQ ID NO: 4664415 - DNA, 11 bp, Homo sapiens
tttctcctggc

SEQ ID NO: 4664416 - DNA, 19 bp, Homo sapiens
tttctcctggcccctgcct

SEQ ID NO: 4664417 - DNA, 18 bp, Homo sapiens
tttctcttctaccctttt

SEQ ID NO: 4664418 - DNA, 22 bp, Homo sapiens
tttctgaatgtttgtgtctgtg

SEQ ID NO: 4664419 - DNA, 17 bp, Homo sapiens
tttctgagatgctcact

SEQ ID NO: 4664420 - DNA, 19 bp, Homo sapiens
tttctgctgtttacaacat

SEQ ID NO: 4664421 - DNA, 22 bp, Homo sapiens
tttctgctgtttacaacatcac

SEQ ID NO: 4664422 - DNA, 11 bp, Homo sapiens
tttctgggctc

SEQ ID NO: 4664423 - DNA, 14 bp, Homo sapiens
tttctgggctctgg

SEQ ID NO: 4664424 - DNA, 15 bp, Homo sapiens
tttctgggctctgga

SEQ ID NO: 4664425 - DNA, 17 bp, Homo sapiens
tttctgggctctggact

SEQ ID NO: 4664426 - DNA, 20 bp, Homo sapiens
tttctgggctctggactcca

SEQ ID NO: 4664427 - DNA, 13 bp, Homo sapiens
tttctgttccttt

SEQ ID NO: 4664428 - DNA, 16 bp, Homo sapiens
tttctgtttcctggcc

SEQ ID NO: 4664429 - DNA, 20 bp, Homo sapiens
tttcttagatggagaagttg

SEQ ID NO: 4664430 - DNA, 11 bp, Homo sapiens
tttctttatat

SEQ ID NO: 4664431 - DNA, 16 bp, Homo sapiens
tttctttcttagtcca

SEQ ID NO: 4664432 - DNA, 18 bp, Homo sapiens
aataatgggtttctttca

SEQ ID NO: 4664433 - DNA, 14 bp, Homo sapiens
aataattattatta

SEQ ID NO: 4664434 - DNA, 15 bp, Homo sapiens
aataattcatattct

SEQ ID NO: 4664435 - DNA, 21 bp, Homo sapiens
aataattgtatctacattaaa

SEQ ID NO: 4664436 - DNA, 22 bp, Homo sapiens
aataattgtatctacattaaaa

SEQ ID NO: 4664437 - DNA, 23 bp, Homo sapiens
aataattgtatctacattaaaat

SEQ ID NO: 4664438 - DNA, 12 bp, Homo sapiens
aatacaggaaat

SEQ ID NO: 4664439 - DNA, 12 bp, Homo sapiens
aatacatttgta

SEQ ID NO: 4664440 - DNA, 14 bp, Homo sapiens
aatacctctgtgtg

SEQ ID NO: 4664441 - DNA, 15 bp, Homo sapiens
aatacctttaaatat

SEQ ID NO: 4664442 - DNA, 18 bp, Homo sapiens
aatacctttaaatatcat

SEQ ID NO: 4664443 - DNA, 20 bp, Homo sapiens
aatacctttaaatatcattc

SEQ ID NO: 4664444 - DNA, 22 bp, Homo sapiens
aatacctttaaatatcattctt

SEQ ID NO: 4664445 - DNA, 14 bp, Homo sapiens
aatacgtattacaa

SEQ ID NO: 4664446 - DNA, 13 bp, Homo sapiens
aatactacccata

SEQ ID NO: 4664447 - DNA, 12 bp, Homo sapiens
aatacttatttt

SEQ ID NO: 4664448 - DNA, 15 bp, Homo sapiens
aatacttattttcag

SEQ ID NO: 4664449 - DNA, 21 bp, Homo sapiens
aatacttattttcagtgcatc

SEQ ID NO: 4664450 - DNA, 14 bp, Homo sapiens
aatacttttccaca

SEQ ID NO: 4664451 - DNA, 12 bp, Homo sapiens
aatagaaaaagt

SEQ ID NO: 4664452 - DNA, 19 bp, Homo sapiens
aatagagtacttaatatac

SEQ ID NO: 4664453 - DNA, 14 bp, Homo sapiens
aatagattaggttt

SEQ ID NO: 4664454 - DNA, 16 bp, Homo sapiens
aatagattaggtttgc

SEQ ID NO: 4664455 - DNA, 16 bp, Homo sapiens
aatagcatttttgtaa

SEQ ID NO: 4664456 - DNA, 16 bp, Homo sapiens
aatagctaataatgtt

SEQ ID NO: 4664457 - DNA, 15 bp, Homo sapiens
aataggggattttaa

SEQ ID NO: 4664458 - DNA, 21 bp, Homo sapiens
aatagtcaccttcatgattat

SEQ ID NO: 4664459 - DNA, 19 bp, Homo sapiens
aatagttattttaatacct

SEQ ID NO: 4664460 - DNA, 15 bp, Homo sapiens
aatataaattgtaca

SEQ ID NO: 4664461 - DNA, 17 bp, Homo sapiens
aatataaattgtacatt

SEQ ID NO: 4664462 - DNA, 20 bp, Homo sapiens
aatataagaaaagtaatgaa

SEQ ID NO: 4664463 - DNA, 20 bp, Homo sapiens
aatatacattttctaaataa

SEQ ID NO: 4664464 - DNA, 18 bp, Homo sapiens
aatatagacattctcaca

SEQ ID NO: 4664465 - DNA, 15 bp, Homo sapiens
aatatagcaaatgca

SEQ ID NO: 4664466 - DNA, 16 bp, Homo sapiens
aatatatatatatata

SEQ ID NO: 4664467 - DNA, 13 bp, Homo sapiens
aatatatattaag

SEQ ID NO: 4664468 - DNA, 16 bp, Homo sapiens
aatatatattaagtgt

SEQ ID NO: 4664469 - DNA, 14 bp, Homo sapiens
aatatatattatat

SEQ ID NO: 4664470 - DNA, 12 bp, Homo sapiens
aatatcaaataa

SEQ ID NO: 4664471 - DNA, 17 bp, Homo sapiens
aatatcaaataaaatat

SEQ ID NO: 4664472 - DNA, 19 bp, Homo sapiens
aatatcaaataaaattatt

SEQ ID NO: 4664473 - DNA, 13 bp, Homo sapiens
aatatcagacttt

SEQ ID NO: 4664474 - DNA, 15 bp, Homo sapiens
aatatcataaagcat

SEQ ID NO: 4664475 - DNA, 13 bp, Homo sapiens
aatatgaatctat

SEQ ID NO: 4664476 - DNA, 14 bp, Homo sapiens
aatatgacagataa

SEQ ID NO: 4664477 - DNA, 19 bp, Homo sapiens
aatatgacagataacctaa

SEQ ID NO: 4664478 - DNA, 19 bp, Homo sapiens
aatatgagtacaaatgcct

SEQ ID NO: 4664479 - DNA, 20 bp, Homo sapiens
aatatgcaaggcggtacact

SEQ ID NO: 4664480 - DNA, 14 bp, Homo sapiens
aatatggaaatctt

SEQ ID NO: 4664481 - DNA, 18 bp, Homo sapiens
aatatggtgtacattctt

SEQ ID NO: 4664482 - DNA, 15 bp, Homo sapiens
aatatgtaatttcaa

SEQ ID NO: 4664483 - DNA, 19 bp, Homo sapiens
aatatgtaatttcaaaata

SEQ ID NO: 4664484 - DNA, 23 bp, Homo sapiens
aatatgtaatttcaaaatacatt

SEQ ID NO: 4664485 - DNA, 19 bp, Homo sapiens
aatatgtgacattcctgat

SEQ ID NO: 4664486 - DNA, 14 bp, Homo sapiens
aatatgtgtttact

SEQ ID NO: 4664487 - DNA, 17 bp, Homo sapiens
aatgctgcaaacttaat

SEQ ID NO: 4664488 - DNA, 13 bp, Homo sapiens
aatgctgcactaa

SEQ ID NO: 4664489 - DNA, 18 bp, Homo sapiens
aatgctggtttttcagtt

SEQ ID NO: 4664490 - DNA, 12 bp, Homo sapiens
aatgctgtactt

SEQ ID NO: 4664491 - DNA, 13 bp, Homo sapiens
aatgctgtttcta

SEQ ID NO: 4664492 - DNA, 14 bp, Homo sapiens
aatgctgtttctaa

SEQ ID NO: 4664493 - DNA, 18 bp, Homo sapiens
aatgctgtttctaagaaa

SEQ ID NO: 4664494 - DNA, 20 bp, Homo sapiens
aatgctgtttctaagaaaat

SEQ ID NO: 4664495 - DNA, 24 bp, Homo sapiens
aatgctgtttctaagaaaatgtag

SEQ ID NO: 4664496 - DNA, 13 bp, Homo sapiens
aatgcttcattat

SEQ ID NO: 4664497 - DNA, 14 bp, Homo sapiens
aatgcttctatcag

SEQ ID NO: 4664498 - DNA, 23 bp, Homo sapiens
aatgcttctatcagactcagttt

SEQ ID NO: 4664499 - DNA, 17 bp, Homo sapiens
aatggacaaataagttt

SEQ ID NO: 4664500 - DNA, 14 bp, Homo sapiens
aatggaggagccag

SEQ ID NO: 4664501 - DNA, 19 bp, Homo sapiens
aatggaggtcccagccctg

SEQ ID NO: 4664502 - DNA, 20 bp, Homo sapiens
aatggaggtcccagccctgg

SEQ ID NO: 4664503 - DNA, 15 bp, Homo sapiens
aatggccaggggcca

SEQ ID NO: 4664504 - DNA, 24 bp, Homo sapiens
aatgggagacttgagtgataatag

SEQ ID NO: 4664505 - DNA, 21 bp, Homo sapiens
aatggggtagaaacattgtaa

SEQ ID NO: 4664506 - DNA, 12 bp, Homo sapiens
aatgtaaaatga

SEQ ID NO: 4664507 - DNA, 20 bp, Homo sapiens
aatgtaattaactgtaaact

SEQ ID NO: 4664508 - DNA, 18 bp, Homo sapiens
aatgtaatttaatgcctg

SEQ ID NO: 4664509 - DNA, 20 bp, Homo sapiens
aatgtaatttaatgcctgcc

SEQ ID NO: 4664510 - DNA, 22 bp, Homo sapiens
aatgtacccaccgggccactcc

SEQ ID NO: 4664511 - DNA, 12 bp, Homo sapiens
aatgtcaaggca

SEQ ID NO: 4664512 - DNA, 17 bp, Homo sapiens
aatgtctcatgtcaatg

SEQ ID NO: 4664513 - DNA, 11 bp, Homo sapiens
aatgtcttgtg

SEQ ID NO: 4664514 - DNA, 17 bp, Homo sapiens
aatgtcttgtgtatttc

SEQ ID NO: 4664515 - DNA, 24 bp, Homo sapiens
aatgtcttgtgtatttctctgtga

SEQ ID NO: 4664516 - DNA, 19 bp, Homo sapiens
aatgtgaactctcccctcc

SEQ ID NO: 4664517 - DNA, 20 bp, Homo sapiens
aatgtgaataatggcactga

SEQ ID NO: 4664518 - DNA, 15 bp, Homo sapiens
aatgtgagaagccag

SEQ ID NO: 4664519 - DNA, 21 bp, Homo sapiens
aatgtgagaagccagccagag

SEQ ID NO: 4664520 - DNA, 15 bp, Homo sapiens
aatgtgaggcaataa

SEQ ID NO: 4664521 - DNA, 16 bp, Homo sapiens
aatgtgaggcaataag

SEQ ID NO: 4664522 - DNA, 14 bp, Homo sapiens
aatgtgagtatttc

SEQ ID NO: 4664523 - DNA, 15 bp, Homo sapiens
aatgtgatcatatga

SEQ ID NO: 4664524 - DNA, 16 bp, Homo sapiens
aatgtgatcatatgag

SEQ ID NO: 4664525 - DNA, 23 bp, Homo sapiens
aatgtgatcctgccttgctgtga

SEQ ID NO: 4664526 - DNA, 16 bp, Homo sapiens
aatgtggcagctgtct

SEQ ID NO: 4664527 - DNA, 18 bp, Homo sapiens
aatgtggccaagcctatc

SEQ ID NO: 4664528 - DNA, 21 bp, Homo sapiens
aatgtgtaagaacaactacct

SEQ ID NO: 4664529 - DNA, 21 bp, Homo sapiens
aatgtgtggtggcctcagctg

SEQ ID NO: 4664530 - DNA, 17 bp, Homo sapiens
aatgttaactacatatt

SEQ ID NO: 4664531 - DNA, 16 bp, Homo sapiens
aatgttatgccagctc

SEQ ID NO: 4664532 - DNA, 23 bp, Homo sapiens
aatgttcatatttattgattaaa

SEQ ID NO: 4664533 - DNA, 14 bp, Homo sapiens
aatgttctcaaata

SEQ ID NO: 4664534 - DNA, 17 bp, Homo sapiens
aatgttgtacttgaaaa

SEQ ID NO: 4664535 - DNA, 12 bp, Homo sapiens
aatgtttccccc

SEQ ID NO: 4664536 - DNA, 17 bp, Homo sapiens
aatgtttcccccactcc

SEQ ID NO: 4664537 - DNA, 12 bp, Homo sapiens
aatgttttcatt

SEQ ID NO: 4664538 - DNA, 15 bp, Homo sapiens
aatgttttcattatg

SEQ ID NO: 4664539 - DNA, 19 bp, Homo sapiens
aatgttttcattatgttca

SEQ ID NO: 4664540 - DNA, 13 bp, Homo sapiens
aattaaaacaaat

SEQ ID NO: 4664541 - DNA, 16 bp, Homo sapiens
aattaaaacaaatata

SEQ ID NO: 4664542 - DNA, 14 bp, Homo sapiens
aattaaacattttt

SEQ ID NO: 4664543 - DNA, 17 bp, Homo sapiens
aattaaatctagacatt

SEQ ID NO: 4664544 - DNA, 11 bp, Homo sapiens
aattaaatgtg

SEQ ID NO: 4664545 - DNA, 21 bp, Homo sapiens
aattaacaaatttctttgttt

SEQ ID NO: 4664546 - DNA, 20 bp, Homo sapiens
tggatgaattttccagacct

SEQ ID NO: 4664547 - DNA, 18 bp, Homo sapiens
tggatgagaaacagctca

SEQ ID NO: 4664548 - DNA, 21 bp, Homo sapiens
tggatgagaaacagctcagcc

SEQ ID NO: 4664549 - DNA, 23 bp, Homo sapiens
tggatgctgtgctacgtgtgaaa

SEQ ID NO: 4664550 - DNA, 18 bp, Homo sapiens
tggatgggcaaagcttgt

SEQ ID NO: 4664551 - DNA, 15 bp, Homo sapiens
tggattaaatttaat

SEQ ID NO: 4664552 - DNA, 13 bp, Homo sapiens
tggattaggtctc

SEQ ID NO: 4664553 - DNA, 15 bp, Homo sapiens
tggattaggtctctg

SEQ ID NO: 4664554 - DNA, 17 bp, Homo sapiens
tggcaaaacagccctca

SEQ ID NO: 4664555 - DNA, 18 bp, Homo sapiens
tggcaaaactcaggcaga

SEQ ID NO: 4664556 - DNA, 21 bp, Homo sapiens
tggcaaacgagactttctcct

SEQ ID NO: 4664557 - DNA, 18 bp, Homo sapiens
tggcaagagggtgacagc

SEQ ID NO: 4664558 - DNA, 15 bp, Homo sapiens
tggcacagaagagga

SEQ ID NO: 4664559 - DNA, 23 bp, Homo sapiens
tggcacagaggtagtctcactgc

SEQ ID NO: 4664560 - DNA, 21 bp, Homo sapiens
tggcagagcagtctaaacaga

SEQ ID NO: 4664561 - DNA, 15 bp, Homo sapiens
tggcagatgtaggag

SEQ ID NO: 4664562 - DNA, 18 bp, Homo sapiens
tggcagatgtaggaggga

SEQ ID NO: 4664563 - DNA, 19 bp, Homo sapiens
tggcagcctcccatccagg

SEQ ID NO: 4664564 - DNA, 22 bp, Homo sapiens
tggcagcctcccatccagggcc

SEQ ID NO: 4664565 - DNA, 19 bp, Homo sapiens
tggcagggaccggcagagc

SEQ ID NO: 4664566 - DNA, 18 bp, Homo sapiens
tggcagggggccccgcca

SEQ ID NO: 4664567 - DNA, 23 bp, Homo sapiens
tggcagggggccccgccagggct

SEQ ID NO: 4664568 - DNA, 14 bp, Homo sapiens
tggcataattttta

SEQ ID NO: 4664569 - DNA, 14 bp, Homo sapiens
tggcatagacatgg

SEQ ID NO: 4664570 - DNA, 13 bp, Homo sapiens
tggcatcctgtga

SEQ ID NO: 4664571 - DNA, 15 bp, Homo sapiens
tggcatcctgtgaag

SEQ ID NO: 4664572 - DNA, 13 bp, Homo sapiens
tggcatctgcttt

SEQ ID NO: 4664573 - DNA, 17 bp, Homo sapiens
tggcatctgcttttaat

SEQ ID NO: 4664574 - DNA, 17 bp, Homo sapiens
tggcatcttcaatatga

SEQ ID NO: 4664575 - DNA, 13 bp, Homo sapiens
tggcatggtggct

SEQ ID NO: 4664576 - DNA, 17 bp, Homo sapiens
tggcatggtggctcccg

SEQ ID NO: 4664577 - DNA, 18 bp, Homo sapiens
tggcatttctctttaaac

SEQ ID NO: 4664578 - DNA, 17 bp, Homo sapiens
tggcatttttgcttcct

SEQ ID NO: 4664579 - DNA, 14 bp, Homo sapiens
tggccaaagtcact

SEQ ID NO: 4664580 - DNA, 19 bp, Homo sapiens
tggccaagctgaggtgccc

SEQ ID NO: 4664581 - DNA, 22 bp, Homo sapiens
tggccaagctgaggtgcccagg

SEQ ID NO: 4664582 - DNA, 14 bp, Homo sapiens
tggccaatgtgcat

SEQ ID NO: 4664583 - DNA, 15 bp, Homo sapiens
tggccacagccttcc

SEQ ID NO: 4664584 - DNA, 16 bp, Homo sapiens
tggccaccttttcagc

SEQ ID NO: 4664585 - DNA, 14 bp, Homo sapiens
tggccagactccct

SEQ ID NO: 4664586 - DNA, 16 bp, Homo sapiens
tggccagactcccttg

SEQ ID NO: 4664587 - DNA, 14 bp, Homo sapiens
tggccatcatcctc

SEQ ID NO: 4664588 - DNA, 22 bp, Homo sapiens
atgtgatcaggccccacccctg

SEQ ID NO: 4664589 - DNA, 21 bp, Homo sapiens
atgtgattaatgttttcatta

SEQ ID NO: 4664590 - DNA, 23 bp, Homo sapiens
atgtgattaatgttttcattatg

SEQ ID NO: 4664591 - DNA, 20 bp, Homo sapiens
atgtgattttaactctgtct

SEQ ID NO: 4664592 - DNA, 19 bp, Homo sapiens
atgtgcaaaatctgttata

SEQ ID NO: 4664593 - DNA, 19 bp, Homo sapiens
atgtgctacaggggccaga

SEQ ID NO: 4664594 - DNA, 21 bp, Homo sapiens
atgtgctacaggggccagaag

SEQ ID NO: 4664595 - DNA, 16 bp, Homo sapiens
atgtggaggaagagcc

SEQ ID NO: 4664596 - DNA, 21 bp, Homo sapiens
atgtggaggaagagccacctg

SEQ ID NO: 4664597 - DNA, 14 bp, Homo sapiens
atgtggccccaccc

SEQ ID NO: 4664598 - DNA, 21 bp, Homo sapiens
atgtggttacacagtgtgaat

SEQ ID NO: 4664599 - DNA, 14 bp, Homo sapiens
atgtgtagcctgtg

SEQ ID NO: 4664600 - DNA, 16 bp, Homo sapiens
atgtgtagcctgtgca

SEQ ID NO: 4664601 - DNA, 15 bp, Homo sapiens
atgtgtatacataca

SEQ ID NO: 4664602 - DNA, 20 bp, Homo sapiens
atgtgtatacatacatgtat

SEQ ID NO: 4664603 - DNA, 14 bp, Homo sapiens
atgtgtgcagagca

SEQ ID NO: 4664604 - DNA, 18 bp, Homo sapiens
atgtgtgcagagcagaca

SEQ ID NO: 4664605 - DNA, 20 bp, Homo sapiens
atgtgtgcagagcagacagg

SEQ ID NO: 4664606 - DNA, 18 bp, Homo sapiens
atgtgtgtgtgtggcagg

SEQ ID NO: 4664607 - DNA, 15 bp, Homo sapiens
atgtgtttactttaa

SEQ ID NO: 4664608 - DNA, 17 bp, Homo sapiens
atgttcaggaaatgaaa

SEQ ID NO: 4664609 - DNA, 18 bp, Homo sapiens
atgttcatatttattgat

SEQ ID NO: 4664610 - DNA, 20 bp, Homo sapiens
atgttcatatttattgatta

SEQ ID NO: 4664611 - DNA, 19 bp, Homo sapiens
atgttcctaacaaaatgag

SEQ ID NO: 4664612 - DNA, 18 bp, Homo sapiens
atgttcctaataagtgaa

SEQ ID NO: 4664613 - DNA, 23 bp, Homo sapiens
atgttcctccttttcttcaccct

SEQ ID NO: 4664614 - DNA, 15 bp, Homo sapiens
atgttctgtcttccc

SEQ ID NO: 4664615 - DNA, 12 bp, Homo sapiens
atgttgctcttt

SEQ ID NO: 4664616 - DNA, 18 bp, Homo sapiens
atgttgctctttcacctg

SEQ ID NO: 4664617 - DNA, 17 bp, Homo sapiens
atgttggccaggctggt

SEQ ID NO: 4664618 - DNA, 16 bp, Homo sapiens
atgttgtacttgaaaa

SEQ ID NO: 4664619 - DNA, 14 bp, Homo sapiens
atgttgtcaaggat

SEQ ID NO: 4664620 - DNA, 18 bp, Homo sapiens
atgttgtgcctccctggt

SEQ ID NO: 4664621 - DNA, 19 bp, Homo sapiens
atgtttaaaagaaatatat

SEQ ID NO: 4664622 - DNA, 13 bp, Homo sapiens
atgtttaatgtga

SEQ ID NO: 4664623 - DNA, 20 bp, Homo sapiens
atgtttataaatcttatgct

SEQ ID NO: 4664624 - DNA, 13 bp, Homo sapiens
atgtttatttcat

SEQ ID NO: 4664625 - DNA, 22 bp, Homo sapiens
atgtttatttcatgtggtgaat

SEQ ID NO: 4664626 - DNA, 15 bp, Homo sapiens
atgtttccctctcct

SEQ ID NO: 4664627 - DNA, 18 bp, Homo sapiens
atgtttgtgggtatttct

SEQ ID NO: 4664628 - DNA, 22 bp, Homo sapiens
atgtttgttttcaaaatacttc

SEQ ID NO: 4664629 - DNA, 12 bp, Homo sapiens
atgttttaaaga

SEQ ID NO: 4664630 - DNA, 15 bp, Homo sapiens
atgttttaacaaaaa

SEQ ID NO: 4664631 - DNA, 19 bp, Homo sapiens
atgttttcattatgttcat

SEQ ID NO: 4664632 - DNA, 14 bp, Homo sapiens
atgtttttaatgac

SEQ ID NO: 4664633 - DNA, 18 bp, Homo sapiens
attaaaaaagcatacttc

SEQ ID NO: 4664634 - DNA, 19 bp, Homo sapiens
attaaaaaagcatacttct

SEQ ID NO: 4664635 - DNA, 18 bp, Homo sapiens
attaaaacatatttcatt

SEQ ID NO: 4664636 - DNA, 14 bp, Homo sapiens
attaaaagaatgag

SEQ ID NO: 4664637 - DNA, 16 bp, Homo sapiens
attaaaatattttgga

SEQ ID NO: 4664638 - DNA, 19 bp, Homo sapiens
attaaaatgacaaacatga

SEQ ID NO: 4664639 - DNA, 21 bp, Homo sapiens
attaaaatgacaaacatgata

SEQ ID NO: 4664640 - DNA, 11 bp, Homo sapiens
attaaaccttt

SEQ ID NO: 4664641 - DNA, 18 bp, Homo sapiens
attaaacgtatgcatgtg

SEQ ID NO: 4664642 - DNA, 21 bp, Homo sapiens
attaaacgtatgcatgtgaag

SEQ ID NO: 4664643 - DNA, 12 bp, Homo sapiens
attaaactgaat

SEQ ID NO: 4664644 - DNA, 19 bp, Homo sapiens
attaaactgaatagttcag

SEQ ID NO: 4664645 - DNA, 16 bp, Homo sapiens
attaaaggcttctctc

SEQ ID NO: 4664646 - DNA, 20 bp, Homo sapiens
attaaaggcttctctctcac

SEQ ID NO: 4664647 - DNA, 15 bp, Homo sapiens
attaaatatttgaag

SEQ ID NO: 4664648 - DNA, 12 bp, Homo sapiens
attaaatttaat

SEQ ID NO: 4664649 - DNA, 20 bp, Homo sapiens
attaacattttgagctattt

SEQ ID NO: 4664650 - DNA, 18 bp, Homo sapiens
attaaccttttttgtctt

SEQ ID NO: 4664651 - DNA, 22 bp, Homo sapiens
attaaccttttttgtcttattg

SEQ ID NO: 4664652 - DNA, 17 bp, Homo sapiens
attaactccctccacca

SEQ ID NO: 4664653 - DNA, 19 bp, Homo sapiens
attaactccctccaccagc

SEQ ID NO: 4664654 - DNA, 21 bp, Homo sapiens
attaactccctccaccagcct

SEQ ID NO: 4664655 - DNA, 23 bp, Homo sapiens
attaactccctccaccagcctgc

SEQ ID NO: 4664656 - DNA, 12 bp, Homo sapiens
attaagcagaaa

SEQ ID NO: 4664657 - DNA, 21 bp, Homo sapiens
attaagcattttgaaacaaag

SEQ ID NO: 4664658 - DNA, 13 bp, Homo sapiens
attaagttgttaa

SEQ ID NO: 4664659 - DNA, 20 bp, Homo sapiens
attaagttgttaataaaagt

SEQ ID NO: 4664660 - DNA, 16 bp, Homo sapiens
attaatactacccata

SEQ ID NO: 4664661 - DNA, 11 bp, Homo sapiens
attaatattta

SEQ ID NO: 4664662 - DNA, 13 bp, Homo sapiens
attaatcaagaga

SEQ ID NO: 4664663 - DNA, 18 bp, Homo sapiens
attaatcaagagaaactt

SEQ ID NO: 4664664 - DNA, 22 bp, Homo sapiens
attaatcaagagaaacttcaaa

SEQ ID NO: 4664665 - DNA, 21 bp, Homo sapiens
attaatcatacaaactctcac

SEQ ID NO: 4664666 - DNA, 20 bp, Homo sapiens
attaatgacacttgtcccca

SEQ ID NO: 4664667 - DNA, 16 bp, Homo sapiens
attaatgttttcatta

SEQ ID NO: 4664668 - DNA, 20 bp, Homo sapiens
attaatgttttcattatgtt

SEQ ID NO: 4664669 - DNA, 19 bp, Homo sapiens
attaattgttttgcacttt

SEQ ID NO: 4664670 - DNA, 12 bp, Homo sapiens
attacaaacaag

SEQ ID NO: 4664671 - DNA, 16 bp, Homo sapiens
attacatgtaatttga

SEQ ID NO: 4664672 - DNA, 13 bp, Homo sapiens
attaccatcttaa

SEQ ID NO: 4664673 - DNA, 20 bp, Homo sapiens
attaccatcttaatctttat

SEQ ID NO: 4664674 - DNA, 20 bp, Homo sapiens
attaccgtcacactcttcag

SEQ ID NO: 4664675 - DNA, 21 bp, Homo sapiens
attacctcaggtgccaaccca

SEQ ID NO: 4664676 - DNA, 16 bp, Homo sapiens
attacctttaatttta

SEQ ID NO: 4664677 - DNA, 19 bp, Homo sapiens
attacctttaattttaatg

SEQ ID NO: 4664678 - DNA, 20 bp, Homo sapiens
attactaaggagtaatctgt

SEQ ID NO: 4664679 - DNA, 12 bp, Homo sapiens
attactgggcct

SEQ ID NO: 4664680 - DNA, 15 bp, Homo sapiens
attactgttccagat

SEQ ID NO: 4664681 - DNA, 14 bp, Homo sapiens
attactgtttctaa

SEQ ID NO: 4664682 - DNA, 14 bp, Homo sapiens
attacttgaatgta

SEQ ID NO: 4664683 - DNA, 17 bp, Homo sapiens
attacttgctttcaatt

SEQ ID NO: 4664684 - DNA, 23 bp, Homo sapiens
attacttgtaattatgaaaagaa

SEQ ID NO: 4664685 - DNA, 18 bp, Homo sapiens
attaggccagcaacgctt

SEQ ID NO: 4664686 - DNA, 11 bp, Homo sapiens
attaggctgtt

SEQ ID NO: 4664687 - DNA, 21 bp, Homo sapiens
attagtcgggcatgagtctgt

SEQ ID NO: 4664688 - DNA, 20 bp, Homo sapiens
attagtctattattttagag

SEQ ID NO: 4664689 - DNA, 18 bp, Homo sapiens
attataaaattaatcaca

SEQ ID NO: 4664690 - DNA, 21 bp, Homo sapiens
attataaagccaattatctga

SEQ ID NO: 4664691 - DNA, 21 bp, Homo sapiens
attatacagacctaatatcat

SEQ ID NO: 4664692 - DNA, 23 bp, Homo sapiens
attatacagacctaatatcattt

SEQ ID NO: 4664693 - DNA, 14 bp, Homo sapiens
attatagaaaatta

SEQ ID NO: 4664694 - DNA, 21 bp, Homo sapiens
attatagaaaattatttgtat

SEQ ID NO: 4664695 - DNA, 16 bp, Homo sapiens
attatagcaactaatg

SEQ ID NO: 4664696 - DNA, 13 bp, Homo sapiens
attatattatgtt

SEQ ID NO: 4664697 - DNA, 16 bp, Homo sapiens
attatattatgtttaa

SEQ ID NO: 4664698 - DNA, 18 bp, Homo sapiens
attgcagagtgaccagca

SEQ ID NO: 4664699 - DNA, 15 bp, Homo sapiens
attgcatgtgactct

SEQ ID NO: 4664700 - DNA, 13 bp, Homo sapiens
attgctcccagga

SEQ ID NO: 4664701 - DNA, 22 bp, Homo sapiens
attgctctgttcccagtagtta

SEQ ID NO: 4664702 - DNA, 16 bp, Homo sapiens
attgctggggccaggc

SEQ ID NO: 4664703 - DNA, 16 bp, Homo sapiens
attgcttgttggattt

SEQ ID NO: 4664704 - DNA, 13 bp, Homo sapiens
attgctttctgaa

SEQ ID NO: 4664705 - DNA, 16 bp, Homo sapiens
attgctttctgaaatt

SEQ ID NO: 4664706 - DNA, 17 bp, Homo sapiens
attgcttttttaaatat

SEQ ID NO: 4664707 - DNA, 14 bp, Homo sapiens
attggaaatgtact

SEQ ID NO: 4664708 - DNA, 15 bp, Homo sapiens
attggaaatgtactt

SEQ ID NO: 4664709 - DNA, 19 bp, Homo sapiens
attggaagctgctgaggcc

SEQ ID NO: 4664710 - DNA, 22 bp, Homo sapiens
attggaatgcagaggtctccaa

SEQ ID NO: 4664711 - DNA, 14 bp, Homo sapiens
attggacagaaaat

SEQ ID NO: 4664712 - DNA, 17 bp, Homo sapiens
attggcagtggcagaga

SEQ ID NO: 4664713 - DNA, 16 bp, Homo sapiens
attggcatctgctttt

SEQ ID NO: 4664714 - DNA, 19 bp, Homo sapiens
attgggcagcgcccttcct

SEQ ID NO: 4664715 - DNA, 22 bp, Homo sapiens
attgggcagcgcccttcctctc

SEQ ID NO: 4664716 - DNA, 18 bp, Homo sapiens
attgggtttttattgttg

SEQ ID NO: 4664717 - DNA, 21 bp, Homo sapiens
attggtgctatttgaagaaaa

SEQ ID NO: 4664718 - DNA, 16 bp, Homo sapiens
attggtgtactgtgtt

SEQ ID NO: 4664719 - DNA, 16 bp, Homo sapiens
attggttattaaactg

SEQ ID NO: 4664720 - DNA, 19 bp, Homo sapiens
attggttattaaactgaat

SEQ ID NO: 4664721 - DNA, 15 bp, Homo sapiens
attgtaactattaac

SEQ ID NO: 4664722 - DNA, 18 bp, Homo sapiens
attgtaatatgacagata

SEQ ID NO: 4664723 - DNA, 14 bp, Homo sapiens
attgtacagttttt

SEQ ID NO: 4664724 - DNA, 21 bp, Homo sapiens
attgtactgttcatacagttt

SEQ ID NO: 4664725 - DNA, 22 bp, Homo sapiens
attgtatctacattaaaatgac

SEQ ID NO: 4664726 - DNA, 18 bp, Homo sapiens
attgtcacctcagcactg

SEQ ID NO: 4664727 - DNA, 16 bp, Homo sapiens
attgtcataagtaaac

SEQ ID NO: 4664728 - DNA, 22 bp, Homo sapiens
attgtcgtataggcatgtaaac

SEQ ID NO: 4664729 - DNA, 18 bp, Homo sapiens
attgtctcctatatattt

SEQ ID NO: 4664730 - DNA, 16 bp, Homo sapiens
attgtgaactgacagg

SEQ ID NO: 4664731 - DNA, 21 bp, Homo sapiens
attgtgaccacaggctggtgt

SEQ ID NO: 4664732 - DNA, 17 bp, Homo sapiens
attgttaataataatta

SEQ ID NO: 4664733 - DNA, 16 bp, Homo sapiens
attgttagaaaatgac

SEQ ID NO: 4664734 - DNA, 13 bp, Homo sapiens
attgttcctcttt

SEQ ID NO: 4664735 - DNA, 17 bp, Homo sapiens
attgttggcacagaaca

SEQ ID NO: 4664736 - DNA, 21 bp, Homo sapiens
attgttggtgaattttcaagg

SEQ ID NO: 4664737 - DNA, 24 bp, Homo sapiens
attgttgttactttttcttgtatt

SEQ ID NO: 4664738 - DNA, 17 bp, Homo sapiens
attgtttctcaaatctt

SEQ ID NO: 4664739 - DNA, 12 bp, Homo sapiens
attgtttctgca

SEQ ID NO: 4664740 - DNA, 13 bp, Homo sapiens
attgtttgaaaca

SEQ ID NO: 4664741 - DNA, 18 bp, Homo sapiens
attgtttgaaacaaagaa

SEQ ID NO: 4664742 - DNA, 21 bp, Homo sapiens
attgttttctatttatgcctt

SEQ ID NO: 4664743 - DNA, 22 bp, Homo sapiens
attgttttggtctcaaaatggt

SEQ ID NO: 4664744 - DNA, 15 bp, Homo sapiens
attgtttttaaacct

SEQ ID NO: 4664745 - DNA, 19 bp, Homo sapiens
atttaaaaacttaaatatt

SEQ ID NO: 4664746 - DNA, 19 bp, Homo sapiens
atttaacccctccactgct

SEQ ID NO: 4664747 - DNA, 22 bp, Homo sapiens
atttaacttaagaaaatttaca

SEQ ID NO: 4664748 - DNA, 17 bp, Homo sapiens
atttaacttttagtaaa

SEQ ID NO: 4664749 - DNA, 23 bp, Homo sapiens
atttaacttttagtaaagtcaag

SEQ ID NO: 4664750 - DNA, 21 bp, Homo sapiens
atttaagcataatctgaaaac

SEQ ID NO: 4664751 - DNA, 20 bp, Homo sapiens
atttaagttcctgctgcctg

SEQ ID NO: 4664752 - DNA, 16 bp, Homo sapiens
atttaatgcctgccca

SEQ ID NO: 4664753 - DNA, 14 bp, Homo sapiens
atttacaaaattta

SEQ ID NO: 4664754 - DNA, 18 bp, Homo sapiens
atttactaccttatcact

SEQ ID NO: 4664755 - DNA, 16 bp, Homo sapiens
atttactctttgcaaa

SEQ ID NO: 4664756 - DNA, 16 bp, Homo sapiens
atttactttgtagact

SEQ ID NO: 4664757 - DNA, 14 bp, Homo sapiens
atttagagttctag

SEQ ID NO: 4664758 - DNA, 13 bp, Homo sapiens
atttagcttcttt

SEQ ID NO: 4664759 - DNA, 17 bp, Homo sapiens
atttataatactgtttt

SEQ ID NO: 4664760 - DNA, 16 bp, Homo sapiens
atttatagaatttaat

SEQ ID NO: 4664761 - DNA, 19 bp, Homo sapiens
atttatagcaagatattga

SEQ ID NO: 4664762 - DNA, 21 bp, Homo sapiens
atttatagcaagatattgatc

SEQ ID NO: 4664763 - DNA, 12 bp, Homo sapiens
atttatccacta

SEQ ID NO: 4664764 - DNA, 23 bp, Homo sapiens
atttatctcctcttcatggcatc

SEQ ID NO: 4664765 - DNA, 21 bp, Homo sapiens
atttatgccttgatgatttaa

SEQ ID NO: 4664766 - DNA, 16 bp, Homo sapiens
atttattaaaaatgtt

SEQ ID NO: 4664767 - DNA, 19 bp, Homo sapiens
atttattaaaaatgttctc

SEQ ID NO: 4664768 - DNA, 23 bp, Homo sapiens
atttattaaaaatgttctcaaat

SEQ ID NO: 4664769 - DNA, 13 bp, Homo sapiens
atttattcataga

SEQ ID NO: 4664770 - DNA, 19 bp, Homo sapiens
atttattgattaaaaatgt

SEQ ID NO: 4664771 - DNA, 18 bp, Homo sapiens
atttattgttagaaaatg

SEQ ID NO: 4664772 - DNA, 23 bp, Homo sapiens
atttattgttagaaaatgactta

SEQ ID NO: 4664773 - DNA, 20 bp, Homo sapiens
atttatttccactaaaaata

SEQ ID NO: 4664774 - DNA, 23 bp, Homo sapiens
atttattttcttttgaattgttt

SEQ ID NO: 4664775 - DNA, 16 bp, Homo sapiens
atttattttttaagaa

SEQ ID NO: 4664776 - DNA, 19 bp, Homo sapiens
atttcaaaatacatttgta

SEQ ID NO: 4664777 - DNA, 22 bp, Homo sapiens
atttcaaaatacatttgtaagt

SEQ ID NO: 4664778 - DNA, 14 bp, Homo sapiens
atttcaaaatttaa

SEQ ID NO: 4664779 - DNA, 17 bp, Homo sapiens
atttcacacagtgaaac

SEQ ID NO: 4664780 - DNA, 14 bp, Homo sapiens
atttcacaggctaa

SEQ ID NO: 4664781 - DNA, 21 bp, Homo sapiens
atttcaccactcaaaggccag

SEQ ID NO: 4664782 - DNA, 12 bp, Homo sapiens
atttcaggaaaa

SEQ ID NO: 4664783 - DNA, 22 bp, Homo sapiens
atttcaggaaaatgtattgatt

SEQ ID NO: 4664784 - DNA, 23 bp, Homo sapiens
atttcaggtgtgaaagaatcagt

SEQ ID NO: 4664785 - DNA, 18 bp, Homo sapiens
atttcatgaaaaagctgc

SEQ ID NO: 4664786 - DNA, 18 bp, Homo sapiens
atttcatgaacgttatta

SEQ ID NO: 4664787 - DNA, 13 bp, Homo sapiens
atttcattgcact

SEQ ID NO: 4664788 - DNA, 14 bp, Homo sapiens
atttccactatttt

SEQ ID NO: 4664789 - DNA, 18 bp, Homo sapiens
atttccactattttcaaa

SEQ ID NO: 4664790 - DNA, 24 bp, Homo sapiens
atttccatttggggatattgtcat

SEQ ID NO: 4664791 - DNA, 17 bp, Homo sapiens
atttccttccagccttt

SEQ ID NO: 4664792 - DNA, 19 bp, Homo sapiens
atttccttccagccttttt

SEQ ID NO: 4664793 - DNA, 12 bp, Homo sapiens
atttctaattgt

SEQ ID NO: 4664794 - DNA, 15 bp, Homo sapiens
atttctatgacaaat

SEQ ID NO: 4664795 - DNA, 16 bp, Homo sapiens
atttctatgacaaatt

SEQ ID NO: 4664796 - DNA, 16 bp, Homo sapiens
atttctcagactttgg

SEQ ID NO: 4664797 - DNA, 18 bp, Homo sapiens
atttctcagactttggaa

SEQ ID NO: 4664798 - DNA, 14 bp, Homo sapiens
atttctcatcacag

SEQ ID NO: 4664799 - DNA, 12 bp, Homo sapiens
atttctctgtga

SEQ ID NO: 4664800 - DNA, 15 bp, Homo sapiens
atttctctgtgaatc

SEQ ID NO: 4664801 - DNA, 18 bp, Homo sapiens
atttctcttctacccttt

SEQ ID NO: 4664802 - DNA, 13 bp, Homo sapiens
atttctgcctccc

SEQ ID NO: 4664803 - DNA, 13 bp, Homo sapiens
atttctgctctgg

SEQ ID NO: 4664804 - DNA, 18 bp, Homo sapiens
atttctgttcctttttgt

SEQ ID NO: 4664805 - DNA, 17 bp, Homo sapiens
atttcttcgtgaacata

SEQ ID NO: 4664806 - DNA, 15 bp, Homo sapiens
atttcttggcatgca

SEQ ID NO: 4664807 - DNA, 20 bp, Homo sapiens
atttctttaaaagaatgact

SEQ ID NO: 4664808 - DNA, 21 bp, Homo sapiens
caaaactgttcttttgcattt

SEQ ID NO: 4664809 - DNA, 19 bp, Homo sapiens
caaaacttcttgtcagaca

SEQ ID NO: 4664810 - DNA, 12 bp, Homo sapiens
caaaacttgaaa

SEQ ID NO: 4664811 - DNA, 22 bp, Homo sapiens
caaaagaaataatccctgtaat

SEQ ID NO: 4664812 - DNA, 21 bp, Homo sapiens
caaaagaaatttaagttctat

SEQ ID NO: 4664813 - DNA, 16 bp, Homo sapiens
caaaagaaggtcaaac

SEQ ID NO: 4664814 - DNA, 16 bp, Homo sapiens
caaaagattaatcttt

SEQ ID NO: 4664815 - DNA, 19 bp, Homo sapiens
caaaagattaatctttaaa

SEQ ID NO: 4664816 - DNA, 16 bp, Homo sapiens
caaaagtcacccaggg

SEQ ID NO: 4664817 - DNA, 16 bp, Homo sapiens
caaaagtctgtctttc

SEQ ID NO: 4664818 - DNA, 16 bp, Homo sapiens
caaaagtggcctcttt

SEQ ID NO: 4664819 - DNA, 16 bp, Homo sapiens
caaaatggacatggtg

SEQ ID NO: 4664820 - DNA, 12 bp, Homo sapiens
caaaatgtcttg

SEQ ID NO: 4664821 - DNA, 19 bp, Homo sapiens
caaaattcatttctaatta

SEQ ID NO: 4664822 - DNA, 13 bp, Homo sapiens
caaaatttattct

SEQ ID NO: 4664823 - DNA, 13 bp, Homo sapiens
caaaatttgacta

SEQ ID NO: 4664824 - DNA, 14 bp, Homo sapiens
caaaatttgactaa

SEQ ID NO: 4664825 - DNA, 23 bp, Homo sapiens
caaaatttgactaattttacatg

SEQ ID NO: 4664826 - DNA, 17 bp, Homo sapiens
caaacaagccccctgcc

SEQ ID NO: 4664827 - DNA, 18 bp, Homo sapiens
caaacaagccccctgccc

SEQ ID NO: 4664828 - DNA, 23 bp, Homo sapiens
caaacaagtggatgtttttaatg

SEQ ID NO: 4664829 - DNA, 16 bp, Homo sapiens
caaacagaacagggtc

SEQ ID NO: 4664830 - DNA, 22 bp, Homo sapiens
caaacattcgtgagctggggac

SEQ ID NO: 4664831 - DNA, 14 bp, Homo sapiens
caaaccacagcagg

SEQ ID NO: 4664832 - DNA, 15 bp, Homo sapiens
caaaccacagcagga

SEQ ID NO: 4664833 - DNA, 23 bp, Homo sapiens
caaaccacttctccatgctgcaa

SEQ ID NO: 4664834 - DNA, 14 bp, Homo sapiens
caaaccaggaccct

SEQ ID NO: 4664835 - DNA, 21 bp, Homo sapiens
caaaccaggggacactttgtt

SEQ ID NO: 4664836 - DNA, 22 bp, Homo sapiens
caaaccaggggacactttgtta

SEQ ID NO: 4664837 - DNA, 20 bp, Homo sapiens
caaaccattataccttactt

SEQ ID NO: 4664838 - DNA, 20 bp, Homo sapiens
caaacccagtctcctctcca

SEQ ID NO: 4664839 - DNA, 22 bp, Homo sapiens
caaacccagtctcctctccatt

SEQ ID NO: 4664840 - DNA, 12 bp, Homo sapiens
caaaccttcaca

SEQ ID NO: 4664841 - DNA, 16 bp, Homo sapiens
caaacctttgtttcaa

SEQ ID NO: 4664842 - DNA, 18 bp, Homo sapiens
caaactatgatttatttt

SEQ ID NO: 4664843 - DNA, 16 bp, Homo sapiens
caaactcctgacctca

SEQ ID NO: 4664844 - DNA, 12 bp, Homo sapiens
caaactctgctg

SEQ ID NO: 4664845 - DNA, 13 bp, Homo sapiens
caaactctgctgt

SEQ ID NO: 4664846 - DNA, 18 bp, Homo sapiens
caaactctgctgtctaac

SEQ ID NO: 4664847 - DNA, 16 bp, Homo sapiens
caaactgcctcaatcc

SEQ ID NO: 4664848 - DNA, 12 bp, Homo sapiens
caaactgttctg

SEQ ID NO: 4664849 - DNA, 20 bp, Homo sapiens
caaactgttctgagaaggtg

SEQ ID NO: 4664850 - DNA, 13 bp, Homo sapiens
caaacttgttcat

SEQ ID NO: 4664851 - DNA, 14 bp, Homo sapiens
caaacttgttcatt

SEQ ID NO: 4664852 - DNA, 17 bp, Homo sapiens
caaacttgttcatttag

SEQ ID NO: 4664853 - DNA, 14 bp, Homo sapiens
caaagagatattga

SEQ ID NO: 4664854 - DNA, 14 bp, Homo sapiens
caaagagcacttga

SEQ ID NO: 4664855 - DNA, 16 bp, Homo sapiens
caaagagcacttgagc

SEQ ID NO: 4664856 - DNA, 15 bp, Homo sapiens
caaagcagacagctc

SEQ ID NO: 4664857 - DNA, 17 bp, Homo sapiens
caaagcagacagctcca

SEQ ID NO: 4664858 - DNA, 19 bp, Homo sapiens
caaagcagacagctccacc

SEQ ID NO: 4664859 - DNA, 23 bp, Homo sapiens
caaagcagagatcgacagacagc

SEQ ID NO: 4664860 - DNA, 23 bp, Homo sapiens
caaagccagggtctctccctcag

SEQ ID NO: 4664861 - DNA, 15 bp, Homo sapiens
caaagcctgaggaca

SEQ ID NO: 4664862 - DNA, 18 bp, Homo sapiens
caaagcttgtcaaagatg

SEQ ID NO: 4664863 - DNA, 23 bp, Homo sapiens
caaagctttcctgtttccagggt

SEQ ID NO: 4664864 - DNA, 22 bp, Homo sapiens
caaaggaatataagaaaagtaa

SEQ ID NO: 4664865 - DNA, 21 bp, Homo sapiens
caaaggaatttgcatccagca

SEQ ID NO: 4664866 - DNA, 15 bp, Homo sapiens
caaaggagcctgtga

SEQ ID NO: 4664867 - DNA, 23 bp, Homo sapiens
caaaggagcctgtgaacccagga

SEQ ID NO: 4664868 - DNA, 19 bp, Homo sapiens
caaaggccagacctgcaga

SEQ ID NO: 4664869 - DNA, 20 bp, Homo sapiens
caaaggccagacctgcagac

SEQ ID NO: 4664870 - DNA, 22 bp, Homo sapiens
caaaggccagacctgcagacgc

SEQ ID NO: 4664871 - DNA, 20 bp, Homo sapiens
caaaggctcagcttggattt

SEQ ID NO: 4664872 - DNA, 22 bp, Homo sapiens
caaagggatggtattgagaaga

SEQ ID NO: 4664873 - DNA, 22 bp, Homo sapiens
caaagggggaggctaaagccca

SEQ ID NO: 4664874 - DNA, 19 bp, Homo sapiens
caaagggtgaagctattta

SEQ ID NO: 4664875 - DNA, 19 bp, Homo sapiens
caaagtaaagcagaggatg

SEQ ID NO: 4664876 - DNA, 22 bp, Homo sapiens
caaagtaacctgggcttaagtt

SEQ ID NO: 4664877 - DNA, 14 bp, Homo sapiens
caaagtataatctt

SEQ ID NO: 4664878 - DNA, 16 bp, Homo sapiens
caaagtcacttcccca

SEQ ID NO: 4664879 - DNA, 17 bp, Homo sapiens
caaagtggcagggaccg

SEQ ID NO: 4664880 - DNA, 19 bp, Homo sapiens
caaagtggtatagaaatgc

SEQ ID NO: 4664881 - DNA, 12 bp, Homo sapiens
caaagttgctca

SEQ ID NO: 4664882 - DNA, 15 bp, Homo sapiens
caaataaaattattt

SEQ ID NO: 4664883 - DNA, 14 bp, Homo sapiens
caaataagtaatat

SEQ ID NO: 4664884 - DNA, 15 bp, Homo sapiens
caaataagtttttgc

SEQ ID NO: 4664885 - DNA, 14 bp, Homo sapiens
caaatacaatcagc

SEQ ID NO: 4664886 - DNA, 23 bp, Homo sapiens
caaatatacattttctaaataaa

SEQ ID NO: 4664887 - DNA, 14 bp, Homo sapiens
caaatatagaaagt

SEQ ID NO: 4664888 - DNA, 17 bp, Homo sapiens
caaatcccgcagcctcg

SEQ ID NO: 4664889 - DNA, 19 bp, Homo sapiens
caaatcccttttatctatt

SEQ ID NO: 4664890 - DNA, 17 bp, Homo sapiens
caaatcctatgtgattt

SEQ ID NO: 4664891 - DNA, 18 bp, Homo sapiens
caaatcctatgtgatttt

SEQ ID NO: 4664892 - DNA, 22 bp, Homo sapiens
caaatcctatgtgattttaact

SEQ ID NO: 4664893 - DNA, 14 bp, Homo sapiens
caaatccttcaaaa

SEQ ID NO: 4664894 - DNA, 16 bp, Homo sapiens
caaatcgtttatttca

SEQ ID NO: 4664895 - DNA, 14 bp, Homo sapiens
caaatctaccactg

SEQ ID NO: 4664896 - DNA, 12 bp, Homo sapiens
caaatgaagaaa

SEQ ID NO: 4664897 - DNA, 18 bp, Homo sapiens
caaatgccttaaaatgga

SEQ ID NO: 4664898 - DNA, 22 bp, Homo sapiens
caaatgctctctcaaattgtca

SEQ ID NO: 4664899 - DNA, 20 bp, Homo sapiens
caaatggactgttacagact

SEQ ID NO: 4664900 - DNA, 15 bp, Homo sapiens
caaatggttcttact

SEQ ID NO: 4664901 - DNA, 19 bp, Homo sapiens
caaatggttcttacttttc

SEQ ID NO: 4664902 - DNA, 15 bp, Homo sapiens
caaatgtaatagttt

SEQ ID NO: 4664903 - DNA, 18 bp, Homo sapiens
caaatgtcttaaagggaa

SEQ ID NO: 4664904 - DNA, 20 bp, Homo sapiens
caaatgtggccaagcctatc

SEQ ID NO: 4664905 - DNA, 22 bp, Homo sapiens
caaattaaaacaaatatacatt

SEQ ID NO: 4664906 - DNA, 13 bp, Homo sapiens
caaattaaaacat

SEQ ID NO: 4664907 - DNA, 14 bp, Homo sapiens
caaattcattttta

SEQ ID NO: 4664908 - DNA, 20 bp, Homo sapiens
caaattgactcttatttata

SEQ ID NO: 4664909 - DNA, 21 bp, Homo sapiens
caaattgactcttatttatag

SEQ ID NO: 4664910 - DNA, 16 bp, Homo sapiens
caaattgtcgttttta

SEQ ID NO: 4664911 - DNA, 15 bp, Homo sapiens
caaatttcacttata

SEQ ID NO: 4664912 - DNA, 14 bp, Homo sapiens
caaatttcattgca

SEQ ID NO: 4664913 - DNA, 16 bp, Homo sapiens
caaatttcattgcact

SEQ ID NO: 4664914 - DNA, 16 bp, Homo sapiens
caacaaatttcattgc

SEQ ID NO: 4664915 - DNA, 17 bp, Homo sapiens
caacaaatttcattgca

SEQ ID NO: 4664916 - DNA, 19 bp, Homo sapiens
caacaaatttcattgcact

SEQ ID NO: 4664917 - DNA, 20 bp, Homo sapiens
caacaaatttcattgcactt

SEQ ID NO: 4664918 - DNA, 21 bp, Homo sapiens
caaggaggaggagtcagatga

SEQ ID NO: 4664919 - DNA, 22 bp, Homo sapiens
caaggcagaagcttggaggagg

SEQ ID NO: 4664920 - DNA, 23 bp, Homo sapiens
caaggcagaagcttggaggaggg

SEQ ID NO: 4664921 - DNA, 14 bp, Homo sapiens
caaggcagcaaggc

SEQ ID NO: 4664922 - DNA, 17 bp, Homo sapiens
caaggcagcaaggcccg

SEQ ID NO: 4664923 - DNA, 14 bp, Homo sapiens
caaggcccgagcag

SEQ ID NO: 4664924 - DNA, 17 bp, Homo sapiens
caaggcccgagcagctg

SEQ ID NO: 4664925 - DNA, 19 bp, Homo sapiens
caaggcccgagcagctgag

SEQ ID NO: 4664926 - DNA, 14 bp, Homo sapiens
caaggccctgcatc

SEQ ID NO: 4664927 - DNA, 21 bp, Homo sapiens
caaggccctgcatctgtctgc

SEQ ID NO: 4664928 - DNA, 22 bp, Homo sapiens
caaggccctgcatctgtctgct

SEQ ID NO: 4664929 - DNA, 16 bp, Homo sapiens
caaggccctgtctctg

SEQ ID NO: 4664930 - DNA, 17 bp, Homo sapiens
caaggccctgtctctgg

SEQ ID NO: 4664931 - DNA, 18 bp, Homo sapiens
caaggccctgtctctggc

SEQ ID NO: 4664932 - DNA, 21 bp, Homo sapiens
caaggccctgtctctggctac

SEQ ID NO: 4664933 - DNA, 15 bp, Homo sapiens
caaggcggtacacta

SEQ ID NO: 4664934 - DNA, 16 bp, Homo sapiens
caagggcgcaagagta

SEQ ID NO: 4664935 - DNA, 19 bp, Homo sapiens
caaggtaggctgcaaaatt

SEQ ID NO: 4664936 - DNA, 20 bp, Homo sapiens
caaggtaggctgcaaaatta

SEQ ID NO: 4664937 - DNA, 9 bp, Homo sapiens
caaggtcag

SEQ ID NO: 4664938 - DNA, 21 bp, Homo sapiens
caaggtcctctgtcagtcaca

SEQ ID NO: 4664939 - DNA, 22 bp, Homo sapiens
caaggtcctctgtcagtcacag

SEQ ID NO: 4664940 - DNA, 21 bp, Homo sapiens
caaggtgccaccaccctgccc

SEQ ID NO: 4664941 - DNA, 14 bp, Homo sapiens
caaggtggagggaa

SEQ ID NO: 4664942 - DNA, 16 bp, Homo sapiens
caaggtggagggaagg

SEQ ID NO: 4664943 - DNA, 15 bp, Homo sapiens
caaggtgtgatggtc

SEQ ID NO: 4664944 - DNA, 19 bp, Homo sapiens
caagtaatggaggtcccag

SEQ ID NO: 4664945 - DNA, 11 bp, Homo sapiens
caagtattttg

SEQ ID NO: 4664946 - DNA, 16 bp, Homo sapiens
caagtccaggtcctgg

SEQ ID NO: 4664947 - DNA, 19 bp, Homo sapiens
caagtcctatcctaaataa

SEQ ID NO: 4664948 - DNA, 14 bp, Homo sapiens
caagtctttctcct

SEQ ID NO: 4664949 - DNA, 18 bp, Homo sapiens
caagtctttctcctcttt

SEQ ID NO: 4664950 - DNA, 22 bp, Homo sapiens
caagtgaaataacaaaatggac

SEQ ID NO: 4664951 - DNA, 19 bp, Homo sapiens
caagtgaggtgacactcca

SEQ ID NO: 4664952 - DNA, 15 bp, Homo sapiens
caagtgccaaatgct

SEQ ID NO: 4664953 - DNA, 13 bp, Homo sapiens
caagtgcctggga

SEQ ID NO: 4664954 - DNA, 17 bp, Homo sapiens
caagtggatgtttttaa

SEQ ID NO: 4664955 - DNA, 20 bp, Homo sapiens
caagtggatgtttttaatga

SEQ ID NO: 4664956 - DNA, 13 bp, Homo sapiens
caagtgtcacctc

SEQ ID NO: 4664957 - DNA, 21 bp, Homo sapiens
caagtgtcacctccttcccca

SEQ ID NO: 4664958 - DNA, 18 bp, Homo sapiens
caagttgtgcttgagcca

SEQ ID NO: 4664959 - DNA, 21 bp, Homo sapiens
caagttttttaattaagcaga

SEQ ID NO: 4664960 - DNA, 19 bp, Homo sapiens
caataaaattttttttcat

SEQ ID NO: 4664961 - DNA, 22 bp, Homo sapiens
caataaaattttttttcatgtt

SEQ ID NO: 4664962 - DNA, 18 bp, Homo sapiens
caataaagttgttgcatt

SEQ ID NO: 4664963 - DNA, 20 bp, Homo sapiens
caataaagttgttgcattcc

SEQ ID NO: 4664964 - DNA, 16 bp, Homo sapiens
caataaatgtctgttg

SEQ ID NO: 4664965 - DNA, 13 bp, Homo sapiens
caataacccagtt

SEQ ID NO: 4664966 - DNA, 15 bp, Homo sapiens
caataacccagttac

SEQ ID NO: 4664967 - DNA, 14 bp, Homo sapiens
caataactgaaaat

SEQ ID NO: 4664968 - DNA, 22 bp, Homo sapiens
caataagcgttaagggcagagt

SEQ ID NO: 4664969 - DNA, 12 bp, Homo sapiens
caataatcagaa

SEQ ID NO: 4664970 - DNA, 13 bp, Homo sapiens
caataatcagaaa

SEQ ID NO: 4664971 - DNA, 18 bp, Homo sapiens
caataatcagaaaagtaa

SEQ ID NO: 4664972 - DNA, 22 bp, Homo sapiens
caataatcagaaaagtaatttt

SEQ ID NO: 4664973 - DNA, 16 bp, Homo sapiens
caatacattaaaataa

SEQ ID NO: 4664974 - DNA, 22 bp, Homo sapiens
caatagagggccacggggaggc

SEQ ID NO: 4664975 - DNA, 18 bp, Homo sapiens
caatagctagctatatat

SEQ ID NO: 4664976 - DNA, 22 bp, Homo sapiens
caatagctagctatatatggta

SEQ ID NO: 4664977 - DNA, 18 bp, Homo sapiens
caatattaccatcttaat

SEQ ID NO: 4664978 - DNA, 20 bp, Homo sapiens
caatattaccatcttaatct

SEQ ID NO: 4664979 - DNA, 14 bp, Homo sapiens
caatattgtacagt

SEQ ID NO: 4664980 - DNA, 16 bp, Homo sapiens
caatattgtacagttt

SEQ ID NO: 4664981 - DNA, 17 bp, Homo sapiens
caatattgtacagtttt

SEQ ID NO: 4664982 - DNA, 18 bp, Homo sapiens
caatattgtacagttttt

SEQ ID NO: 4664983 - DNA, 14 bp, Homo sapiens
caatattttgtata

SEQ ID NO: 4664984 - DNA, 22 bp, Homo sapiens
caatattttgtatattatgttt

SEQ ID NO: 4664985 - DNA, 20 bp, Homo sapiens
caatatttttatatcatgca

SEQ ID NO: 4664986 - DNA, 23 bp, Homo sapiens
caatatttttatatcatgcaaaa

SEQ ID NO: 4664987 - DNA, 17 bp, Homo sapiens
caatcactaaactttat

SEQ ID NO: 4664988 - DNA, 17 bp, Homo sapiens
caatcatcaaaaagtaa

SEQ ID NO: 4664989 - DNA, 12 bp, Homo sapiens
caatcattttat

SEQ ID NO: 4664990 - DNA, 13 bp, Homo sapiens
caatcattttatg

SEQ ID NO: 4664991 - DNA, 19 bp, Homo sapiens
caatccatgtgattaatgt

SEQ ID NO: 4664992 - DNA, 14 bp, Homo sapiens
caatcctccccgct

SEQ ID NO: 4664993 - DNA, 15 bp, Homo sapiens
caatcctccccgctc

SEQ ID NO: 4664994 - DNA, 13 bp, Homo sapiens
caatcgcaaatca

SEQ ID NO: 4664995 - DNA, 15 bp, Homo sapiens
caatcgcaaatcaaa

SEQ ID NO: 4664996 - DNA, 16 bp, Homo sapiens
caatcggactgccaaa

SEQ ID NO: 4664997 - DNA, 20 bp, Homo sapiens
caatctatggcttatttcta

SEQ ID NO: 4664998 - DNA, 23 bp, Homo sapiens
caatctattatttctctaattat

SEQ ID NO: 4664999 - DNA, 15 bp, Homo sapiens
caatctctgcctccc

SEQ ID NO: 4665000 - DNA, 20 bp, Homo sapiens
caatctctgcctcccgggtt

SEQ ID NO: 4665001 - DNA, 19 bp, Homo sapiens
caatgatttggccaggcct

SEQ ID NO: 4665002 - DNA, 12 bp, Homo sapiens
caatgcaacatt

SEQ ID NO: 4665003 - DNA, 15 bp, Homo sapiens
caatgccacagacaa

SEQ ID NO: 4665004 - DNA, 21 bp, Homo sapiens
caatgctagcacaatattcct

SEQ ID NO: 4665005 - DNA, 21 bp, Homo sapiens
caatgcttctatcagactcag

SEQ ID NO: 4665006 - DNA, 23 bp, Homo sapiens
caatgggaagcagacaataactt

SEQ ID NO: 4665007 - DNA, 23 bp, Homo sapiens
caatgggagctgaggccacactc

SEQ ID NO: 4665008 - DNA, 14 bp, Homo sapiens
caatggtgcttgga

SEQ ID NO: 4665009 - DNA, 19 bp, Homo sapiens
caatggtgcttggaggggg

SEQ ID NO: 4665010 - DNA, 17 bp, Homo sapiens
caatgtacccaccgggc

SEQ ID NO: 4665011 - DNA, 22 bp, Homo sapiens
caatgtacccaccgggccactc

SEQ ID NO: 4665012 - DNA, 21 bp, Homo sapiens
caatgtactaggatactgctg

SEQ ID NO: 4665013 - DNA, 11 bp, Homo sapiens
caatgtgaata

SEQ ID NO: 4665014 - DNA, 17 bp, Homo sapiens
caatgtgaataatggca

SEQ ID NO: 4665015 - DNA, 18 bp, Homo sapiens
caatgtggaaaaaatatt

SEQ ID NO: 4665016 - DNA, 20 bp, Homo sapiens
caatgtggaaaaaatatttt

SEQ ID NO: 4665017 - DNA, 16 bp, Homo sapiens
caatgttatgccagct

SEQ ID NO: 4665018 - DNA, 18 bp, Homo sapiens
caatgttctttgtctcaa

SEQ ID NO: 4665019 - DNA, 19 bp, Homo sapiens
caattagcctcatagttat

SEQ ID NO: 4665020 - DNA, 18 bp, Homo sapiens
caattagtggtcataaaa

SEQ ID NO: 4665021 - DNA, 21 bp, Homo sapiens
caattagtggtcataaaatag

SEQ ID NO: 4665022 - DNA, 22 bp, Homo sapiens
caattagtgtgacagtttccaa

SEQ ID NO: 4665023 - DNA, 17 bp, Homo sapiens
caattcacccactccct

SEQ ID NO: 4665024 - DNA, 13 bp, Homo sapiens
caattcagacagg

SEQ ID NO: 4665025 - DNA, 16 bp, Homo sapiens
caattccaccagggcc

SEQ ID NO: 4665026 - DNA, 17 bp, Homo sapiens
caattccaccagggcca

SEQ ID NO: 4665027 - DNA, 18 bp, Homo sapiens
aaaacttcttgtcagaca

SEQ ID NO: 4665028 - DNA, 14 bp, Homo sapiens
aaaacttgaaagaa

SEQ ID NO: 4665029 - DNA, 13 bp, Homo sapiens
aaaagaaagttaa

SEQ ID NO: 4665030 - DNA, 14 bp, Homo sapiens
aaaagaaatatatt

SEQ ID NO: 4665031 - DNA, 23 bp, Homo sapiens
aaaagaaatatattttttgttat

SEQ ID NO: 4665032 - DNA, 19 bp, Homo sapiens
aaaagaaattcgcatgttt

SEQ ID NO: 4665033 - DNA, 10 bp, Homo sapiens
aaaagaatga

SEQ ID NO: 4665034 - DNA, 13 bp, Homo sapiens
aaaagacattttt

SEQ ID NO: 4665035 - DNA, 16 bp, Homo sapiens
aaaagcacaatcacta

SEQ ID NO: 4665036 - DNA, 20 bp, Homo sapiens
aaaagcacaatcactaaact

SEQ ID NO: 4665037 - DNA, 22 bp, Homo sapiens
aaaagcacaatcactaaacttt

SEQ ID NO: 4665038 - DNA, 20 bp, Homo sapiens
aaaagctatggtgagatgca

SEQ ID NO: 4665039 - DNA, 18 bp, Homo sapiens
aaaaggaagccaaagagt

SEQ ID NO: 4665040 - DNA, 23 bp, Homo sapiens
aaaaggccaaacctctgttcagt

SEQ ID NO: 4665041 - DNA, 18 bp, Homo sapiens
aaaagggaactgaacatt

SEQ ID NO: 4665042 - DNA, 14 bp, Homo sapiens
aaaagtaatgaaga

SEQ ID NO: 4665043 - DNA, 22 bp, Homo sapiens
aaaagtaatgacttagaaactg

SEQ ID NO: 4665044 - DNA, 13 bp, Homo sapiens
aaaagtaatgtaa

SEQ ID NO: 4665045 - DNA, 23 bp, Homo sapiens
aaaagtaattttgtcacattatt

SEQ ID NO: 4665046 - DNA, 13 bp, Homo sapiens
aaaagtattatca

SEQ ID NO: 4665047 - DNA, 22 bp, Homo sapiens
aaaagtattattttccaaaagt

SEQ ID NO: 4665048 - DNA, 18 bp, Homo sapiens
aaaagtctgtctttcctg

SEQ ID NO: 4665049 - DNA, 16 bp, Homo sapiens
aaaagttccatagaaa

SEQ ID NO: 4665050 - DNA, 21 bp, Homo sapiens
aaaagttttgatatttatttt

SEQ ID NO: 4665051 - DNA, 21 bp, Homo sapiens
aaaataaaatgaaaattgtat

SEQ ID NO: 4665052 - DNA, 14 bp, Homo sapiens
aaaataaagcaatg

SEQ ID NO: 4665053 - DNA, 20 bp, Homo sapiens
aaaataaaggataactctgt

SEQ ID NO: 4665054 - DNA, 13 bp, Homo sapiens
aaaataaatgaaa

SEQ ID NO: 4665055 - DNA, 18 bp, Homo sapiens
aaaataactatgctttag

SEQ ID NO: 4665056 - DNA, 17 bp, Homo sapiens
aaaatacacgtttatct

SEQ ID NO: 4665057 - DNA, 18 bp, Homo sapiens
aaaatacacgtttatctt

SEQ ID NO: 4665058 - DNA, 19 bp, Homo sapiens
aaaatacacgtttatctta

SEQ ID NO: 4665059 - DNA, 17 bp, Homo sapiens
aaaatacatttgtaagt

SEQ ID NO: 4665060 - DNA, 18 bp, Homo sapiens
aaaatagagcaaaatcaa

SEQ ID NO: 4665061 - DNA, 21 bp, Homo sapiens
aaaatataaattgtacatttt

SEQ ID NO: 4665062 - DNA, 12 bp, Homo sapiens
aaaatatcttgg

SEQ ID NO: 4665063 - DNA, 15 bp, Homo sapiens
aaaatatgtaatttc

SEQ ID NO: 4665064 - DNA, 17 bp, Homo sapiens
aaaatatgtaatttcaa

SEQ ID NO: 4665065 - DNA, 22 bp, Homo sapiens
aaaatattgtttctgcattcat

SEQ ID NO: 4665066 - DNA, 23 bp, Homo sapiens
aaaatattgtttctgcattcatt

SEQ ID NO: 4665067 - DNA, 12 bp, Homo sapiens
aaaatattttgg

SEQ ID NO: 4665068 - DNA, 14 bp, Homo sapiens
aaaatcaaaacaag

SEQ ID NO: 4665069 - DNA, 14 bp, Homo sapiens
aaaatcatgtgaca

SEQ ID NO: 4665070 - DNA, 21 bp, Homo sapiens
aaaatccccttcgctgaaatt

SEQ ID NO: 4665071 - DNA, 22 bp, Homo sapiens
aaaatctagtgggttgaccttt

SEQ ID NO: 4665072 - DNA, 19 bp, Homo sapiens
aaaatctccccagtagaga

SEQ ID NO: 4665073 - DNA, 10 bp, Homo sapiens
aaaatcttgt

SEQ ID NO: 4665074 - DNA, 16 bp, Homo sapiens
aaaatgaaaattgtat

SEQ ID NO: 4665075 - DNA, 14 bp, Homo sapiens
aaaatgaaatgcta

SEQ ID NO: 4665076 - DNA, 15 bp, Homo sapiens
aaaatgaacatctct

SEQ ID NO: 4665077 - DNA, 13 bp, Homo sapiens
aaaatgacaaaca

SEQ ID NO: 4665078 - DNA, 16 bp, Homo sapiens
aaaatgacaaacatga

SEQ ID NO: 4665079 - DNA, 18 bp, Homo sapiens
aaaatgcaaatcctatgt

SEQ ID NO: 4665080 - DNA, 14 bp, Homo sapiens
aaaatgcattgtat

SEQ ID NO: 4665081 - DNA, 16 bp, Homo sapiens
aaaatgtaataacttt

SEQ ID NO: 4665082 - DNA, 11 bp, Homo sapiens
aaaatgtcttg

SEQ ID NO: 4665083 - DNA, 21 bp, Homo sapiens
aaaatgtcttgtgtatttctc

SEQ ID NO: 4665084 - DNA, 21 bp, Homo sapiens
aaaatgtttcattatgcactt

SEQ ID NO: 4665085 - DNA, 17 bp, Homo sapiens
aaaattaacaaatttct

SEQ ID NO: 4665086 - DNA, 12 bp, Homo sapiens
aaaattaacttt

SEQ ID NO: 4665087 - DNA, 20 bp, Homo sapiens
aaaattacctttaattttaa

SEQ ID NO: 4665088 - DNA, 21 bp, Homo sapiens
aaaattatatattgcaaggtg

SEQ ID NO: 4665089 - DNA, 17 bp, Homo sapiens
aaaattatttgctatgg

SEQ ID NO: 4665090 - DNA, 14 bp, Homo sapiens
aaaattcatttcta

SEQ ID NO: 4665091 - DNA, 19 bp, Homo sapiens
aaaatttaagtatcttttt

SEQ ID NO: 4665092 - DNA, 19 bp, Homo sapiens
aaaatttgactaattttac

SEQ ID NO: 4665093 - DNA, 15 bp, Homo sapiens
aaaattttttttcat

SEQ ID NO: 4665094 - DNA, 16 bp, Homo sapiens
aaaattttttttcatg

SEQ ID NO: 4665095 - DNA, 13 bp, Homo sapiens
aaacaaaatttga

SEQ ID NO: 4665096 - DNA, 20 bp, Homo sapiens
aaacaaaatttgtttgaaat

SEQ ID NO: 4665097 - DNA, 14 bp, Homo sapiens
aaacaaatgttcat

SEQ ID NO: 4665098 - DNA, 16 bp, Homo sapiens
aaacaagccccctgcc

SEQ ID NO: 4665099 - DNA, 17 bp, Homo sapiens
aaacaagccccctgccc

SEQ ID NO: 4665100 - DNA, 20 bp, Homo sapiens
aaacaagctgtgcaggcatg

SEQ ID NO: 4665101 - DNA, 11 bp, Homo sapiens
aaacacacatt

SEQ ID NO: 4665102 - DNA, 14 bp, Homo sapiens
aaacaccacttaat

SEQ ID NO: 4665103 - DNA, 17 bp, Homo sapiens
aaacaccacttaatctt

SEQ ID NO: 4665104 - DNA, 21 bp, Homo sapiens
aaacactgataatcacactgc

SEQ ID NO: 4665105 - DNA, 15 bp, Homo sapiens
aaacagaacagggtc

SEQ ID NO: 4665106 - DNA, 18 bp, Homo sapiens
aaacagaagcctgtttca

SEQ ID NO: 4665107 - DNA, 15 bp, Homo sapiens
aaacagagtggcctc

SEQ ID NO: 4665108 - DNA, 18 bp, Homo sapiens
aaacagagtggcctccct

SEQ ID NO: 4665109 - DNA, 16 bp, Homo sapiens
aaacagcattgctttc

SEQ ID NO: 4665110 - DNA, 21 bp, Homo sapiens
aaacagcattgctttctgaaa

SEQ ID NO: 4665111 - DNA, 23 bp, Homo sapiens
aaacagtccaaactgttctgaga

SEQ ID NO: 4665112 - DNA, 15 bp, Homo sapiens
aaacagttgctgtga

SEQ ID NO: 4665113 - DNA, 16 bp, Homo sapiens
aaacatcccactgact

SEQ ID NO: 4665114 - DNA, 21 bp, Homo sapiens
aaacatcccccaatgacctta

SEQ ID NO: 4665115 - DNA, 19 bp, Homo sapiens
aaacatgaatcctgtgata

SEQ ID NO: 4665116 - DNA, 11 bp, Homo sapiens
aaacattgtaa

SEQ ID NO: 4665117 - DNA, 23 bp, Homo sapiens
aaacattttatcattaaaaatta

SEQ ID NO: 4665118 - DNA, 21 bp, Homo sapiens
aaaccaaacttgttcatttag

SEQ ID NO: 4665119 - DNA, 18 bp, Homo sapiens
aaaccacttctccatgct

SEQ ID NO: 4665120 - DNA, 21 bp, Homo sapiens
aaaccatgcctggtattttca

SEQ ID NO: 4665121 - DNA, 12 bp, Homo sapiens
aaaccattgtaa

SEQ ID NO: 4665122 - DNA, 13 bp, Homo sapiens
aaacctgaatggt

SEQ ID NO: 4665123 - DNA, 22 bp, Homo sapiens
aaacctggggtgaatacttatt

SEQ ID NO: 4665124 - DNA, 22 bp, Homo sapiens
aaacctgttcaggcaggctttc

SEQ ID NO: 4665125 - DNA, 16 bp, Homo sapiens
aaaccttgttctattt

SEQ ID NO: 4665126 - DNA, 23 bp, Homo sapiens
aaacctttttataaagatcattt

SEQ ID NO: 4665127 - DNA, 23 bp, Homo sapiens
aaacgagttaatgatggcagagg

SEQ ID NO: 4665128 - DNA, 14 bp, Homo sapiens
aaacgcaattttac

SEQ ID NO: 4665129 - DNA, 19 bp, Homo sapiens
aaacgctctctactctgct

SEQ ID NO: 4665130 - DNA, 16 bp, Homo sapiens
aaacgtatgcatgtga

SEQ ID NO: 4665131 - DNA, 20 bp, Homo sapiens
aaactactgattacttgtaa

SEQ ID NO: 4665132 - DNA, 20 bp, Homo sapiens
aaactactgattgaatgtta

SEQ ID NO: 4665133 - DNA, 21 bp, Homo sapiens
aaactactgattgaatgttaa

SEQ ID NO: 4665134 - DNA, 20 bp, Homo sapiens
aaactaggattgacattcta

SEQ ID NO: 4665135 - DNA, 17 bp, Homo sapiens
aaactatgttcctaaca

SEQ ID NO: 4665136 - DNA, 16 bp, Homo sapiens
aaactatttttttctt

SEQ ID NO: 4665137 - DNA, 13 bp, Homo sapiens
aaataattatgca

SEQ ID NO: 4665138 - DNA, 23 bp, Homo sapiens
aaatacaatcagcccagtgcaaa

SEQ ID NO: 4665139 - DNA, 20 bp, Homo sapiens
aaatacacgtttatcttaca

SEQ ID NO: 4665140 - DNA, 23 bp, Homo sapiens
aaatacatgtgtatattcctttt

SEQ ID NO: 4665141 - DNA, 16 bp, Homo sapiens
aaataccagtacttga

SEQ ID NO: 4665142 - DNA, 15 bp, Homo sapiens
aaataccattcacta

SEQ ID NO: 4665143 - DNA, 23 bp, Homo sapiens
aaatactcttgatttcacatttc

SEQ ID NO: 4665144 - DNA, 16 bp, Homo sapiens
aaatagagcaaaatca

SEQ ID NO: 4665145 - DNA, 12 bp, Homo sapiens
aaatagcaataa

SEQ ID NO: 4665146 - DNA, 14 bp, Homo sapiens
aaatagttgtctgt

SEQ ID NO: 4665147 - DNA, 16 bp, Homo sapiens
aaatataaattgtaca

SEQ ID NO: 4665148 - DNA, 15 bp, Homo sapiens
aaatatacattttct

SEQ ID NO: 4665149 - DNA, 14 bp, Homo sapiens
aaatatatattata

SEQ ID NO: 4665150 - DNA, 13 bp, Homo sapiens
aaatatattgctg

SEQ ID NO: 4665151 - DNA, 23 bp, Homo sapiens
aaatatattttaccatacattta

SEQ ID NO: 4665152 - DNA, 17 bp, Homo sapiens
aaatatcataaagcatt

SEQ ID NO: 4665153 - DNA, 19 bp, Homo sapiens
aaatatgtaatttcaaaat

SEQ ID NO: 4665154 - DNA, 19 bp, Homo sapiens
aaatattagttaatggatt

SEQ ID NO: 4665155 - DNA, 16 bp, Homo sapiens
aaatattgctctatgt

SEQ ID NO: 4665156 - DNA, 17 bp, Homo sapiens
aaatattgtaatatgac

SEQ ID NO: 4665157 - DNA, 16 bp, Homo sapiens
aaatattgtttctgca

SEQ ID NO: 4665158 - DNA, 21 bp, Homo sapiens
aaatattgtttctgcattcat

SEQ ID NO: 4665159 - DNA, 11 bp, Homo sapiens
aaatattttct

SEQ ID NO: 4665160 - DNA, 12 bp, Homo sapiens
aaatattttcta

SEQ ID NO: 4665161 - DNA, 14 bp, Homo sapiens
aaatattttctatt

SEQ ID NO: 4665162 - DNA, 15 bp, Homo sapiens
aaatattttctattt

SEQ ID NO: 4665163 - DNA, 19 bp, Homo sapiens
aaatattttctattttaag

SEQ ID NO: 4665164 - DNA, 16 bp, Homo sapiens
aaatcaaaacaagtga

SEQ ID NO: 4665165 - DNA, 12 bp, Homo sapiens
aaatcaacatga

SEQ ID NO: 4665166 - DNA, 13 bp, Homo sapiens
aaatcaacatgac

SEQ ID NO: 4665167 - DNA, 12 bp, Homo sapiens
aaatcaagtatt

SEQ ID NO: 4665168 - DNA, 16 bp, Homo sapiens
aaatcactatgggtga

SEQ ID NO: 4665169 - DNA, 22 bp, Homo sapiens
aaatcatattagtattaatact

SEQ ID NO: 4665170 - DNA, 16 bp, Homo sapiens
aaatccaaggaaacat

SEQ ID NO: 4665171 - DNA, 17 bp, Homo sapiens
aaatccaataatcagaa

SEQ ID NO: 4665172 - DNA, 20 bp, Homo sapiens
aaatccatactgtagacact

SEQ ID NO: 4665173 - DNA, 15 bp, Homo sapiens
aaatccgaacctcct

SEQ ID NO: 4665174 - DNA, 20 bp, Homo sapiens
aaatccgaacctcctctgtg

SEQ ID NO: 4665175 - DNA, 21 bp, Homo sapiens
aaatccgaacctcctctgtga

SEQ ID NO: 4665176 - DNA, 23 bp, Homo sapiens
aaatcctatgtgattttaactct

SEQ ID NO: 4665177 - DNA, 15 bp, Homo sapiens
aaatctagacattct

SEQ ID NO: 4665178 - DNA, 21 bp, Homo sapiens
aaatctagacattcttttaat

SEQ ID NO: 4665179 - DNA, 18 bp, Homo sapiens
aaatctgtaacaggtatt

SEQ ID NO: 4665180 - DNA, 13 bp, Homo sapiens
aaatctgtctttg

SEQ ID NO: 4665181 - DNA, 14 bp, Homo sapiens
aaatctgtctttgc

SEQ ID NO: 4665182 - DNA, 23 bp, Homo sapiens
aaatctgtctttgcggggcctgt

SEQ ID NO: 4665183 - DNA, 19 bp, Homo sapiens
aaatcttcagtattttctc

SEQ ID NO: 4665184 - DNA, 17 bp, Homo sapiens
aaatcttttacattttt

SEQ ID NO: 4665185 - DNA, 11 bp, Homo sapiens
aaatgaaaatt

SEQ ID NO: 4665186 - DNA, 12 bp, Homo sapiens
aaatgaaaattg

SEQ ID NO: 4665187 - DNA, 15 bp, Homo sapiens
aaatgaaagtggtaa

SEQ ID NO: 4665188 - DNA, 14 bp, Homo sapiens
aaatgaaagtgtta

SEQ ID NO: 4665189 - DNA, 18 bp, Homo sapiens
aaatgaacatctcttgaa

SEQ ID NO: 4665190 - DNA, 13 bp, Homo sapiens
aaatgaagaaagt

SEQ ID NO: 4665191 - DNA, 16 bp, Homo sapiens
aaatgaagaaagtcaa

SEQ ID NO: 4665192 - DNA, 13 bp, Homo sapiens
aaatgacttattt

SEQ ID NO: 4665193 - DNA, 16 bp, Homo sapiens
aaatgacttatttctg

SEQ ID NO: 4665194 - DNA, 20 bp, Homo sapiens
aaatgagaatgacagccttt

SEQ ID NO: 4665195 - DNA, 15 bp, Homo sapiens
aaatgatcctcagtg

SEQ ID NO: 4665196 - DNA, 13 bp, Homo sapiens
aaatgcaaatcct

SEQ ID NO: 4665197 - DNA, 15 bp, Homo sapiens
aaatgcagaaccaca

SEQ ID NO: 4665198 - DNA, 12 bp, Homo sapiens
aaatgcatattt

SEQ ID NO: 4665199 - DNA, 13 bp, Homo sapiens
aaatgcattgtat

SEQ ID NO: 4665200 - DNA, 18 bp, Homo sapiens
aaatgccagtctcattgt

SEQ ID NO: 4665201 - DNA, 17 bp, Homo sapiens
aaatgcctagagatatt

SEQ ID NO: 4665202 - DNA, 16 bp, Homo sapiens
aaatgctctctcaaat

SEQ ID NO: 4665203 - DNA, 10 bp, Homo sapiens
aaatgctgct

SEQ ID NO: 4665204 - DNA, 14 bp, Homo sapiens
aaatggaaattttg

SEQ ID NO: 4665205 - DNA, 17 bp, Homo sapiens
aaatggactgttacaga

SEQ ID NO: 4665206 - DNA, 18 bp, Homo sapiens
aaatggtcatggggatga

SEQ ID NO: 4665207 - DNA, 14 bp, Homo sapiens
aaatggtgggatta

SEQ ID NO: 4665208 - DNA, 16 bp, Homo sapiens
aaatgtaatagtttat

SEQ ID NO: 4665209 - DNA, 11 bp, Homo sapiens
aaatgtacact

SEQ ID NO: 4665210 - DNA, 13 bp, Homo sapiens
aaatgtcttgtgt

SEQ ID NO: 4665211 - DNA, 13 bp, Homo sapiens
aaatgtgtacagt

SEQ ID NO: 4665212 - DNA, 16 bp, Homo sapiens
aaatgttgagaagcgt

SEQ ID NO: 4665213 - DNA, 22 bp, Homo sapiens
aaatgttgagaagcgtttttaa

SEQ ID NO: 4665214 - DNA, 12 bp, Homo sapiens
aaattaaaacaa

SEQ ID NO: 4665215 - DNA, 20 bp, Homo sapiens
aaattaaaacatatttcatt

SEQ ID NO: 4665216 - DNA, 15 bp, Homo sapiens
aaattaaacattttt

SEQ ID NO: 4665217 - DNA, 16 bp, Homo sapiens
aaattaaacatttttc

SEQ ID NO: 4665218 - DNA, 13 bp, Homo sapiens
aaattaaatctag

SEQ ID NO: 4665219 - DNA, 14 bp, Homo sapiens
aaattacaatttta

SEQ ID NO: 4665220 - DNA, 13 bp, Homo sapiens
aaattacctttaa

SEQ ID NO: 4665221 - DNA, 23 bp, Homo sapiens
aaattatatattgcaaggtgtga

SEQ ID NO: 4665222 - DNA, 16 bp, Homo sapiens
aaattcatttctaatt

SEQ ID NO: 4665223 - DNA, 19 bp, Homo sapiens
aaattcgcatgtttaatgt

SEQ ID NO: 4665224 - DNA, 20 bp, Homo sapiens
aaattctttcagctatcagt

SEQ ID NO: 4665225 - DNA, 18 bp, Homo sapiens
aaattgccctatgctgtg

SEQ ID NO: 4665226 - DNA, 19 bp, Homo sapiens
aaattgccctatgctgtgc

SEQ ID NO: 4665227 - DNA, 13 bp, Homo sapiens
aaattgctctgtt

SEQ ID NO: 4665228 - DNA, 18 bp, Homo sapiens
aaattgtaaatcctgtgt

SEQ ID NO: 4665229 - DNA, 15 bp, Homo sapiens
aaatttaagaaaaca

SEQ ID NO: 4665230 - DNA, 15 bp, Homo sapiens
aaatttaagtatctt

SEQ ID NO: 4665231 - DNA, 12 bp, Homo sapiens
aaatttaattct

SEQ ID NO: 4665232 - DNA, 13 bp, Homo sapiens
aaatttcattgca

SEQ ID NO: 4665233 - DNA, 18 bp, Homo sapiens
aaatttctttgtttaaca

SEQ ID NO: 4665234 - DNA, 17 bp, Homo sapiens
aaatttgactaatttta

SEQ ID NO: 4665235 - DNA, 18 bp, Homo sapiens
aaatttgactaattttac

SEQ ID NO: 4665236 - DNA, 18 bp, Homo sapiens
aaatttgtttgaaatctt

SEQ ID NO: 4665237 - DNA, 14 bp, Homo sapiens
aaattttattatta

SEQ ID NO: 4665238 - DNA, 17 bp, Homo sapiens
aaattttttaaaagttt

SEQ ID NO: 4665239 - DNA, 16 bp, Homo sapiens
aaattttttagtatgt

SEQ ID NO: 4665240 - DNA, 17 bp, Homo sapiens
aaattttttttcatgtt

SEQ ID NO: 4665241 - DNA, 23 bp, Homo sapiens
aacaaaaaggtaaatcccacatc

SEQ ID NO: 4665242 - DNA, 14 bp, Homo sapiens
aacaaaacgaaact

SEQ ID NO: 4665243 - DNA, 21 bp, Homo sapiens
aacaaaactgttcttttgcat

SEQ ID NO: 4665244 - DNA, 20 bp, Homo sapiens
aacaaaatttgactaatttt

SEQ ID NO: 4665245 - DNA, 17 bp, Homo sapiens
aacaaaccacagcagga

SEQ ID NO: 4665246 - DNA, 23 bp, Homo sapiens
aacaaagccaaacaaaactgaac

SEQ ID NO: 4665247 - DNA, 15 bp, Homo sapiens
aacaaagtactcttt

SEQ ID NO: 4665248 - DNA, 18 bp, Homo sapiens
aaccttttttgtcttatt

SEQ ID NO: 4665249 - DNA, 12 bp, Homo sapiens
aacgaaaagcac

SEQ ID NO: 4665250 - DNA, 13 bp, Homo sapiens
aacgcaattttac

SEQ ID NO: 4665251 - DNA, 21 bp, Homo sapiens
aacgcagaagagggggagggg

SEQ ID NO: 4665252 - DNA, 17 bp, Homo sapiens
aacgcctgagcccaggg

SEQ ID NO: 4665253 - DNA, 19 bp, Homo sapiens
aacgcctgagcccagggag

SEQ ID NO: 4665254 - DNA, 21 bp, Homo sapiens
aacgctagaagcctaagaact

SEQ ID NO: 4665255 - DNA, 22 bp, Homo sapiens
aacgcttgtagaactcactctg

SEQ ID NO: 4665256 - DNA, 15 bp, Homo sapiens
aacggtctggcaggg

SEQ ID NO: 4665257 - DNA, 20 bp, Homo sapiens
aacggtctggcagggcagca

SEQ ID NO: 4665258 - DNA, 14 bp, Homo sapiens
aacggtgctaaaaa

SEQ ID NO: 4665259 - DNA, 18 bp, Homo sapiens
aacgtatgcatgtgaaga

SEQ ID NO: 4665260 - DNA, 22 bp, Homo sapiens
aacgtgagagaaagagagaagc

SEQ ID NO: 4665261 - DNA, 15 bp, Homo sapiens
aacgtgatacatttg

SEQ ID NO: 4665262 - DNA, 16 bp, Homo sapiens
aacgtgatacatttgg

SEQ ID NO: 4665263 - DNA, 16 bp, Homo sapiens
aacgtggctctgctgg

SEQ ID NO: 4665264 - DNA, 17 bp, Homo sapiens
aacgtggctctgctggc

SEQ ID NO: 4665265 - DNA, 14 bp, Homo sapiens
aactaaaacattat

SEQ ID NO: 4665266 - DNA, 16 bp, Homo sapiens
aactaaggcttttatt

SEQ ID NO: 4665267 - DNA, 18 bp, Homo sapiens
aactagccaaaccaggac

SEQ ID NO: 4665268 - DNA, 19 bp, Homo sapiens
aactatctggccatattta

SEQ ID NO: 4665269 - DNA, 20 bp, Homo sapiens
aactatgatttattttggtg

SEQ ID NO: 4665270 - DNA, 17 bp, Homo sapiens
aactatgttcctaacaa

SEQ ID NO: 4665271 - DNA, 16 bp, Homo sapiens
aactcacacccctgcc

SEQ ID NO: 4665272 - DNA, 13 bp, Homo sapiens
aactcactctggg

SEQ ID NO: 4665273 - DNA, 15 bp, Homo sapiens
aactcactgtgatca

SEQ ID NO: 4665274 - DNA, 14 bp, Homo sapiens
aactcatcattttt

SEQ ID NO: 4665275 - DNA, 17 bp, Homo sapiens
aactcatcctcttttaa

SEQ ID NO: 4665276 - DNA, 16 bp, Homo sapiens
aactccatgcaaacca

SEQ ID NO: 4665277 - DNA, 11 bp, Homo sapiens
aactccctcca

SEQ ID NO: 4665278 - DNA, 19 bp, Homo sapiens
aactccctccaccagcctg

SEQ ID NO: 4665279 - DNA, 12 bp, Homo sapiens
aactcccttctg

SEQ ID NO: 4665280 - DNA, 16 bp, Homo sapiens
aactcccttctgcttg

SEQ ID NO: 4665281 - DNA, 15 bp, Homo sapiens
aactctcccctcccc

SEQ ID NO: 4665282 - DNA, 17 bp, Homo sapiens
aactctcccctccccat

SEQ ID NO: 4665283 - DNA, 20 bp, Homo sapiens
aactctctggaagcccctgg

SEQ ID NO: 4665284 - DNA, 11 bp, Homo sapiens
aactctgctgt

SEQ ID NO: 4665285 - DNA, 22 bp, Homo sapiens
aactctgctgtctaacctgtga

SEQ ID NO: 4665286 - DNA, 23 bp, Homo sapiens
aactctgtcttcacctgattcaa

SEQ ID NO: 4665287 - DNA, 15 bp, Homo sapiens
aactgaacattccag

SEQ ID NO: 4665288 - DNA, 19 bp, Homo sapiens
aactgaagggggcggccta

SEQ ID NO: 4665289 - DNA, 22 bp, Homo sapiens
aactgactatcataaaatcaaa

SEQ ID NO: 4665290 - DNA, 19 bp, Homo sapiens
aactgactgaaggaaaagc

SEQ ID NO: 4665291 - DNA, 22 bp, Homo sapiens
aactgaggagatgaccagggat

SEQ ID NO: 4665292 - DNA, 23 bp, Homo sapiens
aactgaggcccacggtttcagct

SEQ ID NO: 4665293 - DNA, 23 bp, Homo sapiens
aactgatgagtaaactgaggccc

SEQ ID NO: 4665294 - DNA, 22 bp, Homo sapiens
aactgattgctcccaggatctc

SEQ ID NO: 4665295 - DNA, 22 bp, Homo sapiens
aactgcattgactttcagtaaa

SEQ ID NO: 4665296 - DNA, 15 bp, Homo sapiens
aactgccaagaaatt

SEQ ID NO: 4665297 - DNA, 19 bp, Homo sapiens
aactgctaatgcaaattaa

SEQ ID NO: 4665298 - DNA, 18 bp, Homo sapiens
aactgcttcatgtgaaca

SEQ ID NO: 4665299 - DNA, 19 bp, Homo sapiens
aactggaaacaaaacagaa

SEQ ID NO: 4665300 - DNA, 17 bp, Homo sapiens
aactggccaagctgagg

SEQ ID NO: 4665301 - DNA, 15 bp, Homo sapiens
aactggcctaaattt

SEQ ID NO: 4665302 - DNA, 22 bp, Homo sapiens
aactggtaagcgatttgaaaca

SEQ ID NO: 4665303 - DNA, 23 bp, Homo sapiens
aactggttaaaaaacaaatgttc

SEQ ID NO: 4665304 - DNA, 11 bp, Homo sapiens
aactgtaaatc

SEQ ID NO: 4665305 - DNA, 14 bp, Homo sapiens
aactgtactgggcc

SEQ ID NO: 4665306 - DNA, 20 bp, Homo sapiens
aactgtcccaaggagggggc

SEQ ID NO: 4665307 - DNA, 13 bp, Homo sapiens
aactgtcctgtcc

SEQ ID NO: 4665308 - DNA, 18 bp, Homo sapiens
aactgtgtttcaaatgga

SEQ ID NO: 4665309 - DNA, 22 bp, Homo sapiens
aactgtgtttcaaatggactgt

SEQ ID NO: 4665310 - DNA, 16 bp, Homo sapiens
aactgttcttttgcat

SEQ ID NO: 4665311 - DNA, 18 bp, Homo sapiens
aactgttcttttgcattt

SEQ ID NO: 4665312 - DNA, 16 bp, Homo sapiens
aactgtttccctgctg

SEQ ID NO: 4665313 - DNA, 14 bp, Homo sapiens
aacttaaatattgt

SEQ ID NO: 4665314 - DNA, 23 bp, Homo sapiens
aacttaatttgggaatttgttgt

SEQ ID NO: 4665315 - DNA, 19 bp, Homo sapiens
aacttagtgtaatatacca

SEQ ID NO: 4665316 - DNA, 21 bp, Homo sapiens
aacttatagttaatattttgt

SEQ ID NO: 4665317 - DNA, 22 bp, Homo sapiens
aacttattacctcaggtgccaa

SEQ ID NO: 4665318 - DNA, 20 bp, Homo sapiens
aacttcaagatgagcctggg

SEQ ID NO: 4665319 - DNA, 22 bp, Homo sapiens
aacttcaagatgagcctgggct

SEQ ID NO: 4665320 - DNA, 15 bp, Homo sapiens
aacttccgctgaggg

SEQ ID NO: 4665321 - DNA, 15 bp, Homo sapiens
aacttctttgaattt

SEQ ID NO: 4665322 - DNA, 21 bp, Homo sapiens
aacttgactgggtgagaccca

SEQ ID NO: 4665323 - DNA, 23 bp, Homo sapiens
aacttgcatattgttggcacaga

SEQ ID NO: 4665324 - DNA, 21 bp, Homo sapiens
aacttgccatccgcacagaaa

SEQ ID NO: 4665325 - DNA, 21 bp, Homo sapiens
aacttgcctccatctttttct

SEQ ID NO: 4665326 - DNA, 14 bp, Homo sapiens
aacttgtcttttca

SEQ ID NO: 4665327 - DNA, 17 bp, Homo sapiens
aactttataacttaaat

SEQ ID NO: 4665328 - DNA, 20 bp, Homo sapiens
aactttatttgtaaaccatt

SEQ ID NO: 4665329 - DNA, 22 bp, Homo sapiens
aactttctccatttaagacaca

SEQ ID NO: 4665330 - DNA, 23 bp, Homo sapiens
aactttctccatttaagacacat

SEQ ID NO: 4665331 - DNA, 13 bp, Homo sapiens
aacttttctcttt

SEQ ID NO: 4665332 - DNA, 18 bp, Homo sapiens
aacttttcttaaggtttt

SEQ ID NO: 4665333 - DNA, 15 bp, Homo sapiens
aacttttgtgtgaaa

SEQ ID NO: 4665334 - DNA, 14 bp, Homo sapiens
aacttttgtttttt

SEQ ID NO: 4665335 - DNA, 16 bp, Homo sapiens
aacttttttgtggcaa

SEQ ID NO: 4665336 - DNA, 21 bp, Homo sapiens
aacttttttgtggcaattagt

SEQ ID NO: 4665337 - DNA, 20 bp, Homo sapiens
aacttttttttaagttacac

SEQ ID NO: 4665338 - DNA, 13 bp, Homo sapiens
aagaaaaaaagct

SEQ ID NO: 4665339 - DNA, 16 bp, Homo sapiens
aagaaacaagctgtgc

SEQ ID NO: 4665340 - DNA, 16 bp, Homo sapiens
aagaaacaccacttaa

SEQ ID NO: 4665341 - DNA, 14 bp, Homo sapiens
aagaaacagccagc

SEQ ID NO: 4665342 - DNA, 19 bp, Homo sapiens
aagaaagggacccacctgc

SEQ ID NO: 4665343 - DNA, 15 bp, Homo sapiens
aagaaattttttaaa

SEQ ID NO: 4665344 - DNA, 14 bp, Homo sapiens
aagaacaagtttag

SEQ ID NO: 4665345 - DNA, 13 bp, Homo sapiens
aagaactctctgg

SEQ ID NO: 4665346 - DNA, 20 bp, Homo sapiens
aagaagatagtgagatttaa

SEQ ID NO: 4665347 - DNA, 15 bp, Homo sapiens
aagaaggaccctttt

SEQ ID NO: 4665348 - DNA, 15 bp, Homo sapiens
aagaagggggccctg

SEQ ID NO: 4665349 - DNA, 18 bp, Homo sapiens
aagaaggtttgtgttttt

SEQ ID NO: 4665350 - DNA, 16 bp, Homo sapiens
aagaagtggagacagt

SEQ ID NO: 4665351 - DNA, 19 bp, Homo sapiens
aagaagtggagacagtcct

SEQ ID NO: 4665352 - DNA, 17 bp, Homo sapiens
aagaatacccaggaaga

SEQ ID NO: 4665353 - DNA, 14 bp, Homo sapiens
aagaatatgacttt

SEQ ID NO: 4665354 - DNA, 13 bp, Homo sapiens
aagaatattttga

SEQ ID NO: 4665355 - DNA, 23 bp, Homo sapiens
aagaatattttgatgcagataaa

SEQ ID NO: 4665356 - DNA, 22 bp, Homo sapiens
aagaatcagtaggaccaggcca

SEQ ID NO: 4665357 - DNA, 21 bp, Homo sapiens
aagctaacagggaaggcaggc

SEQ ID NO: 4665358 - DNA, 20 bp, Homo sapiens
aagctaggccccagaggccc

SEQ ID NO: 4665359 - DNA, 23 bp, Homo sapiens
aagctaggccccagaggccctgg

SEQ ID NO: 4665360 - DNA, 20 bp, Homo sapiens
aagctatattagctgaaaca

SEQ ID NO: 4665361 - DNA, 21 bp, Homo sapiens
aagctatattagctgaaacaa

SEQ ID NO: 4665362 - DNA, 21 bp, Homo sapiens
aagctatcacctagcagcctc

SEQ ID NO: 4665363 - DNA, 22 bp, Homo sapiens
aagctcagaggcgcactgtgac

SEQ ID NO: 4665364 - DNA, 17 bp, Homo sapiens
aagctcaggatatggct

SEQ ID NO: 4665365 - DNA, 23 bp, Homo sapiens
aagctcatggctgtgtccactgc

SEQ ID NO: 4665366 - DNA, 15 bp, Homo sapiens
aagctctgaagaact

SEQ ID NO: 4665367 - DNA, 21 bp, Homo sapiens
aagctctgccccttccccatg

SEQ ID NO: 4665368 - DNA, 19 bp, Homo sapiens
aagctgacgaacttccatg

SEQ ID NO: 4665369 - DNA, 15 bp, Homo sapiens
aagctgagctggctt

SEQ ID NO: 4665370 - DNA, 17 bp, Homo sapiens
aagctgaggtgcccagg

SEQ ID NO: 4665371 - DNA, 19 bp, Homo sapiens
aagctgaggtgcccaggag

SEQ ID NO: 4665372 - DNA, 20 bp, Homo sapiens
aagctgaggtgcccaggaga

SEQ ID NO: 4665373 - DNA, 17 bp, Homo sapiens
aagctgcactgtgaacc

SEQ ID NO: 4665374 - DNA, 19 bp, Homo sapiens
aagctggccaaagtcactt

SEQ ID NO: 4665375 - DNA, 13 bp, Homo sapiens
aagctgtccctgc

SEQ ID NO: 4665376 - DNA, 16 bp, Homo sapiens
aagctgtccctgcagg

SEQ ID NO: 4665377 - DNA, 17 bp, Homo sapiens
aagctgtccctgcaggg

SEQ ID NO: 4665378 - DNA, 23 bp, Homo sapiens
aagctgtctcttcggcagggagg

SEQ ID NO: 4665379 - DNA, 13 bp, Homo sapiens
aagctgtgcaggc

SEQ ID NO: 4665380 - DNA, 13 bp, Homo sapiens
aagctgttcctgt

SEQ ID NO: 4665381 - DNA, 15 bp, Homo sapiens
aagcttactctctgc

SEQ ID NO: 4665382 - DNA, 15 bp, Homo sapiens
aagcttggaggaggg

SEQ ID NO: 4665383 - DNA, 16 bp, Homo sapiens
aagctttataaacttt

SEQ ID NO: 4665384 - DNA, 20 bp, Homo sapiens
aagctttatttatagaaatg

SEQ ID NO: 4665385 - DNA, 21 bp, Homo sapiens
aagctttcctgtttccagggt

SEQ ID NO: 4665386 - DNA, 13 bp, Homo sapiens
aagcttttatttc

SEQ ID NO: 4665387 - DNA, 20 bp, Homo sapiens
aaggaaagaagggggccctg

SEQ ID NO: 4665388 - DNA, 18 bp, Homo sapiens
aaggaacagaagtgagga

SEQ ID NO: 4665389 - DNA, 18 bp, Homo sapiens
aaggaacagttgcattta

SEQ ID NO: 4665390 - DNA, 17 bp, Homo sapiens
aaggaatagaagcaaat

SEQ ID NO: 4665391 - DNA, 16 bp, Homo sapiens
aaggaatataagaaaa

SEQ ID NO: 4665392 - DNA, 22 bp, Homo sapiens
aaggaatttgcatccagcagca

SEQ ID NO: 4665393 - DNA, 13 bp, Homo sapiens
aaggacaggaccc

SEQ ID NO: 4665394 - DNA, 13 bp, Homo sapiens
aaggacagttcag

SEQ ID NO: 4665395 - DNA, 21 bp, Homo sapiens
aaggacatgagatcagggcct

SEQ ID NO: 4665396 - DNA, 22 bp, Homo sapiens
aaggacatgagatcagggcctg

SEQ ID NO: 4665397 - DNA, 15 bp, Homo sapiens
aaggacccagccctc

SEQ ID NO: 4665398 - DNA, 17 bp, Homo sapiens
aaggagaaggagtgcca

SEQ ID NO: 4665399 - DNA, 16 bp, Homo sapiens
aaggagacaggatgag

SEQ ID NO: 4665400 - DNA, 21 bp, Homo sapiens
aaggagcaaaaatctgagaaa

SEQ ID NO: 4665401 - DNA, 13 bp, Homo sapiens
aaggagcctgtga

SEQ ID NO: 4665402 - DNA, 12 bp, Homo sapiens
aaggaggaccag

SEQ ID NO: 4665403 - DNA, 21 bp, Homo sapiens
aaggaggaccagtcaggatga

SEQ ID NO: 4665404 - DNA, 20 bp, Homo sapiens
aaggaggaggagtcagatga

SEQ ID NO: 4665405 - DNA, 18 bp, Homo sapiens
aaggaggccaaccagccc

SEQ ID NO: 4665406 - DNA, 14 bp, Homo sapiens
aaggaggcccactg

SEQ ID NO: 4665407 - DNA, 18 bp, Homo sapiens
aaggagggcacattaact

SEQ ID NO: 4665408 - DNA, 11 bp, Homo sapiens
aaggagggggc

SEQ ID NO: 4665409 - DNA, 13 bp, Homo sapiens
aaggataactctg

SEQ ID NO: 4665410 - DNA, 15 bp, Homo sapiens
aaggataactctgta

SEQ ID NO: 4665411 - DNA, 19 bp, Homo sapiens
aaggcagcaaggcccgagc

SEQ ID NO: 4665412 - DNA, 16 bp, Homo sapiens
aaggcaggcagggctc

SEQ ID NO: 4665413 - DNA, 17 bp, Homo sapiens
aaggcaggcagggctct

SEQ ID NO: 4665414 - DNA, 22 bp, Homo sapiens
aaggcaggcagggctctcctgg

SEQ ID NO: 4665415 - DNA, 18 bp, Homo sapiens
aaggcagtggcaggggag

SEQ ID NO: 4665416 - DNA, 20 bp, Homo sapiens
aaggcattggcatctgcttt

SEQ ID NO: 4665417 - DNA, 17 bp, Homo sapiens
aaggccaaaatcaagag

SEQ ID NO: 4665418 - DNA, 17 bp, Homo sapiens
aaggcccgagcagctga

SEQ ID NO: 4665419 - DNA, 18 bp, Homo sapiens
aaggcccgagcagctgag

SEQ ID NO: 4665420 - DNA, 20 bp, Homo sapiens
aaggccctgcatctgtctgc

SEQ ID NO: 4665421 - DNA, 23 bp, Homo sapiens
aaggccctgcatctgtctgctct

SEQ ID NO: 4665422 - DNA, 23 bp, Homo sapiens
aaggcccttaactatcaccagtg

SEQ ID NO: 4665423 - DNA, 22 bp, Homo sapiens
aaggccggcagcgggcggaggg

SEQ ID NO: 4665424 - DNA, 13 bp, Homo sapiens
aaggcctggtctg

SEQ ID NO: 4665425 - DNA, 23 bp, Homo sapiens
aaggctacttcggggctgggaag

SEQ ID NO: 4665426 - DNA, 16 bp, Homo sapiens
aaggcttaagaactgc

SEQ ID NO: 4665427 - DNA, 12 bp, Homo sapiens
aaggcttctctc

SEQ ID NO: 4665428 - DNA, 19 bp, Homo sapiens
aagggaatttaatactttt

SEQ ID NO: 4665429 - DNA, 21 bp, Homo sapiens
aagggacacttttatgttttt

SEQ ID NO: 4665430 - DNA, 20 bp, Homo sapiens
aagggacaggagaagagagg

SEQ ID NO: 4665431 - DNA, 14 bp, Homo sapiens
aagggacccacctg

SEQ ID NO: 4665432 - DNA, 19 bp, Homo sapiens
aagggagatgtcaggatgt

SEQ ID NO: 4665433 - DNA, 16 bp, Homo sapiens
aagggaggggtggtat

SEQ ID NO: 4665434 - DNA, 18 bp, Homo sapiens
aagggcactcccaaccct

SEQ ID NO: 4665435 - DNA, 11 bp, Homo sapiens
aagggcagagt

SEQ ID NO: 4665436 - DNA, 13 bp, Homo sapiens
aagggcagtgccc

SEQ ID NO: 4665437 - DNA, 14 bp, Homo sapiens
aagggcagtgccca

SEQ ID NO: 4665438 - DNA, 22 bp, Homo sapiens
aagggcagtgcccatgtgtaca

SEQ ID NO: 4665439 - DNA, 17 bp, Homo sapiens
aagggccctggcacccc

SEQ ID NO: 4665440 - DNA, 12 bp, Homo sapiens
aagggggccctg

SEQ ID NO: 4665441 - DNA, 13 bp, Homo sapiens
aagggggccctgc

SEQ ID NO: 4665442 - DNA, 22 bp, Homo sapiens
aagggggcggcctatgacttgg

SEQ ID NO: 4665443 - DNA, 15 bp, Homo sapiens
aagggtcttgggaaa

SEQ ID NO: 4665444 - DNA, 19 bp, Homo sapiens
aagggtcttgggaaatatg

SEQ ID NO: 4665445 - DNA, 17 bp, Homo sapiens
aaggtaaatcccacatc

SEQ ID NO: 4665446 - DNA, 12 bp, Homo sapiens
aaggtactgtgg

SEQ ID NO: 4665447 - DNA, 15 bp, Homo sapiens
aaggtactgtggggt

SEQ ID NO: 4665448 - DNA, 16 bp, Homo sapiens
aaggtactgtggggtg

SEQ ID NO: 4665449 - DNA, 19 bp, Homo sapiens
aaggtactgtggggtggac

SEQ ID NO: 4665450 - DNA, 12 bp, Homo sapiens
aaggtctttcag

SEQ ID NO: 4665451 - DNA, 18 bp, Homo sapiens
aaggtctttcagtacttt

SEQ ID NO: 4665452 - DNA, 19 bp, Homo sapiens
aaggtctttcagtactttt

SEQ ID NO: 4665453 - DNA, 13 bp, Homo sapiens
aaggtctttgtta

SEQ ID NO: 4665454 - DNA, 21 bp, Homo sapiens
aaggtgccaccaccctgcccc

SEQ ID NO: 4665455 - DNA, 16 bp, Homo sapiens
aaggtggagggaagga

SEQ ID NO: 4665456 - DNA, 20 bp, Homo sapiens
aaggtggagggaaggataaa

SEQ ID NO: 4665457 - DNA, 22 bp, Homo sapiens
aaggttttggatcttgaatgtg

SEQ ID NO: 4665458 - DNA, 23 bp, Homo sapiens
aaggttttggatcttgaatgtgg

SEQ ID NO: 4665459 - DNA, 19 bp, Homo sapiens
aagtaacctgggcttaagt

SEQ ID NO: 4665460 - DNA, 17 bp, Homo sapiens
aagtaatgacttagaaa

SEQ ID NO: 4665461 - DNA, 24 bp, Homo sapiens
aagtactctttaacatacaagaaa

SEQ ID NO: 4665462 - DNA, 20 bp, Homo sapiens
aagtagaggttgtatacacc

SEQ ID NO: 4665463 - DNA, 21 bp, Homo sapiens
aagtatattatatggcaggag

SEQ ID NO: 4665464 - DNA, 21 bp, Homo sapiens
aagtatgcaatgcttcattat

SEQ ID NO: 4665465 - DNA, 13 bp, Homo sapiens
aagtatggtgtgt

SEQ ID NO: 4665466 - DNA, 18 bp, Homo sapiens
aatatcataaagcatttt

SEQ ID NO: 4665467 - DNA, 11 bp, Homo sapiens
aatatcattct

SEQ ID NO: 4665468 - DNA, 20 bp, Homo sapiens
aatatcattctttgtatctt

SEQ ID NO: 4665469 - DNA, 15 bp, Homo sapiens
aatatcttggcctaa

SEQ ID NO: 4665470 - DNA, 14 bp, Homo sapiens
aatatctttcagtt

SEQ ID NO: 4665471 - DNA, 22 bp, Homo sapiens
aatatgaatgcccccagctggc

SEQ ID NO: 4665472 - DNA, 20 bp, Homo sapiens
aatatgactttttataaaat

SEQ ID NO: 4665473 - DNA, 21 bp, Homo sapiens
aatatgcaaggcggtacacta

SEQ ID NO: 4665474 - DNA, 16 bp, Homo sapiens
aatatggggatagtct

SEQ ID NO: 4665475 - DNA, 17 bp, Homo sapiens
aatatgtgacattcctg

SEQ ID NO: 4665476 - DNA, 17 bp, Homo sapiens
aatattaaaccctggat

SEQ ID NO: 4665477 - DNA, 18 bp, Homo sapiens
aatattagttaatggatt

SEQ ID NO: 4665478 - DNA, 19 bp, Homo sapiens
aatattcatggatggctca

SEQ ID NO: 4665479 - DNA, 17 bp, Homo sapiens
aatattccaagcttcat

SEQ ID NO: 4665480 - DNA, 22 bp, Homo sapiens
aatattgctctatgttagtata

SEQ ID NO: 4665481 - DNA, 17 bp, Homo sapiens
aatattgtacagttttt

SEQ ID NO: 4665482 - DNA, 23 bp, Homo sapiens
aatattgtacagtttttattgct

SEQ ID NO: 4665483 - DNA, 12 bp, Homo sapiens
aatattgtttct

SEQ ID NO: 4665484 - DNA, 20 bp, Homo sapiens
aatatttactaactaaatac

SEQ ID NO: 4665485 - DNA, 14 bp, Homo sapiens
aatatttagcaaat

SEQ ID NO: 4665486 - DNA, 20 bp, Homo sapiens
aatatttagcaaataatttc

SEQ ID NO: 4665487 - DNA, 16 bp, Homo sapiens
aatatttagctgtaaa

SEQ ID NO: 4665488 - DNA, 22 bp, Homo sapiens
aatatttaggagtctattttgt

SEQ ID NO: 4665489 - DNA, 14 bp, Homo sapiens
aatatttgaataat

SEQ ID NO: 4665490 - DNA, 22 bp, Homo sapiens
aatattttctctgtacttttca

SEQ ID NO: 4665491 - DNA, 13 bp, Homo sapiens
aatattttggatg

SEQ ID NO: 4665492 - DNA, 23 bp, Homo sapiens
aatatttttatatcatgcaaaat

SEQ ID NO: 4665493 - DNA, 17 bp, Homo sapiens
aatatttttgtatttct

SEQ ID NO: 4665494 - DNA, 16 bp, Homo sapiens
aatcaacatgactggt

SEQ ID NO: 4665495 - DNA, 10 bp, Homo sapiens
aatcaagaga

SEQ ID NO: 4665496 - DNA, 14 bp, Homo sapiens
aatcaagagaaact

SEQ ID NO: 4665497 - DNA, 22 bp, Homo sapiens
aatcaagccatgtataaatgtg

SEQ ID NO: 4665498 - DNA, 19 bp, Homo sapiens
aatcacagaaaatttaact

SEQ ID NO: 4665499 - DNA, 22 bp, Homo sapiens
aatcacatttttttatgctctt

SEQ ID NO: 4665500 - DNA, 15 bp, Homo sapiens
aatcacgtaaagcta

SEQ ID NO: 4665501 - DNA, 17 bp, Homo sapiens
aatcactaaactttatt

SEQ ID NO: 4665502 - DNA, 18 bp, Homo sapiens
aatcactcattctatgaa

SEQ ID NO: 4665503 - DNA, 19 bp, Homo sapiens
aatcagaaaagtaattttg

SEQ ID NO: 4665504 - DNA, 16 bp, Homo sapiens
aatcagtaggaccagg

SEQ ID NO: 4665505 - DNA, 23 bp, Homo sapiens
aatcatgacttatcccattttca

SEQ ID NO: 4665506 - DNA, 21 bp, Homo sapiens
aatcatgtctgtatccccagt

SEQ ID NO: 4665507 - DNA, 21 bp, Homo sapiens
aatcattaatttcaaaattta

SEQ ID NO: 4665508 - DNA, 16 bp, Homo sapiens
aatcatttgtttacat

SEQ ID NO: 4665509 - DNA, 21 bp, Homo sapiens
aatcattttatgctgtttatg

SEQ ID NO: 4665510 - DNA, 17 bp, Homo sapiens
aatcattttcattccta

SEQ ID NO: 4665511 - DNA, 18 bp, Homo sapiens
aatcattttcattcctaa

SEQ ID NO: 4665512 - DNA, 23 bp, Homo sapiens
aatccatactgtagacactctga

SEQ ID NO: 4665513 - DNA, 14 bp, Homo sapiens
aatccatgggtctg

SEQ ID NO: 4665514 - DNA, 16 bp, Homo sapiens
aatccatgggtctggc

SEQ ID NO: 4665515 - DNA, 21 bp, Homo sapiens
aatccatgtgattaatgtttt

SEQ ID NO: 4665516 - DNA, 23 bp, Homo sapiens
aatccatgtgattaatgttttca

SEQ ID NO: 4665517 - DNA, 19 bp, Homo sapiens
aatcccatcagtgaatcct

SEQ ID NO: 4665518 - DNA, 19 bp, Homo sapiens
aatccgaacctcctctgtg

SEQ ID NO: 4665519 - DNA, 19 bp, Homo sapiens
aatccgccagtgtttctga

SEQ ID NO: 4665520 - DNA, 12 bp, Homo sapiens
aatcctcctgag

SEQ ID NO: 4665521 - DNA, 17 bp, Homo sapiens
aatcctctgttaatgtg

SEQ ID NO: 4665522 - DNA, 11 bp, Homo sapiens
aatcctgtgtt

SEQ ID NO: 4665523 - DNA, 20 bp, Homo sapiens
aatccttcaaaataaaaagt

SEQ ID NO: 4665524 - DNA, 19 bp, Homo sapiens
aatcgctaatcagtcattt

SEQ ID NO: 4665525 - DNA, 13 bp, Homo sapiens
aatctattgtttc

SEQ ID NO: 4665526 - DNA, 22 bp, Homo sapiens
aatctccccagtagagaaacat

SEQ ID NO: 4665527 - DNA, 16 bp, Homo sapiens
aatctctccattcccg

SEQ ID NO: 4665528 - DNA, 21 bp, Homo sapiens
aatctgcttttcctctgcctt

SEQ ID NO: 4665529 - DNA, 23 bp, Homo sapiens
aatctggtctgaataacactgga

SEQ ID NO: 4665530 - DNA, 15 bp, Homo sapiens
aatctgtaaagccag

SEQ ID NO: 4665531 - DNA, 13 bp, Homo sapiens
aatctgtacaatg

SEQ ID NO: 4665532 - DNA, 20 bp, Homo sapiens
aatctgtatctgtagtgaga

SEQ ID NO: 4665533 - DNA, 17 bp, Homo sapiens
aatctgtgtacaaagaa

SEQ ID NO: 4665534 - DNA, 18 bp, Homo sapiens
aatctgtgtacaaagaaa

SEQ ID NO: 4665535 - DNA, 12 bp, Homo sapiens
aatctgttatcc

SEQ ID NO: 4665536 - DNA, 12 bp, Homo sapiens
aatctgttttgg

SEQ ID NO: 4665537 - DNA, 14 bp, Homo sapiens
aatcttatacaaca

SEQ ID NO: 4665538 - DNA, 18 bp, Homo sapiens
aatcttcagtattttctc

SEQ ID NO: 4665539 - DNA, 16 bp, Homo sapiens
aatcttctctcttgat

SEQ ID NO: 4665540 - DNA, 14 bp, Homo sapiens
aatcttgctttctt

SEQ ID NO: 4665541 - DNA, 16 bp, Homo sapiens
aatcttgctttcttta

SEQ ID NO: 4665542 - DNA, 15 bp, Homo sapiens
aatcttgtgttaact

SEQ ID NO: 4665543 - DNA, 22 bp, Homo sapiens
aatcttgtgttaacttgcctcc

SEQ ID NO: 4665544 - DNA, 18 bp, Homo sapiens
aatctttattttattatt

SEQ ID NO: 4665545 - DNA, 19 bp, Homo sapiens
aatctttattttattattc

SEQ ID NO: 4665546 - DNA, 22 bp, Homo sapiens
aatctttattttattattcaga

SEQ ID NO: 4665547 - DNA, 21 bp, Homo sapiens
aatgaaaataaaacacacctc

SEQ ID NO: 4665548 - DNA, 15 bp, Homo sapiens
aatgaaagtggtaat

SEQ ID NO: 4665549 - DNA, 16 bp, Homo sapiens
aatgaaagtgttaatt

SEQ ID NO: 4665550 - DNA, 17 bp, Homo sapiens
aatgaaatccttttcct

SEQ ID NO: 4665551 - DNA, 20 bp, Homo sapiens
aatgaaattaacacaaagga

SEQ ID NO: 4665552 - DNA, 21 bp, Homo sapiens
aatgaacccccatgatgtaag

SEQ ID NO: 4665553 - DNA, 14 bp, Homo sapiens
aatgaagaaagtca

SEQ ID NO: 4665554 - DNA, 14 bp, Homo sapiens
aatgaagaagtttc

SEQ ID NO: 4665555 - DNA, 17 bp, Homo sapiens
aatgacacttgtcccca

SEQ ID NO: 4665556 - DNA, 15 bp, Homo sapiens
aatgaccattcaatt

SEQ ID NO: 4665557 - DNA, 19 bp, Homo sapiens
aatgaccattcaattagtg

SEQ ID NO: 4665558 - DNA, 17 bp, Homo sapiens
aatgagagcgacacaga

SEQ ID NO: 4665559 - DNA, 22 bp, Homo sapiens
aatgagagcgacacagacgtta

SEQ ID NO: 4665560 - DNA, 19 bp, Homo sapiens
aatgagcccagagaacagc

SEQ ID NO: 4665561 - DNA, 19 bp, Homo sapiens
aatgagtgaagtattgctg

SEQ ID NO: 4665562 - DNA, 19 bp, Homo sapiens
aatgatagttgattttcaa

SEQ ID NO: 4665563 - DNA, 14 bp, Homo sapiens
aatgatatcaaaga

SEQ ID NO: 4665564 - DNA, 19 bp, Homo sapiens
aatgatccccagctgttta

SEQ ID NO: 4665565 - DNA, 15 bp, Homo sapiens
aatgatcctcagtgc

SEQ ID NO: 4665566 - DNA, 22 bp, Homo sapiens
aatgatcctcagtgcaaaatgt

SEQ ID NO: 4665567 - DNA, 19 bp, Homo sapiens
aatgatgacaaaaaatgtt

SEQ ID NO: 4665568 - DNA, 14 bp, Homo sapiens
aatgatggcagagg

SEQ ID NO: 4665569 - DNA, 18 bp, Homo sapiens
aatgatttggccaggcct

SEQ ID NO: 4665570 - DNA, 13 bp, Homo sapiens
aatgattttggaa

SEQ ID NO: 4665571 - DNA, 21 bp, Homo sapiens
aatgcaatgtaagcatacttt

SEQ ID NO: 4665572 - DNA, 15 bp, Homo sapiens
aatgcactgttttta

SEQ ID NO: 4665573 - DNA, 14 bp, Homo sapiens
aatgcagaggtctc

SEQ ID NO: 4665574 - DNA, 13 bp, Homo sapiens
aatgcataatgtt

SEQ ID NO: 4665575 - DNA, 13 bp, Homo sapiens
aatttcaggaaaa

SEQ ID NO: 4665576 - DNA, 13 bp, Homo sapiens
aatttcattgcac

SEQ ID NO: 4665577 - DNA, 18 bp, Homo sapiens
aatttctataaatttaag

SEQ ID NO: 4665578 - DNA, 20 bp, Homo sapiens
aatttctttgtttaacaaaa

SEQ ID NO: 4665579 - DNA, 12 bp, Homo sapiens
aatttggcttct

SEQ ID NO: 4665580 - DNA, 12 bp, Homo sapiens
aatttgtaaact

SEQ ID NO: 4665581 - DNA, 17 bp, Homo sapiens
aatttgtttgaaatctt

SEQ ID NO: 4665582 - DNA, 17 bp, Homo sapiens
aatttgttttagccatt

SEQ ID NO: 4665583 - DNA, 16 bp, Homo sapiens
aattttaatgataaaa

SEQ ID NO: 4665584 - DNA, 21 bp, Homo sapiens
aattttaatgctgtttctaag

SEQ ID NO: 4665585 - DNA, 20 bp, Homo sapiens
aattttacatgtttataaat

SEQ ID NO: 4665586 - DNA, 15 bp, Homo sapiens
aattttaccttgttt

SEQ ID NO: 4665587 - DNA, 17 bp, Homo sapiens
aattttatttttctgtg

SEQ ID NO: 4665588 - DNA, 21 bp, Homo sapiens
aattttcaaggccttcagttt

SEQ ID NO: 4665589 - DNA, 22 bp, Homo sapiens
aattttcaaggccttcagttta

SEQ ID NO: 4665590 - DNA, 20 bp, Homo sapiens
aattttctacaaataatttt

SEQ ID NO: 4665591 - DNA, 13 bp, Homo sapiens
aattttcttgttt

SEQ ID NO: 4665592 - DNA, 16 bp, Homo sapiens
aattttcttgtttgtt

SEQ ID NO: 4665593 - DNA, 15 bp, Homo sapiens
aatttttcagatgct

SEQ ID NO: 4665594 - DNA, 19 bp, Homo sapiens
acaaaaaataaaatgaaca

SEQ ID NO: 4665595 - DNA, 15 bp, Homo sapiens
acaaaaaatgtaatt

SEQ ID NO: 4665596 - DNA, 11 bp, Homo sapiens
acaaaactgtt

SEQ ID NO: 4665597 - DNA, 22 bp, Homo sapiens
acaaaactgttcttttgcattt

SEQ ID NO: 4665598 - DNA, 13 bp, Homo sapiens
acaaaacttcttg

SEQ ID NO: 4665599 - DNA, 13 bp, Homo sapiens
acaaaacttgaaa

SEQ ID NO: 4665600 - DNA, 15 bp, Homo sapiens
acaaaagaaaagact

SEQ ID NO: 4665601 - DNA, 20 bp, Homo sapiens
acaaaagaaaagacttgtaa

SEQ ID NO: 4665602 - DNA, 15 bp, Homo sapiens
acaaaagtctgtctt

SEQ ID NO: 4665603 - DNA, 10 bp, Homo sapiens
acaaaatgga

SEQ ID NO: 4665604 - DNA, 14 bp, Homo sapiens
acaaaccacagcag

SEQ ID NO: 4665605 - DNA, 16 bp, Homo sapiens
acaaactctcaccatg

SEQ ID NO: 4665606 - DNA, 16 bp, Homo sapiens
acaaactgaagataat

SEQ ID NO: 4665607 - DNA, 14 bp, Homo sapiens
acaaagaatttaaa

SEQ ID NO: 4665608 - DNA, 16 bp, Homo sapiens
acaaagcacaccatat

SEQ ID NO: 4665609 - DNA, 18 bp, Homo sapiens
acaaagccaaacaaaact

SEQ ID NO: 4665610 - DNA, 18 bp, Homo sapiens
acaaatgcaaatttctat

SEQ ID NO: 4665611 - DNA, 22 bp, Homo sapiens
acaaatgcaaatttctataaat

SEQ ID NO: 4665612 - DNA, 19 bp, Homo sapiens
acaaatgccttaaaatgga

SEQ ID NO: 4665613 - DNA, 16 bp, Homo sapiens
acaaatgtggccaagc

SEQ ID NO: 4665614 - DNA, 23 bp, Homo sapiens
acaaatgttcatatttattgatt

SEQ ID NO: 4665615 - DNA, 14 bp, Homo sapiens
acaaatttcattgc

SEQ ID NO: 4665616 - DNA, 17 bp, Homo sapiens
acaaatttcattgcact

SEQ ID NO: 4665617 - DNA, 18 bp, Homo sapiens
acaaatttcattgcactt

SEQ ID NO: 4665618 - DNA, 22 bp, Homo sapiens
acaaatttcattgcactttcct

SEQ ID NO: 4665619 - DNA, 12 bp, Homo sapiens
acaacatcagaa

SEQ ID NO: 4665620 - DNA, 22 bp, Homo sapiens
acaaccaacagaaaacatccca

SEQ ID NO: 4665621 - DNA, 14 bp, Homo sapiens
acaaccaccattca

SEQ ID NO: 4665622 - DNA, 16 bp, Homo sapiens
acaaccagaaggccct

SEQ ID NO: 4665623 - DNA, 13 bp, Homo sapiens
acaaccgttggaa

SEQ ID NO: 4665624 - DNA, 15 bp, Homo sapiens
acaactccttccatc

SEQ ID NO: 4665625 - DNA, 12 bp, Homo sapiens
acaagaaaatgt

SEQ ID NO: 4665626 - DNA, 20 bp, Homo sapiens
acaagacagaggggagcagt

SEQ ID NO: 4665627 - DNA, 22 bp, Homo sapiens
acaagagtggagagaagctctt

SEQ ID NO: 4665628 - DNA, 13 bp, Homo sapiens
acaagcagccctt

SEQ ID NO: 4665629 - DNA, 17 bp, Homo sapiens
acaagcagcccttgctt

SEQ ID NO: 4665630 - DNA, 23 bp, Homo sapiens
acaagcatggtcccacatccctg

SEQ ID NO: 4665631 - DNA, 13 bp, Homo sapiens
acaagctgcactg

SEQ ID NO: 4665632 - DNA, 17 bp, Homo sapiens
acaagctgtccctgcag

SEQ ID NO: 4665633 - DNA, 18 bp, Homo sapiens
acaaggcagcaaggcccg

SEQ ID NO: 4665634 - DNA, 19 bp, Homo sapiens
acaaggcagcctgaacact

SEQ ID NO: 4665635 - DNA, 13 bp, Homo sapiens
acaaggcctggtc

SEQ ID NO: 4665636 - DNA, 14 bp, Homo sapiens
acaaggcctggtct

SEQ ID NO: 4665637 - DNA, 11 bp, Homo sapiens
acaagtattta

SEQ ID NO: 4665638 - DNA, 18 bp, Homo sapiens
acaagtctttctcctctt

SEQ ID NO: 4665639 - DNA, 23 bp, Homo sapiens
acaagtgaaataacaaaatggac

SEQ ID NO: 4665640 - DNA, 19 bp, Homo sapiens
acaagtggactcagggcag

SEQ ID NO: 4665641 - DNA, 11 bp, Homo sapiens
acaagtgtcta

SEQ ID NO: 4665642 - DNA, 20 bp, Homo sapiens
acaataaaattttttttcat

SEQ ID NO: 4665643 - DNA, 21 bp, Homo sapiens
acaataaaattttttttcatg

SEQ ID NO: 4665644 - DNA, 16 bp, Homo sapiens
acaataacccagttac

SEQ ID NO: 4665645 - DNA, 14 bp, Homo sapiens
acaataacttctta

SEQ ID NO: 4665646 - DNA, 23 bp, Homo sapiens
acaataagcgttaagggcagagt

SEQ ID NO: 4665647 - DNA, 22 bp, Homo sapiens
acaatccatgtgattaatgttt

SEQ ID NO: 4665648 - DNA, 15 bp, Homo sapiens
acaatcctagtgctt

SEQ ID NO: 4665649 - DNA, 20 bp, Homo sapiens
acaatctatggcttatttct

SEQ ID NO: 4665650 - DNA, 22 bp, Homo sapiens
acaatctatggcttatttctat

SEQ ID NO: 4665651 - DNA, 16 bp, Homo sapiens
acaatcttagtgaatg

SEQ ID NO: 4665652 - DNA, 14 bp, Homo sapiens
acaatgaaattttt

SEQ ID NO: 4665653 - DNA, 17 bp, Homo sapiens
acaatgaagaagtttct

SEQ ID NO: 4665654 - DNA, 23 bp, Homo sapiens
acaatgtagatggcctcttacta

SEQ ID NO: 4665655 - DNA, 13 bp, Homo sapiens
acaattcctgtgc

SEQ ID NO: 4665656 - DNA, 22 bp, Homo sapiens
acaattcgaatggggtagaaac

SEQ ID NO: 4665657 - DNA, 14 bp, Homo sapiens
acacaacacagata

SEQ ID NO: 4665658 - DNA, 14 bp, Homo sapiens
acacaccctgaggt

SEQ ID NO: 4665659 - DNA, 20 bp, Homo sapiens
acacacggttttggcagctg

SEQ ID NO: 4665660 - DNA, 12 bp, Homo sapiens
acacagagaagg

SEQ ID NO: 4665661 - DNA, 20 bp, Homo sapiens
acacagaggaatttatacct

SEQ ID NO: 4665662 - DNA, 20 bp, Homo sapiens
acacagcatgggtccagaag

SEQ ID NO: 4665663 - DNA, 17 bp, Homo sapiens
acacaggcagccagccg

SEQ ID NO: 4665664 - DNA, 20 bp, Homo sapiens
acacaggcagccagccgtgg

SEQ ID NO: 4665665 - DNA, 13 bp, Homo sapiens
acacaggcctgtg

SEQ ID NO: 4665666 - DNA, 14 bp, Homo sapiens
acacagttatcaaa

SEQ ID NO: 4665667 - DNA, 13 bp, Homo sapiens
acacattttatga

SEQ ID NO: 4665668 - DNA, 15 bp, Homo sapiens
acacatttttaaatt

SEQ ID NO: 4665669 - DNA, 14 bp, Homo sapiens
acacatttttcaga

SEQ ID NO: 4665670 - DNA, 18 bp, Homo sapiens
acaccaagcacagcagcc

SEQ ID NO: 4665671 - DNA, 14 bp, Homo sapiens
acaccaaggccctg

SEQ ID NO: 4665672 - DNA, 16 bp, Homo sapiens
acaccaaggccctgca

SEQ ID NO: 4665673 - DNA, 13 bp, Homo sapiens
acaccactctggc

SEQ ID NO: 4665674 - DNA, 17 bp, Homo sapiens
acaccactctggcagcc

SEQ ID NO: 4665675 - DNA, 18 bp, Homo sapiens
acaccactctggcagcca

SEQ ID NO: 4665676 - DNA, 22 bp, Homo sapiens
acaccactctggcagccacact

SEQ ID NO: 4665677 - DNA, 14 bp, Homo sapiens
acaccacttaatct

SEQ ID NO: 4665678 - DNA, 17 bp, Homo sapiens
acacccaggaatgaccc

SEQ ID NO: 4665679 - DNA, 17 bp, Homo sapiens
acaccctggcctgaact

SEQ ID NO: 4665680 - DNA, 19 bp, Homo sapiens
acacctggccttaaagagg

SEQ ID NO: 4665681 - DNA, 21 bp, Homo sapiens
acacctgtgtggcccagttct

SEQ ID NO: 4665682 - DNA, 13 bp, Homo sapiens
acacgagccacaa

SEQ ID NO: 4665683 - DNA, 14 bp, Homo sapiens
acacgcacctgcct

SEQ ID NO: 4665684 - DNA, 17 bp, Homo sapiens
acacgcacctgcctcag

SEQ ID NO: 4665685 - DNA, 21 bp, Homo sapiens
acacggatctgctgggctctg

SEQ ID NO: 4665686 - DNA, 18 bp, Homo sapiens
acagtccaaactgttctg

SEQ ID NO: 4665687 - DNA, 14 bp, Homo sapiens
acagtcttgtatta

SEQ ID NO: 4665688 - DNA, 15 bp, Homo sapiens
acagtcttgtattaa

SEQ ID NO: 4665689 - DNA, 18 bp, Homo sapiens
acagtcttgtattaagtt

SEQ ID NO: 4665690 - DNA, 18 bp, Homo sapiens
acagtgacactactttct

SEQ ID NO: 4665691 - DNA, 18 bp, Homo sapiens
acagtgaggcaggagaag

SEQ ID NO: 4665692 - DNA, 18 bp, Homo sapiens
acagtgccaactcctcac

SEQ ID NO: 4665693 - DNA, 19 bp, Homo sapiens
acagtgccatccccacctt

SEQ ID NO: 4665694 - DNA, 13 bp, Homo sapiens
acagtggcaggac

SEQ ID NO: 4665695 - DNA, 18 bp, Homo sapiens
acagtggcaggacaggaa

SEQ ID NO: 4665696 - DNA, 12 bp, Homo sapiens
acagtgggaaat

SEQ ID NO: 4665697 - DNA, 15 bp, Homo sapiens
acagtgggaaatatt

SEQ ID NO: 4665698 - DNA, 20 bp, Homo sapiens
acagtgggagctgagctgga

SEQ ID NO: 4665699 - DNA, 23 bp, Homo sapiens
acagtgggagctgagctggaagg

SEQ ID NO: 4665700 - DNA, 12 bp, Homo sapiens
acagtgtacagt

SEQ ID NO: 4665701 - DNA, 15 bp, Homo sapiens
acagtgtacagtctt

SEQ ID NO: 4665702 - DNA, 15 bp, Homo sapiens
acagtgtttggacag

SEQ ID NO: 4665703 - DNA, 20 bp, Homo sapiens
acagtgtttggacaggaggg

SEQ ID NO: 4665704 - DNA, 16 bp, Homo sapiens
acagttcagagatcag

SEQ ID NO: 4665705 - DNA, 23 bp, Homo sapiens
acagttgctgtgaactttcatgt

SEQ ID NO: 4665706 - DNA, 13 bp, Homo sapiens
acagtttccaaat

SEQ ID NO: 4665707 - DNA, 19 bp, Homo sapiens
acagtttcttgcttggaag

SEQ ID NO: 4665708 - DNA, 23 bp, Homo sapiens
acagtttcttgcttggaagccag

SEQ ID NO: 4665709 - DNA, 23 bp, Homo sapiens
acagttttgagtaaaaagacatt

SEQ ID NO: 4665710 - DNA, 23 bp, Homo sapiens
acataaagcactacctaagtaat

SEQ ID NO: 4665711 - DNA, 16 bp, Homo sapiens
acataaagccatgttt

SEQ ID NO: 4665712 - DNA, 18 bp, Homo sapiens
acataaccaatttgtaat

SEQ ID NO: 4665713 - DNA, 20 bp, Homo sapiens
acataaccaatttgtaatga

SEQ ID NO: 4665714 - DNA, 16 bp, Homo sapiens
acataagcaatcattt

SEQ ID NO: 4665715 - DNA, 21 bp, Homo sapiens
acataagtcctttcaattcca

SEQ ID NO: 4665716 - DNA, 19 bp, Homo sapiens
acataatgaaaatattttt

SEQ ID NO: 4665717 - DNA, 14 bp, Homo sapiens
acatacaagaaaat

SEQ ID NO: 4665718 - DNA, 16 bp, Homo sapiens
acatacggttctgtta

SEQ ID NO: 4665719 - DNA, 18 bp, Homo sapiens
acatactgtaatcaaaag

SEQ ID NO: 4665720 - DNA, 20 bp, Homo sapiens
acatagaaatggaaattttg

SEQ ID NO: 4665721 - DNA, 17 bp, Homo sapiens
acataggtcataaagca

SEQ ID NO: 4665722 - DNA, 20 bp, Homo sapiens
acataggtctgtatggctgt

SEQ ID NO: 4665723 - DNA, 19 bp, Homo sapiens
acatatatataacaaataa

SEQ ID NO: 4665724 - DNA, 12 bp, Homo sapiens
acatatgaacac

SEQ ID NO: 4665725 - DNA, 15 bp, Homo sapiens
acatatgaacacaga

SEQ ID NO: 4665726 - DNA, 24 bp, Homo sapiens
acatatgctgatcttttaaaatca

SEQ ID NO: 4665727 - DNA, 12 bp, Homo sapiens
acatatgtctta

SEQ ID NO: 4665728 - DNA, 15 bp, Homo sapiens
acatatgttcctaat

SEQ ID NO: 4665729 - DNA, 22 bp, Homo sapiens
acatattccatgtttggaagac

SEQ ID NO: 4665730 - DNA, 18 bp, Homo sapiens
acatcacaaaatgtaatt

SEQ ID NO: 4665731 - DNA, 13 bp, Homo sapiens
acatcataaatct

SEQ ID NO: 4665732 - DNA, 14 bp, Homo sapiens
acatcatgagcctt

SEQ ID NO: 4665733 - DNA, 15 bp, Homo sapiens
acatcatgagccttc

SEQ ID NO: 4665734 - DNA, 15 bp, Homo sapiens
acatccaaagcagac

SEQ ID NO: 4665735 - DNA, 16 bp, Homo sapiens
acatcccactgactgt

SEQ ID NO: 4665736 - DNA, 20 bp, Homo sapiens
acatcccagtttctcagaag

SEQ ID NO: 4665737 - DNA, 17 bp, Homo sapiens
acatcccccaatgacct

SEQ ID NO: 4665738 - DNA, 14 bp, Homo sapiens
acatccctgggcct

SEQ ID NO: 4665739 - DNA, 16 bp, Homo sapiens
acatcctctgatagct

SEQ ID NO: 4665740 - DNA, 17 bp, Homo sapiens
acatctctttgaatttt

SEQ ID NO: 4665741 - DNA, 15 bp, Homo sapiens
acatcttacttgtcc

SEQ ID NO: 4665742 - DNA, 14 bp, Homo sapiens
acatcttcatataa

SEQ ID NO: 4665743 - DNA, 17 bp, Homo sapiens
acatcttcatataaact

SEQ ID NO: 4665744 - DNA, 13 bp, Homo sapiens
acatgaagctgtt

SEQ ID NO: 4665745 - DNA, 23 bp, Homo sapiens
acatgaatcccacccacatgtga

SEQ ID NO: 4665746 - DNA, 23 bp, Homo sapiens
acatgacgccagataaaatgttc

SEQ ID NO: 4665747 - DNA, 15 bp, Homo sapiens
acatgagatcagggc

SEQ ID NO: 4665748 - DNA, 22 bp, Homo sapiens
acatgaggccatctcaggagat

SEQ ID NO: 4665749 - DNA, 15 bp, Homo sapiens
acatgatacattttt

SEQ ID NO: 4665750 - DNA, 17 bp, Homo sapiens
acatgatactgctgctt

SEQ ID NO: 4665751 - DNA, 13 bp, Homo sapiens
acatgatttcaaa

SEQ ID NO: 4665752 - DNA, 21 bp, Homo sapiens
acatgcagctcttcaacatga

SEQ ID NO: 4665753 - DNA, 17 bp, Homo sapiens
acatgccatttgtactg

SEQ ID NO: 4665754 - DNA, 17 bp, Homo sapiens
acatggcctatgcacat

SEQ ID NO: 4665755 - DNA, 18 bp, Homo sapiens
acatggcctatgcacata

SEQ ID NO: 4665756 - DNA, 15 bp, Homo sapiens
acatggtagatgctt

SEQ ID NO: 4665757 - DNA, 20 bp, Homo sapiens
acatggtagatgcttgattg

SEQ ID NO: 4665758 - DNA, 20 bp, Homo sapiens
acatgtagcttcttctgaaa

SEQ ID NO: 4665759 - DNA, 15 bp, Homo sapiens
acatgtagggcaaga

SEQ ID NO: 4665760 - DNA, 19 bp, Homo sapiens
acatgtagggcaagaggat

SEQ ID NO: 4665761 - DNA, 12 bp, Homo sapiens
acatgtcaatct

SEQ ID NO: 4665762 - DNA, 15 bp, Homo sapiens
acatgtcaatctgtc

SEQ ID NO: 4665763 - DNA, 22 bp, Homo sapiens
acatgtcttgtacatgtgtagc

SEQ ID NO: 4665764 - DNA, 14 bp, Homo sapiens
acatgtgacacata

SEQ ID NO: 4665765 - DNA, 21 bp, Homo sapiens
acatgtgacacatatgcacct

SEQ ID NO: 4665766 - DNA, 17 bp, Homo sapiens
acatgtgtagcctgtgc

SEQ ID NO: 4665767 - DNA, 18 bp, Homo sapiens
acatgtgtagcctgtgca

SEQ ID NO: 4665768 - DNA, 18 bp, Homo sapiens
acatgtgtatattccttt

SEQ ID NO: 4665769 - DNA, 15 bp, Homo sapiens
acattaaaatgacaa

SEQ ID NO: 4665770 - DNA, 14 bp, Homo sapiens
acattaacattttg

SEQ ID NO: 4665771 - DNA, 17 bp, Homo sapiens
acattaacattttgagc

SEQ ID NO: 4665772 - DNA, 21 bp, Homo sapiens
acattaacattttgagctatt

SEQ ID NO: 4665773 - DNA, 18 bp, Homo sapiens
acattaacggtgctaaaa

SEQ ID NO: 4665774 - DNA, 12 bp, Homo sapiens
acattaatttaa

SEQ ID NO: 4665775 - DNA, 13 bp, Homo sapiens
acattaggctgtt

SEQ ID NO: 4665776 - DNA, 19 bp, Homo sapiens
acattatttattaaaaatg

SEQ ID NO: 4665777 - DNA, 21 bp, Homo sapiens
acattatttattaaaaatgtt

SEQ ID NO: 4665778 - DNA, 22 bp, Homo sapiens
acattatttattaaaaatgttc

SEQ ID NO: 4665779 - DNA, 14 bp, Homo sapiens
acattcacctgccc

SEQ ID NO: 4665780 - DNA, 20 bp, Homo sapiens
acattcacctgccccaactc

SEQ ID NO: 4665781 - DNA, 13 bp, Homo sapiens
acattcagctctg

SEQ ID NO: 4665782 - DNA, 15 bp, Homo sapiens
acattcagctctgga

SEQ ID NO: 4665783 - DNA, 18 bp, Homo sapiens
acattcagctctggagaa

SEQ ID NO: 4665784 - DNA, 16 bp, Homo sapiens
acattctaatgcatat

SEQ ID NO: 4665785 - DNA, 14 bp, Homo sapiens
acattctacagttg

SEQ ID NO: 4665786 - DNA, 18 bp, Homo sapiens
acattctcacataagccc

SEQ ID NO: 4665787 - DNA, 23 bp, Homo sapiens
acattctgcctagagtgtagcct

SEQ ID NO: 4665788 - DNA, 12 bp, Homo sapiens
acattcttttaa

SEQ ID NO: 4665789 - DNA, 17 bp, Homo sapiens
acattgggcagcgccct

SEQ ID NO: 4665790 - DNA, 20 bp, Homo sapiens
acattgggcagcgcccttcc

SEQ ID NO: 4665791 - DNA, 21 bp, Homo sapiens
acattgggcagcgcccttcct

SEQ ID NO: 4665792 - DNA, 22 bp, Homo sapiens
acattgggcagcgcccttcctc

SEQ ID NO: 4665793 - DNA, 22 bp, Homo sapiens
acattgtaaatatttactcttt

SEQ ID NO: 4665794 - DNA, 12 bp, Homo sapiens
acatttaaattc

SEQ ID NO: 4665795 - DNA, 18 bp, Homo sapiens
acatttattgagatctaa

SEQ ID NO: 4665796 - DNA, 14 bp, Homo sapiens
acccctccccagtc

SEQ ID NO: 4665797 - DNA, 14 bp, Homo sapiens
acccctcccctggg

SEQ ID NO: 4665798 - DNA, 18 bp, Homo sapiens
acccctgcccctgtggga

SEQ ID NO: 4665799 - DNA, 20 bp, Homo sapiens
acccctgcccctgtgggact

SEQ ID NO: 4665800 - DNA, 13 bp, Homo sapiens
accccttcatgtc

SEQ ID NO: 4665801 - DNA, 18 bp, Homo sapiens
accccttggaggagagag

SEQ ID NO: 4665802 - DNA, 21 bp, Homo sapiens
accccttggaggagagagacc

SEQ ID NO: 4665803 - DNA, 22 bp, Homo sapiens
acccggccaggaccttggtgag

SEQ ID NO: 4665804 - DNA, 22 bp, Homo sapiens
acccgtgccaagtccaggtcct

SEQ ID NO: 4665805 - DNA, 13 bp, Homo sapiens
acccgttccaaaa

SEQ ID NO: 4665806 - DNA, 11 bp, Homo sapiens
accctcaggaa

SEQ ID NO: 4665807 - DNA, 13 bp, Homo sapiens
accctcccagacc

SEQ ID NO: 4665808 - DNA, 16 bp, Homo sapiens
accctcccagacctgc

SEQ ID NO: 4665809 - DNA, 11 bp, Homo sapiens
accctcccatg

SEQ ID NO: 4665810 - DNA, 14 bp, Homo sapiens
accctgaggagtct

SEQ ID NO: 4665811 - DNA, 19 bp, Homo sapiens
accctgaggagtctgaggt

SEQ ID NO: 4665812 - DNA, 20 bp, Homo sapiens
accctgaggtcagggagtgc

SEQ ID NO: 4665813 - DNA, 22 bp, Homo sapiens
accctgaggtcagggagtgctg

SEQ ID NO: 4665814 - DNA, 20 bp, Homo sapiens
accctgatgtgacattccat

SEQ ID NO: 4665815 - DNA, 19 bp, Homo sapiens
accctgcaaacagaacagg

SEQ ID NO: 4665816 - DNA, 23 bp, Homo sapiens
accctgcaaacagaacagggtca

SEQ ID NO: 4665817 - DNA, 12 bp, Homo sapiens
accctgcaggac

SEQ ID NO: 4665818 - DNA, 14 bp, Homo sapiens
accctgcaggactt

SEQ ID NO: 4665819 - DNA, 21 bp, Homo sapiens
accctggccgagtccaagctg

SEQ ID NO: 4665820 - DNA, 22 bp, Homo sapiens
accctggccgagtccaagctgg

SEQ ID NO: 4665821 - DNA, 16 bp, Homo sapiens
accctggcctgaactg

SEQ ID NO: 4665822 - DNA, 15 bp, Homo sapiens
accctgggctgggga

SEQ ID NO: 4665823 - DNA, 17 bp, Homo sapiens
accctgggctggggagg

SEQ ID NO: 4665824 - DNA, 19 bp, Homo sapiens
accctgggctggggaggag

SEQ ID NO: 4665825 - DNA, 23 bp, Homo sapiens
accctgggctggggaggaggaga

SEQ ID NO: 4665826 - DNA, 18 bp, Homo sapiens
acccttacagcctctgac

SEQ ID NO: 4665827 - DNA, 19 bp, Homo sapiens
acccttacagcctctgact

SEQ ID NO: 4665828 - DNA, 15 bp, Homo sapiens
acccttattgctgtc

SEQ ID NO: 4665829 - DNA, 19 bp, Homo sapiens
acccttattgctgtcctgg

SEQ ID NO: 4665830 - DNA, 16 bp, Homo sapiens
acccttgcccacccca

SEQ ID NO: 4665831 - DNA, 18 bp, Homo sapiens
acccttgctttcctgggc

SEQ ID NO: 4665832 - DNA, 23 bp, Homo sapiens
acccttttaagcatgtgatgttg

SEQ ID NO: 4665833 - DNA, 12 bp, Homo sapiens
acccttttcctt

SEQ ID NO: 4665834 - DNA, 15 bp, Homo sapiens
acccttttccttttt

SEQ ID NO: 4665835 - DNA, 23 bp, Homo sapiens
accgaatattcatggatggctca

SEQ ID NO: 4665836 - DNA, 18 bp, Homo sapiens
accgcgtctaccctggga

SEQ ID NO: 4665837 - DNA, 17 bp, Homo sapiens
accgctacaccactctg

SEQ ID NO: 4665838 - DNA, 15 bp, Homo sapiens
accggaaggaggcca

SEQ ID NO: 4665839 - DNA, 23 bp, Homo sapiens
accggaaggaggccaaccagccc

SEQ ID NO: 4665840 - DNA, 12 bp, Homo sapiens
accggcagagct

SEQ ID NO: 4665841 - DNA, 19 bp, Homo sapiens
accggcctgtgggtctctg

SEQ ID NO: 4665842 - DNA, 20 bp, Homo sapiens
accggcctgtgggtctctga

SEQ ID NO: 4665843 - DNA, 22 bp, Homo sapiens
accggcctgtgggtctctgaag

SEQ ID NO: 4665844 - DNA, 12 bp, Homo sapiens
accgggccactc

SEQ ID NO: 4665845 - DNA, 21 bp, Homo sapiens
accgggccactccttcctgcc

SEQ ID NO: 4665846 - DNA, 21 bp, Homo sapiens
accggtgcttttattgtaaag

SEQ ID NO: 4665847 - DNA, 17 bp, Homo sapiens
accgtcacactcttcag

SEQ ID NO: 4665848 - DNA, 12 bp, Homo sapiens
accgtgcctggc

SEQ ID NO: 4665849 - DNA, 16 bp, Homo sapiens
accgtggcccttcctg

SEQ ID NO: 4665850 - DNA, 22 bp, Homo sapiens
accgtggcccttcctggacagc

SEQ ID NO: 4665851 - DNA, 16 bp, Homo sapiens
accgtgggcagggagc

SEQ ID NO: 4665852 - DNA, 12 bp, Homo sapiens
acctaaatactg

SEQ ID NO: 4665853 - DNA, 22 bp, Homo sapiens
acctaatatcattttattcaca

SEQ ID NO: 4665854 - DNA, 22 bp, Homo sapiens
acctacaccattatcttggaaa

SEQ ID NO: 4665855 - DNA, 17 bp, Homo sapiens
acctacagtgtacagtc

SEQ ID NO: 4665856 - DNA, 20 bp, Homo sapiens
acctacagtgtacagtcttg

SEQ ID NO: 4665857 - DNA, 17 bp, Homo sapiens
acctactcacacaggca

SEQ ID NO: 4665858 - DNA, 18 bp, Homo sapiens
acctagaacctccctcct

SEQ ID NO: 4665859 - DNA, 21 bp, Homo sapiens
acctagaacctccctcctttc

SEQ ID NO: 4665860 - DNA, 22 bp, Homo sapiens
acctagcagcaccgttctgtgc

SEQ ID NO: 4665861 - DNA, 23 bp, Homo sapiens
acctagcagcaccgttctgtgca

SEQ ID NO: 4665862 - DNA, 14 bp, Homo sapiens
acctatctgtggaa

SEQ ID NO: 4665863 - DNA, 19 bp, Homo sapiens
acctatgagtgagaatatg

SEQ ID NO: 4665864 - DNA, 20 bp, Homo sapiens
acctcaagccccatttcctc

SEQ ID NO: 4665865 - DNA, 17 bp, Homo sapiens
acctcacaactccttcc

SEQ ID NO: 4665866 - DNA, 20 bp, Homo sapiens
acctcacaactccttccatc

SEQ ID NO: 4665867 - DNA, 15 bp, Homo sapiens
acctcaccccactta

SEQ ID NO: 4665868 - DNA, 17 bp, Homo sapiens
acctcagaccccggggt

SEQ ID NO: 4665869 - DNA, 15 bp, Homo sapiens
acctcagcactgtgg

SEQ ID NO: 4665870 - DNA, 16 bp, Homo sapiens
acctcaggtgccaacc

SEQ ID NO: 4665871 - DNA, 22 bp, Homo sapiens
acctcatctgtggagctgccac

SEQ ID NO: 4665872 - DNA, 12 bp, Homo sapiens
acctccaagcat

SEQ ID NO: 4665873 - DNA, 13 bp, Homo sapiens
acctccagcctct

SEQ ID NO: 4665874 - DNA, 18 bp, Homo sapiens
acctccagctttcctgta

SEQ ID NO: 4665875 - DNA, 23 bp, Homo sapiens
acctcccatcccgtaagaccacc

SEQ ID NO: 4665876 - DNA, 18 bp, Homo sapiens
acctcctctgccagcagg

SEQ ID NO: 4665877 - DNA, 23 bp, Homo sapiens
acctcctctgccagcaggaataa

SEQ ID NO: 4665878 - DNA, 12 bp, Homo sapiens
acctcctctgtg

SEQ ID NO: 4665879 - DNA, 13 bp, Homo sapiens
acctcctctgtga

SEQ ID NO: 4665880 - DNA, 11 bp, Homo sapiens
acctcctgctg

SEQ ID NO: 4665881 - DNA, 13 bp, Homo sapiens
acctccttcccca

SEQ ID NO: 4665882 - DNA, 18 bp, Homo sapiens
acctccttccccagctcc

SEQ ID NO: 4665883 - DNA, 23 bp, Homo sapiens
acctccttctgcaaagtggcagg

SEQ ID NO: 4665884 - DNA, 22 bp, Homo sapiens
acctcctttcaaggtaactgta

SEQ ID NO: 4665885 - DNA, 16 bp, Homo sapiens
acctcgctgggctcta

SEQ ID NO: 4665886 - DNA, 23 bp, Homo sapiens
acctcggagggatggagaaagaa

SEQ ID NO: 4665887 - DNA, 12 bp, Homo sapiens
acctctgcctcc

SEQ ID NO: 4665888 - DNA, 13 bp, Homo sapiens
acctctgcctcct

SEQ ID NO: 4665889 - DNA, 15 bp, Homo sapiens
acctctgcttcccag

SEQ ID NO: 4665890 - DNA, 17 bp, Homo sapiens
acctctgggaccccagc

SEQ ID NO: 4665891 - DNA, 18 bp, Homo sapiens
acctctgggaccccagct

SEQ ID NO: 4665892 - DNA, 19 bp, Homo sapiens
acctctgtgacccctcctt

SEQ ID NO: 4665893 - DNA, 18 bp, Homo sapiens
acctctgttccccaccca

SEQ ID NO: 4665894 - DNA, 12 bp, Homo sapiens
acctgaaaagat

SEQ ID NO: 4665895 - DNA, 22 bp, Homo sapiens
acctgacactaaccagagtcag

SEQ ID NO: 4665896 - DNA, 16 bp, Homo sapiens
acctgagcctgccgag

SEQ ID NO: 4665897 - DNA, 12 bp, Homo sapiens
acctgagctaaa

SEQ ID NO: 4665898 - DNA, 11 bp, Homo sapiens
acctgattcaa

SEQ ID NO: 4665899 - DNA, 10 bp, Homo sapiens
acctgcaaga

SEQ ID NO: 4665900 - DNA, 12 bp, Homo sapiens
acctgcacaggc

SEQ ID NO: 4665901 - DNA, 17 bp, Homo sapiens
acctgcacaggcttgct

SEQ ID NO: 4665902 - DNA, 17 bp, Homo sapiens
acctgccccgtagagaa

SEQ ID NO: 4665903 - DNA, 18 bp, Homo sapiens
acctgccccgtagagaat

SEQ ID NO: 4665904 - DNA, 20 bp, Homo sapiens
acctgccccgtagagaatgt

SEQ ID NO: 4665905 - DNA, 21 bp, Homo sapiens
acctgccccgtagagaatgtg

SEQ ID NO: 4665906 - DNA, 14 bp, Homo sapiens
actaacacaaggac

SEQ ID NO: 4665907 - DNA, 20 bp, Homo sapiens
actaacactcagaagcctgg

SEQ ID NO: 4665908 - DNA, 21 bp, Homo sapiens
actaacactcagaagcctggg

SEQ ID NO: 4665909 - DNA, 14 bp, Homo sapiens
actaaccaaatctc

SEQ ID NO: 4665910 - DNA, 14 bp, Homo sapiens
actaaggcaggtgg

SEQ ID NO: 4665911 - DNA, 16 bp, Homo sapiens
actaaggcttttattt

SEQ ID NO: 4665912 - DNA, 22 bp, Homo sapiens
actaagggaacaatccatgtga

SEQ ID NO: 4665913 - DNA, 15 bp, Homo sapiens
actaatagagtactt

SEQ ID NO: 4665914 - DNA, 20 bp, Homo sapiens
actaatagagtacttaatat

SEQ ID NO: 4665915 - DNA, 21 bp, Homo sapiens
actaatagagtacttaatata

SEQ ID NO: 4665916 - DNA, 22 bp, Homo sapiens
actaatagagtacttaatatac

SEQ ID NO: 4665917 - DNA, 21 bp, Homo sapiens
actaattatactactttgtta

SEQ ID NO: 4665918 - DNA, 17 bp, Homo sapiens
actaatttatactttaa

SEQ ID NO: 4665919 - DNA, 18 bp, Homo sapiens
actaatttttgtattatt

SEQ ID NO: 4665920 - DNA, 16 bp, Homo sapiens
actacacatttttaaa

SEQ ID NO: 4665921 - DNA, 22 bp, Homo sapiens
actacacatttttaaattgtta

SEQ ID NO: 4665922 - DNA, 21 bp, Homo sapiens
actacattttttctaataaag

SEQ ID NO: 4665923 - DNA, 15 bp, Homo sapiens
actactgcagcacct

SEQ ID NO: 4665924 - DNA, 14 bp, Homo sapiens
actactgggtgtca

SEQ ID NO: 4665925 - DNA, 17 bp, Homo sapiens
actactgggtgtcattt

SEQ ID NO: 4665926 - DNA, 21 bp, Homo sapiens
actagaggtgttacagaggac

SEQ ID NO: 4665927 - DNA, 21 bp, Homo sapiens
actagccagaattctaccctg

SEQ ID NO: 4665928 - DNA, 23 bp, Homo sapiens
actaggattgacattctacagtt

SEQ ID NO: 4665929 - DNA, 23 bp, Homo sapiens
actaggattggagtatgatttac

SEQ ID NO: 4665930 - DNA, 17 bp, Homo sapiens
actaggcattgtgatgt

SEQ ID NO: 4665931 - DNA, 19 bp, Homo sapiens
actaggcattgtgatgttt

SEQ ID NO: 4665932 - DNA, 17 bp, Homo sapiens
actagtagatttctatg

SEQ ID NO: 4665933 - DNA, 22 bp, Homo sapiens
actagttacacatcttcaacag

SEQ ID NO: 4665934 - DNA, 24 bp, Homo sapiens
actatcaccagtgcatcacatctg

SEQ ID NO: 4665935 - DNA, 14 bp, Homo sapiens
actatgatttattt

SEQ ID NO: 4665936 - DNA, 14 bp, Homo sapiens
actatgggtgagca

SEQ ID NO: 4665937 - DNA, 23 bp, Homo sapiens
actatgtatgtatgtattattat

SEQ ID NO: 4665938 - DNA, 17 bp, Homo sapiens
actatgttcctaacaaa

SEQ ID NO: 4665939 - DNA, 22 bp, Homo sapiens
actattgcagacctgtcaccct

SEQ ID NO: 4665940 - DNA, 21 bp, Homo sapiens
actatttacaagatggactta

SEQ ID NO: 4665941 - DNA, 15 bp, Homo sapiens
actattttcaaagaa

SEQ ID NO: 4665942 - DNA, 16 bp, Homo sapiens
actattttcaaagaaa

SEQ ID NO: 4665943 - DNA, 23 bp, Homo sapiens
actcaaatatgagtacaaatgcc

SEQ ID NO: 4665944 - DNA, 22 bp, Homo sapiens
actcaacaaaacccatgcattt

SEQ ID NO: 4665945 - DNA, 15 bp, Homo sapiens
actcaagctgtctct

SEQ ID NO: 4665946 - DNA, 15 bp, Homo sapiens
actcaagtgtcacct

SEQ ID NO: 4665947 - DNA, 19 bp, Homo sapiens
actcaagtgtcacctcctt

SEQ ID NO: 4665948 - DNA, 22 bp, Homo sapiens
actcacaagtgctcatctgttg

SEQ ID NO: 4665949 - DNA, 20 bp, Homo sapiens
actcacattgttcaactccc

SEQ ID NO: 4665950 - DNA, 23 bp, Homo sapiens
actcacctgcgcaagtgcctggg

SEQ ID NO: 4665951 - DNA, 14 bp, Homo sapiens
actcagaagcctgg

SEQ ID NO: 4665952 - DNA, 20 bp, Homo sapiens
actcagggcagcgccaggct

SEQ ID NO: 4665953 - DNA, 16 bp, Homo sapiens
actcagtttatgctgt

SEQ ID NO: 4665954 - DNA, 18 bp, Homo sapiens
actcataaaggtttttgt

SEQ ID NO: 4665955 - DNA, 16 bp, Homo sapiens
actcatcctcttttaa

SEQ ID NO: 4665956 - DNA, 15 bp, Homo sapiens
actcatccttgccca

SEQ ID NO: 4665957 - DNA, 17 bp, Homo sapiens
actcatccttgcccagg

SEQ ID NO: 4665958 - DNA, 16 bp, Homo sapiens
actcatgcacacagat

SEQ ID NO: 4665959 - DNA, 18 bp, Homo sapiens
actcatttatctcctctt

SEQ ID NO: 4665960 - DNA, 16 bp, Homo sapiens
actccaccctccacct

SEQ ID NO: 4665961 - DNA, 23 bp, Homo sapiens
actccacggatgcgtgggcagag

SEQ ID NO: 4665962 - DNA, 21 bp, Homo sapiens
actcccccagccccagagaaa

SEQ ID NO: 4665963 - DNA, 23 bp, Homo sapiens
actcccccctccattcccacccc

SEQ ID NO: 4665964 - DNA, 11 bp, Homo sapiens
actccctaggc

SEQ ID NO: 4665965 - DNA, 15 bp, Homo sapiens
actccctaggcccaa

SEQ ID NO: 4665966 - DNA, 18 bp, Homo sapiens
actccctaggcccaagtc

SEQ ID NO: 4665967 - DNA, 22 bp, Homo sapiens
actcccttgaagttgtggagga

SEQ ID NO: 4665968 - DNA, 14 bp, Homo sapiens
actccgccagccac

SEQ ID NO: 4665969 - DNA, 15 bp, Homo sapiens
actccgccagccaca

SEQ ID NO: 4665970 - DNA, 18 bp, Homo sapiens
actccgccagccacagga

SEQ ID NO: 4665971 - DNA, 23 bp, Homo sapiens
actccgccagccacaggaccacc

SEQ ID NO: 4665972 - DNA, 22 bp, Homo sapiens
actccgcgccgatgccaccggc

SEQ ID NO: 4665973 - DNA, 23 bp, Homo sapiens
actccgcgccgatgccaccggcc

SEQ ID NO: 4665974 - DNA, 14 bp, Homo sapiens
actcctcagtccct

SEQ ID NO: 4665975 - DNA, 16 bp, Homo sapiens
actcctcagtccctct

SEQ ID NO: 4665976 - DNA, 16 bp, Homo sapiens
actcctgaggacagct

SEQ ID NO: 4665977 - DNA, 17 bp, Homo sapiens
actcctgaggacagctg

SEQ ID NO: 4665978 - DNA, 20 bp, Homo sapiens
actcctgaggacagctgtcc

SEQ ID NO: 4665979 - DNA, 17 bp, Homo sapiens
actcctgtgggagcctc

SEQ ID NO: 4665980 - DNA, 13 bp, Homo sapiens
actccttccagct

SEQ ID NO: 4665981 - DNA, 14 bp, Homo sapiens
actccttccctaat

SEQ ID NO: 4665982 - DNA, 17 bp, Homo sapiens
actccttccctaatagc

SEQ ID NO: 4665983 - DNA, 22 bp, Homo sapiens
actccttccctaatagcttttt

SEQ ID NO: 4665984 - DNA, 11 bp, Homo sapiens
actccttcctg

SEQ ID NO: 4665985 - DNA, 13 bp, Homo sapiens
actcctttccaat

SEQ ID NO: 4665986 - DNA, 17 bp, Homo sapiens
actcctttccaatagaa

SEQ ID NO: 4665987 - DNA, 14 bp, Homo sapiens
actcggggtccctg

SEQ ID NO: 4665988 - DNA, 17 bp, Homo sapiens
actcgtcaccccagccc

SEQ ID NO: 4665989 - DNA, 18 bp, Homo sapiens
actctagatggcaacatt

SEQ ID NO: 4665990 - DNA, 21 bp, Homo sapiens
actctagatggcaacattgga

SEQ ID NO: 4665991 - DNA, 20 bp, Homo sapiens
actctagggagtatgctgga

SEQ ID NO: 4665992 - DNA, 22 bp, Homo sapiens
actctcaccatgatgtgaagag

SEQ ID NO: 4665993 - DNA, 22 bp, Homo sapiens
actctcacctgtactattgcag

SEQ ID NO: 4665994 - DNA, 22 bp, Homo sapiens
actctcccctccccatctgtgt

SEQ ID NO: 4665995 - DNA, 23 bp, Homo sapiens
actctcttctccattccctagca

SEQ ID NO: 4665996 - DNA, 14 bp, Homo sapiens
actctgacaagctg

SEQ ID NO: 4665997 - DNA, 19 bp, Homo sapiens
actctgacaagctggccaa

SEQ ID NO: 4665998 - DNA, 18 bp, Homo sapiens
actctgcacatgtcttgt

SEQ ID NO: 4665999 - DNA, 22 bp, Homo sapiens
actctgcacatgtcttgtacat

SEQ ID NO: 4666000 - DNA, 13 bp, Homo sapiens
actctgctctgat

SEQ ID NO: 4666001 - DNA, 12 bp, Homo sapiens
actctggccctg

SEQ ID NO: 4666002 - DNA, 13 bp, Homo sapiens
actctgtattaca

SEQ ID NO: 4666003 - DNA, 11 bp, Homo sapiens
actctgtgcca

SEQ ID NO: 4666004 - DNA, 15 bp, Homo sapiens
actctgtgtctgagt

SEQ ID NO: 4666005 - DNA, 16 bp, Homo sapiens
actctgtgtctgagtg

SEQ ID NO: 4666006 - DNA, 15 bp, Homo sapiens
actctgttcctggct

SEQ ID NO: 4666007 - DNA, 12 bp, Homo sapiens
actctgttgcct

SEQ ID NO: 4666008 - DNA, 13 bp, Homo sapiens
actctgttgcctc

SEQ ID NO: 4666009 - DNA, 22 bp, Homo sapiens
actcttcagtgactcctgctgg

SEQ ID NO: 4666010 - DNA, 23 bp, Homo sapiens
actcttcagtgactcctgctggt

SEQ ID NO: 4666011 - DNA, 22 bp, Homo sapiens
actcttctgactgccccctcct

SEQ ID NO: 4666012 - DNA, 21 bp, Homo sapiens
actcttgatttcacatttcta

SEQ ID NO: 4666013 - DNA, 21 bp, Homo sapiens
actcttgtcacccaggctgga

SEQ ID NO: 4666014 - DNA, 20 bp, Homo sapiens
actcttgttgaagtgctgtt

SEQ ID NO: 4666015 - DNA, 16 bp, Homo sapiens
agaaacttcattcaga

SEQ ID NO: 4666016 - DNA, 18 bp, Homo sapiens
agaaactttctggtgctg

SEQ ID NO: 4666017 - DNA, 18 bp, Homo sapiens
agaaagaagatagtgaga

SEQ ID NO: 4666018 - DNA, 22 bp, Homo sapiens
agaaagaccctgatgcaggtca

SEQ ID NO: 4666019 - DNA, 16 bp, Homo sapiens
agaaagagctgcctgg

SEQ ID NO: 4666020 - DNA, 20 bp, Homo sapiens
agaaagagctgcctggatga

SEQ ID NO: 4666021 - DNA, 23 bp, Homo sapiens
agaaagaggtgaccccagggcac

SEQ ID NO: 4666022 - DNA, 18 bp, Homo sapiens
agaaagcctaaaattgag

SEQ ID NO: 4666023 - DNA, 14 bp, Homo sapiens
agaaaggctctgaa

SEQ ID NO: 4666024 - DNA, 19 bp, Homo sapiens
agaaagggacccacctgct

SEQ ID NO: 4666025 - DNA, 15 bp, Homo sapiens
agaaagggagggctc

SEQ ID NO: 4666026 - DNA, 14 bp, Homo sapiens
agaaagggtgtttt

SEQ ID NO: 4666027 - DNA, 18 bp, Homo sapiens
agaaagtcaaaaaattat

SEQ ID NO: 4666028 - DNA, 19 bp, Homo sapiens
agaaagtcaaaaaattatt

SEQ ID NO: 4666029 - DNA, 16 bp, Homo sapiens
agaaatacccatgtta

SEQ ID NO: 4666030 - DNA, 15 bp, Homo sapiens
agaaatagttgtctg

SEQ ID NO: 4666031 - DNA, 14 bp, Homo sapiens
agaaatatattttt

SEQ ID NO: 4666032 - DNA, 16 bp, Homo sapiens
agaaatatattttttg

SEQ ID NO: 4666033 - DNA, 21 bp, Homo sapiens
agaaatgctggtttttcagtt

SEQ ID NO: 4666034 - DNA, 20 bp, Homo sapiens
agaaattcgcatgtttaatg

SEQ ID NO: 4666035 - DNA, 22 bp, Homo sapiens
agaaattcgcatgtttaatgtg

SEQ ID NO: 4666036 - DNA, 18 bp, Homo sapiens
agaaatttttcagatgct

SEQ ID NO: 4666037 - DNA, 21 bp, Homo sapiens
agaaatttttcagatgcttct

SEQ ID NO: 4666038 - DNA, 23 bp, Homo sapiens
agaaatttttcagatgcttctgg

SEQ ID NO: 4666039 - DNA, 17 bp, Homo sapiens
agaacacaaaacttgaa

SEQ ID NO: 4666040 - DNA, 20 bp, Homo sapiens
agaacacagcaattcctcag

SEQ ID NO: 4666041 - DNA, 19 bp, Homo sapiens
agaacaggaggtgtgaatg

SEQ ID NO: 4666042 - DNA, 21 bp, Homo sapiens
agaacaggaggtgtgaatgca

SEQ ID NO: 4666043 - DNA, 18 bp, Homo sapiens
agaacatacatgatacat

SEQ ID NO: 4666044 - DNA, 22 bp, Homo sapiens
agaacattcagctctggagaac

SEQ ID NO: 4666045 - DNA, 17 bp, Homo sapiens
agaacgtggctctgctg

SEQ ID NO: 4666046 - DNA, 18 bp, Homo sapiens
agaacgtggctctgctgg

SEQ ID NO: 4666047 - DNA, 19 bp, Homo sapiens
agaacgtggctctgctggc

SEQ ID NO: 4666048 - DNA, 16 bp, Homo sapiens
agaacgttttttcctc

SEQ ID NO: 4666049 - DNA, 15 bp, Homo sapiens
agaactagcatatag

SEQ ID NO: 4666050 - DNA, 19 bp, Homo sapiens
agaactcactctgggctgt

SEQ ID NO: 4666051 - DNA, 13 bp, Homo sapiens
agaactctctgga

SEQ ID NO: 4666052 - DNA, 16 bp, Homo sapiens
agaactctctggaagc

SEQ ID NO: 4666053 - DNA, 14 bp, Homo sapiens
agaactgtctgtga

SEQ ID NO: 4666054 - DNA, 16 bp, Homo sapiens
agaactttgtattttc

SEQ ID NO: 4666055 - DNA, 20 bp, Homo sapiens
agaagacattttctcttaga

SEQ ID NO: 4666056 - DNA, 16 bp, Homo sapiens
agaagacgggagggga

SEQ ID NO: 4666057 - DNA, 17 bp, Homo sapiens
agaagacgggaggggag

SEQ ID NO: 4666058 - DNA, 20 bp, Homo sapiens
agaagacgggaggggaggca

SEQ ID NO: 4666059 - DNA, 21 bp, Homo sapiens
agaagacgggaggggaggcat

SEQ ID NO: 4666060 - DNA, 20 bp, Homo sapiens
agaagagggggaggggaagc

SEQ ID NO: 4666061 - DNA, 17 bp, Homo sapiens
agaagatagtgagattt

SEQ ID NO: 4666062 - DNA, 12 bp, Homo sapiens
agaagcaagaca

SEQ ID NO: 4666063 - DNA, 19 bp, Homo sapiens
agaagcacagctcctgcca

SEQ ID NO: 4666064 - DNA, 11 bp, Homo sapiens
agaagcctggg

SEQ ID NO: 4666065 - DNA, 12 bp, Homo sapiens
agaagcctgggg

SEQ ID NO: 4666066 - DNA, 13 bp, Homo sapiens
agaagcctggggg

SEQ ID NO: 4666067 - DNA, 19 bp, Homo sapiens
agaagcctgggggcctggc

SEQ ID NO: 4666068 - DNA, 20 bp, Homo sapiens
agaagcctgggggcctggct

SEQ ID NO: 4666069 - DNA, 20 bp, Homo sapiens
agaagcgtttttaacctgtt

SEQ ID NO: 4666070 - DNA, 23 bp, Homo sapiens
agaagctatattagctgaaacaa

SEQ ID NO: 4666071 - DNA, 12 bp, Homo sapiens
agaagctttatc

SEQ ID NO: 4666072 - DNA, 20 bp, Homo sapiens
agaaggaaggcctgagcccc

SEQ ID NO: 4666073 - DNA, 16 bp, Homo sapiens
agaaggagaaggctgg

SEQ ID NO: 4666074 - DNA, 22 bp, Homo sapiens
agaaggctatgtaaacaaacca

SEQ ID NO: 4666075 - DNA, 15 bp, Homo sapiens
agaagggggccctgc

SEQ ID NO: 4666076 - DNA, 16 bp, Homo sapiens
agaagggggccctgct

SEQ ID NO: 4666077 - DNA, 17 bp, Homo sapiens
agaagggggctctgccc

SEQ ID NO: 4666078 - DNA, 21 bp, Homo sapiens
agaagggggctctgccccagg

SEQ ID NO: 4666079 - DNA, 23 bp, Homo sapiens
agaaggtggtggcatttttgctt

SEQ ID NO: 4666080 - DNA, 20 bp, Homo sapiens
agaaggtttgtgtttttctg

SEQ ID NO: 4666081 - DNA, 20 bp, Homo sapiens
agaagtgaggatgagaccca

SEQ ID NO: 4666082 - DNA, 23 bp, Homo sapiens
agaagtgaggatgagacccagcc

SEQ ID NO: 4666083 - DNA, 15 bp, Homo sapiens
agaagtggagacagt

SEQ ID NO: 4666084 - DNA, 12 bp, Homo sapiens
agaatagctttt

SEQ ID NO: 4666085 - DNA, 13 bp, Homo sapiens
agaatatttacta

SEQ ID NO: 4666086 - DNA, 22 bp, Homo sapiens
agaatcagtaggaccaggccac

SEQ ID NO: 4666087 - DNA, 22 bp, Homo sapiens
agaatcatacttaacatttcat

SEQ ID NO: 4666088 - DNA, 20 bp, Homo sapiens
agaatgagagcgacacagac

SEQ ID NO: 4666089 - DNA, 16 bp, Homo sapiens
agaatgagtgaagtat

SEQ ID NO: 4666090 - DNA, 17 bp, Homo sapiens
agaatgctggcaaaggc

SEQ ID NO: 4666091 - DNA, 18 bp, Homo sapiens
agaatggataaaataatg

SEQ ID NO: 4666092 - DNA, 17 bp, Homo sapiens
agaatgtccccttaggt

SEQ ID NO: 4666093 - DNA, 17 bp, Homo sapiens
agaatgtgtgtgtgtgg

SEQ ID NO: 4666094 - DNA, 17 bp, Homo sapiens
agaatgttgtacttgaa

SEQ ID NO: 4666095 - DNA, 13 bp, Homo sapiens
agaattactttgt

SEQ ID NO: 4666096 - DNA, 17 bp, Homo sapiens
agaattactttgtgttg

SEQ ID NO: 4666097 - DNA, 18 bp, Homo sapiens
agaattctgtattggata

SEQ ID NO: 4666098 - DNA, 15 bp, Homo sapiens
agaattgatcagaat

SEQ ID NO: 4666099 - DNA, 23 bp, Homo sapiens
agaatttttttttaaattttatt

SEQ ID NO: 4666100 - DNA, 15 bp, Homo sapiens
agacaaaacagataa

SEQ ID NO: 4666101 - DNA, 23 bp, Homo sapiens
agacaacaggtaaaacagggcca

SEQ ID NO: 4666102 - DNA, 19 bp, Homo sapiens
agacaagacagaggggagc

SEQ ID NO: 4666103 - DNA, 13 bp, Homo sapiens
agacaagcagccc

SEQ ID NO: 4666104 - DNA, 14 bp, Homo sapiens
agacaagcagccct

SEQ ID NO: 4666105 - DNA, 15 bp, Homo sapiens
agacaagcagccctt

SEQ ID NO: 4666106 - DNA, 19 bp, Homo sapiens
agacaagcagcccttgctt

SEQ ID NO: 4666107 - DNA, 14 bp, Homo sapiens
agacaaggtgctaa

SEQ ID NO: 4666108 - DNA, 20 bp, Homo sapiens
agacaatgatttggccaggc

SEQ ID NO: 4666109 - DNA, 21 bp, Homo sapiens
agacaatgatttggccaggcc

SEQ ID NO: 4666110 - DNA, 16 bp, Homo sapiens
agacacatgctatgtt

SEQ ID NO: 4666111 - DNA, 17 bp, Homo sapiens
agacaccgttcattcag

SEQ ID NO: 4666112 - DNA, 20 bp, Homo sapiens
agacactcccccctccattc

SEQ ID NO: 4666113 - DNA, 15 bp, Homo sapiens
agacactctgacaag

SEQ ID NO: 4666114 - DNA, 17 bp, Homo sapiens
agacactctgacaagct

SEQ ID NO: 4666115 - DNA, 15 bp, Homo sapiens
agacagaggatgtgg

SEQ ID NO: 4666116 - DNA, 17 bp, Homo sapiens
agacagcccaggatact

SEQ ID NO: 4666117 - DNA, 21 bp, Homo sapiens
agacagctccaccctggccga

SEQ ID NO: 4666118 - DNA, 12 bp, Homo sapiens
agacagtcttgc

SEQ ID NO: 4666119 - DNA, 11 bp, Homo sapiens
agacataaagc

SEQ ID NO: 4666120 - DNA, 22 bp, Homo sapiens
agacatccataaagaagcaata

SEQ ID NO: 4666121 - DNA, 16 bp, Homo sapiens
agacatgcccaaaact

SEQ ID NO: 4666122 - DNA, 14 bp, Homo sapiens
agacattcttttaa

SEQ ID NO: 4666123 - DNA, 16 bp, Homo sapiens
agacattttctcttag

SEQ ID NO: 4666124 - DNA, 21 bp, Homo sapiens
agaccaccttcccttcctcag

SEQ ID NO: 4666125 - DNA, 24 bp, Homo sapiens
agaggccctggatcagcgtggcct

SEQ ID NO: 4666126 - DNA, 19 bp, Homo sapiens
agaggctgaggctggcaca

SEQ ID NO: 4666127 - DNA, 15 bp, Homo sapiens
agagggaacaaaact

SEQ ID NO: 4666128 - DNA, 22 bp, Homo sapiens
agagggacaaccagaaggccct

SEQ ID NO: 4666129 - DNA, 15 bp, Homo sapiens
agagggacaggctga

SEQ ID NO: 4666130 - DNA, 13 bp, Homo sapiens
agagggagaagaa

SEQ ID NO: 4666131 - DNA, 18 bp, Homo sapiens
agaggggcagatggaaag

SEQ ID NO: 4666132 - DNA, 18 bp, Homo sapiens
agaggtactagaatgctt

SEQ ID NO: 4666133 - DNA, 15 bp, Homo sapiens
agaggtcagcacaca

SEQ ID NO: 4666134 - DNA, 15 bp, Homo sapiens
agaggtgaccccagg

SEQ ID NO: 4666135 - DNA, 14 bp, Homo sapiens
agaggttctgcctc

SEQ ID NO: 4666136 - DNA, 15 bp, Homo sapiens
agagtacctgtgtgt

SEQ ID NO: 4666137 - DNA, 16 bp, Homo sapiens
agagtacctgtgtgtt

SEQ ID NO: 4666138 - DNA, 12 bp, Homo sapiens
agagtcctgcct

SEQ ID NO: 4666139 - DNA, 19 bp, Homo sapiens
agagtggagagaagctctt

SEQ ID NO: 4666140 - DNA, 14 bp, Homo sapiens
agagtgggccccgg

SEQ ID NO: 4666141 - DNA, 22 bp, Homo sapiens
agagtgggccccgggctggaga

SEQ ID NO: 4666142 - DNA, 23 bp, Homo sapiens
agagtgggccccgggctggagaa

SEQ ID NO: 4666143 - DNA, 22 bp, Homo sapiens
agagtgtagcctaaagggcagg

SEQ ID NO: 4666144 - DNA, 15 bp, Homo sapiens
agagtgtgtgtttgt

SEQ ID NO: 4666145 - DNA, 21 bp, Homo sapiens
agagttgtgatggaggggaga

SEQ ID NO: 4666146 - DNA, 21 bp, Homo sapiens
agataaagaaactgaggccca

SEQ ID NO: 4666147 - DNA, 21 bp, Homo sapiens
agataacctaataattgtatc

SEQ ID NO: 4666148 - DNA, 22 bp, Homo sapiens
agataacctaataattgtatct

SEQ ID NO: 4666149 - DNA, 14 bp, Homo sapiens
agataatatttttg

SEQ ID NO: 4666150 - DNA, 21 bp, Homo sapiens
agataatatttttgtatttct

SEQ ID NO: 4666151 - DNA, 22 bp, Homo sapiens
agatacaggactggttccttcc

SEQ ID NO: 4666152 - DNA, 14 bp, Homo sapiens
agatagagagctat

SEQ ID NO: 4666153 - DNA, 18 bp, Homo sapiens
agatagcattgtgaactg

SEQ ID NO: 4666154 - DNA, 15 bp, Homo sapiens
agatataaaagactg

SEQ ID NO: 4666155 - DNA, 17 bp, Homo sapiens
agatatatgtgtataca

SEQ ID NO: 4666156 - DNA, 21 bp, Homo sapiens
agatatgccactaacttctaa

SEQ ID NO: 4666157 - DNA, 16 bp, Homo sapiens
agatattgatattgaa

SEQ ID NO: 4666158 - DNA, 21 bp, Homo sapiens
agatatttaggaaaatgctta

SEQ ID NO: 4666159 - DNA, 23 bp, Homo sapiens
agatatttcaagctcatgtcatt

SEQ ID NO: 4666160 - DNA, 17 bp, Homo sapiens
agatcaacgcctcactg

SEQ ID NO: 4666161 - DNA, 12 bp, Homo sapiens
agatcaagctgt

SEQ ID NO: 4666162 - DNA, 18 bp, Homo sapiens
agatcacagccccaccct

SEQ ID NO: 4666163 - DNA, 17 bp, Homo sapiens
agatcagaacattcagc

SEQ ID NO: 4666164 - DNA, 18 bp, Homo sapiens
agatcagaacattcagct

SEQ ID NO: 4666165 - DNA, 21 bp, Homo sapiens
agatcagaacattcagctctg

SEQ ID NO: 4666166 - DNA, 23 bp, Homo sapiens
agatcagaacattcagctctgga

SEQ ID NO: 4666167 - DNA, 23 bp, Homo sapiens
agatcagggcctgccccctgggg

SEQ ID NO: 4666168 - DNA, 18 bp, Homo sapiens
agatcatatacgtgaaaa

SEQ ID NO: 4666169 - DNA, 21 bp, Homo sapiens
agatcatccagaagttcctca

SEQ ID NO: 4666170 - DNA, 18 bp, Homo sapiens
agatccctattagataca

SEQ ID NO: 4666171 - DNA, 22 bp, Homo sapiens
agatccctattagatacacttc

SEQ ID NO: 4666172 - DNA, 15 bp, Homo sapiens
agatcgacagacagc

SEQ ID NO: 4666173 - DNA, 16 bp, Homo sapiens
agatctcggtttgcca

SEQ ID NO: 4666174 - DNA, 19 bp, Homo sapiens
agatgaactgactgaagga

SEQ ID NO: 4666175 - DNA, 22 bp, Homo sapiens
agatgaactgactgaaggaaaa

SEQ ID NO: 4666176 - DNA, 22 bp, Homo sapiens
agatgaagtttgtagttgtttt

SEQ ID NO: 4666177 - DNA, 15 bp, Homo sapiens
agatgaccagggatg

SEQ ID NO: 4666178 - DNA, 15 bp, Homo sapiens
agatgactattactt

SEQ ID NO: 4666179 - DNA, 13 bp, Homo sapiens
agatgagcctggg

SEQ ID NO: 4666180 - DNA, 11 bp, Homo sapiens
agatgaggccc

SEQ ID NO: 4666181 - DNA, 12 bp, Homo sapiens
agatgaggccct

SEQ ID NO: 4666182 - DNA, 14 bp, Homo sapiens
agatgaggccctgc

SEQ ID NO: 4666183 - DNA, 20 bp, Homo sapiens
agatgataaaagagaagcca

SEQ ID NO: 4666184 - DNA, 13 bp, Homo sapiens
agatgcagggcag

SEQ ID NO: 4666185 - DNA, 21 bp, Homo sapiens
agatgccccctccaggagaga

SEQ ID NO: 4666186 - DNA, 20 bp, Homo sapiens
agatgctgatggagccttcc

SEQ ID NO: 4666187 - DNA, 15 bp, Homo sapiens
agatgcttctgggag

SEQ ID NO: 4666188 - DNA, 22 bp, Homo sapiens
agatggaagcttactctctgct

SEQ ID NO: 4666189 - DNA, 19 bp, Homo sapiens
agatggagggcttggccca

SEQ ID NO: 4666190 - DNA, 22 bp, Homo sapiens
agatggagggcttggcccagcg

SEQ ID NO: 4666191 - DNA, 11 bp, Homo sapiens
agatggagtcc

SEQ ID NO: 4666192 - DNA, 20 bp, Homo sapiens
agatggcaacattggacaga

SEQ ID NO: 4666193 - DNA, 19 bp, Homo sapiens
agatggcatcctgtgaagt

SEQ ID NO: 4666194 - DNA, 22 bp, Homo sapiens
agatggcctcttactaatgtaa

SEQ ID NO: 4666195 - DNA, 17 bp, Homo sapiens
agatggctttcagggca

SEQ ID NO: 4666196 - DNA, 16 bp, Homo sapiens
agatgggccaggcaga

SEQ ID NO: 4666197 - DNA, 16 bp, Homo sapiens
agatgtgatcaggccc

SEQ ID NO: 4666198 - DNA, 19 bp, Homo sapiens
agatgtgatcaggccccac

SEQ ID NO: 4666199 - DNA, 12 bp, Homo sapiens
agatgttgctct

SEQ ID NO: 4666200 - DNA, 14 bp, Homo sapiens
agatgttgctcttt

SEQ ID NO: 4666201 - DNA, 21 bp, Homo sapiens
agatgtttggatattttttgg

SEQ ID NO: 4666202 - DNA, 23 bp, Homo sapiens
agatgtttgttttcaaaatactt

SEQ ID NO: 4666203 - DNA, 19 bp, Homo sapiens
agattatgagacacaggat

SEQ ID NO: 4666204 - DNA, 18 bp, Homo sapiens
agattgcatgtgactctg

SEQ ID NO: 4666205 - DNA, 19 bp, Homo sapiens
agattgcatgtgactctga

SEQ ID NO: 4666206 - DNA, 23 bp, Homo sapiens
agattgcatgtgactctgaagct

SEQ ID NO: 4666207 - DNA, 15 bp, Homo sapiens
agattgctgcaaaga

SEQ ID NO: 4666208 - DNA, 20 bp, Homo sapiens
agattgggccgcctctcctc

SEQ ID NO: 4666209 - DNA, 13 bp, Homo sapiens
agattgtactgtt

SEQ ID NO: 4666210 - DNA, 14 bp, Homo sapiens
agattgttggtgaa

SEQ ID NO: 4666211 - DNA, 17 bp, Homo sapiens
agattgttggtgaattt

SEQ ID NO: 4666212 - DNA, 22 bp, Homo sapiens
agatttaagtgaatacattaac

SEQ ID NO: 4666213 - DNA, 16 bp, Homo sapiens
agatttactaaatcaa

SEQ ID NO: 4666214 - DNA, 14 bp, Homo sapiens
agattttaaagaca

SEQ ID NO: 4666215 - DNA, 16 bp, Homo sapiens
agattttcattttagt

SEQ ID NO: 4666216 - DNA, 19 bp, Homo sapiens
agattttcctccattttta

SEQ ID NO: 4666217 - DNA, 23 bp, Homo sapiens
agattttcctccatttttatttc

SEQ ID NO: 4666218 - DNA, 12 bp, Homo sapiens
agatttttttgt

SEQ ID NO: 4666219 - DNA, 23 bp, Homo sapiens
agatttttttttccacttttgtt

SEQ ID NO: 4666220 - DNA, 11 bp, Homo sapiens
agcaaaccatt

SEQ ID NO: 4666221 - DNA, 12 bp, Homo sapiens
agcaaaccatta

SEQ ID NO: 4666222 - DNA, 18 bp, Homo sapiens
agcaaactatgatttatt

SEQ ID NO: 4666223 - DNA, 12 bp, Homo sapiens
agcaaagcctgt

SEQ ID NO: 4666224 - DNA, 11 bp, Homo sapiens
agcaacacaga

SEQ ID NO: 4666225 - DNA, 16 bp, Homo sapiens
agcaacagatagatgt

SEQ ID NO: 4666226 - DNA, 22 bp, Homo sapiens
agcaaccgtggcccttcctgga

SEQ ID NO: 4666227 - DNA, 16 bp, Homo sapiens
agcaacggccccagcg

SEQ ID NO: 4666228 - DNA, 22 bp, Homo sapiens
agcaagacacgtggcctcgtga

SEQ ID NO: 4666229 - DNA, 12 bp, Homo sapiens
agcaagaggagg

SEQ ID NO: 4666230 - DNA, 19 bp, Homo sapiens
agcaagagggaacaaaact

SEQ ID NO: 4666231 - DNA, 21 bp, Homo sapiens
agcaagagggaacaaaactgt

SEQ ID NO: 4666232 - DNA, 18 bp, Homo sapiens
agcaagatattgatcaaa

SEQ ID NO: 4666233 - DNA, 20 bp, Homo sapiens
agcaagatattgatcaaata

SEQ ID NO: 4666234 - DNA, 12 bp, Homo sapiens
agccacctgcaa

SEQ ID NO: 4666235 - DNA, 13 bp, Homo sapiens
agccacctgcaag

SEQ ID NO: 4666236 - DNA, 19 bp, Homo sapiens
agccacctgcaagatggac

SEQ ID NO: 4666237 - DNA, 15 bp, Homo sapiens
agccactctgttcct

SEQ ID NO: 4666238 - DNA, 20 bp, Homo sapiens
agccagaacgtggctctgct

SEQ ID NO: 4666239 - DNA, 20 bp, Homo sapiens
agccagagacagaggatgtg

SEQ ID NO: 4666240 - DNA, 22 bp, Homo sapiens
agccagagacagaggatgtggc

SEQ ID NO: 4666241 - DNA, 16 bp, Homo sapiens
agccagattctcttga

SEQ ID NO: 4666242 - DNA, 20 bp, Homo sapiens
agccagattctcttgaataa

SEQ ID NO: 4666243 - DNA, 18 bp, Homo sapiens
agccagcacacagggcag

SEQ ID NO: 4666244 - DNA, 21 bp, Homo sapiens
agccagcacttgtccagctga

SEQ ID NO: 4666245 - DNA, 9 bp, Homo sapiens
agccagcca

SEQ ID NO: 4666246 - DNA, 15 bp, Homo sapiens
agccagccctgcctg

SEQ ID NO: 4666247 - DNA, 16 bp, Homo sapiens
agccagccctgcctgg

SEQ ID NO: 4666248 - DNA, 21 bp, Homo sapiens
agccagccctgcctggaggac

SEQ ID NO: 4666249 - DNA, 16 bp, Homo sapiens
agccaggagcagccct

SEQ ID NO: 4666250 - DNA, 14 bp, Homo sapiens
agccaggatgccca

SEQ ID NO: 4666251 - DNA, 11 bp, Homo sapiens
agccaggcccc

SEQ ID NO: 4666252 - DNA, 15 bp, Homo sapiens
agccaggccccaccc

SEQ ID NO: 4666253 - DNA, 16 bp, Homo sapiens
agccaggccccacccc

SEQ ID NO: 4666254 - DNA, 21 bp, Homo sapiens
agccaggccccaccccttccc

SEQ ID NO: 4666255 - DNA, 22 bp, Homo sapiens
agccaggccccaccccttccct

SEQ ID NO: 4666256 - DNA, 18 bp, Homo sapiens
agccagggtctctccctc

SEQ ID NO: 4666257 - DNA, 21 bp, Homo sapiens
agccagggtctctccctcagg

SEQ ID NO: 4666258 - DNA, 22 bp, Homo sapiens
agccagggtctctccctcaggt

SEQ ID NO: 4666259 - DNA, 12 bp, Homo sapiens
agccaggtctcc

SEQ ID NO: 4666260 - DNA, 15 bp, Homo sapiens
agccagtgctgtctg

SEQ ID NO: 4666261 - DNA, 16 bp, Homo sapiens
agccatgtagccaccc

SEQ ID NO: 4666262 - DNA, 17 bp, Homo sapiens
agccatgtagccaccca

SEQ ID NO: 4666263 - DNA, 14 bp, Homo sapiens
agccatttcttata

SEQ ID NO: 4666264 - DNA, 15 bp, Homo sapiens
agcccaaagcctgag

SEQ ID NO: 4666265 - DNA, 17 bp, Homo sapiens
agcccaaagcctgagga

SEQ ID NO: 4666266 - DNA, 21 bp, Homo sapiens
agcccaaagcctgaggacaga

SEQ ID NO: 4666267 - DNA, 20 bp, Homo sapiens
agcccaaagtggtatagaaa

SEQ ID NO: 4666268 - DNA, 23 bp, Homo sapiens
agcccaaagtggtatagaaatgc

SEQ ID NO: 4666269 - DNA, 21 bp, Homo sapiens
agcccaaggacagttcagaga

SEQ ID NO: 4666270 - DNA, 24 bp, Homo sapiens
agcccaaggacagttcagagatca

SEQ ID NO: 4666271 - DNA, 14 bp, Homo sapiens
agcccagagcctgg

SEQ ID NO: 4666272 - DNA, 21 bp, Homo sapiens
agcccagagcctggctgccca

SEQ ID NO: 4666273 - DNA, 16 bp, Homo sapiens
agcccagcgccatcct

SEQ ID NO: 4666274 - DNA, 14 bp, Homo sapiens
agcccagcggccca

SEQ ID NO: 4666275 - DNA, 17 bp, Homo sapiens
agcccagcggcccaaga

SEQ ID NO: 4666276 - DNA, 14 bp, Homo sapiens
agcccagctggcct

SEQ ID NO: 4666277 - DNA, 15 bp, Homo sapiens
agcccagctgggtca

SEQ ID NO: 4666278 - DNA, 21 bp, Homo sapiens
agcccaggaaaaactggaagc

SEQ ID NO: 4666279 - DNA, 13 bp, Homo sapiens
agcccaggatctc

SEQ ID NO: 4666280 - DNA, 16 bp, Homo sapiens
agcccagggaggccga

SEQ ID NO: 4666281 - DNA, 14 bp, Homo sapiens
agcccagtgttttc

SEQ ID NO: 4666282 - DNA, 22 bp, Homo sapiens
agcccagtgttttctttgagga

SEQ ID NO: 4666283 - DNA, 20 bp, Homo sapiens
agcccatccattaggccagc

SEQ ID NO: 4666284 - DNA, 12 bp, Homo sapiens
agccccaccctt

SEQ ID NO: 4666285 - DNA, 11 bp, Homo sapiens
agccccaggca

SEQ ID NO: 4666286 - DNA, 20 bp, Homo sapiens
agcccccaccaggggaagga

SEQ ID NO: 4666287 - DNA, 19 bp, Homo sapiens
agcccccaccgtgggcagg

SEQ ID NO: 4666288 - DNA, 13 bp, Homo sapiens
agccccctcctgg

SEQ ID NO: 4666289 - DNA, 15 bp, Homo sapiens
agccccgggcttggc

SEQ ID NO: 4666290 - DNA, 13 bp, Homo sapiens
agcccctaagtgc

SEQ ID NO: 4666291 - DNA, 16 bp, Homo sapiens
agcccctcacttccag

SEQ ID NO: 4666292 - DNA, 20 bp, Homo sapiens
agcccctcctccagcccctg

SEQ ID NO: 4666293 - DNA, 14 bp, Homo sapiens
agcccctgggccca

SEQ ID NO: 4666294 - DNA, 11 bp, Homo sapiens
agcccctgtcc

SEQ ID NO: 4666295 - DNA, 12 bp, Homo sapiens
agcccctgtccc

SEQ ID NO: 4666296 - DNA, 16 bp, Homo sapiens
agcccctgttttctgc

SEQ ID NO: 4666297 - DNA, 19 bp, Homo sapiens
agcccctgttttctgctgt

SEQ ID NO: 4666298 - DNA, 17 bp, Homo sapiens
agccccttatttttagc

SEQ ID NO: 4666299 - DNA, 14 bp, Homo sapiens
agccccttcccctg

SEQ ID NO: 4666300 - DNA, 19 bp, Homo sapiens
agccccttctgctcagctc

SEQ ID NO: 4666301 - DNA, 22 bp, Homo sapiens
agcccctttgcctgtcaagttg

SEQ ID NO: 4666302 - DNA, 20 bp, Homo sapiens
agcccgacagtgccatcccc

SEQ ID NO: 4666303 - DNA, 16 bp, Homo sapiens
agcccgtgccaccccc

SEQ ID NO: 4666304 - DNA, 23 bp, Homo sapiens
agcccgtgccacccccagccctg

SEQ ID NO: 4666305 - DNA, 19 bp, Homo sapiens
agccctcagctggtcctga

SEQ ID NO: 4666306 - DNA, 22 bp, Homo sapiens
agccctcagctggtcctgacca

SEQ ID NO: 4666307 - DNA, 17 bp, Homo sapiens
agccctctcactgtgtc

SEQ ID NO: 4666308 - DNA, 12 bp, Homo sapiens
agccctgcccac

SEQ ID NO: 4666309 - DNA, 12 bp, Homo sapiens
agccctgcctgg

SEQ ID NO: 4666310 - DNA, 14 bp, Homo sapiens
agccctgcctggag

SEQ ID NO: 4666311 - DNA, 11 bp, Homo sapiens
agccctgctag

SEQ ID NO: 4666312 - DNA, 20 bp, Homo sapiens
agcccttggcttgtgttatc

SEQ ID NO: 4666313 - DNA, 19 bp, Homo sapiens
agccgactctggccctggc

SEQ ID NO: 4666314 - DNA, 18 bp, Homo sapiens
agccgtgctcgccccagc

SEQ ID NO: 4666315 - DNA, 20 bp, Homo sapiens
agccgtttgaatatatttta

SEQ ID NO: 4666316 - DNA, 21 bp, Homo sapiens
agccgtttgaatatattttat

SEQ ID NO: 4666317 - DNA, 15 bp, Homo sapiens
agcctaaagggcagg

SEQ ID NO: 4666318 - DNA, 16 bp, Homo sapiens
agcctaaagggcaggg

SEQ ID NO: 4666319 - DNA, 17 bp, Homo sapiens
agcctaaagggcagggc

SEQ ID NO: 4666320 - DNA, 22 bp, Homo sapiens
agcctaaagggcagggcccacg

SEQ ID NO: 4666321 - DNA, 23 bp, Homo sapiens
agcctaaagggcagggcccacgt

SEQ ID NO: 4666322 - DNA, 16 bp, Homo sapiens
agcctacgctgaagat

SEQ ID NO: 4666323 - DNA, 19 bp, Homo sapiens
agcctatcaaaggaaatga

SEQ ID NO: 4666324 - DNA, 16 bp, Homo sapiens
agcctcaaaacgggtc

SEQ ID NO: 4666325 - DNA, 14 bp, Homo sapiens
agcctcaaatgcag

SEQ ID NO: 4666326 - DNA, 21 bp, Homo sapiens
agcctcacccctgcccctgtg

SEQ ID NO: 4666327 - DNA, 22 bp, Homo sapiens
agcctcacccctgcccctgtgg

SEQ ID NO: 4666328 - DNA, 20 bp, Homo sapiens
agcctcacttcctttgccct

SEQ ID NO: 4666329 - DNA, 19 bp, Homo sapiens
agcctcccaaaatggtggg

SEQ ID NO: 4666330 - DNA, 18 bp, Homo sapiens
agcctccgacgctgcctc

SEQ ID NO: 4666331 - DNA, 18 bp, Homo sapiens
agcctcgcaacccgtgcc

SEQ ID NO: 4666332 - DNA, 15 bp, Homo sapiens
agcctcgctttttca

SEQ ID NO: 4666333 - DNA, 16 bp, Homo sapiens
agcctcgctttttcat

SEQ ID NO: 4666334 - DNA, 18 bp, Homo sapiens
agcctcttattccaggag

SEQ ID NO: 4666335 - DNA, 19 bp, Homo sapiens
agcctcttattccaggaga

SEQ ID NO: 4666336 - DNA, 21 bp, Homo sapiens
agcctcttattccaggagaag

SEQ ID NO: 4666337 - DNA, 13 bp, Homo sapiens
agcctgaggacag

SEQ ID NO: 4666338 - DNA, 14 bp, Homo sapiens
agcctgaggtgccc

SEQ ID NO: 4666339 - DNA, 17 bp, Homo sapiens
agcctgaggtgcccact

SEQ ID NO: 4666340 - DNA, 15 bp, Homo sapiens
agcctgcattgagct

SEQ ID NO: 4666341 - DNA, 13 bp, Homo sapiens
agcctggcctcct

SEQ ID NO: 4666342 - DNA, 19 bp, Homo sapiens
agcctgggcctatggagag

SEQ ID NO: 4666343 - DNA, 13 bp, Homo sapiens
agcctggggctct

SEQ ID NO: 4666344 - DNA, 17 bp, Homo sapiens
agcctgtgcgtcccagc

SEQ ID NO: 4666345 - DNA, 23 bp, Homo sapiens
agcctgtgtctttaaatgctgct

SEQ ID NO: 4666346 - DNA, 16 bp, Homo sapiens
agcctgttcatggcag

SEQ ID NO: 4666347 - DNA, 12 bp, Homo sapiens
agccttccagtt

SEQ ID NO: 4666348 - DNA, 19 bp, Homo sapiens
agccttcccccagcaaggc

SEQ ID NO: 4666349 - DNA, 20 bp, Homo sapiens
agcctttgaatgctaagaat

SEQ ID NO: 4666350 - DNA, 15 bp, Homo sapiens
agcgaacatcttcat

SEQ ID NO: 4666351 - DNA, 15 bp, Homo sapiens
agcgagtggatgctg

SEQ ID NO: 4666352 - DNA, 19 bp, Homo sapiens
agcgagtggatgctgtgct

SEQ ID NO: 4666353 - DNA, 23 bp, Homo sapiens
agcgattccctctcccaggcccc

SEQ ID NO: 4666354 - DNA, 14 bp, Homo sapiens
agcgatttgaaaca

SEQ ID NO: 4666355 - DNA, 16 bp, Homo sapiens
agcgccctgcagaccc

SEQ ID NO: 4666356 - DNA, 19 bp, Homo sapiens
agcgccctgcagaccctgc

SEQ ID NO: 4666357 - DNA, 17 bp, Homo sapiens
agcgcccttcctctcca

SEQ ID NO: 4666358 - DNA, 15 bp, Homo sapiens
agcggacagtggcag

SEQ ID NO: 4666359 - DNA, 14 bp, Homo sapiens
agcggcccaagagc

SEQ ID NO: 4666360 - DNA, 17 bp, Homo sapiens
agcggcccaagagcccg

SEQ ID NO: 4666361 - DNA, 18 bp, Homo sapiens
agcgggatggggatggga

SEQ ID NO: 4666362 - DNA, 13 bp, Homo sapiens
agcgggcggaggg

SEQ ID NO: 4666363 - DNA, 16 bp, Homo sapiens
agcgggtgcaagcact

SEQ ID NO: 4666364 - DNA, 16 bp, Homo sapiens
agcgtaaaatggtgaa

SEQ ID NO: 4666365 - DNA, 21 bp, Homo sapiens
agcgtacatacggttctgtta

SEQ ID NO: 4666366 - DNA, 18 bp, Homo sapiens
agcgtggccttgttctgt

SEQ ID NO: 4666367 - DNA, 20 bp, Homo sapiens
agcgtgggctcagcagggct

SEQ ID NO: 4666368 - DNA, 22 bp, Homo sapiens
agcgtgggctcagcagggctgg

SEQ ID NO: 4666369 - DNA, 15 bp, Homo sapiens
agcgttaagggcaga

SEQ ID NO: 4666370 - DNA, 14 bp, Homo sapiens
agctaaaaatatta

SEQ ID NO: 4666371 - DNA, 17 bp, Homo sapiens
agctaaattcagggaga

SEQ ID NO: 4666372 - DNA, 16 bp, Homo sapiens
agctaacagggaaggc

SEQ ID NO: 4666373 - DNA, 20 bp, Homo sapiens
agctaacagggaaggcaggc

SEQ ID NO: 4666374 - DNA, 21 bp, Homo sapiens
agctaaccacttcgcacacac

SEQ ID NO: 4666375 - DNA, 21 bp, Homo sapiens
agctaagggtgggtgctcaga

SEQ ID NO: 4666376 - DNA, 20 bp, Homo sapiens
agctacctgtgtggacagga

SEQ ID NO: 4666377 - DNA, 15 bp, Homo sapiens
agctacttggcaggc

SEQ ID NO: 4666378 - DNA, 19 bp, Homo sapiens
agctacttggcaggctgag

SEQ ID NO: 4666379 - DNA, 19 bp, Homo sapiens
agctagaaaaataaaatgt

SEQ ID NO: 4666380 - DNA, 11 bp, Homo sapiens
agctagaaatg

SEQ ID NO: 4666381 - DNA, 13 bp, Homo sapiens
agctagacaatga

SEQ ID NO: 4666382 - DNA, 16 bp, Homo sapiens
agctaggagcaaagcc

SEQ ID NO: 4666383 - DNA, 21 bp, Homo sapiens
agctaggagcaaagcctgttc

SEQ ID NO: 4666384 - DNA, 16 bp, Homo sapiens
agctaggccccagagg

SEQ ID NO: 4666385 - DNA, 17 bp, Homo sapiens
agctagtgacccacatg

SEQ ID NO: 4666386 - DNA, 20 bp, Homo sapiens
agctagtgacccacatgcca

SEQ ID NO: 4666387 - DNA, 21 bp, Homo sapiens
agctagtgacccacatgccat

SEQ ID NO: 4666388 - DNA, 19 bp, Homo sapiens
agctatattagctgaaaca

SEQ ID NO: 4666389 - DNA, 18 bp, Homo sapiens
agctatcagtaggctaat

SEQ ID NO: 4666390 - DNA, 24 bp, Homo sapiens
agctatctggtcaacctcctggac

SEQ ID NO: 4666391 - DNA, 17 bp, Homo sapiens
agctatggtgagatgca

SEQ ID NO: 4666392 - DNA, 13 bp, Homo sapiens
agctatttccttc

SEQ ID NO: 4666393 - DNA, 16 bp, Homo sapiens
agctcacaaggcagca

SEQ ID NO: 4666394 - DNA, 14 bp, Homo sapiens
agctcaggtgcctt

SEQ ID NO: 4666395 - DNA, 17 bp, Homo sapiens
agctcatcccccctgct

SEQ ID NO: 4666396 - DNA, 24 bp, Homo sapiens
agctcatcccccctgctgcccagt

SEQ ID NO: 4666397 - DNA, 17 bp, Homo sapiens
agctcatgtcattatga

SEQ ID NO: 4666398 - DNA, 23 bp, Homo sapiens
agctcatgtcattatgacatttc

SEQ ID NO: 4666399 - DNA, 13 bp, Homo sapiens
agctcccccaggc

SEQ ID NO: 4666400 - DNA, 14 bp, Homo sapiens
agctcccccaggca

SEQ ID NO: 4666401 - DNA, 15 bp, Homo sapiens
agctcccccaggcag

SEQ ID NO: 4666402 - DNA, 15 bp, Homo sapiens
agctcccctgcctta

SEQ ID NO: 4666403 - DNA, 19 bp, Homo sapiens
agctcctagtatgccctgt

SEQ ID NO: 4666404 - DNA, 12 bp, Homo sapiens
agctcctctgtc

SEQ ID NO: 4666405 - DNA, 18 bp, Homo sapiens
agctcctctgtctcgagc

SEQ ID NO: 4666406 - DNA, 14 bp, Homo sapiens
agctcctgccaggg

SEQ ID NO: 4666407 - DNA, 16 bp, Homo sapiens
agctctctaggcctct

SEQ ID NO: 4666408 - DNA, 19 bp, Homo sapiens
agctctctaggcctctcca

SEQ ID NO: 4666409 - DNA, 21 bp, Homo sapiens
agctctgaaatcaactctctt

SEQ ID NO: 4666410 - DNA, 22 bp, Homo sapiens
agctctgaagaactctctggaa

SEQ ID NO: 4666411 - DNA, 13 bp, Homo sapiens
agctctgagaggc

SEQ ID NO: 4666412 - DNA, 15 bp, Homo sapiens
agctctgagaggccc

SEQ ID NO: 4666413 - DNA, 16 bp, Homo sapiens
agctctgagaggccct

SEQ ID NO: 4666414 - DNA, 21 bp, Homo sapiens
agctctgagaggccctggatc

SEQ ID NO: 4666415 - DNA, 11 bp, Homo sapiens
agctctggaga

SEQ ID NO: 4666416 - DNA, 15 bp, Homo sapiens
agctcttcccttgct

SEQ ID NO: 4666417 - DNA, 17 bp, Homo sapiens
agctctttccaaattaa

SEQ ID NO: 4666418 - DNA, 21 bp, Homo sapiens
agctcttttttgtttgtttct

SEQ ID NO: 4666419 - DNA, 23 bp, Homo sapiens
agctcttttttgtttgtttcttt

SEQ ID NO: 4666420 - DNA, 19 bp, Homo sapiens
agctgaaaagggcactccc

SEQ ID NO: 4666421 - DNA, 19 bp, Homo sapiens
agctgaaggcagtggcagg

SEQ ID NO: 4666422 - DNA, 20 bp, Homo sapiens
agctgaataacctgcacagg

SEQ ID NO: 4666423 - DNA, 22 bp, Homo sapiens
agctgaataacctgcacaggct

SEQ ID NO: 4666424 - DNA, 20 bp, Homo sapiens
agctgaatgcctcctgtggg

SEQ ID NO: 4666425 - DNA, 16 bp, Homo sapiens
agctgactgaatgcag

SEQ ID NO: 4666426 - DNA, 19 bp, Homo sapiens
agctgagactacaagtgtg

SEQ ID NO: 4666427 - DNA, 14 bp, Homo sapiens
agctgagcagggcc

SEQ ID NO: 4666428 - DNA, 12 bp, Homo sapiens
agctgagcgcca

SEQ ID NO: 4666429 - DNA, 14 bp, Homo sapiens
agctgagcgccagg

SEQ ID NO: 4666430 - DNA, 15 bp, Homo sapiens
agctgagcgccagga

SEQ ID NO: 4666431 - DNA, 21 bp, Homo sapiens
agctgagctcacaaggcagca

SEQ ID NO: 4666432 - DNA, 11 bp, Homo sapiens
agctgagctgg

SEQ ID NO: 4666433 - DNA, 16 bp, Homo sapiens
agctgaggcaggggga

SEQ ID NO: 4666434 - DNA, 22 bp, Homo sapiens
agctgaggccacactcagcaca

SEQ ID NO: 4666435 - DNA, 16 bp, Homo sapiens
agctgaggtgcccagg

SEQ ID NO: 4666436 - DNA, 12 bp, Homo sapiens
agctgcacggca

SEQ ID NO: 4666437 - DNA, 14 bp, Homo sapiens
agctgcactgtgaa

SEQ ID NO: 4666438 - DNA, 14 bp, Homo sapiens
agctgcaggggcat

SEQ ID NO: 4666439 - DNA, 13 bp, Homo sapiens
agctgccacagag

SEQ ID NO: 4666440 - DNA, 18 bp, Homo sapiens
agctgcccctctctgggc

SEQ ID NO: 4666441 - DNA, 22 bp, Homo sapiens
agctgcgggggcaggccgggcc

SEQ ID NO: 4666442 - DNA, 18 bp, Homo sapiens
aggactaacactcagaag

SEQ ID NO: 4666443 - DNA, 21 bp, Homo sapiens
aggactaacactcagaagcct

SEQ ID NO: 4666444 - DNA, 17 bp, Homo sapiens
aggactcccaaccctgg

SEQ ID NO: 4666445 - DNA, 19 bp, Homo sapiens
aggactcccaaccctggct

SEQ ID NO: 4666446 - DNA, 18 bp, Homo sapiens
aggactggttccttcctt

SEQ ID NO: 4666447 - DNA, 15 bp, Homo sapiens
aggagaagagaggaa

SEQ ID NO: 4666448 - DNA, 18 bp, Homo sapiens
aggagaagcacagctcct

SEQ ID NO: 4666449 - DNA, 20 bp, Homo sapiens
aggagactttacaaaccttt

SEQ ID NO: 4666450 - DNA, 12 bp, Homo sapiens
aggagagaagaa

SEQ ID NO: 4666451 - DNA, 15 bp, Homo sapiens
aggagagagtcccag

SEQ ID NO: 4666452 - DNA, 15 bp, Homo sapiens
aggagaggcagcatg

SEQ ID NO: 4666453 - DNA, 17 bp, Homo sapiens
aggagatgaccagggat

SEQ ID NO: 4666454 - DNA, 20 bp, Homo sapiens
aggagcaaaaatctgagaaa

SEQ ID NO: 4666455 - DNA, 16 bp, Homo sapiens
aggagcaaagcctgtt

SEQ ID NO: 4666456 - DNA, 18 bp, Homo sapiens
aggagcagccctggcccc

SEQ ID NO: 4666457 - DNA, 11 bp, Homo sapiens
aggagcctgtg

SEQ ID NO: 4666458 - DNA, 12 bp, Homo sapiens
aggagcctgtga

SEQ ID NO: 4666459 - DNA, 13 bp, Homo sapiens
aggagcctgtgaa

SEQ ID NO: 4666460 - DNA, 20 bp, Homo sapiens
aggagcctgtgaacccagga

SEQ ID NO: 4666461 - DNA, 21 bp, Homo sapiens
aggagcctgtgaacccaggac

SEQ ID NO: 4666462 - DNA, 12 bp, Homo sapiens
aggagctacctg

SEQ ID NO: 4666463 - DNA, 15 bp, Homo sapiens
aggagctacctgtgt

SEQ ID NO: 4666464 - DNA, 23 bp, Homo sapiens
aggagctacctgtgtggacagga

SEQ ID NO: 4666465 - DNA, 22 bp, Homo sapiens
aggagctcaacggtctggcagg

SEQ ID NO: 4666466 - DNA, 19 bp, Homo sapiens
aggagcttcttcgttcctg

SEQ ID NO: 4666467 - DNA, 17 bp, Homo sapiens
aggaggaatgctggact

SEQ ID NO: 4666468 - DNA, 19 bp, Homo sapiens
aggaggaatgctggactgg

SEQ ID NO: 4666469 - DNA, 22 bp, Homo sapiens
aggaggaatgctggactggagg

SEQ ID NO: 4666470 - DNA, 21 bp, Homo sapiens
aggaggaccagtcaggatgag

SEQ ID NO: 4666471 - DNA, 13 bp, Homo sapiens
aggaggaggagtc

SEQ ID NO: 4666472 - DNA, 20 bp, Homo sapiens
aggaggagtcagatgaggcc

SEQ ID NO: 4666473 - DNA, 22 bp, Homo sapiens
aggaggagtcagatgaggccct

SEQ ID NO: 4666474 - DNA, 17 bp, Homo sapiens
aggaggatgtccctggg

SEQ ID NO: 4666475 - DNA, 14 bp, Homo sapiens
aggagggacaaagg

SEQ ID NO: 4666476 - DNA, 18 bp, Homo sapiens
aggagggacaaaggagcc

SEQ ID NO: 4666477 - DNA, 20 bp, Homo sapiens
aggagggacaaaggagcctg

SEQ ID NO: 4666478 - DNA, 21 bp, Homo sapiens
aggagggacaaaggagcctgt

SEQ ID NO: 4666479 - DNA, 20 bp, Homo sapiens
aggagggggtcgtggagagc

SEQ ID NO: 4666480 - DNA, 16 bp, Homo sapiens
aggagggtttgggcag

SEQ ID NO: 4666481 - DNA, 20 bp, Homo sapiens
aggagtaatctgtgtacaaa

SEQ ID NO: 4666482 - DNA, 17 bp, Homo sapiens
aggagtcagatgaggcc

SEQ ID NO: 4666483 - DNA, 19 bp, Homo sapiens
aggagtcagatgaggccct

SEQ ID NO: 4666484 - DNA, 15 bp, Homo sapiens
aggagtctattttgt

SEQ ID NO: 4666485 - DNA, 13 bp, Homo sapiens
aggagtctgaggt

SEQ ID NO: 4666486 - DNA, 17 bp, Homo sapiens
aggagtctgaggtcctg

SEQ ID NO: 4666487 - DNA, 23 bp, Homo sapiens
aggagtctgaggtcctgagcact

SEQ ID NO: 4666488 - DNA, 20 bp, Homo sapiens
aggagtgccataccttctcc

SEQ ID NO: 4666489 - DNA, 23 bp, Homo sapiens
aggagtgccataccttctcccag

SEQ ID NO: 4666490 - DNA, 18 bp, Homo sapiens
aggagtgggttgatttca

SEQ ID NO: 4666491 - DNA, 15 bp, Homo sapiens
aggataaaatggtac

SEQ ID NO: 4666492 - DNA, 13 bp, Homo sapiens
aggataactctgt

SEQ ID NO: 4666493 - DNA, 21 bp, Homo sapiens
aggataataattttatagaaa

SEQ ID NO: 4666494 - DNA, 17 bp, Homo sapiens
aggatagctaactgtaa

SEQ ID NO: 4666495 - DNA, 17 bp, Homo sapiens
aggatatccttatcaga

SEQ ID NO: 4666496 - DNA, 22 bp, Homo sapiens
aggatctcctgccagcccagct

SEQ ID NO: 4666497 - DNA, 23 bp, Homo sapiens
aggatctctgagaccacagaggc

SEQ ID NO: 4666498 - DNA, 15 bp, Homo sapiens
aggatgagacccagc

SEQ ID NO: 4666499 - DNA, 14 bp, Homo sapiens
aggatgaggccccg

SEQ ID NO: 4666500 - DNA, 15 bp, Homo sapiens
aggatgaggccccgc

SEQ ID NO: 4666501 - DNA, 18 bp, Homo sapiens
aggatgaggccccgcctt

SEQ ID NO: 4666502 - DNA, 22 bp, Homo sapiens
aggatgaggccccgccttttcc

SEQ ID NO: 4666503 - DNA, 14 bp, Homo sapiens
aggatgaggtctcg

SEQ ID NO: 4666504 - DNA, 22 bp, Homo sapiens
aggatgcaacaaatgtggccaa

SEQ ID NO: 4666505 - DNA, 23 bp, Homo sapiens
aggatggttttgggactagaggc

SEQ ID NO: 4666506 - DNA, 17 bp, Homo sapiens
aggatgtccctgggcca

SEQ ID NO: 4666507 - DNA, 17 bp, Homo sapiens
aggattttaatttcagg

SEQ ID NO: 4666508 - DNA, 21 bp, Homo sapiens
aggattttaatttcaggaaaa

SEQ ID NO: 4666509 - DNA, 13 bp, Homo sapiens
aggcaaggaggag

SEQ ID NO: 4666510 - DNA, 21 bp, Homo sapiens
aggcaataagaattactttgt

SEQ ID NO: 4666511 - DNA, 19 bp, Homo sapiens
aggcaatggcctaaacttc

SEQ ID NO: 4666512 - DNA, 19 bp, Homo sapiens
aggcaattcagtcctgggc

SEQ ID NO: 4666513 - DNA, 15 bp, Homo sapiens
aggcacagtgggagc

SEQ ID NO: 4666514 - DNA, 20 bp, Homo sapiens
aggcaccgccacgtcccagc

SEQ ID NO: 4666515 - DNA, 21 bp, Homo sapiens
aggcaccgccacgtcccagca

SEQ ID NO: 4666516 - DNA, 16 bp, Homo sapiens
aggcactccaaacctg

SEQ ID NO: 4666517 - DNA, 20 bp, Homo sapiens
aggcactgttcaatactgta

SEQ ID NO: 4666518 - DNA, 23 bp, Homo sapiens
aggcagaaatagttgtctgtgct

SEQ ID NO: 4666519 - DNA, 18 bp, Homo sapiens
aggcagaagcttggagga

SEQ ID NO: 4666520 - DNA, 23 bp, Homo sapiens
aggcagacagcaggcagcgccaa

SEQ ID NO: 4666521 - DNA, 12 bp, Homo sapiens
aggcagagggca

SEQ ID NO: 4666522 - DNA, 13 bp, Homo sapiens
aggcagatgccct

SEQ ID NO: 4666523 - DNA, 15 bp, Homo sapiens
aggcagcaaggcccg

SEQ ID NO: 4666524 - DNA, 16 bp, Homo sapiens
aggcagcaaggcccga

SEQ ID NO: 4666525 - DNA, 23 bp, Homo sapiens
aggcagcaaggcccgagcagctg

SEQ ID NO: 4666526 - DNA, 18 bp, Homo sapiens
aggcagcatgcttgggct

SEQ ID NO: 4666527 - DNA, 11 bp, Homo sapiens
aggcagcatgg

SEQ ID NO: 4666528 - DNA, 13 bp, Homo sapiens
aggcagccagcca

SEQ ID NO: 4666529 - DNA, 16 bp, Homo sapiens
aggcagcctgaacact

SEQ ID NO: 4666530 - DNA, 17 bp, Homo sapiens
aggcagcctgaacactc

SEQ ID NO: 4666531 - DNA, 20 bp, Homo sapiens
aggcagcctggacatagaga

SEQ ID NO: 4666532 - DNA, 19 bp, Homo sapiens
aggcagcgccaagtgcgtg

SEQ ID NO: 4666533 - DNA, 16 bp, Homo sapiens
aggcaggcagggctct

SEQ ID NO: 4666534 - DNA, 14 bp, Homo sapiens
aggcaggcattgag

SEQ ID NO: 4666535 - DNA, 15 bp, Homo sapiens
aggcagggctctcct

SEQ ID NO: 4666536 - DNA, 17 bp, Homo sapiens
aggcagggctctcctgg

SEQ ID NO: 4666537 - DNA, 14 bp, Homo sapiens
aggcagtggcaggg

SEQ ID NO: 4666538 - DNA, 17 bp, Homo sapiens
aggcagtggcaggggag

SEQ ID NO: 4666539 - DNA, 18 bp, Homo sapiens
aggcagtggcaggggagc

SEQ ID NO: 4666540 - DNA, 20 bp, Homo sapiens
aggcagtggcaggggagcag

SEQ ID NO: 4666541 - DNA, 18 bp, Homo sapiens
aggcattcctgaagggaa

SEQ ID NO: 4666542 - DNA, 19 bp, Homo sapiens
aggcattgaggaagagtct

SEQ ID NO: 4666543 - DNA, 14 bp, Homo sapiens
aggcatttcctgct

SEQ ID NO: 4666544 - DNA, 22 bp, Homo sapiens
aggcatttcctgctgaacgttt

SEQ ID NO: 4666545 - DNA, 17 bp, Homo sapiens
aggcatttcctgggtgg

SEQ ID NO: 4666546 - DNA, 17 bp, Homo sapiens
aggccaaaatcaagagt

SEQ ID NO: 4666547 - DNA, 16 bp, Homo sapiens
aggccaaacatggcca

SEQ ID NO: 4666548 - DNA, 15 bp, Homo sapiens
aggccaaacctctgt

SEQ ID NO: 4666549 - DNA, 13 bp, Homo sapiens
aggccaaccagcc

SEQ ID NO: 4666550 - DNA, 20 bp, Homo sapiens
aggccaccattataatttat

SEQ ID NO: 4666551 - DNA, 21 bp, Homo sapiens
aggccaccattataatttata

SEQ ID NO: 4666552 - DNA, 14 bp, Homo sapiens
aggccagacctgca

SEQ ID NO: 4666553 - DNA, 14 bp, Homo sapiens
aggccagcaacgct

SEQ ID NO: 4666554 - DNA, 17 bp, Homo sapiens
aggccagcctggcctcc

SEQ ID NO: 4666555 - DNA, 19 bp, Homo sapiens
aggccagcctggcctcctg

SEQ ID NO: 4666556 - DNA, 20 bp, Homo sapiens
aggccagcctggcctcctgc

SEQ ID NO: 4666557 - DNA, 23 bp, Homo sapiens
aggccagcctggcctcctgcctc

SEQ ID NO: 4666558 - DNA, 18 bp, Homo sapiens
aggccatctcagcttgct

SEQ ID NO: 4666559 - DNA, 16 bp, Homo sapiens
aggccatctcaggaga

SEQ ID NO: 4666560 - DNA, 18 bp, Homo sapiens
aggccatctcaggagatg

SEQ ID NO: 4666561 - DNA, 19 bp, Homo sapiens
aggccatctcaggagatgg

SEQ ID NO: 4666562 - DNA, 21 bp, Homo sapiens
aggccatctgggctcctccag

SEQ ID NO: 4666563 - DNA, 19 bp, Homo sapiens
aggcccaaagcacttgctt

SEQ ID NO: 4666564 - DNA, 23 bp, Homo sapiens
aggcccacggtttcagctagaca

SEQ ID NO: 4666565 - DNA, 22 bp, Homo sapiens
aggccccaactcaagtgtcacc

SEQ ID NO: 4666566 - DNA, 20 bp, Homo sapiens
aggccccacaaggcctggtc

SEQ ID NO: 4666567 - DNA, 15 bp, Homo sapiens
aggccccacccctgt

SEQ ID NO: 4666568 - DNA, 13 bp, Homo sapiens
aggccccagaggc

SEQ ID NO: 4666569 - DNA, 14 bp, Homo sapiens
aggccccagaggcc

SEQ ID NO: 4666570 - DNA, 18 bp, Homo sapiens
aggccccagaggccctgg

SEQ ID NO: 4666571 - DNA, 22 bp, Homo sapiens
aggccccagaggccctggaggt

SEQ ID NO: 4666572 - DNA, 16 bp, Homo sapiens
aggccccatgacctcc

SEQ ID NO: 4666573 - DNA, 17 bp, Homo sapiens
aggccccatgacctcca

SEQ ID NO: 4666574 - DNA, 20 bp, Homo sapiens
aggccccatgacctccagct

SEQ ID NO: 4666575 - DNA, 18 bp, Homo sapiens
aggcccccacccttgggc

SEQ ID NO: 4666576 - DNA, 19 bp, Homo sapiens
aggcccccccagaagcaag

SEQ ID NO: 4666577 - DNA, 19 bp, Homo sapiens
aggcccccgtcagggagag

SEQ ID NO: 4666578 - DNA, 21 bp, Homo sapiens
aggccccgccttttcccccac

SEQ ID NO: 4666579 - DNA, 15 bp, Homo sapiens
aggcccgagcagctg

SEQ ID NO: 4666580 - DNA, 21 bp, Homo sapiens
aggcccgagcagctgagcagg

SEQ ID NO: 4666581 - DNA, 12 bp, Homo sapiens
aggccctgcatc

SEQ ID NO: 4666582 - DNA, 20 bp, Homo sapiens
aggccctggaggtctccagg

SEQ ID NO: 4666583 - DNA, 18 bp, Homo sapiens
aggccctggatcagcgtg

SEQ ID NO: 4666584 - DNA, 14 bp, Homo sapiens
aggccctgtctctg

SEQ ID NO: 4666585 - DNA, 16 bp, Homo sapiens
aggccggcagcgggcg

SEQ ID NO: 4666586 - DNA, 21 bp, Homo sapiens
aggcctagtaaccaaggccct

SEQ ID NO: 4666587 - DNA, 18 bp, Homo sapiens
aggcctagtacaatcttg

SEQ ID NO: 4666588 - DNA, 23 bp, Homo sapiens
aggcctcacccctcccctgggac

SEQ ID NO: 4666589 - DNA, 20 bp, Homo sapiens
aggcctcgaaaaccatcaca

SEQ ID NO: 4666590 - DNA, 16 bp, Homo sapiens
aggcctcgagcagaga

SEQ ID NO: 4666591 - DNA, 14 bp, Homo sapiens
aggcctcgcaggaa

SEQ ID NO: 4666592 - DNA, 15 bp, Homo sapiens
aggcctctgtgccgc

SEQ ID NO: 4666593 - DNA, 22 bp, Homo sapiens
aggcctgggtgatctgctgctg

SEQ ID NO: 4666594 - DNA, 24 bp, Homo sapiens
aggcctgtgtagctgtgacctgct

SEQ ID NO: 4666595 - DNA, 16 bp, Homo sapiens
aggccttcagacacat

SEQ ID NO: 4666596 - DNA, 14 bp, Homo sapiens
aggccttgtcccag

SEQ ID NO: 4666597 - DNA, 22 bp, Homo sapiens
aggcgcactgtgacccccagct

SEQ ID NO: 4666598 - DNA, 18 bp, Homo sapiens
aggctaaagcccagagac

SEQ ID NO: 4666599 - DNA, 14 bp, Homo sapiens
aggctaatgtcaaa

SEQ ID NO: 4666600 - DNA, 13 bp, Homo sapiens
aggctagacagaa

SEQ ID NO: 4666601 - DNA, 15 bp, Homo sapiens
aggctagacttagat

SEQ ID NO: 4666602 - DNA, 10 bp, Homo sapiens
aggctcaggt

SEQ ID NO: 4666603 - DNA, 22 bp, Homo sapiens
aggctctgcacagacaagcagc

SEQ ID NO: 4666604 - DNA, 17 bp, Homo sapiens
aggctgaccacagcaca

SEQ ID NO: 4666605 - DNA, 21 bp, Homo sapiens
aggctgaccacagcacagcca

SEQ ID NO: 4666606 - DNA, 13 bp, Homo sapiens
aggctggagaagg

SEQ ID NO: 4666607 - DNA, 20 bp, Homo sapiens
aggctggagtgcagtggcat

SEQ ID NO: 4666608 - DNA, 20 bp, Homo sapiens
aggctggagtgtagtggcat

SEQ ID NO: 4666609 - DNA, 13 bp, Homo sapiens
aggctggattcta

SEQ ID NO: 4666610 - DNA, 21 bp, Homo sapiens
aggctggcctatgtggtctaa

SEQ ID NO: 4666611 - DNA, 18 bp, Homo sapiens
aggctgggctctgcctgt

SEQ ID NO: 4666612 - DNA, 21 bp, Homo sapiens
aggctgggctctgcctgtctg

SEQ ID NO: 4666613 - DNA, 20 bp, Homo sapiens
aggctgtaactgagagaaag

SEQ ID NO: 4666614 - DNA, 21 bp, Homo sapiens
aggctgttggttcaaactttt

SEQ ID NO: 4666615 - DNA, 17 bp, Homo sapiens
aggcttaagaactgctt

SEQ ID NO: 4666616 - DNA, 21 bp, Homo sapiens
aggcttccctacacagggcct

SEQ ID NO: 4666617 - DNA, 15 bp, Homo sapiens
aggcttgctgtatga

SEQ ID NO: 4666618 - DNA, 13 bp, Homo sapiens
aggctttcatgtt

SEQ ID NO: 4666619 - DNA, 14 bp, Homo sapiens
aggctttctgggct

SEQ ID NO: 4666620 - DNA, 19 bp, Homo sapiens
aggctttctgggctctgga

SEQ ID NO: 4666621 - DNA, 14 bp, Homo sapiens
agggaaaagggaag

SEQ ID NO: 4666622 - DNA, 14 bp, Homo sapiens
agggaactagaggt

SEQ ID NO: 4666623 - DNA, 19 bp, Homo sapiens
agggaagaaaggaggcagc

SEQ ID NO: 4666624 - DNA, 15 bp, Homo sapiens
agggaagaaggagga

SEQ ID NO: 4666625 - DNA, 19 bp, Homo sapiens
agggaagagacagcccagg

SEQ ID NO: 4666626 - DNA, 15 bp, Homo sapiens
agggaaggagacagg

SEQ ID NO: 4666627 - DNA, 14 bp, Homo sapiens
agggaaggcaggca

SEQ ID NO: 4666628 - DNA, 18 bp, Homo sapiens
agggaaggcaggcagggc

SEQ ID NO: 4666629 - DNA, 16 bp, Homo sapiens
agggaatcatttttgt

SEQ ID NO: 4666630 - DNA, 15 bp, Homo sapiens
agggaattctcttgg

SEQ ID NO: 4666631 - DNA, 19 bp, Homo sapiens
agggaatttaatacttttc

SEQ ID NO: 4666632 - DNA, 20 bp, Homo sapiens
agggaatttaatacttttcc

SEQ ID NO: 4666633 - DNA, 13 bp, Homo sapiens
agggacaggctga

SEQ ID NO: 4666634 - DNA, 19 bp, Homo sapiens
agggacaggctgaagagag

SEQ ID NO: 4666635 - DNA, 15 bp, Homo sapiens
agggacccacctgct

SEQ ID NO: 4666636 - DNA, 22 bp, Homo sapiens
agggaccggcagagctctacag

SEQ ID NO: 4666637 - DNA, 19 bp, Homo sapiens
agggactgtcctagccagg

SEQ ID NO: 4666638 - DNA, 22 bp, Homo sapiens
agggactgtcctagccaggtct

SEQ ID NO: 4666639 - DNA, 16 bp, Homo sapiens
agggactgtcgctgct

SEQ ID NO: 4666640 - DNA, 16 bp, Homo sapiens
agggagcacctgtctg

SEQ ID NO: 4666641 - DNA, 19 bp, Homo sapiens
agggagcggccggccagcc

SEQ ID NO: 4666642 - DNA, 23 bp, Homo sapiens
agggaggagcaacggccccagcg

SEQ ID NO: 4666643 - DNA, 13 bp, Homo sapiens
agggagggctctg

SEQ ID NO: 4666644 - DNA, 14 bp, Homo sapiens
agggagggctctga

SEQ ID NO: 4666645 - DNA, 18 bp, Homo sapiens
agggagggctctgaggcg

SEQ ID NO: 4666646 - DNA, 15 bp, Homo sapiens
agggagtgctggctc

SEQ ID NO: 4666647 - DNA, 16 bp, Homo sapiens
agggagtgctggctca

SEQ ID NO: 4666648 - DNA, 18 bp, Homo sapiens
agggagtgctggctcaca

SEQ ID NO: 4666649 - DNA, 20 bp, Homo sapiens
agggagtgctggctcacagt

SEQ ID NO: 4666650 - DNA, 24 bp, Homo sapiens
agggagtgctggctcacagtacag

SEQ ID NO: 4666651 - DNA, 16 bp, Homo sapiens
agggagtgtactccca

SEQ ID NO: 4666652 - DNA, 16 bp, Homo sapiens
agggatggagaaagaa

SEQ ID NO: 4666653 - DNA, 21 bp, Homo sapiens
agggatggagaaagaagtgga

SEQ ID NO: 4666654 - DNA, 18 bp, Homo sapiens
agggcaagaggatgaagg

SEQ ID NO: 4666655 - DNA, 12 bp, Homo sapiens
agggcaagccct

SEQ ID NO: 4666656 - DNA, 14 bp, Homo sapiens
agggcaagccctgc

SEQ ID NO: 4666657 - DNA, 12 bp, Homo sapiens
agggcacaggag

SEQ ID NO: 4666658 - DNA, 15 bp, Homo sapiens
agggcacaggagcta

SEQ ID NO: 4666659 - DNA, 18 bp, Homo sapiens
agggcacaggagctacct

SEQ ID NO: 4666660 - DNA, 20 bp, Homo sapiens
agggcacaggagctacctgt

SEQ ID NO: 4666661 - DNA, 14 bp, Homo sapiens
aggtcataaagcat

SEQ ID NO: 4666662 - DNA, 16 bp, Homo sapiens
aggtcataaagcattg

SEQ ID NO: 4666663 - DNA, 18 bp, Homo sapiens
aggtcataaagcattgga

SEQ ID NO: 4666664 - DNA, 16 bp, Homo sapiens
aggtccaatttgtaaa

SEQ ID NO: 4666665 - DNA, 21 bp, Homo sapiens
aggtccacggtctgttcttga

SEQ ID NO: 4666666 - DNA, 15 bp, Homo sapiens
aggtcctgagcactg

SEQ ID NO: 4666667 - DNA, 16 bp, Homo sapiens
aggtcctgagcactgc

SEQ ID NO: 4666668 - DNA, 20 bp, Homo sapiens
aggtccttaggcctctgaga

SEQ ID NO: 4666669 - DNA, 13 bp, Homo sapiens
aggtcgaggactg

SEQ ID NO: 4666670 - DNA, 17 bp, Homo sapiens
aggtctccaggggcctg

SEQ ID NO: 4666671 - DNA, 21 bp, Homo sapiens
aggtctctgttgactggctgt

SEQ ID NO: 4666672 - DNA, 14 bp, Homo sapiens
aggtcttcctgtgg

SEQ ID NO: 4666673 - DNA, 21 bp, Homo sapiens
aggtcttcctgtggctccctc

SEQ ID NO: 4666674 - DNA, 22 bp, Homo sapiens
aggtcttcctgtggctccctct

SEQ ID NO: 4666675 - DNA, 17 bp, Homo sapiens
aggtctttgttatgaca

SEQ ID NO: 4666676 - DNA, 13 bp, Homo sapiens
aggtgagggaagg

SEQ ID NO: 4666677 - DNA, 15 bp, Homo sapiens
aggtgagggaaggag

SEQ ID NO: 4666678 - DNA, 21 bp, Homo sapiens
aggtgagggaaggagacagga

SEQ ID NO: 4666679 - DNA, 16 bp, Homo sapiens
aggtgcagtggagggg

SEQ ID NO: 4666680 - DNA, 20 bp, Homo sapiens
aggtgcagtggagggggcaa

SEQ ID NO: 4666681 - DNA, 18 bp, Homo sapiens
aggtgccaccaccctgcc

SEQ ID NO: 4666682 - DNA, 13 bp, Homo sapiens
aggtgcccactcc

SEQ ID NO: 4666683 - DNA, 16 bp, Homo sapiens
aggtgcccactccgcc

SEQ ID NO: 4666684 - DNA, 15 bp, Homo sapiens
aggtgctaacataga

SEQ ID NO: 4666685 - DNA, 16 bp, Homo sapiens
aggtgctaacatagat

SEQ ID NO: 4666686 - DNA, 15 bp, Homo sapiens
aggtggagggaagga

SEQ ID NO: 4666687 - DNA, 23 bp, Homo sapiens
aggtggcacttccacctccagcc

SEQ ID NO: 4666688 - DNA, 19 bp, Homo sapiens
aggtgggcaaagggaagta

SEQ ID NO: 4666689 - DNA, 16 bp, Homo sapiens
aggtgggcgggcaggg

SEQ ID NO: 4666690 - DNA, 21 bp, Homo sapiens
aggtggttcagacaagacaga

SEQ ID NO: 4666691 - DNA, 14 bp, Homo sapiens
aggtgtgaatgcac

SEQ ID NO: 4666692 - DNA, 16 bp, Homo sapiens
aggtgttgcagcccaa

SEQ ID NO: 4666693 - DNA, 23 bp, Homo sapiens
aggtgttttttatgaagtgcgtg

SEQ ID NO: 4666694 - DNA, 22 bp, Homo sapiens
aggttacagattatcacattaa

SEQ ID NO: 4666695 - DNA, 16 bp, Homo sapiens
aggttaccaagaagcc

SEQ ID NO: 4666696 - DNA, 12 bp, Homo sapiens
aggttatacaat

SEQ ID NO: 4666697 - DNA, 14 bp, Homo sapiens
aggttcccaagctc

SEQ ID NO: 4666698 - DNA, 18 bp, Homo sapiens
aggttccccaagggccct

SEQ ID NO: 4666699 - DNA, 17 bp, Homo sapiens
aggttcttaaaaaggaa

SEQ ID NO: 4666700 - DNA, 19 bp, Homo sapiens
aggttcttcttcctgaagc

SEQ ID NO: 4666701 - DNA, 16 bp, Homo sapiens
aggttggggtgtacta

SEQ ID NO: 4666702 - DNA, 20 bp, Homo sapiens
aggtttcaacaaatttcatt

SEQ ID NO: 4666703 - DNA, 23 bp, Homo sapiens
aggtttcaacaaatttcattgca

SEQ ID NO: 4666704 - DNA, 14 bp, Homo sapiens
aggttttgttgcta

SEQ ID NO: 4666705 - DNA, 19 bp, Homo sapiens
agtaaaaccttgttctatt

SEQ ID NO: 4666706 - DNA, 16 bp, Homo sapiens
agtaaactatttatct

SEQ ID NO: 4666707 - DNA, 15 bp, Homo sapiens
agtaaactgaggccc

SEQ ID NO: 4666708 - DNA, 21 bp, Homo sapiens
agtaaatcagaaagtaacaat

SEQ ID NO: 4666709 - DNA, 24 bp, Homo sapiens
agtaaatcagaaagtaacaatcta

SEQ ID NO: 4666710 - DNA, 15 bp, Homo sapiens
agtaacaaataaata

SEQ ID NO: 4666711 - DNA, 20 bp, Homo sapiens
agtaacactgtgatttatct

SEQ ID NO: 4666712 - DNA, 15 bp, Homo sapiens
agtaaccaaggccct

SEQ ID NO: 4666713 - DNA, 12 bp, Homo sapiens
agtaagtcagga

SEQ ID NO: 4666714 - DNA, 20 bp, Homo sapiens
agtaagtcaggacagcttgt

SEQ ID NO: 4666715 - DNA, 18 bp, Homo sapiens
agtaatatcaaagcattt

SEQ ID NO: 4666716 - DNA, 13 bp, Homo sapiens
agtaatctgtgta

SEQ ID NO: 4666717 - DNA, 19 bp, Homo sapiens
agtaatctgtgtacaaaga

SEQ ID NO: 4666718 - DNA, 17 bp, Homo sapiens
agtaatgaaatgtttac

SEQ ID NO: 4666719 - DNA, 15 bp, Homo sapiens
agtaatgaagaatca

SEQ ID NO: 4666720 - DNA, 16 bp, Homo sapiens
agtaatggaggtccca

SEQ ID NO: 4666721 - DNA, 14 bp, Homo sapiens
agtaatggcagagc

SEQ ID NO: 4666722 - DNA, 14 bp, Homo sapiens
agtaatttcttttt

SEQ ID NO: 4666723 - DNA, 14 bp, Homo sapiens
agtaattttgtcac

SEQ ID NO: 4666724 - DNA, 21 bp, Homo sapiens
agtacaaatgccttaaaatgg

SEQ ID NO: 4666725 - DNA, 13 bp, Homo sapiens
agtacaatcttgg

SEQ ID NO: 4666726 - DNA, 15 bp, Homo sapiens
agtacaatcttggga

SEQ ID NO: 4666727 - DNA, 19 bp, Homo sapiens
agtacaccacaagggtcac

SEQ ID NO: 4666728 - DNA, 15 bp, Homo sapiens
agtacagcatgtgcc

SEQ ID NO: 4666729 - DNA, 16 bp, Homo sapiens
agtacagcatgtgcct

SEQ ID NO: 4666730 - DNA, 22 bp, Homo sapiens
agtacatatttattttcttttg

SEQ ID NO: 4666731 - DNA, 11 bp, Homo sapiens
agtaccaaaga

SEQ ID NO: 4666732 - DNA, 21 bp, Homo sapiens
agtacctagctggctctgtga

SEQ ID NO: 4666733 - DNA, 19 bp, Homo sapiens
agtacctgtccaagacagg

SEQ ID NO: 4666734 - DNA, 14 bp, Homo sapiens
agtacctgtgtgtt

SEQ ID NO: 4666735 - DNA, 14 bp, Homo sapiens
agtactctttaaca

SEQ ID NO: 4666736 - DNA, 15 bp, Homo sapiens
agtacttacattcca

SEQ ID NO: 4666737 - DNA, 15 bp, Homo sapiens
agtactttgtgcatt

SEQ ID NO: 4666738 - DNA, 11 bp, Homo sapiens
agtagaactgt

SEQ ID NO: 4666739 - DNA, 15 bp, Homo sapiens
agtagagaaacattt

SEQ ID NO: 4666740 - DNA, 17 bp, Homo sapiens
agtagcctggactgttt

SEQ ID NO: 4666741 - DNA, 18 bp, Homo sapiens
agtagcctggactgtttc

SEQ ID NO: 4666742 - DNA, 14 bp, Homo sapiens
agtagctagtttgc

SEQ ID NO: 4666743 - DNA, 20 bp, Homo sapiens
agtagctcaaaaatactctt

SEQ ID NO: 4666744 - DNA, 21 bp, Homo sapiens
agtagctcaaaaatactcttg

SEQ ID NO: 4666745 - DNA, 13 bp, Homo sapiens
agtagctcttaga

SEQ ID NO: 4666746 - DNA, 11 bp, Homo sapiens
agtagctgagc

SEQ ID NO: 4666747 - DNA, 13 bp, Homo sapiens
agtagctgagctc

SEQ ID NO: 4666748 - DNA, 14 bp, Homo sapiens
agtagctgagctca

SEQ ID NO: 4666749 - DNA, 13 bp, Homo sapiens
agtagcttgctcc

SEQ ID NO: 4666750 - DNA, 19 bp, Homo sapiens
agtagcttgctccctgtgt

SEQ ID NO: 4666751 - DNA, 13 bp, Homo sapiens
agtaggaccaggc

SEQ ID NO: 4666752 - DNA, 16 bp, Homo sapiens
agtaggaccaggccac

SEQ ID NO: 4666753 - DNA, 23 bp, Homo sapiens
agtagggatgcggatcctgctgg

SEQ ID NO: 4666754 - DNA, 16 bp, Homo sapiens
agtagtccttggcata

SEQ ID NO: 4666755 - DNA, 13 bp, Homo sapiens
agtagttaaataa

SEQ ID NO: 4666756 - DNA, 18 bp, Homo sapiens
agtataagaaatgcatat

SEQ ID NO: 4666757 - DNA, 14 bp, Homo sapiens
agtataagcttttc

SEQ ID NO: 4666758 - DNA, 15 bp, Homo sapiens
agtatagtctccctt

SEQ ID NO: 4666759 - DNA, 21 bp, Homo sapiens
agtatatcatgtaaagaaatg

SEQ ID NO: 4666760 - DNA, 16 bp, Homo sapiens
agtatatttatttcta

SEQ ID NO: 4666761 - DNA, 15 bp, Homo sapiens
agtatctattagcag

SEQ ID NO: 4666762 - DNA, 20 bp, Homo sapiens
agtatctgtatataagttgc

SEQ ID NO: 4666763 - DNA, 21 bp, Homo sapiens
agtatctgtatataagttgct

SEQ ID NO: 4666764 - DNA, 14 bp, Homo sapiens
agtatggtgtgttc

SEQ ID NO: 4666765 - DNA, 13 bp, Homo sapiens
agtattaaggttt

SEQ ID NO: 4666766 - DNA, 16 bp, Homo sapiens
agtatttataaaaata

SEQ ID NO: 4666767 - DNA, 19 bp, Homo sapiens
agtatttataaaaatataa

SEQ ID NO: 4666768 - DNA, 16 bp, Homo sapiens
agtatttatcaggaga

SEQ ID NO: 4666769 - DNA, 14 bp, Homo sapiens
agtatttattccca

SEQ ID NO: 4666770 - DNA, 22 bp, Homo sapiens
agtatttccacttgttctcagg

SEQ ID NO: 4666771 - DNA, 21 bp, Homo sapiens
agtatttctgttcctttttgt

SEQ ID NO: 4666772 - DNA, 14 bp, Homo sapiens
agtggatgctgtgc

SEQ ID NO: 4666773 - DNA, 15 bp, Homo sapiens
agtggatgctgtgct

SEQ ID NO: 4666774 - DNA, 17 bp, Homo sapiens
agtggatgtttttaatg

SEQ ID NO: 4666775 - DNA, 14 bp, Homo sapiens
agtggcagggaccg

SEQ ID NO: 4666776 - DNA, 22 bp, Homo sapiens
agtggcagggaccggcagagct

SEQ ID NO: 4666777 - DNA, 23 bp, Homo sapiens
agtggcagggaccggcagagctc

SEQ ID NO: 4666778 - DNA, 15 bp, Homo sapiens
agtggcctccctgct

SEQ ID NO: 4666779 - DNA, 17 bp, Homo sapiens
agtggctttaatgaata

SEQ ID NO: 4666780 - DNA, 22 bp, Homo sapiens
agtgggccagggctgccctgag

SEQ ID NO: 4666781 - DNA, 20 bp, Homo sapiens
agtgggccccgggctggaga

SEQ ID NO: 4666782 - DNA, 22 bp, Homo sapiens
agtgggccccgggctggagaaa

SEQ ID NO: 4666783 - DNA, 14 bp, Homo sapiens
agtggggcctgtgg

SEQ ID NO: 4666784 - DNA, 15 bp, Homo sapiens
agtggggcctgtgga

SEQ ID NO: 4666785 - DNA, 20 bp, Homo sapiens
agtggggctctctgagtcct

SEQ ID NO: 4666786 - DNA, 19 bp, Homo sapiens
agtggggtcaagctgagct

SEQ ID NO: 4666787 - DNA, 20 bp, Homo sapiens
agtggggtcaagctgagctg

SEQ ID NO: 4666788 - DNA, 15 bp, Homo sapiens
agtggttgcctgggg

SEQ ID NO: 4666789 - DNA, 20 bp, Homo sapiens
agtgtagcctaaagggcagg

SEQ ID NO: 4666790 - DNA, 13 bp, Homo sapiens
agtgtagctgtaa

SEQ ID NO: 4666791 - DNA, 14 bp, Homo sapiens
agtgtagctgtaag

SEQ ID NO: 4666792 - DNA, 23 bp, Homo sapiens
agtgtagctgtaagggcagtgcc

SEQ ID NO: 4666793 - DNA, 20 bp, Homo sapiens
agtgtcacctccttccccag

SEQ ID NO: 4666794 - DNA, 18 bp, Homo sapiens
agtgtcctgcccatgccc

SEQ ID NO: 4666795 - DNA, 17 bp, Homo sapiens
agtgtctagtttctcaa

SEQ ID NO: 4666796 - DNA, 17 bp, Homo sapiens
agtgtctcattctcaga

SEQ ID NO: 4666797 - DNA, 16 bp, Homo sapiens
agtgtgaagtacaata

SEQ ID NO: 4666798 - DNA, 17 bp, Homo sapiens
agtgtgaagtacaataa

SEQ ID NO: 4666799 - DNA, 15 bp, Homo sapiens
agtgtgacagggcca

SEQ ID NO: 4666800 - DNA, 17 bp, Homo sapiens
agtgtgacagggccagt

SEQ ID NO: 4666801 - DNA, 17 bp, Homo sapiens
agtgtgacagtttccaa

SEQ ID NO: 4666802 - DNA, 18 bp, Homo sapiens
agtgtgccaaatcagttt

SEQ ID NO: 4666803 - DNA, 22 bp, Homo sapiens
agtgtgtgtttgtgtgtttcaa

SEQ ID NO: 4666804 - DNA, 18 bp, Homo sapiens
agtgttagggattccttc

SEQ ID NO: 4666805 - DNA, 19 bp, Homo sapiens
agtgttctgtttgaaacta

SEQ ID NO: 4666806 - DNA, 21 bp, Homo sapiens
agtgttggcaaacgagacttt

SEQ ID NO: 4666807 - DNA, 11 bp, Homo sapiens
agtgttttctt

SEQ ID NO: 4666808 - DNA, 16 bp, Homo sapiens
agtgttttctttgagg

SEQ ID NO: 4666809 - DNA, 16 bp, Homo sapiens
agttaaataactgtgt

SEQ ID NO: 4666810 - DNA, 18 bp, Homo sapiens
agttaatgatggcagagg

SEQ ID NO: 4666811 - DNA, 15 bp, Homo sapiens
agttacaaagttata

SEQ ID NO: 4666812 - DNA, 17 bp, Homo sapiens
agttactccagtgccaa

SEQ ID NO: 4666813 - DNA, 15 bp, Homo sapiens
agttagctccataaa

SEQ ID NO: 4666814 - DNA, 23 bp, Homo sapiens
agttagctccataaagtacaaat

SEQ ID NO: 4666815 - DNA, 17 bp, Homo sapiens
agttatcaaaaagtatt

SEQ ID NO: 4666816 - DNA, 21 bp, Homo sapiens
agttatcaaaaagtattatca

SEQ ID NO: 4666817 - DNA, 16 bp, Homo sapiens
agttattttaatacct

SEQ ID NO: 4666818 - DNA, 22 bp, Homo sapiens
agttattttaatacctttaaat

SEQ ID NO: 4666819 - DNA, 13 bp, Homo sapiens
agttcaatacagt

SEQ ID NO: 4666820 - DNA, 23 bp, Homo sapiens
agttcagagatcaggatcagctt

SEQ ID NO: 4666821 - DNA, 22 bp, Homo sapiens
agttcaggttaccagaaccagt

SEQ ID NO: 4666822 - DNA, 19 bp, Homo sapiens
agttcatcaccatttcctc

SEQ ID NO: 4666823 - DNA, 18 bp, Homo sapiens
agttcctgctgcctgggt

SEQ ID NO: 4666824 - DNA, 14 bp, Homo sapiens
agttcctttagaaa

SEQ ID NO: 4666825 - DNA, 18 bp, Homo sapiens
agttcgcagccaccctga

SEQ ID NO: 4666826 - DNA, 12 bp, Homo sapiens
agttctagcagt

SEQ ID NO: 4666827 - DNA, 21 bp, Homo sapiens
agttctctactccctcttgtc

SEQ ID NO: 4666828 - DNA, 22 bp, Homo sapiens
agttctctgggaagtggtcagc

SEQ ID NO: 4666829 - DNA, 23 bp, Homo sapiens
agttctgctacattataatgtac

SEQ ID NO: 4666830 - DNA, 22 bp, Homo sapiens
agttctgtgtggtgcattcctg

SEQ ID NO: 4666831 - DNA, 21 bp, Homo sapiens
agttcttagttgctgtatgtc

SEQ ID NO: 4666832 - DNA, 12 bp, Homo sapiens
agttcttgtgcc

SEQ ID NO: 4666833 - DNA, 15 bp, Homo sapiens
agttctttcctcccc

SEQ ID NO: 4666834 - DNA, 21 bp, Homo sapiens
agttctttcctccccctgcaa

SEQ ID NO: 4666835 - DNA, 13 bp, Homo sapiens
agttgatattcaa

SEQ ID NO: 4666836 - DNA, 14 bp, Homo sapiens
agttgcagcccaag

SEQ ID NO: 4666837 - DNA, 20 bp, Homo sapiens
agttgcgtggactctgcaca

SEQ ID NO: 4666838 - DNA, 16 bp, Homo sapiens
agttgctgtgaacttt

SEQ ID NO: 4666839 - DNA, 19 bp, Homo sapiens
agttggaactttctgttcc

SEQ ID NO: 4666840 - DNA, 14 bp, Homo sapiens
agttggtctttcca

SEQ ID NO: 4666841 - DNA, 16 bp, Homo sapiens
agttgtaaaatagaaa

SEQ ID NO: 4666842 - DNA, 21 bp, Homo sapiens
agttgtaaaatagaaaaagtg

SEQ ID NO: 4666843 - DNA, 17 bp, Homo sapiens
agttgtccacaaatctt

SEQ ID NO: 4666844 - DNA, 23 bp, Homo sapiens
agttgtccacaaatcttcagtat

SEQ ID NO: 4666845 - DNA, 21 bp, Homo sapiens
agttgtcttatgtgaaaaatt

SEQ ID NO: 4666846 - DNA, 23 bp, Homo sapiens
agttgtgttgacacatatgaaca

SEQ ID NO: 4666847 - DNA, 16 bp, Homo sapiens
agttgttaataaaagt

SEQ ID NO: 4666848 - DNA, 18 bp, Homo sapiens
agtttaaaacagaagcct

SEQ ID NO: 4666849 - DNA, 19 bp, Homo sapiens
agtttaaataccagtactt

SEQ ID NO: 4666850 - DNA, 18 bp, Homo sapiens
agtttaattgacttattt

SEQ ID NO: 4666851 - DNA, 19 bp, Homo sapiens
agtttatggcaaagatttt

SEQ ID NO: 4666852 - DNA, 23 bp, Homo sapiens
agtttatttccactattttcaaa

SEQ ID NO: 4666853 - DNA, 16 bp, Homo sapiens
agtttcagctggaaac

SEQ ID NO: 4666854 - DNA, 23 bp, Homo sapiens
agtttcagctggaaacttctgta

SEQ ID NO: 4666855 - DNA, 21 bp, Homo sapiens
agtttcctgaagcatttagtt

SEQ ID NO: 4666856 - DNA, 13 bp, Homo sapiens
agtttctattctg

SEQ ID NO: 4666857 - DNA, 15 bp, Homo sapiens
agtttctgcctgggc

SEQ ID NO: 4666858 - DNA, 17 bp, Homo sapiens
agtttctgcctgggcaa

SEQ ID NO: 4666859 - DNA, 22 bp, Homo sapiens
agtttgatttttgtttttgtaa

SEQ ID NO: 4666860 - DNA, 16 bp, Homo sapiens
agtttgtagccaggta

SEQ ID NO: 4666861 - DNA, 17 bp, Homo sapiens
agttttatacccttttt

SEQ ID NO: 4666862 - DNA, 21 bp, Homo sapiens
agttttataccctttttcatt

SEQ ID NO: 4666863 - DNA, 15 bp, Homo sapiens
agttttcaaatttgt

SEQ ID NO: 4666864 - DNA, 21 bp, Homo sapiens
agttttgtggattaaaccttt

SEQ ID NO: 4666865 - DNA, 15 bp, Homo sapiens
agtttttattgcttg

SEQ ID NO: 4666866 - DNA, 17 bp, Homo sapiens
agttttttattatgcat

SEQ ID NO: 4666867 - DNA, 14 bp, Homo sapiens
ataaaaatataaat

SEQ ID NO: 4666868 - DNA, 15 bp, Homo sapiens
ataaaaatatgtaat

SEQ ID NO: 4666869 - DNA, 19 bp, Homo sapiens
ataaaacatcataaatctt

SEQ ID NO: 4666870 - DNA, 15 bp, Homo sapiens
ataaaagctatggtg

SEQ ID NO: 4666871 - DNA, 15 bp, Homo sapiens
ataaaatatcataaa

SEQ ID NO: 4666872 - DNA, 13 bp, Homo sapiens
ataaaatgaaaat

SEQ ID NO: 4666873 - DNA, 17 bp, Homo sapiens
ataaaatgaaaattgta

SEQ ID NO: 4666874 - DNA, 18 bp, Homo sapiens
ataaaatgaacatctctt

SEQ ID NO: 4666875 - DNA, 18 bp, Homo sapiens
ataaaatgtttcattatg

SEQ ID NO: 4666876 - DNA, 12 bp, Homo sapiens
ataaaatttaaa

SEQ ID NO: 4666877 - DNA, 18 bp, Homo sapiens
ataaaatttaaaaactta

SEQ ID NO: 4666878 - DNA, 11 bp, Homo sapiens
ataaaattttt

SEQ ID NO: 4666879 - DNA, 17 bp, Homo sapiens
ataaaattttttttcat

SEQ ID NO: 4666880 - DNA, 23 bp, Homo sapiens
ataaaattttttttcatgtttta

SEQ ID NO: 4666881 - DNA, 20 bp, Homo sapiens
atactgtagacactctgaca

SEQ ID NO: 4666882 - DNA, 19 bp, Homo sapiens
atactgtatgccttctgta

SEQ ID NO: 4666883 - DNA, 16 bp, Homo sapiens
atacttaacatttcat

SEQ ID NO: 4666884 - DNA, 22 bp, Homo sapiens
atacttatgcaagatatttttg

SEQ ID NO: 4666885 - DNA, 21 bp, Homo sapiens
atacttattttcagtgcatca

SEQ ID NO: 4666886 - DNA, 14 bp, Homo sapiens
atactttgtaaata

SEQ ID NO: 4666887 - DNA, 14 bp, Homo sapiens
atagaaaattattt

SEQ ID NO: 4666888 - DNA, 18 bp, Homo sapiens
atagaaaattatttgtat

SEQ ID NO: 4666889 - DNA, 18 bp, Homo sapiens
atagaaacttcatggttt

SEQ ID NO: 4666890 - DNA, 23 bp, Homo sapiens
atagaaagaaactaaacagaaaa

SEQ ID NO: 4666891 - DNA, 20 bp, Homo sapiens
atagaaagttgatattcaac

SEQ ID NO: 4666892 - DNA, 13 bp, Homo sapiens
atagaaatgctgg

SEQ ID NO: 4666893 - DNA, 19 bp, Homo sapiens
atagaaatgctggtttttc

SEQ ID NO: 4666894 - DNA, 20 bp, Homo sapiens
atagaaatggaaattttgct

SEQ ID NO: 4666895 - DNA, 23 bp, Homo sapiens
atagaacacaaaacttgaaagaa

SEQ ID NO: 4666896 - DNA, 14 bp, Homo sapiens
atagaagattgttg

SEQ ID NO: 4666897 - DNA, 20 bp, Homo sapiens
atagaataattcttttctga

SEQ ID NO: 4666898 - DNA, 12 bp, Homo sapiens
atagaatgctgc

SEQ ID NO: 4666899 - DNA, 21 bp, Homo sapiens
atagactgtacattatgaaga

SEQ ID NO: 4666900 - DNA, 18 bp, Homo sapiens
atagagagggagaagaag

SEQ ID NO: 4666901 - DNA, 13 bp, Homo sapiens
atagagcaaaatc

SEQ ID NO: 4666902 - DNA, 16 bp, Homo sapiens
atagaggcattacttg

SEQ ID NO: 4666903 - DNA, 20 bp, Homo sapiens
atagaggcattacttgcttt

SEQ ID NO: 4666904 - DNA, 15 bp, Homo sapiens
atagatgttgctctt

SEQ ID NO: 4666905 - DNA, 21 bp, Homo sapiens
atagatgttgctctttcacct

SEQ ID NO: 4666906 - DNA, 18 bp, Homo sapiens
atagcaacaacaattggt

SEQ ID NO: 4666907 - DNA, 16 bp, Homo sapiens
atagcaataactgaaa

SEQ ID NO: 4666908 - DNA, 21 bp, Homo sapiens
atagcaataactgaaaatgaa

SEQ ID NO: 4666909 - DNA, 15 bp, Homo sapiens
atagcattgtgaact

SEQ ID NO: 4666910 - DNA, 23 bp, Homo sapiens
atagccaactgctaatgcaaatt

SEQ ID NO: 4666911 - DNA, 21 bp, Homo sapiens
atagccattgatcataaactg

SEQ ID NO: 4666912 - DNA, 17 bp, Homo sapiens
atagccctcagacattt

SEQ ID NO: 4666913 - DNA, 15 bp, Homo sapiens
atagctaactgtaaa

SEQ ID NO: 4666914 - DNA, 14 bp, Homo sapiens
atagctgaaaaggg

SEQ ID NO: 4666915 - DNA, 17 bp, Homo sapiens
atagctgaaaagggcac

SEQ ID NO: 4666916 - DNA, 16 bp, Homo sapiens
atagctgtttcaaatg

SEQ ID NO: 4666917 - DNA, 20 bp, Homo sapiens
atagctgtttcaaatgtgca

SEQ ID NO: 4666918 - DNA, 11 bp, Homo sapiens
ataggaacagc

SEQ ID NO: 4666919 - DNA, 16 bp, Homo sapiens
ataggatttttagaat

SEQ ID NO: 4666920 - DNA, 17 bp, Homo sapiens
atagggaatatatctct

SEQ ID NO: 4666921 - DNA, 20 bp, Homo sapiens
atagggagaatatttactaa

SEQ ID NO: 4666922 - DNA, 22 bp, Homo sapiens
atagggcctggtccctgggagg

SEQ ID NO: 4666923 - DNA, 16 bp, Homo sapiens
ataggggtgtttattt

SEQ ID NO: 4666924 - DNA, 14 bp, Homo sapiens
ataggtttctctcc

SEQ ID NO: 4666925 - DNA, 18 bp, Homo sapiens
ataggtttctctccctcc

SEQ ID NO: 4666926 - DNA, 14 bp, Homo sapiens
atagtaaaagaaat

SEQ ID NO: 4666927 - DNA, 18 bp, Homo sapiens
atagtagttaaataactg

SEQ ID NO: 4666928 - DNA, 12 bp, Homo sapiens
atagtattccat

SEQ ID NO: 4666929 - DNA, 12 bp, Homo sapiens
atagtctgggtc

SEQ ID NO: 4666930 - DNA, 23 bp, Homo sapiens
atagtctgggtcagacccatctc

SEQ ID NO: 4666931 - DNA, 20 bp, Homo sapiens
atagtgtcatataaactcat

SEQ ID NO: 4666932 - DNA, 15 bp, Homo sapiens
atagttaatattttg

SEQ ID NO: 4666933 - DNA, 21 bp, Homo sapiens
atagttattttaataccttta

SEQ ID NO: 4666934 - DNA, 20 bp, Homo sapiens
atagttgcagcccaaggaca

SEQ ID NO: 4666935 - DNA, 21 bp, Homo sapiens
atagttgcagcccaaggacag

SEQ ID NO: 4666936 - DNA, 22 bp, Homo sapiens
atataaattgtacattttgtaa

SEQ ID NO: 4666937 - DNA, 22 bp, Homo sapiens
atataaattttttttgtttcat

SEQ ID NO: 4666938 - DNA, 22 bp, Homo sapiens
atataatttatttccactaaaa

SEQ ID NO: 4666939 - DNA, 18 bp, Homo sapiens
atatagacattctcacat

SEQ ID NO: 4666940 - DNA, 16 bp, Homo sapiens
atatagactgtacatt

SEQ ID NO: 4666941 - DNA, 18 bp, Homo sapiens
atatatacttaagaatat

SEQ ID NO: 4666942 - DNA, 15 bp, Homo sapiens
atatatataggttct

SEQ ID NO: 4666943 - DNA, 11 bp, Homo sapiens
atatatatata

SEQ ID NO: 4666944 - DNA, 12 bp, Homo sapiens
atatatatatat

SEQ ID NO: 4666945 - DNA, 14 bp, Homo sapiens
atatatattaagtg

SEQ ID NO: 4666946 - DNA, 18 bp, Homo sapiens
atatatcactctagaaaa

SEQ ID NO: 4666947 - DNA, 17 bp, Homo sapiens
atatatctctatttgag

SEQ ID NO: 4666948 - DNA, 12 bp, Homo sapiens
atatatgtgtat

SEQ ID NO: 4666949 - DNA, 16 bp, Homo sapiens
atatatgtgtatacat

SEQ ID NO: 4666950 - DNA, 22 bp, Homo sapiens
atatatgtgtatacatacatgt

SEQ ID NO: 4666951 - DNA, 15 bp, Homo sapiens
atatattatatacat

SEQ ID NO: 4666952 - DNA, 16 bp, Homo sapiens
atatattgctgcattt

SEQ ID NO: 4666953 - DNA, 22 bp, Homo sapiens
atatatttggagtttttctgaa

SEQ ID NO: 4666954 - DNA, 14 bp, Homo sapiens
atatatttttctga

SEQ ID NO: 4666955 - DNA, 19 bp, Homo sapiens
atatcaaagcattttataa

SEQ ID NO: 4666956 - DNA, 15 bp, Homo sapiens
atatcaaataaaata

SEQ ID NO: 4666957 - DNA, 23 bp, Homo sapiens
atatcaaataaaatatcataaag

SEQ ID NO: 4666958 - DNA, 21 bp, Homo sapiens
atatcaatcaagccatgtata

SEQ ID NO: 4666959 - DNA, 12 bp, Homo sapiens
atatcagggcct

SEQ ID NO: 4666960 - DNA, 19 bp, Homo sapiens
atatcatgtaaagaaatgt

SEQ ID NO: 4666961 - DNA, 21 bp, Homo sapiens
atatcattctttgtatcttaa

SEQ ID NO: 4666962 - DNA, 13 bp, Homo sapiens
atatcatttataa

SEQ ID NO: 4666963 - DNA, 11 bp, Homo sapiens
atatcatttta

SEQ ID NO: 4666964 - DNA, 22 bp, Homo sapiens
atatcattttaaaaactttatt

SEQ ID NO: 4666965 - DNA, 16 bp, Homo sapiens
atatcattttattcac

SEQ ID NO: 4666966 - DNA, 18 bp, Homo sapiens
atatctgggttaagtgtt

SEQ ID NO: 4666967 - DNA, 19 bp, Homo sapiens
atatctgggttaagtgttt

SEQ ID NO: 4666968 - DNA, 23 bp, Homo sapiens
atatgaacacagacaaagtgcta

SEQ ID NO: 4666969 - DNA, 18 bp, Homo sapiens
atatgatcagtgttactg

SEQ ID NO: 4666970 - DNA, 15 bp, Homo sapiens
atatgattggcaata

SEQ ID NO: 4666971 - DNA, 13 bp, Homo sapiens
atatgattgtttc

SEQ ID NO: 4666972 - DNA, 14 bp, Homo sapiens
atatgattgtttct

SEQ ID NO: 4666973 - DNA, 15 bp, Homo sapiens
atatgcaccttgtgt

SEQ ID NO: 4666974 - DNA, 19 bp, Homo sapiens
atatgcaccttgtgtctgt

SEQ ID NO: 4666975 - DNA, 20 bp, Homo sapiens
atatgcaccttgtgtctgta

SEQ ID NO: 4666976 - DNA, 21 bp, Homo sapiens
atatgcaccttgtgtctgtac

SEQ ID NO: 4666977 - DNA, 17 bp, Homo sapiens
atatgccaagctaattt

SEQ ID NO: 4666978 - DNA, 17 bp, Homo sapiens
atatgctgatcttttaa

SEQ ID NO: 4666979 - DNA, 16 bp, Homo sapiens
atatggactctgcaca

SEQ ID NO: 4666980 - DNA, 14 bp, Homo sapiens
atatggcaggagct

SEQ ID NO: 4666981 - DNA, 13 bp, Homo sapiens
atatgtaatttca

SEQ ID NO: 4666982 - DNA, 14 bp, Homo sapiens
atatgtaatttcaa

SEQ ID NO: 4666983 - DNA, 23 bp, Homo sapiens
atatgtaatttcaaaatacattt

SEQ ID NO: 4666984 - DNA, 17 bp, Homo sapiens
atatgtacttgtcaaag

SEQ ID NO: 4666985 - DNA, 21 bp, Homo sapiens
atatgtacttgtcaaagaagg

SEQ ID NO: 4666986 - DNA, 19 bp, Homo sapiens
atatgtcttactactttaa

SEQ ID NO: 4666987 - DNA, 15 bp, Homo sapiens
atatgtcttgcaaag

SEQ ID NO: 4666988 - DNA, 21 bp, Homo sapiens
atatgttgtaatatttcttca

SEQ ID NO: 4666989 - DNA, 18 bp, Homo sapiens
atattaagtgtgccaaat

SEQ ID NO: 4666990 - DNA, 22 bp, Homo sapiens
atattaccatcttaatctttat

SEQ ID NO: 4666991 - DNA, 19 bp, Homo sapiens
atccatgtgattaatgttt

SEQ ID NO: 4666992 - DNA, 20 bp, Homo sapiens
atccatgtgattaatgtttt

SEQ ID NO: 4666993 - DNA, 19 bp, Homo sapiens
atccattaggccagcaacg

SEQ ID NO: 4666994 - DNA, 14 bp, Homo sapiens
atccattctacatc

SEQ ID NO: 4666995 - DNA, 16 bp, Homo sapiens
atcccaaccagtgcca

SEQ ID NO: 4666996 - DNA, 20 bp, Homo sapiens
atcccaaccagtgccaagga

SEQ ID NO: 4666997 - DNA, 21 bp, Homo sapiens
atcccaaccagtgccaaggac

SEQ ID NO: 4666998 - DNA, 17 bp, Homo sapiens
atcccaatcattgttgc

SEQ ID NO: 4666999 - DNA, 14 bp, Homo sapiens
atcccacccacatg

SEQ ID NO: 4667000 - DNA, 20 bp, Homo sapiens
atccccaacatgcactgatg

SEQ ID NO: 4667001 - DNA, 16 bp, Homo sapiens
atcccccctgctgccc

SEQ ID NO: 4667002 - DNA, 17 bp, Homo sapiens
atcccccctgctgccca

SEQ ID NO: 4667003 - DNA, 19 bp, Homo sapiens
atcccccctgctgcccagt

SEQ ID NO: 4667004 - DNA, 21 bp, Homo sapiens
atcccgtaagaccaccttccc

SEQ ID NO: 4667005 - DNA, 20 bp, Homo sapiens
atccctatagaccactgggt

SEQ ID NO: 4667006 - DNA, 20 bp, Homo sapiens
atccctccaccttccgttcc

SEQ ID NO: 4667007 - DNA, 18 bp, Homo sapiens
atccctggagcaggagcc

SEQ ID NO: 4667008 - DNA, 22 bp, Homo sapiens
atccctggagcaggagccccgc

SEQ ID NO: 4667009 - DNA, 16 bp, Homo sapiens
atccctgggcattgct

SEQ ID NO: 4667010 - DNA, 18 bp, Homo sapiens
atccctgggcattgcttt

SEQ ID NO: 4667011 - DNA, 14 bp, Homo sapiens
atccctgggcctgc

SEQ ID NO: 4667012 - DNA, 20 bp, Homo sapiens
atccctgggcctgctgctga

SEQ ID NO: 4667013 - DNA, 16 bp, Homo sapiens
atccgaacctcctctg

SEQ ID NO: 4667014 - DNA, 19 bp, Homo sapiens
atccgaacctcctctgtga

SEQ ID NO: 4667015 - DNA, 20 bp, Homo sapiens
atccgaacctcctctgtgaa

SEQ ID NO: 4667016 - DNA, 17 bp, Homo sapiens
atccgccagtgtttctg

SEQ ID NO: 4667017 - DNA, 17 bp, Homo sapiens
atccgcccacctcagcc

SEQ ID NO: 4667018 - DNA, 20 bp, Homo sapiens
atccgcccacctcagcctcc

SEQ ID NO: 4667019 - DNA, 22 bp, Homo sapiens
atcctaaataaaaaaagacaaa

SEQ ID NO: 4667020 - DNA, 12 bp, Homo sapiens
atcctaccaaag

SEQ ID NO: 4667021 - DNA, 19 bp, Homo sapiens
atcctagcctttgggcaca

SEQ ID NO: 4667022 - DNA, 18 bp, Homo sapiens
atcctatatagaatgctg

SEQ ID NO: 4667023 - DNA, 22 bp, Homo sapiens
atcctcagttcctgcagcagag

SEQ ID NO: 4667024 - DNA, 17 bp, Homo sapiens
atcctccccgctctgcc

SEQ ID NO: 4667025 - DNA, 18 bp, Homo sapiens
atcctccccgctctgccg

SEQ ID NO: 4667026 - DNA, 21 bp, Homo sapiens
atcctcccgccaggagcttct

SEQ ID NO: 4667027 - DNA, 22 bp, Homo sapiens
atcctcccgccaggagcttctt

SEQ ID NO: 4667028 - DNA, 19 bp, Homo sapiens
atcctcctgagtagctggg

SEQ ID NO: 4667029 - DNA, 22 bp, Homo sapiens
atcctctgttaatgtggactgg

SEQ ID NO: 4667030 - DNA, 19 bp, Homo sapiens
atcctgcagggcttctcct

SEQ ID NO: 4667031 - DNA, 20 bp, Homo sapiens
atcctgcagggcttctcctc

SEQ ID NO: 4667032 - DNA, 17 bp, Homo sapiens
atcctgcccgagggcag

SEQ ID NO: 4667033 - DNA, 23 bp, Homo sapiens
atcctgggacctccccagcccag

SEQ ID NO: 4667034 - DNA, 14 bp, Homo sapiens
atcctggtcagctg

SEQ ID NO: 4667035 - DNA, 21 bp, Homo sapiens
atcctgtgtttcattacttga

SEQ ID NO: 4667036 - DNA, 22 bp, Homo sapiens
atcctgtgtttcattacttgaa

SEQ ID NO: 4667037 - DNA, 23 bp, Homo sapiens
atcctgtgtttcattacttgaat

SEQ ID NO: 4667038 - DNA, 13 bp, Homo sapiens
atccttacaatgt

SEQ ID NO: 4667039 - DNA, 20 bp, Homo sapiens
atccttacaatgtgaataat

SEQ ID NO: 4667040 - DNA, 16 bp, Homo sapiens
atccttatcagagcta

SEQ ID NO: 4667041 - DNA, 13 bp, Homo sapiens
atccttgaatcct

SEQ ID NO: 4667042 - DNA, 17 bp, Homo sapiens
atccttgaatcctatgt

SEQ ID NO: 4667043 - DNA, 14 bp, Homo sapiens
atccttgcccaggt

SEQ ID NO: 4667044 - DNA, 22 bp, Homo sapiens
atccttgggccataattatgaa

SEQ ID NO: 4667045 - DNA, 14 bp, Homo sapiens
atcctttgtcttgg

SEQ ID NO: 4667046 - DNA, 16 bp, Homo sapiens
atccttttttgtcatt

SEQ ID NO: 4667047 - DNA, 20 bp, Homo sapiens
atccttttttgtcattttat

SEQ ID NO: 4667048 - DNA, 13 bp, Homo sapiens
atcgacagacagc

SEQ ID NO: 4667049 - DNA, 17 bp, Homo sapiens
atcgacagacagccagg

SEQ ID NO: 4667050 - DNA, 22 bp, Homo sapiens
atcgattcccaagctcccttcc

SEQ ID NO: 4667051 - DNA, 14 bp, Homo sapiens
atcggactgccaaa

SEQ ID NO: 4667052 - DNA, 15 bp, Homo sapiens
atcggactgccaaat

SEQ ID NO: 4667053 - DNA, 15 bp, Homo sapiens
atcgttccagttccc

SEQ ID NO: 4667054 - DNA, 20 bp, Homo sapiens
atctaactgatgagtaaact

SEQ ID NO: 4667055 - DNA, 19 bp, Homo sapiens
atctaagcattccacactg

SEQ ID NO: 4667056 - DNA, 18 bp, Homo sapiens
atctacagtaatgaaatg

SEQ ID NO: 4667057 - DNA, 12 bp, Homo sapiens
atctacattaaa

SEQ ID NO: 4667058 - DNA, 18 bp, Homo sapiens
atctacattaaaatgaca

SEQ ID NO: 4667059 - DNA, 23 bp, Homo sapiens
atctagggaatgggactgtgagg

SEQ ID NO: 4667060 - DNA, 19 bp, Homo sapiens
atctagtgggttgaccttt

SEQ ID NO: 4667061 - DNA, 16 bp, Homo sapiens
atctatatgtacttgt

SEQ ID NO: 4667062 - DNA, 18 bp, Homo sapiens
atctatggcttatttcta

SEQ ID NO: 4667063 - DNA, 19 bp, Homo sapiens
atctatggcttatttctat

SEQ ID NO: 4667064 - DNA, 21 bp, Homo sapiens
atctatggcttatttctatga

SEQ ID NO: 4667065 - DNA, 17 bp, Homo sapiens
atctattgaaaatatat

SEQ ID NO: 4667066 - DNA, 17 bp, Homo sapiens
atctatttcacttattt

SEQ ID NO: 4667067 - DNA, 14 bp, Homo sapiens
atctcacaggctga

SEQ ID NO: 4667068 - DNA, 23 bp, Homo sapiens
atctcatgcccctggctgggacg

SEQ ID NO: 4667069 - DNA, 20 bp, Homo sapiens
atctcccacctagcagcacc

SEQ ID NO: 4667070 - DNA, 18 bp, Homo sapiens
atctcccttccacctcac

SEQ ID NO: 4667071 - DNA, 15 bp, Homo sapiens
atctcgaatttgaag

SEQ ID NO: 4667072 - DNA, 19 bp, Homo sapiens
atctcgaatttgaagagat

SEQ ID NO: 4667073 - DNA, 19 bp, Homo sapiens
atctcggctcactgcaatc

SEQ ID NO: 4667074 - DNA, 14 bp, Homo sapiens
atctctcaaatctg

SEQ ID NO: 4667075 - DNA, 15 bp, Homo sapiens
atctctcccttaccc

SEQ ID NO: 4667076 - DNA, 17 bp, Homo sapiens
atctctctagctttgtc

SEQ ID NO: 4667077 - DNA, 16 bp, Homo sapiens
atctctgaagaaacaa

SEQ ID NO: 4667078 - DNA, 14 bp, Homo sapiens
atctcttgaaacct

SEQ ID NO: 4667079 - DNA, 16 bp, Homo sapiens
atctgactgccaagcc

SEQ ID NO: 4667080 - DNA, 18 bp, Homo sapiens
atctgactgccaagccag

SEQ ID NO: 4667081 - DNA, 19 bp, Homo sapiens
atctgaggaggctttggta

SEQ ID NO: 4667082 - DNA, 22 bp, Homo sapiens
atctgcaaaaggcctcttgtaa

SEQ ID NO: 4667083 - DNA, 22 bp, Homo sapiens
atctgcacctagaacctccctc

SEQ ID NO: 4667084 - DNA, 16 bp, Homo sapiens
atctgccagacctgca

SEQ ID NO: 4667085 - DNA, 23 bp, Homo sapiens
atctgctcgcctgagggaagagt

SEQ ID NO: 4667086 - DNA, 22 bp, Homo sapiens
atctgctgtcctgtttctgtca

SEQ ID NO: 4667087 - DNA, 17 bp, Homo sapiens
atctgcttttcctctgc

SEQ ID NO: 4667088 - DNA, 19 bp, Homo sapiens
atctgcttttcctctgcct

SEQ ID NO: 4667089 - DNA, 20 bp, Homo sapiens
atctggaaggggatcccacc

SEQ ID NO: 4667090 - DNA, 14 bp, Homo sapiens
atctgggaaagaca

SEQ ID NO: 4667091 - DNA, 18 bp, Homo sapiens
atctgggtgcatgatctt

SEQ ID NO: 4667092 - DNA, 18 bp, Homo sapiens
atctgtaaagccagttag

SEQ ID NO: 4667093 - DNA, 11 bp, Homo sapiens
atctgtaacag

SEQ ID NO: 4667094 - DNA, 14 bp, Homo sapiens
atctgtctgctctg

SEQ ID NO: 4667095 - DNA, 15 bp, Homo sapiens
atctgtggagctgcc

SEQ ID NO: 4667096 - DNA, 19 bp, Homo sapiens
atctgtggagctgccacag

SEQ ID NO: 4667097 - DNA, 22 bp, Homo sapiens
atctgtgtacaaagaaataaca

SEQ ID NO: 4667098 - DNA, 9 bp, Homo sapiens
atctgtgtt

SEQ ID NO: 4667099 - DNA, 16 bp, Homo sapiens
atctgtgttctaactt

SEQ ID NO: 4667100 - DNA, 23 bp, Homo sapiens
atgcaacatttgtgcagaaattt

SEQ ID NO: 4667101 - DNA, 18 bp, Homo sapiens
atgcaagtcaggaatcat

SEQ ID NO: 4667102 - DNA, 23 bp, Homo sapiens
atgcaatgcttcattattcaaga

SEQ ID NO: 4667103 - DNA, 24 bp, Homo sapiens
atgcaatgtaagcatactttgtaa

SEQ ID NO: 4667104 - DNA, 16 bp, Homo sapiens
atgcaatgtgctactg

SEQ ID NO: 4667105 - DNA, 19 bp, Homo sapiens
atgcaattagcctcatagt

SEQ ID NO: 4667106 - DNA, 15 bp, Homo sapiens
atgcacacagataca

SEQ ID NO: 4667107 - DNA, 15 bp, Homo sapiens
atgcaccttgtgtct

SEQ ID NO: 4667108 - DNA, 16 bp, Homo sapiens
atgcaccttgtgtctg

SEQ ID NO: 4667109 - DNA, 18 bp, Homo sapiens
atgcaccttgtgtctgta

SEQ ID NO: 4667110 - DNA, 23 bp, Homo sapiens
atgcacgtttcaaagctttcctg

SEQ ID NO: 4667111 - DNA, 12 bp, Homo sapiens
atgcactgtttt

SEQ ID NO: 4667112 - DNA, 17 bp, Homo sapiens
atgcactgtttttaatc

SEQ ID NO: 4667113 - DNA, 15 bp, Homo sapiens
atgcagaggtctcca

SEQ ID NO: 4667114 - DNA, 21 bp, Homo sapiens
atgcagaggtctccaaactga

SEQ ID NO: 4667115 - DNA, 21 bp, Homo sapiens
atgcagctcttcaacatgaca

SEQ ID NO: 4667116 - DNA, 13 bp, Homo sapiens
atgcagggcagtc

SEQ ID NO: 4667117 - DNA, 12 bp, Homo sapiens
atgcaggtcagc

SEQ ID NO: 4667118 - DNA, 16 bp, Homo sapiens
atgcaggtcagcccat

SEQ ID NO: 4667119 - DNA, 14 bp, Homo sapiens
atgcatactttatt

SEQ ID NO: 4667120 - DNA, 18 bp, Homo sapiens
atgcatatgtcactagaa

SEQ ID NO: 4667121 - DNA, 20 bp, Homo sapiens
atgcatatgtcactagaatg

SEQ ID NO: 4667122 - DNA, 20 bp, Homo sapiens
atgcatatttataagagaag

SEQ ID NO: 4667123 - DNA, 20 bp, Homo sapiens
atgcatctttaattccttat

SEQ ID NO: 4667124 - DNA, 15 bp, Homo sapiens
atgcatgtcttttaa

SEQ ID NO: 4667125 - DNA, 18 bp, Homo sapiens
atgccactaacttctaaa

SEQ ID NO: 4667126 - DNA, 12 bp, Homo sapiens
atgccacttcct

SEQ ID NO: 4667127 - DNA, 16 bp, Homo sapiens
atgccagtctcattgt

SEQ ID NO: 4667128 - DNA, 19 bp, Homo sapiens
atgcccagatgaactgact

SEQ ID NO: 4667129 - DNA, 15 bp, Homo sapiens
atgcccccagctggc

SEQ ID NO: 4667130 - DNA, 17 bp, Homo sapiens
atgccccctccaggaga

SEQ ID NO: 4667131 - DNA, 12 bp, Homo sapiens
atgccctgtgca

SEQ ID NO: 4667132 - DNA, 13 bp, Homo sapiens
atgccctgtgcaa

SEQ ID NO: 4667133 - DNA, 18 bp, Homo sapiens
atgcctagagatatttca

SEQ ID NO: 4667134 - DNA, 22 bp, Homo sapiens
atgcctagagatatttcaagct

SEQ ID NO: 4667135 - DNA, 22 bp, Homo sapiens
atgcctccgaaggggctctgag

SEQ ID NO: 4667136 - DNA, 14 bp, Homo sapiens
atgcctcctgtggg

SEQ ID NO: 4667137 - DNA, 13 bp, Homo sapiens
atgcctctgaggc

SEQ ID NO: 4667138 - DNA, 19 bp, Homo sapiens
atgcctctgaggccagcct

SEQ ID NO: 4667139 - DNA, 22 bp, Homo sapiens
atgcctctgaggccagcctggc

SEQ ID NO: 4667140 - DNA, 18 bp, Homo sapiens
atgcctggtattttcaac

SEQ ID NO: 4667141 - DNA, 13 bp, Homo sapiens
atgccttaaaatg

SEQ ID NO: 4667142 - DNA, 17 bp, Homo sapiens
atgcggaggaaagcaag

SEQ ID NO: 4667143 - DNA, 16 bp, Homo sapiens
atgcgggccagtgctc

SEQ ID NO: 4667144 - DNA, 15 bp, Homo sapiens
atgcgtgggcagagg

SEQ ID NO: 4667145 - DNA, 16 bp, Homo sapiens
atgcgtgggcagagga

SEQ ID NO: 4667146 - DNA, 15 bp, Homo sapiens
atgctatgttctgtc

SEQ ID NO: 4667147 - DNA, 21 bp, Homo sapiens
atgctcccaactcccttctgc

SEQ ID NO: 4667148 - DNA, 22 bp, Homo sapiens
atgctctcactgtttgttttta

SEQ ID NO: 4667149 - DNA, 17 bp, Homo sapiens
atgctctctcaaattgt

SEQ ID NO: 4667150 - DNA, 19 bp, Homo sapiens
atgctctctcaaattgtca

SEQ ID NO: 4667151 - DNA, 17 bp, Homo sapiens
atgctcttgaaatattc

SEQ ID NO: 4667152 - DNA, 17 bp, Homo sapiens
atgctgatcttttaaaa

SEQ ID NO: 4667153 - DNA, 16 bp, Homo sapiens
atgctgcaaaggagaa

SEQ ID NO: 4667154 - DNA, 21 bp, Homo sapiens
atgctgcaatacattaaaata

SEQ ID NO: 4667155 - DNA, 16 bp, Homo sapiens
atgctggactggaggc

SEQ ID NO: 4667156 - DNA, 18 bp, Homo sapiens
atgctggctcccagggcc

SEQ ID NO: 4667157 - DNA, 19 bp, Homo sapiens
atgctgggccactggggac

SEQ ID NO: 4667158 - DNA, 13 bp, Homo sapiens
atgctgggctggg

SEQ ID NO: 4667159 - DNA, 21 bp, Homo sapiens
atgctggtactattgtgacca

SEQ ID NO: 4667160 - DNA, 23 bp, Homo sapiens
atgctgtgcattttttttttcat

SEQ ID NO: 4667161 - DNA, 12 bp, Homo sapiens
atgctgtgctac

SEQ ID NO: 4667162 - DNA, 18 bp, Homo sapiens
atgctgtgctccatattt

SEQ ID NO: 4667163 - DNA, 15 bp, Homo sapiens
atgctgtttctaaga

SEQ ID NO: 4667164 - DNA, 19 bp, Homo sapiens
atgcttacggccatctctt

SEQ ID NO: 4667165 - DNA, 21 bp, Homo sapiens
atgcttattgatgaggtttat

SEQ ID NO: 4667166 - DNA, 13 bp, Homo sapiens
atgcttcattatt

SEQ ID NO: 4667167 - DNA, 17 bp, Homo sapiens
atgcttctactgtgaca

SEQ ID NO: 4667168 - DNA, 19 bp, Homo sapiens
atgcttctactgtgacact

SEQ ID NO: 4667169 - DNA, 12 bp, Homo sapiens
atgcttctatca

SEQ ID NO: 4667170 - DNA, 22 bp, Homo sapiens
atgcttctatcagactcagttt

SEQ ID NO: 4667171 - DNA, 14 bp, Homo sapiens
atgcttctgggaga

SEQ ID NO: 4667172 - DNA, 22 bp, Homo sapiens
atgcttgattgttttggtctca

SEQ ID NO: 4667173 - DNA, 15 bp, Homo sapiens
atgcttttactaagc

SEQ ID NO: 4667174 - DNA, 19 bp, Homo sapiens
atggaaaactgtgttgcca

SEQ ID NO: 4667175 - DNA, 23 bp, Homo sapiens
atggaaaggagcctaggccaggt

SEQ ID NO: 4667176 - DNA, 18 bp, Homo sapiens
atggaagcttactctctg

SEQ ID NO: 4667177 - DNA, 16 bp, Homo sapiens
atggacaaataagttt

SEQ ID NO: 4667178 - DNA, 14 bp, Homo sapiens
atggacacgagcca

SEQ ID NO: 4667179 - DNA, 17 bp, Homo sapiens
atggacacgagccacaa

SEQ ID NO: 4667180 - DNA, 19 bp, Homo sapiens
atggacaggctggctccag

SEQ ID NO: 4667181 - DNA, 19 bp, Homo sapiens
atggagaaagaagtggaga

SEQ ID NO: 4667182 - DNA, 22 bp, Homo sapiens
atggagaaagaagtggagacag

SEQ ID NO: 4667183 - DNA, 15 bp, Homo sapiens
atggagagccctggg

SEQ ID NO: 4667184 - DNA, 16 bp, Homo sapiens
atggagagccctggga

SEQ ID NO: 4667185 - DNA, 17 bp, Homo sapiens
atggagaggcttcccta

SEQ ID NO: 4667186 - DNA, 17 bp, Homo sapiens
atggagcaagctcttcc

SEQ ID NO: 4667187 - DNA, 18 bp, Homo sapiens
atggaggagccaggcccc

SEQ ID NO: 4667188 - DNA, 19 bp, Homo sapiens
atggaggagccaggcccca

SEQ ID NO: 4667189 - DNA, 14 bp, Homo sapiens
atggaggcagatgc

SEQ ID NO: 4667190 - DNA, 19 bp, Homo sapiens
atggagggcttggcccagc

SEQ ID NO: 4667191 - DNA, 23 bp, Homo sapiens
atggagggtatactgaggggtct

SEQ ID NO: 4667192 - DNA, 21 bp, Homo sapiens
atggaggtcccagccctgggg

SEQ ID NO: 4667193 - DNA, 22 bp, Homo sapiens
atggagtagaggtactagaatg

SEQ ID NO: 4667194 - DNA, 13 bp, Homo sapiens
atggagtctcact

SEQ ID NO: 4667195 - DNA, 20 bp, Homo sapiens
atggataaaataatgctgca

SEQ ID NO: 4667196 - DNA, 21 bp, Homo sapiens
atggatggaaaacgctctcta

SEQ ID NO: 4667197 - DNA, 14 bp, Homo sapiens
atggatggcttcta

SEQ ID NO: 4667198 - DNA, 14 bp, Homo sapiens
atggatttgttaca

SEQ ID NO: 4667199 - DNA, 17 bp, Homo sapiens
atggatttgttacagcc

SEQ ID NO: 4667200 - DNA, 15 bp, Homo sapiens
atggcacctaagcat

SEQ ID NO: 4667201 - DNA, 16 bp, Homo sapiens
atggcatatggtccta

SEQ ID NO: 4667202 - DNA, 17 bp, Homo sapiens
atggcatttctctttaa

SEQ ID NO: 4667203 - DNA, 21 bp, Homo sapiens
atggcatttctctttaaacta

SEQ ID NO: 4667204 - DNA, 23 bp, Homo sapiens
atggcatttctctttaaactatg

SEQ ID NO: 4667205 - DNA, 18 bp, Homo sapiens
atggccggagaggaccgg

SEQ ID NO: 4667206 - DNA, 21 bp, Homo sapiens
atggcctcttactaatgtaaa

SEQ ID NO: 4667207 - DNA, 14 bp, Homo sapiens
atggccttgaaaca

SEQ ID NO: 4667208 - DNA, 17 bp, Homo sapiens
atggctcaagtctgcac

SEQ ID NO: 4667209 - DNA, 22 bp, Homo sapiens
atggcttatttctatgacaaat

SEQ ID NO: 4667210 - DNA, 14 bp, Homo sapiens
atgttgctctttca

SEQ ID NO: 4667211 - DNA, 15 bp, Homo sapiens
atgttgtacaatgta

SEQ ID NO: 4667212 - DNA, 15 bp, Homo sapiens
atgttgtacttgaaa

SEQ ID NO: 4667213 - DNA, 12 bp, Homo sapiens
atgtttaaaata

SEQ ID NO: 4667214 - DNA, 17 bp, Homo sapiens
atgtttaaaataaaatg

SEQ ID NO: 4667215 - DNA, 18 bp, Homo sapiens
atgtttaaaataaaatga

SEQ ID NO: 4667216 - DNA, 19 bp, Homo sapiens
atgtttaaaataaaatgaa

SEQ ID NO: 4667217 - DNA, 18 bp, Homo sapiens
atgtttaataaagcttta

SEQ ID NO: 4667218 - DNA, 23 bp, Homo sapiens
atgtttaggggcaaacatcacaa

SEQ ID NO: 4667219 - DNA, 20 bp, Homo sapiens
atgtttagttttacatttta

SEQ ID NO: 4667220 - DNA, 14 bp, Homo sapiens
atgtttatgaaggg

SEQ ID NO: 4667221 - DNA, 13 bp, Homo sapiens
atgtttcattatg

SEQ ID NO: 4667222 - DNA, 12 bp, Homo sapiens
atgtttccccca

SEQ ID NO: 4667223 - DNA, 15 bp, Homo sapiens
atgtttcccccactc

SEQ ID NO: 4667224 - DNA, 16 bp, Homo sapiens
atgtttccctctcctt

SEQ ID NO: 4667225 - DNA, 19 bp, Homo sapiens
atgtttccctctccttcca

SEQ ID NO: 4667226 - DNA, 13 bp, Homo sapiens
atgtttgcagggg

SEQ ID NO: 4667227 - DNA, 14 bp, Homo sapiens
atgtttgtgtctgt

SEQ ID NO: 4667228 - DNA, 15 bp, Homo sapiens
atgtttgtgtctgtg

SEQ ID NO: 4667229 - DNA, 13 bp, Homo sapiens
atgttttaaagaa

SEQ ID NO: 4667230 - DNA, 16 bp, Homo sapiens
atgttttccattgttt

SEQ ID NO: 4667231 - DNA, 16 bp, Homo sapiens
attaaaaagaatagaa

SEQ ID NO: 4667232 - DNA, 13 bp, Homo sapiens
attaaaaatgttc

SEQ ID NO: 4667233 - DNA, 15 bp, Homo sapiens
attaaaaatgttctc

SEQ ID NO: 4667234 - DNA, 18 bp, Homo sapiens
attaaaaatgttctcaaa

SEQ ID NO: 4667235 - DNA, 20 bp, Homo sapiens
attaaaaatgttctcaaata

SEQ ID NO: 4667236 - DNA, 13 bp, Homo sapiens
attaaaaattacc

SEQ ID NO: 4667237 - DNA, 14 bp, Homo sapiens
attaaaacaaatat

SEQ ID NO: 4667238 - DNA, 19 bp, Homo sapiens
attaaaacatatttcattt

SEQ ID NO: 4667239 - DNA, 13 bp, Homo sapiens
attaaaatgacaa

SEQ ID NO: 4667240 - DNA, 17 bp, Homo sapiens
attaaaatgacaaacat

SEQ ID NO: 4667241 - DNA, 20 bp, Homo sapiens
attaaaatgacaaacatgat

SEQ ID NO: 4667242 - DNA, 14 bp, Homo sapiens
attaaaccctggat

SEQ ID NO: 4667243 - DNA, 19 bp, Homo sapiens
attaaacgtatgcatgtga

SEQ ID NO: 4667244 - DNA, 14 bp, Homo sapiens
attaaagtaaatgg

SEQ ID NO: 4667245 - DNA, 13 bp, Homo sapiens
attaaatttaatt

SEQ ID NO: 4667246 - DNA, 15 bp, Homo sapiens
attaacacaaaggaa

SEQ ID NO: 4667247 - DNA, 12 bp, Homo sapiens
attaacattttt

SEQ ID NO: 4667248 - DNA, 17 bp, Homo sapiens
attaaccttactaatta

SEQ ID NO: 4667249 - DNA, 17 bp, Homo sapiens
attaaccttttttgtct

SEQ ID NO: 4667250 - DNA, 23 bp, Homo sapiens
attaaccttttttgtcttattga

SEQ ID NO: 4667251 - DNA, 14 bp, Homo sapiens
attaactccctcca

SEQ ID NO: 4667252 - DNA, 15 bp, Homo sapiens
attaactgtaaactt

SEQ ID NO: 4667253 - DNA, 14 bp, Homo sapiens
attaagcagaaaca

SEQ ID NO: 4667254 - DNA, 15 bp, Homo sapiens
attaagcagaaacag

SEQ ID NO: 4667255 - DNA, 15 bp, Homo sapiens
attaagcattctttc

SEQ ID NO: 4667256 - DNA, 22 bp, Homo sapiens
attaagctgttcctgttcagta

SEQ ID NO: 4667257 - DNA, 20 bp, Homo sapiens
attaagcttttgtctgtagg

SEQ ID NO: 4667258 - DNA, 16 bp, Homo sapiens
attaagggctacttaa

SEQ ID NO: 4667259 - DNA, 12 bp, Homo sapiens
attaaggttttc

SEQ ID NO: 4667260 - DNA, 18 bp, Homo sapiens
attaatattaattttcta

SEQ ID NO: 4667261 - DNA, 14 bp, Homo sapiens
attaatcatacaaa

SEQ ID NO: 4667262 - DNA, 20 bp, Homo sapiens
attaatcatacaaactctca

SEQ ID NO: 4667263 - DNA, 22 bp, Homo sapiens
attaatcatacaaactctcacc

SEQ ID NO: 4667264 - DNA, 13 bp, Homo sapiens
attaatcttgatc

SEQ ID NO: 4667265 - DNA, 14 bp, Homo sapiens
attaatcttgatca

SEQ ID NO: 4667266 - DNA, 16 bp, Homo sapiens
attaatgacacttgtc

SEQ ID NO: 4667267 - DNA, 22 bp, Homo sapiens
attaatggacaaataagttttt

SEQ ID NO: 4667268 - DNA, 14 bp, Homo sapiens
attaatgttgatga

SEQ ID NO: 4667269 - DNA, 15 bp, Homo sapiens
attaatgttttcatt

SEQ ID NO: 4667270 - DNA, 17 bp, Homo sapiens
attaatgttttcattat

SEQ ID NO: 4667271 - DNA, 21 bp, Homo sapiens
attaattaaatgaacttatgt

SEQ ID NO: 4667272 - DNA, 18 bp, Homo sapiens
attaattgttttgcactt

SEQ ID NO: 4667273 - DNA, 20 bp, Homo sapiens
attaattgttttgcactttt

SEQ ID NO: 4667274 - DNA, 15 bp, Homo sapiens
attaatttaattact

SEQ ID NO: 4667275 - DNA, 21 bp, Homo sapiens
attaattttcttggttctttc

SEQ ID NO: 4667276 - DNA, 17 bp, Homo sapiens
attaattttttttcatt

SEQ ID NO: 4667277 - DNA, 19 bp, Homo sapiens
attacaaatgcaaatttct

SEQ ID NO: 4667278 - DNA, 21 bp, Homo sapiens
attacaaatgcaaatttctat

SEQ ID NO: 4667279 - DNA, 13 bp, Homo sapiens
attacaattttat

SEQ ID NO: 4667280 - DNA, 14 bp, Homo sapiens
attacaattttatc

SEQ ID NO: 4667281 - DNA, 18 bp, Homo sapiens
attacaattttatctgtt

SEQ ID NO: 4667282 - DNA, 17 bp, Homo sapiens
attacacttgtctttac

SEQ ID NO: 4667283 - DNA, 20 bp, Homo sapiens
attaccagttttccagaaca

SEQ ID NO: 4667284 - DNA, 18 bp, Homo sapiens
attaccatcttaatcttt

SEQ ID NO: 4667285 - DNA, 16 bp, Homo sapiens
attaccccttcatgtc

SEQ ID NO: 4667286 - DNA, 16 bp, Homo sapiens
attaccgtcacactct

SEQ ID NO: 4667287 - DNA, 19 bp, Homo sapiens
attaccttctattggtctc

SEQ ID NO: 4667288 - DNA, 22 bp, Homo sapiens
attactaaggcaggtgggcaga

SEQ ID NO: 4667289 - DNA, 18 bp, Homo sapiens
attactctagtttattct

SEQ ID NO: 4667290 - DNA, 19 bp, Homo sapiens
attactctagtttattcta

SEQ ID NO: 4667291 - DNA, 21 bp, Homo sapiens
attactgaataatatcaaata

SEQ ID NO: 4667292 - DNA, 14 bp, Homo sapiens
attactgggcctta

SEQ ID NO: 4667293 - DNA, 15 bp, Homo sapiens
attactgggccttag

SEQ ID NO: 4667294 - DNA, 23 bp, Homo sapiens
attactgggccttagtgggccag

SEQ ID NO: 4667295 - DNA, 19 bp, Homo sapiens
attactgttccagattcct

SEQ ID NO: 4667296 - DNA, 19 bp, Homo sapiens
attacttgtaattatgaaa

SEQ ID NO: 4667297 - DNA, 14 bp, Homo sapiens
attagataatattt

SEQ ID NO: 4667298 - DNA, 20 bp, Homo sapiens
attagcagccatattgtcac

SEQ ID NO: 4667299 - DNA, 23 bp, Homo sapiens
attagccaactgtttccctgctg

SEQ ID NO: 4667300 - DNA, 19 bp, Homo sapiens
attaggctcttttaggtaa

SEQ ID NO: 4667301 - DNA, 12 bp, Homo sapiens
attaggctgttg

SEQ ID NO: 4667302 - DNA, 22 bp, Homo sapiens
attagggttgcctcactgtagc

SEQ ID NO: 4667303 - DNA, 22 bp, Homo sapiens
attagtattaatactacccata

SEQ ID NO: 4667304 - DNA, 12 bp, Homo sapiens
attatacttgag

SEQ ID NO: 4667305 - DNA, 16 bp, Homo sapiens
attatataaactgtgc

SEQ ID NO: 4667306 - DNA, 17 bp, Homo sapiens
attatatggcaggagct

SEQ ID NO: 4667307 - DNA, 23 bp, Homo sapiens
attatccctatttttaaagtaca

SEQ ID NO: 4667308 - DNA, 17 bp, Homo sapiens
attatcttgctcattct

SEQ ID NO: 4667309 - DNA, 17 bp, Homo sapiens
attatgaaaagaaataa

SEQ ID NO: 4667310 - DNA, 12 bp, Homo sapiens
attatgaagaat

SEQ ID NO: 4667311 - DNA, 18 bp, Homo sapiens
attatgacatttcttaaa

SEQ ID NO: 4667312 - DNA, 19 bp, Homo sapiens
attatgacatttcttaaaa

SEQ ID NO: 4667313 - DNA, 23 bp, Homo sapiens
attatgacatttcttaaaacttt

SEQ ID NO: 4667314 - DNA, 23 bp, Homo sapiens
attatgatgaaaacctacatatt

SEQ ID NO: 4667315 - DNA, 14 bp, Homo sapiens
attatgtggaatcc

SEQ ID NO: 4667316 - DNA, 14 bp, Homo sapiens
attatgttcatgta

SEQ ID NO: 4667317 - DNA, 20 bp, Homo sapiens
attatgttcatgtaagaagc

SEQ ID NO: 4667318 - DNA, 20 bp, Homo sapiens
attatgtttatttcatgtgg

SEQ ID NO: 4667319 - DNA, 17 bp, Homo sapiens
attattagataatattt

SEQ ID NO: 4667320 - DNA, 12 bp, Homo sapiens
attggaaatgta

SEQ ID NO: 4667321 - DNA, 17 bp, Homo sapiens
attggacagaaaatgca

SEQ ID NO: 4667322 - DNA, 18 bp, Homo sapiens
attggacagaaaatgcaa

SEQ ID NO: 4667323 - DNA, 14 bp, Homo sapiens
attggaggctgcag

SEQ ID NO: 4667324 - DNA, 18 bp, Homo sapiens
attgggatatcattttaa

SEQ ID NO: 4667325 - DNA, 13 bp, Homo sapiens
attgggtttttat

SEQ ID NO: 4667326 - DNA, 17 bp, Homo sapiens
attggtgctatttgaag

SEQ ID NO: 4667327 - DNA, 20 bp, Homo sapiens
attgtaactattaacctttt

SEQ ID NO: 4667328 - DNA, 17 bp, Homo sapiens
attgtaagtgaaattaa

SEQ ID NO: 4667329 - DNA, 20 bp, Homo sapiens
attgtaagtgaaattaagca

SEQ ID NO: 4667330 - DNA, 23 bp, Homo sapiens
attgtaagtgaaattaagcattt

SEQ ID NO: 4667331 - DNA, 19 bp, Homo sapiens
attgtaatatgacagataa

SEQ ID NO: 4667332 - DNA, 21 bp, Homo sapiens
attgtacagtttttattgctt

SEQ ID NO: 4667333 - DNA, 15 bp, Homo sapiens
attgtatcgatgtta

SEQ ID NO: 4667334 - DNA, 14 bp, Homo sapiens
attgtatctacatt

SEQ ID NO: 4667335 - DNA, 21 bp, Homo sapiens
attgtatctacattaaaatga

SEQ ID NO: 4667336 - DNA, 23 bp, Homo sapiens
attgtatctacattaaaatgaca

SEQ ID NO: 4667337 - DNA, 16 bp, Homo sapiens
attgtattcagataat

SEQ ID NO: 4667338 - DNA, 16 bp, Homo sapiens
attgtcagccttgcta

SEQ ID NO: 4667339 - DNA, 21 bp, Homo sapiens
attgtcatatcagcacatatt

SEQ ID NO: 4667340 - DNA, 13 bp, Homo sapiens
attgtgtctcccg

SEQ ID NO: 4667341 - DNA, 19 bp, Homo sapiens
attgttaataataattatt

SEQ ID NO: 4667342 - DNA, 14 bp, Homo sapiens
attgttcccttcct

SEQ ID NO: 4667343 - DNA, 15 bp, Homo sapiens
attgttcccttcctc

SEQ ID NO: 4667344 - DNA, 23 bp, Homo sapiens
attgttcccttcctcttcctgcc

SEQ ID NO: 4667345 - DNA, 17 bp, Homo sapiens
attgttgaatctatttc

SEQ ID NO: 4667346 - DNA, 13 bp, Homo sapiens
attgttgttgcca

SEQ ID NO: 4667347 - DNA, 17 bp, Homo sapiens
attgtttgaaacaaaga

SEQ ID NO: 4667348 - DNA, 21 bp, Homo sapiens
attgttttacctgttctgaaa

SEQ ID NO: 4667349 - DNA, 22 bp, Homo sapiens
attgttttctatttatgccttg

SEQ ID NO: 4667350 - DNA, 17 bp, Homo sapiens
attgttttcttttacag

SEQ ID NO: 4667351 - DNA, 15 bp, Homo sapiens
attgttttgcacttt

SEQ ID NO: 4667352 - DNA, 16 bp, Homo sapiens
attgtttttatttcta

SEQ ID NO: 4667353 - DNA, 13 bp, Homo sapiens
atttaaaaacaac

SEQ ID NO: 4667354 - DNA, 15 bp, Homo sapiens
atttaaaaacttaaa

SEQ ID NO: 4667355 - DNA, 17 bp, Homo sapiens
atttaaaaacttaaata

SEQ ID NO: 4667356 - DNA, 21 bp, Homo sapiens
atttaaattacaattttatct

SEQ ID NO: 4667357 - DNA, 22 bp, Homo sapiens
atttaaattccacagattatca

SEQ ID NO: 4667358 - DNA, 17 bp, Homo sapiens
atttaacaaaaaatgta

SEQ ID NO: 4667359 - DNA, 18 bp, Homo sapiens
atttaacaaaaaatgtaa

SEQ ID NO: 4667360 - DNA, 13 bp, Homo sapiens
atttaactttata

SEQ ID NO: 4667361 - DNA, 14 bp, Homo sapiens
atttaagacacatt

SEQ ID NO: 4667362 - DNA, 19 bp, Homo sapiens
atttaagcataatctgaaa

SEQ ID NO: 4667363 - DNA, 15 bp, Homo sapiens
atttaagttcctgct

SEQ ID NO: 4667364 - DNA, 16 bp, Homo sapiens
atttaagttcctgctg

SEQ ID NO: 4667365 - DNA, 13 bp, Homo sapiens
atttaatactttt

SEQ ID NO: 4667366 - DNA, 23 bp, Homo sapiens
atttaatgcctgcccattagaga

SEQ ID NO: 4667367 - DNA, 20 bp, Homo sapiens
atttaccaaagagatattga

SEQ ID NO: 4667368 - DNA, 19 bp, Homo sapiens
atttacccaactctgtaca

SEQ ID NO: 4667369 - DNA, 15 bp, Homo sapiens
atttagaagcagagg

SEQ ID NO: 4667370 - DNA, 19 bp, Homo sapiens
atttagaagcagagggaca

SEQ ID NO: 4667371 - DNA, 23 bp, Homo sapiens
atttagataatttgaaaaagttc

SEQ ID NO: 4667372 - DNA, 17 bp, Homo sapiens
atttagcttctttccct

SEQ ID NO: 4667373 - DNA, 14 bp, Homo sapiens
atttaggaaaatgc

SEQ ID NO: 4667374 - DNA, 19 bp, Homo sapiens
atttataaaaatataaatt

SEQ ID NO: 4667375 - DNA, 22 bp, Homo sapiens
atttataaaaatataaattgta

SEQ ID NO: 4667376 - DNA, 16 bp, Homo sapiens
atttataatactgttt

SEQ ID NO: 4667377 - DNA, 20 bp, Homo sapiens
atttataatactgttttaaa

SEQ ID NO: 4667378 - DNA, 18 bp, Homo sapiens
atttatacctcaaactat

SEQ ID NO: 4667379 - DNA, 16 bp, Homo sapiens
atttatagaaatgaca

SEQ ID NO: 4667380 - DNA, 15 bp, Homo sapiens
atttatataaatttt

SEQ ID NO: 4667381 - DNA, 15 bp, Homo sapiens
atttatcaggagaag

SEQ ID NO: 4667382 - DNA, 15 bp, Homo sapiens
atttattcatagata

SEQ ID NO: 4667383 - DNA, 13 bp, Homo sapiens
atttattcctgtt

SEQ ID NO: 4667384 - DNA, 14 bp, Homo sapiens
atttattgttagaa

SEQ ID NO: 4667385 - DNA, 14 bp, Homo sapiens
atttcaaaatacat

SEQ ID NO: 4667386 - DNA, 21 bp, Homo sapiens
atttcaaaatacatttgtaag

SEQ ID NO: 4667387 - DNA, 21 bp, Homo sapiens
atttcaaaatcagtttttcat

SEQ ID NO: 4667388 - DNA, 14 bp, Homo sapiens
atttcaagctcatg

SEQ ID NO: 4667389 - DNA, 16 bp, Homo sapiens
atttcaagctcatgtc

SEQ ID NO: 4667390 - DNA, 17 bp, Homo sapiens
atttcaagctcatgtca

SEQ ID NO: 4667391 - DNA, 14 bp, Homo sapiens
atttcaatcattga

SEQ ID NO: 4667392 - DNA, 16 bp, Homo sapiens
atttcaatcattgaag

SEQ ID NO: 4667393 - DNA, 22 bp, Homo sapiens
atttcacacagtgaaacgcaat

SEQ ID NO: 4667394 - DNA, 16 bp, Homo sapiens
atttcacatttctact

SEQ ID NO: 4667395 - DNA, 23 bp, Homo sapiens
atttcaccactcaaaggccagac

SEQ ID NO: 4667396 - DNA, 14 bp, Homo sapiens
atttcagaaggaga

SEQ ID NO: 4667397 - DNA, 16 bp, Homo sapiens
atttcatgaaaaagct

SEQ ID NO: 4667398 - DNA, 13 bp, Homo sapiens
atttcattccatt

SEQ ID NO: 4667399 - DNA, 17 bp, Homo sapiens
atttcattccattgcct

SEQ ID NO: 4667400 - DNA, 12 bp, Homo sapiens
atttcattgcac

SEQ ID NO: 4667401 - DNA, 14 bp, Homo sapiens
atttcattgcactt

SEQ ID NO: 4667402 - DNA, 20 bp, Homo sapiens
atttcattgtacaagtatta

SEQ ID NO: 4667403 - DNA, 19 bp, Homo sapiens
atttcattttaacatgatt

SEQ ID NO: 4667404 - DNA, 15 bp, Homo sapiens
atttcccagggttaa

SEQ ID NO: 4667405 - DNA, 21 bp, Homo sapiens
atttccttaaaatctctaata

SEQ ID NO: 4667406 - DNA, 22 bp, Homo sapiens
atttcgtttggtcttaggtctt

SEQ ID NO: 4667407 - DNA, 18 bp, Homo sapiens
atttctacaactggagtt

SEQ ID NO: 4667408 - DNA, 13 bp, Homo sapiens
atttctactctag

SEQ ID NO: 4667409 - DNA, 23 bp, Homo sapiens
atttctagcaaacagatgtttgt

SEQ ID NO: 4667410 - DNA, 21 bp, Homo sapiens
atttctagttctttcctcccc

SEQ ID NO: 4667411 - DNA, 13 bp, Homo sapiens
atttctataaatt

SEQ ID NO: 4667412 - DNA, 20 bp, Homo sapiens
atttctataaatttaagaaa

SEQ ID NO: 4667413 - DNA, 17 bp, Homo sapiens
atttctatgacaaattc

SEQ ID NO: 4667414 - DNA, 19 bp, Homo sapiens
atttctatgacaaattcaa

SEQ ID NO: 4667415 - DNA, 14 bp, Homo sapiens
atttctattattaa

SEQ ID NO: 4667416 - DNA, 22 bp, Homo sapiens
atttctattattaattgcaaaa

SEQ ID NO: 4667417 - DNA, 21 bp, Homo sapiens
atttctcagactttggaaaat

SEQ ID NO: 4667418 - DNA, 23 bp, Homo sapiens
atttctctattttcataatcagt

SEQ ID NO: 4667419 - DNA, 21 bp, Homo sapiens
atttctcttctacccttttcc

SEQ ID NO: 4667420 - DNA, 19 bp, Homo sapiens
atttctctttaaactatgt

SEQ ID NO: 4667421 - DNA, 16 bp, Homo sapiens
atttctgcctcccctt

SEQ ID NO: 4667422 - DNA, 14 bp, Homo sapiens
atttctgctctgga

SEQ ID NO: 4667423 - DNA, 15 bp, Homo sapiens
atttctgctctggaa

SEQ ID NO: 4667424 - DNA, 18 bp, Homo sapiens
atttctgctctggaataa

SEQ ID NO: 4667425 - DNA, 21 bp, Homo sapiens
atttctgctctggaataaagt

SEQ ID NO: 4667426 - DNA, 16 bp, Homo sapiens
atttctgttccttttt

SEQ ID NO: 4667427 - DNA, 14 bp, Homo sapiens
atttcttggcatgc

SEQ ID NO: 4667428 - DNA, 18 bp, Homo sapiens
atttctttaaaagaatga

SEQ ID NO: 4667429 - DNA, 16 bp, Homo sapiens
atttctttatatttat

SEQ ID NO: 4667430 - DNA, 14 bp, Homo sapiens
caaaatacttcttt

SEQ ID NO: 4667431 - DNA, 16 bp, Homo sapiens
caaaatatgtttaaaa

SEQ ID NO: 4667432 - DNA, 15 bp, Homo sapiens
caaaatcaacatgac

SEQ ID NO: 4667433 - DNA, 18 bp, Homo sapiens
caaaatcagtttttcata

SEQ ID NO: 4667434 - DNA, 15 bp, Homo sapiens
caaaattcatttcta

SEQ ID NO: 4667435 - DNA, 13 bp, Homo sapiens
caaaatttgtttg

SEQ ID NO: 4667436 - DNA, 19 bp, Homo sapiens
caaacaagccccctgccct

SEQ ID NO: 4667437 - DNA, 13 bp, Homo sapiens
caaacaattcgaa

SEQ ID NO: 4667438 - DNA, 18 bp, Homo sapiens
caaacactccaccctcca

SEQ ID NO: 4667439 - DNA, 13 bp, Homo sapiens
caaacagaacagg

SEQ ID NO: 4667440 - DNA, 13 bp, Homo sapiens
caaacagatgttt

SEQ ID NO: 4667441 - DNA, 18 bp, Homo sapiens
caaacagccaagattttc

SEQ ID NO: 4667442 - DNA, 11 bp, Homo sapiens
caaacatcaca

SEQ ID NO: 4667443 - DNA, 19 bp, Homo sapiens
caaacatcacaaaatgtaa

SEQ ID NO: 4667444 - DNA, 17 bp, Homo sapiens
caaacatcccccaatga

SEQ ID NO: 4667445 - DNA, 23 bp, Homo sapiens
caaacattagtatagtctccctt

SEQ ID NO: 4667446 - DNA, 20 bp, Homo sapiens
caaaccaggggacactttgt

SEQ ID NO: 4667447 - DNA, 16 bp, Homo sapiens
caaacccttgctttcc

SEQ ID NO: 4667448 - DNA, 11 bp, Homo sapiens
caaacctctgt

SEQ ID NO: 4667449 - DNA, 15 bp, Homo sapiens
caaacctctgttcag

SEQ ID NO: 4667450 - DNA, 23 bp, Homo sapiens
caaacctctgttcagtgtaaata

SEQ ID NO: 4667451 - DNA, 19 bp, Homo sapiens
caaacctgtcttggggcca

SEQ ID NO: 4667452 - DNA, 19 bp, Homo sapiens
caaacgagactttctcctg

SEQ ID NO: 4667453 - DNA, 14 bp, Homo sapiens
caaactcctgacct

SEQ ID NO: 4667454 - DNA, 21 bp, Homo sapiens
caaacttaatgttcttatgca

SEQ ID NO: 4667455 - DNA, 13 bp, Homo sapiens
caaacttgcttta

SEQ ID NO: 4667456 - DNA, 22 bp, Homo sapiens
caaacttgttcatttagataat

SEQ ID NO: 4667457 - DNA, 14 bp, Homo sapiens
caaagaaaatgcct

SEQ ID NO: 4667458 - DNA, 23 bp, Homo sapiens
caaagaaacaagctgtgcaggca

SEQ ID NO: 4667459 - DNA, 11 bp, Homo sapiens
caaagaatatt

SEQ ID NO: 4667460 - DNA, 14 bp, Homo sapiens
caaagacaaaagtc

SEQ ID NO: 4667461 - DNA, 19 bp, Homo sapiens
caaagacccgggagctggc

SEQ ID NO: 4667462 - DNA, 17 bp, Homo sapiens
caaagactgtgaacagc

SEQ ID NO: 4667463 - DNA, 22 bp, Homo sapiens
caaagactgtgaacagcttgct

SEQ ID NO: 4667464 - DNA, 11 bp, Homo sapiens
caaagagcact

SEQ ID NO: 4667465 - DNA, 17 bp, Homo sapiens
caaagagcacttgagct

SEQ ID NO: 4667466 - DNA, 21 bp, Homo sapiens
caaagagcacttgagctgtct

SEQ ID NO: 4667467 - DNA, 21 bp, Homo sapiens
caaagcacttgcttacatcct

SEQ ID NO: 4667468 - DNA, 16 bp, Homo sapiens
caaagcagacagctcc

SEQ ID NO: 4667469 - DNA, 12 bp, Homo sapiens
caaagcagccac

SEQ ID NO: 4667470 - DNA, 16 bp, Homo sapiens
caaagccaaacaaaac

SEQ ID NO: 4667471 - DNA, 14 bp, Homo sapiens
caaagcctgaggac

SEQ ID NO: 4667472 - DNA, 21 bp, Homo sapiens
caaagcctgttcatggcagat

SEQ ID NO: 4667473 - DNA, 15 bp, Homo sapiens
caaagcctttaaatt

SEQ ID NO: 4667474 - DNA, 17 bp, Homo sapiens
caaagcggtccctgtcc

SEQ ID NO: 4667475 - DNA, 14 bp, Homo sapiens
caaagctcaaagta

SEQ ID NO: 4667476 - DNA, 20 bp, Homo sapiens
caaagcttgtcaaagatgcc

SEQ ID NO: 4667477 - DNA, 11 bp, Homo sapiens
caaaggaaagg

SEQ ID NO: 4667478 - DNA, 23 bp, Homo sapiens
caaaggaatttgcatccagcagc

SEQ ID NO: 4667479 - DNA, 18 bp, Homo sapiens
caaaggagaagcacagct

SEQ ID NO: 4667480 - DNA, 11 bp, Homo sapiens
caaaggagcct

SEQ ID NO: 4667481 - DNA, 12 bp, Homo sapiens
caaaggagcctg

SEQ ID NO: 4667482 - DNA, 14 bp, Homo sapiens
caaaggagcctgtg

SEQ ID NO: 4667483 - DNA, 18 bp, Homo sapiens
caaaggccagacctgcag

SEQ ID NO: 4667484 - DNA, 21 bp, Homo sapiens
caaaggccagacctgcagacg

SEQ ID NO: 4667485 - DNA, 20 bp, Homo sapiens
caaagggaagtaacagacac

SEQ ID NO: 4667486 - DNA, 17 bp, Homo sapiens
caaagtatgcaatgctt

SEQ ID NO: 4667487 - DNA, 13 bp, Homo sapiens
caaataaatgttt

SEQ ID NO: 4667488 - DNA, 22 bp, Homo sapiens
caaataagtaatatctttcagt

SEQ ID NO: 4667489 - DNA, 13 bp, Homo sapiens
caaataagttttt

SEQ ID NO: 4667490 - DNA, 16 bp, Homo sapiens
caaataagtttttgct

SEQ ID NO: 4667491 - DNA, 19 bp, Homo sapiens
caaatacaaagtggaaact

SEQ ID NO: 4667492 - DNA, 14 bp, Homo sapiens
caaatacatgtgta

SEQ ID NO: 4667493 - DNA, 15 bp, Homo sapiens
caaatatcaaataaa

SEQ ID NO: 4667494 - DNA, 21 bp, Homo sapiens
caaatatgagtacaaatgcct

SEQ ID NO: 4667495 - DNA, 19 bp, Homo sapiens
caaatccaaggaaacatgc

SEQ ID NO: 4667496 - DNA, 16 bp, Homo sapiens
caaatccgccagtgtt

SEQ ID NO: 4667497 - DNA, 17 bp, Homo sapiens
caaatccgccagtgttt

SEQ ID NO: 4667498 - DNA, 13 bp, Homo sapiens
caaatcctatgtg

SEQ ID NO: 4667499 - DNA, 21 bp, Homo sapiens
caaatcctatgtgattttaac

SEQ ID NO: 4667500 - DNA, 23 bp, Homo sapiens
caaatcctatgtgattttaactc

SEQ ID NO: 4667501 - DNA, 14 bp, Homo sapiens
caaatctcttgctt

SEQ ID NO: 4667502 - DNA, 22 bp, Homo sapiens
caaatcttggcaatattcctta

SEQ ID NO: 4667503 - DNA, 15 bp, Homo sapiens
caaatgaagaaagtc

SEQ ID NO: 4667504 - DNA, 10 bp, Homo sapiens
caaatgaatt

SEQ ID NO: 4667505 - DNA, 12 bp, Homo sapiens
caaatgagccat

SEQ ID NO: 4667506 - DNA, 13 bp, Homo sapiens
caaatgagccatg

SEQ ID NO: 4667507 - DNA, 23 bp, Homo sapiens
caaatgcaaatttctataaattt

SEQ ID NO: 4667508 - DNA, 22 bp, Homo sapiens
caaatgcagaaccacaaacaat

SEQ ID NO: 4667509 - DNA, 19 bp, Homo sapiens
caaatgccttaaaatggaa

SEQ ID NO: 4667510 - DNA, 15 bp, Homo sapiens
caaatgtggccaagc

SEQ ID NO: 4667511 - DNA, 23 bp, Homo sapiens
caaattaaaacaaatatacattt

SEQ ID NO: 4667512 - DNA, 19 bp, Homo sapiens
caaattaaaacatatttca

SEQ ID NO: 4667513 - DNA, 23 bp, Homo sapiens
caaattaaaacatatttcatttt

SEQ ID NO: 4667514 - DNA, 18 bp, Homo sapiens
caaattgtgcagtacttt

SEQ ID NO: 4667515 - DNA, 17 bp, Homo sapiens
caaatttcattgcactt

SEQ ID NO: 4667516 - DNA, 19 bp, Homo sapiens
caaatttcattgcactttc

SEQ ID NO: 4667517 - DNA, 17 bp, Homo sapiens
caaatttctataaattt

SEQ ID NO: 4667518 - DNA, 22 bp, Homo sapiens
caacaaatttcattgcactttc

SEQ ID NO: 4667519 - DNA, 15 bp, Homo sapiens
caacaacaattggta

SEQ ID NO: 4667520 - DNA, 19 bp, Homo sapiens
caacaacgtgagagaaaga

SEQ ID NO: 4667521 - DNA, 22 bp, Homo sapiens
caacaacgtgagagaaagagag

SEQ ID NO: 4667522 - DNA, 22 bp, Homo sapiens
caacaagtgctcctgaaagaaa

SEQ ID NO: 4667523 - DNA, 15 bp, Homo sapiens
caacaataaaatttt

SEQ ID NO: 4667524 - DNA, 16 bp, Homo sapiens
caacaataaaattttt

SEQ ID NO: 4667525 - DNA, 13 bp, Homo sapiens
caacaataacact

SEQ ID NO: 4667526 - DNA, 19 bp, Homo sapiens
caacaattggtaaaactca

SEQ ID NO: 4667527 - DNA, 21 bp, Homo sapiens
caacacagataattttttctt

SEQ ID NO: 4667528 - DNA, 15 bp, Homo sapiens
caacaccaagcacag

SEQ ID NO: 4667529 - DNA, 17 bp, Homo sapiens
caacacgcacctgcctc

SEQ ID NO: 4667530 - DNA, 12 bp, Homo sapiens
caacagcacaca

SEQ ID NO: 4667531 - DNA, 13 bp, Homo sapiens
caacagcacacag

SEQ ID NO: 4667532 - DNA, 23 bp, Homo sapiens
caacagcacacaggcagccagcc

SEQ ID NO: 4667533 - DNA, 22 bp, Homo sapiens
caacagggaagaaactttctgg

SEQ ID NO: 4667534 - DNA, 21 bp, Homo sapiens
caacagggagcacctgtctgg

SEQ ID NO: 4667535 - DNA, 20 bp, Homo sapiens
caacaggtcacttgatcatg

SEQ ID NO: 4667536 - DNA, 20 bp, Homo sapiens
caacaggtcatgttcaattt

SEQ ID NO: 4667537 - DNA, 14 bp, Homo sapiens
caacagtcacctca

SEQ ID NO: 4667538 - DNA, 21 bp, Homo sapiens
caacatcttacttgtcctttg

SEQ ID NO: 4667539 - DNA, 21 bp, Homo sapiens
caacatgacatccagagatga

SEQ ID NO: 4667540 - DNA, 13 bp, Homo sapiens
caagggccctggc

SEQ ID NO: 4667541 - DNA, 14 bp, Homo sapiens
caagggccctggca

SEQ ID NO: 4667542 - DNA, 23 bp, Homo sapiens
caaggtaagaggattgcttgagc

SEQ ID NO: 4667543 - DNA, 14 bp, Homo sapiens
caaggtaggctgca

SEQ ID NO: 4667544 - DNA, 11 bp, Homo sapiens
caaggtgctaa

SEQ ID NO: 4667545 - DNA, 12 bp, Homo sapiens
caaggtgctaac

SEQ ID NO: 4667546 - DNA, 13 bp, Homo sapiens
caaggtgctaaca

SEQ ID NO: 4667547 - DNA, 14 bp, Homo sapiens
caaggtgctaacat

SEQ ID NO: 4667548 - DNA, 18 bp, Homo sapiens
caagtaatggaggtccca

SEQ ID NO: 4667549 - DNA, 17 bp, Homo sapiens
caagtatataatttact

SEQ ID NO: 4667550 - DNA, 22 bp, Homo sapiens
caagtatataatttactttgta

SEQ ID NO: 4667551 - DNA, 18 bp, Homo sapiens
caagtatatttatttcta

SEQ ID NO: 4667552 - DNA, 20 bp, Homo sapiens
caagtatatttatttctagc

SEQ ID NO: 4667553 - DNA, 16 bp, Homo sapiens
caagtatttattccca

SEQ ID NO: 4667554 - DNA, 21 bp, Homo sapiens
caagtcaggaatcattaattt

SEQ ID NO: 4667555 - DNA, 13 bp, Homo sapiens
caagtccaggtcc

SEQ ID NO: 4667556 - DNA, 15 bp, Homo sapiens
caagtccaggtcctg

SEQ ID NO: 4667557 - DNA, 17 bp, Homo sapiens
caagtccaggtcctggt

SEQ ID NO: 4667558 - DNA, 24 bp, Homo sapiens
caagtccaggtcctggtggggcag

SEQ ID NO: 4667559 - DNA, 23 bp, Homo sapiens
caagtctttctcctctttgagac

SEQ ID NO: 4667560 - DNA, 16 bp, Homo sapiens
caagtggactcagggc

SEQ ID NO: 4667561 - DNA, 18 bp, Homo sapiens
caagtggactcagggcag

SEQ ID NO: 4667562 - DNA, 23 bp, Homo sapiens
caagtggactcagggcagcgcca

SEQ ID NO: 4667563 - DNA, 19 bp, Homo sapiens
caagtgtcacctccttccc

SEQ ID NO: 4667564 - DNA, 22 bp, Homo sapiens
caagtgtgtgccaccatgcctc

SEQ ID NO: 4667565 - DNA, 20 bp, Homo sapiens
caagtgttggtcagtagttt

SEQ ID NO: 4667566 - DNA, 22 bp, Homo sapiens
caagttagaaaattcagctcct

SEQ ID NO: 4667567 - DNA, 18 bp, Homo sapiens
caagttgtgcttttctgt

SEQ ID NO: 4667568 - DNA, 20 bp, Homo sapiens
caataaaatttttttaaagt

SEQ ID NO: 4667569 - DNA, 11 bp, Homo sapiens
caataaagttg

SEQ ID NO: 4667570 - DNA, 13 bp, Homo sapiens
caataaagttgtt

SEQ ID NO: 4667571 - DNA, 15 bp, Homo sapiens
caataaagttgttgc

SEQ ID NO: 4667572 - DNA, 19 bp, Homo sapiens
caataacaaaacgaaacta

SEQ ID NO: 4667573 - DNA, 13 bp, Homo sapiens
caataacactgtc

SEQ ID NO: 4667574 - DNA, 13 bp, Homo sapiens
caataacttttat

SEQ ID NO: 4667575 - DNA, 21 bp, Homo sapiens
caataagaattactttgtgtt

SEQ ID NO: 4667576 - DNA, 15 bp, Homo sapiens
caataatcagaaaag

SEQ ID NO: 4667577 - DNA, 20 bp, Homo sapiens
caatagttagatctaccctg

SEQ ID NO: 4667578 - DNA, 15 bp, Homo sapiens
caatattgtacagtt

SEQ ID NO: 4667579 - DNA, 15 bp, Homo sapiens
caatccgagcagtgg

SEQ ID NO: 4667580 - DNA, 19 bp, Homo sapiens
caatctatggcttatttct

SEQ ID NO: 4667581 - DNA, 20 bp, Homo sapiens
caatctgttttggctttatg

SEQ ID NO: 4667582 - DNA, 13 bp, Homo sapiens
caatgaaccccca

SEQ ID NO: 4667583 - DNA, 20 bp, Homo sapiens
caatgaacccccatgatgta

SEQ ID NO: 4667584 - DNA, 16 bp, Homo sapiens
caatgaagaagtttct

SEQ ID NO: 4667585 - DNA, 14 bp, Homo sapiens
caatgatttggcca

SEQ ID NO: 4667586 - DNA, 16 bp, Homo sapiens
caatgatttggccagg

SEQ ID NO: 4667587 - DNA, 17 bp, Homo sapiens
caatgatttggccaggc

SEQ ID NO: 4667588 - DNA, 20 bp, Homo sapiens
caatgatttggccaggccta

SEQ ID NO: 4667589 - DNA, 16 bp, Homo sapiens
caatgcacatggtgca

SEQ ID NO: 4667590 - DNA, 15 bp, Homo sapiens
caatgcttcattatt

SEQ ID NO: 4667591 - DNA, 12 bp, Homo sapiens
caatggccaggg

SEQ ID NO: 4667592 - DNA, 15 bp, Homo sapiens
caatggcctaaactt

SEQ ID NO: 4667593 - DNA, 16 bp, Homo sapiens
caatggtgcttggagg

SEQ ID NO: 4667594 - DNA, 21 bp, Homo sapiens
caatggtgcttggagggggaa

SEQ ID NO: 4667595 - DNA, 22 bp, Homo sapiens
caatggtgcttggagggggaag

SEQ ID NO: 4667596 - DNA, 23 bp, Homo sapiens
caatgtgctactgattgtttcat

SEQ ID NO: 4667597 - DNA, 22 bp, Homo sapiens
caatgtggaaaaaatattttaa

SEQ ID NO: 4667598 - DNA, 16 bp, Homo sapiens
caatgttagagacttt

SEQ ID NO: 4667599 - DNA, 17 bp, Homo sapiens
caatgttagagactttt

SEQ ID NO: 4667600 - DNA, 17 bp, Homo sapiens
caatgttatgccagctc

SEQ ID NO: 4667601 - DNA, 22 bp, Homo sapiens
caattatctgattaagcattct

SEQ ID NO: 4667602 - DNA, 14 bp, Homo sapiens
caattctgttttta

SEQ ID NO: 4667603 - DNA, 19 bp, Homo sapiens
caattggattggaatgcag

SEQ ID NO: 4667604 - DNA, 17 bp, Homo sapiens
caattggtggtaacagt

SEQ ID NO: 4667605 - DNA, 13 bp, Homo sapiens
caatttggtctta

SEQ ID NO: 4667606 - DNA, 22 bp, Homo sapiens
caatttggtcttagctttacat

SEQ ID NO: 4667607 - DNA, 23 bp, Homo sapiens
caatttgtaaaaacagcattgct

SEQ ID NO: 4667608 - DNA, 12 bp, Homo sapiens
caatttgtaatg

SEQ ID NO: 4667609 - DNA, 13 bp, Homo sapiens
caattttaatgat

SEQ ID NO: 4667610 - DNA, 15 bp, Homo sapiens
caattttatctgttt

SEQ ID NO: 4667611 - DNA, 16 bp, Homo sapiens
caatttttgtctcaga

SEQ ID NO: 4667612 - DNA, 14 bp, Homo sapiens
cacaaaacttgaaa

SEQ ID NO: 4667613 - DNA, 17 bp, Homo sapiens
cacaaaggtcacaggca

SEQ ID NO: 4667614 - DNA, 16 bp, Homo sapiens
cacaaatccttcaaaa

SEQ ID NO: 4667615 - DNA, 11 bp, Homo sapiens
cacaagctgca

SEQ ID NO: 4667616 - DNA, 14 bp, Homo sapiens
cacaagctgcactg

SEQ ID NO: 4667617 - DNA, 15 bp, Homo sapiens
cacaagctgcactgt

SEQ ID NO: 4667618 - DNA, 16 bp, Homo sapiens
cacaagctgcactgtg

SEQ ID NO: 4667619 - DNA, 18 bp, Homo sapiens
cacaagctgcactgtgaa

SEQ ID NO: 4667620 - DNA, 20 bp, Homo sapiens
cacaagctgtccctgcaggg

SEQ ID NO: 4667621 - DNA, 12 bp, Homo sapiens
cacaaggaaaga

SEQ ID NO: 4667622 - DNA, 11 bp, Homo sapiens
cacaaggcagc

SEQ ID NO: 4667623 - DNA, 16 bp, Homo sapiens
cacaaggcagcaaggc

SEQ ID NO: 4667624 - DNA, 19 bp, Homo sapiens
cacaaggcctggtctggga

SEQ ID NO: 4667625 - DNA, 16 bp, Homo sapiens
cacaaggctgttgcat

SEQ ID NO: 4667626 - DNA, 17 bp, Homo sapiens
cacaatcactaaacttt

SEQ ID NO: 4667627 - DNA, 16 bp, Homo sapiens
cacaattcctgtgctc

SEQ ID NO: 4667628 - DNA, 19 bp, Homo sapiens
cacacagcaagtcagggtt

SEQ ID NO: 4667629 - DNA, 17 bp, Homo sapiens
cacacaggcagccagcc

SEQ ID NO: 4667630 - DNA, 16 bp, Homo sapiens
cacacaggcatttcct

SEQ ID NO: 4667631 - DNA, 18 bp, Homo sapiens
cacacaggcatttcctgg

SEQ ID NO: 4667632 - DNA, 23 bp, Homo sapiens
cacacatatatataacaaataat

SEQ ID NO: 4667633 - DNA, 13 bp, Homo sapiens
cacacatcaggag

SEQ ID NO: 4667634 - DNA, 21 bp, Homo sapiens
cacacatctgtaatcctagct

SEQ ID NO: 4667635 - DNA, 13 bp, Homo sapiens
cacacattccatt

SEQ ID NO: 4667636 - DNA, 20 bp, Homo sapiens
cacacccaccccctgcctgg

SEQ ID NO: 4667637 - DNA, 14 bp, Homo sapiens
cacacctcctgcct

SEQ ID NO: 4667638 - DNA, 19 bp, Homo sapiens
cacactcatgcacacagat

SEQ ID NO: 4667639 - DNA, 16 bp, Homo sapiens
cacactccaagatatg

SEQ ID NO: 4667640 - DNA, 22 bp, Homo sapiens
cacactccaagatatggacaca

SEQ ID NO: 4667641 - DNA, 13 bp, Homo sapiens
cacactctcttct

SEQ ID NO: 4667642 - DNA, 15 bp, Homo sapiens
cacactctcttctcc

SEQ ID NO: 4667643 - DNA, 17 bp, Homo sapiens
cacactctcttctccat

SEQ ID NO: 4667644 - DNA, 22 bp, Homo sapiens
cacactctcttctccattccct

SEQ ID NO: 4667645 - DNA, 23 bp, Homo sapiens
cacactcttcagtgactcctgct

SEQ ID NO: 4667646 - DNA, 20 bp, Homo sapiens
cacactggactccgaggtgg

SEQ ID NO: 4667647 - DNA, 16 bp, Homo sapiens
cacacttcgctcttga

SEQ ID NO: 4667648 - DNA, 12 bp, Homo sapiens
cacagaagagga

SEQ ID NO: 4667649 - DNA, 16 bp, Homo sapiens
cacagacaagcagccc

SEQ ID NO: 4667650 - DNA, 17 bp, Homo sapiens
caccctccaccttccat

SEQ ID NO: 4667651 - DNA, 21 bp, Homo sapiens
caccctccctagctctgaaat

SEQ ID NO: 4667652 - DNA, 22 bp, Homo sapiens
caccctgaggagtctgaggtcc

SEQ ID NO: 4667653 - DNA, 22 bp, Homo sapiens
caccctgccccccctaagagac

SEQ ID NO: 4667654 - DNA, 21 bp, Homo sapiens
caccctggccgagtccaagct

SEQ ID NO: 4667655 - DNA, 22 bp, Homo sapiens
caccctggccgagtccaagctg

SEQ ID NO: 4667656 - DNA, 12 bp, Homo sapiens
cacccttgccca

SEQ ID NO: 4667657 - DNA, 23 bp, Homo sapiens
cacccttgcccaccccaccccca

SEQ ID NO: 4667658 - DNA, 15 bp, Homo sapiens
caccgactcacctgc

SEQ ID NO: 4667659 - DNA, 18 bp, Homo sapiens
caccgagcgggtgcaagc

SEQ ID NO: 4667660 - DNA, 22 bp, Homo sapiens
caccgagcgggtgcaagcactc

SEQ ID NO: 4667661 - DNA, 14 bp, Homo sapiens
caccgcctgaaggc

SEQ ID NO: 4667662 - DNA, 20 bp, Homo sapiens
caccgcctgaaggcacagct

SEQ ID NO: 4667663 - DNA, 12 bp, Homo sapiens
caccgggccact

SEQ ID NO: 4667664 - DNA, 14 bp, Homo sapiens
caccgggccactcc

SEQ ID NO: 4667665 - DNA, 16 bp, Homo sapiens
caccgtgcctggctga

SEQ ID NO: 4667666 - DNA, 23 bp, Homo sapiens
cacctacagtgtacagtcttgta

SEQ ID NO: 4667667 - DNA, 17 bp, Homo sapiens
cacctagaacctccctc

SEQ ID NO: 4667668 - DNA, 18 bp, Homo sapiens
cacctccaagcatttcat

SEQ ID NO: 4667669 - DNA, 22 bp, Homo sapiens
cacctccaagcatttcatgaaa

SEQ ID NO: 4667670 - DNA, 14 bp, Homo sapiens
cacctccagcctct

SEQ ID NO: 4667671 - DNA, 17 bp, Homo sapiens
cacctcctctgccagca

SEQ ID NO: 4667672 - DNA, 20 bp, Homo sapiens
cacctcctctgccagcagga

SEQ ID NO: 4667673 - DNA, 21 bp, Homo sapiens
cacctcctctgccagcaggaa

SEQ ID NO: 4667674 - DNA, 22 bp, Homo sapiens
cacctcctctgccagcaggaat

SEQ ID NO: 4667675 - DNA, 23 bp, Homo sapiens
cacctcctctgccagcaggaata

SEQ ID NO: 4667676 - DNA, 12 bp, Homo sapiens
cacctccttccc

SEQ ID NO: 4667677 - DNA, 13 bp, Homo sapiens
cacctccttcccc

SEQ ID NO: 4667678 - DNA, 15 bp, Homo sapiens
cacctccttccccag

SEQ ID NO: 4667679 - DNA, 13 bp, Homo sapiens
cacctcggaggga

SEQ ID NO: 4667680 - DNA, 16 bp, Homo sapiens
cacctctgggacccca

SEQ ID NO: 4667681 - DNA, 20 bp, Homo sapiens
cacctctgggaccccagctg

SEQ ID NO: 4667682 - DNA, 22 bp, Homo sapiens
cacctctgtgacccctccttgt

SEQ ID NO: 4667683 - DNA, 11 bp, Homo sapiens
cacctcttcca

SEQ ID NO: 4667684 - DNA, 19 bp, Homo sapiens
cacctcttccactccttct

SEQ ID NO: 4667685 - DNA, 21 bp, Homo sapiens
cacctgattcaactaaaaaaa

SEQ ID NO: 4667686 - DNA, 12 bp, Homo sapiens
cacctgcaagat

SEQ ID NO: 4667687 - DNA, 18 bp, Homo sapiens
cacctgccccgtagagaa

SEQ ID NO: 4667688 - DNA, 14 bp, Homo sapiens
cacctgcctcagga

SEQ ID NO: 4667689 - DNA, 20 bp, Homo sapiens
cacctgcctcaggactgcga

SEQ ID NO: 4667690 - DNA, 19 bp, Homo sapiens
cacctgcgcaagtgcctgg

SEQ ID NO: 4667691 - DNA, 21 bp, Homo sapiens
cacctgcgcaagtgcctggga

SEQ ID NO: 4667692 - DNA, 23 bp, Homo sapiens
cacctgctagtcgcccctcagag

SEQ ID NO: 4667693 - DNA, 20 bp, Homo sapiens
cacctggccttaaagaggga

SEQ ID NO: 4667694 - DNA, 17 bp, Homo sapiens
cacctgggccctggggc

SEQ ID NO: 4667695 - DNA, 21 bp, Homo sapiens
cacctgtccccaccctccact

SEQ ID NO: 4667696 - DNA, 10 bp, Homo sapiens
caccttcacc

SEQ ID NO: 4667697 - DNA, 16 bp, Homo sapiens
caccttcacctcggag

SEQ ID NO: 4667698 - DNA, 19 bp, Homo sapiens
caccttcactctccagggt

SEQ ID NO: 4667699 - DNA, 16 bp, Homo sapiens
caccttcatgattata

SEQ ID NO: 4667700 - DNA, 21 bp, Homo sapiens
caccttcccttcctcagcagg

SEQ ID NO: 4667701 - DNA, 18 bp, Homo sapiens
caccttccgttccccgct

SEQ ID NO: 4667702 - DNA, 22 bp, Homo sapiens
cacgaacctcggggtgggggtg

SEQ ID NO: 4667703 - DNA, 12 bp, Homo sapiens
cacgagccacaa

SEQ ID NO: 4667704 - DNA, 18 bp, Homo sapiens
cacgcagagaagccccgg

SEQ ID NO: 4667705 - DNA, 13 bp, Homo sapiens
cacgctgttctaa

SEQ ID NO: 4667706 - DNA, 23 bp, Homo sapiens
cacggaggcctcgagcagagaga

SEQ ID NO: 4667707 - DNA, 17 bp, Homo sapiens
cacggatgcgtgggcag

SEQ ID NO: 4667708 - DNA, 21 bp, Homo sapiens
cacggatgcgtgggcagagga

SEQ ID NO: 4667709 - DNA, 22 bp, Homo sapiens
cacggatgcgtgggcagaggaa

SEQ ID NO: 4667710 - DNA, 19 bp, Homo sapiens
cacggccacatcaaagagg

SEQ ID NO: 4667711 - DNA, 21 bp, Homo sapiens
cacggccctccttcttttcct

SEQ ID NO: 4667712 - DNA, 14 bp, Homo sapiens
cacggcctggctgg

SEQ ID NO: 4667713 - DNA, 15 bp, Homo sapiens
cacgtagggggcagg

SEQ ID NO: 4667714 - DNA, 12 bp, Homo sapiens
cacgtcccagca

SEQ ID NO: 4667715 - DNA, 14 bp, Homo sapiens
cacgtcccagcatc

SEQ ID NO: 4667716 - DNA, 20 bp, Homo sapiens
cacgtcccagcatccctgga

SEQ ID NO: 4667717 - DNA, 19 bp, Homo sapiens
cacgtctggctccctgccc

SEQ ID NO: 4667718 - DNA, 23 bp, Homo sapiens
cacgtgtatagtatctgtatata

SEQ ID NO: 4667719 - DNA, 13 bp, Homo sapiens
cacgttgtccctg

SEQ ID NO: 4667720 - DNA, 14 bp, Homo sapiens
cacgttgtccctga

SEQ ID NO: 4667721 - DNA, 22 bp, Homo sapiens
cactaaaaatattgtttctgca

SEQ ID NO: 4667722 - DNA, 14 bp, Homo sapiens
cactaaactttatt

SEQ ID NO: 4667723 - DNA, 20 bp, Homo sapiens
cactaatttttgtattattt

SEQ ID NO: 4667724 - DNA, 18 bp, Homo sapiens
cactacattttttctaat

SEQ ID NO: 4667725 - DNA, 19 bp, Homo sapiens
cactacattttttctaata

SEQ ID NO: 4667726 - DNA, 14 bp, Homo sapiens
cactactgggtgtc

SEQ ID NO: 4667727 - DNA, 16 bp, Homo sapiens
cactactgggtgtcat

SEQ ID NO: 4667728 - DNA, 22 bp, Homo sapiens
cactactgggtgtcatttcatt

SEQ ID NO: 4667729 - DNA, 16 bp, Homo sapiens
cactaggaaacgtgtt

SEQ ID NO: 4667730 - DNA, 11 bp, Homo sapiens
cactatctggg

SEQ ID NO: 4667731 - DNA, 14 bp, Homo sapiens
cactattttcaaag

SEQ ID NO: 4667732 - DNA, 15 bp, Homo sapiens
cactcaaaggccaga

SEQ ID NO: 4667733 - DNA, 14 bp, Homo sapiens
cactcagaagcctg

SEQ ID NO: 4667734 - DNA, 16 bp, Homo sapiens
cactcagaagcctggg

SEQ ID NO: 4667735 - DNA, 17 bp, Homo sapiens
cactcagaagcctgggg

SEQ ID NO: 4667736 - DNA, 12 bp, Homo sapiens
cactcagcacaa

SEQ ID NO: 4667737 - DNA, 15 bp, Homo sapiens
cactcagcacaaggc

SEQ ID NO: 4667738 - DNA, 22 bp, Homo sapiens
cactcagcacaaggccatctgg

SEQ ID NO: 4667739 - DNA, 18 bp, Homo sapiens
cactcagctgtcctgcag

SEQ ID NO: 4667740 - DNA, 15 bp, Homo sapiens
cactccccagagctg

SEQ ID NO: 4667741 - DNA, 19 bp, Homo sapiens
cactccccagagctgtgcc

SEQ ID NO: 4667742 - DNA, 20 bp, Homo sapiens
cactccccagagctgtgcca

SEQ ID NO: 4667743 - DNA, 13 bp, Homo sapiens
cactcccccctcc

SEQ ID NO: 4667744 - DNA, 16 bp, Homo sapiens
cactcccccctccatt

SEQ ID NO: 4667745 - DNA, 23 bp, Homo sapiens
cactcccttgaagttgtggagga

SEQ ID NO: 4667746 - DNA, 20 bp, Homo sapiens
cactccgcgccgatgccacc

SEQ ID NO: 4667747 - DNA, 21 bp, Homo sapiens
cactccgcgccgatgccaccg

SEQ ID NO: 4667748 - DNA, 22 bp, Homo sapiens
cactccgcgccgatgccaccgg

SEQ ID NO: 4667749 - DNA, 13 bp, Homo sapiens
cactcctgctgta

SEQ ID NO: 4667750 - DNA, 13 bp, Homo sapiens
cactccttgtccc

SEQ ID NO: 4667751 - DNA, 16 bp, Homo sapiens
cactcggggtccctgg

SEQ ID NO: 4667752 - DNA, 21 bp, Homo sapiens
cactcggggtccctggagggc

SEQ ID NO: 4667753 - DNA, 12 bp, Homo sapiens
cactctgctctg

SEQ ID NO: 4667754 - DNA, 14 bp, Homo sapiens
cactctgctctgat

SEQ ID NO: 4667755 - DNA, 16 bp, Homo sapiens
cactctggcagccaca

SEQ ID NO: 4667756 - DNA, 17 bp, Homo sapiens
cactcttcagtgactcc

SEQ ID NO: 4667757 - DNA, 20 bp, Homo sapiens
cactcttcagtgactcctgc

SEQ ID NO: 4667758 - DNA, 14 bp, Homo sapiens
cactcttctcagcc

SEQ ID NO: 4667759 - DNA, 19 bp, Homo sapiens
cactcttgttgaagtgctg

SEQ ID NO: 4667760 - DNA, 19 bp, Homo sapiens
ctcagaggcgcactgtgac

SEQ ID NO: 4667761 - DNA, 14 bp, Homo sapiens
ctcagcacaaggcc

SEQ ID NO: 4667762 - DNA, 22 bp, Homo sapiens
ctcagcagacatccacacacag

SEQ ID NO: 4667763 - DNA, 13 bp, Homo sapiens
ctcagcagggctg

SEQ ID NO: 4667764 - DNA, 14 bp, Homo sapiens
ctcagcagggctgg

SEQ ID NO: 4667765 - DNA, 22 bp, Homo sapiens
ctcagcctaccgctggccctgc

SEQ ID NO: 4667766 - DNA, 12 bp, Homo sapiens
ctcagcctcccg

SEQ ID NO: 4667767 - DNA, 18 bp, Homo sapiens
ctcagctgtcctgcagca

SEQ ID NO: 4667768 - DNA, 17 bp, Homo sapiens
ctcaggaattcagtgcc

SEQ ID NO: 4667769 - DNA, 18 bp, Homo sapiens
ctcaggaattcagtgcct

SEQ ID NO: 4667770 - DNA, 19 bp, Homo sapiens
ctcaggaattcagtgcctt

SEQ ID NO: 4667771 - DNA, 13 bp, Homo sapiens
ctcaggacacagg

SEQ ID NO: 4667772 - DNA, 15 bp, Homo sapiens
ctcaggacacaggcc

SEQ ID NO: 4667773 - DNA, 16 bp, Homo sapiens
ctcaggacacaggcct

SEQ ID NO: 4667774 - DNA, 14 bp, Homo sapiens
ctcaggactgcgac

SEQ ID NO: 4667775 - DNA, 19 bp, Homo sapiens
ctcaggagatggagggctt

SEQ ID NO: 4667776 - DNA, 20 bp, Homo sapiens
ctcaggagatggagggcttg

SEQ ID NO: 4667777 - DNA, 11 bp, Homo sapiens
ctcaggctctg

SEQ ID NO: 4667778 - DNA, 23 bp, Homo sapiens
ctcaggctctgcacagacaagca

SEQ ID NO: 4667779 - DNA, 13 bp, Homo sapiens
ctcagggcctcag

SEQ ID NO: 4667780 - DNA, 14 bp, Homo sapiens
ctcagggcctcagg

SEQ ID NO: 4667781 - DNA, 15 bp, Homo sapiens
ctcagggcctcaggc

SEQ ID NO: 4667782 - DNA, 17 bp, Homo sapiens
ctcaggtaatcatttta

SEQ ID NO: 4667783 - DNA, 18 bp, Homo sapiens
ctcaggtaatcattttaa

SEQ ID NO: 4667784 - DNA, 11 bp, Homo sapiens
ctccctggggg

SEQ ID NO: 4667785 - DNA, 12 bp, Homo sapiens
ctccctgtccca

SEQ ID NO: 4667786 - DNA, 15 bp, Homo sapiens
ctccctgtcccaggg

SEQ ID NO: 4667787 - DNA, 18 bp, Homo sapiens
ctccctgtcccagggccc

SEQ ID NO: 4667788 - DNA, 22 bp, Homo sapiens
ctcccttacccatcttgcttcc

SEQ ID NO: 4667789 - DNA, 20 bp, Homo sapiens
ctcccttcaagacgaggggc

SEQ ID NO: 4667790 - DNA, 15 bp, Homo sapiens
ctcccttccacctca

SEQ ID NO: 4667791 - DNA, 21 bp, Homo sapiens
ctcccttctctacactcttgt

SEQ ID NO: 4667792 - DNA, 14 bp, Homo sapiens
ctcccttctgcttg

SEQ ID NO: 4667793 - DNA, 21 bp, Homo sapiens
ctcccttgctttttgctgtgt

SEQ ID NO: 4667794 - DNA, 20 bp, Homo sapiens
ctccgccagccacaggacca

SEQ ID NO: 4667795 - DNA, 20 bp, Homo sapiens
ctccgcgccgatgccaccgg

SEQ ID NO: 4667796 - DNA, 19 bp, Homo sapiens
ctcctaggggcttggtcct

SEQ ID NO: 4667797 - DNA, 20 bp, Homo sapiens
ctcctcaatttttgtctcag

SEQ ID NO: 4667798 - DNA, 15 bp, Homo sapiens
ctcctcactccctag

SEQ ID NO: 4667799 - DNA, 20 bp, Homo sapiens
ctcctcactccctaggccca

SEQ ID NO: 4667800 - DNA, 15 bp, Homo sapiens
ctcctccagcccctg

SEQ ID NO: 4667801 - DNA, 16 bp, Homo sapiens
ctcctccagcccctgt

SEQ ID NO: 4667802 - DNA, 14 bp, Homo sapiens
ctcctccctcctca

SEQ ID NO: 4667803 - DNA, 13 bp, Homo sapiens
ctcctcctccctc

SEQ ID NO: 4667804 - DNA, 17 bp, Homo sapiens
ctcctctctccctgcct

SEQ ID NO: 4667805 - DNA, 19 bp, Homo sapiens
ctcctctctccctgcctca

SEQ ID NO: 4667806 - DNA, 22 bp, Homo sapiens
ctcctctctccctgcctcacat

SEQ ID NO: 4667807 - DNA, 17 bp, Homo sapiens
ctcctctgccagcagga

SEQ ID NO: 4667808 - DNA, 22 bp, Homo sapiens
ctcctctgccagcaggaataaa

SEQ ID NO: 4667809 - DNA, 13 bp, Homo sapiens
ctcctctttgaga

SEQ ID NO: 4667810 - DNA, 15 bp, Homo sapiens
ctcctgacctcaggt

SEQ ID NO: 4667811 - DNA, 15 bp, Homo sapiens
ctcctgaggacagct

SEQ ID NO: 4667812 - DNA, 17 bp, Homo sapiens
ctcctgagtagctggga

SEQ ID NO: 4667813 - DNA, 21 bp, Homo sapiens
ctcctgatcagaggcatttga

SEQ ID NO: 4667814 - DNA, 13 bp, Homo sapiens
ctcctgccagccc

SEQ ID NO: 4667815 - DNA, 15 bp, Homo sapiens
ctcctgccagcccag

SEQ ID NO: 4667816 - DNA, 17 bp, Homo sapiens
ctcctgccagcccagct

SEQ ID NO: 4667817 - DNA, 11 bp, Homo sapiens
ctcctgccagg

SEQ ID NO: 4667818 - DNA, 20 bp, Homo sapiens
ctcctgcccgcagacctctg

SEQ ID NO: 4667819 - DNA, 22 bp, Homo sapiens
ctcctgcccgcagacctctgga

SEQ ID NO: 4667820 - DNA, 15 bp, Homo sapiens
ctcctgcctcagcct

SEQ ID NO: 4667821 - DNA, 15 bp, Homo sapiens
ctcctgcctctactg

SEQ ID NO: 4667822 - DNA, 23 bp, Homo sapiens
ctcctgcctttaggccatgggtg

SEQ ID NO: 4667823 - DNA, 14 bp, Homo sapiens
ctcctgctggtacc

SEQ ID NO: 4667824 - DNA, 22 bp, Homo sapiens
ctcctgctggtacctgccctct

SEQ ID NO: 4667825 - DNA, 18 bp, Homo sapiens
ctcctggacattttttca

SEQ ID NO: 4667826 - DNA, 21 bp, Homo sapiens
ctcctggactggttatcttgt

SEQ ID NO: 4667827 - DNA, 22 bp, Homo sapiens
ctcctggactggttatcttgtt

SEQ ID NO: 4667828 - DNA, 17 bp, Homo sapiens
ctcctggccttctagga

SEQ ID NO: 4667829 - DNA, 21 bp, Homo sapiens
ctcctggcttcccatccccag

SEQ ID NO: 4667830 - DNA, 23 bp, Homo sapiens
ctcctggcttcccatccccagcg

SEQ ID NO: 4667831 - DNA, 16 bp, Homo sapiens
ctcctgggaaagggag

SEQ ID NO: 4667832 - DNA, 17 bp, Homo sapiens
ctcctgggaaagggaga

SEQ ID NO: 4667833 - DNA, 22 bp, Homo sapiens
ctcctgtccaaagtagggatgc

SEQ ID NO: 4667834 - DNA, 19 bp, Homo sapiens
ctccttcagttctgcttgc

SEQ ID NO: 4667835 - DNA, 20 bp, Homo sapiens
ctccttcagttctgcttgct

SEQ ID NO: 4667836 - DNA, 16 bp, Homo sapiens
ctccttccatccttga

SEQ ID NO: 4667837 - DNA, 18 bp, Homo sapiens
ctccttccccagctcccc

SEQ ID NO: 4667838 - DNA, 11 bp, Homo sapiens
ctccttcctgc

SEQ ID NO: 4667839 - DNA, 15 bp, Homo sapiens
ctccttcctgcccca

SEQ ID NO: 4667840 - DNA, 14 bp, Homo sapiens
ctccttctgcaaag

SEQ ID NO: 4667841 - DNA, 12 bp, Homo sapiens
ctccttcttttc

SEQ ID NO: 4667842 - DNA, 19 bp, Homo sapiens
ctccttgtcagggtctcct

SEQ ID NO: 4667843 - DNA, 16 bp, Homo sapiens
ctcctttcctttgccc

SEQ ID NO: 4667844 - DNA, 18 bp, Homo sapiens
ctcctttctgtcctggag

SEQ ID NO: 4667845 - DNA, 20 bp, Homo sapiens
ctccttttcttcaccctccc

SEQ ID NO: 4667846 - DNA, 19 bp, Homo sapiens
ctcgacagggcctggagcc

SEQ ID NO: 4667847 - DNA, 23 bp, Homo sapiens
ctcgagcgccctgcagaccctgc

SEQ ID NO: 4667848 - DNA, 17 bp, Homo sapiens
ctcgccccaaagttgct

SEQ ID NO: 4667849 - DNA, 17 bp, Homo sapiens
ctcgctccccactctgc

SEQ ID NO: 4667850 - DNA, 18 bp, Homo sapiens
ctcgctttttcatccttc

SEQ ID NO: 4667851 - DNA, 17 bp, Homo sapiens
ctcggaggaagccccca

SEQ ID NO: 4667852 - DNA, 17 bp, Homo sapiens
ctcggatgacaccctgg

SEQ ID NO: 4667853 - DNA, 20 bp, Homo sapiens
ctcggatgacaccctggcct

SEQ ID NO: 4667854 - DNA, 22 bp, Homo sapiens
ctcggctcactgcaacctctgc

SEQ ID NO: 4667855 - DNA, 16 bp, Homo sapiens
ctcggctcagtgcaac

SEQ ID NO: 4667856 - DNA, 23 bp, Homo sapiens
ctcggctcagtgcaacctctgct

SEQ ID NO: 4667857 - DNA, 17 bp, Homo sapiens
ctcggggtgcacaggag

SEQ ID NO: 4667858 - DNA, 15 bp, Homo sapiens
ctcgtggtaggactg

SEQ ID NO: 4667859 - DNA, 16 bp, Homo sapiens
ctctaacgcctgagcc

SEQ ID NO: 4667860 - DNA, 16 bp, Homo sapiens
ctctaagcccaggatc

SEQ ID NO: 4667861 - DNA, 23 bp, Homo sapiens
ctctaagtatattatatggcagg

SEQ ID NO: 4667862 - DNA, 13 bp, Homo sapiens
ctctacagtgcca

SEQ ID NO: 4667863 - DNA, 20 bp, Homo sapiens
ctctacagtgccaactcctc

SEQ ID NO: 4667864 - DNA, 12 bp, Homo sapiens
ctctacatattt

SEQ ID NO: 4667865 - DNA, 23 bp, Homo sapiens
ctctactccctcttgtcagtgta

SEQ ID NO: 4667866 - DNA, 13 bp, Homo sapiens
ctctacttcagga

SEQ ID NO: 4667867 - DNA, 20 bp, Homo sapiens
ctctagatggcaacattgga

SEQ ID NO: 4667868 - DNA, 21 bp, Homo sapiens
ctctagggactgccaggctgt

SEQ ID NO: 4667869 - DNA, 19 bp, Homo sapiens
ctctaggtgtgtccacaga

SEQ ID NO: 4667870 - DNA, 23 bp, Homo sapiens
ctctagtgggacagcccagagcc

SEQ ID NO: 4667871 - DNA, 12 bp, Homo sapiens
ctctatgtacta

SEQ ID NO: 4667872 - DNA, 19 bp, Homo sapiens
ctctatgttagtataagct

SEQ ID NO: 4667873 - DNA, 21 bp, Homo sapiens
ctctatgttagtataagcttt

SEQ ID NO: 4667874 - DNA, 15 bp, Homo sapiens
ctctatttttgttgg

SEQ ID NO: 4667875 - DNA, 21 bp, Homo sapiens
ctctcactgtgttactgcttt

SEQ ID NO: 4667876 - DNA, 21 bp, Homo sapiens
ctctcatttccagcttctcag

SEQ ID NO: 4667877 - DNA, 14 bp, Homo sapiens
ctctccagcctgac

SEQ ID NO: 4667878 - DNA, 19 bp, Homo sapiens
ctctccagggagctgatgt

SEQ ID NO: 4667879 - DNA, 17 bp, Homo sapiens
ctctccagtttgcacct

SEQ ID NO: 4667880 - DNA, 22 bp, Homo sapiens
ctctccagtttgcacctgtccc

SEQ ID NO: 4667881 - DNA, 23 bp, Homo sapiens
ctctccagtttgcacctgtcccc

SEQ ID NO: 4667882 - DNA, 12 bp, Homo sapiens
ctctcccaggcc

SEQ ID NO: 4667883 - DNA, 24 bp, Homo sapiens
ctctcccaggccccatgacctcca

SEQ ID NO: 4667884 - DNA, 21 bp, Homo sapiens
ctctcccatcctggggcagca

SEQ ID NO: 4667885 - DNA, 12 bp, Homo sapiens
ctctcccctccc

SEQ ID NO: 4667886 - DNA, 14 bp, Homo sapiens
ctctcccctcccca

SEQ ID NO: 4667887 - DNA, 15 bp, Homo sapiens
ctctcccctccccat

SEQ ID NO: 4667888 - DNA, 16 bp, Homo sapiens
ctctccctgcctcaca

SEQ ID NO: 4667889 - DNA, 15 bp, Homo sapiens
ctctcccttacccat

SEQ ID NO: 4667890 - DNA, 22 bp, Homo sapiens
ctctcccttacccatcttgctt

SEQ ID NO: 4667891 - DNA, 21 bp, Homo sapiens
ctctccgtttattataaactg

SEQ ID NO: 4667892 - DNA, 13 bp, Homo sapiens
ctctcctggcctt

SEQ ID NO: 4667893 - DNA, 16 bp, Homo sapiens
ctctcctggcttccca

SEQ ID NO: 4667894 - DNA, 18 bp, Homo sapiens
ctctctagctttgtcata

SEQ ID NO: 4667895 - DNA, 19 bp, Homo sapiens
ctctctaggcctctccagt

SEQ ID NO: 4667896 - DNA, 14 bp, Homo sapiens
ctctctcctggact

SEQ ID NO: 4667897 - DNA, 14 bp, Homo sapiens
ctctctctaagtat

SEQ ID NO: 4667898 - DNA, 20 bp, Homo sapiens
ctctctgagtcctggcccaa

SEQ ID NO: 4667899 - DNA, 17 bp, Homo sapiens
ctctctgcttccgttcc

SEQ ID NO: 4667900 - DNA, 16 bp, Homo sapiens
ctctctggaaaggagg

SEQ ID NO: 4667901 - DNA, 22 bp, Homo sapiens
ctctcttcggtcgtatccacct

SEQ ID NO: 4667902 - DNA, 14 bp, Homo sapiens
ctctcttctctcta

SEQ ID NO: 4667903 - DNA, 19 bp, Homo sapiens
ctctcttgcctgaggggaa

SEQ ID NO: 4667904 - DNA, 16 bp, Homo sapiens
ctctgaaatcaactct

SEQ ID NO: 4667905 - DNA, 19 bp, Homo sapiens
ctctgaaatcaactctctt

SEQ ID NO: 4667906 - DNA, 23 bp, Homo sapiens
ctctgaacttccaagctccaaat

SEQ ID NO: 4667907 - DNA, 18 bp, Homo sapiens
ctctgacaagctggccaa

SEQ ID NO: 4667908 - DNA, 23 bp, Homo sapiens
ctctgacaagctggccaaagtca

SEQ ID NO: 4667909 - DNA, 16 bp, Homo sapiens
ctctgagaggccctgg

SEQ ID NO: 4667910 - DNA, 17 bp, Homo sapiens
ctctgagaggccctgga

SEQ ID NO: 4667911 - DNA, 18 bp, Homo sapiens
ctctgagaggccctggat

SEQ ID NO: 4667912 - DNA, 13 bp, Homo sapiens
ctctgaggccagc

SEQ ID NO: 4667913 - DNA, 19 bp, Homo sapiens
ctctgaggccagcctggcc

SEQ ID NO: 4667914 - DNA, 20 bp, Homo sapiens
ctctgaggccagcctggcct

SEQ ID NO: 4667915 - DNA, 12 bp, Homo sapiens
ctctgaggcgcc

SEQ ID NO: 4667916 - DNA, 16 bp, Homo sapiens
ctctgagtcctggccc

SEQ ID NO: 4667917 - DNA, 16 bp, Homo sapiens
ctctgcacagacaagc

SEQ ID NO: 4667918 - DNA, 14 bp, Homo sapiens
ctctgcacatgtct

SEQ ID NO: 4667919 - DNA, 13 bp, Homo sapiens
ctctgcacccctc

SEQ ID NO: 4667920 - DNA, 17 bp, Homo sapiens
ctctgcagcattgaagt

SEQ ID NO: 4667921 - DNA, 23 bp, Homo sapiens
ctctgcatatatgtctctttgga

SEQ ID NO: 4667922 - DNA, 15 bp, Homo sapiens
ctctgcattgacctg

SEQ ID NO: 4667923 - DNA, 12 bp, Homo sapiens
ctctgccagcag

SEQ ID NO: 4667924 - DNA, 15 bp, Homo sapiens
ctctgccagcaggaa

SEQ ID NO: 4667925 - DNA, 16 bp, Homo sapiens
ctctgccagcaggaat

SEQ ID NO: 4667926 - DNA, 14 bp, Homo sapiens
ctctgcccaccctc

SEQ ID NO: 4667927 - DNA, 16 bp, Homo sapiens
ctctgcccaggcaagg

SEQ ID NO: 4667928 - DNA, 22 bp, Homo sapiens
ctctgcccaggcaaggaacaga

SEQ ID NO: 4667929 - DNA, 22 bp, Homo sapiens
ctctgccccaagagcaggaggt

SEQ ID NO: 4667930 - DNA, 16 bp, Homo sapiens
ctctgccccaggccct

SEQ ID NO: 4667931 - DNA, 22 bp, Homo sapiens
ctctgccctcattactgggcct

SEQ ID NO: 4667932 - DNA, 14 bp, Homo sapiens
ctctgcctgggatg

SEQ ID NO: 4667933 - DNA, 14 bp, Homo sapiens
ctctgctctgatgc

SEQ ID NO: 4667934 - DNA, 13 bp, Homo sapiens
ctctgcttcccag

SEQ ID NO: 4667935 - DNA, 15 bp, Homo sapiens
ctctgcttccgttcc

SEQ ID NO: 4667936 - DNA, 15 bp, Homo sapiens
ctctggaataaagtt

SEQ ID NO: 4667937 - DNA, 19 bp, Homo sapiens
ctctggaataaagttgcag

SEQ ID NO: 4667938 - DNA, 10 bp, Homo sapiens
ctctggactc

SEQ ID NO: 4667939 - DNA, 11 bp, Homo sapiens
ctctggactcc

SEQ ID NO: 4667940 - DNA, 23 bp, Homo sapiens
ctctggactccacggatgcgtgg

SEQ ID NO: 4667941 - DNA, 11 bp, Homo sapiens
ctctggcagcc

SEQ ID NO: 4667942 - DNA, 14 bp, Homo sapiens
ctctggcagccaca

SEQ ID NO: 4667943 - DNA, 15 bp, Homo sapiens
ctctggcagccacac

SEQ ID NO: 4667944 - DNA, 16 bp, Homo sapiens
ctctggcagccacact

SEQ ID NO: 4667945 - DNA, 20 bp, Homo sapiens
ctctggccctggcccttact

SEQ ID NO: 4667946 - DNA, 13 bp, Homo sapiens
ctctggctactcc

SEQ ID NO: 4667947 - DNA, 17 bp, Homo sapiens
ctctggctactccctgg

SEQ ID NO: 4667948 - DNA, 21 bp, Homo sapiens
ctctggctactccctggacca

SEQ ID NO: 4667949 - DNA, 15 bp, Homo sapiens
ctctgggaccccagc

SEQ ID NO: 4667950 - DNA, 20 bp, Homo sapiens
ctctgggccattctccacag

SEQ ID NO: 4667951 - DNA, 11 bp, Homo sapiens
ctctgggctgt

SEQ ID NO: 4667952 - DNA, 23 bp, Homo sapiens
ctctgggctgtaacgtggcactg

SEQ ID NO: 4667953 - DNA, 14 bp, Homo sapiens
ctctgggtgctgcc

SEQ ID NO: 4667954 - DNA, 22 bp, Homo sapiens
ctctgtacttttcattctcttt

SEQ ID NO: 4667955 - DNA, 23 bp, Homo sapiens
ctctgtcaaatctagtttcctat

SEQ ID NO: 4667956 - DNA, 17 bp, Homo sapiens
ctctgtcagtcacagcc

SEQ ID NO: 4667957 - DNA, 19 bp, Homo sapiens
ctctgtcggctttttgcca

SEQ ID NO: 4667958 - DNA, 20 bp, Homo sapiens
ctctgtctacctggtctggt

SEQ ID NO: 4667959 - DNA, 22 bp, Homo sapiens
ctctgtctcgagcgccctgcag

SEQ ID NO: 4667960 - DNA, 21 bp, Homo sapiens
ctctgtgccagagcctggggc

SEQ ID NO: 4667961 - DNA, 14 bp, Homo sapiens
ctctgtgtctgagt

SEQ ID NO: 4667962 - DNA, 13 bp, Homo sapiens
ctctgttcatttc

SEQ ID NO: 4667963 - DNA, 15 bp, Homo sapiens
ctctgttcatttcac

SEQ ID NO: 4667964 - DNA, 15 bp, Homo sapiens
ctctgttcctggctc

SEQ ID NO: 4667965 - DNA, 12 bp, Homo sapiens
ctctgttgcctc

SEQ ID NO: 4667966 - DNA, 16 bp, Homo sapiens
ctctgttgcctcctct

SEQ ID NO: 4667967 - DNA, 17 bp, Homo sapiens
ctctgttgcctcctctc

SEQ ID NO: 4667968 - DNA, 19 bp, Homo sapiens
ctctgttgcctcctctctc

SEQ ID NO: 4667969 - DNA, 20 bp, Homo sapiens
ctctgttgcctcctctctcc

SEQ ID NO: 4667970 - DNA, 22 bp, Homo sapiens
ctctgttgcctcctctctccct

SEQ ID NO: 4667971 - DNA, 23 bp, Homo sapiens
ctctgttgcctcctctctccctg

SEQ ID NO: 4667972 - DNA, 20 bp, Homo sapiens
ctctgttttgtgccagtgct

SEQ ID NO: 4667973 - DNA, 17 bp, Homo sapiens
ctcttactaatgtaaaa

SEQ ID NO: 4667974 - DNA, 14 bp, Homo sapiens
ctcttatgggggtg

SEQ ID NO: 4667975 - DNA, 18 bp, Homo sapiens
ctcttattccaggagaag

SEQ ID NO: 4667976 - DNA, 16 bp, Homo sapiens
ctcttccactccttct

SEQ ID NO: 4667977 - DNA, 14 bp, Homo sapiens
ctcttcccttgctc

SEQ ID NO: 4667978 - DNA, 19 bp, Homo sapiens
ctcttcccttgctcatgag

SEQ ID NO: 4667979 - DNA, 21 bp, Homo sapiens
ctcttcccttgctcatgagct

SEQ ID NO: 4667980 - DNA, 17 bp, Homo sapiens
ctcttcctaatcgctaa

SEQ ID NO: 4667981 - DNA, 19 bp, Homo sapiens
ctcttcgatgtgcccaggg

SEQ ID NO: 4667982 - DNA, 23 bp, Homo sapiens
ctcttcgatgtgcccaggggagc

SEQ ID NO: 4667983 - DNA, 16 bp, Homo sapiens
ctcttctaaaatagca

SEQ ID NO: 4667984 - DNA, 13 bp, Homo sapiens
ctcttctgactgc

SEQ ID NO: 4667985 - DNA, 16 bp, Homo sapiens
ctcttctgcatcttgg

SEQ ID NO: 4667986 - DNA, 20 bp, Homo sapiens
ctcttctggtttccctttat

SEQ ID NO: 4667987 - DNA, 17 bp, Homo sapiens
ctcttgatttcacattt

SEQ ID NO: 4667988 - DNA, 16 bp, Homo sapiens
ctcttggggaagggga

SEQ ID NO: 4667989 - DNA, 22 bp, Homo sapiens
ctcttgtaaagactggttttct

SEQ ID NO: 4667990 - DNA, 18 bp, Homo sapiens
ctcttgtcacccaggctg

SEQ ID NO: 4667991 - DNA, 20 bp, Homo sapiens
ctcttgtcacccaggctgga

SEQ ID NO: 4667992 - DNA, 22 bp, Homo sapiens
ctcttgtcagtgtagacacagg

SEQ ID NO: 4667993 - DNA, 14 bp, Homo sapiens
ctcttgtgatttct

SEQ ID NO: 4667994 - DNA, 18 bp, Homo sapiens
ctcttgttgaagtgctgt

SEQ ID NO: 4667995 - DNA, 17 bp, Homo sapiens
ctctttaacatacaaga

SEQ ID NO: 4667996 - DNA, 17 bp, Homo sapiens
ctctttagtgttctgtt

SEQ ID NO: 4667997 - DNA, 11 bp, Homo sapiens
ctctttcaaag

SEQ ID NO: 4667998 - DNA, 19 bp, Homo sapiens
ctctttccccaaggaccca

SEQ ID NO: 4667999 - DNA, 13 bp, Homo sapiens
ctctttccctgcg

SEQ ID NO: 4668000 - DNA, 15 bp, Homo sapiens
ctctttccctgcgag

SEQ ID NO: 4668001 - DNA, 20 bp, Homo sapiens
ctctttccctgcgagacgca

SEQ ID NO: 4668002 - DNA, 14 bp, Homo sapiens
ctctttctgtttcc

SEQ ID NO: 4668003 - DNA, 18 bp, Homo sapiens
ctctttctgtttcctggc

SEQ ID NO: 4668004 - DNA, 19 bp, Homo sapiens
ctctttctgtttcctggcc

SEQ ID NO: 4668005 - DNA, 20 bp, Homo sapiens
ctctttgagaccccagtgcc

SEQ ID NO: 4668006 - DNA, 22 bp, Homo sapiens
ctctttgagaccccagtgcctg

SEQ ID NO: 4668007 - DNA, 17 bp, Homo sapiens
ctctttgtctaaaacaa

SEQ ID NO: 4668008 - DNA, 21 bp, Homo sapiens
ctctttgtctaaaacaataaa

SEQ ID NO: 4668009 - DNA, 22 bp, Homo sapiens
ctctttgtctaaaacaataaaa

SEQ ID NO: 4668010 - DNA, 23 bp, Homo sapiens
ctcttttccactccattgtcgta

SEQ ID NO: 4668011 - DNA, 14 bp, Homo sapiens
ctcttttgctgtgc

SEQ ID NO: 4668012 - DNA, 17 bp, Homo sapiens
ctcttttttgtttgttt

SEQ ID NO: 4668013 - DNA, 20 bp, Homo sapiens
ctcttttttgtttgtttctt

SEQ ID NO: 4668014 - DNA, 19 bp, Homo sapiens
ctgaaaacatctagcccaa

SEQ ID NO: 4668015 - DNA, 19 bp, Homo sapiens
ctgaaactcatagacactg

SEQ ID NO: 4668016 - DNA, 23 bp, Homo sapiens
ctgaaagaattatttgccttctg

SEQ ID NO: 4668017 - DNA, 15 bp, Homo sapiens
ctgaaagctgggagc

SEQ ID NO: 4668018 - DNA, 22 bp, Homo sapiens
ctgaaagggcacttaatttgta

SEQ ID NO: 4668019 - DNA, 23 bp, Homo sapiens
ctgaaagggcacttaatttgtaa

SEQ ID NO: 4668020 - DNA, 15 bp, Homo sapiens
ctgaacattccagag

SEQ ID NO: 4668021 - DNA, 16 bp, Homo sapiens
ctgaaccacaaaaaaa

SEQ ID NO: 4668022 - DNA, 12 bp, Homo sapiens
ctgaactgagga

SEQ ID NO: 4668023 - DNA, 17 bp, Homo sapiens
ctgaacttccaagctcc

SEQ ID NO: 4668024 - DNA, 15 bp, Homo sapiens
ctgaagactgagaac

SEQ ID NO: 4668025 - DNA, 15 bp, Homo sapiens
ctgaagatcagaaca

SEQ ID NO: 4668026 - DNA, 20 bp, Homo sapiens
ctgaagatggcatcctgtga

SEQ ID NO: 4668027 - DNA, 23 bp, Homo sapiens
ctgaagatggcatcctgtgaagt

SEQ ID NO: 4668028 - DNA, 19 bp, Homo sapiens
ctgaagcaggttcccaagc

SEQ ID NO: 4668029 - DNA, 22 bp, Homo sapiens
ctgaagccatgtagccacccaa

SEQ ID NO: 4668030 - DNA, 15 bp, Homo sapiens
ctgaagcccaaagcc

SEQ ID NO: 4668031 - DNA, 17 bp, Homo sapiens
ctgaagcccaaagcctg

SEQ ID NO: 4668032 - DNA, 22 bp, Homo sapiens
ctgaagcccaaagcctgaggac

SEQ ID NO: 4668033 - DNA, 20 bp, Homo sapiens
ctgaagctgacgaacttcca

SEQ ID NO: 4668034 - DNA, 20 bp, Homo sapiens
ctgaaggagatcaatggttt

SEQ ID NO: 4668035 - DNA, 11 bp, Homo sapiens
ctgaaggcagt

SEQ ID NO: 4668036 - DNA, 22 bp, Homo sapiens
ctgaaggcagtggcaggggagc

SEQ ID NO: 4668037 - DNA, 23 bp, Homo sapiens
ctgaaggctttcagggcctccag

SEQ ID NO: 4668038 - DNA, 20 bp, Homo sapiens
ctgaagggggcggcctatga

SEQ ID NO: 4668039 - DNA, 15 bp, Homo sapiens
ctgaataacctgcac

SEQ ID NO: 4668040 - DNA, 19 bp, Homo sapiens
ctgaataacctgcacaggc

SEQ ID NO: 4668041 - DNA, 20 bp, Homo sapiens
ctgaataacctgcacaggct

SEQ ID NO: 4668042 - DNA, 21 bp, Homo sapiens
ctgaataatatcaaataaaat

SEQ ID NO: 4668043 - DNA, 15 bp, Homo sapiens
ctgaatcatgtctgt

SEQ ID NO: 4668044 - DNA, 19 bp, Homo sapiens
ctgaatgcctcgctccctt

SEQ ID NO: 4668045 - DNA, 21 bp, Homo sapiens
ctgaatgcctcgctcccttca

SEQ ID NO: 4668046 - DNA, 15 bp, Homo sapiens
ctgaatgtttgtgtc

SEQ ID NO: 4668047 - DNA, 18 bp, Homo sapiens
ctgaatgtttgtgtctgt

SEQ ID NO: 4668048 - DNA, 19 bp, Homo sapiens
ctgaatgtttgtgtctgtg

SEQ ID NO: 4668049 - DNA, 15 bp, Homo sapiens
ctgacaggcagcctg

SEQ ID NO: 4668050 - DNA, 14 bp, Homo sapiens
ctgacagtagctct

SEQ ID NO: 4668051 - DNA, 19 bp, Homo sapiens
ctgacagtagctcttagac

SEQ ID NO: 4668052 - DNA, 20 bp, Homo sapiens
ctgacagtagctcttagact

SEQ ID NO: 4668053 - DNA, 12 bp, Homo sapiens
ctgaccacagca

SEQ ID NO: 4668054 - DNA, 20 bp, Homo sapiens
ctgaccaggatggagcaagc

SEQ ID NO: 4668055 - DNA, 12 bp, Homo sapiens
ctgacccagcat

SEQ ID NO: 4668056 - DNA, 16 bp, Homo sapiens
ctgaccccatcaccta

SEQ ID NO: 4668057 - DNA, 17 bp, Homo sapiens
ctgacctgtgagcccag

SEQ ID NO: 4668058 - DNA, 18 bp, Homo sapiens
ctgacctgtgagcccagc

SEQ ID NO: 4668059 - DNA, 23 bp, Homo sapiens
ctgacggcgcctttttggcctgt

SEQ ID NO: 4668060 - DNA, 19 bp, Homo sapiens
ctgactcctcagtccctct

SEQ ID NO: 4668061 - DNA, 22 bp, Homo sapiens
ctgactgaaggaaaagcaagaa

SEQ ID NO: 4668062 - DNA, 17 bp, Homo sapiens
ctgactgccaagccaga

SEQ ID NO: 4668063 - DNA, 17 bp, Homo sapiens
ctgactgccccctcctg

SEQ ID NO: 4668064 - DNA, 16 bp, Homo sapiens
ctgactggccaaaccc

SEQ ID NO: 4668065 - DNA, 15 bp, Homo sapiens
ctgactgttgccttt

SEQ ID NO: 4668066 - DNA, 19 bp, Homo sapiens
ctgacttggttctgaagcc

SEQ ID NO: 4668067 - DNA, 12 bp, Homo sapiens
ctgagaacctgg

SEQ ID NO: 4668068 - DNA, 14 bp, Homo sapiens
ctgagaacctggcc

SEQ ID NO: 4668069 - DNA, 13 bp, Homo sapiens
ctgagaagctctg

SEQ ID NO: 4668070 - DNA, 16 bp, Homo sapiens
ctgagaagctctgaag

SEQ ID NO: 4668071 - DNA, 21 bp, Homo sapiens
ctgagaagctgctccaggcct

SEQ ID NO: 4668072 - DNA, 21 bp, Homo sapiens
ctgagaatctaggccacccca

SEQ ID NO: 4668073 - DNA, 22 bp, Homo sapiens
ctgagacgccacggagggctgg

SEQ ID NO: 4668074 - DNA, 18 bp, Homo sapiens
ctgagagaattggctcaa

SEQ ID NO: 4668075 - DNA, 14 bp, Homo sapiens
ctgagatctgctgt

SEQ ID NO: 4668076 - DNA, 18 bp, Homo sapiens
ctgagatggagtgagctg

SEQ ID NO: 4668077 - DNA, 20 bp, Homo sapiens
ctgagatttaacccctccac

SEQ ID NO: 4668078 - DNA, 16 bp, Homo sapiens
ctgagcactgccagga

SEQ ID NO: 4668079 - DNA, 17 bp, Homo sapiens
ctgagcactgccaggag

SEQ ID NO: 4668080 - DNA, 22 bp, Homo sapiens
ctgagcactgccaggagggaca

SEQ ID NO: 4668081 - DNA, 12 bp, Homo sapiens
ctgagcagggcc

SEQ ID NO: 4668082 - DNA, 13 bp, Homo sapiens
ctgagcagggccg

SEQ ID NO: 4668083 - DNA, 14 bp, Homo sapiens
ctgagcatttgcac

SEQ ID NO: 4668084 - DNA, 12 bp, Homo sapiens
ctgagccaacct

SEQ ID NO: 4668085 - DNA, 13 bp, Homo sapiens
ctgagcccaggga

SEQ ID NO: 4668086 - DNA, 16 bp, Homo sapiens
ctgagcccagggaggc

SEQ ID NO: 4668087 - DNA, 19 bp, Homo sapiens
ctgagcccagggaggccga

SEQ ID NO: 4668088 - DNA, 22 bp, Homo sapiens
ctgagcccagggaggccgaagc

SEQ ID NO: 4668089 - DNA, 19 bp, Homo sapiens
ctgagccgaagctgcgggg

SEQ ID NO: 4668090 - DNA, 15 bp, Homo sapiens
ctgagcgccaggatg

SEQ ID NO: 4668091 - DNA, 20 bp, Homo sapiens
ctgagctcacaaggcagcaa

SEQ ID NO: 4668092 - DNA, 22 bp, Homo sapiens
ctgagctcacaaggcagcaagg

SEQ ID NO: 4668093 - DNA, 23 bp, Homo sapiens
ctgagctctgagaggccctggat

SEQ ID NO: 4668094 - DNA, 18 bp, Homo sapiens
ctgagctggaaggggcca

SEQ ID NO: 4668095 - DNA, 14 bp, Homo sapiens
ctgaggactcctga

SEQ ID NO: 4668096 - DNA, 21 bp, Homo sapiens
ctgaggagatgaccagggatg

SEQ ID NO: 4668097 - DNA, 19 bp, Homo sapiens
ctgaggagtctgaggtcct

SEQ ID NO: 4668098 - DNA, 24 bp, Homo sapiens
ctgaggccacactcagcacaaggc

SEQ ID NO: 4668099 - DNA, 13 bp, Homo sapiens
ctgaggccagcct

SEQ ID NO: 4668100 - DNA, 17 bp, Homo sapiens
ctgaggccagcctggcc

SEQ ID NO: 4668101 - DNA, 18 bp, Homo sapiens
ctgaggccagcctggcct

SEQ ID NO: 4668102 - DNA, 19 bp, Homo sapiens
ctgaggcctagactctgtc

SEQ ID NO: 4668103 - DNA, 11 bp, Homo sapiens
ctgagggcagt

SEQ ID NO: 4668104 - DNA, 16 bp, Homo sapiens
ctgagggcagtgccct

SEQ ID NO: 4668105 - DNA, 17 bp, Homo sapiens
ctgagggcagtgccctt

SEQ ID NO: 4668106 - DNA, 19 bp, Homo sapiens
ctgagggcagtgccctttg

SEQ ID NO: 4668107 - DNA, 12 bp, Homo sapiens
ctgagggcagtt

SEQ ID NO: 4668108 - DNA, 15 bp, Homo sapiens
ctgaggtcagggagt

SEQ ID NO: 4668109 - DNA, 19 bp, Homo sapiens
ctgaggtcagggagtgctg

SEQ ID NO: 4668110 - DNA, 18 bp, Homo sapiens
ctgaggtcctgagcactg

SEQ ID NO: 4668111 - DNA, 15 bp, Homo sapiens
ctgaggtgcccactc

SEQ ID NO: 4668112 - DNA, 23 bp, Homo sapiens
ctgaggtgcccactccgccagcc

SEQ ID NO: 4668113 - DNA, 14 bp, Homo sapiens
ctgaggtgcccagg

SEQ ID NO: 4668114 - DNA, 20 bp, Homo sapiens
ctgaggtgcccaggagaaga

SEQ ID NO: 4668115 - DNA, 20 bp, Homo sapiens
ctgagtgacctccttctgca

SEQ ID NO: 4668116 - DNA, 21 bp, Homo sapiens
ctgagtgaggtgttgcagccc

SEQ ID NO: 4668117 - DNA, 20 bp, Homo sapiens
ctgagttgttgagtctgttt

SEQ ID NO: 4668118 - DNA, 19 bp, Homo sapiens
ctgagttttagttggtctt

SEQ ID NO: 4668119 - DNA, 14 bp, Homo sapiens
ctgatcagaggcat

SEQ ID NO: 4668120 - DNA, 21 bp, Homo sapiens
ctgatcagaggcatttgagca

SEQ ID NO: 4668121 - DNA, 20 bp, Homo sapiens
ctgatgagtaaactgaggcc

SEQ ID NO: 4668122 - DNA, 21 bp, Homo sapiens
ctgatgagtaaactgaggccc

SEQ ID NO: 4668123 - DNA, 13 bp, Homo sapiens
ctgatgcaggtca

SEQ ID NO: 4668124 - DNA, 23 bp, Homo sapiens
ctgatgcaggtcagcccatggag

SEQ ID NO: 4668125 - DNA, 14 bp, Homo sapiens
ctgatgcatcagaa

SEQ ID NO: 4668126 - DNA, 22 bp, Homo sapiens
ctgatgcatcagaaagggaggg

SEQ ID NO: 4668127 - DNA, 12 bp, Homo sapiens
ctgatgctgaca

SEQ ID NO: 4668128 - DNA, 22 bp, Homo sapiens
ctgatgggaaaactgccaatat

SEQ ID NO: 4668129 - DNA, 16 bp, Homo sapiens
ctgattaagcattctt

SEQ ID NO: 4668130 - DNA, 22 bp, Homo sapiens
ctgattacttgtaattatgaaa

SEQ ID NO: 4668131 - DNA, 14 bp, Homo sapiens
ctgattcaactaaa

SEQ ID NO: 4668132 - DNA, 18 bp, Homo sapiens
ctgattcaactaaaaaaa

SEQ ID NO: 4668133 - DNA, 22 bp, Homo sapiens
ctgattcataataaatatctgt

SEQ ID NO: 4668134 - DNA, 20 bp, Homo sapiens
ctgattgatttgggtttttt

SEQ ID NO: 4668135 - DNA, 16 bp, Homo sapiens
ctgattgctcccagga

SEQ ID NO: 4668136 - DNA, 17 bp, Homo sapiens
ctgattgctcccaggat

SEQ ID NO: 4668137 - DNA, 20 bp, Homo sapiens
ctgatttctacaactggagt

SEQ ID NO: 4668138 - DNA, 15 bp, Homo sapiens
ctgcaaaaattatat

SEQ ID NO: 4668139 - DNA, 19 bp, Homo sapiens
ctgcaaaaattatatattg

SEQ ID NO: 4668140 - DNA, 15 bp, Homo sapiens
ctgcaaaaggcctct

SEQ ID NO: 4668141 - DNA, 21 bp, Homo sapiens
ctgcaaaaggcctcttgtaaa

SEQ ID NO: 4668142 - DNA, 13 bp, Homo sapiens
ctgcaaaattaaa

SEQ ID NO: 4668143 - DNA, 21 bp, Homo sapiens
ctgcaaacagaacagggtcat

SEQ ID NO: 4668144 - DNA, 14 bp, Homo sapiens
ctgcaaaggagaag

SEQ ID NO: 4668145 - DNA, 22 bp, Homo sapiens
ctgcaacctctgcctcctgggt

SEQ ID NO: 4668146 - DNA, 21 bp, Homo sapiens
ctgcaagatggacacgagcca

SEQ ID NO: 4668147 - DNA, 17 bp, Homo sapiens
ctgcacaccaaggccct

SEQ ID NO: 4668148 - DNA, 20 bp, Homo sapiens
ctgcacaccctccagagaca

SEQ ID NO: 4668149 - DNA, 20 bp, Homo sapiens
ctgcacactctcttctccat

SEQ ID NO: 4668150 - DNA, 17 bp, Homo sapiens
ctgcacagacaagcagc

SEQ ID NO: 4668151 - DNA, 22 bp, Homo sapiens
ctgcacagacaagcagcccttg

SEQ ID NO: 4668152 - DNA, 15 bp, Homo sapiens
ctgcacaggcttgct

SEQ ID NO: 4668153 - DNA, 13 bp, Homo sapiens
ctgcacagtgttg

SEQ ID NO: 4668154 - DNA, 23 bp, Homo sapiens
ctgcacatgtcttgtacatgtgt

SEQ ID NO: 4668155 - DNA, 17 bp, Homo sapiens
ctgcacctagaacctcc

SEQ ID NO: 4668156 - DNA, 17 bp, Homo sapiens
ctgcaccttcagcggat

SEQ ID NO: 4668157 - DNA, 13 bp, Homo sapiens
ctgcaccttcccc

SEQ ID NO: 4668158 - DNA, 18 bp, Homo sapiens
ctgcactccagcctgggg

SEQ ID NO: 4668159 - DNA, 20 bp, Homo sapiens
ctgcactccagcctggggga

SEQ ID NO: 4668160 - DNA, 12 bp, Homo sapiens
ctgcactgtgaa

SEQ ID NO: 4668161 - DNA, 12 bp, Homo sapiens
ctgcagaaccca

SEQ ID NO: 4668162 - DNA, 22 bp, Homo sapiens
ctgcagaaggaaagaagggggc

SEQ ID NO: 4668163 - DNA, 16 bp, Homo sapiens
ctgcagaccctgccct

SEQ ID NO: 4668164 - DNA, 21 bp, Homo sapiens
ctgcagaccctgcccttgttt

SEQ ID NO: 4668165 - DNA, 17 bp, Homo sapiens
ctgcagcaaacactcca

SEQ ID NO: 4668166 - DNA, 12 bp, Homo sapiens
ctgcagcacctc

SEQ ID NO: 4668167 - DNA, 18 bp, Homo sapiens
ctgcagcacctccaggcc

SEQ ID NO: 4668168 - DNA, 20 bp, Homo sapiens
ctgcagcacctccaggcctg

SEQ ID NO: 4668169 - DNA, 14 bp, Homo sapiens
ctgcagcagagcct

SEQ ID NO: 4668170 - DNA, 13 bp, Homo sapiens
ctgcagcaggagt

SEQ ID NO: 4668171 - DNA, 19 bp, Homo sapiens
ctgcagcttgtagccagcc

SEQ ID NO: 4668172 - DNA, 20 bp, Homo sapiens
ctgcaggagtgtcctgccca

SEQ ID NO: 4668173 - DNA, 15 bp, Homo sapiens
ctgcaggcaggaaca

SEQ ID NO: 4668174 - DNA, 22 bp, Homo sapiens
ctgcaggcaggaacaaacaggg

SEQ ID NO: 4668175 - DNA, 13 bp, Homo sapiens
ctgcagggaggag

SEQ ID NO: 4668176 - DNA, 15 bp, Homo sapiens
ctgcagggccatctg

SEQ ID NO: 4668177 - DNA, 20 bp, Homo sapiens
ctgcaggttcttcttcctga

SEQ ID NO: 4668178 - DNA, 23 bp, Homo sapiens
ctgcagtccgtgtggatccaatg

SEQ ID NO: 4668179 - DNA, 15 bp, Homo sapiens
ctgcagtgagccatg

SEQ ID NO: 4668180 - DNA, 22 bp, Homo sapiens
ctgcagttttgctatctgggct

SEQ ID NO: 4668181 - DNA, 17 bp, Homo sapiens
ctgcatctgtctgctct

SEQ ID NO: 4668182 - DNA, 18 bp, Homo sapiens
ctgcatctgtctgctctg

SEQ ID NO: 4668183 - DNA, 17 bp, Homo sapiens
ctgcatggtcaagcctc

SEQ ID NO: 4668184 - DNA, 17 bp, Homo sapiens
ctgcattatcttgctca

SEQ ID NO: 4668185 - DNA, 16 bp, Homo sapiens
ctgcattcatttttat

SEQ ID NO: 4668186 - DNA, 23 bp, Homo sapiens
ctgcattcatttttatagcaaca

SEQ ID NO: 4668187 - DNA, 13 bp, Homo sapiens
ctgcattctctcc

SEQ ID NO: 4668188 - DNA, 22 bp, Homo sapiens
ctgcattctctcccatcctggg

SEQ ID NO: 4668189 - DNA, 14 bp, Homo sapiens
ctgcattgacctgg

SEQ ID NO: 4668190 - DNA, 16 bp, Homo sapiens
ctgcattgacctggag

SEQ ID NO: 4668191 - DNA, 18 bp, Homo sapiens
ctgcattgacctggaggg

SEQ ID NO: 4668192 - DNA, 20 bp, Homo sapiens
ctgcattgacctggagggga

SEQ ID NO: 4668193 - DNA, 13 bp, Homo sapiens
ctgccaagccaga

SEQ ID NO: 4668194 - DNA, 17 bp, Homo sapiens
ctgccaaggtggaggga

SEQ ID NO: 4668195 - DNA, 13 bp, Homo sapiens
ctgccacagagaa

SEQ ID NO: 4668196 - DNA, 12 bp, Homo sapiens
ctgccagacctg

SEQ ID NO: 4668197 - DNA, 15 bp, Homo sapiens
ctgccagacctgcat

SEQ ID NO: 4668198 - DNA, 16 bp, Homo sapiens
ctgccagacctgcatg

SEQ ID NO: 4668199 - DNA, 19 bp, Homo sapiens
ctgccagcaggaataaaga

SEQ ID NO: 4668200 - DNA, 15 bp, Homo sapiens
ctgccagccactgtc

SEQ ID NO: 4668201 - DNA, 16 bp, Homo sapiens
ctgccagccactgtca

SEQ ID NO: 4668202 - DNA, 12 bp, Homo sapiens
ctgccagcccag

SEQ ID NO: 4668203 - DNA, 15 bp, Homo sapiens
ctgccagcccagctg

SEQ ID NO: 4668204 - DNA, 16 bp, Homo sapiens
ctgccagggtgagcag

SEQ ID NO: 4668205 - DNA, 23 bp, Homo sapiens
ctgccatctcacctcctgctggg

SEQ ID NO: 4668206 - DNA, 19 bp, Homo sapiens
ctgcccaggtatcctgggg

SEQ ID NO: 4668207 - DNA, 12 bp, Homo sapiens
ctgcccagtgca

SEQ ID NO: 4668208 - DNA, 18 bp, Homo sapiens
ctgcccatggacaggctg

SEQ ID NO: 4668209 - DNA, 20 bp, Homo sapiens
ctgcccatggacaggctggc

SEQ ID NO: 4668210 - DNA, 24 bp, Homo sapiens
ctgccccaactccttccagctagt

SEQ ID NO: 4668211 - DNA, 23 bp, Homo sapiens
ctgccccacccctccccattagc

SEQ ID NO: 4668212 - DNA, 20 bp, Homo sapiens
ctgccccacgttgtccctga

SEQ ID NO: 4668213 - DNA, 17 bp, Homo sapiens
ctgccccaggccctact

SEQ ID NO: 4668214 - DNA, 20 bp, Homo sapiens
ctgccccccaccccaccctc

SEQ ID NO: 4668215 - DNA, 13 bp, Homo sapiens
ctgccccctcctg

SEQ ID NO: 4668216 - DNA, 12 bp, Homo sapiens
ctgccccctggg

SEQ ID NO: 4668217 - DNA, 14 bp, Homo sapiens
ctgccccctgggga

SEQ ID NO: 4668218 - DNA, 13 bp, Homo sapiens
ctgcccctcacaa

SEQ ID NO: 4668219 - DNA, 16 bp, Homo sapiens
ctgcccctctctgggc

SEQ ID NO: 4668220 - DNA, 17 bp, Homo sapiens
ctgcccctctctgggcc

SEQ ID NO: 4668221 - DNA, 18 bp, Homo sapiens
ctgcccctctctgggcct

SEQ ID NO: 4668222 - DNA, 17 bp, Homo sapiens
ctgcccctgtgggactc

SEQ ID NO: 4668223 - DNA, 18 bp, Homo sapiens
ctgccccttaaccccaag

SEQ ID NO: 4668224 - DNA, 21 bp, Homo sapiens
ctgccccttaaccccaaggac

SEQ ID NO: 4668225 - DNA, 13 bp, Homo sapiens
ctgccccttcccc

SEQ ID NO: 4668226 - DNA, 23 bp, Homo sapiens
ctgccctcattactgggccttag

SEQ ID NO: 4668227 - DNA, 11 bp, Homo sapiens
ctgccctgaga

SEQ ID NO: 4668228 - DNA, 15 bp, Homo sapiens
ctgccctgcccaggt

SEQ ID NO: 4668229 - DNA, 16 bp, Homo sapiens
ctgccctgctctgccc

SEQ ID NO: 4668230 - DNA, 16 bp, Homo sapiens
ctgcccttcagcatcc

SEQ ID NO: 4668231 - DNA, 21 bp, Homo sapiens
ctgcccttgtttggggcagga

SEQ ID NO: 4668232 - DNA, 21 bp, Homo sapiens
ctgccgagcaaccgtggccct

SEQ ID NO: 4668233 - DNA, 23 bp, Homo sapiens
ctgccggttcttaaatccatcct

SEQ ID NO: 4668234 - DNA, 14 bp, Homo sapiens
ctgcctagagtgta

SEQ ID NO: 4668235 - DNA, 22 bp, Homo sapiens
ctgcctagagtgtagcctaaag

SEQ ID NO: 4668236 - DNA, 20 bp, Homo sapiens
ctgcctataatcttatacaa

SEQ ID NO: 4668237 - DNA, 16 bp, Homo sapiens
ctgcctcacatctccc

SEQ ID NO: 4668238 - DNA, 15 bp, Homo sapiens
ctgcctcagcctccc

SEQ ID NO: 4668239 - DNA, 14 bp, Homo sapiens
ctgcctcaggactg

SEQ ID NO: 4668240 - DNA, 23 bp, Homo sapiens
ctgcctcccgggttcaagcttgt

SEQ ID NO: 4668241 - DNA, 17 bp, Homo sapiens
ctgcctctactgggaag

SEQ ID NO: 4668242 - DNA, 18 bp, Homo sapiens
ctgcctctactgggaagg

SEQ ID NO: 4668243 - DNA, 16 bp, Homo sapiens
ctgcctctcacagctg

SEQ ID NO: 4668244 - DNA, 21 bp, Homo sapiens
ctgcctctcacagctgagttg

SEQ ID NO: 4668245 - DNA, 21 bp, Homo sapiens
ctgcctcttccccctgcttcc

SEQ ID NO: 4668246 - DNA, 15 bp, Homo sapiens
ctgcctgaccttgga

SEQ ID NO: 4668247 - DNA, 10 bp, Homo sapiens
ctgcctggag

SEQ ID NO: 4668248 - DNA, 22 bp, Homo sapiens
ctgcctggagacaaggtgctaa

SEQ ID NO: 4668249 - DNA, 16 bp, Homo sapiens
ctgcctggaggacctg

SEQ ID NO: 4668250 - DNA, 17 bp, Homo sapiens
ctgcctggaggacctga

SEQ ID NO: 4668251 - DNA, 19 bp, Homo sapiens
ctgcctggaggacctgagc

SEQ ID NO: 4668252 - DNA, 20 bp, Homo sapiens
ctgcctggaggacctgagcc

SEQ ID NO: 4668253 - DNA, 18 bp, Homo sapiens
ctgcctggatgagaaaca

SEQ ID NO: 4668254 - DNA, 9 bp, Homo sapiens
ctgcctggc

SEQ ID NO: 4668255 - DNA, 12 bp, Homo sapiens
ctgcctgggatg

SEQ ID NO: 4668256 - DNA, 16 bp, Homo sapiens
ctgcctgggcaatggc

SEQ ID NO: 4668257 - DNA, 20 bp, Homo sapiens
ctgcctgggtaggccccaca

SEQ ID NO: 4668258 - DNA, 21 bp, Homo sapiens
ctgcctgggtaggccccacaa

SEQ ID NO: 4668259 - DNA, 23 bp, Homo sapiens
ctgcctgggtaggccccacaagg

SEQ ID NO: 4668260 - DNA, 13 bp, Homo sapiens
ctgcctggttcta

SEQ ID NO: 4668261 - DNA, 17 bp, Homo sapiens
ctgcctggttctaggct

SEQ ID NO: 4668262 - DNA, 18 bp, Homo sapiens
ctgcctggttctaggctg

SEQ ID NO: 4668263 - DNA, 13 bp, Homo sapiens
ctgcctgtgggct

SEQ ID NO: 4668264 - DNA, 16 bp, Homo sapiens
ctgccttaacctggga

SEQ ID NO: 4668265 - DNA, 19 bp, Homo sapiens
ctgccttaacctgggacca

SEQ ID NO: 4668266 - DNA, 20 bp, Homo sapiens
ctgccttaacctgggaccaa

SEQ ID NO: 4668267 - DNA, 18 bp, Homo sapiens
ctgccttctggccttgta

SEQ ID NO: 4668268 - DNA, 14 bp, Homo sapiens
ctgcctttaagcca

SEQ ID NO: 4668269 - DNA, 18 bp, Homo sapiens
ctgcctttaagccaaaga

SEQ ID NO: 4668270 - DNA, 21 bp, Homo sapiens
ctgcctttctcaactgtccca

SEQ ID NO: 4668271 - DNA, 17 bp, Homo sapiens
ctgcgcaagtgcctggg

SEQ ID NO: 4668272 - DNA, 20 bp, Homo sapiens
ctgcggagagaggccttgtc

SEQ ID NO: 4668273 - DNA, 17 bp, Homo sapiens
ctgcggagcaagaggag

SEQ ID NO: 4668274 - DNA, 15 bp, Homo sapiens
ctgcgggggcaggcc

SEQ ID NO: 4668275 - DNA, 16 bp, Homo sapiens
ctgcgggggcaggccg

SEQ ID NO: 4668276 - DNA, 21 bp, Homo sapiens
ctgctacattataatgtacag

SEQ ID NO: 4668277 - DNA, 14 bp, Homo sapiens
ctgctacctgttct

SEQ ID NO: 4668278 - DNA, 17 bp, Homo sapiens
ctgctagtcgcccctca

SEQ ID NO: 4668279 - DNA, 18 bp, Homo sapiens
ctgctagtcgcccctcag

SEQ ID NO: 4668280 - DNA, 20 bp, Homo sapiens
ctgctagtcgcccctcagag

SEQ ID NO: 4668281 - DNA, 23 bp, Homo sapiens
ctgctagtcgcccctcagagcat

SEQ ID NO: 4668282 - DNA, 19 bp, Homo sapiens
ctgctattctagagctttt

SEQ ID NO: 4668283 - DNA, 20 bp, Homo sapiens
ctgctattctagagctttta

SEQ ID NO: 4668284 - DNA, 21 bp, Homo sapiens
ctgctattctagagcttttat

SEQ ID NO: 4668285 - DNA, 13 bp, Homo sapiens
ctgctcagctctg

SEQ ID NO: 4668286 - DNA, 22 bp, Homo sapiens
ctgctcagctctgggccattct

SEQ ID NO: 4668287 - DNA, 13 bp, Homo sapiens
ctgctccaggcct

SEQ ID NO: 4668288 - DNA, 14 bp, Homo sapiens
ctgctcgctccctg

SEQ ID NO: 4668289 - DNA, 17 bp, Homo sapiens
ctgctcggggtgcacag

SEQ ID NO: 4668290 - DNA, 21 bp, Homo sapiens
ctgctcggggtgcacaggagg

SEQ ID NO: 4668291 - DNA, 19 bp, Homo sapiens
ctgctctaagcccaggatc

SEQ ID NO: 4668292 - DNA, 22 bp, Homo sapiens
ctgctctaagcccaggatctct

SEQ ID NO: 4668293 - DNA, 12 bp, Homo sapiens
ctgctctgcata

SEQ ID NO: 4668294 - DNA, 11 bp, Homo sapiens
ctgctctgccc

SEQ ID NO: 4668295 - DNA, 17 bp, Homo sapiens
ctgctctgcccaggcaa

SEQ ID NO: 4668296 - DNA, 23 bp, Homo sapiens
ctgctctggaataaagttgcaga

SEQ ID NO: 4668297 - DNA, 21 bp, Homo sapiens
ctgctctttccacttgccctg

SEQ ID NO: 4668298 - DNA, 20 bp, Homo sapiens
ctgctgacagacactaactt

SEQ ID NO: 4668299 - DNA, 15 bp, Homo sapiens
ctgctgagaacctgg

SEQ ID NO: 4668300 - DNA, 16 bp, Homo sapiens
ctgctgagaacctggc

SEQ ID NO: 4668301 - DNA, 17 bp, Homo sapiens
ctgctgagaacctggcc

SEQ ID NO: 4668302 - DNA, 19 bp, Homo sapiens
ctgctgagaacctggcctt

SEQ ID NO: 4668303 - DNA, 17 bp, Homo sapiens
ctgctgagatctgctgt

SEQ ID NO: 4668304 - DNA, 13 bp, Homo sapiens
ctgctgagctctg

SEQ ID NO: 4668305 - DNA, 17 bp, Homo sapiens
ctgctgagctctgagag

SEQ ID NO: 4668306 - DNA, 20 bp, Homo sapiens
ctgctgcacaccaaggccct

SEQ ID NO: 4668307 - DNA, 14 bp, Homo sapiens
ctgctgctgagaac

SEQ ID NO: 4668308 - DNA, 16 bp, Homo sapiens
ctgctgctgagaacct

SEQ ID NO: 4668309 - DNA, 21 bp, Homo sapiens
ctgctgctgagaacctggcct

SEQ ID NO: 4668310 - DNA, 22 bp, Homo sapiens
ctgctgctgagaacctggcctt

SEQ ID NO: 4668311 - DNA, 20 bp, Homo sapiens
ctgctggagatcagcatgcc

SEQ ID NO: 4668312 - DNA, 21 bp, Homo sapiens
ctgctggccccgcccctgccc

SEQ ID NO: 4668313 - DNA, 13 bp, Homo sapiens
ctgctgggctctg

SEQ ID NO: 4668314 - DNA, 18 bp, Homo sapiens
ctgctggtacctgccctc

SEQ ID NO: 4668315 - DNA, 19 bp, Homo sapiens
ctgctgtaaatttggcttc

SEQ ID NO: 4668316 - DNA, 22 bp, Homo sapiens
ctgctgtaaatttggcttctgt

SEQ ID NO: 4668317 - DNA, 20 bp, Homo sapiens
ctgctgtctaacctgtgacc

SEQ ID NO: 4668318 - DNA, 23 bp, Homo sapiens
ctgctgtgccatgctgggccact

SEQ ID NO: 4668319 - DNA, 13 bp, Homo sapiens
ctgctgtgcccca

SEQ ID NO: 4668320 - DNA, 19 bp, Homo sapiens
ctgctgtgccccaccacgt

SEQ ID NO: 4668321 - DNA, 13 bp, Homo sapiens
ctgcttcccaggt

SEQ ID NO: 4668322 - DNA, 18 bp, Homo sapiens
ctgcttgacagactcaag

SEQ ID NO: 4668323 - DNA, 12 bp, Homo sapiens
ctgcttgtcaaa

SEQ ID NO: 4668324 - DNA, 14 bp, Homo sapiens
ctgctttgcaaaga

SEQ ID NO: 4668325 - DNA, 15 bp, Homo sapiens
ctgctttgcaaagac

SEQ ID NO: 4668326 - DNA, 23 bp, Homo sapiens
ctgctttgggaagactgaggcat

SEQ ID NO: 4668327 - DNA, 19 bp, Homo sapiens
ctgcttttcctctgccttc

SEQ ID NO: 4668328 - DNA, 17 bp, Homo sapiens
ctgctttttctgcgctt

SEQ ID NO: 4668329 - DNA, 19 bp, Homo sapiens
ctggaaaagggtcttggga

SEQ ID NO: 4668330 - DNA, 22 bp, Homo sapiens
ctggaaaagggtcttgggaaat

SEQ ID NO: 4668331 - DNA, 21 bp, Homo sapiens
ctggaaacaaaacagaagggg

SEQ ID NO: 4668332 - DNA, 17 bp, Homo sapiens
ctggaaacttctgtaag

SEQ ID NO: 4668333 - DNA, 19 bp, Homo sapiens
ctggaacaaattatttttg

SEQ ID NO: 4668334 - DNA, 19 bp, Homo sapiens
ctggaactcctaaaccttt

SEQ ID NO: 4668335 - DNA, 21 bp, Homo sapiens
ctggaagagccgagcacctgt

SEQ ID NO: 4668336 - DNA, 20 bp, Homo sapiens
ctggaagcccctgggcccag

SEQ ID NO: 4668337 - DNA, 15 bp, Homo sapiens
ctggaagccttcccc

SEQ ID NO: 4668338 - DNA, 19 bp, Homo sapiens
ctggaagtcaaataaatgt

SEQ ID NO: 4668339 - DNA, 23 bp, Homo sapiens
ctggaataaagttgcagatgatt

SEQ ID NO: 4668340 - DNA, 21 bp, Homo sapiens
ctggaatcctgaaagggcact

SEQ ID NO: 4668341 - DNA, 22 bp, Homo sapiens
ctggaatcctgaaagggcactt

SEQ ID NO: 4668342 - DNA, 14 bp, Homo sapiens
ctggacagctgtgc

SEQ ID NO: 4668343 - DNA, 16 bp, Homo sapiens
ctggacagctgtgcct

SEQ ID NO: 4668344 - DNA, 17 bp, Homo sapiens
ctggacagctgtgcctc

SEQ ID NO: 4668345 - DNA, 19 bp, Homo sapiens
ctggacagctgtgcctcgc

SEQ ID NO: 4668346 - DNA, 17 bp, Homo sapiens
ctggacataacattttc

SEQ ID NO: 4668347 - DNA, 18 bp, Homo sapiens
ctggacatagagagggag

SEQ ID NO: 4668348 - DNA, 12 bp, Homo sapiens
ctggactggtta

SEQ ID NO: 4668349 - DNA, 17 bp, Homo sapiens
ctggactggttatcttg

SEQ ID NO: 4668350 - DNA, 19 bp, Homo sapiens
ctggactggttatcttgtt

SEQ ID NO: 4668351 - DNA, 20 bp, Homo sapiens
ctggactggttatcttgtta

SEQ ID NO: 4668352 - DNA, 16 bp, Homo sapiens
ctggactgtttcatag

SEQ ID NO: 4668353 - DNA, 19 bp, Homo sapiens
ctggactgtttcatagttt

SEQ ID NO: 4668354 - DNA, 21 bp, Homo sapiens
ctggactgtttcatagttttc

SEQ ID NO: 4668355 - DNA, 14 bp, Homo sapiens
ctggagaaagagct

SEQ ID NO: 4668356 - DNA, 19 bp, Homo sapiens
ctggagaaagagctgcctg

SEQ ID NO: 4668357 - DNA, 13 bp, Homo sapiens
ctggagcaggagc

SEQ ID NO: 4668358 - DNA, 19 bp, Homo sapiens
ctggaggaatacattttat

SEQ ID NO: 4668359 - DNA, 14 bp, Homo sapiens
ctggaggacctgag

SEQ ID NO: 4668360 - DNA, 18 bp, Homo sapiens
ctggaggacctgagcctg

SEQ ID NO: 4668361 - DNA, 14 bp, Homo sapiens
ctggaggagagaag

SEQ ID NO: 4668362 - DNA, 17 bp, Homo sapiens
ctggaggagagaagaat

SEQ ID NO: 4668363 - DNA, 10 bp, Homo sapiens
ctggaggcag

SEQ ID NO: 4668364 - DNA, 13 bp, Homo sapiens
ctggaggcccctg

SEQ ID NO: 4668365 - DNA, 14 bp, Homo sapiens
ctggaggcccctgg

SEQ ID NO: 4668366 - DNA, 21 bp, Homo sapiens
ctggaggcccctggagccaga

SEQ ID NO: 4668367 - DNA, 13 bp, Homo sapiens
ctggagggcaagc

SEQ ID NO: 4668368 - DNA, 16 bp, Homo sapiens
ctggagggcaagccct

SEQ ID NO: 4668369 - DNA, 17 bp, Homo sapiens
ctggagggcaagccctg

SEQ ID NO: 4668370 - DNA, 20 bp, Homo sapiens
ctggagggcaagccctgccc

SEQ ID NO: 4668371 - DNA, 21 bp, Homo sapiens
ctggagggcaagccctgccca

SEQ ID NO: 4668372 - DNA, 13 bp, Homo sapiens
ctggaggggagag

SEQ ID NO: 4668373 - DNA, 18 bp, Homo sapiens
ctggagtgagaggccccc

SEQ ID NO: 4668374 - DNA, 16 bp, Homo sapiens
ctggatcagcgtggcc

SEQ ID NO: 4668375 - DNA, 17 bp, Homo sapiens
ctggatcagcgtggcct

SEQ ID NO: 4668376 - DNA, 18 bp, Homo sapiens
ctggatcagcgtggcctt

SEQ ID NO: 4668377 - DNA, 14 bp, Homo sapiens
ctggatgagaaaca

SEQ ID NO: 4668378 - DNA, 19 bp, Homo sapiens
ctggatgagaaacagctca

SEQ ID NO: 4668379 - DNA, 23 bp, Homo sapiens
ctggatgagaaacagctcagcca

SEQ ID NO: 4668380 - DNA, 12 bp, Homo sapiens
ctggcacacatc

SEQ ID NO: 4668381 - DNA, 21 bp, Homo sapiens
ctggcacacatcaggagttca

SEQ ID NO: 4668382 - DNA, 15 bp, Homo sapiens
ctggcacagaagagg

SEQ ID NO: 4668383 - DNA, 18 bp, Homo sapiens
ctggcacagaagaggagt

SEQ ID NO: 4668384 - DNA, 12 bp, Homo sapiens
ctggcacagagg

SEQ ID NO: 4668385 - DNA, 22 bp, Homo sapiens
ctggcagacttgcccaggtcac

SEQ ID NO: 4668386 - DNA, 15 bp, Homo sapiens
ctggcagcctcccat

SEQ ID NO: 4668387 - DNA, 23 bp, Homo sapiens
ctggcagcctcccatccagggcc

SEQ ID NO: 4668388 - DNA, 16 bp, Homo sapiens
ctggcagggcagcagg

SEQ ID NO: 4668389 - DNA, 18 bp, Homo sapiens
ctggcatgctaaagcctt

SEQ ID NO: 4668390 - DNA, 17 bp, Homo sapiens
ctggcattaagggcatt

SEQ ID NO: 4668391 - DNA, 14 bp, Homo sapiens
ctggccaaagtcac

SEQ ID NO: 4668392 - DNA, 15 bp, Homo sapiens
ctggccaaagtcact

SEQ ID NO: 4668393 - DNA, 19 bp, Homo sapiens
ctggccaaagtcacttccc

SEQ ID NO: 4668394 - DNA, 19 bp, Homo sapiens
ctggccaagctgaggtgcc

SEQ ID NO: 4668395 - DNA, 17 bp, Homo sapiens
ctggccaatttttgtac

SEQ ID NO: 4668396 - DNA, 20 bp, Homo sapiens
ctggccaatttttgtacttt

SEQ ID NO: 4668397 - DNA, 16 bp, Homo sapiens
ctggcccccagcttca

SEQ ID NO: 4668398 - DNA, 18 bp, Homo sapiens
ctggccccgcccctgccc

SEQ ID NO: 4668399 - DNA, 21 bp, Homo sapiens
ctggcccgggcatccacgtag

SEQ ID NO: 4668400 - DNA, 15 bp, Homo sapiens
ctggcccgtgacaga

SEQ ID NO: 4668401 - DNA, 18 bp, Homo sapiens
ctggcccgtgacagactc

SEQ ID NO: 4668402 - DNA, 19 bp, Homo sapiens
ctggcccgtgacagactcc

SEQ ID NO: 4668403 - DNA, 23 bp, Homo sapiens
ctggcccgtgacagactcctgag

SEQ ID NO: 4668404 - DNA, 13 bp, Homo sapiens
ctggccctgccgt

SEQ ID NO: 4668405 - DNA, 12 bp, Homo sapiens
ctggccctgctt

SEQ ID NO: 4668406 - DNA, 16 bp, Homo sapiens
ctggccgagtccaagc

SEQ ID NO: 4668407 - DNA, 20 bp, Homo sapiens
ctggccgagtccaagctggg

SEQ ID NO: 4668408 - DNA, 23 bp, Homo sapiens
ctggccgagtccaagctgggaga

SEQ ID NO: 4668409 - DNA, 18 bp, Homo sapiens
ctggcctcagagcttcct

SEQ ID NO: 4668410 - DNA, 21 bp, Homo sapiens
ctggcctcagagcttcctggg

SEQ ID NO: 4668411 - DNA, 14 bp, Homo sapiens
ctggcctcctgcct

SEQ ID NO: 4668412 - DNA, 17 bp, Homo sapiens
ctggcctgaactgagga

SEQ ID NO: 4668413 - DNA, 22 bp, Homo sapiens
ctggcctggcacacatcaggag

SEQ ID NO: 4668414 - DNA, 18 bp, Homo sapiens
ctggcggggaaccctggg

SEQ ID NO: 4668415 - DNA, 13 bp, Homo sapiens
ctggctactccct

SEQ ID NO: 4668416 - DNA, 20 bp, Homo sapiens
ctggctactccctggaccac

SEQ ID NO: 4668417 - DNA, 16 bp, Homo sapiens
ctggctagagggccca

SEQ ID NO: 4668418 - DNA, 20 bp, Homo sapiens
ctggctagagggcccaaagc

SEQ ID NO: 4668419 - DNA, 21 bp, Homo sapiens
ctggctagagggcccaaagct

SEQ ID NO: 4668420 - DNA, 24 bp, Homo sapiens
ctggctcacagtacagcatgtgcc

SEQ ID NO: 4668421 - DNA, 14 bp, Homo sapiens
ctggctcccagggc

SEQ ID NO: 4668422 - DNA, 12 bp, Homo sapiens
ctggctccctgc

SEQ ID NO: 4668423 - DNA, 20 bp, Homo sapiens
ctggctctcccatttcctga

SEQ ID NO: 4668424 - DNA, 12 bp, Homo sapiens
ctggctctgtga

SEQ ID NO: 4668425 - DNA, 12 bp, Homo sapiens
ctggctgagggc

SEQ ID NO: 4668426 - DNA, 13 bp, Homo sapiens
ctggctgagggca

SEQ ID NO: 4668427 - DNA, 15 bp, Homo sapiens
ctggctgagggcagt

SEQ ID NO: 4668428 - DNA, 19 bp, Homo sapiens
ctggctggccgcatgacca

SEQ ID NO: 4668429 - DNA, 14 bp, Homo sapiens
ctggctggctgagg

SEQ ID NO: 4668430 - DNA, 15 bp, Homo sapiens
ctggctggctgaggg

SEQ ID NO: 4668431 - DNA, 17 bp, Homo sapiens
ctggctggctgagggca

SEQ ID NO: 4668432 - DNA, 16 bp, Homo sapiens
ctggctgggacgtggc

SEQ ID NO: 4668433 - DNA, 23 bp, Homo sapiens
ctggctgggacgtggctcagcca

SEQ ID NO: 4668434 - DNA, 20 bp, Homo sapiens
ctggcttacctatctgtgga

SEQ ID NO: 4668435 - DNA, 16 bp, Homo sapiens
ctggcttcccatcccc

SEQ ID NO: 4668436 - DNA, 16 bp, Homo sapiens
ctggctttcctgctgg

SEQ ID NO: 4668437 - DNA, 14 bp, Homo sapiens
ctgggaaccactcc

SEQ ID NO: 4668438 - DNA, 23 bp, Homo sapiens
ctgggaagtcgtccttactcctg

SEQ ID NO: 4668439 - DNA, 19 bp, Homo sapiens
ctgggacacttaacagatg

SEQ ID NO: 4668440 - DNA, 23 bp, Homo sapiens
ctgggacacttaacagatgcaat

SEQ ID NO: 4668441 - DNA, 13 bp, Homo sapiens
ctgggaccccagc

SEQ ID NO: 4668442 - DNA, 19 bp, Homo sapiens
ctgggacctccccagccca

SEQ ID NO: 4668443 - DNA, 22 bp, Homo sapiens
ctgggacctccccagcccagga

SEQ ID NO: 4668444 - DNA, 20 bp, Homo sapiens
ctgggacgtggctcagccag

SEQ ID NO: 4668445 - DNA, 20 bp, Homo sapiens
ctgggactttcccacccagg

SEQ ID NO: 4668446 - DNA, 15 bp, Homo sapiens
ctgggagattcaagg

SEQ ID NO: 4668447 - DNA, 19 bp, Homo sapiens
ctgggagattcaagggacc

SEQ ID NO: 4668448 - DNA, 15 bp, Homo sapiens
ctgggagcttccgct

SEQ ID NO: 4668449 - DNA, 19 bp, Homo sapiens
ctgggagtatacggaaaca

SEQ ID NO: 4668450 - DNA, 21 bp, Homo sapiens
ctgggagtatacggaaacaaa

SEQ ID NO: 4668451 - DNA, 21 bp, Homo sapiens
ctgggattacaggcgtgagcc

SEQ ID NO: 4668452 - DNA, 23 bp, Homo sapiens
ctgggattcaggaaaaggcctgg

SEQ ID NO: 4668453 - DNA, 22 bp, Homo sapiens
ctgggcaatggccaggggccag

SEQ ID NO: 4668454 - DNA, 13 bp, Homo sapiens
ctgggcattgctt

SEQ ID NO: 4668455 - DNA, 22 bp, Homo sapiens
ctgggccagggtctgtgtgaat

SEQ ID NO: 4668456 - DNA, 19 bp, Homo sapiens
ctgggccatgttgtgcctc

SEQ ID NO: 4668457 - DNA, 21 bp, Homo sapiens
ctgggccattctccacagcaa

SEQ ID NO: 4668458 - DNA, 14 bp, Homo sapiens
ctgggcccatctct

SEQ ID NO: 4668459 - DNA, 20 bp, Homo sapiens
ctgggccctctttccctgcg

SEQ ID NO: 4668460 - DNA, 22 bp, Homo sapiens
ctgggcctatggagagccctgg

SEQ ID NO: 4668461 - DNA, 23 bp, Homo sapiens
ctgggcctatggagagccctggg

SEQ ID NO: 4668462 - DNA, 13 bp, Homo sapiens
ctgggcctgctgc

SEQ ID NO: 4668463 - DNA, 14 bp, Homo sapiens
ctgggcctgctgct

SEQ ID NO: 4668464 - DNA, 20 bp, Homo sapiens
ctgggcctgctgctgagaac

SEQ ID NO: 4668465 - DNA, 13 bp, Homo sapiens
ctgggcctggggg

SEQ ID NO: 4668466 - DNA, 20 bp, Homo sapiens
ctgggcctgggggttttcca

SEQ ID NO: 4668467 - DNA, 17 bp, Homo sapiens
ctgggcctttgcaagat

SEQ ID NO: 4668468 - DNA, 19 bp, Homo sapiens
ctgggctcaagctttcccg

SEQ ID NO: 4668469 - DNA, 14 bp, Homo sapiens
ctgggctcctccag

SEQ ID NO: 4668470 - DNA, 17 bp, Homo sapiens
ctgggctcctccagggt

SEQ ID NO: 4668471 - DNA, 15 bp, Homo sapiens
ctgggctctaaggta

SEQ ID NO: 4668472 - DNA, 14 bp, Homo sapiens
ctgggctctggact

SEQ ID NO: 4668473 - DNA, 14 bp, Homo sapiens
ctgggctgttgttc

SEQ ID NO: 4668474 - DNA, 13 bp, Homo sapiens
ctgggcttaagtt

SEQ ID NO: 4668475 - DNA, 13 bp, Homo sapiens
ctggggacagagg

SEQ ID NO: 4668476 - DNA, 14 bp, Homo sapiens
ctggggacagaggg

SEQ ID NO: 4668477 - DNA, 12 bp, Homo sapiens
ctggggaggcag

SEQ ID NO: 4668478 - DNA, 14 bp, Homo sapiens
ctggggaggcaggc

SEQ ID NO: 4668479 - DNA, 14 bp, Homo sapiens
ctggggcagcactc

SEQ ID NO: 4668480 - DNA, 12 bp, Homo sapiens
ctggggccaggc

SEQ ID NO: 4668481 - DNA, 12 bp, Homo sapiens
ctggggcctgag

SEQ ID NO: 4668482 - DNA, 13 bp, Homo sapiens
ctggggcctgaga

SEQ ID NO: 4668483 - DNA, 15 bp, Homo sapiens
ctggggcctgagaga

SEQ ID NO: 4668484 - DNA, 16 bp, Homo sapiens
ctggggcctgagagaa

SEQ ID NO: 4668485 - DNA, 23 bp, Homo sapiens
ctggggcctgtactgcctgcttg

SEQ ID NO: 4668486 - DNA, 22 bp, Homo sapiens
ctggggctctaacgcctgagcc

SEQ ID NO: 4668487 - DNA, 15 bp, Homo sapiens
ctggggctggcctcc

SEQ ID NO: 4668488 - DNA, 15 bp, Homo sapiens
ctgggggaagaggag

SEQ ID NO: 4668489 - DNA, 12 bp, Homo sapiens
ctgggggcctgg

SEQ ID NO: 4668490 - DNA, 14 bp, Homo sapiens
ctgggggcctggct

SEQ ID NO: 4668491 - DNA, 16 bp, Homo sapiens
ctgggggcctggctgg

SEQ ID NO: 4668492 - DNA, 17 bp, Homo sapiens
ctgggggcctggctggc

SEQ ID NO: 4668493 - DNA, 18 bp, Homo sapiens
ctgggggtttaagctctg

SEQ ID NO: 4668494 - DNA, 22 bp, Homo sapiens
ctgggggtttaagctctgcccc

SEQ ID NO: 4668495 - DNA, 13 bp, Homo sapiens
ctggggtgaatac

SEQ ID NO: 4668496 - DNA, 14 bp, Homo sapiens
ctgggtcagaccca

SEQ ID NO: 4668497 - DNA, 15 bp, Homo sapiens
ctgggtggctactct

SEQ ID NO: 4668498 - DNA, 21 bp, Homo sapiens
ctgggtggctactctgtgcca

SEQ ID NO: 4668499 - DNA, 13 bp, Homo sapiens
ctgggtgtcattt

SEQ ID NO: 4668500 - DNA, 12 bp, Homo sapiens
ctgggtgtctgg

SEQ ID NO: 4668501 - DNA, 23 bp, Homo sapiens
ctgggttcacgtaatcctcctga

SEQ ID NO: 4668502 - DNA, 20 bp, Homo sapiens
ctggtaggttgggacaccag

SEQ ID NO: 4668503 - DNA, 19 bp, Homo sapiens
ctggtcaacctcctggaca

SEQ ID NO: 4668504 - DNA, 16 bp, Homo sapiens
ctggtcacctcccatc

SEQ ID NO: 4668505 - DNA, 15 bp, Homo sapiens
ctggtccctgggagg

SEQ ID NO: 4668506 - DNA, 15 bp, Homo sapiens
ctggtcctgaccagg

SEQ ID NO: 4668507 - DNA, 16 bp, Homo sapiens
ctggtcctgaccagga

SEQ ID NO: 4668508 - DNA, 12 bp, Homo sapiens
ctggtctgggag

SEQ ID NO: 4668509 - DNA, 21 bp, Homo sapiens
ctggtctggttgggcagccag

SEQ ID NO: 4668510 - DNA, 19 bp, Homo sapiens
ctggtgggaaggccggcag

SEQ ID NO: 4668511 - DNA, 15 bp, Homo sapiens
ctggtggggcagctc

SEQ ID NO: 4668512 - DNA, 16 bp, Homo sapiens
ctggtggggcagctcc

SEQ ID NO: 4668513 - DNA, 23 bp, Homo sapiens
ctggtgtctgctttctccattgt

SEQ ID NO: 4668514 - DNA, 22 bp, Homo sapiens
ctggtgtttaggtgaattaatt

SEQ ID NO: 4668515 - DNA, 13 bp, Homo sapiens
ctggttatcttgt

SEQ ID NO: 4668516 - DNA, 13 bp, Homo sapiens
ctggttgggcagc

SEQ ID NO: 4668517 - DNA, 20 bp, Homo sapiens
ctggttgtctagtcattgtc

SEQ ID NO: 4668518 - DNA, 18 bp, Homo sapiens
ctggtttcaaactcctga

SEQ ID NO: 4668519 - DNA, 19 bp, Homo sapiens
ctggtttcaaactcctgac

SEQ ID NO: 4668520 - DNA, 21 bp, Homo sapiens
ctggtttcaaactcctgacct

SEQ ID NO: 4668521 - DNA, 19 bp, Homo sapiens
ctggtttgccggtggtgca

SEQ ID NO: 4668522 - DNA, 11 bp, Homo sapiens
ctgtaaatcat

SEQ ID NO: 4668523 - DNA, 17 bp, Homo sapiens
ctgtaacaggtattttg

SEQ ID NO: 4668524 - DNA, 18 bp, Homo sapiens
ctgtaacaggtattttgt

SEQ ID NO: 4668525 - DNA, 23 bp, Homo sapiens
ctgtaacaggtattttgtttctt

SEQ ID NO: 4668526 - DNA, 17 bp, Homo sapiens
ctgtaatcaggcaagga

SEQ ID NO: 4668527 - DNA, 19 bp, Homo sapiens
ctgtaatcaggcaaggagg

SEQ ID NO: 4668528 - DNA, 21 bp, Homo sapiens
ctgtaatcaggcaaggaggag

SEQ ID NO: 4668529 - DNA, 19 bp, Homo sapiens
ctgtaatgagtcagtgaag

SEQ ID NO: 4668530 - DNA, 18 bp, Homo sapiens
ctgtacattatgaagaat

SEQ ID NO: 4668531 - DNA, 19 bp, Homo sapiens
ctgtaccagcccagatgtt

SEQ ID NO: 4668532 - DNA, 20 bp, Homo sapiens
ctgtaccgtcgacaagaatg

SEQ ID NO: 4668533 - DNA, 22 bp, Homo sapiens
ctgtaccgtcgacaagaatgtc

SEQ ID NO: 4668534 - DNA, 23 bp, Homo sapiens
ctgtactattgcagacctgtcac

SEQ ID NO: 4668535 - DNA, 19 bp, Homo sapiens
ctgtagaaaagggaactga

SEQ ID NO: 4668536 - DNA, 20 bp, Homo sapiens
ctgtagaatagcctgtggcc

SEQ ID NO: 4668537 - DNA, 21 bp, Homo sapiens
ctgtagaatagcctgtggcct

SEQ ID NO: 4668538 - DNA, 15 bp, Homo sapiens
ctgtagacactctga

SEQ ID NO: 4668539 - DNA, 14 bp, Homo sapiens
ctgtagcttctctt

SEQ ID NO: 4668540 - DNA, 20 bp, Homo sapiens
ctgtagtgagatagcattgt

SEQ ID NO: 4668541 - DNA, 20 bp, Homo sapiens
ctgtagttgcgtggactctg

SEQ ID NO: 4668542 - DNA, 19 bp, Homo sapiens
ctgtatactgaaggtctga

SEQ ID NO: 4668543 - DNA, 16 bp, Homo sapiens
ctgtatcactctgtgt

SEQ ID NO: 4668544 - DNA, 17 bp, Homo sapiens
ctgtatgacccctggcc

SEQ ID NO: 4668545 - DNA, 14 bp, Homo sapiens
ctgtatgccttctg

SEQ ID NO: 4668546 - DNA, 15 bp, Homo sapiens
ctgtatgccttctgt

SEQ ID NO: 4668547 - DNA, 16 bp, Homo sapiens
ctgtatgccttctgta

SEQ ID NO: 4668548 - DNA, 17 bp, Homo sapiens
ctgtatgccttctgtat

SEQ ID NO: 4668549 - DNA, 20 bp, Homo sapiens
ctgtatggctgtatttgctg

SEQ ID NO: 4668550 - DNA, 20 bp, Homo sapiens
ctgtattactgaataatatc

SEQ ID NO: 4668551 - DNA, 16 bp, Homo sapiens
ctgtatttgctgttga

SEQ ID NO: 4668552 - DNA, 17 bp, Homo sapiens
ctgtatttgttcccaag

SEQ ID NO: 4668553 - DNA, 14 bp, Homo sapiens
ctgtattttgagtt

SEQ ID NO: 4668554 - DNA, 14 bp, Homo sapiens
ctgtcaccctgcag

SEQ ID NO: 4668555 - DNA, 18 bp, Homo sapiens
ctgtcacttcttcacctc

SEQ ID NO: 4668556 - DNA, 13 bp, Homo sapiens
ctgtcagtcacag

SEQ ID NO: 4668557 - DNA, 18 bp, Homo sapiens
ctgtcagtgttaaagatt

SEQ ID NO: 4668558 - DNA, 16 bp, Homo sapiens
ctgtcattcagaaaaa

SEQ ID NO: 4668559 - DNA, 16 bp, Homo sapiens
ctgtccaagacagggc

SEQ ID NO: 4668560 - DNA, 13 bp, Homo sapiens
ctgtccccactgc

SEQ ID NO: 4668561 - DNA, 15 bp, Homo sapiens
ctgtccccactgccc

SEQ ID NO: 4668562 - DNA, 21 bp, Homo sapiens
ctgtccccatctaggtcctgg

SEQ ID NO: 4668563 - DNA, 17 bp, Homo sapiens
ctgtccctctagtgcct

SEQ ID NO: 4668564 - DNA, 19 bp, Homo sapiens
ctgtccctctagtgccttc

SEQ ID NO: 4668565 - DNA, 12 bp, Homo sapiens
ctgtccctgcag

SEQ ID NO: 4668566 - DNA, 14 bp, Homo sapiens
ctgtccctgcaggg

SEQ ID NO: 4668567 - DNA, 18 bp, Homo sapiens
ctgtcctagccaggtctc

SEQ ID NO: 4668568 - DNA, 15 bp, Homo sapiens
ctgtcctcttctgca

SEQ ID NO: 4668569 - DNA, 16 bp, Homo sapiens
ctgtcctgcagcaaac

SEQ ID NO: 4668570 - DNA, 23 bp, Homo sapiens
ctgtcctgcagcaaacactccac

SEQ ID NO: 4668571 - DNA, 13 bp, Homo sapiens
ctgtctcagggtg

SEQ ID NO: 4668572 - DNA, 13 bp, Homo sapiens
ctgtctcctagga

SEQ ID NO: 4668573 - DNA, 15 bp, Homo sapiens
ctgtctcgagcgccc

SEQ ID NO: 4668574 - DNA, 17 bp, Homo sapiens
ctgtctcgagcgccctg

SEQ ID NO: 4668575 - DNA, 16 bp, Homo sapiens
ctgtctctctcttctc

SEQ ID NO: 4668576 - DNA, 22 bp, Homo sapiens
ctgtctctctcttctctctagg

SEQ ID NO: 4668577 - DNA, 19 bp, Homo sapiens
ctgtctctggctactccct

SEQ ID NO: 4668578 - DNA, 21 bp, Homo sapiens
ctgtctctggctactccctgg

SEQ ID NO: 4668579 - DNA, 15 bp, Homo sapiens
ctgtctcttccatgc

SEQ ID NO: 4668580 - DNA, 20 bp, Homo sapiens
ctgtctcttcggcagggagg

SEQ ID NO: 4668581 - DNA, 14 bp, Homo sapiens
ctgtctgaagccca

SEQ ID NO: 4668582 - DNA, 16 bp, Homo sapiens
ctgtctgaagcccaaa

SEQ ID NO: 4668583 - DNA, 15 bp, Homo sapiens
ctgtctgctctgcat

SEQ ID NO: 4668584 - DNA, 16 bp, Homo sapiens
ctgtctgttacactgg

SEQ ID NO: 4668585 - DNA, 17 bp, Homo sapiens
ctgtcttcacctgattc

SEQ ID NO: 4668586 - DNA, 22 bp, Homo sapiens
ctgtcttcacctgattcaacta

SEQ ID NO: 4668587 - DNA, 14 bp, Homo sapiens
ctgtcttggggcca

SEQ ID NO: 4668588 - DNA, 20 bp, Homo sapiens
ctgtctttgcggggcctgtc

SEQ ID NO: 4668589 - DNA, 14 bp, Homo sapiens
ctgtgaacagcttg

SEQ ID NO: 4668590 - DNA, 18 bp, Homo sapiens
ctgtgaacagcttgctgt

SEQ ID NO: 4668591 - DNA, 21 bp, Homo sapiens
ctgtgaacagcttgctgtcac

SEQ ID NO: 4668592 - DNA, 15 bp, Homo sapiens
ctgtgaacccaggac

SEQ ID NO: 4668593 - DNA, 19 bp, Homo sapiens
ctgtgaacccaggacaagc

SEQ ID NO: 4668594 - DNA, 17 bp, Homo sapiens
ctgtgaacttgactggg

SEQ ID NO: 4668595 - DNA, 19 bp, Homo sapiens
ctgtgaacttgactgggtg

SEQ ID NO: 4668596 - DNA, 22 bp, Homo sapiens
ctgtgacacttatctcactgtt

SEQ ID NO: 4668597 - DNA, 14 bp, Homo sapiens
ctgtgacagtgaaa

SEQ ID NO: 4668598 - DNA, 16 bp, Homo sapiens
ctgtgacccccagctc

SEQ ID NO: 4668599 - DNA, 16 bp, Homo sapiens
ctgtgacccctccttg

SEQ ID NO: 4668600 - DNA, 15 bp, Homo sapiens
ctgtgacctgctgag

SEQ ID NO: 4668601 - DNA, 16 bp, Homo sapiens
ctgtgacctgctgagc

SEQ ID NO: 4668602 - DNA, 19 bp, Homo sapiens
ctgtgacctgctgagctct

SEQ ID NO: 4668603 - DNA, 21 bp, Homo sapiens
ctgtgacctgctgagctctga

SEQ ID NO: 4668604 - DNA, 19 bp, Homo sapiens
ctgtgagacagtgggaaat

SEQ ID NO: 4668605 - DNA, 22 bp, Homo sapiens
ctgtgaggccatacttgtgaaa

SEQ ID NO: 4668606 - DNA, 23 bp, Homo sapiens
ctgtgatcaatatttttatatca

SEQ ID NO: 4668607 - DNA, 18 bp, Homo sapiens
ctgtgcacaaagtggcat

SEQ ID NO: 4668608 - DNA, 19 bp, Homo sapiens
ctgtgcacaaagtggcata

SEQ ID NO: 4668609 - DNA, 14 bp, Homo sapiens
ctgtgcacttagcc

SEQ ID NO: 4668610 - DNA, 15 bp, Homo sapiens
ctgtgcacttagcca

SEQ ID NO: 4668611 - DNA, 22 bp, Homo sapiens
ctgtgccaatacagacaaagca

SEQ ID NO: 4668612 - DNA, 15 bp, Homo sapiens
ctgtgccagagcctg

SEQ ID NO: 4668613 - DNA, 21 bp, Homo sapiens
ctgtgcctgattattttagct

SEQ ID NO: 4668614 - DNA, 14 bp, Homo sapiens
ctgtgcgtcccagc

SEQ ID NO: 4668615 - DNA, 17 bp, Homo sapiens
ctgtgcgtcccagctga

SEQ ID NO: 4668616 - DNA, 23 bp, Homo sapiens
ctgtgcgtcccagctgaaggcag

SEQ ID NO: 4668617 - DNA, 13 bp, Homo sapiens
ctgtgctacgtgt

SEQ ID NO: 4668618 - DNA, 14 bp, Homo sapiens
ctgtgctacgtgtg

SEQ ID NO: 4668619 - DNA, 18 bp, Homo sapiens
ctgtgctacgtgtgaaat

SEQ ID NO: 4668620 - DNA, 19 bp, Homo sapiens
ctgtgctacgtgtgaaatc

SEQ ID NO: 4668621 - DNA, 21 bp, Homo sapiens
ctgtgctacgtgtgaaatctg

SEQ ID NO: 4668622 - DNA, 14 bp, Homo sapiens
ctgtgctagaagct

SEQ ID NO: 4668623 - DNA, 23 bp, Homo sapiens
ctgtgctgggggaatgagcccag

SEQ ID NO: 4668624 - DNA, 11 bp, Homo sapiens
ctgtggagctg

SEQ ID NO: 4668625 - DNA, 23 bp, Homo sapiens
ctgtggagctgccacagagaagt

SEQ ID NO: 4668626 - DNA, 23 bp, Homo sapiens
ctgtggctccctctctcctggac

SEQ ID NO: 4668627 - DNA, 20 bp, Homo sapiens
ctgtgggactcatccttgcc

SEQ ID NO: 4668628 - DNA, 21 bp, Homo sapiens
ctgtgggactcatccttgccc

SEQ ID NO: 4668629 - DNA, 14 bp, Homo sapiens
ctgtgggagcctcg

SEQ ID NO: 4668630 - DNA, 15 bp, Homo sapiens
ctgtgggcttcccca

SEQ ID NO: 4668631 - DNA, 16 bp, Homo sapiens
ctgtggggtggacctg

SEQ ID NO: 4668632 - DNA, 18 bp, Homo sapiens
ctgtgggtctctgaaggg

SEQ ID NO: 4668633 - DNA, 20 bp, Homo sapiens
ctgtgggtctctgaagggac

SEQ ID NO: 4668634 - DNA, 16 bp, Homo sapiens
ctgtggttttattaca

SEQ ID NO: 4668635 - DNA, 20 bp, Homo sapiens
ctgtggttttattacaaatg

SEQ ID NO: 4668636 - DNA, 21 bp, Homo sapiens
ctgtgtaactttctcttaaga

SEQ ID NO: 4668637 - DNA, 17 bp, Homo sapiens
ctgtgtacatgtgtgca

SEQ ID NO: 4668638 - DNA, 19 bp, Homo sapiens
ctgtgtagctgtgacctgc

SEQ ID NO: 4668639 - DNA, 23 bp, Homo sapiens
ctgtgtagctgtgacctgctgag

SEQ ID NO: 4668640 - DNA, 17 bp, Homo sapiens
ctgtgtagttccctctg

SEQ ID NO: 4668641 - DNA, 15 bp, Homo sapiens
ctgtgtccctctctc

SEQ ID NO: 4668642 - DNA, 19 bp, Homo sapiens
ctgtgtccctctctctgga

SEQ ID NO: 4668643 - DNA, 20 bp, Homo sapiens
ctgtgtccctctctctggaa

SEQ ID NO: 4668644 - DNA, 19 bp, Homo sapiens
ctgtgtctaggcaggcaag

SEQ ID NO: 4668645 - DNA, 17 bp, Homo sapiens
ctgtgtctgaatcatgt

SEQ ID NO: 4668646 - DNA, 19 bp, Homo sapiens
ctgtgtctgaatcatgtct

SEQ ID NO: 4668647 - DNA, 18 bp, Homo sapiens
ctgtgtctgagtggcttc

SEQ ID NO: 4668648 - DNA, 21 bp, Homo sapiens
ctgtgtggcccagttctgaaa

SEQ ID NO: 4668649 - DNA, 19 bp, Homo sapiens
ctgtgtggtgcattcctga

SEQ ID NO: 4668650 - DNA, 12 bp, Homo sapiens
ctgtgtgtctgt

SEQ ID NO: 4668651 - DNA, 22 bp, Homo sapiens
ctgtgttactgctttgcaaaga

SEQ ID NO: 4668652 - DNA, 15 bp, Homo sapiens
ctgtgttatgaaaat

SEQ ID NO: 4668653 - DNA, 17 bp, Homo sapiens
ctgtgttctaacttatt

SEQ ID NO: 4668654 - DNA, 22 bp, Homo sapiens
ctgtgttctttccccaggggca

SEQ ID NO: 4668655 - DNA, 23 bp, Homo sapiens
ctgtgttgccacagtagaactgt

SEQ ID NO: 4668656 - DNA, 16 bp, Homo sapiens
ctgtgtttcattactt

SEQ ID NO: 4668657 - DNA, 15 bp, Homo sapiens
ctgtgtttgcagcct

SEQ ID NO: 4668658 - DNA, 23 bp, Homo sapiens
ctgtgtttgcagcctgctctagt

SEQ ID NO: 4668659 - DNA, 15 bp, Homo sapiens
ctgtgtttttgaaat

SEQ ID NO: 4668660 - DNA, 17 bp, Homo sapiens
ctgttacagactgaaag

SEQ ID NO: 4668661 - DNA, 18 bp, Homo sapiens
ctgttacagactgaaagg

SEQ ID NO: 4668662 - DNA, 22 bp, Homo sapiens
ctgttagctttccaaggaagca

SEQ ID NO: 4668663 - DNA, 15 bp, Homo sapiens
ctgttcacagctttt

SEQ ID NO: 4668664 - DNA, 19 bp, Homo sapiens
ctgttcacagcttttcttg

SEQ ID NO: 4668665 - DNA, 21 bp, Homo sapiens
ctgttcacagcttttcttgat

SEQ ID NO: 4668666 - DNA, 22 bp, Homo sapiens
ctgttcagctactcccactccc

SEQ ID NO: 4668667 - DNA, 21 bp, Homo sapiens
ctgttcatacactaaccaaat

SEQ ID NO: 4668668 - DNA, 15 bp, Homo sapiens
ctgttccctatggag

SEQ ID NO: 4668669 - DNA, 23 bp, Homo sapiens
ctgttccctatggagaggcttcc

SEQ ID NO: 4668670 - DNA, 13 bp, Homo sapiens
ctgttcctttttg

SEQ ID NO: 4668671 - DNA, 16 bp, Homo sapiens
ctgttcctttttgtaa

SEQ ID NO: 4668672 - DNA, 18 bp, Homo sapiens
ctgttcctttttgtaaat

SEQ ID NO: 4668673 - DNA, 21 bp, Homo sapiens
ctgttcttagagtgtagctgt

SEQ ID NO: 4668674 - DNA, 23 bp, Homo sapiens
ctgttcttagagtgtagctgtaa

SEQ ID NO: 4668675 - DNA, 12 bp, Homo sapiens
ctgttcttgaag

SEQ ID NO: 4668676 - DNA, 18 bp, Homo sapiens
ctgttcttgggcctcagg

SEQ ID NO: 4668677 - DNA, 21 bp, Homo sapiens
ctgttgaaacttacactgttt

SEQ ID NO: 4668678 - DNA, 23 bp, Homo sapiens
ctgttgaaacttacactgtttca

SEQ ID NO: 4668679 - DNA, 12 bp, Homo sapiens
ctgttgcctcct

SEQ ID NO: 4668680 - DNA, 21 bp, Homo sapiens
ctgttgcctcctctctccctg

SEQ ID NO: 4668681 - DNA, 22 bp, Homo sapiens
ctgttgcctttttcattttcca

SEQ ID NO: 4668682 - DNA, 23 bp, Homo sapiens
ctgttgctatagagcctacctgt

SEQ ID NO: 4668683 - DNA, 14 bp, Homo sapiens
ctgttggagcaaac

SEQ ID NO: 4668684 - DNA, 9 bp, Homo sapiens
ctgttgttt

SEQ ID NO: 4668685 - DNA, 22 bp, Homo sapiens
ctgtttacatccagagttctgt

SEQ ID NO: 4668686 - DNA, 20 bp, Homo sapiens
ctgtttcatagttttctaaa

SEQ ID NO: 4668687 - DNA, 16 bp, Homo sapiens
ctgtttcatctcagct

SEQ ID NO: 4668688 - DNA, 13 bp, Homo sapiens
ctgtttcccaagc

SEQ ID NO: 4668689 - DNA, 17 bp, Homo sapiens
ctgtttccctgctgaat

SEQ ID NO: 4668690 - DNA, 20 bp, Homo sapiens
ctgtttccctgctgaatgcc

SEQ ID NO: 4668691 - DNA, 13 bp, Homo sapiens
ctgtttcctggcc

SEQ ID NO: 4668692 - DNA, 19 bp, Homo sapiens
ctgtttcctggcctcagag

SEQ ID NO: 4668693 - DNA, 20 bp, Homo sapiens
ctgtttcctggcctcagagc

SEQ ID NO: 4668694 - DNA, 22 bp, Homo sapiens
ctgtttcctggcctcagagctt

SEQ ID NO: 4668695 - DNA, 16 bp, Homo sapiens
ctgtttctaagaaaat

SEQ ID NO: 4668696 - DNA, 21 bp, Homo sapiens
ctgtttctgtcaagctggtgc

SEQ ID NO: 4668697 - DNA, 23 bp, Homo sapiens
ctgttttaaaatgtgaggcaata

SEQ ID NO: 4668698 - DNA, 16 bp, Homo sapiens
ctgttttattactgtt

SEQ ID NO: 4668699 - DNA, 17 bp, Homo sapiens
ctgttttattactgttt

SEQ ID NO: 4668700 - DNA, 22 bp, Homo sapiens
ctgttttattactgtttctaaa

SEQ ID NO: 4668701 - DNA, 21 bp, Homo sapiens
ctgttttgtaaagtccccaga

SEQ ID NO: 4668702 - DNA, 18 bp, Homo sapiens
ctgttttgttaatgctct

SEQ ID NO: 4668703 - DNA, 12 bp, Homo sapiens
cttaaaacttta

SEQ ID NO: 4668704 - DNA, 13 bp, Homo sapiens
cttaaaggacata

SEQ ID NO: 4668705 - DNA, 15 bp, Homo sapiens
cttaaaggacataaa

SEQ ID NO: 4668706 - DNA, 21 bp, Homo sapiens
cttaaagggaatcatttttgt

SEQ ID NO: 4668707 - DNA, 16 bp, Homo sapiens
cttaaatattgtaata

SEQ ID NO: 4668708 - DNA, 20 bp, Homo sapiens
cttaacctgggaccaacctg

SEQ ID NO: 4668709 - DNA, 17 bp, Homo sapiens
cttaactatcaccagtg

SEQ ID NO: 4668710 - DNA, 19 bp, Homo sapiens
cttaactatcaccagtgca

SEQ ID NO: 4668711 - DNA, 20 bp, Homo sapiens
cttaactatcaccagtgcat

SEQ ID NO: 4668712 - DNA, 18 bp, Homo sapiens
cttaactggcctaaattt

SEQ ID NO: 4668713 - DNA, 13 bp, Homo sapiens
cttaactttataa

SEQ ID NO: 4668714 - DNA, 16 bp, Homo sapiens
cttaagctcccctgcc

SEQ ID NO: 4668715 - DNA, 17 bp, Homo sapiens
cttaagctcccctgcct

SEQ ID NO: 4668716 - DNA, 21 bp, Homo sapiens
cttaatacctgggtgattaca

SEQ ID NO: 4668717 - DNA, 12 bp, Homo sapiens
cttaatctttat

SEQ ID NO: 4668718 - DNA, 17 bp, Homo sapiens
cttaatctttattttat

SEQ ID NO: 4668719 - DNA, 13 bp, Homo sapiens
cttaatttgtaaa

SEQ ID NO: 4668720 - DNA, 19 bp, Homo sapiens
cttaatttgtaaacttctg

SEQ ID NO: 4668721 - DNA, 23 bp, Homo sapiens
cttaatttgtaaacttctgaaga

SEQ ID NO: 4668722 - DNA, 12 bp, Homo sapiens
cttacactcccc

SEQ ID NO: 4668723 - DNA, 14 bp, Homo sapiens
cttacactgtttca

SEQ ID NO: 4668724 - DNA, 18 bp, Homo sapiens
cttacactgtttcatctc

SEQ ID NO: 4668725 - DNA, 21 bp, Homo sapiens
cttacactgtttcatctcagc

SEQ ID NO: 4668726 - DNA, 22 bp, Homo sapiens
cttacactgtttcatctcagct

SEQ ID NO: 4668727 - DNA, 16 bp, Homo sapiens
cttacagcctctgact

SEQ ID NO: 4668728 - DNA, 15 bp, Homo sapiens
cttacattcagaaat

SEQ ID NO: 4668729 - DNA, 17 bp, Homo sapiens
cttaccaagttgtgctt

SEQ ID NO: 4668730 - DNA, 23 bp, Homo sapiens
cttaccaagttgtgcttttctgt

SEQ ID NO: 4668731 - DNA, 20 bp, Homo sapiens
cttaccgtgggcactgaagg

SEQ ID NO: 4668732 - DNA, 20 bp, Homo sapiens
cttacctgtctctctcttct

SEQ ID NO: 4668733 - DNA, 14 bp, Homo sapiens
cttactactttaaa

SEQ ID NO: 4668734 - DNA, 13 bp, Homo sapiens
cttactcctgtgg

SEQ ID NO: 4668735 - DNA, 14 bp, Homo sapiens
cttactcctgtggg

SEQ ID NO: 4668736 - DNA, 20 bp, Homo sapiens
cttactcctgtgggagcctc

SEQ ID NO: 4668737 - DNA, 18 bp, Homo sapiens
cttactgcctgaccttgg

SEQ ID NO: 4668738 - DNA, 13 bp, Homo sapiens
cttacttgtcctt

SEQ ID NO: 4668739 - DNA, 14 bp, Homo sapiens
cttactttcctgtg

SEQ ID NO: 4668740 - DNA, 11 bp, Homo sapiens
cttagaaactg

SEQ ID NO: 4668741 - DNA, 17 bp, Homo sapiens
cttagacctgccagcca

SEQ ID NO: 4668742 - DNA, 18 bp, Homo sapiens
cttagacctgccagccac

SEQ ID NO: 4668743 - DNA, 14 bp, Homo sapiens
cttagactcgccta

SEQ ID NO: 4668744 - DNA, 17 bp, Homo sapiens
cttagactcgcctatct

SEQ ID NO: 4668745 - DNA, 20 bp, Homo sapiens
cttagagattttcattttag

SEQ ID NO: 4668746 - DNA, 19 bp, Homo sapiens
cttagaggttctgcctcta

SEQ ID NO: 4668747 - DNA, 17 bp, Homo sapiens
cttagagtgtagctgta

SEQ ID NO: 4668748 - DNA, 22 bp, Homo sapiens
cttagatggagaagttgtgaaa

SEQ ID NO: 4668749 - DNA, 12 bp, Homo sapiens
cttagcatggta

SEQ ID NO: 4668750 - DNA, 15 bp, Homo sapiens
cttagctttgaaact

SEQ ID NO: 4668751 - DNA, 17 bp, Homo sapiens
cttagggcactgggctg

SEQ ID NO: 4668752 - DNA, 13 bp, Homo sapiens
cttaggtcttcct

SEQ ID NO: 4668753 - DNA, 14 bp, Homo sapiens
cttaggtcttcctg

SEQ ID NO: 4668754 - DNA, 17 bp, Homo sapiens
cttaggtcttcctgtgg

SEQ ID NO: 4668755 - DNA, 19 bp, Homo sapiens
cttaggtcttcctgtggct

SEQ ID NO: 4668756 - DNA, 21 bp, Homo sapiens
cttaggtcttcctgtggctcc

SEQ ID NO: 4668757 - DNA, 22 bp, Homo sapiens
cttaggtcttcctgtggctccc

SEQ ID NO: 4668758 - DNA, 13 bp, Homo sapiens
cttagtgggccag

SEQ ID NO: 4668759 - DNA, 18 bp, Homo sapiens
cttagtgggccagggctg

SEQ ID NO: 4668760 - DNA, 21 bp, Homo sapiens
cttataaaaataaagggaaga

SEQ ID NO: 4668761 - DNA, 17 bp, Homo sapiens
cttataaacagataatg

SEQ ID NO: 4668762 - DNA, 14 bp, Homo sapiens
cttatacccatgaa

SEQ ID NO: 4668763 - DNA, 14 bp, Homo sapiens
cttatagttaatat

SEQ ID NO: 4668764 - DNA, 13 bp, Homo sapiens
cttatatgccaag

SEQ ID NO: 4668765 - DNA, 21 bp, Homo sapiens
cttatcactgcattattctct

SEQ ID NO: 4668766 - DNA, 12 bp, Homo sapiens
cttatccctctc

SEQ ID NO: 4668767 - DNA, 13 bp, Homo sapiens
cttatcctagcct

SEQ ID NO: 4668768 - DNA, 14 bp, Homo sapiens
cttatcctagcctt

SEQ ID NO: 4668769 - DNA, 21 bp, Homo sapiens
cttatctcgaatttgaagaga

SEQ ID NO: 4668770 - DNA, 14 bp, Homo sapiens
cttatgcaaaatgg

SEQ ID NO: 4668771 - DNA, 16 bp, Homo sapiens
cttatgtgaaaaatta

SEQ ID NO: 4668772 - DNA, 21 bp, Homo sapiens
cttatgtgaaaaattaacttt

SEQ ID NO: 4668773 - DNA, 16 bp, Homo sapiens
cttattccaggagaag

SEQ ID NO: 4668774 - DNA, 23 bp, Homo sapiens
cttattgaaaaaaaaaatgttga

SEQ ID NO: 4668775 - DNA, 13 bp, Homo sapiens
cttattgccaaaa

SEQ ID NO: 4668776 - DNA, 21 bp, Homo sapiens
cttattggaaatgtacttttg

SEQ ID NO: 4668777 - DNA, 17 bp, Homo sapiens
cttattgggatatcatt

SEQ ID NO: 4668778 - DNA, 20 bp, Homo sapiens
cttattgggatatcatttta

SEQ ID NO: 4668779 - DNA, 21 bp, Homo sapiens
cttatttatagaatttaatat

SEQ ID NO: 4668780 - DNA, 17 bp, Homo sapiens
cttatttctatgacaaa

SEQ ID NO: 4668781 - DNA, 22 bp, Homo sapiens
cttcaacaacgtgagagaaaga

SEQ ID NO: 4668782 - DNA, 19 bp, Homo sapiens
cttcaagacgaggggcagg

SEQ ID NO: 4668783 - DNA, 18 bp, Homo sapiens
cttcaaggaggcccactg

SEQ ID NO: 4668784 - DNA, 22 bp, Homo sapiens
cttcaatttgtagactcttgct

SEQ ID NO: 4668785 - DNA, 13 bp, Homo sapiens
cttcacacacaga

SEQ ID NO: 4668786 - DNA, 18 bp, Homo sapiens
cttcacctgattcaacta

SEQ ID NO: 4668787 - DNA, 13 bp, Homo sapiens
cttcactcctgct

SEQ ID NO: 4668788 - DNA, 18 bp, Homo sapiens
cttcactctccagggtac

SEQ ID NO: 4668789 - DNA, 22 bp, Homo sapiens
cttcactctctccgtctgtttt

SEQ ID NO: 4668790 - DNA, 21 bp, Homo sapiens
cttcagcccccaccaggggaa

SEQ ID NO: 4668791 - DNA, 22 bp, Homo sapiens
cttcaggaagcataaagcaatt

SEQ ID NO: 4668792 - DNA, 16 bp, Homo sapiens
cttcagtattttctcc

SEQ ID NO: 4668793 - DNA, 18 bp, Homo sapiens
cttcagtattttctccac

SEQ ID NO: 4668794 - DNA, 22 bp, Homo sapiens
cttcagtattttctccacttca

SEQ ID NO: 4668795 - DNA, 21 bp, Homo sapiens
cttcagttctgcttgctccca

SEQ ID NO: 4668796 - DNA, 18 bp, Homo sapiens
cttcataagatattcttt

SEQ ID NO: 4668797 - DNA, 22 bp, Homo sapiens
cttcataagatattctttacaa

SEQ ID NO: 4668798 - DNA, 13 bp, Homo sapiens
cttcatataaact

SEQ ID NO: 4668799 - DNA, 13 bp, Homo sapiens
cttcatctcccac

SEQ ID NO: 4668800 - DNA, 23 bp, Homo sapiens
cttcatggcatcttcaatatgaa

SEQ ID NO: 4668801 - DNA, 17 bp, Homo sapiens
cttcattattcaagaat

SEQ ID NO: 4668802 - DNA, 17 bp, Homo sapiens
cttcattccttccacta

SEQ ID NO: 4668803 - DNA, 13 bp, Homo sapiens
cttcatttcaatc

SEQ ID NO: 4668804 - DNA, 14 bp, Homo sapiens
cttcatttcaatca

SEQ ID NO: 4668805 - DNA, 18 bp, Homo sapiens
cttccaagaccatttgta

SEQ ID NO: 4668806 - DNA, 15 bp, Homo sapiens
cttccaagtccttta

SEQ ID NO: 4668807 - DNA, 20 bp, Homo sapiens
cttccaatagttagatctac

SEQ ID NO: 4668808 - DNA, 23 bp, Homo sapiens
cttccaccaagttggaacatcct

SEQ ID NO: 4668809 - DNA, 17 bp, Homo sapiens
cttccacctcaccccac

SEQ ID NO: 4668810 - DNA, 14 bp, Homo sapiens
cttccacctccagc

SEQ ID NO: 4668811 - DNA, 16 bp, Homo sapiens
cttccacctccagcct

SEQ ID NO: 4668812 - DNA, 20 bp, Homo sapiens
cttccacctccagcctctgg

SEQ ID NO: 4668813 - DNA, 17 bp, Homo sapiens
cttccactccttctctc

SEQ ID NO: 4668814 - DNA, 22 bp, Homo sapiens
cttccagcctttttagggcaga

SEQ ID NO: 4668815 - DNA, 18 bp, Homo sapiens
cttccaggtggcccttcc

SEQ ID NO: 4668816 - DNA, 22 bp, Homo sapiens
cttccatagcctaatccctggg

SEQ ID NO: 4668817 - DNA, 23 bp, Homo sapiens
cttccatgctcccaactcccttc

SEQ ID NO: 4668818 - DNA, 16 bp, Homo sapiens
cttccatggccctcat

SEQ ID NO: 4668819 - DNA, 19 bp, Homo sapiens
cttccatggccctcattaa

SEQ ID NO: 4668820 - DNA, 21 bp, Homo sapiens
cttccattccatctagttttt

SEQ ID NO: 4668821 - DNA, 19 bp, Homo sapiens
cttccattttcccccacta

SEQ ID NO: 4668822 - DNA, 18 bp, Homo sapiens
cttcccaaacccagtctc

SEQ ID NO: 4668823 - DNA, 19 bp, Homo sapiens
cttcccagaatgttactga

SEQ ID NO: 4668824 - DNA, 18 bp, Homo sapiens
cttcccaggttcaagcga

SEQ ID NO: 4668825 - DNA, 14 bp, Homo sapiens
cttccccaaaggaa

SEQ ID NO: 4668826 - DNA, 23 bp, Homo sapiens
cttccccaacgaaaagcacatcc

SEQ ID NO: 4668827 - DNA, 13 bp, Homo sapiens
cttccccaagatc

SEQ ID NO: 4668828 - DNA, 20 bp, Homo sapiens
cttccccaagatctgccaga

SEQ ID NO: 4668829 - DNA, 15 bp, Homo sapiens
cttccccagctcccc

SEQ ID NO: 4668830 - DNA, 18 bp, Homo sapiens
cttccccagctcccccag

SEQ ID NO: 4668831 - DNA, 20 bp, Homo sapiens
cttccccagctcccccaggc

SEQ ID NO: 4668832 - DNA, 18 bp, Homo sapiens
cttccccatgaaccctgc

SEQ ID NO: 4668833 - DNA, 22 bp, Homo sapiens
cttccccatgaaccctgccctg

SEQ ID NO: 4668834 - DNA, 19 bp, Homo sapiens
cttcccccagcaaggcaga

SEQ ID NO: 4668835 - DNA, 14 bp, Homo sapiens
cttcccccagccca

SEQ ID NO: 4668836 - DNA, 20 bp, Homo sapiens
cttccccctttctctgcctg

SEQ ID NO: 4668837 - DNA, 21 bp, Homo sapiens
cttccccctttctctgcctgg

SEQ ID NO: 4668838 - DNA, 23 bp, Homo sapiens
cttccccctttctctgcctggca

SEQ ID NO: 4668839 - DNA, 19 bp, Homo sapiens
cttcccggcacacattcca

SEQ ID NO: 4668840 - DNA, 13 bp, Homo sapiens
cttccctatagga

SEQ ID NO: 4668841 - DNA, 21 bp, Homo sapiens
cttccctataggaacagccca

SEQ ID NO: 4668842 - DNA, 14 bp, Homo sapiens
cttccctctgcatt

SEQ ID NO: 4668843 - DNA, 13 bp, Homo sapiens
cttcccttcctca

SEQ ID NO: 4668844 - DNA, 12 bp, Homo sapiens
cttcccttgctc

SEQ ID NO: 4668845 - DNA, 21 bp, Homo sapiens
cttcccttgctcatgagctcc

SEQ ID NO: 4668846 - DNA, 17 bp, Homo sapiens
cttccgcaccctcccta

SEQ ID NO: 4668847 - DNA, 21 bp, Homo sapiens
cttccgctgaggggtctcgga

SEQ ID NO: 4668848 - DNA, 22 bp, Homo sapiens
cttccgctgaggggtctcggat

SEQ ID NO: 4668849 - DNA, 14 bp, Homo sapiens
cttccgttcctccc

SEQ ID NO: 4668850 - DNA, 22 bp, Homo sapiens
cttcctagtaagtcaggacagc

SEQ ID NO: 4668851 - DNA, 14 bp, Homo sapiens
cttcctctccaccc

SEQ ID NO: 4668852 - DNA, 15 bp, Homo sapiens
cttcctcttcctgcc

SEQ ID NO: 4668853 - DNA, 17 bp, Homo sapiens
cttcctcttcctgccct

SEQ ID NO: 4668854 - DNA, 19 bp, Homo sapiens
cttcctcttcctgcccttg

SEQ ID NO: 4668855 - DNA, 14 bp, Homo sapiens
cttcctcttcttgt

SEQ ID NO: 4668856 - DNA, 15 bp, Homo sapiens
cttcctcttcttgtt

SEQ ID NO: 4668857 - DNA, 21 bp, Homo sapiens
cttcctgcaggcaggaacaaa

SEQ ID NO: 4668858 - DNA, 21 bp, Homo sapiens
cttcctgccccaactccttcc

SEQ ID NO: 4668859 - DNA, 13 bp, Homo sapiens
cttcctggacagc

SEQ ID NO: 4668860 - DNA, 14 bp, Homo sapiens
cttcctggacagct

SEQ ID NO: 4668861 - DNA, 20 bp, Homo sapiens
cttcctggacagctgtgcct

SEQ ID NO: 4668862 - DNA, 22 bp, Homo sapiens
cttcctggacagctgtgcctcg

SEQ ID NO: 4668863 - DNA, 12 bp, Homo sapiens
cttcctggggac

SEQ ID NO: 4668864 - DNA, 14 bp, Homo sapiens
cttcctggggacca

SEQ ID NO: 4668865 - DNA, 17 bp, Homo sapiens
cttcctgtggctccctc

SEQ ID NO: 4668866 - DNA, 18 bp, Homo sapiens
cttcctgtggctccctct

SEQ ID NO: 4668867 - DNA, 18 bp, Homo sapiens
cttccttggttcatgctt

SEQ ID NO: 4668868 - DNA, 18 bp, Homo sapiens
cttcctttgcccttcctc

SEQ ID NO: 4668869 - DNA, 12 bp, Homo sapiens
cttcgcacacac

SEQ ID NO: 4668870 - DNA, 14 bp, Homo sapiens
cttcgctcttgagg

SEQ ID NO: 4668871 - DNA, 14 bp, Homo sapiens
cttcggcagggagg

SEQ ID NO: 4668872 - DNA, 13 bp, Homo sapiens
cttcgtgaacata

SEQ ID NO: 4668873 - DNA, 15 bp, Homo sapiens
cttctaaaatagcaa

SEQ ID NO: 4668874 - DNA, 19 bp, Homo sapiens
cttctaaaatagcaataac

SEQ ID NO: 4668875 - DNA, 18 bp, Homo sapiens
cttctaatttatattatc

SEQ ID NO: 4668876 - DNA, 20 bp, Homo sapiens
cttctaatttatattatcca

SEQ ID NO: 4668877 - DNA, 18 bp, Homo sapiens
cttctaggaatggaggag

SEQ ID NO: 4668878 - DNA, 23 bp, Homo sapiens
cttctaggaatggaggagccagg

SEQ ID NO: 4668879 - DNA, 23 bp, Homo sapiens
cttctatcagactcagttttttg

SEQ ID NO: 4668880 - DNA, 23 bp, Homo sapiens
cttctattaatcaagagaaactt

SEQ ID NO: 4668881 - DNA, 21 bp, Homo sapiens
cttctattctagcctgcattg

SEQ ID NO: 4668882 - DNA, 17 bp, Homo sapiens
cttctcaggacacaggc

SEQ ID NO: 4668883 - DNA, 18 bp, Homo sapiens
cttctcaggacacaggcc

SEQ ID NO: 4668884 - DNA, 17 bp, Homo sapiens
cttctcagtttctgcct

SEQ ID NO: 4668885 - DNA, 20 bp, Homo sapiens
cttctcagtttctgcctggg

SEQ ID NO: 4668886 - DNA, 22 bp, Homo sapiens
cttctcagtttctgcctgggca

SEQ ID NO: 4668887 - DNA, 18 bp, Homo sapiens
cttctccattccctagca

SEQ ID NO: 4668888 - DNA, 20 bp, Homo sapiens
cttctccattccctagcagg

SEQ ID NO: 4668889 - DNA, 17 bp, Homo sapiens
cttctcccacatgaggc

SEQ ID NO: 4668890 - DNA, 13 bp, Homo sapiens
cttctcctgatcc

SEQ ID NO: 4668891 - DNA, 18 bp, Homo sapiens
cttctcggggtgggacag

SEQ ID NO: 4668892 - DNA, 12 bp, Homo sapiens
cttctgaaatgt

SEQ ID NO: 4668893 - DNA, 12 bp, Homo sapiens
cttctgaagact

SEQ ID NO: 4668894 - DNA, 20 bp, Homo sapiens
cttctgaagactgagaactt

SEQ ID NO: 4668895 - DNA, 19 bp, Homo sapiens
cttctgcaaagtggcaggg

SEQ ID NO: 4668896 - DNA, 23 bp, Homo sapiens
cttctgcaaagtggcagggaccg

SEQ ID NO: 4668897 - DNA, 15 bp, Homo sapiens
cttctgcttgtccca

SEQ ID NO: 4668898 - DNA, 13 bp, Homo sapiens
cttctggccttgt

SEQ ID NO: 4668899 - DNA, 18 bp, Homo sapiens
cttctgtaggaattcttt

SEQ ID NO: 4668900 - DNA, 14 bp, Homo sapiens
cttctgtggaagta

SEQ ID NO: 4668901 - DNA, 15 bp, Homo sapiens
cttctgttgtcacct

SEQ ID NO: 4668902 - DNA, 21 bp, Homo sapiens
cttcttacttggaactgaagg

SEQ ID NO: 4668903 - DNA, 16 bp, Homo sapiens
cttcttgtcagacata

SEQ ID NO: 4668904 - DNA, 18 bp, Homo sapiens
cttcttgtcagacataaa

SEQ ID NO: 4668905 - DNA, 19 bp, Homo sapiens
cttcttgtcagacataaag

SEQ ID NO: 4668906 - DNA, 19 bp, Homo sapiens
cttgaaaaagtattgtttt

SEQ ID NO: 4668907 - DNA, 18 bp, Homo sapiens
cttgaaccccctccctgt

SEQ ID NO: 4668908 - DNA, 19 bp, Homo sapiens
cttgaaccccctccctgtc

SEQ ID NO: 4668909 - DNA, 24 bp, Homo sapiens
cttgaaccccctccctgtcccagg

SEQ ID NO: 4668910 - DNA, 22 bp, Homo sapiens
cttgaagaaacagagtggcctc

SEQ ID NO: 4668911 - DNA, 23 bp, Homo sapiens
cttgaagaaacagagtggcctcc

SEQ ID NO: 4668912 - DNA, 15 bp, Homo sapiens
cttgaagaaggaaag

SEQ ID NO: 4668913 - DNA, 16 bp, Homo sapiens
cttgaagaaggaaaga

SEQ ID NO: 4668914 - DNA, 12 bp, Homo sapiens
cttgaagcagta

SEQ ID NO: 4668915 - DNA, 16 bp, Homo sapiens
cttgaaggtacacccc

SEQ ID NO: 4668916 - DNA, 17 bp, Homo sapiens
cttgaaggtacacccca

SEQ ID NO: 4668917 - DNA, 20 bp, Homo sapiens
cttgaatgtggtctcaggat

SEQ ID NO: 4668918 - DNA, 13 bp, Homo sapiens
cttgacagactgt

SEQ ID NO: 4668919 - DNA, 14 bp, Homo sapiens
cttgacatgtagct

SEQ ID NO: 4668920 - DNA, 11 bp, Homo sapiens
cttgactgaag

SEQ ID NO: 4668921 - DNA, 18 bp, Homo sapiens
cttgactgaagcgaacat

SEQ ID NO: 4668922 - DNA, 21 bp, Homo sapiens
cttgactgaagcgaacatctt

SEQ ID NO: 4668923 - DNA, 22 bp, Homo sapiens
cttgactgaagcgaacatcttc

SEQ ID NO: 4668924 - DNA, 21 bp, Homo sapiens
cttgactgttagttgtccaca

SEQ ID NO: 4668925 - DNA, 19 bp, Homo sapiens
cttgactttgaactaatga

SEQ ID NO: 4668926 - DNA, 18 bp, Homo sapiens
cttgagccaggaggcctg

SEQ ID NO: 4668927 - DNA, 13 bp, Homo sapiens
cttgagctgtctg

SEQ ID NO: 4668928 - DNA, 15 bp, Homo sapiens
cttgatagatgtttg

SEQ ID NO: 4668929 - DNA, 15 bp, Homo sapiens
cttgatcggaaagct

SEQ ID NO: 4668930 - DNA, 15 bp, Homo sapiens
cttgcaaagccttta

SEQ ID NO: 4668931 - DNA, 17 bp, Homo sapiens
cttgcaaagcctttaaa

SEQ ID NO: 4668932 - DNA, 14 bp, Homo sapiens
cttgcccaccccac

SEQ ID NO: 4668933 - DNA, 22 bp, Homo sapiens
cttgcccaccccacccccaccc

SEQ ID NO: 4668934 - DNA, 22 bp, Homo sapiens
cttgcccaggtgagggaaggag

SEQ ID NO: 4668935 - DNA, 20 bp, Homo sapiens
cttgccctgtgttctttccc

SEQ ID NO: 4668936 - DNA, 23 bp, Homo sapiens
cttgcctccatctttttcttggg

SEQ ID NO: 4668937 - DNA, 14 bp, Homo sapiens
cttgcctctgcaca

SEQ ID NO: 4668938 - DNA, 24 bp, Homo sapiens
cttgcctctgcacaccctccagag

SEQ ID NO: 4668939 - DNA, 15 bp, Homo sapiens
cttgcctgaggggaa

SEQ ID NO: 4668940 - DNA, 14 bp, Homo sapiens
cttgctcattaatt

SEQ ID NO: 4668941 - DNA, 16 bp, Homo sapiens
cttgctcattaatttt

SEQ ID NO: 4668942 - DNA, 15 bp, Homo sapiens
cttgctcccaagccc

SEQ ID NO: 4668943 - DNA, 18 bp, Homo sapiens
cttgctcccaagcccctg

SEQ ID NO: 4668944 - DNA, 15 bp, Homo sapiens
cttgctccctgtgtc

SEQ ID NO: 4668945 - DNA, 12 bp, Homo sapiens
cttgctcctgct

SEQ ID NO: 4668946 - DNA, 13 bp, Homo sapiens
cttgctcttgggg

SEQ ID NO: 4668947 - DNA, 16 bp, Homo sapiens
cttgctcttggggaag

SEQ ID NO: 4668948 - DNA, 15 bp, Homo sapiens
cttgctgctttttct

SEQ ID NO: 4668949 - DNA, 13 bp, Homo sapiens
cttgctgggcctg

SEQ ID NO: 4668950 - DNA, 15 bp, Homo sapiens
cttgctgggcctggg

SEQ ID NO: 4668951 - DNA, 19 bp, Homo sapiens
cttgctgtatgacccctgg

SEQ ID NO: 4668952 - DNA, 13 bp, Homo sapiens
cttgctttcaatt

SEQ ID NO: 4668953 - DNA, 18 bp, Homo sapiens
cttgctttcctgggcctt

SEQ ID NO: 4668954 - DNA, 15 bp, Homo sapiens
cttgctttcggagct

SEQ ID NO: 4668955 - DNA, 11 bp, Homo sapiens
cttgctttctt

SEQ ID NO: 4668956 - DNA, 15 bp, Homo sapiens
cttggaactgaaggg

SEQ ID NO: 4668957 - DNA, 13 bp, Homo sapiens
cttggaagccagg

SEQ ID NO: 4668958 - DNA, 14 bp, Homo sapiens
cttggaagccaggt

SEQ ID NO: 4668959 - DNA, 20 bp, Homo sapiens
cttggactgttttgaaaagt

SEQ ID NO: 4668960 - DNA, 15 bp, Homo sapiens
cttggagaccctgca

SEQ ID NO: 4668961 - DNA, 15 bp, Homo sapiens
cttggaggagagaga

SEQ ID NO: 4668962 - DNA, 18 bp, Homo sapiens
cttggaggagagagaccc

SEQ ID NO: 4668963 - DNA, 19 bp, Homo sapiens
cttggaggagagagacccc

SEQ ID NO: 4668964 - DNA, 21 bp, Homo sapiens
cttggattattttaaatcatt

SEQ ID NO: 4668965 - DNA, 18 bp, Homo sapiens
cttggcaatattccttag

SEQ ID NO: 4668966 - DNA, 19 bp, Homo sapiens
cttggcctaaacctcagtt

SEQ ID NO: 4668967 - DNA, 13 bp, Homo sapiens
cttggcctcctgc

SEQ ID NO: 4668968 - DNA, 17 bp, Homo sapiens
cttggcctgatcagacc

SEQ ID NO: 4668969 - DNA, 17 bp, Homo sapiens
cttggcggctctagccc

SEQ ID NO: 4668970 - DNA, 20 bp, Homo sapiens
cttggctgccgtctggccgg

SEQ ID NO: 4668971 - DNA, 14 bp, Homo sapiens
cttggcttaatcat

SEQ ID NO: 4668972 - DNA, 20 bp, Homo sapiens
cttggctttatgcaaataca

SEQ ID NO: 4668973 - DNA, 21 bp, Homo sapiens
cttggctttatgcaaatacaa

SEQ ID NO: 4668974 - DNA, 17 bp, Homo sapiens
cttggctttcctgtttc

SEQ ID NO: 4668975 - DNA, 18 bp, Homo sapiens
cttggctttcctgtttct

SEQ ID NO: 4668976 - DNA, 19 bp, Homo sapiens
cttgggaaatatgaatgcc

SEQ ID NO: 4668977 - DNA, 13 bp, Homo sapiens
cttgggcaccccc

SEQ ID NO: 4668978 - DNA, 21 bp, Homo sapiens
cttgggcacccccagcctggg

SEQ ID NO: 4668979 - DNA, 21 bp, Homo sapiens
cttgggcagagtcctgccttc

SEQ ID NO: 4668980 - DNA, 15 bp, Homo sapiens
cttgggcccttccct

SEQ ID NO: 4668981 - DNA, 19 bp, Homo sapiens
cttgggctgacccagcatc

SEQ ID NO: 4668982 - DNA, 20 bp, Homo sapiens
cttggtttctctctacagtg

SEQ ID NO: 4668983 - DNA, 23 bp, Homo sapiens
cttgtaaagactggttttctgcc

SEQ ID NO: 4668984 - DNA, 21 bp, Homo sapiens
cttgtaattatgaaaagaaat

SEQ ID NO: 4668985 - DNA, 13 bp, Homo sapiens
cttgtacatgtgt

SEQ ID NO: 4668986 - DNA, 19 bp, Homo sapiens
cttgtacatgtgtagcctg

SEQ ID NO: 4668987 - DNA, 22 bp, Homo sapiens
cttgtacatgtgtagcctgtgc

SEQ ID NO: 4668988 - DNA, 20 bp, Homo sapiens
cttgtagaaaaatccctcca

SEQ ID NO: 4668989 - DNA, 14 bp, Homo sapiens
cttgtagccagccg

SEQ ID NO: 4668990 - DNA, 15 bp, Homo sapiens
cttgtagccagccgg

SEQ ID NO: 4668991 - DNA, 23 bp, Homo sapiens
cttgtattaagttgttaataaaa

SEQ ID NO: 4668992 - DNA, 18 bp, Homo sapiens
cttgtattctgaggatgt

SEQ ID NO: 4668993 - DNA, 18 bp, Homo sapiens
cttgtcaaaagaaataat

SEQ ID NO: 4668994 - DNA, 17 bp, Homo sapiens
cttgtcacccaggctgg

SEQ ID NO: 4668995 - DNA, 18 bp, Homo sapiens
cttgtcacccaggctgga

SEQ ID NO: 4668996 - DNA, 19 bp, Homo sapiens
cttgtcagacataaagcca

SEQ ID NO: 4668997 - DNA, 20 bp, Homo sapiens
cttgtcagggtctccttcct

SEQ ID NO: 4668998 - DNA, 13 bp, Homo sapiens
cttgtcagtgtag

SEQ ID NO: 4668999 - DNA, 18 bp, Homo sapiens
cttgtcccactatctggg

SEQ ID NO: 4669000 - DNA, 15 bp, Homo sapiens
cttgtcccagaggct

SEQ ID NO: 4669001 - DNA, 16 bp, Homo sapiens
cttgtctgcctcctgc

SEQ ID NO: 4669002 - DNA, 17 bp, Homo sapiens
cttgtcttttcaaaata

SEQ ID NO: 4669003 - DNA, 19 bp, Homo sapiens
cttgtgaaacgtctggact

SEQ ID NO: 4669004 - DNA, 16 bp, Homo sapiens
cttgtgatttctttaa

SEQ ID NO: 4669005 - DNA, 22 bp, Homo sapiens
cttgtgatttctttaaaagaat

SEQ ID NO: 4669006 - DNA, 19 bp, Homo sapiens
cttgtgccatagtcacatg

SEQ ID NO: 4669007 - DNA, 21 bp, Homo sapiens
cttgtggagatcacagcccca

SEQ ID NO: 4669008 - DNA, 14 bp, Homo sapiens
cttgtgggtccatg

SEQ ID NO: 4669009 - DNA, 16 bp, Homo sapiens
cttgtgggtccatgct

SEQ ID NO: 4669010 - DNA, 15 bp, Homo sapiens
cttgtggttgaaatc

SEQ ID NO: 4669011 - DNA, 12 bp, Homo sapiens
cttgtggttgtg

SEQ ID NO: 4669012 - DNA, 22 bp, Homo sapiens
cttgtggttgtgtgtgttctgt

SEQ ID NO: 4669013 - DNA, 17 bp, Homo sapiens
cttgtgtatttctctgt

SEQ ID NO: 4669014 - DNA, 20 bp, Homo sapiens
cttgtgtatttctctgtgaa

SEQ ID NO: 4669015 - DNA, 15 bp, Homo sapiens
cttgtgtctgtacac

SEQ ID NO: 4669016 - DNA, 22 bp, Homo sapiens
cttgtgttatcggacattctaa

SEQ ID NO: 4669017 - DNA, 15 bp, Homo sapiens
cttgtgtttttgtct

SEQ ID NO: 4669018 - DNA, 15 bp, Homo sapiens
cttgttattattgtt

SEQ ID NO: 4669019 - DNA, 16 bp, Homo sapiens
cttgttattattgtta

SEQ ID NO: 4669020 - DNA, 22 bp, Homo sapiens
cttgttcagcaggctagacaga

SEQ ID NO: 4669021 - DNA, 19 bp, Homo sapiens
cttgttctatttttcaatc

SEQ ID NO: 4669022 - DNA, 20 bp, Homo sapiens
cttgttctatttttcaatca

SEQ ID NO: 4669023 - DNA, 12 bp, Homo sapiens
cttgttctctgc

SEQ ID NO: 4669024 - DNA, 21 bp, Homo sapiens
cttgttgaagtgctgttttat

SEQ ID NO: 4669025 - DNA, 23 bp, Homo sapiens
cttgttgctgagtctgcagatga

SEQ ID NO: 4669026 - DNA, 23 bp, Homo sapiens
cttgttggatttttgtcttgtgt

SEQ ID NO: 4669027 - DNA, 14 bp, Homo sapiens
cttgtttggggcag

SEQ ID NO: 4669028 - DNA, 17 bp, Homo sapiens
cttgtttggggcaggag

SEQ ID NO: 4669029 - DNA, 19 bp, Homo sapiens
ctttaaaaaaaaatcttgt

SEQ ID NO: 4669030 - DNA, 16 bp, Homo sapiens
ctttaaaagaatgact

SEQ ID NO: 4669031 - DNA, 17 bp, Homo sapiens
ctttaaatatcattctt

SEQ ID NO: 4669032 - DNA, 14 bp, Homo sapiens
ctttaaatgctgct

SEQ ID NO: 4669033 - DNA, 15 bp, Homo sapiens
ctttaaattgttcct

SEQ ID NO: 4669034 - DNA, 17 bp, Homo sapiens
ctttaaattgttcctct

SEQ ID NO: 4669035 - DNA, 18 bp, Homo sapiens
ctttaaattgttcctctt

SEQ ID NO: 4669036 - DNA, 18 bp, Homo sapiens
ctttaacatacaagaaaa

SEQ ID NO: 4669037 - DNA, 14 bp, Homo sapiens
ctttaagccaaaga

SEQ ID NO: 4669038 - DNA, 16 bp, Homo sapiens
ctttaattttcttgtt

SEQ ID NO: 4669039 - DNA, 20 bp, Homo sapiens
ctttacaaactgaagataat

SEQ ID NO: 4669040 - DNA, 23 bp, Homo sapiens
ctttacattttcagtaccaaaga

SEQ ID NO: 4669041 - DNA, 19 bp, Homo sapiens
ctttactaactctggttta

SEQ ID NO: 4669042 - DNA, 14 bp, Homo sapiens
ctttagtagctcaa

SEQ ID NO: 4669043 - DNA, 17 bp, Homo sapiens
ctttataattgaattgg

SEQ ID NO: 4669044 - DNA, 14 bp, Homo sapiens
ctttatgcaaatac

SEQ ID NO: 4669045 - DNA, 19 bp, Homo sapiens
ctttatgtagtttttatat

SEQ ID NO: 4669046 - DNA, 14 bp, Homo sapiens
ctttattaagtaaa

SEQ ID NO: 4669047 - DNA, 16 bp, Homo sapiens
ctttattctttactat

SEQ ID NO: 4669048 - DNA, 17 bp, Homo sapiens
ctttatttgtaaaccat

SEQ ID NO: 4669049 - DNA, 21 bp, Homo sapiens
ctttatttgtaaaccattgta

SEQ ID NO: 4669050 - DNA, 23 bp, Homo sapiens
ctttattttaaaaaacactgata

SEQ ID NO: 4669051 - DNA, 19 bp, Homo sapiens
ctttattttattattcaga

SEQ ID NO: 4669052 - DNA, 12 bp, Homo sapiens
ctttcaataaag

SEQ ID NO: 4669053 - DNA, 17 bp, Homo sapiens
ctttcaattccaccagg

SEQ ID NO: 4669054 - DNA, 18 bp, Homo sapiens
ctttcagagcccccagcc

SEQ ID NO: 4669055 - DNA, 15 bp, Homo sapiens
ctttcagtacttttt

SEQ ID NO: 4669056 - DNA, 15 bp, Homo sapiens
ctttccaaggaagca

SEQ ID NO: 4669057 - DNA, 14 bp, Homo sapiens
ctttccaatagaaa

SEQ ID NO: 4669058 - DNA, 22 bp, Homo sapiens
ctttccaatagaaagaaactaa

SEQ ID NO: 4669059 - DNA, 15 bp, Homo sapiens
ctttccaatgccaca

SEQ ID NO: 4669060 - DNA, 19 bp, Homo sapiens
ctttccaatgccacagaca

SEQ ID NO: 4669061 - DNA, 13 bp, Homo sapiens
ctttcccaccatt

SEQ ID NO: 4669062 - DNA, 21 bp, Homo sapiens
ctttcccacccaggaaaggag

SEQ ID NO: 4669063 - DNA, 17 bp, Homo sapiens
ctttccccaaggaccca

SEQ ID NO: 4669064 - DNA, 19 bp, Homo sapiens
ctttccccaaggacccagc

SEQ ID NO: 4669065 - DNA, 23 bp, Homo sapiens
ctttccccaaggacccagccctc

SEQ ID NO: 4669066 - DNA, 14 bp, Homo sapiens
ctttccccaggggc

SEQ ID NO: 4669067 - DNA, 15 bp, Homo sapiens
ctttccccaggggca

SEQ ID NO: 4669068 - DNA, 18 bp, Homo sapiens
ctttcccttagtgactct

SEQ ID NO: 4669069 - DNA, 15 bp, Homo sapiens
ctttcctcacatttg

SEQ ID NO: 4669070 - DNA, 13 bp, Homo sapiens
ctttcctggaagt

SEQ ID NO: 4669071 - DNA, 17 bp, Homo sapiens
ctttcctgggcctttgc

SEQ ID NO: 4669072 - DNA, 18 bp, Homo sapiens
ctttcctgggcctttgca

SEQ ID NO: 4669073 - DNA, 23 bp, Homo sapiens
ctttcctgtatttgttcccaaga

SEQ ID NO: 4669074 - DNA, 16 bp, Homo sapiens
ctttcctgtttccagg

SEQ ID NO: 4669075 - DNA, 20 bp, Homo sapiens
ctttcctgtttccagggtct

SEQ ID NO: 4669076 - DNA, 17 bp, Homo sapiens
ctttcctttcaataaag

SEQ ID NO: 4669077 - DNA, 13 bp, Homo sapiens
ctttctcctcttt

SEQ ID NO: 4669078 - DNA, 16 bp, Homo sapiens
ctttctctgcctggca

SEQ ID NO: 4669079 - DNA, 17 bp, Homo sapiens
ctttctctgcctggcaa

SEQ ID NO: 4669080 - DNA, 17 bp, Homo sapiens
ctttctctttctgtttc

SEQ ID NO: 4669081 - DNA, 17 bp, Homo sapiens
ctttctgggctctggac

SEQ ID NO: 4669082 - DNA, 18 bp, Homo sapiens
ctttctgggctctggact

SEQ ID NO: 4669083 - DNA, 20 bp, Homo sapiens
ctttctgggctctggactcc

SEQ ID NO: 4669084 - DNA, 21 bp, Homo sapiens
ctttctgggctctggactcca

SEQ ID NO: 4669085 - DNA, 21 bp, Homo sapiens
ctttctgttccctatggagag

SEQ ID NO: 4669086 - DNA, 15 bp, Homo sapiens
ctttctgtttcctgg

SEQ ID NO: 4669087 - DNA, 15 bp, Homo sapiens
ctttctttagaattt

SEQ ID NO: 4669088 - DNA, 17 bp, Homo sapiens
ctttctttctctttctg

SEQ ID NO: 4669089 - DNA, 20 bp, Homo sapiens
ctttgaaagaagcaagacac

SEQ ID NO: 4669090 - DNA, 18 bp, Homo sapiens
ctttgaacctgtgcaata

SEQ ID NO: 4669091 - DNA, 22 bp, Homo sapiens
ctttgaactaatgataaagtaa

SEQ ID NO: 4669092 - DNA, 17 bp, Homo sapiens
ctttgagatctggggag

SEQ ID NO: 4669093 - DNA, 21 bp, Homo sapiens
ctttgagatctggggaggcag

SEQ ID NO: 4669094 - DNA, 21 bp, Homo sapiens
ctttgaggccccaactcaagt

SEQ ID NO: 4669095 - DNA, 12 bp, Homo sapiens
ctttgcaaagac

SEQ ID NO: 4669096 - DNA, 15 bp, Homo sapiens
ctttgcaagatgctt

SEQ ID NO: 4669097 - DNA, 17 bp, Homo sapiens
ctttgcaagatgcttgg

SEQ ID NO: 4669098 - DNA, 19 bp, Homo sapiens
ctttgccagtcattcagca

SEQ ID NO: 4669099 - DNA, 18 bp, Homo sapiens
ctttgcggggcctgtctc

SEQ ID NO: 4669100 - DNA, 21 bp, Homo sapiens
ctttggaaaatgcattgtatc

SEQ ID NO: 4669101 - DNA, 15 bp, Homo sapiens
ctttggagttggaat

SEQ ID NO: 4669102 - DNA, 20 bp, Homo sapiens
ctttggattgctggggccag

SEQ ID NO: 4669103 - DNA, 20 bp, Homo sapiens
ctttgggaagactgaggcat

SEQ ID NO: 4669104 - DNA, 20 bp, Homo sapiens
ctttgggcacaattcctgtg

SEQ ID NO: 4669105 - DNA, 23 bp, Homo sapiens
ctttgggggtgattgtctcgctt

SEQ ID NO: 4669106 - DNA, 17 bp, Homo sapiens
ctttgtagactgtttca

SEQ ID NO: 4669107 - DNA, 21 bp, Homo sapiens
ctttgtcatagttatgtgatt

SEQ ID NO: 4669108 - DNA, 15 bp, Homo sapiens
ctttgtctaaaacaa

SEQ ID NO: 4669109 - DNA, 15 bp, Homo sapiens
ctttgtgactgtcac

SEQ ID NO: 4669110 - DNA, 23 bp, Homo sapiens
ctttgtgactgtcacttgctgct

SEQ ID NO: 4669111 - DNA, 18 bp, Homo sapiens
ctttgtgcctttgggcac

SEQ ID NO: 4669112 - DNA, 15 bp, Homo sapiens
ctttgtgttcatttc

SEQ ID NO: 4669113 - DNA, 17 bp, Homo sapiens
ctttgtgttcatttcat

SEQ ID NO: 4669114 - DNA, 15 bp, Homo sapiens
ctttgtttcaacttt

SEQ ID NO: 4669115 - DNA, 17 bp, Homo sapiens
ctttgtttcaactttct

SEQ ID NO: 4669116 - DNA, 12 bp, Homo sapiens
ctttgttttttt

SEQ ID NO: 4669117 - DNA, 13 bp, Homo sapiens
cttttaaaatgca

SEQ ID NO: 4669118 - DNA, 19 bp, Homo sapiens
cttttaaaatgcaatgtaa

SEQ ID NO: 4669119 - DNA, 13 bp, Homo sapiens
cttttaaagaagc

SEQ ID NO: 4669120 - DNA, 16 bp, Homo sapiens
cttttaaagaagcttt

SEQ ID NO: 4669121 - DNA, 12 bp, Homo sapiens
cttttaaagtat

SEQ ID NO: 4669122 - DNA, 13 bp, Homo sapiens
cttttaaggtttc

SEQ ID NO: 4669123 - DNA, 20 bp, Homo sapiens
cttttaaggtttcaacaaat

SEQ ID NO: 4669124 - DNA, 18 bp, Homo sapiens
cttttagtagagacagtg

SEQ ID NO: 4669125 - DNA, 17 bp, Homo sapiens
cttttataagcactcca

SEQ ID NO: 4669126 - DNA, 15 bp, Homo sapiens
cttttatctcacaaa

SEQ ID NO: 4669127 - DNA, 22 bp, Homo sapiens
cttttatctgtttaaagcatat

SEQ ID NO: 4669128 - DNA, 21 bp, Homo sapiens
cttttattattattattgctg

SEQ ID NO: 4669129 - DNA, 16 bp, Homo sapiens
cttttattgtaaagtc

SEQ ID NO: 4669130 - DNA, 18 bp, Homo sapiens
cttttatttggtgtgttc

SEQ ID NO: 4669131 - DNA, 19 bp, Homo sapiens
cttttcacattaggctgtt

SEQ ID NO: 4669132 - DNA, 13 bp, Homo sapiens
cttttcatctggg

SEQ ID NO: 4669133 - DNA, 14 bp, Homo sapiens
cttttcccccaccc

SEQ ID NO: 4669134 - DNA, 23 bp, Homo sapiens
cttttcccccaccctcccatgag

SEQ ID NO: 4669135 - DNA, 16 bp, Homo sapiens
cttttctgccactcca

SEQ ID NO: 4669136 - DNA, 13 bp, Homo sapiens
cttttgctgtgca

SEQ ID NO: 4669137 - DNA, 20 bp, Homo sapiens
cttttgttaaacccttctgt

SEQ ID NO: 4669138 - DNA, 21 bp, Homo sapiens
cttttgttctactccttccct

SEQ ID NO: 4669139 - DNA, 17 bp, Homo sapiens
ctttttacagcagcaat

SEQ ID NO: 4669140 - DNA, 20 bp, Homo sapiens
ctttttagggcagattttgg

SEQ ID NO: 4669141 - DNA, 18 bp, Homo sapiens
ctttttattattttaagt

SEQ ID NO: 4669142 - DNA, 15 bp, Homo sapiens
ctttttcatttaact

SEQ ID NO: 4669143 - DNA, 13 bp, Homo sapiens
ctttttctgcgct

SEQ ID NO: 4669144 - DNA, 16 bp, Homo sapiens
ctttttctgcgcttca

SEQ ID NO: 4669145 - DNA, 16 bp, Homo sapiens
ctttttcttgtattca

SEQ ID NO: 4669146 - DNA, 17 bp, Homo sapiens
ctttttgttgtaaaaca

SEQ ID NO: 4669147 - DNA, 13 bp, Homo sapiens
cttttttatgtta

SEQ ID NO: 4669148 - DNA, 19 bp, Homo sapiens
cttttttatgttggttgat

SEQ ID NO: 4669149 - DNA, 13 bp, Homo sapiens
cttttttgaacca

SEQ ID NO: 4669150 - DNA, 24 bp, Homo sapiens
cttttttggggagtacctgtccaa

SEQ ID NO: 4669151 - DNA, 19 bp, Homo sapiens
cttttttgtggcaattagt

SEQ ID NO: 4669152 - DNA, 16 bp, Homo sapiens
ctttttttccttttta

SEQ ID NO: 4669153 - DNA, 22 bp, Homo sapiens
gaaaaaaaaaaaaagaaattcg

SEQ ID NO: 4669154 - DNA, 20 bp, Homo sapiens
gaaaaaaaaaatgttgagaa

SEQ ID NO: 4669155 - DNA, 22 bp, Homo sapiens
gaaaaaaagaggtttaagtttg

SEQ ID NO: 4669156 - DNA, 16 bp, Homo sapiens
gaaaaataaaatgttt

SEQ ID NO: 4669157 - DNA, 14 bp, Homo sapiens
gaaaaattaacttt

SEQ ID NO: 4669158 - DNA, 15 bp, Homo sapiens
gaaaaattaactttt

SEQ ID NO: 4669159 - DNA, 16 bp, Homo sapiens
gaaaaattaacttttt

SEQ ID NO: 4669160 - DNA, 22 bp, Homo sapiens
gaaaacaaagccaaacaaaact

SEQ ID NO: 4669161 - DNA, 16 bp, Homo sapiens
gaaaaccatcacatga

SEQ ID NO: 4669162 - DNA, 22 bp, Homo sapiens
gaaaacgctctctactctgctt

SEQ ID NO: 4669163 - DNA, 12 bp, Homo sapiens
gaaaactaaaaa

SEQ ID NO: 4669164 - DNA, 22 bp, Homo sapiens
gaaaactcatgatcaagatata

SEQ ID NO: 4669165 - DNA, 13 bp, Homo sapiens
gaaaactcccaat

SEQ ID NO: 4669166 - DNA, 18 bp, Homo sapiens
gaaaactcccaatacaaa

SEQ ID NO: 4669167 - DNA, 22 bp, Homo sapiens
gaaaactgcctgacctttggga

SEQ ID NO: 4669168 - DNA, 14 bp, Homo sapiens
gaaaactgggtatg

SEQ ID NO: 4669169 - DNA, 18 bp, Homo sapiens
gaaaagacttgtaatatt

SEQ ID NO: 4669170 - DNA, 20 bp, Homo sapiens
gaaaagatgtacctggtgga

SEQ ID NO: 4669171 - DNA, 18 bp, Homo sapiens
gaaaagatgttgtgtctt

SEQ ID NO: 4669172 - DNA, 14 bp, Homo sapiens
gaaaaggcctgggg

SEQ ID NO: 4669173 - DNA, 22 bp, Homo sapiens
gaaaagggcactcccaaccctg

SEQ ID NO: 4669174 - DNA, 14 bp, Homo sapiens
gaaaagtaatgaag

SEQ ID NO: 4669175 - DNA, 17 bp, Homo sapiens
gaaaagtaattttgtca

SEQ ID NO: 4669176 - DNA, 19 bp, Homo sapiens
gaaaagtaattttgtcaca

SEQ ID NO: 4669177 - DNA, 21 bp, Homo sapiens
gaaaagtgttagggattcctt

SEQ ID NO: 4669178 - DNA, 13 bp, Homo sapiens
gaaaataaaacac

SEQ ID NO: 4669179 - DNA, 14 bp, Homo sapiens
gaaaataaaacaca

SEQ ID NO: 4669180 - DNA, 16 bp, Homo sapiens
gaaaataaaacacacc

SEQ ID NO: 4669181 - DNA, 21 bp, Homo sapiens
gaaaatataaggactttttga

SEQ ID NO: 4669182 - DNA, 22 bp, Homo sapiens
gaaaatatagacattctcacat

SEQ ID NO: 4669183 - DNA, 20 bp, Homo sapiens
gaaaatatatattatataca

SEQ ID NO: 4669184 - DNA, 12 bp, Homo sapiens
gaaaatgactta

SEQ ID NO: 4669185 - DNA, 18 bp, Homo sapiens
gaaaatgacttatttctg

SEQ ID NO: 4669186 - DNA, 13 bp, Homo sapiens
gaaaatgcttatt

SEQ ID NO: 4669187 - DNA, 12 bp, Homo sapiens
gaaacaaaatgt

SEQ ID NO: 4669188 - DNA, 16 bp, Homo sapiens
gaaacaatgaaatttt

SEQ ID NO: 4669189 - DNA, 13 bp, Homo sapiens
gaaacaccactta

SEQ ID NO: 4669190 - DNA, 17 bp, Homo sapiens
gaaacagagtggcctcc

SEQ ID NO: 4669191 - DNA, 20 bp, Homo sapiens
gaaacagagtggcctccctg

SEQ ID NO: 4669192 - DNA, 20 bp, Homo sapiens
gaaacagcctgtgtctttaa

SEQ ID NO: 4669193 - DNA, 16 bp, Homo sapiens
gaaacagctcagccag

SEQ ID NO: 4669194 - DNA, 17 bp, Homo sapiens
gaaacagttccatttat

SEQ ID NO: 4669195 - DNA, 12 bp, Homo sapiens
gaaacatttata

SEQ ID NO: 4669196 - DNA, 13 bp, Homo sapiens
gaaacatttggaa

SEQ ID NO: 4669197 - DNA, 18 bp, Homo sapiens
gaaaccaattaagcagct

SEQ ID NO: 4669198 - DNA, 18 bp, Homo sapiens
gaaacctacaagatttcc

SEQ ID NO: 4669199 - DNA, 16 bp, Homo sapiens
gaaacctctacatatt

SEQ ID NO: 4669200 - DNA, 13 bp, Homo sapiens
gaaacggacagct

SEQ ID NO: 4669201 - DNA, 19 bp, Homo sapiens
gaaactaaacagaaaactc

SEQ ID NO: 4669202 - DNA, 13 bp, Homo sapiens
gaaactgccacat

SEQ ID NO: 4669203 - DNA, 23 bp, Homo sapiens
gaaacttatagttaatattttgt

SEQ ID NO: 4669204 - DNA, 17 bp, Homo sapiens
gaaacttcattcagagg

SEQ ID NO: 4669205 - DNA, 18 bp, Homo sapiens
gaaacttctgatgtttat

SEQ ID NO: 4669206 - DNA, 15 bp, Homo sapiens
gaaacttctgtaagg

SEQ ID NO: 4669207 - DNA, 20 bp, Homo sapiens
gaaagaaacttcattcagag

SEQ ID NO: 4669208 - DNA, 13 bp, Homo sapiens
gaaagaacaagtt

SEQ ID NO: 4669209 - DNA, 15 bp, Homo sapiens
gaaagaagcaagaca

SEQ ID NO: 4669210 - DNA, 14 bp, Homo sapiens
gaaagaagggggcc

SEQ ID NO: 4669211 - DNA, 20 bp, Homo sapiens
gaaagaagggggccctgcta

SEQ ID NO: 4669212 - DNA, 20 bp, Homo sapiens
gaaagaattgatcagaatcc

SEQ ID NO: 4669213 - DNA, 21 bp, Homo sapiens
gaaagaccctgatgcaggtca

SEQ ID NO: 4669214 - DNA, 14 bp, Homo sapiens
gaaagagagaagcc

SEQ ID NO: 4669215 - DNA, 17 bp, Homo sapiens
gaaagagagaagccagc

SEQ ID NO: 4669216 - DNA, 19 bp, Homo sapiens
gaaagagagaagccagcca

SEQ ID NO: 4669217 - DNA, 20 bp, Homo sapiens
gaaagagagaagccagccac

SEQ ID NO: 4669218 - DNA, 23 bp, Homo sapiens
gaaagagagatgggccaggcaga

SEQ ID NO: 4669219 - DNA, 16 bp, Homo sapiens
gaaagagatacagagg

SEQ ID NO: 4669220 - DNA, 14 bp, Homo sapiens
gaaagagctgcctg

SEQ ID NO: 4669221 - DNA, 19 bp, Homo sapiens
gaaagaggtgaccccaggg

SEQ ID NO: 4669222 - DNA, 14 bp, Homo sapiens
gaaagccaggagca

SEQ ID NO: 4669223 - DNA, 17 bp, Homo sapiens
gaaagccctgtgctcca

SEQ ID NO: 4669224 - DNA, 19 bp, Homo sapiens
gaaaggagcctaggccagg

SEQ ID NO: 4669225 - DNA, 14 bp, Homo sapiens
gaaaggaggaccag

SEQ ID NO: 4669226 - DNA, 21 bp, Homo sapiens
gaaaggccttcagacacatgc

SEQ ID NO: 4669227 - DNA, 13 bp, Homo sapiens
gaaagggagatgt

SEQ ID NO: 4669228 - DNA, 23 bp, Homo sapiens
gaaagggtgtttttctgttttat

SEQ ID NO: 4669229 - DNA, 21 bp, Homo sapiens
gaaagtcaaaaaattatttgc

SEQ ID NO: 4669230 - DNA, 22 bp, Homo sapiens
gaaagtcccccctcgccccaaa

SEQ ID NO: 4669231 - DNA, 22 bp, Homo sapiens
gaaagtgacatttgctttcggt

SEQ ID NO: 4669232 - DNA, 18 bp, Homo sapiens
gaaagtgttaattttacc

SEQ ID NO: 4669233 - DNA, 22 bp, Homo sapiens
gaaagttgtaaaatagaaaaag

SEQ ID NO: 4669234 - DNA, 23 bp, Homo sapiens
gaaataaaaggaagccaaagagt

SEQ ID NO: 4669235 - DNA, 22 bp, Homo sapiens
gaaataaattctgacttatgaa

SEQ ID NO: 4669236 - DNA, 15 bp, Homo sapiens
gaaataacaaaatgg

SEQ ID NO: 4669237 - DNA, 17 bp, Homo sapiens
gaaataacaaaatggac

SEQ ID NO: 4669238 - DNA, 18 bp, Homo sapiens
gaaataacaagtcgatga

SEQ ID NO: 4669239 - DNA, 23 bp, Homo sapiens
gaaatatattttaccatacattt

SEQ ID NO: 4669240 - DNA, 15 bp, Homo sapiens
gaaatatttagcaaa

SEQ ID NO: 4669241 - DNA, 19 bp, Homo sapiens
gaaatatttagcaaataat

SEQ ID NO: 4669242 - DNA, 16 bp, Homo sapiens
gaaatcaactctcttc

SEQ ID NO: 4669243 - DNA, 22 bp, Homo sapiens
gaaatccatactgtagacactc

SEQ ID NO: 4669244 - DNA, 17 bp, Homo sapiens
gaaatctgtaaagccag

SEQ ID NO: 4669245 - DNA, 18 bp, Homo sapiens
gaaatcttttacattttt

SEQ ID NO: 4669246 - DNA, 19 bp, Homo sapiens
gaaatcttttacatttttc

SEQ ID NO: 4669247 - DNA, 14 bp, Homo sapiens
gaaatggaaatttt

SEQ ID NO: 4669248 - DNA, 16 bp, Homo sapiens
gaaatgggacggaggt

SEQ ID NO: 4669249 - DNA, 12 bp, Homo sapiens
gaaatgtacact

SEQ ID NO: 4669250 - DNA, 13 bp, Homo sapiens
gaaatgtacactt

SEQ ID NO: 4669251 - DNA, 15 bp, Homo sapiens
gaaatgtacactttt

SEQ ID NO: 4669252 - DNA, 14 bp, Homo sapiens
gaaatgtacttttg

SEQ ID NO: 4669253 - DNA, 17 bp, Homo sapiens
gaaatgtacttttggat

SEQ ID NO: 4669254 - DNA, 18 bp, Homo sapiens
gaaatgtttaataaagct

SEQ ID NO: 4669255 - DNA, 20 bp, Homo sapiens
gaaatgtttaataaagcttt

SEQ ID NO: 4669256 - DNA, 22 bp, Homo sapiens
gaaatgtttaataaagctttat

SEQ ID NO: 4669257 - DNA, 18 bp, Homo sapiens
gaaattaagcattttgaa

SEQ ID NO: 4669258 - DNA, 22 bp, Homo sapiens
gaaattaagcattttgaaacaa

SEQ ID NO: 4669259 - DNA, 13 bp, Homo sapiens
gaaattagggccc

SEQ ID NO: 4669260 - DNA, 20 bp, Homo sapiens
gaaattcgcatgtttaatgt

SEQ ID NO: 4669261 - DNA, 12 bp, Homo sapiens
gaaattgacaga

SEQ ID NO: 4669262 - DNA, 19 bp, Homo sapiens
gaaattgtaaatcctgtgt

SEQ ID NO: 4669263 - DNA, 16 bp, Homo sapiens
gaaatttagagttcta

SEQ ID NO: 4669264 - DNA, 17 bp, Homo sapiens
gaaatttctcatcacag

SEQ ID NO: 4669265 - DNA, 21 bp, Homo sapiens
gaaattttcaagagtctaata

SEQ ID NO: 4669266 - DNA, 22 bp, Homo sapiens
gaaatttttcagatgcttctgg

SEQ ID NO: 4669267 - DNA, 10 bp, Homo sapiens
gaacaaaact

SEQ ID NO: 4669268 - DNA, 13 bp, Homo sapiens
gaacaaaactgtt

SEQ ID NO: 4669269 - DNA, 23 bp, Homo sapiens
gaacaaaactgttcttttgcatt

SEQ ID NO: 4669270 - DNA, 15 bp, Homo sapiens
gaacaaagcagccac

SEQ ID NO: 4669271 - DNA, 15 bp, Homo sapiens
gaacaaatgtcttaa

SEQ ID NO: 4669272 - DNA, 14 bp, Homo sapiens
gaacaaattatttt

SEQ ID NO: 4669273 - DNA, 22 bp, Homo sapiens
gaacacggccacatcaaagagg

SEQ ID NO: 4669274 - DNA, 13 bp, Homo sapiens
gaacactcttagc

SEQ ID NO: 4669275 - DNA, 20 bp, Homo sapiens
gaacagagagacccttgtgg

SEQ ID NO: 4669276 - DNA, 21 bp, Homo sapiens
gaacagagagacccttgtggg

SEQ ID NO: 4669277 - DNA, 18 bp, Homo sapiens
gaacagataatccctgta

SEQ ID NO: 4669278 - DNA, 11 bp, Homo sapiens
gaacagcccag

SEQ ID NO: 4669279 - DNA, 12 bp, Homo sapiens
gaacagcccagc

SEQ ID NO: 4669280 - DNA, 13 bp, Homo sapiens
gaacagcccagca

SEQ ID NO: 4669281 - DNA, 21 bp, Homo sapiens
gaacagctttgtatgtttatg

SEQ ID NO: 4669282 - DNA, 15 bp, Homo sapiens
gaacagtggttgcct

SEQ ID NO: 4669283 - DNA, 22 bp, Homo sapiens
gaacagttgcatttagcttctt

SEQ ID NO: 4669284 - DNA, 13 bp, Homo sapiens
gaacatcttcata

SEQ ID NO: 4669285 - DNA, 19 bp, Homo sapiens
gaacattcagctctggaga

SEQ ID NO: 4669286 - DNA, 22 bp, Homo sapiens
gaacattcagctctggagaaca

SEQ ID NO: 4669287 - DNA, 14 bp, Homo sapiens
gaaccacaaaaaaa

SEQ ID NO: 4669288 - DNA, 22 bp, Homo sapiens
gaaccacaaaaaaaaaggctgg

SEQ ID NO: 4669289 - DNA, 15 bp, Homo sapiens
gaaccactcccacca

SEQ ID NO: 4669290 - DNA, 22 bp, Homo sapiens
gaaccactcccaccacaggcat

SEQ ID NO: 4669291 - DNA, 18 bp, Homo sapiens
gaaccagggctcttctca

SEQ ID NO: 4669292 - DNA, 20 bp, Homo sapiens
gaaccatccacttacatata

SEQ ID NO: 4669293 - DNA, 11 bp, Homo sapiens
gaacccaggac

SEQ ID NO: 4669294 - DNA, 21 bp, Homo sapiens
gaaccccctccctgtcccagg

SEQ ID NO: 4669295 - DNA, 20 bp, Homo sapiens
gaaccccggggtgcccacag

SEQ ID NO: 4669296 - DNA, 14 bp, Homo sapiens
gaacctcctctgtg

SEQ ID NO: 4669297 - DNA, 16 bp, Homo sapiens
gaacctcggggtgggg

SEQ ID NO: 4669298 - DNA, 19 bp, Homo sapiens
gaacctcggggtgggggtg

SEQ ID NO: 4669299 - DNA, 13 bp, Homo sapiens
gaacctggccttc

SEQ ID NO: 4669300 - DNA, 17 bp, Homo sapiens
gaacgtggctctgctgg

SEQ ID NO: 4669301 - DNA, 15 bp, Homo sapiens
gaacgtttttcctgt

SEQ ID NO: 4669302 - DNA, 15 bp, Homo sapiens
gaactaatttatact

SEQ ID NO: 4669303 - DNA, 23 bp, Homo sapiens
gaactagaggtgttacagaggac

SEQ ID NO: 4669304 - DNA, 18 bp, Homo sapiens
gaactagccaaaccagga

SEQ ID NO: 4669305 - DNA, 15 bp, Homo sapiens
gaactaggctgagca

SEQ ID NO: 4669306 - DNA, 13 bp, Homo sapiens
gaactcactctgg

SEQ ID NO: 4669307 - DNA, 16 bp, Homo sapiens
gaactcactctgggct

SEQ ID NO: 4669308 - DNA, 18 bp, Homo sapiens
gaactcactctgggctgt

SEQ ID NO: 4669309 - DNA, 14 bp, Homo sapiens
gaactccagagtca

SEQ ID NO: 4669310 - DNA, 14 bp, Homo sapiens
gaactctcccctcc

SEQ ID NO: 4669311 - DNA, 17 bp, Homo sapiens
gaactctcccctcccca

SEQ ID NO: 4669312 - DNA, 18 bp, Homo sapiens
gaactctcccctccccat

SEQ ID NO: 4669313 - DNA, 22 bp, Homo sapiens
gaactgaggagatgaccaggga

SEQ ID NO: 4669314 - DNA, 21 bp, Homo sapiens
gaactgattgctcccaggatc

SEQ ID NO: 4669315 - DNA, 21 bp, Homo sapiens
gaactgcctttggcagagttc

SEQ ID NO: 4669316 - DNA, 15 bp, Homo sapiens
gaactggccaagctg

SEQ ID NO: 4669317 - DNA, 17 bp, Homo sapiens
gaactgtctgtgaacag

SEQ ID NO: 4669318 - DNA, 21 bp, Homo sapiens
gaactgtgtttcaaatggact

SEQ ID NO: 4669319 - DNA, 17 bp, Homo sapiens
gaacttctagctcattt

SEQ ID NO: 4669320 - DNA, 15 bp, Homo sapiens
gaacttgactgggtg

SEQ ID NO: 4669321 - DNA, 18 bp, Homo sapiens
gaactttctgttccctat

SEQ ID NO: 4669322 - DNA, 21 bp, Homo sapiens
gaagaaacacgtggtcatgaa

SEQ ID NO: 4669323 - DNA, 23 bp, Homo sapiens
gaagaaggaggaatgctggactg

SEQ ID NO: 4669324 - DNA, 17 bp, Homo sapiens
gaagaatacccaggaag

SEQ ID NO: 4669325 - DNA, 13 bp, Homo sapiens
gaagaattttatt

SEQ ID NO: 4669326 - DNA, 14 bp, Homo sapiens
gaagacattttctc

SEQ ID NO: 4669327 - DNA, 15 bp, Homo sapiens
gaagacgggagggga

SEQ ID NO: 4669328 - DNA, 15 bp, Homo sapiens
gaagactgagaactt

SEQ ID NO: 4669329 - DNA, 16 bp, Homo sapiens
gaagactgagaacttt

SEQ ID NO: 4669330 - DNA, 23 bp, Homo sapiens
gaagagaggaaataacagagaga

SEQ ID NO: 4669331 - DNA, 15 bp, Homo sapiens
gaagagagggacagg

SEQ ID NO: 4669332 - DNA, 14 bp, Homo sapiens
gaagagattgctga

SEQ ID NO: 4669333 - DNA, 10 bp, Homo sapiens
gaagagccac

SEQ ID NO: 4669334 - DNA, 14 bp, Homo sapiens
gaagagccacctgc

SEQ ID NO: 4669335 - DNA, 15 bp, Homo sapiens
gaagagccacctgca

SEQ ID NO: 4669336 - DNA, 20 bp, Homo sapiens
gaagagccacctgcaagatg

SEQ ID NO: 4669337 - DNA, 22 bp, Homo sapiens
gaagagccacctgcaagatgga

SEQ ID NO: 4669338 - DNA, 13 bp, Homo sapiens
gaagaggagatgt

SEQ ID NO: 4669339 - DNA, 15 bp, Homo sapiens
gaagagggggagggg

SEQ ID NO: 4669340 - DNA, 14 bp, Homo sapiens
gaagatcagaacat

SEQ ID NO: 4669341 - DNA, 17 bp, Homo sapiens
gaagatcattgccatca

SEQ ID NO: 4669342 - DNA, 20 bp, Homo sapiens
gaagatggcatcctgtgaag

SEQ ID NO: 4669343 - DNA, 18 bp, Homo sapiens
gaagattctctattggct

SEQ ID NO: 4669344 - DNA, 14 bp, Homo sapiens
gaagcacacctaca

SEQ ID NO: 4669345 - DNA, 15 bp, Homo sapiens
gaagcagagggacaa

SEQ ID NO: 4669346 - DNA, 17 bp, Homo sapiens
gaagcatacactatgaa

SEQ ID NO: 4669347 - DNA, 13 bp, Homo sapiens
gaagccagccaca

SEQ ID NO: 4669348 - DNA, 13 bp, Homo sapiens
gaagccaggtaca

SEQ ID NO: 4669349 - DNA, 20 bp, Homo sapiens
gaagccaggtacaggagagg

SEQ ID NO: 4669350 - DNA, 24 bp, Homo sapiens
gaagccaggtacaggagaggcagc

SEQ ID NO: 4669351 - DNA, 17 bp, Homo sapiens
gaagcccaaagcctgag

SEQ ID NO: 4669352 - DNA, 19 bp, Homo sapiens
gaagcccaaagcctgagga

SEQ ID NO: 4669353 - DNA, 20 bp, Homo sapiens
gaagcccccaccgtgggcag

SEQ ID NO: 4669354 - DNA, 14 bp, Homo sapiens
gaagcccctgggcc

SEQ ID NO: 4669355 - DNA, 15 bp, Homo sapiens
gaagccccttatttt

SEQ ID NO: 4669356 - DNA, 14 bp, Homo sapiens
gaagccgactctgg

SEQ ID NO: 4669357 - DNA, 12 bp, Homo sapiens
gaagcctggggg

SEQ ID NO: 4669358 - DNA, 13 bp, Homo sapiens
gaagcctgggggc

SEQ ID NO: 4669359 - DNA, 19 bp, Homo sapiens
gaagcctgggggcctggct

SEQ ID NO: 4669360 - DNA, 20 bp, Homo sapiens
gaagcctgggggcctggctg

SEQ ID NO: 4669361 - DNA, 21 bp, Homo sapiens
gaagcctgggggcctggctgg

SEQ ID NO: 4669362 - DNA, 14 bp, Homo sapiens
gaagccttccccca

SEQ ID NO: 4669363 - DNA, 14 bp, Homo sapiens
gaagcgaacatctt

SEQ ID NO: 4669364 - DNA, 15 bp, Homo sapiens
gaagcgaacatcttc

SEQ ID NO: 4669365 - DNA, 13 bp, Homo sapiens
gaagcgtttttaa

SEQ ID NO: 4669366 - DNA, 15 bp, Homo sapiens
gaagctaacagggaa

SEQ ID NO: 4669367 - DNA, 22 bp, Homo sapiens
gaagctgcctggtgtggagtga

SEQ ID NO: 4669368 - DNA, 18 bp, Homo sapiens
gaagctgcgggggcaggc

SEQ ID NO: 4669369 - DNA, 20 bp, Homo sapiens
gaagctgctccaggcctgca

SEQ ID NO: 4669370 - DNA, 22 bp, Homo sapiens
gaagctttatttatagaaatga

SEQ ID NO: 4669371 - DNA, 13 bp, Homo sapiens
gaaggaaggaggg

SEQ ID NO: 4669372 - DNA, 19 bp, Homo sapiens
gaaggaaggggctatcctg

SEQ ID NO: 4669373 - DNA, 20 bp, Homo sapiens
gaaggacaggaccctcagga

SEQ ID NO: 4669374 - DNA, 18 bp, Homo sapiens
gaaggagaaatacccatg

SEQ ID NO: 4669375 - DNA, 16 bp, Homo sapiens
gaaggagaaggctgga

SEQ ID NO: 4669376 - DNA, 19 bp, Homo sapiens
gaaggagaaggctggagaa

SEQ ID NO: 4669377 - DNA, 17 bp, Homo sapiens
gaaggagacaggatgag

SEQ ID NO: 4669378 - DNA, 18 bp, Homo sapiens
gaaggagacaggatgagg

SEQ ID NO: 4669379 - DNA, 20 bp, Homo sapiens
gaaggaggccaaccagcccg

SEQ ID NO: 4669380 - DNA, 22 bp, Homo sapiens
gaaggagtgccataccttctcc

SEQ ID NO: 4669381 - DNA, 13 bp, Homo sapiens
gaaggagtttaaa

SEQ ID NO: 4669382 - DNA, 17 bp, Homo sapiens
gaaggataaagccactt

SEQ ID NO: 4669383 - DNA, 13 bp, Homo sapiens
gaaggcagacagc

SEQ ID NO: 4669384 - DNA, 14 bp, Homo sapiens
gaaggcagacagca

SEQ ID NO: 4669385 - DNA, 13 bp, Homo sapiens
gaaggcaggcagg

SEQ ID NO: 4669386 - DNA, 15 bp, Homo sapiens
gaaggcaggcagggc

SEQ ID NO: 4669387 - DNA, 18 bp, Homo sapiens
gaaggcaggcagggctct

SEQ ID NO: 4669388 - DNA, 19 bp, Homo sapiens
gaaggcaggcagggctctc

SEQ ID NO: 4669389 - DNA, 22 bp, Homo sapiens
gaaggcaggcagggctctcctg

SEQ ID NO: 4669390 - DNA, 23 bp, Homo sapiens
gaaggcaggcagggctctcctgg

SEQ ID NO: 4669391 - DNA, 21 bp, Homo sapiens
gaaggcagtggcaggggagca

SEQ ID NO: 4669392 - DNA, 22 bp, Homo sapiens
gaaggcagtggcaggggagcag

SEQ ID NO: 4669393 - DNA, 20 bp, Homo sapiens
gaaggcattggcatctgctt

SEQ ID NO: 4669394 - DNA, 22 bp, Homo sapiens
gaaggcattggcatctgctttt

SEQ ID NO: 4669395 - DNA, 23 bp, Homo sapiens
gaaggcattggcatctgctttta

SEQ ID NO: 4669396 - DNA, 22 bp, Homo sapiens
gaaggcccttaactatcaccag

SEQ ID NO: 4669397 - DNA, 15 bp, Homo sapiens
gaaggcctcgcagga

SEQ ID NO: 4669398 - DNA, 15 bp, Homo sapiens
gaaggcctgagcccc

SEQ ID NO: 4669399 - DNA, 21 bp, Homo sapiens
gaaggctacttcggggctggg

SEQ ID NO: 4669400 - DNA, 22 bp, Homo sapiens
gaaggctacttcggggctggga

SEQ ID NO: 4669401 - DNA, 16 bp, Homo sapiens
gaaggcttaagaactg

SEQ ID NO: 4669402 - DNA, 18 bp, Homo sapiens
gaaggggctatcctggga

SEQ ID NO: 4669403 - DNA, 19 bp, Homo sapiens
gaaggggctatcctgggac

SEQ ID NO: 4669404 - DNA, 15 bp, Homo sapiens
gaagggggccctgct

SEQ ID NO: 4669405 - DNA, 17 bp, Homo sapiens
gaagggggctctgcccc

SEQ ID NO: 4669406 - DNA, 19 bp, Homo sapiens
gaagggggctctgccccag

SEQ ID NO: 4669407 - DNA, 16 bp, Homo sapiens
gaaggtcctgctatta

SEQ ID NO: 4669408 - DNA, 15 bp, Homo sapiens
gaaggtctttgttat

SEQ ID NO: 4669409 - DNA, 16 bp, Homo sapiens
gaaggtttgtgttttt

SEQ ID NO: 4669410 - DNA, 22 bp, Homo sapiens
gaagtaaattaaacatttttca

SEQ ID NO: 4669411 - DNA, 22 bp, Homo sapiens
gaagtaacatgcatactttatt

SEQ ID NO: 4669412 - DNA, 19 bp, Homo sapiens
gaagtcaaataaatgtttc

SEQ ID NO: 4669413 - DNA, 22 bp, Homo sapiens
gaagtcgtccttactcctgtgg

SEQ ID NO: 4669414 - DNA, 21 bp, Homo sapiens
gaagtgaggatgagacccagc

SEQ ID NO: 4669415 - DNA, 15 bp, Homo sapiens
gaagtgctgttttat

SEQ ID NO: 4669416 - DNA, 13 bp, Homo sapiens
gaagtgttgcatg

SEQ ID NO: 4669417 - DNA, 18 bp, Homo sapiens
gaagtgttgcatggatgt

SEQ ID NO: 4669418 - DNA, 15 bp, Homo sapiens
gaagtttgtagccag

SEQ ID NO: 4669419 - DNA, 15 bp, Homo sapiens
gaataaagtattcta

SEQ ID NO: 4669420 - DNA, 15 bp, Homo sapiens
gaataagcagaacat

SEQ ID NO: 4669421 - DNA, 19 bp, Homo sapiens
gaataatatcaaataaaat

SEQ ID NO: 4669422 - DNA, 20 bp, Homo sapiens
gaataatatcaaataaaata

SEQ ID NO: 4669423 - DNA, 15 bp, Homo sapiens
gaataatgaaaataa

SEQ ID NO: 4669424 - DNA, 18 bp, Homo sapiens
gaataatgaaaataaaac

SEQ ID NO: 4669425 - DNA, 18 bp, Homo sapiens
gaatacattttattctgt

SEQ ID NO: 4669426 - DNA, 13 bp, Homo sapiens
gaatactcttgaa

SEQ ID NO: 4669427 - DNA, 21 bp, Homo sapiens
gaatacttattttcagtgcat

SEQ ID NO: 4669428 - DNA, 14 bp, Homo sapiens
gaatacttgaagaa

SEQ ID NO: 4669429 - DNA, 19 bp, Homo sapiens
gaatagttcaggagacttt

SEQ ID NO: 4669430 - DNA, 15 bp, Homo sapiens
gaatataagaaaagt

SEQ ID NO: 4669431 - DNA, 22 bp, Homo sapiens
gaatataagaaaagtaatgaag

SEQ ID NO: 4669432 - DNA, 14 bp, Homo sapiens
gaatatacatagtc

SEQ ID NO: 4669433 - DNA, 21 bp, Homo sapiens
gaatatacatagtctttgttt

SEQ ID NO: 4669434 - DNA, 16 bp, Homo sapiens
gaatatcattgatttt

SEQ ID NO: 4669435 - DNA, 12 bp, Homo sapiens
gaatatttacta

SEQ ID NO: 4669436 - DNA, 13 bp, Homo sapiens
gaatcatgtctgt

SEQ ID NO: 4669437 - DNA, 14 bp, Homo sapiens
gaatcatgtctgta

SEQ ID NO: 4669438 - DNA, 21 bp, Homo sapiens
gaatcatgtctgtatccccag

SEQ ID NO: 4669439 - DNA, 14 bp, Homo sapiens
gaatcatttttgta

SEQ ID NO: 4669440 - DNA, 16 bp, Homo sapiens
gaatcatttttgtagg

SEQ ID NO: 4669441 - DNA, 21 bp, Homo sapiens
gaatcatttttgtaggaagca

SEQ ID NO: 4669442 - DNA, 17 bp, Homo sapiens
gaatccatgggtctggc

SEQ ID NO: 4669443 - DNA, 18 bp, Homo sapiens
gaatcccacccacatgtg

SEQ ID NO: 4669444 - DNA, 22 bp, Homo sapiens
gaatcccacccacatgtgacac

SEQ ID NO: 4669445 - DNA, 21 bp, Homo sapiens
gaatcccgtcggcttctcgac

SEQ ID NO: 4669446 - DNA, 19 bp, Homo sapiens
gaatctgcttttcctctgc

SEQ ID NO: 4669447 - DNA, 18 bp, Homo sapiens
gaatgagagcgacacaga

SEQ ID NO: 4669448 - DNA, 19 bp, Homo sapiens
gaatgagagcgacacagac

SEQ ID NO: 4669449 - DNA, 22 bp, Homo sapiens
gaatgagcctacgctgaagatg

SEQ ID NO: 4669450 - DNA, 21 bp, Homo sapiens
gaatgagtgaagtattgctga

SEQ ID NO: 4669451 - DNA, 14 bp, Homo sapiens
gaatgagtgtgcat

SEQ ID NO: 4669452 - DNA, 24 bp, Homo sapiens
gaatgccactttggctgaactaca

SEQ ID NO: 4669453 - DNA, 17 bp, Homo sapiens
gaatgcctcctgtgggg

SEQ ID NO: 4669454 - DNA, 12 bp, Homo sapiens
gaatgcctcgct

SEQ ID NO: 4669455 - DNA, 17 bp, Homo sapiens
gaatgcctcgctccctt

SEQ ID NO: 4669456 - DNA, 17 bp, Homo sapiens
gaatggaggagccaggc

SEQ ID NO: 4669457 - DNA, 20 bp, Homo sapiens
gaatggaggagccaggcccc

SEQ ID NO: 4669458 - DNA, 15 bp, Homo sapiens
gaatgtccccttagg

SEQ ID NO: 4669459 - DNA, 15 bp, Homo sapiens
gaatgtgggcactgg

SEQ ID NO: 4669460 - DNA, 15 bp, Homo sapiens
gaatgtggtctcagg

SEQ ID NO: 4669461 - DNA, 17 bp, Homo sapiens
gaatgtgtgtgtgtggc

SEQ ID NO: 4669462 - DNA, 21 bp, Homo sapiens
gaatgtgtgtgtgtggcaggg

SEQ ID NO: 4669463 - DNA, 14 bp, Homo sapiens
gaatgtgtttcaaa

SEQ ID NO: 4669464 - DNA, 22 bp, Homo sapiens
gaatgtgtttcaaaaccatgcc

SEQ ID NO: 4669465 - DNA, 16 bp, Homo sapiens
gaatgtttgtgtctgt

SEQ ID NO: 4669466 - DNA, 18 bp, Homo sapiens
gaatgtttgtgtctgtgg

SEQ ID NO: 4669467 - DNA, 20 bp, Homo sapiens
gaatgtttgtgtctgtggtt

SEQ ID NO: 4669468 - DNA, 15 bp, Homo sapiens
gaattataaatgtgt

SEQ ID NO: 4669469 - DNA, 23 bp, Homo sapiens
gaattatacagacctaatatcat

SEQ ID NO: 4669470 - DNA, 17 bp, Homo sapiens
gaattcagtgccttcaa

SEQ ID NO: 4669471 - DNA, 23 bp, Homo sapiens
gaattcatactctgttgcctcct

SEQ ID NO: 4669472 - DNA, 15 bp, Homo sapiens
gaattccttcgaaag

SEQ ID NO: 4669473 - DNA, 19 bp, Homo sapiens
gaattccttcgaaaggcct

SEQ ID NO: 4669474 - DNA, 21 bp, Homo sapiens
gaattccttcgaaaggccttc

SEQ ID NO: 4669475 - DNA, 13 bp, Homo sapiens
gaattctaccctg

SEQ ID NO: 4669476 - DNA, 15 bp, Homo sapiens
gaattctaccctgga

SEQ ID NO: 4669477 - DNA, 9 bp, Homo sapiens
gaattgttt

SEQ ID NO: 4669478 - DNA, 15 bp, Homo sapiens
gaatttaatatatat

SEQ ID NO: 4669479 - DNA, 23 bp, Homo sapiens
gaatttgggaggaggaaaagaaa

SEQ ID NO: 4669480 - DNA, 18 bp, Homo sapiens
gaattttatttttctgtg

SEQ ID NO: 4669481 - DNA, 18 bp, Homo sapiens
gaattttcaaggccttca

SEQ ID NO: 4669482 - DNA, 12 bp, Homo sapiens
gacaaaacttct

SEQ ID NO: 4669483 - DNA, 22 bp, Homo sapiens
gacaaaacttcttgtcagacat

SEQ ID NO: 4669484 - DNA, 14 bp, Homo sapiens
gacaaaagtctgtc

SEQ ID NO: 4669485 - DNA, 18 bp, Homo sapiens
gacaaaatcatctttgtg

SEQ ID NO: 4669486 - DNA, 15 bp, Homo sapiens
gacaaaggagcctgt

SEQ ID NO: 4669487 - DNA, 19 bp, Homo sapiens
gacaaattcggatgtatga

SEQ ID NO: 4669488 - DNA, 20 bp, Homo sapiens
gacaacagcacacaggcagc

SEQ ID NO: 4669489 - DNA, 20 bp, Homo sapiens
gacaacaggtaaaacagggc

SEQ ID NO: 4669490 - DNA, 15 bp, Homo sapiens
gacaaccagaaggcc

SEQ ID NO: 4669491 - DNA, 16 bp, Homo sapiens
gacaagacagagggga

SEQ ID NO: 4669492 - DNA, 21 bp, Homo sapiens
gacaagcatggtcccacatcc

SEQ ID NO: 4669493 - DNA, 14 bp, Homo sapiens
gacaagctggccaa

SEQ ID NO: 4669494 - DNA, 14 bp, Homo sapiens
gacaaggtgctaac

SEQ ID NO: 4669495 - DNA, 16 bp, Homo sapiens
gacaagtctttctcct

SEQ ID NO: 4669496 - DNA, 20 bp, Homo sapiens
gacaagtctttctcctcttt

SEQ ID NO: 4669497 - DNA, 23 bp, Homo sapiens
gacaagtctttctcctctttgag

SEQ ID NO: 4669498 - DNA, 15 bp, Homo sapiens
gacaagtggactcag

SEQ ID NO: 4669499 - DNA, 20 bp, Homo sapiens
gacaagtggactcagggcag

SEQ ID NO: 4669500 - DNA, 12 bp, Homo sapiens
gacacaggcctg

SEQ ID NO: 4669501 - DNA, 21 bp, Homo sapiens
gacacaggcctgtgtagctgt

SEQ ID NO: 4669502 - DNA, 18 bp, Homo sapiens
gacacagttatcaaaaag

SEQ ID NO: 4669503 - DNA, 13 bp, Homo sapiens
gacacagttcctg

SEQ ID NO: 4669504 - DNA, 14 bp, Homo sapiens
gacacagttcctgg

SEQ ID NO: 4669505 - DNA, 14 bp, Homo sapiens
gacacccaaagggt

SEQ ID NO: 4669506 - DNA, 21 bp, Homo sapiens
gacaccctggcctgaactgag

SEQ ID NO: 4669507 - DNA, 19 bp, Homo sapiens
gacacgagccacaagctgc

SEQ ID NO: 4669508 - DNA, 17 bp, Homo sapiens
gacacgtggcctcgtga

SEQ ID NO: 4669509 - DNA, 14 bp, Homo sapiens
gacactaactttgt

SEQ ID NO: 4669510 - DNA, 18 bp, Homo sapiens
gacactccaactctacac

SEQ ID NO: 4669511 - DNA, 16 bp, Homo sapiens
gacactgcagcagaaa

SEQ ID NO: 4669512 - DNA, 15 bp, Homo sapiens
gacagaaagaccctg

SEQ ID NO: 4669513 - DNA, 14 bp, Homo sapiens
gacagacagccagg

SEQ ID NO: 4669514 - DNA, 17 bp, Homo sapiens
gacagacagccaggtag

SEQ ID NO: 4669515 - DNA, 14 bp, Homo sapiens
gacagacgagacaa

SEQ ID NO: 4669516 - DNA, 18 bp, Homo sapiens
gacagacgagacaacagc

SEQ ID NO: 4669517 - DNA, 16 bp, Homo sapiens
gacagactcctgagga

SEQ ID NO: 4669518 - DNA, 19 bp, Homo sapiens
gacagactcctgaggacag

SEQ ID NO: 4669519 - DNA, 19 bp, Homo sapiens
gacagatcaagctgtgaga

SEQ ID NO: 4669520 - DNA, 23 bp, Homo sapiens
gacagatcaagctgtgagacagt

SEQ ID NO: 4669521 - DNA, 11 bp, Homo sapiens
gacagcccaga

SEQ ID NO: 4669522 - DNA, 13 bp, Homo sapiens
gacagcccagagc

SEQ ID NO: 4669523 - DNA, 19 bp, Homo sapiens
gacagcccagcgccatcct

SEQ ID NO: 4669524 - DNA, 22 bp, Homo sapiens
gacagcccaggatactggcaca

SEQ ID NO: 4669525 - DNA, 23 bp, Homo sapiens
gacagcccaggatactggcacag

SEQ ID NO: 4669526 - DNA, 20 bp, Homo sapiens
gacagcctccccctgtcccc

SEQ ID NO: 4669527 - DNA, 13 bp, Homo sapiens
gacagctgtgcct

SEQ ID NO: 4669528 - DNA, 19 bp, Homo sapiens
gacagctgtgcctcgctcc

SEQ ID NO: 4669529 - DNA, 14 bp, Homo sapiens
gacaggaaagccag

SEQ ID NO: 4669530 - DNA, 12 bp, Homo sapiens
gacaggaccctc

SEQ ID NO: 4669531 - DNA, 18 bp, Homo sapiens
gacaggaccctcaggaat

SEQ ID NO: 4669532 - DNA, 22 bp, Homo sapiens
gacaggaccctcaggaattcag

SEQ ID NO: 4669533 - DNA, 21 bp, Homo sapiens
gacaggctggctccagatgca

SEQ ID NO: 4669534 - DNA, 11 bp, Homo sapiens
gacagggccag

SEQ ID NO: 4669535 - DNA, 13 bp, Homo sapiens
gacagggccagtg

SEQ ID NO: 4669536 - DNA, 14 bp, Homo sapiens
gacagggccagtgg

SEQ ID NO: 4669537 - DNA, 16 bp, Homo sapiens
gacagggccagtgggg

SEQ ID NO: 4669538 - DNA, 19 bp, Homo sapiens
gacagggccagtggggcct

SEQ ID NO: 4669539 - DNA, 21 bp, Homo sapiens
gacagggccagtggggcctgt

SEQ ID NO: 4669540 - DNA, 16 bp, Homo sapiens
gacagggcctggagcc

SEQ ID NO: 4669541 - DNA, 17 bp, Homo sapiens
gacagggctcatttttg

SEQ ID NO: 4669542 - DNA, 17 bp, Homo sapiens
gacagtcatcatcaggg

SEQ ID NO: 4669543 - DNA, 22 bp, Homo sapiens
gacagtcatcatcagggcctgg

SEQ ID NO: 4669544 - DNA, 18 bp, Homo sapiens
gacagtcctttcccacca

SEQ ID NO: 4669545 - DNA, 12 bp, Homo sapiens
gacagtgccatc

SEQ ID NO: 4669546 - DNA, 19 bp, Homo sapiens
gacatacatgctacttttt

SEQ ID NO: 4669547 - DNA, 21 bp, Homo sapiens
gacatagagagggagaagaag

SEQ ID NO: 4669548 - DNA, 21 bp, Homo sapiens
gacatatgggatattcccaag

SEQ ID NO: 4669549 - DNA, 16 bp, Homo sapiens
gacatcattgtcagcc

SEQ ID NO: 4669550 - DNA, 22 bp, Homo sapiens
gacatcattgtcagccttgcta

SEQ ID NO: 4669551 - DNA, 19 bp, Homo sapiens
gacatccataaagaagcaa

SEQ ID NO: 4669552 - DNA, 16 bp, Homo sapiens
gacatgaagctgttgt

SEQ ID NO: 4669553 - DNA, 16 bp, Homo sapiens
gacatgcggtagccag

SEQ ID NO: 4669554 - DNA, 16 bp, Homo sapiens
gacatgcttttctgcc

SEQ ID NO: 4669555 - DNA, 21 bp, Homo sapiens
gacatgcttttctgccactcc

SEQ ID NO: 4669556 - DNA, 14 bp, Homo sapiens
gacattcacctgcc

SEQ ID NO: 4669557 - DNA, 18 bp, Homo sapiens
gacattcacctgccccaa

SEQ ID NO: 4669558 - DNA, 14 bp, Homo sapiens
gacattctacagtt

SEQ ID NO: 4669559 - DNA, 12 bp, Homo sapiens
gacattctttta

SEQ ID NO: 4669560 - DNA, 15 bp, Homo sapiens
gacattttttcagtc

SEQ ID NO: 4669561 - DNA, 20 bp, Homo sapiens
gacattttttcagtcatata

SEQ ID NO: 4669562 - DNA, 16 bp, Homo sapiens
gaccacccctctcgcc

SEQ ID NO: 4669563 - DNA, 18 bp, Homo sapiens
gaccacctcctctgccag

SEQ ID NO: 4669564 - DNA, 23 bp, Homo sapiens
gaccacctcctctgccagcagga

SEQ ID NO: 4669565 - DNA, 24 bp, Homo sapiens
gaccacctcctctgccagcaggaa

SEQ ID NO: 4669566 - DNA, 17 bp, Homo sapiens
gaccaccttcccttcct

SEQ ID NO: 4669567 - DNA, 18 bp, Homo sapiens
gaccaccttcccttcctc

SEQ ID NO: 4669568 - DNA, 24 bp, Homo sapiens
gaccacgaggctgattcctctcat

SEQ ID NO: 4669569 - DNA, 17 bp, Homo sapiens
gaccaggatggagcaag

SEQ ID NO: 4669570 - DNA, 18 bp, Homo sapiens
gaccaggatggagcaagc

SEQ ID NO: 4669571 - DNA, 13 bp, Homo sapiens
gaccagggatgct

SEQ ID NO: 4669572 - DNA, 18 bp, Homo sapiens
gaccagggatgctgggct

SEQ ID NO: 4669573 - DNA, 20 bp, Homo sapiens
gaccagggatgctgggctgg

SEQ ID NO: 4669574 - DNA, 21 bp, Homo sapiens
gaccagggatgctgggctggg

SEQ ID NO: 4669575 - DNA, 15 bp, Homo sapiens
gaccattcaattagt

SEQ ID NO: 4669576 - DNA, 12 bp, Homo sapiens
gacccagcatct

SEQ ID NO: 4669577 - DNA, 22 bp, Homo sapiens
gacccagcatctcccagcaaga

SEQ ID NO: 4669578 - DNA, 22 bp, Homo sapiens
gacccagccccttcccctggga

SEQ ID NO: 4669579 - DNA, 23 bp, Homo sapiens
gacccagccccttcccctgggaa

SEQ ID NO: 4669580 - DNA, 23 bp, Homo sapiens
gacccatgagttggggtctggca

SEQ ID NO: 4669581 - DNA, 21 bp, Homo sapiens
gaccccagctgctctaagccc

SEQ ID NO: 4669582 - DNA, 11 bp, Homo sapiens
gaccccagggc

SEQ ID NO: 4669583 - DNA, 13 bp, Homo sapiens
gaccccagggcac

SEQ ID NO: 4669584 - DNA, 17 bp, Homo sapiens
gacccccagctccggcc

SEQ ID NO: 4669585 - DNA, 23 bp, Homo sapiens
gacccccagctccggcctgtcct

SEQ ID NO: 4669586 - DNA, 15 bp, Homo sapiens
gaccccgcacccggc

SEQ ID NO: 4669587 - DNA, 20 bp, Homo sapiens
gaccccgtccacgtcctcca

SEQ ID NO: 4669588 - DNA, 14 bp, Homo sapiens
gacccctccttgtc

SEQ ID NO: 4669589 - DNA, 13 bp, Homo sapiens
gacccctggccac

SEQ ID NO: 4669590 - DNA, 12 bp, Homo sapiens
gacccctgggag

SEQ ID NO: 4669591 - DNA, 15 bp, Homo sapiens
gacccctgggagctt

SEQ ID NO: 4669592 - DNA, 23 bp, Homo sapiens
gacccgctcggacttactgcctg

SEQ ID NO: 4669593 - DNA, 20 bp, Homo sapiens
gacccggcaccccctgcagc

SEQ ID NO: 4669594 - DNA, 21 bp, Homo sapiens
gacccggcaccccctgcagct

SEQ ID NO: 4669595 - DNA, 20 bp, Homo sapiens
gaccctcgggccccatcctc

SEQ ID NO: 4669596 - DNA, 17 bp, Homo sapiens
gaccctgatgcaggtca

SEQ ID NO: 4669597 - DNA, 18 bp, Homo sapiens
gaccctgatgcaggtcag

SEQ ID NO: 4669598 - DNA, 19 bp, Homo sapiens
gaccctgcaaacagaacag

SEQ ID NO: 4669599 - DNA, 11 bp, Homo sapiens
gaccctgccct

SEQ ID NO: 4669600 - DNA, 13 bp, Homo sapiens
gaccctgcccttg

SEQ ID NO: 4669601 - DNA, 23 bp, Homo sapiens
gaccctgcccttgtttggggcag

SEQ ID NO: 4669602 - DNA, 12 bp, Homo sapiens
gaccctgggccc

SEQ ID NO: 4669603 - DNA, 20 bp, Homo sapiens
gacccttattgctgtcctgg

SEQ ID NO: 4669604 - DNA, 19 bp, Homo sapiens
gaccgctacaccactctgg

SEQ ID NO: 4669605 - DNA, 21 bp, Homo sapiens
gaccgctacaccactctggca

SEQ ID NO: 4669606 - DNA, 16 bp, Homo sapiens
gaccggtgctgcagga

SEQ ID NO: 4669607 - DNA, 20 bp, Homo sapiens
gacctaaaaaggtctgttaa

SEQ ID NO: 4669608 - DNA, 18 bp, Homo sapiens
gacctaatatcattttat

SEQ ID NO: 4669609 - DNA, 21 bp, Homo sapiens
gacctaatatcattttattca

SEQ ID NO: 4669610 - DNA, 22 bp, Homo sapiens
gacctatatctggagtgagagg

SEQ ID NO: 4669611 - DNA, 17 bp, Homo sapiens
gacctcatctgtggagc

SEQ ID NO: 4669612 - DNA, 18 bp, Homo sapiens
gacctccagctttcctgt

SEQ ID NO: 4669613 - DNA, 17 bp, Homo sapiens
gacctccttctgcaaag

SEQ ID NO: 4669614 - DNA, 21 bp, Homo sapiens
gacctgccagccactgtcacc

SEQ ID NO: 4669615 - DNA, 18 bp, Homo sapiens
gacctgcctcttccccct

SEQ ID NO: 4669616 - DNA, 10 bp, Homo sapiens
gacctgctga

SEQ ID NO: 4669617 - DNA, 16 bp, Homo sapiens
gacctgctgagctctg

SEQ ID NO: 4669618 - DNA, 18 bp, Homo sapiens
gacctgctgagctctgag

SEQ ID NO: 4669619 - DNA, 22 bp, Homo sapiens
gacctgctgagctctgagaggc

SEQ ID NO: 4669620 - DNA, 12 bp, Homo sapiens
gacctggagggg

SEQ ID NO: 4669621 - DNA, 17 bp, Homo sapiens
gacctggaggggagagg

SEQ ID NO: 4669622 - DNA, 18 bp, Homo sapiens
gacctggaggggagaggt

SEQ ID NO: 4669623 - DNA, 21 bp, Homo sapiens
gacctggaggggagaggtcag

SEQ ID NO: 4669624 - DNA, 18 bp, Homo sapiens
gacctgggacaagcaggc

SEQ ID NO: 4669625 - DNA, 16 bp, Homo sapiens
gacctgtgagcccagc

SEQ ID NO: 4669626 - DNA, 19 bp, Homo sapiens
gacctgtgagcccagctgg

SEQ ID NO: 4669627 - DNA, 19 bp, Homo sapiens
gacctgttagcagacaggc

SEQ ID NO: 4669628 - DNA, 13 bp, Homo sapiens
gaccttagcccca

SEQ ID NO: 4669629 - DNA, 16 bp, Homo sapiens
gaccttccctccgcct

SEQ ID NO: 4669630 - DNA, 18 bp, Homo sapiens
gaccttggaatcgtccct

SEQ ID NO: 4669631 - DNA, 20 bp, Homo sapiens
gaccttggaatcgtccctat

SEQ ID NO: 4669632 - DNA, 21 bp, Homo sapiens
gacgaacttccatggccctca

SEQ ID NO: 4669633 - DNA, 17 bp, Homo sapiens
gacgactgcaaagccag

SEQ ID NO: 4669634 - DNA, 21 bp, Homo sapiens
gacgagacaacagcacacagg

SEQ ID NO: 4669635 - DNA, 16 bp, Homo sapiens
gacgcacacagctgag

SEQ ID NO: 4669636 - DNA, 22 bp, Homo sapiens
gacgcaccgcctgaaggcacag

SEQ ID NO: 4669637 - DNA, 18 bp, Homo sapiens
gacgccacggagggctgg

SEQ ID NO: 4669638 - DNA, 15 bp, Homo sapiens
gacgccgtcccacca

SEQ ID NO: 4669639 - DNA, 19 bp, Homo sapiens
gacggctggcatggtggct

SEQ ID NO: 4669640 - DNA, 18 bp, Homo sapiens
gacgggaggggaggcatt

SEQ ID NO: 4669641 - DNA, 17 bp, Homo sapiens
gacggggtttcaccatg

SEQ ID NO: 4669642 - DNA, 16 bp, Homo sapiens
gacggtgcagtctggg

SEQ ID NO: 4669643 - DNA, 23 bp, Homo sapiens
gacggtgttttgccatgttggcc

SEQ ID NO: 4669644 - DNA, 16 bp, Homo sapiens
gacgtggctcagccag

SEQ ID NO: 4669645 - DNA, 16 bp, Homo sapiens
gactaacactcagaag

SEQ ID NO: 4669646 - DNA, 19 bp, Homo sapiens
gactaacactcagaagcct

SEQ ID NO: 4669647 - DNA, 23 bp, Homo sapiens
gactaattttacatgtttataaa

SEQ ID NO: 4669648 - DNA, 17 bp, Homo sapiens
gactacaaaataaaact

SEQ ID NO: 4669649 - DNA, 16 bp, Homo sapiens
gactatataatttatt

SEQ ID NO: 4669650 - DNA, 16 bp, Homo sapiens
gactattcatggctac

SEQ ID NO: 4669651 - DNA, 22 bp, Homo sapiens
gactcaatgtggaaaaaatatt

SEQ ID NO: 4669652 - DNA, 12 bp, Homo sapiens
gactcacctgcg

SEQ ID NO: 4669653 - DNA, 22 bp, Homo sapiens
gactcacctgcgcaagtgcctg

SEQ ID NO: 4669654 - DNA, 15 bp, Homo sapiens
gactcactcataaag

SEQ ID NO: 4669655 - DNA, 20 bp, Homo sapiens
gactcagggaccggtgctgc

SEQ ID NO: 4669656 - DNA, 22 bp, Homo sapiens
gactcagggaccggtgctgcag

SEQ ID NO: 4669657 - DNA, 16 bp, Homo sapiens
gactcagggcagcgcc

SEQ ID NO: 4669658 - DNA, 18 bp, Homo sapiens
gactcagggcagcgccag

SEQ ID NO: 4669659 - DNA, 16 bp, Homo sapiens
gactcagttttttgta

SEQ ID NO: 4669660 - DNA, 17 bp, Homo sapiens
gactcagttttttgtaa

SEQ ID NO: 4669661 - DNA, 14 bp, Homo sapiens
gactcatccttgcc

SEQ ID NO: 4669662 - DNA, 15 bp, Homo sapiens
gactcatccttgccc

SEQ ID NO: 4669663 - DNA, 23 bp, Homo sapiens
gactccacggatgcgtgggcaga

SEQ ID NO: 4669664 - DNA, 20 bp, Homo sapiens
gactccgaggtggttcagac

SEQ ID NO: 4669665 - DNA, 16 bp, Homo sapiens
gactctaggttataca

SEQ ID NO: 4669666 - DNA, 19 bp, Homo sapiens
gactctgcacatgtcttgt

SEQ ID NO: 4669667 - DNA, 13 bp, Homo sapiens
gactctggccctg

SEQ ID NO: 4669668 - DNA, 17 bp, Homo sapiens
gactctggccctggccc

SEQ ID NO: 4669669 - DNA, 18 bp, Homo sapiens
gactcttcgatgtgccca

SEQ ID NO: 4669670 - DNA, 19 bp, Homo sapiens
gactgaagcgaacatcttc

SEQ ID NO: 4669671 - DNA, 21 bp, Homo sapiens
gactgaagcgaacatcttcat

SEQ ID NO: 4669672 - DNA, 13 bp, Homo sapiens
gactgagaacttt

SEQ ID NO: 4669673 - DNA, 13 bp, Homo sapiens
gactgccaagcca

SEQ ID NO: 4669674 - DNA, 14 bp, Homo sapiens
gactgccaagccag

SEQ ID NO: 4669675 - DNA, 15 bp, Homo sapiens
gactgccaagccaga

SEQ ID NO: 4669676 - DNA, 16 bp, Homo sapiens
gactgccaagccagat

SEQ ID NO: 4669677 - DNA, 16 bp, Homo sapiens
gactgccctgcccagg

SEQ ID NO: 4669678 - DNA, 19 bp, Homo sapiens
gactgctggacataaatca

SEQ ID NO: 4669679 - DNA, 16 bp, Homo sapiens
gactggaggcccctgg

SEQ ID NO: 4669680 - DNA, 20 bp, Homo sapiens
gactggaggcccctggagcc

SEQ ID NO: 4669681 - DNA, 11 bp, Homo sapiens
gactgtagaaa

SEQ ID NO: 4669682 - DNA, 17 bp, Homo sapiens
gactgtcacttgctgct

SEQ ID NO: 4669683 - DNA, 13 bp, Homo sapiens
gactgtcagttct

SEQ ID NO: 4669684 - DNA, 16 bp, Homo sapiens
gactgtcctagccagg

SEQ ID NO: 4669685 - DNA, 17 bp, Homo sapiens
gactgtcgccacacgcc

SEQ ID NO: 4669686 - DNA, 18 bp, Homo sapiens
gactgtcgccacacgcct

SEQ ID NO: 4669687 - DNA, 23 bp, Homo sapiens
gactgtcgccacacgcctctgtg

SEQ ID NO: 4669688 - DNA, 18 bp, Homo sapiens
gactgtgaacagcttgct

SEQ ID NO: 4669689 - DNA, 21 bp, Homo sapiens
gactgtgaacttgactgggtg

SEQ ID NO: 4669690 - DNA, 17 bp, Homo sapiens
gactgtggtgacttctg

SEQ ID NO: 4669691 - DNA, 14 bp, Homo sapiens
gactgtgtctgaat

SEQ ID NO: 4669692 - DNA, 21 bp, Homo sapiens
gactgttacagactgaaaggt

SEQ ID NO: 4669693 - DNA, 13 bp, Homo sapiens
gactgttgtccct

SEQ ID NO: 4669694 - DNA, 14 bp, Homo sapiens
gactgttgtccctg

SEQ ID NO: 4669695 - DNA, 15 bp, Homo sapiens
gactgtttcacattg

SEQ ID NO: 4669696 - DNA, 13 bp, Homo sapiens
gactgttttgaaa

SEQ ID NO: 4669697 - DNA, 14 bp, Homo sapiens
gacttactgcctga

SEQ ID NO: 4669698 - DNA, 21 bp, Homo sapiens
gacttactgcctgaccttgga

SEQ ID NO: 4669699 - DNA, 18 bp, Homo sapiens
gacttattgccaaaaaca

SEQ ID NO: 4669700 - DNA, 18 bp, Homo sapiens
gacttatttctgctctgg

SEQ ID NO: 4669701 - DNA, 19 bp, Homo sapiens
gacttatttctgctctgga

SEQ ID NO: 4669702 - DNA, 24 bp, Homo sapiens
gacttcatctcccacctagcagca

SEQ ID NO: 4669703 - DNA, 13 bp, Homo sapiens
gacttctgctgct

SEQ ID NO: 4669704 - DNA, 17 bp, Homo sapiens
gacttctgctgctggcc

SEQ ID NO: 4669705 - DNA, 18 bp, Homo sapiens
gacttgggcacccccagc

SEQ ID NO: 4669706 - DNA, 19 bp, Homo sapiens
gacttgggcacccccagcc

SEQ ID NO: 4669707 - DNA, 21 bp, Homo sapiens
gacttgggcacccccagcctg

SEQ ID NO: 4669708 - DNA, 22 bp, Homo sapiens
gacttgggcacccccagcctgg

SEQ ID NO: 4669709 - DNA, 20 bp, Homo sapiens
gacttggggagatggagttc

SEQ ID NO: 4669710 - DNA, 14 bp, Homo sapiens
gacttgtctgcctc

SEQ ID NO: 4669711 - DNA, 20 bp, Homo sapiens
gacttgtctgcctcctgctt

SEQ ID NO: 4669712 - DNA, 12 bp, Homo sapiens
gacttgtgtctg

SEQ ID NO: 4669713 - DNA, 22 bp, Homo sapiens
gactttatctaatacctctgtg

SEQ ID NO: 4669714 - DNA, 15 bp, Homo sapiens
gactttctcctggcc

SEQ ID NO: 4669715 - DNA, 19 bp, Homo sapiens
gactttgtgttcatttcat

SEQ ID NO: 4669716 - DNA, 13 bp, Homo sapiens
gactttttataaa

SEQ ID NO: 4669717 - DNA, 16 bp, Homo sapiens
gagaaacagctcagcc

SEQ ID NO: 4669718 - DNA, 17 bp, Homo sapiens
gagaaacagctcagcca

SEQ ID NO: 4669719 - DNA, 15 bp, Homo sapiens
gagaaagagagaagc

SEQ ID NO: 4669720 - DNA, 17 bp, Homo sapiens
gagaaagagctgcctgg

SEQ ID NO: 4669721 - DNA, 13 bp, Homo sapiens
gagaaatagctga

SEQ ID NO: 4669722 - DNA, 12 bp, Homo sapiens
gagaacagtggt

SEQ ID NO: 4669723 - DNA, 21 bp, Homo sapiens
gagaacagtggttgcctgggg

SEQ ID NO: 4669724 - DNA, 16 bp, Homo sapiens
gagaacctggccttca

SEQ ID NO: 4669725 - DNA, 20 bp, Homo sapiens
gagaagcacagctcctgcca

SEQ ID NO: 4669726 - DNA, 11 bp, Homo sapiens
gagaagccagc

SEQ ID NO: 4669727 - DNA, 13 bp, Homo sapiens
gagaagccagcca

SEQ ID NO: 4669728 - DNA, 14 bp, Homo sapiens
gagaagccagccac

SEQ ID NO: 4669729 - DNA, 15 bp, Homo sapiens
gagaagccagccaca

SEQ ID NO: 4669730 - DNA, 16 bp, Homo sapiens
gagaagccagccacag

SEQ ID NO: 4669731 - DNA, 19 bp, Homo sapiens
gagaagccagccacagacc

SEQ ID NO: 4669732 - DNA, 13 bp, Homo sapiens
gagaagctctgaa

SEQ ID NO: 4669733 - DNA, 12 bp, Homo sapiens
gagaagctcttc

SEQ ID NO: 4669734 - DNA, 12 bp, Homo sapiens
gagaagctgctc

SEQ ID NO: 4669735 - DNA, 20 bp, Homo sapiens
gagaagctgctccaggcctg

SEQ ID NO: 4669736 - DNA, 22 bp, Homo sapiens
gagaatatttactaactaaata

SEQ ID NO: 4669737 - DNA, 22 bp, Homo sapiens
gagaatgagagcgacacagacg

SEQ ID NO: 4669738 - DNA, 13 bp, Homo sapiens
gagaattggctca

SEQ ID NO: 4669739 - DNA, 16 bp, Homo sapiens
gagacaaggtgctaac

SEQ ID NO: 4669740 - DNA, 17 bp, Homo sapiens
gagacacaggatgaagc

SEQ ID NO: 4669741 - DNA, 18 bp, Homo sapiens
gagacacaggatgaagca

SEQ ID NO: 4669742 - DNA, 23 bp, Homo sapiens
gagacactcccccctccattccc

SEQ ID NO: 4669743 - DNA, 15 bp, Homo sapiens
gagacagaggatgtg

SEQ ID NO: 4669744 - DNA, 19 bp, Homo sapiens
gagacagcttgatcaaagg

SEQ ID NO: 4669745 - DNA, 14 bp, Homo sapiens
gagacagtgggaaa

SEQ ID NO: 4669746 - DNA, 15 bp, Homo sapiens
gagacagtgggaaat

SEQ ID NO: 4669747 - DNA, 16 bp, Homo sapiens
gagacagtgggaaata

SEQ ID NO: 4669748 - DNA, 12 bp, Homo sapiens
gagacagtgttt

SEQ ID NO: 4669749 - DNA, 22 bp, Homo sapiens
gagacccaaagcggtccctgtc

SEQ ID NO: 4669750 - DNA, 14 bp, Homo sapiens
gagacccagcccct

SEQ ID NO: 4669751 - DNA, 17 bp, Homo sapiens
gagacccagccccttcc

SEQ ID NO: 4669752 - DNA, 19 bp, Homo sapiens
gagacccagccccttcccc

SEQ ID NO: 4669753 - DNA, 23 bp, Homo sapiens
gagacccagccccttcccctggg

SEQ ID NO: 4669754 - DNA, 20 bp, Homo sapiens
gagaccccagtcaagctcct

SEQ ID NO: 4669755 - DNA, 20 bp, Homo sapiens
gagaccccagtcgtgatgtg

SEQ ID NO: 4669756 - DNA, 18 bp, Homo sapiens
gagaccccagtgcctgca

SEQ ID NO: 4669757 - DNA, 19 bp, Homo sapiens
gagacgcacacagctgagc

SEQ ID NO: 4669758 - DNA, 21 bp, Homo sapiens
gagacgccacggagggctggg

SEQ ID NO: 4669759 - DNA, 15 bp, Homo sapiens
gagactgccctgccc

SEQ ID NO: 4669760 - DNA, 13 bp, Homo sapiens
gagacttgagtga

SEQ ID NO: 4669761 - DNA, 14 bp, Homo sapiens
gagactttctcctg

SEQ ID NO: 4669762 - DNA, 16 bp, Homo sapiens
gagacttttttctagt

SEQ ID NO: 4669763 - DNA, 17 bp, Homo sapiens
gagagaaagagagaagc

SEQ ID NO: 4669764 - DNA, 18 bp, Homo sapiens
gagagaaagagagaagcc

SEQ ID NO: 4669765 - DNA, 20 bp, Homo sapiens
gagagaaagagagaagccag

SEQ ID NO: 4669766 - DNA, 12 bp, Homo sapiens
gagagaagccag

SEQ ID NO: 4669767 - DNA, 14 bp, Homo sapiens
gagagaagccagcc

SEQ ID NO: 4669768 - DNA, 15 bp, Homo sapiens
gagagaagccagcca

SEQ ID NO: 4669769 - DNA, 18 bp, Homo sapiens
gagagaagccagccacag

SEQ ID NO: 4669770 - DNA, 19 bp, Homo sapiens
gagagaagccagccacaga

SEQ ID NO: 4669771 - DNA, 22 bp, Homo sapiens
gagagaatgtgtgtgtgtggca

SEQ ID NO: 4669772 - DNA, 16 bp, Homo sapiens
gagagaccacacattt

SEQ ID NO: 4669773 - DNA, 11 bp, Homo sapiens
gagagacccca

SEQ ID NO: 4669774 - DNA, 19 bp, Homo sapiens
gagagaccccgcacccggc

SEQ ID NO: 4669775 - DNA, 21 bp, Homo sapiens
gagagaccccgcacccggctc

SEQ ID NO: 4669776 - DNA, 16 bp, Homo sapiens
gagagagagtgtgtgt

SEQ ID NO: 4669777 - DNA, 13 bp, Homo sapiens
gagagagccagga

SEQ ID NO: 4669778 - DNA, 13 bp, Homo sapiens
gagagagctggag

SEQ ID NO: 4669779 - DNA, 14 bp, Homo sapiens
gagagccaggatgc

SEQ ID NO: 4669780 - DNA, 19 bp, Homo sapiens
gagagccaggatgcccaga

SEQ ID NO: 4669781 - DNA, 19 bp, Homo sapiens
gagagccctgaggcctaga

SEQ ID NO: 4669782 - DNA, 15 bp, Homo sapiens
gagagccctgggacc

SEQ ID NO: 4669783 - DNA, 14 bp, Homo sapiens
gagagcgacacaga

SEQ ID NO: 4669784 - DNA, 16 bp, Homo sapiens
gagagcgacacagacg

SEQ ID NO: 4669785 - DNA, 19 bp, Homo sapiens
gagagctaggagcaaagcc

SEQ ID NO: 4669786 - DNA, 22 bp, Homo sapiens
gagaggaaataacagagagaat

SEQ ID NO: 4669787 - DNA, 21 bp, Homo sapiens
gagaggccctggatcagcgtg

SEQ ID NO: 4669788 - DNA, 24 bp, Homo sapiens
gagaggccctggatcagcgtggcc

SEQ ID NO: 4669789 - DNA, 13 bp, Homo sapiens
gagaggcttccct

SEQ ID NO: 4669790 - DNA, 15 bp, Homo sapiens
gagagggacaggcac

SEQ ID NO: 4669791 - DNA, 23 bp, Homo sapiens
gagagggagaagaagtcagagag

SEQ ID NO: 4669792 - DNA, 21 bp, Homo sapiens
gagaggtcaccagctgctgtg

SEQ ID NO: 4669793 - DNA, 14 bp, Homo sapiens
gagatactggtgga

SEQ ID NO: 4669794 - DNA, 15 bp, Homo sapiens
gagatactggtggaa

SEQ ID NO: 4669795 - DNA, 12 bp, Homo sapiens
gagatagcattg

SEQ ID NO: 4669796 - DNA, 20 bp, Homo sapiens
gagatagcattgtgaactga

SEQ ID NO: 4669797 - DNA, 17 bp, Homo sapiens
gagatatggcattgcac

SEQ ID NO: 4669798 - DNA, 21 bp, Homo sapiens
gagatatttaggaaaatgctt

SEQ ID NO: 4669799 - DNA, 15 bp, Homo sapiens
gagatcacagcccca

SEQ ID NO: 4669800 - DNA, 23 bp, Homo sapiens
gagatcagggcctgccccctggg

SEQ ID NO: 4669801 - DNA, 15 bp, Homo sapiens
gagatcccaggaggt

SEQ ID NO: 4669802 - DNA, 17 bp, Homo sapiens
gagatcgacagacagcc

SEQ ID NO: 4669803 - DNA, 20 bp, Homo sapiens
gagatcgacagacagccagg

SEQ ID NO: 4669804 - DNA, 17 bp, Homo sapiens
gagatctggggaggcag

SEQ ID NO: 4669805 - DNA, 23 bp, Homo sapiens
gagatctggggaggcaggcattc

SEQ ID NO: 4669806 - DNA, 22 bp, Homo sapiens
gagatgaccagggatgctgggc

SEQ ID NO: 4669807 - DNA, 12 bp, Homo sapiens
gagatgagccca

SEQ ID NO: 4669808 - DNA, 13 bp, Homo sapiens
gagatgagcccac

SEQ ID NO: 4669809 - DNA, 13 bp, Homo sapiens
gagatgcagctgg

SEQ ID NO: 4669810 - DNA, 14 bp, Homo sapiens
gagatggagggctt

SEQ ID NO: 4669811 - DNA, 17 bp, Homo sapiens
gagatggagggcttggc

SEQ ID NO: 4669812 - DNA, 21 bp, Homo sapiens
gagatggagtctcactcttgt

SEQ ID NO: 4669813 - DNA, 16 bp, Homo sapiens
gagatgggccaggcag

SEQ ID NO: 4669814 - DNA, 17 bp, Homo sapiens
gagatgggccaggcaga

SEQ ID NO: 4669815 - DNA, 15 bp, Homo sapiens
gagatgtagaaagtt

SEQ ID NO: 4669816 - DNA, 13 bp, Homo sapiens
gagatgtctagag

SEQ ID NO: 4669817 - DNA, 13 bp, Homo sapiens
gagattgtactgt

SEQ ID NO: 4669818 - DNA, 14 bp, Homo sapiens
gagattttcatttt

SEQ ID NO: 4669819 - DNA, 15 bp, Homo sapiens
gagattttcatttta

SEQ ID NO: 4669820 - DNA, 19 bp, Homo sapiens
gagatttttaaaaaatatt

SEQ ID NO: 4669821 - DNA, 23 bp, Homo sapiens
gagcaaagcctgttcatggcaga

SEQ ID NO: 4669822 - DNA, 18 bp, Homo sapiens
gagcaagttccttctggt

SEQ ID NO: 4669823 - DNA, 14 bp, Homo sapiens
gagcactgccagga

SEQ ID NO: 4669824 - DNA, 15 bp, Homo sapiens
gagcactgccaggag

SEQ ID NO: 4669825 - DNA, 14 bp, Homo sapiens
gagcacttagcagg

SEQ ID NO: 4669826 - DNA, 18 bp, Homo sapiens
gagcacttgagctgtctg

SEQ ID NO: 4669827 - DNA, 12 bp, Homo sapiens
gagcagccctgg

SEQ ID NO: 4669828 - DNA, 23 bp, Homo sapiens
gagcagccctggcccccatcagc

SEQ ID NO: 4669829 - DNA, 24 bp, Homo sapiens
gagcagccctggcccccatcagcc

SEQ ID NO: 4669830 - DNA, 22 bp, Homo sapiens
gagcagctgaataacctgcaca

SEQ ID NO: 4669831 - DNA, 15 bp, Homo sapiens
gagcagctgagcagg

SEQ ID NO: 4669832 - DNA, 20 bp, Homo sapiens
gagcagctgagcagggccgg

SEQ ID NO: 4669833 - DNA, 11 bp, Homo sapiens
gagcaggagcc

SEQ ID NO: 4669834 - DNA, 13 bp, Homo sapiens
gagcaggagcccc

SEQ ID NO: 4669835 - DNA, 20 bp, Homo sapiens
gagcaggttccccaagggcc

SEQ ID NO: 4669836 - DNA, 16 bp, Homo sapiens
gagcatcatgcctctg

SEQ ID NO: 4669837 - DNA, 16 bp, Homo sapiens
gagcatgatgggaggt

SEQ ID NO: 4669838 - DNA, 22 bp, Homo sapiens
gagccaaccttgctcttgggga

SEQ ID NO: 4669839 - DNA, 15 bp, Homo sapiens
gagccacaagctgca

SEQ ID NO: 4669840 - DNA, 16 bp, Homo sapiens
gagccacaagctgcac

SEQ ID NO: 4669841 - DNA, 20 bp, Homo sapiens
gagccacaagctgcactgtg

SEQ ID NO: 4669842 - DNA, 20 bp, Homo sapiens
gagccacctgcaagatggac

SEQ ID NO: 4669843 - DNA, 12 bp, Homo sapiens
gagccaggcccc

SEQ ID NO: 4669844 - DNA, 14 bp, Homo sapiens
gagccaggccccac

SEQ ID NO: 4669845 - DNA, 20 bp, Homo sapiens
gagccatgagtatgccactg

SEQ ID NO: 4669846 - DNA, 14 bp, Homo sapiens
gagcccagagaaca

SEQ ID NO: 4669847 - DNA, 16 bp, Homo sapiens
gagcccagagaacagc

SEQ ID NO: 4669848 - DNA, 17 bp, Homo sapiens
gagcccagcggcccaag

SEQ ID NO: 4669849 - DNA, 22 bp, Homo sapiens
gagcccagctgggtcaggcagg

SEQ ID NO: 4669850 - DNA, 20 bp, Homo sapiens
gagcccagggaggccgaagc

SEQ ID NO: 4669851 - DNA, 17 bp, Homo sapiens
gagcccattaatcttga

SEQ ID NO: 4669852 - DNA, 19 bp, Homo sapiens
gagcccattaatcttgatc

SEQ ID NO: 4669853 - DNA, 18 bp, Homo sapiens
gagcccccagccctggga

SEQ ID NO: 4669854 - DNA, 20 bp, Homo sapiens
gagcccctcctccagcccct

SEQ ID NO: 4669855 - DNA, 20 bp, Homo sapiens
gagccccttctgctcagctc

SEQ ID NO: 4669856 - DNA, 22 bp, Homo sapiens
gagcccgtgccacccccagccc

SEQ ID NO: 4669857 - DNA, 12 bp, Homo sapiens
gagccctgggac

SEQ ID NO: 4669858 - DNA, 15 bp, Homo sapiens
gagcctccctgcctc

SEQ ID NO: 4669859 - DNA, 19 bp, Homo sapiens
gagcctcgcaacccgtgcc

SEQ ID NO: 4669860 - DNA, 20 bp, Homo sapiens
gagcctcgcaacccgtgcca

SEQ ID NO: 4669861 - DNA, 23 bp, Homo sapiens
gagcctcgcaacccgtgccaagt

SEQ ID NO: 4669862 - DNA, 14 bp, Homo sapiens
gagcctcgctctgt

SEQ ID NO: 4669863 - DNA, 16 bp, Homo sapiens
gagcctgccgagcaac

SEQ ID NO: 4669864 - DNA, 21 bp, Homo sapiens
gagcctgccgagcaaccgtgg

SEQ ID NO: 4669865 - DNA, 22 bp, Homo sapiens
gagcctgccgagcaaccgtggc

SEQ ID NO: 4669866 - DNA, 16 bp, Homo sapiens
gagcctggctgcccat

SEQ ID NO: 4669867 - DNA, 17 bp, Homo sapiens
gagcctgggctcatagt

SEQ ID NO: 4669868 - DNA, 18 bp, Homo sapiens
gagcctgtgaacccagga

SEQ ID NO: 4669869 - DNA, 19 bp, Homo sapiens
gagcctgtgaacccaggac

SEQ ID NO: 4669870 - DNA, 23 bp, Homo sapiens
gagcctgtgaacccaggacaagc

SEQ ID NO: 4669871 - DNA, 22 bp, Homo sapiens
gagccttgacaatgttgtcctc

SEQ ID NO: 4669872 - DNA, 13 bp, Homo sapiens
gagcgacacagac

SEQ ID NO: 4669873 - DNA, 14 bp, Homo sapiens
gagcgccctgcaga

SEQ ID NO: 4669874 - DNA, 16 bp, Homo sapiens
gagcgccctgcagacc

SEQ ID NO: 4669875 - DNA, 20 bp, Homo sapiens
gagcgccctgcagaccctgc

SEQ ID NO: 4669876 - DNA, 22 bp, Homo sapiens
gagcgccctgcagaccctgccc

SEQ ID NO: 4669877 - DNA, 12 bp, Homo sapiens
gagcgggatggg

SEQ ID NO: 4669878 - DNA, 16 bp, Homo sapiens
gagcgtcaaagaaaat

SEQ ID NO: 4669879 - DNA, 18 bp, Homo sapiens
gagcgtcaaagaaaatgc

SEQ ID NO: 4669880 - DNA, 14 bp, Homo sapiens
gagcgtgggctcag

SEQ ID NO: 4669881 - DNA, 23 bp, Homo sapiens
gagcgtgggctcagcagggctgg

SEQ ID NO: 4669882 - DNA, 20 bp, Homo sapiens
gagctacctgtgtggacagg

SEQ ID NO: 4669883 - DNA, 20 bp, Homo sapiens
gagctactccccacctccca

SEQ ID NO: 4669884 - DNA, 14 bp, Homo sapiens
gagctactgagaac

SEQ ID NO: 4669885 - DNA, 19 bp, Homo sapiens
gagctagaaaaataaaatg

SEQ ID NO: 4669886 - DNA, 21 bp, Homo sapiens
gagctatttccttccagcctt

SEQ ID NO: 4669887 - DNA, 18 bp, Homo sapiens
gagctcaacggtctggca

SEQ ID NO: 4669888 - DNA, 14 bp, Homo sapiens
gagctcacaaggca

SEQ ID NO: 4669889 - DNA, 18 bp, Homo sapiens
gagctcacaaggcagcaa

SEQ ID NO: 4669890 - DNA, 21 bp, Homo sapiens
gagctcacaaggcagcaaggc

SEQ ID NO: 4669891 - DNA, 22 bp, Homo sapiens
gagctcacaaggcagcaaggcc

SEQ ID NO: 4669892 - DNA, 17 bp, Homo sapiens
gagctcatcccccctgc

SEQ ID NO: 4669893 - DNA, 22 bp, Homo sapiens
gagctcatcccccctgctgccc

SEQ ID NO: 4669894 - DNA, 12 bp, Homo sapiens
gagctctgagag

SEQ ID NO: 4669895 - DNA, 17 bp, Homo sapiens
gagctctgagaggccct

SEQ ID NO: 4669896 - DNA, 18 bp, Homo sapiens
gagctctgagaggccctg

SEQ ID NO: 4669897 - DNA, 19 bp, Homo sapiens
gagctgcaggggcatggga

SEQ ID NO: 4669898 - DNA, 12 bp, Homo sapiens
gagctgccaaga

SEQ ID NO: 4669899 - DNA, 15 bp, Homo sapiens
gagctgcccctctct

SEQ ID NO: 4669900 - DNA, 19 bp, Homo sapiens
gagctgcccctctctgggc

SEQ ID NO: 4669901 - DNA, 17 bp, Homo sapiens
gagctggcttcggagat

SEQ ID NO: 4669902 - DNA, 17 bp, Homo sapiens
gagctggggactcaggg

SEQ ID NO: 4669903 - DNA, 18 bp, Homo sapiens
gagctgtctgaagcccaa

SEQ ID NO: 4669904 - DNA, 22 bp, Homo sapiens
gagctgtctgaagcccaaagcc

SEQ ID NO: 4669905 - DNA, 23 bp, Homo sapiens
gagcttccgctttgaaagaagca

SEQ ID NO: 4669906 - DNA, 22 bp, Homo sapiens
gagcttttatttggtgtgttcg

SEQ ID NO: 4669907 - DNA, 19 bp, Homo sapiens
gaggaaataacagagagaa

SEQ ID NO: 4669908 - DNA, 13 bp, Homo sapiens
gaggaagagccac

SEQ ID NO: 4669909 - DNA, 16 bp, Homo sapiens
gaggaagagccacctg

SEQ ID NO: 4669910 - DNA, 18 bp, Homo sapiens
gaggaagagccacctgca

SEQ ID NO: 4669911 - DNA, 22 bp, Homo sapiens
gaggaagccaggtccacggtct

SEQ ID NO: 4669912 - DNA, 15 bp, Homo sapiens
gaggaatacatttta

SEQ ID NO: 4669913 - DNA, 18 bp, Homo sapiens
gaggaatgctggactgga

SEQ ID NO: 4669914 - DNA, 22 bp, Homo sapiens
gaggaatttatacctcaaacta

SEQ ID NO: 4669915 - DNA, 13 bp, Homo sapiens
gaggacaaaactt

SEQ ID NO: 4669916 - DNA, 23 bp, Homo sapiens
gaggacaaaacttcttgtcagac

SEQ ID NO: 4669917 - DNA, 18 bp, Homo sapiens
gaggaccagtcaggatga

SEQ ID NO: 4669918 - DNA, 22 bp, Homo sapiens
gaggaccagtcaggatgaggcc

SEQ ID NO: 4669919 - DNA, 21 bp, Homo sapiens
gaggaccccttaatcttgctt

SEQ ID NO: 4669920 - DNA, 21 bp, Homo sapiens
gaggacccttacgtgagaaat

SEQ ID NO: 4669921 - DNA, 13 bp, Homo sapiens
gaggacctgagcc

SEQ ID NO: 4669922 - DNA, 21 bp, Homo sapiens
gaggacctgagcctgccgagc

SEQ ID NO: 4669923 - DNA, 18 bp, Homo sapiens
gaggactcccaaccctgg

SEQ ID NO: 4669924 - DNA, 12 bp, Homo sapiens
gaggagagaaga

SEQ ID NO: 4669925 - DNA, 13 bp, Homo sapiens
gaggagagagacc

SEQ ID NO: 4669926 - DNA, 14 bp, Homo sapiens
gaggagagagaccc

SEQ ID NO: 4669927 - DNA, 18 bp, Homo sapiens
gaggagatgaccagggat

SEQ ID NO: 4669928 - DNA, 14 bp, Homo sapiens
gaggagccaggccc

SEQ ID NO: 4669929 - DNA, 17 bp, Homo sapiens
gaggagccaggccccac

SEQ ID NO: 4669930 - DNA, 22 bp, Homo sapiens
gaggagcctgtgcgtcccagct

SEQ ID NO: 4669931 - DNA, 23 bp, Homo sapiens
gaggagcctgtgcgtcccagctg

SEQ ID NO: 4669932 - DNA, 11 bp, Homo sapiens
gaggagctcaa

SEQ ID NO: 4669933 - DNA, 22 bp, Homo sapiens
gaggagctcaacggtctggcag

SEQ ID NO: 4669934 - DNA, 21 bp, Homo sapiens
gaggaggatgtccctgggcca

SEQ ID NO: 4669935 - DNA, 17 bp, Homo sapiens
gaggaggcctgcacagg

SEQ ID NO: 4669936 - DNA, 13 bp, Homo sapiens
gaggagtctgagg

SEQ ID NO: 4669937 - DNA, 18 bp, Homo sapiens
gaggagtctgaggtcctg

SEQ ID NO: 4669938 - DNA, 19 bp, Homo sapiens
gaggagtctgaggtcctga

SEQ ID NO: 4669939 - DNA, 23 bp, Homo sapiens
gaggagtctgaggtcctgagcac

SEQ ID NO: 4669940 - DNA, 11 bp, Homo sapiens
gaggcaataag

SEQ ID NO: 4669941 - DNA, 17 bp, Homo sapiens
gaggcagatgcccttgc

SEQ ID NO: 4669942 - DNA, 18 bp, Homo sapiens
gaggcagatgcccttgct

SEQ ID NO: 4669943 - DNA, 21 bp, Homo sapiens
gaggcagcatgcttgggctga

SEQ ID NO: 4669944 - DNA, 22 bp, Homo sapiens
gaggcagcatggagagaggcct

SEQ ID NO: 4669945 - DNA, 17 bp, Homo sapiens
gaggcaggcattcctga

SEQ ID NO: 4669946 - DNA, 23 bp, Homo sapiens
gaggcagggacaagtctttctcc

SEQ ID NO: 4669947 - DNA, 14 bp, Homo sapiens
gaggcagtccatct

SEQ ID NO: 4669948 - DNA, 22 bp, Homo sapiens
gaggcattacttgctttcaatt

SEQ ID NO: 4669949 - DNA, 13 bp, Homo sapiens
gaggccagcctgg

SEQ ID NO: 4669950 - DNA, 14 bp, Homo sapiens
gaggccagcctggc

SEQ ID NO: 4669951 - DNA, 17 bp, Homo sapiens
gaggccagcctggcctc

SEQ ID NO: 4669952 - DNA, 22 bp, Homo sapiens
gaggccagcctggcctcctgcc

SEQ ID NO: 4669953 - DNA, 16 bp, Homo sapiens
gaggccatctcaggag

SEQ ID NO: 4669954 - DNA, 18 bp, Homo sapiens
gaggccatctcaggagat

SEQ ID NO: 4669955 - DNA, 17 bp, Homo sapiens
gaggcccccacccttgg

SEQ ID NO: 4669956 - DNA, 18 bp, Homo sapiens
gaggcccctggagccaga

SEQ ID NO: 4669957 - DNA, 20 bp, Homo sapiens
gaggcccctgtctcagggtg

SEQ ID NO: 4669958 - DNA, 16 bp, Homo sapiens
gaggccctcctgtgct

SEQ ID NO: 4669959 - DNA, 17 bp, Homo sapiens
gaggccctcctgtgctg

SEQ ID NO: 4669960 - DNA, 14 bp, Homo sapiens
gaggccctgcacct

SEQ ID NO: 4669961 - DNA, 19 bp, Homo sapiens
gaggccctgcaccttcccc

SEQ ID NO: 4669962 - DNA, 11 bp, Homo sapiens
gaggccctgga

SEQ ID NO: 4669963 - DNA, 22 bp, Homo sapiens
gaggccctggaggtctccaggg

SEQ ID NO: 4669964 - DNA, 12 bp, Homo sapiens
gaggccctggat

SEQ ID NO: 4669965 - DNA, 13 bp, Homo sapiens
gaggccctggatc

SEQ ID NO: 4669966 - DNA, 22 bp, Homo sapiens
gaggccctggatcagcgtggcc

SEQ ID NO: 4669967 - DNA, 18 bp, Homo sapiens
gaggcctcgagcagagag

SEQ ID NO: 4669968 - DNA, 14 bp, Homo sapiens
gaggcctgcacagg

SEQ ID NO: 4669969 - DNA, 21 bp, Homo sapiens
gaggccttatgagggtcctct

SEQ ID NO: 4669970 - DNA, 20 bp, Homo sapiens
gaggctgaggctggcacagg

SEQ ID NO: 4669971 - DNA, 13 bp, Homo sapiens
gaggcttccctac

SEQ ID NO: 4669972 - DNA, 17 bp, Homo sapiens
gaggctttctgggctct

SEQ ID NO: 4669973 - DNA, 23 bp, Homo sapiens
gaggctttctgggctctggactc

SEQ ID NO: 4669974 - DNA, 20 bp, Homo sapiens
gagggaaatctgtaaagcca

SEQ ID NO: 4669975 - DNA, 14 bp, Homo sapiens
gagggaaatgtaca

SEQ ID NO: 4669976 - DNA, 20 bp, Homo sapiens
gagggaaattgtaaatcctg

SEQ ID NO: 4669977 - DNA, 16 bp, Homo sapiens
gagggacaaaggagcc

SEQ ID NO: 4669978 - DNA, 18 bp, Homo sapiens
gagggacaaaggagcctg

SEQ ID NO: 4669979 - DNA, 21 bp, Homo sapiens
gagggacaaaggagcctgtga

SEQ ID NO: 4669980 - DNA, 22 bp, Homo sapiens
gagggacaaaggagcctgtgaa

SEQ ID NO: 4669981 - DNA, 13 bp, Homo sapiens
gagggacaggctg

SEQ ID NO: 4669982 - DNA, 20 bp, Homo sapiens
gagggacaggctgaagagag

SEQ ID NO: 4669983 - DNA, 23 bp, Homo sapiens
gagggactgtcgctgcttcgtgg

SEQ ID NO: 4669984 - DNA, 13 bp, Homo sapiens
gagggagaagaag

SEQ ID NO: 4669985 - DNA, 18 bp, Homo sapiens
gagggatggagaaagaag

SEQ ID NO: 4669986 - DNA, 20 bp, Homo sapiens
gagggatggagaaagaagtg

SEQ ID NO: 4669987 - DNA, 15 bp, Homo sapiens
gagggcaagccctgc

SEQ ID NO: 4669988 - DNA, 21 bp, Homo sapiens
gagggcaagccctgcccacag

SEQ ID NO: 4669989 - DNA, 22 bp, Homo sapiens
gagggcaagccctgcccacaga

SEQ ID NO: 4669990 - DNA, 15 bp, Homo sapiens
gagggcagcagccag

SEQ ID NO: 4669991 - DNA, 21 bp, Homo sapiens
gagggcagcagccagccctgc

SEQ ID NO: 4669992 - DNA, 22 bp, Homo sapiens
gagggcagcagccagccctgcc

SEQ ID NO: 4669993 - DNA, 15 bp, Homo sapiens
gagggcagccccctc

SEQ ID NO: 4669994 - DNA, 23 bp, Homo sapiens
gagggcagtgccctttgagatct

SEQ ID NO: 4669995 - DNA, 23 bp, Homo sapiens
gagggcagttcgcagccaccctg

SEQ ID NO: 4669996 - DNA, 16 bp, Homo sapiens
gaggggagaggtcagc

SEQ ID NO: 4669997 - DNA, 16 bp, Homo sapiens
gaggggatccagccac

SEQ ID NO: 4669998 - DNA, 17 bp, Homo sapiens
gaggggatccagccact

SEQ ID NO: 4669999 - DNA, 13 bp, Homo sapiens
gaggggcagcttt

SEQ ID NO: 4670000 - DNA, 15 bp, Homo sapiens
gaggggcagggaagg

SEQ ID NO: 4670001 - DNA, 13 bp, Homo sapiens
gagggggcaagct

SEQ ID NO: 4670002 - DNA, 15 bp, Homo sapiens
gagggggcctcattg

SEQ ID NO: 4670003 - DNA, 17 bp, Homo sapiens
gagggggtcgtggagag

SEQ ID NO: 4670004 - DNA, 18 bp, Homo sapiens
gagggggtcgtggagagc

SEQ ID NO: 4670005 - DNA, 19 bp, Homo sapiens
gagggtatggtgctgctct

SEQ ID NO: 4670006 - DNA, 17 bp, Homo sapiens
gagggtttgggcagagc

SEQ ID NO: 4670007 - DNA, 17 bp, Homo sapiens
gaggtcaccagctgctg

SEQ ID NO: 4670008 - DNA, 15 bp, Homo sapiens
gaggtcaccagggga

SEQ ID NO: 4670009 - DNA, 17 bp, Homo sapiens
gaggtcagccttgacct

SEQ ID NO: 4670010 - DNA, 17 bp, Homo sapiens
gaggtcccagccctggg

SEQ ID NO: 4670011 - DNA, 20 bp, Homo sapiens
gaggtcccagccctgggggt

SEQ ID NO: 4670012 - DNA, 13 bp, Homo sapiens
gaggtcctgagca

SEQ ID NO: 4670013 - DNA, 14 bp, Homo sapiens
gaggtcctgagcac

SEQ ID NO: 4670014 - DNA, 17 bp, Homo sapiens
gaggtcctgagcactgc

SEQ ID NO: 4670015 - DNA, 20 bp, Homo sapiens
gaggtcctgagcactgccag

SEQ ID NO: 4670016 - DNA, 21 bp, Homo sapiens
gaggtcctgagcactgccagg

SEQ ID NO: 4670017 - DNA, 20 bp, Homo sapiens
gaggtctccaggggcctgca

SEQ ID NO: 4670018 - DNA, 22 bp, Homo sapiens
gaggtctccaggggcctgcaga

SEQ ID NO: 4670019 - DNA, 14 bp, Homo sapiens
gaggtctcgaccct

SEQ ID NO: 4670020 - DNA, 19 bp, Homo sapiens
gaggtgagctactttgtga

SEQ ID NO: 4670021 - DNA, 23 bp, Homo sapiens
gaggtgccacccagtagcccaga

SEQ ID NO: 4670022 - DNA, 16 bp, Homo sapiens
gaggtgcccaggagaa

SEQ ID NO: 4670023 - DNA, 23 bp, Homo sapiens
gaggtgctgtccccactgcccca

SEQ ID NO: 4670024 - DNA, 16 bp, Homo sapiens
gaggtggttcagacaa

SEQ ID NO: 4670025 - DNA, 17 bp, Homo sapiens
gaggtttggtttcctgt

SEQ ID NO: 4670026 - DNA, 21 bp, Homo sapiens
gagtaaaaaaaaaaacaatta

SEQ ID NO: 4670027 - DNA, 16 bp, Homo sapiens
gagtaaattgctctgt

SEQ ID NO: 4670028 - DNA, 17 bp, Homo sapiens
gagtaaattgctctgtt

SEQ ID NO: 4670029 - DNA, 22 bp, Homo sapiens
gagtaataagcatggtgtcagt

SEQ ID NO: 4670030 - DNA, 14 bp, Homo sapiens
gagtacaaatgcct

SEQ ID NO: 4670031 - DNA, 14 bp, Homo sapiens
gagtagcctggact

SEQ ID NO: 4670032 - DNA, 18 bp, Homo sapiens
gagtataagaaatgcata

SEQ ID NO: 4670033 - DNA, 14 bp, Homo sapiens
gagtcaacaggtca

SEQ ID NO: 4670034 - DNA, 19 bp, Homo sapiens
gagtcagatgaggccctgc

SEQ ID NO: 4670035 - DNA, 14 bp, Homo sapiens
gagtcatggctaat

SEQ ID NO: 4670036 - DNA, 12 bp, Homo sapiens
gagtccaagctg

SEQ ID NO: 4670037 - DNA, 11 bp, Homo sapiens
gagtccctgct

SEQ ID NO: 4670038 - DNA, 19 bp, Homo sapiens
gagtcccttttcattctcc

SEQ ID NO: 4670039 - DNA, 13 bp, Homo sapiens
gagtcctgccttc

SEQ ID NO: 4670040 - DNA, 16 bp, Homo sapiens
gagtctgaggtcctga

SEQ ID NO: 4670041 - DNA, 17 bp, Homo sapiens
gagtctgtttcccaagc

SEQ ID NO: 4670042 - DNA, 18 bp, Homo sapiens
gagtctgtttcccaagct

SEQ ID NO: 4670043 - DNA, 17 bp, Homo sapiens
gagtctgttttgtaaag

SEQ ID NO: 4670044 - DNA, 14 bp, Homo sapiens
gagtgagaggcccc

SEQ ID NO: 4670045 - DNA, 14 bp, Homo sapiens
gagtgagtgggaga

SEQ ID NO: 4670046 - DNA, 23 bp, Homo sapiens
gagtgataataggggattttaaa

SEQ ID NO: 4670047 - DNA, 21 bp, Homo sapiens
gagtgctggctcacagtacag

SEQ ID NO: 4670048 - DNA, 20 bp, Homo sapiens
gagtggcttcactcctgctg

SEQ ID NO: 4670049 - DNA, 21 bp, Homo sapiens
gagtgggagagtacctgtgtg

SEQ ID NO: 4670050 - DNA, 21 bp, Homo sapiens
gagtgtagcctaaagggcagg

SEQ ID NO: 4670051 - DNA, 16 bp, Homo sapiens
gagtgtcctgcccatg

SEQ ID NO: 4670052 - DNA, 12 bp, Homo sapiens
gagtgtgacagg

SEQ ID NO: 4670053 - DNA, 13 bp, Homo sapiens
gagtgtgcatgga

SEQ ID NO: 4670054 - DNA, 16 bp, Homo sapiens
gagtgtgtgtttgtgt

SEQ ID NO: 4670055 - DNA, 18 bp, Homo sapiens
gagttatatgttcactgt

SEQ ID NO: 4670056 - DNA, 15 bp, Homo sapiens
gagttcaaatacttt

SEQ ID NO: 4670057 - DNA, 22 bp, Homo sapiens
gagttcaggttaccagaaccag

SEQ ID NO: 4670058 - DNA, 15 bp, Homo sapiens
gagttcttgtgccat

SEQ ID NO: 4670059 - DNA, 15 bp, Homo sapiens
gagtttttctgaaaa

SEQ ID NO: 4670060 - DNA, 21 bp, Homo sapiens
gataaaataatgctgcaaact

SEQ ID NO: 4670061 - DNA, 22 bp, Homo sapiens
gataaaatgccagtctcattgt

SEQ ID NO: 4670062 - DNA, 15 bp, Homo sapiens
gataaaatgttcagt

SEQ ID NO: 4670063 - DNA, 11 bp, Homo sapiens
gataaacaaac

SEQ ID NO: 4670064 - DNA, 16 bp, Homo sapiens
gataaccttgtttatt

SEQ ID NO: 4670065 - DNA, 19 bp, Homo sapiens
gataaccttgtttattagc

SEQ ID NO: 4670066 - DNA, 22 bp, Homo sapiens
gataagtttctattctgtcagt

SEQ ID NO: 4670067 - DNA, 18 bp, Homo sapiens
gataataattttatagaa

SEQ ID NO: 4670068 - DNA, 15 bp, Homo sapiens
gataatagcattttt

SEQ ID NO: 4670069 - DNA, 20 bp, Homo sapiens
gatacatccaaagcagacag

SEQ ID NO: 4670070 - DNA, 21 bp, Homo sapiens
gatacatccaaagcagacagc

SEQ ID NO: 4670071 - DNA, 13 bp, Homo sapiens
gatacatttttat

SEQ ID NO: 4670072 - DNA, 14 bp, Homo sapiens
gatactgctgcttg

SEQ ID NO: 4670073 - DNA, 13 bp, Homo sapiens
gatactggcacag

SEQ ID NO: 4670074 - DNA, 12 bp, Homo sapiens
gatagatgtttg

SEQ ID NO: 4670075 - DNA, 17 bp, Homo sapiens
gatagcattgtgaactg

SEQ ID NO: 4670076 - DNA, 20 bp, Homo sapiens
gatagctaactgtaaatcat

SEQ ID NO: 4670077 - DNA, 19 bp, Homo sapiens
gataggaaaaatgagtaat

SEQ ID NO: 4670078 - DNA, 13 bp, Homo sapiens
gatagtgagattt

SEQ ID NO: 4670079 - DNA, 16 bp, Homo sapiens
gatatatgtgtataca

SEQ ID NO: 4670080 - DNA, 21 bp, Homo sapiens
gatatatgtgtatacatacat

SEQ ID NO: 4670081 - DNA, 12 bp, Homo sapiens
gatatcatttta

SEQ ID NO: 4670082 - DNA, 16 bp, Homo sapiens
gatatccttatcagag

SEQ ID NO: 4670083 - DNA, 21 bp, Homo sapiens
gatatgccactaacttctaaa

SEQ ID NO: 4670084 - DNA, 20 bp, Homo sapiens
gatattctttacaaactgaa

SEQ ID NO: 4670085 - DNA, 14 bp, Homo sapiens
gatattgatattga

SEQ ID NO: 4670086 - DNA, 18 bp, Homo sapiens
gatcaacgcctcactgaa

SEQ ID NO: 4670087 - DNA, 19 bp, Homo sapiens
gatcaatatttttatatca

SEQ ID NO: 4670088 - DNA, 13 bp, Homo sapiens
gatcacagcccca

SEQ ID NO: 4670089 - DNA, 15 bp, Homo sapiens
gatcacagcctcacc

SEQ ID NO: 4670090 - DNA, 23 bp, Homo sapiens
gatcacagcctcacccctgcccc

SEQ ID NO: 4670091 - DNA, 16 bp, Homo sapiens
gatcagaacattcagc

SEQ ID NO: 4670092 - DNA, 20 bp, Homo sapiens
gatcagaacattcagctctg

SEQ ID NO: 4670093 - DNA, 23 bp, Homo sapiens
gatcagaacattcagctctggag

SEQ ID NO: 4670094 - DNA, 20 bp, Homo sapiens
gatcagaggcatttgagcag

SEQ ID NO: 4670095 - DNA, 21 bp, Homo sapiens
gatcagaggcatttgagcagc

SEQ ID NO: 4670096 - DNA, 15 bp, Homo sapiens
gatcagattgcatgt

SEQ ID NO: 4670097 - DNA, 23 bp, Homo sapiens
gatcagattgcatgtgactctga

SEQ ID NO: 4670098 - DNA, 15 bp, Homo sapiens
gatcagcgtggcctt

SEQ ID NO: 4670099 - DNA, 20 bp, Homo sapiens
gatcagctttgaaggctgga

SEQ ID NO: 4670100 - DNA, 16 bp, Homo sapiens
gatcaggccccacccc

SEQ ID NO: 4670101 - DNA, 17 bp, Homo sapiens
gatcaggctagccctgc

SEQ ID NO: 4670102 - DNA, 21 bp, Homo sapiens
gatcaggctagccctgccctc

SEQ ID NO: 4670103 - DNA, 17 bp, Homo sapiens
gatcagggcctgccccc

SEQ ID NO: 4670104 - DNA, 19 bp, Homo sapiens
gatcagtatttaactaatt

SEQ ID NO: 4670105 - DNA, 15 bp, Homo sapiens
gatcataaactgact

SEQ ID NO: 4670106 - DNA, 20 bp, Homo sapiens
gatcatatgaattagccaaa

SEQ ID NO: 4670107 - DNA, 13 bp, Homo sapiens
gatcatgtacttt

SEQ ID NO: 4670108 - DNA, 15 bp, Homo sapiens
gatcatgtacttttt

SEQ ID NO: 4670109 - DNA, 20 bp, Homo sapiens
gatcattggagtttaggaat

SEQ ID NO: 4670110 - DNA, 18 bp, Homo sapiens
gatcatttataatactgt

SEQ ID NO: 4670111 - DNA, 22 bp, Homo sapiens
gatccaatgttagagacttttt

SEQ ID NO: 4670112 - DNA, 12 bp, Homo sapiens
gatccagccact

SEQ ID NO: 4670113 - DNA, 15 bp, Homo sapiens
gatccatccatctct

SEQ ID NO: 4670114 - DNA, 22 bp, Homo sapiens
gatcccaccccattttctgtgg

SEQ ID NO: 4670115 - DNA, 17 bp, Homo sapiens
gatcccttaagaagtta

SEQ ID NO: 4670116 - DNA, 18 bp, Homo sapiens
gatccgcccacctcagcc

SEQ ID NO: 4670117 - DNA, 12 bp, Homo sapiens
gatcctcagtgc

SEQ ID NO: 4670118 - DNA, 15 bp, Homo sapiens
gatcctctcacctca

SEQ ID NO: 4670119 - DNA, 11 bp, Homo sapiens
gatcctgctgg

SEQ ID NO: 4670120 - DNA, 22 bp, Homo sapiens
gatcctgctggggccgccacgg

SEQ ID NO: 4670121 - DNA, 16 bp, Homo sapiens
gatccttccattccat

SEQ ID NO: 4670122 - DNA, 19 bp, Homo sapiens
gatccttttttgtcatttt

SEQ ID NO: 4670123 - DNA, 13 bp, Homo sapiens
gatcgacagacag

SEQ ID NO: 4670124 - DNA, 18 bp, Homo sapiens
gatcgacagacagccagg

SEQ ID NO: 4670125 - DNA, 13 bp, Homo sapiens
gatctaatgtgaa

SEQ ID NO: 4670126 - DNA, 16 bp, Homo sapiens
gatctaatgtgaaaat

SEQ ID NO: 4670127 - DNA, 24 bp, Homo sapiens
gatctagatacaggactggttcct

SEQ ID NO: 4670128 - DNA, 12 bp, Homo sapiens
gatctcccctca

SEQ ID NO: 4670129 - DNA, 16 bp, Homo sapiens
gatctcggctcagtgc

SEQ ID NO: 4670130 - DNA, 17 bp, Homo sapiens
gatctctctagctttgt

SEQ ID NO: 4670131 - DNA, 18 bp, Homo sapiens
gatctctgagaccacaga

SEQ ID NO: 4670132 - DNA, 13 bp, Homo sapiens
gatctgccagacc

SEQ ID NO: 4670133 - DNA, 15 bp, Homo sapiens
gatctgccagacctg

SEQ ID NO: 4670134 - DNA, 18 bp, Homo sapiens
gatctgctgggctctgcc

SEQ ID NO: 4670135 - DNA, 19 bp, Homo sapiens
gatctgctgggctctgcct

SEQ ID NO: 4670136 - DNA, 23 bp, Homo sapiens
gatcttgaatgtggtctcaggat

SEQ ID NO: 4670137 - DNA, 13 bp, Homo sapiens
gatgaacagactg

SEQ ID NO: 4670138 - DNA, 16 bp, Homo sapiens
gatgaactgactgaag

SEQ ID NO: 4670139 - DNA, 22 bp, Homo sapiens
gatgaagtttgtagttgtttta

SEQ ID NO: 4670140 - DNA, 16 bp, Homo sapiens
gatgacaccctggcct

SEQ ID NO: 4670141 - DNA, 11 bp, Homo sapiens
gatgactggtc

SEQ ID NO: 4670142 - DNA, 17 bp, Homo sapiens
gatgagaaacagctcag

SEQ ID NO: 4670143 - DNA, 14 bp, Homo sapiens
gatgagcccaccct

SEQ ID NO: 4670144 - DNA, 16 bp, Homo sapiens
gatgaggccctgcacc

SEQ ID NO: 4670145 - DNA, 21 bp, Homo sapiens
gatgaggccctgcaccttccc

SEQ ID NO: 4670146 - DNA, 20 bp, Homo sapiens
gatgaggtctcgaccctgtc

SEQ ID NO: 4670147 - DNA, 15 bp, Homo sapiens
gatgatggtgttttg

SEQ ID NO: 4670148 - DNA, 14 bp, Homo sapiens
gatgcagggcagtc

SEQ ID NO: 4670149 - DNA, 23 bp, Homo sapiens
gatgcaggtcagcccatggaggc

SEQ ID NO: 4670150 - DNA, 19 bp, Homo sapiens
gatgccccctccaggagag

SEQ ID NO: 4670151 - DNA, 20 bp, Homo sapiens
gatgccccctccaggagaga

SEQ ID NO: 4670152 - DNA, 23 bp, Homo sapiens
gatgccccctccaggagagagcc

SEQ ID NO: 4670153 - DNA, 15 bp, Homo sapiens
gatgcccttgctggg

SEQ ID NO: 4670154 - DNA, 22 bp, Homo sapiens
gatgcgggccagtgctccagcc

SEQ ID NO: 4670155 - DNA, 16 bp, Homo sapiens
gatgcgtgggcagagg

SEQ ID NO: 4670156 - DNA, 18 bp, Homo sapiens
gatgcgtgggcagaggaa

SEQ ID NO: 4670157 - DNA, 14 bp, Homo sapiens
gatgctgatggagc

SEQ ID NO: 4670158 - DNA, 12 bp, Homo sapiens
gatgctgggctg

SEQ ID NO: 4670159 - DNA, 14 bp, Homo sapiens
gatgctgggctggg

SEQ ID NO: 4670160 - DNA, 15 bp, Homo sapiens
gatgcttctgggaga

SEQ ID NO: 4670161 - DNA, 16 bp, Homo sapiens
gatggacacgagccac

SEQ ID NO: 4670162 - DNA, 17 bp, Homo sapiens
gatggacacgagccaca

SEQ ID NO: 4670163 - DNA, 16 bp, Homo sapiens
gatggagaaagaagtg

SEQ ID NO: 4670164 - DNA, 18 bp, Homo sapiens
gatggagggcttggccca

SEQ ID NO: 4670165 - DNA, 14 bp, Homo sapiens
gatggaggggagag

SEQ ID NO: 4670166 - DNA, 14 bp, Homo sapiens
gatggatggcagac

SEQ ID NO: 4670167 - DNA, 19 bp, Homo sapiens
gatggcaacattggacaga

SEQ ID NO: 4670168 - DNA, 17 bp, Homo sapiens
gatggccccgcaaggcc

SEQ ID NO: 4670169 - DNA, 14 bp, Homo sapiens
gatgggaggtgtgc

SEQ ID NO: 4670170 - DNA, 16 bp, Homo sapiens
gatgggcaaagcttgt

SEQ ID NO: 4670171 - DNA, 22 bp, Homo sapiens
gatgggcaaagcttgtcaaaga

SEQ ID NO: 4670172 - DNA, 17 bp, Homo sapiens
gatggtgttttggggat

SEQ ID NO: 4670173 - DNA, 22 bp, Homo sapiens
gatgtacttctctgtgtgcaca

SEQ ID NO: 4670174 - DNA, 13 bp, Homo sapiens
gatgtaggaggga

SEQ ID NO: 4670175 - DNA, 14 bp, Homo sapiens
gatgtaggagggac

SEQ ID NO: 4670176 - DNA, 18 bp, Homo sapiens
gatgtatgatctctctag

SEQ ID NO: 4670177 - DNA, 19 bp, Homo sapiens
gatgtatgcagctatctgg

SEQ ID NO: 4670178 - DNA, 20 bp, Homo sapiens
gatgtccctgggccagggtc

SEQ ID NO: 4670179 - DNA, 22 bp, Homo sapiens
gatgtctgttgaaataaaacat

SEQ ID NO: 4670180 - DNA, 14 bp, Homo sapiens
gatgtgaagccaat

SEQ ID NO: 4670181 - DNA, 16 bp, Homo sapiens
gatgtgatcaggcccc

SEQ ID NO: 4670182 - DNA, 23 bp, Homo sapiens
gatgtgatcaggccccacccctg

SEQ ID NO: 4670183 - DNA, 17 bp, Homo sapiens
gatgtgcccaggggagc

SEQ ID NO: 4670184 - DNA, 23 bp, Homo sapiens
gatgtggaggaagagccacctgc

SEQ ID NO: 4670185 - DNA, 20 bp, Homo sapiens
gatgttatgtaaaaggccaa

SEQ ID NO: 4670186 - DNA, 19 bp, Homo sapiens
gatgttgctccatcctttg

SEQ ID NO: 4670187 - DNA, 19 bp, Homo sapiens
gatgttgctgttcacagct

SEQ ID NO: 4670188 - DNA, 21 bp, Homo sapiens
gatgtttccctctccttccaa

SEQ ID NO: 4670189 - DNA, 15 bp, Homo sapiens
gattaaatatttgaa

SEQ ID NO: 4670190 - DNA, 14 bp, Homo sapiens
gattaatgttttca

SEQ ID NO: 4670191 - DNA, 15 bp, Homo sapiens
gattacaggcgcctg

SEQ ID NO: 4670192 - DNA, 14 bp, Homo sapiens
gattacataatctg

SEQ ID NO: 4670193 - DNA, 13 bp, Homo sapiens
gattatcttgaaa

SEQ ID NO: 4670194 - DNA, 15 bp, Homo sapiens
gattcaacagggaag

SEQ ID NO: 4670195 - DNA, 23 bp, Homo sapiens
gattcaactaaaaaaaaaaaagt

SEQ ID NO: 4670196 - DNA, 18 bp, Homo sapiens
gattcaggaaaaggcctg

SEQ ID NO: 4670197 - DNA, 14 bp, Homo sapiens
gcacaccaaggccc

SEQ ID NO: 4670198 - DNA, 17 bp, Homo sapiens
gcacactctcttctcca

SEQ ID NO: 4670199 - DNA, 19 bp, Homo sapiens
gcacactctcttctccatt

SEQ ID NO: 4670200 - DNA, 18 bp, Homo sapiens
gcacagaacaggaggtgt

SEQ ID NO: 4670201 - DNA, 16 bp, Homo sapiens
gcacagaagaggagtc

SEQ ID NO: 4670202 - DNA, 15 bp, Homo sapiens
gcacagacaagcagc

SEQ ID NO: 4670203 - DNA, 16 bp, Homo sapiens
gcacagacaagcagcc

SEQ ID NO: 4670204 - DNA, 18 bp, Homo sapiens
gcacagacaagcagccct

SEQ ID NO: 4670205 - DNA, 22 bp, Homo sapiens
gcacagacaagcagcccttgct

SEQ ID NO: 4670206 - DNA, 13 bp, Homo sapiens
gcacagagcaagt

SEQ ID NO: 4670207 - DNA, 22 bp, Homo sapiens
gcacagccaacacgcacctgcc

SEQ ID NO: 4670208 - DNA, 21 bp, Homo sapiens
gcacaggacatgcggtagcca

SEQ ID NO: 4670209 - DNA, 22 bp, Homo sapiens
gcacaggacatgcggtagccag

SEQ ID NO: 4670210 - DNA, 20 bp, Homo sapiens
gcacaggagctacctgtgtg

SEQ ID NO: 4670211 - DNA, 12 bp, Homo sapiens
gcacaggagggg

SEQ ID NO: 4670212 - DNA, 21 bp, Homo sapiens
gcacaggagggggtcgtggag

SEQ ID NO: 4670213 - DNA, 22 bp, Homo sapiens
gcacagggagtgcacatatcca

SEQ ID NO: 4670214 - DNA, 22 bp, Homo sapiens
gcacagtgggagctgagctgga

SEQ ID NO: 4670215 - DNA, 23 bp, Homo sapiens
gcacatacgggctttaatagtca

SEQ ID NO: 4670216 - DNA, 21 bp, Homo sapiens
gcacattaactccctccacca

SEQ ID NO: 4670217 - DNA, 22 bp, Homo sapiens
gcaccaagggacaggagaagag

SEQ ID NO: 4670218 - DNA, 15 bp, Homo sapiens
gcaccaggctgagcc

SEQ ID NO: 4670219 - DNA, 22 bp, Homo sapiens
gcaccaggctgagccgaagctg

SEQ ID NO: 4670220 - DNA, 20 bp, Homo sapiens
gcaccattgcttaaaagaaa

SEQ ID NO: 4670221 - DNA, 22 bp, Homo sapiens
gcaccattgcttaaaagaaagt

SEQ ID NO: 4670222 - DNA, 12 bp, Homo sapiens
gcacccccacaa

SEQ ID NO: 4670223 - DNA, 13 bp, Homo sapiens
gcacccccagcct

SEQ ID NO: 4670224 - DNA, 17 bp, Homo sapiens
gcacccccagcctgggc

SEQ ID NO: 4670225 - DNA, 18 bp, Homo sapiens
gcacccccagcctgggcc

SEQ ID NO: 4670226 - DNA, 19 bp, Homo sapiens
gcacccccagcctgggcct

SEQ ID NO: 4670227 - DNA, 20 bp, Homo sapiens
gcacccccagcctgggccta

SEQ ID NO: 4670228 - DNA, 20 bp, Homo sapiens
gcacccgcggcccgcgcagc

SEQ ID NO: 4670229 - DNA, 12 bp, Homo sapiens
gcaccgccacgt

SEQ ID NO: 4670230 - DNA, 18 bp, Homo sapiens
gcaccgccacgtcccagc

SEQ ID NO: 4670231 - DNA, 15 bp, Homo sapiens
gcaccgcctgaaggc

SEQ ID NO: 4670232 - DNA, 16 bp, Homo sapiens
gcacctgggccctggg

SEQ ID NO: 4670233 - DNA, 18 bp, Homo sapiens
gcacctgggccctggggc

SEQ ID NO: 4670234 - DNA, 20 bp, Homo sapiens
gcacctgggccctggggcct

SEQ ID NO: 4670235 - DNA, 15 bp, Homo sapiens
gcacctgtccccacc

SEQ ID NO: 4670236 - DNA, 20 bp, Homo sapiens
gcacctgtccccaccctcca

SEQ ID NO: 4670237 - DNA, 22 bp, Homo sapiens
gcacctgtgcccatggcttctg

SEQ ID NO: 4670238 - DNA, 21 bp, Homo sapiens
gcacggccctccttcttttcc

SEQ ID NO: 4670239 - DNA, 12 bp, Homo sapiens
gcactactgggt

SEQ ID NO: 4670240 - DNA, 16 bp, Homo sapiens
gcactactgggtgtca

SEQ ID NO: 4670241 - DNA, 18 bp, Homo sapiens
gcactactgggtgtcatt

SEQ ID NO: 4670242 - DNA, 19 bp, Homo sapiens
gcactactgggtgtcattt

SEQ ID NO: 4670243 - DNA, 14 bp, Homo sapiens
gcactccaaacctg

SEQ ID NO: 4670244 - DNA, 13 bp, Homo sapiens
gcactccagcctg

SEQ ID NO: 4670245 - DNA, 14 bp, Homo sapiens
gcactccagcctgg

SEQ ID NO: 4670246 - DNA, 19 bp, Homo sapiens
gcactccagcctgggggac

SEQ ID NO: 4670247 - DNA, 19 bp, Homo sapiens
gcactccccagagctgtgc

SEQ ID NO: 4670248 - DNA, 20 bp, Homo sapiens
gcactccccagagctgtgcc

SEQ ID NO: 4670249 - DNA, 22 bp, Homo sapiens
gcactcggggtccctggagggc

SEQ ID NO: 4670250 - DNA, 17 bp, Homo sapiens
gcactgatgttgtgttt

SEQ ID NO: 4670251 - DNA, 18 bp, Homo sapiens
gcactgatgttgtgtttt

SEQ ID NO: 4670252 - DNA, 14 bp, Homo sapiens
gcactgccaggagg

SEQ ID NO: 4670253 - DNA, 16 bp, Homo sapiens
gcactgccaggaggga

SEQ ID NO: 4670254 - DNA, 21 bp, Homo sapiens
gcactgcctctcacagctgag

SEQ ID NO: 4670255 - DNA, 19 bp, Homo sapiens
gcactgtgacccccagctc

SEQ ID NO: 4670256 - DNA, 16 bp, Homo sapiens
gcactgtgatacagtt

SEQ ID NO: 4670257 - DNA, 17 bp, Homo sapiens
gcactgtgatacagttt

SEQ ID NO: 4670258 - DNA, 13 bp, Homo sapiens
gcactgtggcctt

SEQ ID NO: 4670259 - DNA, 14 bp, Homo sapiens
gcactgtggccttg

SEQ ID NO: 4670260 - DNA, 20 bp, Homo sapiens
gcactgtgtttatatgtctt

SEQ ID NO: 4670261 - DNA, 22 bp, Homo sapiens
gcactgtgtttatatgtcttgc

SEQ ID NO: 4670262 - DNA, 17 bp, Homo sapiens
gcacttagacctgccag

SEQ ID NO: 4670263 - DNA, 19 bp, Homo sapiens
gcacttagacctgccagcc

SEQ ID NO: 4670264 - DNA, 23 bp, Homo sapiens
gcacttagacctgccagccactg

SEQ ID NO: 4670265 - DNA, 15 bp, Homo sapiens
gcacttagcaggcac

SEQ ID NO: 4670266 - DNA, 22 bp, Homo sapiens
gcacttatctcgaatttgaaga

SEQ ID NO: 4670267 - DNA, 17 bp, Homo sapiens
gcacttccacctccagc

SEQ ID NO: 4670268 - DNA, 19 bp, Homo sapiens
gcacttccacctccagcct

SEQ ID NO: 4670269 - DNA, 21 bp, Homo sapiens
gcacttccacctccagcctct

SEQ ID NO: 4670270 - DNA, 15 bp, Homo sapiens
gcacttgagctgtct

SEQ ID NO: 4670271 - DNA, 17 bp, Homo sapiens
gcacttgagctgtctga

SEQ ID NO: 4670272 - DNA, 18 bp, Homo sapiens
gcactttccaatgccaca

SEQ ID NO: 4670273 - DNA, 19 bp, Homo sapiens
gcactttccaatgccacag

SEQ ID NO: 4670274 - DNA, 18 bp, Homo sapiens
gcagaaatagttgtctgt

SEQ ID NO: 4670275 - DNA, 19 bp, Homo sapiens
gcagaaatagttgtctgtg

SEQ ID NO: 4670276 - DNA, 20 bp, Homo sapiens
gcagaagacgggaggggagg

SEQ ID NO: 4670277 - DNA, 15 bp, Homo sapiens
gcagaaggaaagaag

SEQ ID NO: 4670278 - DNA, 17 bp, Homo sapiens
gcagaatgaagccattt

SEQ ID NO: 4670279 - DNA, 18 bp, Homo sapiens
gcagacagcaggcagcgc

SEQ ID NO: 4670280 - DNA, 15 bp, Homo sapiens
gcagacagctccacc

SEQ ID NO: 4670281 - DNA, 20 bp, Homo sapiens
gcagacaggccccgtgaggc

SEQ ID NO: 4670282 - DNA, 18 bp, Homo sapiens
gcagacaggctacaaagc

SEQ ID NO: 4670283 - DNA, 12 bp, Homo sapiens
gcagactgtgaa

SEQ ID NO: 4670284 - DNA, 17 bp, Homo sapiens
gcagagatcgacagaca

SEQ ID NO: 4670285 - DNA, 19 bp, Homo sapiens
gcagagatcgacagacagc

SEQ ID NO: 4670286 - DNA, 21 bp, Homo sapiens
gcagagatcgacagacagcca

SEQ ID NO: 4670287 - DNA, 22 bp, Homo sapiens
gcagagatcgacagacagccag

SEQ ID NO: 4670288 - DNA, 14 bp, Homo sapiens
gcagagctctacag

SEQ ID NO: 4670289 - DNA, 22 bp, Homo sapiens
gcagaggaatgtgggctatgta

SEQ ID NO: 4670290 - DNA, 18 bp, Homo sapiens
gcagagggacaaccagaa

SEQ ID NO: 4670291 - DNA, 22 bp, Homo sapiens
gcagagggacaaccagaaggcc

SEQ ID NO: 4670292 - DNA, 18 bp, Homo sapiens
gcagagggcaagggaggg

SEQ ID NO: 4670293 - DNA, 19 bp, Homo sapiens
gcagagtaaattgctctgt

SEQ ID NO: 4670294 - DNA, 23 bp, Homo sapiens
gcagagtaaattgctctgttccc

SEQ ID NO: 4670295 - DNA, 13 bp, Homo sapiens
gcagagtcctgcc

SEQ ID NO: 4670296 - DNA, 16 bp, Homo sapiens
gcagagtcctgccttc

SEQ ID NO: 4670297 - DNA, 22 bp, Homo sapiens
gcagataaaatgccagtctcat

SEQ ID NO: 4670298 - DNA, 18 bp, Homo sapiens
gcagatgcccttgctggg

SEQ ID NO: 4670299 - DNA, 22 bp, Homo sapiens
gcagatgcccttgctgggcctg

SEQ ID NO: 4670300 - DNA, 15 bp, Homo sapiens
gcagatgtaggaggg

SEQ ID NO: 4670301 - DNA, 16 bp, Homo sapiens
gcagatgtaggaggga

SEQ ID NO: 4670302 - DNA, 19 bp, Homo sapiens
gcagatgtaggagggactg

SEQ ID NO: 4670303 - DNA, 21 bp, Homo sapiens
gcagattttggttggttttta

SEQ ID NO: 4670304 - DNA, 21 bp, Homo sapiens
gcagcaaggcccgagcagctg

SEQ ID NO: 4670305 - DNA, 17 bp, Homo sapiens
gcagcaccgttctgtgc

SEQ ID NO: 4670306 - DNA, 14 bp, Homo sapiens
gcatcctgtgaagt

SEQ ID NO: 4670307 - DNA, 12 bp, Homo sapiens
gcatctgctttt

SEQ ID NO: 4670308 - DNA, 15 bp, Homo sapiens
gcatctgtctgctct

SEQ ID NO: 4670309 - DNA, 19 bp, Homo sapiens
gcatctgtctgctctgcat

SEQ ID NO: 4670310 - DNA, 15 bp, Homo sapiens
gcatgaaatttttaa

SEQ ID NO: 4670311 - DNA, 18 bp, Homo sapiens
gcatgaataacatttaaa

SEQ ID NO: 4670312 - DNA, 20 bp, Homo sapiens
gcatgactgtcgccacacgc

SEQ ID NO: 4670313 - DNA, 23 bp, Homo sapiens
gcatgagtctgtttcccaagcta

SEQ ID NO: 4670314 - DNA, 19 bp, Homo sapiens
gcatgatgtttccctctcc

SEQ ID NO: 4670315 - DNA, 22 bp, Homo sapiens
gcatgatgtttccctctccttc

SEQ ID NO: 4670316 - DNA, 16 bp, Homo sapiens
gcatgcattgaaaaat

SEQ ID NO: 4670317 - DNA, 22 bp, Homo sapiens
gcatgcattgaaaaatttctaa

SEQ ID NO: 4670318 - DNA, 15 bp, Homo sapiens
gcatgcttgggctga

SEQ ID NO: 4670319 - DNA, 20 bp, Homo sapiens
gcatgcttgggctgacccag

SEQ ID NO: 4670320 - DNA, 21 bp, Homo sapiens
gcatggatgttttagccattg

SEQ ID NO: 4670321 - DNA, 16 bp, Homo sapiens
gcatggggattgcaga

SEQ ID NO: 4670322 - DNA, 17 bp, Homo sapiens
gcatggggattgcagag

SEQ ID NO: 4670323 - DNA, 14 bp, Homo sapiens
gcatggtcaagcct

SEQ ID NO: 4670324 - DNA, 15 bp, Homo sapiens
gcatggtcaagcctc

SEQ ID NO: 4670325 - DNA, 20 bp, Homo sapiens
gcatggtcccacatccctgg

SEQ ID NO: 4670326 - DNA, 23 bp, Homo sapiens
gcatggtcccacatccctgggcc

SEQ ID NO: 4670327 - DNA, 16 bp, Homo sapiens
gcatgtctgttcttct

SEQ ID NO: 4670328 - DNA, 15 bp, Homo sapiens
gcatgtcttttaaaa

SEQ ID NO: 4670329 - DNA, 23 bp, Homo sapiens
gcatgtttaatgtgaactctccc

SEQ ID NO: 4670330 - DNA, 16 bp, Homo sapiens
gcattattctctttta

SEQ ID NO: 4670331 - DNA, 19 bp, Homo sapiens
gcattcatttttatagcaa

SEQ ID NO: 4670332 - DNA, 16 bp, Homo sapiens
gcattctctcccatcc

SEQ ID NO: 4670333 - DNA, 18 bp, Homo sapiens
gcattgaaaaatttctaa

SEQ ID NO: 4670334 - DNA, 21 bp, Homo sapiens
gcattgaagtatggtgtgttc

SEQ ID NO: 4670335 - DNA, 23 bp, Homo sapiens
gcattgaagtatggtgtgttcac

SEQ ID NO: 4670336 - DNA, 23 bp, Homo sapiens
gcattgacataggtcataaagca

SEQ ID NO: 4670337 - DNA, 14 bp, Homo sapiens
gcattgacctggag

SEQ ID NO: 4670338 - DNA, 17 bp, Homo sapiens
gcattgagcatattttc

SEQ ID NO: 4670339 - DNA, 18 bp, Homo sapiens
gcattgaggaagagtctt

SEQ ID NO: 4670340 - DNA, 20 bp, Homo sapiens
gcattgctttctgaaattag

SEQ ID NO: 4670341 - DNA, 18 bp, Homo sapiens
gcattggcatctgctttt

SEQ ID NO: 4670342 - DNA, 22 bp, Homo sapiens
gcatttcatgaaaaagctgctt

SEQ ID NO: 4670343 - DNA, 13 bp, Homo sapiens
gcatttcctgctg

SEQ ID NO: 4670344 - DNA, 13 bp, Homo sapiens
gcatttcctgggt

SEQ ID NO: 4670345 - DNA, 21 bp, Homo sapiens
gcatttcctgggtggctactc

SEQ ID NO: 4670346 - DNA, 16 bp, Homo sapiens
gcatttctctttaaac

SEQ ID NO: 4670347 - DNA, 13 bp, Homo sapiens
gcatttgattttt

SEQ ID NO: 4670348 - DNA, 22 bp, Homo sapiens
gcatttggtggcctaatttaca

SEQ ID NO: 4670349 - DNA, 12 bp, Homo sapiens
gcattttataaa

SEQ ID NO: 4670350 - DNA, 11 bp, Homo sapiens
gcatttttgct

SEQ ID NO: 4670351 - DNA, 23 bp, Homo sapiens
gcattttttataattttctaagt

SEQ ID NO: 4670352 - DNA, 19 bp, Homo sapiens
gccaaacccttgctttcct

SEQ ID NO: 4670353 - DNA, 14 bp, Homo sapiens
gccaaacctctgtt

SEQ ID NO: 4670354 - DNA, 17 bp, Homo sapiens
gccaaacctctgttcag

SEQ ID NO: 4670355 - DNA, 16 bp, Homo sapiens
gccaaagaaacaagct

SEQ ID NO: 4670356 - DNA, 19 bp, Homo sapiens
gccaaagaaacaagctgtg

SEQ ID NO: 4670357 - DNA, 20 bp, Homo sapiens
gccaaagaaacaagctgtgc

SEQ ID NO: 4670358 - DNA, 21 bp, Homo sapiens
gccaacacgcacctgcctcag

SEQ ID NO: 4670359 - DNA, 23 bp, Homo sapiens
gccaacacgcacctgcctcagga

SEQ ID NO: 4670360 - DNA, 13 bp, Homo sapiens
gccaagaatactt

SEQ ID NO: 4670361 - DNA, 16 bp, Homo sapiens
gccaagaatacttgaa

SEQ ID NO: 4670362 - DNA, 15 bp, Homo sapiens
gccaagattttcctc

SEQ ID NO: 4670363 - DNA, 16 bp, Homo sapiens
gccaaggtggagggaa

SEQ ID NO: 4670364 - DNA, 16 bp, Homo sapiens
gccaagtccaggtcct

SEQ ID NO: 4670365 - DNA, 18 bp, Homo sapiens
gccaatgttatgccagct

SEQ ID NO: 4670366 - DNA, 15 bp, Homo sapiens
gccaattcagacagg

SEQ ID NO: 4670367 - DNA, 14 bp, Homo sapiens
gccaatttttgtac

SEQ ID NO: 4670368 - DNA, 20 bp, Homo sapiens
gccacaactcctacatgatg

SEQ ID NO: 4670369 - DNA, 13 bp, Homo sapiens
gccacaagctgca

SEQ ID NO: 4670370 - DNA, 15 bp, Homo sapiens
gccacaagctgcact

SEQ ID NO: 4670371 - DNA, 17 bp, Homo sapiens
gccacaagctgcactgt

SEQ ID NO: 4670372 - DNA, 12 bp, Homo sapiens
gccacacctggc

SEQ ID NO: 4670373 - DNA, 13 bp, Homo sapiens
gccacacctggcc

SEQ ID NO: 4670374 - DNA, 14 bp, Homo sapiens
gccacacctggcct

SEQ ID NO: 4670375 - DNA, 19 bp, Homo sapiens
gccacacgcctctgtgtac

SEQ ID NO: 4670376 - DNA, 13 bp, Homo sapiens
gccacactcagca

SEQ ID NO: 4670377 - DNA, 16 bp, Homo sapiens
gccacacttctcagga

SEQ ID NO: 4670378 - DNA, 23 bp, Homo sapiens
gccacacttctcaggacacaggc

SEQ ID NO: 4670379 - DNA, 16 bp, Homo sapiens
gccacagacccctggg

SEQ ID NO: 4670380 - DNA, 17 bp, Homo sapiens
gccacagacccctggga

SEQ ID NO: 4670381 - DNA, 21 bp, Homo sapiens
gccacagagaagtttgtagcc

SEQ ID NO: 4670382 - DNA, 23 bp, Homo sapiens
gccacagagaagtttgtagccag

SEQ ID NO: 4670383 - DNA, 23 bp, Homo sapiens
gccacagccttccctctgcattg

SEQ ID NO: 4670384 - DNA, 12 bp, Homo sapiens
gccacaggacca

SEQ ID NO: 4670385 - DNA, 11 bp, Homo sapiens
gccacattttc

SEQ ID NO: 4670386 - DNA, 22 bp, Homo sapiens
gccaccatgcctcactaatttt

SEQ ID NO: 4670387 - DNA, 12 bp, Homo sapiens
gccacccccagc

SEQ ID NO: 4670388 - DNA, 17 bp, Homo sapiens
gccacccccagccctgg

SEQ ID NO: 4670389 - DNA, 22 bp, Homo sapiens
gccacccccagccctggcccct

SEQ ID NO: 4670390 - DNA, 16 bp, Homo sapiens
gccacccccagttcct

SEQ ID NO: 4670391 - DNA, 17 bp, Homo sapiens
gccacccccagttccta

SEQ ID NO: 4670392 - DNA, 12 bp, Homo sapiens
gccaccctgagg

SEQ ID NO: 4670393 - DNA, 13 bp, Homo sapiens
gccaccctgagga

SEQ ID NO: 4670394 - DNA, 14 bp, Homo sapiens
gccaccctgaggag

SEQ ID NO: 4670395 - DNA, 20 bp, Homo sapiens
gccaccctgaggagtctgag

SEQ ID NO: 4670396 - DNA, 15 bp, Homo sapiens
gccaccggcctgtgg

SEQ ID NO: 4670397 - DNA, 22 bp, Homo sapiens
gccaccggcctgtgggtctctg

SEQ ID NO: 4670398 - DNA, 15 bp, Homo sapiens
gccaccgtgcctggc

SEQ ID NO: 4670399 - DNA, 17 bp, Homo sapiens
gccacgcattttgcact

SEQ ID NO: 4670400 - DNA, 23 bp, Homo sapiens
gccacggcctggctggtgggaag

SEQ ID NO: 4670401 - DNA, 16 bp, Homo sapiens
gccacgtcccagcatc

SEQ ID NO: 4670402 - DNA, 14 bp, Homo sapiens
gccactccttcctg

SEQ ID NO: 4670403 - DNA, 15 bp, Homo sapiens
gccactccttcctgc

SEQ ID NO: 4670404 - DNA, 17 bp, Homo sapiens
gccactgcactccagcc

SEQ ID NO: 4670405 - DNA, 19 bp, Homo sapiens
gccactgcactccagcctg

SEQ ID NO: 4670406 - DNA, 20 bp, Homo sapiens
gccactgcactccagcctgg

SEQ ID NO: 4670407 - DNA, 18 bp, Homo sapiens
gccactggggactttatt

SEQ ID NO: 4670408 - DNA, 17 bp, Homo sapiens
gccagaaagtcccccct

SEQ ID NO: 4670409 - DNA, 18 bp, Homo sapiens
gccagaacgtggctctgc

SEQ ID NO: 4670410 - DNA, 22 bp, Homo sapiens
gccagaacgtggctctgctggc

SEQ ID NO: 4670411 - DNA, 19 bp, Homo sapiens
gccagaagatgaacagact

SEQ ID NO: 4670412 - DNA, 12 bp, Homo sapiens
gccagagcagct

SEQ ID NO: 4670413 - DNA, 14 bp, Homo sapiens
gccagagcagctcc

SEQ ID NO: 4670414 - DNA, 12 bp, Homo sapiens
gccagagcctgg

SEQ ID NO: 4670415 - DNA, 14 bp, Homo sapiens
gccagagcctgggg

SEQ ID NO: 4670416 - DNA, 15 bp, Homo sapiens
gccagagcctggggc

SEQ ID NO: 4670417 - DNA, 19 bp, Homo sapiens
gccagagcctggggctcta

SEQ ID NO: 4670418 - DNA, 16 bp, Homo sapiens
gccagattctcttgaa

SEQ ID NO: 4670419 - DNA, 18 bp, Homo sapiens
gccagcaacgcttgtaga

SEQ ID NO: 4670420 - DNA, 22 bp, Homo sapiens
gccagcaacgcttgtagaactc

SEQ ID NO: 4670421 - DNA, 13 bp, Homo sapiens
gccagcacacagg

SEQ ID NO: 4670422 - DNA, 15 bp, Homo sapiens
gccagcacacagggc

SEQ ID NO: 4670423 - DNA, 17 bp, Homo sapiens
gccagcacacagggcag

SEQ ID NO: 4670424 - DNA, 18 bp, Homo sapiens
gccagcacacagggcagt

SEQ ID NO: 4670425 - DNA, 20 bp, Homo sapiens
gccagcacttgtccagctga

SEQ ID NO: 4670426 - DNA, 13 bp, Homo sapiens
gccagcaggaata

SEQ ID NO: 4670427 - DNA, 14 bp, Homo sapiens
gccagcaggaataa

SEQ ID NO: 4670428 - DNA, 10 bp, Homo sapiens
gccagccaca

SEQ ID NO: 4670429 - DNA, 20 bp, Homo sapiens
gccagccacagacccctggg

SEQ ID NO: 4670430 - DNA, 23 bp, Homo sapiens
gccagccacagacccctgggagc

SEQ ID NO: 4670431 - DNA, 14 bp, Homo sapiens
gccagccacaggac

SEQ ID NO: 4670432 - DNA, 12 bp, Homo sapiens
gccagccactgt

SEQ ID NO: 4670433 - DNA, 20 bp, Homo sapiens
gccagcccctggccccagga

SEQ ID NO: 4670434 - DNA, 19 bp, Homo sapiens
gccagccctgcctggagga

SEQ ID NO: 4670435 - DNA, 12 bp, Homo sapiens
gccagcctggcc

SEQ ID NO: 4670436 - DNA, 13 bp, Homo sapiens
gccagcctggcct

SEQ ID NO: 4670437 - DNA, 14 bp, Homo sapiens
gccagcctggcctc

SEQ ID NO: 4670438 - DNA, 16 bp, Homo sapiens
gccagcctggcctcct

SEQ ID NO: 4670439 - DNA, 22 bp, Homo sapiens
gccagctaatttttgtattttt

SEQ ID NO: 4670440 - DNA, 16 bp, Homo sapiens
gccagctccatgttct

SEQ ID NO: 4670441 - DNA, 13 bp, Homo sapiens
gccagctgctccc

SEQ ID NO: 4670442 - DNA, 19 bp, Homo sapiens
gccaggaccttggtgagat

SEQ ID NO: 4670443 - DNA, 13 bp, Homo sapiens
gccaggagcagcc

SEQ ID NO: 4670444 - DNA, 15 bp, Homo sapiens
gccaggagcagccct

SEQ ID NO: 4670445 - DNA, 17 bp, Homo sapiens
gccaggagcagccctgg

SEQ ID NO: 4670446 - DNA, 17 bp, Homo sapiens
gccaggcagagaacaga

SEQ ID NO: 4670447 - DNA, 11 bp, Homo sapiens
gccaggcccca

SEQ ID NO: 4670448 - DNA, 14 bp, Homo sapiens
gccaggccccaccc

SEQ ID NO: 4670449 - DNA, 21 bp, Homo sapiens
gccaggcctagtaaccaaggc

SEQ ID NO: 4670450 - DNA, 22 bp, Homo sapiens
gccaggctgaccacagcacagc

SEQ ID NO: 4670451 - DNA, 10 bp, Homo sapiens
gccagggctg

SEQ ID NO: 4670452 - DNA, 17 bp, Homo sapiens
gccagggctgccctgag

SEQ ID NO: 4670453 - DNA, 13 bp, Homo sapiens
gccagggctgggg

SEQ ID NO: 4670454 - DNA, 15 bp, Homo sapiens
gccaggggccaggag

SEQ ID NO: 4670455 - DNA, 16 bp, Homo sapiens
gccaggggccaggagt

SEQ ID NO: 4670456 - DNA, 17 bp, Homo sapiens
gccaggggccaggagtg

SEQ ID NO: 4670457 - DNA, 18 bp, Homo sapiens
gccaggggccaggagtgg

SEQ ID NO: 4670458 - DNA, 20 bp, Homo sapiens
gccagggtctgtgtgaatgt

SEQ ID NO: 4670459 - DNA, 21 bp, Homo sapiens
gccagggtctgtgtgaatgtg

SEQ ID NO: 4670460 - DNA, 19 bp, Homo sapiens
gccaggtacaggagaggca

SEQ ID NO: 4670461 - DNA, 20 bp, Homo sapiens
gccaggtacaggagaggcag

SEQ ID NO: 4670462 - DNA, 21 bp, Homo sapiens
gccaggtacaggagaggcagc

SEQ ID NO: 4670463 - DNA, 22 bp, Homo sapiens
gccaggtacaggagaggcagca

SEQ ID NO: 4670464 - DNA, 21 bp, Homo sapiens
gccaggtactgcattctctcc

SEQ ID NO: 4670465 - DNA, 23 bp, Homo sapiens
gccaggtactgcattctctccca

SEQ ID NO: 4670466 - DNA, 18 bp, Homo sapiens
gccagtggggcctgtgga

SEQ ID NO: 4670467 - DNA, 19 bp, Homo sapiens
gccagtgtttctgaatgtt

SEQ ID NO: 4670468 - DNA, 14 bp, Homo sapiens
gccataccttctcc

SEQ ID NO: 4670469 - DNA, 20 bp, Homo sapiens
gccataccttctcccaggcc

SEQ ID NO: 4670470 - DNA, 15 bp, Homo sapiens
gccatacttgtgaaa

SEQ ID NO: 4670471 - DNA, 14 bp, Homo sapiens
gccatatttactac

SEQ ID NO: 4670472 - DNA, 12 bp, Homo sapiens
gccatcatcctc

SEQ ID NO: 4670473 - DNA, 23 bp, Homo sapiens
gccatcatcctcccgccaggagc

SEQ ID NO: 4670474 - DNA, 17 bp, Homo sapiens
gccatccgcacagaaaa

SEQ ID NO: 4670475 - DNA, 13 bp, Homo sapiens
gccatctcaggag

SEQ ID NO: 4670476 - DNA, 14 bp, Homo sapiens
gccatctcggctca

SEQ ID NO: 4670477 - DNA, 17 bp, Homo sapiens
gccatctcggctcactg

SEQ ID NO: 4670478 - DNA, 19 bp, Homo sapiens
gccatctcggctcactgca

SEQ ID NO: 4670479 - DNA, 22 bp, Homo sapiens
gccatctgactgccaagccaga

SEQ ID NO: 4670480 - DNA, 21 bp, Homo sapiens
gccatctgggctcctccaggg

SEQ ID NO: 4670481 - DNA, 21 bp, Homo sapiens
gccatgaaccaaatggttctt

SEQ ID NO: 4670482 - DNA, 23 bp, Homo sapiens
gccatgagatgatacatccaaag

SEQ ID NO: 4670483 - DNA, 15 bp, Homo sapiens
gccatgatggcaaca

SEQ ID NO: 4670484 - DNA, 15 bp, Homo sapiens
gccatgctgggccac

SEQ ID NO: 4670485 - DNA, 16 bp, Homo sapiens
gccatgctgggccact

SEQ ID NO: 4670486 - DNA, 17 bp, Homo sapiens
gccatgctgggccactg

SEQ ID NO: 4670487 - DNA, 16 bp, Homo sapiens
gccatgggtggaaagt

SEQ ID NO: 4670488 - DNA, 19 bp, Homo sapiens
gccatgggtggaaagtgct

SEQ ID NO: 4670489 - DNA, 19 bp, Homo sapiens
gccatgttggccaggctgg

SEQ ID NO: 4670490 - DNA, 20 bp, Homo sapiens
gccatgttgtgcctccctgg

SEQ ID NO: 4670491 - DNA, 21 bp, Homo sapiens
gccatgttgtgcctccctggt

SEQ ID NO: 4670492 - DNA, 23 bp, Homo sapiens
gccatgttgtgcctccctggtga

SEQ ID NO: 4670493 - DNA, 20 bp, Homo sapiens
gccattagccagatttgtct

SEQ ID NO: 4670494 - DNA, 19 bp, Homo sapiens
gccattgatcataaactga

SEQ ID NO: 4670495 - DNA, 21 bp, Homo sapiens
gccatttagagggtgaaggag

SEQ ID NO: 4670496 - DNA, 14 bp, Homo sapiens
gccatttgtactga

SEQ ID NO: 4670497 - DNA, 22 bp, Homo sapiens
gccattttggggggttatttat

SEQ ID NO: 4670498 - DNA, 13 bp, Homo sapiens
gcccaaagcctga

SEQ ID NO: 4670499 - DNA, 13 bp, Homo sapiens
gcccaagagcccg

SEQ ID NO: 4670500 - DNA, 24 bp, Homo sapiens
gcccaaggacagttcagagatcag

SEQ ID NO: 4670501 - DNA, 13 bp, Homo sapiens
gcccaccccaccc

SEQ ID NO: 4670502 - DNA, 14 bp, Homo sapiens
gcccacctcagcct

SEQ ID NO: 4670503 - DNA, 17 bp, Homo sapiens
gcccacggtttcagcta

SEQ ID NO: 4670504 - DNA, 16 bp, Homo sapiens
gcccactccgccagcc

SEQ ID NO: 4670505 - DNA, 18 bp, Homo sapiens
gcccactccgccagccac

SEQ ID NO: 4670506 - DNA, 19 bp, Homo sapiens
gcccactccgccagccaca

SEQ ID NO: 4670507 - DNA, 22 bp, Homo sapiens
gcccactccgccagccacagga

SEQ ID NO: 4670508 - DNA, 13 bp, Homo sapiens
gcccagagaacag

SEQ ID NO: 4670509 - DNA, 16 bp, Homo sapiens
gcccagaggactccca

SEQ ID NO: 4670510 - DNA, 20 bp, Homo sapiens
gcccagaggactcccaaccc

SEQ ID NO: 4670511 - DNA, 21 bp, Homo sapiens
gcccagaggactcccaaccct

SEQ ID NO: 4670512 - DNA, 21 bp, Homo sapiens
gcccagaggagcccagcggcc

SEQ ID NO: 4670513 - DNA, 18 bp, Homo sapiens
gcccagatgaactgactg

SEQ ID NO: 4670514 - DNA, 17 bp, Homo sapiens
gcccagcctcacttcct

SEQ ID NO: 4670515 - DNA, 14 bp, Homo sapiens
gcccagcgccaagt

SEQ ID NO: 4670516 - DNA, 20 bp, Homo sapiens
gcccagcggacagtggcagg

SEQ ID NO: 4670517 - DNA, 21 bp, Homo sapiens
gcccagcggcccaagagcccg

SEQ ID NO: 4670518 - DNA, 22 bp, Homo sapiens
gcccagctggcctggcccccag

SEQ ID NO: 4670519 - DNA, 19 bp, Homo sapiens
gcccagctgggtcaggcag

SEQ ID NO: 4670520 - DNA, 20 bp, Homo sapiens
gcccagctgggtcaggcagg

SEQ ID NO: 4670521 - DNA, 22 bp, Homo sapiens
gcccaggatactggcacagagg

SEQ ID NO: 4670522 - DNA, 14 bp, Homo sapiens
gcccagggaataag

SEQ ID NO: 4670523 - DNA, 18 bp, Homo sapiens
gcccaggtatcctggggg

SEQ ID NO: 4670524 - DNA, 19 bp, Homo sapiens
gcccaggtatcctggggga

SEQ ID NO: 4670525 - DNA, 22 bp, Homo sapiens
gcccaggtgagggaaggagaca

SEQ ID NO: 4670526 - DNA, 24 bp, Homo sapiens
gcccttccccctttctctgcctgg

SEQ ID NO: 4670527 - DNA, 22 bp, Homo sapiens
gcccttcctcctgcctttctca

SEQ ID NO: 4670528 - DNA, 13 bp, Homo sapiens
gcccttcctctcc

SEQ ID NO: 4670529 - DNA, 12 bp, Homo sapiens
gcccttcctgga

SEQ ID NO: 4670530 - DNA, 14 bp, Homo sapiens
gcccttcctggaca

SEQ ID NO: 4670531 - DNA, 16 bp, Homo sapiens
gcccttgctgggcctg

SEQ ID NO: 4670532 - DNA, 18 bp, Homo sapiens
gcccttgctgggcctggg

SEQ ID NO: 4670533 - DNA, 19 bp, Homo sapiens
gcccttgtttggggcagga

SEQ ID NO: 4670534 - DNA, 20 bp, Homo sapiens
gcccttgtttggggcaggag

SEQ ID NO: 4670535 - DNA, 22 bp, Homo sapiens
gcccttgtttggggcaggagta

SEQ ID NO: 4670536 - DNA, 13 bp, Homo sapiens
gccgaagctgcgg

SEQ ID NO: 4670537 - DNA, 12 bp, Homo sapiens
gccgactctggc

SEQ ID NO: 4670538 - DNA, 14 bp, Homo sapiens
gccgactctggccc

SEQ ID NO: 4670539 - DNA, 14 bp, Homo sapiens
gccgagcaaccgtg

SEQ ID NO: 4670540 - DNA, 18 bp, Homo sapiens
gccgagtccaagctggga

SEQ ID NO: 4670541 - DNA, 12 bp, Homo sapiens
gccgatgccacc

SEQ ID NO: 4670542 - DNA, 20 bp, Homo sapiens
gccgcagtggggtcaagctg

SEQ ID NO: 4670543 - DNA, 17 bp, Homo sapiens
gccgccacggcctggct

SEQ ID NO: 4670544 - DNA, 15 bp, Homo sapiens
gccgcgcctggctta

SEQ ID NO: 4670545 - DNA, 23 bp, Homo sapiens
gccggggaactggccaagctgag

SEQ ID NO: 4670546 - DNA, 17 bp, Homo sapiens
gccggggcgagtggcac

SEQ ID NO: 4670547 - DNA, 20 bp, Homo sapiens
gccggggctctgggtgctgc

SEQ ID NO: 4670548 - DNA, 17 bp, Homo sapiens
gccggtaactgtcctgt

SEQ ID NO: 4670549 - DNA, 23 bp, Homo sapiens
gccgtttgaatatattttatctt

SEQ ID NO: 4670550 - DNA, 16 bp, Homo sapiens
gcctaaagggcagggc

SEQ ID NO: 4670551 - DNA, 21 bp, Homo sapiens
gcctaaagggcagggcccacg

SEQ ID NO: 4670552 - DNA, 15 bp, Homo sapiens
gcctaaccgagatca

SEQ ID NO: 4670553 - DNA, 14 bp, Homo sapiens
gcctaatccctggg

SEQ ID NO: 4670554 - DNA, 16 bp, Homo sapiens
gcctaatccctgggca

SEQ ID NO: 4670555 - DNA, 14 bp, Homo sapiens
gcctagtaaccaag

SEQ ID NO: 4670556 - DNA, 15 bp, Homo sapiens
gcctagtgggagtta

SEQ ID NO: 4670557 - DNA, 23 bp, Homo sapiens
gcctatgcacatatggactctgc

SEQ ID NO: 4670558 - DNA, 18 bp, Homo sapiens
gcctcaaaacgggtcagt

SEQ ID NO: 4670559 - DNA, 13 bp, Homo sapiens
gcctcaaatgcag

SEQ ID NO: 4670560 - DNA, 17 bp, Homo sapiens
gcctcacccctcccctg

SEQ ID NO: 4670561 - DNA, 12 bp, Homo sapiens
gcctcactgaaa

SEQ ID NO: 4670562 - DNA, 15 bp, Homo sapiens
gcctcacttcctttg

SEQ ID NO: 4670563 - DNA, 16 bp, Homo sapiens
gcctcacttcctttgc

SEQ ID NO: 4670564 - DNA, 11 bp, Homo sapiens
gcctcagagct

SEQ ID NO: 4670565 - DNA, 15 bp, Homo sapiens
gcctcagagcttcct

SEQ ID NO: 4670566 - DNA, 16 bp, Homo sapiens
gcctcagagcttcctg

SEQ ID NO: 4670567 - DNA, 21 bp, Homo sapiens
gcctcagagcttcctggggac

SEQ ID NO: 4670568 - DNA, 14 bp, Homo sapiens
gcctcaggctctgc

SEQ ID NO: 4670569 - DNA, 16 bp, Homo sapiens
gcctcaggctctgcac

SEQ ID NO: 4670570 - DNA, 17 bp, Homo sapiens
gcctcattgtgtctccc

SEQ ID NO: 4670571 - DNA, 19 bp, Homo sapiens
gcctccccttaaaggggag

SEQ ID NO: 4670572 - DNA, 23 bp, Homo sapiens
gcctccctgctgtgccatgctgg

SEQ ID NO: 4670573 - DNA, 13 bp, Homo sapiens
gcctcctctctcc

SEQ ID NO: 4670574 - DNA, 15 bp, Homo sapiens
gcctcctctctccct

SEQ ID NO: 4670575 - DNA, 13 bp, Homo sapiens
gcctcctgctttg

SEQ ID NO: 4670576 - DNA, 15 bp, Homo sapiens
gcctcctgctttggg

SEQ ID NO: 4670577 - DNA, 20 bp, Homo sapiens
gcctcctgctttgggaagac

SEQ ID NO: 4670578 - DNA, 14 bp, Homo sapiens
gcctcctgggttca

SEQ ID NO: 4670579 - DNA, 18 bp, Homo sapiens
gcctcctgtggggaaagg

SEQ ID NO: 4670580 - DNA, 12 bp, Homo sapiens
gcctcgcaaccc

SEQ ID NO: 4670581 - DNA, 23 bp, Homo sapiens
gcctcgcaacccgtgccaagtcc

SEQ ID NO: 4670582 - DNA, 16 bp, Homo sapiens
gcctcgccttgtgtta

SEQ ID NO: 4670583 - DNA, 16 bp, Homo sapiens
gcctcgctccccactc

SEQ ID NO: 4670584 - DNA, 18 bp, Homo sapiens
gcctcgctccccactctg

SEQ ID NO: 4670585 - DNA, 23 bp, Homo sapiens
gcctcgctccccactctgctctg

SEQ ID NO: 4670586 - DNA, 15 bp, Homo sapiens
gcctcgctcccttca

SEQ ID NO: 4670587 - DNA, 15 bp, Homo sapiens
gcctcgtgaggggca

SEQ ID NO: 4670588 - DNA, 16 bp, Homo sapiens
gcctcgtgaggggcaa

SEQ ID NO: 4670589 - DNA, 18 bp, Homo sapiens
gcctcgtgaggggcaagc

SEQ ID NO: 4670590 - DNA, 16 bp, Homo sapiens
gcctctactgggaagg

SEQ ID NO: 4670591 - DNA, 17 bp, Homo sapiens
gcctctactgggaaggc

SEQ ID NO: 4670592 - DNA, 12 bp, Homo sapiens
gcctctgaggcc

SEQ ID NO: 4670593 - DNA, 16 bp, Homo sapiens
gcctctgaggccagcc

SEQ ID NO: 4670594 - DNA, 19 bp, Homo sapiens
gcctctgaggccagcctgg

SEQ ID NO: 4670595 - DNA, 22 bp, Homo sapiens
gcctctgaggccagcctggcct

SEQ ID NO: 4670596 - DNA, 21 bp, Homo sapiens
gcctctgcacaccctccagag

SEQ ID NO: 4670597 - DNA, 17 bp, Homo sapiens
gcctctgccccaagagc

SEQ ID NO: 4670598 - DNA, 12 bp, Homo sapiens
gcctctggtcct

SEQ ID NO: 4670599 - DNA, 14 bp, Homo sapiens
gcctcttccccctg

SEQ ID NO: 4670600 - DNA, 17 bp, Homo sapiens
gcctcttgtaaagactg

SEQ ID NO: 4670601 - DNA, 23 bp, Homo sapiens
gcctctttgtctaaaacaataaa

SEQ ID NO: 4670602 - DNA, 17 bp, Homo sapiens
gcctgaaagctgggagc

SEQ ID NO: 4670603 - DNA, 16 bp, Homo sapiens
gcctgaaggcacagct

SEQ ID NO: 4670604 - DNA, 16 bp, Homo sapiens
gcctgaccttggaatc

SEQ ID NO: 4670605 - DNA, 17 bp, Homo sapiens
gcctgacctttgggact

SEQ ID NO: 4670606 - DNA, 15 bp, Homo sapiens
gcctgagcccaggga

SEQ ID NO: 4670607 - DNA, 13 bp, Homo sapiens
gcctgaggctgta

SEQ ID NO: 4670608 - DNA, 12 bp, Homo sapiens
gcctgaggggaa

SEQ ID NO: 4670609 - DNA, 19 bp, Homo sapiens
gcctgaggtgcccactccg

SEQ ID NO: 4670610 - DNA, 15 bp, Homo sapiens
gcctgagtgacctcc

SEQ ID NO: 4670611 - DNA, 20 bp, Homo sapiens
gcctgatcagaccacggctc

SEQ ID NO: 4670612 - DNA, 19 bp, Homo sapiens
gcctgcccattagagaagt

SEQ ID NO: 4670613 - DNA, 14 bp, Homo sapiens
gcctgccccctggg

SEQ ID NO: 4670614 - DNA, 16 bp, Homo sapiens
gcctgccccctgggga

SEQ ID NO: 4670615 - DNA, 21 bp, Homo sapiens
gcctgcccctaccctggactt

SEQ ID NO: 4670616 - DNA, 12 bp, Homo sapiens
gcctgccgagca

SEQ ID NO: 4670617 - DNA, 14 bp, Homo sapiens
gcctgccgagcaac

SEQ ID NO: 4670618 - DNA, 13 bp, Homo sapiens
gcctgcctcgcct

SEQ ID NO: 4670619 - DNA, 17 bp, Homo sapiens
gcctgcctcgccttgtg

SEQ ID NO: 4670620 - DNA, 20 bp, Homo sapiens
gcctgcctcgccttgtgtta

SEQ ID NO: 4670621 - DNA, 19 bp, Homo sapiens
gcctgctctagtgggacag

SEQ ID NO: 4670622 - DNA, 12 bp, Homo sapiens
gcctgctgctga

SEQ ID NO: 4670623 - DNA, 14 bp, Homo sapiens
gcctgctgctgaga

SEQ ID NO: 4670624 - DNA, 20 bp, Homo sapiens
gcctgctgctgagaacctgg

SEQ ID NO: 4670625 - DNA, 11 bp, Homo sapiens
gcctgctgtca

SEQ ID NO: 4670626 - DNA, 19 bp, Homo sapiens
gcctgctgtcacctcgctg

SEQ ID NO: 4670627 - DNA, 13 bp, Homo sapiens
gcctggagcccca

SEQ ID NO: 4670628 - DNA, 17 bp, Homo sapiens
gcctggaggacctgagc

SEQ ID NO: 4670629 - DNA, 22 bp, Homo sapiens
gcctggaggacctgagcctgcc

SEQ ID NO: 4670630 - DNA, 17 bp, Homo sapiens
gcctggatgagaaacag

SEQ ID NO: 4670631 - DNA, 22 bp, Homo sapiens
gcctggatgagaaacagctcag

SEQ ID NO: 4670632 - DNA, 18 bp, Homo sapiens
gcctggatgcagatctgc

SEQ ID NO: 4670633 - DNA, 9 bp, Homo sapiens
gcctggcaa

SEQ ID NO: 4670634 - DNA, 10 bp, Homo sapiens
gcctggcaac

SEQ ID NO: 4670635 - DNA, 17 bp, Homo sapiens
gcctggcccccagcttc

SEQ ID NO: 4670636 - DNA, 18 bp, Homo sapiens
gcctggcccccagcttca

SEQ ID NO: 4670637 - DNA, 14 bp, Homo sapiens
gcctggtccctggg

SEQ ID NO: 4670638 - DNA, 13 bp, Homo sapiens
gcctggtctggga

SEQ ID NO: 4670639 - DNA, 15 bp, Homo sapiens
gcctggtctgggagt

SEQ ID NO: 4670640 - DNA, 19 bp, Homo sapiens
gcctggttctaggctgctg

SEQ ID NO: 4670641 - DNA, 20 bp, Homo sapiens
gcctggttctaggctgctgc

SEQ ID NO: 4670642 - DNA, 11 bp, Homo sapiens
gcctgtactgc

SEQ ID NO: 4670643 - DNA, 14 bp, Homo sapiens
gcctgtactgcctg

SEQ ID NO: 4670644 - DNA, 17 bp, Homo sapiens
gcctgtactgcctgctt

SEQ ID NO: 4670645 - DNA, 19 bp, Homo sapiens
gcctgtactgcctgcttgg

SEQ ID NO: 4670646 - DNA, 22 bp, Homo sapiens
gcctgtagaatagcctgtggcc

SEQ ID NO: 4670647 - DNA, 12 bp, Homo sapiens
gcctgtctcagt

SEQ ID NO: 4670648 - DNA, 13 bp, Homo sapiens
gcctgtctcagtg

SEQ ID NO: 4670649 - DNA, 14 bp, Homo sapiens
gcctgtctcagtga

SEQ ID NO: 4670650 - DNA, 14 bp, Homo sapiens
gcctgtgaacccag

SEQ ID NO: 4670651 - DNA, 15 bp, Homo sapiens
gcctgtgaacccagg

SEQ ID NO: 4670652 - DNA, 16 bp, Homo sapiens
gcctgtgaacccagga

SEQ ID NO: 4670653 - DNA, 19 bp, Homo sapiens
gcctgtgaacccaggacaa

SEQ ID NO: 4670654 - DNA, 21 bp, Homo sapiens
gcctgtgaacccaggacaagc

SEQ ID NO: 4670655 - DNA, 14 bp, Homo sapiens
gcctgtgatgtttt

SEQ ID NO: 4670656 - DNA, 19 bp, Homo sapiens
gcctgtgcatgtatgtctt

SEQ ID NO: 4670657 - DNA, 19 bp, Homo sapiens
gcctgtgcgtcccagctga

SEQ ID NO: 4670658 - DNA, 16 bp, Homo sapiens
gcctgtggaatgagtg

SEQ ID NO: 4670659 - DNA, 13 bp, Homo sapiens
gcctgtgggtctc

SEQ ID NO: 4670660 - DNA, 19 bp, Homo sapiens
gcctgtgggtctctgaagg

SEQ ID NO: 4670661 - DNA, 16 bp, Homo sapiens
gcctgtgtagctgtga

SEQ ID NO: 4670662 - DNA, 22 bp, Homo sapiens
gcctgtgtctttaaatgctgct

SEQ ID NO: 4670663 - DNA, 15 bp, Homo sapiens
gccttaaacacacat

SEQ ID NO: 4670664 - DNA, 23 bp, Homo sapiens
gccttaaagagggacaggctgaa

SEQ ID NO: 4670665 - DNA, 16 bp, Homo sapiens
gccttaacctgggacc

SEQ ID NO: 4670666 - DNA, 19 bp, Homo sapiens
gccttagggcactgggctg

SEQ ID NO: 4670667 - DNA, 16 bp, Homo sapiens
gccttagtgggccagg

SEQ ID NO: 4670668 - DNA, 22 bp, Homo sapiens
gccttataaacagataatgctt

SEQ ID NO: 4670669 - DNA, 23 bp, Homo sapiens
gccttatgagggtcctctacttc

SEQ ID NO: 4670670 - DNA, 22 bp, Homo sapiens
gccttcagacacatgctatgtt

SEQ ID NO: 4670671 - DNA, 12 bp, Homo sapiens
gccttccagttt

SEQ ID NO: 4670672 - DNA, 16 bp, Homo sapiens
gccttccagttttgtg

SEQ ID NO: 4670673 - DNA, 18 bp, Homo sapiens
gccttccagttttgtgga

SEQ ID NO: 4670674 - DNA, 19 bp, Homo sapiens
gccttcccaagttgtgctt

SEQ ID NO: 4670675 - DNA, 19 bp, Homo sapiens
gccttcctattttgcataa

SEQ ID NO: 4670676 - DNA, 20 bp, Homo sapiens
gccttctaggaatggaggag

SEQ ID NO: 4670677 - DNA, 21 bp, Homo sapiens
gccttctaggaatggaggagc

SEQ ID NO: 4670678 - DNA, 14 bp, Homo sapiens
gccttctgaaatgt

SEQ ID NO: 4670679 - DNA, 19 bp, Homo sapiens
gccttctgaaatgtgaccc

SEQ ID NO: 4670680 - DNA, 21 bp, Homo sapiens
gccttgatccccttgatagat

SEQ ID NO: 4670681 - DNA, 20 bp, Homo sapiens
gccttggctgacatgaagct

SEQ ID NO: 4670682 - DNA, 18 bp, Homo sapiens
gccttggtctaacttttg

SEQ ID NO: 4670683 - DNA, 17 bp, Homo sapiens
gccttgtcccagaggct

SEQ ID NO: 4670684 - DNA, 12 bp, Homo sapiens
gccttgttctgt

SEQ ID NO: 4670685 - DNA, 21 bp, Homo sapiens
gcctttaagccaaagaaacaa

SEQ ID NO: 4670686 - DNA, 21 bp, Homo sapiens
gcctttcctgtagccttctgt

SEQ ID NO: 4670687 - DNA, 14 bp, Homo sapiens
gcctttgcaagatg

SEQ ID NO: 4670688 - DNA, 19 bp, Homo sapiens
gcctttgcaagatgcttgg

SEQ ID NO: 4670689 - DNA, 16 bp, Homo sapiens
gcctttgctcttataa

SEQ ID NO: 4670690 - DNA, 16 bp, Homo sapiens
gcctttggcagagttc

SEQ ID NO: 4670691 - DNA, 14 bp, Homo sapiens
gccttttaattttt

SEQ ID NO: 4670692 - DNA, 16 bp, Homo sapiens
gccttttcccccaccc

SEQ ID NO: 4670693 - DNA, 17 bp, Homo sapiens
gcctttttcattttcca

SEQ ID NO: 4670694 - DNA, 19 bp, Homo sapiens
gcctttttcattttccaat

SEQ ID NO: 4670695 - DNA, 22 bp, Homo sapiens
gcctttttctgagatgctcact

SEQ ID NO: 4670696 - DNA, 14 bp, Homo sapiens
gcctttttggcctg

SEQ ID NO: 4670697 - DNA, 22 bp, Homo sapiens
gcctttttggcctgtgatgttt

SEQ ID NO: 4670698 - DNA, 16 bp, Homo sapiens
gcgaagtagcttgctc

SEQ ID NO: 4670699 - DNA, 20 bp, Homo sapiens
gcgaagtagcttgctccctg

SEQ ID NO: 4670700 - DNA, 17 bp, Homo sapiens
gcgagtggatgctgtgc

SEQ ID NO: 4670701 - DNA, 16 bp, Homo sapiens
gcgatctcggctcagt

SEQ ID NO: 4670702 - DNA, 22 bp, Homo sapiens
gcgattccctctcccaggcccc

SEQ ID NO: 4670703 - DNA, 17 bp, Homo sapiens
gcgcaccaggctgagcc

SEQ ID NO: 4670704 - DNA, 22 bp, Homo sapiens
gcgccaggatggaacacggcca

SEQ ID NO: 4670705 - DNA, 15 bp, Homo sapiens
gcgccaggctgacca

SEQ ID NO: 4670706 - DNA, 20 bp, Homo sapiens
gcgccaggctgaccacagca

SEQ ID NO: 4670707 - DNA, 23 bp, Homo sapiens
gcgccatctcggctcactgcaac

SEQ ID NO: 4670708 - DNA, 22 bp, Homo sapiens
gcgccccaacccgtggaggctg

SEQ ID NO: 4670709 - DNA, 18 bp, Homo sapiens
gcgccctgcagaccctgc

SEQ ID NO: 4670710 - DNA, 17 bp, Homo sapiens
gcgccgatgccaccggc

SEQ ID NO: 4670711 - DNA, 13 bp, Homo sapiens
gcgcctgcgtccg

SEQ ID NO: 4670712 - DNA, 17 bp, Homo sapiens
gcgcctttttggcctgt

SEQ ID NO: 4670713 - DNA, 14 bp, Homo sapiens
gcggacagtggcag

SEQ ID NO: 4670714 - DNA, 15 bp, Homo sapiens
gcggacagtggcagg

SEQ ID NO: 4670715 - DNA, 18 bp, Homo sapiens
gcggagcaagaggaggcc

SEQ ID NO: 4670716 - DNA, 19 bp, Homo sapiens
gcggaggaaagcaagtgtt

SEQ ID NO: 4670717 - DNA, 16 bp, Homo sapiens
gcggagggaggggagg

SEQ ID NO: 4670718 - DNA, 19 bp, Homo sapiens
gcggaggggatccagccac

SEQ ID NO: 4670719 - DNA, 15 bp, Homo sapiens
gcggatcctgctggg

SEQ ID NO: 4670720 - DNA, 16 bp, Homo sapiens
gcggcccaagagcccg

SEQ ID NO: 4670721 - DNA, 17 bp, Homo sapiens
gcggcccaagagcccgt

SEQ ID NO: 4670722 - DNA, 17 bp, Homo sapiens
gcggcccgcgcagctgc

SEQ ID NO: 4670723 - DNA, 16 bp, Homo sapiens
gcggctctagccccag

SEQ ID NO: 4670724 - DNA, 17 bp, Homo sapiens
gcgggcgcactgcctct

SEQ ID NO: 4670725 - DNA, 15 bp, Homo sapiens
gcgggcggagggagg

SEQ ID NO: 4670726 - DNA, 23 bp, Homo sapiens
gcgggcggaggggatccagccac

SEQ ID NO: 4670727 - DNA, 12 bp, Homo sapiens
gcgggtgtcaca

SEQ ID NO: 4670728 - DNA, 13 bp, Homo sapiens
gcgtaaggatgtg

SEQ ID NO: 4670729 - DNA, 12 bp, Homo sapiens
gcgtacacagag

SEQ ID NO: 4670730 - DNA, 15 bp, Homo sapiens
tctcacaaataagta

SEQ ID NO: 4670731 - DNA, 14 bp, Homo sapiens
tctcacctcctgct

SEQ ID NO: 4670732 - DNA, 15 bp, Homo sapiens
tctcacctcctgctg

SEQ ID NO: 4670733 - DNA, 18 bp, Homo sapiens
tctcacctcctgctgggc

SEQ ID NO: 4670734 - DNA, 19 bp, Homo sapiens
tctcacctcctgctgggca

SEQ ID NO: 4670735 - DNA, 21 bp, Homo sapiens
tctcagactttggaaaatgca

SEQ ID NO: 4670736 - DNA, 15 bp, Homo sapiens
tctcaggacacaggc

SEQ ID NO: 4670737 - DNA, 20 bp, Homo sapiens
tctcaggacacaggcctgtg

SEQ ID NO: 4670738 - DNA, 21 bp, Homo sapiens
tctcaggacacaggcctgtgt

SEQ ID NO: 4670739 - DNA, 11 bp, Homo sapiens
tctcagtcccc

SEQ ID NO: 4670740 - DNA, 14 bp, Homo sapiens
tctcagtccccttc

SEQ ID NO: 4670741 - DNA, 13 bp, Homo sapiens
tctcataaattta

SEQ ID NO: 4670742 - DNA, 15 bp, Homo sapiens
tctcatttccagctt

SEQ ID NO: 4670743 - DNA, 17 bp, Homo sapiens
tctcatttccagcttct

SEQ ID NO: 4670744 - DNA, 21 bp, Homo sapiens
tctccacttcatttttaagaa

SEQ ID NO: 4670745 - DNA, 17 bp, Homo sapiens
tctccaggggcctgcag

SEQ ID NO: 4670746 - DNA, 18 bp, Homo sapiens
tctccagtttgcacctgt

SEQ ID NO: 4670747 - DNA, 23 bp, Homo sapiens
tctccataaccccacccttgccc

SEQ ID NO: 4670748 - DNA, 14 bp, Homo sapiens
tctccatgctgcaa

SEQ ID NO: 4670749 - DNA, 15 bp, Homo sapiens
tctccattaataccc

SEQ ID NO: 4670750 - DNA, 16 bp, Homo sapiens
tctccattccctagca

SEQ ID NO: 4670751 - DNA, 17 bp, Homo sapiens
tctccattccctagcag

SEQ ID NO: 4670752 - DNA, 24 bp, Homo sapiens
tctcccacatgaggccatctcagg

SEQ ID NO: 4670753 - DNA, 14 bp, Homo sapiens
tctcccacctagca

SEQ ID NO: 4670754 - DNA, 14 bp, Homo sapiens
tctcccaggcccca

SEQ ID NO: 4670755 - DNA, 17 bp, Homo sapiens
tctcccaggcctctgcc

SEQ ID NO: 4670756 - DNA, 20 bp, Homo sapiens
tctcccaggcctctgcccca

SEQ ID NO: 4670757 - DNA, 14 bp, Homo sapiens
tctccccagtagag

SEQ ID NO: 4670758 - DNA, 17 bp, Homo sapiens
tctcccctccccatctg

SEQ ID NO: 4670759 - DNA, 13 bp, Homo sapiens
tctccctgcctca

SEQ ID NO: 4670760 - DNA, 17 bp, Homo sapiens
tctccctgcctcacatc

SEQ ID NO: 4670761 - DNA, 18 bp, Homo sapiens
tctccctgcctcacatct

SEQ ID NO: 4670762 - DNA, 20 bp, Homo sapiens
tctccctgcctcacatctcc

SEQ ID NO: 4670763 - DNA, 21 bp, Homo sapiens
tctccctgcctcacatctccc

SEQ ID NO: 4670764 - DNA, 21 bp, Homo sapiens
tctcccttacccatcttgctt

SEQ ID NO: 4670765 - DNA, 17 bp, Homo sapiens
tctcccttccacctcac

SEQ ID NO: 4670766 - DNA, 15 bp, Homo sapiens
tctcctatatatttc

SEQ ID NO: 4670767 - DNA, 18 bp, Homo sapiens
tctcctatatatttctat

SEQ ID NO: 4670768 - DNA, 17 bp, Homo sapiens
tctcctcctctgtcttt

SEQ ID NO: 4670769 - DNA, 14 bp, Homo sapiens
tctcctctttgaga

SEQ ID NO: 4670770 - DNA, 13 bp, Homo sapiens
tctcctgccagcc

SEQ ID NO: 4670771 - DNA, 15 bp, Homo sapiens
tctcctgccagccca

SEQ ID NO: 4670772 - DNA, 13 bp, Homo sapiens
tctcctggcccct

SEQ ID NO: 4670773 - DNA, 20 bp, Homo sapiens
tctcctggcccctgcctgct

SEQ ID NO: 4670774 - DNA, 21 bp, Homo sapiens
tctcctggcccctgcctgctg

SEQ ID NO: 4670775 - DNA, 11 bp, Homo sapiens
tctcctggcct

SEQ ID NO: 4670776 - DNA, 18 bp, Homo sapiens
tctcctggccttctagga

SEQ ID NO: 4670777 - DNA, 12 bp, Homo sapiens
tctccttccttc

SEQ ID NO: 4670778 - DNA, 18 bp, Homo sapiens
tctcgaatttgaagagat

SEQ ID NO: 4670779 - DNA, 20 bp, Homo sapiens
tctcgaccctgtcccctagg

SEQ ID NO: 4670780 - DNA, 14 bp, Homo sapiens
tctcgagcgccctg

SEQ ID NO: 4670781 - DNA, 18 bp, Homo sapiens
tctcgagcgccctgcaga

SEQ ID NO: 4670782 - DNA, 22 bp, Homo sapiens
tctcgagcgccctgcagaccct

SEQ ID NO: 4670783 - DNA, 16 bp, Homo sapiens
tctcgcatcttcccaa

SEQ ID NO: 4670784 - DNA, 23 bp, Homo sapiens
tctcggctcagtgcaacctctgc

SEQ ID NO: 4670785 - DNA, 21 bp, Homo sapiens
tctcgtggtaggactgtagaa

SEQ ID NO: 4670786 - DNA, 14 bp, Homo sapiens
tctctacagtgcca

SEQ ID NO: 4670787 - DNA, 16 bp, Homo sapiens
tctctactccctcttg

SEQ ID NO: 4670788 - DNA, 12 bp, Homo sapiens
tctctactgctt

SEQ ID NO: 4670789 - DNA, 15 bp, Homo sapiens
tctctagctttgtca

SEQ ID NO: 4670790 - DNA, 22 bp, Homo sapiens
tctctaggtgtgtccacagagt

SEQ ID NO: 4670791 - DNA, 18 bp, Homo sapiens
tctctattggctcccttt

SEQ ID NO: 4670792 - DNA, 13 bp, Homo sapiens
tctctattttcat

SEQ ID NO: 4670793 - DNA, 14 bp, Homo sapiens
tctctccattcccg

SEQ ID NO: 4670794 - DNA, 15 bp, Homo sapiens
tctctccctccttct

SEQ ID NO: 4670795 - DNA, 13 bp, Homo sapiens
tctctccctgcct

SEQ ID NO: 4670796 - DNA, 14 bp, Homo sapiens
tctctccctgcctc

SEQ ID NO: 4670797 - DNA, 13 bp, Homo sapiens
tctctcctggact

SEQ ID NO: 4670798 - DNA, 11 bp, Homo sapiens
tctctcttcca

SEQ ID NO: 4670799 - DNA, 14 bp, Homo sapiens
tctctcttctctct

SEQ ID NO: 4670800 - DNA, 14 bp, Homo sapiens
tctctgcctggcaa

SEQ ID NO: 4670801 - DNA, 23 bp, Homo sapiens
tctctgcctggcaacatcttact

SEQ ID NO: 4670802 - DNA, 20 bp, Homo sapiens
tctctggaagcccctgggcc

SEQ ID NO: 4670803 - DNA, 18 bp, Homo sapiens
tctctggctactccctgg

SEQ ID NO: 4670804 - DNA, 22 bp, Homo sapiens
tctctggctactccctggacca

SEQ ID NO: 4670805 - DNA, 23 bp, Homo sapiens
tctctggctactccctggaccac

SEQ ID NO: 4670806 - DNA, 15 bp, Homo sapiens
tctctgggcctcaga

SEQ ID NO: 4670807 - DNA, 17 bp, Homo sapiens
tctctgggcctcagagg

SEQ ID NO: 4670808 - DNA, 16 bp, Homo sapiens
tctctgtacttttcat

SEQ ID NO: 4670809 - DNA, 21 bp, Homo sapiens
tctcttcggtcgtatccacct

SEQ ID NO: 4670810 - DNA, 12 bp, Homo sapiens
tctcttgaaacc

SEQ ID NO: 4670811 - DNA, 23 bp, Homo sapiens
tctcttgaataaagtattctagt

SEQ ID NO: 4670812 - DNA, 17 bp, Homo sapiens
tctcttgattgattttt

SEQ ID NO: 4670813 - DNA, 20 bp, Homo sapiens
tctcttgattgatttttaaa

SEQ ID NO: 4670814 - DNA, 16 bp, Homo sapiens
tctctttaaccctccc

SEQ ID NO: 4670815 - DNA, 11 bp, Homo sapiens
tctctttctgt

SEQ ID NO: 4670816 - DNA, 15 bp, Homo sapiens
tctcttttaaagtat

SEQ ID NO: 4670817 - DNA, 22 bp, Homo sapiens
tctcttttaaagtatttataaa

SEQ ID NO: 4670818 - DNA, 19 bp, Homo sapiens
tctcttttatctgtttaaa

SEQ ID NO: 4670819 - DNA, 11 bp, Homo sapiens
tctgaaaacat

SEQ ID NO: 4670820 - DNA, 23 bp, Homo sapiens
tctgaagaaggaaggcctgagcc

SEQ ID NO: 4670821 - DNA, 20 bp, Homo sapiens
tctgaagcccaaagcctgag

SEQ ID NO: 4670822 - DNA, 22 bp, Homo sapiens
tctgaagcccaaagcctgagga

SEQ ID NO: 4670823 - DNA, 18 bp, Homo sapiens
tctgaaggtccaaagagt

SEQ ID NO: 4670824 - DNA, 16 bp, Homo sapiens
tctgaatcatgtctgt

SEQ ID NO: 4670825 - DNA, 13 bp, Homo sapiens
tctgaattttcag

SEQ ID NO: 4670826 - DNA, 14 bp, Homo sapiens
tctgaattttcaga

SEQ ID NO: 4670827 - DNA, 17 bp, Homo sapiens
tctgacaagctggccaa

SEQ ID NO: 4670828 - DNA, 22 bp, Homo sapiens
tctgacaggcgcaactcctcca

SEQ ID NO: 4670829 - DNA, 13 bp, Homo sapiens
tctgacagtagct

SEQ ID NO: 4670830 - DNA, 20 bp, Homo sapiens
tctgacagtagctcttagac

SEQ ID NO: 4670831 - DNA, 22 bp, Homo sapiens
tctgaccccagtggaaaacaaa

SEQ ID NO: 4670832 - DNA, 18 bp, Homo sapiens
tctgactagtagatttct

SEQ ID NO: 4670833 - DNA, 21 bp, Homo sapiens
tctgactagtagatttctatg

SEQ ID NO: 4670834 - DNA, 14 bp, Homo sapiens
tctgactgccaagc

SEQ ID NO: 4670835 - DNA, 13 bp, Homo sapiens
tctgacttttaca

SEQ ID NO: 4670836 - DNA, 16 bp, Homo sapiens
tctgagaccacagagg

SEQ ID NO: 4670837 - DNA, 17 bp, Homo sapiens
tctgagaggccctggat

SEQ ID NO: 4670838 - DNA, 15 bp, Homo sapiens
tctgagatgctcact

SEQ ID NO: 4670839 - DNA, 13 bp, Homo sapiens
tctgaggccagcc

SEQ ID NO: 4670840 - DNA, 12 bp, Homo sapiens
tctgagggggag

SEQ ID NO: 4670841 - DNA, 19 bp, Homo sapiens
tcttagagattttcatttt

SEQ ID NO: 4670842 - DNA, 18 bp, Homo sapiens
tcttagagtgtagctgta

SEQ ID NO: 4670843 - DNA, 14 bp, Homo sapiens
tcttagctttgaaa

SEQ ID NO: 4670844 - DNA, 18 bp, Homo sapiens
tcttaggtagtcatgctg

SEQ ID NO: 4670845 - DNA, 11 bp, Homo sapiens
tcttaggtctt

SEQ ID NO: 4670846 - DNA, 18 bp, Homo sapiens
tcttaggtcttcctgtgg

SEQ ID NO: 4670847 - DNA, 20 bp, Homo sapiens
tcttaggtcttcctgtggct

SEQ ID NO: 4670848 - DNA, 23 bp, Homo sapiens
tcttatacaacagcaaaccctga

SEQ ID NO: 4670849 - DNA, 16 bp, Homo sapiens
tcttatgcaaaatgga

SEQ ID NO: 4670850 - DNA, 22 bp, Homo sapiens
tcttatgggggtgtttctatct

SEQ ID NO: 4670851 - DNA, 20 bp, Homo sapiens
tcttattaatcatacaaact

SEQ ID NO: 4670852 - DNA, 19 bp, Homo sapiens
tcttattccaggagaaggg

SEQ ID NO: 4670853 - DNA, 22 bp, Homo sapiens
tcttattgaaaaaaaaaatgtt

SEQ ID NO: 4670854 - DNA, 15 bp, Homo sapiens
tcttatttatagaat

SEQ ID NO: 4670855 - DNA, 11 bp, Homo sapiens
tcttcaacaga

SEQ ID NO: 4670856 - DNA, 13 bp, Homo sapiens
tcttcaacatgac

SEQ ID NO: 4670857 - DNA, 17 bp, Homo sapiens
tcttcaatatgaatcta

SEQ ID NO: 4670858 - DNA, 17 bp, Homo sapiens
tcttcagtgactcctgc

SEQ ID NO: 4670859 - DNA, 12 bp, Homo sapiens
tcttcatataaa

SEQ ID NO: 4670860 - DNA, 23 bp, Homo sapiens
tcttcatggcatcttcaatatga

SEQ ID NO: 4670861 - DNA, 19 bp, Homo sapiens
tcttccccatctcactctt

SEQ ID NO: 4670862 - DNA, 13 bp, Homo sapiens
tcttcccttgctc

SEQ ID NO: 4670863 - DNA, 17 bp, Homo sapiens
tcttcccttgctcatga

SEQ ID NO: 4670864 - DNA, 17 bp, Homo sapiens
tcttccgcaccctccct

SEQ ID NO: 4670865 - DNA, 21 bp, Homo sapiens
tcttccgcaccctccctagct

SEQ ID NO: 4670866 - DNA, 13 bp, Homo sapiens
tcttcctgccctt

SEQ ID NO: 4670867 - DNA, 21 bp, Homo sapiens
tcttcctgtggctccctctct

SEQ ID NO: 4670868 - DNA, 14 bp, Homo sapiens
tcttcggcagggag

SEQ ID NO: 4670869 - DNA, 16 bp, Homo sapiens
tcttctaaaatagcaa

SEQ ID NO: 4670870 - DNA, 19 bp, Homo sapiens
tcttctattaatcaagaga

SEQ ID NO: 4670871 - DNA, 19 bp, Homo sapiens
tcttctccattccctagca

SEQ ID NO: 4670872 - DNA, 18 bp, Homo sapiens
tcttctgaagatcagaac

SEQ ID NO: 4670873 - DNA, 20 bp, Homo sapiens
tcttctgaagatcagaacat

SEQ ID NO: 4670874 - DNA, 20 bp, Homo sapiens
tcttctgactgccccctcct

SEQ ID NO: 4670875 - DNA, 19 bp, Homo sapiens
tcttcttgttgaccctttt

SEQ ID NO: 4670876 - DNA, 20 bp, Homo sapiens
tcttgaaacctgttaaaaca

SEQ ID NO: 4670877 - DNA, 19 bp, Homo sapiens
tcttgaataaagtattcta

SEQ ID NO: 4670878 - DNA, 11 bp, Homo sapiens
tcttgaatgtg

SEQ ID NO: 4670879 - DNA, 22 bp, Homo sapiens
tcttgagcagttagcagaccta

SEQ ID NO: 4670880 - DNA, 18 bp, Homo sapiens
tcttgattgatttttaaa

SEQ ID NO: 4670881 - DNA, 20 bp, Homo sapiens
tcttgatttcacatttctac

SEQ ID NO: 4670882 - DNA, 18 bp, Homo sapiens
tcttgcaaagcctttaaa

SEQ ID NO: 4670883 - DNA, 20 bp, Homo sapiens
tcttgctcattcttcagttc

SEQ ID NO: 4670884 - DNA, 17 bp, Homo sapiens
tcttgcttccaagacca

SEQ ID NO: 4670885 - DNA, 16 bp, Homo sapiens
tcttggaaagaaacaa

SEQ ID NO: 4670886 - DNA, 16 bp, Homo sapiens
tcttggacactgtaca

SEQ ID NO: 4670887 - DNA, 17 bp, Homo sapiens
tcttggacactgtacaa

SEQ ID NO: 4670888 - DNA, 17 bp, Homo sapiens
tcttggagaccctgcaa

SEQ ID NO: 4670889 - DNA, 16 bp, Homo sapiens
tcttggctggcttcct

SEQ ID NO: 4670890 - DNA, 15 bp, Homo sapiens
tcttggctttcatgt

SEQ ID NO: 4670891 - DNA, 16 bp, Homo sapiens
tcttggctttcatgtt

SEQ ID NO: 4670892 - DNA, 14 bp, Homo sapiens
tcttgggaaatatg

SEQ ID NO: 4670893 - DNA, 20 bp, Homo sapiens
tcttgggaaatatgaatgcc

SEQ ID NO: 4670894 - DNA, 16 bp, Homo sapiens
tcttgggaacagggtt

SEQ ID NO: 4670895 - DNA, 17 bp, Homo sapiens
tcttggggacatctctt

SEQ ID NO: 4670896 - DNA, 23 bp, Homo sapiens
tcttggggccactttcagagccc

SEQ ID NO: 4670897 - DNA, 14 bp, Homo sapiens
tcttgtaaagactg

SEQ ID NO: 4670898 - DNA, 15 bp, Homo sapiens
tcttgtaaagactgg

SEQ ID NO: 4670899 - DNA, 23 bp, Homo sapiens
tcttgtaaagactggttttctgc

SEQ ID NO: 4670900 - DNA, 19 bp, Homo sapiens
tcttgtacatgtgtagcct

SEQ ID NO: 4670901 - DNA, 20 bp, Homo sapiens
tcttgtcacccaggctggag

SEQ ID NO: 4670902 - DNA, 18 bp, Homo sapiens
tcttgtcagacataaagc

SEQ ID NO: 4670903 - DNA, 20 bp, Homo sapiens
tcttgtcagacataaagcca

SEQ ID NO: 4670904 - DNA, 20 bp, Homo sapiens
tcttgtggttgtgtgtgttc

SEQ ID NO: 4670905 - DNA, 21 bp, Homo sapiens
tcttgtggttgtgtgtgttct

SEQ ID NO: 4670906 - DNA, 20 bp, Homo sapiens
tcttgtgttaacttgcctcc

SEQ ID NO: 4670907 - DNA, 19 bp, Homo sapiens
tctttaaaaaaaaatcttg

SEQ ID NO: 4670908 - DNA, 21 bp, Homo sapiens
tctttaaaaaaaaatcttgtg

SEQ ID NO: 4670909 - DNA, 16 bp, Homo sapiens
tctttaaaagaatgac

SEQ ID NO: 4670910 - DNA, 21 bp, Homo sapiens
tctttaaaccactaaaataca

SEQ ID NO: 4670911 - DNA, 16 bp, Homo sapiens
tctttaataaattgct

SEQ ID NO: 4670912 - DNA, 12 bp, Homo sapiens
tctttaattcct

SEQ ID NO: 4670913 - DNA, 13 bp, Homo sapiens
tctttaattcctt

SEQ ID NO: 4670914 - DNA, 14 bp, Homo sapiens
tctttacaaactga

SEQ ID NO: 4670915 - DNA, 19 bp, Homo sapiens
tctttactattaaaatatt

SEQ ID NO: 4670916 - DNA, 21 bp, Homo sapiens
tctttactattaaaatatttt

SEQ ID NO: 4670917 - DNA, 17 bp, Homo sapiens
tctttcacaggtagcct

SEQ ID NO: 4670918 - DNA, 15 bp, Homo sapiens
tctttcacctgggtg

SEQ ID NO: 4670919 - DNA, 22 bp, Homo sapiens
tctttcagattttttgaaccat

SEQ ID NO: 4670920 - DNA, 11 bp, Homo sapiens
tctttccaaat

SEQ ID NO: 4670921 - DNA, 15 bp, Homo sapiens
tctttccaaattaaa

SEQ ID NO: 4670922 - DNA, 16 bp, Homo sapiens
tctttccacttgccct

SEQ ID NO: 4670923 - DNA, 21 bp, Homo sapiens
tctttccatctatcactgcat

SEQ ID NO: 4670924 - DNA, 13 bp, Homo sapiens
tctttcccccagg

SEQ ID NO: 4670925 - DNA, 15 bp, Homo sapiens
tctttccttgttcag

SEQ ID NO: 4670926 - DNA, 16 bp, Homo sapiens
tctttccttgttcagc

SEQ ID NO: 4670927 - DNA, 14 bp, Homo sapiens
tctttctaatgctg

SEQ ID NO: 4670928 - DNA, 22 bp, Homo sapiens
tctttctagttcagctgcccca

SEQ ID NO: 4670929 - DNA, 19 bp, Homo sapiens
tctttctgtttcctggcct

SEQ ID NO: 4670930 - DNA, 13 bp, Homo sapiens
tctttctttctct

SEQ ID NO: 4670931 - DNA, 12 bp, Homo sapiens
tctttgaaatat

SEQ ID NO: 4670932 - DNA, 15 bp, Homo sapiens
tctttgtatcttaaa

SEQ ID NO: 4670933 - DNA, 16 bp, Homo sapiens
tctttgtatcttaaat

SEQ ID NO: 4670934 - DNA, 15 bp, Homo sapiens
tctttgtctaaaaca

SEQ ID NO: 4670935 - DNA, 20 bp, Homo sapiens
tctttgtctaaaacaataaa

SEQ ID NO: 4670936 - DNA, 19 bp, Homo sapiens
tcttttaaaaattcaaatg

SEQ ID NO: 4670937 - DNA, 20 bp, Homo sapiens
tcttttaaagtatttataaa

SEQ ID NO: 4670938 - DNA, 15 bp, Homo sapiens
tcttttatttaacaa

SEQ ID NO: 4670939 - DNA, 13 bp, Homo sapiens
tcttttcacatta

SEQ ID NO: 4670940 - DNA, 22 bp, Homo sapiens
tcttttcatctgggaaagacat

SEQ ID NO: 4670941 - DNA, 15 bp, Homo sapiens
tcttttgaattgttt

SEQ ID NO: 4670942 - DNA, 12 bp, Homo sapiens
tctttttatctc

SEQ ID NO: 4670943 - DNA, 13 bp, Homo sapiens
tcttttttatgtt

SEQ ID NO: 4670944 - DNA, 18 bp, Homo sapiens
tcttttttatgttaaaaa

SEQ ID NO: 4670945 - DNA, 13 bp, Homo sapiens
tcttttttcaaaa

SEQ ID NO: 4670946 - DNA, 23 bp, Homo sapiens
tcttttttgtttgtttctttgtg

SEQ ID NO: 4670947 - DNA, 21 bp, Homo sapiens
tctttttttaaaaataaatct

SEQ ID NO: 4670948 - DNA, 17 bp, Homo sapiens
tgaaaaaaaaaatgttg

SEQ ID NO: 4670949 - DNA, 18 bp, Homo sapiens
tgaaaaaaaaaatgttga

SEQ ID NO: 4670950 - DNA, 20 bp, Homo sapiens
tgaaaaagttccatagaaaa

SEQ ID NO: 4670951 - DNA, 11 bp, Homo sapiens
tgaaaaatata

SEQ ID NO: 4670952 - DNA, 16 bp, Homo sapiens
tgaaaaattaactttt

SEQ ID NO: 4670953 - DNA, 15 bp, Homo sapiens
tgaaaaatttctaac

SEQ ID NO: 4670954 - DNA, 15 bp, Homo sapiens
tgaaaacctacatat

SEQ ID NO: 4670955 - DNA, 22 bp, Homo sapiens
tgaaaactcatgatcaagatat

SEQ ID NO: 4670956 - DNA, 13 bp, Homo sapiens
tgaaaagatgtac

SEQ ID NO: 4670957 - DNA, 22 bp, Homo sapiens
tgaaaagatgtacctggtggat

SEQ ID NO: 4670958 - DNA, 23 bp, Homo sapiens
tgaaaatatatattatatacata

SEQ ID NO: 4670959 - DNA, 14 bp, Homo sapiens
tgaaaatcttggag

SEQ ID NO: 4670960 - DNA, 15 bp, Homo sapiens
tgaaaattatttgaa

SEQ ID NO: 4670961 - DNA, 16 bp, Homo sapiens
tgaaaattatttgaaa

SEQ ID NO: 4670962 - DNA, 14 bp, Homo sapiens
tgaaacaaagaagg

SEQ ID NO: 4670963 - DNA, 18 bp, Homo sapiens
tgaaacaaagtactcttt

SEQ ID NO: 4670964 - DNA, 14 bp, Homo sapiens
tgaaacaactcctt

SEQ ID NO: 4670965 - DNA, 20 bp, Homo sapiens
tgaaacaactccttttactg

SEQ ID NO: 4670966 - DNA, 18 bp, Homo sapiens
tgaaacagttccatttat

SEQ ID NO: 4670967 - DNA, 22 bp, Homo sapiens
tgaaacagttgctgtgaacttt

SEQ ID NO: 4670968 - DNA, 18 bp, Homo sapiens
tgaaacctgttaaaacaa

SEQ ID NO: 4670969 - DNA, 19 bp, Homo sapiens
tgaaactcatagacactga

SEQ ID NO: 4670970 - DNA, 22 bp, Homo sapiens
tgaaactggttttaagtgcttt

SEQ ID NO: 4670971 - DNA, 13 bp, Homo sapiens
tgaaagaaaggga

SEQ ID NO: 4670972 - DNA, 22 bp, Homo sapiens
tgaaagaaagggacccacctgc

SEQ ID NO: 4670973 - DNA, 14 bp, Homo sapiens
tgaaagaagcaaga

SEQ ID NO: 4670974 - DNA, 20 bp, Homo sapiens
tgaaagaatcagtaggacca

SEQ ID NO: 4670975 - DNA, 19 bp, Homo sapiens
tgaaagggcacttaatttg

SEQ ID NO: 4670976 - DNA, 20 bp, Homo sapiens
tgaaagtagcagtgtgaagt

SEQ ID NO: 4670977 - DNA, 20 bp, Homo sapiens
tgaaagtgttaattttacct

SEQ ID NO: 4670978 - DNA, 18 bp, Homo sapiens
tgaaataacaaaatggac

SEQ ID NO: 4670979 - DNA, 14 bp, Homo sapiens
tgaaataactggaa

SEQ ID NO: 4670980 - DNA, 13 bp, Homo sapiens
tgaaatacatcct

SEQ ID NO: 4670981 - DNA, 20 bp, Homo sapiens
tgaaatagttattttaatac

SEQ ID NO: 4670982 - DNA, 12 bp, Homo sapiens
tgaaatctgtct

SEQ ID NO: 4670983 - DNA, 14 bp, Homo sapiens
tgaaatctgtcttt

SEQ ID NO: 4670984 - DNA, 18 bp, Homo sapiens
tgaaatgtttaataaagc

SEQ ID NO: 4670985 - DNA, 19 bp, Homo sapiens
tgaaattaacacaaaggaa

SEQ ID NO: 4670986 - DNA, 20 bp, Homo sapiens
tgaaattaacacaaaggaag

SEQ ID NO: 4670987 - DNA, 23 bp, Homo sapiens
tgaaattagggcccaattaataa

SEQ ID NO: 4670988 - DNA, 18 bp, Homo sapiens
tgaacaaagctcaaagta

SEQ ID NO: 4670989 - DNA, 15 bp, Homo sapiens
tgaacaaatgtctta

SEQ ID NO: 4670990 - DNA, 14 bp, Homo sapiens
tgaacagctttgta

SEQ ID NO: 4670991 - DNA, 15 bp, Homo sapiens
tgaaccaacatcttt

SEQ ID NO: 4670992 - DNA, 22 bp, Homo sapiens
tgaacccaggacaagcatggtc

SEQ ID NO: 4670993 - DNA, 13 bp, Homo sapiens
tgaaccccctccc

SEQ ID NO: 4670994 - DNA, 14 bp, Homo sapiens
tgaaccctgccctg

SEQ ID NO: 4670995 - DNA, 20 bp, Homo sapiens
tgaactagctaccatataag

SEQ ID NO: 4670996 - DNA, 18 bp, Homo sapiens
tgaactaggctgagcaat

SEQ ID NO: 4670997 - DNA, 23 bp, Homo sapiens
tgaactattccccagcagggtct

SEQ ID NO: 4670998 - DNA, 18 bp, Homo sapiens
tgaactctcccctcccca

SEQ ID NO: 4670999 - DNA, 23 bp, Homo sapiens
tgaactctcccctccccatctgt

SEQ ID NO: 4671000 - DNA, 13 bp, Homo sapiens
tgaactgacaggc

SEQ ID NO: 4671001 - DNA, 19 bp, Homo sapiens
tgaactgtgtgtgaatctg

SEQ ID NO: 4671002 - DNA, 21 bp, Homo sapiens
tgaacttccaagctccaaatc

SEQ ID NO: 4671003 - DNA, 14 bp, Homo sapiens
tgaacttggctttc

SEQ ID NO: 4671004 - DNA, 22 bp, Homo sapiens
tgaacttggctttcctgtttct

SEQ ID NO: 4671005 - DNA, 23 bp, Homo sapiens
tgaacttggctttcctgtttcta

SEQ ID NO: 4671006 - DNA, 16 bp, Homo sapiens
tgaagaaagtcaaaaa

SEQ ID NO: 4671007 - DNA, 20 bp, Homo sapiens
tgaagaaagtcaaaaaatta

SEQ ID NO: 4671008 - DNA, 11 bp, Homo sapiens
tgaagaatcac

SEQ ID NO: 4671009 - DNA, 20 bp, Homo sapiens
tgaagagagggacaggcact

SEQ ID NO: 4671010 - DNA, 22 bp, Homo sapiens
tgaagagagggacaggcactcc

SEQ ID NO: 4671011 - DNA, 23 bp, Homo sapiens
tgaagagagggacaggcactcca

SEQ ID NO: 4671012 - DNA, 17 bp, Homo sapiens
tgaagagatccttccat

SEQ ID NO: 4671013 - DNA, 19 bp, Homo sapiens
tgaagataacgccttccct

SEQ ID NO: 4671014 - DNA, 21 bp, Homo sapiens
tgaagatcagaacattcagct

SEQ ID NO: 4671015 - DNA, 22 bp, Homo sapiens
tgaagatcatatacgtgaaaat

SEQ ID NO: 4671016 - DNA, 19 bp, Homo sapiens
tgaagccaattcagacagg

SEQ ID NO: 4671017 - DNA, 16 bp, Homo sapiens
tgaagccatgtagcca

SEQ ID NO: 4671018 - DNA, 16 bp, Homo sapiens
tgaagccgactctggc

SEQ ID NO: 4671019 - DNA, 18 bp, Homo sapiens
tgaagccgactctggccc

SEQ ID NO: 4671020 - DNA, 19 bp, Homo sapiens
tgaagccgactctggccct

SEQ ID NO: 4671021 - DNA, 16 bp, Homo sapiens
tgaagcgaacatcttc

SEQ ID NO: 4671022 - DNA, 18 bp, Homo sapiens
tgaagcgaacatcttcat

SEQ ID NO: 4671023 - DNA, 23 bp, Homo sapiens
tgaagcgaacatcttcatataaa

SEQ ID NO: 4671024 - DNA, 12 bp, Homo sapiens
tgaagctgcaca

SEQ ID NO: 4671025 - DNA, 19 bp, Homo sapiens
tgaaggcagtggcagggga

SEQ ID NO: 4671026 - DNA, 18 bp, Homo sapiens
tgaaggcctcgcaggaag

SEQ ID NO: 4671027 - DNA, 19 bp, Homo sapiens
tgaaggctttcagggcctc

SEQ ID NO: 4671028 - DNA, 15 bp, Homo sapiens
tgaagggaagagaca

SEQ ID NO: 4671029 - DNA, 15 bp, Homo sapiens
tgaagggggcggcct

SEQ ID NO: 4671030 - DNA, 14 bp, Homo sapiens
tgaagggtaaggga

SEQ ID NO: 4671031 - DNA, 19 bp, Homo sapiens
tgaaggtctgacagtagct

SEQ ID NO: 4671032 - DNA, 20 bp, Homo sapiens
tgaaggtctttgttatgaca

SEQ ID NO: 4671033 - DNA, 22 bp, Homo sapiens
tgaaggtctttgttatgacagt

SEQ ID NO: 4671034 - DNA, 21 bp, Homo sapiens
tgaagtaaattaaacattttt

SEQ ID NO: 4671035 - DNA, 13 bp, Homo sapiens
tgaagtatattct

SEQ ID NO: 4671036 - DNA, 22 bp, Homo sapiens
tgaagtatattcttattggaaa

SEQ ID NO: 4671037 - DNA, 23 bp, Homo sapiens
tgaagtatattcttattggaaat

SEQ ID NO: 4671038 - DNA, 13 bp, Homo sapiens
tgaagtatggtgt

SEQ ID NO: 4671039 - DNA, 18 bp, Homo sapiens
tgaagtatggtgtgttca

SEQ ID NO: 4671040 - DNA, 12 bp, Homo sapiens
tgaagtattgct

SEQ ID NO: 4671041 - DNA, 16 bp, Homo sapiens
tgaagtattgctgaaa

SEQ ID NO: 4671042 - DNA, 15 bp, Homo sapiens
tgaagtctagaatca

SEQ ID NO: 4671043 - DNA, 17 bp, Homo sapiens
tgaagtgcgtgaatgta

SEQ ID NO: 4671044 - DNA, 12 bp, Homo sapiens
tgaagtgctgtt

SEQ ID NO: 4671045 - DNA, 14 bp, Homo sapiens
tgaagttgtggagg

SEQ ID NO: 4671046 - DNA, 13 bp, Homo sapiens
tgaataaagtgct

SEQ ID NO: 4671047 - DNA, 22 bp, Homo sapiens
tgaataacctgcacaggcttgc

SEQ ID NO: 4671048 - DNA, 13 bp, Homo sapiens
tgaataagcagaa

SEQ ID NO: 4671049 - DNA, 16 bp, Homo sapiens
tgaataagcagaacat

SEQ ID NO: 4671050 - DNA, 14 bp, Homo sapiens
tgaataatgaaaat

SEQ ID NO: 4671051 - DNA, 23 bp, Homo sapiens
tgaatacattaacggtgctaaaa

SEQ ID NO: 4671052 - DNA, 15 bp, Homo sapiens
tgaatactcttgaaa

SEQ ID NO: 4671053 - DNA, 21 bp, Homo sapiens
tgaatactcttgaaaggccaa

SEQ ID NO: 4671054 - DNA, 17 bp, Homo sapiens
tgaatataaagcttaat

SEQ ID NO: 4671055 - DNA, 13 bp, Homo sapiens
tgaatcatgtctg

SEQ ID NO: 4671056 - DNA, 19 bp, Homo sapiens
tgaatccatgggtctggct

SEQ ID NO: 4671057 - DNA, 21 bp, Homo sapiens
tgaatccatgggtctggctag

SEQ ID NO: 4671058 - DNA, 18 bp, Homo sapiens
tgaatctgcttttcctct

SEQ ID NO: 4671059 - DNA, 19 bp, Homo sapiens
tgaatctgcttttcctctg

SEQ ID NO: 4671060 - DNA, 21 bp, Homo sapiens
tgagagaaagagagaagccag

SEQ ID NO: 4671061 - DNA, 16 bp, Homo sapiens
tgagagaccacacatt

SEQ ID NO: 4671062 - DNA, 18 bp, Homo sapiens
tgagagcgacacagacgt

SEQ ID NO: 4671063 - DNA, 17 bp, Homo sapiens
tgagaggcccccaccct

SEQ ID NO: 4671064 - DNA, 18 bp, Homo sapiens
tgagaggcccccaccctt

SEQ ID NO: 4671065 - DNA, 20 bp, Homo sapiens
tgagaggcccccacccttgg

SEQ ID NO: 4671066 - DNA, 16 bp, Homo sapiens
tgagaggccctggatc

SEQ ID NO: 4671067 - DNA, 17 bp, Homo sapiens
tgagaggccctggatca

SEQ ID NO: 4671068 - DNA, 23 bp, Homo sapiens
tgagaggccctggatcagcgtgg

SEQ ID NO: 4671069 - DNA, 21 bp, Homo sapiens
tgagagtgacggctggcatgg

SEQ ID NO: 4671070 - DNA, 23 bp, Homo sapiens
tgagatagcattgtgaactgaca

SEQ ID NO: 4671071 - DNA, 20 bp, Homo sapiens
tgagatctgctgtcctgttt

SEQ ID NO: 4671072 - DNA, 14 bp, Homo sapiens
tgagatgcagctgg

SEQ ID NO: 4671073 - DNA, 18 bp, Homo sapiens
tgagatgcagctggaaaa

SEQ ID NO: 4671074 - DNA, 18 bp, Homo sapiens
tgagatggagtctcactc

SEQ ID NO: 4671075 - DNA, 21 bp, Homo sapiens
tgagatggagtctcactcttg

SEQ ID NO: 4671076 - DNA, 17 bp, Homo sapiens
tgagatggtatgaaata

SEQ ID NO: 4671077 - DNA, 22 bp, Homo sapiens
tgagatttaagttcctgctgcc

SEQ ID NO: 4671078 - DNA, 19 bp, Homo sapiens
tgagattttcctccatttt

SEQ ID NO: 4671079 - DNA, 21 bp, Homo sapiens
tgagattttcctccattttta

SEQ ID NO: 4671080 - DNA, 19 bp, Homo sapiens
tgagcactgccaggaggga

SEQ ID NO: 4671081 - DNA, 18 bp, Homo sapiens
tgagcagaatgttgtact

SEQ ID NO: 4671082 - DNA, 22 bp, Homo sapiens
tgagcagctgaataacctgcac

SEQ ID NO: 4671083 - DNA, 19 bp, Homo sapiens
tgagcagggtcaagcctct

SEQ ID NO: 4671084 - DNA, 21 bp, Homo sapiens
tgagccaaccttgctcttggg

SEQ ID NO: 4671085 - DNA, 16 bp, Homo sapiens
tgagcccagaacttca

SEQ ID NO: 4671086 - DNA, 13 bp, Homo sapiens
tgagcccagagaa

SEQ ID NO: 4671087 - DNA, 17 bp, Homo sapiens
tgagcccagctgggtca

SEQ ID NO: 4671088 - DNA, 11 bp, Homo sapiens
tgagcccaggg

SEQ ID NO: 4671089 - DNA, 12 bp, Homo sapiens
tgagcccaggga

SEQ ID NO: 4671090 - DNA, 14 bp, Homo sapiens
tgagcccagggagg

SEQ ID NO: 4671091 - DNA, 12 bp, Homo sapiens
tgagcctgggct

SEQ ID NO: 4671092 - DNA, 19 bp, Homo sapiens
tgagcgagtggatgctgtg

SEQ ID NO: 4671093 - DNA, 20 bp, Homo sapiens
tgagcgagtggatgctgtgc

SEQ ID NO: 4671094 - DNA, 20 bp, Homo sapiens
tgagcgtcaaagaaaatgcc

SEQ ID NO: 4671095 - DNA, 21 bp, Homo sapiens
tgagcgtcaaagaaaatgcct

SEQ ID NO: 4671096 - DNA, 19 bp, Homo sapiens
tgagctatttccttccagc

SEQ ID NO: 4671097 - DNA, 21 bp, Homo sapiens
tgagctatttccttccagcct

SEQ ID NO: 4671098 - DNA, 22 bp, Homo sapiens
tgagctatttccttccagcctt

SEQ ID NO: 4671099 - DNA, 17 bp, Homo sapiens
tgagctcacaaggcagc

SEQ ID NO: 4671100 - DNA, 15 bp, Homo sapiens
tgagctctgagaggc

SEQ ID NO: 4671101 - DNA, 19 bp, Homo sapiens
tgagctctgagaggccctg

SEQ ID NO: 4671102 - DNA, 22 bp, Homo sapiens
tgagctctgagaggccctggat

SEQ ID NO: 4671103 - DNA, 19 bp, Homo sapiens
tgagctggaaggggccacg

SEQ ID NO: 4671104 - DNA, 19 bp, Homo sapiens
tgagctggggactcaggga

SEQ ID NO: 4671105 - DNA, 20 bp, Homo sapiens
tgagctggggactcagggac

SEQ ID NO: 4671106 - DNA, 21 bp, Homo sapiens
tgagctttagctctctctaga

SEQ ID NO: 4671107 - DNA, 13 bp, Homo sapiens
tgaggacagctgt

SEQ ID NO: 4671108 - DNA, 14 bp, Homo sapiens
tgaggacagctgtc

SEQ ID NO: 4671109 - DNA, 16 bp, Homo sapiens
tgaggacagctgtcct

SEQ ID NO: 4671110 - DNA, 18 bp, Homo sapiens
tgaggacagctgtcctct

SEQ ID NO: 4671111 - DNA, 22 bp, Homo sapiens
tgaggaccccttaatcttgctt

SEQ ID NO: 4671112 - DNA, 16 bp, Homo sapiens
tgaggagatgaccagg

SEQ ID NO: 4671113 - DNA, 22 bp, Homo sapiens
tgaggagctcaacggtctggca

SEQ ID NO: 4671114 - DNA, 22 bp, Homo sapiens
tgaggaggatgtccctgggcca

SEQ ID NO: 4671115 - DNA, 20 bp, Homo sapiens
tgaggatagtagttaaataa

SEQ ID NO: 4671116 - DNA, 17 bp, Homo sapiens
tgaggatgagacccagc

SEQ ID NO: 4671117 - DNA, 11 bp, Homo sapiens
tgaggcaataa

SEQ ID NO: 4671118 - DNA, 12 bp, Homo sapiens
tgaggccagcct

SEQ ID NO: 4671119 - DNA, 17 bp, Homo sapiens
tgaggccagcctggcct

SEQ ID NO: 4671120 - DNA, 18 bp, Homo sapiens
tgaggccagcctggcctc

SEQ ID NO: 4671121 - DNA, 14 bp, Homo sapiens
tgaggccatctcag

SEQ ID NO: 4671122 - DNA, 20 bp, Homo sapiens
tgaggccatctcaggagatg

SEQ ID NO: 4671123 - DNA, 12 bp, Homo sapiens
tgaggccctgca

SEQ ID NO: 4671124 - DNA, 15 bp, Homo sapiens
tgaggctggcacagg

SEQ ID NO: 4671125 - DNA, 21 bp, Homo sapiens
tgagggaaatctgtaaagcca

SEQ ID NO: 4671126 - DNA, 17 bp, Homo sapiens
tgagggaagagtagctg

SEQ ID NO: 4671127 - DNA, 12 bp, Homo sapiens
tgagggaaggag

SEQ ID NO: 4671128 - DNA, 17 bp, Homo sapiens
tgagggcagcagccagc

SEQ ID NO: 4671129 - DNA, 18 bp, Homo sapiens
tgagggcagcagccagcc

SEQ ID NO: 4671130 - DNA, 18 bp, Homo sapiens
tgagggcagttcgcagcc

SEQ ID NO: 4671131 - DNA, 22 bp, Homo sapiens
tgaggtcaccaggggaggagcc

SEQ ID NO: 4671132 - DNA, 14 bp, Homo sapiens
tgaggtcagggagt

SEQ ID NO: 4671133 - DNA, 15 bp, Homo sapiens
tgaggtcagggagtg

SEQ ID NO: 4671134 - DNA, 13 bp, Homo sapiens
tgaggtcctgagc

SEQ ID NO: 4671135 - DNA, 17 bp, Homo sapiens
tgaggtcctgagcactg

SEQ ID NO: 4671136 - DNA, 18 bp, Homo sapiens
tgaggtcctgagcactgc

SEQ ID NO: 4671137 - DNA, 19 bp, Homo sapiens
tgaggtcctgagcactgcc

SEQ ID NO: 4671138 - DNA, 19 bp, Homo sapiens
tgaggtctcgaccctgtcc

SEQ ID NO: 4671139 - DNA, 20 bp, Homo sapiens
tgaggtgcccactccgccag

SEQ ID NO: 4671140 - DNA, 15 bp, Homo sapiens
tgaggtgcccaggag

SEQ ID NO: 4671141 - DNA, 17 bp, Homo sapiens
tgagtaaactgaggccc

SEQ ID NO: 4671142 - DNA, 13 bp, Homo sapiens
tgagtagctggga

SEQ ID NO: 4671143 - DNA, 14 bp, Homo sapiens
tgagtatttctgtt

SEQ ID NO: 4671144 - DNA, 19 bp, Homo sapiens
tgagtatttctgttccttt

SEQ ID NO: 4671145 - DNA, 15 bp, Homo sapiens
tgagtcctggcccaa

SEQ ID NO: 4671146 - DNA, 18 bp, Homo sapiens
tgagtctatgttcaaaga

SEQ ID NO: 4671147 - DNA, 23 bp, Homo sapiens
tgagtctatgttcaaagactgtg

SEQ ID NO: 4671148 - DNA, 15 bp, Homo sapiens
tgagtctgtttccca

SEQ ID NO: 4671149 - DNA, 17 bp, Homo sapiens
tgagtctgtttcccaag

SEQ ID NO: 4671150 - DNA, 19 bp, Homo sapiens
tgagtgaagtattgctgaa

SEQ ID NO: 4671151 - DNA, 22 bp, Homo sapiens
tgagtgaagtattgctgaaaag

SEQ ID NO: 4671152 - DNA, 22 bp, Homo sapiens
tgagtggcttcactcctgctgt

SEQ ID NO: 4671153 - DNA, 21 bp, Homo sapiens
tgagtgggagagtacctgtgt

SEQ ID NO: 4671154 - DNA, 12 bp, Homo sapiens
tgagtgtgacag

SEQ ID NO: 4671155 - DNA, 19 bp, Homo sapiens
tgagttggggtctggcagc

SEQ ID NO: 4671156 - DNA, 21 bp, Homo sapiens
tgagttggggtctggcagcct

SEQ ID NO: 4671157 - DNA, 17 bp, Homo sapiens
tgagtttcagctggaaa

SEQ ID NO: 4671158 - DNA, 18 bp, Homo sapiens
tgagtttcagctggaaac

SEQ ID NO: 4671159 - DNA, 22 bp, Homo sapiens
tgagtttcagctggaaacttct

SEQ ID NO: 4671160 - DNA, 22 bp, Homo sapiens
tgagttttagttggtctttcca

SEQ ID NO: 4671161 - DNA, 19 bp, Homo sapiens
tgataaacctgccaagagt

SEQ ID NO: 4671162 - DNA, 13 bp, Homo sapiens
tgataacaccttg

SEQ ID NO: 4671163 - DNA, 20 bp, Homo sapiens
tgataataggggattttaaa

SEQ ID NO: 4671164 - DNA, 20 bp, Homo sapiens
tgatactctttctaatgctg

SEQ ID NO: 4671165 - DNA, 18 bp, Homo sapiens
tgatactggaggaacact

SEQ ID NO: 4671166 - DNA, 22 bp, Homo sapiens
tgatagaactttgatggatttt

SEQ ID NO: 4671167 - DNA, 14 bp, Homo sapiens
tgatagctgtttca

SEQ ID NO: 4671168 - DNA, 17 bp, Homo sapiens
tgataggaaggaaactg

SEQ ID NO: 4671169 - DNA, 16 bp, Homo sapiens
tgcagcacctccaggc

SEQ ID NO: 4671170 - DNA, 23 bp, Homo sapiens
tgcagcagaaaggctctgaaggt

SEQ ID NO: 4671171 - DNA, 13 bp, Homo sapiens
tgcagcagagcct

SEQ ID NO: 4671172 - DNA, 13 bp, Homo sapiens
tgcagcaggagtg

SEQ ID NO: 4671173 - DNA, 20 bp, Homo sapiens
tgcagcaggagtggtgcaga

SEQ ID NO: 4671174 - DNA, 22 bp, Homo sapiens
tgcagcaggagtggtgcagaca

SEQ ID NO: 4671175 - DNA, 14 bp, Homo sapiens
tgcagctatctggt

SEQ ID NO: 4671176 - DNA, 19 bp, Homo sapiens
tgcagctggaaaagggtct

SEQ ID NO: 4671177 - DNA, 19 bp, Homo sapiens
tgcagcttgtagccagccg

SEQ ID NO: 4671178 - DNA, 21 bp, Homo sapiens
tgcagcttgtagccagccggg

SEQ ID NO: 4671179 - DNA, 13 bp, Homo sapiens
tgcagggcagtca

SEQ ID NO: 4671180 - DNA, 14 bp, Homo sapiens
tgcagggcagtcat

SEQ ID NO: 4671181 - DNA, 23 bp, Homo sapiens
tgcagggccatctgactgccaag

SEQ ID NO: 4671182 - DNA, 13 bp, Homo sapiens
tgcagggcctggc

SEQ ID NO: 4671183 - DNA, 19 bp, Homo sapiens
tgcaggggatggggtgggg

SEQ ID NO: 4671184 - DNA, 14 bp, Homo sapiens
tgcaggggtgacgg

SEQ ID NO: 4671185 - DNA, 22 bp, Homo sapiens
tgcaggtagacctgtctcctgg

SEQ ID NO: 4671186 - DNA, 21 bp, Homo sapiens
tgcaggtatttcagaaggaga

SEQ ID NO: 4671187 - DNA, 20 bp, Homo sapiens
tgcaggttcttcttcctgaa

SEQ ID NO: 4671188 - DNA, 18 bp, Homo sapiens
tgcagtactttgtgcatt

SEQ ID NO: 4671189 - DNA, 21 bp, Homo sapiens
tgcagtatcatgccctgtgca

SEQ ID NO: 4671190 - DNA, 14 bp, Homo sapiens
tgcagtctttcccc

SEQ ID NO: 4671191 - DNA, 19 bp, Homo sapiens
tgcagtctttcccccagga

SEQ ID NO: 4671192 - DNA, 15 bp, Homo sapiens
tgcagtggagggggc

SEQ ID NO: 4671193 - DNA, 18 bp, Homo sapiens
tgcagtggcgcattctag

SEQ ID NO: 4671194 - DNA, 14 bp, Homo sapiens
tgcagtttcttttc

SEQ ID NO: 4671195 - DNA, 18 bp, Homo sapiens
tgcagtttcttttcacat

SEQ ID NO: 4671196 - DNA, 19 bp, Homo sapiens
tgcataataaatgcttcag

SEQ ID NO: 4671197 - DNA, 12 bp, Homo sapiens
tgcatactttat

SEQ ID NO: 4671198 - DNA, 14 bp, Homo sapiens
tgcatactttattg

SEQ ID NO: 4671199 - DNA, 21 bp, Homo sapiens
tgcatatgtcactagaatgga

SEQ ID NO: 4671200 - DNA, 19 bp, Homo sapiens
tgcatatttataagagaag

SEQ ID NO: 4671201 - DNA, 15 bp, Homo sapiens
tgcatcacatctgca

SEQ ID NO: 4671202 - DNA, 22 bp, Homo sapiens
tgcatcacatctgcacactctc

SEQ ID NO: 4671203 - DNA, 20 bp, Homo sapiens
tgcatcagaaagggagggct

SEQ ID NO: 4671204 - DNA, 14 bp, Homo sapiens
tgcatccagcagca

SEQ ID NO: 4671205 - DNA, 20 bp, Homo sapiens
tgcatccagcagcagcactt

SEQ ID NO: 4671206 - DNA, 20 bp, Homo sapiens
tgcatcttggggacatctct

SEQ ID NO: 4671207 - DNA, 16 bp, Homo sapiens
tgcatggaggccctcc

SEQ ID NO: 4671208 - DNA, 15 bp, Homo sapiens
tgcatgtatgtcttg

SEQ ID NO: 4671209 - DNA, 14 bp, Homo sapiens
tgcatgtcttttaa

SEQ ID NO: 4671210 - DNA, 13 bp, Homo sapiens
tgcatgtgactct

SEQ ID NO: 4671211 - DNA, 15 bp, Homo sapiens
tgcatgtgactctga

SEQ ID NO: 4671212 - DNA, 17 bp, Homo sapiens
tgcatgtgactctgaag

SEQ ID NO: 4671213 - DNA, 11 bp, Homo sapiens
tgcattcattt

SEQ ID NO: 4671214 - DNA, 15 bp, Homo sapiens
tgcattctctcccat

SEQ ID NO: 4671215 - DNA, 20 bp, Homo sapiens
tgcattctctcccatcctgg

SEQ ID NO: 4671216 - DNA, 16 bp, Homo sapiens
tgcattctggatttta

SEQ ID NO: 4671217 - DNA, 22 bp, Homo sapiens
tgcattgacctggaggggagag

SEQ ID NO: 4671218 - DNA, 23 bp, Homo sapiens
tgcattgacctggaggggagagg

SEQ ID NO: 4671219 - DNA, 19 bp, Homo sapiens
tgcatttaaacatgtttaa

SEQ ID NO: 4671220 - DNA, 15 bp, Homo sapiens
tgcatttagcttctt

SEQ ID NO: 4671221 - DNA, 18 bp, Homo sapiens
tgcattttttttttcatt

SEQ ID NO: 4671222 - DNA, 14 bp, Homo sapiens
tgccaaatcagttt

SEQ ID NO: 4671223 - DNA, 17 bp, Homo sapiens
tgccaagagtgaaggga

SEQ ID NO: 4671224 - DNA, 22 bp, Homo sapiens
tgccaagccagattctcttgaa

SEQ ID NO: 4671225 - DNA, 20 bp, Homo sapiens
tgccaagtccaggtcctggt

SEQ ID NO: 4671226 - DNA, 17 bp, Homo sapiens
tgccacacctggcctta

SEQ ID NO: 4671227 - DNA, 19 bp, Homo sapiens
tgccacacttcgctcttga

SEQ ID NO: 4671228 - DNA, 21 bp, Homo sapiens
tgccacacttcgctcttgagg

SEQ ID NO: 4671229 - DNA, 17 bp, Homo sapiens
tgccacagacaactcac

SEQ ID NO: 4671230 - DNA, 17 bp, Homo sapiens
tgccacagtagaactgt

SEQ ID NO: 4671231 - DNA, 13 bp, Homo sapiens
tgccacatcccta

SEQ ID NO: 4671232 - DNA, 15 bp, Homo sapiens
tgccaccaccctgcc

SEQ ID NO: 4671233 - DNA, 17 bp, Homo sapiens
tgccaccacgctggcca

SEQ ID NO: 4671234 - DNA, 22 bp, Homo sapiens
tgccacccccagccctggcccc

SEQ ID NO: 4671235 - DNA, 17 bp, Homo sapiens
tgccactaacttctaaa

SEQ ID NO: 4671236 - DNA, 13 bp, Homo sapiens
tgccactccttgt

SEQ ID NO: 4671237 - DNA, 15 bp, Homo sapiens
tgccacttcctttta

SEQ ID NO: 4671238 - DNA, 23 bp, Homo sapiens
tgccagactctaggttatacaat

SEQ ID NO: 4671239 - DNA, 17 bp, Homo sapiens
tgccagagcctggggct

SEQ ID NO: 4671240 - DNA, 18 bp, Homo sapiens
tgccagagcctggggctc

SEQ ID NO: 4671241 - DNA, 19 bp, Homo sapiens
tgccagcaggaataaagac

SEQ ID NO: 4671242 - DNA, 15 bp, Homo sapiens
tgccagcccagctgg

SEQ ID NO: 4671243 - DNA, 17 bp, Homo sapiens
tgccagcctgaggtgcc

SEQ ID NO: 4671244 - DNA, 17 bp, Homo sapiens
tgccataccttctccca

SEQ ID NO: 4671245 - DNA, 20 bp, Homo sapiens
tgccataccttctcccaggc

SEQ ID NO: 4671246 - DNA, 21 bp, Homo sapiens
tgccataccttctcccaggcc

SEQ ID NO: 4671247 - DNA, 22 bp, Homo sapiens
tgccataccttctcccaggcct

SEQ ID NO: 4671248 - DNA, 19 bp, Homo sapiens
tgccatagtcacatggcct

SEQ ID NO: 4671249 - DNA, 23 bp, Homo sapiens
tgccatctcacctcctgctgggc

SEQ ID NO: 4671250 - DNA, 22 bp, Homo sapiens
tgccatttgcttgtactgggac

SEQ ID NO: 4671251 - DNA, 23 bp, Homo sapiens
tgccatttgcttgtactgggaca

SEQ ID NO: 4671252 - DNA, 13 bp, Homo sapiens
tgcccaccccacc

SEQ ID NO: 4671253 - DNA, 13 bp, Homo sapiens
tgcccaccctcct

SEQ ID NO: 4671254 - DNA, 23 bp, Homo sapiens
tgcccactccgccagccacagga

SEQ ID NO: 4671255 - DNA, 21 bp, Homo sapiens
tgcccagaggactcccaaccc

SEQ ID NO: 4671256 - DNA, 21 bp, Homo sapiens
tgcccagcggacagtggcagg

SEQ ID NO: 4671257 - DNA, 11 bp, Homo sapiens
tgcccaggaga

SEQ ID NO: 4671258 - DNA, 18 bp, Homo sapiens
tgcccaggcctatctgga

SEQ ID NO: 4671259 - DNA, 20 bp, Homo sapiens
tgcccaggcctatctggaag

SEQ ID NO: 4671260 - DNA, 19 bp, Homo sapiens
tgcccaggtatcctggggg

SEQ ID NO: 4671261 - DNA, 20 bp, Homo sapiens
tgcccaggtatcctggggga

SEQ ID NO: 4671262 - DNA, 21 bp, Homo sapiens
tgcccaggtatcctgggggaa

SEQ ID NO: 4671263 - DNA, 18 bp, Homo sapiens
tgcccaggtcaccaagca

SEQ ID NO: 4671264 - DNA, 19 bp, Homo sapiens
tgcccaggtcaccaagcag

SEQ ID NO: 4671265 - DNA, 16 bp, Homo sapiens
tgcccaggtgagggaa

SEQ ID NO: 4671266 - DNA, 19 bp, Homo sapiens
tgcccaggtgagggaagga

SEQ ID NO: 4671267 - DNA, 20 bp, Homo sapiens
tgcccagtgcaaaccacttc

SEQ ID NO: 4671268 - DNA, 21 bp, Homo sapiens
tgcccatcatgtggccccacc

SEQ ID NO: 4671269 - DNA, 16 bp, Homo sapiens
tgcccatggcttctgg

SEQ ID NO: 4671270 - DNA, 18 bp, Homo sapiens
tgccccaagagcaggagg

SEQ ID NO: 4671271 - DNA, 24 bp, Homo sapiens
tgccccaagagcaggaggtgcctg

SEQ ID NO: 4671272 - DNA, 15 bp, Homo sapiens
tgccccaccacgtct

SEQ ID NO: 4671273 - DNA, 12 bp, Homo sapiens
tgccccaggccc

SEQ ID NO: 4671274 - DNA, 13 bp, Homo sapiens
tgccccaggccct

SEQ ID NO: 4671275 - DNA, 24 bp, Homo sapiens
tgccccagtcggccccatctctca

SEQ ID NO: 4671276 - DNA, 20 bp, Homo sapiens
tgcccccagagcgtccttgg

SEQ ID NO: 4671277 - DNA, 18 bp, Homo sapiens
tgccccctccaggagaga

SEQ ID NO: 4671278 - DNA, 13 bp, Homo sapiens
tgccccctgggga

SEQ ID NO: 4671279 - DNA, 19 bp, Homo sapiens
tgccccgggatattataga

SEQ ID NO: 4671280 - DNA, 17 bp, Homo sapiens
tgccccttaaccccaag

SEQ ID NO: 4671281 - DNA, 15 bp, Homo sapiens
tgcccgagggcagcc

SEQ ID NO: 4671282 - DNA, 19 bp, Homo sapiens
tgcccgagggcagccccct

SEQ ID NO: 4671283 - DNA, 18 bp, Homo sapiens
tgcccgcagacctctgga

SEQ ID NO: 4671284 - DNA, 23 bp, Homo sapiens
tgccctaactgtacatttcacag

SEQ ID NO: 4671285 - DNA, 23 bp, Homo sapiens
tgccctccacccacacctgcccg

SEQ ID NO: 4671286 - DNA, 22 bp, Homo sapiens
tgccctctatttattagccaac

SEQ ID NO: 4671287 - DNA, 11 bp, Homo sapiens
tgccctgagaa

SEQ ID NO: 4671288 - DNA, 11 bp, Homo sapiens
tgccctgccca

SEQ ID NO: 4671289 - DNA, 22 bp, Homo sapiens
tgccctgcccaggtatcctggg

SEQ ID NO: 4671290 - DNA, 18 bp, Homo sapiens
tgccctgctctgcccagg

SEQ ID NO: 4671291 - DNA, 20 bp, Homo sapiens
tgcccttacctgtctctctc

SEQ ID NO: 4671292 - DNA, 12 bp, Homo sapiens
tgcccttccccc

SEQ ID NO: 4671293 - DNA, 13 bp, Homo sapiens
tgcccttccccct

SEQ ID NO: 4671294 - DNA, 22 bp, Homo sapiens
tgcccttccccctttctctgcc

SEQ ID NO: 4671295 - DNA, 18 bp, Homo sapiens
tgcccttgaaccccctcc

SEQ ID NO: 4671296 - DNA, 20 bp, Homo sapiens
tgcccttgtttggggcagga

SEQ ID NO: 4671297 - DNA, 23 bp, Homo sapiens
tgccgcagtggggtcaagctgag

SEQ ID NO: 4671298 - DNA, 16 bp, Homo sapiens
tgccgccgcccgctgg

SEQ ID NO: 4671299 - DNA, 19 bp, Homo sapiens
tgccgccgcccgctgggga

SEQ ID NO: 4671300 - DNA, 21 bp, Homo sapiens
tgccgccgcccgctggggacc

SEQ ID NO: 4671301 - DNA, 19 bp, Homo sapiens
tgccgtgtgagtgtgacag

SEQ ID NO: 4671302 - DNA, 14 bp, Homo sapiens
tgccgtttcccctc

SEQ ID NO: 4671303 - DNA, 24 bp, Homo sapiens
tgcctagagatatttcaagctcat

SEQ ID NO: 4671304 - DNA, 13 bp, Homo sapiens
tgcctagagtgta

SEQ ID NO: 4671305 - DNA, 22 bp, Homo sapiens
tgcctagagtgtagcctaaagg

SEQ ID NO: 4671306 - DNA, 14 bp, Homo sapiens
tgcctcacatctcc

SEQ ID NO: 4671307 - DNA, 16 bp, Homo sapiens
tgcctcagcctcccga

SEQ ID NO: 4671308 - DNA, 12 bp, Homo sapiens
tgcctccatctt

SEQ ID NO: 4671309 - DNA, 15 bp, Homo sapiens
tgcctcctctctccc

SEQ ID NO: 4671310 - DNA, 22 bp, Homo sapiens
tgcctcctctctccctgcctca

SEQ ID NO: 4671311 - DNA, 23 bp, Homo sapiens
tgcctcctctctccctgcctcac

SEQ ID NO: 4671312 - DNA, 14 bp, Homo sapiens
tgcctcctgctttg

SEQ ID NO: 4671313 - DNA, 14 bp, Homo sapiens
tgcctcctgtgggg

SEQ ID NO: 4671314 - DNA, 19 bp, Homo sapiens
tgcctcgccttgtgttacg

SEQ ID NO: 4671315 - DNA, 19 bp, Homo sapiens
tgcctctactgggaaggct

SEQ ID NO: 4671316 - DNA, 13 bp, Homo sapiens
tgcctctattttt

SEQ ID NO: 4671317 - DNA, 19 bp, Homo sapiens
tgcctctgaggccagcctg

SEQ ID NO: 4671318 - DNA, 23 bp, Homo sapiens
tgcctctgaggccagcctggcct

SEQ ID NO: 4671319 - DNA, 18 bp, Homo sapiens
tgcctgaaagctgggagc

SEQ ID NO: 4671320 - DNA, 15 bp, Homo sapiens
tgcctgaccttggaa

SEQ ID NO: 4671321 - DNA, 14 bp, Homo sapiens
tgcctgaggctgta

SEQ ID NO: 4671322 - DNA, 14 bp, Homo sapiens
tgcctgattatttt

SEQ ID NO: 4671323 - DNA, 21 bp, Homo sapiens
tgcctgcacatcatgagcctt

SEQ ID NO: 4671324 - DNA, 21 bp, Homo sapiens
tgcctgcccctaccctggact

SEQ ID NO: 4671325 - DNA, 22 bp, Homo sapiens
tgcctgcttggggggtgatgag

SEQ ID NO: 4671326 - DNA, 19 bp, Homo sapiens
tgcctggagacaaggtgct

SEQ ID NO: 4671327 - DNA, 22 bp, Homo sapiens
tgcctggagacaaggtgctaac

SEQ ID NO: 4671328 - DNA, 18 bp, Homo sapiens
tgcctggaggtgtgggag

SEQ ID NO: 4671329 - DNA, 9 bp, Homo sapiens
tgcctggca

SEQ ID NO: 4671330 - DNA, 17 bp, Homo sapiens
tgcctggcctggcacac

SEQ ID NO: 4671331 - DNA, 20 bp, Homo sapiens
tgcctggctgattcagcatt

SEQ ID NO: 4671332 - DNA, 19 bp, Homo sapiens
tgcctgggatgcccttccc

SEQ ID NO: 4671333 - DNA, 14 bp, Homo sapiens
tgcctgggcaatgg

SEQ ID NO: 4671334 - DNA, 20 bp, Homo sapiens
tgcctgggcaatggccaggg

SEQ ID NO: 4671335 - DNA, 18 bp, Homo sapiens
tgcctgggtaggccccac

SEQ ID NO: 4671336 - DNA, 21 bp, Homo sapiens
tgcctgggtaggccccacaag

SEQ ID NO: 4671337 - DNA, 13 bp, Homo sapiens
tgcctggtatttt

SEQ ID NO: 4671338 - DNA, 14 bp, Homo sapiens
tgcctggtattttc

SEQ ID NO: 4671339 - DNA, 22 bp, Homo sapiens
tgcctggttctaggctgctgca

SEQ ID NO: 4671340 - DNA, 23 bp, Homo sapiens
tgcctgtactactctagggagta

SEQ ID NO: 4671341 - DNA, 15 bp, Homo sapiens
tgcctgtcctttcag

SEQ ID NO: 4671342 - DNA, 15 bp, Homo sapiens
tgccttaaaatggaa

SEQ ID NO: 4671343 - DNA, 23 bp, Homo sapiens
tgccttaacctgggaccaacctg

SEQ ID NO: 4671344 - DNA, 22 bp, Homo sapiens
tgccttctttagaccctcgggc

SEQ ID NO: 4671345 - DNA, 16 bp, Homo sapiens
tgcctttaagccaaag

SEQ ID NO: 4671346 - DNA, 17 bp, Homo sapiens
tgcctttgctcttataa

SEQ ID NO: 4671347 - DNA, 20 bp, Homo sapiens
tgcctttttcattttccaat

SEQ ID NO: 4671348 - DNA, 21 bp, Homo sapiens
tgcgagacgcacacagctgag

SEQ ID NO: 4671349 - DNA, 19 bp, Homo sapiens
tgcgatctcggctcagtgc

SEQ ID NO: 4671350 - DNA, 15 bp, Homo sapiens
tgcggatcctgctgg

SEQ ID NO: 4671351 - DNA, 13 bp, Homo sapiens
tgcggatggccgg

SEQ ID NO: 4671352 - DNA, 15 bp, Homo sapiens
tgcggggcctgtctc

SEQ ID NO: 4671353 - DNA, 23 bp, Homo sapiens
tgcgggtgaacaaagcagccacg

SEQ ID NO: 4671354 - DNA, 17 bp, Homo sapiens
tgcggtagccagcacac

SEQ ID NO: 4671355 - DNA, 14 bp, Homo sapiens
tgcgtacacagaga

SEQ ID NO: 4671356 - DNA, 13 bp, Homo sapiens
tgcgtcccagctg

SEQ ID NO: 4671357 - DNA, 14 bp, Homo sapiens
tgcgtcccagctga

SEQ ID NO: 4671358 - DNA, 20 bp, Homo sapiens
tgcgtcccagctgaaggcag

SEQ ID NO: 4671359 - DNA, 20 bp, Homo sapiens
tgcgtgaatgtatgtaatgt

SEQ ID NO: 4671360 - DNA, 15 bp, Homo sapiens
tgcgtgccgtgtgag

SEQ ID NO: 4671361 - DNA, 16 bp, Homo sapiens
tgcgtggactctgcac

SEQ ID NO: 4671362 - DNA, 17 bp, Homo sapiens
tgcgtggactctgcaca

SEQ ID NO: 4671363 - DNA, 18 bp, Homo sapiens
tgcgtggactctgcacat

SEQ ID NO: 4671364 - DNA, 13 bp, Homo sapiens
tgcgtgggcagag

SEQ ID NO: 4671365 - DNA, 21 bp, Homo sapiens
tgctaatcaaagccagggtct

SEQ ID NO: 4671366 - DNA, 23 bp, Homo sapiens
tgctaatgcaaattaaaacatat

SEQ ID NO: 4671367 - DNA, 21 bp, Homo sapiens
tgctacattataatgtacaga

SEQ ID NO: 4671368 - DNA, 14 bp, Homo sapiens
tgctactgattgtt

SEQ ID NO: 4671369 - DNA, 23 bp, Homo sapiens
tgctacttttttttagttcaata

SEQ ID NO: 4671370 - DNA, 12 bp, Homo sapiens
tgctatgttctg

SEQ ID NO: 4671371 - DNA, 20 bp, Homo sapiens
tgctattctagagcttttat

SEQ ID NO: 4671372 - DNA, 15 bp, Homo sapiens
tgctatttgaagaaa

SEQ ID NO: 4671373 - DNA, 15 bp, Homo sapiens
tgctattttcatcac

SEQ ID NO: 4671374 - DNA, 23 bp, Homo sapiens
tgctcaacaatttatccattcaa

SEQ ID NO: 4671375 - DNA, 17 bp, Homo sapiens
tgctcaccgactcacct

SEQ ID NO: 4671376 - DNA, 19 bp, Homo sapiens
tgctcaccgactcacctgc

SEQ ID NO: 4671377 - DNA, 22 bp, Homo sapiens
tgctcaccgactcacctgcgca

SEQ ID NO: 4671378 - DNA, 15 bp, Homo sapiens
tgctcattaattttg

SEQ ID NO: 4671379 - DNA, 17 bp, Homo sapiens
tgctcattatgccactt

SEQ ID NO: 4671380 - DNA, 19 bp, Homo sapiens
tgctcattcttcagttctc

SEQ ID NO: 4671381 - DNA, 14 bp, Homo sapiens
tgctccaggcctgc

SEQ ID NO: 4671382 - DNA, 20 bp, Homo sapiens
tgctccaggcctgcagcagg

SEQ ID NO: 4671383 - DNA, 15 bp, Homo sapiens
tgctccatcctttgt

SEQ ID NO: 4671384 - DNA, 23 bp, Homo sapiens
tgctcccaactcccttctgcttg

SEQ ID NO: 4671385 - DNA, 15 bp, Homo sapiens
tgctcccaagcccct

SEQ ID NO: 4671386 - DNA, 16 bp, Homo sapiens
tgctcccaagcccctg

SEQ ID NO: 4671387 - DNA, 17 bp, Homo sapiens
tggaataaagttgcaga

SEQ ID NO: 4671388 - DNA, 23 bp, Homo sapiens
tggaatatattctttgaaatata

SEQ ID NO: 4671389 - DNA, 17 bp, Homo sapiens
tggaattattgtagaca

SEQ ID NO: 4671390 - DNA, 17 bp, Homo sapiens
tggaattttgagaaaaa

SEQ ID NO: 4671391 - DNA, 18 bp, Homo sapiens
tggaattttgagaaaaat

SEQ ID NO: 4671392 - DNA, 16 bp, Homo sapiens
tggacaaataagtttt

SEQ ID NO: 4671393 - DNA, 21 bp, Homo sapiens
tggacacgagccacaagctgc

SEQ ID NO: 4671394 - DNA, 18 bp, Homo sapiens
tggacagaaaatgcaatg

SEQ ID NO: 4671395 - DNA, 14 bp, Homo sapiens
tggacagctgtgcc

SEQ ID NO: 4671396 - DNA, 14 bp, Homo sapiens
tggacatagagagg

SEQ ID NO: 4671397 - DNA, 14 bp, Homo sapiens
tggactagccagaa

SEQ ID NO: 4671398 - DNA, 20 bp, Homo sapiens
tggactctgaggactcctga

SEQ ID NO: 4671399 - DNA, 17 bp, Homo sapiens
tggactctgcacatgtc

SEQ ID NO: 4671400 - DNA, 18 bp, Homo sapiens
tggactctgcacatgtct

SEQ ID NO: 4671401 - DNA, 22 bp, Homo sapiens
tggactctgcacatgtcttgta

SEQ ID NO: 4671402 - DNA, 17 bp, Homo sapiens
tggactgctattctaga

SEQ ID NO: 4671403 - DNA, 23 bp, Homo sapiens
tggactggaggcccctggagcca

SEQ ID NO: 4671404 - DNA, 16 bp, Homo sapiens
tggacttacctggcag

SEQ ID NO: 4671405 - DNA, 13 bp, Homo sapiens
tggagaaagaagt

SEQ ID NO: 4671406 - DNA, 15 bp, Homo sapiens
tggagaaagaagtgg

SEQ ID NO: 4671407 - DNA, 18 bp, Homo sapiens
tggagaaagaagtggaga

SEQ ID NO: 4671408 - DNA, 19 bp, Homo sapiens
tggagaaagaagtggagac

SEQ ID NO: 4671409 - DNA, 14 bp, Homo sapiens
tggagaaagagctg

SEQ ID NO: 4671410 - DNA, 15 bp, Homo sapiens
tggagaaagctcatg

SEQ ID NO: 4671411 - DNA, 11 bp, Homo sapiens
tggagaacagt

SEQ ID NO: 4671412 - DNA, 20 bp, Homo sapiens
tggagaacagtggttgcctg

SEQ ID NO: 4671413 - DNA, 22 bp, Homo sapiens
tggagaacagtggttgcctggg

SEQ ID NO: 4671414 - DNA, 23 bp, Homo sapiens
tggagaacagtggttgcctgggg

SEQ ID NO: 4671415 - DNA, 20 bp, Homo sapiens
tggagacaaggtgctaacat

SEQ ID NO: 4671416 - DNA, 19 bp, Homo sapiens
tggagaccctgcaaacaga

SEQ ID NO: 4671417 - DNA, 13 bp, Homo sapiens
tggagagccctgg

SEQ ID NO: 4671418 - DNA, 18 bp, Homo sapiens
tggagagccctgggaccg

SEQ ID NO: 4671419 - DNA, 17 bp, Homo sapiens
tggagagctaggagcaa

SEQ ID NO: 4671420 - DNA, 14 bp, Homo sapiens
tggagcaaaccatt

SEQ ID NO: 4671421 - DNA, 17 bp, Homo sapiens
tggagcaaacctagccc

SEQ ID NO: 4671422 - DNA, 12 bp, Homo sapiens
tggagcaagctc

SEQ ID NO: 4671423 - DNA, 17 bp, Homo sapiens
tggagcaagctcttccc

SEQ ID NO: 4671424 - DNA, 19 bp, Homo sapiens
tggagcaggagccccgcca

SEQ ID NO: 4671425 - DNA, 19 bp, Homo sapiens
tggaggaacacttgatgga

SEQ ID NO: 4671426 - DNA, 14 bp, Homo sapiens
tggaggaagagcca

SEQ ID NO: 4671427 - DNA, 15 bp, Homo sapiens
tggaggaagagccac

SEQ ID NO: 4671428 - DNA, 19 bp, Homo sapiens
tggaggaagagccacctgc

SEQ ID NO: 4671429 - DNA, 17 bp, Homo sapiens
tggaggaatcaccccat

SEQ ID NO: 4671430 - DNA, 13 bp, Homo sapiens
tggaggacctgag

SEQ ID NO: 4671431 - DNA, 15 bp, Homo sapiens
tggaggacctgagcc

SEQ ID NO: 4671432 - DNA, 16 bp, Homo sapiens
tggaggacctgagcct

SEQ ID NO: 4671433 - DNA, 18 bp, Homo sapiens
tggaggacctgagcctgc

SEQ ID NO: 4671434 - DNA, 15 bp, Homo sapiens
tggaggagagagacc

SEQ ID NO: 4671435 - DNA, 12 bp, Homo sapiens
tggaggagggtt

SEQ ID NO: 4671436 - DNA, 22 bp, Homo sapiens
tggaggagggtttgggcagagc

SEQ ID NO: 4671437 - DNA, 13 bp, Homo sapiens
tggaggcagatgc

SEQ ID NO: 4671438 - DNA, 23 bp, Homo sapiens
tggaggcagatgcccttgctggg

SEQ ID NO: 4671439 - DNA, 22 bp, Homo sapiens
tggagggacaagtggactcagg

SEQ ID NO: 4671440 - DNA, 20 bp, Homo sapiens
tggagggcttggcccagcgc

SEQ ID NO: 4671441 - DNA, 15 bp, Homo sapiens
tggaggggagagggg

SEQ ID NO: 4671442 - DNA, 19 bp, Homo sapiens
tggagggtatactgagggg

SEQ ID NO: 4671443 - DNA, 20 bp, Homo sapiens
tggaggtcccagccctgggg

SEQ ID NO: 4671444 - DNA, 15 bp, Homo sapiens
tggaggtctccaggg

SEQ ID NO: 4671445 - DNA, 22 bp, Homo sapiens
tggagtagcctggactgtttca

SEQ ID NO: 4671446 - DNA, 17 bp, Homo sapiens
tggagtatagtgcaaat

SEQ ID NO: 4671447 - DNA, 15 bp, Homo sapiens
tggagtgagaggccc

SEQ ID NO: 4671448 - DNA, 16 bp, Homo sapiens
tggagtgagaggcccc

SEQ ID NO: 4671449 - DNA, 17 bp, Homo sapiens
tggagtgagaggccccc

SEQ ID NO: 4671450 - DNA, 23 bp, Homo sapiens
tggagtgagaggcccccaccctt

SEQ ID NO: 4671451 - DNA, 16 bp, Homo sapiens
tggagttcttgtgcca

SEQ ID NO: 4671452 - DNA, 20 bp, Homo sapiens
tggataagtggctgtttcat

SEQ ID NO: 4671453 - DNA, 17 bp, Homo sapiens
tggatcagcgtggcctt

SEQ ID NO: 4671454 - DNA, 18 bp, Homo sapiens
tggatcagcgtggccttg

SEQ ID NO: 4671455 - DNA, 22 bp, Homo sapiens
tggatccaatgttagagacttt

SEQ ID NO: 4671456 - DNA, 23 bp, Homo sapiens
tggatctgaggaggctttggtaa

SEQ ID NO: 4671457 - DNA, 14 bp, Homo sapiens
tggatcttgaatgt

SEQ ID NO: 4671458 - DNA, 16 bp, Homo sapiens
tggatcttgaatgtgg

SEQ ID NO: 4671459 - DNA, 19 bp, Homo sapiens
tggatgaattttccagacc

SEQ ID NO: 4671460 - DNA, 15 bp, Homo sapiens
tggatgcccagagga

SEQ ID NO: 4671461 - DNA, 13 bp, Homo sapiens
tggatgctgtgct

SEQ ID NO: 4671462 - DNA, 14 bp, Homo sapiens
tggatgctgtgcta

SEQ ID NO: 4671463 - DNA, 22 bp, Homo sapiens
tggatggtttgttgttctgcct

SEQ ID NO: 4671464 - DNA, 15 bp, Homo sapiens
tggattaaacctttt

SEQ ID NO: 4671465 - DNA, 21 bp, Homo sapiens
tggattcatggagtagcctgg

SEQ ID NO: 4671466 - DNA, 14 bp, Homo sapiens
tggattgctggggc

SEQ ID NO: 4671467 - DNA, 20 bp, Homo sapiens
tggattggaatgcagaggtc

SEQ ID NO: 4671468 - DNA, 22 bp, Homo sapiens
tggcaacagaaaccaagagaca

SEQ ID NO: 4671469 - DNA, 17 bp, Homo sapiens
tggcaacattggacaga

SEQ ID NO: 4671470 - DNA, 20 bp, Homo sapiens
tggcaacattggacagaaaa

SEQ ID NO: 4671471 - DNA, 23 bp, Homo sapiens
tggcaacattggacagaaaatgc

SEQ ID NO: 4671472 - DNA, 22 bp, Homo sapiens
tggcaagagggtgacagcttcc

SEQ ID NO: 4671473 - DNA, 23 bp, Homo sapiens
tggcacagaacaggaggtgtgaa

SEQ ID NO: 4671474 - DNA, 14 bp, Homo sapiens
tggcacagaagagg

SEQ ID NO: 4671475 - DNA, 18 bp, Homo sapiens
tggcacccccacaagctg

SEQ ID NO: 4671476 - DNA, 21 bp, Homo sapiens
tggcactggtaggttgggaca

SEQ ID NO: 4671477 - DNA, 18 bp, Homo sapiens
tggcacttccacctccag

SEQ ID NO: 4671478 - DNA, 21 bp, Homo sapiens
tggcacttccacctccagcct

SEQ ID NO: 4671479 - DNA, 23 bp, Homo sapiens
tggcacttccacctccagcctct

SEQ ID NO: 4671480 - DNA, 20 bp, Homo sapiens
tggcactttgttttcaagat

SEQ ID NO: 4671481 - DNA, 19 bp, Homo sapiens
tggcagactctttaataaa

SEQ ID NO: 4671482 - DNA, 19 bp, Homo sapiens
tggcagatgtaggagggac

SEQ ID NO: 4671483 - DNA, 11 bp, Homo sapiens
tggcagccaca

SEQ ID NO: 4671484 - DNA, 19 bp, Homo sapiens
tggcagccacacttctcag

SEQ ID NO: 4671485 - DNA, 22 bp, Homo sapiens
tggcagcccctgttttctgctg

SEQ ID NO: 4671486 - DNA, 14 bp, Homo sapiens
tggcagctgtctca

SEQ ID NO: 4671487 - DNA, 13 bp, Homo sapiens
tggcaggacagga

SEQ ID NO: 4671488 - DNA, 22 bp, Homo sapiens
tggcagggaccggcagagctct

SEQ ID NO: 4671489 - DNA, 12 bp, Homo sapiens
tggcagggcagc

SEQ ID NO: 4671490 - DNA, 13 bp, Homo sapiens
tggcagggcagca

SEQ ID NO: 4671491 - DNA, 21 bp, Homo sapiens
tggcagggggccccgccaggg

SEQ ID NO: 4671492 - DNA, 22 bp, Homo sapiens
tggcagggggccccgccagggc

SEQ ID NO: 4671493 - DNA, 16 bp, Homo sapiens
tggcatacctgtgcct

SEQ ID NO: 4671494 - DNA, 23 bp, Homo sapiens
tggcatattttaatcattatttg

SEQ ID NO: 4671495 - DNA, 16 bp, Homo sapiens
tggcatcctgtgaagt

SEQ ID NO: 4671496 - DNA, 21 bp, Homo sapiens
tgggattcaggaaaaggcctg

SEQ ID NO: 4671497 - DNA, 16 bp, Homo sapiens
tgggcacccccagcct

SEQ ID NO: 4671498 - DNA, 18 bp, Homo sapiens
tgggcacccccagcctgg

SEQ ID NO: 4671499 - DNA, 19 bp, Homo sapiens
tgggcacccccagcctggg

SEQ ID NO: 4671500 - DNA, 20 bp, Homo sapiens
tgggcacccccagcctgggc

SEQ ID NO: 4671501 - DNA, 24 bp, Homo sapiens
tgggcactccgcgccgatgccacc

SEQ ID NO: 4671502 - DNA, 16 bp, Homo sapiens
tgggcactggcccagg

SEQ ID NO: 4671503 - DNA, 22 bp, Homo sapiens
tgggcagaggaatgtgggctat

SEQ ID NO: 4671504 - DNA, 23 bp, Homo sapiens
tgggcagaggaatgtgggctatg

SEQ ID NO: 4671505 - DNA, 17 bp, Homo sapiens
tgggcagagtcctgcct

SEQ ID NO: 4671506 - DNA, 18 bp, Homo sapiens
tgggcagagtcctgcctt

SEQ ID NO: 4671507 - DNA, 17 bp, Homo sapiens
tgggccacaaggaaaga

SEQ ID NO: 4671508 - DNA, 20 bp, Homo sapiens
tgggccaccgtgcctggctg

SEQ ID NO: 4671509 - DNA, 15 bp, Homo sapiens
tgggccactggggac

SEQ ID NO: 4671510 - DNA, 21 bp, Homo sapiens
tgggccaggcagagaacagaa

SEQ ID NO: 4671511 - DNA, 21 bp, Homo sapiens
tgggccagggctgccctgaga

SEQ ID NO: 4671512 - DNA, 14 bp, Homo sapiens
tgggccagggtctg

SEQ ID NO: 4671513 - DNA, 22 bp, Homo sapiens
tgggccagggtctgtgtgaatg

SEQ ID NO: 4671514 - DNA, 20 bp, Homo sapiens
tgggccattctccacagcaa

SEQ ID NO: 4671515 - DNA, 13 bp, Homo sapiens
tgggccctctggt

SEQ ID NO: 4671516 - DNA, 14 bp, Homo sapiens
tgggccctctggtt

SEQ ID NO: 4671517 - DNA, 16 bp, Homo sapiens
tgggccctctggtttg

SEQ ID NO: 4671518 - DNA, 23 bp, Homo sapiens
tgggccctctttccctgcgagac

SEQ ID NO: 4671519 - DNA, 14 bp, Homo sapiens
tgggccctggggcc

SEQ ID NO: 4671520 - DNA, 15 bp, Homo sapiens
tgggcctatggagag

SEQ ID NO: 4671521 - DNA, 12 bp, Homo sapiens
tgggcctgctgc

SEQ ID NO: 4671522 - DNA, 14 bp, Homo sapiens
tgggcctgctgctg

SEQ ID NO: 4671523 - DNA, 17 bp, Homo sapiens
tgggcctgctgctgaga

SEQ ID NO: 4671524 - DNA, 20 bp, Homo sapiens
tgggcctggccctgctttct

SEQ ID NO: 4671525 - DNA, 18 bp, Homo sapiens
tgggccttagtgggccag

SEQ ID NO: 4671526 - DNA, 17 bp, Homo sapiens
tgggctcagcagggctg

SEQ ID NO: 4671527 - DNA, 15 bp, Homo sapiens
tgggctgacccagca

SEQ ID NO: 4671528 - DNA, 16 bp, Homo sapiens
tgggctgggccctctt

SEQ ID NO: 4671529 - DNA, 20 bp, Homo sapiens
tggggaagggagtctctctt

SEQ ID NO: 4671530 - DNA, 18 bp, Homo sapiens
tggggacatctctttgaa

SEQ ID NO: 4671531 - DNA, 15 bp, Homo sapiens
tggggaccctgggcc

SEQ ID NO: 4671532 - DNA, 19 bp, Homo sapiens
tggggaccggttcccacaa

SEQ ID NO: 4671533 - DNA, 20 bp, Homo sapiens
tggggaccggttcccacaag

SEQ ID NO: 4671534 - DNA, 14 bp, Homo sapiens
tggggactcaggga

SEQ ID NO: 4671535 - DNA, 22 bp, Homo sapiens
tggggagagttgtgatggaggg

SEQ ID NO: 4671536 - DNA, 15 bp, Homo sapiens
tggggaggacaaaac

SEQ ID NO: 4671537 - DNA, 21 bp, Homo sapiens
tggggaggcaggcattcctga

SEQ ID NO: 4671538 - DNA, 14 bp, Homo sapiens
tggggatagtctgg

SEQ ID NO: 4671539 - DNA, 16 bp, Homo sapiens
tggggatagtctgggt

SEQ ID NO: 4671540 - DNA, 14 bp, Homo sapiens
tggggatgggaggg

SEQ ID NO: 4671541 - DNA, 20 bp, Homo sapiens
tggggcagctcctctgtctc

SEQ ID NO: 4671542 - DNA, 15 bp, Homo sapiens
tggggcaggagtagc

SEQ ID NO: 4671543 - DNA, 21 bp, Homo sapiens
tggggcaggagtagctgagct

SEQ ID NO: 4671544 - DNA, 23 bp, Homo sapiens
tggggccgaaaatgtttttaaag

SEQ ID NO: 4671545 - DNA, 12 bp, Homo sapiens
tggggcctgaga

SEQ ID NO: 4671546 - DNA, 11 bp, Homo sapiens
tggggcctgta

SEQ ID NO: 4671547 - DNA, 13 bp, Homo sapiens
tggggcctgtgga

SEQ ID NO: 4671548 - DNA, 14 bp, Homo sapiens
tggggcctgtggaa

SEQ ID NO: 4671549 - DNA, 16 bp, Homo sapiens
tggggcctgtggaatg

SEQ ID NO: 4671550 - DNA, 20 bp, Homo sapiens
tggggctagggggagcccct

SEQ ID NO: 4671551 - DNA, 19 bp, Homo sapiens
tggggctctaacgcctgag

SEQ ID NO: 4671552 - DNA, 22 bp, Homo sapiens
tggggctctaacgcctgagccc

SEQ ID NO: 4671553 - DNA, 22 bp, Homo sapiens
tggggctctctgagtcctggcc

SEQ ID NO: 4671554 - DNA, 12 bp, Homo sapiens
tgggggaagagg

SEQ ID NO: 4671555 - DNA, 19 bp, Homo sapiens
tgggggcctggctggctga

SEQ ID NO: 4671556 - DNA, 20 bp, Homo sapiens
tgggggcctggctggctgag

SEQ ID NO: 4671557 - DNA, 19 bp, Homo sapiens
tggggtagaaacattgtaa

SEQ ID NO: 4671558 - DNA, 12 bp, Homo sapiens
tggggtattttt

SEQ ID NO: 4671559 - DNA, 14 bp, Homo sapiens
tggggtctggcagc

SEQ ID NO: 4671560 - DNA, 12 bp, Homo sapiens
tggggtgaatac

SEQ ID NO: 4671561 - DNA, 11 bp, Homo sapiens
tggggtgacag

SEQ ID NO: 4671562 - DNA, 23 bp, Homo sapiens
tggggtgacccggcaccccctgc

SEQ ID NO: 4671563 - DNA, 19 bp, Homo sapiens
tgggtaaaagcagggcagc

SEQ ID NO: 4671564 - DNA, 21 bp, Homo sapiens
tgggtaaaagcagggcagcag

SEQ ID NO: 4671565 - DNA, 14 bp, Homo sapiens
tgggtaccatgctt

SEQ ID NO: 4671566 - DNA, 15 bp, Homo sapiens
tgggtaggccccaca

SEQ ID NO: 4671567 - DNA, 21 bp, Homo sapiens
tgggtaggccccacaaggcct

SEQ ID NO: 4671568 - DNA, 17 bp, Homo sapiens
tgggtcagacccatctc

SEQ ID NO: 4671569 - DNA, 15 bp, Homo sapiens
tgggtctctgtgtgt

SEQ ID NO: 4671570 - DNA, 13 bp, Homo sapiens
tgggtctggctag

SEQ ID NO: 4671571 - DNA, 13 bp, Homo sapiens
tgggtgctcagaa

SEQ ID NO: 4671572 - DNA, 15 bp, Homo sapiens
tgggtgctcagaata

SEQ ID NO: 4671573 - DNA, 20 bp, Homo sapiens
tgggtggctactctgtgcca

SEQ ID NO: 4671574 - DNA, 23 bp, Homo sapiens
tgggtgggcctggccctgctttc

SEQ ID NO: 4671575 - DNA, 14 bp, Homo sapiens
tgggtggggaggga

SEQ ID NO: 4671576 - DNA, 21 bp, Homo sapiens
tgggttcacgtaatcctcctg

SEQ ID NO: 4671577 - DNA, 15 bp, Homo sapiens
tggtaaaactcactg

SEQ ID NO: 4671578 - DNA, 20 bp, Homo sapiens
tggtaaaactcactgtgatc

SEQ ID NO: 4671579 - DNA, 18 bp, Homo sapiens
tggtaacaatagttctta

SEQ ID NO: 4671580 - DNA, 17 bp, Homo sapiens
tggtaagcgatttgaaa

SEQ ID NO: 4671581 - DNA, 13 bp, Homo sapiens
tggtacctgccct

SEQ ID NO: 4671582 - DNA, 15 bp, Homo sapiens
tggtacctgccctct

SEQ ID NO: 4671583 - DNA, 18 bp, Homo sapiens
tggtaggactgtagaaaa

SEQ ID NO: 4671584 - DNA, 22 bp, Homo sapiens
tggtatgaaataaattctgact

SEQ ID NO: 4671585 - DNA, 16 bp, Homo sapiens
tggtcaacctcctgga

SEQ ID NO: 4671586 - DNA, 16 bp, Homo sapiens
tggtcacctcccatcc

SEQ ID NO: 4671587 - DNA, 21 bp, Homo sapiens
tggtcataaaatagaataatt

SEQ ID NO: 4671588 - DNA, 23 bp, Homo sapiens
tggtcatgaatagaaaaaaaaca

SEQ ID NO: 4671589 - DNA, 14 bp, Homo sapiens
tggtccctgggagg

SEQ ID NO: 4671590 - DNA, 12 bp, Homo sapiens
tggtcctagaca

SEQ ID NO: 4671591 - DNA, 13 bp, Homo sapiens
tggtctcaggata

SEQ ID NO: 4671592 - DNA, 14 bp, Homo sapiens
tggtctgattttga

SEQ ID NO: 4671593 - DNA, 15 bp, Homo sapiens
tggtctggtgttcca

SEQ ID NO: 4671594 - DNA, 16 bp, Homo sapiens
tggtctggttgggcag

SEQ ID NO: 4671595 - DNA, 14 bp, Homo sapiens
tggtcttaggtctt

SEQ ID NO: 4671596 - DNA, 15 bp, Homo sapiens
tggtcttaggtcttc

SEQ ID NO: 4671597 - DNA, 17 bp, Homo sapiens
tggtcttaggtcttcct

SEQ ID NO: 4671598 - DNA, 20 bp, Homo sapiens
tggtcttaggtcttcctgtg

SEQ ID NO: 4671599 - DNA, 21 bp, Homo sapiens
tggtgaagtaacatgcatact

SEQ ID NO: 4671600 - DNA, 13 bp, Homo sapiens
tggtgacttgtct

SEQ ID NO: 4671601 - DNA, 17 bp, Homo sapiens
tggtgacttgtctgcct

SEQ ID NO: 4671602 - DNA, 18 bp, Homo sapiens
tggtgacttgtctgcctc

SEQ ID NO: 4671603 - DNA, 23 bp, Homo sapiens
tggtgacttgtctgcctcctgct

SEQ ID NO: 4671604 - DNA, 15 bp, Homo sapiens
tggtgcagacagaag

SEQ ID NO: 4671605 - DNA, 12 bp, Homo sapiens
tggtgcctggcc

SEQ ID NO: 4671606 - DNA, 17 bp, Homo sapiens
tggtgcctggcctggca

SEQ ID NO: 4671607 - DNA, 18 bp, Homo sapiens
tggtgcctggcctggcac

SEQ ID NO: 4671608 - DNA, 19 bp, Homo sapiens
tggtgcctggcctggcaca

SEQ ID NO: 4671609 - DNA, 22 bp, Homo sapiens
tggtgcctggcctggcacacat

SEQ ID NO: 4671610 - DNA, 23 bp, Homo sapiens
tggtgcctggcctggcacacatc

SEQ ID NO: 4671611 - DNA, 16 bp, Homo sapiens
tggtgctatttgaaga

SEQ ID NO: 4671612 - DNA, 22 bp, Homo sapiens
tggtgctatttgaagaaaaaaa

SEQ ID NO: 4671613 - DNA, 23 bp, Homo sapiens
tggtgctgtcttttgttctctga

SEQ ID NO: 4671614 - DNA, 18 bp, Homo sapiens
tggtggcatttttgcttc

SEQ ID NO: 4671615 - DNA, 23 bp, Homo sapiens
tggtgggaaggccggcagcgggc

SEQ ID NO: 4671616 - DNA, 14 bp, Homo sapiens
tggtgggattacag

SEQ ID NO: 4671617 - DNA, 23 bp, Homo sapiens
tggtgtatgtttatcaaagagca

SEQ ID NO: 4671618 - DNA, 12 bp, Homo sapiens
tggtgtgaaggt

SEQ ID NO: 4671619 - DNA, 13 bp, Homo sapiens
tggtgtgccctgt

SEQ ID NO: 4671620 - DNA, 20 bp, Homo sapiens
tggtgttcaccaaaaccaaa

SEQ ID NO: 4671621 - DNA, 16 bp, Homo sapiens
tggttaccactctttt

SEQ ID NO: 4671622 - DNA, 14 bp, Homo sapiens
tggttatcttgtta

SEQ ID NO: 4671623 - DNA, 12 bp, Homo sapiens
tggttcatgctt

SEQ ID NO: 4671624 - DNA, 14 bp, Homo sapiens
tggttctaggctgc

SEQ ID NO: 4671625 - DNA, 16 bp, Homo sapiens
tggttgcagtctttcc

SEQ ID NO: 4671626 - DNA, 22 bp, Homo sapiens
tggttgcagtctttcccccagg

SEQ ID NO: 4671627 - DNA, 12 bp, Homo sapiens
tggttgcctggg

SEQ ID NO: 4671628 - DNA, 20 bp, Homo sapiens
tggttgtctagtcattgtca

SEQ ID NO: 4671629 - DNA, 16 bp, Homo sapiens
tggttgtgtgtgttct

SEQ ID NO: 4671630 - DNA, 17 bp, Homo sapiens
tggttgtgtgtgttctg

SEQ ID NO: 4671631 - DNA, 15 bp, Homo sapiens
tggttgtgttgaggt

SEQ ID NO: 4671632 - DNA, 21 bp, Homo sapiens
tggtttctctctacagtgcca

SEQ ID NO: 4671633 - DNA, 21 bp, Homo sapiens
tggtttgccggtggtgcaggt

SEQ ID NO: 4671634 - DNA, 21 bp, Homo sapiens
tggtttgtggcgtctccctcg

SEQ ID NO: 4671635 - DNA, 13 bp, Homo sapiens
tggttttctgcca

SEQ ID NO: 4671636 - DNA, 21 bp, Homo sapiens
tggttttctgccaatgaccaa

SEQ ID NO: 4671637 - DNA, 19 bp, Homo sapiens
tgtaaaaacagcattgctt

SEQ ID NO: 4671638 - DNA, 16 bp, Homo sapiens
tgtaaaatagaaaaag

SEQ ID NO: 4671639 - DNA, 22 bp, Homo sapiens
tgtaaactgaatataaagctta

SEQ ID NO: 4671640 - DNA, 15 bp, Homo sapiens
tgtaaacttctgaag

SEQ ID NO: 4671641 - DNA, 13 bp, Homo sapiens
tgtaaagaaatgt

SEQ ID NO: 4671642 - DNA, 15 bp, Homo sapiens
tgtaaagtccccaga

SEQ ID NO: 4671643 - DNA, 15 bp, Homo sapiens
tgtaaatatgtgaca

SEQ ID NO: 4671644 - DNA, 13 bp, Homo sapiens
tgtaaatcctgtg

SEQ ID NO: 4671645 - DNA, 14 bp, Homo sapiens
tgtaaatcctgtgt

SEQ ID NO: 4671646 - DNA, 15 bp, Homo sapiens
tgtaaatgctggtat

SEQ ID NO: 4671647 - DNA, 16 bp, Homo sapiens
tgtaaatttggcttct

SEQ ID NO: 4671648 - DNA, 13 bp, Homo sapiens
tgtaaccactgca

SEQ ID NO: 4671649 - DNA, 17 bp, Homo sapiens
tgtaactattaaccttt

SEQ ID NO: 4671650 - DNA, 22 bp, Homo sapiens
tgtaagacccttattgctgtcc

SEQ ID NO: 4671651 - DNA, 20 bp, Homo sapiens
tgtaagcatactttgtaaat

SEQ ID NO: 4671652 - DNA, 22 bp, Homo sapiens
tgtaaggggaagagggaaatgt

SEQ ID NO: 4671653 - DNA, 16 bp, Homo sapiens
tgtaagtgaaattaag

SEQ ID NO: 4671654 - DNA, 12 bp, Homo sapiens
tgtaatatgaca

SEQ ID NO: 4671655 - DNA, 14 bp, Homo sapiens
tgtaatatgacaga

SEQ ID NO: 4671656 - DNA, 17 bp, Homo sapiens
tgtaatatggaaatctt

SEQ ID NO: 4671657 - DNA, 15 bp, Homo sapiens
tgtaatcaggcaagg

SEQ ID NO: 4671658 - DNA, 18 bp, Homo sapiens
tgtaatcaggcaaggagg

SEQ ID NO: 4671659 - DNA, 19 bp, Homo sapiens
tgtaatcatttgtttacat

SEQ ID NO: 4671660 - DNA, 18 bp, Homo sapiens
tgtaatcccagtactttg

SEQ ID NO: 4671661 - DNA, 19 bp, Homo sapiens
tgtaatgcactgtttttaa

SEQ ID NO: 4671662 - DNA, 17 bp, Homo sapiens
tgtaattaactgtaaac

SEQ ID NO: 4671663 - DNA, 19 bp, Homo sapiens
tgtaattaactgtaaactt

SEQ ID NO: 4671664 - DNA, 14 bp, Homo sapiens
tgtaatttcaaaat

SEQ ID NO: 4671665 - DNA, 17 bp, Homo sapiens
tgtaatttcaaaataca

SEQ ID NO: 4671666 - DNA, 14 bp, Homo sapiens
tgtacaaactcatc

SEQ ID NO: 4671667 - DNA, 15 bp, Homo sapiens
tgtacactttttaca

SEQ ID NO: 4671668 - DNA, 18 bp, Homo sapiens
tgtacactttttacagca

SEQ ID NO: 4671669 - DNA, 21 bp, Homo sapiens
tgtacagtcttgtattaagtt

SEQ ID NO: 4671670 - DNA, 17 bp, Homo sapiens
tgtacatgtgtagcctg

SEQ ID NO: 4671671 - DNA, 20 bp, Homo sapiens
tgtacatgtgtagcctgtgc

SEQ ID NO: 4671672 - DNA, 20 bp, Homo sapiens
tgtacatgtgtgcagagcag

SEQ ID NO: 4671673 - DNA, 15 bp, Homo sapiens
tgtacattctgccta

SEQ ID NO: 4671674 - DNA, 21 bp, Homo sapiens
tgtacattctgcctagagtgt

SEQ ID NO: 4671675 - DNA, 16 bp, Homo sapiens
tgtacatttattcata

SEQ ID NO: 4671676 - DNA, 19 bp, Homo sapiens
tgtaccatgtgctacaggg

SEQ ID NO: 4671677 - DNA, 16 bp, Homo sapiens
tgtacccaccgggcca

SEQ ID NO: 4671678 - DNA, 20 bp, Homo sapiens
tgtacccaccgggccactcc

SEQ ID NO: 4671679 - DNA, 22 bp, Homo sapiens
tgtaccgcgtctaccctgggat

SEQ ID NO: 4671680 - DNA, 22 bp, Homo sapiens
tgtactactctagggagtatgc

SEQ ID NO: 4671681 - DNA, 18 bp, Homo sapiens
tgtactattgcagacctg

SEQ ID NO: 4671682 - DNA, 12 bp, Homo sapiens
tgtactcccagg

SEQ ID NO: 4671683 - DNA, 12 bp, Homo sapiens
tgtactgcctgc

SEQ ID NO: 4671684 - DNA, 15 bp, Homo sapiens
tgtactgcctgcttg

SEQ ID NO: 4671685 - DNA, 12 bp, Homo sapiens
tgtactgggaca

SEQ ID NO: 4671686 - DNA, 15 bp, Homo sapiens
tgtactgggccatgt

SEQ ID NO: 4671687 - DNA, 13 bp, Homo sapiens
tgtactgttcata

SEQ ID NO: 4671688 - DNA, 18 bp, Homo sapiens
tgtactgttcatacagtt

SEQ ID NO: 4671689 - DNA, 21 bp, Homo sapiens
tgtacttcataagatattctt

SEQ ID NO: 4671690 - DNA, 15 bp, Homo sapiens
tgtacttgtcaaaga

SEQ ID NO: 4671691 - DNA, 17 bp, Homo sapiens
tgtacttttcattctct

SEQ ID NO: 4671692 - DNA, 19 bp, Homo sapiens
tgtagaaaaatccctccac

SEQ ID NO: 4671693 - DNA, 15 bp, Homo sapiens
tgtagaactttatta

SEQ ID NO: 4671694 - DNA, 18 bp, Homo sapiens
tgtagacactctgacaag

SEQ ID NO: 4671695 - DNA, 21 bp, Homo sapiens
tgtagacactctgacaagctg

SEQ ID NO: 4671696 - DNA, 21 bp, Homo sapiens
tgtagactcttgctcctgctt

SEQ ID NO: 4671697 - DNA, 14 bp, Homo sapiens
tgtagactgtttca

SEQ ID NO: 4671698 - DNA, 21 bp, Homo sapiens
tgtagcaagtactttggctta

SEQ ID NO: 4671699 - DNA, 16 bp, Homo sapiens
tgtagcctaaagggca

SEQ ID NO: 4671700 - DNA, 17 bp, Homo sapiens
tgtagcctaaagggcag

SEQ ID NO: 4671701 - DNA, 13 bp, Homo sapiens
tgtagcctgtgca

SEQ ID NO: 4671702 - DNA, 14 bp, Homo sapiens
tgtagcctgtgcat

SEQ ID NO: 4671703 - DNA, 15 bp, Homo sapiens
tgtagcctgtgcatg

SEQ ID NO: 4671704 - DNA, 22 bp, Homo sapiens
tgtagcctgtgcatgtatgtct

SEQ ID NO: 4671705 - DNA, 15 bp, Homo sapiens
tgtagctaaaaataa

SEQ ID NO: 4671706 - DNA, 18 bp, Homo sapiens
tgtagctacaagggaagc

SEQ ID NO: 4671707 - DNA, 16 bp, Homo sapiens
tgtagctgtaagggca

SEQ ID NO: 4671708 - DNA, 18 bp, Homo sapiens
tgtagctgtaagggcagt

SEQ ID NO: 4671709 - DNA, 21 bp, Homo sapiens
tgtagctgtaagggcagtgcc

SEQ ID NO: 4671710 - DNA, 17 bp, Homo sapiens
tgtagcttcttctgaaa

SEQ ID NO: 4671711 - DNA, 19 bp, Homo sapiens
tgtagcttcttctgaaaga

SEQ ID NO: 4671712 - DNA, 12 bp, Homo sapiens
tgtagctttcct

SEQ ID NO: 4671713 - DNA, 13 bp, Homo sapiens
tgtagctttcctg

SEQ ID NO: 4671714 - DNA, 15 bp, Homo sapiens
tgtagctttcctgga

SEQ ID NO: 4671715 - DNA, 16 bp, Homo sapiens
tgtaggaagcattttt

SEQ ID NO: 4671716 - DNA, 15 bp, Homo sapiens
tgtgttcatttcatt

SEQ ID NO: 4671717 - DNA, 23 bp, Homo sapiens
tgtgttctaatccaagggccagt

SEQ ID NO: 4671718 - DNA, 12 bp, Homo sapiens
tgtgttgacaca

SEQ ID NO: 4671719 - DNA, 23 bp, Homo sapiens
tgtgttgacacatatgaacacag

SEQ ID NO: 4671720 - DNA, 21 bp, Homo sapiens
tgtgtttcaaaaccatgcctg

SEQ ID NO: 4671721 - DNA, 19 bp, Homo sapiens
tgtgtttcattacttgaat

SEQ ID NO: 4671722 - DNA, 21 bp, Homo sapiens
tgtgtttcattacttgaatgt

SEQ ID NO: 4671723 - DNA, 12 bp, Homo sapiens
tgttaaaacaac

SEQ ID NO: 4671724 - DNA, 12 bp, Homo sapiens
tgttaaagactt

SEQ ID NO: 4671725 - DNA, 14 bp, Homo sapiens
tgttaactacatat

SEQ ID NO: 4671726 - DNA, 14 bp, Homo sapiens
tgttaagaatagaa

SEQ ID NO: 4671727 - DNA, 21 bp, Homo sapiens
tgttaagaatgaagttctgct

SEQ ID NO: 4671728 - DNA, 15 bp, Homo sapiens
tgttaaggttcaaga

SEQ ID NO: 4671729 - DNA, 17 bp, Homo sapiens
tgttactgactcctcag

SEQ ID NO: 4671730 - DNA, 19 bp, Homo sapiens
tgttactgcctataatctt

SEQ ID NO: 4671731 - DNA, 16 bp, Homo sapiens
tgttactgctttgcaa

SEQ ID NO: 4671732 - DNA, 17 bp, Homo sapiens
tgttagaaaatgactta

SEQ ID NO: 4671733 - DNA, 18 bp, Homo sapiens
tgttagaaaatgacttat

SEQ ID NO: 4671734 - DNA, 14 bp, Homo sapiens
tgttagcagacagg

SEQ ID NO: 4671735 - DNA, 14 bp, Homo sapiens
tgttagcttcctta

SEQ ID NO: 4671736 - DNA, 17 bp, Homo sapiens
tgttagtataagctttt

SEQ ID NO: 4671737 - DNA, 18 bp, Homo sapiens
tgttataccccatatatt

SEQ ID NO: 4671738 - DNA, 23 bp, Homo sapiens
tgttatcggacattctaatgcat

SEQ ID NO: 4671739 - DNA, 14 bp, Homo sapiens
tgttatgccagctc

SEQ ID NO: 4671740 - DNA, 20 bp, Homo sapiens
tgttattaaacgtatgcatg

SEQ ID NO: 4671741 - DNA, 22 bp, Homo sapiens
tgttattaaacgtatgcatgtg

SEQ ID NO: 4671742 - DNA, 16 bp, Homo sapiens
tgttattattagataa

SEQ ID NO: 4671743 - DNA, 13 bp, Homo sapiens
tgttcacagcttt

SEQ ID NO: 4671744 - DNA, 13 bp, Homo sapiens
tgttcactgtccc

SEQ ID NO: 4671745 - DNA, 17 bp, Homo sapiens
tgttcagctctttccaa

SEQ ID NO: 4671746 - DNA, 18 bp, Homo sapiens
tgttcagctctttccaaa

SEQ ID NO: 4671747 - DNA, 19 bp, Homo sapiens
tgttcagctctttccaaat

SEQ ID NO: 4671748 - DNA, 21 bp, Homo sapiens
tgttcagctctttccaaatta

SEQ ID NO: 4671749 - DNA, 17 bp, Homo sapiens
tgttcagtgcaatcaga

SEQ ID NO: 4671750 - DNA, 15 bp, Homo sapiens
tgttcagtgtaaata

SEQ ID NO: 4671751 - DNA, 13 bp, Homo sapiens
tgttcatggcaga

SEQ ID NO: 4671752 - DNA, 21 bp, Homo sapiens
tgttccattgaagccgactct

SEQ ID NO: 4671753 - DNA, 16 bp, Homo sapiens
tgttcccaagagcatc

SEQ ID NO: 4671754 - DNA, 23 bp, Homo sapiens
tgttcccaagagcatcatgcctc

SEQ ID NO: 4671755 - DNA, 13 bp, Homo sapiens
tgttccccaccca

SEQ ID NO: 4671756 - DNA, 14 bp, Homo sapiens
tgttccccacccag

SEQ ID NO: 4671757 - DNA, 14 bp, Homo sapiens
tgttcccccagggg

SEQ ID NO: 4671758 - DNA, 20 bp, Homo sapiens
tgttcccttcctcttcctgc

SEQ ID NO: 4671759 - DNA, 21 bp, Homo sapiens
tgttccgcttctctcttttaa

SEQ ID NO: 4671760 - DNA, 20 bp, Homo sapiens
tgttcctaacaaaatgagat

SEQ ID NO: 4671761 - DNA, 16 bp, Homo sapiens
tgttcctttttgtaaa

SEQ ID NO: 4671762 - DNA, 18 bp, Homo sapiens
tgttcgttgcacagctgt

SEQ ID NO: 4671763 - DNA, 22 bp, Homo sapiens
tgttctaaaatgtcaaggcagt

SEQ ID NO: 4671764 - DNA, 16 bp, Homo sapiens
tgttctatttttcaat

SEQ ID NO: 4671765 - DNA, 19 bp, Homo sapiens
tgttctcaacatactgtaa

SEQ ID NO: 4671766 - DNA, 17 bp, Homo sapiens
tgttctgaaatgttctt

SEQ ID NO: 4671767 - DNA, 18 bp, Homo sapiens
tgttctgaaatgttctta

SEQ ID NO: 4671768 - DNA, 20 bp, Homo sapiens
tgttcttagagtgtagctgt

SEQ ID NO: 4671769 - DNA, 11 bp, Homo sapiens
tgttctttccc

SEQ ID NO: 4671770 - DNA, 18 bp, Homo sapiens
tgttctttccccaggggc

SEQ ID NO: 4671771 - DNA, 15 bp, Homo sapiens
tgttctttccggcca

SEQ ID NO: 4671772 - DNA, 12 bp, Homo sapiens
tgttcttttgca

SEQ ID NO: 4671773 - DNA, 20 bp, Homo sapiens
tgttgaaacttacactgttt

SEQ ID NO: 4671774 - DNA, 19 bp, Homo sapiens
tgttgacacatatgaacac

SEQ ID NO: 4671775 - DNA, 17 bp, Homo sapiens
tgttgacccttttttga

SEQ ID NO: 4671776 - DNA, 20 bp, Homo sapiens
tgttgatcatgtacttttta

SEQ ID NO: 4671777 - DNA, 14 bp, Homo sapiens
tgttgcatggatgt

SEQ ID NO: 4671778 - DNA, 11 bp, Homo sapiens
tgttgcattcc

SEQ ID NO: 4671779 - DNA, 15 bp, Homo sapiens
tgttgctctttcacc

SEQ ID NO: 4671780 - DNA, 14 bp, Homo sapiens
tgttggagcaaacc

SEQ ID NO: 4671781 - DNA, 13 bp, Homo sapiens
tgttggcacagaa

SEQ ID NO: 4671782 - DNA, 21 bp, Homo sapiens
tgttggcacagaacaggaggt

SEQ ID NO: 4671783 - DNA, 21 bp, Homo sapiens
tgttgggaaagataaaactct

SEQ ID NO: 4671784 - DNA, 17 bp, Homo sapiens
tgttggttcaaactttt

SEQ ID NO: 4671785 - DNA, 13 bp, Homo sapiens
tgttgtaaaacaa

SEQ ID NO: 4671786 - DNA, 16 bp, Homo sapiens
tgttgtcttttttatg

SEQ ID NO: 4671787 - DNA, 16 bp, Homo sapiens
tgttgtgcctccctgg

SEQ ID NO: 4671788 - DNA, 18 bp, Homo sapiens
tgttgttctgcctggaga

SEQ ID NO: 4671789 - DNA, 12 bp, Homo sapiens
tgtttaaaataa

SEQ ID NO: 4671790 - DNA, 14 bp, Homo sapiens
tgtttaataaagct

SEQ ID NO: 4671791 - DNA, 17 bp, Homo sapiens
tgtttaataaagcttta

SEQ ID NO: 4671792 - DNA, 19 bp, Homo sapiens
tgtttaatcagttctgtgt

SEQ ID NO: 4671793 - DNA, 17 bp, Homo sapiens
tgtttaatgtgaactct

SEQ ID NO: 4671794 - DNA, 23 bp, Homo sapiens
tgtttaatgtgaactctcccctc

SEQ ID NO: 4671795 - DNA, 23 bp, Homo sapiens
tgtttacaacatcaccagtgcca

SEQ ID NO: 4671796 - DNA, 16 bp, Homo sapiens
tgtttatcaaagagca

SEQ ID NO: 4671797 - DNA, 21 bp, Homo sapiens
tgtttatgaagaaagatacta

SEQ ID NO: 4671798 - DNA, 18 bp, Homo sapiens
tgtttatgaattataaat

SEQ ID NO: 4671799 - DNA, 15 bp, Homo sapiens
tgtttatgtttaaaa

SEQ ID NO: 4671800 - DNA, 15 bp, Homo sapiens
tgtttatttcatgtg

SEQ ID NO: 4671801 - DNA, 12 bp, Homo sapiens
tgtttcaaatgg

SEQ ID NO: 4671802 - DNA, 16 bp, Homo sapiens
tgtttcatttgcttgc

SEQ ID NO: 4671803 - DNA, 13 bp, Homo sapiens
tgtttcccaagct

SEQ ID NO: 4671804 - DNA, 12 bp, Homo sapiens
tgtttcccccac

SEQ ID NO: 4671805 - DNA, 12 bp, Homo sapiens
tgtttcctggcc

SEQ ID NO: 4671806 - DNA, 22 bp, Homo sapiens
tgtttcctggcctcagagcttc

SEQ ID NO: 4671807 - DNA, 23 bp, Homo sapiens
tgtttcctggcctcagagcttcc

SEQ ID NO: 4671808 - DNA, 15 bp, Homo sapiens
tgtttctcaaatctt

SEQ ID NO: 4671809 - DNA, 15 bp, Homo sapiens
tgtttctcctctgaa

SEQ ID NO: 4671810 - DNA, 17 bp, Homo sapiens
tgtttctgaatgtttgt

SEQ ID NO: 4671811 - DNA, 13 bp, Homo sapiens
tgtttgaaatctt

SEQ ID NO: 4671812 - DNA, 23 bp, Homo sapiens
tgtttggggcaggagtagctgag

SEQ ID NO: 4671813 - DNA, 14 bp, Homo sapiens
tgtttgtagctttc

SEQ ID NO: 4671814 - DNA, 16 bp, Homo sapiens
tgtttgtgtctgtggt

SEQ ID NO: 4671815 - DNA, 13 bp, Homo sapiens
tgtttgtgtgttt

SEQ ID NO: 4671816 - DNA, 14 bp, Homo sapiens
tgtttgttttcaaa

SEQ ID NO: 4671817 - DNA, 22 bp, Homo sapiens
tgttttaaagaatatgactttt

SEQ ID NO: 4671818 - DNA, 18 bp, Homo sapiens
tgttttaagtactacaca

SEQ ID NO: 4671819 - DNA, 23 bp, Homo sapiens
tgttttagggagtggttcctgtg

SEQ ID NO: 4671820 - DNA, 23 bp, Homo sapiens
tgttttatccttacaatgtgaat

SEQ ID NO: 4671821 - DNA, 17 bp, Homo sapiens
tgttttattactgtttc

SEQ ID NO: 4671822 - DNA, 16 bp, Homo sapiens
tgttttcaagtgtaaa

SEQ ID NO: 4671823 - DNA, 19 bp, Homo sapiens
tgttttcaagtgtaaatga

SEQ ID NO: 4671824 - DNA, 19 bp, Homo sapiens
tgttttcattatgttcatg

SEQ ID NO: 4671825 - DNA, 18 bp, Homo sapiens
tgttttctgctgtttaca

SEQ ID NO: 4671826 - DNA, 19 bp, Homo sapiens
tgttttctgctgtttacaa

SEQ ID NO: 4671827 - DNA, 12 bp, Homo sapiens
tgttttcttaaa

SEQ ID NO: 4671828 - DNA, 14 bp, Homo sapiens
tgttttgcactttt

SEQ ID NO: 4671829 - DNA, 17 bp, Homo sapiens
tgttttgttctttaaag

SEQ ID NO: 4671830 - DNA, 16 bp, Homo sapiens
tgttttgtttttttga

SEQ ID NO: 4671831 - DNA, 12 bp, Homo sapiens
tgtttttgtaat

SEQ ID NO: 4671832 - DNA, 17 bp, Homo sapiens
tgtttttgtaatgcact

SEQ ID NO: 4671833 - DNA, 15 bp, Homo sapiens
tgttttttatgaagt

SEQ ID NO: 4671834 - DNA, 23 bp, Homo sapiens
tgttttttcggacatgcttttct

SEQ ID NO: 4671835 - DNA, 17 bp, Homo sapiens
ttaaaaaaaaatcttgt

SEQ ID NO: 4671836 - DNA, 17 bp, Homo sapiens
ttaaaaaacaaatgttc

SEQ ID NO: 4671837 - DNA, 23 bp, Homo sapiens
ttaaaaaactgacaggcactata

SEQ ID NO: 4671838 - DNA, 13 bp, Homo sapiens
ttaaaaaatactt

SEQ ID NO: 4671839 - DNA, 20 bp, Homo sapiens
ttaaaaaatattttctctgt

SEQ ID NO: 4671840 - DNA, 14 bp, Homo sapiens
ttaaaaactttatt

SEQ ID NO: 4671841 - DNA, 17 bp, Homo sapiens
ttaaaaagaaatccagt

SEQ ID NO: 4671842 - DNA, 17 bp, Homo sapiens
ttaaaaataaatctaaa

SEQ ID NO: 4671843 - DNA, 12 bp, Homo sapiens
ttaaaaatgtgg

SEQ ID NO: 4671844 - DNA, 14 bp, Homo sapiens
ttaaaaatgtgtca

SEQ ID NO: 4671845 - DNA, 20 bp, Homo sapiens
ttaaaaattacctttaattt

SEQ ID NO: 4671846 - DNA, 19 bp, Homo sapiens
ttaaaacaaatatacattt

SEQ ID NO: 4671847 - DNA, 14 bp, Homo sapiens
ttaaaacaaccagt

SEQ ID NO: 4671848 - DNA, 13 bp, Homo sapiens
ttaaaagaaatat

SEQ ID NO: 4671849 - DNA, 13 bp, Homo sapiens
ttaaaagaatgac

SEQ ID NO: 4671850 - DNA, 14 bp, Homo sapiens
ttaaaagaatgact

SEQ ID NO: 4671851 - DNA, 20 bp, Homo sapiens
ttaaaagaatgagtgaagta

SEQ ID NO: 4671852 - DNA, 14 bp, Homo sapiens
ttaaaatacatttt

SEQ ID NO: 4671853 - DNA, 14 bp, Homo sapiens
ttaaaatattttgg

SEQ ID NO: 4671854 - DNA, 17 bp, Homo sapiens
ttaaaatattttggatg

SEQ ID NO: 4671855 - DNA, 17 bp, Homo sapiens
ttaaaatgacaaacatg

SEQ ID NO: 4671856 - DNA, 18 bp, Homo sapiens
ttaaaatgacaaacatga

SEQ ID NO: 4671857 - DNA, 11 bp, Homo sapiens
ttaaaatggaa

SEQ ID NO: 4671858 - DNA, 14 bp, Homo sapiens
ttaaaatgtgtaca

SEQ ID NO: 4671859 - DNA, 20 bp, Homo sapiens
ttaaaccctggatcagtcct

SEQ ID NO: 4671860 - DNA, 12 bp, Homo sapiens
ttaaaccttttt

SEQ ID NO: 4671861 - DNA, 18 bp, Homo sapiens
ttaaactatgttcctaac

SEQ ID NO: 4671862 - DNA, 15 bp, Homo sapiens
ttaaactcaaatgta

SEQ ID NO: 4671863 - DNA, 22 bp, Homo sapiens
ttaaagcaagcaacacagagga

SEQ ID NO: 4671864 - DNA, 14 bp, Homo sapiens
ttaaaggacataaa

SEQ ID NO: 4671865 - DNA, 18 bp, Homo sapiens
ttaaagggaatcattttt

SEQ ID NO: 4671866 - DNA, 21 bp, Homo sapiens
ttaaaggggagacctcagaag

SEQ ID NO: 4671867 - DNA, 18 bp, Homo sapiens
ttaaagtttaaataccag

SEQ ID NO: 4671868 - DNA, 19 bp, Homo sapiens
ttaaagtttaaataccagt

SEQ ID NO: 4671869 - DNA, 14 bp, Homo sapiens
ttaaataactgtgt

SEQ ID NO: 4671870 - DNA, 18 bp, Homo sapiens
ttaaataggatattaaca

SEQ ID NO: 4671871 - DNA, 14 bp, Homo sapiens
ttaaatatcattct

SEQ ID NO: 4671872 - DNA, 19 bp, Homo sapiens
ttaaatatcattctttgta

SEQ ID NO: 4671873 - DNA, 23 bp, Homo sapiens
ttaaatattgtaatatgacagat

SEQ ID NO: 4671874 - DNA, 18 bp, Homo sapiens
ttaaatcctaccaaagta

SEQ ID NO: 4671875 - DNA, 16 bp, Homo sapiens
ttaaatgaacttatgt

SEQ ID NO: 4671876 - DNA, 12 bp, Homo sapiens
ttaaatgctgct

SEQ ID NO: 4671877 - DNA, 15 bp, Homo sapiens
ttaaattacaatttt

SEQ ID NO: 4671878 - DNA, 21 bp, Homo sapiens
ttaacaacaataacactgtct

SEQ ID NO: 4671879 - DNA, 16 bp, Homo sapiens
ttaacatacaagaaaa

SEQ ID NO: 4671880 - DNA, 19 bp, Homo sapiens
ttaacatttcattgtacaa

SEQ ID NO: 4671881 - DNA, 19 bp, Homo sapiens
ttaacattttgagctattt

SEQ ID NO: 4671882 - DNA, 12 bp, Homo sapiens
ttaacccctcca

SEQ ID NO: 4671883 - DNA, 14 bp, Homo sapiens
ttaacccctccact

SEQ ID NO: 4671884 - DNA, 14 bp, Homo sapiens
ttaacctgggacca

SEQ ID NO: 4671885 - DNA, 21 bp, Homo sapiens
ttaaccttactaattatacta

SEQ ID NO: 4671886 - DNA, 12 bp, Homo sapiens
ttaacctttttt

SEQ ID NO: 4671887 - DNA, 16 bp, Homo sapiens
ttaaccttttttgtct

SEQ ID NO: 4671888 - DNA, 13 bp, Homo sapiens
ttaacggtgctaa

SEQ ID NO: 4671889 - DNA, 12 bp, Homo sapiens
ttaactccctcc

SEQ ID NO: 4671890 - DNA, 18 bp, Homo sapiens
ttaactccctccaccagc

SEQ ID NO: 4671891 - DNA, 19 bp, Homo sapiens
ttaactccctccaccagcc

SEQ ID NO: 4671892 - DNA, 20 bp, Homo sapiens
ttaactgacttcactaggca

SEQ ID NO: 4671893 - DNA, 16 bp, Homo sapiens
ttaacttattacctca

SEQ ID NO: 4671894 - DNA, 12 bp, Homo sapiens
ttaacttgcctc

SEQ ID NO: 4671895 - DNA, 17 bp, Homo sapiens
ttaacttgcctccatct

SEQ ID NO: 4671896 - DNA, 18 bp, Homo sapiens
ttaagaactgcttcatgt

SEQ ID NO: 4671897 - DNA, 18 bp, Homo sapiens
ttaagactgattttaata

SEQ ID NO: 4671898 - DNA, 17 bp, Homo sapiens
ttaagatttctttatgt

SEQ ID NO: 4671899 - DNA, 20 bp, Homo sapiens
ttaagccaaagaaacaagct

SEQ ID NO: 4671900 - DNA, 13 bp, Homo sapiens
ttaagcttttatt

SEQ ID NO: 4671901 - DNA, 15 bp, Homo sapiens
ttaagcttttatttc

SEQ ID NO: 4671902 - DNA, 21 bp, Homo sapiens
ttaaggcacagtgggagctga

SEQ ID NO: 4671903 - DNA, 22 bp, Homo sapiens
ttaagggagtgtactcccaggg

SEQ ID NO: 4671904 - DNA, 12 bp, Homo sapiens
ttaagggcagag

SEQ ID NO: 4671905 - DNA, 12 bp, Homo sapiens
ttaagtttgttg

SEQ ID NO: 4671906 - DNA, 15 bp, Homo sapiens
ttaataaagctttat

SEQ ID NO: 4671907 - DNA, 14 bp, Homo sapiens
ttaatacaggaaat

SEQ ID NO: 4671908 - DNA, 17 bp, Homo sapiens
ttaatacaggaaattga

SEQ ID NO: 4671909 - DNA, 16 bp, Homo sapiens
ttaatacccatgcttt

SEQ ID NO: 4671910 - DNA, 21 bp, Homo sapiens
ttaatacctttaaatatcatt

SEQ ID NO: 4671911 - DNA, 21 bp, Homo sapiens
ttaatacttttccacagattt

SEQ ID NO: 4671912 - DNA, 16 bp, Homo sapiens
ttaatatactcaggga

SEQ ID NO: 4671913 - DNA, 17 bp, Homo sapiens
ttaatatatacattttt

SEQ ID NO: 4671914 - DNA, 15 bp, Homo sapiens
ttaatattctattaa

SEQ ID NO: 4671915 - DNA, 16 bp, Homo sapiens
ttaatattttgttctt

SEQ ID NO: 4671916 - DNA, 19 bp, Homo sapiens
ttaatattttgttcttatt

SEQ ID NO: 4671917 - DNA, 12 bp, Homo sapiens
ttaatcaagaga

SEQ ID NO: 4671918 - DNA, 15 bp, Homo sapiens
ttaatcatacaaact

SEQ ID NO: 4671919 - DNA, 21 bp, Homo sapiens
ttaatcatacaaactctcacc

SEQ ID NO: 4671920 - DNA, 14 bp, Homo sapiens
ttaatcattatttg

SEQ ID NO: 4671921 - DNA, 19 bp, Homo sapiens
ttaatcattttcattccta

SEQ ID NO: 4671922 - DNA, 15 bp, Homo sapiens
ttaatcttgatcatt

SEQ ID NO: 4671923 - DNA, 13 bp, Homo sapiens
ttaatctttattt

SEQ ID NO: 4671924 - DNA, 22 bp, Homo sapiens
ttaatctttattttattattca

SEQ ID NO: 4671925 - DNA, 16 bp, Homo sapiens
ttaatgatggcagagg

SEQ ID NO: 4671926 - DNA, 19 bp, Homo sapiens
ttaatgctctatgtttgta

SEQ ID NO: 4671927 - DNA, 20 bp, Homo sapiens
ttaatgctctatgtttgtat

SEQ ID NO: 4671928 - DNA, 19 bp, Homo sapiens
ttaatgctgtttctaagaa

SEQ ID NO: 4671929 - DNA, 22 bp, Homo sapiens
ttaatgctgtttctaagaaaat

SEQ ID NO: 4671930 - DNA, 23 bp, Homo sapiens
ttaatgctgtttctaagaaaatg

SEQ ID NO: 4671931 - DNA, 24 bp, Homo sapiens
ttaatgctgtttctaagaaaatgt

SEQ ID NO: 4671932 - DNA, 22 bp, Homo sapiens
ttaatggacaaataagtttttg

SEQ ID NO: 4671933 - DNA, 22 bp, Homo sapiens
ttaatggccggctggaaatgct

SEQ ID NO: 4671934 - DNA, 12 bp, Homo sapiens
ttaatgtatctt

SEQ ID NO: 4671935 - DNA, 15 bp, Homo sapiens
ttaatgtatcttaaa

SEQ ID NO: 4671936 - DNA, 19 bp, Homo sapiens
ttaatgtatcttaaaggac

SEQ ID NO: 4671937 - DNA, 16 bp, Homo sapiens
ttatccttttatctca

SEQ ID NO: 4671938 - DNA, 18 bp, Homo sapiens
ttatcgaacgtggtctga

SEQ ID NO: 4671939 - DNA, 19 bp, Homo sapiens
ttatcggacattctaatgc

SEQ ID NO: 4671940 - DNA, 20 bp, Homo sapiens
ttatctaatacctctgtgtg

SEQ ID NO: 4671941 - DNA, 19 bp, Homo sapiens
ttatctcgaatttgaagag

SEQ ID NO: 4671942 - DNA, 18 bp, Homo sapiens
ttatctgtgtttttgaaa

SEQ ID NO: 4671943 - DNA, 12 bp, Homo sapiens
ttatctgtttcc

SEQ ID NO: 4671944 - DNA, 20 bp, Homo sapiens
ttatgaagaatacccaggaa

SEQ ID NO: 4671945 - DNA, 17 bp, Homo sapiens
ttatgacatttcttaaa

SEQ ID NO: 4671946 - DNA, 23 bp, Homo sapiens
ttatgatgaaaacctacatattc

SEQ ID NO: 4671947 - DNA, 14 bp, Homo sapiens
ttatgcaaaatgga

SEQ ID NO: 4671948 - DNA, 15 bp, Homo sapiens
ttatgcaaaatggaa

SEQ ID NO: 4671949 - DNA, 18 bp, Homo sapiens
ttatgcacttttagaaat

SEQ ID NO: 4671950 - DNA, 17 bp, Homo sapiens
ttatgctctcactgttt

SEQ ID NO: 4671951 - DNA, 20 bp, Homo sapiens
ttatgtaaaaggccaaacct

SEQ ID NO: 4671952 - DNA, 22 bp, Homo sapiens
ttatgtaaaaggccaaacctct

SEQ ID NO: 4671953 - DNA, 20 bp, Homo sapiens
ttatgtattctttctgcctt

SEQ ID NO: 4671954 - DNA, 18 bp, Homo sapiens
ttatgtgaaaaattaact

SEQ ID NO: 4671955 - DNA, 12 bp, Homo sapiens
ttatgtgatttt

SEQ ID NO: 4671956 - DNA, 18 bp, Homo sapiens
ttatgtttaaaagaaata

SEQ ID NO: 4671957 - DNA, 13 bp, Homo sapiens
ttattaaaagaat

SEQ ID NO: 4671958 - DNA, 14 bp, Homo sapiens
ttattaagtaaaat

SEQ ID NO: 4671959 - DNA, 18 bp, Homo sapiens
ttattacatgtaatttga

SEQ ID NO: 4671960 - DNA, 16 bp, Homo sapiens
ttattactgtttctaa

SEQ ID NO: 4671961 - DNA, 12 bp, Homo sapiens
ttattagataat

SEQ ID NO: 4671962 - DNA, 14 bp, Homo sapiens
ttattataaactgt

SEQ ID NO: 4671963 - DNA, 11 bp, Homo sapiens
ttattattcag

SEQ ID NO: 4671964 - DNA, 15 bp, Homo sapiens
ttattattgctgaag

SEQ ID NO: 4671965 - DNA, 14 bp, Homo sapiens
ttattattgttaat

SEQ ID NO: 4671966 - DNA, 15 bp, Homo sapiens
ttattcatttggtga

SEQ ID NO: 4671967 - DNA, 19 bp, Homo sapiens
ttattctcttttatctgtt

SEQ ID NO: 4671968 - DNA, 17 bp, Homo sapiens
ttattggaaatgtactt

SEQ ID NO: 4671969 - DNA, 21 bp, Homo sapiens
ttattgggatatcattttaaa

SEQ ID NO: 4671970 - DNA, 17 bp, Homo sapiens
ttattgtaaagtcctat

SEQ ID NO: 4671971 - DNA, 23 bp, Homo sapiens
ttattgtgaatcgattcccaagc

SEQ ID NO: 4671972 - DNA, 20 bp, Homo sapiens
ttatttaacaaaaaatgtaa

SEQ ID NO: 4671973 - DNA, 14 bp, Homo sapiens
ttatttaactggta

SEQ ID NO: 4671974 - DNA, 20 bp, Homo sapiens
ttatttattaaaaatgttct

SEQ ID NO: 4671975 - DNA, 18 bp, Homo sapiens
ttatttccactaaaaata

SEQ ID NO: 4671976 - DNA, 19 bp, Homo sapiens
ttatttccactaaaaatat

SEQ ID NO: 4671977 - DNA, 22 bp, Homo sapiens
ttatttctcagactttggaaaa

SEQ ID NO: 4671978 - DNA, 17 bp, Homo sapiens
ttatttctgctctggaa

SEQ ID NO: 4671979 - DNA, 14 bp, Homo sapiens
ttatttcttcgtga

SEQ ID NO: 4671980 - DNA, 16 bp, Homo sapiens
ttatttgccagagcca

SEQ ID NO: 4671981 - DNA, 17 bp, Homo sapiens
ttatttgccttctgaaa

SEQ ID NO: 4671982 - DNA, 15 bp, Homo sapiens
ttatttggtgtgttc

SEQ ID NO: 4671983 - DNA, 22 bp, Homo sapiens
ttattttcccctatcatttatt

SEQ ID NO: 4671984 - DNA, 14 bp, Homo sapiens
ttattttccttcca

SEQ ID NO: 4671985 - DNA, 12 bp, Homo sapiens
ttattttgtaat

SEQ ID NO: 4671986 - DNA, 13 bp, Homo sapiens
ttattttgtaata

SEQ ID NO: 4671987 - DNA, 14 bp, Homo sapiens
ttatttttagccat

SEQ ID NO: 4671988 - DNA, 12 bp, Homo sapiens
ttatttttctgt

SEQ ID NO: 4671989 - DNA, 12 bp, Homo sapiens
ttcaaaatactt

SEQ ID NO: 4671990 - DNA, 15 bp, Homo sapiens
ttcaaaatacttctt

SEQ ID NO: 4671991 - DNA, 16 bp, Homo sapiens
ttcaaactcctgacct

SEQ ID NO: 4671992 - DNA, 16 bp, Homo sapiens
ttcaaagtgtctcatt

SEQ ID NO: 4671993 - DNA, 13 bp, Homo sapiens
ttcaaatactttt

SEQ ID NO: 4671994 - DNA, 18 bp, Homo sapiens
ttcaaatcccgcagcctc

SEQ ID NO: 4671995 - DNA, 19 bp, Homo sapiens
ttcaaatcgtttatttcac

SEQ ID NO: 4671996 - DNA, 22 bp, Homo sapiens
ttcaaatgatttttacaagttt

SEQ ID NO: 4671997 - DNA, 21 bp, Homo sapiens
ttcaaatgttagagtttaatt

SEQ ID NO: 4671998 - DNA, 23 bp, Homo sapiens
ttcaaatgttagagtttaatttt

SEQ ID NO: 4671999 - DNA, 21 bp, Homo sapiens
ttcaacaacgtgagagaaaga

SEQ ID NO: 4672000 - DNA, 23 bp, Homo sapiens
ttcaacagaccccctctagaaat

SEQ ID NO: 4672001 - DNA, 15 bp, Homo sapiens
ttcaacagggaagaa

SEQ ID NO: 4672002 - DNA, 14 bp, Homo sapiens
ttcaaccagataac

SEQ ID NO: 4672003 - DNA, 12 bp, Homo sapiens
ttcaacttttct

SEQ ID NO: 4672004 - DNA, 15 bp, Homo sapiens
ttcaaggccttcagt

SEQ ID NO: 4672005 - DNA, 19 bp, Homo sapiens
ttcaaggccttcagtttat

SEQ ID NO: 4672006 - DNA, 20 bp, Homo sapiens
ttcaaggccttcagtttatt

SEQ ID NO: 4672007 - DNA, 19 bp, Homo sapiens
ttcaagtgcttaaaaatac

SEQ ID NO: 4672008 - DNA, 20 bp, Homo sapiens
ttcaataaagttgttgcatt

SEQ ID NO: 4672009 - DNA, 22 bp, Homo sapiens
ttcaatactgtatgccttctgt

SEQ ID NO: 4672010 - DNA, 14 bp, Homo sapiens
ttcaatcatcaaaa

SEQ ID NO: 4672011 - DNA, 16 bp, Homo sapiens
ttcaatcatttattca

SEQ ID NO: 4672012 - DNA, 16 bp, Homo sapiens
ttcaatgcttctatca

SEQ ID NO: 4672013 - DNA, 23 bp, Homo sapiens
ttcaatgcttctatcagactcag

SEQ ID NO: 4672014 - DNA, 15 bp, Homo sapiens
ttcaattccaccagg

SEQ ID NO: 4672015 - DNA, 20 bp, Homo sapiens
ttcaattccaccagggccag

SEQ ID NO: 4672016 - DNA, 14 bp, Homo sapiens
ttcacagcttttct

SEQ ID NO: 4672017 - DNA, 16 bp, Homo sapiens
ttcacagcttttcttg

SEQ ID NO: 4672018 - DNA, 15 bp, Homo sapiens
ttcacattcttggct

SEQ ID NO: 4672019 - DNA, 21 bp, Homo sapiens
ttcaccatgatggccaggctg

SEQ ID NO: 4672020 - DNA, 19 bp, Homo sapiens
ttcacctcactgaaaacat

SEQ ID NO: 4672021 - DNA, 21 bp, Homo sapiens
ttcacctcttccactccttct

SEQ ID NO: 4672022 - DNA, 21 bp, Homo sapiens
ttcacctgattcaactaaaaa

SEQ ID NO: 4672023 - DNA, 18 bp, Homo sapiens
ttcacctgccccaactct

SEQ ID NO: 4672024 - DNA, 16 bp, Homo sapiens
ttcacgtaatcctcct

SEQ ID NO: 4672025 - DNA, 18 bp, Homo sapiens
ttcacgtaatcctcctga

SEQ ID NO: 4672026 - DNA, 20 bp, Homo sapiens
ttcacgtaatcctcctgagt

SEQ ID NO: 4672027 - DNA, 21 bp, Homo sapiens
ttcactcatagccacttttat

SEQ ID NO: 4672028 - DNA, 22 bp, Homo sapiens
ttcactcccaggtgagaattca

SEQ ID NO: 4672029 - DNA, 13 bp, Homo sapiens
ttcagaaggagaa

SEQ ID NO: 4672030 - DNA, 14 bp, Homo sapiens
ttcagaaggagaag

SEQ ID NO: 4672031 - DNA, 15 bp, Homo sapiens
ttcagacacatgcta

SEQ ID NO: 4672032 - DNA, 18 bp, Homo sapiens
ttcagagcccccagccct

SEQ ID NO: 4672033 - DNA, 19 bp, Homo sapiens
ttcagatataaaagactga

SEQ ID NO: 4672034 - DNA, 22 bp, Homo sapiens
ttcagatataaaagactgacca

SEQ ID NO: 4672035 - DNA, 19 bp, Homo sapiens
ttcagatgcttctgggaga

SEQ ID NO: 4672036 - DNA, 19 bp, Homo sapiens
ttcagcagcaaattttcag

SEQ ID NO: 4672037 - DNA, 20 bp, Homo sapiens
ttcagcatctaaagcagcag

SEQ ID NO: 4672038 - DNA, 16 bp, Homo sapiens
ttcagcccccaccagg

SEQ ID NO: 4672039 - DNA, 14 bp, Homo sapiens
ttcagcctgccttc

SEQ ID NO: 4672040 - DNA, 24 bp, Homo sapiens
ttcagcgatgtatgcagctatctg

SEQ ID NO: 4672041 - DNA, 16 bp, Homo sapiens
ttcagctagacaatga

SEQ ID NO: 4672042 - DNA, 13 bp, Homo sapiens
ttcagctggaaac

SEQ ID NO: 4672043 - DNA, 22 bp, Homo sapiens
ttcagctggaaacttctgtaag

SEQ ID NO: 4672044 - DNA, 16 bp, Homo sapiens
ttcaggaaaaggcctg

SEQ ID NO: 4672045 - DNA, 13 bp, Homo sapiens
ttcaggaaaatgt

SEQ ID NO: 4672046 - DNA, 23 bp, Homo sapiens
ttcaggagactttacaaaccttt

SEQ ID NO: 4672047 - DNA, 11 bp, Homo sapiens
ttcctgccttt

SEQ ID NO: 4672048 - DNA, 15 bp, Homo sapiens
ttcctgcctttaagc

SEQ ID NO: 4672049 - DNA, 19 bp, Homo sapiens
ttcctgcctttaagccaaa

SEQ ID NO: 4672050 - DNA, 13 bp, Homo sapiens
ttcctgctgcctg

SEQ ID NO: 4672051 - DNA, 17 bp, Homo sapiens
ttcctggacagctgtgc

SEQ ID NO: 4672052 - DNA, 18 bp, Homo sapiens
ttcctggcctcagagctt

SEQ ID NO: 4672053 - DNA, 20 bp, Homo sapiens
ttcctggcctcagagcttcc

SEQ ID NO: 4672054 - DNA, 16 bp, Homo sapiens
ttcctgggtggctact

SEQ ID NO: 4672055 - DNA, 22 bp, Homo sapiens
ttcctgtgacagtgaaatacat

SEQ ID NO: 4672056 - DNA, 21 bp, Homo sapiens
ttcctgtgtgtactctgtcca

SEQ ID NO: 4672057 - DNA, 19 bp, Homo sapiens
ttccttaagtatatcatgt

SEQ ID NO: 4672058 - DNA, 20 bp, Homo sapiens
ttccttaagtatatcatgta

SEQ ID NO: 4672059 - DNA, 12 bp, Homo sapiens
ttccttagtcat

SEQ ID NO: 4672060 - DNA, 20 bp, Homo sapiens
ttccttccaggtgattctgt

SEQ ID NO: 4672061 - DNA, 21 bp, Homo sapiens
ttccttcgaaaggccttcaga

SEQ ID NO: 4672062 - DNA, 15 bp, Homo sapiens
ttcctttcaataaag

SEQ ID NO: 4672063 - DNA, 23 bp, Homo sapiens
ttcctttcctgtgtgtactctgt

SEQ ID NO: 4672064 - DNA, 21 bp, Homo sapiens
ttccttttaaagaagctttat

SEQ ID NO: 4672065 - DNA, 22 bp, Homo sapiens
ttccttttttggggagtacctg

SEQ ID NO: 4672066 - DNA, 24 bp, Homo sapiens
ttccttttttggggagtacctgtc

SEQ ID NO: 4672067 - DNA, 20 bp, Homo sapiens
ttcgatgtgcccaggggagc

SEQ ID NO: 4672068 - DNA, 14 bp, Homo sapiens
ttcgcagccaccct

SEQ ID NO: 4672069 - DNA, 16 bp, Homo sapiens
ttcgcagccaccctga

SEQ ID NO: 4672070 - DNA, 18 bp, Homo sapiens
ttcgcatgtttaatgtga

SEQ ID NO: 4672071 - DNA, 11 bp, Homo sapiens
ttcgctcttga

SEQ ID NO: 4672072 - DNA, 23 bp, Homo sapiens
ttcggacatgcttttctgccact

SEQ ID NO: 4672073 - DNA, 20 bp, Homo sapiens
ttcggttgggtaccatgctt

SEQ ID NO: 4672074 - DNA, 17 bp, Homo sapiens
ttctaaaatagcaataa

SEQ ID NO: 4672075 - DNA, 16 bp, Homo sapiens
ttctaaactaggattg

SEQ ID NO: 4672076 - DNA, 17 bp, Homo sapiens
ttctaaatgtacaaatt

SEQ ID NO: 4672077 - DNA, 14 bp, Homo sapiens
ttctaagaaaatgt

SEQ ID NO: 4672078 - DNA, 19 bp, Homo sapiens
ttctaatacactctaaatt

SEQ ID NO: 4672079 - DNA, 16 bp, Homo sapiens
ttctaatgcatattta

SEQ ID NO: 4672080 - DNA, 23 bp, Homo sapiens
ttctaattgtaagtgaaattaag

SEQ ID NO: 4672081 - DNA, 14 bp, Homo sapiens
ttctaccctggaaa

SEQ ID NO: 4672082 - DNA, 22 bp, Homo sapiens
ttctactctagatggcaacatt

SEQ ID NO: 4672083 - DNA, 21 bp, Homo sapiens
ttctagagagggaattctctt

SEQ ID NO: 4672084 - DNA, 14 bp, Homo sapiens
ttctagagctttta

SEQ ID NO: 4672085 - DNA, 18 bp, Homo sapiens
ttctagataaccttgttt

SEQ ID NO: 4672086 - DNA, 17 bp, Homo sapiens
ttctagccatacctcag

SEQ ID NO: 4672087 - DNA, 23 bp, Homo sapiens
ttctaggaatggaggagccaggc

SEQ ID NO: 4672088 - DNA, 13 bp, Homo sapiens
ttctataaattta

SEQ ID NO: 4672089 - DNA, 14 bp, Homo sapiens
ttctataaatttaa

SEQ ID NO: 4672090 - DNA, 19 bp, Homo sapiens
ttctataaatttaagaaaa

SEQ ID NO: 4672091 - DNA, 22 bp, Homo sapiens
ttctataaatttaagaaaacaa

SEQ ID NO: 4672092 - DNA, 17 bp, Homo sapiens
ttctatgacaaattcaa

SEQ ID NO: 4672093 - DNA, 18 bp, Homo sapiens
ttctatgacaaattcaag

SEQ ID NO: 4672094 - DNA, 17 bp, Homo sapiens
ttctattaatcaagaga

SEQ ID NO: 4672095 - DNA, 15 bp, Homo sapiens
ttctattatggaaaa

SEQ ID NO: 4672096 - DNA, 18 bp, Homo sapiens
ttctattatggaaaactg

SEQ ID NO: 4672097 - DNA, 19 bp, Homo sapiens
ttctattcattcattttga

SEQ ID NO: 4672098 - DNA, 18 bp, Homo sapiens
ttctatttattcctgtta

SEQ ID NO: 4672099 - DNA, 20 bp, Homo sapiens
ttctcaacatactgtaatca

SEQ ID NO: 4672100 - DNA, 19 bp, Homo sapiens
ttctcaggacacaggcctg

SEQ ID NO: 4672101 - DNA, 20 bp, Homo sapiens
ttctcaggacacaggcctgt

SEQ ID NO: 4672102 - DNA, 22 bp, Homo sapiens
ttctcaggacacaggcctgtgt

SEQ ID NO: 4672103 - DNA, 23 bp, Homo sapiens
ttctcaggacacaggcctgtgta

SEQ ID NO: 4672104 - DNA, 16 bp, Homo sapiens
ttctcaggtaatcatt

SEQ ID NO: 4672105 - DNA, 20 bp, Homo sapiens
ttctcaggtaatcattttaa

SEQ ID NO: 4672106 - DNA, 16 bp, Homo sapiens
ttctcataattcctac

SEQ ID NO: 4672107 - DNA, 19 bp, Homo sapiens
ttctcataattcctacagc

SEQ ID NO: 4672108 - DNA, 20 bp, Homo sapiens
ttctcatagaggaaattcaa

SEQ ID NO: 4672109 - DNA, 20 bp, Homo sapiens
ttctccaggattttaatttc

SEQ ID NO: 4672110 - DNA, 14 bp, Homo sapiens
ttctccatgctgca

SEQ ID NO: 4672111 - DNA, 18 bp, Homo sapiens
ttctccattccctagcag

SEQ ID NO: 4672112 - DNA, 14 bp, Homo sapiens
ttctccattgtaaa

SEQ ID NO: 4672113 - DNA, 22 bp, Homo sapiens
ttctcccacatgaggccatctc

SEQ ID NO: 4672114 - DNA, 13 bp, Homo sapiens
ttctcccaggcct

SEQ ID NO: 4672115 - DNA, 19 bp, Homo sapiens
ttctcccaggcctctgccc

SEQ ID NO: 4672116 - DNA, 21 bp, Homo sapiens
ttctcccaggcctctgcccca

SEQ ID NO: 4672117 - DNA, 15 bp, Homo sapiens
ttctccccttcacgt

SEQ ID NO: 4672118 - DNA, 16 bp, Homo sapiens
ttctcctctttgagac

SEQ ID NO: 4672119 - DNA, 19 bp, Homo sapiens
ttctcctggcccctgcctg

SEQ ID NO: 4672120 - DNA, 23 bp, Homo sapiens
ttctcgacccacgcagagaagcc

SEQ ID NO: 4672121 - DNA, 18 bp, Homo sapiens
ttctcggtccactcttgt

SEQ ID NO: 4672122 - DNA, 21 bp, Homo sapiens
ttctcggtccactcttgttga

SEQ ID NO: 4672123 - DNA, 19 bp, Homo sapiens
ttctctacttgtcatatca

SEQ ID NO: 4672124 - DNA, 18 bp, Homo sapiens
ttctctattttcataatc

SEQ ID NO: 4672125 - DNA, 15 bp, Homo sapiens
ttctctcccatcctg

SEQ ID NO: 4672126 - DNA, 13 bp, Homo sapiens
ttctctcttttaa

SEQ ID NO: 4672127 - DNA, 20 bp, Homo sapiens
ttctctcttttaaagtattt

SEQ ID NO: 4672128 - DNA, 12 bp, Homo sapiens
ttctctgcctgg

SEQ ID NO: 4672129 - DNA, 18 bp, Homo sapiens
ttctctgtacttttcatt

SEQ ID NO: 4672130 - DNA, 13 bp, Homo sapiens
ttctctgtgaatc

SEQ ID NO: 4672131 - DNA, 14 bp, Homo sapiens
ttctctgtgtgcac

SEQ ID NO: 4672132 - DNA, 21 bp, Homo sapiens
ttctcttctacccttttcctt

SEQ ID NO: 4672133 - DNA, 21 bp, Homo sapiens
ttctcttgagcagttagcaga

SEQ ID NO: 4672134 - DNA, 12 bp, Homo sapiens
ttctctttctgt

SEQ ID NO: 4672135 - DNA, 13 bp, Homo sapiens
ttctctttctgtt

SEQ ID NO: 4672136 - DNA, 15 bp, Homo sapiens
ttctcttttcctttg

SEQ ID NO: 4672137 - DNA, 16 bp, Homo sapiens
ttctgaaagaattatt

SEQ ID NO: 4672138 - DNA, 15 bp, Homo sapiens
ttctgaaatgtgacc

SEQ ID NO: 4672139 - DNA, 12 bp, Homo sapiens
ttctgaaatgtt

SEQ ID NO: 4672140 - DNA, 16 bp, Homo sapiens
ttctgaaatgttctta

SEQ ID NO: 4672141 - DNA, 19 bp, Homo sapiens
ttctgaagccatgtagcca

SEQ ID NO: 4672142 - DNA, 14 bp, Homo sapiens
ttctgaatgtttgt

SEQ ID NO: 4672143 - DNA, 13 bp, Homo sapiens
ttctgacttttac

SEQ ID NO: 4672144 - DNA, 13 bp, Homo sapiens
ttctgagaaggtg

SEQ ID NO: 4672145 - DNA, 16 bp, Homo sapiens
ttctgcctagagtgta

SEQ ID NO: 4672146 - DNA, 14 bp, Homo sapiens
ttctgcctcccctt

SEQ ID NO: 4672147 - DNA, 20 bp, Homo sapiens
ttctgctcagctctgggcca

SEQ ID NO: 4672148 - DNA, 14 bp, Homo sapiens
ttctgctctggaat

SEQ ID NO: 4672149 - DNA, 23 bp, Homo sapiens
ttctgctctggaataaagttgca

SEQ ID NO: 4672150 - DNA, 16 bp, Homo sapiens
ttctggcataattttt

SEQ ID NO: 4672151 - DNA, 12 bp, Homo sapiens
ttctgggctctg

SEQ ID NO: 4672152 - DNA, 13 bp, Homo sapiens
ttctgggctctgg

SEQ ID NO: 4672153 - DNA, 17 bp, Homo sapiens
ttctgggctctggactc

SEQ ID NO: 4672154 - DNA, 18 bp, Homo sapiens
ttctgggctctggactcc

SEQ ID NO: 4672155 - DNA, 16 bp, Homo sapiens
ttctggggttggaagt

SEQ ID NO: 4672156 - DNA, 16 bp, Homo sapiens
ttctgtaaggggcagc

SEQ ID NO: 4672157 - DNA, 23 bp, Homo sapiens
ttgcctcctctctccctgcctca

SEQ ID NO: 4672158 - DNA, 21 bp, Homo sapiens
ttgcctgaggggaaagagaga

SEQ ID NO: 4672159 - DNA, 12 bp, Homo sapiens
ttgcctgtcaag

SEQ ID NO: 4672160 - DNA, 12 bp, Homo sapiens
ttgcctgtttct

SEQ ID NO: 4672161 - DNA, 14 bp, Homo sapiens
ttgcctgtttcttc

SEQ ID NO: 4672162 - DNA, 20 bp, Homo sapiens
ttgcctttttcattttccaa

SEQ ID NO: 4672163 - DNA, 18 bp, Homo sapiens
ttgcgtacacagagaagg

SEQ ID NO: 4672164 - DNA, 23 bp, Homo sapiens
ttgcgtacacagagaaggctatg

SEQ ID NO: 4672165 - DNA, 18 bp, Homo sapiens
ttgcgtggactctgcaca

SEQ ID NO: 4672166 - DNA, 22 bp, Homo sapiens
ttgctatcaacaataaaatttt

SEQ ID NO: 4672167 - DNA, 16 bp, Homo sapiens
ttgctcccaggatctc

SEQ ID NO: 4672168 - DNA, 19 bp, Homo sapiens
ttgctcctgcttctcctga

SEQ ID NO: 4672169 - DNA, 17 bp, Homo sapiens
ttgctccttcagttctg

SEQ ID NO: 4672170 - DNA, 16 bp, Homo sapiens
ttgctcttggggaagg

SEQ ID NO: 4672171 - DNA, 17 bp, Homo sapiens
ttgctcttggggaaggg

SEQ ID NO: 4672172 - DNA, 17 bp, Homo sapiens
ttgctgagctgtttata

SEQ ID NO: 4672173 - DNA, 24 bp, Homo sapiens
ttgctgagctgtttatagagaatg

SEQ ID NO: 4672174 - DNA, 15 bp, Homo sapiens
ttgctgggcctgggg

SEQ ID NO: 4672175 - DNA, 17 bp, Homo sapiens
ttgctgggccttttgtt

SEQ ID NO: 4672176 - DNA, 16 bp, Homo sapiens
ttgctggggccaggcc

SEQ ID NO: 4672177 - DNA, 14 bp, Homo sapiens
ttgctgtcacttct

SEQ ID NO: 4672178 - DNA, 16 bp, Homo sapiens
ttgcttaaaagaaagt

SEQ ID NO: 4672179 - DNA, 13 bp, Homo sapiens
ttgcttacatcct

SEQ ID NO: 4672180 - DNA, 21 bp, Homo sapiens
ttgcttccaagaccatttgta

SEQ ID NO: 4672181 - DNA, 13 bp, Homo sapiens
ttgcttcctagta

SEQ ID NO: 4672182 - DNA, 16 bp, Homo sapiens
ttgcttcctagtaagt

SEQ ID NO: 4672183 - DNA, 17 bp, Homo sapiens
ttgcttgtactgggaca

SEQ ID NO: 4672184 - DNA, 23 bp, Homo sapiens
ttgctttcaattgacaaatgatg

SEQ ID NO: 4672185 - DNA, 17 bp, Homo sapiens
ttgctttttgctgtgta

SEQ ID NO: 4672186 - DNA, 15 bp, Homo sapiens
ttggaaaatgcattg

SEQ ID NO: 4672187 - DNA, 21 bp, Homo sapiens
ttggaaatgtacttttggata

SEQ ID NO: 4672188 - DNA, 17 bp, Homo sapiens
ttggaactgaagggggc

SEQ ID NO: 4672189 - DNA, 20 bp, Homo sapiens
ttggacagaaaatgcaatga

SEQ ID NO: 4672190 - DNA, 19 bp, Homo sapiens
ttggactagccagaattct

SEQ ID NO: 4672191 - DNA, 12 bp, Homo sapiens
ttggaggctgca

SEQ ID NO: 4672192 - DNA, 16 bp, Homo sapiens
ttggagggggaagaga

SEQ ID NO: 4672193 - DNA, 18 bp, Homo sapiens
ttggatttttgtcttgtg

SEQ ID NO: 4672194 - DNA, 17 bp, Homo sapiens
ttggcagcccctgtttt

SEQ ID NO: 4672195 - DNA, 22 bp, Homo sapiens
ttggcagcccctgttttctgct

SEQ ID NO: 4672196 - DNA, 13 bp, Homo sapiens
ttggcaggctgag

SEQ ID NO: 4672197 - DNA, 16 bp, Homo sapiens
ttggcagtggcagaga

SEQ ID NO: 4672198 - DNA, 14 bp, Homo sapiens
ttggccaggctggt

SEQ ID NO: 4672199 - DNA, 20 bp, Homo sapiens
ttggctaactatatttgctt

SEQ ID NO: 4672200 - DNA, 17 bp, Homo sapiens
ttggctcaataaagatt

SEQ ID NO: 4672201 - DNA, 16 bp, Homo sapiens
ttggcttaatcatttt

SEQ ID NO: 4672202 - DNA, 13 bp, Homo sapiens
ttggcttcatttc

SEQ ID NO: 4672203 - DNA, 19 bp, Homo sapiens
ttgggcacccccagcctgg

SEQ ID NO: 4672204 - DNA, 20 bp, Homo sapiens
ttgggcacccccagcctggg

SEQ ID NO: 4672205 - DNA, 21 bp, Homo sapiens
ttgggcagcgcccttcctctc

SEQ ID NO: 4672206 - DNA, 22 bp, Homo sapiens
ttgggcagcgcccttcctctcc

SEQ ID NO: 4672207 - DNA, 23 bp, Homo sapiens
ttggggcaggagtagctgagctc

SEQ ID NO: 4672208 - DNA, 13 bp, Homo sapiens
ttggggtgacagt

SEQ ID NO: 4672209 - DNA, 23 bp, Homo sapiens
ttgggtagaaagagatacagagg

SEQ ID NO: 4672210 - DNA, 14 bp, Homo sapiens
ttgggtgaatttca

SEQ ID NO: 4672211 - DNA, 12 bp, Homo sapiens
ttgggtttttat

SEQ ID NO: 4672212 - DNA, 17 bp, Homo sapiens
ttgggtttttttgttgt

SEQ ID NO: 4672213 - DNA, 19 bp, Homo sapiens
ttggtaaaacagtttcatc

SEQ ID NO: 4672214 - DNA, 18 bp, Homo sapiens
ttggtaaaactcactgtg

SEQ ID NO: 4672215 - DNA, 19 bp, Homo sapiens
ttggtaaaactcactgtga

SEQ ID NO: 4672216 - DNA, 22 bp, Homo sapiens
ttggtctcccttctctacactc

SEQ ID NO: 4672217 - DNA, 21 bp, Homo sapiens
ttggtgaattttcaaggcctt

SEQ ID NO: 4672218 - DNA, 23 bp, Homo sapiens
ttggtgacttgtctgcctcctgc

SEQ ID NO: 4672219 - DNA, 22 bp, Homo sapiens
ttggtgcctggcctggcacaca

SEQ ID NO: 4672220 - DNA, 15 bp, Homo sapiens
ttggtgctatttgaa

SEQ ID NO: 4672221 - DNA, 23 bp, Homo sapiens
ttggtgtgttcgttgcacagctg

SEQ ID NO: 4672222 - DNA, 22 bp, Homo sapiens
ttggtttgtggcgtctccctcg

SEQ ID NO: 4672223 - DNA, 13 bp, Homo sapiens
ttggttttaaaag

SEQ ID NO: 4672224 - DNA, 14 bp, Homo sapiens
ttggttttaaaagc

SEQ ID NO: 4672225 - DNA, 23 bp, Homo sapiens
ttgtaaaaacagcattgctttct

SEQ ID NO: 4672226 - DNA, 12 bp, Homo sapiens
ttgtaaaccatt

SEQ ID NO: 4672227 - DNA, 22 bp, Homo sapiens
ttgtaaatatgtgacattcctg

SEQ ID NO: 4672228 - DNA, 17 bp, Homo sapiens
ttgtaaatcctgtgttt

SEQ ID NO: 4672229 - DNA, 20 bp, Homo sapiens
ttgtaactattaaccttttt

SEQ ID NO: 4672230 - DNA, 15 bp, Homo sapiens
ttgtaatatgacaga

SEQ ID NO: 4672231 - DNA, 16 bp, Homo sapiens
ttgtaatatgacagat

SEQ ID NO: 4672232 - DNA, 23 bp, Homo sapiens
ttgtaatatgacagataacctaa

SEQ ID NO: 4672233 - DNA, 14 bp, Homo sapiens
ttgtaatattttta

SEQ ID NO: 4672234 - DNA, 22 bp, Homo sapiens
ttgtaatgattttggaactgtg

SEQ ID NO: 4672235 - DNA, 16 bp, Homo sapiens
ttgtacagtttttatt

SEQ ID NO: 4672236 - DNA, 18 bp, Homo sapiens
ttgtacattttgtaaaat

SEQ ID NO: 4672237 - DNA, 19 bp, Homo sapiens
ttgtactgttcatacagtt

SEQ ID NO: 4672238 - DNA, 18 bp, Homo sapiens
ttgtactttgtggagaga

SEQ ID NO: 4672239 - DNA, 12 bp, Homo sapiens
ttgtagactctt

SEQ ID NO: 4672240 - DNA, 14 bp, Homo sapiens
ttgtagctttcctg

SEQ ID NO: 4672241 - DNA, 22 bp, Homo sapiens
ttgtataagtaattcagtggga

SEQ ID NO: 4672242 - DNA, 21 bp, Homo sapiens
ttgtatcgatgttatgtaaaa

SEQ ID NO: 4672243 - DNA, 18 bp, Homo sapiens
ttgtatctacattaaaat

SEQ ID NO: 4672244 - DNA, 14 bp, Homo sapiens
ttgtatcttaaatc

SEQ ID NO: 4672245 - DNA, 15 bp, Homo sapiens
ttgtatgcaatggat

SEQ ID NO: 4672246 - DNA, 22 bp, Homo sapiens
ttgtatttggaatatttgaata

SEQ ID NO: 4672247 - DNA, 16 bp, Homo sapiens
ttgtcacattatttat

SEQ ID NO: 4672248 - DNA, 22 bp, Homo sapiens
ttgtcacattatttattaaaaa

SEQ ID NO: 4672249 - DNA, 14 bp, Homo sapiens
ttgtcacccaggct

SEQ ID NO: 4672250 - DNA, 13 bp, Homo sapiens
ttgtcagacataa

SEQ ID NO: 4672251 - DNA, 14 bp, Homo sapiens
ttgtcagacataaa

SEQ ID NO: 4672252 - DNA, 19 bp, Homo sapiens
ttgtcagacataaagccat

SEQ ID NO: 4672253 - DNA, 21 bp, Homo sapiens
ttgtcagtgtagacacaggtc

SEQ ID NO: 4672254 - DNA, 13 bp, Homo sapiens
ttgtcattttatg

SEQ ID NO: 4672255 - DNA, 17 bp, Homo sapiens
ttgtccatcttgtttca

SEQ ID NO: 4672256 - DNA, 19 bp, Homo sapiens
ttgtccatcttgtttcatt

SEQ ID NO: 4672257 - DNA, 21 bp, Homo sapiens
ttgtcccagaggctgccccac

SEQ ID NO: 4672258 - DNA, 15 bp, Homo sapiens
ttgtcccttccagga

SEQ ID NO: 4672259 - DNA, 20 bp, Homo sapiens
ttgtccggtggaaggccttc

SEQ ID NO: 4672260 - DNA, 18 bp, Homo sapiens
ttgtctaaaacaataaaa

SEQ ID NO: 4672261 - DNA, 14 bp, Homo sapiens
ttgtctgcctcctg

SEQ ID NO: 4672262 - DNA, 23 bp, Homo sapiens
ttgtcttagcatggtacctgctg

SEQ ID NO: 4672263 - DNA, 21 bp, Homo sapiens
ttgtcttatgtgaaaaattaa

SEQ ID NO: 4672264 - DNA, 12 bp, Homo sapiens
ttgtcttattga

SEQ ID NO: 4672265 - DNA, 18 bp, Homo sapiens
ttgtcttttcaaaatatt

SEQ ID NO: 4672266 - DNA, 13 bp, Homo sapiens
ttgtgactgtcac

SEQ ID NO: 4672267 - DNA, 18 bp, Homo sapiens
ttgtgataatagcatttt

SEQ ID NO: 4672268 - DNA, 20 bp, Homo sapiens
ttgtgataatagcatttttg

SEQ ID NO: 4672269 - DNA, 11 bp, Homo sapiens
ttgtgcagaga

SEQ ID NO: 4672270 - DNA, 22 bp, Homo sapiens
ttgtgccatagtcacatggcct

SEQ ID NO: 4672271 - DNA, 16 bp, Homo sapiens
ttgtgctagaaatttt

SEQ ID NO: 4672272 - DNA, 20 bp, Homo sapiens
ttgtggagatcacagcccca

SEQ ID NO: 4672273 - DNA, 18 bp, Homo sapiens
ttgtgggtatttcttggc

SEQ ID NO: 4672274 - DNA, 17 bp, Homo sapiens
ttgtgtctatgatgttg

SEQ ID NO: 4672275 - DNA, 19 bp, Homo sapiens
ttgtgttaacttgcctcca

SEQ ID NO: 4672276 - DNA, 23 bp, Homo sapiens
ttgtgttaacttgcctccatctt

SEQ ID NO: 4672277 - DNA, 22 bp, Homo sapiens
ttgtgttcagctctttccaaat

SEQ ID NO: 4672278 - DNA, 21 bp, Homo sapiens
ttgttattattagataatatt

SEQ ID NO: 4672279 - DNA, 16 bp, Homo sapiens
ttgttattattgttaa

SEQ ID NO: 4672280 - DNA, 13 bp, Homo sapiens
ttgttctattttt

SEQ ID NO: 4672281 - DNA, 18 bp, Homo sapiens
ttgttctatttttcaatc

SEQ ID NO: 4672282 - DNA, 19 bp, Homo sapiens
ttgttgaagtgctgtttta

SEQ ID NO: 4672283 - DNA, 16 bp, Homo sapiens
ttgttggcacagaaca

SEQ ID NO: 4672284 - DNA, 15 bp, Homo sapiens
ttgttgttgccaaag

SEQ ID NO: 4672285 - DNA, 14 bp, Homo sapiens
ttgtttaacaaaag

SEQ ID NO: 4672286 - DNA, 20 bp, Homo sapiens
ttgtttaatcagttctgtgt

SEQ ID NO: 4672287 - DNA, 18 bp, Homo sapiens
ttgtttgtagctttcctg

SEQ ID NO: 4672288 - DNA, 19 bp, Homo sapiens
ttgtttgtagctttcctgg

SEQ ID NO: 4672289 - DNA, 12 bp, Homo sapiens
ttgtttgtttct

SEQ ID NO: 4672290 - DNA, 13 bp, Homo sapiens
ttgttttcttaaa

SEQ ID NO: 4672291 - DNA, 16 bp, Homo sapiens
ttgttttgcacttttt

SEQ ID NO: 4672292 - DNA, 16 bp, Homo sapiens
ttgttttgtgcagaga

SEQ ID NO: 4672293 - DNA, 15 bp, Homo sapiens
ttgtttttttgagat

SEQ ID NO: 4672294 - DNA, 13 bp, Homo sapiens
tttaaaaaggtgc

SEQ ID NO: 4672295 - DNA, 12 bp, Homo sapiens
tttaaaaatgca

SEQ ID NO: 4672296 - DNA, 12 bp, Homo sapiens
tttaaaagaaat

SEQ ID NO: 4672297 - DNA, 13 bp, Homo sapiens
tttaaaagttttg

SEQ ID NO: 4672298 - DNA, 18 bp, Homo sapiens
tttaaaataaaatgaaaa

SEQ ID NO: 4672299 - DNA, 22 bp, Homo sapiens
tttaaaataaaatgaaaattgt

SEQ ID NO: 4672300 - DNA, 19 bp, Homo sapiens
tttaaaatgtgaggcaata

SEQ ID NO: 4672301 - DNA, 19 bp, Homo sapiens
tttaaaatttaagtatctt

SEQ ID NO: 4672302 - DNA, 22 bp, Homo sapiens
tttaaaccagggatgtctgttg

SEQ ID NO: 4672303 - DNA, 15 bp, Homo sapiens
tttaaagtttaaata

SEQ ID NO: 4672304 - DNA, 18 bp, Homo sapiens
tttaaagtttaaatacca

SEQ ID NO: 4672305 - DNA, 16 bp, Homo sapiens
tttaaatatatatttt

SEQ ID NO: 4672306 - DNA, 14 bp, Homo sapiens
tttaaatatcattc

SEQ ID NO: 4672307 - DNA, 14 bp, Homo sapiens
tttaaatattttct

SEQ ID NO: 4672308 - DNA, 17 bp, Homo sapiens
tttaacatgatttcaaa

SEQ ID NO: 4672309 - DNA, 12 bp, Homo sapiens
tttaagaaaaaa

SEQ ID NO: 4672310 - DNA, 17 bp, Homo sapiens
tttaagatagaacacaa

SEQ ID NO: 4672311 - DNA, 21 bp, Homo sapiens
tttaagccaaagaaacaagct

SEQ ID NO: 4672312 - DNA, 16 bp, Homo sapiens
tttaagctctgcccct

SEQ ID NO: 4672313 - DNA, 12 bp, Homo sapiens
tttaaggtttca

SEQ ID NO: 4672314 - DNA, 16 bp, Homo sapiens
tttaaggtttcaacaa

SEQ ID NO: 4672315 - DNA, 18 bp, Homo sapiens
tttaagttacacattttt

SEQ ID NO: 4672316 - DNA, 17 bp, Homo sapiens
tttaataaagctttata

SEQ ID NO: 4672317 - DNA, 16 bp, Homo sapiens
tttaataaattgctta

SEQ ID NO: 4672318 - DNA, 16 bp, Homo sapiens
tttaatacctttaaat

SEQ ID NO: 4672319 - DNA, 20 bp, Homo sapiens
tttaatacctttaaatatca

SEQ ID NO: 4672320 - DNA, 15 bp, Homo sapiens
tttaatacttttcca

SEQ ID NO: 4672321 - DNA, 17 bp, Homo sapiens
tttaatcagttctgtgt

SEQ ID NO: 4672322 - DNA, 22 bp, Homo sapiens
tttaatgcctgcccattagaga

SEQ ID NO: 4672323 - DNA, 10 bp, Homo sapiens
tttaatgtat

SEQ ID NO: 4672324 - DNA, 16 bp, Homo sapiens
tttaatgtatcttaaa

SEQ ID NO: 4672325 - DNA, 20 bp, Homo sapiens
tttaatgtgaactctcccct

SEQ ID NO: 4672326 - DNA, 16 bp, Homo sapiens
tttaattactactagg

SEQ ID NO: 4672327 - DNA, 15 bp, Homo sapiens
tttaatttcaggaaa

SEQ ID NO: 4672328 - DNA, 13 bp, Homo sapiens
tttacaaaccttt

SEQ ID NO: 4672329 - DNA, 16 bp, Homo sapiens
tttacaaactgaagat

SEQ ID NO: 4672330 - DNA, 21 bp, Homo sapiens
tttacaacatcaccagtgcca

SEQ ID NO: 4672331 - DNA, 15 bp, Homo sapiens
tttacacaattctta

SEQ ID NO: 4672332 - DNA, 13 bp, Homo sapiens
tttacagaaatgg

SEQ ID NO: 4672333 - DNA, 17 bp, Homo sapiens
tttacatagttgagatt

SEQ ID NO: 4672334 - DNA, 23 bp, Homo sapiens
tttacatagttgagattgtactg

SEQ ID NO: 4672335 - DNA, 12 bp, Homo sapiens
tttacattttaa

SEQ ID NO: 4672336 - DNA, 18 bp, Homo sapiens
tttacattttcagtacca

SEQ ID NO: 4672337 - DNA, 21 bp, Homo sapiens
tttaccaaagagatattgata

SEQ ID NO: 4672338 - DNA, 15 bp, Homo sapiens
tttaccatacattta

SEQ ID NO: 4672339 - DNA, 19 bp, Homo sapiens
tttactaactaaataccat

SEQ ID NO: 4672340 - DNA, 19 bp, Homo sapiens
tttactaattttctagatt

SEQ ID NO: 4672341 - DNA, 19 bp, Homo sapiens
tttactggccatacaaaat

SEQ ID NO: 4672342 - DNA, 19 bp, Homo sapiens
tttacttgaggatcatatg

SEQ ID NO: 4672343 - DNA, 16 bp, Homo sapiens
tttactttaaacttgt

SEQ ID NO: 4672344 - DNA, 18 bp, Homo sapiens
tttactttaaacttgtct

SEQ ID NO: 4672345 - DNA, 23 bp, Homo sapiens
tttagaaaaaatggatgcccaga

SEQ ID NO: 4672346 - DNA, 16 bp, Homo sapiens
tttagataatttgaaa

SEQ ID NO: 4672347 - DNA, 18 bp, Homo sapiens
tttagataatttgaaaaa

SEQ ID NO: 4672348 - DNA, 17 bp, Homo sapiens
tttagcccagtgttttc

SEQ ID NO: 4672349 - DNA, 13 bp, Homo sapiens
tttagcttcattt

SEQ ID NO: 4672350 - DNA, 18 bp, Homo sapiens
tttagcttctttccctta

SEQ ID NO: 4672351 - DNA, 13 bp, Homo sapiens
tttaggaaaatgc

SEQ ID NO: 4672352 - DNA, 17 bp, Homo sapiens
tttaggtactattctga

SEQ ID NO: 4672353 - DNA, 22 bp, Homo sapiens
tttaggtgaattaattaaacat

SEQ ID NO: 4672354 - DNA, 15 bp, Homo sapiens
tttagtaatttcttt

SEQ ID NO: 4672355 - DNA, 17 bp, Homo sapiens
tttagtgtatctttaaa

SEQ ID NO: 4672356 - DNA, 12 bp, Homo sapiens
tttagttttaca

SEQ ID NO: 4672357 - DNA, 20 bp, Homo sapiens
tttataacttaaatattgct

SEQ ID NO: 4672358 - DNA, 14 bp, Homo sapiens
tttataatactgtt

SEQ ID NO: 4672359 - DNA, 10 bp, Homo sapiens
tttatacctc

SEQ ID NO: 4672360 - DNA, 21 bp, Homo sapiens
tttatacctcaaactatctgg

SEQ ID NO: 4672361 - DNA, 18 bp, Homo sapiens
tttatagcaacaacaatt

SEQ ID NO: 4672362 - DNA, 13 bp, Homo sapiens
tttatatctgtct

SEQ ID NO: 4672363 - DNA, 13 bp, Homo sapiens
tttatatgttgta

SEQ ID NO: 4672364 - DNA, 16 bp, Homo sapiens
tttatatttatccact

SEQ ID NO: 4672365 - DNA, 23 bp, Homo sapiens
tttatcaattatattatgtttaa

SEQ ID NO: 4672366 - DNA, 21 bp, Homo sapiens
tttatccttacaatgtgaata

SEQ ID NO: 4672367 - DNA, 19 bp, Homo sapiens
tttatctgtagtaaactat

SEQ ID NO: 4672368 - DNA, 13 bp, Homo sapiens
tttatctgtttaa

SEQ ID NO: 4672369 - DNA, 19 bp, Homo sapiens
tttatgccttcttattgct

SEQ ID NO: 4672370 - DNA, 23 bp, Homo sapiens
tttatgctcttgaaatattcaga

SEQ ID NO: 4672371 - DNA, 16 bp, Homo sapiens
tttattaaaaatgttc

SEQ ID NO: 4672372 - DNA, 17 bp, Homo sapiens
tttattaaaaatgttct

SEQ ID NO: 4672373 - DNA, 21 bp, Homo sapiens
tttattaaaaatgttctcaaa

SEQ ID NO: 4672374 - DNA, 12 bp, Homo sapiens
tttattaaaaga

SEQ ID NO: 4672375 - DNA, 15 bp, Homo sapiens
tttattacaaatgca

SEQ ID NO: 4672376 - DNA, 19 bp, Homo sapiens
tttattacaaatgcaaatt

SEQ ID NO: 4672377 - DNA, 14 bp, Homo sapiens
ttttattatgcatt

SEQ ID NO: 4672378 - DNA, 12 bp, Homo sapiens
ttttattcacat

SEQ ID NO: 4672379 - DNA, 14 bp, Homo sapiens
ttttattttttagt

SEQ ID NO: 4672380 - DNA, 10 bp, Homo sapiens
ttttcaaaat

SEQ ID NO: 4672381 - DNA, 18 bp, Homo sapiens
ttttcaaaatacttcttt

SEQ ID NO: 4672382 - DNA, 18 bp, Homo sapiens
ttttcaaccataaaagaa

SEQ ID NO: 4672383 - DNA, 22 bp, Homo sapiens
ttttcaaccataaaagaagttt

SEQ ID NO: 4672384 - DNA, 20 bp, Homo sapiens
ttttcaataccaattacatg

SEQ ID NO: 4672385 - DNA, 13 bp, Homo sapiens
ttttcacaaacat

SEQ ID NO: 4672386 - DNA, 19 bp, Homo sapiens
ttttcagatataaaagact

SEQ ID NO: 4672387 - DNA, 21 bp, Homo sapiens
ttttcagatataaaagactga

SEQ ID NO: 4672388 - DNA, 18 bp, Homo sapiens
ttttcagcgatgtatgca

SEQ ID NO: 4672389 - DNA, 15 bp, Homo sapiens
ttttcagtcatataa

SEQ ID NO: 4672390 - DNA, 15 bp, Homo sapiens
ttttcagtgcatcat

SEQ ID NO: 4672391 - DNA, 20 bp, Homo sapiens
ttttcatgttttaacaaaaa

SEQ ID NO: 4672392 - DNA, 20 bp, Homo sapiens
ttttcattatgttcatgtaa

SEQ ID NO: 4672393 - DNA, 14 bp, Homo sapiens
ttttcctcttgtga

SEQ ID NO: 4672394 - DNA, 14 bp, Homo sapiens
ttttcctgttcata

SEQ ID NO: 4672395 - DNA, 12 bp, Homo sapiens
ttttccttccat

SEQ ID NO: 4672396 - DNA, 16 bp, Homo sapiens
ttttctaaataaaaat

SEQ ID NO: 4672397 - DNA, 13 bp, Homo sapiens
ttttctaataaag

SEQ ID NO: 4672398 - DNA, 23 bp, Homo sapiens
ttttctattatggaaaactgtgt

SEQ ID NO: 4672399 - DNA, 22 bp, Homo sapiens
ttttctgaggatagtagttaaa

SEQ ID NO: 4672400 - DNA, 23 bp, Homo sapiens
ttttctgaggatagtagttaaat

SEQ ID NO: 4672401 - DNA, 16 bp, Homo sapiens
ttttctgcttttgaaa

SEQ ID NO: 4672402 - DNA, 11 bp, Homo sapiens
ttttcttgata

SEQ ID NO: 4672403 - DNA, 17 bp, Homo sapiens
ttttcttggttctttca

SEQ ID NO: 4672404 - DNA, 13 bp, Homo sapiens
ttttgaaacaaag

SEQ ID NO: 4672405 - DNA, 20 bp, Homo sapiens
ttttgaaatctgtatctgta

SEQ ID NO: 4672406 - DNA, 18 bp, Homo sapiens
ttttgaaccaacatcttt

SEQ ID NO: 4672407 - DNA, 21 bp, Homo sapiens
ttttgagataaatgagtgatt

SEQ ID NO: 4672408 - DNA, 16 bp, Homo sapiens
ttttgagctatttcct

SEQ ID NO: 4672409 - DNA, 17 bp, Homo sapiens
ttttgagctatttcctt

SEQ ID NO: 4672410 - DNA, 19 bp, Homo sapiens
ttttgagtatttttaaaaa

SEQ ID NO: 4672411 - DNA, 20 bp, Homo sapiens
ttttgagtttcagctggaaa

SEQ ID NO: 4672412 - DNA, 14 bp, Homo sapiens
ttttgcacttatct

SEQ ID NO: 4672413 - DNA, 17 bp, Homo sapiens
ttttgcgtacacagaga

SEQ ID NO: 4672414 - DNA, 13 bp, Homo sapiens
ttttgctgtagaa

SEQ ID NO: 4672415 - DNA, 21 bp, Homo sapiens
ttttgctttagagaatgccac

SEQ ID NO: 4672416 - DNA, 21 bp, Homo sapiens
ttttggggagtacctgtccaa

SEQ ID NO: 4672417 - DNA, 18 bp, Homo sapiens
ttttggtatttgtttgta

SEQ ID NO: 4672418 - DNA, 16 bp, Homo sapiens
ttttggtgtgccctgt

SEQ ID NO: 4672419 - DNA, 19 bp, Homo sapiens
ttttggttggtttttacat

SEQ ID NO: 4672420 - DNA, 13 bp, Homo sapiens
ttttgtaaaatat

SEQ ID NO: 4672421 - DNA, 17 bp, Homo sapiens
ttttgtaatgcactgtt

SEQ ID NO: 4672422 - DNA, 13 bp, Homo sapiens
ttttgtccatctt

SEQ ID NO: 4672423 - DNA, 13 bp, Homo sapiens
ttttgtcttgtgt

SEQ ID NO: 4672424 - DNA, 21 bp, Homo sapiens
ttttgtgaagtttaattgact

SEQ ID NO: 4672425 - DNA, 21 bp, Homo sapiens
ttttgttgtgcactagtgcaa

SEQ ID NO: 4672426 - DNA, 14 bp, Homo sapiens
ttttgtttgtttct

SEQ ID NO: 4672427 - DNA, 21 bp, Homo sapiens
ttttgtttgtttctttgtgtt

SEQ ID NO: 4672428 - DNA, 16 bp, Homo sapiens
ttttgtttttgtaatg

SEQ ID NO: 4672429 - DNA, 13 bp, Homo sapiens
tttttaaaagcct

SEQ ID NO: 4672430 - DNA, 21 bp, Homo sapiens
tttttaaaagccttccagttt

SEQ ID NO: 4672431 - DNA, 22 bp, Homo sapiens
tttttaaaccagggatgtctgt

SEQ ID NO: 4672432 - DNA, 16 bp, Homo sapiens
tttttaaagtttaaat

SEQ ID NO: 4672433 - DNA, 13 bp, Homo sapiens
tttttaaattgtt

SEQ ID NO: 4672434 - DNA, 14 bp, Homo sapiens
tttttaacctgttt

SEQ ID NO: 4672435 - DNA, 18 bp, Homo sapiens
tttttacaagttttaaat

SEQ ID NO: 4672436 - DNA, 20 bp, Homo sapiens
tttttactaagttttcaaat

SEQ ID NO: 4672437 - DNA, 21 bp, Homo sapiens
tttttagtgcatccagttaac

SEQ ID NO: 4672438 - DNA, 18 bp, Homo sapiens
tttttataaaatggctgt

SEQ ID NO: 4672439 - DNA, 14 bp, Homo sapiens
tttttcattttcca

SEQ ID NO: 4672440 - DNA, 12 bp, Homo sapiens
tttttctgcgct

SEQ ID NO: 4672441 - DNA, 23 bp, Homo sapiens
tttttcttctattaatcaagaga

SEQ ID NO: 4672442 - DNA, 18 bp, Homo sapiens
tttttgaaccaacatctt

SEQ ID NO: 4672443 - DNA, 23 bp, Homo sapiens
tttttgaagtaaattaaacattt

SEQ ID NO: 4672444 - DNA, 13 bp, Homo sapiens
tttttgctgtgta

SEQ ID NO: 4672445 - DNA, 19 bp, Homo sapiens
tttttgtaatgcactgttt

SEQ ID NO: 4672446 - DNA, 22 bp, Homo sapiens
tttttgtatttctctattttca

SEQ ID NO: 4672447 - DNA, 17 bp, Homo sapiens
tttttgtcttattgaaa

SEQ ID NO: 4672448 - DNA, 15 bp, Homo sapiens
ttttttaatgtatct

SEQ ID NO: 4672449 - DNA, 11 bp, Homo sapiens
ttttttatgtt

SEQ ID NO: 4672450 - DNA, 12 bp, Homo sapiens
ttttttgtttca

SEQ ID NO: 4672451 - DNA, 13 bp, Homo sapiens
ttttttgtttcat

SEQ ID NO: 4672452 - DNA, 16 bp, Homo sapiens
ttttttgtttgtttct

SEQ ID NO: 4672453 - DNA, 11 bp, Homo sapiens
ttttttttcat

SEQ ID NO: 4672454 - DNA, 13 bp, Homo sapiens
tttttttttaaac

SEQ ID NO: 4672455 - DNA, 13 bp, Homo sapiens
tttttttttcatt

SEQ ID NO: 4672456 - DNA, 17 bp, Homo sapiens
cctgtcttggggccact

SEQ ID NO: 4672457 - DNA, 17 bp, Homo sapiens
cctgtgagcccagctgg

SEQ ID NO: 4672458 - DNA, 20 bp, Homo sapiens
cctgtgagcccagctgggtc

SEQ ID NO: 4672459 - DNA, 15 bp, Homo sapiens
cctgtgcgtcccagc

SEQ ID NO: 4672460 - DNA, 18 bp, Homo sapiens
cctgtgcgtcccagctga

SEQ ID NO: 4672461 - DNA, 23 bp, Homo sapiens
cctgtggaatgagtgtgcatgga

SEQ ID NO: 4672462 - DNA, 20 bp, Homo sapiens
cctgtggccaagttcttagt

SEQ ID NO: 4672463 - DNA, 18 bp, Homo sapiens
cctgtggctccctctctc

SEQ ID NO: 4672464 - DNA, 21 bp, Homo sapiens
cctgtggctccctctctcctg

SEQ ID NO: 4672465 - DNA, 16 bp, Homo sapiens
cctgtgggtctctgaa

SEQ ID NO: 4672466 - DNA, 18 bp, Homo sapiens
cctgtgggtctctgaagg

SEQ ID NO: 4672467 - DNA, 23 bp, Homo sapiens
cctgtgtagctgtgacctgctga

SEQ ID NO: 4672468 - DNA, 14 bp, Homo sapiens
cctgtgtggacagg

SEQ ID NO: 4672469 - DNA, 15 bp, Homo sapiens
cctgtgtggacagga

SEQ ID NO: 4672470 - DNA, 17 bp, Homo sapiens
cctgtgtggacaggact

SEQ ID NO: 4672471 - DNA, 18 bp, Homo sapiens
cctgtgtgtactctgtcc

SEQ ID NO: 4672472 - DNA, 20 bp, Homo sapiens
cctgtgtgtgtgtgtgtaca

SEQ ID NO: 4672473 - DNA, 17 bp, Homo sapiens
cctgtttattccaaatg

SEQ ID NO: 4672474 - DNA, 13 bp, Homo sapiens
cctgtttccaggg

SEQ ID NO: 4672475 - DNA, 15 bp, Homo sapiens
cctgttttctgctgt

SEQ ID NO: 4672476 - DNA, 16 bp, Homo sapiens
cctgttttctgctgtt

SEQ ID NO: 4672477 - DNA, 12 bp, Homo sapiens
ccttaaaatgga

SEQ ID NO: 4672478 - DNA, 13 bp, Homo sapiens
ccttaaaatggaa

SEQ ID NO: 4672479 - DNA, 19 bp, Homo sapiens
ccttaactatcaccagtgc

SEQ ID NO: 4672480 - DNA, 14 bp, Homo sapiens
ccttaagccctggc

SEQ ID NO: 4672481 - DNA, 16 bp, Homo sapiens
ccttaagccctggccc

SEQ ID NO: 4672482 - DNA, 18 bp, Homo sapiens
ccttaatcttgctttctt

SEQ ID NO: 4672483 - DNA, 16 bp, Homo sapiens
ccttacaatgtgaata

SEQ ID NO: 4672484 - DNA, 13 bp, Homo sapiens
ccttacactcccc

SEQ ID NO: 4672485 - DNA, 15 bp, Homo sapiens
ccttacactccccca

SEQ ID NO: 4672486 - DNA, 16 bp, Homo sapiens
ccttacccatcttgct

SEQ ID NO: 4672487 - DNA, 21 bp, Homo sapiens
ccttactcctgtgggagcctc

SEQ ID NO: 4672488 - DNA, 20 bp, Homo sapiens
ccttacttccagcaagcaaa

SEQ ID NO: 4672489 - DNA, 21 bp, Homo sapiens
ccttacttccagcaagcaaag

SEQ ID NO: 4672490 - DNA, 12 bp, Homo sapiens
cgattctcctgc

SEQ ID NO: 4672491 - DNA, 12 bp, Homo sapiens
cgcaagtgcctg

SEQ ID NO: 4672492 - DNA, 20 bp, Homo sapiens
cgcaatctcagctcactgca

SEQ ID NO: 4672493 - DNA, 22 bp, Homo sapiens
cgcaccgcctgaaggcacagct

SEQ ID NO: 4672494 - DNA, 14 bp, Homo sapiens
cgcacctgcctcag

SEQ ID NO: 4672495 - DNA, 15 bp, Homo sapiens
cgcacctgcctcagg

SEQ ID NO: 4672496 - DNA, 16 bp, Homo sapiens
cgcacctgcctcagga

SEQ ID NO: 4672497 - DNA, 12 bp, Homo sapiens
cgcactgcctct

SEQ ID NO: 4672498 - DNA, 11 bp, Homo sapiens
cgcagaagagg

SEQ ID NO: 4672499 - DNA, 13 bp, Homo sapiens
cgcagccaccctg

SEQ ID NO: 4672500 - DNA, 17 bp, Homo sapiens
cgcagccaccctgagga

SEQ ID NO: 4672501 - DNA, 23 bp, Homo sapiens
cgcaggtatttagaagcagaggg

SEQ ID NO: 4672502 - DNA, 22 bp, Homo sapiens
cgcagtggggtcaagctgagct

SEQ ID NO: 4672503 - DNA, 19 bp, Homo sapiens
cgcatgtttaatgtgaact

SEQ ID NO: 4672504 - DNA, 21 bp, Homo sapiens
cgccaatgttatgccagctcc

SEQ ID NO: 4672505 - DNA, 15 bp, Homo sapiens
cgccacgtcccagca

SEQ ID NO: 4672506 - DNA, 15 bp, Homo sapiens
cgccagccacaggac

SEQ ID NO: 4672507 - DNA, 16 bp, Homo sapiens
cgccagccacaggacc

SEQ ID NO: 4672508 - DNA, 17 bp, Homo sapiens
cgccagccacaggacca

SEQ ID NO: 4672509 - DNA, 21 bp, Homo sapiens
cgccaggatggaacacggcca

SEQ ID NO: 4672510 - DNA, 23 bp, Homo sapiens
cgccaggatggaacacggccaca

SEQ ID NO: 4672511 - DNA, 13 bp, Homo sapiens
cgccagggctggg

SEQ ID NO: 4672512 - DNA, 16 bp, Homo sapiens
cgccagggctggggac

SEQ ID NO: 4672513 - DNA, 13 bp, Homo sapiens
cgcccagcctcac

SEQ ID NO: 4672514 - DNA, 21 bp, Homo sapiens
cgcccagcctcacttcctttg

SEQ ID NO: 4672515 - DNA, 22 bp, Homo sapiens
cgccccaacccgtggaggctgc

SEQ ID NO: 4672516 - DNA, 15 bp, Homo sapiens
cgcccctcagagcat

SEQ ID NO: 4672517 - DNA, 13 bp, Homo sapiens
cgcccgctgggga

SEQ ID NO: 4672518 - DNA, 16 bp, Homo sapiens
cgccctgcagaccctg

SEQ ID NO: 4672519 - DNA, 13 bp, Homo sapiens
cgcccttcctctc

SEQ ID NO: 4672520 - DNA, 12 bp, Homo sapiens
cgccgatgccac

SEQ ID NO: 4672521 - DNA, 19 bp, Homo sapiens
cgcctcccaggttcaagca

SEQ ID NO: 4672522 - DNA, 14 bp, Homo sapiens
cgcctgagcccagg

SEQ ID NO: 4672523 - DNA, 18 bp, Homo sapiens
cgcctgagcccagggagg

SEQ ID NO: 4672524 - DNA, 19 bp, Homo sapiens
cgcctgagcccagggaggc

SEQ ID NO: 4672525 - DNA, 14 bp, Homo sapiens
cgcctgagggaaga

SEQ ID NO: 4672526 - DNA, 21 bp, Homo sapiens
cgcctgccaccacgctggcca

SEQ ID NO: 4672527 - DNA, 14 bp, Homo sapiens
cgcgccgatgccac

SEQ ID NO: 4672528 - DNA, 15 bp, Homo sapiens
cgcgtctaccctggg

SEQ ID NO: 4672529 - DNA, 17 bp, Homo sapiens
cgctacaccactctggc

SEQ ID NO: 4672530 - DNA, 16 bp, Homo sapiens
cgctccccactctgct

SEQ ID NO: 4672531 - DNA, 17 bp, Homo sapiens
cgctccccactctgctc

SEQ ID NO: 4672532 - DNA, 19 bp, Homo sapiens
cgctcggacttactgcctg

SEQ ID NO: 4672533 - DNA, 20 bp, Homo sapiens
cgctcggacttactgcctga

SEQ ID NO: 4672534 - DNA, 14 bp, Homo sapiens
cgctggccctgccg

SEQ ID NO: 4672535 - DNA, 20 bp, Homo sapiens
cgcttatcaactaatgattt

SEQ ID NO: 4672536 - DNA, 20 bp, Homo sapiens
cgcttgtagaactcactctg

SEQ ID NO: 4672537 - DNA, 21 bp, Homo sapiens
cgcttgtagaactcactctgg

SEQ ID NO: 4672538 - DNA, 22 bp, Homo sapiens
cgcttgtagaactcactctggg

SEQ ID NO: 4672539 - DNA, 17 bp, Homo sapiens
cggaaagccctgtgctc

SEQ ID NO: 4672540 - DNA, 13 bp, Homo sapiens
cggaaagctcttc

SEQ ID NO: 4672541 - DNA, 15 bp, Homo sapiens
cggacagtggcagga

SEQ ID NO: 4672542 - DNA, 16 bp, Homo sapiens
cggagcaaactctgct

SEQ ID NO: 4672543 - DNA, 14 bp, Homo sapiens
cggagcaagaggag

SEQ ID NO: 4672544 - DNA, 13 bp, Homo sapiens
cggaggaacagat

SEQ ID NO: 4672545 - DNA, 20 bp, Homo sapiens
cggaggcctcgagcagagag

SEQ ID NO: 4672546 - DNA, 14 bp, Homo sapiens
cggaggggatccag

SEQ ID NO: 4672547 - DNA, 18 bp, Homo sapiens
cggaggggatccagccac

SEQ ID NO: 4672548 - DNA, 13 bp, Homo sapiens
cggatcctgctgg

SEQ ID NO: 4672549 - DNA, 14 bp, Homo sapiens
cggatcctgctggg

SEQ ID NO: 4672550 - DNA, 16 bp, Homo sapiens
cggatctgctgggctc

SEQ ID NO: 4672551 - DNA, 15 bp, Homo sapiens
cggatgacaccctgg

SEQ ID NO: 4672552 - DNA, 17 bp, Homo sapiens
cggatgacaccctggcc

SEQ ID NO: 4672553 - DNA, 17 bp, Homo sapiens
cggcaccccctgcagct

SEQ ID NO: 4672554 - DNA, 19 bp, Homo sapiens
cggcacctgggccctgggg

SEQ ID NO: 4672555 - DNA, 20 bp, Homo sapiens
cggcacctgggccctggggc

SEQ ID NO: 4672556 - DNA, 23 bp, Homo sapiens
cggcacctgggccctggggcctg

SEQ ID NO: 4672557 - DNA, 15 bp, Homo sapiens
cggcagcgggcggag

SEQ ID NO: 4672558 - DNA, 14 bp, Homo sapiens
cggccaaggtgcca

SEQ ID NO: 4672559 - DNA, 20 bp, Homo sapiens
cggccaaggtgccaccaccc

SEQ ID NO: 4672560 - DNA, 22 bp, Homo sapiens
cggccagcccctggccccagga

SEQ ID NO: 4672561 - DNA, 22 bp, Homo sapiens
cggccatctctttgtacaggaa

SEQ ID NO: 4672562 - DNA, 15 bp, Homo sapiens
cggcccgcgcagctg

SEQ ID NO: 4672563 - DNA, 18 bp, Homo sapiens
cggcccgcgcagctgcct

SEQ ID NO: 4672564 - DNA, 14 bp, Homo sapiens
cggccggccagccc

SEQ ID NO: 4672565 - DNA, 18 bp, Homo sapiens
cggcctatgacttgggca

SEQ ID NO: 4672566 - DNA, 12 bp, Homo sapiens
cggcctgtcctc

SEQ ID NO: 4672567 - DNA, 15 bp, Homo sapiens
cggcctgtcctccaa

SEQ ID NO: 4672568 - DNA, 20 bp, Homo sapiens
cggctcagtgcaacctctgc

SEQ ID NO: 4672569 - DNA, 21 bp, Homo sapiens
cggctcccacggagcatctca

SEQ ID NO: 4672570 - DNA, 19 bp, Homo sapiens
cggctcgtgtatttattac

SEQ ID NO: 4672571 - DNA, 20 bp, Homo sapiens
cggctggaaatgctgggctg

SEQ ID NO: 4672572 - DNA, 22 bp, Homo sapiens
cggctggcatggtggctcccgc

SEQ ID NO: 4672573 - DNA, 18 bp, Homo sapiens
cggcttctcgacccacgc

SEQ ID NO: 4672574 - DNA, 15 bp, Homo sapiens
cggcttggcttggct

SEQ ID NO: 4672575 - DNA, 17 bp, Homo sapiens
cgggagcctccctgcct

SEQ ID NO: 4672576 - DNA, 19 bp, Homo sapiens
cgggagcctccctgcctca

SEQ ID NO: 4672577 - DNA, 10 bp, Homo sapiens
cgggagggga

SEQ ID NO: 4672578 - DNA, 23 bp, Homo sapiens
cgggcaggggagggtcagccagg

SEQ ID NO: 4672579 - DNA, 21 bp, Homo sapiens
cgggcctgctgtcacctcgct

SEQ ID NO: 4672580 - DNA, 16 bp, Homo sapiens
cgggcgcactgcctct

SEQ ID NO: 4672581 - DNA, 17 bp, Homo sapiens
cgggcgcactgcctctc

SEQ ID NO: 4672582 - DNA, 18 bp, Homo sapiens
cgggcgcactgcctctca

SEQ ID NO: 4672583 - DNA, 13 bp, Homo sapiens
cgggcggagggag

SEQ ID NO: 4672584 - DNA, 22 bp, Homo sapiens
cgggcggaggggatccagccac

SEQ ID NO: 4672585 - DNA, 15 bp, Homo sapiens
cgggctggagaaaga

SEQ ID NO: 4672586 - DNA, 14 bp, Homo sapiens
cgggcttgcggtgg

SEQ ID NO: 4672587 - DNA, 13 bp, Homo sapiens
cggggcctgtctc

SEQ ID NO: 4672588 - DNA, 17 bp, Homo sapiens
cggggtgcacaggaggg

SEQ ID NO: 4672589 - DNA, 14 bp, Homo sapiens
cgggtgcaagcact

SEQ ID NO: 4672590 - DNA, 15 bp, Homo sapiens
cgggttctaccccta

SEQ ID NO: 4672591 - DNA, 15 bp, Homo sapiens
cggtagccagcacac

SEQ ID NO: 4672592 - DNA, 13 bp, Homo sapiens
cggtccctgtccc

SEQ ID NO: 4672593 - DNA, 19 bp, Homo sapiens
cggtctggcagggcagcag

SEQ ID NO: 4672594 - DNA, 13 bp, Homo sapiens
cggtgcagtctgg

SEQ ID NO: 4672595 - DNA, 15 bp, Homo sapiens
cggtgggctagaaag

SEQ ID NO: 4672596 - DNA, 21 bp, Homo sapiens
cggttcccacaagcctgcctc

SEQ ID NO: 4672597 - DNA, 21 bp, Homo sapiens
cggttcctcgttctccctggg

SEQ ID NO: 4672598 - DNA, 16 bp, Homo sapiens
cgtaagaccaccttcc

SEQ ID NO: 4672599 - DNA, 22 bp, Homo sapiens
cgtaagaccaccttcccttcct

SEQ ID NO: 4672600 - DNA, 23 bp, Homo sapiens
ctacactcttgtaataaaatgtc

SEQ ID NO: 4672601 - DNA, 23 bp, Homo sapiens
ctacagatggcatacctgtgcct

SEQ ID NO: 4672602 - DNA, 19 bp, Homo sapiens
ctacagcactactgggtgt

SEQ ID NO: 4672603 - DNA, 20 bp, Homo sapiens
ctacagcactactgggtgtc

SEQ ID NO: 4672604 - DNA, 21 bp, Homo sapiens
ctacagcactactgggtgtca

SEQ ID NO: 4672605 - DNA, 12 bp, Homo sapiens
ctacaggcctgc

SEQ ID NO: 4672606 - DNA, 18 bp, Homo sapiens
ctacagtgccaactcctc

SEQ ID NO: 4672607 - DNA, 23 bp, Homo sapiens
ctacagttgtgataatagcattt

SEQ ID NO: 4672608 - DNA, 20 bp, Homo sapiens
ctacagtttttatttagcat

SEQ ID NO: 4672609 - DNA, 20 bp, Homo sapiens
ctacccattgttcccttcct

SEQ ID NO: 4672610 - DNA, 15 bp, Homo sapiens
ctacccgcagagttc

SEQ ID NO: 4672611 - DNA, 22 bp, Homo sapiens
ctaccggacactcgtcacccca

SEQ ID NO: 4672612 - DNA, 11 bp, Homo sapiens
ctacctgtgtg

SEQ ID NO: 4672613 - DNA, 16 bp, Homo sapiens
ctacgcactggacagc

SEQ ID NO: 4672614 - DNA, 22 bp, Homo sapiens
ctacgtgtgaaatctgtctttg

SEQ ID NO: 4672615 - DNA, 14 bp, Homo sapiens
ctactcacacaggc

SEQ ID NO: 4672616 - DNA, 15 bp, Homo sapiens
ctactcacacaggca

SEQ ID NO: 4672617 - DNA, 17 bp, Homo sapiens
ctactccctggaccacg

SEQ ID NO: 4672618 - DNA, 19 bp, Homo sapiens
ctactccctggaccacgag

SEQ ID NO: 4672619 - DNA, 20 bp, Homo sapiens
ctactctagatggcaacatt

SEQ ID NO: 4672620 - DNA, 16 bp, Homo sapiens
ctactgattgtttcat

SEQ ID NO: 4672621 - DNA, 17 bp, Homo sapiens
ctactgattgtttcatt

SEQ ID NO: 4672622 - DNA, 22 bp, Homo sapiens
ctactgcagcacctccaggcct

SEQ ID NO: 4672623 - DNA, 19 bp, Homo sapiens
ctactgggtgtcatttcat

SEQ ID NO: 4672624 - DNA, 23 bp, Homo sapiens
ctactgggtgtcatttcattcca

SEQ ID NO: 4672625 - DNA, 16 bp, Homo sapiens
ctacttaatgcacagt

SEQ ID NO: 4672626 - DNA, 12 bp, Homo sapiens
ctactttaaatc

SEQ ID NO: 4672627 - DNA, 22 bp, Homo sapiens
ctactttaaatcctaccaaagt

SEQ ID NO: 4672628 - DNA, 20 bp, Homo sapiens
ctactttgttaggattttca

SEQ ID NO: 4672629 - DNA, 14 bp, Homo sapiens
ctagaaaaataaaa

SEQ ID NO: 4672630 - DNA, 16 bp, Homo sapiens
ctagaaaacatttttt

SEQ ID NO: 4672631 - DNA, 13 bp, Homo sapiens
ctagaaatttttc

SEQ ID NO: 4672632 - DNA, 23 bp, Homo sapiens
ctagaaatttttcagatgcttct

SEQ ID NO: 4672633 - DNA, 19 bp, Homo sapiens
ctagacaatgatttggcca

SEQ ID NO: 4672634 - DNA, 21 bp, Homo sapiens
ctagacatcattgtcagcctt

SEQ ID NO: 4672635 - DNA, 17 bp, Homo sapiens
ctagaccagggctgctc

SEQ ID NO: 4672636 - DNA, 19 bp, Homo sapiens
ctagaccagggctgctctt

SEQ ID NO: 4672637 - DNA, 16 bp, Homo sapiens
ctagacgcaccgcctg

SEQ ID NO: 4672638 - DNA, 13 bp, Homo sapiens
ctagagctctaat

SEQ ID NO: 4672639 - DNA, 13 bp, Homo sapiens
ctagagggcccaa

SEQ ID NO: 4672640 - DNA, 17 bp, Homo sapiens
ctagagggcccaaagct

SEQ ID NO: 4672641 - DNA, 15 bp, Homo sapiens
ctagagtgtagccta

SEQ ID NO: 4672642 - DNA, 16 bp, Homo sapiens
ctagagtgtagcctaa

SEQ ID NO: 4672643 - DNA, 23 bp, Homo sapiens
ctagagtgtagcctaaagggcag

SEQ ID NO: 4672644 - DNA, 22 bp, Homo sapiens
ctagatacaggactggttcctt

SEQ ID NO: 4672645 - DNA, 22 bp, Homo sapiens
ctagcagcaccgttctgtgcac

SEQ ID NO: 4672646 - DNA, 22 bp, Homo sapiens
ctagcaggcaatgctgtacttt

SEQ ID NO: 4672647 - DNA, 17 bp, Homo sapiens
ctagccaggtctcctgg

SEQ ID NO: 4672648 - DNA, 20 bp, Homo sapiens
ctagccaggtctcctgggaa

SEQ ID NO: 4672649 - DNA, 16 bp, Homo sapiens
ctagccccagcgccaa

SEQ ID NO: 4672650 - DNA, 20 bp, Homo sapiens
ctagctacttggcaggctga

SEQ ID NO: 4672651 - DNA, 16 bp, Homo sapiens
ctagctctctaggcct

SEQ ID NO: 4672652 - DNA, 14 bp, Homo sapiens
ctagctggctctgt

SEQ ID NO: 4672653 - DNA, 16 bp, Homo sapiens
ctaggaatggaggagc

SEQ ID NO: 4672654 - DNA, 15 bp, Homo sapiens
ctaggagcaaagcct

SEQ ID NO: 4672655 - DNA, 16 bp, Homo sapiens
ctaggagcaaagcctg

SEQ ID NO: 4672656 - DNA, 18 bp, Homo sapiens
ctaggagcaaagcctgtt

SEQ ID NO: 4672657 - DNA, 14 bp, Homo sapiens
ctaggatactgctg

SEQ ID NO: 4672658 - DNA, 17 bp, Homo sapiens
ctaggatgttctgggct

SEQ ID NO: 4672659 - DNA, 15 bp, Homo sapiens
ctaggcaggacctgt

SEQ ID NO: 4672660 - DNA, 21 bp, Homo sapiens
ctaggccaccccaacctctgt

SEQ ID NO: 4672661 - DNA, 19 bp, Homo sapiens
ctaggccccagaggccctg

SEQ ID NO: 4672662 - DNA, 22 bp, Homo sapiens
ctaggccccagaggccctggag

SEQ ID NO: 4672663 - DNA, 16 bp, Homo sapiens
ctaggcctctccagtt

SEQ ID NO: 4672664 - DNA, 22 bp, Homo sapiens
ctaggctgctgcacaccaaggc

SEQ ID NO: 4672665 - DNA, 21 bp, Homo sapiens
ctaggcttaatacctgggtga

SEQ ID NO: 4672666 - DNA, 16 bp, Homo sapiens
ctaggggcttggtcct

SEQ ID NO: 4672667 - DNA, 23 bp, Homo sapiens
ctagggggagccccttctgctca

SEQ ID NO: 4672668 - DNA, 20 bp, Homo sapiens
ctagggtgggaaggggctag

SEQ ID NO: 4672669 - DNA, 14 bp, Homo sapiens
ctaggtcctggctg

SEQ ID NO: 4672670 - DNA, 18 bp, Homo sapiens
ctaggttatacaataacc

SEQ ID NO: 4672671 - DNA, 14 bp, Homo sapiens
ctagtaaaaccttg

SEQ ID NO: 4672672 - DNA, 20 bp, Homo sapiens
ctagtaaaaccttgttctat

SEQ ID NO: 4672673 - DNA, 14 bp, Homo sapiens
ctagtaaccaaggc

SEQ ID NO: 4672674 - DNA, 17 bp, Homo sapiens
ctagtaaccaaggccct

SEQ ID NO: 4672675 - DNA, 15 bp, Homo sapiens
ctagtacacttttat

SEQ ID NO: 4672676 - DNA, 16 bp, Homo sapiens
ctagtgacccacatgc

SEQ ID NO: 4672677 - DNA, 22 bp, Homo sapiens
ctagttctttcctccccctgca

SEQ ID NO: 4672678 - DNA, 12 bp, Homo sapiens
ctagtttattct

SEQ ID NO: 4672679 - DNA, 23 bp, Homo sapiens
ctagtttgaacaggatatgttca

SEQ ID NO: 4672680 - DNA, 22 bp, Homo sapiens
ctagttttactttgaactttca

SEQ ID NO: 4672681 - DNA, 17 bp, Homo sapiens
ctataatcttatacaac

SEQ ID NO: 4672682 - DNA, 19 bp, Homo sapiens
ctatagaaaaagtaaaaga

SEQ ID NO: 4672683 - DNA, 22 bp, Homo sapiens
ctatagttgcagcccaaggaca

SEQ ID NO: 4672684 - DNA, 18 bp, Homo sapiens
ctatatagaatgctgcac

SEQ ID NO: 4672685 - DNA, 12 bp, Homo sapiens
ctatatatggta

SEQ ID NO: 4672686 - DNA, 12 bp, Homo sapiens
ctatatatttct

SEQ ID NO: 4672687 - DNA, 13 bp, Homo sapiens
ctatatatttcta

SEQ ID NO: 4672688 - DNA, 15 bp, Homo sapiens
ctatattagctgaaa

SEQ ID NO: 4672689 - DNA, 17 bp, Homo sapiens
ctatattagctgaaaca

SEQ ID NO: 4672690 - DNA, 19 bp, Homo sapiens
ctatcaacaataaaatttt

SEQ ID NO: 4672691 - DNA, 19 bp, Homo sapiens
ctatcaccagtgcatcaca

SEQ ID NO: 4672692 - DNA, 19 bp, Homo sapiens
ctatcacctagcagcctca

SEQ ID NO: 4672693 - DNA, 13 bp, Homo sapiens
ctatcactgcatt

SEQ ID NO: 4672694 - DNA, 22 bp, Homo sapiens
ctatcactgcattatcttgctc

SEQ ID NO: 4672695 - DNA, 23 bp, Homo sapiens
ctatcactgcattatcttgctca

SEQ ID NO: 4672696 - DNA, 19 bp, Homo sapiens
ctatcagcagctagaaaac

SEQ ID NO: 4672697 - DNA, 12 bp, Homo sapiens
ctatcctgggac

SEQ ID NO: 4672698 - DNA, 13 bp, Homo sapiens
ctatcctgggacc

SEQ ID NO: 4672699 - DNA, 14 bp, Homo sapiens
ctatgacaaattca

SEQ ID NO: 4672700 - DNA, 13 bp, Homo sapiens
ctatgaggaaagg

SEQ ID NO: 4672701 - DNA, 19 bp, Homo sapiens
ctatgatccttttttgtca

SEQ ID NO: 4672702 - DNA, 17 bp, Homo sapiens
ctatgatggatggcaga

SEQ ID NO: 4672703 - DNA, 22 bp, Homo sapiens
ctatgatggatggcagactctt

SEQ ID NO: 4672704 - DNA, 16 bp, Homo sapiens
ctatgatgttgctgtt

SEQ ID NO: 4672705 - DNA, 23 bp, Homo sapiens
ctatgatgttgctgttcacagct

SEQ ID NO: 4672706 - DNA, 20 bp, Homo sapiens
ctatgcacatatggactctg

SEQ ID NO: 4672707 - DNA, 19 bp, Homo sapiens
ctatgcggaggaaagcaag

SEQ ID NO: 4672708 - DNA, 23 bp, Homo sapiens
ctatgcggaggaaagcaagtgtt

SEQ ID NO: 4672709 - DNA, 20 bp, Homo sapiens
cacttaatcttctctcttga

SEQ ID NO: 4672710 - DNA, 15 bp, Homo sapiens
cacttaatttgtaaa

SEQ ID NO: 4672711 - DNA, 21 bp, Homo sapiens
cacttaatttgtaaacttctg

SEQ ID NO: 4672712 - DNA, 17 bp, Homo sapiens
cacttagacctgccagc

SEQ ID NO: 4672713 - DNA, 23 bp, Homo sapiens
cacttagcaggcaccgccacgtc

SEQ ID NO: 4672714 - DNA, 19 bp, Homo sapiens
cacttatcattagaatctt

SEQ ID NO: 4672715 - DNA, 16 bp, Homo sapiens
cacttatccctctcca

SEQ ID NO: 4672716 - DNA, 14 bp, Homo sapiens
cacttatctcactg

SEQ ID NO: 4672717 - DNA, 16 bp, Homo sapiens
cacttatctcgaattt

SEQ ID NO: 4672718 - DNA, 21 bp, Homo sapiens
cacttccacctccagcctctg

SEQ ID NO: 4672719 - DNA, 20 bp, Homo sapiens
cacttccccaagatctgcca

SEQ ID NO: 4672720 - DNA, 21 bp, Homo sapiens
cacttccccaagatctgccag

SEQ ID NO: 4672721 - DNA, 14 bp, Homo sapiens
cacttccccctctt

SEQ ID NO: 4672722 - DNA, 13 bp, Homo sapiens
cacttctcaggac

SEQ ID NO: 4672723 - DNA, 23 bp, Homo sapiens
cacttctcaggacacaggcctgt

SEQ ID NO: 4672724 - DNA, 20 bp, Homo sapiens
cacttcttcacctcttccac

SEQ ID NO: 4672725 - DNA, 12 bp, Homo sapiens
cacttgagctgt

SEQ ID NO: 4672726 - DNA, 15 bp, Homo sapiens
cacttgagctgtctg

SEQ ID NO: 4672727 - DNA, 21 bp, Homo sapiens
cacttgccctgtgttctttcc

SEQ ID NO: 4672728 - DNA, 22 bp, Homo sapiens
cacttgtcccactatctgggtg

SEQ ID NO: 4672729 - DNA, 12 bp, Homo sapiens
cacttgtcccca

SEQ ID NO: 4672730 - DNA, 23 bp, Homo sapiens
cacttgtccccaaatccgaacct

SEQ ID NO: 4672731 - DNA, 17 bp, Homo sapiens
cactttccaatgccaca

SEQ ID NO: 4672732 - DNA, 20 bp, Homo sapiens
cactttccaatgccacagac

SEQ ID NO: 4672733 - DNA, 22 bp, Homo sapiens
cactttccccgtgggccatggc

SEQ ID NO: 4672734 - DNA, 20 bp, Homo sapiens
cactttcctttcaataaagt

SEQ ID NO: 4672735 - DNA, 22 bp, Homo sapiens
cactttcctttcaataaagttg

SEQ ID NO: 4672736 - DNA, 17 bp, Homo sapiens
cacttttagaaatgcat

SEQ ID NO: 4672737 - DNA, 19 bp, Homo sapiens
cacttttgttctactcctt

SEQ ID NO: 4672738 - DNA, 16 bp, Homo sapiens
cactttttacagcagc

SEQ ID NO: 4672739 - DNA, 20 bp, Homo sapiens
cagaaaacctgttcaggcag

SEQ ID NO: 4672740 - DNA, 18 bp, Homo sapiens
cagaaaactaaaaaggaa

SEQ ID NO: 4672741 - DNA, 21 bp, Homo sapiens
cagaaaactaaaaaggaagaa

SEQ ID NO: 4672742 - DNA, 19 bp, Homo sapiens
cagaaaagtaattttgtca

SEQ ID NO: 4672743 - DNA, 20 bp, Homo sapiens
cagaaaagtaattttgtcac

SEQ ID NO: 4672744 - DNA, 22 bp, Homo sapiens
cagaaagaattgatcagaatcc

SEQ ID NO: 4672745 - DNA, 17 bp, Homo sapiens
cagaaagaccctgatgc

SEQ ID NO: 4672746 - DNA, 20 bp, Homo sapiens
cagaaagatttgatgggcca

SEQ ID NO: 4672747 - DNA, 16 bp, Homo sapiens
cagaaagccaggagca

SEQ ID NO: 4672748 - DNA, 18 bp, Homo sapiens
cagaaagccaggagcagc

SEQ ID NO: 4672749 - DNA, 17 bp, Homo sapiens
cagaaagggagggctct

SEQ ID NO: 4672750 - DNA, 18 bp, Homo sapiens
cagaaagtcccccctcgc

SEQ ID NO: 4672751 - DNA, 15 bp, Homo sapiens
cagaaatagttgtct

SEQ ID NO: 4672752 - DNA, 20 bp, Homo sapiens
cagaaatagttgtctgtgct

SEQ ID NO: 4672753 - DNA, 23 bp, Homo sapiens
cagaacaggaggtgtgaatgcac

SEQ ID NO: 4672754 - DNA, 20 bp, Homo sapiens
cagaacattcagctctggag

SEQ ID NO: 4672755 - DNA, 22 bp, Homo sapiens
cagaacattcagctctggagaa

SEQ ID NO: 4672756 - DNA, 21 bp, Homo sapiens
cagaaccttgttatttctcag

SEQ ID NO: 4672757 - DNA, 18 bp, Homo sapiens
cagaacgtggctctgctg

SEQ ID NO: 4672758 - DNA, 15 bp, Homo sapiens
cagaactggaggcag

SEQ ID NO: 4672759 - DNA, 23 bp, Homo sapiens
cagaactggaggcagtccatcta

SEQ ID NO: 4672760 - DNA, 18 bp, Homo sapiens
cagaagacgggaggggag

SEQ ID NO: 4672761 - DNA, 19 bp, Homo sapiens
cagaagacgggaggggagg

SEQ ID NO: 4672762 - DNA, 21 bp, Homo sapiens
cagaagacgggaggggaggca

SEQ ID NO: 4672763 - DNA, 22 bp, Homo sapiens
cagaagaggggcagctttttca

SEQ ID NO: 4672764 - DNA, 18 bp, Homo sapiens
cagaagcctgatgctgac

SEQ ID NO: 4672765 - DNA, 13 bp, Homo sapiens
cagaagcctgggg

SEQ ID NO: 4672766 - DNA, 15 bp, Homo sapiens
cagaagcctgtttca

SEQ ID NO: 4672767 - DNA, 16 bp, Homo sapiens
cagaagcttggaggag

SEQ ID NO: 4672768 - DNA, 18 bp, Homo sapiens
cagaagcttggaggaggg

SEQ ID NO: 4672769 - DNA, 23 bp, Homo sapiens
cagaaggaaagaagggggccctg

SEQ ID NO: 4672770 - DNA, 11 bp, Homo sapiens
cagaaggccct

SEQ ID NO: 4672771 - DNA, 19 bp, Homo sapiens
cagaagggacttcacgaag

SEQ ID NO: 4672772 - DNA, 14 bp, Homo sapiens
cagaagtctcctca

SEQ ID NO: 4672773 - DNA, 12 bp, Homo sapiens
cagatgcttctg

SEQ ID NO: 4672774 - DNA, 13 bp, Homo sapiens
cagatgcttctgg

SEQ ID NO: 4672775 - DNA, 18 bp, Homo sapiens
cagatggctttcagggca

SEQ ID NO: 4672776 - DNA, 22 bp, Homo sapiens
cagatgtttgttttcaaaatac

SEQ ID NO: 4672777 - DNA, 18 bp, Homo sapiens
cagattcctatgatggat

SEQ ID NO: 4672778 - DNA, 21 bp, Homo sapiens
cagattgcatgtgactctgaa

SEQ ID NO: 4672779 - DNA, 14 bp, Homo sapiens
cagatttgtctttt

SEQ ID NO: 4672780 - DNA, 16 bp, Homo sapiens
cagatttttttgtaag

SEQ ID NO: 4672781 - DNA, 16 bp, Homo sapiens
cagcaacatcccatct

SEQ ID NO: 4672782 - DNA, 17 bp, Homo sapiens
cagcaacgcttgtagaa

SEQ ID NO: 4672783 - DNA, 12 bp, Homo sapiens
cagcaagaagct

SEQ ID NO: 4672784 - DNA, 13 bp, Homo sapiens
cagcaagacctca

SEQ ID NO: 4672785 - DNA, 23 bp, Homo sapiens
cagcaagacctcatctgtggagc

SEQ ID NO: 4672786 - DNA, 21 bp, Homo sapiens
cagcaagagggaacaaaactg

SEQ ID NO: 4672787 - DNA, 23 bp, Homo sapiens
cagcaagagggaacaaaactgtt

SEQ ID NO: 4672788 - DNA, 14 bp, Homo sapiens
cagcaaggcccgag

SEQ ID NO: 4672789 - DNA, 19 bp, Homo sapiens
cagcaaggcccgagcagct

SEQ ID NO: 4672790 - DNA, 21 bp, Homo sapiens
cagcaaggcccgagcagctga

SEQ ID NO: 4672791 - DNA, 23 bp, Homo sapiens
cagcaaggcccgagcagctgagc

SEQ ID NO: 4672792 - DNA, 20 bp, Homo sapiens
cagcaagtgtttgtgggaca

SEQ ID NO: 4672793 - DNA, 13 bp, Homo sapiens
cagcacacaggca

SEQ ID NO: 4672794 - DNA, 22 bp, Homo sapiens
cagcacacaggcagccagccgt

SEQ ID NO: 4672795 - DNA, 14 bp, Homo sapiens
cagcacacagggca

SEQ ID NO: 4672796 - DNA, 18 bp, Homo sapiens
cagcacacagggcagtga

SEQ ID NO: 4672797 - DNA, 14 bp, Homo sapiens
cagcacatattttc

SEQ ID NO: 4672798 - DNA, 17 bp, Homo sapiens
cagcaccgttctgtgca

SEQ ID NO: 4672799 - DNA, 20 bp, Homo sapiens
cagcacctacagtgtacagt

SEQ ID NO: 4672800 - DNA, 14 bp, Homo sapiens
cagcacctccaggc

SEQ ID NO: 4672801 - DNA, 16 bp, Homo sapiens
cagcacctccaggcct

SEQ ID NO: 4672802 - DNA, 16 bp, Homo sapiens
cagcacgtggttttat

SEQ ID NO: 4672803 - DNA, 22 bp, Homo sapiens
cagcactccccagagctgtgcc

SEQ ID NO: 4672804 - DNA, 23 bp, Homo sapiens
cagcactccccagagctgtgcca

SEQ ID NO: 4672805 - DNA, 17 bp, Homo sapiens
cagcacttagacctgcc

SEQ ID NO: 4672806 - DNA, 17 bp, Homo sapiens
cagcacttgtccagctg

SEQ ID NO: 4672807 - DNA, 19 bp, Homo sapiens
cagcagcacttagacctgc

SEQ ID NO: 4672808 - DNA, 15 bp, Homo sapiens
cagcagccagccctg

SEQ ID NO: 4672809 - DNA, 16 bp, Homo sapiens
cagcagccagccctgc

SEQ ID NO: 4672810 - DNA, 17 bp, Homo sapiens
cagcagccagccctgcc

SEQ ID NO: 4672811 - DNA, 20 bp, Homo sapiens
cagcagcctggggctggcct

SEQ ID NO: 4672812 - DNA, 16 bp, Homo sapiens
cagcaggaataaagac

SEQ ID NO: 4672813 - DNA, 14 bp, Homo sapiens
cagcaggaggcttt

SEQ ID NO: 4672814 - DNA, 22 bp, Homo sapiens
cagcaggaggctttctgggctc

SEQ ID NO: 4672815 - DNA, 23 bp, Homo sapiens
cagcaggaggctttctgggctct

SEQ ID NO: 4672816 - DNA, 16 bp, Homo sapiens
cagcaggagtggtgca

SEQ ID NO: 4672817 - DNA, 22 bp, Homo sapiens
cagcaggagtggtgcagacaga

SEQ ID NO: 4672818 - DNA, 15 bp, Homo sapiens
cagcaggcagcgcca

SEQ ID NO: 4672819 - DNA, 15 bp, Homo sapiens
cagcaggccaaacat

SEQ ID NO: 4672820 - DNA, 17 bp, Homo sapiens
cagcaggctagacagaa

SEQ ID NO: 4672821 - DNA, 14 bp, Homo sapiens
cagcaggctggcct

SEQ ID NO: 4672822 - DNA, 18 bp, Homo sapiens
cagcaggggggctgtgcc

SEQ ID NO: 4672823 - DNA, 12 bp, Homo sapiens
cagcagttgagg

SEQ ID NO: 4672824 - DNA, 13 bp, Homo sapiens
cagcatccctgga

SEQ ID NO: 4672825 - DNA, 15 bp, Homo sapiens
cagcatccctggagc

SEQ ID NO: 4672826 - DNA, 15 bp, Homo sapiens
cagcatctcccagca

SEQ ID NO: 4672827 - DNA, 14 bp, Homo sapiens
cagcatgcttgggc

SEQ ID NO: 4672828 - DNA, 23 bp, Homo sapiens
cagcatgcttgggctgacccagc

SEQ ID NO: 4672829 - DNA, 14 bp, Homo sapiens
cagcattgaagtat

SEQ ID NO: 4672830 - DNA, 22 bp, Homo sapiens
cagcattgccataccattccca

SEQ ID NO: 4672831 - DNA, 12 bp, Homo sapiens
cagcattgcttt

SEQ ID NO: 4672832 - DNA, 14 bp, Homo sapiens
cagcattgctttct

SEQ ID NO: 4672833 - DNA, 20 bp, Homo sapiens
cagcattttttatcaggcag

SEQ ID NO: 4672834 - DNA, 19 bp, Homo sapiens
cagccaacacgcacctgcc

SEQ ID NO: 4672835 - DNA, 20 bp, Homo sapiens
cagccaagattttcctcttg

SEQ ID NO: 4672836 - DNA, 22 bp, Homo sapiens
cagccaagattttcctcttgtg

SEQ ID NO: 4672837 - DNA, 20 bp, Homo sapiens
cagccaagtgccaaatgctc

SEQ ID NO: 4672838 - DNA, 18 bp, Homo sapiens
cagccacacttctcagga

SEQ ID NO: 4672839 - DNA, 21 bp, Homo sapiens
cagccacacttctcaggacac

SEQ ID NO: 4672840 - DNA, 14 bp, Homo sapiens
cagccacacttgaa

SEQ ID NO: 4672841 - DNA, 17 bp, Homo sapiens
cagccacagacccctgg

SEQ ID NO: 4672842 - DNA, 14 bp, Homo sapiens
cagccacaggacca

SEQ ID NO: 4672843 - DNA, 17 bp, Homo sapiens
cagccacaggaccacct

SEQ ID NO: 4672844 - DNA, 18 bp, Homo sapiens
cagccacaggaccacctc

SEQ ID NO: 4672845 - DNA, 19 bp, Homo sapiens
cagccacaggaccacctcc

SEQ ID NO: 4672846 - DNA, 15 bp, Homo sapiens
cagccaccctgagga

SEQ ID NO: 4672847 - DNA, 19 bp, Homo sapiens
cagccaccctgaggagtct

SEQ ID NO: 4672848 - DNA, 20 bp, Homo sapiens
cagccaccctgaggagtctg

SEQ ID NO: 4672849 - DNA, 18 bp, Homo sapiens
cagccacgaggtgcaaca

SEQ ID NO: 4672850 - DNA, 18 bp, Homo sapiens
cagccacttccccctctt

SEQ ID NO: 4672851 - DNA, 21 bp, Homo sapiens
cagccagaacgtggctctgct

SEQ ID NO: 4672852 - DNA, 22 bp, Homo sapiens
cagccagaacgtggctctgctg

SEQ ID NO: 4672853 - DNA, 16 bp, Homo sapiens
cagccagaccagcagg

SEQ ID NO: 4672854 - DNA, 20 bp, Homo sapiens
cagccagccctgcctggagg

SEQ ID NO: 4672855 - DNA, 23 bp, Homo sapiens
cagccaggtagttggaactttct

SEQ ID NO: 4672856 - DNA, 16 bp, Homo sapiens
cagcccagcacaggta

SEQ ID NO: 4672857 - DNA, 20 bp, Homo sapiens
cagcccaggatactggcaca

SEQ ID NO: 4672858 - DNA, 12 bp, Homo sapiens
cagcccatccat

SEQ ID NO: 4672859 - DNA, 18 bp, Homo sapiens
cagcccatccattaggcc

SEQ ID NO: 4672860 - DNA, 21 bp, Homo sapiens
cagcccatccattaggccagc

SEQ ID NO: 4672861 - DNA, 20 bp, Homo sapiens
cagcccatggaggcagatgc

SEQ ID NO: 4672862 - DNA, 19 bp, Homo sapiens
cagcccattgctgccaagg

SEQ ID NO: 4672863 - DNA, 15 bp, Homo sapiens
cagccccacccttgt

SEQ ID NO: 4672864 - DNA, 14 bp, Homo sapiens
cagcccccaccagg

SEQ ID NO: 4672865 - DNA, 13 bp, Homo sapiens
cagccccctccct

SEQ ID NO: 4672866 - DNA, 14 bp, Homo sapiens
cagccccctcctgg

SEQ ID NO: 4672867 - DNA, 15 bp, Homo sapiens
cagccccgacttcct

SEQ ID NO: 4672868 - DNA, 16 bp, Homo sapiens
cagccccgacttcctg

SEQ ID NO: 4672869 - DNA, 17 bp, Homo sapiens
cagccccgacttcctga

SEQ ID NO: 4672870 - DNA, 13 bp, Homo sapiens
cagcccctggccc

SEQ ID NO: 4672871 - DNA, 21 bp, Homo sapiens
cagcccctggccccaggacct

SEQ ID NO: 4672872 - DNA, 13 bp, Homo sapiens
cagcccctgtccc

SEQ ID NO: 4672873 - DNA, 18 bp, Homo sapiens
cagcccctgttttctgct

SEQ ID NO: 4672874 - DNA, 20 bp, Homo sapiens
cagccccttcccctgggaac

SEQ ID NO: 4672875 - DNA, 21 bp, Homo sapiens
cagcccgacagtgccatcccc

SEQ ID NO: 4672876 - DNA, 14 bp, Homo sapiens
cagccctcagactg

SEQ ID NO: 4672877 - DNA, 19 bp, Homo sapiens
cagccctcgcctctgcgag

SEQ ID NO: 4672878 - DNA, 16 bp, Homo sapiens
cagccctgcctggagg

SEQ ID NO: 4672879 - DNA, 22 bp, Homo sapiens
cagccctggcccccatcagccc

SEQ ID NO: 4672880 - DNA, 17 bp, Homo sapiens
cagccctggcccctcca

SEQ ID NO: 4672881 - DNA, 15 bp, Homo sapiens
cagccggggcgagtg

SEQ ID NO: 4672882 - DNA, 23 bp, Homo sapiens
cagcctaccgctggccctgccgt

SEQ ID NO: 4672883 - DNA, 16 bp, Homo sapiens
caggacctggctgcca

SEQ ID NO: 4672884 - DNA, 22 bp, Homo sapiens
caggactaacactcagaagcct

SEQ ID NO: 4672885 - DNA, 23 bp, Homo sapiens
caggactaacactcagaagcctg

SEQ ID NO: 4672886 - DNA, 14 bp, Homo sapiens
caggagaagaaaga

SEQ ID NO: 4672887 - DNA, 21 bp, Homo sapiens
caggagaagaacaagaaatgg

SEQ ID NO: 4672888 - DNA, 20 bp, Homo sapiens
caggagagaaaactgcctga

SEQ ID NO: 4672889 - DNA, 15 bp, Homo sapiens
caggagagagccagg

SEQ ID NO: 4672890 - DNA, 18 bp, Homo sapiens
caggagatggagggcttg

SEQ ID NO: 4672891 - DNA, 14 bp, Homo sapiens
caggagcagccctg

SEQ ID NO: 4672892 - DNA, 17 bp, Homo sapiens
caggagcagccctggcc

SEQ ID NO: 4672893 - DNA, 15 bp, Homo sapiens
caggagccccgccac

SEQ ID NO: 4672894 - DNA, 22 bp, Homo sapiens
caggagctacctgtgtggacag

SEQ ID NO: 4672895 - DNA, 15 bp, Homo sapiens
caggagctactgaga

SEQ ID NO: 4672896 - DNA, 17 bp, Homo sapiens
caggagctactgagaac

SEQ ID NO: 4672897 - DNA, 15 bp, Homo sapiens
caggagcttcttcgt

SEQ ID NO: 4672898 - DNA, 19 bp, Homo sapiens
caggagcttcttcgttcct

SEQ ID NO: 4672899 - DNA, 19 bp, Homo sapiens
caggaggctttctgggctc

SEQ ID NO: 4672900 - DNA, 24 bp, Homo sapiens
caggagggacaaaggagcctgtga

SEQ ID NO: 4672901 - DNA, 18 bp, Homo sapiens
caggagggggtcgtggag

SEQ ID NO: 4672902 - DNA, 21 bp, Homo sapiens
caggagggggtcgtggagagc

SEQ ID NO: 4672903 - DNA, 16 bp, Homo sapiens
caggaggtgcagtgga

SEQ ID NO: 4672904 - DNA, 20 bp, Homo sapiens
caggaggtgcagtggagggg

SEQ ID NO: 4672905 - DNA, 13 bp, Homo sapiens
caggagtagctga

SEQ ID NO: 4672906 - DNA, 15 bp, Homo sapiens
caggagtagctgagc

SEQ ID NO: 4672907 - DNA, 20 bp, Homo sapiens
caggagtggtgcagacagaa

SEQ ID NO: 4672908 - DNA, 17 bp, Homo sapiens
caggagtgtcctgccca

SEQ ID NO: 4672909 - DNA, 19 bp, Homo sapiens
caggagtgtcctgcccatg

SEQ ID NO: 4672910 - DNA, 23 bp, Homo sapiens
caggagttcaataaatgtctgtt

SEQ ID NO: 4672911 - DNA, 23 bp, Homo sapiens
caggataagaaagcctaaaattg

SEQ ID NO: 4672912 - DNA, 19 bp, Homo sapiens
caggatactggcacagagg

SEQ ID NO: 4672913 - DNA, 20 bp, Homo sapiens
caggatatccttatcagagc

SEQ ID NO: 4672914 - DNA, 21 bp, Homo sapiens
caggatatccttatcagagct

SEQ ID NO: 4672915 - DNA, 24 bp, Homo sapiens
caggatcagattgcatgtgactct

SEQ ID NO: 4672916 - DNA, 15 bp, Homo sapiens
caggatgaagcattt

SEQ ID NO: 4672917 - DNA, 12 bp, Homo sapiens
caggatgaggcc

SEQ ID NO: 4672918 - DNA, 13 bp, Homo sapiens
caggatgaggccc

SEQ ID NO: 4672919 - DNA, 15 bp, Homo sapiens
caggatgaggccccg

SEQ ID NO: 4672920 - DNA, 21 bp, Homo sapiens
caggatgaggtctcgaccctg

SEQ ID NO: 4672921 - DNA, 13 bp, Homo sapiens
caggatgcccaga

SEQ ID NO: 4672922 - DNA, 10 bp, Homo sapiens
caggcaagga

SEQ ID NO: 4672923 - DNA, 14 bp, Homo sapiens
caggcaaggaacag

SEQ ID NO: 4672924 - DNA, 13 bp, Homo sapiens
caggcaaggagga

SEQ ID NO: 4672925 - DNA, 15 bp, Homo sapiens
caggcaaggaggagg

SEQ ID NO: 4672926 - DNA, 16 bp, Homo sapiens
caggcaaggaggagga

SEQ ID NO: 4672927 - DNA, 14 bp, Homo sapiens
caggcaatgctgta

SEQ ID NO: 4672928 - DNA, 16 bp, Homo sapiens
caggcaatgctgtact

SEQ ID NO: 4672929 - DNA, 20 bp, Homo sapiens
caggcaccaggactagggct

SEQ ID NO: 4672930 - DNA, 19 bp, Homo sapiens
caggcacccgtccccacac

SEQ ID NO: 4672931 - DNA, 23 bp, Homo sapiens
caggcaccgccacgtcccagcat

SEQ ID NO: 4672932 - DNA, 15 bp, Homo sapiens
caggcagaaatagtt

SEQ ID NO: 4672933 - DNA, 21 bp, Homo sapiens
caggcagaaatagttgtctgt

SEQ ID NO: 4672934 - DNA, 22 bp, Homo sapiens
caggcagaaatagttgtctgtg

SEQ ID NO: 4672935 - DNA, 16 bp, Homo sapiens
caggcagagaacagaa

SEQ ID NO: 4672936 - DNA, 13 bp, Homo sapiens
caggcagccagcc

SEQ ID NO: 4672937 - DNA, 20 bp, Homo sapiens
caggcaggaacaaacagggc

SEQ ID NO: 4672938 - DNA, 11 bp, Homo sapiens
caggcagggct

SEQ ID NO: 4672939 - DNA, 18 bp, Homo sapiens
caggcagggctctcctgg

SEQ ID NO: 4672940 - DNA, 23 bp, Homo sapiens
caggcagggctctcctggcttcc

SEQ ID NO: 4672941 - DNA, 22 bp, Homo sapiens
caggcatggtcccttaaggcac

SEQ ID NO: 4672942 - DNA, 14 bp, Homo sapiens
caggcattgaggaa

SEQ ID NO: 4672943 - DNA, 14 bp, Homo sapiens
caggcatttcctgg

SEQ ID NO: 4672944 - DNA, 15 bp, Homo sapiens
caggcatttcctggg

SEQ ID NO: 4672945 - DNA, 16 bp, Homo sapiens
caggcatttcctgggt

SEQ ID NO: 4672946 - DNA, 18 bp, Homo sapiens
caggcatttcctgggtgg

SEQ ID NO: 4672947 - DNA, 16 bp, Homo sapiens
caggccaaacatggcc

SEQ ID NO: 4672948 - DNA, 12 bp, Homo sapiens
caggccccaccc

SEQ ID NO: 4672949 - DNA, 17 bp, Homo sapiens
caggccccaccccttcc

SEQ ID NO: 4672950 - DNA, 18 bp, Homo sapiens
caggccccatgacctcca

SEQ ID NO: 4672951 - DNA, 22 bp, Homo sapiens
caggccccatgacctccagctt

SEQ ID NO: 4672952 - DNA, 14 bp, Homo sapiens
caggccgccctgcg

SEQ ID NO: 4672953 - DNA, 23 bp, Homo sapiens
caggcctagtaaccaaggccctg

SEQ ID NO: 4672954 - DNA, 17 bp, Homo sapiens
caggcctcacccctccc

SEQ ID NO: 4672955 - DNA, 20 bp, Homo sapiens
caggcctcacccctcccctg

SEQ ID NO: 4672956 - DNA, 22 bp, Homo sapiens
caggcctcacccctcccctggg

SEQ ID NO: 4672957 - DNA, 12 bp, Homo sapiens
caggcctctgcc

SEQ ID NO: 4672958 - DNA, 17 bp, Homo sapiens
caggcctctgccccaag

SEQ ID NO: 4672959 - DNA, 23 bp, Homo sapiens
caggcctctgccccaagagcagg

SEQ ID NO: 4672960 - DNA, 12 bp, Homo sapiens
caggcctgcagc

SEQ ID NO: 4672961 - DNA, 13 bp, Homo sapiens
caggcctgcagcc

SEQ ID NO: 4672962 - DNA, 14 bp, Homo sapiens
caggcctgcagccc

SEQ ID NO: 4672963 - DNA, 19 bp, Homo sapiens
caggcctgcagcccctaag

SEQ ID NO: 4672964 - DNA, 18 bp, Homo sapiens
caggcctgtgtagctgtg

SEQ ID NO: 4672965 - DNA, 19 bp, Homo sapiens
caggcctgtgtagctgtga

SEQ ID NO: 4672966 - DNA, 13 bp, Homo sapiens
caggcgcctgcca

SEQ ID NO: 4672967 - DNA, 14 bp, Homo sapiens
caggctacaaagca

SEQ ID NO: 4672968 - DNA, 18 bp, Homo sapiens
caggctacaaagcagaga

SEQ ID NO: 4672969 - DNA, 11 bp, Homo sapiens
caggctctgca

SEQ ID NO: 4672970 - DNA, 20 bp, Homo sapiens
caggctgaagagagggacag

SEQ ID NO: 4672971 - DNA, 15 bp, Homo sapiens
caggctgaccacagc

SEQ ID NO: 4672972 - DNA, 14 bp, Homo sapiens
caggctgagaactc

SEQ ID NO: 4672973 - DNA, 23 bp, Homo sapiens
caggctgagaactcgttcacctc

SEQ ID NO: 4672974 - DNA, 16 bp, Homo sapiens
caggctgaggtgagaa

SEQ ID NO: 4672975 - DNA, 16 bp, Homo sapiens
caggctggagtgcagt

SEQ ID NO: 4672976 - DNA, 17 bp, Homo sapiens
caggctggctccagatg

SEQ ID NO: 4672977 - DNA, 23 bp, Homo sapiens
caggctggtttcaaactcctgac

SEQ ID NO: 4672978 - DNA, 15 bp, Homo sapiens
caggctgtttcagcc

SEQ ID NO: 4672979 - DNA, 23 bp, Homo sapiens
caggcttgctgtatgacccctgg

SEQ ID NO: 4672980 - DNA, 12 bp, Homo sapiens
cagggaacaaaa

SEQ ID NO: 4672981 - DNA, 13 bp, Homo sapiens
cagggaacagtat

SEQ ID NO: 4672982 - DNA, 14 bp, Homo sapiens
cagggaaggacagg

SEQ ID NO: 4672983 - DNA, 16 bp, Homo sapiens
cagggaaggacaggac

SEQ ID NO: 4672984 - DNA, 17 bp, Homo sapiens
cagggaaggacaggacc

SEQ ID NO: 4672985 - DNA, 21 bp, Homo sapiens
cagggaaggacaggaccctca

SEQ ID NO: 4672986 - DNA, 14 bp, Homo sapiens
cagggaaggcaggc

SEQ ID NO: 4672987 - DNA, 18 bp, Homo sapiens
cagggaaggcaggcaggg

SEQ ID NO: 4672988 - DNA, 21 bp, Homo sapiens
cagggaaggcaggcagggctc

SEQ ID NO: 4672989 - DNA, 22 bp, Homo sapiens
cagggaaggcaggcagggctct

SEQ ID NO: 4672990 - DNA, 23 bp, Homo sapiens
cagggaaggcaggcagggctctc

SEQ ID NO: 4672991 - DNA, 19 bp, Homo sapiens
cagggaccggcagagctct

SEQ ID NO: 4672992 - DNA, 21 bp, Homo sapiens
cagggaccggcagagctctac

SEQ ID NO: 4672993 - DNA, 14 bp, Homo sapiens
cagtcctccctagc

SEQ ID NO: 4672994 - DNA, 19 bp, Homo sapiens
cagtcgtgatgtggaggaa

SEQ ID NO: 4672995 - DNA, 13 bp, Homo sapiens
cagtctcattgtc

SEQ ID NO: 4672996 - DNA, 15 bp, Homo sapiens
cagtctcattgtcac

SEQ ID NO: 4672997 - DNA, 17 bp, Homo sapiens
cagtctcattgtcacct

SEQ ID NO: 4672998 - DNA, 13 bp, Homo sapiens
cagtctcctctcc

SEQ ID NO: 4672999 - DNA, 13 bp, Homo sapiens
cagtctttccccc

SEQ ID NO: 4673000 - DNA, 14 bp, Homo sapiens
cagtctttccccca

SEQ ID NO: 4673001 - DNA, 16 bp, Homo sapiens
cagtctttcccccagg

SEQ ID NO: 4673002 - DNA, 18 bp, Homo sapiens
cagtgaacaaatgtctta

SEQ ID NO: 4673003 - DNA, 15 bp, Homo sapiens
cagtgactcctgctg

SEQ ID NO: 4673004 - DNA, 19 bp, Homo sapiens
cagtgactcctgctggtac

SEQ ID NO: 4673005 - DNA, 20 bp, Homo sapiens
cagtgactcctgctggtacc

SEQ ID NO: 4673006 - DNA, 14 bp, Homo sapiens
cagtgcaaaatgtc

SEQ ID NO: 4673007 - DNA, 15 bp, Homo sapiens
cagtgcaaaatgtct

SEQ ID NO: 4673008 - DNA, 18 bp, Homo sapiens
cagtgcaaaccacttctc

SEQ ID NO: 4673009 - DNA, 15 bp, Homo sapiens
cagtgcaacctctgc

SEQ ID NO: 4673010 - DNA, 16 bp, Homo sapiens
cagtgcaacctctgct

SEQ ID NO: 4673011 - DNA, 17 bp, Homo sapiens
cagtgcatcacatctgc

SEQ ID NO: 4673012 - DNA, 19 bp, Homo sapiens
cagtgcatcacatctgcac

SEQ ID NO: 4673013 - DNA, 23 bp, Homo sapiens
cagtgcatcacatctgcacactc

SEQ ID NO: 4673014 - DNA, 10 bp, Homo sapiens
cagtgccaac

SEQ ID NO: 4673015 - DNA, 17 bp, Homo sapiens
cagtgccaactcctcac

SEQ ID NO: 4673016 - DNA, 14 bp, Homo sapiens
cagtgccacgtcat

SEQ ID NO: 4673017 - DNA, 22 bp, Homo sapiens
cagtgcctgcacatcatgagcc

SEQ ID NO: 4673018 - DNA, 13 bp, Homo sapiens
cagtgccttcaac

SEQ ID NO: 4673019 - DNA, 13 bp, Homo sapiens
cagtgctccagcc

SEQ ID NO: 4673020 - DNA, 23 bp, Homo sapiens
cagtgctgaccagacagcctccc

SEQ ID NO: 4673021 - DNA, 14 bp, Homo sapiens
cagtggactctgag

SEQ ID NO: 4673022 - DNA, 12 bp, Homo sapiens
cagtggaggggg

SEQ ID NO: 4673023 - DNA, 22 bp, Homo sapiens
cagtggagggggcaagctttgc

SEQ ID NO: 4673024 - DNA, 12 bp, Homo sapiens
cagtggcagaga

SEQ ID NO: 4673025 - DNA, 17 bp, Homo sapiens
cagtggcaggacaggaa

SEQ ID NO: 4673026 - DNA, 15 bp, Homo sapiens
cagtggcaggggagc

SEQ ID NO: 4673027 - DNA, 18 bp, Homo sapiens
cagtggcgcaatctcagc

SEQ ID NO: 4673028 - DNA, 12 bp, Homo sapiens
cagtgggaaata

SEQ ID NO: 4673029 - DNA, 17 bp, Homo sapiens
cagtgggagctgagctg

SEQ ID NO: 4673030 - DNA, 13 bp, Homo sapiens
cagtggggcctgt

SEQ ID NO: 4673031 - DNA, 14 bp, Homo sapiens
cagtggggcctgtg

SEQ ID NO: 4673032 - DNA, 17 bp, Homo sapiens
cagtggggcctgtggaa

SEQ ID NO: 4673033 - DNA, 16 bp, Homo sapiens
cagtggggctctctga

SEQ ID NO: 4673034 - DNA, 19 bp, Homo sapiens
cagtggggctctctgagtc

SEQ ID NO: 4673035 - DNA, 20 bp, Homo sapiens
cagtggggctctctgagtcc

SEQ ID NO: 4673036 - DNA, 21 bp, Homo sapiens
cagtggggctctctgagtcct

SEQ ID NO: 4673037 - DNA, 17 bp, Homo sapiens
cagtggttgcctggggg

SEQ ID NO: 4673038 - DNA, 17 bp, Homo sapiens
cagtgtacagtcttgta

SEQ ID NO: 4673039 - DNA, 18 bp, Homo sapiens
cagtgtagacacaggtca

SEQ ID NO: 4673040 - DNA, 19 bp, Homo sapiens
cagtgtagacacaggtcac

SEQ ID NO: 4673041 - DNA, 18 bp, Homo sapiens
cagtgtgaataaagtgct

SEQ ID NO: 4673042 - DNA, 13 bp, Homo sapiens
cagtgtttcgtca

SEQ ID NO: 4673043 - DNA, 14 bp, Homo sapiens
cagtgtttctgaat

SEQ ID NO: 4673044 - DNA, 19 bp, Homo sapiens
cagtgtttctgaatgtttg

SEQ ID NO: 4673045 - DNA, 18 bp, Homo sapiens
cagtgttttctttgagga

SEQ ID NO: 4673046 - DNA, 14 bp, Homo sapiens
cagttatcaaaaag

SEQ ID NO: 4673047 - DNA, 15 bp, Homo sapiens
cagttcaactttcag

SEQ ID NO: 4673048 - DNA, 20 bp, Homo sapiens
cagttcaactttcagaagtg

SEQ ID NO: 4673049 - DNA, 15 bp, Homo sapiens
cagttcagagatcag

SEQ ID NO: 4673050 - DNA, 19 bp, Homo sapiens
cagttcatcaccatttcct

SEQ ID NO: 4673051 - DNA, 16 bp, Homo sapiens
cagttcatcgattttc

SEQ ID NO: 4673052 - DNA, 15 bp, Homo sapiens
cagttcctgggaaca

SEQ ID NO: 4673053 - DNA, 14 bp, Homo sapiens
cagttccttggcct

SEQ ID NO: 4673054 - DNA, 13 bp, Homo sapiens
cagttcgcagcca

SEQ ID NO: 4673055 - DNA, 16 bp, Homo sapiens
cagttcgcagccaccc

SEQ ID NO: 4673056 - DNA, 21 bp, Homo sapiens
cagttcgcagccaccctgagg

SEQ ID NO: 4673057 - DNA, 19 bp, Homo sapiens
cagttctcctgcctcagcc

SEQ ID NO: 4673058 - DNA, 22 bp, Homo sapiens
cagttctgtgtggtgcattcct

SEQ ID NO: 4673059 - DNA, 16 bp, Homo sapiens
cagttgatgtgtcttt

SEQ ID NO: 4673060 - DNA, 21 bp, Homo sapiens
cagttgcagagaattgtttct

SEQ ID NO: 4673061 - DNA, 20 bp, Homo sapiens
cagttgctgtgaactttcat

SEQ ID NO: 4673062 - DNA, 20 bp, Homo sapiens
cagttgtgataatagcattt

SEQ ID NO: 4673063 - DNA, 22 bp, Homo sapiens
cagttgtgataatagcattttt

SEQ ID NO: 4673064 - DNA, 23 bp, Homo sapiens
cagtttaaaggggtcccatcagt

SEQ ID NO: 4673065 - DNA, 16 bp, Homo sapiens
cagtttatgttgtaca

SEQ ID NO: 4673066 - DNA, 19 bp, Homo sapiens
cagtttatttccactattt

SEQ ID NO: 4673067 - DNA, 22 bp, Homo sapiens
cagtttatttccactattttca

SEQ ID NO: 4673068 - DNA, 12 bp, Homo sapiens
cagtttccaaat

SEQ ID NO: 4673069 - DNA, 13 bp, Homo sapiens
cagtttctgcctg

SEQ ID NO: 4673070 - DNA, 23 bp, Homo sapiens
cagtttcttgcttggaagccagg

SEQ ID NO: 4673071 - DNA, 14 bp, Homo sapiens
cagtttgggaaggt

SEQ ID NO: 4673072 - DNA, 19 bp, Homo sapiens
cagttttggtgtgtaactt

SEQ ID NO: 4673073 - DNA, 22 bp, Homo sapiens
cagtttttaaaatatattgctg

SEQ ID NO: 4673074 - DNA, 19 bp, Homo sapiens
cataaagcaattgtgaaat

SEQ ID NO: 4673075 - DNA, 22 bp, Homo sapiens
cataaagcactacctaagtaat

SEQ ID NO: 4673076 - DNA, 19 bp, Homo sapiens
cataaatcacagaaaattt

SEQ ID NO: 4673077 - DNA, 20 bp, Homo sapiens
cataacattttcagaatagt

SEQ ID NO: 4673078 - DNA, 17 bp, Homo sapiens
cataaccaatttgtaat

SEQ ID NO: 4673079 - DNA, 18 bp, Homo sapiens
cataagactttgggatag

SEQ ID NO: 4673080 - DNA, 15 bp, Homo sapiens
cataagatattcttt

SEQ ID NO: 4673081 - DNA, 19 bp, Homo sapiens
cataagatattctttacaa

SEQ ID NO: 4673082 - DNA, 18 bp, Homo sapiens
cataagcaatcattttat

SEQ ID NO: 4673083 - DNA, 18 bp, Homo sapiens
cataataaatatctgtac

SEQ ID NO: 4673084 - DNA, 17 bp, Homo sapiens
cataataaatgcttcag

SEQ ID NO: 4673085 - DNA, 23 bp, Homo sapiens
cataatcagtaaatagtgtcata

SEQ ID NO: 4673086 - DNA, 16 bp, Homo sapiens
cataatctgaaaacat

SEQ ID NO: 4673087 - DNA, 18 bp, Homo sapiens
cataatctgtacaatgaa

SEQ ID NO: 4673088 - DNA, 16 bp, Homo sapiens
cataattatgaaaact

SEQ ID NO: 4673089 - DNA, 11 bp, Homo sapiens
cataattccta

SEQ ID NO: 4673090 - DNA, 18 bp, Homo sapiens
cataattcctacagcact

SEQ ID NO: 4673091 - DNA, 20 bp, Homo sapiens
cataatttggtcatttggca

SEQ ID NO: 4673092 - DNA, 13 bp, Homo sapiens
cataattttgcat

SEQ ID NO: 4673093 - DNA, 16 bp, Homo sapiens
catacaaactctcacc

SEQ ID NO: 4673094 - DNA, 22 bp, Homo sapiens
catacaagaaaatgtatccaag

SEQ ID NO: 4673095 - DNA, 19 bp, Homo sapiens
catacactaaccaaatctc

SEQ ID NO: 4673096 - DNA, 17 bp, Homo sapiens
catacagagtgggcccc

SEQ ID NO: 4673097 - DNA, 12 bp, Homo sapiens
catacagtttta

SEQ ID NO: 4673098 - DNA, 18 bp, Homo sapiens
catacatgatacattttt

SEQ ID NO: 4673099 - DNA, 17 bp, Homo sapiens
cataccattcccatgga

SEQ ID NO: 4673100 - DNA, 20 bp, Homo sapiens
catacctcagataatatgtt

SEQ ID NO: 4673101 - DNA, 13 bp, Homo sapiens
cataccttctccc

SEQ ID NO: 4673102 - DNA, 19 bp, Homo sapiens
cataccttctcccaggcct

SEQ ID NO: 4673103 - DNA, 15 bp, Homo sapiens
catctgtctgctctg

SEQ ID NO: 4673104 - DNA, 16 bp, Homo sapiens
catctgtctgctctgc

SEQ ID NO: 4673105 - DNA, 17 bp, Homo sapiens
catctgtgcactgccca

SEQ ID NO: 4673106 - DNA, 13 bp, Homo sapiens
catctgtggagct

SEQ ID NO: 4673107 - DNA, 14 bp, Homo sapiens
catctgtggagctg

SEQ ID NO: 4673108 - DNA, 11 bp, Homo sapiens
catctgtgttc

SEQ ID NO: 4673109 - DNA, 15 bp, Homo sapiens
catcttaatctttat

SEQ ID NO: 4673110 - DNA, 17 bp, Homo sapiens
catcttacttgtccttt

SEQ ID NO: 4673111 - DNA, 13 bp, Homo sapiens
catcttcatataa

SEQ ID NO: 4673112 - DNA, 14 bp, Homo sapiens
catcttcatataaa

SEQ ID NO: 4673113 - DNA, 13 bp, Homo sapiens
catcttgcttcca

SEQ ID NO: 4673114 - DNA, 15 bp, Homo sapiens
catcttggggacatc

SEQ ID NO: 4673115 - DNA, 16 bp, Homo sapiens
catcttggggacatct

SEQ ID NO: 4673116 - DNA, 15 bp, Homo sapiens
catcttgtttcattt

SEQ ID NO: 4673117 - DNA, 17 bp, Homo sapiens
catctttaattccttat

SEQ ID NO: 4673118 - DNA, 14 bp, Homo sapiens
catgaaatttttaa

SEQ ID NO: 4673119 - DNA, 15 bp, Homo sapiens
catgaaccaaatggt

SEQ ID NO: 4673120 - DNA, 16 bp, Homo sapiens
catgaaccaaatggtt

SEQ ID NO: 4673121 - DNA, 12 bp, Homo sapiens
catgaaccctgc

SEQ ID NO: 4673122 - DNA, 14 bp, Homo sapiens
catgaaccctgccc

SEQ ID NO: 4673123 - DNA, 16 bp, Homo sapiens
catgaaccctgccctg

SEQ ID NO: 4673124 - DNA, 17 bp, Homo sapiens
catgaacgttattatat

SEQ ID NO: 4673125 - DNA, 16 bp, Homo sapiens
catgaatgatttgtgt

SEQ ID NO: 4673126 - DNA, 19 bp, Homo sapiens
catgaattcatactctgtt

SEQ ID NO: 4673127 - DNA, 19 bp, Homo sapiens
catgacgccagataaaatg

SEQ ID NO: 4673128 - DNA, 17 bp, Homo sapiens
catgactgtcgccacac

SEQ ID NO: 4673129 - DNA, 21 bp, Homo sapiens
catgagatcagggcctgcccc

SEQ ID NO: 4673130 - DNA, 22 bp, Homo sapiens
catgagatgatacatccaaagc

SEQ ID NO: 4673131 - DNA, 23 bp, Homo sapiens
catgagcgtcaaagaaaatgcct

SEQ ID NO: 4673132 - DNA, 17 bp, Homo sapiens
catgagctcctgatcag

SEQ ID NO: 4673133 - DNA, 16 bp, Homo sapiens
catgaggccactgctg

SEQ ID NO: 4673134 - DNA, 16 bp, Homo sapiens
catgaggccatctcag

SEQ ID NO: 4673135 - DNA, 14 bp, Homo sapiens
catgagtctgtttc

SEQ ID NO: 4673136 - DNA, 15 bp, Homo sapiens
catgagttcaaatac

SEQ ID NO: 4673137 - DNA, 16 bp, Homo sapiens
catgatacatttttat

SEQ ID NO: 4673138 - DNA, 20 bp, Homo sapiens
catgatgcgggccagtgctc

SEQ ID NO: 4673139 - DNA, 14 bp, Homo sapiens
catgatggcaacag

SEQ ID NO: 4673140 - DNA, 15 bp, Homo sapiens
catgatggcaacaga

SEQ ID NO: 4673141 - DNA, 20 bp, Homo sapiens
catgatggcaacagaaacca

SEQ ID NO: 4673142 - DNA, 14 bp, Homo sapiens
catgattatagcaa

SEQ ID NO: 4673143 - DNA, 22 bp, Homo sapiens
catgattatagcaactaatgtt

SEQ ID NO: 4673144 - DNA, 12 bp, Homo sapiens
catgatttcaaa

SEQ ID NO: 4673145 - DNA, 21 bp, Homo sapiens
catgcaacagaagtgacttct

SEQ ID NO: 4673146 - DNA, 15 bp, Homo sapiens
catgcaccttgctcc

SEQ ID NO: 4673147 - DNA, 20 bp, Homo sapiens
catgcatctttaattcctta

SEQ ID NO: 4673148 - DNA, 21 bp, Homo sapiens
catgcatctttaattccttat

SEQ ID NO: 4673149 - DNA, 13 bp, Homo sapiens
catgcattgaaaa

SEQ ID NO: 4673150 - DNA, 17 bp, Homo sapiens
catgccatttgtactga

SEQ ID NO: 4673151 - DNA, 18 bp, Homo sapiens
catgccatttgtactgac

SEQ ID NO: 4673152 - DNA, 19 bp, Homo sapiens
catgccatttgtactgacc

SEQ ID NO: 4673153 - DNA, 14 bp, Homo sapiens
catgccctgtgcaa

SEQ ID NO: 4673154 - DNA, 14 bp, Homo sapiens
catgcctctgaggc

SEQ ID NO: 4673155 - DNA, 19 bp, Homo sapiens
catgcctctgaggccagcc

SEQ ID NO: 4673156 - DNA, 16 bp, Homo sapiens
catgcctggtattttc

SEQ ID NO: 4673157 - DNA, 15 bp, Homo sapiens
catgcctgtcctttc

SEQ ID NO: 4673158 - DNA, 14 bp, Homo sapiens
catgcggtagccag

SEQ ID NO: 4673159 - DNA, 19 bp, Homo sapiens
catgcggtagccagcacac

SEQ ID NO: 4673160 - DNA, 17 bp, Homo sapiens
catgctaacaaagacaa

SEQ ID NO: 4673161 - DNA, 12 bp, Homo sapiens
catgctatgttc

SEQ ID NO: 4673162 - DNA, 14 bp, Homo sapiens
catgctatgttctg

SEQ ID NO: 4673163 - DNA, 19 bp, Homo sapiens
catgctatgttctgtcttc

SEQ ID NO: 4673164 - DNA, 20 bp, Homo sapiens
catgctggctcccagggcca

SEQ ID NO: 4673165 - DNA, 15 bp, Homo sapiens
catgctgtgcatttt

SEQ ID NO: 4673166 - DNA, 21 bp, Homo sapiens
catgcttctactgtgacactt

SEQ ID NO: 4673167 - DNA, 21 bp, Homo sapiens
catgcttgggctgacccagca

SEQ ID NO: 4673168 - DNA, 15 bp, Homo sapiens
catggacaggctggc

SEQ ID NO: 4673169 - DNA, 20 bp, Homo sapiens
catggacgtgtctgcacagg

SEQ ID NO: 4673170 - DNA, 17 bp, Homo sapiens
catggaggcagatgccc

SEQ ID NO: 4673171 - DNA, 16 bp, Homo sapiens
catggagtagcctgga

SEQ ID NO: 4673172 - DNA, 20 bp, Homo sapiens
catggagtagcctggactgt

SEQ ID NO: 4673173 - DNA, 22 bp, Homo sapiens
catggatgaattttccagacct

SEQ ID NO: 4673174 - DNA, 14 bp, Homo sapiens
catggatggaaaac

SEQ ID NO: 4673175 - DNA, 12 bp, Homo sapiens
catggatgtttt

SEQ ID NO: 4673176 - DNA, 19 bp, Homo sapiens
catggcagatgtaggaggg

SEQ ID NO: 4673177 - DNA, 20 bp, Homo sapiens
catggcagatgtaggaggga

SEQ ID NO: 4673178 - DNA, 16 bp, Homo sapiens
catggccagactccct

SEQ ID NO: 4673179 - DNA, 17 bp, Homo sapiens
catggccagactccctt

SEQ ID NO: 4673180 - DNA, 18 bp, Homo sapiens
catggccagactcccttg

SEQ ID NO: 4673181 - DNA, 17 bp, Homo sapiens
catggcctatgcacata

SEQ ID NO: 4673182 - DNA, 20 bp, Homo sapiens
catggcggcacacatctgta

SEQ ID NO: 4673183 - DNA, 13 bp, Homo sapiens
catgggtctggct

SEQ ID NO: 4673184 - DNA, 13 bp, Homo sapiens
catggtacttcct

SEQ ID NO: 4673185 - DNA, 18 bp, Homo sapiens
catggtcccacatccctg

SEQ ID NO: 4673186 - DNA, 20 bp, Homo sapiens
catggtcccttaaggcacag

SEQ ID NO: 4673187 - DNA, 14 bp, Homo sapiens
catgtaatcctcaa

SEQ ID NO: 4673188 - DNA, 21 bp, Homo sapiens
catgtagccacccaactttgt

SEQ ID NO: 4673189 - DNA, 20 bp, Homo sapiens
catgtagccagcagaactga

SEQ ID NO: 4673190 - DNA, 17 bp, Homo sapiens
catgtagcttcttctga

SEQ ID NO: 4673191 - DNA, 20 bp, Homo sapiens
catgtagggcaagaggatga

SEQ ID NO: 4673192 - DNA, 21 bp, Homo sapiens
catgtagggcaagaggatgaa

SEQ ID NO: 4673193 - DNA, 16 bp, Homo sapiens
catgtataaatgtgat

SEQ ID NO: 4673194 - DNA, 13 bp, Homo sapiens
catgtatgtcttg

SEQ ID NO: 4673195 - DNA, 17 bp, Homo sapiens
catgtatgtcttggaca

SEQ ID NO: 4673196 - DNA, 22 bp, Homo sapiens
catgtatgtcttggacactgta

SEQ ID NO: 4673197 - DNA, 22 bp, Homo sapiens
catgtcaacaatccacatcaga

SEQ ID NO: 4673198 - DNA, 18 bp, Homo sapiens
catgtccctacaaagaac

SEQ ID NO: 4673199 - DNA, 13 bp, Homo sapiens
catgtctgtatcc

SEQ ID NO: 4673200 - DNA, 14 bp, Homo sapiens
catgtgacacatat

SEQ ID NO: 4673201 - DNA, 13 bp, Homo sapiens
catgtgactctga

SEQ ID NO: 4673202 - DNA, 20 bp, Homo sapiens
catgtgattaatgttttcat

SEQ ID NO: 4673203 - DNA, 17 bp, Homo sapiens
catgtgctacaggggcc

SEQ ID NO: 4673204 - DNA, 22 bp, Homo sapiens
catgtgctacaggggccagaag

SEQ ID NO: 4673205 - DNA, 16 bp, Homo sapiens
catgtggttacacagt

SEQ ID NO: 4673206 - DNA, 23 bp, Homo sapiens
catgtggttacacagtgtgaata

SEQ ID NO: 4673207 - DNA, 18 bp, Homo sapiens
catgtgtagcctgtgcat

SEQ ID NO: 4673208 - DNA, 20 bp, Homo sapiens
catgttgatcatgtactttt

SEQ ID NO: 4673209 - DNA, 22 bp, Homo sapiens
catgttgcaaagaactccagag

SEQ ID NO: 4673210 - DNA, 23 bp, Homo sapiens
catgttgcaaagaactccagagt

SEQ ID NO: 4673211 - DNA, 17 bp, Homo sapiens
catgttggccaggctgg

SEQ ID NO: 4673212 - DNA, 19 bp, Homo sapiens
catgttgtgcctccctggt

SEQ ID NO: 4673213 - DNA, 12 bp, Homo sapiens
catttttatagc

SEQ ID NO: 4673214 - DNA, 12 bp, Homo sapiens
catttttgtagg

SEQ ID NO: 4673215 - DNA, 19 bp, Homo sapiens
catttttgtaggaagcatt

SEQ ID NO: 4673216 - DNA, 22 bp, Homo sapiens
cattttttaaaagccttccagt

SEQ ID NO: 4673217 - DNA, 20 bp, Homo sapiens
cattttttaggacatcttaa

SEQ ID NO: 4673218 - DNA, 22 bp, Homo sapiens
cattttttaggacatcttaaat

SEQ ID NO: 4673219 - DNA, 17 bp, Homo sapiens
cattttttataattttc

SEQ ID NO: 4673220 - DNA, 13 bp, Homo sapiens
cattttttctaat

SEQ ID NO: 4673221 - DNA, 14 bp, Homo sapiens
ccaaacaggaacta

SEQ ID NO: 4673222 - DNA, 21 bp, Homo sapiens
ccaaacctctgttcagtgtaa

SEQ ID NO: 4673223 - DNA, 15 bp, Homo sapiens
ccaaacttgttcatt

SEQ ID NO: 4673224 - DNA, 14 bp, Homo sapiens
ccaaagaaacaagc

SEQ ID NO: 4673225 - DNA, 18 bp, Homo sapiens
ccaaagaaacaagctgtg

SEQ ID NO: 4673226 - DNA, 14 bp, Homo sapiens
ccaaagaaacacca

SEQ ID NO: 4673227 - DNA, 22 bp, Homo sapiens
ccaaagaaacaccacttaatct

SEQ ID NO: 4673228 - DNA, 16 bp, Homo sapiens
ccaaagaatattttga

SEQ ID NO: 4673229 - DNA, 22 bp, Homo sapiens
ccaaaggcattttattgcttga

SEQ ID NO: 4673230 - DNA, 23 bp, Homo sapiens
ccaaagggtgaagctatttatct

SEQ ID NO: 4673231 - DNA, 22 bp, Homo sapiens
ccaaatccgaacctcctctgtg

SEQ ID NO: 4673232 - DNA, 16 bp, Homo sapiens
ccaaatccgccagtgt

SEQ ID NO: 4673233 - DNA, 19 bp, Homo sapiens
ccaaatctctcaaatctgt

SEQ ID NO: 4673234 - DNA, 20 bp, Homo sapiens
ccaacacgcacctgcctcag

SEQ ID NO: 4673235 - DNA, 20 bp, Homo sapiens
ccaacccgtggaggctgctc

SEQ ID NO: 4673236 - DNA, 21 bp, Homo sapiens
ccaaccctgggctggggagga

SEQ ID NO: 4673237 - DNA, 22 bp, Homo sapiens
ccaaccctgggctggggaggag

SEQ ID NO: 4673238 - DNA, 20 bp, Homo sapiens
ccaacctctgttccccaccc

SEQ ID NO: 4673239 - DNA, 18 bp, Homo sapiens
ccaacctgttcttagagt

SEQ ID NO: 4673240 - DNA, 17 bp, Homo sapiens
ccaaccttgctcttggg

SEQ ID NO: 4673241 - DNA, 15 bp, Homo sapiens
ccaacgaaaagcaca

SEQ ID NO: 4673242 - DNA, 16 bp, Homo sapiens
ccaactattctcaggc

SEQ ID NO: 4673243 - DNA, 20 bp, Homo sapiens
ccaactcaagtgtcacctcc

SEQ ID NO: 4673244 - DNA, 23 bp, Homo sapiens
ccaactcaagtgtcacctccttc

SEQ ID NO: 4673245 - DNA, 14 bp, Homo sapiens
ccaactgtttccct

SEQ ID NO: 4673246 - DNA, 15 bp, Homo sapiens
ccaagagcaggaggt

SEQ ID NO: 4673247 - DNA, 21 bp, Homo sapiens
ccaagagcaggaggtgcctga

SEQ ID NO: 4673248 - DNA, 18 bp, Homo sapiens
ccaagagcatcatgcctc

SEQ ID NO: 4673249 - DNA, 21 bp, Homo sapiens
ccaagagcatcatgcctctga

SEQ ID NO: 4673250 - DNA, 23 bp, Homo sapiens
ccaagagcccgtgccacccccag

SEQ ID NO: 4673251 - DNA, 21 bp, Homo sapiens
ccaagatttaccaattcaccc

SEQ ID NO: 4673252 - DNA, 15 bp, Homo sapiens
ccaagcacagcagcc

SEQ ID NO: 4673253 - DNA, 15 bp, Homo sapiens
ccaagcagtggcctt

SEQ ID NO: 4673254 - DNA, 14 bp, Homo sapiens
ccaagccagattct

SEQ ID NO: 4673255 - DNA, 16 bp, Homo sapiens
ccaagcccctgacccg

SEQ ID NO: 4673256 - DNA, 19 bp, Homo sapiens
ccaagccctcagctggtcc

SEQ ID NO: 4673257 - DNA, 11 bp, Homo sapiens
ccaagcctatc

SEQ ID NO: 4673258 - DNA, 14 bp, Homo sapiens
ccaagcctgcaact

SEQ ID NO: 4673259 - DNA, 15 bp, Homo sapiens
ccaagctagactgtg

SEQ ID NO: 4673260 - DNA, 14 bp, Homo sapiens
ccaagctccaaatc

SEQ ID NO: 4673261 - DNA, 22 bp, Homo sapiens
ccaagctccaaatccaaggaaa

SEQ ID NO: 4673262 - DNA, 13 bp, Homo sapiens
ccaagctcccttc

SEQ ID NO: 4673263 - DNA, 19 bp, Homo sapiens
ccaagctgaggtgcccagg

SEQ ID NO: 4673264 - DNA, 23 bp, Homo sapiens
ccaagctgaggtgcccaggagaa

SEQ ID NO: 4673265 - DNA, 15 bp, Homo sapiens
ccaaggaaatatatt

SEQ ID NO: 4673266 - DNA, 23 bp, Homo sapiens
ccaaggaagcagaagacgggagg

SEQ ID NO: 4673267 - DNA, 15 bp, Homo sapiens
ccaaggacagttcag

SEQ ID NO: 4673268 - DNA, 19 bp, Homo sapiens
ccaaggacccagccctcgc

SEQ ID NO: 4673269 - DNA, 14 bp, Homo sapiens
ccaaggactgaggg

SEQ ID NO: 4673270 - DNA, 17 bp, Homo sapiens
ccaaggactgagggcag

SEQ ID NO: 4673271 - DNA, 19 bp, Homo sapiens
ccaaggagggggcctcatt

SEQ ID NO: 4673272 - DNA, 20 bp, Homo sapiens
ccaagggacaggagaagaga

SEQ ID NO: 4673273 - DNA, 16 bp, Homo sapiens
ccaagggccctggcac

SEQ ID NO: 4673274 - DNA, 22 bp, Homo sapiens
ccaagggccctggcacccccac

SEQ ID NO: 4673275 - DNA, 19 bp, Homo sapiens
ccaaggtggagggaaggat

SEQ ID NO: 4673276 - DNA, 20 bp, Homo sapiens
ccaagtagctgggattacag

SEQ ID NO: 4673277 - DNA, 16 bp, Homo sapiens
ccaagtgcaaaagaaa

SEQ ID NO: 4673278 - DNA, 17 bp, Homo sapiens
ccaagttgtgcttgagc

SEQ ID NO: 4673279 - DNA, 16 bp, Homo sapiens
ccaatagaaagaaact

SEQ ID NO: 4673280 - DNA, 21 bp, Homo sapiens
ccaatattaccatcttaatct

SEQ ID NO: 4673281 - DNA, 14 bp, Homo sapiens
ccaatattgtacag

SEQ ID NO: 4673282 - DNA, 15 bp, Homo sapiens
ccaatattgtacagt

SEQ ID NO: 4673283 - DNA, 16 bp, Homo sapiens
ccaatcctccccgctc

SEQ ID NO: 4673284 - DNA, 18 bp, Homo sapiens
ccaatcctccccgctctg

SEQ ID NO: 4673285 - DNA, 14 bp, Homo sapiens
ccaatcggactgcc

SEQ ID NO: 4673286 - DNA, 16 bp, Homo sapiens
ccaatggattcatgga

SEQ ID NO: 4673287 - DNA, 18 bp, Homo sapiens
ccaatggtgcttggaggg

SEQ ID NO: 4673288 - DNA, 15 bp, Homo sapiens
ccaatgtacccaccg

SEQ ID NO: 4673289 - DNA, 16 bp, Homo sapiens
ccaatgtgacctgggg

SEQ ID NO: 4673290 - DNA, 19 bp, Homo sapiens
ccaatgtgacctggggcag

SEQ ID NO: 4673291 - DNA, 20 bp, Homo sapiens
ccaatgtgacctggggcaga

SEQ ID NO: 4673292 - DNA, 16 bp, Homo sapiens
ccaatgttatgccagc

SEQ ID NO: 4673293 - DNA, 17 bp, Homo sapiens
ccaatgttatgccagct

SEQ ID NO: 4673294 - DNA, 20 bp, Homo sapiens
ccaatgttatgccagctcca

SEQ ID NO: 4673295 - DNA, 21 bp, Homo sapiens
ccaattacatggaacttttct

SEQ ID NO: 4673296 - DNA, 15 bp, Homo sapiens
ccaattcacccactc

SEQ ID NO: 4673297 - DNA, 16 bp, Homo sapiens
ccaattcagacaggca

SEQ ID NO: 4673298 - DNA, 12 bp, Homo sapiens
ccaatttgtaat

SEQ ID NO: 4673299 - DNA, 20 bp, Homo sapiens
ccaatttttgtacttttagt

SEQ ID NO: 4673300 - DNA, 11 bp, Homo sapiens
ccacaaacaat

SEQ ID NO: 4673301 - DNA, 16 bp, Homo sapiens
ccacaaaggtcacagg

SEQ ID NO: 4673302 - DNA, 18 bp, Homo sapiens
ccacaagctgcactgtga

SEQ ID NO: 4673303 - DNA, 20 bp, Homo sapiens
ccacaagctgcactgtgaac

SEQ ID NO: 4673304 - DNA, 21 bp, Homo sapiens
ccacaagctgcactgtgaacc

SEQ ID NO: 4673305 - DNA, 17 bp, Homo sapiens
ccacaagctgtccctgc

SEQ ID NO: 4673306 - DNA, 21 bp, Homo sapiens
ccacaagctgtccctgcaggg

SEQ ID NO: 4673307 - DNA, 13 bp, Homo sapiens
ccacaaggaaaga

SEQ ID NO: 4673308 - DNA, 13 bp, Homo sapiens
ccacaaggcctgg

SEQ ID NO: 4673309 - DNA, 14 bp, Homo sapiens
ccacacagggtggc

SEQ ID NO: 4673310 - DNA, 15 bp, Homo sapiens
ccacacgcctctgtg

SEQ ID NO: 4673311 - DNA, 18 bp, Homo sapiens
ccacacttcgctcttgag

SEQ ID NO: 4673312 - DNA, 21 bp, Homo sapiens
ccacacttctcaggacacagg

SEQ ID NO: 4673313 - DNA, 22 bp, Homo sapiens
ccacacttctcaggacacaggc

SEQ ID NO: 4673314 - DNA, 20 bp, Homo sapiens
ccacagatggctttcagggc

SEQ ID NO: 4673315 - DNA, 19 bp, Homo sapiens
ccacagcaaccccaggctg

SEQ ID NO: 4673316 - DNA, 17 bp, Homo sapiens
ccacagccttccctctg

SEQ ID NO: 4673317 - DNA, 14 bp, Homo sapiens
ccacaggaccacct

SEQ ID NO: 4673318 - DNA, 20 bp, Homo sapiens
ccacagtagaactgtctgtg

SEQ ID NO: 4673319 - DNA, 14 bp, Homo sapiens
ccacatcaaagagg

SEQ ID NO: 4673320 - DNA, 13 bp, Homo sapiens
ccacatgaggcca

SEQ ID NO: 4673321 - DNA, 17 bp, Homo sapiens
ccacatgaggccatctc

SEQ ID NO: 4673322 - DNA, 22 bp, Homo sapiens
ccacatgaggccatctcaggag

SEQ ID NO: 4673323 - DNA, 23 bp, Homo sapiens
ccagcccctggccccaggacctg

SEQ ID NO: 4673324 - DNA, 17 bp, Homo sapiens
ccagcccctgtcccacc

SEQ ID NO: 4673325 - DNA, 16 bp, Homo sapiens
ccagccccttcccctg

SEQ ID NO: 4673326 - DNA, 17 bp, Homo sapiens
ccagccccttcccctgg

SEQ ID NO: 4673327 - DNA, 21 bp, Homo sapiens
ccagccccttcccctgggaac

SEQ ID NO: 4673328 - DNA, 13 bp, Homo sapiens
ccagccctggggg

SEQ ID NO: 4673329 - DNA, 20 bp, Homo sapiens
ccagcctgaggtgcccactc

SEQ ID NO: 4673330 - DNA, 23 bp, Homo sapiens
ccagcctgaggtgcccactccgc

SEQ ID NO: 4673331 - DNA, 12 bp, Homo sapiens
ccagcctgctga

SEQ ID NO: 4673332 - DNA, 15 bp, Homo sapiens
ccagcctgctgacag

SEQ ID NO: 4673333 - DNA, 21 bp, Homo sapiens
ccagcctggcctcctgcctct

SEQ ID NO: 4673334 - DNA, 13 bp, Homo sapiens
ccagcctgggcct

SEQ ID NO: 4673335 - DNA, 21 bp, Homo sapiens
ccagcgattccctctcccagg

SEQ ID NO: 4673336 - DNA, 15 bp, Homo sapiens
ccagcggacagtggc

SEQ ID NO: 4673337 - DNA, 15 bp, Homo sapiens
ccagcggcccaagag

SEQ ID NO: 4673338 - DNA, 16 bp, Homo sapiens
ccagcggcccaagagc

SEQ ID NO: 4673339 - DNA, 19 bp, Homo sapiens
ccagcggcccaagagcccg

SEQ ID NO: 4673340 - DNA, 20 bp, Homo sapiens
ccagcggcccaagagcccgt

SEQ ID NO: 4673341 - DNA, 14 bp, Homo sapiens
ccagctagtgaccc

SEQ ID NO: 4673342 - DNA, 19 bp, Homo sapiens
ccagctccatgttctccca

SEQ ID NO: 4673343 - DNA, 20 bp, Homo sapiens
ccagctccatgttctcccaa

SEQ ID NO: 4673344 - DNA, 13 bp, Homo sapiens
ccagctcccccag

SEQ ID NO: 4673345 - DNA, 16 bp, Homo sapiens
ccagctcccccaggca

SEQ ID NO: 4673346 - DNA, 19 bp, Homo sapiens
ccagctccggcctgtcctc

SEQ ID NO: 4673347 - DNA, 14 bp, Homo sapiens
ccagctccttcgct

SEQ ID NO: 4673348 - DNA, 22 bp, Homo sapiens
ccagctgaaggcagtggcaggg

SEQ ID NO: 4673349 - DNA, 12 bp, Homo sapiens
ccagctgctccc

SEQ ID NO: 4673350 - DNA, 14 bp, Homo sapiens
ccagctgctcccca

SEQ ID NO: 4673351 - DNA, 17 bp, Homo sapiens
ccagctgctctaagccc

SEQ ID NO: 4673352 - DNA, 19 bp, Homo sapiens
ccagctgctctaagcccag

SEQ ID NO: 4673353 - DNA, 15 bp, Homo sapiens
ccagctgctgtgccc

SEQ ID NO: 4673354 - DNA, 19 bp, Homo sapiens
ccagctggcccgtgacaga

SEQ ID NO: 4673355 - DNA, 22 bp, Homo sapiens
ccagctggcctggcccccagct

SEQ ID NO: 4673356 - DNA, 16 bp, Homo sapiens
ccagctgggtcaggca

SEQ ID NO: 4673357 - DNA, 21 bp, Homo sapiens
ccagcttctcagtttctgcct

SEQ ID NO: 4673358 - DNA, 21 bp, Homo sapiens
ccagcttgcctgtttcttctc

SEQ ID NO: 4673359 - DNA, 14 bp, Homo sapiens
ccaggaaaggagga

SEQ ID NO: 4673360 - DNA, 23 bp, Homo sapiens
ccaggaagggccattttggtgct

SEQ ID NO: 4673361 - DNA, 15 bp, Homo sapiens
ccaggacaagcatgg

SEQ ID NO: 4673362 - DNA, 17 bp, Homo sapiens
ccaggacaagcatggtc

SEQ ID NO: 4673363 - DNA, 20 bp, Homo sapiens
ccaggacaagcatggtccca

SEQ ID NO: 4673364 - DNA, 20 bp, Homo sapiens
ccaggagaagaaagaggtga

SEQ ID NO: 4673365 - DNA, 21 bp, Homo sapiens
ccaggagaagggggctctgcc

SEQ ID NO: 4673366 - DNA, 23 bp, Homo sapiens
ccaggagagagccaggatgccca

SEQ ID NO: 4673367 - DNA, 16 bp, Homo sapiens
ccaggagcagccctgg

SEQ ID NO: 4673368 - DNA, 19 bp, Homo sapiens
ccaggagcagccctggccc

SEQ ID NO: 4673369 - DNA, 14 bp, Homo sapiens
ccaggagcttcttc

SEQ ID NO: 4673370 - DNA, 24 bp, Homo sapiens
ccaggagggacaaaggagcctgtg

SEQ ID NO: 4673371 - DNA, 12 bp, Homo sapiens
ccaggagtgggg

SEQ ID NO: 4673372 - DNA, 16 bp, Homo sapiens
ccaggagtggggagag

SEQ ID NO: 4673373 - DNA, 18 bp, Homo sapiens
ccaggatcgttttttccc

SEQ ID NO: 4673374 - DNA, 18 bp, Homo sapiens
ccaggatctcctgccagc

SEQ ID NO: 4673375 - DNA, 23 bp, Homo sapiens
ccaggatctcctgccagcccagc

SEQ ID NO: 4673376 - DNA, 21 bp, Homo sapiens
ccaggatggaacacggccaca

SEQ ID NO: 4673377 - DNA, 23 bp, Homo sapiens
ccaggatggagcaagctcttccc

SEQ ID NO: 4673378 - DNA, 23 bp, Homo sapiens
ccaggattttaatttcaggaaaa

SEQ ID NO: 4673379 - DNA, 17 bp, Homo sapiens
ccaggcaaggaacagaa

SEQ ID NO: 4673380 - DNA, 13 bp, Homo sapiens
ccaggcaatggcc

SEQ ID NO: 4673381 - DNA, 19 bp, Homo sapiens
ccaggcaatggcctaaact

SEQ ID NO: 4673382 - DNA, 17 bp, Homo sapiens
ccaggcaccaggactag

SEQ ID NO: 4673383 - DNA, 22 bp, Homo sapiens
ccaggcacttaaagccttttcc

SEQ ID NO: 4673384 - DNA, 15 bp, Homo sapiens
ccaggccccacccct

SEQ ID NO: 4673385 - DNA, 16 bp, Homo sapiens
ccaggccccacccctt

SEQ ID NO: 4673386 - DNA, 18 bp, Homo sapiens
ccaggccccaccccttcc

SEQ ID NO: 4673387 - DNA, 19 bp, Homo sapiens
ccaggccccaccccttccc

SEQ ID NO: 4673388 - DNA, 16 bp, Homo sapiens
ccaggccccatgacct

SEQ ID NO: 4673389 - DNA, 21 bp, Homo sapiens
ccaggcctagtaaccaaggcc

SEQ ID NO: 4673390 - DNA, 13 bp, Homo sapiens
ccaggcctctgcc

SEQ ID NO: 4673391 - DNA, 21 bp, Homo sapiens
ccaggcctctgccccaagagc

SEQ ID NO: 4673392 - DNA, 13 bp, Homo sapiens
ccaggcctgcagc

SEQ ID NO: 4673393 - DNA, 14 bp, Homo sapiens
ccaggcctgcagca

SEQ ID NO: 4673394 - DNA, 17 bp, Homo sapiens
ccaggctgaccacagca

SEQ ID NO: 4673395 - DNA, 19 bp, Homo sapiens
ccaggctgaccacagcaca

SEQ ID NO: 4673396 - DNA, 20 bp, Homo sapiens
ccaggctgaccacagcacag

SEQ ID NO: 4673397 - DNA, 19 bp, Homo sapiens
ccaggctgggctctgcctg

SEQ ID NO: 4673398 - DNA, 15 bp, Homo sapiens
ccagggagctgatgt

SEQ ID NO: 4673399 - DNA, 15 bp, Homo sapiens
ccagggagctgcagg

SEQ ID NO: 4673400 - DNA, 19 bp, Homo sapiens
ccagggagctgcaggggca

SEQ ID NO: 4673401 - DNA, 12 bp, Homo sapiens
ccagggatgctg

SEQ ID NO: 4673402 - DNA, 23 bp, Homo sapiens
ccagggatgctgggctgggccct

SEQ ID NO: 4673403 - DNA, 12 bp, Homo sapiens
ccagggatgtct

SEQ ID NO: 4673404 - DNA, 14 bp, Homo sapiens
ccagggcacaggag

SEQ ID NO: 4673405 - DNA, 17 bp, Homo sapiens
ccagggcacaggagcta

SEQ ID NO: 4673406 - DNA, 20 bp, Homo sapiens
ccagggcacaggagctacct

SEQ ID NO: 4673407 - DNA, 22 bp, Homo sapiens
ccagggcacaggagctacctgt

SEQ ID NO: 4673408 - DNA, 16 bp, Homo sapiens
ccagggccctcccagc

SEQ ID NO: 4673409 - DNA, 14 bp, Homo sapiens
ccagggcctgcgag

SEQ ID NO: 4673410 - DNA, 11 bp, Homo sapiens
ccagggctggg

SEQ ID NO: 4673411 - DNA, 13 bp, Homo sapiens
ccagggctgggga

SEQ ID NO: 4673412 - DNA, 18 bp, Homo sapiens
ccagggctggggacagag

SEQ ID NO: 4673413 - DNA, 21 bp, Homo sapiens
ccagggcttacggccctggcc

SEQ ID NO: 4673414 - DNA, 14 bp, Homo sapiens
ccaggggaggagcc

SEQ ID NO: 4673415 - DNA, 16 bp, Homo sapiens
ccaggggaggagcctg

SEQ ID NO: 4673416 - DNA, 13 bp, Homo sapiens
ccaggggcctgca

SEQ ID NO: 4673417 - DNA, 14 bp, Homo sapiens
ccaggggcctgcag

SEQ ID NO: 4673418 - DNA, 15 bp, Homo sapiens
ccaggggcctgcaga

SEQ ID NO: 4673419 - DNA, 18 bp, Homo sapiens
ccagggtctctccctcag

SEQ ID NO: 4673420 - DNA, 16 bp, Homo sapiens
ccagggtctgtgtgaa

SEQ ID NO: 4673421 - DNA, 22 bp, Homo sapiens
ccagggtctgtgtgaatgtggg

SEQ ID NO: 4673422 - DNA, 19 bp, Homo sapiens
ccaggtacaggagaggcag

SEQ ID NO: 4673423 - DNA, 20 bp, Homo sapiens
ccaggtactgcattctctcc

SEQ ID NO: 4673424 - DNA, 16 bp, Homo sapiens
ccaggtagttggaact

SEQ ID NO: 4673425 - DNA, 22 bp, Homo sapiens
ccaggtagttggaactttctgt

SEQ ID NO: 4673426 - DNA, 15 bp, Homo sapiens
ccaggtatggctctg

SEQ ID NO: 4673427 - DNA, 19 bp, Homo sapiens
ccaggtctcctgggaaagg

SEQ ID NO: 4673428 - DNA, 23 bp, Homo sapiens
ccaggtctcctgggaaagggaga

SEQ ID NO: 4673429 - DNA, 18 bp, Homo sapiens
ccaggtgcaaccagggag

SEQ ID NO: 4673430 - DNA, 15 bp, Homo sapiens
ccaggtggaaggcag

SEQ ID NO: 4673431 - DNA, 20 bp, Homo sapiens
ccaggtggcccttcccggca

SEQ ID NO: 4673432 - DNA, 19 bp, Homo sapiens
cccaaggacagttcagaga

SEQ ID NO: 4673433 - DNA, 12 bp, Homo sapiens
cccaaggaccca

SEQ ID NO: 4673434 - DNA, 13 bp, Homo sapiens
cccaaggacccag

SEQ ID NO: 4673435 - DNA, 17 bp, Homo sapiens
cccaaggacccagccct

SEQ ID NO: 4673436 - DNA, 23 bp, Homo sapiens
cccaaggactgagggcagtgccc

SEQ ID NO: 4673437 - DNA, 13 bp, Homo sapiens
cccaagggccctg

SEQ ID NO: 4673438 - DNA, 14 bp, Homo sapiens
cccaagggccctgg

SEQ ID NO: 4673439 - DNA, 16 bp, Homo sapiens
cccaagggccctggca

SEQ ID NO: 4673440 - DNA, 14 bp, Homo sapiens
cccacaagctgtcc

SEQ ID NO: 4673441 - DNA, 16 bp, Homo sapiens
cccacaagctgtccct

SEQ ID NO: 4673442 - DNA, 18 bp, Homo sapiens
cccacaagctgtccctgc

SEQ ID NO: 4673443 - DNA, 19 bp, Homo sapiens
cccacaagctgtccctgca

SEQ ID NO: 4673444 - DNA, 22 bp, Homo sapiens
cccacaagctgtccctgcaggg

SEQ ID NO: 4673445 - DNA, 13 bp, Homo sapiens
cccacaaggcctg

SEQ ID NO: 4673446 - DNA, 18 bp, Homo sapiens
cccacaaggcctggtctg

SEQ ID NO: 4673447 - DNA, 13 bp, Homo sapiens
cccacatccctgg

SEQ ID NO: 4673448 - DNA, 16 bp, Homo sapiens
cccacatccctgggcc

SEQ ID NO: 4673449 - DNA, 17 bp, Homo sapiens
cccacatccctgggcct

SEQ ID NO: 4673450 - DNA, 24 bp, Homo sapiens
cccacatccctgggcctgctgctg

SEQ ID NO: 4673451 - DNA, 16 bp, Homo sapiens
cccacatgtgacacat

SEQ ID NO: 4673452 - DNA, 21 bp, Homo sapiens
cccaccaggggaaggaaggag

SEQ ID NO: 4673453 - DNA, 12 bp, Homo sapiens
cccaccattcct

SEQ ID NO: 4673454 - DNA, 13 bp, Homo sapiens
cccaccattcctg

SEQ ID NO: 4673455 - DNA, 15 bp, Homo sapiens
cccaccccctgcctg

SEQ ID NO: 4673456 - DNA, 17 bp, Homo sapiens
cccaccccctgcctggt

SEQ ID NO: 4673457 - DNA, 15 bp, Homo sapiens
cccaccccttcccta

SEQ ID NO: 4673458 - DNA, 13 bp, Homo sapiens
cccaccctcctgt

SEQ ID NO: 4673459 - DNA, 12 bp, Homo sapiens
cccacccttggg

SEQ ID NO: 4673460 - DNA, 13 bp, Homo sapiens
cccacccttgtcc

SEQ ID NO: 4673461 - DNA, 18 bp, Homo sapiens
cccaccgggccactcctt

SEQ ID NO: 4673462 - DNA, 12 bp, Homo sapiens
cccacctcagcc

SEQ ID NO: 4673463 - DNA, 17 bp, Homo sapiens
cccactccgccagccac

SEQ ID NO: 4673464 - DNA, 18 bp, Homo sapiens
cccactccgccagccaca

SEQ ID NO: 4673465 - DNA, 19 bp, Homo sapiens
cccactccgccagccacag

SEQ ID NO: 4673466 - DNA, 20 bp, Homo sapiens
cccactccgccagccacagg

SEQ ID NO: 4673467 - DNA, 17 bp, Homo sapiens
cccagactactattttc

SEQ ID NO: 4673468 - DNA, 13 bp, Homo sapiens
cccagagaacagc

SEQ ID NO: 4673469 - DNA, 16 bp, Homo sapiens
cccagagcccctcctc

SEQ ID NO: 4673470 - DNA, 14 bp, Homo sapiens
cccagagctgtgcc

SEQ ID NO: 4673471 - DNA, 17 bp, Homo sapiens
cccagaggagcccagcg

SEQ ID NO: 4673472 - DNA, 23 bp, Homo sapiens
cccagcaagacctcatctgtgga

SEQ ID NO: 4673473 - DNA, 14 bp, Homo sapiens
cccagcaaggcaga

SEQ ID NO: 4673474 - DNA, 21 bp, Homo sapiens
cccagcaaggcagaagcttgg

SEQ ID NO: 4673475 - DNA, 15 bp, Homo sapiens
cccagcatccctgga

SEQ ID NO: 4673476 - DNA, 17 bp, Homo sapiens
cccagcatccctggagc

SEQ ID NO: 4673477 - DNA, 15 bp, Homo sapiens
cccagcatctcccag

SEQ ID NO: 4673478 - DNA, 22 bp, Homo sapiens
cccagcccatccattaggccag

SEQ ID NO: 4673479 - DNA, 15 bp, Homo sapiens
cccagcccattgctg

SEQ ID NO: 4673480 - DNA, 16 bp, Homo sapiens
cccagcccattgctgc

SEQ ID NO: 4673481 - DNA, 18 bp, Homo sapiens
cccagccccttcccctgg

SEQ ID NO: 4673482 - DNA, 11 bp, Homo sapiens
cccagccctgg

SEQ ID NO: 4673483 - DNA, 21 bp, Homo sapiens
cccagccctgggaaccactcc

SEQ ID NO: 4673484 - DNA, 22 bp, Homo sapiens
cccagccctgggaaccactccc

SEQ ID NO: 4673485 - DNA, 23 bp, Homo sapiens
cccagccctgggaaccactccca

SEQ ID NO: 4673486 - DNA, 14 bp, Homo sapiens
cccagccctggggg

SEQ ID NO: 4673487 - DNA, 11 bp, Homo sapiens
cccagcctggg

SEQ ID NO: 4673488 - DNA, 14 bp, Homo sapiens
cccagcctgggcct

SEQ ID NO: 4673489 - DNA, 14 bp, Homo sapiens
cccagcgattccct

SEQ ID NO: 4673490 - DNA, 17 bp, Homo sapiens
cccagcgccatcctgag

SEQ ID NO: 4673491 - DNA, 18 bp, Homo sapiens
cccagcggacagtggcag

SEQ ID NO: 4673492 - DNA, 20 bp, Homo sapiens
cccagcggacagtggcagga

SEQ ID NO: 4673493 - DNA, 16 bp, Homo sapiens
cccagctcccccaggc

SEQ ID NO: 4673494 - DNA, 19 bp, Homo sapiens
cccagctcccccaggcaga

SEQ ID NO: 4673495 - DNA, 21 bp, Homo sapiens
cccagctcccccaggcagaaa

SEQ ID NO: 4673496 - DNA, 18 bp, Homo sapiens
cccagctgaaggcagtgg

SEQ ID NO: 4673497 - DNA, 11 bp, Homo sapiens
cccagctgttt

SEQ ID NO: 4673498 - DNA, 23 bp, Homo sapiens
cccagcttcacctctgggacccc

SEQ ID NO: 4673499 - DNA, 18 bp, Homo sapiens
cccaggaaaggaggacca

SEQ ID NO: 4673500 - DNA, 19 bp, Homo sapiens
cccaggaaaggaggaccag

SEQ ID NO: 4673501 - DNA, 20 bp, Homo sapiens
cccaggaaaggaggaccagt

SEQ ID NO: 4673502 - DNA, 20 bp, Homo sapiens
cccaggatctcctgccagcc

SEQ ID NO: 4673503 - DNA, 21 bp, Homo sapiens
cccaggatctcctgccagccc

SEQ ID NO: 4673504 - DNA, 23 bp, Homo sapiens
cccaggatctcctgccagcccag

SEQ ID NO: 4673505 - DNA, 13 bp, Homo sapiens
cccaggcaaggaa

SEQ ID NO: 4673506 - DNA, 17 bp, Homo sapiens
cccaggcaaggaacaga

SEQ ID NO: 4673507 - DNA, 13 bp, Homo sapiens
cccaggcctctgc

SEQ ID NO: 4673508 - DNA, 14 bp, Homo sapiens
cccaggcctctgcc

SEQ ID NO: 4673509 - DNA, 18 bp, Homo sapiens
cccagggaggccgaagct

SEQ ID NO: 4673510 - DNA, 15 bp, Homo sapiens
cccagggcacaggag

SEQ ID NO: 4673511 - DNA, 16 bp, Homo sapiens
cccagggcacaggagc

SEQ ID NO: 4673512 - DNA, 22 bp, Homo sapiens
cccagggcttacggccctggcc

SEQ ID NO: 4673513 - DNA, 19 bp, Homo sapiens
cccagggttaatagggcct

SEQ ID NO: 4673514 - DNA, 16 bp, Homo sapiens
cccaggtgagaattca

SEQ ID NO: 4673515 - DNA, 18 bp, Homo sapiens
cccaggtgagggaaggag

SEQ ID NO: 4673516 - DNA, 22 bp, Homo sapiens
cccagtcggccccatctctcat

SEQ ID NO: 4673517 - DNA, 15 bp, Homo sapiens
cccagtctcctctcc

SEQ ID NO: 4673518 - DNA, 12 bp, Homo sapiens
cccagtgcaaac

SEQ ID NO: 4673519 - DNA, 16 bp, Homo sapiens
cccagtgcaaaccact

SEQ ID NO: 4673520 - DNA, 22 bp, Homo sapiens
cccagttacttttttacactga

SEQ ID NO: 4673521 - DNA, 18 bp, Homo sapiens
cccagttcctatgacaca

SEQ ID NO: 4673522 - DNA, 20 bp, Homo sapiens
cccagttcctatgacacagt

SEQ ID NO: 4673523 - DNA, 22 bp, Homo sapiens
cccagttcttcatttggaggaa

SEQ ID NO: 4673524 - DNA, 19 bp, Homo sapiens
cccatatattaccccttca

SEQ ID NO: 4673525 - DNA, 13 bp, Homo sapiens
cccatcagccctg

SEQ ID NO: 4673526 - DNA, 14 bp, Homo sapiens
cccatcagccctgc

SEQ ID NO: 4673527 - DNA, 16 bp, Homo sapiens
cccatcagccctgcta

SEQ ID NO: 4673528 - DNA, 19 bp, Homo sapiens
cccatcatgtggccccacc

SEQ ID NO: 4673529 - DNA, 19 bp, Homo sapiens
cccatccattaggccagca

SEQ ID NO: 4673530 - DNA, 14 bp, Homo sapiens
cccatccccagcga

SEQ ID NO: 4673531 - DNA, 22 bp, Homo sapiens
cccatctcatgcccctggctgg

SEQ ID NO: 4673532 - DNA, 15 bp, Homo sapiens
cccatgaaccctgcc

SEQ ID NO: 4673533 - DNA, 16 bp, Homo sapiens
cccatgaaccctgccc

SEQ ID NO: 4673534 - DNA, 18 bp, Homo sapiens
cccatgaaccctgccctg

SEQ ID NO: 4673535 - DNA, 17 bp, Homo sapiens
cccatgagactgccctg

SEQ ID NO: 4673536 - DNA, 22 bp, Homo sapiens
cccatgagactgccctgcccag

SEQ ID NO: 4673537 - DNA, 18 bp, Homo sapiens
cccatggaggcagatgcc

SEQ ID NO: 4673538 - DNA, 23 bp, Homo sapiens
cccatggagggtatactgagggg

SEQ ID NO: 4673539 - DNA, 19 bp, Homo sapiens
cccatgttacttctctgag

SEQ ID NO: 4673540 - DNA, 20 bp, Homo sapiens
cccatgttacttctctgagt

SEQ ID NO: 4673541 - DNA, 14 bp, Homo sapiens
cccattaatcttga

SEQ ID NO: 4673542 - DNA, 19 bp, Homo sapiens
cccgtgggtgggcctggcc

SEQ ID NO: 4673543 - DNA, 20 bp, Homo sapiens
cccgtgggtgggcctggccc

SEQ ID NO: 4673544 - DNA, 17 bp, Homo sapiens
ccctaagtcacatatca

SEQ ID NO: 4673545 - DNA, 22 bp, Homo sapiens
ccctaagtcacatatcagaata

SEQ ID NO: 4673546 - DNA, 14 bp, Homo sapiens
ccctacacagggcc

SEQ ID NO: 4673547 - DNA, 20 bp, Homo sapiens
ccctactacccattgttccc

SEQ ID NO: 4673548 - DNA, 12 bp, Homo sapiens
ccctagggactg

SEQ ID NO: 4673549 - DNA, 17 bp, Homo sapiens
ccctatagaccactggg

SEQ ID NO: 4673550 - DNA, 19 bp, Homo sapiens
ccctataggaacagcccag

SEQ ID NO: 4673551 - DNA, 18 bp, Homo sapiens
ccctatggagaggcttcc

SEQ ID NO: 4673552 - DNA, 18 bp, Homo sapiens
ccctcagacatttatata

SEQ ID NO: 4673553 - DNA, 17 bp, Homo sapiens
ccctcagcaacatccca

SEQ ID NO: 4673554 - DNA, 15 bp, Homo sapiens
ccctcagctggtcct

SEQ ID NO: 4673555 - DNA, 21 bp, Homo sapiens
ccctcagctggtcctgaccag

SEQ ID NO: 4673556 - DNA, 18 bp, Homo sapiens
ccctcattactgggcctt

SEQ ID NO: 4673557 - DNA, 16 bp, Homo sapiens
ccctccaccagcctgc

SEQ ID NO: 4673558 - DNA, 21 bp, Homo sapiens
ccctccactcagctgtcctgc

SEQ ID NO: 4673559 - DNA, 12 bp, Homo sapiens
ccctccactgct

SEQ ID NO: 4673560 - DNA, 15 bp, Homo sapiens
ccctccattcccacc

SEQ ID NO: 4673561 - DNA, 16 bp, Homo sapiens
ccctccattcccaccc

SEQ ID NO: 4673562 - DNA, 17 bp, Homo sapiens
ccctccccatctgtgtt

SEQ ID NO: 4673563 - DNA, 12 bp, Homo sapiens
ccctcccctggg

SEQ ID NO: 4673564 - DNA, 13 bp, Homo sapiens
ccctcccctggga

SEQ ID NO: 4673565 - DNA, 22 bp, Homo sapiens
ccctccccttcgtgtttccccc

SEQ ID NO: 4673566 - DNA, 13 bp, Homo sapiens
ccctccctagctc

SEQ ID NO: 4673567 - DNA, 14 bp, Homo sapiens
ccctccctgtccca

SEQ ID NO: 4673568 - DNA, 16 bp, Homo sapiens
ccctcctcactcccta

SEQ ID NO: 4673569 - DNA, 19 bp, Homo sapiens
ccctcctcactccctaggc

SEQ ID NO: 4673570 - DNA, 21 bp, Homo sapiens
ccctcctcactccctaggccc

SEQ ID NO: 4673571 - DNA, 23 bp, Homo sapiens
ccctcctcactccctaggcccaa

SEQ ID NO: 4673572 - DNA, 21 bp, Homo sapiens
ccctcctccagcccctgtccc

SEQ ID NO: 4673573 - DNA, 22 bp, Homo sapiens
ccctcgcagagcccttctcgtt

SEQ ID NO: 4673574 - DNA, 13 bp, Homo sapiens
ccctctatttatt

SEQ ID NO: 4673575 - DNA, 13 bp, Homo sapiens
ccctctcgcctca

SEQ ID NO: 4673576 - DNA, 15 bp, Homo sapiens
ccctctctcctggac

SEQ ID NO: 4673577 - DNA, 11 bp, Homo sapiens
ccctctctctg

SEQ ID NO: 4673578 - DNA, 14 bp, Homo sapiens
ccctctgcctggga

SEQ ID NO: 4673579 - DNA, 17 bp, Homo sapiens
ccctctgcctgggatgc

SEQ ID NO: 4673580 - DNA, 15 bp, Homo sapiens
ccctcttgtcagtgt

SEQ ID NO: 4673581 - DNA, 21 bp, Homo sapiens
ccctcttgtcagtgtagacac

SEQ ID NO: 4673582 - DNA, 16 bp, Homo sapiens
ccctgacctgtgagcc

SEQ ID NO: 4673583 - DNA, 20 bp, Homo sapiens
ccctgacctgtgagcccagc

SEQ ID NO: 4673584 - DNA, 16 bp, Homo sapiens
ccctgaggagtctgag

SEQ ID NO: 4673585 - DNA, 18 bp, Homo sapiens
ccctgaggagtctgaggt

SEQ ID NO: 4673586 - DNA, 19 bp, Homo sapiens
ccctgaggcctagactctg

SEQ ID NO: 4673587 - DNA, 18 bp, Homo sapiens
ccctgaggtcagggagtg

SEQ ID NO: 4673588 - DNA, 21 bp, Homo sapiens
ccctgaggtcagggagtgctg

SEQ ID NO: 4673589 - DNA, 16 bp, Homo sapiens
ccctgcagaccctgcc

SEQ ID NO: 4673590 - DNA, 21 bp, Homo sapiens
ccctgcagcttgtagccagcc

SEQ ID NO: 4673591 - DNA, 13 bp, Homo sapiens
ccctgcagggcca

SEQ ID NO: 4673592 - DNA, 19 bp, Homo sapiens
ccctgcatctgtctgctct

SEQ ID NO: 4673593 - DNA, 14 bp, Homo sapiens
ccctgcccctgtgg

SEQ ID NO: 4673594 - DNA, 11 bp, Homo sapiens
ccctgcctgga

SEQ ID NO: 4673595 - DNA, 14 bp, Homo sapiens
ccctgcctggagga

SEQ ID NO: 4673596 - DNA, 23 bp, Homo sapiens
ccctgcctggaggacctgagcct

SEQ ID NO: 4673597 - DNA, 11 bp, Homo sapiens
ccctgcctggt

SEQ ID NO: 4673598 - DNA, 19 bp, Homo sapiens
ccctgcctggttctaggct

SEQ ID NO: 4673599 - DNA, 22 bp, Homo sapiens
ccctgcctggttctaggctgct

SEQ ID NO: 4673600 - DNA, 16 bp, Homo sapiens
ccctgccttaacctgg

SEQ ID NO: 4673601 - DNA, 19 bp, Homo sapiens
ccctgccttaacctgggac

SEQ ID NO: 4673602 - DNA, 17 bp, Homo sapiens
ccctgcggtagatggga

SEQ ID NO: 4673603 - DNA, 11 bp, Homo sapiens
ccctgctacct

SEQ ID NO: 4673604 - DNA, 16 bp, Homo sapiens
ccctgctacctgttct

SEQ ID NO: 4673605 - DNA, 22 bp, Homo sapiens
ccctgctctgcccaggcaagga

SEQ ID NO: 4673606 - DNA, 21 bp, Homo sapiens
ccctgctgtgccatgctgggc

SEQ ID NO: 4673607 - DNA, 14 bp, Homo sapiens
ccctgcttccacct

SEQ ID NO: 4673608 - DNA, 18 bp, Homo sapiens
ccctgcttccacctcacc

SEQ ID NO: 4673609 - DNA, 21 bp, Homo sapiens
ccctggaaggacatccatgtt

SEQ ID NO: 4673610 - DNA, 13 bp, Homo sapiens
ccctggaccacga

SEQ ID NO: 4673611 - DNA, 14 bp, Homo sapiens
ccctggagcaggag

SEQ ID NO: 4673612 - DNA, 12 bp, Homo sapiens
ccctggagccag

SEQ ID NO: 4673613 - DNA, 12 bp, Homo sapiens
ccctggagggca

SEQ ID NO: 4673614 - DNA, 20 bp, Homo sapiens
ccctggagggcaagccctgc

SEQ ID NO: 4673615 - DNA, 23 bp, Homo sapiens
ccctggaggggacttccacacct

SEQ ID NO: 4673616 - DNA, 18 bp, Homo sapiens
ccctggaggtctccaggg

SEQ ID NO: 4673617 - DNA, 19 bp, Homo sapiens
ccctggaggtctccagggg

SEQ ID NO: 4673618 - DNA, 21 bp, Homo sapiens
ccctggaggtctccaggggcc

SEQ ID NO: 4673619 - DNA, 16 bp, Homo sapiens
ccctggatcagcgtgg

SEQ ID NO: 4673620 - DNA, 11 bp, Homo sapiens
ccctggcaccc

SEQ ID NO: 4673621 - DNA, 17 bp, Homo sapiens
ccctggccacagccttc

SEQ ID NO: 4673622 - DNA, 13 bp, Homo sapiens
ccctggccccagg

SEQ ID NO: 4673623 - DNA, 11 bp, Homo sapiens
ccctggccccc

SEQ ID NO: 4673624 - DNA, 23 bp, Homo sapiens
ccctggcccccatcagccctgct

SEQ ID NO: 4673625 - DNA, 18 bp, Homo sapiens
ccctggcctgaactgagg

SEQ ID NO: 4673626 - DNA, 20 bp, Homo sapiens
ccctgggaactctcctggcc

SEQ ID NO: 4673627 - DNA, 20 bp, Homo sapiens
ccctgggactttcccaccca

SEQ ID NO: 4673628 - DNA, 24 bp, Homo sapiens
ccctgggaggcgggcgcactgcct

SEQ ID NO: 4673629 - DNA, 17 bp, Homo sapiens
ccctgggattcaggaaa

SEQ ID NO: 4673630 - DNA, 12 bp, Homo sapiens
ccctgggccagg

SEQ ID NO: 4673631 - DNA, 13 bp, Homo sapiens
ccctgggccaggg

SEQ ID NO: 4673632 - DNA, 10 bp, Homo sapiens
ccctgggccc

SEQ ID NO: 4673633 - DNA, 11 bp, Homo sapiens
ccctgggcctg

SEQ ID NO: 4673634 - DNA, 17 bp, Homo sapiens
ccctgggcctgctgctg

SEQ ID NO: 4673635 - DNA, 15 bp, Homo sapiens
ccctgggctggggag

SEQ ID NO: 4673636 - DNA, 12 bp, Homo sapiens
ccctggggcctg

SEQ ID NO: 4673637 - DNA, 22 bp, Homo sapiens
ccctggggcctgtactgcctgc

SEQ ID NO: 4673638 - DNA, 21 bp, Homo sapiens
ccctgggggtttaagctctgc

SEQ ID NO: 4673639 - DNA, 15 bp, Homo sapiens
ccctgtcccaccccc

SEQ ID NO: 4673640 - DNA, 22 bp, Homo sapiens
ccctgtcccacccccttccccc

SEQ ID NO: 4673641 - DNA, 16 bp, Homo sapiens
ccctgtcccagggccc

SEQ ID NO: 4673642 - DNA, 22 bp, Homo sapiens
ccctgtcccagggccctcccag

SEQ ID NO: 4673643 - DNA, 16 bp, Homo sapiens
ccctgtcccctaggga

SEQ ID NO: 4673644 - DNA, 18 bp, Homo sapiens
ccctgtcccctagggact

SEQ ID NO: 4673645 - DNA, 15 bp, Homo sapiens
ccctgtctctggcta

SEQ ID NO: 4673646 - DNA, 16 bp, Homo sapiens
ccctgtctctggctac

SEQ ID NO: 4673647 - DNA, 21 bp, Homo sapiens
ccctgtctctggctactccct

SEQ ID NO: 4673648 - DNA, 18 bp, Homo sapiens
ccctgtgggactcatcct

SEQ ID NO: 4673649 - DNA, 19 bp, Homo sapiens
ccctgtgggactcatcctt

SEQ ID NO: 4673650 - DNA, 11 bp, Homo sapiens
ccctgtgtgtg

SEQ ID NO: 4673651 - DNA, 24 bp, Homo sapiens
ccctgtgttctttccccaggggca

SEQ ID NO: 4673652 - DNA, 19 bp, Homo sapiens
cctaagagacacatacaga

SEQ ID NO: 4673653 - DNA, 14 bp, Homo sapiens
cctaataattgtat

SEQ ID NO: 4673654 - DNA, 17 bp, Homo sapiens
cctaataattgtatcta

SEQ ID NO: 4673655 - DNA, 22 bp, Homo sapiens
cctaatccctgggcattgcttt

SEQ ID NO: 4673656 - DNA, 13 bp, Homo sapiens
cctaatttacaag

SEQ ID NO: 4673657 - DNA, 16 bp, Homo sapiens
cctacaagatttcctt

SEQ ID NO: 4673658 - DNA, 14 bp, Homo sapiens
cctacacagggcct

SEQ ID NO: 4673659 - DNA, 15 bp, Homo sapiens
cctacagcactactg

SEQ ID NO: 4673660 - DNA, 21 bp, Homo sapiens
cctacagcactactgggtgtc

SEQ ID NO: 4673661 - DNA, 22 bp, Homo sapiens
cctacagcactactgggtgtca

SEQ ID NO: 4673662 - DNA, 15 bp, Homo sapiens
cctacagtgtacagt

SEQ ID NO: 4673663 - DNA, 16 bp, Homo sapiens
cctacagtgtacagtc

SEQ ID NO: 4673664 - DNA, 21 bp, Homo sapiens
cctacatatgctgatctttta

SEQ ID NO: 4673665 - DNA, 11 bp, Homo sapiens
cctaccaaagt

SEQ ID NO: 4673666 - DNA, 14 bp, Homo sapiens
cctaccctggactt

SEQ ID NO: 4673667 - DNA, 19 bp, Homo sapiens
cctaccgctggccctgccg

SEQ ID NO: 4673668 - DNA, 23 bp, Homo sapiens
cctactcacacaggcatttcctg

SEQ ID NO: 4673669 - DNA, 17 bp, Homo sapiens
cctagaacctccctcct

SEQ ID NO: 4673670 - DNA, 20 bp, Homo sapiens
cctagactctgtctacctgg

SEQ ID NO: 4673671 - DNA, 12 bp, Homo sapiens
cctagcagcacc

SEQ ID NO: 4673672 - DNA, 20 bp, Homo sapiens
cctagcaggaacttctagct

SEQ ID NO: 4673673 - DNA, 21 bp, Homo sapiens
cctagcaggaacttctagctc

SEQ ID NO: 4673674 - DNA, 22 bp, Homo sapiens
cctagccaggtctcctgggaaa

SEQ ID NO: 4673675 - DNA, 21 bp, Homo sapiens
cctagctacttggcaggctga

SEQ ID NO: 4673676 - DNA, 23 bp, Homo sapiens
cctagctcttccccatctcactc

SEQ ID NO: 4673677 - DNA, 14 bp, Homo sapiens
cctagctggctctg

SEQ ID NO: 4673678 - DNA, 20 bp, Homo sapiens
cctaggatgtcatgtctgct

SEQ ID NO: 4673679 - DNA, 22 bp, Homo sapiens
cctagggactgtcctagccagg

SEQ ID NO: 4673680 - DNA, 17 bp, Homo sapiens
cctaggtaacgagggca

SEQ ID NO: 4673681 - DNA, 15 bp, Homo sapiens
cctagtaaccaaggc

SEQ ID NO: 4673682 - DNA, 18 bp, Homo sapiens
cctagtaaccaaggccct

SEQ ID NO: 4673683 - DNA, 16 bp, Homo sapiens
cctagtacaatcttgg

SEQ ID NO: 4673684 - DNA, 17 bp, Homo sapiens
cctagtatgccctgtaa

SEQ ID NO: 4673685 - DNA, 16 bp, Homo sapiens
cctataactgcccagc

SEQ ID NO: 4673686 - DNA, 18 bp, Homo sapiens
cctataatcttatacaac

SEQ ID NO: 4673687 - DNA, 19 bp, Homo sapiens
cctataggaacagcccagc

SEQ ID NO: 4673688 - DNA, 16 bp, Homo sapiens
cctatgacacagttat

SEQ ID NO: 4673689 - DNA, 16 bp, Homo sapiens
cctatgacttgggcac

SEQ ID NO: 4673690 - DNA, 20 bp, Homo sapiens
cctatgcacatatggactct

SEQ ID NO: 4673691 - DNA, 19 bp, Homo sapiens
cctatggagagccctggga

SEQ ID NO: 4673692 - DNA, 20 bp, Homo sapiens
cctatgtgattttaactctg

SEQ ID NO: 4673693 - DNA, 22 bp, Homo sapiens
cctatgtgattttaactctgtc

SEQ ID NO: 4673694 - DNA, 23 bp, Homo sapiens
cctatgtgattttaactctgtct

SEQ ID NO: 4673695 - DNA, 20 bp, Homo sapiens
cctattagatacacttctta

SEQ ID NO: 4673696 - DNA, 21 bp, Homo sapiens
cctattagatacacttcttaa

SEQ ID NO: 4673697 - DNA, 17 bp, Homo sapiens
cctcaagtgatcctccc

SEQ ID NO: 4673698 - DNA, 18 bp, Homo sapiens
cctcaagtgatcctccca

SEQ ID NO: 4673699 - DNA, 14 bp, Homo sapiens
cctcacaactcctt

SEQ ID NO: 4673700 - DNA, 21 bp, Homo sapiens
cctcacaactccttccatcct

SEQ ID NO: 4673701 - DNA, 17 bp, Homo sapiens
cctcacacaccctgagg

SEQ ID NO: 4673702 - DNA, 11 bp, Homo sapiens
cctcacacagc

SEQ ID NO: 4673703 - DNA, 22 bp, Homo sapiens
cctcaccccacttatccctctc

SEQ ID NO: 4673704 - DNA, 16 bp, Homo sapiens
cctcacccctcccctg

SEQ ID NO: 4673705 - DNA, 14 bp, Homo sapiens
cctcactaattttt

SEQ ID NO: 4673706 - DNA, 15 bp, Homo sapiens
cctcactccctaggc

SEQ ID NO: 4673707 - DNA, 18 bp, Homo sapiens
cctcactgaaaacatctg

SEQ ID NO: 4673708 - DNA, 11 bp, Homo sapiens
cctcacttcct

SEQ ID NO: 4673709 - DNA, 13 bp, Homo sapiens
cctcacttccttt

SEQ ID NO: 4673710 - DNA, 19 bp, Homo sapiens
cctcagcaacatcccatct

SEQ ID NO: 4673711 - DNA, 19 bp, Homo sapiens
cctcagctggtcctgacca

SEQ ID NO: 4673712 - DNA, 22 bp, Homo sapiens
cctcagctggtcctgaccagga

SEQ ID NO: 4673713 - DNA, 13 bp, Homo sapiens
cctcaggcacccg

SEQ ID NO: 4673714 - DNA, 14 bp, Homo sapiens
cctcaggcctctgt

SEQ ID NO: 4673715 - DNA, 11 bp, Homo sapiens
cctcaggtgcc

SEQ ID NO: 4673716 - DNA, 24 bp, Homo sapiens
cctcaggtgttttttatgaagtgc

SEQ ID NO: 4673717 - DNA, 15 bp, Homo sapiens
cctcagtccctcttc

SEQ ID NO: 4673718 - DNA, 23 bp, Homo sapiens
cctcatagccctcagacatttat

SEQ ID NO: 4673719 - DNA, 22 bp, Homo sapiens
cctcatctgtggagctgccaca

SEQ ID NO: 4673720 - DNA, 16 bp, Homo sapiens
cctcattactgggcct

SEQ ID NO: 4673721 - DNA, 17 bp, Homo sapiens
cctcattgtgtctcccg

SEQ ID NO: 4673722 - DNA, 14 bp, Homo sapiens
cctccaagcatttc

SEQ ID NO: 4673723 - DNA, 17 bp, Homo sapiens
cctccaagcatttcatg

SEQ ID NO: 4673724 - DNA, 18 bp, Homo sapiens
cctccaagcatttcatga

SEQ ID NO: 4673725 - DNA, 19 bp, Homo sapiens
cctccaatcctccccgctc

SEQ ID NO: 4673726 - DNA, 21 bp, Homo sapiens
cctccaatcctccccgctctg

SEQ ID NO: 4673727 - DNA, 18 bp, Homo sapiens
cctccaccttccgttccc

SEQ ID NO: 4673728 - DNA, 21 bp, Homo sapiens
cctccactcagctgtcctgca

SEQ ID NO: 4673729 - DNA, 15 bp, Homo sapiens
cctccactgctgggg

SEQ ID NO: 4673730 - DNA, 14 bp, Homo sapiens
cctccagcccctgt

SEQ ID NO: 4673731 - DNA, 12 bp, Homo sapiens
cctccagcctct

SEQ ID NO: 4673732 - DNA, 22 bp, Homo sapiens
cctccatttttatttcttcgtg

SEQ ID NO: 4673733 - DNA, 18 bp, Homo sapiens
cctcccaaaatgctggga

SEQ ID NO: 4673734 - DNA, 21 bp, Homo sapiens
cctcccaaaatggtgggatta

SEQ ID NO: 4673735 - DNA, 20 bp, Homo sapiens
cctcccatgagactgccctg

SEQ ID NO: 4673736 - DNA, 13 bp, Homo sapiens
cctccccagccca

SEQ ID NO: 4673737 - DNA, 15 bp, Homo sapiens
cctccccatctgtgt

SEQ ID NO: 4673738 - DNA, 11 bp, Homo sapiens
cctccccctgc

SEQ ID NO: 4673739 - DNA, 14 bp, Homo sapiens
cctccccctgcaac

SEQ ID NO: 4673740 - DNA, 14 bp, Homo sapiens
cctccccctgtccc

SEQ ID NO: 4673741 - DNA, 12 bp, Homo sapiens
cctcccctggga

SEQ ID NO: 4673742 - DNA, 16 bp, Homo sapiens
cctcccgccaggagct

SEQ ID NO: 4673743 - DNA, 14 bp, Homo sapiens
cctccctagctctt

SEQ ID NO: 4673744 - DNA, 15 bp, Homo sapiens
cctccctcctcactc

SEQ ID NO: 4673745 - DNA, 15 bp, Homo sapiens
cctccctgctgtgcc

SEQ ID NO: 4673746 - DNA, 23 bp, Homo sapiens
cctccctgctgtgccatgctggg

SEQ ID NO: 4673747 - DNA, 19 bp, Homo sapiens
cctccgacgctgcctctca

SEQ ID NO: 4673748 - DNA, 12 bp, Homo sapiens
cctcctccagcc

SEQ ID NO: 4673749 - DNA, 18 bp, Homo sapiens
cctcctccagcccctgtc

SEQ ID NO: 4673750 - DNA, 20 bp, Homo sapiens
cctcctccagcccctgtccc

SEQ ID NO: 4673751 - DNA, 17 bp, Homo sapiens
cctcctccctcctcact

SEQ ID NO: 4673752 - DNA, 15 bp, Homo sapiens
cctcctctctccctg

SEQ ID NO: 4673753 - DNA, 16 bp, Homo sapiens
cctcctctctccctgc

SEQ ID NO: 4673754 - DNA, 17 bp, Homo sapiens
cctcctctctccctgcc

SEQ ID NO: 4673755 - DNA, 14 bp, Homo sapiens
cctcctgcctttct

SEQ ID NO: 4673756 - DNA, 12 bp, Homo sapiens
cctcctgctttg

SEQ ID NO: 4673757 - DNA, 13 bp, Homo sapiens
cctcctgctttgg

SEQ ID NO: 4673758 - DNA, 21 bp, Homo sapiens
cctcctggacattttttcagt

SEQ ID NO: 4673759 - DNA, 12 bp, Homo sapiens
cctcctgtgggg

SEQ ID NO: 4673760 - DNA, 12 bp, Homo sapiens
cctccttcccca

SEQ ID NO: 4673761 - DNA, 21 bp, Homo sapiens
cctccttggctttatgcaaat

SEQ ID NO: 4673762 - DNA, 17 bp, Homo sapiens
cctgcagcccccactca

SEQ ID NO: 4673763 - DNA, 17 bp, Homo sapiens
cctgcagcttgtagcca

SEQ ID NO: 4673764 - DNA, 18 bp, Homo sapiens
cctgcagcttgtagccag

SEQ ID NO: 4673765 - DNA, 22 bp, Homo sapiens
cctgcaggcaggaacaaacagg

SEQ ID NO: 4673766 - DNA, 15 bp, Homo sapiens
cctgcagggccatct

SEQ ID NO: 4673767 - DNA, 16 bp, Homo sapiens
cctgcatctgtctgct

SEQ ID NO: 4673768 - DNA, 20 bp, Homo sapiens
cctgcatctgtctgctctgc

SEQ ID NO: 4673769 - DNA, 22 bp, Homo sapiens
cctgcatctgtctgctctgcat

SEQ ID NO: 4673770 - DNA, 18 bp, Homo sapiens
cctgcatggtcaagcctc

SEQ ID NO: 4673771 - DNA, 17 bp, Homo sapiens
cctgccagcccagctgg

SEQ ID NO: 4673772 - DNA, 22 bp, Homo sapiens
cctgcccaggtatcctggggga

SEQ ID NO: 4673773 - DNA, 22 bp, Homo sapiens
cctgcccattagagaagtattt

SEQ ID NO: 4673774 - DNA, 16 bp, Homo sapiens
cctgcccattggagag

SEQ ID NO: 4673775 - DNA, 22 bp, Homo sapiens
cctgcccccagagcgtccttgg

SEQ ID NO: 4673776 - DNA, 22 bp, Homo sapiens
cctgccccccctaagagacaca

SEQ ID NO: 4673777 - DNA, 19 bp, Homo sapiens
cctgcccctgtgggactca

SEQ ID NO: 4673778 - DNA, 17 bp, Homo sapiens
cctgccccttaacccca

SEQ ID NO: 4673779 - DNA, 16 bp, Homo sapiens
cctgcccgagggcagc

SEQ ID NO: 4673780 - DNA, 17 bp, Homo sapiens
cctgcccgagggcagcc

SEQ ID NO: 4673781 - DNA, 20 bp, Homo sapiens
cctgcccgcagacctctgga

SEQ ID NO: 4673782 - DNA, 17 bp, Homo sapiens
cctgccctctatttatt

SEQ ID NO: 4673783 - DNA, 15 bp, Homo sapiens
cctgcccttgaaccc

SEQ ID NO: 4673784 - DNA, 23 bp, Homo sapiens
cctgcccttgaaccccctccctg

SEQ ID NO: 4673785 - DNA, 21 bp, Homo sapiens
cctgcccttgtttggggcagg

SEQ ID NO: 4673786 - DNA, 10 bp, Homo sapiens
cctgcctcac

SEQ ID NO: 4673787 - DNA, 13 bp, Homo sapiens
cctgcctcacatc

SEQ ID NO: 4673788 - DNA, 12 bp, Homo sapiens
cctgcctcagga

SEQ ID NO: 4673789 - DNA, 19 bp, Homo sapiens
cctgcctcaggcctctgtg

SEQ ID NO: 4673790 - DNA, 15 bp, Homo sapiens
cctgcctcgccttgt

SEQ ID NO: 4673791 - DNA, 13 bp, Homo sapiens
cctgcctggagga

SEQ ID NO: 4673792 - DNA, 19 bp, Homo sapiens
cctgcctggaggacctgag

SEQ ID NO: 4673793 - DNA, 21 bp, Homo sapiens
cctgcctggaggacctgagcc

SEQ ID NO: 4673794 - DNA, 24 bp, Homo sapiens
cctgcctggaggacctgagcctgc

SEQ ID NO: 4673795 - DNA, 18 bp, Homo sapiens
cctgccttaacctgggac

SEQ ID NO: 4673796 - DNA, 20 bp, Homo sapiens
cctgcctttaagccaaagaa

SEQ ID NO: 4673797 - DNA, 19 bp, Homo sapiens
cctgcgcaagtgcctggga

SEQ ID NO: 4673798 - DNA, 17 bp, Homo sapiens
cctgcgcatatagactg

SEQ ID NO: 4673799 - DNA, 24 bp, Homo sapiens
cctgcgggtgaacaaagcagccac

SEQ ID NO: 4673800 - DNA, 17 bp, Homo sapiens
cctgctagacgcaccgc

SEQ ID NO: 4673801 - DNA, 15 bp, Homo sapiens
cctgctagtcgcccc

SEQ ID NO: 4673802 - DNA, 22 bp, Homo sapiens
cctgctagtcgcccctcagagc

SEQ ID NO: 4673803 - DNA, 17 bp, Homo sapiens
cctgctctagtgggaca

SEQ ID NO: 4673804 - DNA, 18 bp, Homo sapiens
cctgctctagtgggacag

SEQ ID NO: 4673805 - DNA, 19 bp, Homo sapiens
cctgctctagtgggacagc

SEQ ID NO: 4673806 - DNA, 16 bp, Homo sapiens
cctgctctgcccaggc

SEQ ID NO: 4673807 - DNA, 22 bp, Homo sapiens
cctgctctgcccaggcaaggaa

SEQ ID NO: 4673808 - DNA, 13 bp, Homo sapiens
cctgctgacagac

SEQ ID NO: 4673809 - DNA, 23 bp, Homo sapiens
cctgctgagatctgctgtcctgt

SEQ ID NO: 4673810 - DNA, 13 bp, Homo sapiens
cctgctgagctct

SEQ ID NO: 4673811 - DNA, 21 bp, Homo sapiens
cctgctgagctctgagaggcc

SEQ ID NO: 4673812 - DNA, 22 bp, Homo sapiens
cctgctgagctctgagaggccc

SEQ ID NO: 4673813 - DNA, 24 bp, Homo sapiens
cctgctgagctctgagaggccctg

SEQ ID NO: 4673814 - DNA, 12 bp, Homo sapiens
cctgctgcctgg

SEQ ID NO: 4673815 - DNA, 15 bp, Homo sapiens
cctgctgctgagaac

SEQ ID NO: 4673816 - DNA, 16 bp, Homo sapiens
cctgctgctgagaacc

SEQ ID NO: 4673817 - DNA, 19 bp, Homo sapiens
cctgctgctgagaacctgg

SEQ ID NO: 4673818 - DNA, 20 bp, Homo sapiens
cctgctgctgagaacctggc

SEQ ID NO: 4673819 - DNA, 23 bp, Homo sapiens
cctgctggagatcagcatgcctg

SEQ ID NO: 4673820 - DNA, 15 bp, Homo sapiens
cctgctggtacctgc

SEQ ID NO: 4673821 - DNA, 18 bp, Homo sapiens
cctgctggtacctgccct

SEQ ID NO: 4673822 - DNA, 20 bp, Homo sapiens
cctgctggtacctgccctct

SEQ ID NO: 4673823 - DNA, 14 bp, Homo sapiens
cctgcttctcctga

SEQ ID NO: 4673824 - DNA, 23 bp, Homo sapiens
cctgcttggggggtgatgagggc

SEQ ID NO: 4673825 - DNA, 13 bp, Homo sapiens
cctgctttctacg

SEQ ID NO: 4673826 - DNA, 22 bp, Homo sapiens
cctggaaggacatccatgttcc

SEQ ID NO: 4673827 - DNA, 22 bp, Homo sapiens
cctggaagtcaaataaatgttt

SEQ ID NO: 4673828 - DNA, 23 bp, Homo sapiens
cctggaagtcaaataaatgtttc

SEQ ID NO: 4673829 - DNA, 15 bp, Homo sapiens
cctggacagctgtgc

SEQ ID NO: 4673830 - DNA, 19 bp, Homo sapiens
cctggacagctgtgcctcg

SEQ ID NO: 4673831 - DNA, 18 bp, Homo sapiens
cctggacatagagaggga

SEQ ID NO: 4673832 - DNA, 20 bp, Homo sapiens
cctggacattttttcagtca

SEQ ID NO: 4673833 - DNA, 15 bp, Homo sapiens
cctggaccacgaggc

SEQ ID NO: 4673834 - DNA, 13 bp, Homo sapiens
cctggactggtta

SEQ ID NO: 4673835 - DNA, 21 bp, Homo sapiens
cctggactggttatcttgtta

SEQ ID NO: 4673836 - DNA, 16 bp, Homo sapiens
cctggacttaaagaaa

SEQ ID NO: 4673837 - DNA, 16 bp, Homo sapiens
cctggacttgcctctg

SEQ ID NO: 4673838 - DNA, 14 bp, Homo sapiens
cctggagaaggaag

SEQ ID NO: 4673839 - DNA, 20 bp, Homo sapiens
cctggagaaggaagctgcct

SEQ ID NO: 4673840 - DNA, 19 bp, Homo sapiens
cctggagacaaggtgctaa

SEQ ID NO: 4673841 - DNA, 22 bp, Homo sapiens
cctggagccccatcggccaaga

SEQ ID NO: 4673842 - DNA, 12 bp, Homo sapiens
cctggaggacct

SEQ ID NO: 4673843 - DNA, 15 bp, Homo sapiens
cctggaggacctgag

SEQ ID NO: 4673844 - DNA, 16 bp, Homo sapiens
cctggaggacctgagc

SEQ ID NO: 4673845 - DNA, 22 bp, Homo sapiens
cctggaggacctgagcctgccg

SEQ ID NO: 4673846 - DNA, 20 bp, Homo sapiens
cctggagggcaagccctgcc

SEQ ID NO: 4673847 - DNA, 21 bp, Homo sapiens
cctggagggcaagccctgccc

SEQ ID NO: 4673848 - DNA, 22 bp, Homo sapiens
cctggagggcaagccctgccca

SEQ ID NO: 4673849 - DNA, 21 bp, Homo sapiens
cctggaggtctccaggggcct

SEQ ID NO: 4673850 - DNA, 22 bp, Homo sapiens
cctggatgagaaacagctcagc

SEQ ID NO: 4673851 - DNA, 13 bp, Homo sapiens
cctggcacacatc

SEQ ID NO: 4673852 - DNA, 12 bp, Homo sapiens
cctggcatagag

SEQ ID NO: 4673853 - DNA, 13 bp, Homo sapiens
cctggcatagagt

SEQ ID NO: 4673854 - DNA, 15 bp, Homo sapiens
cctggccacagcctt

SEQ ID NO: 4673855 - DNA, 20 bp, Homo sapiens
cctggccacagccttccctc

SEQ ID NO: 4673856 - DNA, 16 bp, Homo sapiens
cctggcccccatcagc

SEQ ID NO: 4673857 - DNA, 19 bp, Homo sapiens
cctggcccccatcagccct

SEQ ID NO: 4673858 - DNA, 20 bp, Homo sapiens
cctggcccccatcagccctg

SEQ ID NO: 4673859 - DNA, 21 bp, Homo sapiens
cctggcccccatcagccctgc

SEQ ID NO: 4673860 - DNA, 14 bp, Homo sapiens
cctggcccctccaa

SEQ ID NO: 4673861 - DNA, 18 bp, Homo sapiens
cctggcccctccaatcct

SEQ ID NO: 4673862 - DNA, 15 bp, Homo sapiens
cctggcccctgcctg

SEQ ID NO: 4673863 - DNA, 13 bp, Homo sapiens
cctggccctgctt

SEQ ID NO: 4673864 - DNA, 17 bp, Homo sapiens
cctggcctcagagcttc

SEQ ID NO: 4673865 - DNA, 18 bp, Homo sapiens
cctggcctgaactgagga

SEQ ID NO: 4673866 - DNA, 19 bp, Homo sapiens
cctggcctgaactgaggag

SEQ ID NO: 4673867 - DNA, 15 bp, Homo sapiens
cctggcctggcacac

SEQ ID NO: 4673868 - DNA, 16 bp, Homo sapiens
cctggcctggcacaca

SEQ ID NO: 4673869 - DNA, 18 bp, Homo sapiens
cctggccttcagtgtacc

SEQ ID NO: 4673870 - DNA, 20 bp, Homo sapiens
cctggccttctaggaatgga

SEQ ID NO: 4673871 - DNA, 16 bp, Homo sapiens
aacattgctgatgtag

SEQ ID NO: 4673872 - DNA, 17 bp, Homo sapiens
aacattggacagaaaat

SEQ ID NO: 4673873 - DNA, 12 bp, Homo sapiens
aacatttaaatt

SEQ ID NO: 4673874 - DNA, 23 bp, Homo sapiens
aacattttagctctattgatact

SEQ ID NO: 4673875 - DNA, 23 bp, Homo sapiens
aacattttatcattaaaaattac

SEQ ID NO: 4673876 - DNA, 23 bp, Homo sapiens
aaccaaacatcccccaatgacct

SEQ ID NO: 4673877 - DNA, 20 bp, Homo sapiens
aaccaaacttgttcatttag

SEQ ID NO: 4673878 - DNA, 13 bp, Homo sapiens
aaccacagcagga

SEQ ID NO: 4673879 - DNA, 21 bp, Homo sapiens
aaccactcccaccacaggcat

SEQ ID NO: 4673880 - DNA, 13 bp, Homo sapiens
aaccacttctcca

SEQ ID NO: 4673881 - DNA, 20 bp, Homo sapiens
aaccacttctccatgctgca

SEQ ID NO: 4673882 - DNA, 21 bp, Homo sapiens
aaccagcccgacagtgccatc

SEQ ID NO: 4673883 - DNA, 15 bp, Homo sapiens
aaccagggagctgca

SEQ ID NO: 4673884 - DNA, 14 bp, Homo sapiens
aaccagggatgtct

SEQ ID NO: 4673885 - DNA, 20 bp, Homo sapiens
aaccagggatgtctgttgaa

SEQ ID NO: 4673886 - DNA, 17 bp, Homo sapiens
aaccaggggacactttg

SEQ ID NO: 4673887 - DNA, 13 bp, Homo sapiens
aaccagtgccaag

SEQ ID NO: 4673888 - DNA, 14 bp, Homo sapiens
aaccataaaagaag

SEQ ID NO: 4673889 - DNA, 21 bp, Homo sapiens
aaccatccacttacatatatt

SEQ ID NO: 4673890 - DNA, 20 bp, Homo sapiens
aaccatgcctggtattttca

SEQ ID NO: 4673891 - DNA, 23 bp, Homo sapiens
aaccattgtaactattaaccttt

SEQ ID NO: 4673892 - DNA, 16 bp, Homo sapiens
aacccagtctcctctc

SEQ ID NO: 4673893 - DNA, 12 bp, Homo sapiens
aacccagttact

SEQ ID NO: 4673894 - DNA, 18 bp, Homo sapiens
aaccccctccctgtccca

SEQ ID NO: 4673895 - DNA, 20 bp, Homo sapiens
aaccccggggtgcccacagg

SEQ ID NO: 4673896 - DNA, 11 bp, Homo sapiens
aaccctgccct

SEQ ID NO: 4673897 - DNA, 17 bp, Homo sapiens
aaccctgccctgctctg

SEQ ID NO: 4673898 - DNA, 18 bp, Homo sapiens
aaccctgccctgctctgc

SEQ ID NO: 4673899 - DNA, 20 bp, Homo sapiens
aaccctgccctgctctgccc

SEQ ID NO: 4673900 - DNA, 21 bp, Homo sapiens
aaccctgggagtagctagttt

SEQ ID NO: 4673901 - DNA, 22 bp, Homo sapiens
aaccctgggctggggaggagga

SEQ ID NO: 4673902 - DNA, 19 bp, Homo sapiens
aaccgcccagtgcaggtat

SEQ ID NO: 4673903 - DNA, 17 bp, Homo sapiens
aaccgtggcccttcctg

SEQ ID NO: 4673904 - DNA, 19 bp, Homo sapiens
aaccgtggcccttcctgga

SEQ ID NO: 4673905 - DNA, 21 bp, Homo sapiens
aaccgtggcccttcctggaca

SEQ ID NO: 4673906 - DNA, 15 bp, Homo sapiens
aacctaataattgta

SEQ ID NO: 4673907 - DNA, 22 bp, Homo sapiens
aacctaggagggctctgagcca

SEQ ID NO: 4673908 - DNA, 16 bp, Homo sapiens
aacctccctcctttcc

SEQ ID NO: 4673909 - DNA, 12 bp, Homo sapiens
aacctcctctgt

SEQ ID NO: 4673910 - DNA, 14 bp, Homo sapiens
aacctcctctgtga

SEQ ID NO: 4673911 - DNA, 13 bp, Homo sapiens
aacctcctggaca

SEQ ID NO: 4673912 - DNA, 14 bp, Homo sapiens
aacctcggggtggg

SEQ ID NO: 4673913 - DNA, 12 bp, Homo sapiens
aacctctgcctc

SEQ ID NO: 4673914 - DNA, 18 bp, Homo sapiens
aacctctgcctcctgggt

SEQ ID NO: 4673915 - DNA, 18 bp, Homo sapiens
aacctctgcttcccaggt

SEQ ID NO: 4673916 - DNA, 13 bp, Homo sapiens
aacctctgttcag

SEQ ID NO: 4673917 - DNA, 16 bp, Homo sapiens
aacctctgttcagtgt

SEQ ID NO: 4673918 - DNA, 19 bp, Homo sapiens
aacctctgttccccaccca

SEQ ID NO: 4673919 - DNA, 21 bp, Homo sapiens
aacctgaaaagatgttgtgtc

SEQ ID NO: 4673920 - DNA, 16 bp, Homo sapiens
aacctgcacaggcttg

SEQ ID NO: 4673921 - DNA, 11 bp, Homo sapiens
aacctgggacc

SEQ ID NO: 4673922 - DNA, 16 bp, Homo sapiens
aacctgggaccaacct

SEQ ID NO: 4673923 - DNA, 22 bp, Homo sapiens
aacctggggtgaatacttattt

SEQ ID NO: 4673924 - DNA, 16 bp, Homo sapiens
aacctgtattactgaa

SEQ ID NO: 4673925 - DNA, 17 bp, Homo sapiens
aacctgtcattgtattc

SEQ ID NO: 4673926 - DNA, 22 bp, Homo sapiens
aacctgtgaccagtctgaccct

SEQ ID NO: 4673927 - DNA, 23 bp, Homo sapiens
aacctgttcttagagtgtagctg

SEQ ID NO: 4673928 - DNA, 22 bp, Homo sapiens
aaccttaattttacagcccttg

SEQ ID NO: 4673929 - DNA, 16 bp, Homo sapiens
aacctttgtttcaact

SEQ ID NO: 4673930 - DNA, 19 bp, Homo sapiens
aacgagggcaacagggagc

SEQ ID NO: 4673931 - DNA, 13 bp, Homo sapiens
aacgcagaagagg

SEQ ID NO: 4673932 - DNA, 16 bp, Homo sapiens
aacgcagaagaggggg

SEQ ID NO: 4673933 - DNA, 23 bp, Homo sapiens
aacgcttgtagaactcactctgg

SEQ ID NO: 4673934 - DNA, 19 bp, Homo sapiens
aacggtctggcagggcagc

SEQ ID NO: 4673935 - DNA, 23 bp, Homo sapiens
aacgtgagagaaagagagaagcc

SEQ ID NO: 4673936 - DNA, 15 bp, Homo sapiens
aattaacacaaagga

SEQ ID NO: 4673937 - DNA, 15 bp, Homo sapiens
aattaactgtaaact

SEQ ID NO: 4673938 - DNA, 23 bp, Homo sapiens
aattaactgtaaacttggaatca

SEQ ID NO: 4673939 - DNA, 15 bp, Homo sapiens
aattaatgtttgtgg

SEQ ID NO: 4673940 - DNA, 13 bp, Homo sapiens
aattaccagtttt

SEQ ID NO: 4673941 - DNA, 17 bp, Homo sapiens
aattactactaggtaat

SEQ ID NO: 4673942 - DNA, 22 bp, Homo sapiens
aattagtcgggcatgagtctgt

SEQ ID NO: 4673943 - DNA, 23 bp, Homo sapiens
aattagtcgggcatgagtctgtt

SEQ ID NO: 4673944 - DNA, 24 bp, Homo sapiens
aattagtcgggcatgagtctgttt

SEQ ID NO: 4673945 - DNA, 19 bp, Homo sapiens
aattagtggtcataaaata

SEQ ID NO: 4673946 - DNA, 12 bp, Homo sapiens
aattataaatgt

SEQ ID NO: 4673947 - DNA, 22 bp, Homo sapiens
aattatacagacctaatatcat

SEQ ID NO: 4673948 - DNA, 19 bp, Homo sapiens
aattatatattgcaaggtg

SEQ ID NO: 4673949 - DNA, 16 bp, Homo sapiens
aattatgaaaagaaat

SEQ ID NO: 4673950 - DNA, 20 bp, Homo sapiens
aattattattattattttcc

SEQ ID NO: 4673951 - DNA, 14 bp, Homo sapiens
aattattgtagaca

SEQ ID NO: 4673952 - DNA, 15 bp, Homo sapiens
aattattgtagacat

SEQ ID NO: 4673953 - DNA, 13 bp, Homo sapiens
aattatttaagat

SEQ ID NO: 4673954 - DNA, 20 bp, Homo sapiens
aattcaagagctagaaaaat

SEQ ID NO: 4673955 - DNA, 15 bp, Homo sapiens
aattcaggcaaacgt

SEQ ID NO: 4673956 - DNA, 21 bp, Homo sapiens
aattcagtcctgggcaaaggt

SEQ ID NO: 4673957 - DNA, 22 bp, Homo sapiens
aattcatgacattatgtggaat

SEQ ID NO: 4673958 - DNA, 14 bp, Homo sapiens
aattcctacagcac

SEQ ID NO: 4673959 - DNA, 18 bp, Homo sapiens
aattcctacagcactact

SEQ ID NO: 4673960 - DNA, 19 bp, Homo sapiens
aattccttcgaaaggcctt

SEQ ID NO: 4673961 - DNA, 20 bp, Homo sapiens
aattcgcatgtttaatgtga

SEQ ID NO: 4673962 - DNA, 17 bp, Homo sapiens
aattctaacccaggtat

SEQ ID NO: 4673963 - DNA, 23 bp, Homo sapiens
aattctaccctggaaaagtgtta

SEQ ID NO: 4673964 - DNA, 18 bp, Homo sapiens
aattctccaggattttaa

SEQ ID NO: 4673965 - DNA, 20 bp, Homo sapiens
aattctgtcttgttcatttt

SEQ ID NO: 4673966 - DNA, 21 bp, Homo sapiens
aattcttgaaagaattttcct

SEQ ID NO: 4673967 - DNA, 23 bp, Homo sapiens
aattgacagatcaagctgtgaga

SEQ ID NO: 4673968 - DNA, 20 bp, Homo sapiens
aattgactcttatttataga

SEQ ID NO: 4673969 - DNA, 21 bp, Homo sapiens
aattgactcttatttatagaa

SEQ ID NO: 4673970 - DNA, 21 bp, Homo sapiens
aattgacttatttatataaat

SEQ ID NO: 4673971 - DNA, 17 bp, Homo sapiens
aattgcttttttaaata

SEQ ID NO: 4673972 - DNA, 21 bp, Homo sapiens
aattggtaaaactcactgtga

SEQ ID NO: 4673973 - DNA, 15 bp, Homo sapiens
aattgtaagtgaaat

SEQ ID NO: 4673974 - DNA, 19 bp, Homo sapiens
aattgtaagtgaaattaag

SEQ ID NO: 4673975 - DNA, 22 bp, Homo sapiens
aattgtatctacattaaaatga

SEQ ID NO: 4673976 - DNA, 23 bp, Homo sapiens
aattgtatctacattaaaatgac

SEQ ID NO: 4673977 - DNA, 18 bp, Homo sapiens
aattgtcagcaatttaac

SEQ ID NO: 4673978 - DNA, 15 bp, Homo sapiens
aattgttcctctttg

SEQ ID NO: 4673979 - DNA, 13 bp, Homo sapiens
aattgttttacct

SEQ ID NO: 4673980 - DNA, 22 bp, Homo sapiens
aattgttttacctgttctgaaa

SEQ ID NO: 4673981 - DNA, 20 bp, Homo sapiens
aattgttttgcactttttta

SEQ ID NO: 4673982 - DNA, 20 bp, Homo sapiens
aattgtttttattgttttct

SEQ ID NO: 4673983 - DNA, 23 bp, Homo sapiens
aatttaaaatccattttaggtga

SEQ ID NO: 4673984 - DNA, 17 bp, Homo sapiens
acattaaaatgacaaac

SEQ ID NO: 4673985 - DNA, 14 bp, Homo sapiens
acattaacggtgct

SEQ ID NO: 4673986 - DNA, 15 bp, Homo sapiens
acattaactccctcc

SEQ ID NO: 4673987 - DNA, 14 bp, Homo sapiens
acattatgaagaat

SEQ ID NO: 4673988 - DNA, 20 bp, Homo sapiens
acattatgtggaatcctaaa

SEQ ID NO: 4673989 - DNA, 17 bp, Homo sapiens
acattcagctctggaga

SEQ ID NO: 4673990 - DNA, 21 bp, Homo sapiens
acattcagctctggagaacag

SEQ ID NO: 4673991 - DNA, 15 bp, Homo sapiens
acattcgtgagctgg

SEQ ID NO: 4673992 - DNA, 18 bp, Homo sapiens
acattcgtgagctgggga

SEQ ID NO: 4673993 - DNA, 14 bp, Homo sapiens
acattctaatgcat

SEQ ID NO: 4673994 - DNA, 15 bp, Homo sapiens
acattctaatgcata

SEQ ID NO: 4673995 - DNA, 22 bp, Homo sapiens
acattcttagctgtaacttaac

SEQ ID NO: 4673996 - DNA, 20 bp, Homo sapiens
acattgatccagtcatttta

SEQ ID NO: 4673997 - DNA, 18 bp, Homo sapiens
acattgctgatgtagtat

SEQ ID NO: 4673998 - DNA, 17 bp, Homo sapiens
acattgttcaactccct

SEQ ID NO: 4673999 - DNA, 21 bp, Homo sapiens
acattgttcaactcccttctc

SEQ ID NO: 4674000 - DNA, 15 bp, Homo sapiens
acatttaaattccac

SEQ ID NO: 4674001 - DNA, 17 bp, Homo sapiens
acatttaaattccacag

SEQ ID NO: 4674002 - DNA, 21 bp, Homo sapiens
acatttctactctagatggca

SEQ ID NO: 4674003 - DNA, 18 bp, Homo sapiens
acatttggacatttccag

SEQ ID NO: 4674004 - DNA, 18 bp, Homo sapiens
acattttagctctattga

SEQ ID NO: 4674005 - DNA, 18 bp, Homo sapiens
acattttcagtaccaaag

SEQ ID NO: 4674006 - DNA, 13 bp, Homo sapiens
acattttctaaat

SEQ ID NO: 4674007 - DNA, 16 bp, Homo sapiens
acattttctaaataaa

SEQ ID NO: 4674008 - DNA, 13 bp, Homo sapiens
acattttctctta

SEQ ID NO: 4674009 - DNA, 16 bp, Homo sapiens
acattttctcttagag

SEQ ID NO: 4674010 - DNA, 17 bp, Homo sapiens
acattttgtaaaatatt

SEQ ID NO: 4674011 - DNA, 21 bp, Homo sapiens
acattttttctaataaagcca

SEQ ID NO: 4674012 - DNA, 18 bp, Homo sapiens
acattttttttttaaatc

SEQ ID NO: 4674013 - DNA, 19 bp, Homo sapiens
accaaacatcccccaatga

SEQ ID NO: 4674014 - DNA, 18 bp, Homo sapiens
accaaacttgttcattta

SEQ ID NO: 4674015 - DNA, 19 bp, Homo sapiens
accaagaagcctttcctgt

SEQ ID NO: 4674016 - DNA, 14 bp, Homo sapiens
accaagatttacca

SEQ ID NO: 4674017 - DNA, 14 bp, Homo sapiens
accaagcacagcag

SEQ ID NO: 4674018 - DNA, 17 bp, Homo sapiens
accaagcacagcagcct

SEQ ID NO: 4674019 - DNA, 13 bp, Homo sapiens
accaaggccctgc

SEQ ID NO: 4674020 - DNA, 14 bp, Homo sapiens
accaaggccctgca

SEQ ID NO: 4674021 - DNA, 18 bp, Homo sapiens
accaatattaccatctta

SEQ ID NO: 4674022 - DNA, 22 bp, Homo sapiens
accaatattaccatcttaatct

SEQ ID NO: 4674023 - DNA, 15 bp, Homo sapiens
accaatattgtacag

SEQ ID NO: 4674024 - DNA, 18 bp, Homo sapiens
accaatattgtacagttt

SEQ ID NO: 4674025 - DNA, 13 bp, Homo sapiens
accaattcaccca

SEQ ID NO: 4674026 - DNA, 12 bp, Homo sapiens
accacagcagga

SEQ ID NO: 4674027 - DNA, 16 bp, Homo sapiens
accaccacacccggct

SEQ ID NO: 4674028 - DNA, 21 bp, Homo sapiens
accaccctgccccccctaaga

SEQ ID NO: 4674029 - DNA, 19 bp, Homo sapiens
accacgccagctaattttt

SEQ ID NO: 4674030 - DNA, 13 bp, Homo sapiens
accactctggcag

SEQ ID NO: 4674031 - DNA, 17 bp, Homo sapiens
accacttctccatgctg

SEQ ID NO: 4674032 - DNA, 23 bp, Homo sapiens
accagactacttgggagcaccgc

SEQ ID NO: 4674033 - DNA, 17 bp, Homo sapiens
accagagtcagcacagg

SEQ ID NO: 4674034 - DNA, 21 bp, Homo sapiens
accagctgctgtgccccacca

SEQ ID NO: 4674035 - DNA, 21 bp, Homo sapiens
accagcttgtatgcaatggat

SEQ ID NO: 4674036 - DNA, 22 bp, Homo sapiens
accagcttgtatgcaatggatt

SEQ ID NO: 4674037 - DNA, 19 bp, Homo sapiens
accagggatgctgggctgg

SEQ ID NO: 4674038 - DNA, 22 bp, Homo sapiens
accagggccagagcagctccac

SEQ ID NO: 4674039 - DNA, 17 bp, Homo sapiens
accaggggaaggaagga

SEQ ID NO: 4674040 - DNA, 22 bp, Homo sapiens
accaggggaaggaaggagggca

SEQ ID NO: 4674041 - DNA, 15 bp, Homo sapiens
accaggggacacttt

SEQ ID NO: 4674042 - DNA, 15 bp, Homo sapiens
accaggggaggagcc

SEQ ID NO: 4674043 - DNA, 19 bp, Homo sapiens
accaggggaggagcctgtg

SEQ ID NO: 4674044 - DNA, 21 bp, Homo sapiens
accagtcaggatgaggccccg

SEQ ID NO: 4674045 - DNA, 15 bp, Homo sapiens
accagtgacgctgct

SEQ ID NO: 4674046 - DNA, 14 bp, Homo sapiens
accagtgccaagga

SEQ ID NO: 4674047 - DNA, 15 bp, Homo sapiens
accagtgccaaggac

SEQ ID NO: 4674048 - DNA, 17 bp, Homo sapiens
accagtgccaaggacct

SEQ ID NO: 4674049 - DNA, 20 bp, Homo sapiens
accagtgccacgtcatgagc

SEQ ID NO: 4674050 - DNA, 22 bp, Homo sapiens
accagtgccacgtcatgagcgt

SEQ ID NO: 4674051 - DNA, 19 bp, Homo sapiens
acttcatttttaagaaagg

SEQ ID NO: 4674052 - DNA, 21 bp, Homo sapiens
acttccaagctccaaatccaa

SEQ ID NO: 4674053 - DNA, 18 bp, Homo sapiens
acttccacctccagcctc

SEQ ID NO: 4674054 - DNA, 19 bp, Homo sapiens
acttccacctccagcctct

SEQ ID NO: 4674055 - DNA, 12 bp, Homo sapiens
acttccagcaag

SEQ ID NO: 4674056 - DNA, 18 bp, Homo sapiens
acttccagcttgcctgtt

SEQ ID NO: 4674057 - DNA, 19 bp, Homo sapiens
acttccccaagatctgcca

SEQ ID NO: 4674058 - DNA, 21 bp, Homo sapiens
acttccccctcttcttctgaa

SEQ ID NO: 4674059 - DNA, 22 bp, Homo sapiens
acttccccctcttcttctgaag

SEQ ID NO: 4674060 - DNA, 15 bp, Homo sapiens
acttcctctgtgaac

SEQ ID NO: 4674061 - DNA, 21 bp, Homo sapiens
acttcctgactctcacctgta

SEQ ID NO: 4674062 - DNA, 18 bp, Homo sapiens
acttcctttgcccttcct

SEQ ID NO: 4674063 - DNA, 19 bp, Homo sapiens
acttcctttgcccttcctc

SEQ ID NO: 4674064 - DNA, 15 bp, Homo sapiens
acttcgctcttgagg

SEQ ID NO: 4674065 - DNA, 17 bp, Homo sapiens
acttcggggctgggaag

SEQ ID NO: 4674066 - DNA, 12 bp, Homo sapiens
acttctagctca

SEQ ID NO: 4674067 - DNA, 20 bp, Homo sapiens
acttctcaggacacaggcct

SEQ ID NO: 4674068 - DNA, 21 bp, Homo sapiens
acttctcaggacacaggcctg

SEQ ID NO: 4674069 - DNA, 16 bp, Homo sapiens
acttctccatgctgca

SEQ ID NO: 4674070 - DNA, 21 bp, Homo sapiens
acttcttaaaggaattctaca

SEQ ID NO: 4674071 - DNA, 15 bp, Homo sapiens
acttcttcacctctt

SEQ ID NO: 4674072 - DNA, 23 bp, Homo sapiens
acttcttgtcagacataaagcca

SEQ ID NO: 4674073 - DNA, 24 bp, Homo sapiens
acttcttgtcagacataaagccat

SEQ ID NO: 4674074 - DNA, 23 bp, Homo sapiens
acttgagctgtctgaagcccaaa

SEQ ID NO: 4674075 - DNA, 20 bp, Homo sapiens
acttgagggaccaatattac

SEQ ID NO: 4674076 - DNA, 15 bp, Homo sapiens
acttgcctccatctt

SEQ ID NO: 4674077 - DNA, 15 bp, Homo sapiens
acttgctgctttttc

SEQ ID NO: 4674078 - DNA, 15 bp, Homo sapiens
acttgcttctctagc

SEQ ID NO: 4674079 - DNA, 14 bp, Homo sapiens
acttggcaggctga

SEQ ID NO: 4674080 - DNA, 22 bp, Homo sapiens
acttgggcacccccagcctggg

SEQ ID NO: 4674081 - DNA, 23 bp, Homo sapiens
acttgggcacccccagcctgggc

SEQ ID NO: 4674082 - DNA, 20 bp, Homo sapiens
acttggggagatggagttct

SEQ ID NO: 4674083 - DNA, 15 bp, Homo sapiens
acttggttctgaagc

SEQ ID NO: 4674084 - DNA, 16 bp, Homo sapiens
acttggttctgaagcc

SEQ ID NO: 4674085 - DNA, 17 bp, Homo sapiens
acttgtaatatttttat

SEQ ID NO: 4674086 - DNA, 18 bp, Homo sapiens
acttgtctgcctcctgct

SEQ ID NO: 4674087 - DNA, 14 bp, Homo sapiens
acttgtctttactg

SEQ ID NO: 4674088 - DNA, 11 bp, Homo sapiens
acttgtgtctg

SEQ ID NO: 4674089 - DNA, 11 bp, Homo sapiens
acttgttcatt

SEQ ID NO: 4674090 - DNA, 17 bp, Homo sapiens
actttacaaacctttgt

SEQ ID NO: 4674091 - DNA, 18 bp, Homo sapiens
actttacagaaatggact

SEQ ID NO: 4674092 - DNA, 21 bp, Homo sapiens
actttattgccttttaatttt

SEQ ID NO: 4674093 - DNA, 16 bp, Homo sapiens
actttatttatttcta

SEQ ID NO: 4674094 - DNA, 19 bp, Homo sapiens
actttcagaagtgccactt

SEQ ID NO: 4674095 - DNA, 13 bp, Homo sapiens
actttcagagccc

SEQ ID NO: 4674096 - DNA, 23 bp, Homo sapiens
actttcagagcccccagccctgg

SEQ ID NO: 4674097 - DNA, 18 bp, Homo sapiens
actttccaatgccacaga

SEQ ID NO: 4674098 - DNA, 13 bp, Homo sapiens
actttcccaccca

SEQ ID NO: 4674099 - DNA, 19 bp, Homo sapiens
actttcccacccaggaaag

SEQ ID NO: 4674100 - DNA, 15 bp, Homo sapiens
actttcctgtggttt

SEQ ID NO: 4674101 - DNA, 19 bp, Homo sapiens
actttcctttcaataaagt

SEQ ID NO: 4674102 - DNA, 22 bp, Homo sapiens
actttctcctggcccctgcctg

SEQ ID NO: 4674103 - DNA, 21 bp, Homo sapiens
actttctcggtccactcttgt

SEQ ID NO: 4674104 - DNA, 22 bp, Homo sapiens
actttctcggtccactcttgtt

SEQ ID NO: 4674105 - DNA, 15 bp, Homo sapiens
actttctctctttgt

SEQ ID NO: 4674106 - DNA, 19 bp, Homo sapiens
actttctgttccctatgga

SEQ ID NO: 4674107 - DNA, 15 bp, Homo sapiens
actttggaaaatgca

SEQ ID NO: 4674108 - DNA, 15 bp, Homo sapiens
actttggcttatgaa

SEQ ID NO: 4674109 - DNA, 13 bp, Homo sapiens
actttgtaaatag

SEQ ID NO: 4674110 - DNA, 23 bp, Homo sapiens
actttgtaaataggatttttaga

SEQ ID NO: 4674111 - DNA, 12 bp, Homo sapiens
actttgtgagcc

SEQ ID NO: 4674112 - DNA, 14 bp, Homo sapiens
actttgttagaaag

SEQ ID NO: 4674113 - DNA, 22 bp, Homo sapiens
acttttagtagagacagtgttt

SEQ ID NO: 4674114 - DNA, 20 bp, Homo sapiens
acttttatgagcttccaagg

SEQ ID NO: 4674115 - DNA, 13 bp, Homo sapiens
acttttattattt

SEQ ID NO: 4674116 - DNA, 14 bp, Homo sapiens
acttttcattctct

SEQ ID NO: 4674117 - DNA, 21 bp, Homo sapiens
acttttcctggacttaaagaa

SEQ ID NO: 4674118 - DNA, 23 bp, Homo sapiens
acttttcctggacttaaagaaaa

SEQ ID NO: 4674119 - DNA, 13 bp, Homo sapiens
acttttctgttta

SEQ ID NO: 4674120 - DNA, 20 bp, Homo sapiens
actttttacagcagcaatat

SEQ ID NO: 4674121 - DNA, 12 bp, Homo sapiens
actttttataaa

SEQ ID NO: 4674122 - DNA, 18 bp, Homo sapiens
acttttttacactgataa

SEQ ID NO: 4674123 - DNA, 22 bp, Homo sapiens
agaaaaaaaaaagaaatgcaaa

SEQ ID NO: 4674124 - DNA, 21 bp, Homo sapiens
agaaaaagcttaatgattctg

SEQ ID NO: 4674125 - DNA, 15 bp, Homo sapiens
agaaaaataaaatgt

SEQ ID NO: 4674126 - DNA, 21 bp, Homo sapiens
agaaaaatagagcaaaatcaa

SEQ ID NO: 4674127 - DNA, 23 bp, Homo sapiens
agaaaacattttttttttaaatc

SEQ ID NO: 4674128 - DNA, 18 bp, Homo sapiens
agaaaactcccaatacaa

SEQ ID NO: 4674129 - DNA, 20 bp, Homo sapiens
agaaaagtaatgaagaatca

SEQ ID NO: 4674130 - DNA, 21 bp, Homo sapiens
agaaaagtaatgaagaatcac

SEQ ID NO: 4674131 - DNA, 20 bp, Homo sapiens
agaaaagtaattttgtcaca

SEQ ID NO: 4674132 - DNA, 21 bp, Homo sapiens
actgaatgcataatgtttaaa

SEQ ID NO: 4674133 - DNA, 22 bp, Homo sapiens
actgaattgtcagatgtggagt

SEQ ID NO: 4674134 - DNA, 21 bp, Homo sapiens
actgaccaatattgtacagtt

SEQ ID NO: 4674135 - DNA, 16 bp, Homo sapiens
actgaccggtgctttt

SEQ ID NO: 4674136 - DNA, 21 bp, Homo sapiens
actgactcctcagtccctctt

SEQ ID NO: 4674137 - DNA, 23 bp, Homo sapiens
actgactgaaggaaaagcaagaa

SEQ ID NO: 4674138 - DNA, 19 bp, Homo sapiens
actgagaatctaggccacc

SEQ ID NO: 4674139 - DNA, 18 bp, Homo sapiens
actgaggagatgaccagg

SEQ ID NO: 4674140 - DNA, 14 bp, Homo sapiens
actgagggcagtgc

SEQ ID NO: 4674141 - DNA, 15 bp, Homo sapiens
actgagggcagtgcc

SEQ ID NO: 4674142 - DNA, 18 bp, Homo sapiens
actgagggcagtgccctt

SEQ ID NO: 4674143 - DNA, 22 bp, Homo sapiens
actgatgagtaaactgaggccc

SEQ ID NO: 4674144 - DNA, 13 bp, Homo sapiens
actgatgttgtgt

SEQ ID NO: 4674145 - DNA, 14 bp, Homo sapiens
actgattaaatatt

SEQ ID NO: 4674146 - DNA, 19 bp, Homo sapiens
actgattaaatatttgaag

SEQ ID NO: 4674147 - DNA, 20 bp, Homo sapiens
actgattcataataaatatc

SEQ ID NO: 4674148 - DNA, 17 bp, Homo sapiens
actgattgctcccagga

SEQ ID NO: 4674149 - DNA, 15 bp, Homo sapiens
actgcaacctctgcc

SEQ ID NO: 4674150 - DNA, 17 bp, Homo sapiens
actgcaacctctgcctc

SEQ ID NO: 4674151 - DNA, 22 bp, Homo sapiens
actgcaacctctgcctcctggg

SEQ ID NO: 4674152 - DNA, 23 bp, Homo sapiens
actgcaacctctgcctcctgggt

SEQ ID NO: 4674153 - DNA, 17 bp, Homo sapiens
actgcacttttttattg

SEQ ID NO: 4674154 - DNA, 22 bp, Homo sapiens
actgcagagtaaattgctctgt

SEQ ID NO: 4674155 - DNA, 14 bp, Homo sapiens
actgcagcacctcc

SEQ ID NO: 4674156 - DNA, 21 bp, Homo sapiens
actgcagcacctccaggcctg

SEQ ID NO: 4674157 - DNA, 22 bp, Homo sapiens
actgcagcagaaaggctctgaa

SEQ ID NO: 4674158 - DNA, 20 bp, Homo sapiens
actgcattattctcttttat

SEQ ID NO: 4674159 - DNA, 20 bp, Homo sapiens
actgcattctctcccatcct

SEQ ID NO: 4674160 - DNA, 21 bp, Homo sapiens
actgccaagccagattctctt

SEQ ID NO: 4674161 - DNA, 23 bp, Homo sapiens
actgccaatatagaaaaataaaa

SEQ ID NO: 4674162 - DNA, 16 bp, Homo sapiens
actgcccagcggacag

SEQ ID NO: 4674163 - DNA, 12 bp, Homo sapiens
actgccccacgt

SEQ ID NO: 4674164 - DNA, 21 bp, Homo sapiens
actgccccacgttgtccctga

SEQ ID NO: 4674165 - DNA, 14 bp, Homo sapiens
actgccccctcctg

SEQ ID NO: 4674166 - DNA, 18 bp, Homo sapiens
actgccccctcctgtgta

SEQ ID NO: 4674167 - DNA, 19 bp, Homo sapiens
actgccctaactgtacatt

SEQ ID NO: 4674168 - DNA, 15 bp, Homo sapiens
actgcctctcacagc

SEQ ID NO: 4674169 - DNA, 15 bp, Homo sapiens
actgcctgaccttgg

SEQ ID NO: 4674170 - DNA, 20 bp, Homo sapiens
actgctattctagagctttt

SEQ ID NO: 4674171 - DNA, 22 bp, Homo sapiens
actgctattctagagcttttat

SEQ ID NO: 4674172 - DNA, 21 bp, Homo sapiens
actggaaacaaaacagaaggg

SEQ ID NO: 4674173 - DNA, 21 bp, Homo sapiens
actggactccgaggtggttca

SEQ ID NO: 4674174 - DNA, 15 bp, Homo sapiens
actggagctcatctg

SEQ ID NO: 4674175 - DNA, 20 bp, Homo sapiens
actggaggagagaagaatga

SEQ ID NO: 4674176 - DNA, 11 bp, Homo sapiens
actggaggcag

SEQ ID NO: 4674177 - DNA, 14 bp, Homo sapiens
actggcacagaggt

SEQ ID NO: 4674178 - DNA, 10 bp, Homo sapiens
actggcatgc

SEQ ID NO: 4674179 - DNA, 18 bp, Homo sapiens
actggccaagctgaggtg

SEQ ID NO: 4674180 - DNA, 21 bp, Homo sapiens
actggccaagctgaggtgccc

SEQ ID NO: 4674181 - DNA, 21 bp, Homo sapiens
actggctgtgtgaccttaggc

SEQ ID NO: 4674182 - DNA, 13 bp, Homo sapiens
actggcttcagca

SEQ ID NO: 4674183 - DNA, 17 bp, Homo sapiens
actggctttcctgctgg

SEQ ID NO: 4674184 - DNA, 12 bp, Homo sapiens
actgggaaggct

SEQ ID NO: 4674185 - DNA, 17 bp, Homo sapiens
actgggaaggctacttc

SEQ ID NO: 4674186 - DNA, 21 bp, Homo sapiens
actgggtgtcatttcattcca

SEQ ID NO: 4674187 - DNA, 22 bp, Homo sapiens
actgggtgtcatttcattccat

SEQ ID NO: 4674188 - DNA, 23 bp, Homo sapiens
actgggtttggcaaaactcaggc

SEQ ID NO: 4674189 - DNA, 20 bp, Homo sapiens
actggtaagcgatttgaaac

SEQ ID NO: 4674190 - DNA, 18 bp, Homo sapiens
actggtaggttgggacac

SEQ ID NO: 4674191 - DNA, 14 bp, Homo sapiens
actggttccttcct

SEQ ID NO: 4674192 - DNA, 14 bp, Homo sapiens
actggttttctgcc

SEQ ID NO: 4674193 - DNA, 21 bp, Homo sapiens
actgtaaacttggaatcaagg

SEQ ID NO: 4674194 - DNA, 17 bp, Homo sapiens
actgtaatttctttgag

SEQ ID NO: 4674195 - DNA, 14 bp, Homo sapiens
actgtagacactct

SEQ ID NO: 4674196 - DNA, 18 bp, Homo sapiens
actgtagacactctgaca

SEQ ID NO: 4674197 - DNA, 20 bp, Homo sapiens
actgtcacttgctgcttttt

SEQ ID NO: 4674198 - DNA, 23 bp, Homo sapiens
actgtcgccacacgcctctgtgt

SEQ ID NO: 4674199 - DNA, 13 bp, Homo sapiens
actgtcgctgctt

SEQ ID NO: 4674200 - DNA, 17 bp, Homo sapiens
actgtcgctgcttcgtg

SEQ ID NO: 4674201 - DNA, 22 bp, Homo sapiens
actgtgaacctgggcactccgc

SEQ ID NO: 4674202 - DNA, 19 bp, Homo sapiens
actgtgacccccagctccg

SEQ ID NO: 4674203 - DNA, 16 bp, Homo sapiens
actgtgatacagtttt

SEQ ID NO: 4674204 - DNA, 12 bp, Homo sapiens
actgtggccttg

SEQ ID NO: 4674205 - DNA, 22 bp, Homo sapiens
actgtgtccctctctctggaaa

SEQ ID NO: 4674206 - DNA, 17 bp, Homo sapiens
actgtgtctgaatcatg

SEQ ID NO: 4674207 - DNA, 19 bp, Homo sapiens
actgtgtctgaatcatgtc

SEQ ID NO: 4674208 - DNA, 22 bp, Homo sapiens
actgtgtctgaatcatgtctgt

SEQ ID NO: 4674209 - DNA, 11 bp, Homo sapiens
acctcacccca

SEQ ID NO: 4674210 - DNA, 20 bp, Homo sapiens
acctcactgaaaacatctgg

SEQ ID NO: 4674211 - DNA, 15 bp, Homo sapiens
acctcacttgcttct

SEQ ID NO: 4674212 - DNA, 21 bp, Homo sapiens
acctcacttgcttcttatcct

SEQ ID NO: 4674213 - DNA, 11 bp, Homo sapiens
acctcagcctc

SEQ ID NO: 4674214 - DNA, 18 bp, Homo sapiens
acctcaggtgccaaccca

SEQ ID NO: 4674215 - DNA, 18 bp, Homo sapiens
acctcagttattacatgt

SEQ ID NO: 4674216 - DNA, 19 bp, Homo sapiens
acctcatctgtggagctgc

SEQ ID NO: 4674217 - DNA, 17 bp, Homo sapiens
acctccaagcatttcat

SEQ ID NO: 4674218 - DNA, 15 bp, Homo sapiens
acctccagcctctgg

SEQ ID NO: 4674219 - DNA, 16 bp, Homo sapiens
acctccagctttcctg

SEQ ID NO: 4674220 - DNA, 17 bp, Homo sapiens
acctccagctttcctgt

SEQ ID NO: 4674221 - DNA, 15 bp, Homo sapiens
acctccaggcctgtt

SEQ ID NO: 4674222 - DNA, 16 bp, Homo sapiens
acctccccagcccagg

SEQ ID NO: 4674223 - DNA, 17 bp, Homo sapiens
acctccccagcccagga

SEQ ID NO: 4674224 - DNA, 13 bp, Homo sapiens
acctccctccttt

SEQ ID NO: 4674225 - DNA, 18 bp, Homo sapiens
acctccctcctttccttt

SEQ ID NO: 4674226 - DNA, 21 bp, Homo sapiens
acctcctctgccagcaggaat

SEQ ID NO: 4674227 - DNA, 22 bp, Homo sapiens
acctcctctgccagcaggaata

SEQ ID NO: 4674228 - DNA, 11 bp, Homo sapiens
acctcctctgt

SEQ ID NO: 4674229 - DNA, 14 bp, Homo sapiens
acctcctcttcccc

SEQ ID NO: 4674230 - DNA, 15 bp, Homo sapiens
acctcctcttccccc

SEQ ID NO: 4674231 - DNA, 12 bp, Homo sapiens
acctccttcccc

SEQ ID NO: 4674232 - DNA, 15 bp, Homo sapiens
acctccttccccagc

SEQ ID NO: 4674233 - DNA, 17 bp, Homo sapiens
acctccttccccagctc

SEQ ID NO: 4674234 - DNA, 19 bp, Homo sapiens
acctccttccccagctccc

SEQ ID NO: 4674235 - DNA, 17 bp, Homo sapiens
acctccttctgcaaagt

SEQ ID NO: 4674236 - DNA, 14 bp, Homo sapiens
acctctgcctcctg

SEQ ID NO: 4674237 - DNA, 15 bp, Homo sapiens
acctctgcctcctgg

SEQ ID NO: 4674238 - DNA, 20 bp, Homo sapiens
acctctgcctcctgggttca

SEQ ID NO: 4674239 - DNA, 16 bp, Homo sapiens
acctctgggaccccag

SEQ ID NO: 4674240 - DNA, 21 bp, Homo sapiens
acctctgggaccccagctgct

SEQ ID NO: 4674241 - DNA, 17 bp, Homo sapiens
acctctggttaatttat

SEQ ID NO: 4674242 - DNA, 11 bp, Homo sapiens
acctctgtgtg

SEQ ID NO: 4674243 - DNA, 15 bp, Homo sapiens
acctctgtgtgctcc

SEQ ID NO: 4674244 - DNA, 18 bp, Homo sapiens
acctctgttcagtgtaaa

SEQ ID NO: 4674245 - DNA, 19 bp, Homo sapiens
acctctgttcagtgtaaat

SEQ ID NO: 4674246 - DNA, 15 bp, Homo sapiens
acctctgttcatttc

SEQ ID NO: 4674247 - DNA, 13 bp, Homo sapiens
actactgcagcac

SEQ ID NO: 4674248 - DNA, 13 bp, Homo sapiens
actactgggtgtc

SEQ ID NO: 4674249 - DNA, 16 bp, Homo sapiens
actactgggtgtcatt

SEQ ID NO: 4674250 - DNA, 20 bp, Homo sapiens
actactgggtgtcatttcat

SEQ ID NO: 4674251 - DNA, 21 bp, Homo sapiens
actactgggtgtcatttcatt

SEQ ID NO: 4674252 - DNA, 23 bp, Homo sapiens
actactttaaatcctaccaaagt

SEQ ID NO: 4674253 - DNA, 19 bp, Homo sapiens
actactttgttaggatttt

SEQ ID NO: 4674254 - DNA, 23 bp, Homo sapiens
actagcaggcaatgctgtacttt

SEQ ID NO: 4674255 - DNA, 11 bp, Homo sapiens
actagccagaa

SEQ ID NO: 4674256 - DNA, 15 bp, Homo sapiens
actagccagaattct

SEQ ID NO: 4674257 - DNA, 13 bp, Homo sapiens
actaggaaacgtg

SEQ ID NO: 4674258 - DNA, 14 bp, Homo sapiens
actaggctgagcaa

SEQ ID NO: 4674259 - DNA, 23 bp, Homo sapiens
actagtgcaattccaagaaaata

SEQ ID NO: 4674260 - DNA, 15 bp, Homo sapiens
actagttacacatct

SEQ ID NO: 4674261 - DNA, 18 bp, Homo sapiens
actagttacacatcttca

SEQ ID NO: 4674262 - DNA, 20 bp, Homo sapiens
actatatgatcagtgttact

SEQ ID NO: 4674263 - DNA, 13 bp, Homo sapiens
actatcataaaat

SEQ ID NO: 4674264 - DNA, 21 bp, Homo sapiens
actatgttcctaacaaaatga

SEQ ID NO: 4674265 - DNA, 13 bp, Homo sapiens
actattacttttc

SEQ ID NO: 4674266 - DNA, 14 bp, Homo sapiens
actattcatggcta

SEQ ID NO: 4674267 - DNA, 21 bp, Homo sapiens
actattccccagcagggtctt

SEQ ID NO: 4674268 - DNA, 15 bp, Homo sapiens
actatttatctgtgt

SEQ ID NO: 4674269 - DNA, 14 bp, Homo sapiens
actattttcaaaga

SEQ ID NO: 4674270 - DNA, 14 bp, Homo sapiens
actattttcttttt

SEQ ID NO: 4674271 - DNA, 14 bp, Homo sapiens
actcaaaggccaga

SEQ ID NO: 4674272 - DNA, 19 bp, Homo sapiens
actcaatgtggaaaaaata

SEQ ID NO: 4674273 - DNA, 22 bp, Homo sapiens
actcaatgtggaaaaaatattt

SEQ ID NO: 4674274 - DNA, 21 bp, Homo sapiens
actcacattgttcaactccct

SEQ ID NO: 4674275 - DNA, 22 bp, Homo sapiens
actcacctgcgcaagtgcctgg

SEQ ID NO: 4674276 - DNA, 16 bp, Homo sapiens
actcactctgggctgt

SEQ ID NO: 4674277 - DNA, 18 bp, Homo sapiens
actcactgtgatcaatat

SEQ ID NO: 4674278 - DNA, 13 bp, Homo sapiens
actcagaagcctg

SEQ ID NO: 4674279 - DNA, 23 bp, Homo sapiens
actcagaagcctgggggcctggc

SEQ ID NO: 4674280 - DNA, 17 bp, Homo sapiens
actcagcctagcacagg

SEQ ID NO: 4674281 - DNA, 14 bp, Homo sapiens
actcagctgtcctg

SEQ ID NO: 4674282 - DNA, 17 bp, Homo sapiens
actcagctgtcctgcag

SEQ ID NO: 4674283 - DNA, 19 bp, Homo sapiens
actcagctgtcctgcagca

SEQ ID NO: 4674284 - DNA, 22 bp, Homo sapiens
actcagggaccggtgctgcagg

SEQ ID NO: 4674285 - DNA, 15 bp, Homo sapiens
actcagttttttgta

SEQ ID NO: 4674286 - DNA, 17 bp, Homo sapiens
actcagttttttgtaac

SEQ ID NO: 4674287 - DNA, 18 bp, Homo sapiens
actcatgatcaagatata

SEQ ID NO: 4674288 - DNA, 21 bp, Homo sapiens
actccacggatgcgtgggcag

SEQ ID NO: 4674289 - DNA, 12 bp, Homo sapiens
actccagcctgg

SEQ ID NO: 4674290 - DNA, 20 bp, Homo sapiens
actccagcctgggggacaga

SEQ ID NO: 4674291 - DNA, 21 bp, Homo sapiens
actccagtgccaacaatccta

SEQ ID NO: 4674292 - DNA, 19 bp, Homo sapiens
actcccaggtgagaattca

SEQ ID NO: 4674293 - DNA, 14 bp, Homo sapiens
actccccagagctg

SEQ ID NO: 4674294 - DNA, 15 bp, Homo sapiens
actccctccaccagc

SEQ ID NO: 4674295 - DNA, 18 bp, Homo sapiens
actccctccaccagcctg

SEQ ID NO: 4674296 - DNA, 23 bp, Homo sapiens
actccctcttgtcagtgtagaca

SEQ ID NO: 4674297 - DNA, 22 bp, Homo sapiens
actcccttctcggggtgggaca

SEQ ID NO: 4674298 - DNA, 13 bp, Homo sapiens
actcccttctgct

SEQ ID NO: 4674299 - DNA, 13 bp, Homo sapiens
actccgccagcca

SEQ ID NO: 4674300 - DNA, 16 bp, Homo sapiens
actccgccagccacag

SEQ ID NO: 4674301 - DNA, 17 bp, Homo sapiens
actccgcgccgatgcca

SEQ ID NO: 4674302 - DNA, 18 bp, Homo sapiens
actccgcgccgatgccac

SEQ ID NO: 4674303 - DNA, 21 bp, Homo sapiens
actccgcgccgatgccaccgg

SEQ ID NO: 4674304 - DNA, 17 bp, Homo sapiens
actcctgacctcaggtg

SEQ ID NO: 4674305 - DNA, 19 bp, Homo sapiens
actcctgaggacagctgtc

SEQ ID NO: 4674306 - DNA, 16 bp, Homo sapiens
actcctgctggtacct

SEQ ID NO: 4674307 - DNA, 21 bp, Homo sapiens
actcctgctggtacctgccct

SEQ ID NO: 4674308 - DNA, 15 bp, Homo sapiens
actcctgtgggagcc

SEQ ID NO: 4674309 - DNA, 18 bp, Homo sapiens
actcctgtgggagcctcg

SEQ ID NO: 4674310 - DNA, 20 bp, Homo sapiens
actcctgtgggagcctcgca

SEQ ID NO: 4674311 - DNA, 12 bp, Homo sapiens
actccttccagc

SEQ ID NO: 4674312 - DNA, 19 bp, Homo sapiens
actccttccctaatagctt

SEQ ID NO: 4674313 - DNA, 13 bp, Homo sapiens
actccttcctgcc

SEQ ID NO: 4674314 - DNA, 15 bp, Homo sapiens
actccttcctgcccc

SEQ ID NO: 4674315 - DNA, 14 bp, Homo sapiens
actccttctctcac

SEQ ID NO: 4674316 - DNA, 16 bp, Homo sapiens
actccttctctcactg

SEQ ID NO: 4674317 - DNA, 23 bp, Homo sapiens
actcctttccaatagaaagaaac

SEQ ID NO: 4674318 - DNA, 17 bp, Homo sapiens
actctaggttatacaat

SEQ ID NO: 4674319 - DNA, 20 bp, Homo sapiens
actctaggttatacaataac

SEQ ID NO: 4674320 - DNA, 17 bp, Homo sapiens
actctagtttattctaa

SEQ ID NO: 4674321 - DNA, 16 bp, Homo sapiens
aggtacaggagaggca

SEQ ID NO: 4674322 - DNA, 17 bp, Homo sapiens
aggtacaggagaggcag

SEQ ID NO: 4674323 - DNA, 17 bp, Homo sapiens
aggtactagaatgctta

SEQ ID NO: 4674324 - DNA, 21 bp, Homo sapiens
aggtagctatagttgcagccc

SEQ ID NO: 4674325 - DNA, 18 bp, Homo sapiens
aggtaggctgcaaaatta

SEQ ID NO: 4674326 - DNA, 21 bp, Homo sapiens
aggtagtcatgctgtgcattt

SEQ ID NO: 4674327 - DNA, 20 bp, Homo sapiens
aggtagttggaactttctgt

SEQ ID NO: 4674328 - DNA, 19 bp, Homo sapiens
aggtatcctgggggaagag

SEQ ID NO: 4674329 - DNA, 20 bp, Homo sapiens
aggtatcctgggggaagagg

SEQ ID NO: 4674330 - DNA, 13 bp, Homo sapiens
aggtatggctctg

SEQ ID NO: 4674331 - DNA, 16 bp, Homo sapiens
aggtattattatcttt

SEQ ID NO: 4674332 - DNA, 17 bp, Homo sapiens
aggtattttgtttcttt

SEQ ID NO: 4674333 - DNA, 19 bp, Homo sapiens
aggtattttgtttctttta

SEQ ID NO: 4674334 - DNA, 14 bp, Homo sapiens
aggtcaaggtcatt

SEQ ID NO: 4674335 - DNA, 13 bp, Homo sapiens
aggtcaccagctg

SEQ ID NO: 4674336 - DNA, 14 bp, Homo sapiens
aggtcaccagggga

SEQ ID NO: 4674337 - DNA, 18 bp, Homo sapiens
aggtcagcccatggaggc

SEQ ID NO: 4674338 - DNA, 16 bp, Homo sapiens
aggtcagggagtgctg

SEQ ID NO: 4674339 - DNA, 13 bp, Homo sapiens
aggtcccagccct

SEQ ID NO: 4674340 - DNA, 18 bp, Homo sapiens
aggtcctgagcactgcca

SEQ ID NO: 4674341 - DNA, 14 bp, Homo sapiens
aggtcctggtgggg

SEQ ID NO: 4674342 - DNA, 17 bp, Homo sapiens
aggtcctggtggggcag

SEQ ID NO: 4674343 - DNA, 22 bp, Homo sapiens
aggtctccaggggcctgcagaa

SEQ ID NO: 4674344 - DNA, 14 bp, Homo sapiens
aggtctcgaccctg

SEQ ID NO: 4674345 - DNA, 17 bp, Homo sapiens
aggtctgtatggctgta

SEQ ID NO: 4674346 - DNA, 16 bp, Homo sapiens
aggtcttcctgtggct

SEQ ID NO: 4674347 - DNA, 18 bp, Homo sapiens
aggtctttcagtactttt

SEQ ID NO: 4674348 - DNA, 21 bp, Homo sapiens
aggtgaaagaaagggacccac

SEQ ID NO: 4674349 - DNA, 22 bp, Homo sapiens
aggtgaaagaaagggacccacc

SEQ ID NO: 4674350 - DNA, 21 bp, Homo sapiens
aggtgacactccagttgcaga

SEQ ID NO: 4674351 - DNA, 13 bp, Homo sapiens
aggtgaccccagg

SEQ ID NO: 4674352 - DNA, 14 bp, Homo sapiens
aggtgaccccaggg

SEQ ID NO: 4674353 - DNA, 18 bp, Homo sapiens
aggtgaccccagggcaca

SEQ ID NO: 4674354 - DNA, 24 bp, Homo sapiens
aggtgaccccagggcacaggagct

SEQ ID NO: 4674355 - DNA, 13 bp, Homo sapiens
aggtgaggggaag

SEQ ID NO: 4674356 - DNA, 15 bp, Homo sapiens
aggtgataaaatttt

SEQ ID NO: 4674357 - DNA, 23 bp, Homo sapiens
aggtgatccgcccacctcagcct

SEQ ID NO: 4674358 - DNA, 13 bp, Homo sapiens
aggtgcaaccagg

SEQ ID NO: 4674359 - DNA, 15 bp, Homo sapiens
aggtgcaaccaggga

SEQ ID NO: 4674360 - DNA, 14 bp, Homo sapiens
aggtgcagtggagg

SEQ ID NO: 4674361 - DNA, 22 bp, Homo sapiens
aggtgccaccaccctgcccccc

SEQ ID NO: 4674362 - DNA, 15 bp, Homo sapiens
aggtgccatctcagg

SEQ ID NO: 4674363 - DNA, 17 bp, Homo sapiens
aggtgcccactccgcca

SEQ ID NO: 4674364 - DNA, 23 bp, Homo sapiens
aggtgcccactccgccagccaca

SEQ ID NO: 4674365 - DNA, 24 bp, Homo sapiens
aggtgcccactccgccagccacag

SEQ ID NO: 4674366 - DNA, 14 bp, Homo sapiens
aggtgcccaggaga

SEQ ID NO: 4674367 - DNA, 15 bp, Homo sapiens
aggtgcccaggagaa

SEQ ID NO: 4674368 - DNA, 18 bp, Homo sapiens
aggtgctaacatagattt

SEQ ID NO: 4674369 - DNA, 19 bp, Homo sapiens
aggtgctgtccccactgcc

SEQ ID NO: 4674370 - DNA, 17 bp, Homo sapiens
aggtggaaggcagacag

SEQ ID NO: 4674371 - DNA, 16 bp, Homo sapiens
aggtggagggaaggat

SEQ ID NO: 4674372 - DNA, 19 bp, Homo sapiens
aggtggagggaaggataaa

SEQ ID NO: 4674373 - DNA, 15 bp, Homo sapiens
aggtgtagaaaaggt

SEQ ID NO: 4674374 - DNA, 22 bp, Homo sapiens
aggtgtatgccacacctggcct

SEQ ID NO: 4674375 - DNA, 23 bp, Homo sapiens
aggtgtatgccacacctggcctt

SEQ ID NO: 4674376 - DNA, 18 bp, Homo sapiens
aggtgtgaaagaatcagt

SEQ ID NO: 4674377 - DNA, 16 bp, Homo sapiens
aggtgtgatggtctgg

SEQ ID NO: 4674378 - DNA, 20 bp, Homo sapiens
aggttacccgagaagcactt

SEQ ID NO: 4674379 - DNA, 18 bp, Homo sapiens
aggttatacaataaccca

SEQ ID NO: 4674380 - DNA, 16 bp, Homo sapiens
aggttcccaagctcag

SEQ ID NO: 4674381 - DNA, 21 bp, Homo sapiens
aggttccccaagggccctggc

SEQ ID NO: 4674382 - DNA, 22 bp, Homo sapiens
aggttccccaagggccctggca

SEQ ID NO: 4674383 - DNA, 23 bp, Homo sapiens
aggttccccaagggccctggcac

SEQ ID NO: 4674384 - DNA, 13 bp, Homo sapiens
aggttctgcctct

SEQ ID NO: 4674385 - DNA, 21 bp, Homo sapiens
aggttcttcttcctgaagctg

SEQ ID NO: 4674386 - DNA, 14 bp, Homo sapiens
aggttgatcttgaa

SEQ ID NO: 4674387 - DNA, 23 bp, Homo sapiens
aggtttattctatctgtttttaa

SEQ ID NO: 4674388 - DNA, 18 bp, Homo sapiens
aggtttttttgtttttgt

SEQ ID NO: 4674389 - DNA, 17 bp, Homo sapiens
agtaaaaccttgttcta

SEQ ID NO: 4674390 - DNA, 18 bp, Homo sapiens
agtaaaaccttgttctat

SEQ ID NO: 4674391 - DNA, 16 bp, Homo sapiens
agtaaacagggtacct

SEQ ID NO: 4674392 - DNA, 15 bp, Homo sapiens
agtaaatcagaaagt

SEQ ID NO: 4674393 - DNA, 17 bp, Homo sapiens
agtaaatcagaaagtaa

SEQ ID NO: 4674394 - DNA, 13 bp, Homo sapiens
agtaacagacaca

SEQ ID NO: 4674395 - DNA, 22 bp, Homo sapiens
agtaaccaaggccctgtctctg

SEQ ID NO: 4674396 - DNA, 13 bp, Homo sapiens
agtaatatattct

SEQ ID NO: 4674397 - DNA, 17 bp, Homo sapiens
agtaatatctttcagtt

SEQ ID NO: 4674398 - DNA, 22 bp, Homo sapiens
agtaatggaggtcccagccctg

SEQ ID NO: 4674399 - DNA, 19 bp, Homo sapiens
agtaattcagtgggaattg

SEQ ID NO: 4674400 - DNA, 21 bp, Homo sapiens
agtaatttctttttttccttt

SEQ ID NO: 4674401 - DNA, 21 bp, Homo sapiens
agtaattttgtcacattattt

SEQ ID NO: 4674402 - DNA, 16 bp, Homo sapiens
agtacaaatgccttaa

SEQ ID NO: 4674403 - DNA, 14 bp, Homo sapiens
agtacaatcttggg

SEQ ID NO: 4674404 - DNA, 19 bp, Homo sapiens
agtacacaattgttttacc

SEQ ID NO: 4674405 - DNA, 19 bp, Homo sapiens
agtacatatttattttctt

SEQ ID NO: 4674406 - DNA, 21 bp, Homo sapiens
agtacatatttattttctttt

SEQ ID NO: 4674407 - DNA, 14 bp, Homo sapiens
agtacatgttaaac

SEQ ID NO: 4674408 - DNA, 15 bp, Homo sapiens
agtacctgtgtgttt

SEQ ID NO: 4674409 - DNA, 17 bp, Homo sapiens
agtacctgtgtgtttcg

SEQ ID NO: 4674410 - DNA, 16 bp, Homo sapiens
agtactacacattttt

SEQ ID NO: 4674411 - DNA, 12 bp, Homo sapiens
agtactctttaa

SEQ ID NO: 4674412 - DNA, 13 bp, Homo sapiens
agtacttaatata

SEQ ID NO: 4674413 - DNA, 20 bp, Homo sapiens
agtacttgagggaccaatat

SEQ ID NO: 4674414 - DNA, 23 bp, Homo sapiens
agtacttttttaaatattttcta

SEQ ID NO: 4674415 - DNA, 15 bp, Homo sapiens
agtagagacagtgtt

SEQ ID NO: 4674416 - DNA, 14 bp, Homo sapiens
agtagctcttagac

SEQ ID NO: 4674417 - DNA, 22 bp, Homo sapiens
agtagctgagctcacaaggcag

SEQ ID NO: 4674418 - DNA, 21 bp, Homo sapiens
agtagctgggattacaggcgc

SEQ ID NO: 4674419 - DNA, 23 bp, Homo sapiens
agtagcttgctccctgtgtccac

SEQ ID NO: 4674420 - DNA, 21 bp, Homo sapiens
agtagggatgcggatcctgct

SEQ ID NO: 4674421 - DNA, 18 bp, Homo sapiens
agtagtaaatcagaaagt

SEQ ID NO: 4674422 - DNA, 15 bp, Homo sapiens
agtagttaaataact

SEQ ID NO: 4674423 - DNA, 14 bp, Homo sapiens
agtataagaaatgc

SEQ ID NO: 4674424 - DNA, 13 bp, Homo sapiens
agtataagctttt

SEQ ID NO: 4674425 - DNA, 17 bp, Homo sapiens
agtatatcatgtaaaga

SEQ ID NO: 4674426 - DNA, 18 bp, Homo sapiens
agtatattcttattggaa

SEQ ID NO: 4674427 - DNA, 17 bp, Homo sapiens
agtatatttatttctag

SEQ ID NO: 4674428 - DNA, 15 bp, Homo sapiens
agtatcatgccctgt

SEQ ID NO: 4674429 - DNA, 17 bp, Homo sapiens
agtatcttttttcaaaa

SEQ ID NO: 4674430 - DNA, 18 bp, Homo sapiens
agtatgatttacctcata

SEQ ID NO: 4674431 - DNA, 17 bp, Homo sapiens
agtattacaaccatata

SEQ ID NO: 4674432 - DNA, 13 bp, Homo sapiens
agggactgtccta

SEQ ID NO: 4674433 - DNA, 15 bp, Homo sapiens
agggagaagaagtca

SEQ ID NO: 4674434 - DNA, 14 bp, Homo sapiens
agggagaattgaga

SEQ ID NO: 4674435 - DNA, 21 bp, Homo sapiens
agggagcggccggccagcccc

SEQ ID NO: 4674436 - DNA, 22 bp, Homo sapiens
agggagcggccggccagcccct

SEQ ID NO: 4674437 - DNA, 22 bp, Homo sapiens
agggaggaccaaagggatggta

SEQ ID NO: 4674438 - DNA, 23 bp, Homo sapiens
agggaggccgaagctaacaggga

SEQ ID NO: 4674439 - DNA, 12 bp, Homo sapiens
agggagggctct

SEQ ID NO: 4674440 - DNA, 15 bp, Homo sapiens
agggagggctctgag

SEQ ID NO: 4674441 - DNA, 12 bp, Homo sapiens
agggaggggagg

SEQ ID NO: 4674442 - DNA, 14 bp, Homo sapiens
agggaggggagggg

SEQ ID NO: 4674443 - DNA, 18 bp, Homo sapiens
agggagtggttcctgtgg

SEQ ID NO: 4674444 - DNA, 21 bp, Homo sapiens
agggagtttaatacaggaaat

SEQ ID NO: 4674445 - DNA, 18 bp, Homo sapiens
agggatcagccctgccct

SEQ ID NO: 4674446 - DNA, 18 bp, Homo sapiens
agggatgcggatcctgct

SEQ ID NO: 4674447 - DNA, 20 bp, Homo sapiens
agggatgcggatcctgctgg

SEQ ID NO: 4674448 - DNA, 13 bp, Homo sapiens
agggatgctgggc

SEQ ID NO: 4674449 - DNA, 15 bp, Homo sapiens
agggatggagaaaga

SEQ ID NO: 4674450 - DNA, 17 bp, Homo sapiens
agggatggagaaagaag

SEQ ID NO: 4674451 - DNA, 15 bp, Homo sapiens
agggcaagccctgcc

SEQ ID NO: 4674452 - DNA, 17 bp, Homo sapiens
agggcaagggaggggtg

SEQ ID NO: 4674453 - DNA, 21 bp, Homo sapiens
agggcaagggaggggtggtat

SEQ ID NO: 4674454 - DNA, 17 bp, Homo sapiens
agggcacaggagctacc

SEQ ID NO: 4674455 - DNA, 23 bp, Homo sapiens
agggcacaggagctacctgtgtg

SEQ ID NO: 4674456 - DNA, 17 bp, Homo sapiens
agggcacaggccatgga

SEQ ID NO: 4674457 - DNA, 20 bp, Homo sapiens
agggcacattaactccctcc

SEQ ID NO: 4674458 - DNA, 17 bp, Homo sapiens
agggcactcccaaccct

SEQ ID NO: 4674459 - DNA, 22 bp, Homo sapiens
agggcacttaatttgtaaactt

SEQ ID NO: 4674460 - DNA, 17 bp, Homo sapiens
agggcagattttcatgc

SEQ ID NO: 4674461 - DNA, 22 bp, Homo sapiens
agggcagattttggttggtttt

SEQ ID NO: 4674462 - DNA, 14 bp, Homo sapiens
agggcagcagccag

SEQ ID NO: 4674463 - DNA, 15 bp, Homo sapiens
agggcagccccctcc

SEQ ID NO: 4674464 - DNA, 17 bp, Homo sapiens
agggcagcgccaggctg

SEQ ID NO: 4674465 - DNA, 17 bp, Homo sapiens
agggcagggcccacgtg

SEQ ID NO: 4674466 - DNA, 23 bp, Homo sapiens
agggcagggcccacgtgtatagt

SEQ ID NO: 4674467 - DNA, 17 bp, Homo sapiens
agggcagttcgcagcca

SEQ ID NO: 4674468 - DNA, 19 bp, Homo sapiens
agggcagttcgcagccacc

SEQ ID NO: 4674469 - DNA, 22 bp, Homo sapiens
agggcagttcgcagccaccctg

SEQ ID NO: 4674470 - DNA, 13 bp, Homo sapiens
agggccagagcag

SEQ ID NO: 4674471 - DNA, 16 bp, Homo sapiens
agggccagagcagctc

SEQ ID NO: 4674472 - DNA, 21 bp, Homo sapiens
agggccagtggggcctgtgga

SEQ ID NO: 4674473 - DNA, 22 bp, Homo sapiens
agggccatctgactgccaagcc

SEQ ID NO: 4674474 - DNA, 23 bp, Homo sapiens
agggccatctgactgccaagcca

SEQ ID NO: 4674475 - DNA, 23 bp, Homo sapiens
agggccccgtgggtgggcctggc

SEQ ID NO: 4674476 - DNA, 17 bp, Homo sapiens
agggccctcccagccca

SEQ ID NO: 4674477 - DNA, 11 bp, Homo sapiens
agggccctggc

SEQ ID NO: 4674478 - DNA, 18 bp, Homo sapiens
agggccggggaactggcc

SEQ ID NO: 4674479 - DNA, 20 bp, Homo sapiens
agggccggggaactggccaa

SEQ ID NO: 4674480 - DNA, 21 bp, Homo sapiens
agggccggggaactggccaag

SEQ ID NO: 4674481 - DNA, 23 bp, Homo sapiens
agggccggggaactggccaagct

SEQ ID NO: 4674482 - DNA, 19 bp, Homo sapiens
agggcctgagtgacctcct

SEQ ID NO: 4674483 - DNA, 20 bp, Homo sapiens
agggcctgagtgacctcctt

SEQ ID NO: 4674484 - DNA, 12 bp, Homo sapiens
agggcctgcccc

SEQ ID NO: 4674485 - DNA, 13 bp, Homo sapiens
agggcctgccccc

SEQ ID NO: 4674486 - DNA, 14 bp, Homo sapiens
agggcctgccccct

SEQ ID NO: 4674487 - DNA, 16 bp, Homo sapiens
agggcctgccccctgg

SEQ ID NO: 4674488 - DNA, 18 bp, Homo sapiens
agggcctgccccctgggg

SEQ ID NO: 4674489 - DNA, 12 bp, Homo sapiens
agggcctggagc

SEQ ID NO: 4674490 - DNA, 12 bp, Homo sapiens
agggcctggcat

SEQ ID NO: 4674491 - DNA, 21 bp, Homo sapiens
agggcctggggaaaccatggc

SEQ ID NO: 4674492 - DNA, 18 bp, Homo sapiens
agggcctggggcctgaga

SEQ ID NO: 4674493 - DNA, 19 bp, Homo sapiens
agggcgtggaaaggggcag

SEQ ID NO: 4674494 - DNA, 14 bp, Homo sapiens
agggctctcctggc

SEQ ID NO: 4674495 - DNA, 15 bp, Homo sapiens
agggctctcctggct

SEQ ID NO: 4674496 - DNA, 18 bp, Homo sapiens
agggctctgagccaacct

SEQ ID NO: 4674497 - DNA, 16 bp, Homo sapiens
agggctgccctgagaa

SEQ ID NO: 4674498 - DNA, 23 bp, Homo sapiens
agggctgccctgagaagctgctc

SEQ ID NO: 4674499 - DNA, 11 bp, Homo sapiens
agggctgggga

SEQ ID NO: 4674500 - DNA, 18 bp, Homo sapiens
agggctggggatgcgcct

SEQ ID NO: 4674501 - DNA, 19 bp, Homo sapiens
agggctggtcacctcccat

SEQ ID NO: 4674502 - DNA, 19 bp, Homo sapiens
agggctgtcatctgtgcac

SEQ ID NO: 4674503 - DNA, 20 bp, Homo sapiens
agggctgtcatctgtgcact

SEQ ID NO: 4674504 - DNA, 15 bp, Homo sapiens
agggcttacggccct

SEQ ID NO: 4674505 - DNA, 19 bp, Homo sapiens
aggggaaggaaggagggca

SEQ ID NO: 4674506 - DNA, 15 bp, Homo sapiens
aggggagaggtcagc

SEQ ID NO: 4674507 - DNA, 19 bp, Homo sapiens
aggggagaggtcagccttg

SEQ ID NO: 4674508 - DNA, 16 bp, Homo sapiens
aggggagcgtgttcct

SEQ ID NO: 4674509 - DNA, 22 bp, Homo sapiens
aggggcaagctaggccccagag

SEQ ID NO: 4674510 - DNA, 19 bp, Homo sapiens
aggggcagatggaaaggag

SEQ ID NO: 4674511 - DNA, 18 bp, Homo sapiens
aggggcatgactgtcgcc

SEQ ID NO: 4674512 - DNA, 11 bp, Homo sapiens
aggggccagga

SEQ ID NO: 4674513 - DNA, 16 bp, Homo sapiens
aggggccaggagtggg

SEQ ID NO: 4674514 - DNA, 17 bp, Homo sapiens
aggggccttagggcact

SEQ ID NO: 4674515 - DNA, 22 bp, Homo sapiens
aggggccttagggcactgggct

SEQ ID NO: 4674516 - DNA, 15 bp, Homo sapiens
aggggcgacagtagt

SEQ ID NO: 4674517 - DNA, 18 bp, Homo sapiens
aggggcgggcggagggag

SEQ ID NO: 4674518 - DNA, 19 bp, Homo sapiens
aggggctcagggcctcagg

SEQ ID NO: 4674519 - DNA, 20 bp, Homo sapiens
aggggctgactctccaggga

SEQ ID NO: 4674520 - DNA, 22 bp, Homo sapiens
agggggagccccttctgctcag

SEQ ID NO: 4674521 - DNA, 14 bp, Homo sapiens
agggggcaggggca

SEQ ID NO: 4674522 - DNA, 22 bp, Homo sapiens
agggggccccgccagggctggg

SEQ ID NO: 4674523 - DNA, 13 bp, Homo sapiens
agggggccctgct

SEQ ID NO: 4674524 - DNA, 13 bp, Homo sapiens
agggggcctcatt

SEQ ID NO: 4674525 - DNA, 15 bp, Homo sapiens
agggggcctcattgt

SEQ ID NO: 4674526 - DNA, 15 bp, Homo sapiens
agggggcggcctatg

SEQ ID NO: 4674527 - DNA, 14 bp, Homo sapiens
agggggctctgccc

SEQ ID NO: 4674528 - DNA, 20 bp, Homo sapiens
agggggctctgccccaggcc

SEQ ID NO: 4674529 - DNA, 22 bp, Homo sapiens
agggggctctgccccaggccct

SEQ ID NO: 4674530 - DNA, 14 bp, Homo sapiens
aggggggctgtgcc

SEQ ID NO: 4674531 - DNA, 18 bp, Homo sapiens
agggggtcgtggagagct

SEQ ID NO: 4674532 - DNA, 23 bp, Homo sapiens
aggggtacattctagctgagaag

SEQ ID NO: 4674533 - DNA, 18 bp, Homo sapiens
agggtcggaggtgctgtc

SEQ ID NO: 4674534 - DNA, 17 bp, Homo sapiens
agggtctctccctcagg

SEQ ID NO: 4674535 - DNA, 15 bp, Homo sapiens
agggtcttgggaaat

SEQ ID NO: 4674536 - DNA, 21 bp, Homo sapiens
agggtcttttcatctgggaaa

SEQ ID NO: 4674537 - DNA, 17 bp, Homo sapiens
agggtgacagcttcctt

SEQ ID NO: 4674538 - DNA, 21 bp, Homo sapiens
agggtgagcagggtcaagcct

SEQ ID NO: 4674539 - DNA, 18 bp, Homo sapiens
agggtgggtgctcagaat

SEQ ID NO: 4674540 - DNA, 17 bp, Homo sapiens
agggtttttagagaatg

SEQ ID NO: 4674541 - DNA, 19 bp, Homo sapiens
aggcattgtgatgtttagg

SEQ ID NO: 4674542 - DNA, 13 bp, Homo sapiens
aggcatttcctgg

SEQ ID NO: 4674543 - DNA, 16 bp, Homo sapiens
aggcatttcctgggtg

SEQ ID NO: 4674544 - DNA, 16 bp, Homo sapiens
aggcatttgagcagct

SEQ ID NO: 4674545 - DNA, 15 bp, Homo sapiens
aggccaaaatcaaga

SEQ ID NO: 4674546 - DNA, 14 bp, Homo sapiens
aggccaaacctctg

SEQ ID NO: 4674547 - DNA, 22 bp, Homo sapiens
aggccaaacctctgttcagtgt

SEQ ID NO: 4674548 - DNA, 15 bp, Homo sapiens
aggccaaccagcccg

SEQ ID NO: 4674549 - DNA, 18 bp, Homo sapiens
aggccacactcagcacaa

SEQ ID NO: 4674550 - DNA, 21 bp, Homo sapiens
aggccaccccaacctctgttc

SEQ ID NO: 4674551 - DNA, 13 bp, Homo sapiens
aggccagcaacgc

SEQ ID NO: 4674552 - DNA, 12 bp, Homo sapiens
aggccagcctgg

SEQ ID NO: 4674553 - DNA, 15 bp, Homo sapiens
aggccagcctggcct

SEQ ID NO: 4674554 - DNA, 12 bp, Homo sapiens
aggccaggtgca

SEQ ID NO: 4674555 - DNA, 18 bp, Homo sapiens
aggccaggtgcaaccagg

SEQ ID NO: 4674556 - DNA, 18 bp, Homo sapiens
aggccatgggtggaaagt

SEQ ID NO: 4674557 - DNA, 11 bp, Homo sapiens
aggcccaagtc

SEQ ID NO: 4674558 - DNA, 23 bp, Homo sapiens
aggcccaagtctcctaggggctt

SEQ ID NO: 4674559 - DNA, 21 bp, Homo sapiens
aggccccaactcaagtgtcac

SEQ ID NO: 4674560 - DNA, 16 bp, Homo sapiens
aggccccacaaggcct

SEQ ID NO: 4674561 - DNA, 18 bp, Homo sapiens
aggccccacaaggcctgg

SEQ ID NO: 4674562 - DNA, 16 bp, Homo sapiens
aggccccaccccttcc

SEQ ID NO: 4674563 - DNA, 19 bp, Homo sapiens
aggccccaccccttcccta

SEQ ID NO: 4674564 - DNA, 20 bp, Homo sapiens
aggccccagaggccctggag

SEQ ID NO: 4674565 - DNA, 17 bp, Homo sapiens
aggcccccacccttggg

SEQ ID NO: 4674566 - DNA, 17 bp, Homo sapiens
aggccccggtatgtgat

SEQ ID NO: 4674567 - DNA, 16 bp, Homo sapiens
aggcccctggagccag

SEQ ID NO: 4674568 - DNA, 18 bp, Homo sapiens
aggcccgagcagctgagc

SEQ ID NO: 4674569 - DNA, 22 bp, Homo sapiens
aggcccgagcagctgagcaggg

SEQ ID NO: 4674570 - DNA, 19 bp, Homo sapiens
aggccctgcatctgtctgc

SEQ ID NO: 4674571 - DNA, 12 bp, Homo sapiens
aggccctggagg

SEQ ID NO: 4674572 - DNA, 13 bp, Homo sapiens
aggccctggaggt

SEQ ID NO: 4674573 - DNA, 13 bp, Homo sapiens
aggccctggatca

SEQ ID NO: 4674574 - DNA, 20 bp, Homo sapiens
aggccctgtctctggctact

SEQ ID NO: 4674575 - DNA, 18 bp, Homo sapiens
aggccggcagcgggcgga

SEQ ID NO: 4674576 - DNA, 18 bp, Homo sapiens
aggccgggcctgctgtca

SEQ ID NO: 4674577 - DNA, 14 bp, Homo sapiens
aggcctagactctg

SEQ ID NO: 4674578 - DNA, 17 bp, Homo sapiens
aggcctagactctgtct

SEQ ID NO: 4674579 - DNA, 20 bp, Homo sapiens
aggcctagtacaatcttggg

SEQ ID NO: 4674580 - DNA, 15 bp, Homo sapiens
aggcctatctggaag

SEQ ID NO: 4674581 - DNA, 21 bp, Homo sapiens
aggcctcacccctcccctggg

SEQ ID NO: 4674582 - DNA, 22 bp, Homo sapiens
aggcctcacccctcccctggga

SEQ ID NO: 4674583 - DNA, 17 bp, Homo sapiens
aggcctcgagcagagag

SEQ ID NO: 4674584 - DNA, 19 bp, Homo sapiens
aggcctcttgtaaagactg

SEQ ID NO: 4674585 - DNA, 13 bp, Homo sapiens
aggcctgagcccc

SEQ ID NO: 4674586 - DNA, 18 bp, Homo sapiens
aggcctggggtgacccgg

SEQ ID NO: 4674587 - DNA, 20 bp, Homo sapiens
aggcctggggtgacccggca

SEQ ID NO: 4674588 - DNA, 14 bp, Homo sapiens
aggccttcagttta

SEQ ID NO: 4674589 - DNA, 21 bp, Homo sapiens
aggcgcactgtgacccccagc

SEQ ID NO: 4674590 - DNA, 21 bp, Homo sapiens
aggcgccccaacccgtggagg

SEQ ID NO: 4674591 - DNA, 21 bp, Homo sapiens
aggctaaagcccagagacagc

SEQ ID NO: 4674592 - DNA, 13 bp, Homo sapiens
aggctaatgtcaa

SEQ ID NO: 4674593 - DNA, 22 bp, Homo sapiens
aggctaccagaagaggggcagc

SEQ ID NO: 4674594 - DNA, 15 bp, Homo sapiens
aggctagacagaaac

SEQ ID NO: 4674595 - DNA, 21 bp, Homo sapiens
aggctagacttagattcatta

SEQ ID NO: 4674596 - DNA, 18 bp, Homo sapiens
aggctcagtggtgggaga

SEQ ID NO: 4674597 - DNA, 23 bp, Homo sapiens
aggctctgcacagacaagcagcc

SEQ ID NO: 4674598 - DNA, 14 bp, Homo sapiens
aggctgaccacagc

SEQ ID NO: 4674599 - DNA, 21 bp, Homo sapiens
aggctgagaactcgttcacct

SEQ ID NO: 4674600 - DNA, 21 bp, Homo sapiens
aggctgagccgaagctgcggg

SEQ ID NO: 4674601 - DNA, 16 bp, Homo sapiens
aggctgaggctggcac

SEQ ID NO: 4674602 - DNA, 17 bp, Homo sapiens
aggctgaggctggcaca

SEQ ID NO: 4674603 - DNA, 19 bp, Homo sapiens
aggctgattcctctcattt

SEQ ID NO: 4674604 - DNA, 22 bp, Homo sapiens
aggctgattcctctcatttcca

SEQ ID NO: 4674605 - DNA, 14 bp, Homo sapiens
aggctgcaaaatta

SEQ ID NO: 4674606 - DNA, 20 bp, Homo sapiens
aggctgcaaaattaaatcta

SEQ ID NO: 4674607 - DNA, 16 bp, Homo sapiens
aggctgctgcacacca

SEQ ID NO: 4674608 - DNA, 20 bp, Homo sapiens
aggctggagtgcagtggcgt

SEQ ID NO: 4674609 - DNA, 23 bp, Homo sapiens
aggctggatcttggagaatgtga

SEQ ID NO: 4674610 - DNA, 16 bp, Homo sapiens
aggctggctgtgtata

SEQ ID NO: 4674611 - DNA, 23 bp, Homo sapiens
aggctggtttcaaactcctgacc

SEQ ID NO: 4674612 - DNA, 23 bp, Homo sapiens
aggcttaagaactgcttcatgtg

SEQ ID NO: 4674613 - DNA, 18 bp, Homo sapiens
aggcttaatacctgggtg

SEQ ID NO: 4674614 - DNA, 14 bp, Homo sapiens
aggcttatgagatc

SEQ ID NO: 4674615 - DNA, 22 bp, Homo sapiens
aggcttccctacacagggcctg

SEQ ID NO: 4674616 - DNA, 14 bp, Homo sapiens
aggcttctctctca

SEQ ID NO: 4674617 - DNA, 16 bp, Homo sapiens
aggcttgaaggccagc

SEQ ID NO: 4674618 - DNA, 21 bp, Homo sapiens
aggcttgctgtatgacccctg

SEQ ID NO: 4674619 - DNA, 15 bp, Homo sapiens
aggctttctgggctc

SEQ ID NO: 4674620 - DNA, 17 bp, Homo sapiens
aggctttctgggctctg

SEQ ID NO: 4674621 - DNA, 18 bp, Homo sapiens
aggctttctgggctctgg

SEQ ID NO: 4674622 - DNA, 20 bp, Homo sapiens
aggctttctgggctctggac

SEQ ID NO: 4674623 - DNA, 22 bp, Homo sapiens
aggctttctgggctctggactc

SEQ ID NO: 4674624 - DNA, 15 bp, Homo sapiens
aggcttttatttctg

SEQ ID NO: 4674625 - DNA, 23 bp, Homo sapiens
agggaaatagctaataatgttaa

SEQ ID NO: 4674626 - DNA, 16 bp, Homo sapiens
agggaaatgtacactt

SEQ ID NO: 4674627 - DNA, 21 bp, Homo sapiens
agggaaattgtaaatcctgtg

SEQ ID NO: 4674628 - DNA, 18 bp, Homo sapiens
agggaagaaggaggaatg

SEQ ID NO: 4674629 - DNA, 14 bp, Homo sapiens
agggaagagacagc

SEQ ID NO: 4674630 - DNA, 14 bp, Homo sapiens
agggaaggacagga

SEQ ID NO: 4674631 - DNA, 22 bp, Homo sapiens
agggaaggacaggaccctcagg

SEQ ID NO: 4674632 - DNA, 20 bp, Homo sapiens
agggaaggcaggcagggctc

SEQ ID NO: 4674633 - DNA, 14 bp, Homo sapiens
agggaattctcttg

SEQ ID NO: 4674634 - DNA, 14 bp, Homo sapiens
agggacaaaggagc

SEQ ID NO: 4674635 - DNA, 16 bp, Homo sapiens
agggacaaccagaagg

SEQ ID NO: 4674636 - DNA, 21 bp, Homo sapiens
agggacaagtctttctcctct

SEQ ID NO: 4674637 - DNA, 19 bp, Homo sapiens
agggacaagtggactcagg

SEQ ID NO: 4674638 - DNA, 14 bp, Homo sapiens
agggacaggagaag

SEQ ID NO: 4674639 - DNA, 15 bp, Homo sapiens
agggacaggagaaga

SEQ ID NO: 4674640 - DNA, 17 bp, Homo sapiens
agggacaggagaagaga

SEQ ID NO: 4674641 - DNA, 13 bp, Homo sapiens
agggacccacctg

SEQ ID NO: 4674642 - DNA, 19 bp, Homo sapiens
agggacccacctgctagtc

SEQ ID NO: 4674643 - DNA, 16 bp, Homo sapiens
agggacccccccccaa

SEQ ID NO: 4674644 - DNA, 16 bp, Homo sapiens
agggaccggcagagct

SEQ ID NO: 4674645 - DNA, 19 bp, Homo sapiens
agggaccggcagagctcta

SEQ ID NO: 4674646 - DNA, 15 bp, Homo sapiens
agggaccggtgctgc

SEQ ID NO: 4674647 - DNA, 18 bp, Homo sapiens
agggaccggtgctgcagg

SEQ ID NO: 4674648 - DNA, 17 bp, Homo sapiens
agggactgccaggctgt

SEQ ID NO: 4674649 - DNA, 17 bp, Homo sapiens
agctgaggccacactca

SEQ ID NO: 4674650 - DNA, 21 bp, Homo sapiens
agctgaggccacactcagcac

SEQ ID NO: 4674651 - DNA, 15 bp, Homo sapiens
agctgaggtgcccag

SEQ ID NO: 4674652 - DNA, 22 bp, Homo sapiens
agctgaggtgcccaggagaaga

SEQ ID NO: 4674653 - DNA, 19 bp, Homo sapiens
agctgagtgagtgggagag

SEQ ID NO: 4674654 - DNA, 18 bp, Homo sapiens
agctgcaaaaattatata

SEQ ID NO: 4674655 - DNA, 13 bp, Homo sapiens
agctgcactgtga

SEQ ID NO: 4674656 - DNA, 21 bp, Homo sapiens
agctgccacagagaagtttgt

SEQ ID NO: 4674657 - DNA, 16 bp, Homo sapiens
agctgcccctctctgg

SEQ ID NO: 4674658 - DNA, 13 bp, Homo sapiens
agctgcctggatg

SEQ ID NO: 4674659 - DNA, 15 bp, Homo sapiens
agctgcctggatgag

SEQ ID NO: 4674660 - DNA, 20 bp, Homo sapiens
agctgcctggatgagaaaca

SEQ ID NO: 4674661 - DNA, 17 bp, Homo sapiens
agctgcgggggcaggcc

SEQ ID NO: 4674662 - DNA, 15 bp, Homo sapiens
agctgctccaggcct

SEQ ID NO: 4674663 - DNA, 17 bp, Homo sapiens
agctgctctaagcccag

SEQ ID NO: 4674664 - DNA, 20 bp, Homo sapiens
agctgctctaagcccaggat

SEQ ID NO: 4674665 - DNA, 21 bp, Homo sapiens
agctgctctaagcccaggatc

SEQ ID NO: 4674666 - DNA, 23 bp, Homo sapiens
agctgctctaagcccaggatctc

SEQ ID NO: 4674667 - DNA, 20 bp, Homo sapiens
agctggaaggggccacgtgg

SEQ ID NO: 4674668 - DNA, 21 bp, Homo sapiens
agctggaggaatacattttat

SEQ ID NO: 4674669 - DNA, 17 bp, Homo sapiens
agctggccaaagtcact

SEQ ID NO: 4674670 - DNA, 23 bp, Homo sapiens
agctggcctggcccccagcttca

SEQ ID NO: 4674671 - DNA, 22 bp, Homo sapiens
agctggctctgtgagggtgctg

SEQ ID NO: 4674672 - DNA, 16 bp, Homo sapiens
agctgggtcaggcagg

SEQ ID NO: 4674673 - DNA, 19 bp, Homo sapiens
agctgtaaactgaatataa

SEQ ID NO: 4674674 - DNA, 13 bp, Homo sapiens
agctgtccctgca

SEQ ID NO: 4674675 - DNA, 14 bp, Homo sapiens
agctgtccctgcag

SEQ ID NO: 4674676 - DNA, 20 bp, Homo sapiens
agctgtccctgcagggccat

SEQ ID NO: 4674677 - DNA, 16 bp, Homo sapiens
agctgtcctgcagcaa

SEQ ID NO: 4674678 - DNA, 19 bp, Homo sapiens
agctgtctcaaacctccaa

SEQ ID NO: 4674679 - DNA, 16 bp, Homo sapiens
agctgtctgaagccca

SEQ ID NO: 4674680 - DNA, 17 bp, Homo sapiens
agctgtctgaagcccaa

SEQ ID NO: 4674681 - DNA, 18 bp, Homo sapiens
agctgtgacctgctgagc

SEQ ID NO: 4674682 - DNA, 20 bp, Homo sapiens
agctgtgacctgctgagctc

SEQ ID NO: 4674683 - DNA, 22 bp, Homo sapiens
agctgtgacctgctgagctctg

SEQ ID NO: 4674684 - DNA, 13 bp, Homo sapiens
agctgtttatgca

SEQ ID NO: 4674685 - DNA, 14 bp, Homo sapiens
agcttaactttata

SEQ ID NO: 4674686 - DNA, 23 bp, Homo sapiens
agcttataaaaataaagggaaga

SEQ ID NO: 4674687 - DNA, 18 bp, Homo sapiens
agcttcaacttttctctt

SEQ ID NO: 4674688 - DNA, 17 bp, Homo sapiens
agcttcagctatactta

SEQ ID NO: 4674689 - DNA, 22 bp, Homo sapiens
agcttccaaggggcaaattttt

SEQ ID NO: 4674690 - DNA, 20 bp, Homo sapiens
agcttccgctttgaaagaag

SEQ ID NO: 4674691 - DNA, 22 bp, Homo sapiens
agcttccttaagtatatcatgt

SEQ ID NO: 4674692 - DNA, 15 bp, Homo sapiens
agcttctcagtttct

SEQ ID NO: 4674693 - DNA, 19 bp, Homo sapiens
agcttctcagtttctgcct

SEQ ID NO: 4674694 - DNA, 22 bp, Homo sapiens
agcttctcagtttctgcctggg

SEQ ID NO: 4674695 - DNA, 14 bp, Homo sapiens
agcttctcttgctc

SEQ ID NO: 4674696 - DNA, 13 bp, Homo sapiens
agcttctttccct

SEQ ID NO: 4674697 - DNA, 18 bp, Homo sapiens
agcttgctgtcacttctt

SEQ ID NO: 4674698 - DNA, 21 bp, Homo sapiens
agcttgtaaatatggggatag

SEQ ID NO: 4674699 - DNA, 14 bp, Homo sapiens
agcttgtagccagc

SEQ ID NO: 4674700 - DNA, 18 bp, Homo sapiens
agcttgtatgcaatggat

SEQ ID NO: 4674701 - DNA, 15 bp, Homo sapiens
agcttgtatgtaagg

SEQ ID NO: 4674702 - DNA, 15 bp, Homo sapiens
agcttgtcaaagatg

SEQ ID NO: 4674703 - DNA, 21 bp, Homo sapiens
agcttgtccaggttgatcttg

SEQ ID NO: 4674704 - DNA, 13 bp, Homo sapiens
agctttacatttt

SEQ ID NO: 4674705 - DNA, 20 bp, Homo sapiens
agctttatttatagaaatga

SEQ ID NO: 4674706 - DNA, 22 bp, Homo sapiens
agctttcctggaagtcaaataa

SEQ ID NO: 4674707 - DNA, 20 bp, Homo sapiens
agctttcctgtttccagggt

SEQ ID NO: 4674708 - DNA, 20 bp, Homo sapiens
agctttgctccttcagttct

SEQ ID NO: 4674709 - DNA, 21 bp, Homo sapiens
agctttgctccttcagttctg

SEQ ID NO: 4674710 - DNA, 15 bp, Homo sapiens
agctttgtatgttta

SEQ ID NO: 4674711 - DNA, 22 bp, Homo sapiens
agctttgtcatagttatgtgat

SEQ ID NO: 4674712 - DNA, 20 bp, Homo sapiens
agcttttatttggtgtgttc

SEQ ID NO: 4674713 - DNA, 12 bp, Homo sapiens
agcttttcttga

SEQ ID NO: 4674714 - DNA, 13 bp, Homo sapiens
agcttttcttgat

SEQ ID NO: 4674715 - DNA, 22 bp, Homo sapiens
aggaaaaaaaaaaaaagaaatt

SEQ ID NO: 4674716 - DNA, 17 bp, Homo sapiens
aggaaaacgtgaacaaa

SEQ ID NO: 4674717 - DNA, 14 bp, Homo sapiens
aggaaaagaaacct

SEQ ID NO: 4674718 - DNA, 17 bp, Homo sapiens
aggaaaagaaacctggg

SEQ ID NO: 4674719 - DNA, 21 bp, Homo sapiens
aggaaaagcaagaaacagttt

SEQ ID NO: 4674720 - DNA, 13 bp, Homo sapiens
aggaaaaggcctg

SEQ ID NO: 4674721 - DNA, 15 bp, Homo sapiens
aggaaaatgtattga

SEQ ID NO: 4674722 - DNA, 17 bp, Homo sapiens
aggaaaatgtattgatt

SEQ ID NO: 4674723 - DNA, 18 bp, Homo sapiens
aggaaacattttatcatt

SEQ ID NO: 4674724 - DNA, 21 bp, Homo sapiens
aggaaagaagggggccctgct

SEQ ID NO: 4674725 - DNA, 11 bp, Homo sapiens
aggaaatctgt

SEQ ID NO: 4674726 - DNA, 22 bp, Homo sapiens
aggaacagcccagcacaggtat

SEQ ID NO: 4674727 - DNA, 15 bp, Homo sapiens
aggaacttctagctc

SEQ ID NO: 4674728 - DNA, 13 bp, Homo sapiens
aggaagaaaaaag

SEQ ID NO: 4674729 - DNA, 16 bp, Homo sapiens
aggaagagccacctgc

SEQ ID NO: 4674730 - DNA, 20 bp, Homo sapiens
aggaagagccacctgcaaga

SEQ ID NO: 4674731 - DNA, 12 bp, Homo sapiens
aggaagagttta

SEQ ID NO: 4674732 - DNA, 15 bp, Homo sapiens
aggaagcagaagacg

SEQ ID NO: 4674733 - DNA, 15 bp, Homo sapiens
aggaagccaaagagt

SEQ ID NO: 4674734 - DNA, 12 bp, Homo sapiens
aggaaggaaact

SEQ ID NO: 4674735 - DNA, 15 bp, Homo sapiens
aggaaggagggcaca

SEQ ID NO: 4674736 - DNA, 14 bp, Homo sapiens
aggaaggccaaaat

SEQ ID NO: 4674737 - DNA, 14 bp, Homo sapiens
aggaaggcctgagc

SEQ ID NO: 4674738 - DNA, 17 bp, Homo sapiens
aggaatataagaaaagt

SEQ ID NO: 4674739 - DNA, 11 bp, Homo sapiens
aggaatataca

SEQ ID NO: 4674740 - DNA, 15 bp, Homo sapiens
aggaatgctggactg

SEQ ID NO: 4674741 - DNA, 17 bp, Homo sapiens
aggaatgctggactgga

SEQ ID NO: 4674742 - DNA, 18 bp, Homo sapiens
aggaatggaggagccagg

SEQ ID NO: 4674743 - DNA, 23 bp, Homo sapiens
aggaatggaggagccaggcccca

SEQ ID NO: 4674744 - DNA, 14 bp, Homo sapiens
aggaatttatacct

SEQ ID NO: 4674745 - DNA, 12 bp, Homo sapiens
aggacaaaactt

SEQ ID NO: 4674746 - DNA, 17 bp, Homo sapiens
aggacaaaacttcttgt

SEQ ID NO: 4674747 - DNA, 20 bp, Homo sapiens
aggacaaaacttcttgtcag

SEQ ID NO: 4674748 - DNA, 12 bp, Homo sapiens
aggacacaggcc

SEQ ID NO: 4674749 - DNA, 14 bp, Homo sapiens
aggacacaggcctg

SEQ ID NO: 4674750 - DNA, 17 bp, Homo sapiens
agaggaaataacagaga

SEQ ID NO: 4674751 - DNA, 16 bp, Homo sapiens
agaggaaattcaaatc

SEQ ID NO: 4674752 - DNA, 16 bp, Homo sapiens
agaggaatgtgggcta

SEQ ID NO: 4674753 - DNA, 18 bp, Homo sapiens
agaggaatgtgggctatg

SEQ ID NO: 4674754 - DNA, 13 bp, Homo sapiens
agaggaatttata

SEQ ID NO: 4674755 - DNA, 18 bp, Homo sapiens
agaggactcccaaccctg

SEQ ID NO: 4674756 - DNA, 19 bp, Homo sapiens
agaggagatgtgatcaggc

SEQ ID NO: 4674757 - DNA, 20 bp, Homo sapiens
agaggagatgtgatcaggcc

SEQ ID NO: 4674758 - DNA, 12 bp, Homo sapiens
agaggcagcatg

SEQ ID NO: 4674759 - DNA, 19 bp, Homo sapiens
agaggcatttgagcagctg

SEQ ID NO: 4674760 - DNA, 15 bp, Homo sapiens
agaggcccccaccct

SEQ ID NO: 4674761 - DNA, 13 bp, Homo sapiens
agaggccctggag

SEQ ID NO: 4674762 - DNA, 14 bp, Homo sapiens
agaggccctggagg

SEQ ID NO: 4674763 - DNA, 16 bp, Homo sapiens
agaggccctggaggtc

SEQ ID NO: 4674764 - DNA, 22 bp, Homo sapiens
agaggccctggatcagcgtggc

SEQ ID NO: 4674765 - DNA, 23 bp, Homo sapiens
agaggccctggatcagcgtggcc

SEQ ID NO: 4674766 - DNA, 23 bp, Homo sapiens
agaggcgagaggtgagctacttt

SEQ ID NO: 4674767 - DNA, 18 bp, Homo sapiens
agaggctcgaggggctca

SEQ ID NO: 4674768 - DNA, 16 bp, Homo sapiens
agaggctgaggctggc

SEQ ID NO: 4674769 - DNA, 22 bp, Homo sapiens
agaggcttatgagatctaatgt

SEQ ID NO: 4674770 - DNA, 14 bp, Homo sapiens
agcctgaggacaga

SEQ ID NO: 4674771 - DNA, 22 bp, Homo sapiens
agcctgcattgagcttgcatgc

SEQ ID NO: 4674772 - DNA, 17 bp, Homo sapiens
agcctgccgagcaaccg

SEQ ID NO: 4674773 - DNA, 13 bp, Homo sapiens
agcctgctgacag

SEQ ID NO: 4674774 - DNA, 18 bp, Homo sapiens
agcctggactgtttcata

SEQ ID NO: 4674775 - DNA, 14 bp, Homo sapiens
agcctggcctcctg

SEQ ID NO: 4674776 - DNA, 16 bp, Homo sapiens
agcctggcctcctgcc

SEQ ID NO: 4674777 - DNA, 18 bp, Homo sapiens
agcctggcctcctgcctc

SEQ ID NO: 4674778 - DNA, 24 bp, Homo sapiens
agcctgggcctatggagagccctg

SEQ ID NO: 4674779 - DNA, 21 bp, Homo sapiens
agcctggggctctaacgcctg

SEQ ID NO: 4674780 - DNA, 16 bp, Homo sapiens
agcctgggggcctggc

SEQ ID NO: 4674781 - DNA, 20 bp, Homo sapiens
agcctgggggcctggctggc

SEQ ID NO: 4674782 - DNA, 21 bp, Homo sapiens
agcctgggggcctggctggct

SEQ ID NO: 4674783 - DNA, 22 bp, Homo sapiens
agcctgggggcctggctggctg

SEQ ID NO: 4674784 - DNA, 21 bp, Homo sapiens
agcctgtgcatgtatgtcttg

SEQ ID NO: 4674785 - DNA, 10 bp, Homo sapiens
agcctgtgcg

SEQ ID NO: 4674786 - DNA, 19 bp, Homo sapiens
agcctgtgcgtcccagctg

SEQ ID NO: 4674787 - DNA, 13 bp, Homo sapiens
agcctgtggcctt

SEQ ID NO: 4674788 - DNA, 16 bp, Homo sapiens
agcctgtgtctttaaa

SEQ ID NO: 4674789 - DNA, 17 bp, Homo sapiens
agcctgttcatggcaga

SEQ ID NO: 4674790 - DNA, 18 bp, Homo sapiens
agcctgttcatggcagat

SEQ ID NO: 4674791 - DNA, 19 bp, Homo sapiens
agcctgttcatggcagatg

SEQ ID NO: 4674792 - DNA, 17 bp, Homo sapiens
agccttcagtcagggtt

SEQ ID NO: 4674793 - DNA, 13 bp, Homo sapiens
agccttcccccag

SEQ ID NO: 4674794 - DNA, 16 bp, Homo sapiens
agccttccctctgcat

SEQ ID NO: 4674795 - DNA, 18 bp, Homo sapiens
agccttttgctttatgct

SEQ ID NO: 4674796 - DNA, 13 bp, Homo sapiens
agcgaacatcttc

SEQ ID NO: 4674797 - DNA, 13 bp, Homo sapiens
agcgaagtagctt

SEQ ID NO: 4674798 - DNA, 17 bp, Homo sapiens
agcgagtggatgctgtg

SEQ ID NO: 4674799 - DNA, 20 bp, Homo sapiens
agcgattccctctcccaggc

SEQ ID NO: 4674800 - DNA, 21 bp, Homo sapiens
agcgattccctctcccaggcc

SEQ ID NO: 4674801 - DNA, 22 bp, Homo sapiens
agcgattccctctcccaggccc

SEQ ID NO: 4674802 - DNA, 14 bp, Homo sapiens
agcgattctcctgc

SEQ ID NO: 4674803 - DNA, 12 bp, Homo sapiens
agcgccaggctg

SEQ ID NO: 4674804 - DNA, 21 bp, Homo sapiens
agcgccaggctgaccacagca

SEQ ID NO: 4674805 - DNA, 14 bp, Homo sapiens
agcgccctgcagac

SEQ ID NO: 4674806 - DNA, 20 bp, Homo sapiens
agcgccctgcagaccctgcc

SEQ ID NO: 4674807 - DNA, 14 bp, Homo sapiens
agcgcccttcctct

SEQ ID NO: 4674808 - DNA, 14 bp, Homo sapiens
agcggacagtggca

SEQ ID NO: 4674809 - DNA, 16 bp, Homo sapiens
agcggacagtggcagg

SEQ ID NO: 4674810 - DNA, 17 bp, Homo sapiens
agcggacagtggcagga

SEQ ID NO: 4674811 - DNA, 15 bp, Homo sapiens
agcggcccaagagcc

SEQ ID NO: 4674812 - DNA, 19 bp, Homo sapiens
agcggcccaagagcccgtg

SEQ ID NO: 4674813 - DNA, 11 bp, Homo sapiens
agcggccggcc

SEQ ID NO: 4674814 - DNA, 20 bp, Homo sapiens
agcggcttgcctgcctgctc

SEQ ID NO: 4674815 - DNA, 17 bp, Homo sapiens
agcggtccctgtccctc

SEQ ID NO: 4674816 - DNA, 13 bp, Homo sapiens
agcgtaaaatggt

SEQ ID NO: 4674817 - DNA, 12 bp, Homo sapiens
agcgtcaaagaa

SEQ ID NO: 4674818 - DNA, 19 bp, Homo sapiens
agcgtcaaagaaaatgcct

SEQ ID NO: 4674819 - DNA, 18 bp, Homo sapiens
agcgtccttggctgccgt

SEQ ID NO: 4674820 - DNA, 22 bp, Homo sapiens
agcgtggccttgttctgtcacc

SEQ ID NO: 4674821 - DNA, 17 bp, Homo sapiens
agcgtgggctcagcagg

SEQ ID NO: 4674822 - DNA, 18 bp, Homo sapiens
agctaacagggaaggcag

SEQ ID NO: 4674823 - DNA, 21 bp, Homo sapiens
agctaacagggaaggcaggca

SEQ ID NO: 4674824 - DNA, 23 bp, Homo sapiens
agctaacagggaaggcaggcagg

SEQ ID NO: 4674825 - DNA, 19 bp, Homo sapiens
agctaaggacatttcccag

SEQ ID NO: 4674826 - DNA, 20 bp, Homo sapiens
agctaagggtgggtgctcag

SEQ ID NO: 4674827 - DNA, 15 bp, Homo sapiens
agctacaagggaagc

SEQ ID NO: 4674828 - DNA, 17 bp, Homo sapiens
agctacccgcagagttc

SEQ ID NO: 4674829 - DNA, 22 bp, Homo sapiens
agctactgagaacataaaatct

SEQ ID NO: 4674830 - DNA, 16 bp, Homo sapiens
agctacttggcaggct

SEQ ID NO: 4674831 - DNA, 17 bp, Homo sapiens
agctacttggcaggctg

SEQ ID NO: 4674832 - DNA, 18 bp, Homo sapiens
agctacttggcaggctga

SEQ ID NO: 4674833 - DNA, 12 bp, Homo sapiens
agctagaaatga

SEQ ID NO: 4674834 - DNA, 15 bp, Homo sapiens
agctagactgtgtct

SEQ ID NO: 4674835 - DNA, 18 bp, Homo sapiens
agctaggccccagaggcc

SEQ ID NO: 4674836 - DNA, 19 bp, Homo sapiens
agctaggccccagaggccc

SEQ ID NO: 4674837 - DNA, 20 bp, Homo sapiens
agctaggccccagaggccct

SEQ ID NO: 4674838 - DNA, 23 bp, Homo sapiens
agctaggccccagaggccctgga

SEQ ID NO: 4674839 - DNA, 16 bp, Homo sapiens
agctatagttgcagcc

SEQ ID NO: 4674840 - DNA, 23 bp, Homo sapiens
agctatcttaggtggagctactc

SEQ ID NO: 4674841 - DNA, 14 bp, Homo sapiens
agctatttccttcc

SEQ ID NO: 4674842 - DNA, 13 bp, Homo sapiens
agctcaaaaatac

SEQ ID NO: 4674843 - DNA, 20 bp, Homo sapiens
agctcaaaaatactcttgat

SEQ ID NO: 4674844 - DNA, 15 bp, Homo sapiens
agctcaacggtctgg

SEQ ID NO: 4674845 - DNA, 14 bp, Homo sapiens
agctcacaaggcag

SEQ ID NO: 4674846 - DNA, 20 bp, Homo sapiens
agctcacaaggcagcaaggc

SEQ ID NO: 4674847 - DNA, 16 bp, Homo sapiens
agctcatctgcaaaag

SEQ ID NO: 4674848 - DNA, 17 bp, Homo sapiens
agctccaccactgtgca

SEQ ID NO: 4674849 - DNA, 18 bp, Homo sapiens
agctccaccactgtgcac

SEQ ID NO: 4674850 - DNA, 17 bp, Homo sapiens
agctccaccctggccga

SEQ ID NO: 4674851 - DNA, 17 bp, Homo sapiens
agctccatgttctccca

SEQ ID NO: 4674852 - DNA, 16 bp, Homo sapiens
agctcccccaggcaga

SEQ ID NO: 4674853 - DNA, 17 bp, Homo sapiens
agctcctgatcagaggc

SEQ ID NO: 4674854 - DNA, 18 bp, Homo sapiens
agctcctgatcagaggca

SEQ ID NO: 4674855 - DNA, 18 bp, Homo sapiens
agctctctctagaatgag

SEQ ID NO: 4674856 - DNA, 21 bp, Homo sapiens
agctctgaagaactctctgga

SEQ ID NO: 4674857 - DNA, 10 bp, Homo sapiens
agctctgaga

SEQ ID NO: 4674858 - DNA, 19 bp, Homo sapiens
agctctgagaggccctgga

SEQ ID NO: 4674859 - DNA, 23 bp, Homo sapiens
agctctgagaggccctggatcag

SEQ ID NO: 4674860 - DNA, 19 bp, Homo sapiens
agctctgccccttccccat

SEQ ID NO: 4674861 - DNA, 17 bp, Homo sapiens
agctcttagactcgcct

SEQ ID NO: 4674862 - DNA, 14 bp, Homo sapiens
agctcttcccttgc

SEQ ID NO: 4674863 - DNA, 15 bp, Homo sapiens
agctctttccaaatt

SEQ ID NO: 4674864 - DNA, 22 bp, Homo sapiens
agctctttccaaattaaaacaa

SEQ ID NO: 4674865 - DNA, 16 bp, Homo sapiens
agctgaaaagggcact

SEQ ID NO: 4674866 - DNA, 12 bp, Homo sapiens
agctgaaggcag

SEQ ID NO: 4674867 - DNA, 16 bp, Homo sapiens
agctgaataacctgca

SEQ ID NO: 4674868 - DNA, 20 bp, Homo sapiens
agaaaatataaggacttttt

SEQ ID NO: 4674869 - DNA, 20 bp, Homo sapiens
agaaaatgacttatttctgc

SEQ ID NO: 4674870 - DNA, 18 bp, Homo sapiens
agaaaatgcctagagata

SEQ ID NO: 4674871 - DNA, 16 bp, Homo sapiens
agaaacaagctgtgca

SEQ ID NO: 4674872 - DNA, 17 bp, Homo sapiens
agaaacaagctgtgcag

SEQ ID NO: 4674873 - DNA, 17 bp, Homo sapiens
agaaacagagtggcctc

SEQ ID NO: 4674874 - DNA, 18 bp, Homo sapiens
agaaacagagtggcctcc

SEQ ID NO: 4674875 - DNA, 23 bp, Homo sapiens
agaaacagagtggcctccctgct

SEQ ID NO: 4674876 - DNA, 14 bp, Homo sapiens
agaaacagctcagc

SEQ ID NO: 4674877 - DNA, 17 bp, Homo sapiens
agaaacagctcagccag

SEQ ID NO: 4674878 - DNA, 16 bp, Homo sapiens
agaaacattgtaaata

SEQ ID NO: 4674879 - DNA, 19 bp, Homo sapiens
agaaacctggggtgaatac

SEQ ID NO: 4674880 - DNA, 15 bp, Homo sapiens
agaaactaaaaatat

SEQ ID NO: 4674881 - DNA, 20 bp, Homo sapiens
agaaactaaaaatatagcaa

SEQ ID NO: 4674882 - DNA, 17 bp, Homo sapiens
agaaactaaacagaaaa

SEQ ID NO: 4674883 - DNA, 23 bp, Homo sapiens
agaaagaaactaaacagaaaact

SEQ ID NO: 4674884 - DNA, 19 bp, Homo sapiens
agaaagagagaagccagcc

SEQ ID NO: 4674885 - DNA, 14 bp, Homo sapiens
agaaagagctgcct

SEQ ID NO: 4674886 - DNA, 18 bp, Homo sapiens
agaaagagctgcctggat

SEQ ID NO: 4674887 - DNA, 19 bp, Homo sapiens
agaaagaggtgaccccagg

SEQ ID NO: 4674888 - DNA, 16 bp, Homo sapiens
agaaagatttgatggg

SEQ ID NO: 4674889 - DNA, 16 bp, Homo sapiens
agaaagggacccacct

SEQ ID NO: 4674890 - DNA, 13 bp, Homo sapiens
agaaagggagggc

SEQ ID NO: 4674891 - DNA, 16 bp, Homo sapiens
agaaagggagggctct

SEQ ID NO: 4674892 - DNA, 20 bp, Homo sapiens
agaaagggagggctctgagg

SEQ ID NO: 4674893 - DNA, 14 bp, Homo sapiens
agaaagtcccccct

SEQ ID NO: 4674894 - DNA, 22 bp, Homo sapiens
attcctctcatttccagcttct

SEQ ID NO: 4674895 - DNA, 21 bp, Homo sapiens
attccttttaaagaagcttta

SEQ ID NO: 4674896 - DNA, 22 bp, Homo sapiens
attccttttaaagaagctttat

SEQ ID NO: 4674897 - DNA, 23 bp, Homo sapiens
attccttttaaagaagctttatc

SEQ ID NO: 4674898 - DNA, 22 bp, Homo sapiens
attcgcatgtttaatgtgaact

SEQ ID NO: 4674899 - DNA, 13 bp, Homo sapiens
attctaatgcata

SEQ ID NO: 4674900 - DNA, 14 bp, Homo sapiens
attctacagttgtg

SEQ ID NO: 4674901 - DNA, 14 bp, Homo sapiens
attctattaacttt

SEQ ID NO: 4674902 - DNA, 17 bp, Homo sapiens
attctcataattcctac

SEQ ID NO: 4674903 - DNA, 16 bp, Homo sapiens
attctccacagcaacc

SEQ ID NO: 4674904 - DNA, 13 bp, Homo sapiens
attctcctcctcc

SEQ ID NO: 4674905 - DNA, 22 bp, Homo sapiens
attctcctcctcctccctcctc

SEQ ID NO: 4674906 - DNA, 14 bp, Homo sapiens
attctctctctgtt

SEQ ID NO: 4674907 - DNA, 16 bp, Homo sapiens
attctcttgaataaag

SEQ ID NO: 4674908 - DNA, 14 bp, Homo sapiens
attctctttcaaag

SEQ ID NO: 4674909 - DNA, 17 bp, Homo sapiens
attctcttttatctgtt

SEQ ID NO: 4674910 - DNA, 19 bp, Homo sapiens
attctgaagcaacatttta

SEQ ID NO: 4674911 - DNA, 16 bp, Homo sapiens
attctgacttatgaat

SEQ ID NO: 4674912 - DNA, 16 bp, Homo sapiens
attctgcatgagctga

SEQ ID NO: 4674913 - DNA, 17 bp, Homo sapiens
attctgcctagagtgta

SEQ ID NO: 4674914 - DNA, 15 bp, Homo sapiens
attctgtcttgttca

SEQ ID NO: 4674915 - DNA, 17 bp, Homo sapiens
attctgtgtggtatatt

SEQ ID NO: 4674916 - DNA, 19 bp, Homo sapiens
attctgtttttaatgctat

SEQ ID NO: 4674917 - DNA, 20 bp, Homo sapiens
attcttagctgtaacttaac

SEQ ID NO: 4674918 - DNA, 19 bp, Homo sapiens
attcttattggaaatgtac

SEQ ID NO: 4674919 - DNA, 18 bp, Homo sapiens
attcttggcttaatcatt

SEQ ID NO: 4674920 - DNA, 14 bp, Homo sapiens
attctttataattg

SEQ ID NO: 4674921 - DNA, 22 bp, Homo sapiens
attctttctgcctttaattttc

SEQ ID NO: 4674922 - DNA, 16 bp, Homo sapiens
attctttgtatcttaa

SEQ ID NO: 4674923 - DNA, 15 bp, Homo sapiens
attgaaaaaaaaaat

SEQ ID NO: 4674924 - DNA, 15 bp, Homo sapiens
attgaaaaatttcta

SEQ ID NO: 4674925 - DNA, 17 bp, Homo sapiens
attgaaaaatttctaac

SEQ ID NO: 4674926 - DNA, 17 bp, Homo sapiens
attgaaaatatatatta

SEQ ID NO: 4674927 - DNA, 18 bp, Homo sapiens
attgaagccgactctggc

SEQ ID NO: 4674928 - DNA, 22 bp, Homo sapiens
attgaagccgactctggccctg

SEQ ID NO: 4674929 - DNA, 18 bp, Homo sapiens
attgacagatcaagctgt

SEQ ID NO: 4674930 - DNA, 20 bp, Homo sapiens
attgacataggtcataaagc

SEQ ID NO: 4674931 - DNA, 23 bp, Homo sapiens
attgacattctacagttgtgata

SEQ ID NO: 4674932 - DNA, 15 bp, Homo sapiens
attgacctggagggg

SEQ ID NO: 4674933 - DNA, 22 bp, Homo sapiens
attgacctggaggggagaggtc

SEQ ID NO: 4674934 - DNA, 15 bp, Homo sapiens
attgactttcagtaa

SEQ ID NO: 4674935 - DNA, 12 bp, Homo sapiens
attgaggaagag

SEQ ID NO: 4674936 - DNA, 14 bp, Homo sapiens
attgagtaagaaca

SEQ ID NO: 4674937 - DNA, 15 bp, Homo sapiens
attgatactctttct

SEQ ID NO: 4674938 - DNA, 18 bp, Homo sapiens
attgatttgggttttttt

SEQ ID NO: 4674939 - DNA, 13 bp, Homo sapiens
attgatttttaaa

SEQ ID NO: 4674940 - DNA, 19 bp, Homo sapiens
attgatttttaaagtttaa

SEQ ID NO: 4674941 - DNA, 22 bp, Homo sapiens
attgatttttaaagtttaaata

SEQ ID NO: 4674942 - DNA, 23 bp, Homo sapiens
attgatttttaaagtttaaatac

SEQ ID NO: 4674943 - DNA, 18 bp, Homo sapiens
attgcactttcctttcaa

SEQ ID NO: 4674944 - DNA, 18 bp, Homo sapiens
attgctggggccaggccc

SEQ ID NO: 4674945 - DNA, 21 bp, Homo sapiens
attgctggggccaggccccat

SEQ ID NO: 4674946 - DNA, 13 bp, Homo sapiens
attgcttactgat

SEQ ID NO: 4674947 - DNA, 16 bp, Homo sapiens
attgcttactgatatt

SEQ ID NO: 4674948 - DNA, 18 bp, Homo sapiens
attggaatgcagaggtct

SEQ ID NO: 4674949 - DNA, 18 bp, Homo sapiens
attggagtttcaaatccc

SEQ ID NO: 4674950 - DNA, 20 bp, Homo sapiens
attgggcagcgcccttcctc

SEQ ID NO: 4674951 - DNA, 21 bp, Homo sapiens
attggtaaaactcactgtgat

SEQ ID NO: 4674952 - DNA, 16 bp, Homo sapiens
attggtgctatttgaa

SEQ ID NO: 4674953 - DNA, 13 bp, Homo sapiens
attgtaactatta

SEQ ID NO: 4674954 - DNA, 19 bp, Homo sapiens
attgtaactattaaccttt

SEQ ID NO: 4674955 - DNA, 18 bp, Homo sapiens
attgtaagtgaaattaag

SEQ ID NO: 4674956 - DNA, 15 bp, Homo sapiens
attgtacagttttta

SEQ ID NO: 4674957 - DNA, 20 bp, Homo sapiens
attgtacattttgtaaaata

SEQ ID NO: 4674958 - DNA, 18 bp, Homo sapiens
attgtatctacattaaaa

SEQ ID NO: 4674959 - DNA, 16 bp, Homo sapiens
attgtcacctcagcac

SEQ ID NO: 4674960 - DNA, 20 bp, Homo sapiens
attgtctcctatatatttct

SEQ ID NO: 4674961 - DNA, 23 bp, Homo sapiens
attgtctcctatatatttctatt

SEQ ID NO: 4674962 - DNA, 20 bp, Homo sapiens
attgttagaaaatgacttat

SEQ ID NO: 4674963 - DNA, 18 bp, Homo sapiens
attgttcaactcccttct

SEQ ID NO: 4674964 - DNA, 16 bp, Homo sapiens
attgttcccttcctct

SEQ ID NO: 4674965 - DNA, 15 bp, Homo sapiens
attgttcctctttgt

SEQ ID NO: 4674966 - DNA, 22 bp, Homo sapiens
attgtttcattgcgaatctttt

SEQ ID NO: 4674967 - DNA, 17 bp, Homo sapiens
attgtttctgcattcat

SEQ ID NO: 4674968 - DNA, 19 bp, Homo sapiens
attgtttgaaacaaagaag

SEQ ID NO: 4674969 - DNA, 19 bp, Homo sapiens
attgttttacctgttctga

SEQ ID NO: 4674970 - DNA, 18 bp, Homo sapiens
attgttttccagtgtcac

SEQ ID NO: 4674971 - DNA, 15 bp, Homo sapiens
attgttttctattta

SEQ ID NO: 4674972 - DNA, 18 bp, Homo sapiens
attgttttctatttatgc

SEQ ID NO: 4674973 - DNA, 20 bp, Homo sapiens
attgttttcttttacagact

SEQ ID NO: 4674974 - DNA, 18 bp, Homo sapiens
atttaaaaacaaccaaca

SEQ ID NO: 4674975 - DNA, 18 bp, Homo sapiens
atttaaaaacttaaatat

SEQ ID NO: 4674976 - DNA, 22 bp, Homo sapiens
atttaacagataaagaaactga

SEQ ID NO: 4674977 - DNA, 21 bp, Homo sapiens
atttaacttttagtaaagtca

SEQ ID NO: 4674978 - DNA, 18 bp, Homo sapiens
atttacaagatggactta

SEQ ID NO: 4674979 - DNA, 18 bp, Homo sapiens
atttagagggtgaaggag

SEQ ID NO: 4674980 - DNA, 17 bp, Homo sapiens
atttagataatttgaaa

SEQ ID NO: 4674981 - DNA, 13 bp, Homo sapiens
atttagcaaataa

SEQ ID NO: 4674982 - DNA, 18 bp, Homo sapiens
atttagcaaataatttcc

SEQ ID NO: 4674983 - DNA, 21 bp, Homo sapiens
atttagcatggggattgcaga

SEQ ID NO: 4674984 - DNA, 17 bp, Homo sapiens
atttagctgtaaactga

SEQ ID NO: 4674985 - DNA, 18 bp, Homo sapiens
atttagctgtaaactgaa

SEQ ID NO: 4674986 - DNA, 21 bp, Homo sapiens
atttagtgatcaaattgtgca

SEQ ID NO: 4674987 - DNA, 16 bp, Homo sapiens
atttataaaaatataa

SEQ ID NO: 4674988 - DNA, 18 bp, Homo sapiens
atttataaaaatataaat

SEQ ID NO: 4674989 - DNA, 15 bp, Homo sapiens
atttataatactgtt

SEQ ID NO: 4674990 - DNA, 13 bp, Homo sapiens
atttatacctcaa

SEQ ID NO: 4674991 - DNA, 20 bp, Homo sapiens
atttatactttaaagtattt

SEQ ID NO: 4674992 - DNA, 17 bp, Homo sapiens
atttatagaatttaata

SEQ ID NO: 4674993 - DNA, 18 bp, Homo sapiens
atttatagaatttaatat

SEQ ID NO: 4674994 - DNA, 20 bp, Homo sapiens
atttatctgtgtttttgaaa

SEQ ID NO: 4674995 - DNA, 17 bp, Homo sapiens
atttattaaaaatgttc

SEQ ID NO: 4674996 - DNA, 20 bp, Homo sapiens
atttattaaaaatgttctca

SEQ ID NO: 4674997 - DNA, 22 bp, Homo sapiens
atttattaaaaatgttctcaaa

SEQ ID NO: 4674998 - DNA, 16 bp, Homo sapiens
atttattagccaactg

SEQ ID NO: 4674999 - DNA, 12 bp, Homo sapiens
atttattgatta

SEQ ID NO: 4675000 - DNA, 22 bp, Homo sapiens
atttatttctagttctttcctc

SEQ ID NO: 4675001 - DNA, 15 bp, Homo sapiens
atttattttttaaga

SEQ ID NO: 4675002 - DNA, 17 bp, Homo sapiens
atttattttttaagaaa

SEQ ID NO: 4675003 - DNA, 13 bp, Homo sapiens
atttcaaaattta

SEQ ID NO: 4675004 - DNA, 14 bp, Homo sapiens
atttcacatttcta

SEQ ID NO: 4675005 - DNA, 23 bp, Homo sapiens
atcttggggacatctctttgaat

SEQ ID NO: 4675006 - DNA, 17 bp, Homo sapiens
atcttgttattattgtt

SEQ ID NO: 4675007 - DNA, 18 bp, Homo sapiens
atcttgttattattgtta

SEQ ID NO: 4675008 - DNA, 19 bp, Homo sapiens
atcttgtttcatttgcttg

SEQ ID NO: 4675009 - DNA, 22 bp, Homo sapiens
atctttaaaaaaaaatcttgtg

SEQ ID NO: 4675010 - DNA, 15 bp, Homo sapiens
atctttaattcctta

SEQ ID NO: 4675011 - DNA, 17 bp, Homo sapiens
atctttaattccttatc

SEQ ID NO: 4675012 - DNA, 19 bp, Homo sapiens
atctttattttattattca

SEQ ID NO: 4675013 - DNA, 19 bp, Homo sapiens
atctttcattaaaggcttc

SEQ ID NO: 4675014 - DNA, 13 bp, Homo sapiens
atctttgtgaagg

SEQ ID NO: 4675015 - DNA, 17 bp, Homo sapiens
atctttgtgaaggcctc

SEQ ID NO: 4675016 - DNA, 13 bp, Homo sapiens
atcttttgaattc

SEQ ID NO: 4675017 - DNA, 14 bp, Homo sapiens
atctttttcttggg

SEQ ID NO: 4675018 - DNA, 14 bp, Homo sapiens
atcttttttcaaaa

SEQ ID NO: 4675019 - DNA, 17 bp, Homo sapiens
atgaaaaagctgcttct

SEQ ID NO: 4675020 - DNA, 22 bp, Homo sapiens
atgaaaatatagacattctcac

SEQ ID NO: 4675021 - DNA, 23 bp, Homo sapiens
atgaaatagttattttaatacct

SEQ ID NO: 4675022 - DNA, 13 bp, Homo sapiens
atgaaatgtttac

SEQ ID NO: 4675023 - DNA, 17 bp, Homo sapiens
atgaaattcaagtgctt

SEQ ID NO: 4675024 - DNA, 16 bp, Homo sapiens
atgaacatctcttgaa

SEQ ID NO: 4675025 - DNA, 17 bp, Homo sapiens
atgaacatctcttgaaa

SEQ ID NO: 4675026 - DNA, 18 bp, Homo sapiens
atgaacatctcttgaaac

SEQ ID NO: 4675027 - DNA, 15 bp, Homo sapiens
atgaagaagtttcta

SEQ ID NO: 4675028 - DNA, 20 bp, Homo sapiens
atgaagatcatatacgtgaa

SEQ ID NO: 4675029 - DNA, 18 bp, Homo sapiens
atgaagtgcgtgaatgta

SEQ ID NO: 4675030 - DNA, 14 bp, Homo sapiens
atgaataacattta

SEQ ID NO: 4675031 - DNA, 16 bp, Homo sapiens
atgaataatgaaaata

SEQ ID NO: 4675032 - DNA, 12 bp, Homo sapiens
atgaatatcatt

SEQ ID NO: 4675033 - DNA, 18 bp, Homo sapiens
atgaatcccacccacatg

SEQ ID NO: 4675034 - DNA, 15 bp, Homo sapiens
atgaattataaatgt

SEQ ID NO: 4675035 - DNA, 16 bp, Homo sapiens
atgaattcatactctg

SEQ ID NO: 4675036 - DNA, 16 bp, Homo sapiens
atgacaaacatgatac

SEQ ID NO: 4675037 - DNA, 17 bp, Homo sapiens
atgacaccctggcctga

SEQ ID NO: 4675038 - DNA, 15 bp, Homo sapiens
atgacatttcttaaa

SEQ ID NO: 4675039 - DNA, 19 bp, Homo sapiens
atgacatttcttaaaactt

SEQ ID NO: 4675040 - DNA, 19 bp, Homo sapiens
atgaccagggatgctgggc

SEQ ID NO: 4675041 - DNA, 20 bp, Homo sapiens
atgaccagggatgctgggct

SEQ ID NO: 4675042 - DNA, 21 bp, Homo sapiens
atgaccagggatgctgggctg

SEQ ID NO: 4675043 - DNA, 16 bp, Homo sapiens
atgacccctggccaca

SEQ ID NO: 4675044 - DNA, 12 bp, Homo sapiens
atgacctccagc

SEQ ID NO: 4675045 - DNA, 22 bp, Homo sapiens
atgacgccagataaaatgttca

SEQ ID NO: 4675046 - DNA, 17 bp, Homo sapiens
atgactattacttttct

SEQ ID NO: 4675047 - DNA, 23 bp, Homo sapiens
atgactattacttttctgtttag

SEQ ID NO: 4675048 - DNA, 19 bp, Homo sapiens
atgactggtggtgagagac

SEQ ID NO: 4675049 - DNA, 21 bp, Homo sapiens
atgacttatttctgctctgga

SEQ ID NO: 4675050 - DNA, 22 bp, Homo sapiens
atgacttatttctgctctggaa

SEQ ID NO: 4675051 - DNA, 21 bp, Homo sapiens
atgacttgggcacccccagcc

SEQ ID NO: 4675052 - DNA, 22 bp, Homo sapiens
atgacttgggcacccccagcct

SEQ ID NO: 4675053 - DNA, 23 bp, Homo sapiens
atgacttgggcacccccagcctg

SEQ ID NO: 4675054 - DNA, 13 bp, Homo sapiens
atgactttttata

SEQ ID NO: 4675055 - DNA, 18 bp, Homo sapiens
atgactttttataaaatg

SEQ ID NO: 4675056 - DNA, 20 bp, Homo sapiens
atgagaaacagctcagccag

SEQ ID NO: 4675057 - DNA, 16 bp, Homo sapiens
atgagaatgacagcct

SEQ ID NO: 4675058 - DNA, 13 bp, Homo sapiens
atgagacacagga

SEQ ID NO: 4675059 - DNA, 17 bp, Homo sapiens
atgagacccagcccctt

SEQ ID NO: 4675060 - DNA, 17 bp, Homo sapiens
atgagactgccctgccc

SEQ ID NO: 4675061 - DNA, 17 bp, Homo sapiens
atgagagcgacacagac

SEQ ID NO: 4675062 - DNA, 18 bp, Homo sapiens
atgagagcgacacagacg

SEQ ID NO: 4675063 - DNA, 19 bp, Homo sapiens
atgagatcagggcctgccc

SEQ ID NO: 4675064 - DNA, 16 bp, Homo sapiens
atgagatctaatgtga

SEQ ID NO: 4675065 - DNA, 24 bp, Homo sapiens
atgagatgatacatccaaagcaga

SEQ ID NO: 4675066 - DNA, 14 bp, Homo sapiens
atgagcaagactgg

SEQ ID NO: 4675067 - DNA, 18 bp, Homo sapiens
atgagcccagagaacagc

SEQ ID NO: 4675068 - DNA, 16 bp, Homo sapiens
atgagcctacgctgaa

SEQ ID NO: 4675069 - DNA, 23 bp, Homo sapiens
atgagcctacgctgaagatggca

SEQ ID NO: 4675070 - DNA, 15 bp, Homo sapiens
atgagcgtcaaagaa

SEQ ID NO: 4675071 - DNA, 18 bp, Homo sapiens
atgagcgtcaaagaaaat

SEQ ID NO: 4675072 - DNA, 21 bp, Homo sapiens
atgagcgtcaaagaaaatgcc

SEQ ID NO: 4675073 - DNA, 19 bp, Homo sapiens
atgagctcctgatcagagg

SEQ ID NO: 4675074 - DNA, 22 bp, Homo sapiens
atgagctgtgcacaaagtggca

SEQ ID NO: 4675075 - DNA, 17 bp, Homo sapiens
atgaggccatctcagga

SEQ ID NO: 4675076 - DNA, 22 bp, Homo sapiens
atgaggccatctcaggagatgg

SEQ ID NO: 4675077 - DNA, 16 bp, Homo sapiens
atgagggcagcagcca

SEQ ID NO: 4675078 - DNA, 17 bp, Homo sapiens
atgagggcagcagccag

SEQ ID NO: 4675079 - DNA, 18 bp, Homo sapiens
atgagggcagcagccagc

SEQ ID NO: 4675080 - DNA, 19 bp, Homo sapiens
atgagggcagcagccagcc

SEQ ID NO: 4675081 - DNA, 22 bp, Homo sapiens
atgagggcagcagccagccctg

SEQ ID NO: 4675082 - DNA, 14 bp, Homo sapiens
atgaggtcaccagg

SEQ ID NO: 4675083 - DNA, 21 bp, Homo sapiens
atgagtaaaaaaaaaaacaat

SEQ ID NO: 4675084 - DNA, 17 bp, Homo sapiens
atgagtacaaatgcctt

SEQ ID NO: 4675085 - DNA, 17 bp, Homo sapiens
atgagtctgtttcccaa

SEQ ID NO: 4675086 - DNA, 16 bp, Homo sapiens
atgagttagaggagaa

SEQ ID NO: 4675087 - DNA, 15 bp, Homo sapiens
atgagttcaaatact

SEQ ID NO: 4675088 - DNA, 18 bp, Homo sapiens
atgagttcaaatactttt

SEQ ID NO: 4675089 - DNA, 14 bp, Homo sapiens
atgataacagaact

SEQ ID NO: 4675090 - DNA, 15 bp, Homo sapiens
atgatacatccaaag

SEQ ID NO: 4675091 - DNA, 13 bp, Homo sapiens
atgatactgctgc

SEQ ID NO: 4675092 - DNA, 15 bp, Homo sapiens
atgatcaagatatat

SEQ ID NO: 4675093 - DNA, 12 bp, Homo sapiens
atgatcctcagt

SEQ ID NO: 4675094 - DNA, 13 bp, Homo sapiens
atgatcctcagtg

SEQ ID NO: 4675095 - DNA, 14 bp, Homo sapiens
atgatcctcagtgc

SEQ ID NO: 4675096 - DNA, 18 bp, Homo sapiens
atgatccttttttgtcat

SEQ ID NO: 4675097 - DNA, 15 bp, Homo sapiens
atgatcgctgtattt

SEQ ID NO: 4675098 - DNA, 15 bp, Homo sapiens
atgatctcggctcac

SEQ ID NO: 4675099 - DNA, 15 bp, Homo sapiens
atgatctctctagct

SEQ ID NO: 4675100 - DNA, 21 bp, Homo sapiens
atgatcttgagtataagaaat

SEQ ID NO: 4675101 - DNA, 14 bp, Homo sapiens
atgatggatggcag

SEQ ID NO: 4675102 - DNA, 18 bp, Homo sapiens
atgatggatggcagactc

SEQ ID NO: 4675103 - DNA, 13 bp, Homo sapiens
atgatggcaacag

SEQ ID NO: 4675104 - DNA, 12 bp, Homo sapiens
atgattgtttct

SEQ ID NO: 4675105 - DNA, 14 bp, Homo sapiens
atgatttggccagg

SEQ ID NO: 4675106 - DNA, 15 bp, Homo sapiens
atgcaaaagttctca

SEQ ID NO: 4675107 - DNA, 12 bp, Homo sapiens
atgcaaaatgga

SEQ ID NO: 4675108 - DNA, 16 bp, Homo sapiens
atgcaaattaaaacat

SEQ ID NO: 4675109 - DNA, 18 bp, Homo sapiens
atgcaaattaaaacatat

SEQ ID NO: 4675110 - DNA, 13 bp, Homo sapiens
atgcaatgtgcta

SEQ ID NO: 4675111 - DNA, 18 bp, Homo sapiens
atgcaatgtgctactgat

SEQ ID NO: 4675112 - DNA, 22 bp, Homo sapiens
atgcacactcatgcacacagat

SEQ ID NO: 4675113 - DNA, 20 bp, Homo sapiens
atgcaccctcatacacagaa

SEQ ID NO: 4675114 - DNA, 21 bp, Homo sapiens
atgcaccttgtgtctgtacac

SEQ ID NO: 4675115 - DNA, 15 bp, Homo sapiens
atgcacttttagaaa

SEQ ID NO: 4675116 - DNA, 22 bp, Homo sapiens
atggtcccacatccctgggcct

SEQ ID NO: 4675117 - DNA, 17 bp, Homo sapiens
atggtcggatctcacag

SEQ ID NO: 4675118 - DNA, 22 bp, Homo sapiens
atggtctgaagaaggaaggcct

SEQ ID NO: 4675119 - DNA, 16 bp, Homo sapiens
atggtgcttggagggg

SEQ ID NO: 4675120 - DNA, 16 bp, Homo sapiens
atgtaaagaaatgtct

SEQ ID NO: 4675121 - DNA, 22 bp, Homo sapiens
atgtaaggaggtttgtataagt

SEQ ID NO: 4675122 - DNA, 18 bp, Homo sapiens
atgtaagtttacctatgt

SEQ ID NO: 4675123 - DNA, 23 bp, Homo sapiens
atgtaatgtgtggtggcctcagc

SEQ ID NO: 4675124 - DNA, 20 bp, Homo sapiens
atgtaatttaatgcctgccc

SEQ ID NO: 4675125 - DNA, 17 bp, Homo sapiens
atgtaatttcaaaatac

SEQ ID NO: 4675126 - DNA, 20 bp, Homo sapiens
atgtaatttcaaaatacatt

SEQ ID NO: 4675127 - DNA, 14 bp, Homo sapiens
atgtacaggatgct

SEQ ID NO: 4675128 - DNA, 16 bp, Homo sapiens
atgtacagttgaaata

SEQ ID NO: 4675129 - DNA, 14 bp, Homo sapiens
atgtactttttagt

SEQ ID NO: 4675130 - DNA, 19 bp, Homo sapiens
atgtagccagcagaactga

SEQ ID NO: 4675131 - DNA, 15 bp, Homo sapiens
atgtagcttcttctg

SEQ ID NO: 4675132 - DNA, 14 bp, Homo sapiens
atgtagtcataata

SEQ ID NO: 4675133 - DNA, 16 bp, Homo sapiens
atgtagtcataataaa

SEQ ID NO: 4675134 - DNA, 20 bp, Homo sapiens
atgtagtttttatatgttgt

SEQ ID NO: 4675135 - DNA, 14 bp, Homo sapiens
atgtataaatgtga

SEQ ID NO: 4675136 - DNA, 12 bp, Homo sapiens
atgtataataca

SEQ ID NO: 4675137 - DNA, 15 bp, Homo sapiens
atgtatgatctctct

SEQ ID NO: 4675138 - DNA, 16 bp, Homo sapiens
atgtatgatctctcta

SEQ ID NO: 4675139 - DNA, 18 bp, Homo sapiens
atgtattctttctgcctt

SEQ ID NO: 4675140 - DNA, 14 bp, Homo sapiens
atgtattgattcaa

SEQ ID NO: 4675141 - DNA, 19 bp, Homo sapiens
atgtattttcctaatgtga

SEQ ID NO: 4675142 - DNA, 17 bp, Homo sapiens
atgtcaaaattgtttaa

SEQ ID NO: 4675143 - DNA, 14 bp, Homo sapiens
atgtcaattcatga

SEQ ID NO: 4675144 - DNA, 16 bp, Homo sapiens
atgtcactagaatgga

SEQ ID NO: 4675145 - DNA, 21 bp, Homo sapiens
atgtccactgttctgttctca

SEQ ID NO: 4675146 - DNA, 16 bp, Homo sapiens
atgtccctgggccagg

SEQ ID NO: 4675147 - DNA, 19 bp, Homo sapiens
atgtcgaaacctacaagat

SEQ ID NO: 4675148 - DNA, 16 bp, Homo sapiens
atgtctgcttgtcaaa

SEQ ID NO: 4675149 - DNA, 16 bp, Homo sapiens
atgtctgtatccccag

SEQ ID NO: 4675150 - DNA, 16 bp, Homo sapiens
atgtctgttgatgact

SEQ ID NO: 4675151 - DNA, 18 bp, Homo sapiens
atgtcttactactttaaa

SEQ ID NO: 4675152 - DNA, 19 bp, Homo sapiens
atgtcttactactttaaat

SEQ ID NO: 4675153 - DNA, 21 bp, Homo sapiens
atgtcttgcaaagcctttaaa

SEQ ID NO: 4675154 - DNA, 13 bp, Homo sapiens
atgtcttggacac

SEQ ID NO: 4675155 - DNA, 21 bp, Homo sapiens
atgtcttgtgtatttctctgt

SEQ ID NO: 4675156 - DNA, 15 bp, Homo sapiens
atgtgaaaaattaac

SEQ ID NO: 4675157 - DNA, 12 bp, Homo sapiens
atgtgaagccaa

SEQ ID NO: 4675158 - DNA, 22 bp, Homo sapiens
atgtgaagccaattcagacagg

SEQ ID NO: 4675159 - DNA, 18 bp, Homo sapiens
atgtgactctgaagctga

SEQ ID NO: 4675160 - DNA, 15 bp, Homo sapiens
atgtgaggcaataag

SEQ ID NO: 4675161 - DNA, 12 bp, Homo sapiens
atgtgagtattt

SEQ ID NO: 4675162 - DNA, 14 bp, Homo sapiens
atgtgagtatttct

SEQ ID NO: 4675163 - DNA, 19 bp, Homo sapiens
atgtgatcaggccccaccc

SEQ ID NO: 4675164 - DNA, 18 bp, Homo sapiens
atgtgattaatgttttca

SEQ ID NO: 4675165 - DNA, 21 bp, Homo sapiens
atgtgattttcctttgtagct

SEQ ID NO: 4675166 - DNA, 20 bp, Homo sapiens
atgtgctactgattgtttca

SEQ ID NO: 4675167 - DNA, 22 bp, Homo sapiens
atgtggaggaagagccacctgc

SEQ ID NO: 4675168 - DNA, 23 bp, Homo sapiens
atgtggaggaagagccacctgca

SEQ ID NO: 4675169 - DNA, 16 bp, Homo sapiens
atgtggcagctgtctc

SEQ ID NO: 4675170 - DNA, 17 bp, Homo sapiens
atgtggccaagcctatc

SEQ ID NO: 4675171 - DNA, 13 bp, Homo sapiens
atgtgggcactgg

SEQ ID NO: 4675172 - DNA, 14 bp, Homo sapiens
atgtggtctcagga

SEQ ID NO: 4675173 - DNA, 17 bp, Homo sapiens
atgtggtgaatatgcaa

SEQ ID NO: 4675174 - DNA, 17 bp, Homo sapiens
atgtgtagcctgtgcat

SEQ ID NO: 4675175 - DNA, 23 bp, Homo sapiens
atgtgtagcctgtgcatgtatgt

SEQ ID NO: 4675176 - DNA, 16 bp, Homo sapiens
atgtgtatacatacat

SEQ ID NO: 4675177 - DNA, 16 bp, Homo sapiens
atgtgtatattccttt

SEQ ID NO: 4675178 - DNA, 23 bp, Homo sapiens
atgtgtatattccttttaaagaa

SEQ ID NO: 4675179 - DNA, 21 bp, Homo sapiens
atgtgtcagtggggctctctg

SEQ ID NO: 4675180 - DNA, 22 bp, Homo sapiens
atgtgtgcagagcagacaggct

SEQ ID NO: 4675181 - DNA, 16 bp, Homo sapiens
atgtgtggtggcctca

SEQ ID NO: 4675182 - DNA, 18 bp, Homo sapiens
atgttaaaaagaaatcca

SEQ ID NO: 4675183 - DNA, 19 bp, Homo sapiens
atgttaaaaagaaatccag

SEQ ID NO: 4675184 - DNA, 21 bp, Homo sapiens
atgttaaacttacttagtgtt

SEQ ID NO: 4675185 - DNA, 14 bp, Homo sapiens
atgttaccttcaca

SEQ ID NO: 4675186 - DNA, 17 bp, Homo sapiens
atgttactgactcctca

SEQ ID NO: 4675187 - DNA, 15 bp, Homo sapiens
atgttagagactttt

SEQ ID NO: 4675188 - DNA, 21 bp, Homo sapiens
atgttatgtaaaaggccaaac

SEQ ID NO: 4675189 - DNA, 18 bp, Homo sapiens
atgttcaaagactgtgaa

SEQ ID NO: 4675190 - DNA, 12 bp, Homo sapiens
atgttcctcctt

SEQ ID NO: 4675191 - DNA, 16 bp, Homo sapiens
atgttctgtcttccca

SEQ ID NO: 4675192 - DNA, 21 bp, Homo sapiens
atgttcttatgcaaaatggaa

SEQ ID NO: 4675193 - DNA, 17 bp, Homo sapiens
atgttgctctttcacct

SEQ ID NO: 4675194 - DNA, 20 bp, Homo sapiens
atgttgctgttcacagcttt

SEQ ID NO: 4675195 - DNA, 16 bp, Homo sapiens
atgttggccaggctgg

SEQ ID NO: 4675196 - DNA, 14 bp, Homo sapiens
atgttgtaatattt

SEQ ID NO: 4675197 - DNA, 21 bp, Homo sapiens
atgttgtacttgaaaatgcta

SEQ ID NO: 4675198 - DNA, 15 bp, Homo sapiens
atgttgtgtttttaa

SEQ ID NO: 4675199 - DNA, 16 bp, Homo sapiens
atgtttaaaagaaata

SEQ ID NO: 4675200 - DNA, 20 bp, Homo sapiens
atgtttaaaagaaatatatt

SEQ ID NO: 4675201 - DNA, 15 bp, Homo sapiens
atgtttaaaataaaa

SEQ ID NO: 4675202 - DNA, 15 bp, Homo sapiens
atgtttaataaagct

SEQ ID NO: 4675203 - DNA, 16 bp, Homo sapiens
atgtttaataaagctt

SEQ ID NO: 4675204 - DNA, 19 bp, Homo sapiens
atgtttaataaagctttat

SEQ ID NO: 4675205 - DNA, 16 bp, Homo sapiens
atgtttaatgtgaact

SEQ ID NO: 4675206 - DNA, 18 bp, Homo sapiens
atgtttaatgtgaactct

SEQ ID NO: 4675207 - DNA, 20 bp, Homo sapiens
atgtttatcaaagagcactt

SEQ ID NO: 4675208 - DNA, 17 bp, Homo sapiens
atgtttatttactaatt

SEQ ID NO: 4675209 - DNA, 13 bp, Homo sapiens
atgtttccctctc

SEQ ID NO: 4675210 - DNA, 12 bp, Homo sapiens
atgtttgtgtct

SEQ ID NO: 4675211 - DNA, 13 bp, Homo sapiens
atgtttgtgtctg

SEQ ID NO: 4675212 - DNA, 16 bp, Homo sapiens
atgtttgtgtctgtgg

SEQ ID NO: 4675213 - DNA, 13 bp, Homo sapiens
atgtttgttttca

SEQ ID NO: 4675214 - DNA, 20 bp, Homo sapiens
atgtttgttttcaaaatact

SEQ ID NO: 4675215 - DNA, 21 bp, Homo sapiens
atgtttgttttcaaaatactt

SEQ ID NO: 4675216 - DNA, 22 bp, Homo sapiens
atgttttaaagaatatgacttt

SEQ ID NO: 4675217 - DNA, 16 bp, Homo sapiens
atgttttaacaaaaac

SEQ ID NO: 4675218 - DNA, 23 bp, Homo sapiens
atgttttagggagtggttcctgt

SEQ ID NO: 4675219 - DNA, 13 bp, Homo sapiens
atgttttatcctt

SEQ ID NO: 4675220 - DNA, 15 bp, Homo sapiens
atgttttcattatgt

SEQ ID NO: 4675221 - DNA, 13 bp, Homo sapiens
attaaaacaaata

SEQ ID NO: 4675222 - DNA, 19 bp, Homo sapiens
attaaaacaaatatacatt

SEQ ID NO: 4675223 - DNA, 17 bp, Homo sapiens
attaaaacatatttcat

SEQ ID NO: 4675224 - DNA, 21 bp, Homo sapiens
attaaaacatatttcatttta

SEQ ID NO: 4675225 - DNA, 17 bp, Homo sapiens
attaaaagaatgagtga

SEQ ID NO: 4675226 - DNA, 20 bp, Homo sapiens
attaaaataactaagcaagt

SEQ ID NO: 4675227 - DNA, 14 bp, Homo sapiens
attaaaatattttg

SEQ ID NO: 4675228 - DNA, 14 bp, Homo sapiens
attaaaatgacaaa

SEQ ID NO: 4675229 - DNA, 13 bp, Homo sapiens
attaaacattttt

SEQ ID NO: 4675230 - DNA, 13 bp, Homo sapiens
attaaagtattct

SEQ ID NO: 4675231 - DNA, 16 bp, Homo sapiens
attaaatatttgaaga

SEQ ID NO: 4675232 - DNA, 16 bp, Homo sapiens
attaaatctagacatt

SEQ ID NO: 4675233 - DNA, 19 bp, Homo sapiens
attaaatctagacattctt

SEQ ID NO: 4675234 - DNA, 15 bp, Homo sapiens
attaacaaatttctt

SEQ ID NO: 4675235 - DNA, 18 bp, Homo sapiens
attaacaaatttctttgt

SEQ ID NO: 4675236 - DNA, 22 bp, Homo sapiens
attaacctgaaagaacatacat

SEQ ID NO: 4675237 - DNA, 14 bp, Homo sapiens
attaacggtgctaa

SEQ ID NO: 4675238 - DNA, 15 bp, Homo sapiens
attaacggtgctaaa

SEQ ID NO: 4675239 - DNA, 13 bp, Homo sapiens
attaagcagcttg

SEQ ID NO: 4675240 - DNA, 13 bp, Homo sapiens
attaagttatctt

SEQ ID NO: 4675241 - DNA, 16 bp, Homo sapiens
attaatcaagagaaac

SEQ ID NO: 4675242 - DNA, 21 bp, Homo sapiens
attaatcaagagaaacttcaa

SEQ ID NO: 4675243 - DNA, 21 bp, Homo sapiens
attaatgtttgtgggtatttc

SEQ ID NO: 4675244 - DNA, 16 bp, Homo sapiens
attaattaaacattgt

SEQ ID NO: 4675245 - DNA, 14 bp, Homo sapiens
attaatttcaaaat

SEQ ID NO: 4675246 - DNA, 16 bp, Homo sapiens
attaattttttttcat

SEQ ID NO: 4675247 - DNA, 18 bp, Homo sapiens
attacaaatgcaaatttc

SEQ ID NO: 4675248 - DNA, 15 bp, Homo sapiens
attacaattttatct

SEQ ID NO: 4675249 - DNA, 15 bp, Homo sapiens
attacagggcacagg

SEQ ID NO: 4675250 - DNA, 20 bp, Homo sapiens
attacccccagtcctcccta

SEQ ID NO: 4675251 - DNA, 15 bp, Homo sapiens
attacctttaatttt

SEQ ID NO: 4675252 - DNA, 16 bp, Homo sapiens
attactactaggtaat

SEQ ID NO: 4675253 - DNA, 13 bp, Homo sapiens
attactgtgagga

SEQ ID NO: 4675254 - DNA, 14 bp, Homo sapiens
attactgttccaga

SEQ ID NO: 4675255 - DNA, 23 bp, Homo sapiens
attacttgctttcaattgacaaa

SEQ ID NO: 4675256 - DNA, 19 bp, Homo sapiens
attagatgattatatattg

SEQ ID NO: 4675257 - DNA, 14 bp, Homo sapiens
attagcatggcggc

SEQ ID NO: 4675258 - DNA, 22 bp, Homo sapiens
attagccaactgtttccctgct

SEQ ID NO: 4675259 - DNA, 18 bp, Homo sapiens
attagtcgggcatgagtc

SEQ ID NO: 4675260 - DNA, 20 bp, Homo sapiens
attagtcgggcatgagtctg

SEQ ID NO: 4675261 - DNA, 17 bp, Homo sapiens
attagtggtcataaaat

SEQ ID NO: 4675262 - DNA, 18 bp, Homo sapiens
attagtggtcataaaata

SEQ ID NO: 4675263 - DNA, 21 bp, Homo sapiens
attagtgtgacagtttccaaa

SEQ ID NO: 4675264 - DNA, 23 bp, Homo sapiens
attagtgtgacagtttccaaatt

SEQ ID NO: 4675265 - DNA, 18 bp, Homo sapiens
attagttacaaagttata

SEQ ID NO: 4675266 - DNA, 17 bp, Homo sapiens
attatacagacctaata

SEQ ID NO: 4675267 - DNA, 22 bp, Homo sapiens
attatacagacctaatatcatt

SEQ ID NO: 4675268 - DNA, 19 bp, Homo sapiens
attatagcaactaatgttt

SEQ ID NO: 4675269 - DNA, 19 bp, Homo sapiens
attatatattgcaaggtgt

SEQ ID NO: 4675270 - DNA, 23 bp, Homo sapiens
attatatattgcaaggtgtgatg

SEQ ID NO: 4675271 - DNA, 14 bp, Homo sapiens
attatatggcagga

SEQ ID NO: 4675272 - DNA, 18 bp, Homo sapiens
attatatggcaggagcta

SEQ ID NO: 4675273 - DNA, 16 bp, Homo sapiens
attatccttgctatga

SEQ ID NO: 4675274 - DNA, 19 bp, Homo sapiens
attatccttttatctcaca

SEQ ID NO: 4675275 - DNA, 19 bp, Homo sapiens
attatcttgaaaaagtatt

SEQ ID NO: 4675276 - DNA, 22 bp, Homo sapiens
attatgcaattagcctcatagt

SEQ ID NO: 4675277 - DNA, 16 bp, Homo sapiens
attatgcattatatca

SEQ ID NO: 4675278 - DNA, 14 bp, Homo sapiens
attatggaaaactg

SEQ ID NO: 4675279 - DNA, 15 bp, Homo sapiens
attatggaaaactgt

SEQ ID NO: 4675280 - DNA, 12 bp, Homo sapiens
attatgttcatg

SEQ ID NO: 4675281 - DNA, 19 bp, Homo sapiens
attatgttcatgtaagaag

SEQ ID NO: 4675282 - DNA, 12 bp, Homo sapiens
attatgtttatt

SEQ ID NO: 4675283 - DNA, 19 bp, Homo sapiens
attatgtttatttcatgtg

SEQ ID NO: 4675284 - DNA, 13 bp, Homo sapiens
attattaattgca

SEQ ID NO: 4675285 - DNA, 14 bp, Homo sapiens
attattatctttaa

SEQ ID NO: 4675286 - DNA, 12 bp, Homo sapiens
attattattatt

SEQ ID NO: 4675287 - DNA, 15 bp, Homo sapiens
attattattattatt

SEQ ID NO: 4675288 - DNA, 10 bp, Homo sapiens
attattattt

SEQ ID NO: 4675289 - DNA, 14 bp, Homo sapiens
attattcaaaaaca

SEQ ID NO: 4675290 - DNA, 12 bp, Homo sapiens
attattcaagaa

SEQ ID NO: 4675291 - DNA, 18 bp, Homo sapiens
attattgttaataataat

SEQ ID NO: 4675292 - DNA, 20 bp, Homo sapiens
attatttattaaaaatgttc

SEQ ID NO: 4675293 - DNA, 20 bp, Homo sapiens
attatttatttctggtaact

SEQ ID NO: 4675294 - DNA, 12 bp, Homo sapiens
attatttgctat

SEQ ID NO: 4675295 - DNA, 16 bp, Homo sapiens
attatttgctatggca

SEQ ID NO: 4675296 - DNA, 22 bp, Homo sapiens
attattttttttatatttattg

SEQ ID NO: 4675297 - DNA, 13 bp, Homo sapiens
attcaactaaaaa

SEQ ID NO: 4675298 - DNA, 20 bp, Homo sapiens
attcaactaatacatggttt

SEQ ID NO: 4675299 - DNA, 21 bp, Homo sapiens
attcaagaatgaaaaatataa

SEQ ID NO: 4675300 - DNA, 19 bp, Homo sapiens
attcaagagctagaaaaat

SEQ ID NO: 4675301 - DNA, 16 bp, Homo sapiens
attcaatcatttattc

SEQ ID NO: 4675302 - DNA, 18 bp, Homo sapiens
attcaatcatttattcat

SEQ ID NO: 4675303 - DNA, 21 bp, Homo sapiens
attcaattagtggtcataaaa

SEQ ID NO: 4675304 - DNA, 15 bp, Homo sapiens
attcacatatgtctt

SEQ ID NO: 4675305 - DNA, 16 bp, Homo sapiens
attcacccactccctt

SEQ ID NO: 4675306 - DNA, 13 bp, Homo sapiens
attcacttcacgc

SEQ ID NO: 4675307 - DNA, 17 bp, Homo sapiens
attcagaattatacaga

SEQ ID NO: 4675308 - DNA, 22 bp, Homo sapiens
attcagaattatacagacctaa

SEQ ID NO: 4675309 - DNA, 13 bp, Homo sapiens
attcagacaggca

SEQ ID NO: 4675310 - DNA, 19 bp, Homo sapiens
attcagactttcacaccat

SEQ ID NO: 4675311 - DNA, 18 bp, Homo sapiens
attcagcagcaaattttc

SEQ ID NO: 4675312 - DNA, 19 bp, Homo sapiens
attcagcagcaaattttca

SEQ ID NO: 4675313 - DNA, 11 bp, Homo sapiens
attcagctcct

SEQ ID NO: 4675314 - DNA, 14 bp, Homo sapiens
attcagctctggag

SEQ ID NO: 4675315 - DNA, 16 bp, Homo sapiens
attcagctctggagaa

SEQ ID NO: 4675316 - DNA, 14 bp, Homo sapiens
attcagctttgtcc

SEQ ID NO: 4675317 - DNA, 19 bp, Homo sapiens
attcaggaaaaggcctggg

SEQ ID NO: 4675318 - DNA, 14 bp, Homo sapiens
attcatactctgtt

SEQ ID NO: 4675319 - DNA, 20 bp, Homo sapiens
attcatactctgttgcctcc

SEQ ID NO: 4675320 - DNA, 17 bp, Homo sapiens
attcatgacattatgtg

SEQ ID NO: 4675321 - DNA, 18 bp, Homo sapiens
attcatggagtagcctgg

SEQ ID NO: 4675322 - DNA, 19 bp, Homo sapiens
attcatggagtagcctgga

SEQ ID NO: 4675323 - DNA, 21 bp, Homo sapiens
attcatggagtagcctggact

SEQ ID NO: 4675324 - DNA, 22 bp, Homo sapiens
attcatggagtagcctggactg

SEQ ID NO: 4675325 - DNA, 12 bp, Homo sapiens
attcatggctac

SEQ ID NO: 4675326 - DNA, 19 bp, Homo sapiens
attccaagccttattttga

SEQ ID NO: 4675327 - DNA, 19 bp, Homo sapiens
attccaagcttcatattaa

SEQ ID NO: 4675328 - DNA, 19 bp, Homo sapiens
attccaccagggccagagc

SEQ ID NO: 4675329 - DNA, 20 bp, Homo sapiens
attccaccagggccagagca

SEQ ID NO: 4675330 - DNA, 24 bp, Homo sapiens
attccaccagggccagagcagctc

SEQ ID NO: 4675331 - DNA, 13 bp, Homo sapiens
attccaggagaag

SEQ ID NO: 4675332 - DNA, 19 bp, Homo sapiens
attcccaagccgaccttcc

SEQ ID NO: 4675333 - DNA, 15 bp, Homo sapiens
attcccaagctccct

SEQ ID NO: 4675334 - DNA, 16 bp, Homo sapiens
attcccatggagttgc

SEQ ID NO: 4675335 - DNA, 18 bp, Homo sapiens
attccctctcccaggccc

SEQ ID NO: 4675336 - DNA, 23 bp, Homo sapiens
attccgtagccagctgctcccca

SEQ ID NO: 4675337 - DNA, 20 bp, Homo sapiens
attcctatgctgcaatacat

SEQ ID NO: 4675338 - DNA, 20 bp, Homo sapiens
attcctctcatttccagctt

SEQ ID NO: 4675339 - DNA, 16 bp, Homo sapiens
atgcacttttagaaat

SEQ ID NO: 4675340 - DNA, 20 bp, Homo sapiens
atgcacttttagaaatgcat

SEQ ID NO: 4675341 - DNA, 14 bp, Homo sapiens
atgcagctatctgg

SEQ ID NO: 4675342 - DNA, 20 bp, Homo sapiens
atgcagctcttcaacatgac

SEQ ID NO: 4675343 - DNA, 22 bp, Homo sapiens
atgcatatgtcactagaatgga

SEQ ID NO: 4675344 - DNA, 16 bp, Homo sapiens
atgcatatttataaga

SEQ ID NO: 4675345 - DNA, 14 bp, Homo sapiens
atgcatcagaaagg

SEQ ID NO: 4675346 - DNA, 19 bp, Homo sapiens
atgcatctttaattcctta

SEQ ID NO: 4675347 - DNA, 18 bp, Homo sapiens
atgcatgtcttttaaaat

SEQ ID NO: 4675348 - DNA, 16 bp, Homo sapiens
atgcatgtgaagaaag

SEQ ID NO: 4675349 - DNA, 17 bp, Homo sapiens
atgcatgtgaagaaagg

SEQ ID NO: 4675350 - DNA, 18 bp, Homo sapiens
atgcattatatcaaatct

SEQ ID NO: 4675351 - DNA, 15 bp, Homo sapiens
atgccacacctggcc

SEQ ID NO: 4675352 - DNA, 20 bp, Homo sapiens
atgccactgcactccagcct

SEQ ID NO: 4675353 - DNA, 13 bp, Homo sapiens
atgcccccagctg

SEQ ID NO: 4675354 - DNA, 16 bp, Homo sapiens
atgcccccagctggcc

SEQ ID NO: 4675355 - DNA, 12 bp, Homo sapiens
atgcccttcccc

SEQ ID NO: 4675356 - DNA, 23 bp, Homo sapiens
atgcccttccccctttctctgcc

SEQ ID NO: 4675357 - DNA, 13 bp, Homo sapiens
atgcccttgctgg

SEQ ID NO: 4675358 - DNA, 15 bp, Homo sapiens
atgcctcactaattt

SEQ ID NO: 4675359 - DNA, 21 bp, Homo sapiens
atgcctcactaatttttgtat

SEQ ID NO: 4675360 - DNA, 18 bp, Homo sapiens
atgcctctgaggccagcc

SEQ ID NO: 4675361 - DNA, 21 bp, Homo sapiens
atgcctctgaggccagcctgg

SEQ ID NO: 4675362 - DNA, 21 bp, Homo sapiens
atgcctgcccattagagaagt

SEQ ID NO: 4675363 - DNA, 14 bp, Homo sapiens
atgcctggtatttt

SEQ ID NO: 4675364 - DNA, 22 bp, Homo sapiens
atgccttaaaatggaattgaaa

SEQ ID NO: 4675365 - DNA, 13 bp, Homo sapiens
atgccttctgtat

SEQ ID NO: 4675366 - DNA, 20 bp, Homo sapiens
atgccttggggaggacaaaa

SEQ ID NO: 4675367 - DNA, 17 bp, Homo sapiens
atgcctttttggttttg

SEQ ID NO: 4675368 - DNA, 15 bp, Homo sapiens
atgcggatcctgctg

SEQ ID NO: 4675369 - DNA, 16 bp, Homo sapiens
atgcggatcctgctgg

SEQ ID NO: 4675370 - DNA, 21 bp, Homo sapiens
atgcggtagccagcacacagg

SEQ ID NO: 4675371 - DNA, 13 bp, Homo sapiens
atgcgtgggcaga

SEQ ID NO: 4675372 - DNA, 15 bp, Homo sapiens
atgctaacaaagaca

SEQ ID NO: 4675373 - DNA, 18 bp, Homo sapiens
atgctatgttctgtcttc

SEQ ID NO: 4675374 - DNA, 13 bp, Homo sapiens
atgctatttgaac

SEQ ID NO: 4675375 - DNA, 19 bp, Homo sapiens
atgctcccaactcccttct

SEQ ID NO: 4675376 - DNA, 17 bp, Homo sapiens
atgctctatgtttgtat

SEQ ID NO: 4675377 - DNA, 18 bp, Homo sapiens
atgctctctcaaattgtc

SEQ ID NO: 4675378 - DNA, 17 bp, Homo sapiens
atgctctgcagcattga

SEQ ID NO: 4675379 - DNA, 20 bp, Homo sapiens
atgctgacattcacctgccc

SEQ ID NO: 4675380 - DNA, 18 bp, Homo sapiens
atgctgatcttttaaaat

SEQ ID NO: 4675381 - DNA, 21 bp, Homo sapiens
atgctgatcttttaaaatcat

SEQ ID NO: 4675382 - DNA, 13 bp, Homo sapiens
atgctgatggagc

SEQ ID NO: 4675383 - DNA, 15 bp, Homo sapiens
atgctggaggcagag

SEQ ID NO: 4675384 - DNA, 19 bp, Homo sapiens
atgctggctcccagggcca

SEQ ID NO: 4675385 - DNA, 16 bp, Homo sapiens
atgctgggctgggccc

SEQ ID NO: 4675386 - DNA, 11 bp, Homo sapiens
atgctgtgcta

SEQ ID NO: 4675387 - DNA, 14 bp, Homo sapiens
atgctgtgctacgt

SEQ ID NO: 4675388 - DNA, 20 bp, Homo sapiens
atgctgtgctacgtgtgaaa

SEQ ID NO: 4675389 - DNA, 21 bp, Homo sapiens
atgctgtgctacgtgtgaaat

SEQ ID NO: 4675390 - DNA, 13 bp, Homo sapiens
atgctgtttctaa

SEQ ID NO: 4675391 - DNA, 22 bp, Homo sapiens
atgctgtttctaagaaaatgta

SEQ ID NO: 4675392 - DNA, 22 bp, Homo sapiens
atgcttagtgaagcataaagtt

SEQ ID NO: 4675393 - DNA, 19 bp, Homo sapiens
atgcttcatatgaggagga

SEQ ID NO: 4675394 - DNA, 15 bp, Homo sapiens
atgcttctatcagac

SEQ ID NO: 4675395 - DNA, 13 bp, Homo sapiens
atgcttgggctga

SEQ ID NO: 4675396 - DNA, 22 bp, Homo sapiens
atgcttgggctgacccagcatc

SEQ ID NO: 4675397 - DNA, 19 bp, Homo sapiens
atggaaaacgctctctact

SEQ ID NO: 4675398 - DNA, 18 bp, Homo sapiens
atggaattaaatgtggga

SEQ ID NO: 4675399 - DNA, 23 bp, Homo sapiens
atggacacgagccacaagctgca

SEQ ID NO: 4675400 - DNA, 14 bp, Homo sapiens
atggacaggctggc

SEQ ID NO: 4675401 - DNA, 21 bp, Homo sapiens
atggagaaagaagtggagaca

SEQ ID NO: 4675402 - DNA, 15 bp, Homo sapiens
atggagagagcctta

SEQ ID NO: 4675403 - DNA, 18 bp, Homo sapiens
atggagagccctgggacc

SEQ ID NO: 4675404 - DNA, 21 bp, Homo sapiens
atggagcaaacctagccccca

SEQ ID NO: 4675405 - DNA, 16 bp, Homo sapiens
atggagcaagctcttc

SEQ ID NO: 4675406 - DNA, 22 bp, Homo sapiens
atggaggagccaggccccaccc

SEQ ID NO: 4675407 - DNA, 15 bp, Homo sapiens
atggaggcagatgcc

SEQ ID NO: 4675408 - DNA, 20 bp, Homo sapiens
atggaggccctcctgtgctg

SEQ ID NO: 4675409 - DNA, 14 bp, Homo sapiens
atggagggcttggc

SEQ ID NO: 4675410 - DNA, 18 bp, Homo sapiens
atggagggcttggcccag

SEQ ID NO: 4675411 - DNA, 22 bp, Homo sapiens
atggaggggagaggggtcacac

SEQ ID NO: 4675412 - DNA, 21 bp, Homo sapiens
atggagtagaggtactagaat

SEQ ID NO: 4675413 - DNA, 15 bp, Homo sapiens
atggagtctcactct

SEQ ID NO: 4675414 - DNA, 20 bp, Homo sapiens
atggagtctcactcttgtca

SEQ ID NO: 4675415 - DNA, 15 bp, Homo sapiens
atggagttcttgtgc

SEQ ID NO: 4675416 - DNA, 21 bp, Homo sapiens
atggatgaattttccagacct

SEQ ID NO: 4675417 - DNA, 16 bp, Homo sapiens
atggatggcagactct

SEQ ID NO: 4675418 - DNA, 19 bp, Homo sapiens
atggatggctcaagtctgc

SEQ ID NO: 4675419 - DNA, 20 bp, Homo sapiens
atggattaaatttaattctt

SEQ ID NO: 4675420 - DNA, 20 bp, Homo sapiens
atggcaacattggacagaaa

SEQ ID NO: 4675421 - DNA, 21 bp, Homo sapiens
atggcactgaccggtgctttt

SEQ ID NO: 4675422 - DNA, 21 bp, Homo sapiens
atggcagactctttaataaat

SEQ ID NO: 4675423 - DNA, 12 bp, Homo sapiens
atggcagagcag

SEQ ID NO: 4675424 - DNA, 14 bp, Homo sapiens
atggcagatgtagg

SEQ ID NO: 4675425 - DNA, 21 bp, Homo sapiens
atggcagatgtaggagggact

SEQ ID NO: 4675426 - DNA, 12 bp, Homo sapiens
atggcaggagct

SEQ ID NO: 4675427 - DNA, 19 bp, Homo sapiens
atggcaggagctactgaga

SEQ ID NO: 4675428 - DNA, 20 bp, Homo sapiens
atggcaggagctactgagaa

SEQ ID NO: 4675429 - DNA, 21 bp, Homo sapiens
atggcaggagctactgagaac

SEQ ID NO: 4675430 - DNA, 15 bp, Homo sapiens
atggcatcttcaata

SEQ ID NO: 4675431 - DNA, 16 bp, Homo sapiens
atggcatcttcaatat

SEQ ID NO: 4675432 - DNA, 19 bp, Homo sapiens
atggcattgcactgcttat

SEQ ID NO: 4675433 - DNA, 16 bp, Homo sapiens
atggccaccttttcag

SEQ ID NO: 4675434 - DNA, 18 bp, Homo sapiens
atggccagactcccttgc

SEQ ID NO: 4675435 - DNA, 18 bp, Homo sapiens
atggctcaagtctgcaca

SEQ ID NO: 4675436 - DNA, 23 bp, Homo sapiens
atggctctgcacccctctgccct

SEQ ID NO: 4675437 - DNA, 16 bp, Homo sapiens
atggctgtatttgctg

SEQ ID NO: 4675438 - DNA, 19 bp, Homo sapiens
atggctgtatttgctgttg

SEQ ID NO: 4675439 - DNA, 13 bp, Homo sapiens
atggcttaggaat

SEQ ID NO: 4675440 - DNA, 21 bp, Homo sapiens
atggcttatttctatgacaaa

SEQ ID NO: 4675441 - DNA, 18 bp, Homo sapiens
atgggaaggtgggcgggc

SEQ ID NO: 4675442 - DNA, 18 bp, Homo sapiens
atgggagggaggctcagg

SEQ ID NO: 4675443 - DNA, 22 bp, Homo sapiens
atggggtagaaacattgtaaat

SEQ ID NO: 4675444 - DNA, 15 bp, Homo sapiens
atgggtctggctaga

SEQ ID NO: 4675445 - DNA, 22 bp, Homo sapiens
atgggtctggctagagggccca

SEQ ID NO: 4675446 - DNA, 13 bp, Homo sapiens
atggtacttcctc

SEQ ID NO: 4675447 - DNA, 17 bp, Homo sapiens
atggtacttcctctgtg

SEQ ID NO: 4675448 - DNA, 18 bp, Homo sapiens
atggtatcctactgagca

SEQ ID NO: 4675449 - DNA, 20 bp, Homo sapiens
atggtcccacatccctgggc

SEQ ID NO: 4675450 - DNA, 12 bp, Homo sapiens
atcctgggacct

SEQ ID NO: 4675451 - DNA, 22 bp, Homo sapiens
atcctgggacctccccagccca

SEQ ID NO: 4675452 - DNA, 15 bp, Homo sapiens
atccttatcagagct

SEQ ID NO: 4675453 - DNA, 18 bp, Homo sapiens
atccttcaaaataaaaag

SEQ ID NO: 4675454 - DNA, 21 bp, Homo sapiens
atccttctggcagattcaaat

SEQ ID NO: 4675455 - DNA, 21 bp, Homo sapiens
atccttgactgaagcgaacat

SEQ ID NO: 4675456 - DNA, 21 bp, Homo sapiens
atccttgggccataattatga

SEQ ID NO: 4675457 - DNA, 20 bp, Homo sapiens
atccttgtgttcagctcttt

SEQ ID NO: 4675458 - DNA, 23 bp, Homo sapiens
atccttgttttgaaaacctaaaa

SEQ ID NO: 4675459 - DNA, 15 bp, Homo sapiens
atccttttttgtcat

SEQ ID NO: 4675460 - DNA, 17 bp, Homo sapiens
atcgaagggtttttaga

SEQ ID NO: 4675461 - DNA, 23 bp, Homo sapiens
atcgaagggtttttagagaatgt

SEQ ID NO: 4675462 - DNA, 15 bp, Homo sapiens
atcgacagacagcca

SEQ ID NO: 4675463 - DNA, 19 bp, Homo sapiens
atcgattcccaagctccct

SEQ ID NO: 4675464 - DNA, 13 bp, Homo sapiens
atcggactgccaa

SEQ ID NO: 4675465 - DNA, 16 bp, Homo sapiens
atcggttgttctttcc

SEQ ID NO: 4675466 - DNA, 22 bp, Homo sapiens
atcgtccctatatcagggcctg

SEQ ID NO: 4675467 - DNA, 14 bp, Homo sapiens
atcgtttatttcac

SEQ ID NO: 4675468 - DNA, 21 bp, Homo sapiens
atctaactgatgagtaaactg

SEQ ID NO: 4675469 - DNA, 15 bp, Homo sapiens
atctaatacctctgt

SEQ ID NO: 4675470 - DNA, 17 bp, Homo sapiens
atctaatacctctgtgt

SEQ ID NO: 4675471 - DNA, 19 bp, Homo sapiens
atctaatacctctgtgtgc

SEQ ID NO: 4675472 - DNA, 22 bp, Homo sapiens
atctaatacctctgtgtgctcc

SEQ ID NO: 4675473 - DNA, 16 bp, Homo sapiens
atctacagtaatgaaa

SEQ ID NO: 4675474 - DNA, 15 bp, Homo sapiens
atctacattaaaatg

SEQ ID NO: 4675475 - DNA, 20 bp, Homo sapiens
atctacattaaaatgacaaa

SEQ ID NO: 4675476 - DNA, 14 bp, Homo sapiens
atctaggccacccc

SEQ ID NO: 4675477 - DNA, 18 bp, Homo sapiens
atctaggccaccccaacc

SEQ ID NO: 4675478 - DNA, 23 bp, Homo sapiens
atctaggccaccccaacctctgt

SEQ ID NO: 4675479 - DNA, 15 bp, Homo sapiens
atctaggtcctggct

SEQ ID NO: 4675480 - DNA, 23 bp, Homo sapiens
atctagtgggttgacctttaaat

SEQ ID NO: 4675481 - DNA, 22 bp, Homo sapiens
atctataagtagtaaatcagaa

SEQ ID NO: 4675482 - DNA, 13 bp, Homo sapiens
atctatggcttat

SEQ ID NO: 4675483 - DNA, 23 bp, Homo sapiens
atctattgaaaatatatattata

SEQ ID NO: 4675484 - DNA, 13 bp, Homo sapiens
atctcacaggctg

SEQ ID NO: 4675485 - DNA, 16 bp, Homo sapiens
atctcacaggctgaga

SEQ ID NO: 4675486 - DNA, 17 bp, Homo sapiens
atctcacaggctgagaa

SEQ ID NO: 4675487 - DNA, 14 bp, Homo sapiens
atctcagcttgctg

SEQ ID NO: 4675488 - DNA, 13 bp, Homo sapiens
atctcagcttttg

SEQ ID NO: 4675489 - DNA, 14 bp, Homo sapiens
atctcaggagatgg

SEQ ID NO: 4675490 - DNA, 18 bp, Homo sapiens
atctcccacctagcagca

SEQ ID NO: 4675491 - DNA, 21 bp, Homo sapiens
atctccccagtagagaaacat

SEQ ID NO: 4675492 - DNA, 19 bp, Homo sapiens
atctcccttccacctcaca

SEQ ID NO: 4675493 - DNA, 22 bp, Homo sapiens
atctcccttccacctcacaact

SEQ ID NO: 4675494 - DNA, 15 bp, Homo sapiens
atctcctgccagccc

SEQ ID NO: 4675495 - DNA, 17 bp, Homo sapiens
atctcctgccagcccag

SEQ ID NO: 4675496 - DNA, 17 bp, Homo sapiens
atctctcccttacccat

SEQ ID NO: 4675497 - DNA, 15 bp, Homo sapiens
atctctctcttgcct

SEQ ID NO: 4675498 - DNA, 17 bp, Homo sapiens
atctctctcttgcctga

SEQ ID NO: 4675499 - DNA, 11 bp, Homo sapiens
atctctgagac

SEQ ID NO: 4675500 - DNA, 13 bp, Homo sapiens
atctcttgaaacc

SEQ ID NO: 4675501 - DNA, 12 bp, Homo sapiens
atctcttgcttt

SEQ ID NO: 4675502 - DNA, 18 bp, Homo sapiens
atctctttctttctcttt

SEQ ID NO: 4675503 - DNA, 21 bp, Homo sapiens
atctctttgaattttctgtgt

SEQ ID NO: 4675504 - DNA, 20 bp, Homo sapiens
atctctttgtacaggaactg

SEQ ID NO: 4675505 - DNA, 23 bp, Homo sapiens
atctcttttccactccattgtcg

SEQ ID NO: 4675506 - DNA, 21 bp, Homo sapiens
atctgaaaacatctagcccaa

SEQ ID NO: 4675507 - DNA, 17 bp, Homo sapiens
atctgactgccaagcca

SEQ ID NO: 4675508 - DNA, 19 bp, Homo sapiens
atctgactgccaagccaga

SEQ ID NO: 4675509 - DNA, 16 bp, Homo sapiens
atctgcacactctctt

SEQ ID NO: 4675510 - DNA, 20 bp, Homo sapiens
atctgcacactctcttctcc

SEQ ID NO: 4675511 - DNA, 14 bp, Homo sapiens
atctgccagacctg

SEQ ID NO: 4675512 - DNA, 15 bp, Homo sapiens
atctgccagacctgc

SEQ ID NO: 4675513 - DNA, 18 bp, Homo sapiens
atctgccagacctgcatg

SEQ ID NO: 4675514 - DNA, 19 bp, Homo sapiens
atctgcttttaatggatgt

SEQ ID NO: 4675515 - DNA, 21 bp, Homo sapiens
atctggaaacctctacatatt

SEQ ID NO: 4675516 - DNA, 19 bp, Homo sapiens
atctggagtgagaggcccc

SEQ ID NO: 4675517 - DNA, 20 bp, Homo sapiens
atctggagtgagaggccccc

SEQ ID NO: 4675518 - DNA, 21 bp, Homo sapiens
atctggctgcagttttgctat

SEQ ID NO: 4675519 - DNA, 11 bp, Homo sapiens
atctgggaaag

SEQ ID NO: 4675520 - DNA, 17 bp, Homo sapiens
atctgggctgtgggcaa

SEQ ID NO: 4675521 - DNA, 22 bp, Homo sapiens
atctggggaggcaggcattcct

SEQ ID NO: 4675522 - DNA, 22 bp, Homo sapiens
atctgggtgcatgatcttgagc

SEQ ID NO: 4675523 - DNA, 23 bp, Homo sapiens
atctgtaacaggtattttgtttc

SEQ ID NO: 4675524 - DNA, 13 bp, Homo sapiens
atctgtacaatga

SEQ ID NO: 4675525 - DNA, 15 bp, Homo sapiens
atctgtacaatgaac

SEQ ID NO: 4675526 - DNA, 13 bp, Homo sapiens
atctgtcttttat

SEQ ID NO: 4675527 - DNA, 18 bp, Homo sapiens
atctgtgccatagaacaa

SEQ ID NO: 4675528 - DNA, 16 bp, Homo sapiens
atctgtggaaagctag

SEQ ID NO: 4675529 - DNA, 13 bp, Homo sapiens
atctgtggagctg

SEQ ID NO: 4675530 - DNA, 14 bp, Homo sapiens
atctgtggagctgc

SEQ ID NO: 4675531 - DNA, 17 bp, Homo sapiens
atctgtggagctgccac

SEQ ID NO: 4675532 - DNA, 21 bp, Homo sapiens
atctgtggagctgccacagag

SEQ ID NO: 4675533 - DNA, 15 bp, Homo sapiens
atctgtgtacaaaga

SEQ ID NO: 4675534 - DNA, 17 bp, Homo sapiens
atctgtgtacaaagaaa

SEQ ID NO: 4675535 - DNA, 18 bp, Homo sapiens
atctgtgtacaaagaaat

SEQ ID NO: 4675536 - DNA, 13 bp, Homo sapiens
atctgtgttctaa

SEQ ID NO: 4675537 - DNA, 18 bp, Homo sapiens
atctgtgtttttgaaata

SEQ ID NO: 4675538 - DNA, 21 bp, Homo sapiens
atctgtgtttttgaaatatta

SEQ ID NO: 4675539 - DNA, 17 bp, Homo sapiens
atctgtttttaaagcac

SEQ ID NO: 4675540 - DNA, 12 bp, Homo sapiens
atcttaaaggac

SEQ ID NO: 4675541 - DNA, 18 bp, Homo sapiens
atcttaaatctaaacaaa

SEQ ID NO: 4675542 - DNA, 13 bp, Homo sapiens
atcttaaatctgt

SEQ ID NO: 4675543 - DNA, 18 bp, Homo sapiens
atcttaatatatacattt

SEQ ID NO: 4675544 - DNA, 20 bp, Homo sapiens
atcttaatatatacattttt

SEQ ID NO: 4675545 - DNA, 13 bp, Homo sapiens
atcttaatcttta

SEQ ID NO: 4675546 - DNA, 14 bp, Homo sapiens
atcttaatctttat

SEQ ID NO: 4675547 - DNA, 20 bp, Homo sapiens
atcttcaatatgaatctata

SEQ ID NO: 4675548 - DNA, 12 bp, Homo sapiens
atcttcatataa

SEQ ID NO: 4675549 - DNA, 14 bp, Homo sapiens
atcttcatataaac

SEQ ID NO: 4675550 - DNA, 15 bp, Homo sapiens
atcttcatataaact

SEQ ID NO: 4675551 - DNA, 14 bp, Homo sapiens
atcttctctcttga

SEQ ID NO: 4675552 - DNA, 15 bp, Homo sapiens
atcttctctcttgat

SEQ ID NO: 4675553 - DNA, 23 bp, Homo sapiens
atcttctctcttgattgattttt

SEQ ID NO: 4675554 - DNA, 16 bp, Homo sapiens
atcttcttactaagct

SEQ ID NO: 4675555 - DNA, 20 bp, Homo sapiens
atcttgaatgtggtctcagg

SEQ ID NO: 4675556 - DNA, 20 bp, Homo sapiens
atcttgctcattcttcagtt

SEQ ID NO: 4675557 - DNA, 15 bp, Homo sapiens
atcttgcttccaaga

SEQ ID NO: 4675558 - DNA, 17 bp, Homo sapiens
atcttgcttccaagacc

SEQ ID NO: 4675559 - DNA, 20 bp, Homo sapiens
atcttggcctaaacctcagt

SEQ ID NO: 4675560 - DNA, 22 bp, Homo sapiens
atcttggggacatctctttgaa

SEQ ID NO: 4675561 - DNA, 17 bp, Homo sapiens
atcacagccccaccctt

SEQ ID NO: 4675562 - DNA, 18 bp, Homo sapiens
atcacagccccacccttg

SEQ ID NO: 4675563 - DNA, 21 bp, Homo sapiens
atcacagcctcacccctgccc

SEQ ID NO: 4675564 - DNA, 15 bp, Homo sapiens
atcacattaatttaa

SEQ ID NO: 4675565 - DNA, 20 bp, Homo sapiens
atcaccagtgcatcacatct

SEQ ID NO: 4675566 - DNA, 13 bp, Homo sapiens
atcacgatttcat

SEQ ID NO: 4675567 - DNA, 16 bp, Homo sapiens
atcacgatttcatcct

SEQ ID NO: 4675568 - DNA, 14 bp, Homo sapiens
atcacgtaaagcta

SEQ ID NO: 4675569 - DNA, 20 bp, Homo sapiens
atcactaaactttatttgta

SEQ ID NO: 4675570 - DNA, 12 bp, Homo sapiens
atcactctagaa

SEQ ID NO: 4675571 - DNA, 12 bp, Homo sapiens
atcactgcatta

SEQ ID NO: 4675572 - DNA, 18 bp, Homo sapiens
atcagaaaagtaattttg

SEQ ID NO: 4675573 - DNA, 16 bp, Homo sapiens
atcagaaagggagggc

SEQ ID NO: 4675574 - DNA, 18 bp, Homo sapiens
atcagaaagtaacaatct

SEQ ID NO: 4675575 - DNA, 23 bp, Homo sapiens
atcagaacattcagctctggaga

SEQ ID NO: 4675576 - DNA, 15 bp, Homo sapiens
atcagaataggaaga

SEQ ID NO: 4675577 - DNA, 14 bp, Homo sapiens
atcagactcagttt

SEQ ID NO: 4675578 - DNA, 21 bp, Homo sapiens
atcagactcagttttttgtaa

SEQ ID NO: 4675579 - DNA, 21 bp, Homo sapiens
atcagaggcatttgagcagct

SEQ ID NO: 4675580 - DNA, 22 bp, Homo sapiens
atcagaggcatttgagcagctg

SEQ ID NO: 4675581 - DNA, 14 bp, Homo sapiens
atcagattgcatgt

SEQ ID NO: 4675582 - DNA, 16 bp, Homo sapiens
atcagattgcatgtga

SEQ ID NO: 4675583 - DNA, 18 bp, Homo sapiens
atcagattgcatgtgact

SEQ ID NO: 4675584 - DNA, 21 bp, Homo sapiens
atcagattgcatgtgactctg

SEQ ID NO: 4675585 - DNA, 15 bp, Homo sapiens
atcagcacacggctc

SEQ ID NO: 4675586 - DNA, 11 bp, Homo sapiens
atcagccctgc

SEQ ID NO: 4675587 - DNA, 13 bp, Homo sapiens
atcagcgtggcct

SEQ ID NO: 4675588 - DNA, 15 bp, Homo sapiens
atcagcgtggccttg

SEQ ID NO: 4675589 - DNA, 16 bp, Homo sapiens
atcagcgtggccttgt

SEQ ID NO: 4675590 - DNA, 16 bp, Homo sapiens
atcaggatcagctttg

SEQ ID NO: 4675591 - DNA, 16 bp, Homo sapiens
atcaggctactagaat

SEQ ID NO: 4675592 - DNA, 11 bp, Homo sapiens
atcagggcctg

SEQ ID NO: 4675593 - DNA, 15 bp, Homo sapiens
atcagggcctgcccc

SEQ ID NO: 4675594 - DNA, 18 bp, Homo sapiens
atcagtaggctaatgtca

SEQ ID NO: 4675595 - DNA, 12 bp, Homo sapiens
atcagttctgtg

SEQ ID NO: 4675596 - DNA, 14 bp, Homo sapiens
atcagtttttcata

SEQ ID NO: 4675597 - DNA, 12 bp, Homo sapiens
atcataaagcat

SEQ ID NO: 4675598 - DNA, 14 bp, Homo sapiens
atcataaagcattt

SEQ ID NO: 4675599 - DNA, 13 bp, Homo sapiens
atcatcaaaaagt

SEQ ID NO: 4675600 - DNA, 19 bp, Homo sapiens
atcatcatagtaaaagaaa

SEQ ID NO: 4675601 - DNA, 20 bp, Homo sapiens
atcatcctcccgccaggagc

SEQ ID NO: 4675602 - DNA, 19 bp, Homo sapiens
atcatgagccttcagtcag

SEQ ID NO: 4675603 - DNA, 12 bp, Homo sapiens
atcatgcaaaat

SEQ ID NO: 4675604 - DNA, 14 bp, Homo sapiens
atcatgcctctgag

SEQ ID NO: 4675605 - DNA, 11 bp, Homo sapiens
atcatgtaaag

SEQ ID NO: 4675606 - DNA, 14 bp, Homo sapiens
atcatgtctgtatc

SEQ ID NO: 4675607 - DNA, 23 bp, Homo sapiens
atcatgtctgtatccccagtgcc

SEQ ID NO: 4675608 - DNA, 17 bp, Homo sapiens
atcatgtggccccaccc

SEQ ID NO: 4675609 - DNA, 20 bp, Homo sapiens
atcattactgttccagattc

SEQ ID NO: 4675610 - DNA, 15 bp, Homo sapiens
atcattatttgagac

SEQ ID NO: 4675611 - DNA, 17 bp, Homo sapiens
atcattctttgtatctt

SEQ ID NO: 4675612 - DNA, 19 bp, Homo sapiens
atcattctttgtatcttaa

SEQ ID NO: 4675613 - DNA, 13 bp, Homo sapiens
atcattgatttta

SEQ ID NO: 4675614 - DNA, 23 bp, Homo sapiens
atcattgccatcaccatttggtg

SEQ ID NO: 4675615 - DNA, 21 bp, Homo sapiens
atcattgtcagccttgctact

SEQ ID NO: 4675616 - DNA, 19 bp, Homo sapiens
atcatttataatactgttt

SEQ ID NO: 4675617 - DNA, 15 bp, Homo sapiens
atcatttattcattg

SEQ ID NO: 4675618 - DNA, 17 bp, Homo sapiens
atcattttaataaagtt

SEQ ID NO: 4675619 - DNA, 13 bp, Homo sapiens
atcattttattca

SEQ ID NO: 4675620 - DNA, 12 bp, Homo sapiens
atcatttttgta

SEQ ID NO: 4675621 - DNA, 15 bp, Homo sapiens
atccaaggaaacatg

SEQ ID NO: 4675622 - DNA, 20 bp, Homo sapiens
atccaaggaaacatgcagct

SEQ ID NO: 4675623 - DNA, 22 bp, Homo sapiens
atccaatgttagagactttttt

SEQ ID NO: 4675624 - DNA, 23 bp, Homo sapiens
atccaatgttagagacttttttc

SEQ ID NO: 4675625 - DNA, 12 bp, Homo sapiens
atccacacacag

SEQ ID NO: 4675626 - DNA, 13 bp, Homo sapiens
atccacacacagt

SEQ ID NO: 4675627 - DNA, 14 bp, Homo sapiens
atccacacacagta

SEQ ID NO: 4675628 - DNA, 16 bp, Homo sapiens
atccacccatatgtta

SEQ ID NO: 4675629 - DNA, 20 bp, Homo sapiens
atccacgtagggggcagggg

SEQ ID NO: 4675630 - DNA, 21 bp, Homo sapiens
atccacgtagggggcaggggc

SEQ ID NO: 4675631 - DNA, 16 bp, Homo sapiens
atccaggcaccaggac

SEQ ID NO: 4675632 - DNA, 20 bp, Homo sapiens
atccagtcattttattttgt

SEQ ID NO: 4675633 - DNA, 21 bp, Homo sapiens
atccataaagaagcaataaag

SEQ ID NO: 4675634 - DNA, 22 bp, Homo sapiens
atccataggtttctctccctcc

SEQ ID NO: 4675635 - DNA, 17 bp, Homo sapiens
atccatgggtctggcta

SEQ ID NO: 4675636 - DNA, 22 bp, Homo sapiens
atccatgtgattaatgttttca

SEQ ID NO: 4675637 - DNA, 15 bp, Homo sapiens
atccattaggccagc

SEQ ID NO: 4675638 - DNA, 16 bp, Homo sapiens
atccattaggccagca

SEQ ID NO: 4675639 - DNA, 17 bp, Homo sapiens
atcccaaccagtgccaa

SEQ ID NO: 4675640 - DNA, 16 bp, Homo sapiens
atcccaatcattgttg

SEQ ID NO: 4675641 - DNA, 18 bp, Homo sapiens
atcccacccacatgtgac

SEQ ID NO: 4675642 - DNA, 23 bp, Homo sapiens
atcccacccacatgtgacacata

SEQ ID NO: 4675643 - DNA, 11 bp, Homo sapiens
atcccaggagg

SEQ ID NO: 4675644 - DNA, 17 bp, Homo sapiens
atcccaggaggtgcagt

SEQ ID NO: 4675645 - DNA, 12 bp, Homo sapiens
atccccagtgcc

SEQ ID NO: 4675646 - DNA, 14 bp, Homo sapiens
atcccgcagcctcg

SEQ ID NO: 4675647 - DNA, 23 bp, Homo sapiens
atcccgtaagaccaccttccctt

SEQ ID NO: 4675648 - DNA, 18 bp, Homo sapiens
atccctccaccttccgtt

SEQ ID NO: 4675649 - DNA, 11 bp, Homo sapiens
atccctctcca

SEQ ID NO: 4675650 - DNA, 14 bp, Homo sapiens
atccctggagcagg

SEQ ID NO: 4675651 - DNA, 17 bp, Homo sapiens
atccctggagcaggagc

SEQ ID NO: 4675652 - DNA, 16 bp, Homo sapiens
atccctgggcctgctg

SEQ ID NO: 4675653 - DNA, 18 bp, Homo sapiens
atccctgggcctgctgct

SEQ ID NO: 4675654 - DNA, 22 bp, Homo sapiens
atccggcaacatcaacccgagt

SEQ ID NO: 4675655 - DNA, 13 bp, Homo sapiens
atcctaccaaagt

SEQ ID NO: 4675656 - DNA, 14 bp, Homo sapiens
atcctaccaaagta

SEQ ID NO: 4675657 - DNA, 13 bp, Homo sapiens
atcctagtgcttt

SEQ ID NO: 4675658 - DNA, 13 bp, Homo sapiens
atcctatatagaa

SEQ ID NO: 4675659 - DNA, 12 bp, Homo sapiens
atcctatgtgat

SEQ ID NO: 4675660 - DNA, 16 bp, Homo sapiens
atcctatgtgatttta

SEQ ID NO: 4675661 - DNA, 23 bp, Homo sapiens
atcctatgtgattttaactctgt

SEQ ID NO: 4675662 - DNA, 20 bp, Homo sapiens
atcctcagtgcaaaatgtct

SEQ ID NO: 4675663 - DNA, 22 bp, Homo sapiens
atcctcagtgcaaaatgtcttg

SEQ ID NO: 4675664 - DNA, 23 bp, Homo sapiens
atcctcagtgcaaaatgtcttgt

SEQ ID NO: 4675665 - DNA, 15 bp, Homo sapiens
atcctcatccctgac

SEQ ID NO: 4675666 - DNA, 16 bp, Homo sapiens
atcctcatccctgact

SEQ ID NO: 4675667 - DNA, 16 bp, Homo sapiens
atcctctcacctcagc

SEQ ID NO: 4675668 - DNA, 14 bp, Homo sapiens
atcctctgttaatg

SEQ ID NO: 4675669 - DNA, 22 bp, Homo sapiens
atcctcttttaatggcatttct

SEQ ID NO: 4675670 - DNA, 23 bp, Homo sapiens
atcctcttttaatggcatttctc

SEQ ID NO: 4675671 - DNA, 15 bp, Homo sapiens
atcctgcagggcttc

SEQ ID NO: 4675672 - DNA, 21 bp, Homo sapiens
atcctgcccgagggcagcccc

SEQ ID NO: 4675673 - DNA, 23 bp, Homo sapiens
ctgcctggagacaaggtgctaac

SEQ ID NO: 4675674 - DNA, 11 bp, Homo sapiens
ctgcctggagg

SEQ ID NO: 4675675 - DNA, 13 bp, Homo sapiens
ctgcctggcaaca

SEQ ID NO: 4675676 - DNA, 19 bp, Homo sapiens
ctgcctgggatgcccttcc

SEQ ID NO: 4675677 - DNA, 23 bp, Homo sapiens
ctgcctgggatgcccttccccct

SEQ ID NO: 4675678 - DNA, 11 bp, Homo sapiens
ctgcctgggca

SEQ ID NO: 4675679 - DNA, 17 bp, Homo sapiens
ctgcctgggcaatggcc

SEQ ID NO: 4675680 - DNA, 21 bp, Homo sapiens
ctgcctgggcaatggccaggg

SEQ ID NO: 4675681 - DNA, 23 bp, Homo sapiens
ctgcctgggcaatggccaggggc

SEQ ID NO: 4675682 - DNA, 12 bp, Homo sapiens
ctgcctgggtag

SEQ ID NO: 4675683 - DNA, 14 bp, Homo sapiens
ctgcctgggtaggc

SEQ ID NO: 4675684 - DNA, 13 bp, Homo sapiens
ctgcctgtactac

SEQ ID NO: 4675685 - DNA, 17 bp, Homo sapiens
ctgcctgtactactcta

SEQ ID NO: 4675686 - DNA, 15 bp, Homo sapiens
ctgccttaacctggg

SEQ ID NO: 4675687 - DNA, 15 bp, Homo sapiens
ctgcctttaagccaa

SEQ ID NO: 4675688 - DNA, 16 bp, Homo sapiens
ctgcctttaagccaaa

SEQ ID NO: 4675689 - DNA, 15 bp, Homo sapiens
ctgcgcaagtgcctg

SEQ ID NO: 4675690 - DNA, 15 bp, Homo sapiens
ctgcgccacccacca

SEQ ID NO: 4675691 - DNA, 15 bp, Homo sapiens
ctgctacctgttctt

SEQ ID NO: 4675692 - DNA, 21 bp, Homo sapiens
ctgctacctgttcttgggcct

SEQ ID NO: 4675693 - DNA, 19 bp, Homo sapiens
ctgctagtcgcccctcaga

SEQ ID NO: 4675694 - DNA, 22 bp, Homo sapiens
ctgctagtcgcccctcagagca

SEQ ID NO: 4675695 - DNA, 12 bp, Homo sapiens
ctgctccaggcc

SEQ ID NO: 4675696 - DNA, 19 bp, Homo sapiens
ctgctcggggtgcacagga

SEQ ID NO: 4675697 - DNA, 22 bp, Homo sapiens
ctgctcggggtgcacaggaggg

SEQ ID NO: 4675698 - DNA, 20 bp, Homo sapiens
ctgctctaagcccaggatct

SEQ ID NO: 4675699 - DNA, 17 bp, Homo sapiens
ctgctctagtgggacag

SEQ ID NO: 4675700 - DNA, 12 bp, Homo sapiens
ctgctctgatgc

SEQ ID NO: 4675701 - DNA, 13 bp, Homo sapiens
ctgctctgatgca

SEQ ID NO: 4675702 - DNA, 14 bp, Homo sapiens
ctgctctttccact

SEQ ID NO: 4675703 - DNA, 22 bp, Homo sapiens
ctgctgaatgcctcgctccctt

SEQ ID NO: 4675704 - DNA, 23 bp, Homo sapiens
ctgctgaatgcctcgctcccttc

SEQ ID NO: 4675705 - DNA, 17 bp, Homo sapiens
ctgctgacagacactaa

SEQ ID NO: 4675706 - DNA, 21 bp, Homo sapiens
ctgctgagctctgagaggccc

SEQ ID NO: 4675707 - DNA, 11 bp, Homo sapiens
ctgctgcctgg

SEQ ID NO: 4675708 - DNA, 12 bp, Homo sapiens
ctgctgcctggg

SEQ ID NO: 4675709 - DNA, 11 bp, Homo sapiens
ctgctgctgag

SEQ ID NO: 4675710 - DNA, 20 bp, Homo sapiens
ctgctgctgagaacctggcc

SEQ ID NO: 4675711 - DNA, 21 bp, Homo sapiens
ctgctggagatcagcatgcct

SEQ ID NO: 4675712 - DNA, 22 bp, Homo sapiens
ctgctgggggtgagctgtactc

SEQ ID NO: 4675713 - DNA, 14 bp, Homo sapiens
ctgctggtacctgc

SEQ ID NO: 4675714 - DNA, 16 bp, Homo sapiens
ctgctggtacctgccc

SEQ ID NO: 4675715 - DNA, 16 bp, Homo sapiens
ctgctgtcacctcgct

SEQ ID NO: 4675716 - DNA, 21 bp, Homo sapiens
ctgctgtgccatgctgggcca

SEQ ID NO: 4675717 - DNA, 17 bp, Homo sapiens
ctgctgtgccccaccac

SEQ ID NO: 4675718 - DNA, 16 bp, Homo sapiens
ctgcttccacctcacc

SEQ ID NO: 4675719 - DNA, 20 bp, Homo sapiens
ctgcttccacctcaccccac

SEQ ID NO: 4675720 - DNA, 19 bp, Homo sapiens
ctgctttgggaagactgag

SEQ ID NO: 4675721 - DNA, 14 bp, Homo sapiens
ctgcttttcctctg

SEQ ID NO: 4675722 - DNA, 15 bp, Homo sapiens
ctggaaacaaaacag

SEQ ID NO: 4675723 - DNA, 22 bp, Homo sapiens
ctggaaacttctgtaaggggca

SEQ ID NO: 4675724 - DNA, 16 bp, Homo sapiens
ctggaacaaattattt

SEQ ID NO: 4675725 - DNA, 23 bp, Homo sapiens
ctggaactgattgctcccaggat

SEQ ID NO: 4675726 - DNA, 20 bp, Homo sapiens
ctggaagaaactaaaaatat

SEQ ID NO: 4675727 - DNA, 21 bp, Homo sapiens
ctggaagcccctgggcccagt

SEQ ID NO: 4675728 - DNA, 22 bp, Homo sapiens
ctggaagtcaaataaatgtttc

SEQ ID NO: 4675729 - DNA, 18 bp, Homo sapiens
ctggaataaagttgcaga

SEQ ID NO: 4675730 - DNA, 13 bp, Homo sapiens
ctggacagctgtg

SEQ ID NO: 4675731 - DNA, 20 bp, Homo sapiens
ctggacagctgtgcctcgct

SEQ ID NO: 4675732 - DNA, 23 bp, Homo sapiens
ctggacatagagagggagaagaa

SEQ ID NO: 4675733 - DNA, 17 bp, Homo sapiens
ctggacattttttcagt

SEQ ID NO: 4675734 - DNA, 16 bp, Homo sapiens
ctggaccacgaggctg

SEQ ID NO: 4675735 - DNA, 24 bp, Homo sapiens
ctggactccacggatgcgtgggca

SEQ ID NO: 4675736 - DNA, 20 bp, Homo sapiens
ctggactccgaggtggttca

SEQ ID NO: 4675737 - DNA, 13 bp, Homo sapiens
ctggactgtttca

SEQ ID NO: 4675738 - DNA, 12 bp, Homo sapiens
ctctcttttaaa

SEQ ID NO: 4675739 - DNA, 14 bp, Homo sapiens
ctctgaagcatttg

SEQ ID NO: 4675740 - DNA, 17 bp, Homo sapiens
ctctgacaagctggcca

SEQ ID NO: 4675741 - DNA, 20 bp, Homo sapiens
ctctgacaagctggccaaag

SEQ ID NO: 4675742 - DNA, 15 bp, Homo sapiens
ctctgagaggccctg

SEQ ID NO: 4675743 - DNA, 14 bp, Homo sapiens
ctctgagccaacct

SEQ ID NO: 4675744 - DNA, 14 bp, Homo sapiens
ctctgaggccagcc

SEQ ID NO: 4675745 - DNA, 15 bp, Homo sapiens
ctctgaggccagcct

SEQ ID NO: 4675746 - DNA, 16 bp, Homo sapiens
ctctgaggccagcctg

SEQ ID NO: 4675747 - DNA, 17 bp, Homo sapiens
ctctgaggccagcctgg

SEQ ID NO: 4675748 - DNA, 21 bp, Homo sapiens
ctctgaggccagcctggcctc

SEQ ID NO: 4675749 - DNA, 19 bp, Homo sapiens
ctctgaggcgccccaaccc

SEQ ID NO: 4675750 - DNA, 18 bp, Homo sapiens
ctctgagtcctggcccaa

SEQ ID NO: 4675751 - DNA, 23 bp, Homo sapiens
ctctgatagctgtttcaaatgtg

SEQ ID NO: 4675752 - DNA, 20 bp, Homo sapiens
ctctgcacaccctccagaga

SEQ ID NO: 4675753 - DNA, 22 bp, Homo sapiens
ctctgcacaccctccagagaca

SEQ ID NO: 4675754 - DNA, 17 bp, Homo sapiens
ctctgcacagacaagca

SEQ ID NO: 4675755 - DNA, 18 bp, Homo sapiens
ctctgcacagacaagcag

SEQ ID NO: 4675756 - DNA, 18 bp, Homo sapiens
ctctgcacatgtcttgta

SEQ ID NO: 4675757 - DNA, 15 bp, Homo sapiens
ctctgcacccctctg

SEQ ID NO: 4675758 - DNA, 17 bp, Homo sapiens
ctctgcattgacctgga

SEQ ID NO: 4675759 - DNA, 22 bp, Homo sapiens
ctctgcattgacctggagggga

SEQ ID NO: 4675760 - DNA, 14 bp, Homo sapiens
ctctgccagcagga

SEQ ID NO: 4675761 - DNA, 17 bp, Homo sapiens
ctctgccagcaggaata

SEQ ID NO: 4675762 - DNA, 18 bp, Homo sapiens
ctctgccagcaggaataa

SEQ ID NO: 4675763 - DNA, 20 bp, Homo sapiens
ctctgccagcaggaataaag

SEQ ID NO: 4675764 - DNA, 22 bp, Homo sapiens
ctctgccagcaggaataaagac

SEQ ID NO: 4675765 - DNA, 17 bp, Homo sapiens
ctctgcccaccctcctg

SEQ ID NO: 4675766 - DNA, 20 bp, Homo sapiens
ctctgcccaggcaaggaaca

SEQ ID NO: 4675767 - DNA, 15 bp, Homo sapiens
ctctgccccttcccc

SEQ ID NO: 4675768 - DNA, 18 bp, Homo sapiens
ctctgccgccgcccgctg

SEQ ID NO: 4675769 - DNA, 22 bp, Homo sapiens
ctctgccgccgcccgctgggga

SEQ ID NO: 4675770 - DNA, 15 bp, Homo sapiens
ctctgcctgggatgc

SEQ ID NO: 4675771 - DNA, 13 bp, Homo sapiens
ctctgcctgtctg

SEQ ID NO: 4675772 - DNA, 15 bp, Homo sapiens
ctctgctctgatgca

SEQ ID NO: 4675773 - DNA, 14 bp, Homo sapiens
ctctgctggccgga

SEQ ID NO: 4675774 - DNA, 20 bp, Homo sapiens
ctctggaataaagttgcaga

SEQ ID NO: 4675775 - DNA, 17 bp, Homo sapiens
ctctggagaacagtggt

SEQ ID NO: 4675776 - DNA, 13 bp, Homo sapiens
ctctgggacccca

SEQ ID NO: 4675777 - DNA, 20 bp, Homo sapiens
ctctgggaccccagctgctc

SEQ ID NO: 4675778 - DNA, 15 bp, Homo sapiens
ctctgggtgctgccc

SEQ ID NO: 4675779 - DNA, 21 bp, Homo sapiens
ctctggttgtctagtcattgt

SEQ ID NO: 4675780 - DNA, 12 bp, Homo sapiens
ctctgtactttt

SEQ ID NO: 4675781 - DNA, 20 bp, Homo sapiens
ctctgtacttttcattctct

SEQ ID NO: 4675782 - DNA, 14 bp, Homo sapiens
ctctgtcagtcaca

SEQ ID NO: 4675783 - DNA, 16 bp, Homo sapiens
ctctgtcagtcacagc

SEQ ID NO: 4675784 - DNA, 21 bp, Homo sapiens
ctctgtctcgagcgccctgca

SEQ ID NO: 4675785 - DNA, 13 bp, Homo sapiens
ctctgtgaactgt

SEQ ID NO: 4675786 - DNA, 12 bp, Homo sapiens
ctctgtgaatcc

SEQ ID NO: 4675787 - DNA, 16 bp, Homo sapiens
ctctgtgacccctcct

SEQ ID NO: 4675788 - DNA, 19 bp, Homo sapiens
ctctgtgacccctccttgt

SEQ ID NO: 4675789 - DNA, 20 bp, Homo sapiens
ctctgtgacccctccttgtc

SEQ ID NO: 4675790 - DNA, 15 bp, Homo sapiens
ctctgtgccagagcc

SEQ ID NO: 4675791 - DNA, 16 bp, Homo sapiens
ctctgtgccagagcct

SEQ ID NO: 4675792 - DNA, 15 bp, Homo sapiens
ctctgtgtacatgtg

SEQ ID NO: 4675793 - DNA, 23 bp, Homo sapiens
ctctgtgtacatgtgtgcagagc

SEQ ID NO: 4675794 - DNA, 20 bp, Homo sapiens
ctctgtgtctgagtggcttc

SEQ ID NO: 4675795 - DNA, 21 bp, Homo sapiens
ctctgtgtctgagtggcttca

SEQ ID NO: 4675796 - DNA, 13 bp, Homo sapiens
ctctgtgtgctcc

SEQ ID NO: 4675797 - DNA, 13 bp, Homo sapiens
ctctgttaatgtg

SEQ ID NO: 4675798 - DNA, 15 bp, Homo sapiens
ctctgttcagtgtaa

SEQ ID NO: 4675799 - DNA, 17 bp, Homo sapiens
ctctgttccccacccag

SEQ ID NO: 4675800 - DNA, 22 bp, Homo sapiens
ctctgttcctggctcagcctca

SEQ ID NO: 4675801 - DNA, 19 bp, Homo sapiens
ctctgttgactggctgtgt

SEQ ID NO: 4675802 - DNA, 11 bp, Homo sapiens
ctctgttgcct

SEQ ID NO: 4675803 - DNA, 14 bp, Homo sapiens
ctctgttgcctcct

SEQ ID NO: 4675804 - DNA, 16 bp, Homo sapiens
ctcttactaatgtaaa

SEQ ID NO: 4675805 - DNA, 18 bp, Homo sapiens
ctcttcagtgactcctgc

SEQ ID NO: 4675806 - DNA, 19 bp, Homo sapiens
ctcttcatggcatcttcaa

SEQ ID NO: 4675807 - DNA, 16 bp, Homo sapiens
ctcttcccccttccaa

SEQ ID NO: 4675808 - DNA, 14 bp, Homo sapiens
ctcttcctgccctt

SEQ ID NO: 4675809 - DNA, 14 bp, Homo sapiens
ctcttcggcaggga

SEQ ID NO: 4675810 - DNA, 15 bp, Homo sapiens
ctcttctaccctttt

SEQ ID NO: 4675811 - DNA, 16 bp, Homo sapiens
ctcttctacccttttc

SEQ ID NO: 4675812 - DNA, 22 bp, Homo sapiens
ctcttctacccttttccttttt

SEQ ID NO: 4675813 - DNA, 13 bp, Homo sapiens
ctcttctccattc

SEQ ID NO: 4675814 - DNA, 19 bp, Homo sapiens
ctcttctccattccctagc

SEQ ID NO: 4675815 - DNA, 21 bp, Homo sapiens
ctcttctccattccctagcag

SEQ ID NO: 4675816 - DNA, 19 bp, Homo sapiens
ctcttctggtttcccttta

SEQ ID NO: 4675817 - DNA, 16 bp, Homo sapiens
ctcttcttctgaagat

SEQ ID NO: 4675818 - DNA, 12 bp, Homo sapiens
ctcttcttgttg

SEQ ID NO: 4675819 - DNA, 17 bp, Homo sapiens
ctcttgaaacctgttaa

SEQ ID NO: 4675820 - DNA, 13 bp, Homo sapiens
ctcttgaagtact

SEQ ID NO: 4675821 - DNA, 22 bp, Homo sapiens
ctcttgaataaagtattctagt

SEQ ID NO: 4675822 - DNA, 21 bp, Homo sapiens
ctcttgatttcacatttctac

SEQ ID NO: 4675823 - DNA, 21 bp, Homo sapiens
ctcttgccatttgtagctttg

SEQ ID NO: 4675824 - DNA, 12 bp, Homo sapiens
ctcttgctctcg

SEQ ID NO: 4675825 - DNA, 15 bp, Homo sapiens
ctcttgtcacccagg

SEQ ID NO: 4675826 - DNA, 16 bp, Homo sapiens
ctcttgtcacccaggc

SEQ ID NO: 4675827 - DNA, 14 bp, Homo sapiens
ctcttgtcagtgta

SEQ ID NO: 4675828 - DNA, 21 bp, Homo sapiens
ctcttgtcagtgtagacacag

SEQ ID NO: 4675829 - DNA, 20 bp, Homo sapiens
ctctttaaactatgttccta

SEQ ID NO: 4675830 - DNA, 18 bp, Homo sapiens
ctctttagtgttctgttt

SEQ ID NO: 4675831 - DNA, 13 bp, Homo sapiens
ctctttattttcc

SEQ ID NO: 4675832 - DNA, 17 bp, Homo sapiens
ctctttccacttgccct

SEQ ID NO: 4675833 - DNA, 14 bp, Homo sapiens
ctctttccctgcga

SEQ ID NO: 4675834 - DNA, 16 bp, Homo sapiens
ctctttctaatgctga

SEQ ID NO: 4675835 - DNA, 14 bp, Homo sapiens
ctctttctttctct

SEQ ID NO: 4675836 - DNA, 18 bp, Homo sapiens
ctctttgtctaaaacaat

SEQ ID NO: 4675837 - DNA, 19 bp, Homo sapiens
ctcttttttgtttgtttct

SEQ ID NO: 4675838 - DNA, 14 bp, Homo sapiens
ctgaaaacatctgg

SEQ ID NO: 4675839 - DNA, 10 bp, Homo sapiens
ctgaaaaggg

SEQ ID NO: 4675840 - DNA, 19 bp, Homo sapiens
ctgaaaagggcactcccaa

SEQ ID NO: 4675841 - DNA, 20 bp, Homo sapiens
ctgaaaatccaataatcaga

SEQ ID NO: 4675842 - DNA, 22 bp, Homo sapiens
ctgaaactggttttaagtgctt

SEQ ID NO: 4675843 - DNA, 18 bp, Homo sapiens
ctgaaaggtgtgaacagc

SEQ ID NO: 4675844 - DNA, 17 bp, Homo sapiens
ctgaaatcaactctctt

SEQ ID NO: 4675845 - DNA, 23 bp, Homo sapiens
ctgaacgtttccccgaagagtca

SEQ ID NO: 4675846 - DNA, 23 bp, Homo sapiens
ctgaactacaagtgtaggccacc

SEQ ID NO: 4675847 - DNA, 13 bp, Homo sapiens
ctgaactgaggag

SEQ ID NO: 4675848 - DNA, 23 bp, Homo sapiens
ctgaagacaccgttcattcaggc

SEQ ID NO: 4675849 - DNA, 20 bp, Homo sapiens
ctgaagagagggacaggcac

SEQ ID NO: 4675850 - DNA, 19 bp, Homo sapiens
ctccgcgccgatgccaccg

SEQ ID NO: 4675851 - DNA, 22 bp, Homo sapiens
ctccgtttattataaactgtat

SEQ ID NO: 4675852 - DNA, 19 bp, Homo sapiens
ctcctaacctcaagtgatc

SEQ ID NO: 4675853 - DNA, 22 bp, Homo sapiens
ctcctaggggcttggtcctagg

SEQ ID NO: 4675854 - DNA, 23 bp, Homo sapiens
ctcctcactccctaggcccaagt

SEQ ID NO: 4675855 - DNA, 17 bp, Homo sapiens
ctcctccagcccctgtc

SEQ ID NO: 4675856 - DNA, 20 bp, Homo sapiens
ctcctccagcccctgtccca

SEQ ID NO: 4675857 - DNA, 13 bp, Homo sapiens
ctcctctctccct

SEQ ID NO: 4675858 - DNA, 16 bp, Homo sapiens
ctcctctctccctgcc

SEQ ID NO: 4675859 - DNA, 18 bp, Homo sapiens
ctcctctctccctgcctc

SEQ ID NO: 4675860 - DNA, 15 bp, Homo sapiens
ctcctctgccagcag

SEQ ID NO: 4675861 - DNA, 16 bp, Homo sapiens
ctcctctgccagcagg

SEQ ID NO: 4675862 - DNA, 12 bp, Homo sapiens
ctcctctgtgaa

SEQ ID NO: 4675863 - DNA, 13 bp, Homo sapiens
ctcctgacctcag

SEQ ID NO: 4675864 - DNA, 17 bp, Homo sapiens
ctcctgaggacagctgt

SEQ ID NO: 4675865 - DNA, 18 bp, Homo sapiens
ctcctgaggacagctgtc

SEQ ID NO: 4675866 - DNA, 13 bp, Homo sapiens
ctcctgagtagct

SEQ ID NO: 4675867 - DNA, 17 bp, Homo sapiens
ctcctgatcagaggcat

SEQ ID NO: 4675868 - DNA, 14 bp, Homo sapiens
ctcctgccagccca

SEQ ID NO: 4675869 - DNA, 21 bp, Homo sapiens
ctcctgcccgcagacctctgg

SEQ ID NO: 4675870 - DNA, 19 bp, Homo sapiens
ctcctgcctttctcaactg

SEQ ID NO: 4675871 - DNA, 13 bp, Homo sapiens
ctcctgctgggca

SEQ ID NO: 4675872 - DNA, 14 bp, Homo sapiens
ctcctgctgtaaat

SEQ ID NO: 4675873 - DNA, 16 bp, Homo sapiens
ctcctggcccctgcct

SEQ ID NO: 4675874 - DNA, 18 bp, Homo sapiens
ctcctggtttgatttgat

SEQ ID NO: 4675875 - DNA, 13 bp, Homo sapiens
ctcctgtgggagc

SEQ ID NO: 4675876 - DNA, 16 bp, Homo sapiens
ctcctgtgggagcctc

SEQ ID NO: 4675877 - DNA, 18 bp, Homo sapiens
ctcctgtgggagcctcgc

SEQ ID NO: 4675878 - DNA, 20 bp, Homo sapiens
ctcctgttcatctgtgcacc

SEQ ID NO: 4675879 - DNA, 16 bp, Homo sapiens
ctccttcagttctgct

SEQ ID NO: 4675880 - DNA, 18 bp, Homo sapiens
ctccttcagttctgcttg

SEQ ID NO: 4675881 - DNA, 16 bp, Homo sapiens
ctccttccagctagtg

SEQ ID NO: 4675882 - DNA, 13 bp, Homo sapiens
ctccttccatcct

SEQ ID NO: 4675883 - DNA, 13 bp, Homo sapiens
ctccttccccagc

SEQ ID NO: 4675884 - DNA, 12 bp, Homo sapiens
ctccttctgcaa

SEQ ID NO: 4675885 - DNA, 17 bp, Homo sapiens
ctccttggctttatgca

SEQ ID NO: 4675886 - DNA, 16 bp, Homo sapiens
ctcctttttattttag

SEQ ID NO: 4675887 - DNA, 21 bp, Homo sapiens
ctcctttttattttaggcact

SEQ ID NO: 4675888 - DNA, 13 bp, Homo sapiens
ctcgaccctgtcc

SEQ ID NO: 4675889 - DNA, 19 bp, Homo sapiens
ctcgaccctgtcccctagg

SEQ ID NO: 4675890 - DNA, 16 bp, Homo sapiens
ctcgaccggccctgca

SEQ ID NO: 4675891 - DNA, 12 bp, Homo sapiens
ctcgagcgccct

SEQ ID NO: 4675892 - DNA, 15 bp, Homo sapiens
ctcgagcgccctgca

SEQ ID NO: 4675893 - DNA, 18 bp, Homo sapiens
ctcgagcgccctgcagac

SEQ ID NO: 4675894 - DNA, 19 bp, Homo sapiens
ctcgagcgccctgcagacc

SEQ ID NO: 4675895 - DNA, 21 bp, Homo sapiens
ctcgagcgccctgcagaccct

SEQ ID NO: 4675896 - DNA, 22 bp, Homo sapiens
ctcgcaacccgtgccaagtcca

SEQ ID NO: 4675897 - DNA, 23 bp, Homo sapiens
ctcgcaacccgtgccaagtccag

SEQ ID NO: 4675898 - DNA, 15 bp, Homo sapiens
ctcgcatcttcccaa

SEQ ID NO: 4675899 - DNA, 19 bp, Homo sapiens
ctcgccccaaagttgctca

SEQ ID NO: 4675900 - DNA, 14 bp, Homo sapiens
ctcgccttgtgtta

SEQ ID NO: 4675901 - DNA, 13 bp, Homo sapiens
ctcgctcccttca

SEQ ID NO: 4675902 - DNA, 14 bp, Homo sapiens
ctcgctcccttcaa

SEQ ID NO: 4675903 - DNA, 17 bp, Homo sapiens
ctcgctttttcatcctt

SEQ ID NO: 4675904 - DNA, 22 bp, Homo sapiens
ctcgctttttcatccttctttc

SEQ ID NO: 4675905 - DNA, 16 bp, Homo sapiens
ctcggacttactgcct

SEQ ID NO: 4675906 - DNA, 17 bp, Homo sapiens
ctcggacttactgcctg

SEQ ID NO: 4675907 - DNA, 18 bp, Homo sapiens
ctcggacttactgcctga

SEQ ID NO: 4675908 - DNA, 20 bp, Homo sapiens
ctcggctcactgcaacctct

SEQ ID NO: 4675909 - DNA, 22 bp, Homo sapiens
ctcggctcactgcaatctctgc

SEQ ID NO: 4675910 - DNA, 18 bp, Homo sapiens
ctcggggtgcacaggagg

SEQ ID NO: 4675911 - DNA, 22 bp, Homo sapiens
ctcggtttgccaaaattcattt

SEQ ID NO: 4675912 - DNA, 20 bp, Homo sapiens
ctcgtgaggggcaagctagg

SEQ ID NO: 4675913 - DNA, 16 bp, Homo sapiens
ctcgtggtaggactgt

SEQ ID NO: 4675914 - DNA, 19 bp, Homo sapiens
ctcgttattgttgttgcca

SEQ ID NO: 4675915 - DNA, 16 bp, Homo sapiens
ctcgttctccctggga

SEQ ID NO: 4675916 - DNA, 12 bp, Homo sapiens
ctctaacgcctg

SEQ ID NO: 4675917 - DNA, 17 bp, Homo sapiens
ctctaacgcctgagccc

SEQ ID NO: 4675918 - DNA, 18 bp, Homo sapiens
ctctaacgcctgagccca

SEQ ID NO: 4675919 - DNA, 14 bp, Homo sapiens
ctctaagcccagga

SEQ ID NO: 4675920 - DNA, 18 bp, Homo sapiens
ctctaagcccaggatctc

SEQ ID NO: 4675921 - DNA, 19 bp, Homo sapiens
ctctaagcccaggatctct

SEQ ID NO: 4675922 - DNA, 18 bp, Homo sapiens
ctctaaggtactgtgggg

SEQ ID NO: 4675923 - DNA, 15 bp, Homo sapiens
ctctacactcttgta

SEQ ID NO: 4675924 - DNA, 13 bp, Homo sapiens
ctctactctgctt

SEQ ID NO: 4675925 - DNA, 14 bp, Homo sapiens
ctctactctgcttt

SEQ ID NO: 4675926 - DNA, 13 bp, Homo sapiens
ctctactgggaag

SEQ ID NO: 4675927 - DNA, 14 bp, Homo sapiens
ctctagccccagcg

SEQ ID NO: 4675928 - DNA, 16 bp, Homo sapiens
ctctaggcctctccag

SEQ ID NO: 4675929 - DNA, 14 bp, Homo sapiens
ctctaggttataca

SEQ ID NO: 4675930 - DNA, 17 bp, Homo sapiens
ctctaggttatacaata

SEQ ID NO: 4675931 - DNA, 18 bp, Homo sapiens
ctacaccactctggcagc

SEQ ID NO: 4675932 - DNA, 19 bp, Homo sapiens
ctacaccactctggcagcc

SEQ ID NO: 4675933 - DNA, 17 bp, Homo sapiens
ctacaggcctgcagccc

SEQ ID NO: 4675934 - DNA, 13 bp, Homo sapiens
ctacaggggccag

SEQ ID NO: 4675935 - DNA, 14 bp, Homo sapiens
ctacaggggccaga

SEQ ID NO: 4675936 - DNA, 15 bp, Homo sapiens
ctacagtaatgaaat

SEQ ID NO: 4675937 - DNA, 12 bp, Homo sapiens
ctacagtgccaa

SEQ ID NO: 4675938 - DNA, 20 bp, Homo sapiens
ctacagtgccaactcctcac

SEQ ID NO: 4675939 - DNA, 14 bp, Homo sapiens
ctacagtgtacagt

SEQ ID NO: 4675940 - DNA, 17 bp, Homo sapiens
ctacagtgtacagtctt

SEQ ID NO: 4675941 - DNA, 14 bp, Homo sapiens
ctacatattgtctg

SEQ ID NO: 4675942 - DNA, 18 bp, Homo sapiens
ctacattaaaatgacaaa

SEQ ID NO: 4675943 - DNA, 19 bp, Homo sapiens
ctacattaaaatgacaaac

SEQ ID NO: 4675944 - DNA, 15 bp, Homo sapiens
ctacatttactttaa

SEQ ID NO: 4675945 - DNA, 17 bp, Homo sapiens
ctacattttttctaata

SEQ ID NO: 4675946 - DNA, 18 bp, Homo sapiens
ctacattttttctaataa

SEQ ID NO: 4675947 - DNA, 19 bp, Homo sapiens
ctacccattgttcccttcc

SEQ ID NO: 4675948 - DNA, 15 bp, Homo sapiens
ctacccgttccaaaa

SEQ ID NO: 4675949 - DNA, 14 bp, Homo sapiens
ctacccttttcctt

SEQ ID NO: 4675950 - DNA, 17 bp, Homo sapiens
ctaccgctggccctgcc

SEQ ID NO: 4675951 - DNA, 18 bp, Homo sapiens
ctaccgtaattgctttgt

SEQ ID NO: 4675952 - DNA, 22 bp, Homo sapiens
ctaccgtaattgctttgtgcct

SEQ ID NO: 4675953 - DNA, 17 bp, Homo sapiens
ctacctgtgtggacagg

SEQ ID NO: 4675954 - DNA, 20 bp, Homo sapiens
ctacgcactggacagcatca

SEQ ID NO: 4675955 - DNA, 22 bp, Homo sapiens
ctacgctgaagatggcatcctg

SEQ ID NO: 4675956 - DNA, 22 bp, Homo sapiens
ctactcacacaggcatttcctg

SEQ ID NO: 4675957 - DNA, 12 bp, Homo sapiens
ctactccccacc

SEQ ID NO: 4675958 - DNA, 16 bp, Homo sapiens
ctactccctcttgtca

SEQ ID NO: 4675959 - DNA, 12 bp, Homo sapiens
ctactccttccc

SEQ ID NO: 4675960 - DNA, 15 bp, Homo sapiens
ctactctagatggca

SEQ ID NO: 4675961 - DNA, 19 bp, Homo sapiens
ctactctgtgccagagcct

SEQ ID NO: 4675962 - DNA, 20 bp, Homo sapiens
ctactctgtgccagagcctg

SEQ ID NO: 4675963 - DNA, 22 bp, Homo sapiens
ctactctgtgccagagcctggg

SEQ ID NO: 4675964 - DNA, 21 bp, Homo sapiens
ctactgcagcacctccaggcc

SEQ ID NO: 4675965 - DNA, 23 bp, Homo sapiens
ctactggcctccctttgtgtgca

SEQ ID NO: 4675966 - DNA, 17 bp, Homo sapiens
ctacttcggggctggga

SEQ ID NO: 4675967 - DNA, 20 bp, Homo sapiens
ctacttgaaggtacacccca

SEQ ID NO: 4675968 - DNA, 13 bp, Homo sapiens
ctactttaaatcc

SEQ ID NO: 4675969 - DNA, 12 bp, Homo sapiens
ctagaaaaataa

SEQ ID NO: 4675970 - DNA, 18 bp, Homo sapiens
ctagaaaaataaaatgtt

SEQ ID NO: 4675971 - DNA, 19 bp, Homo sapiens
ctagaaagtacaagaaaag

SEQ ID NO: 4675972 - DNA, 18 bp, Homo sapiens
ctagaacctccctccttt

SEQ ID NO: 4675973 - DNA, 21 bp, Homo sapiens
ctagaacctccctcctttcct

SEQ ID NO: 4675974 - DNA, 12 bp, Homo sapiens
ctagaagaacaa

SEQ ID NO: 4675975 - DNA, 12 bp, Homo sapiens
ctagaatggata

SEQ ID NO: 4675976 - DNA, 23 bp, Homo sapiens
ctagacagttagagactctgtca

SEQ ID NO: 4675977 - DNA, 22 bp, Homo sapiens
ctagacatcattgtcagccttg

SEQ ID NO: 4675978 - DNA, 13 bp, Homo sapiens
ctagaccagggct

SEQ ID NO: 4675979 - DNA, 16 bp, Homo sapiens
ctagactgtgtctgaa

SEQ ID NO: 4675980 - DNA, 19 bp, Homo sapiens
ctagagagggaattctctt

SEQ ID NO: 4675981 - DNA, 16 bp, Homo sapiens
ctagaggcagactcct

SEQ ID NO: 4675982 - DNA, 19 bp, Homo sapiens
ctagaggtgttacagagga

SEQ ID NO: 4675983 - DNA, 22 bp, Homo sapiens
ctagagtgtagcctaaagggca

SEQ ID NO: 4675984 - DNA, 20 bp, Homo sapiens
ctagatacaggactggttcc

SEQ ID NO: 4675985 - DNA, 21 bp, Homo sapiens
ctagcaggaacttctagctca

SEQ ID NO: 4675986 - DNA, 22 bp, Homo sapiens
ctagcaggaacttctagctcat

SEQ ID NO: 4675987 - DNA, 17 bp, Homo sapiens
ctagcagtccccagctg

SEQ ID NO: 4675988 - DNA, 14 bp, Homo sapiens
ctagccagaattct

SEQ ID NO: 4675989 - DNA, 16 bp, Homo sapiens
ctagccagaattctac

SEQ ID NO: 4675990 - DNA, 21 bp, Homo sapiens
ctagccaggtctcctgggaaa

SEQ ID NO: 4675991 - DNA, 12 bp, Homo sapiens
ctagccccagcg

SEQ ID NO: 4675992 - DNA, 14 bp, Homo sapiens
ctagccccagcgcc

SEQ ID NO: 4675993 - DNA, 22 bp, Homo sapiens
ctagcccctcacttccagcttg

SEQ ID NO: 4675994 - DNA, 12 bp, Homo sapiens
ctagcctttggg

SEQ ID NO: 4675995 - DNA, 21 bp, Homo sapiens
ctagctctctaggcctctcca

SEQ ID NO: 4675996 - DNA, 13 bp, Homo sapiens
ctagctggctctg

SEQ ID NO: 4675997 - DNA, 17 bp, Homo sapiens
ctaggagcaaagcctgt

SEQ ID NO: 4675998 - DNA, 22 bp, Homo sapiens
ctaggatagctaactgtaaatc

SEQ ID NO: 4675999 - DNA, 14 bp, Homo sapiens
ctaggccaccccaa

SEQ ID NO: 4676000 - DNA, 20 bp, Homo sapiens
ctaggccaggtgcaaccagg

SEQ ID NO: 4676001 - DNA, 20 bp, Homo sapiens
ctaggccccagaggccctgg

SEQ ID NO: 4676002 - DNA, 21 bp, Homo sapiens
ctaggccccagaggccctgga

SEQ ID NO: 4676003 - DNA, 13 bp, Homo sapiens
ctaggctgctgca

SEQ ID NO: 4676004 - DNA, 15 bp, Homo sapiens
ctaggctgctgcaca

SEQ ID NO: 4676005 - DNA, 16 bp, Homo sapiens
ctaggctgctgcacac

SEQ ID NO: 4676006 - DNA, 21 bp, Homo sapiens
ctaggctgctgcacaccaagg

SEQ ID NO: 4676007 - DNA, 19 bp, Homo sapiens
ctagggactgccaggctgt

SEQ ID NO: 4676008 - DNA, 21 bp, Homo sapiens
ctagggactgtcctagccagg

SEQ ID NO: 4676009 - DNA, 23 bp, Homo sapiens
ctagggactgtcctagccaggtc

SEQ ID NO: 4676010 - DNA, 13 bp, Homo sapiens
ctaggtcctggct

SEQ ID NO: 4676011 - DNA, 17 bp, Homo sapiens
ctaggtgtttcaacaga

SEQ ID NO: 4676012 - DNA, 13 bp, Homo sapiens
ctaggttatacaa

SEQ ID NO: 4676013 - DNA, 15 bp, Homo sapiens
ctaggttatacaata

SEQ ID NO: 4676014 - DNA, 13 bp, Homo sapiens
ctagtaaaacctt

SEQ ID NO: 4676015 - DNA, 19 bp, Homo sapiens
ctagtacacttttatgagc

SEQ ID NO: 4676016 - DNA, 17 bp, Homo sapiens
ctagtagatttctatga

SEQ ID NO: 4676017 - DNA, 20 bp, Homo sapiens
ctagtcagaaaattggcagt

SEQ ID NO: 4676018 - DNA, 16 bp, Homo sapiens
ctagtccgtcctggca

SEQ ID NO: 4676019 - DNA, 12 bp, Homo sapiens
ctagtccttgtt

SEQ ID NO: 4676020 - DNA, 15 bp, Homo sapiens
ctagtcgcccctcag

SEQ ID NO: 4676021 - DNA, 14 bp, Homo sapiens
ctcactccctaggc

SEQ ID NO: 4676022 - DNA, 17 bp, Homo sapiens
ctcactccctaggccca

SEQ ID NO: 4676023 - DNA, 13 bp, Homo sapiens
ctcactctgggct

SEQ ID NO: 4676024 - DNA, 13 bp, Homo sapiens
ctcactgaaaaca

SEQ ID NO: 4676025 - DNA, 19 bp, Homo sapiens
ctcactgaaaacatctgga

SEQ ID NO: 4676026 - DNA, 21 bp, Homo sapiens
ctcactgcaacctctgcctcc

SEQ ID NO: 4676027 - DNA, 16 bp, Homo sapiens
ctcactgcttgaacta

SEQ ID NO: 4676028 - DNA, 18 bp, Homo sapiens
ctcactgcttgaactagg

SEQ ID NO: 4676029 - DNA, 22 bp, Homo sapiens
ctcactgtgatcaatattttta

SEQ ID NO: 4676030 - DNA, 19 bp, Homo sapiens
ctcactgtttgtttttatt

SEQ ID NO: 4676031 - DNA, 15 bp, Homo sapiens
ctcacttcctttgcc

SEQ ID NO: 4676032 - DNA, 16 bp, Homo sapiens
ctcacttcctttgccc

SEQ ID NO: 4676033 - DNA, 14 bp, Homo sapiens
ctcagaaagatttg

SEQ ID NO: 4676034 - DNA, 22 bp, Homo sapiens
ctcagaagcctgggggcctggc

SEQ ID NO: 4676035 - DNA, 11 bp, Homo sapiens
ctcagaagtaa

SEQ ID NO: 4676036 - DNA, 17 bp, Homo sapiens
ctcagactttggaaaat

SEQ ID NO: 4676037 - DNA, 22 bp, Homo sapiens
ctcagactttggaaaatgcatt

SEQ ID NO: 4676038 - DNA, 14 bp, Homo sapiens
ctcagagcttcctg

SEQ ID NO: 4676039 - DNA, 15 bp, Homo sapiens
ctcagagcttcctgg

SEQ ID NO: 4676040 - DNA, 18 bp, Homo sapiens
ctcagagcttcctgggga

SEQ ID NO: 4676041 - DNA, 23 bp, Homo sapiens
ctcagagcttcctggggaccaag

SEQ ID NO: 4676042 - DNA, 20 bp, Homo sapiens
ctcagcacaaggccatctgg

SEQ ID NO: 4676043 - DNA, 12 bp, Homo sapiens
ctcagcaggcca

SEQ ID NO: 4676044 - DNA, 12 bp, Homo sapiens
ctcagcagggct

SEQ ID NO: 4676045 - DNA, 18 bp, Homo sapiens
ctcagcagggctggtcac

SEQ ID NO: 4676046 - DNA, 15 bp, Homo sapiens
cgccctgcagaccct

SEQ ID NO: 4676047 - DNA, 17 bp, Homo sapiens
cgcccttcctctccacc

SEQ ID NO: 4676048 - DNA, 13 bp, Homo sapiens
cgcctatcttagg

SEQ ID NO: 4676049 - DNA, 13 bp, Homo sapiens
cgcctcaaaatgt

SEQ ID NO: 4676050 - DNA, 14 bp, Homo sapiens
cgcctgaaggcaca

SEQ ID NO: 4676051 - DNA, 17 bp, Homo sapiens
cgcctgaaggcacagct

SEQ ID NO: 4676052 - DNA, 11 bp, Homo sapiens
cgcctgagccc

SEQ ID NO: 4676053 - DNA, 16 bp, Homo sapiens
cgcctgtaatcccagt

SEQ ID NO: 4676054 - DNA, 19 bp, Homo sapiens
cgcctgtaatcccagtact

SEQ ID NO: 4676055 - DNA, 17 bp, Homo sapiens
cgccttttcccccaccc

SEQ ID NO: 4676056 - DNA, 15 bp, Homo sapiens
cgcctttttggcctg

SEQ ID NO: 4676057 - DNA, 15 bp, Homo sapiens
ccttgatgatttaat

SEQ ID NO: 4676058 - DNA, 14 bp, Homo sapiens
ccttgcacccgcaa

SEQ ID NO: 4676059 - DNA, 16 bp, Homo sapiens
ccttgctcatgagctc

SEQ ID NO: 4676060 - DNA, 19 bp, Homo sapiens
ccttgctcccaatggtgct

SEQ ID NO: 4676061 - DNA, 23 bp, Homo sapiens
ccttgctcccaatggtgcttgga

SEQ ID NO: 4676062 - DNA, 14 bp, Homo sapiens
ccttgctcttgggg

SEQ ID NO: 4676063 - DNA, 19 bp, Homo sapiens
ccttgctcttggggaaggg

SEQ ID NO: 4676064 - DNA, 13 bp, Homo sapiens
ccttgctgggcct

SEQ ID NO: 4676065 - DNA, 15 bp, Homo sapiens
cctgccccaactcct

SEQ ID NO: 4676066 - DNA, 17 bp, Homo sapiens
cctgccccaactccttc

SEQ ID NO: 4676067 - DNA, 13 bp, Homo sapiens
cctgccccctggg

SEQ ID NO: 4676068 - DNA, 15 bp, Homo sapiens
cctgcccctgtggga

SEQ ID NO: 4676069 - DNA, 22 bp, Homo sapiens
cctgcccgagggcagccccctc

SEQ ID NO: 4676070 - DNA, 19 bp, Homo sapiens
cctgcccgcagacctctgg

SEQ ID NO: 4676071 - DNA, 10 bp, Homo sapiens
cctgcccttg

SEQ ID NO: 4676072 - DNA, 19 bp, Homo sapiens
cctgcctcagcctcccgag

SEQ ID NO: 4676073 - DNA, 21 bp, Homo sapiens
cctgcctctactgggaaggct

SEQ ID NO: 4676074 - DNA, 18 bp, Homo sapiens
cctgcctgctcgctccct

SEQ ID NO: 4676075 - DNA, 11 bp, Homo sapiens
cctgcctggag

SEQ ID NO: 4676076 - DNA, 10 bp, Homo sapiens
cctgcctggt

SEQ ID NO: 4676077 - DNA, 18 bp, Homo sapiens
cctgcctggttctaggct

SEQ ID NO: 4676078 - DNA, 20 bp, Homo sapiens
cctgcctgtactactctagg

SEQ ID NO: 4676079 - DNA, 16 bp, Homo sapiens
cctgcctttaagccaa

SEQ ID NO: 4676080 - DNA, 18 bp, Homo sapiens
cctgcctttaagccaaag

SEQ ID NO: 4676081 - DNA, 22 bp, Homo sapiens
cctgcctttaagccaaagaaac

SEQ ID NO: 4676082 - DNA, 20 bp, Homo sapiens
cctgcgagacgcacacagct

SEQ ID NO: 4676083 - DNA, 19 bp, Homo sapiens
cctgcgagggcagcgggag

SEQ ID NO: 4676084 - DNA, 15 bp, Homo sapiens
cctgcgcaagtgcct

SEQ ID NO: 4676085 - DNA, 16 bp, Homo sapiens
cctgcgcaagtgcctg

SEQ ID NO: 4676086 - DNA, 16 bp, Homo sapiens
cctgcgcaccaggctg

SEQ ID NO: 4676087 - DNA, 23 bp, Homo sapiens
cctgcgggtgaacaaagcagcca

SEQ ID NO: 4676088 - DNA, 20 bp, Homo sapiens
cctgctagacgcaccgcctg

SEQ ID NO: 4676089 - DNA, 19 bp, Homo sapiens
cctgctagtcgcccctcag

SEQ ID NO: 4676090 - DNA, 22 bp, Homo sapiens
cctgctattactaaggagtaat

SEQ ID NO: 4676091 - DNA, 17 bp, Homo sapiens
cctgctcattatgccac

SEQ ID NO: 4676092 - DNA, 12 bp, Homo sapiens
cctgctctgccc

SEQ ID NO: 4676093 - DNA, 15 bp, Homo sapiens
cctgctctgcccagg

SEQ ID NO: 4676094 - DNA, 20 bp, Homo sapiens
cctgctctgcccaggcaagg

SEQ ID NO: 4676095 - DNA, 21 bp, Homo sapiens
cctgctgaatgcctcgctccc

SEQ ID NO: 4676096 - DNA, 16 bp, Homo sapiens
cctgctgacagacact

SEQ ID NO: 4676097 - DNA, 20 bp, Homo sapiens
cctgctgacagacactaact

SEQ ID NO: 4676098 - DNA, 11 bp, Homo sapiens
cctgctgagct

SEQ ID NO: 4676099 - DNA, 17 bp, Homo sapiens
cctgctgagctctgaga

SEQ ID NO: 4676100 - DNA, 20 bp, Homo sapiens
cctgctgagctctgagaggc

SEQ ID NO: 4676101 - DNA, 14 bp, Homo sapiens
cctgctgcctgggt

SEQ ID NO: 4676102 - DNA, 22 bp, Homo sapiens
cctgctgctgagaacctggcct

SEQ ID NO: 4676103 - DNA, 24 bp, Homo sapiens
cctgctgctgagaacctggccttc

SEQ ID NO: 4676104 - DNA, 20 bp, Homo sapiens
cctgctggggccgccacggc

SEQ ID NO: 4676105 - DNA, 22 bp, Homo sapiens
cctgctggtacctgccctctat

SEQ ID NO: 4676106 - DNA, 21 bp, Homo sapiens
cctgctgtaaatttggcttct

SEQ ID NO: 4676107 - DNA, 23 bp, Homo sapiens
cctgctgtcacctcgctgggctc

SEQ ID NO: 4676108 - DNA, 20 bp, Homo sapiens
cctgctgtgccatgctgggc

SEQ ID NO: 4676109 - DNA, 21 bp, Homo sapiens
cctgctgtgccatgctgggcc

SEQ ID NO: 4676110 - DNA, 20 bp, Homo sapiens
cctgcttccacctcacccca

SEQ ID NO: 4676111 - DNA, 22 bp, Homo sapiens
cctgcttctcctgatcctgcaa

SEQ ID NO: 4676112 - DNA, 16 bp, Homo sapiens
cctgctttctacgcca

SEQ ID NO: 4676113 - DNA, 21 bp, Homo sapiens
cctggaagagccgagcacctg

SEQ ID NO: 4676114 - DNA, 20 bp, Homo sapiens
cctggaaggacatccatgtt

SEQ ID NO: 4676115 - DNA, 16 bp, Homo sapiens
cctggacagctgtgcc

SEQ ID NO: 4676116 - DNA, 17 bp, Homo sapiens
cctggacagctgtgcct

SEQ ID NO: 4676117 - DNA, 22 bp, Homo sapiens
cctggaccacgaggctgattcc

SEQ ID NO: 4676118 - DNA, 14 bp, Homo sapiens
cctggactgtttca

SEQ ID NO: 4676119 - DNA, 16 bp, Homo sapiens
cctggagacaaggtgc

SEQ ID NO: 4676120 - DNA, 17 bp, Homo sapiens
cctggagacaaggtgct

SEQ ID NO: 4676121 - DNA, 20 bp, Homo sapiens
cctggagacaaggtgctaac

SEQ ID NO: 4676122 - DNA, 15 bp, Homo sapiens
cctggagcaggagcc

SEQ ID NO: 4676123 - DNA, 23 bp, Homo sapiens
cctggagcaggagccccgccaca

SEQ ID NO: 4676124 - DNA, 21 bp, Homo sapiens
cctggaggacctgagcctgcc

SEQ ID NO: 4676125 - DNA, 14 bp, Homo sapiens
cctggaggggagag

SEQ ID NO: 4676126 - DNA, 19 bp, Homo sapiens
cctggaggggagaggtcag

SEQ ID NO: 4676127 - DNA, 22 bp, Homo sapiens
cctggaggggagaggtcagcct

SEQ ID NO: 4676128 - DNA, 21 bp, Homo sapiens
cctggatgagaaacagctcag

SEQ ID NO: 4676129 - DNA, 21 bp, Homo sapiens
cctggcaacatcttacttgtc

SEQ ID NO: 4676130 - DNA, 22 bp, Homo sapiens
cctggcaacatcttacttgtcc

SEQ ID NO: 4676131 - DNA, 15 bp, Homo sapiens
cctggcacacatcag

SEQ ID NO: 4676132 - DNA, 11 bp, Homo sapiens
cctggcataga

SEQ ID NO: 4676133 - DNA, 23 bp, Homo sapiens
cctggccacagccttccctctgc

SEQ ID NO: 4676134 - DNA, 17 bp, Homo sapiens
cctggcccccagcttca

SEQ ID NO: 4676135 - DNA, 22 bp, Homo sapiens
cctggcccccatcagccctgct

SEQ ID NO: 4676136 - DNA, 12 bp, Homo sapiens
cctggccctgct

SEQ ID NO: 4676137 - DNA, 12 bp, Homo sapiens
cctggcccttac

SEQ ID NO: 4676138 - DNA, 18 bp, Homo sapiens
cctggccgagtccaagct

SEQ ID NO: 4676139 - DNA, 12 bp, Homo sapiens
cctggcctcaga

SEQ ID NO: 4676140 - DNA, 14 bp, Homo sapiens
cctggcctcagagc

SEQ ID NO: 4676141 - DNA, 18 bp, Homo sapiens
cctggcctcagagcttcc

SEQ ID NO: 4676142 - DNA, 19 bp, Homo sapiens
cctggcctcagagcttcct

SEQ ID NO: 4676143 - DNA, 17 bp, Homo sapiens
cctggcctcctgcctct

SEQ ID NO: 4676144 - DNA, 20 bp, Homo sapiens
cctggcctgaactgaggaga

SEQ ID NO: 4676145 - DNA, 12 bp, Homo sapiens
cctggcctggca

SEQ ID NO: 4676146 - DNA, 16 bp, Homo sapiens
cctggctgattcagca

SEQ ID NO: 4676147 - DNA, 17 bp, Homo sapiens
cctggctgattcagcat

SEQ ID NO: 4676148 - DNA, 18 bp, Homo sapiens
cctggctggctgagggca

SEQ ID NO: 4676149 - DNA, 19 bp, Homo sapiens
cctggctggctgagggcag

SEQ ID NO: 4676150 - DNA, 20 bp, Homo sapiens
cctggctggctgagggcagt

SEQ ID NO: 4676151 - DNA, 21 bp, Homo sapiens
cctggcttcccatccccagcg

SEQ ID NO: 4676152 - DNA, 13 bp, Homo sapiens
cctgggaaaggga

SEQ ID NO: 4676153 - DNA, 14 bp, Homo sapiens
cctgggaaagggag

SEQ ID NO: 4676154 - DNA, 20 bp, Homo sapiens
cctgggaaccactcccacca

SEQ ID NO: 4676155 - DNA, 18 bp, Homo sapiens
cctgggaactctcctggc

SEQ ID NO: 4676156 - DNA, 19 bp, Homo sapiens
cctgggaactctcctggcc

SEQ ID NO: 4676157 - DNA, 17 bp, Homo sapiens
cctgggacaagcaggcc

SEQ ID NO: 4676158 - DNA, 20 bp, Homo sapiens
cctgggacaagcaggccgcc

SEQ ID NO: 4676159 - DNA, 23 bp, Homo sapiens
cctgggacctccccagcccagga

SEQ ID NO: 4676160 - DNA, 19 bp, Homo sapiens
cctgggaggaaatttgaat

SEQ ID NO: 4676161 - DNA, 12 bp, Homo sapiens
cctgggatgccc

SEQ ID NO: 4676162 - DNA, 16 bp, Homo sapiens
cctgggatgcccttcc

SEQ ID NO: 4676163 - DNA, 23 bp, Homo sapiens
cctgggattcaggaaaaggcctg

SEQ ID NO: 4676164 - DNA, 18 bp, Homo sapiens
cctgggcaatggccaggg

SEQ ID NO: 4676165 - DNA, 13 bp, Homo sapiens
cctgggcactccg

SEQ ID NO: 4676166 - DNA, 19 bp, Homo sapiens
cctgggcactccgcgccga

SEQ ID NO: 4676167 - DNA, 14 bp, Homo sapiens
cctgggcattgctt

SEQ ID NO: 4676168 - DNA, 15 bp, Homo sapiens
cctgggcattgcttt

SEQ ID NO: 4676169 - DNA, 16 bp, Homo sapiens
cctgggcattgctttc

SEQ ID NO: 4676170 - DNA, 14 bp, Homo sapiens
cctgggccagggtc

SEQ ID NO: 4676171 - DNA, 19 bp, Homo sapiens
cctgggcccatctctccct

SEQ ID NO: 4676172 - DNA, 20 bp, Homo sapiens
cctgggccctggggcctgta

SEQ ID NO: 4676173 - DNA, 17 bp, Homo sapiens
cctgggcctatggagag

SEQ ID NO: 4676174 - DNA, 13 bp, Homo sapiens
cctgggcctgctg

SEQ ID NO: 4676175 - DNA, 13 bp, Homo sapiens
ccctgctgtgcca

SEQ ID NO: 4676176 - DNA, 20 bp, Homo sapiens
ccctgctgtgccatgctggg

SEQ ID NO: 4676177 - DNA, 15 bp, Homo sapiens
ccctgcttccacctc

SEQ ID NO: 4676178 - DNA, 23 bp, Homo sapiens
ccctggaccacgaggctgattcc

SEQ ID NO: 4676179 - DNA, 17 bp, Homo sapiens
ccctggacttgcctctg

SEQ ID NO: 4676180 - DNA, 15 bp, Homo sapiens
ccctggagcaggagc

SEQ ID NO: 4676181 - DNA, 13 bp, Homo sapiens
ccctggccacagc

SEQ ID NO: 4676182 - DNA, 14 bp, Homo sapiens
ccctggcccccatc

SEQ ID NO: 4676183 - DNA, 17 bp, Homo sapiens
ccctggcccccatcagc

SEQ ID NO: 4676184 - DNA, 19 bp, Homo sapiens
ccctggcccccatcagccc

SEQ ID NO: 4676185 - DNA, 14 bp, Homo sapiens
ccctggcccctcca

SEQ ID NO: 4676186 - DNA, 19 bp, Homo sapiens
ccctggcctgaactgagga

SEQ ID NO: 4676187 - DNA, 21 bp, Homo sapiens
ccctggccttgggccctctgg

SEQ ID NO: 4676188 - DNA, 22 bp, Homo sapiens
ccctggccttgggccctctggt

SEQ ID NO: 4676189 - DNA, 18 bp, Homo sapiens
ccctgggaaccactccca

SEQ ID NO: 4676190 - DNA, 22 bp, Homo sapiens
ccctgggactttcccacccagg

SEQ ID NO: 4676191 - DNA, 17 bp, Homo sapiens
ccctgggccagggtctg

SEQ ID NO: 4676192 - DNA, 22 bp, Homo sapiens
ccctgggccagggtctgtgtga

SEQ ID NO: 4676193 - DNA, 15 bp, Homo sapiens
ccctgggcctgctgc

SEQ ID NO: 4676194 - DNA, 18 bp, Homo sapiens
ccctgggctggggaggag

SEQ ID NO: 4676195 - DNA, 21 bp, Homo sapiens
ccctgggctggggaggaggag

SEQ ID NO: 4676196 - DNA, 18 bp, Homo sapiens
ccctggggcctgtactgc

SEQ ID NO: 4676197 - DNA, 20 bp, Homo sapiens
ccctggggcctgtactgcct

SEQ ID NO: 4676198 - DNA, 23 bp, Homo sapiens
ccctggggcctgtactgcctgct

SEQ ID NO: 4676199 - DNA, 22 bp, Homo sapiens
ccctggtgagagggccgggcag

SEQ ID NO: 4676200 - DNA, 21 bp, Homo sapiens
ccctgtcccagggccctccca

SEQ ID NO: 4676201 - DNA, 23 bp, Homo sapiens
ccctgtcccagggccctcccagc

SEQ ID NO: 4676202 - DNA, 14 bp, Homo sapiens
ccctgtctctggct

SEQ ID NO: 4676203 - DNA, 19 bp, Homo sapiens
ccctgttcagctactccca

SEQ ID NO: 4676204 - DNA, 17 bp, Homo sapiens
cccttaaccccaaggac

SEQ ID NO: 4676205 - DNA, 15 bp, Homo sapiens
cccttaagccctggc

SEQ ID NO: 4676206 - DNA, 17 bp, Homo sapiens
cccttaagccctggccc

SEQ ID NO: 4676207 - DNA, 15 bp, Homo sapiens
cccttaatcttgctt

SEQ ID NO: 4676208 - DNA, 18 bp, Homo sapiens
cccttacctgtctctctc

SEQ ID NO: 4676209 - DNA, 11 bp, Homo sapiens
cccttcatgtc

SEQ ID NO: 4676210 - DNA, 12 bp, Homo sapiens
cccttcatgtcc

SEQ ID NO: 4676211 - DNA, 21 bp, Homo sapiens
cccttccccatgaaccctgcc

SEQ ID NO: 4676212 - DNA, 19 bp, Homo sapiens
cccttccccctttctctgc

SEQ ID NO: 4676213 - DNA, 17 bp, Homo sapiens
cccttcccctgggaact

SEQ ID NO: 4676214 - DNA, 15 bp, Homo sapiens
cccttccctatagga

SEQ ID NO: 4676215 - DNA, 15 bp, Homo sapiens
cccttcctctccacc

SEQ ID NO: 4676216 - DNA, 16 bp, Homo sapiens
cccttcctcttcctgc

SEQ ID NO: 4676217 - DNA, 13 bp, Homo sapiens
cccttcctggaca

SEQ ID NO: 4676218 - DNA, 16 bp, Homo sapiens
cccttcctggacagct

SEQ ID NO: 4676219 - DNA, 17 bp, Homo sapiens
cccttcctggacagctg

SEQ ID NO: 4676220 - DNA, 20 bp, Homo sapiens
cccttctcggggtgggacag

SEQ ID NO: 4676221 - DNA, 18 bp, Homo sapiens
cccttgaaccccctccct

SEQ ID NO: 4676222 - DNA, 12 bp, Homo sapiens
cccttgctgggc

SEQ ID NO: 4676223 - DNA, 20 bp, Homo sapiens
cccttgctttcctgggcctt

SEQ ID NO: 4676224 - DNA, 17 bp, Homo sapiens
cccttggaggagagaga

SEQ ID NO: 4676225 - DNA, 19 bp, Homo sapiens
cccttgggcagagtcctgc

SEQ ID NO: 4676226 - DNA, 19 bp, Homo sapiens
ccctttctctgcctggcaa

SEQ ID NO: 4676227 - DNA, 21 bp, Homo sapiens
ccgaagctaacagggaaggca

SEQ ID NO: 4676228 - DNA, 23 bp, Homo sapiens
ccgaagctaacagggaaggcagg

SEQ ID NO: 4676229 - DNA, 21 bp, Homo sapiens
ccgaagctgcgggggcaggcc

SEQ ID NO: 4676230 - DNA, 12 bp, Homo sapiens
ccgaatcccgtc

SEQ ID NO: 4676231 - DNA, 23 bp, Homo sapiens
ccgacgccgtcccaccagcttca

SEQ ID NO: 4676232 - DNA, 13 bp, Homo sapiens
ccgactctggccc

SEQ ID NO: 4676233 - DNA, 19 bp, Homo sapiens
ccgactctggccctggccc

SEQ ID NO: 4676234 - DNA, 18 bp, Homo sapiens
ccgagagcctcgcttttt

SEQ ID NO: 4676235 - DNA, 15 bp, Homo sapiens
ccgagcagctgagca

SEQ ID NO: 4676236 - DNA, 17 bp, Homo sapiens
ccgagcagctgagcagg

SEQ ID NO: 4676237 - DNA, 18 bp, Homo sapiens
ccgagcagctgagcaggg

SEQ ID NO: 4676238 - DNA, 21 bp, Homo sapiens
ccgagcgggtgcaagcactcg

SEQ ID NO: 4676239 - DNA, 20 bp, Homo sapiens
ccgagtagctgggattacag

SEQ ID NO: 4676240 - DNA, 12 bp, Homo sapiens
ccgagtccaagc

SEQ ID NO: 4676241 - DNA, 13 bp, Homo sapiens
ccgcacagaaaat

SEQ ID NO: 4676242 - DNA, 15 bp, Homo sapiens
ccgcaccctccctag

SEQ ID NO: 4676243 - DNA, 14 bp, Homo sapiens
ccgcagacctctgg

SEQ ID NO: 4676244 - DNA, 16 bp, Homo sapiens
ccgcatactgagaatc

SEQ ID NO: 4676245 - DNA, 16 bp, Homo sapiens
ccgccacggcctggct

SEQ ID NO: 4676246 - DNA, 20 bp, Homo sapiens
ccgccacggcctggctggtg

SEQ ID NO: 4676247 - DNA, 11 bp, Homo sapiens
ccgccagccac

SEQ ID NO: 4676248 - DNA, 12 bp, Homo sapiens
ccgccagccaca

SEQ ID NO: 4676249 - DNA, 11 bp, Homo sapiens
ccgccagggct

SEQ ID NO: 4676250 - DNA, 14 bp, Homo sapiens
ccgccagggctggg

SEQ ID NO: 4676251 - DNA, 23 bp, Homo sapiens
ccgccagtgtttctgaatgtttg

SEQ ID NO: 4676252 - DNA, 16 bp, Homo sapiens
ccgcccacctcagcct

SEQ ID NO: 4676253 - DNA, 21 bp, Homo sapiens
ccgccctcggactaggttagc

SEQ ID NO: 4676254 - DNA, 16 bp, Homo sapiens
ccgccttctcccacat

SEQ ID NO: 4676255 - DNA, 15 bp, Homo sapiens
ccgcgcagctgccta

SEQ ID NO: 4676256 - DNA, 17 bp, Homo sapiens
ccgctacaccactctgg

SEQ ID NO: 4676257 - DNA, 21 bp, Homo sapiens
ccgctacaccactctggcagc

SEQ ID NO: 4676258 - DNA, 18 bp, Homo sapiens
ccgctacagtttttattt

SEQ ID NO: 4676259 - DNA, 15 bp, Homo sapiens
ccgctggccctgccg

SEQ ID NO: 4676260 - DNA, 17 bp, Homo sapiens
ccgctttgaaagaagca

SEQ ID NO: 4676261 - DNA, 21 bp, Homo sapiens
ccggaaggaggccaaccagcc

SEQ ID NO: 4676262 - DNA, 19 bp, Homo sapiens
ccggagcaaactctgctgt

SEQ ID NO: 4676263 - DNA, 18 bp, Homo sapiens
ccggagctgcccctctct

SEQ ID NO: 4676264 - DNA, 15 bp, Homo sapiens
ccggcaccccctgca

SEQ ID NO: 4676265 - DNA, 20 bp, Homo sapiens
ccggcctgtgggtctctgaa

SEQ ID NO: 4676266 - DNA, 12 bp, Homo sapiens
ccggctggaaat

SEQ ID NO: 4676267 - DNA, 23 bp, Homo sapiens
ccgggatattatagaaaattatt

SEQ ID NO: 4676268 - DNA, 15 bp, Homo sapiens
ccgggcagaggggca

SEQ ID NO: 4676269 - DNA, 18 bp, Homo sapiens
ccgggccactccttcctg

SEQ ID NO: 4676270 - DNA, 20 bp, Homo sapiens
ccgggccactccttcctgcc

SEQ ID NO: 4676271 - DNA, 15 bp, Homo sapiens
ccgggcctgctgtca

SEQ ID NO: 4676272 - DNA, 12 bp, Homo sapiens
ccgggctggaga

SEQ ID NO: 4676273 - DNA, 23 bp, Homo sapiens
ccgggctggagaaagagctgcct

SEQ ID NO: 4676274 - DNA, 17 bp, Homo sapiens
ccgggcttggcctcctg

SEQ ID NO: 4676275 - DNA, 17 bp, Homo sapiens
ccggggaactggccaag

SEQ ID NO: 4676276 - DNA, 16 bp, Homo sapiens
ccggtaactgtcctgt

SEQ ID NO: 4676277 - DNA, 18 bp, Homo sapiens
ccggtaactgtcctgtcc

SEQ ID NO: 4676278 - DNA, 21 bp, Homo sapiens
ccggtaactgtcctgtcctgc

SEQ ID NO: 4676279 - DNA, 16 bp, Homo sapiens
ccggtgctgcaggagt

SEQ ID NO: 4676280 - DNA, 14 bp, Homo sapiens
ccggttcccacaag

SEQ ID NO: 4676281 - DNA, 13 bp, Homo sapiens
ccgtcagggagag

SEQ ID NO: 4676282 - DNA, 23 bp, Homo sapiens
ccgtcagggagaggtcaccagct

SEQ ID NO: 4676283 - DNA, 17 bp, Homo sapiens
ccgtcccaccagcttca

SEQ ID NO: 4676284 - DNA, 14 bp, Homo sapiens
ccgtgatctcccct

SEQ ID NO: 4676285 - DNA, 18 bp, Homo sapiens
ccgtgccacccccagccc

SEQ ID NO: 4676286 - DNA, 23 bp, Homo sapiens
ccgtgcgggaaattcagtcttga

SEQ ID NO: 4676287 - DNA, 16 bp, Homo sapiens
ccgtgctcgccccagc

SEQ ID NO: 4676288 - DNA, 12 bp, Homo sapiens
cccctgcccctc

SEQ ID NO: 4676289 - DNA, 19 bp, Homo sapiens
cccctgcccctgtgggact

SEQ ID NO: 4676290 - DNA, 23 bp, Homo sapiens
cccctgcctggttctaggctgct

SEQ ID NO: 4676291 - DNA, 11 bp, Homo sapiens
cccctgcctta

SEQ ID NO: 4676292 - DNA, 21 bp, Homo sapiens
cccctgccttaacctgggacc

SEQ ID NO: 4676293 - DNA, 12 bp, Homo sapiens
cccctgctgccc

SEQ ID NO: 4676294 - DNA, 16 bp, Homo sapiens
ccagacctgcagacgc

SEQ ID NO: 4676295 - DNA, 20 bp, Homo sapiens
ccagacctgcagacgcccag

SEQ ID NO: 4676296 - DNA, 21 bp, Homo sapiens
ccagacctgcagacgcccaga

SEQ ID NO: 4676297 - DNA, 14 bp, Homo sapiens
ccagacctgcatgg

SEQ ID NO: 4676298 - DNA, 17 bp, Homo sapiens
ccagacctgcatggtca

SEQ ID NO: 4676299 - DNA, 22 bp, Homo sapiens
ccagacctgcatggtcaagcct

SEQ ID NO: 4676300 - DNA, 14 bp, Homo sapiens
ccagacctgcctct

SEQ ID NO: 4676301 - DNA, 17 bp, Homo sapiens
ccagactactattttct

SEQ ID NO: 4676302 - DNA, 15 bp, Homo sapiens
ccagactctaggtta

SEQ ID NO: 4676303 - DNA, 17 bp, Homo sapiens
ccagagacagaggatgt

SEQ ID NO: 4676304 - DNA, 23 bp, Homo sapiens
ccagagatgactattacttttct

SEQ ID NO: 4676305 - DNA, 21 bp, Homo sapiens
ccagagcccctcctccagccc

SEQ ID NO: 4676306 - DNA, 11 bp, Homo sapiens
ccagagcctgg

SEQ ID NO: 4676307 - DNA, 19 bp, Homo sapiens
ccagagcctggctgcccat

SEQ ID NO: 4676308 - DNA, 13 bp, Homo sapiens
ccagagcctgggg

SEQ ID NO: 4676309 - DNA, 15 bp, Homo sapiens
ccagagcctggggct

SEQ ID NO: 4676310 - DNA, 18 bp, Homo sapiens
ccagagcctggggctcta

SEQ ID NO: 4676311 - DNA, 18 bp, Homo sapiens
ccagagctcatcccccct

SEQ ID NO: 4676312 - DNA, 21 bp, Homo sapiens
ccagagctcatcccccctgct

SEQ ID NO: 4676313 - DNA, 16 bp, Homo sapiens
ccaattcacccactcc

SEQ ID NO: 4676314 - DNA, 20 bp, Homo sapiens
ccaatttgtaaaaacagcat

SEQ ID NO: 4676315 - DNA, 13 bp, Homo sapiens
ccaatttttgtac

SEQ ID NO: 4676316 - DNA, 15 bp, Homo sapiens
ccacaaatcttcagt

SEQ ID NO: 4676317 - DNA, 19 bp, Homo sapiens
ccacaactcctacatgatg

SEQ ID NO: 4676318 - DNA, 19 bp, Homo sapiens
ccacaagctgcactgtgaa

SEQ ID NO: 4676319 - DNA, 16 bp, Homo sapiens
ccacaagctgtccctg

SEQ ID NO: 4676320 - DNA, 19 bp, Homo sapiens
ccacaagctgtccctgcag

SEQ ID NO: 4676321 - DNA, 20 bp, Homo sapiens
ccacaagctgtccctgcagg

SEQ ID NO: 4676322 - DNA, 22 bp, Homo sapiens
ccacaagctgtccctgcagggc

SEQ ID NO: 4676323 - DNA, 12 bp, Homo sapiens
ccacaaggcctg

SEQ ID NO: 4676324 - DNA, 17 bp, Homo sapiens
ccacaaggcctggtctg

SEQ ID NO: 4676325 - DNA, 21 bp, Homo sapiens
ccacaaggcctggtctgggag

SEQ ID NO: 4676326 - DNA, 13 bp, Homo sapiens
ccacacctggcct

SEQ ID NO: 4676327 - DNA, 16 bp, Homo sapiens
ccacacctggccttaa

SEQ ID NO: 4676328 - DNA, 22 bp, Homo sapiens
ccacacctggccttaaagaggg

SEQ ID NO: 4676329 - DNA, 13 bp, Homo sapiens
ccacacgagggcc

SEQ ID NO: 4676330 - DNA, 16 bp, Homo sapiens
ccacacgcctctgtgt

SEQ ID NO: 4676331 - DNA, 14 bp, Homo sapiens
ccacactcagcaca

SEQ ID NO: 4676332 - DNA, 15 bp, Homo sapiens
ccacacttctcagga

SEQ ID NO: 4676333 - DNA, 17 bp, Homo sapiens
ccacacttctcaggaca

SEQ ID NO: 4676334 - DNA, 19 bp, Homo sapiens
ccacagaaagccaggagca

SEQ ID NO: 4676335 - DNA, 17 bp, Homo sapiens
ccacagacaactcacat

SEQ ID NO: 4676336 - DNA, 20 bp, Homo sapiens
cattactgttccagattcct

SEQ ID NO: 4676337 - DNA, 20 bp, Homo sapiens
cattacttgctttcaattga

SEQ ID NO: 4676338 - DNA, 18 bp, Homo sapiens
cattagccagatttgtct

SEQ ID NO: 4676339 - DNA, 21 bp, Homo sapiens
cattaggaattaagttatctt

SEQ ID NO: 4676340 - DNA, 16 bp, Homo sapiens
cattaggccagcaacg

SEQ ID NO: 4676341 - DNA, 19 bp, Homo sapiens
cattaggctgttggttcaa

SEQ ID NO: 4676342 - DNA, 19 bp, Homo sapiens
cattagtatagtctccctt

SEQ ID NO: 4676343 - DNA, 23 bp, Homo sapiens
cattatccttttatctcacaaat

SEQ ID NO: 4676344 - DNA, 21 bp, Homo sapiens
cattatgcacttttagaaatg

SEQ ID NO: 4676345 - DNA, 23 bp, Homo sapiens
cattatgccacttccttttaact

SEQ ID NO: 4676346 - DNA, 21 bp, Homo sapiens
cattatttgagactgtcctgt

SEQ ID NO: 4676347 - DNA, 19 bp, Homo sapiens
cattcagaggttttgttag

SEQ ID NO: 4676348 - DNA, 14 bp, Homo sapiens
cattcagctctgga

SEQ ID NO: 4676349 - DNA, 13 bp, Homo sapiens
cattcattttgaa

SEQ ID NO: 4676350 - DNA, 16 bp, Homo sapiens
cattcatttttatagc

SEQ ID NO: 4676351 - DNA, 18 bp, Homo sapiens
cattccacactgcaggga

SEQ ID NO: 4676352 - DNA, 14 bp, Homo sapiens
cattccattgccta

SEQ ID NO: 4676353 - DNA, 14 bp, Homo sapiens
cattcctctgccct

SEQ ID NO: 4676354 - DNA, 13 bp, Homo sapiens
cattcctgacggc

SEQ ID NO: 4676355 - DNA, 19 bp, Homo sapiens
cattcctgcctttaagcca

SEQ ID NO: 4676356 - DNA, 21 bp, Homo sapiens
cattcctgcctttaagccaaa

SEQ ID NO: 4676357 - DNA, 22 bp, Homo sapiens
cattcctgcctttaagccaaag

SEQ ID NO: 4676358 - DNA, 17 bp, Homo sapiens
cattcgtgagctgggga

SEQ ID NO: 4676359 - DNA, 18 bp, Homo sapiens
cattcgtgagctggggac

SEQ ID NO: 4676360 - DNA, 11 bp, Homo sapiens
cattctaatgc

SEQ ID NO: 4676361 - DNA, 12 bp, Homo sapiens
cattctaatgca

SEQ ID NO: 4676362 - DNA, 13 bp, Homo sapiens
cattctaatgcat

SEQ ID NO: 4676363 - DNA, 13 bp, Homo sapiens
cattctacagttg

SEQ ID NO: 4676364 - DNA, 17 bp, Homo sapiens
cattctaggctcactgc

SEQ ID NO: 4676365 - DNA, 11 bp, Homo sapiens
cattctcacat

SEQ ID NO: 4676366 - DNA, 23 bp, Homo sapiens
cattctcataattcctacagcac

SEQ ID NO: 4676367 - DNA, 18 bp, Homo sapiens
cattctccacagcaaccc

SEQ ID NO: 4676368 - DNA, 14 bp, Homo sapiens
cattctcctcctcc

SEQ ID NO: 4676369 - DNA, 22 bp, Homo sapiens
cattctcctcctcctccctcct

SEQ ID NO: 4676370 - DNA, 17 bp, Homo sapiens
cattctctcccatcctg

SEQ ID NO: 4676371 - DNA, 18 bp, Homo sapiens
cattctctcccatcctgg

SEQ ID NO: 4676372 - DNA, 13 bp, Homo sapiens
cattctcttttaa

SEQ ID NO: 4676373 - DNA, 14 bp, Homo sapiens
cattctcttttaat

SEQ ID NO: 4676374 - DNA, 19 bp, Homo sapiens
cattctgcctagagtgtag

SEQ ID NO: 4676375 - DNA, 13 bp, Homo sapiens
cattcttcagttc

SEQ ID NO: 4676376 - DNA, 20 bp, Homo sapiens
cattcttggcttaatcattt

SEQ ID NO: 4676377 - DNA, 16 bp, Homo sapiens
cattctttgtatctta

SEQ ID NO: 4676378 - DNA, 19 bp, Homo sapiens
cattctttgtatcttaaat

SEQ ID NO: 4676379 - DNA, 21 bp, Homo sapiens
cattctttgtatcttaaatct

SEQ ID NO: 4676380 - DNA, 18 bp, Homo sapiens
cattcttttgccacatcc

SEQ ID NO: 4676381 - DNA, 17 bp, Homo sapiens
cattgaagccgactctg

SEQ ID NO: 4676382 - DNA, 13 bp, Homo sapiens
cattgaagtatat

SEQ ID NO: 4676383 - DNA, 20 bp, Homo sapiens
cattgaagtatggtgtgttc

SEQ ID NO: 4676384 - DNA, 21 bp, Homo sapiens
cattgaagtatggtgtgttca

SEQ ID NO: 4676385 - DNA, 22 bp, Homo sapiens
cattgacataggtcataaagca

SEQ ID NO: 4676386 - DNA, 16 bp, Homo sapiens
cattgacctggagggg

SEQ ID NO: 4676387 - DNA, 23 bp, Homo sapiens
cattgactcctttccaatagaaa

SEQ ID NO: 4676388 - DNA, 15 bp, Homo sapiens
cattgagcatatttt

SEQ ID NO: 4676389 - DNA, 19 bp, Homo sapiens
cattgagcttgcatgcttg

SEQ ID NO: 4676390 - DNA, 21 bp, Homo sapiens
cattgcactcatcatattttg

SEQ ID NO: 4676391 - DNA, 11 bp, Homo sapiens
cattgcacttt

SEQ ID NO: 4676392 - DNA, 15 bp, Homo sapiens
cattgctccattcac

SEQ ID NO: 4676393 - DNA, 15 bp, Homo sapiens
cattgctcccctgat

SEQ ID NO: 4676394 - DNA, 20 bp, Homo sapiens
cattgctcccctgatagaag

SEQ ID NO: 4676395 - DNA, 22 bp, Homo sapiens
cattgctgccaaggtggaggga

SEQ ID NO: 4676396 - DNA, 14 bp, Homo sapiens
cattgctttctgaa

SEQ ID NO: 4676397 - DNA, 11 bp, Homo sapiens
cattggacaga

SEQ ID NO: 4676398 - DNA, 23 bp, Homo sapiens
cattggagtctcatttgggctag

SEQ ID NO: 4676399 - DNA, 17 bp, Homo sapiens
cattggagtttcaaatc

SEQ ID NO: 4676400 - DNA, 17 bp, Homo sapiens
cattggcatctgctttt

SEQ ID NO: 4676401 - DNA, 19 bp, Homo sapiens
cattgggcagcgcccttcc

SEQ ID NO: 4676402 - DNA, 20 bp, Homo sapiens
cattgggcagcgcccttcct

SEQ ID NO: 4676403 - DNA, 17 bp, Homo sapiens
cattgtatcgatgttat

SEQ ID NO: 4676404 - DNA, 22 bp, Homo sapiens
cattgtatcgatgttatgtaaa

SEQ ID NO: 4676405 - DNA, 14 bp, Homo sapiens
cattgtcagccttg

SEQ ID NO: 4676406 - DNA, 15 bp, Homo sapiens
cattgtcagccttgc

SEQ ID NO: 4676407 - DNA, 15 bp, Homo sapiens
cattgtcataagtaa

SEQ ID NO: 4676408 - DNA, 21 bp, Homo sapiens
cattgtctcctatatatttct

SEQ ID NO: 4676409 - DNA, 18 bp, Homo sapiens
cattgtgaactgacaggc

SEQ ID NO: 4676410 - DNA, 21 bp, Homo sapiens
cattgtttgaaacaaagaagg

SEQ ID NO: 4676411 - DNA, 21 bp, Homo sapiens
cattgttttcttttacagact

SEQ ID NO: 4676412 - DNA, 12 bp, Homo sapiens
catttaaattcc

SEQ ID NO: 4676413 - DNA, 19 bp, Homo sapiens
catttagataatttgaaaa

SEQ ID NO: 4676414 - DNA, 22 bp, Homo sapiens
catttagataatttgaaaaagt

SEQ ID NO: 4676415 - DNA, 15 bp, Homo sapiens
catttataatactgt

SEQ ID NO: 4676416 - DNA, 16 bp, Homo sapiens
catttataatactgtt

SEQ ID NO: 4676417 - DNA, 15 bp, Homo sapiens
catttatatttttat

SEQ ID NO: 4676418 - DNA, 20 bp, Homo sapiens
catagagatgagcccaccct

SEQ ID NO: 4676419 - DNA, 18 bp, Homo sapiens
catagcctaatccctggg

SEQ ID NO: 4676420 - DNA, 19 bp, Homo sapiens
cataggtttctctccctcc

SEQ ID NO: 4676421 - DNA, 16 bp, Homo sapiens
catagtctttgtttac

SEQ ID NO: 4676422 - DNA, 15 bp, Homo sapiens
catagtgagaaccca

SEQ ID NO: 4676423 - DNA, 15 bp, Homo sapiens
catagttatgtgatt

SEQ ID NO: 4676424 - DNA, 19 bp, Homo sapiens
catatagccattgatcata

SEQ ID NO: 4676425 - DNA, 15 bp, Homo sapiens
catatatgtctcttt

SEQ ID NO: 4676426 - DNA, 18 bp, Homo sapiens
catatattaccccttcat

SEQ ID NO: 4676427 - DNA, 21 bp, Homo sapiens
catatatttggagtttttctg

SEQ ID NO: 4676428 - DNA, 22 bp, Homo sapiens
catatatttttaaaaaatgaaa

SEQ ID NO: 4676429 - DNA, 20 bp, Homo sapiens
catatgaggacctttatatc

SEQ ID NO: 4676430 - DNA, 23 bp, Homo sapiens
catatgctgatcttttaaaatca

SEQ ID NO: 4676431 - DNA, 18 bp, Homo sapiens
catatggactctgcacat

SEQ ID NO: 4676432 - DNA, 17 bp, Homo sapiens
catatgtattcctgatc

SEQ ID NO: 4676433 - DNA, 21 bp, Homo sapiens
catatgtcactagaatggata

SEQ ID NO: 4676434 - DNA, 11 bp, Homo sapiens
catatgtctta

SEQ ID NO: 4676435 - DNA, 23 bp, Homo sapiens
catatgtcttactactttaaatc

SEQ ID NO: 4676436 - DNA, 20 bp, Homo sapiens
catattgtaccccctcattt

SEQ ID NO: 4676437 - DNA, 16 bp, Homo sapiens
catatttactacctta

SEQ ID NO: 4676438 - DNA, 14 bp, Homo sapiens
catatttataagag

SEQ ID NO: 4676439 - DNA, 15 bp, Homo sapiens
catatttataagaga

SEQ ID NO: 4676440 - DNA, 18 bp, Homo sapiens
catatttattttcttttg

SEQ ID NO: 4676441 - DNA, 13 bp, Homo sapiens
catatttcatttt

SEQ ID NO: 4676442 - DNA, 15 bp, Homo sapiens
catatttcattttaa

SEQ ID NO: 4676443 - DNA, 15 bp, Homo sapiens
catattttaatcatt

SEQ ID NO: 4676444 - DNA, 19 bp, Homo sapiens
catattttaatcattattt

SEQ ID NO: 4676445 - DNA, 23 bp, Homo sapiens
catattttaatcattatttgaga

SEQ ID NO: 4676446 - DNA, 11 bp, Homo sapiens
catcaaagagg

SEQ ID NO: 4676447 - DNA, 23 bp, Homo sapiens
catcaacctattaaaatacattt

SEQ ID NO: 4676448 - DNA, 16 bp, Homo sapiens
catcacatctgcacac

SEQ ID NO: 4676449 - DNA, 17 bp, Homo sapiens
catcacatctgcacact

SEQ ID NO: 4676450 - DNA, 21 bp, Homo sapiens
catcacatctgcacactctct

SEQ ID NO: 4676451 - DNA, 14 bp, Homo sapiens
catcaccagtgcca

SEQ ID NO: 4676452 - DNA, 18 bp, Homo sapiens
catcagaaagggagggct

SEQ ID NO: 4676453 - DNA, 21 bp, Homo sapiens
catcagaaagggagggctctg

SEQ ID NO: 4676454 - DNA, 21 bp, Homo sapiens
catcagggcctggggcctgag

SEQ ID NO: 4676455 - DNA, 16 bp, Homo sapiens
catcatgcctctgagg

SEQ ID NO: 4676456 - DNA, 20 bp, Homo sapiens
catcatgcctctgaggccag

SEQ ID NO: 4676457 - DNA, 23 bp, Homo sapiens
catcatgcctctgaggccagcct

SEQ ID NO: 4676458 - DNA, 20 bp, Homo sapiens
catcattactgttccagatt

SEQ ID NO: 4676459 - DNA, 16 bp, Homo sapiens
catcattgtcagcctt

SEQ ID NO: 4676460 - DNA, 14 bp, Homo sapiens
catcatttcccagg

SEQ ID NO: 4676461 - DNA, 15 bp, Homo sapiens
catccaaagcagaca

SEQ ID NO: 4676462 - DNA, 20 bp, Homo sapiens
catccaatctattatttctc

SEQ ID NO: 4676463 - DNA, 23 bp, Homo sapiens
catccacgtagggggcaggggca

SEQ ID NO: 4676464 - DNA, 17 bp, Homo sapiens
catccataaagaagcaa

SEQ ID NO: 4676465 - DNA, 13 bp, Homo sapiens
catccattaggcc

SEQ ID NO: 4676466 - DNA, 20 bp, Homo sapiens
catccattaggccagcaacg

SEQ ID NO: 4676467 - DNA, 17 bp, Homo sapiens
catcccaaccagtgcca

SEQ ID NO: 4676468 - DNA, 20 bp, Homo sapiens
catcccaaccagtgccaagg

SEQ ID NO: 4676469 - DNA, 22 bp, Homo sapiens
catcccaaccagtgccaaggac

SEQ ID NO: 4676470 - DNA, 20 bp, Homo sapiens
catcccatctaagcattcca

SEQ ID NO: 4676471 - DNA, 15 bp, Homo sapiens
catcccccctgctgc

SEQ ID NO: 4676472 - DNA, 18 bp, Homo sapiens
catcccccctgctgccca

SEQ ID NO: 4676473 - DNA, 20 bp, Homo sapiens
catccctatagaccactggg

SEQ ID NO: 4676474 - DNA, 20 bp, Homo sapiens
catccctgactggccaaacc

SEQ ID NO: 4676475 - DNA, 18 bp, Homo sapiens
catccctggagcaggagc

SEQ ID NO: 4676476 - DNA, 12 bp, Homo sapiens
catccctgggcc

SEQ ID NO: 4676477 - DNA, 14 bp, Homo sapiens
catccctgggcctg

SEQ ID NO: 4676478 - DNA, 23 bp, Homo sapiens
catccctgggcctgctgctgaga

SEQ ID NO: 4676479 - DNA, 15 bp, Homo sapiens
catcctcatccctga

SEQ ID NO: 4676480 - DNA, 20 bp, Homo sapiens
catcctcatccctgactggc

SEQ ID NO: 4676481 - DNA, 12 bp, Homo sapiens
catcctgtgaag

SEQ ID NO: 4676482 - DNA, 16 bp, Homo sapiens
catccttgactgaagc

SEQ ID NO: 4676483 - DNA, 20 bp, Homo sapiens
catcggccaagaatacttga

SEQ ID NO: 4676484 - DNA, 21 bp, Homo sapiens
catcggccaagaatacttgaa

SEQ ID NO: 4676485 - DNA, 19 bp, Homo sapiens
catctaaacacaacaataa

SEQ ID NO: 4676486 - DNA, 18 bp, Homo sapiens
catctaacaggaaaagag

SEQ ID NO: 4676487 - DNA, 12 bp, Homo sapiens
catctaggtcct

SEQ ID NO: 4676488 - DNA, 18 bp, Homo sapiens
catctaggtcctggctgg

SEQ ID NO: 4676489 - DNA, 15 bp, Homo sapiens
catctatcactgcat

SEQ ID NO: 4676490 - DNA, 21 bp, Homo sapiens
catctcccacctagcagcacc

SEQ ID NO: 4676491 - DNA, 19 bp, Homo sapiens
catctcccttccacctcac

SEQ ID NO: 4676492 - DNA, 20 bp, Homo sapiens
cagctccatgttctcccaaa

SEQ ID NO: 4676493 - DNA, 14 bp, Homo sapiens
cagctcccccaggc

SEQ ID NO: 4676494 - DNA, 16 bp, Homo sapiens
cagctccggcctgtcc

SEQ ID NO: 4676495 - DNA, 19 bp, Homo sapiens
cagctcctctgtctcgagc

SEQ ID NO: 4676496 - DNA, 23 bp, Homo sapiens
cagctcctttctgtcctggagct

SEQ ID NO: 4676497 - DNA, 17 bp, Homo sapiens
cagctctggagaacagt

SEQ ID NO: 4676498 - DNA, 22 bp, Homo sapiens
cagctctgggccattctccaca

SEQ ID NO: 4676499 - DNA, 14 bp, Homo sapiens
cagctctttccaaa

SEQ ID NO: 4676500 - DNA, 16 bp, Homo sapiens
cagctctttccaaatt

SEQ ID NO: 4676501 - DNA, 19 bp, Homo sapiens
cagctctttccaaattaaa

SEQ ID NO: 4676502 - DNA, 15 bp, Homo sapiens
cagctgaaggcagtg

SEQ ID NO: 4676503 - DNA, 17 bp, Homo sapiens
cagctgaaggcagtggc

SEQ ID NO: 4676504 - DNA, 20 bp, Homo sapiens
cagctgaataacctgcacag

SEQ ID NO: 4676505 - DNA, 23 bp, Homo sapiens
cagctgaataacctgcacaggct

SEQ ID NO: 4676506 - DNA, 20 bp, Homo sapiens
cagctgaatgcctcctgtgg

SEQ ID NO: 4676507 - DNA, 21 bp, Homo sapiens
cagctgacttggttctgaagc

SEQ ID NO: 4676508 - DNA, 17 bp, Homo sapiens
cagctgagtgagtggga

SEQ ID NO: 4676509 - DNA, 19 bp, Homo sapiens
cagctgctctaagcccagg

SEQ ID NO: 4676510 - DNA, 14 bp, Homo sapiens
cagctgctgtgccc

SEQ ID NO: 4676511 - DNA, 13 bp, Homo sapiens
cagctggaaactt

SEQ ID NO: 4676512 - DNA, 19 bp, Homo sapiens
cagctggaggaatacattt

SEQ ID NO: 4676513 - DNA, 20 bp, Homo sapiens
cagctggaggaatacatttt

SEQ ID NO: 4676514 - DNA, 18 bp, Homo sapiens
cagctggcccgtgacaga

SEQ ID NO: 4676515 - DNA, 20 bp, Homo sapiens
cagctgggtcaggcagggtg

SEQ ID NO: 4676516 - DNA, 17 bp, Homo sapiens
cagctggtcctgaccag

SEQ ID NO: 4676517 - DNA, 19 bp, Homo sapiens
cagctggtcctgaccagga

SEQ ID NO: 4676518 - DNA, 11 bp, Homo sapiens
cagctgtgcct

SEQ ID NO: 4676519 - DNA, 17 bp, Homo sapiens
cagctgtttgaaatgtt

SEQ ID NO: 4676520 - DNA, 18 bp, Homo sapiens
cagcttcaacttttctct

SEQ ID NO: 4676521 - DNA, 15 bp, Homo sapiens
cagcttctcagtttc

SEQ ID NO: 4676522 - DNA, 21 bp, Homo sapiens
cagcttctcagtttctgcctg

SEQ ID NO: 4676523 - DNA, 13 bp, Homo sapiens
cagcttgctgtca

SEQ ID NO: 4676524 - DNA, 15 bp, Homo sapiens
cagcttgctgtcact

SEQ ID NO: 4676525 - DNA, 12 bp, Homo sapiens
cagcttgtagcc

SEQ ID NO: 4676526 - DNA, 17 bp, Homo sapiens
cagcttgtagccagccg

SEQ ID NO: 4676527 - DNA, 18 bp, Homo sapiens
cagcttgtagccagccgg

SEQ ID NO: 4676528 - DNA, 19 bp, Homo sapiens
cagctttataacaaatgtg

SEQ ID NO: 4676529 - DNA, 14 bp, Homo sapiens
cagctttcctgtat

SEQ ID NO: 4676530 - DNA, 22 bp, Homo sapiens
cagctttggattgctggggcca

SEQ ID NO: 4676531 - DNA, 23 bp, Homo sapiens
cagctttggattgctggggccag

SEQ ID NO: 4676532 - DNA, 18 bp, Homo sapiens
cagctttgtatgtttatg

SEQ ID NO: 4676533 - DNA, 12 bp, Homo sapiens
cagcttttcttg

SEQ ID NO: 4676534 - DNA, 13 bp, Homo sapiens
cagcttttcttga

SEQ ID NO: 4676535 - DNA, 15 bp, Homo sapiens
cagcttttcttgata

SEQ ID NO: 4676536 - DNA, 15 bp, Homo sapiens
cagcttttgatggta

SEQ ID NO: 4676537 - DNA, 21 bp, Homo sapiens
caggaaaagagggagaagaaa

SEQ ID NO: 4676538 - DNA, 21 bp, Homo sapiens
cagtcctttcccaccattcct

SEQ ID NO: 4676539 - DNA, 23 bp, Homo sapiens
cagtcctttcccaccattcctgc

SEQ ID NO: 4676540 - DNA, 18 bp, Homo sapiens
cagtcgtgatgtggagga

SEQ ID NO: 4676541 - DNA, 16 bp, Homo sapiens
cagtctaaacagagtc

SEQ ID NO: 4676542 - DNA, 21 bp, Homo sapiens
cagtctaaacagagtccggga

SEQ ID NO: 4676543 - DNA, 19 bp, Homo sapiens
cagtcttgatttaacctta

SEQ ID NO: 4676544 - DNA, 17 bp, Homo sapiens
cagtgaaatacatcctt

SEQ ID NO: 4676545 - DNA, 19 bp, Homo sapiens
cagtgaagtctagaatcat

SEQ ID NO: 4676546 - DNA, 22 bp, Homo sapiens
cagtgactcctgctggtacctg

SEQ ID NO: 4676547 - DNA, 17 bp, Homo sapiens
cagtgaggcaggagaag

SEQ ID NO: 4676548 - DNA, 21 bp, Homo sapiens
cagtgagggagggctgtcatc

SEQ ID NO: 4676549 - DNA, 16 bp, Homo sapiens
cagtgattcgcttttg

SEQ ID NO: 4676550 - DNA, 23 bp, Homo sapiens
cagtgattcgcttttggtatttg

SEQ ID NO: 4676551 - DNA, 17 bp, Homo sapiens
cagtgcaaaatgtcttg

SEQ ID NO: 4676552 - DNA, 15 bp, Homo sapiens
cagtgcaaaccactt

SEQ ID NO: 4676553 - DNA, 17 bp, Homo sapiens
cagtgcaaaccacttct

SEQ ID NO: 4676554 - DNA, 21 bp, Homo sapiens
cagtgcaacctctgcttccca

SEQ ID NO: 4676555 - DNA, 22 bp, Homo sapiens
cagtgcagtttcttttcacatt

SEQ ID NO: 4676556 - DNA, 22 bp, Homo sapiens
cagtgcatcacatctgcacact

SEQ ID NO: 4676557 - DNA, 17 bp, Homo sapiens
cagtgcattatgtacac

SEQ ID NO: 4676558 - DNA, 20 bp, Homo sapiens
cagtgccatccccaccttca

SEQ ID NO: 4676559 - DNA, 19 bp, Homo sapiens
cagtgcccggtgcagggcc

SEQ ID NO: 4676560 - DNA, 14 bp, Homo sapiens
cagtgcctgcacat

SEQ ID NO: 4676561 - DNA, 14 bp, Homo sapiens
cagtggaaaacaaa

SEQ ID NO: 4676562 - DNA, 19 bp, Homo sapiens
cagtggaaaccctgagagt

SEQ ID NO: 4676563 - DNA, 14 bp, Homo sapiens
cagtggagggggca

SEQ ID NO: 4676564 - DNA, 18 bp, Homo sapiens
cagtggcagagaatccaa

SEQ ID NO: 4676565 - DNA, 14 bp, Homo sapiens
cagtggcaggggag

SEQ ID NO: 4676566 - DNA, 18 bp, Homo sapiens
cagtggcaggggagcagg

SEQ ID NO: 4676567 - DNA, 17 bp, Homo sapiens
cagtggccatcatcctc

SEQ ID NO: 4676568 - DNA, 21 bp, Homo sapiens
cagtggcgccatctcggctca

SEQ ID NO: 4676569 - DNA, 14 bp, Homo sapiens
cagtgggaaatatt

SEQ ID NO: 4676570 - DNA, 18 bp, Homo sapiens
cagtgggaattgcagcat

SEQ ID NO: 4676571 - DNA, 16 bp, Homo sapiens
cagtgggactgtggtg

SEQ ID NO: 4676572 - DNA, 13 bp, Homo sapiens
cagtgggagctga

SEQ ID NO: 4676573 - DNA, 21 bp, Homo sapiens
cagtggggtcaagctgagctg

SEQ ID NO: 4676574 - DNA, 22 bp, Homo sapiens
cagtggggtcaagctgagctgg

SEQ ID NO: 4676575 - DNA, 14 bp, Homo sapiens
cagtggttgcctgg

SEQ ID NO: 4676576 - DNA, 15 bp, Homo sapiens
cagtggttgcctggg

SEQ ID NO: 4676577 - DNA, 17 bp, Homo sapiens
cagtgtaaatagttact

SEQ ID NO: 4676578 - DNA, 12 bp, Homo sapiens
cagtgtacagtc

SEQ ID NO: 4676579 - DNA, 15 bp, Homo sapiens
cagtgtacagtcttg

SEQ ID NO: 4676580 - DNA, 11 bp, Homo sapiens
cagtgtagaca

SEQ ID NO: 4676581 - DNA, 14 bp, Homo sapiens
cagtgtagacacag

SEQ ID NO: 4676582 - DNA, 17 bp, Homo sapiens
cagtgtagacacaggtc

SEQ ID NO: 4676583 - DNA, 22 bp, Homo sapiens
cagtgtagacacaggtcaccat

SEQ ID NO: 4676584 - DNA, 18 bp, Homo sapiens
cagtgtatggggctgcag

SEQ ID NO: 4676585 - DNA, 21 bp, Homo sapiens
cagtgtgaagtacaataattc

SEQ ID NO: 4676586 - DNA, 23 bp, Homo sapiens
cagtgtgaagtacaataattcat

SEQ ID NO: 4676587 - DNA, 15 bp, Homo sapiens
cagtgtttctgaatg

SEQ ID NO: 4676588 - DNA, 22 bp, Homo sapiens
cagttagagcccattaatcttg

SEQ ID NO: 4676589 - DNA, 16 bp, Homo sapiens
cagttcaactttcaga

SEQ ID NO: 4676590 - DNA, 20 bp, Homo sapiens
cagttcagagatcaggatca

SEQ ID NO: 4676591 - DNA, 22 bp, Homo sapiens
cagttccatttatgctggttaa

SEQ ID NO: 4676592 - DNA, 14 bp, Homo sapiens
cagttcgcagccac

SEQ ID NO: 4676593 - DNA, 19 bp, Homo sapiens
cagttcgcagccaccctga

SEQ ID NO: 4676594 - DNA, 21 bp, Homo sapiens
cagttctctactccctcttgt

SEQ ID NO: 4676595 - DNA, 14 bp, Homo sapiens
cagttctgaaagct

SEQ ID NO: 4676596 - DNA, 20 bp, Homo sapiens
cagttctgtgtggtgcattc

SEQ ID NO: 4676597 - DNA, 20 bp, Homo sapiens
cagttcttcatttggaggaa

SEQ ID NO: 4676598 - DNA, 14 bp, Homo sapiens
cagttgaattttaa

SEQ ID NO: 4676599 - DNA, 14 bp, Homo sapiens
cagttgctgtgaac

SEQ ID NO: 4676600 - DNA, 22 bp, Homo sapiens
cagttggatctctggttgtcta

SEQ ID NO: 4676601 - DNA, 15 bp, Homo sapiens
cagtttctgcctggg

SEQ ID NO: 4676602 - DNA, 18 bp, Homo sapiens
cagtttctgcctgggcaa

SEQ ID NO: 4676603 - DNA, 12 bp, Homo sapiens
cagtttgggaag

SEQ ID NO: 4676604 - DNA, 15 bp, Homo sapiens
cagttttttgtaact

SEQ ID NO: 4676605 - DNA, 22 bp, Homo sapiens
cataaaatcaaaacaagtgaaa

SEQ ID NO: 4676606 - DNA, 20 bp, Homo sapiens
cataaaatttaaaaacttaa

SEQ ID NO: 4676607 - DNA, 22 bp, Homo sapiens
cataaactttctccatttaaga

SEQ ID NO: 4676608 - DNA, 20 bp, Homo sapiens
cataaagccttttgctttat

SEQ ID NO: 4676609 - DNA, 11 bp, Homo sapiens
cacaaaggaag

SEQ ID NO: 4676610 - DNA, 13 bp, Homo sapiens
cacaaagtggcat

SEQ ID NO: 4676611 - DNA, 20 bp, Homo sapiens
cacaaatttcacttatacct

SEQ ID NO: 4676612 - DNA, 12 bp, Homo sapiens
cacaacacagat

SEQ ID NO: 4676613 - DNA, 21 bp, Homo sapiens
cacaactccttccatccttga

SEQ ID NO: 4676614 - DNA, 22 bp, Homo sapiens
cacaagcctgcctcgccttgtg

SEQ ID NO: 4676615 - DNA, 17 bp, Homo sapiens
cacaagctgcactgtga

SEQ ID NO: 4676616 - DNA, 15 bp, Homo sapiens
cacaagctgtccctg

SEQ ID NO: 4676617 - DNA, 16 bp, Homo sapiens
cacaagctgtccctgc

SEQ ID NO: 4676618 - DNA, 17 bp, Homo sapiens
cacaaggcagcaaggcc

SEQ ID NO: 4676619 - DNA, 18 bp, Homo sapiens
cacaaggcagcaaggccc

SEQ ID NO: 4676620 - DNA, 18 bp, Homo sapiens
cacaaggcctggtctggg

SEQ ID NO: 4676621 - DNA, 18 bp, Homo sapiens
cacaattcctgtgctcaa

SEQ ID NO: 4676622 - DNA, 13 bp, Homo sapiens
cacacacccatgt

SEQ ID NO: 4676623 - DNA, 22 bp, Homo sapiens
cacacacggttttggcagctga

SEQ ID NO: 4676624 - DNA, 18 bp, Homo sapiens
cacacaggcagccagccg

SEQ ID NO: 4676625 - DNA, 19 bp, Homo sapiens
cacacaggcagccagccgt

SEQ ID NO: 4676626 - DNA, 20 bp, Homo sapiens
cacacaggcatttcctgggt

SEQ ID NO: 4676627 - DNA, 20 bp, Homo sapiens
cacacatctgtaatcctagc

SEQ ID NO: 4676628 - DNA, 22 bp, Homo sapiens
cacaccaaggccctgcatctgt

SEQ ID NO: 4676629 - DNA, 23 bp, Homo sapiens
cacaccaaggccctgcatctgtc

SEQ ID NO: 4676630 - DNA, 21 bp, Homo sapiens
cacacccaccccctgcctggt

SEQ ID NO: 4676631 - DNA, 20 bp, Homo sapiens
cacacccatgtaaccactgc

SEQ ID NO: 4676632 - DNA, 21 bp, Homo sapiens
cacaccctgaggtcagggagt

SEQ ID NO: 4676633 - DNA, 12 bp, Homo sapiens
cacacctggcct

SEQ ID NO: 4676634 - DNA, 15 bp, Homo sapiens
cacacctggccttaa

SEQ ID NO: 4676635 - DNA, 22 bp, Homo sapiens
cacactcttcagtgactcctgc

SEQ ID NO: 4676636 - DNA, 16 bp, Homo sapiens
cacactgcagggagga

SEQ ID NO: 4676637 - DNA, 17 bp, Homo sapiens
cacacttcgctcttgag

SEQ ID NO: 4676638 - DNA, 23 bp, Homo sapiens
cacacttctcaggacacaggcct

SEQ ID NO: 4676639 - DNA, 16 bp, Homo sapiens
cacagaaaccaatttt

SEQ ID NO: 4676640 - DNA, 11 bp, Homo sapiens
cacagaacagg

SEQ ID NO: 4676641 - DNA, 20 bp, Homo sapiens
cacagacaactcacattgtt

SEQ ID NO: 4676642 - DNA, 15 bp, Homo sapiens
cacagacaagcagcc

SEQ ID NO: 4676643 - DNA, 19 bp, Homo sapiens
cacagacaagcagcccttg

SEQ ID NO: 4676644 - DNA, 16 bp, Homo sapiens
cacagacccctgggag

SEQ ID NO: 4676645 - DNA, 21 bp, Homo sapiens
cacagagaagtttgtagccag

SEQ ID NO: 4676646 - DNA, 23 bp, Homo sapiens
cacagaggtagtctcactgcttg

SEQ ID NO: 4676647 - DNA, 19 bp, Homo sapiens
cacagataattttttctta

SEQ ID NO: 4676648 - DNA, 20 bp, Homo sapiens
cacagatggctttcagggca

SEQ ID NO: 4676649 - DNA, 17 bp, Homo sapiens
cacagcaaccccaggct

SEQ ID NO: 4676650 - DNA, 12 bp, Homo sapiens
cacagcacagcc

SEQ ID NO: 4676651 - DNA, 12 bp, Homo sapiens
cacagcagcctg

SEQ ID NO: 4676652 - DNA, 20 bp, Homo sapiens
cacagccccacccttgtccc

SEQ ID NO: 4676653 - DNA, 22 bp, Homo sapiens
cacagccccacccttgtccctc

SEQ ID NO: 4676654 - DNA, 16 bp, Homo sapiens
cacagcctcacccctg

SEQ ID NO: 4676655 - DNA, 21 bp, Homo sapiens
cacagcctcacccctgcccct

SEQ ID NO: 4676656 - DNA, 11 bp, Homo sapiens
cacagccttcc

SEQ ID NO: 4676657 - DNA, 13 bp, Homo sapiens
cacagctcctgcc

SEQ ID NO: 4676658 - DNA, 18 bp, Homo sapiens
cacagctgagcacttagc

SEQ ID NO: 4676659 - DNA, 15 bp, Homo sapiens
cacagcttttcttga

SEQ ID NO: 4676660 - DNA, 17 bp, Homo sapiens
cacagcttttcttgata

SEQ ID NO: 4676661 - DNA, 23 bp, Homo sapiens
cacaggacatgcggtagccagca

SEQ ID NO: 4676662 - DNA, 14 bp, Homo sapiens
cacaggagctacct

SEQ ID NO: 4676663 - DNA, 15 bp, Homo sapiens
cacaggagctacctg

SEQ ID NO: 4676664 - DNA, 20 bp, Homo sapiens
cacctacagtgtacagtctt

SEQ ID NO: 4676665 - DNA, 15 bp, Homo sapiens
cacctagcagcctca

SEQ ID NO: 4676666 - DNA, 16 bp, Homo sapiens
cacctagcagcctcaa

SEQ ID NO: 4676667 - DNA, 18 bp, Homo sapiens
cacctcacaactccttcc

SEQ ID NO: 4676668 - DNA, 21 bp, Homo sapiens
cacctcactgaaaacatctgg

SEQ ID NO: 4676669 - DNA, 16 bp, Homo sapiens
cacctccagcctctgg

SEQ ID NO: 4676670 - DNA, 13 bp, Homo sapiens
cacctccaggcct

SEQ ID NO: 4676671 - DNA, 14 bp, Homo sapiens
cacctccaggcctg

SEQ ID NO: 4676672 - DNA, 11 bp, Homo sapiens
cacctcccatc

SEQ ID NO: 4676673 - DNA, 18 bp, Homo sapiens
cacctcctctgccagcag

SEQ ID NO: 4676674 - DNA, 16 bp, Homo sapiens
cacctccttccccagc

SEQ ID NO: 4676675 - DNA, 17 bp, Homo sapiens
cacctccttccccagct

SEQ ID NO: 4676676 - DNA, 18 bp, Homo sapiens
cacctccttccccagctc

SEQ ID NO: 4676677 - DNA, 23 bp, Homo sapiens
cacctcctttcaaggtaactgta

SEQ ID NO: 4676678 - DNA, 15 bp, Homo sapiens
cacctcgctgggctc

SEQ ID NO: 4676679 - DNA, 22 bp, Homo sapiens
cacctctgggaccccagctgct

SEQ ID NO: 4676680 - DNA, 23 bp, Homo sapiens
cacctctgggaccccagctgctc

SEQ ID NO: 4676681 - DNA, 15 bp, Homo sapiens
cacctgattcaacta

SEQ ID NO: 4676682 - DNA, 16 bp, Homo sapiens
cacctgattcaactaa

SEQ ID NO: 4676683 - DNA, 17 bp, Homo sapiens
cacctgattcaactaaa

SEQ ID NO: 4676684 - DNA, 19 bp, Homo sapiens
cacctgattcaactaaaaa

SEQ ID NO: 4676685 - DNA, 11 bp, Homo sapiens
cacctgcaaga

SEQ ID NO: 4676686 - DNA, 13 bp, Homo sapiens
cacctgcctcagg

SEQ ID NO: 4676687 - DNA, 20 bp, Homo sapiens
cacctgcgcaagtgcctggg

SEQ ID NO: 4676688 - DNA, 21 bp, Homo sapiens
cacctgctagtcgcccctcag

SEQ ID NO: 4676689 - DNA, 13 bp, Homo sapiens
cacctggccttaa

SEQ ID NO: 4676690 - DNA, 14 bp, Homo sapiens
cacctgggccctgg

SEQ ID NO: 4676691 - DNA, 18 bp, Homo sapiens
cacctgggccctggggcc

SEQ ID NO: 4676692 - DNA, 20 bp, Homo sapiens
cacctgtccccaccctccac

SEQ ID NO: 4676693 - DNA, 17 bp, Homo sapiens
caccttcactctccagg

SEQ ID NO: 4676694 - DNA, 17 bp, Homo sapiens
caccttcccttcctcag

SEQ ID NO: 4676695 - DNA, 18 bp, Homo sapiens
caccttcccttcctcagc

SEQ ID NO: 4676696 - DNA, 16 bp, Homo sapiens
cacgaagtgttgcatg

SEQ ID NO: 4676697 - DNA, 14 bp, Homo sapiens
cacgagccacaagc

SEQ ID NO: 4676698 - DNA, 20 bp, Homo sapiens
cacgaggctgattcctctca

SEQ ID NO: 4676699 - DNA, 23 bp, Homo sapiens
cacgaggctgattcctctcattt

SEQ ID NO: 4676700 - DNA, 17 bp, Homo sapiens
cacgagggccccgtggg

SEQ ID NO: 4676701 - DNA, 19 bp, Homo sapiens
cacggatgcgtgggcagag

SEQ ID NO: 4676702 - DNA, 14 bp, Homo sapiens
cacggccatgacca

SEQ ID NO: 4676703 - DNA, 20 bp, Homo sapiens
cacggccctccttcttttcc

SEQ ID NO: 4676704 - DNA, 14 bp, Homo sapiens
cacggtctgttctt

SEQ ID NO: 4676705 - DNA, 15 bp, Homo sapiens
cacggttatttaagc

SEQ ID NO: 4676706 - DNA, 17 bp, Homo sapiens
cacgtaatcctcctgag

SEQ ID NO: 4676707 - DNA, 15 bp, Homo sapiens
cacgtacaaaatcca

SEQ ID NO: 4676708 - DNA, 18 bp, Homo sapiens
cacgtagggggcaggggc

SEQ ID NO: 4676709 - DNA, 20 bp, Homo sapiens
cacgtagggggcaggggcag

SEQ ID NO: 4676710 - DNA, 21 bp, Homo sapiens
cacgtctggctccctgcccct

SEQ ID NO: 4676711 - DNA, 15 bp, Homo sapiens
cacgtgtcctgtagt

SEQ ID NO: 4676712 - DNA, 16 bp, Homo sapiens
cacgtgtcctgtagtt

SEQ ID NO: 4676713 - DNA, 20 bp, Homo sapiens
cactaaactttatttgtaaa

SEQ ID NO: 4676714 - DNA, 15 bp, Homo sapiens
cactaaccaaaaact

SEQ ID NO: 4676715 - DNA, 15 bp, Homo sapiens
cactaagagggcaga

SEQ ID NO: 4676716 - DNA, 20 bp, Homo sapiens
cactaagtttgcaacattta

SEQ ID NO: 4676717 - DNA, 19 bp, Homo sapiens
cactaatttttgtattatt

SEQ ID NO: 4676718 - DNA, 19 bp, Homo sapiens
cactactgcagcacctcca

SEQ ID NO: 4676719 - DNA, 12 bp, Homo sapiens
cactactgggtg

SEQ ID NO: 4676720 - DNA, 13 bp, Homo sapiens
cactactgggtgt

SEQ ID NO: 4676721 - DNA, 18 bp, Homo sapiens
cactagaatggataaaat

SEQ ID NO: 4676722 - DNA, 20 bp, Homo sapiens
cactatatgatcagtgttac

SEQ ID NO: 4676723 - DNA, 22 bp, Homo sapiens
cactcaaaggccagacctgcag

SEQ ID NO: 4676724 - DNA, 22 bp, Homo sapiens
cactcagaagcctgggggcctg

SEQ ID NO: 4676725 - DNA, 13 bp, Homo sapiens
cactcagcacaag

SEQ ID NO: 4676726 - DNA, 16 bp, Homo sapiens
cactcagtttatgctg

SEQ ID NO: 4676727 - DNA, 19 bp, Homo sapiens
cactccaagatatggacac

SEQ ID NO: 4676728 - DNA, 15 bp, Homo sapiens
cactccaccctccac

SEQ ID NO: 4676729 - DNA, 18 bp, Homo sapiens
cactccaccctccacctt

SEQ ID NO: 4676730 - DNA, 21 bp, Homo sapiens
cactccaccctccaccttcca

SEQ ID NO: 4676731 - DNA, 16 bp, Homo sapiens
cactccagttgcagac

SEQ ID NO: 4676732 - DNA, 18 bp, Homo sapiens
cactccccagagctgtgc

SEQ ID NO: 4676733 - DNA, 15 bp, Homo sapiens
cactccgccagccac

SEQ ID NO: 4676734 - DNA, 16 bp, Homo sapiens
cactcctgctgtaaat

SEQ ID NO: 4676735 - DNA, 17 bp, Homo sapiens
cactccttcctgcccca

SEQ ID NO: 4676736 - DNA, 14 bp, Homo sapiens
cactccttgtcccc

SEQ ID NO: 4676737 - DNA, 19 bp, Homo sapiens
cactcgtcaccccagccct

SEQ ID NO: 4676738 - DNA, 21 bp, Homo sapiens
cactcgtcaccccagccctcg

SEQ ID NO: 4676739 - DNA, 16 bp, Homo sapiens
cactctcttctccatt

SEQ ID NO: 4676740 - DNA, 18 bp, Homo sapiens
cactctgacaagctggcc

SEQ ID NO: 4676741 - DNA, 16 bp, Homo sapiens
cactctgctctgatgc

SEQ ID NO: 4676742 - DNA, 13 bp, Homo sapiens
cactctggcagcc

SEQ ID NO: 4676743 - DNA, 14 bp, Homo sapiens
cactctggcagcca

SEQ ID NO: 4676744 - DNA, 19 bp, Homo sapiens
cactctgtagtcaaaaaag

SEQ ID NO: 4676745 - DNA, 22 bp, Homo sapiens
cactcttcagtgactcctgctg

SEQ ID NO: 4676746 - DNA, 13 bp, Homo sapiens
cactcttctcagc

SEQ ID NO: 4676747 - DNA, 17 bp, Homo sapiens
cactcttctcttgagca

SEQ ID NO: 4676748 - DNA, 17 bp, Homo sapiens
cactcttgtcacccagg

SEQ ID NO: 4676749 - DNA, 22 bp, Homo sapiens
cactcttgtcacccaggctgga

SEQ ID NO: 4676750 - DNA, 23 bp, Homo sapiens
cactcttgtcacccaggctggag

SEQ ID NO: 4676751 - DNA, 16 bp, Homo sapiens
cactcttttgctgtgc

SEQ ID NO: 4676752 - DNA, 18 bp, Homo sapiens
cactgaaaatagtgttcc

SEQ ID NO: 4676753 - DNA, 16 bp, Homo sapiens
cactgaaatatgtgaa

SEQ ID NO: 4676754 - DNA, 16 bp, Homo sapiens
cactgcaacctctgcc

SEQ ID NO: 4676755 - DNA, 16 bp, Homo sapiens
cactgcactccagcct

SEQ ID NO: 4676756 - DNA, 15 bp, Homo sapiens
cactgcagggaggag

SEQ ID NO: 4676757 - DNA, 17 bp, Homo sapiens
cactgcattatcttgct

SEQ ID NO: 4676758 - DNA, 18 bp, Homo sapiens
cactgcattattctcttt

SEQ ID NO: 4676759 - DNA, 15 bp, Homo sapiens
cactgccaggaggga

SEQ ID NO: 4676760 - DNA, 17 bp, Homo sapiens
cactgccaggagggaca

SEQ ID NO: 4676761 - DNA, 16 bp, Homo sapiens
cactgcctctcacagc

SEQ ID NO: 4676762 - DNA, 17 bp, Homo sapiens
cactgcctctcacagct

SEQ ID NO: 4676763 - DNA, 17 bp, Homo sapiens
cactgcttgaactaggc

SEQ ID NO: 4676764 - DNA, 19 bp, Homo sapiens
cactggaggagagaagaat

SEQ ID NO: 4676765 - DNA, 23 bp, Homo sapiens
cactggggactttatttatttct

SEQ ID NO: 4676766 - DNA, 20 bp, Homo sapiens
cactgtacaaggtacccctt

SEQ ID NO: 4676767 - DNA, 19 bp, Homo sapiens
cactgtgacccccagctcc

SEQ ID NO: 4676768 - DNA, 14 bp, Homo sapiens
cactgtgcacttag

SEQ ID NO: 4676769 - DNA, 12 bp, Homo sapiens
cactgtggcctt

SEQ ID NO: 4676770 - DNA, 16 bp, Homo sapiens
cactgtgttactgctt

SEQ ID NO: 4676771 - DNA, 20 bp, Homo sapiens
cactgtgttactgctttgca

SEQ ID NO: 4676772 - DNA, 14 bp, Homo sapiens
cactgttcaatact

SEQ ID NO: 4676773 - DNA, 17 bp, Homo sapiens
cactgtttcatctcagc

SEQ ID NO: 4676774 - DNA, 19 bp, Homo sapiens
cactgtttcatctcagctt

SEQ ID NO: 4676775 - DNA, 20 bp, Homo sapiens
cactgtttcatctcagcttt

SEQ ID NO: 4676776 - DNA, 19 bp, Homo sapiens
cactgttttataattagtc

SEQ ID NO: 4676777 - DNA, 17 bp, Homo sapiens
cacttaatcttctctct

SEQ ID NO: 4676778 - DNA, 16 bp, Homo sapiens
cacttaatttgtaaac

SEQ ID NO: 4676779 - DNA, 16 bp, Homo sapiens
cacttagacctgccag

SEQ ID NO: 4676780 - DNA, 21 bp, Homo sapiens
cacttagcaggcaccgccacg

SEQ ID NO: 4676781 - DNA, 22 bp, Homo sapiens
cacttagccatgatggcaacag

SEQ ID NO: 4676782 - DNA, 20 bp, Homo sapiens
cacttatttatgaacctgcc

SEQ ID NO: 4676783 - DNA, 14 bp, Homo sapiens
cacttcaaagctaa

SEQ ID NO: 4676784 - DNA, 18 bp, Homo sapiens
cacttccacctccagcct

SEQ ID NO: 4676785 - DNA, 16 bp, Homo sapiens
cacttcgctcttgagg

SEQ ID NO: 4676786 - DNA, 15 bp, Homo sapiens
cacttctcaggacac

SEQ ID NO: 4676787 - DNA, 19 bp, Homo sapiens
cacttctcaggacacaggc

SEQ ID NO: 4676788 - DNA, 17 bp, Homo sapiens
cacttcttaaatacaat

SEQ ID NO: 4676789 - DNA, 17 bp, Homo sapiens
cacttgaaattctttca

SEQ ID NO: 4676790 - DNA, 14 bp, Homo sapiens
cacttgccctgtgt

SEQ ID NO: 4676791 - DNA, 22 bp, Homo sapiens
cacttgctgctttttctgcgct

SEQ ID NO: 4676792 - DNA, 14 bp, Homo sapiens
cacttgtccagctg

SEQ ID NO: 4676793 - DNA, 19 bp, Homo sapiens
cacttgtcccactatctgg

SEQ ID NO: 4676794 - DNA, 23 bp, Homo sapiens
cactttattgccttttaattttt

SEQ ID NO: 4676795 - DNA, 23 bp, Homo sapiens
cactttcagagcccccagccctg

SEQ ID NO: 4676796 - DNA, 24 bp, Homo sapiens
cactttcagagcccccagccctgg

SEQ ID NO: 4676797 - DNA, 15 bp, Homo sapiens
cactttcctttcaat

SEQ ID NO: 4676798 - DNA, 19 bp, Homo sapiens
cactttcctttcaataaag

SEQ ID NO: 4676799 - DNA, 20 bp, Homo sapiens
cactttgccatttgcttgta

SEQ ID NO: 4676800 - DNA, 20 bp, Homo sapiens
cactttgttagaaagtgctt

SEQ ID NO: 4676801 - DNA, 15 bp, Homo sapiens
cacttttagaaatgc

SEQ ID NO: 4676802 - DNA, 16 bp, Homo sapiens
cacttttatgagcttc

SEQ ID NO: 4676803 - DNA, 19 bp, Homo sapiens
cagaaaattggcagtggca

SEQ ID NO: 4676804 - DNA, 23 bp, Homo sapiens
cagaaaattggcagtggcagaga

SEQ ID NO: 4676805 - DNA, 14 bp, Homo sapiens
cagaaaccaagaga

SEQ ID NO: 4676806 - DNA, 21 bp, Homo sapiens
cagaaagaccctgatgcaggt

SEQ ID NO: 4676807 - DNA, 21 bp, Homo sapiens
cagaaagatttgatgggccac

SEQ ID NO: 4676808 - DNA, 23 bp, Homo sapiens
cagaaagccaggagcagccctgg

SEQ ID NO: 4676809 - DNA, 14 bp, Homo sapiens
cagaaaggctctga

SEQ ID NO: 4676810 - DNA, 15 bp, Homo sapiens
cagaaagggagggct

SEQ ID NO: 4676811 - DNA, 19 bp, Homo sapiens
cagaaagggagggctctga

SEQ ID NO: 4676812 - DNA, 21 bp, Homo sapiens
cagaaagggagggctctgagg

SEQ ID NO: 4676813 - DNA, 23 bp, Homo sapiens
cagaaagggagggctctgaggcg

SEQ ID NO: 4676814 - DNA, 16 bp, Homo sapiens
cagaaagtcccccctc

SEQ ID NO: 4676815 - DNA, 21 bp, Homo sapiens
cagaaatagttgtctgtgctt

SEQ ID NO: 4676816 - DNA, 17 bp, Homo sapiens
cagaacaggaggtgtga

SEQ ID NO: 4676817 - DNA, 19 bp, Homo sapiens
cagaacaggaggtgtgaat

SEQ ID NO: 4676818 - DNA, 20 bp, Homo sapiens
cagaacaggaggtgtgaatg

SEQ ID NO: 4676819 - DNA, 21 bp, Homo sapiens
cagaacattcagctctggaga

SEQ ID NO: 4676820 - DNA, 15 bp, Homo sapiens
cagaaccacaaacaa

SEQ ID NO: 4676821 - DNA, 17 bp, Homo sapiens
cagaaccttgttatttc

SEQ ID NO: 4676822 - DNA, 18 bp, Homo sapiens
cagaaccttgttatttct

SEQ ID NO: 4676823 - DNA, 15 bp, Homo sapiens
cagaacgtggctctg

SEQ ID NO: 4676824 - DNA, 22 bp, Homo sapiens
cagaacgtggtttgcctgaggc

SEQ ID NO: 4676825 - DNA, 23 bp, Homo sapiens
cagaacttcaagatgagcctggg

SEQ ID NO: 4676826 - DNA, 16 bp, Homo sapiens
cagaacttgaagggtt

SEQ ID NO: 4676827 - DNA, 12 bp, Homo sapiens
cagaagacggga

SEQ ID NO: 4676828 - DNA, 24 bp, Homo sapiens
cagaagcctgggggcctggctggc

SEQ ID NO: 4676829 - DNA, 16 bp, Homo sapiens
cagaagcttctgccca

SEQ ID NO: 4676830 - DNA, 20 bp, Homo sapiens
cagaagcttggaggagggtt

SEQ ID NO: 4676831 - DNA, 14 bp, Homo sapiens
cagaaggaaagaag

SEQ ID NO: 4676832 - DNA, 22 bp, Homo sapiens
cagaaggagaaggctggagaag

SEQ ID NO: 4676833 - DNA, 15 bp, Homo sapiens
cagaataggaagata

SEQ ID NO: 4676834 - DNA, 13 bp, Homo sapiens
cagaatgaagcca

SEQ ID NO: 4676835 - DNA, 18 bp, Homo sapiens
cagaatgttgtacttgaa

SEQ ID NO: 4676836 - DNA, 20 bp, Homo sapiens
cagaattatacagacctaat

SEQ ID NO: 4676837 - DNA, 16 bp, Homo sapiens
cagaattgcacatcta

SEQ ID NO: 4676838 - DNA, 13 bp, Homo sapiens
cagacaagacaga

SEQ ID NO: 4676839 - DNA, 15 bp, Homo sapiens
cagacaagacagagg

SEQ ID NO: 4676840 - DNA, 18 bp, Homo sapiens
cagacaagacagagggga

SEQ ID NO: 4676841 - DNA, 17 bp, Homo sapiens
cagacacatgctatgtt

SEQ ID NO: 4676842 - DNA, 19 bp, Homo sapiens
cagacacgagccacctcac

SEQ ID NO: 4676843 - DNA, 17 bp, Homo sapiens
cagacagaagtctcctc

SEQ ID NO: 4676844 - DNA, 15 bp, Homo sapiens
cagacagcaggcagc

SEQ ID NO: 4676845 - DNA, 16 bp, Homo sapiens
cagacagcaggcagcg

SEQ ID NO: 4676846 - DNA, 17 bp, Homo sapiens
cagacagcaggcagcgc

SEQ ID NO: 4676847 - DNA, 19 bp, Homo sapiens
cagacaggctacaaagcag

SEQ ID NO: 4676848 - DNA, 11 bp, Homo sapiens
cagacataaag

SEQ ID NO: 4676849 - DNA, 18 bp, Homo sapiens
cagacatatgggatattc

SEQ ID NO: 4676850 - DNA, 12 bp, Homo sapiens
cagacatttata

SEQ ID NO: 4676851 - DNA, 13 bp, Homo sapiens
cagaccacggctc

SEQ ID NO: 4676852 - DNA, 16 bp, Homo sapiens
cagaccagccctgcag

SEQ ID NO: 4676853 - DNA, 20 bp, Homo sapiens
cagacccctgggagcttccg

SEQ ID NO: 4676854 - DNA, 15 bp, Homo sapiens
cagacctaatatcat

SEQ ID NO: 4676855 - DNA, 16 bp, Homo sapiens
cagacctaatatcatt

SEQ ID NO: 4676856 - DNA, 20 bp, Homo sapiens
cagacctgcagacgcccaga

SEQ ID NO: 4676857 - DNA, 13 bp, Homo sapiens
cagacctgcatgg

SEQ ID NO: 4676858 - DNA, 23 bp, Homo sapiens
cagacctgcatggtcaagcctct

SEQ ID NO: 4676859 - DNA, 19 bp, Homo sapiens
cagacgagacaacagcaca

SEQ ID NO: 4676860 - DNA, 22 bp, Homo sapiens
cagacgttaggcatttcctgct

SEQ ID NO: 4676861 - DNA, 23 bp, Homo sapiens
cagacgttaggcatttcctgctg

SEQ ID NO: 4676862 - DNA, 19 bp, Homo sapiens
cagactactattttctttt

SEQ ID NO: 4676863 - DNA, 20 bp, Homo sapiens
cagactactattttcttttt

SEQ ID NO: 4676864 - DNA, 14 bp, Homo sapiens
cagactcccttgct

SEQ ID NO: 4676865 - DNA, 19 bp, Homo sapiens
cagactctttaataaattg

SEQ ID NO: 4676866 - DNA, 23 bp, Homo sapiens
cagactctttaataaattgctta

SEQ ID NO: 4676867 - DNA, 13 bp, Homo sapiens
cagactgaccttg

SEQ ID NO: 4676868 - DNA, 19 bp, Homo sapiens
cagactgtagcttctcttg

SEQ ID NO: 4676869 - DNA, 16 bp, Homo sapiens
cagactgttgtccctg

SEQ ID NO: 4676870 - DNA, 17 bp, Homo sapiens
cagacttgcccaggtca

SEQ ID NO: 4676871 - DNA, 17 bp, Homo sapiens
cagagaaagcgcagatg

SEQ ID NO: 4676872 - DNA, 23 bp, Homo sapiens
cagagaacagaactggaggcagt

SEQ ID NO: 4676873 - DNA, 11 bp, Homo sapiens
cagagaacagc

SEQ ID NO: 4676874 - DNA, 24 bp, Homo sapiens
cagagaacagcgaagtagcttgct

SEQ ID NO: 4676875 - DNA, 22 bp, Homo sapiens
cagagagaatgagagcgacaca

SEQ ID NO: 4676876 - DNA, 16 bp, Homo sapiens
cagagatcaggatcag

SEQ ID NO: 4676877 - DNA, 19 bp, Homo sapiens
cagagatcaggatcagctt

SEQ ID NO: 4676878 - DNA, 21 bp, Homo sapiens
cagagatcaggatcagctttg

SEQ ID NO: 4676879 - DNA, 20 bp, Homo sapiens
cagagatcgacagacagcca

SEQ ID NO: 4676880 - DNA, 21 bp, Homo sapiens
cagagatcgacagacagccag

SEQ ID NO: 4676881 - DNA, 18 bp, Homo sapiens
cagagcaagaccctgcct

SEQ ID NO: 4676882 - DNA, 20 bp, Homo sapiens
caaggacagttcagagatca

SEQ ID NO: 4676883 - DNA, 12 bp, Homo sapiens
caaggactgagg

SEQ ID NO: 4676884 - DNA, 19 bp, Homo sapiens
caaggagggggcctcattg

SEQ ID NO: 4676885 - DNA, 20 bp, Homo sapiens
caaggagggggcctcattgt

SEQ ID NO: 4676886 - DNA, 16 bp, Homo sapiens
caaggcagcaaggccc

SEQ ID NO: 4676887 - DNA, 19 bp, Homo sapiens
caaggcagcaaggcccgag

SEQ ID NO: 4676888 - DNA, 14 bp, Homo sapiens
caaggccatctggg

SEQ ID NO: 4676889 - DNA, 17 bp, Homo sapiens
caaggccatctgggctc

SEQ ID NO: 4676890 - DNA, 13 bp, Homo sapiens
caaggcccgagca

SEQ ID NO: 4676891 - DNA, 16 bp, Homo sapiens
caaggcccgagcagct

SEQ ID NO: 4676892 - DNA, 18 bp, Homo sapiens
caaggcccgagcagctga

SEQ ID NO: 4676893 - DNA, 20 bp, Homo sapiens
caaggcccgagcagctgagc

SEQ ID NO: 4676894 - DNA, 15 bp, Homo sapiens
caaggccctgtctct

SEQ ID NO: 4676895 - DNA, 13 bp, Homo sapiens
caaggccttcagt

SEQ ID NO: 4676896 - DNA, 22 bp, Homo sapiens
caaggccttcagtttatttcca

SEQ ID NO: 4676897 - DNA, 14 bp, Homo sapiens
caaggcggtacact

SEQ ID NO: 4676898 - DNA, 18 bp, Homo sapiens
caagggaagcctgcctgg

SEQ ID NO: 4676899 - DNA, 18 bp, Homo sapiens
caagggaggggtggtatt

SEQ ID NO: 4676900 - DNA, 20 bp, Homo sapiens
caagggcactgtgatacagt

SEQ ID NO: 4676901 - DNA, 21 bp, Homo sapiens
caagggcactgtgatacagtt

SEQ ID NO: 4676902 - DNA, 12 bp, Homo sapiens
caagggccctgg

SEQ ID NO: 4676903 - DNA, 18 bp, Homo sapiens
caagggccctggcacccc

SEQ ID NO: 4676904 - DNA, 16 bp, Homo sapiens
caaggtaactgtactg

SEQ ID NO: 4676905 - DNA, 19 bp, Homo sapiens
caaggtcagaacaggtttt

SEQ ID NO: 4676906 - DNA, 15 bp, Homo sapiens
caaggttgtcagctt

SEQ ID NO: 4676907 - DNA, 20 bp, Homo sapiens
caagtaatggaggtcccagc

SEQ ID NO: 4676908 - DNA, 23 bp, Homo sapiens
caagtaatggaggtcccagccct

SEQ ID NO: 4676909 - DNA, 15 bp, Homo sapiens
caagtatttattccc

SEQ ID NO: 4676910 - DNA, 18 bp, Homo sapiens
caagtccaataagacact

SEQ ID NO: 4676911 - DNA, 24 bp, Homo sapiens
caagtcctttatctgcacctagaa

SEQ ID NO: 4676912 - DNA, 17 bp, Homo sapiens
caagtctgcacagagca

SEQ ID NO: 4676913 - DNA, 19 bp, Homo sapiens
caagtctttctcctctttg

SEQ ID NO: 4676914 - DNA, 16 bp, Homo sapiens
caagtgccaaatgctc

SEQ ID NO: 4676915 - DNA, 19 bp, Homo sapiens
caagtgcttaaaaatactt

SEQ ID NO: 4676916 - DNA, 23 bp, Homo sapiens
caagtgcttaaaaatacttctat

SEQ ID NO: 4676917 - DNA, 15 bp, Homo sapiens
caagtggactcaggg

SEQ ID NO: 4676918 - DNA, 14 bp, Homo sapiens
caagtggatgtttt

SEQ ID NO: 4676919 - DNA, 14 bp, Homo sapiens
caagtgtcacctcc

SEQ ID NO: 4676920 - DNA, 20 bp, Homo sapiens
caagtgtcacctccttcccc

SEQ ID NO: 4676921 - DNA, 21 bp, Homo sapiens
caagttagaaaattcagctcc

SEQ ID NO: 4676922 - DNA, 18 bp, Homo sapiens
caataaaatttttttaaa

SEQ ID NO: 4676923 - DNA, 13 bp, Homo sapiens
caataaagaagag

SEQ ID NO: 4676924 - DNA, 10 bp, Homo sapiens
caataaagtt

SEQ ID NO: 4676925 - DNA, 17 bp, Homo sapiens
caataaagttgttgcat

SEQ ID NO: 4676926 - DNA, 19 bp, Homo sapiens
caataaagttgttgcattc

SEQ ID NO: 4676927 - DNA, 14 bp, Homo sapiens
caataaatgtctgt

SEQ ID NO: 4676928 - DNA, 16 bp, Homo sapiens
caataacccagttact

SEQ ID NO: 4676929 - DNA, 17 bp, Homo sapiens
caataacccagttactt

SEQ ID NO: 4676930 - DNA, 21 bp, Homo sapiens
caataagcgttaagggcagag

SEQ ID NO: 4676931 - DNA, 16 bp, Homo sapiens
caataattcatattct

SEQ ID NO: 4676932 - DNA, 19 bp, Homo sapiens
caataattcatattcttca

SEQ ID NO: 4676933 - DNA, 14 bp, Homo sapiens
caatacaaagatga

SEQ ID NO: 4676934 - DNA, 23 bp, Homo sapiens
caatacagtgaaggtctttgtta

SEQ ID NO: 4676935 - DNA, 14 bp, Homo sapiens
caatacattaaaat

SEQ ID NO: 4676936 - DNA, 18 bp, Homo sapiens
caatactgtatgccttct

SEQ ID NO: 4676937 - DNA, 21 bp, Homo sapiens
caatagctagctatatatggt

SEQ ID NO: 4676938 - DNA, 22 bp, Homo sapiens
caatatagaaaaataaaaatct

SEQ ID NO: 4676939 - DNA, 19 bp, Homo sapiens
caatatgaatctataagta

SEQ ID NO: 4676940 - DNA, 22 bp, Homo sapiens
caaagaggctgaggctggcaca

SEQ ID NO: 4676941 - DNA, 12 bp, Homo sapiens
caaagcagacag

SEQ ID NO: 4676942 - DNA, 13 bp, Homo sapiens
caaagcagccacg

SEQ ID NO: 4676943 - DNA, 14 bp, Homo sapiens
caaagccaaacaaa

SEQ ID NO: 4676944 - DNA, 14 bp, Homo sapiens
caaagccagggtct

SEQ ID NO: 4676945 - DNA, 22 bp, Homo sapiens
caaagccagggtctctccctca

SEQ ID NO: 4676946 - DNA, 22 bp, Homo sapiens
caaagcctgttcatggcagatg

SEQ ID NO: 4676947 - DNA, 20 bp, Homo sapiens
caaagctaaaaaattgttaa

SEQ ID NO: 4676948 - DNA, 13 bp, Homo sapiens
caaaggagcctgt

SEQ ID NO: 4676949 - DNA, 21 bp, Homo sapiens
caaagggtgaagctatttatc

SEQ ID NO: 4676950 - DNA, 21 bp, Homo sapiens
caaagtaacctgggcttaagt

SEQ ID NO: 4676951 - DNA, 14 bp, Homo sapiens
caaagtactcttta

SEQ ID NO: 4676952 - DNA, 21 bp, Homo sapiens
caaagtcacttccccaagatc

SEQ ID NO: 4676953 - DNA, 19 bp, Homo sapiens
caaagtgctttgacttctt

SEQ ID NO: 4676954 - DNA, 13 bp, Homo sapiens
caaagtgtctcat

SEQ ID NO: 4676955 - DNA, 19 bp, Homo sapiens
caaagttaatgggatggtc

SEQ ID NO: 4676956 - DNA, 19 bp, Homo sapiens
caaagttatattcacagtt

SEQ ID NO: 4676957 - DNA, 23 bp, Homo sapiens
caaagttgctcaccgactcacct

SEQ ID NO: 4676958 - DNA, 15 bp, Homo sapiens
caaataaaatatcat

SEQ ID NO: 4676959 - DNA, 16 bp, Homo sapiens
caaataaaatatcata

SEQ ID NO: 4676960 - DNA, 12 bp, Homo sapiens
caaataaatgtt

SEQ ID NO: 4676961 - DNA, 13 bp, Homo sapiens
caaatacatgtgt

SEQ ID NO: 4676962 - DNA, 22 bp, Homo sapiens
caaatacatgtgtatattcctt

SEQ ID NO: 4676963 - DNA, 16 bp, Homo sapiens
caaatacccaccaggg

SEQ ID NO: 4676964 - DNA, 17 bp, Homo sapiens
caaatatacattttcta

SEQ ID NO: 4676965 - DNA, 19 bp, Homo sapiens
caaatatacattttctaaa

SEQ ID NO: 4676966 - DNA, 12 bp, Homo sapiens
caaatatagaaa

SEQ ID NO: 4676967 - DNA, 23 bp, Homo sapiens
caaatatgagtacaaatgcctta

SEQ ID NO: 4676968 - DNA, 21 bp, Homo sapiens
caaatccgaacctcctctgtg

SEQ ID NO: 4676969 - DNA, 14 bp, Homo sapiens
caaatgaagaaagt

SEQ ID NO: 4676970 - DNA, 16 bp, Homo sapiens
caaatgaagaaagtca

SEQ ID NO: 4676971 - DNA, 22 bp, Homo sapiens
caaatgaagaaagtcaaaaaat

SEQ ID NO: 4676972 - DNA, 22 bp, Homo sapiens
caaatggttcttacttttcctg

SEQ ID NO: 4676973 - DNA, 23 bp, Homo sapiens
caaatggttcttacttttcctgg

SEQ ID NO: 4676974 - DNA, 15 bp, Homo sapiens
caaattaaaacaaat

SEQ ID NO: 4676975 - DNA, 19 bp, Homo sapiens
caaattaaaacaaatatac

SEQ ID NO: 4676976 - DNA, 21 bp, Homo sapiens
caaattaaaacaaatatacat

SEQ ID NO: 4676977 - DNA, 21 bp, Homo sapiens
caaattaaaacatatttcatt

SEQ ID NO: 4676978 - DNA, 21 bp, Homo sapiens
caaattcaagagctagaaaaa

SEQ ID NO: 4676979 - DNA, 22 bp, Homo sapiens
caaattcaagagctagaaaaat

SEQ ID NO: 4676980 - DNA, 15 bp, Homo sapiens
caaattcatttttaa

SEQ ID NO: 4676981 - DNA, 17 bp, Homo sapiens
caaattgtcgtttttat

SEQ ID NO: 4676982 - DNA, 13 bp, Homo sapiens
caaatttcattgc

SEQ ID NO: 4676983 - DNA, 15 bp, Homo sapiens
caaatttcattgcac

SEQ ID NO: 4676984 - DNA, 18 bp, Homo sapiens
caaatttcattgcacttt

SEQ ID NO: 4676985 - DNA, 21 bp, Homo sapiens
caaatttcattgcactttcct

SEQ ID NO: 4676986 - DNA, 21 bp, Homo sapiens
caaatttctataaatttaaga

SEQ ID NO: 4676987 - DNA, 22 bp, Homo sapiens
attttatgtattctttctgcct

SEQ ID NO: 4676988 - DNA, 19 bp, Homo sapiens
attttattttggcttcatt

SEQ ID NO: 4676989 - DNA, 15 bp, Homo sapiens
attttatttttctgt

SEQ ID NO: 4676990 - DNA, 22 bp, Homo sapiens
attttcaaaagcattaattttt

SEQ ID NO: 4676991 - DNA, 18 bp, Homo sapiens
attttcaacaacatcaga

SEQ ID NO: 4676992 - DNA, 22 bp, Homo sapiens
attttcaaccataaaagaagtt

SEQ ID NO: 4676993 - DNA, 13 bp, Homo sapiens
attttcaaggcct

SEQ ID NO: 4676994 - DNA, 23 bp, Homo sapiens
attttcaataacaaaacgaaact

SEQ ID NO: 4676995 - DNA, 15 bp, Homo sapiens
attttcagatgaaat

SEQ ID NO: 4676996 - DNA, 12 bp, Homo sapiens
attttcagcatt

SEQ ID NO: 4676997 - DNA, 19 bp, Homo sapiens
attttcagcattaagctgt

SEQ ID NO: 4676998 - DNA, 20 bp, Homo sapiens
attttcagcattaagctgtt

SEQ ID NO: 4676999 - DNA, 16 bp, Homo sapiens
attttcagtaccaaag

SEQ ID NO: 4677000 - DNA, 20 bp, Homo sapiens
attttcagtaccaaagaaac

SEQ ID NO: 4677001 - DNA, 21 bp, Homo sapiens
attttcataatcagtaaatag

SEQ ID NO: 4677002 - DNA, 21 bp, Homo sapiens
attttcccccactactgcagc

SEQ ID NO: 4677003 - DNA, 15 bp, Homo sapiens
attttcctcttgtga

SEQ ID NO: 4677004 - DNA, 16 bp, Homo sapiens
attttccttccatgct

SEQ ID NO: 4677005 - DNA, 22 bp, Homo sapiens
attttccttccatgctcccaac

SEQ ID NO: 4677006 - DNA, 23 bp, Homo sapiens
attttctaagtcgtgcactttct

SEQ ID NO: 4677007 - DNA, 16 bp, Homo sapiens
attttctattttaaga

SEQ ID NO: 4677008 - DNA, 16 bp, Homo sapiens
attttctctgtacttt

SEQ ID NO: 4677009 - DNA, 15 bp, Homo sapiens
attttcttactttta

SEQ ID NO: 4677010 - DNA, 18 bp, Homo sapiens
attttcttttgaattgtt

SEQ ID NO: 4677011 - DNA, 14 bp, Homo sapiens
attttgagaaaaat

SEQ ID NO: 4677012 - DNA, 13 bp, Homo sapiens
attttgaggttta

SEQ ID NO: 4677013 - DNA, 17 bp, Homo sapiens
attttgaggtttagcaa

SEQ ID NO: 4677014 - DNA, 15 bp, Homo sapiens
attttgcataataaa

SEQ ID NO: 4677015 - DNA, 18 bp, Homo sapiens
attttgcatactgaaaat

SEQ ID NO: 4677016 - DNA, 17 bp, Homo sapiens
attttgccgctgagata

SEQ ID NO: 4677017 - DNA, 20 bp, Homo sapiens
attttgctgtagaagatggc

SEQ ID NO: 4677018 - DNA, 14 bp, Homo sapiens
attttggaactgtg

SEQ ID NO: 4677019 - DNA, 19 bp, Homo sapiens
attttggaactgtgtttca

SEQ ID NO: 4677020 - DNA, 19 bp, Homo sapiens
attttggggggttatttat

SEQ ID NO: 4677021 - DNA, 21 bp, Homo sapiens
attttgtcacattatttatta

SEQ ID NO: 4677022 - DNA, 14 bp, Homo sapiens
attttgttcttatt

SEQ ID NO: 4677023 - DNA, 16 bp, Homo sapiens
attttgttttgttgga

SEQ ID NO: 4677024 - DNA, 18 bp, Homo sapiens
atttttaaaaaatatttt

SEQ ID NO: 4677025 - DNA, 19 bp, Homo sapiens
atttttaaaaaatattttc

SEQ ID NO: 4677026 - DNA, 16 bp, Homo sapiens
atttttaaaaaatgaa

SEQ ID NO: 4677027 - DNA, 15 bp, Homo sapiens
atttttaaagtttaa

SEQ ID NO: 4677028 - DNA, 19 bp, Homo sapiens
atttttaagaaaggaagca

SEQ ID NO: 4677029 - DNA, 20 bp, Homo sapiens
atttttagccataattttgc

SEQ ID NO: 4677030 - DNA, 22 bp, Homo sapiens
atttttatatcatgcaaaatat

SEQ ID NO: 4677031 - DNA, 19 bp, Homo sapiens
atttttattttttagtgca

SEQ ID NO: 4677032 - DNA, 13 bp, Homo sapiens
ttgtttctttgtg

SEQ ID NO: 4677033 - DNA, 13 bp, Homo sapiens
ttgtttcttttaa

SEQ ID NO: 4677034 - DNA, 17 bp, Homo sapiens
ttgtttgtagctttcct

SEQ ID NO: 4677035 - DNA, 20 bp, Homo sapiens
ttgtttgtagctttcctgga

SEQ ID NO: 4677036 - DNA, 13 bp, Homo sapiens
ttgtttgtttctt

SEQ ID NO: 4677037 - DNA, 14 bp, Homo sapiens
ttgttttgcacttt

SEQ ID NO: 4677038 - DNA, 15 bp, Homo sapiens
ttgttttgcactttt

SEQ ID NO: 4677039 - DNA, 19 bp, Homo sapiens
tttaaaaaaaaatcttgtg

SEQ ID NO: 4677040 - DNA, 20 bp, Homo sapiens
tttaaaaaaaaatcttgtgt

SEQ ID NO: 4677041 - DNA, 16 bp, Homo sapiens
tttaaaaacttaaata

SEQ ID NO: 4677042 - DNA, 22 bp, Homo sapiens
tttaaaagttttgaaggaaacc

SEQ ID NO: 4677043 - DNA, 16 bp, Homo sapiens
tttaaaataaaatgaa

SEQ ID NO: 4677044 - DNA, 17 bp, Homo sapiens
tttaaaataaaatgaaa

SEQ ID NO: 4677045 - DNA, 17 bp, Homo sapiens
tttaaaatccattttag

SEQ ID NO: 4677046 - DNA, 16 bp, Homo sapiens
tttaaagaagctttat

SEQ ID NO: 4677047 - DNA, 17 bp, Homo sapiens
tttaaagaagctttatc

SEQ ID NO: 4677048 - DNA, 22 bp, Homo sapiens
tttaaagcaccgaggttgcatt

SEQ ID NO: 4677049 - DNA, 17 bp, Homo sapiens
tttaaagtttaaatacc

SEQ ID NO: 4677050 - DNA, 14 bp, Homo sapiens
tttaaataccagta

SEQ ID NO: 4677051 - DNA, 16 bp, Homo sapiens
tttaaatatcattctt

SEQ ID NO: 4677052 - DNA, 13 bp, Homo sapiens
tttaaattacaat

SEQ ID NO: 4677053 - DNA, 16 bp, Homo sapiens
tttaaattttattatt

SEQ ID NO: 4677054 - DNA, 19 bp, Homo sapiens
tttaacatacaagaaaatg

SEQ ID NO: 4677055 - DNA, 13 bp, Homo sapiens
tttaacccctcca

SEQ ID NO: 4677056 - DNA, 13 bp, Homo sapiens
tttaacctgtttt

SEQ ID NO: 4677057 - DNA, 17 bp, Homo sapiens
tttaactctgtcttcac

SEQ ID NO: 4677058 - DNA, 18 bp, Homo sapiens
tttaagccaaagaaacaa

SEQ ID NO: 4677059 - DNA, 17 bp, Homo sapiens
tttaaggtttcaacaaa

SEQ ID NO: 4677060 - DNA, 22 bp, Homo sapiens
tttaaggtttcaacaaatttca

SEQ ID NO: 4677061 - DNA, 21 bp, Homo sapiens
tttaagtactacacattttta

SEQ ID NO: 4677062 - DNA, 20 bp, Homo sapiens
tttaataaattgcttactga

SEQ ID NO: 4677063 - DNA, 23 bp, Homo sapiens
tttaataaattgcttactgatat

SEQ ID NO: 4677064 - DNA, 14 bp, Homo sapiens
tttaatacaggaaa

SEQ ID NO: 4677065 - DNA, 18 bp, Homo sapiens
tttaatagtcaccttcat

SEQ ID NO: 4677066 - DNA, 18 bp, Homo sapiens
tttaatggatgtataata

SEQ ID NO: 4677067 - DNA, 22 bp, Homo sapiens
tttaatggccggctggaaatgc

SEQ ID NO: 4677068 - DNA, 13 bp, Homo sapiens
tttaatgtatctt

SEQ ID NO: 4677069 - DNA, 23 bp, Homo sapiens
tttaatgtatcttaaaggacata

SEQ ID NO: 4677070 - DNA, 20 bp, Homo sapiens
tttaattctgtcttgttcat

SEQ ID NO: 4677071 - DNA, 21 bp, Homo sapiens
tttaattctgtcttgttcatt

SEQ ID NO: 4677072 - DNA, 16 bp, Homo sapiens
tttaatttcaggaaaa

SEQ ID NO: 4677073 - DNA, 17 bp, Homo sapiens
tttaattttaatgctgt

SEQ ID NO: 4677074 - DNA, 17 bp, Homo sapiens
tttacaaacctttgttt

SEQ ID NO: 4677075 - DNA, 18 bp, Homo sapiens
tttacaacatcaccagtg

SEQ ID NO: 4677076 - DNA, 18 bp, Homo sapiens
tttacagcagcaatattt

SEQ ID NO: 4677077 - DNA, 13 bp, Homo sapiens
tttacagcccttg

SEQ ID NO: 4677078 - DNA, 21 bp, Homo sapiens
tttacagcccttggcttgtgt

SEQ ID NO: 4677079 - DNA, 15 bp, Homo sapiens
tttacatagttgaga

SEQ ID NO: 4677080 - DNA, 17 bp, Homo sapiens
tttacatctaagaattt

SEQ ID NO: 4677081 - DNA, 23 bp, Homo sapiens
tttacctgttctgaaatgttctt

SEQ ID NO: 4677082 - DNA, 17 bp, Homo sapiens
tttacctttcagtgcag

SEQ ID NO: 4677083 - DNA, 17 bp, Homo sapiens
tttactctggtaggaat

SEQ ID NO: 4677084 - DNA, 12 bp, Homo sapiens
tttactttgaac

SEQ ID NO: 4677085 - DNA, 15 bp, Homo sapiens
tttagaaatgcatat

SEQ ID NO: 4677086 - DNA, 11 bp, Homo sapiens
tttagaagcag

SEQ ID NO: 4677087 - DNA, 15 bp, Homo sapiens
tttagataatttgaa

SEQ ID NO: 4677088 - DNA, 22 bp, Homo sapiens
tttagcatgttcctccttttct

SEQ ID NO: 4677089 - DNA, 15 bp, Homo sapiens
tttagtagagacagt

SEQ ID NO: 4677090 - DNA, 18 bp, Homo sapiens
tttagtagagacagtgtt

SEQ ID NO: 4677091 - DNA, 17 bp, Homo sapiens
tttagtcattaatgtgt

SEQ ID NO: 4677092 - DNA, 18 bp, Homo sapiens
tttagtgtttatgtttaa

SEQ ID NO: 4677093 - DNA, 15 bp, Homo sapiens
tttagttttacacta

SEQ ID NO: 4677094 - DNA, 14 bp, Homo sapiens
tttataaaaatata

SEQ ID NO: 4677095 - DNA, 16 bp, Homo sapiens
tttataaaaatataaa

SEQ ID NO: 4677096 - DNA, 19 bp, Homo sapiens
tttataaaaatataaattg

SEQ ID NO: 4677097 - DNA, 13 bp, Homo sapiens
tttataagaattt

SEQ ID NO: 4677098 - DNA, 19 bp, Homo sapiens
tttatactttaaagtattt

SEQ ID NO: 4677099 - DNA, 17 bp, Homo sapiens
tttatagaatttaatat

SEQ ID NO: 4677100 - DNA, 16 bp, Homo sapiens
tttatatcatgcaaaa

SEQ ID NO: 4677101 - DNA, 19 bp, Homo sapiens
tttatatttattgttagaa

SEQ ID NO: 4677102 - DNA, 20 bp, Homo sapiens
tttatatttattgttagaaa

SEQ ID NO: 4677103 - DNA, 12 bp, Homo sapiens
tttatattttta

SEQ ID NO: 4677104 - DNA, 20 bp, Homo sapiens
tttatctaatacctctgtgt

SEQ ID NO: 4677105 - DNA, 18 bp, Homo sapiens
tttatcttggtagtacat

SEQ ID NO: 4677106 - DNA, 17 bp, Homo sapiens
tttatgaagaaagatac

SEQ ID NO: 4677107 - DNA, 12 bp, Homo sapiens
tttatgcaaata

SEQ ID NO: 4677108 - DNA, 14 bp, Homo sapiens
tttatgtacaggat

SEQ ID NO: 4677109 - DNA, 15 bp, Homo sapiens
tttattaaaaatgtt

SEQ ID NO: 4677110 - DNA, 18 bp, Homo sapiens
tttattaaaaatgttctc

SEQ ID NO: 4677111 - DNA, 18 bp, Homo sapiens
tttattcacatatgtctt

SEQ ID NO: 4677112 - DNA, 19 bp, Homo sapiens
tttattcacatatgtctta

SEQ ID NO: 4677113 - DNA, 16 bp, Homo sapiens
tttattctatctgttt

SEQ ID NO: 4677114 - DNA, 23 bp, Homo sapiens
tttattctcaggtaatcatttta

SEQ ID NO: 4677115 - DNA, 14 bp, Homo sapiens
tttattctgtccat

SEQ ID NO: 4677116 - DNA, 23 bp, Homo sapiens
tttattgccttttaatttttaat

SEQ ID NO: 4677117 - DNA, 22 bp, Homo sapiens
tttatttaacttttagtaaagt

SEQ ID NO: 4677118 - DNA, 22 bp, Homo sapiens
tttattttaaaaaacactgata

SEQ ID NO: 4677119 - DNA, 16 bp, Homo sapiens
tttattttcttttgaa

SEQ ID NO: 4677120 - DNA, 21 bp, Homo sapiens
tttattttggcttcatttcaa

SEQ ID NO: 4677121 - DNA, 16 bp, Homo sapiens
tttattttttagtgca

SEQ ID NO: 4677122 - DNA, 13 bp, Homo sapiens
tttcaaaaacatt

SEQ ID NO: 4677123 - DNA, 16 bp, Homo sapiens
tttcaacaaatttcat

SEQ ID NO: 4677124 - DNA, 17 bp, Homo sapiens
tttcaacaaatttcatt

SEQ ID NO: 4677125 - DNA, 20 bp, Homo sapiens
tttcaacaaatttcattgca

SEQ ID NO: 4677126 - DNA, 21 bp, Homo sapiens
tttcaacaaatttcattgcac

SEQ ID NO: 4677127 - DNA, 13 bp, Homo sapiens
tttcaactttctt

SEQ ID NO: 4677128 - DNA, 21 bp, Homo sapiens
tttcaagagtctaatagtctt

SEQ ID NO: 4677129 - DNA, 15 bp, Homo sapiens
tttcaaggccttcag

SEQ ID NO: 4677130 - DNA, 22 bp, Homo sapiens
tttcaataaagttgttgcattc

SEQ ID NO: 4677131 - DNA, 16 bp, Homo sapiens
tttcacattcttggct

SEQ ID NO: 4677132 - DNA, 16 bp, Homo sapiens
tttcagaaggagaagg

SEQ ID NO: 4677133 - DNA, 20 bp, Homo sapiens
tttcagaagtgccacttaag

SEQ ID NO: 4677134 - DNA, 16 bp, Homo sapiens
tttcagatataaaaga

SEQ ID NO: 4677135 - DNA, 14 bp, Homo sapiens
tttcagctggaaac

SEQ ID NO: 4677136 - DNA, 21 bp, Homo sapiens
tttcagctggaaacttctgta

SEQ ID NO: 4677137 - DNA, 21 bp, Homo sapiens
tttcaggaaaatgtattgatt

SEQ ID NO: 4677138 - DNA, 23 bp, Homo sapiens
tttcaggaaaatgtattgattca

SEQ ID NO: 4677139 - DNA, 16 bp, Homo sapiens
tttcagtactttttta

SEQ ID NO: 4677140 - DNA, 21 bp, Homo sapiens
tttcagtcatataaaagctat

SEQ ID NO: 4677141 - DNA, 19 bp, Homo sapiens
tttggtgtgccctgtgtgt

SEQ ID NO: 4677142 - DNA, 13 bp, Homo sapiens
tttggttggtttt

SEQ ID NO: 4677143 - DNA, 9 bp, Homo sapiens
tttggtttt

SEQ ID NO: 4677144 - DNA, 13 bp, Homo sapiens
tttgtaaaccatt

SEQ ID NO: 4677145 - DNA, 15 bp, Homo sapiens
tttgtaaacttctga

SEQ ID NO: 4677146 - DNA, 13 bp, Homo sapiens
tttgtaagtgtaa

SEQ ID NO: 4677147 - DNA, 15 bp, Homo sapiens
ttctttactattaaa

SEQ ID NO: 4677148 - DNA, 18 bp, Homo sapiens
ttctttactattaaaata

SEQ ID NO: 4677149 - DNA, 13 bp, Homo sapiens
ttctttagaattt

SEQ ID NO: 4677150 - DNA, 16 bp, Homo sapiens
ttctttagaattttta

SEQ ID NO: 4677151 - DNA, 18 bp, Homo sapiens
ttctttcagctatcagta

SEQ ID NO: 4677152 - DNA, 21 bp, Homo sapiens
ttctttcctccccctgcaact

SEQ ID NO: 4677153 - DNA, 16 bp, Homo sapiens
ttcttttacagactag

SEQ ID NO: 4677154 - DNA, 13 bp, Homo sapiens
ttcttttcacatt

SEQ ID NO: 4677155 - DNA, 12 bp, Homo sapiens
ttcttttgcatt

SEQ ID NO: 4677156 - DNA, 17 bp, Homo sapiens
ttgaaaaagttccatag

SEQ ID NO: 4677157 - DNA, 20 bp, Homo sapiens
ttgaaaaagttccatagaaa

SEQ ID NO: 4677158 - DNA, 16 bp, Homo sapiens
ttgaaacaaagaaggt

SEQ ID NO: 4677159 - DNA, 15 bp, Homo sapiens
ttgaaagaagcaaga

SEQ ID NO: 4677160 - DNA, 16 bp, Homo sapiens
ttgaaataactggaac

SEQ ID NO: 4677161 - DNA, 17 bp, Homo sapiens
ttgaaatagaaaatgta

SEQ ID NO: 4677162 - DNA, 16 bp, Homo sapiens
ttgaaccaacatcttt

SEQ ID NO: 4677163 - DNA, 14 bp, Homo sapiens
ttgaaccccctccc

SEQ ID NO: 4677164 - DNA, 19 bp, Homo sapiens
ttgaagccgactctggccc

SEQ ID NO: 4677165 - DNA, 17 bp, Homo sapiens
ttgaagtatattcttat

SEQ ID NO: 4677166 - DNA, 15 bp, Homo sapiens
ttgaataaagtattc

SEQ ID NO: 4677167 - DNA, 21 bp, Homo sapiens
ttgaataaagtattctagtgt

SEQ ID NO: 4677168 - DNA, 23 bp, Homo sapiens
ttgaataatgacagatggtgaag

SEQ ID NO: 4677169 - DNA, 18 bp, Homo sapiens
ttgaatctatttcactta

SEQ ID NO: 4677170 - DNA, 15 bp, Homo sapiens
ttgaatgggtccatt

SEQ ID NO: 4677171 - DNA, 18 bp, Homo sapiens
ttgaatttactggacata

SEQ ID NO: 4677172 - DNA, 16 bp, Homo sapiens
ttgacaattgggagct

SEQ ID NO: 4677173 - DNA, 19 bp, Homo sapiens
ttgacacatatgaacacag

SEQ ID NO: 4677174 - DNA, 19 bp, Homo sapiens
ttgacactggtatcttatt

SEQ ID NO: 4677175 - DNA, 20 bp, Homo sapiens
ttgacctttaaatgcaacag

SEQ ID NO: 4677176 - DNA, 22 bp, Homo sapiens
ttgagaaaaatagagcaaaatc

SEQ ID NO: 4677177 - DNA, 13 bp, Homo sapiens
ttgagacttaaaa

SEQ ID NO: 4677178 - DNA, 23 bp, Homo sapiens
ttgagatggagtctcactcttgt

SEQ ID NO: 4677179 - DNA, 18 bp, Homo sapiens
ttgagattgtactgttca

SEQ ID NO: 4677180 - DNA, 20 bp, Homo sapiens
ttgagattgtactgttcata

SEQ ID NO: 4677181 - DNA, 13 bp, Homo sapiens
ttgagcatatttt

SEQ ID NO: 4677182 - DNA, 22 bp, Homo sapiens
ttgaggcccccgtcagggagag

SEQ ID NO: 4677183 - DNA, 11 bp, Homo sapiens
ttgaggggcag

SEQ ID NO: 4677184 - DNA, 22 bp, Homo sapiens
ttgaggtttttaaatatatatt

SEQ ID NO: 4677185 - DNA, 17 bp, Homo sapiens
ttgagtataagaaatgc

SEQ ID NO: 4677186 - DNA, 15 bp, Homo sapiens
ttgagtctgttttgt

SEQ ID NO: 4677187 - DNA, 17 bp, Homo sapiens
ttgagttatcagggaac

SEQ ID NO: 4677188 - DNA, 18 bp, Homo sapiens
ttgagtttcagctggaaa

SEQ ID NO: 4677189 - DNA, 19 bp, Homo sapiens
ttgagtttcagctggaaac

SEQ ID NO: 4677190 - DNA, 17 bp, Homo sapiens
ttgataatatatattaa

SEQ ID NO: 4677191 - DNA, 15 bp, Homo sapiens
ttgatagatgtttgg

SEQ ID NO: 4677192 - DNA, 14 bp, Homo sapiens
ttgatcaaatatag

SEQ ID NO: 4677193 - DNA, 21 bp, Homo sapiens
ttgatcaaatatagaaagttg

SEQ ID NO: 4677194 - DNA, 23 bp, Homo sapiens
ttgatcataaactgactatcata

SEQ ID NO: 4677195 - DNA, 15 bp, Homo sapiens
ttgatcatgtacttt

SEQ ID NO: 4677196 - DNA, 13 bp, Homo sapiens
ttgatgaatgttg

SEQ ID NO: 4677197 - DNA, 16 bp, Homo sapiens
ttgatgaggtttattc

SEQ ID NO: 4677198 - DNA, 16 bp, Homo sapiens
ttgattattcaacaca

SEQ ID NO: 4677199 - DNA, 22 bp, Homo sapiens
ttgattgatttttaaagtttaa

SEQ ID NO: 4677200 - DNA, 19 bp, Homo sapiens
ttgatttcacatttctact

SEQ ID NO: 4677201 - DNA, 16 bp, Homo sapiens
ttgatttttaaagttt

SEQ ID NO: 4677202 - DNA, 19 bp, Homo sapiens
ttgcaaagaactccagagt

SEQ ID NO: 4677203 - DNA, 15 bp, Homo sapiens
ttgcaaagcctttaa

SEQ ID NO: 4677204 - DNA, 18 bp, Homo sapiens
ttgcaaagcctttaaatt

SEQ ID NO: 4677205 - DNA, 19 bp, Homo sapiens
ttgcacataggaaactttt

SEQ ID NO: 4677206 - DNA, 22 bp, Homo sapiens
ttgcacttgattaagcttttgt

SEQ ID NO: 4677207 - DNA, 17 bp, Homo sapiens
ttgcactttcctttcaa

SEQ ID NO: 4677208 - DNA, 21 bp, Homo sapiens
ttgcactttcctttcaataaa

SEQ ID NO: 4677209 - DNA, 15 bp, Homo sapiens
ttgcagcccaaggac

SEQ ID NO: 4677210 - DNA, 16 bp, Homo sapiens
ttgcagcccaaggaca

SEQ ID NO: 4677211 - DNA, 22 bp, Homo sapiens
ttgcagcctgctctagtgggac

SEQ ID NO: 4677212 - DNA, 16 bp, Homo sapiens
ttgcagtctttccccc

SEQ ID NO: 4677213 - DNA, 17 bp, Homo sapiens
ttgcagtctttccccca

SEQ ID NO: 4677214 - DNA, 15 bp, Homo sapiens
ttgcatgtgactctg

SEQ ID NO: 4677215 - DNA, 16 bp, Homo sapiens
ttgcatgtgactctga

SEQ ID NO: 4677216 - DNA, 20 bp, Homo sapiens
ttgccacagtagaactgtct

SEQ ID NO: 4677217 - DNA, 24 bp, Homo sapiens
ttgccagactctaggttatacaat

SEQ ID NO: 4677218 - DNA, 18 bp, Homo sapiens
ttgccatttgtagctttg

SEQ ID NO: 4677219 - DNA, 15 bp, Homo sapiens
ttgcccttcctcctg

SEQ ID NO: 4677220 - DNA, 19 bp, Homo sapiens
ttgcctatgcccagggaat

SEQ ID NO: 4677221 - DNA, 15 bp, Homo sapiens
ttgcctgaggctgta

SEQ ID NO: 4677222 - DNA, 20 bp, Homo sapiens
ttgcctgaggggaaagagag

SEQ ID NO: 4677223 - DNA, 20 bp, Homo sapiens
ttgccttctgaaatgtgacc

SEQ ID NO: 4677224 - DNA, 18 bp, Homo sapiens
ttgcctttgctcttataa

SEQ ID NO: 4677225 - DNA, 16 bp, Homo sapiens
ttgctaatcaaagcca

SEQ ID NO: 4677226 - DNA, 18 bp, Homo sapiens
ttgctaatcaaagccagg

SEQ ID NO: 4677227 - DNA, 21 bp, Homo sapiens
ttgctaatcaaagccagggtc

SEQ ID NO: 4677228 - DNA, 23 bp, Homo sapiens
ttgctatggcaggataagaaagc

SEQ ID NO: 4677229 - DNA, 16 bp, Homo sapiens
ttgctcatgagctcct

SEQ ID NO: 4677230 - DNA, 18 bp, Homo sapiens
ttgctcatgagctcctga

SEQ ID NO: 4677231 - DNA, 13 bp, Homo sapiens
ttgctcccaagcc

SEQ ID NO: 4677232 - DNA, 21 bp, Homo sapiens
ttgctcccaatggtgcttgga

SEQ ID NO: 4677233 - DNA, 13 bp, Homo sapiens
ttgctcccaggat

SEQ ID NO: 4677234 - DNA, 21 bp, Homo sapiens
ttgctcccctgatagaagatt

SEQ ID NO: 4677235 - DNA, 14 bp, Homo sapiens
ttgctctatgttag

SEQ ID NO: 4677236 - DNA, 13 bp, Homo sapiens
ttgctctttcacc

SEQ ID NO: 4677237 - DNA, 12 bp, Homo sapiens
ttgctgcttttt

SEQ ID NO: 4677238 - DNA, 20 bp, Homo sapiens
ttgctgtagaagatggcact

SEQ ID NO: 4677239 - DNA, 18 bp, Homo sapiens
ttgctgtatgacccctgg

SEQ ID NO: 4677240 - DNA, 15 bp, Homo sapiens
ttgctgtcacttctt

SEQ ID NO: 4677241 - DNA, 10 bp, Homo sapiens
ttgctttcct

SEQ ID NO: 4677242 - DNA, 15 bp, Homo sapiens
ttgctttctgaaatt

SEQ ID NO: 4677243 - DNA, 15 bp, Homo sapiens
ttggaactgtgtttc

SEQ ID NO: 4677244 - DNA, 22 bp, Homo sapiens
ttggaactgtgtttcaaatgga

SEQ ID NO: 4677245 - DNA, 20 bp, Homo sapiens
ttggaactttctgttcccta

SEQ ID NO: 4677246 - DNA, 14 bp, Homo sapiens
ttggaagaggaaaa

SEQ ID NO: 4677247 - DNA, 14 bp, Homo sapiens
ttggaatatttgaa

SEQ ID NO: 4677248 - DNA, 15 bp, Homo sapiens
ttggaatatttgaat

SEQ ID NO: 4677249 - DNA, 14 bp, Homo sapiens
ttggaatcaaggta

SEQ ID NO: 4677250 - DNA, 22 bp, Homo sapiens
ttggaatgcagaggtctccaaa

SEQ ID NO: 4677251 - DNA, 15 bp, Homo sapiens
ttggacactgtacaa

SEQ ID NO: 4677252 - DNA, 18 bp, Homo sapiens
ttggacagaaaatgcaat

SEQ ID NO: 4677253 - DNA, 15 bp, Homo sapiens
ttcgcacacacccat

SEQ ID NO: 4677254 - DNA, 13 bp, Homo sapiens
ttcgcagccaccc

SEQ ID NO: 4677255 - DNA, 15 bp, Homo sapiens
ttcgcagccaccctg

SEQ ID NO: 4677256 - DNA, 18 bp, Homo sapiens
ttcgcagccaccctgagg

SEQ ID NO: 4677257 - DNA, 15 bp, Homo sapiens
ttcgctgaaattgct

SEQ ID NO: 4677258 - DNA, 17 bp, Homo sapiens
ttcggggctgggaagtc

SEQ ID NO: 4677259 - DNA, 18 bp, Homo sapiens
ttcggttgggtaccatgc

SEQ ID NO: 4677260 - DNA, 21 bp, Homo sapiens
ttcgtcatgttggccaggctg

SEQ ID NO: 4677261 - DNA, 15 bp, Homo sapiens
ttcgtgagctgggga

SEQ ID NO: 4677262 - DNA, 18 bp, Homo sapiens
ttcgtgagctggggactc

SEQ ID NO: 4677263 - DNA, 12 bp, Homo sapiens
ttcgttctgtgg

SEQ ID NO: 4677264 - DNA, 23 bp, Homo sapiens
ttcgttgcacagctgtttgaaat

SEQ ID NO: 4677265 - DNA, 18 bp, Homo sapiens
ttctaaaatagcaataac

SEQ ID NO: 4677266 - DNA, 16 bp, Homo sapiens
ttctaaagaagttcaa

SEQ ID NO: 4677267 - DNA, 18 bp, Homo sapiens
ttctaaataaaaatatgt

SEQ ID NO: 4677268 - DNA, 23 bp, Homo sapiens
ttctaaatgtacaaattcttata

SEQ ID NO: 4677269 - DNA, 16 bp, Homo sapiens
ttctaagaaaatgtag

SEQ ID NO: 4677270 - DNA, 17 bp, Homo sapiens
ttctaagaaaatgtagt

SEQ ID NO: 4677271 - DNA, 20 bp, Homo sapiens
ttctaagtcgtgcactttct

SEQ ID NO: 4677272 - DNA, 14 bp, Homo sapiens
ttctaagtgtactt

SEQ ID NO: 4677273 - DNA, 17 bp, Homo sapiens
ttctaataaagccattt

SEQ ID NO: 4677274 - DNA, 20 bp, Homo sapiens
ttctaataaagccatttctt

SEQ ID NO: 4677275 - DNA, 21 bp, Homo sapiens
ttctaataaagccatttctta

SEQ ID NO: 4677276 - DNA, 16 bp, Homo sapiens
ttctaatgctgatatg

SEQ ID NO: 4677277 - DNA, 14 bp, Homo sapiens
ttctaattgtaagt

SEQ ID NO: 4677278 - DNA, 17 bp, Homo sapiens
ttctacccttttccttt

SEQ ID NO: 4677279 - DNA, 23 bp, Homo sapiens
ttctactccttccctaatagctt

SEQ ID NO: 4677280 - DNA, 16 bp, Homo sapiens
ttctagcagtccccag

SEQ ID NO: 4677281 - DNA, 17 bp, Homo sapiens
ttctaggaatggaggag

SEQ ID NO: 4677282 - DNA, 13 bp, Homo sapiens
ttctaggctgctg

SEQ ID NO: 4677283 - DNA, 19 bp, Homo sapiens
ttctatcagactcagtttt

SEQ ID NO: 4677284 - DNA, 16 bp, Homo sapiens
ttctatgacaaattca

SEQ ID NO: 4677285 - DNA, 19 bp, Homo sapiens
ttctatgacaaattcaaga

SEQ ID NO: 4677286 - DNA, 17 bp, Homo sapiens
ttctattaactttaatt

SEQ ID NO: 4677287 - DNA, 17 bp, Homo sapiens
ttctatttattcctgtt

SEQ ID NO: 4677288 - DNA, 22 bp, Homo sapiens
ttctcaaaacccttaaaagaag

SEQ ID NO: 4677289 - DNA, 18 bp, Homo sapiens
ttctcaacatactgtaat

SEQ ID NO: 4677290 - DNA, 23 bp, Homo sapiens
ttctcagactttggaaaatgcat

SEQ ID NO: 4677291 - DNA, 18 bp, Homo sapiens
ttctcaggacacaggcct

SEQ ID NO: 4677292 - DNA, 17 bp, Homo sapiens
ttctcagtttctgcctg

SEQ ID NO: 4677293 - DNA, 21 bp, Homo sapiens
ttctcagtttctgcctgggca

SEQ ID NO: 4677294 - DNA, 18 bp, Homo sapiens
ttctcataattcctacag

SEQ ID NO: 4677295 - DNA, 21 bp, Homo sapiens
ttctcatagaggaaattcaaa

SEQ ID NO: 4677296 - DNA, 22 bp, Homo sapiens
ttctccacagcaaccccaggct

SEQ ID NO: 4677297 - DNA, 23 bp, Homo sapiens
ttctccatgctgcaaaggagaag

SEQ ID NO: 4677298 - DNA, 22 bp, Homo sapiens
ttctccatggccaccttttcag

SEQ ID NO: 4677299 - DNA, 20 bp, Homo sapiens
ttctccattccctagcagga

SEQ ID NO: 4677300 - DNA, 18 bp, Homo sapiens
ttctcccaggcctctgcc

SEQ ID NO: 4677301 - DNA, 16 bp, Homo sapiens
ttctcctcctcctccc

SEQ ID NO: 4677302 - DNA, 18 bp, Homo sapiens
ttctcctcctcctccctc

SEQ ID NO: 4677303 - DNA, 24 bp, Homo sapiens
ttctcctcctcctccctcctcact

SEQ ID NO: 4677304 - DNA, 17 bp, Homo sapiens
ttctctagctctctagg

SEQ ID NO: 4677305 - DNA, 20 bp, Homo sapiens
ttctctagctctctaggcct

SEQ ID NO: 4677306 - DNA, 12 bp, Homo sapiens
ttctctccctcc

SEQ ID NO: 4677307 - DNA, 19 bp, Homo sapiens
ttctctcttttaaagtatt

SEQ ID NO: 4677308 - DNA, 10 bp, Homo sapiens
ttctctgcct

SEQ ID NO: 4677309 - DNA, 15 bp, Homo sapiens
ttctctgcctggcaa

SEQ ID NO: 4677310 - DNA, 13 bp, Homo sapiens
ttctctgtacttt

SEQ ID NO: 4677311 - DNA, 14 bp, Homo sapiens
ttctctgtactttt

SEQ ID NO: 4677312 - DNA, 20 bp, Homo sapiens
ttctctgtgtgcacacccat

SEQ ID NO: 4677313 - DNA, 14 bp, Homo sapiens
ttctcttagagatt

SEQ ID NO: 4677314 - DNA, 20 bp, Homo sapiens
ttctcttagagattttcatt

SEQ ID NO: 4677315 - DNA, 23 bp, Homo sapiens
ttctcttagagattttcatttta

SEQ ID NO: 4677316 - DNA, 14 bp, Homo sapiens
ttctcttgctctcg

SEQ ID NO: 4677317 - DNA, 16 bp, Homo sapiens
ttctcttggctggctt

SEQ ID NO: 4677318 - DNA, 15 bp, Homo sapiens
ttctgaaaaatggag

SEQ ID NO: 4677319 - DNA, 15 bp, Homo sapiens
ttctgaaatgttctt

SEQ ID NO: 4677320 - DNA, 22 bp, Homo sapiens
ttctgaagccatgtagccaccc

SEQ ID NO: 4677321 - DNA, 13 bp, Homo sapiens
ttctgactgcccc

SEQ ID NO: 4677322 - DNA, 16 bp, Homo sapiens
ttctgacttttacaga

SEQ ID NO: 4677323 - DNA, 13 bp, Homo sapiens
ttctgatgtttat

SEQ ID NO: 4677324 - DNA, 13 bp, Homo sapiens
ttctgcaaagtgt

SEQ ID NO: 4677325 - DNA, 19 bp, Homo sapiens
ttctgcattcatttttata

SEQ ID NO: 4677326 - DNA, 20 bp, Homo sapiens
ttctgcctagagtgtagcct

SEQ ID NO: 4677327 - DNA, 16 bp, Homo sapiens
ttctgcctctattttt

SEQ ID NO: 4677328 - DNA, 11 bp, Homo sapiens
ttctgcctggg

SEQ ID NO: 4677329 - DNA, 13 bp, Homo sapiens
ttctgcctttaat

SEQ ID NO: 4677330 - DNA, 13 bp, Homo sapiens
ttctgctctggaa

SEQ ID NO: 4677331 - DNA, 18 bp, Homo sapiens
ttctgctgtttacaacat

SEQ ID NO: 4677332 - DNA, 19 bp, Homo sapiens
ttctgcttgctcccaagcc

SEQ ID NO: 4677333 - DNA, 23 bp, Homo sapiens
ttctgcttgctcccaagcccctg

SEQ ID NO: 4677334 - DNA, 22 bp, Homo sapiens
ttctggctctcccatttcctga

SEQ ID NO: 4677335 - DNA, 16 bp, Homo sapiens
ttctggcttcagcccc

SEQ ID NO: 4677336 - DNA, 17 bp, Homo sapiens
ttctgggaaacagtccc

SEQ ID NO: 4677337 - DNA, 11 bp, Homo sapiens
ttctgggctct

SEQ ID NO: 4677338 - DNA, 15 bp, Homo sapiens
ttctgggctctggac

SEQ ID NO: 4677339 - DNA, 16 bp, Homo sapiens
ttctgtcagtgttaaa

SEQ ID NO: 4677340 - DNA, 15 bp, Homo sapiens
ttctgtctctctctt

SEQ ID NO: 4677341 - DNA, 14 bp, Homo sapiens
ttctgtcttcccaa

SEQ ID NO: 4677342 - DNA, 21 bp, Homo sapiens
ttctgtcttgttcattttgag

SEQ ID NO: 4677343 - DNA, 13 bp, Homo sapiens
ttctgtttcctgg

SEQ ID NO: 4677344 - DNA, 14 bp, Homo sapiens
ttctgtttcctggc

SEQ ID NO: 4677345 - DNA, 19 bp, Homo sapiens
ttctgtttcctggcctcag

SEQ ID NO: 4677346 - DNA, 20 bp, Homo sapiens
ttctgtttcctggcctcaga

SEQ ID NO: 4677347 - DNA, 14 bp, Homo sapiens
ttcttaaaaaggaa

SEQ ID NO: 4677348 - DNA, 23 bp, Homo sapiens
ttcttaagacgtgattttgctgt

SEQ ID NO: 4677349 - DNA, 13 bp, Homo sapiens
ttcttaaggtttt

SEQ ID NO: 4677350 - DNA, 20 bp, Homo sapiens
ttcttaaggttttgttgcta

SEQ ID NO: 4677351 - DNA, 13 bp, Homo sapiens
ttcttagagtgta

SEQ ID NO: 4677352 - DNA, 19 bp, Homo sapiens
ttcttagctgtaacttaac

SEQ ID NO: 4677353 - DNA, 15 bp, Homo sapiens
ttcttagttgctgta

SEQ ID NO: 4677354 - DNA, 23 bp, Homo sapiens
ttcttagttgctgtatgtctcgt

SEQ ID NO: 4677355 - DNA, 16 bp, Homo sapiens
ttcttatgcaaaatgg

SEQ ID NO: 4677356 - DNA, 16 bp, Homo sapiens
ttcttattggaaatgt

SEQ ID NO: 4677357 - DNA, 15 bp, Homo sapiens
ttcttcacctcttcc

SEQ ID NO: 4677358 - DNA, 22 bp, Homo sapiens
ttcttcagcgtaaaatggtgaa

SEQ ID NO: 4677359 - DNA, 22 bp, Homo sapiens
ttcttccgcaccctccctagct

SEQ ID NO: 4677360 - DNA, 13 bp, Homo sapiens
ttcttcttcctga

SEQ ID NO: 4677361 - DNA, 14 bp, Homo sapiens
ttcttcttcctgaa

SEQ ID NO: 4677362 - DNA, 16 bp, Homo sapiens
ttcttgataggcctag

SEQ ID NO: 4677363 - DNA, 19 bp, Homo sapiens
ttcttgtcagacataaagc

SEQ ID NO: 4677364 - DNA, 16 bp, Homo sapiens
ttcatctaaatgaaag

SEQ ID NO: 4677365 - DNA, 22 bp, Homo sapiens
ttcatctcccacctagcagcac

SEQ ID NO: 4677366 - DNA, 13 bp, Homo sapiens
ttcatctgggaaa

SEQ ID NO: 4677367 - DNA, 14 bp, Homo sapiens
ttcatctgggaaag

SEQ ID NO: 4677368 - DNA, 21 bp, Homo sapiens
ttcatggcatcttcaatatga

SEQ ID NO: 4677369 - DNA, 18 bp, Homo sapiens
ttcatgtaatcctcaaga

SEQ ID NO: 4677370 - DNA, 18 bp, Homo sapiens
ttcattatgttcatgtaa

SEQ ID NO: 4677371 - DNA, 21 bp, Homo sapiens
ttcattccattgcctagctct

SEQ ID NO: 4677372 - DNA, 12 bp, Homo sapiens
ttcattctcata

SEQ ID NO: 4677373 - DNA, 23 bp, Homo sapiens
ttcattctcataattcctacagc

SEQ ID NO: 4677374 - DNA, 12 bp, Homo sapiens
ttcattgtacaa

SEQ ID NO: 4677375 - DNA, 19 bp, Homo sapiens
ttcatttagataatttgaa

SEQ ID NO: 4677376 - DNA, 16 bp, Homo sapiens
ttcatttcaatcattg

SEQ ID NO: 4677377 - DNA, 18 bp, Homo sapiens
ttcatttcaatcattgaa

SEQ ID NO: 4677378 - DNA, 21 bp, Homo sapiens
ttcatttcacacagtgaaacg

SEQ ID NO: 4677379 - DNA, 22 bp, Homo sapiens
ttcatttggaggaatcacccca

SEQ ID NO: 4677380 - DNA, 14 bp, Homo sapiens
ttcattttccaata

SEQ ID NO: 4677381 - DNA, 19 bp, Homo sapiens
ttcattttgagtattttta

SEQ ID NO: 4677382 - DNA, 18 bp, Homo sapiens
ttccaaaagtggcctctt

SEQ ID NO: 4677383 - DNA, 22 bp, Homo sapiens
ttccaaaagtggcctctttgtc

SEQ ID NO: 4677384 - DNA, 19 bp, Homo sapiens
ttccaaattaaaacaaata

SEQ ID NO: 4677385 - DNA, 15 bp, Homo sapiens
ttccaagaaaatatc

SEQ ID NO: 4677386 - DNA, 22 bp, Homo sapiens
ttccaagaccatttgtagtgag

SEQ ID NO: 4677387 - DNA, 15 bp, Homo sapiens
ttccaagctccaaat

SEQ ID NO: 4677388 - DNA, 19 bp, Homo sapiens
ttccaaggaagcagaagac

SEQ ID NO: 4677389 - DNA, 14 bp, Homo sapiens
ttccaccagggcca

SEQ ID NO: 4677390 - DNA, 17 bp, Homo sapiens
ttccaccagggccagag

SEQ ID NO: 4677391 - DNA, 23 bp, Homo sapiens
ttccaccagggccagagcagctc

SEQ ID NO: 4677392 - DNA, 15 bp, Homo sapiens
ttccacctcacaact

SEQ ID NO: 4677393 - DNA, 15 bp, Homo sapiens
ttccacctcacccca

SEQ ID NO: 4677394 - DNA, 14 bp, Homo sapiens
ttccacctccagcc

SEQ ID NO: 4677395 - DNA, 13 bp, Homo sapiens
ttccacttgccct

SEQ ID NO: 4677396 - DNA, 17 bp, Homo sapiens
ttccacttgccctgtgt

SEQ ID NO: 4677397 - DNA, 20 bp, Homo sapiens
ttccacttgccctgtgttct

SEQ ID NO: 4677398 - DNA, 14 bp, Homo sapiens
ttccagccttttta

SEQ ID NO: 4677399 - DNA, 23 bp, Homo sapiens
ttccagctagtgacccacatgcc

SEQ ID NO: 4677400 - DNA, 18 bp, Homo sapiens
ttccatcccaaccagtgc

SEQ ID NO: 4677401 - DNA, 20 bp, Homo sapiens
ttccatcccaaccagtgcca

SEQ ID NO: 4677402 - DNA, 17 bp, Homo sapiens
ttccatccttgactgaa

SEQ ID NO: 4677403 - DNA, 12 bp, Homo sapiens
ttccatctgaaa

SEQ ID NO: 4677404 - DNA, 17 bp, Homo sapiens
ttccatggccctcatta

SEQ ID NO: 4677405 - DNA, 15 bp, Homo sapiens
ttccattccatctag

SEQ ID NO: 4677406 - DNA, 22 bp, Homo sapiens
ttccattgtttgaaacaaagaa

SEQ ID NO: 4677407 - DNA, 14 bp, Homo sapiens
ttcccaagctccct

SEQ ID NO: 4677408 - DNA, 23 bp, Homo sapiens
ttcccacccctcatacctacacc

SEQ ID NO: 4677409 - DNA, 17 bp, Homo sapiens
ttcccatccccagcgat

SEQ ID NO: 4677410 - DNA, 16 bp, Homo sapiens
ttccccaacgaaaagc

SEQ ID NO: 4677411 - DNA, 21 bp, Homo sapiens
ttccccaagatctgccagacc

SEQ ID NO: 4677412 - DNA, 12 bp, Homo sapiens
ttccccacccag

SEQ ID NO: 4677413 - DNA, 11 bp, Homo sapiens
ttcccccaccc

SEQ ID NO: 4677414 - DNA, 13 bp, Homo sapiens
ttcccccaccctc

SEQ ID NO: 4677415 - DNA, 11 bp, Homo sapiens
ttcccccactc

SEQ ID NO: 4677416 - DNA, 18 bp, Homo sapiens
ttcccccagcaaggcaga

SEQ ID NO: 4677417 - DNA, 13 bp, Homo sapiens
ttcccccagccca

SEQ ID NO: 4677418 - DNA, 19 bp, Homo sapiens
ttccccctcttcttctgaa

SEQ ID NO: 4677419 - DNA, 17 bp, Homo sapiens
ttcccccttccaaataa

SEQ ID NO: 4677420 - DNA, 19 bp, Homo sapiens
ttccccctttctctgcctg

SEQ ID NO: 4677421 - DNA, 20 bp, Homo sapiens
ttccccgaagagtcagcccc

SEQ ID NO: 4677422 - DNA, 10 bp, Homo sapiens
ttcccctggg

SEQ ID NO: 4677423 - DNA, 12 bp, Homo sapiens
ttcccctgggaa

SEQ ID NO: 4677424 - DNA, 19 bp, Homo sapiens
ttcccgcccagcctcactt

SEQ ID NO: 4677425 - DNA, 16 bp, Homo sapiens
ttccctatggagaggc

SEQ ID NO: 4677426 - DNA, 18 bp, Homo sapiens
ttccctatggagaggctt

SEQ ID NO: 4677427 - DNA, 21 bp, Homo sapiens
ttccctatggagaggcttccc

SEQ ID NO: 4677428 - DNA, 14 bp, Homo sapiens
ttccctctcccagg

SEQ ID NO: 4677429 - DNA, 16 bp, Homo sapiens
ttccctctcccaggcc

SEQ ID NO: 4677430 - DNA, 12 bp, Homo sapiens
ttccctctgcct

SEQ ID NO: 4677431 - DNA, 16 bp, Homo sapiens
ttccctctgcctggga

SEQ ID NO: 4677432 - DNA, 22 bp, Homo sapiens
ttccctgcgagacgcacacagc

SEQ ID NO: 4677433 - DNA, 21 bp, Homo sapiens
ttcccttcctcttcctgccct

SEQ ID NO: 4677434 - DNA, 22 bp, Homo sapiens
ttcccttcctcttcctgccctt

SEQ ID NO: 4677435 - DNA, 21 bp, Homo sapiens
ttcccttgctcatgagctcct

SEQ ID NO: 4677436 - DNA, 19 bp, Homo sapiens
ttccgcaccctccctagct

SEQ ID NO: 4677437 - DNA, 16 bp, Homo sapiens
ttcctaacaaaatgag

SEQ ID NO: 4677438 - DNA, 14 bp, Homo sapiens
ttcctacagcacta

SEQ ID NO: 4677439 - DNA, 14 bp, Homo sapiens
ttcctacccccgtc

SEQ ID NO: 4677440 - DNA, 15 bp, Homo sapiens
ttcctcctttacctt

SEQ ID NO: 4677441 - DNA, 14 bp, Homo sapiens
ttcctctcatttcc

SEQ ID NO: 4677442 - DNA, 22 bp, Homo sapiens
ttcctctcatttccagcttctc

SEQ ID NO: 4677443 - DNA, 15 bp, Homo sapiens
ttcctctgtgaactg

SEQ ID NO: 4677444 - DNA, 13 bp, Homo sapiens
ttcctcttcctgc

SEQ ID NO: 4677445 - DNA, 16 bp, Homo sapiens
ttcctcttcctgccct

SEQ ID NO: 4677446 - DNA, 20 bp, Homo sapiens
ttcctcttcctgcccttgaa

SEQ ID NO: 4677447 - DNA, 11 bp, Homo sapiens
ttcctgaagct

SEQ ID NO: 4677448 - DNA, 15 bp, Homo sapiens
ttcctgacattgtct

SEQ ID NO: 4677449 - DNA, 23 bp, Homo sapiens
ttcctgcccttgaaccccctccc

SEQ ID NO: 4677450 - DNA, 15 bp, Homo sapiens
ttcctggacagctgt

SEQ ID NO: 4677451 - DNA, 24 bp, Homo sapiens
ttcctggacagctgtgcctcgctc

SEQ ID NO: 4677452 - DNA, 14 bp, Homo sapiens
ttcctggcctcaga

SEQ ID NO: 4677453 - DNA, 15 bp, Homo sapiens
ttcctggcctcagag

SEQ ID NO: 4677454 - DNA, 21 bp, Homo sapiens
ttcctggcctcagagcttcct

SEQ ID NO: 4677455 - DNA, 17 bp, Homo sapiens
ttcctgggccagaagta

SEQ ID NO: 4677456 - DNA, 23 bp, Homo sapiens
ttcctgggtggctactctgtgcc

SEQ ID NO: 4677457 - DNA, 21 bp, Homo sapiens
ttcctgtatttgttcccaaga

SEQ ID NO: 4677458 - DNA, 16 bp, Homo sapiens
ttcctgtggctccctc

SEQ ID NO: 4677459 - DNA, 22 bp, Homo sapiens
ttcctgtggctccctctctcct

SEQ ID NO: 4677460 - DNA, 23 bp, Homo sapiens
ttcctgtggctccctctctcctg

SEQ ID NO: 4677461 - DNA, 14 bp, Homo sapiens
ttcctgttcagtaa

SEQ ID NO: 4677462 - DNA, 20 bp, Homo sapiens
ttcctgttcttaagacgtga

SEQ ID NO: 4677463 - DNA, 13 bp, Homo sapiens
ttccttccagcct

SEQ ID NO: 4677464 - DNA, 18 bp, Homo sapiens
ttccttgaggggcagttt

SEQ ID NO: 4677465 - DNA, 16 bp, Homo sapiens
ttcctttcaataaagt

SEQ ID NO: 4677466 - DNA, 17 bp, Homo sapiens
ttcctttcaataaagtt

SEQ ID NO: 4677467 - DNA, 18 bp, Homo sapiens
ttcctttcaataaagttg

SEQ ID NO: 4677468 - DNA, 21 bp, Homo sapiens
ttcctttcaataaagttgttg

SEQ ID NO: 4677469 - DNA, 14 bp, Homo sapiens
ttccttttaaagaa

SEQ ID NO: 4677470 - DNA, 23 bp, Homo sapiens
ttcctttttgtaaatatgtgaca

SEQ ID NO: 4677471 - DNA, 21 bp, Homo sapiens
ttccttttttaaaaatgcaaa

SEQ ID NO: 4677472 - DNA, 12 bp, Homo sapiens
ttcgaaaggcct

SEQ ID NO: 4677473 - DNA, 22 bp, Homo sapiens
ttcgaatcttaatttattattt

SEQ ID NO: 4677474 - DNA, 17 bp, Homo sapiens
ttcgaatggggtagaaa

SEQ ID NO: 4677475 - DNA, 20 bp, Homo sapiens
ttatgcaaatacaatcagcc

SEQ ID NO: 4677476 - DNA, 19 bp, Homo sapiens
ttatgcacttttagaaatg

SEQ ID NO: 4677477 - DNA, 21 bp, Homo sapiens
ttatgcacttttagaaatgca

SEQ ID NO: 4677478 - DNA, 14 bp, Homo sapiens
ttatgcatagataa

SEQ ID NO: 4677479 - DNA, 15 bp, Homo sapiens
ttatgcgtgtgacag

SEQ ID NO: 4677480 - DNA, 23 bp, Homo sapiens
ttatgcgtgtgacagtgtatggg

SEQ ID NO: 4677481 - DNA, 19 bp, Homo sapiens
ttatgctctcactgtttgt

SEQ ID NO: 4677482 - DNA, 17 bp, Homo sapiens
ttatgtacagaaaacat

SEQ ID NO: 4677483 - DNA, 11 bp, Homo sapiens
ttatgtagttt

SEQ ID NO: 4677484 - DNA, 21 bp, Homo sapiens
ttatgtagtttttatatgttg

SEQ ID NO: 4677485 - DNA, 17 bp, Homo sapiens
ttatgtttaaaagaaat

SEQ ID NO: 4677486 - DNA, 20 bp, Homo sapiens
ttattaaacgtatgcatgtg

SEQ ID NO: 4677487 - DNA, 14 bp, Homo sapiens
ttattaaactgaat

SEQ ID NO: 4677488 - DNA, 13 bp, Homo sapiens
ttattacatgtaa

SEQ ID NO: 4677489 - DNA, 16 bp, Homo sapiens
ttattatattcagagt

SEQ ID NO: 4677490 - DNA, 14 bp, Homo sapiens
ttattatgcattat

SEQ ID NO: 4677491 - DNA, 12 bp, Homo sapiens
tgccctgtgtgt

SEQ ID NO: 4677492 - DNA, 23 bp, Homo sapiens
tgcccttcctcctgcctttctca

SEQ ID NO: 4677493 - DNA, 14 bp, Homo sapiens
tgcccttgctgggc

SEQ ID NO: 4677494 - DNA, 15 bp, Homo sapiens
tgcccttgctgggcc

SEQ ID NO: 4677495 - DNA, 16 bp, Homo sapiens
tgcccttgctgggcct

SEQ ID NO: 4677496 - DNA, 17 bp, Homo sapiens
tgcccttgctgggcctg

SEQ ID NO: 4677497 - DNA, 22 bp, Homo sapiens
tgcccttgctgggcctgggggt

SEQ ID NO: 4677498 - DNA, 20 bp, Homo sapiens
tgccgagcaaccgtggccct

SEQ ID NO: 4677499 - DNA, 21 bp, Homo sapiens
tgccgagcaaccgtggccctt

SEQ ID NO: 4677500 - DNA, 21 bp, Homo sapiens
tgccgcagtggggtcaagctg

SEQ ID NO: 4677501 - DNA, 14 bp, Homo sapiens
tgccgccgcccgct

SEQ ID NO: 4677502 - DNA, 20 bp, Homo sapiens
tgcctacaaaacctcaaacc

SEQ ID NO: 4677503 - DNA, 15 bp, Homo sapiens
tgcctcactaatttt

SEQ ID NO: 4677504 - DNA, 18 bp, Homo sapiens
tgcctcagcctcccgagt

SEQ ID NO: 4677505 - DNA, 18 bp, Homo sapiens
tgcctcaggcctctgtgc

SEQ ID NO: 4677506 - DNA, 15 bp, Homo sapiens
tgcctccatcttttt

SEQ ID NO: 4677507 - DNA, 22 bp, Homo sapiens
tgcctccctggtgagagggccg

SEQ ID NO: 4677508 - DNA, 16 bp, Homo sapiens
tgcctcctctctccct

SEQ ID NO: 4677509 - DNA, 18 bp, Homo sapiens
tgcctcctctctccctgc

SEQ ID NO: 4677510 - DNA, 13 bp, Homo sapiens
tgcctcctgtggg

SEQ ID NO: 4677511 - DNA, 18 bp, Homo sapiens
tgcctcctgtggggaaag

SEQ ID NO: 4677512 - DNA, 13 bp, Homo sapiens
tgcctcgccttgt

SEQ ID NO: 4677513 - DNA, 14 bp, Homo sapiens
tgcctcgccttgtg

SEQ ID NO: 4677514 - DNA, 17 bp, Homo sapiens
tgcctcgccttgtgtta

SEQ ID NO: 4677515 - DNA, 21 bp, Homo sapiens
tgcctcgctccccactctgct

SEQ ID NO: 4677516 - DNA, 17 bp, Homo sapiens
tgcctctcacagctgag

SEQ ID NO: 4677517 - DNA, 12 bp, Homo sapiens
tgcctctgaggc

SEQ ID NO: 4677518 - DNA, 16 bp, Homo sapiens
tgcctctgaggccagc

SEQ ID NO: 4677519 - DNA, 20 bp, Homo sapiens
tgcctctgaggccagcctgg

SEQ ID NO: 4677520 - DNA, 21 bp, Homo sapiens
tgcctctgaggccagcctggc

SEQ ID NO: 4677521 - DNA, 22 bp, Homo sapiens
tgcctctgaggccagcctggcc

SEQ ID NO: 4677522 - DNA, 23 bp, Homo sapiens
tgcctcttccccctgcttccacc

SEQ ID NO: 4677523 - DNA, 14 bp, Homo sapiens
tgcctgcacatcat

SEQ ID NO: 4677524 - DNA, 22 bp, Homo sapiens
tgcctgcccctaccctggactt

SEQ ID NO: 4677525 - DNA, 23 bp, Homo sapiens
tgcctggaagagccgagcacctg

SEQ ID NO: 4677526 - DNA, 16 bp, Homo sapiens
tgcctggaggacctga

SEQ ID NO: 4677527 - DNA, 20 bp, Homo sapiens
tgcctggaggacctgagcct

SEQ ID NO: 4677528 - DNA, 21 bp, Homo sapiens
tgcctggaggacctgagcctg

SEQ ID NO: 4677529 - DNA, 23 bp, Homo sapiens
tgcctggatgagaaacagctcag

SEQ ID NO: 4677530 - DNA, 11 bp, Homo sapiens
tgcctggcaac

SEQ ID NO: 4677531 - DNA, 22 bp, Homo sapiens
tgcctggcctggcacacatcag

SEQ ID NO: 4677532 - DNA, 22 bp, Homo sapiens
tgcctggctgattcagcatttt

SEQ ID NO: 4677533 - DNA, 13 bp, Homo sapiens
tgcctgggattct

SEQ ID NO: 4677534 - DNA, 14 bp, Homo sapiens
tgcctgggattcta

SEQ ID NO: 4677535 - DNA, 19 bp, Homo sapiens
tgcctgggcaatggccagg

SEQ ID NO: 4677536 - DNA, 16 bp, Homo sapiens
tgcctgtcctttcagt

SEQ ID NO: 4677537 - DNA, 16 bp, Homo sapiens
tgcctgtctggtgcct

SEQ ID NO: 4677538 - DNA, 18 bp, Homo sapiens
tgcctgtctgttacactg

SEQ ID NO: 4677539 - DNA, 14 bp, Homo sapiens
tgccttaaaatgga

SEQ ID NO: 4677540 - DNA, 16 bp, Homo sapiens
tgccttaacctgggac

SEQ ID NO: 4677541 - DNA, 17 bp, Homo sapiens
tgccttaacctgggacc

SEQ ID NO: 4677542 - DNA, 18 bp, Homo sapiens
tgcctttaagccaaagaa

SEQ ID NO: 4677543 - DNA, 11 bp, Homo sapiens
tgcctttctca

SEQ ID NO: 4677544 - DNA, 20 bp, Homo sapiens
tgcctttctcaactgtccca

SEQ ID NO: 4677545 - DNA, 15 bp, Homo sapiens
tgcctttgggcacgg

SEQ ID NO: 4677546 - DNA, 19 bp, Homo sapiens
tgcctttttcattttccaa

SEQ ID NO: 4677547 - DNA, 21 bp, Homo sapiens
tgcctttttcattttccaata

SEQ ID NO: 4677548 - DNA, 22 bp, Homo sapiens
tgcgagacgcacacagctgagc

SEQ ID NO: 4677549 - DNA, 16 bp, Homo sapiens
tgcgcaagtgcctggg

SEQ ID NO: 4677550 - DNA, 12 bp, Homo sapiens
tgttttcaaaat

SEQ ID NO: 4677551 - DNA, 13 bp, Homo sapiens
tgttttgcacttt

SEQ ID NO: 4677552 - DNA, 19 bp, Homo sapiens
tgtttttaacatgtcaatc

SEQ ID NO: 4677553 - DNA, 13 bp, Homo sapiens
tgttttttgttct

SEQ ID NO: 4677554 - DNA, 14 bp, Homo sapiens
tgttttttgttctt

SEQ ID NO: 4677555 - DNA, 14 bp, Homo sapiens
ttaaaaaatatttt

SEQ ID NO: 4677556 - DNA, 16 bp, Homo sapiens
ttaaaaaatgaaatcc

SEQ ID NO: 4677557 - DNA, 12 bp, Homo sapiens
ttaaaaatgcaa

SEQ ID NO: 4677558 - DNA, 15 bp, Homo sapiens
ttaaaaatgcaaatc

SEQ ID NO: 4677559 - DNA, 18 bp, Homo sapiens
ttaaaaatgttctcaaat

SEQ ID NO: 4677560 - DNA, 16 bp, Homo sapiens
ttaaaacaaatataca

SEQ ID NO: 4677561 - DNA, 17 bp, Homo sapiens
ttaaaacaaatatacat

SEQ ID NO: 4677562 - DNA, 13 bp, Homo sapiens
ttaaaacatattt

SEQ ID NO: 4677563 - DNA, 18 bp, Homo sapiens
ttaaaacatatttcattt

SEQ ID NO: 4677564 - DNA, 19 bp, Homo sapiens
ttaaaacatatttcatttt

SEQ ID NO: 4677565 - DNA, 17 bp, Homo sapiens
ttaaaactttattaaaa

SEQ ID NO: 4677566 - DNA, 16 bp, Homo sapiens
ttaaaagaatgagtga

SEQ ID NO: 4677567 - DNA, 15 bp, Homo sapiens
ttaaaagcacaatca

SEQ ID NO: 4677568 - DNA, 15 bp, Homo sapiens
ttaaaataaaatgaa

SEQ ID NO: 4677569 - DNA, 20 bp, Homo sapiens
ttaaaataaaatgaaaattg

SEQ ID NO: 4677570 - DNA, 21 bp, Homo sapiens
ttaaaataaaatgaaaattgt

SEQ ID NO: 4677571 - DNA, 17 bp, Homo sapiens
ttaaaatctctaataga

SEQ ID NO: 4677572 - DNA, 19 bp, Homo sapiens
ttaaaatgtgaggcaataa

SEQ ID NO: 4677573 - DNA, 18 bp, Homo sapiens
ttaaacgtatgcatgtga

SEQ ID NO: 4677574 - DNA, 16 bp, Homo sapiens
ttaaactatgttccta

SEQ ID NO: 4677575 - DNA, 15 bp, Homo sapiens
ttaaacttgtctttt

SEQ ID NO: 4677576 - DNA, 19 bp, Homo sapiens
ttaaagattacccccagtc

SEQ ID NO: 4677577 - DNA, 19 bp, Homo sapiens
ttaaagcatatagagatga

SEQ ID NO: 4677578 - DNA, 15 bp, Homo sapiens
ttaaaggcttctctc

SEQ ID NO: 4677579 - DNA, 13 bp, Homo sapiens
ttaaagtatttct

SEQ ID NO: 4677580 - DNA, 18 bp, Homo sapiens
ttaaagtcaggtccaatt

SEQ ID NO: 4677581 - DNA, 19 bp, Homo sapiens
ttaaagtgtacttataaac

SEQ ID NO: 4677582 - DNA, 13 bp, Homo sapiens
ttaaataccagta

SEQ ID NO: 4677583 - DNA, 16 bp, Homo sapiens
ttaaataccagtactt

SEQ ID NO: 4677584 - DNA, 14 bp, Homo sapiens
ttaaatattgtaat

SEQ ID NO: 4677585 - DNA, 18 bp, Homo sapiens
ttaaatattgtaatatga

SEQ ID NO: 4677586 - DNA, 24 bp, Homo sapiens
ttaaatattgtaatatgacagata

SEQ ID NO: 4677587 - DNA, 18 bp, Homo sapiens
ttaaatattttctatttt

SEQ ID NO: 4677588 - DNA, 22 bp, Homo sapiens
ttaacaacaataacactgtctc

SEQ ID NO: 4677589 - DNA, 14 bp, Homo sapiens
ttaaccctcccctt

SEQ ID NO: 4677590 - DNA, 19 bp, Homo sapiens
ttaacctgggaccaacctg

SEQ ID NO: 4677591 - DNA, 15 bp, Homo sapiens
ttaacggtgctaaaa

SEQ ID NO: 4677592 - DNA, 17 bp, Homo sapiens
ttaactagacacagata

SEQ ID NO: 4677593 - DNA, 13 bp, Homo sapiens
ttaactccctcca

SEQ ID NO: 4677594 - DNA, 12 bp, Homo sapiens
ttaactctgtct

SEQ ID NO: 4677595 - DNA, 15 bp, Homo sapiens
ttaactgacttcact

SEQ ID NO: 4677596 - DNA, 15 bp, Homo sapiens
ttaactgtaaacttg

SEQ ID NO: 4677597 - DNA, 19 bp, Homo sapiens
ttaacttgcctccatcttt

SEQ ID NO: 4677598 - DNA, 22 bp, Homo sapiens
ttaacttgcctccatctttttc

SEQ ID NO: 4677599 - DNA, 23 bp, Homo sapiens
ttaacttgcctccatctttttct

SEQ ID NO: 4677600 - DNA, 22 bp, Homo sapiens
ttaagaaaacaagtatataatt

SEQ ID NO: 4677601 - DNA, 13 bp, Homo sapiens
ttaagaactgctt

SEQ ID NO: 4677602 - DNA, 17 bp, Homo sapiens
ttaagaaggcattggca

SEQ ID NO: 4677603 - DNA, 20 bp, Homo sapiens
ttaagaatagaaaactgggt

SEQ ID NO: 4677604 - DNA, 17 bp, Homo sapiens
ttaagccaaagaaacaa

SEQ ID NO: 4677605 - DNA, 23 bp, Homo sapiens
ttaagccaaagaaacaagctgtg

SEQ ID NO: 4677606 - DNA, 21 bp, Homo sapiens
ttaagctgttcctgttcagta

SEQ ID NO: 4677607 - DNA, 14 bp, Homo sapiens
ttaagcttttattt

SEQ ID NO: 4677608 - DNA, 19 bp, Homo sapiens
ttaaggacccttttaagca

SEQ ID NO: 4677609 - DNA, 17 bp, Homo sapiens
ttaaggagcaaaaatct

SEQ ID NO: 4677610 - DNA, 16 bp, Homo sapiens
ttaaggtctttcagta

SEQ ID NO: 4677611 - DNA, 18 bp, Homo sapiens
ttaaggtttcaacaaatt

SEQ ID NO: 4677612 - DNA, 19 bp, Homo sapiens
ttaagtatcttttttcaaa

SEQ ID NO: 4677613 - DNA, 13 bp, Homo sapiens
ttaataataatta

SEQ ID NO: 4677614 - DNA, 21 bp, Homo sapiens
ttaatacatgcaacagaagtg

SEQ ID NO: 4677615 - DNA, 20 bp, Homo sapiens
ttaatacctttaaatatcat

SEQ ID NO: 4677616 - DNA, 14 bp, Homo sapiens
ttaatacttttcca

SEQ ID NO: 4677617 - DNA, 15 bp, Homo sapiens
ttaatacttttccac

SEQ ID NO: 4677618 - DNA, 17 bp, Homo sapiens
ttaatatactcagggat

SEQ ID NO: 4677619 - DNA, 12 bp, Homo sapiens
ttaatatggatt

SEQ ID NO: 4677620 - DNA, 19 bp, Homo sapiens
ttaatcacaaatttcactt

SEQ ID NO: 4677621 - DNA, 20 bp, Homo sapiens
ttaatcacaaatttcactta

SEQ ID NO: 4677622 - DNA, 21 bp, Homo sapiens
ttaatcacaaatttcacttat

SEQ ID NO: 4677623 - DNA, 12 bp, Homo sapiens
ttaatcttgctt

SEQ ID NO: 4677624 - DNA, 23 bp, Homo sapiens
ttaatgacacttgtccccaaatc

SEQ ID NO: 4677625 - DNA, 20 bp, Homo sapiens
ttaatgctatttgaacaagt

SEQ ID NO: 4677626 - DNA, 21 bp, Homo sapiens
ttaatgctgtttctaagaaaa

SEQ ID NO: 4677627 - DNA, 18 bp, Homo sapiens
ttaatggacaaataagtt

SEQ ID NO: 4677628 - DNA, 10 bp, Homo sapiens
ttaatgtatc

SEQ ID NO: 4677629 - DNA, 22 bp, Homo sapiens
ttaatgtcatggccttgaaaca

SEQ ID NO: 4677630 - DNA, 21 bp, Homo sapiens
ttaatgtgaactctcccctcc

SEQ ID NO: 4677631 - DNA, 18 bp, Homo sapiens
ttaatgtggactggaaca

SEQ ID NO: 4677632 - DNA, 12 bp, Homo sapiens
ttaatgttttca

SEQ ID NO: 4677633 - DNA, 15 bp, Homo sapiens
ttaatgttttcatta

SEQ ID NO: 4677634 - DNA, 21 bp, Homo sapiens
ttaatgttttcattatgttca

SEQ ID NO: 4677635 - DNA, 13 bp, Homo sapiens
ttaattctgtctt

SEQ ID NO: 4677636 - DNA, 21 bp, Homo sapiens
ttaattgacttatttatataa

SEQ ID NO: 4677637 - DNA, 15 bp, Homo sapiens
ttaatttcaggaaaa

SEQ ID NO: 4677638 - DNA, 19 bp, Homo sapiens
ttaatttcaggaaaatgta

SEQ ID NO: 4677639 - DNA, 21 bp, Homo sapiens
ttaatttgtaaacttctgaag

SEQ ID NO: 4677640 - DNA, 13 bp, Homo sapiens
ttaattttaatgc

SEQ ID NO: 4677641 - DNA, 22 bp, Homo sapiens
ttacaaacaagtggatgttttt

SEQ ID NO: 4677642 - DNA, 16 bp, Homo sapiens
ttacaaacctttgttt

SEQ ID NO: 4677643 - DNA, 18 bp, Homo sapiens
ttacaaacctttgtttca

SEQ ID NO: 4677644 - DNA, 17 bp, Homo sapiens
ttacaaatgcaaatttc

SEQ ID NO: 4677645 - DNA, 19 bp, Homo sapiens
ttacaacccggttcactct

SEQ ID NO: 4677646 - DNA, 16 bp, Homo sapiens
ttacacaattcttacc

SEQ ID NO: 4677647 - DNA, 18 bp, Homo sapiens
ttacactaggaaacgtgt

SEQ ID NO: 4677648 - DNA, 21 bp, Homo sapiens
ttacactggaggagagaagaa

SEQ ID NO: 4677649 - DNA, 15 bp, Homo sapiens
ttacagaaatggact

SEQ ID NO: 4677650 - DNA, 19 bp, Homo sapiens
ttacagaaatggactggag

SEQ ID NO: 4677651 - DNA, 19 bp, Homo sapiens
ttacagattatcacattaa

SEQ ID NO: 4677652 - DNA, 18 bp, Homo sapiens
ttacagggagctgggaca

SEQ ID NO: 4677653 - DNA, 20 bp, Homo sapiens
ttacagggcacaggccatgg

SEQ ID NO: 4677654 - DNA, 15 bp, Homo sapiens
ttacatagttgagat

SEQ ID NO: 4677655 - DNA, 19 bp, Homo sapiens
ttacatagttgagattgta

SEQ ID NO: 4677656 - DNA, 19 bp, Homo sapiens
ttacatgagttcaaatact

SEQ ID NO: 4677657 - DNA, 20 bp, Homo sapiens
ttacatgagttcaaatactt

SEQ ID NO: 4677658 - DNA, 16 bp, Homo sapiens
ttacatgtaatttgat

SEQ ID NO: 4677659 - DNA, 20 bp, Homo sapiens
ttacatgtaatttgatgagg

SEQ ID NO: 4677660 - DNA, 22 bp, Homo sapiens
tgtatccaaggaaacattttat

SEQ ID NO: 4677661 - DNA, 16 bp, Homo sapiens
tgtatccccagtgccc

SEQ ID NO: 4677662 - DNA, 16 bp, Homo sapiens
tgtatcttaaaggaca

SEQ ID NO: 4677663 - DNA, 21 bp, Homo sapiens
tgtatcttaaaggacataaaa

SEQ ID NO: 4677664 - DNA, 12 bp, Homo sapiens
tgtatgcagcta

SEQ ID NO: 4677665 - DNA, 16 bp, Homo sapiens
tgtattcagataatta

SEQ ID NO: 4677666 - DNA, 14 bp, Homo sapiens
tgtattctgaggat

SEQ ID NO: 4677667 - DNA, 16 bp, Homo sapiens
tgtattctttctgcct

SEQ ID NO: 4677668 - DNA, 13 bp, Homo sapiens
tgtatttctctgt

SEQ ID NO: 4677669 - DNA, 16 bp, Homo sapiens
tgtatttctctgtgaa

SEQ ID NO: 4677670 - DNA, 23 bp, Homo sapiens
tgtatttggaatatttgaataat

SEQ ID NO: 4677671 - DNA, 14 bp, Homo sapiens
tgtcaaagaaggtt

SEQ ID NO: 4677672 - DNA, 18 bp, Homo sapiens
tgtcaataaacaacagct

SEQ ID NO: 4677673 - DNA, 15 bp, Homo sapiens
tgtcaatctgtccgt

SEQ ID NO: 4677674 - DNA, 14 bp, Homo sapiens
tgtcacccaggctg

SEQ ID NO: 4677675 - DNA, 19 bp, Homo sapiens
tgtcacccaggctggagtg

SEQ ID NO: 4677676 - DNA, 17 bp, Homo sapiens
tgtcacctccttcccca

SEQ ID NO: 4677677 - DNA, 20 bp, Homo sapiens
tgtcacctccttccccagct

SEQ ID NO: 4677678 - DNA, 21 bp, Homo sapiens
tgtcacctccttccccagctc

SEQ ID NO: 4677679 - DNA, 22 bp, Homo sapiens
tgtcacctccttccccagctcc

SEQ ID NO: 4677680 - DNA, 20 bp, Homo sapiens
tgtcactagaatggataaaa

SEQ ID NO: 4677681 - DNA, 15 bp, Homo sapiens
tgtcacttgactctt

SEQ ID NO: 4677682 - DNA, 18 bp, Homo sapiens
tgtcacttgactcttgaa

SEQ ID NO: 4677683 - DNA, 18 bp, Homo sapiens
tgtcacttgctgcttttt

SEQ ID NO: 4677684 - DNA, 20 bp, Homo sapiens
tgtcagacataaagccatgt

SEQ ID NO: 4677685 - DNA, 20 bp, Homo sapiens
tgtcagaggcacaaaagggt

SEQ ID NO: 4677686 - DNA, 14 bp, Homo sapiens
tgtcagggtctcct

SEQ ID NO: 4677687 - DNA, 15 bp, Homo sapiens
tgtcagggtctcctt

SEQ ID NO: 4677688 - DNA, 20 bp, Homo sapiens
tgtcagtggggctctctgag

SEQ ID NO: 4677689 - DNA, 16 bp, Homo sapiens
tgtcagtgtagacaca

SEQ ID NO: 4677690 - DNA, 17 bp, Homo sapiens
tgtcagttcaactttca

SEQ ID NO: 4677691 - DNA, 18 bp, Homo sapiens
tgtcagttcaactttcag

SEQ ID NO: 4677692 - DNA, 16 bp, Homo sapiens
tgtcataaactttctc

SEQ ID NO: 4677693 - DNA, 18 bp, Homo sapiens
tgtcataaactttctcca

SEQ ID NO: 4677694 - DNA, 21 bp, Homo sapiens
tgtcatataaactcatttatc

SEQ ID NO: 4677695 - DNA, 13 bp, Homo sapiens
tgtcatctgtgca

SEQ ID NO: 4677696 - DNA, 15 bp, Homo sapiens
tgtcatttcattcca

SEQ ID NO: 4677697 - DNA, 20 bp, Homo sapiens
tgtcatttcattccattgcc

SEQ ID NO: 4677698 - DNA, 15 bp, Homo sapiens
tgtcattttatgaat

SEQ ID NO: 4677699 - DNA, 13 bp, Homo sapiens
tgtccaagacagg

SEQ ID NO: 4677700 - DNA, 15 bp, Homo sapiens
tgtccacctgtgggt

SEQ ID NO: 4677701 - DNA, 21 bp, Homo sapiens
tgtccagctgagcgccaggat

SEQ ID NO: 4677702 - DNA, 19 bp, Homo sapiens
tgtccaggttgatcttgaa

SEQ ID NO: 4677703 - DNA, 20 bp, Homo sapiens
tgtccaggttgatcttgaac

SEQ ID NO: 4677704 - DNA, 13 bp, Homo sapiens
tgtccatcttgtt

SEQ ID NO: 4677705 - DNA, 21 bp, Homo sapiens
tgtcccaaatccgccagtgtt

SEQ ID NO: 4677706 - DNA, 16 bp, Homo sapiens
tgtcccaaggaggggg

SEQ ID NO: 4677707 - DNA, 19 bp, Homo sapiens
tgtcccacccccttccccc

SEQ ID NO: 4677708 - DNA, 18 bp, Homo sapiens
tgtcccagggccctccca

SEQ ID NO: 4677709 - DNA, 20 bp, Homo sapiens
tgtcccagggccctcccagc

SEQ ID NO: 4677710 - DNA, 14 bp, Homo sapiens
tgtccccaaatccg

SEQ ID NO: 4677711 - DNA, 13 bp, Homo sapiens
tgtccccactgcc

SEQ ID NO: 4677712 - DNA, 22 bp, Homo sapiens
tgtccccatctaggtcctggct

SEQ ID NO: 4677713 - DNA, 13 bp, Homo sapiens
tgtcccctaggga

SEQ ID NO: 4677714 - DNA, 16 bp, Homo sapiens
tgtccctctagtgcct

SEQ ID NO: 4677715 - DNA, 22 bp, Homo sapiens
tgtccctctagtgccttcttta

SEQ ID NO: 4677716 - DNA, 15 bp, Homo sapiens
tgtccctctctctgg

SEQ ID NO: 4677717 - DNA, 16 bp, Homo sapiens
tgtccctctctctgga

SEQ ID NO: 4677718 - DNA, 13 bp, Homo sapiens
tgtccctgcaggg

SEQ ID NO: 4677719 - DNA, 14 bp, Homo sapiens
tgtccctgcagggc

SEQ ID NO: 4677720 - DNA, 21 bp, Homo sapiens
tgtccctgcagggccatctga

SEQ ID NO: 4677721 - DNA, 20 bp, Homo sapiens
tgtccctgggccagggtctg

SEQ ID NO: 4677722 - DNA, 22 bp, Homo sapiens
tgtcctattactgatgtgtgca

SEQ ID NO: 4677723 - DNA, 19 bp, Homo sapiens
tgtcctcttctgcatcttg

SEQ ID NO: 4677724 - DNA, 24 bp, Homo sapiens
tgtcctgtagttgcgtggactctg

SEQ ID NO: 4677725 - DNA, 21 bp, Homo sapiens
tgtcctttgaggccccaactc

SEQ ID NO: 4677726 - DNA, 22 bp, Homo sapiens
tgtcctttgaggccccaactca

SEQ ID NO: 4677727 - DNA, 23 bp, Homo sapiens
tgtcgccacacgcctctgtgtac

SEQ ID NO: 4677728 - DNA, 15 bp, Homo sapiens
tgtctaaaacaataa

SEQ ID NO: 4677729 - DNA, 17 bp, Homo sapiens
tgtctaaaacaataaaa

SEQ ID NO: 4677730 - DNA, 19 bp, Homo sapiens
tgtctaggcaggacctgtg

SEQ ID NO: 4677731 - DNA, 20 bp, Homo sapiens
tgtctatttttaatgtttgt

SEQ ID NO: 4677732 - DNA, 23 bp, Homo sapiens
tgtctcccgtgcatgctctgcag

SEQ ID NO: 4677733 - DNA, 21 bp, Homo sapiens
tgtctcctggcggttcctcgt

SEQ ID NO: 4677734 - DNA, 18 bp, Homo sapiens
tgtctcgagcgccctgca

SEQ ID NO: 4677735 - DNA, 21 bp, Homo sapiens
tgtctcgtggtaggactgtag

SEQ ID NO: 4677736 - DNA, 10 bp, Homo sapiens
tgtctctctc

SEQ ID NO: 4677737 - DNA, 14 bp, Homo sapiens
tgtctctctcttct

SEQ ID NO: 4677738 - DNA, 13 bp, Homo sapiens
tgtctctggctac

SEQ ID NO: 4677739 - DNA, 14 bp, Homo sapiens
tgtctgcctcctgc

SEQ ID NO: 4677740 - DNA, 19 bp, Homo sapiens
tgtctgcctcctgctttgg

SEQ ID NO: 4677741 - DNA, 23 bp, Homo sapiens
tgtctgcctcctgctttgggaag

SEQ ID NO: 4677742 - DNA, 13 bp, Homo sapiens
tgtctgctctgca

SEQ ID NO: 4677743 - DNA, 16 bp, Homo sapiens
tgtctgctctgcatat

SEQ ID NO: 4677744 - DNA, 19 bp, Homo sapiens
tgtctgctttctccattgt

SEQ ID NO: 4677745 - DNA, 18 bp, Homo sapiens
tgtctgggctcaagcttt

SEQ ID NO: 4677746 - DNA, 19 bp, Homo sapiens
tgtctgtacacgtgtcctg

SEQ ID NO: 4677747 - DNA, 20 bp, Homo sapiens
tgtctgtacacgtgtcctgt

SEQ ID NO: 4677748 - DNA, 12 bp, Homo sapiens
tgtctgttacac

SEQ ID NO: 4677749 - DNA, 23 bp, Homo sapiens
tgtcttaaagggaatcatttttg

SEQ ID NO: 4677750 - DNA, 22 bp, Homo sapiens
tgtcttatgtgaaaaattaact

SEQ ID NO: 4677751 - DNA, 14 bp, Homo sapiens
tgtcttattgaaaa

SEQ ID NO: 4677752 - DNA, 17 bp, Homo sapiens
tgtcttggaaccaccag

SEQ ID NO: 4677753 - DNA, 19 bp, Homo sapiens
tgtcttggacactgtacaa

SEQ ID NO: 4677754 - DNA, 19 bp, Homo sapiens
tgtcttggctttcatgtta

SEQ ID NO: 4677755 - DNA, 13 bp, Homo sapiens
tgtcttgtacatg

SEQ ID NO: 4677756 - DNA, 17 bp, Homo sapiens
tgtcttgtacatgtgta

SEQ ID NO: 4677757 - DNA, 19 bp, Homo sapiens
tgtcttgtgtatttctctg

SEQ ID NO: 4677758 - DNA, 23 bp, Homo sapiens
tgtcttgtgtatttctctgtgaa

SEQ ID NO: 4677759 - DNA, 15 bp, Homo sapiens
tgtcttgtgtttctt

SEQ ID NO: 4677760 - DNA, 12 bp, Homo sapiens
tgtcttgttcat

SEQ ID NO: 4677761 - DNA, 22 bp, Homo sapiens
tgtcttgttcattttgagtatt

SEQ ID NO: 4677762 - DNA, 17 bp, Homo sapiens
tgtctttaaatgctgct

SEQ ID NO: 4677763 - DNA, 22 bp, Homo sapiens
tgtctttcctgaaccatgtgga

SEQ ID NO: 4677764 - DNA, 10 bp, Homo sapiens
tgtctttgcg

SEQ ID NO: 4677765 - DNA, 21 bp, Homo sapiens
tgtctttgcggggcctgtctc

SEQ ID NO: 4677766 - DNA, 17 bp, Homo sapiens
tgtcttttgttctctga

SEQ ID NO: 4677767 - DNA, 13 bp, Homo sapiens
tgtgaaaaattaa

SEQ ID NO: 4677768 - DNA, 23 bp, Homo sapiens
tgtgaaagaatcagtaggaccag

SEQ ID NO: 4677769 - DNA, 15 bp, Homo sapiens
tgtgaaatctgtctt

SEQ ID NO: 4677770 - DNA, 19 bp, Homo sapiens
tgtgaacagctttgtatgt

SEQ ID NO: 4677771 - DNA, 18 bp, Homo sapiens
tgcgcaccaggctgagcc

SEQ ID NO: 4677772 - DNA, 16 bp, Homo sapiens
tgcgcgctatcccctc

SEQ ID NO: 4677773 - DNA, 16 bp, Homo sapiens
tgcggatcctgctggg

SEQ ID NO: 4677774 - DNA, 15 bp, Homo sapiens
tgcgggaaattcagt

SEQ ID NO: 4677775 - DNA, 15 bp, Homo sapiens
tgcggtagccagcac

SEQ ID NO: 4677776 - DNA, 16 bp, Homo sapiens
tgcggtagccagcaca

SEQ ID NO: 4677777 - DNA, 18 bp, Homo sapiens
tgcggtagccagcacaca

SEQ ID NO: 4677778 - DNA, 17 bp, Homo sapiens
tgcgtaaggatgtgtga

SEQ ID NO: 4677779 - DNA, 17 bp, Homo sapiens
tgcgtacacagagaagg

SEQ ID NO: 4677780 - DNA, 15 bp, Homo sapiens
tgcgtcccagctgaa

SEQ ID NO: 4677781 - DNA, 18 bp, Homo sapiens
tgcgtcccagctgaaggc

SEQ ID NO: 4677782 - DNA, 21 bp, Homo sapiens
tgcgtcccagctgaaggcagt

SEQ ID NO: 4677783 - DNA, 18 bp, Homo sapiens
tgcgtgccgtgtgagtgt

SEQ ID NO: 4677784 - DNA, 23 bp, Homo sapiens
tgcgtgccgtgtgagtgtgacag

SEQ ID NO: 4677785 - DNA, 22 bp, Homo sapiens
tgcgtggactctgcacatgtct

SEQ ID NO: 4677786 - DNA, 11 bp, Homo sapiens
tgcgtgggcag

SEQ ID NO: 4677787 - DNA, 16 bp, Homo sapiens
tgcgtgggcagaggaa

SEQ ID NO: 4677788 - DNA, 21 bp, Homo sapiens
tgcgtgggtggggagggaggt

SEQ ID NO: 4677789 - DNA, 13 bp, Homo sapiens
tgctaaactactg

SEQ ID NO: 4677790 - DNA, 17 bp, Homo sapiens
tgctaaagccttcctat

SEQ ID NO: 4677791 - DNA, 14 bp, Homo sapiens
tgctaaatgtgagt

SEQ ID NO: 4677792 - DNA, 19 bp, Homo sapiens
tgctaaatgtgagtatttc

SEQ ID NO: 4677793 - DNA, 20 bp, Homo sapiens
tgctaatcaaagccagggtc

SEQ ID NO: 4677794 - DNA, 18 bp, Homo sapiens
tgctaatgcaaattaaaa

SEQ ID NO: 4677795 - DNA, 18 bp, Homo sapiens
tgctacgtgtgaaatctg

SEQ ID NO: 4677796 - DNA, 16 bp, Homo sapiens
tgctagcacatgccct

SEQ ID NO: 4677797 - DNA, 20 bp, Homo sapiens
tgctagcccttcaagtgcac

SEQ ID NO: 4677798 - DNA, 20 bp, Homo sapiens
tgctagggttaggaggtcct

SEQ ID NO: 4677799 - DNA, 23 bp, Homo sapiens
tgctagtcgcccctcagagcatg

SEQ ID NO: 4677800 - DNA, 20 bp, Homo sapiens
tgctatggcaggataagaaa

SEQ ID NO: 4677801 - DNA, 16 bp, Homo sapiens
tgctatgttctgtctt

SEQ ID NO: 4677802 - DNA, 17 bp, Homo sapiens
tgctatgttctgtcttc

SEQ ID NO: 4677803 - DNA, 22 bp, Homo sapiens
tgctatgttctgtcttcccaaa

SEQ ID NO: 4677804 - DNA, 15 bp, Homo sapiens
tgctattctagagct

SEQ ID NO: 4677805 - DNA, 17 bp, Homo sapiens
tgctatttgaacaagtg

SEQ ID NO: 4677806 - DNA, 20 bp, Homo sapiens
tgctatttgaacaagtgggc

SEQ ID NO: 4677807 - DNA, 18 bp, Homo sapiens
tgctcagctctgggccat

SEQ ID NO: 4677808 - DNA, 20 bp, Homo sapiens
tgctcagctctgggccattc

SEQ ID NO: 4677809 - DNA, 16 bp, Homo sapiens
tgctcatgagctcctg

SEQ ID NO: 4677810 - DNA, 17 bp, Homo sapiens
tgctcatgagctcctga

SEQ ID NO: 4677811 - DNA, 20 bp, Homo sapiens
tgctcatgagctcctgatca

SEQ ID NO: 4677812 - DNA, 17 bp, Homo sapiens
tgctcattcttcagttc

SEQ ID NO: 4677813 - DNA, 14 bp, Homo sapiens
tgctcccaggatct

SEQ ID NO: 4677814 - DNA, 17 bp, Homo sapiens
tgctcccctacttctca

SEQ ID NO: 4677815 - DNA, 12 bp, Homo sapiens
tgctccctgtgt

SEQ ID NO: 4677816 - DNA, 17 bp, Homo sapiens
tgctccctgtgtccacc

SEQ ID NO: 4677817 - DNA, 19 bp, Homo sapiens
tgctccttcagttctgctt

SEQ ID NO: 4677818 - DNA, 17 bp, Homo sapiens
tgctcggggtgcacagg

SEQ ID NO: 4677819 - DNA, 21 bp, Homo sapiens
tgctcggggtgcacaggaggg

SEQ ID NO: 4677820 - DNA, 16 bp, Homo sapiens
tgctctaagcccagga

SEQ ID NO: 4677821 - DNA, 18 bp, Homo sapiens
tgctctagtgggacagcc

SEQ ID NO: 4677822 - DNA, 14 bp, Homo sapiens
tgctctcactgttt

SEQ ID NO: 4677823 - DNA, 18 bp, Homo sapiens
tgctctgcccaggcaagg

SEQ ID NO: 4677824 - DNA, 12 bp, Homo sapiens
tgctctggaata

SEQ ID NO: 4677825 - DNA, 19 bp, Homo sapiens
tgctctttcacctgggtgt

SEQ ID NO: 4677826 - DNA, 17 bp, Homo sapiens
tgctctttccacttgcc

SEQ ID NO: 4677827 - DNA, 23 bp, Homo sapiens
tgctgaatgcctcgctcccttca

SEQ ID NO: 4677828 - DNA, 14 bp, Homo sapiens
tgctgacagacact

SEQ ID NO: 4677829 - DNA, 19 bp, Homo sapiens
tgctgagaacctggccttc

SEQ ID NO: 4677830 - DNA, 20 bp, Homo sapiens
tgctgagaacctggccttca

SEQ ID NO: 4677831 - DNA, 13 bp, Homo sapiens
tgctgagctctga

SEQ ID NO: 4677832 - DNA, 17 bp, Homo sapiens
tgctgagctctgagagg

SEQ ID NO: 4677833 - DNA, 21 bp, Homo sapiens
tgctgagctctgagaggccct

SEQ ID NO: 4677834 - DNA, 16 bp, Homo sapiens
tgctgcaaaggagaag

SEQ ID NO: 4677835 - DNA, 16 bp, Homo sapiens
tgctgcaatacattaa

SEQ ID NO: 4677836 - DNA, 23 bp, Homo sapiens
tgctgcacaccaaggccctgcat

SEQ ID NO: 4677837 - DNA, 14 bp, Homo sapiens
tgctgcactaattg

SEQ ID NO: 4677838 - DNA, 14 bp, Homo sapiens
tgctgcattttata

SEQ ID NO: 4677839 - DNA, 19 bp, Homo sapiens
tgctgccaaggtggaggga

SEQ ID NO: 4677840 - DNA, 13 bp, Homo sapiens
tgctgcctgggta

SEQ ID NO: 4677841 - DNA, 16 bp, Homo sapiens
tgctgcggagcaagag

SEQ ID NO: 4677842 - DNA, 13 bp, Homo sapiens
tgctgctgagaac

SEQ ID NO: 4677843 - DNA, 16 bp, Homo sapiens
tgctgctgagaacctg

SEQ ID NO: 4677844 - DNA, 21 bp, Homo sapiens
tgctgctgagaacctggcctt

SEQ ID NO: 4677845 - DNA, 13 bp, Homo sapiens
tgctgctgtgcag

SEQ ID NO: 4677846 - DNA, 18 bp, Homo sapiens
tgctgctgtgcagcatgg

SEQ ID NO: 4677847 - DNA, 22 bp, Homo sapiens
tgctgctttttctgcgcttcag

SEQ ID NO: 4677848 - DNA, 17 bp, Homo sapiens
tgctggaagaaactaaa

SEQ ID NO: 4677849 - DNA, 14 bp, Homo sapiens
tgctggaggcagag

SEQ ID NO: 4677850 - DNA, 14 bp, Homo sapiens
tgctgggccactgg

SEQ ID NO: 4677851 - DNA, 13 bp, Homo sapiens
tgctgggcctggg

SEQ ID NO: 4677852 - DNA, 14 bp, Homo sapiens
tgctgggcctgggg

SEQ ID NO: 4677853 - DNA, 15 bp, Homo sapiens
tgctgggcctggggg

SEQ ID NO: 4677854 - DNA, 13 bp, Homo sapiens
tgctgggctctgc

SEQ ID NO: 4677855 - DNA, 19 bp, Homo sapiens
tgctgggctgacggtgcag

SEQ ID NO: 4677856 - DNA, 18 bp, Homo sapiens
tgctgggggtgagctgta

SEQ ID NO: 4677857 - DNA, 19 bp, Homo sapiens
tgctgtaaatttggcttct

SEQ ID NO: 4677858 - DNA, 23 bp, Homo sapiens
tgctgtcacctcgctgggctcta

SEQ ID NO: 4677859 - DNA, 22 bp, Homo sapiens
tgctgtcctgtttctgtcaagc

SEQ ID NO: 4677860 - DNA, 18 bp, Homo sapiens
tgctgtcttttgttctct

SEQ ID NO: 4677861 - DNA, 12 bp, Homo sapiens
tgctgtgcattt

SEQ ID NO: 4677862 - DNA, 19 bp, Homo sapiens
tgctgtgccatgctgggcc

SEQ ID NO: 4677863 - DNA, 13 bp, Homo sapiens
tgctgtgccccac

SEQ ID NO: 4677864 - DNA, 14 bp, Homo sapiens
tgctgtgccccacc

SEQ ID NO: 4677865 - DNA, 16 bp, Homo sapiens
tgctgtttctaagaaa

SEQ ID NO: 4677866 - DNA, 18 bp, Homo sapiens
tgctgttttattactgtt

SEQ ID NO: 4677867 - DNA, 21 bp, Homo sapiens
tgctgttttattactgtttct

SEQ ID NO: 4677868 - DNA, 12 bp, Homo sapiens
tgcttaaaagaa

SEQ ID NO: 4677869 - DNA, 16 bp, Homo sapiens
tgcttagagactatca

SEQ ID NO: 4677870 - DNA, 21 bp, Homo sapiens
tgcttattgatgaggtttatt

SEQ ID NO: 4677871 - DNA, 23 bp, Homo sapiens
tgcttcattattcaagaatgaaa

SEQ ID NO: 4677872 - DNA, 15 bp, Homo sapiens
tgcttccacctcacc

SEQ ID NO: 4677873 - DNA, 18 bp, Homo sapiens
tgcttccacctcacccca

SEQ ID NO: 4677874 - DNA, 19 bp, Homo sapiens
tgcttccttggttcatgct

SEQ ID NO: 4677875 - DNA, 14 bp, Homo sapiens
tgcttctactgtga

SEQ ID NO: 4677876 - DNA, 19 bp, Homo sapiens
tgcttctactgtgacactt

SEQ ID NO: 4677877 - DNA, 18 bp, Homo sapiens
tgcttctatcagactcag

SEQ ID NO: 4677878 - DNA, 10 bp, Homo sapiens
tgcttctcta

SEQ ID NO: 4677879 - DNA, 13 bp, Homo sapiens
tgcttctgggaga

SEQ ID NO: 4677880 - DNA, 21 bp, Homo sapiens
tgcttgagccaggaggcctgc

SEQ ID NO: 4677881 - DNA, 16 bp, Homo sapiens
tgcttgcataagagct

SEQ ID NO: 4677882 - DNA, 14 bp, Homo sapiens
tgcataatgtttaa

SEQ ID NO: 4677883 - DNA, 17 bp, Homo sapiens
tgcatactgaaaatcca

SEQ ID NO: 4677884 - DNA, 19 bp, Homo sapiens
tgcatatgtcactagaatg

SEQ ID NO: 4677885 - DNA, 16 bp, Homo sapiens
tgcatatttataagag

SEQ ID NO: 4677886 - DNA, 17 bp, Homo sapiens
tgcatatttataagaga

SEQ ID NO: 4677887 - DNA, 18 bp, Homo sapiens
tgcatatttataagagaa

SEQ ID NO: 4677888 - DNA, 15 bp, Homo sapiens
tgcatcattactgtt

SEQ ID NO: 4677889 - DNA, 19 bp, Homo sapiens
tgcatcattactgttccag

SEQ ID NO: 4677890 - DNA, 16 bp, Homo sapiens
tgcatctgtctgctct

SEQ ID NO: 4677891 - DNA, 20 bp, Homo sapiens
tgcatctgtctgctctgcat

SEQ ID NO: 4677892 - DNA, 12 bp, Homo sapiens
tgcatgagctga

SEQ ID NO: 4677893 - DNA, 22 bp, Homo sapiens
tgcatgagctgatcagcctgtg

SEQ ID NO: 4677894 - DNA, 13 bp, Homo sapiens
tgcatggaggccc

SEQ ID NO: 4677895 - DNA, 12 bp, Homo sapiens
tgcatgtgaaga

SEQ ID NO: 4677896 - DNA, 16 bp, Homo sapiens
tgcatgtgaagaaagg

SEQ ID NO: 4677897 - DNA, 16 bp, Homo sapiens
tgcattatcttgctca

SEQ ID NO: 4677898 - DNA, 15 bp, Homo sapiens
tgcattattctcttt

SEQ ID NO: 4677899 - DNA, 21 bp, Homo sapiens
tgcattctctcccatcctggg

SEQ ID NO: 4677900 - DNA, 12 bp, Homo sapiens
tgcattgaaaaa

SEQ ID NO: 4677901 - DNA, 19 bp, Homo sapiens
tgcattgaaaaatttctaa

SEQ ID NO: 4677902 - DNA, 14 bp, Homo sapiens
tgcattgacctgga

SEQ ID NO: 4677903 - DNA, 20 bp, Homo sapiens
tgcattgacctggaggggag

SEQ ID NO: 4677904 - DNA, 14 bp, Homo sapiens
tgcattgactttca

SEQ ID NO: 4677905 - DNA, 21 bp, Homo sapiens
tgcattgactttcagtaaaca

SEQ ID NO: 4677906 - DNA, 17 bp, Homo sapiens
tgcattgagcatatttt

SEQ ID NO: 4677907 - DNA, 18 bp, Homo sapiens
tgcattgtatcgatgtta

SEQ ID NO: 4677908 - DNA, 22 bp, Homo sapiens
tgcatttagcttctttccctta

SEQ ID NO: 4677909 - DNA, 19 bp, Homo sapiens
tgcattttttttttcattg

SEQ ID NO: 4677910 - DNA, 19 bp, Homo sapiens
tgccaaattctccggtttg

SEQ ID NO: 4677911 - DNA, 15 bp, Homo sapiens
tgccaacaatcctag

SEQ ID NO: 4677912 - DNA, 21 bp, Homo sapiens
tgccaacaatcctagtgcttt

SEQ ID NO: 4677913 - DNA, 20 bp, Homo sapiens
tgccaagagtcaacaggtca

SEQ ID NO: 4677914 - DNA, 12 bp, Homo sapiens
tgccaagccaga

SEQ ID NO: 4677915 - DNA, 13 bp, Homo sapiens
tgccaagccagat

SEQ ID NO: 4677916 - DNA, 22 bp, Homo sapiens
tgccaagctaatttatagcaag

SEQ ID NO: 4677917 - DNA, 21 bp, Homo sapiens
tgccaagtccaggtcctggtg

SEQ ID NO: 4677918 - DNA, 15 bp, Homo sapiens
tgccacacctggcct

SEQ ID NO: 4677919 - DNA, 22 bp, Homo sapiens
tgccacatttatttttatatct

SEQ ID NO: 4677920 - DNA, 14 bp, Homo sapiens
tgccacattttctt

SEQ ID NO: 4677921 - DNA, 13 bp, Homo sapiens
tgccacccccagc

SEQ ID NO: 4677922 - DNA, 16 bp, Homo sapiens
tgccacccccagccct

SEQ ID NO: 4677923 - DNA, 21 bp, Homo sapiens
tgccacccccagccctggccc

SEQ ID NO: 4677924 - DNA, 15 bp, Homo sapiens
tgccacccccagttc

SEQ ID NO: 4677925 - DNA, 21 bp, Homo sapiens
tgccacccccagttcctatga

SEQ ID NO: 4677926 - DNA, 15 bp, Homo sapiens
tgccaccggcctgtg

SEQ ID NO: 4677927 - DNA, 22 bp, Homo sapiens
tgccaccggcctgtgggtctct

SEQ ID NO: 4677928 - DNA, 14 bp, Homo sapiens
tgccacgtcatgag

SEQ ID NO: 4677929 - DNA, 16 bp, Homo sapiens
tgccactaacttctaa

SEQ ID NO: 4677930 - DNA, 18 bp, Homo sapiens
tgccactgcactccagcc

SEQ ID NO: 4677931 - DNA, 13 bp, Homo sapiens
tgccagaaagtcc

SEQ ID NO: 4677932 - DNA, 19 bp, Homo sapiens
tgccagaaagtcccccctc

SEQ ID NO: 4677933 - DNA, 13 bp, Homo sapiens
tgccagactctag

SEQ ID NO: 4677934 - DNA, 19 bp, Homo sapiens
tgccagactctaggttata

SEQ ID NO: 4677935 - DNA, 11 bp, Homo sapiens
tgccagagcct

SEQ ID NO: 4677936 - DNA, 13 bp, Homo sapiens
tgccagagcctgg

SEQ ID NO: 4677937 - DNA, 15 bp, Homo sapiens
tgccagagcctgggg

SEQ ID NO: 4677938 - DNA, 11 bp, Homo sapiens
tgccagcagga

SEQ ID NO: 4677939 - DNA, 19 bp, Homo sapiens
tgatgtaagtttacctatg

SEQ ID NO: 4677940 - DNA, 21 bp, Homo sapiens
tgatgtgaagagtttcacaaa

SEQ ID NO: 4677941 - DNA, 14 bp, Homo sapiens
tgatgtggaggaag

SEQ ID NO: 4677942 - DNA, 19 bp, Homo sapiens
tgatgtttccctctccttc

SEQ ID NO: 4677943 - DNA, 22 bp, Homo sapiens
tgatgttttatccttacaatgt

SEQ ID NO: 4677944 - DNA, 19 bp, Homo sapiens
tgattaaatatttgaagag

SEQ ID NO: 4677945 - DNA, 16 bp, Homo sapiens
tgattaatgttttcat

SEQ ID NO: 4677946 - DNA, 17 bp, Homo sapiens
tgattaatgttttcatt

SEQ ID NO: 4677947 - DNA, 20 bp, Homo sapiens
tgattaatgttttcattatg

SEQ ID NO: 4677948 - DNA, 21 bp, Homo sapiens
tgattatagcaactaatgttt

SEQ ID NO: 4677949 - DNA, 13 bp, Homo sapiens
tgattatcttgaa

SEQ ID NO: 4677950 - DNA, 14 bp, Homo sapiens
tgattatcttgaaa

SEQ ID NO: 4677951 - DNA, 15 bp, Homo sapiens
tgattatcttgaaaa

SEQ ID NO: 4677952 - DNA, 15 bp, Homo sapiens
tgattattttagcta

SEQ ID NO: 4677953 - DNA, 20 bp, Homo sapiens
tgattcagactttcacacca

SEQ ID NO: 4677954 - DNA, 21 bp, Homo sapiens
tgattcagcattttttatcag

SEQ ID NO: 4677955 - DNA, 17 bp, Homo sapiens
tgattcataataaatat

SEQ ID NO: 4677956 - DNA, 19 bp, Homo sapiens
tgattgctcccaggatctc

SEQ ID NO: 4677957 - DNA, 22 bp, Homo sapiens
tgatttacatatattatttatt

SEQ ID NO: 4677958 - DNA, 15 bp, Homo sapiens
tgatttcaaaatcag

SEQ ID NO: 4677959 - DNA, 14 bp, Homo sapiens
tgatttctaattgt

SEQ ID NO: 4677960 - DNA, 20 bp, Homo sapiens
tgatttctttaaaagaatga

SEQ ID NO: 4677961 - DNA, 18 bp, Homo sapiens
tgatttgtctcatatatt

SEQ ID NO: 4677962 - DNA, 15 bp, Homo sapiens
tgattttaactctgt

SEQ ID NO: 4677963 - DNA, 16 bp, Homo sapiens
tgattttgctgtagaa

SEQ ID NO: 4677964 - DNA, 22 bp, Homo sapiens
tgcaaaatctgttatagcttta

SEQ ID NO: 4677965 - DNA, 12 bp, Homo sapiens
tgcaaaatggaa

SEQ ID NO: 4677966 - DNA, 12 bp, Homo sapiens
tgcaaaatgtct

SEQ ID NO: 4677967 - DNA, 13 bp, Homo sapiens
tgcaaaatgtctt

SEQ ID NO: 4677968 - DNA, 17 bp, Homo sapiens
tgcaaaatgtcttgtgt

SEQ ID NO: 4677969 - DNA, 21 bp, Homo sapiens
tgcaaaatgtcttgtgtattt

SEQ ID NO: 4677970 - DNA, 22 bp, Homo sapiens
tgcaaaattaaatctagacatt

SEQ ID NO: 4677971 - DNA, 17 bp, Homo sapiens
tgcaaacagaacagggt

SEQ ID NO: 4677972 - DNA, 22 bp, Homo sapiens
tgcaaaccctggtggtatttta

SEQ ID NO: 4677973 - DNA, 20 bp, Homo sapiens
tgcaaagaactccagagtca

SEQ ID NO: 4677974 - DNA, 13 bp, Homo sapiens
tgcaaaggagaag

SEQ ID NO: 4677975 - DNA, 20 bp, Homo sapiens
tgcaaaggagaagcacagct

SEQ ID NO: 4677976 - DNA, 15 bp, Homo sapiens
tgcaaagtggcaggg

SEQ ID NO: 4677977 - DNA, 16 bp, Homo sapiens
tgcaaagtggcaggga

SEQ ID NO: 4677978 - DNA, 10 bp, Homo sapiens
tgcaaatcct

SEQ ID NO: 4677979 - DNA, 22 bp, Homo sapiens
tgcaaattaaaacatatttcat

SEQ ID NO: 4677980 - DNA, 14 bp, Homo sapiens
tgcaaatttctata

SEQ ID NO: 4677981 - DNA, 22 bp, Homo sapiens
tgcaaatttctataaatttaag

SEQ ID NO: 4677982 - DNA, 14 bp, Homo sapiens
tgcaacctctgcct

SEQ ID NO: 4677983 - DNA, 15 bp, Homo sapiens
tgcaacctctgcctc

SEQ ID NO: 4677984 - DNA, 23 bp, Homo sapiens
tgcaacctctgcctcctgggttc

SEQ ID NO: 4677985 - DNA, 19 bp, Homo sapiens
tgcaacctctgcttcccag

SEQ ID NO: 4677986 - DNA, 21 bp, Homo sapiens
tgcaacctctgcttcccaggt

SEQ ID NO: 4677987 - DNA, 18 bp, Homo sapiens
tgcaacctcttggcctga

SEQ ID NO: 4677988 - DNA, 15 bp, Homo sapiens
tgcaaccttttatgt

SEQ ID NO: 4677989 - DNA, 18 bp, Homo sapiens
tgcaactaggtatttcta

SEQ ID NO: 4677990 - DNA, 19 bp, Homo sapiens
tgcaactaggtatttctaa

SEQ ID NO: 4677991 - DNA, 21 bp, Homo sapiens
tgcaagatggacacgagccac

SEQ ID NO: 4677992 - DNA, 23 bp, Homo sapiens
tgaacaagtgggccattagccag

SEQ ID NO: 4677993 - DNA, 22 bp, Homo sapiens
tgaacagctttgtatgtttatg

SEQ ID NO: 4677994 - DNA, 14 bp, Homo sapiens
tgaacattccagag

SEQ ID NO: 4677995 - DNA, 12 bp, Homo sapiens
tgaaccctgccc

SEQ ID NO: 4677996 - DNA, 17 bp, Homo sapiens
tgaactaggctgagcaa

SEQ ID NO: 4677997 - DNA, 16 bp, Homo sapiens
tgaactcatcattttt

SEQ ID NO: 4677998 - DNA, 13 bp, Homo sapiens
tgaactctcccct

SEQ ID NO: 4677999 - DNA, 21 bp, Homo sapiens
tgaactgacaggcagcctgga

SEQ ID NO: 4678000 - DNA, 12 bp, Homo sapiens
tgaactgtgtgt

SEQ ID NO: 4678001 - DNA, 17 bp, Homo sapiens
tgaacttgactgggtga

SEQ ID NO: 4678002 - DNA, 21 bp, Homo sapiens
tgaagaaagtcaaaaaattat

SEQ ID NO: 4678003 - DNA, 16 bp, Homo sapiens
tgaagactgagaactt

SEQ ID NO: 4678004 - DNA, 15 bp, Homo sapiens
tgaagcataaagtta

SEQ ID NO: 4678005 - DNA, 18 bp, Homo sapiens
tgaagcataaagttacct

SEQ ID NO: 4678006 - DNA, 17 bp, Homo sapiens
tgaagccgactctggcc

SEQ ID NO: 4678007 - DNA, 15 bp, Homo sapiens
tgaagcgaacatctt

SEQ ID NO: 4678008 - DNA, 19 bp, Homo sapiens
tgaagcgaacatcttcata

SEQ ID NO: 4678009 - DNA, 15 bp, Homo sapiens
tgaagctgttgtgtg

SEQ ID NO: 4678010 - DNA, 19 bp, Homo sapiens
tgaagctgttgtgtgaggt

SEQ ID NO: 4678011 - DNA, 22 bp, Homo sapiens
tgaaggaaaagcaagaaacagt

SEQ ID NO: 4678012 - DNA, 18 bp, Homo sapiens
tgaagggggcggcctatg

SEQ ID NO: 4678013 - DNA, 16 bp, Homo sapiens
tgaagtaaattaaaca

SEQ ID NO: 4678014 - DNA, 18 bp, Homo sapiens
tgaagtaacatgcatact

SEQ ID NO: 4678015 - DNA, 16 bp, Homo sapiens
tgaagtatggtgtgtt

SEQ ID NO: 4678016 - DNA, 19 bp, Homo sapiens
tgaagtctagaatcatact

SEQ ID NO: 4678017 - DNA, 21 bp, Homo sapiens
tgaagtgcgtgaatgtatgta

SEQ ID NO: 4678018 - DNA, 18 bp, Homo sapiens
tgaagtggttgcattcta

SEQ ID NO: 4678019 - DNA, 15 bp, Homo sapiens
tgaagttgtggagga

SEQ ID NO: 4678020 - DNA, 15 bp, Homo sapiens
tgaataacatttaaa

SEQ ID NO: 4678021 - DNA, 23 bp, Homo sapiens
tgaataagcagaacatactgttc

SEQ ID NO: 4678022 - DNA, 22 bp, Homo sapiens
tgaataatgaaaataaaacaca

SEQ ID NO: 4678023 - DNA, 16 bp, Homo sapiens
tgaatacttattttca

SEQ ID NO: 4678024 - DNA, 16 bp, Homo sapiens
tgaatatattttatct

SEQ ID NO: 4678025 - DNA, 13 bp, Homo sapiens
tgaatcaaaacaa

SEQ ID NO: 4678026 - DNA, 23 bp, Homo sapiens
tgaatcacgtaaagctagaaatg

SEQ ID NO: 4678027 - DNA, 14 bp, Homo sapiens
tgaatcatgtctgt

SEQ ID NO: 4678028 - DNA, 15 bp, Homo sapiens
tgaatcatgtctgta

SEQ ID NO: 4678029 - DNA, 16 bp, Homo sapiens
tgaatccatgggtctg

SEQ ID NO: 4678030 - DNA, 20 bp, Homo sapiens
tgaatccatgggtctggcta

SEQ ID NO: 4678031 - DNA, 15 bp, Homo sapiens
tgaatgcacgtttca

SEQ ID NO: 4678032 - DNA, 16 bp, Homo sapiens
tgaatgcataatgttt

SEQ ID NO: 4678033 - DNA, 16 bp, Homo sapiens
tgaatgcctcctgtgg

SEQ ID NO: 4678034 - DNA, 17 bp, Homo sapiens
tgaatgcctcctgtggg

SEQ ID NO: 4678035 - DNA, 18 bp, Homo sapiens
tgaatgcctcctgtgggg

SEQ ID NO: 4678036 - DNA, 18 bp, Homo sapiens
tgaatgcctcgctccctt

SEQ ID NO: 4678037 - DNA, 23 bp, Homo sapiens
tgaatggggaagggagtctctct

SEQ ID NO: 4678038 - DNA, 20 bp, Homo sapiens
tgaatgtatgtaatgtgtgg

SEQ ID NO: 4678039 - DNA, 21 bp, Homo sapiens
tgaatgtgggcactggcccag

SEQ ID NO: 4678040 - DNA, 16 bp, Homo sapiens
tgaatgtggtctcagg

SEQ ID NO: 4678041 - DNA, 19 bp, Homo sapiens
tgaatgtttgtgtctgtgg

SEQ ID NO: 4678042 - DNA, 21 bp, Homo sapiens
tgaatgtttgtgtctgtggtt

SEQ ID NO: 4678043 - DNA, 23 bp, Homo sapiens
tgaattataaatgtgtttatagc

SEQ ID NO: 4678044 - DNA, 18 bp, Homo sapiens
tgaattcatactctgttg

SEQ ID NO: 4678045 - DNA, 17 bp, Homo sapiens
tgaattggctatgcagt

SEQ ID NO: 4678046 - DNA, 17 bp, Homo sapiens
tgaattggtttttccca

SEQ ID NO: 4678047 - DNA, 17 bp, Homo sapiens
tgaattttcaaggcctt

SEQ ID NO: 4678048 - DNA, 18 bp, Homo sapiens
tgaattttcaaggccttc

SEQ ID NO: 4678049 - DNA, 19 bp, Homo sapiens
tgaattttcaaggccttca

SEQ ID NO: 4678050 - DNA, 15 bp, Homo sapiens
tgaattttctgtgtt

SEQ ID NO: 4678051 - DNA, 21 bp, Homo sapiens
tgacaaaaaatgttttaaaga

SEQ ID NO: 4678052 - DNA, 21 bp, Homo sapiens
tgacaaacatgatactgctgc

SEQ ID NO: 4678053 - DNA, 17 bp, Homo sapiens
tgacaagctggccaaag

SEQ ID NO: 4678054 - DNA, 15 bp, Homo sapiens
tgagattgtactgtt

SEQ ID NO: 4678055 - DNA, 18 bp, Homo sapiens
tgagatttaacccctcca

SEQ ID NO: 4678056 - DNA, 21 bp, Homo sapiens
tgagatttaagttcctgctgc

SEQ ID NO: 4678057 - DNA, 13 bp, Homo sapiens
tgagcactgccag

SEQ ID NO: 4678058 - DNA, 17 bp, Homo sapiens
tgagcactgccaggagg

SEQ ID NO: 4678059 - DNA, 16 bp, Homo sapiens
tgagcagaatgttgta

SEQ ID NO: 4678060 - DNA, 21 bp, Homo sapiens
tgagcagctgaataacctgca

SEQ ID NO: 4678061 - DNA, 14 bp, Homo sapiens
tgagcagggccggg

SEQ ID NO: 4678062 - DNA, 16 bp, Homo sapiens
tgagcagggccgggga

SEQ ID NO: 4678063 - DNA, 13 bp, Homo sapiens
tgagcatattttc

SEQ ID NO: 4678064 - DNA, 18 bp, Homo sapiens
tgagccaaccttgctctt

SEQ ID NO: 4678065 - DNA, 23 bp, Homo sapiens
tgagccaaccttgctcttgggga

SEQ ID NO: 4678066 - DNA, 17 bp, Homo sapiens
tgagcccagggaggccg

SEQ ID NO: 4678067 - DNA, 22 bp, Homo sapiens
tgagcccctttgcctgtcaagt

SEQ ID NO: 4678068 - DNA, 14 bp, Homo sapiens
tgagcctgggctca

SEQ ID NO: 4678069 - DNA, 21 bp, Homo sapiens
tgagcgagtggatgctgtgct

SEQ ID NO: 4678070 - DNA, 22 bp, Homo sapiens
tgagcgagtggatgctgtgcta

SEQ ID NO: 4678071 - DNA, 21 bp, Homo sapiens
tgagctaaataaagatattgt

SEQ ID NO: 4678072 - DNA, 15 bp, Homo sapiens
tgagctcctgatcag

SEQ ID NO: 4678073 - DNA, 19 bp, Homo sapiens
tgagctcctgatcagaggc

SEQ ID NO: 4678074 - DNA, 18 bp, Homo sapiens
tgagctctgagaggccct

SEQ ID NO: 4678075 - DNA, 20 bp, Homo sapiens
tgagctctgagaggccctgg

SEQ ID NO: 4678076 - DNA, 18 bp, Homo sapiens
tgagctggggactcaggg

SEQ ID NO: 4678077 - DNA, 21 bp, Homo sapiens
tgagctggggactcagggacc

SEQ ID NO: 4678078 - DNA, 21 bp, Homo sapiens
tgagctgtctgaagcccaaag

SEQ ID NO: 4678079 - DNA, 19 bp, Homo sapiens
tgaggacagaaagaccctg

SEQ ID NO: 4678080 - DNA, 15 bp, Homo sapiens
tgaggacagctgtcc

SEQ ID NO: 4678081 - DNA, 15 bp, Homo sapiens
tgaggacctttatat

SEQ ID NO: 4678082 - DNA, 15 bp, Homo sapiens
tgaggactcctgagg

SEQ ID NO: 4678083 - DNA, 14 bp, Homo sapiens
tgaggagtctgagg

SEQ ID NO: 4678084 - DNA, 15 bp, Homo sapiens
tgaggagtctgaggt

SEQ ID NO: 4678085 - DNA, 16 bp, Homo sapiens
tgaggagtctgaggtc

SEQ ID NO: 4678086 - DNA, 17 bp, Homo sapiens
tgaggagtctgaggtcc

SEQ ID NO: 4678087 - DNA, 12 bp, Homo sapiens
tgaggcaataag

SEQ ID NO: 4678088 - DNA, 19 bp, Homo sapiens
tgaggcatccgtgaggcag

SEQ ID NO: 4678089 - DNA, 16 bp, Homo sapiens
tgaggccagcctggcc

SEQ ID NO: 4678090 - DNA, 18 bp, Homo sapiens
tgaggccatacttgtgaa

SEQ ID NO: 4678091 - DNA, 16 bp, Homo sapiens
tgaggccatctcagga

SEQ ID NO: 4678092 - DNA, 20 bp, Homo sapiens
tgaggcccacggtttcagct

SEQ ID NO: 4678093 - DNA, 14 bp, Homo sapiens
tgaggccccaactc

SEQ ID NO: 4678094 - DNA, 24 bp, Homo sapiens
tgaggccccaactcaagtgtcacc

SEQ ID NO: 4678095 - DNA, 23 bp, Homo sapiens
tgaggcccccgtcagggagaggt

SEQ ID NO: 4678096 - DNA, 13 bp, Homo sapiens
tgaggccctgcac

SEQ ID NO: 4678097 - DNA, 15 bp, Homo sapiens
tgaggccctgcacct

SEQ ID NO: 4678098 - DNA, 21 bp, Homo sapiens
tgaggctcaggggtgtgcctg

SEQ ID NO: 4678099 - DNA, 16 bp, Homo sapiens
tgagggaaatctgtaa

SEQ ID NO: 4678100 - DNA, 14 bp, Homo sapiens
tgagggaaggagac

SEQ ID NO: 4678101 - DNA, 12 bp, Homo sapiens
tgagggcagcag

SEQ ID NO: 4678102 - DNA, 14 bp, Homo sapiens
tgagggcagcagcc

SEQ ID NO: 4678103 - DNA, 22 bp, Homo sapiens
tgagggcagcagccagccctgc

SEQ ID NO: 4678104 - DNA, 20 bp, Homo sapiens
tgagggccttgcacatagga

SEQ ID NO: 4678105 - DNA, 15 bp, Homo sapiens
tcttcgtgaacatag

SEQ ID NO: 4678106 - DNA, 18 bp, Homo sapiens
tcttctaaaatagcaata

SEQ ID NO: 4678107 - DNA, 15 bp, Homo sapiens
tcttctctcttgatt

SEQ ID NO: 4678108 - DNA, 19 bp, Homo sapiens
tcttcttcctgaagctgag

SEQ ID NO: 4678109 - DNA, 21 bp, Homo sapiens
tcttgaaacctgttaaaacaa

SEQ ID NO: 4678110 - DNA, 16 bp, Homo sapiens
tcttgaactcctgacc

SEQ ID NO: 4678111 - DNA, 14 bp, Homo sapiens
tcttgaagtactta

SEQ ID NO: 4678112 - DNA, 12 bp, Homo sapiens
tcttgaatgtgg

SEQ ID NO: 4678113 - DNA, 19 bp, Homo sapiens
tcttgaatgtggtctcagg

SEQ ID NO: 4678114 - DNA, 20 bp, Homo sapiens
tcttgataaatgactgtttt

SEQ ID NO: 4678115 - DNA, 13 bp, Homo sapiens
tcttgattgattt

SEQ ID NO: 4678116 - DNA, 14 bp, Homo sapiens
tcttgattgatttt

SEQ ID NO: 4678117 - DNA, 11 bp, Homo sapiens
tcttgattttt

SEQ ID NO: 4678118 - DNA, 23 bp, Homo sapiens
tcttgcctgaggggaaagagaga

SEQ ID NO: 4678119 - DNA, 22 bp, Homo sapiens
tcttgctctcgaccggccctgc

SEQ ID NO: 4678120 - DNA, 13 bp, Homo sapiens
tcttgcttccaag

SEQ ID NO: 4678121 - DNA, 17 bp, Homo sapiens
tcttggaaccaccagtc

SEQ ID NO: 4678122 - DNA, 20 bp, Homo sapiens
tcttggcttaatcattttca

SEQ ID NO: 4678123 - DNA, 21 bp, Homo sapiens
tcttggcttaatcattttcat

SEQ ID NO: 4678124 - DNA, 11 bp, Homo sapiens
tcttgggaaat

SEQ ID NO: 4678125 - DNA, 19 bp, Homo sapiens
tcttgggaaatatgaatgc

SEQ ID NO: 4678126 - DNA, 14 bp, Homo sapiens
tcttgggtgaggac

SEQ ID NO: 4678127 - DNA, 22 bp, Homo sapiens
tcttggtttctctctacagtgc

SEQ ID NO: 4678128 - DNA, 17 bp, Homo sapiens
tcttgtacatgtgtagc

SEQ ID NO: 4678129 - DNA, 16 bp, Homo sapiens
tcttgtattaagttgt

SEQ ID NO: 4678130 - DNA, 17 bp, Homo sapiens
tcttgtcacccaggctg

SEQ ID NO: 4678131 - DNA, 18 bp, Homo sapiens
tcttgtcacccaggctgg

SEQ ID NO: 4678132 - DNA, 24 bp, Homo sapiens
tcttgtcacccaggctggagtgca

SEQ ID NO: 4678133 - DNA, 14 bp, Homo sapiens
tcttgtcagacata

SEQ ID NO: 4678134 - DNA, 19 bp, Homo sapiens
tcttgtcagacataaagcc

SEQ ID NO: 4678135 - DNA, 21 bp, Homo sapiens
tcttgtcagacataaagccat

SEQ ID NO: 4678136 - DNA, 23 bp, Homo sapiens
tcttgtcagacataaagccatgt

SEQ ID NO: 4678137 - DNA, 13 bp, Homo sapiens
tcttgtcagtgta

SEQ ID NO: 4678138 - DNA, 11 bp, Homo sapiens
tcttgtgtatt

SEQ ID NO: 4678139 - DNA, 18 bp, Homo sapiens
tcttgtgtatttctctgt

SEQ ID NO: 4678140 - DNA, 10 bp, Homo sapiens
tcttgtgtta

SEQ ID NO: 4678141 - DNA, 13 bp, Homo sapiens
tcttgtgttaact

SEQ ID NO: 4678142 - DNA, 15 bp, Homo sapiens
tcttgtgttaacttg

SEQ ID NO: 4678143 - DNA, 12 bp, Homo sapiens
tcttgtgtttct

SEQ ID NO: 4678144 - DNA, 22 bp, Homo sapiens
tcttgttcattttgagtatttt

SEQ ID NO: 4678145 - DNA, 16 bp, Homo sapiens
tcttgttgaagtgctg

SEQ ID NO: 4678146 - DNA, 15 bp, Homo sapiens
tctttaaaagaatga

SEQ ID NO: 4678147 - DNA, 22 bp, Homo sapiens
tctttaacatacaagaaaatgt

SEQ ID NO: 4678148 - DNA, 24 bp, Homo sapiens
tctttaattccttatcctagcctt

SEQ ID NO: 4678149 - DNA, 20 bp, Homo sapiens
tctttacaaactgaagataa

SEQ ID NO: 4678150 - DNA, 15 bp, Homo sapiens
tctttactattaaaa

SEQ ID NO: 4678151 - DNA, 15 bp, Homo sapiens
tctttagaccctcgg

SEQ ID NO: 4678152 - DNA, 15 bp, Homo sapiens
tctttagtttttgtg

SEQ ID NO: 4678153 - DNA, 19 bp, Homo sapiens
tctttataattgaattggt

SEQ ID NO: 4678154 - DNA, 17 bp, Homo sapiens
tctttcagctatcagta

SEQ ID NO: 4678155 - DNA, 18 bp, Homo sapiens
tctttcagctatcagtag

SEQ ID NO: 4678156 - DNA, 21 bp, Homo sapiens
tctttcagtacttttttaaat

SEQ ID NO: 4678157 - DNA, 22 bp, Homo sapiens
tctttccaaattaaaacaaata

SEQ ID NO: 4678158 - DNA, 23 bp, Homo sapiens
tctttccccaaggacccagccct

SEQ ID NO: 4678159 - DNA, 13 bp, Homo sapiens
tctttccggccaa

SEQ ID NO: 4678160 - DNA, 16 bp, Homo sapiens
tctttcctgaaccatg

SEQ ID NO: 4678161 - DNA, 16 bp, Homo sapiens
tctttctgtttcctgg

SEQ ID NO: 4678162 - DNA, 24 bp, Homo sapiens
tctttctgtttcctggcctcagag

SEQ ID NO: 4678163 - DNA, 16 bp, Homo sapiens
tctttgaattttctgt

SEQ ID NO: 4678164 - DNA, 22 bp, Homo sapiens
tctttgcggggcctgtctcagt

SEQ ID NO: 4678165 - DNA, 14 bp, Homo sapiens
tctttgtatcttaa

SEQ ID NO: 4678166 - DNA, 18 bp, Homo sapiens
tctttgtatcttaaatct

SEQ ID NO: 4678167 - DNA, 13 bp, Homo sapiens
tctttgtctaaaa

SEQ ID NO: 4678168 - DNA, 14 bp, Homo sapiens
tctttgtttaacaa

SEQ ID NO: 4678169 - DNA, 15 bp, Homo sapiens
tctttgtttaacaaa

SEQ ID NO: 4678170 - DNA, 15 bp, Homo sapiens
tctttgtttacatga

SEQ ID NO: 4678171 - DNA, 14 bp, Homo sapiens
tctgccagcaggaa

SEQ ID NO: 4678172 - DNA, 13 bp, Homo sapiens
tctgccatcaact

SEQ ID NO: 4678173 - DNA, 10 bp, Homo sapiens
tctgccccag

SEQ ID NO: 4678174 - DNA, 12 bp, Homo sapiens
tctgccccttcc

SEQ ID NO: 4678175 - DNA, 18 bp, Homo sapiens
tctgccccttccccatga

SEQ ID NO: 4678176 - DNA, 17 bp, Homo sapiens
tctgcctctatttttgt

SEQ ID NO: 4678177 - DNA, 10 bp, Homo sapiens
tctgcctggc

SEQ ID NO: 4678178 - DNA, 18 bp, Homo sapiens
tctgcctgggatgccctt

SEQ ID NO: 4678179 - DNA, 20 bp, Homo sapiens
tctgcctgggcaatggccag

SEQ ID NO: 4678180 - DNA, 23 bp, Homo sapiens
tctgcctgggcaatggccagggg

SEQ ID NO: 4678181 - DNA, 11 bp, Homo sapiens
tctgctctgat

SEQ ID NO: 4678182 - DNA, 17 bp, Homo sapiens
tctgctgtcctgtttct

SEQ ID NO: 4678183 - DNA, 15 bp, Homo sapiens
tctgctgtttacaac

SEQ ID NO: 4678184 - DNA, 17 bp, Homo sapiens
tctgctgtttacaacat

SEQ ID NO: 4678185 - DNA, 12 bp, Homo sapiens
tctgcttccgtt

SEQ ID NO: 4678186 - DNA, 14 bp, Homo sapiens
tctgcttgctccca

SEQ ID NO: 4678187 - DNA, 18 bp, Homo sapiens
tctgcttgctcccaagcc

SEQ ID NO: 4678188 - DNA, 16 bp, Homo sapiens
tctgcttttcctctgc

SEQ ID NO: 4678189 - DNA, 20 bp, Homo sapiens
tctggaaacctctacatatt

SEQ ID NO: 4678190 - DNA, 15 bp, Homo sapiens
tctggaaaggaggaa

SEQ ID NO: 4678191 - DNA, 16 bp, Homo sapiens
tctggaaaggaggaag

SEQ ID NO: 4678192 - DNA, 22 bp, Homo sapiens
tctggactgctattctagagct

SEQ ID NO: 4678193 - DNA, 21 bp, Homo sapiens
tctggagctggcactgtggag

SEQ ID NO: 4678194 - DNA, 22 bp, Homo sapiens
tctggcagccacacttctcagg

SEQ ID NO: 4678195 - DNA, 13 bp, Homo sapiens
tctggccctggcc

SEQ ID NO: 4678196 - DNA, 15 bp, Homo sapiens
tctggccctggccct

SEQ ID NO: 4678197 - DNA, 18 bp, Homo sapiens
tctggctagagggcccaa

SEQ ID NO: 4678198 - DNA, 13 bp, Homo sapiens
tctggctccctgc

SEQ ID NO: 4678199 - DNA, 18 bp, Homo sapiens
tctggctccctgcccctt

SEQ ID NO: 4678200 - DNA, 15 bp, Homo sapiens
tctggcttcagcccc

SEQ ID NO: 4678201 - DNA, 22 bp, Homo sapiens
tctggcttcagcccccaccagg

SEQ ID NO: 4678202 - DNA, 15 bp, Homo sapiens
tctgggacagggagg

SEQ ID NO: 4678203 - DNA, 16 bp, Homo sapiens
tctgggaccccagctg

SEQ ID NO: 4678204 - DNA, 15 bp, Homo sapiens
tctgggctcaagctt

SEQ ID NO: 4678205 - DNA, 17 bp, Homo sapiens
tctgggctctggactcc

SEQ ID NO: 4678206 - DNA, 23 bp, Homo sapiens
tctggggctgtgttatgaaaata

SEQ ID NO: 4678207 - DNA, 18 bp, Homo sapiens
tctgggtccatcctggtc

SEQ ID NO: 4678208 - DNA, 19 bp, Homo sapiens
tctgggtgtgactgattcc

SEQ ID NO: 4678209 - DNA, 14 bp, Homo sapiens
tctggttaatttat

SEQ ID NO: 4678210 - DNA, 13 bp, Homo sapiens
tctgtacaatgaa

SEQ ID NO: 4678211 - DNA, 14 bp, Homo sapiens
tctgtacttttcat

SEQ ID NO: 4678212 - DNA, 14 bp, Homo sapiens
tctgtatccccagt

SEQ ID NO: 4678213 - DNA, 16 bp, Homo sapiens
tctgtatccccagtgc

SEQ ID NO: 4678214 - DNA, 13 bp, Homo sapiens
tctgtcagtcaca

SEQ ID NO: 4678215 - DNA, 14 bp, Homo sapiens
tctgtcttcccaaa

SEQ ID NO: 4678216 - DNA, 19 bp, Homo sapiens
tctgtcttggctttcatgt

SEQ ID NO: 4678217 - DNA, 11 bp, Homo sapiens
tctgtctttcc

SEQ ID NO: 4678218 - DNA, 21 bp, Homo sapiens
tctgtctttcctgaaccatgt

SEQ ID NO: 4678219 - DNA, 20 bp, Homo sapiens
tctgtctttgcggggcctgt

SEQ ID NO: 4678220 - DNA, 24 bp, Homo sapiens
tctgtctttgcggggcctgtctca

SEQ ID NO: 4678221 - DNA, 19 bp, Homo sapiens
tctgtgaatccatgggtct

SEQ ID NO: 4678222 - DNA, 21 bp, Homo sapiens
tctgtgagggtgctgactggc

SEQ ID NO: 4678223 - DNA, 15 bp, Homo sapiens
tctgtgccagagcct

SEQ ID NO: 4678224 - DNA, 16 bp, Homo sapiens
tctgtgccagagcctg

SEQ ID NO: 4678225 - DNA, 17 bp, Homo sapiens
tctgtgccatagaacaa

SEQ ID NO: 4678226 - DNA, 20 bp, Homo sapiens
tctgtgcttccttggttcat

SEQ ID NO: 4678227 - DNA, 18 bp, Homo sapiens
tctgtggagctgccacag

SEQ ID NO: 4678228 - DNA, 14 bp, Homo sapiens
tctgtgtaaacaga

SEQ ID NO: 4678229 - DNA, 15 bp, Homo sapiens
tctgtgtgaatgtgg

SEQ ID NO: 4678230 - DNA, 19 bp, Homo sapiens
tctgtgtggtgcattcctg

SEQ ID NO: 4678231 - DNA, 17 bp, Homo sapiens
tctgtgttctaacttat

SEQ ID NO: 4678232 - DNA, 16 bp, Homo sapiens
tctgtgtttttgaaat

SEQ ID NO: 4678233 - DNA, 17 bp, Homo sapiens
tctgttcagtgtaaata

SEQ ID NO: 4678234 - DNA, 20 bp, Homo sapiens
tctgttccctatggagaggc

SEQ ID NO: 4678235 - DNA, 23 bp, Homo sapiens
tctgttcctggctcagcctcaaa

SEQ ID NO: 4678236 - DNA, 21 bp, Homo sapiens
tctgttctacccgttccaaaa

SEQ ID NO: 4678237 - DNA, 16 bp, Homo sapiens
tctgttgcctcctctc

SEQ ID NO: 4678238 - DNA, 19 bp, Homo sapiens
tctgttgcctcctctctcc

SEQ ID NO: 4678239 - DNA, 22 bp, Homo sapiens
tctgttgcctcctctctccctg

SEQ ID NO: 4678240 - DNA, 15 bp, Homo sapiens
tctcccctccccatc

SEQ ID NO: 4678241 - DNA, 23 bp, Homo sapiens
tctcccctccccatctgtgttct

SEQ ID NO: 4678242 - DNA, 14 bp, Homo sapiens
tctccctgcctcac

SEQ ID NO: 4678243 - DNA, 23 bp, Homo sapiens
tctccctgcgcaccaggctgagc

SEQ ID NO: 4678244 - DNA, 15 bp, Homo sapiens
tctcccttacccatc

SEQ ID NO: 4678245 - DNA, 14 bp, Homo sapiens
tctcccttccacct

SEQ ID NO: 4678246 - DNA, 16 bp, Homo sapiens
tctcccttccacctca

SEQ ID NO: 4678247 - DNA, 20 bp, Homo sapiens
tctccgtttattataaactg

SEQ ID NO: 4678248 - DNA, 20 bp, Homo sapiens
tctcctaggggcttggtcct

SEQ ID NO: 4678249 - DNA, 14 bp, Homo sapiens
tctcctcctcctcc

SEQ ID NO: 4678250 - DNA, 18 bp, Homo sapiens
tctcctcctcctccctcc

SEQ ID NO: 4678251 - DNA, 21 bp, Homo sapiens
tctcctcctcctccctcctca

SEQ ID NO: 4678252 - DNA, 13 bp, Homo sapiens
tctcctctttgag

SEQ ID NO: 4678253 - DNA, 20 bp, Homo sapiens
tctcctgccagcccagctgg

SEQ ID NO: 4678254 - DNA, 15 bp, Homo sapiens
tctcctggactggtt

SEQ ID NO: 4678255 - DNA, 12 bp, Homo sapiens
tctcctggcccc

SEQ ID NO: 4678256 - DNA, 17 bp, Homo sapiens
tctcctggcccctgcct

SEQ ID NO: 4678257 - DNA, 12 bp, Homo sapiens
tctcctggcctt

SEQ ID NO: 4678258 - DNA, 22 bp, Homo sapiens
tctcctggcttcccatccccag

SEQ ID NO: 4678259 - DNA, 14 bp, Homo sapiens
tctcctgggaaagg

SEQ ID NO: 4678260 - DNA, 20 bp, Homo sapiens
tctccttaaagagtgtggca

SEQ ID NO: 4678261 - DNA, 20 bp, Homo sapiens
tctcgaactcctaacctcaa

SEQ ID NO: 4678262 - DNA, 15 bp, Homo sapiens
tctcgaatttgaaga

SEQ ID NO: 4678263 - DNA, 16 bp, Homo sapiens
tctcgaatttgaagag

SEQ ID NO: 4678264 - DNA, 13 bp, Homo sapiens
tctcgaccctgtc

SEQ ID NO: 4678265 - DNA, 16 bp, Homo sapiens
tctcgagcgccctgca

SEQ ID NO: 4678266 - DNA, 19 bp, Homo sapiens
tctcgagcgccctgcagac

SEQ ID NO: 4678267 - DNA, 12 bp, Homo sapiens
tctcgcctcatt

SEQ ID NO: 4678268 - DNA, 19 bp, Homo sapiens
tctcggatgacaccctggc

SEQ ID NO: 4678269 - DNA, 16 bp, Homo sapiens
tctcggctcagtgcaa

SEQ ID NO: 4678270 - DNA, 17 bp, Homo sapiens
tctcggtccactcttgt

SEQ ID NO: 4678271 - DNA, 22 bp, Homo sapiens
tctctaatagaggcattacttg

SEQ ID NO: 4678272 - DNA, 19 bp, Homo sapiens
tctctaggcctctccagtt

SEQ ID NO: 4678273 - DNA, 12 bp, Homo sapiens
tctctatgtact

SEQ ID NO: 4678274 - DNA, 14 bp, Homo sapiens
tctctatgtactat

SEQ ID NO: 4678275 - DNA, 13 bp, Homo sapiens
tctctcactgtgt

SEQ ID NO: 4678276 - DNA, 19 bp, Homo sapiens
tctctcccatcctggggca

SEQ ID NO: 4678277 - DNA, 12 bp, Homo sapiens
tctctccctgcc

SEQ ID NO: 4678278 - DNA, 16 bp, Homo sapiens
tctctccctgcctcac

SEQ ID NO: 4678279 - DNA, 12 bp, Homo sapiens
tctctcctggac

SEQ ID NO: 4678280 - DNA, 17 bp, Homo sapiens
tctctcctggactggtt

SEQ ID NO: 4678281 - DNA, 19 bp, Homo sapiens
tctctcctggactggttat

SEQ ID NO: 4678282 - DNA, 14 bp, Homo sapiens
tctctctcttgcct

SEQ ID NO: 4678283 - DNA, 12 bp, Homo sapiens
tctctctggaaa

SEQ ID NO: 4678284 - DNA, 18 bp, Homo sapiens
tctctctttaaccctccc

SEQ ID NO: 4678285 - DNA, 11 bp, Homo sapiens
tctctgaaggg

SEQ ID NO: 4678286 - DNA, 19 bp, Homo sapiens
tctctgagaccacagaggc

SEQ ID NO: 4678287 - DNA, 16 bp, Homo sapiens
tctctgagttttagtt

SEQ ID NO: 4678288 - DNA, 21 bp, Homo sapiens
tctctgctctttcctcggcct

SEQ ID NO: 4678289 - DNA, 16 bp, Homo sapiens
tctctggaaaggagga

SEQ ID NO: 4678290 - DNA, 23 bp, Homo sapiens
tctctggaaatttagagttctag

SEQ ID NO: 4678291 - DNA, 19 bp, Homo sapiens
tctctggaagcccctgggc

SEQ ID NO: 4678292 - DNA, 12 bp, Homo sapiens
tctctgtgaatc

SEQ ID NO: 4678293 - DNA, 20 bp, Homo sapiens
tctctgtgtgtgtatgagag

SEQ ID NO: 4678294 - DNA, 22 bp, Homo sapiens
tctctgttctacccgttccaaa

SEQ ID NO: 4678295 - DNA, 19 bp, Homo sapiens
tctcttccaagtcctttat

SEQ ID NO: 4678296 - DNA, 20 bp, Homo sapiens
tctcttccacctgctggcct

SEQ ID NO: 4678297 - DNA, 21 bp, Homo sapiens
tctcttctccattccctagca

SEQ ID NO: 4678298 - DNA, 16 bp, Homo sapiens
tctcttgattgatttt

SEQ ID NO: 4678299 - DNA, 14 bp, Homo sapiens
tctctttaaactat

SEQ ID NO: 4678300 - DNA, 21 bp, Homo sapiens
tctctttccccaaggacccag

SEQ ID NO: 4678301 - DNA, 14 bp, Homo sapiens
tctctttctgtttc

SEQ ID NO: 4678302 - DNA, 20 bp, Homo sapiens
tctctttgaattttctgtgt

SEQ ID NO: 4678303 - DNA, 22 bp, Homo sapiens
tctcttttccactccattgtcg

SEQ ID NO: 4678304 - DNA, 16 bp, Homo sapiens
tctgaaatcaactctc

SEQ ID NO: 4678305 - DNA, 19 bp, Homo sapiens
tctgaaatcaactctcttc

SEQ ID NO: 4678306 - DNA, 15 bp, Homo sapiens
tctgaagaaaaatta

SEQ ID NO: 4678307 - DNA, 20 bp, Homo sapiens
tctgaagaaggaaggcctga

SEQ ID NO: 4678308 - DNA, 13 bp, Homo sapiens
tctgaagatcaga

SEQ ID NO: 4678309 - DNA, 23 bp, Homo sapiens
tctgaagatcagaacattcagct

SEQ ID NO: 4678310 - DNA, 13 bp, Homo sapiens
tctgaagccatgt

SEQ ID NO: 4678311 - DNA, 21 bp, Homo sapiens
tctgaagccatgtagccaccc

SEQ ID NO: 4678312 - DNA, 22 bp, Homo sapiens
tctaaaatagcaataactgaaa

SEQ ID NO: 4678313 - DNA, 23 bp, Homo sapiens
tctaaacacaacaataactttta

SEQ ID NO: 4678314 - DNA, 22 bp, Homo sapiens
tctaaactaggattgacattct

SEQ ID NO: 4678315 - DNA, 21 bp, Homo sapiens
tctaaagaagttcaaaccctg

SEQ ID NO: 4678316 - DNA, 15 bp, Homo sapiens
tctaaataaaaatat

SEQ ID NO: 4678317 - DNA, 18 bp, Homo sapiens
tctaaataaaaatatgta

SEQ ID NO: 4678318 - DNA, 16 bp, Homo sapiens
tctaaatgattatctt

SEQ ID NO: 4678319 - DNA, 19 bp, Homo sapiens
tctaaatgattatcttgaa

SEQ ID NO: 4678320 - DNA, 20 bp, Homo sapiens
tctaaatgattatcttgaaa

SEQ ID NO: 4678321 - DNA, 20 bp, Homo sapiens
tctaacaggaaaagagggag

SEQ ID NO: 4678322 - DNA, 13 bp, Homo sapiens
tctaacgcctgag

SEQ ID NO: 4678323 - DNA, 14 bp, Homo sapiens
tctaacgcctgagc

SEQ ID NO: 4678324 - DNA, 21 bp, Homo sapiens
tctaacgcctgagcccaggga

SEQ ID NO: 4678325 - DNA, 22 bp, Homo sapiens
tctaactgatgagtaaactgag

SEQ ID NO: 4678326 - DNA, 14 bp, Homo sapiens
tctaagaaaatgta

SEQ ID NO: 4678327 - DNA, 12 bp, Homo sapiens
tctaagcccagg

SEQ ID NO: 4678328 - DNA, 14 bp, Homo sapiens
tctaagcccaggat

SEQ ID NO: 4678329 - DNA, 16 bp, Homo sapiens
tctaagcccaggatct

SEQ ID NO: 4678330 - DNA, 14 bp, Homo sapiens
tctaaggtactgtg

SEQ ID NO: 4678331 - DNA, 20 bp, Homo sapiens
tctaataaagccatttctta

SEQ ID NO: 4678332 - DNA, 20 bp, Homo sapiens
tctaatggcacttatcatta

SEQ ID NO: 4678333 - DNA, 14 bp, Homo sapiens
tctaatgtgaaaat

SEQ ID NO: 4678334 - DNA, 16 bp, Homo sapiens
tctaatgtgaaaatca

SEQ ID NO: 4678335 - DNA, 18 bp, Homo sapiens
tctaattaaccttactaa

SEQ ID NO: 4678336 - DNA, 20 bp, Homo sapiens
tctaattgtaagtgaaatta

SEQ ID NO: 4678337 - DNA, 16 bp, Homo sapiens
tctacaactggagttt

SEQ ID NO: 4678338 - DNA, 22 bp, Homo sapiens
tctacagatggcatacctgtgc

SEQ ID NO: 4678339 - DNA, 12 bp, Homo sapiens
tctacaggcctg

SEQ ID NO: 4678340 - DNA, 19 bp, Homo sapiens
tctacaggcctgcagcccc

SEQ ID NO: 4678341 - DNA, 16 bp, Homo sapiens
tctacagtaatgaaat

SEQ ID NO: 4678342 - DNA, 13 bp, Homo sapiens
tctacattaaaat

SEQ ID NO: 4678343 - DNA, 21 bp, Homo sapiens
tctacattaaaatgacaaaca

SEQ ID NO: 4678344 - DNA, 21 bp, Homo sapiens
tctaccctgcctgtactactc

SEQ ID NO: 4678345 - DNA, 15 bp, Homo sapiens
tctacttgtcatatc

SEQ ID NO: 4678346 - DNA, 14 bp, Homo sapiens
tctactttattaat

SEQ ID NO: 4678347 - DNA, 17 bp, Homo sapiens
tctagacattcttttaa

SEQ ID NO: 4678348 - DNA, 15 bp, Homo sapiens
tctagagcttttatt

SEQ ID NO: 4678349 - DNA, 18 bp, Homo sapiens
tctagatggcaacattgg

SEQ ID NO: 4678350 - DNA, 19 bp, Homo sapiens
tctagatggcaacattgga

SEQ ID NO: 4678351 - DNA, 16 bp, Homo sapiens
tctagcaaacagatgt

SEQ ID NO: 4678352 - DNA, 22 bp, Homo sapiens
tctagcaaccgcctcaaaatgt

SEQ ID NO: 4678353 - DNA, 16 bp, Homo sapiens
tctagctctctaggcc

SEQ ID NO: 4678354 - DNA, 21 bp, Homo sapiens
tctaggacacagttcctggga

SEQ ID NO: 4678355 - DNA, 23 bp, Homo sapiens
tctaggatagctaactgtaaatc

SEQ ID NO: 4678356 - DNA, 15 bp, Homo sapiens
tctaggcctctccag

SEQ ID NO: 4678357 - DNA, 14 bp, Homo sapiens
tctaggctgctgca

SEQ ID NO: 4678358 - DNA, 16 bp, Homo sapiens
tctaggctgctgcaca

SEQ ID NO: 4678359 - DNA, 21 bp, Homo sapiens
tctagggaatgggactgtgag

SEQ ID NO: 4678360 - DNA, 21 bp, Homo sapiens
tctagggactgccaggctgtt

SEQ ID NO: 4678361 - DNA, 16 bp, Homo sapiens
tctagggagtatgctg

SEQ ID NO: 4678362 - DNA, 12 bp, Homo sapiens
tctagtcattgt

SEQ ID NO: 4678363 - DNA, 17 bp, Homo sapiens
tctagtccgtcctggca

SEQ ID NO: 4678364 - DNA, 13 bp, Homo sapiens
tctagtgggacag

SEQ ID NO: 4678365 - DNA, 15 bp, Homo sapiens
tctagtgggacagcc

SEQ ID NO: 4678366 - DNA, 19 bp, Homo sapiens
tctagtgggacagcccaga

SEQ ID NO: 4678367 - DNA, 24 bp, Homo sapiens
tctagtgggacagcccagagcctg

SEQ ID NO: 4678368 - DNA, 14 bp, Homo sapiens
tctagtttattcta

SEQ ID NO: 4678369 - DNA, 15 bp, Homo sapiens
tctagtttattctaa

SEQ ID NO: 4678370 - DNA, 22 bp, Homo sapiens
tctataagtgaggaagagttta

SEQ ID NO: 4678371 - DNA, 19 bp, Homo sapiens
tctataatcccagcacttt

SEQ ID NO: 4678372 - DNA, 21 bp, Homo sapiens
tctataatcccagcactttgg

SEQ ID NO: 4678373 - DNA, 13 bp, Homo sapiens
tctatatgtactt

SEQ ID NO: 4678374 - DNA, 20 bp, Homo sapiens
tctatatgtacttgtcaaag

SEQ ID NO: 4678375 - DNA, 14 bp, Homo sapiens
tctatcactgcatt

SEQ ID NO: 4678376 - DNA, 15 bp, Homo sapiens
tctatcactgcatta

SEQ ID NO: 4678377 - DNA, 23 bp, Homo sapiens
tctatcagactcagttttttgta

SEQ ID NO: 4678378 - DNA, 13 bp, Homo sapiens
tctatctctttct

SEQ ID NO: 4678379 - DNA, 12 bp, Homo sapiens
tctatgatgttg

SEQ ID NO: 4678380 - DNA, 15 bp, Homo sapiens
tctatgatgttgctg

SEQ ID NO: 4678381 - DNA, 16 bp, Homo sapiens
tctatggcttatttct

SEQ ID NO: 4678382 - DNA, 12 bp, Homo sapiens
tctatgtttgta

SEQ ID NO: 4678383 - DNA, 18 bp, Homo sapiens
tctatgtttgtatttgga

SEQ ID NO: 4678384 - DNA, 23 bp, Homo sapiens
tctattaatcaagagaaacttca

SEQ ID NO: 4678385 - DNA, 12 bp, Homo sapiens
tctatttattag

SEQ ID NO: 4678386 - DNA, 16 bp, Homo sapiens
tctatttctgcctccc

SEQ ID NO: 4678387 - DNA, 14 bp, Homo sapiens
tctattttcataat

SEQ ID NO: 4678388 - DNA, 16 bp, Homo sapiens
tcattaaaaattacct

SEQ ID NO: 4678389 - DNA, 22 bp, Homo sapiens
tcattaaaaattacctttaatt

SEQ ID NO: 4678390 - DNA, 18 bp, Homo sapiens
tcattaaaggcttctctc

SEQ ID NO: 4678391 - DNA, 13 bp, Homo sapiens
tcattaatgacac

SEQ ID NO: 4678392 - DNA, 19 bp, Homo sapiens
tcattaatgacacttgtcc

SEQ ID NO: 4678393 - DNA, 12 bp, Homo sapiens
tcattatgacat

SEQ ID NO: 4678394 - DNA, 23 bp, Homo sapiens
tcattatgcacttttagaaatgc

SEQ ID NO: 4678395 - DNA, 17 bp, Homo sapiens
tcattatgttcatgtaa

SEQ ID NO: 4678396 - DNA, 16 bp, Homo sapiens
tcattattcaagaatg

SEQ ID NO: 4678397 - DNA, 14 bp, Homo sapiens
tcattatttgagac

SEQ ID NO: 4678398 - DNA, 23 bp, Homo sapiens
tcattcagcagcaaattttcagc

SEQ ID NO: 4678399 - DNA, 13 bp, Homo sapiens
tcattccattgcc

SEQ ID NO: 4678400 - DNA, 15 bp, Homo sapiens
tcattccattgccta

SEQ ID NO: 4678401 - DNA, 20 bp, Homo sapiens
tcattccattgcctagctct

SEQ ID NO: 4678402 - DNA, 18 bp, Homo sapiens
tcattctcataattccta

SEQ ID NO: 4678403 - DNA, 23 bp, Homo sapiens
tcattctcataattcctacagca

SEQ ID NO: 4678404 - DNA, 13 bp, Homo sapiens
tcattctcctcct

SEQ ID NO: 4678405 - DNA, 16 bp, Homo sapiens
tcattcttcagttctc

SEQ ID NO: 4678406 - DNA, 13 bp, Homo sapiens
tcattctttattc

SEQ ID NO: 4678407 - DNA, 13 bp, Homo sapiens
tcattctttgtat

SEQ ID NO: 4678408 - DNA, 16 bp, Homo sapiens
tcattctttgtatctt

SEQ ID NO: 4678409 - DNA, 20 bp, Homo sapiens
tcattcttttgccacatccc

SEQ ID NO: 4678410 - DNA, 21 bp, Homo sapiens
tcattgaagtatattcttatt

SEQ ID NO: 4678411 - DNA, 12 bp, Homo sapiens
tcattgcacttt

SEQ ID NO: 4678412 - DNA, 17 bp, Homo sapiens
tcattgccatcaccatt

SEQ ID NO: 4678413 - DNA, 22 bp, Homo sapiens
tcattgccatcaccatttggtg

SEQ ID NO: 4678414 - DNA, 12 bp, Homo sapiens
tcattgtattca

SEQ ID NO: 4678415 - DNA, 18 bp, Homo sapiens
tcattgtattcagataat

SEQ ID NO: 4678416 - DNA, 14 bp, Homo sapiens
tcattgtgtctccc

SEQ ID NO: 4678417 - DNA, 23 bp, Homo sapiens
tcattgtgtctcccgtgcatgct

SEQ ID NO: 4678418 - DNA, 14 bp, Homo sapiens
tcatttaactttat

SEQ ID NO: 4678419 - DNA, 21 bp, Homo sapiens
tcatttagataatttgaaaaa

SEQ ID NO: 4678420 - DNA, 14 bp, Homo sapiens
tcatttcacacagt

SEQ ID NO: 4678421 - DNA, 14 bp, Homo sapiens
tcatttccagcttc

SEQ ID NO: 4678422 - DNA, 16 bp, Homo sapiens
tcatttgggctagact

SEQ ID NO: 4678423 - DNA, 21 bp, Homo sapiens
tcattttaacatgatttcaaa

SEQ ID NO: 4678424 - DNA, 14 bp, Homo sapiens
tcattttattcaca

SEQ ID NO: 4678425 - DNA, 16 bp, Homo sapiens
tcatttttaagaaagg

SEQ ID NO: 4678426 - DNA, 20 bp, Homo sapiens
tccaaaagcaaccacaaacc

SEQ ID NO: 4678427 - DNA, 12 bp, Homo sapiens
tccaaacctgtc

SEQ ID NO: 4678428 - DNA, 14 bp, Homo sapiens
tccaaacctgtctt

SEQ ID NO: 4678429 - DNA, 20 bp, Homo sapiens
tccaaacctgtcttggggcc

SEQ ID NO: 4678430 - DNA, 19 bp, Homo sapiens
tccaaactgattaaatatt

SEQ ID NO: 4678431 - DNA, 14 bp, Homo sapiens
tccaaagcagacag

SEQ ID NO: 4678432 - DNA, 14 bp, Homo sapiens
tccaaataataaag

SEQ ID NO: 4678433 - DNA, 17 bp, Homo sapiens
tccaaattaaaacaaat

SEQ ID NO: 4678434 - DNA, 22 bp, Homo sapiens
tccaacaaaagaaggtcaaact

SEQ ID NO: 4678435 - DNA, 17 bp, Homo sapiens
tccaacaccaagcacag

SEQ ID NO: 4678436 - DNA, 13 bp, Homo sapiens
tccaagaaaatat

SEQ ID NO: 4678437 - DNA, 12 bp, Homo sapiens
tccaagcatttc

SEQ ID NO: 4678438 - DNA, 17 bp, Homo sapiens
tccaagcatttcatgaa

SEQ ID NO: 4678439 - DNA, 11 bp, Homo sapiens
tccaagcctgc

SEQ ID NO: 4678440 - DNA, 22 bp, Homo sapiens
tccaagctgggagattcaaggg

SEQ ID NO: 4678441 - DNA, 22 bp, Homo sapiens
tccaaggaaacattttatcatt

SEQ ID NO: 4678442 - DNA, 15 bp, Homo sapiens
tccaaggaagcagaa

SEQ ID NO: 4678443 - DNA, 15 bp, Homo sapiens
tccaataatcagaaa

SEQ ID NO: 4678444 - DNA, 13 bp, Homo sapiens
tccaatcctcccc

SEQ ID NO: 4678445 - DNA, 14 bp, Homo sapiens
tccaatcctccccg

SEQ ID NO: 4678446 - DNA, 19 bp, Homo sapiens
tccaatcctccccgctctg

SEQ ID NO: 4678447 - DNA, 14 bp, Homo sapiens
tccaatgccacaga

SEQ ID NO: 4678448 - DNA, 19 bp, Homo sapiens
tccacactgcagggaggag

SEQ ID NO: 4678449 - DNA, 19 bp, Homo sapiens
tccacagatttttttgtaa

SEQ ID NO: 4678450 - DNA, 20 bp, Homo sapiens
tccacagggagcaaacactt

SEQ ID NO: 4678451 - DNA, 16 bp, Homo sapiens
tccaccactgtgcact

SEQ ID NO: 4678452 - DNA, 12 bp, Homo sapiens
tccaccagcctg

SEQ ID NO: 4678453 - DNA, 16 bp, Homo sapiens
tccaccagcctgctga

SEQ ID NO: 4678454 - DNA, 18 bp, Homo sapiens
tccaccagcctgctgaca

SEQ ID NO: 4678455 - DNA, 19 bp, Homo sapiens
tccaccagcctgctgacag

SEQ ID NO: 4678456 - DNA, 21 bp, Homo sapiens
tccaccagggccagagcagct

SEQ ID NO: 4678457 - DNA, 13 bp, Homo sapiens
tccaccctccacc

SEQ ID NO: 4678458 - DNA, 15 bp, Homo sapiens
tccaccctccacctt

SEQ ID NO: 4678459 - DNA, 17 bp, Homo sapiens
tccacctcacaactcct

SEQ ID NO: 4678460 - DNA, 13 bp, Homo sapiens
tccaccttgcacc

SEQ ID NO: 4678461 - DNA, 14 bp, Homo sapiens
tccacggatgcgtg

SEQ ID NO: 4678462 - DNA, 21 bp, Homo sapiens
tccacggatgcgtgggcagag

SEQ ID NO: 4678463 - DNA, 16 bp, Homo sapiens
tccacggtctgttctt

SEQ ID NO: 4678464 - DNA, 21 bp, Homo sapiens
tccacgtagggggcaggggca

SEQ ID NO: 4678465 - DNA, 15 bp, Homo sapiens
tccactccattgtcg

SEQ ID NO: 4678466 - DNA, 12 bp, Homo sapiens
tccactcctccc

SEQ ID NO: 4678467 - DNA, 14 bp, Homo sapiens
tccacttcaatgca

SEQ ID NO: 4678468 - DNA, 16 bp, Homo sapiens
tccacttgccctgtgt

SEQ ID NO: 4678469 - DNA, 13 bp, Homo sapiens
tccagaacactct

SEQ ID NO: 4678470 - DNA, 21 bp, Homo sapiens
tccagaagacgtggtctagac

SEQ ID NO: 4678471 - DNA, 22 bp, Homo sapiens
tccagacctatatctggagtga

SEQ ID NO: 4678472 - DNA, 13 bp, Homo sapiens
tccagatgtgtgc

SEQ ID NO: 4678473 - DNA, 21 bp, Homo sapiens
tccagcagcagcacttagacc

SEQ ID NO: 4678474 - DNA, 9 bp, Homo sapiens
tccagccac

SEQ ID NO: 4678475 - DNA, 10 bp, Homo sapiens
tccagccact

SEQ ID NO: 4678476 - DNA, 21 bp, Homo sapiens
tccagccacttccccctcttc

SEQ ID NO: 4678477 - DNA, 16 bp, Homo sapiens
tccagctgagcgccag

SEQ ID NO: 4678478 - DNA, 14 bp, Homo sapiens
tccagctgaggcag

SEQ ID NO: 4678479 - DNA, 17 bp, Homo sapiens
tccagcttgcctgtttc

SEQ ID NO: 4678480 - DNA, 15 bp, Homo sapiens
tcacatttttttatg

SEQ ID NO: 4678481 - DNA, 23 bp, Homo sapiens
tcaccaaaaccaaacttgttcat

SEQ ID NO: 4678482 - DNA, 20 bp, Homo sapiens
tcaccactcaaaggccagac

SEQ ID NO: 4678483 - DNA, 23 bp, Homo sapiens
tcaccactcaaaggccagacctg

SEQ ID NO: 4678484 - DNA, 21 bp, Homo sapiens
tcaccaggctggagtgcagtg

SEQ ID NO: 4678485 - DNA, 14 bp, Homo sapiens
tcaccaggggagga

SEQ ID NO: 4678486 - DNA, 18 bp, Homo sapiens
tcaccaggggaggagcct

SEQ ID NO: 4678487 - DNA, 24 bp, Homo sapiens
tcaccaggggaggagcctgtgcgt

SEQ ID NO: 4678488 - DNA, 13 bp, Homo sapiens
tcacccactccct

SEQ ID NO: 4678489 - DNA, 19 bp, Homo sapiens
tcacccaggctggagtgca

SEQ ID NO: 4678490 - DNA, 21 bp, Homo sapiens
tcacccagggacactccaact

SEQ ID NO: 4678491 - DNA, 19 bp, Homo sapiens
tcacccctcccctgggact

SEQ ID NO: 4678492 - DNA, 14 bp, Homo sapiens
tcacccctgcccct

SEQ ID NO: 4678493 - DNA, 18 bp, Homo sapiens
tcacccctgcccctgtgg

SEQ ID NO: 4678494 - DNA, 22 bp, Homo sapiens
tcacccctgcccctgtgggact

SEQ ID NO: 4678495 - DNA, 15 bp, Homo sapiens
tcacccctgtttctg

SEQ ID NO: 4678496 - DNA, 11 bp, Homo sapiens
tcacctcccat

SEQ ID NO: 4678497 - DNA, 13 bp, Homo sapiens
tcacctcccatcc

SEQ ID NO: 4678498 - DNA, 14 bp, Homo sapiens
tcacctcctgctgg

SEQ ID NO: 4678499 - DNA, 15 bp, Homo sapiens
tcacctcctgctggg

SEQ ID NO: 4678500 - DNA, 16 bp, Homo sapiens
tcacctccttccccag

SEQ ID NO: 4678501 - DNA, 21 bp, Homo sapiens
tcacctctgggaccccagctg

SEQ ID NO: 4678502 - DNA, 20 bp, Homo sapiens
tcacctcttccactccttct

SEQ ID NO: 4678503 - DNA, 12 bp, Homo sapiens
tcacctgattca

SEQ ID NO: 4678504 - DNA, 18 bp, Homo sapiens
tcacctgattcaactaaa

SEQ ID NO: 4678505 - DNA, 16 bp, Homo sapiens
tcacctgccccaactc

SEQ ID NO: 4678506 - DNA, 22 bp, Homo sapiens
tcacctgcgcaagtgcctggga

SEQ ID NO: 4678507 - DNA, 23 bp, Homo sapiens
tcacctgtactattgcagacctg

SEQ ID NO: 4678508 - DNA, 16 bp, Homo sapiens
tcacgctgaaacatgc

SEQ ID NO: 4678509 - DNA, 17 bp, Homo sapiens
tcacgtaatcctcctga

SEQ ID NO: 4678510 - DNA, 18 bp, Homo sapiens
tcacgtaatcctcctgag

SEQ ID NO: 4678511 - DNA, 21 bp, Homo sapiens
tcactaaactttatttgtaaa

SEQ ID NO: 4678512 - DNA, 17 bp, Homo sapiens
tcactagaatggataaa

SEQ ID NO: 4678513 - DNA, 23 bp, Homo sapiens
tcactaggcattgtgatgtttag

SEQ ID NO: 4678514 - DNA, 17 bp, Homo sapiens
tcactatgggtgagcat

SEQ ID NO: 4678515 - DNA, 12 bp, Homo sapiens
tcactccctagg

SEQ ID NO: 4678516 - DNA, 19 bp, Homo sapiens
tcactcctgctgtaaattt

SEQ ID NO: 4678517 - DNA, 15 bp, Homo sapiens
tcactctctccgtct

SEQ ID NO: 4678518 - DNA, 12 bp, Homo sapiens
tcactctgggct

SEQ ID NO: 4678519 - DNA, 17 bp, Homo sapiens
tcactcttctcagccac

SEQ ID NO: 4678520 - DNA, 21 bp, Homo sapiens
tcactcttgtcacccaggctg

SEQ ID NO: 4678521 - DNA, 18 bp, Homo sapiens
tcactgcaacctctgcct

SEQ ID NO: 4678522 - DNA, 20 bp, Homo sapiens
tcactgcaacctctgcctcc

SEQ ID NO: 4678523 - DNA, 21 bp, Homo sapiens
tcactgcaatctctgcctccc

SEQ ID NO: 4678524 - DNA, 17 bp, Homo sapiens
tcactgcattattctct

SEQ ID NO: 4678525 - DNA, 18 bp, Homo sapiens
tcactgcattattctctt

SEQ ID NO: 4678526 - DNA, 21 bp, Homo sapiens
tcactgtgatcaatattttta

SEQ ID NO: 4678527 - DNA, 16 bp, Homo sapiens
tcactgtgttactgct

SEQ ID NO: 4678528 - DNA, 19 bp, Homo sapiens
tcactgtgttactgctttg

SEQ ID NO: 4678529 - DNA, 15 bp, Homo sapiens
tcacttccccaagat

SEQ ID NO: 4678530 - DNA, 22 bp, Homo sapiens
tcacttccccaagatctgccag

SEQ ID NO: 4678531 - DNA, 20 bp, Homo sapiens
tcacttcttcacctcttcca

SEQ ID NO: 4678532 - DNA, 15 bp, Homo sapiens
tcacttgactcttga

SEQ ID NO: 4678533 - DNA, 16 bp, Homo sapiens
tcacttgactcttgaa

SEQ ID NO: 4678534 - DNA, 18 bp, Homo sapiens
tcacttgactcttgaata

SEQ ID NO: 4678535 - DNA, 19 bp, Homo sapiens
tcacttgcttcttatcctt

SEQ ID NO: 4678536 - DNA, 17 bp, Homo sapiens
tcagaaaaaaataaatg

SEQ ID NO: 4678537 - DNA, 17 bp, Homo sapiens
tcagaaaagtaattttg

SEQ ID NO: 4678538 - DNA, 22 bp, Homo sapiens
tcagaaagaattgatcagaatc

SEQ ID NO: 4678539 - DNA, 17 bp, Homo sapiens
tcagaaagggagggctc

SEQ ID NO: 4678540 - DNA, 22 bp, Homo sapiens
tcagaaagggagggctctgagg

SEQ ID NO: 4678541 - DNA, 15 bp, Homo sapiens
tcagaaatagatttc

SEQ ID NO: 4678542 - DNA, 20 bp, Homo sapiens
tcagaacattcagctctgga

SEQ ID NO: 4678543 - DNA, 14 bp, Homo sapiens
tcagaagcctgggg

SEQ ID NO: 4678544 - DNA, 23 bp, Homo sapiens
tcagaagcctgggggcctggctg

SEQ ID NO: 4678545 - DNA, 12 bp, Homo sapiens
tcagaaggagaa

SEQ ID NO: 4678546 - DNA, 20 bp, Homo sapiens
tcagaataaggcaggcattg

SEQ ID NO: 4678547 - DNA, 21 bp, Homo sapiens
tcagaataaggcaggcattga

SEQ ID NO: 4678548 - DNA, 14 bp, Homo sapiens
tcagacaagacaga

SEQ ID NO: 4678549 - DNA, 15 bp, Homo sapiens
tcagacaagacagag

SEQ ID NO: 4678550 - DNA, 15 bp, Homo sapiens
tcagacataaagcca

SEQ ID NO: 4678551 - DNA, 14 bp, Homo sapiens
tcagacatttatat

SEQ ID NO: 4678552 - DNA, 13 bp, Homo sapiens
tcagacccatctc

SEQ ID NO: 4678553 - DNA, 14 bp, Homo sapiens
tcagactcagtttt

SEQ ID NO: 4678554 - DNA, 17 bp, Homo sapiens
tcagactcagttttttg

SEQ ID NO: 4678555 - DNA, 22 bp, Homo sapiens
tcagactcagttttttgtaact

SEQ ID NO: 4678556 - DNA, 19 bp, Homo sapiens
tcagactttggaaaatgca

SEQ ID NO: 4678557 - DNA, 23 bp, Homo sapiens
tcagactttgtgttcatttcatt

SEQ ID NO: 4678558 - DNA, 19 bp, Homo sapiens
tcagagcccccagccctgg

SEQ ID NO: 4678559 - DNA, 20 bp, Homo sapiens
tcagagcccccagccctggg

SEQ ID NO: 4678560 - DNA, 13 bp, Homo sapiens
tcagagcttcctg

SEQ ID NO: 4678561 - DNA, 14 bp, Homo sapiens
tcagagcttcctgg

SEQ ID NO: 4678562 - DNA, 22 bp, Homo sapiens
tcagagcttcctggggaccaag

SEQ ID NO: 4678563 - DNA, 20 bp, Homo sapiens
tcagaggcatttgagcagct

SEQ ID NO: 4678564 - DNA, 13 bp, Homo sapiens
tcagatagtctat

SEQ ID NO: 4678565 - DNA, 16 bp, Homo sapiens
tcagatgaggccctgc

SEQ ID NO: 4678566 - DNA, 17 bp, Homo sapiens
tcagatgaggccctgca

SEQ ID NO: 4678567 - DNA, 13 bp, Homo sapiens
tcagatgcttctg

SEQ ID NO: 4678568 - DNA, 14 bp, Homo sapiens
tcagatgcttctgg

SEQ ID NO: 4678569 - DNA, 19 bp, Homo sapiens
tcagcaatttaactagaca

SEQ ID NO: 4678570 - DNA, 22 bp, Homo sapiens
tcagcacctacagtgtacagtc

SEQ ID NO: 4678571 - DNA, 14 bp, Homo sapiens
tcagcagctagaaa

SEQ ID NO: 4678572 - DNA, 17 bp, Homo sapiens
tcagcagggctggtcac

SEQ ID NO: 4678573 - DNA, 15 bp, Homo sapiens
tcagcatgcctgtcc

SEQ ID NO: 4678574 - DNA, 16 bp, Homo sapiens
tcagcatgcctgtcct

SEQ ID NO: 4678575 - DNA, 16 bp, Homo sapiens
tcagccagtggggatg

SEQ ID NO: 4678576 - DNA, 15 bp, Homo sapiens
tcagcccagtgcaaa

SEQ ID NO: 4678577 - DNA, 15 bp, Homo sapiens
tcagcccatggaggc

SEQ ID NO: 4678578 - DNA, 21 bp, Homo sapiens
tcagcccatggaggcagatgc

SEQ ID NO: 4678579 - DNA, 21 bp, Homo sapiens
tcagccccgacttcctgactc

SEQ ID NO: 4678580 - DNA, 14 bp, Homo sapiens
tcagccctgccctt

SEQ ID NO: 4678581 - DNA, 12 bp, Homo sapiens
tcagccctgcta

SEQ ID NO: 4678582 - DNA, 18 bp, Homo sapiens
tcagcgatgtatgcagct

SEQ ID NO: 4678583 - DNA, 13 bp, Homo sapiens
tcagcgtggcctt

SEQ ID NO: 4678584 - DNA, 14 bp, Homo sapiens
tcagctagacaatg

SEQ ID NO: 4678585 - DNA, 9 bp, Homo sapiens
tcagctcct

SEQ ID NO: 4678586 - DNA, 12 bp, Homo sapiens
tcagctcctttc

SEQ ID NO: 4678587 - DNA, 13 bp, Homo sapiens
tcagctctggaga

SEQ ID NO: 4678588 - DNA, 14 bp, Homo sapiens
tcagctctggagaa

SEQ ID NO: 4678589 - DNA, 17 bp, Homo sapiens
tcagctctggagaacag

SEQ ID NO: 4678590 - DNA, 16 bp, Homo sapiens
tcagctctttccaaat

SEQ ID NO: 4678591 - DNA, 16 bp, Homo sapiens
tcagctgccccacagg

SEQ ID NO: 4678592 - DNA, 17 bp, Homo sapiens
tcaggaaaaggcctggg

SEQ ID NO: 4678593 - DNA, 18 bp, Homo sapiens
tcaggaaaaggcctgggg

SEQ ID NO: 4678594 - DNA, 18 bp, Homo sapiens
tcaggaattcagtgcctt

SEQ ID NO: 4678595 - DNA, 23 bp, Homo sapiens
tcaggatatccttatcagagcta

SEQ ID NO: 4678596 - DNA, 15 bp, Homo sapiens
tcaggatgaggcccc

SEQ ID NO: 4678597 - DNA, 16 bp, Homo sapiens
tcaggatgaggccccg

SEQ ID NO: 4678598 - DNA, 14 bp, Homo sapiens
tcaggcaaggagga

SEQ ID NO: 4678599 - DNA, 22 bp, Homo sapiens
tcaggcctcacccctcccctgg

SEQ ID NO: 4678600 - DNA, 13 bp, Homo sapiens
tcaggctagccct

SEQ ID NO: 4678601 - DNA, 16 bp, Homo sapiens
tcagggaccggtgctg

SEQ ID NO: 4678602 - DNA, 20 bp, Homo sapiens
tcagggagaggtcaccagct

SEQ ID NO: 4678603 - DNA, 22 bp, Homo sapiens
tcagggagtgctggctcacagt

SEQ ID NO: 4678604 - DNA, 15 bp, Homo sapiens
tcagggcctgccccc

SEQ ID NO: 4678605 - DNA, 17 bp, Homo sapiens
tcagggcctgccccctg

SEQ ID NO: 4678606 - DNA, 21 bp, Homo sapiens
tcagggcctgccccctgggga

SEQ ID NO: 4678607 - DNA, 21 bp, Homo sapiens
tcagggcctggggcctgagag

SEQ ID NO: 4678608 - DNA, 23 bp, Homo sapiens
tcagggcctggggcctgagagaa

SEQ ID NO: 4678609 - DNA, 16 bp, Homo sapiens
tcagggtctccttcct

SEQ ID NO: 4678610 - DNA, 17 bp, Homo sapiens
tcaggtaatcattttaa

SEQ ID NO: 4678611 - DNA, 16 bp, Homo sapiens
tcaggtgtgataaaat

SEQ ID NO: 4678612 - DNA, 23 bp, Homo sapiens
tcagtacttttttaaatattttc

SEQ ID NO: 4678613 - DNA, 18 bp, Homo sapiens
tcagtaggctaatgtcaa

SEQ ID NO: 4678614 - DNA, 15 bp, Homo sapiens
tcagtagtttcatgt

SEQ ID NO: 4678615 - DNA, 20 bp, Homo sapiens
tcagtatttaactaattata

SEQ ID NO: 4678616 - DNA, 20 bp, Homo sapiens
tcagtattttctccacttca

SEQ ID NO: 4678617 - DNA, 16 bp, Homo sapiens
tcagtcagggtttgtc

SEQ ID NO: 4678618 - DNA, 18 bp, Homo sapiens
tcagtccctcttctggtt

SEQ ID NO: 4678619 - DNA, 20 bp, Homo sapiens
tcagtgaagtacacctgtgt

SEQ ID NO: 4678620 - DNA, 13 bp, Homo sapiens
tcagtgactcctg

SEQ ID NO: 4678621 - DNA, 18 bp, Homo sapiens
tcagtgactcctgctggt

SEQ ID NO: 4678622 - DNA, 16 bp, Homo sapiens
tcagtgcaaaatgtct

SEQ ID NO: 4678623 - DNA, 22 bp, Homo sapiens
tcagtgcaaaatgtcttgtgta

SEQ ID NO: 4678624 - DNA, 16 bp, Homo sapiens
tcagtgcatttgtgct

SEQ ID NO: 4678625 - DNA, 19 bp, Homo sapiens
tcagtggaaaccctgagag

SEQ ID NO: 4678626 - DNA, 16 bp, Homo sapiens
tcagtggggctctctg

SEQ ID NO: 4678627 - DNA, 14 bp, Homo sapiens
tcagtggtgggaga

SEQ ID NO: 4678628 - DNA, 16 bp, Homo sapiens
tcagtgtagacacagg

SEQ ID NO: 4678629 - DNA, 20 bp, Homo sapiens
tcagtgtagacacaggtcac

SEQ ID NO: 4678630 - DNA, 13 bp, Homo sapiens
tcagttattaaat

SEQ ID NO: 4678631 - DNA, 20 bp, Homo sapiens
tcagttcaactttcagaagt

SEQ ID NO: 4678632 - DNA, 20 bp, Homo sapiens
tcagttcctgcagcagagcc

SEQ ID NO: 4678633 - DNA, 19 bp, Homo sapiens
tcagttctctactccctct

SEQ ID NO: 4678634 - DNA, 14 bp, Homo sapiens
tcagttctgcttgc

SEQ ID NO: 4678635 - DNA, 15 bp, Homo sapiens
tcagttctgcttgct

SEQ ID NO: 4678636 - DNA, 21 bp, Homo sapiens
tcagttctgtgtggtgcattc

SEQ ID NO: 4678637 - DNA, 21 bp, Homo sapiens
tcagtttatgttgtacaatgt

SEQ ID NO: 4678638 - DNA, 15 bp, Homo sapiens
tcagttttgtacata

SEQ ID NO: 4678639 - DNA, 17 bp, Homo sapiens
tcagttttttgtaacta

SEQ ID NO: 4678640 - DNA, 16 bp, Homo sapiens
tcataaaatagaataa

SEQ ID NO: 4678641 - DNA, 21 bp, Homo sapiens
tcataaaatagaataattctt

SEQ ID NO: 4678642 - DNA, 21 bp, Homo sapiens
tcataaataaaggtgtagaaa

SEQ ID NO: 4678643 - DNA, 14 bp, Homo sapiens
tcataaatttgaat

SEQ ID NO: 4678644 - DNA, 15 bp, Homo sapiens
tcataagatattctt

SEQ ID NO: 4678645 - DNA, 17 bp, Homo sapiens
tcataagatattcttta

SEQ ID NO: 4678646 - DNA, 15 bp, Homo sapiens
tcataagtaaaccta

SEQ ID NO: 4678647 - DNA, 11 bp, Homo sapiens
tcataataaat

SEQ ID NO: 4678648 - DNA, 14 bp, Homo sapiens
tcataatcagtaaa

SEQ ID NO: 4678649 - DNA, 18 bp, Homo sapiens
tcataatcagtaaatagt

SEQ ID NO: 4678650 - DNA, 20 bp, Homo sapiens
tcataatcagtaaatagtgt

SEQ ID NO: 4678651 - DNA, 20 bp, Homo sapiens
tcataattcctacagcacta

SEQ ID NO: 4678652 - DNA, 23 bp, Homo sapiens
tcataattcctacagcactactg

SEQ ID NO: 4678653 - DNA, 15 bp, Homo sapiens
tcatacaaactctca

SEQ ID NO: 4678654 - DNA, 13 bp, Homo sapiens
tcatacacagaaa

SEQ ID NO: 4678655 - DNA, 19 bp, Homo sapiens
tcatacactaaccaaatct

SEQ ID NO: 4678656 - DNA, 19 bp, Homo sapiens
tcatacctacacccaaggt

SEQ ID NO: 4678657 - DNA, 19 bp, Homo sapiens
tcatactctgttgcctcct

SEQ ID NO: 4678658 - DNA, 23 bp, Homo sapiens
tcatactctgttgcctcctctct

SEQ ID NO: 4678659 - DNA, 22 bp, Homo sapiens
tcatacttaacatttcattgta

SEQ ID NO: 4678660 - DNA, 18 bp, Homo sapiens
tcatagttatgtgatttt

SEQ ID NO: 4678661 - DNA, 12 bp, Homo sapiens
tcatagttttct

SEQ ID NO: 4678662 - DNA, 20 bp, Homo sapiens
tcatataaaagctatggtga

SEQ ID NO: 4678663 - DNA, 15 bp, Homo sapiens
tcatatttattgatt

SEQ ID NO: 4678664 - DNA, 15 bp, Homo sapiens
tcatattttgttgtg

SEQ ID NO: 4678665 - DNA, 19 bp, Homo sapiens
tcatcaaaaagtaattata

SEQ ID NO: 4678666 - DNA, 17 bp, Homo sapiens
tcatcagccagcaagag

SEQ ID NO: 4678667 - DNA, 16 bp, Homo sapiens
tcatcagggcctgggg

SEQ ID NO: 4678668 - DNA, 23 bp, Homo sapiens
tcatcagggcctggggcctgaga

SEQ ID NO: 4678669 - DNA, 13 bp, Homo sapiens
tcatcccccctgc

SEQ ID NO: 4678670 - DNA, 15 bp, Homo sapiens
tcatcccccctgctg

SEQ ID NO: 4678671 - DNA, 21 bp, Homo sapiens
tcatcctcccgccaggagctt

SEQ ID NO: 4678672 - DNA, 13 bp, Homo sapiens
tcatctcagcttt

SEQ ID NO: 4678673 - DNA, 22 bp, Homo sapiens
tcatctcccacctagcagcacc

SEQ ID NO: 4678674 - DNA, 16 bp, Homo sapiens
tcatctgggaaagaca

SEQ ID NO: 4678675 - DNA, 18 bp, Homo sapiens
tcatctgggaaagacatc

SEQ ID NO: 4678676 - DNA, 19 bp, Homo sapiens
tcatctgtgcaccacttga

SEQ ID NO: 4678677 - DNA, 16 bp, Homo sapiens
tcatctgtggagctgc

SEQ ID NO: 4678678 - DNA, 22 bp, Homo sapiens
tcatctgtggagctgccacaga

SEQ ID NO: 4678679 - DNA, 21 bp, Homo sapiens
tcatgaaaaagctgcttctta

SEQ ID NO: 4678680 - DNA, 22 bp, Homo sapiens
tcatgaaaactgtttttactaa

SEQ ID NO: 4678681 - DNA, 16 bp, Homo sapiens
tcatgagccttcagtc

SEQ ID NO: 4678682 - DNA, 10 bp, Homo sapiens
tcatgagctc

SEQ ID NO: 4678683 - DNA, 12 bp, Homo sapiens
tcatgagctcct

SEQ ID NO: 4678684 - DNA, 21 bp, Homo sapiens
tcatgagctcctgatcagagg

SEQ ID NO: 4678685 - DNA, 18 bp, Homo sapiens
tcatgattatagcaacta

SEQ ID NO: 4678686 - DNA, 22 bp, Homo sapiens
tcatgattatagcaactaatgt

SEQ ID NO: 4678687 - DNA, 13 bp, Homo sapiens
tcatgcaaaatat

SEQ ID NO: 4678688 - DNA, 13 bp, Homo sapiens
tcatgcctctgag

SEQ ID NO: 4678689 - DNA, 15 bp, Homo sapiens
tcatgcctctgaggc

SEQ ID NO: 4678690 - DNA, 22 bp, Homo sapiens
tcatgcctctgaggccagcctg

SEQ ID NO: 4678691 - DNA, 17 bp, Homo sapiens
tcatgctgtgcattttt

SEQ ID NO: 4678692 - DNA, 18 bp, Homo sapiens
tcatggagtagcctggac

SEQ ID NO: 4678693 - DNA, 21 bp, Homo sapiens
tcatggcagatgtaggaggga

SEQ ID NO: 4678694 - DNA, 19 bp, Homo sapiens
tcatggctaatttaacacc

SEQ ID NO: 4678695 - DNA, 16 bp, Homo sapiens
tcatggtacttcctct

SEQ ID NO: 4678696 - DNA, 18 bp, Homo sapiens
tcatgtcacctacatatg

SEQ ID NO: 4678697 - DNA, 16 bp, Homo sapiens
tcatgtcattatgaca

SEQ ID NO: 4678698 - DNA, 21 bp, Homo sapiens
tcatgtctgtatccccagtgc

SEQ ID NO: 4678699 - DNA, 19 bp, Homo sapiens
tcatgttgatcatgtactt

SEQ ID NO: 4678700 - DNA, 19 bp, Homo sapiens
tcatgttggccaggctggt

SEQ ID NO: 4678701 - DNA, 22 bp, Homo sapiens
tcatgttttccattgtttgaaa

SEQ ID NO: 4678702 - DNA, 23 bp, Homo sapiens
tatttgccagagccaaattttat

SEQ ID NO: 4678703 - DNA, 16 bp, Homo sapiens
tatttgccttctgaaa

SEQ ID NO: 4678704 - DNA, 23 bp, Homo sapiens
tatttgggagggaaaagggaagt

SEQ ID NO: 4678705 - DNA, 13 bp, Homo sapiens
tatttggtgtgtt

SEQ ID NO: 4678706 - DNA, 15 bp, Homo sapiens
tatttgtaaaccatt

SEQ ID NO: 4678707 - DNA, 16 bp, Homo sapiens
tatttgttcttcaaga

SEQ ID NO: 4678708 - DNA, 16 bp, Homo sapiens
tatttgtttgtagctt

SEQ ID NO: 4678709 - DNA, 14 bp, Homo sapiens
tattttaaactact

SEQ ID NO: 4678710 - DNA, 18 bp, Homo sapiens
tattttaagactgatttt

SEQ ID NO: 4678711 - DNA, 20 bp, Homo sapiens
tattttaatacctttaaata

SEQ ID NO: 4678712 - DNA, 13 bp, Homo sapiens
tattttcaaagaa

SEQ ID NO: 4678713 - DNA, 19 bp, Homo sapiens
tattttcccctatcattta

SEQ ID NO: 4678714 - DNA, 17 bp, Homo sapiens
tattttctccacttcat

SEQ ID NO: 4678715 - DNA, 16 bp, Homo sapiens
tattttcttttgaatt

SEQ ID NO: 4678716 - DNA, 16 bp, Homo sapiens
tattttgtaatattga

SEQ ID NO: 4678717 - DNA, 20 bp, Homo sapiens
tattttgtactttgtggaga

SEQ ID NO: 4678718 - DNA, 17 bp, Homo sapiens
tattttgtttcttttaa

SEQ ID NO: 4678719 - DNA, 19 bp, Homo sapiens
tatttttatatcatgcaaa

SEQ ID NO: 4678720 - DNA, 20 bp, Homo sapiens
tatttttatatcatgcaaaa

SEQ ID NO: 4678721 - DNA, 12 bp, Homo sapiens
tattttttaaga

SEQ ID NO: 4678722 - DNA, 13 bp, Homo sapiens
tattttttaagaa

SEQ ID NO: 4678723 - DNA, 19 bp, Homo sapiens
tatttttttgtaattgctt

SEQ ID NO: 4678724 - DNA, 11 bp, Homo sapiens
tcaaaaaatta

SEQ ID NO: 4678725 - DNA, 19 bp, Homo sapiens
tcaaaaaattatttgctat

SEQ ID NO: 4678726 - DNA, 19 bp, Homo sapiens
tcaaaatcagtttttcata

SEQ ID NO: 4678727 - DNA, 12 bp, Homo sapiens
tcaaaatttaaa

SEQ ID NO: 4678728 - DNA, 22 bp, Homo sapiens
tcaaacattcgtgagctgggga

SEQ ID NO: 4678729 - DNA, 17 bp, Homo sapiens
tcaaaccagtcactttt

SEQ ID NO: 4678730 - DNA, 20 bp, Homo sapiens
tcaaaccagtcacttttgtc

SEQ ID NO: 4678731 - DNA, 14 bp, Homo sapiens
tcaaagaaaataga

SEQ ID NO: 4678732 - DNA, 23 bp, Homo sapiens
tcaaaggaatataagaaaagtaa

SEQ ID NO: 4678733 - DNA, 12 bp, Homo sapiens
tcaaaggccaga

SEQ ID NO: 4678734 - DNA, 14 bp, Homo sapiens
tcaaaggccagacc

SEQ ID NO: 4678735 - DNA, 17 bp, Homo sapiens
tcaaagtataatctttc

SEQ ID NO: 4678736 - DNA, 14 bp, Homo sapiens
tcaaagtatgcaat

SEQ ID NO: 4678737 - DNA, 19 bp, Homo sapiens
tcaaataaaatatcataaa

SEQ ID NO: 4678738 - DNA, 12 bp, Homo sapiens
tcaaataaatgt

SEQ ID NO: 4678739 - DNA, 15 bp, Homo sapiens
tcaaatctaccactg

SEQ ID NO: 4678740 - DNA, 22 bp, Homo sapiens
tcaacaaatttcattgcacttt

SEQ ID NO: 4678741 - DNA, 18 bp, Homo sapiens
tcaacaacatcagaaaga

SEQ ID NO: 4678742 - DNA, 19 bp, Homo sapiens
tcaacaacatcagaaagaa

SEQ ID NO: 4678743 - DNA, 19 bp, Homo sapiens
tcaacatactgtaatcaaa

SEQ ID NO: 4678744 - DNA, 17 bp, Homo sapiens
tcaaccggaaggaggcc

SEQ ID NO: 4678745 - DNA, 12 bp, Homo sapiens
tcaacctcctgg

SEQ ID NO: 4678746 - DNA, 13 bp, Homo sapiens
tcaacctcctgga

SEQ ID NO: 4678747 - DNA, 23 bp, Homo sapiens
tcaacgcctcactgaaacatggc

SEQ ID NO: 4678748 - DNA, 22 bp, Homo sapiens
tcaacggtctggcagggcagca

SEQ ID NO: 4678749 - DNA, 23 bp, Homo sapiens
tcaacggtctggcagggcagcag

SEQ ID NO: 4678750 - DNA, 17 bp, Homo sapiens
tcaactaatacatggtt

SEQ ID NO: 4678751 - DNA, 18 bp, Homo sapiens
tcaactccctcctttagt

SEQ ID NO: 4678752 - DNA, 12 bp, Homo sapiens
tcaactttcaga

SEQ ID NO: 4678753 - DNA, 15 bp, Homo sapiens
tcaagaaacagccag

SEQ ID NO: 4678754 - DNA, 16 bp, Homo sapiens
tcaagaaacagccagc

SEQ ID NO: 4678755 - DNA, 20 bp, Homo sapiens
tcaagaaataaaaggaagcc

SEQ ID NO: 4678756 - DNA, 21 bp, Homo sapiens
tcaagaaataaaaggaagcca

SEQ ID NO: 4678757 - DNA, 22 bp, Homo sapiens
tcaagaaataaaaggaagccaa

SEQ ID NO: 4678758 - DNA, 17 bp, Homo sapiens
tcaagactcaatgtgga

SEQ ID NO: 4678759 - DNA, 15 bp, Homo sapiens
tcaagagaaacttca

SEQ ID NO: 4678760 - DNA, 22 bp, Homo sapiens
tcaagagctagaaaaataaaat

SEQ ID NO: 4678761 - DNA, 23 bp, Homo sapiens
tcaagagtgagatgtagaaagtt

SEQ ID NO: 4678762 - DNA, 18 bp, Homo sapiens
tcaagccccatttcctca

SEQ ID NO: 4678763 - DNA, 15 bp, Homo sapiens
tcaagctcatgtcat

SEQ ID NO: 4678764 - DNA, 18 bp, Homo sapiens
tcaagctcatgtcattat

SEQ ID NO: 4678765 - DNA, 14 bp, Homo sapiens
tcaagctcctagta

SEQ ID NO: 4678766 - DNA, 21 bp, Homo sapiens
tcaagctcctagtatgccctg

SEQ ID NO: 4678767 - DNA, 12 bp, Homo sapiens
tcaagctttccc

SEQ ID NO: 4678768 - DNA, 12 bp, Homo sapiens
tcaaggccttca

SEQ ID NO: 4678769 - DNA, 14 bp, Homo sapiens
tcaaggccttcagt

SEQ ID NO: 4678770 - DNA, 22 bp, Homo sapiens
tcaagtgaggtgacactccagt

SEQ ID NO: 4678771 - DNA, 12 bp, Homo sapiens
tcaagtgtcacc

SEQ ID NO: 4678772 - DNA, 14 bp, Homo sapiens
tcaagtgtcacctc

SEQ ID NO: 4678773 - DNA, 17 bp, Homo sapiens
tcaagtgtcacctcctt

SEQ ID NO: 4678774 - DNA, 18 bp, Homo sapiens
tcaagtgtcacctccttc

SEQ ID NO: 4678775 - DNA, 17 bp, Homo sapiens
tcaataaacaacagctg

SEQ ID NO: 4678776 - DNA, 18 bp, Homo sapiens
tcaataaagttgttgcat

SEQ ID NO: 4678777 - DNA, 19 bp, Homo sapiens
tcaataaagttgttgcatt

SEQ ID NO: 4678778 - DNA, 13 bp, Homo sapiens
tcaatacagtgaa

SEQ ID NO: 4678779 - DNA, 17 bp, Homo sapiens
tcaatatgaatctataa

SEQ ID NO: 4678780 - DNA, 16 bp, Homo sapiens
tcaatatttttatatc

SEQ ID NO: 4678781 - DNA, 13 bp, Homo sapiens
tcaatcattgaag

SEQ ID NO: 4678782 - DNA, 22 bp, Homo sapiens
tcaatcattgaagtatattctt

SEQ ID NO: 4678783 - DNA, 20 bp, Homo sapiens
tcaatgaccattcaattagt

SEQ ID NO: 4678784 - DNA, 21 bp, Homo sapiens
tcaattagtggtcataaaata

SEQ ID NO: 4678785 - DNA, 14 bp, Homo sapiens
tcaattccaccagg

SEQ ID NO: 4678786 - DNA, 14 bp, Homo sapiens
tcaattctgtgtgg

SEQ ID NO: 4678787 - DNA, 12 bp, Homo sapiens
tcaattgacaaa

SEQ ID NO: 4678788 - DNA, 13 bp, Homo sapiens
tcaattttatgta

SEQ ID NO: 4678789 - DNA, 22 bp, Homo sapiens
tcacaaataagtaatatctttc

SEQ ID NO: 4678790 - DNA, 22 bp, Homo sapiens
tcacaaatttcacttatacctg

SEQ ID NO: 4678791 - DNA, 22 bp, Homo sapiens
tcacaactccttccatccttga

SEQ ID NO: 4678792 - DNA, 18 bp, Homo sapiens
tcacaaggcagcaaggcc

SEQ ID NO: 4678793 - DNA, 22 bp, Homo sapiens
tcacaaggcagcaaggcccgag

SEQ ID NO: 4678794 - DNA, 18 bp, Homo sapiens
tcacacccaccccctgcc

SEQ ID NO: 4678795 - DNA, 13 bp, Homo sapiens
tcacacccctgcc

SEQ ID NO: 4678796 - DNA, 16 bp, Homo sapiens
tcacagaaaatttaac

SEQ ID NO: 4678797 - DNA, 22 bp, Homo sapiens
tcacagccccacccttgtccct

SEQ ID NO: 4678798 - DNA, 13 bp, Homo sapiens
tcacagcttttct

SEQ ID NO: 4678799 - DNA, 14 bp, Homo sapiens
tcacagcttttctt

SEQ ID NO: 4678800 - DNA, 12 bp, Homo sapiens
tcacaggctaat

SEQ ID NO: 4678801 - DNA, 14 bp, Homo sapiens
tcacaggctgagaa

SEQ ID NO: 4678802 - DNA, 19 bp, Homo sapiens
tcacagtacagcatgtgcc

SEQ ID NO: 4678803 - DNA, 20 bp, Homo sapiens
tcacagtacagcatgtgcct

SEQ ID NO: 4678804 - DNA, 19 bp, Homo sapiens
tcacatctcccttccacct

SEQ ID NO: 4678805 - DNA, 22 bp, Homo sapiens
tcacatctcccttccacctcac

SEQ ID NO: 4678806 - DNA, 21 bp, Homo sapiens
tcacatggcctatgcacatat

SEQ ID NO: 4678807 - DNA, 15 bp, Homo sapiens
tcacattaatttaat

SEQ ID NO: 4678808 - DNA, 19 bp, Homo sapiens
tcacattatttattaaaaa

SEQ ID NO: 4678809 - DNA, 20 bp, Homo sapiens
tcacattatttattaaaaat

SEQ ID NO: 4678810 - DNA, 14 bp, Homo sapiens
tcacattcttggct

SEQ ID NO: 4678811 - DNA, 21 bp, Homo sapiens
tcacattcttggcttaatcat

SEQ ID NO: 4678812 - DNA, 18 bp, Homo sapiens
tcacattgttcaactccc

SEQ ID NO: 4678813 - DNA, 15 bp, Homo sapiens
tatggagagccctgg

SEQ ID NO: 4678814 - DNA, 16 bp, Homo sapiens
tatggcaggagctact

SEQ ID NO: 4678815 - DNA, 22 bp, Homo sapiens
tatggctctgcacccctctgcc

SEQ ID NO: 4678816 - DNA, 22 bp, Homo sapiens
tatggcttatttctatgacaaa

SEQ ID NO: 4678817 - DNA, 19 bp, Homo sapiens
tatgggagcttaactttat

SEQ ID NO: 4678818 - DNA, 20 bp, Homo sapiens
tatgggatattcccaagccg

SEQ ID NO: 4678819 - DNA, 12 bp, Homo sapiens
tatggtgagatg

SEQ ID NO: 4678820 - DNA, 18 bp, Homo sapiens
tatggtgctgctctgtgt

SEQ ID NO: 4678821 - DNA, 22 bp, Homo sapiens
tatgtaaaaggccaaacctctg

SEQ ID NO: 4678822 - DNA, 15 bp, Homo sapiens
tatgtaatttcaaaa

SEQ ID NO: 4678823 - DNA, 19 bp, Homo sapiens
tatgtaatttcaaaataca

SEQ ID NO: 4678824 - DNA, 21 bp, Homo sapiens
tatgtaccatatgatctgttt

SEQ ID NO: 4678825 - DNA, 19 bp, Homo sapiens
tatgtacttgtcaaagaag

SEQ ID NO: 4678826 - DNA, 21 bp, Homo sapiens
tatgtcaataaacaacagctg

SEQ ID NO: 4678827 - DNA, 15 bp, Homo sapiens
tatgtccactgttct

SEQ ID NO: 4678828 - DNA, 19 bp, Homo sapiens
tatgtcttactactttaaa

SEQ ID NO: 4678829 - DNA, 21 bp, Homo sapiens
tatgtcttgcaaagcctttaa

SEQ ID NO: 4678830 - DNA, 17 bp, Homo sapiens
tatgtcttggacactgt

SEQ ID NO: 4678831 - DNA, 19 bp, Homo sapiens
tatgtcttggacactgtac

SEQ ID NO: 4678832 - DNA, 21 bp, Homo sapiens
tatgtcttggacactgtacaa

SEQ ID NO: 4678833 - DNA, 16 bp, Homo sapiens
tatgtgaaaaattaac

SEQ ID NO: 4678834 - DNA, 19 bp, Homo sapiens
tatgtgattttcctttgta

SEQ ID NO: 4678835 - DNA, 22 bp, Homo sapiens
tatgttagtataagcttttcac

SEQ ID NO: 4678836 - DNA, 13 bp, Homo sapiens
tatgttcactgtc

SEQ ID NO: 4678837 - DNA, 19 bp, Homo sapiens
tatgttcctaacaaaatga

SEQ ID NO: 4678838 - DNA, 21 bp, Homo sapiens
tatgttcctaacaaaatgaga

SEQ ID NO: 4678839 - DNA, 16 bp, Homo sapiens
tatgttctgtcttccc

SEQ ID NO: 4678840 - DNA, 16 bp, Homo sapiens
tatgtttaaaagaaat

SEQ ID NO: 4678841 - DNA, 19 bp, Homo sapiens
tatgtttaaaagaaatata

SEQ ID NO: 4678842 - DNA, 18 bp, Homo sapiens
tatgtttatttactaatt

SEQ ID NO: 4678843 - DNA, 17 bp, Homo sapiens
tatgtttatttcatgtg

SEQ ID NO: 4678844 - DNA, 15 bp, Homo sapiens
tatgtttgatttctc

SEQ ID NO: 4678845 - DNA, 14 bp, Homo sapiens
tattaaaaatgttc

SEQ ID NO: 4678846 - DNA, 17 bp, Homo sapiens
tattaaaaatgttctca

SEQ ID NO: 4678847 - DNA, 21 bp, Homo sapiens
tattaaaaatgttctcaaata

SEQ ID NO: 4678848 - DNA, 14 bp, Homo sapiens
tattaaaagaatga

SEQ ID NO: 4678849 - DNA, 23 bp, Homo sapiens
tattaaacaagtcaattctgtgt

SEQ ID NO: 4678850 - DNA, 20 bp, Homo sapiens
tattaaacgtatgcatgtga

SEQ ID NO: 4678851 - DNA, 16 bp, Homo sapiens
tattaaccttttttgt

SEQ ID NO: 4678852 - DNA, 22 bp, Homo sapiens
tattaatactacccatagaaaa

SEQ ID NO: 4678853 - DNA, 20 bp, Homo sapiens
tattaatcaagagaaacttc

SEQ ID NO: 4678854 - DNA, 14 bp, Homo sapiens
tattacaaatgcaa

SEQ ID NO: 4678855 - DNA, 15 bp, Homo sapiens
tattacaaatgcaaa

SEQ ID NO: 4678856 - DNA, 22 bp, Homo sapiens
tattacataaaggctaactatg

SEQ ID NO: 4678857 - DNA, 22 bp, Homo sapiens
tattaccatcttaatctttatt

SEQ ID NO: 4678858 - DNA, 12 bp, Homo sapiens
tattaccccttc

SEQ ID NO: 4678859 - DNA, 14 bp, Homo sapiens
tattaccccttcat

SEQ ID NO: 4678860 - DNA, 16 bp, Homo sapiens
tattacctcaggtgcc

SEQ ID NO: 4678861 - DNA, 22 bp, Homo sapiens
tattactaaggagtaatctgtg

SEQ ID NO: 4678862 - DNA, 15 bp, Homo sapiens
tattagctgaaacaa

SEQ ID NO: 4678863 - DNA, 19 bp, Homo sapiens
tattagttaatggattaaa

SEQ ID NO: 4678864 - DNA, 21 bp, Homo sapiens
tattataaagccaattatctg

SEQ ID NO: 4678865 - DNA, 20 bp, Homo sapiens
tattatcattgctcccctga

SEQ ID NO: 4678866 - DNA, 19 bp, Homo sapiens
tattatgcattatatcaaa

SEQ ID NO: 4678867 - DNA, 13 bp, Homo sapiens
tattatgtttatt

SEQ ID NO: 4678868 - DNA, 20 bp, Homo sapiens
tattatgtttgatttctcta

SEQ ID NO: 4678869 - DNA, 15 bp, Homo sapiens
tattattatctttaa

SEQ ID NO: 4678870 - DNA, 16 bp, Homo sapiens
tattattattattttc

SEQ ID NO: 4678871 - DNA, 14 bp, Homo sapiens
tattattgctgaag

SEQ ID NO: 4678872 - DNA, 14 bp, Homo sapiens
tattattgttaata

SEQ ID NO: 4678873 - DNA, 13 bp, Homo sapiens
tattattttccaa

SEQ ID NO: 4678874 - DNA, 17 bp, Homo sapiens
tattcaagaatgaaaaa

SEQ ID NO: 4678875 - DNA, 18 bp, Homo sapiens
tattcaagaatgaaaaat

SEQ ID NO: 4678876 - DNA, 13 bp, Homo sapiens
tattcacagtttt

SEQ ID NO: 4678877 - DNA, 14 bp, Homo sapiens
tattcagataatta

SEQ ID NO: 4678878 - DNA, 13 bp, Homo sapiens
tattccaggagaa

SEQ ID NO: 4678879 - DNA, 14 bp, Homo sapiens
tattccaggagaag

SEQ ID NO: 4678880 - DNA, 16 bp, Homo sapiens
tattccttttaaagaa

SEQ ID NO: 4678881 - DNA, 20 bp, Homo sapiens
tattccttttaaagaagctt

SEQ ID NO: 4678882 - DNA, 14 bp, Homo sapiens
tattctagagcttt

SEQ ID NO: 4678883 - DNA, 16 bp, Homo sapiens
tattctagcctgcatt

SEQ ID NO: 4678884 - DNA, 15 bp, Homo sapiens
tattctatctgtttt

SEQ ID NO: 4678885 - DNA, 14 bp, Homo sapiens
tattctcttttatc

SEQ ID NO: 4678886 - DNA, 18 bp, Homo sapiens
tattctcttttatctgtt

SEQ ID NO: 4678887 - DNA, 16 bp, Homo sapiens
tattctgaagcaacat

SEQ ID NO: 4678888 - DNA, 13 bp, Homo sapiens
tattctttacaaa

SEQ ID NO: 4678889 - DNA, 14 bp, Homo sapiens
tattgaaggaattt

SEQ ID NO: 4678890 - DNA, 19 bp, Homo sapiens
tattgagggataattggtt

SEQ ID NO: 4678891 - DNA, 20 bp, Homo sapiens
tattgccatccactcctttt

SEQ ID NO: 4678892 - DNA, 15 bp, Homo sapiens
tattgctctatgtta

SEQ ID NO: 4678893 - DNA, 22 bp, Homo sapiens
tattgtaatatgacagataacc

SEQ ID NO: 4678894 - DNA, 14 bp, Homo sapiens
tattgtacagtttt

SEQ ID NO: 4678895 - DNA, 17 bp, Homo sapiens
tattgtacagtttttat

SEQ ID NO: 4678896 - DNA, 20 bp, Homo sapiens
tattgttaataataattatt

SEQ ID NO: 4678897 - DNA, 13 bp, Homo sapiens
tattgttgttact

SEQ ID NO: 4678898 - DNA, 12 bp, Homo sapiens
tattgtttctgc

SEQ ID NO: 4678899 - DNA, 17 bp, Homo sapiens
tatttactaactaaata

SEQ ID NO: 4678900 - DNA, 13 bp, Homo sapiens
tatttagaagcag

SEQ ID NO: 4678901 - DNA, 22 bp, Homo sapiens
tatttagctccaaaccttcaca

SEQ ID NO: 4678902 - DNA, 24 bp, Homo sapiens
tatttataaaaagatgatcgctgt

SEQ ID NO: 4678903 - DNA, 14 bp, Homo sapiens
tatttataagagaa

SEQ ID NO: 4678904 - DNA, 13 bp, Homo sapiens
tatttatgccttg

SEQ ID NO: 4678905 - DNA, 19 bp, Homo sapiens
tatttatgccttgatgatt

SEQ ID NO: 4678906 - DNA, 21 bp, Homo sapiens
tatttatgccttgatgattta

SEQ ID NO: 4678907 - DNA, 19 bp, Homo sapiens
tatttattaaaaatgttct

SEQ ID NO: 4678908 - DNA, 12 bp, Homo sapiens
tatttattaccg

SEQ ID NO: 4678909 - DNA, 20 bp, Homo sapiens
tatttattgttagaaaatga

SEQ ID NO: 4678910 - DNA, 24 bp, Homo sapiens
tatttattgttagaaaatgactta

SEQ ID NO: 4678911 - DNA, 12 bp, Homo sapiens
tatttatttcta

SEQ ID NO: 4678912 - DNA, 14 bp, Homo sapiens
tatttatttctagt

SEQ ID NO: 4678913 - DNA, 13 bp, Homo sapiens
tatttattttctt

SEQ ID NO: 4678914 - DNA, 21 bp, Homo sapiens
tatttattttcttttgaattg

SEQ ID NO: 4678915 - DNA, 13 bp, Homo sapiens
tatttcagaagga

SEQ ID NO: 4678916 - DNA, 15 bp, Homo sapiens
tatttccactaaaaa

SEQ ID NO: 4678917 - DNA, 22 bp, Homo sapiens
tatttccttccagcctttttag

SEQ ID NO: 4678918 - DNA, 16 bp, Homo sapiens
tatttcgtttggtctt

SEQ ID NO: 4678919 - DNA, 19 bp, Homo sapiens
tatttctatgacaaattca

SEQ ID NO: 4678920 - DNA, 21 bp, Homo sapiens
tatttctattattaattgcaa

SEQ ID NO: 4678921 - DNA, 13 bp, Homo sapiens
tatttctgctctg

SEQ ID NO: 4678922 - DNA, 13 bp, Homo sapiens
tatttctgttcct

SEQ ID NO: 4678923 - DNA, 16 bp, Homo sapiens
tatttgatttctaatt

SEQ ID NO: 4678924 - DNA, 19 bp, Homo sapiens
tataatgttgataatatat

SEQ ID NO: 4678925 - DNA, 20 bp, Homo sapiens
tataattagtcgggcatgag

SEQ ID NO: 4678926 - DNA, 15 bp, Homo sapiens
tatacaaaaaatttt

SEQ ID NO: 4678927 - DNA, 17 bp, Homo sapiens
tatacaataacccagtt

SEQ ID NO: 4678928 - DNA, 20 bp, Homo sapiens
tatacagaggaaatctgtaa

SEQ ID NO: 4678929 - DNA, 18 bp, Homo sapiens
tatacatacatgtatctg

SEQ ID NO: 4678930 - DNA, 22 bp, Homo sapiens
tatacattttctaaataaaaat

SEQ ID NO: 4678931 - DNA, 15 bp, Homo sapiens
tatacctcaaactat

SEQ ID NO: 4678932 - DNA, 18 bp, Homo sapiens
tatacgataaataacttt

SEQ ID NO: 4678933 - DNA, 23 bp, Homo sapiens
tatactcagggattccttctaag

SEQ ID NO: 4678934 - DNA, 12 bp, Homo sapiens
tatactgagggg

SEQ ID NO: 4678935 - DNA, 13 bp, Homo sapiens
tatactggcatgc

SEQ ID NO: 4678936 - DNA, 23 bp, Homo sapiens
tatactggcatgctaaagccttc

SEQ ID NO: 4678937 - DNA, 13 bp, Homo sapiens
tatactgttcttc

SEQ ID NO: 4678938 - DNA, 16 bp, Homo sapiens
tatacttgtaaaacca

SEQ ID NO: 4678939 - DNA, 17 bp, Homo sapiens
tatagacattctcacat

SEQ ID NO: 4678940 - DNA, 17 bp, Homo sapiens
tatagcaactaatgttt

SEQ ID NO: 4678941 - DNA, 16 bp, Homo sapiens
tataggaacagcccag

SEQ ID NO: 4678942 - DNA, 20 bp, Homo sapiens
tataggctagacttagattc

SEQ ID NO: 4678943 - DNA, 13 bp, Homo sapiens
tatagtagatttt

SEQ ID NO: 4678944 - DNA, 16 bp, Homo sapiens
tatagttgcagcccaa

SEQ ID NO: 4678945 - DNA, 23 bp, Homo sapiens
tatataaattttttttgtttcat

SEQ ID NO: 4678946 - DNA, 14 bp, Homo sapiens
tatataatttactt

SEQ ID NO: 4678947 - DNA, 18 bp, Homo sapiens
tatataatttactttgta

SEQ ID NO: 4678948 - DNA, 13 bp, Homo sapiens
tatatagaatgct

SEQ ID NO: 4678949 - DNA, 14 bp, Homo sapiens
tatatatatatata

SEQ ID NO: 4678950 - DNA, 14 bp, Homo sapiens
tatatattataaaa

SEQ ID NO: 4678951 - DNA, 12 bp, Homo sapiens
tatatcactcta

SEQ ID NO: 4678952 - DNA, 13 bp, Homo sapiens
tatatcatcttta

SEQ ID NO: 4678953 - DNA, 14 bp, Homo sapiens
tatatcatgcaaaa

SEQ ID NO: 4678954 - DNA, 16 bp, Homo sapiens
tatatctatatgtact

SEQ ID NO: 4678955 - DNA, 17 bp, Homo sapiens
tatatgccaagctaatt

SEQ ID NO: 4678956 - DNA, 15 bp, Homo sapiens
tatatggcaggagct

SEQ ID NO: 4678957 - DNA, 22 bp, Homo sapiens
tatatgtgacactgcagcagaa

SEQ ID NO: 4678958 - DNA, 22 bp, Homo sapiens
tatattaccccttcatgtccta

SEQ ID NO: 4678959 - DNA, 12 bp, Homo sapiens
tatattatatac

SEQ ID NO: 4678960 - DNA, 20 bp, Homo sapiens
tatattccttttaaagaagc

SEQ ID NO: 4678961 - DNA, 18 bp, Homo sapiens
tatattcttattggaaat

SEQ ID NO: 4678962 - DNA, 22 bp, Homo sapiens
tatattcttattggaaatgtac

SEQ ID NO: 4678963 - DNA, 12 bp, Homo sapiens
tatatttattgt

SEQ ID NO: 4678964 - DNA, 18 bp, Homo sapiens
tatatttttaaaaaatga

SEQ ID NO: 4678965 - DNA, 12 bp, Homo sapiens
tatcaaagagca

SEQ ID NO: 4678966 - DNA, 15 bp, Homo sapiens
tatcaaagagcactt

SEQ ID NO: 4678967 - DNA, 17 bp, Homo sapiens
tatcaaataaaatatca

SEQ ID NO: 4678968 - DNA, 14 bp, Homo sapiens
tatcacattaattt

SEQ ID NO: 4678969 - DNA, 17 bp, Homo sapiens
tatcagaataggaagat

SEQ ID NO: 4678970 - DNA, 20 bp, Homo sapiens
tatcagcacatattttctgt

SEQ ID NO: 4678971 - DNA, 14 bp, Homo sapiens
tatcagggcctgag

SEQ ID NO: 4678972 - DNA, 16 bp, Homo sapiens
tatcagggcctgagtg

SEQ ID NO: 4678973 - DNA, 14 bp, Homo sapiens
tatcatgcaaaata

SEQ ID NO: 4678974 - DNA, 14 bp, Homo sapiens
tatcattctttgta

SEQ ID NO: 4678975 - DNA, 14 bp, Homo sapiens
tatcattttattca

SEQ ID NO: 4678976 - DNA, 12 bp, Homo sapiens
tatccaaggaaa

SEQ ID NO: 4678977 - DNA, 18 bp, Homo sapiens
tatccagaggacccaact

SEQ ID NO: 4678978 - DNA, 15 bp, Homo sapiens
tatccaggcaccagg

SEQ ID NO: 4678979 - DNA, 17 bp, Homo sapiens
tatccaggcaccaggac

SEQ ID NO: 4678980 - DNA, 18 bp, Homo sapiens
tatcctgggggaagagga

SEQ ID NO: 4678981 - DNA, 16 bp, Homo sapiens
tatccttacaatgtga

SEQ ID NO: 4678982 - DNA, 14 bp, Homo sapiens
tatccttttatctc

SEQ ID NO: 4678983 - DNA, 19 bp, Homo sapiens
tatcgatgttatgtaaaag

SEQ ID NO: 4678984 - DNA, 22 bp, Homo sapiens
tatctacattaaaatgacaaac

SEQ ID NO: 4678985 - DNA, 15 bp, Homo sapiens
tatctcactgtttta

SEQ ID NO: 4678986 - DNA, 16 bp, Homo sapiens
tatctcgaatttgaag

SEQ ID NO: 4678987 - DNA, 17 bp, Homo sapiens
tatctctttctttctct

SEQ ID NO: 4678988 - DNA, 18 bp, Homo sapiens
tatctgggctgtgggcaa

SEQ ID NO: 4678989 - DNA, 17 bp, Homo sapiens
tatctgggttaagtgtt

SEQ ID NO: 4678990 - DNA, 18 bp, Homo sapiens
tatctgtttttaaagcac

SEQ ID NO: 4678991 - DNA, 19 bp, Homo sapiens
tatcttaaaggacataaaa

SEQ ID NO: 4678992 - DNA, 14 bp, Homo sapiens
tatcttaaatttga

SEQ ID NO: 4678993 - DNA, 20 bp, Homo sapiens
tatcttaggtagtcatgctg

SEQ ID NO: 4678994 - DNA, 17 bp, Homo sapiens
tatcttattaaagtatt

SEQ ID NO: 4678995 - DNA, 15 bp, Homo sapiens
tatcttgctcattct

SEQ ID NO: 4678996 - DNA, 11 bp, Homo sapiens
tatcttggcct

SEQ ID NO: 4678997 - DNA, 15 bp, Homo sapiens
tatcttttttcaaaa

SEQ ID NO: 4678998 - DNA, 22 bp, Homo sapiens
tatgaaaatatagacattctca

SEQ ID NO: 4678999 - DNA, 15 bp, Homo sapiens
tatgaaagaggcagc

SEQ ID NO: 4679000 - DNA, 22 bp, Homo sapiens
tatgaacacagacaaagtgcta

SEQ ID NO: 4679001 - DNA, 19 bp, Homo sapiens
tatgaagtgcgtgaatgta

SEQ ID NO: 4679002 - DNA, 13 bp, Homo sapiens
tatgaatatcatt

SEQ ID NO: 4679003 - DNA, 15 bp, Homo sapiens
tatgaatatcattga

SEQ ID NO: 4679004 - DNA, 13 bp, Homo sapiens
tatgaatctataa

SEQ ID NO: 4679005 - DNA, 21 bp, Homo sapiens
tatgaatgcccccagctggcc

SEQ ID NO: 4679006 - DNA, 17 bp, Homo sapiens
tatgacaaattcaagag

SEQ ID NO: 4679007 - DNA, 16 bp, Homo sapiens
tatgacccctggccac

SEQ ID NO: 4679008 - DNA, 22 bp, Homo sapiens
tatgacccctggccacagcctt

SEQ ID NO: 4679009 - DNA, 23 bp, Homo sapiens
tatgacccctggccacagccttc

SEQ ID NO: 4679010 - DNA, 22 bp, Homo sapiens
tatgacttgggcacccccagcc

SEQ ID NO: 4679011 - DNA, 23 bp, Homo sapiens
tatgacttgggcacccccagcct

SEQ ID NO: 4679012 - DNA, 13 bp, Homo sapiens
tatgactttttat

SEQ ID NO: 4679013 - DNA, 19 bp, Homo sapiens
tatgactttttataaaatg

SEQ ID NO: 4679014 - DNA, 19 bp, Homo sapiens
tatgagatctaatgtgaaa

SEQ ID NO: 4679015 - DNA, 16 bp, Homo sapiens
tatgatcagtgttact

SEQ ID NO: 4679016 - DNA, 13 bp, Homo sapiens
tatgatccttttt

SEQ ID NO: 4679017 - DNA, 15 bp, Homo sapiens
tatgatctgttttgt

SEQ ID NO: 4679018 - DNA, 20 bp, Homo sapiens
tatgatctgttttgtatctt

SEQ ID NO: 4679019 - DNA, 16 bp, Homo sapiens
tatgattttttcatga

SEQ ID NO: 4679020 - DNA, 11 bp, Homo sapiens
tatgcaaatac

SEQ ID NO: 4679021 - DNA, 18 bp, Homo sapiens
tatgcaaggcggtacact

SEQ ID NO: 4679022 - DNA, 17 bp, Homo sapiens
tatgcaatggattttca

SEQ ID NO: 4679023 - DNA, 22 bp, Homo sapiens
tatgcaatggattttcaaccag

SEQ ID NO: 4679024 - DNA, 20 bp, Homo sapiens
tatgcacatatggactctgc

SEQ ID NO: 4679025 - DNA, 12 bp, Homo sapiens
tatgcactttta

SEQ ID NO: 4679026 - DNA, 19 bp, Homo sapiens
tatgcacttttagaaatgc

SEQ ID NO: 4679027 - DNA, 23 bp, Homo sapiens
tatgcacttttagaaatgcatat

SEQ ID NO: 4679028 - DNA, 15 bp, Homo sapiens
tatgccactgcactc

SEQ ID NO: 4679029 - DNA, 14 bp, Homo sapiens
tatgccacttcctt

SEQ ID NO: 4679030 - DNA, 13 bp, Homo sapiens
tatgccttctgta

SEQ ID NO: 4679031 - DNA, 14 bp, Homo sapiens
tatgccttctgtat

SEQ ID NO: 4679032 - DNA, 14 bp, Homo sapiens
tatgccttcttatt

SEQ ID NO: 4679033 - DNA, 21 bp, Homo sapiens
tatgctgatcttttaaaatca

SEQ ID NO: 4679034 - DNA, 13 bp, Homo sapiens
tatggaaaactgt

SEQ ID NO: 4679035 - DNA, 12 bp, Homo sapiens
tatggactctgc

SEQ ID NO: 4679036 - DNA, 21 bp, Homo sapiens
tagccaactgtttccctgctg

SEQ ID NO: 4679037 - DNA, 22 bp, Homo sapiens
tagccaactgtttccctgctga

SEQ ID NO: 4679038 - DNA, 23 bp, Homo sapiens
tagccaactgtttccctgctgaa

SEQ ID NO: 4679039 - DNA, 13 bp, Homo sapiens
tagccagaattct

SEQ ID NO: 4679040 - DNA, 19 bp, Homo sapiens
tagccagcacacagggcag

SEQ ID NO: 4679041 - DNA, 20 bp, Homo sapiens
tagccagcacacagggcagt

SEQ ID NO: 4679042 - DNA, 17 bp, Homo sapiens
tagccagccaggtgcat

SEQ ID NO: 4679043 - DNA, 15 bp, Homo sapiens
tagccagctgctccc

SEQ ID NO: 4679044 - DNA, 18 bp, Homo sapiens
tagccagctgctccccag

SEQ ID NO: 4679045 - DNA, 16 bp, Homo sapiens
tagccaggtactgcat

SEQ ID NO: 4679046 - DNA, 24 bp, Homo sapiens
tagccataattttgcatactgaaa

SEQ ID NO: 4679047 - DNA, 14 bp, Homo sapiens
tagcccagtgtttt

SEQ ID NO: 4679048 - DNA, 13 bp, Homo sapiens
tagcctgatgaga

SEQ ID NO: 4679049 - DNA, 23 bp, Homo sapiens
tagcctggactgtttcatagttt

SEQ ID NO: 4679050 - DNA, 17 bp, Homo sapiens
tagcctttgggcacaat

SEQ ID NO: 4679051 - DNA, 23 bp, Homo sapiens
tagcctttgggcacaattcctgt

SEQ ID NO: 4679052 - DNA, 22 bp, Homo sapiens
tagctacttggcaggctgaggt

SEQ ID NO: 4679053 - DNA, 20 bp, Homo sapiens
tagctatagttgcagcccaa

SEQ ID NO: 4679054 - DNA, 21 bp, Homo sapiens
tagctccataaagtacaaatg

SEQ ID NO: 4679055 - DNA, 13 bp, Homo sapiens
tagctctctaggc

SEQ ID NO: 4679056 - DNA, 20 bp, Homo sapiens
tagctctgaaatcaactctc

SEQ ID NO: 4679057 - DNA, 17 bp, Homo sapiens
tagctgaaaagggcact

SEQ ID NO: 4679058 - DNA, 11 bp, Homo sapiens
tagctgagctc

SEQ ID NO: 4679059 - DNA, 13 bp, Homo sapiens
tagctgtgacctg

SEQ ID NO: 4679060 - DNA, 18 bp, Homo sapiens
tagctgtgacctgctgag

SEQ ID NO: 4679061 - DNA, 20 bp, Homo sapiens
tagctgtgacctgctgagct

SEQ ID NO: 4679062 - DNA, 22 bp, Homo sapiens
tagctgtgacctgctgagctct

SEQ ID NO: 4679063 - DNA, 12 bp, Homo sapiens
tagcttctttcc

SEQ ID NO: 4679064 - DNA, 24 bp, Homo sapiens
tagctttacattttcagtaccaaa

SEQ ID NO: 4679065 - DNA, 17 bp, Homo sapiens
tagctttcaattccgta

SEQ ID NO: 4679066 - DNA, 12 bp, Homo sapiens
tagctttcctgg

SEQ ID NO: 4679067 - DNA, 15 bp, Homo sapiens
tagctttttattatt

SEQ ID NO: 4679068 - DNA, 23 bp, Homo sapiens
taggaatggaggagccaggcccc

SEQ ID NO: 4679069 - DNA, 19 bp, Homo sapiens
taggacacagttcctggga

SEQ ID NO: 4679070 - DNA, 14 bp, Homo sapiens
taggactgtagaaa

SEQ ID NO: 4679071 - DNA, 14 bp, Homo sapiens
taggagggactgtc

SEQ ID NO: 4679072 - DNA, 14 bp, Homo sapiens
taggatactgctgc

SEQ ID NO: 4679073 - DNA, 18 bp, Homo sapiens
taggatagctaactgtaa

SEQ ID NO: 4679074 - DNA, 15 bp, Homo sapiens
taggattgacattct

SEQ ID NO: 4679075 - DNA, 21 bp, Homo sapiens
taggattgacattctacagtt

SEQ ID NO: 4679076 - DNA, 13 bp, Homo sapiens
taggatttttaga

SEQ ID NO: 4679077 - DNA, 17 bp, Homo sapiens
taggcactgttcaatac

SEQ ID NO: 4679078 - DNA, 14 bp, Homo sapiens
taggcaggacctgt

SEQ ID NO: 4679079 - DNA, 16 bp, Homo sapiens
taggcatttcctgctg

SEQ ID NO: 4679080 - DNA, 17 bp, Homo sapiens
taggcatttcctgctga

SEQ ID NO: 4679081 - DNA, 9 bp, Homo sapiens
taggcccaa

SEQ ID NO: 4679082 - DNA, 16 bp, Homo sapiens
taggccccagaggccc

SEQ ID NO: 4679083 - DNA, 19 bp, Homo sapiens
taggcccggagctgcccct

SEQ ID NO: 4679084 - DNA, 22 bp, Homo sapiens
taggcctagtacaatcttggga

SEQ ID NO: 4679085 - DNA, 14 bp, Homo sapiens
taggctaatgtcaa

SEQ ID NO: 4679086 - DNA, 20 bp, Homo sapiens
tagggactgtcctagccagg

SEQ ID NO: 4679087 - DNA, 18 bp, Homo sapiens
tagggagaatatttacta

SEQ ID NO: 4679088 - DNA, 20 bp, Homo sapiens
tagggatgcggatcctgctg

SEQ ID NO: 4679089 - DNA, 21 bp, Homo sapiens
tagggatgcggatcctgctgg

SEQ ID NO: 4679090 - DNA, 18 bp, Homo sapiens
taggggcttggtcctagg

SEQ ID NO: 4679091 - DNA, 15 bp, Homo sapiens
taggggttctattta

SEQ ID NO: 4679092 - DNA, 20 bp, Homo sapiens
taggtagtcatgctgtgcat

SEQ ID NO: 4679093 - DNA, 22 bp, Homo sapiens
taggtagtcatgctgtgcattt

SEQ ID NO: 4679094 - DNA, 15 bp, Homo sapiens
taggtcataaagcat

SEQ ID NO: 4679095 - DNA, 12 bp, Homo sapiens
taggtcctggct

SEQ ID NO: 4679096 - DNA, 14 bp, Homo sapiens
taggtcttcctgtg

SEQ ID NO: 4679097 - DNA, 15 bp, Homo sapiens
taggttatacaataa

SEQ ID NO: 4679098 - DNA, 18 bp, Homo sapiens
tagtaaaaccttgttcta

SEQ ID NO: 4679099 - DNA, 13 bp, Homo sapiens
tagtaatggcaga

SEQ ID NO: 4679100 - DNA, 15 bp, Homo sapiens
tagtaatggcagagc

SEQ ID NO: 4679101 - DNA, 13 bp, Homo sapiens
tagtacaatcttg

SEQ ID NO: 4679102 - DNA, 15 bp, Homo sapiens
tagtacaatcttggg

SEQ ID NO: 4679103 - DNA, 13 bp, Homo sapiens
tagtacactttta

SEQ ID NO: 4679104 - DNA, 19 bp, Homo sapiens
tagtacacttttatgagct

SEQ ID NO: 4679105 - DNA, 16 bp, Homo sapiens
tagtagagacagtgtt

SEQ ID NO: 4679106 - DNA, 12 bp, Homo sapiens
tagtagatttct

SEQ ID NO: 4679107 - DNA, 20 bp, Homo sapiens
tagtattaatactacccata

SEQ ID NO: 4679108 - DNA, 17 bp, Homo sapiens
tagtcatgctgtgcatt

SEQ ID NO: 4679109 - DNA, 18 bp, Homo sapiens
tagtcatgctgtgcattt

SEQ ID NO: 4679110 - DNA, 17 bp, Homo sapiens
tagtccgtcctggcaca

SEQ ID NO: 4679111 - DNA, 14 bp, Homo sapiens
tagtccttggcata

SEQ ID NO: 4679112 - DNA, 18 bp, Homo sapiens
tagtctttgccagtcatt

SEQ ID NO: 4679113 - DNA, 15 bp, Homo sapiens
tagtctttgtttaca

SEQ ID NO: 4679114 - DNA, 19 bp, Homo sapiens
tagtgatcaaattgtgcag

SEQ ID NO: 4679115 - DNA, 22 bp, Homo sapiens
tagtgcatccagttaaccaagt

SEQ ID NO: 4679116 - DNA, 18 bp, Homo sapiens
tagtgctgcaataaacat

SEQ ID NO: 4679117 - DNA, 14 bp, Homo sapiens
tagtggtcataaaa

SEQ ID NO: 4679118 - DNA, 17 bp, Homo sapiens
tagtgtaataagactta

SEQ ID NO: 4679119 - DNA, 16 bp, Homo sapiens
tagttaaataactgtg

SEQ ID NO: 4679120 - DNA, 17 bp, Homo sapiens
tagttaaataactgtgt

SEQ ID NO: 4679121 - DNA, 14 bp, Homo sapiens
tagttaatattttg

SEQ ID NO: 4679122 - DNA, 19 bp, Homo sapiens
tagttattttaataccttt

SEQ ID NO: 4679123 - DNA, 22 bp, Homo sapiens
tagttattttaatacctttaaa

SEQ ID NO: 4679124 - DNA, 14 bp, Homo sapiens
tagttcaatacagt

SEQ ID NO: 4679125 - DNA, 20 bp, Homo sapiens
tagttccctaaactttagaa

SEQ ID NO: 4679126 - DNA, 21 bp, Homo sapiens
tagttccctctgcctgggatg

SEQ ID NO: 4679127 - DNA, 18 bp, Homo sapiens
tagttcttagctttgaaa

SEQ ID NO: 4679128 - DNA, 13 bp, Homo sapiens
tagttgcagccca

SEQ ID NO: 4679129 - DNA, 15 bp, Homo sapiens
tagttgcagcccaag

SEQ ID NO: 4679130 - DNA, 22 bp, Homo sapiens
tagttggtctttccatctatca

SEQ ID NO: 4679131 - DNA, 16 bp, Homo sapiens
tagtttcaaagtgtct

SEQ ID NO: 4679132 - DNA, 22 bp, Homo sapiens
tagttttacactaggaaacgtg

SEQ ID NO: 4679133 - DNA, 12 bp, Homo sapiens
tagttttacatt

SEQ ID NO: 4679134 - DNA, 16 bp, Homo sapiens
tagttttacattttaa

SEQ ID NO: 4679135 - DNA, 16 bp, Homo sapiens
tagttttactttgaac

SEQ ID NO: 4679136 - DNA, 16 bp, Homo sapiens
tataaaaatataaatt

SEQ ID NO: 4679137 - DNA, 22 bp, Homo sapiens
tataaaaatataaattgtacat

SEQ ID NO: 4679138 - DNA, 23 bp, Homo sapiens
tataaatacgtattacaaacaag

SEQ ID NO: 4679139 - DNA, 19 bp, Homo sapiens
tataaatgatatcaaagaa

SEQ ID NO: 4679140 - DNA, 15 bp, Homo sapiens
tataaatgtgatatg

SEQ ID NO: 4679141 - DNA, 21 bp, Homo sapiens
tataaattttttttgtttcat

SEQ ID NO: 4679142 - DNA, 14 bp, Homo sapiens
tataacttaaatat

SEQ ID NO: 4679143 - DNA, 19 bp, Homo sapiens
tataagcagattgctttaa

SEQ ID NO: 4679144 - DNA, 14 bp, Homo sapiens
tataataaacataa

SEQ ID NO: 4679145 - DNA, 13 bp, Homo sapiens
tataatctttcta

SEQ ID NO: 4679146 - DNA, 15 bp, Homo sapiens
tataatgttattcat

SEQ ID NO: 4679147 - DNA, 16 bp, Homo sapiens
tactcaagctgtctct

SEQ ID NO: 4679148 - DNA, 21 bp, Homo sapiens
tactcacacaggcatttcctg

SEQ ID NO: 4679149 - DNA, 13 bp, Homo sapiens
tactcatgcgtga

SEQ ID NO: 4679150 - DNA, 21 bp, Homo sapiens
tactccataaaaggtgtgttg

SEQ ID NO: 4679151 - DNA, 20 bp, Homo sapiens
tactccctcttgtcagtgta

SEQ ID NO: 4679152 - DNA, 20 bp, Homo sapiens
tactcctgtgggagcctcgc

SEQ ID NO: 4679153 - DNA, 18 bp, Homo sapiens
tactctagatggcaacat

SEQ ID NO: 4679154 - DNA, 14 bp, Homo sapiens
tactctgtgccaga

SEQ ID NO: 4679155 - DNA, 22 bp, Homo sapiens
tactctgtgccagagcctgggg

SEQ ID NO: 4679156 - DNA, 23 bp, Homo sapiens
tactctgtgccagagcctggggc

SEQ ID NO: 4679157 - DNA, 14 bp, Homo sapiens
tactctgttgcctc

SEQ ID NO: 4679158 - DNA, 15 bp, Homo sapiens
tactctgttgcctcc

SEQ ID NO: 4679159 - DNA, 17 bp, Homo sapiens
tactctgttgcctcctc

SEQ ID NO: 4679160 - DNA, 18 bp, Homo sapiens
tactctgttgcctcctct

SEQ ID NO: 4679161 - DNA, 20 bp, Homo sapiens
tactctgttgcctcctctct

SEQ ID NO: 4679162 - DNA, 21 bp, Homo sapiens
tactctgttgcctcctctctc

SEQ ID NO: 4679163 - DNA, 19 bp, Homo sapiens
tactgaataatatcaaata

SEQ ID NO: 4679164 - DNA, 15 bp, Homo sapiens
tactgacaacattat

SEQ ID NO: 4679165 - DNA, 21 bp, Homo sapiens
tactgagcatttgcacctctg

SEQ ID NO: 4679166 - DNA, 14 bp, Homo sapiens
tactgattgaatgt

SEQ ID NO: 4679167 - DNA, 21 bp, Homo sapiens
tactgcagcacctccaggcct

SEQ ID NO: 4679168 - DNA, 11 bp, Homo sapiens
tactgcctgac

SEQ ID NO: 4679169 - DNA, 16 bp, Homo sapiens
tactgcctgcttgggg

SEQ ID NO: 4679170 - DNA, 15 bp, Homo sapiens
tactggccaattttt

SEQ ID NO: 4679171 - DNA, 22 bp, Homo sapiens
tactgggccttagtgggccagg

SEQ ID NO: 4679172 - DNA, 22 bp, Homo sapiens
tactgggtaaaagcagggcagc

SEQ ID NO: 4679173 - DNA, 23 bp, Homo sapiens
tactgggtgtcatttcattccat

SEQ ID NO: 4679174 - DNA, 16 bp, Homo sapiens
tactgttctcaacata

SEQ ID NO: 4679175 - DNA, 16 bp, Homo sapiens
tacttaagaatatgct

SEQ ID NO: 4679176 - DNA, 15 bp, Homo sapiens
tacttaatatactca

SEQ ID NO: 4679177 - DNA, 21 bp, Homo sapiens
tacttaatatactcagggatt

SEQ ID NO: 4679178 - DNA, 21 bp, Homo sapiens
tacttatgatttaaaaacaac

SEQ ID NO: 4679179 - DNA, 18 bp, Homo sapiens
tacttatgcaagatattt

SEQ ID NO: 4679180 - DNA, 21 bp, Homo sapiens
tacttattttcagtgcatcat

SEQ ID NO: 4679181 - DNA, 24 bp, Homo sapiens
tacttcataagatattctttacaa

SEQ ID NO: 4679182 - DNA, 13 bp, Homo sapiens
tacttcctctgtg

SEQ ID NO: 4679183 - DNA, 16 bp, Homo sapiens
tacttctttttcatta

SEQ ID NO: 4679184 - DNA, 12 bp, Homo sapiens
tacttgaatgta

SEQ ID NO: 4679185 - DNA, 21 bp, Homo sapiens
tacttgagggaccaatattac

SEQ ID NO: 4679186 - DNA, 14 bp, Homo sapiens
tacttggcaggctg

SEQ ID NO: 4679187 - DNA, 20 bp, Homo sapiens
tacttggctgcttcctgtga

SEQ ID NO: 4679188 - DNA, 13 bp, Homo sapiens
tactttaaatcct

SEQ ID NO: 4679189 - DNA, 19 bp, Homo sapiens
tactttaaatcctaccaaa

SEQ ID NO: 4679190 - DNA, 23 bp, Homo sapiens
tactttgtaaataggatttttag

SEQ ID NO: 4679191 - DNA, 19 bp, Homo sapiens
tactttgttaggattttca

SEQ ID NO: 4679192 - DNA, 23 bp, Homo sapiens
tacttttagtagagacagtgttt

SEQ ID NO: 4679193 - DNA, 16 bp, Homo sapiens
tacttttcattctctt

SEQ ID NO: 4679194 - DNA, 14 bp, Homo sapiens
tacttttctgttta

SEQ ID NO: 4679195 - DNA, 17 bp, Homo sapiens
tacttttctgtttagtt

SEQ ID NO: 4679196 - DNA, 11 bp, Homo sapiens
tactttttcct

SEQ ID NO: 4679197 - DNA, 13 bp, Homo sapiens
tacttttttaaat

SEQ ID NO: 4679198 - DNA, 22 bp, Homo sapiens
tacttttttaaatattttctat

SEQ ID NO: 4679199 - DNA, 23 bp, Homo sapiens
tacttttttaaatattttctatt

SEQ ID NO: 4679200 - DNA, 19 bp, Homo sapiens
tacttttttacactgataa

SEQ ID NO: 4679201 - DNA, 18 bp, Homo sapiens
tacttttttttagttcaa

SEQ ID NO: 4679202 - DNA, 16 bp, Homo sapiens
tagaaaaataaaatgt

SEQ ID NO: 4679203 - DNA, 17 bp, Homo sapiens
tagaaaaataaaatgtt

SEQ ID NO: 4679204 - DNA, 18 bp, Homo sapiens
tagaaaaataaaatgttt

SEQ ID NO: 4679205 - DNA, 14 bp, Homo sapiens
tagaaaattatttg

SEQ ID NO: 4679206 - DNA, 16 bp, Homo sapiens
tagaaaattcagctcc

SEQ ID NO: 4679207 - DNA, 18 bp, Homo sapiens
tagaaaattcagctcctt

SEQ ID NO: 4679208 - DNA, 20 bp, Homo sapiens
tagaaaattcagctcctttc

SEQ ID NO: 4679209 - DNA, 13 bp, Homo sapiens
tagaaagaaacta

SEQ ID NO: 4679210 - DNA, 17 bp, Homo sapiens
tagaaagagatacagag

SEQ ID NO: 4679211 - DNA, 21 bp, Homo sapiens
tagaacctatatcgagagtgt

SEQ ID NO: 4679212 - DNA, 16 bp, Homo sapiens
tagaactcactctggg

SEQ ID NO: 4679213 - DNA, 22 bp, Homo sapiens
tagaattccttcgaaaggcctt

SEQ ID NO: 4679214 - DNA, 21 bp, Homo sapiens
tagaattctgtattggatata

SEQ ID NO: 4679215 - DNA, 17 bp, Homo sapiens
tagaatttaatatatat

SEQ ID NO: 4679216 - DNA, 19 bp, Homo sapiens
tagacactctgacaagctg

SEQ ID NO: 4679217 - DNA, 22 bp, Homo sapiens
tagacactctgacaagctggcc

SEQ ID NO: 4679218 - DNA, 15 bp, Homo sapiens
tagacattctcacat

SEQ ID NO: 4679219 - DNA, 18 bp, Homo sapiens
tagaccagggctgctctt

SEQ ID NO: 4679220 - DNA, 24 bp, Homo sapiens
tagaccagggctgctctttccact

SEQ ID NO: 4679221 - DNA, 16 bp, Homo sapiens
tagaccctcgggcccc

SEQ ID NO: 4679222 - DNA, 13 bp, Homo sapiens
tagacgcaccgcc

SEQ ID NO: 4679223 - DNA, 19 bp, Homo sapiens
tagactcgcctatcttagg

SEQ ID NO: 4679224 - DNA, 17 bp, Homo sapiens
tagactctgtctacctg

SEQ ID NO: 4679225 - DNA, 16 bp, Homo sapiens
tagactcttgctcctg

SEQ ID NO: 4679226 - DNA, 20 bp, Homo sapiens
tagactgtgtctgaatcatg

SEQ ID NO: 4679227 - DNA, 21 bp, Homo sapiens
tagactgtgtctgaatcatgt

SEQ ID NO: 4679228 - DNA, 22 bp, Homo sapiens
tagactgtgtctgaatcatgtc

SEQ ID NO: 4679229 - DNA, 14 bp, Homo sapiens
tagagaatgtgttt

SEQ ID NO: 4679230 - DNA, 14 bp, Homo sapiens
tagagacagtgttt

SEQ ID NO: 4679231 - DNA, 13 bp, Homo sapiens
tagagagctattt

SEQ ID NO: 4679232 - DNA, 21 bp, Homo sapiens
tagagcaaaatcaacatgact

SEQ ID NO: 4679233 - DNA, 18 bp, Homo sapiens
tagagcccattaatcttg

SEQ ID NO: 4679234 - DNA, 19 bp, Homo sapiens
tagagcccattaatcttga

SEQ ID NO: 4679235 - DNA, 14 bp, Homo sapiens
tagaggcagactcc

SEQ ID NO: 4679236 - DNA, 15 bp, Homo sapiens
tagaggcagactcct

SEQ ID NO: 4679237 - DNA, 21 bp, Homo sapiens
tagaggctcagtggtgggaga

SEQ ID NO: 4679238 - DNA, 15 bp, Homo sapiens
tagagggtgaaggag

SEQ ID NO: 4679239 - DNA, 19 bp, Homo sapiens
tagaggtgttacagaggac

SEQ ID NO: 4679240 - DNA, 15 bp, Homo sapiens
tagaggttctgcctc

SEQ ID NO: 4679241 - DNA, 16 bp, Homo sapiens
tagaggttctgcctct

SEQ ID NO: 4679242 - DNA, 20 bp, Homo sapiens
tagaggttctgcctctattt

SEQ ID NO: 4679243 - DNA, 15 bp, Homo sapiens
tagagtacttaatat

SEQ ID NO: 4679244 - DNA, 23 bp, Homo sapiens
tagatacaggactggttccttcc

SEQ ID NO: 4679245 - DNA, 21 bp, Homo sapiens
tagatggcaacattggacaga

SEQ ID NO: 4679246 - DNA, 19 bp, Homo sapiens
tagattcattaactcaaat

SEQ ID NO: 4679247 - DNA, 16 bp, Homo sapiens
tagattttaaagacaa

SEQ ID NO: 4679248 - DNA, 15 bp, Homo sapiens
tagatttttcttaac

SEQ ID NO: 4679249 - DNA, 16 bp, Homo sapiens
tagcaacaacaattgg

SEQ ID NO: 4679250 - DNA, 19 bp, Homo sapiens
tagcaacaacaattggtaa

SEQ ID NO: 4679251 - DNA, 19 bp, Homo sapiens
tagcaataactgaaaatga

SEQ ID NO: 4679252 - DNA, 18 bp, Homo sapiens
tagcaggaacttctagct

SEQ ID NO: 4679253 - DNA, 16 bp, Homo sapiens
tagcagggattctctc

SEQ ID NO: 4679254 - DNA, 22 bp, Homo sapiens
tagcatggcggcacacatctgt

SEQ ID NO: 4679255 - DNA, 22 bp, Homo sapiens
tagcatggggattgcagagtga

SEQ ID NO: 4679256 - DNA, 20 bp, Homo sapiens
tagcattgtgaactgacagg

SEQ ID NO: 4679257 - DNA, 11 bp, Homo sapiens
tacaaaccttt

SEQ ID NO: 4679258 - DNA, 12 bp, Homo sapiens
tacaaactctca

SEQ ID NO: 4679259 - DNA, 13 bp, Homo sapiens
tacaaactctcac

SEQ ID NO: 4679260 - DNA, 13 bp, Homo sapiens
tacaaagcagaga

SEQ ID NO: 4679261 - DNA, 15 bp, Homo sapiens
tacaaatgaagaaag

SEQ ID NO: 4679262 - DNA, 19 bp, Homo sapiens
tacaaatgccttaaaatgg

SEQ ID NO: 4679263 - DNA, 20 bp, Homo sapiens
tacaaatgccttaaaatgga

SEQ ID NO: 4679264 - DNA, 20 bp, Homo sapiens
tacaaattgtcgtttttatt

SEQ ID NO: 4679265 - DNA, 23 bp, Homo sapiens
tacaacccggttcactcttctca

SEQ ID NO: 4679266 - DNA, 23 bp, Homo sapiens
tacaagagtggagagaagctctt

SEQ ID NO: 4679267 - DNA, 12 bp, Homo sapiens
tacaagatttcc

SEQ ID NO: 4679268 - DNA, 20 bp, Homo sapiens
tacaaggtaggctgcaaaat

SEQ ID NO: 4679269 - DNA, 20 bp, Homo sapiens
tacaataacccagttacttt

SEQ ID NO: 4679270 - DNA, 13 bp, Homo sapiens
tacaatcacatta

SEQ ID NO: 4679271 - DNA, 20 bp, Homo sapiens
tacaatgatgtataattaat

SEQ ID NO: 4679272 - DNA, 11 bp, Homo sapiens
tacacagtgtg

SEQ ID NO: 4679273 - DNA, 19 bp, Homo sapiens
tacacatttttcagatata

SEQ ID NO: 4679274 - DNA, 14 bp, Homo sapiens
tacaccactctggc

SEQ ID NO: 4679275 - DNA, 16 bp, Homo sapiens
tacaccatatactgtt

SEQ ID NO: 4679276 - DNA, 12 bp, Homo sapiens
tacactacgcac

SEQ ID NO: 4679277 - DNA, 18 bp, Homo sapiens
tacactacgcactggaca

SEQ ID NO: 4679278 - DNA, 17 bp, Homo sapiens
tacactaggaaacgtgt

SEQ ID NO: 4679279 - DNA, 14 bp, Homo sapiens
tacactatgaaatt

SEQ ID NO: 4679280 - DNA, 13 bp, Homo sapiens
tacactgtttcat

SEQ ID NO: 4679281 - DNA, 15 bp, Homo sapiens
tacacttttatgagc

SEQ ID NO: 4679282 - DNA, 18 bp, Homo sapiens
tacacttttatgagcttc

SEQ ID NO: 4679283 - DNA, 17 bp, Homo sapiens
tacactttttacagcag

SEQ ID NO: 4679284 - DNA, 20 bp, Homo sapiens
tacagacctaatatcatttt

SEQ ID NO: 4679285 - DNA, 22 bp, Homo sapiens
tacagacctaatatcattttat

SEQ ID NO: 4679286 - DNA, 23 bp, Homo sapiens
tacagacctaatatcattttatt

SEQ ID NO: 4679287 - DNA, 12 bp, Homo sapiens
tacagactgaaa

SEQ ID NO: 4679288 - DNA, 17 bp, Homo sapiens
tacagaggaaatctgta

SEQ ID NO: 4679289 - DNA, 18 bp, Homo sapiens
tacagaggaaatctgtaa

SEQ ID NO: 4679290 - DNA, 15 bp, Homo sapiens
tacagaggaccctta

SEQ ID NO: 4679291 - DNA, 13 bp, Homo sapiens
tacagagtgggcc

SEQ ID NO: 4679292 - DNA, 21 bp, Homo sapiens
tacagatggcatacctgtgcc

SEQ ID NO: 4679293 - DNA, 23 bp, Homo sapiens
tacagattaacctgaaagaacat

SEQ ID NO: 4679294 - DNA, 18 bp, Homo sapiens
tacagcactactgggtgt

SEQ ID NO: 4679295 - DNA, 20 bp, Homo sapiens
tacagcagcaatattttgta

SEQ ID NO: 4679296 - DNA, 19 bp, Homo sapiens
tacagcccttggcttgtgt

SEQ ID NO: 4679297 - DNA, 22 bp, Homo sapiens
tacagcccttggcttgtgttat

SEQ ID NO: 4679298 - DNA, 18 bp, Homo sapiens
tacaggagaggcagcatg

SEQ ID NO: 4679299 - DNA, 18 bp, Homo sapiens
tacaggcctgcagcccct

SEQ ID NO: 4679300 - DNA, 23 bp, Homo sapiens
tacaggtgcatattaattttctt

SEQ ID NO: 4679301 - DNA, 14 bp, Homo sapiens
tacaggtgtgtggg

SEQ ID NO: 4679302 - DNA, 12 bp, Homo sapiens
tacagtcttgta

SEQ ID NO: 4679303 - DNA, 13 bp, Homo sapiens
tacagtcttgtat

SEQ ID NO: 4679304 - DNA, 22 bp, Homo sapiens
tacagtgtacagtcttgtatta

SEQ ID NO: 4679305 - DNA, 16 bp, Homo sapiens
tacagtgtttggacag

SEQ ID NO: 4679306 - DNA, 22 bp, Homo sapiens
tacagttgtgataatagcattt

SEQ ID NO: 4679307 - DNA, 18 bp, Homo sapiens
tacataagtcctttcaat

SEQ ID NO: 4679308 - DNA, 14 bp, Homo sapiens
tacatagtctttgt

SEQ ID NO: 4679309 - DNA, 19 bp, Homo sapiens
tacatagtctttgtttaca

SEQ ID NO: 4679310 - DNA, 20 bp, Homo sapiens
tacatagtctttgtttacat

SEQ ID NO: 4679311 - DNA, 15 bp, Homo sapiens
tacatatataaaact

SEQ ID NO: 4679312 - DNA, 23 bp, Homo sapiens
tacatatataaaactaaggcttt

SEQ ID NO: 4679313 - DNA, 15 bp, Homo sapiens
tacatatatttttaa

SEQ ID NO: 4679314 - DNA, 18 bp, Homo sapiens
tacatatgctgatctttt

SEQ ID NO: 4679315 - DNA, 13 bp, Homo sapiens
tacatcaattaat

SEQ ID NO: 4679316 - DNA, 20 bp, Homo sapiens
tacatccaaagcagacagct

SEQ ID NO: 4679317 - DNA, 18 bp, Homo sapiens
tacatgtgtgcagagcag

SEQ ID NO: 4679318 - DNA, 19 bp, Homo sapiens
tacatgtgtgcagagcaga

SEQ ID NO: 4679319 - DNA, 14 bp, Homo sapiens
tacattaaaatgac

SEQ ID NO: 4679320 - DNA, 16 bp, Homo sapiens
tacattaaaatgacaa

SEQ ID NO: 4679321 - DNA, 21 bp, Homo sapiens
tacattaaactcaaatgtaat

SEQ ID NO: 4679322 - DNA, 14 bp, Homo sapiens
tacattaacggtgc

SEQ ID NO: 4679323 - DNA, 16 bp, Homo sapiens
tacattaacggtgcta

SEQ ID NO: 4679324 - DNA, 19 bp, Homo sapiens
tacattaacggtgctaaaa

SEQ ID NO: 4679325 - DNA, 19 bp, Homo sapiens
tacattttcagtaccaaag

SEQ ID NO: 4679326 - DNA, 14 bp, Homo sapiens
tacattttctaaat

SEQ ID NO: 4679327 - DNA, 21 bp, Homo sapiens
tacattttctaaataaaaata

SEQ ID NO: 4679328 - DNA, 19 bp, Homo sapiens
tacatttttatttttggtt

SEQ ID NO: 4679329 - DNA, 22 bp, Homo sapiens
taccaaagaaacaccacttaat

SEQ ID NO: 4679330 - DNA, 17 bp, Homo sapiens
taccaagtaaccatttc

SEQ ID NO: 4679331 - DNA, 17 bp, Homo sapiens
taccaattcacccactc

SEQ ID NO: 4679332 - DNA, 16 bp, Homo sapiens
taccagcagaaaacct

SEQ ID NO: 4679333 - DNA, 14 bp, Homo sapiens
taccatcttaatct

SEQ ID NO: 4679334 - DNA, 22 bp, Homo sapiens
tacccaggtattacacaagcca

SEQ ID NO: 4679335 - DNA, 15 bp, Homo sapiens
taccccatatattac

SEQ ID NO: 4679336 - DNA, 19 bp, Homo sapiens
taccgcgtctaccctggga

SEQ ID NO: 4679337 - DNA, 19 bp, Homo sapiens
taccgtcgacaagaatgtc

SEQ ID NO: 4679338 - DNA, 18 bp, Homo sapiens
tacctatctgtggaaagc

SEQ ID NO: 4679339 - DNA, 11 bp, Homo sapiens
tacctcagaaa

SEQ ID NO: 4679340 - DNA, 15 bp, Homo sapiens
tacctgtctctctct

SEQ ID NO: 4679341 - DNA, 11 bp, Homo sapiens
tacctgtgtgt

SEQ ID NO: 4679342 - DNA, 12 bp, Homo sapiens
taccttctccca

SEQ ID NO: 4679343 - DNA, 16 bp, Homo sapiens
tacctttaaatatcat

SEQ ID NO: 4679344 - DNA, 20 bp, Homo sapiens
tacctttaaatatcattctt

SEQ ID NO: 4679345 - DNA, 21 bp, Homo sapiens
tacctttaaatatcattcttt

SEQ ID NO: 4679346 - DNA, 16 bp, Homo sapiens
tacctttaattttaat

SEQ ID NO: 4679347 - DNA, 12 bp, Homo sapiens
tacggttctgtt

SEQ ID NO: 4679348 - DNA, 14 bp, Homo sapiens
tacgtctgggagaa

SEQ ID NO: 4679349 - DNA, 14 bp, Homo sapiens
tactaacacaagga

SEQ ID NO: 4679350 - DNA, 23 bp, Homo sapiens
tactaaggagtaatctgtgtaca

SEQ ID NO: 4679351 - DNA, 22 bp, Homo sapiens
tactaagggaacaatccatgtg

SEQ ID NO: 4679352 - DNA, 19 bp, Homo sapiens
tactaatagagtacttaat

SEQ ID NO: 4679353 - DNA, 13 bp, Homo sapiens
tactactttaaat

SEQ ID NO: 4679354 - DNA, 23 bp, Homo sapiens
tactactttaaatcctaccaaag

SEQ ID NO: 4679355 - DNA, 14 bp, Homo sapiens
tactagaatgctta

SEQ ID NO: 4679356 - DNA, 21 bp, Homo sapiens
gttgcagtctttcccccagga

SEQ ID NO: 4679357 - DNA, 13 bp, Homo sapiens
gttgcatttagct

SEQ ID NO: 4679358 - DNA, 22 bp, Homo sapiens
gttgcatttagcttctttccct

SEQ ID NO: 4679359 - DNA, 11 bp, Homo sapiens
gttgcctcctc

SEQ ID NO: 4679360 - DNA, 13 bp, Homo sapiens
gttgcctcctctc

SEQ ID NO: 4679361 - DNA, 18 bp, Homo sapiens
gttgcctcctctctccct

SEQ ID NO: 4679362 - DNA, 19 bp, Homo sapiens
gttgcctcctctctccctg

SEQ ID NO: 4679363 - DNA, 21 bp, Homo sapiens
gttgcctcctctctccctgcc

SEQ ID NO: 4679364 - DNA, 23 bp, Homo sapiens
gttgcctcctctctccctgcctc

SEQ ID NO: 4679365 - DNA, 24 bp, Homo sapiens
gttgcctttttcattttccaatac

SEQ ID NO: 4679366 - DNA, 23 bp, Homo sapiens
gttgcgtggactctgcacatgtc

SEQ ID NO: 4679367 - DNA, 19 bp, Homo sapiens
gttgctgaaacttgctgag

SEQ ID NO: 4679368 - DNA, 16 bp, Homo sapiens
gttgctgttcacagct

SEQ ID NO: 4679369 - DNA, 20 bp, Homo sapiens
gttggatttttgtcttgtgt

SEQ ID NO: 4679370 - DNA, 22 bp, Homo sapiens
gttggcaaacgagactttctcc

SEQ ID NO: 4679371 - DNA, 14 bp, Homo sapiens
gttggccaggctgg

SEQ ID NO: 4679372 - DNA, 16 bp, Homo sapiens
gttggggtctggcagc

SEQ ID NO: 4679373 - DNA, 19 bp, Homo sapiens
gttggggtgacagtcatca

SEQ ID NO: 4679374 - DNA, 22 bp, Homo sapiens
gttgtcagtattattctactat

SEQ ID NO: 4679375 - DNA, 12 bp, Homo sapiens
gttgtccctgca

SEQ ID NO: 4679376 - DNA, 14 bp, Homo sapiens
gttgtcctcctgtt

SEQ ID NO: 4679377 - DNA, 19 bp, Homo sapiens
gttgtctagtcattgtcat

SEQ ID NO: 4679378 - DNA, 12 bp, Homo sapiens
gttgtctgtgct

SEQ ID NO: 4679379 - DNA, 18 bp, Homo sapiens
gttgtgataatagcattt

SEQ ID NO: 4679380 - DNA, 14 bp, Homo sapiens
gttgtgatggaggg

SEQ ID NO: 4679381 - DNA, 14 bp, Homo sapiens
gttgtggaggaggt

SEQ ID NO: 4679382 - DNA, 15 bp, Homo sapiens
gttgtggaggaggtg

SEQ ID NO: 4679383 - DNA, 13 bp, Homo sapiens
gttgttctgcctg

SEQ ID NO: 4679384 - DNA, 12 bp, Homo sapiens
gttgttgcattc

SEQ ID NO: 4679385 - DNA, 21 bp, Homo sapiens
gtttaaaataaaatgaaaatt

SEQ ID NO: 4679386 - DNA, 21 bp, Homo sapiens
gtttaaactgattcataataa

SEQ ID NO: 4679387 - DNA, 13 bp, Homo sapiens
gtttaacaagtat

SEQ ID NO: 4679388 - DNA, 17 bp, Homo sapiens
gtttaataaagctttat

SEQ ID NO: 4679389 - DNA, 19 bp, Homo sapiens
gtttaataaagctttataa

SEQ ID NO: 4679390 - DNA, 21 bp, Homo sapiens
gtttaatgtgaactctcccct

SEQ ID NO: 4679391 - DNA, 22 bp, Homo sapiens
gtttacaacatcaccagtgcca

SEQ ID NO: 4679392 - DNA, 13 bp, Homo sapiens
gtttataaatctt

SEQ ID NO: 4679393 - DNA, 14 bp, Homo sapiens
gtttatatgtcttg

SEQ ID NO: 4679394 - DNA, 20 bp, Homo sapiens
gtttcaaaaccatgcctggt

SEQ ID NO: 4679395 - DNA, 15 bp, Homo sapiens
gtttcaaactcctga

SEQ ID NO: 4679396 - DNA, 16 bp, Homo sapiens
gtttcaaactcctgac

SEQ ID NO: 4679397 - DNA, 18 bp, Homo sapiens
gtttcaaactcctgacct

SEQ ID NO: 4679398 - DNA, 13 bp, Homo sapiens
gtttcaaatgtgc

SEQ ID NO: 4679399 - DNA, 24 bp, Homo sapiens
gtttcaacaaatttcattgcactt

SEQ ID NO: 4679400 - DNA, 22 bp, Homo sapiens
gtttcaccatgatggccaggct

SEQ ID NO: 4679401 - DNA, 15 bp, Homo sapiens
gtttcatagttttct

SEQ ID NO: 4679402 - DNA, 16 bp, Homo sapiens
gtttcattacttgaat

SEQ ID NO: 4679403 - DNA, 23 bp, Homo sapiens
gtttcccaagctagactgtgtct

SEQ ID NO: 4679404 - DNA, 13 bp, Homo sapiens
gtttcccccactc

SEQ ID NO: 4679405 - DNA, 11 bp, Homo sapiens
gtttccctgct

SEQ ID NO: 4679406 - DNA, 13 bp, Homo sapiens
gtttccctgctga

SEQ ID NO: 4679407 - DNA, 14 bp, Homo sapiens
gtttccctgctgaa

SEQ ID NO: 4679408 - DNA, 15 bp, Homo sapiens
gtttcctgacattgt

SEQ ID NO: 4679409 - DNA, 16 bp, Homo sapiens
gtttctattctgtcag

SEQ ID NO: 4679410 - DNA, 14 bp, Homo sapiens
gtttctcaaatctt

SEQ ID NO: 4679411 - DNA, 15 bp, Homo sapiens
gtttctgcctgggca

SEQ ID NO: 4679412 - DNA, 16 bp, Homo sapiens
gtttctgcctgggcaa

SEQ ID NO: 4679413 - DNA, 13 bp, Homo sapiens
gtttctgtcaagc

SEQ ID NO: 4679414 - DNA, 23 bp, Homo sapiens
gtttcttttcacattaggctgtt

SEQ ID NO: 4679415 - DNA, 14 bp, Homo sapiens
gtttgaaatctttt

SEQ ID NO: 4679416 - DNA, 14 bp, Homo sapiens
gtttgaaatgttta

SEQ ID NO: 4679417 - DNA, 17 bp, Homo sapiens
gtttgatttttgttttt

SEQ ID NO: 4679418 - DNA, 15 bp, Homo sapiens
gtttgcacctgtccc

SEQ ID NO: 4679419 - DNA, 11 bp, Homo sapiens
gtttgcagcct

SEQ ID NO: 4679420 - DNA, 19 bp, Homo sapiens
gtttgcagttgatgtgtct

SEQ ID NO: 4679421 - DNA, 23 bp, Homo sapiens
gtttgccccgggatattatagaa

SEQ ID NO: 4679422 - DNA, 23 bp, Homo sapiens
gtttggcaaaactcaggcagaag

SEQ ID NO: 4679423 - DNA, 17 bp, Homo sapiens
gtttggggcaggagtag

SEQ ID NO: 4679424 - DNA, 17 bp, Homo sapiens
gtttgtagctttcctgg

SEQ ID NO: 4679425 - DNA, 20 bp, Homo sapiens
gtttgtagctttcctggaag

SEQ ID NO: 4679426 - DNA, 23 bp, Homo sapiens
gtttgtgggtatttcttggcatg

SEQ ID NO: 4679427 - DNA, 14 bp, Homo sapiens
gtttgtgtctgtgg

SEQ ID NO: 4679428 - DNA, 14 bp, Homo sapiens
gtttgtgtgtttca

SEQ ID NO: 4679429 - DNA, 14 bp, Homo sapiens
gtttgtttctttgt

SEQ ID NO: 4679430 - DNA, 17 bp, Homo sapiens
gtttgttttcaaaatac

SEQ ID NO: 4679431 - DNA, 12 bp, Homo sapiens
gttttaaaagca

SEQ ID NO: 4679432 - DNA, 14 bp, Homo sapiens
gttttaacaaaaac

SEQ ID NO: 4679433 - DNA, 20 bp, Homo sapiens
gttttagccattgttggctt

SEQ ID NO: 4679434 - DNA, 20 bp, Homo sapiens
gttttagcggggagggggat

SEQ ID NO: 4679435 - DNA, 17 bp, Homo sapiens
gttttattactgtttct

SEQ ID NO: 4679436 - DNA, 14 bp, Homo sapiens
gttttccaagccct

SEQ ID NO: 4679437 - DNA, 14 bp, Homo sapiens
gttttctgctgttt

SEQ ID NO: 4679438 - DNA, 22 bp, Homo sapiens
gttttgaaaacctaaaagacag

SEQ ID NO: 4679439 - DNA, 15 bp, Homo sapiens
gttttggcagctgac

SEQ ID NO: 4679440 - DNA, 17 bp, Homo sapiens
gttttgtaaagtcccca

SEQ ID NO: 4679441 - DNA, 19 bp, Homo sapiens
gttttgtatcttaaatttg

SEQ ID NO: 4679442 - DNA, 17 bp, Homo sapiens
gtgccagagcctggggc

SEQ ID NO: 4679443 - DNA, 18 bp, Homo sapiens
gtgccagagcctggggct

SEQ ID NO: 4679444 - DNA, 13 bp, Homo sapiens
gtgccatgctggg

SEQ ID NO: 4679445 - DNA, 21 bp, Homo sapiens
gtgcccaacctcacttgcttc

SEQ ID NO: 4679446 - DNA, 13 bp, Homo sapiens
gtgcccacaggcc

SEQ ID NO: 4679447 - DNA, 21 bp, Homo sapiens
gtgcccacaggccgccctgcg

SEQ ID NO: 4679448 - DNA, 19 bp, Homo sapiens
gtgcccactccgccagcca

SEQ ID NO: 4679449 - DNA, 21 bp, Homo sapiens
gtgcccactccgccagccaca

SEQ ID NO: 4679450 - DNA, 22 bp, Homo sapiens
gtgcccactccgccagccacag

SEQ ID NO: 4679451 - DNA, 23 bp, Homo sapiens
gtgcccactccgccagccacagg

SEQ ID NO: 4679452 - DNA, 12 bp, Homo sapiens
gtgcccaggaga

SEQ ID NO: 4679453 - DNA, 13 bp, Homo sapiens
gtgcccaggagaa

SEQ ID NO: 4679454 - DNA, 14 bp, Homo sapiens
gtgcccaggggagc

SEQ ID NO: 4679455 - DNA, 20 bp, Homo sapiens
gtgcccggtgcagggcctgg

SEQ ID NO: 4679456 - DNA, 13 bp, Homo sapiens
gtgccgtgtgagt

SEQ ID NO: 4679457 - DNA, 19 bp, Homo sapiens
gtgccgtgtgagtgtgaca

SEQ ID NO: 4679458 - DNA, 12 bp, Homo sapiens
gtgcctccctgg

SEQ ID NO: 4679459 - DNA, 15 bp, Homo sapiens
gtgcctccctggtga

SEQ ID NO: 4679460 - DNA, 19 bp, Homo sapiens
gtgcctcgctccccactct

SEQ ID NO: 4679461 - DNA, 21 bp, Homo sapiens
gtgcctcgctccccactctgc

SEQ ID NO: 4679462 - DNA, 17 bp, Homo sapiens
gtgcctgcacatcatga

SEQ ID NO: 4679463 - DNA, 15 bp, Homo sapiens
gtgcctttgggcacg

SEQ ID NO: 4679464 - DNA, 17 bp, Homo sapiens
gtgcctttgggcacggc

SEQ ID NO: 4679465 - DNA, 13 bp, Homo sapiens
gtgcgtcccagct

SEQ ID NO: 4679466 - DNA, 16 bp, Homo sapiens
gtgcgtgccgtgtgag

SEQ ID NO: 4679467 - DNA, 16 bp, Homo sapiens
gtgctaaaaatgaaaa

SEQ ID NO: 4679468 - DNA, 16 bp, Homo sapiens
gtgctacaggggccag

SEQ ID NO: 4679469 - DNA, 19 bp, Homo sapiens
gtgctacaggggccagaag

SEQ ID NO: 4679470 - DNA, 20 bp, Homo sapiens
gtgctacaggggccagaaga

SEQ ID NO: 4679471 - DNA, 17 bp, Homo sapiens
gtgctacgtgtgaaatc

SEQ ID NO: 4679472 - DNA, 13 bp, Homo sapiens
gtgctatttgaag

SEQ ID NO: 4679473 - DNA, 21 bp, Homo sapiens
gtgctattttgtttgttttgt

SEQ ID NO: 4679474 - DNA, 23 bp, Homo sapiens
gtgctccatatttgatttctaat

SEQ ID NO: 4679475 - DNA, 22 bp, Homo sapiens
gtgctccatggctgccatctca

SEQ ID NO: 4679476 - DNA, 14 bp, Homo sapiens
gtgctcccacggcc

SEQ ID NO: 4679477 - DNA, 14 bp, Homo sapiens
gtgtgcagagcaga

SEQ ID NO: 4679478 - DNA, 22 bp, Homo sapiens
gtgtgcatggaggccctcctgt

SEQ ID NO: 4679479 - DNA, 14 bp, Homo sapiens
gtgtggacaggact

SEQ ID NO: 4679480 - DNA, 18 bp, Homo sapiens
gtgtggatccaatgttag

SEQ ID NO: 4679481 - DNA, 15 bp, Homo sapiens
gtgtggtggcctcag

SEQ ID NO: 4679482 - DNA, 13 bp, Homo sapiens
gtgtgtctgtcct

SEQ ID NO: 4679483 - DNA, 13 bp, Homo sapiens
gtgtgtggcaggg

SEQ ID NO: 4679484 - DNA, 14 bp, Homo sapiens
gtgtgtggcagggg

SEQ ID NO: 4679485 - DNA, 21 bp, Homo sapiens
gtgtgtgggccaccgtgcctg

SEQ ID NO: 4679486 - DNA, 22 bp, Homo sapiens
gtgtgtgtacaaatacatgtgt

SEQ ID NO: 4679487 - DNA, 20 bp, Homo sapiens
gtgtgttcgttgcacagctg

SEQ ID NO: 4679488 - DNA, 20 bp, Homo sapiens
gtgttaacttgcctccatct

SEQ ID NO: 4679489 - DNA, 15 bp, Homo sapiens
gtgttactgctttgc

SEQ ID NO: 4679490 - DNA, 17 bp, Homo sapiens
gtgttcagctctttcca

SEQ ID NO: 4679491 - DNA, 20 bp, Homo sapiens
gtgttcgttgcacagctgtt

SEQ ID NO: 4679492 - DNA, 19 bp, Homo sapiens
gtgttctaacttatttata

SEQ ID NO: 4679493 - DNA, 13 bp, Homo sapiens
gtgttctttcccc

SEQ ID NO: 4679494 - DNA, 16 bp, Homo sapiens
gtgttctttccccagg

SEQ ID NO: 4679495 - DNA, 21 bp, Homo sapiens
gtgttctttccccaggggcat

SEQ ID NO: 4679496 - DNA, 14 bp, Homo sapiens
gtgttgacacatat

SEQ ID NO: 4679497 - DNA, 21 bp, Homo sapiens
gtgtttcattacttgaatgta

SEQ ID NO: 4679498 - DNA, 16 bp, Homo sapiens
gtgtttgtgtgtttca

SEQ ID NO: 4679499 - DNA, 14 bp, Homo sapiens
gtgtttttctgctt

SEQ ID NO: 4679500 - DNA, 19 bp, Homo sapiens
gtgtttttctgcttttgaa

SEQ ID NO: 4679501 - DNA, 15 bp, Homo sapiens
gtgtttttgaaatat

SEQ ID NO: 4679502 - DNA, 17 bp, Homo sapiens
gttaaacccttctgtct

SEQ ID NO: 4679503 - DNA, 19 bp, Homo sapiens
gttaaggacccttttaagc

SEQ ID NO: 4679504 - DNA, 21 bp, Homo sapiens
gttaaggacccttttaagcat

SEQ ID NO: 4679505 - DNA, 12 bp, Homo sapiens
gttaagggcaga

SEQ ID NO: 4679506 - DNA, 17 bp, Homo sapiens
gttaatgctctatgttt

SEQ ID NO: 4679507 - DNA, 21 bp, Homo sapiens
gttaatttttcttagtgttgt

SEQ ID NO: 4679508 - DNA, 17 bp, Homo sapiens
gttacacagtgtgaata

SEQ ID NO: 4679509 - DNA, 16 bp, Homo sapiens
gttacacatttttcag

SEQ ID NO: 4679510 - DNA, 15 bp, Homo sapiens
gttacagactgaaag

SEQ ID NO: 4679511 - DNA, 19 bp, Homo sapiens
gttacagactgaaaggtgt

SEQ ID NO: 4679512 - DNA, 15 bp, Homo sapiens
gttacttctctgagt

SEQ ID NO: 4679513 - DNA, 19 bp, Homo sapiens
gttagaaaattcagctcct

SEQ ID NO: 4679514 - DNA, 23 bp, Homo sapiens
gttagaagcaaggagaaaatata

SEQ ID NO: 4679515 - DNA, 14 bp, Homo sapiens
gttagaaggcttaa

SEQ ID NO: 4679516 - DNA, 13 bp, Homo sapiens
gttaggaggtcct

SEQ ID NO: 4679517 - DNA, 18 bp, Homo sapiens
gttatacaataacccagt

SEQ ID NO: 4679518 - DNA, 22 bp, Homo sapiens
gttatacaataacccagttact

SEQ ID NO: 4679519 - DNA, 23 bp, Homo sapiens
gttatacaataacccagttactt

SEQ ID NO: 4679520 - DNA, 17 bp, Homo sapiens
gttatcttgttattatt

SEQ ID NO: 4679521 - DNA, 20 bp, Homo sapiens
gttatcttttgaattcttga

SEQ ID NO: 4679522 - DNA, 11 bp, Homo sapiens
gttatgaaaat

SEQ ID NO: 4679523 - DNA, 22 bp, Homo sapiens
gttatgtaccatatgatctgtt

SEQ ID NO: 4679524 - DNA, 22 bp, Homo sapiens
gttattaaacgtatgcatgtga

SEQ ID NO: 4679525 - DNA, 13 bp, Homo sapiens
gttattattgtta

SEQ ID NO: 4679526 - DNA, 20 bp, Homo sapiens
gttattttaatacctttaaa

SEQ ID NO: 4679527 - DNA, 20 bp, Homo sapiens
gttcaagcgattctcctgcc

SEQ ID NO: 4679528 - DNA, 17 bp, Homo sapiens
gttcacagcttttcttg

SEQ ID NO: 4679529 - DNA, 21 bp, Homo sapiens
gttcacctccaagcatttcat

SEQ ID NO: 4679530 - DNA, 13 bp, Homo sapiens
gttcactcttctc

SEQ ID NO: 4679531 - DNA, 14 bp, Homo sapiens
gttcagagatcagg

SEQ ID NO: 4679532 - DNA, 21 bp, Homo sapiens
gttcagctctttccaaattaa

SEQ ID NO: 4679533 - DNA, 15 bp, Homo sapiens
gttcatacagtttta

SEQ ID NO: 4679534 - DNA, 18 bp, Homo sapiens
gttcatttcacacagtga

SEQ ID NO: 4679535 - DNA, 12 bp, Homo sapiens
gttcatttcatt

SEQ ID NO: 4679536 - DNA, 18 bp, Homo sapiens
gttccaaacagacaaaac

SEQ ID NO: 4679537 - DNA, 19 bp, Homo sapiens
gttccaagtccaataagac

SEQ ID NO: 4679538 - DNA, 22 bp, Homo sapiens
gttccagattcctatgatggat

SEQ ID NO: 4679539 - DNA, 18 bp, Homo sapiens
gttccatagaaaaggcgt

SEQ ID NO: 4679540 - DNA, 21 bp, Homo sapiens
gttccattgaagccgactctg

SEQ ID NO: 4679541 - DNA, 15 bp, Homo sapiens
gttccctatggagag

SEQ ID NO: 4679542 - DNA, 12 bp, Homo sapiens
gttccctctgcc

SEQ ID NO: 4679543 - DNA, 14 bp, Homo sapiens
gttccctctgcctg

SEQ ID NO: 4679544 - DNA, 16 bp, Homo sapiens
gttccctctgcctggg

SEQ ID NO: 4679545 - DNA, 17 bp, Homo sapiens
gttccctctgcctggga

SEQ ID NO: 4679546 - DNA, 18 bp, Homo sapiens
gttccctctgcctgggat

SEQ ID NO: 4679547 - DNA, 20 bp, Homo sapiens
gttcctccccctgctcccct

SEQ ID NO: 4679548 - DNA, 13 bp, Homo sapiens
gttcctgctgcct

SEQ ID NO: 4679549 - DNA, 17 bp, Homo sapiens
gttcctgctgcctgggt

SEQ ID NO: 4679550 - DNA, 20 bp, Homo sapiens
gttccttctggtgtctgctt

SEQ ID NO: 4679551 - DNA, 13 bp, Homo sapiens
gttcgcagccacc

SEQ ID NO: 4679552 - DNA, 15 bp, Homo sapiens
gttcgcagccaccct

SEQ ID NO: 4679553 - DNA, 20 bp, Homo sapiens
gttcgcagccaccctgagga

SEQ ID NO: 4679554 - DNA, 17 bp, Homo sapiens
gttctacccgttccaaa

SEQ ID NO: 4679555 - DNA, 17 bp, Homo sapiens
gttctagcagtccccag

SEQ ID NO: 4679556 - DNA, 18 bp, Homo sapiens
gttctagcagtccccagc

SEQ ID NO: 4679557 - DNA, 21 bp, Homo sapiens
gttctagcagtccccagctga

SEQ ID NO: 4679558 - DNA, 20 bp, Homo sapiens
gtcttatgtgaaaaattaac

SEQ ID NO: 4679559 - DNA, 18 bp, Homo sapiens
gtcttcctgtggctccct

SEQ ID NO: 4679560 - DNA, 20 bp, Homo sapiens
gtcttcctgtggctccctct

SEQ ID NO: 4679561 - DNA, 22 bp, Homo sapiens
gtcttcctgtggctccctctct

SEQ ID NO: 4679562 - DNA, 22 bp, Homo sapiens
gtcttgcaaagcctttaaattg

SEQ ID NO: 4679563 - DNA, 15 bp, Homo sapiens
gtcttggacactgta

SEQ ID NO: 4679564 - DNA, 16 bp, Homo sapiens
gtcttgggaaatatga

SEQ ID NO: 4679565 - DNA, 18 bp, Homo sapiens
gtcttggtttctctctac

SEQ ID NO: 4679566 - DNA, 15 bp, Homo sapiens
gtcttgtacatgtgt

SEQ ID NO: 4679567 - DNA, 21 bp, Homo sapiens
gtcttgtgtatttctctgtga

SEQ ID NO: 4679568 - DNA, 20 bp, Homo sapiens
gtcttgtgtttctttagttt

SEQ ID NO: 4679569 - DNA, 13 bp, Homo sapiens
gtctttcccccag

SEQ ID NO: 4679570 - DNA, 14 bp, Homo sapiens
gtctttcccccagg

SEQ ID NO: 4679571 - DNA, 17 bp, Homo sapiens
gtctttgcggggcctgt

SEQ ID NO: 4679572 - DNA, 18 bp, Homo sapiens
gtctttgcggggcctgtc

SEQ ID NO: 4679573 - DNA, 20 bp, Homo sapiens
gtctttgcggggcctgtctc

SEQ ID NO: 4679574 - DNA, 23 bp, Homo sapiens
gtctttgcggggcctgtctcagt

SEQ ID NO: 4679575 - DNA, 17 bp, Homo sapiens
gtctttgttatgacagt

SEQ ID NO: 4679576 - DNA, 13 bp, Homo sapiens
gtcttttaaaatg

SEQ ID NO: 4679577 - DNA, 15 bp, Homo sapiens
gtgaaatacatcctt

SEQ ID NO: 4679578 - DNA, 15 bp, Homo sapiens
gtgaacagcttgctg

SEQ ID NO: 4679579 - DNA, 24 bp, Homo sapiens
gtgaacatcccttattagttacaa

SEQ ID NO: 4679580 - DNA, 13 bp, Homo sapiens
gtgaacccaggac

SEQ ID NO: 4679581 - DNA, 22 bp, Homo sapiens
gtgaactgtgtgtgaatctgct

SEQ ID NO: 4679582 - DNA, 16 bp, Homo sapiens
gtgaacttgactgggt

SEQ ID NO: 4679583 - DNA, 10 bp, Homo sapiens
gtgaagccaa

SEQ ID NO: 4679584 - DNA, 16 bp, Homo sapiens
gtgaagggaaagataa

SEQ ID NO: 4679585 - DNA, 15 bp, Homo sapiens
gtgaagtattgctga

SEQ ID NO: 4679586 - DNA, 22 bp, Homo sapiens
gtgaatacttattttcagtgca

SEQ ID NO: 4679587 - DNA, 20 bp, Homo sapiens
gtgaatccatgggtctggct

SEQ ID NO: 4679588 - DNA, 14 bp, Homo sapiens
gtgaatctgctttt

SEQ ID NO: 4679589 - DNA, 21 bp, Homo sapiens
gtgaattaattaaacattgtg

SEQ ID NO: 4679590 - DNA, 22 bp, Homo sapiens
gtgaattttcaaggccttcagt

SEQ ID NO: 4679591 - DNA, 19 bp, Homo sapiens
gtgacaattctgtttttaa

SEQ ID NO: 4679592 - DNA, 22 bp, Homo sapiens
gtgacagactcctgaggacagc

SEQ ID NO: 4679593 - DNA, 14 bp, Homo sapiens
gtgacagcttcctt

SEQ ID NO: 4679594 - DNA, 13 bp, Homo sapiens
gtgacagggccag

SEQ ID NO: 4679595 - DNA, 14 bp, Homo sapiens
gtgacagggccagt

SEQ ID NO: 4679596 - DNA, 16 bp, Homo sapiens
gtatcctgggggaaga

SEQ ID NO: 4679597 - DNA, 20 bp, Homo sapiens
gtatcctgggggaagaggag

SEQ ID NO: 4679598 - DNA, 17 bp, Homo sapiens
gtatctacagtaatgaa

SEQ ID NO: 4679599 - DNA, 22 bp, Homo sapiens
gtatctacagtaatgaaatgtt

SEQ ID NO: 4679600 - DNA, 20 bp, Homo sapiens
gtatctacattaaaatgaca

SEQ ID NO: 4679601 - DNA, 14 bp, Homo sapiens
gtatcttaaaggac

SEQ ID NO: 4679602 - DNA, 22 bp, Homo sapiens
gtatcttaaaggacataaaatt

SEQ ID NO: 4679603 - DNA, 22 bp, Homo sapiens
gtatctttaaaaaaaaatcttg

SEQ ID NO: 4679604 - DNA, 23 bp, Homo sapiens
gtatctttaaaaaaaaatcttgt

SEQ ID NO: 4679605 - DNA, 16 bp, Homo sapiens
gtatcttttttcaaaa

SEQ ID NO: 4679606 - DNA, 23 bp, Homo sapiens
gtatgaataatgaaaataaaaca

SEQ ID NO: 4679607 - DNA, 16 bp, Homo sapiens
gtatgacccctggcca

SEQ ID NO: 4679608 - DNA, 21 bp, Homo sapiens
gtatgatctctctagctttgt

SEQ ID NO: 4679609 - DNA, 15 bp, Homo sapiens
gtatgcatgtgaaga

SEQ ID NO: 4679610 - DNA, 16 bp, Homo sapiens
gtatgcatgtgaagaa

SEQ ID NO: 4679611 - DNA, 17 bp, Homo sapiens
gtatgcatgtgaagaaa

SEQ ID NO: 4679612 - DNA, 18 bp, Homo sapiens
gtatgcatgtgaagaaag

SEQ ID NO: 4679613 - DNA, 16 bp, Homo sapiens
gtatgccactgcactc

SEQ ID NO: 4679614 - DNA, 21 bp, Homo sapiens
gtatgccttctgtattttaat

SEQ ID NO: 4679615 - DNA, 19 bp, Homo sapiens
gtatgtaaggaggtttgta

SEQ ID NO: 4679616 - DNA, 18 bp, Homo sapiens
gtatgtttatcaaagagc

SEQ ID NO: 4679617 - DNA, 23 bp, Homo sapiens
gtattacccaagaagtaaagatg

SEQ ID NO: 4679618 - DNA, 15 bp, Homo sapiens
gtattattattattg

SEQ ID NO: 4679619 - DNA, 14 bp, Homo sapiens
gtattattctacta

SEQ ID NO: 4679620 - DNA, 20 bp, Homo sapiens
gtattcaaatgttagagttt

SEQ ID NO: 4679621 - DNA, 16 bp, Homo sapiens
gtattctgaggatgtt

SEQ ID NO: 4679622 - DNA, 22 bp, Homo sapiens
gtatttctctattttcataatc

SEQ ID NO: 4679623 - DNA, 12 bp, Homo sapiens
gtatttctctgt

SEQ ID NO: 4679624 - DNA, 17 bp, Homo sapiens
gtatttctctgtgaatc

SEQ ID NO: 4679625 - DNA, 22 bp, Homo sapiens
gtatttcttggcatgcatcttt

SEQ ID NO: 4679626 - DNA, 14 bp, Homo sapiens
gtatttgatttcct

SEQ ID NO: 4679627 - DNA, 13 bp, Homo sapiens
gtatttgctgttg

SEQ ID NO: 4679628 - DNA, 19 bp, Homo sapiens
gtatttggaatatttgaat

SEQ ID NO: 4679629 - DNA, 12 bp, Homo sapiens
gtattttctcca

SEQ ID NO: 4679630 - DNA, 13 bp, Homo sapiens
gtattttgacact

SEQ ID NO: 4679631 - DNA, 18 bp, Homo sapiens
gtattttgagtttcagct

SEQ ID NO: 4679632 - DNA, 21 bp, Homo sapiens
gtcaaaataaaggataactct

SEQ ID NO: 4679633 - DNA, 23 bp, Homo sapiens
gtcaaaataaaggataactctgt

SEQ ID NO: 4679634 - DNA, 20 bp, Homo sapiens
gtcaaacattcgtgagctgg

SEQ ID NO: 4679635 - DNA, 19 bp, Homo sapiens
gtcaaataaatgtttcccc

SEQ ID NO: 4679636 - DNA, 16 bp, Homo sapiens
gtcaacctcctggaca

SEQ ID NO: 4679637 - DNA, 17 bp, Homo sapiens
gtcaataaacaacagct

SEQ ID NO: 4679638 - DNA, 20 bp, Homo sapiens
gtcaataaacaacagctgaa

SEQ ID NO: 4679639 - DNA, 22 bp, Homo sapiens
gtcaataaacaacagctgaagc

SEQ ID NO: 4679640 - DNA, 14 bp, Homo sapiens
gtcaattctgtgtg

SEQ ID NO: 4679641 - DNA, 15 bp, Homo sapiens
gtcaattctgtgtgg

SEQ ID NO: 4679642 - DNA, 15 bp, Homo sapiens
gtaaagctagaaatg

SEQ ID NO: 4679643 - DNA, 23 bp, Homo sapiens
gtaaaggtacgattatacttgag

SEQ ID NO: 4679644 - DNA, 15 bp, Homo sapiens
gtaaagtcaaggaga

SEQ ID NO: 4679645 - DNA, 20 bp, Homo sapiens
gtaaataggatttttagaat

SEQ ID NO: 4679646 - DNA, 20 bp, Homo sapiens
gtaaatagttactccagtgc

SEQ ID NO: 4679647 - DNA, 16 bp, Homo sapiens
gtaaatatggggatag

SEQ ID NO: 4679648 - DNA, 15 bp, Homo sapiens
gtaaatatttactct

SEQ ID NO: 4679649 - DNA, 20 bp, Homo sapiens
gtaaatatttactctttgca

SEQ ID NO: 4679650 - DNA, 13 bp, Homo sapiens
gtaaatttggctt

SEQ ID NO: 4679651 - DNA, 20 bp, Homo sapiens
gtaacactgtgatttatctt

SEQ ID NO: 4679652 - DNA, 22 bp, Homo sapiens
gtaacactgtgatttatctttc

SEQ ID NO: 4679653 - DNA, 17 bp, Homo sapiens
gtaacagacacacgatg

SEQ ID NO: 4679654 - DNA, 20 bp, Homo sapiens
gtaacatgcatactttattg

SEQ ID NO: 4679655 - DNA, 20 bp, Homo sapiens
gtaaccaaggccctgtctct

SEQ ID NO: 4679656 - DNA, 17 bp, Homo sapiens
gtaactattaacctttt

SEQ ID NO: 4679657 - DNA, 15 bp, Homo sapiens
gtaactgagagaaag

SEQ ID NO: 4679658 - DNA, 13 bp, Homo sapiens
gtaactgtcctgt

SEQ ID NO: 4679659 - DNA, 17 bp, Homo sapiens
gtaactgtcctgtcctg

SEQ ID NO: 4679660 - DNA, 20 bp, Homo sapiens
gtaagaacatccctgtctta

SEQ ID NO: 4679661 - DNA, 17 bp, Homo sapiens
gtaagaccaccttccct

SEQ ID NO: 4679662 - DNA, 20 bp, Homo sapiens
gtaagcaggagagaaatttc

SEQ ID NO: 4679663 - DNA, 18 bp, Homo sapiens
gtaaggaggtttgtataa

SEQ ID NO: 4679664 - DNA, 11 bp, Homo sapiens
gtaagggcagt

SEQ ID NO: 4679665 - DNA, 15 bp, Homo sapiens
gtaagggcagtgccc

SEQ ID NO: 4679666 - DNA, 15 bp, Homo sapiens
gtaagtgaaattaag

SEQ ID NO: 4679667 - DNA, 14 bp, Homo sapiens
gtaatagtttatct

SEQ ID NO: 4679668 - DNA, 15 bp, Homo sapiens
gtaatagtttatctt

SEQ ID NO: 4679669 - DNA, 19 bp, Homo sapiens
gtaatagtttatcttatac

SEQ ID NO: 4679670 - DNA, 22 bp, Homo sapiens
gtaatatattctgaagcaacat

SEQ ID NO: 4679671 - DNA, 13 bp, Homo sapiens
gtaatatctttca

SEQ ID NO: 4679672 - DNA, 14 bp, Homo sapiens
gtaatcacttttca

SEQ ID NO: 4679673 - DNA, 11 bp, Homo sapiens
gtaatcaggca

SEQ ID NO: 4679674 - DNA, 18 bp, Homo sapiens
gtaatcaggcaaggagga

SEQ ID NO: 4679675 - DNA, 19 bp, Homo sapiens
gtaatcaggcaaggaggag

SEQ ID NO: 4679676 - DNA, 13 bp, Homo sapiens
gtaatcattttaa

SEQ ID NO: 4679677 - DNA, 14 bp, Homo sapiens
gtaatcattttaat

SEQ ID NO: 4679678 - DNA, 19 bp, Homo sapiens
gtaatcccagtactttgga

SEQ ID NO: 4679679 - DNA, 21 bp, Homo sapiens
gtaatgcactgtttttaatct

SEQ ID NO: 4679680 - DNA, 16 bp, Homo sapiens
gtaattatgaaaagaa

SEQ ID NO: 4679681 - DNA, 18 bp, Homo sapiens
gtaattatgaaaagaaat

SEQ ID NO: 4679682 - DNA, 22 bp, Homo sapiens
gtaattatgaaaagaaataaag

SEQ ID NO: 4679683 - DNA, 16 bp, Homo sapiens
gtacaaatacatgtgt

SEQ ID NO: 4679684 - DNA, 23 bp, Homo sapiens
gtacaaattgtcgtttttattcc

SEQ ID NO: 4679685 - DNA, 16 bp, Homo sapiens
gtacaataattcatat

SEQ ID NO: 4679686 - DNA, 13 bp, Homo sapiens
gtacacagagaag

SEQ ID NO: 4679687 - DNA, 15 bp, Homo sapiens
gtacacgtgtcctgt

SEQ ID NO: 4679688 - DNA, 23 bp, Homo sapiens
gtacactttttacagcagcaata

SEQ ID NO: 4679689 - DNA, 19 bp, Homo sapiens
gtacaggagaggcagcatg

SEQ ID NO: 4679690 - DNA, 16 bp, Homo sapiens
gtacagtcttgtatta

SEQ ID NO: 4679691 - DNA, 22 bp, Homo sapiens
gtacagtgaacaaatgtcttaa

SEQ ID NO: 4679692 - DNA, 18 bp, Homo sapiens
gtacatacggttctgtta

SEQ ID NO: 4679693 - DNA, 23 bp, Homo sapiens
ggatgtccctgggccagggtctg

SEQ ID NO: 4679694 - DNA, 14 bp, Homo sapiens
ggatgtctgttgaa

SEQ ID NO: 4679695 - DNA, 13 bp, Homo sapiens
ggattaaaccttt

SEQ ID NO: 4679696 - DNA, 22 bp, Homo sapiens
ggattcattctcataattccta

SEQ ID NO: 4679697 - DNA, 23 bp, Homo sapiens
ggatttcctgctttgggaagccg

SEQ ID NO: 4679698 - DNA, 15 bp, Homo sapiens
ggattttaatttcag

SEQ ID NO: 4679699 - DNA, 16 bp, Homo sapiens
ggatttttagaattaa

SEQ ID NO: 4679700 - DNA, 22 bp, Homo sapiens
ggcaaaaagaatcccaatgttt

SEQ ID NO: 4679701 - DNA, 17 bp, Homo sapiens
ggcaaaacagccctcag

SEQ ID NO: 4679702 - DNA, 11 bp, Homo sapiens
ggcaaaataat

SEQ ID NO: 4679703 - DNA, 18 bp, Homo sapiens
ggcaaatttttatttttt

SEQ ID NO: 4679704 - DNA, 21 bp, Homo sapiens
ggcaaatttttattttttagt

SEQ ID NO: 4679705 - DNA, 15 bp, Homo sapiens
ggcaagccctgccca

SEQ ID NO: 4679706 - DNA, 23 bp, Homo sapiens
ggcaagctaggccccagaggccc

SEQ ID NO: 4679707 - DNA, 23 bp, Homo sapiens
ggcaagctttgctccttcagttc

SEQ ID NO: 4679708 - DNA, 13 bp, Homo sapiens
ggcaaggaacaga

SEQ ID NO: 4679709 - DNA, 16 bp, Homo sapiens
ggcaagggaggggtgg

SEQ ID NO: 4679710 - DNA, 17 bp, Homo sapiens
ggcacaattcctgtgct

SEQ ID NO: 4679711 - DNA, 18 bp, Homo sapiens
ggcacaattcctgtgctc

SEQ ID NO: 4679712 - DNA, 13 bp, Homo sapiens
ggcacacatctgt

SEQ ID NO: 4679713 - DNA, 13 bp, Homo sapiens
ggcacaggagcta

SEQ ID NO: 4679714 - DNA, 23 bp, Homo sapiens
ggcacaggccatggatggaaaac

SEQ ID NO: 4679715 - DNA, 17 bp, Homo sapiens
ggcacatgaaaaatttt

SEQ ID NO: 4679716 - DNA, 18 bp, Homo sapiens
ggcacatgaaaaatttta

SEQ ID NO: 4679717 - DNA, 17 bp, Homo sapiens
ggcacattaactccctc

SEQ ID NO: 4679718 - DNA, 19 bp, Homo sapiens
ggcacattaactccctcca

SEQ ID NO: 4679719 - DNA, 14 bp, Homo sapiens
ggcacccccagcct

SEQ ID NO: 4679720 - DNA, 15 bp, Homo sapiens
ggcacccccagcctg

SEQ ID NO: 4679721 - DNA, 18 bp, Homo sapiens
ggcacccccagcctgggc

SEQ ID NO: 4679722 - DNA, 20 bp, Homo sapiens
ggcacccccagcctgggcct

SEQ ID NO: 4679723 - DNA, 15 bp, Homo sapiens
ggcaccccctgcagc

SEQ ID NO: 4679724 - DNA, 20 bp, Homo sapiens
ggcacccgtccccacacgag

SEQ ID NO: 4679725 - DNA, 16 bp, Homo sapiens
ggcacctgggccctgg

SEQ ID NO: 4679726 - DNA, 19 bp, Homo sapiens
ggcacctgggccctggggc

SEQ ID NO: 4679727 - DNA, 20 bp, Homo sapiens
ggcactccaaacctgtcttg

SEQ ID NO: 4679728 - DNA, 10 bp, Homo sapiens
ggcactccca

SEQ ID NO: 4679729 - DNA, 22 bp, Homo sapiens
ggcactccgcgccgatgccacc

SEQ ID NO: 4679730 - DNA, 20 bp, Homo sapiens
ggcactgtgatacagttttg

SEQ ID NO: 4679731 - DNA, 13 bp, Homo sapiens
ggcacttaatttg

SEQ ID NO: 4679732 - DNA, 20 bp, Homo sapiens
ggcacttaatttgtaaactt

SEQ ID NO: 4679733 - DNA, 22 bp, Homo sapiens
ggcacttaatttgtaaacttct

SEQ ID NO: 4679734 - DNA, 15 bp, Homo sapiens
ggcacttccacctcc

SEQ ID NO: 4679735 - DNA, 20 bp, Homo sapiens
ggcagaaatagttgtctgtg

SEQ ID NO: 4679736 - DNA, 20 bp, Homo sapiens
ggcagaagcttggaggaggg

SEQ ID NO: 4679737 - DNA, 23 bp, Homo sapiens
ggcagagcagtctaaacagagtc

SEQ ID NO: 4679738 - DNA, 20 bp, Homo sapiens
ggcagagctctacaggcctg

SEQ ID NO: 4679739 - DNA, 14 bp, Homo sapiens
ggcagagtcctgcc

SEQ ID NO: 4679740 - DNA, 21 bp, Homo sapiens
ggcagagttctataatgtaaa

SEQ ID NO: 4679741 - DNA, 17 bp, Homo sapiens
ggcagatgcccttgctg

SEQ ID NO: 4679742 - DNA, 20 bp, Homo sapiens
ggcagatgtaggagggactg

SEQ ID NO: 4679743 - DNA, 17 bp, Homo sapiens
ggcagattttcatgcaa

SEQ ID NO: 4679744 - DNA, 20 bp, Homo sapiens
ggcagcaaggcccgagcagc

SEQ ID NO: 4679745 - DNA, 23 bp, Homo sapiens
ggcagcaaggcccgagcagctga

SEQ ID NO: 4679746 - DNA, 23 bp, Homo sapiens
ggcagcactccccagagctgtgc

SEQ ID NO: 4679747 - DNA, 24 bp, Homo sapiens
ggcagcactccccagagctgtgcc

SEQ ID NO: 4679748 - DNA, 11 bp, Homo sapiens
ggcagcagcca

SEQ ID NO: 4679749 - DNA, 12 bp, Homo sapiens
ggcagcagccag

SEQ ID NO: 4679750 - DNA, 21 bp, Homo sapiens
ggcagcagccagccctgcctg

SEQ ID NO: 4679751 - DNA, 19 bp, Homo sapiens
ggcagcatgcttgggctga

SEQ ID NO: 4679752 - DNA, 17 bp, Homo sapiens
ggcagcatggagagagg

SEQ ID NO: 4679753 - DNA, 13 bp, Homo sapiens
ggcagccagacca

SEQ ID NO: 4679754 - DNA, 15 bp, Homo sapiens
ggcagccagaccagc

SEQ ID NO: 4679755 - DNA, 15 bp, Homo sapiens
ggcagccagccgtgg

SEQ ID NO: 4679756 - DNA, 22 bp, Homo sapiens
ggcagcccctgttttctgctgt

SEQ ID NO: 4679757 - DNA, 14 bp, Homo sapiens
ggcagcctcccatc

SEQ ID NO: 4679758 - DNA, 19 bp, Homo sapiens
ggcagcgcccttcctctcc

SEQ ID NO: 4679759 - DNA, 13 bp, Homo sapiens
ggcagcgggcgga

SEQ ID NO: 4679760 - DNA, 13 bp, Homo sapiens
ggcagctcctctg

SEQ ID NO: 4679761 - DNA, 16 bp, Homo sapiens
ggcagctcctctgtct

SEQ ID NO: 4679762 - DNA, 21 bp, Homo sapiens
ggcagctcctctgtctcgagc

SEQ ID NO: 4679763 - DNA, 15 bp, Homo sapiens
ggcaggaacaaacag

SEQ ID NO: 4679764 - DNA, 14 bp, Homo sapiens
ggcaggacaggaaa

SEQ ID NO: 4679765 - DNA, 10 bp, Homo sapiens
ggcaggagct

SEQ ID NO: 4679766 - DNA, 16 bp, Homo sapiens
gggtcaagctgagctg

SEQ ID NO: 4679767 - DNA, 17 bp, Homo sapiens
gggtcaagctgagctgg

SEQ ID NO: 4679768 - DNA, 18 bp, Homo sapiens
gggtcaagctgagctggc

SEQ ID NO: 4679769 - DNA, 16 bp, Homo sapiens
gggtcagccagggcct

SEQ ID NO: 4679770 - DNA, 13 bp, Homo sapiens
gggtccagaagac

SEQ ID NO: 4679771 - DNA, 21 bp, Homo sapiens
gggtccatagagatgagccca

SEQ ID NO: 4679772 - DNA, 22 bp, Homo sapiens
gggtccctggagggcaagccct

SEQ ID NO: 4679773 - DNA, 14 bp, Homo sapiens
gggtctctccctca

SEQ ID NO: 4679774 - DNA, 12 bp, Homo sapiens
gggtctctgaag

SEQ ID NO: 4679775 - DNA, 14 bp, Homo sapiens
gggtctctgaaggg

SEQ ID NO: 4679776 - DNA, 18 bp, Homo sapiens
gggtctgagtctatgttc

SEQ ID NO: 4679777 - DNA, 23 bp, Homo sapiens
gggtgaaatccatactgtagaca

SEQ ID NO: 4679778 - DNA, 20 bp, Homo sapiens
gggtgaacaaagcagccacg

SEQ ID NO: 4679779 - DNA, 13 bp, Homo sapiens
gggtgacaagata

SEQ ID NO: 4679780 - DNA, 13 bp, Homo sapiens
gggtgacggccct

SEQ ID NO: 4679781 - DNA, 23 bp, Homo sapiens
gggtgagcagggtcaagcctctt

SEQ ID NO: 4679782 - DNA, 18 bp, Homo sapiens
gggtgatgagggcagcag

SEQ ID NO: 4679783 - DNA, 19 bp, Homo sapiens
gggtgatgagggcagcagc

SEQ ID NO: 4679784 - DNA, 13 bp, Homo sapiens
gggtgcacaggag

SEQ ID NO: 4679785 - DNA, 14 bp, Homo sapiens
gggtgcacaggagg

SEQ ID NO: 4679786 - DNA, 18 bp, Homo sapiens
gggtgctcagaataaggc

SEQ ID NO: 4679787 - DNA, 21 bp, Homo sapiens
gggtgctcagaataaggcagg

SEQ ID NO: 4679788 - DNA, 15 bp, Homo sapiens
gggtgggaaggggct

SEQ ID NO: 4679789 - DNA, 19 bp, Homo sapiens
gggtgggcctggccctgct

SEQ ID NO: 4679790 - DNA, 16 bp, Homo sapiens
gggtgggtgctcagaa

SEQ ID NO: 4679791 - DNA, 22 bp, Homo sapiens
gggtggtcttgtggttgtgtgt

SEQ ID NO: 4679792 - DNA, 15 bp, Homo sapiens
gggttggggtgacag

SEQ ID NO: 4679793 - DNA, 20 bp, Homo sapiens
gggtttcactgtgttagcca

SEQ ID NO: 4679794 - DNA, 15 bp, Homo sapiens
gggtttgtcagagga

SEQ ID NO: 4679795 - DNA, 14 bp, Homo sapiens
ggtaaaacagtttc

SEQ ID NO: 4679796 - DNA, 23 bp, Homo sapiens
ggtaatcctcttctaaaatagca

SEQ ID NO: 4679797 - DNA, 15 bp, Homo sapiens
ggtacaggagaggca

SEQ ID NO: 4679798 - DNA, 17 bp, Homo sapiens
ggtaccatgctttttct

SEQ ID NO: 4679799 - DNA, 17 bp, Homo sapiens
ggtacctcaagccccat

SEQ ID NO: 4679800 - DNA, 22 bp, Homo sapiens
ggtacctcaagccccatttcct

SEQ ID NO: 4679801 - DNA, 12 bp, Homo sapiens
ggtacctgccct

SEQ ID NO: 4679802 - DNA, 14 bp, Homo sapiens
ggtagacctgtctc

SEQ ID NO: 4679803 - DNA, 21 bp, Homo sapiens
ggtaggccccacaaggcctgg

SEQ ID NO: 4679804 - DNA, 19 bp, Homo sapiens
ggtaggttgggacaccagg

SEQ ID NO: 4679805 - DNA, 15 bp, Homo sapiens
ggtagtctcactgct

SEQ ID NO: 4679806 - DNA, 20 bp, Homo sapiens
ggtagtctcactgcttgaac

SEQ ID NO: 4679807 - DNA, 13 bp, Homo sapiens
ggtatagaaatgc

SEQ ID NO: 4679808 - DNA, 23 bp, Homo sapiens
ggtatcctactgagcatttgcac

SEQ ID NO: 4679809 - DNA, 21 bp, Homo sapiens
ggtatcctgggggaagaggag

SEQ ID NO: 4679810 - DNA, 18 bp, Homo sapiens
ggtatttagaagcagagg

SEQ ID NO: 4679811 - DNA, 15 bp, Homo sapiens
ggtattttgtttctt

SEQ ID NO: 4679812 - DNA, 19 bp, Homo sapiens
ggtcaagaaacagccagca

SEQ ID NO: 4679813 - DNA, 15 bp, Homo sapiens
ggtcaagctgagctg

SEQ ID NO: 4679814 - DNA, 16 bp, Homo sapiens
ggtcaagctgagctgg

SEQ ID NO: 4679815 - DNA, 11 bp, Homo sapiens
ggtcaccagct

SEQ ID NO: 4679816 - DNA, 15 bp, Homo sapiens
ggtcaccagctgctg

SEQ ID NO: 4679817 - DNA, 16 bp, Homo sapiens
ggtcaccagctgctgt

SEQ ID NO: 4679818 - DNA, 19 bp, Homo sapiens
ggtcaccagctgctgtgcc

SEQ ID NO: 4679819 - DNA, 20 bp, Homo sapiens
ggtcaccattatgctggtgt

SEQ ID NO: 4679820 - DNA, 13 bp, Homo sapiens
ggtcagcccatgg

SEQ ID NO: 4679821 - DNA, 16 bp, Homo sapiens
ggtcagcccatggagg

SEQ ID NO: 4679822 - DNA, 11 bp, Homo sapiens
ggtcagccttg

SEQ ID NO: 4679823 - DNA, 13 bp, Homo sapiens
ggtcaggcagggt

SEQ ID NO: 4679824 - DNA, 16 bp, Homo sapiens
ggtcatagtttcctga

SEQ ID NO: 4679825 - DNA, 14 bp, Homo sapiens
ggtcatgtttgcag

SEQ ID NO: 4679826 - DNA, 19 bp, Homo sapiens
ggtcatgtttgcaggggtg

SEQ ID NO: 4679827 - DNA, 14 bp, Homo sapiens
ggtccatcctggtc

SEQ ID NO: 4679828 - DNA, 16 bp, Homo sapiens
ggtcccacatccctgg

SEQ ID NO: 4679829 - DNA, 17 bp, Homo sapiens
ggtcccacatccctggg

SEQ ID NO: 4679830 - DNA, 21 bp, Homo sapiens
ggtcccacatccctgggcctg

SEQ ID NO: 4679831 - DNA, 16 bp, Homo sapiens
ggtcccagccctgggg

SEQ ID NO: 4679832 - DNA, 23 bp, Homo sapiens
ggtccctggagggcaagccctgc

SEQ ID NO: 4679833 - DNA, 13 bp, Homo sapiens
ggtcctctgtcag

SEQ ID NO: 4679834 - DNA, 16 bp, Homo sapiens
ggtcctgagcactgcc

SEQ ID NO: 4679835 - DNA, 20 bp, Homo sapiens
ggtcctgagcactgccagga

SEQ ID NO: 4679836 - DNA, 21 bp, Homo sapiens
ggtcctggtggggcagctcct

SEQ ID NO: 4679837 - DNA, 17 bp, Homo sapiens
ggtcggaggtgctgtcc

SEQ ID NO: 4679838 - DNA, 14 bp, Homo sapiens
ggtcgtggagagct

SEQ ID NO: 4679839 - DNA, 18 bp, Homo sapiens
ggtctagaccagggctgc

SEQ ID NO: 4679840 - DNA, 13 bp, Homo sapiens
ggtctccaggggc

SEQ ID NO: 4679841 - DNA, 15 bp, Homo sapiens
ggtctccaggggcct

SEQ ID NO: 4679842 - DNA, 18 bp, Homo sapiens
ggtctccaggggcctgca

SEQ ID NO: 4679843 - DNA, 21 bp, Homo sapiens
ggtctccaggggcctgcagaa

SEQ ID NO: 4679844 - DNA, 12 bp, Homo sapiens
ggtctccttcct

SEQ ID NO: 4679845 - DNA, 14 bp, Homo sapiens
ggtctccttccttc

SEQ ID NO: 4679846 - DNA, 15 bp, Homo sapiens
ggtctctgaagggac

SEQ ID NO: 4679847 - DNA, 15 bp, Homo sapiens
ggtctggcagcctcc

SEQ ID NO: 4679848 - DNA, 13 bp, Homo sapiens
ggtctggcagggc

SEQ ID NO: 4679849 - DNA, 12 bp, Homo sapiens
ggtctggctaga

SEQ ID NO: 4679850 - DNA, 20 bp, Homo sapiens
ggtctggctagagggcccaa

SEQ ID NO: 4679851 - DNA, 24 bp, Homo sapiens
ggtctgtgtgaatgtgggcactgg

SEQ ID NO: 4679852 - DNA, 12 bp, Homo sapiens
ggtcttcctgtg

SEQ ID NO: 4679853 - DNA, 18 bp, Homo sapiens
ggtcttcctgtggctccc

SEQ ID NO: 4679854 - DNA, 23 bp, Homo sapiens
ggtcttgtggttgtgtgtgttct

SEQ ID NO: 4679855 - DNA, 19 bp, Homo sapiens
ggtcttttcatctgggaaa

SEQ ID NO: 4679856 - DNA, 20 bp, Homo sapiens
ggtcttttcatctgggaaag

SEQ ID NO: 4679857 - DNA, 13 bp, Homo sapiens
ggtgaaagaacaa

SEQ ID NO: 4679858 - DNA, 18 bp, Homo sapiens
ggtgaagctatttatctg

SEQ ID NO: 4679859 - DNA, 18 bp, Homo sapiens
ggtgacagtcatcatcag

SEQ ID NO: 4679860 - DNA, 15 bp, Homo sapiens
ggtgaccccagggca

SEQ ID NO: 4679861 - DNA, 16 bp, Homo sapiens
ggtgaccccagggcac

SEQ ID NO: 4679862 - DNA, 21 bp, Homo sapiens
ggtgaccccagggcacaggag

SEQ ID NO: 4679863 - DNA, 23 bp, Homo sapiens
ggtgactgtgtaactttctctta

SEQ ID NO: 4679864 - DNA, 15 bp, Homo sapiens
ggtgacttctgctgc

SEQ ID NO: 4679865 - DNA, 16 bp, Homo sapiens
ggtgacttctgctgct

SEQ ID NO: 4679866 - DNA, 17 bp, Homo sapiens
ggtgacttctgctgctg

SEQ ID NO: 4679867 - DNA, 17 bp, Homo sapiens
ggtgacttgtctgcctc

SEQ ID NO: 4679868 - DNA, 23 bp, Homo sapiens
ggtgacttgtctgcctcctgctt

SEQ ID NO: 4679869 - DNA, 21 bp, Homo sapiens
ggtgagagaccacacatttta

SEQ ID NO: 4679870 - DNA, 14 bp, Homo sapiens
ggtgataaaatttt

SEQ ID NO: 4679871 - DNA, 21 bp, Homo sapiens
ggtgatccgcccacctcagcc

SEQ ID NO: 4679872 - DNA, 15 bp, Homo sapiens
ggtgatgagggcagc

SEQ ID NO: 4679873 - DNA, 17 bp, Homo sapiens
ggtgatgagggcagcag

SEQ ID NO: 4679874 - DNA, 22 bp, Homo sapiens
ggtgattacataatctgtacaa

SEQ ID NO: 4679875 - DNA, 14 bp, Homo sapiens
ggtgcaagcactcg

SEQ ID NO: 4679876 - DNA, 12 bp, Homo sapiens
ggccactgggga

SEQ ID NO: 4679877 - DNA, 14 bp, Homo sapiens
ggccactggggact

SEQ ID NO: 4679878 - DNA, 20 bp, Homo sapiens
ggccactggggactttattt

SEQ ID NO: 4679879 - DNA, 19 bp, Homo sapiens
ggccactttcagagccccc

SEQ ID NO: 4679880 - DNA, 15 bp, Homo sapiens
ggccagacctgcaga

SEQ ID NO: 4679881 - DNA, 18 bp, Homo sapiens
ggccagacctgcagacgc

SEQ ID NO: 4679882 - DNA, 13 bp, Homo sapiens
ggccagagcagct

SEQ ID NO: 4679883 - DNA, 22 bp, Homo sapiens
ggccagagctacccgcagagtt

SEQ ID NO: 4679884 - DNA, 20 bp, Homo sapiens
ggccagatgcacatccctgg

SEQ ID NO: 4679885 - DNA, 21 bp, Homo sapiens
ggccagatgcacatccctgga

SEQ ID NO: 4679886 - DNA, 12 bp, Homo sapiens
ggccagcctggc

SEQ ID NO: 4679887 - DNA, 22 bp, Homo sapiens
ggccagcctggcctcctgcctc

SEQ ID NO: 4679888 - DNA, 14 bp, Homo sapiens
ggccaggagtgggg

SEQ ID NO: 4679889 - DNA, 16 bp, Homo sapiens
ggccaggagtggggag

SEQ ID NO: 4679890 - DNA, 11 bp, Homo sapiens
ggccaggcccc

SEQ ID NO: 4679891 - DNA, 12 bp, Homo sapiens
ggccaggcccca

SEQ ID NO: 4679892 - DNA, 15 bp, Homo sapiens
ggccaggccccatgg

SEQ ID NO: 4679893 - DNA, 20 bp, Homo sapiens
ggccagggctgccctgagaa

SEQ ID NO: 4679894 - DNA, 13 bp, Homo sapiens
ggccaggggccag

SEQ ID NO: 4679895 - DNA, 22 bp, Homo sapiens
ggccagggtctgtgtgaatgtg

SEQ ID NO: 4679896 - DNA, 22 bp, Homo sapiens
ggccatctgggctcctccaggg

SEQ ID NO: 4679897 - DNA, 15 bp, Homo sapiens
ggccatgaactttgt

SEQ ID NO: 4679898 - DNA, 16 bp, Homo sapiens
ggccatgttgtgcctc

SEQ ID NO: 4679899 - DNA, 21 bp, Homo sapiens
ggccatgttgtgcctccctgg

SEQ ID NO: 4679900 - DNA, 23 bp, Homo sapiens
ggccattttggggggttatttat

SEQ ID NO: 4679901 - DNA, 17 bp, Homo sapiens
ggcccaagagcccgtgc

SEQ ID NO: 4679902 - DNA, 17 bp, Homo sapiens
ggcccaagtctcctagg

SEQ ID NO: 4679903 - DNA, 17 bp, Homo sapiens
ggcccacggtttcagct

SEQ ID NO: 4679904 - DNA, 17 bp, Homo sapiens
ggcccatctctccctgc

SEQ ID NO: 4679905 - DNA, 17 bp, Homo sapiens
ggccccacaaggcctgg

SEQ ID NO: 4679906 - DNA, 16 bp, Homo sapiens
ggccccagaggccctg

SEQ ID NO: 4679907 - DNA, 19 bp, Homo sapiens
ggccccagaggccctggag

SEQ ID NO: 4679908 - DNA, 21 bp, Homo sapiens
ggccccaggacctggctgcca

SEQ ID NO: 4679909 - DNA, 21 bp, Homo sapiens
ggccccatcctcatccctgac

SEQ ID NO: 4679910 - DNA, 20 bp, Homo sapiens
ggcccccaagttttttaatt

SEQ ID NO: 4679911 - DNA, 14 bp, Homo sapiens
ggcccccagcttca

SEQ ID NO: 4679912 - DNA, 17 bp, Homo sapiens
ggcccccatcagccctg

SEQ ID NO: 4679913 - DNA, 20 bp, Homo sapiens
ggcccccatcagccctgcta

SEQ ID NO: 4679914 - DNA, 21 bp, Homo sapiens
ggcccccatcagccctgctag

SEQ ID NO: 4679915 - DNA, 21 bp, Homo sapiens
ggcccccatctcatgcccctg

SEQ ID NO: 4679916 - DNA, 19 bp, Homo sapiens
ggccccgccagggctgggg

SEQ ID NO: 4679917 - DNA, 18 bp, Homo sapiens
ggccccgggctggagaaa

SEQ ID NO: 4679918 - DNA, 20 bp, Homo sapiens
ggcccctaggctgctgctgt

SEQ ID NO: 4679919 - DNA, 20 bp, Homo sapiens
ggcccctgcctgctggagat

SEQ ID NO: 4679920 - DNA, 13 bp, Homo sapiens
ggcccgagcagct

SEQ ID NO: 4679921 - DNA, 14 bp, Homo sapiens
ggcccgagcagctg

SEQ ID NO: 4679922 - DNA, 20 bp, Homo sapiens
ggcccgagcagctgagcagg

SEQ ID NO: 4679923 - DNA, 22 bp, Homo sapiens
ggcccgagcagctgagcagggc

SEQ ID NO: 4679924 - DNA, 23 bp, Homo sapiens
ggcccgagcagctgagcagggcc

SEQ ID NO: 4679925 - DNA, 16 bp, Homo sapiens
ggcccgcgcagctgcc

SEQ ID NO: 4679926 - DNA, 21 bp, Homo sapiens
ggccctcatctatgaggaaag

SEQ ID NO: 4679927 - DNA, 14 bp, Homo sapiens
ggccctcccagccc

SEQ ID NO: 4679928 - DNA, 17 bp, Homo sapiens
ggccctctttccctgcg

SEQ ID NO: 4679929 - DNA, 20 bp, Homo sapiens
ggccctctttccctgcgaga

SEQ ID NO: 4679930 - DNA, 21 bp, Homo sapiens
ggccctgcatctgtctgctct

SEQ ID NO: 4679931 - DNA, 20 bp, Homo sapiens
ggccctgctttctacgccaa

SEQ ID NO: 4679932 - DNA, 12 bp, Homo sapiens
ggccctggaggt

SEQ ID NO: 4679933 - DNA, 17 bp, Homo sapiens
ggccctggatcagcgtg

SEQ ID NO: 4679934 - DNA, 16 bp, Homo sapiens
ggccctggcaccccca

SEQ ID NO: 4679935 - DNA, 12 bp, Homo sapiens
ggccctggccct

SEQ ID NO: 4679936 - DNA, 14 bp, Homo sapiens
ggccctggggcctg

SEQ ID NO: 4679937 - DNA, 23 bp, Homo sapiens
ggccctggggcctgtactgcctg

SEQ ID NO: 4679938 - DNA, 16 bp, Homo sapiens
ggccctgtctctggct

SEQ ID NO: 4679939 - DNA, 13 bp, Homo sapiens
ggcccttcctgga

SEQ ID NO: 4679940 - DNA, 14 bp, Homo sapiens
ggcccttcctggac

SEQ ID NO: 4679941 - DNA, 15 bp, Homo sapiens
ggcccttcctggaca

SEQ ID NO: 4679942 - DNA, 17 bp, Homo sapiens
ggcccttcctggacagc

SEQ ID NO: 4679943 - DNA, 23 bp, Homo sapiens
ggcccttcctggacagctgtgcc

SEQ ID NO: 4679944 - DNA, 20 bp, Homo sapiens
ggccgaagctaacagggaag

SEQ ID NO: 4679945 - DNA, 21 bp, Homo sapiens
ggctttctgggctctggactc

SEQ ID NO: 4679946 - DNA, 20 bp, Homo sapiens
gggaaaggggttggggtgac

SEQ ID NO: 4679947 - DNA, 12 bp, Homo sapiens
gggaaattcagt

SEQ ID NO: 4679948 - DNA, 23 bp, Homo sapiens
gggaaattgtaaatcctgtgttt

SEQ ID NO: 4679949 - DNA, 21 bp, Homo sapiens
gggaacaaaactgttcttttg

SEQ ID NO: 4679950 - DNA, 16 bp, Homo sapiens
gggaactctcctggcc

SEQ ID NO: 4679951 - DNA, 17 bp, Homo sapiens
gggaactctcctggcct

SEQ ID NO: 4679952 - DNA, 12 bp, Homo sapiens
gggaactggcca

SEQ ID NO: 4679953 - DNA, 15 bp, Homo sapiens
gggaactggccaagc

SEQ ID NO: 4679954 - DNA, 16 bp, Homo sapiens
gggaactggccaagct

SEQ ID NO: 4679955 - DNA, 18 bp, Homo sapiens
gggaactggccaagctga

SEQ ID NO: 4679956 - DNA, 12 bp, Homo sapiens
gggaagaggaga

SEQ ID NO: 4679957 - DNA, 14 bp, Homo sapiens
gggaagaggagatg

SEQ ID NO: 4679958 - DNA, 18 bp, Homo sapiens
gggaaggagacaggatga

SEQ ID NO: 4679959 - DNA, 15 bp, Homo sapiens
gggaaggcaggcagg

SEQ ID NO: 4679960 - DNA, 21 bp, Homo sapiens
gggaaggcaggcagggctctc

SEQ ID NO: 4679961 - DNA, 13 bp, Homo sapiens
gggaatcattttt

SEQ ID NO: 4679962 - DNA, 14 bp, Homo sapiens
gggaatgagcccag

SEQ ID NO: 4679963 - DNA, 17 bp, Homo sapiens
gggaatgagcccagaga

SEQ ID NO: 4679964 - DNA, 15 bp, Homo sapiens
gggacaaaggagcct

SEQ ID NO: 4679965 - DNA, 16 bp, Homo sapiens
gggacaaaggagcctg

SEQ ID NO: 4679966 - DNA, 18 bp, Homo sapiens
gggacaaccagaaggccc

SEQ ID NO: 4679967 - DNA, 14 bp, Homo sapiens
gggacaagcaggcc

SEQ ID NO: 4679968 - DNA, 20 bp, Homo sapiens
gggacaagcaggccgccctc

SEQ ID NO: 4679969 - DNA, 16 bp, Homo sapiens
gggacaagtctttctc

SEQ ID NO: 4679970 - DNA, 16 bp, Homo sapiens
gggacagcccagagcc

SEQ ID NO: 4679971 - DNA, 18 bp, Homo sapiens
gggacaggctgaagagag

SEQ ID NO: 4679972 - DNA, 19 bp, Homo sapiens
gggacaggctgaagagagg

SEQ ID NO: 4679973 - DNA, 14 bp, Homo sapiens
gggacccacctgct

SEQ ID NO: 4679974 - DNA, 16 bp, Homo sapiens
gggacccacctgctag

SEQ ID NO: 4679975 - DNA, 17 bp, Homo sapiens
gggaccccagctgctct

SEQ ID NO: 4679976 - DNA, 21 bp, Homo sapiens
gggaccggcagagctctacag

SEQ ID NO: 4679977 - DNA, 13 bp, Homo sapiens
gggactcagggac

SEQ ID NO: 4679978 - DNA, 15 bp, Homo sapiens
gggactcagggaccg

SEQ ID NO: 4679979 - DNA, 12 bp, Homo sapiens
gggactgtccta

SEQ ID NO: 4679980 - DNA, 13 bp, Homo sapiens
gggacttgtgtct

SEQ ID NO: 4679981 - DNA, 15 bp, Homo sapiens
gggacttgtgtctgc

SEQ ID NO: 4679982 - DNA, 23 bp, Homo sapiens
gggactttcccacccaggaaagg

SEQ ID NO: 4679983 - DNA, 21 bp, Homo sapiens
gggagagatccctgcagaacc

SEQ ID NO: 4679984 - DNA, 20 bp, Homo sapiens
gggagaggtcaccagctgct

SEQ ID NO: 4679985 - DNA, 18 bp, Homo sapiens
gggagagtacctgtgtgt

SEQ ID NO: 4679986 - DNA, 19 bp, Homo sapiens
gggagatggagttcttgtg

SEQ ID NO: 4679987 - DNA, 19 bp, Homo sapiens
gggagccccttctgctcag

SEQ ID NO: 4679988 - DNA, 21 bp, Homo sapiens
gggagcctcgcaacccgtgcc

SEQ ID NO: 4679989 - DNA, 20 bp, Homo sapiens
gggagcgtgggctcagcagg

SEQ ID NO: 4679990 - DNA, 21 bp, Homo sapiens
ggagcaagctcttcccttgct

SEQ ID NO: 4679991 - DNA, 13 bp, Homo sapiens
ggagcagccctgg

SEQ ID NO: 4679992 - DNA, 18 bp, Homo sapiens
ggagcaggttccccaagg

SEQ ID NO: 4679993 - DNA, 24 bp, Homo sapiens
ggagcaggttccccaagggccctg

SEQ ID NO: 4679994 - DNA, 15 bp, Homo sapiens
ggagccaggccccac

SEQ ID NO: 4679995 - DNA, 16 bp, Homo sapiens
ggagcccagcggccca

SEQ ID NO: 4679996 - DNA, 18 bp, Homo sapiens
ggagcccagcggcccaag

SEQ ID NO: 4679997 - DNA, 13 bp, Homo sapiens
ggagccgctggca

SEQ ID NO: 4679998 - DNA, 23 bp, Homo sapiens
ggagccggtaactgtcctgtcct

SEQ ID NO: 4679999 - DNA, 17 bp, Homo sapiens
ggagcctgtgaacccag

SEQ ID NO: 4680000 - DNA, 22 bp, Homo sapiens
ggagcctgtgaacccaggacaa

SEQ ID NO: 4680001 - DNA, 21 bp, Homo sapiens
ggagcctgtgcgtcccagctg

SEQ ID NO: 4680002 - DNA, 13 bp, Homo sapiens
ggagccttcccaa

SEQ ID NO: 4680003 - DNA, 23 bp, Homo sapiens
ggagccttcccaagttgtgcttg

SEQ ID NO: 4680004 - DNA, 20 bp, Homo sapiens
ggagcggccggccagcccct

SEQ ID NO: 4680005 - DNA, 23 bp, Homo sapiens
ggagctacctgtgtggacaggac

SEQ ID NO: 4680006 - DNA, 12 bp, Homo sapiens
ggagctgcaggg

SEQ ID NO: 4680007 - DNA, 14 bp, Homo sapiens
ggagctgcaggggc

SEQ ID NO: 4680008 - DNA, 20 bp, Homo sapiens
ggagctgcaggggcatggga

SEQ ID NO: 4680009 - DNA, 12 bp, Homo sapiens
ggagctgccaca

SEQ ID NO: 4680010 - DNA, 22 bp, Homo sapiens
ggagctgcccctctctgggcct

SEQ ID NO: 4680011 - DNA, 12 bp, Homo sapiens
ggagctggaacc

SEQ ID NO: 4680012 - DNA, 13 bp, Homo sapiens
ggagcttccgctt

SEQ ID NO: 4680013 - DNA, 21 bp, Homo sapiens
ggagcttcttcgttcctgcgc

SEQ ID NO: 4680014 - DNA, 23 bp, Homo sapiens
ggagcttcttcgttcctgcgcat

SEQ ID NO: 4680015 - DNA, 16 bp, Homo sapiens
ggaggaagagccacct

SEQ ID NO: 4680016 - DNA, 20 bp, Homo sapiens
ggaggaagagccacctgcaa

SEQ ID NO: 4680017 - DNA, 21 bp, Homo sapiens
ggaggaccagtcaggatgagg

SEQ ID NO: 4680018 - DNA, 14 bp, Homo sapiens
ggaggacctgagcc

SEQ ID NO: 4680019 - DNA, 15 bp, Homo sapiens
ggaggacctgagcct

SEQ ID NO: 4680020 - DNA, 17 bp, Homo sapiens
ggaggacctgagcctgc

SEQ ID NO: 4680021 - DNA, 18 bp, Homo sapiens
ggaggacctgagcctgcc

SEQ ID NO: 4680022 - DNA, 12 bp, Homo sapiens
ggaggagagaga

SEQ ID NO: 4680023 - DNA, 13 bp, Homo sapiens
ggaggagagagac

SEQ ID NO: 4680024 - DNA, 21 bp, Homo sapiens
ggaggagcaacggccccagcg

SEQ ID NO: 4680025 - DNA, 12 bp, Homo sapiens
ggaggagccagg

SEQ ID NO: 4680026 - DNA, 21 bp, Homo sapiens
ggaggagggtttgggcagagc

SEQ ID NO: 4680027 - DNA, 16 bp, Homo sapiens
ggaggagtcagatgag

SEQ ID NO: 4680028 - DNA, 22 bp, Homo sapiens
ggaggatttcctacccccgtcc

SEQ ID NO: 4680029 - DNA, 23 bp, Homo sapiens
ggaggcagcatggagagaggcct

SEQ ID NO: 4680030 - DNA, 23 bp, Homo sapiens
ggaggccctcctgtgctggggga

SEQ ID NO: 4680031 - DNA, 11 bp, Homo sapiens
ggaggctgctc

SEQ ID NO: 4680032 - DNA, 23 bp, Homo sapiens
ggaggctgctcggggtgcacagg

SEQ ID NO: 4680033 - DNA, 21 bp, Homo sapiens
ggagggaaggataaagccact

SEQ ID NO: 4680034 - DNA, 18 bp, Homo sapiens
ggagggacaaaggagcct

SEQ ID NO: 4680035 - DNA, 21 bp, Homo sapiens
ggagggacaaaggagcctgtg

SEQ ID NO: 4680036 - DNA, 22 bp, Homo sapiens
ggagggacaagtggactcaggg

SEQ ID NO: 4680037 - DNA, 15 bp, Homo sapiens
ggagggaggctcagg

SEQ ID NO: 4680038 - DNA, 16 bp, Homo sapiens
ggagggaggctcaggt

SEQ ID NO: 4680039 - DNA, 12 bp, Homo sapiens
ggagggctctga

SEQ ID NO: 4680040 - DNA, 13 bp, Homo sapiens
ggagggctctgag

SEQ ID NO: 4680041 - DNA, 16 bp, Homo sapiens
ggagggctctgaggcg

SEQ ID NO: 4680042 - DNA, 18 bp, Homo sapiens
ggagggctctgaggcgcc

SEQ ID NO: 4680043 - DNA, 21 bp, Homo sapiens
ggagggctctgaggcgcccca

SEQ ID NO: 4680044 - DNA, 19 bp, Homo sapiens
ggagggcttggcccagcgc

SEQ ID NO: 4680045 - DNA, 13 bp, Homo sapiens
ggaggggagaggt

SEQ ID NO: 4680046 - DNA, 14 bp, Homo sapiens
ggagggggcaagct

SEQ ID NO: 4680047 - DNA, 17 bp, Homo sapiens
ggagggtatactgaggg

SEQ ID NO: 4680048 - DNA, 13 bp, Homo sapiens
ggaggtcccagcc

SEQ ID NO: 4680049 - DNA, 15 bp, Homo sapiens
ggaggtcccagccct

SEQ ID NO: 4680050 - DNA, 16 bp, Homo sapiens
ggaggtcccagccctg

SEQ ID NO: 4680051 - DNA, 17 bp, Homo sapiens
ggaggtcccagccctgg

SEQ ID NO: 4680052 - DNA, 23 bp, Homo sapiens
ggaggtgaaagaaagggacccac

SEQ ID NO: 4680053 - DNA, 22 bp, Homo sapiens
ggaggtgctgtccccactgccc

SEQ ID NO: 4680054 - DNA, 19 bp, Homo sapiens
ggagtcagatgaggccctg

SEQ ID NO: 4680055 - DNA, 16 bp, Homo sapiens
ggagtctgaggtcctg

SEQ ID NO: 4680056 - DNA, 18 bp, Homo sapiens
ggagtctgaggtcctgag

SEQ ID NO: 4680057 - DNA, 19 bp, Homo sapiens
ggagtctgaggtcctgagc

SEQ ID NO: 4680058 - DNA, 12 bp, Homo sapiens
ggagtgcagtgg

SEQ ID NO: 4680059 - DNA, 19 bp, Homo sapiens
ggagtgccataccttctcc

SEQ ID NO: 4680060 - DNA, 23 bp, Homo sapiens
ggagtgccataccttctcccagg

SEQ ID NO: 4680061 - DNA, 22 bp, Homo sapiens
ggagtggtacttaagctcccct

SEQ ID NO: 4680062 - DNA, 23 bp, Homo sapiens
ggagtggtacttaagctcccctg

SEQ ID NO: 4680063 - DNA, 15 bp, Homo sapiens
ggagtggtgcagaca

SEQ ID NO: 4680064 - DNA, 15 bp, Homo sapiens
ggagtgtactcccag

SEQ ID NO: 4680065 - DNA, 18 bp, Homo sapiens
ggagtgtactcccagggc

SEQ ID NO: 4680066 - DNA, 14 bp, Homo sapiens
ggagtgtcctgccc

SEQ ID NO: 4680067 - DNA, 18 bp, Homo sapiens
ggaaggagacaggatgag

SEQ ID NO: 4680068 - DNA, 11 bp, Homo sapiens
ggaaggcaggc

SEQ ID NO: 4680069 - DNA, 15 bp, Homo sapiens
ggaaggcctgagccc

SEQ ID NO: 4680070 - DNA, 19 bp, Homo sapiens
ggaaggctacttcggggct

SEQ ID NO: 4680071 - DNA, 20 bp, Homo sapiens
ggaaggctacttcggggctg

SEQ ID NO: 4680072 - DNA, 21 bp, Homo sapiens
ggaaggggctatcctgggacc

SEQ ID NO: 4680073 - DNA, 16 bp, Homo sapiens
ggaagtagtccttggc

SEQ ID NO: 4680074 - DNA, 18 bp, Homo sapiens
ggaagtagtccttggcat

SEQ ID NO: 4680075 - DNA, 16 bp, Homo sapiens
ggaagtcctagcccct

SEQ ID NO: 4680076 - DNA, 20 bp, Homo sapiens
ggaagtggtggctgtggaag

SEQ ID NO: 4680077 - DNA, 15 bp, Homo sapiens
ggaataaaatgattt

SEQ ID NO: 4680078 - DNA, 22 bp, Homo sapiens
ggaataaaatgatttgtggaaa

SEQ ID NO: 4680079 - DNA, 13 bp, Homo sapiens
ggaataaagactt

SEQ ID NO: 4680080 - DNA, 15 bp, Homo sapiens
ggaataaagttgcag

SEQ ID NO: 4680081 - DNA, 18 bp, Homo sapiens
ggaataaagttgcagatg

SEQ ID NO: 4680082 - DNA, 17 bp, Homo sapiens
ggaatacattttattct

SEQ ID NO: 4680083 - DNA, 17 bp, Homo sapiens
ggaatcctatatagaat

SEQ ID NO: 4680084 - DNA, 22 bp, Homo sapiens
ggaatcctatatagaatgctgc

SEQ ID NO: 4680085 - DNA, 14 bp, Homo sapiens
ggaatgctggactg

SEQ ID NO: 4680086 - DNA, 15 bp, Homo sapiens
ggaattcagtgcctt

SEQ ID NO: 4680087 - DNA, 13 bp, Homo sapiens
ggaattctcttgg

SEQ ID NO: 4680088 - DNA, 22 bp, Homo sapiens
ggaattctcttggctggcttcc

SEQ ID NO: 4680089 - DNA, 13 bp, Homo sapiens
ggacaaaggagcc

SEQ ID NO: 4680090 - DNA, 14 bp, Homo sapiens
ggacaaaggagcct

SEQ ID NO: 4680091 - DNA, 17 bp, Homo sapiens
ggacaaccagaaggccc

SEQ ID NO: 4680092 - DNA, 16 bp, Homo sapiens
ggacaagcaggccgcc

SEQ ID NO: 4680093 - DNA, 18 bp, Homo sapiens
ggacaagcaggccgccct

SEQ ID NO: 4680094 - DNA, 20 bp, Homo sapiens
ggacaagtctttctcctctt

SEQ ID NO: 4680095 - DNA, 16 bp, Homo sapiens
ggacacagttcctggg

SEQ ID NO: 4680096 - DNA, 18 bp, Homo sapiens
ggacacagttcctgggaa

SEQ ID NO: 4680097 - DNA, 19 bp, Homo sapiens
ggacacccaggaatgaccc

SEQ ID NO: 4680098 - DNA, 13 bp, Homo sapiens
ggacacgagccac

SEQ ID NO: 4680099 - DNA, 21 bp, Homo sapiens
ggacacgagccacaagctgca

SEQ ID NO: 4680100 - DNA, 23 bp, Homo sapiens
ggacacgagccacaagctgcact

SEQ ID NO: 4680101 - DNA, 18 bp, Homo sapiens
ggacacttaacagatgca

SEQ ID NO: 4680102 - DNA, 12 bp, Homo sapiens
ggacactttgtt

SEQ ID NO: 4680103 - DNA, 13 bp, Homo sapiens
ggacagaaaatgc

SEQ ID NO: 4680104 - DNA, 16 bp, Homo sapiens
ggacagaaagaccctg

SEQ ID NO: 4680105 - DNA, 18 bp, Homo sapiens
ggacagcccagagcctgg

SEQ ID NO: 4680106 - DNA, 21 bp, Homo sapiens
ggacagcccagagcctggctg

SEQ ID NO: 4680107 - DNA, 19 bp, Homo sapiens
ggacagctgactgaatgca

SEQ ID NO: 4680108 - DNA, 11 bp, Homo sapiens
ggacagctgtg

SEQ ID NO: 4680109 - DNA, 20 bp, Homo sapiens
ggacagctgtgcctcgctcc

SEQ ID NO: 4680110 - DNA, 15 bp, Homo sapiens
ggacaggaccctcag

SEQ ID NO: 4680111 - DNA, 23 bp, Homo sapiens
ggacaggaccctcaggaattcag

SEQ ID NO: 4680112 - DNA, 19 bp, Homo sapiens
ggacaggactaacactcag

SEQ ID NO: 4680113 - DNA, 15 bp, Homo sapiens
ggacaggagaagaga

SEQ ID NO: 4680114 - DNA, 18 bp, Homo sapiens
ggacaggctgaagagagg

SEQ ID NO: 4680115 - DNA, 15 bp, Homo sapiens
ggacatctctttgaa

SEQ ID NO: 4680116 - DNA, 19 bp, Homo sapiens
ggacatgagatcagggcct

SEQ ID NO: 4680117 - DNA, 21 bp, Homo sapiens
ggacatgcggtagccagcaca

SEQ ID NO: 4680118 - DNA, 14 bp, Homo sapiens
ggaccaacctgacc

SEQ ID NO: 4680119 - DNA, 20 bp, Homo sapiens
ggaccacctcctctgccagc

SEQ ID NO: 4680120 - DNA, 16 bp, Homo sapiens
ggaccccagctgctct

SEQ ID NO: 4680121 - DNA, 21 bp, Homo sapiens
ggaccccttaatcttgctttc

SEQ ID NO: 4680122 - DNA, 18 bp, Homo sapiens
ggaccctttttggactag

SEQ ID NO: 4680123 - DNA, 22 bp, Homo sapiens
ggaccgctacaccactctggca

SEQ ID NO: 4680124 - DNA, 14 bp, Homo sapiens
ggaccggtgctgca

SEQ ID NO: 4680125 - DNA, 19 bp, Homo sapiens
ggaccggtgctgcaggagt

SEQ ID NO: 4680126 - DNA, 13 bp, Homo sapiens
ggaccggttccca

SEQ ID NO: 4680127 - DNA, 21 bp, Homo sapiens
ggaccggttcccacaagcctg

SEQ ID NO: 4680128 - DNA, 16 bp, Homo sapiens
ggacctccccagccca

SEQ ID NO: 4680129 - DNA, 16 bp, Homo sapiens
ggacctgagcctgccg

SEQ ID NO: 4680130 - DNA, 17 bp, Homo sapiens
ggacctgagcctgccga

SEQ ID NO: 4680131 - DNA, 20 bp, Homo sapiens
ggacctgagcctgccgagca

SEQ ID NO: 4680132 - DNA, 14 bp, Homo sapiens
ggactagccagaat

SEQ ID NO: 4680133 - DNA, 22 bp, Homo sapiens
ggactcagggcagcgccaggct

SEQ ID NO: 4680134 - DNA, 19 bp, Homo sapiens
ggactcatccttgcccagg

SEQ ID NO: 4680135 - DNA, 21 bp, Homo sapiens
ggactcatccttgcccaggtg

SEQ ID NO: 4680136 - DNA, 13 bp, Homo sapiens
ggactctgcacat

SEQ ID NO: 4680137 - DNA, 20 bp, Homo sapiens
ggactctgcacatgtcttgt

SEQ ID NO: 4680138 - DNA, 11 bp, Homo sapiens
ggactgagggc

SEQ ID NO: 4680139 - DNA, 17 bp, Homo sapiens
ggactgccaggctgttt

SEQ ID NO: 4680140 - DNA, 23 bp, Homo sapiens
ggactgtgaggccatacttgtga

SEQ ID NO: 4680141 - DNA, 22 bp, Homo sapiens
ggactgtttcatagttttctaa

SEQ ID NO: 4680142 - DNA, 16 bp, Homo sapiens
ggacttccacacctcc

SEQ ID NO: 4680143 - DNA, 18 bp, Homo sapiens
ggactttatttatttcta

SEQ ID NO: 4680144 - DNA, 17 bp, Homo sapiens
ggactttcccacccagg

SEQ ID NO: 4680145 - DNA, 12 bp, Homo sapiens
ggagaaaatata

SEQ ID NO: 4680146 - DNA, 12 bp, Homo sapiens
ggagaaagaagt

SEQ ID NO: 4680147 - DNA, 21 bp, Homo sapiens
ggagaaagaagtggagacagt

SEQ ID NO: 4680148 - DNA, 14 bp, Homo sapiens
gctgattcagcatt

SEQ ID NO: 4680149 - DNA, 15 bp, Homo sapiens
gctgattcagcattt

SEQ ID NO: 4680150 - DNA, 15 bp, Homo sapiens
gctgattcctctcat

SEQ ID NO: 4680151 - DNA, 12 bp, Homo sapiens
gctgcaaaaatt

SEQ ID NO: 4680152 - DNA, 13 bp, Homo sapiens
gctgcaatacatt

SEQ ID NO: 4680153 - DNA, 12 bp, Homo sapiens
gctgcactgtga

SEQ ID NO: 4680154 - DNA, 15 bp, Homo sapiens
gctgcactgtgaacc

SEQ ID NO: 4680155 - DNA, 12 bp, Homo sapiens
gctgcaggagtg

SEQ ID NO: 4680156 - DNA, 17 bp, Homo sapiens
gctgcagttttgctatc

SEQ ID NO: 4680157 - DNA, 20 bp, Homo sapiens
gctgccaagagtgaagggaa

SEQ ID NO: 4680158 - DNA, 20 bp, Homo sapiens
gctgccagcctgaggtgccc

SEQ ID NO: 4680159 - DNA, 22 bp, Homo sapiens
gctgcccagtgcaaaccacttc

SEQ ID NO: 4680160 - DNA, 19 bp, Homo sapiens
gctgcccatcatgtggccc

SEQ ID NO: 4680161 - DNA, 16 bp, Homo sapiens
gctgcccctctctggg

SEQ ID NO: 4680162 - DNA, 16 bp, Homo sapiens
gctgccctgagaagct

SEQ ID NO: 4680163 - DNA, 15 bp, Homo sapiens
gctgccctgcgccct

SEQ ID NO: 4680164 - DNA, 22 bp, Homo sapiens
gctgcctaggatgttctgggct

SEQ ID NO: 4680165 - DNA, 18 bp, Homo sapiens
gctgcctgggtaggcccc

SEQ ID NO: 4680166 - DNA, 23 bp, Homo sapiens
gctgcctgggtaggccccacaag

SEQ ID NO: 4680167 - DNA, 14 bp, Homo sapiens
gctgctccaggcct

SEQ ID NO: 4680168 - DNA, 19 bp, Homo sapiens
gctgctccaggcctgcagc

SEQ ID NO: 4680169 - DNA, 22 bp, Homo sapiens
gctgctccaggcctgcagcagg

SEQ ID NO: 4680170 - DNA, 23 bp, Homo sapiens
gctgctccaggcctgcagcagga

SEQ ID NO: 4680171 - DNA, 16 bp, Homo sapiens
gctgctccccagcagc

SEQ ID NO: 4680172 - DNA, 18 bp, Homo sapiens
gctgctcggggtgcacag

SEQ ID NO: 4680173 - DNA, 20 bp, Homo sapiens
gctgctcggggtgcacagga

SEQ ID NO: 4680174 - DNA, 21 bp, Homo sapiens
gctgctcggggtgcacaggag

SEQ ID NO: 4680175 - DNA, 16 bp, Homo sapiens
gctgctctaagcccag

SEQ ID NO: 4680176 - DNA, 19 bp, Homo sapiens
gctgctctaagcccaggat

SEQ ID NO: 4680177 - DNA, 13 bp, Homo sapiens
gctgctgagaacc

SEQ ID NO: 4680178 - DNA, 14 bp, Homo sapiens
gctgctgagaacct

SEQ ID NO: 4680179 - DNA, 19 bp, Homo sapiens
gctgctgagaacctggcct

SEQ ID NO: 4680180 - DNA, 18 bp, Homo sapiens
gctgctgcacaccaaggc

SEQ ID NO: 4680181 - DNA, 12 bp, Homo sapiens
gctgctgtgccc

SEQ ID NO: 4680182 - DNA, 15 bp, Homo sapiens
gctgctgtgccccac

SEQ ID NO: 4680183 - DNA, 19 bp, Homo sapiens
gctgctgtgccccaccacg

SEQ ID NO: 4680184 - DNA, 15 bp, Homo sapiens
gctggaaaagggtct

SEQ ID NO: 4680185 - DNA, 16 bp, Homo sapiens
gctggaaacttctgta

SEQ ID NO: 4680186 - DNA, 17 bp, Homo sapiens
gctggaaacttctgtaa

SEQ ID NO: 4680187 - DNA, 20 bp, Homo sapiens
gctggaaggggccacgtgga

SEQ ID NO: 4680188 - DNA, 20 bp, Homo sapiens
gctggactggaggcccctgg

SEQ ID NO: 4680189 - DNA, 13 bp, Homo sapiens
gctggagaaagag

SEQ ID NO: 4680190 - DNA, 16 bp, Homo sapiens
gctggagatcagcatg

SEQ ID NO: 4680191 - DNA, 20 bp, Homo sapiens
gctggccccgcccctgcccc

SEQ ID NO: 4680192 - DNA, 17 bp, Homo sapiens
gctggctcacagtacag

SEQ ID NO: 4680193 - DNA, 14 bp, Homo sapiens
gctggctccagatg

SEQ ID NO: 4680194 - DNA, 22 bp, Homo sapiens
gctggctccagatgcagggcag

SEQ ID NO: 4680195 - DNA, 23 bp, Homo sapiens
gctggctccagatgcagggcagt

SEQ ID NO: 4680196 - DNA, 15 bp, Homo sapiens
gctggctgagggcag

SEQ ID NO: 4680197 - DNA, 19 bp, Homo sapiens
gctgggacgtggctcagcc

SEQ ID NO: 4680198 - DNA, 22 bp, Homo sapiens
gctgggacgtggctcagccagc

SEQ ID NO: 4680199 - DNA, 20 bp, Homo sapiens
gctgggattacaggcgcctg

SEQ ID NO: 4680200 - DNA, 23 bp, Homo sapiens
gctgggattacaggcgcctgcca

SEQ ID NO: 4680201 - DNA, 19 bp, Homo sapiens
gctgggccaactccagtga

SEQ ID NO: 4680202 - DNA, 17 bp, Homo sapiens
gctgggccctctttccc

SEQ ID NO: 4680203 - DNA, 16 bp, Homo sapiens
gctgggctctgcctgt

SEQ ID NO: 4680204 - DNA, 15 bp, Homo sapiens
gctgggctgggccct

SEQ ID NO: 4680205 - DNA, 22 bp, Homo sapiens
gctggggaccggttcccacaag

SEQ ID NO: 4680206 - DNA, 13 bp, Homo sapiens
gctggggactcag

SEQ ID NO: 4680207 - DNA, 17 bp, Homo sapiens
gctggggaggaggagag

SEQ ID NO: 4680208 - DNA, 15 bp, Homo sapiens
gctggggatgcgcct

SEQ ID NO: 4680209 - DNA, 23 bp, Homo sapiens
gctggggccgccacggcctggct

SEQ ID NO: 4680210 - DNA, 22 bp, Homo sapiens
gctgggtgtttttttttaaaag

SEQ ID NO: 4680211 - DNA, 17 bp, Homo sapiens
gctggtacctgccctct

SEQ ID NO: 4680212 - DNA, 14 bp, Homo sapiens
gctggtcacctccc

SEQ ID NO: 4680213 - DNA, 15 bp, Homo sapiens
gctggtcacctccca

SEQ ID NO: 4680214 - DNA, 23 bp, Homo sapiens
gctggtcctgaccaggatggagc

SEQ ID NO: 4680215 - DNA, 22 bp, Homo sapiens
gctggtgggaaggccggcagcg

SEQ ID NO: 4680216 - DNA, 20 bp, Homo sapiens
gctggtttcaaactcctgac

SEQ ID NO: 4680217 - DNA, 14 bp, Homo sapiens
gctggtttttcagt

SEQ ID NO: 4680218 - DNA, 20 bp, Homo sapiens
gctgtaaatttggcttctgt

SEQ ID NO: 4680219 - DNA, 18 bp, Homo sapiens
gctgtaacgtggcactgg

SEQ ID NO: 4680220 - DNA, 22 bp, Homo sapiens
gctgtaatcatttgtttacatt

SEQ ID NO: 4680221 - DNA, 14 bp, Homo sapiens
gctgtatttgctgt

SEQ ID NO: 4680222 - DNA, 16 bp, Homo sapiens
gctgtccccactgccc

SEQ ID NO: 4680223 - DNA, 16 bp, Homo sapiens
gctgtccctgcagggc

SEQ ID NO: 4680224 - DNA, 20 bp, Homo sapiens
gctgtctgaagcccaaagcc

SEQ ID NO: 4680225 - DNA, 22 bp, Homo sapiens
gctgtctgaagcccaaagcctg

SEQ ID NO: 4680226 - DNA, 20 bp, Homo sapiens
gctgtcttttgttctctgaa

SEQ ID NO: 4680227 - DNA, 14 bp, Homo sapiens
gctgtgacctgctg

SEQ ID NO: 4680228 - DNA, 15 bp, Homo sapiens
gctgtgacctgctga

SEQ ID NO: 4680229 - DNA, 16 bp, Homo sapiens
gctgtgacctgctgag

SEQ ID NO: 4680230 - DNA, 21 bp, Homo sapiens
gctgtgcacaaagtggcataa

SEQ ID NO: 4680231 - DNA, 15 bp, Homo sapiens
gctgtgcctcgctcc

SEQ ID NO: 4680232 - DNA, 20 bp, Homo sapiens
gctgtgctacgtgtgaaatc

SEQ ID NO: 4680233 - DNA, 21 bp, Homo sapiens
gctgtgctacgtgtgaaatct

SEQ ID NO: 4680234 - DNA, 17 bp, Homo sapiens
gctgtgtttgcagcctg

SEQ ID NO: 4680235 - DNA, 22 bp, Homo sapiens
gctgttagggctgaatcttctg

SEQ ID NO: 4680236 - DNA, 18 bp, Homo sapiens
gcttcagtcatcagccag

SEQ ID NO: 4680237 - DNA, 20 bp, Homo sapiens
gcttcagtcatcagccagca

SEQ ID NO: 4680238 - DNA, 14 bp, Homo sapiens
gcttcatttcaatc

SEQ ID NO: 4680239 - DNA, 21 bp, Homo sapiens
gcttccaagaccatttgtagt

SEQ ID NO: 4680240 - DNA, 12 bp, Homo sapiens
gcttccacctca

SEQ ID NO: 4680241 - DNA, 15 bp, Homo sapiens
gcttccacctcaccc

SEQ ID NO: 4680242 - DNA, 14 bp, Homo sapiens
gcttccaggtggcc

SEQ ID NO: 4680243 - DNA, 22 bp, Homo sapiens
gcttccatcccaaccagtgcca

SEQ ID NO: 4680244 - DNA, 16 bp, Homo sapiens
gcttccgagacaccac

SEQ ID NO: 4680245 - DNA, 18 bp, Homo sapiens
gcttccgctttgaaagaa

SEQ ID NO: 4680246 - DNA, 14 bp, Homo sapiens
gcttcctagtaagt

SEQ ID NO: 4680247 - DNA, 16 bp, Homo sapiens
gcttcctggggaccaa

SEQ ID NO: 4680248 - DNA, 19 bp, Homo sapiens
gcttcctggggaccaagat

SEQ ID NO: 4680249 - DNA, 21 bp, Homo sapiens
gcttcggagatggagtccctt

SEQ ID NO: 4680250 - DNA, 15 bp, Homo sapiens
gcttctatcagactc

SEQ ID NO: 4680251 - DNA, 20 bp, Homo sapiens
gcttctatcagactcagttt

SEQ ID NO: 4680252 - DNA, 12 bp, Homo sapiens
gcttctcagttt

SEQ ID NO: 4680253 - DNA, 20 bp, Homo sapiens
gcttctcagtttctgcctgg

SEQ ID NO: 4680254 - DNA, 14 bp, Homo sapiens
gcttctctctcacc

SEQ ID NO: 4680255 - DNA, 16 bp, Homo sapiens
gcttctctctcaccag

SEQ ID NO: 4680256 - DNA, 16 bp, Homo sapiens
gcttctctcttttaaa

SEQ ID NO: 4680257 - DNA, 20 bp, Homo sapiens
gcttctttcccttagtgact

SEQ ID NO: 4680258 - DNA, 13 bp, Homo sapiens
gcttgaaggccag

SEQ ID NO: 4680259 - DNA, 11 bp, Homo sapiens
gcttgaatgct

SEQ ID NO: 4680260 - DNA, 16 bp, Homo sapiens
gcttgcctgcctgctc

SEQ ID NO: 4680261 - DNA, 22 bp, Homo sapiens
gcttgctgtatgacccctggcc

SEQ ID NO: 4680262 - DNA, 11 bp, Homo sapiens
gcttggaggag

SEQ ID NO: 4680263 - DNA, 23 bp, Homo sapiens
gcttgggctgacccagcatctcc

SEQ ID NO: 4680264 - DNA, 18 bp, Homo sapiens
gcttggtcctagggtggg

SEQ ID NO: 4680265 - DNA, 15 bp, Homo sapiens
gcttgtactgggaca

SEQ ID NO: 4680266 - DNA, 18 bp, Homo sapiens
gcttgtagaactcactct

SEQ ID NO: 4680267 - DNA, 19 bp, Homo sapiens
gcttgtagaactcactctg

SEQ ID NO: 4680268 - DNA, 22 bp, Homo sapiens
gcttgtagaactcactctgggc

SEQ ID NO: 4680269 - DNA, 23 bp, Homo sapiens
gcttgtagaactcactctgggct

SEQ ID NO: 4680270 - DNA, 17 bp, Homo sapiens
gcttgtagccagccggg

SEQ ID NO: 4680271 - DNA, 22 bp, Homo sapiens
gcttgtagccagccggggcgag

SEQ ID NO: 4680272 - DNA, 18 bp, Homo sapiens
gcttgtatgcaatggatt

SEQ ID NO: 4680273 - DNA, 15 bp, Homo sapiens
gctttaaaatatatc

SEQ ID NO: 4680274 - DNA, 22 bp, Homo sapiens
gctttacattttcagtaccaaa

SEQ ID NO: 4680275 - DNA, 15 bp, Homo sapiens
gctttataacaaatg

SEQ ID NO: 4680276 - DNA, 20 bp, Homo sapiens
gctttatcgaacgtggtctg

SEQ ID NO: 4680277 - DNA, 15 bp, Homo sapiens
gctttatgcaaatac

SEQ ID NO: 4680278 - DNA, 17 bp, Homo sapiens
gctttatgcaaatacaa

SEQ ID NO: 4680279 - DNA, 18 bp, Homo sapiens
gctttatgcaaatacaat

SEQ ID NO: 4680280 - DNA, 19 bp, Homo sapiens
gctttatttatagaaatga

SEQ ID NO: 4680281 - DNA, 21 bp, Homo sapiens
gctttcaattccgtagccagc

SEQ ID NO: 4680282 - DNA, 16 bp, Homo sapiens
gctttcccttatcaaa

SEQ ID NO: 4680283 - DNA, 12 bp, Homo sapiens
gctttcctgggc

SEQ ID NO: 4680284 - DNA, 17 bp, Homo sapiens
gctttcctgtttccagg

SEQ ID NO: 4680285 - DNA, 17 bp, Homo sapiens
gctttcggagctcctgt

SEQ ID NO: 4680286 - DNA, 16 bp, Homo sapiens
gctttctgggctctgg

SEQ ID NO: 4680287 - DNA, 17 bp, Homo sapiens
gctttctgggctctgga

SEQ ID NO: 4680288 - DNA, 19 bp, Homo sapiens
gctttctttagaattttta

SEQ ID NO: 4680289 - DNA, 12 bp, Homo sapiens
gctttgcaaaga

SEQ ID NO: 4680290 - DNA, 14 bp, Homo sapiens
gctttgcaaagacc

SEQ ID NO: 4680291 - DNA, 15 bp, Homo sapiens
gctttgctccttcag

SEQ ID NO: 4680292 - DNA, 18 bp, Homo sapiens
gctttgctccttcagttc

SEQ ID NO: 4680293 - DNA, 20 bp, Homo sapiens
gctttgctccttcagttctg

SEQ ID NO: 4680294 - DNA, 20 bp, Homo sapiens
gctttgggaagactgaggca

SEQ ID NO: 4680295 - DNA, 20 bp, Homo sapiens
gctttggtaaaacagtttca

SEQ ID NO: 4680296 - DNA, 15 bp, Homo sapiens
gctttgtaggtgtct

SEQ ID NO: 4680297 - DNA, 16 bp, Homo sapiens
gctttgtaggtgtctc

SEQ ID NO: 4680298 - DNA, 13 bp, Homo sapiens
gctttgtatgttt

SEQ ID NO: 4680299 - DNA, 16 bp, Homo sapiens
gctttgtgcctttggg

SEQ ID NO: 4680300 - DNA, 19 bp, Homo sapiens
gcttttatttggtgtgttc

SEQ ID NO: 4680301 - DNA, 13 bp, Homo sapiens
gcttttcttgata

SEQ ID NO: 4680302 - DNA, 13 bp, Homo sapiens
gcttttgaaatct

SEQ ID NO: 4680303 - DNA, 23 bp, Homo sapiens
gctttttaaaaaaatctccccag

SEQ ID NO: 4680304 - DNA, 14 bp, Homo sapiens
gctttttattattt

SEQ ID NO: 4680305 - DNA, 14 bp, Homo sapiens
gctttttcatcctt

SEQ ID NO: 4680306 - DNA, 21 bp, Homo sapiens
ggaaaaaaaaaaaaagaaatt

SEQ ID NO: 4680307 - DNA, 21 bp, Homo sapiens
ggaaaaagcaggactgtgcct

SEQ ID NO: 4680308 - DNA, 13 bp, Homo sapiens
ggaaaactgtgtt

SEQ ID NO: 4680309 - DNA, 22 bp, Homo sapiens
ggaaaagcaagaaacagtttct

SEQ ID NO: 4680310 - DNA, 12 bp, Homo sapiens
ggaaaaggcctg

SEQ ID NO: 4680311 - DNA, 14 bp, Homo sapiens
ggaaaaggcctggg

SEQ ID NO: 4680312 - DNA, 16 bp, Homo sapiens
ggaaaaggcctggggt

SEQ ID NO: 4680313 - DNA, 22 bp, Homo sapiens
ggaaaaggcctggggtgacccg

SEQ ID NO: 4680314 - DNA, 12 bp, Homo sapiens
ggaaaagggaag

SEQ ID NO: 4680315 - DNA, 21 bp, Homo sapiens
ggaaaagggtcttgggaaata

SEQ ID NO: 4680316 - DNA, 17 bp, Homo sapiens
ggaaaatgtattgattc

SEQ ID NO: 4680317 - DNA, 19 bp, Homo sapiens
ggaaaatgtattgattcaa

SEQ ID NO: 4680318 - DNA, 15 bp, Homo sapiens
ggaaacttctgtaag

SEQ ID NO: 4680319 - DNA, 19 bp, Homo sapiens
ggaaagaagggggccctgc

SEQ ID NO: 4680320 - DNA, 21 bp, Homo sapiens
ggaaagaagggggccctgcta

SEQ ID NO: 4680321 - DNA, 14 bp, Homo sapiens
ctgagggcagtgcc

SEQ ID NO: 4680322 - DNA, 15 bp, Homo sapiens
ctgagggcagtgccc

SEQ ID NO: 4680323 - DNA, 22 bp, Homo sapiens
ctgagggcagttcgcagccacc

SEQ ID NO: 4680324 - DNA, 17 bp, Homo sapiens
ctgaggtcagggagtgc

SEQ ID NO: 4680325 - DNA, 20 bp, Homo sapiens
ctgaggtcctgagcactgcc

SEQ ID NO: 4680326 - DNA, 24 bp, Homo sapiens
ctgaggtcctgagcactgccagga

SEQ ID NO: 4680327 - DNA, 22 bp, Homo sapiens
ctgaggtgcccactccgccagc

SEQ ID NO: 4680328 - DNA, 15 bp, Homo sapiens
ctgaggtgcccagga

SEQ ID NO: 4680329 - DNA, 17 bp, Homo sapiens
ctgaggtgcccaggaga

SEQ ID NO: 4680330 - DNA, 19 bp, Homo sapiens
ctgaggtgcccaggagaag

SEQ ID NO: 4680331 - DNA, 16 bp, Homo sapiens
ctgagtagctgggatt

SEQ ID NO: 4680332 - DNA, 13 bp, Homo sapiens
ctgagtctatgtt

SEQ ID NO: 4680333 - DNA, 14 bp, Homo sapiens
ctgagtctatgttc

SEQ ID NO: 4680334 - DNA, 19 bp, Homo sapiens
ctgagtctatgttcaaaga

SEQ ID NO: 4680335 - DNA, 20 bp, Homo sapiens
ctgagtctatgttcaaagac

SEQ ID NO: 4680336 - DNA, 17 bp, Homo sapiens
ctgagtgacctccttct

SEQ ID NO: 4680337 - DNA, 21 bp, Homo sapiens
ctgagtgacctccttctgcaa

SEQ ID NO: 4680338 - DNA, 16 bp, Homo sapiens
ctgagtggcttcactc

SEQ ID NO: 4680339 - DNA, 22 bp, Homo sapiens
ctgagtggcttcactcctgctg

SEQ ID NO: 4680340 - DNA, 23 bp, Homo sapiens
ctgagttttagttggtctttcca

SEQ ID NO: 4680341 - DNA, 22 bp, Homo sapiens
ctgatagctgtttcaaatgtgc

SEQ ID NO: 4680342 - DNA, 20 bp, Homo sapiens
ctgatcgccaacctttcccc

SEQ ID NO: 4680343 - DNA, 18 bp, Homo sapiens
ctgatcttttaaaatcat

SEQ ID NO: 4680344 - DNA, 21 bp, Homo sapiens
ctgatgcaggtcagcccatgg

SEQ ID NO: 4680345 - DNA, 17 bp, Homo sapiens
ctgatgcatcagaaagg

SEQ ID NO: 4680346 - DNA, 18 bp, Homo sapiens
ctgatgcatcagaaaggg

SEQ ID NO: 4680347 - DNA, 22 bp, Homo sapiens
ctgatgtgacattccatgacga

SEQ ID NO: 4680348 - DNA, 12 bp, Homo sapiens
ctgatgttgtgt

SEQ ID NO: 4680349 - DNA, 18 bp, Homo sapiens
ctgattaaatatttgaag

SEQ ID NO: 4680350 - DNA, 17 bp, Homo sapiens
ctgattatacaccattt

SEQ ID NO: 4680351 - DNA, 13 bp, Homo sapiens
ctgattattttag

SEQ ID NO: 4680352 - DNA, 15 bp, Homo sapiens
ctgattattttagct

SEQ ID NO: 4680353 - DNA, 18 bp, Homo sapiens
ctgattattttagctaaa

SEQ ID NO: 4680354 - DNA, 15 bp, Homo sapiens
ctgattcaactaaaa

SEQ ID NO: 4680355 - DNA, 13 bp, Homo sapiens
ctgattcctctca

SEQ ID NO: 4680356 - DNA, 16 bp, Homo sapiens
ctgattcctctcattt

SEQ ID NO: 4680357 - DNA, 19 bp, Homo sapiens
ctgattcctctcatttcca

SEQ ID NO: 4680358 - DNA, 17 bp, Homo sapiens
ctgattgtttcattgcg

SEQ ID NO: 4680359 - DNA, 17 bp, Homo sapiens
atgttatattaaagaaa

SEQ ID NO: 4680360 - DNA, 16 bp, Homo sapiens
attaaagaaaaacttt

SEQ ID NO: 4680361 - DNA, 14 bp, Homo sapiens
attaagagatgaag

SEQ ID NO: 4680362 - DNA, 20 bp, Homo sapiens
attacagagatataaatgaa

SEQ ID NO: 4680363 - DNA, 21 bp, Homo sapiens
attacagagatataaatgaag

SEQ ID NO: 4680364 - DNA, 22 bp, Homo sapiens
attacagagatataaatgaagt

SEQ ID NO: 4680365 - DNA, 16 bp, Homo sapiens
attactaataactttt

SEQ ID NO: 4680366 - DNA, 15 bp, Homo sapiens
attagaatagaactt

SEQ ID NO: 4680367 - DNA, 14 bp, Homo sapiens
attattatatattt

SEQ ID NO: 4680368 - DNA, 21 bp, Homo sapiens
attctctaataaaattcagaa

SEQ ID NO: 4680369 - DNA, 21 bp, Homo sapiens
attgatgataatacccacatt

SEQ ID NO: 4680370 - DNA, 13 bp, Homo sapiens
atttaatgacttt

SEQ ID NO: 4680371 - DNA, 17 bp, Homo sapiens
atttaatgacttttgaa

SEQ ID NO: 4680372 - DNA, 16 bp, Homo sapiens
atttcaagatgttata

SEQ ID NO: 4680373 - DNA, 17 bp, Homo sapiens
atttcaagatgttatat

SEQ ID NO: 4680374 - DNA, 14 bp, Homo sapiens
actaataaaatgtg

SEQ ID NO: 4680375 - DNA, 15 bp, Homo sapiens
actaataaaatgtga

SEQ ID NO: 4680376 - DNA, 23 bp, Homo sapiens
actcacaattgttgactaaaatg

SEQ ID NO: 4680377 - DNA, 18 bp, Homo sapiens
actccaggatcctcctgg

SEQ ID NO: 4680378 - DNA, 13 bp, Homo sapiens
actcctcccttcc

SEQ ID NO: 4680379 - DNA, 19 bp, Homo sapiens
actgagccgtgcagctggg

SEQ ID NO: 4680380 - DNA, 19 bp, Homo sapiens
actggggatcccgtgctgg

SEQ ID NO: 4680381 - DNA, 22 bp, Homo sapiens
actggggatcccgtgctggaag

SEQ ID NO: 4680382 - DNA, 15 bp, Homo sapiens
acttaataaatattg

SEQ ID NO: 4680383 - DNA, 16 bp, Homo sapiens
acttactaataaaatg

SEQ ID NO: 4680384 - DNA, 21 bp, Homo sapiens
acttactaataaaatgtgaag

SEQ ID NO: 4680385 - DNA, 21 bp, Homo sapiens
acttagatctgagccctccct

SEQ ID NO: 4680386 - DNA, 18 bp, Homo sapiens
tctatagcagtcatcatt

SEQ ID NO: 4680387 - DNA, 18 bp, Homo sapiens
tctatgtaatgtaaacca

SEQ ID NO: 4680388 - DNA, 20 bp, Homo sapiens
tctcttacttgatagactta

SEQ ID NO: 4680389 - DNA, 21 bp, Homo sapiens
tctgagccctccctcttccca

SEQ ID NO: 4680390 - DNA, 13 bp, Homo sapiens
tctgtcctctgtc

SEQ ID NO: 4680391 - DNA, 15 bp, Homo sapiens
tcttctctgggccca

SEQ ID NO: 4680392 - DNA, 22 bp, Homo sapiens
tcttctgtaaaatgggtatatt

SEQ ID NO: 4680393 - DNA, 14 bp, Homo sapiens
tgaattctgttgta

SEQ ID NO: 4680394 - DNA, 16 bp, Homo sapiens
tgaattctgttgtaat

SEQ ID NO: 4680395 - DNA, 13 bp, Homo sapiens
tgaattttttcct

SEQ ID NO: 4680396 - DNA, 13 bp, Homo sapiens
tgactaaaatgct

SEQ ID NO: 4680397 - DNA, 14 bp, Homo sapiens
tgactaagtcaagt

SEQ ID NO: 4680398 - DNA, 14 bp, Homo sapiens
tgagaccctcttct

SEQ ID NO: 4680399 - DNA, 23 bp, Homo sapiens
tgagccctccctcttcccagcac

SEQ ID NO: 4680400 - DNA, 18 bp, Homo sapiens
tgagccgtgcagctggga

SEQ ID NO: 4680401 - DNA, 20 bp, Homo sapiens
tgagctagttaaggcaaatc

SEQ ID NO: 4680402 - DNA, 21 bp, Homo sapiens
tgagctagttaaggcaaatca

SEQ ID NO: 4680403 - DNA, 14 bp, Homo sapiens
tgagtacattgaag

SEQ ID NO: 4680404 - DNA, 22 bp, Homo sapiens
tgagtctatattatctagcttt

SEQ ID NO: 4680405 - DNA, 12 bp, Homo sapiens
tgagtgcaaatc

SEQ ID NO: 4680406 - DNA, 22 bp, Homo sapiens
tgagtgcaaatccatagcacaa

SEQ ID NO: 4680407 - DNA, 14 bp, Homo sapiens
tgataatacccaca

SEQ ID NO: 4680408 - DNA, 19 bp, Homo sapiens
tgatacagagtatatttcc

SEQ ID NO: 4680409 - DNA, 12 bp, Homo sapiens
gctaagcacaga

SEQ ID NO: 4680410 - DNA, 13 bp, Homo sapiens
gctcccagcccct

SEQ ID NO: 4680411 - DNA, 22 bp, Homo sapiens
gctgaggccccagggctgtggg

SEQ ID NO: 4680412 - DNA, 18 bp, Homo sapiens
gctggaagacttagatct

SEQ ID NO: 4680413 - DNA, 21 bp, Homo sapiens
gctgggatttgaactgagccg

SEQ ID NO: 4680414 - DNA, 23 bp, Homo sapiens
ggaacaaaatgataaagaacaga

SEQ ID NO: 4680415 - DNA, 20 bp, Homo sapiens
ggactccaggatcctcctgg

SEQ ID NO: 4680416 - DNA, 17 bp, Homo sapiens
ggatcccgtgctggaag

SEQ ID NO: 4680417 - DNA, 15 bp, Homo sapiens
ggcaaggatgatcca

SEQ ID NO: 4680418 - DNA, 18 bp, Homo sapiens
ggcgtcctggtgaggaca

SEQ ID NO: 4680419 - DNA, 23 bp, Homo sapiens
ggcgtcctggtgaggacaaggta

SEQ ID NO: 4680420 - DNA, 15 bp, Homo sapiens
ggcttctgcgccgcc

SEQ ID NO: 4680421 - DNA, 20 bp, Homo sapiens
ggctttgtaaactccacagg

SEQ ID NO: 4680422 - DNA, 19 bp, Homo sapiens
gggcacctcatggactcca

SEQ ID NO: 4680423 - DNA, 17 bp, Homo sapiens
gggctgtgggtggggaa

SEQ ID NO: 4680424 - DNA, 20 bp, Homo sapiens
ggggatcccgtgctggaaga

SEQ ID NO: 4680425 - DNA, 17 bp, Homo sapiens
ggtgagcgggtggggtg

SEQ ID NO: 4680426 - DNA, 13 bp, Homo sapiens
ggtgcttgctgtg

SEQ ID NO: 4680427 - DNA, 16 bp, Homo sapiens
ggtggggtgcttgctg

SEQ ID NO: 4680428 - DNA, 23 bp, Homo sapiens
gtaaaccagaaaaaataaatgtt

SEQ ID NO: 4680429 - DNA, 17 bp, Homo sapiens
tgccaagtcctcctaga

SEQ ID NO: 4680430 - DNA, 13 bp, Homo sapiens
tgccacactttca

SEQ ID NO: 4680431 - DNA, 22 bp, Homo sapiens
tgccacactttcactggggatc

SEQ ID NO: 4680432 - DNA, 17 bp, Homo sapiens
tgctgcttttaaaacat

SEQ ID NO: 4680433 - DNA, 18 bp, Homo sapiens
tgcttgctgtgtgacctt

SEQ ID NO: 4680434 - DNA, 22 bp, Homo sapiens
tggaagacttagatctgagccc

SEQ ID NO: 4680435 - DNA, 18 bp, Homo sapiens
tggacgtcagcctgtgga

SEQ ID NO: 4680436 - DNA, 19 bp, Homo sapiens
tggacgtcagcctgtggat

SEQ ID NO: 4680437 - DNA, 21 bp, Homo sapiens
tggactccaggatcctcctgg

SEQ ID NO: 4680438 - DNA, 18 bp, Homo sapiens
tggagcagcagctgaggc

SEQ ID NO: 4680439 - DNA, 12 bp, Homo sapiens
tgggatttgaac

SEQ ID NO: 4680440 - DNA, 16 bp, Homo sapiens
tgggcaagtcccttga

SEQ ID NO: 4680441 - DNA, 19 bp, Homo sapiens
tgggcaagtcccttgacct

SEQ ID NO: 4680442 - DNA, 24 bp, Homo sapiens
tgggcccagagagaggcgtcctgg

SEQ ID NO: 4680443 - DNA, 18 bp, Homo sapiens
tgggtgagcgggtggggt

SEQ ID NO: 4680444 - DNA, 23 bp, Homo sapiens
tgtaaaccagaaaaaataaatgt

SEQ ID NO: 4680445 - DNA, 15 bp, Homo sapiens
tgtaacctgtttgtc

SEQ ID NO: 4680446 - DNA, 16 bp, Homo sapiens
tgtctagttttctaga

SEQ ID NO: 4680447 - DNA, 17 bp, Homo sapiens
tgtgactcctcccttcc

SEQ ID NO: 4680448 - DNA, 14 bp, Homo sapiens
tgtgatacagagta

SEQ ID NO: 4680449 - DNA, 18 bp, Homo sapiens
tgtgatacagagtatatt

SEQ ID NO: 4680450 - DNA, 14 bp, Homo sapiens
tgtgttaaagtact

SEQ ID NO: 4680451 - DNA, 17 bp, Homo sapiens
tgttaaagtacttgaaa

SEQ ID NO: 4680452 - DNA, 13 bp, Homo sapiens
tgttataattaga

SEQ ID NO: 4680453 - DNA, 22 bp, Homo sapiens
tgttataattagagttgtgata

SEQ ID NO: 4680454 - DNA, 14 bp, Homo sapiens
tgttatattaaaga

SEQ ID NO: 4680455 - DNA, 17 bp, Homo sapiens
tgttgagtacattgaag

SEQ ID NO: 4680456 - DNA, 22 bp, Homo sapiens
tgtttatggtagtagtttttct

SEQ ID NO: 4680457 - DNA, 14 bp, Homo sapiens
ttaaccagaaagtc

SEQ ID NO: 4680458 - DNA, 18 bp, Homo sapiens
ttaataaatattgtattt

SEQ ID NO: 4680459 - DNA, 15 bp, Homo sapiens
ttaatgacttttgaa

SEQ ID NO: 4680460 - DNA, 22 bp, Homo sapiens
ttaatgacttttgaattacaga

SEQ ID NO: 4680461 - DNA, 20 bp, Homo sapiens
ttacttgatagacttactaa

SEQ ID NO: 4680462 - DNA, 18 bp, Homo sapiens
ttagagttgtgatacaga

SEQ ID NO: 4680463 - DNA, 16 bp, Homo sapiens
ttatattaaagaaaaa

SEQ ID NO: 4680464 - DNA, 14 bp, Homo sapiens
gtgcttgctgtgtg

SEQ ID NO: 4680465 - DNA, 16 bp, Homo sapiens
gttaaagtacttgaaa

SEQ ID NO: 4680466 - DNA, 13 bp, Homo sapiens
gttgactaaaatg

SEQ ID NO: 4680467 - DNA, 19 bp, Homo sapiens
gttgcacagtccctcctgt

SEQ ID NO: 4680468 - DNA, 17 bp, Homo sapiens
gttgtgatacagagtat

SEQ ID NO: 4680469 - DNA, 13 bp, Homo sapiens
taaaaaagttgtg

SEQ ID NO: 4680470 - DNA, 14 bp, Homo sapiens
taaaaagtaactga

SEQ ID NO: 4680471 - DNA, 21 bp, Homo sapiens
taaaaattgttataattagag

SEQ ID NO: 4680472 - DNA, 18 bp, Homo sapiens
taaaatagtcatgattct

SEQ ID NO: 4680473 - DNA, 16 bp, Homo sapiens
taaacagatgtcttct

SEQ ID NO: 4680474 - DNA, 17 bp, Homo sapiens
taaagaaaaactttaaa

SEQ ID NO: 4680475 - DNA, 17 bp, Homo sapiens
taaatattgtattttag

SEQ ID NO: 4680476 - DNA, 19 bp, Homo sapiens
taaatattgtattttagat

SEQ ID NO: 4680477 - DNA, 20 bp, Homo sapiens
taaatgttcatgatttcaag

SEQ ID NO: 4680478 - DNA, 17 bp, Homo sapiens
taacttgctcttgcttg

SEQ ID NO: 4680479 - DNA, 13 bp, Homo sapiens
taataaaatgtga

SEQ ID NO: 4680480 - DNA, 15 bp, Homo sapiens
taataaaattcagaa

SEQ ID NO: 4680481 - DNA, 21 bp, Homo sapiens
taataaagtaattgacaaatg

SEQ ID NO: 4680482 - DNA, 21 bp, Homo sapiens
taatagagaatgattgtcttc

SEQ ID NO: 4680483 - DNA, 21 bp, Homo sapiens
taatgacttttgaattacaga

SEQ ID NO: 4680484 - DNA, 21 bp, Homo sapiens
taattagagttgtgatacaga

SEQ ID NO: 4680485 - DNA, 13 bp, Homo sapiens
tacaacagtaaat

SEQ ID NO: 4680486 - DNA, 22 bp, Homo sapiens
tacaggatggttactgaggacc

SEQ ID NO: 4680487 - DNA, 17 bp, Homo sapiens
tacattgtaacctgttt

SEQ ID NO: 4680488 - DNA, 18 bp, Homo sapiens
taccttgagaccctcttc

SEQ ID NO: 4680489 - DNA, 20 bp, Homo sapiens
taccttgagaccctcttctc

SEQ ID NO: 4680490 - DNA, 23 bp, Homo sapiens
taccttgagaccctcttctctgg

SEQ ID NO: 4680491 - DNA, 17 bp, Homo sapiens
tacctttcaaagaactc

SEQ ID NO: 4680492 - DNA, 19 bp, Homo sapiens
tactgtaaagaaaatgaat

SEQ ID NO: 4680493 - DNA, 21 bp, Homo sapiens
tacttaaaaataaagtaactt

SEQ ID NO: 4680494 - DNA, 21 bp, Homo sapiens
tagaacttgaacctgaagaca

SEQ ID NO: 4680495 - DNA, 14 bp, Homo sapiens
tagctaagcacaga

SEQ ID NO: 4680496 - DNA, 19 bp, Homo sapiens
tagctgggatttgaactga

SEQ ID NO: 4680497 - DNA, 12 bp, Homo sapiens
aaaaaagttgtg

SEQ ID NO: 4680498 - DNA, 13 bp, Homo sapiens
aaaaactttaaaa

SEQ ID NO: 4680499 - DNA, 16 bp, Homo sapiens
aaaaatgtcattactt

SEQ ID NO: 4680500 - DNA, 23 bp, Homo sapiens
aaaaattattatatatttatagc

SEQ ID NO: 4680501 - DNA, 17 bp, Homo sapiens
aaaaattttattatcct

SEQ ID NO: 4680502 - DNA, 13 bp, Homo sapiens
aaaagcaagaatt

SEQ ID NO: 4680503 - DNA, 20 bp, Homo sapiens
aaaagctctagataaaactt

SEQ ID NO: 4680504 - DNA, 18 bp, Homo sapiens
aaaatagtcatgattcta

SEQ ID NO: 4680505 - DNA, 18 bp, Homo sapiens
aaaattgttataattaga

SEQ ID NO: 4680506 - DNA, 22 bp, Homo sapiens
aaaattgttataattagagttg

SEQ ID NO: 4680507 - DNA, 15 bp, Homo sapiens
aaaccacatatgaaa

SEQ ID NO: 4680508 - DNA, 16 bp, Homo sapiens
aaaccattgccatcat

SEQ ID NO: 4680509 - DNA, 15 bp, Homo sapiens
aaacccaaaccacat

SEQ ID NO: 4680510 - DNA, 12 bp, Homo sapiens
aaactccacagg

SEQ ID NO: 4680511 - DNA, 17 bp, Homo sapiens
aaactgtgtattatttg

SEQ ID NO: 4680512 - DNA, 19 bp, Homo sapiens
aaactgtgtattatttgga

SEQ ID NO: 4680513 - DNA, 16 bp, Homo sapiens
aaagaaaaactttaaa

SEQ ID NO: 4680514 - DNA, 12 bp, Homo sapiens
aaagcaagaatt

SEQ ID NO: 4680515 - DNA, 18 bp, Homo sapiens
aaagctctagataaaact

SEQ ID NO: 4680516 - DNA, 19 bp, Homo sapiens
aaagctctagataaaactt

SEQ ID NO: 4680517 - DNA, 13 bp, Homo sapiens
aaataaatgttca

SEQ ID NO: 4680518 - DNA, 14 bp, Homo sapiens
aaatagtcatgatt

SEQ ID NO: 4680519 - DNA, 17 bp, Homo sapiens
aaatagtcatgattcta

SEQ ID NO: 4680520 - DNA, 15 bp, Homo sapiens
aaatatgaattctgt

SEQ ID NO: 4680521 - DNA, 20 bp, Homo sapiens
aaatatgaattctgttgtaa

SEQ ID NO: 4680522 - DNA, 15 bp, Homo sapiens
aaatattgtatttta

SEQ ID NO: 4680523 - DNA, 22 bp, Homo sapiens
aaatattgtattttagatatat

SEQ ID NO: 4680524 - DNA, 17 bp, Homo sapiens
aaattgagctagttaag

SEQ ID NO: 4680525 - DNA, 13 bp, Homo sapiens
aacaaaatgaaat

SEQ ID NO: 4680526 - DNA, 13 bp, Homo sapiens
aaccagaaaaaat

SEQ ID NO: 4680527 - DNA, 17 bp, Homo sapiens
aaccagaaaaaataaat

SEQ ID NO: 4680528 - DNA, 22 bp, Homo sapiens
ccaaactaacaagcaaaacctg

SEQ ID NO: 4680529 - DNA, 14 bp, Homo sapiens
ccacaaagggtagc

SEQ ID NO: 4680530 - DNA, 18 bp, Homo sapiens
ccacatccccaccttcca

SEQ ID NO: 4680531 - DNA, 19 bp, Homo sapiens
ccactctgctcccagcccc

SEQ ID NO: 4680532 - DNA, 16 bp, Homo sapiens
ccactttcccttcccc

SEQ ID NO: 4680533 - DNA, 20 bp, Homo sapiens
ccactttcccttcccctgtg

SEQ ID NO: 4680534 - DNA, 16 bp, Homo sapiens
ccagaaaaaataaatg

SEQ ID NO: 4680535 - DNA, 14 bp, Homo sapiens
ccaggatcctcctg

SEQ ID NO: 4680536 - DNA, 15 bp, Homo sapiens
ccaggatcctcctgg

SEQ ID NO: 4680537 - DNA, 16 bp, Homo sapiens
ccaggccctagaccct

SEQ ID NO: 4680538 - DNA, 19 bp, Homo sapiens
ccaggccctagaccctccc

SEQ ID NO: 4680539 - DNA, 13 bp, Homo sapiens
ccaggccttctga

SEQ ID NO: 4680540 - DNA, 21 bp, Homo sapiens
ccagggaagtttttaaaaatg

SEQ ID NO: 4680541 - DNA, 14 bp, Homo sapiens
ccagggctgtgggt

SEQ ID NO: 4680542 - DNA, 20 bp, Homo sapiens
ccatagcacaagataaattg

SEQ ID NO: 4680543 - DNA, 23 bp, Homo sapiens
ccatccctttccctcgctcgatt

SEQ ID NO: 4680544 - DNA, 18 bp, Homo sapiens
cccaccattccacatccc

SEQ ID NO: 4680545 - DNA, 13 bp, Homo sapiens
cccactctgctcc

SEQ ID NO: 4680546 - DNA, 21 bp, Homo sapiens
cccagcacaggcaggggtaga

SEQ ID NO: 4680547 - DNA, 23 bp, Homo sapiens
cccaggccctagaccctccccca

SEQ ID NO: 4680548 - DNA, 17 bp, Homo sapiens
cccagggctgtgggtgg

SEQ ID NO: 4680549 - DNA, 17 bp, Homo sapiens
ccccactctgctcccag

SEQ ID NO: 4680550 - DNA, 14 bp, Homo sapiens
ccccagggctgtgg

SEQ ID NO: 4680551 - DNA, 20 bp, Homo sapiens
ccccagggctgtgggtgggg

SEQ ID NO: 4680552 - DNA, 17 bp, Homo sapiens
cccctgtgactcctccc

SEQ ID NO: 4680553 - DNA, 20 bp, Homo sapiens
ccctagaccctcccccacca

SEQ ID NO: 4680554 - DNA, 13 bp, Homo sapiens
ccctccctcttcc

SEQ ID NO: 4680555 - DNA, 14 bp, Homo sapiens
ccctccctcttccc

SEQ ID NO: 4680556 - DNA, 21 bp, Homo sapiens
ccctcttctctgggcccagag

SEQ ID NO: 4680557 - DNA, 17 bp, Homo sapiens
cccttccccactctgct

SEQ ID NO: 4680558 - DNA, 18 bp, Homo sapiens
ccctttagctaagcacag

SEQ ID NO: 4680559 - DNA, 14 bp, Homo sapiens
cctatatttcctct

SEQ ID NO: 4680560 - DNA, 22 bp, Homo sapiens
cctcccccaccattccacatcc

SEQ ID NO: 4680561 - DNA, 20 bp, Homo sapiens
cctcctggagcagcagctga

SEQ ID NO: 4680562 - DNA, 22 bp, Homo sapiens
cctcctggagcagcagctgagg

SEQ ID NO: 4680563 - DNA, 21 bp, Homo sapiens
cctcttctctgggcccagaga

SEQ ID NO: 4680564 - DNA, 14 bp, Homo sapiens
cctggagcagcagc

SEQ ID NO: 4680565 - DNA, 19 bp, Homo sapiens
cctggagcagcagctgagg

SEQ ID NO: 4680566 - DNA, 14 bp, Homo sapiens
cctggcttttctgg

SEQ ID NO: 4680567 - DNA, 19 bp, Homo sapiens
cctggcttttctggctggg

SEQ ID NO: 4680568 - DNA, 22 bp, Homo sapiens
cctgtgactcctcccttcccca

SEQ ID NO: 4680569 - DNA, 14 bp, Homo sapiens
ccttgacctttcca

SEQ ID NO: 4680570 - DNA, 13 bp, Homo sapiens
cctttaatgaact

SEQ ID NO: 4680571 - DNA, 19 bp, Homo sapiens
cgggtggggtgcttgctgt

SEQ ID NO: 4680572 - DNA, 20 bp, Homo sapiens
cgtccactttcccttcccct

SEQ ID NO: 4680573 - DNA, 22 bp, Homo sapiens
cgtccactttcccttcccctgt

SEQ ID NO: 4680574 - DNA, 13 bp, Homo sapiens
ctaactataacca

SEQ ID NO: 4680575 - DNA, 19 bp, Homo sapiens
ctaagcatccatttttccc

SEQ ID NO: 4680576 - DNA, 12 bp, Homo sapiens
ctaataaaatgt

SEQ ID NO: 4680577 - DNA, 15 bp, Homo sapiens
ctaataaaattcaga

SEQ ID NO: 4680578 - DNA, 12 bp, Homo sapiens
ctaataactttt

SEQ ID NO: 4680579 - DNA, 13 bp, Homo sapiens
ctacaatgtgaaa

SEQ ID NO: 4680580 - DNA, 18 bp, Homo sapiens
ctagaccctcccccacca

SEQ ID NO: 4680581 - DNA, 15 bp, Homo sapiens
ctatagcagtcatca

SEQ ID NO: 4680582 - DNA, 17 bp, Homo sapiens
ctcacttatagagctct

SEQ ID NO: 4680583 - DNA, 14 bp, Homo sapiens
ctcatggactccag

SEQ ID NO: 4680584 - DNA, 17 bp, Homo sapiens
ctccaggatcctcctgg

SEQ ID NO: 4680585 - DNA, 18 bp, Homo sapiens
ctccaggatcctcctgga

SEQ ID NO: 4680586 - DNA, 21 bp, Homo sapiens
ctccaggatcctcctggagca

SEQ ID NO: 4680587 - DNA, 12 bp, Homo sapiens
ctccctcttccc

SEQ ID NO: 4680588 - DNA, 13 bp, Homo sapiens
ctcctagaactcc

SEQ ID NO: 4680589 - DNA, 14 bp, Homo sapiens
ctcctcccttcccc

SEQ ID NO: 4680590 - DNA, 14 bp, Homo sapiens
ctcctgttgccaca

SEQ ID NO: 4680591 - DNA, 13 bp, Homo sapiens
ctctaataaaatt

SEQ ID NO: 4680592 - DNA, 14 bp, Homo sapiens
ctctaataaaattc

SEQ ID NO: 4680593 - DNA, 23 bp, Homo sapiens
ctctatacctttcaaagaactcc

SEQ ID NO: 4680594 - DNA, 12 bp, Homo sapiens
ctctgctcccag

SEQ ID NO: 4680595 - DNA, 13 bp, Homo sapiens
ctctgtcctctgt

SEQ ID NO: 4680596 - DNA, 14 bp, Homo sapiens
ctcttcccagcaca

SEQ ID NO: 4680597 - DNA, 15 bp, Homo sapiens
ctcttctctgggccc

SEQ ID NO: 4680598 - DNA, 20 bp, Homo sapiens
ctcttctctgggcccagaga

SEQ ID NO: 4680599 - DNA, 17 bp, Homo sapiens
ctgacatttgttgttaa

SEQ ID NO: 4680600 - DNA, 20 bp, Homo sapiens
ctgagccctccctcttccca

SEQ ID NO: 4680601 - DNA, 13 bp, Homo sapiens
ctgaggccccagg

SEQ ID NO: 4680602 - DNA, 22 bp, Homo sapiens
ctgaggccccagggctgtgggt

SEQ ID NO: 4680603 - DNA, 20 bp, Homo sapiens
ctgatttcaaggtccgagct

SEQ ID NO: 4680604 - DNA, 23 bp, Homo sapiens
ctggaagacttagatctgagccc

SEQ ID NO: 4680605 - DNA, 13 bp, Homo sapiens
ctggctggggatg

SEQ ID NO: 4680606 - DNA, 14 bp, Homo sapiens
ctggctggggatgg

SEQ ID NO: 4680607 - DNA, 21 bp, Homo sapiens
ctggggatcccgtgctggaag

SEQ ID NO: 4680608 - DNA, 13 bp, Homo sapiens
ctggtgaggacaa

SEQ ID NO: 4680609 - DNA, 16 bp, Homo sapiens
ctggttggtgctttgt

SEQ ID NO: 4680610 - DNA, 13 bp, Homo sapiens
ctgtaaaaattgt

SEQ ID NO: 4680611 - DNA, 15 bp, Homo sapiens
ctgtatccaaataat

SEQ ID NO: 4680612 - DNA, 12 bp, Homo sapiens
ctgtcagtcatg

SEQ ID NO: 4680613 - DNA, 13 bp, Homo sapiens
ctgtgggtgggga

SEQ ID NO: 4680614 - DNA, 16 bp, Homo sapiens
ctgtgggtggggaagg

SEQ ID NO: 4680615 - DNA, 16 bp, Homo sapiens
ctgtgtgaccttgggc

SEQ ID NO: 4680616 - DNA, 17 bp, Homo sapiens
ctgttgtaatttaatga

SEQ ID NO: 4680617 - DNA, 13 bp, Homo sapiens
cttaaatatgaat

SEQ ID NO: 4680618 - DNA, 14 bp, Homo sapiens
cttaaatatgaatt

SEQ ID NO: 4680619 - DNA, 21 bp, Homo sapiens
cttagatctgagccctccctc

SEQ ID NO: 4680620 - DNA, 18 bp, Homo sapiens
cttctctgggcccagaga

SEQ ID NO: 4680621 - DNA, 14 bp, Homo sapiens
cttgacctttccag

SEQ ID NO: 4680622 - DNA, 21 bp, Homo sapiens
cttgagaccctcttctctggg

SEQ ID NO: 4680623 - DNA, 12 bp, Homo sapiens
ctttaaaaatta

SEQ ID NO: 4680624 - DNA, 23 bp, Homo sapiens
ctttaaaaattattatatattta

SEQ ID NO: 4680625 - DNA, 11 bp, Homo sapiens
ctttagctaag

SEQ ID NO: 4680626 - DNA, 19 bp, Homo sapiens
ctttctttaaaagaaactt

SEQ ID NO: 4680627 - DNA, 21 bp, Homo sapiens
ctttgtgtctagttttctaga

SEQ ID NO: 4680628 - DNA, 15 bp, Homo sapiens
cttttgaattacaga

SEQ ID NO: 4680629 - DNA, 23 bp, Homo sapiens
cttttgaattacagagatataaa

SEQ ID NO: 4680630 - DNA, 14 bp, Homo sapiens
gaaaaaataaatgt

SEQ ID NO: 4680631 - DNA, 17 bp, Homo sapiens
gaactgagccgtgcagc

SEQ ID NO: 4680632 - DNA, 15 bp, Homo sapiens
gaagaaaaaactgaa

SEQ ID NO: 4680633 - DNA, 18 bp, Homo sapiens
gaagtattatctgtaaaa

SEQ ID NO: 4680634 - DNA, 20 bp, Homo sapiens
gaataaagtaccttgacttt

SEQ ID NO: 4680635 - DNA, 21 bp, Homo sapiens
gaattacagagatataaatga

SEQ ID NO: 4680636 - DNA, 18 bp, Homo sapiens
tgtaatgtaaaccagaaa

SEQ ID NO: 4680637 - DNA, 17 bp, Homo sapiens
tgtagctgccaggcttt

SEQ ID NO: 4680638 - DNA, 23 bp, Homo sapiens
tgtattttagatatattctctaa

SEQ ID NO: 4680639 - DNA, 17 bp, Homo sapiens
tgtcctctgtcagtcat

SEQ ID NO: 4680640 - DNA, 17 bp, Homo sapiens
tgtctagttttctagac

SEQ ID NO: 4680641 - DNA, 22 bp, Homo sapiens
tgtgactcctcccttccccact

SEQ ID NO: 4680642 - DNA, 17 bp, Homo sapiens
tgtgtctagttttctag

SEQ ID NO: 4680643 - DNA, 23 bp, Homo sapiens
tgtgttaaagtacttgaaatgta

SEQ ID NO: 4680644 - DNA, 20 bp, Homo sapiens
tgttctatagcagtcatcat

SEQ ID NO: 4680645 - DNA, 18 bp, Homo sapiens
ttaaaaataaagtaactt

SEQ ID NO: 4680646 - DNA, 19 bp, Homo sapiens
ttaaaaattattatatatt

SEQ ID NO: 4680647 - DNA, 17 bp, Homo sapiens
ttaaagaaaaactttaa

SEQ ID NO: 4680648 - DNA, 12 bp, Homo sapiens
ttaaatatgaat

SEQ ID NO: 4680649 - DNA, 19 bp, Homo sapiens
ttaaggcaaatcaggtaaa

SEQ ID NO: 4680650 - DNA, 18 bp, Homo sapiens
ttaagtctttattaactt

SEQ ID NO: 4680651 - DNA, 16 bp, Homo sapiens
ttacagagatataaat

SEQ ID NO: 4680652 - DNA, 16 bp, Homo sapiens
ttactaataaaatgtg

SEQ ID NO: 4680653 - DNA, 15 bp, Homo sapiens
ttacttgatagactt

SEQ ID NO: 4680654 - DNA, 14 bp, Homo sapiens
ttagatctgagccc

SEQ ID NO: 4680655 - DNA, 21 bp, Homo sapiens
ttatcaaaagaagaaaaaact

SEQ ID NO: 4680656 - DNA, 12 bp, Homo sapiens
ttattatatatt

SEQ ID NO: 4680657 - DNA, 12 bp, Homo sapiens
ttcaaagaactc

SEQ ID NO: 4680658 - DNA, 22 bp, Homo sapiens
ttcaagatgttatattaaagaa

SEQ ID NO: 4680659 - DNA, 18 bp, Homo sapiens
ttctcacttatagagctc

SEQ ID NO: 4680660 - DNA, 17 bp, Homo sapiens
ttgaaccaggccttctg

SEQ ID NO: 4680661 - DNA, 20 bp, Homo sapiens
ttgaaggaacttaaaacttt

SEQ ID NO: 4680662 - DNA, 20 bp, Homo sapiens
ttgaattacagagatataaa

SEQ ID NO: 4680663 - DNA, 15 bp, Homo sapiens
ttgactaaaatgctg

SEQ ID NO: 4680664 - DNA, 19 bp, Homo sapiens
ttgactttgttcacagcat

SEQ ID NO: 4680665 - DNA, 12 bp, Homo sapiens
ttgatagactta

SEQ ID NO: 4680666 - DNA, 19 bp, Homo sapiens
ttgccacactttcactggg

SEQ ID NO: 4680667 - DNA, 21 bp, Homo sapiens
ttgtattttagatatattctc

SEQ ID NO: 4680668 - DNA, 14 bp, Homo sapiens
ttgtctttgaacgt

SEQ ID NO: 4680669 - DNA, 21 bp, Homo sapiens
ttgtgatacagagtatatttc

SEQ ID NO: 4680670 - DNA, 20 bp, Homo sapiens
tttaaccctttaatgaactt

SEQ ID NO: 4680671 - DNA, 21 bp, Homo sapiens
tttaactgtgttaaagtactt

SEQ ID NO: 4680672 - DNA, 20 bp, Homo sapiens
tttagagccagaagtaactt

SEQ ID NO: 4680673 - DNA, 17 bp, Homo sapiens
tttcaaagaactcctga

SEQ ID NO: 4680674 - DNA, 22 bp, Homo sapiens
tttccctttagctaagcacaga

SEQ ID NO: 4680675 - DNA, 12 bp, Homo sapiens
tttcctcttctg

SEQ ID NO: 4680676 - DNA, 14 bp, Homo sapiens
tttctggctgggga

SEQ ID NO: 4680677 - DNA, 16 bp, Homo sapiens
tttctggctggggatg

SEQ ID NO: 4680678 - DNA, 14 bp, Homo sapiens
tttgttgttaatgt

SEQ ID NO: 4680679 - DNA, 13 bp, Homo sapiens
ttttagatatatt

SEQ ID NO: 4680680 - DNA, 14 bp, Homo sapiens
ttttagatatattc

SEQ ID NO: 4680681 - DNA, 12 bp, Homo sapiens
ttttttaactgt

SEQ ID NO: 4680682 - DNA, 10 bp, Homo sapiens
aactgagccg

SEQ ID NO: 4680683 - DNA, 12 bp, Homo sapiens
aacttaataaat

SEQ ID NO: 4680684 - DNA, 15 bp, Homo sapiens
aacttaataaatatt

SEQ ID NO: 4680685 - DNA, 22 bp, Homo sapiens
aactttaaaaattattatatat

SEQ ID NO: 4680686 - DNA, 16 bp, Homo sapiens
aagacaatgattattt

SEQ ID NO: 4680687 - DNA, 20 bp, Homo sapiens
aagacttagatctgagccct

SEQ ID NO: 4680688 - DNA, 12 bp, Homo sapiens
aagataaattga

SEQ ID NO: 4680689 - DNA, 23 bp, Homo sapiens
aagatgttatattaaagaaaaac

SEQ ID NO: 4680690 - DNA, 19 bp, Homo sapiens
aagctctagataaaacttt

SEQ ID NO: 4680691 - DNA, 19 bp, Homo sapiens
aaggtcacatagctgggat

SEQ ID NO: 4680692 - DNA, 16 bp, Homo sapiens
aagtaccacactgaaa

SEQ ID NO: 4680693 - DNA, 22 bp, Homo sapiens
aagtattatctgtaaaaattgt

SEQ ID NO: 4680694 - DNA, 16 bp, Homo sapiens
aagtcatccagtgaaa

SEQ ID NO: 4680695 - DNA, 21 bp, Homo sapiens
aagtctgtccatatgaaaatg

SEQ ID NO: 4680696 - DNA, 17 bp, Homo sapiens
aagtgatattgtcttca

SEQ ID NO: 4680697 - DNA, 17 bp, Homo sapiens
aagttatcttaaatatg

SEQ ID NO: 4680698 - DNA, 16 bp, Homo sapiens
aataaaatgtgaagac

SEQ ID NO: 4680699 - DNA, 10 bp, Homo sapiens
aataaatatt

SEQ ID NO: 4680700 - DNA, 18 bp, Homo sapiens
aataaatattgtatttta

SEQ ID NO: 4680701 - DNA, 22 bp, Homo sapiens
aataaatattgtattttagata

SEQ ID NO: 4680702 - DNA, 18 bp, Homo sapiens
aataaatgttcatgattt

SEQ ID NO: 4680703 - DNA, 14 bp, Homo sapiens
aataagaataaagt

SEQ ID NO: 4680704 - DNA, 16 bp, Homo sapiens
aataataaagtaattg

SEQ ID NO: 4680705 - DNA, 24 bp, Homo sapiens
aatagtcatgattctatgtaatgt

SEQ ID NO: 4680706 - DNA, 21 bp, Homo sapiens
aatataggataagaaataaga

SEQ ID NO: 4680707 - DNA, 13 bp, Homo sapiens
aatatatttgtgt

SEQ ID NO: 4680708 - DNA, 22 bp, Homo sapiens
aatattgtatttgagaaaataa

SEQ ID NO: 4680709 - DNA, 23 bp, Homo sapiens
aatattgtattttagatatattc

SEQ ID NO: 4680710 - DNA, 23 bp, Homo sapiens
aatcaggtaaaatagtcatgatt

SEQ ID NO: 4680711 - DNA, 22 bp, Homo sapiens
aatgaagtattatctgtaaaaa

SEQ ID NO: 4680712 - DNA, 19 bp, Homo sapiens
aatgctgcttttaaaacat

SEQ ID NO: 4680713 - DNA, 20 bp, Homo sapiens
aatgtaaaccagaaaaaata

SEQ ID NO: 4680714 - DNA, 23 bp, Homo sapiens
aatgtaaaccagaaaaaataaat

SEQ ID NO: 4680715 - DNA, 22 bp, Homo sapiens
aattacagagatataaatgaag

SEQ ID NO: 4680716 - DNA, 17 bp, Homo sapiens
aatttaatgacttttga

SEQ ID NO: 4680717 - DNA, 14 bp, Homo sapiens
acaagataaattga

SEQ ID NO: 4680718 - DNA, 20 bp, Homo sapiens
acacagaatataggataaga

SEQ ID NO: 4680719 - DNA, 22 bp, Homo sapiens
acacagaatataggataagaaa

SEQ ID NO: 4680720 - DNA, 22 bp, Homo sapiens
acactgttggaagaaaagagat

SEQ ID NO: 4680721 - DNA, 16 bp, Homo sapiens
acagagatataaatga

SEQ ID NO: 4680722 - DNA, 17 bp, Homo sapiens
acagagatataaatgaa

SEQ ID NO: 4680723 - DNA, 19 bp, Homo sapiens
acaggcaaggatgatccag

SEQ ID NO: 4680724 - DNA, 18 bp, Homo sapiens
acatccccaccttccaag

SEQ ID NO: 4680725 - DNA, 15 bp, Homo sapiens
accagaaagtcctgg

SEQ ID NO: 4680726 - DNA, 21 bp, Homo sapiens
accctcccccaccattccaca

SEQ ID NO: 4680727 - DNA, 14 bp, Homo sapiens
accctcttctctgg

SEQ ID NO: 4680728 - DNA, 22 bp, Homo sapiens
accctcttctctgggcccagag

SEQ ID NO: 4680729 - DNA, 13 bp, Homo sapiens
accttgactttgt

SEQ ID NO: 4680730 - DNA, 22 bp, Homo sapiens
accttgagaccctcttctctgg

SEQ ID NO: 4680731 - DNA, 16 bp, Homo sapiens
acctttcaaagaactc

SEQ ID NO: 4680732 - DNA, 21 bp, Homo sapiens
acgtacccaaggtcacatagc

SEQ ID NO: 4680733 - DNA, 19 bp, Homo sapiens
actccacagggactgttct

SEQ ID NO: 4680734 - DNA, 21 bp, Homo sapiens
actccaggatcctcctggagc

SEQ ID NO: 4680735 - DNA, 18 bp, Homo sapiens
actccagtaaaagttgtg

SEQ ID NO: 4680736 - DNA, 16 bp, Homo sapiens
actcctcccttcccca

SEQ ID NO: 4680737 - DNA, 22 bp, Homo sapiens
actcctcccttccccactctgc

SEQ ID NO: 4680738 - DNA, 15 bp, Homo sapiens
actctgctcccagcc

SEQ ID NO: 4680739 - DNA, 18 bp, Homo sapiens
actgagccgtgcagctgg

SEQ ID NO: 4680740 - DNA, 23 bp, Homo sapiens
actggggatcccgtgctggaaga

SEQ ID NO: 4680741 - DNA, 14 bp, Homo sapiens
acttaataaatatt

SEQ ID NO: 4680742 - DNA, 15 bp, Homo sapiens
acttactaataaaat

SEQ ID NO: 4680743 - DNA, 19 bp, Homo sapiens
acttactaataaaatgtga

SEQ ID NO: 4680744 - DNA, 17 bp, Homo sapiens
acttagatctgagccct

SEQ ID NO: 4680745 - DNA, 22 bp, Homo sapiens
acttagatctgagccctccctc

SEQ ID NO: 4680746 - DNA, 15 bp, Homo sapiens
acttgaacctgaaga

SEQ ID NO: 4680747 - DNA, 14 bp, Homo sapiens
actttcccttcccc

SEQ ID NO: 4680748 - DNA, 20 bp, Homo sapiens
acttttgaattacagagata

SEQ ID NO: 4680749 - DNA, 14 bp, Homo sapiens
agaaaaaataaatg

SEQ ID NO: 4680750 - DNA, 17 bp, Homo sapiens
agaaaaactttaaaaat

SEQ ID NO: 4680751 - DNA, 14 bp, Homo sapiens
agaaacactgttgg

SEQ ID NO: 4680752 - DNA, 22 bp, Homo sapiens
agaagaaaaaactgaaggtact

SEQ ID NO: 4680753 - DNA, 18 bp, Homo sapiens
agaagcaaaggcaggagg

SEQ ID NO: 4680754 - DNA, 12 bp, Homo sapiens
agaatagaactt

SEQ ID NO: 4680755 - DNA, 13 bp, Homo sapiens
agaccctcttctc

SEQ ID NO: 4680756 - DNA, 16 bp, Homo sapiens
agaccctcttctctgg

SEQ ID NO: 4680757 - DNA, 17 bp, Homo sapiens
agacttactaataaaat

SEQ ID NO: 4680758 - DNA, 22 bp, Homo sapiens
agacttactaataaaatgtgaa

SEQ ID NO: 4680759 - DNA, 22 bp, Homo sapiens
agacttagatctgagccctccc

SEQ ID NO: 4680760 - DNA, 16 bp, Homo sapiens
agagaggcgtcctggt

SEQ ID NO: 4680761 - DNA, 14 bp, Homo sapiens
agagatataaatga

SEQ ID NO: 4680762 - DNA, 15 bp, Homo sapiens
agagatataaatgaa

SEQ ID NO: 4680763 - DNA, 17 bp, Homo sapiens
agagccagaagtaactt

SEQ ID NO: 4680764 - DNA, 17 bp, Homo sapiens
agaggcgtcctggtgag

SEQ ID NO: 4680765 - DNA, 14 bp, Homo sapiens
agatataaatgaag

SEQ ID NO: 4680766 - DNA, 15 bp, Homo sapiens
agatataaatgaagt

SEQ ID NO: 4680767 - DNA, 19 bp, Homo sapiens
agatatattctctaataaa

SEQ ID NO: 4680768 - DNA, 21 bp, Homo sapiens
agatcagattaaaaacaccat

SEQ ID NO: 4680769 - DNA, 12 bp, Homo sapiens
agatctgagccc

SEQ ID NO: 4680770 - DNA, 13 bp, Homo sapiens
agatgttatatta

SEQ ID NO: 4680771 - DNA, 17 bp, Homo sapiens
agatgttatattaaaga

SEQ ID NO: 4680772 - DNA, 21 bp, Homo sapiens
agatgttatattaaagaaaaa

SEQ ID NO: 4680773 - DNA, 18 bp, Homo sapiens
agattcatataaccacaa

SEQ ID NO: 4680774 - DNA, 22 bp, Homo sapiens
agcaaaacctgaggtttaccta

SEQ ID NO: 4680775 - DNA, 18 bp, Homo sapiens
agcaaagttatcttaaat

SEQ ID NO: 4680776 - DNA, 22 bp, Homo sapiens
agcaaagttatcttaaatatga

SEQ ID NO: 4680777 - DNA, 15 bp, Homo sapiens
agcacaagataaatt

SEQ ID NO: 4680778 - DNA, 18 bp, Homo sapiens
agcacagatctaccttgg

SEQ ID NO: 4680779 - DNA, 16 bp, Homo sapiens
agcctatatttcctct

SEQ ID NO: 4680780 - DNA, 18 bp, Homo sapiens
agcctatatttcctcttc

SEQ ID NO: 4680781 - DNA, 20 bp, Homo sapiens
agcctatatttcctcttctg

SEQ ID NO: 4680782 - DNA, 21 bp, Homo sapiens
agcctatatttcctcttctgt

SEQ ID NO: 4680783 - DNA, 20 bp, Homo sapiens
agcctggcttttctggctgg

SEQ ID NO: 4680784 - DNA, 15 bp, Homo sapiens
agctctgtcctctgt

SEQ ID NO: 4680785 - DNA, 13 bp, Homo sapiens
agctgggatttga

SEQ ID NO: 4680786 - DNA, 18 bp, Homo sapiens
aggaaggcgtgtccagga

SEQ ID NO: 4680787 - DNA, 21 bp, Homo sapiens
aggaaggcgtgtccaggagac

SEQ ID NO: 4680788 - DNA, 19 bp, Homo sapiens
taccctcggctcccgggtc

SEQ ID NO: 4680789 - DNA, 16 bp, Homo sapiens
tacctttcaaagaact

SEQ ID NO: 4680790 - DNA, 16 bp, Homo sapiens
tactaataaaatgtga

SEQ ID NO: 4680791 - DNA, 15 bp, Homo sapiens
tactcctaaaacttt

SEQ ID NO: 4680792 - DNA, 16 bp, Homo sapiens
tacttaaaaataaagt

SEQ ID NO: 4680793 - DNA, 14 bp, Homo sapiens
tacttgatagactt

SEQ ID NO: 4680794 - DNA, 21 bp, Homo sapiens
tacttggaattctaattgttt

SEQ ID NO: 4680795 - DNA, 18 bp, Homo sapiens
tagaccctcccccaccat

SEQ ID NO: 4680796 - DNA, 18 bp, Homo sapiens
tagacttactaataaaat

SEQ ID NO: 4680797 - DNA, 13 bp, Homo sapiens
tagataaaacttt

SEQ ID NO: 4680798 - DNA, 16 bp, Homo sapiens
tagatatattctctaa

SEQ ID NO: 4680799 - DNA, 22 bp, Homo sapiens
tagatatattctctaataaaat

SEQ ID NO: 4680800 - DNA, 13 bp, Homo sapiens
tagatctgagccc

SEQ ID NO: 4680801 - DNA, 14 bp, Homo sapiens
tagatctgagccct

SEQ ID NO: 4680802 - DNA, 18 bp, Homo sapiens
tagatctgagccctccct

SEQ ID NO: 4680803 - DNA, 17 bp, Homo sapiens
tagcaaagttatcttaa

SEQ ID NO: 4680804 - DNA, 22 bp, Homo sapiens
tagcaaagttatcttaaatatg

SEQ ID NO: 4680805 - DNA, 18 bp, Homo sapiens
tagcacaagataaattga

SEQ ID NO: 4680806 - DNA, 19 bp, Homo sapiens
tagcacaagataaattgag

SEQ ID NO: 4680807 - DNA, 23 bp, Homo sapiens
tagctgggatttgaactgagccg

SEQ ID NO: 4680808 - DNA, 22 bp, Homo sapiens
tagggctttgtaaactccacag

SEQ ID NO: 4680809 - DNA, 22 bp, Homo sapiens
tataaatgaagtattatctgta

SEQ ID NO: 4680810 - DNA, 13 bp, Homo sapiens
tataagaagactt

SEQ ID NO: 4680811 - DNA, 18 bp, Homo sapiens
tataattagagttgtgat

SEQ ID NO: 4680812 - DNA, 14 bp, Homo sapiens
tataggataagaaa

SEQ ID NO: 4680813 - DNA, 22 bp, Homo sapiens
tatatatttatagcaaagttat

SEQ ID NO: 4680814 - DNA, 13 bp, Homo sapiens
tatatcataactt

SEQ ID NO: 4680815 - DNA, 22 bp, Homo sapiens
tatatcataacttaataaatat

SEQ ID NO: 4680816 - DNA, 19 bp, Homo sapiens
tatattctctaataaaatt

SEQ ID NO: 4680817 - DNA, 16 bp, Homo sapiens
tatatttccattcaga

SEQ ID NO: 4680818 - DNA, 13 bp, Homo sapiens
tatcttaaatatg

SEQ ID NO: 4680819 - DNA, 16 bp, Homo sapiens
tatcttaaatatgaat

SEQ ID NO: 4680820 - DNA, 18 bp, Homo sapiens
tatgtatatttcaaagta

SEQ ID NO: 4680821 - DNA, 14 bp, Homo sapiens
tattatctgtaaaa

SEQ ID NO: 4680822 - DNA, 17 bp, Homo sapiens
tattatctgtaaaaatt

SEQ ID NO: 4680823 - DNA, 16 bp, Homo sapiens
tattctctaataaaat

SEQ ID NO: 4680824 - DNA, 18 bp, Homo sapiens
tattctctaataaaattc

SEQ ID NO: 4680825 - DNA, 14 bp, Homo sapiens
tattttagatatat

SEQ ID NO: 4680826 - DNA, 14 bp, Homo sapiens
tcaaaggaacagaa

SEQ ID NO: 4680827 - DNA, 19 bp, Homo sapiens
tcaaagtaccacactgaaa

SEQ ID NO: 4680828 - DNA, 15 bp, Homo sapiens
tcaagatgttatatt

SEQ ID NO: 4680829 - DNA, 15 bp, Homo sapiens
tcagacaatatatca

SEQ ID NO: 4680830 - DNA, 16 bp, Homo sapiens
tcagggctaaagtcat

SEQ ID NO: 4680831 - DNA, 22 bp, Homo sapiens
tcataacttaataaatattgta

SEQ ID NO: 4680832 - DNA, 22 bp, Homo sapiens
tcatgattctatgtaatgtaaa

SEQ ID NO: 4680833 - DNA, 22 bp, Homo sapiens
tcatgcgtccactttcccttcc

SEQ ID NO: 4680834 - DNA, 15 bp, Homo sapiens
tccacatccccacct

SEQ ID NO: 4680835 - DNA, 20 bp, Homo sapiens
tccaggatcctcctggagca

SEQ ID NO: 4680836 - DNA, 22 bp, Homo sapiens
tccatccctttccctcgctcga

SEQ ID NO: 4680837 - DNA, 21 bp, Homo sapiens
tccattaagggtccaagaagt

SEQ ID NO: 4680838 - DNA, 16 bp, Homo sapiens
tcccagcccctacctt

SEQ ID NO: 4680839 - DNA, 18 bp, Homo sapiens
tccccactctgctcccag

SEQ ID NO: 4680840 - DNA, 14 bp, Homo sapiens
tccctcttcccagc

SEQ ID NO: 4680841 - DNA, 15 bp, Homo sapiens
tccctcttcccagca

SEQ ID NO: 4680842 - DNA, 16 bp, Homo sapiens
tccctcttcccagcac

SEQ ID NO: 4680843 - DNA, 17 bp, Homo sapiens
tcccttgacctttccag

SEQ ID NO: 4680844 - DNA, 15 bp, Homo sapiens
tccgagctctgtcct

SEQ ID NO: 4680845 - DNA, 23 bp, Homo sapiens
tccgaggtggtgggggcgccgca

SEQ ID NO: 4680846 - DNA, 21 bp, Homo sapiens
tccgccctccgctggctccga

SEQ ID NO: 4680847 - DNA, 17 bp, Homo sapiens
tcctcccttccccactc

SEQ ID NO: 4680848 - DNA, 18 bp, Homo sapiens
tcctcctagaactccagt

SEQ ID NO: 4680849 - DNA, 15 bp, Homo sapiens
tcctctgtcagtcat

SEQ ID NO: 4680850 - DNA, 22 bp, Homo sapiens
tcctcttctgtaaaatgggtat

SEQ ID NO: 4680851 - DNA, 14 bp, Homo sapiens
tcctggagcagcag

SEQ ID NO: 4680852 - DNA, 14 bp, Homo sapiens
tcctggtgaggaca

SEQ ID NO: 4680853 - DNA, 15 bp, Homo sapiens
tccttgataaaagtc

SEQ ID NO: 4680854 - DNA, 17 bp, Homo sapiens
tccttgataaaagtcat

SEQ ID NO: 4680855 - DNA, 12 bp, Homo sapiens
tctaataaaatt

SEQ ID NO: 4680856 - DNA, 15 bp, Homo sapiens
tctagttttctagac

SEQ ID NO: 4680857 - DNA, 24 bp, Homo sapiens
tctgagccctccctcttcccagca

SEQ ID NO: 4680858 - DNA, 15 bp, Homo sapiens
tctgctcccagcccc

SEQ ID NO: 4680859 - DNA, 15 bp, Homo sapiens
tctgtaaaaattgtt

SEQ ID NO: 4680860 - DNA, 19 bp, Homo sapiens
tctgtatccaaataatgaa

SEQ ID NO: 4680861 - DNA, 20 bp, Homo sapiens
tctgtatccaaataatgaat

SEQ ID NO: 4680862 - DNA, 19 bp, Homo sapiens
tctgttgtaatttaatgac

SEQ ID NO: 4680863 - DNA, 14 bp, Homo sapiens
tctttgatatcagc

SEQ ID NO: 4680864 - DNA, 17 bp, Homo sapiens
tgaaccaggccttctga

SEQ ID NO: 4680865 - DNA, 21 bp, Homo sapiens
tgaactgagccgtgcagctgg

SEQ ID NO: 4680866 - DNA, 20 bp, Homo sapiens
tgaagcatgaaactgtgtat

SEQ ID NO: 4680867 - DNA, 18 bp, Homo sapiens
tgaattacagagatataa

SEQ ID NO: 4680868 - DNA, 18 bp, Homo sapiens
tgacttttgaattacaga

SEQ ID NO: 4680869 - DNA, 18 bp, Homo sapiens
tgagaccctcttctctgg

SEQ ID NO: 4680870 - DNA, 19 bp, Homo sapiens
tgagaccctcttctctggg

SEQ ID NO: 4680871 - DNA, 22 bp, Homo sapiens
tgagcgggtggggtgcttgctg

SEQ ID NO: 4680872 - DNA, 17 bp, Homo sapiens
tgaggggtatactagaa

SEQ ID NO: 4680873 - DNA, 16 bp, Homo sapiens
tgataatacccacatt

SEQ ID NO: 4680874 - DNA, 15 bp, Homo sapiens
tgatacagagtatat

SEQ ID NO: 4680875 - DNA, 17 bp, Homo sapiens
tgatacagagtatattt

SEQ ID NO: 4680876 - DNA, 18 bp, Homo sapiens
tgatgataatacccacat

SEQ ID NO: 4680877 - DNA, 22 bp, Homo sapiens
tgcaatattttaaatattgtat

SEQ ID NO: 4680878 - DNA, 17 bp, Homo sapiens
tgccacactttcactgg

SEQ ID NO: 4680879 - DNA, 21 bp, Homo sapiens
tgccacactttcactggggat

SEQ ID NO: 4680880 - DNA, 15 bp, Homo sapiens
tgcgtccactttccc

SEQ ID NO: 4680881 - DNA, 20 bp, Homo sapiens
tgctaaacagatgtcttctt

SEQ ID NO: 4680882 - DNA, 11 bp, Homo sapiens
tgctcccagcc

SEQ ID NO: 4680883 - DNA, 23 bp, Homo sapiens
tgctcccagcccctaccttgaga

SEQ ID NO: 4680884 - DNA, 14 bp, Homo sapiens
tgcttgctgtgtga

SEQ ID NO: 4680885 - DNA, 14 bp, Homo sapiens
tgcttttaaaacat

SEQ ID NO: 4680886 - DNA, 17 bp, Homo sapiens
tggagcagcagctgagg

SEQ ID NO: 4680887 - DNA, 21 bp, Homo sapiens
tggagctgtgcttactggctt

SEQ ID NO: 4680888 - DNA, 20 bp, Homo sapiens
tggccgatggggcccacatt

SEQ ID NO: 4680889 - DNA, 12 bp, Homo sapiens
tggctggggatg

SEQ ID NO: 4680890 - DNA, 12 bp, Homo sapiens
tggctgtttgtt

SEQ ID NO: 4680891 - DNA, 19 bp, Homo sapiens
tgggatttgaactgagccg

SEQ ID NO: 4680892 - DNA, 13 bp, Homo sapiens
tgggcaagtccct

SEQ ID NO: 4680893 - DNA, 20 bp, Homo sapiens
tggggatcccgtgctggaag

SEQ ID NO: 4680894 - DNA, 19 bp, Homo sapiens
tgtaaaaattgttataatt

SEQ ID NO: 4680895 - DNA, 16 bp, Homo sapiens
aaaaagcaagaattct

SEQ ID NO: 4680896 - DNA, 12 bp, Homo sapiens
aaaaataaatgt

SEQ ID NO: 4680897 - DNA, 15 bp, Homo sapiens
aaaaataaatgttca

SEQ ID NO: 4680898 - DNA, 15 bp, Homo sapiens
aaaactttaaaaatt

SEQ ID NO: 4680899 - DNA, 19 bp, Homo sapiens
aaaatgataaagaacagaa

SEQ ID NO: 4680900 - DNA, 17 bp, Homo sapiens
aaacagttgtctgctgt

SEQ ID NO: 4680901 - DNA, 13 bp, Homo sapiens
aaaccagaaaaaa

SEQ ID NO: 4680902 - DNA, 20 bp, Homo sapiens
aaaccagaaaaaataaatgt

SEQ ID NO: 4680903 - DNA, 17 bp, Homo sapiens
aaactccacagggactg

SEQ ID NO: 4680904 - DNA, 14 bp, Homo sapiens
aaagcaagaattct

SEQ ID NO: 4680905 - DNA, 23 bp, Homo sapiens
aaagggtagcctggcttttctgg

SEQ ID NO: 4680906 - DNA, 17 bp, Homo sapiens
aaataataaagtaattg

SEQ ID NO: 4680907 - DNA, 21 bp, Homo sapiens
aaatagtcatgattctatgta

SEQ ID NO: 4680908 - DNA, 17 bp, Homo sapiens
aaatattgtattttaga

SEQ ID NO: 4680909 - DNA, 14 bp, Homo sapiens
aaatgttcatgatt

SEQ ID NO: 4680910 - DNA, 17 bp, Homo sapiens
aaattagaatagaactt

SEQ ID NO: 4680911 - DNA, 17 bp, Homo sapiens
aaattattatatattta

SEQ ID NO: 4680912 - DNA, 22 bp, Homo sapiens
aaattgagctagttaaggcaaa

SEQ ID NO: 4680913 - DNA, 19 bp, Homo sapiens
aacaccttttatgaaaatg

SEQ ID NO: 4680914 - DNA, 11 bp, Homo sapiens
aacagaaacta

SEQ ID NO: 4680915 - DNA, 14 bp, Homo sapiens
aacagaaactacat

SEQ ID NO: 4680916 - DNA, 22 bp, Homo sapiens
aactgagccgtgcagctgggat

SEQ ID NO: 4680917 - DNA, 13 bp, Homo sapiens
aacttaaaacttt

SEQ ID NO: 4680918 - DNA, 17 bp, Homo sapiens
aacttaataaatattgt

SEQ ID NO: 4680919 - DNA, 21 bp, Homo sapiens
aactttaaaaattattatata

SEQ ID NO: 4680920 - DNA, 21 bp, Homo sapiens
aagacttagatctgagccctc

SEQ ID NO: 4680921 - DNA, 12 bp, Homo sapiens
aagatgttatat

SEQ ID NO: 4680922 - DNA, 16 bp, Homo sapiens
aagatgttatattaaa

SEQ ID NO: 4680923 - DNA, 21 bp, Homo sapiens
aagatgttatattaaagaaaa

SEQ ID NO: 4680924 - DNA, 19 bp, Homo sapiens
aagtaccacactgaaaatt

SEQ ID NO: 4680925 - DNA, 15 bp, Homo sapiens
aagtaccttgacttt

SEQ ID NO: 4680926 - DNA, 16 bp, Homo sapiens
aagtaccttgactttg

SEQ ID NO: 4680927 - DNA, 17 bp, Homo sapiens
aagtcatccagtgaaac

SEQ ID NO: 4680928 - DNA, 20 bp, Homo sapiens
aagttatcttaaatatgaat

SEQ ID NO: 4680929 - DNA, 21 bp, Homo sapiens
aagttatcttaaatatgaatt

SEQ ID NO: 4680930 - DNA, 17 bp, Homo sapiens
aataaatgttcatgatt

SEQ ID NO: 4680931 - DNA, 12 bp, Homo sapiens
aatacccacatt

SEQ ID NO: 4680932 - DNA, 13 bp, Homo sapiens
aatagtcatgatt

SEQ ID NO: 4680933 - DNA, 23 bp, Homo sapiens
aatataggataagaaataagaat

SEQ ID NO: 4680934 - DNA, 17 bp, Homo sapiens
aatattgtattttagat

SEQ ID NO: 4680935 - DNA, 18 bp, Homo sapiens
aatattgtattttagata

SEQ ID NO: 4680936 - DNA, 20 bp, Homo sapiens
aatgaagtattatctgtaaa

SEQ ID NO: 4680937 - DNA, 16 bp, Homo sapiens
aatgttcatgatttca

SEQ ID NO: 4680938 - DNA, 23 bp, Homo sapiens
aatgttcatgatttcaagatgtt

SEQ ID NO: 4680939 - DNA, 18 bp, Homo sapiens
aattacagagatataaat

SEQ ID NO: 4680940 - DNA, 15 bp, Homo sapiens
aattattatatattt

SEQ ID NO: 4680941 - DNA, 19 bp, Homo sapiens
aattctaattgttttgtgt

SEQ ID NO: 4680942 - DNA, 21 bp, Homo sapiens
aattctgttgtaatttaatga

SEQ ID NO: 4680943 - DNA, 15 bp, Homo sapiens
aattgttataattag

SEQ ID NO: 4680944 - DNA, 17 bp, Homo sapiens
aattgttgactaaaatg

SEQ ID NO: 4680945 - DNA, 16 bp, Homo sapiens
acaatatatcataact

SEQ ID NO: 4680946 - DNA, 12 bp, Homo sapiens
acagagatataa

SEQ ID NO: 4680947 - DNA, 13 bp, Homo sapiens
acagagtatattt

SEQ ID NO: 4680948 - DNA, 14 bp, Homo sapiens
acagtccctcctgt

SEQ ID NO: 4680949 - DNA, 15 bp, Homo sapiens
acatattgtgaatgt

SEQ ID NO: 4680950 - DNA, 15 bp, Homo sapiens
acatctataaaatgt

SEQ ID NO: 4680951 - DNA, 11 bp, Homo sapiens
accagaaaaaa

SEQ ID NO: 4680952 - DNA, 18 bp, Homo sapiens
accagaaaaaataaatgt

SEQ ID NO: 4680953 - DNA, 14 bp, Homo sapiens
accctcccccacca

SEQ ID NO: 4680954 - DNA, 21 bp, Homo sapiens
acctgatactcctaaaacttt

SEQ ID NO: 4680955 - DNA, 17 bp, Homo sapiens
accttgagaccctcttc

SEQ ID NO: 4680956 - DNA, 18 bp, Homo sapiens
accttgagaccctcttct

SEQ ID NO: 4680957 - DNA, 19 bp, Homo sapiens
accttgagaccctcttctc

SEQ ID NO: 4680958 - DNA, 23 bp, Homo sapiens
accttgagaccctcttctctggg

SEQ ID NO: 4680959 - DNA, 15 bp, Homo sapiens
actagaccaattgtc

SEQ ID NO: 4680960 - DNA, 15 bp, Homo sapiens
actcctaaaactttt

SEQ ID NO: 4680961 - DNA, 13 bp, Homo sapiens
actcctatgtcat

SEQ ID NO: 4680962 - DNA, 20 bp, Homo sapiens
actcctcccttccccactct

SEQ ID NO: 4680963 - DNA, 9 bp, Homo sapiens
actctgctc

SEQ ID NO: 4680964 - DNA, 15 bp, Homo sapiens
actgtatactggtgt

SEQ ID NO: 4680965 - DNA, 17 bp, Homo sapiens
acttactaataaaatgt

SEQ ID NO: 4680966 - DNA, 20 bp, Homo sapiens
acttactaataaaatgtgaa

SEQ ID NO: 4680967 - DNA, 15 bp, Homo sapiens
acttagatctgagcc

SEQ ID NO: 4680968 - DNA, 16 bp, Homo sapiens
acttagatctgagccc

SEQ ID NO: 4680969 - DNA, 14 bp, Homo sapiens
acttatagagctct

SEQ ID NO: 4680970 - DNA, 18 bp, Homo sapiens
ttatcttaaatatgaatt

SEQ ID NO: 4680971 - DNA, 22 bp, Homo sapiens
ttatgaaaatgttgaaggaact

SEQ ID NO: 4680972 - DNA, 20 bp, Homo sapiens
ttcaaagtaccacactgaaa

SEQ ID NO: 4680973 - DNA, 20 bp, Homo sapiens
ttcaagatgttatattaaag

SEQ ID NO: 4680974 - DNA, 23 bp, Homo sapiens
ttcagacaatatatcataactta

SEQ ID NO: 4680975 - DNA, 12 bp, Homo sapiens
ttcatctcttac

SEQ ID NO: 4680976 - DNA, 13 bp, Homo sapiens
ttccacatcccca

SEQ ID NO: 4680977 - DNA, 15 bp, Homo sapiens
ttccccactctgctc

SEQ ID NO: 4680978 - DNA, 20 bp, Homo sapiens
ttccccactctgctcccagc

SEQ ID NO: 4680979 - DNA, 16 bp, Homo sapiens
ttcctttccttcagtc

SEQ ID NO: 4680980 - DNA, 15 bp, Homo sapiens
ttctctaataaaatt

SEQ ID NO: 4680981 - DNA, 19 bp, Homo sapiens
ttctctaataaaattcaga

SEQ ID NO: 4680982 - DNA, 14 bp, Homo sapiens
ttctgatcatgaat

SEQ ID NO: 4680983 - DNA, 19 bp, Homo sapiens
ttctgtaacacagaatata

SEQ ID NO: 4680984 - DNA, 14 bp, Homo sapiens
ttcttaaactttca

SEQ ID NO: 4680985 - DNA, 12 bp, Homo sapiens
ttgaattacaga

SEQ ID NO: 4680986 - DNA, 13 bp, Homo sapiens
ttgactaaaatgc

SEQ ID NO: 4680987 - DNA, 18 bp, Homo sapiens
ttgcacagtccctcctgt

SEQ ID NO: 4680988 - DNA, 22 bp, Homo sapiens
ttgtcaatttttaaaacttttt

SEQ ID NO: 4680989 - DNA, 16 bp, Homo sapiens
ttgttataattagagt

SEQ ID NO: 4680990 - DNA, 18 bp, Homo sapiens
tttaaaaattattatata

SEQ ID NO: 4680991 - DNA, 14 bp, Homo sapiens
tttaaaagaaactt

SEQ ID NO: 4680992 - DNA, 19 bp, Homo sapiens
tttagaatatatttgtgta

SEQ ID NO: 4680993 - DNA, 17 bp, Homo sapiens
tttagatatattctcta

SEQ ID NO: 4680994 - DNA, 17 bp, Homo sapiens
tttataaaagctctaga

SEQ ID NO: 4680995 - DNA, 14 bp, Homo sapiens
tttcactggggatc

SEQ ID NO: 4680996 - DNA, 15 bp, Homo sapiens
tttctggctggggat

SEQ ID NO: 4680997 - DNA, 19 bp, Homo sapiens
tttgtttattttttaactt

SEQ ID NO: 4680998 - DNA, 20 bp, Homo sapiens
ttttctgtaacacagaatat

SEQ ID NO: 4680999 - DNA, 15 bp, Homo sapiens
tttttctttatgcat

SEQ ID NO: 4681000 - DNA, 15 bp, Homo sapiens
gaaccaggccttctg

SEQ ID NO: 4681001 - DNA, 16 bp, Homo sapiens
gaaccaggccttctga

SEQ ID NO: 4681002 - DNA, 21 bp, Homo sapiens
gaaccaggccttctgatttca

SEQ ID NO: 4681003 - DNA, 22 bp, Homo sapiens
gaacctaccctcggctcccggg

SEQ ID NO: 4681004 - DNA, 11 bp, Homo sapiens
gaactgagccg

SEQ ID NO: 4681005 - DNA, 19 bp, Homo sapiens
gaagacttagatctgagcc

SEQ ID NO: 4681006 - DNA, 16 bp, Homo sapiens
gaagcaaaggcaggag

SEQ ID NO: 4681007 - DNA, 13 bp, Homo sapiens
gaaggactttggc

SEQ ID NO: 4681008 - DNA, 11 bp, Homo sapiens
gaatttaccca

SEQ ID NO: 4681009 - DNA, 13 bp, Homo sapiens
gacaatatatcat

SEQ ID NO: 4681010 - DNA, 17 bp, Homo sapiens
gaccctcttctctgggc

SEQ ID NO: 4681011 - DNA, 18 bp, Homo sapiens
gaccctcttctctgggcc

SEQ ID NO: 4681012 - DNA, 18 bp, Homo sapiens
gacctccagacagagtcc

SEQ ID NO: 4681013 - DNA, 15 bp, Homo sapiens
gactaagaatgaacc

SEQ ID NO: 4681014 - DNA, 18 bp, Homo sapiens
gactccaggatcctcctg

SEQ ID NO: 4681015 - DNA, 21 bp, Homo sapiens
gactgctgactatattttaaa

SEQ ID NO: 4681016 - DNA, 17 bp, Homo sapiens
gacttactaataaaatg

SEQ ID NO: 4681017 - DNA, 17 bp, Homo sapiens
gacttagatctgagccc

SEQ ID NO: 4681018 - DNA, 19 bp, Homo sapiens
gacttttgaattacagaga

SEQ ID NO: 4681019 - DNA, 21 bp, Homo sapiens
gagaccctcttctctgggccc

SEQ ID NO: 4681020 - DNA, 23 bp, Homo sapiens
gagatataaatgaagtattatct

SEQ ID NO: 4681021 - DNA, 13 bp, Homo sapiens
gagccctccctct

SEQ ID NO: 4681022 - DNA, 18 bp, Homo sapiens
gagccctccctcttccca

SEQ ID NO: 4681023 - DNA, 15 bp, Homo sapiens
gagccgtgcagctgg

SEQ ID NO: 4681024 - DNA, 13 bp, Homo sapiens
gaggaccaaagat

SEQ ID NO: 4681025 - DNA, 14 bp, Homo sapiens
gaggcgtcctggtg

SEQ ID NO: 4681026 - DNA, 15 bp, Homo sapiens
gagttgtgatacaga

SEQ ID NO: 4681027 - DNA, 13 bp, Homo sapiens
gatacagagtata

SEQ ID NO: 4681028 - DNA, 14 bp, Homo sapiens
gatatattctctaa

SEQ ID NO: 4681029 - DNA, 19 bp, Homo sapiens
gatatattctctaataaaa

SEQ ID NO: 4681030 - DNA, 23 bp, Homo sapiens
gatcctcctggagcagcagctga

SEQ ID NO: 4681031 - DNA, 22 bp, Homo sapiens
gatgttatattaaagaaaaact

SEQ ID NO: 4681032 - DNA, 13 bp, Homo sapiens
gatttgaactgag

SEQ ID NO: 4681033 - DNA, 13 bp, Homo sapiens
gcaaagttatctt

SEQ ID NO: 4681034 - DNA, 21 bp, Homo sapiens
gcaaggatgatccagggattg

SEQ ID NO: 4681035 - DNA, 16 bp, Homo sapiens
gcacagtccctcctgt

SEQ ID NO: 4681036 - DNA, 16 bp, Homo sapiens
gcagcagctgaggccc

SEQ ID NO: 4681037 - DNA, 15 bp, Homo sapiens
gcagctgaggcccca

SEQ ID NO: 4681038 - DNA, 19 bp, Homo sapiens
gcccacattagggggtttg

SEQ ID NO: 4681039 - DNA, 21 bp, Homo sapiens
gcccagagagaggcgtcctgg

SEQ ID NO: 4681040 - DNA, 16 bp, Homo sapiens
gccccagggctgtggg

SEQ ID NO: 4681041 - DNA, 15 bp, Homo sapiens
gccctagaccctccc

SEQ ID NO: 4681042 - DNA, 19 bp, Homo sapiens
gccctagaccctcccccac

SEQ ID NO: 4681043 - DNA, 20 bp, Homo sapiens
gccctccctcttcccagcac

SEQ ID NO: 4681044 - DNA, 16 bp, Homo sapiens
gccgatggggcccaca

SEQ ID NO: 4681045 - DNA, 22 bp, Homo sapiens
gccttcttcaatccttttcata

SEQ ID NO: 4681046 - DNA, 18 bp, Homo sapiens
gcgtccactttcccttcc

SEQ ID NO: 4681047 - DNA, 20 bp, Homo sapiens
gctaaagtcatccagtgaaa

SEQ ID NO: 4681048 - DNA, 20 bp, Homo sapiens
gctgccaggctttctgtaaa

SEQ ID NO: 4681049 - DNA, 22 bp, Homo sapiens
gctgcttttaaaacataggaaa

SEQ ID NO: 4681050 - DNA, 13 bp, Homo sapiens
gctgtgggtgggg

SEQ ID NO: 4681051 - DNA, 12 bp, Homo sapiens
gcttgctgtgtg

SEQ ID NO: 4681052 - DNA, 17 bp, Homo sapiens
gctttgtaaactccaca

SEQ ID NO: 4681053 - DNA, 23 bp, Homo sapiens
ggaggtgggtgagcgggtggggt

SEQ ID NO: 4681054 - DNA, 17 bp, Homo sapiens
ggatttgaactgagccg

SEQ ID NO: 4681055 - DNA, 15 bp, Homo sapiens
ggctgtgggtgggga

SEQ ID NO: 4681056 - DNA, 18 bp, Homo sapiens
gggatggccgatggggcc

SEQ ID NO: 4681057 - DNA, 18 bp, Homo sapiens
gggatttgaactgagccg

SEQ ID NO: 4681058 - DNA, 22 bp, Homo sapiens
gggcaagtcccttgacctttcc

SEQ ID NO: 4681059 - DNA, 20 bp, Homo sapiens
gggcacctcatggactccag

SEQ ID NO: 4681060 - DNA, 11 bp, Homo sapiens
gggcccagaga

SEQ ID NO: 4681061 - DNA, 14 bp, Homo sapiens
ggggtgcttgctgt

SEQ ID NO: 4681062 - DNA, 18 bp, Homo sapiens
ggtccgagctctgtcctc

SEQ ID NO: 4681063 - DNA, 16 bp, Homo sapiens
ggtgcttgctgtgtga

SEQ ID NO: 4681064 - DNA, 17 bp, Homo sapiens
gtaatttaatgactttt

SEQ ID NO: 4681065 - DNA, 17 bp, Homo sapiens
gtacaatcaagtgatat

SEQ ID NO: 4681066 - DNA, 15 bp, Homo sapiens
gtaccttgactttgt

SEQ ID NO: 4681067 - DNA, 18 bp, Homo sapiens
gtagaagcaaaggcagga

SEQ ID NO: 4681068 - DNA, 23 bp, Homo sapiens
gtagaatggttgagtgcaaatcc

SEQ ID NO: 4681069 - DNA, 22 bp, Homo sapiens
gtagcctggcttttctggctgg

SEQ ID NO: 4681070 - DNA, 15 bp, Homo sapiens
gtattttagatatat

SEQ ID NO: 4681071 - DNA, 15 bp, Homo sapiens
gtccctcctgttgcc

SEQ ID NO: 4681072 - DNA, 20 bp, Homo sapiens
gtcctcctagaactccagta

SEQ ID NO: 4681073 - DNA, 19 bp, Homo sapiens
gtctgtatccaaataatga

SEQ ID NO: 4681074 - DNA, 12 bp, Homo sapiens
gtgaaactttta

SEQ ID NO: 4681075 - DNA, 15 bp, Homo sapiens
actttcccttcccct

SEQ ID NO: 4681076 - DNA, 18 bp, Homo sapiens
acttttgaattacagaga

SEQ ID NO: 4681077 - DNA, 22 bp, Homo sapiens
agaactccagtaaaagttgtgc

SEQ ID NO: 4681078 - DNA, 19 bp, Homo sapiens
agaagcaaaggcaggaggt

SEQ ID NO: 4681079 - DNA, 17 bp, Homo sapiens
agaagtagttaaccaaa

SEQ ID NO: 4681080 - DNA, 19 bp, Homo sapiens
agaagttcatgggcacctc

SEQ ID NO: 4681081 - DNA, 19 bp, Homo sapiens
agaatataggataagaaat

SEQ ID NO: 4681082 - DNA, 20 bp, Homo sapiens
agacaatatatcataactta

SEQ ID NO: 4681083 - DNA, 17 bp, Homo sapiens
agacagttaatatcaaa

SEQ ID NO: 4681084 - DNA, 14 bp, Homo sapiens
agaccctcttctct

SEQ ID NO: 4681085 - DNA, 15 bp, Homo sapiens
agaccctcttctctg

SEQ ID NO: 4681086 - DNA, 16 bp, Homo sapiens
agacttactaataaaa

SEQ ID NO: 4681087 - DNA, 16 bp, Homo sapiens
agaggcgtcctggtga

SEQ ID NO: 4681088 - DNA, 20 bp, Homo sapiens
agatatattctctaataaaa

SEQ ID NO: 4681089 - DNA, 21 bp, Homo sapiens
agatatattctctaataaaat

SEQ ID NO: 4681090 - DNA, 22 bp, Homo sapiens
agatatattctctaataaaatt

SEQ ID NO: 4681091 - DNA, 13 bp, Homo sapiens
agatctgagccct

SEQ ID NO: 4681092 - DNA, 18 bp, Homo sapiens
agatgttatattaaagaa

SEQ ID NO: 4681093 - DNA, 22 bp, Homo sapiens
agatgttatattaaagaaaaac

SEQ ID NO: 4681094 - DNA, 12 bp, Homo sapiens
agattttgttgt

SEQ ID NO: 4681095 - DNA, 23 bp, Homo sapiens
agcaaagttatcttaaatatgaa

SEQ ID NO: 4681096 - DNA, 15 bp, Homo sapiens
agcaagggaacagaa

SEQ ID NO: 4681097 - DNA, 19 bp, Homo sapiens
agcctatatttcctcttct

SEQ ID NO: 4681098 - DNA, 18 bp, Homo sapiens
agcctggcttttctggct

SEQ ID NO: 4681099 - DNA, 22 bp, Homo sapiens
agcctggcttttctggctgggg

SEQ ID NO: 4681100 - DNA, 11 bp, Homo sapiens
agcgggtgggg

SEQ ID NO: 4681101 - DNA, 13 bp, Homo sapiens
agctctagataaa

SEQ ID NO: 4681102 - DNA, 16 bp, Homo sapiens
agctctgtcctctgtc

SEQ ID NO: 4681103 - DNA, 14 bp, Homo sapiens
agctgaggccccag

SEQ ID NO: 4681104 - DNA, 22 bp, Homo sapiens
agctgaggccccagggctgtgg

SEQ ID NO: 4681105 - DNA, 20 bp, Homo sapiens
aggaaggcgtgtccaggaga

SEQ ID NO: 4681106 - DNA, 13 bp, Homo sapiens
aggatcctcctgg

SEQ ID NO: 4681107 - DNA, 22 bp, Homo sapiens
aggcaaatcaggtaaaatagtc

SEQ ID NO: 4681108 - DNA, 17 bp, Homo sapiens
aggcaggaggtgggtga

SEQ ID NO: 4681109 - DNA, 14 bp, Homo sapiens
agggctgtgggtgg

SEQ ID NO: 4681110 - DNA, 15 bp, Homo sapiens
agggtagcctggctt

SEQ ID NO: 4681111 - DNA, 17 bp, Homo sapiens
aggtccgagctctgtcc

SEQ ID NO: 4681112 - DNA, 19 bp, Homo sapiens
aggtgggtgagcgggtggg

SEQ ID NO: 4681113 - DNA, 18 bp, Homo sapiens
agtcatgattctatgtaa

SEQ ID NO: 4681114 - DNA, 15 bp, Homo sapiens
agtcctcctagaact

SEQ ID NO: 4681115 - DNA, 16 bp, Homo sapiens
agtcctcctagaactc

SEQ ID NO: 4681116 - DNA, 20 bp, Homo sapiens
agtctgtatccaaataatga

SEQ ID NO: 4681117 - DNA, 17 bp, Homo sapiens
agtcttgtctttgatat

SEQ ID NO: 4681118 - DNA, 16 bp, Homo sapiens
agtgtaacagtactct

SEQ ID NO: 4681119 - DNA, 22 bp, Homo sapiens
agttaaggcaaatcaggtaaaa

SEQ ID NO: 4681120 - DNA, 18 bp, Homo sapiens
agttatcaaaagaagaaa

SEQ ID NO: 4681121 - DNA, 16 bp, Homo sapiens
agttatcttaaatatg

SEQ ID NO: 4681122 - DNA, 18 bp, Homo sapiens
agttatcttaaatatgaa

SEQ ID NO: 4681123 - DNA, 20 bp, Homo sapiens
agttatcttaaatatgaatt

SEQ ID NO: 4681124 - DNA, 19 bp, Homo sapiens
agttgtgatacagagtata

SEQ ID NO: 4681125 - DNA, 12 bp, Homo sapiens
agttttctagac

SEQ ID NO: 4681126 - DNA, 18 bp, Homo sapiens
agtttttaaaaatgtcat

SEQ ID NO: 4681127 - DNA, 16 bp, Homo sapiens
ataaaaagcaagaatt

SEQ ID NO: 4681128 - DNA, 15 bp, Homo sapiens
ataaaaagtaactga

SEQ ID NO: 4681129 - DNA, 21 bp, Homo sapiens
ataaatattgtattttagata

SEQ ID NO: 4681130 - DNA, 16 bp, Homo sapiens
ataacttaataaatat

SEQ ID NO: 4681131 - DNA, 22 bp, Homo sapiens
ataacttaataaatattgtatt

SEQ ID NO: 4681132 - DNA, 17 bp, Homo sapiens
ataatacagcgctctct

SEQ ID NO: 4681133 - DNA, 14 bp, Homo sapiens
atacagagtatatt

SEQ ID NO: 4681134 - DNA, 17 bp, Homo sapiens
atacctttcaaagaact

SEQ ID NO: 4681135 - DNA, 18 bp, Homo sapiens
atacctttcaaagaactc

SEQ ID NO: 4681136 - DNA, 21 bp, Homo sapiens
atagacttactaataaaatgt

SEQ ID NO: 4681137 - DNA, 23 bp, Homo sapiens
atagacttactaataaaatgtga

SEQ ID NO: 4681138 - DNA, 19 bp, Homo sapiens
atagcaaagttatcttaaa

SEQ ID NO: 4681139 - DNA, 18 bp, Homo sapiens
atagcacaagataaattg

SEQ ID NO: 4681140 - DNA, 14 bp, Homo sapiens
ataggataagaaat

SEQ ID NO: 4681141 - DNA, 24 bp, Homo sapiens
atagtcatgattctatgtaatgta

SEQ ID NO: 4681142 - DNA, 14 bp, Homo sapiens
atataaatgaagta

SEQ ID NO: 4681143 - DNA, 22 bp, Homo sapiens
atataaatgaagtattatctgt

SEQ ID NO: 4681144 - DNA, 23 bp, Homo sapiens
atataggataagaaataagaata

SEQ ID NO: 4681145 - DNA, 16 bp, Homo sapiens
atatattctctaataa

SEQ ID NO: 4681146 - DNA, 17 bp, Homo sapiens
atatcataacttaataa

SEQ ID NO: 4681147 - DNA, 18 bp, Homo sapiens
atatgaattctgttgtaa

SEQ ID NO: 4681148 - DNA, 17 bp, Homo sapiens
atattatatgtatgtat

SEQ ID NO: 4681149 - DNA, 13 bp, Homo sapiens
atattctctaata

SEQ ID NO: 4681150 - DNA, 21 bp, Homo sapiens
atattgtatttgagaaaataa

SEQ ID NO: 4681151 - DNA, 15 bp, Homo sapiens
atattgtattttaga

SEQ ID NO: 4681152 - DNA, 22 bp, Homo sapiens
atattgtattttagatatattc

SEQ ID NO: 4681153 - DNA, 13 bp, Homo sapiens
atctgagccctcc

SEQ ID NO: 4681154 - DNA, 23 bp, Homo sapiens
atctgagccctccctcttcccag

SEQ ID NO: 4681155 - DNA, 15 bp, Homo sapiens
atctgtaaaaattgt

SEQ ID NO: 4681156 - DNA, 21 bp, Homo sapiens
atcttaaatatgaattctgtt

SEQ ID NO: 4681157 - DNA, 21 bp, Homo sapiens
atgaaaatgttgaaggaactt

SEQ ID NO: 4681158 - DNA, 17 bp, Homo sapiens
atgacttttgaattaca

SEQ ID NO: 4681159 - DNA, 20 bp, Homo sapiens
atgacttttgaattacagag

SEQ ID NO: 4681160 - DNA, 23 bp, Homo sapiens
atgacttttgaattacagagata

SEQ ID NO: 4681161 - DNA, 20 bp, Homo sapiens
atgattctatgtaatgtaaa

SEQ ID NO: 4681162 - DNA, 20 bp, Homo sapiens
atgatttcaagatgttatat

SEQ ID NO: 4681163 - DNA, 21 bp, Homo sapiens
atggccgatggggcccacatt

SEQ ID NO: 4681164 - DNA, 15 bp, Homo sapiens
atgggcacctcatgg

SEQ ID NO: 4681165 - DNA, 15 bp, Homo sapiens
atgttatattaaaga

SEQ ID NO: 4681166 - DNA, 16 bp, Homo sapiens
atgttatattaaagaa

SEQ ID NO: 4681167 - DNA, 17 bp, Homo sapiens
atttcaaggtccgagct

SEQ ID NO: 4681168 - DNA, 23 bp, Homo sapiens
atttcaaggtccgagctctgtcc

SEQ ID NO: 4681169 - DNA, 13 bp, Homo sapiens
attttaacttgct

SEQ ID NO: 4681170 - DNA, 15 bp, Homo sapiens
atttttaaaactttt

SEQ ID NO: 4681171 - DNA, 14 bp, Homo sapiens
attttttaactttt

SEQ ID NO: 4681172 - DNA, 18 bp, Homo sapiens
caaaccttgacctccaga

SEQ ID NO: 4681173 - DNA, 18 bp, Homo sapiens
caaagtaccacactgaaa

SEQ ID NO: 4681174 - DNA, 22 bp, Homo sapiens
caaagttatcttaaatatgaat

SEQ ID NO: 4681175 - DNA, 14 bp, Homo sapiens
caagataaattgag

SEQ ID NO: 4681176 - DNA, 21 bp, Homo sapiens
caagatgttatattaaagaaa

SEQ ID NO: 4681177 - DNA, 14 bp, Homo sapiens
caagtcccttgacc

SEQ ID NO: 4681178 - DNA, 20 bp, Homo sapiens
caagtcccttgacctttcca

SEQ ID NO: 4681179 - DNA, 13 bp, Homo sapiens
cacaagataaatt

SEQ ID NO: 4681180 - DNA, 15 bp, Homo sapiens
cacaattgttgacta

SEQ ID NO: 4681181 - DNA, 12 bp, Homo sapiens
cacagaatatag

SEQ ID NO: 4681182 - DNA, 15 bp, Homo sapiens
cacaggcaggggtag

SEQ ID NO: 4681183 - DNA, 13 bp, Homo sapiens
cacagtccctcct

SEQ ID NO: 4681184 - DNA, 17 bp, Homo sapiens
cacagtccctcctgttg

SEQ ID NO: 4681185 - DNA, 21 bp, Homo sapiens
cacatccccaccttccaagga

SEQ ID NO: 4681186 - DNA, 19 bp, Homo sapiens
cacctcatggactccagga

SEQ ID NO: 4681187 - DNA, 13 bp, Homo sapiens
caccttccaagga

SEQ ID NO: 4681188 - DNA, 15 bp, Homo sapiens
cagaaacactgttgg

SEQ ID NO: 4681189 - DNA, 22 bp, Homo sapiens
cagaaggcaagatcagattaaa

SEQ ID NO: 4681190 - DNA, 19 bp, Homo sapiens
cagaatataggataagaaa

SEQ ID NO: 4681191 - DNA, 15 bp, Homo sapiens
cagagatataaatga

SEQ ID NO: 4681192 - DNA, 12 bp, Homo sapiens
cagatgtcttct

SEQ ID NO: 4681193 - DNA, 13 bp, Homo sapiens
cagattaaaaaca

SEQ ID NO: 4681194 - DNA, 23 bp, Homo sapiens
cagcccctaccttgagaccctct

SEQ ID NO: 4681195 - DNA, 18 bp, Homo sapiens
cagcctatatttcctctt

SEQ ID NO: 4681196 - DNA, 23 bp, Homo sapiens
cagctgggatttgaaccaggcct

SEQ ID NO: 4681197 - DNA, 15 bp, Homo sapiens
caggaggtgggtgag

SEQ ID NO: 4681198 - DNA, 13 bp, Homo sapiens
caggatcctcctg

SEQ ID NO: 4681199 - DNA, 15 bp, Homo sapiens
caggatcctcctgga

SEQ ID NO: 4681200 - DNA, 17 bp, Homo sapiens
caggatcctcctggagc

SEQ ID NO: 4681201 - DNA, 18 bp, Homo sapiens
caggatggttactgagga

SEQ ID NO: 4681202 - DNA, 21 bp, Homo sapiens
caggatggttactgaggacca

SEQ ID NO: 4681203 - DNA, 17 bp, Homo sapiens
caggccctagaccctcc

SEQ ID NO: 4681204 - DNA, 22 bp, Homo sapiens
cagggctaaagtcatccagtga

SEQ ID NO: 4681205 - DNA, 12 bp, Homo sapiens
cagggctgtggg

SEQ ID NO: 4681206 - DNA, 20 bp, Homo sapiens
cagtcatgcgtccactttcc

SEQ ID NO: 4681207 - DNA, 12 bp, Homo sapiens
cagtccctcctg

SEQ ID NO: 4681208 - DNA, 14 bp, Homo sapiens
cagtccctcctgtt

SEQ ID NO: 4681209 - DNA, 14 bp, Homo sapiens
cataacttaataaa

SEQ ID NO: 4681210 - DNA, 16 bp, Homo sapiens
catagctgggatttga

SEQ ID NO: 4681211 - DNA, 24 bp, Homo sapiens
catagtctgtatccaaataatgaa

SEQ ID NO: 4681212 - DNA, 17 bp, Homo sapiens
catgggcacctcatgga

SEQ ID NO: 4681213 - DNA, 16 bp, Homo sapiens
ccaaaccacatatgaa

SEQ ID NO: 4681214 - DNA, 18 bp, Homo sapiens
ccacaaagggtagcctgg

SEQ ID NO: 4681215 - DNA, 17 bp, Homo sapiens
ccaccattccacatccc

SEQ ID NO: 4681216 - DNA, 12 bp, Homo sapiens
ccactctgctcc

SEQ ID NO: 4681217 - DNA, 15 bp, Homo sapiens
ccactctgctcccag

SEQ ID NO: 4681218 - DNA, 17 bp, Homo sapiens
ccagaaaaaataaatgt

SEQ ID NO: 4681219 - DNA, 23 bp, Homo sapiens
ccagaaaaaataaatgttcatga

SEQ ID NO: 4681220 - DNA, 18 bp, Homo sapiens
ccaggccctagaccctcc

SEQ ID NO: 4681221 - DNA, 14 bp, Homo sapiens
ccagtgaaactttt

SEQ ID NO: 4681222 - DNA, 15 bp, Homo sapiens
ccatacagagtaaat

SEQ ID NO: 4681223 - DNA, 18 bp, Homo sapiens
ccatagcacaagataaat

SEQ ID NO: 4681224 - DNA, 16 bp, Homo sapiens
cccaaggtcacatagc

SEQ ID NO: 4681225 - DNA, 17 bp, Homo sapiens
cccactctgctcccagc

SEQ ID NO: 4681226 - DNA, 19 bp, Homo sapiens
cccactctgctcccagccc

SEQ ID NO: 4681227 - DNA, 21 bp, Homo sapiens
cccactctgctcccagcccct

SEQ ID NO: 4681228 - DNA, 15 bp, Homo sapiens
cccagcccctacctt

SEQ ID NO: 4681229 - DNA, 19 bp, Homo sapiens
cccagcccctaccttgaga

SEQ ID NO: 4681230 - DNA, 18 bp, Homo sapiens
cccagggctgtgggtggg

SEQ ID NO: 4681231 - DNA, 16 bp, Homo sapiens
cccccaccattccaca

SEQ ID NO: 4681232 - DNA, 20 bp, Homo sapiens
cccccaccattccacatccc

SEQ ID NO: 4681233 - DNA, 16 bp, Homo sapiens
cccctgtgactcctcc

SEQ ID NO: 4681234 - DNA, 19 bp, Homo sapiens
cccctgtgactcctccctt

SEQ ID NO: 4681235 - DNA, 14 bp, Homo sapiens
cccgtgctggaaga

SEQ ID NO: 4681236 - DNA, 22 bp, Homo sapiens
ccctaccttgagaccctcttct

SEQ ID NO: 4681237 - DNA, 18 bp, Homo sapiens
ccctcctgttgccacact

SEQ ID NO: 4681238 - DNA, 12 bp, Homo sapiens
ccctcttcccag

SEQ ID NO: 4681239 - DNA, 14 bp, Homo sapiens
ccctcttctctggg

SEQ ID NO: 4681240 - DNA, 14 bp, Homo sapiens
ccctgtgactcctc

SEQ ID NO: 4681241 - DNA, 15 bp, Homo sapiens
ccctgtgactcctcc

SEQ ID NO: 4681242 - DNA, 16 bp, Homo sapiens
cccttcccctgtgact

SEQ ID NO: 4681243 - DNA, 21 bp, Homo sapiens
ccctttctttaaaagaaactt

SEQ ID NO: 4681244 - DNA, 12 bp, Homo sapiens
cccttttttcct

SEQ ID NO: 4681245 - DNA, 12 bp, Homo sapiens
ccgtgcagctgg

SEQ ID NO: 4681246 - DNA, 19 bp, Homo sapiens
cctaccttgagaccctctt

SEQ ID NO: 4681247 - DNA, 17 bp, Homo sapiens
cctatatttcctcttct

SEQ ID NO: 4681248 - DNA, 22 bp, Homo sapiens
cctcaaattagaatagaacttg

SEQ ID NO: 4681249 - DNA, 13 bp, Homo sapiens
cctccctcttccc

SEQ ID NO: 4681250 - DNA, 15 bp, Homo sapiens
cctccctcttcccag

SEQ ID NO: 4681251 - DNA, 22 bp, Homo sapiens
cctccctcttcccagcacaggc

SEQ ID NO: 4681252 - DNA, 13 bp, Homo sapiens
cctcctagaactc

SEQ ID NO: 4681253 - DNA, 16 bp, Homo sapiens
cctcctgttgccacac

SEQ ID NO: 4681254 - DNA, 17 bp, Homo sapiens
cctcctgttgccacact

SEQ ID NO: 4681255 - DNA, 21 bp, Homo sapiens
cctgaaattttaaaaaagttg

SEQ ID NO: 4681256 - DNA, 21 bp, Homo sapiens
cctggcttttctggctgggga

SEQ ID NO: 4681257 - DNA, 15 bp, Homo sapiens
ccttcccctgtgact

SEQ ID NO: 4681258 - DNA, 15 bp, Homo sapiens
aggaggtgggtgagc

SEQ ID NO: 4681259 - DNA, 20 bp, Homo sapiens
aggatggttactgaggacca

SEQ ID NO: 4681260 - DNA, 17 bp, Homo sapiens
aggattcaaaagataaa

SEQ ID NO: 4681261 - DNA, 20 bp, Homo sapiens
aggcaaacattgcaactcag

SEQ ID NO: 4681262 - DNA, 17 bp, Homo sapiens
aggcaaatcaggtaaaa

SEQ ID NO: 4681263 - DNA, 18 bp, Homo sapiens
aggcaaatcaggtaaaat

SEQ ID NO: 4681264 - DNA, 18 bp, Homo sapiens
aggccttctgatttcaag

SEQ ID NO: 4681265 - DNA, 12 bp, Homo sapiens
agggctgtgggt

SEQ ID NO: 4681266 - DNA, 13 bp, Homo sapiens
agggctgtgggtg

SEQ ID NO: 4681267 - DNA, 17 bp, Homo sapiens
aggtcacatagctggga

SEQ ID NO: 4681268 - DNA, 21 bp, Homo sapiens
agtagaatggttgagtgcaaa

SEQ ID NO: 4681269 - DNA, 21 bp, Homo sapiens
agtagtttttctgtaacacag

SEQ ID NO: 4681270 - DNA, 14 bp, Homo sapiens
agtattatctgtaa

SEQ ID NO: 4681271 - DNA, 19 bp, Homo sapiens
agtcatgcgtccactttcc

SEQ ID NO: 4681272 - DNA, 21 bp, Homo sapiens
agtcatgcgtccactttccct

SEQ ID NO: 4681273 - DNA, 23 bp, Homo sapiens
agtcccttctcacttatagagct

SEQ ID NO: 4681274 - DNA, 16 bp, Homo sapiens
agtcctacaatgtgaa

SEQ ID NO: 4681275 - DNA, 17 bp, Homo sapiens
agtcctcctagaactcc

SEQ ID NO: 4681276 - DNA, 20 bp, Homo sapiens
agtcctcctagaactccagt

SEQ ID NO: 4681277 - DNA, 21 bp, Homo sapiens
agtctgtatccaaataatgaa

SEQ ID NO: 4681278 - DNA, 18 bp, Homo sapiens
agttaaaggtacttttgt

SEQ ID NO: 4681279 - DNA, 17 bp, Homo sapiens
agttatcttaaatatga

SEQ ID NO: 4681280 - DNA, 21 bp, Homo sapiens
ataaaggattcaaaagataaa

SEQ ID NO: 4681281 - DNA, 16 bp, Homo sapiens
ataaatattgtatttt

SEQ ID NO: 4681282 - DNA, 21 bp, Homo sapiens
ataaatgaagtattatctgta

SEQ ID NO: 4681283 - DNA, 17 bp, Homo sapiens
ataattagagttgtgat

SEQ ID NO: 4681284 - DNA, 15 bp, Homo sapiens
atacagagtatattt

SEQ ID NO: 4681285 - DNA, 18 bp, Homo sapiens
atagacttactaataaaa

SEQ ID NO: 4681286 - DNA, 20 bp, Homo sapiens
atagcaaagttatcttaaat

SEQ ID NO: 4681287 - DNA, 19 bp, Homo sapiens
atagcacaagataaattga

SEQ ID NO: 4681288 - DNA, 18 bp, Homo sapiens
ataggataagaaataaga

SEQ ID NO: 4681289 - DNA, 23 bp, Homo sapiens
atatatcataacttaataaatat

SEQ ID NO: 4681290 - DNA, 19 bp, Homo sapiens
atatcataacttaataaat

SEQ ID NO: 4681291 - DNA, 14 bp, Homo sapiens
atattctctaataa

SEQ ID NO: 4681292 - DNA, 15 bp, Homo sapiens
atattctctaataaa

SEQ ID NO: 4681293 - DNA, 12 bp, Homo sapiens
atattgtatttt

SEQ ID NO: 4681294 - DNA, 19 bp, Homo sapiens
atattgtattttagatata

SEQ ID NO: 4681295 - DNA, 15 bp, Homo sapiens
atcataacttaataa

SEQ ID NO: 4681296 - DNA, 17 bp, Homo sapiens
atcataacttaataaat

SEQ ID NO: 4681297 - DNA, 20 bp, Homo sapiens
atcataacttaataaatatt

SEQ ID NO: 4681298 - DNA, 20 bp, Homo sapiens
atccatagcacaagataaat

SEQ ID NO: 4681299 - DNA, 23 bp, Homo sapiens
atctgtaaaaattgttataatta

SEQ ID NO: 4681300 - DNA, 21 bp, Homo sapiens
atctgttgagtacattgaaga

SEQ ID NO: 4681301 - DNA, 13 bp, Homo sapiens
atcttaaatatga

SEQ ID NO: 4681302 - DNA, 16 bp, Homo sapiens
atcttaaatatgaatt

SEQ ID NO: 4681303 - DNA, 20 bp, Homo sapiens
atcttctctactgtgtgaaa

SEQ ID NO: 4681304 - DNA, 18 bp, Homo sapiens
atcttggacgcactgttt

SEQ ID NO: 4681305 - DNA, 20 bp, Homo sapiens
atgaaactgtgtattatttg

SEQ ID NO: 4681306 - DNA, 19 bp, Homo sapiens
atgaattctgttgtaattt

SEQ ID NO: 4681307 - DNA, 19 bp, Homo sapiens
atgagcactcacaattgtt

SEQ ID NO: 4681308 - DNA, 15 bp, Homo sapiens
atgattctatgtaat

SEQ ID NO: 4681309 - DNA, 14 bp, Homo sapiens
atggggcccacatt

SEQ ID NO: 4681310 - DNA, 15 bp, Homo sapiens
atgtaaaccagaaaa

SEQ ID NO: 4681311 - DNA, 19 bp, Homo sapiens
atgtaaaccagaaaaaata

SEQ ID NO: 4681312 - DNA, 22 bp, Homo sapiens
atgtaatgtaaaccagaaaaaa

SEQ ID NO: 4681313 - DNA, 22 bp, Homo sapiens
atgtatacttaaaaataaagta

SEQ ID NO: 4681314 - DNA, 15 bp, Homo sapiens
atgttcatgatttca

SEQ ID NO: 4681315 - DNA, 17 bp, Homo sapiens
atgttcatgatttcaag

SEQ ID NO: 4681316 - DNA, 15 bp, Homo sapiens
attaaagaaaaactt

SEQ ID NO: 4681317 - DNA, 18 bp, Homo sapiens
attaaagaaaaactttaa

SEQ ID NO: 4681318 - DNA, 19 bp, Homo sapiens
attaaagaaaaactttaaa

SEQ ID NO: 4681319 - DNA, 19 bp, Homo sapiens
attacagagatataaatga

SEQ ID NO: 4681320 - DNA, 19 bp, Homo sapiens
attagagttgtgatacaga

SEQ ID NO: 4681321 - DNA, 12 bp, Homo sapiens
attatatattta

SEQ ID NO: 4681322 - DNA, 14 bp, Homo sapiens
attctctaataaaa

SEQ ID NO: 4681323 - DNA, 16 bp, Homo sapiens
attctctaataaaatt

SEQ ID NO: 4681324 - DNA, 18 bp, Homo sapiens
atttcaagatgttatatt

SEQ ID NO: 4681325 - DNA, 13 bp, Homo sapiens
attttagatatat

SEQ ID NO: 4681326 - DNA, 15 bp, Homo sapiens
attttagatatattc

SEQ ID NO: 4681327 - DNA, 19 bp, Homo sapiens
attttagatatattctcta

SEQ ID NO: 4681328 - DNA, 21 bp, Homo sapiens
caaagttatcttaaatatgaa

SEQ ID NO: 4681329 - DNA, 13 bp, Homo sapiens
caaatcaggtaaa

SEQ ID NO: 4681330 - DNA, 15 bp, Homo sapiens
caaatccatagcaca

SEQ ID NO: 4681331 - DNA, 17 bp, Homo sapiens
caagataaattgagcta

SEQ ID NO: 4681332 - DNA, 15 bp, Homo sapiens
caagatgttatatta

SEQ ID NO: 4681333 - DNA, 19 bp, Homo sapiens
caagatgttatattaaaga

SEQ ID NO: 4681334 - DNA, 15 bp, Homo sapiens
caagtcctcctagaa

SEQ ID NO: 4681335 - DNA, 18 bp, Homo sapiens
caagtcctcctagaactc

SEQ ID NO: 4681336 - DNA, 16 bp, Homo sapiens
caattgttgactaaaa

SEQ ID NO: 4681337 - DNA, 17 bp, Homo sapiens
caatttttaaaactttt

SEQ ID NO: 4681338 - DNA, 13 bp, Homo sapiens
cacaactgtgata

SEQ ID NO: 4681339 - DNA, 14 bp, Homo sapiens
cacactttcactgg

SEQ ID NO: 4681340 - DNA, 17 bp, Homo sapiens
cacagaatataggataa

SEQ ID NO: 4681341 - DNA, 16 bp, Homo sapiens
cacaggcaggggtaga

SEQ ID NO: 4681342 - DNA, 15 bp, Homo sapiens
cacagtccctcctgt

SEQ ID NO: 4681343 - DNA, 14 bp, Homo sapiens
caccattccacatc

SEQ ID NO: 4681344 - DNA, 13 bp, Homo sapiens
cactctgctccca

SEQ ID NO: 4681345 - DNA, 17 bp, Homo sapiens
cactctgctcccagccc

SEQ ID NO: 4681346 - DNA, 19 bp, Homo sapiens
cactggggatcccgtgctg

SEQ ID NO: 4681347 - DNA, 16 bp, Homo sapiens
cagagagaggcgtcct

SEQ ID NO: 4681348 - DNA, 22 bp, Homo sapiens
cagagagaggcgtcctggtgag

SEQ ID NO: 4681349 - DNA, 14 bp, Homo sapiens
cagagatataaatg

SEQ ID NO: 4681350 - DNA, 19 bp, Homo sapiens
cagccttccacctccaaga

SEQ ID NO: 4681351 - DNA, 15 bp, Homo sapiens
cagctgaggccccag

SEQ ID NO: 4681352 - DNA, 17 bp, Homo sapiens
cagctgaggccccaggg

SEQ ID NO: 4681353 - DNA, 18 bp, Homo sapiens
caggatcctcctggagca

SEQ ID NO: 4681354 - DNA, 12 bp, Homo sapiens
caggccttctga

SEQ ID NO: 4681355 - DNA, 22 bp, Homo sapiens
caggccttctgatttcaaggtc

SEQ ID NO: 4681356 - DNA, 15 bp, Homo sapiens
cagggctgtgggtgg

SEQ ID NO: 4681357 - DNA, 17 bp, Homo sapiens
cagggctgtgggtgggg

SEQ ID NO: 4681358 - DNA, 19 bp, Homo sapiens
cagggctgtgggtggggaa

SEQ ID NO: 4681359 - DNA, 20 bp, Homo sapiens
catagctgggatttgaactg

SEQ ID NO: 4681360 - DNA, 23 bp, Homo sapiens
catagtctgtatccaaataatga

SEQ ID NO: 4681361 - DNA, 11 bp, Homo sapiens
catccccacct

SEQ ID NO: 4681362 - DNA, 15 bp, Homo sapiens
catccccaccttcca

SEQ ID NO: 4681363 - DNA, 20 bp, Homo sapiens
catgattctatgtaatgtaa

SEQ ID NO: 4681364 - DNA, 20 bp, Homo sapiens
catggactccaggatcctcc

SEQ ID NO: 4681365 - DNA, 22 bp, Homo sapiens
gaattacagagatataaatgaa

SEQ ID NO: 4681366 - DNA, 22 bp, Homo sapiens
gacacaaattacaacagtaaat

SEQ ID NO: 4681367 - DNA, 12 bp, Homo sapiens
gaccctccccca

SEQ ID NO: 4681368 - DNA, 14 bp, Homo sapiens
gaccctcttctctg

SEQ ID NO: 4681369 - DNA, 20 bp, Homo sapiens
gactaaaatgctgcttttaa

SEQ ID NO: 4681370 - DNA, 19 bp, Homo sapiens
gactccaggatcctcctgg

SEQ ID NO: 4681371 - DNA, 20 bp, Homo sapiens
gactccaggatcctcctgga

SEQ ID NO: 4681372 - DNA, 11 bp, Homo sapiens
gactcctccct

SEQ ID NO: 4681373 - DNA, 19 bp, Homo sapiens
gactcctcccttccccact

SEQ ID NO: 4681374 - DNA, 16 bp, Homo sapiens
gacttagatctgagcc

SEQ ID NO: 4681375 - DNA, 13 bp, Homo sapiens
gagaccctcttct

SEQ ID NO: 4681376 - DNA, 16 bp, Homo sapiens
gagagaggcgtcctgg

SEQ ID NO: 4681377 - DNA, 15 bp, Homo sapiens
gagcagcagctgagg

SEQ ID NO: 4681378 - DNA, 17 bp, Homo sapiens
gagcagcagctgaggcc

SEQ ID NO: 4681379 - DNA, 21 bp, Homo sapiens
gagccctccctcttcccagca

SEQ ID NO: 4681380 - DNA, 11 bp, Homo sapiens
gagctctgtcc

SEQ ID NO: 4681381 - DNA, 16 bp, Homo sapiens
gaggaccaaagataca

SEQ ID NO: 4681382 - DNA, 16 bp, Homo sapiens
gaggcgtcctggtgag

SEQ ID NO: 4681383 - DNA, 20 bp, Homo sapiens
gaggcgtcctggtgaggaca

SEQ ID NO: 4681384 - DNA, 14 bp, Homo sapiens
gagggcaaagtcat

SEQ ID NO: 4681385 - DNA, 21 bp, Homo sapiens
gagtgcaaatccatagcacaa

SEQ ID NO: 4681386 - DNA, 22 bp, Homo sapiens
gagtgcaaatccatagcacaag

SEQ ID NO: 4681387 - DNA, 12 bp, Homo sapiens
gataaaagtcat

SEQ ID NO: 4681388 - DNA, 14 bp, Homo sapiens
gataagaaataaga

SEQ ID NO: 4681389 - DNA, 17 bp, Homo sapiens
gatacagagtatatttc

SEQ ID NO: 4681390 - DNA, 19 bp, Homo sapiens
gatagacttactaataaaa

SEQ ID NO: 4681391 - DNA, 21 bp, Homo sapiens
gatatattctctaataaaatt

SEQ ID NO: 4681392 - DNA, 11 bp, Homo sapiens
gatcctcctgg

SEQ ID NO: 4681393 - DNA, 18 bp, Homo sapiens
gatggttactgaggacca

SEQ ID NO: 4681394 - DNA, 14 bp, Homo sapiens
gcaaagttatctta

SEQ ID NO: 4681395 - DNA, 20 bp, Homo sapiens
gcaaagttatcttaaatatg

SEQ ID NO: 4681396 - DNA, 21 bp, Homo sapiens
gcaaagttatcttaaatatga

SEQ ID NO: 4681397 - DNA, 12 bp, Homo sapiens
gcacaggcaggg

SEQ ID NO: 4681398 - DNA, 15 bp, Homo sapiens
gcacagtccctcctg

SEQ ID NO: 4681399 - DNA, 23 bp, Homo sapiens
gcactcacaattgttgactaaaa

SEQ ID NO: 4681400 - DNA, 20 bp, Homo sapiens
gcagcagctgaggccccagg

SEQ ID NO: 4681401 - DNA, 19 bp, Homo sapiens
gcagctgaggccccagggc

SEQ ID NO: 4681402 - DNA, 14 bp, Homo sapiens
gcagctgggatttg

SEQ ID NO: 4681403 - DNA, 16 bp, Homo sapiens
gcaggaggtgggtgag

SEQ ID NO: 4681404 - DNA, 14 bp, Homo sapiens
gccagaagtaactt

SEQ ID NO: 4681405 - DNA, 14 bp, Homo sapiens
gcccaggccctaga

SEQ ID NO: 4681406 - DNA, 13 bp, Homo sapiens
gccctagaccctc

SEQ ID NO: 4681407 - DNA, 18 bp, Homo sapiens
gccctagaccctccccca

SEQ ID NO: 4681408 - DNA, 14 bp, Homo sapiens
gccctccctcttcc

SEQ ID NO: 4681409 - DNA, 16 bp, Homo sapiens
gccctccctcttccca

SEQ ID NO: 4681410 - DNA, 13 bp, Homo sapiens
gccgtgcagctgg

SEQ ID NO: 4681411 - DNA, 15 bp, Homo sapiens
gcctgaaattttaaa

SEQ ID NO: 4681412 - DNA, 19 bp, Homo sapiens
gcctggcttttctggctgg

SEQ ID NO: 4681413 - DNA, 18 bp, Homo sapiens
gctcccagcccctacctt

SEQ ID NO: 4681414 - DNA, 16 bp, Homo sapiens
gctctagataaaactt

SEQ ID NO: 4681415 - DNA, 14 bp, Homo sapiens
gctgcttttaaaac

SEQ ID NO: 4681416 - DNA, 14 bp, Homo sapiens
gctgtgggtgggga

SEQ ID NO: 4681417 - DNA, 13 bp, Homo sapiens
gcttttaaaacat

SEQ ID NO: 4681418 - DNA, 21 bp, Homo sapiens
ggaagacttagatctgagccc

SEQ ID NO: 4681419 - DNA, 21 bp, Homo sapiens
ggatttgaaccaggccttctg

SEQ ID NO: 4681420 - DNA, 16 bp, Homo sapiens
ggcgtcctggtgagga

SEQ ID NO: 4681421 - DNA, 16 bp, Homo sapiens
ggctggggatggccga

SEQ ID NO: 4681422 - DNA, 19 bp, Homo sapiens
gggatttgaaccaggcctt

SEQ ID NO: 4681423 - DNA, 22 bp, Homo sapiens
gggcccagagagaggcgtcctg

SEQ ID NO: 4681424 - DNA, 22 bp, Homo sapiens
gggggtttgttgcacagtccct

SEQ ID NO: 4681425 - DNA, 20 bp, Homo sapiens
ggtagcctggcttttctggc

SEQ ID NO: 4681426 - DNA, 16 bp, Homo sapiens
ggtccgagctctgtcc

SEQ ID NO: 4681427 - DNA, 17 bp, Homo sapiens
ggtccgagctctgtcct

SEQ ID NO: 4681428 - DNA, 15 bp, Homo sapiens
gtaaaccagaaaaaa

SEQ ID NO: 4681429 - DNA, 22 bp, Homo sapiens
gtaaaccagaaaaaataaatgt

SEQ ID NO: 4681430 - DNA, 15 bp, Homo sapiens
gtacccaaggtcaca

SEQ ID NO: 4681431 - DNA, 14 bp, Homo sapiens
gtaccttgactttg

SEQ ID NO: 4681432 - DNA, 18 bp, Homo sapiens
gtattatctgtaaaaatt

SEQ ID NO: 4681433 - DNA, 15 bp, Homo sapiens
gtcatgcgtccactt

SEQ ID NO: 4681434 - DNA, 19 bp, Homo sapiens
gtccctcctgttgccacac

SEQ ID NO: 4681435 - DNA, 15 bp, Homo sapiens
gtcctggtgaggaca

SEQ ID NO: 4681436 - DNA, 18 bp, Homo sapiens
gtgactcctcccttcccc

SEQ ID NO: 4681437 - DNA, 23 bp, Homo sapiens
gtgactcctcccttccccactct

SEQ ID NO: 4681438 - DNA, 16 bp, Homo sapiens
gtgagcgggtggggtg

SEQ ID NO: 4681439 - DNA, 19 bp, Homo sapiens
gtgatacagagtatatttc

SEQ ID NO: 4681440 - DNA, 12 bp, Homo sapiens
gtgcagctggga

SEQ ID NO: 4681441 - DNA, 23 bp, Homo sapiens
gtgcctcaaattagaatagaact

SEQ ID NO: 4681442 - DNA, 13 bp, Homo sapiens
gttactgaggacc

SEQ ID NO: 4681443 - DNA, 19 bp, Homo sapiens
gttactgaggaccaaagat

SEQ ID NO: 4681444 - DNA, 16 bp, Homo sapiens
gttatattaaagaaaa

SEQ ID NO: 4681445 - DNA, 14 bp, Homo sapiens
gttatcttaaatat

SEQ ID NO: 4681446 - DNA, 17 bp, Homo sapiens
gttatcttaaatatgaa

SEQ ID NO: 4681447 - DNA, 18 bp, Homo sapiens
gttatcttaaatatgaat

SEQ ID NO: 4681448 - DNA, 14 bp, Homo sapiens
gttgactaaaatgc

SEQ ID NO: 4681449 - DNA, 18 bp, Homo sapiens
gtttgtctttcttaaaac

SEQ ID NO: 4681450 - DNA, 16 bp, Homo sapiens
taaaaacaaaatgaaa

SEQ ID NO: 4681451 - DNA, 15 bp, Homo sapiens
taaaaattattatat

SEQ ID NO: 4681452 - DNA, 19 bp, Homo sapiens
taaaaattattatatattt

SEQ ID NO: 4681453 - DNA, 23 bp, Homo sapiens
taaaacccaaaccacatatgaaa

SEQ ID NO: 4681454 - DNA, 21 bp, Homo sapiens
taaaatgctgcttttaaaaca

SEQ ID NO: 4681455 - DNA, 17 bp, Homo sapiens
taaagtaccttgacttt

SEQ ID NO: 4681456 - DNA, 18 bp, Homo sapiens
taaagtaccttgactttg

SEQ ID NO: 4681457 - DNA, 18 bp, Homo sapiens
taaagtcatccagtgaaa

SEQ ID NO: 4681458 - DNA, 17 bp, Homo sapiens
taaatatgaattctgtt

SEQ ID NO: 4681459 - DNA, 15 bp, Homo sapiens
taaatattgtatttg

SEQ ID NO: 4681460 - DNA, 22 bp, Homo sapiens
taaatgttcatgatttcaagat

SEQ ID NO: 4681461 - DNA, 16 bp, Homo sapiens
taagaaataagaataa

SEQ ID NO: 4681462 - DNA, 17 bp, Homo sapiens
taagaaataagaataaa

SEQ ID NO: 4681463 - DNA, 18 bp, Homo sapiens
taaggcaaatcaggtaaa

SEQ ID NO: 4681464 - DNA, 22 bp, Homo sapiens
taaggcaaatcaggtaaaatag

SEQ ID NO: 4681465 - DNA, 14 bp, Homo sapiens
taataaagtaattg

SEQ ID NO: 4681466 - DNA, 22 bp, Homo sapiens
taatacagcgctctctctgctt

SEQ ID NO: 4681467 - DNA, 17 bp, Homo sapiens
taatgacttttgaatta

SEQ ID NO: 4681468 - DNA, 20 bp, Homo sapiens
taatgacttttgaattacag

SEQ ID NO: 4681469 - DNA, 16 bp, Homo sapiens
taattctcaaataata

SEQ ID NO: 4681470 - DNA, 21 bp, Homo sapiens
tacagttttatgaagctttct

SEQ ID NO: 4681471 - DNA, 16 bp, Homo sapiens
tacattgtaacctgtt

SEQ ID NO: 4681472 - DNA, 16 bp, Homo sapiens
caaaccacatatgaaa

SEQ ID NO: 4681473 - DNA, 20 bp, Homo sapiens
caaaccttgacctccagaca

SEQ ID NO: 4681474 - DNA, 20 bp, Homo sapiens
caaaggcaggaggtgggtga

SEQ ID NO: 4681475 - DNA, 20 bp, Homo sapiens
caaagttatcttaaatatga

SEQ ID NO: 4681476 - DNA, 22 bp, Homo sapiens
caaatccatagcacaagataaa

SEQ ID NO: 4681477 - DNA, 17 bp, Homo sapiens
caaattagaatagaact

SEQ ID NO: 4681478 - DNA, 22 bp, Homo sapiens
caagaagtctgtccatatgaaa

SEQ ID NO: 4681479 - DNA, 18 bp, Homo sapiens
caagatgttatattaaag

SEQ ID NO: 4681480 - DNA, 17 bp, Homo sapiens
caaggtcacatagctgg

SEQ ID NO: 4681481 - DNA, 16 bp, Homo sapiens
caagtcccttgacctt

SEQ ID NO: 4681482 - DNA, 13 bp, Homo sapiens
caattgttgacta

SEQ ID NO: 4681483 - DNA, 22 bp, Homo sapiens
cacatagctgggatttgaactg

SEQ ID NO: 4681484 - DNA, 19 bp, Homo sapiens
cacatccccaccttccaag

SEQ ID NO: 4681485 - DNA, 14 bp, Homo sapiens
caccatgtttctaa

SEQ ID NO: 4681486 - DNA, 23 bp, Homo sapiens
caccattccacatccccaccttc

SEQ ID NO: 4681487 - DNA, 21 bp, Homo sapiens
cacctcatggactccaggatc

SEQ ID NO: 4681488 - DNA, 15 bp, Homo sapiens
cactttcactgggga

SEQ ID NO: 4681489 - DNA, 19 bp, Homo sapiens
cactttcccttcccctgtg

SEQ ID NO: 4681490 - DNA, 13 bp, Homo sapiens
cagagatataaat

SEQ ID NO: 4681491 - DNA, 16 bp, Homo sapiens
cagagatataaatgaa

SEQ ID NO: 4681492 - DNA, 22 bp, Homo sapiens
cagagttgttaaccagaaagtc

SEQ ID NO: 4681493 - DNA, 17 bp, Homo sapiens
cagcctatatttcctct

SEQ ID NO: 4681494 - DNA, 18 bp, Homo sapiens
cagccttccacctccaag

SEQ ID NO: 4681495 - DNA, 16 bp, Homo sapiens
cagctgaggccccagg

SEQ ID NO: 4681496 - DNA, 16 bp, Homo sapiens
caggaggtgggtgagc

SEQ ID NO: 4681497 - DNA, 14 bp, Homo sapiens
caggatcctcctgg

SEQ ID NO: 4681498 - DNA, 17 bp, Homo sapiens
caggatggttactgagg

SEQ ID NO: 4681499 - DNA, 13 bp, Homo sapiens
cagtcaagttgtg

SEQ ID NO: 4681500 - DNA, 21 bp, Homo sapiens
cagtcatgcgtccactttccc

SEQ ID NO: 4681501 - DNA, 13 bp, Homo sapiens
cagtccctcctgt

SEQ ID NO: 4681502 - DNA, 19 bp, Homo sapiens
cagttttatgaagctttct

SEQ ID NO: 4681503 - DNA, 15 bp, Homo sapiens
cataacttaataaat

SEQ ID NO: 4681504 - DNA, 15 bp, Homo sapiens
catagcacaagataa

SEQ ID NO: 4681505 - DNA, 19 bp, Homo sapiens
catagcacaagataaattg

SEQ ID NO: 4681506 - DNA, 21 bp, Homo sapiens
catagcacaagataaattgag

SEQ ID NO: 4681507 - DNA, 19 bp, Homo sapiens
catagtctgtatccaaata

SEQ ID NO: 4681508 - DNA, 14 bp, Homo sapiens
catccagtgaaact

SEQ ID NO: 4681509 - DNA, 23 bp, Homo sapiens
catgcgtccactttcccttcccc

SEQ ID NO: 4681510 - DNA, 20 bp, Homo sapiens
catgtagggtgatgagcact

SEQ ID NO: 4681511 - DNA, 22 bp, Homo sapiens
ccaagaagtctgtccatatgaa

SEQ ID NO: 4681512 - DNA, 13 bp, Homo sapiens
ccacaaagggtag

SEQ ID NO: 4681513 - DNA, 17 bp, Homo sapiens
ccacatccccaccttcc

SEQ ID NO: 4681514 - DNA, 16 bp, Homo sapiens
ccactctgctcccagc

SEQ ID NO: 4681515 - DNA, 19 bp, Homo sapiens
ccagagagaggcgtcctgg

SEQ ID NO: 4681516 - DNA, 22 bp, Homo sapiens
ccagcccctaccttgagaccct

SEQ ID NO: 4681517 - DNA, 17 bp, Homo sapiens
ccagcctatatttcctc

SEQ ID NO: 4681518 - DNA, 15 bp, Homo sapiens
ccaggagaccttcca

SEQ ID NO: 4681519 - DNA, 12 bp, Homo sapiens
ccaggccttctg

SEQ ID NO: 4681520 - DNA, 17 bp, Homo sapiens
ccagggctgtgggtggg

SEQ ID NO: 4681521 - DNA, 21 bp, Homo sapiens
cccaccattccacatccccac

SEQ ID NO: 4681522 - DNA, 23 bp, Homo sapiens
cccagagagaggcgtcctggtga

SEQ ID NO: 4681523 - DNA, 18 bp, Homo sapiens
cccctgtgactcctccct

SEQ ID NO: 4681524 - DNA, 13 bp, Homo sapiens
ccctcccccacca

SEQ ID NO: 4681525 - DNA, 13 bp, Homo sapiens
ccctcctgttgcc

SEQ ID NO: 4681526 - DNA, 17 bp, Homo sapiens
ccctcctgttgccacac

SEQ ID NO: 4681527 - DNA, 19 bp, Homo sapiens
ccctcctgttgccacactt

SEQ ID NO: 4681528 - DNA, 13 bp, Homo sapiens
ccctcttctctgg

SEQ ID NO: 4681529 - DNA, 15 bp, Homo sapiens
cccttccccactctg

SEQ ID NO: 4681530 - DNA, 14 bp, Homo sapiens
ccgtgcagctggga

SEQ ID NO: 4681531 - DNA, 22 bp, Homo sapiens
cctaccttgagaccctcttctc

SEQ ID NO: 4681532 - DNA, 14 bp, Homo sapiens
cctagaactccagt

SEQ ID NO: 4681533 - DNA, 15 bp, Homo sapiens
cctatatttcctctt

SEQ ID NO: 4681534 - DNA, 16 bp, Homo sapiens
cctatatttcctcttc

SEQ ID NO: 4681535 - DNA, 17 bp, Homo sapiens
cctcatggactccagga

SEQ ID NO: 4681536 - DNA, 12 bp, Homo sapiens
cctcccccacca

SEQ ID NO: 4681537 - DNA, 16 bp, Homo sapiens
cctcccccaccattcc

SEQ ID NO: 4681538 - DNA, 12 bp, Homo sapiens
cctccctcttcc

SEQ ID NO: 4681539 - DNA, 14 bp, Homo sapiens
cctccctcttccca

SEQ ID NO: 4681540 - DNA, 19 bp, Homo sapiens
cctccctcttcccagcaca

SEQ ID NO: 4681541 - DNA, 15 bp, Homo sapiens
cctcctgttgccaca

SEQ ID NO: 4681542 - DNA, 21 bp, Homo sapiens
cctctgtcagtcatgcgtcca

SEQ ID NO: 4681543 - DNA, 17 bp, Homo sapiens
cctcttctctgggccca

SEQ ID NO: 4681544 - DNA, 20 bp, Homo sapiens
cctcttctctgggcccagag

SEQ ID NO: 4681545 - DNA, 20 bp, Homo sapiens
cctgatactcctaaaacttt

SEQ ID NO: 4681546 - DNA, 22 bp, Homo sapiens
cctgttgccacactttcactgg

SEQ ID NO: 4681547 - DNA, 13 bp, Homo sapiens
ccttccccactct

SEQ ID NO: 4681548 - DNA, 18 bp, Homo sapiens
ccttccccactctgctcc

SEQ ID NO: 4681549 - DNA, 17 bp, Homo sapiens
ccttgagaccctcttct

SEQ ID NO: 4681550 - DNA, 20 bp, Homo sapiens
ccttgagaccctcttctctg

SEQ ID NO: 4681551 - DNA, 14 bp, Homo sapiens
cctttcaaagaact

SEQ ID NO: 4681552 - DNA, 16 bp, Homo sapiens
cctttcaaagaactcc

SEQ ID NO: 4681553 - DNA, 11 bp, Homo sapiens
cgactcccggt

SEQ ID NO: 4681554 - DNA, 18 bp, Homo sapiens
cgagctctgtcctctgtc

SEQ ID NO: 4681555 - DNA, 12 bp, Homo sapiens
cggaagaactga

SEQ ID NO: 4681556 - DNA, 14 bp, Homo sapiens
cgtccactttccct

SEQ ID NO: 4681557 - DNA, 13 bp, Homo sapiens
cgtgtccaggaga

SEQ ID NO: 4681558 - DNA, 14 bp, Homo sapiens
ctaataaaatgtga

SEQ ID NO: 4681559 - DNA, 20 bp, Homo sapiens
ctaataaaattcagaattct

SEQ ID NO: 4681560 - DNA, 21 bp, Homo sapiens
ctaccttgagaccctcttctc

SEQ ID NO: 4681561 - DNA, 22 bp, Homo sapiens
ctaccttgagaccctcttctct

SEQ ID NO: 4681562 - DNA, 16 bp, Homo sapiens
ctagacccttcatctc

SEQ ID NO: 4681563 - DNA, 15 bp, Homo sapiens
ctattttaacttgct

SEQ ID NO: 4681564 - DNA, 20 bp, Homo sapiens
ctcaaattagaatagaactt

SEQ ID NO: 4681565 - DNA, 23 bp, Homo sapiens
ctcacaattgttgactaaaatgc

SEQ ID NO: 4681566 - DNA, 20 bp, Homo sapiens
ctcatggactccaggatcct

SEQ ID NO: 4681567 - DNA, 15 bp, Homo sapiens
ctccacagggactgt

SEQ ID NO: 4681568 - DNA, 14 bp, Homo sapiens
ctccaggatcctcc

SEQ ID NO: 4681569 - DNA, 21 bp, Homo sapiens
ctccagtaaaagttgtgcctc

SEQ ID NO: 4681570 - DNA, 19 bp, Homo sapiens
ctcccttccccactctgct

SEQ ID NO: 4681571 - DNA, 17 bp, Homo sapiens
ctcctcccttccccact

SEQ ID NO: 4681572 - DNA, 19 bp, Homo sapiens
ctcctggagcagcagctga

SEQ ID NO: 4681573 - DNA, 22 bp, Homo sapiens
ctcctggagcagcagctgaggc

SEQ ID NO: 4681574 - DNA, 16 bp, Homo sapiens
ctcctgttgccacact

SEQ ID NO: 4681575 - DNA, 14 bp, Homo sapiens
ctctgctcccagcc

SEQ ID NO: 4681576 - DNA, 16 bp, Homo sapiens
ctctgctcccagcccc

SEQ ID NO: 4681577 - DNA, 16 bp, Homo sapiens
ctctgggcccagagag

SEQ ID NO: 4681578 - DNA, 14 bp, Homo sapiens
ctctgtcctctgtc

SEQ ID NO: 4681579 - DNA, 23 bp, Homo sapiens
tagtctgtatccaaataatgaat

SEQ ID NO: 4681580 - DNA, 19 bp, Homo sapiens
tatacctttcaaagaactc

SEQ ID NO: 4681581 - DNA, 19 bp, Homo sapiens
tataggataagaaataaga

SEQ ID NO: 4681582 - DNA, 12 bp, Homo sapiens
tatattaaagaa

SEQ ID NO: 4681583 - DNA, 13 bp, Homo sapiens
tatattaaagaaa

SEQ ID NO: 4681584 - DNA, 18 bp, Homo sapiens
tatattaaagaaaaactt

SEQ ID NO: 4681585 - DNA, 22 bp, Homo sapiens
tatattaaagaaaaactttaaa

SEQ ID NO: 4681586 - DNA, 18 bp, Homo sapiens
tatattctctaataaaat

SEQ ID NO: 4681587 - DNA, 14 bp, Homo sapiens
tatccaaataatga

SEQ ID NO: 4681588 - DNA, 15 bp, Homo sapiens
tatccaaataatgaa

SEQ ID NO: 4681589 - DNA, 14 bp, Homo sapiens
tatcttaaatatga

SEQ ID NO: 4681590 - DNA, 17 bp, Homo sapiens
tatgtaatgtaaaccag

SEQ ID NO: 4681591 - DNA, 15 bp, Homo sapiens
tattaaagaaaaact

SEQ ID NO: 4681592 - DNA, 22 bp, Homo sapiens
tattaagcagaggatggaagta

SEQ ID NO: 4681593 - DNA, 18 bp, Homo sapiens
tattatctgtaaaaattg

SEQ ID NO: 4681594 - DNA, 21 bp, Homo sapiens
tattgatgataatacccacat

SEQ ID NO: 4681595 - DNA, 14 bp, Homo sapiens
tattgtattttaga

SEQ ID NO: 4681596 - DNA, 15 bp, Homo sapiens
tatttggacgtcagc

SEQ ID NO: 4681597 - DNA, 14 bp, Homo sapiens
tcacatagctggga

SEQ ID NO: 4681598 - DNA, 22 bp, Homo sapiens
tcagtcatgcgtccactttccc

SEQ ID NO: 4681599 - DNA, 21 bp, Homo sapiens
tcatgcttgacacaactgctg

SEQ ID NO: 4681600 - DNA, 17 bp, Homo sapiens
tccacatccccaccttc

SEQ ID NO: 4681601 - DNA, 17 bp, Homo sapiens
tccactttcccttcccc

SEQ ID NO: 4681602 - DNA, 18 bp, Homo sapiens
tccaggagaccttccaca

SEQ ID NO: 4681603 - DNA, 14 bp, Homo sapiens
tccaggatcctcct

SEQ ID NO: 4681604 - DNA, 16 bp, Homo sapiens
tccagtaaaagttgtg

SEQ ID NO: 4681605 - DNA, 22 bp, Homo sapiens
tccatagcacaagataaattga

SEQ ID NO: 4681606 - DNA, 14 bp, Homo sapiens
tcccagcccctacc

SEQ ID NO: 4681607 - DNA, 16 bp, Homo sapiens
tccccaccttccaagg

SEQ ID NO: 4681608 - DNA, 21 bp, Homo sapiens
tcccctgtgactcctcccttc

SEQ ID NO: 4681609 - DNA, 14 bp, Homo sapiens
tcccgtgctggaag

SEQ ID NO: 4681610 - DNA, 17 bp, Homo sapiens
tccctcctgttgccaca

SEQ ID NO: 4681611 - DNA, 18 bp, Homo sapiens
tccctcctgttgccacac

SEQ ID NO: 4681612 - DNA, 13 bp, Homo sapiens
tccctcttcccag

SEQ ID NO: 4681613 - DNA, 19 bp, Homo sapiens
tcccttccccactctgctc

SEQ ID NO: 4681614 - DNA, 14 bp, Homo sapiens
tcccttcccctgtg

SEQ ID NO: 4681615 - DNA, 18 bp, Homo sapiens
tcccttgacctttccagc

SEQ ID NO: 4681616 - DNA, 14 bp, Homo sapiens
tcctcccttcccca

SEQ ID NO: 4681617 - DNA, 17 bp, Homo sapiens
tccttttttaactgtgt

SEQ ID NO: 4681618 - DNA, 16 bp, Homo sapiens
tcggtattttaactga

SEQ ID NO: 4681619 - DNA, 14 bp, Homo sapiens
tctagttttctaga

SEQ ID NO: 4681620 - DNA, 16 bp, Homo sapiens
tctctgggcccagaga

SEQ ID NO: 4681621 - DNA, 19 bp, Homo sapiens
tctcttacttgatagactt

SEQ ID NO: 4681622 - DNA, 17 bp, Homo sapiens
tctgagccctccctctt

SEQ ID NO: 4681623 - DNA, 19 bp, Homo sapiens
tctgagccctccctcttcc

SEQ ID NO: 4681624 - DNA, 13 bp, Homo sapiens
tctgctcccagcc

SEQ ID NO: 4681625 - DNA, 14 bp, Homo sapiens
tctgctcccagccc

SEQ ID NO: 4681626 - DNA, 20 bp, Homo sapiens
tctgctcccagcccctacct

SEQ ID NO: 4681627 - DNA, 22 bp, Homo sapiens
tctgtaaaaattgttataatta

SEQ ID NO: 4681628 - DNA, 15 bp, Homo sapiens
tctttaaaagaaact

SEQ ID NO: 4681629 - DNA, 23 bp, Homo sapiens
tctttaaaagaaacttaactgtt

SEQ ID NO: 4681630 - DNA, 18 bp, Homo sapiens
tctttgaacgtacccaag

SEQ ID NO: 4681631 - DNA, 19 bp, Homo sapiens
tgaaactgtgtattatttg

SEQ ID NO: 4681632 - DNA, 21 bp, Homo sapiens
tgaaatatttgtgtgtttgtg

SEQ ID NO: 4681633 - DNA, 16 bp, Homo sapiens
tgaaccaggccttctg

SEQ ID NO: 4681634 - DNA, 20 bp, Homo sapiens
tgaacgtacccaaggtcaca

SEQ ID NO: 4681635 - DNA, 21 bp, Homo sapiens
tgaacgtacccaaggtcacat

SEQ ID NO: 4681636 - DNA, 22 bp, Homo sapiens
tgaaggaagttcagtcttgtct

SEQ ID NO: 4681637 - DNA, 13 bp, Homo sapiens
tgaattacagaga

SEQ ID NO: 4681638 - DNA, 21 bp, Homo sapiens
tgaattacagagatataaatg

SEQ ID NO: 4681639 - DNA, 23 bp, Homo sapiens
tgaattacagagatataaatgaa

SEQ ID NO: 4681640 - DNA, 21 bp, Homo sapiens
tgagaccctcttctctgggcc

SEQ ID NO: 4681641 - DNA, 18 bp, Homo sapiens
tgagccctccctcttccc

SEQ ID NO: 4681642 - DNA, 17 bp, Homo sapiens
tgagccgtgcagctggg

SEQ ID NO: 4681643 - DNA, 13 bp, Homo sapiens
tgagcgggtgggg

SEQ ID NO: 4681644 - DNA, 15 bp, Homo sapiens
tgagcgggtggggtg

SEQ ID NO: 4681645 - DNA, 17 bp, Homo sapiens
tgatattgtcttcatgt

SEQ ID NO: 4681646 - DNA, 14 bp, Homo sapiens
tgatccagggattg

SEQ ID NO: 4681647 - DNA, 20 bp, Homo sapiens
tgattctatgtaatgtaaac

SEQ ID NO: 4681648 - DNA, 15 bp, Homo sapiens
tgatttatatttcat

SEQ ID NO: 4681649 - DNA, 15 bp, Homo sapiens
tgatttcaagatgtt

SEQ ID NO: 4681650 - DNA, 22 bp, Homo sapiens
tgatttcaagatgttatattaa

SEQ ID NO: 4681651 - DNA, 20 bp, Homo sapiens
tgcacagtccctcctgttgc

SEQ ID NO: 4681652 - DNA, 12 bp, Homo sapiens
aaaaagttgtgt

SEQ ID NO: 4681653 - DNA, 13 bp, Homo sapiens
aaaaattgttata

SEQ ID NO: 4681654 - DNA, 14 bp, Homo sapiens
aaaacataggaaag

SEQ ID NO: 4681655 - DNA, 16 bp, Homo sapiens
aaaagctctagataaa

SEQ ID NO: 4681656 - DNA, 22 bp, Homo sapiens
aaaatgctgcttttaaaacata

SEQ ID NO: 4681657 - DNA, 16 bp, Homo sapiens
aaaattgttataatta

SEQ ID NO: 4681658 - DNA, 14 bp, Homo sapiens
aaacataggaaagt

SEQ ID NO: 4681659 - DNA, 19 bp, Homo sapiens
aaacattttaaatgttaaa

SEQ ID NO: 4681660 - DNA, 19 bp, Homo sapiens
aaactttaaaaattattat

SEQ ID NO: 4681661 - DNA, 20 bp, Homo sapiens
aaagagatgactaagtcaag

SEQ ID NO: 4681662 - DNA, 16 bp, Homo sapiens
aaagataaagacaaag

SEQ ID NO: 4681663 - DNA, 15 bp, Homo sapiens
aaaggcaggaggtgg

SEQ ID NO: 4681664 - DNA, 19 bp, Homo sapiens
aaagttatcttaaatatga

SEQ ID NO: 4681665 - DNA, 17 bp, Homo sapiens
aaataaaaagtaactga

SEQ ID NO: 4681666 - DNA, 14 bp, Homo sapiens
aaataaagtaactt

SEQ ID NO: 4681667 - DNA, 19 bp, Homo sapiens
aaataaatgttcatgattt

SEQ ID NO: 4681668 - DNA, 12 bp, Homo sapiens
aaataatgaatc

SEQ ID NO: 4681669 - DNA, 13 bp, Homo sapiens
aaatatgaattct

SEQ ID NO: 4681670 - DNA, 19 bp, Homo sapiens
aaatatgaattctgttgta

SEQ ID NO: 4681671 - DNA, 19 bp, Homo sapiens
aaatgaagtattatctgta

SEQ ID NO: 4681672 - DNA, 20 bp, Homo sapiens
aaatgaagtattatctgtaa

SEQ ID NO: 4681673 - DNA, 16 bp, Homo sapiens
aaatgctgcttttaaa

SEQ ID NO: 4681674 - DNA, 18 bp, Homo sapiens
aaatgctgcttttaaaac

SEQ ID NO: 4681675 - DNA, 17 bp, Homo sapiens
aaatgttgaaggaactt

SEQ ID NO: 4681676 - DNA, 16 bp, Homo sapiens
aaattagaatagaact

SEQ ID NO: 4681677 - DNA, 21 bp, Homo sapiens
aaattgagctagttaaggcaa

SEQ ID NO: 4681678 - DNA, 12 bp, Homo sapiens
aaccagaaaaaa

SEQ ID NO: 4681679 - DNA, 15 bp, Homo sapiens
aaccaggccttctga

SEQ ID NO: 4681680 - DNA, 16 bp, Homo sapiens
aaccagtcaagttgtg

SEQ ID NO: 4681681 - DNA, 17 bp, Homo sapiens
aaccagtcaagttgtgt

SEQ ID NO: 4681682 - DNA, 16 bp, Homo sapiens
aaccctttaatgaact

SEQ ID NO: 4681683 - DNA, 20 bp, Homo sapiens
aactccacagggactgttct

SEQ ID NO: 4681684 - DNA, 22 bp, Homo sapiens
aacttgctcttgcttgtaaatc

SEQ ID NO: 4681685 - DNA, 15 bp, Homo sapiens
aactttaaaaattat

SEQ ID NO: 4681686 - DNA, 21 bp, Homo sapiens
aagaagtctgtccatatgaaa

SEQ ID NO: 4681687 - DNA, 19 bp, Homo sapiens
aagacttagatctgagccc

SEQ ID NO: 4681688 - DNA, 18 bp, Homo sapiens
aagatgttatattaaaga

SEQ ID NO: 4681689 - DNA, 20 bp, Homo sapiens
aagatgttatattaaagaaa

SEQ ID NO: 4681690 - DNA, 13 bp, Homo sapiens
aaggaaggcgtgt

SEQ ID NO: 4681691 - DNA, 17 bp, Homo sapiens
aagggaacagaaactac

SEQ ID NO: 4681692 - DNA, 18 bp, Homo sapiens
aaggtccgagctctgtcc

SEQ ID NO: 4681693 - DNA, 20 bp, Homo sapiens
aagtattatctgtaaaaatt

SEQ ID NO: 4681694 - DNA, 18 bp, Homo sapiens
aagtcctcctagaactcc

SEQ ID NO: 4681695 - DNA, 20 bp, Homo sapiens
aagttcagtcttgtctttga

SEQ ID NO: 4681696 - DNA, 14 bp, Homo sapiens
aataaatattgtat

SEQ ID NO: 4681697 - DNA, 10 bp, Homo sapiens
aataaatgtt

SEQ ID NO: 4681698 - DNA, 16 bp, Homo sapiens
aatagtcatgattcta

SEQ ID NO: 4681699 - DNA, 15 bp, Homo sapiens
aatatgaattctgtt

SEQ ID NO: 4681700 - DNA, 13 bp, Homo sapiens
aatgaaaccacat

SEQ ID NO: 4681701 - DNA, 20 bp, Homo sapiens
aatgaatcttcgggtgtttc

SEQ ID NO: 4681702 - DNA, 17 bp, Homo sapiens
aatgacttttgaattac

SEQ ID NO: 4681703 - DNA, 21 bp, Homo sapiens
aatgacttttgaattacagag

SEQ ID NO: 4681704 - DNA, 17 bp, Homo sapiens
aatgctgcttttaaaac

SEQ ID NO: 4681705 - DNA, 22 bp, Homo sapiens
aatgtaaaccagaaaaaataaa

SEQ ID NO: 4681706 - DNA, 20 bp, Homo sapiens
aattacagagatataaatga

SEQ ID NO: 4681707 - DNA, 21 bp, Homo sapiens
aattacagagatataaatgaa

SEQ ID NO: 4681708 - DNA, 12 bp, Homo sapiens
aattattatata

SEQ ID NO: 4681709 - DNA, 15 bp, Homo sapiens
aattctcaaataata

SEQ ID NO: 4681710 - DNA, 16 bp, Homo sapiens
aattctcaaataataa

SEQ ID NO: 4681711 - DNA, 18 bp, Homo sapiens
aattctgttgtaatttaa

SEQ ID NO: 4681712 - DNA, 22 bp, Homo sapiens
aattctgttgtaatttaatgac

SEQ ID NO: 4681713 - DNA, 13 bp, Homo sapiens
acactttcactgg

SEQ ID NO: 4681714 - DNA, 18 bp, Homo sapiens
acactttcactggggatc

SEQ ID NO: 4681715 - DNA, 10 bp, Homo sapiens
acagaaacta

SEQ ID NO: 4681716 - DNA, 13 bp, Homo sapiens
acagacagttaat

SEQ ID NO: 4681717 - DNA, 22 bp, Homo sapiens
acagatctaccttggtgatttg

SEQ ID NO: 4681718 - DNA, 12 bp, Homo sapiens
acataggaaagt

SEQ ID NO: 4681719 - DNA, 14 bp, Homo sapiens
acattttaaatgtt

SEQ ID NO: 4681720 - DNA, 21 bp, Homo sapiens
accacatatgaaaaaatccat

SEQ ID NO: 4681721 - DNA, 19 bp, Homo sapiens
accagaaaaaataaatgtt

SEQ ID NO: 4681722 - DNA, 13 bp, Homo sapiens
accccaacaccgg

SEQ ID NO: 4681723 - DNA, 16 bp, Homo sapiens
accctcttctctgggc

SEQ ID NO: 4681724 - DNA, 19 bp, Homo sapiens
accctcttctctgggccca

SEQ ID NO: 4681725 - DNA, 20 bp, Homo sapiens
accttgagaccctcttctct

SEQ ID NO: 4681726 - DNA, 12 bp, Homo sapiens
actaataaaatg

SEQ ID NO: 4681727 - DNA, 14 bp, Homo sapiens
ccttgagaccctct

SEQ ID NO: 4681728 - DNA, 19 bp, Homo sapiens
ccttgagaccctcttctct

SEQ ID NO: 4681729 - DNA, 21 bp, Homo sapiens
ccttgagaccctcttctctgg

SEQ ID NO: 4681730 - DNA, 21 bp, Homo sapiens
ccttgggcaagtcccttgacc

SEQ ID NO: 4681731 - DNA, 14 bp, Homo sapiens
cctttccttcagtc

SEQ ID NO: 4681732 - DNA, 22 bp, Homo sapiens
ccttttttcctatgcaactttt

SEQ ID NO: 4681733 - DNA, 17 bp, Homo sapiens
cgagctctgtcctctgt

SEQ ID NO: 4681734 - DNA, 22 bp, Homo sapiens
cgtgtccaggagaccttccaca

SEQ ID NO: 4681735 - DNA, 15 bp, Homo sapiens
ctaataaaatgtgaa

SEQ ID NO: 4681736 - DNA, 16 bp, Homo sapiens
ctaataactttttcca

SEQ ID NO: 4681737 - DNA, 15 bp, Homo sapiens
ctagaccctccccca

SEQ ID NO: 4681738 - DNA, 16 bp, Homo sapiens
ctagaccctcccccac

SEQ ID NO: 4681739 - DNA, 16 bp, Homo sapiens
ctagataaaactttct

SEQ ID NO: 4681740 - DNA, 14 bp, Homo sapiens
ctatagcagtcatc

SEQ ID NO: 4681741 - DNA, 19 bp, Homo sapiens
ctatattatctagctttct

SEQ ID NO: 4681742 - DNA, 11 bp, Homo sapiens
ctcccccacca

SEQ ID NO: 4681743 - DNA, 18 bp, Homo sapiens
ctcccccaccattccaca

SEQ ID NO: 4681744 - DNA, 13 bp, Homo sapiens
ctccctcttccca

SEQ ID NO: 4681745 - DNA, 19 bp, Homo sapiens
gtagggtgatgagcactca

SEQ ID NO: 4681746 - DNA, 21 bp, Homo sapiens
gtagtttttctgtaacacaga

SEQ ID NO: 4681747 - DNA, 15 bp, Homo sapiens
gtcacatagctggga

SEQ ID NO: 4681748 - DNA, 23 bp, Homo sapiens
gtcatgattctatgtaatgtaaa

SEQ ID NO: 4681749 - DNA, 17 bp, Homo sapiens
gtccaggagaccttcca

SEQ ID NO: 4681750 - DNA, 17 bp, Homo sapiens
gtcccttgacctttcca

SEQ ID NO: 4681751 - DNA, 17 bp, Homo sapiens
gtcctcctagaactcca

SEQ ID NO: 4681752 - DNA, 10 bp, Homo sapiens
gtgactcctc

SEQ ID NO: 4681753 - DNA, 14 bp, Homo sapiens
gtgagcgggtgggg

SEQ ID NO: 4681754 - DNA, 20 bp, Homo sapiens
gttatattaaagaaaaactt

SEQ ID NO: 4681755 - DNA, 19 bp, Homo sapiens
gttcatgggcacctcatgg

SEQ ID NO: 4681756 - DNA, 18 bp, Homo sapiens
gttgaaggaacttaaaac

SEQ ID NO: 4681757 - DNA, 15 bp, Homo sapiens
gttgcacagtccctc

SEQ ID NO: 4681758 - DNA, 15 bp, Homo sapiens
gttgtaatttaatga

SEQ ID NO: 4681759 - DNA, 19 bp, Homo sapiens
gtttattttttaactttta

SEQ ID NO: 4681760 - DNA, 18 bp, Homo sapiens
gtttgttgcacagtccct

SEQ ID NO: 4681761 - DNA, 12 bp, Homo sapiens
taaaattcagaa

SEQ ID NO: 4681762 - DNA, 21 bp, Homo sapiens
taaaccagaaaaaataaatgt

SEQ ID NO: 4681763 - DNA, 22 bp, Homo sapiens
taaagaaaaactttaaaaatta

SEQ ID NO: 4681764 - DNA, 12 bp, Homo sapiens
taaatatgaatt

SEQ ID NO: 4681765 - DNA, 14 bp, Homo sapiens
taaatattgtattt

SEQ ID NO: 4681766 - DNA, 15 bp, Homo sapiens
taaatattgtatttt

SEQ ID NO: 4681767 - DNA, 20 bp, Homo sapiens
taaatattgtattttagata

SEQ ID NO: 4681768 - DNA, 23 bp, Homo sapiens
taaatattgtattttagatatat

SEQ ID NO: 4681769 - DNA, 15 bp, Homo sapiens
taacacagaatatag

SEQ ID NO: 4681770 - DNA, 13 bp, Homo sapiens
taacttaataaat

SEQ ID NO: 4681771 - DNA, 14 bp, Homo sapiens
taacttaataaata

SEQ ID NO: 4681772 - DNA, 14 bp, Homo sapiens
taatataaactggt

SEQ ID NO: 4681773 - DNA, 18 bp, Homo sapiens
taatgtaaaccagaaaaa

SEQ ID NO: 4681774 - DNA, 23 bp, Homo sapiens
taattagagttgtgatacagagt

SEQ ID NO: 4681775 - DNA, 14 bp, Homo sapiens
taatttaatgactt

SEQ ID NO: 4681776 - DNA, 17 bp, Homo sapiens
tacagagatataaatga

SEQ ID NO: 4681777 - DNA, 18 bp, Homo sapiens
tacagagatataaatgaa

SEQ ID NO: 4681778 - DNA, 17 bp, Homo sapiens
tacatattgtgaatgta

SEQ ID NO: 4681779 - DNA, 23 bp, Homo sapiens
tacattgtaacctgtttgtcttt

SEQ ID NO: 4681780 - DNA, 23 bp, Homo sapiens
taccttgactttgttcacagcat

SEQ ID NO: 4681781 - DNA, 21 bp, Homo sapiens
taccttgagaccctcttctct

SEQ ID NO: 4681782 - DNA, 21 bp, Homo sapiens
tacgtataaaaagcaagaatt

SEQ ID NO: 4681783 - DNA, 15 bp, Homo sapiens
tactggcttgtcttt

SEQ ID NO: 4681784 - DNA, 17 bp, Homo sapiens
tagacttactaataaaa

SEQ ID NO: 4681785 - DNA, 20 bp, Homo sapiens
tagacttactaataaaatgt

SEQ ID NO: 4681786 - DNA, 12 bp, Homo sapiens
tagataaaactt

SEQ ID NO: 4681787 - DNA, 23 bp, Homo sapiens
tagcaaagttatcttaaatatga

SEQ ID NO: 4681788 - DNA, 20 bp, Homo sapiens
taggcagagggcaaagtcat

SEQ ID NO: 4681789 - DNA, 15 bp, Homo sapiens
tagttaaggcaaatc

SEQ ID NO: 4681790 - DNA, 12 bp, Homo sapiens
tatagcaaagtt

SEQ ID NO: 4681791 - DNA, 17 bp, Homo sapiens
tatagtttatttcccag

SEQ ID NO: 4681792 - DNA, 14 bp, Homo sapiens
tatatcataactta

SEQ ID NO: 4681793 - DNA, 14 bp, Homo sapiens
tatattaaagaaaa

SEQ ID NO: 4681794 - DNA, 17 bp, Homo sapiens
tatattactaataactt

SEQ ID NO: 4681795 - DNA, 17 bp, Homo sapiens
tatattctctaataaaa

SEQ ID NO: 4681796 - DNA, 16 bp, Homo sapiens
tatatttcctcttctg

SEQ ID NO: 4681797 - DNA, 15 bp, Homo sapiens
tatcttaaatatgaa

SEQ ID NO: 4681798 - DNA, 17 bp, Homo sapiens
tatcttaaatatgaatt

SEQ ID NO: 4681799 - DNA, 21 bp, Homo sapiens
tatgtaatgtaaaccagaaaa

SEQ ID NO: 4681800 - DNA, 14 bp, Homo sapiens
tattaaagaaaaac

SEQ ID NO: 4681801 - DNA, 21 bp, Homo sapiens
tattgtattttagatatattc

SEQ ID NO: 4681802 - DNA, 16 bp, Homo sapiens
tattttaaatgaagta

SEQ ID NO: 4681803 - DNA, 19 bp, Homo sapiens
tcaaataataaagtaattg

SEQ ID NO: 4681804 - DNA, 18 bp, Homo sapiens
tcaagatgttatattaaa

SEQ ID NO: 4681805 - DNA, 19 bp, Homo sapiens
tcaagatgttatattaaag

SEQ ID NO: 4681806 - DNA, 20 bp, Homo sapiens
tcaagatgttatattaaaga

SEQ ID NO: 4681807 - DNA, 22 bp, Homo sapiens
tcactggggatcccgtgctgga

SEQ ID NO: 4681808 - DNA, 19 bp, Homo sapiens
tcagagttgttaaccagaa

SEQ ID NO: 4681809 - DNA, 22 bp, Homo sapiens
tcataaaacccaaaccacatat

SEQ ID NO: 4681810 - DNA, 16 bp, Homo sapiens
tcataacttaataaat

SEQ ID NO: 4681811 - DNA, 21 bp, Homo sapiens
tcataacttaataaatattgt

SEQ ID NO: 4681812 - DNA, 24 bp, Homo sapiens
tccaagaagtctgtccatatgaaa

SEQ ID NO: 4681813 - DNA, 16 bp, Homo sapiens
tccaaggaaaagcaga

SEQ ID NO: 4681814 - DNA, 23 bp, Homo sapiens
tccaggatcctcctggagcagca

SEQ ID NO: 4681815 - DNA, 13 bp, Homo sapiens
tccatagcacaag

SEQ ID NO: 4681816 - DNA, 21 bp, Homo sapiens
tccatagcacaagataaattg

SEQ ID NO: 4681817 - DNA, 17 bp, Homo sapiens
tccccaccttccaagga

SEQ ID NO: 4681818 - DNA, 14 bp, Homo sapiens
tccccactctgctc

SEQ ID NO: 4681819 - DNA, 16 bp, Homo sapiens
tccccactctgctccc

SEQ ID NO: 4681820 - DNA, 17 bp, Homo sapiens
tcccccaccattccaca

SEQ ID NO: 4681821 - DNA, 14 bp, Homo sapiens
tccctcctgttgcc

SEQ ID NO: 4681822 - DNA, 15 bp, Homo sapiens
tcctagaactccagt

SEQ ID NO: 4681823 - DNA, 21 bp, Homo sapiens
tcctagaactccagtaaaagt

SEQ ID NO: 4681824 - DNA, 13 bp, Homo sapiens
tcctcccttcccc

SEQ ID NO: 4681825 - DNA, 14 bp, Homo sapiens
tcctcctagaactc

SEQ ID NO: 4681826 - DNA, 14 bp, Homo sapiens
tcctcctggagcag

SEQ ID NO: 4681827 - DNA, 18 bp, Homo sapiens
tcctttccttcagtcact

SEQ ID NO: 4681828 - DNA, 16 bp, Homo sapiens
tctaataaaattcaga

SEQ ID NO: 4681829 - DNA, 14 bp, Homo sapiens
tctatagcagtcat

SEQ ID NO: 4681830 - DNA, 14 bp, Homo sapiens
ctccctcttcccag

SEQ ID NO: 4681831 - DNA, 15 bp, Homo sapiens
ctccctcttcccagc

SEQ ID NO: 4681832 - DNA, 17 bp, Homo sapiens
ctccctcttcccagcac

SEQ ID NO: 4681833 - DNA, 12 bp, Homo sapiens
ctcccttcccca

SEQ ID NO: 4681834 - DNA, 19 bp, Homo sapiens
ctcctcccttccccactct

SEQ ID NO: 4681835 - DNA, 15 bp, Homo sapiens
ctcctgttgccacac

SEQ ID NO: 4681836 - DNA, 12 bp, Homo sapiens
ctcggctcccgg

SEQ ID NO: 4681837 - DNA, 16 bp, Homo sapiens
ctctagataaaacttt

SEQ ID NO: 4681838 - DNA, 12 bp, Homo sapiens
ctctgggcccag

SEQ ID NO: 4681839 - DNA, 19 bp, Homo sapiens
ctctgtcctctgtcagtca

SEQ ID NO: 4681840 - DNA, 13 bp, Homo sapiens
ctcttctctgggc

SEQ ID NO: 4681841 - DNA, 16 bp, Homo sapiens
ctcttctctgggccca

SEQ ID NO: 4681842 - DNA, 19 bp, Homo sapiens
ctgagccctccctcttccc

SEQ ID NO: 4681843 - DNA, 18 bp, Homo sapiens
ctgagccgtgcagctggg

SEQ ID NO: 4681844 - DNA, 22 bp, Homo sapiens
ctgagccgtgcagctgggattt

SEQ ID NO: 4681845 - DNA, 21 bp, Homo sapiens
ctgccacttattttttgtcaa

SEQ ID NO: 4681846 - DNA, 16 bp, Homo sapiens
ctggagcagcagctga

SEQ ID NO: 4681847 - DNA, 19 bp, Homo sapiens
ctggggatcccgtgctgga

SEQ ID NO: 4681848 - DNA, 19 bp, Homo sapiens
ctgtatccaaataatgaat

SEQ ID NO: 4681849 - DNA, 17 bp, Homo sapiens
ctgtcagtcatgcgtcc

SEQ ID NO: 4681850 - DNA, 12 bp, Homo sapiens
ctgtgggtgggg

SEQ ID NO: 4681851 - DNA, 23 bp, Homo sapiens
ctgttgccacactttcactgggg

SEQ ID NO: 4681852 - DNA, 15 bp, Homo sapiens
cttaaatatgaattc

SEQ ID NO: 4681853 - DNA, 16 bp, Homo sapiens
cttactaataaaatgt

SEQ ID NO: 4681854 - DNA, 19 bp, Homo sapiens
cttactaataaaatgtgaa

SEQ ID NO: 4681855 - DNA, 16 bp, Homo sapiens
cttagatctgagccct

SEQ ID NO: 4681856 - DNA, 16 bp, Homo sapiens
cttccccactctgctc

SEQ ID NO: 4681857 - DNA, 18 bp, Homo sapiens
cttccccactctgctccc

SEQ ID NO: 4681858 - DNA, 21 bp, Homo sapiens
cttccccactctgctcccagc

SEQ ID NO: 4681859 - DNA, 22 bp, Homo sapiens
cttcctagattttgttgtttaa

SEQ ID NO: 4681860 - DNA, 17 bp, Homo sapiens
cttgagaccctcttctc

SEQ ID NO: 4681861 - DNA, 20 bp, Homo sapiens
cttgatagacttactaataa

SEQ ID NO: 4681862 - DNA, 17 bp, Homo sapiens
ctttaaaaattattata

SEQ ID NO: 4681863 - DNA, 20 bp, Homo sapiens
ctttaaaaattattatatat

SEQ ID NO: 4681864 - DNA, 21 bp, Homo sapiens
ctttaaaaattattatatatt

SEQ ID NO: 4681865 - DNA, 22 bp, Homo sapiens
ctttaaaaattattatatattt

SEQ ID NO: 4681866 - DNA, 22 bp, Homo sapiens
ctttccagcctatatttcctct

SEQ ID NO: 4681867 - DNA, 16 bp, Homo sapiens
ctttcccttcccctgt

SEQ ID NO: 4681868 - DNA, 18 bp, Homo sapiens
ctttcttaaaactgacat

SEQ ID NO: 4681869 - DNA, 18 bp, Homo sapiens
ctttctttaaaagaaact

SEQ ID NO: 4681870 - DNA, 15 bp, Homo sapiens
ctttgtcccagtcct

SEQ ID NO: 4681871 - DNA, 18 bp, Homo sapiens
cttttctggctggggatg

SEQ ID NO: 4681872 - DNA, 13 bp, Homo sapiens
gaaaagagtgaat

SEQ ID NO: 4681873 - DNA, 18 bp, Homo sapiens
gaaataagaataaagtac

SEQ ID NO: 4681874 - DNA, 23 bp, Homo sapiens
gaacctaccctcggctcccgggt

SEQ ID NO: 4681875 - DNA, 20 bp, Homo sapiens
gaagacttagatctgagccc

SEQ ID NO: 4681876 - DNA, 14 bp, Homo sapiens
gaattacagagata

SEQ ID NO: 4681877 - DNA, 17 bp, Homo sapiens
gaattacagagatataa

SEQ ID NO: 4681878 - DNA, 23 bp, Homo sapiens
gaattctgttgtaatttaatgac

SEQ ID NO: 4681879 - DNA, 15 bp, Homo sapiens
gaccctcccccacca

SEQ ID NO: 4681880 - DNA, 15 bp, Homo sapiens
gaccctcttctctgg

SEQ ID NO: 4681881 - DNA, 20 bp, Homo sapiens
gaccctcttctctgggccca

SEQ ID NO: 4681882 - DNA, 22 bp, Homo sapiens
gaccctcttctctgggcccaga

SEQ ID NO: 4681883 - DNA, 14 bp, Homo sapiens
gaccttccacaaag

SEQ ID NO: 4681884 - DNA, 19 bp, Homo sapiens
gaccttgggcaagtccctt

SEQ ID NO: 4681885 - DNA, 13 bp, Homo sapiens
gactcctcccttc

SEQ ID NO: 4681886 - DNA, 18 bp, Homo sapiens
gactcctcccttccccac

SEQ ID NO: 4681887 - DNA, 18 bp, Homo sapiens
gactttggcaagtgatat

SEQ ID NO: 4681888 - DNA, 18 bp, Homo sapiens
gagaccctcttctctggg

SEQ ID NO: 4681889 - DNA, 19 bp, Homo sapiens
gagagaggcgtcctggtga

SEQ ID NO: 4681890 - DNA, 19 bp, Homo sapiens
gagaggcgtcctggtgagg

SEQ ID NO: 4681891 - DNA, 14 bp, Homo sapiens
gagatataaatgaa

SEQ ID NO: 4681892 - DNA, 14 bp, Homo sapiens
gagcagcagctgag

SEQ ID NO: 4681893 - DNA, 20 bp, Homo sapiens
gagccctccctcttcccagc

SEQ ID NO: 4681894 - DNA, 22 bp, Homo sapiens
gagccctccctcttcccagcac

SEQ ID NO: 4681895 - DNA, 14 bp, Homo sapiens
gaggacaaggtaca

SEQ ID NO: 4681896 - DNA, 21 bp, Homo sapiens
gaggtgggtgagcgggtgggg

SEQ ID NO: 4681897 - DNA, 19 bp, Homo sapiens
gatactcctaaaactttta

SEQ ID NO: 4681898 - DNA, 23 bp, Homo sapiens
gatagacttactaataaaatgtg

SEQ ID NO: 4681899 - DNA, 12 bp, Homo sapiens
gatctgagccct

SEQ ID NO: 4681900 - DNA, 13 bp, Homo sapiens
gatggggcccaca

SEQ ID NO: 4681901 - DNA, 17 bp, Homo sapiens
gatgttatattaaagaa

SEQ ID NO: 4681902 - DNA, 23 bp, Homo sapiens
gatttcaaggtccgagctctgtc

SEQ ID NO: 4681903 - DNA, 16 bp, Homo sapiens
gatttgaactgagccg

SEQ ID NO: 4681904 - DNA, 17 bp, Homo sapiens
gcaaagttatcttaaat

SEQ ID NO: 4681905 - DNA, 21 bp, Homo sapiens
gcactcacaattgttgactaa

SEQ ID NO: 4681906 - DNA, 12 bp, Homo sapiens
gcagctgaggcc

SEQ ID NO: 4681907 - DNA, 18 bp, Homo sapiens
gcatttatatttttcaaa

SEQ ID NO: 4681908 - DNA, 22 bp, Homo sapiens
gccaagtcctcctagaactcca

SEQ ID NO: 4681909 - DNA, 23 bp, Homo sapiens
gccagaaggcaagatcagattaa

SEQ ID NO: 4681910 - DNA, 24 bp, Homo sapiens
gccagaaggcaagatcagattaaa

SEQ ID NO: 4681911 - DNA, 16 bp, Homo sapiens
gccatgagttttcaga

SEQ ID NO: 4681912 - DNA, 19 bp, Homo sapiens
gccatgagttttcagatga

SEQ ID NO: 4681913 - DNA, 22 bp, Homo sapiens
gcccagagagaggcgtcctggt

SEQ ID NO: 4681914 - DNA, 16 bp, Homo sapiens
gccctagaccctcccc

SEQ ID NO: 4681915 - DNA, 21 bp, Homo sapiens
gccctagaccctcccccacca

SEQ ID NO: 4681916 - DNA, 15 bp, Homo sapiens
gcctggcttttctgg

SEQ ID NO: 4681917 - DNA, 20 bp, Homo sapiens
tgatagacttactaataaaa

SEQ ID NO: 4681918 - DNA, 20 bp, Homo sapiens
tgatttcaaggtccgagctc

SEQ ID NO: 4681919 - DNA, 18 bp, Homo sapiens
tgcaaatccatagcacaa

SEQ ID NO: 4681920 - DNA, 11 bp, Homo sapiens
tgcaacttttt

SEQ ID NO: 4681921 - DNA, 17 bp, Homo sapiens
tgcacagtccctcctgt

SEQ ID NO: 4681922 - DNA, 16 bp, Homo sapiens
tgcagctgggatttga

SEQ ID NO: 4681923 - DNA, 20 bp, Homo sapiens
tgccacactttcactgggga

SEQ ID NO: 4681924 - DNA, 23 bp, Homo sapiens
tgcctcaaattagaatagaactt

SEQ ID NO: 4681925 - DNA, 12 bp, Homo sapiens
tgcctctggttt

SEQ ID NO: 4681926 - DNA, 21 bp, Homo sapiens
tgcgtccactttcccttcccc

SEQ ID NO: 4681927 - DNA, 16 bp, Homo sapiens
tggaagcatcaataaa

SEQ ID NO: 4681928 - DNA, 20 bp, Homo sapiens
tggactccaggatcctcctg

SEQ ID NO: 4681929 - DNA, 15 bp, Homo sapiens
tggccgatggggccc

SEQ ID NO: 4681930 - DNA, 19 bp, Homo sapiens
tggcttttctggctgggga

SEQ ID NO: 4681931 - DNA, 23 bp, Homo sapiens
tgggcacctcatggactccagga

SEQ ID NO: 4681932 - DNA, 14 bp, Homo sapiens
tggggtgcttgctg

SEQ ID NO: 4681933 - DNA, 16 bp, Homo sapiens
tggttgagtgcaaatc

SEQ ID NO: 4681934 - DNA, 18 bp, Homo sapiens
tgtccaggagaccttcca

SEQ ID NO: 4681935 - DNA, 13 bp, Homo sapiens
tgtgggtggggaa

SEQ ID NO: 4681936 - DNA, 21 bp, Homo sapiens
tgttatattaaagaaaaactt

SEQ ID NO: 4681937 - DNA, 15 bp, Homo sapiens
tgttgcacagtccct

SEQ ID NO: 4681938 - DNA, 17 bp, Homo sapiens
tgttgccacactttcac

SEQ ID NO: 4681939 - DNA, 18 bp, Homo sapiens
ttaaatatgaattctgtt

SEQ ID NO: 4681940 - DNA, 16 bp, Homo sapiens
ttaaatattgtatttg

SEQ ID NO: 4681941 - DNA, 22 bp, Homo sapiens
ttaataaatattgtattttaga

SEQ ID NO: 4681942 - DNA, 12 bp, Homo sapiens
ttaatgactttt

SEQ ID NO: 4681943 - DNA, 18 bp, Homo sapiens
ttacagagatataaatga

SEQ ID NO: 4681944 - DNA, 15 bp, Homo sapiens
ttacccattgactaa

SEQ ID NO: 4681945 - DNA, 16 bp, Homo sapiens
ttactaataacttttt

SEQ ID NO: 4681946 - DNA, 20 bp, Homo sapiens
ttactccctatagagaaacc

SEQ ID NO: 4681947 - DNA, 14 bp, Homo sapiens
ttagaatagaactt

SEQ ID NO: 4681948 - DNA, 19 bp, Homo sapiens
ttagagccagaagtaactt

SEQ ID NO: 4681949 - DNA, 20 bp, Homo sapiens
ttataattagagttgtgata

SEQ ID NO: 4681950 - DNA, 17 bp, Homo sapiens
ttatagcaaagttatct

SEQ ID NO: 4681951 - DNA, 16 bp, Homo sapiens
ttatatttttcaaaat

SEQ ID NO: 4681952 - DNA, 13 bp, Homo sapiens
ttatcttaaatat

SEQ ID NO: 4681953 - DNA, 14 bp, Homo sapiens
ttatcttaaatatg

SEQ ID NO: 4681954 - DNA, 23 bp, Homo sapiens
ttcaaggtccgagctctgtcctc

SEQ ID NO: 4681955 - DNA, 22 bp, Homo sapiens
ttcagacaatatatcataactt

SEQ ID NO: 4681956 - DNA, 13 bp, Homo sapiens
ttcatgggcacct

SEQ ID NO: 4681957 - DNA, 15 bp, Homo sapiens
ttccattcagacaat

SEQ ID NO: 4681958 - DNA, 16 bp, Homo sapiens
ttcccagcacaggcag

SEQ ID NO: 4681959 - DNA, 17 bp, Homo sapiens
ttcccagcacaggcagg

SEQ ID NO: 4681960 - DNA, 19 bp, Homo sapiens
ttccccactctgctcccag

SEQ ID NO: 4681961 - DNA, 22 bp, Homo sapiens
ttccctttagctaagcacagat

SEQ ID NO: 4681962 - DNA, 12 bp, Homo sapiens
ttctctaataaa

SEQ ID NO: 4681963 - DNA, 16 bp, Homo sapiens
ttctgtaacacagaat

SEQ ID NO: 4681964 - DNA, 20 bp, Homo sapiens
ttctgttgtaatttaatgac

SEQ ID NO: 4681965 - DNA, 23 bp, Homo sapiens
ttctttaaaagaaacttaactgt

SEQ ID NO: 4681966 - DNA, 19 bp, Homo sapiens
ttgaattacagagatataa

SEQ ID NO: 4681967 - DNA, 19 bp, Homo sapiens
ttgatgataatacccacat

SEQ ID NO: 4681968 - DNA, 17 bp, Homo sapiens
ttgtattttagatatat

SEQ ID NO: 4681969 - DNA, 14 bp, Homo sapiens
ttgttataattaga

SEQ ID NO: 4681970 - DNA, 23 bp, Homo sapiens
tttaaaagaaacttaactgttct

SEQ ID NO: 4681971 - DNA, 22 bp, Homo sapiens
tttagatatattctctaataaa

SEQ ID NO: 4681972 - DNA, 13 bp, Homo sapiens
tttcaaagaactc

SEQ ID NO: 4681973 - DNA, 19 bp, Homo sapiens
tttcaagatgttatattaa

SEQ ID NO: 4681974 - DNA, 23 bp, Homo sapiens
tttcaatatattactaataactt

SEQ ID NO: 4681975 - DNA, 18 bp, Homo sapiens
tttgaattacagagatat

SEQ ID NO: 4681976 - DNA, 22 bp, Homo sapiens
tttgttgcacagtccctcctgt

SEQ ID NO: 4681977 - DNA, 20 bp, Homo sapiens
ttttaaccctttaatgaact

SEQ ID NO: 4681978 - DNA, 14 bp, Homo sapiens
ttttctggctgggg

SEQ ID NO: 4681979 - DNA, 18 bp, Homo sapiens
ttttgaaatatttgtgtg

SEQ ID NO: 4681980 - DNA, 13 bp, Homo sapiens
actttaaaaatta

SEQ ID NO: 4681981 - DNA, 13 bp, Homo sapiens
agaaaaaataaat

SEQ ID NO: 4681982 - DNA, 17 bp, Homo sapiens
agaaataagaataaagt

SEQ ID NO: 4681983 - DNA, 14 bp, Homo sapiens
agaagaaaaaactg

SEQ ID NO: 4681984 - DNA, 23 bp, Homo sapiens
agaagttcatgggcacctcatgg

SEQ ID NO: 4681985 - DNA, 18 bp, Homo sapiens
agacatttattaaccaaa

SEQ ID NO: 4681986 - DNA, 18 bp, Homo sapiens
agaccctcttctctgggc

SEQ ID NO: 4681987 - DNA, 15 bp, Homo sapiens
agacttactaataaa

SEQ ID NO: 4681988 - DNA, 18 bp, Homo sapiens
agacttactaataaaatg

SEQ ID NO: 4681989 - DNA, 23 bp, Homo sapiens
agacttactaataaaatgtgaag

SEQ ID NO: 4681990 - DNA, 13 bp, Homo sapiens
agacttagatctg

SEQ ID NO: 4681991 - DNA, 17 bp, Homo sapiens
agacttagatctgagcc

SEQ ID NO: 4681992 - DNA, 18 bp, Homo sapiens
agacttagatctgagccc

SEQ ID NO: 4681993 - DNA, 21 bp, Homo sapiens
agaggcgtcctggtgaggaca

SEQ ID NO: 4681994 - DNA, 23 bp, Homo sapiens
agagtacagtgtaacagtactct

SEQ ID NO: 4681995 - DNA, 12 bp, Homo sapiens
agatatattctc

SEQ ID NO: 4681996 - DNA, 14 bp, Homo sapiens
agatatattctcta

SEQ ID NO: 4681997 - DNA, 16 bp, Homo sapiens
agatgttatattaaag

SEQ ID NO: 4681998 - DNA, 20 bp, Homo sapiens
agcaaagttatcttaaatat

SEQ ID NO: 4681999 - DNA, 21 bp, Homo sapiens
agcaaagttatcttaaatatg

SEQ ID NO: 4682000 - DNA, 16 bp, Homo sapiens
agcacaagataaattg

SEQ ID NO: 4682001 - DNA, 19 bp, Homo sapiens
agcacctcactatctgaaa

SEQ ID NO: 4682002 - DNA, 16 bp, Homo sapiens
agcagcagctgaggcc

SEQ ID NO: 4682003 - DNA, 15 bp, Homo sapiens
agcatgtagggtgat

SEQ ID NO: 4682004 - DNA, 14 bp, Homo sapiens
agccctccctcttc

SEQ ID NO: 4682005 - DNA, 17 bp, Homo sapiens
agccctccctcttccca

SEQ ID NO: 4682006 - DNA, 20 bp, Homo sapiens
agccctccctcttcccagca

SEQ ID NO: 4682007 - DNA, 21 bp, Homo sapiens
agccctccctcttcccagcac

SEQ ID NO: 4682008 - DNA, 12 bp, Homo sapiens
agcgggtggggt

SEQ ID NO: 4682009 - DNA, 12 bp, Homo sapiens
agctaagcacag

SEQ ID NO: 4682010 - DNA, 20 bp, Homo sapiens
agctctagataaaactttct

SEQ ID NO: 4682011 - DNA, 23 bp, Homo sapiens
agctgaggccccagggctgtggg

SEQ ID NO: 4682012 - DNA, 22 bp, Homo sapiens
agctgggatttgaactgagccg

SEQ ID NO: 4682013 - DNA, 23 bp, Homo sapiens
agctgggatttgaactgagccgt

SEQ ID NO: 4682014 - DNA, 15 bp, Homo sapiens
aggatcctcctggag

SEQ ID NO: 4682015 - DNA, 18 bp, Homo sapiens
aggcaggaggtgggtgag

SEQ ID NO: 4682016 - DNA, 16 bp, Homo sapiens
agggctgtgggtgggg

SEQ ID NO: 4682017 - DNA, 21 bp, Homo sapiens
agggtagcctggcttttctgg

SEQ ID NO: 4682018 - DNA, 15 bp, Homo sapiens
aggtccgagctctgt

SEQ ID NO: 4682019 - DNA, 20 bp, Homo sapiens
aggtccgagctctgtcctct

SEQ ID NO: 4682020 - DNA, 14 bp, Homo sapiens
agtacttgaaatgt

SEQ ID NO: 4682021 - DNA, 18 bp, Homo sapiens
agtatatttccattcaga

SEQ ID NO: 4682022 - DNA, 20 bp, Homo sapiens
agtatatttccattcagaca

SEQ ID NO: 4682023 - DNA, 16 bp, Homo sapiens
agtattatctgtaaaa

SEQ ID NO: 4682024 - DNA, 15 bp, Homo sapiens
agtcatccagtgaaa

SEQ ID NO: 4682025 - DNA, 18 bp, Homo sapiens
agtctgtatccaaataat

SEQ ID NO: 4682026 - DNA, 17 bp, Homo sapiens
agtctgtccatatgaaa

SEQ ID NO: 4682027 - DNA, 20 bp, Homo sapiens
agttaaggcaaatcaggtaa

SEQ ID NO: 4682028 - DNA, 14 bp, Homo sapiens
agttatcttaaata

SEQ ID NO: 4682029 - DNA, 15 bp, Homo sapiens
agttatcttaaatat

SEQ ID NO: 4682030 - DNA, 15 bp, Homo sapiens
agttgtgatacagag

SEQ ID NO: 4682031 - DNA, 20 bp, Homo sapiens
agttgtgatacagagtatat

SEQ ID NO: 4682032 - DNA, 15 bp, Homo sapiens
ataaaaagcaagaat

SEQ ID NO: 4682033 - DNA, 18 bp, Homo sapiens
ataaatattgtattttag

SEQ ID NO: 4682034 - DNA, 15 bp, Homo sapiens
ataataaagtaattg

SEQ ID NO: 4682035 - DNA, 19 bp, Homo sapiens
atacctttcaaagaactcc

SEQ ID NO: 4682036 - DNA, 16 bp, Homo sapiens
atagacttactaataa

SEQ ID NO: 4682037 - DNA, 19 bp, Homo sapiens
atagacttactaataaaat

SEQ ID NO: 4682038 - DNA, 17 bp, Homo sapiens
atagcaaagttatctta

SEQ ID NO: 4682039 - DNA, 13 bp, Homo sapiens
atagcacaagata

SEQ ID NO: 4682040 - DNA, 15 bp, Homo sapiens
atagcacaagataaa

SEQ ID NO: 4682041 - DNA, 13 bp, Homo sapiens
atataaatgaagt

SEQ ID NO: 4682042 - DNA, 13 bp, Homo sapiens
atatatcataact

SEQ ID NO: 4682043 - DNA, 16 bp, Homo sapiens
atatatcataacttaa

SEQ ID NO: 4682044 - DNA, 13 bp, Homo sapiens
atatattctctaa

SEQ ID NO: 4682045 - DNA, 18 bp, Homo sapiens
atatattctctaataaaa

SEQ ID NO: 4682046 - DNA, 16 bp, Homo sapiens
atattctctaataaaa

SEQ ID NO: 4682047 - DNA, 17 bp, Homo sapiens
atattctctaataaaat

SEQ ID NO: 4682048 - DNA, 20 bp, Homo sapiens
atattgtattttagatatat

SEQ ID NO: 4682049 - DNA, 21 bp, Homo sapiens
atatttatagcaaagttatct

SEQ ID NO: 4682050 - DNA, 23 bp, Homo sapiens
atatttatagcaaagttatctta

SEQ ID NO: 4682051 - DNA, 16 bp, Homo sapiens
atatttccattcagac

SEQ ID NO: 4682052 - DNA, 17 bp, Homo sapiens
atatttcctcttctgta

SEQ ID NO: 4682053 - DNA, 14 bp, Homo sapiens
atcataacttaata

SEQ ID NO: 4682054 - DNA, 14 bp, Homo sapiens
atccaaataatgaa

SEQ ID NO: 4682055 - DNA, 20 bp, Homo sapiens
atctgagccctccctcttcc

SEQ ID NO: 4682056 - DNA, 21 bp, Homo sapiens
atctgagccctccctcttccc

SEQ ID NO: 4682057 - DNA, 14 bp, Homo sapiens
atctgtaaaaattg

SEQ ID NO: 4682058 - DNA, 14 bp, Homo sapiens
atcttaaatatgaa

SEQ ID NO: 4682059 - DNA, 17 bp, Homo sapiens
atcttaaatatgaattc

SEQ ID NO: 4682060 - DNA, 20 bp, Homo sapiens
atcttaaatatgaattctgt

SEQ ID NO: 4682061 - DNA, 16 bp, Homo sapiens
atgaattctgttgtaa

SEQ ID NO: 4682062 - DNA, 15 bp, Homo sapiens
atgacttttgaatta

SEQ ID NO: 4682063 - DNA, 17 bp, Homo sapiens
atgataatacccacatt

SEQ ID NO: 4682064 - DNA, 18 bp, Homo sapiens
atgattctatgtaatgta

SEQ ID NO: 4682065 - DNA, 22 bp, Homo sapiens
atgatttcaagatgttatatta

SEQ ID NO: 4682066 - DNA, 22 bp, Homo sapiens
atggactccaggatcctcctgg

SEQ ID NO: 4682067 - DNA, 18 bp, Homo sapiens
atgtaaaccagaaaaaat

SEQ ID NO: 4682068 - DNA, 22 bp, Homo sapiens
atgtaaaccagaaaaaataaat

SEQ ID NO: 4682069 - DNA, 21 bp, Homo sapiens
atgtaatgtaaaccagaaaaa

SEQ ID NO: 4682070 - DNA, 14 bp, Homo sapiens
atgttatattaaag

SEQ ID NO: 4682071 - DNA, 19 bp, Homo sapiens
atgttcatgatttcaagat

SEQ ID NO: 4682072 - DNA, 16 bp, Homo sapiens
attatatatttatagc

SEQ ID NO: 4682073 - DNA, 15 bp, Homo sapiens
attatctagctttct

SEQ ID NO: 4682074 - DNA, 20 bp, Homo sapiens
attctatgtaatgtaaacca

SEQ ID NO: 4682075 - DNA, 16 bp, Homo sapiens
attctgtcactcaaga

SEQ ID NO: 4682076 - DNA, 18 bp, Homo sapiens
attgagggagaagagaca

SEQ ID NO: 4682077 - DNA, 20 bp, Homo sapiens
attgtattttagatatattc

SEQ ID NO: 4682078 - DNA, 13 bp, Homo sapiens
attgttgactaaa

SEQ ID NO: 4682079 - DNA, 15 bp, Homo sapiens
attgttgactaaaat

SEQ ID NO: 4682080 - DNA, 23 bp, Homo sapiens
atttatagcaaagttatcttaaa

SEQ ID NO: 4682081 - DNA, 15 bp, Homo sapiens
atttgaactgagccg

SEQ ID NO: 4682082 - DNA, 22 bp, Homo sapiens
atttggaccctggttgctttgt

SEQ ID NO: 4682083 - DNA, 19 bp, Homo sapiens
attttaaatattgtatttg

SEQ ID NO: 4682084 - DNA, 14 bp, Homo sapiens
attttagatatatt

SEQ ID NO: 4682085 - DNA, 18 bp, Homo sapiens
attttagatatattctct

SEQ ID NO: 4682086 - DNA, 21 bp, Homo sapiens
atttttcaaaattatatgtat

SEQ ID NO: 4682087 - DNA, 20 bp, Homo sapiens
ctgaagcatgaaactgtgta

SEQ ID NO: 4682088 - DNA, 15 bp, Homo sapiens
ctgcggaagaactga

SEQ ID NO: 4682089 - DNA, 22 bp, Homo sapiens
ctggaagacttagatctgagcc

SEQ ID NO: 4682090 - DNA, 14 bp, Homo sapiens
ctggcttttctggc

SEQ ID NO: 4682091 - DNA, 17 bp, Homo sapiens
ctggcttttctggctgg

SEQ ID NO: 4682092 - DNA, 16 bp, Homo sapiens
ctgggatttgaaccag

SEQ ID NO: 4682093 - DNA, 20 bp, Homo sapiens
ctgggatttgaactgagccg

SEQ ID NO: 4682094 - DNA, 21 bp, Homo sapiens
ctggggagaggacttaactga

SEQ ID NO: 4682095 - DNA, 17 bp, Homo sapiens
ctggtgaggacaaggta

SEQ ID NO: 4682096 - DNA, 14 bp, Homo sapiens
ctgtatactggtgt

SEQ ID NO: 4682097 - DNA, 15 bp, Homo sapiens
ctgtgactcctccct

SEQ ID NO: 4682098 - DNA, 22 bp, Homo sapiens
ctgtgactcctcccttccccac

SEQ ID NO: 4682099 - DNA, 15 bp, Homo sapiens
ctgtgggtggggaag

SEQ ID NO: 4682100 - DNA, 22 bp, Homo sapiens
ctgttgtaatttaatgactttt

SEQ ID NO: 4682101 - DNA, 18 bp, Homo sapiens
cttaaatatgaattctgt

SEQ ID NO: 4682102 - DNA, 22 bp, Homo sapiens
cttaagttaaaggtacttttgt

SEQ ID NO: 4682103 - DNA, 23 bp, Homo sapiens
cttaataaatattgtattttaga

SEQ ID NO: 4682104 - DNA, 17 bp, Homo sapiens
cttactaataaaatgtg

SEQ ID NO: 4682105 - DNA, 20 bp, Homo sapiens
cttagatctgagccctccct

SEQ ID NO: 4682106 - DNA, 17 bp, Homo sapiens
cttccccactctgctcc

SEQ ID NO: 4682107 - DNA, 19 bp, Homo sapiens
cttccccactctgctccca

SEQ ID NO: 4682108 - DNA, 22 bp, Homo sapiens
cttccccactctgctcccagcc

SEQ ID NO: 4682109 - DNA, 17 bp, Homo sapiens
cttctgcgccgccctcc

SEQ ID NO: 4682110 - DNA, 15 bp, Homo sapiens
cttgacctttccagc

SEQ ID NO: 4682111 - DNA, 18 bp, Homo sapiens
cttgagaccctcttctct

SEQ ID NO: 4682112 - DNA, 18 bp, Homo sapiens
cttgatagacttactaat

SEQ ID NO: 4682113 - DNA, 23 bp, Homo sapiens
cttgtctttgatatcagcccctg

SEQ ID NO: 4682114 - DNA, 13 bp, Homo sapiens
ctttcactgggga

SEQ ID NO: 4682115 - DNA, 15 bp, Homo sapiens
ctttcactggggatc

SEQ ID NO: 4682116 - DNA, 20 bp, Homo sapiens
cttttgttcttaaactttca

SEQ ID NO: 4682117 - DNA, 14 bp, Homo sapiens
gaaaaactttaaaa

SEQ ID NO: 4682118 - DNA, 18 bp, Homo sapiens
aaaaattattatatattt

SEQ ID NO: 4682119 - DNA, 17 bp, Homo sapiens
aaaaattgttataatta

SEQ ID NO: 4682120 - DNA, 22 bp, Homo sapiens
aaaacataggaaagtagaatgg

SEQ ID NO: 4682121 - DNA, 17 bp, Homo sapiens
aaaataaaaagtaactg

SEQ ID NO: 4682122 - DNA, 17 bp, Homo sapiens
aaaatagtcatgattct

SEQ ID NO: 4682123 - DNA, 14 bp, Homo sapiens
aaaattattatata

SEQ ID NO: 4682124 - DNA, 17 bp, Homo sapiens
aaaattattatatattt

SEQ ID NO: 4682125 - DNA, 17 bp, Homo sapiens
aaactgacatttgttgt

SEQ ID NO: 4682126 - DNA, 10 bp, Homo sapiens
aaagaaaaac

SEQ ID NO: 4682127 - DNA, 12 bp, Homo sapiens
aaaggaacagaa

SEQ ID NO: 4682128 - DNA, 16 bp, Homo sapiens
aaaggcaattattctt

SEQ ID NO: 4682129 - DNA, 11 bp, Homo sapiens
aaagtaactga

SEQ ID NO: 4682130 - DNA, 12 bp, Homo sapiens
aaagttatctta

SEQ ID NO: 4682131 - DNA, 13 bp, Homo sapiens
aaataatgaatct

SEQ ID NO: 4682132 - DNA, 14 bp, Homo sapiens
aaatattgtatttg

SEQ ID NO: 4682133 - DNA, 12 bp, Homo sapiens
aaatatttgtgt

SEQ ID NO: 4682134 - DNA, 16 bp, Homo sapiens
aaatcaggtaaaatag

SEQ ID NO: 4682135 - DNA, 16 bp, Homo sapiens
aaatccatagcacaag

SEQ ID NO: 4682136 - DNA, 17 bp, Homo sapiens
aaatgctgcttttaaaa

SEQ ID NO: 4682137 - DNA, 16 bp, Homo sapiens
aaattattatatattt

SEQ ID NO: 4682138 - DNA, 15 bp, Homo sapiens
aacgtacccaaggtc

SEQ ID NO: 4682139 - DNA, 13 bp, Homo sapiens
aactgacttaaga

SEQ ID NO: 4682140 - DNA, 19 bp, Homo sapiens
aactgagccgtgcagctgg

SEQ ID NO: 4682141 - DNA, 21 bp, Homo sapiens
aactgagccgtgcagctggga

SEQ ID NO: 4682142 - DNA, 16 bp, Homo sapiens
aagaaaaaactgaagg

SEQ ID NO: 4682143 - DNA, 13 bp, Homo sapiens
aagaaataagaat

SEQ ID NO: 4682144 - DNA, 19 bp, Homo sapiens
aagatgttatattaaagaa

SEQ ID NO: 4682145 - DNA, 16 bp, Homo sapiens
aaggaacttaaaactt

SEQ ID NO: 4682146 - DNA, 15 bp, Homo sapiens
aaggtacttttgttt

SEQ ID NO: 4682147 - DNA, 13 bp, Homo sapiens
aagtattatctgt

SEQ ID NO: 4682148 - DNA, 16 bp, Homo sapiens
aagtattatctgtaaa

SEQ ID NO: 4682149 - DNA, 17 bp, Homo sapiens
aagtattatctgtaaaa

SEQ ID NO: 4682150 - DNA, 13 bp, Homo sapiens
aagttatcttaaa

SEQ ID NO: 4682151 - DNA, 18 bp, Homo sapiens
aagttatcttaaatatga

SEQ ID NO: 4682152 - DNA, 21 bp, Homo sapiens
aagttcatgggcacctcatgg

SEQ ID NO: 4682153 - DNA, 12 bp, Homo sapiens
aataaatgttca

SEQ ID NO: 4682154 - DNA, 14 bp, Homo sapiens
aatataggataaga

SEQ ID NO: 4682155 - DNA, 19 bp, Homo sapiens
aatatgaattctgttgtaa

SEQ ID NO: 4682156 - DNA, 16 bp, Homo sapiens
aatattgtattttaga

SEQ ID NO: 4682157 - DNA, 16 bp, Homo sapiens
aatgacttttgaatta

SEQ ID NO: 4682158 - DNA, 22 bp, Homo sapiens
aatgatgagtctatattatcta

SEQ ID NO: 4682159 - DNA, 18 bp, Homo sapiens
aatgtaaaccagaaaaaa

SEQ ID NO: 4682160 - DNA, 16 bp, Homo sapiens
aattacagagatataa

SEQ ID NO: 4682161 - DNA, 16 bp, Homo sapiens
aattagaatagaactt

SEQ ID NO: 4682162 - DNA, 17 bp, Homo sapiens
aattagagttgtgatac

SEQ ID NO: 4682163 - DNA, 22 bp, Homo sapiens
aattagagttgtgatacagagt

SEQ ID NO: 4682164 - DNA, 16 bp, Homo sapiens
aattattatatattta

SEQ ID NO: 4682165 - DNA, 18 bp, Homo sapiens
aattgttgactaaaatgc

SEQ ID NO: 4682166 - DNA, 15 bp, Homo sapiens
aatttttaaaacttt

SEQ ID NO: 4682167 - DNA, 22 bp, Homo sapiens
acaattgttgactaaaatgctg

SEQ ID NO: 4682168 - DNA, 15 bp, Homo sapiens
acagaatataggata

SEQ ID NO: 4682169 - DNA, 14 bp, Homo sapiens
acagagatataaat

SEQ ID NO: 4682170 - DNA, 15 bp, Homo sapiens
acagagtatatttcc

SEQ ID NO: 4682171 - DNA, 13 bp, Homo sapiens
acagtccctcctg

SEQ ID NO: 4682172 - DNA, 12 bp, Homo sapiens
acatccccacct

SEQ ID NO: 4682173 - DNA, 20 bp, Homo sapiens
acatccccaccttccaagga

SEQ ID NO: 4682174 - DNA, 13 bp, Homo sapiens
accattccacatc

SEQ ID NO: 4682175 - DNA, 18 bp, Homo sapiens
accctcccccaccattcc

SEQ ID NO: 4682176 - DNA, 17 bp, Homo sapiens
accctcggctcccgggt

SEQ ID NO: 4682177 - DNA, 18 bp, Homo sapiens
accctcttctctgggccc

SEQ ID NO: 4682178 - DNA, 20 bp, Homo sapiens
accctcttctctgggcccag

SEQ ID NO: 4682179 - DNA, 17 bp, Homo sapiens
accgttccttaaaaaca

SEQ ID NO: 4682180 - DNA, 16 bp, Homo sapiens
acctcactatctgaaa

SEQ ID NO: 4682181 - DNA, 23 bp, Homo sapiens
acctgaagcatgaaactgtgtat

SEQ ID NO: 4682182 - DNA, 18 bp, Homo sapiens
accttgggcaagtccctt

SEQ ID NO: 4682183 - DNA, 18 bp, Homo sapiens
accttttatgaaaatgtt

SEQ ID NO: 4682184 - DNA, 13 bp, Homo sapiens
actaataaaatgt

SEQ ID NO: 4682185 - DNA, 17 bp, Homo sapiens
actccaggatcctcctg

SEQ ID NO: 4682186 - DNA, 18 bp, Homo sapiens
actctgctcccagcccct

SEQ ID NO: 4682187 - DNA, 19 bp, Homo sapiens
actgttctatagcagtcat

SEQ ID NO: 4682188 - DNA, 19 bp, Homo sapiens
acttaataaatattgtatt

SEQ ID NO: 4682189 - DNA, 18 bp, Homo sapiens
acttactaataaaatgtg

SEQ ID NO: 4682190 - DNA, 21 bp, Homo sapiens
acttttatggaattaagagat

SEQ ID NO: 4682191 - DNA, 17 bp, Homo sapiens
agaagagacaaactcct

SEQ ID NO: 4682192 - DNA, 22 bp, Homo sapiens
agaatggttgagtgcaaatcca

SEQ ID NO: 4682193 - DNA, 13 bp, Homo sapiens
agacaatatatca

SEQ ID NO: 4682194 - DNA, 16 bp, Homo sapiens
agaccctcccccacca

SEQ ID NO: 4682195 - DNA, 12 bp, Homo sapiens
agaccctcttct

SEQ ID NO: 4682196 - DNA, 19 bp, Homo sapiens
agaccctcttctctgggcc

SEQ ID NO: 4682197 - DNA, 15 bp, Homo sapiens
agaccttccacaaag

SEQ ID NO: 4682198 - DNA, 20 bp, Homo sapiens
agacttactaataaaatgtg

SEQ ID NO: 4682199 - DNA, 19 bp, Homo sapiens
agacttagatctgagccct

SEQ ID NO: 4682200 - DNA, 16 bp, Homo sapiens
agagaatgattgtctt

SEQ ID NO: 4682201 - DNA, 15 bp, Homo sapiens
agagaggcgtcctgg

SEQ ID NO: 4682202 - DNA, 16 bp, Homo sapiens
agagatataaatgaag

SEQ ID NO: 4682203 - DNA, 17 bp, Homo sapiens
agagatataaatgaagt

SEQ ID NO: 4682204 - DNA, 14 bp, Homo sapiens
agagctctccagga

SEQ ID NO: 4682205 - DNA, 13 bp, Homo sapiens
agatataaatgaa

SEQ ID NO: 4682206 - DNA, 17 bp, Homo sapiens
agatctaccttggtgat

SEQ ID NO: 4682207 - DNA, 19 bp, Homo sapiens
agatctgagccctccctct

SEQ ID NO: 4682208 - DNA, 15 bp, Homo sapiens
agatgttatattaaa

SEQ ID NO: 4682209 - DNA, 19 bp, Homo sapiens
agatgttatattaaagaaa

SEQ ID NO: 4682210 - DNA, 22 bp, Homo sapiens
agcaaaggcaggaggtgggtga

SEQ ID NO: 4682211 - DNA, 21 bp, Homo sapiens
agcccctaccttgagaccctc

SEQ ID NO: 4682212 - DNA, 15 bp, Homo sapiens
agccctccctcttcc

SEQ ID NO: 4682213 - DNA, 16 bp, Homo sapiens
agccctccctcttccc

SEQ ID NO: 4682214 - DNA, 22 bp, Homo sapiens
agccctccctcttcccagcaca

SEQ ID NO: 4682215 - DNA, 16 bp, Homo sapiens
agcctggcttttctgg

SEQ ID NO: 4682216 - DNA, 11 bp, Homo sapiens
agctgaggccc

SEQ ID NO: 4682217 - DNA, 17 bp, Homo sapiens
agctgaggccccagggc

SEQ ID NO: 4682218 - DNA, 14 bp, Homo sapiens
aggacaaggtacag

SEQ ID NO: 4682219 - DNA, 13 bp, Homo sapiens
aggaggtgggtga

SEQ ID NO: 4682220 - DNA, 14 bp, Homo sapiens
aggataagaaataa

SEQ ID NO: 4682221 - DNA, 18 bp, Homo sapiens
aggatcctcctggagcag

SEQ ID NO: 4682222 - DNA, 16 bp, Homo sapiens
aggcaaatcaggtaaa

SEQ ID NO: 4682223 - DNA, 17 bp, Homo sapiens
aggccccagggctgtgg

SEQ ID NO: 4682224 - DNA, 15 bp, Homo sapiens
aggccctagaccctc

SEQ ID NO: 4682225 - DNA, 15 bp, Homo sapiens
aggcgtcctggtgag

SEQ ID NO: 4682226 - DNA, 17 bp, Homo sapiens
aggcgtcctggtgagga

SEQ ID NO: 4682227 - DNA, 17 bp, Homo sapiens
agggctgtgggtgggga

SEQ ID NO: 4682228 - DNA, 16 bp, Homo sapiens
aggtccgagctctgtc

SEQ ID NO: 4682229 - DNA, 18 bp, Homo sapiens
aggtccgagctctgtcct

SEQ ID NO: 4682230 - DNA, 20 bp, Homo sapiens
agtcatcttctctactgtgt

SEQ ID NO: 4682231 - DNA, 12 bp, Homo sapiens
agtccctcctgt

SEQ ID NO: 4682232 - DNA, 17 bp, Homo sapiens
agtcctacaatgtgaaa

SEQ ID NO: 4682233 - DNA, 13 bp, Homo sapiens
agttaaggcaaat

SEQ ID NO: 4682234 - DNA, 15 bp, Homo sapiens
agttaaggcaaatca

SEQ ID NO: 4682235 - DNA, 13 bp, Homo sapiens
agttatcttaaat

SEQ ID NO: 4682236 - DNA, 19 bp, Homo sapiens
agttatcttaaatatgaat

SEQ ID NO: 4682237 - DNA, 22 bp, Homo sapiens
ataaaagctctagataaaactt

SEQ ID NO: 4682238 - DNA, 17 bp, Homo sapiens
ataaaattcagaattct

SEQ ID NO: 4682239 - DNA, 13 bp, Homo sapiens
ataaatattgtat

SEQ ID NO: 4682240 - DNA, 14 bp, Homo sapiens
ataaatattgtatt

SEQ ID NO: 4682241 - DNA, 22 bp, Homo sapiens
ataaatgttcatgatttcaaga

SEQ ID NO: 4682242 - DNA, 20 bp, Homo sapiens
ataacttaataaatattgta

SEQ ID NO: 4682243 - DNA, 12 bp, Homo sapiens
ataagaagactt

SEQ ID NO: 4682244 - DNA, 12 bp, Homo sapiens
ataagaataaag

SEQ ID NO: 4682245 - DNA, 16 bp, Homo sapiens
ataattagagttgtga

SEQ ID NO: 4682246 - DNA, 18 bp, Homo sapiens
ataattagagttgtgata

SEQ ID NO: 4682247 - DNA, 17 bp, Homo sapiens
atacagcgctctctctg

SEQ ID NO: 4682248 - DNA, 16 bp, Homo sapiens
atagcacaagataaat

SEQ ID NO: 4682249 - DNA, 16 bp, Homo sapiens
ataggataagaaataa

SEQ ID NO: 4682250 - DNA, 13 bp, Homo sapiens
atagtcatgattc

SEQ ID NO: 4682251 - DNA, 16 bp, Homo sapiens
atataaatgaagtatt

SEQ ID NO: 4682252 - DNA, 14 bp, Homo sapiens
atatatcataactt

SEQ ID NO: 4682253 - DNA, 14 bp, Homo sapiens
atatattctctaat

SEQ ID NO: 4682254 - DNA, 20 bp, Homo sapiens
atatattctctaataaaatt

SEQ ID NO: 4682255 - DNA, 15 bp, Homo sapiens
atatatttatagcaa

SEQ ID NO: 4682256 - DNA, 20 bp, Homo sapiens
atatatttatagcaaagtta

SEQ ID NO: 4682257 - DNA, 15 bp, Homo sapiens
atattaaagaaaaac

SEQ ID NO: 4682258 - DNA, 16 bp, Homo sapiens
atattaaagaaaaact

SEQ ID NO: 4682259 - DNA, 20 bp, Homo sapiens
atattaaagaaaaactttaa

SEQ ID NO: 4682260 - DNA, 15 bp, Homo sapiens
atatttatagcaaag

SEQ ID NO: 4682261 - DNA, 14 bp, Homo sapiens
atattttaaaaaca

SEQ ID NO: 4682262 - DNA, 15 bp, Homo sapiens
atccaaataatgaat

SEQ ID NO: 4682263 - DNA, 16 bp, Homo sapiens
atccaaataatgaatc

SEQ ID NO: 4682264 - DNA, 18 bp, Homo sapiens
atccatagcacaagataa

SEQ ID NO: 4682265 - DNA, 19 bp, Homo sapiens
atccatagcacaagataaa

SEQ ID NO: 4682266 - DNA, 22 bp, Homo sapiens
atccatagcacaagataaattg

SEQ ID NO: 4682267 - DNA, 22 bp, Homo sapiens
atctgagccctccctcttccca

SEQ ID NO: 4682268 - DNA, 19 bp, Homo sapiens
atctgtaaaaattgttata

SEQ ID NO: 4682269 - DNA, 21 bp, Homo sapiens
atctgtaaaaattgttataat

SEQ ID NO: 4682270 - DNA, 15 bp, Homo sapiens
atcttaaatatgaat

SEQ ID NO: 4682271 - DNA, 22 bp, Homo sapiens
atgaagtattatctgtaaaaat

SEQ ID NO: 4682272 - DNA, 15 bp, Homo sapiens
atgatccagggattg

SEQ ID NO: 4682273 - DNA, 15 bp, Homo sapiens
atgcgtccactttcc

SEQ ID NO: 4682274 - DNA, 16 bp, Homo sapiens
atgctgcttttaaaac

SEQ ID NO: 4682275 - DNA, 13 bp, Homo sapiens
atgtaatgtaaac

SEQ ID NO: 4682276 - DNA, 14 bp, Homo sapiens
atgttcatgatttc

SEQ ID NO: 4682277 - DNA, 14 bp, Homo sapiens
attaaagaaaaact

SEQ ID NO: 4682278 - DNA, 16 bp, Homo sapiens
attaattctcaaataa

SEQ ID NO: 4682279 - DNA, 13 bp, Homo sapiens
attacagagatat

SEQ ID NO: 4682280 - DNA, 17 bp, Homo sapiens
attacagagatataaat

SEQ ID NO: 4682281 - DNA, 14 bp, Homo sapiens
attagagttgtgat

SEQ ID NO: 4682282 - DNA, 15 bp, Homo sapiens
attatatatttatag

SEQ ID NO: 4682283 - DNA, 15 bp, Homo sapiens
attatctgtaaaaat

SEQ ID NO: 4682284 - DNA, 16 bp, Homo sapiens
attatctgtaaaaatt

SEQ ID NO: 4682285 - DNA, 17 bp, Homo sapiens
attatctgtaaaaattg

SEQ ID NO: 4682286 - DNA, 21 bp, Homo sapiens
attatctgtaaaaattgttat

SEQ ID NO: 4682287 - DNA, 16 bp, Homo sapiens
attctatgtaatgtaa

SEQ ID NO: 4682288 - DNA, 17 bp, Homo sapiens
attctatgtaatgtaaa

SEQ ID NO: 4682289 - DNA, 16 bp, Homo sapiens
attctgttgtaattta

SEQ ID NO: 4682290 - DNA, 23 bp, Homo sapiens
attgagctagttaaggcaaatca

SEQ ID NO: 4682291 - DNA, 14 bp, Homo sapiens
attgtttaaaaacc

SEQ ID NO: 4682292 - DNA, 12 bp, Homo sapiens
atttaatgactt

SEQ ID NO: 4682293 - DNA, 18 bp, Homo sapiens
atttaatgacttttgaat

SEQ ID NO: 4682294 - DNA, 19 bp, Homo sapiens
atttaatgacttttgaatt

SEQ ID NO: 4682295 - DNA, 19 bp, Homo sapiens
atttcaagatgttatatta

SEQ ID NO: 4682296 - DNA, 20 bp, Homo sapiens
atttgaaccaggccttctga

SEQ ID NO: 4682297 - DNA, 12 bp, Homo sapiens
caaagaactcct

SEQ ID NO: 4682298 - DNA, 13 bp, Homo sapiens
caaagtcattgaa

SEQ ID NO: 4682299 - DNA, 14 bp, Homo sapiens
caaagtcattgaat

SEQ ID NO: 4682300 - DNA, 16 bp, Homo sapiens
caaagttatcttaaat

SEQ ID NO: 4682301 - DNA, 17 bp, Homo sapiens
caaagttatcttaaata

SEQ ID NO: 4682302 - DNA, 20 bp, Homo sapiens
caagagaggaggaaaaacag

SEQ ID NO: 4682303 - DNA, 14 bp, Homo sapiens
caaggatgatccag

SEQ ID NO: 4682304 - DNA, 15 bp, Homo sapiens
caaggtccgagctct

SEQ ID NO: 4682305 - DNA, 22 bp, Homo sapiens
caagtcccttgacctttccagc

SEQ ID NO: 4682306 - DNA, 21 bp, Homo sapiens
caagtcctcctagaactccag

SEQ ID NO: 4682307 - DNA, 18 bp, Homo sapiens
caagtgatattgtcttca

SEQ ID NO: 4682308 - DNA, 22 bp, Homo sapiens
caatatatcataacttaataaa

SEQ ID NO: 4682309 - DNA, 18 bp, Homo sapiens
caattgttgactaaaatg

SEQ ID NO: 4682310 - DNA, 21 bp, Homo sapiens
cacaattgttgactaaaatgc

SEQ ID NO: 4682311 - DNA, 11 bp, Homo sapiens
cacagggactg

SEQ ID NO: 4682312 - DNA, 14 bp, Homo sapiens
cacagtccctcctg

SEQ ID NO: 4682313 - DNA, 17 bp, Homo sapiens
cacatagctgggatttg

SEQ ID NO: 4682314 - DNA, 13 bp, Homo sapiens
cacatccccacct

SEQ ID NO: 4682315 - DNA, 14 bp, Homo sapiens
cacatccccacctt

SEQ ID NO: 4682316 - DNA, 21 bp, Homo sapiens
caccattccacatccccacct

SEQ ID NO: 4682317 - DNA, 16 bp, Homo sapiens
cactctgctcccagcc

SEQ ID NO: 4682318 - DNA, 22 bp, Homo sapiens
cactctgctcccagcccctacc

SEQ ID NO: 4682319 - DNA, 20 bp, Homo sapiens
cactggggatcccgtgctgg

SEQ ID NO: 4682320 - DNA, 21 bp, Homo sapiens
cactgttggaagaaaagagat

SEQ ID NO: 4682321 - DNA, 15 bp, Homo sapiens
cactttcccttcccc

SEQ ID NO: 4682322 - DNA, 16 bp, Homo sapiens
cagaaaaaataaatgt

SEQ ID NO: 4682323 - DNA, 18 bp, Homo sapiens
cagaaactacattgtaac

SEQ ID NO: 4682324 - DNA, 20 bp, Homo sapiens
cagagagaggcgtcctggtg

SEQ ID NO: 4682325 - DNA, 21 bp, Homo sapiens
cagagagaggcgtcctggtga

SEQ ID NO: 4682326 - DNA, 22 bp, Homo sapiens
cagagctgcagagtacagtgta

SEQ ID NO: 4682327 - DNA, 14 bp, Homo sapiens
cagcagctgaggcc

SEQ ID NO: 4682328 - DNA, 20 bp, Homo sapiens
cagcagctgaggccccaggg

SEQ ID NO: 4682329 - DNA, 22 bp, Homo sapiens
cagcctatatttcctcttctgt

SEQ ID NO: 4682330 - DNA, 21 bp, Homo sapiens
caggccctagaccctccccca

SEQ ID NO: 4682331 - DNA, 18 bp, Homo sapiens
caggtaaaatagtcatga

SEQ ID NO: 4682332 - DNA, 20 bp, Homo sapiens
catgatgtgacttccggaga

SEQ ID NO: 4682333 - DNA, 17 bp, Homo sapiens
catgattctatgtaatg

SEQ ID NO: 4682334 - DNA, 21 bp, Homo sapiens
catgcgtccactttcccttcc

SEQ ID NO: 4682335 - DNA, 18 bp, Homo sapiens
catggactccaggatcct

SEQ ID NO: 4682336 - DNA, 23 bp, Homo sapiens
catggactccaggatcctcctgg

SEQ ID NO: 4682337 - DNA, 22 bp, Homo sapiens
cattccacatccccaccttcca

SEQ ID NO: 4682338 - DNA, 12 bp, Homo sapiens
cattgactaaga

SEQ ID NO: 4682339 - DNA, 17 bp, Homo sapiens
ccaaaccacatatgaaa

SEQ ID NO: 4682340 - DNA, 20 bp, Homo sapiens
ccaagtcctcctagaactcc

SEQ ID NO: 4682341 - DNA, 18 bp, Homo sapiens
ccacactttcactgggga

SEQ ID NO: 4682342 - DNA, 23 bp, Homo sapiens
ccacatccccaccttccaaggaa

SEQ ID NO: 4682343 - DNA, 13 bp, Homo sapiens
ccactctgctccc

SEQ ID NO: 4682344 - DNA, 14 bp, Homo sapiens
ccactctgctccca

SEQ ID NO: 4682345 - DNA, 14 bp, Homo sapiens
ccactttcccttcc

SEQ ID NO: 4682346 - DNA, 23 bp, Homo sapiens
ccactttcccttcccctgtgact

SEQ ID NO: 4682347 - DNA, 18 bp, Homo sapiens
ccagagagaggcgtcctg

SEQ ID NO: 4682348 - DNA, 21 bp, Homo sapiens
ccagagagaggcgtcctggtg

SEQ ID NO: 4682349 - DNA, 22 bp, Homo sapiens
ccagagagaggcgtcctggtga

SEQ ID NO: 4682350 - DNA, 19 bp, Homo sapiens
ccagcctatatttcctctt

SEQ ID NO: 4682351 - DNA, 18 bp, Homo sapiens
ccaggactggaaaaagtg

SEQ ID NO: 4682352 - DNA, 15 bp, Homo sapiens
ccattccacatcccc

SEQ ID NO: 4682353 - DNA, 12 bp, Homo sapiens
cccaccattcca

SEQ ID NO: 4682354 - DNA, 14 bp, Homo sapiens
cccaccattccaca

SEQ ID NO: 4682355 - DNA, 17 bp, Homo sapiens
cccaccattccacatcc

SEQ ID NO: 4682356 - DNA, 18 bp, Homo sapiens
cccactctgctcccagcc

SEQ ID NO: 4682357 - DNA, 12 bp, Homo sapiens
cccagcacaggc

SEQ ID NO: 4682358 - DNA, 17 bp, Homo sapiens
cccaggccctagaccct

SEQ ID NO: 4682359 - DNA, 19 bp, Homo sapiens
cccagggctgtgggtgggg

SEQ ID NO: 4682360 - DNA, 19 bp, Homo sapiens
ccccaccattccacatccc

SEQ ID NO: 4682361 - DNA, 14 bp, Homo sapiens
ccccaccttccaag

SEQ ID NO: 4682362 - DNA, 20 bp, Homo sapiens
ccccactctgctcccagccc

SEQ ID NO: 4682363 - DNA, 16 bp, Homo sapiens
ccccagggctgtgggt

SEQ ID NO: 4682364 - DNA, 20 bp, Homo sapiens
ccctaccttgagaccctctt

SEQ ID NO: 4682365 - DNA, 23 bp, Homo sapiens
ccctctctatacctttcaaagaa

SEQ ID NO: 4682366 - DNA, 13 bp, Homo sapiens
ccctcttcccagc

SEQ ID NO: 4682367 - DNA, 19 bp, Homo sapiens
cccttcccctgtgactcct

SEQ ID NO: 4682368 - DNA, 23 bp, Homo sapiens
cccttcccctgtgactcctccct

SEQ ID NO: 4682369 - DNA, 13 bp, Homo sapiens
ccgagctctgtcc

SEQ ID NO: 4682370 - DNA, 19 bp, Homo sapiens
ccgagctctgtcctctgtc

SEQ ID NO: 4682371 - DNA, 12 bp, Homo sapiens
ccgatggggccc

SEQ ID NO: 4682372 - DNA, 17 bp, Homo sapiens
ccgatggggcccacatt

SEQ ID NO: 4682373 - DNA, 14 bp, Homo sapiens
cctatagagaaacc

SEQ ID NO: 4682374 - DNA, 13 bp, Homo sapiens
cctcccttcccca

SEQ ID NO: 4682375 - DNA, 17 bp, Homo sapiens
cctcccttccccactct

SEQ ID NO: 4682376 - DNA, 18 bp, Homo sapiens
cctcctggagcagcagct

SEQ ID NO: 4682377 - DNA, 21 bp, Homo sapiens
cctcctggagcagcagctgag

SEQ ID NO: 4682378 - DNA, 18 bp, Homo sapiens
cctcctgttgccacactt

SEQ ID NO: 4682379 - DNA, 23 bp, Homo sapiens
cctggagcagcagctgaggcccc

SEQ ID NO: 4682380 - DNA, 18 bp, Homo sapiens
cctggcttttctggctgg

SEQ ID NO: 4682381 - DNA, 13 bp, Homo sapiens
cctgtgactcctc

SEQ ID NO: 4682382 - DNA, 13 bp, Homo sapiens
cctttccagccta

SEQ ID NO: 4682383 - DNA, 15 bp, Homo sapiens
cgatggggcccacat

SEQ ID NO: 4682384 - DNA, 11 bp, Homo sapiens
cggctcccggg

SEQ ID NO: 4682385 - DNA, 17 bp, Homo sapiens
cgggtggggtgcttgct

SEQ ID NO: 4682386 - DNA, 14 bp, Homo sapiens
cgtacccaaggtca

SEQ ID NO: 4682387 - DNA, 13 bp, Homo sapiens
cgtccactttccc

SEQ ID NO: 4682388 - DNA, 20 bp, Homo sapiens
ctaaaatgctgcttttaaaa

SEQ ID NO: 4682389 - DNA, 19 bp, Homo sapiens
ctaaagtcatccagtgaaa

SEQ ID NO: 4682390 - DNA, 16 bp, Homo sapiens
ctaccttggtgatttg

SEQ ID NO: 4682391 - DNA, 22 bp, Homo sapiens
ctcatggactccaggatcctcc

SEQ ID NO: 4682392 - DNA, 23 bp, Homo sapiens
ctcatggactccaggatcctcct

SEQ ID NO: 4682393 - DNA, 15 bp, Homo sapiens
ctcattttgaaatat

SEQ ID NO: 4682394 - DNA, 16 bp, Homo sapiens
ctccaggatcctcctg

SEQ ID NO: 4682395 - DNA, 22 bp, Homo sapiens
ctccaggatcctcctggagcag

SEQ ID NO: 4682396 - DNA, 22 bp, Homo sapiens
ctccagtaaaagttgtgcctca

SEQ ID NO: 4682397 - DNA, 19 bp, Homo sapiens
ctccatccctttccctcgc

SEQ ID NO: 4682398 - DNA, 16 bp, Homo sapiens
ctccctcttcccagca

SEQ ID NO: 4682399 - DNA, 14 bp, Homo sapiens
ctcccttccccact

SEQ ID NO: 4682400 - DNA, 21 bp, Homo sapiens
ctccgaggtggtgggggcgcc

SEQ ID NO: 4682401 - DNA, 22 bp, Homo sapiens
ctctatacctttcaaagaactc

SEQ ID NO: 4682402 - DNA, 13 bp, Homo sapiens
ctctgctcccagc

SEQ ID NO: 4682403 - DNA, 20 bp, Homo sapiens
ctctgggcccagagagaggc

SEQ ID NO: 4682404 - DNA, 22 bp, Homo sapiens
ctctgtcagtcatgcgtccact

SEQ ID NO: 4682405 - DNA, 20 bp, Homo sapiens
ctctgtcctctgtcagtcat

SEQ ID NO: 4682406 - DNA, 16 bp, Homo sapiens
ctcttacttgatagac

SEQ ID NO: 4682407 - DNA, 18 bp, Homo sapiens
ctgagccctccctcttcc

SEQ ID NO: 4682408 - DNA, 22 bp, Homo sapiens
ctgagccctccctcttcccagc

SEQ ID NO: 4682409 - DNA, 23 bp, Homo sapiens
ctgagccctccctcttcccagca

SEQ ID NO: 4682410 - DNA, 19 bp, Homo sapiens
ctgagccgtgcagctggga

SEQ ID NO: 4682411 - DNA, 15 bp, Homo sapiens
ctgatttcaaggtcc

SEQ ID NO: 4682412 - DNA, 22 bp, Homo sapiens
ctgatttcaaggtccgagctct

SEQ ID NO: 4682413 - DNA, 12 bp, Homo sapiens
ctgctcccagcc

SEQ ID NO: 4682414 - DNA, 22 bp, Homo sapiens
ctgcttttaaaacataggaaag

SEQ ID NO: 4682415 - DNA, 18 bp, Homo sapiens
ctggaagacttagatctg

SEQ ID NO: 4682416 - DNA, 19 bp, Homo sapiens
ctggagcagcagctgaggc

SEQ ID NO: 4682417 - DNA, 20 bp, Homo sapiens
ctggagcagcagctgaggcc

SEQ ID NO: 4682418 - DNA, 22 bp, Homo sapiens
ctggcttttctggctggggatg

SEQ ID NO: 4682419 - DNA, 12 bp, Homo sapiens
ctggtgaggaca

SEQ ID NO: 4682420 - DNA, 12 bp, Homo sapiens
ctgtaaaaattg

SEQ ID NO: 4682421 - DNA, 19 bp, Homo sapiens
ctgtaaaatgggtatattg

SEQ ID NO: 4682422 - DNA, 21 bp, Homo sapiens
ctgtgggtggggaaggaaggc

SEQ ID NO: 4682423 - DNA, 12 bp, Homo sapiens
ctgttgtaattt

SEQ ID NO: 4682424 - DNA, 19 bp, Homo sapiens
ctgttgtaatttaatgact

SEQ ID NO: 4682425 - DNA, 13 bp, Homo sapiens
cttaataaatatt

SEQ ID NO: 4682426 - DNA, 14 bp, Homo sapiens
cttacatttgctaa

SEQ ID NO: 4682427 - DNA, 13 bp, Homo sapiens
cttactaataaaa

SEQ ID NO: 4682428 - DNA, 15 bp, Homo sapiens
cttactaataaaatg

SEQ ID NO: 4682429 - DNA, 15 bp, Homo sapiens
cttagatctgagccc

SEQ ID NO: 4682430 - DNA, 18 bp, Homo sapiens
cttagatctgagccctcc

SEQ ID NO: 4682431 - DNA, 20 bp, Homo sapiens
cttcattgcagcctgaaatt

SEQ ID NO: 4682432 - DNA, 20 bp, Homo sapiens
cttccccactctgctcccag

SEQ ID NO: 4682433 - DNA, 23 bp, Homo sapiens
cttccccactctgctcccagccc

SEQ ID NO: 4682434 - DNA, 21 bp, Homo sapiens
cttctctactgtgtgaaatga

SEQ ID NO: 4682435 - DNA, 23 bp, Homo sapiens
cttgagaccctcttctctgggcc

SEQ ID NO: 4682436 - DNA, 21 bp, Homo sapiens
cttgatagacttactaataaa

SEQ ID NO: 4682437 - DNA, 11 bp, Homo sapiens
cttgctgtgtg

SEQ ID NO: 4682438 - DNA, 16 bp, Homo sapiens
cttgctgtgtgacctt

SEQ ID NO: 4682439 - DNA, 16 bp, Homo sapiens
cttggacgcactgttt

SEQ ID NO: 4682440 - DNA, 13 bp, Homo sapiens
ctttaaaaattat

SEQ ID NO: 4682441 - DNA, 13 bp, Homo sapiens
ctttcccttcccc

SEQ ID NO: 4682442 - DNA, 22 bp, Homo sapiens
ctttgtgtctagttttctagac

SEQ ID NO: 4682443 - DNA, 18 bp, Homo sapiens
gaaactgtgtattatttg

SEQ ID NO: 4682444 - DNA, 21 bp, Homo sapiens
gaagtattatctgtaaaaatt

SEQ ID NO: 4682445 - DNA, 14 bp, Homo sapiens
gaatagaacttgaa

SEQ ID NO: 4682446 - DNA, 20 bp, Homo sapiens
gaattacagagatataaatg

SEQ ID NO: 4682447 - DNA, 16 bp, Homo sapiens
gaccctcttctctggg

SEQ ID NO: 4682448 - DNA, 14 bp, Homo sapiens
gactcctcccttcc

SEQ ID NO: 4682449 - DNA, 22 bp, Homo sapiens
gactcctcccttccccactctg

SEQ ID NO: 4682450 - DNA, 16 bp, Homo sapiens
gacttactaataaaat

SEQ ID NO: 4682451 - DNA, 14 bp, Homo sapiens
gacttagatctgag

SEQ ID NO: 4682452 - DNA, 15 bp, Homo sapiens
gagaggcgtcctggt

SEQ ID NO: 4682453 - DNA, 23 bp, Homo sapiens
gagcagcagctgaggccccaggg

SEQ ID NO: 4682454 - DNA, 15 bp, Homo sapiens
gagccctccctcttc

SEQ ID NO: 4682455 - DNA, 13 bp, Homo sapiens
gagcgggtggggt

SEQ ID NO: 4682456 - DNA, 15 bp, Homo sapiens
gagctctgtcctctg

SEQ ID NO: 4682457 - DNA, 19 bp, Homo sapiens
gaggagcaagggaacagaa

SEQ ID NO: 4682458 - DNA, 18 bp, Homo sapiens
gaggccccagggctgtgg

SEQ ID NO: 4682459 - DNA, 15 bp, Homo sapiens
gaggcgtcctggtga

SEQ ID NO: 4682460 - DNA, 20 bp, Homo sapiens
gagtatatttccattcagac

SEQ ID NO: 4682461 - DNA, 17 bp, Homo sapiens
gataaaggattcaaaag

SEQ ID NO: 4682462 - DNA, 15 bp, Homo sapiens
gatacagagtatatt

SEQ ID NO: 4682463 - DNA, 16 bp, Homo sapiens
gatacagagtatattt

SEQ ID NO: 4682464 - DNA, 14 bp, Homo sapiens
gatagacttactaa

SEQ ID NO: 4682465 - DNA, 22 bp, Homo sapiens
gatagacttactaataaaatgt

SEQ ID NO: 4682466 - DNA, 12 bp, Homo sapiens
gatataaatgaa

SEQ ID NO: 4682467 - DNA, 14 bp, Homo sapiens
gatataaatgaagt

SEQ ID NO: 4682468 - DNA, 15 bp, Homo sapiens
gatcagattaaaaac

SEQ ID NO: 4682469 - DNA, 21 bp, Homo sapiens
gatctgagccctccctcttcc

SEQ ID NO: 4682470 - DNA, 23 bp, Homo sapiens
gatctgagccctccctcttccca

SEQ ID NO: 4682471 - DNA, 14 bp, Homo sapiens
gattcatataacca

SEQ ID NO: 4682472 - DNA, 17 bp, Homo sapiens
gattctatgtaatgtaa

SEQ ID NO: 4682473 - DNA, 18 bp, Homo sapiens
gattctatgtaatgtaaa

SEQ ID NO: 4682474 - DNA, 22 bp, Homo sapiens
gattctatgtaatgtaaaccag

SEQ ID NO: 4682475 - DNA, 21 bp, Homo sapiens
gatttgaaccaggccttctga

SEQ ID NO: 4682476 - DNA, 17 bp, Homo sapiens
gcaaaggcaggaggtgg

SEQ ID NO: 4682477 - DNA, 16 bp, Homo sapiens
gcaaagttatcttaaa

SEQ ID NO: 4682478 - DNA, 18 bp, Homo sapiens
gcaaagttatcttaaata

SEQ ID NO: 4682479 - DNA, 17 bp, Homo sapiens
gcaaatcaggtaaaata

SEQ ID NO: 4682480 - DNA, 23 bp, Homo sapiens
gcaaatccatagcacaagataaa

SEQ ID NO: 4682481 - DNA, 21 bp, Homo sapiens
gcaactcagggctaaagtcat

SEQ ID NO: 4682482 - DNA, 19 bp, Homo sapiens
gcacctcatggactccagg

SEQ ID NO: 4682483 - DNA, 13 bp, Homo sapiens
gcagctgaggccc

SEQ ID NO: 4682484 - DNA, 20 bp, Homo sapiens
gcagctgggatttgaaccag

SEQ ID NO: 4682485 - DNA, 15 bp, Homo sapiens
gcaggaggtgggtga

SEQ ID NO: 4682486 - DNA, 21 bp, Homo sapiens
gccacactttcactggggatc

SEQ ID NO: 4682487 - DNA, 20 bp, Homo sapiens
gcccagagagaggcgtcctg

SEQ ID NO: 4682488 - DNA, 17 bp, Homo sapiens
gccccagggctgtgggt

SEQ ID NO: 4682489 - DNA, 23 bp, Homo sapiens
gcccctaccttgagaccctcttc

SEQ ID NO: 4682490 - DNA, 22 bp, Homo sapiens
gccctagaccctcccccaccat

SEQ ID NO: 4682491 - DNA, 18 bp, Homo sapiens
gccctccctcttcccagc

SEQ ID NO: 4682492 - DNA, 19 bp, Homo sapiens
gccctccctcttcccagca

SEQ ID NO: 4682493 - DNA, 18 bp, Homo sapiens
gcctatatttcctcttct

SEQ ID NO: 4682494 - DNA, 16 bp, Homo sapiens
gcctccccctcgactc

SEQ ID NO: 4682495 - DNA, 16 bp, Homo sapiens
gcctggcttttctggc

SEQ ID NO: 4682496 - DNA, 22 bp, Homo sapiens
gcgtccactttcccttcccctg

SEQ ID NO: 4682497 - DNA, 19 bp, Homo sapiens
gctaaagtcatccagtgaa

SEQ ID NO: 4682498 - DNA, 15 bp, Homo sapiens
gctctgtcctctgtc

SEQ ID NO: 4682499 - DNA, 12 bp, Homo sapiens
gctgtgggtggg

SEQ ID NO: 4682500 - DNA, 15 bp, Homo sapiens
gcttctctcttgcat

SEQ ID NO: 4682501 - DNA, 19 bp, Homo sapiens
ggactccaggatcctcctg

SEQ ID NO: 4682502 - DNA, 16 bp, Homo sapiens
ggagcaagggaacaga

SEQ ID NO: 4682503 - DNA, 16 bp, Homo sapiens
ggagcagcagctgagg

SEQ ID NO: 4682504 - DNA, 18 bp, Homo sapiens
ggagcagcagctgaggcc

SEQ ID NO: 4682505 - DNA, 12 bp, Homo sapiens
ggatcctcctgg

SEQ ID NO: 4682506 - DNA, 16 bp, Homo sapiens
ggatgatccagggatt

SEQ ID NO: 4682507 - DNA, 16 bp, Homo sapiens
ggatggccgatggggc

SEQ ID NO: 4682508 - DNA, 15 bp, Homo sapiens
ggcaggaggtgggtg

SEQ ID NO: 4682509 - DNA, 16 bp, Homo sapiens
ggcaggaggtgggtga

SEQ ID NO: 4682510 - DNA, 11 bp, Homo sapiens
ggctggggatg

SEQ ID NO: 4682511 - DNA, 17 bp, Homo sapiens
ggctggttggtgctttg

SEQ ID NO: 4682512 - DNA, 12 bp, Homo sapiens
ggctgtgggtgg

SEQ ID NO: 4682513 - DNA, 14 bp, Homo sapiens
ggctgtgggtgggg

SEQ ID NO: 4682514 - DNA, 13 bp, Homo sapiens
gggcccagagaga

SEQ ID NO: 4682515 - DNA, 20 bp, Homo sapiens
gggcccaggccctagaccct

SEQ ID NO: 4682516 - DNA, 22 bp, Homo sapiens
gggtagaagcaaaggcaggagg

SEQ ID NO: 4682517 - DNA, 15 bp, Homo sapiens
gtaattgacaaatga

SEQ ID NO: 4682518 - DNA, 16 bp, Homo sapiens
gtattatctgtaaaaa

SEQ ID NO: 4682519 - DNA, 20 bp, Homo sapiens
gtcatgcgtccactttccct

SEQ ID NO: 4682520 - DNA, 15 bp, Homo sapiens
gtccactttcccttc

SEQ ID NO: 4682521 - DNA, 16 bp, Homo sapiens
gtccactttcccttcc

SEQ ID NO: 4682522 - DNA, 16 bp, Homo sapiens
gtccgagctctgtcct

SEQ ID NO: 4682523 - DNA, 22 bp, Homo sapiens
gtcctatgcagtattgttagac

SEQ ID NO: 4682524 - DNA, 16 bp, Homo sapiens
gtcctctgtcagtcat

SEQ ID NO: 4682525 - DNA, 13 bp, Homo sapiens
gtgactcctccct

SEQ ID NO: 4682526 - DNA, 23 bp, Homo sapiens
gtgaggacaaggtacaggcaagg

SEQ ID NO: 4682527 - DNA, 16 bp, Homo sapiens
gtgatattgtcttcat

SEQ ID NO: 4682528 - DNA, 13 bp, Homo sapiens
gtgcttgctgtgt

SEQ ID NO: 4682529 - DNA, 12 bp, Homo sapiens
gtggatttgata

SEQ ID NO: 4682530 - DNA, 15 bp, Homo sapiens
gtgggtggggaagga

SEQ ID NO: 4682531 - DNA, 14 bp, Homo sapiens
gttatattaaagaa

SEQ ID NO: 4682532 - DNA, 15 bp, Homo sapiens
gttatcttaaatatg

SEQ ID NO: 4682533 - DNA, 16 bp, Homo sapiens
gttattgtgttaaaac

SEQ ID NO: 4682534 - DNA, 20 bp, Homo sapiens
gttcagtcttgtctttgata

SEQ ID NO: 4682535 - DNA, 18 bp, Homo sapiens
gttcatgatttcaagatg

SEQ ID NO: 4682536 - DNA, 19 bp, Homo sapiens
gttctatagcagtcatcat

SEQ ID NO: 4682537 - DNA, 18 bp, Homo sapiens
gttgcacagtccctcctg

SEQ ID NO: 4682538 - DNA, 16 bp, Homo sapiens
gtttccctttagctaa

SEQ ID NO: 4682539 - DNA, 23 bp, Homo sapiens
gtttgttgcacagtccctcctgt

SEQ ID NO: 4682540 - DNA, 15 bp, Homo sapiens
taaaaagcaagaatt

SEQ ID NO: 4682541 - DNA, 20 bp, Homo sapiens
taaaagaaacttaactgttc

SEQ ID NO: 4682542 - DNA, 21 bp, Homo sapiens
taaaagctctagataaaactt

SEQ ID NO: 4682543 - DNA, 13 bp, Homo sapiens
taaaccagaaaaa

SEQ ID NO: 4682544 - DNA, 20 bp, Homo sapiens
taaaccagaaaaaataaatg

SEQ ID NO: 4682545 - DNA, 22 bp, Homo sapiens
taaaccagaaaaaataaatgtt

SEQ ID NO: 4682546 - DNA, 12 bp, Homo sapiens
taaagaacagaa

SEQ ID NO: 4682547 - DNA, 14 bp, Homo sapiens
taaagtaactttat

SEQ ID NO: 4682548 - DNA, 14 bp, Homo sapiens
taaagtacttgaaa

SEQ ID NO: 4682549 - DNA, 17 bp, Homo sapiens
taaatgaagtattatct

SEQ ID NO: 4682550 - DNA, 16 bp, Homo sapiens
taaatgttcatgattt

SEQ ID NO: 4682551 - DNA, 18 bp, Homo sapiens
taacttaataaatattgt

SEQ ID NO: 4682552 - DNA, 23 bp, Homo sapiens
taagaataaagtaccttgacttt

SEQ ID NO: 4682553 - DNA, 17 bp, Homo sapiens
taaggcaaatcaggtaa

SEQ ID NO: 4682554 - DNA, 23 bp, Homo sapiens
taataaatattgtattttagata

SEQ ID NO: 4682555 - DNA, 21 bp, Homo sapiens
taatacgccaaccagtcaagt

SEQ ID NO: 4682556 - DNA, 23 bp, Homo sapiens
taatgacttttgaattacagaga

SEQ ID NO: 4682557 - DNA, 19 bp, Homo sapiens
taatgtaaaccagaaaaaa

SEQ ID NO: 4682558 - DNA, 21 bp, Homo sapiens
tacaatgtgaaaagagtgaat

SEQ ID NO: 4682559 - DNA, 19 bp, Homo sapiens
tacagagatataaatgaag

SEQ ID NO: 4682560 - DNA, 14 bp, Homo sapiens
tacagagtatattt

SEQ ID NO: 4682561 - DNA, 21 bp, Homo sapiens
tacaggatggttactgaggac

SEQ ID NO: 4682562 - DNA, 22 bp, Homo sapiens
tacccaaggtcacatagctggg

SEQ ID NO: 4682563 - DNA, 16 bp, Homo sapiens
taccttgagaccctct

SEQ ID NO: 4682564 - DNA, 22 bp, Homo sapiens
taccttgagaccctcttctctg

SEQ ID NO: 4682565 - DNA, 15 bp, Homo sapiens
tactaataaaatgtg

SEQ ID NO: 4682566 - DNA, 17 bp, Homo sapiens
tactgtgtgaaatgaat

SEQ ID NO: 4682567 - DNA, 16 bp, Homo sapiens
tagaagcagaatgaaa

SEQ ID NO: 4682568 - DNA, 17 bp, Homo sapiens
tagaccctcccccacca

SEQ ID NO: 4682569 - DNA, 22 bp, Homo sapiens
tagacttactaataaaatgtga

SEQ ID NO: 4682570 - DNA, 16 bp, Homo sapiens
tagctgggatttgaac

SEQ ID NO: 4682571 - DNA, 22 bp, Homo sapiens
tagtctgtatccaaataatgaa

SEQ ID NO: 4682572 - DNA, 17 bp, Homo sapiens
tagttaaggcaaatcag

SEQ ID NO: 4682573 - DNA, 22 bp, Homo sapiens
tagttaaggcaaatcaggtaaa

SEQ ID NO: 4682574 - DNA, 13 bp, Homo sapiens
tataaatgaagta

SEQ ID NO: 4682575 - DNA, 23 bp, Homo sapiens
tataaatgaagtattatctgtaa

SEQ ID NO: 4682576 - DNA, 14 bp, Homo sapiens
tatagcaaagttat

SEQ ID NO: 4682577 - DNA, 16 bp, Homo sapiens
tatattaaagaaaaac

SEQ ID NO: 4682578 - DNA, 19 bp, Homo sapiens
tatattactaataactttt

SEQ ID NO: 4682579 - DNA, 17 bp, Homo sapiens
tatcataacttaataaa

SEQ ID NO: 4682580 - DNA, 15 bp, Homo sapiens
tatctgtaaaaattg

SEQ ID NO: 4682581 - DNA, 16 bp, Homo sapiens
tatctgtaaaaattgt

SEQ ID NO: 4682582 - DNA, 19 bp, Homo sapiens
tatcttggacgcactgttt

SEQ ID NO: 4682583 - DNA, 13 bp, Homo sapiens
tatgtaatgtaaa

SEQ ID NO: 4682584 - DNA, 12 bp, Homo sapiens
tattatatattt

SEQ ID NO: 4682585 - DNA, 15 bp, Homo sapiens
tattctctaataaaa

SEQ ID NO: 4682586 - DNA, 17 bp, Homo sapiens
tattctctaataaaatt

SEQ ID NO: 4682587 - DNA, 19 bp, Homo sapiens
tattgtatttgagaaaata

SEQ ID NO: 4682588 - DNA, 20 bp, Homo sapiens
tattgtatttgagaaaataa

SEQ ID NO: 4682589 - DNA, 13 bp, Homo sapiens
tattgtattttag

SEQ ID NO: 4682590 - DNA, 22 bp, Homo sapiens
tatttatagcaaagttatctta

SEQ ID NO: 4682591 - DNA, 16 bp, Homo sapiens
tattttagatatattc

SEQ ID NO: 4682592 - DNA, 14 bp, Homo sapiens
tcaagatgttatat

SEQ ID NO: 4682593 - DNA, 16 bp, Homo sapiens
tcaagatgttatatta

SEQ ID NO: 4682594 - DNA, 21 bp, Homo sapiens
tcacttgccaaattctggctt

SEQ ID NO: 4682595 - DNA, 15 bp, Homo sapiens
tcagtcatgcgtcca

SEQ ID NO: 4682596 - DNA, 12 bp, Homo sapiens
tccaaataatga

SEQ ID NO: 4682597 - DNA, 14 bp, Homo sapiens
tccaaataatgaat

SEQ ID NO: 4682598 - DNA, 19 bp, Homo sapiens
tccacatccccaccttcca

SEQ ID NO: 4682599 - DNA, 18 bp, Homo sapiens
tccactttcccttcccct

SEQ ID NO: 4682600 - DNA, 15 bp, Homo sapiens
tccaggatcctcctg

SEQ ID NO: 4682601 - DNA, 16 bp, Homo sapiens
tccaggatcctcctgg

SEQ ID NO: 4682602 - DNA, 19 bp, Homo sapiens
tccaggatcctcctggagc

SEQ ID NO: 4682603 - DNA, 17 bp, Homo sapiens
tccatagcacaagataa

SEQ ID NO: 4682604 - DNA, 19 bp, Homo sapiens
tccccactctgctcccagc

SEQ ID NO: 4682605 - DNA, 20 bp, Homo sapiens
tccccactctgctcccagcc

SEQ ID NO: 4682606 - DNA, 15 bp, Homo sapiens
tcccgtgctggaaga

SEQ ID NO: 4682607 - DNA, 16 bp, Homo sapiens
tcccttgacctttcca

SEQ ID NO: 4682608 - DNA, 16 bp, Homo sapiens
tccgagctctgtcctc

SEQ ID NO: 4682609 - DNA, 19 bp, Homo sapiens
tcctaggcaaacattgcaa

SEQ ID NO: 4682610 - DNA, 18 bp, Homo sapiens
tcctggagcagcagctga

SEQ ID NO: 4682611 - DNA, 13 bp, Homo sapiens
tcctgttgccaca

SEQ ID NO: 4682612 - DNA, 23 bp, Homo sapiens
tcctgttgccacactttcactgg

SEQ ID NO: 4682613 - DNA, 14 bp, Homo sapiens
tccttcagtcactc

SEQ ID NO: 4682614 - DNA, 20 bp, Homo sapiens
tctagacccttcatctctta

SEQ ID NO: 4682615 - DNA, 20 bp, Homo sapiens
tctatacctttcaaagaact

SEQ ID NO: 4682616 - DNA, 17 bp, Homo sapiens
tctatagcagtcatcat

SEQ ID NO: 4682617 - DNA, 12 bp, Homo sapiens
tctctaataaaa

SEQ ID NO: 4682618 - DNA, 18 bp, Homo sapiens
tctctaataaaattcaga

SEQ ID NO: 4682619 - DNA, 15 bp, Homo sapiens
tctgagccctccctc

SEQ ID NO: 4682620 - DNA, 12 bp, Homo sapiens
tctggctgggga

SEQ ID NO: 4682621 - DNA, 14 bp, Homo sapiens
tctggttttgtgtt

SEQ ID NO: 4682622 - DNA, 13 bp, Homo sapiens
tctgtcagtcatg

SEQ ID NO: 4682623 - DNA, 14 bp, Homo sapiens
tcttaaatatgaat

SEQ ID NO: 4682624 - DNA, 15 bp, Homo sapiens
tcttaaatatgaatt

SEQ ID NO: 4682625 - DNA, 19 bp, Homo sapiens
tcttctctgggcccagaga

SEQ ID NO: 4682626 - DNA, 17 bp, Homo sapiens
tcttttatcaactgtat

SEQ ID NO: 4682627 - DNA, 12 bp, Homo sapiens
tgaactgagccg

SEQ ID NO: 4682628 - DNA, 22 bp, Homo sapiens
tgaattacagagatataaatga

SEQ ID NO: 4682629 - DNA, 18 bp, Homo sapiens
tgaattctgttgtaattt

SEQ ID NO: 4682630 - DNA, 14 bp, Homo sapiens
tgacctttccagcc

SEQ ID NO: 4682631 - DNA, 21 bp, Homo sapiens
tgactcctcccttccccactc

SEQ ID NO: 4682632 - DNA, 24 bp, Homo sapiens
tgactcctcccttccccactctgc

SEQ ID NO: 4682633 - DNA, 20 bp, Homo sapiens
tgagaccctcttctctgggc

SEQ ID NO: 4682634 - DNA, 22 bp, Homo sapiens
tgagaccctcttctctgggccc

SEQ ID NO: 4682635 - DNA, 14 bp, Homo sapiens
tgagcgggtggggt

SEQ ID NO: 4682636 - DNA, 21 bp, Homo sapiens
tgaggccccagggctgtgggt

SEQ ID NO: 4682637 - DNA, 23 bp, Homo sapiens
tgaggccccagggctgtgggtgg

SEQ ID NO: 4682638 - DNA, 12 bp, Homo sapiens
tgataaagaaca

SEQ ID NO: 4682639 - DNA, 13 bp, Homo sapiens
tgataatacccac

SEQ ID NO: 4682640 - DNA, 18 bp, Homo sapiens
tgatttcaagatgttata

SEQ ID NO: 4682641 - DNA, 16 bp, Homo sapiens
tgcacagtccctcctg

SEQ ID NO: 4682642 - DNA, 22 bp, Homo sapiens
tgcctccccctcgactcccggt

SEQ ID NO: 4682643 - DNA, 22 bp, Homo sapiens
tgctaaacagatgtcttcttgc

SEQ ID NO: 4682644 - DNA, 17 bp, Homo sapiens
tgctgctattttaactt

SEQ ID NO: 4682645 - DNA, 22 bp, Homo sapiens
tggactccaggatcctcctgga

SEQ ID NO: 4682646 - DNA, 19 bp, Homo sapiens
tggccgatggggcccacat

SEQ ID NO: 4682647 - DNA, 17 bp, Homo sapiens
tggcttttctggctggg

SEQ ID NO: 4682648 - DNA, 17 bp, Homo sapiens
tgggtgagcgggtgggg

SEQ ID NO: 4682649 - DNA, 16 bp, Homo sapiens
tggtataagaagactt

SEQ ID NO: 4682650 - DNA, 19 bp, Homo sapiens
tggttgagtgcaaatccat

SEQ ID NO: 4682651 - DNA, 24 bp, Homo sapiens
tgtatacttaaaaataaagtaact

SEQ ID NO: 4682652 - DNA, 16 bp, Homo sapiens
tgtattttatgctcat

SEQ ID NO: 4682653 - DNA, 19 bp, Homo sapiens
tgtcaatttttaaaacttt

SEQ ID NO: 4682654 - DNA, 12 bp, Homo sapiens
tgtgggtgggga

SEQ ID NO: 4682655 - DNA, 15 bp, Homo sapiens
tgttatattaaagaa

SEQ ID NO: 4682656 - DNA, 20 bp, Homo sapiens
tgttgcacagtccctcctgt

SEQ ID NO: 4682657 - DNA, 15 bp, Homo sapiens
tgttgttaatgtcat

SEQ ID NO: 4682658 - DNA, 17 bp, Homo sapiens
ttaaaaattattatata

SEQ ID NO: 4682659 - DNA, 13 bp, Homo sapiens
ttaaggcaaatca

SEQ ID NO: 4682660 - DNA, 15 bp, Homo sapiens
ttaataaatattgta

SEQ ID NO: 4682661 - DNA, 19 bp, Homo sapiens
ttacagagatataaatgaa

SEQ ID NO: 4682662 - DNA, 20 bp, Homo sapiens
ttacagagatataaatgaag

SEQ ID NO: 4682663 - DNA, 12 bp, Homo sapiens
ttactaataaaa

SEQ ID NO: 4682664 - DNA, 18 bp, Homo sapiens
ttactaataaaatgtgaa

SEQ ID NO: 4682665 - DNA, 21 bp, Homo sapiens
ttacttgatagacttactaat

SEQ ID NO: 4682666 - DNA, 16 bp, Homo sapiens
ttagatatattctcta

SEQ ID NO: 4682667 - DNA, 17 bp, Homo sapiens
ttagatatattctctaa

SEQ ID NO: 4682668 - DNA, 15 bp, Homo sapiens
ttatcttaaatatga

SEQ ID NO: 4682669 - DNA, 17 bp, Homo sapiens
ttatcttaaatatgaat

SEQ ID NO: 4682670 - DNA, 18 bp, Homo sapiens
ttcaagatgttatattaa

SEQ ID NO: 4682671 - DNA, 19 bp, Homo sapiens
ttcaagatgttatattaaa

SEQ ID NO: 4682672 - DNA, 16 bp, Homo sapiens
ttcatgatttcaagat

SEQ ID NO: 4682673 - DNA, 17 bp, Homo sapiens
ttcatgatttcaagatg

SEQ ID NO: 4682674 - DNA, 15 bp, Homo sapiens
ttccacatccccacc

SEQ ID NO: 4682675 - DNA, 16 bp, Homo sapiens
ttccacatccccacct

SEQ ID NO: 4682676 - DNA, 22 bp, Homo sapiens
ttccacatccccaccttccaag

SEQ ID NO: 4682677 - DNA, 22 bp, Homo sapiens
ttccccactctgctcccagccc

SEQ ID NO: 4682678 - DNA, 23 bp, Homo sapiens
ttccctttctttaaaagaaactt

SEQ ID NO: 4682679 - DNA, 18 bp, Homo sapiens
ttctaattgttttgtgtg

SEQ ID NO: 4682680 - DNA, 16 bp, Homo sapiens
ttctatagcagtcatc

SEQ ID NO: 4682681 - DNA, 19 bp, Homo sapiens
ttctatagcagtcatcatt

SEQ ID NO: 4682682 - DNA, 21 bp, Homo sapiens
ttctctaataaaattcagaat

SEQ ID NO: 4682683 - DNA, 13 bp, Homo sapiens
ttctggctgggga

SEQ ID NO: 4682684 - DNA, 13 bp, Homo sapiens
ttgaactgagccg

SEQ ID NO: 4682685 - DNA, 19 bp, Homo sapiens
ttgaaggaacttaaaactt

SEQ ID NO: 4682686 - DNA, 20 bp, Homo sapiens
ttgactaaaatgctgctttt

SEQ ID NO: 4682687 - DNA, 16 bp, Homo sapiens
ttgagaccctcttctc

SEQ ID NO: 4682688 - DNA, 20 bp, Homo sapiens
ttgagaccctcttctctggg

SEQ ID NO: 4682689 - DNA, 17 bp, Homo sapiens
ttgcacagtccctcctg

SEQ ID NO: 4682690 - DNA, 13 bp, Homo sapiens
ttgtaatttaatg

SEQ ID NO: 4682691 - DNA, 21 bp, Homo sapiens
tttaaaacataggaaagtaga

SEQ ID NO: 4682692 - DNA, 12 bp, Homo sapiens
tttaatgacttt

SEQ ID NO: 4682693 - DNA, 22 bp, Homo sapiens
tttcaagatgttatattaaaga

SEQ ID NO: 4682694 - DNA, 12 bp, Homo sapiens
tttcactgggga

SEQ ID NO: 4682695 - DNA, 13 bp, Homo sapiens
tttcactggggat

SEQ ID NO: 4682696 - DNA, 17 bp, Homo sapiens
tttcctatgcaactttt

SEQ ID NO: 4682697 - DNA, 15 bp, Homo sapiens
tttctgtaacacaga

SEQ ID NO: 4682698 - DNA, 14 bp, Homo sapiens
tttgaactgagccg

SEQ ID NO: 4682699 - DNA, 17 bp, Homo sapiens
gcagggtcaggagaggg

SEQ ID NO: 4682700 - DNA, 17 bp, Homo sapiens
gcagtgcttggcccagg

SEQ ID NO: 4682701 - DNA, 19 bp, Homo sapiens
gcataacctgtctcacctg

SEQ ID NO: 4682702 - DNA, 19 bp, Homo sapiens
gcatttaggccatgggaca

SEQ ID NO: 4682703 - DNA, 16 bp, Homo sapiens
gccaatatcctaataa

SEQ ID NO: 4682704 - DNA, 20 bp, Homo sapiens
gccaatatcctaataaaaag

SEQ ID NO: 4682705 - DNA, 19 bp, Homo sapiens
gccaccagttctcatgggt

SEQ ID NO: 4682706 - DNA, 16 bp, Homo sapiens
gccacttaatgtatgt

SEQ ID NO: 4682707 - DNA, 19 bp, Homo sapiens
gccacttaatgtatgttac

SEQ ID NO: 4682708 - DNA, 14 bp, Homo sapiens
gccagacatgtggt

SEQ ID NO: 4682709 - DNA, 13 bp, Homo sapiens
gccagcagccagc

SEQ ID NO: 4682710 - DNA, 15 bp, Homo sapiens
gccagcagccagctc

SEQ ID NO: 4682711 - DNA, 16 bp, Homo sapiens
gccagcagccagctct

SEQ ID NO: 4682712 - DNA, 17 bp, Homo sapiens
gccagcagccagctctc

SEQ ID NO: 4682713 - DNA, 20 bp, Homo sapiens
gccagcagccagctctcagc

SEQ ID NO: 4682714 - DNA, 16 bp, Homo sapiens
gccagccagcagccag

SEQ ID NO: 4682715 - DNA, 14 bp, Homo sapiens
gccagctctcagcc

SEQ ID NO: 4682716 - DNA, 14 bp, Homo sapiens
gccatgggacaggg

SEQ ID NO: 4682717 - DNA, 13 bp, Homo sapiens
gcccaggagtttg

SEQ ID NO: 4682718 - DNA, 12 bp, Homo sapiens
gcccagggctca

SEQ ID NO: 4682719 - DNA, 15 bp, Homo sapiens
gcccagggctcagcc

SEQ ID NO: 4682720 - DNA, 16 bp, Homo sapiens
gcccagggctcagcct

SEQ ID NO: 4682721 - DNA, 16 bp, Homo sapiens
gcccgtcttcagccta

SEQ ID NO: 4682722 - DNA, 18 bp, Homo sapiens
gcccgtcttcagcctagc

SEQ ID NO: 4682723 - DNA, 17 bp, Homo sapiens
gccctagagcacactgt

SEQ ID NO: 4682724 - DNA, 13 bp, Homo sapiens
gccctgagctcgg

SEQ ID NO: 4682725 - DNA, 15 bp, Homo sapiens
gccctgagctcggtg

SEQ ID NO: 4682726 - DNA, 18 bp, Homo sapiens
gcctagccgacctcagcc

SEQ ID NO: 4682727 - DNA, 12 bp, Homo sapiens
gcctccatcctg

SEQ ID NO: 4682728 - DNA, 16 bp, Homo sapiens
gcctccatcctgaggc

SEQ ID NO: 4682729 - DNA, 16 bp, Homo sapiens
gcctcctctgtccagg

SEQ ID NO: 4682730 - DNA, 14 bp, Homo sapiens
gcctcggagcctca

SEQ ID NO: 4682731 - DNA, 17 bp, Homo sapiens
gcctcggagcctcatcc

SEQ ID NO: 4682732 - DNA, 13 bp, Homo sapiens
gcctggtgggcct

SEQ ID NO: 4682733 - DNA, 15 bp, Homo sapiens
gcctgtgctgcccgt

SEQ ID NO: 4682734 - DNA, 18 bp, Homo sapiens
gccttccccttgcccagg

SEQ ID NO: 4682735 - DNA, 14 bp, Homo sapiens
gcctttttcattta

SEQ ID NO: 4682736 - DNA, 17 bp, Homo sapiens
gctaattcaaggaattt

SEQ ID NO: 4682737 - DNA, 21 bp, Homo sapiens
gctaccagtatttagaagcca

SEQ ID NO: 4682738 - DNA, 14 bp, Homo sapiens
gctacctcactggg

SEQ ID NO: 4682739 - DNA, 13 bp, Homo sapiens
gctagaactccct

SEQ ID NO: 4682740 - DNA, 14 bp, Homo sapiens
gctcagcctggtgg

SEQ ID NO: 4682741 - DNA, 19 bp, Homo sapiens
gctccaccttgcagctctc

SEQ ID NO: 4682742 - DNA, 20 bp, Homo sapiens
gctccacttggtctgtgaga

SEQ ID NO: 4682743 - DNA, 21 bp, Homo sapiens
ttgtgtgttatttaaatgagt

SEQ ID NO: 4682744 - DNA, 13 bp, Homo sapiens
ttgtttttccttg

SEQ ID NO: 4682745 - DNA, 21 bp, Homo sapiens
ttgtttttccttgtatttaaa

SEQ ID NO: 4682746 - DNA, 13 bp, Homo sapiens
tttaaagaaagtg

SEQ ID NO: 4682747 - DNA, 12 bp, Homo sapiens
tttccaactact

SEQ ID NO: 4682748 - DNA, 18 bp, Homo sapiens
tttccaactactaataga

SEQ ID NO: 4682749 - DNA, 15 bp, Homo sapiens
tttctgtaccagtta

SEQ ID NO: 4682750 - DNA, 17 bp, Homo sapiens
tttcttaacttcttgct

SEQ ID NO: 4682751 - DNA, 18 bp, Homo sapiens
tttcttaacttcttgctt

SEQ ID NO: 4682752 - DNA, 21 bp, Homo sapiens
tttcttaacttcttgcttctt

SEQ ID NO: 4682753 - DNA, 11 bp, Homo sapiens
tttgaaaatgg

SEQ ID NO: 4682754 - DNA, 10 bp, Homo sapiens
tttggccaga

SEQ ID NO: 4682755 - DNA, 14 bp, Homo sapiens
tttggccagaagtc

SEQ ID NO: 4682756 - DNA, 20 bp, Homo sapiens
ttttaaattcccgttttgtc

SEQ ID NO: 4682757 - DNA, 19 bp, Homo sapiens
ttttcggccccatgtatct

SEQ ID NO: 4682758 - DNA, 21 bp, Homo sapiens
ttttctgtaccagttaatttt

SEQ ID NO: 4682759 - DNA, 24 bp, Homo sapiens
ttttgtataattggatttcctaat

SEQ ID NO: 4682760 - DNA, 13 bp, Homo sapiens
ttttgttggcata

SEQ ID NO: 4682761 - DNA, 13 bp, Homo sapiens
tttttctgataaa

SEQ ID NO: 4682762 - DNA, 17 bp, Homo sapiens
tttttctgataaaagat

SEQ ID NO: 4682763 - DNA, 14 bp, Homo sapiens
tttttctgtaccag

SEQ ID NO: 4682764 - DNA, 16 bp, Homo sapiens
gctcctgtctgccagc

SEQ ID NO: 4682765 - DNA, 18 bp, Homo sapiens
gctcctgtctgccagcca

SEQ ID NO: 4682766 - DNA, 19 bp, Homo sapiens
gctcctgtctgccagccag

SEQ ID NO: 4682767 - DNA, 15 bp, Homo sapiens
gctctaacagccctc

SEQ ID NO: 4682768 - DNA, 18 bp, Homo sapiens
gctctaattcacagtgct

SEQ ID NO: 4682769 - DNA, 10 bp, Homo sapiens
gctctcagcc

SEQ ID NO: 4682770 - DNA, 11 bp, Homo sapiens
gctctcagcca

SEQ ID NO: 4682771 - DNA, 13 bp, Homo sapiens
gctctctggcctt

SEQ ID NO: 4682772 - DNA, 14 bp, Homo sapiens
gctctctggccttc

SEQ ID NO: 4682773 - DNA, 15 bp, Homo sapiens
gctctctggccttcg

SEQ ID NO: 4682774 - DNA, 20 bp, Homo sapiens
gctctctggccttcggcctc

SEQ ID NO: 4682775 - DNA, 19 bp, Homo sapiens
gctctggggtgggcagttt

SEQ ID NO: 4682776 - DNA, 12 bp, Homo sapiens
gctgaacatcac

SEQ ID NO: 4682777 - DNA, 20 bp, Homo sapiens
gctgactaaactttttttct

SEQ ID NO: 4682778 - DNA, 18 bp, Homo sapiens
gctgccaatatcctaata

SEQ ID NO: 4682779 - DNA, 16 bp, Homo sapiens
gctgcccgtcttcagc

SEQ ID NO: 4682780 - DNA, 19 bp, Homo sapiens
gctgcccgtcttcagccta

SEQ ID NO: 4682781 - DNA, 21 bp, Homo sapiens
gctgcccgtcttcagcctagc

SEQ ID NO: 4682782 - DNA, 21 bp, Homo sapiens
gctgtaactactttataacta

SEQ ID NO: 4682783 - DNA, 14 bp, Homo sapiens
gcttagacctcagc

SEQ ID NO: 4682784 - DNA, 16 bp, Homo sapiens
gcttagacctcagcct

SEQ ID NO: 4682785 - DNA, 17 bp, Homo sapiens
gcttagacctcagcctg

SEQ ID NO: 4682786 - DNA, 18 bp, Homo sapiens
gcttagacctcagcctgt

SEQ ID NO: 4682787 - DNA, 23 bp, Homo sapiens
gcttagacctcagcctgtgctgc

SEQ ID NO: 4682788 - DNA, 21 bp, Homo sapiens
gcttctttctagaaagagaaa

SEQ ID NO: 4682789 - DNA, 14 bp, Homo sapiens
ggaaaattcatttt

SEQ ID NO: 4682790 - DNA, 15 bp, Homo sapiens
ggaaaattcattttt

SEQ ID NO: 4682791 - DNA, 18 bp, Homo sapiens
ggaatttcttaacttctt

SEQ ID NO: 4682792 - DNA, 13 bp, Homo sapiens
ggacgctctctgg

SEQ ID NO: 4682793 - DNA, 14 bp, Homo sapiens
ggacgctctctggc

SEQ ID NO: 4682794 - DNA, 23 bp, Homo sapiens
ggagccctgtctcctctctctgt

SEQ ID NO: 4682795 - DNA, 21 bp, Homo sapiens
ggagcctcatccgaggcaggg

SEQ ID NO: 4682796 - DNA, 16 bp, Homo sapiens
ggatgacatgtcccta

SEQ ID NO: 4682797 - DNA, 19 bp, Homo sapiens
ggcaactgaggcagacagc

SEQ ID NO: 4682798 - DNA, 14 bp, Homo sapiens
ggcagaacagccgc

SEQ ID NO: 4682799 - DNA, 18 bp, Homo sapiens
ggcagaacagccgctcct

SEQ ID NO: 4682800 - DNA, 20 bp, Homo sapiens
ggcagaacagccgctcctgt

SEQ ID NO: 4682801 - DNA, 20 bp, Homo sapiens
ggcagacagcagctcaggca

SEQ ID NO: 4682802 - DNA, 18 bp, Homo sapiens
ggcagagttacagttctg

SEQ ID NO: 4682803 - DNA, 16 bp, Homo sapiens
ggcagtgcttggccca

SEQ ID NO: 4682804 - DNA, 18 bp, Homo sapiens
ggcagtgcttggcccagg

SEQ ID NO: 4682805 - DNA, 21 bp, Homo sapiens
ggcagtgcttggcccaggagt

SEQ ID NO: 4682806 - DNA, 22 bp, Homo sapiens
ggcagtgcttggcccaggagtt

SEQ ID NO: 4682807 - DNA, 23 bp, Homo sapiens
ggcagtgcttggcccaggagttt

SEQ ID NO: 4682808 - DNA, 13 bp, Homo sapiens
ggcatagctctgg

SEQ ID NO: 4682809 - DNA, 15 bp, Homo sapiens
ggcccaccagggtcc

SEQ ID NO: 4682810 - DNA, 19 bp, Homo sapiens
ggcccaggagtttggccag

SEQ ID NO: 4682811 - DNA, 14 bp, Homo sapiens
ggcctccatcctga

SEQ ID NO: 4682812 - DNA, 15 bp, Homo sapiens
ggcctccatcctgag

SEQ ID NO: 4682813 - DNA, 19 bp, Homo sapiens
ggcctcctctgtccagggc

SEQ ID NO: 4682814 - DNA, 14 bp, Homo sapiens
gtgagtcaccactt

SEQ ID NO: 4682815 - DNA, 13 bp, Homo sapiens
gtgcgtcctgtcg

SEQ ID NO: 4682816 - DNA, 16 bp, Homo sapiens
gtgctcttttctcctc

SEQ ID NO: 4682817 - DNA, 20 bp, Homo sapiens
gtgctcttttctcctcactg

SEQ ID NO: 4682818 - DNA, 18 bp, Homo sapiens
gtgctgcccgtcttcagc

SEQ ID NO: 4682819 - DNA, 19 bp, Homo sapiens
gtgcttggcccaggagttt

SEQ ID NO: 4682820 - DNA, 19 bp, Homo sapiens
gtggctgctagcacttgga

SEQ ID NO: 4682821 - DNA, 20 bp, Homo sapiens
gttaatttttccaactacta

SEQ ID NO: 4682822 - DNA, 18 bp, Homo sapiens
gttaccttatagttactg

SEQ ID NO: 4682823 - DNA, 20 bp, Homo sapiens
gttaccttatagttactgtg

SEQ ID NO: 4682824 - DNA, 13 bp, Homo sapiens
gttactgtgtaat

SEQ ID NO: 4682825 - DNA, 23 bp, Homo sapiens
gttagttaccttatagttactgt

SEQ ID NO: 4682826 - DNA, 10 bp, Homo sapiens
gttatttaaa

SEQ ID NO: 4682827 - DNA, 15 bp, Homo sapiens
gttcatgcagctgtg

SEQ ID NO: 4682828 - DNA, 13 bp, Homo sapiens
gttccctcccaga

SEQ ID NO: 4682829 - DNA, 16 bp, Homo sapiens
gttctgtggtttcatg

SEQ ID NO: 4682830 - DNA, 19 bp, Homo sapiens
gttctgtggtttcatgtta

SEQ ID NO: 4682831 - DNA, 16 bp, Homo sapiens
gtttaaagaaagtgta

SEQ ID NO: 4682832 - DNA, 21 bp, Homo sapiens
gtttaaagaaagtgtatttgg

SEQ ID NO: 4682833 - DNA, 21 bp, Homo sapiens
gtttattaatcttagtgtatg

SEQ ID NO: 4682834 - DNA, 19 bp, Homo sapiens
gtttttccttgtatttaaa

SEQ ID NO: 4682835 - DNA, 13 bp, Homo sapiens
taaaaaggtgacc

SEQ ID NO: 4682836 - DNA, 18 bp, Homo sapiens
taaactttttttctgtac

SEQ ID NO: 4682837 - DNA, 20 bp, Homo sapiens
taaactttttttctgtacca

SEQ ID NO: 4682838 - DNA, 15 bp, Homo sapiens
taaagaaagtgtatt

SEQ ID NO: 4682839 - DNA, 13 bp, Homo sapiens
taaagcagtggac

SEQ ID NO: 4682840 - DNA, 19 bp, Homo sapiens
taaagcagtggacaccagg

SEQ ID NO: 4682841 - DNA, 14 bp, Homo sapiens
taaaggcagttttc

SEQ ID NO: 4682842 - DNA, 18 bp, Homo sapiens
taaatatgttagcaaaga

SEQ ID NO: 4682843 - DNA, 21 bp, Homo sapiens
taaatatgttagcaaagagtt

SEQ ID NO: 4682844 - DNA, 18 bp, Homo sapiens
taacagccctcctctgca

SEQ ID NO: 4682845 - DNA, 12 bp, Homo sapiens
taacttcttgct

SEQ ID NO: 4682846 - DNA, 13 bp, Homo sapiens
taacttcttgctt

SEQ ID NO: 4682847 - DNA, 19 bp, Homo sapiens
taacttcttgcttctttct

SEQ ID NO: 4682848 - DNA, 16 bp, Homo sapiens
taacttttgtgaatta

SEQ ID NO: 4682849 - DNA, 19 bp, Homo sapiens
taagattacaaatcagaag

SEQ ID NO: 4682850 - DNA, 14 bp, Homo sapiens
taagtactgtgtac

SEQ ID NO: 4682851 - DNA, 15 bp, Homo sapiens
taataaaaaggtgac

SEQ ID NO: 4682852 - DNA, 14 bp, Homo sapiens
taatagaataaagg

SEQ ID NO: 4682853 - DNA, 16 bp, Homo sapiens
taatagaataaaggca

SEQ ID NO: 4682854 - DNA, 13 bp, Homo sapiens
taatcttagtgta

SEQ ID NO: 4682855 - DNA, 15 bp, Homo sapiens
taatcttagtgtatg

SEQ ID NO: 4682856 - DNA, 22 bp, Homo sapiens
taattcacagtgctcttttctc

SEQ ID NO: 4682857 - DNA, 16 bp, Homo sapiens
taattggatttcctaa

SEQ ID NO: 4682858 - DNA, 22 bp, Homo sapiens
tccttttgacactgctctaaca

SEQ ID NO: 4682859 - DNA, 14 bp, Homo sapiens
tcggagccctgtct

SEQ ID NO: 4682860 - DNA, 15 bp, Homo sapiens
tcggcctccatcctg

SEQ ID NO: 4682861 - DNA, 16 bp, Homo sapiens
tcggcctccatcctga

SEQ ID NO: 4682862 - DNA, 12 bp, Homo sapiens
tctaacagccct

SEQ ID NO: 4682863 - DNA, 13 bp, Homo sapiens
tctaacagccctc

SEQ ID NO: 4682864 - DNA, 21 bp, Homo sapiens
tctaacagccctcctctgcac

SEQ ID NO: 4682865 - DNA, 22 bp, Homo sapiens
tctaacagccctcctctgcact

SEQ ID NO: 4682866 - DNA, 21 bp, Homo sapiens
tctaccccagactagatgtag

SEQ ID NO: 4682867 - DNA, 23 bp, Homo sapiens
tctaccccagactagatgtagta

SEQ ID NO: 4682868 - DNA, 19 bp, Homo sapiens
tctagaaagagaaacagtt

SEQ ID NO: 4682869 - DNA, 24 bp, Homo sapiens
tctcacctggacttaagcatctgg

SEQ ID NO: 4682870 - DNA, 12 bp, Homo sapiens
tctccagctgac

SEQ ID NO: 4682871 - DNA, 17 bp, Homo sapiens
tctctggccttcggcct

SEQ ID NO: 4682872 - DNA, 23 bp, Homo sapiens
tctctggccttcggcctccatcc

SEQ ID NO: 4682873 - DNA, 18 bp, Homo sapiens
tctctgtaataaactcat

SEQ ID NO: 4682874 - DNA, 22 bp, Homo sapiens
tctctgtaataaactcatttct

SEQ ID NO: 4682875 - DNA, 15 bp, Homo sapiens
tctcttctctccagc

SEQ ID NO: 4682876 - DNA, 21 bp, Homo sapiens
tctgcactcccacctgacaca

SEQ ID NO: 4682877 - DNA, 19 bp, Homo sapiens
tctgccagccagcagccag

SEQ ID NO: 4682878 - DNA, 14 bp, Homo sapiens
tctgctacctcact

SEQ ID NO: 4682879 - DNA, 14 bp, Homo sapiens
tctggcccaccagg

SEQ ID NO: 4682880 - DNA, 20 bp, Homo sapiens
tctggctctaattcacagtg

SEQ ID NO: 4682881 - DNA, 22 bp, Homo sapiens
tctggctctaattcacagtgct

SEQ ID NO: 4682882 - DNA, 17 bp, Homo sapiens
tctggtgagtcaccact

SEQ ID NO: 4682883 - DNA, 20 bp, Homo sapiens
tctggtgagtcaccacttca

SEQ ID NO: 4682884 - DNA, 22 bp, Homo sapiens
tctgtaccagttaatttttcca

SEQ ID NO: 4682885 - DNA, 17 bp, Homo sapiens
tctgtccagggccctga

SEQ ID NO: 4682886 - DNA, 22 bp, Homo sapiens
tctgtgagatgctagaactccc

SEQ ID NO: 4682887 - DNA, 23 bp, Homo sapiens
tctgtgagatgctagaactccct

SEQ ID NO: 4682888 - DNA, 16 bp, Homo sapiens
tcttaacttcttgctt

SEQ ID NO: 4682889 - DNA, 21 bp, Homo sapiens
tcttcagcctagccgacctca

SEQ ID NO: 4682890 - DNA, 22 bp, Homo sapiens
tcttcagcctagccgacctcag

SEQ ID NO: 4682891 - DNA, 18 bp, Homo sapiens
tcttctctccagctgact

SEQ ID NO: 4682892 - DNA, 16 bp, Homo sapiens
tcttgggtaggcggga

SEQ ID NO: 4682893 - DNA, 16 bp, Homo sapiens
tgacacaccaggcgct

SEQ ID NO: 4682894 - DNA, 22 bp, Homo sapiens
tgacacaccaggcgctaattca

SEQ ID NO: 4682895 - DNA, 21 bp, Homo sapiens
tgacactgctctaacagccct

SEQ ID NO: 4682896 - DNA, 19 bp, Homo sapiens
tgactaaactttttttctg

SEQ ID NO: 4682897 - DNA, 21 bp, Homo sapiens
tgactaaactttttttctgta

SEQ ID NO: 4682898 - DNA, 21 bp, Homo sapiens
tgagagcagtttggtttctag

SEQ ID NO: 4682899 - DNA, 23 bp, Homo sapiens
tgagagcagtttggtttctagca

SEQ ID NO: 4682900 - DNA, 14 bp, Homo sapiens
tgagatgctagaac

SEQ ID NO: 4682901 - DNA, 20 bp, Homo sapiens
tgagatgctagaactccctt

SEQ ID NO: 4682902 - DNA, 12 bp, Homo sapiens
tgaggcagacag

SEQ ID NO: 4682903 - DNA, 14 bp, Homo sapiens
tgaggcagacagca

SEQ ID NO: 4682904 - DNA, 15 bp, Homo sapiens
tgaggcagacagcag

SEQ ID NO: 4682905 - DNA, 17 bp, Homo sapiens
tgaggcagacagcagct

SEQ ID NO: 4682906 - DNA, 24 bp, Homo sapiens
tgaggcagacagcagctcaggcac

SEQ ID NO: 4682907 - DNA, 23 bp, Homo sapiens
tgattactggcctttttcattta

SEQ ID NO: 4682908 - DNA, 20 bp, Homo sapiens
tgattattaacgatgtccaa

SEQ ID NO: 4682909 - DNA, 17 bp, Homo sapiens
tgatttagcaggaagct

SEQ ID NO: 4682910 - DNA, 16 bp, Homo sapiens
tgcaagcacagccctt

SEQ ID NO: 4682911 - DNA, 18 bp, Homo sapiens
tgcaaggtactctggtga

SEQ ID NO: 4682912 - DNA, 16 bp, Homo sapiens
tgcacgcacactgtct

SEQ ID NO: 4682913 - DNA, 17 bp, Homo sapiens
tgcacgcacactgtctg

SEQ ID NO: 4682914 - DNA, 19 bp, Homo sapiens
tgcactcccacctgacaca

SEQ ID NO: 4682915 - DNA, 20 bp, Homo sapiens
tgcagagacaggacctgact

SEQ ID NO: 4682916 - DNA, 18 bp, Homo sapiens
aaaaataaatatatctac

SEQ ID NO: 4682917 - DNA, 18 bp, Homo sapiens
aaacagttggtaactttt

SEQ ID NO: 4682918 - DNA, 22 bp, Homo sapiens
aaacagttggtaacttttgtga

SEQ ID NO: 4682919 - DNA, 16 bp, Homo sapiens
aaactcatttctagca

SEQ ID NO: 4682920 - DNA, 19 bp, Homo sapiens
aaactttttttctgtacca

SEQ ID NO: 4682921 - DNA, 10 bp, Homo sapiens
aaagaaagtg

SEQ ID NO: 4682922 - DNA, 22 bp, Homo sapiens
aaagagaaacagttggtaactt

SEQ ID NO: 4682923 - DNA, 13 bp, Homo sapiens
aaaggcagttttc

SEQ ID NO: 4682924 - DNA, 14 bp, Homo sapiens
aaaggcagttttct

SEQ ID NO: 4682925 - DNA, 10 bp, Homo sapiens
aaagtgtatt

SEQ ID NO: 4682926 - DNA, 18 bp, Homo sapiens
aaatcagaagtcatcttg

SEQ ID NO: 4682927 - DNA, 12 bp, Homo sapiens
aaatgagtgtgt

SEQ ID NO: 4682928 - DNA, 13 bp, Homo sapiens
aaattcatttttt

SEQ ID NO: 4682929 - DNA, 17 bp, Homo sapiens
aacagccctcctctgca

SEQ ID NO: 4682930 - DNA, 17 bp, Homo sapiens
aacagttggtaactttt

SEQ ID NO: 4682931 - DNA, 21 bp, Homo sapiens
aacagttggtaacttttgtga

SEQ ID NO: 4682932 - DNA, 22 bp, Homo sapiens
aacagttggtaacttttgtgaa

SEQ ID NO: 4682933 - DNA, 15 bp, Homo sapiens
aactaacatgtcctg

SEQ ID NO: 4682934 - DNA, 17 bp, Homo sapiens
aactactaatagaataa

SEQ ID NO: 4682935 - DNA, 12 bp, Homo sapiens
aactgaggcaga

SEQ ID NO: 4682936 - DNA, 20 bp, Homo sapiens
aacttcttgcttctttctag

SEQ ID NO: 4682937 - DNA, 22 bp, Homo sapiens
aacttcttgcttctttctagaa

SEQ ID NO: 4682938 - DNA, 19 bp, Homo sapiens
aacttttgtgaattaggct

SEQ ID NO: 4682939 - DNA, 22 bp, Homo sapiens
aactttttttctgtaccagtta

SEQ ID NO: 4682940 - DNA, 19 bp, Homo sapiens
aagatggcataacctgtct

SEQ ID NO: 4682941 - DNA, 13 bp, Homo sapiens
aagcatctggctc

SEQ ID NO: 4682942 - DNA, 19 bp, Homo sapiens
aaggaatttcttaacttct

SEQ ID NO: 4682943 - DNA, 23 bp, Homo sapiens
aagggattttcagccctcagaat

SEQ ID NO: 4682944 - DNA, 20 bp, Homo sapiens
aagtcagatggaaaattcat

SEQ ID NO: 4682945 - DNA, 23 bp, Homo sapiens
aagtcagatggaaaattcatttt

SEQ ID NO: 4682946 - DNA, 14 bp, Homo sapiens
aagtgctgtttatt

SEQ ID NO: 4682947 - DNA, 16 bp, Homo sapiens
aagtgctgtttattaa

SEQ ID NO: 4682948 - DNA, 18 bp, Homo sapiens
aagtgctgtttattaatc

SEQ ID NO: 4682949 - DNA, 20 bp, Homo sapiens
aagtgctgtttattaatctt

SEQ ID NO: 4682950 - DNA, 13 bp, Homo sapiens
aagtgtatttgga

SEQ ID NO: 4682951 - DNA, 21 bp, Homo sapiens
aagtgtatttggaaataaagt

SEQ ID NO: 4682952 - DNA, 16 bp, Homo sapiens
aataaaaaggtgacca

SEQ ID NO: 4682953 - DNA, 21 bp, Homo sapiens
aatcttagtgtatgattactg

SEQ ID NO: 4682954 - DNA, 13 bp, Homo sapiens
aatgtatgttacc

SEQ ID NO: 4682955 - DNA, 16 bp, Homo sapiens
aattagacactttgga

SEQ ID NO: 4682956 - DNA, 20 bp, Homo sapiens
aattagtgccacttaatgta

SEQ ID NO: 4682957 - DNA, 18 bp, Homo sapiens
aattcattttttaaattc

SEQ ID NO: 4682958 - DNA, 20 bp, Homo sapiens
aattcccgttttgtcacttt

SEQ ID NO: 4682959 - DNA, 17 bp, Homo sapiens
aattggatttcctaata

SEQ ID NO: 4682960 - DNA, 13 bp, Homo sapiens
aatttacctaaga

SEQ ID NO: 4682961 - DNA, 17 bp, Homo sapiens
aatttacctaagattac

SEQ ID NO: 4682962 - DNA, 15 bp, Homo sapiens
aatttcttaacttct

SEQ ID NO: 4682963 - DNA, 16 bp, Homo sapiens
acaaatcagaagtcat

SEQ ID NO: 4682964 - DNA, 19 bp, Homo sapiens
acacaggcaactgaggcag

SEQ ID NO: 4682965 - DNA, 19 bp, Homo sapiens
acaccaggagtccctggta

SEQ ID NO: 4682966 - DNA, 16 bp, Homo sapiens
acacccctcccctgcc

SEQ ID NO: 4682967 - DNA, 17 bp, Homo sapiens
acactgctctaacagcc

SEQ ID NO: 4682968 - DNA, 22 bp, Homo sapiens
acacttcttcttggtcttattt

SEQ ID NO: 4682969 - DNA, 14 bp, Homo sapiens
acagcagctcaggc

SEQ ID NO: 4682970 - DNA, 24 bp, Homo sapiens
acagccgctcctgtctgccagcca

SEQ ID NO: 4682971 - DNA, 20 bp, Homo sapiens
acagggaggacgctctctgg

SEQ ID NO: 4682972 - DNA, 15 bp, Homo sapiens
acagtgctcttttct

SEQ ID NO: 4682973 - DNA, 17 bp, Homo sapiens
acagtgctcttttctcc

SEQ ID NO: 4682974 - DNA, 14 bp, Homo sapiens
acatgctgaacatc

SEQ ID NO: 4682975 - DNA, 21 bp, Homo sapiens
acatgctgaacatcacagctt

SEQ ID NO: 4682976 - DNA, 15 bp, Homo sapiens
acatgtggtgggaca

SEQ ID NO: 4682977 - DNA, 17 bp, Homo sapiens
accaggagtccctggta

SEQ ID NO: 4682978 - DNA, 11 bp, Homo sapiens
accagtattta

SEQ ID NO: 4682979 - DNA, 18 bp, Homo sapiens
accagtatttagaagcca

SEQ ID NO: 4682980 - DNA, 14 bp, Homo sapiens
accagttaattttt

SEQ ID NO: 4682981 - DNA, 22 bp, Homo sapiens
acccagtgttttaggagcatga

SEQ ID NO: 4682982 - DNA, 14 bp, Homo sapiens
accctcatgctgcc

SEQ ID NO: 4682983 - DNA, 21 bp, Homo sapiens
acctaagattacaaatcagaa

SEQ ID NO: 4682984 - DNA, 21 bp, Homo sapiens
acctgacacaccaggcgctaa

SEQ ID NO: 4682985 - DNA, 14 bp, Homo sapiens
accttatagttact

SEQ ID NO: 4682986 - DNA, 18 bp, Homo sapiens
accttatagttactgtgt

SEQ ID NO: 4682987 - DNA, 22 bp, Homo sapiens
accttatagttactgtgtaatt

SEQ ID NO: 4682988 - DNA, 23 bp, Homo sapiens
accttatagttactgtgtaatta

SEQ ID NO: 4682989 - DNA, 16 bp, Homo sapiens
acgagtaatttattgt

SEQ ID NO: 4682990 - DNA, 17 bp, Homo sapiens
actaaactttttttctg

SEQ ID NO: 4682991 - DNA, 18 bp, Homo sapiens
actaaactttttttctgt

SEQ ID NO: 4682992 - DNA, 19 bp, Homo sapiens
actaaactttttttctgta

SEQ ID NO: 4682993 - DNA, 22 bp, Homo sapiens
actaaactttttttctgtacca

SEQ ID NO: 4682994 - DNA, 12 bp, Homo sapiens
actagatgtagt

SEQ ID NO: 4682995 - DNA, 17 bp, Homo sapiens
actagatgtagtatttt

SEQ ID NO: 4682996 - DNA, 14 bp, Homo sapiens
actatcaaactgaa

SEQ ID NO: 4682997 - DNA, 14 bp, Homo sapiens
actcagggccccag

SEQ ID NO: 4682998 - DNA, 15 bp, Homo sapiens
actcagggccccagc

SEQ ID NO: 4682999 - DNA, 17 bp, Homo sapiens
actcagtctctcttctc

SEQ ID NO: 4683000 - DNA, 14 bp, Homo sapiens
actcccacctgaca

SEQ ID NO: 4683001 - DNA, 18 bp, Homo sapiens
actgaagccagaaataaa

SEQ ID NO: 4683002 - DNA, 15 bp, Homo sapiens
actgaggcagacagc

SEQ ID NO: 4683003 - DNA, 18 bp, Homo sapiens
actgctctaacagccctc

SEQ ID NO: 4683004 - DNA, 13 bp, Homo sapiens
actgggggagggg

SEQ ID NO: 4683005 - DNA, 18 bp, Homo sapiens
actggggtcctggggcct

SEQ ID NO: 4683006 - DNA, 17 bp, Homo sapiens
acttaagcatctggctc

SEQ ID NO: 4683007 - DNA, 21 bp, Homo sapiens
acttaagcatctggctctaat

SEQ ID NO: 4683008 - DNA, 15 bp, Homo sapiens
acttaatgtatgtta

SEQ ID NO: 4683009 - DNA, 16 bp, Homo sapiens
acttaatgtatgttac

SEQ ID NO: 4683010 - DNA, 16 bp, Homo sapiens
acttcacacacaggca

SEQ ID NO: 4683011 - DNA, 17 bp, Homo sapiens
acttcacacacaggcaa

SEQ ID NO: 4683012 - DNA, 19 bp, Homo sapiens
acttcacacacaggcaact

SEQ ID NO: 4683013 - DNA, 11 bp, Homo sapiens
acttcttgctt

SEQ ID NO: 4683014 - DNA, 14 bp, Homo sapiens
acttggagccaagg

SEQ ID NO: 4683015 - DNA, 19 bp, Homo sapiens
acttggagccaagggttca

SEQ ID NO: 4683016 - DNA, 12 bp, Homo sapiens
actttttctgat

SEQ ID NO: 4683017 - DNA, 23 bp, Homo sapiens
actttttttctgtaccagttaat

SEQ ID NO: 4683018 - DNA, 21 bp, Homo sapiens
agaaacagttggtaacttttg

SEQ ID NO: 4683019 - DNA, 16 bp, Homo sapiens
agaaagtgtatttgga

SEQ ID NO: 4683020 - DNA, 19 bp, Homo sapiens
agaaataaagttggtgaca

SEQ ID NO: 4683021 - DNA, 18 bp, Homo sapiens
agaagccaactatgatta

SEQ ID NO: 4683022 - DNA, 23 bp, Homo sapiens
agaagccaactatgattattaac

SEQ ID NO: 4683023 - DNA, 18 bp, Homo sapiens
agaagtcaaggcttagac

SEQ ID NO: 4683024 - DNA, 16 bp, Homo sapiens
agaagtcatcttgcta

SEQ ID NO: 4683025 - DNA, 20 bp, Homo sapiens
agaataaaggcagttttcta

SEQ ID NO: 4683026 - DNA, 12 bp, Homo sapiens
agacagcagctc

SEQ ID NO: 4683027 - DNA, 18 bp, Homo sapiens
agacaggacctgactatt

SEQ ID NO: 4683028 - DNA, 17 bp, Homo sapiens
agacatgtggtgggaca

SEQ ID NO: 4683029 - DNA, 18 bp, Homo sapiens
agaccctcatgctgccaa

SEQ ID NO: 4683030 - DNA, 20 bp, Homo sapiens
agaccctcatgctgccaata

SEQ ID NO: 4683031 - DNA, 13 bp, Homo sapiens
agactagatgtag

SEQ ID NO: 4683032 - DNA, 16 bp, Homo sapiens
agactagatgtagtat

SEQ ID NO: 4683033 - DNA, 16 bp, Homo sapiens
agactcagggccccag

SEQ ID NO: 4683034 - DNA, 18 bp, Homo sapiens
agactcagggccccagca

SEQ ID NO: 4683035 - DNA, 20 bp, Homo sapiens
agactggatagtccgtctct

SEQ ID NO: 4683036 - DNA, 19 bp, Homo sapiens
agagactcagggccccagc

SEQ ID NO: 4683037 - DNA, 20 bp, Homo sapiens
agagactcagggccccagca

SEQ ID NO: 4683038 - DNA, 21 bp, Homo sapiens
agagcagtttggtttctagca

SEQ ID NO: 4683039 - DNA, 11 bp, Homo sapiens
agagttacagt

SEQ ID NO: 4683040 - DNA, 15 bp, Homo sapiens
agagttacagttctg

SEQ ID NO: 4683041 - DNA, 16 bp, Homo sapiens
agagttacagttctgt

SEQ ID NO: 4683042 - DNA, 13 bp, Homo sapiens
agatgcacatgag

SEQ ID NO: 4683043 - DNA, 14 bp, Homo sapiens
agatgctagaactc

SEQ ID NO: 4683044 - DNA, 21 bp, Homo sapiens
agatgctagaactccctttca

SEQ ID NO: 4683045 - DNA, 22 bp, Homo sapiens
agatggaaaattcattttttaa

SEQ ID NO: 4683046 - DNA, 21 bp, Homo sapiens
agatggcataacctgtctcac

SEQ ID NO: 4683047 - DNA, 16 bp, Homo sapiens
agcactaaagcagtgg

SEQ ID NO: 4683048 - DNA, 20 bp, Homo sapiens
agcactaaagcagtggacac

SEQ ID NO: 4683049 - DNA, 17 bp, Homo sapiens
agcacttggagccaagg

SEQ ID NO: 4683050 - DNA, 16 bp, Homo sapiens
agcagccagctctcag

SEQ ID NO: 4683051 - DNA, 19 bp, Homo sapiens
agcagccagctctcagcca

SEQ ID NO: 4683052 - DNA, 23 bp, Homo sapiens
agcagccagctctcagccaacga

SEQ ID NO: 4683053 - DNA, 21 bp, Homo sapiens
agcagctcaggcacacttctt

SEQ ID NO: 4683054 - DNA, 19 bp, Homo sapiens
agcagtggacaccaggagt

SEQ ID NO: 4683055 - DNA, 20 bp, Homo sapiens
agcagtttggtttctagcat

SEQ ID NO: 4683056 - DNA, 17 bp, Homo sapiens
agccaactatgattatt

SEQ ID NO: 4683057 - DNA, 18 bp, Homo sapiens
agccaagggttcagagac

SEQ ID NO: 4683058 - DNA, 19 bp, Homo sapiens
agccagaaataaagttggt

SEQ ID NO: 4683059 - DNA, 23 bp, Homo sapiens
agccagaaataaagttggtgaca

SEQ ID NO: 4683060 - DNA, 13 bp, Homo sapiens
agccagcagccag

SEQ ID NO: 4683061 - DNA, 13 bp, Homo sapiens
agccagctctcag

SEQ ID NO: 4683062 - DNA, 15 bp, Homo sapiens
agccagctctcagcc

SEQ ID NO: 4683063 - DNA, 21 bp, Homo sapiens
agcccaagttcatgcagctgt

SEQ ID NO: 4683064 - DNA, 19 bp, Homo sapiens
agccccaccctcagatgca

SEQ ID NO: 4683065 - DNA, 18 bp, Homo sapiens
agccctgtctcctctctc

SEQ ID NO: 4683066 - DNA, 16 bp, Homo sapiens
agccgacctcagcctt

SEQ ID NO: 4683067 - DNA, 14 bp, Homo sapiens
agccgctcctgtct

SEQ ID NO: 4683068 - DNA, 19 bp, Homo sapiens
agccgctcctgtctgccag

SEQ ID NO: 4683069 - DNA, 21 bp, Homo sapiens
agccgctcctgtctgccagcc

SEQ ID NO: 4683070 - DNA, 17 bp, Homo sapiens
agcctagccgacctcag

SEQ ID NO: 4683071 - DNA, 20 bp, Homo sapiens
agcctagccgacctcagcct

SEQ ID NO: 4683072 - DNA, 14 bp, Homo sapiens
agcctcatccgagg

SEQ ID NO: 4683073 - DNA, 19 bp, Homo sapiens
agcctcatccgaggcaggg

SEQ ID NO: 4683074 - DNA, 11 bp, Homo sapiens
agcctggtggg

SEQ ID NO: 4683075 - DNA, 22 bp, Homo sapiens
agcctggtgggcctcctctgtc

SEQ ID NO: 4683076 - DNA, 17 bp, Homo sapiens
agctcggtggacccagg

SEQ ID NO: 4683077 - DNA, 18 bp, Homo sapiens
agctcggtggacccaggg

SEQ ID NO: 4683078 - DNA, 12 bp, Homo sapiens
agctctcagcca

SEQ ID NO: 4683079 - DNA, 14 bp, Homo sapiens
agctctggggtggg

SEQ ID NO: 4683080 - DNA, 21 bp, Homo sapiens
agctctggggtgggcagtttt

SEQ ID NO: 4683081 - DNA, 20 bp, Homo sapiens
agcttatttcctcattttta

SEQ ID NO: 4683082 - DNA, 23 bp, Homo sapiens
aggaatttcttaacttcttgctt

SEQ ID NO: 4683083 - DNA, 13 bp, Homo sapiens
aggacgctctctg

SEQ ID NO: 4683084 - DNA, 19 bp, Homo sapiens
aggacgctctctggccttc

SEQ ID NO: 4683085 - DNA, 17 bp, Homo sapiens
aggagtttggccagaag

SEQ ID NO: 4683086 - DNA, 15 bp, Homo sapiens
aggcaactgaggcag

SEQ ID NO: 4683087 - DNA, 17 bp, Homo sapiens
aggcaactgaggcagac

SEQ ID NO: 4683088 - DNA, 19 bp, Homo sapiens
aggcaactgaggcagacag

SEQ ID NO: 4683089 - DNA, 12 bp, Homo sapiens
aggcacacttct

SEQ ID NO: 4683090 - DNA, 13 bp, Homo sapiens
aggcagacagcag

SEQ ID NO: 4683091 - DNA, 14 bp, Homo sapiens
aggcagggtcagga

SEQ ID NO: 4683092 - DNA, 13 bp, Homo sapiens
aggcagttttcta

SEQ ID NO: 4683093 - DNA, 14 bp, Homo sapiens
aggcgggaaggagg

SEQ ID NO: 4683094 - DNA, 15 bp, Homo sapiens
aggcgggaaggaggg

SEQ ID NO: 4683095 - DNA, 15 bp, Homo sapiens
aggctgtaactactt

SEQ ID NO: 4683096 - DNA, 14 bp, Homo sapiens
aggcttagaccctc

SEQ ID NO: 4683097 - DNA, 14 bp, Homo sapiens
agggccccagcact

SEQ ID NO: 4683098 - DNA, 14 bp, Homo sapiens
aggggcagaacagc

SEQ ID NO: 4683099 - DNA, 17 bp, Homo sapiens
agggtccttttgacact

SEQ ID NO: 4683100 - DNA, 13 bp, Homo sapiens
agggttagggagg

SEQ ID NO: 4683101 - DNA, 15 bp, Homo sapiens
agggttagggagggg

SEQ ID NO: 4683102 - DNA, 19 bp, Homo sapiens
agtatttagaagccaacta

SEQ ID NO: 4683103 - DNA, 20 bp, Homo sapiens
agtattttttgtataattgg

SEQ ID NO: 4683104 - DNA, 23 bp, Homo sapiens
agtcagactggatagtccgtctc

SEQ ID NO: 4683105 - DNA, 22 bp, Homo sapiens
agtcagatggaaaattcatttt

SEQ ID NO: 4683106 - DNA, 19 bp, Homo sapiens
agtcatcttgctaccagta

SEQ ID NO: 4683107 - DNA, 21 bp, Homo sapiens
agtctctcttctctccagctg

SEQ ID NO: 4683108 - DNA, 14 bp, Homo sapiens
agtgccacttaatg

SEQ ID NO: 4683109 - DNA, 17 bp, Homo sapiens
agtgccacttaatgtat

SEQ ID NO: 4683110 - DNA, 21 bp, Homo sapiens
agtgccacttaatgtatgtta

SEQ ID NO: 4683111 - DNA, 17 bp, Homo sapiens
agtgctcttttctcctc

SEQ ID NO: 4683112 - DNA, 20 bp, Homo sapiens
agtgctgtttattaatctta

SEQ ID NO: 4683113 - DNA, 15 bp, Homo sapiens
agtgcttggcccagg

SEQ ID NO: 4683114 - DNA, 16 bp, Homo sapiens
agtgcttggcccagga

SEQ ID NO: 4683115 - DNA, 18 bp, Homo sapiens
agtgcttggcccaggagt

SEQ ID NO: 4683116 - DNA, 19 bp, Homo sapiens
agtgcttggcccaggagtt

SEQ ID NO: 4683117 - DNA, 14 bp, Homo sapiens
agtgtatgattact

SEQ ID NO: 4683118 - DNA, 15 bp, Homo sapiens
agtgtatgattactg

SEQ ID NO: 4683119 - DNA, 14 bp, Homo sapiens
agtgtatttggaaa

SEQ ID NO: 4683120 - DNA, 23 bp, Homo sapiens
agtgtatttggaaataaagtcag

SEQ ID NO: 4683121 - DNA, 15 bp, Homo sapiens
agttaatttttccaa

SEQ ID NO: 4683122 - DNA, 17 bp, Homo sapiens
agttaatttttccaact

SEQ ID NO: 4683123 - DNA, 11 bp, Homo sapiens
agttactgtgt

SEQ ID NO: 4683124 - DNA, 14 bp, Homo sapiens
agttactgtgtaat

SEQ ID NO: 4683125 - DNA, 18 bp, Homo sapiens
agttactgtgtaattagt

SEQ ID NO: 4683126 - DNA, 19 bp, Homo sapiens
agttactgtgtaattagtg

SEQ ID NO: 4683127 - DNA, 22 bp, Homo sapiens
agttcatgcagctgtggcagag

SEQ ID NO: 4683128 - DNA, 19 bp, Homo sapiens
agttctgtggtttcatgtt

SEQ ID NO: 4683129 - DNA, 13 bp, Homo sapiens
agttggtgacaga

SEQ ID NO: 4683130 - DNA, 15 bp, Homo sapiens
agttgtttcattgac

SEQ ID NO: 4683131 - DNA, 11 bp, Homo sapiens
agtttggccag

SEQ ID NO: 4683132 - DNA, 12 bp, Homo sapiens
agtttggccaga

SEQ ID NO: 4683133 - DNA, 13 bp, Homo sapiens
agtttggccagaa

SEQ ID NO: 4683134 - DNA, 16 bp, Homo sapiens
agtttggtttctagca

SEQ ID NO: 4683135 - DNA, 15 bp, Homo sapiens
ataatgtcccttcac

SEQ ID NO: 4683136 - DNA, 16 bp, Homo sapiens
ataattggatttccta

SEQ ID NO: 4683137 - DNA, 17 bp, Homo sapiens
ataattggatttcctaa

SEQ ID NO: 4683138 - DNA, 22 bp, Homo sapiens
atagaataaaggcagttttcta

SEQ ID NO: 4683139 - DNA, 22 bp, Homo sapiens
atagctctggggtgggcagttt

SEQ ID NO: 4683140 - DNA, 14 bp, Homo sapiens
atagttactgtgta

SEQ ID NO: 4683141 - DNA, 17 bp, Homo sapiens
atagttactgtgtaatt

SEQ ID NO: 4683142 - DNA, 14 bp, Homo sapiens
atatcctaataaaa

SEQ ID NO: 4683143 - DNA, 21 bp, Homo sapiens
atatctaccccagactagatg

SEQ ID NO: 4683144 - DNA, 15 bp, Homo sapiens
atcaaactgaagcca

SEQ ID NO: 4683145 - DNA, 15 bp, Homo sapiens
atccaggttccctcc

SEQ ID NO: 4683146 - DNA, 17 bp, Homo sapiens
atcctaataaaaaggtg

SEQ ID NO: 4683147 - DNA, 18 bp, Homo sapiens
atcctaataaaaaggtga

SEQ ID NO: 4683148 - DNA, 15 bp, Homo sapiens
atcctcaaagaaagt

SEQ ID NO: 4683149 - DNA, 16 bp, Homo sapiens
atcctcaaagaaagtg

SEQ ID NO: 4683150 - DNA, 19 bp, Homo sapiens
atcctcaaagaaagtgtat

SEQ ID NO: 4683151 - DNA, 18 bp, Homo sapiens
atcctgaggctccacttg

SEQ ID NO: 4683152 - DNA, 17 bp, Homo sapiens
atcgctccaccttgcag

SEQ ID NO: 4683153 - DNA, 11 bp, Homo sapiens
atctataattt

SEQ ID NO: 4683154 - DNA, 16 bp, Homo sapiens
atctataatttaccta

SEQ ID NO: 4683155 - DNA, 13 bp, Homo sapiens
atcttagtgtatg

SEQ ID NO: 4683156 - DNA, 19 bp, Homo sapiens
atcttagtgtatgattact

SEQ ID NO: 4683157 - DNA, 16 bp, Homo sapiens
atcttgctaccagtat

SEQ ID NO: 4683158 - DNA, 14 bp, Homo sapiens
atgattactggcct

SEQ ID NO: 4683159 - DNA, 19 bp, Homo sapiens
atgcggttaattttgaagt

SEQ ID NO: 4683160 - DNA, 15 bp, Homo sapiens
atgctagaactccct

SEQ ID NO: 4683161 - DNA, 13 bp, Homo sapiens
atgctgccaatat

SEQ ID NO: 4683162 - DNA, 20 bp, Homo sapiens
atgctgccaatatcctaata

SEQ ID NO: 4683163 - DNA, 14 bp, Homo sapiens
atggagctgggcta

SEQ ID NO: 4683164 - DNA, 14 bp, Homo sapiens
atgtatgttaccaa

SEQ ID NO: 4683165 - DNA, 16 bp, Homo sapiens
atgtccaacccgtctg

SEQ ID NO: 4683166 - DNA, 15 bp, Homo sapiens
atgtggtgggacagg

SEQ ID NO: 4683167 - DNA, 20 bp, Homo sapiens
atgttagttaccttatagtt

SEQ ID NO: 4683168 - DNA, 22 bp, Homo sapiens
attaaatatgttagcaaagagt

SEQ ID NO: 4683169 - DNA, 15 bp, Homo sapiens
attaacgatgtccaa

SEQ ID NO: 4683170 - DNA, 14 bp, Homo sapiens
attacaaatcagaa

SEQ ID NO: 4683171 - DNA, 18 bp, Homo sapiens
attacaaatcagaagtca

SEQ ID NO: 4683172 - DNA, 15 bp, Homo sapiens
attaggctgtaacta

SEQ ID NO: 4683173 - DNA, 23 bp, Homo sapiens
attattgtgtgttatttaaatga

SEQ ID NO: 4683174 - DNA, 17 bp, Homo sapiens
attcaaggaatttctta

SEQ ID NO: 4683175 - DNA, 23 bp, Homo sapiens
attcccgttttgtcactttttct

SEQ ID NO: 4683176 - DNA, 23 bp, Homo sapiens
attccttagcttagacctcagcc

SEQ ID NO: 4683177 - DNA, 14 bp, Homo sapiens
attggatttcctaa

SEQ ID NO: 4683178 - DNA, 15 bp, Homo sapiens
attggtttaaagaaa

SEQ ID NO: 4683179 - DNA, 18 bp, Homo sapiens
attggtttaaagaaagtg

SEQ ID NO: 4683180 - DNA, 16 bp, Homo sapiens
attgtgtgttatttaa

SEQ ID NO: 4683181 - DNA, 17 bp, Homo sapiens
atttacctaagattaca

SEQ ID NO: 4683182 - DNA, 18 bp, Homo sapiens
atttacctaagattacaa

SEQ ID NO: 4683183 - DNA, 23 bp, Homo sapiens
atttagaagccaactatgattat

SEQ ID NO: 4683184 - DNA, 17 bp, Homo sapiens
atttcctaatactgtca

SEQ ID NO: 4683185 - DNA, 17 bp, Homo sapiens
atttcttaacttcttgc

SEQ ID NO: 4683186 - DNA, 19 bp, Homo sapiens
atttgcagagacaggacct

SEQ ID NO: 4683187 - DNA, 15 bp, Homo sapiens
atttggaaataaagt

SEQ ID NO: 4683188 - DNA, 19 bp, Homo sapiens
attttgaagtgctgtttat

SEQ ID NO: 4683189 - DNA, 15 bp, Homo sapiens
attttgttggcatag

SEQ ID NO: 4683190 - DNA, 21 bp, Homo sapiens
atttttccaactactaataga

SEQ ID NO: 4683191 - DNA, 15 bp, Homo sapiens
attttttgtataatt

SEQ ID NO: 4683192 - DNA, 24 bp, Homo sapiens
caaacccagtgttttaggagcatg

SEQ ID NO: 4683193 - DNA, 14 bp, Homo sapiens
caaagaaagtgtat

SEQ ID NO: 4683194 - DNA, 20 bp, Homo sapiens
caacccgtctggcccaccag

SEQ ID NO: 4683195 - DNA, 20 bp, Homo sapiens
caactgaggcagacagcagc

SEQ ID NO: 4683196 - DNA, 22 bp, Homo sapiens
caactgaggcagacagcagctc

SEQ ID NO: 4683197 - DNA, 16 bp, Homo sapiens
caaggtactctggtga

SEQ ID NO: 4683198 - DNA, 17 bp, Homo sapiens
caagttcatgcagctgt

SEQ ID NO: 4683199 - DNA, 12 bp, Homo sapiens
caatatcctaat

SEQ ID NO: 4683200 - DNA, 14 bp, Homo sapiens
caatatcctaataa

SEQ ID NO: 4683201 - DNA, 23 bp, Homo sapiens
cacagcccttatgcggttaattt

SEQ ID NO: 4683202 - DNA, 13 bp, Homo sapiens
cacaggcaactga

SEQ ID NO: 4683203 - DNA, 22 bp, Homo sapiens
cacaggcaactgaggcagacag

SEQ ID NO: 4683204 - DNA, 16 bp, Homo sapiens
cacagtgctcttttct

SEQ ID NO: 4683205 - DNA, 22 bp, Homo sapiens
caccagggtccttttgacactg

SEQ ID NO: 4683206 - DNA, 20 bp, Homo sapiens
caccagttctcatgggtggc

SEQ ID NO: 4683207 - DNA, 15 bp, Homo sapiens
cacccctcccctgcc

SEQ ID NO: 4683208 - DNA, 22 bp, Homo sapiens
cacccctcccctgccctagagc

SEQ ID NO: 4683209 - DNA, 17 bp, Homo sapiens
cacctgacacaccaggc

SEQ ID NO: 4683210 - DNA, 20 bp, Homo sapiens
cacctgacacaccaggcgct

SEQ ID NO: 4683211 - DNA, 17 bp, Homo sapiens
cactcccacctgacaca

SEQ ID NO: 4683212 - DNA, 22 bp, Homo sapiens
cactcccacctgacacaccagg

SEQ ID NO: 4683213 - DNA, 23 bp, Homo sapiens
cactcccacctgacacaccaggc

SEQ ID NO: 4683214 - DNA, 18 bp, Homo sapiens
cactgctctaacagccct

SEQ ID NO: 4683215 - DNA, 14 bp, Homo sapiens
cactgggggagggg

SEQ ID NO: 4683216 - DNA, 15 bp, Homo sapiens
cactgggggagggga

SEQ ID NO: 4683217 - DNA, 18 bp, Homo sapiens
cactggggtcctggggcc

SEQ ID NO: 4683218 - DNA, 14 bp, Homo sapiens
cactgtatccaggt

SEQ ID NO: 4683219 - DNA, 12 bp, Homo sapiens
cacttaatgtat

SEQ ID NO: 4683220 - DNA, 14 bp, Homo sapiens
cacttaatgtatgt

SEQ ID NO: 4683221 - DNA, 18 bp, Homo sapiens
cacttcacacacaggcaa

SEQ ID NO: 4683222 - DNA, 12 bp, Homo sapiens
cacttggagcca

SEQ ID NO: 4683223 - DNA, 15 bp, Homo sapiens
cacttggtctgtgag

SEQ ID NO: 4683224 - DNA, 12 bp, Homo sapiens
cagaacagccgc

SEQ ID NO: 4683225 - DNA, 16 bp, Homo sapiens
cagaagtcaaggctta

SEQ ID NO: 4683226 - DNA, 22 bp, Homo sapiens
cagaagtcatcttgctaccagt

SEQ ID NO: 4683227 - DNA, 21 bp, Homo sapiens
cagaattctgctacctcactg

SEQ ID NO: 4683228 - DNA, 13 bp, Homo sapiens
cagacagcagctc

SEQ ID NO: 4683229 - DNA, 19 bp, Homo sapiens
cagactggatagtccgtct

SEQ ID NO: 4683230 - DNA, 21 bp, Homo sapiens
cagagactcagggccccagca

SEQ ID NO: 4683231 - DNA, 18 bp, Homo sapiens
cagaggagccaccagttc

SEQ ID NO: 4683232 - DNA, 19 bp, Homo sapiens
cagaggagccaccagttct

SEQ ID NO: 4683233 - DNA, 13 bp, Homo sapiens
cagagttacagtt

SEQ ID NO: 4683234 - DNA, 15 bp, Homo sapiens
cagagttacagttct

SEQ ID NO: 4683235 - DNA, 16 bp, Homo sapiens
cagagttacagttctg

SEQ ID NO: 4683236 - DNA, 19 bp, Homo sapiens
cagagttacagttctgtgg

SEQ ID NO: 4683237 - DNA, 19 bp, Homo sapiens
cagatggaaaattcatttt

SEQ ID NO: 4683238 - DNA, 19 bp, Homo sapiens
cagcactaaagcagtggac

SEQ ID NO: 4683239 - DNA, 20 bp, Homo sapiens
cagcactaaagcagtggaca

SEQ ID NO: 4683240 - DNA, 14 bp, Homo sapiens
cagcagccagctct

SEQ ID NO: 4683241 - DNA, 18 bp, Homo sapiens
cagcagccagctctcagc

SEQ ID NO: 4683242 - DNA, 21 bp, Homo sapiens
cagcagccagctctcagccaa

SEQ ID NO: 4683243 - DNA, 12 bp, Homo sapiens
cagcagctcagg

SEQ ID NO: 4683244 - DNA, 21 bp, Homo sapiens
cagccaacgagtaatttattg

SEQ ID NO: 4683245 - DNA, 21 bp, Homo sapiens
cagccagcagccagctctcag

SEQ ID NO: 4683246 - DNA, 16 bp, Homo sapiens
cagccagctctcagcc

SEQ ID NO: 4683247 - DNA, 13 bp, Homo sapiens
cagccctcagaat

SEQ ID NO: 4683248 - DNA, 15 bp, Homo sapiens
cagcctagccgacct

SEQ ID NO: 4683249 - DNA, 18 bp, Homo sapiens
cagcctagccgacctcag

SEQ ID NO: 4683250 - DNA, 21 bp, Homo sapiens
cagcctagccgacctcagcct

SEQ ID NO: 4683251 - DNA, 22 bp, Homo sapiens
cagcctagccgacctcagcctt

SEQ ID NO: 4683252 - DNA, 15 bp, Homo sapiens
cagcctggtgggcct

SEQ ID NO: 4683253 - DNA, 14 bp, Homo sapiens
cagcctgtgctgcc

SEQ ID NO: 4683254 - DNA, 16 bp, Homo sapiens
cagcctgtgctgcccg

SEQ ID NO: 4683255 - DNA, 13 bp, Homo sapiens
cagctctcagcca

SEQ ID NO: 4683256 - DNA, 16 bp, Homo sapiens
cagctctccccttctc

SEQ ID NO: 4683257 - DNA, 13 bp, Homo sapiens
cagctgactaaac

SEQ ID NO: 4683258 - DNA, 19 bp, Homo sapiens
cagctgcaaggtactctgg

SEQ ID NO: 4683259 - DNA, 22 bp, Homo sapiens
cagctgcaaggtactctggtga

SEQ ID NO: 4683260 - DNA, 16 bp, Homo sapiens
cagctgtggcagagtt

SEQ ID NO: 4683261 - DNA, 15 bp, Homo sapiens
caggagaggggcaga

SEQ ID NO: 4683262 - DNA, 17 bp, Homo sapiens
caggagaggggcagaac

SEQ ID NO: 4683263 - DNA, 13 bp, Homo sapiens
caggagtccctgg

SEQ ID NO: 4683264 - DNA, 22 bp, Homo sapiens
caggcaactgaggcagacagca

SEQ ID NO: 4683265 - DNA, 22 bp, Homo sapiens
cagggaggacgctctctggcct

SEQ ID NO: 4683266 - DNA, 14 bp, Homo sapiens
cagggccccagcac

SEQ ID NO: 4683267 - DNA, 22 bp, Homo sapiens
cagggccccagcactaaagcag

SEQ ID NO: 4683268 - DNA, 14 bp, Homo sapiens
cagggctcagcctg

SEQ ID NO: 4683269 - DNA, 15 bp, Homo sapiens
caggttccctcccag

SEQ ID NO: 4683270 - DNA, 23 bp, Homo sapiens
caggttccctcccagaggagcca

SEQ ID NO: 4683271 - DNA, 14 bp, Homo sapiens
cagtgcttggccca

SEQ ID NO: 4683272 - DNA, 16 bp, Homo sapiens
cagtgcttggcccagg

SEQ ID NO: 4683273 - DNA, 16 bp, Homo sapiens
cagtgttttaggagca

SEQ ID NO: 4683274 - DNA, 20 bp, Homo sapiens
cagtgttttaggagcatgag

SEQ ID NO: 4683275 - DNA, 16 bp, Homo sapiens
cagttaatttttccaa

SEQ ID NO: 4683276 - DNA, 13 bp, Homo sapiens
catccgaggcagg

SEQ ID NO: 4683277 - DNA, 14 bp, Homo sapiens
catcttgctaccag

SEQ ID NO: 4683278 - DNA, 20 bp, Homo sapiens
catcttgctaccagtattta

SEQ ID NO: 4683279 - DNA, 17 bp, Homo sapiens
catgctgccaatatcct

SEQ ID NO: 4683280 - DNA, 21 bp, Homo sapiens
catgctgccaatatcctaata

SEQ ID NO: 4683281 - DNA, 22 bp, Homo sapiens
catgctgccaatatcctaataa

SEQ ID NO: 4683282 - DNA, 12 bp, Homo sapiens
catgtggtggga

SEQ ID NO: 4683283 - DNA, 21 bp, Homo sapiens
catgttagttaccttatagtt

SEQ ID NO: 4683284 - DNA, 18 bp, Homo sapiens
cattgactatcaaactga

SEQ ID NO: 4683285 - DNA, 22 bp, Homo sapiens
cattgactatcaaactgaagcc

SEQ ID NO: 4683286 - DNA, 17 bp, Homo sapiens
catttaggccatgggac

SEQ ID NO: 4683287 - DNA, 16 bp, Homo sapiens
ccaaaaataaatatat

SEQ ID NO: 4683288 - DNA, 14 bp, Homo sapiens
ccaactactaatag

SEQ ID NO: 4683289 - DNA, 22 bp, Homo sapiens
ccaactactaatagaataaagg

SEQ ID NO: 4683290 - DNA, 12 bp, Homo sapiens
ccaatatcctaa

SEQ ID NO: 4683291 - DNA, 17 bp, Homo sapiens
ccaatatcctaataaaa

SEQ ID NO: 4683292 - DNA, 19 bp, Homo sapiens
ccaatatcctaataaaaag

SEQ ID NO: 4683293 - DNA, 15 bp, Homo sapiens
ccacttaatgtatgt

SEQ ID NO: 4683294 - DNA, 16 bp, Homo sapiens
ccacttggtctgtgag

SEQ ID NO: 4683295 - DNA, 19 bp, Homo sapiens
ccacttggtctgtgagatg

SEQ ID NO: 4683296 - DNA, 22 bp, Homo sapiens
ccacttggtctgtgagatgcta

SEQ ID NO: 4683297 - DNA, 18 bp, Homo sapiens
ccagaagtcaaggcttag

SEQ ID NO: 4683298 - DNA, 19 bp, Homo sapiens
ccagacatgtggtgggaca

SEQ ID NO: 4683299 - DNA, 22 bp, Homo sapiens
ccagactagatgtagtattttt

SEQ ID NO: 4683300 - DNA, 17 bp, Homo sapiens
ccagcactaaagcagtg

SEQ ID NO: 4683301 - DNA, 24 bp, Homo sapiens
ccagcactaaagcagtggacacca

SEQ ID NO: 4683302 - DNA, 15 bp, Homo sapiens
ccagcagccagctct

SEQ ID NO: 4683303 - DNA, 13 bp, Homo sapiens
ccagccagcagcc

SEQ ID NO: 4683304 - DNA, 16 bp, Homo sapiens
ccagccagcagccagc

SEQ ID NO: 4683305 - DNA, 23 bp, Homo sapiens
ccagctgactaaactttttttct

SEQ ID NO: 4683306 - DNA, 15 bp, Homo sapiens
ccaggagtttggcca

SEQ ID NO: 4683307 - DNA, 16 bp, Homo sapiens
ccatgggacagggagg

SEQ ID NO: 4683308 - DNA, 15 bp, Homo sapiens
cccaggagtttggcc

SEQ ID NO: 4683309 - DNA, 16 bp, Homo sapiens
cccaggagtttggcca

SEQ ID NO: 4683310 - DNA, 17 bp, Homo sapiens
cccaggagtttggccag

SEQ ID NO: 4683311 - DNA, 18 bp, Homo sapiens
cccaggagtttggccaga

SEQ ID NO: 4683312 - DNA, 15 bp, Homo sapiens
cccagggctcagcct

SEQ ID NO: 4683313 - DNA, 17 bp, Homo sapiens
cccagtgttttaggagc

SEQ ID NO: 4683314 - DNA, 11 bp, Homo sapiens
ccccagcacta

SEQ ID NO: 4683315 - DNA, 17 bp, Homo sapiens
ccccttgcccagggctc

SEQ ID NO: 4683316 - DNA, 23 bp, Homo sapiens
ccccttgcccagggctcagcctg

SEQ ID NO: 4683317 - DNA, 21 bp, Homo sapiens
cccttgcccagggctcagcct

SEQ ID NO: 4683318 - DNA, 15 bp, Homo sapiens
ccgacctcagccttc

SEQ ID NO: 4683319 - DNA, 20 bp, Homo sapiens
ccgaggcagggtcaggagag

SEQ ID NO: 4683320 - DNA, 14 bp, Homo sapiens
ccgctcctgtctgc

SEQ ID NO: 4683321 - DNA, 15 bp, Homo sapiens
ccgctcctgtctgcc

SEQ ID NO: 4683322 - DNA, 24 bp, Homo sapiens
ccgtagacgtgcacgcacactgtc

SEQ ID NO: 4683323 - DNA, 14 bp, Homo sapiens
ccgtcttcagccta

SEQ ID NO: 4683324 - DNA, 15 bp, Homo sapiens
cctagagcacactgt

SEQ ID NO: 4683325 - DNA, 17 bp, Homo sapiens
cctagccgacctcagcc

SEQ ID NO: 4683326 - DNA, 20 bp, Homo sapiens
cctagccgacctcagccttc

SEQ ID NO: 4683327 - DNA, 14 bp, Homo sapiens
cctcaaagaaagtg

SEQ ID NO: 4683328 - DNA, 20 bp, Homo sapiens
cctcactggggtcctggggc

SEQ ID NO: 4683329 - DNA, 20 bp, Homo sapiens
cctcactgtatccaggttcc

SEQ ID NO: 4683330 - DNA, 22 bp, Homo sapiens
cctcagccttccccttgcccag

SEQ ID NO: 4683331 - DNA, 20 bp, Homo sapiens
cctcatgctgccaatatcct

SEQ ID NO: 4683332 - DNA, 21 bp, Homo sapiens
cctcatttttataatgtccct

SEQ ID NO: 4683333 - DNA, 21 bp, Homo sapiens
cctcccagaggagccaccagt

SEQ ID NO: 4683334 - DNA, 23 bp, Homo sapiens
cctcccagaggagccaccagttc

SEQ ID NO: 4683335 - DNA, 15 bp, Homo sapiens
cctcctctgtccagg

SEQ ID NO: 4683336 - DNA, 16 bp, Homo sapiens
cctcctctgtccaggg

SEQ ID NO: 4683337 - DNA, 14 bp, Homo sapiens
cctcggagcctcat

SEQ ID NO: 4683338 - DNA, 23 bp, Homo sapiens
cctcggagcctcatccgaggcag

SEQ ID NO: 4683339 - DNA, 15 bp, Homo sapiens
cctgagctcggtgga

SEQ ID NO: 4683340 - DNA, 18 bp, Homo sapiens
cctgagctcggtggaccc

SEQ ID NO: 4683341 - DNA, 18 bp, Homo sapiens
cctgccctagagcacact

SEQ ID NO: 4683342 - DNA, 19 bp, Homo sapiens
cctgcctattatctgtcag

SEQ ID NO: 4683343 - DNA, 22 bp, Homo sapiens
cctggggcctcggagcctcatc

SEQ ID NO: 4683344 - DNA, 18 bp, Homo sapiens
cctggtgggcctcctctg

SEQ ID NO: 4683345 - DNA, 20 bp, Homo sapiens
cctggtgggcctcctctgtc

SEQ ID NO: 4683346 - DNA, 19 bp, Homo sapiens
cctgtctgccagccagcag

SEQ ID NO: 4683347 - DNA, 21 bp, Homo sapiens
cctgtctgccagccagcagcc

SEQ ID NO: 4683348 - DNA, 21 bp, Homo sapiens
cctgtgctgcccgtcttcagc

SEQ ID NO: 4683349 - DNA, 22 bp, Homo sapiens
cctgtgctgcccgtcttcagcc

SEQ ID NO: 4683350 - DNA, 19 bp, Homo sapiens
ccttagcttagacctcagc

SEQ ID NO: 4683351 - DNA, 18 bp, Homo sapiens
ccttccccttgcccaggg

SEQ ID NO: 4683352 - DNA, 22 bp, Homo sapiens
ccttccccttgcccagggctca

SEQ ID NO: 4683353 - DNA, 20 bp, Homo sapiens
ccttgaacactgggggaggg

SEQ ID NO: 4683354 - DNA, 20 bp, Homo sapiens
ccttgcccagggctcagcct

SEQ ID NO: 4683355 - DNA, 22 bp, Homo sapiens
ccttgcccagggctcagcctgg

SEQ ID NO: 4683356 - DNA, 14 bp, Homo sapiens
ccttgtatttaaat

SEQ ID NO: 4683357 - DNA, 13 bp, Homo sapiens
ccttttgacactg

SEQ ID NO: 4683358 - DNA, 13 bp, Homo sapiens
cctttttcattta

SEQ ID NO: 4683359 - DNA, 13 bp, Homo sapiens
cgacctcagcctt

SEQ ID NO: 4683360 - DNA, 15 bp, Homo sapiens
cgacctcagccttcc

SEQ ID NO: 4683361 - DNA, 23 bp, Homo sapiens
cgctaattcaaggaatttcttaa

SEQ ID NO: 4683362 - DNA, 14 bp, Homo sapiens
cgctctctggcctt

SEQ ID NO: 4683363 - DNA, 18 bp, Homo sapiens
cgctctctggccttcggc

SEQ ID NO: 4683364 - DNA, 12 bp, Homo sapiens
cggcctccatcc

SEQ ID NO: 4683365 - DNA, 14 bp, Homo sapiens
cggcctccatcctg

SEQ ID NO: 4683366 - DNA, 14 bp, Homo sapiens
cgggaaggagggtt

SEQ ID NO: 4683367 - DNA, 23 bp, Homo sapiens
cgggaaggagggttagggagggg

SEQ ID NO: 4683368 - DNA, 14 bp, Homo sapiens
cgtcttcagcctag

SEQ ID NO: 4683369 - DNA, 18 bp, Homo sapiens
cgtgcacgcacactgtct

SEQ ID NO: 4683370 - DNA, 22 bp, Homo sapiens
cgtggtgatttagcaggaagct

SEQ ID NO: 4683371 - DNA, 11 bp, Homo sapiens
cgttttgtcac

SEQ ID NO: 4683372 - DNA, 11 bp, Homo sapiens
ctaaagcagtg

SEQ ID NO: 4683373 - DNA, 17 bp, Homo sapiens
ctaacatgtcctgccta

SEQ ID NO: 4683374 - DNA, 19 bp, Homo sapiens
ctaagattacaaatcagaa

SEQ ID NO: 4683375 - DNA, 20 bp, Homo sapiens
ctaatagaataaaggcagtt

SEQ ID NO: 4683376 - DNA, 20 bp, Homo sapiens
ctaattcaaggaatttctta

SEQ ID NO: 4683377 - DNA, 16 bp, Homo sapiens
ctaattcacagtgctc

SEQ ID NO: 4683378 - DNA, 19 bp, Homo sapiens
ctaccagtatttagaagcc

SEQ ID NO: 4683379 - DNA, 16 bp, Homo sapiens
ctagatgtagtatttt

SEQ ID NO: 4683380 - DNA, 22 bp, Homo sapiens
ctataatttacctaagattaca

SEQ ID NO: 4683381 - DNA, 21 bp, Homo sapiens
ctatcaaactgaagccagaaa

SEQ ID NO: 4683382 - DNA, 14 bp, Homo sapiens
ctatgattattaac

SEQ ID NO: 4683383 - DNA, 12 bp, Homo sapiens
ctcacctggact

SEQ ID NO: 4683384 - DNA, 13 bp, Homo sapiens
ctcacctggactt

SEQ ID NO: 4683385 - DNA, 19 bp, Homo sapiens
ctcagcctggtgggcctcc

SEQ ID NO: 4683386 - DNA, 20 bp, Homo sapiens
ctcagcctggtgggcctcct

SEQ ID NO: 4683387 - DNA, 18 bp, Homo sapiens
ctcagcctgtgctgcccg

SEQ ID NO: 4683388 - DNA, 18 bp, Homo sapiens
ctcagggccccagcacta

SEQ ID NO: 4683389 - DNA, 18 bp, Homo sapiens
ctcagtagtcagactgga

SEQ ID NO: 4683390 - DNA, 17 bp, Homo sapiens
ctcagtctctcttctct

SEQ ID NO: 4683391 - DNA, 14 bp, Homo sapiens
ctcatccgaggcag

SEQ ID NO: 4683392 - DNA, 15 bp, Homo sapiens
ctcatccgaggcagg

SEQ ID NO: 4683393 - DNA, 17 bp, Homo sapiens
ctcatccgaggcagggt

SEQ ID NO: 4683394 - DNA, 14 bp, Homo sapiens
ctcatttctagcag

SEQ ID NO: 4683395 - DNA, 16 bp, Homo sapiens
ctccacttggtctgtg

SEQ ID NO: 4683396 - DNA, 12 bp, Homo sapiens
ctccatcctgag

SEQ ID NO: 4683397 - DNA, 14 bp, Homo sapiens
ctccatcctgaggc

SEQ ID NO: 4683398 - DNA, 19 bp, Homo sapiens
ctcccagaggagccaccag

SEQ ID NO: 4683399 - DNA, 21 bp, Homo sapiens
ctcccagaggagccaccagtt

SEQ ID NO: 4683400 - DNA, 15 bp, Homo sapiens
ctcctctgtccaggg

SEQ ID NO: 4683401 - DNA, 18 bp, Homo sapiens
ctcctctgtccagggccc

SEQ ID NO: 4683402 - DNA, 19 bp, Homo sapiens
ctcctgtctgccagccagc

SEQ ID NO: 4683403 - DNA, 22 bp, Homo sapiens
ctcctgtctgccagccagcagc

SEQ ID NO: 4683404 - DNA, 16 bp, Homo sapiens
ctcggagcctcatccg

SEQ ID NO: 4683405 - DNA, 22 bp, Homo sapiens
ctcggagcctcatccgaggcag

SEQ ID NO: 4683406 - DNA, 23 bp, Homo sapiens
ctctcagccaacgagtaatttat

SEQ ID NO: 4683407 - DNA, 15 bp, Homo sapiens
ctctccagctgacta

SEQ ID NO: 4683408 - DNA, 16 bp, Homo sapiens
ctctccagctgactaa

SEQ ID NO: 4683409 - DNA, 18 bp, Homo sapiens
ctctccagctgactaaac

SEQ ID NO: 4683410 - DNA, 16 bp, Homo sapiens
ctctccccttctctgt

SEQ ID NO: 4683411 - DNA, 11 bp, Homo sapiens
ctctctggcct

SEQ ID NO: 4683412 - DNA, 12 bp, Homo sapiens
ctctctggcctt

SEQ ID NO: 4683413 - DNA, 17 bp, Homo sapiens
ctctctggccttcggcc

SEQ ID NO: 4683414 - DNA, 16 bp, Homo sapiens
ctctctgtaataaact

SEQ ID NO: 4683415 - DNA, 22 bp, Homo sapiens
ctctggccttcggcctccatcc

SEQ ID NO: 4683416 - DNA, 22 bp, Homo sapiens
ctctgtccagggccctgagctc

SEQ ID NO: 4683417 - DNA, 19 bp, Homo sapiens
ctcttctctccagctgact

SEQ ID NO: 4683418 - DNA, 14 bp, Homo sapiens
ctgacacaccaggc

SEQ ID NO: 4683419 - DNA, 23 bp, Homo sapiens
ctgacgacttgagtgctcagtag

SEQ ID NO: 4683420 - DNA, 14 bp, Homo sapiens
ctgactaaactttt

SEQ ID NO: 4683421 - DNA, 15 bp, Homo sapiens
ctgactaaacttttt

SEQ ID NO: 4683422 - DNA, 22 bp, Homo sapiens
ctgagctcggtggacccaggga

SEQ ID NO: 4683423 - DNA, 17 bp, Homo sapiens
ctgaggcagacagcagc

SEQ ID NO: 4683424 - DNA, 21 bp, Homo sapiens
ctgaggctccacttggtctgt

SEQ ID NO: 4683425 - DNA, 14 bp, Homo sapiens
ctgcaagcacagcc

SEQ ID NO: 4683426 - DNA, 17 bp, Homo sapiens
ctgcaagcacagccctt

SEQ ID NO: 4683427 - DNA, 19 bp, Homo sapiens
ctgcaaggtactctggtga

SEQ ID NO: 4683428 - DNA, 16 bp, Homo sapiens
ctgcactcccacctga

SEQ ID NO: 4683429 - DNA, 18 bp, Homo sapiens
ctgcactcccacctgaca

SEQ ID NO: 4683430 - DNA, 19 bp, Homo sapiens
ctgcactcccacctgacac

SEQ ID NO: 4683431 - DNA, 16 bp, Homo sapiens
ctgccaatatcctaat

SEQ ID NO: 4683432 - DNA, 18 bp, Homo sapiens
ctgccaatatcctaataa

SEQ ID NO: 4683433 - DNA, 19 bp, Homo sapiens
ctgccaatatcctaataaa

SEQ ID NO: 4683434 - DNA, 16 bp, Homo sapiens
ctgccagccagcagcc

SEQ ID NO: 4683435 - DNA, 18 bp, Homo sapiens
ctgccagccagcagccag

SEQ ID NO: 4683436 - DNA, 19 bp, Homo sapiens
ctgccagccagcagccagc

SEQ ID NO: 4683437 - DNA, 23 bp, Homo sapiens
ctgccagccagcagccagctctc

SEQ ID NO: 4683438 - DNA, 17 bp, Homo sapiens
ctgcctattatctgtca

SEQ ID NO: 4683439 - DNA, 13 bp, Homo sapiens
ctgctacctcact

SEQ ID NO: 4683440 - DNA, 15 bp, Homo sapiens
ctgctacctcactgg

SEQ ID NO: 4683441 - DNA, 18 bp, Homo sapiens
ctgctacctcactggggt

SEQ ID NO: 4683442 - DNA, 14 bp, Homo sapiens
ctgctagcacttgg

SEQ ID NO: 4683443 - DNA, 21 bp, Homo sapiens
ctgctagcacttggagccaag

SEQ ID NO: 4683444 - DNA, 12 bp, Homo sapiens
ctgctctaacag

SEQ ID NO: 4683445 - DNA, 18 bp, Homo sapiens
ctggacttaagcatctgg

SEQ ID NO: 4683446 - DNA, 23 bp, Homo sapiens
ctggacttaagcatctggctcta

SEQ ID NO: 4683447 - DNA, 15 bp, Homo sapiens
ctggccttcggcctc

SEQ ID NO: 4683448 - DNA, 18 bp, Homo sapiens
ctggccttcggcctccat

SEQ ID NO: 4683449 - DNA, 17 bp, Homo sapiens
ctggcctttttcattta

SEQ ID NO: 4683450 - DNA, 19 bp, Homo sapiens
ctggcctttttcatttatc

SEQ ID NO: 4683451 - DNA, 19 bp, Homo sapiens
ctggggcctcggagcctca

SEQ ID NO: 4683452 - DNA, 23 bp, Homo sapiens
ctggggcctcggagcctcatccg

SEQ ID NO: 4683453 - DNA, 24 bp, Homo sapiens
ctggtgagtcaccacttcagggct

SEQ ID NO: 4683454 - DNA, 17 bp, Homo sapiens
ctggtgggcctcctctg

SEQ ID NO: 4683455 - DNA, 16 bp, Homo sapiens
ctgtaactactttata

SEQ ID NO: 4683456 - DNA, 17 bp, Homo sapiens
ctgtaccagttaatttt

SEQ ID NO: 4683457 - DNA, 23 bp, Homo sapiens
ctgtatccaggttccctcccaga

SEQ ID NO: 4683458 - DNA, 23 bp, Homo sapiens
ctgtcatcctcaaagaaagtgta

SEQ ID NO: 4683459 - DNA, 18 bp, Homo sapiens
ctgtccagggccctgagc

SEQ ID NO: 4683460 - DNA, 19 bp, Homo sapiens
ctgtccagggccctgagct

SEQ ID NO: 4683461 - DNA, 17 bp, Homo sapiens
ctgtcggagccctgtct

SEQ ID NO: 4683462 - DNA, 23 bp, Homo sapiens
ctgtcggagccctgtctcctctc

SEQ ID NO: 4683463 - DNA, 14 bp, Homo sapiens
ctgtctcacctgga

SEQ ID NO: 4683464 - DNA, 17 bp, Homo sapiens
ctgtctcacctggactt

SEQ ID NO: 4683465 - DNA, 17 bp, Homo sapiens
ctgtctcctctctctgt

SEQ ID NO: 4683466 - DNA, 21 bp, Homo sapiens
ctgtctgccagccagcagcca

SEQ ID NO: 4683467 - DNA, 21 bp, Homo sapiens
ctgtgagatgctagaactccc

SEQ ID NO: 4683468 - DNA, 20 bp, Homo sapiens
ctgtgctgcccgtcttcagc

SEQ ID NO: 4683469 - DNA, 22 bp, Homo sapiens
ctgtgctgcccgtcttcagcct

SEQ ID NO: 4683470 - DNA, 18 bp, Homo sapiens
ctgtggcagagttacagt

SEQ ID NO: 4683471 - DNA, 17 bp, Homo sapiens
ctgtggtttcatgttag

SEQ ID NO: 4683472 - DNA, 18 bp, Homo sapiens
ctgtggtttcatgttagt

SEQ ID NO: 4683473 - DNA, 14 bp, Homo sapiens
ctgtttattaatct

SEQ ID NO: 4683474 - DNA, 15 bp, Homo sapiens
cttaagcatctggct

SEQ ID NO: 4683475 - DNA, 14 bp, Homo sapiens
cttaatgtatgtta

SEQ ID NO: 4683476 - DNA, 18 bp, Homo sapiens
cttagaccctcatgctgc

SEQ ID NO: 4683477 - DNA, 20 bp, Homo sapiens
cttagaccctcatgctgcca

SEQ ID NO: 4683478 - DNA, 15 bp, Homo sapiens
cttagacctcagcct

SEQ ID NO: 4683479 - DNA, 16 bp, Homo sapiens
cttagacctcagcctg

SEQ ID NO: 4683480 - DNA, 17 bp, Homo sapiens
cttagcttagacctcag

SEQ ID NO: 4683481 - DNA, 19 bp, Homo sapiens
cttagcttagacctcagcc

SEQ ID NO: 4683482 - DNA, 19 bp, Homo sapiens
cttatagttactgtgtaat

SEQ ID NO: 4683483 - DNA, 21 bp, Homo sapiens
cttatagttactgtgtaatta

SEQ ID NO: 4683484 - DNA, 18 bp, Homo sapiens
cttatgcggttaattttg

SEQ ID NO: 4683485 - DNA, 13 bp, Homo sapiens
cttatttattatt

SEQ ID NO: 4683486 - DNA, 22 bp, Homo sapiens
cttcagcctagccgacctcagc

SEQ ID NO: 4683487 - DNA, 23 bp, Homo sapiens
cttccccttgcccagggctcagc

SEQ ID NO: 4683488 - DNA, 20 bp, Homo sapiens
cttcggcctccatcctgagg

SEQ ID NO: 4683489 - DNA, 16 bp, Homo sapiens
cttctctccagctgac

SEQ ID NO: 4683490 - DNA, 17 bp, Homo sapiens
cttctctccagctgact

SEQ ID NO: 4683491 - DNA, 20 bp, Homo sapiens
cttcttggtcttatttatta

SEQ ID NO: 4683492 - DNA, 16 bp, Homo sapiens
cttctttctagaaaga

SEQ ID NO: 4683493 - DNA, 13 bp, Homo sapiens
cttgaacactggg

SEQ ID NO: 4683494 - DNA, 16 bp, Homo sapiens
cttgaacactggggga

SEQ ID NO: 4683495 - DNA, 14 bp, Homo sapiens
cttgcccagggctc

SEQ ID NO: 4683496 - DNA, 16 bp, Homo sapiens
cttgcccagggctcag

SEQ ID NO: 4683497 - DNA, 21 bp, Homo sapiens
cttgcccagggctcagcctgg

SEQ ID NO: 4683498 - DNA, 17 bp, Homo sapiens
cttgctaccagtattta

SEQ ID NO: 4683499 - DNA, 18 bp, Homo sapiens
cttgctaccagtatttag

SEQ ID NO: 4683500 - DNA, 18 bp, Homo sapiens
cttgcttctttctagaaa

SEQ ID NO: 4683501 - DNA, 15 bp, Homo sapiens
cttggcccaggagtt

SEQ ID NO: 4683502 - DNA, 22 bp, Homo sapiens
cttggcccaggagtttggccag

SEQ ID NO: 4683503 - DNA, 16 bp, Homo sapiens
cttggtctgtgagatg

SEQ ID NO: 4683504 - DNA, 17 bp, Homo sapiens
cttttctcctcactgta

SEQ ID NO: 4683505 - DNA, 12 bp, Homo sapiens
cttttgacactg

SEQ ID NO: 4683506 - DNA, 13 bp, Homo sapiens
cttttgtgaatta

SEQ ID NO: 4683507 - DNA, 12 bp, Homo sapiens
ctttttcattta

SEQ ID NO: 4683508 - DNA, 13 bp, Homo sapiens
ctttttcatttat

SEQ ID NO: 4683509 - DNA, 13 bp, Homo sapiens
gaaaattcatttt

SEQ ID NO: 4683510 - DNA, 19 bp, Homo sapiens
gaaacagttggtaactttt

SEQ ID NO: 4683511 - DNA, 21 bp, Homo sapiens
gaaacagttggtaacttttgt

SEQ ID NO: 4683512 - DNA, 18 bp, Homo sapiens
gaaagagaaacagttggt

SEQ ID NO: 4683513 - DNA, 20 bp, Homo sapiens
gaaagggattttcagccctc

SEQ ID NO: 4683514 - DNA, 11 bp, Homo sapiens
gaaagtgtatt

SEQ ID NO: 4683515 - DNA, 15 bp, Homo sapiens
gaaagtgtatttgga

SEQ ID NO: 4683516 - DNA, 14 bp, Homo sapiens
gaactccctttcaa

SEQ ID NO: 4683517 - DNA, 13 bp, Homo sapiens
gaagactgtggct

SEQ ID NO: 4683518 - DNA, 19 bp, Homo sapiens
gaaggagggttagggaggg

SEQ ID NO: 4683519 - DNA, 15 bp, Homo sapiens
gaataaaggcagttt

SEQ ID NO: 4683520 - DNA, 19 bp, Homo sapiens
gaataaaggcagttttcta

SEQ ID NO: 4683521 - DNA, 16 bp, Homo sapiens
gaattaggctgtaact

SEQ ID NO: 4683522 - DNA, 17 bp, Homo sapiens
gaattaggctgtaacta

SEQ ID NO: 4683523 - DNA, 18 bp, Homo sapiens
gaattaggctgtaactac

SEQ ID NO: 4683524 - DNA, 14 bp, Homo sapiens
gaatttcttaactt

SEQ ID NO: 4683525 - DNA, 18 bp, Homo sapiens
gaatttcttaacttcttg

SEQ ID NO: 4683526 - DNA, 21 bp, Homo sapiens
gacagagccccaccctcagat

SEQ ID NO: 4683527 - DNA, 15 bp, Homo sapiens
gacagcagctcaggc

SEQ ID NO: 4683528 - DNA, 12 bp, Homo sapiens
gaccctcatgct

SEQ ID NO: 4683529 - DNA, 14 bp, Homo sapiens
gaccctcatgctgc

SEQ ID NO: 4683530 - DNA, 13 bp, Homo sapiens
gacctcagccttc

SEQ ID NO: 4683531 - DNA, 19 bp, Homo sapiens
gactaaactttttttctgt

SEQ ID NO: 4683532 - DNA, 20 bp, Homo sapiens
gactaaactttttttctgta

SEQ ID NO: 4683533 - DNA, 18 bp, Homo sapiens
gactagatgtagtatttt

SEQ ID NO: 4683534 - DNA, 14 bp, Homo sapiens
gactcagggcccca

SEQ ID NO: 4683535 - DNA, 17 bp, Homo sapiens
gactcagggccccagca

SEQ ID NO: 4683536 - DNA, 20 bp, Homo sapiens
gactcagggccccagcacta

SEQ ID NO: 4683537 - DNA, 18 bp, Homo sapiens
gagaaacagttggtaact

SEQ ID NO: 4683538 - DNA, 19 bp, Homo sapiens
gagaaacagttggtaactt

SEQ ID NO: 4683539 - DNA, 21 bp, Homo sapiens
gagaaacagttggtaactttt

SEQ ID NO: 4683540 - DNA, 21 bp, Homo sapiens
gagactcagggccccagcact

SEQ ID NO: 4683541 - DNA, 15 bp, Homo sapiens
gagcacactgtagca

SEQ ID NO: 4683542 - DNA, 23 bp, Homo sapiens
gagccaagggttcagagactcag

SEQ ID NO: 4683543 - DNA, 14 bp, Homo sapiens
gagccaccagttct

SEQ ID NO: 4683544 - DNA, 17 bp, Homo sapiens
gagccccaccctcagat

SEQ ID NO: 4683545 - DNA, 17 bp, Homo sapiens
gagcctcatccgaggca

SEQ ID NO: 4683546 - DNA, 18 bp, Homo sapiens
gagcctcatccgaggcag

SEQ ID NO: 4683547 - DNA, 15 bp, Homo sapiens
gaggacgctctctgg

SEQ ID NO: 4683548 - DNA, 12 bp, Homo sapiens
gaggcagacagc

SEQ ID NO: 4683549 - DNA, 16 bp, Homo sapiens
gaggcagacagcagct

SEQ ID NO: 4683550 - DNA, 18 bp, Homo sapiens
gaggctccacttggtctg

SEQ ID NO: 4683551 - DNA, 19 bp, Homo sapiens
gaggctccacttggtctgt

SEQ ID NO: 4683552 - DNA, 15 bp, Homo sapiens
gagggttagggaggg

SEQ ID NO: 4683553 - DNA, 14 bp, Homo sapiens
gagtaatttattgt

SEQ ID NO: 4683554 - DNA, 16 bp, Homo sapiens
gagtaatttattgttt

SEQ ID NO: 4683555 - DNA, 21 bp, Homo sapiens
gagtgctcagtagtcagactg

SEQ ID NO: 4683556 - DNA, 22 bp, Homo sapiens
gatgctagaactccctttcaac

SEQ ID NO: 4683557 - DNA, 17 bp, Homo sapiens
gatggaaaattcatttt

SEQ ID NO: 4683558 - DNA, 13 bp, Homo sapiens
gatgtagtatttt

SEQ ID NO: 4683559 - DNA, 17 bp, Homo sapiens
gattacaaatcagaagt

SEQ ID NO: 4683560 - DNA, 23 bp, Homo sapiens
gattacaaatcagaagtcatctt

SEQ ID NO: 4683561 - DNA, 22 bp, Homo sapiens
gattactggcctttttcattta

SEQ ID NO: 4683562 - DNA, 19 bp, Homo sapiens
gcaactgaggcagacagca

SEQ ID NO: 4683563 - DNA, 22 bp, Homo sapiens
gcaactgaggcagacagcagct

SEQ ID NO: 4683564 - DNA, 14 bp, Homo sapiens
gcactaaagcagtg

SEQ ID NO: 4683565 - DNA, 18 bp, Homo sapiens
gcactcccacctgacaca

SEQ ID NO: 4683566 - DNA, 16 bp, Homo sapiens
gcacttggagccaagg

SEQ ID NO: 4683567 - DNA, 16 bp, Homo sapiens
gcagccagctctcagc

SEQ ID NO: 4683568 - DNA, 18 bp, Homo sapiens
gcagccagctctcagcca

SEQ ID NO: 4683569 - DNA, 16 bp, Homo sapiens
gcagggtcaggagagg

SEQ ID NO: 4683570 - DNA, 18 bp, Homo sapiens
gcagtgcttggcccagga

SEQ ID NO: 4683571 - DNA, 19 bp, Homo sapiens
gcagtgcttggcccaggag

SEQ ID NO: 4683572 - DNA, 12 bp, Homo sapiens
gcagttttttga

SEQ ID NO: 4683573 - DNA, 18 bp, Homo sapiens
gcagttttttgaaaatgg

SEQ ID NO: 4683574 - DNA, 22 bp, Homo sapiens
gcatcattatttgcagagacag

SEQ ID NO: 4683575 - DNA, 14 bp, Homo sapiens
gccaatatcctaat

SEQ ID NO: 4683576 - DNA, 15 bp, Homo sapiens
gccaatatcctaata

SEQ ID NO: 4683577 - DNA, 11 bp, Homo sapiens
gccaccagttc

SEQ ID NO: 4683578 - DNA, 13 bp, Homo sapiens
gccaccagttctc

SEQ ID NO: 4683579 - DNA, 13 bp, Homo sapiens
gccacttaatgta

SEQ ID NO: 4683580 - DNA, 22 bp, Homo sapiens
gccagaagtcaaggcttagacc

SEQ ID NO: 4683581 - DNA, 23 bp, Homo sapiens
gccagaagtcaaggcttagaccc

SEQ ID NO: 4683582 - DNA, 18 bp, Homo sapiens
gccagcagccagctctca

SEQ ID NO: 4683583 - DNA, 13 bp, Homo sapiens
gccagccagcagc

SEQ ID NO: 4683584 - DNA, 15 bp, Homo sapiens
gccagctctcagcca

SEQ ID NO: 4683585 - DNA, 16 bp, Homo sapiens
gcccaggagtttggcc

SEQ ID NO: 4683586 - DNA, 20 bp, Homo sapiens
gcccaggagtttggccagaa

SEQ ID NO: 4683587 - DNA, 17 bp, Homo sapiens
gcccgtcttcagcctag

SEQ ID NO: 4683588 - DNA, 14 bp, Homo sapiens
gccgacctcagcct

SEQ ID NO: 4683589 - DNA, 15 bp, Homo sapiens
gccgacctcagcctt

SEQ ID NO: 4683590 - DNA, 20 bp, Homo sapiens
gccgctcctgtctgccagcc

SEQ ID NO: 4683591 - DNA, 21 bp, Homo sapiens
gccgctcctgtctgccagcca

SEQ ID NO: 4683592 - DNA, 19 bp, Homo sapiens
gcctagccgacctcagcct

SEQ ID NO: 4683593 - DNA, 18 bp, Homo sapiens
gcctcatccgaggcaggg

SEQ ID NO: 4683594 - DNA, 14 bp, Homo sapiens
gcctccatcctgag

SEQ ID NO: 4683595 - DNA, 15 bp, Homo sapiens
gcctccatcctgagg

SEQ ID NO: 4683596 - DNA, 20 bp, Homo sapiens
gcctccatcctgaggctcca

SEQ ID NO: 4683597 - DNA, 13 bp, Homo sapiens
gcctcctctgtcc

SEQ ID NO: 4683598 - DNA, 23 bp, Homo sapiens
gcctcggagcctcatccgaggca

SEQ ID NO: 4683599 - DNA, 21 bp, Homo sapiens
gccttcggcctccatcctgag

SEQ ID NO: 4683600 - DNA, 15 bp, Homo sapiens
gcctttttcatttat

SEQ ID NO: 4683601 - DNA, 18 bp, Homo sapiens
gcctttttcatttatcta

SEQ ID NO: 4683602 - DNA, 19 bp, Homo sapiens
gcgtcctgtcggagccctg

SEQ ID NO: 4683603 - DNA, 15 bp, Homo sapiens
gctagaactcccttt

SEQ ID NO: 4683604 - DNA, 16 bp, Homo sapiens
gctagaactccctttc

SEQ ID NO: 4683605 - DNA, 18 bp, Homo sapiens
gctagaactccctttcaa

SEQ ID NO: 4683606 - DNA, 19 bp, Homo sapiens
gctagaactccctttcaac

SEQ ID NO: 4683607 - DNA, 17 bp, Homo sapiens
gctagcacttggagcca

SEQ ID NO: 4683608 - DNA, 18 bp, Homo sapiens
gctcagcctggtgggcct

SEQ ID NO: 4683609 - DNA, 14 bp, Homo sapiens
gctcctgtctgcca

SEQ ID NO: 4683610 - DNA, 17 bp, Homo sapiens
gctcctgtctgccagcc

SEQ ID NO: 4683611 - DNA, 14 bp, Homo sapiens
gctcggtggaccca

SEQ ID NO: 4683612 - DNA, 17 bp, Homo sapiens
gctcggtggacccaggg

SEQ ID NO: 4683613 - DNA, 18 bp, Homo sapiens
gctcggtggacccaggga

SEQ ID NO: 4683614 - DNA, 16 bp, Homo sapiens
gctctaattcacagtg

SEQ ID NO: 4683615 - DNA, 11 bp, Homo sapiens
gctctctggcc

SEQ ID NO: 4683616 - DNA, 12 bp, Homo sapiens
gctctctggcct

SEQ ID NO: 4683617 - DNA, 21 bp, Homo sapiens
gctctggggtgggcagttttt

SEQ ID NO: 4683618 - DNA, 20 bp, Homo sapiens
gctgcaaggtactctggtga

SEQ ID NO: 4683619 - DNA, 19 bp, Homo sapiens
gctgccaatatcctaataa

SEQ ID NO: 4683620 - DNA, 20 bp, Homo sapiens
gctgccaatatcctaataaa

SEQ ID NO: 4683621 - DNA, 21 bp, Homo sapiens
gctgccaatatcctaataaaa

SEQ ID NO: 4683622 - DNA, 20 bp, Homo sapiens
gctgcccgtcttcagcctag

SEQ ID NO: 4683623 - DNA, 19 bp, Homo sapiens
gctgctagcacttggagcc

SEQ ID NO: 4683624 - DNA, 23 bp, Homo sapiens
gctgctagcacttggagccaagg

SEQ ID NO: 4683625 - DNA, 16 bp, Homo sapiens
gctgtttattaatctt

SEQ ID NO: 4683626 - DNA, 17 bp, Homo sapiens
gcttatttcctcatttt

SEQ ID NO: 4683627 - DNA, 12 bp, Homo sapiens
gcttctttctag

SEQ ID NO: 4683628 - DNA, 14 bp, Homo sapiens
gcttggcccaggag

SEQ ID NO: 4683629 - DNA, 16 bp, Homo sapiens
gcttggcccaggagtt

SEQ ID NO: 4683630 - DNA, 22 bp, Homo sapiens
gcttggcccaggagtttggcca

SEQ ID NO: 4683631 - DNA, 14 bp, Homo sapiens
ggacccagggatga

SEQ ID NO: 4683632 - DNA, 15 bp, Homo sapiens
ggacgctctctggcc

SEQ ID NO: 4683633 - DNA, 19 bp, Homo sapiens
ggacgctctctggccttcg

SEQ ID NO: 4683634 - DNA, 14 bp, Homo sapiens
ggagaggggcagaa

SEQ ID NO: 4683635 - DNA, 23 bp, Homo sapiens
ggagccaagggttcagagactca

SEQ ID NO: 4683636 - DNA, 14 bp, Homo sapiens
ggagccaccagttc

SEQ ID NO: 4683637 - DNA, 15 bp, Homo sapiens
ggagccaccagttct

SEQ ID NO: 4683638 - DNA, 19 bp, Homo sapiens
ggaggacgctctctggcct

SEQ ID NO: 4683639 - DNA, 20 bp, Homo sapiens
ggaggacgctctctggcctt

SEQ ID NO: 4683640 - DNA, 21 bp, Homo sapiens
ggaggacgctctctggccttc

SEQ ID NO: 4683641 - DNA, 20 bp, Homo sapiens
ggatgacatgtccctacacc

SEQ ID NO: 4683642 - DNA, 19 bp, Homo sapiens
ggattggggaagactgtgg

SEQ ID NO: 4683643 - DNA, 12 bp, Homo sapiens
ggattttcagcc

SEQ ID NO: 4683644 - DNA, 20 bp, Homo sapiens
ggcaactgaggcagacagca

SEQ ID NO: 4683645 - DNA, 16 bp, Homo sapiens
ggcagacagcagctca

SEQ ID NO: 4683646 - DNA, 17 bp, Homo sapiens
ggcagacagcagctcag

SEQ ID NO: 4683647 - DNA, 15 bp, Homo sapiens
ggcagggtcaggaga

SEQ ID NO: 4683648 - DNA, 17 bp, Homo sapiens
ggcagggtcaggagagg

SEQ ID NO: 4683649 - DNA, 17 bp, Homo sapiens
ggcagtgcttggcccag

SEQ ID NO: 4683650 - DNA, 19 bp, Homo sapiens
ggcagtgcttggcccagga

SEQ ID NO: 4683651 - DNA, 20 bp, Homo sapiens
ggcagtgcttggcccaggag

SEQ ID NO: 4683652 - DNA, 10 bp, Homo sapiens
ggcagttttt

SEQ ID NO: 4683653 - DNA, 11 bp, Homo sapiens
ggcccaggagt

SEQ ID NO: 4683654 - DNA, 13 bp, Homo sapiens
ggccccagcacta

SEQ ID NO: 4683655 - DNA, 19 bp, Homo sapiens
ggccctgagctcggtggac

SEQ ID NO: 4683656 - DNA, 16 bp, Homo sapiens
ggcctccatcctgagg

SEQ ID NO: 4683657 - DNA, 18 bp, Homo sapiens
ggcctcctctgtccaggg

SEQ ID NO: 4683658 - DNA, 15 bp, Homo sapiens
ggcctcggagcctca

SEQ ID NO: 4683659 - DNA, 16 bp, Homo sapiens
ggccttcggcctccat

SEQ ID NO: 4683660 - DNA, 18 bp, Homo sapiens
ggccttcggcctccatcc

SEQ ID NO: 4683661 - DNA, 23 bp, Homo sapiens
ggccttcggcctccatcctgagg

SEQ ID NO: 4683662 - DNA, 20 bp, Homo sapiens
gggaggacgctctctggcct

SEQ ID NO: 4683663 - DNA, 22 bp, Homo sapiens
gggaggggtaaaattccttagc

SEQ ID NO: 4683664 - DNA, 18 bp, Homo sapiens
gggcagtgcttggcccag

SEQ ID NO: 4683665 - DNA, 22 bp, Homo sapiens
gggccctgagctcggtggaccc

SEQ ID NO: 4683666 - DNA, 21 bp, Homo sapiens
gggcctcctctgtccagggcc

SEQ ID NO: 4683667 - DNA, 13 bp, Homo sapiens
ggggcagaacagc

SEQ ID NO: 4683668 - DNA, 17 bp, Homo sapiens
ggggcagaacagccgct

SEQ ID NO: 4683669 - DNA, 23 bp, Homo sapiens
ggggcagtgcttggcccaggagt

SEQ ID NO: 4683670 - DNA, 15 bp, Homo sapiens
gggtgggcagttttt

SEQ ID NO: 4683671 - DNA, 24 bp, Homo sapiens
ggtaacttttgtgaattaggctgt

SEQ ID NO: 4683672 - DNA, 12 bp, Homo sapiens
ggtaccttgaac

SEQ ID NO: 4683673 - DNA, 12 bp, Homo sapiens
ggtcctggggcc

SEQ ID NO: 4683674 - DNA, 18 bp, Homo sapiens
ggtccttttgacactgct

SEQ ID NO: 4683675 - DNA, 16 bp, Homo sapiens
ggttcagagactcagg

SEQ ID NO: 4683676 - DNA, 18 bp, Homo sapiens
ggtttaaagaaagtgtat

SEQ ID NO: 4683677 - DNA, 21 bp, Homo sapiens
gtaattagtgccacttaatgt

SEQ ID NO: 4683678 - DNA, 23 bp, Homo sapiens
gtaccagttaatttttccaacta

SEQ ID NO: 4683679 - DNA, 20 bp, Homo sapiens
gtagacgtgcacgcacactg

SEQ ID NO: 4683680 - DNA, 23 bp, Homo sapiens
gtagacgtgcacgcacactgtct

SEQ ID NO: 4683681 - DNA, 15 bp, Homo sapiens
gtagcattacagtgg

SEQ ID NO: 4683682 - DNA, 15 bp, Homo sapiens
gtagtattttttgta

SEQ ID NO: 4683683 - DNA, 21 bp, Homo sapiens
gtatgattactggcctttttc

SEQ ID NO: 4683684 - DNA, 16 bp, Homo sapiens
gtcaaggcttagaccc

SEQ ID NO: 4683685 - DNA, 22 bp, Homo sapiens
gtcatcctcaaagaaagtgtat

SEQ ID NO: 4683686 - DNA, 15 bp, Homo sapiens
gtccctggtaataag

SEQ ID NO: 4683687 - DNA, 14 bp, Homo sapiens
gtcctggggcctcg

SEQ ID NO: 4683688 - DNA, 20 bp, Homo sapiens
gtcctgtcggagccctgtct

SEQ ID NO: 4683689 - DNA, 17 bp, Homo sapiens
gtccttttgacactgct

SEQ ID NO: 4683690 - DNA, 16 bp, Homo sapiens
gtcggagccctgtctc

SEQ ID NO: 4683691 - DNA, 14 bp, Homo sapiens
gtctctcttctctc

SEQ ID NO: 4683692 - DNA, 15 bp, Homo sapiens
gtctgccagccagca

SEQ ID NO: 4683693 - DNA, 19 bp, Homo sapiens
gtgctgcccgtcttcagcc

SEQ ID NO: 4683694 - DNA, 19 bp, Homo sapiens
gtgctgtttattaatctta

SEQ ID NO: 4683695 - DNA, 13 bp, Homo sapiens
gtgcttggcccag

SEQ ID NO: 4683696 - DNA, 24 bp, Homo sapiens
gtgcttggcccaggagtttggcca

SEQ ID NO: 4683697 - DNA, 21 bp, Homo sapiens
gtggacaccaggagtccctgg

SEQ ID NO: 4683698 - DNA, 22 bp, Homo sapiens
gtggacaccaggagtccctggt

SEQ ID NO: 4683699 - DNA, 22 bp, Homo sapiens
gtggacccagggatgacatgtc

SEQ ID NO: 4683700 - DNA, 22 bp, Homo sapiens
gtggcactcagtctctcttctc

SEQ ID NO: 4683701 - DNA, 15 bp, Homo sapiens
gtgggcctcctctgt

SEQ ID NO: 4683702 - DNA, 18 bp, Homo sapiens
gtggtgggacagggaccc

SEQ ID NO: 4683703 - DNA, 18 bp, Homo sapiens
gtgtacagaattctgcta

SEQ ID NO: 4683704 - DNA, 21 bp, Homo sapiens
gtgtatttggaaataaagtca

SEQ ID NO: 4683705 - DNA, 17 bp, Homo sapiens
gttaattttgaagtgct

SEQ ID NO: 4683706 - DNA, 22 bp, Homo sapiens
gttaattttgaagtgctgttta

SEQ ID NO: 4683707 - DNA, 14 bp, Homo sapiens
gttacagttctgtg

SEQ ID NO: 4683708 - DNA, 15 bp, Homo sapiens
gttacagttctgtgg

SEQ ID NO: 4683709 - DNA, 15 bp, Homo sapiens
gttaccttatagtta

SEQ ID NO: 4683710 - DNA, 11 bp, Homo sapiens
gttatttaaat

SEQ ID NO: 4683711 - DNA, 13 bp, Homo sapiens
gttatttaaatga

SEQ ID NO: 4683712 - DNA, 22 bp, Homo sapiens
gttcagagactcagggccccag

SEQ ID NO: 4683713 - DNA, 15 bp, Homo sapiens
gttggcatagctctg

SEQ ID NO: 4683714 - DNA, 13 bp, Homo sapiens
gtttaaagaaagt

SEQ ID NO: 4683715 - DNA, 14 bp, Homo sapiens
gtttaaagaaagtg

SEQ ID NO: 4683716 - DNA, 15 bp, Homo sapiens
gtttaaagaaagtgt

SEQ ID NO: 4683717 - DNA, 17 bp, Homo sapiens
gtttaaagaaagtgtat

SEQ ID NO: 4683718 - DNA, 14 bp, Homo sapiens
gtttattaatctta

SEQ ID NO: 4683719 - DNA, 18 bp, Homo sapiens
gtttattaatcttagtgt

SEQ ID NO: 4683720 - DNA, 11 bp, Homo sapiens
gtttcattgac

SEQ ID NO: 4683721 - DNA, 12 bp, Homo sapiens
gtttggccagaa

SEQ ID NO: 4683722 - DNA, 18 bp, Homo sapiens
gtttggccagaagtcaag

SEQ ID NO: 4683723 - DNA, 16 bp, Homo sapiens
taaactttttttctgt

SEQ ID NO: 4683724 - DNA, 11 bp, Homo sapiens
taaagaaagtg

SEQ ID NO: 4683725 - DNA, 13 bp, Homo sapiens
taaagaaagtgta

SEQ ID NO: 4683726 - DNA, 14 bp, Homo sapiens
taaagaaagtgtat

SEQ ID NO: 4683727 - DNA, 20 bp, Homo sapiens
taaagaaagtgtatttggaa

SEQ ID NO: 4683728 - DNA, 24 bp, Homo sapiens
taaagaaagtgtatttggaaataa

SEQ ID NO: 4683729 - DNA, 17 bp, Homo sapiens
taaaggcagttttctaa

SEQ ID NO: 4683730 - DNA, 13 bp, Homo sapiens
taaagtcagatgg

SEQ ID NO: 4683731 - DNA, 15 bp, Homo sapiens
taaagtcagatggaa

SEQ ID NO: 4683732 - DNA, 17 bp, Homo sapiens
taaagtcagatggaaaa

SEQ ID NO: 4683733 - DNA, 14 bp, Homo sapiens
taaatatatctacc

SEQ ID NO: 4683734 - DNA, 18 bp, Homo sapiens
taaattcccgttttgtca

SEQ ID NO: 4683735 - DNA, 20 bp, Homo sapiens
taacagccctcctctgcact

SEQ ID NO: 4683736 - DNA, 18 bp, Homo sapiens
taacctgtctcacctgga

SEQ ID NO: 4683737 - DNA, 13 bp, Homo sapiens
taactactttata

SEQ ID NO: 4683738 - DNA, 17 bp, Homo sapiens
taactactttataacta

SEQ ID NO: 4683739 - DNA, 15 bp, Homo sapiens
taacttcttgcttct

SEQ ID NO: 4683740 - DNA, 22 bp, Homo sapiens
taagattacaaatcagaagtca

SEQ ID NO: 4683741 - DNA, 14 bp, Homo sapiens
taataaaaaggtga

SEQ ID NO: 4683742 - DNA, 15 bp, Homo sapiens
taattggatttccta

SEQ ID NO: 4683743 - DNA, 22 bp, Homo sapiens
taattttgaagtgctgtttatt

SEQ ID NO: 4683744 - DNA, 13 bp, Homo sapiens
taatttttccaac

SEQ ID NO: 4683745 - DNA, 16 bp, Homo sapiens
tacaaatcagaagtca

SEQ ID NO: 4683746 - DNA, 17 bp, Homo sapiens
tacaaatcagaagtcat

SEQ ID NO: 4683747 - DNA, 20 bp, Homo sapiens
tacaaatcagaagtcatctt

SEQ ID NO: 4683748 - DNA, 21 bp, Homo sapiens
tacagttctgtggtttcatgt

SEQ ID NO: 4683749 - DNA, 19 bp, Homo sapiens
taccagttaatttttccaa

SEQ ID NO: 4683750 - DNA, 22 bp, Homo sapiens
tacctaagattacaaatcagaa

SEQ ID NO: 4683751 - DNA, 15 bp, Homo sapiens
tacctcactggggtc

SEQ ID NO: 4683752 - DNA, 18 bp, Homo sapiens
taccttatagttactgtg

SEQ ID NO: 4683753 - DNA, 23 bp, Homo sapiens
tactgtcatcctcaaagaaagtg

SEQ ID NO: 4683754 - DNA, 14 bp, Homo sapiens
tagacctcagcctg

SEQ ID NO: 4683755 - DNA, 14 bp, Homo sapiens
tagccgacctcagc

SEQ ID NO: 4683756 - DNA, 17 bp, Homo sapiens
tagccgacctcagcctt

SEQ ID NO: 4683757 - DNA, 22 bp, Homo sapiens
tagctctggggtgggcagtttt

SEQ ID NO: 4683758 - DNA, 19 bp, Homo sapiens
tagcttagacctcagcctg

SEQ ID NO: 4683759 - DNA, 18 bp, Homo sapiens
taggccatgggacaggga

SEQ ID NO: 4683760 - DNA, 14 bp, Homo sapiens
tagttaccttatag

SEQ ID NO: 4683761 - DNA, 19 bp, Homo sapiens
tagttaccttatagttact

SEQ ID NO: 4683762 - DNA, 22 bp, Homo sapiens
tagttaccttatagttactgtg

SEQ ID NO: 4683763 - DNA, 23 bp, Homo sapiens
tagttaccttatagttactgtgt

SEQ ID NO: 4683764 - DNA, 17 bp, Homo sapiens
tagttactgtgtaatta

SEQ ID NO: 4683765 - DNA, 14 bp, Homo sapiens
tataactaacatgt

SEQ ID NO: 4683766 - DNA, 18 bp, Homo sapiens
tataattggatttcctaa

SEQ ID NO: 4683767 - DNA, 19 bp, Homo sapiens
tataattggatttcctaat

SEQ ID NO: 4683768 - DNA, 14 bp, Homo sapiens
tataatttacctaa

SEQ ID NO: 4683769 - DNA, 16 bp, Homo sapiens
tataatttacctaaga

SEQ ID NO: 4683770 - DNA, 18 bp, Homo sapiens
tataatttacctaagatt

SEQ ID NO: 4683771 - DNA, 18 bp, Homo sapiens
tatagttactgtgtaatt

SEQ ID NO: 4683772 - DNA, 13 bp, Homo sapiens
tatcaaactgaag

SEQ ID NO: 4683773 - DNA, 19 bp, Homo sapiens
tatccaggttccctcccag

SEQ ID NO: 4683774 - DNA, 18 bp, Homo sapiens
tatcctaataaaaaggtg

SEQ ID NO: 4683775 - DNA, 16 bp, Homo sapiens
tatctataatttacct

SEQ ID NO: 4683776 - DNA, 17 bp, Homo sapiens
tattaatcttagtgtat

SEQ ID NO: 4683777 - DNA, 15 bp, Homo sapiens
tattaccccttttcg

SEQ ID NO: 4683778 - DNA, 14 bp, Homo sapiens
tattatctgtcagc

SEQ ID NO: 4683779 - DNA, 20 bp, Homo sapiens
tattggtttaaagaaagtgt

SEQ ID NO: 4683780 - DNA, 17 bp, Homo sapiens
tattttttgtataattg

SEQ ID NO: 4683781 - DNA, 12 bp, Homo sapiens
tcaaagaaagtg

SEQ ID NO: 4683782 - DNA, 18 bp, Homo sapiens
tcacagtgctcttttctc

SEQ ID NO: 4683783 - DNA, 22 bp, Homo sapiens
tcacctggacttaagcatctgg

SEQ ID NO: 4683784 - DNA, 16 bp, Homo sapiens
tcactttttctgataa

SEQ ID NO: 4683785 - DNA, 22 bp, Homo sapiens
tcagaagtcatcttgctaccag

SEQ ID NO: 4683786 - DNA, 20 bp, Homo sapiens
tcagatggaaaattcatttt

SEQ ID NO: 4683787 - DNA, 18 bp, Homo sapiens
tcagcctagccgacctca

SEQ ID NO: 4683788 - DNA, 22 bp, Homo sapiens
tcagcctagccgacctcagcct

SEQ ID NO: 4683789 - DNA, 23 bp, Homo sapiens
tcagcctagccgacctcagcctt

SEQ ID NO: 4683790 - DNA, 14 bp, Homo sapiens
tcagcctggtgggc

SEQ ID NO: 4683791 - DNA, 17 bp, Homo sapiens
tcagcctggtgggcctc

SEQ ID NO: 4683792 - DNA, 17 bp, Homo sapiens
tcagcctgtgctgcccg

SEQ ID NO: 4683793 - DNA, 21 bp, Homo sapiens
tcagccttccccttgcccagg

SEQ ID NO: 4683794 - DNA, 22 bp, Homo sapiens
tcagccttccccttgcccaggg

SEQ ID NO: 4683795 - DNA, 21 bp, Homo sapiens
tcagctgcaaggtactctggt

SEQ ID NO: 4683796 - DNA, 16 bp, Homo sapiens
tcagggccccagcact

SEQ ID NO: 4683797 - DNA, 15 bp, Homo sapiens
tcatccgaggcaggg

SEQ ID NO: 4683798 - DNA, 14 bp, Homo sapiens
tcatgcagctgtgg

SEQ ID NO: 4683799 - DNA, 19 bp, Homo sapiens
tcatgctgccaatatccta

SEQ ID NO: 4683800 - DNA, 19 bp, Homo sapiens
tcatgttagttaccttata

SEQ ID NO: 4683801 - DNA, 16 bp, Homo sapiens
tcattatttgcagaga

SEQ ID NO: 4683802 - DNA, 21 bp, Homo sapiens
tcattgactatcaaactgaag

SEQ ID NO: 4683803 - DNA, 18 bp, Homo sapiens
tcatttatctataattta

SEQ ID NO: 4683804 - DNA, 22 bp, Homo sapiens
tccaacccgtctggcccaccag

SEQ ID NO: 4683805 - DNA, 21 bp, Homo sapiens
tccaactactaatagaataaa

SEQ ID NO: 4683806 - DNA, 23 bp, Homo sapiens
tccaactactaatagaataaagg

SEQ ID NO: 4683807 - DNA, 15 bp, Homo sapiens
tccacttggtctgtg

SEQ ID NO: 4683808 - DNA, 16 bp, Homo sapiens
tccacttggtctgtga

SEQ ID NO: 4683809 - DNA, 21 bp, Homo sapiens
tccatcctgaggctccacttg

SEQ ID NO: 4683810 - DNA, 16 bp, Homo sapiens
tcccagaggagccacc

SEQ ID NO: 4683811 - DNA, 20 bp, Homo sapiens
tcccagaggagccaccagtt

SEQ ID NO: 4683812 - DNA, 21 bp, Homo sapiens
tcccagaggagccaccagttc

SEQ ID NO: 4683813 - DNA, 23 bp, Homo sapiens
tcccagaggagccaccagttctc

SEQ ID NO: 4683814 - DNA, 16 bp, Homo sapiens
tccccttgcccagggc

SEQ ID NO: 4683815 - DNA, 24 bp, Homo sapiens
tccccttgcccagggctcagcctg

SEQ ID NO: 4683816 - DNA, 20 bp, Homo sapiens
tcccttcacaaacccagtgt

SEQ ID NO: 4683817 - DNA, 13 bp, Homo sapiens
tcctaataaaaag

SEQ ID NO: 4683818 - DNA, 16 bp, Homo sapiens
tcctaataaaaaggtg

SEQ ID NO: 4683819 - DNA, 17 bp, Homo sapiens
tcctaataaaaaggtga

SEQ ID NO: 4683820 - DNA, 18 bp, Homo sapiens
tcctaataaaaaggtgac

SEQ ID NO: 4683821 - DNA, 15 bp, Homo sapiens
tcctaatactgtcat

SEQ ID NO: 4683822 - DNA, 16 bp, Homo sapiens
tcctctgcactcccac

SEQ ID NO: 4683823 - DNA, 16 bp, Homo sapiens
tcctctgtccagggcc

SEQ ID NO: 4683824 - DNA, 17 bp, Homo sapiens
tcctgaggctccacttg

SEQ ID NO: 4683825 - DNA, 19 bp, Homo sapiens
tcctgaggctccacttggt

SEQ ID NO: 4683826 - DNA, 21 bp, Homo sapiens
tcctgaggctccacttggtct

SEQ ID NO: 4683827 - DNA, 19 bp, Homo sapiens
tcctgcctattatctgtca

SEQ ID NO: 4683828 - DNA, 19 bp, Homo sapiens
tcctgtcggagccctgtct

SEQ ID NO: 4683829 - DNA, 21 bp, Homo sapiens
tcctgtctgccagccagcagc

SEQ ID NO: 4683830 - DNA, 19 bp, Homo sapiens
tccttagcttagacctcag

SEQ ID NO: 4683831 - DNA, 17 bp, Homo sapiens
tcggcctccatcctgag

SEQ ID NO: 4683832 - DNA, 23 bp, Homo sapiens
tctaacagccctcctctgcactc

SEQ ID NO: 4683833 - DNA, 16 bp, Homo sapiens
tctaattcacagtgct

SEQ ID NO: 4683834 - DNA, 18 bp, Homo sapiens
tctaccccagactagatg

SEQ ID NO: 4683835 - DNA, 12 bp, Homo sapiens
tctataatttac

SEQ ID NO: 4683836 - DNA, 13 bp, Homo sapiens
tctcacctggact

SEQ ID NO: 4683837 - DNA, 15 bp, Homo sapiens
tctcagccaacgagt

SEQ ID NO: 4683838 - DNA, 20 bp, Homo sapiens
tctcagtaccccatggagct

SEQ ID NO: 4683839 - DNA, 15 bp, Homo sapiens
tctccagctgactaa

SEQ ID NO: 4683840 - DNA, 18 bp, Homo sapiens
tctctccagctgactaaa

SEQ ID NO: 4683841 - DNA, 12 bp, Homo sapiens
tctctcttctct

SEQ ID NO: 4683842 - DNA, 12 bp, Homo sapiens
tctcttctctcc

SEQ ID NO: 4683843 - DNA, 14 bp, Homo sapiens
tctcttctctccag

SEQ ID NO: 4683844 - DNA, 18 bp, Homo sapiens
tctgcactcccacctgac

SEQ ID NO: 4683845 - DNA, 15 bp, Homo sapiens
tctgccagccagcag

SEQ ID NO: 4683846 - DNA, 16 bp, Homo sapiens
tctggcccaccagggt

SEQ ID NO: 4683847 - DNA, 23 bp, Homo sapiens
tctggccttcggcctccatcctg

SEQ ID NO: 4683848 - DNA, 24 bp, Homo sapiens
tctgtaataaactcatttctagca

SEQ ID NO: 4683849 - DNA, 14 bp, Homo sapiens
tctgtgagatgcta

SEQ ID NO: 4683850 - DNA, 17 bp, Homo sapiens
tctgtgagatgctagaa

SEQ ID NO: 4683851 - DNA, 13 bp, Homo sapiens
tcttatttattat

SEQ ID NO: 4683852 - DNA, 11 bp, Homo sapiens
tcttcagccta

SEQ ID NO: 4683853 - DNA, 23 bp, Homo sapiens
tcttcagcctagccgacctcagc

SEQ ID NO: 4683854 - DNA, 14 bp, Homo sapiens
tcttgctaccagta

SEQ ID NO: 4683855 - DNA, 20 bp, Homo sapiens
tcttgctaccagtatttaga

SEQ ID NO: 4683856 - DNA, 16 bp, Homo sapiens
tctttctgatgtcaaa

SEQ ID NO: 4683857 - DNA, 20 bp, Homo sapiens
tgaacaagttgtttcattga

SEQ ID NO: 4683858 - DNA, 17 bp, Homo sapiens
tgaacactgggggaggg

SEQ ID NO: 4683859 - DNA, 18 bp, Homo sapiens
tgaagtgctgtttattaa

SEQ ID NO: 4683860 - DNA, 17 bp, Homo sapiens
tgaattaggctgtaact

SEQ ID NO: 4683861 - DNA, 21 bp, Homo sapiens
tgaattaggctgtaactactt

SEQ ID NO: 4683862 - DNA, 22 bp, Homo sapiens
tgaattaggctgtaactacttt

SEQ ID NO: 4683863 - DNA, 23 bp, Homo sapiens
tgacacaccaggcgctaattcaa

SEQ ID NO: 4683864 - DNA, 13 bp, Homo sapiens
tgacactgctcta

SEQ ID NO: 4683865 - DNA, 16 bp, Homo sapiens
tgacactgctctaaca

SEQ ID NO: 4683866 - DNA, 22 bp, Homo sapiens
tgacactgctctaacagccctc

SEQ ID NO: 4683867 - DNA, 22 bp, Homo sapiens
tgactatcaaactgaagccaga

SEQ ID NO: 4683868 - DNA, 20 bp, Homo sapiens
tgactattgaagttgcagat

SEQ ID NO: 4683869 - DNA, 21 bp, Homo sapiens
tgagctcggtggacccaggga

SEQ ID NO: 4683870 - DNA, 13 bp, Homo sapiens
tgaggcagacagc

SEQ ID NO: 4683871 - DNA, 20 bp, Homo sapiens
tgaggcagacagcagctcag

SEQ ID NO: 4683872 - DNA, 17 bp, Homo sapiens
tgcactcccacctgaca

SEQ ID NO: 4683873 - DNA, 15 bp, Homo sapiens
tgccaatatcctaat

SEQ ID NO: 4683874 - DNA, 19 bp, Homo sapiens
tgccaatatcctaataaaa

SEQ ID NO: 4683875 - DNA, 20 bp, Homo sapiens
tgccacttaatgtatgttac

SEQ ID NO: 4683876 - DNA, 11 bp, Homo sapiens
tgccagccagc

SEQ ID NO: 4683877 - DNA, 15 bp, Homo sapiens
tgccagccagcagcc

SEQ ID NO: 4683878 - DNA, 23 bp, Homo sapiens
tgccagccagcagccagctctca

SEQ ID NO: 4683879 - DNA, 11 bp, Homo sapiens
tgcccagggct

SEQ ID NO: 4683880 - DNA, 15 bp, Homo sapiens
tgcccagggctcagc

SEQ ID NO: 4683881 - DNA, 20 bp, Homo sapiens
tgcccagggctcagcctggt

SEQ ID NO: 4683882 - DNA, 13 bp, Homo sapiens
tgcccgtcttcag

SEQ ID NO: 4683883 - DNA, 18 bp, Homo sapiens
tgcccgtcttcagcctag

SEQ ID NO: 4683884 - DNA, 18 bp, Homo sapiens
tgctaccagtatttagaa

SEQ ID NO: 4683885 - DNA, 16 bp, Homo sapiens
tgctacctcactgggg

SEQ ID NO: 4683886 - DNA, 13 bp, Homo sapiens
tgctagaactccc

SEQ ID NO: 4683887 - DNA, 19 bp, Homo sapiens
tgctagaactccctttcaa

SEQ ID NO: 4683888 - DNA, 20 bp, Homo sapiens
tgctagcacttggagccaag

SEQ ID NO: 4683889 - DNA, 15 bp, Homo sapiens
tgctctaacagccct

SEQ ID NO: 4683890 - DNA, 21 bp, Homo sapiens
tgctcttttctcctcactgta

SEQ ID NO: 4683891 - DNA, 17 bp, Homo sapiens
tgctgcccgtcttcagc

SEQ ID NO: 4683892 - DNA, 17 bp, Homo sapiens
tgctgtttattaatctt

SEQ ID NO: 4683893 - DNA, 14 bp, Homo sapiens
tgcttctttctaga

SEQ ID NO: 4683894 - DNA, 15 bp, Homo sapiens
tgcttctttctagaa

SEQ ID NO: 4683895 - DNA, 12 bp, Homo sapiens
tgcttggcccag

SEQ ID NO: 4683896 - DNA, 16 bp, Homo sapiens
tgcttggcccaggagt

SEQ ID NO: 4683897 - DNA, 18 bp, Homo sapiens
tgcttggcccaggagttt

SEQ ID NO: 4683898 - DNA, 18 bp, Homo sapiens
tggacaccaggagtccct

SEQ ID NO: 4683899 - DNA, 15 bp, Homo sapiens
tggatttcctaatac

SEQ ID NO: 4683900 - DNA, 21 bp, Homo sapiens
tggatttcctaatactgtcat

SEQ ID NO: 4683901 - DNA, 20 bp, Homo sapiens
tggcagagttacagttctgt

SEQ ID NO: 4683902 - DNA, 16 bp, Homo sapiens
tggcatagctctgggg

SEQ ID NO: 4683903 - DNA, 17 bp, Homo sapiens
tggccagaagtcaaggc

SEQ ID NO: 4683904 - DNA, 19 bp, Homo sapiens
tggcccaggagtttggcca

SEQ ID NO: 4683905 - DNA, 23 bp, Homo sapiens
tggccttcggcctccatcctgag

SEQ ID NO: 4683906 - DNA, 19 bp, Homo sapiens
tggcctttttcatttatct

SEQ ID NO: 4683907 - DNA, 24 bp, Homo sapiens
tggtaacttttgtgaattaggctg

SEQ ID NO: 4683908 - DNA, 12 bp, Homo sapiens
tggtttcatgtt

SEQ ID NO: 4683909 - DNA, 15 bp, Homo sapiens
tggtttctagcatga

SEQ ID NO: 4683910 - DNA, 16 bp, Homo sapiens
tgtaactactttataa

SEQ ID NO: 4683911 - DNA, 18 bp, Homo sapiens
tgtaactactttataact

SEQ ID NO: 4683912 - DNA, 11 bp, Homo sapiens
tgtaccagtta

SEQ ID NO: 4683913 - DNA, 20 bp, Homo sapiens
tgtagtattttttgtataat

SEQ ID NO: 4683914 - DNA, 18 bp, Homo sapiens
tgtataattggatttcct

SEQ ID NO: 4683915 - DNA, 13 bp, Homo sapiens
tgtatgattactg

SEQ ID NO: 4683916 - DNA, 22 bp, Homo sapiens
tgtatgattactggcctttttc

SEQ ID NO: 4683917 - DNA, 21 bp, Homo sapiens
tgtatttggaaataaagtcag

SEQ ID NO: 4683918 - DNA, 23 bp, Homo sapiens
tgtcagctgcaaggtactctggt

SEQ ID NO: 4683919 - DNA, 22 bp, Homo sapiens
tgtcatcctcaaagaaagtgta

SEQ ID NO: 4683920 - DNA, 19 bp, Homo sapiens
tgtccagggccctgagctc

SEQ ID NO: 4683921 - DNA, 12 bp, Homo sapiens
tgtccctacacc

SEQ ID NO: 4683922 - DNA, 16 bp, Homo sapiens
tgtctgccagccagca

SEQ ID NO: 4683923 - DNA, 22 bp, Homo sapiens
tgtgaattaggctgtaactact

SEQ ID NO: 4683924 - DNA, 19 bp, Homo sapiens
tgtggcagagttacagttc

SEQ ID NO: 4683925 - DNA, 17 bp, Homo sapiens
tgtggtttcatgttagt

SEQ ID NO: 4683926 - DNA, 23 bp, Homo sapiens
tgtgtacagaattctgctacctc

SEQ ID NO: 4683927 - DNA, 14 bp, Homo sapiens
tgttttaggagcat

SEQ ID NO: 4683928 - DNA, 12 bp, Homo sapiens
ttaaagaaagtg

SEQ ID NO: 4683929 - DNA, 19 bp, Homo sapiens
ttaaattcccgttttgtca

SEQ ID NO: 4683930 - DNA, 22 bp, Homo sapiens
ttaaattcccgttttgtcactt

SEQ ID NO: 4683931 - DNA, 21 bp, Homo sapiens
ttaacttcttgcttctttcta

SEQ ID NO: 4683932 - DNA, 19 bp, Homo sapiens
ttaatcttagtgtatgatt

SEQ ID NO: 4683933 - DNA, 17 bp, Homo sapiens
ttaatgtatgttaccaa

SEQ ID NO: 4683934 - DNA, 18 bp, Homo sapiens
ttaatgtatgttaccaaa

SEQ ID NO: 4683935 - DNA, 13 bp, Homo sapiens
ttaatttttccaa

SEQ ID NO: 4683936 - DNA, 16 bp, Homo sapiens
ttacaaatcagaagtc

SEQ ID NO: 4683937 - DNA, 14 bp, Homo sapiens
ttacagttctgtgg

SEQ ID NO: 4683938 - DNA, 13 bp, Homo sapiens
ttactggcctttt

SEQ ID NO: 4683939 - DNA, 13 bp, Homo sapiens
ttactgtgtaatt

SEQ ID NO: 4683940 - DNA, 13 bp, Homo sapiens
ttagacctcagcc

SEQ ID NO: 4683941 - DNA, 13 bp, Homo sapiens
ttagcaaagagtt

SEQ ID NO: 4683942 - DNA, 20 bp, Homo sapiens
ttagcaaagagttaatatat

SEQ ID NO: 4683943 - DNA, 21 bp, Homo sapiens
ttagcttagacctcagcctgt

SEQ ID NO: 4683944 - DNA, 12 bp, Homo sapiens
ttagggaggggt

SEQ ID NO: 4683945 - DNA, 19 bp, Homo sapiens
ttagtgccacttaatgtat

SEQ ID NO: 4683946 - DNA, 17 bp, Homo sapiens
ttatctataatttacct

SEQ ID NO: 4683947 - DNA, 15 bp, Homo sapiens
ttatttgcagagaca

SEQ ID NO: 4683948 - DNA, 17 bp, Homo sapiens
ttcaaggaatttcttaa

SEQ ID NO: 4683949 - DNA, 19 bp, Homo sapiens
ttcaaggaatttcttaact

SEQ ID NO: 4683950 - DNA, 21 bp, Homo sapiens
ttcacacacaggcaactgagg

SEQ ID NO: 4683951 - DNA, 22 bp, Homo sapiens
ttccccttgcccagggctcagc

SEQ ID NO: 4683952 - DNA, 19 bp, Homo sapiens
ttctagaaagagaaacagt

SEQ ID NO: 4683953 - DNA, 22 bp, Homo sapiens
ttctagaaagagaaacagttgg

SEQ ID NO: 4683954 - DNA, 12 bp, Homo sapiens
ttctctccagct

SEQ ID NO: 4683955 - DNA, 19 bp, Homo sapiens
ttctgataaaagatggcca

SEQ ID NO: 4683956 - DNA, 12 bp, Homo sapiens
ttctgtaccagt

SEQ ID NO: 4683957 - DNA, 18 bp, Homo sapiens
ttctgtggtttcatgtta

SEQ ID NO: 4683958 - DNA, 22 bp, Homo sapiens
ttctgtggtttcatgttagtta

SEQ ID NO: 4683959 - DNA, 13 bp, Homo sapiens
ttcttaacttctt

SEQ ID NO: 4683960 - DNA, 22 bp, Homo sapiens
ttgacactgctctaacagccct

SEQ ID NO: 4683961 - DNA, 18 bp, Homo sapiens
ttgcccagggctcagcct

SEQ ID NO: 4683962 - DNA, 20 bp, Homo sapiens
ttgcccagggctcagcctgg

SEQ ID NO: 4683963 - DNA, 12 bp, Homo sapiens
ttgctaccagta

SEQ ID NO: 4683964 - DNA, 15 bp, Homo sapiens
ttgctaccagtattt

SEQ ID NO: 4683965 - DNA, 23 bp, Homo sapiens
ttgctaccagtatttagaagcca

SEQ ID NO: 4683966 - DNA, 21 bp, Homo sapiens
ttggcccaggagtttggccag

SEQ ID NO: 4683967 - DNA, 14 bp, Homo sapiens
ttgggtaggcggga

SEQ ID NO: 4683968 - DNA, 15 bp, Homo sapiens
ttggtaacttttgtg

SEQ ID NO: 4683969 - DNA, 15 bp, Homo sapiens
ttggtctgtgagatg

SEQ ID NO: 4683970 - DNA, 19 bp, Homo sapiens
ttggtcttatttattattg

SEQ ID NO: 4683971 - DNA, 18 bp, Homo sapiens
ttggtttaaagaaagtgt

SEQ ID NO: 4683972 - DNA, 12 bp, Homo sapiens
ttgtataattgg

SEQ ID NO: 4683973 - DNA, 15 bp, Homo sapiens
ttgtgtgttatttaa

SEQ ID NO: 4683974 - DNA, 16 bp, Homo sapiens
ttgttggcatagctct

SEQ ID NO: 4683975 - DNA, 14 bp, Homo sapiens
tttagaagccaact

SEQ ID NO: 4683976 - DNA, 14 bp, Homo sapiens
tttataactaacat

SEQ ID NO: 4683977 - DNA, 14 bp, Homo sapiens
tttatctataattt

SEQ ID NO: 4683978 - DNA, 20 bp, Homo sapiens
tttcacgcctgaggcaatta

SEQ ID NO: 4683979 - DNA, 22 bp, Homo sapiens
tttcattgactatcaaactgaa

SEQ ID NO: 4683980 - DNA, 14 bp, Homo sapiens
tttcatttatctat

SEQ ID NO: 4683981 - DNA, 19 bp, Homo sapiens
tttccaactactaatagaa

SEQ ID NO: 4683982 - DNA, 18 bp, Homo sapiens
tttcctcatttttataat

SEQ ID NO: 4683983 - DNA, 13 bp, Homo sapiens
tttcttaacttct

SEQ ID NO: 4683984 - DNA, 15 bp, Homo sapiens
tttgaagtgctgttt

SEQ ID NO: 4683985 - DNA, 20 bp, Homo sapiens
tttgaagtgctgtttattaa

SEQ ID NO: 4683986 - DNA, 22 bp, Homo sapiens
tttgtgaattaggctgtaacta

SEQ ID NO: 4683987 - DNA, 23 bp, Homo sapiens
ttttgtataattggatttcctaa

SEQ ID NO: 4683988 - DNA, 21 bp, Homo sapiens
tttttccaactactaatagaa

SEQ ID NO: 4683989 - DNA, 17 bp, Homo sapiens
tttttccttgtatttaa

SEQ ID NO: 4683990 - DNA, 22 bp, Homo sapiens
aaaaatgtcttgggtaggcggg

SEQ ID NO: 4683991 - DNA, 14 bp, Homo sapiens
aaaataaatatatc

SEQ ID NO: 4683992 - DNA, 17 bp, Homo sapiens
aaaataaatatatctac

SEQ ID NO: 4683993 - DNA, 12 bp, Homo sapiens
aaaattcatttt

SEQ ID NO: 4683994 - DNA, 16 bp, Homo sapiens
aaacagttggtaactt

SEQ ID NO: 4683995 - DNA, 19 bp, Homo sapiens
aaacagttggtaacttttg

SEQ ID NO: 4683996 - DNA, 14 bp, Homo sapiens
aaactgaagccaga

SEQ ID NO: 4683997 - DNA, 15 bp, Homo sapiens
aaactttttttctgt

SEQ ID NO: 4683998 - DNA, 22 bp, Homo sapiens
aaactttttttctgtaccagtt

SEQ ID NO: 4683999 - DNA, 16 bp, Homo sapiens
aaagaaagtgtatttg

SEQ ID NO: 4684000 - DNA, 14 bp, Homo sapiens
aaagtgtatttgga

SEQ ID NO: 4684001 - DNA, 22 bp, Homo sapiens
aaagtgtatttggaaataaagt

SEQ ID NO: 4684002 - DNA, 23 bp, Homo sapiens
aaagtgtatttggaaataaagtc

SEQ ID NO: 4684003 - DNA, 16 bp, Homo sapiens
aaagttggtgacagat

SEQ ID NO: 4684004 - DNA, 18 bp, Homo sapiens
aaataaagttggtgacag

SEQ ID NO: 4684005 - DNA, 20 bp, Homo sapiens
aaatatgttagcaaagagtt

SEQ ID NO: 4684006 - DNA, 19 bp, Homo sapiens
aaattcattttttaaattc

SEQ ID NO: 4684007 - DNA, 22 bp, Homo sapiens
aaattccttagcttagacctca

SEQ ID NO: 4684008 - DNA, 20 bp, Homo sapiens
gcccaagttcatgcagctgt

SEQ ID NO: 4684009 - DNA, 15 bp, Homo sapiens
gcccaggagtttggc

SEQ ID NO: 4684010 - DNA, 18 bp, Homo sapiens
gcccaggagtttggccag

SEQ ID NO: 4684011 - DNA, 19 bp, Homo sapiens
gcccaggagtttggccaga

SEQ ID NO: 4684012 - DNA, 13 bp, Homo sapiens
gcccagggctcag

SEQ ID NO: 4684013 - DNA, 17 bp, Homo sapiens
gcccagggctcagcctg

SEQ ID NO: 4684014 - DNA, 18 bp, Homo sapiens
gcccagggctcagcctgg

SEQ ID NO: 4684015 - DNA, 15 bp, Homo sapiens
gccccaccctcagat

SEQ ID NO: 4684016 - DNA, 17 bp, Homo sapiens
gccccagcactaaagca

SEQ ID NO: 4684017 - DNA, 19 bp, Homo sapiens
gccccagcactaaagcagt

SEQ ID NO: 4684018 - DNA, 14 bp, Homo sapiens
gcccgtcttcagcc

SEQ ID NO: 4684019 - DNA, 15 bp, Homo sapiens
gcccgtcttcagcct

SEQ ID NO: 4684020 - DNA, 16 bp, Homo sapiens
gccctcctctgcactc

SEQ ID NO: 4684021 - DNA, 16 bp, Homo sapiens
gccctgagctcggtgg

SEQ ID NO: 4684022 - DNA, 17 bp, Homo sapiens
gccgacctcagccttcc

SEQ ID NO: 4684023 - DNA, 15 bp, Homo sapiens
gccgctcctgtctgc

SEQ ID NO: 4684024 - DNA, 19 bp, Homo sapiens
gccgctcctgtctgccagc

SEQ ID NO: 4684025 - DNA, 23 bp, Homo sapiens
gccgctcctgtctgccagccagc

SEQ ID NO: 4684026 - DNA, 22 bp, Homo sapiens
gccgtgtgtgtgcgtcctgtcg

SEQ ID NO: 4684027 - DNA, 15 bp, Homo sapiens
gcctagccgacctca

SEQ ID NO: 4684028 - DNA, 17 bp, Homo sapiens
gcctagccgacctcagc

SEQ ID NO: 4684029 - DNA, 20 bp, Homo sapiens
gcctagccgacctcagcctt

SEQ ID NO: 4684030 - DNA, 16 bp, Homo sapiens
gcctcatccgaggcag

SEQ ID NO: 4684031 - DNA, 15 bp, Homo sapiens
gcctcggagcctcat

SEQ ID NO: 4684032 - DNA, 15 bp, Homo sapiens
gcctggtgggcctcc

SEQ ID NO: 4684033 - DNA, 14 bp, Homo sapiens
gcctgtgctgcccg

SEQ ID NO: 4684034 - DNA, 23 bp, Homo sapiens
gcctgtgctgcccgtcttcagcc

SEQ ID NO: 4684035 - DNA, 19 bp, Homo sapiens
gccttcggcctccatcctg

SEQ ID NO: 4684036 - DNA, 19 bp, Homo sapiens
gcctttttcatttatctat

SEQ ID NO: 4684037 - DNA, 22 bp, Homo sapiens
gcctttttcatttatctataat

SEQ ID NO: 4684038 - DNA, 13 bp, Homo sapiens
gcgggaaggaggg

SEQ ID NO: 4684039 - DNA, 22 bp, Homo sapiens
gctaattcaaggaatttcttaa

SEQ ID NO: 4684040 - DNA, 14 bp, Homo sapiens
gctaccagtattta

SEQ ID NO: 4684041 - DNA, 15 bp, Homo sapiens
gctaccagtatttag

SEQ ID NO: 4684042 - DNA, 18 bp, Homo sapiens
gctaccagtatttagaag

SEQ ID NO: 4684043 - DNA, 14 bp, Homo sapiens
gctagaactccctt

SEQ ID NO: 4684044 - DNA, 17 bp, Homo sapiens
gctcagcctggtgggcc

SEQ ID NO: 4684045 - DNA, 19 bp, Homo sapiens
gctcagcctggtgggcctc

SEQ ID NO: 4684046 - DNA, 18 bp, Homo sapiens
gctccacttggtctgtga

SEQ ID NO: 4684047 - DNA, 19 bp, Homo sapiens
gctccacttggtctgtgag

SEQ ID NO: 4684048 - DNA, 21 bp, Homo sapiens
gctcctgtctgccagccagca

SEQ ID NO: 4684049 - DNA, 15 bp, Homo sapiens
gctctaattcacagt

SEQ ID NO: 4684050 - DNA, 19 bp, Homo sapiens
gctctaattcacagtgctc

SEQ ID NO: 4684051 - DNA, 17 bp, Homo sapiens
gctctcagccaacgagt

SEQ ID NO: 4684052 - DNA, 19 bp, Homo sapiens
gctctctggccttcggcct

SEQ ID NO: 4684053 - DNA, 12 bp, Homo sapiens
gctgcaaggtac

SEQ ID NO: 4684054 - DNA, 15 bp, Homo sapiens
gctgccaatatccta

SEQ ID NO: 4684055 - DNA, 17 bp, Homo sapiens
gctgccaatatcctaat

SEQ ID NO: 4684056 - DNA, 20 bp, Homo sapiens
gctgctagcacttggagcca

SEQ ID NO: 4684057 - DNA, 16 bp, Homo sapiens
gcttagaccctcatgc

SEQ ID NO: 4684058 - DNA, 21 bp, Homo sapiens
gcttagaccctcatgctgcca

SEQ ID NO: 4684059 - DNA, 19 bp, Homo sapiens
gcttagacctcagcctgtg

SEQ ID NO: 4684060 - DNA, 13 bp, Homo sapiens
gcttggcccagga

SEQ ID NO: 4684061 - DNA, 15 bp, Homo sapiens
gcttggcccaggagt

SEQ ID NO: 4684062 - DNA, 23 bp, Homo sapiens
gcttggcccaggagtttggccag

SEQ ID NO: 4684063 - DNA, 19 bp, Homo sapiens
gctttactccgtaacagat

SEQ ID NO: 4684064 - DNA, 16 bp, Homo sapiens
ggacgctctctggcct

SEQ ID NO: 4684065 - DNA, 23 bp, Homo sapiens
ggacttaagcatctggctctaat

SEQ ID NO: 4684066 - DNA, 18 bp, Homo sapiens
ggagccctgtctcctctc

SEQ ID NO: 4684067 - DNA, 13 bp, Homo sapiens
ggagtttggccag

SEQ ID NO: 4684068 - DNA, 13 bp, Homo sapiens
ggcaactgaggca

SEQ ID NO: 4684069 - DNA, 23 bp, Homo sapiens
ggcaactgaggcagacagcagct

SEQ ID NO: 4684070 - DNA, 14 bp, Homo sapiens
tttcttaacttctt

SEQ ID NO: 4684071 - DNA, 12 bp, Homo sapiens
tttggccagaag

SEQ ID NO: 4684072 - DNA, 21 bp, Homo sapiens
tttgtataattggatttccta

SEQ ID NO: 4684073 - DNA, 14 bp, Homo sapiens
tttgtcactttttc

SEQ ID NO: 4684074 - DNA, 15 bp, Homo sapiens
tttgtgaattaggct

SEQ ID NO: 4684075 - DNA, 14 bp, Homo sapiens
ttttccaactacta

SEQ ID NO: 4684076 - DNA, 18 bp, Homo sapiens
ttttgtcactttttctga

SEQ ID NO: 4684077 - DNA, 21 bp, Homo sapiens
ttttgttggcatagctctggg

SEQ ID NO: 4684078 - DNA, 18 bp, Homo sapiens
cttagcttagacctcagc

SEQ ID NO: 4684079 - DNA, 20 bp, Homo sapiens
cttagcttagacctcagcct

SEQ ID NO: 4684080 - DNA, 23 bp, Homo sapiens
cttagcttagacctcagcctgtg

SEQ ID NO: 4684081 - DNA, 11 bp, Homo sapiens
cttagtgtatg

SEQ ID NO: 4684082 - DNA, 14 bp, Homo sapiens
cttatagttactgt

SEQ ID NO: 4684083 - DNA, 15 bp, Homo sapiens
cttatagttactgtg

SEQ ID NO: 4684084 - DNA, 16 bp, Homo sapiens
cttatagttactgtgt

SEQ ID NO: 4684085 - DNA, 15 bp, Homo sapiens
cttatttcctcattt

SEQ ID NO: 4684086 - DNA, 16 bp, Homo sapiens
cttcacacacaggcaa

SEQ ID NO: 4684087 - DNA, 21 bp, Homo sapiens
cttcagcctagccgacctcag

SEQ ID NO: 4684088 - DNA, 15 bp, Homo sapiens
cttctctccagctga

SEQ ID NO: 4684089 - DNA, 18 bp, Homo sapiens
cttctctccagctgacta

SEQ ID NO: 4684090 - DNA, 22 bp, Homo sapiens
cttctctgtattcctagaaact

SEQ ID NO: 4684091 - DNA, 21 bp, Homo sapiens
cttcttgcttctttctagaaa

SEQ ID NO: 4684092 - DNA, 15 bp, Homo sapiens
cttgaacactggggg

SEQ ID NO: 4684093 - DNA, 18 bp, Homo sapiens
cttgcccagggctcagcc

SEQ ID NO: 4684094 - DNA, 20 bp, Homo sapiens
cttgctgcaagcacagccct

SEQ ID NO: 4684095 - DNA, 14 bp, Homo sapiens
cttggcccaggagt

SEQ ID NO: 4684096 - DNA, 20 bp, Homo sapiens
cttggcccaggagtttggcc

SEQ ID NO: 4684097 - DNA, 23 bp, Homo sapiens
cttggcccaggagtttggccaga

SEQ ID NO: 4684098 - DNA, 19 bp, Homo sapiens
cttggtctgtgagatgcta

SEQ ID NO: 4684099 - DNA, 15 bp, Homo sapiens
cttggtcttatttat

SEQ ID NO: 4684100 - DNA, 12 bp, Homo sapiens
cttgtatttaaa

SEQ ID NO: 4684101 - DNA, 17 bp, Homo sapiens
cttttgacactgctcta

SEQ ID NO: 4684102 - DNA, 15 bp, Homo sapiens
ctttttcatttatct

SEQ ID NO: 4684103 - DNA, 14 bp, Homo sapiens
ctttttttctgtac

SEQ ID NO: 4684104 - DNA, 14 bp, Homo sapiens
gaaaattcattttt

SEQ ID NO: 4684105 - DNA, 18 bp, Homo sapiens
gaaacagttggtaacttt

SEQ ID NO: 4684106 - DNA, 20 bp, Homo sapiens
gaaacagttggtaacttttg

SEQ ID NO: 4684107 - DNA, 18 bp, Homo sapiens
gaaataaagttggtgaca

SEQ ID NO: 4684108 - DNA, 15 bp, Homo sapiens
gaactccctttcaac

SEQ ID NO: 4684109 - DNA, 18 bp, Homo sapiens
gaagtgctgtttattaat

SEQ ID NO: 4684110 - DNA, 20 bp, Homo sapiens
gaagtgctgtttattaatct

SEQ ID NO: 4684111 - DNA, 16 bp, Homo sapiens
gaataaaggcagtttt

SEQ ID NO: 4684112 - DNA, 15 bp, Homo sapiens
gaattaggctgtaac

SEQ ID NO: 4684113 - DNA, 13 bp, Homo sapiens
gaatttcttaact

SEQ ID NO: 4684114 - DNA, 15 bp, Homo sapiens
gaatttcttaacttc

SEQ ID NO: 4684115 - DNA, 14 bp, Homo sapiens
gacagcagctcagg

SEQ ID NO: 4684116 - DNA, 16 bp, Homo sapiens
gacagcagctcaggca

SEQ ID NO: 4684117 - DNA, 15 bp, Homo sapiens
gacaggacctgacta

SEQ ID NO: 4684118 - DNA, 19 bp, Homo sapiens
gacagggacccacttcaca

SEQ ID NO: 4684119 - DNA, 17 bp, Homo sapiens
gacagggaggacgctct

SEQ ID NO: 4684120 - DNA, 18 bp, Homo sapiens
gacagggaggacgctctc

SEQ ID NO: 4684121 - DNA, 19 bp, Homo sapiens
gacctcagcctgtgctgcc

SEQ ID NO: 4684122 - DNA, 15 bp, Homo sapiens
gacctgactattgaa

SEQ ID NO: 4684123 - DNA, 16 bp, Homo sapiens
gacgctctctggcctt

SEQ ID NO: 4684124 - DNA, 22 bp, Homo sapiens
gactatcaaactgaagccagaa

SEQ ID NO: 4684125 - DNA, 22 bp, Homo sapiens
gactggatagtccgtctctgct

SEQ ID NO: 4684126 - DNA, 12 bp, Homo sapiens
gactgtggctgc

SEQ ID NO: 4684127 - DNA, 14 bp, Homo sapiens
gactgtggctgcta

SEQ ID NO: 4684128 - DNA, 15 bp, Homo sapiens
gactgtggctgctag

SEQ ID NO: 4684129 - DNA, 17 bp, Homo sapiens
gagactcagggccccag

SEQ ID NO: 4684130 - DNA, 13 bp, Homo sapiens
gagcacactgtag

SEQ ID NO: 4684131 - DNA, 19 bp, Homo sapiens
gagccaagggttcagagac

SEQ ID NO: 4684132 - DNA, 12 bp, Homo sapiens
gagccaccagtt

SEQ ID NO: 4684133 - DNA, 15 bp, Homo sapiens
gaggcagacagcagc

SEQ ID NO: 4684134 - DNA, 13 bp, Homo sapiens
gaggcagggtcag

SEQ ID NO: 4684135 - DNA, 12 bp, Homo sapiens
gaggctccactt

SEQ ID NO: 4684136 - DNA, 23 bp, Homo sapiens
gaggctccacttggtctgtgaga

SEQ ID NO: 4684137 - DNA, 18 bp, Homo sapiens
gaggggcagaacagccgc

SEQ ID NO: 4684138 - DNA, 13 bp, Homo sapiens
gagttacagttct

SEQ ID NO: 4684139 - DNA, 20 bp, Homo sapiens
gatgctagaactccctttca

SEQ ID NO: 4684140 - DNA, 21 bp, Homo sapiens
gatgctgtcttcgtactggga

SEQ ID NO: 4684141 - DNA, 20 bp, Homo sapiens
gattacaaatcagaagtcat

SEQ ID NO: 4684142 - DNA, 19 bp, Homo sapiens
gattattaacgatgtccaa

SEQ ID NO: 4684143 - DNA, 15 bp, Homo sapiens
gattttcagccctca

SEQ ID NO: 4684144 - DNA, 19 bp, Homo sapiens
gattttcagccctcagaat

SEQ ID NO: 4684145 - DNA, 14 bp, Homo sapiens
gcaactgaggcaga

SEQ ID NO: 4684146 - DNA, 15 bp, Homo sapiens
gcaactgaggcagac

SEQ ID NO: 4684147 - DNA, 17 bp, Homo sapiens
gcaaggtactctggtga

SEQ ID NO: 4684148 - DNA, 22 bp, Homo sapiens
gcactcccacctgacacaccag

SEQ ID NO: 4684149 - DNA, 13 bp, Homo sapiens
gcacttggagcca

SEQ ID NO: 4684150 - DNA, 21 bp, Homo sapiens
gcagaacagccgctcctgtct

SEQ ID NO: 4684151 - DNA, 23 bp, Homo sapiens
gcagaacagccgctcctgtctgc

SEQ ID NO: 4684152 - DNA, 13 bp, Homo sapiens
gcagacagcagct

SEQ ID NO: 4684153 - DNA, 16 bp, Homo sapiens
gcagacagcagctcag

SEQ ID NO: 4684154 - DNA, 17 bp, Homo sapiens
gcagacagcagctcagg

SEQ ID NO: 4684155 - DNA, 18 bp, Homo sapiens
gcagacagcagctcaggc

SEQ ID NO: 4684156 - DNA, 20 bp, Homo sapiens
gcagacagcagctcaggcac

SEQ ID NO: 4684157 - DNA, 17 bp, Homo sapiens
gcagagttacagttctg

SEQ ID NO: 4684158 - DNA, 21 bp, Homo sapiens
gcagagttacagttctgtggt

SEQ ID NO: 4684159 - DNA, 20 bp, Homo sapiens
gcagattcatttttctttct

SEQ ID NO: 4684160 - DNA, 15 bp, Homo sapiens
gcagccagctctcag

SEQ ID NO: 4684161 - DNA, 16 bp, Homo sapiens
gcaggaagctgtgaga

SEQ ID NO: 4684162 - DNA, 15 bp, Homo sapiens
gcagggtcaggagag

SEQ ID NO: 4684163 - DNA, 16 bp, Homo sapiens
gcagtgcttggcccag

SEQ ID NO: 4684164 - DNA, 20 bp, Homo sapiens
gcagtgcttggcccaggagt

SEQ ID NO: 4684165 - DNA, 14 bp, Homo sapiens
gcatagctctgggg

SEQ ID NO: 4684166 - DNA, 15 bp, Homo sapiens
gcatagctctggggt

SEQ ID NO: 4684167 - DNA, 18 bp, Homo sapiens
gccaactatgattattaa

SEQ ID NO: 4684168 - DNA, 13 bp, Homo sapiens
gccaatatcctaa

SEQ ID NO: 4684169 - DNA, 19 bp, Homo sapiens
gccaatatcctaataaaaa

SEQ ID NO: 4684170 - DNA, 23 bp, Homo sapiens
gccaatatcctaataaaaaggtg

SEQ ID NO: 4684171 - DNA, 20 bp, Homo sapiens
gccagaagtcaaggcttaga

SEQ ID NO: 4684172 - DNA, 12 bp, Homo sapiens
gccagcagccag

SEQ ID NO: 4684173 - DNA, 22 bp, Homo sapiens
gccagcagccagctctcagcca

SEQ ID NO: 4684174 - DNA, 12 bp, Homo sapiens
gccagccagcag

SEQ ID NO: 4684175 - DNA, 14 bp, Homo sapiens
gccagccagcagcc

SEQ ID NO: 4684176 - DNA, 19 bp, Homo sapiens
gccagccagcagccagctc

SEQ ID NO: 4684177 - DNA, 19 bp, Homo sapiens
gccatgggacagggaggac

SEQ ID NO: 4684178 - DNA, 23 bp, Homo sapiens
gccatgggacagggaggacgctc

SEQ ID NO: 4684179 - DNA, 21 bp, Homo sapiens
cctgagctcggtggacccagg

SEQ ID NO: 4684180 - DNA, 22 bp, Homo sapiens
cctgagctcggtggacccaggg

SEQ ID NO: 4684181 - DNA, 17 bp, Homo sapiens
cctgaggctccacttgg

SEQ ID NO: 4684182 - DNA, 22 bp, Homo sapiens
cctgccctagagcacactgtag

SEQ ID NO: 4684183 - DNA, 24 bp, Homo sapiens
cctgccctagagcacactgtagca

SEQ ID NO: 4684184 - DNA, 12 bp, Homo sapiens
cctggggcctcg

SEQ ID NO: 4684185 - DNA, 21 bp, Homo sapiens
cctgtcggagccctgtctcct

SEQ ID NO: 4684186 - DNA, 15 bp, Homo sapiens
cctgtctcacctgga

SEQ ID NO: 4684187 - DNA, 17 bp, Homo sapiens
ccttagcttagacctca

SEQ ID NO: 4684188 - DNA, 20 bp, Homo sapiens
ccttagcttagacctcagcc

SEQ ID NO: 4684189 - DNA, 21 bp, Homo sapiens
ccttagcttagacctcagcct

SEQ ID NO: 4684190 - DNA, 22 bp, Homo sapiens
ccttagcttagacctcagcctg

SEQ ID NO: 4684191 - DNA, 21 bp, Homo sapiens
ccttatagttactgtgtaatt

SEQ ID NO: 4684192 - DNA, 16 bp, Homo sapiens
ccttcggcctccatcc

SEQ ID NO: 4684193 - DNA, 18 bp, Homo sapiens
ccttcggcctccatcctg

SEQ ID NO: 4684194 - DNA, 15 bp, Homo sapiens
ccttgcccagggctc

SEQ ID NO: 4684195 - DNA, 21 bp, Homo sapiens
ccttgtatttaaatattaaat

SEQ ID NO: 4684196 - DNA, 14 bp, Homo sapiens
cgaggcagggtcag

SEQ ID NO: 4684197 - DNA, 22 bp, Homo sapiens
cgaggcagggtcaggagagggg

SEQ ID NO: 4684198 - DNA, 22 bp, Homo sapiens
cggagcctcatccgaggcaggg

SEQ ID NO: 4684199 - DNA, 15 bp, Homo sapiens
cgtcttcagcctagc

SEQ ID NO: 4684200 - DNA, 22 bp, Homo sapiens
ctaagattacaaatcagaagtc

SEQ ID NO: 4684201 - DNA, 23 bp, Homo sapiens
ctaagattacaaatcagaagtca

SEQ ID NO: 4684202 - DNA, 17 bp, Homo sapiens
ctaagtaaataggaatt

SEQ ID NO: 4684203 - DNA, 11 bp, Homo sapiens
ctaataaaaag

SEQ ID NO: 4684204 - DNA, 23 bp, Homo sapiens
ctaatagaataaaggcagttttc

SEQ ID NO: 4684205 - DNA, 16 bp, Homo sapiens
ctaattcaaggaattt

SEQ ID NO: 4684206 - DNA, 22 bp, Homo sapiens
ctaattcacagtgctcttttct

SEQ ID NO: 4684207 - DNA, 22 bp, Homo sapiens
ctacacccctcccctgccctag

SEQ ID NO: 4684208 - DNA, 18 bp, Homo sapiens
ctactttataactaacat

SEQ ID NO: 4684209 - DNA, 17 bp, Homo sapiens
ctagaactccctttcaa

SEQ ID NO: 4684210 - DNA, 18 bp, Homo sapiens
ctagaactccctttcaac

SEQ ID NO: 4684211 - DNA, 20 bp, Homo sapiens
ctagatgtagtattttttgt

SEQ ID NO: 4684212 - DNA, 13 bp, Homo sapiens
ctagccgacctca

SEQ ID NO: 4684213 - DNA, 15 bp, Homo sapiens
ctagccgacctcagc

SEQ ID NO: 4684214 - DNA, 20 bp, Homo sapiens
ctatcaaactgaagccagaa

SEQ ID NO: 4684215 - DNA, 16 bp, Homo sapiens
ctcaaagaaagtgtat

SEQ ID NO: 4684216 - DNA, 20 bp, Homo sapiens
ctcactggggtcctggggcc

SEQ ID NO: 4684217 - DNA, 22 bp, Homo sapiens
ctcactggggtcctggggcctc

SEQ ID NO: 4684218 - DNA, 13 bp, Homo sapiens
ctcagcctgtgct

SEQ ID NO: 4684219 - DNA, 14 bp, Homo sapiens
ctcagcctgtgctg

SEQ ID NO: 4684220 - DNA, 16 bp, Homo sapiens
ctcagcctgtgctgcc

SEQ ID NO: 4684221 - DNA, 19 bp, Homo sapiens
ctcagtctctcttctctcc

SEQ ID NO: 4684222 - DNA, 12 bp, Homo sapiens
ctcatgctgcca

SEQ ID NO: 4684223 - DNA, 14 bp, Homo sapiens
ctcatgggtggcac

SEQ ID NO: 4684224 - DNA, 17 bp, Homo sapiens
ctccaccttgcagctct

SEQ ID NO: 4684225 - DNA, 17 bp, Homo sapiens
ctccacttggtctgtga

SEQ ID NO: 4684226 - DNA, 21 bp, Homo sapiens
ctccacttggtctgtgagatg

SEQ ID NO: 4684227 - DNA, 23 bp, Homo sapiens
ctccacttggtctgtgagatgct

SEQ ID NO: 4684228 - DNA, 11 bp, Homo sapiens
ctccatcctga

SEQ ID NO: 4684229 - DNA, 13 bp, Homo sapiens
ctccatcctgagg

SEQ ID NO: 4684230 - DNA, 16 bp, Homo sapiens
ctccatcctgaggctc

SEQ ID NO: 4684231 - DNA, 18 bp, Homo sapiens
ctccatcctgaggctcca

SEQ ID NO: 4684232 - DNA, 14 bp, Homo sapiens
ctcctcactgtatc

SEQ ID NO: 4684233 - DNA, 14 bp, Homo sapiens
ctcctctgtccagg

SEQ ID NO: 4684234 - DNA, 16 bp, Homo sapiens
ctcctctgtccagggc

SEQ ID NO: 4684235 - DNA, 16 bp, Homo sapiens
ctcctgtctgccagcc

SEQ ID NO: 4684236 - DNA, 17 bp, Homo sapiens
ctcctgtctgccagcca

SEQ ID NO: 4684237 - DNA, 23 bp, Homo sapiens
ctcggagcctcatccgaggcagg

SEQ ID NO: 4684238 - DNA, 14 bp, Homo sapiens
ctctaacagccctc

SEQ ID NO: 4684239 - DNA, 20 bp, Homo sapiens
ctctaattcacagtgctctt

SEQ ID NO: 4684240 - DNA, 14 bp, Homo sapiens
ctctctggccttcg

SEQ ID NO: 4684241 - DNA, 19 bp, Homo sapiens
ctctctggccttcggcctc

SEQ ID NO: 4684242 - DNA, 22 bp, Homo sapiens
ctctctggccttcggcctccat

SEQ ID NO: 4684243 - DNA, 23 bp, Homo sapiens
ctctgcactcccacctgacacac

SEQ ID NO: 4684244 - DNA, 15 bp, Homo sapiens
ctctggggtgggcag

SEQ ID NO: 4684245 - DNA, 21 bp, Homo sapiens
ctctgtccagggccctgagct

SEQ ID NO: 4684246 - DNA, 13 bp, Homo sapiens
ctcttctctccag

SEQ ID NO: 4684247 - DNA, 22 bp, Homo sapiens
ctcttctctccagctgactaaa

SEQ ID NO: 4684248 - DNA, 17 bp, Homo sapiens
ctgacacaccaggcgct

SEQ ID NO: 4684249 - DNA, 19 bp, Homo sapiens
ctgactaaactttttttct

SEQ ID NO: 4684250 - DNA, 20 bp, Homo sapiens
ctgagctcggtggacccagg

SEQ ID NO: 4684251 - DNA, 18 bp, Homo sapiens
ctgataaaagatggccat

SEQ ID NO: 4684252 - DNA, 18 bp, Homo sapiens
ctgcaaggtactctggtg

SEQ ID NO: 4684253 - DNA, 22 bp, Homo sapiens
ctgcactcccacctgacacacc

SEQ ID NO: 4684254 - DNA, 13 bp, Homo sapiens
ctgccagccagca

SEQ ID NO: 4684255 - DNA, 16 bp, Homo sapiens
ctgcccgtcttcagcc

SEQ ID NO: 4684256 - DNA, 18 bp, Homo sapiens
ctgcccgtcttcagccta

SEQ ID NO: 4684257 - DNA, 19 bp, Homo sapiens
ctgccctagagcacactgt

SEQ ID NO: 4684258 - DNA, 17 bp, Homo sapiens
ctggccttcggcctcca

SEQ ID NO: 4684259 - DNA, 23 bp, Homo sapiens
ctggccttcggcctccatcctga

SEQ ID NO: 4684260 - DNA, 21 bp, Homo sapiens
ctggcctttttcatttatcta

SEQ ID NO: 4684261 - DNA, 15 bp, Homo sapiens
ctggctctaattcac

SEQ ID NO: 4684262 - DNA, 20 bp, Homo sapiens
ctgggaaagggattttcagc

SEQ ID NO: 4684263 - DNA, 19 bp, Homo sapiens
ctggggtcctggggcctcg

SEQ ID NO: 4684264 - DNA, 12 bp, Homo sapiens
ctggtgggcctc

SEQ ID NO: 4684265 - DNA, 17 bp, Homo sapiens
ctgtaactactttataa

SEQ ID NO: 4684266 - DNA, 12 bp, Homo sapiens
ctgtaccagtta

SEQ ID NO: 4684267 - DNA, 17 bp, Homo sapiens
ctgtagcattacagtgg

SEQ ID NO: 4684268 - DNA, 12 bp, Homo sapiens
ctgtcagctgca

SEQ ID NO: 4684269 - DNA, 20 bp, Homo sapiens
ctgtccagggccctgagctc

SEQ ID NO: 4684270 - DNA, 22 bp, Homo sapiens
ctgtccagggccctgagctcgg

SEQ ID NO: 4684271 - DNA, 16 bp, Homo sapiens
ctgtgagatgctagaa

SEQ ID NO: 4684272 - DNA, 23 bp, Homo sapiens
ctgtgagatgctagaactccctt

SEQ ID NO: 4684273 - DNA, 19 bp, Homo sapiens
ctgtggcagagttacagtt

SEQ ID NO: 4684274 - DNA, 22 bp, Homo sapiens
ctgtggcagagttacagttctg

SEQ ID NO: 4684275 - DNA, 14 bp, Homo sapiens
cttaacttcttgct

SEQ ID NO: 4684276 - DNA, 18 bp, Homo sapiens
cttaagcatctggctcta

SEQ ID NO: 4684277 - DNA, 14 bp, Homo sapiens
cttagaccctcatg

SEQ ID NO: 4684278 - DNA, 22 bp, Homo sapiens
cttagaccctcatgctgccaat

SEQ ID NO: 4684279 - DNA, 22 bp, Homo sapiens
cagggacccacttcacacacag

SEQ ID NO: 4684280 - DNA, 19 bp, Homo sapiens
cagggaggacgctctctgg

SEQ ID NO: 4684281 - DNA, 12 bp, Homo sapiens
cagggctcagcc

SEQ ID NO: 4684282 - DNA, 22 bp, Homo sapiens
cagggctttactccgtaacaga

SEQ ID NO: 4684283 - DNA, 14 bp, Homo sapiens
cagggtccttttga

SEQ ID NO: 4684284 - DNA, 19 bp, Homo sapiens
cagggtccttttgacactg

SEQ ID NO: 4684285 - DNA, 17 bp, Homo sapiens
cagtatttagaagccaa

SEQ ID NO: 4684286 - DNA, 14 bp, Homo sapiens
cagtctctcttctc

SEQ ID NO: 4684287 - DNA, 17 bp, Homo sapiens
cagtctctcttctctcc

SEQ ID NO: 4684288 - DNA, 14 bp, Homo sapiens
cagtgctcttttct

SEQ ID NO: 4684289 - DNA, 23 bp, Homo sapiens
cagtgctcttttctcctcactgt

SEQ ID NO: 4684290 - DNA, 17 bp, Homo sapiens
cagtgcttggcccagga

SEQ ID NO: 4684291 - DNA, 18 bp, Homo sapiens
cagtgcttggcccaggag

SEQ ID NO: 4684292 - DNA, 20 bp, Homo sapiens
cagtgcttggcccaggagtt

SEQ ID NO: 4684293 - DNA, 13 bp, Homo sapiens
cagttaatttttc

SEQ ID NO: 4684294 - DNA, 14 bp, Homo sapiens
cagttggtaacttt

SEQ ID NO: 4684295 - DNA, 16 bp, Homo sapiens
cagttggtaacttttg

SEQ ID NO: 4684296 - DNA, 12 bp, Homo sapiens
cataacctgtct

SEQ ID NO: 4684297 - DNA, 22 bp, Homo sapiens
catccgaggcagggtcaggaga

SEQ ID NO: 4684298 - DNA, 23 bp, Homo sapiens
catccgaggcagggtcaggagag

SEQ ID NO: 4684299 - DNA, 20 bp, Homo sapiens
catcctcaaagaaagtgtat

SEQ ID NO: 4684300 - DNA, 22 bp, Homo sapiens
catcctcaaagaaagtgtattg

SEQ ID NO: 4684301 - DNA, 18 bp, Homo sapiens
catctggctctaattcac

SEQ ID NO: 4684302 - DNA, 12 bp, Homo sapiens
catcttgctacc

SEQ ID NO: 4684303 - DNA, 16 bp, Homo sapiens
catcttgctaccagta

SEQ ID NO: 4684304 - DNA, 22 bp, Homo sapiens
catcttgctaccagtatttaga

SEQ ID NO: 4684305 - DNA, 23 bp, Homo sapiens
catcttgctaccagtatttagaa

SEQ ID NO: 4684306 - DNA, 19 bp, Homo sapiens
catgctgccaatatcctaa

SEQ ID NO: 4684307 - DNA, 15 bp, Homo sapiens
catggagctgggcta

SEQ ID NO: 4684308 - DNA, 17 bp, Homo sapiens
catgggacagggaggac

SEQ ID NO: 4684309 - DNA, 14 bp, Homo sapiens
catgttagttacct

SEQ ID NO: 4684310 - DNA, 24 bp, Homo sapiens
catgttagttaccttatagttact

SEQ ID NO: 4684311 - DNA, 21 bp, Homo sapiens
catttatctataatttaccta

SEQ ID NO: 4684312 - DNA, 22 bp, Homo sapiens
catttatctataatttacctaa

SEQ ID NO: 4684313 - DNA, 20 bp, Homo sapiens
ccaagggttcagagactcag

SEQ ID NO: 4684314 - DNA, 23 bp, Homo sapiens
ccaagggttcagagactcagggc

SEQ ID NO: 4684315 - DNA, 14 bp, Homo sapiens
ccaatatcctaata

SEQ ID NO: 4684316 - DNA, 18 bp, Homo sapiens
ccaatatcctaataaaaa

SEQ ID NO: 4684317 - DNA, 12 bp, Homo sapiens
ccaccagttctc

SEQ ID NO: 4684318 - DNA, 17 bp, Homo sapiens
ccacttggtctgtgaga

SEQ ID NO: 4684319 - DNA, 20 bp, Homo sapiens
ccacttggtctgtgagatgc

SEQ ID NO: 4684320 - DNA, 18 bp, Homo sapiens
ccagactagatgtagtat

SEQ ID NO: 4684321 - DNA, 21 bp, Homo sapiens
ccagaggagccaccagttctc

SEQ ID NO: 4684322 - DNA, 19 bp, Homo sapiens
ccagcagccagctctcagc

SEQ ID NO: 4684323 - DNA, 13 bp, Homo sapiens
ccagctctcagcc

SEQ ID NO: 4684324 - DNA, 14 bp, Homo sapiens
ccagctgactaaac

SEQ ID NO: 4684325 - DNA, 14 bp, Homo sapiens
ccaggagtttggcc

SEQ ID NO: 4684326 - DNA, 16 bp, Homo sapiens
ccaggagtttggccag

SEQ ID NO: 4684327 - DNA, 18 bp, Homo sapiens
ccaggagtttggccagaa

SEQ ID NO: 4684328 - DNA, 15 bp, Homo sapiens
ccagggccctgagct

SEQ ID NO: 4684329 - DNA, 13 bp, Homo sapiens
ccagggctcagcc

SEQ ID NO: 4684330 - DNA, 14 bp, Homo sapiens
ccagggctcagcct

SEQ ID NO: 4684331 - DNA, 15 bp, Homo sapiens
ccagggctcagcctg

SEQ ID NO: 4684332 - DNA, 20 bp, Homo sapiens
ccagggctcagcctggtggg

SEQ ID NO: 4684333 - DNA, 17 bp, Homo sapiens
ccagtatttagaagcca

SEQ ID NO: 4684334 - DNA, 18 bp, Homo sapiens
ccagtatttagaagccaa

SEQ ID NO: 4684335 - DNA, 19 bp, Homo sapiens
ccagtgttttaggagcatg

SEQ ID NO: 4684336 - DNA, 15 bp, Homo sapiens
ccatcctgaggctcc

SEQ ID NO: 4684337 - DNA, 16 bp, Homo sapiens
ccatcctgaggctcca

SEQ ID NO: 4684338 - DNA, 18 bp, Homo sapiens
ccatcctgaggctccact

SEQ ID NO: 4684339 - DNA, 19 bp, Homo sapiens
cccaagttcatgcagctgt

SEQ ID NO: 4684340 - DNA, 18 bp, Homo sapiens
cccacctgacacaccagg

SEQ ID NO: 4684341 - DNA, 16 bp, Homo sapiens
cccagcactaaagcag

SEQ ID NO: 4684342 - DNA, 20 bp, Homo sapiens
cccaggagtttggccagaag

SEQ ID NO: 4684343 - DNA, 16 bp, Homo sapiens
cccagggctcagcctg

SEQ ID NO: 4684344 - DNA, 17 bp, Homo sapiens
cccagggctcagcctgg

SEQ ID NO: 4684345 - DNA, 18 bp, Homo sapiens
cccagggctcagcctggt

SEQ ID NO: 4684346 - DNA, 16 bp, Homo sapiens
cccagtgttttaggag

SEQ ID NO: 4684347 - DNA, 19 bp, Homo sapiens
ccccatggagctgggctaa

SEQ ID NO: 4684348 - DNA, 20 bp, Homo sapiens
ccccttgcccagggctcagc

SEQ ID NO: 4684349 - DNA, 22 bp, Homo sapiens
ccccttttcggccccatgtatc

SEQ ID NO: 4684350 - DNA, 15 bp, Homo sapiens
cccgtcttcagccta

SEQ ID NO: 4684351 - DNA, 16 bp, Homo sapiens
cccgtcttcagcctag

SEQ ID NO: 4684352 - DNA, 14 bp, Homo sapiens
ccctcatgctgcca

SEQ ID NO: 4684353 - DNA, 12 bp, Homo sapiens
ccctgagctcgg

SEQ ID NO: 4684354 - DNA, 23 bp, Homo sapiens
cccttgcccagggctcagcctgg

SEQ ID NO: 4684355 - DNA, 14 bp, Homo sapiens
ccgacctcagcctt

SEQ ID NO: 4684356 - DNA, 18 bp, Homo sapiens
ccgtctggcccaccaggg

SEQ ID NO: 4684357 - DNA, 15 bp, Homo sapiens
ccgtcttcagcctag

SEQ ID NO: 4684358 - DNA, 14 bp, Homo sapiens
ccgttttgtcactt

SEQ ID NO: 4684359 - DNA, 19 bp, Homo sapiens
ccgttttgtcactttttct

SEQ ID NO: 4684360 - DNA, 14 bp, Homo sapiens
cctaataaaaaggt

SEQ ID NO: 4684361 - DNA, 15 bp, Homo sapiens
cctaataaaaaggtg

SEQ ID NO: 4684362 - DNA, 13 bp, Homo sapiens
cctacaccattcc

SEQ ID NO: 4684363 - DNA, 16 bp, Homo sapiens
cctagccgacctcagc

SEQ ID NO: 4684364 - DNA, 18 bp, Homo sapiens
cctagccgacctcagcct

SEQ ID NO: 4684365 - DNA, 12 bp, Homo sapiens
cctcagcctgtg

SEQ ID NO: 4684366 - DNA, 14 bp, Homo sapiens
cctcatccgaggca

SEQ ID NO: 4684367 - DNA, 17 bp, Homo sapiens
cctcatccgaggcaggg

SEQ ID NO: 4684368 - DNA, 20 bp, Homo sapiens
cctcatccgaggcagggtca

SEQ ID NO: 4684369 - DNA, 13 bp, Homo sapiens
cctcatgctgcca

SEQ ID NO: 4684370 - DNA, 21 bp, Homo sapiens
cctcatgctgccaatatccta

SEQ ID NO: 4684371 - DNA, 14 bp, Homo sapiens
cctccatcctgagg

SEQ ID NO: 4684372 - DNA, 21 bp, Homo sapiens
cctcctctgcactcccacctg

SEQ ID NO: 4684373 - DNA, 12 bp, Homo sapiens
cctcctctgtcc

SEQ ID NO: 4684374 - DNA, 18 bp, Homo sapiens
cctcctctgtccagggcc

SEQ ID NO: 4684375 - DNA, 13 bp, Homo sapiens
cctcggagcctca

SEQ ID NO: 4684376 - DNA, 16 bp, Homo sapiens
cctcggagcctcatcc

SEQ ID NO: 4684377 - DNA, 15 bp, Homo sapiens
cctctgtccagggcc

SEQ ID NO: 4684378 - DNA, 23 bp, Homo sapiens
cctctgtccagggccctgagctc

SEQ ID NO: 4684379 - DNA, 18 bp, Homo sapiens
cctgacacaccaggcgct

SEQ ID NO: 4684380 - DNA, 22 bp, Homo sapiens
agcagtttggtttctagcatga

SEQ ID NO: 4684381 - DNA, 18 bp, Homo sapiens
agcatctggctctaattc

SEQ ID NO: 4684382 - DNA, 20 bp, Homo sapiens
agccaactatgattattaac

SEQ ID NO: 4684383 - DNA, 22 bp, Homo sapiens
agccaagggttcagagactcag

SEQ ID NO: 4684384 - DNA, 14 bp, Homo sapiens
agccaccagttctc

SEQ ID NO: 4684385 - DNA, 17 bp, Homo sapiens
agccctcctctgcactc

SEQ ID NO: 4684386 - DNA, 11 bp, Homo sapiens
agccctgtctc

SEQ ID NO: 4684387 - DNA, 21 bp, Homo sapiens
agcccttatgcggttaatttt

SEQ ID NO: 4684388 - DNA, 22 bp, Homo sapiens
agcccttatgcggttaattttg

SEQ ID NO: 4684389 - DNA, 12 bp, Homo sapiens
agccgacctcag

SEQ ID NO: 4684390 - DNA, 14 bp, Homo sapiens
agccgacctcagcc

SEQ ID NO: 4684391 - DNA, 18 bp, Homo sapiens
agcctagccgacctcagc

SEQ ID NO: 4684392 - DNA, 21 bp, Homo sapiens
agcctagccgacctcagcctt

SEQ ID NO: 4684393 - DNA, 14 bp, Homo sapiens
agcctggtgggcct

SEQ ID NO: 4684394 - DNA, 18 bp, Homo sapiens
agcctggtgggcctcctc

SEQ ID NO: 4684395 - DNA, 12 bp, Homo sapiens
agctcggtggac

SEQ ID NO: 4684396 - DNA, 15 bp, Homo sapiens
agctcggtggaccca

SEQ ID NO: 4684397 - DNA, 13 bp, Homo sapiens
agctctcagccaa

SEQ ID NO: 4684398 - DNA, 20 bp, Homo sapiens
agctctggggtgggcagttt

SEQ ID NO: 4684399 - DNA, 23 bp, Homo sapiens
agctgactaaactttttttctgt

SEQ ID NO: 4684400 - DNA, 23 bp, Homo sapiens
agctgcaaggtactctggtgagt

SEQ ID NO: 4684401 - DNA, 17 bp, Homo sapiens
agctgggctaagtaaat

SEQ ID NO: 4684402 - DNA, 17 bp, Homo sapiens
agcttagacctcagcct

SEQ ID NO: 4684403 - DNA, 18 bp, Homo sapiens
agcttagacctcagcctg

SEQ ID NO: 4684404 - DNA, 18 bp, Homo sapiens
aggaagctgtgagagcag

SEQ ID NO: 4684405 - DNA, 13 bp, Homo sapiens
aggaatttcttaa

SEQ ID NO: 4684406 - DNA, 19 bp, Homo sapiens
aggaatttcttaacttctt

SEQ ID NO: 4684407 - DNA, 14 bp, Homo sapiens
aggacgctctctgg

SEQ ID NO: 4684408 - DNA, 17 bp, Homo sapiens
aggacgctctctggcct

SEQ ID NO: 4684409 - DNA, 18 bp, Homo sapiens
aggagaggggcagaacag

SEQ ID NO: 4684410 - DNA, 19 bp, Homo sapiens
aggagaggggcagaacagc

SEQ ID NO: 4684411 - DNA, 14 bp, Homo sapiens
aggagccaccagtt

SEQ ID NO: 4684412 - DNA, 15 bp, Homo sapiens
aggagccaccagttc

SEQ ID NO: 4684413 - DNA, 21 bp, Homo sapiens
aggcaattagacactttggaa

SEQ ID NO: 4684414 - DNA, 16 bp, Homo sapiens
aggcacacttcttctt

SEQ ID NO: 4684415 - DNA, 14 bp, Homo sapiens
aggcagacagcagc

SEQ ID NO: 4684416 - DNA, 20 bp, Homo sapiens
aggcagacagcagctcaggc

SEQ ID NO: 4684417 - DNA, 17 bp, Homo sapiens
aggcagggtcaggagag

SEQ ID NO: 4684418 - DNA, 19 bp, Homo sapiens
aggcagggtcaggagaggg

SEQ ID NO: 4684419 - DNA, 20 bp, Homo sapiens
aggcagggtcaggagagggg

SEQ ID NO: 4684420 - DNA, 22 bp, Homo sapiens
aggctccacttggtctgtgaga

SEQ ID NO: 4684421 - DNA, 12 bp, Homo sapiens
aggctgtaacta

SEQ ID NO: 4684422 - DNA, 22 bp, Homo sapiens
aggcttagaccctcatgctgcc

SEQ ID NO: 4684423 - DNA, 23 bp, Homo sapiens
aggcttagaccctcatgctgcca

SEQ ID NO: 4684424 - DNA, 17 bp, Homo sapiens
agggattttcagccctc

SEQ ID NO: 4684425 - DNA, 22 bp, Homo sapiens
agggattttcagccctcagaat

SEQ ID NO: 4684426 - DNA, 19 bp, Homo sapiens
agggtaccttgaacactgg

SEQ ID NO: 4684427 - DNA, 18 bp, Homo sapiens
agggtcaggagaggggca

SEQ ID NO: 4684428 - DNA, 22 bp, Homo sapiens
agggtccttttgacactgctct

SEQ ID NO: 4684429 - DNA, 16 bp, Homo sapiens
agggttagggaggggt

SEQ ID NO: 4684430 - DNA, 13 bp, Homo sapiens
agtaatttattgt

SEQ ID NO: 4684431 - DNA, 13 bp, Homo sapiens
agtagtcagactg

SEQ ID NO: 4684432 - DNA, 19 bp, Homo sapiens
agtattttttgtataattg

SEQ ID NO: 4684433 - DNA, 23 bp, Homo sapiens
agtcagatggaaaattcattttt

SEQ ID NO: 4684434 - DNA, 14 bp, Homo sapiens
agtctctcttctct

SEQ ID NO: 4684435 - DNA, 18 bp, Homo sapiens
agtgccacttaatgtatg

SEQ ID NO: 4684436 - DNA, 20 bp, Homo sapiens
agtgccacttaatgtatgtt

SEQ ID NO: 4684437 - DNA, 21 bp, Homo sapiens
agtgctgtttattaatcttag

SEQ ID NO: 4684438 - DNA, 22 bp, Homo sapiens
agtggacaccaggagtccctgg

SEQ ID NO: 4684439 - DNA, 19 bp, Homo sapiens
agtgtatgattactggcct

SEQ ID NO: 4684440 - DNA, 13 bp, Homo sapiens
agttacagttctg

SEQ ID NO: 4684441 - DNA, 20 bp, Homo sapiens
agttaccttatagttactgt

SEQ ID NO: 4684442 - DNA, 16 bp, Homo sapiens
agttctgtggtttcat

SEQ ID NO: 4684443 - DNA, 23 bp, Homo sapiens
agttctgtggtttcatgttagtt

SEQ ID NO: 4684444 - DNA, 15 bp, Homo sapiens
agttggtaacttttg

SEQ ID NO: 4684445 - DNA, 15 bp, Homo sapiens
ataaactcatttcta

SEQ ID NO: 4684446 - DNA, 17 bp, Homo sapiens
ataaaggcagttttcta

SEQ ID NO: 4684447 - DNA, 18 bp, Homo sapiens
ataaaggcagttttctaa

SEQ ID NO: 4684448 - DNA, 17 bp, Homo sapiens
ataaagttggtgacaga

SEQ ID NO: 4684449 - DNA, 21 bp, Homo sapiens
ataaatatatctaccccagac

SEQ ID NO: 4684450 - DNA, 15 bp, Homo sapiens
ataactaacatgtcc

SEQ ID NO: 4684451 - DNA, 16 bp, Homo sapiens
ataagtactgtgtaca

SEQ ID NO: 4684452 - DNA, 19 bp, Homo sapiens
ataagtactgtgtacagaa

SEQ ID NO: 4684453 - DNA, 20 bp, Homo sapiens
ataattggatttcctaatac

SEQ ID NO: 4684454 - DNA, 23 bp, Homo sapiens
ataatttacctaagattacaaat

SEQ ID NO: 4684455 - DNA, 20 bp, Homo sapiens
atagaataaaggcagttttc

SEQ ID NO: 4684456 - DNA, 13 bp, Homo sapiens
atagctctggggt

SEQ ID NO: 4684457 - DNA, 13 bp, Homo sapiens
atagttactgtgt

SEQ ID NO: 4684458 - DNA, 20 bp, Homo sapiens
atagttactgtgtaattagt

SEQ ID NO: 4684459 - DNA, 12 bp, Homo sapiens
atatcctaataa

SEQ ID NO: 4684460 - DNA, 23 bp, Homo sapiens
atatctaccccagactagatgta

SEQ ID NO: 4684461 - DNA, 23 bp, Homo sapiens
atattaaatatgttagcaaagag

SEQ ID NO: 4684462 - DNA, 14 bp, Homo sapiens
atcaaactgaagcc

SEQ ID NO: 4684463 - DNA, 18 bp, Homo sapiens
atcagaagtcatcttgct

SEQ ID NO: 4684464 - DNA, 19 bp, Homo sapiens
atccaggttccctcccaga

SEQ ID NO: 4684465 - DNA, 12 bp, Homo sapiens
atccgaggcagg

SEQ ID NO: 4684466 - DNA, 13 bp, Homo sapiens
atccgaggcaggg

SEQ ID NO: 4684467 - DNA, 15 bp, Homo sapiens
atcctaataaaaagg

SEQ ID NO: 4684468 - DNA, 16 bp, Homo sapiens
atcctaataaaaaggt

SEQ ID NO: 4684469 - DNA, 13 bp, Homo sapiens
atcctgaggctcc

SEQ ID NO: 4684470 - DNA, 21 bp, Homo sapiens
atcgctccaccttgcagctct

SEQ ID NO: 4684471 - DNA, 20 bp, Homo sapiens
atctaccccagactagatgt

SEQ ID NO: 4684472 - DNA, 23 bp, Homo sapiens
atctataatttacctaagattac

SEQ ID NO: 4684473 - DNA, 15 bp, Homo sapiens
atcttagtgtatgat

SEQ ID NO: 4684474 - DNA, 16 bp, Homo sapiens
atcttagtgtatgatt

SEQ ID NO: 4684475 - DNA, 19 bp, Homo sapiens
atcttgctaccagtattta

SEQ ID NO: 4684476 - DNA, 23 bp, Homo sapiens
atcttgctaccagtatttagaag

SEQ ID NO: 4684477 - DNA, 19 bp, Homo sapiens
atgattactggcctttttc

SEQ ID NO: 4684478 - DNA, 16 bp, Homo sapiens
atgctagaactccctt

SEQ ID NO: 4684479 - DNA, 19 bp, Homo sapiens
atgctagaactccctttca

SEQ ID NO: 4684480 - DNA, 19 bp, Homo sapiens
atgctgccaatatcctaat

SEQ ID NO: 4684481 - DNA, 21 bp, Homo sapiens
atgctgccaatatcctaataa

SEQ ID NO: 4684482 - DNA, 17 bp, Homo sapiens
atggcataacctgtctc

SEQ ID NO: 4684483 - DNA, 15 bp, Homo sapiens
atgggacagggagga

SEQ ID NO: 4684484 - DNA, 23 bp, Homo sapiens
atgtagtattttttgtataattg

SEQ ID NO: 4684485 - DNA, 12 bp, Homo sapiens
atgtatgttacc

SEQ ID NO: 4684486 - DNA, 22 bp, Homo sapiens
atgtcctgcctattatctgtca

SEQ ID NO: 4684487 - DNA, 15 bp, Homo sapiens
atgttagcaaagagt

SEQ ID NO: 4684488 - DNA, 20 bp, Homo sapiens
attaatcttagtgtatgatt

SEQ ID NO: 4684489 - DNA, 21 bp, Homo sapiens
attaatcttagtgtatgatta

SEQ ID NO: 4684490 - DNA, 14 bp, Homo sapiens
attaggctgtaact

SEQ ID NO: 4684491 - DNA, 18 bp, Homo sapiens
attcaaggaatttcttaa

SEQ ID NO: 4684492 - DNA, 21 bp, Homo sapiens
attcacagtgctcttttctcc

SEQ ID NO: 4684493 - DNA, 16 bp, Homo sapiens
attcccgttttgtcac

SEQ ID NO: 4684494 - DNA, 18 bp, Homo sapiens
attcccgttttgtcactt

SEQ ID NO: 4684495 - DNA, 20 bp, Homo sapiens
attccttagcttagacctca

SEQ ID NO: 4684496 - DNA, 21 bp, Homo sapiens
attccttagcttagacctcag

SEQ ID NO: 4684497 - DNA, 22 bp, Homo sapiens
attccttagcttagacctcagc

SEQ ID NO: 4684498 - DNA, 24 bp, Homo sapiens
attccttagcttagacctcagcct

SEQ ID NO: 4684499 - DNA, 15 bp, Homo sapiens
attctgctacctcac

SEQ ID NO: 4684500 - DNA, 21 bp, Homo sapiens
attgactatcaaactgaagcc

SEQ ID NO: 4684501 - DNA, 17 bp, Homo sapiens
attggtttaaagaaagt

SEQ ID NO: 4684502 - DNA, 16 bp, Homo sapiens
atttaaatattaaata

SEQ ID NO: 4684503 - DNA, 13 bp, Homo sapiens
atttagaagccaa

SEQ ID NO: 4684504 - DNA, 22 bp, Homo sapiens
atttagaagccaactatgatta

SEQ ID NO: 4684505 - DNA, 11 bp, Homo sapiens
atttatctata

SEQ ID NO: 4684506 - DNA, 15 bp, Homo sapiens
atttatctataattt

SEQ ID NO: 4684507 - DNA, 14 bp, Homo sapiens
atttcttaacttct

SEQ ID NO: 4684508 - DNA, 19 bp, Homo sapiens
atttcttaacttcttgctt

SEQ ID NO: 4684509 - DNA, 13 bp, Homo sapiens
attttgaagtgct

SEQ ID NO: 4684510 - DNA, 14 bp, Homo sapiens
attttttgtataat

SEQ ID NO: 4684511 - DNA, 16 bp, Homo sapiens
attttttgtataattg

SEQ ID NO: 4684512 - DNA, 15 bp, Homo sapiens
caaatcagaagtcat

SEQ ID NO: 4684513 - DNA, 22 bp, Homo sapiens
caacccgtctggcccaccaggg

SEQ ID NO: 4684514 - DNA, 13 bp, Homo sapiens
caactactaatag

SEQ ID NO: 4684515 - DNA, 21 bp, Homo sapiens
caactactaatagaataaagg

SEQ ID NO: 4684516 - DNA, 16 bp, Homo sapiens
caactgaggcagacag

SEQ ID NO: 4684517 - DNA, 21 bp, Homo sapiens
caactgaggcagacagcagct

SEQ ID NO: 4684518 - DNA, 14 bp, Homo sapiens
caagcacagccctt

SEQ ID NO: 4684519 - DNA, 15 bp, Homo sapiens
caaggaatttcttaa

SEQ ID NO: 4684520 - DNA, 16 bp, Homo sapiens
caaggaatttcttaac

SEQ ID NO: 4684521 - DNA, 15 bp, Homo sapiens
caaggcttagaccct

SEQ ID NO: 4684522 - DNA, 18 bp, Homo sapiens
caaggcttagaccctcat

SEQ ID NO: 4684523 - DNA, 19 bp, Homo sapiens
caaggcttagaccctcatg

SEQ ID NO: 4684524 - DNA, 14 bp, Homo sapiens
caaggtactctggt

SEQ ID NO: 4684525 - DNA, 13 bp, Homo sapiens
caatatcctaata

SEQ ID NO: 4684526 - DNA, 16 bp, Homo sapiens
caatatcctaataaaa

SEQ ID NO: 4684527 - DNA, 22 bp, Homo sapiens
caatatcctaataaaaaggtga

SEQ ID NO: 4684528 - DNA, 21 bp, Homo sapiens
cacacacaggcaactgaggca

SEQ ID NO: 4684529 - DNA, 13 bp, Homo sapiens
cacacaggcaact

SEQ ID NO: 4684530 - DNA, 18 bp, Homo sapiens
cacaggcaactgaggcag

SEQ ID NO: 4684531 - DNA, 19 bp, Homo sapiens
cacaggcaactgaggcaga

SEQ ID NO: 4684532 - DNA, 17 bp, Homo sapiens
caccaggagtccctggt

SEQ ID NO: 4684533 - DNA, 17 bp, Homo sapiens
caccaggcgctaattca

SEQ ID NO: 4684534 - DNA, 20 bp, Homo sapiens
caccctcagatgcacatgag

SEQ ID NO: 4684535 - DNA, 21 bp, Homo sapiens
caccgttggggattggggaag

SEQ ID NO: 4684536 - DNA, 13 bp, Homo sapiens
caccttgcagctc

SEQ ID NO: 4684537 - DNA, 22 bp, Homo sapiens
caccttgcagctctccccttct

SEQ ID NO: 4684538 - DNA, 15 bp, Homo sapiens
cacgcacactgtctg

SEQ ID NO: 4684539 - DNA, 21 bp, Homo sapiens
cactgggggaggggacattga

SEQ ID NO: 4684540 - DNA, 19 bp, Homo sapiens
cactggggtcctggggcct

SEQ ID NO: 4684541 - DNA, 20 bp, Homo sapiens
cactggggtcctggggcctc

SEQ ID NO: 4684542 - DNA, 21 bp, Homo sapiens
cactgtagcattacagtgggt

SEQ ID NO: 4684543 - DNA, 20 bp, Homo sapiens
cacttggtctgtgagatgct

SEQ ID NO: 4684544 - DNA, 17 bp, Homo sapiens
cagaacagccgctcctg

SEQ ID NO: 4684545 - DNA, 16 bp, Homo sapiens
cagaagtcatcttgct

SEQ ID NO: 4684546 - DNA, 20 bp, Homo sapiens
cagaagtcatcttgctacca

SEQ ID NO: 4684547 - DNA, 23 bp, Homo sapiens
cagaatcgctccaccttgcagct

SEQ ID NO: 4684548 - DNA, 13 bp, Homo sapiens
cagaattctgcta

SEQ ID NO: 4684549 - DNA, 16 bp, Homo sapiens
cagacagcagctcagg

SEQ ID NO: 4684550 - DNA, 14 bp, Homo sapiens
cagactagatgtag

SEQ ID NO: 4684551 - DNA, 19 bp, Homo sapiens
cagactagatgtagtattt

SEQ ID NO: 4684552 - DNA, 20 bp, Homo sapiens
cagagactcagggccccagc

SEQ ID NO: 4684553 - DNA, 12 bp, Homo sapiens
cagagttacagt

SEQ ID NO: 4684554 - DNA, 17 bp, Homo sapiens
cagagttacagttctgt

SEQ ID NO: 4684555 - DNA, 18 bp, Homo sapiens
cagagttacagttctgtg

SEQ ID NO: 4684556 - DNA, 15 bp, Homo sapiens
cagattcatttttct

SEQ ID NO: 4684557 - DNA, 23 bp, Homo sapiens
cagattttgttggcatagctctg

SEQ ID NO: 4684558 - DNA, 17 bp, Homo sapiens
cagcactaaagcagtgg

SEQ ID NO: 4684559 - DNA, 16 bp, Homo sapiens
cagcagctcaggcaca

SEQ ID NO: 4684560 - DNA, 19 bp, Homo sapiens
cagccagcagccagctctc

SEQ ID NO: 4684561 - DNA, 12 bp, Homo sapiens
cagccagctctc

SEQ ID NO: 4684562 - DNA, 18 bp, Homo sapiens
cagccagctctcagccaa

SEQ ID NO: 4684563 - DNA, 12 bp, Homo sapiens
cagccgctcctg

SEQ ID NO: 4684564 - DNA, 14 bp, Homo sapiens
cagccgctcctgtc

SEQ ID NO: 4684565 - DNA, 17 bp, Homo sapiens
cagccgctcctgtctgc

SEQ ID NO: 4684566 - DNA, 19 bp, Homo sapiens
cagccgctcctgtctgcca

SEQ ID NO: 4684567 - DNA, 20 bp, Homo sapiens
cagccgctcctgtctgccag

SEQ ID NO: 4684568 - DNA, 17 bp, Homo sapiens
cagcctggtgggcctcc

SEQ ID NO: 4684569 - DNA, 18 bp, Homo sapiens
cagcctggtgggcctcct

SEQ ID NO: 4684570 - DNA, 23 bp, Homo sapiens
cagcctggtgggcctcctctgtc

SEQ ID NO: 4684571 - DNA, 23 bp, Homo sapiens
cagccttccccttgcccagggct

SEQ ID NO: 4684572 - DNA, 21 bp, Homo sapiens
cagctcaggcacacttcttct

SEQ ID NO: 4684573 - DNA, 12 bp, Homo sapiens
cagctctcagcc

SEQ ID NO: 4684574 - DNA, 20 bp, Homo sapiens
cagctgcaaggtactctggt

SEQ ID NO: 4684575 - DNA, 19 bp, Homo sapiens
cagctgtggcagagttaca

SEQ ID NO: 4684576 - DNA, 23 bp, Homo sapiens
cagctgtggcagagttacagttc

SEQ ID NO: 4684577 - DNA, 15 bp, Homo sapiens
caggagtccctggta

SEQ ID NO: 4684578 - DNA, 19 bp, Homo sapiens
caggcaactgaggcagaca

SEQ ID NO: 4684579 - DNA, 20 bp, Homo sapiens
caggcaactgaggcagacag

SEQ ID NO: 4684580 - DNA, 23 bp, Homo sapiens
aattaggctgtaactactttata

SEQ ID NO: 4684581 - DNA, 16 bp, Homo sapiens
aattcaaggaatttct

SEQ ID NO: 4684582 - DNA, 21 bp, Homo sapiens
aattcccgttttgtcactttt

SEQ ID NO: 4684583 - DNA, 13 bp, Homo sapiens
aattccttagctt

SEQ ID NO: 4684584 - DNA, 23 bp, Homo sapiens
aattccttagcttagacctcagc

SEQ ID NO: 4684585 - DNA, 14 bp, Homo sapiens
aatttacctaagat

SEQ ID NO: 4684586 - DNA, 20 bp, Homo sapiens
aattttgaagtgctgtttat

SEQ ID NO: 4684587 - DNA, 14 bp, Homo sapiens
acaaatcagaagtc

SEQ ID NO: 4684588 - DNA, 14 bp, Homo sapiens
acacaccaggcgct

SEQ ID NO: 4684589 - DNA, 17 bp, Homo sapiens
acacaccaggcgctaat

SEQ ID NO: 4684590 - DNA, 15 bp, Homo sapiens
acacaggcaactgag

SEQ ID NO: 4684591 - DNA, 18 bp, Homo sapiens
acacatgctgaacatcac

SEQ ID NO: 4684592 - DNA, 23 bp, Homo sapiens
acacccctcccctgccctagagc

SEQ ID NO: 4684593 - DNA, 14 bp, Homo sapiens
acactgctctaaca

SEQ ID NO: 4684594 - DNA, 20 bp, Homo sapiens
acactgctctaacagccctc

SEQ ID NO: 4684595 - DNA, 17 bp, Homo sapiens
acagaattctgctacct

SEQ ID NO: 4684596 - DNA, 15 bp, Homo sapiens
acagcagctcaggca

SEQ ID NO: 4684597 - DNA, 17 bp, Homo sapiens
acagcagctcaggcaca

SEQ ID NO: 4684598 - DNA, 22 bp, Homo sapiens
acagcccttatgcggttaattt

SEQ ID NO: 4684599 - DNA, 18 bp, Homo sapiens
acagccgctcctgtctgc

SEQ ID NO: 4684600 - DNA, 20 bp, Homo sapiens
acagccgctcctgtctgcca

SEQ ID NO: 4684601 - DNA, 19 bp, Homo sapiens
acaggcaactgaggcagac

SEQ ID NO: 4684602 - DNA, 12 bp, Homo sapiens
acagggacccac

SEQ ID NO: 4684603 - DNA, 21 bp, Homo sapiens
acagggaggacgctctctggc

SEQ ID NO: 4684604 - DNA, 21 bp, Homo sapiens
acagtgctcttttctcctcac

SEQ ID NO: 4684605 - DNA, 14 bp, Homo sapiens
acagttggtaactt

SEQ ID NO: 4684606 - DNA, 15 bp, Homo sapiens
acagttggtaacttt

SEQ ID NO: 4684607 - DNA, 16 bp, Homo sapiens
acagttggtaactttt

SEQ ID NO: 4684608 - DNA, 15 bp, Homo sapiens
acatgtccctacacc

SEQ ID NO: 4684609 - DNA, 16 bp, Homo sapiens
accagttaatttttcc

SEQ ID NO: 4684610 - DNA, 21 bp, Homo sapiens
accagttctcatgggtggcac

SEQ ID NO: 4684611 - DNA, 19 bp, Homo sapiens
accccatggagctgggcta

SEQ ID NO: 4684612 - DNA, 20 bp, Homo sapiens
accctcagatgcacatgagc

SEQ ID NO: 4684613 - DNA, 20 bp, Homo sapiens
acctcagccttccccttgcc

SEQ ID NO: 4684614 - DNA, 22 bp, Homo sapiens
attaggctgtaactactttata

SEQ ID NO: 4684615 - DNA, 23 bp, Homo sapiens
attaggctgtaactactttataa

SEQ ID NO: 4684616 - DNA, 22 bp, Homo sapiens
attagtgccacttaatgtatgt

SEQ ID NO: 4684617 - DNA, 16 bp, Homo sapiens
attcaaggaatttctt

SEQ ID NO: 4684618 - DNA, 19 bp, Homo sapiens
attcaaggaatttcttaac

SEQ ID NO: 4684619 - DNA, 20 bp, Homo sapiens
attcaaggaatttcttaact

SEQ ID NO: 4684620 - DNA, 21 bp, Homo sapiens
attcccgttttgtcacttttt

SEQ ID NO: 4684621 - DNA, 24 bp, Homo sapiens
attcctagaaactgacacatgctg

SEQ ID NO: 4684622 - DNA, 18 bp, Homo sapiens
attgactatcaaactgaa

SEQ ID NO: 4684623 - DNA, 15 bp, Homo sapiens
attggatttcctaat

SEQ ID NO: 4684624 - DNA, 23 bp, Homo sapiens
attggatttcctaatactgtcat

SEQ ID NO: 4684625 - DNA, 14 bp, Homo sapiens
atttacctaagatt

SEQ ID NO: 4684626 - DNA, 15 bp, Homo sapiens
atttacctaagatta

SEQ ID NO: 4684627 - DNA, 12 bp, Homo sapiens
atttagaagcca

SEQ ID NO: 4684628 - DNA, 10 bp, Homo sapiens
atttatctat

SEQ ID NO: 4684629 - DNA, 15 bp, Homo sapiens
atttgcagagacagg

SEQ ID NO: 4684630 - DNA, 17 bp, Homo sapiens
atttggaaataaagtca

SEQ ID NO: 4684631 - DNA, 13 bp, Homo sapiens
attttttaaattc

SEQ ID NO: 4684632 - DNA, 16 bp, Homo sapiens
caaagaaagtgtattg

SEQ ID NO: 4684633 - DNA, 14 bp, Homo sapiens
caaatcagaagtca

SEQ ID NO: 4684634 - DNA, 22 bp, Homo sapiens
caaatcagaagtcatcttgcta

SEQ ID NO: 4684635 - DNA, 13 bp, Homo sapiens
caactgaggcaga

SEQ ID NO: 4684636 - DNA, 14 bp, Homo sapiens
caactgaggcagac

SEQ ID NO: 4684637 - DNA, 17 bp, Homo sapiens
caactgaggcagacagc

SEQ ID NO: 4684638 - DNA, 18 bp, Homo sapiens
caaggaatttcttaactt

SEQ ID NO: 4684639 - DNA, 21 bp, Homo sapiens
caaggaatttcttaacttctt

SEQ ID NO: 4684640 - DNA, 14 bp, Homo sapiens
caaggcttagaccc

SEQ ID NO: 4684641 - DNA, 22 bp, Homo sapiens
caaggcttagaccctcatgctg

SEQ ID NO: 4684642 - DNA, 20 bp, Homo sapiens
caagggttcagagactcagg

SEQ ID NO: 4684643 - DNA, 16 bp, Homo sapiens
caagttgtttcattga

SEQ ID NO: 4684644 - DNA, 18 bp, Homo sapiens
caatatcctaataaaaag

SEQ ID NO: 4684645 - DNA, 19 bp, Homo sapiens
caatatcctaataaaaagg

SEQ ID NO: 4684646 - DNA, 21 bp, Homo sapiens
caatatcctaataaaaaggtg

SEQ ID NO: 4684647 - DNA, 20 bp, Homo sapiens
cacacaggcaactgaggcag

SEQ ID NO: 4684648 - DNA, 17 bp, Homo sapiens
cacaggcaactgaggca

SEQ ID NO: 4684649 - DNA, 23 bp, Homo sapiens
cacaggcaactgaggcagacagc

SEQ ID NO: 4684650 - DNA, 15 bp, Homo sapiens
caccttgcagctctc

SEQ ID NO: 4684651 - DNA, 15 bp, Homo sapiens
cactgctctaacagc

SEQ ID NO: 4684652 - DNA, 19 bp, Homo sapiens
cacttcagggctttactcc

SEQ ID NO: 4684653 - DNA, 20 bp, Homo sapiens
cagaaataaagttggtgaca

SEQ ID NO: 4684654 - DNA, 20 bp, Homo sapiens
cagaacagccgctcctgtct

SEQ ID NO: 4684655 - DNA, 17 bp, Homo sapiens
cagaagtcaaggcttag

SEQ ID NO: 4684656 - DNA, 18 bp, Homo sapiens
cagaagtcaaggcttaga

SEQ ID NO: 4684657 - DNA, 14 bp, Homo sapiens
cagaattctgctac

SEQ ID NO: 4684658 - DNA, 15 bp, Homo sapiens
cagacagcagctcag

SEQ ID NO: 4684659 - DNA, 19 bp, Homo sapiens
cagacagcagctcaggcac

SEQ ID NO: 4684660 - DNA, 22 bp, Homo sapiens
cagacatgtggtgggacaggga

SEQ ID NO: 4684661 - DNA, 20 bp, Homo sapiens
cagactagatgtagtatttt

SEQ ID NO: 4684662 - DNA, 19 bp, Homo sapiens
cagagactcagggccccag

SEQ ID NO: 4684663 - DNA, 22 bp, Homo sapiens
cagagactcagggccccagcac

SEQ ID NO: 4684664 - DNA, 20 bp, Homo sapiens
cagagccccaccctcagatg

SEQ ID NO: 4684665 - DNA, 20 bp, Homo sapiens
cagaggagccaccagttctc

SEQ ID NO: 4684666 - DNA, 13 bp, Homo sapiens
cagcagccagctc

SEQ ID NO: 4684667 - DNA, 15 bp, Homo sapiens
cagcagccagctctc

SEQ ID NO: 4684668 - DNA, 20 bp, Homo sapiens
cagcagccagctctcagcca

SEQ ID NO: 4684669 - DNA, 13 bp, Homo sapiens
cagcagctcaggc

SEQ ID NO: 4684670 - DNA, 14 bp, Homo sapiens
cagcagctcaggca

SEQ ID NO: 4684671 - DNA, 12 bp, Homo sapiens
cagccagcagcc

SEQ ID NO: 4684672 - DNA, 17 bp, Homo sapiens
cagccagcagccagctc

SEQ ID NO: 4684673 - DNA, 21 bp, Homo sapiens
cagccagctctcagccaacga

SEQ ID NO: 4684674 - DNA, 17 bp, Homo sapiens
cagccctcctctgcact

SEQ ID NO: 4684675 - DNA, 16 bp, Homo sapiens
cagccgctcctgtctg

SEQ ID NO: 4684676 - DNA, 18 bp, Homo sapiens
cagccgctcctgtctgcc

SEQ ID NO: 4684677 - DNA, 21 bp, Homo sapiens
cagccgctcctgtctgccagc

SEQ ID NO: 4684678 - DNA, 22 bp, Homo sapiens
cagccgctcctgtctgccagcc

SEQ ID NO: 4684679 - DNA, 23 bp, Homo sapiens
cagccgctcctgtctgccagcca

SEQ ID NO: 4684680 - DNA, 19 bp, Homo sapiens
cagcctagccgacctcagc

SEQ ID NO: 4684681 - DNA, 16 bp, Homo sapiens
cagcctggtgggcctc

SEQ ID NO: 4684682 - DNA, 18 bp, Homo sapiens
cagctgactaaacttttt

SEQ ID NO: 4684683 - DNA, 13 bp, Homo sapiens
caggaagctgtga

SEQ ID NO: 4684684 - DNA, 14 bp, Homo sapiens
caggagtccctggt

SEQ ID NO: 4684685 - DNA, 13 bp, Homo sapiens
caggagtttggcc

SEQ ID NO: 4684686 - DNA, 14 bp, Homo sapiens
caggagtttggcca

SEQ ID NO: 4684687 - DNA, 15 bp, Homo sapiens
caggagtttggccag

SEQ ID NO: 4684688 - DNA, 15 bp, Homo sapiens
caggcgctaattcaa

SEQ ID NO: 4684689 - DNA, 17 bp, Homo sapiens
cagggaggacgctctct

SEQ ID NO: 4684690 - DNA, 18 bp, Homo sapiens
cagggaggacgctctctg

SEQ ID NO: 4684691 - DNA, 13 bp, Homo sapiens
cagggctcagcct

SEQ ID NO: 4684692 - DNA, 16 bp, Homo sapiens
cagggctcagcctggt

SEQ ID NO: 4684693 - DNA, 14 bp, Homo sapiens
cagggtcaggagag

SEQ ID NO: 4684694 - DNA, 23 bp, Homo sapiens
cagggtccttttgacactgctct

SEQ ID NO: 4684695 - DNA, 16 bp, Homo sapiens
caggttccctcccaga

SEQ ID NO: 4684696 - DNA, 18 bp, Homo sapiens
caggttccctcccagagg

SEQ ID NO: 4684697 - DNA, 12 bp, Homo sapiens
cagtgcttggcc

SEQ ID NO: 4684698 - DNA, 15 bp, Homo sapiens
cagtgcttggcccag

SEQ ID NO: 4684699 - DNA, 19 bp, Homo sapiens
cagtgcttggcccaggagt

SEQ ID NO: 4684700 - DNA, 14 bp, Homo sapiens
cagttaatttttcc

SEQ ID NO: 4684701 - DNA, 20 bp, Homo sapiens
cagttctgtggtttcatgtt

SEQ ID NO: 4684702 - DNA, 17 bp, Homo sapiens
cagttggtaacttttgt

SEQ ID NO: 4684703 - DNA, 23 bp, Homo sapiens
cataacctgtctcacctggactt

SEQ ID NO: 4684704 - DNA, 13 bp, Homo sapiens
catagctctgggg

SEQ ID NO: 4684705 - DNA, 20 bp, Homo sapiens
catagctctggggtgggcag

SEQ ID NO: 4684706 - DNA, 14 bp, Homo sapiens
catccgaggcaggg

SEQ ID NO: 4684707 - DNA, 15 bp, Homo sapiens
catccgaggcagggt

SEQ ID NO: 4684708 - DNA, 16 bp, Homo sapiens
catccgaggcagggtc

SEQ ID NO: 4684709 - DNA, 17 bp, Homo sapiens
catcttgctaccagtat

SEQ ID NO: 4684710 - DNA, 15 bp, Homo sapiens
catgctgccaatatc

SEQ ID NO: 4684711 - DNA, 23 bp, Homo sapiens
catgggacagggaggacgctctc

SEQ ID NO: 4684712 - DNA, 21 bp, Homo sapiens
catgtggtgggacagggaccc

SEQ ID NO: 4684713 - DNA, 22 bp, Homo sapiens
catgttagttaccttatagtta

SEQ ID NO: 4684714 - DNA, 17 bp, Homo sapiens
taattggatttcctaat

SEQ ID NO: 4684715 - DNA, 19 bp, Homo sapiens
tacaaatcagaagtcatct

SEQ ID NO: 4684716 - DNA, 18 bp, Homo sapiens
tacagaattctgctacct

SEQ ID NO: 4684717 - DNA, 21 bp, Homo sapiens
tacagaattctgctacctcac

SEQ ID NO: 4684718 - DNA, 19 bp, Homo sapiens
taccagtatttagaagcca

SEQ ID NO: 4684719 - DNA, 22 bp, Homo sapiens
taccccagactagatgtagtat

SEQ ID NO: 4684720 - DNA, 17 bp, Homo sapiens
taccttatagttactgt

SEQ ID NO: 4684721 - DNA, 23 bp, Homo sapiens
tactgggaaagggattttcagcc

SEQ ID NO: 4684722 - DNA, 13 bp, Homo sapiens
tactgtgtaatta

SEQ ID NO: 4684723 - DNA, 14 bp, Homo sapiens
tactgtgtaattag

SEQ ID NO: 4684724 - DNA, 19 bp, Homo sapiens
tactttataactaacatgt

SEQ ID NO: 4684725 - DNA, 20 bp, Homo sapiens
tactttataactaacatgtc

SEQ ID NO: 4684726 - DNA, 17 bp, Homo sapiens
tagaactccctttcaac

SEQ ID NO: 4684727 - DNA, 22 bp, Homo sapiens
tagaataaaggcagttttctaa

SEQ ID NO: 4684728 - DNA, 18 bp, Homo sapiens
tagaccctcatgctgcca

SEQ ID NO: 4684729 - DNA, 12 bp, Homo sapiens
tagacctcagcc

SEQ ID NO: 4684730 - DNA, 15 bp, Homo sapiens
tagacctcagcctgt

SEQ ID NO: 4684731 - DNA, 16 bp, Homo sapiens
tagacctcagcctgtg

SEQ ID NO: 4684732 - DNA, 20 bp, Homo sapiens
tagacctcagcctgtgctgc

SEQ ID NO: 4684733 - DNA, 16 bp, Homo sapiens
tagccgacctcagcct

SEQ ID NO: 4684734 - DNA, 11 bp, Homo sapiens
tagctctgggg

SEQ ID NO: 4684735 - DNA, 23 bp, Homo sapiens
tagctctggggtgggcagttttt

SEQ ID NO: 4684736 - DNA, 18 bp, Homo sapiens
tagcttagacctcagcct

SEQ ID NO: 4684737 - DNA, 20 bp, Homo sapiens
tagcttagacctcagcctgt

SEQ ID NO: 4684738 - DNA, 23 bp, Homo sapiens
tagcttagacctcagcctgtgct

SEQ ID NO: 4684739 - DNA, 13 bp, Homo sapiens
taggccatgggac

SEQ ID NO: 4684740 - DNA, 16 bp, Homo sapiens
taggcgggaaggaggg

SEQ ID NO: 4684741 - DNA, 21 bp, Homo sapiens
taggctgtaactactttataa

SEQ ID NO: 4684742 - DNA, 18 bp, Homo sapiens
tagtattttttgtataat

SEQ ID NO: 4684743 - DNA, 22 bp, Homo sapiens
tagtgccacttaatgtatgtta

SEQ ID NO: 4684744 - DNA, 15 bp, Homo sapiens
tagtgtatgattact

SEQ ID NO: 4684745 - DNA, 12 bp, Homo sapiens
tagttaccttat

SEQ ID NO: 4684746 - DNA, 17 bp, Homo sapiens
tagttaccttatagtta

SEQ ID NO: 4684747 - DNA, 21 bp, Homo sapiens
tagttaccttatagttactgt

SEQ ID NO: 4684748 - DNA, 22 bp, Homo sapiens
tataattggatttcctaatact

SEQ ID NO: 4684749 - DNA, 13 bp, Homo sapiens
tatagttactgtg

SEQ ID NO: 4684750 - DNA, 12 bp, Homo sapiens
tatcctaataaa

SEQ ID NO: 4684751 - DNA, 19 bp, Homo sapiens
tatcctaataaaaaggtga

SEQ ID NO: 4684752 - DNA, 15 bp, Homo sapiens
tatctgtcagctgca

SEQ ID NO: 4684753 - DNA, 12 bp, Homo sapiens
tatgattattaa

SEQ ID NO: 4684754 - DNA, 13 bp, Homo sapiens
tatgcggttaatt

SEQ ID NO: 4684755 - DNA, 18 bp, Homo sapiens
tattaatcttagtgtatg

SEQ ID NO: 4684756 - DNA, 13 bp, Homo sapiens
tattatctgtcag

SEQ ID NO: 4684757 - DNA, 17 bp, Homo sapiens
tattgtgtgttatttaa

SEQ ID NO: 4684758 - DNA, 19 bp, Homo sapiens
tattgtgtgttatttaaat

SEQ ID NO: 4684759 - DNA, 22 bp, Homo sapiens
tattgtttttccttgtatttaa

SEQ ID NO: 4684760 - DNA, 22 bp, Homo sapiens
tatttaaatattaaatatgtta

SEQ ID NO: 4684761 - DNA, 17 bp, Homo sapiens
tatttggaaataaagtc

SEQ ID NO: 4684762 - DNA, 16 bp, Homo sapiens
tcaaactgaagccaga

SEQ ID NO: 4684763 - DNA, 15 bp, Homo sapiens
tcaaagaaagtgtat

SEQ ID NO: 4684764 - DNA, 16 bp, Homo sapiens
tcaaagaaagtgtatt

SEQ ID NO: 4684765 - DNA, 19 bp, Homo sapiens
tcaaggaatttcttaactt

SEQ ID NO: 4684766 - DNA, 21 bp, Homo sapiens
tcaaggaatttcttaacttct

SEQ ID NO: 4684767 - DNA, 20 bp, Homo sapiens
tcacagtgctcttttctcct

SEQ ID NO: 4684768 - DNA, 20 bp, Homo sapiens
tcactggggtcctggggcct

SEQ ID NO: 4684769 - DNA, 14 bp, Homo sapiens
tcactttttctgat

SEQ ID NO: 4684770 - DNA, 17 bp, Homo sapiens
tcactttttctgataaa

SEQ ID NO: 4684771 - DNA, 20 bp, Homo sapiens
acacaggcaactgaggcaga

SEQ ID NO: 4684772 - DNA, 21 bp, Homo sapiens
acacaggcaactgaggcagac

SEQ ID NO: 4684773 - DNA, 17 bp, Homo sapiens
acaccaggagtccctgg

SEQ ID NO: 4684774 - DNA, 19 bp, Homo sapiens
acactgctctaacagccct

SEQ ID NO: 4684775 - DNA, 15 bp, Homo sapiens
acactgggggagggg

SEQ ID NO: 4684776 - DNA, 15 bp, Homo sapiens
acagaattctgctac

SEQ ID NO: 4684777 - DNA, 16 bp, Homo sapiens
acagcagctcaggcac

SEQ ID NO: 4684778 - DNA, 14 bp, Homo sapiens
acagccgctcctgt

SEQ ID NO: 4684779 - DNA, 19 bp, Homo sapiens
acagccgctcctgtctgcc

SEQ ID NO: 4684780 - DNA, 23 bp, Homo sapiens
acagccgctcctgtctgccagcc

SEQ ID NO: 4684781 - DNA, 18 bp, Homo sapiens
acaggcaactgaggcaga

SEQ ID NO: 4684782 - DNA, 23 bp, Homo sapiens
acatgtcctgcctattatctgtc

SEQ ID NO: 4684783 - DNA, 21 bp, Homo sapiens
accagggtccttttgacactg

SEQ ID NO: 4684784 - DNA, 19 bp, Homo sapiens
accagtatttagaagccaa

SEQ ID NO: 4684785 - DNA, 12 bp, Homo sapiens
accagttaattt

SEQ ID NO: 4684786 - DNA, 16 bp, Homo sapiens
accagttctcatgggt

SEQ ID NO: 4684787 - DNA, 19 bp, Homo sapiens
acccagtgttttaggagca

SEQ ID NO: 4684788 - DNA, 22 bp, Homo sapiens
accctcatgctgccaatatcct

SEQ ID NO: 4684789 - DNA, 21 bp, Homo sapiens
acctcactggggtcctggggc

SEQ ID NO: 4684790 - DNA, 23 bp, Homo sapiens
acctcactggggtcctggggcct

SEQ ID NO: 4684791 - DNA, 16 bp, Homo sapiens
acctcagcctgtgctg

SEQ ID NO: 4684792 - DNA, 17 bp, Homo sapiens
acctcagcctgtgctgc

SEQ ID NO: 4684793 - DNA, 19 bp, Homo sapiens
acctcagcctgtgctgccc

SEQ ID NO: 4684794 - DNA, 22 bp, Homo sapiens
acctggacttaagcatctggct

SEQ ID NO: 4684795 - DNA, 18 bp, Homo sapiens
acctgtctcacctggact

SEQ ID NO: 4684796 - DNA, 18 bp, Homo sapiens
accttgaacactggggga

SEQ ID NO: 4684797 - DNA, 22 bp, Homo sapiens
accttgctgcaagcacagccct

SEQ ID NO: 4684798 - DNA, 14 bp, Homo sapiens
acgcacactgtctg

SEQ ID NO: 4684799 - DNA, 14 bp, Homo sapiens
acgctctctggcct

SEQ ID NO: 4684800 - DNA, 16 bp, Homo sapiens
acgctctctggccttc

SEQ ID NO: 4684801 - DNA, 17 bp, Homo sapiens
actaatagaataaaggc

SEQ ID NO: 4684802 - DNA, 13 bp, Homo sapiens
actagatgtagta

SEQ ID NO: 4684803 - DNA, 15 bp, Homo sapiens
actatgattattaac

SEQ ID NO: 4684804 - DNA, 18 bp, Homo sapiens
actattgaagttgcagat

SEQ ID NO: 4684805 - DNA, 22 bp, Homo sapiens
actcagggccccagcactaaag

SEQ ID NO: 4684806 - DNA, 19 bp, Homo sapiens
actcagtctctcttctctc

SEQ ID NO: 4684807 - DNA, 23 bp, Homo sapiens
actcagtctctcttctctccagc

SEQ ID NO: 4684808 - DNA, 13 bp, Homo sapiens
actccctttcaac

SEQ ID NO: 4684809 - DNA, 19 bp, Homo sapiens
actccgtaacagattttgt

SEQ ID NO: 4684810 - DNA, 20 bp, Homo sapiens
actctggtgagtcaccactt

SEQ ID NO: 4684811 - DNA, 20 bp, Homo sapiens
actggggtcctggggcctcg

SEQ ID NO: 4684812 - DNA, 12 bp, Homo sapiens
actgtggctgct

SEQ ID NO: 4684813 - DNA, 19 bp, Homo sapiens
acttcttgcttctttctag

SEQ ID NO: 4684814 - DNA, 15 bp, Homo sapiens
acttggtctgtgaga

SEQ ID NO: 4684815 - DNA, 22 bp, Homo sapiens
acttttgtgaattaggctgtaa

SEQ ID NO: 4684816 - DNA, 19 bp, Homo sapiens
agaaacagttggtaacttt

SEQ ID NO: 4684817 - DNA, 22 bp, Homo sapiens
agaaacagttggtaacttttgt

SEQ ID NO: 4684818 - DNA, 11 bp, Homo sapiens
agaaagtgtat

SEQ ID NO: 4684819 - DNA, 13 bp, Homo sapiens
agaaagtgtattt

SEQ ID NO: 4684820 - DNA, 18 bp, Homo sapiens
agaacagccgctcctgtc

SEQ ID NO: 4684821 - DNA, 22 bp, Homo sapiens
agaacagccgctcctgtctgcc

SEQ ID NO: 4684822 - DNA, 17 bp, Homo sapiens
agaactccctttcaaca

SEQ ID NO: 4684823 - DNA, 16 bp, Homo sapiens
agaagtcaaggcttag

SEQ ID NO: 4684824 - DNA, 13 bp, Homo sapiens
agaataaaggcag

SEQ ID NO: 4684825 - DNA, 18 bp, Homo sapiens
agaataaaggcagttttc

SEQ ID NO: 4684826 - DNA, 20 bp, Homo sapiens
agaattctgctacctcactg

SEQ ID NO: 4684827 - DNA, 22 bp, Homo sapiens
agaattctgctacctcactggg

SEQ ID NO: 4684828 - DNA, 13 bp, Homo sapiens
agacactttggaa

SEQ ID NO: 4684829 - DNA, 14 bp, Homo sapiens
agacagcagctcag

SEQ ID NO: 4684830 - DNA, 12 bp, Homo sapiens
agacctcagcct

SEQ ID NO: 4684831 - DNA, 13 bp, Homo sapiens
agacctcagcctg

SEQ ID NO: 4684832 - DNA, 16 bp, Homo sapiens
agacctcagcctgtgc

SEQ ID NO: 4684833 - DNA, 19 bp, Homo sapiens
agacctcagcctgtgctgc

SEQ ID NO: 4684834 - DNA, 21 bp, Homo sapiens
agacgtgcacgcacactgtct

SEQ ID NO: 4684835 - DNA, 22 bp, Homo sapiens
agacgtgcacgcacactgtctg

SEQ ID NO: 4684836 - DNA, 12 bp, Homo sapiens
agactagatgta

SEQ ID NO: 4684837 - DNA, 19 bp, Homo sapiens
agactagatgtagtatttt

SEQ ID NO: 4684838 - DNA, 17 bp, Homo sapiens
agactcagggccccagc

SEQ ID NO: 4684839 - DNA, 20 bp, Homo sapiens
agactcagggccccagcact

SEQ ID NO: 4684840 - DNA, 21 bp, Homo sapiens
agactggatagtccgtctctg

SEQ ID NO: 4684841 - DNA, 11 bp, Homo sapiens
agactgtggct

SEQ ID NO: 4684842 - DNA, 16 bp, Homo sapiens
agagaaacagttggta

SEQ ID NO: 4684843 - DNA, 20 bp, Homo sapiens
agagttaatatatagaaggg

SEQ ID NO: 4684844 - DNA, 22 bp, Homo sapiens
agagttacagttctgtggtttc

SEQ ID NO: 4684845 - DNA, 15 bp, Homo sapiens
agatgctagaactcc

SEQ ID NO: 4684846 - DNA, 22 bp, Homo sapiens
agatgctagaactccctttcaa

SEQ ID NO: 4684847 - DNA, 18 bp, Homo sapiens
agatggaaaattcatttt

SEQ ID NO: 4684848 - DNA, 20 bp, Homo sapiens
agattacaaatcagaagtca

SEQ ID NO: 4684849 - DNA, 12 bp, Homo sapiens
agattcattttt

SEQ ID NO: 4684850 - DNA, 12 bp, Homo sapiens
agcacagccctt

SEQ ID NO: 4684851 - DNA, 13 bp, Homo sapiens
agcactaaagcag

SEQ ID NO: 4684852 - DNA, 23 bp, Homo sapiens
agcactaaagcagtggacaccag

SEQ ID NO: 4684853 - DNA, 13 bp, Homo sapiens
agcagccagctct

SEQ ID NO: 4684854 - DNA, 14 bp, Homo sapiens
agcagccagctctc

SEQ ID NO: 4684855 - DNA, 13 bp, Homo sapiens
agcatctggctct

SEQ ID NO: 4684856 - DNA, 12 bp, Homo sapiens
agcatgaagaca

SEQ ID NO: 4684857 - DNA, 11 bp, Homo sapiens
agccagcagcc

SEQ ID NO: 4684858 - DNA, 16 bp, Homo sapiens
agccagcagccagctc

SEQ ID NO: 4684859 - DNA, 20 bp, Homo sapiens
agccagcagccagctctcag

SEQ ID NO: 4684860 - DNA, 13 bp, Homo sapiens
agccgacctcagc

SEQ ID NO: 4684861 - DNA, 15 bp, Homo sapiens
agccgacctcagcct

SEQ ID NO: 4684862 - DNA, 22 bp, Homo sapiens
agccgctcctgtctgccagcca

SEQ ID NO: 4684863 - DNA, 17 bp, Homo sapiens
agcctcatccgaggcag

SEQ ID NO: 4684864 - DNA, 18 bp, Homo sapiens
agcctcatccgaggcagg

SEQ ID NO: 4684865 - DNA, 20 bp, Homo sapiens
agcctcatccgaggcagggt

SEQ ID NO: 4684866 - DNA, 16 bp, Homo sapiens
agcctggtgggcctcc

SEQ ID NO: 4684867 - DNA, 14 bp, Homo sapiens
agctcggtggaccc

SEQ ID NO: 4684868 - DNA, 16 bp, Homo sapiens
agctcggtggacccag

SEQ ID NO: 4684869 - DNA, 19 bp, Homo sapiens
agctcggtggacccaggga

SEQ ID NO: 4684870 - DNA, 19 bp, Homo sapiens
agctctggggtgggcagtt

SEQ ID NO: 4684871 - DNA, 13 bp, Homo sapiens
cagtggacaccag

SEQ ID NO: 4684872 - DNA, 22 bp, Homo sapiens
cagtggacaccaggagtccctg

SEQ ID NO: 4684873 - DNA, 13 bp, Homo sapiens
cagtgggtgcccc

SEQ ID NO: 4684874 - DNA, 12 bp, Homo sapiens
cagttaattttt

SEQ ID NO: 4684875 - DNA, 19 bp, Homo sapiens
cagttaatttttccaacta

SEQ ID NO: 4684876 - DNA, 12 bp, Homo sapiens
catagctctggg

SEQ ID NO: 4684877 - DNA, 21 bp, Homo sapiens
catcattatttgcagagacag

SEQ ID NO: 4684878 - DNA, 14 bp, Homo sapiens
catcctcaaagaaa

SEQ ID NO: 4684879 - DNA, 18 bp, Homo sapiens
catcctgaggctccactt

SEQ ID NO: 4684880 - DNA, 19 bp, Homo sapiens
catcctgaggctccacttg

SEQ ID NO: 4684881 - DNA, 14 bp, Homo sapiens
catctggctctaat

SEQ ID NO: 4684882 - DNA, 17 bp, Homo sapiens
catgtccctacacccct

SEQ ID NO: 4684883 - DNA, 13 bp, Homo sapiens
catgtcctgccta

SEQ ID NO: 4684884 - DNA, 22 bp, Homo sapiens
catgtcctgcctattatctgtc

SEQ ID NO: 4684885 - DNA, 19 bp, Homo sapiens
cattgactatcaaactgaa

SEQ ID NO: 4684886 - DNA, 22 bp, Homo sapiens
ccaacccgtctggcccaccagg

SEQ ID NO: 4684887 - DNA, 14 bp, Homo sapiens
ccaactatgattat

SEQ ID NO: 4684888 - DNA, 15 bp, Homo sapiens
ccaatatcctaataa

SEQ ID NO: 4684889 - DNA, 16 bp, Homo sapiens
ccacctgacacaccag

SEQ ID NO: 4684890 - DNA, 23 bp, Homo sapiens
ccacctgacacaccaggcgctaa

SEQ ID NO: 4684891 - DNA, 17 bp, Homo sapiens
ccacttaatgtatgtta

SEQ ID NO: 4684892 - DNA, 20 bp, Homo sapiens
ccacttaatgtatgttacca

SEQ ID NO: 4684893 - DNA, 12 bp, Homo sapiens
ccacttggtctg

SEQ ID NO: 4684894 - DNA, 15 bp, Homo sapiens
ccacttggtctgtga

SEQ ID NO: 4684895 - DNA, 23 bp, Homo sapiens
ccagaaataaagttggtgacaga

SEQ ID NO: 4684896 - DNA, 16 bp, Homo sapiens
ccagaggagccaccag

SEQ ID NO: 4684897 - DNA, 16 bp, Homo sapiens
ccagcagccagctctc

SEQ ID NO: 4684898 - DNA, 18 bp, Homo sapiens
ccagcagccagctctcag

SEQ ID NO: 4684899 - DNA, 15 bp, Homo sapiens
ccagccagcagccag

SEQ ID NO: 4684900 - DNA, 23 bp, Homo sapiens
ccagccagcagccagctctcagc

SEQ ID NO: 4684901 - DNA, 16 bp, Homo sapiens
ccaggcgctaattcaa

SEQ ID NO: 4684902 - DNA, 11 bp, Homo sapiens
ccagggctcag

SEQ ID NO: 4684903 - DNA, 13 bp, Homo sapiens
cccaccagggtcc

SEQ ID NO: 4684904 - DNA, 23 bp, Homo sapiens
cccagactagatgtagtattttt

SEQ ID NO: 4684905 - DNA, 20 bp, Homo sapiens
cccagaggagccaccagttc

SEQ ID NO: 4684906 - DNA, 17 bp, Homo sapiens
cccagcactaaagcagt

SEQ ID NO: 4684907 - DNA, 15 bp, Homo sapiens
ccccagactagatgt

SEQ ID NO: 4684908 - DNA, 18 bp, Homo sapiens
ccccagactagatgtagt

SEQ ID NO: 4684909 - DNA, 19 bp, Homo sapiens
ccccagcactaaagcagtg

SEQ ID NO: 4684910 - DNA, 18 bp, Homo sapiens
cccccttgccagacatgt

SEQ ID NO: 4684911 - DNA, 21 bp, Homo sapiens
ccccttgcccagggctcagcc

SEQ ID NO: 4684912 - DNA, 17 bp, Homo sapiens
cccgtctggcccaccag

SEQ ID NO: 4684913 - DNA, 12 bp, Homo sapiens
cccgtcttcagc

SEQ ID NO: 4684914 - DNA, 14 bp, Homo sapiens
cccgtcttcagcct

SEQ ID NO: 4684915 - DNA, 17 bp, Homo sapiens
cccgtcttcagcctagc

SEQ ID NO: 4684916 - DNA, 18 bp, Homo sapiens
ccctacacccctcccctg

SEQ ID NO: 4684917 - DNA, 17 bp, Homo sapiens
ccctcatgctgccaata

SEQ ID NO: 4684918 - DNA, 16 bp, Homo sapiens
ccctcccctgccctag

SEQ ID NO: 4684919 - DNA, 23 bp, Homo sapiens
ccctggtaataagtactgtgtac

SEQ ID NO: 4684920 - DNA, 19 bp, Homo sapiens
ccctgtctcctctctctgt

SEQ ID NO: 4684921 - DNA, 13 bp, Homo sapiens
cccttgccagaca

SEQ ID NO: 4684922 - DNA, 19 bp, Homo sapiens
cccttgcccagggctcagc

SEQ ID NO: 4684923 - DNA, 20 bp, Homo sapiens
cccttgcccagggctcagcc

SEQ ID NO: 4684924 - DNA, 22 bp, Homo sapiens
cccttgcccagggctcagcctg

SEQ ID NO: 4684925 - DNA, 14 bp, Homo sapiens
ccgaggcagggtca

SEQ ID NO: 4684926 - DNA, 16 bp, Homo sapiens
cctaataaaaaggtga

SEQ ID NO: 4684927 - DNA, 20 bp, Homo sapiens
cctaataaaaaggtgaccat

SEQ ID NO: 4684928 - DNA, 23 bp, Homo sapiens
cctcactggggtcctggggcctc

SEQ ID NO: 4684929 - DNA, 16 bp, Homo sapiens
cctcagcctgtgctgc

SEQ ID NO: 4684930 - DNA, 14 bp, Homo sapiens
cctcccctgcccta

SEQ ID NO: 4684931 - DNA, 16 bp, Homo sapiens
cctctgcactcccacc

SEQ ID NO: 4684932 - DNA, 14 bp, Homo sapiens
cctctgtccagggc

SEQ ID NO: 4684933 - DNA, 18 bp, Homo sapiens
cctctgtccagggccctg

SEQ ID NO: 4684934 - DNA, 14 bp, Homo sapiens
cctgacacaccagg

SEQ ID NO: 4684935 - DNA, 15 bp, Homo sapiens
cctgacacaccaggc

SEQ ID NO: 4684936 - DNA, 16 bp, Homo sapiens
cctgagctcggtggac

SEQ ID NO: 4684937 - DNA, 24 bp, Homo sapiens
cctggacttaagcatctggctcta

SEQ ID NO: 4684938 - DNA, 14 bp, Homo sapiens
cctggtgggcctcc

SEQ ID NO: 4684939 - DNA, 14 bp, Homo sapiens
cctgtctgccagcc

SEQ ID NO: 4684940 - DNA, 15 bp, Homo sapiens
cctgtctgccagcca

SEQ ID NO: 4684941 - DNA, 16 bp, Homo sapiens
cctgtctgccagccag

SEQ ID NO: 4684942 - DNA, 17 bp, Homo sapiens
cctgtctgccagccagc

SEQ ID NO: 4684943 - DNA, 23 bp, Homo sapiens
cctgtctgccagccagcagccag

SEQ ID NO: 4684944 - DNA, 14 bp, Homo sapiens
ccttcggcctccat

SEQ ID NO: 4684945 - DNA, 17 bp, Homo sapiens
ccttcggcctccatcct

SEQ ID NO: 4684946 - DNA, 19 bp, Homo sapiens
ccttcggcctccatcctga

SEQ ID NO: 4684947 - DNA, 20 bp, Homo sapiens
ccttcggcctccatcctgag

SEQ ID NO: 4684948 - DNA, 13 bp, Homo sapiens
ccttgaacactgg

SEQ ID NO: 4684949 - DNA, 13 bp, Homo sapiens
ccttgccagacat

SEQ ID NO: 4684950 - DNA, 16 bp, Homo sapiens
ccttgcccagggctca

SEQ ID NO: 4684951 - DNA, 13 bp, Homo sapiens
ccttgtatttaaa

SEQ ID NO: 4684952 - DNA, 16 bp, Homo sapiens
ccttgtatttaaatat

SEQ ID NO: 4684953 - DNA, 18 bp, Homo sapiens
ccttttgacactgctcta

SEQ ID NO: 4684954 - DNA, 14 bp, Homo sapiens
cgacctcagccttc

SEQ ID NO: 4684955 - DNA, 14 bp, Homo sapiens
cgctcctgtctgcc

SEQ ID NO: 4684956 - DNA, 16 bp, Homo sapiens
cgctcctgtctgccag

SEQ ID NO: 4684957 - DNA, 17 bp, Homo sapiens
cgctcctgtctgccagc

SEQ ID NO: 4684958 - DNA, 20 bp, Homo sapiens
cgctcctgtctgccagccag

SEQ ID NO: 4684959 - DNA, 21 bp, Homo sapiens
cgctcctgtctgccagccagc

SEQ ID NO: 4684960 - DNA, 15 bp, Homo sapiens
cgctctctggccttc

SEQ ID NO: 4684961 - DNA, 21 bp, Homo sapiens
cggagcctcatccgaggcagg

SEQ ID NO: 4684962 - DNA, 16 bp, Homo sapiens
cggcctccatcctgag

SEQ ID NO: 4684963 - DNA, 12 bp, Homo sapiens
cgggaaggaggg

SEQ ID NO: 4684964 - DNA, 15 bp, Homo sapiens
cgtggtgatttagca

SEQ ID NO: 4684965 - DNA, 20 bp, Homo sapiens
cgtgtgtgtgcgtcctgtcg

SEQ ID NO: 4684966 - DNA, 17 bp, Homo sapiens
ctaaactttttttctgt

SEQ ID NO: 4684967 - DNA, 18 bp, Homo sapiens
ctaaagcagtggacacca

SEQ ID NO: 4684968 - DNA, 22 bp, Homo sapiens
ctaacagccctcctctgcactc

SEQ ID NO: 4684969 - DNA, 21 bp, Homo sapiens
ctaagattacaaatcagaagt

SEQ ID NO: 4684970 - DNA, 21 bp, Homo sapiens
ctaatagaataaaggcagttt

SEQ ID NO: 4684971 - DNA, 12 bp, Homo sapiens
gtcggagccctg

SEQ ID NO: 4684972 - DNA, 19 bp, Homo sapiens
gtctctcttctctccagct

SEQ ID NO: 4684973 - DNA, 21 bp, Homo sapiens
gtctgtgagatgctagaactc

SEQ ID NO: 4684974 - DNA, 21 bp, Homo sapiens
gtgagatgctagaactccctt

SEQ ID NO: 4684975 - DNA, 18 bp, Homo sapiens
gtgcacgcacactgtctg

SEQ ID NO: 4684976 - DNA, 18 bp, Homo sapiens
gtgccacttaatgtatgt

SEQ ID NO: 4684977 - DNA, 21 bp, Homo sapiens
gtgctgcccgtcttcagccta

SEQ ID NO: 4684978 - DNA, 15 bp, Homo sapiens
gtgctgtttattaat

SEQ ID NO: 4684979 - DNA, 15 bp, Homo sapiens
gtggacaccaggagt

SEQ ID NO: 4684980 - DNA, 15 bp, Homo sapiens
gtggcagagttacag

SEQ ID NO: 4684981 - DNA, 17 bp, Homo sapiens
gtggctgctagcacttg

SEQ ID NO: 4684982 - DNA, 20 bp, Homo sapiens
gtgggcctcctctgtccagg

SEQ ID NO: 4684983 - DNA, 23 bp, Homo sapiens
gtgggcctcctctgtccagggcc

SEQ ID NO: 4684984 - DNA, 19 bp, Homo sapiens
gtgtatttggaaataaagt

SEQ ID NO: 4684985 - DNA, 14 bp, Homo sapiens
gtgtgcgtcctgtc

SEQ ID NO: 4684986 - DNA, 14 bp, Homo sapiens
gtgtgttatttaaa

SEQ ID NO: 4684987 - DNA, 17 bp, Homo sapiens
gtgttatttaaatgagt

SEQ ID NO: 4684988 - DNA, 14 bp, Homo sapiens
gttaatttttccaa

SEQ ID NO: 4684989 - DNA, 13 bp, Homo sapiens
gttacagttctgt

SEQ ID NO: 4684990 - DNA, 11 bp, Homo sapiens
gttagggaggg

SEQ ID NO: 4684991 - DNA, 17 bp, Homo sapiens
gttcagagactcagggc

SEQ ID NO: 4684992 - DNA, 19 bp, Homo sapiens
gttctcatgggtggcactc

SEQ ID NO: 4684993 - DNA, 18 bp, Homo sapiens
gttggcatagctctgggg

SEQ ID NO: 4684994 - DNA, 19 bp, Homo sapiens
gttggcatagctctggggt

SEQ ID NO: 4684995 - DNA, 20 bp, Homo sapiens
gtttattaatcttagtgtat

SEQ ID NO: 4684996 - DNA, 17 bp, Homo sapiens
gtttcatgttagttacc

SEQ ID NO: 4684997 - DNA, 23 bp, Homo sapiens
gtttggccagaagtcaaggctta

SEQ ID NO: 4684998 - DNA, 12 bp, Homo sapiens
taaactcatttc

SEQ ID NO: 4684999 - DNA, 17 bp, Homo sapiens
taaactcatttctagca

SEQ ID NO: 4685000 - DNA, 17 bp, Homo sapiens
taaagaaagtgtatttg

SEQ ID NO: 4685001 - DNA, 20 bp, Homo sapiens
taaatatatctaccccagac

SEQ ID NO: 4685002 - DNA, 17 bp, Homo sapiens
taacagccctcctctgc

SEQ ID NO: 4685003 - DNA, 22 bp, Homo sapiens
taacatgtcctgcctattatct

SEQ ID NO: 4685004 - DNA, 23 bp, Homo sapiens
taactactttataactaacatgt

SEQ ID NO: 4685005 - DNA, 20 bp, Homo sapiens
taacttcttgcttctttcta

SEQ ID NO: 4685006 - DNA, 12 bp, Homo sapiens
taacttttgtga

SEQ ID NO: 4685007 - DNA, 22 bp, Homo sapiens
taacttttgtgaattaggctgt

SEQ ID NO: 4685008 - DNA, 12 bp, Homo sapiens
taataaaaaggt

SEQ ID NO: 4685009 - DNA, 12 bp, Homo sapiens
taataaactcat

SEQ ID NO: 4685010 - DNA, 20 bp, Homo sapiens
taatagaataaaggcagttt

SEQ ID NO: 4685011 - DNA, 22 bp, Homo sapiens
taatagaataaaggcagttttc

SEQ ID NO: 4685012 - DNA, 16 bp, Homo sapiens
taatgtatgttaccaa

SEQ ID NO: 4685013 - DNA, 17 bp, Homo sapiens
taatgtatgttaccaaa

SEQ ID NO: 4685014 - DNA, 14 bp, Homo sapiens
taattagtgccact

SEQ ID NO: 4685015 - DNA, 21 bp, Homo sapiens
taattagtgccacttaatgta

SEQ ID NO: 4685016 - DNA, 22 bp, Homo sapiens
taattagtgccacttaatgtat

SEQ ID NO: 4685017 - DNA, 18 bp, Homo sapiens
taattcaaggaatttctt

SEQ ID NO: 4685018 - DNA, 20 bp, Homo sapiens
taattcaaggaatttcttaa

SEQ ID NO: 4685019 - DNA, 22 bp, Homo sapiens
taattcaaggaatttcttaact

SEQ ID NO: 4685020 - DNA, 14 bp, Homo sapiens
taattcacagtgct

SEQ ID NO: 4685021 - DNA, 23 bp, Homo sapiens
taattggatttcctaatactgtc

SEQ ID NO: 4685022 - DNA, 20 bp, Homo sapiens
taatttattgtttttccttg

SEQ ID NO: 4685023 - DNA, 15 bp, Homo sapiens
tacagttctgtggtt

SEQ ID NO: 4685024 - DNA, 20 bp, Homo sapiens
taccagtatttagaagccaa

SEQ ID NO: 4685025 - DNA, 21 bp, Homo sapiens
taccccagactagatgtagta

SEQ ID NO: 4685026 - DNA, 17 bp, Homo sapiens
tacctaagattacaaat

SEQ ID NO: 4685027 - DNA, 20 bp, Homo sapiens
tactaatagaataaaggcag

SEQ ID NO: 4685028 - DNA, 18 bp, Homo sapiens
tactggcctttttcattt

SEQ ID NO: 4685029 - DNA, 22 bp, Homo sapiens
tactgtgtacagaattctgcta

SEQ ID NO: 4685030 - DNA, 23 bp, Homo sapiens
tactgtgtacagaattctgctac

SEQ ID NO: 4685031 - DNA, 16 bp, Homo sapiens
tagaactccctttcaa

SEQ ID NO: 4685032 - DNA, 18 bp, Homo sapiens
tagaactccctttcaaca

SEQ ID NO: 4685033 - DNA, 21 bp, Homo sapiens
tagaataaaggcagttttcta

SEQ ID NO: 4685034 - DNA, 17 bp, Homo sapiens
tagaccctcatgctgcc

SEQ ID NO: 4685035 - DNA, 19 bp, Homo sapiens
tagaccctcatgctgccaa

SEQ ID NO: 4685036 - DNA, 11 bp, Homo sapiens
tagacctcagc

SEQ ID NO: 4685037 - DNA, 21 bp, Homo sapiens
tagacctcagcctgtgctgcc

SEQ ID NO: 4685038 - DNA, 22 bp, Homo sapiens
tagacctcagcctgtgctgccc

SEQ ID NO: 4685039 - DNA, 15 bp, Homo sapiens
tagatgtagtatttt

SEQ ID NO: 4685040 - DNA, 17 bp, Homo sapiens
tagatgtagtatttttt

SEQ ID NO: 4685041 - DNA, 16 bp, Homo sapiens
tagcatgaagacagag

SEQ ID NO: 4685042 - DNA, 15 bp, Homo sapiens
tagccgacctcagcc

SEQ ID NO: 4685043 - DNA, 12 bp, Homo sapiens
taggagcatgag

SEQ ID NO: 4685044 - DNA, 16 bp, Homo sapiens
taggccatgggacagg

SEQ ID NO: 4685045 - DNA, 19 bp, Homo sapiens
taggctgtaactactttat

SEQ ID NO: 4685046 - DNA, 19 bp, Homo sapiens
tagtgtatgattactggcc

SEQ ID NO: 4685047 - DNA, 19 bp, Homo sapiens
tagttactgtgtaattagt

SEQ ID NO: 4685048 - DNA, 17 bp, Homo sapiens
tataattggatttccta

SEQ ID NO: 4685049 - DNA, 17 bp, Homo sapiens
tataatttacctaagat

SEQ ID NO: 4685050 - DNA, 20 bp, Homo sapiens
tatagttactgtgtaattag

SEQ ID NO: 4685051 - DNA, 21 bp, Homo sapiens
tatatctaccccagactagat

SEQ ID NO: 4685052 - DNA, 15 bp, Homo sapiens
tatcctaataaaaag

SEQ ID NO: 4685053 - DNA, 13 bp, Homo sapiens
tatctataattta

SEQ ID NO: 4685054 - DNA, 19 bp, Homo sapiens
tatctataatttacctaag

SEQ ID NO: 4685055 - DNA, 15 bp, Homo sapiens
tatgattactggcct

SEQ ID NO: 4685056 - DNA, 21 bp, Homo sapiens
tatgattattaacgatgtcca

SEQ ID NO: 4685057 - DNA, 15 bp, Homo sapiens
tattaacgatgtcca

SEQ ID NO: 4685058 - DNA, 14 bp, Homo sapiens
tattaatcttagtg

SEQ ID NO: 4685059 - DNA, 15 bp, Homo sapiens
tattattgtgtgtta

SEQ ID NO: 4685060 - DNA, 16 bp, Homo sapiens
tatttggaaataaagt

SEQ ID NO: 4685061 - DNA, 23 bp, Homo sapiens
tcaaggaatttcttaacttcttg

SEQ ID NO: 4685062 - DNA, 14 bp, Homo sapiens
tcaaggcttagacc

SEQ ID NO: 4685063 - DNA, 20 bp, Homo sapiens
tcacacacaggcaactgagg

SEQ ID NO: 4685064 - DNA, 21 bp, Homo sapiens
tcacacacaggcaactgaggc

SEQ ID NO: 4685065 - DNA, 22 bp, Homo sapiens
tcacagcttatttcctcatttt

SEQ ID NO: 4685066 - DNA, 17 bp, Homo sapiens
tcacagtgctcttttct

SEQ ID NO: 4685067 - DNA, 16 bp, Homo sapiens
tcactggggtcctggg

SEQ ID NO: 4685068 - DNA, 17 bp, Homo sapiens
tcactggggtcctgggg

SEQ ID NO: 4685069 - DNA, 19 bp, Homo sapiens
tcactggggtcctggggcc

SEQ ID NO: 4685070 - DNA, 13 bp, Homo sapiens
ggcagacagcagc

SEQ ID NO: 4685071 - DNA, 15 bp, Homo sapiens
ggcagacagcagctc

SEQ ID NO: 4685072 - DNA, 18 bp, Homo sapiens
ggcagacagcagctcagg

SEQ ID NO: 4685073 - DNA, 19 bp, Homo sapiens
ggcagacagcagctcaggc

SEQ ID NO: 4685074 - DNA, 13 bp, Homo sapiens
ggcagagttacag

SEQ ID NO: 4685075 - DNA, 22 bp, Homo sapiens
ggccatgggacagggaggacgc

SEQ ID NO: 4685076 - DNA, 14 bp, Homo sapiens
ggcccaccagggtc

SEQ ID NO: 4685077 - DNA, 21 bp, Homo sapiens
ggcccaggagtttggccagaa

SEQ ID NO: 4685078 - DNA, 22 bp, Homo sapiens
ggcccaggagtttggccagaag

SEQ ID NO: 4685079 - DNA, 23 bp, Homo sapiens
ggcccaggagtttggccagaagt

SEQ ID NO: 4685080 - DNA, 21 bp, Homo sapiens
ggccccagcactaaagcagtg

SEQ ID NO: 4685081 - DNA, 14 bp, Homo sapiens
ggccctgagctcgg

SEQ ID NO: 4685082 - DNA, 21 bp, Homo sapiens
ggccctgagctcggtggaccc

SEQ ID NO: 4685083 - DNA, 13 bp, Homo sapiens
ggcctccatcctg

SEQ ID NO: 4685084 - DNA, 19 bp, Homo sapiens
ggcctcggagcctcatccg

SEQ ID NO: 4685085 - DNA, 22 bp, Homo sapiens
ggcctcggagcctcatccgagg

SEQ ID NO: 4685086 - DNA, 11 bp, Homo sapiens
ggctcagcctg

SEQ ID NO: 4685087 - DNA, 20 bp, Homo sapiens
ggctcagcctggtgggcctc

SEQ ID NO: 4685088 - DNA, 17 bp, Homo sapiens
ggctctaattcacagtg

SEQ ID NO: 4685089 - DNA, 23 bp, Homo sapiens
ggcttagaccctcatgctgccaa

SEQ ID NO: 4685090 - DNA, 17 bp, Homo sapiens
gggattgaaggatgctg

SEQ ID NO: 4685091 - DNA, 19 bp, Homo sapiens
gggcagtgcttggcccagg

SEQ ID NO: 4685092 - DNA, 22 bp, Homo sapiens
gggcagtgcttggcccaggagt

SEQ ID NO: 4685093 - DNA, 23 bp, Homo sapiens
gggcagtgcttggcccaggagtt

SEQ ID NO: 4685094 - DNA, 12 bp, Homo sapiens
gggccctgagct

SEQ ID NO: 4685095 - DNA, 13 bp, Homo sapiens
gggccctgagctc

SEQ ID NO: 4685096 - DNA, 15 bp, Homo sapiens
gggcctcggagcctc

SEQ ID NO: 4685097 - DNA, 16 bp, Homo sapiens
gggctcagcctggtgg

SEQ ID NO: 4685098 - DNA, 21 bp, Homo sapiens
ggggcagtgcttggcccagga

SEQ ID NO: 4685099 - DNA, 14 bp, Homo sapiens
gggtcaggagaggg

SEQ ID NO: 4685100 - DNA, 19 bp, Homo sapiens
gggttcagagactcagggc

SEQ ID NO: 4685101 - DNA, 19 bp, Homo sapiens
ggtaataagtactgtgtac

SEQ ID NO: 4685102 - DNA, 18 bp, Homo sapiens
ggtaccttgaacactggg

SEQ ID NO: 4685103 - DNA, 14 bp, Homo sapiens
ggtcctggggcctc

SEQ ID NO: 4685104 - DNA, 24 bp, Homo sapiens
ggtctgtgagatgctagaactccc

SEQ ID NO: 4685105 - DNA, 12 bp, Homo sapiens
ggtggacccagg

SEQ ID NO: 4685106 - DNA, 18 bp, Homo sapiens
ggtggggcagtgcttggc

SEQ ID NO: 4685107 - DNA, 16 bp, Homo sapiens
ggtttcatgttagtta

SEQ ID NO: 4685108 - DNA, 20 bp, Homo sapiens
tgaattaggctgtaactact

SEQ ID NO: 4685109 - DNA, 15 bp, Homo sapiens
tgacactgctctaac

SEQ ID NO: 4685110 - DNA, 16 bp, Homo sapiens
tgactatcaaactgaa

SEQ ID NO: 4685111 - DNA, 14 bp, Homo sapiens
tgagctcggtggac

SEQ ID NO: 4685112 - DNA, 18 bp, Homo sapiens
tgaggctccacttggtct

SEQ ID NO: 4685113 - DNA, 20 bp, Homo sapiens
tgaggctccacttggtctgt

SEQ ID NO: 4685114 - DNA, 21 bp, Homo sapiens
tgattactggcctttttcatt

SEQ ID NO: 4685115 - DNA, 20 bp, Homo sapiens
tgatttagcaggaagctgtg

SEQ ID NO: 4685116 - DNA, 19 bp, Homo sapiens
tgcacgcacactgtctgcc

SEQ ID NO: 4685117 - DNA, 13 bp, Homo sapiens
tgcagattcattt

SEQ ID NO: 4685118 - DNA, 23 bp, Homo sapiens
tgccaatatcctaataaaaaggt

SEQ ID NO: 4685119 - DNA, 14 bp, Homo sapiens
tgccacttaatgta

SEQ ID NO: 4685120 - DNA, 23 bp, Homo sapiens
tgccacttaatgtatgttaccaa

SEQ ID NO: 4685121 - DNA, 16 bp, Homo sapiens
tgccagccagcagcca

SEQ ID NO: 4685122 - DNA, 22 bp, Homo sapiens
tgccagccagcagccagctctc

SEQ ID NO: 4685123 - DNA, 21 bp, Homo sapiens
tgcccagggctcagcctggtg

SEQ ID NO: 4685124 - DNA, 18 bp, Homo sapiens
tgccccccttgccagaca

SEQ ID NO: 4685125 - DNA, 16 bp, Homo sapiens
tgcccgtcttcagcct

SEQ ID NO: 4685126 - DNA, 19 bp, Homo sapiens
tgcccgtcttcagcctagc

SEQ ID NO: 4685127 - DNA, 17 bp, Homo sapiens
tgccctagagcacactg

SEQ ID NO: 4685128 - DNA, 23 bp, Homo sapiens
tgccctagagcacactgtagcat

SEQ ID NO: 4685129 - DNA, 21 bp, Homo sapiens
tgcctattatctgtcagctgc

SEQ ID NO: 4685130 - DNA, 16 bp, Homo sapiens
tgcggttaattttgaa

SEQ ID NO: 4685131 - DNA, 22 bp, Homo sapiens
tgctaccagtatttagaagcca

SEQ ID NO: 4685132 - DNA, 15 bp, Homo sapiens
tgctacctcactggg

SEQ ID NO: 4685133 - DNA, 21 bp, Homo sapiens
tgctagaactccctttcaaca

SEQ ID NO: 4685134 - DNA, 15 bp, Homo sapiens
tgctcttttctcctc

SEQ ID NO: 4685135 - DNA, 15 bp, Homo sapiens
tgctgccaatatcct

SEQ ID NO: 4685136 - DNA, 16 bp, Homo sapiens
tgctgccaatatccta

SEQ ID NO: 4685137 - DNA, 17 bp, Homo sapiens
tgctgccaatatcctaa

SEQ ID NO: 4685138 - DNA, 21 bp, Homo sapiens
tgctgccaatatcctaataaa

SEQ ID NO: 4685139 - DNA, 22 bp, Homo sapiens
tgctgcccgtcttcagcctagc

SEQ ID NO: 4685140 - DNA, 21 bp, Homo sapiens
tggacaccaggagtccctggt

SEQ ID NO: 4685141 - DNA, 19 bp, Homo sapiens
tggacttaagcatctggct

SEQ ID NO: 4685142 - DNA, 14 bp, Homo sapiens
tggcccaggagttt

SEQ ID NO: 4685143 - DNA, 20 bp, Homo sapiens
tggcccaggagtttggccag

SEQ ID NO: 4685144 - DNA, 21 bp, Homo sapiens
tggcccaggagtttggccaga

SEQ ID NO: 4685145 - DNA, 14 bp, Homo sapiens
tggccttcggcctc

SEQ ID NO: 4685146 - DNA, 20 bp, Homo sapiens
tggccttcggcctccatcct

SEQ ID NO: 4685147 - DNA, 22 bp, Homo sapiens
tggcctttttcatttatctata

SEQ ID NO: 4685148 - DNA, 20 bp, Homo sapiens
tgggaaagggattttcagcc

SEQ ID NO: 4685149 - DNA, 14 bp, Homo sapiens
tgggacagggagga

SEQ ID NO: 4685150 - DNA, 18 bp, Homo sapiens
tgggcctcctctgtccag

SEQ ID NO: 4685151 - DNA, 16 bp, Homo sapiens
tggggaagactgtggc

SEQ ID NO: 4685152 - DNA, 17 bp, Homo sapiens
tggggaagactgtggct

SEQ ID NO: 4685153 - DNA, 20 bp, Homo sapiens
tggggcagtgcttggcccag

SEQ ID NO: 4685154 - DNA, 23 bp, Homo sapiens
tggggcagtgcttggcccaggag

SEQ ID NO: 4685155 - DNA, 14 bp, Homo sapiens
tggtaacttttgtg

SEQ ID NO: 4685156 - DNA, 16 bp, Homo sapiens
tggtaacttttgtgaa

SEQ ID NO: 4685157 - DNA, 22 bp, Homo sapiens
tggtgatttagcaggaagctgt

SEQ ID NO: 4685158 - DNA, 17 bp, Homo sapiens
tgtaactactttataac

SEQ ID NO: 4685159 - DNA, 21 bp, Homo sapiens
tgtaccagttaatttttccaa

SEQ ID NO: 4685160 - DNA, 22 bp, Homo sapiens
tgtaccagttaatttttccaac

SEQ ID NO: 4685161 - DNA, 19 bp, Homo sapiens
tgtataattggatttccta

SEQ ID NO: 4685162 - DNA, 21 bp, Homo sapiens
tgtataattggatttcctaat

SEQ ID NO: 4685163 - DNA, 20 bp, Homo sapiens
tgtcatcctcaaagaaagtg

SEQ ID NO: 4685164 - DNA, 19 bp, Homo sapiens
tgtccctacacccctcccc

SEQ ID NO: 4685165 - DNA, 24 bp, Homo sapiens
tgtcctgcctattatctgtcagct

SEQ ID NO: 4685166 - DNA, 16 bp, Homo sapiens
tgtctcacctggactt

SEQ ID NO: 4685167 - DNA, 15 bp, Homo sapiens
tgtctcctctctctg

SEQ ID NO: 4685168 - DNA, 18 bp, Homo sapiens
tgtctgccagccagcagc

SEQ ID NO: 4685169 - DNA, 24 bp, Homo sapiens
tgtgaattaggctgtaactacttt

SEQ ID NO: 4685170 - DNA, 20 bp, Homo sapiens
tgtgctgcccgtcttcagcc

SEQ ID NO: 4685171 - DNA, 20 bp, Homo sapiens
tgtggcagagttacagttct

SEQ ID NO: 4685172 - DNA, 21 bp, Homo sapiens
tgtggcagagttacagttctg

SEQ ID NO: 4685173 - DNA, 21 bp, Homo sapiens
tgtgtaattagtgccacttaa

SEQ ID NO: 4685174 - DNA, 19 bp, Homo sapiens
tgtgtgcgtcctgtcggag

SEQ ID NO: 4685175 - DNA, 23 bp, Homo sapiens
tgttagttaccttatagttactg

SEQ ID NO: 4685176 - DNA, 17 bp, Homo sapiens
tgttggcatagctctgg

SEQ ID NO: 4685177 - DNA, 15 bp, Homo sapiens
tgtttattaatctta

SEQ ID NO: 4685178 - DNA, 20 bp, Homo sapiens
tgtttttccttgtatttaaa

SEQ ID NO: 4685179 - DNA, 17 bp, Homo sapiens
ttaaagaaagtgtattt

SEQ ID NO: 4685180 - DNA, 18 bp, Homo sapiens
ttaacgatgtccaacccg

SEQ ID NO: 4685181 - DNA, 17 bp, Homo sapiens
ttaacttcttgcttctt

SEQ ID NO: 4685182 - DNA, 16 bp, Homo sapiens
ttaatcttagtgtatg

SEQ ID NO: 4685183 - DNA, 15 bp, Homo sapiens
ttaatgtatgttacc

SEQ ID NO: 4685184 - DNA, 23 bp, Homo sapiens
ttaattttgaagtgctgtttatt

SEQ ID NO: 4685185 - DNA, 22 bp, Homo sapiens
ttacaaatcagaagtcatcttg

SEQ ID NO: 4685186 - DNA, 12 bp, Homo sapiens
ttacagttctgt

SEQ ID NO: 4685187 - DNA, 18 bp, Homo sapiens
ttactggcctttttcatt

SEQ ID NO: 4685188 - DNA, 20 bp, Homo sapiens
ttactggcctttttcattta

SEQ ID NO: 4685189 - DNA, 19 bp, Homo sapiens
ttagaccctcatgctgcca

SEQ ID NO: 4685190 - DNA, 14 bp, Homo sapiens
ttagacctcagcct

SEQ ID NO: 4685191 - DNA, 18 bp, Homo sapiens
ttagcaggaagctgtgag

SEQ ID NO: 4685192 - DNA, 17 bp, Homo sapiens
ttagcttagacctcagc

SEQ ID NO: 4685193 - DNA, 18 bp, Homo sapiens
ttagcttagacctcagcc

SEQ ID NO: 4685194 - DNA, 17 bp, Homo sapiens
ttaggctgtaactactt

SEQ ID NO: 4685195 - DNA, 18 bp, Homo sapiens
ttagtgccacttaatgta

SEQ ID NO: 4685196 - DNA, 18 bp, Homo sapiens
ttagtgtatgattactgg

SEQ ID NO: 4685197 - DNA, 16 bp, Homo sapiens
ttagttaccttatagt

SEQ ID NO: 4685198 - DNA, 19 bp, Homo sapiens
ttagttaccttatagttac

SEQ ID NO: 4685199 - DNA, 19 bp, Homo sapiens
ttataactaacatgtcctg

SEQ ID NO: 4685200 - DNA, 13 bp, Homo sapiens
ttatagttactgt

SEQ ID NO: 4685201 - DNA, 14 bp, Homo sapiens
ttatagttactgtg

SEQ ID NO: 4685202 - DNA, 15 bp, Homo sapiens
ttatagttactgtgt

SEQ ID NO: 4685203 - DNA, 16 bp, Homo sapiens
ttatctgtcagctgca

SEQ ID NO: 4685204 - DNA, 17 bp, Homo sapiens
ttattaatcttagtgta

SEQ ID NO: 4685205 - DNA, 18 bp, Homo sapiens
ttatttgcagagacagga

SEQ ID NO: 4685206 - DNA, 15 bp, Homo sapiens
ttcacagtgctcttt

SEQ ID NO: 4685207 - DNA, 12 bp, Homo sapiens
gtaactacttta

SEQ ID NO: 4685208 - DNA, 10 bp, Homo sapiens
gtaccagtta

SEQ ID NO: 4685209 - DNA, 16 bp, Homo sapiens
gtaccagttaattttt

SEQ ID NO: 4685210 - DNA, 22 bp, Homo sapiens
gtaccagttaatttttccaact

SEQ ID NO: 4685211 - DNA, 14 bp, Homo sapiens
gtaccttgaacact

SEQ ID NO: 4685212 - DNA, 18 bp, Homo sapiens
gtaccttgaacactgggg

SEQ ID NO: 4685213 - DNA, 23 bp, Homo sapiens
gtactgtgtacagaattctgcta

SEQ ID NO: 4685214 - DNA, 19 bp, Homo sapiens
gtataattggatttcctaa

SEQ ID NO: 4685215 - DNA, 20 bp, Homo sapiens
gtataattggatttcctaat

SEQ ID NO: 4685216 - DNA, 20 bp, Homo sapiens
gtatccaggttccctcccag

SEQ ID NO: 4685217 - DNA, 19 bp, Homo sapiens
gtatttggaaataaagtca

SEQ ID NO: 4685218 - DNA, 13 bp, Homo sapiens
gtcaaggcttaga

SEQ ID NO: 4685219 - DNA, 19 bp, Homo sapiens
gtcatcctcaaagaaagtg

SEQ ID NO: 4685220 - DNA, 15 bp, Homo sapiens
gtcatcttgctacca

SEQ ID NO: 4685221 - DNA, 15 bp, Homo sapiens
gtccagggccctgag

SEQ ID NO: 4685222 - DNA, 16 bp, Homo sapiens
gtccagggccctgagc

SEQ ID NO: 4685223 - DNA, 20 bp, Homo sapiens
gtccagggccctgagctcgg

SEQ ID NO: 4685224 - DNA, 16 bp, Homo sapiens
gtccctacacccctcc

SEQ ID NO: 4685225 - DNA, 21 bp, Homo sapiens
gtccctacacccctcccctgc

SEQ ID NO: 4685226 - DNA, 15 bp, Homo sapiens
gtccttttgacactg

SEQ ID NO: 4685227 - DNA, 21 bp, Homo sapiens
gtccttttgacactgctctaa

SEQ ID NO: 4685228 - DNA, 19 bp, Homo sapiens
gtctcacctggacttaagc

SEQ ID NO: 4685229 - DNA, 15 bp, Homo sapiens
gtctctcttctctcc

SEQ ID NO: 4685230 - DNA, 20 bp, Homo sapiens
gtctctcttctctccagctg

SEQ ID NO: 4685231 - DNA, 23 bp, Homo sapiens
gtctctcttctctccagctgact

SEQ ID NO: 4685232 - DNA, 14 bp, Homo sapiens
gtctgccagccagc

SEQ ID NO: 4685233 - DNA, 15 bp, Homo sapiens
gtctgtgagatgcta

SEQ ID NO: 4685234 - DNA, 16 bp, Homo sapiens
gtctgtgagatgctag

SEQ ID NO: 4685235 - DNA, 17 bp, Homo sapiens
gtctgtgagatgctaga

SEQ ID NO: 4685236 - DNA, 22 bp, Homo sapiens
gtctgtgagatgctagaactcc

SEQ ID NO: 4685237 - DNA, 14 bp, Homo sapiens
gtcttatttattat

SEQ ID NO: 4685238 - DNA, 15 bp, Homo sapiens
gtcttcagcctagcc

SEQ ID NO: 4685239 - DNA, 23 bp, Homo sapiens
gtcttcagcctagccgacctcag

SEQ ID NO: 4685240 - DNA, 18 bp, Homo sapiens
gtgaattaggctgtaact

SEQ ID NO: 4685241 - DNA, 15 bp, Homo sapiens
gtgccacttaatgta

SEQ ID NO: 4685242 - DNA, 13 bp, Homo sapiens
gtgccccccttgc

SEQ ID NO: 4685243 - DNA, 20 bp, Homo sapiens
gtgccccccttgccagacat

SEQ ID NO: 4685244 - DNA, 14 bp, Homo sapiens
gtgctcttttctcc

SEQ ID NO: 4685245 - DNA, 14 bp, Homo sapiens
gtgcttggcccagg

SEQ ID NO: 4685246 - DNA, 15 bp, Homo sapiens
gtgcttggcccagga

SEQ ID NO: 4685247 - DNA, 16 bp, Homo sapiens
gtgcttggcccaggag

SEQ ID NO: 4685248 - DNA, 17 bp, Homo sapiens
gtgcttggcccaggagt

SEQ ID NO: 4685249 - DNA, 14 bp, Homo sapiens
gtggggcagtgctt

SEQ ID NO: 4685250 - DNA, 23 bp, Homo sapiens
gtggggcagtgcttggcccagga

SEQ ID NO: 4685251 - DNA, 15 bp, Homo sapiens
gtgggtggggcagtg

SEQ ID NO: 4685252 - DNA, 14 bp, Homo sapiens
gtggtttcatgtta

SEQ ID NO: 4685253 - DNA, 16 bp, Homo sapiens
gtgtgcgtcctgtcgg

SEQ ID NO: 4685254 - DNA, 22 bp, Homo sapiens
gttaccttatagttactgtgta

SEQ ID NO: 4685255 - DNA, 13 bp, Homo sapiens
gttagggaggggt

SEQ ID NO: 4685256 - DNA, 17 bp, Homo sapiens
gttagttaccttatagt

SEQ ID NO: 4685257 - DNA, 22 bp, Homo sapiens
gttagttaccttatagttactg

SEQ ID NO: 4685258 - DNA, 15 bp, Homo sapiens
gttatttaaatgagt

SEQ ID NO: 4685259 - DNA, 16 bp, Homo sapiens
gttcagagactcaggg

SEQ ID NO: 4685260 - DNA, 16 bp, Homo sapiens
gttcatgcagctgtgg

SEQ ID NO: 4685261 - DNA, 21 bp, Homo sapiens
gttctgtggtttcatgttagt

SEQ ID NO: 4685262 - DNA, 18 bp, Homo sapiens
gtttaaagaaagtgtatt

SEQ ID NO: 4685263 - DNA, 22 bp, Homo sapiens
gtttattaatcttagtgtatga

SEQ ID NO: 4685264 - DNA, 23 bp, Homo sapiens
gtttattaatcttagtgtatgat

SEQ ID NO: 4685265 - DNA, 21 bp, Homo sapiens
gtttcatgttagttaccttat

SEQ ID NO: 4685266 - DNA, 21 bp, Homo sapiens
gtttctagcatgaagacagag

SEQ ID NO: 4685267 - DNA, 11 bp, Homo sapiens
gtttggccaga

SEQ ID NO: 4685268 - DNA, 15 bp, Homo sapiens
taaaaaggtgaccat

SEQ ID NO: 4685269 - DNA, 16 bp, Homo sapiens
taaagaaagtgtattt

SEQ ID NO: 4685270 - DNA, 23 bp, Homo sapiens
taaagaaagtgtatttggaaata

SEQ ID NO: 4685271 - DNA, 18 bp, Homo sapiens
taaatatatctaccccag

SEQ ID NO: 4685272 - DNA, 19 bp, Homo sapiens
taaattcccgttttgtcac

SEQ ID NO: 4685273 - DNA, 11 bp, Homo sapiens
taacagccctc

SEQ ID NO: 4685274 - DNA, 16 bp, Homo sapiens
taactaacatgtcctg

SEQ ID NO: 4685275 - DNA, 14 bp, Homo sapiens
taactactttataa

SEQ ID NO: 4685276 - DNA, 16 bp, Homo sapiens
taactactttataact

SEQ ID NO: 4685277 - DNA, 18 bp, Homo sapiens
taagcatctggctctaat

SEQ ID NO: 4685278 - DNA, 18 bp, Homo sapiens
taatcttagtgtatgatt

SEQ ID NO: 4685279 - DNA, 19 bp, Homo sapiens
taattagtgccacttaatg

SEQ ID NO: 4685280 - DNA, 21 bp, Homo sapiens
taattcacagtgctcttttct

SEQ ID NO: 4685281 - DNA, 21 bp, Homo sapiens
taatttacctaagattacaaa

SEQ ID NO: 4685282 - DNA, 22 bp, Homo sapiens
taatttacctaagattacaaat

SEQ ID NO: 4685283 - DNA, 18 bp, Homo sapiens
taattttgaagtgctgtt

SEQ ID NO: 4685284 - DNA, 14 bp, Homo sapiens
taatttttccaact

SEQ ID NO: 4685285 - DNA, 21 bp, Homo sapiens
tacaaatcagaagtcatcttg

SEQ ID NO: 4685286 - DNA, 22 bp, Homo sapiens
tacaaatcagaagtcatcttgc

SEQ ID NO: 4685287 - DNA, 14 bp, Homo sapiens
tacagttctgtggt

SEQ ID NO: 4685288 - DNA, 15 bp, Homo sapiens
taccaaaaataaata

SEQ ID NO: 4685289 - DNA, 12 bp, Homo sapiens
taccagtattta

SEQ ID NO: 4685290 - DNA, 15 bp, Homo sapiens
taccagtatttagaa

SEQ ID NO: 4685291 - DNA, 18 bp, Homo sapiens
taccagtatttagaagcc

SEQ ID NO: 4685292 - DNA, 18 bp, Homo sapiens
taccagttaatttttcca

SEQ ID NO: 4685293 - DNA, 20 bp, Homo sapiens
taccccatggagctgggcta

SEQ ID NO: 4685294 - DNA, 20 bp, Homo sapiens
tacctaagattacaaatcag

SEQ ID NO: 4685295 - DNA, 16 bp, Homo sapiens
taccttatagttactg

SEQ ID NO: 4685296 - DNA, 18 bp, Homo sapiens
taccttgaacactggggg

SEQ ID NO: 4685297 - DNA, 23 bp, Homo sapiens
tactaatagaataaaggcagttt

SEQ ID NO: 4685298 - DNA, 23 bp, Homo sapiens
tactttataactaacatgtcctg

SEQ ID NO: 4685299 - DNA, 16 bp, Homo sapiens
tagaaagagaaacagt

SEQ ID NO: 4685300 - DNA, 15 bp, Homo sapiens
tagaactccctttca

SEQ ID NO: 4685301 - DNA, 19 bp, Homo sapiens
tagaataaaggcagttttc

SEQ ID NO: 4685302 - DNA, 15 bp, Homo sapiens
tagacactttggaag

SEQ ID NO: 4685303 - DNA, 23 bp, Homo sapiens
tagaccctcatgctgccaatatc

SEQ ID NO: 4685304 - DNA, 13 bp, Homo sapiens
tagacctcagcct

SEQ ID NO: 4685305 - DNA, 16 bp, Homo sapiens
tagagcacactgtagc

SEQ ID NO: 4685306 - DNA, 17 bp, Homo sapiens
tagagcacactgtagca

SEQ ID NO: 4685307 - DNA, 13 bp, Homo sapiens
tagccgacctcag

SEQ ID NO: 4685308 - DNA, 15 bp, Homo sapiens
tagcttagacctcag

SEQ ID NO: 4685309 - DNA, 16 bp, Homo sapiens
tagcttagacctcagc

SEQ ID NO: 4685310 - DNA, 17 bp, Homo sapiens
tagcttagacctcagcc

SEQ ID NO: 4685311 - DNA, 19 bp, Homo sapiens
tagtattttttgtataatt

SEQ ID NO: 4685312 - DNA, 18 bp, Homo sapiens
tagttaccttatagttac

SEQ ID NO: 4685313 - DNA, 18 bp, Homo sapiens
tagttactgtgtaattag

SEQ ID NO: 4685314 - DNA, 20 bp, Homo sapiens
tataattggatttcctaata

SEQ ID NO: 4685315 - DNA, 20 bp, Homo sapiens
tataatttacctaagattac

SEQ ID NO: 4685316 - DNA, 15 bp, Homo sapiens
tatagttactgtgta

SEQ ID NO: 4685317 - DNA, 16 bp, Homo sapiens
tatagttactgtgtaa

SEQ ID NO: 4685318 - DNA, 22 bp, Homo sapiens
tatagttactgtgtaattagtg

SEQ ID NO: 4685319 - DNA, 16 bp, Homo sapiens
tatcaaactgaagcca

SEQ ID NO: 4685320 - DNA, 22 bp, Homo sapiens
tatcctaataaaaaggtgacca

SEQ ID NO: 4685321 - DNA, 22 bp, Homo sapiens
tatctaccccagactagatgta

SEQ ID NO: 4685322 - DNA, 14 bp, Homo sapiens
tatctataatttac

SEQ ID NO: 4685323 - DNA, 22 bp, Homo sapiens
tatgattactggcctttttcat

SEQ ID NO: 4685324 - DNA, 19 bp, Homo sapiens
tatttggaaataaagtcag

SEQ ID NO: 4685325 - DNA, 14 bp, Homo sapiens
tattttttgtataa

SEQ ID NO: 4685326 - DNA, 16 bp, Homo sapiens
tattttttgtataatt

SEQ ID NO: 4685327 - DNA, 14 bp, Homo sapiens
tcaaagaaagtgta

SEQ ID NO: 4685328 - DNA, 16 bp, Homo sapiens
tcaaggaatttcttaa

SEQ ID NO: 4685329 - DNA, 21 bp, Homo sapiens
tcactggggtcctggggcctc

SEQ ID NO: 4685330 - DNA, 13 bp, Homo sapiens
tcactttttctga

SEQ ID NO: 4685331 - DNA, 18 bp, Homo sapiens
tcagaagtcatcttgcta

SEQ ID NO: 4685332 - DNA, 20 bp, Homo sapiens
tcagagactcagggccccag

SEQ ID NO: 4685333 - DNA, 18 bp, Homo sapiens
tcagatgcacatgagctg

SEQ ID NO: 4685334 - DNA, 21 bp, Homo sapiens
tcagccaacgagtaatttatt

SEQ ID NO: 4685335 - DNA, 13 bp, Homo sapiens
tcagccctcagaa

SEQ ID NO: 4685336 - DNA, 14 bp, Homo sapiens
tcagccctcagaat

SEQ ID NO: 4685337 - DNA, 19 bp, Homo sapiens
tcagcctagccgacctcag

SEQ ID NO: 4685338 - DNA, 20 bp, Homo sapiens
tcagcctagccgacctcagc

SEQ ID NO: 4685339 - DNA, 12 bp, Homo sapiens
tcagcctgtgct

SEQ ID NO: 4685340 - DNA, 20 bp, Homo sapiens
tcagctgcaaggtactctgg

SEQ ID NO: 4685341 - DNA, 22 bp, Homo sapiens
tcagctgcaaggtactctggtg

SEQ ID NO: 4685342 - DNA, 15 bp, Homo sapiens
tcaggagaggggcag

SEQ ID NO: 4685343 - DNA, 20 bp, Homo sapiens
tcaggagaggggcagaacag

SEQ ID NO: 4685344 - DNA, 14 bp, Homo sapiens
tcagggccccagca

SEQ ID NO: 4685345 - DNA, 23 bp, Homo sapiens
tcagggccccagcactaaagcag

SEQ ID NO: 4685346 - DNA, 14 bp, Homo sapiens
tcatccgaggcagg

SEQ ID NO: 4685347 - DNA, 21 bp, Homo sapiens
tcatcctcaaagaaagtgtat

SEQ ID NO: 4685348 - DNA, 11 bp, Homo sapiens
tcatcttgcta

SEQ ID NO: 4685349 - DNA, 18 bp, Homo sapiens
tcatcttgctaccagtat

SEQ ID NO: 4685350 - DNA, 13 bp, Homo sapiens
tcatgctgccaat

SEQ ID NO: 4685351 - DNA, 23 bp, Homo sapiens
tcatgctgccaatatcctaataa

SEQ ID NO: 4685352 - DNA, 20 bp, Homo sapiens
tcattgactatcaaactgaa

SEQ ID NO: 4685353 - DNA, 21 bp, Homo sapiens
tcatttatctataatttacct

SEQ ID NO: 4685354 - DNA, 13 bp, Homo sapiens
tccacttggtctg

SEQ ID NO: 4685355 - DNA, 23 bp, Homo sapiens
tccacttggtctgtgagatgcta

SEQ ID NO: 4685356 - DNA, 17 bp, Homo sapiens
tccagggccctgagctc

SEQ ID NO: 4685357 - DNA, 20 bp, Homo sapiens
tccagggccctgagctcggt

SEQ ID NO: 4685358 - DNA, 12 bp, Homo sapiens
tccatcctgagg

SEQ ID NO: 4685359 - DNA, 15 bp, Homo sapiens
tccatcctgaggctc

SEQ ID NO: 4685360 - DNA, 13 bp, Homo sapiens
tccccttgcccag

SEQ ID NO: 4685361 - DNA, 17 bp, Homo sapiens
tccccttgcccagggct

SEQ ID NO: 4685362 - DNA, 22 bp, Homo sapiens
tccctcccagaggagccaccag

SEQ ID NO: 4685363 - DNA, 23 bp, Homo sapiens
tccctcccagaggagccaccagt

SEQ ID NO: 4685364 - DNA, 21 bp, Homo sapiens
tccctggtaataagtactgtg

SEQ ID NO: 4685365 - DNA, 14 bp, Homo sapiens
tccgaggcagggtc

SEQ ID NO: 4685366 - DNA, 12 bp, Homo sapiens
tcctaataaaaa

SEQ ID NO: 4685367 - DNA, 19 bp, Homo sapiens
tcctcaaagaaagtgtatt

SEQ ID NO: 4685368 - DNA, 22 bp, Homo sapiens
tcctcatttttataatgtccct

SEQ ID NO: 4685369 - DNA, 12 bp, Homo sapiens
tcctctgcactc

SEQ ID NO: 4685370 - DNA, 14 bp, Homo sapiens
tcctctgtccaggg

SEQ ID NO: 4685371 - DNA, 15 bp, Homo sapiens
tcctgaggctccact

SEQ ID NO: 4685372 - DNA, 20 bp, Homo sapiens
tcctgaggctccacttggtc

SEQ ID NO: 4685373 - DNA, 13 bp, Homo sapiens
tcctggggcctcg

SEQ ID NO: 4685374 - DNA, 22 bp, Homo sapiens
tcctgtcggagccctgtctcct

SEQ ID NO: 4685375 - DNA, 17 bp, Homo sapiens
tcctgtctgccagccag

SEQ ID NO: 4685376 - DNA, 15 bp, Homo sapiens
tccttgtatttaaat

SEQ ID NO: 4685377 - DNA, 15 bp, Homo sapiens
tcggagccctgtctc

SEQ ID NO: 4685378 - DNA, 18 bp, Homo sapiens
tcggcctccatcctgagg

SEQ ID NO: 4685379 - DNA, 20 bp, Homo sapiens
tctaacagccctcctctgca

SEQ ID NO: 4685380 - DNA, 12 bp, Homo sapiens
tctagcatgaag

SEQ ID NO: 4685381 - DNA, 16 bp, Homo sapiens
tctataatttacctaa

SEQ ID NO: 4685382 - DNA, 15 bp, Homo sapiens
tctcctctctctgta

SEQ ID NO: 4685383 - DNA, 15 bp, Homo sapiens
tctctccagctgact

SEQ ID NO: 4685384 - DNA, 12 bp, Homo sapiens
tctctggccttc

SEQ ID NO: 4685385 - DNA, 13 bp, Homo sapiens
tctctggccttcg

SEQ ID NO: 4685386 - DNA, 16 bp, Homo sapiens
tctctggccttcggcc

SEQ ID NO: 4685387 - DNA, 21 bp, Homo sapiens
tctctggccttcggcctccat

SEQ ID NO: 4685388 - DNA, 16 bp, Homo sapiens
tctcttctctccagct

SEQ ID NO: 4685389 - DNA, 23 bp, Homo sapiens
tctcttctctccagctgactaaa

SEQ ID NO: 4685390 - DNA, 17 bp, Homo sapiens
tctggccttcggcctcc

SEQ ID NO: 4685391 - DNA, 18 bp, Homo sapiens
tctggccttcggcctcca

SEQ ID NO: 4685392 - DNA, 12 bp, Homo sapiens
tctggctctaat

SEQ ID NO: 4685393 - DNA, 16 bp, Homo sapiens
tctggctctaattcac

SEQ ID NO: 4685394 - DNA, 23 bp, Homo sapiens
tctgtaataaactcatttctagc

SEQ ID NO: 4685395 - DNA, 12 bp, Homo sapiens
tctgtaccagtt

SEQ ID NO: 4685396 - DNA, 13 bp, Homo sapiens
tctgtaccagtta

SEQ ID NO: 4685397 - DNA, 13 bp, Homo sapiens
tctgtcagctgca

SEQ ID NO: 4685398 - DNA, 13 bp, Homo sapiens
tctgtccagggcc

SEQ ID NO: 4685399 - DNA, 23 bp, Homo sapiens
tcttaacttcttgcttctttcta

SEQ ID NO: 4685400 - DNA, 12 bp, Homo sapiens
tcttcagcctag

SEQ ID NO: 4685401 - DNA, 11 bp, Homo sapiens
tcttgcttctt

SEQ ID NO: 4685402 - DNA, 16 bp, Homo sapiens
tcttgcttctttctag

SEQ ID NO: 4685403 - DNA, 18 bp, Homo sapiens
tcttgcttctttctagaa

SEQ ID NO: 4685404 - DNA, 19 bp, Homo sapiens
tgaacaagttgtttcattg

SEQ ID NO: 4685405 - DNA, 16 bp, Homo sapiens
tgaacactgggggagg

SEQ ID NO: 4685406 - DNA, 22 bp, Homo sapiens
tgaacactgggggaggggacat

SEQ ID NO: 4685407 - DNA, 22 bp, Homo sapiens
tgaagtgctgtttattaatctt

SEQ ID NO: 4685408 - DNA, 20 bp, Homo sapiens
ttcagagactcagggcccca

SEQ ID NO: 4685409 - DNA, 20 bp, Homo sapiens
ttcagcctagccgacctcag

SEQ ID NO: 4685410 - DNA, 21 bp, Homo sapiens
ttcagcctagccgacctcagc

SEQ ID NO: 4685411 - DNA, 14 bp, Homo sapiens
ttcatgcagctgtg

SEQ ID NO: 4685412 - DNA, 13 bp, Homo sapiens
ttcatgttagtta

SEQ ID NO: 4685413 - DNA, 16 bp, Homo sapiens
ttcatgttagttacct

SEQ ID NO: 4685414 - DNA, 22 bp, Homo sapiens
ttcatgttagttaccttatagt

SEQ ID NO: 4685415 - DNA, 17 bp, Homo sapiens
ttcatttatctataatt

SEQ ID NO: 4685416 - DNA, 23 bp, Homo sapiens
ttccccttgcccagggctcagcc

SEQ ID NO: 4685417 - DNA, 15 bp, Homo sapiens
ttccttgtatttaaa

SEQ ID NO: 4685418 - DNA, 18 bp, Homo sapiens
ttccttgtatttaaatat

SEQ ID NO: 4685419 - DNA, 18 bp, Homo sapiens
ttcggccccatgtatctc

SEQ ID NO: 4685420 - DNA, 22 bp, Homo sapiens
ttcggcctccatcctgaggctc

SEQ ID NO: 4685421 - DNA, 19 bp, Homo sapiens
ttctagcatgaagacagag

SEQ ID NO: 4685422 - DNA, 19 bp, Homo sapiens
ttctctccagctgactaaa

SEQ ID NO: 4685423 - DNA, 18 bp, Homo sapiens
ttctgataaaagatggcc

SEQ ID NO: 4685424 - DNA, 15 bp, Homo sapiens
ttctgctacctcact

SEQ ID NO: 4685425 - DNA, 13 bp, Homo sapiens
ttctgtaccagtt

SEQ ID NO: 4685426 - DNA, 14 bp, Homo sapiens
ttctgtaccagtta

SEQ ID NO: 4685427 - DNA, 21 bp, Homo sapiens
ttctgtaccagttaatttttc

SEQ ID NO: 4685428 - DNA, 16 bp, Homo sapiens
ttcttaacttcttgct

SEQ ID NO: 4685429 - DNA, 17 bp, Homo sapiens
ttcttaacttcttgctt

SEQ ID NO: 4685430 - DNA, 17 bp, Homo sapiens
ttcttgcttctttctag

SEQ ID NO: 4685431 - DNA, 23 bp, Homo sapiens
ttgacactgctctaacagccctc

SEQ ID NO: 4685432 - DNA, 17 bp, Homo sapiens
ttgactatcaaactgaa

SEQ ID NO: 4685433 - DNA, 19 bp, Homo sapiens
ttgcagagacaggacctga

SEQ ID NO: 4685434 - DNA, 20 bp, Homo sapiens
ttgctaccagtatttagaag

SEQ ID NO: 4685435 - DNA, 12 bp, Homo sapiens
ttgcttctttct

SEQ ID NO: 4685436 - DNA, 20 bp, Homo sapiens
ttgcttctttctagaaagag

SEQ ID NO: 4685437 - DNA, 21 bp, Homo sapiens
ttggaaataaagtcagatgga

SEQ ID NO: 4685438 - DNA, 14 bp, Homo sapiens
ttggatttcctaat

SEQ ID NO: 4685439 - DNA, 20 bp, Homo sapiens
ttggccagaagtcaaggctt

SEQ ID NO: 4685440 - DNA, 12 bp, Homo sapiens
ttggtaactttt

SEQ ID NO: 4685441 - DNA, 14 bp, Homo sapiens
ttggtaacttttgt

SEQ ID NO: 4685442 - DNA, 17 bp, Homo sapiens
ttggtttaaagaaagtg

SEQ ID NO: 4685443 - DNA, 20 bp, Homo sapiens
ttgtataattggatttccta

SEQ ID NO: 4685444 - DNA, 21 bp, Homo sapiens
ttgtataattggatttcctaa

SEQ ID NO: 4685445 - DNA, 16 bp, Homo sapiens
ttgtcactttttctga

SEQ ID NO: 4685446 - DNA, 18 bp, Homo sapiens
ttgtgaattaggctgtaa

SEQ ID NO: 4685447 - DNA, 16 bp, Homo sapiens
ttgtgtgttatttaaa

SEQ ID NO: 4685448 - DNA, 20 bp, Homo sapiens
ttgtgtgttatttaaatgag

SEQ ID NO: 4685449 - DNA, 22 bp, Homo sapiens
ttgtttttccttgtatttaaat

SEQ ID NO: 4685450 - DNA, 12 bp, Homo sapiens
tttaaagaaagt

SEQ ID NO: 4685451 - DNA, 16 bp, Homo sapiens
tttaaagaaagtgtat

SEQ ID NO: 4685452 - DNA, 15 bp, Homo sapiens
tttacctaagattac

SEQ ID NO: 4685453 - DNA, 19 bp, Homo sapiens
tttatctataatttaccta

SEQ ID NO: 4685454 - DNA, 20 bp, Homo sapiens
tttatctataatttacctaa

SEQ ID NO: 4685455 - DNA, 13 bp, Homo sapiens
tttattaatctta

SEQ ID NO: 4685456 - DNA, 19 bp, Homo sapiens
tttcatgttagttacctta

SEQ ID NO: 4685457 - DNA, 17 bp, Homo sapiens
tttcatttatctataat

SEQ ID NO: 4685458 - DNA, 20 bp, Homo sapiens
tttcatttatctataattta

SEQ ID NO: 4685459 - DNA, 13 bp, Homo sapiens
tttctagaaagag

SEQ ID NO: 4685460 - DNA, 14 bp, Homo sapiens
tttctgtaccagtt

SEQ ID NO: 4685461 - DNA, 14 bp, Homo sapiens
cccttgcccagggc

SEQ ID NO: 4685462 - DNA, 15 bp, Homo sapiens
cccttgcccagggct

SEQ ID NO: 4685463 - DNA, 12 bp, Homo sapiens
ccgacctcagcc

SEQ ID NO: 4685464 - DNA, 13 bp, Homo sapiens
ccgacctcagcct

SEQ ID NO: 4685465 - DNA, 17 bp, Homo sapiens
ccgctcctgtctgccag

SEQ ID NO: 4685466 - DNA, 16 bp, Homo sapiens
ccgtctggcccaccag

SEQ ID NO: 4685467 - DNA, 17 bp, Homo sapiens
ccgtctggcccaccagg

SEQ ID NO: 4685468 - DNA, 20 bp, Homo sapiens
ccgttggggattggggaaga

SEQ ID NO: 4685469 - DNA, 14 bp, Homo sapiens
cctagccgacctca

SEQ ID NO: 4685470 - DNA, 15 bp, Homo sapiens
cctagccgacctcag

SEQ ID NO: 4685471 - DNA, 19 bp, Homo sapiens
cctagccgacctcagcctt

SEQ ID NO: 4685472 - DNA, 17 bp, Homo sapiens
cctattatctgtcagct

SEQ ID NO: 4685473 - DNA, 16 bp, Homo sapiens
cctcaaagaaagtgta

SEQ ID NO: 4685474 - DNA, 19 bp, Homo sapiens
cctcactggggtcctgggg

SEQ ID NO: 4685475 - DNA, 20 bp, Homo sapiens
cctcagatgcacatgagctg

SEQ ID NO: 4685476 - DNA, 11 bp, Homo sapiens
cctcagcctgt

SEQ ID NO: 4685477 - DNA, 15 bp, Homo sapiens
cctcatccgaggcag

SEQ ID NO: 4685478 - DNA, 15 bp, Homo sapiens
cctcatgctgccaat

SEQ ID NO: 4685479 - DNA, 16 bp, Homo sapiens
cctcatgctgccaata

SEQ ID NO: 4685480 - DNA, 12 bp, Homo sapiens
cctccatcctga

SEQ ID NO: 4685481 - DNA, 13 bp, Homo sapiens
cctccatcctgag

SEQ ID NO: 4685482 - DNA, 20 bp, Homo sapiens
cctcccagaggagccaccag

SEQ ID NO: 4685483 - DNA, 20 bp, Homo sapiens
cctctgtccagggccctgag

SEQ ID NO: 4685484 - DNA, 21 bp, Homo sapiens
cctctgtccagggccctgagc

SEQ ID NO: 4685485 - DNA, 17 bp, Homo sapiens
cctgacacaccaggcgc

SEQ ID NO: 4685486 - DNA, 19 bp, Homo sapiens
cctgagctcggtggaccca

SEQ ID NO: 4685487 - DNA, 20 bp, Homo sapiens
cctgagctcggtggacccag

SEQ ID NO: 4685488 - DNA, 13 bp, Homo sapiens
cctgaggctccac

SEQ ID NO: 4685489 - DNA, 14 bp, Homo sapiens
cctgaggctccact

SEQ ID NO: 4685490 - DNA, 18 bp, Homo sapiens
cctgaggctccacttggt

SEQ ID NO: 4685491 - DNA, 20 bp, Homo sapiens
cctgaggctccacttggtct

SEQ ID NO: 4685492 - DNA, 19 bp, Homo sapiens
cctgccctagagcacactg

SEQ ID NO: 4685493 - DNA, 20 bp, Homo sapiens
cctggacttaagcatctggc

SEQ ID NO: 4685494 - DNA, 16 bp, Homo sapiens
cctgtcggagccctgt

SEQ ID NO: 4685495 - DNA, 17 bp, Homo sapiens
cctgtcggagccctgtc

SEQ ID NO: 4685496 - DNA, 22 bp, Homo sapiens
cctgtcggagccctgtctcctc

SEQ ID NO: 4685497 - DNA, 20 bp, Homo sapiens
cctgtctgccagccagcagc

SEQ ID NO: 4685498 - DNA, 23 bp, Homo sapiens
cctgtgctgcccgtcttcagcct

SEQ ID NO: 4685499 - DNA, 18 bp, Homo sapiens
ccttagcttagacctcag

SEQ ID NO: 4685500 - DNA, 23 bp, Homo sapiens
ccttagcttagacctcagcctgt

SEQ ID NO: 4685501 - DNA, 14 bp, Homo sapiens
ccttatagttactg

SEQ ID NO: 4685502 - DNA, 20 bp, Homo sapiens
ccttccccttgcccagggct

SEQ ID NO: 4685503 - DNA, 13 bp, Homo sapiens
ccttgcccagggc

SEQ ID NO: 4685504 - DNA, 17 bp, Homo sapiens
ccttgcccagggctcag

SEQ ID NO: 4685505 - DNA, 18 bp, Homo sapiens
ccttgcccagggctcagc

SEQ ID NO: 4685506 - DNA, 21 bp, Homo sapiens
ccttgcccagggctcagcctg

SEQ ID NO: 4685507 - DNA, 22 bp, Homo sapiens
ccttgctgcaagcacagccctt

SEQ ID NO: 4685508 - DNA, 15 bp, Homo sapiens
ccttttgacactgct

SEQ ID NO: 4685509 - DNA, 12 bp, Homo sapiens
cgacctcagcct

SEQ ID NO: 4685510 - DNA, 17 bp, Homo sapiens
cgcctgaggcaattaga

SEQ ID NO: 4685511 - DNA, 20 bp, Homo sapiens
cggagcctcatccgaggcag

SEQ ID NO: 4685512 - DNA, 17 bp, Homo sapiens
cggcctccatcctgagg

SEQ ID NO: 4685513 - DNA, 17 bp, Homo sapiens
cgtctggcccaccaggg

SEQ ID NO: 4685514 - DNA, 13 bp, Homo sapiens
cgtcttcagccta

SEQ ID NO: 4685515 - DNA, 15 bp, Homo sapiens
ctaaactttttttct

SEQ ID NO: 4685516 - DNA, 18 bp, Homo sapiens
ctaaactttttttctgta

SEQ ID NO: 4685517 - DNA, 21 bp, Homo sapiens
ctaaactttttttctgtacca

SEQ ID NO: 4685518 - DNA, 12 bp, Homo sapiens
ctaacagccctc

SEQ ID NO: 4685519 - DNA, 13 bp, Homo sapiens
ctaataaaaaggt

SEQ ID NO: 4685520 - DNA, 21 bp, Homo sapiens
cttagcttagacctcagcctg

SEQ ID NO: 4685521 - DNA, 15 bp, Homo sapiens
cttagtgtatgatta

SEQ ID NO: 4685522 - DNA, 18 bp, Homo sapiens
cttatagttactgtgtaa

SEQ ID NO: 4685523 - DNA, 17 bp, Homo sapiens
cttcacacacaggcaac

SEQ ID NO: 4685524 - DNA, 21 bp, Homo sapiens
cttcacacacaggcaactgag

SEQ ID NO: 4685525 - DNA, 16 bp, Homo sapiens
cttccccttgcccagg

SEQ ID NO: 4685526 - DNA, 18 bp, Homo sapiens
cttcggcctccatcctga

SEQ ID NO: 4685527 - DNA, 19 bp, Homo sapiens
cttcggcctccatcctgag

SEQ ID NO: 4685528 - DNA, 19 bp, Homo sapiens
cttctctccagctgactaa

SEQ ID NO: 4685529 - DNA, 16 bp, Homo sapiens
cttcttggtcttattt

SEQ ID NO: 4685530 - DNA, 16 bp, Homo sapiens
cttgccagacatgtgg

SEQ ID NO: 4685531 - DNA, 13 bp, Homo sapiens
cttgcccagggct

SEQ ID NO: 4685532 - DNA, 15 bp, Homo sapiens
cttgcccagggctca

SEQ ID NO: 4685533 - DNA, 13 bp, Homo sapiens
cttgctaccagta

SEQ ID NO: 4685534 - DNA, 14 bp, Homo sapiens
cttgcttctttcta

SEQ ID NO: 4685535 - DNA, 13 bp, Homo sapiens
cttggcccaggag

SEQ ID NO: 4685536 - DNA, 15 bp, Homo sapiens
cttgggtaggcggga

SEQ ID NO: 4685537 - DNA, 18 bp, Homo sapiens
cttgtatttaaatattaa

SEQ ID NO: 4685538 - DNA, 20 bp, Homo sapiens
cttgtatttaaatattaaat

SEQ ID NO: 4685539 - DNA, 16 bp, Homo sapiens
ctttttttctgtacca

SEQ ID NO: 4685540 - DNA, 19 bp, Homo sapiens
ctttttttctgtaccagtt

SEQ ID NO: 4685541 - DNA, 20 bp, Homo sapiens
ctttttttctgtaccagtta

SEQ ID NO: 4685542 - DNA, 23 bp, Homo sapiens
gaaacagttggtaacttttgtga

SEQ ID NO: 4685543 - DNA, 16 bp, Homo sapiens
gaaactgacacatgct

SEQ ID NO: 4685544 - DNA, 23 bp, Homo sapiens
gaaagtgtatttggaaataaagt

SEQ ID NO: 4685545 - DNA, 14 bp, Homo sapiens
gaaataaagtcaga

SEQ ID NO: 4685546 - DNA, 19 bp, Homo sapiens
gaaataaagtcagatggaa

SEQ ID NO: 4685547 - DNA, 19 bp, Homo sapiens
gaacaagttgtttcattga

SEQ ID NO: 4685548 - DNA, 14 bp, Homo sapiens
gaacatcacagctt

SEQ ID NO: 4685549 - DNA, 16 bp, Homo sapiens
gaactccctttcaaca

SEQ ID NO: 4685550 - DNA, 11 bp, Homo sapiens
gaagactgtgg

SEQ ID NO: 4685551 - DNA, 12 bp, Homo sapiens
gaagactgtggc

SEQ ID NO: 4685552 - DNA, 14 bp, Homo sapiens
gaaggatgctgtct

SEQ ID NO: 4685553 - DNA, 18 bp, Homo sapiens
gaagtcatcttgctacca

SEQ ID NO: 4685554 - DNA, 20 bp, Homo sapiens
gaataaaggcagttttctaa

SEQ ID NO: 4685555 - DNA, 19 bp, Homo sapiens
gaattaggctgtaactact

SEQ ID NO: 4685556 - DNA, 18 bp, Homo sapiens
gaattctgctacctcact

SEQ ID NO: 4685557 - DNA, 16 bp, Homo sapiens
gaatttcttaacttct

SEQ ID NO: 4685558 - DNA, 17 bp, Homo sapiens
gaatttcttaacttctt

SEQ ID NO: 4685559 - DNA, 19 bp, Homo sapiens
gaatttcttaacttcttgc

SEQ ID NO: 4685560 - DNA, 21 bp, Homo sapiens
gaatttcttaacttcttgctt

SEQ ID NO: 4685561 - DNA, 15 bp, Homo sapiens
gacacaccaggcgct

SEQ ID NO: 4685562 - DNA, 18 bp, Homo sapiens
gacacaccaggcgctaat

SEQ ID NO: 4685563 - DNA, 19 bp, Homo sapiens
gacaccaggagtccctggt

SEQ ID NO: 4685564 - DNA, 20 bp, Homo sapiens
gacaccaggagtccctggta

SEQ ID NO: 4685565 - DNA, 14 bp, Homo sapiens
gacactgctctaac

SEQ ID NO: 4685566 - DNA, 19 bp, Homo sapiens
gacagagccccaccctcag

SEQ ID NO: 4685567 - DNA, 18 bp, Homo sapiens
gacagcagctcaggcaca

SEQ ID NO: 4685568 - DNA, 14 bp, Homo sapiens
gacatgtggtggga

SEQ ID NO: 4685569 - DNA, 16 bp, Homo sapiens
gacatgtggtgggaca

SEQ ID NO: 4685570 - DNA, 23 bp, Homo sapiens
gacccacttcacacacaggcaac

SEQ ID NO: 4685571 - DNA, 16 bp, Homo sapiens
gaccctcatgctgcca

SEQ ID NO: 4685572 - DNA, 17 bp, Homo sapiens
gaccctcatgctgccaa

SEQ ID NO: 4685573 - DNA, 18 bp, Homo sapiens
gaccctcatgctgccaat

SEQ ID NO: 4685574 - DNA, 22 bp, Homo sapiens
gaccctcatgctgccaatatcc

SEQ ID NO: 4685575 - DNA, 10 bp, Homo sapiens
gacctcagcc

SEQ ID NO: 4685576 - DNA, 12 bp, Homo sapiens
gacctcagcctg

SEQ ID NO: 4685577 - DNA, 14 bp, Homo sapiens
gacctcagcctgtg

SEQ ID NO: 4685578 - DNA, 14 bp, Homo sapiens
gacctcagccttcc

SEQ ID NO: 4685579 - DNA, 20 bp, Homo sapiens
gacctcagccttccccttgc

SEQ ID NO: 4685580 - DNA, 14 bp, Homo sapiens
gacgctctctggcc

SEQ ID NO: 4685581 - DNA, 15 bp, Homo sapiens
gacgctctctggcct

SEQ ID NO: 4685582 - DNA, 17 bp, Homo sapiens
gacgctctctggccttc

SEQ ID NO: 4685583 - DNA, 18 bp, Homo sapiens
gactaaactttttttctg

SEQ ID NO: 4685584 - DNA, 18 bp, Homo sapiens
gactatcaaactgaagcc

SEQ ID NO: 4685585 - DNA, 15 bp, Homo sapiens
gactcagggccccag

SEQ ID NO: 4685586 - DNA, 18 bp, Homo sapiens
gactcagggccccagcac

SEQ ID NO: 4685587 - DNA, 17 bp, Homo sapiens
gactggatagtccgtct

SEQ ID NO: 4685588 - DNA, 20 bp, Homo sapiens
gacttaagcatctggctcta

SEQ ID NO: 4685589 - DNA, 22 bp, Homo sapiens
gacttaagcatctggctctaat

SEQ ID NO: 4685590 - DNA, 17 bp, Homo sapiens
gagaaacagttggtaac

SEQ ID NO: 4685591 - DNA, 16 bp, Homo sapiens
gagatgctagaactcc

SEQ ID NO: 4685592 - DNA, 16 bp, Homo sapiens
gagccccaccctcaga

SEQ ID NO: 4685593 - DNA, 15 bp, Homo sapiens
gagctcggtggaccc

SEQ ID NO: 4685594 - DNA, 16 bp, Homo sapiens
gaggagccaccagttc

SEQ ID NO: 4685595 - DNA, 21 bp, Homo sapiens
gaggcaattagacactttgga

SEQ ID NO: 4685596 - DNA, 19 bp, Homo sapiens
gaggcagacagcagctcag

SEQ ID NO: 4685597 - DNA, 22 bp, Homo sapiens
gaggcagacagcagctcaggca

SEQ ID NO: 4685598 - DNA, 17 bp, Homo sapiens
gaggctccacttggtct

SEQ ID NO: 4685599 - DNA, 17 bp, Homo sapiens
gagtgtgtttgtcaccg

SEQ ID NO: 4685600 - DNA, 14 bp, Homo sapiens
gagttacagttctg

SEQ ID NO: 4685601 - DNA, 17 bp, Homo sapiens
gagttacagttctgtgg

SEQ ID NO: 4685602 - DNA, 12 bp, Homo sapiens
gagtttggccag

SEQ ID NO: 4685603 - DNA, 13 bp, Homo sapiens
gagtttggccaga

SEQ ID NO: 4685604 - DNA, 14 bp, Homo sapiens
gagtttggccagaa

SEQ ID NO: 4685605 - DNA, 16 bp, Homo sapiens
gataaaagatggccat

SEQ ID NO: 4685606 - DNA, 16 bp, Homo sapiens
gatgctagaactccct

SEQ ID NO: 4685607 - DNA, 16 bp, Homo sapiens
gattacaaatcagaag

SEQ ID NO: 4685608 - DNA, 19 bp, Homo sapiens
gattacaaatcagaagtca

SEQ ID NO: 4685609 - DNA, 11 bp, Homo sapiens
gattttcagcc

SEQ ID NO: 4685610 - DNA, 21 bp, Homo sapiens
gcaactgaggcagacagcagc

SEQ ID NO: 4685611 - DNA, 15 bp, Homo sapiens
gcaaggtactctggt

SEQ ID NO: 4685612 - DNA, 12 bp, Homo sapiens
gcacactgtagc

SEQ ID NO: 4685613 - DNA, 11 bp, Homo sapiens
gcacagccctt

SEQ ID NO: 4685614 - DNA, 16 bp, Homo sapiens
gcacgcacactgtctg

SEQ ID NO: 4685615 - DNA, 17 bp, Homo sapiens
gcactcccacctgacac

SEQ ID NO: 4685616 - DNA, 22 bp, Homo sapiens
gcacttggagccaagggttcag

SEQ ID NO: 4685617 - DNA, 14 bp, Homo sapiens
gcagacagcagctc

SEQ ID NO: 4685618 - DNA, 19 bp, Homo sapiens
gcagacagcagctcaggca

SEQ ID NO: 4685619 - DNA, 21 bp, Homo sapiens
gcagacagcagctcaggcaca

SEQ ID NO: 4685620 - DNA, 14 bp, Homo sapiens
gcagggtcaggaga

SEQ ID NO: 4685621 - DNA, 13 bp, Homo sapiens
ggcctcggagcct

SEQ ID NO: 4685622 - DNA, 22 bp, Homo sapiens
ggccttcggcctccatcctgag

SEQ ID NO: 4685623 - DNA, 15 bp, Homo sapiens
ggcctttttcattta

SEQ ID NO: 4685624 - DNA, 12 bp, Homo sapiens
ggctcagcctgg

SEQ ID NO: 4685625 - DNA, 13 bp, Homo sapiens
ggctcagcctggt

SEQ ID NO: 4685626 - DNA, 16 bp, Homo sapiens
ggctccacttggtctg

SEQ ID NO: 4685627 - DNA, 19 bp, Homo sapiens
ggctctaattcacagtgct

SEQ ID NO: 4685628 - DNA, 16 bp, Homo sapiens
ggcttagaccctcatg

SEQ ID NO: 4685629 - DNA, 17 bp, Homo sapiens
gggaggacgctctctgg

SEQ ID NO: 4685630 - DNA, 17 bp, Homo sapiens
gggcctcggagcctcat

SEQ ID NO: 4685631 - DNA, 11 bp, Homo sapiens
gggctcagcct

SEQ ID NO: 4685632 - DNA, 12 bp, Homo sapiens
gggctcagcctg

SEQ ID NO: 4685633 - DNA, 13 bp, Homo sapiens
gggctcagcctgg

SEQ ID NO: 4685634 - DNA, 20 bp, Homo sapiens
gggctcagcctggtgggcct

SEQ ID NO: 4685635 - DNA, 22 bp, Homo sapiens
ggggtaaaattccttagcttag

SEQ ID NO: 4685636 - DNA, 21 bp, Homo sapiens
gggtagccactggactgacga

SEQ ID NO: 4685637 - DNA, 12 bp, Homo sapiens
gggtaggcggga

SEQ ID NO: 4685638 - DNA, 19 bp, Homo sapiens
gggtccttttgacactgct

SEQ ID NO: 4685639 - DNA, 22 bp, Homo sapiens
gggtccttttgacactgctcta

SEQ ID NO: 4685640 - DNA, 21 bp, Homo sapiens
gggtgccccccttgccagaca

SEQ ID NO: 4685641 - DNA, 22 bp, Homo sapiens
ggtcaggagaggggcagaacag

SEQ ID NO: 4685642 - DNA, 16 bp, Homo sapiens
ggtccttttgacactg

SEQ ID NO: 4685643 - DNA, 20 bp, Homo sapiens
ggtgatttagcaggaagctg

SEQ ID NO: 4685644 - DNA, 12 bp, Homo sapiens
ggtttctagcat

SEQ ID NO: 4685645 - DNA, 14 bp, Homo sapiens
gtaaataggaattg

SEQ ID NO: 4685646 - DNA, 14 bp, Homo sapiens
gtaactactttata

SEQ ID NO: 4685647 - DNA, 13 bp, Homo sapiens
gtaataaactcat

SEQ ID NO: 4685648 - DNA, 20 bp, Homo sapiens
gtacagaattctgctacctc

SEQ ID NO: 4685649 - DNA, 20 bp, Homo sapiens
gtagtattttttgtataatt

SEQ ID NO: 4685650 - DNA, 23 bp, Homo sapiens
gtagtattttttgtataattgga

SEQ ID NO: 4685651 - DNA, 18 bp, Homo sapiens
gtataattggatttccta

SEQ ID NO: 4685652 - DNA, 14 bp, Homo sapiens
gtatttagaagcca

SEQ ID NO: 4685653 - DNA, 21 bp, Homo sapiens
gtatttggaaataaagtcaga

SEQ ID NO: 4685654 - DNA, 20 bp, Homo sapiens
gtcaaggcttagaccctcat

SEQ ID NO: 4685655 - DNA, 14 bp, Homo sapiens
gtcactttttctga

SEQ ID NO: 4685656 - DNA, 14 bp, Homo sapiens
gtcatcttgctacc

SEQ ID NO: 4685657 - DNA, 18 bp, Homo sapiens
gtcatcttgctaccagta

SEQ ID NO: 4685658 - DNA, 22 bp, Homo sapiens
gtcatcttgctaccagtattta

SEQ ID NO: 4685659 - DNA, 17 bp, Homo sapiens
gtccagggccctgagct

SEQ ID NO: 4685660 - DNA, 21 bp, Homo sapiens
gtcctgtcggagccctgtctc

SEQ ID NO: 4685661 - DNA, 16 bp, Homo sapiens
gtccttttgacactgc

SEQ ID NO: 4685662 - DNA, 19 bp, Homo sapiens
gtccttttgacactgctct

SEQ ID NO: 4685663 - DNA, 16 bp, Homo sapiens
gtctgccagccagcag

SEQ ID NO: 4685664 - DNA, 17 bp, Homo sapiens
gtctgccagccagcagc

SEQ ID NO: 4685665 - DNA, 18 bp, Homo sapiens
gtctgccagccagcagcc

SEQ ID NO: 4685666 - DNA, 15 bp, Homo sapiens
gtctggcccaccagg

SEQ ID NO: 4685667 - DNA, 23 bp, Homo sapiens
gtctgtgagatgctagaactccc

SEQ ID NO: 4685668 - DNA, 12 bp, Homo sapiens
gtcttcagccta

SEQ ID NO: 4685669 - DNA, 13 bp, Homo sapiens
gtcttcagcctag

SEQ ID NO: 4685670 - DNA, 21 bp, Homo sapiens
gtgaattaggctgtaactact

SEQ ID NO: 4685671 - DNA, 22 bp, Homo sapiens
gtgaattaggctgtaactactt

SEQ ID NO: 4685672 - DNA, 15 bp, Homo sapiens
tcagaagtcatcttg

SEQ ID NO: 4685673 - DNA, 17 bp, Homo sapiens
tcagagactcagggccc

SEQ ID NO: 4685674 - DNA, 12 bp, Homo sapiens
tcagatggaaaa

SEQ ID NO: 4685675 - DNA, 19 bp, Homo sapiens
tcagatggaaaattcattt

SEQ ID NO: 4685676 - DNA, 21 bp, Homo sapiens
tcagcctagccgacctcagcc

SEQ ID NO: 4685677 - DNA, 16 bp, Homo sapiens
tcagcctgtgctgccc

SEQ ID NO: 4685678 - DNA, 23 bp, Homo sapiens
tcagccttccccttgcccagggc

SEQ ID NO: 4685679 - DNA, 17 bp, Homo sapiens
tcaggagaggggcagaa

SEQ ID NO: 4685680 - DNA, 20 bp, Homo sapiens
tcagtctctcttctctccag

SEQ ID NO: 4685681 - DNA, 18 bp, Homo sapiens
tcatcctcaaagaaagtg

SEQ ID NO: 4685682 - DNA, 23 bp, Homo sapiens
tcatcctcaaagaaagtgtattg

SEQ ID NO: 4685683 - DNA, 22 bp, Homo sapiens
tcatcttgctaccagtatttag

SEQ ID NO: 4685684 - DNA, 12 bp, Homo sapiens
tcatgcagctgt

SEQ ID NO: 4685685 - DNA, 17 bp, Homo sapiens
tcatgctgccaatatcc

SEQ ID NO: 4685686 - DNA, 21 bp, Homo sapiens
tcatgctgccaatatcctaat

SEQ ID NO: 4685687 - DNA, 12 bp, Homo sapiens
tcatttatctat

SEQ ID NO: 4685688 - DNA, 16 bp, Homo sapiens
tcatttatctataatt

SEQ ID NO: 4685689 - DNA, 20 bp, Homo sapiens
tccaactactaatagaataa

SEQ ID NO: 4685690 - DNA, 12 bp, Homo sapiens
tccacttggtct

SEQ ID NO: 4685691 - DNA, 14 bp, Homo sapiens
tccagctgactaaa

SEQ ID NO: 4685692 - DNA, 13 bp, Homo sapiens
tccagggccctga

SEQ ID NO: 4685693 - DNA, 17 bp, Homo sapiens
tccaggttccctcccag

SEQ ID NO: 4685694 - DNA, 20 bp, Homo sapiens
tccaggttccctcccagagg

SEQ ID NO: 4685695 - DNA, 11 bp, Homo sapiens
tccatcctgag

SEQ ID NO: 4685696 - DNA, 19 bp, Homo sapiens
tccatcctgaggctccact

SEQ ID NO: 4685697 - DNA, 13 bp, Homo sapiens
tcccacctgacac

SEQ ID NO: 4685698 - DNA, 23 bp, Homo sapiens
tcccacctgacacaccaggcgct

SEQ ID NO: 4685699 - DNA, 20 bp, Homo sapiens
tccccttgcccagggctcag

SEQ ID NO: 4685700 - DNA, 22 bp, Homo sapiens
tccccttgcccagggctcagcc

SEQ ID NO: 4685701 - DNA, 14 bp, Homo sapiens
tcctaatactgtca

SEQ ID NO: 4685702 - DNA, 15 bp, Homo sapiens
tcctcaaagaaagtg

SEQ ID NO: 4685703 - DNA, 16 bp, Homo sapiens
tcctcaaagaaagtgt

SEQ ID NO: 4685704 - DNA, 14 bp, Homo sapiens
tcctcactgtatcc

SEQ ID NO: 4685705 - DNA, 13 bp, Homo sapiens
tcctctgtccagg

SEQ ID NO: 4685706 - DNA, 21 bp, Homo sapiens
tcctggggcctcggagcctca

SEQ ID NO: 4685707 - DNA, 22 bp, Homo sapiens
tcctggggcctcggagcctcat

SEQ ID NO: 4685708 - DNA, 12 bp, Homo sapiens
tcctgtctgcca

SEQ ID NO: 4685709 - DNA, 13 bp, Homo sapiens
tcctgtctgccag

SEQ ID NO: 4685710 - DNA, 14 bp, Homo sapiens
tcctgtctgccagc

SEQ ID NO: 4685711 - DNA, 18 bp, Homo sapiens
tccttagcttagacctca

SEQ ID NO: 4685712 - DNA, 20 bp, Homo sapiens
tccttagcttagacctcagc

SEQ ID NO: 4685713 - DNA, 13 bp, Homo sapiens
tccttttgacact

SEQ ID NO: 4685714 - DNA, 24 bp, Homo sapiens
aaaaataaatatatctaccccaga

SEQ ID NO: 4685715 - DNA, 12 bp, Homo sapiens
aaatcagaagtc

SEQ ID NO: 4685716 - DNA, 21 bp, Homo sapiens
aaatcagaagtcatcttgcta

SEQ ID NO: 4685717 - DNA, 18 bp, Homo sapiens
aaatgagtgtgtttgtca

SEQ ID NO: 4685718 - DNA, 16 bp, Homo sapiens
aacactgggggagggg

SEQ ID NO: 4685719 - DNA, 19 bp, Homo sapiens
aacagccctcctctgcact

SEQ ID NO: 4685720 - DNA, 21 bp, Homo sapiens
aacagccgctcctgtctgcca

SEQ ID NO: 4685721 - DNA, 11 bp, Homo sapiens
aactaacatgt

SEQ ID NO: 4685722 - DNA, 14 bp, Homo sapiens
aactaacatgtcct

SEQ ID NO: 4685723 - DNA, 16 bp, Homo sapiens
aactatgattattaac

SEQ ID NO: 4685724 - DNA, 14 bp, Homo sapiens
aactccctttcaac

SEQ ID NO: 4685725 - DNA, 15 bp, Homo sapiens
aagactgtggctgct

SEQ ID NO: 4685726 - DNA, 18 bp, Homo sapiens
aagactgtggctgctagc

SEQ ID NO: 4685727 - DNA, 20 bp, Homo sapiens
aagagaaacagttggtaact

SEQ ID NO: 4685728 - DNA, 17 bp, Homo sapiens
aaggaatttcttaactt

SEQ ID NO: 4685729 - DNA, 20 bp, Homo sapiens
aaggaatttcttaacttctt

SEQ ID NO: 4685730 - DNA, 19 bp, Homo sapiens
aaggagggttagggagggg

SEQ ID NO: 4685731 - DNA, 15 bp, Homo sapiens
aaggcagttttctaa

SEQ ID NO: 4685732 - DNA, 21 bp, Homo sapiens
aagggattttcagccctcaga

SEQ ID NO: 4685733 - DNA, 22 bp, Homo sapiens
aagtcaaggcttagaccctcat

SEQ ID NO: 4685734 - DNA, 14 bp, Homo sapiens
aagtcatcttgcta

SEQ ID NO: 4685735 - DNA, 21 bp, Homo sapiens
aagtgctgtttattaatctta

SEQ ID NO: 4685736 - DNA, 12 bp, Homo sapiens
aataaaaaggtg

SEQ ID NO: 4685737 - DNA, 13 bp, Homo sapiens
aataaaaaggtga

SEQ ID NO: 4685738 - DNA, 15 bp, Homo sapiens
aataaaggcagtttt

SEQ ID NO: 4685739 - DNA, 19 bp, Homo sapiens
aataaaggcagttttctaa

SEQ ID NO: 4685740 - DNA, 15 bp, Homo sapiens
aataaatatatctac

SEQ ID NO: 4685741 - DNA, 14 bp, Homo sapiens
aatatcctaataaa

SEQ ID NO: 4685742 - DNA, 21 bp, Homo sapiens
aatatcctaataaaaaggtga

SEQ ID NO: 4685743 - DNA, 23 bp, Homo sapiens
aatcgctccaccttgcagctctc

SEQ ID NO: 4685744 - DNA, 18 bp, Homo sapiens
aatcttagtgtatgatta

SEQ ID NO: 4685745 - DNA, 23 bp, Homo sapiens
aatcttagtgtatgattactggc

SEQ ID NO: 4685746 - DNA, 21 bp, Homo sapiens
aatgtatgttaccaaaaataa

SEQ ID NO: 4685747 - DNA, 17 bp, Homo sapiens
aattagacactttggaa

SEQ ID NO: 4685748 - DNA, 15 bp, Homo sapiens
aattaggctgtaact

SEQ ID NO: 4685749 - DNA, 16 bp, Homo sapiens
aattaggctgtaacta

SEQ ID NO: 4685750 - DNA, 19 bp, Homo sapiens
aattaggctgtaactactt

SEQ ID NO: 4685751 - DNA, 21 bp, Homo sapiens
aattaggctgtaactacttta

SEQ ID NO: 4685752 - DNA, 17 bp, Homo sapiens
agccgctcctgtctgcc

SEQ ID NO: 4685753 - DNA, 19 bp, Homo sapiens
agcctagccgacctcagcc

SEQ ID NO: 4685754 - DNA, 21 bp, Homo sapiens
agcctggtgggcctcctctgt

SEQ ID NO: 4685755 - DNA, 20 bp, Homo sapiens
agccttccccttgcccaggg

SEQ ID NO: 4685756 - DNA, 22 bp, Homo sapiens
agccttccccttgcccagggct

SEQ ID NO: 4685757 - DNA, 20 bp, Homo sapiens
agctcggtggacccagggat

SEQ ID NO: 4685758 - DNA, 21 bp, Homo sapiens
agctgcaaggtactctggtga

SEQ ID NO: 4685759 - DNA, 18 bp, Homo sapiens
agctgtggcagagttaca

SEQ ID NO: 4685760 - DNA, 16 bp, Homo sapiens
aggacgctctctggcc

SEQ ID NO: 4685761 - DNA, 20 bp, Homo sapiens
aggacgctctctggccttcg

SEQ ID NO: 4685762 - DNA, 17 bp, Homo sapiens
aggagccaccagttctc

SEQ ID NO: 4685763 - DNA, 12 bp, Homo sapiens
aggagtccctgg

SEQ ID NO: 4685764 - DNA, 13 bp, Homo sapiens
aggagtttggcca

SEQ ID NO: 4685765 - DNA, 14 bp, Homo sapiens
aggagtttggccag

SEQ ID NO: 4685766 - DNA, 15 bp, Homo sapiens
aggagtttggccaga

SEQ ID NO: 4685767 - DNA, 16 bp, Homo sapiens
aggagtttggccagaa

SEQ ID NO: 4685768 - DNA, 14 bp, Homo sapiens
aggcaactgaggca

SEQ ID NO: 4685769 - DNA, 16 bp, Homo sapiens
aggcaactgaggcaga

SEQ ID NO: 4685770 - DNA, 15 bp, Homo sapiens
aggcagacagcagct

SEQ ID NO: 4685771 - DNA, 19 bp, Homo sapiens
aggcagacagcagctcagg

SEQ ID NO: 4685772 - DNA, 23 bp, Homo sapiens
aggcagggtcaggagaggggcag

SEQ ID NO: 4685773 - DNA, 12 bp, Homo sapiens
aggcagttttct

SEQ ID NO: 4685774 - DNA, 20 bp, Homo sapiens
aggcatttaggccatgggac

SEQ ID NO: 4685775 - DNA, 11 bp, Homo sapiens
aggctccactt

SEQ ID NO: 4685776 - DNA, 17 bp, Homo sapiens
aggctccacttggtctg

SEQ ID NO: 4685777 - DNA, 21 bp, Homo sapiens
aggctccacttggtctgtgag

SEQ ID NO: 4685778 - DNA, 23 bp, Homo sapiens
agggaggacgctctctggccttc

SEQ ID NO: 4685779 - DNA, 16 bp, Homo sapiens
agggccctgagctcgg

SEQ ID NO: 4685780 - DNA, 12 bp, Homo sapiens
agggctcagcct

SEQ ID NO: 4685781 - DNA, 14 bp, Homo sapiens
agggctcagcctgg

SEQ ID NO: 4685782 - DNA, 23 bp, Homo sapiens
agggtaccttgaacactggggga

SEQ ID NO: 4685783 - DNA, 14 bp, Homo sapiens
agggtcaggagagg

SEQ ID NO: 4685784 - DNA, 15 bp, Homo sapiens
agggtcaggagaggg

SEQ ID NO: 4685785 - DNA, 18 bp, Homo sapiens
agggttcagagactcagg

SEQ ID NO: 4685786 - DNA, 22 bp, Homo sapiens
agtaatttattgtttttccttg

SEQ ID NO: 4685787 - DNA, 16 bp, Homo sapiens
ttcaaggaatttctta

SEQ ID NO: 4685788 - DNA, 15 bp, Homo sapiens
ttcagagactcaggg

SEQ ID NO: 4685789 - DNA, 21 bp, Homo sapiens
ttcagagactcagggccccag

SEQ ID NO: 4685790 - DNA, 15 bp, Homo sapiens
ttcagccctcagaat

SEQ ID NO: 4685791 - DNA, 22 bp, Homo sapiens
ttcagcctagccgacctcagcc

SEQ ID NO: 4685792 - DNA, 23 bp, Homo sapiens
ttcagcctagccgacctcagcct

SEQ ID NO: 4685793 - DNA, 13 bp, Homo sapiens
ttcatgcagctgt

SEQ ID NO: 4685794 - DNA, 15 bp, Homo sapiens
ttcatgcagctgtgg

SEQ ID NO: 4685795 - DNA, 18 bp, Homo sapiens
ttccaactactaatagaa

SEQ ID NO: 4685796 - DNA, 19 bp, Homo sapiens
ttccctcccagaggagcca

SEQ ID NO: 4685797 - DNA, 20 bp, Homo sapiens
ttccttagcttagacctcag

SEQ ID NO: 4685798 - DNA, 21 bp, Homo sapiens
ttccttagcttagacctcagc

SEQ ID NO: 4685799 - DNA, 22 bp, Homo sapiens
ttccttagcttagacctcagcc

SEQ ID NO: 4685800 - DNA, 23 bp, Homo sapiens
ttccttagcttagacctcagcct

SEQ ID NO: 4685801 - DNA, 17 bp, Homo sapiens
ttcggccccatgtatct

SEQ ID NO: 4685802 - DNA, 18 bp, Homo sapiens
ttcggcctccatcctgag

SEQ ID NO: 4685803 - DNA, 11 bp, Homo sapiens
ttctgtaccag

SEQ ID NO: 4685804 - DNA, 19 bp, Homo sapiens
ttcttgcttctttctagaa

SEQ ID NO: 4685805 - DNA, 12 bp, Homo sapiens
ttctttctagaa

SEQ ID NO: 4685806 - DNA, 20 bp, Homo sapiens
ttgaacaagttgtttcattg

SEQ ID NO: 4685807 - DNA, 13 bp, Homo sapiens
ttgaacactgggg

SEQ ID NO: 4685808 - DNA, 14 bp, Homo sapiens
ttgaaggatgctgt

SEQ ID NO: 4685809 - DNA, 16 bp, Homo sapiens
ttgaaggatgctgtct

SEQ ID NO: 4685810 - DNA, 21 bp, Homo sapiens
ttgaaggatgctgtcttcgta

SEQ ID NO: 4685811 - DNA, 16 bp, Homo sapiens
ttgacactgctctaac

SEQ ID NO: 4685812 - DNA, 14 bp, Homo sapiens
ttgcagagacagga

SEQ ID NO: 4685813 - DNA, 18 bp, Homo sapiens
ttgcagattcatttttct

SEQ ID NO: 4685814 - DNA, 23 bp, Homo sapiens
ttgcagctctccccttctctgta

SEQ ID NO: 4685815 - DNA, 17 bp, Homo sapiens
ttgcccagggctcagcc

SEQ ID NO: 4685816 - DNA, 19 bp, Homo sapiens
ttgcccagggctcagcctg

SEQ ID NO: 4685817 - DNA, 16 bp, Homo sapiens
ttgctaccagtattta

SEQ ID NO: 4685818 - DNA, 13 bp, Homo sapiens
ttggaaataaagt

SEQ ID NO: 4685819 - DNA, 21 bp, Homo sapiens
ttggatttcctaatactgtca

SEQ ID NO: 4685820 - DNA, 13 bp, Homo sapiens
ttggcccaggagt

SEQ ID NO: 4685821 - DNA, 15 bp, Homo sapiens
ttggcccaggagttt

SEQ ID NO: 4685822 - DNA, 20 bp, Homo sapiens
ttggcccaggagtttggcca

SEQ ID NO: 4685823 - DNA, 22 bp, Homo sapiens
ttggcccaggagtttggccaga

SEQ ID NO: 4685824 - DNA, 16 bp, Homo sapiens
ttggtctgtgagatgc

SEQ ID NO: 4685825 - DNA, 14 bp, Homo sapiens
ttgtcactttttct

SEQ ID NO: 4685826 - DNA, 20 bp, Homo sapiens
attcacagtgctcttttctc

SEQ ID NO: 4685827 - DNA, 17 bp, Homo sapiens
attcattttttaaattc

SEQ ID NO: 4685828 - DNA, 19 bp, Homo sapiens
attctgctacctcactggg

SEQ ID NO: 4685829 - DNA, 22 bp, Homo sapiens
attgaacaagttgtttcattga

SEQ ID NO: 4685830 - DNA, 17 bp, Homo sapiens
attgaaggatgctgtct

SEQ ID NO: 4685831 - DNA, 22 bp, Homo sapiens
attggatttcctaatactgtca

SEQ ID NO: 4685832 - DNA, 19 bp, Homo sapiens
attggggaagactgtggct

SEQ ID NO: 4685833 - DNA, 18 bp, Homo sapiens
attgtgtgttatttaaat

SEQ ID NO: 4685834 - DNA, 21 bp, Homo sapiens
atttagaagccaactatgatt

SEQ ID NO: 4685835 - DNA, 21 bp, Homo sapiens
atttcctaatactgtcatcct

SEQ ID NO: 4685836 - DNA, 22 bp, Homo sapiens
atttgcagagacaggacctgac

SEQ ID NO: 4685837 - DNA, 22 bp, Homo sapiens
atttggaaataaagtcagatgg

SEQ ID NO: 4685838 - DNA, 22 bp, Homo sapiens
attttgaagtgctgtttattaa

SEQ ID NO: 4685839 - DNA, 21 bp, Homo sapiens
attttgttggcatagctctgg

SEQ ID NO: 4685840 - DNA, 13 bp, Homo sapiens
atttttccaacta

SEQ ID NO: 4685841 - DNA, 13 bp, Homo sapiens
caaacccagtgtt

SEQ ID NO: 4685842 - DNA, 14 bp, Homo sapiens
caaactgaagccag

SEQ ID NO: 4685843 - DNA, 15 bp, Homo sapiens
caaactgaagccaga

SEQ ID NO: 4685844 - DNA, 13 bp, Homo sapiens
caaagaaagtgta

SEQ ID NO: 4685845 - DNA, 16 bp, Homo sapiens
caaagagttaatatat

SEQ ID NO: 4685846 - DNA, 21 bp, Homo sapiens
caacccgtctggcccaccagg

SEQ ID NO: 4685847 - DNA, 15 bp, Homo sapiens
caactactaatagaa

SEQ ID NO: 4685848 - DNA, 23 bp, Homo sapiens
caactggggtgggtggggcagtg

SEQ ID NO: 4685849 - DNA, 12 bp, Homo sapiens
caaggaatttct

SEQ ID NO: 4685850 - DNA, 23 bp, Homo sapiens
caaggaatttcttaacttcttgc

SEQ ID NO: 4685851 - DNA, 19 bp, Homo sapiens
caagggttcagagactcag

SEQ ID NO: 4685852 - DNA, 15 bp, Homo sapiens
caatatcctaataaa

SEQ ID NO: 4685853 - DNA, 20 bp, Homo sapiens
caatatcctaataaaaaggt

SEQ ID NO: 4685854 - DNA, 13 bp, Homo sapiens
cacacacaggcaa

SEQ ID NO: 4685855 - DNA, 16 bp, Homo sapiens
cacacaggcaactgag

SEQ ID NO: 4685856 - DNA, 19 bp, Homo sapiens
cacacaggcaactgaggca

SEQ ID NO: 4685857 - DNA, 18 bp, Homo sapiens
cacaccaggcgctaattc

SEQ ID NO: 4685858 - DNA, 23 bp, Homo sapiens
cacactgtagcattacagtgggt

SEQ ID NO: 4685859 - DNA, 14 bp, Homo sapiens
cacaggcaactgag

SEQ ID NO: 4685860 - DNA, 20 bp, Homo sapiens
cacaggcaactgaggcagac

SEQ ID NO: 4685861 - DNA, 18 bp, Homo sapiens
cacagtgctcttttctcc

SEQ ID NO: 4685862 - DNA, 23 bp, Homo sapiens
caccaggcgctaattcaaggaat

SEQ ID NO: 4685863 - DNA, 11 bp, Homo sapiens
caccagttctc

SEQ ID NO: 4685864 - DNA, 16 bp, Homo sapiens
cacctgacacaccagg

SEQ ID NO: 4685865 - DNA, 13 bp, Homo sapiens
cactaaagcagtg

SEQ ID NO: 4685866 - DNA, 18 bp, Homo sapiens
cactcagtctctcttctc

SEQ ID NO: 4685867 - DNA, 19 bp, Homo sapiens
cactgctctaacagccctc

SEQ ID NO: 4685868 - DNA, 18 bp, Homo sapiens
cactgggggaggggacat

SEQ ID NO: 4685869 - DNA, 15 bp, Homo sapiens
cactggggtcctggg

SEQ ID NO: 4685870 - DNA, 15 bp, Homo sapiens
cacttaatgtatgtt

SEQ ID NO: 4685871 - DNA, 23 bp, Homo sapiens
cacttcttcttggtcttatttat

SEQ ID NO: 4685872 - DNA, 17 bp, Homo sapiens
cacttggtctgtgagat

SEQ ID NO: 4685873 - DNA, 14 bp, Homo sapiens
cagaagtcatcttg

SEQ ID NO: 4685874 - DNA, 17 bp, Homo sapiens
cagaagtcatcttgcta

SEQ ID NO: 4685875 - DNA, 23 bp, Homo sapiens
cagaattctgctacctcactggg

SEQ ID NO: 4685876 - DNA, 17 bp, Homo sapiens
cagacagcagctcaggc

SEQ ID NO: 4685877 - DNA, 18 bp, Homo sapiens
cagacagcagctcaggca

SEQ ID NO: 4685878 - DNA, 18 bp, Homo sapiens
cagacatgtggtgggaca

SEQ ID NO: 4685879 - DNA, 15 bp, Homo sapiens
cagactagatgtagt

SEQ ID NO: 4685880 - DNA, 21 bp, Homo sapiens
cagactagatgtagtattttt

SEQ ID NO: 4685881 - DNA, 23 bp, Homo sapiens
cagagactcagggccccagcact

SEQ ID NO: 4685882 - DNA, 14 bp, Homo sapiens
cagagttacagttc

SEQ ID NO: 4685883 - DNA, 17 bp, Homo sapiens
cagatgcacatgagctg

SEQ ID NO: 4685884 - DNA, 21 bp, Homo sapiens
cagatggaaaattcatttttt

SEQ ID NO: 4685885 - DNA, 14 bp, Homo sapiens
cagcactaaagcag

SEQ ID NO: 4685886 - DNA, 17 bp, Homo sapiens
cagcagccagctctcag

SEQ ID NO: 4685887 - DNA, 19 bp, Homo sapiens
cagcagccagctctcagcc

SEQ ID NO: 4685888 - DNA, 15 bp, Homo sapiens
cagcagctcaggcac

SEQ ID NO: 4685889 - DNA, 11 bp, Homo sapiens
cagccagcagc

SEQ ID NO: 4685890 - DNA, 14 bp, Homo sapiens
cagccagcagccag

SEQ ID NO: 4685891 - DNA, 15 bp, Homo sapiens
cagccagcagccagc

SEQ ID NO: 4685892 - DNA, 18 bp, Homo sapiens
cagccagcagccagctct

SEQ ID NO: 4685893 - DNA, 15 bp, Homo sapiens
cagccagctctcagc

SEQ ID NO: 4685894 - DNA, 17 bp, Homo sapiens
cagccagctctcagcca

SEQ ID NO: 4685895 - DNA, 18 bp, Homo sapiens
cagccctcctctgcactc

SEQ ID NO: 4685896 - DNA, 23 bp, Homo sapiens
cagcccttatgcggttaattttg

SEQ ID NO: 4685897 - DNA, 17 bp, Homo sapiens
cagcctagccgacctca

SEQ ID NO: 4685898 - DNA, 20 bp, Homo sapiens
cagcctagccgacctcagcc

SEQ ID NO: 4685899 - DNA, 16 bp, Homo sapiens
cagccttccccttgcc

SEQ ID NO: 4685900 - DNA, 21 bp, Homo sapiens
cagccttccccttgcccaggg

SEQ ID NO: 4685901 - DNA, 12 bp, Homo sapiens
cagctcaggcac

SEQ ID NO: 4685902 - DNA, 23 bp, Homo sapiens
cagctcaggcacacttcttcttg

SEQ ID NO: 4685903 - DNA, 12 bp, Homo sapiens
cagctgtggcag

SEQ ID NO: 4685904 - DNA, 17 bp, Homo sapiens
cagctgtggcagagtta

SEQ ID NO: 4685905 - DNA, 22 bp, Homo sapiens
caggaagctgtgagagcagttt

SEQ ID NO: 4685906 - DNA, 13 bp, Homo sapiens
caggacctgacta

SEQ ID NO: 4685907 - DNA, 16 bp, Homo sapiens
caggagtttggccaga

SEQ ID NO: 4685908 - DNA, 17 bp, Homo sapiens
caggagtttggccagaa

SEQ ID NO: 4685909 - DNA, 15 bp, Homo sapiens
caggcaactgaggca

SEQ ID NO: 4685910 - DNA, 16 bp, Homo sapiens
caggcaactgaggcag

SEQ ID NO: 4685911 - DNA, 17 bp, Homo sapiens
caggcaactgaggcaga

SEQ ID NO: 4685912 - DNA, 18 bp, Homo sapiens
caggcaactgaggcagac

SEQ ID NO: 4685913 - DNA, 15 bp, Homo sapiens
caggcacacttcttc

SEQ ID NO: 4685914 - DNA, 15 bp, Homo sapiens
cagggccccagcact

SEQ ID NO: 4685915 - DNA, 16 bp, Homo sapiens
cagggccccagcacta

SEQ ID NO: 4685916 - DNA, 15 bp, Homo sapiens
cagggccctgagctc

SEQ ID NO: 4685917 - DNA, 21 bp, Homo sapiens
cagggccctgagctcggtgga

SEQ ID NO: 4685918 - DNA, 15 bp, Homo sapiens
cagggctcagcctgg

SEQ ID NO: 4685919 - DNA, 19 bp, Homo sapiens
cagggctcagcctggtggg

SEQ ID NO: 4685920 - DNA, 21 bp, Homo sapiens
cagggtccttttgacactgct

SEQ ID NO: 4685921 - DNA, 22 bp, Homo sapiens
cagggtccttttgacactgctc

SEQ ID NO: 4685922 - DNA, 23 bp, Homo sapiens
cagtaccccatggagctgggcta

SEQ ID NO: 4685923 - DNA, 16 bp, Homo sapiens
cagtatttagaagcca

SEQ ID NO: 4685924 - DNA, 22 bp, Homo sapiens
cagtctctcttctctccagctg

SEQ ID NO: 4685925 - DNA, 13 bp, Homo sapiens
cagtgcttggccc

SEQ ID NO: 4685926 - DNA, 16 bp, Homo sapiens
cttatgcggttaattt

SEQ ID NO: 4685927 - DNA, 17 bp, Homo sapiens
cttatgcggttaatttt

SEQ ID NO: 4685928 - DNA, 22 bp, Homo sapiens
cttcacacacaggcaactgagg

SEQ ID NO: 4685929 - DNA, 13 bp, Homo sapiens
cttcagcctagcc

SEQ ID NO: 4685930 - DNA, 20 bp, Homo sapiens
cttcagcctagccgacctca

SEQ ID NO: 4685931 - DNA, 23 bp, Homo sapiens
cttcagcctagccgacctcagcc

SEQ ID NO: 4685932 - DNA, 19 bp, Homo sapiens
cttccccttgcccagggct

SEQ ID NO: 4685933 - DNA, 20 bp, Homo sapiens
cttcgaaagcatcattattt

SEQ ID NO: 4685934 - DNA, 17 bp, Homo sapiens
cttcggcctccatcctg

SEQ ID NO: 4685935 - DNA, 14 bp, Homo sapiens
cttctctccagctg

SEQ ID NO: 4685936 - DNA, 20 bp, Homo sapiens
cttcttgcttctttctagaa

SEQ ID NO: 4685937 - DNA, 16 bp, Homo sapiens
cttgagtgctcagtag

SEQ ID NO: 4685938 - DNA, 22 bp, Homo sapiens
cttgcagctctccccttctctg

SEQ ID NO: 4685939 - DNA, 19 bp, Homo sapiens
cttgcccagggctcagcct

SEQ ID NO: 4685940 - DNA, 20 bp, Homo sapiens
cttgcccagggctcagcctg

SEQ ID NO: 4685941 - DNA, 23 bp, Homo sapiens
cttgcccagggctcagcctggtg

SEQ ID NO: 4685942 - DNA, 20 bp, Homo sapiens
cttgctaccagtatttagaa

SEQ ID NO: 4685943 - DNA, 21 bp, Homo sapiens
cttgctgcaagcacagccctt

SEQ ID NO: 4685944 - DNA, 15 bp, Homo sapiens
cttgcttctttctag

SEQ ID NO: 4685945 - DNA, 19 bp, Homo sapiens
cttgcttctttctagaaag

SEQ ID NO: 4685946 - DNA, 16 bp, Homo sapiens
cttggcccaggagttt

SEQ ID NO: 4685947 - DNA, 18 bp, Homo sapiens
ctttataactaacatgtc

SEQ ID NO: 4685948 - DNA, 22 bp, Homo sapiens
ctttctagaaagagaaacagtt

SEQ ID NO: 4685949 - DNA, 18 bp, Homo sapiens
cttttgacactgctctaa

SEQ ID NO: 4685950 - DNA, 23 bp, Homo sapiens
ctttttcatttatctataattta

SEQ ID NO: 4685951 - DNA, 12 bp, Homo sapiens
gaaagggatttt

SEQ ID NO: 4685952 - DNA, 21 bp, Homo sapiens
gaacaagttgtttcattgact

SEQ ID NO: 4685953 - DNA, 16 bp, Homo sapiens
gaacactgggggaggg

SEQ ID NO: 4685954 - DNA, 17 bp, Homo sapiens
gaacactgggggagggg

SEQ ID NO: 4685955 - DNA, 18 bp, Homo sapiens
gaacactgggggagggga

SEQ ID NO: 4685956 - DNA, 20 bp, Homo sapiens
gaacactgggggaggggaca

SEQ ID NO: 4685957 - DNA, 18 bp, Homo sapiens
gaacagccgctcctgtct

SEQ ID NO: 4685958 - DNA, 18 bp, Homo sapiens
gaagtcaaggcttagacc

SEQ ID NO: 4685959 - DNA, 15 bp, Homo sapiens
gaagtcatcttgcta

SEQ ID NO: 4685960 - DNA, 17 bp, Homo sapiens
gaataaaggcagttttc

SEQ ID NO: 4685961 - DNA, 23 bp, Homo sapiens
gaattaggctgtaactactttat

SEQ ID NO: 4685962 - DNA, 19 bp, Homo sapiens
gaattctgctacctcactg

SEQ ID NO: 4685963 - DNA, 20 bp, Homo sapiens
gacactgctctaacagccct

SEQ ID NO: 4685964 - DNA, 21 bp, Homo sapiens
gacactgctctaacagccctc

SEQ ID NO: 4685965 - DNA, 13 bp, Homo sapiens
gacagcagctcag

SEQ ID NO: 4685966 - DNA, 20 bp, Homo sapiens
gacagcagctcaggcacact

SEQ ID NO: 4685967 - DNA, 13 bp, Homo sapiens
gacaggacctgac

SEQ ID NO: 4685968 - DNA, 13 bp, Homo sapiens
gacagggacccac

SEQ ID NO: 4685969 - DNA, 22 bp, Homo sapiens
gacatgtggtgggacagggacc

SEQ ID NO: 4685970 - DNA, 21 bp, Homo sapiens
gaccctcatgctgccaatatc

SEQ ID NO: 4685971 - DNA, 23 bp, Homo sapiens
gaccctcatgctgccaatatcct

SEQ ID NO: 4685972 - DNA, 11 bp, Homo sapiens
gacctcagcct

SEQ ID NO: 4685973 - DNA, 13 bp, Homo sapiens
gacctcagcctgt

SEQ ID NO: 4685974 - DNA, 16 bp, Homo sapiens
gacctcagcctgtgct

SEQ ID NO: 4685975 - DNA, 22 bp, Homo sapiens
gactaaactttttttctgtacc

SEQ ID NO: 4685976 - DNA, 17 bp, Homo sapiens
gactagatgtagtattt

SEQ ID NO: 4685977 - DNA, 16 bp, Homo sapiens
gactggatagtccgtc

SEQ ID NO: 4685978 - DNA, 22 bp, Homo sapiens
gagaaacagttggtaacttttg

SEQ ID NO: 4685979 - DNA, 16 bp, Homo sapiens
gagacaggacctgact

SEQ ID NO: 4685980 - DNA, 20 bp, Homo sapiens
gagatgctagaactcccttt

SEQ ID NO: 4685981 - DNA, 13 bp, Homo sapiens
gagccaccagttc

SEQ ID NO: 4685982 - DNA, 12 bp, Homo sapiens
gagccctgtctc

SEQ ID NO: 4685983 - DNA, 19 bp, Homo sapiens
gagcctcatccgaggcagg

SEQ ID NO: 4685984 - DNA, 20 bp, Homo sapiens
gagcctcatccgaggcaggg

SEQ ID NO: 4685985 - DNA, 20 bp, Homo sapiens
gaggacgctctctggccttc

SEQ ID NO: 4685986 - DNA, 21 bp, Homo sapiens
gaggacgctctctggccttcg

SEQ ID NO: 4685987 - DNA, 18 bp, Homo sapiens
gaggagccaccagttctc

SEQ ID NO: 4685988 - DNA, 20 bp, Homo sapiens
gaggcagacagcagctcagg

SEQ ID NO: 4685989 - DNA, 21 bp, Homo sapiens
gaggcagacagcagctcaggc

SEQ ID NO: 4685990 - DNA, 15 bp, Homo sapiens
gaggctccacttggt

SEQ ID NO: 4685991 - DNA, 15 bp, Homo sapiens
gagttacagttctgt

SEQ ID NO: 4685992 - DNA, 16 bp, Homo sapiens
gagttacagttctgtg

SEQ ID NO: 4685993 - DNA, 13 bp, Homo sapiens
gataaaagatggc

SEQ ID NO: 4685994 - DNA, 18 bp, Homo sapiens
gatgctagaactcccttt

SEQ ID NO: 4685995 - DNA, 21 bp, Homo sapiens
gattacaaatcagaagtcatc

SEQ ID NO: 4685996 - DNA, 20 bp, Homo sapiens
gattggggaagactgtggct

SEQ ID NO: 4685997 - DNA, 13 bp, Homo sapiens
gatttcctaatac

SEQ ID NO: 4685998 - DNA, 13 bp, Homo sapiens
gcaactgaggcag

SEQ ID NO: 4685999 - DNA, 15 bp, Homo sapiens
gcaagcacagccctt

SEQ ID NO: 4686000 - DNA, 13 bp, Homo sapiens
gcacactgtctgc

SEQ ID NO: 4686001 - DNA, 21 bp, Homo sapiens
gcacatgagctggcgggattg

SEQ ID NO: 4686002 - DNA, 15 bp, Homo sapiens
gcacgcacactgtct

SEQ ID NO: 4686003 - DNA, 20 bp, Homo sapiens
gcactaaagcagtggacacc

SEQ ID NO: 4686004 - DNA, 18 bp, Homo sapiens
gcagaacagccgctcctg

SEQ ID NO: 4686005 - DNA, 17 bp, Homo sapiens
gcagagacaggacctga

SEQ ID NO: 4686006 - DNA, 18 bp, Homo sapiens
gcagagttacagttctgt

SEQ ID NO: 4686007 - DNA, 20 bp, Homo sapiens
gcagagttacagttctgtgg

SEQ ID NO: 4686008 - DNA, 19 bp, Homo sapiens
gcagattcatttttctttc

SEQ ID NO: 4686009 - DNA, 13 bp, Homo sapiens
gcagccagctctc

SEQ ID NO: 4686010 - DNA, 17 bp, Homo sapiens
gcagccagctctcagcc

SEQ ID NO: 4686011 - DNA, 15 bp, Homo sapiens
gcagctctccccttc

SEQ ID NO: 4686012 - DNA, 15 bp, Homo sapiens
gcagtggacaccagg

SEQ ID NO: 4686013 - DNA, 14 bp, Homo sapiens
gcataacctgtctc

SEQ ID NO: 4686014 - DNA, 17 bp, Homo sapiens
gccaatatcctaataaa

SEQ ID NO: 4686015 - DNA, 18 bp, Homo sapiens
gccaatatcctaataaaa

SEQ ID NO: 4686016 - DNA, 22 bp, Homo sapiens
gccaatatcctaataaaaaggt

SEQ ID NO: 4686017 - DNA, 18 bp, Homo sapiens
gccacttaatgtatgtta

SEQ ID NO: 4686018 - DNA, 12 bp, Homo sapiens
gccagaaataaa

SEQ ID NO: 4686019 - DNA, 16 bp, Homo sapiens
gccagaagtcaaggct

SEQ ID NO: 4686020 - DNA, 19 bp, Homo sapiens
gccagcagccagctctcag

SEQ ID NO: 4686021 - DNA, 21 bp, Homo sapiens
gccagcagccagctctcagcc

SEQ ID NO: 4686022 - DNA, 23 bp, Homo sapiens
gccagcagccagctctcagccaa

SEQ ID NO: 4686023 - DNA, 13 bp, Homo sapiens
gccagctctcagc

SEQ ID NO: 4686024 - DNA, 22 bp, Homo sapiens
gccatgggacagggaggacgct

SEQ ID NO: 4686025 - DNA, 14 bp, Homo sapiens
tcagagactcaggg

SEQ ID NO: 4686026 - DNA, 19 bp, Homo sapiens
tcagagactcagggcccca

SEQ ID NO: 4686027 - DNA, 12 bp, Homo sapiens
tcagccctcaga

SEQ ID NO: 4686028 - DNA, 18 bp, Homo sapiens
tcagcctggtgggcctcc

SEQ ID NO: 4686029 - DNA, 19 bp, Homo sapiens
tcagcctggtgggcctcct

SEQ ID NO: 4686030 - DNA, 18 bp, Homo sapiens
tcaggagaggggcagaac

SEQ ID NO: 4686031 - DNA, 13 bp, Homo sapiens
tcagtagtcagac

SEQ ID NO: 4686032 - DNA, 14 bp, Homo sapiens
tcatcctcaaagaa

SEQ ID NO: 4686033 - DNA, 17 bp, Homo sapiens
tcatcctcaaagaaagt

SEQ ID NO: 4686034 - DNA, 22 bp, Homo sapiens
tcatcctcaaagaaagtgtatt

SEQ ID NO: 4686035 - DNA, 17 bp, Homo sapiens
tcatcttgctaccagta

SEQ ID NO: 4686036 - DNA, 21 bp, Homo sapiens
tcatcttgctaccagtattta

SEQ ID NO: 4686037 - DNA, 20 bp, Homo sapiens
tcatgctgccaatatcctaa

SEQ ID NO: 4686038 - DNA, 15 bp, Homo sapiens
tcatgttagttacct

SEQ ID NO: 4686039 - DNA, 23 bp, Homo sapiens
tcatgttagttaccttatagtta

SEQ ID NO: 4686040 - DNA, 23 bp, Homo sapiens
tccaacccgtctggcccaccagg

SEQ ID NO: 4686041 - DNA, 14 bp, Homo sapiens
tccacttggtctgt

SEQ ID NO: 4686042 - DNA, 17 bp, Homo sapiens
tccacttggtctgtgag

SEQ ID NO: 4686043 - DNA, 21 bp, Homo sapiens
tccacttggtctgtgagatgc

SEQ ID NO: 4686044 - DNA, 21 bp, Homo sapiens
tccagctgactaaactttttt

SEQ ID NO: 4686045 - DNA, 16 bp, Homo sapiens
tccagggccctgagct

SEQ ID NO: 4686046 - DNA, 18 bp, Homo sapiens
tccaggttccctcccaga

SEQ ID NO: 4686047 - DNA, 20 bp, Homo sapiens
tccatcctgaggctccactt

SEQ ID NO: 4686048 - DNA, 19 bp, Homo sapiens
tcccacctgacacaccagg

SEQ ID NO: 4686049 - DNA, 15 bp, Homo sapiens
tccccttgcccaggg

SEQ ID NO: 4686050 - DNA, 12 bp, Homo sapiens
tccgaggcaggg

SEQ ID NO: 4686051 - DNA, 13 bp, Homo sapiens
tccgaggcagggt

SEQ ID NO: 4686052 - DNA, 14 bp, Homo sapiens
tcctaataaaaagg

SEQ ID NO: 4686053 - DNA, 15 bp, Homo sapiens
tcctaataaaaaggt

SEQ ID NO: 4686054 - DNA, 18 bp, Homo sapiens
tcctcaaagaaagtgtat

SEQ ID NO: 4686055 - DNA, 23 bp, Homo sapiens
tcctctgtccagggccctgagct

SEQ ID NO: 4686056 - DNA, 16 bp, Homo sapiens
tcctgaggctccactt

SEQ ID NO: 4686057 - DNA, 23 bp, Homo sapiens
tcctggtcccctcagctctgcct

SEQ ID NO: 4686058 - DNA, 16 bp, Homo sapiens
tcctgtctgccagcca

SEQ ID NO: 4686059 - DNA, 22 bp, Homo sapiens
tcctgtctgccagccagcagcc

SEQ ID NO: 4686060 - DNA, 21 bp, Homo sapiens
tccttagcttagacctcagcc

SEQ ID NO: 4686061 - DNA, 22 bp, Homo sapiens
tccttagcttagacctcagcct

SEQ ID NO: 4686062 - DNA, 23 bp, Homo sapiens
tccttagcttagacctcagcctg

SEQ ID NO: 4686063 - DNA, 14 bp, Homo sapiens
tccttttgacactg

SEQ ID NO: 4686064 - DNA, 16 bp, Homo sapiens
tccttttgacactgct

SEQ ID NO: 4686065 - DNA, 18 bp, Homo sapiens
tccttttgacactgctct

SEQ ID NO: 4686066 - DNA, 20 bp, Homo sapiens
tccttttgacactgctctaa

SEQ ID NO: 4686067 - DNA, 18 bp, Homo sapiens
tcgctccaccttgcagct

SEQ ID NO: 4686068 - DNA, 22 bp, Homo sapiens
tcggagcctcatccgaggcagg

SEQ ID NO: 4686069 - DNA, 23 bp, Homo sapiens
tcggagcctcatccgaggcaggg

SEQ ID NO: 4686070 - DNA, 16 bp, Homo sapiens
tctaccccagactaga

SEQ ID NO: 4686071 - DNA, 17 bp, Homo sapiens
tctcatgggtggcactc

SEQ ID NO: 4686072 - DNA, 14 bp, Homo sapiens
tctccagctgacta

SEQ ID NO: 4686073 - DNA, 15 bp, Homo sapiens
tctcctcactgtatc

SEQ ID NO: 4686074 - DNA, 19 bp, Homo sapiens
tctctccagctgactaaac

SEQ ID NO: 4686075 - DNA, 22 bp, Homo sapiens
tctctggccttcggcctccatc

SEQ ID NO: 4686076 - DNA, 13 bp, Homo sapiens
tctgccagccagc

SEQ ID NO: 4686077 - DNA, 16 bp, Homo sapiens
tctgccagccagcagc

SEQ ID NO: 4686078 - DNA, 17 bp, Homo sapiens
tctgccagccagcagcc

SEQ ID NO: 4686079 - DNA, 17 bp, Homo sapiens
tctgctacctcactggg

SEQ ID NO: 4686080 - DNA, 10 bp, Homo sapiens
tctggccttc

SEQ ID NO: 4686081 - DNA, 15 bp, Homo sapiens
tctggctctaattca

SEQ ID NO: 4686082 - DNA, 17 bp, Homo sapiens
tctggggtgggcagttt

SEQ ID NO: 4686083 - DNA, 19 bp, Homo sapiens
tctgtaataaactcatttc

SEQ ID NO: 4686084 - DNA, 14 bp, Homo sapiens
tctgtcagctgcaa

SEQ ID NO: 4686085 - DNA, 19 bp, Homo sapiens
tctgtccagggccctgagc

SEQ ID NO: 4686086 - DNA, 20 bp, Homo sapiens
tctgtccagggccctgagct

SEQ ID NO: 4686087 - DNA, 12 bp, Homo sapiens
tcttaacttctt

SEQ ID NO: 4686088 - DNA, 14 bp, Homo sapiens
tcttagtgtatgat

SEQ ID NO: 4686089 - DNA, 14 bp, Homo sapiens
tcttctctccagct

SEQ ID NO: 4686090 - DNA, 13 bp, Homo sapiens
tcttgctaccagt

SEQ ID NO: 4686091 - DNA, 17 bp, Homo sapiens
tcttgcttctttctaga

SEQ ID NO: 4686092 - DNA, 16 bp, Homo sapiens
tgaaaatgggctcaac

SEQ ID NO: 4686093 - DNA, 22 bp, Homo sapiens
tgaacaagttgtttcattgact

SEQ ID NO: 4686094 - DNA, 14 bp, Homo sapiens
tgaacactggggga

SEQ ID NO: 4686095 - DNA, 19 bp, Homo sapiens
tgacactgctctaacagcc

SEQ ID NO: 4686096 - DNA, 16 bp, Homo sapiens
tgacatgtccctacac

SEQ ID NO: 4686097 - DNA, 12 bp, Homo sapiens
tgactaaacttt

SEQ ID NO: 4686098 - DNA, 18 bp, Homo sapiens
tgactaaactttttttct

SEQ ID NO: 4686099 - DNA, 16 bp, Homo sapiens
tgagatgctagaactc

SEQ ID NO: 4686100 - DNA, 20 bp, Homo sapiens
tgagctcggtggacccaggg

SEQ ID NO: 4686101 - DNA, 16 bp, Homo sapiens
tgaggcagacagcagc

SEQ ID NO: 4686102 - DNA, 23 bp, Homo sapiens
tgaggcagacagcagctcaggca

SEQ ID NO: 4686103 - DNA, 20 bp, Homo sapiens
tgattactggcctttttcat

SEQ ID NO: 4686104 - DNA, 15 bp, Homo sapiens
tgcaagcacagccct

SEQ ID NO: 4686105 - DNA, 16 bp, Homo sapiens
tgcaaggtactctggt

SEQ ID NO: 4686106 - DNA, 14 bp, Homo sapiens
tgcactcccacctg

SEQ ID NO: 4686107 - DNA, 15 bp, Homo sapiens
tgcactcccacctga

SEQ ID NO: 4686108 - DNA, 17 bp, Homo sapiens
tgcagagacaggacctg

SEQ ID NO: 4686109 - DNA, 22 bp, Homo sapiens
tgcagctctccccttctctgta

SEQ ID NO: 4686110 - DNA, 20 bp, Homo sapiens
tgcagctgtggcagagttac

SEQ ID NO: 4686111 - DNA, 14 bp, Homo sapiens
tgccaatatcctaa

SEQ ID NO: 4686112 - DNA, 16 bp, Homo sapiens
tgccaatatcctaata

SEQ ID NO: 4686113 - DNA, 17 bp, Homo sapiens
tgccaatatcctaataa

SEQ ID NO: 4686114 - DNA, 18 bp, Homo sapiens
tgccaatatcctaataaa

SEQ ID NO: 4686115 - DNA, 17 bp, Homo sapiens
tgccacttaatgtatgt

SEQ ID NO: 4686116 - DNA, 18 bp, Homo sapiens
tgccacttaatgtatgtt

SEQ ID NO: 4686117 - DNA, 12 bp, Homo sapiens
tgccagacatgt

SEQ ID NO: 4686118 - DNA, 13 bp, Homo sapiens
tgccagacatgtg

SEQ ID NO: 4686119 - DNA, 17 bp, Homo sapiens
tgccagccagcagccag

SEQ ID NO: 4686120 - DNA, 16 bp, Homo sapiens
tgcccagggctcagcc

SEQ ID NO: 4686121 - DNA, 17 bp, Homo sapiens
tgcccagggctcagcct

SEQ ID NO: 4686122 - DNA, 18 bp, Homo sapiens
tgcccagggctcagcctg

SEQ ID NO: 4686123 - DNA, 17 bp, Homo sapiens
tgcccgtcttcagccta

SEQ ID NO: 4686124 - DNA, 15 bp, Homo sapiens
tgctaccagtattta

SEQ ID NO: 4686125 - DNA, 17 bp, Homo sapiens
tgctagaactccctttc

SEQ ID NO: 4686126 - DNA, 18 bp, Homo sapiens
tgctagaactccctttca

SEQ ID NO: 4686127 - DNA, 20 bp, Homo sapiens
tgctagaactccctttcaac

SEQ ID NO: 4686128 - DNA, 18 bp, Homo sapiens
tgctagcacttggagcca

SEQ ID NO: 4686129 - DNA, 16 bp, Homo sapiens
tgctcagtagtcagac

SEQ ID NO: 4686130 - DNA, 16 bp, Homo sapiens
tgctctaacagccctc

SEQ ID NO: 4686131 - DNA, 23 bp, Homo sapiens
tgctcttttctcctcactgtatc

SEQ ID NO: 4686132 - DNA, 19 bp, Homo sapiens
tgctgccaatatcctaata

SEQ ID NO: 4686133 - DNA, 22 bp, Homo sapiens
tgctgccaatatcctaataaaa

SEQ ID NO: 4686134 - DNA, 14 bp, Homo sapiens
tgctgtttattaat

SEQ ID NO: 4686135 - DNA, 23 bp, Homo sapiens
tgcttggcccaggagtttggcca

SEQ ID NO: 4686136 - DNA, 15 bp, Homo sapiens
tggaaaattcatttt

SEQ ID NO: 4686137 - DNA, 20 bp, Homo sapiens
tggacaccaggagtccctgg

SEQ ID NO: 4686138 - DNA, 14 bp, Homo sapiens
tggcatagctctgg

SEQ ID NO: 4686139 - DNA, 13 bp, Homo sapiens
tggcccaggagtt

SEQ ID NO: 4686140 - DNA, 17 bp, Homo sapiens
tggccttcggcctccat

SEQ ID NO: 4686141 - DNA, 18 bp, Homo sapiens
tggccttcggcctccatc

SEQ ID NO: 4686142 - DNA, 16 bp, Homo sapiens
tggcctttttcattta

SEQ ID NO: 4686143 - DNA, 13 bp, Homo sapiens
tggctgctagcac

SEQ ID NO: 4686144 - DNA, 14 bp, Homo sapiens
tggctgctagcact

SEQ ID NO: 4686145 - DNA, 15 bp, Homo sapiens
tggctgctagcactt

SEQ ID NO: 4686146 - DNA, 20 bp, Homo sapiens
tgggcctcctctgtccaggg

SEQ ID NO: 4686147 - DNA, 14 bp, Homo sapiens
tggggaagactgtg

SEQ ID NO: 4686148 - DNA, 24 bp, Homo sapiens
tggggaagactgtggctgctagca

SEQ ID NO: 4686149 - DNA, 18 bp, Homo sapiens
tggggcagtgcttggccc

SEQ ID NO: 4686150 - DNA, 22 bp, Homo sapiens
tggggcagtgcttggcccagga

SEQ ID NO: 4686151 - DNA, 22 bp, Homo sapiens
tggtctgtgagatgctagaact

SEQ ID NO: 4686152 - DNA, 16 bp, Homo sapiens
tggtttaaagaaagtg

SEQ ID NO: 4686153 - DNA, 21 bp, Homo sapiens
tggtttaaagaaagtgtattt

SEQ ID NO: 4686154 - DNA, 20 bp, Homo sapiens
tgtaataaactcatttctag

SEQ ID NO: 4686155 - DNA, 21 bp, Homo sapiens
tgtaattagtgccacttaatg

SEQ ID NO: 4686156 - DNA, 23 bp, Homo sapiens
tgtaattagtgccacttaatgta

SEQ ID NO: 4686157 - DNA, 21 bp, Homo sapiens
tgtacagaattctgctacctc

SEQ ID NO: 4686158 - DNA, 14 bp, Homo sapiens
tgtaccagttaatt

SEQ ID NO: 4686159 - DNA, 12 bp, Homo sapiens
tgtatgattact

SEQ ID NO: 4686160 - DNA, 23 bp, Homo sapiens
tgtcaaaaatgtcttgggtaggc

SEQ ID NO: 4686161 - DNA, 19 bp, Homo sapiens
tgtcatcctcaaagaaagt

SEQ ID NO: 4686162 - DNA, 23 bp, Homo sapiens
tgtcatcctcaaagaaagtgtat

SEQ ID NO: 4686163 - DNA, 15 bp, Homo sapiens
tgtctgccagccagc

SEQ ID NO: 4686164 - DNA, 19 bp, Homo sapiens
tgtgaattaggctgtaact

SEQ ID NO: 4686165 - DNA, 23 bp, Homo sapiens
tgtgaattaggctgtaactactt

SEQ ID NO: 4686166 - DNA, 19 bp, Homo sapiens
tgtgagatgctagaactcc

SEQ ID NO: 4686167 - DNA, 14 bp, Homo sapiens
tgtgcgtcctgtcg

SEQ ID NO: 4686168 - DNA, 14 bp, Homo sapiens
tgtggcagagttac

SEQ ID NO: 4686169 - DNA, 15 bp, Homo sapiens
tgtggcagagttaca

SEQ ID NO: 4686170 - DNA, 21 bp, Homo sapiens
tgtgtacagaattctgctacc

SEQ ID NO: 4686171 - DNA, 14 bp, Homo sapiens
tgtgttatttaaat

SEQ ID NO: 4686172 - DNA, 15 bp, Homo sapiens
tgttatttaaatgag

SEQ ID NO: 4686173 - DNA, 14 bp, Homo sapiens
tgtttattaatctt

SEQ ID NO: 4686174 - DNA, 17 bp, Homo sapiens
tgtttattaatcttagt

SEQ ID NO: 4686175 - DNA, 21 bp, Homo sapiens
ttaaatatgttagcaaagagt

SEQ ID NO: 4686176 - DNA, 14 bp, Homo sapiens
ttaacgatgtccaa

SEQ ID NO: 4686177 - DNA, 14 bp, Homo sapiens
ttaatcttagtgta

SEQ ID NO: 4686178 - DNA, 18 bp, Homo sapiens
ttaatttttccaactact

SEQ ID NO: 4686179 - DNA, 17 bp, Homo sapiens
ttacaaatcagaagtca

SEQ ID NO: 4686180 - DNA, 11 bp, Homo sapiens
ttacagttctg

SEQ ID NO: 4686181 - DNA, 14 bp, Homo sapiens
ttacctaagattac

SEQ ID NO: 4686182 - DNA, 18 bp, Homo sapiens
ttacctaagattacaaat

SEQ ID NO: 4686183 - DNA, 16 bp, Homo sapiens
ttactgtgtaattagt

SEQ ID NO: 4686184 - DNA, 20 bp, Homo sapiens
ttactgtgtaattagtgcca

SEQ ID NO: 4686185 - DNA, 20 bp, Homo sapiens
ttagaccctcatgctgccaa

SEQ ID NO: 4686186 - DNA, 12 bp, Homo sapiens
ttagacctcagc

SEQ ID NO: 4686187 - DNA, 15 bp, Homo sapiens
ttagacctcagcctg

SEQ ID NO: 4686188 - DNA, 16 bp, Homo sapiens
ttagacctcagcctgt

SEQ ID NO: 4686189 - DNA, 14 bp, Homo sapiens
ttaggctgtaacta

SEQ ID NO: 4686190 - DNA, 20 bp, Homo sapiens
ttaggctgtaactactttat

SEQ ID NO: 4686191 - DNA, 19 bp, Homo sapiens
ttatagttactgtgtaatt

SEQ ID NO: 4686192 - DNA, 14 bp, Homo sapiens
ttatctataattta

SEQ ID NO: 4686193 - DNA, 19 bp, Homo sapiens
ttatgcggttaattttgaa

SEQ ID NO: 4686194 - DNA, 19 bp, Homo sapiens
ttcacgcctgaggcaatta

SEQ ID NO: 4686195 - DNA, 18 bp, Homo sapiens
ttcatgttagttacctta

SEQ ID NO: 4686196 - DNA, 16 bp, Homo sapiens
ttcattgactatcaaa

SEQ ID NO: 4686197 - DNA, 18 bp, Homo sapiens
ttcatttatctataattt

SEQ ID NO: 4686198 - DNA, 14 bp, Homo sapiens
ttcggcctccatcc

SEQ ID NO: 4686199 - DNA, 15 bp, Homo sapiens
ttcggcctccatcct

SEQ ID NO: 4686200 - DNA, 19 bp, Homo sapiens
ttcggcctccatcctgagg

SEQ ID NO: 4686201 - DNA, 18 bp, Homo sapiens
ttctcctcactgtatcca

SEQ ID NO: 4686202 - DNA, 16 bp, Homo sapiens
ttctgctacctcactg

SEQ ID NO: 4686203 - DNA, 21 bp, Homo sapiens
ttctgctacctcactggggtc

SEQ ID NO: 4686204 - DNA, 13 bp, Homo sapiens
ttctttctagaaa

SEQ ID NO: 4686205 - DNA, 14 bp, Homo sapiens
ttgacactgctcta

SEQ ID NO: 4686206 - DNA, 15 bp, Homo sapiens
ttgacactgctctaa

SEQ ID NO: 4686207 - DNA, 22 bp, Homo sapiens
ttgccagacatgtggtgggaca

SEQ ID NO: 4686208 - DNA, 22 bp, Homo sapiens
ttgctaccagtatttagaagcc

SEQ ID NO: 4686209 - DNA, 20 bp, Homo sapiens
ttgctgcaagcacagccctt

SEQ ID NO: 4686210 - DNA, 17 bp, Homo sapiens
ttgcttctttctagaaa

SEQ ID NO: 4686211 - DNA, 22 bp, Homo sapiens
ttggaagatggcataacctgtc

SEQ ID NO: 4686212 - DNA, 12 bp, Homo sapiens
ttggatttccta

SEQ ID NO: 4686213 - DNA, 16 bp, Homo sapiens
ttggcatagctctggg

SEQ ID NO: 4686214 - DNA, 14 bp, Homo sapiens
ttggcccaggagtt

SEQ ID NO: 4686215 - DNA, 15 bp, Homo sapiens
ttggtcttatttatt

SEQ ID NO: 4686216 - DNA, 22 bp, Homo sapiens
ttggtttaaagaaagtgtattt

SEQ ID NO: 4686217 - DNA, 23 bp, Homo sapiens
ttggtttaaagaaagtgtatttg

SEQ ID NO: 4686218 - DNA, 11 bp, Homo sapiens
ttgtataattg

SEQ ID NO: 4686219 - DNA, 19 bp, Homo sapiens
ttgtgaattaggctgtaac

SEQ ID NO: 4686220 - DNA, 23 bp, Homo sapiens
ttgtgaattaggctgtaactact

SEQ ID NO: 4686221 - DNA, 20 bp, Homo sapiens
ttgtttcattgactatcaaa

SEQ ID NO: 4686222 - DNA, 14 bp, Homo sapiens
tttaaagaaagtgt

SEQ ID NO: 4686223 - DNA, 17 bp, Homo sapiens
tttactccgtaacagat

SEQ ID NO: 4686224 - DNA, 22 bp, Homo sapiens
tttagaagccaactatgattat

SEQ ID NO: 4686225 - DNA, 13 bp, Homo sapiens
aaaattcattttt

SEQ ID NO: 4686226 - DNA, 23 bp, Homo sapiens
aaactttttttctgtaccagtta

SEQ ID NO: 4686227 - DNA, 12 bp, Homo sapiens
aaagaaagtgta

SEQ ID NO: 4686228 - DNA, 13 bp, Homo sapiens
aaagaaagtgtat

SEQ ID NO: 4686229 - DNA, 19 bp, Homo sapiens
aaagagaaacagttggtaa

SEQ ID NO: 4686230 - DNA, 16 bp, Homo sapiens
aaaggcagttttctaa

SEQ ID NO: 4686231 - DNA, 15 bp, Homo sapiens
aaagtgtatttggaa

SEQ ID NO: 4686232 - DNA, 17 bp, Homo sapiens
aaattcccgttttgtca

SEQ ID NO: 4686233 - DNA, 23 bp, Homo sapiens
aaattccttagcttagacctcag

SEQ ID NO: 4686234 - DNA, 17 bp, Homo sapiens
aacactgggggagggga

SEQ ID NO: 4686235 - DNA, 14 bp, Homo sapiens
aacagttggtaact

SEQ ID NO: 4686236 - DNA, 15 bp, Homo sapiens
aacccgtctggccca

SEQ ID NO: 4686237 - DNA, 15 bp, Homo sapiens
aactactttataact

SEQ ID NO: 4686238 - DNA, 13 bp, Homo sapiens
aactccctttcaa

SEQ ID NO: 4686239 - DNA, 23 bp, Homo sapiens
aactgacacatgctgaacatcac

SEQ ID NO: 4686240 - DNA, 20 bp, Homo sapiens
aactgaggcagacagcagct

SEQ ID NO: 4686241 - DNA, 20 bp, Homo sapiens
aacttcgaaagcatcattat

SEQ ID NO: 4686242 - DNA, 12 bp, Homo sapiens
aacttcttgctt

SEQ ID NO: 4686243 - DNA, 19 bp, Homo sapiens
aacttcttgcttctttcta

SEQ ID NO: 4686244 - DNA, 13 bp, Homo sapiens
aacttttgtgaat

SEQ ID NO: 4686245 - DNA, 21 bp, Homo sapiens
aactttttttctgtaccagtt

SEQ ID NO: 4686246 - DNA, 12 bp, Homo sapiens
aagaaagtgtat

SEQ ID NO: 4686247 - DNA, 20 bp, Homo sapiens
aagattacaaatcagaagtc

SEQ ID NO: 4686248 - DNA, 21 bp, Homo sapiens
aagattacaaatcagaagtca

SEQ ID NO: 4686249 - DNA, 13 bp, Homo sapiens
aagcacagccctt

SEQ ID NO: 4686250 - DNA, 17 bp, Homo sapiens
aagcagtggacaccagg

SEQ ID NO: 4686251 - DNA, 19 bp, Homo sapiens
aagcatctggctctaattc

SEQ ID NO: 4686252 - DNA, 16 bp, Homo sapiens
aaggaatttcttaact

SEQ ID NO: 4686253 - DNA, 23 bp, Homo sapiens
aaggaatttcttaacttcttgct

SEQ ID NO: 4686254 - DNA, 15 bp, Homo sapiens
aagggattttcagcc

SEQ ID NO: 4686255 - DNA, 13 bp, Homo sapiens
aagtcatcttgct

SEQ ID NO: 4686256 - DNA, 20 bp, Homo sapiens
aagtcatcttgctaccagta

SEQ ID NO: 4686257 - DNA, 23 bp, Homo sapiens
aagtcatcttgctaccagtattt

SEQ ID NO: 4686258 - DNA, 15 bp, Homo sapiens
aagttgtttcattga

SEQ ID NO: 4686259 - DNA, 16 bp, Homo sapiens
aataaaggcagttttc

SEQ ID NO: 4686260 - DNA, 18 bp, Homo sapiens
aataaaggcagttttcta

SEQ ID NO: 4686261 - DNA, 17 bp, Homo sapiens
aataaagtcagatggaa

SEQ ID NO: 4686262 - DNA, 15 bp, Homo sapiens
aatagaataaaggca

SEQ ID NO: 4686263 - DNA, 16 bp, Homo sapiens
aatagaataaaggcag

SEQ ID NO: 4686264 - DNA, 13 bp, Homo sapiens
aatatcctaataa

SEQ ID NO: 4686265 - DNA, 16 bp, Homo sapiens
aatatgttagcaaaga

SEQ ID NO: 4686266 - DNA, 20 bp, Homo sapiens
aatcagaagtcatcttgcta

SEQ ID NO: 4686267 - DNA, 24 bp, Homo sapiens
aatcagaagtcatcttgctaccag

SEQ ID NO: 4686268 - DNA, 17 bp, Homo sapiens
aatgtatgttaccaaaa

SEQ ID NO: 4686269 - DNA, 18 bp, Homo sapiens
aattaggctgtaactact

SEQ ID NO: 4686270 - DNA, 22 bp, Homo sapiens
aattaggctgtaactactttat

SEQ ID NO: 4686271 - DNA, 15 bp, Homo sapiens
aattagtgccactta

SEQ ID NO: 4686272 - DNA, 17 bp, Homo sapiens
aattcaaggaatttctt

SEQ ID NO: 4686273 - DNA, 20 bp, Homo sapiens
aattcacagtgctcttttct

SEQ ID NO: 4686274 - DNA, 19 bp, Homo sapiens
aattctgctacctcactgg

SEQ ID NO: 4686275 - DNA, 15 bp, Homo sapiens
aattggatttcctaa

SEQ ID NO: 4686276 - DNA, 18 bp, Homo sapiens
aatttacctaagattaca

SEQ ID NO: 4686277 - DNA, 16 bp, Homo sapiens
aatttcttaacttctt

SEQ ID NO: 4686278 - DNA, 19 bp, Homo sapiens
aattttgaagtgctgttta

SEQ ID NO: 4686279 - DNA, 14 bp, Homo sapiens
aatttttccaacta

SEQ ID NO: 4686280 - DNA, 20 bp, Homo sapiens
acaaatcagaagtcatcttg

SEQ ID NO: 4686281 - DNA, 23 bp, Homo sapiens
acaaatcagaagtcatcttgcta

SEQ ID NO: 4686282 - DNA, 22 bp, Homo sapiens
agctctggggtgggcagttttt

SEQ ID NO: 4686283 - DNA, 21 bp, Homo sapiens
agctgtggcagagttacagtt

SEQ ID NO: 4686284 - DNA, 22 bp, Homo sapiens
agctgtggcagagttacagttc

SEQ ID NO: 4686285 - DNA, 14 bp, Homo sapiens
agcttagacctcag

SEQ ID NO: 4686286 - DNA, 15 bp, Homo sapiens
agcttagacctcagc

SEQ ID NO: 4686287 - DNA, 16 bp, Homo sapiens
agcttagacctcagcc

SEQ ID NO: 4686288 - DNA, 19 bp, Homo sapiens
agcttagacctcagcctgt

SEQ ID NO: 4686289 - DNA, 20 bp, Homo sapiens
agcttagacctcagcctgtg

SEQ ID NO: 4686290 - DNA, 15 bp, Homo sapiens
aggaatttcttaact

SEQ ID NO: 4686291 - DNA, 13 bp, Homo sapiens
aggagaggggcag

SEQ ID NO: 4686292 - DNA, 18 bp, Homo sapiens
aggagggttagggagggg

SEQ ID NO: 4686293 - DNA, 12 bp, Homo sapiens
aggagtttggcc

SEQ ID NO: 4686294 - DNA, 18 bp, Homo sapiens
aggagtttggccagaagt

SEQ ID NO: 4686295 - DNA, 12 bp, Homo sapiens
aggcaattagac

SEQ ID NO: 4686296 - DNA, 15 bp, Homo sapiens
aggcacacttcttct

SEQ ID NO: 4686297 - DNA, 20 bp, Homo sapiens
aggcacacttcttcttggtc

SEQ ID NO: 4686298 - DNA, 18 bp, Homo sapiens
aggcagacagcagctcag

SEQ ID NO: 4686299 - DNA, 21 bp, Homo sapiens
aggcagacagcagctcaggca

SEQ ID NO: 4686300 - DNA, 14 bp, Homo sapiens
aggcagttttctaa

SEQ ID NO: 4686301 - DNA, 12 bp, Homo sapiens
aggcttagaccc

SEQ ID NO: 4686302 - DNA, 21 bp, Homo sapiens
aggcttagaccctcatgctgc

SEQ ID NO: 4686303 - DNA, 24 bp, Homo sapiens
aggcttagaccctcatgctgccaa

SEQ ID NO: 4686304 - DNA, 21 bp, Homo sapiens
agggaggacgctctctggcct

SEQ ID NO: 4686305 - DNA, 22 bp, Homo sapiens
agggaggacgctctctggcctt

SEQ ID NO: 4686306 - DNA, 12 bp, Homo sapiens
agggccccagca

SEQ ID NO: 4686307 - DNA, 18 bp, Homo sapiens
agggccccagcactaaag

SEQ ID NO: 4686308 - DNA, 13 bp, Homo sapiens
agggctcagcctg

SEQ ID NO: 4686309 - DNA, 15 bp, Homo sapiens
agggctcagcctggt

SEQ ID NO: 4686310 - DNA, 16 bp, Homo sapiens
agggttcagagactca

SEQ ID NO: 4686311 - DNA, 14 bp, Homo sapiens
aggttccctcccag

SEQ ID NO: 4686312 - DNA, 23 bp, Homo sapiens
agtaatttattgtttttccttgt

SEQ ID NO: 4686313 - DNA, 16 bp, Homo sapiens
agtactgtgtacagaa

SEQ ID NO: 4686314 - DNA, 14 bp, Homo sapiens
agtcaaggcttaga

SEQ ID NO: 4686315 - DNA, 16 bp, Homo sapiens
agtcaaggcttagacc

SEQ ID NO: 4686316 - DNA, 20 bp, Homo sapiens
agtcagatggaaaattcatt

SEQ ID NO: 4686317 - DNA, 13 bp, Homo sapiens
agtcatcttgcta

SEQ ID NO: 4686318 - DNA, 23 bp, Homo sapiens
agtcatcttgctaccagtattta

SEQ ID NO: 4686319 - DNA, 15 bp, Homo sapiens
agtctctcttctctc

SEQ ID NO: 4686320 - DNA, 16 bp, Homo sapiens
agtctctcttctctcc

SEQ ID NO: 4686321 - DNA, 16 bp, Homo sapiens
agtgccacttaatgta

SEQ ID NO: 4686322 - DNA, 14 bp, Homo sapiens
agtgctcttttctc

SEQ ID NO: 4686323 - DNA, 12 bp, Homo sapiens
agtgcttggccc

SEQ ID NO: 4686324 - DNA, 14 bp, Homo sapiens
agtgcttggcccag

SEQ ID NO: 4686325 - DNA, 23 bp, Homo sapiens
agttaatttttccaactactaat

SEQ ID NO: 4686326 - DNA, 16 bp, Homo sapiens
agttaccttatagtta

SEQ ID NO: 4686327 - DNA, 17 bp, Homo sapiens
agttaccttatagttac

SEQ ID NO: 4686328 - DNA, 21 bp, Homo sapiens
agttaccttatagttactgtg

SEQ ID NO: 4686329 - DNA, 22 bp, Homo sapiens
agttaccttatagttactgtgt

SEQ ID NO: 4686330 - DNA, 16 bp, Homo sapiens
agttactgtgtaatta

SEQ ID NO: 4686331 - DNA, 22 bp, Homo sapiens
agttctgtggtttcatgttagt

SEQ ID NO: 4686332 - DNA, 16 bp, Homo sapiens
agttgcagattcattt

SEQ ID NO: 4686333 - DNA, 13 bp, Homo sapiens
agttggtaacttt

SEQ ID NO: 4686334 - DNA, 16 bp, Homo sapiens
agttggtaacttttgt

SEQ ID NO: 4686335 - DNA, 14 bp, Homo sapiens
agtttggccagaag

SEQ ID NO: 4686336 - DNA, 22 bp, Homo sapiens
agttttttgaaaatgggctcaa

SEQ ID NO: 4686337 - DNA, 16 bp, Homo sapiens
ataaaggcagttttct

SEQ ID NO: 4686338 - DNA, 16 bp, Homo sapiens
ataaagttggtgacag

SEQ ID NO: 4686339 - DNA, 18 bp, Homo sapiens
ataattggatttcctaat

SEQ ID NO: 4686340 - DNA, 12 bp, Homo sapiens
atagaataaagg

SEQ ID NO: 4686341 - DNA, 17 bp, Homo sapiens
atagaataaaggcagtt

SEQ ID NO: 4686342 - DNA, 19 bp, Homo sapiens
atagctctggggtgggcag

SEQ ID NO: 4686343 - DNA, 24 bp, Homo sapiens
atatatctaccccagactagatgt

SEQ ID NO: 4686344 - DNA, 16 bp, Homo sapiens
atatcctaataaaaag

SEQ ID NO: 4686345 - DNA, 18 bp, Homo sapiens
atatcctaataaaaaggt

SEQ ID NO: 4686346 - DNA, 20 bp, Homo sapiens
atatcctaataaaaaggtga

SEQ ID NO: 4686347 - DNA, 16 bp, Homo sapiens
atcaaactgaagccag

SEQ ID NO: 4686348 - DNA, 19 bp, Homo sapiens
atcagaagtcatcttgcta

SEQ ID NO: 4686349 - DNA, 12 bp, Homo sapiens
atcctaataaaa

SEQ ID NO: 4686350 - DNA, 14 bp, Homo sapiens
atcctaataaaaag

SEQ ID NO: 4686351 - DNA, 18 bp, Homo sapiens
atcctcaaagaaagtgta

SEQ ID NO: 4686352 - DNA, 20 bp, Homo sapiens
atcctcaaagaaagtgtatt

SEQ ID NO: 4686353 - DNA, 21 bp, Homo sapiens
atcctcaaagaaagtgtattg

SEQ ID NO: 4686354 - DNA, 11 bp, Homo sapiens
atcctgaggct

SEQ ID NO: 4686355 - DNA, 22 bp, Homo sapiens
atcctgaggctccacttggtct

SEQ ID NO: 4686356 - DNA, 21 bp, Homo sapiens
atctaccccagactagatgta

SEQ ID NO: 4686357 - DNA, 22 bp, Homo sapiens
atctaccccagactagatgtag

SEQ ID NO: 4686358 - DNA, 13 bp, Homo sapiens
atctataatttac

SEQ ID NO: 4686359 - DNA, 15 bp, Homo sapiens
atgattactggcctt

SEQ ID NO: 4686360 - DNA, 15 bp, Homo sapiens
atgcagctgtggcag

SEQ ID NO: 4686361 - DNA, 21 bp, Homo sapiens
atgctagaactccctttcaac

SEQ ID NO: 4686362 - DNA, 22 bp, Homo sapiens
atgtagtattttttgtataatt

SEQ ID NO: 4686363 - DNA, 13 bp, Homo sapiens
atgtatgttacca

SEQ ID NO: 4686364 - DNA, 21 bp, Homo sapiens
atgtccctacacccctcccct

SEQ ID NO: 4686365 - DNA, 16 bp, Homo sapiens
atgtcctgcctattat

SEQ ID NO: 4686366 - DNA, 21 bp, Homo sapiens
atgttagttaccttatagtta

SEQ ID NO: 4686367 - DNA, 22 bp, Homo sapiens
atgttagttaccttatagttac

SEQ ID NO: 4686368 - DNA, 16 bp, Homo sapiens
attacaaatcagaagt

SEQ ID NO: 4686369 - DNA, 19 bp, Homo sapiens
attacaaatcagaagtcat

SEQ ID NO: 4686370 - DNA, 21 bp, Homo sapiens
attacaaatcagaagtcatct

SEQ ID NO: 4686371 - DNA, 22 bp, Homo sapiens
attacaaatcagaagtcatctt

SEQ ID NO: 4686372 - DNA, 15 bp, Homo sapiens
attacagtgggtgcc

SEQ ID NO: 4686373 - DNA, 17 bp, Homo sapiens
attactggcctttttca

SEQ ID NO: 4686374 - DNA, 21 bp, Homo sapiens
attaggctgtaactactttat

SEQ ID NO: 4686375 - DNA, 16 bp, Homo sapiens
attagtgccacttaat

SEQ ID NO: 4686376 - DNA, 18 bp, Homo sapiens
attagtgccacttaatgt

SEQ ID NO: 4686377 - DNA, 19 bp, Homo sapiens
attagtgccacttaatgta

SEQ ID NO: 4686378 - DNA, 20 bp, Homo sapiens
attagtgccacttaatgtat

SEQ ID NO: 4686379 - DNA, 21 bp, Homo sapiens
attagtgccacttaatgtatg

SEQ ID NO: 4686380 - DNA, 22 bp, Homo sapiens
attcaaggaatttcttaacttc

SEQ ID NO: 4686381 - DNA, 19 bp, Homo sapiens
attcacagtgctcttttct

SEQ ID NO: 4686382 - DNA, 18 bp, Homo sapiens
ctaattcaaggaatttct

SEQ ID NO: 4686383 - DNA, 13 bp, Homo sapiens
ctaccagtattta

SEQ ID NO: 4686384 - DNA, 20 bp, Homo sapiens
ctaccagtatttagaagcca

SEQ ID NO: 4686385 - DNA, 17 bp, Homo sapiens
ctactaatagaataaag

SEQ ID NO: 4686386 - DNA, 18 bp, Homo sapiens
ctactaatagaataaagg

SEQ ID NO: 4686387 - DNA, 14 bp, Homo sapiens
ctactttataacta

SEQ ID NO: 4686388 - DNA, 12 bp, Homo sapiens
ctagaactccct

SEQ ID NO: 4686389 - DNA, 22 bp, Homo sapiens
ctagatgtagtattttttgtat

SEQ ID NO: 4686390 - DNA, 23 bp, Homo sapiens
ctagatgtagtattttttgtata

SEQ ID NO: 4686391 - DNA, 14 bp, Homo sapiens
ctagccgacctcag

SEQ ID NO: 4686392 - DNA, 17 bp, Homo sapiens
ctagccgacctcagcct

SEQ ID NO: 4686393 - DNA, 18 bp, Homo sapiens
ctagccgacctcagcctt

SEQ ID NO: 4686394 - DNA, 13 bp, Homo sapiens
ctcaaagaaagtg

SEQ ID NO: 4686395 - DNA, 17 bp, Homo sapiens
ctcaaagaaagtgtatt

SEQ ID NO: 4686396 - DNA, 16 bp, Homo sapiens
ctcagcctggtgggcc

SEQ ID NO: 4686397 - DNA, 14 bp, Homo sapiens
ctcagggccccagc

SEQ ID NO: 4686398 - DNA, 16 bp, Homo sapiens
ctcagggccccagcac

SEQ ID NO: 4686399 - DNA, 13 bp, Homo sapiens
ctcagtaccccat

SEQ ID NO: 4686400 - DNA, 14 bp, Homo sapiens
ctcatgctgccaat

SEQ ID NO: 4686401 - DNA, 19 bp, Homo sapiens
ctcatgggtggcactcagt

SEQ ID NO: 4686402 - DNA, 23 bp, Homo sapiens
ctcatgggtggcactcagtctct

SEQ ID NO: 4686403 - DNA, 22 bp, Homo sapiens
ctccacttggtctgtgagatgc

SEQ ID NO: 4686404 - DNA, 20 bp, Homo sapiens
ctccatcctgaggctccact

SEQ ID NO: 4686405 - DNA, 21 bp, Homo sapiens
ctccatcctgaggctccactt

SEQ ID NO: 4686406 - DNA, 23 bp, Homo sapiens
ctccatcctgaggctccacttgg

SEQ ID NO: 4686407 - DNA, 14 bp, Homo sapiens
ctcccacctgacac

SEQ ID NO: 4686408 - DNA, 15 bp, Homo sapiens
ctcccacctgacaca

SEQ ID NO: 4686409 - DNA, 21 bp, Homo sapiens
ctcccacctgacacaccaggc

SEQ ID NO: 4686410 - DNA, 15 bp, Homo sapiens
ctcccagaggagcca

SEQ ID NO: 4686411 - DNA, 22 bp, Homo sapiens
ctcccagaggagccaccagttc

SEQ ID NO: 4686412 - DNA, 23 bp, Homo sapiens
ctcccagaggagccaccagttct

SEQ ID NO: 4686413 - DNA, 12 bp, Homo sapiens
ctccctttcaac

SEQ ID NO: 4686414 - DNA, 12 bp, Homo sapiens
ctcctctgcact

SEQ ID NO: 4686415 - DNA, 13 bp, Homo sapiens
ctcctctgcactc

SEQ ID NO: 4686416 - DNA, 17 bp, Homo sapiens
ctcctctgtccagggcc

SEQ ID NO: 4686417 - DNA, 14 bp, Homo sapiens
ctcctgtctgccag

SEQ ID NO: 4686418 - DNA, 15 bp, Homo sapiens
ctcctgtctgccagc

SEQ ID NO: 4686419 - DNA, 23 bp, Homo sapiens
ctcctgtctgccagccagcagcc

SEQ ID NO: 4686420 - DNA, 12 bp, Homo sapiens
ctcggagcctca

SEQ ID NO: 4686421 - DNA, 13 bp, Homo sapiens
ctcggagcctcat

SEQ ID NO: 4686422 - DNA, 14 bp, Homo sapiens
ctcggtggacccag

SEQ ID NO: 4686423 - DNA, 15 bp, Homo sapiens
ctctaattcacagtg

SEQ ID NO: 4686424 - DNA, 16 bp, Homo sapiens
ctctaattcacagtgc

SEQ ID NO: 4686425 - DNA, 13 bp, Homo sapiens
ctctctggccttc

SEQ ID NO: 4686426 - DNA, 21 bp, Homo sapiens
ctctctgtaataaactcattt

SEQ ID NO: 4686427 - DNA, 16 bp, Homo sapiens
ctctcttctctccagc

SEQ ID NO: 4686428 - DNA, 19 bp, Homo sapiens
ctctgcactcccacctgac

SEQ ID NO: 4686429 - DNA, 12 bp, Homo sapiens
ctctggccttcg

SEQ ID NO: 4686430 - DNA, 21 bp, Homo sapiens
ctctggccttcggcctccatc

SEQ ID NO: 4686431 - DNA, 23 bp, Homo sapiens
ctctggtgagtcaccacttcagg

SEQ ID NO: 4686432 - DNA, 14 bp, Homo sapiens
ctctgtccagggcc

SEQ ID NO: 4686433 - DNA, 14 bp, Homo sapiens
ctcttctctccagc

SEQ ID NO: 4686434 - DNA, 17 bp, Homo sapiens
ctgaacatcacagctta

SEQ ID NO: 4686435 - DNA, 17 bp, Homo sapiens
ctgagctcggtggaccc

SEQ ID NO: 4686436 - DNA, 18 bp, Homo sapiens
ctgagctcggtggaccca

SEQ ID NO: 4686437 - DNA, 15 bp, Homo sapiens
ctgaggcagacagca

SEQ ID NO: 4686438 - DNA, 16 bp, Homo sapiens
ctgaggcagacagcag

SEQ ID NO: 4686439 - DNA, 15 bp, Homo sapiens
ctgaggctccacttg

SEQ ID NO: 4686440 - DNA, 16 bp, Homo sapiens
ctgcaaggtactctgg

SEQ ID NO: 4686441 - DNA, 12 bp, Homo sapiens
ctgccagccagc

SEQ ID NO: 4686442 - DNA, 14 bp, Homo sapiens
ctgccagccagcag

SEQ ID NO: 4686443 - DNA, 15 bp, Homo sapiens
ctgcccgtcttcagc

SEQ ID NO: 4686444 - DNA, 17 bp, Homo sapiens
ctgcccgtcttcagcct

SEQ ID NO: 4686445 - DNA, 21 bp, Homo sapiens
ctgcccgtcttcagcctagcc

SEQ ID NO: 4686446 - DNA, 14 bp, Homo sapiens
ctgctacctcactg

SEQ ID NO: 4686447 - DNA, 17 bp, Homo sapiens
ctgctacctcactgggg

SEQ ID NO: 4686448 - DNA, 14 bp, Homo sapiens
ctggcccaccaggg

SEQ ID NO: 4686449 - DNA, 16 bp, Homo sapiens
ctggccttcggcctcc

SEQ ID NO: 4686450 - DNA, 22 bp, Homo sapiens
ctggccttcggcctccatcctg

SEQ ID NO: 4686451 - DNA, 20 bp, Homo sapiens
ctggcctttttcatttatct

SEQ ID NO: 4686452 - DNA, 20 bp, Homo sapiens
ctggctctaattcacagtgc

SEQ ID NO: 4686453 - DNA, 19 bp, Homo sapiens
ctgtaactactttataact

SEQ ID NO: 4686454 - DNA, 22 bp, Homo sapiens
ctgtaataaactcatttctagc

SEQ ID NO: 4686455 - DNA, 16 bp, Homo sapiens
ctgtaccagttaattt

SEQ ID NO: 4686456 - DNA, 18 bp, Homo sapiens
ctgtaccagttaattttt

SEQ ID NO: 4686457 - DNA, 18 bp, Homo sapiens
ctgtagcattacagtggg

SEQ ID NO: 4686458 - DNA, 21 bp, Homo sapiens
ctgtcatcctcaaagaaagtg

SEQ ID NO: 4686459 - DNA, 20 bp, Homo sapiens
ctgtctcctctctctgtaat

SEQ ID NO: 4686460 - DNA, 14 bp, Homo sapiens
ctgtctgccagcca

SEQ ID NO: 4686461 - DNA, 17 bp, Homo sapiens
ctgtctgccagccagca

SEQ ID NO: 4686462 - DNA, 20 bp, Homo sapiens
ctgtctgccagccagcagcc

SEQ ID NO: 4686463 - DNA, 17 bp, Homo sapiens
ctgtggcagagttacag

SEQ ID NO: 4686464 - DNA, 17 bp, Homo sapiens
ctgtggctgctagcact

SEQ ID NO: 4686465 - DNA, 15 bp, Homo sapiens
ctgtggtttcatgtt

SEQ ID NO: 4686466 - DNA, 16 bp, Homo sapiens
ctgtggtttcatgtta

SEQ ID NO: 4686467 - DNA, 18 bp, Homo sapiens
ctgtgtaattagtgccac

SEQ ID NO: 4686468 - DNA, 18 bp, Homo sapiens
ctgtttattaatcttagt

SEQ ID NO: 4686469 - DNA, 15 bp, Homo sapiens
cttaacttcttgctt

SEQ ID NO: 4686470 - DNA, 22 bp, Homo sapiens
cttaacttcttgcttctttcta

SEQ ID NO: 4686471 - DNA, 23 bp, Homo sapiens
cttaagcatctggctctaattca

SEQ ID NO: 4686472 - DNA, 17 bp, Homo sapiens
cttaatgtatgttacca

SEQ ID NO: 4686473 - DNA, 21 bp, Homo sapiens
cttagaccctcatgctgccaa

SEQ ID NO: 4686474 - DNA, 23 bp, Homo sapiens
cttagaccctcatgctgccaata

SEQ ID NO: 4686475 - DNA, 12 bp, Homo sapiens
cttagacctcag

SEQ ID NO: 4686476 - DNA, 13 bp, Homo sapiens
cttagacctcagc

SEQ ID NO: 4686477 - DNA, 14 bp, Homo sapiens
cttagacctcagcc

SEQ ID NO: 4686478 - DNA, 14 bp, Homo sapiens
cttagcttagacct

SEQ ID NO: 4686479 - DNA, 15 bp, Homo sapiens
cttagcttagacctc

SEQ ID NO: 4686480 - DNA, 16 bp, Homo sapiens
cttagcttagacctca

SEQ ID NO: 4686481 - DNA, 22 bp, Homo sapiens
cttagcttagacctcagcctgt

SEQ ID NO: 4686482 - DNA, 19 bp, Homo sapiens
gcccaagttcatgcagctg

SEQ ID NO: 4686483 - DNA, 17 bp, Homo sapiens
gcccaggagtttggcca

SEQ ID NO: 4686484 - DNA, 14 bp, Homo sapiens
gcccagggctcagc

SEQ ID NO: 4686485 - DNA, 18 bp, Homo sapiens
gccccaccctcagatgca

SEQ ID NO: 4686486 - DNA, 12 bp, Homo sapiens
gccccagcacta

SEQ ID NO: 4686487 - DNA, 23 bp, Homo sapiens
gccccagcactaaagcagtggac

SEQ ID NO: 4686488 - DNA, 13 bp, Homo sapiens
gccctagagcaca

SEQ ID NO: 4686489 - DNA, 19 bp, Homo sapiens
gccctagagcacactgtag

SEQ ID NO: 4686490 - DNA, 21 bp, Homo sapiens
gccctagagcacactgtagca

SEQ ID NO: 4686491 - DNA, 22 bp, Homo sapiens
gccctgagctcggtggacccag

SEQ ID NO: 4686492 - DNA, 11 bp, Homo sapiens
gccgacctcag

SEQ ID NO: 4686493 - DNA, 12 bp, Homo sapiens
gccgacctcagc

SEQ ID NO: 4686494 - DNA, 13 bp, Homo sapiens
gccgacctcagcc

SEQ ID NO: 4686495 - DNA, 22 bp, Homo sapiens
gccgctcctgtctgccagccag

SEQ ID NO: 4686496 - DNA, 23 bp, Homo sapiens
gccgtggtgatttagcaggaagc

SEQ ID NO: 4686497 - DNA, 16 bp, Homo sapiens
gcctagccgacctcag

SEQ ID NO: 4686498 - DNA, 21 bp, Homo sapiens
gcctattatctgtcagctgca

SEQ ID NO: 4686499 - DNA, 17 bp, Homo sapiens
gcctcatccgaggcagg

SEQ ID NO: 4686500 - DNA, 19 bp, Homo sapiens
gcctcatccgaggcagggt

SEQ ID NO: 4686501 - DNA, 22 bp, Homo sapiens
gcctcatccgaggcagggtcag

SEQ ID NO: 4686502 - DNA, 13 bp, Homo sapiens
gcctccatcctga

SEQ ID NO: 4686503 - DNA, 16 bp, Homo sapiens
gcctgtgctgcccgtc

SEQ ID NO: 4686504 - DNA, 16 bp, Homo sapiens
gccttccccttgccca

SEQ ID NO: 4686505 - DNA, 18 bp, Homo sapiens
gccttcggcctccatcct

SEQ ID NO: 4686506 - DNA, 20 bp, Homo sapiens
gccttcggcctccatcctga

SEQ ID NO: 4686507 - DNA, 23 bp, Homo sapiens
gccttcggcctccatcctgaggc

SEQ ID NO: 4686508 - DNA, 17 bp, Homo sapiens
gcctttttcatttatct

SEQ ID NO: 4686509 - DNA, 22 bp, Homo sapiens
gcgctaattcaaggaatttctt

SEQ ID NO: 4686510 - DNA, 14 bp, Homo sapiens
gcgggaaggagggt

SEQ ID NO: 4686511 - DNA, 22 bp, Homo sapiens
gcgtcctgtcggagccctgtct

SEQ ID NO: 4686512 - DNA, 13 bp, Homo sapiens
gctaccagtattt

SEQ ID NO: 4686513 - DNA, 19 bp, Homo sapiens
gctaccagtatttagaagc

SEQ ID NO: 4686514 - DNA, 22 bp, Homo sapiens
gctaccagtatttagaagccaa

SEQ ID NO: 4686515 - DNA, 12 bp, Homo sapiens
gctagaactccc

SEQ ID NO: 4686516 - DNA, 11 bp, Homo sapiens
gctcagcctgg

SEQ ID NO: 4686517 - DNA, 15 bp, Homo sapiens
gctcagcctggtggg

SEQ ID NO: 4686518 - DNA, 20 bp, Homo sapiens
gctcagcctggtgggcctcc

SEQ ID NO: 4686519 - DNA, 15 bp, Homo sapiens
gctccacttggtctg

SEQ ID NO: 4686520 - DNA, 20 bp, Homo sapiens
gctcctgtctgccagccagc

SEQ ID NO: 4686521 - DNA, 12 bp, Homo sapiens
gctcggtggacc

SEQ ID NO: 4686522 - DNA, 18 bp, Homo sapiens
gctgcaagcacagccctt

SEQ ID NO: 4686523 - DNA, 14 bp, Homo sapiens
gctgccaatatcct

SEQ ID NO: 4686524 - DNA, 16 bp, Homo sapiens
gctgccaatatcctaa

SEQ ID NO: 4686525 - DNA, 23 bp, Homo sapiens
gctgccaatatcctaataaaaag

SEQ ID NO: 4686526 - DNA, 13 bp, Homo sapiens
gcttagacctcag

SEQ ID NO: 4686527 - DNA, 15 bp, Homo sapiens
gcttagacctcagcc

SEQ ID NO: 4686528 - DNA, 15 bp, Homo sapiens
gcttctttctagaaa

SEQ ID NO: 4686529 - DNA, 23 bp, Homo sapiens
ggaaagggattttcagccctcag

SEQ ID NO: 4686530 - DNA, 20 bp, Homo sapiens
ggaaggagggttagggaggg

SEQ ID NO: 4686531 - DNA, 22 bp, Homo sapiens
ggaatttcttaacttcttgctt

SEQ ID NO: 4686532 - DNA, 13 bp, Homo sapiens
ggacaccaggagt

SEQ ID NO: 4686533 - DNA, 19 bp, Homo sapiens
ggagcctcatccgaggcag

SEQ ID NO: 4686534 - DNA, 20 bp, Homo sapiens
ggagcctcatccgaggcagg

SEQ ID NO: 4686535 - DNA, 16 bp, Homo sapiens
ggaggacgctctctgg

SEQ ID NO: 4686536 - DNA, 14 bp, Homo sapiens
ggagtttggccaga

SEQ ID NO: 4686537 - DNA, 15 bp, Homo sapiens
ggagtttggccagaa

SEQ ID NO: 4686538 - DNA, 15 bp, Homo sapiens
ggatgacatgtccct

SEQ ID NO: 4686539 - DNA, 19 bp, Homo sapiens
ggattgaaggatgctgtct

SEQ ID NO: 4686540 - DNA, 12 bp, Homo sapiens
ggattggggaag

SEQ ID NO: 4686541 - DNA, 18 bp, Homo sapiens
ggattggggaagactgtg

SEQ ID NO: 4686542 - DNA, 14 bp, Homo sapiens
ggcaactgaggcag

SEQ ID NO: 4686543 - DNA, 15 bp, Homo sapiens
ggcaactgaggcaga

SEQ ID NO: 4686544 - DNA, 14 bp, Homo sapiens
ggcagacagcagct

SEQ ID NO: 4686545 - DNA, 19 bp, Homo sapiens
ggcagagttacagttctgt

SEQ ID NO: 4686546 - DNA, 15 bp, Homo sapiens
ggcatagctctgggg

SEQ ID NO: 4686547 - DNA, 13 bp, Homo sapiens
ggcccaggagttt

SEQ ID NO: 4686548 - DNA, 18 bp, Homo sapiens
ggcccaggagtttggcca

SEQ ID NO: 4686549 - DNA, 20 bp, Homo sapiens
ggcccaggagtttggccaga

SEQ ID NO: 4686550 - DNA, 16 bp, Homo sapiens
ggccccagcactaaag

SEQ ID NO: 4686551 - DNA, 10 bp, Homo sapiens
ggctcagcct

SEQ ID NO: 4686552 - DNA, 14 bp, Homo sapiens
ggctccacttggtc

SEQ ID NO: 4686553 - DNA, 18 bp, Homo sapiens
ggcttagaccctcatgct

SEQ ID NO: 4686554 - DNA, 22 bp, Homo sapiens
ggcttagaccctcatgctgcca

SEQ ID NO: 4686555 - DNA, 20 bp, Homo sapiens
gggaaggagggttagggagg

SEQ ID NO: 4686556 - DNA, 21 bp, Homo sapiens
gggattttcagccctcagaat

SEQ ID NO: 4686557 - DNA, 22 bp, Homo sapiens
gggcagaacagccgctcctgtc

SEQ ID NO: 4686558 - DNA, 20 bp, Homo sapiens
gggcagtgcttggcccagga

SEQ ID NO: 4686559 - DNA, 22 bp, Homo sapiens
gggtaaaattccttagcttaga

SEQ ID NO: 4686560 - DNA, 23 bp, Homo sapiens
gggtaccttgaacactgggggag

SEQ ID NO: 4686561 - DNA, 16 bp, Homo sapiens
gggtaggcgggaagga

SEQ ID NO: 4686562 - DNA, 14 bp, Homo sapiens
gggtggggcagtgc

SEQ ID NO: 4686563 - DNA, 14 bp, Homo sapiens
ggtctgtgagatgc

SEQ ID NO: 4686564 - DNA, 22 bp, Homo sapiens
ggtgccccccttgccagacatg

SEQ ID NO: 4686565 - DNA, 14 bp, Homo sapiens
ggtggacccaggga

SEQ ID NO: 4686566 - DNA, 13 bp, Homo sapiens
ggttagggagggg

SEQ ID NO: 4686567 - DNA, 15 bp, Homo sapiens
ggttagggaggggta

SEQ ID NO: 4686568 - DNA, 14 bp, Homo sapiens
gtaacttttgtgaa

SEQ ID NO: 4686569 - DNA, 20 bp, Homo sapiens
gtaattagtgccacttaatg

SEQ ID NO: 4686570 - DNA, 11 bp, Homo sapiens
gtaccagttaa

SEQ ID NO: 4686571 - DNA, 20 bp, Homo sapiens
gtaccagttaatttttccaa

SEQ ID NO: 4686572 - DNA, 23 bp, Homo sapiens
gtaccttgaacactgggggaggg

SEQ ID NO: 4686573 - DNA, 19 bp, Homo sapiens
gtagtattttttgtataat

SEQ ID NO: 4686574 - DNA, 20 bp, Homo sapiens
gtatttggaaataaagtcag

SEQ ID NO: 4686575 - DNA, 14 bp, Homo sapiens
gtcaaggcttagac

SEQ ID NO: 4686576 - DNA, 18 bp, Homo sapiens
gtcaaggcttagaccctc

SEQ ID NO: 4686577 - DNA, 12 bp, Homo sapiens
gtcatcttgcta

SEQ ID NO: 4686578 - DNA, 14 bp, Homo sapiens
gtccagggccctga

SEQ ID NO: 4686579 - DNA, 22 bp, Homo sapiens
gtcctggggcctcggagcctca

SEQ ID NO: 4686580 - DNA, 18 bp, Homo sapiens
gtcctgtcggagccctgt

SEQ ID NO: 4686581 - DNA, 20 bp, Homo sapiens
gtccttttgacactgctcta

SEQ ID NO: 4686582 - DNA, 19 bp, Homo sapiens
tttattaatcttagtgtat

SEQ ID NO: 4686583 - DNA, 12 bp, Homo sapiens
tttcctaatact

SEQ ID NO: 4686584 - DNA, 16 bp, Homo sapiens
tttgaagtgctgttta

SEQ ID NO: 4686585 - DNA, 15 bp, Homo sapiens
tttgacactgctcta

SEQ ID NO: 4686586 - DNA, 13 bp, Homo sapiens
tttggtttctagc

SEQ ID NO: 4686587 - DNA, 13 bp, Homo sapiens
tttgtataattgg

SEQ ID NO: 4686588 - DNA, 15 bp, Homo sapiens
tttgtcactttttct

SEQ ID NO: 4686589 - DNA, 13 bp, Homo sapiens
ttttcatttatct

SEQ ID NO: 4686590 - DNA, 18 bp, Homo sapiens
ttttccaactactaatag

SEQ ID NO: 4686591 - DNA, 21 bp, Homo sapiens
ttttctcctcactgtatccag

SEQ ID NO: 4686592 - DNA, 14 bp, Homo sapiens
ttttctgtaccagt

SEQ ID NO: 4686593 - DNA, 14 bp, Homo sapiens
ttttgtataattgg

SEQ ID NO: 4686594 - DNA, 16 bp, Homo sapiens
ttttgtataattggat

SEQ ID NO: 4686595 - DNA, 14 bp, Homo sapiens
ttttgtgaattagg

SEQ ID NO: 4686596 - DNA, 23 bp, Homo sapiens
tttttccaactactaatagaata

SEQ ID NO: 4686597 - DNA, 16 bp, Homo sapiens
tttttctgtaccagtt

SEQ ID NO: 4686598 - DNA, 20 bp, Homo sapiens
acctgactattgaagttgca

SEQ ID NO: 4686599 - DNA, 20 bp, Homo sapiens
accttatagttactgtgtaa

SEQ ID NO: 4686600 - DNA, 21 bp, Homo sapiens
accttgaacactgggggaggg

SEQ ID NO: 4686601 - DNA, 15 bp, Homo sapiens
acgcctgaggcaatt

SEQ ID NO: 4686602 - DNA, 19 bp, Homo sapiens
acgcctgaggcaattagac

SEQ ID NO: 4686603 - DNA, 15 bp, Homo sapiens
acgctctctggcctt

SEQ ID NO: 4686604 - DNA, 17 bp, Homo sapiens
acgctctctggccttcg

SEQ ID NO: 4686605 - DNA, 17 bp, Homo sapiens
actaacatgtcctgcct

SEQ ID NO: 4686606 - DNA, 16 bp, Homo sapiens
actaatagaataaagg

SEQ ID NO: 4686607 - DNA, 20 bp, Homo sapiens
actaatagaataaaggcagt

SEQ ID NO: 4686608 - DNA, 18 bp, Homo sapiens
actcagggccccagcact

SEQ ID NO: 4686609 - DNA, 12 bp, Homo sapiens
actccctttcaa

SEQ ID NO: 4686610 - DNA, 14 bp, Homo sapiens
actccctttcaaca

SEQ ID NO: 4686611 - DNA, 13 bp, Homo sapiens
actgaggcagaca

SEQ ID NO: 4686612 - DNA, 21 bp, Homo sapiens
actgtcatcctcaaagaaagt

SEQ ID NO: 4686613 - DNA, 22 bp, Homo sapiens
actgtcatcctcaaagaaagtg

SEQ ID NO: 4686614 - DNA, 13 bp, Homo sapiens
actgtgtaattag

SEQ ID NO: 4686615 - DNA, 20 bp, Homo sapiens
acttaagcatctggctctaa

SEQ ID NO: 4686616 - DNA, 18 bp, Homo sapiens
acttcttgcttctttcta

SEQ ID NO: 4686617 - DNA, 21 bp, Homo sapiens
acttggtctgtgagatgctag

SEQ ID NO: 4686618 - DNA, 18 bp, Homo sapiens
actttataactaacatgt

SEQ ID NO: 4686619 - DNA, 11 bp, Homo sapiens
actttttctga

SEQ ID NO: 4686620 - DNA, 21 bp, Homo sapiens
actttttttctgtaccagtta

SEQ ID NO: 4686621 - DNA, 17 bp, Homo sapiens
agaaacagttggtaact

SEQ ID NO: 4686622 - DNA, 17 bp, Homo sapiens
agaaagagaaacagttg

SEQ ID NO: 4686623 - DNA, 23 bp, Homo sapiens
agaacagccgctcctgtctgcca

SEQ ID NO: 4686624 - DNA, 14 bp, Homo sapiens
agaactccctttca

SEQ ID NO: 4686625 - DNA, 15 bp, Homo sapiens
agaactccctttcaa

SEQ ID NO: 4686626 - DNA, 16 bp, Homo sapiens
agaactccctttcaac

SEQ ID NO: 4686627 - DNA, 19 bp, Homo sapiens
agaagtcaaggcttagacc

SEQ ID NO: 4686628 - DNA, 14 bp, Homo sapiens
agaataaaggcagt

SEQ ID NO: 4686629 - DNA, 22 bp, Homo sapiens
agacagagccccaccctcagat

SEQ ID NO: 4686630 - DNA, 24 bp, Homo sapiens
agacagagccccaccctcagatgc

SEQ ID NO: 4686631 - DNA, 19 bp, Homo sapiens
agaccctcatgctgccaat

SEQ ID NO: 4686632 - DNA, 24 bp, Homo sapiens
agaccctcatgctgccaatatcct

SEQ ID NO: 4686633 - DNA, 20 bp, Homo sapiens
agacctcagcctgtgctgcc

SEQ ID NO: 4686634 - DNA, 14 bp, Homo sapiens
agactagatgtagt

SEQ ID NO: 4686635 - DNA, 23 bp, Homo sapiens
agactagatgtagtattttttgt

SEQ ID NO: 4686636 - DNA, 12 bp, Homo sapiens
agactcagggcc

SEQ ID NO: 4686637 - DNA, 20 bp, Homo sapiens
agactgtggctgctagcact

SEQ ID NO: 4686638 - DNA, 14 bp, Homo sapiens
agagcacactgtag

SEQ ID NO: 4686639 - DNA, 23 bp, Homo sapiens
agagcagtttggtttctagcatg

SEQ ID NO: 4686640 - DNA, 17 bp, Homo sapiens
agaggagccaccagttc

SEQ ID NO: 4686641 - DNA, 15 bp, Homo sapiens
agaggggcagaacag

SEQ ID NO: 4686642 - DNA, 16 bp, Homo sapiens
agaggggcagaacagc

SEQ ID NO: 4686643 - DNA, 16 bp, Homo sapiens
agatgcacatgagctg

SEQ ID NO: 4686644 - DNA, 14 bp, Homo sapiens
agatgtagtatttt

SEQ ID NO: 4686645 - DNA, 17 bp, Homo sapiens
agattcatttttctttc

SEQ ID NO: 4686646 - DNA, 14 bp, Homo sapiens
agcacttggagcca

SEQ ID NO: 4686647 - DNA, 17 bp, Homo sapiens
agcagccagctctcagc

SEQ ID NO: 4686648 - DNA, 12 bp, Homo sapiens
agcagctcaggc

SEQ ID NO: 4686649 - DNA, 14 bp, Homo sapiens
agcagctcaggcac

SEQ ID NO: 4686650 - DNA, 20 bp, Homo sapiens
agcaggaagctgtgagagca

SEQ ID NO: 4686651 - DNA, 12 bp, Homo sapiens
agcagtggacac

SEQ ID NO: 4686652 - DNA, 15 bp, Homo sapiens
agcagtggacaccag

SEQ ID NO: 4686653 - DNA, 23 bp, Homo sapiens
agcagtttggtttctagcatgaa

SEQ ID NO: 4686654 - DNA, 21 bp, Homo sapiens
agcatcattatttgcagagac

SEQ ID NO: 4686655 - DNA, 16 bp, Homo sapiens
agcatctggctctaat

SEQ ID NO: 4686656 - DNA, 15 bp, Homo sapiens
agcatgaagacagag

SEQ ID NO: 4686657 - DNA, 12 bp, Homo sapiens
agccaccagttc

SEQ ID NO: 4686658 - DNA, 14 bp, Homo sapiens
agccagcagccagc

SEQ ID NO: 4686659 - DNA, 14 bp, Homo sapiens
agccagctctcagc

SEQ ID NO: 4686660 - DNA, 16 bp, Homo sapiens
agccagctctcagcca

SEQ ID NO: 4686661 - DNA, 23 bp, Homo sapiens
agcccaagttcatgcagctgtgg

SEQ ID NO: 4686662 - DNA, 16 bp, Homo sapiens
agccgctcctgtctgc

SEQ ID NO: 4686663 - DNA, 14 bp, Homo sapiens
ctaataaaaaggtg

SEQ ID NO: 4686664 - DNA, 15 bp, Homo sapiens
ctaataaaaaggtga

SEQ ID NO: 4686665 - DNA, 19 bp, Homo sapiens
ctaataaaaaggtgaccat

SEQ ID NO: 4686666 - DNA, 15 bp, Homo sapiens
ctaattcacagtgct

SEQ ID NO: 4686667 - DNA, 17 bp, Homo sapiens
ctacctcactggggtcc

SEQ ID NO: 4686668 - DNA, 19 bp, Homo sapiens
ctactttataactaacatg

SEQ ID NO: 4686669 - DNA, 13 bp, Homo sapiens
ctagaactccctt

SEQ ID NO: 4686670 - DNA, 16 bp, Homo sapiens
ctagaactccctttca

SEQ ID NO: 4686671 - DNA, 19 bp, Homo sapiens
ctagaactccctttcaaca

SEQ ID NO: 4686672 - DNA, 16 bp, Homo sapiens
ctagcacttggagcca

SEQ ID NO: 4686673 - DNA, 16 bp, Homo sapiens
ctagcatgaagacaga

SEQ ID NO: 4686674 - DNA, 16 bp, Homo sapiens
ctagccgacctcagcc

SEQ ID NO: 4686675 - DNA, 19 bp, Homo sapiens
ctagccgacctcagccttc

SEQ ID NO: 4686676 - DNA, 20 bp, Homo sapiens
ctagccgacctcagccttcc

SEQ ID NO: 4686677 - DNA, 13 bp, Homo sapiens
ctatcaaactgaa

SEQ ID NO: 4686678 - DNA, 16 bp, Homo sapiens
ctatcaaactgaagcc

SEQ ID NO: 4686679 - DNA, 19 bp, Homo sapiens
ctattatctgtcagctgca

SEQ ID NO: 4686680 - DNA, 17 bp, Homo sapiens
ctcactggggtcctggg

SEQ ID NO: 4686681 - DNA, 21 bp, Homo sapiens
ctcagatgcacatgagctggc

SEQ ID NO: 4686682 - DNA, 12 bp, Homo sapiens
ctcagcctggtg

SEQ ID NO: 4686683 - DNA, 18 bp, Homo sapiens
ctcagcctggtgggcctc

SEQ ID NO: 4686684 - DNA, 22 bp, Homo sapiens
ctcagccttccccttgcccagg

SEQ ID NO: 4686685 - DNA, 23 bp, Homo sapiens
ctcagccttccccttgcccaggg

SEQ ID NO: 4686686 - DNA, 12 bp, Homo sapiens
ctcagggcccca

SEQ ID NO: 4686687 - DNA, 13 bp, Homo sapiens
ctcagggccccag

SEQ ID NO: 4686688 - DNA, 22 bp, Homo sapiens
ctcatgctgccaatatcctaat

SEQ ID NO: 4686689 - DNA, 15 bp, Homo sapiens
ctcatgggtggcact

SEQ ID NO: 4686690 - DNA, 23 bp, Homo sapiens
ctcatttttataatgtcccttca

SEQ ID NO: 4686691 - DNA, 13 bp, Homo sapiens
ctccacttggtct

SEQ ID NO: 4686692 - DNA, 15 bp, Homo sapiens
ctccacttggtctgt

SEQ ID NO: 4686693 - DNA, 20 bp, Homo sapiens
ctccagctgactaaactttt

SEQ ID NO: 4686694 - DNA, 20 bp, Homo sapiens
ctcccacctgacacaccagg

SEQ ID NO: 4686695 - DNA, 13 bp, Homo sapiens
ctccctttcaaca

SEQ ID NO: 4686696 - DNA, 16 bp, Homo sapiens
ctcctcactgtatcca

SEQ ID NO: 4686697 - DNA, 19 bp, Homo sapiens
ctcctcactgtatccaggt

SEQ ID NO: 4686698 - DNA, 13 bp, Homo sapiens
ctcctgtctgcca

SEQ ID NO: 4686699 - DNA, 18 bp, Homo sapiens
ctcggtggacccagggat

SEQ ID NO: 4686700 - DNA, 17 bp, Homo sapiens
ctctaattcacagtgct

SEQ ID NO: 4686701 - DNA, 11 bp, Homo sapiens
ctctcagccaa

SEQ ID NO: 4686702 - DNA, 14 bp, Homo sapiens
ctctccagctgact

SEQ ID NO: 4686703 - DNA, 16 bp, Homo sapiens
ctctctggccttcggc

SEQ ID NO: 4686704 - DNA, 20 bp, Homo sapiens
ctctgcactcccacctgaca

SEQ ID NO: 4686705 - DNA, 15 bp, Homo sapiens
agtatttagaagcca

SEQ ID NO: 4686706 - DNA, 13 bp, Homo sapiens
agtattttttgta

SEQ ID NO: 4686707 - DNA, 22 bp, Homo sapiens
agtattttttgtataattggat

SEQ ID NO: 4686708 - DNA, 11 bp, Homo sapiens
agtcatcttgc

SEQ ID NO: 4686709 - DNA, 18 bp, Homo sapiens
agtctctcttctctccag

SEQ ID NO: 4686710 - DNA, 23 bp, Homo sapiens
agtctctcttctctccagctgac

SEQ ID NO: 4686711 - DNA, 22 bp, Homo sapiens
agtgctgtttattaatcttagt

SEQ ID NO: 4686712 - DNA, 20 bp, Homo sapiens
agtgcttggcccaggagttt

SEQ ID NO: 4686713 - DNA, 20 bp, Homo sapiens
agtggacaccaggagtccct

SEQ ID NO: 4686714 - DNA, 14 bp, Homo sapiens
agttacagttctgt

SEQ ID NO: 4686715 - DNA, 15 bp, Homo sapiens
agttacagttctgtg

SEQ ID NO: 4686716 - DNA, 16 bp, Homo sapiens
agttacagttctgtgg

SEQ ID NO: 4686717 - DNA, 15 bp, Homo sapiens
agttactgtgtaatt

SEQ ID NO: 4686718 - DNA, 20 bp, Homo sapiens
agttggtaacttttgtgaat

SEQ ID NO: 4686719 - DNA, 13 bp, Homo sapiens
agttgtttcattg

SEQ ID NO: 4686720 - DNA, 16 bp, Homo sapiens
agttgtttcattgact

SEQ ID NO: 4686721 - DNA, 19 bp, Homo sapiens
agttgtttcattgactatc

SEQ ID NO: 4686722 - DNA, 18 bp, Homo sapiens
ataaagttggtgacagat

SEQ ID NO: 4686723 - DNA, 13 bp, Homo sapiens
ataaatatatcta

SEQ ID NO: 4686724 - DNA, 22 bp, Homo sapiens
ataacctgtctcacctggactt

SEQ ID NO: 4686725 - DNA, 13 bp, Homo sapiens
ataagtactgtgt

SEQ ID NO: 4686726 - DNA, 18 bp, Homo sapiens
ataagtactgtgtacaga

SEQ ID NO: 4686727 - DNA, 13 bp, Homo sapiens
ataatttacctaa

SEQ ID NO: 4686728 - DNA, 16 bp, Homo sapiens
ataatttacctaagat

SEQ ID NO: 4686729 - DNA, 18 bp, Homo sapiens
atagaataaaggcagttt

SEQ ID NO: 4686730 - DNA, 19 bp, Homo sapiens
atagaataaaggcagtttt

SEQ ID NO: 4686731 - DNA, 12 bp, Homo sapiens
atagctctgggg

SEQ ID NO: 4686732 - DNA, 18 bp, Homo sapiens
atagttactgtgtaatta

SEQ ID NO: 4686733 - DNA, 13 bp, Homo sapiens
atatcctaataaa

SEQ ID NO: 4686734 - DNA, 23 bp, Homo sapiens
atatcctaataaaaaggtgacca

SEQ ID NO: 4686735 - DNA, 17 bp, Homo sapiens
atcaaactgaagccaga

SEQ ID NO: 4686736 - DNA, 22 bp, Homo sapiens
atcctaataaaaaggtgaccat

SEQ ID NO: 4686737 - DNA, 16 bp, Homo sapiens
atcctgaggctccact

SEQ ID NO: 4686738 - DNA, 14 bp, Homo sapiens
atctaccccagact

SEQ ID NO: 4686739 - DNA, 14 bp, Homo sapiens
atcttagtgtatga

SEQ ID NO: 4686740 - DNA, 14 bp, Homo sapiens
atcttgctaccagt

SEQ ID NO: 4686741 - DNA, 22 bp, Homo sapiens
atgattactggcctttttcatt

SEQ ID NO: 4686742 - DNA, 20 bp, Homo sapiens
atgctagaactccctttcaa

SEQ ID NO: 4686743 - DNA, 22 bp, Homo sapiens
atgctagaactccctttcaaca

SEQ ID NO: 4686744 - DNA, 14 bp, Homo sapiens
atgctgccaatatc

SEQ ID NO: 4686745 - DNA, 17 bp, Homo sapiens
atgctgccaatatccta

SEQ ID NO: 4686746 - DNA, 18 bp, Homo sapiens
atgctgccaatatcctaa

SEQ ID NO: 4686747 - DNA, 22 bp, Homo sapiens
atgctgccaatatcctaataaa

SEQ ID NO: 4686748 - DNA, 23 bp, Homo sapiens
atgctgccaatatcctaataaaa

SEQ ID NO: 4686749 - DNA, 16 bp, Homo sapiens
atggcataacctgtct

SEQ ID NO: 4686750 - DNA, 12 bp, Homo sapiens
atgtagtatttt

SEQ ID NO: 4686751 - DNA, 21 bp, Homo sapiens
atgtagtattttttgtataat

SEQ ID NO: 4686752 - DNA, 20 bp, Homo sapiens
atgtcctgcctattatctgt

SEQ ID NO: 4686753 - DNA, 21 bp, Homo sapiens
atgtcctgcctattatctgtc

SEQ ID NO: 4686754 - DNA, 19 bp, Homo sapiens
atgtcttgggtaggcggga

SEQ ID NO: 4686755 - DNA, 21 bp, Homo sapiens
atgtggtgggacagggaccca

SEQ ID NO: 4686756 - DNA, 23 bp, Homo sapiens
atgttagttaccttatagttact

SEQ ID NO: 4686757 - DNA, 20 bp, Homo sapiens
attaaatatgttagcaaaga

SEQ ID NO: 4686758 - DNA, 16 bp, Homo sapiens
attaatcttagtgtat

SEQ ID NO: 4686759 - DNA, 17 bp, Homo sapiens
attaatcttagtgtatg

SEQ ID NO: 4686760 - DNA, 19 bp, Homo sapiens
attaatcttagtgtatgat

SEQ ID NO: 4686761 - DNA, 22 bp, Homo sapiens
attaatcttagtgtatgattac

SEQ ID NO: 4686762 - DNA, 23 bp, Homo sapiens
attacaaatcagaagtcatcttg

SEQ ID NO: 4686763 - DNA, 21 bp, Homo sapiens
attactggcctttttcattta

SEQ ID NO: 4686764 - DNA, 22 bp, Homo sapiens
attactggcctttttcatttat

SEQ ID NO: 4686765 - DNA, 18 bp, Homo sapiens
attagacactttggaaga

SEQ ID NO: 4686766 - DNA, 17 bp, Homo sapiens
attaggctgtaactact

SEQ ID NO: 4686767 - DNA, 21 bp, Homo sapiens
cattacagtgggtgcccccct

SEQ ID NO: 4686768 - DNA, 14 bp, Homo sapiens
catttatctataat

SEQ ID NO: 4686769 - DNA, 16 bp, Homo sapiens
catttatctataattt

SEQ ID NO: 4686770 - DNA, 13 bp, Homo sapiens
ccaatatcctaat

SEQ ID NO: 4686771 - DNA, 16 bp, Homo sapiens
ccaatatcctaataaa

SEQ ID NO: 4686772 - DNA, 17 bp, Homo sapiens
ccacctgacacaccagg

SEQ ID NO: 4686773 - DNA, 20 bp, Homo sapiens
ccacctgacacaccaggcgc

SEQ ID NO: 4686774 - DNA, 21 bp, Homo sapiens
ccagaaataaagttggtgaca

SEQ ID NO: 4686775 - DNA, 23 bp, Homo sapiens
ccagacatgtggtgggacaggga

SEQ ID NO: 4686776 - DNA, 17 bp, Homo sapiens
ccagaggagccaccagt

SEQ ID NO: 4686777 - DNA, 19 bp, Homo sapiens
ccagaggagccaccagttc

SEQ ID NO: 4686778 - DNA, 18 bp, Homo sapiens
ccagcactaaagcagtgg

SEQ ID NO: 4686779 - DNA, 20 bp, Homo sapiens
ccagcagccagctctcagcc

SEQ ID NO: 4686780 - DNA, 21 bp, Homo sapiens
ccagcagccagctctcagcca

SEQ ID NO: 4686781 - DNA, 19 bp, Homo sapiens
ccagccagcagccagctct

SEQ ID NO: 4686782 - DNA, 12 bp, Homo sapiens
ccagctctcagc

SEQ ID NO: 4686783 - DNA, 14 bp, Homo sapiens
ccagctctcagcca

SEQ ID NO: 4686784 - DNA, 15 bp, Homo sapiens
ccagctctcagccaa

SEQ ID NO: 4686785 - DNA, 17 bp, Homo sapiens
ccagctgactaaacttt

SEQ ID NO: 4686786 - DNA, 17 bp, Homo sapiens
ccaggagtttggccaga

SEQ ID NO: 4686787 - DNA, 18 bp, Homo sapiens
ccagggccctgagctcgg

SEQ ID NO: 4686788 - DNA, 12 bp, Homo sapiens
ccagggctcagc

SEQ ID NO: 4686789 - DNA, 16 bp, Homo sapiens
ccagggctcagcctgg

SEQ ID NO: 4686790 - DNA, 16 bp, Homo sapiens
ccagttaatttttcca

SEQ ID NO: 4686791 - DNA, 18 bp, Homo sapiens
ccagttaatttttccaac

SEQ ID NO: 4686792 - DNA, 20 bp, Homo sapiens
ccatcctgaggctccacttg

SEQ ID NO: 4686793 - DNA, 20 bp, Homo sapiens
cccagactagatgtagtatt

SEQ ID NO: 4686794 - DNA, 19 bp, Homo sapiens
cccaggagtttggccagaa

SEQ ID NO: 4686795 - DNA, 14 bp, Homo sapiens
cccagggctcagcc

SEQ ID NO: 4686796 - DNA, 20 bp, Homo sapiens
cccagggctcagcctggtgg

SEQ ID NO: 4686797 - DNA, 13 bp, Homo sapiens
cccgtcttcagcc

SEQ ID NO: 4686798 - DNA, 18 bp, Homo sapiens
cccgtcttcagcctagcc

SEQ ID NO: 4686799 - DNA, 13 bp, Homo sapiens
cccgttttgtcac

SEQ ID NO: 4686800 - DNA, 22 bp, Homo sapiens
ccctgagctcggtggacccagg

SEQ ID NO: 4686801 - DNA, 19 bp, Homo sapiens
cccttatgcggttaatttt

SEQ ID NO: 4686802 - DNA, 13 bp, Homo sapiens
cccttctctgtat

SEQ ID NO: 4686803 - DNA, 15 bp, Homo sapiens
cccttgccagacatg

SEQ ID NO: 4686804 - DNA, 12 bp, Homo sapiens
cccttgcccagg

SEQ ID NO: 4686805 - DNA, 19 bp, Homo sapiens
ctctggccttcggcctcca

SEQ ID NO: 4686806 - DNA, 20 bp, Homo sapiens
ctctgtccagggccctgagc

SEQ ID NO: 4686807 - DNA, 15 bp, Homo sapiens
ctcttctctccagct

SEQ ID NO: 4686808 - DNA, 19 bp, Homo sapiens
ctgacacaccaggcgctaa

SEQ ID NO: 4686809 - DNA, 23 bp, Homo sapiens
ctgacacaccaggcgctaattca

SEQ ID NO: 4686810 - DNA, 21 bp, Homo sapiens
ctgacacatgctgaacatcac

SEQ ID NO: 4686811 - DNA, 22 bp, Homo sapiens
ctgactaaactttttttctgta

SEQ ID NO: 4686812 - DNA, 13 bp, Homo sapiens
ctgaggcagacag

SEQ ID NO: 4686813 - DNA, 14 bp, Homo sapiens
ctgaggcagacagc

SEQ ID NO: 4686814 - DNA, 18 bp, Homo sapiens
ctgaggcagacagcagct

SEQ ID NO: 4686815 - DNA, 22 bp, Homo sapiens
ctgaggcagacagcagctcagg

SEQ ID NO: 4686816 - DNA, 17 bp, Homo sapiens
ctgcaaggtactctggt

SEQ ID NO: 4686817 - DNA, 13 bp, Homo sapiens
ctgccaatatcct

SEQ ID NO: 4686818 - DNA, 14 bp, Homo sapiens
ctgccaatatccta

SEQ ID NO: 4686819 - DNA, 17 bp, Homo sapiens
ctgccaatatcctaata

SEQ ID NO: 4686820 - DNA, 20 bp, Homo sapiens
ctgccaatatcctaataaaa

SEQ ID NO: 4686821 - DNA, 22 bp, Homo sapiens
ctgccaatatcctaataaaaag

SEQ ID NO: 4686822 - DNA, 15 bp, Homo sapiens
ctgccagccagcagc

SEQ ID NO: 4686823 - DNA, 20 bp, Homo sapiens
ctgccagccagcagccagct

SEQ ID NO: 4686824 - DNA, 15 bp, Homo sapiens
ctgccctagagcaca

SEQ ID NO: 4686825 - DNA, 21 bp, Homo sapiens
ctgccctagagcacactgtag

SEQ ID NO: 4686826 - DNA, 23 bp, Homo sapiens
ctgcctattatctgtcagctgca

SEQ ID NO: 4686827 - DNA, 12 bp, Homo sapiens
ctgctacctcac

SEQ ID NO: 4686828 - DNA, 22 bp, Homo sapiens
ctgctagcacttggagccaagg

SEQ ID NO: 4686829 - DNA, 17 bp, Homo sapiens
ctgctctaacagccctc

SEQ ID NO: 4686830 - DNA, 20 bp, Homo sapiens
ctgcttatccgttagccgtg

SEQ ID NO: 4686831 - DNA, 22 bp, Homo sapiens
ctggacttaagcatctggctct

SEQ ID NO: 4686832 - DNA, 18 bp, Homo sapiens
ctggatagtccgtctctg

SEQ ID NO: 4686833 - DNA, 19 bp, Homo sapiens
ctggatagtccgtctctgc

SEQ ID NO: 4686834 - DNA, 13 bp, Homo sapiens
ctggcccaccagg

SEQ ID NO: 4686835 - DNA, 21 bp, Homo sapiens
ctggccttcggcctccatcct

SEQ ID NO: 4686836 - DNA, 19 bp, Homo sapiens
ctggctctaattcacagtg

SEQ ID NO: 4686837 - DNA, 22 bp, Homo sapiens
ctggctctaattcacagtgctc

SEQ ID NO: 4686838 - DNA, 23 bp, Homo sapiens
ctggctctaattcacagtgctct

SEQ ID NO: 4686839 - DNA, 20 bp, Homo sapiens
ctggggcctcggagcctcat

SEQ ID NO: 4686840 - DNA, 15 bp, Homo sapiens
ctggggtcctggggc

SEQ ID NO: 4686841 - DNA, 18 bp, Homo sapiens
ctggggtcctggggcctc

SEQ ID NO: 4686842 - DNA, 16 bp, Homo sapiens
ctggggtgggcagttt

SEQ ID NO: 4686843 - DNA, 18 bp, Homo sapiens
ctggggtgggcagttttt

SEQ ID NO: 4686844 - DNA, 23 bp, Homo sapiens
ctggggtgggtggggcagtgctt

SEQ ID NO: 4686845 - DNA, 20 bp, Homo sapiens
ctgtcatcctcaaagaaagt

SEQ ID NO: 4686846 - DNA, 22 bp, Homo sapiens
ctgtcatcctcaaagaaagtgt

SEQ ID NO: 4686847 - DNA, 23 bp, Homo sapiens
ctgtccagggccctgagctcggt

SEQ ID NO: 4686848 - DNA, 12 bp, Homo sapiens
ctgtctcacctg

SEQ ID NO: 4686849 - DNA, 15 bp, Homo sapiens
ctgtctgccagccag

SEQ ID NO: 4686850 - DNA, 16 bp, Homo sapiens
ctgtctgccagccagc

SEQ ID NO: 4686851 - DNA, 23 bp, Homo sapiens
ctgtggcagagttacagttctgt

SEQ ID NO: 4686852 - DNA, 21 bp, Homo sapiens
ctgtgtacagaattctgctac

SEQ ID NO: 4686853 - DNA, 16 bp, Homo sapiens
ctgtttattaatctta

SEQ ID NO: 4686854 - DNA, 18 bp, Homo sapiens
cttaacttcttgcttctt

SEQ ID NO: 4686855 - DNA, 21 bp, Homo sapiens
cttaacttcttgcttctttct

SEQ ID NO: 4686856 - DNA, 21 bp, Homo sapiens
cttaatgtatgttaccaaaaa

SEQ ID NO: 4686857 - DNA, 19 bp, Homo sapiens
cttagaccctcatgctgcc

SEQ ID NO: 4686858 - DNA, 17 bp, Homo sapiens
cttagacctcagcctgt

SEQ ID NO: 4686859 - DNA, 18 bp, Homo sapiens
cttagacctcagcctgtg

SEQ ID NO: 4686860 - DNA, 20 bp, Homo sapiens
cttagacctcagcctgtgct

SEQ ID NO: 4686861 - DNA, 20 bp, Homo sapiens
tgcagctctccccttctctg

SEQ ID NO: 4686862 - DNA, 22 bp, Homo sapiens
tgcagctgtggcagagttacag

SEQ ID NO: 4686863 - DNA, 21 bp, Homo sapiens
tgccaatatcctaataaaaag

SEQ ID NO: 4686864 - DNA, 12 bp, Homo sapiens
tgccagccagca

SEQ ID NO: 4686865 - DNA, 14 bp, Homo sapiens
tgcccagggctcag

SEQ ID NO: 4686866 - DNA, 19 bp, Homo sapiens
tgcccagggctcagcctgg

SEQ ID NO: 4686867 - DNA, 23 bp, Homo sapiens
tgcccagggctcagcctggtggg

SEQ ID NO: 4686868 - DNA, 21 bp, Homo sapiens
tgcggttaattttgaagtgct

SEQ ID NO: 4686869 - DNA, 14 bp, Homo sapiens
tgctacctcactgg

SEQ ID NO: 4686870 - DNA, 22 bp, Homo sapiens
tgctacctcactggggtcctgg

SEQ ID NO: 4686871 - DNA, 14 bp, Homo sapiens
tgctagaactccct

SEQ ID NO: 4686872 - DNA, 15 bp, Homo sapiens
tgctagaactccctt

SEQ ID NO: 4686873 - DNA, 13 bp, Homo sapiens
tgctcttttctcc

SEQ ID NO: 4686874 - DNA, 19 bp, Homo sapiens
tgctgcaagcacagccctt

SEQ ID NO: 4686875 - DNA, 18 bp, Homo sapiens
tgctgccaatatcctaat

SEQ ID NO: 4686876 - DNA, 23 bp, Homo sapiens
tgctgccaatatcctaataaaaa

SEQ ID NO: 4686877 - DNA, 20 bp, Homo sapiens
tgctgcccgtcttcagccta

SEQ ID NO: 4686878 - DNA, 21 bp, Homo sapiens
tgctgcccgtcttcagcctag

SEQ ID NO: 4686879 - DNA, 23 bp, Homo sapiens
tgctgtttattaatcttagtgta

SEQ ID NO: 4686880 - DNA, 15 bp, Homo sapiens
tgcttggcccaggag

SEQ ID NO: 4686881 - DNA, 12 bp, Homo sapiens
tggaaataaagt

SEQ ID NO: 4686882 - DNA, 14 bp, Homo sapiens
tggaaataaagtca

SEQ ID NO: 4686883 - DNA, 16 bp, Homo sapiens
tggaaataaagtcaga

SEQ ID NO: 4686884 - DNA, 20 bp, Homo sapiens
tggacccagggatgacatgt

SEQ ID NO: 4686885 - DNA, 17 bp, Homo sapiens
tggagccaagggttcag

SEQ ID NO: 4686886 - DNA, 12 bp, Homo sapiens
tggcagagttac

SEQ ID NO: 4686887 - DNA, 17 bp, Homo sapiens
tggcagagttacagttc

SEQ ID NO: 4686888 - DNA, 19 bp, Homo sapiens
tggcagagttacagttctg

SEQ ID NO: 4686889 - DNA, 15 bp, Homo sapiens
tggcatagctctggg

SEQ ID NO: 4686890 - DNA, 11 bp, Homo sapiens
tggcccaggag

SEQ ID NO: 4686891 - DNA, 12 bp, Homo sapiens
tggcccaggagt

SEQ ID NO: 4686892 - DNA, 22 bp, Homo sapiens
tggcccaggagtttggccagaa

SEQ ID NO: 4686893 - DNA, 22 bp, Homo sapiens
tggccttcggcctccatcctga

SEQ ID NO: 4686894 - DNA, 20 bp, Homo sapiens
tggcctttttcatttatcta

SEQ ID NO: 4686895 - DNA, 19 bp, Homo sapiens
tggctctaattcacagtgc

SEQ ID NO: 4686896 - DNA, 15 bp, Homo sapiens
tgggcagttttttga

SEQ ID NO: 4686897 - DNA, 16 bp, Homo sapiens
tgggcagttttttgaa

SEQ ID NO: 4686898 - DNA, 18 bp, Homo sapiens
tgggctcaaccagaaaag

SEQ ID NO: 4686899 - DNA, 16 bp, Homo sapiens
tggggtcctggggcct

SEQ ID NO: 4686900 - DNA, 23 bp, Homo sapiens
tgggtgccccccttgccagacat

SEQ ID NO: 4686901 - DNA, 16 bp, Homo sapiens
tggtgatttagcagga

SEQ ID NO: 4686902 - DNA, 15 bp, Homo sapiens
tggtttaaagaaagt

SEQ ID NO: 4686903 - DNA, 17 bp, Homo sapiens
tggtttaaagaaagtgt

SEQ ID NO: 4686904 - DNA, 19 bp, Homo sapiens
tggtttaaagaaagtgtat

SEQ ID NO: 4686905 - DNA, 15 bp, Homo sapiens
tggtttcatgttagt

SEQ ID NO: 4686906 - DNA, 18 bp, Homo sapiens
tgtacagaattctgctac

SEQ ID NO: 4686907 - DNA, 12 bp, Homo sapiens
tgtaccagttaa

SEQ ID NO: 4686908 - DNA, 15 bp, Homo sapiens
tgtaccagttaattt

SEQ ID NO: 4686909 - DNA, 23 bp, Homo sapiens
tgtaccagttaatttttccaact

SEQ ID NO: 4686910 - DNA, 18 bp, Homo sapiens
tgtagtattttttgtata

SEQ ID NO: 4686911 - DNA, 19 bp, Homo sapiens
tgtagtattttttgtataa

SEQ ID NO: 4686912 - DNA, 14 bp, Homo sapiens
tgtataattggatt

SEQ ID NO: 4686913 - DNA, 13 bp, Homo sapiens
tgtatttaaatat

SEQ ID NO: 4686914 - DNA, 12 bp, Homo sapiens
tgtatttggaaa

SEQ ID NO: 4686915 - DNA, 13 bp, Homo sapiens
tgtatttggaaat

SEQ ID NO: 4686916 - DNA, 16 bp, Homo sapiens
tgtcactttttctgat

SEQ ID NO: 4686917 - DNA, 22 bp, Homo sapiens
tgtcagctgcaaggtactctgg

SEQ ID NO: 4686918 - DNA, 16 bp, Homo sapiens
tgtcatcctcaaagaa

SEQ ID NO: 4686919 - DNA, 21 bp, Homo sapiens
tgtcatcctcaaagaaagtgt

SEQ ID NO: 4686920 - DNA, 20 bp, Homo sapiens
tgtccagccccgtagacgtg

SEQ ID NO: 4686921 - DNA, 13 bp, Homo sapiens
tgtccagggccct

SEQ ID NO: 4686922 - DNA, 17 bp, Homo sapiens
tgtccagggccctgagc

SEQ ID NO: 4686923 - DNA, 17 bp, Homo sapiens
tgtcctgcctattatct

SEQ ID NO: 4686924 - DNA, 19 bp, Homo sapiens
tgtctgccagccagcagcc

SEQ ID NO: 4686925 - DNA, 15 bp, Homo sapiens
tgtgagatgctagaa

SEQ ID NO: 4686926 - DNA, 22 bp, Homo sapiens
tgtgagatgctagaactccctt

SEQ ID NO: 4686927 - DNA, 14 bp, Homo sapiens
tgtggctgctagca

SEQ ID NO: 4686928 - DNA, 22 bp, Homo sapiens
tgtggtttcatgttagttacct

SEQ ID NO: 4686929 - DNA, 13 bp, Homo sapiens
tgtgttatttaaa

SEQ ID NO: 4686930 - DNA, 16 bp, Homo sapiens
tgtgttatttaaatga

SEQ ID NO: 4686931 - DNA, 19 bp, Homo sapiens
tgttaccaaaaataaatat

SEQ ID NO: 4686932 - DNA, 23 bp, Homo sapiens
tgttaccaaaaataaatatatct

SEQ ID NO: 4686933 - DNA, 20 bp, Homo sapiens
tgttagttaccttatagtta

SEQ ID NO: 4686934 - DNA, 14 bp, Homo sapiens
ttaacttcttgctt

SEQ ID NO: 4686935 - DNA, 22 bp, Homo sapiens
ttaagcatctggctctaattca

SEQ ID NO: 4686936 - DNA, 21 bp, Homo sapiens
ttaatcttagtgtatgattac

SEQ ID NO: 4686937 - DNA, 13 bp, Homo sapiens
ttaatgtatgtta

SEQ ID NO: 4686938 - DNA, 19 bp, Homo sapiens
ttaattttgaagtgctgtt

SEQ ID NO: 4686939 - DNA, 20 bp, Homo sapiens
ttaattttgaagtgctgttt

SEQ ID NO: 4686940 - DNA, 15 bp, Homo sapiens
ttaatttttccaact

SEQ ID NO: 4686941 - DNA, 13 bp, Homo sapiens
ttacagttctgtg

SEQ ID NO: 4686942 - DNA, 22 bp, Homo sapiens
ttacagttctgtggtttcatgt

SEQ ID NO: 4686943 - DNA, 21 bp, Homo sapiens
ttaccaaaaataaatatatct

SEQ ID NO: 4686944 - DNA, 18 bp, Homo sapiens
ttaccttatagttactgt

SEQ ID NO: 4686945 - DNA, 16 bp, Homo sapiens
ttactggcctttttca

SEQ ID NO: 4686946 - DNA, 11 bp, Homo sapiens
ttagacctcag

SEQ ID NO: 4686947 - DNA, 19 bp, Homo sapiens
ttagcaaagagttaatata

SEQ ID NO: 4686948 - DNA, 21 bp, Homo sapiens
ttagccgtggtgatttagcag

SEQ ID NO: 4686949 - DNA, 16 bp, Homo sapiens
ttagcttagacctcag

SEQ ID NO: 4686950 - DNA, 13 bp, Homo sapiens
ttagttaccttat

SEQ ID NO: 4686951 - DNA, 18 bp, Homo sapiens
ttagttaccttatagtta

SEQ ID NO: 4686952 - DNA, 20 bp, Homo sapiens
ttagttaccttatagttact

SEQ ID NO: 4686953 - DNA, 21 bp, Homo sapiens
ttagttaccttatagttactg

SEQ ID NO: 4686954 - DNA, 22 bp, Homo sapiens
ttagttaccttatagttactgt

SEQ ID NO: 4686955 - DNA, 15 bp, Homo sapiens
ttataactaacatgt

SEQ ID NO: 4686956 - DNA, 15 bp, Homo sapiens
ttatctataatttac

SEQ ID NO: 4686957 - DNA, 22 bp, Homo sapiens
ttatctataatttacctaagat

SEQ ID NO: 4686958 - DNA, 16 bp, Homo sapiens
ttatgcggttaatttt

SEQ ID NO: 4686959 - DNA, 21 bp, Homo sapiens
ttattaacgatgtccaacccg

SEQ ID NO: 4686960 - DNA, 12 bp, Homo sapiens
ttatttaaatga

SEQ ID NO: 4686961 - DNA, 20 bp, Homo sapiens
aatatatctaccccagacta

SEQ ID NO: 4686962 - DNA, 12 bp, Homo sapiens
aatatcctaata

SEQ ID NO: 4686963 - DNA, 15 bp, Homo sapiens
aatatcctaataaaa

SEQ ID NO: 4686964 - DNA, 19 bp, Homo sapiens
aatatcctaataaaaaggt

SEQ ID NO: 4686965 - DNA, 16 bp, Homo sapiens
aatgggctcaaccaga

SEQ ID NO: 4686966 - DNA, 17 bp, Homo sapiens
aattaggctgtaactac

SEQ ID NO: 4686967 - DNA, 17 bp, Homo sapiens
aattagtgccacttaat

SEQ ID NO: 4686968 - DNA, 23 bp, Homo sapiens
aattcaaggaatttcttaacttc

SEQ ID NO: 4686969 - DNA, 15 bp, Homo sapiens
aattctgctacctca

SEQ ID NO: 4686970 - DNA, 16 bp, Homo sapiens
aattctgctacctcac

SEQ ID NO: 4686971 - DNA, 11 bp, Homo sapiens
aattggatttc

SEQ ID NO: 4686972 - DNA, 16 bp, Homo sapiens
aatttacctaagatta

SEQ ID NO: 4686973 - DNA, 21 bp, Homo sapiens
aatttacctaagattacaaat

SEQ ID NO: 4686974 - DNA, 12 bp, Homo sapiens
aatttcttaact

SEQ ID NO: 4686975 - DNA, 20 bp, Homo sapiens
aatttcttaacttcttgctt

SEQ ID NO: 4686976 - DNA, 14 bp, Homo sapiens
aattttgaagtgct

SEQ ID NO: 4686977 - DNA, 20 bp, Homo sapiens
aatttttccaactactaata

SEQ ID NO: 4686978 - DNA, 15 bp, Homo sapiens
acaaatcagaagtca

SEQ ID NO: 4686979 - DNA, 17 bp, Homo sapiens
acacacaggcaactgag

SEQ ID NO: 4686980 - DNA, 16 bp, Homo sapiens
acacaggcaactgagg

SEQ ID NO: 4686981 - DNA, 13 bp, Homo sapiens
acactgctctaac

SEQ ID NO: 4686982 - DNA, 16 bp, Homo sapiens
acactgggggagggga

SEQ ID NO: 4686983 - DNA, 23 bp, Homo sapiens
acagcccttatgcggttaatttt

SEQ ID NO: 4686984 - DNA, 16 bp, Homo sapiens
acaggcaactgaggca

SEQ ID NO: 4686985 - DNA, 22 bp, Homo sapiens
acaggcaactgaggcagacagc

SEQ ID NO: 4686986 - DNA, 16 bp, Homo sapiens
acagtgctcttttctc

SEQ ID NO: 4686987 - DNA, 21 bp, Homo sapiens
acagtgggtgccccccttgcc

SEQ ID NO: 4686988 - DNA, 12 bp, Homo sapiens
acagttctgtgg

SEQ ID NO: 4686989 - DNA, 22 bp, Homo sapiens
acagttctgtggtttcatgtta

SEQ ID NO: 4686990 - DNA, 24 bp, Homo sapiens
acagttggtaacttttgtgaatta

SEQ ID NO: 4686991 - DNA, 23 bp, Homo sapiens
acatgtggtgggacagggaccca

SEQ ID NO: 4686992 - DNA, 15 bp, Homo sapiens
accacttcagggctt

SEQ ID NO: 4686993 - DNA, 17 bp, Homo sapiens
accagaaaagcccaagt

SEQ ID NO: 4686994 - DNA, 22 bp, Homo sapiens
accaggagtccctggtaataag

SEQ ID NO: 4686995 - DNA, 14 bp, Homo sapiens
accagtatttagaa

SEQ ID NO: 4686996 - DNA, 13 bp, Homo sapiens
accagttaatttt

SEQ ID NO: 4686997 - DNA, 19 bp, Homo sapiens
accccagactagatgtagt

SEQ ID NO: 4686998 - DNA, 16 bp, Homo sapiens
accctcatgctgccaa

SEQ ID NO: 4686999 - DNA, 18 bp, Homo sapiens
accgttggggattgggga

SEQ ID NO: 4687000 - DNA, 11 bp, Homo sapiens
acctcagcctg

SEQ ID NO: 4687001 - DNA, 12 bp, Homo sapiens
acctcagcctgt

SEQ ID NO: 4687002 - DNA, 19 bp, Homo sapiens
acctgacacaccaggcgct

SEQ ID NO: 4687003 - DNA, 12 bp, Homo sapiens
accttatagtta

SEQ ID NO: 4687004 - DNA, 19 bp, Homo sapiens
accttatagttactgtgta

SEQ ID NO: 4687005 - DNA, 23 bp, Homo sapiens
accttgctgcaagcacagccctt

SEQ ID NO: 4687006 - DNA, 11 bp, Homo sapiens
acgctctctgg

SEQ ID NO: 4687007 - DNA, 16 bp, Homo sapiens
acgtgcacgcacactg

SEQ ID NO: 4687008 - DNA, 20 bp, Homo sapiens
actaaactttttttctgtac

SEQ ID NO: 4687009 - DNA, 20 bp, Homo sapiens
actaaagcagtggacaccag

SEQ ID NO: 4687010 - DNA, 19 bp, Homo sapiens
actactaatagaataaagg

SEQ ID NO: 4687011 - DNA, 12 bp, Homo sapiens
actactttataa

SEQ ID NO: 4687012 - DNA, 16 bp, Homo sapiens
actagatgtagtattt

SEQ ID NO: 4687013 - DNA, 19 bp, Homo sapiens
actatcaaactgaagccag

SEQ ID NO: 4687014 - DNA, 13 bp, Homo sapiens
actcagggcccca

SEQ ID NO: 4687015 - DNA, 16 bp, Homo sapiens
actcccacctgacaca

SEQ ID NO: 4687016 - DNA, 13 bp, Homo sapiens
actgacacatgct

SEQ ID NO: 4687017 - DNA, 19 bp, Homo sapiens
actgaggcagacagcagct

SEQ ID NO: 4687018 - DNA, 22 bp, Homo sapiens
actgaggcagacagcagctcag

SEQ ID NO: 4687019 - DNA, 23 bp, Homo sapiens
actgaggcagacagcagctcagg

SEQ ID NO: 4687020 - DNA, 18 bp, Homo sapiens
actggcctttttcattta

SEQ ID NO: 4687021 - DNA, 19 bp, Homo sapiens
actgtggctgctagcactt

SEQ ID NO: 4687022 - DNA, 13 bp, Homo sapiens
acttaatgtatgt

SEQ ID NO: 4687023 - DNA, 20 bp, Homo sapiens
acttcttgcttctttctaga

SEQ ID NO: 4687024 - DNA, 11 bp, Homo sapiens
acttggagcca

SEQ ID NO: 4687025 - DNA, 13 bp, Homo sapiens
acttggtctgtga

SEQ ID NO: 4687026 - DNA, 14 bp, Homo sapiens
acttggtctgtgag

SEQ ID NO: 4687027 - DNA, 16 bp, Homo sapiens
actttataactaacat

SEQ ID NO: 4687028 - DNA, 20 bp, Homo sapiens
actttttttctgtaccagtt

SEQ ID NO: 4687029 - DNA, 18 bp, Homo sapiens
agaaacagttggtaactt

SEQ ID NO: 4687030 - DNA, 17 bp, Homo sapiens
agaaagtgtatttggaa

SEQ ID NO: 4687031 - DNA, 21 bp, Homo sapiens
agaaataaagttggtgacaga

SEQ ID NO: 4687032 - DNA, 19 bp, Homo sapiens
agaacagccgctcctgtct

SEQ ID NO: 4687033 - DNA, 20 bp, Homo sapiens
agaacagccgctcctgtctg

SEQ ID NO: 4687034 - DNA, 17 bp, Homo sapiens
agaagtcaaggcttaga

SEQ ID NO: 4687035 - DNA, 15 bp, Homo sapiens
agaagtcatcttgct

SEQ ID NO: 4687036 - DNA, 22 bp, Homo sapiens
agaagtcatcttgctaccagta

SEQ ID NO: 4687037 - DNA, 15 bp, Homo sapiens
agaataaaggcagtt

SEQ ID NO: 4687038 - DNA, 21 bp, Homo sapiens
agaataaaggcagttttctaa

SEQ ID NO: 4687039 - DNA, 13 bp, Homo sapiens
agaattctgctac

SEQ ID NO: 4687040 - DNA, 16 bp, Homo sapiens
agacagcagctcaggc

SEQ ID NO: 4687041 - DNA, 17 bp, Homo sapiens
agaccctcatgctgcca

SEQ ID NO: 4687042 - DNA, 21 bp, Homo sapiens
agaccctcatgctgccaatat

SEQ ID NO: 4687043 - DNA, 11 bp, Homo sapiens
agacctcagcc

SEQ ID NO: 4687044 - DNA, 14 bp, Homo sapiens
agacctcagcctgt

SEQ ID NO: 4687045 - DNA, 15 bp, Homo sapiens
agacctcagcctgtg

SEQ ID NO: 4687046 - DNA, 17 bp, Homo sapiens
agacctcagcctgtgct

SEQ ID NO: 4687047 - DNA, 21 bp, Homo sapiens
agactcagggccccagcacta

SEQ ID NO: 4687048 - DNA, 16 bp, Homo sapiens
agactggatagtccgt

SEQ ID NO: 4687049 - DNA, 14 bp, Homo sapiens
agactgtggctgct

SEQ ID NO: 4687050 - DNA, 13 bp, Homo sapiens
agagaaacagttg

SEQ ID NO: 4687051 - DNA, 17 bp, Homo sapiens
agagttacagttctgtg

SEQ ID NO: 4687052 - DNA, 19 bp, Homo sapiens
agatgctagaactcccttt

SEQ ID NO: 4687053 - DNA, 23 bp, Homo sapiens
agatgctagaactccctttcaac

SEQ ID NO: 4687054 - DNA, 14 bp, Homo sapiens
agcacactgtagca

SEQ ID NO: 4687055 - DNA, 19 bp, Homo sapiens
agcacactgtagcattaca

SEQ ID NO: 4687056 - DNA, 14 bp, Homo sapiens
agcactaaagcagt

SEQ ID NO: 4687057 - DNA, 17 bp, Homo sapiens
agcactaaagcagtgga

SEQ ID NO: 4687058 - DNA, 23 bp, Homo sapiens
agcacttggagccaagggttcag

SEQ ID NO: 4687059 - DNA, 15 bp, Homo sapiens
agcagccagctctca

SEQ ID NO: 4687060 - DNA, 18 bp, Homo sapiens
agcagccagctctcagcc

SEQ ID NO: 4687061 - DNA, 13 bp, Homo sapiens
agcagctcaggca

SEQ ID NO: 4687062 - DNA, 20 bp, Homo sapiens
aacagccgctcctgtctgcc

SEQ ID NO: 4687063 - DNA, 19 bp, Homo sapiens
aacatgtcctgcctattat

SEQ ID NO: 4687064 - DNA, 20 bp, Homo sapiens
aacatgtcctgcctattatc

SEQ ID NO: 4687065 - DNA, 13 bp, Homo sapiens
aactactttataa

SEQ ID NO: 4687066 - DNA, 17 bp, Homo sapiens
aactactttataactaa

SEQ ID NO: 4687067 - DNA, 12 bp, Homo sapiens
aactcatttcta

SEQ ID NO: 4687068 - DNA, 13 bp, Homo sapiens
aactgaagccaga

SEQ ID NO: 4687069 - DNA, 18 bp, Homo sapiens
aacttcttgcttctttct

SEQ ID NO: 4687070 - DNA, 15 bp, Homo sapiens
aagaaagtgtatttg

SEQ ID NO: 4687071 - DNA, 18 bp, Homo sapiens
aagaaagtgtatttggaa

SEQ ID NO: 4687072 - DNA, 22 bp, Homo sapiens
aagacagagccccaccctcaga

SEQ ID NO: 4687073 - DNA, 12 bp, Homo sapiens
aagactgtggct

SEQ ID NO: 4687074 - DNA, 22 bp, Homo sapiens
aagcatcattatttgcagagac

SEQ ID NO: 4687075 - DNA, 17 bp, Homo sapiens
aagcatctggctctaat

SEQ ID NO: 4687076 - DNA, 14 bp, Homo sapiens
aaggaatttcttaa

SEQ ID NO: 4687077 - DNA, 18 bp, Homo sapiens
aaggagggttagggaggg

SEQ ID NO: 4687078 - DNA, 16 bp, Homo sapiens
aagtactgtgtacaga

SEQ ID NO: 4687079 - DNA, 13 bp, Homo sapiens
aagtcaaggctta

SEQ ID NO: 4687080 - DNA, 17 bp, Homo sapiens
aagtgctgtttattaat

SEQ ID NO: 4687081 - DNA, 22 bp, Homo sapiens
aagtgctgtttattaatcttag

SEQ ID NO: 4687082 - DNA, 15 bp, Homo sapiens
aagtgtatttggaaa

SEQ ID NO: 4687083 - DNA, 23 bp, Homo sapiens
aataaatatatctaccccagact

SEQ ID NO: 4687084 - DNA, 16 bp, Homo sapiens
aataggaattggtttc

SEQ ID NO: 4687085 - DNA, 13 bp, Homo sapiens
tgaaaataaagaa

SEQ ID NO: 4687086 - DNA, 14 bp, Homo sapiens
tgaaaatataacca

SEQ ID NO: 4687087 - DNA, 22 bp, Homo sapiens
tgaaaatatctcttgtgctttt

SEQ ID NO: 4687088 - DNA, 20 bp, Homo sapiens
tgaaaatgcaacaacatgta

SEQ ID NO: 4687089 - DNA, 23 bp, Homo sapiens
tgaaaatgcaacaacatgtataa

SEQ ID NO: 4687090 - DNA, 11 bp, Homo sapiens
tgaaaatggaa

SEQ ID NO: 4687091 - DNA, 13 bp, Homo sapiens
tgaaaatgtcttg

SEQ ID NO: 4687092 - DNA, 15 bp, Homo sapiens
tgaaaatgtcttgtg

SEQ ID NO: 4687093 - DNA, 16 bp, Homo sapiens
tgaaaatgtcttgtgt

SEQ ID NO: 4687094 - DNA, 13 bp, Homo sapiens
tgaaacacaaaca

SEQ ID NO: 4687095 - DNA, 17 bp, Homo sapiens
tgaaaccttttttaaga

SEQ ID NO: 4687096 - DNA, 18 bp, Homo sapiens
tgaaaccttttttaagat

SEQ ID NO: 4687097 - DNA, 19 bp, Homo sapiens
tgaaaccttttttaagatt

SEQ ID NO: 4687098 - DNA, 21 bp, Homo sapiens
tgaaactccaccttgcgggga

SEQ ID NO: 4687099 - DNA, 16 bp, Homo sapiens
tgaaagctgatttttt

SEQ ID NO: 4687100 - DNA, 12 bp, Homo sapiens
tgaaaggaaaga

SEQ ID NO: 4687101 - DNA, 13 bp, Homo sapiens
tgaaagggcccag

SEQ ID NO: 4687102 - DNA, 16 bp, Homo sapiens
tgaaagggcccagaga

SEQ ID NO: 4687103 - DNA, 20 bp, Homo sapiens
tgaaagtgggtttcaattta

SEQ ID NO: 4687104 - DNA, 14 bp, Homo sapiens
tgaaataaaatata

SEQ ID NO: 4687105 - DNA, 17 bp, Homo sapiens
tgaaatacctgtttctt

SEQ ID NO: 4687106 - DNA, 18 bp, Homo sapiens
tgaaatattaaaatcact

SEQ ID NO: 4687107 - DNA, 13 bp, Homo sapiens
tgaaatcatcaaa

SEQ ID NO: 4687108 - DNA, 19 bp, Homo sapiens
tgaaatcatcaaaaagaaa

SEQ ID NO: 4687109 - DNA, 21 bp, Homo sapiens
tgaaatgaggtcagagcctgc

SEQ ID NO: 4687110 - DNA, 22 bp, Homo sapiens
tgaaatgaggtcagagcctgca

SEQ ID NO: 4687111 - DNA, 18 bp, Homo sapiens
tgaaatggactgactgta

SEQ ID NO: 4687112 - DNA, 18 bp, Homo sapiens
tgaaattaatttgtgaat

SEQ ID NO: 4687113 - DNA, 14 bp, Homo sapiens
tgaaattattttct

SEQ ID NO: 4687114 - DNA, 18 bp, Homo sapiens
tgaaattattttctccaa

SEQ ID NO: 4687115 - DNA, 17 bp, Homo sapiens
tgaacaagcttcagtaa

SEQ ID NO: 4687116 - DNA, 23 bp, Homo sapiens
tgaacacaatacatgttttcact

SEQ ID NO: 4687117 - DNA, 15 bp, Homo sapiens
tgaacacatggcaga

SEQ ID NO: 4687118 - DNA, 14 bp, Homo sapiens
tgaacattccagag

SEQ ID NO: 4687119 - DNA, 23 bp, Homo sapiens
tgaaccacatcttgctctgctga

SEQ ID NO: 4687120 - DNA, 17 bp, Homo sapiens
tgaaccaccacacccag

SEQ ID NO: 4687121 - DNA, 18 bp, Homo sapiens
tgaacctgatgaaaataa

SEQ ID NO: 4687122 - DNA, 12 bp, Homo sapiens
tgaacctggagg

SEQ ID NO: 4687123 - DNA, 15 bp, Homo sapiens
tgaactaatttctgt

SEQ ID NO: 4687124 - DNA, 17 bp, Homo sapiens
tgaactccatcattcat

SEQ ID NO: 4687125 - DNA, 11 bp, Homo sapiens
tgaactcctgg

SEQ ID NO: 4687126 - DNA, 15 bp, Homo sapiens
tgaactcctggcctc

SEQ ID NO: 4687127 - DNA, 17 bp, Homo sapiens
tgaactctgcaactgaa

SEQ ID NO: 4687128 - DNA, 23 bp, Homo sapiens
tgaactgggtacttgtggacaca

SEQ ID NO: 4687129 - DNA, 17 bp, Homo sapiens
tgaactgtggtgccaca

SEQ ID NO: 4687130 - DNA, 22 bp, Homo sapiens
tgaacttgtaaaggaatttaaa

SEQ ID NO: 4687131 - DNA, 14 bp, Homo sapiens
tgaactttcattgg

SEQ ID NO: 4687132 - DNA, 16 bp, Homo sapiens
tgaactttgctgagcc

SEQ ID NO: 4687133 - DNA, 21 bp, Homo sapiens
tgaagaaaaagacctgcattt

SEQ ID NO: 4687134 - DNA, 22 bp, Homo sapiens
tgaagaaaaagacctgcatttg

SEQ ID NO: 4687135 - DNA, 17 bp, Homo sapiens
tgaagaaatctttccag

SEQ ID NO: 4687136 - DNA, 16 bp, Homo sapiens
tgaagaatgtctgtac

SEQ ID NO: 4687137 - DNA, 19 bp, Homo sapiens
tgaagaatgtctgtacctt

SEQ ID NO: 4687138 - DNA, 12 bp, Homo sapiens
tgaagaattatt

SEQ ID NO: 4687139 - DNA, 16 bp, Homo sapiens
tgaagaattattcagt

SEQ ID NO: 4687140 - DNA, 23 bp, Homo sapiens
tgaagaattattcagtgaatttg

SEQ ID NO: 4687141 - DNA, 16 bp, Homo sapiens
tgaagagggaagccag

SEQ ID NO: 4687142 - DNA, 23 bp, Homo sapiens
tgaagatataactattgcccagg

SEQ ID NO: 4687143 - DNA, 21 bp, Homo sapiens
tgaagatattccaactcaaaa

SEQ ID NO: 4687144 - DNA, 21 bp, Homo sapiens
tgaagatcccaacatggtcct

SEQ ID NO: 4687145 - DNA, 22 bp, Homo sapiens
tgaagcaaactctaaaattata

SEQ ID NO: 4687146 - DNA, 19 bp, Homo sapiens
tgaaggacattgcggacag

SEQ ID NO: 4687147 - DNA, 22 bp, Homo sapiens
tgaaggacattgcggacagcca

SEQ ID NO: 4687148 - DNA, 12 bp, Homo sapiens
tgaaggactgtg

SEQ ID NO: 4687149 - DNA, 11 bp, Homo sapiens
tgaaggagccc

SEQ ID NO: 4687150 - DNA, 23 bp, Homo sapiens
tgaaggagccccattcctgggaa

SEQ ID NO: 4687151 - DNA, 14 bp, Homo sapiens
tgaaggcaatgcca

SEQ ID NO: 4687152 - DNA, 20 bp, Homo sapiens
tgaaggccccgcccaggctt

SEQ ID NO: 4687153 - DNA, 16 bp, Homo sapiens
tgaaggctgggttctg

SEQ ID NO: 4687154 - DNA, 20 bp, Homo sapiens
tgaaggctgggttctgatcc

SEQ ID NO: 4687155 - DNA, 15 bp, Homo sapiens
tgaaggtaattaaag

SEQ ID NO: 4687156 - DNA, 13 bp, Homo sapiens
tgaagtaagcaaa

SEQ ID NO: 4687157 - DNA, 19 bp, Homo sapiens
tgaagtattagacttctaa

SEQ ID NO: 4687158 - DNA, 14 bp, Homo sapiens
tgaagtcacacagt

SEQ ID NO: 4687159 - DNA, 17 bp, Homo sapiens
tgaagtgaaaaacagaa

SEQ ID NO: 4687160 - DNA, 14 bp, Homo sapiens
tgaagtgagtttta

SEQ ID NO: 4687161 - DNA, 16 bp, Homo sapiens
tgaagtttccttggct

SEQ ID NO: 4687162 - DNA, 21 bp, Homo sapiens
tgaagtttccttggctggtgc

SEQ ID NO: 4687163 - DNA, 14 bp, Homo sapiens
tgaataaaaagaaa

SEQ ID NO: 4687164 - DNA, 22 bp, Homo sapiens
tgaataaaccagtatcgttact

SEQ ID NO: 4687165 - DNA, 20 bp, Homo sapiens
tgaataaagggaacatgcag

SEQ ID NO: 4687166 - DNA, 23 bp, Homo sapiens
tgaataaagggaacatgcagctc

SEQ ID NO: 4687167 - DNA, 14 bp, Homo sapiens
tgaatacttgaagt

SEQ ID NO: 4687168 - DNA, 15 bp, Homo sapiens
tgaatacttgaagta

SEQ ID NO: 4687169 - DNA, 15 bp, Homo sapiens
tgaatactttataaa

SEQ ID NO: 4687170 - DNA, 14 bp, Homo sapiens
tgaatataaacact

SEQ ID NO: 4687171 - DNA, 22 bp, Homo sapiens
tgaatatttacgtttttgtaaa

SEQ ID NO: 4687172 - DNA, 15 bp, Homo sapiens
tgaatctagcttatt

SEQ ID NO: 4687173 - DNA, 23 bp, Homo sapiens
tgaatctagcttattttgaggct

SEQ ID NO: 4687174 - DNA, 14 bp, Homo sapiens
tgaatctccttgtt

SEQ ID NO: 4687175 - DNA, 22 bp, Homo sapiens
tgaatgactccactgtttttct

SEQ ID NO: 4687176 - DNA, 15 bp, Homo sapiens
tgaatgcataaaatg

SEQ ID NO: 4687177 - DNA, 19 bp, Homo sapiens
tgaatgcctatggtggatc

SEQ ID NO: 4687178 - DNA, 21 bp, Homo sapiens
tgaatgcttataggtggcctc

SEQ ID NO: 4687179 - DNA, 17 bp, Homo sapiens
tgaatgcttctgattta

SEQ ID NO: 4687180 - DNA, 14 bp, Homo sapiens
tgaatggattggat

SEQ ID NO: 4687181 - DNA, 20 bp, Homo sapiens
tgaatggattggattattta

SEQ ID NO: 4687182 - DNA, 23 bp, Homo sapiens
tgaatggattggattatttaata

SEQ ID NO: 4687183 - DNA, 15 bp, Homo sapiens
tgaatgtaaaagaaa

SEQ ID NO: 4687184 - DNA, 19 bp, Homo sapiens
tgaatgttcaatctgtgta

SEQ ID NO: 4687185 - DNA, 19 bp, Homo sapiens
tgaattagattatttctgt

SEQ ID NO: 4687186 - DNA, 21 bp, Homo sapiens
tgaattattttgttactgtct

SEQ ID NO: 4687187 - DNA, 17 bp, Homo sapiens
tgaattttcccactgca

SEQ ID NO: 4687188 - DNA, 15 bp, Homo sapiens
tgacaaaagctcatg

SEQ ID NO: 4687189 - DNA, 13 bp, Homo sapiens
tgacaacacaaat

SEQ ID NO: 4687190 - DNA, 23 bp, Homo sapiens
tgacaacactcattgacctgagg

SEQ ID NO: 4687191 - DNA, 14 bp, Homo sapiens
tgacaacagcctga

SEQ ID NO: 4687192 - DNA, 15 bp, Homo sapiens
tgacaacagcctgag

SEQ ID NO: 4687193 - DNA, 18 bp, Homo sapiens
tgacaacagcctgagaaa

SEQ ID NO: 4687194 - DNA, 18 bp, Homo sapiens
tgacaaggattgctactg

SEQ ID NO: 4687195 - DNA, 13 bp, Homo sapiens
tgagcatcaggcc

SEQ ID NO: 4687196 - DNA, 16 bp, Homo sapiens
tgagcatcaggccagg

SEQ ID NO: 4687197 - DNA, 20 bp, Homo sapiens
tgagcatcaggccaggccct

SEQ ID NO: 4687198 - DNA, 23 bp, Homo sapiens
tgagcatcgcttaggagaagtct

SEQ ID NO: 4687199 - DNA, 16 bp, Homo sapiens
tgagcatgcattttct

SEQ ID NO: 4687200 - DNA, 15 bp, Homo sapiens
tgagcatggagctgg

SEQ ID NO: 4687201 - DNA, 14 bp, Homo sapiens
tgagcattagattt

SEQ ID NO: 4687202 - DNA, 15 bp, Homo sapiens
tgagccaccacgccc

SEQ ID NO: 4687203 - DNA, 18 bp, Homo sapiens
tgagccactgcaccgggc

SEQ ID NO: 4687204 - DNA, 22 bp, Homo sapiens
tgagccatagagatatttaaaa

SEQ ID NO: 4687205 - DNA, 21 bp, Homo sapiens
tgagccgagatcacgccactg

SEQ ID NO: 4687206 - DNA, 22 bp, Homo sapiens
tgagccgagatcacgccactgc

SEQ ID NO: 4687207 - DNA, 17 bp, Homo sapiens
tgagcctcagcatcctg

SEQ ID NO: 4687208 - DNA, 18 bp, Homo sapiens
tgagcgctcctgccgcag

SEQ ID NO: 4687209 - DNA, 16 bp, Homo sapiens
tgagctacaaatgcat

SEQ ID NO: 4687210 - DNA, 13 bp, Homo sapiens
tgagctgggatga

SEQ ID NO: 4687211 - DNA, 16 bp, Homo sapiens
tgagctgtcaacgaga

SEQ ID NO: 4687212 - DNA, 13 bp, Homo sapiens
tgagctgttatct

SEQ ID NO: 4687213 - DNA, 12 bp, Homo sapiens
tgaggaaatatt

SEQ ID NO: 4687214 - DNA, 17 bp, Homo sapiens
tgaggaacaatcacaaa

SEQ ID NO: 4687215 - DNA, 14 bp, Homo sapiens
tgaggaagccgctg

SEQ ID NO: 4687216 - DNA, 18 bp, Homo sapiens
tgaggaagccgctggggc

SEQ ID NO: 4687217 - DNA, 19 bp, Homo sapiens
tgaggaagccgctggggcc

SEQ ID NO: 4687218 - DNA, 19 bp, Homo sapiens
tgaggcagtgggtcccact

SEQ ID NO: 4687219 - DNA, 15 bp, Homo sapiens
tgaggccagggcaga

SEQ ID NO: 4687220 - DNA, 20 bp, Homo sapiens
tgaggcccagagggcctgca

SEQ ID NO: 4687221 - DNA, 22 bp, Homo sapiens
tgaggcccagagggcctgcaag

SEQ ID NO: 4687222 - DNA, 12 bp, Homo sapiens
tgaggccctcca

SEQ ID NO: 4687223 - DNA, 18 bp, Homo sapiens
tgaggccctccacacctg

SEQ ID NO: 4687224 - DNA, 22 bp, Homo sapiens
tgaggcccttctctccagcccc

SEQ ID NO: 4687225 - DNA, 14 bp, Homo sapiens
tgaggctctgccct

SEQ ID NO: 4687226 - DNA, 15 bp, Homo sapiens
tgaggctgggctccc

SEQ ID NO: 4687227 - DNA, 21 bp, Homo sapiens
tgaggctgggctcccttccca

SEQ ID NO: 4687228 - DNA, 20 bp, Homo sapiens
tgagggagagaactgagcat

SEQ ID NO: 4687229 - DNA, 17 bp, Homo sapiens
tgagggcaccaccaaga

SEQ ID NO: 4687230 - DNA, 12 bp, Homo sapiens
tgaggggcctct

SEQ ID NO: 4687231 - DNA, 19 bp, Homo sapiens
tgaggtacaacctgttctg

SEQ ID NO: 4687232 - DNA, 16 bp, Homo sapiens
tgaggtccagccctgg

SEQ ID NO: 4687233 - DNA, 21 bp, Homo sapiens
tgaggtccagccctggctgaa

SEQ ID NO: 4687234 - DNA, 23 bp, Homo sapiens
tgaggtccagccctggctgaagg

SEQ ID NO: 4687235 - DNA, 16 bp, Homo sapiens
tgaggtcttttacata

SEQ ID NO: 4687236 - DNA, 15 bp, Homo sapiens
tgagtactacagtcc

SEQ ID NO: 4687237 - DNA, 22 bp, Homo sapiens
tgagtactacagtcctcccatc

SEQ ID NO: 4687238 - DNA, 12 bp, Homo sapiens
tgagtatttggt

SEQ ID NO: 4687239 - DNA, 14 bp, Homo sapiens
tgagtatttggtaa

SEQ ID NO: 4687240 - DNA, 15 bp, Homo sapiens
tgagtcaaaaaatct

SEQ ID NO: 4687241 - DNA, 18 bp, Homo sapiens
tgagtcaccaagcccagt

SEQ ID NO: 4687242 - DNA, 23 bp, Homo sapiens
tgagtcagctgaccccctccccc

SEQ ID NO: 4687243 - DNA, 15 bp, Homo sapiens
tgagtcccaggctga

SEQ ID NO: 4687244 - DNA, 20 bp, Homo sapiens
tgagtcccaggctgagcctc

SEQ ID NO: 4687245 - DNA, 20 bp, Homo sapiens
tgagtcccctgtttgtttct

SEQ ID NO: 4687246 - DNA, 18 bp, Homo sapiens
tgagtcgaggacagggag

SEQ ID NO: 4687247 - DNA, 17 bp, Homo sapiens
tgagtctgaaggctggg

SEQ ID NO: 4687248 - DNA, 15 bp, Homo sapiens
tgagtctggcaaaca

SEQ ID NO: 4687249 - DNA, 18 bp, Homo sapiens
tgagtctggcaaacatgt

SEQ ID NO: 4687250 - DNA, 14 bp, Homo sapiens
tgagtgcctggcca

SEQ ID NO: 4687251 - DNA, 13 bp, Homo sapiens
tgagtggcatgtg

SEQ ID NO: 4687252 - DNA, 23 bp, Homo sapiens
tgagttgacttgacagaacactg

SEQ ID NO: 4687253 - DNA, 16 bp, Homo sapiens
tgagttgatagcacag

SEQ ID NO: 4687254 - DNA, 21 bp, Homo sapiens
tgagttgatagcacagaccct

SEQ ID NO: 4687255 - DNA, 20 bp, Homo sapiens
tgagttgcaccattctttct

SEQ ID NO: 4687256 - DNA, 18 bp, Homo sapiens
tgagttgttgccctgggt

SEQ ID NO: 4687257 - DNA, 17 bp, Homo sapiens
tgagttttcttctgtga

SEQ ID NO: 4687258 - DNA, 18 bp, Homo sapiens
tgataacaacctggagac

SEQ ID NO: 4687259 - DNA, 21 bp, Homo sapiens
tgataataatgcctaccttgt

SEQ ID NO: 4687260 - DNA, 22 bp, Homo sapiens
tgataataatgcctaccttgtg

SEQ ID NO: 4687261 - DNA, 21 bp, Homo sapiens
tgataatacagatttgtaaca

SEQ ID NO: 4687262 - DNA, 18 bp, Homo sapiens
tgataatgtattgcagtg

SEQ ID NO: 4687263 - DNA, 13 bp, Homo sapiens
tgataatgttaaa

SEQ ID NO: 4687264 - DNA, 14 bp, Homo sapiens
tgataatgttaaat

SEQ ID NO: 4687265 - DNA, 17 bp, Homo sapiens
tgataatgttaaatttg

SEQ ID NO: 4687266 - DNA, 16 bp, Homo sapiens
tgatacagtattgaaa

SEQ ID NO: 4687267 - DNA, 20 bp, Homo sapiens
tgatacagtcaacaagcctg

SEQ ID NO: 4687268 - DNA, 14 bp, Homo sapiens
tgatacatttttgt

SEQ ID NO: 4687269 - DNA, 14 bp, Homo sapiens
tgatactgttgcac

SEQ ID NO: 4687270 - DNA, 19 bp, Homo sapiens
tgatactgttgcacgtgtg

SEQ ID NO: 4687271 - DNA, 14 bp, Homo sapiens
tgatagcacagacc

SEQ ID NO: 4687272 - DNA, 17 bp, Homo sapiens
tgatagcacagaccctg

SEQ ID NO: 4687273 - DNA, 22 bp, Homo sapiens
tgatagcacagaccctgccctg

SEQ ID NO: 4687274 - DNA, 23 bp, Homo sapiens
tgatagcacagaccctgccctgt

SEQ ID NO: 4687275 - DNA, 12 bp, Homo sapiens
tgatagtgcttc

SEQ ID NO: 4687276 - DNA, 15 bp, Homo sapiens
tgatatggcagaaga

SEQ ID NO: 4687277 - DNA, 16 bp, Homo sapiens
tgatatggcagaagac

SEQ ID NO: 4687278 - DNA, 18 bp, Homo sapiens
tgatatggcagaagacac

SEQ ID NO: 4687279 - DNA, 16 bp, Homo sapiens
tgatattgaccatgtg

SEQ ID NO: 4687280 - DNA, 18 bp, Homo sapiens
tgatattgaccatgtgat

SEQ ID NO: 4687281 - DNA, 19 bp, Homo sapiens
tgatattgaccatgtgatt

SEQ ID NO: 4687282 - DNA, 21 bp, Homo sapiens
tgatattgaccatgtgattat

SEQ ID NO: 4687283 - DNA, 18 bp, Homo sapiens
tgatcaacatcttttctt

SEQ ID NO: 4687284 - DNA, 13 bp, Homo sapiens
tgatcacggctca

SEQ ID NO: 4687285 - DNA, 22 bp, Homo sapiens
tgatcacggctcactgcagcct

SEQ ID NO: 4687286 - DNA, 15 bp, Homo sapiens
tgatcactgagccat

SEQ ID NO: 4687287 - DNA, 16 bp, Homo sapiens
tgatcatatttgtgtg

SEQ ID NO: 4687288 - DNA, 14 bp, Homo sapiens
tgatccaagctggt

SEQ ID NO: 4687289 - DNA, 17 bp, Homo sapiens
tgatccaagctggtccc

SEQ ID NO: 4687290 - DNA, 16 bp, Homo sapiens
tgatccacccacctca

SEQ ID NO: 4687291 - DNA, 17 bp, Homo sapiens
tgatccacccacctcag

SEQ ID NO: 4687292 - DNA, 19 bp, Homo sapiens
tgatccacccacctcagcc

SEQ ID NO: 4687293 - DNA, 22 bp, Homo sapiens
tgatccacccacctcagcctcc

SEQ ID NO: 4687294 - DNA, 19 bp, Homo sapiens
tgatcccttgagatatgga

SEQ ID NO: 4687295 - DNA, 22 bp, Homo sapiens
tgatcctaatgaatgcataaaa

SEQ ID NO: 4687296 - DNA, 16 bp, Homo sapiens
tgatcctcccacctca

SEQ ID NO: 4687297 - DNA, 18 bp, Homo sapiens
tgatccttttggagtcag

SEQ ID NO: 4687298 - DNA, 23 bp, Homo sapiens
tgatcgccttatttatattcatc

SEQ ID NO: 4687299 - DNA, 17 bp, Homo sapiens
tgatcgcctttcccagg

SEQ ID NO: 4687300 - DNA, 15 bp, Homo sapiens
tgatcgcttggttat

SEQ ID NO: 4687301 - DNA, 14 bp, Homo sapiens
tgatctaggaagac

SEQ ID NO: 4687302 - DNA, 13 bp, Homo sapiens
tgatgaaaataaa

SEQ ID NO: 4687303 - DNA, 15 bp, Homo sapiens
tgatgaaaataaaga

SEQ ID NO: 4687304 - DNA, 16 bp, Homo sapiens
tgatgaaaataaagaa

SEQ ID NO: 4687305 - DNA, 22 bp, Homo sapiens
tgcaggaaggagctgcctggac

SEQ ID NO: 4687306 - DNA, 23 bp, Homo sapiens
tgcaggaaggagctgcctggacc

SEQ ID NO: 4687307 - DNA, 14 bp, Homo sapiens
tgcaggcagccagg

SEQ ID NO: 4687308 - DNA, 19 bp, Homo sapiens
tgcaggcagccaggccaca

SEQ ID NO: 4687309 - DNA, 21 bp, Homo sapiens
tgcagggaaaattatttgcat

SEQ ID NO: 4687310 - DNA, 19 bp, Homo sapiens
tgcaggtgagcccatggcc

SEQ ID NO: 4687311 - DNA, 23 bp, Homo sapiens
tgcaggtgagcccatggccctcc

SEQ ID NO: 4687312 - DNA, 20 bp, Homo sapiens
tgcaggtttgaccaggaaag

SEQ ID NO: 4687313 - DNA, 21 bp, Homo sapiens
tgcagtcacgtggaggagcag

SEQ ID NO: 4687314 - DNA, 22 bp, Homo sapiens
tgcagtcctgatcagagccgtg

SEQ ID NO: 4687315 - DNA, 17 bp, Homo sapiens
tgcagtgatatggcaga

SEQ ID NO: 4687316 - DNA, 20 bp, Homo sapiens
tgcagtgatatggcagaaga

SEQ ID NO: 4687317 - DNA, 22 bp, Homo sapiens
tgcagtgatatggcagaagaca

SEQ ID NO: 4687318 - DNA, 16 bp, Homo sapiens
tgcagtgcccctagct

SEQ ID NO: 4687319 - DNA, 17 bp, Homo sapiens
tgcagtgcccctagctt

SEQ ID NO: 4687320 - DNA, 14 bp, Homo sapiens
tgcagttgccagtc

SEQ ID NO: 4687321 - DNA, 11 bp, Homo sapiens
tgcataaaatg

SEQ ID NO: 4687322 - DNA, 19 bp, Homo sapiens
tgcatagagccacgtatgt

SEQ ID NO: 4687323 - DNA, 19 bp, Homo sapiens
tgcatataaatatatttaa

SEQ ID NO: 4687324 - DNA, 15 bp, Homo sapiens
tgcatatgacagaat

SEQ ID NO: 4687325 - DNA, 20 bp, Homo sapiens
tgcatattataaaggataaa

SEQ ID NO: 4687326 - DNA, 23 bp, Homo sapiens
tgcatattataaaggataaagaa

SEQ ID NO: 4687327 - DNA, 19 bp, Homo sapiens
tgcatatttttctaaagaa

SEQ ID NO: 4687328 - DNA, 15 bp, Homo sapiens
tgcatcctccgcctc

SEQ ID NO: 4687329 - DNA, 19 bp, Homo sapiens
tgcatgaaggtttctgaaa

SEQ ID NO: 4687330 - DNA, 22 bp, Homo sapiens
tgcatgcactgttccccctgtg

SEQ ID NO: 4687331 - DNA, 15 bp, Homo sapiens
tgcatgcaggtctcc

SEQ ID NO: 4687332 - DNA, 15 bp, Homo sapiens
tgcatggagtgtttg

SEQ ID NO: 4687333 - DNA, 16 bp, Homo sapiens
tgcatggagtgtttga

SEQ ID NO: 4687334 - DNA, 22 bp, Homo sapiens
tgcattgaatttagtcattatt

SEQ ID NO: 4687335 - DNA, 16 bp, Homo sapiens
tgcattgaggaaatat

SEQ ID NO: 4687336 - DNA, 20 bp, Homo sapiens
tgcattgaggaaatattaat

SEQ ID NO: 4687337 - DNA, 19 bp, Homo sapiens
tgcattgctgtgaattagc

SEQ ID NO: 4687338 - DNA, 17 bp, Homo sapiens
tgcattggaactggagg

SEQ ID NO: 4687339 - DNA, 16 bp, Homo sapiens
tgcatttgatacattt

SEQ ID NO: 4687340 - DNA, 19 bp, Homo sapiens
tgcattttaaccctatttt

SEQ ID NO: 4687341 - DNA, 16 bp, Homo sapiens
tgcattttcttgtatg

SEQ ID NO: 4687342 - DNA, 18 bp, Homo sapiens
tgcattttgtagcctctc

SEQ ID NO: 4687343 - DNA, 17 bp, Homo sapiens
tgccaaatataaataaa

SEQ ID NO: 4687344 - DNA, 21 bp, Homo sapiens
tgccaacactcaagaagcagg

SEQ ID NO: 4687345 - DNA, 22 bp, Homo sapiens
tgccaacactcaagaagcaggc

SEQ ID NO: 4687346 - DNA, 14 bp, Homo sapiens
tgccaagcactgtg

SEQ ID NO: 4687347 - DNA, 22 bp, Homo sapiens
tgccaagctcaggaccaggcaa

SEQ ID NO: 4687348 - DNA, 21 bp, Homo sapiens
tgccaagggctttgttttgca

SEQ ID NO: 4687349 - DNA, 14 bp, Homo sapiens
tgccaatggaacct

SEQ ID NO: 4687350 - DNA, 19 bp, Homo sapiens
tgccaatggaacctccttt

SEQ ID NO: 4687351 - DNA, 13 bp, Homo sapiens
tgccaatggacta

SEQ ID NO: 4687352 - DNA, 19 bp, Homo sapiens
tgccacaccaagctgtgcc

SEQ ID NO: 4687353 - DNA, 20 bp, Homo sapiens
tgccacaccaagctgtgcca

SEQ ID NO: 4687354 - DNA, 13 bp, Homo sapiens
tgccacagcctcc

SEQ ID NO: 4687355 - DNA, 17 bp, Homo sapiens
tgccacagcctcccctg

SEQ ID NO: 4687356 - DNA, 15 bp, Homo sapiens
tgccaccctgggctc

SEQ ID NO: 4687357 - DNA, 17 bp, Homo sapiens
tgccaccctgggctctg

SEQ ID NO: 4687358 - DNA, 19 bp, Homo sapiens
tgccaccctgggctctgtg

SEQ ID NO: 4687359 - DNA, 21 bp, Homo sapiens
tgccaccctgggctctgtggg

SEQ ID NO: 4687360 - DNA, 19 bp, Homo sapiens
tgccaccctggggagaaag

SEQ ID NO: 4687361 - DNA, 19 bp, Homo sapiens
tgccactcccctaaactcc

SEQ ID NO: 4687362 - DNA, 22 bp, Homo sapiens
tgccactgcctttcagaagtga

SEQ ID NO: 4687363 - DNA, 17 bp, Homo sapiens
tgccagccactgtgata

SEQ ID NO: 4687364 - DNA, 15 bp, Homo sapiens
tgccaggctcaacaa

SEQ ID NO: 4687365 - DNA, 18 bp, Homo sapiens
tgccaggtttttggtctg

SEQ ID NO: 4687366 - DNA, 22 bp, Homo sapiens
tgccagtaggctcaactaggga

SEQ ID NO: 4687367 - DNA, 14 bp, Homo sapiens
tgccagtcaccccg

SEQ ID NO: 4687368 - DNA, 20 bp, Homo sapiens
tgccagtcaccccggccacc

SEQ ID NO: 4687369 - DNA, 23 bp, Homo sapiens
tgccagtcaccccggccacctgc

SEQ ID NO: 4687370 - DNA, 12 bp, Homo sapiens
tgccagtcgcgc

SEQ ID NO: 4687371 - DNA, 21 bp, Homo sapiens
tgccagtcgcgctgcctgtgt

SEQ ID NO: 4687372 - DNA, 22 bp, Homo sapiens
tgccagtcgcgctgcctgtgtg

SEQ ID NO: 4687373 - DNA, 23 bp, Homo sapiens
tgccagtcgcgctgcctgtgtgg

SEQ ID NO: 4687374 - DNA, 17 bp, Homo sapiens
tgccatattctgttggc

SEQ ID NO: 4687375 - DNA, 21 bp, Homo sapiens
tgccatattctgttggccagt

SEQ ID NO: 4687376 - DNA, 13 bp, Homo sapiens
tgccatattttca

SEQ ID NO: 4687377 - DNA, 14 bp, Homo sapiens
tgccatattttcac

SEQ ID NO: 4687378 - DNA, 16 bp, Homo sapiens
tgccatcatctcctgc

SEQ ID NO: 4687379 - DNA, 20 bp, Homo sapiens
tgccatccaggttcagcttg

SEQ ID NO: 4687380 - DNA, 11 bp, Homo sapiens
tgccatcctca

SEQ ID NO: 4687381 - DNA, 22 bp, Homo sapiens
tgccatctgcgtgacaataaaa

SEQ ID NO: 4687382 - DNA, 18 bp, Homo sapiens
tgccatgggcttcactgt

SEQ ID NO: 4687383 - DNA, 19 bp, Homo sapiens
tgccatgggcttcactgta

SEQ ID NO: 4687384 - DNA, 14 bp, Homo sapiens
tgccatgtgccagg

SEQ ID NO: 4687385 - DNA, 15 bp, Homo sapiens
tgccattgcactcca

SEQ ID NO: 4687386 - DNA, 18 bp, Homo sapiens
tgcccaaattatgtgaaa

SEQ ID NO: 4687387 - DNA, 18 bp, Homo sapiens
tgcccaactttcattggt

SEQ ID NO: 4687388 - DNA, 14 bp, Homo sapiens
tgcccacaggatca

SEQ ID NO: 4687389 - DNA, 19 bp, Homo sapiens
tgcccacaggatcagtctg

SEQ ID NO: 4687390 - DNA, 20 bp, Homo sapiens
tgcccacaggatcagtctga

SEQ ID NO: 4687391 - DNA, 22 bp, Homo sapiens
tgcccacctccttccagcactg

SEQ ID NO: 4687392 - DNA, 18 bp, Homo sapiens
tgcccacctggcctctgc

SEQ ID NO: 4687393 - DNA, 13 bp, Homo sapiens
tgcccactccctg

SEQ ID NO: 4687394 - DNA, 15 bp, Homo sapiens
tgcccactccctgca

SEQ ID NO: 4687395 - DNA, 16 bp, Homo sapiens
tgcccagccccttctg

SEQ ID NO: 4687396 - DNA, 21 bp, Homo sapiens
tgcccagccccttctgaccca

SEQ ID NO: 4687397 - DNA, 21 bp, Homo sapiens
tgcccaggacggggccggcca

SEQ ID NO: 4687398 - DNA, 14 bp, Homo sapiens
tgcccaggcaggtc

SEQ ID NO: 4687399 - DNA, 17 bp, Homo sapiens
tgcccaggcccctgcca

SEQ ID NO: 4687400 - DNA, 22 bp, Homo sapiens
tgcccaggcccctgccaccctg

SEQ ID NO: 4687401 - DNA, 13 bp, Homo sapiens
tgcccaggctggc

SEQ ID NO: 4687402 - DNA, 21 bp, Homo sapiens
tgcccagggtcagtgtatcta

SEQ ID NO: 4687403 - DNA, 16 bp, Homo sapiens
tgccccaacccccagc

SEQ ID NO: 4687404 - DNA, 20 bp, Homo sapiens
tgccccaacccccagcaccc

SEQ ID NO: 4687405 - DNA, 16 bp, Homo sapiens
tgccccatcagtgctc

SEQ ID NO: 4687406 - DNA, 18 bp, Homo sapiens
tgccccatcagtgctccc

SEQ ID NO: 4687407 - DNA, 20 bp, Homo sapiens
tgccccatcagtgctccctc

SEQ ID NO: 4687408 - DNA, 12 bp, Homo sapiens
tgcccccaggac

SEQ ID NO: 4687409 - DNA, 13 bp, Homo sapiens
tgccccccatcct

SEQ ID NO: 4687410 - DNA, 18 bp, Homo sapiens
tgccccccatcctggccc

SEQ ID NO: 4687411 - DNA, 23 bp, Homo sapiens
tgccccccatcctggcccatcag

SEQ ID NO: 4687412 - DNA, 15 bp, Homo sapiens
tgccccctctgccct

SEQ ID NO: 4687413 - DNA, 13 bp, Homo sapiens
tgccccctgcagg

SEQ ID NO: 4687414 - DNA, 16 bp, Homo sapiens
tgctccagcctgacaa

SEQ ID NO: 4687415 - DNA, 17 bp, Homo sapiens
tgctccattttcttgtc

SEQ ID NO: 4687416 - DNA, 18 bp, Homo sapiens
tgctccattttcttgtca

SEQ ID NO: 4687417 - DNA, 19 bp, Homo sapiens
tgctcctctccccagcaag

SEQ ID NO: 4687418 - DNA, 14 bp, Homo sapiens
tgctccttgggccc

SEQ ID NO: 4687419 - DNA, 15 bp, Homo sapiens
tgctccttgggccct

SEQ ID NO: 4687420 - DNA, 18 bp, Homo sapiens
tgctccttgggccctttg

SEQ ID NO: 4687421 - DNA, 14 bp, Homo sapiens
tgctctaagaagct

SEQ ID NO: 4687422 - DNA, 15 bp, Homo sapiens
tgctctaagaagctg

SEQ ID NO: 4687423 - DNA, 23 bp, Homo sapiens
tgctctccgaccagacaccttga

SEQ ID NO: 4687424 - DNA, 16 bp, Homo sapiens
tgctctgatccctcta

SEQ ID NO: 4687425 - DNA, 22 bp, Homo sapiens
tgctctgcgtgtcacctgtgct

SEQ ID NO: 4687426 - DNA, 16 bp, Homo sapiens
tgctctgctgacagac

SEQ ID NO: 4687427 - DNA, 22 bp, Homo sapiens
tgctctgctgacagacacaggc

SEQ ID NO: 4687428 - DNA, 17 bp, Homo sapiens
tgctctggacaggcatg

SEQ ID NO: 4687429 - DNA, 16 bp, Homo sapiens
tgctgaaaacattaca

SEQ ID NO: 4687430 - DNA, 13 bp, Homo sapiens
tgctgaaggctcg

SEQ ID NO: 4687431 - DNA, 18 bp, Homo sapiens
tgctgaatgtaaaagaaa

SEQ ID NO: 4687432 - DNA, 16 bp, Homo sapiens
tgctgacagacacagg

SEQ ID NO: 4687433 - DNA, 23 bp, Homo sapiens
tgctgacagacacaggcccggct

SEQ ID NO: 4687434 - DNA, 15 bp, Homo sapiens
tgctgagtcccaggc

SEQ ID NO: 4687435 - DNA, 22 bp, Homo sapiens
tgctgagtcccaggctgagcct

SEQ ID NO: 4687436 - DNA, 18 bp, Homo sapiens
tgctgcaccaacccagcc

SEQ ID NO: 4687437 - DNA, 14 bp, Homo sapiens
tgctgccatccagg

SEQ ID NO: 4687438 - DNA, 21 bp, Homo sapiens
tgctgccatccaggttcagct

SEQ ID NO: 4687439 - DNA, 21 bp, Homo sapiens
tgctgccccatcagtgctccc

SEQ ID NO: 4687440 - DNA, 12 bp, Homo sapiens
tgctgcccctcc

SEQ ID NO: 4687441 - DNA, 17 bp, Homo sapiens
tgctgcccctccctgcc

SEQ ID NO: 4687442 - DNA, 10 bp, Homo sapiens
tgctgccctg

SEQ ID NO: 4687443 - DNA, 18 bp, Homo sapiens
tgctgccctgcccacctg

SEQ ID NO: 4687444 - DNA, 14 bp, Homo sapiens
tgctgccctgtgag

SEQ ID NO: 4687445 - DNA, 23 bp, Homo sapiens
tgctgccgccccacccagatggg

SEQ ID NO: 4687446 - DNA, 20 bp, Homo sapiens
tgctgctaccctccctgctg

SEQ ID NO: 4687447 - DNA, 18 bp, Homo sapiens
tgctggagccactaacta

SEQ ID NO: 4687448 - DNA, 20 bp, Homo sapiens
tgctggagccactaactaga

SEQ ID NO: 4687449 - DNA, 18 bp, Homo sapiens
tgctggcctctctgacat

SEQ ID NO: 4687450 - DNA, 17 bp, Homo sapiens
tgctggctggtgcctga

SEQ ID NO: 4687451 - DNA, 23 bp, Homo sapiens
tgctggctggtgcctgagcccct

SEQ ID NO: 4687452 - DNA, 19 bp, Homo sapiens
tgctggctgttggctgggg

SEQ ID NO: 4687453 - DNA, 10 bp, Homo sapiens
tgctgggctg

SEQ ID NO: 4687454 - DNA, 11 bp, Homo sapiens
tgctgggctgg

SEQ ID NO: 4687455 - DNA, 13 bp, Homo sapiens
tgctgggctgggg

SEQ ID NO: 4687456 - DNA, 15 bp, Homo sapiens
tgctgggctgggtgc

SEQ ID NO: 4687457 - DNA, 16 bp, Homo sapiens
tgctgggctgggtgcg

SEQ ID NO: 4687458 - DNA, 16 bp, Homo sapiens
tgctggtttttcagtt

SEQ ID NO: 4687459 - DNA, 14 bp, Homo sapiens
tgctgtaatattgt

SEQ ID NO: 4687460 - DNA, 14 bp, Homo sapiens
tgctgtacaaaagc

SEQ ID NO: 4687461 - DNA, 13 bp, Homo sapiens
tgctgtcccctct

SEQ ID NO: 4687462 - DNA, 18 bp, Homo sapiens
tgctgtgaattagctcac

SEQ ID NO: 4687463 - DNA, 21 bp, Homo sapiens
tgctgtgacaccccccttctg

SEQ ID NO: 4687464 - DNA, 22 bp, Homo sapiens
tgctgtgcaaacagtgtaagct

SEQ ID NO: 4687465 - DNA, 15 bp, Homo sapiens
tgctgtggtgtgtcc

SEQ ID NO: 4687466 - DNA, 17 bp, Homo sapiens
tgcttataggtggcctc

SEQ ID NO: 4687467 - DNA, 18 bp, Homo sapiens
tgcttataggtggcctct

SEQ ID NO: 4687468 - DNA, 23 bp, Homo sapiens
tgcttcaatacccaaatcctctc

SEQ ID NO: 4687469 - DNA, 16 bp, Homo sapiens
tgcttccattaacaaa

SEQ ID NO: 4687470 - DNA, 18 bp, Homo sapiens
tgcttcgggcccttccca

SEQ ID NO: 4687471 - DNA, 14 bp, Homo sapiens
tgcttcttgtaata

SEQ ID NO: 4687472 - DNA, 20 bp, Homo sapiens
tgcttcttgtaatatttctt

SEQ ID NO: 4687473 - DNA, 17 bp, Homo sapiens
tgcttgccacagagcgg

SEQ ID NO: 4687474 - DNA, 14 bp, Homo sapiens
tgcttgctttatta

SEQ ID NO: 4687475 - DNA, 20 bp, Homo sapiens
tgcttggattctctgagaaa

SEQ ID NO: 4687476 - DNA, 21 bp, Homo sapiens
tgcttggattctctgagaaat

SEQ ID NO: 4687477 - DNA, 14 bp, Homo sapiens
tgcttggttttctt

SEQ ID NO: 4687478 - DNA, 20 bp, Homo sapiens
tgctttataccccatttgat

SEQ ID NO: 4687479 - DNA, 15 bp, Homo sapiens
tgctttctccttcac

SEQ ID NO: 4687480 - DNA, 17 bp, Homo sapiens
tgcttttggtctgtgtg

SEQ ID NO: 4687481 - DNA, 21 bp, Homo sapiens
tgctttttccaactcagaaat

SEQ ID NO: 4687482 - DNA, 20 bp, Homo sapiens
tggaaagagtaggaagactt

SEQ ID NO: 4687483 - DNA, 15 bp, Homo sapiens
tggaaatacacagtg

SEQ ID NO: 4687484 - DNA, 17 bp, Homo sapiens
tggaaatgggcagagca

SEQ ID NO: 4687485 - DNA, 17 bp, Homo sapiens
tggaaattcccttcatc

SEQ ID NO: 4687486 - DNA, 18 bp, Homo sapiens
tggaaattcccttcatct

SEQ ID NO: 4687487 - DNA, 18 bp, Homo sapiens
tggaaattgagtctgaag

SEQ ID NO: 4687488 - DNA, 16 bp, Homo sapiens
tggaaattggaagagc

SEQ ID NO: 4687489 - DNA, 21 bp, Homo sapiens
tggaacatcatcaaggcactg

SEQ ID NO: 4687490 - DNA, 23 bp, Homo sapiens
tggaacatcatcaaggcactgcc

SEQ ID NO: 4687491 - DNA, 21 bp, Homo sapiens
tggaaccaggcttgcctggga

SEQ ID NO: 4687492 - DNA, 12 bp, Homo sapiens
tggaacctcctt

SEQ ID NO: 4687493 - DNA, 13 bp, Homo sapiens
tggaagacagaga

SEQ ID NO: 4687494 - DNA, 16 bp, Homo sapiens
tggaagcacagcttca

SEQ ID NO: 4687495 - DNA, 12 bp, Homo sapiens
tggaagctagct

SEQ ID NO: 4687496 - DNA, 15 bp, Homo sapiens
tggaagtgactttgg

SEQ ID NO: 4687497 - DNA, 13 bp, Homo sapiens
tggaagttattta

SEQ ID NO: 4687498 - DNA, 11 bp, Homo sapiens
tggaagttgca

SEQ ID NO: 4687499 - DNA, 19 bp, Homo sapiens
tggaatctaccaactgttt

SEQ ID NO: 4687500 - DNA, 13 bp, Homo sapiens
tggaatctggaga

SEQ ID NO: 4687501 - DNA, 18 bp, Homo sapiens
tggaatcttcacctcaga

SEQ ID NO: 4687502 - DNA, 13 bp, Homo sapiens
tggaatgcttctt

SEQ ID NO: 4687503 - DNA, 13 bp, Homo sapiens
tggacaaggaggt

SEQ ID NO: 4687504 - DNA, 14 bp, Homo sapiens
tggacacagctctt

SEQ ID NO: 4687505 - DNA, 15 bp, Homo sapiens
tggacacagctcttc

SEQ ID NO: 4687506 - DNA, 16 bp, Homo sapiens
tggacagaagcagctc

SEQ ID NO: 4687507 - DNA, 17 bp, Homo sapiens
tggacagaagcagctct

SEQ ID NO: 4687508 - DNA, 18 bp, Homo sapiens
tggacaggcatgttctct

SEQ ID NO: 4687509 - DNA, 23 bp, Homo sapiens
tggacaggcatgttctctgagga

SEQ ID NO: 4687510 - DNA, 18 bp, Homo sapiens
tggacatcgatatgaaaa

SEQ ID NO: 4687511 - DNA, 18 bp, Homo sapiens
tggacatgaagattcttt

SEQ ID NO: 4687512 - DNA, 19 bp, Homo sapiens
tggacatgtgtcccagcca

SEQ ID NO: 4687513 - DNA, 11 bp, Homo sapiens
tggacatttta

SEQ ID NO: 4687514 - DNA, 22 bp, Homo sapiens
tggacccgttcatgggggaggg

SEQ ID NO: 4687515 - DNA, 21 bp, Homo sapiens
tggaccctactattcatgttt

SEQ ID NO: 4687516 - DNA, 18 bp, Homo sapiens
tggaccctgaggcccaga

SEQ ID NO: 4687517 - DNA, 22 bp, Homo sapiens
tggaccggagagtgggggtggg

SEQ ID NO: 4687518 - DNA, 18 bp, Homo sapiens
tggacctctcttgtgagc

SEQ ID NO: 4687519 - DNA, 18 bp, Homo sapiens
tggacgagaaaacaataa

SEQ ID NO: 4687520 - DNA, 17 bp, Homo sapiens
tggacggtgctccaggc

SEQ ID NO: 4687521 - DNA, 18 bp, Homo sapiens
tggacggtgctccaggca

SEQ ID NO: 4687522 - DNA, 20 bp, Homo sapiens
tggacggtgctccaggcagg

SEQ ID NO: 4687523 - DNA, 16 bp, Homo sapiens
tggactatgcacactt

SEQ ID NO: 4687524 - DNA, 14 bp, Homo sapiens
agttgccacattta

SEQ ID NO: 4687525 - DNA, 23 bp, Homo sapiens
agttgccagtcaccccggccacc

SEQ ID NO: 4687526 - DNA, 21 bp, Homo sapiens
agttgcctttatttgctgtta

SEQ ID NO: 4687527 - DNA, 17 bp, Homo sapiens
agttgctcaaagagcct

SEQ ID NO: 4687528 - DNA, 17 bp, Homo sapiens
agttgctcacatgtctt

SEQ ID NO: 4687529 - DNA, 17 bp, Homo sapiens
agttgggtggatgcctg

SEQ ID NO: 4687530 - DNA, 17 bp, Homo sapiens
agttggtcccccttcca

SEQ ID NO: 4687531 - DNA, 18 bp, Homo sapiens
agttggtcttactttgtg

SEQ ID NO: 4687532 - DNA, 15 bp, Homo sapiens
agttgtataaaaaca

SEQ ID NO: 4687533 - DNA, 15 bp, Homo sapiens
agttgtctttctttg

SEQ ID NO: 4687534 - DNA, 18 bp, Homo sapiens
agttgtctttctttgctg

SEQ ID NO: 4687535 - DNA, 17 bp, Homo sapiens
agttgtggaaagataat

SEQ ID NO: 4687536 - DNA, 20 bp, Homo sapiens
agttgtggaaagataataaa

SEQ ID NO: 4687537 - DNA, 23 bp, Homo sapiens
agttgtgtttcaacggaaagtgc

SEQ ID NO: 4687538 - DNA, 17 bp, Homo sapiens
agttgttatttattgaa

SEQ ID NO: 4687539 - DNA, 18 bp, Homo sapiens
agttgtttattccaaaga

SEQ ID NO: 4687540 - DNA, 19 bp, Homo sapiens
agttgtttttttttgtttt

SEQ ID NO: 4687541 - DNA, 14 bp, Homo sapiens
agtttaaattgtaa

SEQ ID NO: 4687542 - DNA, 17 bp, Homo sapiens
agtttaaattgtaatag

SEQ ID NO: 4687543 - DNA, 20 bp, Homo sapiens
agtttaaattgtaataggcg

SEQ ID NO: 4687544 - DNA, 14 bp, Homo sapiens
agtttaattgactt

SEQ ID NO: 4687545 - DNA, 15 bp, Homo sapiens
agtttaattgactta

SEQ ID NO: 4687546 - DNA, 16 bp, Homo sapiens
agtttcaggtgacatg

SEQ ID NO: 4687547 - DNA, 17 bp, Homo sapiens
agtttcaggtgacatgt

SEQ ID NO: 4687548 - DNA, 20 bp, Homo sapiens
agtttcaggtgacatgtgaa

SEQ ID NO: 4687549 - DNA, 16 bp, Homo sapiens
agtttcatatattatt

SEQ ID NO: 4687550 - DNA, 19 bp, Homo sapiens
agtttccttggctggtgca

SEQ ID NO: 4687551 - DNA, 21 bp, Homo sapiens
agtttctccaagcaggacatg

SEQ ID NO: 4687552 - DNA, 17 bp, Homo sapiens
agtttctgtcctgctgg

SEQ ID NO: 4687553 - DNA, 14 bp, Homo sapiens
agtttgattattca

SEQ ID NO: 4687554 - DNA, 23 bp, Homo sapiens
agtttgattattcagtgtcactg

SEQ ID NO: 4687555 - DNA, 21 bp, Homo sapiens
agtttggtttatattcttatg

SEQ ID NO: 4687556 - DNA, 15 bp, Homo sapiens
agttttacagtgttt

SEQ ID NO: 4687557 - DNA, 22 bp, Homo sapiens
agttttcactcttattgcccac

SEQ ID NO: 4687558 - DNA, 12 bp, Homo sapiens
agttttcttata

SEQ ID NO: 4687559 - DNA, 14 bp, Homo sapiens
agttttcttctgtg

SEQ ID NO: 4687560 - DNA, 12 bp, Homo sapiens
agttttgttctt

SEQ ID NO: 4687561 - DNA, 20 bp, Homo sapiens
agtttttattgcttgttgga

SEQ ID NO: 4687562 - DNA, 15 bp, Homo sapiens
agtttttttttaatc

SEQ ID NO: 4687563 - DNA, 11 bp, Homo sapiens
ataaaaaatgg

SEQ ID NO: 4687564 - DNA, 19 bp, Homo sapiens
ataaaaagaaagattttat

SEQ ID NO: 4687565 - DNA, 13 bp, Homo sapiens
ataaaaatatatt

SEQ ID NO: 4687566 - DNA, 13 bp, Homo sapiens
ataaaagaaataa

SEQ ID NO: 4687567 - DNA, 16 bp, Homo sapiens
ataaaagacagtgaaa

SEQ ID NO: 4687568 - DNA, 12 bp, Homo sapiens
ataaaataagaa

SEQ ID NO: 4687569 - DNA, 21 bp, Homo sapiens
ataaaatatgaagacataaac

SEQ ID NO: 4687570 - DNA, 19 bp, Homo sapiens
ataaaatccaatattgtaa

SEQ ID NO: 4687571 - DNA, 14 bp, Homo sapiens
ataaaattttctag

SEQ ID NO: 4687572 - DNA, 16 bp, Homo sapiens
ataaacagtttgacaa

SEQ ID NO: 4687573 - DNA, 13 bp, Homo sapiens
ataaacattttat

SEQ ID NO: 4687574 - DNA, 14 bp, Homo sapiens
ataaacattttatt

SEQ ID NO: 4687575 - DNA, 14 bp, Homo sapiens
ataaagagaaaatg

SEQ ID NO: 4687576 - DNA, 15 bp, Homo sapiens
ataaagagagaaaaa

SEQ ID NO: 4687577 - DNA, 15 bp, Homo sapiens
ataaagcaaattact

SEQ ID NO: 4687578 - DNA, 19 bp, Homo sapiens
ataaagcagattacctctt

SEQ ID NO: 4687579 - DNA, 17 bp, Homo sapiens
ataaaggaacatggttt

SEQ ID NO: 4687580 - DNA, 17 bp, Homo sapiens
ataaagtgcacaccttt

SEQ ID NO: 4687581 - DNA, 22 bp, Homo sapiens
ataaagtgcacacctttattca

SEQ ID NO: 4687582 - DNA, 22 bp, Homo sapiens
ataaagtggaagtatgtatatt

SEQ ID NO: 4687583 - DNA, 13 bp, Homo sapiens
ataaagtgtgtgt

SEQ ID NO: 4687584 - DNA, 13 bp, Homo sapiens
ataaataaaaata

SEQ ID NO: 4687585 - DNA, 14 bp, Homo sapiens
ataaataaaaataa

SEQ ID NO: 4687586 - DNA, 12 bp, Homo sapiens
ataaataacttt

SEQ ID NO: 4687587 - DNA, 16 bp, Homo sapiens
ataaataggagaggat

SEQ ID NO: 4687588 - DNA, 17 bp, Homo sapiens
ataaatatatttaactt

SEQ ID NO: 4687589 - DNA, 14 bp, Homo sapiens
ataaatatgcagtg

SEQ ID NO: 4687590 - DNA, 14 bp, Homo sapiens
ataaatcacacatt

SEQ ID NO: 4687591 - DNA, 19 bp, Homo sapiens
ataaatgtttgttatttac

SEQ ID NO: 4687592 - DNA, 19 bp, Homo sapiens
ataaattatttgattattt

SEQ ID NO: 4687593 - DNA, 14 bp, Homo sapiens
ataaatttgttgaa

SEQ ID NO: 4687594 - DNA, 19 bp, Homo sapiens
ataaatttgttgaatattg

SEQ ID NO: 4687595 - DNA, 16 bp, Homo sapiens
ataaatttgttgtcat

SEQ ID NO: 4687596 - DNA, 15 bp, Homo sapiens
ataacaacctggaga

SEQ ID NO: 4687597 - DNA, 22 bp, Homo sapiens
ataacaatgttaaggaaactct

SEQ ID NO: 4687598 - DNA, 14 bp, Homo sapiens
ataacaattcctct

SEQ ID NO: 4687599 - DNA, 14 bp, Homo sapiens
ataacatcattgta

SEQ ID NO: 4687600 - DNA, 14 bp, Homo sapiens
ataacattacctta

SEQ ID NO: 4687601 - DNA, 20 bp, Homo sapiens
ataacattaccttactgtgg

SEQ ID NO: 4687602 - DNA, 18 bp, Homo sapiens
ataacattttgtttatgt

SEQ ID NO: 4687603 - DNA, 23 bp, Homo sapiens
ataaccgtttcctttcatttact

SEQ ID NO: 4687604 - DNA, 19 bp, Homo sapiens
ataactagaactgaatttt

SEQ ID NO: 4687605 - DNA, 15 bp, Homo sapiens
ataacttattagcag

SEQ ID NO: 4687606 - DNA, 16 bp, Homo sapiens
ataacttattagcagt

SEQ ID NO: 4687607 - DNA, 12 bp, Homo sapiens
ataacttcataa

SEQ ID NO: 4687608 - DNA, 16 bp, Homo sapiens
ataactttttttcaat

SEQ ID NO: 4687609 - DNA, 18 bp, Homo sapiens
ataagaaaaatattaata

SEQ ID NO: 4687610 - DNA, 19 bp, Homo sapiens
ataagaaaaatattaataa

SEQ ID NO: 4687611 - DNA, 17 bp, Homo sapiens
ataagaagaagagaggc

SEQ ID NO: 4687612 - DNA, 13 bp, Homo sapiens
ataagaaggaaaa

SEQ ID NO: 4687613 - DNA, 14 bp, Homo sapiens
ataagacataacgt

SEQ ID NO: 4687614 - DNA, 17 bp, Homo sapiens
ataagacataacgtttt

SEQ ID NO: 4687615 - DNA, 19 bp, Homo sapiens
ataagagggcacacactgt

SEQ ID NO: 4687616 - DNA, 18 bp, Homo sapiens
ataagattatatggactt

SEQ ID NO: 4687617 - DNA, 16 bp, Homo sapiens
ataagatttttgaaaa

SEQ ID NO: 4687618 - DNA, 12 bp, Homo sapiens
ataaggaaattt

SEQ ID NO: 4687619 - DNA, 18 bp, Homo sapiens
ataagggtatctggtgac

SEQ ID NO: 4687620 - DNA, 18 bp, Homo sapiens
ataagtccattaactgct

SEQ ID NO: 4687621 - DNA, 13 bp, Homo sapiens
ataataaaaatat

SEQ ID NO: 4687622 - DNA, 15 bp, Homo sapiens
ataataaaaatatat

SEQ ID NO: 4687623 - DNA, 18 bp, Homo sapiens
ataataaattgatttgtt

SEQ ID NO: 4687624 - DNA, 21 bp, Homo sapiens
ataataatgcctaccttgtga

SEQ ID NO: 4687625 - DNA, 18 bp, Homo sapiens
ataatacagatttgtaac

SEQ ID NO: 4687626 - DNA, 13 bp, Homo sapiens
ataatatattgct

SEQ ID NO: 4687627 - DNA, 15 bp, Homo sapiens
ataatattcattggt

SEQ ID NO: 4687628 - DNA, 20 bp, Homo sapiens
ataatatttttaattaaata

SEQ ID NO: 4687629 - DNA, 20 bp, Homo sapiens
ataatctactgtacacaatc

SEQ ID NO: 4687630 - DNA, 15 bp, Homo sapiens
ataatctatgatgaa

SEQ ID NO: 4687631 - DNA, 19 bp, Homo sapiens
ataatctcacaaaacatat

SEQ ID NO: 4687632 - DNA, 13 bp, Homo sapiens
ataatgaataaat

SEQ ID NO: 4687633 - DNA, 14 bp, Homo sapiens
ataatgaatacttt

SEQ ID NO: 4687634 - DNA, 17 bp, Homo sapiens
ataatggtgaatgttca

SEQ ID NO: 4687635 - DNA, 14 bp, Homo sapiens
atccaaatgctgtg

SEQ ID NO: 4687636 - DNA, 18 bp, Homo sapiens
atccaagctggtcccact

SEQ ID NO: 4687637 - DNA, 22 bp, Homo sapiens
atccaataattttcctgtgaca

SEQ ID NO: 4687638 - DNA, 12 bp, Homo sapiens
atccaatattgt

SEQ ID NO: 4687639 - DNA, 13 bp, Homo sapiens
atccacccacctc

SEQ ID NO: 4687640 - DNA, 14 bp, Homo sapiens
atccacctccttct

SEQ ID NO: 4687641 - DNA, 21 bp, Homo sapiens
atccactgtgccatgtgccag

SEQ ID NO: 4687642 - DNA, 18 bp, Homo sapiens
atccaggagggctaatta

SEQ ID NO: 4687643 - DNA, 14 bp, Homo sapiens
atccaggtaatcca

SEQ ID NO: 4687644 - DNA, 17 bp, Homo sapiens
atccagtagggaaaata

SEQ ID NO: 4687645 - DNA, 13 bp, Homo sapiens
atccagtataaga

SEQ ID NO: 4687646 - DNA, 17 bp, Homo sapiens
atccagtattatattat

SEQ ID NO: 4687647 - DNA, 19 bp, Homo sapiens
atcccaacatggtcctagc

SEQ ID NO: 4687648 - DNA, 12 bp, Homo sapiens
atcccagcccca

SEQ ID NO: 4687649 - DNA, 23 bp, Homo sapiens
atcccaggatcgcaagagccatg

SEQ ID NO: 4687650 - DNA, 16 bp, Homo sapiens
atcccatgagcctcag

SEQ ID NO: 4687651 - DNA, 18 bp, Homo sapiens
atcccatgagcctcagca

SEQ ID NO: 4687652 - DNA, 16 bp, Homo sapiens
atccctaatgctgcag

SEQ ID NO: 4687653 - DNA, 11 bp, Homo sapiens
atccctcatct

SEQ ID NO: 4687654 - DNA, 17 bp, Homo sapiens
atccctcatctgtccct

SEQ ID NO: 4687655 - DNA, 21 bp, Homo sapiens
atccctctacagagcttccct

SEQ ID NO: 4687656 - DNA, 14 bp, Homo sapiens
atccctctcctccc

SEQ ID NO: 4687657 - DNA, 17 bp, Homo sapiens
atccctgaaggccccgc

SEQ ID NO: 4687658 - DNA, 14 bp, Homo sapiens
atcccttgaccagg

SEQ ID NO: 4687659 - DNA, 22 bp, Homo sapiens
atcccttgaccaggcctgggcc

SEQ ID NO: 4687660 - DNA, 20 bp, Homo sapiens
atcccttggacattttatgt

SEQ ID NO: 4687661 - DNA, 19 bp, Homo sapiens
atcctaaaacaaaagctca

SEQ ID NO: 4687662 - DNA, 23 bp, Homo sapiens
atcctaaaacaaaagctcatcca

SEQ ID NO: 4687663 - DNA, 12 bp, Homo sapiens
atcctaatgaat

SEQ ID NO: 4687664 - DNA, 19 bp, Homo sapiens
atcctaatgaatgcataaa

SEQ ID NO: 4687665 - DNA, 21 bp, Homo sapiens
atcctaccccaattccttgta

SEQ ID NO: 4687666 - DNA, 14 bp, Homo sapiens
atcctacttctcca

SEQ ID NO: 4687667 - DNA, 13 bp, Homo sapiens
atcctagttccac

SEQ ID NO: 4687668 - DNA, 21 bp, Homo sapiens
atcctatggtttctccatcca

SEQ ID NO: 4687669 - DNA, 12 bp, Homo sapiens
atcctcaatcca

SEQ ID NO: 4687670 - DNA, 17 bp, Homo sapiens
atcctcatacccacccc

SEQ ID NO: 4687671 - DNA, 19 bp, Homo sapiens
atcctcatacccaccccca

SEQ ID NO: 4687672 - DNA, 11 bp, Homo sapiens
atcctccaggt

SEQ ID NO: 4687673 - DNA, 19 bp, Homo sapiens
atcctccaggtgcacaagc

SEQ ID NO: 4687674 - DNA, 23 bp, Homo sapiens
atcctccaggtgcacaagctcca

SEQ ID NO: 4687675 - DNA, 20 bp, Homo sapiens
atcctcccacctcagcctcc

SEQ ID NO: 4687676 - DNA, 20 bp, Homo sapiens
atcctctgtacagagcccac

SEQ ID NO: 4687677 - DNA, 19 bp, Homo sapiens
atcctggcacccggcccct

SEQ ID NO: 4687678 - DNA, 21 bp, Homo sapiens
atcctggcacccggcccctgc

SEQ ID NO: 4687679 - DNA, 17 bp, Homo sapiens
atcctgtaccaaatctg

SEQ ID NO: 4687680 - DNA, 20 bp, Homo sapiens
atcctgtaccaaatctgaca

SEQ ID NO: 4687681 - DNA, 23 bp, Homo sapiens
atcctgtaccaaatctgacatat

SEQ ID NO: 4687682 - DNA, 17 bp, Homo sapiens
atcctgttaacactgta

SEQ ID NO: 4687683 - DNA, 21 bp, Homo sapiens
atcctgttaacactgtaatat

SEQ ID NO: 4687684 - DNA, 18 bp, Homo sapiens
atccttgacaccttactt

SEQ ID NO: 4687685 - DNA, 22 bp, Homo sapiens
atcgaaataacaatgttaagga

SEQ ID NO: 4687686 - DNA, 23 bp, Homo sapiens
atcgaaataacaatgttaaggaa

SEQ ID NO: 4687687 - DNA, 14 bp, Homo sapiens
atcgacctgcctcg

SEQ ID NO: 4687688 - DNA, 14 bp, Homo sapiens
atcgatatgaaaaa

SEQ ID NO: 4687689 - DNA, 22 bp, Homo sapiens
atcgccttatgagaacatggtg

SEQ ID NO: 4687690 - DNA, 19 bp, Homo sapiens
atcggtcttgcccagagga

SEQ ID NO: 4687691 - DNA, 15 bp, Homo sapiens
atcgtgacaacactt

SEQ ID NO: 4687692 - DNA, 22 bp, Homo sapiens
atctaaatattgatttctgcct

SEQ ID NO: 4687693 - DNA, 13 bp, Homo sapiens
atctaaattgatc

SEQ ID NO: 4687694 - DNA, 14 bp, Homo sapiens
atctaaatttaatt

SEQ ID NO: 4687695 - DNA, 14 bp, Homo sapiens
atctaattctttaa

SEQ ID NO: 4687696 - DNA, 17 bp, Homo sapiens
atctaccccttacttat

SEQ ID NO: 4687697 - DNA, 16 bp, Homo sapiens
atctactgtacacaat

SEQ ID NO: 4687698 - DNA, 20 bp, Homo sapiens
atctacttctgtaattgtgt

SEQ ID NO: 4687699 - DNA, 23 bp, Homo sapiens
atctacttctgtaattgtgtgga

SEQ ID NO: 4687700 - DNA, 18 bp, Homo sapiens
atctagagcttgatgcca

SEQ ID NO: 4687701 - DNA, 22 bp, Homo sapiens
atctaggaagactttggaaaga

SEQ ID NO: 4687702 - DNA, 19 bp, Homo sapiens
atctattaaaattgccatt

SEQ ID NO: 4687703 - DNA, 20 bp, Homo sapiens
atctattaaaattgccattt

SEQ ID NO: 4687704 - DNA, 22 bp, Homo sapiens
atctattttaccatatgtttat

SEQ ID NO: 4687705 - DNA, 13 bp, Homo sapiens
atctattttgagt

SEQ ID NO: 4687706 - DNA, 16 bp, Homo sapiens
atctcacacatgagca

SEQ ID NO: 4687707 - DNA, 23 bp, Homo sapiens
atctcacacatgagcatcaggcc

SEQ ID NO: 4687708 - DNA, 22 bp, Homo sapiens
atctcacttgtgccaacactca

SEQ ID NO: 4687709 - DNA, 20 bp, Homo sapiens
atctcagtcatgcataaata

SEQ ID NO: 4687710 - DNA, 22 bp, Homo sapiens
atctcagtcatgcataaatatg

SEQ ID NO: 4687711 - DNA, 15 bp, Homo sapiens
atctcattggaccct

SEQ ID NO: 4687712 - DNA, 13 bp, Homo sapiens
atctcccccagcc

SEQ ID NO: 4687713 - DNA, 16 bp, Homo sapiens
atctcctgccttcctc

SEQ ID NO: 4687714 - DNA, 18 bp, Homo sapiens
atctcctgtgatcctttg

SEQ ID NO: 4687715 - DNA, 15 bp, Homo sapiens
atctcggctcactgc

SEQ ID NO: 4687716 - DNA, 15 bp, Homo sapiens
atctctagtccctgt

SEQ ID NO: 4687717 - DNA, 16 bp, Homo sapiens
atctctgctttggaaa

SEQ ID NO: 4687718 - DNA, 19 bp, Homo sapiens
atctctttttgctttcgaa

SEQ ID NO: 4687719 - DNA, 11 bp, Homo sapiens
atctgaagaaa

SEQ ID NO: 4687720 - DNA, 17 bp, Homo sapiens
atctgacatattatgcc

SEQ ID NO: 4687721 - DNA, 14 bp, Homo sapiens
atctgatggcttct

SEQ ID NO: 4687722 - DNA, 17 bp, Homo sapiens
atctgatggcttctcca

SEQ ID NO: 4687723 - DNA, 21 bp, Homo sapiens
atctgcaatgtttttgtgtag

SEQ ID NO: 4687724 - DNA, 19 bp, Homo sapiens
atctgcagtacagtcttat

SEQ ID NO: 4687725 - DNA, 23 bp, Homo sapiens
atctgcatgtaaaatcttcagct

SEQ ID NO: 4687726 - DNA, 21 bp, Homo sapiens
atctgccatgtccatagccat

SEQ ID NO: 4687727 - DNA, 12 bp, Homo sapiens
atctgcccctcc

SEQ ID NO: 4687728 - DNA, 16 bp, Homo sapiens
atctgcgtgacaataa

SEQ ID NO: 4687729 - DNA, 23 bp, Homo sapiens
atctgcgtgacaataaaacatta

SEQ ID NO: 4687730 - DNA, 18 bp, Homo sapiens
atctgctaccaaaacagt

SEQ ID NO: 4687731 - DNA, 14 bp, Homo sapiens
atctgctagtgctg

SEQ ID NO: 4687732 - DNA, 20 bp, Homo sapiens
atctgctagtgctgtaatat

SEQ ID NO: 4687733 - DNA, 15 bp, Homo sapiens
atctgctctccttcc

SEQ ID NO: 4687734 - DNA, 16 bp, Homo sapiens
atctgctctccttcct

SEQ ID NO: 4687735 - DNA, 20 bp, Homo sapiens
atctggagagctagaacctg

SEQ ID NO: 4687736 - DNA, 23 bp, Homo sapiens
atctggccgttgatgttggctgg

SEQ ID NO: 4687737 - DNA, 18 bp, Homo sapiens
atctgggcatagatgcag

SEQ ID NO: 4687738 - DNA, 15 bp, Homo sapiens
atctggtatctgcat

SEQ ID NO: 4687739 - DNA, 17 bp, Homo sapiens
atctggtgactttcctc

SEQ ID NO: 4687740 - DNA, 17 bp, Homo sapiens
atctggtgtaggaagtt

SEQ ID NO: 4687741 - DNA, 16 bp, Homo sapiens
atctgtccctgcctca

SEQ ID NO: 4687742 - DNA, 18 bp, Homo sapiens
atctgtgaaaggaaagag

SEQ ID NO: 4687743 - DNA, 12 bp, Homo sapiens
atctgtgtcttg

SEQ ID NO: 4687744 - DNA, 21 bp, Homo sapiens
atgcctggtggcagctgcggt

SEQ ID NO: 4687745 - DNA, 15 bp, Homo sapiens
atgcctttgagacag

SEQ ID NO: 4687746 - DNA, 14 bp, Homo sapiens
atgccttttatttc

SEQ ID NO: 4687747 - DNA, 19 bp, Homo sapiens
atgcctttttttctctgca

SEQ ID NO: 4687748 - DNA, 19 bp, Homo sapiens
atgcgagtgctcatttcag

SEQ ID NO: 4687749 - DNA, 22 bp, Homo sapiens
atgcgattatctacccacgtcc

SEQ ID NO: 4687750 - DNA, 14 bp, Homo sapiens
atgcgcaggctggc

SEQ ID NO: 4687751 - DNA, 18 bp, Homo sapiens
atgcgcaggctggccctg

SEQ ID NO: 4687752 - DNA, 15 bp, Homo sapiens
atgcgggcattttga

SEQ ID NO: 4687753 - DNA, 17 bp, Homo sapiens
atgcgggcattttgaat

SEQ ID NO: 4687754 - DNA, 13 bp, Homo sapiens
atgctaaccttgt

SEQ ID NO: 4687755 - DNA, 21 bp, Homo sapiens
atgctctgtggctggctcacc

SEQ ID NO: 4687756 - DNA, 16 bp, Homo sapiens
atgctgatgtcctcac

SEQ ID NO: 4687757 - DNA, 22 bp, Homo sapiens
atgctgcccagggtcagtgtat

SEQ ID NO: 4687758 - DNA, 12 bp, Homo sapiens
atgctgccctgt

SEQ ID NO: 4687759 - DNA, 16 bp, Homo sapiens
atgctgccctgtgagt

SEQ ID NO: 4687760 - DNA, 16 bp, Homo sapiens
atgctggcctgtgtga

SEQ ID NO: 4687761 - DNA, 16 bp, Homo sapiens
atgctgggctgggtgc

SEQ ID NO: 4687762 - DNA, 19 bp, Homo sapiens
atgctgtgcaaacagtgta

SEQ ID NO: 4687763 - DNA, 22 bp, Homo sapiens
atgcttccattaacaaatgctc

SEQ ID NO: 4687764 - DNA, 14 bp, Homo sapiens
atgcttcttcagag

SEQ ID NO: 4687765 - DNA, 20 bp, Homo sapiens
atgcttcttcagagactcct

SEQ ID NO: 4687766 - DNA, 12 bp, Homo sapiens
atgcttgattta

SEQ ID NO: 4687767 - DNA, 17 bp, Homo sapiens
atgctttgaatgcaaaa

SEQ ID NO: 4687768 - DNA, 21 bp, Homo sapiens
atgctttgaatgcaaaagaaa

SEQ ID NO: 4687769 - DNA, 22 bp, Homo sapiens
atgctttgaatgcaaaagaaat

SEQ ID NO: 4687770 - DNA, 19 bp, Homo sapiens
atggaaaaaaataaacttt

SEQ ID NO: 4687771 - DNA, 14 bp, Homo sapiens
atggaaaaatgtga

SEQ ID NO: 4687772 - DNA, 15 bp, Homo sapiens
atggaaaacagagta

SEQ ID NO: 4687773 - DNA, 22 bp, Homo sapiens
atggaaaacagagtatttctgg

SEQ ID NO: 4687774 - DNA, 19 bp, Homo sapiens
atggaaagcttcagtgctg

SEQ ID NO: 4687775 - DNA, 13 bp, Homo sapiens
atggaaatgttta

SEQ ID NO: 4687776 - DNA, 20 bp, Homo sapiens
atggaaattcccttcatctg

SEQ ID NO: 4687777 - DNA, 14 bp, Homo sapiens
atggaacctccttt

SEQ ID NO: 4687778 - DNA, 21 bp, Homo sapiens
atggaacctcctttctcttct

SEQ ID NO: 4687779 - DNA, 14 bp, Homo sapiens
atggaaggggctga

SEQ ID NO: 4687780 - DNA, 14 bp, Homo sapiens
atggaatgcttctt

SEQ ID NO: 4687781 - DNA, 15 bp, Homo sapiens
atggacaatggaccg

SEQ ID NO: 4687782 - DNA, 20 bp, Homo sapiens
atggacagaagaaggcagca

SEQ ID NO: 4687783 - DNA, 16 bp, Homo sapiens
atggaccggagagtgg

SEQ ID NO: 4687784 - DNA, 13 bp, Homo sapiens
atggacggtgctc

SEQ ID NO: 4687785 - DNA, 21 bp, Homo sapiens
atggagaatggtgttccattg

SEQ ID NO: 4687786 - DNA, 23 bp, Homo sapiens
atggagagctggagcctggtgcc

SEQ ID NO: 4687787 - DNA, 16 bp, Homo sapiens
atggagagtgagagca

SEQ ID NO: 4687788 - DNA, 19 bp, Homo sapiens
atggaggatctctaaagag

SEQ ID NO: 4687789 - DNA, 19 bp, Homo sapiens
atggagtgagacccaggag

SEQ ID NO: 4687790 - DNA, 23 bp, Homo sapiens
atggagtgtttgacgaagaaaca

SEQ ID NO: 4687791 - DNA, 23 bp, Homo sapiens
atggatatgtgtaaatgttatga

SEQ ID NO: 4687792 - DNA, 13 bp, Homo sapiens
atggatctgattt

SEQ ID NO: 4687793 - DNA, 17 bp, Homo sapiens
atggattccaaagcatt

SEQ ID NO: 4687794 - DNA, 20 bp, Homo sapiens
atggattggattatttaata

SEQ ID NO: 4687795 - DNA, 15 bp, Homo sapiens
atggatttttcttta

SEQ ID NO: 4687796 - DNA, 20 bp, Homo sapiens
atggatttttctttaactgc

SEQ ID NO: 4687797 - DNA, 22 bp, Homo sapiens
atggcacaatctcggctcactg

SEQ ID NO: 4687798 - DNA, 13 bp, Homo sapiens
atggcagaagaca

SEQ ID NO: 4687799 - DNA, 16 bp, Homo sapiens
atggcagaagacacca

SEQ ID NO: 4687800 - DNA, 19 bp, Homo sapiens
atggcagaagacaccagag

SEQ ID NO: 4687801 - DNA, 20 bp, Homo sapiens
atggcagaagacaccagagc

SEQ ID NO: 4687802 - DNA, 22 bp, Homo sapiens
atggcagaagacaccagagcag

SEQ ID NO: 4687803 - DNA, 24 bp, Homo sapiens
atggcagaagacaccagagcagat

SEQ ID NO: 4687804 - DNA, 13 bp, Homo sapiens
atggcagaaggca

SEQ ID NO: 4687805 - DNA, 16 bp, Homo sapiens
atggcaggatggcctg

SEQ ID NO: 4687806 - DNA, 24 bp, Homo sapiens
atggcagggggtggaattattact

SEQ ID NO: 4687807 - DNA, 15 bp, Homo sapiens
atggcagtgtctttc

SEQ ID NO: 4687808 - DNA, 15 bp, Homo sapiens
atggcatcacctcca

SEQ ID NO: 4687809 - DNA, 20 bp, Homo sapiens
atggcatctcattgaggaca

SEQ ID NO: 4687810 - DNA, 22 bp, Homo sapiens
atggctagaatatcctacttct

SEQ ID NO: 4687811 - DNA, 15 bp, Homo sapiens
atggctgtgaggatg

SEQ ID NO: 4687812 - DNA, 17 bp, Homo sapiens
atggcttatccagctgg

SEQ ID NO: 4687813 - DNA, 18 bp, Homo sapiens
atggcttatccagctggt

SEQ ID NO: 4687814 - DNA, 19 bp, Homo sapiens
atgggaagcagctcaaggg

SEQ ID NO: 4687815 - DNA, 20 bp, Homo sapiens
atgggagccgggtctgcctc

SEQ ID NO: 4687816 - DNA, 14 bp, Homo sapiens
atgggcactgctgg

SEQ ID NO: 4687817 - DNA, 18 bp, Homo sapiens
atgggcactgctgggtgg

SEQ ID NO: 4687818 - DNA, 13 bp, Homo sapiens
atgggcagagcag

SEQ ID NO: 4687819 - DNA, 14 bp, Homo sapiens
atgggcagagcaga

SEQ ID NO: 4687820 - DNA, 14 bp, Homo sapiens
atgggcagagccca

SEQ ID NO: 4687821 - DNA, 15 bp, Homo sapiens
atgggcttcactgta

SEQ ID NO: 4687822 - DNA, 19 bp, Homo sapiens
atgggcttcactgtataaa

SEQ ID NO: 4687823 - DNA, 18 bp, Homo sapiens
atgggcttttacctgtgc

SEQ ID NO: 4687824 - DNA, 18 bp, Homo sapiens
atgggggagggggcagaa

SEQ ID NO: 4687825 - DNA, 15 bp, Homo sapiens
atgggggctctgcac

SEQ ID NO: 4687826 - DNA, 20 bp, Homo sapiens
atgggtgcttggaggaagga

SEQ ID NO: 4687827 - DNA, 22 bp, Homo sapiens
atgggttagggaaaacattcca

SEQ ID NO: 4687828 - DNA, 16 bp, Homo sapiens
atggtactaaggagaa

SEQ ID NO: 4687829 - DNA, 15 bp, Homo sapiens
atggtagttttacag

SEQ ID NO: 4687830 - DNA, 21 bp, Homo sapiens
atggtagttttacagtgtttc

SEQ ID NO: 4687831 - DNA, 22 bp, Homo sapiens
atggtagttttacagtgtttct

SEQ ID NO: 4687832 - DNA, 18 bp, Homo sapiens
atggtatgatcaataaag

SEQ ID NO: 4687833 - DNA, 13 bp, Homo sapiens
atggtccaggaga

SEQ ID NO: 4687834 - DNA, 16 bp, Homo sapiens
atggtccaggagaagg

SEQ ID NO: 4687835 - DNA, 15 bp, Homo sapiens
atggtgaacatttta

SEQ ID NO: 4687836 - DNA, 18 bp, Homo sapiens
atggtgaacattttaatg

SEQ ID NO: 4687837 - DNA, 15 bp, Homo sapiens
atggtgacattgaaa

SEQ ID NO: 4687838 - DNA, 14 bp, Homo sapiens
atggtgacttttga

SEQ ID NO: 4687839 - DNA, 14 bp, Homo sapiens
atggtgatgaaatg

SEQ ID NO: 4687840 - DNA, 11 bp, Homo sapiens
atggtgcctga

SEQ ID NO: 4687841 - DNA, 13 bp, Homo sapiens
atggtggctgggt

SEQ ID NO: 4687842 - DNA, 20 bp, Homo sapiens
atggtggggtaccagccact

SEQ ID NO: 4687843 - DNA, 16 bp, Homo sapiens
atggtgtaataagaca

SEQ ID NO: 4687844 - DNA, 22 bp, Homo sapiens
atggtgtaataagacataacgt

SEQ ID NO: 4687845 - DNA, 19 bp, Homo sapiens
atggtgtgtgtctctgaca

SEQ ID NO: 4687846 - DNA, 13 bp, Homo sapiens
atggtgttccatt

SEQ ID NO: 4687847 - DNA, 16 bp, Homo sapiens
atggttccaatgaaat

SEQ ID NO: 4687848 - DNA, 18 bp, Homo sapiens
atggtttgcaaggaagcc

SEQ ID NO: 4687849 - DNA, 19 bp, Homo sapiens
atgtaaaatcttcagctgg

SEQ ID NO: 4687850 - DNA, 21 bp, Homo sapiens
atgtaaaatcttcagctggtg

SEQ ID NO: 4687851 - DNA, 14 bp, Homo sapiens
atgtaaactgtgca

SEQ ID NO: 4687852 - DNA, 20 bp, Homo sapiens
atgtaaatagattttaagct

SEQ ID NO: 4687853 - DNA, 14 bp, Homo sapiens
atgtaattataagc

SEQ ID NO: 4687854 - DNA, 16 bp, Homo sapiens
acccctggttctcatc

SEQ ID NO: 4687855 - DNA, 19 bp, Homo sapiens
accccttttcagcttctgc

SEQ ID NO: 4687856 - DNA, 23 bp, Homo sapiens
accccttttcagcttctgctggg

SEQ ID NO: 4687857 - DNA, 19 bp, Homo sapiens
acccgccttttataaacct

SEQ ID NO: 4687858 - DNA, 19 bp, Homo sapiens
acccgctaagagggaggga

SEQ ID NO: 4687859 - DNA, 22 bp, Homo sapiens
acccggcaggctagaacctggc

SEQ ID NO: 4687860 - DNA, 22 bp, Homo sapiens
acccggcccctgctggttcagg

SEQ ID NO: 4687861 - DNA, 19 bp, Homo sapiens
acccgggaagggggctggg

SEQ ID NO: 4687862 - DNA, 16 bp, Homo sapiens
acccgttcatggggga

SEQ ID NO: 4687863 - DNA, 23 bp, Homo sapiens
acccgttcatgggggagggggca

SEQ ID NO: 4687864 - DNA, 16 bp, Homo sapiens
accctagttattttct

SEQ ID NO: 4687865 - DNA, 18 bp, Homo sapiens
accctcaccgcggctgga

SEQ ID NO: 4687866 - DNA, 21 bp, Homo sapiens
accctcactgggactttgtaa

SEQ ID NO: 4687867 - DNA, 13 bp, Homo sapiens
accctcatcacca

SEQ ID NO: 4687868 - DNA, 12 bp, Homo sapiens
accctcatgctg

SEQ ID NO: 4687869 - DNA, 13 bp, Homo sapiens
accctcccctccc

SEQ ID NO: 4687870 - DNA, 11 bp, Homo sapiens
accctccctgc

SEQ ID NO: 4687871 - DNA, 13 bp, Homo sapiens
accctccctgctg

SEQ ID NO: 4687872 - DNA, 14 bp, Homo sapiens
accctccctgctgt

SEQ ID NO: 4687873 - DNA, 20 bp, Homo sapiens
accctcctctatttctttaa

SEQ ID NO: 4687874 - DNA, 21 bp, Homo sapiens
accctcctttcaccacatgtg

SEQ ID NO: 4687875 - DNA, 19 bp, Homo sapiens
accctcgaggcggatcttt

SEQ ID NO: 4687876 - DNA, 18 bp, Homo sapiens
accctctcaggctgtccc

SEQ ID NO: 4687877 - DNA, 19 bp, Homo sapiens
accctctccgcacacctct

SEQ ID NO: 4687878 - DNA, 22 bp, Homo sapiens
accctgagctgaggcagcagtg

SEQ ID NO: 4687879 - DNA, 23 bp, Homo sapiens
accctgagctgaggcagcagtgt

SEQ ID NO: 4687880 - DNA, 11 bp, Homo sapiens
accctgaggcc

SEQ ID NO: 4687881 - DNA, 15 bp, Homo sapiens
accctgaggcccaga

SEQ ID NO: 4687882 - DNA, 19 bp, Homo sapiens
accctgaggcccagagggc

SEQ ID NO: 4687883 - DNA, 15 bp, Homo sapiens
accctgccctgtggg

SEQ ID NO: 4687884 - DNA, 14 bp, Homo sapiens
accctgctcacagg

SEQ ID NO: 4687885 - DNA, 16 bp, Homo sapiens
accctgctcacaggca

SEQ ID NO: 4687886 - DNA, 24 bp, Homo sapiens
accctggaaactaccagtgggcat

SEQ ID NO: 4687887 - DNA, 17 bp, Homo sapiens
accctgtgatggggccc

SEQ ID NO: 4687888 - DNA, 16 bp, Homo sapiens
acccttgacttaactt

SEQ ID NO: 4687889 - DNA, 16 bp, Homo sapiens
acccttgtggtcccac

SEQ ID NO: 4687890 - DNA, 17 bp, Homo sapiens
acccttgtggtcccacc

SEQ ID NO: 4687891 - DNA, 23 bp, Homo sapiens
accgaacatatcatttgtgaaga

SEQ ID NO: 4687892 - DNA, 20 bp, Homo sapiens
accgcagacaggaccaggga

SEQ ID NO: 4687893 - DNA, 22 bp, Homo sapiens
accgcatgccccctcgtgccag

SEQ ID NO: 4687894 - DNA, 13 bp, Homo sapiens
accgctgaatatg

SEQ ID NO: 4687895 - DNA, 16 bp, Homo sapiens
accggaccagcctggc

SEQ ID NO: 4687896 - DNA, 19 bp, Homo sapiens
accgggccacagagaaagt

SEQ ID NO: 4687897 - DNA, 17 bp, Homo sapiens
accgtagcgtatacatt

SEQ ID NO: 4687898 - DNA, 19 bp, Homo sapiens
accgtgcctggccacgccc

SEQ ID NO: 4687899 - DNA, 14 bp, Homo sapiens
accgtgggctccct

SEQ ID NO: 4687900 - DNA, 16 bp, Homo sapiens
accgtgggctccctga

SEQ ID NO: 4687901 - DNA, 21 bp, Homo sapiens
acctaaaatttgccctcccat

SEQ ID NO: 4687902 - DNA, 18 bp, Homo sapiens
acctaaaccctctgtgaa

SEQ ID NO: 4687903 - DNA, 20 bp, Homo sapiens
acctacagtgtacagtcttg

SEQ ID NO: 4687904 - DNA, 11 bp, Homo sapiens
acctacagttt

SEQ ID NO: 4687905 - DNA, 19 bp, Homo sapiens
acctacagttttaactgtg

SEQ ID NO: 4687906 - DNA, 12 bp, Homo sapiens
acctaccacatg

SEQ ID NO: 4687907 - DNA, 20 bp, Homo sapiens
acctaccaccacgcccggct

SEQ ID NO: 4687908 - DNA, 15 bp, Homo sapiens
acctagctgttgtaa

SEQ ID NO: 4687909 - DNA, 16 bp, Homo sapiens
acctagctgttgtaaa

SEQ ID NO: 4687910 - DNA, 19 bp, Homo sapiens
acctagtggctgtccagtg

SEQ ID NO: 4687911 - DNA, 21 bp, Homo sapiens
acctagtggctgtccagtgcc

SEQ ID NO: 4687912 - DNA, 12 bp, Homo sapiens
acctatttccac

SEQ ID NO: 4687913 - DNA, 13 bp, Homo sapiens
acctcaccctctc

SEQ ID NO: 4687914 - DNA, 23 bp, Homo sapiens
acctcaggtaatcgacctgcctc

SEQ ID NO: 4687915 - DNA, 23 bp, Homo sapiens
acctcctgcctcgaactggctgc

SEQ ID NO: 4687916 - DNA, 17 bp, Homo sapiens
acctcctttctcttctc

SEQ ID NO: 4687917 - DNA, 14 bp, Homo sapiens
acctcgctggactc

SEQ ID NO: 4687918 - DNA, 18 bp, Homo sapiens
acctctccagcctcagct

SEQ ID NO: 4687919 - DNA, 19 bp, Homo sapiens
acctctcttgtgagccata

SEQ ID NO: 4687920 - DNA, 19 bp, Homo sapiens
acctgaaaacactgtgcac

SEQ ID NO: 4687921 - DNA, 21 bp, Homo sapiens
acctgaaattaatttgtgaat

SEQ ID NO: 4687922 - DNA, 15 bp, Homo sapiens
acctgaactctgcaa

SEQ ID NO: 4687923 - DNA, 16 bp, Homo sapiens
acctgaactctgcaac

SEQ ID NO: 4687924 - DNA, 16 bp, Homo sapiens
acctgagccagcctgc

SEQ ID NO: 4687925 - DNA, 15 bp, Homo sapiens
acctgaggcccttct

SEQ ID NO: 4687926 - DNA, 21 bp, Homo sapiens
acctgaggcccttctctccag

SEQ ID NO: 4687927 - DNA, 23 bp, Homo sapiens
acctgaggcccttctctccagcc

SEQ ID NO: 4687928 - DNA, 16 bp, Homo sapiens
acctgaggggcctctt

SEQ ID NO: 4687929 - DNA, 14 bp, Homo sapiens
acctgatgaaaata

SEQ ID NO: 4687930 - DNA, 19 bp, Homo sapiens
acctgatgaaaataaagaa

SEQ ID NO: 4687931 - DNA, 21 bp, Homo sapiens
acctgatgaaaataaagaatg

SEQ ID NO: 4687932 - DNA, 14 bp, Homo sapiens
acctgattgtgtct

SEQ ID NO: 4687933 - DNA, 18 bp, Homo sapiens
acctgattgtgtctcttg

SEQ ID NO: 4687934 - DNA, 17 bp, Homo sapiens
acctgcactaacagagt

SEQ ID NO: 4687935 - DNA, 13 bp, Homo sapiens
acctgcaggttgg

SEQ ID NO: 4687936 - DNA, 17 bp, Homo sapiens
acctgcaggttgggcca

SEQ ID NO: 4687937 - DNA, 15 bp, Homo sapiens
acctgcatatctcta

SEQ ID NO: 4687938 - DNA, 10 bp, Homo sapiens
acctgcattt

SEQ ID NO: 4687939 - DNA, 15 bp, Homo sapiens
acctgccagggacag

SEQ ID NO: 4687940 - DNA, 14 bp, Homo sapiens
acctgcccctcctc

SEQ ID NO: 4687941 - DNA, 22 bp, Homo sapiens
acctgcccctcctctctgccct

SEQ ID NO: 4687942 - DNA, 15 bp, Homo sapiens
accaagctatcctgg

SEQ ID NO: 4687943 - DNA, 18 bp, Homo sapiens
accaagctgtgccaccct

SEQ ID NO: 4687944 - DNA, 19 bp, Homo sapiens
accaagctgtgccaccctg

SEQ ID NO: 4687945 - DNA, 20 bp, Homo sapiens
accaagctgtgccaccctgg

SEQ ID NO: 4687946 - DNA, 15 bp, Homo sapiens
accaagggcagaggg

SEQ ID NO: 4687947 - DNA, 20 bp, Homo sapiens
accaagttgtttattccaaa

SEQ ID NO: 4687948 - DNA, 15 bp, Homo sapiens
accaatattgtacag

SEQ ID NO: 4687949 - DNA, 19 bp, Homo sapiens
accaatattgtacagtttt

SEQ ID NO: 4687950 - DNA, 13 bp, Homo sapiens
accaatcctggac

SEQ ID NO: 4687951 - DNA, 18 bp, Homo sapiens
accacagcaaggcacctg

SEQ ID NO: 4687952 - DNA, 19 bp, Homo sapiens
accacagcaaggcacctgc

SEQ ID NO: 4687953 - DNA, 16 bp, Homo sapiens
accacaggcttgttac

SEQ ID NO: 4687954 - DNA, 19 bp, Homo sapiens
accacatcttgctctgctg

SEQ ID NO: 4687955 - DNA, 24 bp, Homo sapiens
accacatcttgctctgctgacaga

SEQ ID NO: 4687956 - DNA, 15 bp, Homo sapiens
accacattgaagaat

SEQ ID NO: 4687957 - DNA, 12 bp, Homo sapiens
accacccagagc

SEQ ID NO: 4687958 - DNA, 18 bp, Homo sapiens
accacccagagcaccctc

SEQ ID NO: 4687959 - DNA, 14 bp, Homo sapiens
accaccccccactc

SEQ ID NO: 4687960 - DNA, 15 bp, Homo sapiens
accaccccccactct

SEQ ID NO: 4687961 - DNA, 13 bp, Homo sapiens
accaccctgaggc

SEQ ID NO: 4687962 - DNA, 12 bp, Homo sapiens
accacctcatgt

SEQ ID NO: 4687963 - DNA, 16 bp, Homo sapiens
accacctcatgtcatt

SEQ ID NO: 4687964 - DNA, 16 bp, Homo sapiens
accacctttgtctctg

SEQ ID NO: 4687965 - DNA, 20 bp, Homo sapiens
accacctttgtttctccccc

SEQ ID NO: 4687966 - DNA, 22 bp, Homo sapiens
accactaatgcttgccaagaaa

SEQ ID NO: 4687967 - DNA, 15 bp, Homo sapiens
accactttttgcagc

SEQ ID NO: 4687968 - DNA, 16 bp, Homo sapiens
accactttttgcagct

SEQ ID NO: 4687969 - DNA, 20 bp, Homo sapiens
accactttttgcagctttct

SEQ ID NO: 4687970 - DNA, 22 bp, Homo sapiens
accagaaacctgggagagactt

SEQ ID NO: 4687971 - DNA, 14 bp, Homo sapiens
accagacaccttga

SEQ ID NO: 4687972 - DNA, 22 bp, Homo sapiens
accagcatcccttgaccaggcc

SEQ ID NO: 4687973 - DNA, 21 bp, Homo sapiens
accagccattggctatttaaa

SEQ ID NO: 4687974 - DNA, 19 bp, Homo sapiens
accagccccagtgcccaca

SEQ ID NO: 4687975 - DNA, 23 bp, Homo sapiens
accagctgttctgtcccttggag

SEQ ID NO: 4687976 - DNA, 12 bp, Homo sapiens
accaggcctggg

SEQ ID NO: 4687977 - DNA, 18 bp, Homo sapiens
accaggcttgcctgggac

SEQ ID NO: 4687978 - DNA, 20 bp, Homo sapiens
accaggtctcctccaccgcc

SEQ ID NO: 4687979 - DNA, 17 bp, Homo sapiens
accaggtcttgacctga

SEQ ID NO: 4687980 - DNA, 18 bp, Homo sapiens
accagtagtcacctctgg

SEQ ID NO: 4687981 - DNA, 19 bp, Homo sapiens
accagtttaacctgatgca

SEQ ID NO: 4687982 - DNA, 21 bp, Homo sapiens
accagtttaacctgatgcagt

SEQ ID NO: 4687983 - DNA, 20 bp, Homo sapiens
accatcagaaacaccctcac

SEQ ID NO: 4687984 - DNA, 23 bp, Homo sapiens
accatcagaaacaccctcacact

SEQ ID NO: 4687985 - DNA, 16 bp, Homo sapiens
accatcatgtctggct

SEQ ID NO: 4687986 - DNA, 16 bp, Homo sapiens
accatccctgaaggcc

SEQ ID NO: 4687987 - DNA, 18 bp, Homo sapiens
accatccctgaaggcccc

SEQ ID NO: 4687988 - DNA, 19 bp, Homo sapiens
accatccttacaatgtaaa

SEQ ID NO: 4687989 - DNA, 19 bp, Homo sapiens
accatgagtggcatggcca

SEQ ID NO: 4687990 - DNA, 16 bp, Homo sapiens
accatggaaagaaata

SEQ ID NO: 4687991 - DNA, 20 bp, Homo sapiens
accatgtacctaatccaaat

SEQ ID NO: 4687992 - DNA, 14 bp, Homo sapiens
accattagcataat

SEQ ID NO: 4687993 - DNA, 18 bp, Homo sapiens
accattatttaatttgta

SEQ ID NO: 4687994 - DNA, 16 bp, Homo sapiens
accattctccacctgc

SEQ ID NO: 4687995 - DNA, 18 bp, Homo sapiens
accattctccacctgcca

SEQ ID NO: 4687996 - DNA, 13 bp, Homo sapiens
accattctttctt

SEQ ID NO: 4687997 - DNA, 23 bp, Homo sapiens
accatttcttgaggtaaaagcat

SEQ ID NO: 4687998 - DNA, 22 bp, Homo sapiens
accattttggggtacccactgc

SEQ ID NO: 4687999 - DNA, 15 bp, Homo sapiens
acccaaatcctctcc

SEQ ID NO: 4688000 - DNA, 19 bp, Homo sapiens
acccaagggcctggcctga

SEQ ID NO: 4688001 - DNA, 22 bp, Homo sapiens
acccaagggcctggcctgagct

SEQ ID NO: 4688002 - DNA, 14 bp, Homo sapiens
acccaattgtttca

SEQ ID NO: 4688003 - DNA, 16 bp, Homo sapiens
acccacagtggagagg

SEQ ID NO: 4688004 - DNA, 15 bp, Homo sapiens
acccaccctcctttc

SEQ ID NO: 4688005 - DNA, 21 bp, Homo sapiens
acccacgtccacgcggccacc

SEQ ID NO: 4688006 - DNA, 15 bp, Homo sapiens
acccactgctctggt

SEQ ID NO: 4688007 - DNA, 16 bp, Homo sapiens
acccacttccctgggc

SEQ ID NO: 4688008 - DNA, 22 bp, Homo sapiens
acccagagaaaattaattatat

SEQ ID NO: 4688009 - DNA, 17 bp, Homo sapiens
acccagccccaaggggt

SEQ ID NO: 4688010 - DNA, 19 bp, Homo sapiens
acccagccccaaggggtgg

SEQ ID NO: 4688011 - DNA, 18 bp, Homo sapiens
acccagccgctgcccggc

SEQ ID NO: 4688012 - DNA, 13 bp, Homo sapiens
acccagcgagccc

SEQ ID NO: 4688013 - DNA, 23 bp, Homo sapiens
acccagcgagccctggtggcagt

SEQ ID NO: 4688014 - DNA, 24 bp, Homo sapiens
acccagcgagccctggtggcagtg

SEQ ID NO: 4688015 - DNA, 15 bp, Homo sapiens
acccaggagccccga

SEQ ID NO: 4688016 - DNA, 23 bp, Homo sapiens
acccaggaggcagaggttgcagt

SEQ ID NO: 4688017 - DNA, 19 bp, Homo sapiens
acccaggctggagtgcagt

SEQ ID NO: 4688018 - DNA, 12 bp, Homo sapiens
acccaggctggg

SEQ ID NO: 4688019 - DNA, 14 bp, Homo sapiens
acccaggctgggca

SEQ ID NO: 4688020 - DNA, 22 bp, Homo sapiens
acccaggctgggcaaggaggcc

SEQ ID NO: 4688021 - DNA, 14 bp, Homo sapiens
acccagggcctagg

SEQ ID NO: 4688022 - DNA, 11 bp, Homo sapiens
acccaggtgct

SEQ ID NO: 4688023 - DNA, 23 bp, Homo sapiens
acccaggtgctaggaacactcct

SEQ ID NO: 4688024 - DNA, 16 bp, Homo sapiens
acccagtccacaaaat

SEQ ID NO: 4688025 - DNA, 17 bp, Homo sapiens
acccagttgccatctgc

SEQ ID NO: 4688026 - DNA, 14 bp, Homo sapiens
acccatgctgccct

SEQ ID NO: 4688027 - DNA, 20 bp, Homo sapiens
agaaacaactctttgagaaa

SEQ ID NO: 4688028 - DNA, 14 bp, Homo sapiens
agaaactactaatt

SEQ ID NO: 4688029 - DNA, 19 bp, Homo sapiens
agaaacttccaaatcccct

SEQ ID NO: 4688030 - DNA, 16 bp, Homo sapiens
agaaacttgtgcttta

SEQ ID NO: 4688031 - DNA, 18 bp, Homo sapiens
agaaagacagagctggga

SEQ ID NO: 4688032 - DNA, 13 bp, Homo sapiens
agaaagattttat

SEQ ID NO: 4688033 - DNA, 20 bp, Homo sapiens
agaaagcccttaggaagaat

SEQ ID NO: 4688034 - DNA, 20 bp, Homo sapiens
agaaaggaggggatagagag

SEQ ID NO: 4688035 - DNA, 23 bp, Homo sapiens
agaaaggaggggatagagagaga

SEQ ID NO: 4688036 - DNA, 18 bp, Homo sapiens
agaaagtaagaaaacaat

SEQ ID NO: 4688037 - DNA, 22 bp, Homo sapiens
agaaagtacttctccaccctgc

SEQ ID NO: 4688038 - DNA, 17 bp, Homo sapiens
agaaagttgcacggctg

SEQ ID NO: 4688039 - DNA, 19 bp, Homo sapiens
agaaagttgcacggctgct

SEQ ID NO: 4688040 - DNA, 20 bp, Homo sapiens
agaaagttgcacggctgctg

SEQ ID NO: 4688041 - DNA, 21 bp, Homo sapiens
agaaagttgcacggctgctga

SEQ ID NO: 4688042 - DNA, 13 bp, Homo sapiens
agaaataaaccaa

SEQ ID NO: 4688043 - DNA, 14 bp, Homo sapiens
agaaatcaattttt

SEQ ID NO: 4688044 - DNA, 21 bp, Homo sapiens
agaaatcatttgggttaatat

SEQ ID NO: 4688045 - DNA, 20 bp, Homo sapiens
agaaatgctggtttttcagt

SEQ ID NO: 4688046 - DNA, 19 bp, Homo sapiens
agaaattcaatttggattt

SEQ ID NO: 4688047 - DNA, 22 bp, Homo sapiens
agaaattcaatttggatttaaa

SEQ ID NO: 4688048 - DNA, 16 bp, Homo sapiens
agaaatttccactcag

SEQ ID NO: 4688049 - DNA, 20 bp, Homo sapiens
agaacaaagtgagacagtcc

SEQ ID NO: 4688050 - DNA, 14 bp, Homo sapiens
agaacactgtgaaa

SEQ ID NO: 4688051 - DNA, 12 bp, Homo sapiens
agaacagcttca

SEQ ID NO: 4688052 - DNA, 18 bp, Homo sapiens
agaacagcttcaggttat

SEQ ID NO: 4688053 - DNA, 22 bp, Homo sapiens
agaacagcttcaggttatcgaa

SEQ ID NO: 4688054 - DNA, 18 bp, Homo sapiens
agaacagtctctggaaga

SEQ ID NO: 4688055 - DNA, 21 bp, Homo sapiens
agaacagtgcttgccacagag

SEQ ID NO: 4688056 - DNA, 15 bp, Homo sapiens
agaacagtgtttgat

SEQ ID NO: 4688057 - DNA, 21 bp, Homo sapiens
agaacatggtgtgtgtctctg

SEQ ID NO: 4688058 - DNA, 17 bp, Homo sapiens
agaaccaggcaacttgg

SEQ ID NO: 4688059 - DNA, 16 bp, Homo sapiens
agaacctggaagggct

SEQ ID NO: 4688060 - DNA, 12 bp, Homo sapiens
agaacctggaga

SEQ ID NO: 4688061 - DNA, 17 bp, Homo sapiens
agaacctggagggctgg

SEQ ID NO: 4688062 - DNA, 17 bp, Homo sapiens
agaacggggctcttctc

SEQ ID NO: 4688063 - DNA, 23 bp, Homo sapiens
agaactacaaacaaaatttctat

SEQ ID NO: 4688064 - DNA, 17 bp, Homo sapiens
agaactagaacctggag

SEQ ID NO: 4688065 - DNA, 18 bp, Homo sapiens
agaactagaacctggagg

SEQ ID NO: 4688066 - DNA, 23 bp, Homo sapiens
agaactattgtgctcagagacac

SEQ ID NO: 4688067 - DNA, 22 bp, Homo sapiens
agaactgaaggggagttttcac

SEQ ID NO: 4688068 - DNA, 18 bp, Homo sapiens
agaacttccccatacaaa

SEQ ID NO: 4688069 - DNA, 18 bp, Homo sapiens
agaacttggatgtacctg

SEQ ID NO: 4688070 - DNA, 12 bp, Homo sapiens
agaagaagaatt

SEQ ID NO: 4688071 - DNA, 21 bp, Homo sapiens
agaagaaggcagcaggtggca

SEQ ID NO: 4688072 - DNA, 15 bp, Homo sapiens
agaagacaccagagc

SEQ ID NO: 4688073 - DNA, 20 bp, Homo sapiens
agaagcattccttctttgat

SEQ ID NO: 4688074 - DNA, 18 bp, Homo sapiens
agaagccacaggcctgag

SEQ ID NO: 4688075 - DNA, 12 bp, Homo sapiens
agaagcccagga

SEQ ID NO: 4688076 - DNA, 20 bp, Homo sapiens
agaagcccaggaaaggctcc

SEQ ID NO: 4688077 - DNA, 22 bp, Homo sapiens
agaagcccaggaaaggctccag

SEQ ID NO: 4688078 - DNA, 13 bp, Homo sapiens
agaagctggagga

SEQ ID NO: 4688079 - DNA, 16 bp, Homo sapiens
agaagctggaggacta

SEQ ID NO: 4688080 - DNA, 18 bp, Homo sapiens
agaagctgttgtacattt

SEQ ID NO: 4688081 - DNA, 21 bp, Homo sapiens
agaagctgttgtacatttatg

SEQ ID NO: 4688082 - DNA, 22 bp, Homo sapiens
agaaggaaaaatttgaagtatt

SEQ ID NO: 4688083 - DNA, 13 bp, Homo sapiens
agaagggctcaga

SEQ ID NO: 4688084 - DNA, 23 bp, Homo sapiens
agaagggctcagagaggacaaaa

SEQ ID NO: 4688085 - DNA, 20 bp, Homo sapiens
agaagggggtggtgtctcca

SEQ ID NO: 4688086 - DNA, 14 bp, Homo sapiens
agaaggtatttttc

SEQ ID NO: 4688087 - DNA, 18 bp, Homo sapiens
agaaggtatttttccaat

SEQ ID NO: 4688088 - DNA, 19 bp, Homo sapiens
agaagtattgtttacatta

SEQ ID NO: 4688089 - DNA, 20 bp, Homo sapiens
agaagtggggacagagcaga

SEQ ID NO: 4688090 - DNA, 22 bp, Homo sapiens
agaagtggggaccccacccctc

SEQ ID NO: 4688091 - DNA, 21 bp, Homo sapiens
agaagtttgggctaacattta

SEQ ID NO: 4688092 - DNA, 22 bp, Homo sapiens
agaagtttgggctaacatttag

SEQ ID NO: 4688093 - DNA, 15 bp, Homo sapiens
agaatatattcactt

SEQ ID NO: 4688094 - DNA, 19 bp, Homo sapiens
agaatatcctacttctcca

SEQ ID NO: 4688095 - DNA, 20 bp, Homo sapiens
agaatattcctacttgcagt

SEQ ID NO: 4688096 - DNA, 15 bp, Homo sapiens
agaatccaatactgc

SEQ ID NO: 4688097 - DNA, 14 bp, Homo sapiens
agaatctatcacta

SEQ ID NO: 4688098 - DNA, 15 bp, Homo sapiens
agaatgacctgccct

SEQ ID NO: 4688099 - DNA, 15 bp, Homo sapiens
agaatgcagttgttg

SEQ ID NO: 4688100 - DNA, 19 bp, Homo sapiens
agaatggctatcaaaagaa

SEQ ID NO: 4688101 - DNA, 21 bp, Homo sapiens
agaatggctatcaaaagaaat

SEQ ID NO: 4688102 - DNA, 15 bp, Homo sapiens
agaatggggtgcatg

SEQ ID NO: 4688103 - DNA, 12 bp, Homo sapiens
agaatgttttca

SEQ ID NO: 4688104 - DNA, 21 bp, Homo sapiens
agaattggctgaactcatgag

SEQ ID NO: 4688105 - DNA, 22 bp, Homo sapiens
agacaaatattcctttgcatat

SEQ ID NO: 4688106 - DNA, 19 bp, Homo sapiens
agacaaggaaaaaataaca

SEQ ID NO: 4688107 - DNA, 21 bp, Homo sapiens
agacaatactccctttaaaga

SEQ ID NO: 4688108 - DNA, 13 bp, Homo sapiens
agacacaggcccg

SEQ ID NO: 4688109 - DNA, 16 bp, Homo sapiens
agacacaggcccggct

SEQ ID NO: 4688110 - DNA, 19 bp, Homo sapiens
agacacaggcccggctcca

SEQ ID NO: 4688111 - DNA, 22 bp, Homo sapiens
agacacaggcccggctccaggc

SEQ ID NO: 4688112 - DNA, 22 bp, Homo sapiens
agacacatgtccaagaagccca

SEQ ID NO: 4688113 - DNA, 20 bp, Homo sapiens
agacacatgtggagaaggtg

SEQ ID NO: 4688114 - DNA, 17 bp, Homo sapiens
agacactgttgataaaa

SEQ ID NO: 4688115 - DNA, 21 bp, Homo sapiens
agacagagacctcctgcctcc

SEQ ID NO: 4688116 - DNA, 16 bp, Homo sapiens
agacagaggcagagat

SEQ ID NO: 4688117 - DNA, 15 bp, Homo sapiens
agacagccccctgcc

SEQ ID NO: 4688118 - DNA, 16 bp, Homo sapiens
agacagcccgggctct

SEQ ID NO: 4688119 - DNA, 20 bp, Homo sapiens
agacagcccgggctctgcct

SEQ ID NO: 4688120 - DNA, 14 bp, Homo sapiens
agacagctgcctgg

SEQ ID NO: 4688121 - DNA, 14 bp, Homo sapiens
agacaggaagcctc

SEQ ID NO: 4688122 - DNA, 15 bp, Homo sapiens
agacaggaccaggga

SEQ ID NO: 4688123 - DNA, 16 bp, Homo sapiens
agacaggaccagggat

SEQ ID NO: 4688124 - DNA, 20 bp, Homo sapiens
agacaggcaagcacctcctg

SEQ ID NO: 4688125 - DNA, 22 bp, Homo sapiens
agacaggcaagcacctcctgcc

SEQ ID NO: 4688126 - DNA, 13 bp, Homo sapiens
agacagtccctgc

SEQ ID NO: 4688127 - DNA, 13 bp, Homo sapiens
agacagtttctta

SEQ ID NO: 4688128 - DNA, 20 bp, Homo sapiens
agacagtttcttagcttttt

SEQ ID NO: 4688129 - DNA, 17 bp, Homo sapiens
agacataacgtttttcc

SEQ ID NO: 4688130 - DNA, 16 bp, Homo sapiens
agacatcagcccttgg

SEQ ID NO: 4688131 - DNA, 12 bp, Homo sapiens
agacattttcat

SEQ ID NO: 4688132 - DNA, 13 bp, Homo sapiens
agacattttcatg

SEQ ID NO: 4688133 - DNA, 16 bp, Homo sapiens
agaccaccacctcaga

SEQ ID NO: 4688134 - DNA, 23 bp, Homo sapiens
agaccatccctgaaggccccgcc

SEQ ID NO: 4688135 - DNA, 14 bp, Homo sapiens
agaccatgcattta

SEQ ID NO: 4688136 - DNA, 15 bp, Homo sapiens
actggagagtggcaa

SEQ ID NO: 4688137 - DNA, 19 bp, Homo sapiens
actggatcccaacaccaaa

SEQ ID NO: 4688138 - DNA, 17 bp, Homo sapiens
actggcctcgcctggcc

SEQ ID NO: 4688139 - DNA, 22 bp, Homo sapiens
actggctgcaaagggtatcagg

SEQ ID NO: 4688140 - DNA, 22 bp, Homo sapiens
actggctgcctccactcccact

SEQ ID NO: 4688141 - DNA, 19 bp, Homo sapiens
actggtaaaatacatataa

SEQ ID NO: 4688142 - DNA, 16 bp, Homo sapiens
actggtctaatgtttg

SEQ ID NO: 4688143 - DNA, 16 bp, Homo sapiens
actgtaacgattgaca

SEQ ID NO: 4688144 - DNA, 22 bp, Homo sapiens
actgtaacttccaaataaataa

SEQ ID NO: 4688145 - DNA, 14 bp, Homo sapiens
actgtaatatcttt

SEQ ID NO: 4688146 - DNA, 16 bp, Homo sapiens
actgtaatatctttaa

SEQ ID NO: 4688147 - DNA, 22 bp, Homo sapiens
actgtaatatctttaaatgatg

SEQ ID NO: 4688148 - DNA, 14 bp, Homo sapiens
actgtataaatagg

SEQ ID NO: 4688149 - DNA, 23 bp, Homo sapiens
actgtataaataggagaggatga

SEQ ID NO: 4688150 - DNA, 23 bp, Homo sapiens
actgtcctacccaccctcctttc

SEQ ID NO: 4688151 - DNA, 18 bp, Homo sapiens
actgtcctattatattca

SEQ ID NO: 4688152 - DNA, 10 bp, Homo sapiens
actgtcctgc

SEQ ID NO: 4688153 - DNA, 15 bp, Homo sapiens
actgtctgtagtgtt

SEQ ID NO: 4688154 - DNA, 16 bp, Homo sapiens
actgtctgtagtgttt

SEQ ID NO: 4688155 - DNA, 17 bp, Homo sapiens
actgtctgtagtgtttt

SEQ ID NO: 4688156 - DNA, 11 bp, Homo sapiens
actgtgaatgc

SEQ ID NO: 4688157 - DNA, 16 bp, Homo sapiens
actgtgaatgcttctg

SEQ ID NO: 4688158 - DNA, 18 bp, Homo sapiens
actgtgacaggcagcaga

SEQ ID NO: 4688159 - DNA, 15 bp, Homo sapiens
actgtgcacatctgt

SEQ ID NO: 4688160 - DNA, 19 bp, Homo sapiens
actgtgcacatctgtgtct

SEQ ID NO: 4688161 - DNA, 18 bp, Homo sapiens
actgtgccatgtgccagg

SEQ ID NO: 4688162 - DNA, 15 bp, Homo sapiens
actgtgctggagcca

SEQ ID NO: 4688163 - DNA, 21 bp, Homo sapiens
actgtgctggagccactaact

SEQ ID NO: 4688164 - DNA, 19 bp, Homo sapiens
actgtgtttaatagtatat

SEQ ID NO: 4688165 - DNA, 19 bp, Homo sapiens
actgttaactatgacagat

SEQ ID NO: 4688166 - DNA, 14 bp, Homo sapiens
actgttatttcacc

SEQ ID NO: 4688167 - DNA, 21 bp, Homo sapiens
actgttctctgccctccaaga

SEQ ID NO: 4688168 - DNA, 15 bp, Homo sapiens
actgttgataaaaac

SEQ ID NO: 4688169 - DNA, 10 bp, Homo sapiens
actgttgcac

SEQ ID NO: 4688170 - DNA, 12 bp, Homo sapiens
actgttgcccag

SEQ ID NO: 4688171 - DNA, 17 bp, Homo sapiens
actgttgcccaggctgg

SEQ ID NO: 4688172 - DNA, 21 bp, Homo sapiens
actgttgggtgggtgggccct

SEQ ID NO: 4688173 - DNA, 21 bp, Homo sapiens
actgtttgtcttctccccagg

SEQ ID NO: 4688174 - DNA, 13 bp, Homo sapiens
acttaaacatcat

SEQ ID NO: 4688175 - DNA, 18 bp, Homo sapiens
acttaaacatcattggat

SEQ ID NO: 4688176 - DNA, 24 bp, Homo sapiens
acttactgttgtcctatgggagtc

SEQ ID NO: 4688177 - DNA, 14 bp, Homo sapiens
acttagctgggaga

SEQ ID NO: 4688178 - DNA, 15 bp, Homo sapiens
acttatttatataaa

SEQ ID NO: 4688179 - DNA, 22 bp, Homo sapiens
acttcagaacagtgtttgattt

SEQ ID NO: 4688180 - DNA, 22 bp, Homo sapiens
acttcaggggctgcccgctccc

SEQ ID NO: 4688181 - DNA, 13 bp, Homo sapiens
acttcataaaact

SEQ ID NO: 4688182 - DNA, 21 bp, Homo sapiens
acttccaaatcccctaagcag

SEQ ID NO: 4688183 - DNA, 18 bp, Homo sapiens
acttccccatacaaataa

SEQ ID NO: 4688184 - DNA, 21 bp, Homo sapiens
acttcccctcctacccctccc

SEQ ID NO: 4688185 - DNA, 15 bp, Homo sapiens
acttcctcccctcgc

SEQ ID NO: 4688186 - DNA, 23 bp, Homo sapiens
acttcctcccctcgcccatcagt

SEQ ID NO: 4688187 - DNA, 17 bp, Homo sapiens
acttctatttaatgctt

SEQ ID NO: 4688188 - DNA, 19 bp, Homo sapiens
acttctgccatattctgtt

SEQ ID NO: 4688189 - DNA, 15 bp, Homo sapiens
acttctgtaattgtg

SEQ ID NO: 4688190 - DNA, 16 bp, Homo sapiens
acttctttgctttgcc

SEQ ID NO: 4688191 - DNA, 18 bp, Homo sapiens
acttctttgctttgccca

SEQ ID NO: 4688192 - DNA, 12 bp, Homo sapiens
acttgaaagaaa

SEQ ID NO: 4688193 - DNA, 17 bp, Homo sapiens
acttgcaaaaagggtca

SEQ ID NO: 4688194 - DNA, 22 bp, Homo sapiens
acttgcagactctacagaggcc

SEQ ID NO: 4688195 - DNA, 23 bp, Homo sapiens
acttgcagactctacagaggcca

SEQ ID NO: 4688196 - DNA, 13 bp, Homo sapiens
acttgcagtacat

SEQ ID NO: 4688197 - DNA, 17 bp, Homo sapiens
acttgctggctgtgaaa

SEQ ID NO: 4688198 - DNA, 15 bp, Homo sapiens
acttggagtttgcat

SEQ ID NO: 4688199 - DNA, 13 bp, Homo sapiens
acttggatgagga

SEQ ID NO: 4688200 - DNA, 15 bp, Homo sapiens
acttggatttcattt

SEQ ID NO: 4688201 - DNA, 17 bp, Homo sapiens
acttggctacacaggga

SEQ ID NO: 4688202 - DNA, 17 bp, Homo sapiens
acttgggccatagctcc

SEQ ID NO: 4688203 - DNA, 20 bp, Homo sapiens
acttgtaaaggaatttaaaa

SEQ ID NO: 4688204 - DNA, 22 bp, Homo sapiens
acttgtccaattaatgaagttg

SEQ ID NO: 4688205 - DNA, 18 bp, Homo sapiens
acttgtgaactccatcat

SEQ ID NO: 4688206 - DNA, 15 bp, Homo sapiens
acttgtggacacagc

SEQ ID NO: 4688207 - DNA, 16 bp, Homo sapiens
acttgtggacacagct

SEQ ID NO: 4688208 - DNA, 22 bp, Homo sapiens
acttgtgtccctaatgtgttta

SEQ ID NO: 4688209 - DNA, 14 bp, Homo sapiens
acttgttctgtatt

SEQ ID NO: 4688210 - DNA, 19 bp, Homo sapiens
acttgttgattaatggaaa

SEQ ID NO: 4688211 - DNA, 20 bp, Homo sapiens
acttgttgtttaatgtttaa

SEQ ID NO: 4688212 - DNA, 22 bp, Homo sapiens
actttaaagcaattgcataata

SEQ ID NO: 4688213 - DNA, 15 bp, Homo sapiens
actttaccaccccca

SEQ ID NO: 4688214 - DNA, 22 bp, Homo sapiens
actttattttctataatttaaa

SEQ ID NO: 4688215 - DNA, 18 bp, Homo sapiens
actttcagtgaaagcatc

SEQ ID NO: 4688216 - DNA, 12 bp, Homo sapiens
actttggaaaga

SEQ ID NO: 4688217 - DNA, 17 bp, Homo sapiens
actttggaaagactttt

SEQ ID NO: 4688218 - DNA, 14 bp, Homo sapiens
actttggaaagagt

SEQ ID NO: 4688219 - DNA, 23 bp, Homo sapiens
actttggaaagagtaggaagact

SEQ ID NO: 4688220 - DNA, 13 bp, Homo sapiens
actttggctgcat

SEQ ID NO: 4688221 - DNA, 14 bp, Homo sapiens
actttggctgcatg

SEQ ID NO: 4688222 - DNA, 16 bp, Homo sapiens
actttgtgttcacctt

SEQ ID NO: 4688223 - DNA, 14 bp, Homo sapiens
actttgttctggct

SEQ ID NO: 4688224 - DNA, 17 bp, Homo sapiens
actttgttctggctctt

SEQ ID NO: 4688225 - DNA, 20 bp, Homo sapiens
actttgttctggctcttcca

SEQ ID NO: 4688226 - DNA, 15 bp, Homo sapiens
acttttaaaaatgta

SEQ ID NO: 4688227 - DNA, 12 bp, Homo sapiens
acttttctcaat

SEQ ID NO: 4688228 - DNA, 12 bp, Homo sapiens
acttttgacaaa

SEQ ID NO: 4688229 - DNA, 14 bp, Homo sapiens
actttttaaacagt

SEQ ID NO: 4688230 - DNA, 17 bp, Homo sapiens
actttttaaacagtgtt

SEQ ID NO: 4688231 - DNA, 17 bp, Homo sapiens
actttttgcagctttct

SEQ ID NO: 4688232 - DNA, 18 bp, Homo sapiens
acttttttccaaagtgta

SEQ ID NO: 4688233 - DNA, 15 bp, Homo sapiens
acttttttttaagtt

SEQ ID NO: 4688234 - DNA, 19 bp, Homo sapiens
agaaaaagacctgcatttg

SEQ ID NO: 4688235 - DNA, 20 bp, Homo sapiens
acctgccctgctgagtccca

SEQ ID NO: 4688236 - DNA, 16 bp, Homo sapiens
acctgccctggcccca

SEQ ID NO: 4688237 - DNA, 23 bp, Homo sapiens
acctgcctcccttcatgcatgga

SEQ ID NO: 4688238 - DNA, 15 bp, Homo sapiens
acctgcctgctgcag

SEQ ID NO: 4688239 - DNA, 16 bp, Homo sapiens
acctgcggtgctatct

SEQ ID NO: 4688240 - DNA, 14 bp, Homo sapiens
acctgctctggaca

SEQ ID NO: 4688241 - DNA, 20 bp, Homo sapiens
acctggagagccagaacctg

SEQ ID NO: 4688242 - DNA, 23 bp, Homo sapiens
acctggagagccagaacctggag

SEQ ID NO: 4688243 - DNA, 13 bp, Homo sapiens
acctggagagcta

SEQ ID NO: 4688244 - DNA, 15 bp, Homo sapiens
acctggagggctgga

SEQ ID NO: 4688245 - DNA, 15 bp, Homo sapiens
acctggggctgctgg

SEQ ID NO: 4688246 - DNA, 22 bp, Homo sapiens
acctggggggcagtggtgtgga

SEQ ID NO: 4688247 - DNA, 19 bp, Homo sapiens
acctgggtaaatgcagcgt

SEQ ID NO: 4688248 - DNA, 23 bp, Homo sapiens
acctgtgcttcgggcccttccca

SEQ ID NO: 4688249 - DNA, 10 bp, Homo sapiens
acctgtggat

SEQ ID NO: 4688250 - DNA, 13 bp, Homo sapiens
acctgtggatatt

SEQ ID NO: 4688251 - DNA, 17 bp, Homo sapiens
accttagacagtccctg

SEQ ID NO: 4688252 - DNA, 23 bp, Homo sapiens
actcagtttcatatattattccg

SEQ ID NO: 4688253 - DNA, 19 bp, Homo sapiens
actcatactgtgctggagc

SEQ ID NO: 4688254 - DNA, 20 bp, Homo sapiens
actcatactgtgctggagcc

SEQ ID NO: 4688255 - DNA, 23 bp, Homo sapiens
actcatactgtgctggagccact

SEQ ID NO: 4688256 - DNA, 19 bp, Homo sapiens
actcatccctaatgctgca

SEQ ID NO: 4688257 - DNA, 23 bp, Homo sapiens
actcatgactgagtctggcaaac

SEQ ID NO: 4688258 - DNA, 14 bp, Homo sapiens
actcattaattcaa

SEQ ID NO: 4688259 - DNA, 13 bp, Homo sapiens
actcattccttct

SEQ ID NO: 4688260 - DNA, 15 bp, Homo sapiens
actcattctgaagga

SEQ ID NO: 4688261 - DNA, 14 bp, Homo sapiens
actcattgacctga

SEQ ID NO: 4688262 - DNA, 18 bp, Homo sapiens
actcattgacctgaggcc

SEQ ID NO: 4688263 - DNA, 19 bp, Homo sapiens
actccaaggtttataaagc

SEQ ID NO: 4688264 - DNA, 20 bp, Homo sapiens
actccaaggtttataaagca

SEQ ID NO: 4688265 - DNA, 21 bp, Homo sapiens
actccaaggtttataaagcag

SEQ ID NO: 4688266 - DNA, 23 bp, Homo sapiens
actccaaggtttataaagcagat

SEQ ID NO: 4688267 - DNA, 14 bp, Homo sapiens
actccacataagtc

SEQ ID NO: 4688268 - DNA, 13 bp, Homo sapiens
actccacctcaaa

SEQ ID NO: 4688269 - DNA, 19 bp, Homo sapiens
actccatcagttagagctg

SEQ ID NO: 4688270 - DNA, 14 bp, Homo sapiens
actcccacttccct

SEQ ID NO: 4688271 - DNA, 13 bp, Homo sapiens
actcccaggcagc

SEQ ID NO: 4688272 - DNA, 17 bp, Homo sapiens
actcccctgctgggtgt

SEQ ID NO: 4688273 - DNA, 23 bp, Homo sapiens
actcccttcccatgacccaggct

SEQ ID NO: 4688274 - DNA, 14 bp, Homo sapiens
actcccttgggctc

SEQ ID NO: 4688275 - DNA, 18 bp, Homo sapiens
actcctacacctaactca

SEQ ID NO: 4688276 - DNA, 14 bp, Homo sapiens
actcctactgcttc

SEQ ID NO: 4688277 - DNA, 20 bp, Homo sapiens
actcctaggcaggacatgct

SEQ ID NO: 4688278 - DNA, 21 bp, Homo sapiens
actcctaggcaggacatgctg

SEQ ID NO: 4688279 - DNA, 19 bp, Homo sapiens
actcctcagggttgaggtc

SEQ ID NO: 4688280 - DNA, 19 bp, Homo sapiens
actcctgaagtgagtttta

SEQ ID NO: 4688281 - DNA, 23 bp, Homo sapiens
actcctgaagtgagttttacacg

SEQ ID NO: 4688282 - DNA, 15 bp, Homo sapiens
actcctgcaggcagc

SEQ ID NO: 4688283 - DNA, 17 bp, Homo sapiens
actcctgcaggcagcca

SEQ ID NO: 4688284 - DNA, 21 bp, Homo sapiens
actcctgcaggcagccaggcc

SEQ ID NO: 4688285 - DNA, 12 bp, Homo sapiens
actcctggcctc

SEQ ID NO: 4688286 - DNA, 22 bp, Homo sapiens
actccttctgccagttccctcc

SEQ ID NO: 4688287 - DNA, 17 bp, Homo sapiens
actccttgagagaccag

SEQ ID NO: 4688288 - DNA, 21 bp, Homo sapiens
actccttgagagaccaggcaa

SEQ ID NO: 4688289 - DNA, 23 bp, Homo sapiens
actccttgagagaccaggcaaag

SEQ ID NO: 4688290 - DNA, 16 bp, Homo sapiens
actcctttttattcat

SEQ ID NO: 4688291 - DNA, 14 bp, Homo sapiens
actcgggctcctgt

SEQ ID NO: 4688292 - DNA, 17 bp, Homo sapiens
actcgggctcctgtgcc

SEQ ID NO: 4688293 - DNA, 16 bp, Homo sapiens
actctcagtctctgag

SEQ ID NO: 4688294 - DNA, 18 bp, Homo sapiens
actctcagtctctgagca

SEQ ID NO: 4688295 - DNA, 14 bp, Homo sapiens
actctcctctgcct

SEQ ID NO: 4688296 - DNA, 17 bp, Homo sapiens
actctcctctgctgctg

SEQ ID NO: 4688297 - DNA, 13 bp, Homo sapiens
actctgcttgtta

SEQ ID NO: 4688298 - DNA, 15 bp, Homo sapiens
actctggacctctct

SEQ ID NO: 4688299 - DNA, 15 bp, Homo sapiens
actctggattttgaa

SEQ ID NO: 4688300 - DNA, 16 bp, Homo sapiens
actctggattttgaat

SEQ ID NO: 4688301 - DNA, 18 bp, Homo sapiens
actctggattttgaatta

SEQ ID NO: 4688302 - DNA, 13 bp, Homo sapiens
actctggcagctc

SEQ ID NO: 4688303 - DNA, 15 bp, Homo sapiens
actctggcagctcag

SEQ ID NO: 4688304 - DNA, 17 bp, Homo sapiens
actctggcagctcagag

SEQ ID NO: 4688305 - DNA, 19 bp, Homo sapiens
actctgtcgcccagtctgg

SEQ ID NO: 4688306 - DNA, 12 bp, Homo sapiens
actctgtgccca

SEQ ID NO: 4688307 - DNA, 18 bp, Homo sapiens
actctgtgcccatgggca

SEQ ID NO: 4688308 - DNA, 20 bp, Homo sapiens
actctgtgcctgaccttgag

SEQ ID NO: 4688309 - DNA, 16 bp, Homo sapiens
actctgtgtcaggtgg

SEQ ID NO: 4688310 - DNA, 15 bp, Homo sapiens
actctgtgtgtgtat

SEQ ID NO: 4688311 - DNA, 15 bp, Homo sapiens
actctgtttgcttgt

SEQ ID NO: 4688312 - DNA, 23 bp, Homo sapiens
actcttaccatcccggtgcatgc

SEQ ID NO: 4688313 - DNA, 12 bp, Homo sapiens
actcttatctca

SEQ ID NO: 4688314 - DNA, 13 bp, Homo sapiens
actctttcaaaac

SEQ ID NO: 4688315 - DNA, 18 bp, Homo sapiens
actctttgagaaacaaca

SEQ ID NO: 4688316 - DNA, 16 bp, Homo sapiens
actctttttgtacctg

SEQ ID NO: 4688317 - DNA, 17 bp, Homo sapiens
actgaaatgagcatgca

SEQ ID NO: 4688318 - DNA, 16 bp, Homo sapiens
actgaaattattttct

SEQ ID NO: 4688319 - DNA, 13 bp, Homo sapiens
actgaacattcca

SEQ ID NO: 4688320 - DNA, 19 bp, Homo sapiens
actgaactttgctgagcct

SEQ ID NO: 4688321 - DNA, 16 bp, Homo sapiens
actgaagatattccaa

SEQ ID NO: 4688322 - DNA, 14 bp, Homo sapiens
actgaatacttgaa

SEQ ID NO: 4688323 - DNA, 12 bp, Homo sapiens
actgaatgtaag

SEQ ID NO: 4688324 - DNA, 17 bp, Homo sapiens
actgacattgttggcca

SEQ ID NO: 4688325 - DNA, 18 bp, Homo sapiens
actgacattgttggccaa

SEQ ID NO: 4688326 - DNA, 22 bp, Homo sapiens
actgaccaatattgtacagttt

SEQ ID NO: 4688327 - DNA, 20 bp, Homo sapiens
actgagaatgtaagaactac

SEQ ID NO: 4688328 - DNA, 18 bp, Homo sapiens
actgagataccagcgagg

SEQ ID NO: 4688329 - DNA, 14 bp, Homo sapiens
actgagccatcatt

SEQ ID NO: 4688330 - DNA, 15 bp, Homo sapiens
actgagccatcattt

SEQ ID NO: 4688331 - DNA, 19 bp, Homo sapiens
actgagccatcatttcctg

SEQ ID NO: 4688332 - DNA, 13 bp, Homo sapiens
actgaggaagaac

SEQ ID NO: 4688333 - DNA, 23 bp, Homo sapiens
actgagggcagtcgatagagctg

SEQ ID NO: 4688334 - DNA, 12 bp, Homo sapiens
actgatttcaga

SEQ ID NO: 4688335 - DNA, 22 bp, Homo sapiens
actgcaaaaagaaaatctttat

SEQ ID NO: 4688336 - DNA, 20 bp, Homo sapiens
actgcaaccttcgccacctg

SEQ ID NO: 4688337 - DNA, 14 bp, Homo sapiens
actgcaacttgtga

SEQ ID NO: 4688338 - DNA, 18 bp, Homo sapiens
actgcaacttgtgaactc

SEQ ID NO: 4688339 - DNA, 19 bp, Homo sapiens
actgcaccccctcctgctg

SEQ ID NO: 4688340 - DNA, 21 bp, Homo sapiens
actgcagcctcaacctcctgg

SEQ ID NO: 4688341 - DNA, 23 bp, Homo sapiens
actgcatcctccgcctcccgggt

SEQ ID NO: 4688342 - DNA, 19 bp, Homo sapiens
actgcattttgtagcctct

SEQ ID NO: 4688343 - DNA, 17 bp, Homo sapiens
actgccccctctgccct

SEQ ID NO: 4688344 - DNA, 16 bp, Homo sapiens
actgccgtaatttaac

SEQ ID NO: 4688345 - DNA, 17 bp, Homo sapiens
actgcctgatggacctg

SEQ ID NO: 4688346 - DNA, 11 bp, Homo sapiens
actgcctttga

SEQ ID NO: 4688347 - DNA, 16 bp, Homo sapiens
actgcggggcttggct

SEQ ID NO: 4688348 - DNA, 20 bp, Homo sapiens
agggcagtcgatagagctgt

SEQ ID NO: 4688349 - DNA, 14 bp, Homo sapiens
agggcataaagtaa

SEQ ID NO: 4688350 - DNA, 15 bp, Homo sapiens
agggcataaagtaaa

SEQ ID NO: 4688351 - DNA, 20 bp, Homo sapiens
agggcataaagtaaatacat

SEQ ID NO: 4688352 - DNA, 19 bp, Homo sapiens
agggcatgggtcgggagag

SEQ ID NO: 4688353 - DNA, 23 bp, Homo sapiens
agggcccagagagggtggtgacc

SEQ ID NO: 4688354 - DNA, 15 bp, Homo sapiens
agggcctgcaaggga

SEQ ID NO: 4688355 - DNA, 12 bp, Homo sapiens
agggcctggcct

SEQ ID NO: 4688356 - DNA, 18 bp, Homo sapiens
agggcctggcctgagctg

SEQ ID NO: 4688357 - DNA, 18 bp, Homo sapiens
agggcctggctcaggtgg

SEQ ID NO: 4688358 - DNA, 14 bp, Homo sapiens
agggcgcaaagggc

SEQ ID NO: 4688359 - DNA, 17 bp, Homo sapiens
agggcgcaaagggcatg

SEQ ID NO: 4688360 - DNA, 18 bp, Homo sapiens
agggcgcaaagggcatgg

SEQ ID NO: 4688361 - DNA, 16 bp, Homo sapiens
agggctagaacctgga

SEQ ID NO: 4688362 - DNA, 17 bp, Homo sapiens
agggctagaacctggaa

SEQ ID NO: 4688363 - DNA, 22 bp, Homo sapiens
agggctagaacctggaagggct

SEQ ID NO: 4688364 - DNA, 21 bp, Homo sapiens
agggctagaacctggaggggc

SEQ ID NO: 4688365 - DNA, 18 bp, Homo sapiens
agggctagtagaactgga

SEQ ID NO: 4688366 - DNA, 20 bp, Homo sapiens
agggctcagcggggacagct

SEQ ID NO: 4688367 - DNA, 23 bp, Homo sapiens
agggctcagcggggacagctcct

SEQ ID NO: 4688368 - DNA, 13 bp, Homo sapiens
agggctgctgtga

SEQ ID NO: 4688369 - DNA, 22 bp, Homo sapiens
agggctggaatctggagagcta

SEQ ID NO: 4688370 - DNA, 15 bp, Homo sapiens
agggctggactgagg

SEQ ID NO: 4688371 - DNA, 17 bp, Homo sapiens
agggctggactgaggcc

SEQ ID NO: 4688372 - DNA, 20 bp, Homo sapiens
agggctggactgaggcctga

SEQ ID NO: 4688373 - DNA, 14 bp, Homo sapiens
aggggaacagactg

SEQ ID NO: 4688374 - DNA, 20 bp, Homo sapiens
aggggaatgtttgcctctgc

SEQ ID NO: 4688375 - DNA, 21 bp, Homo sapiens
aggggaatgtttgcctctgcc

SEQ ID NO: 4688376 - DNA, 15 bp, Homo sapiens
aggggacgcaggccc

SEQ ID NO: 4688377 - DNA, 19 bp, Homo sapiens
aggggacgcaggcccctct

SEQ ID NO: 4688378 - DNA, 24 bp, Homo sapiens
aggggacgcaggcccctctcctcc

SEQ ID NO: 4688379 - DNA, 14 bp, Homo sapiens
aggggcaggcacag

SEQ ID NO: 4688380 - DNA, 23 bp, Homo sapiens
aggggcaggccctgcactgtcct

SEQ ID NO: 4688381 - DNA, 15 bp, Homo sapiens
aggggcccgcttgcc

SEQ ID NO: 4688382 - DNA, 19 bp, Homo sapiens
aggggcccgcttgcctcgg

SEQ ID NO: 4688383 - DNA, 19 bp, Homo sapiens
aggggcctcttatgggctg

SEQ ID NO: 4688384 - DNA, 19 bp, Homo sapiens
aggggcctgccacctggac

SEQ ID NO: 4688385 - DNA, 21 bp, Homo sapiens
aggggcctgccacctggaccc

SEQ ID NO: 4688386 - DNA, 12 bp, Homo sapiens
aggggcctgcct

SEQ ID NO: 4688387 - DNA, 19 bp, Homo sapiens
aggggctgcccgctcccag

SEQ ID NO: 4688388 - DNA, 14 bp, Homo sapiens
agggggaagtgaga

SEQ ID NO: 4688389 - DNA, 13 bp, Homo sapiens
agggggctggagg

SEQ ID NO: 4688390 - DNA, 19 bp, Homo sapiens
agggggctggaggagccca

SEQ ID NO: 4688391 - DNA, 15 bp, Homo sapiens
agggggtggcctccc

SEQ ID NO: 4688392 - DNA, 20 bp, Homo sapiens
agggggtggcctcccaactc

SEQ ID NO: 4688393 - DNA, 20 bp, Homo sapiens
aggggtggccgtcctgaggg

SEQ ID NO: 4688394 - DNA, 24 bp, Homo sapiens
aggggttcccttttttggctgctg

SEQ ID NO: 4688395 - DNA, 14 bp, Homo sapiens
aggggttgaagaaa

SEQ ID NO: 4688396 - DNA, 22 bp, Homo sapiens
aggggttttaggtctcttcccc

SEQ ID NO: 4688397 - DNA, 12 bp, Homo sapiens
agggtagggtgg

SEQ ID NO: 4688398 - DNA, 18 bp, Homo sapiens
agggtatcaaataaaatt

SEQ ID NO: 4688399 - DNA, 19 bp, Homo sapiens
agggtatcaggtgctgcca

SEQ ID NO: 4688400 - DNA, 21 bp, Homo sapiens
agggtcagacgcctgaggaac

SEQ ID NO: 4688401 - DNA, 12 bp, Homo sapiens
agggtcatttct

SEQ ID NO: 4688402 - DNA, 14 bp, Homo sapiens
agggtccctgacct

SEQ ID NO: 4688403 - DNA, 15 bp, Homo sapiens
agggtcggtgccttc

SEQ ID NO: 4688404 - DNA, 15 bp, Homo sapiens
agggtctcactctgt

SEQ ID NO: 4688405 - DNA, 21 bp, Homo sapiens
agggtctcactctgtcgccca

SEQ ID NO: 4688406 - DNA, 14 bp, Homo sapiens
agggtctctgctgc

SEQ ID NO: 4688407 - DNA, 14 bp, Homo sapiens
agggtctttgcaga

SEQ ID NO: 4688408 - DNA, 15 bp, Homo sapiens
agggtgagacactgc

SEQ ID NO: 4688409 - DNA, 22 bp, Homo sapiens
agggtgctacgtacatgtgagg

SEQ ID NO: 4688410 - DNA, 16 bp, Homo sapiens
agggtggtgacctctg

SEQ ID NO: 4688411 - DNA, 21 bp, Homo sapiens
agggtggtgacctctgcctga

SEQ ID NO: 4688412 - DNA, 17 bp, Homo sapiens
agggtggtggagccagt

SEQ ID NO: 4688413 - DNA, 20 bp, Homo sapiens
agggtgtgtgttcaccttca

SEQ ID NO: 4688414 - DNA, 23 bp, Homo sapiens
agggttcatcatccctccctgcc

SEQ ID NO: 4688415 - DNA, 17 bp, Homo sapiens
agggttgaccccagagg

SEQ ID NO: 4688416 - DNA, 23 bp, Homo sapiens
agggttggcccctgcccggctgc

SEQ ID NO: 4688417 - DNA, 13 bp, Homo sapiens
agggttgggctgg

SEQ ID NO: 4688418 - DNA, 15 bp, Homo sapiens
agggttgggctggtg

SEQ ID NO: 4688419 - DNA, 15 bp, Homo sapiens
agggtttggcccaag

SEQ ID NO: 4688420 - DNA, 15 bp, Homo sapiens
aggtaaaggatgagg

SEQ ID NO: 4688421 - DNA, 14 bp, Homo sapiens
aggtaacagaacag

SEQ ID NO: 4688422 - DNA, 15 bp, Homo sapiens
aggtaacagaacagc

SEQ ID NO: 4688423 - DNA, 22 bp, Homo sapiens
aggtaacagaacagcttcaggt

SEQ ID NO: 4688424 - DNA, 16 bp, Homo sapiens
aggtaacaggcagata

SEQ ID NO: 4688425 - DNA, 17 bp, Homo sapiens
aggtaatcgacctgcct

SEQ ID NO: 4688426 - DNA, 19 bp, Homo sapiens
aggtaatcgacctgcctcg

SEQ ID NO: 4688427 - DNA, 17 bp, Homo sapiens
aggtagaatgttttcaa

SEQ ID NO: 4688428 - DNA, 13 bp, Homo sapiens
aggtagcacagtg

SEQ ID NO: 4688429 - DNA, 19 bp, Homo sapiens
aggtatatgttttataatt

SEQ ID NO: 4688430 - DNA, 22 bp, Homo sapiens
aggtatccaatgtcgctgtaaa

SEQ ID NO: 4688431 - DNA, 20 bp, Homo sapiens
aggtatttttccaatcacag

SEQ ID NO: 4688432 - DNA, 12 bp, Homo sapiens
aggtcagagcct

SEQ ID NO: 4688433 - DNA, 13 bp, Homo sapiens
aggtcagagcctg

SEQ ID NO: 4688434 - DNA, 14 bp, Homo sapiens
aggtcagagcctgc

SEQ ID NO: 4688435 - DNA, 17 bp, Homo sapiens
aggtcagagcctgcagt

SEQ ID NO: 4688436 - DNA, 17 bp, Homo sapiens
aggtccacaacacacag

SEQ ID NO: 4688437 - DNA, 19 bp, Homo sapiens
aggtccacaacacacagat

SEQ ID NO: 4688438 - DNA, 17 bp, Homo sapiens
aggtccagccctggctg

SEQ ID NO: 4688439 - DNA, 20 bp, Homo sapiens
aggtccagccctggctgaag

SEQ ID NO: 4688440 - DNA, 15 bp, Homo sapiens
aggtctccatgaaga

SEQ ID NO: 4688441 - DNA, 17 bp, Homo sapiens
agtcaccccggccacct

SEQ ID NO: 4688442 - DNA, 15 bp, Homo sapiens
agtcactgagacagc

SEQ ID NO: 4688443 - DNA, 17 bp, Homo sapiens
agtcactgagacagccc

SEQ ID NO: 4688444 - DNA, 23 bp, Homo sapiens
agtcactggtctgtttgcatttg

SEQ ID NO: 4688445 - DNA, 19 bp, Homo sapiens
agtcaggggttcccttttt

SEQ ID NO: 4688446 - DNA, 14 bp, Homo sapiens
agtcataccaatga

SEQ ID NO: 4688447 - DNA, 18 bp, Homo sapiens
agtcatgcaaaggctggg

SEQ ID NO: 4688448 - DNA, 19 bp, Homo sapiens
agtcatgcataaatatgca

SEQ ID NO: 4688449 - DNA, 18 bp, Homo sapiens
agtcattatgttaatatt

SEQ ID NO: 4688450 - DNA, 17 bp, Homo sapiens
agtcattgtaacctcgt

SEQ ID NO: 4688451 - DNA, 23 bp, Homo sapiens
agtccaaggaaaccacagctgct

SEQ ID NO: 4688452 - DNA, 15 bp, Homo sapiens
agtcccaccttggct

SEQ ID NO: 4688453 - DNA, 16 bp, Homo sapiens
agtcccaccttggctg

SEQ ID NO: 4688454 - DNA, 21 bp, Homo sapiens
agtcccaccttggctgcaggg

SEQ ID NO: 4688455 - DNA, 20 bp, Homo sapiens
agtcccaggctgagcctcag

SEQ ID NO: 4688456 - DNA, 16 bp, Homo sapiens
agtccctgccaatgga

SEQ ID NO: 4688457 - DNA, 23 bp, Homo sapiens
agtccgaaagggacttggaagct

SEQ ID NO: 4688458 - DNA, 16 bp, Homo sapiens
agtcctcccatctcac

SEQ ID NO: 4688459 - DNA, 19 bp, Homo sapiens
agtcctcttttctgagagg

SEQ ID NO: 4688460 - DNA, 13 bp, Homo sapiens
aggacaaacagtg

SEQ ID NO: 4688461 - DNA, 16 bp, Homo sapiens
aggacaagaccctctc

SEQ ID NO: 4688462 - DNA, 19 bp, Homo sapiens
aggacactaaccacgctgg

SEQ ID NO: 4688463 - DNA, 22 bp, Homo sapiens
aggacagggaggtgaccccagg

SEQ ID NO: 4688464 - DNA, 17 bp, Homo sapiens
aggacatgctgaagcca

SEQ ID NO: 4688465 - DNA, 17 bp, Homo sapiens
aggaccaagggcagagg

SEQ ID NO: 4688466 - DNA, 13 bp, Homo sapiens
aggaccaggcaat

SEQ ID NO: 4688467 - DNA, 22 bp, Homo sapiens
aggacccgccggatgacagcca

SEQ ID NO: 4688468 - DNA, 21 bp, Homo sapiens
aggacctgtggccaagttctt

SEQ ID NO: 4688469 - DNA, 13 bp, Homo sapiens
aggactcagctcc

SEQ ID NO: 4688470 - DNA, 13 bp, Homo sapiens
aggactctgcagc

SEQ ID NO: 4688471 - DNA, 11 bp, Homo sapiens
aggactgggcc

SEQ ID NO: 4688472 - DNA, 22 bp, Homo sapiens
aggactgtgacaggcagcagag

SEQ ID NO: 4688473 - DNA, 13 bp, Homo sapiens
aggacttgaaaga

SEQ ID NO: 4688474 - DNA, 14 bp, Homo sapiens
aggactttttctta

SEQ ID NO: 4688475 - DNA, 15 bp, Homo sapiens
aggagaattaaactc

SEQ ID NO: 4688476 - DNA, 11 bp, Homo sapiens
aggagacacaa

SEQ ID NO: 4688477 - DNA, 19 bp, Homo sapiens
aggagacacaacaactcct

SEQ ID NO: 4688478 - DNA, 14 bp, Homo sapiens
aggagacaggaagc

SEQ ID NO: 4688479 - DNA, 12 bp, Homo sapiens
aggagataaatc

SEQ ID NO: 4688480 - DNA, 16 bp, Homo sapiens
aggagatgctccttgg

SEQ ID NO: 4688481 - DNA, 22 bp, Homo sapiens
aggagatgctccttgggccctt

SEQ ID NO: 4688482 - DNA, 13 bp, Homo sapiens
aggagcagccaca

SEQ ID NO: 4688483 - DNA, 14 bp, Homo sapiens
aggagcagccacat

SEQ ID NO: 4688484 - DNA, 16 bp, Homo sapiens
aggagcagcctcagaa

SEQ ID NO: 4688485 - DNA, 19 bp, Homo sapiens
aggagcagcctcagaacaa

SEQ ID NO: 4688486 - DNA, 14 bp, Homo sapiens
aggagcagtgcagg

SEQ ID NO: 4688487 - DNA, 20 bp, Homo sapiens
aggagcatccacctccttct

SEQ ID NO: 4688488 - DNA, 10 bp, Homo sapiens
aggagcccag

SEQ ID NO: 4688489 - DNA, 14 bp, Homo sapiens
aggagcccaggcca

SEQ ID NO: 4688490 - DNA, 15 bp, Homo sapiens
aggagcccaggccag

SEQ ID NO: 4688491 - DNA, 22 bp, Homo sapiens
aggagcccaggccaggactctg

SEQ ID NO: 4688492 - DNA, 16 bp, Homo sapiens
aggagccccattcctg

SEQ ID NO: 4688493 - DNA, 18 bp, Homo sapiens
aggagccccattcctggg

SEQ ID NO: 4688494 - DNA, 21 bp, Homo sapiens
aggagccggacacttctcagg

SEQ ID NO: 4688495 - DNA, 23 bp, Homo sapiens
aggagccggacacttctcaggaa

SEQ ID NO: 4688496 - DNA, 14 bp, Homo sapiens
aggagctgcctgga

SEQ ID NO: 4688497 - DNA, 13 bp, Homo sapiens
aggagctgttact

SEQ ID NO: 4688498 - DNA, 23 bp, Homo sapiens
aggaggagggtcggtgccttcaa

SEQ ID NO: 4688499 - DNA, 21 bp, Homo sapiens
aggaggcacaagccaaggaag

SEQ ID NO: 4688500 - DNA, 14 bp, Homo sapiens
aggagggcagcaga

SEQ ID NO: 4688501 - DNA, 21 bp, Homo sapiens
aggaggggtctggacatgtgg

SEQ ID NO: 4688502 - DNA, 15 bp, Homo sapiens
aggaggtgccaacag

SEQ ID NO: 4688503 - DNA, 16 bp, Homo sapiens
aggaggtgccaacagt

SEQ ID NO: 4688504 - DNA, 18 bp, Homo sapiens
aggagtacaggtgaagca

SEQ ID NO: 4688505 - DNA, 12 bp, Homo sapiens
aggagtgagcac

SEQ ID NO: 4688506 - DNA, 18 bp, Homo sapiens
aggagtggaggaggcctg

SEQ ID NO: 4688507 - DNA, 18 bp, Homo sapiens
aggagtgggttgatttca

SEQ ID NO: 4688508 - DNA, 21 bp, Homo sapiens
aggagtggttgggctgtgcct

SEQ ID NO: 4688509 - DNA, 22 bp, Homo sapiens
aggagtggttgggctgtgcctg

SEQ ID NO: 4688510 - DNA, 15 bp, Homo sapiens
aggagttccagtgct

SEQ ID NO: 4688511 - DNA, 13 bp, Homo sapiens
aggatcagtctga

SEQ ID NO: 4688512 - DNA, 15 bp, Homo sapiens
aggatcatggtgtaa

SEQ ID NO: 4688513 - DNA, 15 bp, Homo sapiens
aggatccctctctgg

SEQ ID NO: 4688514 - DNA, 16 bp, Homo sapiens
aggatccctctctgga

SEQ ID NO: 4688515 - DNA, 17 bp, Homo sapiens
aggatccctctctggat

SEQ ID NO: 4688516 - DNA, 13 bp, Homo sapiens
aggatgagagccc

SEQ ID NO: 4688517 - DNA, 19 bp, Homo sapiens
aggatgagagcccagaggt

SEQ ID NO: 4688518 - DNA, 20 bp, Homo sapiens
aggatgagagcccagaggta

SEQ ID NO: 4688519 - DNA, 23 bp, Homo sapiens
aggatgatgtctttttattaaaa

SEQ ID NO: 4688520 - DNA, 17 bp, Homo sapiens
aggatgccccgtccccc

SEQ ID NO: 4688521 - DNA, 22 bp, Homo sapiens
aggatggcctggccagggcctg

SEQ ID NO: 4688522 - DNA, 11 bp, Homo sapiens
aggatgtaaag

SEQ ID NO: 4688523 - DNA, 14 bp, Homo sapiens
aggattaaataatg

SEQ ID NO: 4688524 - DNA, 17 bp, Homo sapiens
aggattgctactgtcct

SEQ ID NO: 4688525 - DNA, 17 bp, Homo sapiens
aggcaagcacctcctgc

SEQ ID NO: 4688526 - DNA, 19 bp, Homo sapiens
aggcaagcacctcctgcct

SEQ ID NO: 4688527 - DNA, 20 bp, Homo sapiens
aggcacccaccatcatgtct

SEQ ID NO: 4688528 - DNA, 21 bp, Homo sapiens
aggcacccaccatcatgtctg

SEQ ID NO: 4688529 - DNA, 22 bp, Homo sapiens
aggcacccaccatcatgtctgg

SEQ ID NO: 4688530 - DNA, 13 bp, Homo sapiens
aggcactgccctg

SEQ ID NO: 4688531 - DNA, 15 bp, Homo sapiens
aggcactgccctggt

SEQ ID NO: 4688532 - DNA, 22 bp, Homo sapiens
aggcacttcctcccctcgccca

SEQ ID NO: 4688533 - DNA, 22 bp, Homo sapiens
aggcagcagtgtgaggccaggg

SEQ ID NO: 4688534 - DNA, 15 bp, Homo sapiens
aggcagccaggccac

SEQ ID NO: 4688535 - DNA, 17 bp, Homo sapiens
aggcagccccattctgc

SEQ ID NO: 4688536 - DNA, 20 bp, Homo sapiens
aggcagccccattctgcctg

SEQ ID NO: 4688537 - DNA, 22 bp, Homo sapiens
aggcagccccattctgcctgcc

SEQ ID NO: 4688538 - DNA, 15 bp, Homo sapiens
aggcaggaacataca

SEQ ID NO: 4688539 - DNA, 18 bp, Homo sapiens
aggcaggctaaggcgtgg

SEQ ID NO: 4688540 - DNA, 23 bp, Homo sapiens
aggcagggaacatggggaggagg

SEQ ID NO: 4688541 - DNA, 18 bp, Homo sapiens
aggcagggtctcactctg

SEQ ID NO: 4688542 - DNA, 18 bp, Homo sapiens
aggcagtgggtcccactt

SEQ ID NO: 4688543 - DNA, 19 bp, Homo sapiens
aggcagtgggtcccacttc

SEQ ID NO: 4688544 - DNA, 14 bp, Homo sapiens
aggcatcacagcta

SEQ ID NO: 4688545 - DNA, 22 bp, Homo sapiens
aggcatggctggtgcctgaaga

SEQ ID NO: 4688546 - DNA, 17 bp, Homo sapiens
aggcatgtgtgaaacat

SEQ ID NO: 4688547 - DNA, 12 bp, Homo sapiens
aggcatgttctc

SEQ ID NO: 4688548 - DNA, 17 bp, Homo sapiens
aggcatgttctctgagg

SEQ ID NO: 4688549 - DNA, 14 bp, Homo sapiens
aggcattgccaagg

SEQ ID NO: 4688550 - DNA, 20 bp, Homo sapiens
aggccaaggcgggtggatca

SEQ ID NO: 4688551 - DNA, 20 bp, Homo sapiens
aggccacaagacccttgtgg

SEQ ID NO: 4688552 - DNA, 23 bp, Homo sapiens
aggccacgtgatgtggagggcac

SEQ ID NO: 4688553 - DNA, 15 bp, Homo sapiens
aggccagccttgacc

SEQ ID NO: 4688554 - DNA, 15 bp, Homo sapiens
aggccaggactctgc

SEQ ID NO: 4688555 - DNA, 18 bp, Homo sapiens
aggccaggactctgcagc

SEQ ID NO: 4688556 - DNA, 19 bp, Homo sapiens
aggccaggactctgcagcc

SEQ ID NO: 4688557 - DNA, 20 bp, Homo sapiens
aggccaggactctgcagcct

SEQ ID NO: 4688558 - DNA, 23 bp, Homo sapiens
aggccaggactctgcagcctcag

SEQ ID NO: 4688559 - DNA, 15 bp, Homo sapiens
aggccatcttccagg

SEQ ID NO: 4688560 - DNA, 18 bp, Homo sapiens
aggccatcttccaggtgg

SEQ ID NO: 4688561 - DNA, 16 bp, Homo sapiens
aggccatggagagctg

SEQ ID NO: 4688562 - DNA, 17 bp, Homo sapiens
aggccatggagagctgg

SEQ ID NO: 4688563 - DNA, 21 bp, Homo sapiens
agagggagggagggctccaga

SEQ ID NO: 4688564 - DNA, 20 bp, Homo sapiens
agagggagtgacagaggcag

SEQ ID NO: 4688565 - DNA, 18 bp, Homo sapiens
agagggccctgcctgctg

SEQ ID NO: 4688566 - DNA, 13 bp, Homo sapiens
agagggcctgcaa

SEQ ID NO: 4688567 - DNA, 16 bp, Homo sapiens
agagggcctgcaaggg

SEQ ID NO: 4688568 - DNA, 21 bp, Homo sapiens
agctcaggtgtccctgcactt

SEQ ID NO: 4688569 - DNA, 18 bp, Homo sapiens
agctccagctcaccagcc

SEQ ID NO: 4688570 - DNA, 12 bp, Homo sapiens
agctcccaagag

SEQ ID NO: 4688571 - DNA, 13 bp, Homo sapiens
agctcccaggcat

SEQ ID NO: 4688572 - DNA, 13 bp, Homo sapiens
agctcccctcctc

SEQ ID NO: 4688573 - DNA, 21 bp, Homo sapiens
agctccgctttctacccagcg

SEQ ID NO: 4688574 - DNA, 23 bp, Homo sapiens
agctcctgctccacagccatccc

SEQ ID NO: 4688575 - DNA, 19 bp, Homo sapiens
agctccttcctggagactg

SEQ ID NO: 4688576 - DNA, 21 bp, Homo sapiens
agctccttctgtcctactctg

SEQ ID NO: 4688577 - DNA, 18 bp, Homo sapiens
agctctatctgcaatgtt

SEQ ID NO: 4688578 - DNA, 17 bp, Homo sapiens
agctctcagttgcagcc

SEQ ID NO: 4688579 - DNA, 19 bp, Homo sapiens
agctctgaaaccagtgtta

SEQ ID NO: 4688580 - DNA, 21 bp, Homo sapiens
agctctgacccacagcctcca

SEQ ID NO: 4688581 - DNA, 14 bp, Homo sapiens
agctctgagctgtc

SEQ ID NO: 4688582 - DNA, 12 bp, Homo sapiens
agctctgctcct

SEQ ID NO: 4688583 - DNA, 12 bp, Homo sapiens
agctctgtcctg

SEQ ID NO: 4688584 - DNA, 18 bp, Homo sapiens
agctcttctccaggctgt

SEQ ID NO: 4688585 - DNA, 19 bp, Homo sapiens
agctgacacaaacctgcct

SEQ ID NO: 4688586 - DNA, 21 bp, Homo sapiens
agctgacacaaacctgcctgg

SEQ ID NO: 4688587 - DNA, 23 bp, Homo sapiens
agctgacacaaacctgcctgggt

SEQ ID NO: 4688588 - DNA, 13 bp, Homo sapiens
agctgacagtcct

SEQ ID NO: 4688589 - DNA, 15 bp, Homo sapiens
agctgaccccctccc

SEQ ID NO: 4688590 - DNA, 15 bp, Homo sapiens
agctgagaccggtgg

SEQ ID NO: 4688591 - DNA, 16 bp, Homo sapiens
agctgaggcagcagtg

SEQ ID NO: 4688592 - DNA, 17 bp, Homo sapiens
agctgaggcagcagtgt

SEQ ID NO: 4688593 - DNA, 20 bp, Homo sapiens
agctgatactttgacagtgt

SEQ ID NO: 4688594 - DNA, 13 bp, Homo sapiens
agctgcctggacc

SEQ ID NO: 4688595 - DNA, 23 bp, Homo sapiens
agctgcggtccacccaggagccc

SEQ ID NO: 4688596 - DNA, 13 bp, Homo sapiens
agctgctgacagt

SEQ ID NO: 4688597 - DNA, 14 bp, Homo sapiens
agctgctggagact

SEQ ID NO: 4688598 - DNA, 23 bp, Homo sapiens
agctgctggagactcctaggcag

SEQ ID NO: 4688599 - DNA, 21 bp, Homo sapiens
agctgcttttgtctatgggac

SEQ ID NO: 4688600 - DNA, 15 bp, Homo sapiens
agctggagcctggtg

SEQ ID NO: 4688601 - DNA, 17 bp, Homo sapiens
agctggagcctggtgcc

SEQ ID NO: 4688602 - DNA, 19 bp, Homo sapiens
agctggagcctggtgccct

SEQ ID NO: 4688603 - DNA, 22 bp, Homo sapiens
agctggccgcgccaaataatgt

SEQ ID NO: 4688604 - DNA, 16 bp, Homo sapiens
agctgggactacaggc

SEQ ID NO: 4688605 - DNA, 23 bp, Homo sapiens
agctgggatgattggagggggga

SEQ ID NO: 4688606 - DNA, 18 bp, Homo sapiens
agctgggattacaggctc

SEQ ID NO: 4688607 - DNA, 15 bp, Homo sapiens
agctgggcagctgga

SEQ ID NO: 4688608 - DNA, 20 bp, Homo sapiens
agctgggtggcactgccatg

SEQ ID NO: 4688609 - DNA, 16 bp, Homo sapiens
agctgggttggaaaac

SEQ ID NO: 4688610 - DNA, 18 bp, Homo sapiens
agctggtgagtgatgcgg

SEQ ID NO: 4688611 - DNA, 12 bp, Homo sapiens
agctggtggatg

SEQ ID NO: 4688612 - DNA, 21 bp, Homo sapiens
agctggtggatggtgactttt

SEQ ID NO: 4688613 - DNA, 21 bp, Homo sapiens
agctggtggtatctgagttga

SEQ ID NO: 4688614 - DNA, 14 bp, Homo sapiens
agctgtaaaccaga

SEQ ID NO: 4688615 - DNA, 19 bp, Homo sapiens
agctgtgcaggtggggaga

SEQ ID NO: 4688616 - DNA, 13 bp, Homo sapiens
agctgtgccaccc

SEQ ID NO: 4688617 - DNA, 20 bp, Homo sapiens
agctgtgctctggacaggca

SEQ ID NO: 4688618 - DNA, 23 bp, Homo sapiens
agctgtgctctggacaggcatgt

SEQ ID NO: 4688619 - DNA, 21 bp, Homo sapiens
agctgtgtgaatacctgctca

SEQ ID NO: 4688620 - DNA, 14 bp, Homo sapiens
agctgttatcttgt

SEQ ID NO: 4688621 - DNA, 15 bp, Homo sapiens
agctgttgtacattt

SEQ ID NO: 4688622 - DNA, 16 bp, Homo sapiens
agctgttgtacattta

SEQ ID NO: 4688623 - DNA, 22 bp, Homo sapiens
agctgtttactagggatccctc

SEQ ID NO: 4688624 - DNA, 13 bp, Homo sapiens
agctgtttatgca

SEQ ID NO: 4688625 - DNA, 17 bp, Homo sapiens
agcttagattttctgta

SEQ ID NO: 4688626 - DNA, 18 bp, Homo sapiens
agcttcactgtaaaataa

SEQ ID NO: 4688627 - DNA, 17 bp, Homo sapiens
agcttcagtgctgccga

SEQ ID NO: 4688628 - DNA, 23 bp, Homo sapiens
agcttccctcccgtgtgttctcc

SEQ ID NO: 4688629 - DNA, 17 bp, Homo sapiens
agcttctaaatggtgct

SEQ ID NO: 4688630 - DNA, 14 bp, Homo sapiens
agcttctgctgggc

SEQ ID NO: 4688631 - DNA, 15 bp, Homo sapiens
agcttctgctgggct

SEQ ID NO: 4688632 - DNA, 17 bp, Homo sapiens
agcttctgctgggctgg

SEQ ID NO: 4688633 - DNA, 20 bp, Homo sapiens
agcttctgttgctgcctcat

SEQ ID NO: 4688634 - DNA, 18 bp, Homo sapiens
agcttgagggttgggctg

SEQ ID NO: 4688635 - DNA, 15 bp, Homo sapiens
agcttgctcacatct

SEQ ID NO: 4688636 - DNA, 19 bp, Homo sapiens
agcttgtaaatagctcagg

SEQ ID NO: 4688637 - DNA, 20 bp, Homo sapiens
agcttgtaaatagctcaggt

SEQ ID NO: 4688638 - DNA, 22 bp, Homo sapiens
agcttgtattttgtgaagactg

SEQ ID NO: 4688639 - DNA, 17 bp, Homo sapiens
agctttgggtcattttt

SEQ ID NO: 4688640 - DNA, 17 bp, Homo sapiens
agctttggtgcaatggc

SEQ ID NO: 4688641 - DNA, 16 bp, Homo sapiens
agcttttaaaccctat

SEQ ID NO: 4688642 - DNA, 18 bp, Homo sapiens
agcttttcccaaaagccc

SEQ ID NO: 4688643 - DNA, 17 bp, Homo sapiens
agctttttaattgttgt

SEQ ID NO: 4688644 - DNA, 13 bp, Homo sapiens
aggaaaaaattat

SEQ ID NO: 4688645 - DNA, 21 bp, Homo sapiens
aggaaaaaattgaaagaactt

SEQ ID NO: 4688646 - DNA, 16 bp, Homo sapiens
aggaaaaagaacttcc

SEQ ID NO: 4688647 - DNA, 15 bp, Homo sapiens
aggaaaagcctctgt

SEQ ID NO: 4688648 - DNA, 17 bp, Homo sapiens
aggaaaagcctctgtgt

SEQ ID NO: 4688649 - DNA, 23 bp, Homo sapiens
aggaaaatgtctgtaataataga

SEQ ID NO: 4688650 - DNA, 18 bp, Homo sapiens
aggaaacatatttaagaa

SEQ ID NO: 4688651 - DNA, 20 bp, Homo sapiens
aggaaaccacagctgctgga

SEQ ID NO: 4688652 - DNA, 18 bp, Homo sapiens
aggaaacccagctctggt

SEQ ID NO: 4688653 - DNA, 15 bp, Homo sapiens
aggaaaggctccagg

SEQ ID NO: 4688654 - DNA, 16 bp, Homo sapiens
aggaaaggctccagga

SEQ ID NO: 4688655 - DNA, 12 bp, Homo sapiens
aggaaatattaa

SEQ ID NO: 4688656 - DNA, 19 bp, Homo sapiens
aggaaatccagtagggaaa

SEQ ID NO: 4688657 - DNA, 19 bp, Homo sapiens
aggaaatgaaaatgtcttg

SEQ ID NO: 4688658 - DNA, 15 bp, Homo sapiens
aggaacactccttca

SEQ ID NO: 4688659 - DNA, 12 bp, Homo sapiens
aggaacatacag

SEQ ID NO: 4688660 - DNA, 22 bp, Homo sapiens
aggaacgtaatcgtgtccccta

SEQ ID NO: 4688661 - DNA, 15 bp, Homo sapiens
aggaagactttggaa

SEQ ID NO: 4688662 - DNA, 19 bp, Homo sapiens
aggaagccgctggggccag

SEQ ID NO: 4688663 - DNA, 13 bp, Homo sapiens
aggaagcctcaag

SEQ ID NO: 4688664 - DNA, 14 bp, Homo sapiens
aggaagctcagggc

SEQ ID NO: 4688665 - DNA, 15 bp, Homo sapiens
aggaagctcagggcc

SEQ ID NO: 4688666 - DNA, 19 bp, Homo sapiens
aggaaggaaacccagctct

SEQ ID NO: 4688667 - DNA, 12 bp, Homo sapiens
aggaaggagctg

SEQ ID NO: 4688668 - DNA, 14 bp, Homo sapiens
aggaaggagctgcc

SEQ ID NO: 4688669 - DNA, 15 bp, Homo sapiens
aggaaggagctgcct

SEQ ID NO: 4688670 - DNA, 21 bp, Homo sapiens
aggaaggagctgcctggaccc

SEQ ID NO: 4688671 - DNA, 18 bp, Homo sapiens
aggaaggattgtaaaaaa

SEQ ID NO: 4688672 - DNA, 16 bp, Homo sapiens
aggaaggggccagagg

SEQ ID NO: 4688673 - DNA, 18 bp, Homo sapiens
aggaaggggccagaggct

SEQ ID NO: 4688674 - DNA, 18 bp, Homo sapiens
aggaagtcaaagcaagga

SEQ ID NO: 4688675 - DNA, 14 bp, Homo sapiens
aggaagtctgtgtc

SEQ ID NO: 4688676 - DNA, 15 bp, Homo sapiens
aggaataatgggctt

SEQ ID NO: 4688677 - DNA, 15 bp, Homo sapiens
aggaatacctgtccc

SEQ ID NO: 4688678 - DNA, 13 bp, Homo sapiens
agcagaatactgg

SEQ ID NO: 4688679 - DNA, 21 bp, Homo sapiens
agcagagaatgaaagggccca

SEQ ID NO: 4688680 - DNA, 17 bp, Homo sapiens
agcagagaccatccctg

SEQ ID NO: 4688681 - DNA, 19 bp, Homo sapiens
agcagagaccatccctgaa

SEQ ID NO: 4688682 - DNA, 12 bp, Homo sapiens
agcagatgcaga

SEQ ID NO: 4688683 - DNA, 17 bp, Homo sapiens
agcagatgcagagagcc

SEQ ID NO: 4688684 - DNA, 14 bp, Homo sapiens
agcagattacctct

SEQ ID NO: 4688685 - DNA, 20 bp, Homo sapiens
agcagattacctcttgccct

SEQ ID NO: 4688686 - DNA, 21 bp, Homo sapiens
agcagccacattcctgatgct

SEQ ID NO: 4688687 - DNA, 20 bp, Homo sapiens
agcagcctcagaacaaagtg

SEQ ID NO: 4688688 - DNA, 15 bp, Homo sapiens
agcagcttctgccac

SEQ ID NO: 4688689 - DNA, 16 bp, Homo sapiens
agcagcttctgccact

SEQ ID NO: 4688690 - DNA, 21 bp, Homo sapiens
agcaggaaatgaaaatgtctt

SEQ ID NO: 4688691 - DNA, 19 bp, Homo sapiens
agcagggcaggaaggggaa

SEQ ID NO: 4688692 - DNA, 16 bp, Homo sapiens
agcagggtctgggcag

SEQ ID NO: 4688693 - DNA, 15 bp, Homo sapiens
agcagggtgctgtgg

SEQ ID NO: 4688694 - DNA, 13 bp, Homo sapiens
agcagtaaaagat

SEQ ID NO: 4688695 - DNA, 12 bp, Homo sapiens
agcagtatctca

SEQ ID NO: 4688696 - DNA, 18 bp, Homo sapiens
agcagtcgcgagcacatg

SEQ ID NO: 4688697 - DNA, 22 bp, Homo sapiens
agcagtgaatgattcagtgtta

SEQ ID NO: 4688698 - DNA, 14 bp, Homo sapiens
agcagtgtctctca

SEQ ID NO: 4688699 - DNA, 20 bp, Homo sapiens
agcagttacccaacagaaac

SEQ ID NO: 4688700 - DNA, 17 bp, Homo sapiens
agcagttgctcacatgt

SEQ ID NO: 4688701 - DNA, 20 bp, Homo sapiens
agcagttgctcacatgtctt

SEQ ID NO: 4688702 - DNA, 13 bp, Homo sapiens
agcagtttattat

SEQ ID NO: 4688703 - DNA, 18 bp, Homo sapiens
agcagtttctgtcctgct

SEQ ID NO: 4688704 - DNA, 16 bp, Homo sapiens
agcataatttaaaaat

SEQ ID NO: 4688705 - DNA, 17 bp, Homo sapiens
agcataatttaaaaata

SEQ ID NO: 4688706 - DNA, 18 bp, Homo sapiens
agcataatttaaaaatat

SEQ ID NO: 4688707 - DNA, 23 bp, Homo sapiens
agcataattttgtgttgtacaat

SEQ ID NO: 4688708 - DNA, 21 bp, Homo sapiens
agcataggaggggtctggaca

SEQ ID NO: 4688709 - DNA, 21 bp, Homo sapiens
agcatatatagtatttaattg

SEQ ID NO: 4688710 - DNA, 19 bp, Homo sapiens
agcatattcaggaagctca

SEQ ID NO: 4688711 - DNA, 15 bp, Homo sapiens
agcatcaaacatgaa

SEQ ID NO: 4688712 - DNA, 17 bp, Homo sapiens
agcatcaaacatgaaaa

SEQ ID NO: 4688713 - DNA, 20 bp, Homo sapiens
agcatcacatgaacttgtaa

SEQ ID NO: 4688714 - DNA, 21 bp, Homo sapiens
agcatcaggccaggccctctg

SEQ ID NO: 4688715 - DNA, 22 bp, Homo sapiens
agcatcaggccaggccctctgc

SEQ ID NO: 4688716 - DNA, 16 bp, Homo sapiens
agcatccacctccttc

SEQ ID NO: 4688717 - DNA, 17 bp, Homo sapiens
agcatccacctccttct

SEQ ID NO: 4688718 - DNA, 23 bp, Homo sapiens
agcatcccttgaccaggcctggg

SEQ ID NO: 4688719 - DNA, 17 bp, Homo sapiens
agcatcctggcacccgg

SEQ ID NO: 4688720 - DNA, 22 bp, Homo sapiens
agcatcctggcacccggcccct

SEQ ID NO: 4688721 - DNA, 21 bp, Homo sapiens
agcatcgtgatcactgagcca

SEQ ID NO: 4688722 - DNA, 14 bp, Homo sapiens
agcatgcattttct

SEQ ID NO: 4688723 - DNA, 13 bp, Homo sapiens
agcatggctgtga

SEQ ID NO: 4688724 - DNA, 17 bp, Homo sapiens
agcatgtcgtcaaagct

SEQ ID NO: 4688725 - DNA, 18 bp, Homo sapiens
agcattccttctttgata

SEQ ID NO: 4688726 - DNA, 21 bp, Homo sapiens
agcattccttctttgataatg

SEQ ID NO: 4688727 - DNA, 17 bp, Homo sapiens
agcatttaaagttgtat

SEQ ID NO: 4688728 - DNA, 13 bp, Homo sapiens
agcattttcagca

SEQ ID NO: 4688729 - DNA, 12 bp, Homo sapiens
agccaaagccaa

SEQ ID NO: 4688730 - DNA, 18 bp, Homo sapiens
agccaaagctaggcctgg

SEQ ID NO: 4688731 - DNA, 18 bp, Homo sapiens
agccaataacacacagct

SEQ ID NO: 4688732 - DNA, 13 bp, Homo sapiens
agccacagctggt

SEQ ID NO: 4688733 - DNA, 14 bp, Homo sapiens
agccacaggcctga

SEQ ID NO: 4688734 - DNA, 22 bp, Homo sapiens
agccacaggcctgagatttcat

SEQ ID NO: 4688735 - DNA, 15 bp, Homo sapiens
agccacatttacata

SEQ ID NO: 4688736 - DNA, 19 bp, Homo sapiens
agccaccaacatactccca

SEQ ID NO: 4688737 - DNA, 18 bp, Homo sapiens
agccaccgtgcctggcca

SEQ ID NO: 4688738 - DNA, 15 bp, Homo sapiens
agccacggccaggcc

SEQ ID NO: 4688739 - DNA, 16 bp, Homo sapiens
agccacggccaggcca

SEQ ID NO: 4688740 - DNA, 17 bp, Homo sapiens
agccacggccaggccag

SEQ ID NO: 4688741 - DNA, 12 bp, Homo sapiens
agccactcctct

SEQ ID NO: 4688742 - DNA, 13 bp, Homo sapiens
agccactcctctg

SEQ ID NO: 4688743 - DNA, 15 bp, Homo sapiens
agccactcctctgac

SEQ ID NO: 4688744 - DNA, 19 bp, Homo sapiens
agccactgcaccgggccac

SEQ ID NO: 4688745 - DNA, 16 bp, Homo sapiens
agccagcaccggacca

SEQ ID NO: 4688746 - DNA, 21 bp, Homo sapiens
agccagcaccggaccagcctg

SEQ ID NO: 4688747 - DNA, 17 bp, Homo sapiens
agccagcgtcctcctct

SEQ ID NO: 4688748 - DNA, 19 bp, Homo sapiens
agccagcgtcctcctctgt

SEQ ID NO: 4688749 - DNA, 18 bp, Homo sapiens
agccaggatcatggtgta

SEQ ID NO: 4688750 - DNA, 23 bp, Homo sapiens
agccaggatcatggtgtaataag

SEQ ID NO: 4688751 - DNA, 20 bp, Homo sapiens
agccagggagagcccaggag

SEQ ID NO: 4688752 - DNA, 17 bp, Homo sapiens
agccaggtgctgtgaca

SEQ ID NO: 4688753 - DNA, 15 bp, Homo sapiens
agccagtcattgtaa

SEQ ID NO: 4688754 - DNA, 22 bp, Homo sapiens
agccatctccatcttgaaggaa

SEQ ID NO: 4688755 - DNA, 21 bp, Homo sapiens
agccatggagtgagacccagg

SEQ ID NO: 4688756 - DNA, 13 bp, Homo sapiens
agccatgggacca

SEQ ID NO: 4688757 - DNA, 16 bp, Homo sapiens
agccatgggaccaaac

SEQ ID NO: 4688758 - DNA, 22 bp, Homo sapiens
agccattggctatttaaaactt

SEQ ID NO: 4688759 - DNA, 22 bp, Homo sapiens
agccatttatacctttgaaata

SEQ ID NO: 4688760 - DNA, 15 bp, Homo sapiens
agccattttgtgaat

SEQ ID NO: 4688761 - DNA, 17 bp, Homo sapiens
agccattttgtgaatgg

SEQ ID NO: 4688762 - DNA, 19 bp, Homo sapiens
agccattttgtgaatggat

SEQ ID NO: 4688763 - DNA, 14 bp, Homo sapiens
agcccaaagaagga

SEQ ID NO: 4688764 - DNA, 19 bp, Homo sapiens
agcccacgcccccactggt

SEQ ID NO: 4688765 - DNA, 22 bp, Homo sapiens
agcccacgtcctgtcagtgccg

SEQ ID NO: 4688766 - DNA, 15 bp, Homo sapiens
agcccacttctgcca

SEQ ID NO: 4688767 - DNA, 22 bp, Homo sapiens
agcccacttctgccatattctg

SEQ ID NO: 4688768 - DNA, 12 bp, Homo sapiens
agcccagaggag

SEQ ID NO: 4688769 - DNA, 16 bp, Homo sapiens
agcccagaggagggca

SEQ ID NO: 4688770 - DNA, 15 bp, Homo sapiens
agcccagaggtaaca

SEQ ID NO: 4688771 - DNA, 18 bp, Homo sapiens
agcccagaggtaacagaa

SEQ ID NO: 4688772 - DNA, 23 bp, Homo sapiens
agcccagcttgaaaccttcactt

SEQ ID NO: 4688773 - DNA, 14 bp, Homo sapiens
agcccaggaaaggc

SEQ ID NO: 4688774 - DNA, 24 bp, Homo sapiens
agcccaggaaaggctccaggagca

SEQ ID NO: 4688775 - DNA, 12 bp, Homo sapiens
agcccaggagct

SEQ ID NO: 4688776 - DNA, 23 bp, Homo sapiens
agcccaggagctcccctccccaa

SEQ ID NO: 4688777 - DNA, 14 bp, Homo sapiens
agcccaggccagga

SEQ ID NO: 4688778 - DNA, 16 bp, Homo sapiens
agcccaggccaggact

SEQ ID NO: 4688779 - DNA, 20 bp, Homo sapiens
agcccaggccaggactctgc

SEQ ID NO: 4688780 - DNA, 19 bp, Homo sapiens
agcccatggccctcccagt

SEQ ID NO: 4688781 - DNA, 14 bp, Homo sapiens
agccccaaggggtg

SEQ ID NO: 4688782 - DNA, 18 bp, Homo sapiens
agccccacagcccacgtc

SEQ ID NO: 4688783 - DNA, 14 bp, Homo sapiens
agccccagtgccca

SEQ ID NO: 4688784 - DNA, 17 bp, Homo sapiens
agccccatcctctgtac

SEQ ID NO: 4688785 - DNA, 16 bp, Homo sapiens
agccccattcctggga

SEQ ID NO: 4688786 - DNA, 18 bp, Homo sapiens
agccccattctgcctgcc

SEQ ID NO: 4688787 - DNA, 22 bp, Homo sapiens
agccccattctgcctgcccagg

SEQ ID NO: 4688788 - DNA, 16 bp, Homo sapiens
agccccctgccccgca

SEQ ID NO: 4688789 - DNA, 17 bp, Homo sapiens
cagcatcaaacatgaaa

SEQ ID NO: 4688790 - DNA, 19 bp, Homo sapiens
cagcatcccttgaccaggc

SEQ ID NO: 4688791 - DNA, 16 bp, Homo sapiens
cagcatcctggcaccc

SEQ ID NO: 4688792 - DNA, 22 bp, Homo sapiens
cagcatcgtgatcactgagcca

SEQ ID NO: 4688793 - DNA, 14 bp, Homo sapiens
cagccaaatttaaa

SEQ ID NO: 4688794 - DNA, 22 bp, Homo sapiens
cagccaaatttaaaactgttgg

SEQ ID NO: 4688795 - DNA, 17 bp, Homo sapiens
cagccacattcctgatg

SEQ ID NO: 4688796 - DNA, 14 bp, Homo sapiens
cagccacggccagg

SEQ ID NO: 4688797 - DNA, 18 bp, Homo sapiens
cagccacggccaggccag

SEQ ID NO: 4688798 - DNA, 21 bp, Homo sapiens
cagccacggccaggccagagg

SEQ ID NO: 4688799 - DNA, 22 bp, Homo sapiens
cagccaggccacaagacccttg

SEQ ID NO: 4688800 - DNA, 14 bp, Homo sapiens
cagccagggagagc

SEQ ID NO: 4688801 - DNA, 16 bp, Homo sapiens
cagccagggagagccc

SEQ ID NO: 4688802 - DNA, 21 bp, Homo sapiens
cagccagggagagcccaggag

SEQ ID NO: 4688803 - DNA, 22 bp, Homo sapiens
cagccagggagagcccaggagc

SEQ ID NO: 4688804 - DNA, 24 bp, Homo sapiens
cagccagggagagcccaggagctc

SEQ ID NO: 4688805 - DNA, 15 bp, Homo sapiens
cagccagggctgcta

SEQ ID NO: 4688806 - DNA, 23 bp, Homo sapiens
cagccagggctgctagacggagg

SEQ ID NO: 4688807 - DNA, 19 bp, Homo sapiens
cagccattggctatttaaa

SEQ ID NO: 4688808 - DNA, 22 bp, Homo sapiens
cagccattggctatttaaaact

SEQ ID NO: 4688809 - DNA, 15 bp, Homo sapiens
cagcccacgtcctgt

SEQ ID NO: 4688810 - DNA, 18 bp, Homo sapiens
cagcccacgtcctgtcag

SEQ ID NO: 4688811 - DNA, 15 bp, Homo sapiens
cagcccacttctgcc

SEQ ID NO: 4688812 - DNA, 18 bp, Homo sapiens
cagcccacttctgccata

SEQ ID NO: 4688813 - DNA, 17 bp, Homo sapiens
cagccccaaggggtggc

SEQ ID NO: 4688814 - DNA, 18 bp, Homo sapiens
cagccccacagcccacgt

SEQ ID NO: 4688815 - DNA, 17 bp, Homo sapiens
cagccccagtgcccaca

SEQ ID NO: 4688816 - DNA, 12 bp, Homo sapiens
cagccccatcct

SEQ ID NO: 4688817 - DNA, 14 bp, Homo sapiens
cagccccatcctct

SEQ ID NO: 4688818 - DNA, 20 bp, Homo sapiens
cagccccattctgcctgccc

SEQ ID NO: 4688819 - DNA, 21 bp, Homo sapiens
cagcccctgatcctgtgaagt

SEQ ID NO: 4688820 - DNA, 13 bp, Homo sapiens
cagcccctggatg

SEQ ID NO: 4688821 - DNA, 14 bp, Homo sapiens
cagcccctggatgc

SEQ ID NO: 4688822 - DNA, 23 bp, Homo sapiens
cagcccctggatgcagcctcaca

SEQ ID NO: 4688823 - DNA, 16 bp, Homo sapiens
cagccccttctgaccc

SEQ ID NO: 4688824 - DNA, 23 bp, Homo sapiens
cagccccttctgacccatgctgc

SEQ ID NO: 4688825 - DNA, 13 bp, Homo sapiens
cagcccgggctct

SEQ ID NO: 4688826 - DNA, 23 bp, Homo sapiens
cagccctccatctaaactgcccc

SEQ ID NO: 4688827 - DNA, 23 bp, Homo sapiens
cagccctcccagcagtggcttgc

SEQ ID NO: 4688828 - DNA, 15 bp, Homo sapiens
caggacccagaggaa

SEQ ID NO: 4688829 - DNA, 23 bp, Homo sapiens
caggacctaggatatcttctcca

SEQ ID NO: 4688830 - DNA, 18 bp, Homo sapiens
caggactcagctccccag

SEQ ID NO: 4688831 - DNA, 20 bp, Homo sapiens
caggactcagctccccagag

SEQ ID NO: 4688832 - DNA, 20 bp, Homo sapiens
caggactctgcagcctcaga

SEQ ID NO: 4688833 - DNA, 18 bp, Homo sapiens
caggactcttgtgaaaag

SEQ ID NO: 4688834 - DNA, 13 bp, Homo sapiens
caggactgggcca

SEQ ID NO: 4688835 - DNA, 15 bp, Homo sapiens
caggactgggccact

SEQ ID NO: 4688836 - DNA, 16 bp, Homo sapiens
caggacttgaaagaaa

SEQ ID NO: 4688837 - DNA, 20 bp, Homo sapiens
caggagcatccacctccttc

SEQ ID NO: 4688838 - DNA, 22 bp, Homo sapiens
caggagcatccacctccttctc

SEQ ID NO: 4688839 - DNA, 16 bp, Homo sapiens
caggagccccgaggcc

SEQ ID NO: 4688840 - DNA, 20 bp, Homo sapiens
caggagccccgaggccttct

SEQ ID NO: 4688841 - DNA, 22 bp, Homo sapiens
caggagccccgaggccttctct

SEQ ID NO: 4688842 - DNA, 18 bp, Homo sapiens
caggagctcccctcccca

SEQ ID NO: 4688843 - DNA, 15 bp, Homo sapiens
caggaggaggtgcca

SEQ ID NO: 4688844 - DNA, 13 bp, Homo sapiens
caggaggccagcc

SEQ ID NO: 4688845 - DNA, 14 bp, Homo sapiens
caggaggccagcct

SEQ ID NO: 4688846 - DNA, 17 bp, Homo sapiens
caggaggccagccttga

SEQ ID NO: 4688847 - DNA, 19 bp, Homo sapiens
caggaggccagccttgacc

SEQ ID NO: 4688848 - DNA, 19 bp, Homo sapiens
caggaggggaaaaaattaa

SEQ ID NO: 4688849 - DNA, 17 bp, Homo sapiens
caggagttccagtgctg

SEQ ID NO: 4688850 - DNA, 14 bp, Homo sapiens
caggatgactttac

SEQ ID NO: 4688851 - DNA, 15 bp, Homo sapiens
caggatggcctggcc

SEQ ID NO: 4688852 - DNA, 13 bp, Homo sapiens
caggattgcgaga

SEQ ID NO: 4688853 - DNA, 17 bp, Homo sapiens
caggattgcgagagatg

SEQ ID NO: 4688854 - DNA, 20 bp, Homo sapiens
caggattgcgagagatgtgt

SEQ ID NO: 4688855 - DNA, 22 bp, Homo sapiens
caggattgcgagagatgtgtgt

SEQ ID NO: 4688856 - DNA, 16 bp, Homo sapiens
caggcaaagcaagtga

SEQ ID NO: 4688857 - DNA, 16 bp, Homo sapiens
caggcaagcacctcct

SEQ ID NO: 4688858 - DNA, 21 bp, Homo sapiens
caggcaagcacctcctgcctc

SEQ ID NO: 4688859 - DNA, 16 bp, Homo sapiens
caggcacagcacaggg

SEQ ID NO: 4688860 - DNA, 22 bp, Homo sapiens
caggcactgagataccagcgag

SEQ ID NO: 4688861 - DNA, 23 bp, Homo sapiens
caggcactgagataccagcgagg

SEQ ID NO: 4688862 - DNA, 16 bp, Homo sapiens
caggcactgccctggt

SEQ ID NO: 4688863 - DNA, 14 bp, Homo sapiens
caggcagcagagac

SEQ ID NO: 4688864 - DNA, 14 bp, Homo sapiens
caggcagccaggcc

SEQ ID NO: 4688865 - DNA, 15 bp, Homo sapiens
caggcagccaggcca

SEQ ID NO: 4688866 - DNA, 23 bp, Homo sapiens
caggcaggctaaggcgtggagct

SEQ ID NO: 4688867 - DNA, 13 bp, Homo sapiens
caggcaggtcttg

SEQ ID NO: 4688868 - DNA, 20 bp, Homo sapiens
caggcagtgtttaaaatgat

SEQ ID NO: 4688869 - DNA, 18 bp, Homo sapiens
caggcatgttctctgagg

SEQ ID NO: 4688870 - DNA, 22 bp, Homo sapiens
caggccaggaccaagggcagag

SEQ ID NO: 4688871 - DNA, 23 bp, Homo sapiens
caggccaggaccaagggcagagg

SEQ ID NO: 4688872 - DNA, 14 bp, Homo sapiens
caggccaggactct

SEQ ID NO: 4688873 - DNA, 16 bp, Homo sapiens
caggccaggactctgc

SEQ ID NO: 4688874 - DNA, 18 bp, Homo sapiens
caggccaggactctgcag

SEQ ID NO: 4688875 - DNA, 21 bp, Homo sapiens
caggccaggactctgcagcct

SEQ ID NO: 4688876 - DNA, 23 bp, Homo sapiens
caggccaggactctgcagcctca

SEQ ID NO: 4688877 - DNA, 12 bp, Homo sapiens
caggccaggccc

SEQ ID NO: 4688878 - DNA, 17 bp, Homo sapiens
caggccaggccctctgc

SEQ ID NO: 4688879 - DNA, 19 bp, Homo sapiens
caggccaggccctctgccc

SEQ ID NO: 4688880 - DNA, 22 bp, Homo sapiens
caggccaggccctctgcccact

SEQ ID NO: 4688881 - DNA, 21 bp, Homo sapiens
caggccatcatcagtggagcc

SEQ ID NO: 4688882 - DNA, 13 bp, Homo sapiens
caggccatcttcc

SEQ ID NO: 4688883 - DNA, 16 bp, Homo sapiens
caggccatcttccagg

SEQ ID NO: 4688884 - DNA, 17 bp, Homo sapiens
caggcccctgccaccct

SEQ ID NO: 4688885 - DNA, 13 bp, Homo sapiens
caggcccggctcc

SEQ ID NO: 4688886 - DNA, 19 bp, Homo sapiens
caggccctctgcccactcc

SEQ ID NO: 4688887 - DNA, 20 bp, Homo sapiens
caggccctctgcccactccc

SEQ ID NO: 4688888 - DNA, 21 bp, Homo sapiens
caggccctctgcccactccct

SEQ ID NO: 4688889 - DNA, 13 bp, Homo sapiens
caggccctgcact

SEQ ID NO: 4688890 - DNA, 22 bp, Homo sapiens
caggccctgcactgtcctgctc

SEQ ID NO: 4688891 - DNA, 23 bp, Homo sapiens
caggccctgcactgtcctgctcc

SEQ ID NO: 4688892 - DNA, 21 bp, Homo sapiens
caggcctgagatttcatctgc

SEQ ID NO: 4688893 - DNA, 14 bp, Homo sapiens
caggctcctgccac

SEQ ID NO: 4688894 - DNA, 19 bp, Homo sapiens
caggctcctttagcgccca

SEQ ID NO: 4688895 - DNA, 17 bp, Homo sapiens
caggctctgagacacac

SEQ ID NO: 4688896 - DNA, 13 bp, Homo sapiens
caggctgagcctc

SEQ ID NO: 4688897 - DNA, 15 bp, Homo sapiens
caggctgagcctcag

SEQ ID NO: 4688898 - DNA, 20 bp, Homo sapiens
caggctgctcttgaactcct

SEQ ID NO: 4688899 - DNA, 14 bp, Homo sapiens
caggctggccagcc

SEQ ID NO: 4688900 - DNA, 16 bp, Homo sapiens
caggctggccagcccc

SEQ ID NO: 4688901 - DNA, 17 bp, Homo sapiens
caccttgccaaagcact

SEQ ID NO: 4688902 - DNA, 13 bp, Homo sapiens
caccttggctcaa

SEQ ID NO: 4688903 - DNA, 15 bp, Homo sapiens
caccttggctcaagt

SEQ ID NO: 4688904 - DNA, 15 bp, Homo sapiens
caccttggctgcagg

SEQ ID NO: 4688905 - DNA, 18 bp, Homo sapiens
caccttggctgcagggag

SEQ ID NO: 4688906 - DNA, 13 bp, Homo sapiens
cacgactgtctcc

SEQ ID NO: 4688907 - DNA, 15 bp, Homo sapiens
cacgcaacacatttt

SEQ ID NO: 4688908 - DNA, 12 bp, Homo sapiens
cacgcacacaca

SEQ ID NO: 4688909 - DNA, 14 bp, Homo sapiens
cacgcagctggcag

SEQ ID NO: 4688910 - DNA, 17 bp, Homo sapiens
cacgcagctggcagaga

SEQ ID NO: 4688911 - DNA, 23 bp, Homo sapiens
cacgccagattctttcctgaggc

SEQ ID NO: 4688912 - DNA, 15 bp, Homo sapiens
cacgcgtgcacacac

SEQ ID NO: 4688913 - DNA, 21 bp, Homo sapiens
cacgcgtgcacacaccagagc

SEQ ID NO: 4688914 - DNA, 17 bp, Homo sapiens
cacgctggaccttgaac

SEQ ID NO: 4688915 - DNA, 18 bp, Homo sapiens
cacggagccactcctctg

SEQ ID NO: 4688916 - DNA, 13 bp, Homo sapiens
cacggccaggcca

SEQ ID NO: 4688917 - DNA, 14 bp, Homo sapiens
cacggccaggccag

SEQ ID NO: 4688918 - DNA, 15 bp, Homo sapiens
cacggccaggccaga

SEQ ID NO: 4688919 - DNA, 15 bp, Homo sapiens
cacggctcactgcag

SEQ ID NO: 4688920 - DNA, 17 bp, Homo sapiens
cacggctcactgcagcc

SEQ ID NO: 4688921 - DNA, 12 bp, Homo sapiens
cacggctgctga

SEQ ID NO: 4688922 - DNA, 15 bp, Homo sapiens
cacgggggccaagga

SEQ ID NO: 4688923 - DNA, 14 bp, Homo sapiens
cacgtacacacaca

SEQ ID NO: 4688924 - DNA, 18 bp, Homo sapiens
cacgtacacacacataca

SEQ ID NO: 4688925 - DNA, 14 bp, Homo sapiens
cacgtcctgtcagt

SEQ ID NO: 4688926 - DNA, 19 bp, Homo sapiens
cacgtcctgtcagtgccgc

SEQ ID NO: 4688927 - DNA, 15 bp, Homo sapiens
cacgtctgacaaatg

SEQ ID NO: 4688928 - DNA, 20 bp, Homo sapiens
cacgtggaggagcagtgcag

SEQ ID NO: 4688929 - DNA, 17 bp, Homo sapiens
cacgtgtgtttttctat

SEQ ID NO: 4688930 - DNA, 22 bp, Homo sapiens
cacgtgtgtttttctattaaaa

SEQ ID NO: 4688931 - DNA, 23 bp, Homo sapiens
cacgtgtgtttttctattaaaag

SEQ ID NO: 4688932 - DNA, 16 bp, Homo sapiens
cacgtgtttgtgctgt

SEQ ID NO: 4688933 - DNA, 16 bp, Homo sapiens
cactaaccacgctgga

SEQ ID NO: 4688934 - DNA, 17 bp, Homo sapiens
cactaagaacacctgca

SEQ ID NO: 4688935 - DNA, 23 bp, Homo sapiens
cactacggaatagttggctagga

SEQ ID NO: 4688936 - DNA, 16 bp, Homo sapiens
cactagacccactgga

SEQ ID NO: 4688937 - DNA, 19 bp, Homo sapiens
cactatcccggctgccctt

SEQ ID NO: 4688938 - DNA, 20 bp, Homo sapiens
cactatctgaaaatacattt

SEQ ID NO: 4688939 - DNA, 15 bp, Homo sapiens
cactatggtgccaat

SEQ ID NO: 4688940 - DNA, 22 bp, Homo sapiens
cactatggtgccaatggaacct

SEQ ID NO: 4688941 - DNA, 15 bp, Homo sapiens
cactatgttgcccag

SEQ ID NO: 4688942 - DNA, 18 bp, Homo sapiens
cactatgttgcccaggca

SEQ ID NO: 4688943 - DNA, 21 bp, Homo sapiens
cactatgttgcccaggcaggt

SEQ ID NO: 4688944 - DNA, 16 bp, Homo sapiens
cactatttgcagaggc

SEQ ID NO: 4688945 - DNA, 17 bp, Homo sapiens
cactatttgcagaggct

SEQ ID NO: 4688946 - DNA, 14 bp, Homo sapiens
cactcaagaagcag

SEQ ID NO: 4688947 - DNA, 19 bp, Homo sapiens
cactcaagaagcaggctac

SEQ ID NO: 4688948 - DNA, 19 bp, Homo sapiens
cactcacatttattctgct

SEQ ID NO: 4688949 - DNA, 12 bp, Homo sapiens
cactcacctgca

SEQ ID NO: 4688950 - DNA, 12 bp, Homo sapiens
cactcagaagac

SEQ ID NO: 4688951 - DNA, 16 bp, Homo sapiens
cactcagaagacactg

SEQ ID NO: 4688952 - DNA, 22 bp, Homo sapiens
cactcagaagacactgatgggc

SEQ ID NO: 4688953 - DNA, 19 bp, Homo sapiens
cactcattgacctgaggcc

SEQ ID NO: 4688954 - DNA, 18 bp, Homo sapiens
cactccacgcagctggca

SEQ ID NO: 4688955 - DNA, 19 bp, Homo sapiens
cactccacgcagctggcag

SEQ ID NO: 4688956 - DNA, 13 bp, Homo sapiens
cactcccctgctg

SEQ ID NO: 4688957 - DNA, 14 bp, Homo sapiens
cactcccctgctgg

SEQ ID NO: 4688958 - DNA, 15 bp, Homo sapiens
cactcccctgctggg

SEQ ID NO: 4688959 - DNA, 12 bp, Homo sapiens
cactccctgcaa

SEQ ID NO: 4688960 - DNA, 22 bp, Homo sapiens
cactcccttcccatgacccagg

SEQ ID NO: 4688961 - DNA, 16 bp, Homo sapiens
cactcccttgggctcc

SEQ ID NO: 4688962 - DNA, 17 bp, Homo sapiens
cactcctcggcaggcat

SEQ ID NO: 4688963 - DNA, 20 bp, Homo sapiens
cactcctctgactcagggct

SEQ ID NO: 4688964 - DNA, 14 bp, Homo sapiens
cactccttcacaga

SEQ ID NO: 4688965 - DNA, 21 bp, Homo sapiens
cactccttcacagatgggtgc

SEQ ID NO: 4688966 - DNA, 14 bp, Homo sapiens
cactctggcagctc

SEQ ID NO: 4688967 - DNA, 20 bp, Homo sapiens
cactctggcagctcagagag

SEQ ID NO: 4688968 - DNA, 16 bp, Homo sapiens
cactctgtcgcccagt

SEQ ID NO: 4688969 - DNA, 13 bp, Homo sapiens
cactctgtgccca

SEQ ID NO: 4688970 - DNA, 14 bp, Homo sapiens
cactctgtgcccat

SEQ ID NO: 4688971 - DNA, 18 bp, Homo sapiens
cactctgtgcccatgggc

SEQ ID NO: 4688972 - DNA, 17 bp, Homo sapiens
cactcttattgcccacg

SEQ ID NO: 4688973 - DNA, 21 bp, Homo sapiens
cactcttattgcccacgctgg

SEQ ID NO: 4688974 - DNA, 16 bp, Homo sapiens
cactgagaatgtaaga

SEQ ID NO: 4688975 - DNA, 20 bp, Homo sapiens
cactgagaatgtaagaacta

SEQ ID NO: 4688976 - DNA, 12 bp, Homo sapiens
cactgagacagc

SEQ ID NO: 4688977 - DNA, 13 bp, Homo sapiens
cactgagacagcc

SEQ ID NO: 4688978 - DNA, 17 bp, Homo sapiens
cactgagacagcccggg

SEQ ID NO: 4688979 - DNA, 19 bp, Homo sapiens
cactgagacagcccgggct

SEQ ID NO: 4688980 - DNA, 19 bp, Homo sapiens
cactgagataccagcgagg

SEQ ID NO: 4688981 - DNA, 23 bp, Homo sapiens
cactgagataccagcgaggaggc

SEQ ID NO: 4688982 - DNA, 11 bp, Homo sapiens
cactgagccat

SEQ ID NO: 4688983 - DNA, 14 bp, Homo sapiens
cactgatgggcaac

SEQ ID NO: 4688984 - DNA, 14 bp, Homo sapiens
cactgcaaccttcg

SEQ ID NO: 4688985 - DNA, 22 bp, Homo sapiens
cactgcaaccttcgccacctgg

SEQ ID NO: 4688986 - DNA, 14 bp, Homo sapiens
cactgcaacttgtg

SEQ ID NO: 4688987 - DNA, 12 bp, Homo sapiens
cactgcacagaa

SEQ ID NO: 4688988 - DNA, 15 bp, Homo sapiens
cactgcaccccctcc

SEQ ID NO: 4688989 - DNA, 19 bp, Homo sapiens
cactgcaccccctcctgct

SEQ ID NO: 4688990 - DNA, 22 bp, Homo sapiens
cactgcaccccctcctgctgca

SEQ ID NO: 4688991 - DNA, 14 bp, Homo sapiens
cactgcaccgggcc

SEQ ID NO: 4688992 - DNA, 19 bp, Homo sapiens
cactgcaccgggccacaga

SEQ ID NO: 4688993 - DNA, 19 bp, Homo sapiens
cactgcactatagcctagg

SEQ ID NO: 4688994 - DNA, 12 bp, Homo sapiens
cactgcagcctc

SEQ ID NO: 4688995 - DNA, 16 bp, Homo sapiens
cactgcatcctccgcc

SEQ ID NO: 4688996 - DNA, 17 bp, Homo sapiens
cactgccatgcagggcc

SEQ ID NO: 4688997 - DNA, 19 bp, Homo sapiens
cactgccatgcagggcctc

SEQ ID NO: 4688998 - DNA, 21 bp, Homo sapiens
cactgcggggcttggctgaga

SEQ ID NO: 4688999 - DNA, 18 bp, Homo sapiens
cactgctgggtggcccat

SEQ ID NO: 4689000 - DNA, 20 bp, Homo sapiens
cactgctgggtggcccatcc

SEQ ID NO: 4689001 - DNA, 23 bp, Homo sapiens
cactgctgggtggcccatccccc

SEQ ID NO: 4689002 - DNA, 13 bp, Homo sapiens
cactgcttgagga

SEQ ID NO: 4689003 - DNA, 21 bp, Homo sapiens
cactgcttttggtctgtgtga

SEQ ID NO: 4689004 - DNA, 15 bp, Homo sapiens
cactggactcacctc

SEQ ID NO: 4689005 - DNA, 18 bp, Homo sapiens
cactggactcacctcccc

SEQ ID NO: 4689006 - DNA, 19 bp, Homo sapiens
cactggattggtcatttag

SEQ ID NO: 4689007 - DNA, 15 bp, Homo sapiens
cactggctgcctcca

SEQ ID NO: 4689008 - DNA, 17 bp, Homo sapiens
cactggctgcctccact

SEQ ID NO: 4689009 - DNA, 17 bp, Homo sapiens
cactgggacttgcaaaa

SEQ ID NO: 4689010 - DNA, 13 bp, Homo sapiens
cactgtataaata

SEQ ID NO: 4689011 - DNA, 16 bp, Homo sapiens
cactgtcctattatat

SEQ ID NO: 4689012 - DNA, 20 bp, Homo sapiens
cagagctgggatgtttctgt

SEQ ID NO: 4689013 - DNA, 14 bp, Homo sapiens
cagaggaggagaaa

SEQ ID NO: 4689014 - DNA, 12 bp, Homo sapiens
cagaggcagccc

SEQ ID NO: 4689015 - DNA, 14 bp, Homo sapiens
cagaggcagcccca

SEQ ID NO: 4689016 - DNA, 15 bp, Homo sapiens
cagaggcagccccat

SEQ ID NO: 4689017 - DNA, 23 bp, Homo sapiens
cagaggcagccccattctgcctg

SEQ ID NO: 4689018 - DNA, 20 bp, Homo sapiens
cagaggccctcgctgccagc

SEQ ID NO: 4689019 - DNA, 14 bp, Homo sapiens
cagagggagtgaca

SEQ ID NO: 4689020 - DNA, 19 bp, Homo sapiens
cagagggagtgacagaggc

SEQ ID NO: 4689021 - DNA, 18 bp, Homo sapiens
cagagggatctaggtctt

SEQ ID NO: 4689022 - DNA, 19 bp, Homo sapiens
cagaggggcaggccctgca

SEQ ID NO: 4689023 - DNA, 14 bp, Homo sapiens
cagaggggcctgcc

SEQ ID NO: 4689024 - DNA, 17 bp, Homo sapiens
cagaggggcctgccacc

SEQ ID NO: 4689025 - DNA, 17 bp, Homo sapiens
cagagggggtggcctcc

SEQ ID NO: 4689026 - DNA, 14 bp, Homo sapiens
cagaggtaacagaa

SEQ ID NO: 4689027 - DNA, 16 bp, Homo sapiens
cagaggtaacagaaca

SEQ ID NO: 4689028 - DNA, 18 bp, Homo sapiens
cagaggtaacagaacagc

SEQ ID NO: 4689029 - DNA, 20 bp, Homo sapiens
cagaggtccacaacacacag

SEQ ID NO: 4689030 - DNA, 14 bp, Homo sapiens
cagagtatggagct

SEQ ID NO: 4689031 - DNA, 14 bp, Homo sapiens
cagagtatttctgg

SEQ ID NO: 4689032 - DNA, 14 bp, Homo sapiens
cagagtgagaccca

SEQ ID NO: 4689033 - DNA, 17 bp, Homo sapiens
cagagtgagacccagcc

SEQ ID NO: 4689034 - DNA, 16 bp, Homo sapiens
cagagttccccatgca

SEQ ID NO: 4689035 - DNA, 15 bp, Homo sapiens
cagagtttttatgta

SEQ ID NO: 4689036 - DNA, 13 bp, Homo sapiens
cagataatgtgaa

SEQ ID NO: 4689037 - DNA, 21 bp, Homo sapiens
cagatacaggaaaagctgctg

SEQ ID NO: 4689038 - DNA, 18 bp, Homo sapiens
cagatatatttaagcctt

SEQ ID NO: 4689039 - DNA, 20 bp, Homo sapiens
cagatatcatactgattttt

SEQ ID NO: 4689040 - DNA, 13 bp, Homo sapiens
cagatatttatgt

SEQ ID NO: 4689041 - DNA, 14 bp, Homo sapiens
cagatatttatgta

SEQ ID NO: 4689042 - DNA, 14 bp, Homo sapiens
cagatcctccattt

SEQ ID NO: 4689043 - DNA, 18 bp, Homo sapiens
cagatgaaaccaggtcac

SEQ ID NO: 4689044 - DNA, 16 bp, Homo sapiens
cagatgcagagagcca

SEQ ID NO: 4689045 - DNA, 19 bp, Homo sapiens
cagatgggggaaagcacag

SEQ ID NO: 4689046 - DNA, 12 bp, Homo sapiens
cagatgtccctg

SEQ ID NO: 4689047 - DNA, 13 bp, Homo sapiens
cagatgtccctga

SEQ ID NO: 4689048 - DNA, 14 bp, Homo sapiens
cagattcacactgt

SEQ ID NO: 4689049 - DNA, 15 bp, Homo sapiens
cagattctttcctga

SEQ ID NO: 4689050 - DNA, 19 bp, Homo sapiens
cagattctttcctgaggct

SEQ ID NO: 4689051 - DNA, 23 bp, Homo sapiens
cagatttgtaacattagttttaa

SEQ ID NO: 4689052 - DNA, 20 bp, Homo sapiens
cagcaaggaggctggctggg

SEQ ID NO: 4689053 - DNA, 21 bp, Homo sapiens
cagcaaggaggctggctgggg

SEQ ID NO: 4689054 - DNA, 17 bp, Homo sapiens
cagcaaggcacctgcag

SEQ ID NO: 4689055 - DNA, 23 bp, Homo sapiens
cagcaaggcacctgcaggttggg

SEQ ID NO: 4689056 - DNA, 12 bp, Homo sapiens
cagcaagtgaga

SEQ ID NO: 4689057 - DNA, 17 bp, Homo sapiens
cagcaagtgagagctgg

SEQ ID NO: 4689058 - DNA, 19 bp, Homo sapiens
cagcaagtgagagctgggt

SEQ ID NO: 4689059 - DNA, 15 bp, Homo sapiens
cagcaattctcctgc

SEQ ID NO: 4689060 - DNA, 16 bp, Homo sapiens
cagcaattctcctgcc

SEQ ID NO: 4689061 - DNA, 18 bp, Homo sapiens
cagcaattctcctgcctc

SEQ ID NO: 4689062 - DNA, 20 bp, Homo sapiens
cagcaattctcctgcctcag

SEQ ID NO: 4689063 - DNA, 12 bp, Homo sapiens
cagcacaaaatg

SEQ ID NO: 4689064 - DNA, 18 bp, Homo sapiens
cagcacagggatccgact

SEQ ID NO: 4689065 - DNA, 16 bp, Homo sapiens
cagcacccgggctcag

SEQ ID NO: 4689066 - DNA, 19 bp, Homo sapiens
cagcaccggaccagcctgg

SEQ ID NO: 4689067 - DNA, 11 bp, Homo sapiens
cagcactgagg

SEQ ID NO: 4689068 - DNA, 15 bp, Homo sapiens
cagcactgaggaaga

SEQ ID NO: 4689069 - DNA, 19 bp, Homo sapiens
cagcactgcttgaggaaaa

SEQ ID NO: 4689070 - DNA, 17 bp, Homo sapiens
cagcagaagggggtggt

SEQ ID NO: 4689071 - DNA, 19 bp, Homo sapiens
cagcagagacttgggacat

SEQ ID NO: 4689072 - DNA, 18 bp, Homo sapiens
cagcagggcaggaagggg

SEQ ID NO: 4689073 - DNA, 11 bp, Homo sapiens
cagcagggcta

SEQ ID NO: 4689074 - DNA, 19 bp, Homo sapiens
cagcagggctaccctgagc

SEQ ID NO: 4689075 - DNA, 21 bp, Homo sapiens
cagcagggctaccctgagctg

SEQ ID NO: 4689076 - DNA, 11 bp, Homo sapiens
cagcaggtgct

SEQ ID NO: 4689077 - DNA, 15 bp, Homo sapiens
cagcaggtgctgcta

SEQ ID NO: 4689078 - DNA, 20 bp, Homo sapiens
cagcatatatagtatttaat

SEQ ID NO: 4689079 - DNA, 18 bp, Homo sapiens
caagtgattctcatgcct

SEQ ID NO: 4689080 - DNA, 17 bp, Homo sapiens
caagtgattctcctgcc

SEQ ID NO: 4689081 - DNA, 18 bp, Homo sapiens
caagtgattctcctgcct

SEQ ID NO: 4689082 - DNA, 19 bp, Homo sapiens
caagtgattctcctgcctc

SEQ ID NO: 4689083 - DNA, 20 bp, Homo sapiens
caagtgattctcctgcctca

SEQ ID NO: 4689084 - DNA, 21 bp, Homo sapiens
caagtgattctcctgcctcag

SEQ ID NO: 4689085 - DNA, 18 bp, Homo sapiens
caagtgattgggacagag

SEQ ID NO: 4689086 - DNA, 18 bp, Homo sapiens
caagtgggagatgaaaac

SEQ ID NO: 4689087 - DNA, 12 bp, Homo sapiens
caagttccaaat

SEQ ID NO: 4689088 - DNA, 19 bp, Homo sapiens
caagttgtttattccaaag

SEQ ID NO: 4689089 - DNA, 16 bp, Homo sapiens
caataaaaccaagcct

SEQ ID NO: 4689090 - DNA, 22 bp, Homo sapiens
caataaaaccaagcctctggaa

SEQ ID NO: 4689091 - DNA, 22 bp, Homo sapiens
caataaatgtttgttatttaca

SEQ ID NO: 4689092 - DNA, 18 bp, Homo sapiens
caataattttcctgtgac

SEQ ID NO: 4689093 - DNA, 20 bp, Homo sapiens
caataattttcctgtgacac

SEQ ID NO: 4689094 - DNA, 23 bp, Homo sapiens
caatacccaaatcctctccagct

SEQ ID NO: 4689095 - DNA, 18 bp, Homo sapiens
caatactccctttaaaga

SEQ ID NO: 4689096 - DNA, 16 bp, Homo sapiens
caatataagaaggaaa

SEQ ID NO: 4689097 - DNA, 15 bp, Homo sapiens
caatattttccatga

SEQ ID NO: 4689098 - DNA, 16 bp, Homo sapiens
caatattttccatgaa

SEQ ID NO: 4689099 - DNA, 15 bp, Homo sapiens
caatcagctccttcc

SEQ ID NO: 4689100 - DNA, 16 bp, Homo sapiens
caatcagctccttcct

SEQ ID NO: 4689101 - DNA, 15 bp, Homo sapiens
caatccaaatgcatt

SEQ ID NO: 4689102 - DNA, 11 bp, Homo sapiens
caatcctggac

SEQ ID NO: 4689103 - DNA, 16 bp, Homo sapiens
caatctagttccagag

SEQ ID NO: 4689104 - DNA, 16 bp, Homo sapiens
caatctggattcatat

SEQ ID NO: 4689105 - DNA, 13 bp, Homo sapiens
caatgaaattgac

SEQ ID NO: 4689106 - DNA, 19 bp, Homo sapiens
caatgagagcataatttaa

SEQ ID NO: 4689107 - DNA, 16 bp, Homo sapiens
caatgatcaaattttg

SEQ ID NO: 4689108 - DNA, 18 bp, Homo sapiens
caatgccatcctcaaaca

SEQ ID NO: 4689109 - DNA, 13 bp, Homo sapiens
caatgctgatgtc

SEQ ID NO: 4689110 - DNA, 13 bp, Homo sapiens
caatgctggctgt

SEQ ID NO: 4689111 - DNA, 21 bp, Homo sapiens
caatgctggctgttggctggg

SEQ ID NO: 4689112 - DNA, 14 bp, Homo sapiens
caatgctgtgaata

SEQ ID NO: 4689113 - DNA, 20 bp, Homo sapiens
caatgctgtgaataaaaaga

SEQ ID NO: 4689114 - DNA, 14 bp, Homo sapiens
caatggaacctcct

SEQ ID NO: 4689115 - DNA, 18 bp, Homo sapiens
caatggtttgcaaggaag

SEQ ID NO: 4689116 - DNA, 15 bp, Homo sapiens
caatggtttgtgtca

SEQ ID NO: 4689117 - DNA, 21 bp, Homo sapiens
caatggtttgtgtcaaaactg

SEQ ID NO: 4689118 - DNA, 15 bp, Homo sapiens
caatgtacaaggtat

SEQ ID NO: 4689119 - DNA, 11 bp, Homo sapiens
caatgtcttga

SEQ ID NO: 4689120 - DNA, 21 bp, Homo sapiens
caatgtcttgatgcatgcact

SEQ ID NO: 4689121 - DNA, 23 bp, Homo sapiens
caatgtcttgatgcatgcactgt

SEQ ID NO: 4689122 - DNA, 18 bp, Homo sapiens
caatgttaaggaaactct

SEQ ID NO: 4689123 - DNA, 19 bp, Homo sapiens
caatgttaaggaaactctt

SEQ ID NO: 4689124 - DNA, 19 bp, Homo sapiens
caatgttgcactgaaaacc

SEQ ID NO: 4689125 - DNA, 15 bp, Homo sapiens
caatgtttttgtgta

SEQ ID NO: 4689126 - DNA, 22 bp, Homo sapiens
caattacatctctaattttgga

SEQ ID NO: 4689127 - DNA, 15 bp, Homo sapiens
caattataacttatt

SEQ ID NO: 4689128 - DNA, 20 bp, Homo sapiens
caattataacttattagcag

SEQ ID NO: 4689129 - DNA, 15 bp, Homo sapiens
caattattaaattgt

SEQ ID NO: 4689130 - DNA, 14 bp, Homo sapiens
caattcaacactcc

SEQ ID NO: 4689131 - DNA, 15 bp, Homo sapiens
caattctcctgcctc

SEQ ID NO: 4689132 - DNA, 20 bp, Homo sapiens
caattctgatgttactgaga

SEQ ID NO: 4689133 - DNA, 21 bp, Homo sapiens
caattctgatgttactgagat

SEQ ID NO: 4689134 - DNA, 17 bp, Homo sapiens
caattcttccctatctt

SEQ ID NO: 4689135 - DNA, 20 bp, Homo sapiens
caattcttccctatctttgc

SEQ ID NO: 4689136 - DNA, 21 bp, Homo sapiens
caattcttccctatctttgcc

SEQ ID NO: 4689137 - DNA, 15 bp, Homo sapiens
caattcttgccaaat

SEQ ID NO: 4689138 - DNA, 18 bp, Homo sapiens
caatttactttttaaaca

SEQ ID NO: 4689139 - DNA, 19 bp, Homo sapiens
caatttactttttaaacag

SEQ ID NO: 4689140 - DNA, 13 bp, Homo sapiens
caatttctcccca

SEQ ID NO: 4689141 - DNA, 23 bp, Homo sapiens
caatttgctgaaaacattacatg

SEQ ID NO: 4689142 - DNA, 23 bp, Homo sapiens
caatttggatttaaaagcctgct

SEQ ID NO: 4689143 - DNA, 13 bp, Homo sapiens
cacaaaacagcct

SEQ ID NO: 4689144 - DNA, 16 bp, Homo sapiens
cacaaaagtttctctt

SEQ ID NO: 4689145 - DNA, 22 bp, Homo sapiens
cacaaagtttgtggtaatttgt

SEQ ID NO: 4689146 - DNA, 12 bp, Homo sapiens
cacaaataaaat

SEQ ID NO: 4689147 - DNA, 21 bp, Homo sapiens
cacaaatgtgtcccagtgaac

SEQ ID NO: 4689148 - DNA, 23 bp, Homo sapiens
cacaaccatctgtccctgcctca

SEQ ID NO: 4689149 - DNA, 14 bp, Homo sapiens
cacaagctccaagc

SEQ ID NO: 4689150 - DNA, 19 bp, Homo sapiens
cacaagctccaagctccca

SEQ ID NO: 4689151 - DNA, 20 bp, Homo sapiens
cacaagctccaagctcccag

SEQ ID NO: 4689152 - DNA, 18 bp, Homo sapiens
cacaataaaaccaagcct

SEQ ID NO: 4689153 - DNA, 21 bp, Homo sapiens
cacaataaaaccaagcctctg

SEQ ID NO: 4689154 - DNA, 17 bp, Homo sapiens
cacaatgttgcactgaa

SEQ ID NO: 4689155 - DNA, 21 bp, Homo sapiens
cacaatgttgcactgaaaacc

SEQ ID NO: 4689156 - DNA, 15 bp, Homo sapiens
cacacacacatacag

SEQ ID NO: 4689157 - DNA, 13 bp, Homo sapiens
cacacacaggagc

SEQ ID NO: 4689158 - DNA, 20 bp, Homo sapiens
cacacagatttgagctcagc

SEQ ID NO: 4689159 - DNA, 22 bp, Homo sapiens
cacacagatttgagctcagccc

SEQ ID NO: 4689160 - DNA, 20 bp, Homo sapiens
cacacagctctgtcctggga

SEQ ID NO: 4689161 - DNA, 20 bp, Homo sapiens
cacacagtattacttctgct

SEQ ID NO: 4689162 - DNA, 15 bp, Homo sapiens
cacacatacacacac

SEQ ID NO: 4689163 - DNA, 20 bp, Homo sapiens
cacacatgagcatcaggcca

SEQ ID NO: 4689164 - DNA, 22 bp, Homo sapiens
cacacatgagcatcaggccagg

SEQ ID NO: 4689165 - DNA, 13 bp, Homo sapiens
cacacatttgcct

SEQ ID NO: 4689166 - DNA, 12 bp, Homo sapiens
cacaccagagcc

SEQ ID NO: 4689167 - DNA, 13 bp, Homo sapiens
cacaccagagccc

SEQ ID NO: 4689168 - DNA, 22 bp, Homo sapiens
cacaccagagcccaccttggct

SEQ ID NO: 4689169 - DNA, 20 bp, Homo sapiens
cacacccagcccacttctgc

SEQ ID NO: 4689170 - DNA, 16 bp, Homo sapiens
cacacccatcatctga

SEQ ID NO: 4689171 - DNA, 13 bp, Homo sapiens
cacacccccaccc

SEQ ID NO: 4689172 - DNA, 17 bp, Homo sapiens
cacaccgggcactcaga

SEQ ID NO: 4689173 - DNA, 14 bp, Homo sapiens
cacacctagcgtca

SEQ ID NO: 4689174 - DNA, 19 bp, Homo sapiens
cacacggtttgaagcctgg

SEQ ID NO: 4689175 - DNA, 14 bp, Homo sapiens
cacactaaaattta

SEQ ID NO: 4689176 - DNA, 17 bp, Homo sapiens
cacactaaaatttaatt

SEQ ID NO: 4689177 - DNA, 14 bp, Homo sapiens
cacagaccctgccc

SEQ ID NO: 4689178 - DNA, 17 bp, Homo sapiens
cacagaccctgccctgt

SEQ ID NO: 4689179 - DNA, 19 bp, Homo sapiens
cacagaccctgccctgtgg

SEQ ID NO: 4689180 - DNA, 20 bp, Homo sapiens
cacagaccctgccctgtggg

SEQ ID NO: 4689181 - DNA, 21 bp, Homo sapiens
cacagaccctgccctgtgggc

SEQ ID NO: 4689182 - DNA, 13 bp, Homo sapiens
cacagacctgctc

SEQ ID NO: 4689183 - DNA, 19 bp, Homo sapiens
cacagagaaagtacttctc

SEQ ID NO: 4689184 - DNA, 20 bp, Homo sapiens
cacagagaaagtacttctcc

SEQ ID NO: 4689185 - DNA, 13 bp, Homo sapiens
cacagagcgggga

SEQ ID NO: 4689186 - DNA, 17 bp, Homo sapiens
cacagatttgagctcag

SEQ ID NO: 4689187 - DNA, 18 bp, Homo sapiens
cacagcaattcctcaggc

SEQ ID NO: 4689188 - DNA, 15 bp, Homo sapiens
cacagcaccctatat

SEQ ID NO: 4689189 - DNA, 16 bp, Homo sapiens
cacagccatcccagcc

SEQ ID NO: 4689190 - DNA, 20 bp, Homo sapiens
attgttctgggtgatttcta

SEQ ID NO: 4689191 - DNA, 14 bp, Homo sapiens
attgttgtttcttt

SEQ ID NO: 4689192 - DNA, 21 bp, Homo sapiens
attgtttggggatgagaaagg

SEQ ID NO: 4689193 - DNA, 14 bp, Homo sapiens
atttaaaagcctgc

SEQ ID NO: 4689194 - DNA, 17 bp, Homo sapiens
atttaaagttgtataaa

SEQ ID NO: 4689195 - DNA, 21 bp, Homo sapiens
atttaaatacagtcttccatt

SEQ ID NO: 4689196 - DNA, 20 bp, Homo sapiens
atttaaatcctgaagagcat

SEQ ID NO: 4689197 - DNA, 14 bp, Homo sapiens
atttaaattgttat

SEQ ID NO: 4689198 - DNA, 19 bp, Homo sapiens
atttaaattgttataactt

SEQ ID NO: 4689199 - DNA, 21 bp, Homo sapiens
atttaaccataaatcaattca

SEQ ID NO: 4689200 - DNA, 16 bp, Homo sapiens
atttaagagacagtca

SEQ ID NO: 4689201 - DNA, 14 bp, Homo sapiens
atttaagcatgagt

SEQ ID NO: 4689202 - DNA, 20 bp, Homo sapiens
atttaagccttataaaccaa

SEQ ID NO: 4689203 - DNA, 22 bp, Homo sapiens
atttaagccttataaaccaatc

SEQ ID NO: 4689204 - DNA, 14 bp, Homo sapiens
atttaagtgcgtgt

SEQ ID NO: 4689205 - DNA, 19 bp, Homo sapiens
atttaagtgcgtgtgtaga

SEQ ID NO: 4689206 - DNA, 21 bp, Homo sapiens
atttaataaaataattctaaa

SEQ ID NO: 4689207 - DNA, 17 bp, Homo sapiens
atttaataacattacct

SEQ ID NO: 4689208 - DNA, 15 bp, Homo sapiens
atttaataatctgta

SEQ ID NO: 4689209 - DNA, 19 bp, Homo sapiens
atttaatactaattttcca

SEQ ID NO: 4689210 - DNA, 15 bp, Homo sapiens
atttaatcacagtca

SEQ ID NO: 4689211 - DNA, 24 bp, Homo sapiens
atttaattctttctattttcacaa

SEQ ID NO: 4689212 - DNA, 15 bp, Homo sapiens
atttaatttgaaggt

SEQ ID NO: 4689213 - DNA, 22 bp, Homo sapiens
atttaatttgaaggtagaatgt

SEQ ID NO: 4689214 - DNA, 18 bp, Homo sapiens
atttaatttgtatgctaa

SEQ ID NO: 4689215 - DNA, 19 bp, Homo sapiens
atttaatttttttgagaca

SEQ ID NO: 4689216 - DNA, 16 bp, Homo sapiens
atttacaaatgggaaa

SEQ ID NO: 4689217 - DNA, 11 bp, Homo sapiens
atttacattta

SEQ ID NO: 4689218 - DNA, 13 bp, Homo sapiens
atttacatttatc

SEQ ID NO: 4689219 - DNA, 14 bp, Homo sapiens
atttacatttatct

SEQ ID NO: 4689220 - DNA, 15 bp, Homo sapiens
atttactatttcaat

SEQ ID NO: 4689221 - DNA, 17 bp, Homo sapiens
atttactttttaaacag

SEQ ID NO: 4689222 - DNA, 20 bp, Homo sapiens
atttagcaatgctgtgaata

SEQ ID NO: 4689223 - DNA, 15 bp, Homo sapiens
atttagcccctctct

SEQ ID NO: 4689224 - DNA, 12 bp, Homo sapiens
atttaggagaag

SEQ ID NO: 4689225 - DNA, 17 bp, Homo sapiens
atttagtcccttaaaaa

SEQ ID NO: 4689226 - DNA, 19 bp, Homo sapiens
atttagttgtggaaagata

SEQ ID NO: 4689227 - DNA, 15 bp, Homo sapiens
atttagtttgattat

SEQ ID NO: 4689228 - DNA, 12 bp, Homo sapiens
atttataaagca

SEQ ID NO: 4689229 - DNA, 16 bp, Homo sapiens
atttatctattaaaat

SEQ ID NO: 4689230 - DNA, 23 bp, Homo sapiens
atttatggttgttaaaaatgtca

SEQ ID NO: 4689231 - DNA, 11 bp, Homo sapiens
atttattatgt

SEQ ID NO: 4689232 - DNA, 13 bp, Homo sapiens
atttattctgctc

SEQ ID NO: 4689233 - DNA, 14 bp, Homo sapiens
atttattctgctca

SEQ ID NO: 4689234 - DNA, 13 bp, Homo sapiens
atttattgaaatg

SEQ ID NO: 4689235 - DNA, 22 bp, Homo sapiens
atttattgaaatgatttcacag

SEQ ID NO: 4689236 - DNA, 14 bp, Homo sapiens
atttatttattcat

SEQ ID NO: 4689237 - DNA, 17 bp, Homo sapiens
atttattttttcttttc

SEQ ID NO: 4689238 - DNA, 22 bp, Homo sapiens
atttattttttcttttctttac

SEQ ID NO: 4689239 - DNA, 21 bp, Homo sapiens
atttcacccctccctttctcc

SEQ ID NO: 4689240 - DNA, 19 bp, Homo sapiens
atttcaggcattggatatt

SEQ ID NO: 4689241 - DNA, 19 bp, Homo sapiens
atttcatactgaaattatt

SEQ ID NO: 4689242 - DNA, 23 bp, Homo sapiens
atttcatactgaaattattttct

SEQ ID NO: 4689243 - DNA, 23 bp, Homo sapiens
atttcatactgtaacattcagga

SEQ ID NO: 4689244 - DNA, 20 bp, Homo sapiens
atttcatctgctctccttcc

SEQ ID NO: 4689245 - DNA, 21 bp, Homo sapiens
atttcatctgctctccttcct

SEQ ID NO: 4689246 - DNA, 22 bp, Homo sapiens
atttccactcaggtctgttttc

SEQ ID NO: 4689247 - DNA, 21 bp, Homo sapiens
atttcccgtggccccagcctg

SEQ ID NO: 4689248 - DNA, 23 bp, Homo sapiens
atttcccgtggccccagcctggc

SEQ ID NO: 4689249 - DNA, 21 bp, Homo sapiens
atttccttcaccacctcatgt

SEQ ID NO: 4689250 - DNA, 18 bp, Homo sapiens
atttcctttgcgcaaact

SEQ ID NO: 4689251 - DNA, 14 bp, Homo sapiens
atttcgatgtacag

SEQ ID NO: 4689252 - DNA, 13 bp, Homo sapiens
atttcgtgtaata

SEQ ID NO: 4689253 - DNA, 20 bp, Homo sapiens
atttcgtgtaatattctctg

SEQ ID NO: 4689254 - DNA, 18 bp, Homo sapiens
atttctactttgaagtca

SEQ ID NO: 4689255 - DNA, 14 bp, Homo sapiens
atttctatgtatgt

SEQ ID NO: 4689256 - DNA, 15 bp, Homo sapiens
atttctcatgttgaa

SEQ ID NO: 4689257 - DNA, 13 bp, Homo sapiens
atttcttaaacaa

SEQ ID NO: 4689258 - DNA, 22 bp, Homo sapiens
atttctttataaaatttactgt

SEQ ID NO: 4689259 - DNA, 17 bp, Homo sapiens
atttgaaaccaggacat

SEQ ID NO: 4689260 - DNA, 15 bp, Homo sapiens
atttgaccattcttt

SEQ ID NO: 4689261 - DNA, 14 bp, Homo sapiens
atttgagtgctctg

SEQ ID NO: 4689262 - DNA, 16 bp, Homo sapiens
atttgagtgctctgat

SEQ ID NO: 4689263 - DNA, 15 bp, Homo sapiens
atttgataacatttt

SEQ ID NO: 4689264 - DNA, 20 bp, Homo sapiens
atttgatagtattgtgcata

SEQ ID NO: 4689265 - DNA, 16 bp, Homo sapiens
atttgatatttgcatt

SEQ ID NO: 4689266 - DNA, 14 bp, Homo sapiens
atttgatatttggt

SEQ ID NO: 4689267 - DNA, 16 bp, Homo sapiens
atttgatatttggtta

SEQ ID NO: 4689268 - DNA, 15 bp, Homo sapiens
atttgcaagggaaaa

SEQ ID NO: 4689269 - DNA, 13 bp, Homo sapiens
atttggaaaataa

SEQ ID NO: 4689270 - DNA, 23 bp, Homo sapiens
atttgggtggtttttatttttat

SEQ ID NO: 4689271 - DNA, 20 bp, Homo sapiens
atttggtttggccatctctg

SEQ ID NO: 4689272 - DNA, 15 bp, Homo sapiens
atttgtaagtttcag

SEQ ID NO: 4689273 - DNA, 22 bp, Homo sapiens
atttgtagattaggattaaaat

SEQ ID NO: 4689274 - DNA, 21 bp, Homo sapiens
atttgtattgtacataaaatt

SEQ ID NO: 4689275 - DNA, 15 bp, Homo sapiens
atttgtcaacaaagt

SEQ ID NO: 4689276 - DNA, 22 bp, Homo sapiens
atttgtccattgtaaatctgaa

SEQ ID NO: 4689277 - DNA, 12 bp, Homo sapiens
atttgtgaagaa

SEQ ID NO: 4689278 - DNA, 12 bp, Homo sapiens
atttgtgaattt

SEQ ID NO: 4689279 - DNA, 15 bp, Homo sapiens
atttgtgaatttgca

SEQ ID NO: 4689280 - DNA, 16 bp, Homo sapiens
atttgtgctatttaat

SEQ ID NO: 4689281 - DNA, 22 bp, Homo sapiens
atttgttaaaaagactgttatt

SEQ ID NO: 4689282 - DNA, 20 bp, Homo sapiens
atttgttggtaactaatgtt

SEQ ID NO: 4689283 - DNA, 16 bp, Homo sapiens
atttgttgtcatgtgt

SEQ ID NO: 4689284 - DNA, 17 bp, Homo sapiens
atttgttgtcatgtgta

SEQ ID NO: 4689285 - DNA, 19 bp, Homo sapiens
atttgttttcccgccaagc

SEQ ID NO: 4689286 - DNA, 16 bp, Homo sapiens
atttgttttggatata

SEQ ID NO: 4689287 - DNA, 15 bp, Homo sapiens
attttaatcctgtac

SEQ ID NO: 4689288 - DNA, 17 bp, Homo sapiens
attttaatcctgtacca

SEQ ID NO: 4689289 - DNA, 21 bp, Homo sapiens
attttaatcctgtaccaaatc

SEQ ID NO: 4689290 - DNA, 22 bp, Homo sapiens
attttaatcctgtaccaaatct

SEQ ID NO: 4689291 - DNA, 23 bp, Homo sapiens
attttaatgaagaaagtggaaaa

SEQ ID NO: 4689292 - DNA, 20 bp, Homo sapiens
attttaatgggtttcccttg

SEQ ID NO: 4689293 - DNA, 22 bp, Homo sapiens
attttacaagggcataaagtaa

SEQ ID NO: 4689294 - DNA, 15 bp, Homo sapiens
attttagatgttatt

SEQ ID NO: 4689295 - DNA, 23 bp, Homo sapiens
attttagcatgatgaaactgtca

SEQ ID NO: 4689296 - DNA, 14 bp, Homo sapiens
attttaggaaattt

SEQ ID NO: 4689297 - DNA, 20 bp, Homo sapiens
attttaggaaatttaagact

SEQ ID NO: 4689298 - DNA, 13 bp, Homo sapiens
attttagtttata

SEQ ID NO: 4689299 - DNA, 18 bp, Homo sapiens
attttataaatttaagca

SEQ ID NO: 4689300 - DNA, 20 bp, Homo sapiens
attttatctttgattctcct

SEQ ID NO: 4689301 - DNA, 21 bp, Homo sapiens
attttatctttgattctcctt

SEQ ID NO: 4689302 - DNA, 22 bp, Homo sapiens
attttatctttgattctccttc

SEQ ID NO: 4689303 - DNA, 12 bp, Homo sapiens
attttatgatct

SEQ ID NO: 4689304 - DNA, 20 bp, Homo sapiens
attttattaaacattttcat

SEQ ID NO: 4689305 - DNA, 17 bp, Homo sapiens
attttcacaattattaa

SEQ ID NO: 4689306 - DNA, 19 bp, Homo sapiens
attttcagcatcaaacatg

SEQ ID NO: 4689307 - DNA, 22 bp, Homo sapiens
attttcataagtatttcaaatt

SEQ ID NO: 4689308 - DNA, 20 bp, Homo sapiens
attttcatgcacagtagatt

SEQ ID NO: 4689309 - DNA, 24 bp, Homo sapiens
attttcatgcacagtagattcaag

SEQ ID NO: 4689310 - DNA, 15 bp, Homo sapiens
attttccatgaaaat

SEQ ID NO: 4689311 - DNA, 17 bp, Homo sapiens
attttcctcattttgaa

SEQ ID NO: 4689312 - DNA, 17 bp, Homo sapiens
attttctataatttaaa

SEQ ID NO: 4689313 - DNA, 18 bp, Homo sapiens
attttctataatttaaat

SEQ ID NO: 4689314 - DNA, 22 bp, Homo sapiens
attttctccaaataaaaattag

SEQ ID NO: 4689315 - DNA, 20 bp, Homo sapiens
attttctgcccaactttcat

SEQ ID NO: 4689316 - DNA, 17 bp, Homo sapiens
attttctgtaaatgaag

SEQ ID NO: 4689317 - DNA, 18 bp, Homo sapiens
attttcttgtatgatagt

SEQ ID NO: 4689318 - DNA, 14 bp, Homo sapiens
attttcttgtcaat

SEQ ID NO: 4689319 - DNA, 22 bp, Homo sapiens
attttgaacctgatgaaaataa

SEQ ID NO: 4689320 - DNA, 16 bp, Homo sapiens
attttgagcaaagaaa

SEQ ID NO: 4689321 - DNA, 14 bp, Homo sapiens
attttgatgcacaa

SEQ ID NO: 4689322 - DNA, 18 bp, Homo sapiens
attttgcatatatgttct

SEQ ID NO: 4689323 - DNA, 22 bp, Homo sapiens
attttgcatatatgttcttcat

SEQ ID NO: 4689324 - DNA, 18 bp, Homo sapiens
attttggataatattcat

SEQ ID NO: 4689325 - DNA, 15 bp, Homo sapiens
attttggtttagtgc

SEQ ID NO: 4689326 - DNA, 17 bp, Homo sapiens
attttggttttgttccc

SEQ ID NO: 4689327 - DNA, 21 bp, Homo sapiens
attttggttttgttcccctcc

SEQ ID NO: 4689328 - DNA, 22 bp, Homo sapiens
attttggttttgttcccctcct

SEQ ID NO: 4689329 - DNA, 23 bp, Homo sapiens
attttggttttgttcccctcctc

SEQ ID NO: 4689330 - DNA, 16 bp, Homo sapiens
attttgtaattattgt

SEQ ID NO: 4689331 - DNA, 19 bp, Homo sapiens
attttgtattgtttcaatt

SEQ ID NO: 4689332 - DNA, 21 bp, Homo sapiens
attttgtgaagactgggaagt

SEQ ID NO: 4689333 - DNA, 13 bp, Homo sapiens
attttgtgaatgg

SEQ ID NO: 4689334 - DNA, 18 bp, Homo sapiens
attttgtgttgtacaatt

SEQ ID NO: 4689335 - DNA, 11 bp, Homo sapiens
attttgtttac

SEQ ID NO: 4689336 - DNA, 12 bp, Homo sapiens
attttgtttcaa

SEQ ID NO: 4689337 - DNA, 20 bp, Homo sapiens
atttttaaagaaaagttttg

SEQ ID NO: 4689338 - DNA, 15 bp, Homo sapiens
atttttaaagcatgg

SEQ ID NO: 4689339 - DNA, 14 bp, Homo sapiens
atttttacaaaact

SEQ ID NO: 4689340 - DNA, 14 bp, Homo sapiens
atttttagacagag

SEQ ID NO: 4689341 - DNA, 15 bp, Homo sapiens
atttttattatttgt

SEQ ID NO: 4689342 - DNA, 19 bp, Homo sapiens
atttttctaaagaaatata

SEQ ID NO: 4689343 - DNA, 12 bp, Homo sapiens
atttttgtgtat

SEQ ID NO: 4689344 - DNA, 21 bp, Homo sapiens
atttttgttaattttcctcat

SEQ ID NO: 4689345 - DNA, 21 bp, Homo sapiens
attttttttaagttcactttt

SEQ ID NO: 4689346 - DNA, 20 bp, Homo sapiens
caaaaacatgtttctgcctt

SEQ ID NO: 4689347 - DNA, 17 bp, Homo sapiens
caaaaagaaaaatcaaa

SEQ ID NO: 4689348 - DNA, 16 bp, Homo sapiens
caaaaagatgtatatt

SEQ ID NO: 4689349 - DNA, 16 bp, Homo sapiens
caaaaatagttaaaat

SEQ ID NO: 4689350 - DNA, 12 bp, Homo sapiens
caaaaatataaa

SEQ ID NO: 4689351 - DNA, 22 bp, Homo sapiens
caaaaattgcgagcctttaccc

SEQ ID NO: 4689352 - DNA, 20 bp, Homo sapiens
caaaacaggaggggaaaaaa

SEQ ID NO: 4689353 - DNA, 12 bp, Homo sapiens
caaaacatattt

SEQ ID NO: 4689354 - DNA, 20 bp, Homo sapiens
caaaacatattttacatctg

SEQ ID NO: 4689355 - DNA, 14 bp, Homo sapiens
caaaaccaggtaat

SEQ ID NO: 4689356 - DNA, 15 bp, Homo sapiens
caaaactctcctctg

SEQ ID NO: 4689357 - DNA, 23 bp, Homo sapiens
caaaactctcctctgctgctggc

SEQ ID NO: 4689358 - DNA, 11 bp, Homo sapiens
caaaactgcca

SEQ ID NO: 4689359 - DNA, 15 bp, Homo sapiens
caaaagaaatttaga

SEQ ID NO: 4689360 - DNA, 18 bp, Homo sapiens
caaaagcacttacttttt

SEQ ID NO: 4689361 - DNA, 11 bp, Homo sapiens
caaaagcaggc

SEQ ID NO: 4689362 - DNA, 15 bp, Homo sapiens
caaaagcccattcat

SEQ ID NO: 4689363 - DNA, 20 bp, Homo sapiens
caaaagcccattcattccat

SEQ ID NO: 4689364 - DNA, 22 bp, Homo sapiens
caaaagcccattcattccattc

SEQ ID NO: 4689365 - DNA, 14 bp, Homo sapiens
caaaagctgtgtct

SEQ ID NO: 4689366 - DNA, 15 bp, Homo sapiens
caaaagctgtgtctc

SEQ ID NO: 4689367 - DNA, 21 bp, Homo sapiens
caaaaggataatgaatacttt

SEQ ID NO: 4689368 - DNA, 11 bp, Homo sapiens
caaaagtctga

SEQ ID NO: 4689369 - DNA, 17 bp, Homo sapiens
caaaataaagtgtgtgt

SEQ ID NO: 4689370 - DNA, 20 bp, Homo sapiens
caaaatatattttgtttaca

SEQ ID NO: 4689371 - DNA, 10 bp, Homo sapiens
caaaatgttc

SEQ ID NO: 4689372 - DNA, 19 bp, Homo sapiens
caaaattaatatgattatt

SEQ ID NO: 4689373 - DNA, 14 bp, Homo sapiens
caaaatttctatta

SEQ ID NO: 4689374 - DNA, 13 bp, Homo sapiens
caaacaaaagcac

SEQ ID NO: 4689375 - DNA, 18 bp, Homo sapiens
caaacaaaatttctatta

SEQ ID NO: 4689376 - DNA, 24 bp, Homo sapiens
caaacaatagtaattctcaggcca

SEQ ID NO: 4689377 - DNA, 15 bp, Homo sapiens
caaacacctggactt

SEQ ID NO: 4689378 - DNA, 12 bp, Homo sapiens
caaacagtgaat

SEQ ID NO: 4689379 - DNA, 20 bp, Homo sapiens
caaacagtgaatttaagcat

SEQ ID NO: 4689380 - DNA, 19 bp, Homo sapiens
caaacatgtgcaactcttg

SEQ ID NO: 4689381 - DNA, 17 bp, Homo sapiens
caaaccactttttgcag

SEQ ID NO: 4689382 - DNA, 19 bp, Homo sapiens
caaaccactttttgcagct

SEQ ID NO: 4689383 - DNA, 12 bp, Homo sapiens
caaacctgcctg

SEQ ID NO: 4689384 - DNA, 14 bp, Homo sapiens
caaacctgcctggg

SEQ ID NO: 4689385 - DNA, 14 bp, Homo sapiens
caaactatgtaatg

SEQ ID NO: 4689386 - DNA, 13 bp, Homo sapiens
caaactcatcttg

SEQ ID NO: 4689387 - DNA, 16 bp, Homo sapiens
caaactcttaattaga

SEQ ID NO: 4689388 - DNA, 13 bp, Homo sapiens
caaacttctttca

SEQ ID NO: 4689389 - DNA, 14 bp, Homo sapiens
caaagaaaaacaat

SEQ ID NO: 4689390 - DNA, 22 bp, Homo sapiens
caaagaaaaacaatgaaattga

SEQ ID NO: 4689391 - DNA, 17 bp, Homo sapiens
caaagaaaactgcacaa

SEQ ID NO: 4689392 - DNA, 12 bp, Homo sapiens
caaagatgaaaa

SEQ ID NO: 4689393 - DNA, 21 bp, Homo sapiens
caaagccagcgtcctcctctg

SEQ ID NO: 4689394 - DNA, 13 bp, Homo sapiens
caaagcccagctt

SEQ ID NO: 4689395 - DNA, 14 bp, Homo sapiens
caaagctaggcctg

SEQ ID NO: 4689396 - DNA, 17 bp, Homo sapiens
caaagctaggcctggcc

SEQ ID NO: 4689397 - DNA, 23 bp, Homo sapiens
caaaggccatggagagctggagc

SEQ ID NO: 4689398 - DNA, 23 bp, Homo sapiens
caaaggctgagaacactgtgaaa

SEQ ID NO: 4689399 - DNA, 11 bp, Homo sapiens
caaaggctggg

SEQ ID NO: 4689400 - DNA, 22 bp, Homo sapiens
caaagggcatgggtcgggagag

SEQ ID NO: 4689401 - DNA, 21 bp, Homo sapiens
caaagggtatcaggtgctgcc

SEQ ID NO: 4689402 - DNA, 23 bp, Homo sapiens
caaagggtatcaggtgctgccat

SEQ ID NO: 4689403 - DNA, 14 bp, Homo sapiens
caaagtaaactgtg

SEQ ID NO: 4689404 - DNA, 15 bp, Homo sapiens
caaagtaaactgtgt

SEQ ID NO: 4689405 - DNA, 15 bp, Homo sapiens
caaagtatcaaagaa

SEQ ID NO: 4689406 - DNA, 12 bp, Homo sapiens
caaagtcattaa

SEQ ID NO: 4689407 - DNA, 20 bp, Homo sapiens
caaagtctgatttgtgatga

SEQ ID NO: 4689408 - DNA, 18 bp, Homo sapiens
caaagtgctgggattaca

SEQ ID NO: 4689409 - DNA, 15 bp, Homo sapiens
caaagtggaacgaaa

SEQ ID NO: 4689410 - DNA, 18 bp, Homo sapiens
caaagtggtatagaaatg

SEQ ID NO: 4689411 - DNA, 19 bp, Homo sapiens
caaagtggtatagaaatgc

SEQ ID NO: 4689412 - DNA, 16 bp, Homo sapiens
caaagtgtaagtttgt

SEQ ID NO: 4689413 - DNA, 17 bp, Homo sapiens
caaagttaaaagtaaaa

SEQ ID NO: 4689414 - DNA, 22 bp, Homo sapiens
caaagttaattgtatttatgta

SEQ ID NO: 4689415 - DNA, 13 bp, Homo sapiens
caaagttttgaaa

SEQ ID NO: 4689416 - DNA, 17 bp, Homo sapiens
caaataaacagtttgac

SEQ ID NO: 4689417 - DNA, 20 bp, Homo sapiens
caaataatgtctctgtgaga

SEQ ID NO: 4689418 - DNA, 18 bp, Homo sapiens
caaatactatccaaataa

SEQ ID NO: 4689419 - DNA, 19 bp, Homo sapiens
caaatactatccaaataaa

SEQ ID NO: 4689420 - DNA, 14 bp, Homo sapiens
caaatcaaagcaga

SEQ ID NO: 4689421 - DNA, 16 bp, Homo sapiens
caaatgcattcatgtt

SEQ ID NO: 4689422 - DNA, 23 bp, Homo sapiens
caaatggaaatgggcagagcaga

SEQ ID NO: 4689423 - DNA, 20 bp, Homo sapiens
caaatgtcacagtaatgcaa

SEQ ID NO: 4689424 - DNA, 16 bp, Homo sapiens
caaatgtgtataattt

SEQ ID NO: 4689425 - DNA, 17 bp, Homo sapiens
caaatgtgtataatttt

SEQ ID NO: 4689426 - DNA, 19 bp, Homo sapiens
caaatgtgtcccagtgaac

SEQ ID NO: 4689427 - DNA, 14 bp, Homo sapiens
caaattactccaag

SEQ ID NO: 4689428 - DNA, 14 bp, Homo sapiens
caaattatgtgaaa

SEQ ID NO: 4689429 - DNA, 19 bp, Homo sapiens
caaatttaaaactgttgga

SEQ ID NO: 4689430 - DNA, 14 bp, Homo sapiens
caaatttacattta

SEQ ID NO: 4689431 - DNA, 20 bp, Homo sapiens
caaatttacatttatctatt

SEQ ID NO: 4689432 - DNA, 16 bp, Homo sapiens
caaattttgaggtctt

SEQ ID NO: 4689433 - DNA, 19 bp, Homo sapiens
caaattttgaggtctttta

SEQ ID NO: 4689434 - DNA, 20 bp, Homo sapiens
caacaaagaaacaaagatgt

SEQ ID NO: 4689435 - DNA, 13 bp, Homo sapiens
caacaagctattt

SEQ ID NO: 4689436 - DNA, 19 bp, Homo sapiens
caacaatttctactttgaa

SEQ ID NO: 4689437 - DNA, 15 bp, Homo sapiens
caacactatatattt

SEQ ID NO: 4689438 - DNA, 14 bp, Homo sapiens
caacagaaaacaat

SEQ ID NO: 4689439 - DNA, 12 bp, Homo sapiens
caacaggctggg

SEQ ID NO: 4689440 - DNA, 13 bp, Homo sapiens
caacaggctgggc

SEQ ID NO: 4689441 - DNA, 15 bp, Homo sapiens
caacatactcccatc

SEQ ID NO: 4689442 - DNA, 17 bp, Homo sapiens
caacatactcccatctg

SEQ ID NO: 4689443 - DNA, 19 bp, Homo sapiens
caacatggatacatatttc

SEQ ID NO: 4689444 - DNA, 16 bp, Homo sapiens
caacatggtgtctgga

SEQ ID NO: 4689445 - DNA, 13 bp, Homo sapiens
caacatgtataat

SEQ ID NO: 4689446 - DNA, 17 bp, Homo sapiens
caacatgtatgtggata

SEQ ID NO: 4689447 - DNA, 20 bp, Homo sapiens
caacattaaggcagtatgat

SEQ ID NO: 4689448 - DNA, 17 bp, Homo sapiens
caacattgttcattctt

SEQ ID NO: 4689449 - DNA, 22 bp, Homo sapiens
caacatttctcatgttgaaact

SEQ ID NO: 4689450 - DNA, 14 bp, Homo sapiens
caacccagccgctg

SEQ ID NO: 4689451 - DNA, 18 bp, Homo sapiens
caacccagccgctgcccg

SEQ ID NO: 4689452 - DNA, 22 bp, Homo sapiens
caacccaggagcatccacctcc

SEQ ID NO: 4689453 - DNA, 15 bp, Homo sapiens
caacccccagcaccc

SEQ ID NO: 4689454 - DNA, 14 bp, Homo sapiens
caacccccagcctg

SEQ ID NO: 4689455 - DNA, 18 bp, Homo sapiens
caaccccttcgctcctgt

SEQ ID NO: 4689456 - DNA, 14 bp, Homo sapiens
caacctcctgggct

SEQ ID NO: 4689457 - DNA, 20 bp, Homo sapiens
caacctggggggcagtggtg

SEQ ID NO: 4689458 - DNA, 17 bp, Homo sapiens
caaccttagatgttcta

SEQ ID NO: 4689459 - DNA, 18 bp, Homo sapiens
caactaatttttgtattt

SEQ ID NO: 4689460 - DNA, 18 bp, Homo sapiens
caactatgatttggaaaa

SEQ ID NO: 4689461 - DNA, 13 bp, Homo sapiens
caactgggtcatg

SEQ ID NO: 4689462 - DNA, 21 bp, Homo sapiens
caactggttgtatatttttat

SEQ ID NO: 4689463 - DNA, 19 bp, Homo sapiens
caagaaaacaggcactgcc

SEQ ID NO: 4689464 - DNA, 23 bp, Homo sapiens
caagaaaacaggcactgccctgg

SEQ ID NO: 4689465 - DNA, 13 bp, Homo sapiens
caagaagcaggct

SEQ ID NO: 4689466 - DNA, 14 bp, Homo sapiens
caagaagcaggcta

SEQ ID NO: 4689467 - DNA, 15 bp, Homo sapiens
caagaagcccaggaa

SEQ ID NO: 4689468 - DNA, 19 bp, Homo sapiens
caagacccttgtggtccca

SEQ ID NO: 4689469 - DNA, 23 bp, Homo sapiens
caagacccttgtggtcccacccc

SEQ ID NO: 4689470 - DNA, 20 bp, Homo sapiens
caagaccttcaccaaacata

SEQ ID NO: 4689471 - DNA, 14 bp, Homo sapiens
caagaccttctcct

SEQ ID NO: 4689472 - DNA, 23 bp, Homo sapiens
caagaccttctccttcacctttg

SEQ ID NO: 4689473 - DNA, 15 bp, Homo sapiens
caagacgctgtgctg

SEQ ID NO: 4689474 - DNA, 16 bp, Homo sapiens
caagacgctgtgctgc

SEQ ID NO: 4689475 - DNA, 13 bp, Homo sapiens
caagagcacactt

SEQ ID NO: 4689476 - DNA, 18 bp, Homo sapiens
caagagcttccagagctc

SEQ ID NO: 4689477 - DNA, 14 bp, Homo sapiens
caagaggagatcca

SEQ ID NO: 4689478 - DNA, 19 bp, Homo sapiens
caagagggacgcctggggg

SEQ ID NO: 4689479 - DNA, 23 bp, Homo sapiens
caagatattttaaaatctgtcac

SEQ ID NO: 4689480 - DNA, 15 bp, Homo sapiens
caagattttaaaagt

SEQ ID NO: 4689481 - DNA, 21 bp, Homo sapiens
caagcaaagtatcaaagaaaa

SEQ ID NO: 4689482 - DNA, 23 bp, Homo sapiens
caagcaagctcccaagggatggt

SEQ ID NO: 4689483 - DNA, 13 bp, Homo sapiens
caagcacctcctg

SEQ ID NO: 4689484 - DNA, 17 bp, Homo sapiens
caagcacctcctgcctc

SEQ ID NO: 4689485 - DNA, 17 bp, Homo sapiens
caagcactaaacaaaga

SEQ ID NO: 4689486 - DNA, 17 bp, Homo sapiens
caagcactgtgctcagg

SEQ ID NO: 4689487 - DNA, 23 bp, Homo sapiens
caagcaggaaatgaaaatgtctt

SEQ ID NO: 4689488 - DNA, 21 bp, Homo sapiens
caagcatttaatgtagccatg

SEQ ID NO: 4689489 - DNA, 22 bp, Homo sapiens
caagcatttaatgtagccatgg

SEQ ID NO: 4689490 - DNA, 21 bp, Homo sapiens
caagccaccaacatactccca

SEQ ID NO: 4689491 - DNA, 17 bp, Homo sapiens
caagcccagcactgctt

SEQ ID NO: 4689492 - DNA, 17 bp, Homo sapiens
caagcgattcttctgct

SEQ ID NO: 4689493 - DNA, 17 bp, Homo sapiens
caagctccaagctccca

SEQ ID NO: 4689494 - DNA, 21 bp, Homo sapiens
caagctccaagctcccaggca

SEQ ID NO: 4689495 - DNA, 13 bp, Homo sapiens
caagctcccaagg

SEQ ID NO: 4689496 - DNA, 12 bp, Homo sapiens
caagctcccagg

SEQ ID NO: 4689497 - DNA, 14 bp, Homo sapiens
caagctcccaggca

SEQ ID NO: 4689498 - DNA, 15 bp, Homo sapiens
caagctcccaggcat

SEQ ID NO: 4689499 - DNA, 17 bp, Homo sapiens
caagctcccaggcattc

SEQ ID NO: 4689500 - DNA, 17 bp, Homo sapiens
caagctggtcccactca

SEQ ID NO: 4689501 - DNA, 15 bp, Homo sapiens
caagctgtgccaccc

SEQ ID NO: 4689502 - DNA, 17 bp, Homo sapiens
caagctgtgccaccctg

SEQ ID NO: 4689503 - DNA, 19 bp, Homo sapiens
caagctgtgccaccctggg

SEQ ID NO: 4689504 - DNA, 18 bp, Homo sapiens
caaggaaaaaataacaat

SEQ ID NO: 4689505 - DNA, 20 bp, Homo sapiens
caaggaaaaaataacaatga

SEQ ID NO: 4689506 - DNA, 18 bp, Homo sapiens
caaggaaaccacagctgc

SEQ ID NO: 4689507 - DNA, 21 bp, Homo sapiens
caaggactagggtcctgggga

SEQ ID NO: 4689508 - DNA, 19 bp, Homo sapiens
caaggatgccccgtccccc

SEQ ID NO: 4689509 - DNA, 19 bp, Homo sapiens
caaggattgctactgtcct

SEQ ID NO: 4689510 - DNA, 20 bp, Homo sapiens
caaggattgctactgtccta

SEQ ID NO: 4689511 - DNA, 14 bp, Homo sapiens
caaggcactgcctg

SEQ ID NO: 4689512 - DNA, 15 bp, Homo sapiens
caaggcctcccacag

SEQ ID NO: 4689513 - DNA, 15 bp, Homo sapiens
caagggaaaagtctc

SEQ ID NO: 4689514 - DNA, 12 bp, Homo sapiens
caagggcagagg

SEQ ID NO: 4689515 - DNA, 15 bp, Homo sapiens
caagggcctggcctg

SEQ ID NO: 4689516 - DNA, 16 bp, Homo sapiens
caagggcctggcctga

SEQ ID NO: 4689517 - DNA, 19 bp, Homo sapiens
caagggcctggcctgagct

SEQ ID NO: 4689518 - DNA, 22 bp, Homo sapiens
caaggggtggccgtcctgaggg

SEQ ID NO: 4689519 - DNA, 18 bp, Homo sapiens
caagggtagggtgggcct

SEQ ID NO: 4689520 - DNA, 19 bp, Homo sapiens
caagggtagggtgggcctt

SEQ ID NO: 4689521 - DNA, 15 bp, Homo sapiens
caagtgagagctggg

SEQ ID NO: 4689522 - DNA, 10 bp, Homo sapiens
caagtgagtg

SEQ ID NO: 4689523 - DNA, 17 bp, Homo sapiens
caagtgattctcatgcc

SEQ ID NO: 4689524 - DNA, 20 bp, Homo sapiens
atgcagagagccattttgtg

SEQ ID NO: 4689525 - DNA, 21 bp, Homo sapiens
atgcagagagccattttgtga

SEQ ID NO: 4689526 - DNA, 17 bp, Homo sapiens
atgcagaggaggagaaa

SEQ ID NO: 4689527 - DNA, 17 bp, Homo sapiens
atgcagaggtccacaac

SEQ ID NO: 4689528 - DNA, 14 bp, Homo sapiens
atgcagcctcacag

SEQ ID NO: 4689529 - DNA, 18 bp, Homo sapiens
atgcagcctcacagtcct

SEQ ID NO: 4689530 - DNA, 13 bp, Homo sapiens
atgcagcgtgaag

SEQ ID NO: 4689531 - DNA, 15 bp, Homo sapiens
atgcagtattgagca

SEQ ID NO: 4689532 - DNA, 22 bp, Homo sapiens
atgcagtgatatggcagaagac

SEQ ID NO: 4689533 - DNA, 18 bp, Homo sapiens
atgcagtgcccctagctt

SEQ ID NO: 4689534 - DNA, 23 bp, Homo sapiens
atgcagtggtatgatcacggctc

SEQ ID NO: 4689535 - DNA, 14 bp, Homo sapiens
atgcataaatatgc

SEQ ID NO: 4689536 - DNA, 15 bp, Homo sapiens
atgcataaatatgca

SEQ ID NO: 4689537 - DNA, 17 bp, Homo sapiens
atgcataaatatgcagt

SEQ ID NO: 4689538 - DNA, 19 bp, Homo sapiens
atgcatataatgaataaat

SEQ ID NO: 4689539 - DNA, 12 bp, Homo sapiens
atgcatatttgc

SEQ ID NO: 4689540 - DNA, 17 bp, Homo sapiens
atgcatatttgcaaagt

SEQ ID NO: 4689541 - DNA, 22 bp, Homo sapiens
atgcatcccaccttgccaaagc

SEQ ID NO: 4689542 - DNA, 21 bp, Homo sapiens
atgcatgcccttcctttctat

SEQ ID NO: 4689543 - DNA, 16 bp, Homo sapiens
atgccaagcactgtgc

SEQ ID NO: 4689544 - DNA, 21 bp, Homo sapiens
atgccaagcactgtgctcagg

SEQ ID NO: 4689545 - DNA, 17 bp, Homo sapiens
atgccacaccaagctgt

SEQ ID NO: 4689546 - DNA, 22 bp, Homo sapiens
atgccacaccaagctgtgccac

SEQ ID NO: 4689547 - DNA, 23 bp, Homo sapiens
atgccacaccaagctgtgccacc

SEQ ID NO: 4689548 - DNA, 20 bp, Homo sapiens
atgccagtaggctcaactag

SEQ ID NO: 4689549 - DNA, 16 bp, Homo sapiens
atgccatcatctcctg

SEQ ID NO: 4689550 - DNA, 18 bp, Homo sapiens
atgccccctcgtgccagt

SEQ ID NO: 4689551 - DNA, 16 bp, Homo sapiens
atgcctcagcctcctg

SEQ ID NO: 4689552 - DNA, 12 bp, Homo sapiens
atgcctggtggc

SEQ ID NO: 4689553 - DNA, 14 bp, Homo sapiens
atgcctggtggcag

SEQ ID NO: 4689554 - DNA, 18 bp, Homo sapiens
atgcctggtggcagctgc

SEQ ID NO: 4689555 - DNA, 13 bp, Homo sapiens
atgcctttgagac

SEQ ID NO: 4689556 - DNA, 16 bp, Homo sapiens
atgcctttgagacagt

SEQ ID NO: 4689557 - DNA, 21 bp, Homo sapiens
atgcctttgagacagtttctt

SEQ ID NO: 4689558 - DNA, 22 bp, Homo sapiens
atgcctttgagacagtttctta

SEQ ID NO: 4689559 - DNA, 13 bp, Homo sapiens
atgcgcaggctgg

SEQ ID NO: 4689560 - DNA, 20 bp, Homo sapiens
atgcgcaggctggccctgcc

SEQ ID NO: 4689561 - DNA, 22 bp, Homo sapiens
atgcgcaggctggccctgccct

SEQ ID NO: 4689562 - DNA, 23 bp, Homo sapiens
atgcgcaggctggccctgccctg

SEQ ID NO: 4689563 - DNA, 15 bp, Homo sapiens
atgcggtctagggaa

SEQ ID NO: 4689564 - DNA, 18 bp, Homo sapiens
atgcgtatttgcatttgg

SEQ ID NO: 4689565 - DNA, 23 bp, Homo sapiens
atgctaaaggttgtattgcatat

SEQ ID NO: 4689566 - DNA, 19 bp, Homo sapiens
atgctaccatgcctctcca

SEQ ID NO: 4689567 - DNA, 15 bp, Homo sapiens
atgctccttgggccc

SEQ ID NO: 4689568 - DNA, 13 bp, Homo sapiens
atgctcggctttt

SEQ ID NO: 4689569 - DNA, 19 bp, Homo sapiens
atgctcgtcatacagtaaa

SEQ ID NO: 4689570 - DNA, 20 bp, Homo sapiens
atgctctcatatatatttta

SEQ ID NO: 4689571 - DNA, 18 bp, Homo sapiens
atgctctgtcttcaatga

SEQ ID NO: 4689572 - DNA, 16 bp, Homo sapiens
atgctcttagaaaatt

SEQ ID NO: 4689573 - DNA, 21 bp, Homo sapiens
atgctgcccagggtcagtgta

SEQ ID NO: 4689574 - DNA, 23 bp, Homo sapiens
atgctgcctgggagccagggtga

SEQ ID NO: 4689575 - DNA, 20 bp, Homo sapiens
atgctggctgttggctgggg

SEQ ID NO: 4689576 - DNA, 22 bp, Homo sapiens
atgctggctgttggctgggggc

SEQ ID NO: 4689577 - DNA, 12 bp, Homo sapiens
atgctgggctgg

SEQ ID NO: 4689578 - DNA, 17 bp, Homo sapiens
atgctgtgtaacagaac

SEQ ID NO: 4689579 - DNA, 17 bp, Homo sapiens
atgcttatgcttgtgta

SEQ ID NO: 4689580 - DNA, 23 bp, Homo sapiens
atgcttctttctactttgtttat

SEQ ID NO: 4689581 - DNA, 17 bp, Homo sapiens
atgcttgccaagaaatc

SEQ ID NO: 4689582 - DNA, 15 bp, Homo sapiens
atgcttggttttctt

SEQ ID NO: 4689583 - DNA, 21 bp, Homo sapiens
atgcttgtgtatatgtataaa

SEQ ID NO: 4689584 - DNA, 13 bp, Homo sapiens
atggaaacactga

SEQ ID NO: 4689585 - DNA, 17 bp, Homo sapiens
atggaaacactgatttt

SEQ ID NO: 4689586 - DNA, 14 bp, Homo sapiens
atggaaaggaagaa

SEQ ID NO: 4689587 - DNA, 19 bp, Homo sapiens
atggaaatgggcagagcag

SEQ ID NO: 4689588 - DNA, 14 bp, Homo sapiens
atggaagacacatt

SEQ ID NO: 4689589 - DNA, 13 bp, Homo sapiens
atggaatgcttct

SEQ ID NO: 4689590 - DNA, 13 bp, Homo sapiens
atggacaatggac

SEQ ID NO: 4689591 - DNA, 19 bp, Homo sapiens
atggacagaagaaggcagc

SEQ ID NO: 4689592 - DNA, 18 bp, Homo sapiens
atggacatcgatatgaaa

SEQ ID NO: 4689593 - DNA, 19 bp, Homo sapiens
atggacatcgatatgaaaa

SEQ ID NO: 4689594 - DNA, 14 bp, Homo sapiens
atggacctgtcacg

SEQ ID NO: 4689595 - DNA, 20 bp, Homo sapiens
atggacggtgctccaggcag

SEQ ID NO: 4689596 - DNA, 17 bp, Homo sapiens
atgtggatacagtcatt

SEQ ID NO: 4689597 - DNA, 18 bp, Homo sapiens
atgtggatacagtcatta

SEQ ID NO: 4689598 - DNA, 18 bp, Homo sapiens
atgtggcaggagggcagt

SEQ ID NO: 4689599 - DNA, 20 bp, Homo sapiens
atgtgggctagttgggcttc

SEQ ID NO: 4689600 - DNA, 16 bp, Homo sapiens
atgtgggtcaaggaat

SEQ ID NO: 4689601 - DNA, 15 bp, Homo sapiens
atgtgggtccctctc

SEQ ID NO: 4689602 - DNA, 18 bp, Homo sapiens
atgtgggttgtgatattg

SEQ ID NO: 4689603 - DNA, 17 bp, Homo sapiens
atgtgtaaatgttatga

SEQ ID NO: 4689604 - DNA, 22 bp, Homo sapiens
atgtgtcccagtgaacagtttg

SEQ ID NO: 4689605 - DNA, 16 bp, Homo sapiens
atgtgtctgcaacatg

SEQ ID NO: 4689606 - DNA, 17 bp, Homo sapiens
atgtgtgctcttcttct

SEQ ID NO: 4689607 - DNA, 12 bp, Homo sapiens
atgtgtggtttc

SEQ ID NO: 4689608 - DNA, 16 bp, Homo sapiens
atgtgtggtttcagtt

SEQ ID NO: 4689609 - DNA, 17 bp, Homo sapiens
atgtgtggtttcagttc

SEQ ID NO: 4689610 - DNA, 15 bp, Homo sapiens
atgtgtgttgatact

SEQ ID NO: 4689611 - DNA, 18 bp, Homo sapiens
atgtgtgttgatactgtt

SEQ ID NO: 4689612 - DNA, 22 bp, Homo sapiens
atgtgtgttgatactgttgcac

SEQ ID NO: 4689613 - DNA, 20 bp, Homo sapiens
atgtgttgacgtaagctcta

SEQ ID NO: 4689614 - DNA, 23 bp, Homo sapiens
atgtgttgataattttttaatta

SEQ ID NO: 4689615 - DNA, 12 bp, Homo sapiens
atgttaaatttg

SEQ ID NO: 4689616 - DNA, 15 bp, Homo sapiens
atgttaaatttgtaa

SEQ ID NO: 4689617 - DNA, 17 bp, Homo sapiens
atgttaaatttgtaagt

SEQ ID NO: 4689618 - DNA, 18 bp, Homo sapiens
atgttaaggaaactctta

SEQ ID NO: 4689619 - DNA, 13 bp, Homo sapiens
atgttaatatttc

SEQ ID NO: 4689620 - DNA, 21 bp, Homo sapiens
atgttagtattttaatcctgt

SEQ ID NO: 4689621 - DNA, 14 bp, Homo sapiens
atgttagtcaagga

SEQ ID NO: 4689622 - DNA, 14 bp, Homo sapiens
atgttattatgcta

SEQ ID NO: 4689623 - DNA, 16 bp, Homo sapiens
atgttattatgctaat

SEQ ID NO: 4689624 - DNA, 15 bp, Homo sapiens
atgttcaatctgtgt

SEQ ID NO: 4689625 - DNA, 18 bp, Homo sapiens
atgttcacttttgacaaa

SEQ ID NO: 4689626 - DNA, 20 bp, Homo sapiens
atgttcacttttgacaaagg

SEQ ID NO: 4689627 - DNA, 19 bp, Homo sapiens
atgttcagacatttatgtg

SEQ ID NO: 4689628 - DNA, 18 bp, Homo sapiens
atgttctaagtctttcca

SEQ ID NO: 4689629 - DNA, 20 bp, Homo sapiens
atgttctattttttgttttg

SEQ ID NO: 4689630 - DNA, 17 bp, Homo sapiens
atgttctctgaggacac

SEQ ID NO: 4689631 - DNA, 13 bp, Homo sapiens
atgttgaatgtat

SEQ ID NO: 4689632 - DNA, 14 bp, Homo sapiens
atgttgaatgtatt

SEQ ID NO: 4689633 - DNA, 14 bp, Homo sapiens
atgttgcactgaaa

SEQ ID NO: 4689634 - DNA, 20 bp, Homo sapiens
atgttgcccaggcaggtctt

SEQ ID NO: 4689635 - DNA, 13 bp, Homo sapiens
atgttggccaggc

SEQ ID NO: 4689636 - DNA, 18 bp, Homo sapiens
atctgatggcttctccag

SEQ ID NO: 4689637 - DNA, 17 bp, Homo sapiens
atctgcagtacagtctt

SEQ ID NO: 4689638 - DNA, 16 bp, Homo sapiens
atctgcccctccctgc

SEQ ID NO: 4689639 - DNA, 16 bp, Homo sapiens
atctgctagtgctgta

SEQ ID NO: 4689640 - DNA, 17 bp, Homo sapiens
atctgctagtgctgtaa

SEQ ID NO: 4689641 - DNA, 14 bp, Homo sapiens
atctgctctccttc

SEQ ID NO: 4689642 - DNA, 17 bp, Homo sapiens
atctgctctccttcctg

SEQ ID NO: 4689643 - DNA, 20 bp, Homo sapiens
atctgctctccttcctggag

SEQ ID NO: 4689644 - DNA, 23 bp, Homo sapiens
atctggagagctagaacctggag

SEQ ID NO: 4689645 - DNA, 19 bp, Homo sapiens
atctgggttcactgcaacc

SEQ ID NO: 4689646 - DNA, 10 bp, Homo sapiens
atctggtgac

SEQ ID NO: 4689647 - DNA, 16 bp, Homo sapiens
atctggtgactttcct

SEQ ID NO: 4689648 - DNA, 15 bp, Homo sapiens
atctgtcactgacct

SEQ ID NO: 4689649 - DNA, 18 bp, Homo sapiens
atctgtgccatacttgtt

SEQ ID NO: 4689650 - DNA, 19 bp, Homo sapiens
atctgtggattcagcttct

SEQ ID NO: 4689651 - DNA, 13 bp, Homo sapiens
atctgtgtcttgt

SEQ ID NO: 4689652 - DNA, 14 bp, Homo sapiens
atctgtgtcttgtt

SEQ ID NO: 4689653 - DNA, 15 bp, Homo sapiens
atctgtgtcttgttt

SEQ ID NO: 4689654 - DNA, 13 bp, Homo sapiens
atctgtttcccag

SEQ ID NO: 4689655 - DNA, 14 bp, Homo sapiens
atctgtttcccagc

SEQ ID NO: 4689656 - DNA, 21 bp, Homo sapiens
atcttaagagtgctaaatttt

SEQ ID NO: 4689657 - DNA, 16 bp, Homo sapiens
atcttcacctcagagt

SEQ ID NO: 4689658 - DNA, 18 bp, Homo sapiens
atcttcacctcagagtgg

SEQ ID NO: 4689659 - DNA, 23 bp, Homo sapiens
atcttctgctaaatttttgttgg

SEQ ID NO: 4689660 - DNA, 12 bp, Homo sapiens
atcttgaaggaa

SEQ ID NO: 4689661 - DNA, 15 bp, Homo sapiens
atcttgctctgctga

SEQ ID NO: 4689662 - DNA, 19 bp, Homo sapiens
atcttgctctgctgacaga

SEQ ID NO: 4689663 - DNA, 15 bp, Homo sapiens
atcttgtgtatggat

SEQ ID NO: 4689664 - DNA, 12 bp, Homo sapiens
atctttccagtt

SEQ ID NO: 4689665 - DNA, 14 bp, Homo sapiens
atctttctaaaact

SEQ ID NO: 4689666 - DNA, 15 bp, Homo sapiens
atctttgattctcct

SEQ ID NO: 4689667 - DNA, 17 bp, Homo sapiens
atctttgattctccttc

SEQ ID NO: 4689668 - DNA, 15 bp, Homo sapiens
atcttttcacaaata

SEQ ID NO: 4689669 - DNA, 16 bp, Homo sapiens
atcttttcacaaataa

SEQ ID NO: 4689670 - DNA, 14 bp, Homo sapiens
atcttttcttgcct

SEQ ID NO: 4689671 - DNA, 16 bp, Homo sapiens
atgaaaaaatgtatat

SEQ ID NO: 4689672 - DNA, 11 bp, Homo sapiens
atgaaaacaag

SEQ ID NO: 4689673 - DNA, 14 bp, Homo sapiens
atgaaaatgtcttg

SEQ ID NO: 4689674 - DNA, 16 bp, Homo sapiens
atgaaaatgtcttgtg

SEQ ID NO: 4689675 - DNA, 18 bp, Homo sapiens
atgaaatcttacagctgg

SEQ ID NO: 4689676 - DNA, 20 bp, Homo sapiens
atgaaccacatcttgctctg

SEQ ID NO: 4689677 - DNA, 17 bp, Homo sapiens
atgaaccgctgaatatg

SEQ ID NO: 4689678 - DNA, 20 bp, Homo sapiens
atgaaccttgctatcaagaa

SEQ ID NO: 4689679 - DNA, 21 bp, Homo sapiens
atgaagttgattcatattgca

SEQ ID NO: 4689680 - DNA, 22 bp, Homo sapiens
atgaagttgattcatattgcat

SEQ ID NO: 4689681 - DNA, 23 bp, Homo sapiens
atgaagttgattcatattgcatc

SEQ ID NO: 4689682 - DNA, 23 bp, Homo sapiens
atgaagtttccttggctggtgca

SEQ ID NO: 4689683 - DNA, 19 bp, Homo sapiens
atgacaactggaatagttt

SEQ ID NO: 4689684 - DNA, 22 bp, Homo sapiens
atgacagatatatttaagcctt

SEQ ID NO: 4689685 - DNA, 15 bp, Homo sapiens
atgacagccaccctc

SEQ ID NO: 4689686 - DNA, 12 bp, Homo sapiens
atgacccaggct

SEQ ID NO: 4689687 - DNA, 15 bp, Homo sapiens
atgacccaggctggg

SEQ ID NO: 4689688 - DNA, 22 bp, Homo sapiens
atgacccaggctgggcaaggag

SEQ ID NO: 4689689 - DNA, 16 bp, Homo sapiens
atgacctacagtgctg

SEQ ID NO: 4689690 - DNA, 21 bp, Homo sapiens
atgacctacagtgctgtgtac

SEQ ID NO: 4689691 - DNA, 17 bp, Homo sapiens
atgaccttctaggaagc

SEQ ID NO: 4689692 - DNA, 18 bp, Homo sapiens
atgaccttctaggaagct

SEQ ID NO: 4689693 - DNA, 13 bp, Homo sapiens
atgactgtagaat

SEQ ID NO: 4689694 - DNA, 13 bp, Homo sapiens
atgagaacatggt

SEQ ID NO: 4689695 - DNA, 14 bp, Homo sapiens
atgagagagagaaa

SEQ ID NO: 4689696 - DNA, 13 bp, Homo sapiens
atgagagcataat

SEQ ID NO: 4689697 - DNA, 14 bp, Homo sapiens
atgagagcccagag

SEQ ID NO: 4689698 - DNA, 18 bp, Homo sapiens
atgagagggccctgcctg

SEQ ID NO: 4689699 - DNA, 18 bp, Homo sapiens
atgagcatcaggccaggc

SEQ ID NO: 4689700 - DNA, 19 bp, Homo sapiens
atgagcatcaggccaggcc

SEQ ID NO: 4689701 - DNA, 21 bp, Homo sapiens
atgagcatcaggccaggccct

SEQ ID NO: 4689702 - DNA, 17 bp, Homo sapiens
atgagcatggagctggc

SEQ ID NO: 4689703 - DNA, 12 bp, Homo sapiens
atgagcctcagc

SEQ ID NO: 4689704 - DNA, 18 bp, Homo sapiens
atgagcctcagcatcctg

SEQ ID NO: 4689705 - DNA, 23 bp, Homo sapiens
atgagctacttcttattcacttt

SEQ ID NO: 4689706 - DNA, 18 bp, Homo sapiens
atgaggaacaatcacaaa

SEQ ID NO: 4689707 - DNA, 21 bp, Homo sapiens
atgaggaacaatcacaaaagc

SEQ ID NO: 4689708 - DNA, 14 bp, Homo sapiens
atgaggccctccac

SEQ ID NO: 4689709 - DNA, 19 bp, Homo sapiens
atgaggccctccacacctg

SEQ ID NO: 4689710 - DNA, 15 bp, Homo sapiens
atgaggtcagagcct

SEQ ID NO: 4689711 - DNA, 19 bp, Homo sapiens
atgaggtcagagcctgcag

SEQ ID NO: 4689712 - DNA, 20 bp, Homo sapiens
ctccgcacacctctggctgt

SEQ ID NO: 4689713 - DNA, 20 bp, Homo sapiens
ctccgctttctacccagcga

SEQ ID NO: 4689714 - DNA, 23 bp, Homo sapiens
ctccgtgaaaatatgtttggaat

SEQ ID NO: 4689715 - DNA, 19 bp, Homo sapiens
ctcctacaaccaggtcttg

SEQ ID NO: 4689716 - DNA, 16 bp, Homo sapiens
ctcctacacctaactc

SEQ ID NO: 4689717 - DNA, 14 bp, Homo sapiens
ctcctacccctccc

SEQ ID NO: 4689718 - DNA, 18 bp, Homo sapiens
ctcctacccctcccagct

SEQ ID NO: 4689719 - DNA, 23 bp, Homo sapiens
ctcctacccctcccagctgacag

SEQ ID NO: 4689720 - DNA, 21 bp, Homo sapiens
ctcctcacaacatggtgtctg

SEQ ID NO: 4689721 - DNA, 18 bp, Homo sapiens
ctcctcagggttgaggtc

SEQ ID NO: 4689722 - DNA, 23 bp, Homo sapiens
ctcctcagggttgaggtccagcc

SEQ ID NO: 4689723 - DNA, 13 bp, Homo sapiens
ctcctccaccgcc

SEQ ID NO: 4689724 - DNA, 18 bp, Homo sapiens
ctcctccaccgccatggc

SEQ ID NO: 4689725 - DNA, 19 bp, Homo sapiens
ctcctccaccgccatggct

SEQ ID NO: 4689726 - DNA, 18 bp, Homo sapiens
ctcctccatgggagaaaa

SEQ ID NO: 4689727 - DNA, 13 bp, Homo sapiens
ctcctccgtggca

SEQ ID NO: 4689728 - DNA, 16 bp, Homo sapiens
ctcctccgtggcacat

SEQ ID NO: 4689729 - DNA, 13 bp, Homo sapiens
ctcctccttttcc

SEQ ID NO: 4689730 - DNA, 12 bp, Homo sapiens
ctcctctcccct

SEQ ID NO: 4689731 - DNA, 14 bp, Homo sapiens
ctcctctctgccct

SEQ ID NO: 4689732 - DNA, 18 bp, Homo sapiens
ctcctctgactcagggct

SEQ ID NO: 4689733 - DNA, 19 bp, Homo sapiens
ctcctctgactcagggctc

SEQ ID NO: 4689734 - DNA, 22 bp, Homo sapiens
ctcctctgactcagggctcctg

SEQ ID NO: 4689735 - DNA, 13 bp, Homo sapiens
ctcctctgctgct

SEQ ID NO: 4689736 - DNA, 15 bp, Homo sapiens
ctcctctgctgctgg

SEQ ID NO: 4689737 - DNA, 22 bp, Homo sapiens
ctcctctgtgaccaatgtcttg

SEQ ID NO: 4689738 - DNA, 23 bp, Homo sapiens
ctcctctgtgaccaatgtcttga

SEQ ID NO: 4689739 - DNA, 14 bp, Homo sapiens
ctcctgaccttagg

SEQ ID NO: 4689740 - DNA, 12 bp, Homo sapiens
ctcctgcaggca

SEQ ID NO: 4689741 - DNA, 15 bp, Homo sapiens
ctcctgcaggcagcc

SEQ ID NO: 4689742 - DNA, 17 bp, Homo sapiens
ctcctgcaggcagccag

SEQ ID NO: 4689743 - DNA, 20 bp, Homo sapiens
ctcctgcaggcagccaggcc

SEQ ID NO: 4689744 - DNA, 18 bp, Homo sapiens
ctcctgccgcagagctgg

SEQ ID NO: 4689745 - DNA, 16 bp, Homo sapiens
ctcctgcctcagcctc

SEQ ID NO: 4689746 - DNA, 19 bp, Homo sapiens
ctcctgctgcaccaaccca

SEQ ID NO: 4689747 - DNA, 14 bp, Homo sapiens
ctcctgggccctct

SEQ ID NO: 4689748 - DNA, 23 bp, Homo sapiens
ctcctgggttttgtattctctga

SEQ ID NO: 4689749 - DNA, 16 bp, Homo sapiens
ctcctgtgatcctttg

SEQ ID NO: 4689750 - DNA, 16 bp, Homo sapiens
ctcctgtgatgtccca

SEQ ID NO: 4689751 - DNA, 17 bp, Homo sapiens
ctcctgtgatgtcccag

SEQ ID NO: 4689752 - DNA, 23 bp, Homo sapiens
ctcctgtgtcttgcaatggcagc

SEQ ID NO: 4689753 - DNA, 21 bp, Homo sapiens
ctcctgtgtgtgcgcctacag

SEQ ID NO: 4689754 - DNA, 20 bp, Homo sapiens
ctccttactcattaattcaa

SEQ ID NO: 4689755 - DNA, 17 bp, Homo sapiens
ctccttatcaaaggaca

SEQ ID NO: 4689756 - DNA, 13 bp, Homo sapiens
ctccttcaccttt

SEQ ID NO: 4689757 - DNA, 21 bp, Homo sapiens
ctccttcacctttgtccccac

SEQ ID NO: 4689758 - DNA, 13 bp, Homo sapiens
ctccttcagccct

SEQ ID NO: 4689759 - DNA, 17 bp, Homo sapiens
ctccttcagccctcacc

SEQ ID NO: 4689760 - DNA, 20 bp, Homo sapiens
ctccttcagccctcacccct

SEQ ID NO: 4689761 - DNA, 21 bp, Homo sapiens
ctccttgaaaacactgttctc

SEQ ID NO: 4689762 - DNA, 20 bp, Homo sapiens
ctccttgagagaccaggcaa

SEQ ID NO: 4689763 - DNA, 20 bp, Homo sapiens
ctccttgtggcctgggcctc

SEQ ID NO: 4689764 - DNA, 17 bp, Homo sapiens
ctcctttgtgaggaagc

SEQ ID NO: 4689765 - DNA, 13 bp, Homo sapiens
ctcgaactcctga

SEQ ID NO: 4689766 - DNA, 20 bp, Homo sapiens
ctcgaagaaaataattctct

SEQ ID NO: 4689767 - DNA, 14 bp, Homo sapiens
ctcgaatgtaattg

SEQ ID NO: 4689768 - DNA, 18 bp, Homo sapiens
ctcgaatgtaattggaat

SEQ ID NO: 4689769 - DNA, 21 bp, Homo sapiens
ctcgaatgtaattggaatctt

SEQ ID NO: 4689770 - DNA, 16 bp, Homo sapiens
ctcgagcatgcctgga

SEQ ID NO: 4689771 - DNA, 19 bp, Homo sapiens
ctcgagcatgcctggatgg

SEQ ID NO: 4689772 - DNA, 19 bp, Homo sapiens
ctcgatgtcctcctctgtg

SEQ ID NO: 4689773 - DNA, 21 bp, Homo sapiens
ctcgatgtcctcctctgtgaa

SEQ ID NO: 4689774 - DNA, 22 bp, Homo sapiens
ctcgatgtcctcctctgtgaaa

SEQ ID NO: 4689775 - DNA, 16 bp, Homo sapiens
ctcgcctggcctgagg

SEQ ID NO: 4689776 - DNA, 19 bp, Homo sapiens
ctcgctattgtcaccaggg

SEQ ID NO: 4689777 - DNA, 21 bp, Homo sapiens
ctcgctattgtcaccagggct

SEQ ID NO: 4689778 - DNA, 17 bp, Homo sapiens
ctcgctgatgctgggct

SEQ ID NO: 4689779 - DNA, 21 bp, Homo sapiens
ctcgctgatgctgggctgggt

SEQ ID NO: 4689780 - DNA, 12 bp, Homo sapiens
ctcgctgccagc

SEQ ID NO: 4689781 - DNA, 13 bp, Homo sapiens
ctcgctgccagct

SEQ ID NO: 4689782 - DNA, 16 bp, Homo sapiens
ctcgctgccagctctg

SEQ ID NO: 4689783 - DNA, 19 bp, Homo sapiens
ctcgctggactctcagtct

SEQ ID NO: 4689784 - DNA, 19 bp, Homo sapiens
ctcggacttagctgggaga

SEQ ID NO: 4689785 - DNA, 18 bp, Homo sapiens
ctcggctcactgcatcct

SEQ ID NO: 4689786 - DNA, 14 bp, Homo sapiens
ctcgggcccaggcc

SEQ ID NO: 4689787 - DNA, 23 bp, Homo sapiens
ctcgggcccaggccatcttccag

SEQ ID NO: 4689788 - DNA, 11 bp, Homo sapiens
ctcggtggtac

SEQ ID NO: 4689789 - DNA, 15 bp, Homo sapiens
ctcgtccctcctccc

SEQ ID NO: 4689790 - DNA, 21 bp, Homo sapiens
ctcgtgccagtcgcgctgcct

SEQ ID NO: 4689791 - DNA, 21 bp, Homo sapiens
ctcgtggtaggactgtagaaa

SEQ ID NO: 4689792 - DNA, 20 bp, Homo sapiens
ctcgttgactggctgtgtgt

SEQ ID NO: 4689793 - DNA, 14 bp, Homo sapiens
ctctaaagagcatc

SEQ ID NO: 4689794 - DNA, 18 bp, Homo sapiens
ctctaagaagctgcaata

SEQ ID NO: 4689795 - DNA, 16 bp, Homo sapiens
ctctaatttattttgt

SEQ ID NO: 4689796 - DNA, 17 bp, Homo sapiens
ctctacacaacatgtat

SEQ ID NO: 4689797 - DNA, 17 bp, Homo sapiens
ctctacagagcttccct

SEQ ID NO: 4689798 - DNA, 22 bp, Homo sapiens
ctctacagagcttccctgactc

SEQ ID NO: 4689799 - DNA, 20 bp, Homo sapiens
ctctaccaagctatcctggc

SEQ ID NO: 4689800 - DNA, 12 bp, Homo sapiens
ctctacctgaca

SEQ ID NO: 4689801 - DNA, 22 bp, Homo sapiens
ctctacctgacactcccttggg

SEQ ID NO: 4689802 - DNA, 19 bp, Homo sapiens
ctctagggacccctcctcc

SEQ ID NO: 4689803 - DNA, 14 bp, Homo sapiens
ctctagtatttcca

SEQ ID NO: 4689804 - DNA, 15 bp, Homo sapiens
ctctatcaccaagga

SEQ ID NO: 4689805 - DNA, 16 bp, Homo sapiens
ctctcactcacatttt

SEQ ID NO: 4689806 - DNA, 18 bp, Homo sapiens
ctctcactcacattttct

SEQ ID NO: 4689807 - DNA, 22 bp, Homo sapiens
ctctcagcccctgatcctgtga

SEQ ID NO: 4689808 - DNA, 16 bp, Homo sapiens
ctctcaggctgtccca

SEQ ID NO: 4689809 - DNA, 15 bp, Homo sapiens
ctctcagtctctgag

SEQ ID NO: 4689810 - DNA, 22 bp, Homo sapiens
ctctcagttgcagccctgctgc

SEQ ID NO: 4689811 - DNA, 15 bp, Homo sapiens
ctctccaaaccactt

SEQ ID NO: 4689812 - DNA, 22 bp, Homo sapiens
ctctccacctagtggctgtcca

SEQ ID NO: 4689813 - DNA, 12 bp, Homo sapiens
ctctccagcccc

SEQ ID NO: 4689814 - DNA, 14 bp, Homo sapiens
ctctccagcccctg

SEQ ID NO: 4689815 - DNA, 16 bp, Homo sapiens
ctctccagcccctgga

SEQ ID NO: 4689816 - DNA, 18 bp, Homo sapiens
ctctccagcccctggatg

SEQ ID NO: 4689817 - DNA, 19 bp, Homo sapiens
ctctccagcccctggatgc

SEQ ID NO: 4689818 - DNA, 18 bp, Homo sapiens
ctctccagcctcagctct

SEQ ID NO: 4689819 - DNA, 13 bp, Homo sapiens
ctctccatctcta

SEQ ID NO: 4689820 - DNA, 14 bp, Homo sapiens
ctctccccagcaag

SEQ ID NO: 4689821 - DNA, 15 bp, Homo sapiens
ctctccctcctggcc

SEQ ID NO: 4689822 - DNA, 16 bp, Homo sapiens
ctctccgaccagacac

SEQ ID NO: 4689823 - DNA, 18 bp, Homo sapiens
ctcagtcatgcataaata

SEQ ID NO: 4689824 - DNA, 15 bp, Homo sapiens
ctcagtccatagcag

SEQ ID NO: 4689825 - DNA, 16 bp, Homo sapiens
ctcagtctccctccct

SEQ ID NO: 4689826 - DNA, 20 bp, Homo sapiens
ctcagtctctgagcagtgaa

SEQ ID NO: 4689827 - DNA, 16 bp, Homo sapiens
ctcagtgtgactcctc

SEQ ID NO: 4689828 - DNA, 21 bp, Homo sapiens
ctcagttcagaatcacttctg

SEQ ID NO: 4689829 - DNA, 15 bp, Homo sapiens
ctcagtttcatatat

SEQ ID NO: 4689830 - DNA, 15 bp, Homo sapiens
ctcatacccaccccc

SEQ ID NO: 4689831 - DNA, 16 bp, Homo sapiens
ctcatacccaccccca

SEQ ID NO: 4689832 - DNA, 19 bp, Homo sapiens
ctcatacccacccccaccc

SEQ ID NO: 4689833 - DNA, 13 bp, Homo sapiens
ctcatactgtgct

SEQ ID NO: 4689834 - DNA, 23 bp, Homo sapiens
ctcatagtatggtggctgggttg

SEQ ID NO: 4689835 - DNA, 16 bp, Homo sapiens
ctcatatatattttaa

SEQ ID NO: 4689836 - DNA, 23 bp, Homo sapiens
ctcatatatattttaaaaacact

SEQ ID NO: 4689837 - DNA, 21 bp, Homo sapiens
ctcatcaccaacgtctgtgcc

SEQ ID NO: 4689838 - DNA, 17 bp, Homo sapiens
ctcatcactcccctcca

SEQ ID NO: 4689839 - DNA, 20 bp, Homo sapiens
ctcatcaggagttccagtgc

SEQ ID NO: 4689840 - DNA, 15 bp, Homo sapiens
ctcatctatgtcata

SEQ ID NO: 4689841 - DNA, 15 bp, Homo sapiens
ctcatctctgtccca

SEQ ID NO: 4689842 - DNA, 17 bp, Homo sapiens
ctcatctcttagctccc

SEQ ID NO: 4689843 - DNA, 20 bp, Homo sapiens
ctcatctcttagctcccctc

SEQ ID NO: 4689844 - DNA, 13 bp, Homo sapiens
ctcatctgtccct

SEQ ID NO: 4689845 - DNA, 14 bp, Homo sapiens
ctcatgccctgcca

SEQ ID NO: 4689846 - DNA, 18 bp, Homo sapiens
ctcatgcctcagcctcct

SEQ ID NO: 4689847 - DNA, 20 bp, Homo sapiens
ctcatgcctcagcctcctga

SEQ ID NO: 4689848 - DNA, 12 bp, Homo sapiens
ctcatgctctga

SEQ ID NO: 4689849 - DNA, 15 bp, Homo sapiens
ctcatgctctgatta

SEQ ID NO: 4689850 - DNA, 15 bp, Homo sapiens
ctcatgtcatttctc

SEQ ID NO: 4689851 - DNA, 17 bp, Homo sapiens
ctcatgttgaaacttta

SEQ ID NO: 4689852 - DNA, 11 bp, Homo sapiens
ctcattaaaat

SEQ ID NO: 4689853 - DNA, 15 bp, Homo sapiens
ctcattaaaatccag

SEQ ID NO: 4689854 - DNA, 17 bp, Homo sapiens
ctcattaaaatccagta

SEQ ID NO: 4689855 - DNA, 23 bp, Homo sapiens
ctcattactttaccacccccaca

SEQ ID NO: 4689856 - DNA, 14 bp, Homo sapiens
ctcattagtggtac

SEQ ID NO: 4689857 - DNA, 14 bp, Homo sapiens
ctcattccccgggg

SEQ ID NO: 4689858 - DNA, 17 bp, Homo sapiens
ctcattctgaaggagcc

SEQ ID NO: 4689859 - DNA, 12 bp, Homo sapiens
ctcattcttctg

SEQ ID NO: 4689860 - DNA, 14 bp, Homo sapiens
ctcattcttctgta

SEQ ID NO: 4689861 - DNA, 23 bp, Homo sapiens
ctcattcttctgtacgtctgaca

SEQ ID NO: 4689862 - DNA, 15 bp, Homo sapiens
ctcattgaggacaaa

SEQ ID NO: 4689863 - DNA, 17 bp, Homo sapiens
ctcatttcacccctccc

SEQ ID NO: 4689864 - DNA, 23 bp, Homo sapiens
ctcatttcacccctccctttctc

SEQ ID NO: 4689865 - DNA, 15 bp, Homo sapiens
ctcatttccaatcat

SEQ ID NO: 4689866 - DNA, 18 bp, Homo sapiens
ctcatttgtcacacactt

SEQ ID NO: 4689867 - DNA, 22 bp, Homo sapiens
ctccaaaccactttttgcagct

SEQ ID NO: 4689868 - DNA, 15 bp, Homo sapiens
ctccaaatctccagt

SEQ ID NO: 4689869 - DNA, 15 bp, Homo sapiens
ctccaaatttaacca

SEQ ID NO: 4689870 - DNA, 18 bp, Homo sapiens
ctccaacctggggggcag

SEQ ID NO: 4689871 - DNA, 16 bp, Homo sapiens
ctccaagaccttctcc

SEQ ID NO: 4689872 - DNA, 17 bp, Homo sapiens
ctccaagaccttctcct

SEQ ID NO: 4689873 - DNA, 14 bp, Homo sapiens
ctccaagcaggaca

SEQ ID NO: 4689874 - DNA, 14 bp, Homo sapiens
ctccaagctcccag

SEQ ID NO: 4689875 - DNA, 23 bp, Homo sapiens
ctccaaggtttataaagcagatt

SEQ ID NO: 4689876 - DNA, 12 bp, Homo sapiens
ctccacacctgc

SEQ ID NO: 4689877 - DNA, 16 bp, Homo sapiens
ctccacagccatccca

SEQ ID NO: 4689878 - DNA, 23 bp, Homo sapiens
ctccacagccatcccagccttgg

SEQ ID NO: 4689879 - DNA, 14 bp, Homo sapiens
ctccacatcctcca

SEQ ID NO: 4689880 - DNA, 20 bp, Homo sapiens
ctccaccgccatggcttcca

SEQ ID NO: 4689881 - DNA, 11 bp, Homo sapiens
ctccacctcaa

SEQ ID NO: 4689882 - DNA, 13 bp, Homo sapiens
ctccacctgccag

SEQ ID NO: 4689883 - DNA, 14 bp, Homo sapiens
ctccacctgccagg

SEQ ID NO: 4689884 - DNA, 18 bp, Homo sapiens
ctccacctgccagggaca

SEQ ID NO: 4689885 - DNA, 15 bp, Homo sapiens
ctccaccttgcgggg

SEQ ID NO: 4689886 - DNA, 15 bp, Homo sapiens
ctccacgttctgctc

SEQ ID NO: 4689887 - DNA, 18 bp, Homo sapiens
ctccacgttctgctcatc

SEQ ID NO: 4689888 - DNA, 15 bp, Homo sapiens
ctccactctccccca

SEQ ID NO: 4689889 - DNA, 22 bp, Homo sapiens
ctccactgttgggtgggtgggc

SEQ ID NO: 4689890 - DNA, 21 bp, Homo sapiens
ctccagagggcactctgcttg

SEQ ID NO: 4689891 - DNA, 18 bp, Homo sapiens
ctccagcattctcagcca

SEQ ID NO: 4689892 - DNA, 11 bp, Homo sapiens
ctccagcccct

SEQ ID NO: 4689893 - DNA, 13 bp, Homo sapiens
ctccagcccctgg

SEQ ID NO: 4689894 - DNA, 15 bp, Homo sapiens
ctccagcccctggat

SEQ ID NO: 4689895 - DNA, 20 bp, Homo sapiens
ctccagctcaccagccccag

SEQ ID NO: 4689896 - DNA, 13 bp, Homo sapiens
ctccaggaagaag

SEQ ID NO: 4689897 - DNA, 16 bp, Homo sapiens
ctccaggagcagccac

SEQ ID NO: 4689898 - DNA, 17 bp, Homo sapiens
ctccaggagcagccaca

SEQ ID NO: 4689899 - DNA, 18 bp, Homo sapiens
ctccaggagcagccacat

SEQ ID NO: 4689900 - DNA, 16 bp, Homo sapiens
ctccaggatttataaa

SEQ ID NO: 4689901 - DNA, 19 bp, Homo sapiens
ctccaggatttataaagca

SEQ ID NO: 4689902 - DNA, 15 bp, Homo sapiens
ctccaggcaggctaa

SEQ ID NO: 4689903 - DNA, 23 bp, Homo sapiens
ctccaggctcctttagcgcccag

SEQ ID NO: 4689904 - DNA, 20 bp, Homo sapiens
ctccaggctgtatcccatga

SEQ ID NO: 4689905 - DNA, 18 bp, Homo sapiens
ctccagggctggactgag

SEQ ID NO: 4689906 - DNA, 21 bp, Homo sapiens
ctccagggctggactgaggcc

SEQ ID NO: 4689907 - DNA, 11 bp, Homo sapiens
ctccaggtgca

SEQ ID NO: 4689908 - DNA, 23 bp, Homo sapiens
ctccagtctcatctatgtcatat

SEQ ID NO: 4689909 - DNA, 18 bp, Homo sapiens
ctccatcagttagagctg

SEQ ID NO: 4689910 - DNA, 13 bp, Homo sapiens
ctccatcattcat

SEQ ID NO: 4689911 - DNA, 19 bp, Homo sapiens
ctccatgaagaagctggga

SEQ ID NO: 4689912 - DNA, 19 bp, Homo sapiens
ctccatggccctgccatgc

SEQ ID NO: 4689913 - DNA, 13 bp, Homo sapiens
ctccatgtctctg

SEQ ID NO: 4689914 - DNA, 22 bp, Homo sapiens
ctcccaaagtgctgggattaca

SEQ ID NO: 4689915 - DNA, 16 bp, Homo sapiens
ctcccaactcacccca

SEQ ID NO: 4689916 - DNA, 22 bp, Homo sapiens
ctcccaactcaccccagcccca

SEQ ID NO: 4689917 - DNA, 20 bp, Homo sapiens
ctcccaccataatccctgtc

SEQ ID NO: 4689918 - DNA, 20 bp, Homo sapiens
ctcccagctgacagtcctct

SEQ ID NO: 4689919 - DNA, 20 bp, Homo sapiens
ctcccaggcattccccagga

SEQ ID NO: 4689920 - DNA, 17 bp, Homo sapiens
ctcccagtgtcttcctg

SEQ ID NO: 4689921 - DNA, 20 bp, Homo sapiens
ctcccataaccgctgattct

SEQ ID NO: 4689922 - DNA, 14 bp, Homo sapiens
ctcccatcacccgc

SEQ ID NO: 4689923 - DNA, 11 bp, Homo sapiens
ctcccatctgt

SEQ ID NO: 4689924 - DNA, 14 bp, Homo sapiens
ctcccatctgtgaa

SEQ ID NO: 4689925 - DNA, 23 bp, Homo sapiens
ctcccatctgtgaaaggaaagag

SEQ ID NO: 4689926 - DNA, 23 bp, Homo sapiens
ctccccaactgaccacctttgtt

SEQ ID NO: 4689927 - DNA, 12 bp, Homo sapiens
ctccccagcaag

SEQ ID NO: 4689928 - DNA, 20 bp, Homo sapiens
ctccccagcaagtgagagct

SEQ ID NO: 4689929 - DNA, 19 bp, Homo sapiens
ctcccccactttctttctt

SEQ ID NO: 4689930 - DNA, 15 bp, Homo sapiens
ctcccccagccccat

SEQ ID NO: 4689931 - DNA, 14 bp, Homo sapiens
ctcccccccggggc

SEQ ID NO: 4689932 - DNA, 15 bp, Homo sapiens
ctcccccccggggct

SEQ ID NO: 4689933 - DNA, 15 bp, Homo sapiens
cgagtgctcatttca

SEQ ID NO: 4689934 - DNA, 15 bp, Homo sapiens
cgatgtcctcctctg

SEQ ID NO: 4689935 - DNA, 19 bp, Homo sapiens
cgatgtcctcctctgtgaa

SEQ ID NO: 4689936 - DNA, 22 bp, Homo sapiens
cgcaagagccatgtagaagctg

SEQ ID NO: 4689937 - DNA, 19 bp, Homo sapiens
cgcacacacacatacagag

SEQ ID NO: 4689938 - DNA, 15 bp, Homo sapiens
cgcagcctgagaatg

SEQ ID NO: 4689939 - DNA, 16 bp, Homo sapiens
cgcagcgcagagcggg

SEQ ID NO: 4689940 - DNA, 14 bp, Homo sapiens
cgcaggcccctctc

SEQ ID NO: 4689941 - DNA, 19 bp, Homo sapiens
cgcaggcccctctcctccg

SEQ ID NO: 4689942 - DNA, 17 bp, Homo sapiens
cgcaggctggccctgcc

SEQ ID NO: 4689943 - DNA, 22 bp, Homo sapiens
cgcaggctggccctgccctggt

SEQ ID NO: 4689944 - DNA, 14 bp, Homo sapiens
cgcatgccccctcg

SEQ ID NO: 4689945 - DNA, 20 bp, Homo sapiens
cgcatgccccctcgtgccag

SEQ ID NO: 4689946 - DNA, 21 bp, Homo sapiens
cgcatgccccctcgtgccagt

SEQ ID NO: 4689947 - DNA, 22 bp, Homo sapiens
cgcatgccccctcgtgccagtc

SEQ ID NO: 4689948 - DNA, 17 bp, Homo sapiens
cgccaaataatgtctct

SEQ ID NO: 4689949 - DNA, 20 bp, Homo sapiens
cgccatggcttccaaggtgg

SEQ ID NO: 4689950 - DNA, 13 bp, Homo sapiens
cgcccaccgcatg

SEQ ID NO: 4689951 - DNA, 20 bp, Homo sapiens
cgcccaggctggccagcccc

SEQ ID NO: 4689952 - DNA, 13 bp, Homo sapiens
cgcccatcagtgc

SEQ ID NO: 4689953 - DNA, 15 bp, Homo sapiens
cgcccatcagtgcca

SEQ ID NO: 4689954 - DNA, 12 bp, Homo sapiens
cgccccacccag

SEQ ID NO: 4689955 - DNA, 19 bp, Homo sapiens
cgcccctcccacagcgctg

SEQ ID NO: 4689956 - DNA, 15 bp, Homo sapiens
cgccctggtttgttt

SEQ ID NO: 4689957 - DNA, 13 bp, Homo sapiens
cgccgcctcgccc

SEQ ID NO: 4689958 - DNA, 16 bp, Homo sapiens
cgccgcctcgcccacc

SEQ ID NO: 4689959 - DNA, 14 bp, Homo sapiens
cgcctcgcccaccg

SEQ ID NO: 4689960 - DNA, 16 bp, Homo sapiens
cgcctcgcccaccgca

SEQ ID NO: 4689961 - DNA, 22 bp, Homo sapiens
cgcctcgcccaccgcatgcccc

SEQ ID NO: 4689962 - DNA, 13 bp, Homo sapiens
cgcctttcccagg

SEQ ID NO: 4689963 - DNA, 12 bp, Homo sapiens
cgcgcactcagc

SEQ ID NO: 4689964 - DNA, 13 bp, Homo sapiens
cgcgctgcctgtg

SEQ ID NO: 4689965 - DNA, 20 bp, Homo sapiens
cgcgtgcacacaccagagcc

SEQ ID NO: 4689966 - DNA, 18 bp, Homo sapiens
cgctacccgggaaggggg

SEQ ID NO: 4689967 - DNA, 20 bp, Homo sapiens
cgctctgtcgcccaggctgg

SEQ ID NO: 4689968 - DNA, 21 bp, Homo sapiens
cgctgatgctgggctgggtgc

SEQ ID NO: 4689969 - DNA, 23 bp, Homo sapiens
cgctgattctcagggtctctgct

SEQ ID NO: 4689970 - DNA, 19 bp, Homo sapiens
cgctgccagctctgtatca

SEQ ID NO: 4689971 - DNA, 21 bp, Homo sapiens
cgctgcccggcgccctctgtc

SEQ ID NO: 4689972 - DNA, 22 bp, Homo sapiens
cgctgcccggcgccctctgtcc

SEQ ID NO: 4689973 - DNA, 17 bp, Homo sapiens
cgctggagtgcagtgag

SEQ ID NO: 4689974 - DNA, 17 bp, Homo sapiens
cgctggggccagttggt

SEQ ID NO: 4689975 - DNA, 14 bp, Homo sapiens
cgctgggtcctctg

SEQ ID NO: 4689976 - DNA, 18 bp, Homo sapiens
cgctgtcaggattgcgag

SEQ ID NO: 4689977 - DNA, 15 bp, Homo sapiens
cgctgtgagtgagtg

SEQ ID NO: 4689978 - DNA, 11 bp, Homo sapiens
cgctgtgctgc

SEQ ID NO: 4689979 - DNA, 18 bp, Homo sapiens
cgctgtgctgccctgccc

SEQ ID NO: 4689980 - DNA, 19 bp, Homo sapiens
cgctgtgctgccctgccca

SEQ ID NO: 4689981 - DNA, 18 bp, Homo sapiens
cgcttgcctcggctcctg

SEQ ID NO: 4689982 - DNA, 20 bp, Homo sapiens
cgcttgcctcggctcctgct

SEQ ID NO: 4689983 - DNA, 20 bp, Homo sapiens
cggaaaaggttttattttgt

SEQ ID NO: 4689984 - DNA, 14 bp, Homo sapiens
cggaatagttggct

SEQ ID NO: 4689985 - DNA, 17 bp, Homo sapiens
cggaatagttggctagg

SEQ ID NO: 4689986 - DNA, 20 bp, Homo sapiens
cggaatgaaccacatcttgc

SEQ ID NO: 4689987 - DNA, 18 bp, Homo sapiens
cggacagccacggccagg

SEQ ID NO: 4689988 - DNA, 22 bp, Homo sapiens
cggacagccacggccaggccag

SEQ ID NO: 4689989 - DNA, 14 bp, Homo sapiens
cggaccagcctggc

SEQ ID NO: 4689990 - DNA, 17 bp, Homo sapiens
cggaccagcctggccca

SEQ ID NO: 4689991 - DNA, 16 bp, Homo sapiens
cggacttagctgggag

SEQ ID NO: 4689992 - DNA, 17 bp, Homo sapiens
cggacttagctgggaga

SEQ ID NO: 4689993 - DNA, 17 bp, Homo sapiens
cggagacggagtcccac

SEQ ID NO: 4689994 - DNA, 17 bp, Homo sapiens
cggagccactcctctga

SEQ ID NO: 4689995 - DNA, 18 bp, Homo sapiens
cggagccactcctctgac

SEQ ID NO: 4689996 - DNA, 14 bp, Homo sapiens
cggagtcccacctt

SEQ ID NO: 4689997 - DNA, 20 bp, Homo sapiens
cggagtcccaccttggctgc

SEQ ID NO: 4689998 - DNA, 19 bp, Homo sapiens
cggatctttggacagaagc

SEQ ID NO: 4689999 - DNA, 15 bp, Homo sapiens
cggcattaaagccat

SEQ ID NO: 4690000 - DNA, 20 bp, Homo sapiens
cggccaggccagagggagtg

SEQ ID NO: 4690001 - DNA, 13 bp, Homo sapiens
cggcccctgctgg

SEQ ID NO: 4690002 - DNA, 13 bp, Homo sapiens
cggcctgtgtccc

SEQ ID NO: 4690003 - DNA, 18 bp, Homo sapiens
cggctaatttttgtattt

SEQ ID NO: 4690004 - DNA, 14 bp, Homo sapiens
cggctcactgcagc

SEQ ID NO: 4690005 - DNA, 19 bp, Homo sapiens
cggctcactgcagcctcaa

SEQ ID NO: 4690006 - DNA, 17 bp, Homo sapiens
cggctcactgcatcctc

SEQ ID NO: 4690007 - DNA, 21 bp, Homo sapiens
cggctcactgcatcctccgcc

SEQ ID NO: 4690008 - DNA, 13 bp, Homo sapiens
cggctccaggctc

SEQ ID NO: 4690009 - DNA, 16 bp, Homo sapiens
cggctccaggctcctt

SEQ ID NO: 4690010 - DNA, 15 bp, Homo sapiens
cggctcctgctgcac

SEQ ID NO: 4690011 - DNA, 16 bp, Homo sapiens
cggctggcctggcccc

SEQ ID NO: 4690012 - DNA, 22 bp, Homo sapiens
cggctggcctggcccctcaggg

SEQ ID NO: 4690013 - DNA, 19 bp, Homo sapiens
cggctttctaatagagaga

SEQ ID NO: 4690014 - DNA, 23 bp, Homo sapiens
cgggaccccgagcctggctccaa

SEQ ID NO: 4690015 - DNA, 16 bp, Homo sapiens
cgggagaggggacgca

SEQ ID NO: 4690016 - DNA, 17 bp, Homo sapiens
cgggagaggggacgcag

SEQ ID NO: 4690017 - DNA, 19 bp, Homo sapiens
cgggagaggggacgcaggc

SEQ ID NO: 4690018 - DNA, 23 bp, Homo sapiens
cgggagaggggacgcaggcccct

SEQ ID NO: 4690019 - DNA, 20 bp, Homo sapiens
cgggaggatgttctgggaca

SEQ ID NO: 4690020 - DNA, 23 bp, Homo sapiens
cgggaggatgttctgggacacag

SEQ ID NO: 4690021 - DNA, 19 bp, Homo sapiens
cgggaggggcccgcttgcc

SEQ ID NO: 4690022 - DNA, 15 bp, Homo sapiens
cgggcagcacagcaa

SEQ ID NO: 4690023 - DNA, 14 bp, Homo sapiens
cgggccacagagaa

SEQ ID NO: 4690024 - DNA, 17 bp, Homo sapiens
cgggctcctgtgccctt

SEQ ID NO: 4690025 - DNA, 14 bp, Homo sapiens
cgggctctgcctcc

SEQ ID NO: 4690026 - DNA, 18 bp, Homo sapiens
cggggaggccggcgcagc

SEQ ID NO: 4690027 - DNA, 17 bp, Homo sapiens
cggggctcttctcattt

SEQ ID NO: 4690028 - DNA, 23 bp, Homo sapiens
cggggctcttctcatttcacccc

SEQ ID NO: 4690029 - DNA, 18 bp, Homo sapiens
ctacactgtgctgagtct

SEQ ID NO: 4690030 - DNA, 20 bp, Homo sapiens
ctacagagaaaatgaatttg

SEQ ID NO: 4690031 - DNA, 20 bp, Homo sapiens
ctacagaggccatgggcctc

SEQ ID NO: 4690032 - DNA, 15 bp, Homo sapiens
ctacaggagtgagca

SEQ ID NO: 4690033 - DNA, 16 bp, Homo sapiens
ctacaggagtgagcac

SEQ ID NO: 4690034 - DNA, 15 bp, Homo sapiens
ctacaggcacccacc

SEQ ID NO: 4690035 - DNA, 15 bp, Homo sapiens
ctacagtcaggaaag

SEQ ID NO: 4690036 - DNA, 19 bp, Homo sapiens
ctacagtcctcccatctca

SEQ ID NO: 4690037 - DNA, 13 bp, Homo sapiens
ctacagtgtacag

SEQ ID NO: 4690038 - DNA, 18 bp, Homo sapiens
ctacagttttaactgtgg

SEQ ID NO: 4690039 - DNA, 19 bp, Homo sapiens
ctacagttttaactgtgga

SEQ ID NO: 4690040 - DNA, 20 bp, Homo sapiens
ctacagttttaactgtggat

SEQ ID NO: 4690041 - DNA, 20 bp, Homo sapiens
ctacatacgtctttcacagt

SEQ ID NO: 4690042 - DNA, 14 bp, Homo sapiens
ctacatcagtttga

SEQ ID NO: 4690043 - DNA, 18 bp, Homo sapiens
ctaccacatgccaagcac

SEQ ID NO: 4690044 - DNA, 15 bp, Homo sapiens
ctaccagtgggcatg

SEQ ID NO: 4690045 - DNA, 18 bp, Homo sapiens
ctacccagcgagccctgg

SEQ ID NO: 4690046 - DNA, 20 bp, Homo sapiens
cctctgcccactccctgcaa

SEQ ID NO: 4690047 - DNA, 11 bp, Homo sapiens
cctctgccctg

SEQ ID NO: 4690048 - DNA, 12 bp, Homo sapiens
cctctgccctgc

SEQ ID NO: 4690049 - DNA, 13 bp, Homo sapiens
cctctgccctgcg

SEQ ID NO: 4690050 - DNA, 23 bp, Homo sapiens
cctctgcctctgacacacagctc

SEQ ID NO: 4690051 - DNA, 13 bp, Homo sapiens
cctctgctgctgg

SEQ ID NO: 4690052 - DNA, 18 bp, Homo sapiens
cctctgctgctggctggt

SEQ ID NO: 4690053 - DNA, 14 bp, Homo sapiens
cctctgtacagagc

SEQ ID NO: 4690054 - DNA, 17 bp, Homo sapiens
cctctgtacagagccca

SEQ ID NO: 4690055 - DNA, 23 bp, Homo sapiens
cctctgtacagagcccacgcccc

SEQ ID NO: 4690056 - DNA, 20 bp, Homo sapiens
cctctgtccaggcactgaga

SEQ ID NO: 4690057 - DNA, 21 bp, Homo sapiens
cctctgtccaggcactgagat

SEQ ID NO: 4690058 - DNA, 13 bp, Homo sapiens
cctctgtcctgac

SEQ ID NO: 4690059 - DNA, 17 bp, Homo sapiens
cctctgtgtcactggct

SEQ ID NO: 4690060 - DNA, 17 bp, Homo sapiens
cctcttatgggctgggt

SEQ ID NO: 4690061 - DNA, 13 bp, Homo sapiens
cctcttcagaggc

SEQ ID NO: 4690062 - DNA, 14 bp, Homo sapiens
cctcttcagaggcc

SEQ ID NO: 4690063 - DNA, 18 bp, Homo sapiens
cctcttctgggagggcag

SEQ ID NO: 4690064 - DNA, 23 bp, Homo sapiens
cctcttgccccaacccccagcac

SEQ ID NO: 4690065 - DNA, 19 bp, Homo sapiens
cctctttggtctacactgt

SEQ ID NO: 4690066 - DNA, 16 bp, Homo sapiens
cctcttttcacatttt

SEQ ID NO: 4690067 - DNA, 16 bp, Homo sapiens
cctcttttccccatga

SEQ ID NO: 4690068 - DNA, 18 bp, Homo sapiens
cctgaaattaatttgtga

SEQ ID NO: 4690069 - DNA, 19 bp, Homo sapiens
cctgaaattaatttgtgaa

SEQ ID NO: 4690070 - DNA, 13 bp, Homo sapiens
cctgaaggccccg

SEQ ID NO: 4690071 - DNA, 14 bp, Homo sapiens
cctgaaggccccgc

SEQ ID NO: 4690072 - DNA, 19 bp, Homo sapiens
cctgaaggccccgcccagg

SEQ ID NO: 4690073 - DNA, 19 bp, Homo sapiens
cctgaagtcacacagtgag

SEQ ID NO: 4690074 - DNA, 16 bp, Homo sapiens
cctgaataaaccagta

SEQ ID NO: 4690075 - DNA, 15 bp, Homo sapiens
cctgacaacactcat

SEQ ID NO: 4690076 - DNA, 13 bp, Homo sapiens
cctgacactccct

SEQ ID NO: 4690077 - DNA, 22 bp, Homo sapiens
cctgacactgcggggcttggct

SEQ ID NO: 4690078 - DNA, 16 bp, Homo sapiens
cctgacagcactcctc

SEQ ID NO: 4690079 - DNA, 22 bp, Homo sapiens
cctgacttcaggggctgcccgc

SEQ ID NO: 4690080 - DNA, 14 bp, Homo sapiens
cctgagatttacac

SEQ ID NO: 4690081 - DNA, 15 bp, Homo sapiens
cctgagatttcatct

SEQ ID NO: 4690082 - DNA, 22 bp, Homo sapiens
cctgagatttcatctgctctcc

SEQ ID NO: 4690083 - DNA, 21 bp, Homo sapiens
cctgagcagaatactggtctc

SEQ ID NO: 4690084 - DNA, 17 bp, Homo sapiens
cctgagcccctcagaca

SEQ ID NO: 4690085 - DNA, 12 bp, Homo sapiens
cctgagcgctcc

SEQ ID NO: 4690086 - DNA, 21 bp, Homo sapiens
cctgagctagaagctggagga

SEQ ID NO: 4690087 - DNA, 16 bp, Homo sapiens
cctgagctgaggcagc

SEQ ID NO: 4690088 - DNA, 12 bp, Homo sapiens
cctgagctggga

SEQ ID NO: 4690089 - DNA, 19 bp, Homo sapiens
cctgaggactgatttcaga

SEQ ID NO: 4690090 - DNA, 13 bp, Homo sapiens
cctgaggcccaga

SEQ ID NO: 4690091 - DNA, 12 bp, Homo sapiens
cctgaggccctt

SEQ ID NO: 4690092 - DNA, 20 bp, Homo sapiens
cctgaggcccttctctccag

SEQ ID NO: 4690093 - DNA, 21 bp, Homo sapiens
cctgaggcccttctctccagc

SEQ ID NO: 4690094 - DNA, 22 bp, Homo sapiens
cctgaggcccttctctccagcc

SEQ ID NO: 4690095 - DNA, 14 bp, Homo sapiens
cctgaggctgggct

SEQ ID NO: 4690096 - DNA, 17 bp, Homo sapiens
cctgaggctgggctccc

SEQ ID NO: 4690097 - DNA, 19 bp, Homo sapiens
cctgaggctgggctccctt

SEQ ID NO: 4690098 - DNA, 16 bp, Homo sapiens
cctgaggggcctctta

SEQ ID NO: 4690099 - DNA, 23 bp, Homo sapiens
cctgagttgcaccattctttctt

SEQ ID NO: 4690100 - DNA, 19 bp, Homo sapiens
cctgataaagaacatctgt

SEQ ID NO: 4690101 - DNA, 15 bp, Homo sapiens
cctgatgaaaataaa

SEQ ID NO: 4690102 - DNA, 17 bp, Homo sapiens
cctgatgatttttattt

SEQ ID NO: 4690103 - DNA, 16 bp, Homo sapiens
cctgatgcagtcacgt

SEQ ID NO: 4690104 - DNA, 14 bp, Homo sapiens
cctgatgcttcttc

SEQ ID NO: 4690105 - DNA, 12 bp, Homo sapiens
cctgatggagag

SEQ ID NO: 4690106 - DNA, 13 bp, Homo sapiens
cctgatggagagt

SEQ ID NO: 4690107 - DNA, 14 bp, Homo sapiens
cctgatggagagtg

SEQ ID NO: 4690108 - DNA, 17 bp, Homo sapiens
cctgattgtgtctcttg

SEQ ID NO: 4690109 - DNA, 18 bp, Homo sapiens
cctgcaaagcccagcttg

SEQ ID NO: 4690110 - DNA, 19 bp, Homo sapiens
cctgcaaagcccagcttga

SEQ ID NO: 4690111 - DNA, 21 bp, Homo sapiens
cctgcaacctgattgtgtctc

SEQ ID NO: 4690112 - DNA, 17 bp, Homo sapiens
cctgcactaacagagtg

SEQ ID NO: 4690113 - DNA, 23 bp, Homo sapiens
cctgcactgtcctgctccacagt

SEQ ID NO: 4690114 - DNA, 18 bp, Homo sapiens
cctgcacttgcagactct

SEQ ID NO: 4690115 - DNA, 14 bp, Homo sapiens
cctgcaggaaggag

SEQ ID NO: 4690116 - DNA, 23 bp, Homo sapiens
cctgcaggaaggagctgcctgga

SEQ ID NO: 4690117 - DNA, 14 bp, Homo sapiens
cctgcaggcagcca

SEQ ID NO: 4690118 - DNA, 17 bp, Homo sapiens
cctgcaggcagccaggc

SEQ ID NO: 4690119 - DNA, 22 bp, Homo sapiens
cctgcatatctctagtccctgt

SEQ ID NO: 4690120 - DNA, 20 bp, Homo sapiens
cctgcattggaactggaggc

SEQ ID NO: 4690121 - DNA, 16 bp, Homo sapiens
cctgccaccctgggga

SEQ ID NO: 4690122 - DNA, 22 bp, Homo sapiens
cctgccaccctggggagaaagt

SEQ ID NO: 4690123 - DNA, 19 bp, Homo sapiens
cctgccacctcctgcctca

SEQ ID NO: 4690124 - DNA, 13 bp, Homo sapiens
cctgccacctgga

SEQ ID NO: 4690125 - DNA, 16 bp, Homo sapiens
cctgccacctggaccc

SEQ ID NO: 4690126 - DNA, 13 bp, Homo sapiens
cctgccagggaca

SEQ ID NO: 4690127 - DNA, 22 bp, Homo sapiens
cctgccagggacagagggggtg

SEQ ID NO: 4690128 - DNA, 14 bp, Homo sapiens
cctgcccacctggc

SEQ ID NO: 4690129 - DNA, 20 bp, Homo sapiens
cctgcccacctggcctctgc

SEQ ID NO: 4690130 - DNA, 14 bp, Homo sapiens
cctgcccaggcccc

SEQ ID NO: 4690131 - DNA, 19 bp, Homo sapiens
cctgcccaggcccctgcca

SEQ ID NO: 4690132 - DNA, 17 bp, Homo sapiens
cctgccccgcaggcctg

SEQ ID NO: 4690133 - DNA, 20 bp, Homo sapiens
cctgcccctcctctctgccc

SEQ ID NO: 4690134 - DNA, 14 bp, Homo sapiens
cctgcccggctgcg

SEQ ID NO: 4690135 - DNA, 12 bp, Homo sapiens
cctgccctggga

SEQ ID NO: 4690136 - DNA, 11 bp, Homo sapiens
cctgccctgtg

SEQ ID NO: 4690137 - DNA, 12 bp, Homo sapiens
cctgccctgtgg

SEQ ID NO: 4690138 - DNA, 21 bp, Homo sapiens
cctgcccttgctccagcctga

SEQ ID NO: 4690139 - DNA, 11 bp, Homo sapiens
cctgcctcagc

SEQ ID NO: 4690140 - DNA, 17 bp, Homo sapiens
cctgcctcagcctcccg

SEQ ID NO: 4690141 - DNA, 15 bp, Homo sapiens
cctgcctccagggct

SEQ ID NO: 4690142 - DNA, 20 bp, Homo sapiens
cctgcctccagggctggact

SEQ ID NO: 4690143 - DNA, 23 bp, Homo sapiens
cctgcctccagggctggactgag

SEQ ID NO: 4690144 - DNA, 16 bp, Homo sapiens
cctgcctcccttcatg

SEQ ID NO: 4690145 - DNA, 13 bp, Homo sapiens
cctgcctgctgca

SEQ ID NO: 4690146 - DNA, 17 bp, Homo sapiens
cctgccttcctcctggg

SEQ ID NO: 4690147 - DNA, 16 bp, Homo sapiens
cctgcggtgctatctc

SEQ ID NO: 4690148 - DNA, 13 bp, Homo sapiens
cctgcgtgtgtct

SEQ ID NO: 4690149 - DNA, 16 bp, Homo sapiens
cctgcgtgtgtctgtg

SEQ ID NO: 4690150 - DNA, 18 bp, Homo sapiens
cctgcgtgtgtctgtgtt

SEQ ID NO: 4690151 - DNA, 17 bp, Homo sapiens
cctgctaattccccaga

SEQ ID NO: 4690152 - DNA, 14 bp, Homo sapiens
cctgctcacaggca

SEQ ID NO: 4690153 - DNA, 13 bp, Homo sapiens
cctgctccacagt

SEQ ID NO: 4690154 - DNA, 14 bp, Homo sapiens
cctgctccacagtg

SEQ ID NO: 4690155 - DNA, 15 bp, Homo sapiens
cctgctccacagtgt

SEQ ID NO: 4690156 - DNA, 20 bp, Homo sapiens
cctgctgagtcccaggctga

SEQ ID NO: 4690157 - DNA, 12 bp, Homo sapiens
cctgctgcacca

SEQ ID NO: 4690158 - DNA, 18 bp, Homo sapiens
ctgtgctctggacaggca

SEQ ID NO: 4690159 - DNA, 19 bp, Homo sapiens
ctgtgctctggacaggcat

SEQ ID NO: 4690160 - DNA, 12 bp, Homo sapiens
ctgtgctgagtc

SEQ ID NO: 4690161 - DNA, 14 bp, Homo sapiens
ctgtgctgagtctg

SEQ ID NO: 4690162 - DNA, 15 bp, Homo sapiens
ctgtgctgccctgcc

SEQ ID NO: 4690163 - DNA, 14 bp, Homo sapiens
ctgtgctggagcca

SEQ ID NO: 4690164 - DNA, 20 bp, Homo sapiens
ctgtgcttcgggcccttccc

SEQ ID NO: 4690165 - DNA, 17 bp, Homo sapiens
ctgtggaagtccctcag

SEQ ID NO: 4690166 - DNA, 18 bp, Homo sapiens
ctgtggaagtccctcaga

SEQ ID NO: 4690167 - DNA, 14 bp, Homo sapiens
ctgtggaggaagga

SEQ ID NO: 4690168 - DNA, 16 bp, Homo sapiens
ctgtggaggaaggatt

SEQ ID NO: 4690169 - DNA, 23 bp, Homo sapiens
ctgtggaggccgagtctgtcctg

SEQ ID NO: 4690170 - DNA, 22 bp, Homo sapiens
ctgtggcattgttgatgctcac

SEQ ID NO: 4690171 - DNA, 18 bp, Homo sapiens
ctgtggccaagttcttag

SEQ ID NO: 4690172 - DNA, 22 bp, Homo sapiens
ctgtggcttcttaatcttttca

SEQ ID NO: 4690173 - DNA, 15 bp, Homo sapiens
ctgtgggctgcactc

SEQ ID NO: 4690174 - DNA, 23 bp, Homo sapiens
ctgtgggctgcactctgtgccca

SEQ ID NO: 4690175 - DNA, 20 bp, Homo sapiens
ctgtgggggaagagcacagc

SEQ ID NO: 4690176 - DNA, 21 bp, Homo sapiens
ctgtgggggaagagcacagcc

SEQ ID NO: 4690177 - DNA, 22 bp, Homo sapiens
ctgtgggggaagagcacagccc

SEQ ID NO: 4690178 - DNA, 23 bp, Homo sapiens
ctgtgggggaagagcacagccct

SEQ ID NO: 4690179 - DNA, 15 bp, Homo sapiens
ctgtggtgtgtcccc

SEQ ID NO: 4690180 - DNA, 22 bp, Homo sapiens
ctgtggtgtgtccccctctgtc

SEQ ID NO: 4690181 - DNA, 17 bp, Homo sapiens
ctgtgtaaaaagagagc

SEQ ID NO: 4690182 - DNA, 15 bp, Homo sapiens
ctgtgtcactggctg

SEQ ID NO: 4690183 - DNA, 22 bp, Homo sapiens
ctgtgtcactggctgcctccac

SEQ ID NO: 4690184 - DNA, 23 bp, Homo sapiens
ctgtgtcaggaaacatatttaag

SEQ ID NO: 4690185 - DNA, 22 bp, Homo sapiens
ctgtgtcaggtggggcagcttg

SEQ ID NO: 4690186 - DNA, 15 bp, Homo sapiens
ctgtgtctctgtata

SEQ ID NO: 4690187 - DNA, 16 bp, Homo sapiens
ctgtgtcttgcaatgg

SEQ ID NO: 4690188 - DNA, 20 bp, Homo sapiens
ctgtgtcttgcaatggcagc

SEQ ID NO: 4690189 - DNA, 23 bp, Homo sapiens
ctgtgtcttgcaatggcagcctt

SEQ ID NO: 4690190 - DNA, 20 bp, Homo sapiens
ctgtgtcttttttcactaca

SEQ ID NO: 4690191 - DNA, 19 bp, Homo sapiens
ctgtgtgaacgtgtatgta

SEQ ID NO: 4690192 - DNA, 19 bp, Homo sapiens
ctgtgtgaatacctgctca

SEQ ID NO: 4690193 - DNA, 18 bp, Homo sapiens
ctgtgtgactcaaaccaa

SEQ ID NO: 4690194 - DNA, 15 bp, Homo sapiens
ctgtgtgtgtatgag

SEQ ID NO: 4690195 - DNA, 19 bp, Homo sapiens
ctgtgtgtgtatgagagag

SEQ ID NO: 4690196 - DNA, 16 bp, Homo sapiens
ctgtgttgagcgtgcg

SEQ ID NO: 4690197 - DNA, 21 bp, Homo sapiens
ctgtgttgagcgtgcgtctgt

SEQ ID NO: 4690198 - DNA, 12 bp, Homo sapiens
ctgtgtttagct

SEQ ID NO: 4690199 - DNA, 16 bp, Homo sapiens
ctgtgtttagctattt

SEQ ID NO: 4690200 - DNA, 16 bp, Homo sapiens
ctgttaatagttcagg

SEQ ID NO: 4690201 - DNA, 17 bp, Homo sapiens
ctgttatcttgtgtatg

SEQ ID NO: 4690202 - DNA, 23 bp, Homo sapiens
ctgttattttgcatatatgttct

SEQ ID NO: 4690203 - DNA, 12 bp, Homo sapiens
ctgttcaagagc

SEQ ID NO: 4690204 - DNA, 14 bp, Homo sapiens
ctgttcagctccag

SEQ ID NO: 4690205 - DNA, 19 bp, Homo sapiens
ctgttcagctccagctcac

SEQ ID NO: 4690206 - DNA, 15 bp, Homo sapiens
ctgttccccctgtgc

SEQ ID NO: 4690207 - DNA, 14 bp, Homo sapiens
ctgttctctgccct

SEQ ID NO: 4690208 - DNA, 16 bp, Homo sapiens
ctgttctctgccctcc

SEQ ID NO: 4690209 - DNA, 17 bp, Homo sapiens
ctgttctctgccctcca

SEQ ID NO: 4690210 - DNA, 19 bp, Homo sapiens
ctgttctctgccctccaag

SEQ ID NO: 4690211 - DNA, 16 bp, Homo sapiens
ctgttctgcacacagc

SEQ ID NO: 4690212 - DNA, 18 bp, Homo sapiens
ctgttcttaagacgtgat

SEQ ID NO: 4690213 - DNA, 18 bp, Homo sapiens
ctgttgataaaaactcag

SEQ ID NO: 4690214 - DNA, 19 bp, Homo sapiens
ctgttgcaaactcagcctc

SEQ ID NO: 4690215 - DNA, 17 bp, Homo sapiens
ctgttgcacgtgtgttt

SEQ ID NO: 4690216 - DNA, 20 bp, Homo sapiens
ctgttgcacgtgtgtttttc

SEQ ID NO: 4690217 - DNA, 22 bp, Homo sapiens
ctgttgcacgtgtgtttttcta

SEQ ID NO: 4690218 - DNA, 12 bp, Homo sapiens
ctgttgcccagg

SEQ ID NO: 4690219 - DNA, 13 bp, Homo sapiens
ctgttgcccaggc

SEQ ID NO: 4690220 - DNA, 14 bp, Homo sapiens
ctgttgctgcctca

SEQ ID NO: 4690221 - DNA, 19 bp, Homo sapiens
ctgttggctgggggcctca

SEQ ID NO: 4690222 - DNA, 12 bp, Homo sapiens
ctgttgtacatt

SEQ ID NO: 4690223 - DNA, 12 bp, Homo sapiens
ctgttgtttgaa

SEQ ID NO: 4690224 - DNA, 14 bp, Homo sapiens
ctgtttactgcttt

SEQ ID NO: 4690225 - DNA, 20 bp, Homo sapiens
ctgtttatgggtttcttcca

SEQ ID NO: 4690226 - DNA, 17 bp, Homo sapiens
ctgtttcctagctgtgt

SEQ ID NO: 4690227 - DNA, 22 bp, Homo sapiens
ctgtttggaaattgattttgaa

SEQ ID NO: 4690228 - DNA, 18 bp, Homo sapiens
ctgtttgtttctgaaagg

SEQ ID NO: 4690229 - DNA, 21 bp, Homo sapiens
ctgtttgtttctgaaagggac

SEQ ID NO: 4690230 - DNA, 23 bp, Homo sapiens
ctgtttgtttctgaaagggacgc

SEQ ID NO: 4690231 - DNA, 21 bp, Homo sapiens
ctgtttttctctaatgcttga

SEQ ID NO: 4690232 - DNA, 12 bp, Homo sapiens
cttaaaaactca

SEQ ID NO: 4690233 - DNA, 14 bp, Homo sapiens
cttaaagtcagtaa

SEQ ID NO: 4690234 - DNA, 18 bp, Homo sapiens
cttaagaattttgagcag

SEQ ID NO: 4690235 - DNA, 20 bp, Homo sapiens
cttaatagaaacattgaaga

SEQ ID NO: 4690236 - DNA, 20 bp, Homo sapiens
cttaatcttttcacaaataa

SEQ ID NO: 4690237 - DNA, 22 bp, Homo sapiens
cttaattagacctaggcctcag

SEQ ID NO: 4690238 - DNA, 15 bp, Homo sapiens
cttacaccagtttga

SEQ ID NO: 4690239 - DNA, 22 bp, Homo sapiens
cttacaccagtttgactgtgct

SEQ ID NO: 4690240 - DNA, 22 bp, Homo sapiens
cttacagctgggtggcactgcc

SEQ ID NO: 4690241 - DNA, 16 bp, Homo sapiens
cttacagtaggagccc

SEQ ID NO: 4690242 - DNA, 15 bp, Homo sapiens
cttaccagcagagca

SEQ ID NO: 4690243 - DNA, 16 bp, Homo sapiens
cttaccagcagagcac

SEQ ID NO: 4690244 - DNA, 21 bp, Homo sapiens
cttactaaaaagtataaaata

SEQ ID NO: 4690245 - DNA, 17 bp, Homo sapiens
cttactgtggaggaagg

SEQ ID NO: 4690246 - DNA, 12 bp, Homo sapiens
cttactttgtgc

SEQ ID NO: 4690247 - DNA, 19 bp, Homo sapiens
cttactttgtgcaaaagca

SEQ ID NO: 4690248 - DNA, 15 bp, Homo sapiens
cttagaagtcacaca

SEQ ID NO: 4690249 - DNA, 17 bp, Homo sapiens
cttagaagtcacacagt

SEQ ID NO: 4690250 - DNA, 16 bp, Homo sapiens
cttagaagtggaagta

SEQ ID NO: 4690251 - DNA, 17 bp, Homo sapiens
cttagagcctccctcaa

SEQ ID NO: 4690252 - DNA, 23 bp, Homo sapiens
cttagagcctccctcaattcccc

SEQ ID NO: 4690253 - DNA, 22 bp, Homo sapiens
cttagattgtgttcctgaagaa

SEQ ID NO: 4690254 - DNA, 16 bp, Homo sapiens
cttagctttttaattg

SEQ ID NO: 4690255 - DNA, 16 bp, Homo sapiens
cttaggagcagagctc

SEQ ID NO: 4690256 - DNA, 18 bp, Homo sapiens
cttaggagcagagctctg

SEQ ID NO: 4690257 - DNA, 19 bp, Homo sapiens
cttaggcatgactgtagaa

SEQ ID NO: 4690258 - DNA, 18 bp, Homo sapiens
cttagtcactgagacagc

SEQ ID NO: 4690259 - DNA, 19 bp, Homo sapiens
cttagtcactgagacagcc

SEQ ID NO: 4690260 - DNA, 20 bp, Homo sapiens
cttagtcactgagacagccc

SEQ ID NO: 4690261 - DNA, 15 bp, Homo sapiens
cttataaaccaatct

SEQ ID NO: 4690262 - DNA, 19 bp, Homo sapiens
cttataaaccaatcttaaa

SEQ ID NO: 4690263 - DNA, 14 bp, Homo sapiens
cttataaatatcct

SEQ ID NO: 4690264 - DNA, 16 bp, Homo sapiens
cttatcaaaggacacc

SEQ ID NO: 4690265 - DNA, 20 bp, Homo sapiens
cttatcaactggttgtatat

SEQ ID NO: 4690266 - DNA, 15 bp, Homo sapiens
cttatcaattgcaaa

SEQ ID NO: 4690267 - DNA, 15 bp, Homo sapiens
cttatccagctggtg

SEQ ID NO: 4690268 - DNA, 11 bp, Homo sapiens
ctgagctgtca

SEQ ID NO: 4690269 - DNA, 18 bp, Homo sapiens
ctgaggaagaacggggct

SEQ ID NO: 4690270 - DNA, 17 bp, Homo sapiens
ctgaggaatccagaccc

SEQ ID NO: 4690271 - DNA, 20 bp, Homo sapiens
ctgaggaatccagacccggc

SEQ ID NO: 4690272 - DNA, 22 bp, Homo sapiens
ctgaggcagcagtgtgaggcca

SEQ ID NO: 4690273 - DNA, 23 bp, Homo sapiens
ctgaggcagcagtgtgaggccag

SEQ ID NO: 4690274 - DNA, 24 bp, Homo sapiens
ctgaggcagcagtgtgaggccagg

SEQ ID NO: 4690275 - DNA, 18 bp, Homo sapiens
ctgaggcccagagggcct

SEQ ID NO: 4690276 - DNA, 23 bp, Homo sapiens
ctgaggcccagagggcctgcaag

SEQ ID NO: 4690277 - DNA, 14 bp, Homo sapiens
ctgaggcccttctc

SEQ ID NO: 4690278 - DNA, 18 bp, Homo sapiens
ctgaggcccttctctcca

SEQ ID NO: 4690279 - DNA, 20 bp, Homo sapiens
ctgaggcccttctctccagc

SEQ ID NO: 4690280 - DNA, 24 bp, Homo sapiens
ctgaggcccttctctccagcccct

SEQ ID NO: 4690281 - DNA, 17 bp, Homo sapiens
ctgaggcctgagcgctc

SEQ ID NO: 4690282 - DNA, 22 bp, Homo sapiens
ctgaggcctgagcgctcctgcc

SEQ ID NO: 4690283 - DNA, 17 bp, Homo sapiens
ctgaggctgggctccct

SEQ ID NO: 4690284 - DNA, 12 bp, Homo sapiens
ctgagggagcct

SEQ ID NO: 4690285 - DNA, 17 bp, Homo sapiens
ctgaggtctagaaatag

SEQ ID NO: 4690286 - DNA, 19 bp, Homo sapiens
ctgaggtctcgctgatgct

SEQ ID NO: 4690287 - DNA, 15 bp, Homo sapiens
ctgagtagctgggat

SEQ ID NO: 4690288 - DNA, 14 bp, Homo sapiens
ctgagtctgaaggc

SEQ ID NO: 4690289 - DNA, 16 bp, Homo sapiens
ctgagtctgaaggctg

SEQ ID NO: 4690290 - DNA, 19 bp, Homo sapiens
ctgagtctgaaggctgggt

SEQ ID NO: 4690291 - DNA, 17 bp, Homo sapiens
ctgagtctggcaaacat

SEQ ID NO: 4690292 - DNA, 20 bp, Homo sapiens
ctgagtctggcaaacatgtg

SEQ ID NO: 4690293 - DNA, 14 bp, Homo sapiens
ctgagtgcctggcc

SEQ ID NO: 4690294 - DNA, 16 bp, Homo sapiens
ctgagtgcctggccaa

SEQ ID NO: 4690295 - DNA, 20 bp, Homo sapiens
ctgagttgacttgacagaac

SEQ ID NO: 4690296 - DNA, 21 bp, Homo sapiens
ctgagttggtgttgacatgtg

SEQ ID NO: 4690297 - DNA, 19 bp, Homo sapiens
ctgataaaaccatgtagaa

SEQ ID NO: 4690298 - DNA, 17 bp, Homo sapiens
ctgatagggatacatgc

SEQ ID NO: 4690299 - DNA, 19 bp, Homo sapiens
ctgatagggatacatgctc

SEQ ID NO: 4690300 - DNA, 22 bp, Homo sapiens
ctgatatttccctcccctgggg

SEQ ID NO: 4690301 - DNA, 20 bp, Homo sapiens
ctgatcagagccgtggtcct

SEQ ID NO: 4690302 - DNA, 15 bp, Homo sapiens
ctgatccctctacag

SEQ ID NO: 4690303 - DNA, 21 bp, Homo sapiens
ctgatcctagttccaccatca

SEQ ID NO: 4690304 - DNA, 20 bp, Homo sapiens
ctgatctgatgcaagcaaga

SEQ ID NO: 4690305 - DNA, 19 bp, Homo sapiens
ctgatcttacctttatgag

SEQ ID NO: 4690306 - DNA, 13 bp, Homo sapiens
ctgatgaaaataa

SEQ ID NO: 4690307 - DNA, 17 bp, Homo sapiens
ctgatgatgtgcctggg

SEQ ID NO: 4690308 - DNA, 20 bp, Homo sapiens
ctgatgatttcttgaaaagg

SEQ ID NO: 4690309 - DNA, 13 bp, Homo sapiens
ctgatgctgggct

SEQ ID NO: 4690310 - DNA, 15 bp, Homo sapiens
ctgatgctgggctgg

SEQ ID NO: 4690311 - DNA, 16 bp, Homo sapiens
ctgatgctgggctggg

SEQ ID NO: 4690312 - DNA, 16 bp, Homo sapiens
ctgatgcttcttcaga

SEQ ID NO: 4690313 - DNA, 17 bp, Homo sapiens
ctgatgcttcttcagag

SEQ ID NO: 4690314 - DNA, 19 bp, Homo sapiens
ctgatggcaggatggcctg

SEQ ID NO: 4690315 - DNA, 12 bp, Homo sapiens
ctgatggcttct

SEQ ID NO: 4690316 - DNA, 21 bp, Homo sapiens
ctgatgggcaacccccagcct

SEQ ID NO: 4690317 - DNA, 22 bp, Homo sapiens
ctgatgggcaacccccagcctg

SEQ ID NO: 4690318 - DNA, 15 bp, Homo sapiens
ctgatgttactgaga

SEQ ID NO: 4690319 - DNA, 22 bp, Homo sapiens
ctgatgtttgggggttaccaaa

SEQ ID NO: 4690320 - DNA, 14 bp, Homo sapiens
ctgattagataatc

SEQ ID NO: 4690321 - DNA, 20 bp, Homo sapiens
ctgattcccaagctctgctc

SEQ ID NO: 4690322 - DNA, 22 bp, Homo sapiens
ctgattcccaagctctgctcct

SEQ ID NO: 4690323 - DNA, 16 bp, Homo sapiens
ctgattcggctgtctc

SEQ ID NO: 4690324 - DNA, 17 bp, Homo sapiens
ctgattcggctgtctca

SEQ ID NO: 4690325 - DNA, 23 bp, Homo sapiens
ctgattcggctgtctcagactct

SEQ ID NO: 4690326 - DNA, 17 bp, Homo sapiens
ctgattctcagggtctc

SEQ ID NO: 4690327 - DNA, 18 bp, Homo sapiens
ctgattctcagggtctct

SEQ ID NO: 4690328 - DNA, 22 bp, Homo sapiens
ctgatttagcaatgctgtgaat

SEQ ID NO: 4690329 - DNA, 14 bp, Homo sapiens
ctgcaaaaagaaaa

SEQ ID NO: 4690330 - DNA, 13 bp, Homo sapiens
ctgcaaagcccag

SEQ ID NO: 4690331 - DNA, 20 bp, Homo sapiens
ctgcaacctccgcctcttgg

SEQ ID NO: 4690332 - DNA, 19 bp, Homo sapiens
ctgcaacttgtaaatgtgg

SEQ ID NO: 4690333 - DNA, 18 bp, Homo sapiens
ctgcaatgtttttgtgta

SEQ ID NO: 4690334 - DNA, 20 bp, Homo sapiens
ctgcacaataaaaccaagcc

SEQ ID NO: 4690335 - DNA, 20 bp, Homo sapiens
ctgcacactcagttctgctc

SEQ ID NO: 4690336 - DNA, 14 bp, Homo sapiens
ctgcacagaagaca

SEQ ID NO: 4690337 - DNA, 13 bp, Homo sapiens
ctgcaccaaccca

SEQ ID NO: 4690338 - DNA, 16 bp, Homo sapiens
ctgcaccaacccagcc

SEQ ID NO: 4690339 - DNA, 23 bp, Homo sapiens
ctgcaccaacccagccgctgccc

SEQ ID NO: 4690340 - DNA, 19 bp, Homo sapiens
ctgcaccccctcctgctgc

SEQ ID NO: 4690341 - DNA, 14 bp, Homo sapiens
ctgcaccggctggc

SEQ ID NO: 4690342 - DNA, 16 bp, Homo sapiens
ctgcaccggctggcct

SEQ ID NO: 4690343 - DNA, 19 bp, Homo sapiens
ctgcaccggctggcctggc

SEQ ID NO: 4690344 - DNA, 20 bp, Homo sapiens
ctgcaccggctggcctggcc

SEQ ID NO: 4690345 - DNA, 23 bp, Homo sapiens
ctgcaccggctggcctggcccct

SEQ ID NO: 4690346 - DNA, 20 bp, Homo sapiens
ctgcaccgggccacagagaa

SEQ ID NO: 4690347 - DNA, 21 bp, Homo sapiens
ctgcaccttctgacgcagcct

SEQ ID NO: 4690348 - DNA, 20 bp, Homo sapiens
ctgcactatagcctaggtga

SEQ ID NO: 4690349 - DNA, 18 bp, Homo sapiens
ctgcactcccctgctggg

SEQ ID NO: 4690350 - DNA, 20 bp, Homo sapiens
ctgcactcccctgctgggtg

SEQ ID NO: 4690351 - DNA, 21 bp, Homo sapiens
ctgcactcccctgctgggtgt

SEQ ID NO: 4690352 - DNA, 16 bp, Homo sapiens
ctgcactctgtgccca

SEQ ID NO: 4690353 - DNA, 18 bp, Homo sapiens
ctgcactctgtgcccatg

SEQ ID NO: 4690354 - DNA, 21 bp, Homo sapiens
ctgcactctgtgcccatgggc

SEQ ID NO: 4690355 - DNA, 17 bp, Homo sapiens
ctgcactgtcctgctcc

SEQ ID NO: 4690356 - DNA, 18 bp, Homo sapiens
ctgcactgtcctgctcca

SEQ ID NO: 4690357 - DNA, 21 bp, Homo sapiens
ctgcactgtcctgctccacag

SEQ ID NO: 4690358 - DNA, 17 bp, Homo sapiens
ctgcacttgcagactct

SEQ ID NO: 4690359 - DNA, 15 bp, Homo sapiens
ctgcagaggggcagg

SEQ ID NO: 4690360 - DNA, 17 bp, Homo sapiens
ctgcagaggggcaggcc

SEQ ID NO: 4690361 - DNA, 20 bp, Homo sapiens
ctgcagatttgggctggaac

SEQ ID NO: 4690362 - DNA, 23 bp, Homo sapiens
ctgcagcagggcaggaaggggaa

SEQ ID NO: 4690363 - DNA, 19 bp, Homo sapiens
ctgcagcctcaacctcctg

SEQ ID NO: 4690364 - DNA, 15 bp, Homo sapiens
ctgcaggaaggagct

SEQ ID NO: 4690365 - DNA, 16 bp, Homo sapiens
ctgcaggaaggagctg

SEQ ID NO: 4690366 - DNA, 17 bp, Homo sapiens
ctgcaggaaggagctgc

SEQ ID NO: 4690367 - DNA, 18 bp, Homo sapiens
ctgcaggaaggagctgcc

SEQ ID NO: 4690368 - DNA, 19 bp, Homo sapiens
ctgcaggaaggagctgcct

SEQ ID NO: 4690369 - DNA, 20 bp, Homo sapiens
ctgcaggaaggagctgcctg

SEQ ID NO: 4690370 - DNA, 23 bp, Homo sapiens
ctgcaggaaggagctgcctggac

SEQ ID NO: 4690371 - DNA, 19 bp, Homo sapiens
ctgcaggcagcaaaaacag

SEQ ID NO: 4690372 - DNA, 18 bp, Homo sapiens
ctgcaggcagccaggcca

SEQ ID NO: 4690373 - DNA, 19 bp, Homo sapiens
ctgcaggcagccaggccac

SEQ ID NO: 4690374 - DNA, 20 bp, Homo sapiens
ctgcaggcagccaggccaca

SEQ ID NO: 4690375 - DNA, 13 bp, Homo sapiens
ctgcagttgccag

SEQ ID NO: 4690376 - DNA, 23 bp, Homo sapiens
ctgcatgtaaaatcttcagctgg

SEQ ID NO: 4690377 - DNA, 22 bp, Homo sapiens
ctgcattggaactggaggcagg

SEQ ID NO: 4690378 - DNA, 23 bp, Homo sapiens
ctgcatttggcaggaagatgtat

SEQ ID NO: 4690379 - DNA, 20 bp, Homo sapiens
ctgcattttgtagcctctct

SEQ ID NO: 4690380 - DNA, 18 bp, Homo sapiens
ctgcatttttaaaggaca

SEQ ID NO: 4690381 - DNA, 21 bp, Homo sapiens
ctgccaacttcttcagagctg

SEQ ID NO: 4690382 - DNA, 19 bp, Homo sapiens
ctgccaccacgcccggcta

SEQ ID NO: 4690383 - DNA, 15 bp, Homo sapiens
ctgccaccctgggga

SEQ ID NO: 4690384 - DNA, 14 bp, Homo sapiens
ctgccacctggacc

SEQ ID NO: 4690385 - DNA, 16 bp, Homo sapiens
ctgccacctggacccc

SEQ ID NO: 4690386 - DNA, 13 bp, Homo sapiens
ctgccacttccca

SEQ ID NO: 4690387 - DNA, 16 bp, Homo sapiens
ctgccacttcccaggt

SEQ ID NO: 4690388 - DNA, 17 bp, Homo sapiens
ctgccagctctgtatca

SEQ ID NO: 4690389 - DNA, 22 bp, Homo sapiens
ctgccagggacagagggggtgg

SEQ ID NO: 4690390 - DNA, 16 bp, Homo sapiens
ctgccagttccctccc

SEQ ID NO: 4690391 - DNA, 16 bp, Homo sapiens
ctgccatattctgttg

SEQ ID NO: 4690392 - DNA, 20 bp, Homo sapiens
ctgccatattctgttggcca

SEQ ID NO: 4690393 - DNA, 21 bp, Homo sapiens
ctgccatattctgttggccag

SEQ ID NO: 4690394 - DNA, 12 bp, Homo sapiens
ctgccatccagg

SEQ ID NO: 4690395 - DNA, 16 bp, Homo sapiens
ctgccatccaggttca

SEQ ID NO: 4690396 - DNA, 18 bp, Homo sapiens
ctgccatccaggttcagc

SEQ ID NO: 4690397 - DNA, 19 bp, Homo sapiens
ctgccatccaggttcagct

SEQ ID NO: 4690398 - DNA, 16 bp, Homo sapiens
ctgccatgtccatagc

SEQ ID NO: 4690399 - DNA, 22 bp, Homo sapiens
ctgccatgtccatagccataat

SEQ ID NO: 4690400 - DNA, 16 bp, Homo sapiens
ctgcccaactttcatt

SEQ ID NO: 4690401 - DNA, 19 bp, Homo sapiens
ctgcccaactttcattggt

SEQ ID NO: 4690402 - DNA, 16 bp, Homo sapiens
ctgcccacctccttcc

SEQ ID NO: 4690403 - DNA, 14 bp, Homo sapiens
ctgcccacctggcc

SEQ ID NO: 4690404 - DNA, 17 bp, Homo sapiens
ctgcccacctggcctct

SEQ ID NO: 4690405 - DNA, 22 bp, Homo sapiens
ctgcccacctggcctctgcact

SEQ ID NO: 4690406 - DNA, 21 bp, Homo sapiens
ctgcccaggacggggccggcc

SEQ ID NO: 4690407 - DNA, 13 bp, Homo sapiens
ctgcccagttgca

SEQ ID NO: 4690408 - DNA, 16 bp, Homo sapiens
ctgcccccaggactgg

SEQ ID NO: 4690409 - DNA, 19 bp, Homo sapiens
ctgcccccaggactgggcc

SEQ ID NO: 4690410 - DNA, 11 bp, Homo sapiens
ctgcccctccc

SEQ ID NO: 4690411 - DNA, 14 bp, Homo sapiens
ctgcccctccctgc

SEQ ID NO: 4690412 - DNA, 15 bp, Homo sapiens
ctgcccctccctgcc

SEQ ID NO: 4690413 - DNA, 17 bp, Homo sapiens
ctgcccctccctgcctc

SEQ ID NO: 4690414 - DNA, 14 bp, Homo sapiens
ctgcccgctcccag

SEQ ID NO: 4690415 - DNA, 15 bp, Homo sapiens
ctgcccgctcccagt

SEQ ID NO: 4690416 - DNA, 19 bp, Homo sapiens
ctgcccgctcccagtgtct

SEQ ID NO: 4690417 - DNA, 15 bp, Homo sapiens
ctgcccggcgccctc

SEQ ID NO: 4690418 - DNA, 20 bp, Homo sapiens
ctgccctaatgcgcaggctg

SEQ ID NO: 4690419 - DNA, 19 bp, Homo sapiens
ctgccctccaagaccttct

SEQ ID NO: 4690420 - DNA, 16 bp, Homo sapiens
ctgcttccagtgaggc

SEQ ID NO: 4690421 - DNA, 20 bp, Homo sapiens
ctgcttccagtgaggctctg

SEQ ID NO: 4690422 - DNA, 22 bp, Homo sapiens
ctgctttttccaactcagaaat

SEQ ID NO: 4690423 - DNA, 14 bp, Homo sapiens
ctggaacagattca

SEQ ID NO: 4690424 - DNA, 17 bp, Homo sapiens
ctggaaccacattgaag

SEQ ID NO: 4690425 - DNA, 16 bp, Homo sapiens
ctggaaccatcagaaa

SEQ ID NO: 4690426 - DNA, 17 bp, Homo sapiens
ctggaactcagtgtgac

SEQ ID NO: 4690427 - DNA, 18 bp, Homo sapiens
ctggaagcacagcttcat

SEQ ID NO: 4690428 - DNA, 17 bp, Homo sapiens
ctggaagggcagcatat

SEQ ID NO: 4690429 - DNA, 15 bp, Homo sapiens
ctggaagggctagaa

SEQ ID NO: 4690430 - DNA, 14 bp, Homo sapiens
ctggaatgcagtgg

SEQ ID NO: 4690431 - DNA, 15 bp, Homo sapiens
ctggaatgcagtggt

SEQ ID NO: 4690432 - DNA, 15 bp, Homo sapiens
ctggaatggaaaagg

SEQ ID NO: 4690433 - DNA, 14 bp, Homo sapiens
ctggacaggcatgt

SEQ ID NO: 4690434 - DNA, 23 bp, Homo sapiens
ctggacaggcatgttctctgagg

SEQ ID NO: 4690435 - DNA, 13 bp, Homo sapiens
ctggacccctgca

SEQ ID NO: 4690436 - DNA, 14 bp, Homo sapiens
ctggacccctgcat

SEQ ID NO: 4690437 - DNA, 23 bp, Homo sapiens
ctggacccgttcatgggggaggg

SEQ ID NO: 4690438 - DNA, 13 bp, Homo sapiens
ctggacctctctt

SEQ ID NO: 4690439 - DNA, 17 bp, Homo sapiens
ctggaccttgaactggg

SEQ ID NO: 4690440 - DNA, 20 bp, Homo sapiens
ctggaccttgaactgggtac

SEQ ID NO: 4690441 - DNA, 16 bp, Homo sapiens
ctggactcaggaactt

SEQ ID NO: 4690442 - DNA, 17 bp, Homo sapiens
ctggactctcagtctct

SEQ ID NO: 4690443 - DNA, 18 bp, Homo sapiens
ctggactctcagtctctg

SEQ ID NO: 4690444 - DNA, 20 bp, Homo sapiens
ctggactctcagtctctgag

SEQ ID NO: 4690445 - DNA, 12 bp, Homo sapiens
ctggactgaggc

SEQ ID NO: 4690446 - DNA, 19 bp, Homo sapiens
ctggacttggcccctgcca

SEQ ID NO: 4690447 - DNA, 19 bp, Homo sapiens
ctggagactcctaggcagg

SEQ ID NO: 4690448 - DNA, 19 bp, Homo sapiens
ctggagagccagaacctgg

SEQ ID NO: 4690449 - DNA, 19 bp, Homo sapiens
ctggagagctagaacctgg

SEQ ID NO: 4690450 - DNA, 20 bp, Homo sapiens
ctggagagctagaacctgga

SEQ ID NO: 4690451 - DNA, 22 bp, Homo sapiens
ctggagagctagaacctggaga

SEQ ID NO: 4690452 - DNA, 17 bp, Homo sapiens
ctggagcccagaggagg

SEQ ID NO: 4690453 - DNA, 23 bp, Homo sapiens
ctggagcccagaggagggcagca

SEQ ID NO: 4690454 - DNA, 16 bp, Homo sapiens
ctggagcctggtgccc

SEQ ID NO: 4690455 - DNA, 19 bp, Homo sapiens
ctggaggactagaacctgg

SEQ ID NO: 4690456 - DNA, 13 bp, Homo sapiens
ctggaggagccca

SEQ ID NO: 4690457 - DNA, 21 bp, Homo sapiens
ctggagggaatgaacctggag

SEQ ID NO: 4690458 - DNA, 20 bp, Homo sapiens
ctggagggctagaacctaga

SEQ ID NO: 4690459 - DNA, 21 bp, Homo sapiens
ctggagggctagaactggaga

SEQ ID NO: 4690460 - DNA, 21 bp, Homo sapiens
ctggaggggtgttgtatggct

SEQ ID NO: 4690461 - DNA, 14 bp, Homo sapiens
ctggagtgcagtga

SEQ ID NO: 4690462 - DNA, 16 bp, Homo sapiens
ctggagtgcagtgagc

SEQ ID NO: 4690463 - DNA, 15 bp, Homo sapiens
ctggatgcagcctca

SEQ ID NO: 4690464 - DNA, 18 bp, Homo sapiens
ctggatgcagcctcacag

SEQ ID NO: 4690465 - DNA, 15 bp, Homo sapiens
ctggatggggctgca

SEQ ID NO: 4690466 - DNA, 13 bp, Homo sapiens
ctggatgggggct

SEQ ID NO: 4690467 - DNA, 20 bp, Homo sapiens
cacatgtcagtaccttcaaa

SEQ ID NO: 4690468 - DNA, 17 bp, Homo sapiens
cacatgtccaagaagcc

SEQ ID NO: 4690469 - DNA, 13 bp, Homo sapiens
cacatgttctaat

SEQ ID NO: 4690470 - DNA, 16 bp, Homo sapiens
cacattcctgatgctt

SEQ ID NO: 4690471 - DNA, 18 bp, Homo sapiens
cacattgccccatgagac

SEQ ID NO: 4690472 - DNA, 20 bp, Homo sapiens
cacatttacactagaggcca

SEQ ID NO: 4690473 - DNA, 14 bp, Homo sapiens
cacatttttcagat

SEQ ID NO: 4690474 - DNA, 16 bp, Homo sapiens
caccaaacatactaga

SEQ ID NO: 4690475 - DNA, 20 bp, Homo sapiens
caccaacatactcccatctg

SEQ ID NO: 4690476 - DNA, 21 bp, Homo sapiens
caccaacccagccgctgcccg

SEQ ID NO: 4690477 - DNA, 17 bp, Homo sapiens
caccaacgtctgtgcca

SEQ ID NO: 4690478 - DNA, 12 bp, Homo sapiens
caccaagcccag

SEQ ID NO: 4690479 - DNA, 14 bp, Homo sapiens
caccaagctgtgcc

SEQ ID NO: 4690480 - DNA, 16 bp, Homo sapiens
caccaagctgtgccac

SEQ ID NO: 4690481 - DNA, 21 bp, Homo sapiens
caccaagctgtgccaccctgg

SEQ ID NO: 4690482 - DNA, 22 bp, Homo sapiens
caccaagttggaacatccttgg

SEQ ID NO: 4690483 - DNA, 15 bp, Homo sapiens
caccacacccagccc

SEQ ID NO: 4690484 - DNA, 19 bp, Homo sapiens
caccacacccagcccactt

SEQ ID NO: 4690485 - DNA, 15 bp, Homo sapiens
caccacatgtgcaca

SEQ ID NO: 4690486 - DNA, 13 bp, Homo sapiens
caccacccagagc

SEQ ID NO: 4690487 - DNA, 14 bp, Homo sapiens
caccaccccccact

SEQ ID NO: 4690488 - DNA, 18 bp, Homo sapiens
caccaccccccactctgt

SEQ ID NO: 4690489 - DNA, 14 bp, Homo sapiens
caccacctcagagt

SEQ ID NO: 4690490 - DNA, 15 bp, Homo sapiens
caccacggtggtcac

SEQ ID NO: 4690491 - DNA, 19 bp, Homo sapiens
caccactgtactccagccc

SEQ ID NO: 4690492 - DNA, 17 bp, Homo sapiens
caccagagcagatgcag

SEQ ID NO: 4690493 - DNA, 19 bp, Homo sapiens
caccagagcagatgcagag

SEQ ID NO: 4690494 - DNA, 13 bp, Homo sapiens
caccagccccagt

SEQ ID NO: 4690495 - DNA, 16 bp, Homo sapiens
caccagccccagtgcc

SEQ ID NO: 4690496 - DNA, 21 bp, Homo sapiens
caccagccccagtgcccacag

SEQ ID NO: 4690497 - DNA, 17 bp, Homo sapiens
caccaggggcaggcaca

SEQ ID NO: 4690498 - DNA, 20 bp, Homo sapiens
caccaggggcaggcacagca

SEQ ID NO: 4690499 - DNA, 20 bp, Homo sapiens
caccataatccctgtcttct

SEQ ID NO: 4690500 - DNA, 13 bp, Homo sapiens
caccatcaagcca

SEQ ID NO: 4690501 - DNA, 23 bp, Homo sapiens
caccatcttaagagatgcctcat

SEQ ID NO: 4690502 - DNA, 17 bp, Homo sapiens
caccatttggcaatgcc

SEQ ID NO: 4690503 - DNA, 17 bp, Homo sapiens
cacccaagggcctggcc

SEQ ID NO: 4690504 - DNA, 19 bp, Homo sapiens
cacccaagggcctggcctg

SEQ ID NO: 4690505 - DNA, 12 bp, Homo sapiens
cacccacctcag

SEQ ID NO: 4690506 - DNA, 13 bp, Homo sapiens
cacccagagaaaa

SEQ ID NO: 4690507 - DNA, 16 bp, Homo sapiens
cacccagagcaccctc

SEQ ID NO: 4690508 - DNA, 17 bp, Homo sapiens
cacccagcccacttctg

SEQ ID NO: 4690509 - DNA, 16 bp, Homo sapiens
cacccaggagccccga

SEQ ID NO: 4690510 - DNA, 23 bp, Homo sapiens
cacccaggagccccgaggccttc

SEQ ID NO: 4690511 - DNA, 22 bp, Homo sapiens
cacccaggggacgcgctggaaa

SEQ ID NO: 4690512 - DNA, 11 bp, Homo sapiens
caccccagccc

SEQ ID NO: 4690513 - DNA, 19 bp, Homo sapiens
caccccagggcagccaggg

SEQ ID NO: 4690514 - DNA, 22 bp, Homo sapiens
caccccagggcagccagggaga

SEQ ID NO: 4690515 - DNA, 14 bp, Homo sapiens
cacccccacccctt

SEQ ID NO: 4690516 - DNA, 15 bp, Homo sapiens
caccccctcctgctg

SEQ ID NO: 4690517 - DNA, 17 bp, Homo sapiens
caccccctcctgctgca

SEQ ID NO: 4690518 - DNA, 18 bp, Homo sapiens
cacccctccctttctccc

SEQ ID NO: 4690519 - DNA, 23 bp, Homo sapiens
cacccgggctcagggaccacagc

SEQ ID NO: 4690520 - DNA, 12 bp, Homo sapiens
caccctcacact

SEQ ID NO: 4690521 - DNA, 12 bp, Homo sapiens
caccctcccctc

SEQ ID NO: 4690522 - DNA, 12 bp, Homo sapiens
caccctcctttc

SEQ ID NO: 4690523 - DNA, 12 bp, Homo sapiens
caccctgctctc

SEQ ID NO: 4690524 - DNA, 19 bp, Homo sapiens
caccctgggctctgtgggc

SEQ ID NO: 4690525 - DNA, 22 bp, Homo sapiens
caccctgggctctgtgggctgc

SEQ ID NO: 4690526 - DNA, 11 bp, Homo sapiens
caccctgtgat

SEQ ID NO: 4690527 - DNA, 16 bp, Homo sapiens
cctgctgcaccaaccc

SEQ ID NO: 4690528 - DNA, 19 bp, Homo sapiens
cctgctgcaccaacccagc

SEQ ID NO: 4690529 - DNA, 16 bp, Homo sapiens
cctgctgcagaggggc

SEQ ID NO: 4690530 - DNA, 20 bp, Homo sapiens
cctgctgcagttgccagtca

SEQ ID NO: 4690531 - DNA, 16 bp, Homo sapiens
cctgctgctgcctgcc

SEQ ID NO: 4690532 - DNA, 23 bp, Homo sapiens
cctgctggctggtgcctgagccc

SEQ ID NO: 4690533 - DNA, 20 bp, Homo sapiens
cctgctgggtgtggcgcagc

SEQ ID NO: 4690534 - DNA, 19 bp, Homo sapiens
cctgctgtcccctcttgcc

SEQ ID NO: 4690535 - DNA, 22 bp, Homo sapiens
cctgctgtcccctcttgcccca

SEQ ID NO: 4690536 - DNA, 12 bp, Homo sapiens
cctggaagacag

SEQ ID NO: 4690537 - DNA, 13 bp, Homo sapiens
cctggaagacaga

SEQ ID NO: 4690538 - DNA, 22 bp, Homo sapiens
cctggaagacagagacctcctg

SEQ ID NO: 4690539 - DNA, 11 bp, Homo sapiens
cctggaagggc

SEQ ID NO: 4690540 - DNA, 12 bp, Homo sapiens
cctggaagggct

SEQ ID NO: 4690541 - DNA, 13 bp, Homo sapiens
cctggacccctgc

SEQ ID NO: 4690542 - DNA, 19 bp, Homo sapiens
cctggacttggcccctgcc

SEQ ID NO: 4690543 - DNA, 23 bp, Homo sapiens
cctggagaactagaacctggagg

SEQ ID NO: 4690544 - DNA, 13 bp, Homo sapiens
cctggagagctag

SEQ ID NO: 4690545 - DNA, 21 bp, Homo sapiens
cctggagagctagaacctgga

SEQ ID NO: 4690546 - DNA, 13 bp, Homo sapiens
cctggagcccaga

SEQ ID NO: 4690547 - DNA, 14 bp, Homo sapiens
cctggagcccagag

SEQ ID NO: 4690548 - DNA, 17 bp, Homo sapiens
cctggagcccagaggag

SEQ ID NO: 4690549 - DNA, 18 bp, Homo sapiens
cctggagggctagaactg

SEQ ID NO: 4690550 - DNA, 20 bp, Homo sapiens
cctggaggggctagaaccta

SEQ ID NO: 4690551 - DNA, 22 bp, Homo sapiens
cctggaggggctagaacctaga

SEQ ID NO: 4690552 - DNA, 15 bp, Homo sapiens
cctggatggggctgc

SEQ ID NO: 4690553 - DNA, 12 bp, Homo sapiens
cctggcacagtg

SEQ ID NO: 4690554 - DNA, 13 bp, Homo sapiens
cctggcacagtgt

SEQ ID NO: 4690555 - DNA, 19 bp, Homo sapiens
cctggcacagtgtctgggc

SEQ ID NO: 4690556 - DNA, 20 bp, Homo sapiens
cctggcacagtgtctgggct

SEQ ID NO: 4690557 - DNA, 23 bp, Homo sapiens
cctggcacagtgtctgggctgac

SEQ ID NO: 4690558 - DNA, 21 bp, Homo sapiens
cctggcacccggcccctgctg

SEQ ID NO: 4690559 - DNA, 23 bp, Homo sapiens
cctggcacccggcccctgctggt

SEQ ID NO: 4690560 - DNA, 20 bp, Homo sapiens
cctggcactgcttccagtga

SEQ ID NO: 4690561 - DNA, 21 bp, Homo sapiens
cctggcactgcttccagtgag

SEQ ID NO: 4690562 - DNA, 21 bp, Homo sapiens
cctggccagatgcaccagccc

SEQ ID NO: 4690563 - DNA, 23 bp, Homo sapiens
cctggccagatgcaccagccctt

SEQ ID NO: 4690564 - DNA, 16 bp, Homo sapiens
cctggccagatgtcgc

SEQ ID NO: 4690565 - DNA, 23 bp, Homo sapiens
cctggccagatgtcgctgggtcc

SEQ ID NO: 4690566 - DNA, 19 bp, Homo sapiens
cctggccagggcctggaag

SEQ ID NO: 4690567 - DNA, 20 bp, Homo sapiens
cctggccagggcctggaaga

SEQ ID NO: 4690568 - DNA, 14 bp, Homo sapiens
cctggcccacccca

SEQ ID NO: 4690569 - DNA, 14 bp, Homo sapiens
cctggcccagctcc

SEQ ID NO: 4690570 - DNA, 15 bp, Homo sapiens
cctggcccagctccc

SEQ ID NO: 4690571 - DNA, 16 bp, Homo sapiens
cctggcccagctcccc

SEQ ID NO: 4690572 - DNA, 18 bp, Homo sapiens
cctggcccatcagtgtac

SEQ ID NO: 4690573 - DNA, 16 bp, Homo sapiens
cctggcccctcagggt

SEQ ID NO: 4690574 - DNA, 22 bp, Homo sapiens
cctggccctcaaggcctcccac

SEQ ID NO: 4690575 - DNA, 22 bp, Homo sapiens
cctggcctcaagtgattctcct

SEQ ID NO: 4690576 - DNA, 17 bp, Homo sapiens
cctggcctcccccactt

SEQ ID NO: 4690577 - DNA, 15 bp, Homo sapiens
cctggcctgagctgg

SEQ ID NO: 4690578 - DNA, 21 bp, Homo sapiens
cctggcgtcctctccctcctg

SEQ ID NO: 4690579 - DNA, 13 bp, Homo sapiens
cctgggcaaagcc

SEQ ID NO: 4690580 - DNA, 23 bp, Homo sapiens
cctgggcaaatgaatggctcact

SEQ ID NO: 4690581 - DNA, 20 bp, Homo sapiens
cctgggccccagttgtattt

SEQ ID NO: 4690582 - DNA, 11 bp, Homo sapiens
cctgggccctc

SEQ ID NO: 4690583 - DNA, 15 bp, Homo sapiens
cctgggccctctctg

SEQ ID NO: 4690584 - DNA, 12 bp, Homo sapiens
cctgggctctgt

SEQ ID NO: 4690585 - DNA, 17 bp, Homo sapiens
cctggggctgctggcct

SEQ ID NO: 4690586 - DNA, 19 bp, Homo sapiens
cctgggggcagggagagga

SEQ ID NO: 4690587 - DNA, 13 bp, Homo sapiens
cctgggggcggcc

SEQ ID NO: 4690588 - DNA, 24 bp, Homo sapiens
cctgggggcggccagccctcccag

SEQ ID NO: 4690589 - DNA, 22 bp, Homo sapiens
cctggggtaccaagagactcct

SEQ ID NO: 4690590 - DNA, 20 bp, Homo sapiens
cctgggttagggtgtgtgtt

SEQ ID NO: 4690591 - DNA, 22 bp, Homo sapiens
cctgggttagggtgtgtgttca

SEQ ID NO: 4690592 - DNA, 16 bp, Homo sapiens
cctgggtttaagggga

SEQ ID NO: 4690593 - DNA, 22 bp, Homo sapiens
cctgggttttgtattctctgag

SEQ ID NO: 4690594 - DNA, 23 bp, Homo sapiens
cctgggttttgtattctctgagc

SEQ ID NO: 4690595 - DNA, 14 bp, Homo sapiens
cctggtgacccctt

SEQ ID NO: 4690596 - DNA, 17 bp, Homo sapiens
cctggtgaccccttttc

SEQ ID NO: 4690597 - DNA, 10 bp, Homo sapiens
cctggtgccc

SEQ ID NO: 4690598 - DNA, 13 bp, Homo sapiens
cctggtggcagct

SEQ ID NO: 4690599 - DNA, 18 bp, Homo sapiens
cctggtggcagctcacct

SEQ ID NO: 4690600 - DNA, 21 bp, Homo sapiens
cctggtggcagctcacctctc

SEQ ID NO: 4690601 - DNA, 15 bp, Homo sapiens
cctggtggcagctgc

SEQ ID NO: 4690602 - DNA, 14 bp, Homo sapiens
cctggtggcagtgg

SEQ ID NO: 4690603 - DNA, 19 bp, Homo sapiens
cctggtggcagtgggagct

SEQ ID NO: 4690604 - DNA, 20 bp, Homo sapiens
cctggtggcagtgggagctg

SEQ ID NO: 4690605 - DNA, 21 bp, Homo sapiens
cctggtggcagtgggagctgc

SEQ ID NO: 4690606 - DNA, 12 bp, Homo sapiens
cctggtggccct

SEQ ID NO: 4690607 - DNA, 16 bp, Homo sapiens
cctggtggccctctcc

SEQ ID NO: 4690608 - DNA, 20 bp, Homo sapiens
cctggtttcctgccctggga

SEQ ID NO: 4690609 - DNA, 16 bp, Homo sapiens
cctgtaacctcttcag

SEQ ID NO: 4690610 - DNA, 22 bp, Homo sapiens
cctgtcacttgctggctgtgaa

SEQ ID NO: 4690611 - DNA, 23 bp, Homo sapiens
cctgtcacttgctggctgtgaaa

SEQ ID NO: 4690612 - DNA, 14 bp, Homo sapiens
cctgtcagtgccgc

SEQ ID NO: 4690613 - DNA, 17 bp, Homo sapiens
cctgtccccctgacaac

SEQ ID NO: 4690614 - DNA, 18 bp, Homo sapiens
cctgtgaagtaaggatgt

SEQ ID NO: 4690615 - DNA, 20 bp, Homo sapiens
cctgtgacacttataaatat

SEQ ID NO: 4690616 - DNA, 20 bp, Homo sapiens
cctgtgagtactacagtcct

SEQ ID NO: 4690617 - DNA, 19 bp, Homo sapiens
cctgtgatggggccctgcc

SEQ ID NO: 4690618 - DNA, 15 bp, Homo sapiens
cctgtgcccttattc

SEQ ID NO: 4690619 - DNA, 22 bp, Homo sapiens
cctgtgcttcgggcccttccca

SEQ ID NO: 4690620 - DNA, 21 bp, Homo sapiens
cctgtggaggccgagtctgtc

SEQ ID NO: 4690621 - DNA, 21 bp, Homo sapiens
cctgtgggggaagagcacagc

SEQ ID NO: 4690622 - DNA, 23 bp, Homo sapiens
cctgtgggggaagagcacagccc

SEQ ID NO: 4690623 - DNA, 12 bp, Homo sapiens
cctgtggtgcaa

SEQ ID NO: 4690624 - DNA, 21 bp, Homo sapiens
cctgtgtcttgcaatggcagc

SEQ ID NO: 4690625 - DNA, 22 bp, Homo sapiens
cctgtgtcttgcaatggcagcc

SEQ ID NO: 4690626 - DNA, 19 bp, Homo sapiens
cctgtgtgcgagtctgagt

SEQ ID NO: 4690627 - DNA, 20 bp, Homo sapiens
cctgtgtgtgcgcctacagg

SEQ ID NO: 4690628 - DNA, 13 bp, Homo sapiens
cctgttcagctcc

SEQ ID NO: 4690629 - DNA, 23 bp, Homo sapiens
ccttaaaacagagaaggtcaatc

SEQ ID NO: 4690630 - DNA, 12 bp, Homo sapiens
ccttaacactga

SEQ ID NO: 4690631 - DNA, 20 bp, Homo sapiens
ccttaagccaatcatgtaat

SEQ ID NO: 4690632 - DNA, 16 bp, Homo sapiens
ccttacacttactgtt

SEQ ID NO: 4690633 - DNA, 23 bp, Homo sapiens
ccttaccactgtggaagtccctc

SEQ ID NO: 4690634 - DNA, 14 bp, Homo sapiens
ccttaccagcagag

SEQ ID NO: 4690635 - DNA, 16 bp, Homo sapiens
ccttaccagcagagca

SEQ ID NO: 4690636 - DNA, 20 bp, Homo sapiens
ccttaccagcagagcacctt

SEQ ID NO: 4690637 - DNA, 23 bp, Homo sapiens
ccttactcattaattcaatgaaa

SEQ ID NO: 4690638 - DNA, 17 bp, Homo sapiens
ccttagaagtcacacag

SEQ ID NO: 4690639 - DNA, 14 bp, Homo sapiens
ccttagaagtggaa

SEQ ID NO: 4690640 - DNA, 18 bp, Homo sapiens
ccttagacagtccctgcc

SEQ ID NO: 4690641 - DNA, 19 bp, Homo sapiens
ccttagcagggaaacagct

SEQ ID NO: 4690642 - DNA, 19 bp, Homo sapiens
ccttagcagggaaggctgg

SEQ ID NO: 4690643 - DNA, 16 bp, Homo sapiens
ccttataaaccaatct

SEQ ID NO: 4690644 - DNA, 23 bp, Homo sapiens
ccttatctttctaaaactgcctt

SEQ ID NO: 4690645 - DNA, 21 bp, Homo sapiens
ccttattagagtgtctttcca

SEQ ID NO: 4690646 - DNA, 21 bp, Homo sapiens
ccttattgagcgtgattctgt

SEQ ID NO: 4690647 - DNA, 18 bp, Homo sapiens
ccttattggatatttgat

SEQ ID NO: 4690648 - DNA, 15 bp, Homo sapiens
ccttatttctcatca

SEQ ID NO: 4690649 - DNA, 18 bp, Homo sapiens
ccttcaagaaaacaggca

SEQ ID NO: 4690650 - DNA, 17 bp, Homo sapiens
ccttcacagatgggtgc

SEQ ID NO: 4690651 - DNA, 19 bp, Homo sapiens
ccttcacctttgtccccac

SEQ ID NO: 4690652 - DNA, 18 bp, Homo sapiens
ccttcatgacagcctcca

SEQ ID NO: 4690653 - DNA, 12 bp, Homo sapiens
ccttcatgcatg

SEQ ID NO: 4690654 - DNA, 15 bp, Homo sapiens
ccttcatgcatggaa

SEQ ID NO: 4690655 - DNA, 21 bp, Homo sapiens
ccttcatgcatggaaattccc

SEQ ID NO: 4690656 - DNA, 14 bp, Homo sapiens
ccttccacctcagt

SEQ ID NO: 4690657 - DNA, 18 bp, Homo sapiens
ccttccaggggtgggaca

SEQ ID NO: 4690658 - DNA, 23 bp, Homo sapiens
ccttccatggtgtgatcgtctga

SEQ ID NO: 4690659 - DNA, 12 bp, Homo sapiens
ccttcccacctc

SEQ ID NO: 4690660 - DNA, 22 bp, Homo sapiens
ccttcccagaggggcctgccac

SEQ ID NO: 4690661 - DNA, 19 bp, Homo sapiens
ccttcccaggagtggagga

SEQ ID NO: 4690662 - DNA, 18 bp, Homo sapiens
ccttcccatgacccaggc

SEQ ID NO: 4690663 - DNA, 13 bp, Homo sapiens
ccttccccgaggg

SEQ ID NO: 4690664 - DNA, 23 bp, Homo sapiens
ccttccccgagggatgatgccac

SEQ ID NO: 4690665 - DNA, 19 bp, Homo sapiens
ccttcctaattccacagct

SEQ ID NO: 4690666 - DNA, 12 bp, Homo sapiens
ccttcctcctgg

SEQ ID NO: 4690667 - DNA, 15 bp, Homo sapiens
ccttcctctgagcct

SEQ ID NO: 4690668 - DNA, 20 bp, Homo sapiens
ccttcctggagactgcccag

SEQ ID NO: 4690669 - DNA, 13 bp, Homo sapiens
ccttcgccacctg

SEQ ID NO: 4690670 - DNA, 13 bp, Homo sapiens
ccttctcatcact

SEQ ID NO: 4690671 - DNA, 17 bp, Homo sapiens
ccttctcatcactcccc

SEQ ID NO: 4690672 - DNA, 13 bp, Homo sapiens
ccttctccatcca

SEQ ID NO: 4690673 - DNA, 22 bp, Homo sapiens
ccttctccatccacatgggagc

SEQ ID NO: 4690674 - DNA, 22 bp, Homo sapiens
ccttctccatggccctgccatg

SEQ ID NO: 4690675 - DNA, 22 bp, Homo sapiens
ccttctcccccccggggctggg

SEQ ID NO: 4690676 - DNA, 15 bp, Homo sapiens
ccttctctcatctct

SEQ ID NO: 4690677 - DNA, 17 bp, Homo sapiens
ccttctctccagcccct

SEQ ID NO: 4690678 - DNA, 19 bp, Homo sapiens
ccttctctgtctcatgtgt

SEQ ID NO: 4690679 - DNA, 13 bp, Homo sapiens
ccttctgaatgaa

SEQ ID NO: 4690680 - DNA, 20 bp, Homo sapiens
ccttctgacccatgctgccc

SEQ ID NO: 4690681 - DNA, 16 bp, Homo sapiens
ccttctgacgcagcct

SEQ ID NO: 4690682 - DNA, 18 bp, Homo sapiens
ccttctgacgcagcctga

SEQ ID NO: 4690683 - DNA, 22 bp, Homo sapiens
ccttctgacgcagcctgagaat

SEQ ID NO: 4690684 - DNA, 20 bp, Homo sapiens
ccttctgtcctactctgtgt

SEQ ID NO: 4690685 - DNA, 13 bp, Homo sapiens
ccttctttgataa

SEQ ID NO: 4690686 - DNA, 19 bp, Homo sapiens
ccttctttgataatgttaa

SEQ ID NO: 4690687 - DNA, 21 bp, Homo sapiens
ccttgaaaacactgttctctg

SEQ ID NO: 4690688 - DNA, 21 bp, Homo sapiens
ccttgaccattctccacctgc

SEQ ID NO: 4690689 - DNA, 23 bp, Homo sapiens
ccttgaccattctccacctgcca

SEQ ID NO: 4690690 - DNA, 18 bp, Homo sapiens
ccttgagagaccaggcaa

SEQ ID NO: 4690691 - DNA, 20 bp, Homo sapiens
ccttgagagaccaggcaaag

SEQ ID NO: 4690692 - DNA, 16 bp, Homo sapiens
ccttgaggagtcttgt

SEQ ID NO: 4690693 - DNA, 14 bp, Homo sapiens
ccttgccaaagcac

SEQ ID NO: 4690694 - DNA, 16 bp, Homo sapiens
ccttgcccccctggcc

SEQ ID NO: 4690695 - DNA, 20 bp, Homo sapiens
ccttgccgtctacctgaggg

SEQ ID NO: 4690696 - DNA, 15 bp, Homo sapiens
ccttgctccagcctg

SEQ ID NO: 4690697 - DNA, 16 bp, Homo sapiens
ccttgctccagcctga

SEQ ID NO: 4690698 - DNA, 17 bp, Homo sapiens
ccttgctccagcctgac

SEQ ID NO: 4690699 - DNA, 18 bp, Homo sapiens
ccttggacattttatgtc

SEQ ID NO: 4690700 - DNA, 21 bp, Homo sapiens
ccttggacattttatgtcttt

SEQ ID NO: 4690701 - DNA, 18 bp, Homo sapiens
ccttggcctttacagaaa

SEQ ID NO: 4690702 - DNA, 22 bp, Homo sapiens
ccttggctcaagtcctcttttc

SEQ ID NO: 4690703 - DNA, 12 bp, Homo sapiens
ccttggctgcag

SEQ ID NO: 4690704 - DNA, 14 bp, Homo sapiens
ccttggctgcaggg

SEQ ID NO: 4690705 - DNA, 14 bp, Homo sapiens
ccttgggccctttg

SEQ ID NO: 4690706 - DNA, 13 bp, Homo sapiens
ccttgggctccct

SEQ ID NO: 4690707 - DNA, 20 bp, Homo sapiens
ccttgggggtcctcctccag

SEQ ID NO: 4690708 - DNA, 19 bp, Homo sapiens
ccttgtcaatactgagcca

SEQ ID NO: 4690709 - DNA, 13 bp, Homo sapiens
ccttgtccccaca

SEQ ID NO: 4690710 - DNA, 18 bp, Homo sapiens
ccttgtccccacactcct

SEQ ID NO: 4690711 - DNA, 16 bp, Homo sapiens
ccttgtggcctgggcc

SEQ ID NO: 4690712 - DNA, 19 bp, Homo sapiens
ccttgtggtcccaccccac

SEQ ID NO: 4690713 - DNA, 20 bp, Homo sapiens
ccttgtttctttctgaagtg

SEQ ID NO: 4690714 - DNA, 14 bp, Homo sapiens
cctttagcgcccag

SEQ ID NO: 4690715 - DNA, 14 bp, Homo sapiens
cctttcatttactg

SEQ ID NO: 4690716 - DNA, 16 bp, Homo sapiens
cctttcatttactgtg

SEQ ID NO: 4690717 - DNA, 15 bp, Homo sapiens
cctttctcccctgcc

SEQ ID NO: 4690718 - DNA, 17 bp, Homo sapiens
cctttctcttctctgtt

SEQ ID NO: 4690719 - DNA, 22 bp, Homo sapiens
cctttgaaatattaaaatcact

SEQ ID NO: 4690720 - DNA, 17 bp, Homo sapiens
cctttgacgccatccca

SEQ ID NO: 4690721 - DNA, 22 bp, Homo sapiens
cctttgagtgcagtcctgatca

SEQ ID NO: 4690722 - DNA, 20 bp, Homo sapiens
cctttggcaggtgcagcccc

SEQ ID NO: 4690723 - DNA, 14 bp, Homo sapiens
cctttgtccccacc

SEQ ID NO: 4690724 - DNA, 16 bp, Homo sapiens
cctttgtccccaccgc

SEQ ID NO: 4690725 - DNA, 22 bp, Homo sapiens
cctttgtccccaccgcagacag

SEQ ID NO: 4690726 - DNA, 16 bp, Homo sapiens
cctttgtgaggaagcc

SEQ ID NO: 4690727 - DNA, 21 bp, Homo sapiens
ccttttataaacctctaattt

SEQ ID NO: 4690728 - DNA, 17 bp, Homo sapiens
ccttttcagcttctgct

SEQ ID NO: 4690729 - DNA, 21 bp, Homo sapiens
ccttttgaaattaacctctca

SEQ ID NO: 4690730 - DNA, 14 bp, Homo sapiens
cctttttccttgtc

SEQ ID NO: 4690731 - DNA, 13 bp, Homo sapiens
ccttttttaagat

SEQ ID NO: 4690732 - DNA, 12 bp, Homo sapiens
cgaaatgagctc

SEQ ID NO: 4690733 - DNA, 23 bp, Homo sapiens
cgaacatatcatttgtgaagaat

SEQ ID NO: 4690734 - DNA, 14 bp, Homo sapiens
cgaactggctgcaa

SEQ ID NO: 4690735 - DNA, 15 bp, Homo sapiens
cgaatagctgggact

SEQ ID NO: 4690736 - DNA, 15 bp, Homo sapiens
cgaccccatctgccc

SEQ ID NO: 4690737 - DNA, 19 bp, Homo sapiens
cgaccccatctgcccagga

SEQ ID NO: 4690738 - DNA, 20 bp, Homo sapiens
cgacccttgccgtctacctg

SEQ ID NO: 4690739 - DNA, 17 bp, Homo sapiens
cgagagatcaaagatga

SEQ ID NO: 4690740 - DNA, 15 bp, Homo sapiens
cgagaggaggggccc

SEQ ID NO: 4690741 - DNA, 21 bp, Homo sapiens
cgagatcacaccactgtactc

SEQ ID NO: 4690742 - DNA, 18 bp, Homo sapiens
cgagccctggtggcagtg

SEQ ID NO: 4690743 - DNA, 13 bp, Homo sapiens
cgagcctggctcc

SEQ ID NO: 4690744 - DNA, 13 bp, Homo sapiens
cgaggacagggag

SEQ ID NO: 4690745 - DNA, 16 bp, Homo sapiens
cgaggacagggaggtg

SEQ ID NO: 4690746 - DNA, 15 bp, Homo sapiens
cgagtagctgggact

SEQ ID NO: 4690747 - DNA, 16 bp, Homo sapiens
cgagtagctgggacta

SEQ ID NO: 4690748 - DNA, 14 bp, Homo sapiens
cccgggctctgcct

SEQ ID NO: 4690749 - DNA, 12 bp, Homo sapiens
cccgtggcccca

SEQ ID NO: 4690750 - DNA, 18 bp, Homo sapiens
cccgtggccccagcctgg

SEQ ID NO: 4690751 - DNA, 21 bp, Homo sapiens
cccgtggccccagcctggccc

SEQ ID NO: 4690752 - DNA, 17 bp, Homo sapiens
cccgttgtctccctggc

SEQ ID NO: 4690753 - DNA, 20 bp, Homo sapiens
cccgttgtctccctggccct

SEQ ID NO: 4690754 - DNA, 23 bp, Homo sapiens
ccctaaactccaggatttataaa

SEQ ID NO: 4690755 - DNA, 14 bp, Homo sapiens
ccctactctgtgta

SEQ ID NO: 4690756 - DNA, 17 bp, Homo sapiens
ccctagaaacttccaaa

SEQ ID NO: 4690757 - DNA, 22 bp, Homo sapiens
ccctagcttagagcctccctca

SEQ ID NO: 4690758 - DNA, 17 bp, Homo sapiens
ccctcaaggcctcccac

SEQ ID NO: 4690759 - DNA, 18 bp, Homo sapiens
ccctcaaggcctcccaca

SEQ ID NO: 4690760 - DNA, 19 bp, Homo sapiens
ccctcaaggcctcccacag

SEQ ID NO: 4690761 - DNA, 13 bp, Homo sapiens
ccctcacactggg

SEQ ID NO: 4690762 - DNA, 14 bp, Homo sapiens
ccctcacactggga

SEQ ID NO: 4690763 - DNA, 16 bp, Homo sapiens
ccctcaccctggggct

SEQ ID NO: 4690764 - DNA, 15 bp, Homo sapiens
ccctcagaggccttg

SEQ ID NO: 4690765 - DNA, 19 bp, Homo sapiens
ccctcatagccctcaccct

SEQ ID NO: 4690766 - DNA, 22 bp, Homo sapiens
ccctcatcaccaacgtctgtgc

SEQ ID NO: 4690767 - DNA, 18 bp, Homo sapiens
ccctcatcaggagttcca

SEQ ID NO: 4690768 - DNA, 22 bp, Homo sapiens
ccctcatcaggagttccagtgc

SEQ ID NO: 4690769 - DNA, 22 bp, Homo sapiens
ccctcatcctcatacccacccc

SEQ ID NO: 4690770 - DNA, 13 bp, Homo sapiens
ccctccacacctg

SEQ ID NO: 4690771 - DNA, 15 bp, Homo sapiens
ccctccacacctgcg

SEQ ID NO: 4690772 - DNA, 13 bp, Homo sapiens
ccctcccagctga

SEQ ID NO: 4690773 - DNA, 12 bp, Homo sapiens
ccctcccctccc

SEQ ID NO: 4690774 - DNA, 16 bp, Homo sapiens
ccctccctttctcccc

SEQ ID NO: 4690775 - DNA, 12 bp, Homo sapiens
ccctcctccact

SEQ ID NO: 4690776 - DNA, 23 bp, Homo sapiens
ccctcctccctttttccttgtcc

SEQ ID NO: 4690777 - DNA, 11 bp, Homo sapiens
ccctcctgctg

SEQ ID NO: 4690778 - DNA, 13 bp, Homo sapiens
ccctcctgctgca

SEQ ID NO: 4690779 - DNA, 14 bp, Homo sapiens
ccctcctttcacca

SEQ ID NO: 4690780 - DNA, 21 bp, Homo sapiens
ccctctacagagcttccctga

SEQ ID NO: 4690781 - DNA, 11 bp, Homo sapiens
ccctctcaggc

SEQ ID NO: 4690782 - DNA, 14 bp, Homo sapiens
ccctctcaggctgt

SEQ ID NO: 4690783 - DNA, 22 bp, Homo sapiens
ccctctcccctgccccctgcag

SEQ ID NO: 4690784 - DNA, 14 bp, Homo sapiens
ccctctgccctgcg

SEQ ID NO: 4690785 - DNA, 20 bp, Homo sapiens
ccctctgtccaggcactgag

SEQ ID NO: 4690786 - DNA, 24 bp, Homo sapiens
ccctctgtccaggcactgagatac

SEQ ID NO: 4690787 - DNA, 23 bp, Homo sapiens
ccctcttgccccaacccccagca

SEQ ID NO: 4690788 - DNA, 14 bp, Homo sapiens
ccctgaaggccccg

SEQ ID NO: 4690789 - DNA, 19 bp, Homo sapiens
ccctgaaggccccgcccag

SEQ ID NO: 4690790 - DNA, 15 bp, Homo sapiens
ccctgaagtcttgca

SEQ ID NO: 4690791 - DNA, 16 bp, Homo sapiens
ccctgaagtcttgcat

SEQ ID NO: 4690792 - DNA, 16 bp, Homo sapiens
ccctgacaacactcat

SEQ ID NO: 4690793 - DNA, 14 bp, Homo sapiens
ccctgaggcccaga

SEQ ID NO: 4690794 - DNA, 15 bp, Homo sapiens
ccctgaggcccagag

SEQ ID NO: 4690795 - DNA, 17 bp, Homo sapiens
ccctgaggcccagaggg

SEQ ID NO: 4690796 - DNA, 19 bp, Homo sapiens
ccctgaggcccagagggcc

SEQ ID NO: 4690797 - DNA, 17 bp, Homo sapiens
ccctgaggggtccctga

SEQ ID NO: 4690798 - DNA, 23 bp, Homo sapiens
ccctgagttgcaccattctttct

SEQ ID NO: 4690799 - DNA, 15 bp, Homo sapiens
ccctgcaaagcccag

SEQ ID NO: 4690800 - DNA, 19 bp, Homo sapiens
ccctgcaaagcccagcttg

SEQ ID NO: 4690801 - DNA, 22 bp, Homo sapiens
ccctgcaacctgattgtgtctc

SEQ ID NO: 4690802 - DNA, 10 bp, Homo sapiens
ccctgcactg

SEQ ID NO: 4690803 - DNA, 13 bp, Homo sapiens
ccctgcactgtcc

SEQ ID NO: 4690804 - DNA, 14 bp, Homo sapiens
ccctgcactgtcct

SEQ ID NO: 4690805 - DNA, 20 bp, Homo sapiens
ccctgcactgtcctgctcca

SEQ ID NO: 4690806 - DNA, 21 bp, Homo sapiens
ccctgcactgtcctgctccac

SEQ ID NO: 4690807 - DNA, 22 bp, Homo sapiens
ccctgcacttgcagactctaca

SEQ ID NO: 4690808 - DNA, 19 bp, Homo sapiens
ccctgcaggaaggagctgc

SEQ ID NO: 4690809 - DNA, 20 bp, Homo sapiens
ccctgcaggaaggagctgcc

SEQ ID NO: 4690810 - DNA, 23 bp, Homo sapiens
ccctgcattggaactggaggcag

SEQ ID NO: 4690811 - DNA, 18 bp, Homo sapiens
ccctgccacctcctgcct

SEQ ID NO: 4690812 - DNA, 14 bp, Homo sapiens
ccctgcccacctgg

SEQ ID NO: 4690813 - DNA, 13 bp, Homo sapiens
ccctgcccccagg

SEQ ID NO: 4690814 - DNA, 18 bp, Homo sapiens
ccctgcccccaggactgg

SEQ ID NO: 4690815 - DNA, 15 bp, Homo sapiens
ccctgccccccagcc

SEQ ID NO: 4690816 - DNA, 18 bp, Homo sapiens
ccctgccccctgcaggaa

SEQ ID NO: 4690817 - DNA, 14 bp, Homo sapiens
ccctgcccggctgc

SEQ ID NO: 4690818 - DNA, 17 bp, Homo sapiens
ccctgcccggctgcgga

SEQ ID NO: 4690819 - DNA, 11 bp, Homo sapiens
ccctgccctgt

SEQ ID NO: 4690820 - DNA, 13 bp, Homo sapiens
ccctgccctgtgg

SEQ ID NO: 4690821 - DNA, 20 bp, Homo sapiens
ccctgccctgtgggccccca

SEQ ID NO: 4690822 - DNA, 13 bp, Homo sapiens
ccctgcctccacc

SEQ ID NO: 4690823 - DNA, 14 bp, Homo sapiens
ccctgcctcctttg

SEQ ID NO: 4690824 - DNA, 17 bp, Homo sapiens
ccctgctcccacagaac

SEQ ID NO: 4690825 - DNA, 21 bp, Homo sapiens
ccctgctctccgaccagacac

SEQ ID NO: 4690826 - DNA, 21 bp, Homo sapiens
ccctgctgagtcccaggctga

SEQ ID NO: 4690827 - DNA, 20 bp, Homo sapiens
ccctgctgcccctccctgcc

SEQ ID NO: 4690828 - DNA, 22 bp, Homo sapiens
ccctgctgcccctccctgcctc

SEQ ID NO: 4690829 - DNA, 18 bp, Homo sapiens
ccctgctgctgcctgcct

SEQ ID NO: 4690830 - DNA, 20 bp, Homo sapiens
ccctgctggttcagggttgg

SEQ ID NO: 4690831 - DNA, 10 bp, Homo sapiens
ccctgctgtc

SEQ ID NO: 4690832 - DNA, 21 bp, Homo sapiens
ccctggatgcagcctcacagt

SEQ ID NO: 4690833 - DNA, 15 bp, Homo sapiens
ccctggcctccccca

SEQ ID NO: 4690834 - DNA, 19 bp, Homo sapiens
ccctggcgtcctctccctc

SEQ ID NO: 4690835 - DNA, 18 bp, Homo sapiens
ccctggctgaaggactgt

SEQ ID NO: 4690836 - DNA, 22 bp, Homo sapiens
ccctgggggcggccagccctcc

SEQ ID NO: 4690837 - DNA, 14 bp, Homo sapiens
ccctggtggcagct

SEQ ID NO: 4690838 - DNA, 15 bp, Homo sapiens
ccctggtggcagctc

SEQ ID NO: 4690839 - DNA, 20 bp, Homo sapiens
ccctggtggcagctcacctc

SEQ ID NO: 4690840 - DNA, 19 bp, Homo sapiens
ccctggtggcagtgggagc

SEQ ID NO: 4690841 - DNA, 21 bp, Homo sapiens
ccctggtggcagtgggagctg

SEQ ID NO: 4690842 - DNA, 21 bp, Homo sapiens
ccctggtttcctgccctggga

SEQ ID NO: 4690843 - DNA, 15 bp, Homo sapiens
ccctgtcacttgctg

SEQ ID NO: 4690844 - DNA, 19 bp, Homo sapiens
ccctgtgatggggccctgc

SEQ ID NO: 4690845 - DNA, 15 bp, Homo sapiens
ccctgtgggccccca

SEQ ID NO: 4690846 - DNA, 14 bp, Homo sapiens
cccttacagtagga

SEQ ID NO: 4690847 - DNA, 12 bp, Homo sapiens
cccttacctcaa

SEQ ID NO: 4690848 - DNA, 23 bp, Homo sapiens
cccttagcagggaaacagctaat

SEQ ID NO: 4690849 - DNA, 21 bp, Homo sapiens
cccttagcccccacccacttc

SEQ ID NO: 4690850 - DNA, 14 bp, Homo sapiens
cccttcatctggaa

SEQ ID NO: 4690851 - DNA, 16 bp, Homo sapiens
cccttcatctggaacc

SEQ ID NO: 4690852 - DNA, 16 bp, Homo sapiens
cccttcatgcatggaa

SEQ ID NO: 4690853 - DNA, 13 bp, Homo sapiens
cccttcccacctc

SEQ ID NO: 4690854 - DNA, 14 bp, Homo sapiens
cccttcctaattcc

SEQ ID NO: 4690855 - DNA, 19 bp, Homo sapiens
cccttcctaattccacagc

SEQ ID NO: 4690856 - DNA, 19 bp, Homo sapiens
cccttctcatcactcccct

SEQ ID NO: 4690857 - DNA, 15 bp, Homo sapiens
cccttctctcatctc

SEQ ID NO: 4690858 - DNA, 14 bp, Homo sapiens
cccttctctccagc

SEQ ID NO: 4690859 - DNA, 19 bp, Homo sapiens
cccttctctccagcccctg

SEQ ID NO: 4690860 - DNA, 18 bp, Homo sapiens
cccttgcccccctggcct

SEQ ID NO: 4690861 - DNA, 22 bp, Homo sapiens
cccttgcccccctggcctcccc

SEQ ID NO: 4690862 - DNA, 16 bp, Homo sapiens
cccttgctccagcctg

SEQ ID NO: 4690863 - DNA, 19 bp, Homo sapiens
cccttgctccagcctgaca

SEQ ID NO: 4690864 - DNA, 21 bp, Homo sapiens
cccttgggggtcctcctccag

SEQ ID NO: 4690865 - DNA, 22 bp, Homo sapiens
cccttgtggtcccaccccacac

SEQ ID NO: 4690866 - DNA, 15 bp, Homo sapiens
ccctttatttcacat

SEQ ID NO: 4690867 - DNA, 22 bp, Homo sapiens
ccctttctcccctgcccccagg

SEQ ID NO: 4690868 - DNA, 15 bp, Homo sapiens
cccttttcagcttct

SEQ ID NO: 4690869 - DNA, 18 bp, Homo sapiens
cccttttcagcttctgct

SEQ ID NO: 4690870 - DNA, 16 bp, Homo sapiens
ccctttttccttgtcc

SEQ ID NO: 4690871 - DNA, 23 bp, Homo sapiens
ccctttttccttgtccccacact

SEQ ID NO: 4690872 - DNA, 19 bp, Homo sapiens
ccgaacatatcatttgtga

SEQ ID NO: 4690873 - DNA, 16 bp, Homo sapiens
ccgaatagctgggact

SEQ ID NO: 4690874 - DNA, 18 bp, Homo sapiens
ccgaccagacaccttgac

SEQ ID NO: 4690875 - DNA, 20 bp, Homo sapiens
ccgacttgaattttcccact

SEQ ID NO: 4690876 - DNA, 20 bp, Homo sapiens
ccgagatcgtgccattgcac

SEQ ID NO: 4690877 - DNA, 14 bp, Homo sapiens
ccgaggccttctct

SEQ ID NO: 4690878 - DNA, 20 bp, Homo sapiens
ccgagtagctgagattatag

SEQ ID NO: 4690879 - DNA, 18 bp, Homo sapiens
ccgatgtgggtccctctc

SEQ ID NO: 4690880 - DNA, 17 bp, Homo sapiens
ccgcagacaggaccagg

SEQ ID NO: 4690881 - DNA, 21 bp, Homo sapiens
ccgcatgccccctcgtgccag

SEQ ID NO: 4690882 - DNA, 23 bp, Homo sapiens
ccgcatgccccctcgtgccagtc

SEQ ID NO: 4690883 - DNA, 20 bp, Homo sapiens
ccgccagcttcccttcactc

SEQ ID NO: 4690884 - DNA, 17 bp, Homo sapiens
ccgcccaggctggccag

SEQ ID NO: 4690885 - DNA, 16 bp, Homo sapiens
ccgccgcctcgcccac

SEQ ID NO: 4690886 - DNA, 22 bp, Homo sapiens
ccgcgccaaataatgtctctgt

SEQ ID NO: 4690887 - DNA, 23 bp, Homo sapiens
ccgctaagagggagggagggctc

SEQ ID NO: 4690888 - DNA, 12 bp, Homo sapiens
ccgctcccagtg

SEQ ID NO: 4690889 - DNA, 20 bp, Homo sapiens
ccgctcccagtgtcttcctg

SEQ ID NO: 4690890 - DNA, 23 bp, Homo sapiens
ccgctgagcgaggagatgctcct

SEQ ID NO: 4690891 - DNA, 22 bp, Homo sapiens
ccgctgattctcagggtctctg

SEQ ID NO: 4690892 - DNA, 18 bp, Homo sapiens
ccgcttgcctcggctcct

SEQ ID NO: 4690893 - DNA, 12 bp, Homo sapiens
ccgctttctacc

SEQ ID NO: 4690894 - DNA, 16 bp, Homo sapiens
ccggagagtgggggtg

SEQ ID NO: 4690895 - DNA, 18 bp, Homo sapiens
ccggagccggcactgcat

SEQ ID NO: 4690896 - DNA, 19 bp, Homo sapiens
ccggagccggcactgcatg

SEQ ID NO: 4690897 - DNA, 13 bp, Homo sapiens
ccggcatggacaa

SEQ ID NO: 4690898 - DNA, 22 bp, Homo sapiens
ccggcatggacaatggaccgga

SEQ ID NO: 4690899 - DNA, 18 bp, Homo sapiens
ccggccacctgcggtgct

SEQ ID NO: 4690900 - DNA, 13 bp, Homo sapiens
ccggcccctgctg

SEQ ID NO: 4690901 - DNA, 23 bp, Homo sapiens
ccggcgcagcgcagagcgggctc

SEQ ID NO: 4690902 - DNA, 15 bp, Homo sapiens
ccggcgccctctgtc

SEQ ID NO: 4690903 - DNA, 17 bp, Homo sapiens
ccggcgccctctgtcct

SEQ ID NO: 4690904 - DNA, 18 bp, Homo sapiens
ccggcgccctctgtcctg

SEQ ID NO: 4690905 - DNA, 15 bp, Homo sapiens
ccggctccaggctcc

SEQ ID NO: 4690906 - DNA, 15 bp, Homo sapiens
ccggctggcctggcc

SEQ ID NO: 4690907 - DNA, 17 bp, Homo sapiens
ccgggaccccgagcctg

SEQ ID NO: 4690908 - DNA, 22 bp, Homo sapiens
ccgggaccctgctcacaggcag

SEQ ID NO: 4690909 - DNA, 23 bp, Homo sapiens
ccgggaccctgctcacaggcagg

SEQ ID NO: 4690910 - DNA, 17 bp, Homo sapiens
ccgggacctggtgctgc

SEQ ID NO: 4690911 - DNA, 16 bp, Homo sapiens
ccgggagcctgatcac

SEQ ID NO: 4690912 - DNA, 15 bp, Homo sapiens
ccgggaggggcccgc

SEQ ID NO: 4690913 - DNA, 22 bp, Homo sapiens
ccgggaggggcccgcttgcctc

SEQ ID NO: 4690914 - DNA, 15 bp, Homo sapiens
ccgggcactcagaag

SEQ ID NO: 4690915 - DNA, 22 bp, Homo sapiens
ccgggcactcagaagacactga

SEQ ID NO: 4690916 - DNA, 22 bp, Homo sapiens
ccgggctcagggaccacagcaa

SEQ ID NO: 4690917 - DNA, 18 bp, Homo sapiens
ccgggctctgcctcccat

SEQ ID NO: 4690918 - DNA, 15 bp, Homo sapiens
ccggggctgggttgg

SEQ ID NO: 4690919 - DNA, 13 bp, Homo sapiens
ccgtaatttaact

SEQ ID NO: 4690920 - DNA, 16 bp, Homo sapiens
ccgtaggttattttca

SEQ ID NO: 4690921 - DNA, 14 bp, Homo sapiens
ccgtctacctgagg

SEQ ID NO: 4690922 - DNA, 17 bp, Homo sapiens
ccgtctacctgaggggc

SEQ ID NO: 4690923 - DNA, 16 bp, Homo sapiens
ccgtggccccagcctg

SEQ ID NO: 4690924 - DNA, 19 bp, Homo sapiens
ccgtggccccagcctggcc

SEQ ID NO: 4690925 - DNA, 20 bp, Homo sapiens
ccgtggccccagcctggccc

SEQ ID NO: 4690926 - DNA, 14 bp, Homo sapiens
ccgtgggctccctg

SEQ ID NO: 4690927 - DNA, 18 bp, Homo sapiens
ccgttgatgttggctggg

SEQ ID NO: 4690928 - DNA, 19 bp, Homo sapiens
ccgttgatgttggctggga

SEQ ID NO: 4690929 - DNA, 22 bp, Homo sapiens
cctaaaatttgccctcccatcc

SEQ ID NO: 4690930 - DNA, 13 bp, Homo sapiens
cctaaacatatga

SEQ ID NO: 4690931 - DNA, 21 bp, Homo sapiens
cctaatgcgcaggctggccct

SEQ ID NO: 4690932 - DNA, 15 bp, Homo sapiens
cctaattccacagct

SEQ ID NO: 4690933 - DNA, 18 bp, Homo sapiens
cctacacagctgtttcct

SEQ ID NO: 4690934 - DNA, 18 bp, Homo sapiens
cctacactcacctgcact

SEQ ID NO: 4690935 - DNA, 16 bp, Homo sapiens
cctacagtgtacagtc

SEQ ID NO: 4690936 - DNA, 21 bp, Homo sapiens
cctacagttttaactgtggat

SEQ ID NO: 4690937 - DNA, 13 bp, Homo sapiens
cctacccaccctc

SEQ ID NO: 4690938 - DNA, 18 bp, Homo sapiens
cctaccccaattccttgt

SEQ ID NO: 4690939 - DNA, 15 bp, Homo sapiens
cctacccctcccagc

SEQ ID NO: 4690940 - DNA, 17 bp, Homo sapiens
cctacccctcccagctg

SEQ ID NO: 4690941 - DNA, 18 bp, Homo sapiens
cctacccctcccagctga

SEQ ID NO: 4690942 - DNA, 17 bp, Homo sapiens
cctactgcttcctctga

SEQ ID NO: 4690943 - DNA, 21 bp, Homo sapiens
cctacttccccttcctaattc

SEQ ID NO: 4690944 - DNA, 17 bp, Homo sapiens
cctacttttaaagaatt

SEQ ID NO: 4690945 - DNA, 21 bp, Homo sapiens
cctagaagagtgtgaaaagga

SEQ ID NO: 4690946 - DNA, 23 bp, Homo sapiens
cctagagaagctaaaacctgagc

SEQ ID NO: 4690947 - DNA, 14 bp, Homo sapiens
cctagctgtgtcag

SEQ ID NO: 4690948 - DNA, 22 bp, Homo sapiens
cctagctgtgtgaatacctgct

SEQ ID NO: 4690949 - DNA, 15 bp, Homo sapiens
cctagcttagagcct

SEQ ID NO: 4690950 - DNA, 15 bp, Homo sapiens
cctaggtgacagagt

SEQ ID NO: 4690951 - DNA, 17 bp, Homo sapiens
cctagtctgtaactctt

SEQ ID NO: 4690952 - DNA, 18 bp, Homo sapiens
cctagtgaaggcttctct

SEQ ID NO: 4690953 - DNA, 21 bp, Homo sapiens
cctagtgaaggcttctctctg

SEQ ID NO: 4690954 - DNA, 17 bp, Homo sapiens
cctagtggctgtccagt

SEQ ID NO: 4690955 - DNA, 21 bp, Homo sapiens
cctagtggctgtccagtgccc

SEQ ID NO: 4690956 - DNA, 16 bp, Homo sapiens
cctagttattttctga

SEQ ID NO: 4690957 - DNA, 13 bp, Homo sapiens
cctagttccacca

SEQ ID NO: 4690958 - DNA, 22 bp, Homo sapiens
cctataactttttttcaatttt

SEQ ID NO: 4690959 - DNA, 12 bp, Homo sapiens
cctatcagtgtg

SEQ ID NO: 4690960 - DNA, 20 bp, Homo sapiens
cctatcagtgtgccccccat

SEQ ID NO: 4690961 - DNA, 24 bp, Homo sapiens
cctatcagtgtgccccccatcctg

SEQ ID NO: 4690962 - DNA, 19 bp, Homo sapiens
cctatgcagaggtccacaa

SEQ ID NO: 4690963 - DNA, 22 bp, Homo sapiens
cctatgtttttgttcaaagcca

SEQ ID NO: 4690964 - DNA, 17 bp, Homo sapiens
cctatttgccatgggct

SEQ ID NO: 4690965 - DNA, 13 bp, Homo sapiens
cctcaaacactgc

SEQ ID NO: 4690966 - DNA, 19 bp, Homo sapiens
cctcaaggcctcccacagt

SEQ ID NO: 4690967 - DNA, 20 bp, Homo sapiens
cctcaaggggccatcctgtc

SEQ ID NO: 4690968 - DNA, 16 bp, Homo sapiens
cctcaataagccttgt

SEQ ID NO: 4690969 - DNA, 18 bp, Homo sapiens
cctcaatccagctatgtt

SEQ ID NO: 4690970 - DNA, 20 bp, Homo sapiens
cctcaattccccctggccac

SEQ ID NO: 4690971 - DNA, 12 bp, Homo sapiens
cctcacactggg

SEQ ID NO: 4690972 - DNA, 17 bp, Homo sapiens
cctcacagtccttacca

SEQ ID NO: 4690973 - DNA, 24 bp, Homo sapiens
cctcacagtccttaccagcagagc

SEQ ID NO: 4690974 - DNA, 22 bp, Homo sapiens
cctcacatggcgtcctgccctt

SEQ ID NO: 4690975 - DNA, 17 bp, Homo sapiens
cctcaccacgtggggcc

SEQ ID NO: 4690976 - DNA, 14 bp, Homo sapiens
cctcaccaggggca

SEQ ID NO: 4690977 - DNA, 19 bp, Homo sapiens
cctcaccaggggcaggcac

SEQ ID NO: 4690978 - DNA, 23 bp, Homo sapiens
cctcaccaggggcaggcacagca

SEQ ID NO: 4690979 - DNA, 16 bp, Homo sapiens
cctcaccctctccgca

SEQ ID NO: 4690980 - DNA, 18 bp, Homo sapiens
cctcaccgcggctggatg

SEQ ID NO: 4690981 - DNA, 22 bp, Homo sapiens
cctcactatcccggctgccctt

SEQ ID NO: 4690982 - DNA, 13 bp, Homo sapiens
cctcagagtggag

SEQ ID NO: 4690983 - DNA, 14 bp, Homo sapiens
cctcagggtccctg

SEQ ID NO: 4690984 - DNA, 16 bp, Homo sapiens
cctcagggtccctggt

SEQ ID NO: 4690985 - DNA, 23 bp, Homo sapiens
cctcaggtaatcgacctgcctcg

SEQ ID NO: 4690986 - DNA, 21 bp, Homo sapiens
cctcagtaagtatctggagga

SEQ ID NO: 4690987 - DNA, 22 bp, Homo sapiens
cctcagtggagacaagtgggaa

SEQ ID NO: 4690988 - DNA, 21 bp, Homo sapiens
cctcatagccctcaccctggg

SEQ ID NO: 4690989 - DNA, 20 bp, Homo sapiens
cctcatagtatggtggctgg

SEQ ID NO: 4690990 - DNA, 13 bp, Homo sapiens
cctcatcaccaac

SEQ ID NO: 4690991 - DNA, 23 bp, Homo sapiens
cctcatccagggctctgaccagt

SEQ ID NO: 4690992 - DNA, 14 bp, Homo sapiens
cctcatcccgagca

SEQ ID NO: 4690993 - DNA, 19 bp, Homo sapiens
cctcatctccagtatcctg

SEQ ID NO: 4690994 - DNA, 15 bp, Homo sapiens
cctcatctgtccctc

SEQ ID NO: 4690995 - DNA, 17 bp, Homo sapiens
cctcatctgtccctccg

SEQ ID NO: 4690996 - DNA, 15 bp, Homo sapiens
cctcatcttcttcac

SEQ ID NO: 4690997 - DNA, 16 bp, Homo sapiens
cctcatgtcatttctc

SEQ ID NO: 4690998 - DNA, 22 bp, Homo sapiens
cctcatttcaggagcagcctca

SEQ ID NO: 4690999 - DNA, 13 bp, Homo sapiens
cctccacacctgc

SEQ ID NO: 4691000 - DNA, 14 bp, Homo sapiens
cctccacacctgcg

SEQ ID NO: 4691001 - DNA, 21 bp, Homo sapiens
cctccacccacagtggagagg

SEQ ID NO: 4691002 - DNA, 19 bp, Homo sapiens
cctccaccgccatggcttc

SEQ ID NO: 4691003 - DNA, 21 bp, Homo sapiens
cctccaccgccatggcttcca

SEQ ID NO: 4691004 - DNA, 17 bp, Homo sapiens
cctccacgttctgctca

SEQ ID NO: 4691005 - DNA, 17 bp, Homo sapiens
cctccactctcccccac

SEQ ID NO: 4691006 - DNA, 15 bp, Homo sapiens
cctccagggacagca

SEQ ID NO: 4691007 - DNA, 19 bp, Homo sapiens
cctccaggtgcacaagctc

SEQ ID NO: 4691008 - DNA, 20 bp, Homo sapiens
cctccatgggggctcagcca

SEQ ID NO: 4691009 - DNA, 20 bp, Homo sapiens
cctcccaactcaccccagcc

SEQ ID NO: 4691010 - DNA, 17 bp, Homo sapiens
cctcccacctcagcctc

SEQ ID NO: 4691011 - DNA, 21 bp, Homo sapiens
cctcccagatcggatctgttg

SEQ ID NO: 4691012 - DNA, 11 bp, Homo sapiens
cctcccagctg

SEQ ID NO: 4691013 - DNA, 12 bp, Homo sapiens
cctcccagctga

SEQ ID NO: 4691014 - DNA, 13 bp, Homo sapiens
cctcccatctcac

SEQ ID NO: 4691015 - DNA, 16 bp, Homo sapiens
cctcccatctcacaca

SEQ ID NO: 4691016 - DNA, 20 bp, Homo sapiens
cctcccctggggacagcaag

SEQ ID NO: 4691017 - DNA, 21 bp, Homo sapiens
cctcccgaatagctgggacta

SEQ ID NO: 4691018 - DNA, 20 bp, Homo sapiens
cctcccgagtagctgggact

SEQ ID NO: 4691019 - DNA, 20 bp, Homo sapiens
cctcccgtctactcattccc

SEQ ID NO: 4691020 - DNA, 18 bp, Homo sapiens
cctccctgcctccaccca

SEQ ID NO: 4691021 - DNA, 20 bp, Homo sapiens
cctcccttggggcctatgca

SEQ ID NO: 4691022 - DNA, 12 bp, Homo sapiens
cctccctttctc

SEQ ID NO: 4691023 - DNA, 15 bp, Homo sapiens
cctccctttctcccc

SEQ ID NO: 4691024 - DNA, 13 bp, Homo sapiens
cctccgcctcccg

SEQ ID NO: 4691025 - DNA, 14 bp, Homo sapiens
cctccgcctcttgg

SEQ ID NO: 4691026 - DNA, 16 bp, Homo sapiens
cctcctccactctccc

SEQ ID NO: 4691027 - DNA, 16 bp, Homo sapiens
cctcctccagggacag

SEQ ID NO: 4691028 - DNA, 18 bp, Homo sapiens
cctcctccagggacagca

SEQ ID NO: 4691029 - DNA, 15 bp, Homo sapiens
cctcctccctttttc

SEQ ID NO: 4691030 - DNA, 22 bp, Homo sapiens
cctcctctgtgaccaatgtctt

SEQ ID NO: 4691031 - DNA, 12 bp, Homo sapiens
cctcctgcctcc

SEQ ID NO: 4691032 - DNA, 18 bp, Homo sapiens
cctcctgctgcagagggg

SEQ ID NO: 4691033 - DNA, 21 bp, Homo sapiens
cctcctggccagatgtcgctg

SEQ ID NO: 4691034 - DNA, 14 bp, Homo sapiens
cctcctgggctaag

SEQ ID NO: 4691035 - DNA, 23 bp, Homo sapiens
cctcctgtgtgtgcgcctacagg

SEQ ID NO: 4691036 - DNA, 22 bp, Homo sapiens
cctcctgtgttgtgctgggagc

SEQ ID NO: 4691037 - DNA, 16 bp, Homo sapiens
cctccttccagcactg

SEQ ID NO: 4691038 - DNA, 23 bp, Homo sapiens
cctccttctctgtctcatgtgtg

SEQ ID NO: 4691039 - DNA, 20 bp, Homo sapiens
cctcctttctcttctctgtt

SEQ ID NO: 4691040 - DNA, 18 bp, Homo sapiens
cctcctttgtgaggaagc

SEQ ID NO: 4691041 - DNA, 19 bp, Homo sapiens
cctcctttgtgaggaagcc

SEQ ID NO: 4691042 - DNA, 17 bp, Homo sapiens
cctccttttcctgtgtt

SEQ ID NO: 4691043 - DNA, 16 bp, Homo sapiens
cctcgaactggctgca

SEQ ID NO: 4691044 - DNA, 16 bp, Homo sapiens
cctcgaggtttctcaa

SEQ ID NO: 4691045 - DNA, 18 bp, Homo sapiens
cctcgatgtcctcctctg

SEQ ID NO: 4691046 - DNA, 21 bp, Homo sapiens
cctcgcccaccgcatgccccc

SEQ ID NO: 4691047 - DNA, 12 bp, Homo sapiens
cctcgcctggcc

SEQ ID NO: 4691048 - DNA, 14 bp, Homo sapiens
cctcgcctggcctg

SEQ ID NO: 4691049 - DNA, 15 bp, Homo sapiens
cctcgcctggcctga

SEQ ID NO: 4691050 - DNA, 19 bp, Homo sapiens
cctcgctgccagctctgta

SEQ ID NO: 4691051 - DNA, 19 bp, Homo sapiens
cctcggacttagctgggag

SEQ ID NO: 4691052 - DNA, 18 bp, Homo sapiens
cctcggcaggcatggctg

SEQ ID NO: 4691053 - DNA, 12 bp, Homo sapiens
cctcggctcctg

SEQ ID NO: 4691054 - DNA, 13 bp, Homo sapiens
cctcggctcctgc

SEQ ID NO: 4691055 - DNA, 17 bp, Homo sapiens
cctcggctcctgctgca

SEQ ID NO: 4691056 - DNA, 18 bp, Homo sapiens
cctcggctcctgctgcac

SEQ ID NO: 4691057 - DNA, 20 bp, Homo sapiens
cctcggctcctgctgcacca

SEQ ID NO: 4691058 - DNA, 18 bp, Homo sapiens
cctctacagagcttccct

SEQ ID NO: 4691059 - DNA, 20 bp, Homo sapiens
cctctacagagcttccctga

SEQ ID NO: 4691060 - DNA, 12 bp, Homo sapiens
cctctagggacc

SEQ ID NO: 4691061 - DNA, 14 bp, Homo sapiens
cctctcagagctac

SEQ ID NO: 4691062 - DNA, 14 bp, Homo sapiens
cctctccagctata

SEQ ID NO: 4691063 - DNA, 18 bp, Homo sapiens
cctctcccctaccactgt

SEQ ID NO: 4691064 - DNA, 12 bp, Homo sapiens
cctctcccctgc

SEQ ID NO: 4691065 - DNA, 20 bp, Homo sapiens
cctctcccctgccccctgca

SEQ ID NO: 4691066 - DNA, 14 bp, Homo sapiens
cctctccctcctgg

SEQ ID NO: 4691067 - DNA, 13 bp, Homo sapiens
cctctcccttgga

SEQ ID NO: 4691068 - DNA, 22 bp, Homo sapiens
cctctcccttggattgtccccg

SEQ ID NO: 4691069 - DNA, 17 bp, Homo sapiens
cctctccgcacacctct

SEQ ID NO: 4691070 - DNA, 23 bp, Homo sapiens
cctctccgcacacctctggctgt

SEQ ID NO: 4691071 - DNA, 13 bp, Homo sapiens
cctctctcactcc

SEQ ID NO: 4691072 - DNA, 14 bp, Homo sapiens
cctctctcactcct

SEQ ID NO: 4691073 - DNA, 15 bp, Homo sapiens
cctctctcactcctt

SEQ ID NO: 4691074 - DNA, 16 bp, Homo sapiens
cctctctgctctgcgt

SEQ ID NO: 4691075 - DNA, 17 bp, Homo sapiens
cctctgacacacagctc

SEQ ID NO: 4691076 - DNA, 19 bp, Homo sapiens
cctctgactcagggctcct

SEQ ID NO: 4691077 - DNA, 21 bp, Homo sapiens
cctctgactcagggctcctgg

SEQ ID NO: 4691078 - DNA, 19 bp, Homo sapiens
cctctgcactcccctgctg

SEQ ID NO: 4691079 - DNA, 22 bp, Homo sapiens
cctctgcactcccctgctgggt

SEQ ID NO: 4691080 - DNA, 13 bp, Homo sapiens
cctctgcccactc

SEQ ID NO: 4691081 - DNA, 23 bp, Homo sapiens
ccagttggtcccccttccatgga

SEQ ID NO: 4691082 - DNA, 15 bp, Homo sapiens
ccagtttcccactct

SEQ ID NO: 4691083 - DNA, 13 bp, Homo sapiens
ccataagctattt

SEQ ID NO: 4691084 - DNA, 19 bp, Homo sapiens
ccatacataaaagaaataa

SEQ ID NO: 4691085 - DNA, 22 bp, Homo sapiens
ccataccacccaatgctgatgt

SEQ ID NO: 4691086 - DNA, 23 bp, Homo sapiens
ccatactaattataccccctgca

SEQ ID NO: 4691087 - DNA, 23 bp, Homo sapiens
ccatagagagcaagacgctgtgc

SEQ ID NO: 4691088 - DNA, 13 bp, Homo sapiens
ccatcaaagagaa

SEQ ID NO: 4691089 - DNA, 18 bp, Homo sapiens
ccatcaaagagaaggaaa

SEQ ID NO: 4691090 - DNA, 12 bp, Homo sapiens
ccatcaagccac

SEQ ID NO: 4691091 - DNA, 16 bp, Homo sapiens
ccatcaagccaccaac

SEQ ID NO: 4691092 - DNA, 12 bp, Homo sapiens
ccatcatgtctg

SEQ ID NO: 4691093 - DNA, 12 bp, Homo sapiens
ccatcccagccc

SEQ ID NO: 4691094 - DNA, 14 bp, Homo sapiens
ccatcccagccttg

SEQ ID NO: 4691095 - DNA, 23 bp, Homo sapiens
ccatcccagccttggcatctaga

SEQ ID NO: 4691096 - DNA, 14 bp, Homo sapiens
ccatcccccctcac

SEQ ID NO: 4691097 - DNA, 18 bp, Homo sapiens
ccatcccctagaaatcct

SEQ ID NO: 4691098 - DNA, 15 bp, Homo sapiens
ccatccctgaaggcc

SEQ ID NO: 4691099 - DNA, 13 bp, Homo sapiens
ccatcctcaaaca

SEQ ID NO: 4691100 - DNA, 18 bp, Homo sapiens
ccatcctcaaacactgca

SEQ ID NO: 4691101 - DNA, 20 bp, Homo sapiens
ccatcctctgtacagagccc

SEQ ID NO: 4691102 - DNA, 12 bp, Homo sapiens
ccatcctggccc

SEQ ID NO: 4691103 - DNA, 13 bp, Homo sapiens
ccatcctggccca

SEQ ID NO: 4691104 - DNA, 17 bp, Homo sapiens
ccatcctgtcccaccat

SEQ ID NO: 4691105 - DNA, 16 bp, Homo sapiens
ccatcgctgtcatctc

SEQ ID NO: 4691106 - DNA, 18 bp, Homo sapiens
ccatctcacacatgagca

SEQ ID NO: 4691107 - DNA, 12 bp, Homo sapiens
ccatctctggat

SEQ ID NO: 4691108 - DNA, 13 bp, Homo sapiens
ccatctgcccagg

SEQ ID NO: 4691109 - DNA, 22 bp, Homo sapiens
ccatctgcgtgacaataaaaca

SEQ ID NO: 4691110 - DNA, 23 bp, Homo sapiens
ccatctgcgtgacaataaaacat

SEQ ID NO: 4691111 - DNA, 16 bp, Homo sapiens
ccatcttccaggtggg

SEQ ID NO: 4691112 - DNA, 14 bp, Homo sapiens
ccatgacccaggct

SEQ ID NO: 4691113 - DNA, 16 bp, Homo sapiens
ccatgacccaggctgg

SEQ ID NO: 4691114 - DNA, 18 bp, Homo sapiens
ccatgacccaggctgggc

SEQ ID NO: 4691115 - DNA, 14 bp, Homo sapiens
ccatgagtcccctg

SEQ ID NO: 4691116 - DNA, 21 bp, Homo sapiens
ccatgagtggcatggccacca

SEQ ID NO: 4691117 - DNA, 18 bp, Homo sapiens
ccatgatgttttccatga

SEQ ID NO: 4691118 - DNA, 14 bp, Homo sapiens
ccatggactttgtt

SEQ ID NO: 4691119 - DNA, 20 bp, Homo sapiens
ccatggcttccaaggtggtc

SEQ ID NO: 4691120 - DNA, 15 bp, Homo sapiens
ccatgggaccaaacc

SEQ ID NO: 4691121 - DNA, 21 bp, Homo sapiens
ccatgggaccaaacctagccc

SEQ ID NO: 4691122 - DNA, 22 bp, Homo sapiens
ccatgggcactgctgggtggcc

SEQ ID NO: 4691123 - DNA, 14 bp, Homo sapiens
ccatgggcagagcc

SEQ ID NO: 4691124 - DNA, 14 bp, Homo sapiens
ccatgggcctcctg

SEQ ID NO: 4691125 - DNA, 19 bp, Homo sapiens
ccatgtagaagctgcatct

SEQ ID NO: 4691126 - DNA, 23 bp, Homo sapiens
ccatgtatagctagctatttcta

SEQ ID NO: 4691127 - DNA, 23 bp, Homo sapiens
ccatgtgcaggtggattccatgc

SEQ ID NO: 4691128 - DNA, 13 bp, Homo sapiens
ccatgttggccag

SEQ ID NO: 4691129 - DNA, 18 bp, Homo sapiens
ccatgttggccaggctgg

SEQ ID NO: 4691130 - DNA, 23 bp, Homo sapiens
ccattagaagatattagtcttgg

SEQ ID NO: 4691131 - DNA, 17 bp, Homo sapiens
ccattatgaagaagaga

SEQ ID NO: 4691132 - DNA, 14 bp, Homo sapiens
ccattcattccatt

SEQ ID NO: 4691133 - DNA, 20 bp, Homo sapiens
ccattcattccattctggaa

SEQ ID NO: 4691134 - DNA, 22 bp, Homo sapiens
ccattcctgggaaatattccct

SEQ ID NO: 4691135 - DNA, 17 bp, Homo sapiens
ccattctacctgtcctc

SEQ ID NO: 4691136 - DNA, 15 bp, Homo sapiens
ccattctccacctgc

SEQ ID NO: 4691137 - DNA, 18 bp, Homo sapiens
ccattctccacctgccag

SEQ ID NO: 4691138 - DNA, 17 bp, Homo sapiens
ccattctgcctgcccag

SEQ ID NO: 4691139 - DNA, 18 bp, Homo sapiens
ccattctgcctgcccagg

SEQ ID NO: 4691140 - DNA, 19 bp, Homo sapiens
ccattctgcctgcccaggc

SEQ ID NO: 4691141 - DNA, 21 bp, Homo sapiens
ccattctgcctgcccaggccc

SEQ ID NO: 4691142 - DNA, 22 bp, Homo sapiens
ccattctggattttgtcaagca

SEQ ID NO: 4691143 - DNA, 12 bp, Homo sapiens
ccattctttctt

SEQ ID NO: 4691144 - DNA, 22 bp, Homo sapiens
ccattgaattcttggttgagga

SEQ ID NO: 4691145 - DNA, 20 bp, Homo sapiens
ccattgcactccagcctggg

SEQ ID NO: 4691146 - DNA, 23 bp, Homo sapiens
ccattgcctcttttcacattttt

SEQ ID NO: 4691147 - DNA, 15 bp, Homo sapiens
ccattggatctcatt

SEQ ID NO: 4691148 - DNA, 20 bp, Homo sapiens
ccattggctatttaaaactt

SEQ ID NO: 4691149 - DNA, 19 bp, Homo sapiens
ccattgtaaatctgaagaa

SEQ ID NO: 4691150 - DNA, 20 bp, Homo sapiens
ccattgtaaatctgaagaaa

SEQ ID NO: 4691151 - DNA, 16 bp, Homo sapiens
ccatttggtattacac

SEQ ID NO: 4691152 - DNA, 18 bp, Homo sapiens
ccatttggtgaagtgaaa

SEQ ID NO: 4691153 - DNA, 21 bp, Homo sapiens
ccatttgtattgtacataaaa

SEQ ID NO: 4691154 - DNA, 20 bp, Homo sapiens
ccattttggggtacccactg

SEQ ID NO: 4691155 - DNA, 12 bp, Homo sapiens
ccattttgtgaa

SEQ ID NO: 4691156 - DNA, 23 bp, Homo sapiens
ccattttgttattgactaacagg

SEQ ID NO: 4691157 - DNA, 16 bp, Homo sapiens
cccaaaactctcctct

SEQ ID NO: 4691158 - DNA, 18 bp, Homo sapiens
cccaaaactctcctctgc

SEQ ID NO: 4691159 - DNA, 20 bp, Homo sapiens
cccaaaactctcctctgctg

SEQ ID NO: 4691160 - DNA, 20 bp, Homo sapiens
cccaaagtggtatagaaatg

SEQ ID NO: 4691161 - DNA, 12 bp, Homo sapiens
cccaactgacca

SEQ ID NO: 4691162 - DNA, 16 bp, Homo sapiens
cccaagcctggcaagg

SEQ ID NO: 4691163 - DNA, 12 bp, Homo sapiens
cccaagctctgc

SEQ ID NO: 4691164 - DNA, 15 bp, Homo sapiens
cccaagctctgctcc

SEQ ID NO: 4691165 - DNA, 17 bp, Homo sapiens
cccaagctctgctcctc

SEQ ID NO: 4691166 - DNA, 21 bp, Homo sapiens
cccaaggggtggccgtcctga

SEQ ID NO: 4691167 - DNA, 16 bp, Homo sapiens
cccaagtggcagagct

SEQ ID NO: 4691168 - DNA, 18 bp, Homo sapiens
cccaattttgcagggagc

SEQ ID NO: 4691169 - DNA, 14 bp, Homo sapiens
cccacactcctaca

SEQ ID NO: 4691170 - DNA, 11 bp, Homo sapiens
cccacagccca

SEQ ID NO: 4691171 - DNA, 19 bp, Homo sapiens
cccacagcccacgtcctgt

SEQ ID NO: 4691172 - DNA, 19 bp, Homo sapiens
cccacagcgctggccggga

SEQ ID NO: 4691173 - DNA, 19 bp, Homo sapiens
cccacaggacatttctcta

SEQ ID NO: 4691174 - DNA, 13 bp, Homo sapiens
cccacaggatcag

SEQ ID NO: 4691175 - DNA, 17 bp, Homo sapiens
cccacaggatcagtctg

SEQ ID NO: 4691176 - DNA, 22 bp, Homo sapiens
cccacagtgactcgggctcctg

SEQ ID NO: 4691177 - DNA, 20 bp, Homo sapiens
cccacccaagggcctggcct

SEQ ID NO: 4691178 - DNA, 21 bp, Homo sapiens
cccacccaagggcctggcctg

SEQ ID NO: 4691179 - DNA, 16 bp, Homo sapiens
cccacccacttctgca

SEQ ID NO: 4691180 - DNA, 12 bp, Homo sapiens
cccacccccacc

SEQ ID NO: 4691181 - DNA, 15 bp, Homo sapiens
cccacccccacccaa

SEQ ID NO: 4691182 - DNA, 14 bp, Homo sapiens
cccaccccttgctc

SEQ ID NO: 4691183 - DNA, 15 bp, Homo sapiens
cccaccttggctcaa

SEQ ID NO: 4691184 - DNA, 14 bp, Homo sapiens
cccaccttggctgc

SEQ ID NO: 4691185 - DNA, 14 bp, Homo sapiens
cccacgcccccact

SEQ ID NO: 4691186 - DNA, 19 bp, Homo sapiens
cccacgtcctgtcagtgcc

SEQ ID NO: 4691187 - DNA, 13 bp, Homo sapiens
cccactgaaatgg

SEQ ID NO: 4691188 - DNA, 15 bp, Homo sapiens
cccactgcaacttgt

SEQ ID NO: 4691189 - DNA, 16 bp, Homo sapiens
cccactgcaccccctc

SEQ ID NO: 4691190 - DNA, 18 bp, Homo sapiens
cccactgcaccccctcct

SEQ ID NO: 4691191 - DNA, 19 bp, Homo sapiens
cccactgcaccccctcctg

SEQ ID NO: 4691192 - DNA, 23 bp, Homo sapiens
cccactgcaccccctcctgctgc

SEQ ID NO: 4691193 - DNA, 13 bp, Homo sapiens
cccactgctctgg

SEQ ID NO: 4691194 - DNA, 22 bp, Homo sapiens
cccactgcttttggtctgtgtg

SEQ ID NO: 4691195 - DNA, 23 bp, Homo sapiens
cccactgcttttggtctgtgtga

SEQ ID NO: 4691196 - DNA, 15 bp, Homo sapiens
cccacttcccctcct

SEQ ID NO: 4691197 - DNA, 19 bp, Homo sapiens
cccacttcccctcctaccc

SEQ ID NO: 4691198 - DNA, 24 bp, Homo sapiens
cccacttccctgacactgcggggc

SEQ ID NO: 4691199 - DNA, 15 bp, Homo sapiens
cccacttccctgggc

SEQ ID NO: 4691200 - DNA, 12 bp, Homo sapiens
cccacttctgca

SEQ ID NO: 4691201 - DNA, 14 bp, Homo sapiens
cccacttctgcact

SEQ ID NO: 4691202 - DNA, 16 bp, Homo sapiens
cccagaggattgctgc

SEQ ID NO: 4691203 - DNA, 13 bp, Homo sapiens
cccagaggggcct

SEQ ID NO: 4691204 - DNA, 19 bp, Homo sapiens
cccagaggggcctgccacc

SEQ ID NO: 4691205 - DNA, 21 bp, Homo sapiens
cccagaggggcctgccacctg

SEQ ID NO: 4691206 - DNA, 23 bp, Homo sapiens
cccagaggtaacagaacagcttc

SEQ ID NO: 4691207 - DNA, 14 bp, Homo sapiens
cccagagtttttat

SEQ ID NO: 4691208 - DNA, 21 bp, Homo sapiens
cccagatgtgagggcaccacc

SEQ ID NO: 4691209 - DNA, 20 bp, Homo sapiens
cccagattggctcacactga

SEQ ID NO: 4691210 - DNA, 22 bp, Homo sapiens
cccagattggctcacactgaga

SEQ ID NO: 4691211 - DNA, 21 bp, Homo sapiens
cccagattttatttatatctt

SEQ ID NO: 4691212 - DNA, 12 bp, Homo sapiens
cccagcacccgg

SEQ ID NO: 4691213 - DNA, 19 bp, Homo sapiens
cccagcacccgggctcagg

SEQ ID NO: 4691214 - DNA, 14 bp, Homo sapiens
cccagcactgagga

SEQ ID NO: 4691215 - DNA, 15 bp, Homo sapiens
cccagcactgaggaa

SEQ ID NO: 4691216 - DNA, 24 bp, Homo sapiens
cccagcactgaggaagaacggggc

SEQ ID NO: 4691217 - DNA, 17 bp, Homo sapiens
cccagcagtggcttgct

SEQ ID NO: 4691218 - DNA, 20 bp, Homo sapiens
cccagcattttactgattca

SEQ ID NO: 4691219 - DNA, 14 bp, Homo sapiens
cccagccccatcct

SEQ ID NO: 4691220 - DNA, 19 bp, Homo sapiens
cccagccccatcctctgta

SEQ ID NO: 4691221 - DNA, 11 bp, Homo sapiens
cccagcccctt

SEQ ID NO: 4691222 - DNA, 15 bp, Homo sapiens
cccagccctcatccc

SEQ ID NO: 4691223 - DNA, 23 bp, Homo sapiens
cccagccctccttatcaaaggac

SEQ ID NO: 4691224 - DNA, 14 bp, Homo sapiens
cccagccgctgccc

SEQ ID NO: 4691225 - DNA, 10 bp, Homo sapiens
cccagcctgg

SEQ ID NO: 4691226 - DNA, 15 bp, Homo sapiens
cccagcctggcccag

SEQ ID NO: 4691227 - DNA, 17 bp, Homo sapiens
cccagcctggcccagct

SEQ ID NO: 4691228 - DNA, 19 bp, Homo sapiens
cccagcctggcccagctcc

SEQ ID NO: 4691229 - DNA, 22 bp, Homo sapiens
cccagcctggcccagctccccc

SEQ ID NO: 4691230 - DNA, 21 bp, Homo sapiens
cccagccttggcatctagagc

SEQ ID NO: 4691231 - DNA, 18 bp, Homo sapiens
cccagctaattgagacca

SEQ ID NO: 4691232 - DNA, 19 bp, Homo sapiens
cccagctgacagtcctctc

SEQ ID NO: 4691233 - DNA, 11 bp, Homo sapiens
cccagctgttt

SEQ ID NO: 4691234 - DNA, 16 bp, Homo sapiens
cccaggaaaggctcca

SEQ ID NO: 4691235 - DNA, 17 bp, Homo sapiens
cccaggaaaggctccag

SEQ ID NO: 4691236 - DNA, 22 bp, Homo sapiens
cccaggaatgccaaggagacat

SEQ ID NO: 4691237 - DNA, 12 bp, Homo sapiens
cccaggacccca

SEQ ID NO: 4691238 - DNA, 15 bp, Homo sapiens
cccaggacggggccg

SEQ ID NO: 4691239 - DNA, 17 bp, Homo sapiens
cccaggacggggccggc

SEQ ID NO: 4691240 - DNA, 22 bp, Homo sapiens
cccaggacggggccggccaggt

SEQ ID NO: 4691241 - DNA, 12 bp, Homo sapiens
cccaggactggg

SEQ ID NO: 4691242 - DNA, 13 bp, Homo sapiens
cccaggagctccc

SEQ ID NO: 4691243 - DNA, 20 bp, Homo sapiens
cccaggagctcccctcccca

SEQ ID NO: 4691244 - DNA, 18 bp, Homo sapiens
cccaggaggccagccttg

SEQ ID NO: 4691245 - DNA, 15 bp, Homo sapiens
cccaggcattcccca

SEQ ID NO: 4691246 - DNA, 17 bp, Homo sapiens
cccaggcattccccagg

SEQ ID NO: 4691247 - DNA, 20 bp, Homo sapiens
cccaggcattccccaggagg

SEQ ID NO: 4691248 - DNA, 21 bp, Homo sapiens
cccaggcattccccaggaggc

SEQ ID NO: 4691249 - DNA, 22 bp, Homo sapiens
cccaggcattccccaggaggcc

SEQ ID NO: 4691250 - DNA, 19 bp, Homo sapiens
cccaggccaggactctgca

SEQ ID NO: 4691251 - DNA, 21 bp, Homo sapiens
cccaggccatcttccaggtgg

SEQ ID NO: 4691252 - DNA, 22 bp, Homo sapiens
cccaggccatcttccaggtggg

SEQ ID NO: 4691253 - DNA, 13 bp, Homo sapiens
cccaggctggagt

SEQ ID NO: 4691254 - DNA, 13 bp, Homo sapiens
cccaggctggcca

SEQ ID NO: 4691255 - DNA, 15 bp, Homo sapiens
cccaggctggccagc

SEQ ID NO: 4691256 - DNA, 19 bp, Homo sapiens
cccaggctggccagcccca

SEQ ID NO: 4691257 - DNA, 20 bp, Homo sapiens
cccaggctggccagccccac

SEQ ID NO: 4691258 - DNA, 17 bp, Homo sapiens
cccaggctggcgtgcag

SEQ ID NO: 4691259 - DNA, 20 bp, Homo sapiens
cccaggctggcgtgcagtgg

SEQ ID NO: 4691260 - DNA, 15 bp, Homo sapiens
cccaggcttagtcac

SEQ ID NO: 4691261 - DNA, 20 bp, Homo sapiens
cccaggcttagtcactgaga

SEQ ID NO: 4691262 - DNA, 22 bp, Homo sapiens
cccaggcttagtcactgagaca

SEQ ID NO: 4691263 - DNA, 18 bp, Homo sapiens
cccagggttcagtcctca

SEQ ID NO: 4691264 - DNA, 13 bp, Homo sapiens
cccaggtttctat

SEQ ID NO: 4691265 - DNA, 19 bp, Homo sapiens
cccagtctggaatgcagtg

SEQ ID NO: 4691266 - DNA, 19 bp, Homo sapiens
cccagtgatttacatgctg

SEQ ID NO: 4691267 - DNA, 13 bp, Homo sapiens
cccagtgcccaca

SEQ ID NO: 4691268 - DNA, 16 bp, Homo sapiens
cccagtgtcttcctgt

SEQ ID NO: 4691269 - DNA, 15 bp, Homo sapiens
cccagttgccatctg

SEQ ID NO: 4691270 - DNA, 16 bp, Homo sapiens
cccagtttcccactct

SEQ ID NO: 4691271 - DNA, 20 bp, Homo sapiens
cccatcagtgccagcccctg

SEQ ID NO: 4691272 - DNA, 22 bp, Homo sapiens
cccatcagtgctccctcacatg

SEQ ID NO: 4691273 - DNA, 13 bp, Homo sapiens
cccatcctggccc

SEQ ID NO: 4691274 - DNA, 15 bp, Homo sapiens
cccatcctggcccat

SEQ ID NO: 4691275 - DNA, 14 bp, Homo sapiens
cccatctgcccagg

SEQ ID NO: 4691276 - DNA, 20 bp, Homo sapiens
cccatctgtgaaaggaaaga

SEQ ID NO: 4691277 - DNA, 21 bp, Homo sapiens
cccatcttccctggcgtcctc

SEQ ID NO: 4691278 - DNA, 17 bp, Homo sapiens
cccatgctgccctgtga

SEQ ID NO: 4691279 - DNA, 18 bp, Homo sapiens
cccatgctgccctgtgag

SEQ ID NO: 4691280 - DNA, 22 bp, Homo sapiens
cccatggcagtgggaaaaatgt

SEQ ID NO: 4691281 - DNA, 20 bp, Homo sapiens
cccatgggcactgctgggtg

SEQ ID NO: 4691282 - DNA, 21 bp, Homo sapiens
cccatgggcactgctgggtgg

SEQ ID NO: 4691283 - DNA, 18 bp, Homo sapiens
cccattcattccattctg

SEQ ID NO: 4691284 - DNA, 21 bp, Homo sapiens
cccattcattccattctggaa

SEQ ID NO: 4691285 - DNA, 22 bp, Homo sapiens
cccattcattccattctggaag

SEQ ID NO: 4691286 - DNA, 14 bp, Homo sapiens
cccattcctgggaa

SEQ ID NO: 4691287 - DNA, 14 bp, Homo sapiens
cccattctgcctgc

SEQ ID NO: 4691288 - DNA, 21 bp, Homo sapiens
cccattctgcctgcccaggcc

SEQ ID NO: 4691289 - DNA, 22 bp, Homo sapiens
cccattctgcctgcccaggccc

SEQ ID NO: 4691290 - DNA, 22 bp, Homo sapiens
ccccaaaactctcctctgctgc

SEQ ID NO: 4691291 - DNA, 23 bp, Homo sapiens
ccccaacccccagcacccgggct

SEQ ID NO: 4691292 - DNA, 14 bp, Homo sapiens
ccccaagcctggca

SEQ ID NO: 4691293 - DNA, 14 bp, Homo sapiens
ccccaaggggtggc

SEQ ID NO: 4691294 - DNA, 19 bp, Homo sapiens
ccccaatatctcccttttt

SEQ ID NO: 4691295 - DNA, 13 bp, Homo sapiens
ccccaatccctca

SEQ ID NO: 4691296 - DNA, 14 bp, Homo sapiens
ccccaatccctcaa

SEQ ID NO: 4691297 - DNA, 16 bp, Homo sapiens
ccccaatccctcaaac

SEQ ID NO: 4691298 - DNA, 14 bp, Homo sapiens
ccccaattccttgt

SEQ ID NO: 4691299 - DNA, 22 bp, Homo sapiens
ccccacagcccacgtcctgtca

SEQ ID NO: 4691300 - DNA, 15 bp, Homo sapiens
ccccaccccagggca

SEQ ID NO: 4691301 - DNA, 19 bp, Homo sapiens
ccccaccgcagacaggacc

SEQ ID NO: 4691302 - DNA, 12 bp, Homo sapiens
ccccactggtga

SEQ ID NO: 4691303 - DNA, 15 bp, Homo sapiens
ccccagatggctttg

SEQ ID NO: 4691304 - DNA, 22 bp, Homo sapiens
ccccagatgtgagggcaccacc

SEQ ID NO: 4691305 - DNA, 21 bp, Homo sapiens
ccccagattgcaacaggctgg

SEQ ID NO: 4691306 - DNA, 17 bp, Homo sapiens
ccccagcaagtgagagc

SEQ ID NO: 4691307 - DNA, 19 bp, Homo sapiens
ccccagcaagtgagagctg

SEQ ID NO: 4691308 - DNA, 13 bp, Homo sapiens
ccccagcacccgg

SEQ ID NO: 4691309 - DNA, 15 bp, Homo sapiens
ccccagcacccgggc

SEQ ID NO: 4691310 - DNA, 19 bp, Homo sapiens
ccccagcacccgggctcag

SEQ ID NO: 4691311 - DNA, 12 bp, Homo sapiens
ccccagcactga

SEQ ID NO: 4691312 - DNA, 15 bp, Homo sapiens
ccccagcactgagga

SEQ ID NO: 4691313 - DNA, 10 bp, Homo sapiens
ccccagcccc

SEQ ID NO: 4691314 - DNA, 14 bp, Homo sapiens
ccccagccccaaaa

SEQ ID NO: 4691315 - DNA, 16 bp, Homo sapiens
ccccagcctggcccag

SEQ ID NO: 4691316 - DNA, 17 bp, Homo sapiens
ccccagcctggcccagc

SEQ ID NO: 4691317 - DNA, 18 bp, Homo sapiens
ccccagcctggcccagct

SEQ ID NO: 4691318 - DNA, 13 bp, Homo sapiens
ccccaggactggg

SEQ ID NO: 4691319 - DNA, 22 bp, Homo sapiens
ccccaggactgggccacttctg

SEQ ID NO: 4691320 - DNA, 17 bp, Homo sapiens
ccccaggaggccagcct

SEQ ID NO: 4691321 - DNA, 22 bp, Homo sapiens
ccccaggaggccagccttgacc

SEQ ID NO: 4691322 - DNA, 12 bp, Homo sapiens
ccccagggcagc

SEQ ID NO: 4691323 - DNA, 14 bp, Homo sapiens
ccccagtgcccaca

SEQ ID NO: 4691324 - DNA, 19 bp, Homo sapiens
ccccatcaggactcttgtg

SEQ ID NO: 4691325 - DNA, 14 bp, Homo sapiens
ccccatcagtgctc

SEQ ID NO: 4691326 - DNA, 14 bp, Homo sapiens
ccccatcctctgta

SEQ ID NO: 4691327 - DNA, 16 bp, Homo sapiens
ccccatcctggcccat

SEQ ID NO: 4691328 - DNA, 14 bp, Homo sapiens
ccccatctgcccag

SEQ ID NO: 4691329 - DNA, 19 bp, Homo sapiens
ccccatggtcagccctagg

SEQ ID NO: 4691330 - DNA, 14 bp, Homo sapiens
ccccattctgcctg

SEQ ID NO: 4691331 - DNA, 12 bp, Homo sapiens
cccccaccccct

SEQ ID NO: 4691332 - DNA, 13 bp, Homo sapiens
cccccactggtga

SEQ ID NO: 4691333 - DNA, 13 bp, Homo sapiens
cccccagcactga

SEQ ID NO: 4691334 - DNA, 13 bp, Homo sapiens
cccccaggactgg

SEQ ID NO: 4691335 - DNA, 16 bp, Homo sapiens
cccccatctcttctgg

SEQ ID NO: 4691336 - DNA, 14 bp, Homo sapiens
cccccctcaccagg

SEQ ID NO: 4691337 - DNA, 18 bp, Homo sapiens
ccccctcgtgccagtcgc

SEQ ID NO: 4691338 - DNA, 14 bp, Homo sapiens
ccccctctgccctg

SEQ ID NO: 4691339 - DNA, 12 bp, Homo sapiens
ccccctctgtcc

SEQ ID NO: 4691340 - DNA, 17 bp, Homo sapiens
ccccctgacaacactca

SEQ ID NO: 4691341 - DNA, 18 bp, Homo sapiens
ccccctgcaaagcccagc

SEQ ID NO: 4691342 - DNA, 14 bp, Homo sapiens
ccccctgcaggaag

SEQ ID NO: 4691343 - DNA, 21 bp, Homo sapiens
ccccctgtgcagccgctgagc

SEQ ID NO: 4691344 - DNA, 18 bp, Homo sapiens
ccccgagggatgatgcca

SEQ ID NO: 4691345 - DNA, 19 bp, Homo sapiens
ccccgagggatgatgccac

SEQ ID NO: 4691346 - DNA, 15 bp, Homo sapiens
ccccgcccaggctgg

SEQ ID NO: 4691347 - DNA, 14 bp, Homo sapiens
ccccgcccaggctt

SEQ ID NO: 4691348 - DNA, 16 bp, Homo sapiens
ccccgggaggggcccg

SEQ ID NO: 4691349 - DNA, 20 bp, Homo sapiens
cccctaccactgtcttcttc

SEQ ID NO: 4691350 - DNA, 16 bp, Homo sapiens
cccctcaccaggggca

SEQ ID NO: 4691351 - DNA, 18 bp, Homo sapiens
cccctcagacagccccct

SEQ ID NO: 4691352 - DNA, 22 bp, Homo sapiens
cccctcagggtccctggtggca

SEQ ID NO: 4691353 - DNA, 18 bp, Homo sapiens
cccctcctccactctccc

SEQ ID NO: 4691354 - DNA, 22 bp, Homo sapiens
cccctcctccctttttccttgt

SEQ ID NO: 4691355 - DNA, 17 bp, Homo sapiens
cccctcctctctgccct

SEQ ID NO: 4691356 - DNA, 13 bp, Homo sapiens
cccctcctgctgc

SEQ ID NO: 4691357 - DNA, 14 bp, Homo sapiens
cccctcgtgccagt

SEQ ID NO: 4691358 - DNA, 17 bp, Homo sapiens
cccctcgtgccagtcgc

SEQ ID NO: 4691359 - DNA, 19 bp, Homo sapiens
cccctctggctccagctgg

SEQ ID NO: 4691360 - DNA, 14 bp, Homo sapiens
cccctctgtccagg

SEQ ID NO: 4691361 - DNA, 18 bp, Homo sapiens
cccctcttgccccaaccc

SEQ ID NO: 4691362 - DNA, 22 bp, Homo sapiens
cccctcttgccccaacccccag

SEQ ID NO: 4691363 - DNA, 16 bp, Homo sapiens
cccctgcaaagcccag

SEQ ID NO: 4691364 - DNA, 18 bp, Homo sapiens
cccctgcaaagcccagct

SEQ ID NO: 4691365 - DNA, 21 bp, Homo sapiens
cccctgcaaagcccagcttga

SEQ ID NO: 4691366 - DNA, 15 bp, Homo sapiens
cccctgcaggaagga

SEQ ID NO: 4691367 - DNA, 21 bp, Homo sapiens
cccctgcaggaaggagctgcc

SEQ ID NO: 4691368 - DNA, 22 bp, Homo sapiens
cccctgcaggaaggagctgcct

SEQ ID NO: 4691369 - DNA, 22 bp, Homo sapiens
cccctgcattggaactggaggc

SEQ ID NO: 4691370 - DNA, 16 bp, Homo sapiens
cccctgcccccaggac

SEQ ID NO: 4691371 - DNA, 15 bp, Homo sapiens
cccctgccccctgca

SEQ ID NO: 4691372 - DNA, 14 bp, Homo sapiens
cccctgctggctgg

SEQ ID NO: 4691373 - DNA, 20 bp, Homo sapiens
cccctgctggttcagggttg

SEQ ID NO: 4691374 - DNA, 15 bp, Homo sapiens
cccctggatgcagcc

SEQ ID NO: 4691375 - DNA, 18 bp, Homo sapiens
cccctggttctcatcttt

SEQ ID NO: 4691376 - DNA, 11 bp, Homo sapiens
cccctgtgcag

SEQ ID NO: 4691377 - DNA, 17 bp, Homo sapiens
ccccttcgctcctgtgt

SEQ ID NO: 4691378 - DNA, 16 bp, Homo sapiens
ccccttctctcatctc

SEQ ID NO: 4691379 - DNA, 16 bp, Homo sapiens
ccccttttcagcttct

SEQ ID NO: 4691380 - DNA, 17 bp, Homo sapiens
ccccttttcagcttctg

SEQ ID NO: 4691381 - DNA, 23 bp, Homo sapiens
cccgaatacaaacacctggactt

SEQ ID NO: 4691382 - DNA, 18 bp, Homo sapiens
cccgaatagctgggacta

SEQ ID NO: 4691383 - DNA, 22 bp, Homo sapiens
cccgaatagctgggactacagg

SEQ ID NO: 4691384 - DNA, 21 bp, Homo sapiens
cccgaggccttctctgaagga

SEQ ID NO: 4691385 - DNA, 20 bp, Homo sapiens
cccgagggatgatgccacac

SEQ ID NO: 4691386 - DNA, 22 bp, Homo sapiens
cccgagggatgatgccacacca

SEQ ID NO: 4691387 - DNA, 18 bp, Homo sapiens
cccgagtagctgggacta

SEQ ID NO: 4691388 - DNA, 18 bp, Homo sapiens
cccgcaggcctgccttct

SEQ ID NO: 4691389 - DNA, 18 bp, Homo sapiens
cccgcccaggctggccag

SEQ ID NO: 4691390 - DNA, 22 bp, Homo sapiens
cccgcccaggctggccagcccc

SEQ ID NO: 4691391 - DNA, 20 bp, Homo sapiens
cccgcccaggcttagtcact

SEQ ID NO: 4691392 - DNA, 22 bp, Homo sapiens
cccgcccaggcttagtcactga

SEQ ID NO: 4691393 - DNA, 22 bp, Homo sapiens
cccgctaagagggagggagggc

SEQ ID NO: 4691394 - DNA, 23 bp, Homo sapiens
cccgctaagagggagggagggct

SEQ ID NO: 4691395 - DNA, 12 bp, Homo sapiens
cccgctcccagt

SEQ ID NO: 4691396 - DNA, 15 bp, Homo sapiens
cccgctcccagtgtc

SEQ ID NO: 4691397 - DNA, 15 bp, Homo sapiens
cccgcttgcctcggc

SEQ ID NO: 4691398 - DNA, 20 bp, Homo sapiens
cccgcttgcctcggctcctg

SEQ ID NO: 4691399 - DNA, 23 bp, Homo sapiens
cccgcttgcctcggctcctgctg

SEQ ID NO: 4691400 - DNA, 23 bp, Homo sapiens
cccggagccggcactgcatgttc

SEQ ID NO: 4691401 - DNA, 20 bp, Homo sapiens
cccggagggaaactgtgaat

SEQ ID NO: 4691402 - DNA, 13 bp, Homo sapiens
cccggccacctgc

SEQ ID NO: 4691403 - DNA, 15 bp, Homo sapiens
cccggcccctgctgg

SEQ ID NO: 4691404 - DNA, 14 bp, Homo sapiens
cccggcgccctctg

SEQ ID NO: 4691405 - DNA, 16 bp, Homo sapiens
cccggcgccctctgtc

SEQ ID NO: 4691406 - DNA, 18 bp, Homo sapiens
cccggcgccctctgtcct

SEQ ID NO: 4691407 - DNA, 20 bp, Homo sapiens
cccggcgccctctgtcctga

SEQ ID NO: 4691408 - DNA, 16 bp, Homo sapiens
cccggctccaggctcc

SEQ ID NO: 4691409 - DNA, 15 bp, Homo sapiens
cccgggaggggcccg

SEQ ID NO: 4691410 - DNA, 23 bp, Homo sapiens
cccgggaggggcccgcttgcctc

SEQ ID NO: 4691411 - DNA, 20 bp, Homo sapiens
cccgggctcagggaccacag

SEQ ID NO: 4691412 - DNA, 21 bp, Homo sapiens
cccgggctcagggaccacagc

SEQ ID NO: 4691413 - DNA, 12 bp, Homo sapiens
cccgggctctgc

SEQ ID NO: 4691414 - DNA, 20 bp, Homo sapiens
ccaaccccccagcactgagg

SEQ ID NO: 4691415 - DNA, 17 bp, Homo sapiens
ccaactcaccccagccc

SEQ ID NO: 4691416 - DNA, 18 bp, Homo sapiens
ccaacttcttcagagctg

SEQ ID NO: 4691417 - DNA, 12 bp, Homo sapiens
ccaactttcatt

SEQ ID NO: 4691418 - DNA, 15 bp, Homo sapiens
ccaagaagcccagga

SEQ ID NO: 4691419 - DNA, 20 bp, Homo sapiens
ccaagaagcccaggaaaggc

SEQ ID NO: 4691420 - DNA, 13 bp, Homo sapiens
ccaagagcttcca

SEQ ID NO: 4691421 - DNA, 14 bp, Homo sapiens
ccaagcactgtgct

SEQ ID NO: 4691422 - DNA, 22 bp, Homo sapiens
ccaagcactgtgctcagggcta

SEQ ID NO: 4691423 - DNA, 11 bp, Homo sapiens
ccaagcctctg

SEQ ID NO: 4691424 - DNA, 15 bp, Homo sapiens
ccaagcctggcaagg

SEQ ID NO: 4691425 - DNA, 19 bp, Homo sapiens
ccaagctcaggaccaggca

SEQ ID NO: 4691426 - DNA, 16 bp, Homo sapiens
ccaagctcccaggcat

SEQ ID NO: 4691427 - DNA, 18 bp, Homo sapiens
ccaagctctgctcctctc

SEQ ID NO: 4691428 - DNA, 20 bp, Homo sapiens
ccaagctggtcccactcagt

SEQ ID NO: 4691429 - DNA, 13 bp, Homo sapiens
ccaagctgtgcca

SEQ ID NO: 4691430 - DNA, 14 bp, Homo sapiens
ccaagctgtgccac

SEQ ID NO: 4691431 - DNA, 16 bp, Homo sapiens
ccaagctgtgccaccc

SEQ ID NO: 4691432 - DNA, 17 bp, Homo sapiens
ccaagctgtgccaccct

SEQ ID NO: 4691433 - DNA, 21 bp, Homo sapiens
ccaagctgtgccaccctgggc

SEQ ID NO: 4691434 - DNA, 22 bp, Homo sapiens
ccaagctgtgccaccctgggct

SEQ ID NO: 4691435 - DNA, 22 bp, Homo sapiens
ccaaggaaaccacagctgctgg

SEQ ID NO: 4691436 - DNA, 17 bp, Homo sapiens
ccaaggaagtctgtgtc

SEQ ID NO: 4691437 - DNA, 20 bp, Homo sapiens
ccaagggatgaaagagaagg

SEQ ID NO: 4691438 - DNA, 13 bp, Homo sapiens
ccaagggcagagg

SEQ ID NO: 4691439 - DNA, 16 bp, Homo sapiens
ccaagggcctggcctg

SEQ ID NO: 4691440 - DNA, 21 bp, Homo sapiens
ccaagggctttgttttgcaca

SEQ ID NO: 4691441 - DNA, 13 bp, Homo sapiens
ccaaggggtggcc

SEQ ID NO: 4691442 - DNA, 15 bp, Homo sapiens
ccaaggtggtctgct

SEQ ID NO: 4691443 - DNA, 23 bp, Homo sapiens
ccaaggtggtctgctcgggccca

SEQ ID NO: 4691444 - DNA, 14 bp, Homo sapiens
ccaagtggcagagc

SEQ ID NO: 4691445 - DNA, 17 bp, Homo sapiens
ccaagtggcagagcttg

SEQ ID NO: 4691446 - DNA, 17 bp, Homo sapiens
ccaagtttactcaaccc

SEQ ID NO: 4691447 - DNA, 21 bp, Homo sapiens
ccaagtttactcaaccctctc

SEQ ID NO: 4691448 - DNA, 19 bp, Homo sapiens
ccaagtttctaagggaggc

SEQ ID NO: 4691449 - DNA, 16 bp, Homo sapiens
ccaataacacacagct

SEQ ID NO: 4691450 - DNA, 16 bp, Homo sapiens
ccaatattgtacagtt

SEQ ID NO: 4691451 - DNA, 13 bp, Homo sapiens
ccaatcctatgtt

SEQ ID NO: 4691452 - DNA, 23 bp, Homo sapiens
ccaatgaaaaaatgtatatgcac

SEQ ID NO: 4691453 - DNA, 23 bp, Homo sapiens
ccaatgcactttgttctggctct

SEQ ID NO: 4691454 - DNA, 16 bp, Homo sapiens
ccaatgctgcctggga

SEQ ID NO: 4691455 - DNA, 19 bp, Homo sapiens
ccaattcttacaaacatgt

SEQ ID NO: 4691456 - DNA, 22 bp, Homo sapiens
ccacaaatgtgtcccagtgaac

SEQ ID NO: 4691457 - DNA, 20 bp, Homo sapiens
ccacaccaagctgtgccacc

SEQ ID NO: 4691458 - DNA, 14 bp, Homo sapiens
ccacacccagccca

SEQ ID NO: 4691459 - DNA, 21 bp, Homo sapiens
ccacacccagcccacttctgc

SEQ ID NO: 4691460 - DNA, 15 bp, Homo sapiens
ccacacccccacccc

SEQ ID NO: 4691461 - DNA, 14 bp, Homo sapiens
ccacagagcgggga

SEQ ID NO: 4691462 - DNA, 19 bp, Homo sapiens
ccacagcaaggcacctgca

SEQ ID NO: 4691463 - DNA, 14 bp, Homo sapiens
ccacagcccacgtc

SEQ ID NO: 4691464 - DNA, 12 bp, Homo sapiens
ccacagctgctg

SEQ ID NO: 4691465 - DNA, 13 bp, Homo sapiens
ccacagctgctgg

SEQ ID NO: 4691466 - DNA, 22 bp, Homo sapiens
ccacagcttttacgtagtaaaa

SEQ ID NO: 4691467 - DNA, 16 bp, Homo sapiens
ccacaggacatttctc

SEQ ID NO: 4691468 - DNA, 22 bp, Homo sapiens
ccacagtgactcgggctcctgt

SEQ ID NO: 4691469 - DNA, 22 bp, Homo sapiens
ccacagtgttggcgagaggagg

SEQ ID NO: 4691470 - DNA, 16 bp, Homo sapiens
ccacatcttgctctgc

SEQ ID NO: 4691471 - DNA, 16 bp, Homo sapiens
ccacattcctgatgct

SEQ ID NO: 4691472 - DNA, 16 bp, Homo sapiens
ccacatttagtcctgt

SEQ ID NO: 4691473 - DNA, 14 bp, Homo sapiens
ccaccaacatactc

SEQ ID NO: 4691474 - DNA, 20 bp, Homo sapiens
ccaccaacatactcccatct

SEQ ID NO: 4691475 - DNA, 21 bp, Homo sapiens
ccaccaagagggacgcctggg

SEQ ID NO: 4691476 - DNA, 16 bp, Homo sapiens
ccaccacacccagccc

SEQ ID NO: 4691477 - DNA, 14 bp, Homo sapiens
ccaccacagcttat

SEQ ID NO: 4691478 - DNA, 15 bp, Homo sapiens
ccaccacgcccggct

SEQ ID NO: 4691479 - DNA, 13 bp, Homo sapiens
ccaccataatccc

SEQ ID NO: 4691480 - DNA, 17 bp, Homo sapiens
ccaccatcaagccacca

SEQ ID NO: 4691481 - DNA, 14 bp, Homo sapiens
ccacccacctcagc

SEQ ID NO: 4691482 - DNA, 15 bp, Homo sapiens
ccacccacctcagcc

SEQ ID NO: 4691483 - DNA, 16 bp, Homo sapiens
ccacccacctcagcct

SEQ ID NO: 4691484 - DNA, 15 bp, Homo sapiens
ccacccacttccctg

SEQ ID NO: 4691485 - DNA, 15 bp, Homo sapiens
ccacccacttctgca

SEQ ID NO: 4691486 - DNA, 12 bp, Homo sapiens
ccacccaggagc

SEQ ID NO: 4691487 - DNA, 19 bp, Homo sapiens
ccaccccagggcagccagg

SEQ ID NO: 4691488 - DNA, 12 bp, Homo sapiens
ccacccccacac

SEQ ID NO: 4691489 - DNA, 20 bp, Homo sapiens
ccaccccttgctctcaaccc

SEQ ID NO: 4691490 - DNA, 21 bp, Homo sapiens
ccacccggtggttcttcctgt

SEQ ID NO: 4691491 - DNA, 23 bp, Homo sapiens
ccaccctcaccgcggctggatgg

SEQ ID NO: 4691492 - DNA, 13 bp, Homo sapiens
ccaccgcagacag

SEQ ID NO: 4691493 - DNA, 22 bp, Homo sapiens
ccaccgcagacaggaccaggga

SEQ ID NO: 4691494 - DNA, 17 bp, Homo sapiens
ccaccgcatgccccctc

SEQ ID NO: 4691495 - DNA, 18 bp, Homo sapiens
ccaccgcatgccccctcg

SEQ ID NO: 4691496 - DNA, 18 bp, Homo sapiens
ccaccgccatggcttcca

SEQ ID NO: 4691497 - DNA, 18 bp, Homo sapiens
ccacctagtggctgtcca

SEQ ID NO: 4691498 - DNA, 12 bp, Homo sapiens
ccacctcagcct

SEQ ID NO: 4691499 - DNA, 14 bp, Homo sapiens
ccacctctctcact

SEQ ID NO: 4691500 - DNA, 16 bp, Homo sapiens
ccacctctctcactcc

SEQ ID NO: 4691501 - DNA, 12 bp, Homo sapiens
ccacctggaccc

SEQ ID NO: 4691502 - DNA, 17 bp, Homo sapiens
ccacctggacccctgca

SEQ ID NO: 4691503 - DNA, 15 bp, Homo sapiens
ccacctggcctctgc

SEQ ID NO: 4691504 - DNA, 16 bp, Homo sapiens
ccacctggcctctgca

SEQ ID NO: 4691505 - DNA, 13 bp, Homo sapiens
ccaccttggctca

SEQ ID NO: 4691506 - DNA, 14 bp, Homo sapiens
ccaccttggctcaa

SEQ ID NO: 4691507 - DNA, 15 bp, Homo sapiens
ccaccttggctgcag

SEQ ID NO: 4691508 - DNA, 18 bp, Homo sapiens
ccaccttggctgcaggga

SEQ ID NO: 4691509 - DNA, 20 bp, Homo sapiens
ccacctttgtttctccccca

SEQ ID NO: 4691510 - DNA, 13 bp, Homo sapiens
ccacgcccccact

SEQ ID NO: 4691511 - DNA, 16 bp, Homo sapiens
ccacgctggagtgcag

SEQ ID NO: 4691512 - DNA, 19 bp, Homo sapiens
ccacgctggagtgcagtga

SEQ ID NO: 4691513 - DNA, 16 bp, Homo sapiens
ccacggccaggccaga

SEQ ID NO: 4691514 - DNA, 18 bp, Homo sapiens
ccacggccaggccagagg

SEQ ID NO: 4691515 - DNA, 11 bp, Homo sapiens
ccactaactag

SEQ ID NO: 4691516 - DNA, 23 bp, Homo sapiens
ccactacggaatagttggctagg

SEQ ID NO: 4691517 - DNA, 11 bp, Homo sapiens
ccactcaggtc

SEQ ID NO: 4691518 - DNA, 18 bp, Homo sapiens
ccactcagtccatagcag

SEQ ID NO: 4691519 - DNA, 12 bp, Homo sapiens
ccactcccactt

SEQ ID NO: 4691520 - DNA, 22 bp, Homo sapiens
ccactcccacttccctgacact

SEQ ID NO: 4691521 - DNA, 13 bp, Homo sapiens
ccactcccaggca

SEQ ID NO: 4691522 - DNA, 15 bp, Homo sapiens
ccactcccaggcagc

SEQ ID NO: 4691523 - DNA, 12 bp, Homo sapiens
ccactccctgca

SEQ ID NO: 4691524 - DNA, 13 bp, Homo sapiens
ccactccctgcaa

SEQ ID NO: 4691525 - DNA, 17 bp, Homo sapiens
ccactccctgcaacctg

SEQ ID NO: 4691526 - DNA, 14 bp, Homo sapiens
ccactcctctgact

SEQ ID NO: 4691527 - DNA, 20 bp, Homo sapiens
ccactctcccccaccccctc

SEQ ID NO: 4691528 - DNA, 11 bp, Homo sapiens
ccactctgtgc

SEQ ID NO: 4691529 - DNA, 18 bp, Homo sapiens
ccactgcaacttgtgaac

SEQ ID NO: 4691530 - DNA, 22 bp, Homo sapiens
ccactgcaccccctcctgctgc

SEQ ID NO: 4691531 - DNA, 19 bp, Homo sapiens
ccactgcaccgggccacag

SEQ ID NO: 4691532 - DNA, 17 bp, Homo sapiens
ccactgcctttcagaag

SEQ ID NO: 4691533 - DNA, 12 bp, Homo sapiens
ccactgctctgg

SEQ ID NO: 4691534 - DNA, 21 bp, Homo sapiens
ccactggaggggtcatccttg

SEQ ID NO: 4691535 - DNA, 19 bp, Homo sapiens
ccactgtgccatgtgccag

SEQ ID NO: 4691536 - DNA, 17 bp, Homo sapiens
ccactgtggaagtccct

SEQ ID NO: 4691537 - DNA, 19 bp, Homo sapiens
ccacttcccctcctacccc

SEQ ID NO: 4691538 - DNA, 12 bp, Homo sapiens
ccacttctgcac

SEQ ID NO: 4691539 - DNA, 15 bp, Homo sapiens
ccacttctgggtggg

SEQ ID NO: 4691540 - DNA, 21 bp, Homo sapiens
ccagacaccttgacagggcac

SEQ ID NO: 4691541 - DNA, 15 bp, Homo sapiens
ccagacccggctgcg

SEQ ID NO: 4691542 - DNA, 16 bp, Homo sapiens
ccagacccggctgcgt

SEQ ID NO: 4691543 - DNA, 18 bp, Homo sapiens
ccagagaaaattaattat

SEQ ID NO: 4691544 - DNA, 13 bp, Homo sapiens
ccagagagggtgg

SEQ ID NO: 4691545 - DNA, 14 bp, Homo sapiens
ccagagagggtggt

SEQ ID NO: 4691546 - DNA, 14 bp, Homo sapiens
ccagagcagatgca

SEQ ID NO: 4691547 - DNA, 18 bp, Homo sapiens
ccagagcagatgcagaga

SEQ ID NO: 4691548 - DNA, 17 bp, Homo sapiens
ccagagctctgacccac

SEQ ID NO: 4691549 - DNA, 18 bp, Homo sapiens
ccagagctctgacccaca

SEQ ID NO: 4691550 - DNA, 14 bp, Homo sapiens
ccagagctgcttct

SEQ ID NO: 4691551 - DNA, 19 bp, Homo sapiens
ccagagctgcttctgtctg

SEQ ID NO: 4691552 - DNA, 20 bp, Homo sapiens
ccagagctgcttctgtctgg

SEQ ID NO: 4691553 - DNA, 19 bp, Homo sapiens
ccagaggaaggggccagag

SEQ ID NO: 4691554 - DNA, 21 bp, Homo sapiens
ccagaggattgctgccccatc

SEQ ID NO: 4691555 - DNA, 21 bp, Homo sapiens
ccagagggagtgacagaggca

SEQ ID NO: 4691556 - DNA, 23 bp, Homo sapiens
ccagagggagtgacagaggcagc

SEQ ID NO: 4691557 - DNA, 17 bp, Homo sapiens
ccagagggcctgcaagg

SEQ ID NO: 4691558 - DNA, 19 bp, Homo sapiens
ccagagggcctgcaaggga

SEQ ID NO: 4691559 - DNA, 20 bp, Homo sapiens
ccagagggcctgcaagggag

SEQ ID NO: 4691560 - DNA, 13 bp, Homo sapiens
ccagaggggcctg

SEQ ID NO: 4691561 - DNA, 20 bp, Homo sapiens
ccagaggggcctgccacctg

SEQ ID NO: 4691562 - DNA, 22 bp, Homo sapiens
ccagaggggcctgccacctgga

SEQ ID NO: 4691563 - DNA, 23 bp, Homo sapiens
ccagaggggcctgccacctggac

SEQ ID NO: 4691564 - DNA, 20 bp, Homo sapiens
ccagagtttttatgtagcag

SEQ ID NO: 4691565 - DNA, 17 bp, Homo sapiens
ccagatagtgtagctga

SEQ ID NO: 4691566 - DNA, 20 bp, Homo sapiens
ccagatagtgtagctgagga

SEQ ID NO: 4691567 - DNA, 14 bp, Homo sapiens
ccagatatttatgt

SEQ ID NO: 4691568 - DNA, 23 bp, Homo sapiens
ccagatatttatgtatcttgatg

SEQ ID NO: 4691569 - DNA, 14 bp, Homo sapiens
ccagatgcaccagc

SEQ ID NO: 4691570 - DNA, 23 bp, Homo sapiens
ccagatgcaccagcccttagcag

SEQ ID NO: 4691571 - DNA, 19 bp, Homo sapiens
ccagatgtcgctgggtcct

SEQ ID NO: 4691572 - DNA, 18 bp, Homo sapiens
ccagattctttcctgagg

SEQ ID NO: 4691573 - DNA, 23 bp, Homo sapiens
ccagattctttcctgaggctggg

SEQ ID NO: 4691574 - DNA, 14 bp, Homo sapiens
ccagattgcaacag

SEQ ID NO: 4691575 - DNA, 19 bp, Homo sapiens
ccagattgcaacaggctgg

SEQ ID NO: 4691576 - DNA, 23 bp, Homo sapiens
ccagattttatttatatctttat

SEQ ID NO: 4691577 - DNA, 15 bp, Homo sapiens
ccagcaaacaaaatg

SEQ ID NO: 4691578 - DNA, 16 bp, Homo sapiens
ccagcaagtgagagct

SEQ ID NO: 4691579 - DNA, 19 bp, Homo sapiens
ccagcaagtgagagctggg

SEQ ID NO: 4691580 - DNA, 16 bp, Homo sapiens
ccagcaattctcctgc

SEQ ID NO: 4691581 - DNA, 18 bp, Homo sapiens
ccagcaattctcctgcct

SEQ ID NO: 4691582 - DNA, 20 bp, Homo sapiens
ccagcaattctcctgcctca

SEQ ID NO: 4691583 - DNA, 14 bp, Homo sapiens
ccagcactgaggaa

SEQ ID NO: 4691584 - DNA, 22 bp, Homo sapiens
ccagcactgaggaagaacgggg

SEQ ID NO: 4691585 - DNA, 12 bp, Homo sapiens
ccagcactgctt

SEQ ID NO: 4691586 - DNA, 18 bp, Homo sapiens
ccagcactgcttgaggaa

SEQ ID NO: 4691587 - DNA, 21 bp, Homo sapiens
ccagcacttggagaggctgag

SEQ ID NO: 4691588 - DNA, 18 bp, Homo sapiens
ccagcatcccttgaccag

SEQ ID NO: 4691589 - DNA, 21 bp, Homo sapiens
ccagcatcccttgaccaggcc

SEQ ID NO: 4691590 - DNA, 16 bp, Homo sapiens
ccagcccacttctgcc

SEQ ID NO: 4691591 - DNA, 13 bp, Homo sapiens
ccagccccagtgc

SEQ ID NO: 4691592 - DNA, 17 bp, Homo sapiens
ccagccccagtgcccac

SEQ ID NO: 4691593 - DNA, 16 bp, Homo sapiens
ccagccccatcaggac

SEQ ID NO: 4691594 - DNA, 17 bp, Homo sapiens
ccagccccatcctctgt

SEQ ID NO: 4691595 - DNA, 23 bp, Homo sapiens
ccagccccatcctctgtacagag

SEQ ID NO: 4691596 - DNA, 13 bp, Homo sapiens
ccagcccctgctg

SEQ ID NO: 4691597 - DNA, 12 bp, Homo sapiens
ccagcccctgga

SEQ ID NO: 4691598 - DNA, 15 bp, Homo sapiens
ccagcccctggatgc

SEQ ID NO: 4691599 - DNA, 21 bp, Homo sapiens
ccagcccctggatgcagcctc

SEQ ID NO: 4691600 - DNA, 24 bp, Homo sapiens
ccagccccttctgacccatgctgc

SEQ ID NO: 4691601 - DNA, 15 bp, Homo sapiens
ccagccctcccagca

SEQ ID NO: 4691602 - DNA, 21 bp, Homo sapiens
ccagccctccttatcaaagga

SEQ ID NO: 4691603 - DNA, 14 bp, Homo sapiens
ccagccctggctga

SEQ ID NO: 4691604 - DNA, 22 bp, Homo sapiens
ccagccggtacctgggaagggg

SEQ ID NO: 4691605 - DNA, 23 bp, Homo sapiens
ccagcctgacaacagcctgagaa

SEQ ID NO: 4691606 - DNA, 13 bp, Homo sapiens
ccagcctggagat

SEQ ID NO: 4691607 - DNA, 17 bp, Homo sapiens
ccagcctggccaacatg

SEQ ID NO: 4691608 - DNA, 14 bp, Homo sapiens
ccagcctggcccag

SEQ ID NO: 4691609 - DNA, 19 bp, Homo sapiens
ccagccttgaccattctcc

SEQ ID NO: 4691610 - DNA, 18 bp, Homo sapiens
ccagccttggcatctaga

SEQ ID NO: 4691611 - DNA, 16 bp, Homo sapiens
ccagcgaggaggctcc

SEQ ID NO: 4691612 - DNA, 19 bp, Homo sapiens
ccagcgtcctcctctgtga

SEQ ID NO: 4691613 - DNA, 22 bp, Homo sapiens
ccagctcaccagccccagtgcc

SEQ ID NO: 4691614 - DNA, 17 bp, Homo sapiens
ccagctctggtccatag

SEQ ID NO: 4691615 - DNA, 14 bp, Homo sapiens
ccagctctgtatca

SEQ ID NO: 4691616 - DNA, 21 bp, Homo sapiens
ccagctctgtatcaggaccca

SEQ ID NO: 4691617 - DNA, 15 bp, Homo sapiens
ccagctgacagtcct

SEQ ID NO: 4691618 - DNA, 23 bp, Homo sapiens
ccagctgacagtcctctccacct

SEQ ID NO: 4691619 - DNA, 12 bp, Homo sapiens
ccagctggccgg

SEQ ID NO: 4691620 - DNA, 16 bp, Homo sapiens
ccagctgggttggaaa

SEQ ID NO: 4691621 - DNA, 17 bp, Homo sapiens
ccagctgggttggaaaa

SEQ ID NO: 4691622 - DNA, 18 bp, Homo sapiens
ccagctgtgaagagactc

SEQ ID NO: 4691623 - DNA, 18 bp, Homo sapiens
ccagctgtgctctggaca

SEQ ID NO: 4691624 - DNA, 22 bp, Homo sapiens
ccagctgttctgtcccttggag

SEQ ID NO: 4691625 - DNA, 13 bp, Homo sapiens
ccagcttttccca

SEQ ID NO: 4691626 - DNA, 11 bp, Homo sapiens
ccaggaaagca

SEQ ID NO: 4691627 - DNA, 15 bp, Homo sapiens
ccaggaaaggctcca

SEQ ID NO: 4691628 - DNA, 23 bp, Homo sapiens
ccaggaaaggctccaggagcagc

SEQ ID NO: 4691629 - DNA, 11 bp, Homo sapiens
ccaggaagaag

SEQ ID NO: 4691630 - DNA, 23 bp, Homo sapiens
ccaggaccagtcaacctgggcaa

SEQ ID NO: 4691631 - DNA, 18 bp, Homo sapiens
ccaggacggggccggcca

SEQ ID NO: 4691632 - DNA, 19 bp, Homo sapiens
ccaggacggggccggccag

SEQ ID NO: 4691633 - DNA, 21 bp, Homo sapiens
ccaggacggggccggccaggt

SEQ ID NO: 4691634 - DNA, 14 bp, Homo sapiens
ccaggactctgcag

SEQ ID NO: 4691635 - DNA, 17 bp, Homo sapiens
ccaggactctgcagcct

SEQ ID NO: 4691636 - DNA, 17 bp, Homo sapiens
ccaggactgggccactt

SEQ ID NO: 4691637 - DNA, 15 bp, Homo sapiens
ccaggagcagccaca

SEQ ID NO: 4691638 - DNA, 20 bp, Homo sapiens
ccaggagcatccacctcctt

SEQ ID NO: 4691639 - DNA, 15 bp, Homo sapiens
ccaggagccccgagg

SEQ ID NO: 4691640 - DNA, 23 bp, Homo sapiens
ccaggagccggacacttctcagg

SEQ ID NO: 4691641 - DNA, 14 bp, Homo sapiens
ccaggaggccagcc

SEQ ID NO: 4691642 - DNA, 20 bp, Homo sapiens
ccaggattggggacctgatg

SEQ ID NO: 4691643 - DNA, 17 bp, Homo sapiens
ccaggatttataaagca

SEQ ID NO: 4691644 - DNA, 20 bp, Homo sapiens
ccaggcaggctaaggcgtgg

SEQ ID NO: 4691645 - DNA, 17 bp, Homo sapiens
ccaggcattccccagga

SEQ ID NO: 4691646 - DNA, 18 bp, Homo sapiens
ccaggcattccccaggag

SEQ ID NO: 4691647 - DNA, 23 bp, Homo sapiens
ccaggcattccccaggaggccag

SEQ ID NO: 4691648 - DNA, 16 bp, Homo sapiens
ccaggccacaaatgtg

SEQ ID NO: 4691649 - DNA, 13 bp, Homo sapiens
ccaggccaggact

SEQ ID NO: 4691650 - DNA, 18 bp, Homo sapiens
ccaggccatcttccaggt

SEQ ID NO: 4691651 - DNA, 15 bp, Homo sapiens
ccaggcccctgccac

SEQ ID NO: 4691652 - DNA, 16 bp, Homo sapiens
ccaggcccctgccacc

SEQ ID NO: 4691653 - DNA, 13 bp, Homo sapiens
ccaggccctctgc

SEQ ID NO: 4691654 - DNA, 17 bp, Homo sapiens
ccaggccctctgcccac

SEQ ID NO: 4691655 - DNA, 18 bp, Homo sapiens
ccaggccctctgcccact

SEQ ID NO: 4691656 - DNA, 19 bp, Homo sapiens
ccaggccctctgcccactc

SEQ ID NO: 4691657 - DNA, 22 bp, Homo sapiens
ccaggccctctgcccactccct

SEQ ID NO: 4691658 - DNA, 23 bp, Homo sapiens
ccaggcctggcccggctgggccc

SEQ ID NO: 4691659 - DNA, 16 bp, Homo sapiens
ccaggctgagcctcag

SEQ ID NO: 4691660 - DNA, 21 bp, Homo sapiens
ccaggctgctcttgaactcct

SEQ ID NO: 4691661 - DNA, 12 bp, Homo sapiens
ccaggctggcca

SEQ ID NO: 4691662 - DNA, 23 bp, Homo sapiens
ccaggctggccagccccacagcc

SEQ ID NO: 4691663 - DNA, 17 bp, Homo sapiens
ccaggctggcgtgcagt

SEQ ID NO: 4691664 - DNA, 13 bp, Homo sapiens
ccaggctgggaga

SEQ ID NO: 4691665 - DNA, 22 bp, Homo sapiens
ccaggctgggagagccttccag

SEQ ID NO: 4691666 - DNA, 14 bp, Homo sapiens
ccaggctggtctca

SEQ ID NO: 4691667 - DNA, 19 bp, Homo sapiens
ccaggctggtctcaaactc

SEQ ID NO: 4691668 - DNA, 21 bp, Homo sapiens
ccaggctggtctcgaactcct

SEQ ID NO: 4691669 - DNA, 20 bp, Homo sapiens
ccaggctgtatcccatgagc

SEQ ID NO: 4691670 - DNA, 15 bp, Homo sapiens
ccaggcttgcctggg

SEQ ID NO: 4691671 - DNA, 12 bp, Homo sapiens
ccagggaagggg

SEQ ID NO: 4691672 - DNA, 14 bp, Homo sapiens
ccagggacagaggg

SEQ ID NO: 4691673 - DNA, 23 bp, Homo sapiens
ccagggacagagggggtggcctc

SEQ ID NO: 4691674 - DNA, 14 bp, Homo sapiens
ccagggcagccagg

SEQ ID NO: 4691675 - DNA, 15 bp, Homo sapiens
ccagggcagccaggg

SEQ ID NO: 4691676 - DNA, 19 bp, Homo sapiens
ccagggcagccagggagag

SEQ ID NO: 4691677 - DNA, 13 bp, Homo sapiens
ccagggcctagga

SEQ ID NO: 4691678 - DNA, 20 bp, Homo sapiens
ccagggctgctagacggagg

SEQ ID NO: 4691679 - DNA, 19 bp, Homo sapiens
ccagggctggactgaggcc

SEQ ID NO: 4691680 - DNA, 18 bp, Homo sapiens
ccaggggcaggcacagca

SEQ ID NO: 4691681 - DNA, 14 bp, Homo sapiens
ccaggggtgggaca

SEQ ID NO: 4691682 - DNA, 17 bp, Homo sapiens
ccaggggtgggacaccc

SEQ ID NO: 4691683 - DNA, 22 bp, Homo sapiens
ccaggggtgggacaccctgtga

SEQ ID NO: 4691684 - DNA, 23 bp, Homo sapiens
ccaggggtgggacaccctgtgat

SEQ ID NO: 4691685 - DNA, 14 bp, Homo sapiens
ccagggtctttgca

SEQ ID NO: 4691686 - DNA, 13 bp, Homo sapiens
ccaggtaaaaaca

SEQ ID NO: 4691687 - DNA, 16 bp, Homo sapiens
ccaggtctcctccacc

SEQ ID NO: 4691688 - DNA, 19 bp, Homo sapiens
ccaggtctcctccaccgcc

SEQ ID NO: 4691689 - DNA, 21 bp, Homo sapiens
ccaggtctcctccaccgccat

SEQ ID NO: 4691690 - DNA, 18 bp, Homo sapiens
ccaggtgcacaagctcca

SEQ ID NO: 4691691 - DNA, 19 bp, Homo sapiens
ccaggtgcacaagctccaa

SEQ ID NO: 4691692 - DNA, 21 bp, Homo sapiens
ccaggtgctaggaacactcct

SEQ ID NO: 4691693 - DNA, 19 bp, Homo sapiens
ccaggtgggcgggcagcac

SEQ ID NO: 4691694 - DNA, 16 bp, Homo sapiens
ccaggttatctgggca

SEQ ID NO: 4691695 - DNA, 15 bp, Homo sapiens
ccaggttcagcttgt

SEQ ID NO: 4691696 - DNA, 17 bp, Homo sapiens
ccaggtttctggtctct

SEQ ID NO: 4691697 - DNA, 22 bp, Homo sapiens
ccaggtttctggtctctaggct

SEQ ID NO: 4691698 - DNA, 17 bp, Homo sapiens
ccagtaaacagaggagt

SEQ ID NO: 4691699 - DNA, 18 bp, Homo sapiens
ccagtacctcctgtctct

SEQ ID NO: 4691700 - DNA, 16 bp, Homo sapiens
ccagtataagattttt

SEQ ID NO: 4691701 - DNA, 18 bp, Homo sapiens
ccagtataagatttttga

SEQ ID NO: 4691702 - DNA, 12 bp, Homo sapiens
ccagtcaccccg

SEQ ID NO: 4691703 - DNA, 13 bp, Homo sapiens
ccagtcaccccgg

SEQ ID NO: 4691704 - DNA, 21 bp, Homo sapiens
ccagtcattatgttaatattt

SEQ ID NO: 4691705 - DNA, 14 bp, Homo sapiens
ccagtccaaggaaa

SEQ ID NO: 4691706 - DNA, 14 bp, Homo sapiens
ccagtcgcgctgcc

SEQ ID NO: 4691707 - DNA, 17 bp, Homo sapiens
ccagtcgcgctgcctgt

SEQ ID NO: 4691708 - DNA, 14 bp, Homo sapiens
ccagtgagatgcat

SEQ ID NO: 4691709 - DNA, 13 bp, Homo sapiens
ccagtgaggctct

SEQ ID NO: 4691710 - DNA, 14 bp, Homo sapiens
ccagtgaggctctg

SEQ ID NO: 4691711 - DNA, 18 bp, Homo sapiens
ccagtgaggctctgccct

SEQ ID NO: 4691712 - DNA, 23 bp, Homo sapiens
ccagtgagttcagcctttaagat

SEQ ID NO: 4691713 - DNA, 21 bp, Homo sapiens
ccagtgatgctaaaggttgta

SEQ ID NO: 4691714 - DNA, 16 bp, Homo sapiens
ccagtgcagagatcct

SEQ ID NO: 4691715 - DNA, 18 bp, Homo sapiens
ccagtgcccattcctcac

SEQ ID NO: 4691716 - DNA, 13 bp, Homo sapiens
ccagtgctgcatg

SEQ ID NO: 4691717 - DNA, 14 bp, Homo sapiens
ccagtggctgctgc

SEQ ID NO: 4691718 - DNA, 15 bp, Homo sapiens
ccagtggctgctgcc

SEQ ID NO: 4691719 - DNA, 18 bp, Homo sapiens
ccagtggctgctgcccag

SEQ ID NO: 4691720 - DNA, 19 bp, Homo sapiens
ccagtggctgctgcccagg

SEQ ID NO: 4691721 - DNA, 20 bp, Homo sapiens
ccagtgtatgagagggccct

SEQ ID NO: 4691722 - DNA, 13 bp, Homo sapiens
ccagtgtcttcct

SEQ ID NO: 4691723 - DNA, 15 bp, Homo sapiens
ccagtgtcttcctgt

SEQ ID NO: 4691724 - DNA, 17 bp, Homo sapiens
ccagtgtcttcctgtgg

SEQ ID NO: 4691725 - DNA, 20 bp, Homo sapiens
ccagtgtgacaggaaagatt

SEQ ID NO: 4691726 - DNA, 17 bp, Homo sapiens
ccagttaaaaaaaattt

SEQ ID NO: 4691727 - DNA, 21 bp, Homo sapiens
ccagttcctttcaatggtttg

SEQ ID NO: 4691728 - DNA, 15 bp, Homo sapiens
ccagttgccatctgc

SEQ ID NO: 4691729 - DNA, 19 bp, Homo sapiens
ccagttgggtggatgcctg

SEQ ID NO: 4691730 - DNA, 23 bp, Homo sapiens
ccagttgggtggatgcctggtgg

SEQ ID NO: 4691731 - DNA, 13 bp, Homo sapiens
aatagaaggtgat

SEQ ID NO: 4691732 - DNA, 14 bp, Homo sapiens
aatagagcctgagg

SEQ ID NO: 4691733 - DNA, 16 bp, Homo sapiens
aatagagcctgaggga

SEQ ID NO: 4691734 - DNA, 14 bp, Homo sapiens
aatagctgggacta

SEQ ID NO: 4691735 - DNA, 20 bp, Homo sapiens
aatagcttattatagaattg

SEQ ID NO: 4691736 - DNA, 15 bp, Homo sapiens
aataggagaggatga

SEQ ID NO: 4691737 - DNA, 21 bp, Homo sapiens
aatagtatatctaatggctgt

SEQ ID NO: 4691738 - DNA, 14 bp, Homo sapiens
aatagtatgaaaat

SEQ ID NO: 4691739 - DNA, 17 bp, Homo sapiens
aatagtatgaaaatgga

SEQ ID NO: 4691740 - DNA, 14 bp, Homo sapiens
aatagttgttgatt

SEQ ID NO: 4691741 - DNA, 13 bp, Homo sapiens
aatataaaaataa

SEQ ID NO: 4691742 - DNA, 14 bp, Homo sapiens
aatataaaatatga

SEQ ID NO: 4691743 - DNA, 14 bp, Homo sapiens
aatataaacactat

SEQ ID NO: 4691744 - DNA, 12 bp, Homo sapiens
aatatacatttg

SEQ ID NO: 4691745 - DNA, 13 bp, Homo sapiens
aatatacatttgt

SEQ ID NO: 4691746 - DNA, 22 bp, Homo sapiens
aatatagttgtctttctttgct

SEQ ID NO: 4691747 - DNA, 20 bp, Homo sapiens
aatatcaaagtcattaaaga

SEQ ID NO: 4691748 - DNA, 19 bp, Homo sapiens
aatatctttaaatgatgta

SEQ ID NO: 4691749 - DNA, 14 bp, Homo sapiens
aatatgattattaa

SEQ ID NO: 4691750 - DNA, 16 bp, Homo sapiens
aatatgattcactatt

SEQ ID NO: 4691751 - DNA, 20 bp, Homo sapiens
aatatgtttggaatattcca

SEQ ID NO: 4691752 - DNA, 22 bp, Homo sapiens
aatattaaaatcactgtcaata

SEQ ID NO: 4691753 - DNA, 14 bp, Homo sapiens
aatattaagaaaca

SEQ ID NO: 4691754 - DNA, 15 bp, Homo sapiens
aatattaagaaacaa

SEQ ID NO: 4691755 - DNA, 19 bp, Homo sapiens
aatattaagaaacaattta

SEQ ID NO: 4691756 - DNA, 21 bp, Homo sapiens
aatattactgatcttaccttt

SEQ ID NO: 4691757 - DNA, 23 bp, Homo sapiens
aatattcctacttgcagtacatc

SEQ ID NO: 4691758 - DNA, 13 bp, Homo sapiens
aatggatttttct

SEQ ID NO: 4691759 - DNA, 18 bp, Homo sapiens
aatggctatcaaaagaaa

SEQ ID NO: 4691760 - DNA, 21 bp, Homo sapiens
aatggctcactatggtgccaa

SEQ ID NO: 4691761 - DNA, 14 bp, Homo sapiens
aatggtagttttac

SEQ ID NO: 4691762 - DNA, 14 bp, Homo sapiens
aatggtccaggaga

SEQ ID NO: 4691763 - DNA, 15 bp, Homo sapiens
aatggtgaacatttt

SEQ ID NO: 4691764 - DNA, 17 bp, Homo sapiens
aatggtttgaatataaa

SEQ ID NO: 4691765 - DNA, 17 bp, Homo sapiens
aatggtttgcaaggaag

SEQ ID NO: 4691766 - DNA, 20 bp, Homo sapiens
aatggtttgtgtcaaaactg

SEQ ID NO: 4691767 - DNA, 16 bp, Homo sapiens
aatgtaaaagaaaatt

SEQ ID NO: 4691768 - DNA, 12 bp, Homo sapiens
aatgtaaataaa

SEQ ID NO: 4691769 - DNA, 13 bp, Homo sapiens
aatgtatatgcac

SEQ ID NO: 4691770 - DNA, 13 bp, Homo sapiens
aatgtcacaggca

SEQ ID NO: 4691771 - DNA, 17 bp, Homo sapiens
aatgtcacagtaatgca

SEQ ID NO: 4691772 - DNA, 20 bp, Homo sapiens
aatgtcagttgttatttatt

SEQ ID NO: 4691773 - DNA, 23 bp, Homo sapiens
aatgtctgtaataatagactgta

SEQ ID NO: 4691774 - DNA, 11 bp, Homo sapiens
aatgtcttgtg

SEQ ID NO: 4691775 - DNA, 13 bp, Homo sapiens
aatgtcttgtgtt

SEQ ID NO: 4691776 - DNA, 15 bp, Homo sapiens
aatgtgaaaaaaatt

SEQ ID NO: 4691777 - DNA, 14 bp, Homo sapiens
aatgtgactcaaga

SEQ ID NO: 4691778 - DNA, 13 bp, Homo sapiens
aatgtgatcatct

SEQ ID NO: 4691779 - DNA, 12 bp, Homo sapiens
aatgtgatgaat

SEQ ID NO: 4691780 - DNA, 15 bp, Homo sapiens
aatgtgcaatagaag

SEQ ID NO: 4691781 - DNA, 19 bp, Homo sapiens
aatgtggctgtatccactt

SEQ ID NO: 4691782 - DNA, 23 bp, Homo sapiens
aatgtgtatgtgtggtttcagtt

SEQ ID NO: 4691783 - DNA, 23 bp, Homo sapiens
aatgtgtctgcaacatggattcc

SEQ ID NO: 4691784 - DNA, 17 bp, Homo sapiens
aatgtgttttgtacatg

SEQ ID NO: 4691785 - DNA, 16 bp, Homo sapiens
aatgttaaatttgtaa

SEQ ID NO: 4691786 - DNA, 17 bp, Homo sapiens
aatgttaaatttgtaag

SEQ ID NO: 4691787 - DNA, 18 bp, Homo sapiens
aatgttgcactgaaaacc

SEQ ID NO: 4691788 - DNA, 15 bp, Homo sapiens
aatgtttaaacattt

SEQ ID NO: 4691789 - DNA, 16 bp, Homo sapiens
aatgtttaaacatttt

SEQ ID NO: 4691790 - DNA, 15 bp, Homo sapiens
aatgtttgtgagaag

SEQ ID NO: 4691791 - DNA, 15 bp, Homo sapiens
aatgtttgttattta

SEQ ID NO: 4691792 - DNA, 21 bp, Homo sapiens
aatgtttgttatttacactgg

SEQ ID NO: 4691793 - DNA, 13 bp, Homo sapiens
aattaaactccta

SEQ ID NO: 4691794 - DNA, 20 bp, Homo sapiens
aattaaataaataaataaga

SEQ ID NO: 4691795 - DNA, 12 bp, Homo sapiens
aattaacactgc

SEQ ID NO: 4691796 - DNA, 15 bp, Homo sapiens
aattaagaagaaaat

SEQ ID NO: 4691797 - DNA, 21 bp, Homo sapiens
aattaatttgtgaatttgcaa

SEQ ID NO: 4691798 - DNA, 16 bp, Homo sapiens
aattacatctctaatt

SEQ ID NO: 4691799 - DNA, 22 bp, Homo sapiens
aattactttggggctaatttaa

SEQ ID NO: 4691800 - DNA, 15 bp, Homo sapiens
aattagattatttct

SEQ ID NO: 4691801 - DNA, 17 bp, Homo sapiens
aattagattatttctgt

SEQ ID NO: 4691802 - DNA, 19 bp, Homo sapiens
aattagattatttctgtat

SEQ ID NO: 4691803 - DNA, 13 bp, Homo sapiens
aattataaatgac

SEQ ID NO: 4691804 - DNA, 17 bp, Homo sapiens
aattataattttagttt

SEQ ID NO: 4691805 - DNA, 19 bp, Homo sapiens
aattatatttctacagaga

SEQ ID NO: 4691806 - DNA, 21 bp, Homo sapiens
aattatcagttatattttgct

SEQ ID NO: 4691807 - DNA, 15 bp, Homo sapiens
aattatctcctaatt

SEQ ID NO: 4691808 - DNA, 17 bp, Homo sapiens
aattatctcctaattgt

SEQ ID NO: 4691809 - DNA, 17 bp, Homo sapiens
aattattgatgttttca

SEQ ID NO: 4691810 - DNA, 14 bp, Homo sapiens
aattatttaaatgt

SEQ ID NO: 4691811 - DNA, 20 bp, Homo sapiens
aattatttgattatttaaga

SEQ ID NO: 4691812 - DNA, 23 bp, Homo sapiens
aattattttctccaaataaaaat

SEQ ID NO: 4691813 - DNA, 17 bp, Homo sapiens
aattcaatttggattta

SEQ ID NO: 4691814 - DNA, 22 bp, Homo sapiens
aattcacatctaacctcatctt

SEQ ID NO: 4691815 - DNA, 14 bp, Homo sapiens
aattcatctttttt

SEQ ID NO: 4691816 - DNA, 19 bp, Homo sapiens
aattcatctttttttttct

SEQ ID NO: 4691817 - DNA, 22 bp, Homo sapiens
aattcgttgttcccactgaaat

SEQ ID NO: 4691818 - DNA, 13 bp, Homo sapiens
aattctattgaaa

SEQ ID NO: 4691819 - DNA, 14 bp, Homo sapiens
aattctcctgcctc

SEQ ID NO: 4691820 - DNA, 15 bp, Homo sapiens
aattctcctgcctca

SEQ ID NO: 4691821 - DNA, 16 bp, Homo sapiens
aattctcctgcctcag

SEQ ID NO: 4691822 - DNA, 19 bp, Homo sapiens
aattctgatgttactgaga

SEQ ID NO: 4691823 - DNA, 21 bp, Homo sapiens
aattcttatttttaatttttc

SEQ ID NO: 4691824 - DNA, 11 bp, Homo sapiens
aattcttccct

SEQ ID NO: 4691825 - DNA, 20 bp, Homo sapiens
aattctttctattttcacaa

SEQ ID NO: 4691826 - DNA, 22 bp, Homo sapiens
aattctttctattttcacaatt

SEQ ID NO: 4691827 - DNA, 16 bp, Homo sapiens
aattgaaagaacttaa

SEQ ID NO: 4691828 - DNA, 14 bp, Homo sapiens
aattgacttattta

SEQ ID NO: 4691829 - DNA, 15 bp, Homo sapiens
aattgatttgttatg

SEQ ID NO: 4691830 - DNA, 14 bp, Homo sapiens
aattgattttgaac

SEQ ID NO: 4691831 - DNA, 15 bp, Homo sapiens
aattgcaaaatgcgt

SEQ ID NO: 4691832 - DNA, 14 bp, Homo sapiens
aattggaatcttca

SEQ ID NO: 4691833 - DNA, 22 bp, Homo sapiens
aattggatattgatgaaatcat

SEQ ID NO: 4691834 - DNA, 15 bp, Homo sapiens
aattggccatcttaa

SEQ ID NO: 4691835 - DNA, 16 bp, Homo sapiens
aattgtaactgttctt

SEQ ID NO: 4691836 - DNA, 11 bp, Homo sapiens
aattgtaatag

SEQ ID NO: 4691837 - DNA, 22 bp, Homo sapiens
aattgtatgttagaataatttt

SEQ ID NO: 4691838 - DNA, 22 bp, Homo sapiens
aattgtgtacactttcattact

SEQ ID NO: 4691839 - DNA, 20 bp, Homo sapiens
aattgttgtttctttctagt

SEQ ID NO: 4691840 - DNA, 13 bp, Homo sapiens
aatttaaattgtt

SEQ ID NO: 4691841 - DNA, 13 bp, Homo sapiens
aatttaaccataa

SEQ ID NO: 4691842 - DNA, 23 bp, Homo sapiens
aatttaagtgcgtgtgtagagtt

SEQ ID NO: 4691843 - DNA, 16 bp, Homo sapiens
aatttacaaaaatata

SEQ ID NO: 4691844 - DNA, 17 bp, Homo sapiens
aatttactttttaaaca

SEQ ID NO: 4691845 - DNA, 21 bp, Homo sapiens
aatttattttgtcgaattttt

SEQ ID NO: 4691846 - DNA, 14 bp, Homo sapiens
aagccacagctggt

SEQ ID NO: 4691847 - DNA, 14 bp, Homo sapiens
aagccacaggcctg

SEQ ID NO: 4691848 - DNA, 15 bp, Homo sapiens
aagccacaggcctga

SEQ ID NO: 4691849 - DNA, 19 bp, Homo sapiens
aagccacaggcctgagatt

SEQ ID NO: 4691850 - DNA, 19 bp, Homo sapiens
aagccaccaacatactccc

SEQ ID NO: 4691851 - DNA, 23 bp, Homo sapiens
aagccagcaccggaccagcctgg

SEQ ID NO: 4691852 - DNA, 20 bp, Homo sapiens
aagccagcgtcctcctctgt

SEQ ID NO: 4691853 - DNA, 14 bp, Homo sapiens
aagccatggagtga

SEQ ID NO: 4691854 - DNA, 20 bp, Homo sapiens
aagccgctggggccagttgg

SEQ ID NO: 4691855 - DNA, 12 bp, Homo sapiens
aagcctctggaa

SEQ ID NO: 4691856 - DNA, 21 bp, Homo sapiens
aagcctctgtgtcactggctg

SEQ ID NO: 4691857 - DNA, 19 bp, Homo sapiens
aagccttataaaccaatct

SEQ ID NO: 4691858 - DNA, 15 bp, Homo sapiens
aagccttctgacctg

SEQ ID NO: 4691859 - DNA, 22 bp, Homo sapiens
aagcgcttctttctgactctaa

SEQ ID NO: 4691860 - DNA, 16 bp, Homo sapiens
aagcgtgagccactgc

SEQ ID NO: 4691861 - DNA, 20 bp, Homo sapiens
aagcgtgagccactgcaccg

SEQ ID NO: 4691862 - DNA, 21 bp, Homo sapiens
aagcgtgagccactgcaccgg

SEQ ID NO: 4691863 - DNA, 23 bp, Homo sapiens
aagctaaaacctgagctagaagc

SEQ ID NO: 4691864 - DNA, 16 bp, Homo sapiens
aagctagaacctggag

SEQ ID NO: 4691865 - DNA, 20 bp, Homo sapiens
aagctagctcccctcctctc

SEQ ID NO: 4691866 - DNA, 16 bp, Homo sapiens
aagctaggcctggcca

SEQ ID NO: 4691867 - DNA, 17 bp, Homo sapiens
aagctaggcctggccag

SEQ ID NO: 4691868 - DNA, 16 bp, Homo sapiens
aagctattagccagga

SEQ ID NO: 4691869 - DNA, 19 bp, Homo sapiens
aagctcaagtgttcacaac

SEQ ID NO: 4691870 - DNA, 13 bp, Homo sapiens
aagctcagggcct

SEQ ID NO: 4691871 - DNA, 18 bp, Homo sapiens
aagctcagggcctggctc

SEQ ID NO: 4691872 - DNA, 18 bp, Homo sapiens
aagctccaagctcccagg

SEQ ID NO: 4691873 - DNA, 19 bp, Homo sapiens
aagctcccaagggatggtg

SEQ ID NO: 4691874 - DNA, 11 bp, Homo sapiens
aagctcccagg

SEQ ID NO: 4691875 - DNA, 15 bp, Homo sapiens
aagctctgagctgtc

SEQ ID NO: 4691876 - DNA, 16 bp, Homo sapiens
aagctctgagctgtca

SEQ ID NO: 4691877 - DNA, 17 bp, Homo sapiens
aagctctgctcctctcc

SEQ ID NO: 4691878 - DNA, 18 bp, Homo sapiens
aagctgattttttttaat

SEQ ID NO: 4691879 - DNA, 16 bp, Homo sapiens
aagctgtgtctctgta

SEQ ID NO: 4691880 - DNA, 20 bp, Homo sapiens
aagctgttgtacatttatga

SEQ ID NO: 4691881 - DNA, 21 bp, Homo sapiens
aagctttcagtattagtgatg

SEQ ID NO: 4691882 - DNA, 22 bp, Homo sapiens
aagctttcatgtaaactgtgca

SEQ ID NO: 4691883 - DNA, 23 bp, Homo sapiens
aagctttcatgtaaactgtgcac

SEQ ID NO: 4691884 - DNA, 19 bp, Homo sapiens
aaggaaaaaataacaatga

SEQ ID NO: 4691885 - DNA, 18 bp, Homo sapiens
aaggaaaccacagctgct

SEQ ID NO: 4691886 - DNA, 16 bp, Homo sapiens
aaggaaacccagctct

SEQ ID NO: 4691887 - DNA, 16 bp, Homo sapiens
aaggaaactcttatct

SEQ ID NO: 4691888 - DNA, 13 bp, Homo sapiens
aaggaaattttac

SEQ ID NO: 4691889 - DNA, 22 bp, Homo sapiens
aaggaagccacagctggtggta

SEQ ID NO: 4691890 - DNA, 21 bp, Homo sapiens
aaggaagtcaaagcaaggaaa

SEQ ID NO: 4691891 - DNA, 20 bp, Homo sapiens
aaggaatccactcccaggca

SEQ ID NO: 4691892 - DNA, 22 bp, Homo sapiens
aaggaatccactcccaggcagc

SEQ ID NO: 4691893 - DNA, 23 bp, Homo sapiens
aaggaatccactcccaggcagcc

SEQ ID NO: 4691894 - DNA, 12 bp, Homo sapiens
aaggacaaacag

SEQ ID NO: 4691895 - DNA, 21 bp, Homo sapiens
aaggacaaacagtgaatttaa

SEQ ID NO: 4691896 - DNA, 18 bp, Homo sapiens
aaggacacagatgaaaca

SEQ ID NO: 4691897 - DNA, 22 bp, Homo sapiens
aaggacacagatgaaacacaaa

SEQ ID NO: 4691898 - DNA, 18 bp, Homo sapiens
aaggacattgcggacagc

SEQ ID NO: 4691899 - DNA, 21 bp, Homo sapiens
aaggactgtgacaggcagcag

SEQ ID NO: 4691900 - DNA, 13 bp, Homo sapiens
aaggagaggaggc

SEQ ID NO: 4691901 - DNA, 17 bp, Homo sapiens
aaggagccccattcctg

SEQ ID NO: 4691902 - DNA, 12 bp, Homo sapiens
aaggagctgcct

SEQ ID NO: 4691903 - DNA, 16 bp, Homo sapiens
aaggagctgcctggac

SEQ ID NO: 4691904 - DNA, 20 bp, Homo sapiens
aaggaggtaaaggatgaggg

SEQ ID NO: 4691905 - DNA, 15 bp, Homo sapiens
aaggatcagaagtat

SEQ ID NO: 4691906 - DNA, 11 bp, Homo sapiens
aaggatgaggg

SEQ ID NO: 4691907 - DNA, 15 bp, Homo sapiens
aaggatgagggttca

SEQ ID NO: 4691908 - DNA, 17 bp, Homo sapiens
aaggattctaaacagat

SEQ ID NO: 4691909 - DNA, 21 bp, Homo sapiens
aaggattgtaaaaaaaaatgc

SEQ ID NO: 4691910 - DNA, 15 bp, Homo sapiens
aaggcaaacccatca

SEQ ID NO: 4691911 - DNA, 18 bp, Homo sapiens
aaggcaagcacttgtggg

SEQ ID NO: 4691912 - DNA, 20 bp, Homo sapiens
aaggcagggagcgagggaga

SEQ ID NO: 4691913 - DNA, 19 bp, Homo sapiens
aaggcagggagggcctggg

SEQ ID NO: 4691914 - DNA, 20 bp, Homo sapiens
aaggcaggggaatgtatgtg

SEQ ID NO: 4691915 - DNA, 18 bp, Homo sapiens
aaggccatggagagctgg

SEQ ID NO: 4691916 - DNA, 21 bp, Homo sapiens
aaggccatggagagctggagc

SEQ ID NO: 4691917 - DNA, 22 bp, Homo sapiens
aaggccatggagagctggagcc

SEQ ID NO: 4691918 - DNA, 19 bp, Homo sapiens
aaggccccgcccaggctta

SEQ ID NO: 4691919 - DNA, 16 bp, Homo sapiens
aaggcctcccacagtg

SEQ ID NO: 4691920 - DNA, 17 bp, Homo sapiens
aaggcctcccacagtga

SEQ ID NO: 4691921 - DNA, 18 bp, Homo sapiens
aaggcgtggagctgcctg

SEQ ID NO: 4691922 - DNA, 19 bp, Homo sapiens
aaggctccaggagcagcca

SEQ ID NO: 4691923 - DNA, 18 bp, Homo sapiens
aaggctcgagcatgcctg

SEQ ID NO: 4691924 - DNA, 22 bp, Homo sapiens
aaggctcgagcatgcctggatg

SEQ ID NO: 4691925 - DNA, 22 bp, Homo sapiens
acaggtgtgagtcaccaagccc

SEQ ID NO: 4691926 - DNA, 17 bp, Homo sapiens
acaggtgttggtgacaa

SEQ ID NO: 4691927 - DNA, 15 bp, Homo sapiens
acaggttataacagt

SEQ ID NO: 4691928 - DNA, 22 bp, Homo sapiens
acagtaatcagagttaccatta

SEQ ID NO: 4691929 - DNA, 22 bp, Homo sapiens
acagtacccttggcctttacag

SEQ ID NO: 4691930 - DNA, 13 bp, Homo sapiens
acagtaggagccc

SEQ ID NO: 4691931 - DNA, 16 bp, Homo sapiens
acagtattacttctgc

SEQ ID NO: 4691932 - DNA, 13 bp, Homo sapiens
acagtcatcttta

SEQ ID NO: 4691933 - DNA, 21 bp, Homo sapiens
acagtcattatttaaagcaca

SEQ ID NO: 4691934 - DNA, 22 bp, Homo sapiens
acagtcattatttaaagcacat

SEQ ID NO: 4691935 - DNA, 14 bp, Homo sapiens
acagtccagcctgg

SEQ ID NO: 4691936 - DNA, 12 bp, Homo sapiens
acagtccctgcc

SEQ ID NO: 4691937 - DNA, 15 bp, Homo sapiens
acagtccctgccaat

SEQ ID NO: 4691938 - DNA, 13 bp, Homo sapiens
acagtcctcccat

SEQ ID NO: 4691939 - DNA, 18 bp, Homo sapiens
acagtccttaccagcaga

SEQ ID NO: 4691940 - DNA, 23 bp, Homo sapiens
acccctgcattggaactggaggc

SEQ ID NO: 4691941 - DNA, 14 bp, Homo sapiens
acccctggttctca

SEQ ID NO: 4691942 - DNA, 15 bp, Homo sapiens
acccctggttctcat

SEQ ID NO: 4691943 - DNA, 22 bp, Homo sapiens
acccctggttctcatctttctt

SEQ ID NO: 4691944 - DNA, 15 bp, Homo sapiens
accccttcgctcctg

SEQ ID NO: 4691945 - DNA, 20 bp, Homo sapiens
accccttcgctcctgtgtct

SEQ ID NO: 4691946 - DNA, 17 bp, Homo sapiens
accccttttcagcttct

SEQ ID NO: 4691947 - DNA, 16 bp, Homo sapiens
acccgccttttataaa

SEQ ID NO: 4691948 - DNA, 14 bp, Homo sapiens
acccggcccctgct

SEQ ID NO: 4691949 - DNA, 16 bp, Homo sapiens
acccggcccctgctgg

SEQ ID NO: 4691950 - DNA, 20 bp, Homo sapiens
actccagctgggttggaaaa

SEQ ID NO: 4691951 - DNA, 19 bp, Homo sapiens
actccaggatttataaagc

SEQ ID NO: 4691952 - DNA, 20 bp, Homo sapiens
actccaggatttataaagca

SEQ ID NO: 4691953 - DNA, 17 bp, Homo sapiens
actccatcattcatcca

SEQ ID NO: 4691954 - DNA, 15 bp, Homo sapiens
actcccaagctggac

SEQ ID NO: 4691955 - DNA, 16 bp, Homo sapiens
actcccacttccctga

SEQ ID NO: 4691956 - DNA, 17 bp, Homo sapiens
actcccacttccctgac

SEQ ID NO: 4691957 - DNA, 20 bp, Homo sapiens
actcccacttccctgacact

SEQ ID NO: 4691958 - DNA, 11 bp, Homo sapiens
actcccctcca

SEQ ID NO: 4691959 - DNA, 13 bp, Homo sapiens
actcccctgctgg

SEQ ID NO: 4691960 - DNA, 21 bp, Homo sapiens
actcccttcccatgacccagg

SEQ ID NO: 4691961 - DNA, 16 bp, Homo sapiens
actccctttaaagaga

SEQ ID NO: 4691962 - DNA, 17 bp, Homo sapiens
actcctacacctaactc

SEQ ID NO: 4691963 - DNA, 16 bp, Homo sapiens
actcctaggcaggaca

SEQ ID NO: 4691964 - DNA, 16 bp, Homo sapiens
actcctcagggttgag

SEQ ID NO: 4691965 - DNA, 20 bp, Homo sapiens
actcctctgactcagggctc

SEQ ID NO: 4691966 - DNA, 14 bp, Homo sapiens
actcctgcaggcag

SEQ ID NO: 4691967 - DNA, 16 bp, Homo sapiens
actcctgcaggcagcc

SEQ ID NO: 4691968 - DNA, 18 bp, Homo sapiens
actcctgcaggcagccag

SEQ ID NO: 4691969 - DNA, 22 bp, Homo sapiens
actcctgcaggcagccaggcca

SEQ ID NO: 4691970 - DNA, 14 bp, Homo sapiens
actcctggcctcaa

SEQ ID NO: 4691971 - DNA, 19 bp, Homo sapiens
actccttctgccagttccc

SEQ ID NO: 4691972 - DNA, 24 bp, Homo sapiens
actccttgaaaacactgttctctg

SEQ ID NO: 4691973 - DNA, 18 bp, Homo sapiens
actccttgagagaccagg

SEQ ID NO: 4691974 - DNA, 19 bp, Homo sapiens
actctaattggtcattcct

SEQ ID NO: 4691975 - DNA, 16 bp, Homo sapiens
actctacctgcacact

SEQ ID NO: 4691976 - DNA, 22 bp, Homo sapiens
actctcaggaccaaagctttca

SEQ ID NO: 4691977 - DNA, 13 bp, Homo sapiens
actctcagtctct

SEQ ID NO: 4691978 - DNA, 17 bp, Homo sapiens
actctcagtctctgagc

SEQ ID NO: 4691979 - DNA, 10 bp, Homo sapiens
actctccccc

SEQ ID NO: 4691980 - DNA, 20 bp, Homo sapiens
actctcccccaccccctccc

SEQ ID NO: 4691981 - DNA, 16 bp, Homo sapiens
actctcctctgcctca

SEQ ID NO: 4691982 - DNA, 16 bp, Homo sapiens
actctcctctgctgct

SEQ ID NO: 4691983 - DNA, 19 bp, Homo sapiens
actctcctctgctgctggc

SEQ ID NO: 4691984 - DNA, 16 bp, Homo sapiens
actctgcaactgaata

SEQ ID NO: 4691985 - DNA, 14 bp, Homo sapiens
actctgcagcctca

SEQ ID NO: 4691986 - DNA, 15 bp, Homo sapiens
actctgcagcctcag

SEQ ID NO: 4691987 - DNA, 16 bp, Homo sapiens
actctgcagcctcaga

SEQ ID NO: 4691988 - DNA, 17 bp, Homo sapiens
actctgctgaatgtaaa

SEQ ID NO: 4691989 - DNA, 22 bp, Homo sapiens
actctggatgattcttccagat

SEQ ID NO: 4691990 - DNA, 14 bp, Homo sapiens
actctggattttga

SEQ ID NO: 4691991 - DNA, 16 bp, Homo sapiens
actctggcagctcaga

SEQ ID NO: 4691992 - DNA, 19 bp, Homo sapiens
actctgtctcaaaaaaaca

SEQ ID NO: 4691993 - DNA, 24 bp, Homo sapiens
actctgtgcccatgggcactgctg

SEQ ID NO: 4691994 - DNA, 23 bp, Homo sapiens
actctgtgtaatagaataaaggc

SEQ ID NO: 4691995 - DNA, 19 bp, Homo sapiens
actctgtgtcaggtggggc

SEQ ID NO: 4691996 - DNA, 21 bp, Homo sapiens
actctgtgtcaggtggggcag

SEQ ID NO: 4691997 - DNA, 18 bp, Homo sapiens
actctgtgtgtgtatgag

SEQ ID NO: 4691998 - DNA, 22 bp, Homo sapiens
actcttatctcagtcatgcata

SEQ ID NO: 4691999 - DNA, 16 bp, Homo sapiens
actcttattgcccacg

SEQ ID NO: 4692000 - DNA, 19 bp, Homo sapiens
actcttattgcccacgctg

SEQ ID NO: 4692001 - DNA, 21 bp, Homo sapiens
actcttattgcccacgctgga

SEQ ID NO: 4692002 - DNA, 14 bp, Homo sapiens
actcttgacctcag

SEQ ID NO: 4692003 - DNA, 13 bp, Homo sapiens
actctttttgtac

SEQ ID NO: 4692004 - DNA, 20 bp, Homo sapiens
actgaaatgagcatgcattt

SEQ ID NO: 4692005 - DNA, 20 bp, Homo sapiens
actgaaattattttctccaa

SEQ ID NO: 4692006 - DNA, 21 bp, Homo sapiens
actgaccaatattgtacagtt

SEQ ID NO: 4692007 - DNA, 18 bp, Homo sapiens
actgagacagcccgggct

SEQ ID NO: 4692008 - DNA, 21 bp, Homo sapiens
actgagacagcccgggctctg

SEQ ID NO: 4692009 - DNA, 23 bp, Homo sapiens
actgagacagcccgggctctgcc

SEQ ID NO: 4692010 - DNA, 16 bp, Homo sapiens
actgagccatcatttc

SEQ ID NO: 4692011 - DNA, 15 bp, Homo sapiens
actgaggatattcag

SEQ ID NO: 4692012 - DNA, 13 bp, Homo sapiens
actgaggcctgag

SEQ ID NO: 4692013 - DNA, 14 bp, Homo sapiens
actgaggcctgagc

SEQ ID NO: 4692014 - DNA, 15 bp, Homo sapiens
actgatcacaaaaac

SEQ ID NO: 4692015 - DNA, 18 bp, Homo sapiens
actgattttgtaaagttg

SEQ ID NO: 4692016 - DNA, 13 bp, Homo sapiens
actgatttttaag

SEQ ID NO: 4692017 - DNA, 15 bp, Homo sapiens
actgatttttaagtc

SEQ ID NO: 4692018 - DNA, 14 bp, Homo sapiens
actgcaacctccgc

SEQ ID NO: 4692019 - DNA, 22 bp, Homo sapiens
actgcaacctccgcctcttggg

SEQ ID NO: 4692020 - DNA, 20 bp, Homo sapiens
actgcaacttgtaaatgtgg

SEQ ID NO: 4692021 - DNA, 19 bp, Homo sapiens
actgcacaataaaaccaag

SEQ ID NO: 4692022 - DNA, 22 bp, Homo sapiens
actgcacaataaaaccaagcct

SEQ ID NO: 4692023 - DNA, 16 bp, Homo sapiens
actgcaccccctcctg

SEQ ID NO: 4692024 - DNA, 14 bp, Homo sapiens
actgcaccgggcca

SEQ ID NO: 4692025 - DNA, 20 bp, Homo sapiens
actgcactatagcctaggtg

SEQ ID NO: 4692026 - DNA, 23 bp, Homo sapiens
actgcagcctcaacctcctgggc

SEQ ID NO: 4692027 - DNA, 23 bp, Homo sapiens
actgcagggaaaattatttgcat

SEQ ID NO: 4692028 - DNA, 17 bp, Homo sapiens
actgcatcctccgcctc

SEQ ID NO: 4692029 - DNA, 22 bp, Homo sapiens
actgcattttgtagcctctctt

SEQ ID NO: 4692030 - DNA, 21 bp, Homo sapiens
actgcccaaggataggtattt

SEQ ID NO: 4692031 - DNA, 15 bp, Homo sapiens
actgccccctctgcc

SEQ ID NO: 4692032 - DNA, 18 bp, Homo sapiens
actgccccctctgccctg

SEQ ID NO: 4692033 - DNA, 19 bp, Homo sapiens
actgccccctctgccctgc

SEQ ID NO: 4692034 - DNA, 20 bp, Homo sapiens
actgccccctctgccctgcg

SEQ ID NO: 4692035 - DNA, 11 bp, Homo sapiens
actgccctggt

SEQ ID NO: 4692036 - DNA, 20 bp, Homo sapiens
actgcctgatggacctgtca

SEQ ID NO: 4692037 - DNA, 18 bp, Homo sapiens
actgccttgattagtgta

SEQ ID NO: 4692038 - DNA, 19 bp, Homo sapiens
actgcctttcagaagtgat

SEQ ID NO: 4692039 - DNA, 18 bp, Homo sapiens
actgcggggcttggctga

SEQ ID NO: 4692040 - DNA, 16 bp, Homo sapiens
actgctgggtggccca

SEQ ID NO: 4692041 - DNA, 15 bp, Homo sapiens
actgcttttggtctg

SEQ ID NO: 4692042 - DNA, 16 bp, Homo sapiens
actgcttttggtctgt

SEQ ID NO: 4692043 - DNA, 19 bp, Homo sapiens
actggaagcacagcttcat

SEQ ID NO: 4692044 - DNA, 12 bp, Homo sapiens
actggactcagg

SEQ ID NO: 4692045 - DNA, 16 bp, Homo sapiens
actggactcaggaact

SEQ ID NO: 4692046 - DNA, 17 bp, Homo sapiens
actggactcaggaactt

SEQ ID NO: 4692047 - DNA, 23 bp, Homo sapiens
actggagagtggcaaaagtctga

SEQ ID NO: 4692048 - DNA, 12 bp, Homo sapiens
actggctgcctc

SEQ ID NO: 4692049 - DNA, 16 bp, Homo sapiens
actggctgcctccact

SEQ ID NO: 4692050 - DNA, 13 bp, Homo sapiens
actgggccctgcc

SEQ ID NO: 4692051 - DNA, 13 bp, Homo sapiens
actgggctgaggg

SEQ ID NO: 4692052 - DNA, 17 bp, Homo sapiens
actgggctgagggagcc

SEQ ID NO: 4692053 - DNA, 15 bp, Homo sapiens
actgggtacttgtgg

SEQ ID NO: 4692054 - DNA, 20 bp, Homo sapiens
acattttcttttgttcttga

SEQ ID NO: 4692055 - DNA, 18 bp, Homo sapiens
acattttgacacaatgtt

SEQ ID NO: 4692056 - DNA, 21 bp, Homo sapiens
acatttttcagatataaaaga

SEQ ID NO: 4692057 - DNA, 21 bp, Homo sapiens
accaaattttgaggtctttta

SEQ ID NO: 4692058 - DNA, 16 bp, Homo sapiens
accaacatactcccat

SEQ ID NO: 4692059 - DNA, 22 bp, Homo sapiens
accaacatactcccatctgtga

SEQ ID NO: 4692060 - DNA, 13 bp, Homo sapiens
accaacccagccg

SEQ ID NO: 4692061 - DNA, 15 bp, Homo sapiens
accaacccagccgct

SEQ ID NO: 4692062 - DNA, 23 bp, Homo sapiens
accaagctgtgccaccctgggct

SEQ ID NO: 4692063 - DNA, 12 bp, Homo sapiens
accaagggcaga

SEQ ID NO: 4692064 - DNA, 14 bp, Homo sapiens
accaagggcagagg

SEQ ID NO: 4692065 - DNA, 23 bp, Homo sapiens
accaagttggaacatccttggaa

SEQ ID NO: 4692066 - DNA, 21 bp, Homo sapiens
aggttgggccatactggcctc

SEQ ID NO: 4692067 - DNA, 16 bp, Homo sapiens
aggttgttcctaaaat

SEQ ID NO: 4692068 - DNA, 14 bp, Homo sapiens
aggtttataaagca

SEQ ID NO: 4692069 - DNA, 14 bp, Homo sapiens
aggtttctgaaaat

SEQ ID NO: 4692070 - DNA, 14 bp, Homo sapiens
agtaaatatgtgaa

SEQ ID NO: 4692071 - DNA, 16 bp, Homo sapiens
agtaaatatgtgaaga

SEQ ID NO: 4692072 - DNA, 22 bp, Homo sapiens
agtaaatggcttatccagctgg

SEQ ID NO: 4692073 - DNA, 17 bp, Homo sapiens
agtaaattttgtgatga

SEQ ID NO: 4692074 - DNA, 18 bp, Homo sapiens
agtaagcagagttctttg

SEQ ID NO: 4692075 - DNA, 20 bp, Homo sapiens
agtaagtagcaaccctgtga

SEQ ID NO: 4692076 - DNA, 17 bp, Homo sapiens
agtaagtataacaaact

SEQ ID NO: 4692077 - DNA, 14 bp, Homo sapiens
agtaattattttct

SEQ ID NO: 4692078 - DNA, 21 bp, Homo sapiens
agtacccaaaagctcagccag

SEQ ID NO: 4692079 - DNA, 19 bp, Homo sapiens
agtacccttggcctttaca

SEQ ID NO: 4692080 - DNA, 14 bp, Homo sapiens
agtacgttaaaagc

SEQ ID NO: 4692081 - DNA, 16 bp, Homo sapiens
agtacgttaaaagcaa

SEQ ID NO: 4692082 - DNA, 17 bp, Homo sapiens
agtactcaaattcaatg

SEQ ID NO: 4692083 - DNA, 21 bp, Homo sapiens
agtacttctccaccctgctct

SEQ ID NO: 4692084 - DNA, 11 bp, Homo sapiens
agtactttgtg

SEQ ID NO: 4692085 - DNA, 13 bp, Homo sapiens
agtactttgtgct

SEQ ID NO: 4692086 - DNA, 14 bp, Homo sapiens
agtagaactggatc

SEQ ID NO: 4692087 - DNA, 11 bp, Homo sapiens
agtagagacag

SEQ ID NO: 4692088 - DNA, 18 bp, Homo sapiens
agtagatgtggcctttga

SEQ ID NO: 4692089 - DNA, 22 bp, Homo sapiens
agtagattcaagttgtgtctga

SEQ ID NO: 4692090 - DNA, 18 bp, Homo sapiens
agtagcaaccctgtgata

SEQ ID NO: 4692091 - DNA, 21 bp, Homo sapiens
agtagctgggactacaggcac

SEQ ID NO: 4692092 - DNA, 18 bp, Homo sapiens
agtaggaagactttggaa

SEQ ID NO: 4692093 - DNA, 19 bp, Homo sapiens
agtaggaagactttggaaa

SEQ ID NO: 4692094 - DNA, 17 bp, Homo sapiens
agtaggcttttaccatt

SEQ ID NO: 4692095 - DNA, 21 bp, Homo sapiens
agtaggggttgaagaaaacaa

SEQ ID NO: 4692096 - DNA, 19 bp, Homo sapiens
agtataagactactgaatc

SEQ ID NO: 4692097 - DNA, 17 bp, Homo sapiens
agtatcaaagaaaaaca

SEQ ID NO: 4692098 - DNA, 14 bp, Homo sapiens
agtatcctgctggt

SEQ ID NO: 4692099 - DNA, 14 bp, Homo sapiens
agtatggaattttc

SEQ ID NO: 4692100 - DNA, 19 bp, Homo sapiens
agtatggagctcagagagg

SEQ ID NO: 4692101 - DNA, 22 bp, Homo sapiens
agtatggtgagagaagcctgtg

SEQ ID NO: 4692102 - DNA, 18 bp, Homo sapiens
agtatgtatattaaaaaa

SEQ ID NO: 4692103 - DNA, 15 bp, Homo sapiens
agtattacttctgct

SEQ ID NO: 4692104 - DNA, 22 bp, Homo sapiens
agtattgaaaaattatcagtta

SEQ ID NO: 4692105 - DNA, 16 bp, Homo sapiens
agtatttaattgtttc

SEQ ID NO: 4692106 - DNA, 16 bp, Homo sapiens
agtatttcaaattgga

SEQ ID NO: 4692107 - DNA, 16 bp, Homo sapiens
agtattttaatcctgt

SEQ ID NO: 4692108 - DNA, 17 bp, Homo sapiens
agtattttaatcctgta

SEQ ID NO: 4692109 - DNA, 18 bp, Homo sapiens
agtcaaatttacatttat

SEQ ID NO: 4692110 - DNA, 21 bp, Homo sapiens
agtcaaatttacatttatcta

SEQ ID NO: 4692111 - DNA, 15 bp, Homo sapiens
agtcaacctgcctga

SEQ ID NO: 4692112 - DNA, 20 bp, Homo sapiens
agtcaatttgctgaaaacat

SEQ ID NO: 4692113 - DNA, 15 bp, Homo sapiens
agtcaccaagcccag

SEQ ID NO: 4692114 - DNA, 13 bp, Homo sapiens
agtcaccccagga

SEQ ID NO: 4692115 - DNA, 19 bp, Homo sapiens
agtcaccccggccacctgc

SEQ ID NO: 4692116 - DNA, 16 bp, Homo sapiens
agtcagacagatgtgg

SEQ ID NO: 4692117 - DNA, 13 bp, Homo sapiens
agtcagctgaccc

SEQ ID NO: 4692118 - DNA, 17 bp, Homo sapiens
agtcagctgaccccctc

SEQ ID NO: 4692119 - DNA, 21 bp, Homo sapiens
agtcagctgaccccctccccc

SEQ ID NO: 4692120 - DNA, 17 bp, Homo sapiens
agtcagtattcccagcc

SEQ ID NO: 4692121 - DNA, 14 bp, Homo sapiens
agtcataaatgcat

SEQ ID NO: 4692122 - DNA, 23 bp, Homo sapiens
agtcataccaatgaaaaaatgta

SEQ ID NO: 4692123 - DNA, 17 bp, Homo sapiens
agtcatgcaaaggctgg

SEQ ID NO: 4692124 - DNA, 20 bp, Homo sapiens
agtcatgcataaatatgcag

SEQ ID NO: 4692125 - DNA, 19 bp, Homo sapiens
agtcatgcgtttaatcaca

SEQ ID NO: 4692126 - DNA, 14 bp, Homo sapiens
agtcattaaagaca

SEQ ID NO: 4692127 - DNA, 23 bp, Homo sapiens
agtcattaaagacaggagacaaa

SEQ ID NO: 4692128 - DNA, 16 bp, Homo sapiens
agtccacagtggaacc

SEQ ID NO: 4692129 - DNA, 13 bp, Homo sapiens
agtccagcctgga

SEQ ID NO: 4692130 - DNA, 17 bp, Homo sapiens
agtccaggtaaatggta

SEQ ID NO: 4692131 - DNA, 23 bp, Homo sapiens
agtccatatttcaatttccaaga

SEQ ID NO: 4692132 - DNA, 22 bp, Homo sapiens
agtccattaactgctttccacc

SEQ ID NO: 4692133 - DNA, 19 bp, Homo sapiens
agtcccaccttggctgcag

SEQ ID NO: 4692134 - DNA, 23 bp, Homo sapiens
agtcccaccttggctgcagggag

SEQ ID NO: 4692135 - DNA, 17 bp, Homo sapiens
agtcccaggctgagcct

SEQ ID NO: 4692136 - DNA, 18 bp, Homo sapiens
agtcccaggctgagcctc

SEQ ID NO: 4692137 - DNA, 14 bp, Homo sapiens
agtcccctgtttgt

SEQ ID NO: 4692138 - DNA, 23 bp, Homo sapiens
agtcccctgtttgtttctgaaag

SEQ ID NO: 4692139 - DNA, 15 bp, Homo sapiens
agtcccttaaaaatt

SEQ ID NO: 4692140 - DNA, 14 bp, Homo sapiens
agtcctcccatctc

SEQ ID NO: 4692141 - DNA, 14 bp, Homo sapiens
agtcctctccacct

SEQ ID NO: 4692142 - DNA, 19 bp, Homo sapiens
agtcctctccacctagtgg

SEQ ID NO: 4692143 - DNA, 14 bp, Homo sapiens
agtcctcttttctg

SEQ ID NO: 4692144 - DNA, 22 bp, Homo sapiens
agtcctcttttctgagaggact

SEQ ID NO: 4692145 - DNA, 20 bp, Homo sapiens
agtcctgatcagagccgtgg

SEQ ID NO: 4692146 - DNA, 19 bp, Homo sapiens
agtcgatagagctgtatta

SEQ ID NO: 4692147 - DNA, 17 bp, Homo sapiens
agtcgcgctgcctgtgt

SEQ ID NO: 4692148 - DNA, 14 bp, Homo sapiens
agtcgttgtgaggg

SEQ ID NO: 4692149 - DNA, 19 bp, Homo sapiens
agtctagcacagttccttg

SEQ ID NO: 4692150 - DNA, 20 bp, Homo sapiens
agtctcactgttgcccaggc

SEQ ID NO: 4692151 - DNA, 22 bp, Homo sapiens
agtctcagatatcatactgatt

SEQ ID NO: 4692152 - DNA, 18 bp, Homo sapiens
agtctcatctatgtcata

SEQ ID NO: 4692153 - DNA, 15 bp, Homo sapiens
agtctcgaatgtaat

SEQ ID NO: 4692154 - DNA, 23 bp, Homo sapiens
agtctcgaatgtaattggaatct

SEQ ID NO: 4692155 - DNA, 22 bp, Homo sapiens
agtctctgggtttacaacaaac

SEQ ID NO: 4692156 - DNA, 13 bp, Homo sapiens
agtctgaagcact

SEQ ID NO: 4692157 - DNA, 13 bp, Homo sapiens
agtctgaaggctg

SEQ ID NO: 4692158 - DNA, 15 bp, Homo sapiens
agtctgaaggctggg

SEQ ID NO: 4692159 - DNA, 19 bp, Homo sapiens
agtctgatgatttcttgaa

SEQ ID NO: 4692160 - DNA, 16 bp, Homo sapiens
agtctgattcccaagc

SEQ ID NO: 4692161 - DNA, 17 bp, Homo sapiens
agtctggaatgcagtgg

SEQ ID NO: 4692162 - DNA, 18 bp, Homo sapiens
agtctggaatgcagtggt

SEQ ID NO: 4692163 - DNA, 11 bp, Homo sapiens
agtctgtcctg

SEQ ID NO: 4692164 - DNA, 20 bp, Homo sapiens
agtctgtgccacgtgtttgt

SEQ ID NO: 4692165 - DNA, 19 bp, Homo sapiens
agtcttccatttgcaaggg

SEQ ID NO: 4692166 - DNA, 18 bp, Homo sapiens
agtcttcccttacctcaa

SEQ ID NO: 4692167 - DNA, 14 bp, Homo sapiens
agtcttctatttat

SEQ ID NO: 4692168 - DNA, 18 bp, Homo sapiens
agtctttcacatttaaat

SEQ ID NO: 4692169 - DNA, 19 bp, Homo sapiens
agtctttgatcatcatgta

SEQ ID NO: 4692170 - DNA, 15 bp, Homo sapiens
agtcttttccatgaa

SEQ ID NO: 4692171 - DNA, 14 bp, Homo sapiens
agtgaaaaatgaga

SEQ ID NO: 4692172 - DNA, 18 bp, Homo sapiens
agtgaacagtttggatgt

SEQ ID NO: 4692173 - DNA, 15 bp, Homo sapiens
agtgaaggcttctct

SEQ ID NO: 4692174 - DNA, 14 bp, Homo sapiens
agtgaatttgtcca

SEQ ID NO: 4692175 - DNA, 21 bp, Homo sapiens
agtgaatttgtccattgtaaa

SEQ ID NO: 4692176 - DNA, 21 bp, Homo sapiens
agtgacaccaataaatgtttg

SEQ ID NO: 4692177 - DNA, 18 bp, Homo sapiens
aggtgggatcctccaggt

SEQ ID NO: 4692178 - DNA, 20 bp, Homo sapiens
aggtgggatcctccaggtgc

SEQ ID NO: 4692179 - DNA, 20 bp, Homo sapiens
aggtgggcgggcagcacagc

SEQ ID NO: 4692180 - DNA, 21 bp, Homo sapiens
aggtgggcttcccagtggctg

SEQ ID NO: 4692181 - DNA, 14 bp, Homo sapiens
aggtggggcagctt

SEQ ID NO: 4692182 - DNA, 23 bp, Homo sapiens
aggtgggttttcatcaagactgg

SEQ ID NO: 4692183 - DNA, 20 bp, Homo sapiens
aggtggtctgctcgggccca

SEQ ID NO: 4692184 - DNA, 21 bp, Homo sapiens
aggtggtctgctcgggcccag

SEQ ID NO: 4692185 - DNA, 14 bp, Homo sapiens
aggtgtgaaatcat

SEQ ID NO: 4692186 - DNA, 17 bp, Homo sapiens
aggtgtgaaccaccaca

SEQ ID NO: 4692187 - DNA, 20 bp, Homo sapiens
aggtgtgagccaccacgccc

SEQ ID NO: 4692188 - DNA, 14 bp, Homo sapiens
aggtgtgagtcacc

SEQ ID NO: 4692189 - DNA, 18 bp, Homo sapiens
aggttagaacctagaagg

SEQ ID NO: 4692190 - DNA, 14 bp, Homo sapiens
aggttatcgaaata

SEQ ID NO: 4692191 - DNA, 23 bp, Homo sapiens
aggttccctttgacgccatccca

SEQ ID NO: 4692192 - DNA, 17 bp, Homo sapiens
aggttctctcctcccca

SEQ ID NO: 4692193 - DNA, 15 bp, Homo sapiens
aggttcttcagaagt

SEQ ID NO: 4692194 - DNA, 15 bp, Homo sapiens
aggttggaaaagaaa

SEQ ID NO: 4692195 - DNA, 20 bp, Homo sapiens
aggttgggccatactggcct

SEQ ID NO: 4692196 - DNA, 17 bp, Homo sapiens
agggagaggagtgactg

SEQ ID NO: 4692197 - DNA, 14 bp, Homo sapiens
agggagcctggccc

SEQ ID NO: 4692198 - DNA, 19 bp, Homo sapiens
agggaggaaagtttctttg

SEQ ID NO: 4692199 - DNA, 19 bp, Homo sapiens
agggagggctccagacaca

SEQ ID NO: 4692200 - DNA, 22 bp, Homo sapiens
agggagggctccagacacatgt

SEQ ID NO: 4692201 - DNA, 18 bp, Homo sapiens
agggagtgacagaggcag

SEQ ID NO: 4692202 - DNA, 19 bp, Homo sapiens
agggagtgacagaggcagc

SEQ ID NO: 4692203 - DNA, 20 bp, Homo sapiens
agggagtgagttgatagcac

SEQ ID NO: 4692204 - DNA, 16 bp, Homo sapiens
agggatacatgctctt

SEQ ID NO: 4692205 - DNA, 16 bp, Homo sapiens
agggatccctcatctg

SEQ ID NO: 4692206 - DNA, 22 bp, Homo sapiens
agggatccctcatctgtccctc

SEQ ID NO: 4692207 - DNA, 17 bp, Homo sapiens
agggatgaaagagaagg

SEQ ID NO: 4692208 - DNA, 20 bp, Homo sapiens
agggatgagcatggagctgg

SEQ ID NO: 4692209 - DNA, 21 bp, Homo sapiens
agggatgagcatggagctggc

SEQ ID NO: 4692210 - DNA, 16 bp, Homo sapiens
agggatgatgccacac

SEQ ID NO: 4692211 - DNA, 13 bp, Homo sapiens
agggatggtgccc

SEQ ID NO: 4692212 - DNA, 19 bp, Homo sapiens
agggcacattccttgcctg

SEQ ID NO: 4692213 - DNA, 20 bp, Homo sapiens
agagcttgtaataaatactg

SEQ ID NO: 4692214 - DNA, 16 bp, Homo sapiens
agaggaaggggccaga

SEQ ID NO: 4692215 - DNA, 18 bp, Homo sapiens
agaggaaggggccagagg

SEQ ID NO: 4692216 - DNA, 17 bp, Homo sapiens
agaggaatattatgact

SEQ ID NO: 4692217 - DNA, 15 bp, Homo sapiens
agaggacaaaataaa

SEQ ID NO: 4692218 - DNA, 17 bp, Homo sapiens
agaggacaaaataaagt

SEQ ID NO: 4692219 - DNA, 18 bp, Homo sapiens
agaggacaaaataaagtg

SEQ ID NO: 4692220 - DNA, 14 bp, Homo sapiens
agaggacttttctt

SEQ ID NO: 4692221 - DNA, 23 bp, Homo sapiens
agaggagggcagcagaagggggt

SEQ ID NO: 4692222 - DNA, 18 bp, Homo sapiens
agaggatgagagcccaga

SEQ ID NO: 4692223 - DNA, 19 bp, Homo sapiens
agaggcagagattggagtg

SEQ ID NO: 4692224 - DNA, 23 bp, Homo sapiens
agaggcagccccattctgcctgc

SEQ ID NO: 4692225 - DNA, 19 bp, Homo sapiens
agaggccctcgctgccagc

SEQ ID NO: 4692226 - DNA, 22 bp, Homo sapiens
agaggctcgttgactggctgtg

SEQ ID NO: 4692227 - DNA, 12 bp, Homo sapiens
agagggaagcca

SEQ ID NO: 4692228 - DNA, 15 bp, Homo sapiens
agagggacgcctggg

SEQ ID NO: 4692229 - DNA, 20 bp, Homo sapiens
agagggagggagggctccag

SEQ ID NO: 4692230 - DNA, 15 bp, Homo sapiens
agagggaggtaagga

SEQ ID NO: 4692231 - DNA, 20 bp, Homo sapiens
agaggggacgcaggcccctc

SEQ ID NO: 4692232 - DNA, 17 bp, Homo sapiens
agaggggcctgccacct

SEQ ID NO: 4692233 - DNA, 21 bp, Homo sapiens
agaggggcctgccacctggac

SEQ ID NO: 4692234 - DNA, 20 bp, Homo sapiens
agagggtggtgacctctgcc

SEQ ID NO: 4692235 - DNA, 22 bp, Homo sapiens
agagggtggtgacctctgcctg

SEQ ID NO: 4692236 - DNA, 16 bp, Homo sapiens
agaggtaacagaacag

SEQ ID NO: 4692237 - DNA, 17 bp, Homo sapiens
agaggtaacagaacagc

SEQ ID NO: 4692238 - DNA, 20 bp, Homo sapiens
agaggtaacagaacagcttc

SEQ ID NO: 4692239 - DNA, 21 bp, Homo sapiens
agagtcacacgggggcagctg

SEQ ID NO: 4692240 - DNA, 20 bp, Homo sapiens
agagtctcactgttgcccag

SEQ ID NO: 4692241 - DNA, 16 bp, Homo sapiens
agagtgagactctgtc

SEQ ID NO: 4692242 - DNA, 14 bp, Homo sapiens
agagtggagttgaa

SEQ ID NO: 4692243 - DNA, 14 bp, Homo sapiens
agagtgggggtggg

SEQ ID NO: 4692244 - DNA, 13 bp, Homo sapiens
agagtgtagaagc

SEQ ID NO: 4692245 - DNA, 15 bp, Homo sapiens
agagtgtctttccac

SEQ ID NO: 4692246 - DNA, 22 bp, Homo sapiens
agagttaccattatttaatttg

SEQ ID NO: 4692247 - DNA, 17 bp, Homo sapiens
agagttatttaggcttt

SEQ ID NO: 4692248 - DNA, 18 bp, Homo sapiens
agagtttgatgaggccct

SEQ ID NO: 4692249 - DNA, 22 bp, Homo sapiens
agagtttgatgaggccctccac

SEQ ID NO: 4692250 - DNA, 16 bp, Homo sapiens
agataataaattgatt

SEQ ID NO: 4692251 - DNA, 13 bp, Homo sapiens
agataatccctgt

SEQ ID NO: 4692252 - DNA, 17 bp, Homo sapiens
agataatcttttacatt

SEQ ID NO: 4692253 - DNA, 18 bp, Homo sapiens
agataatcttttacattg

SEQ ID NO: 4692254 - DNA, 13 bp, Homo sapiens
agataatgtgaaa

SEQ ID NO: 4692255 - DNA, 18 bp, Homo sapiens
agataatgtgaaaatggt

SEQ ID NO: 4692256 - DNA, 20 bp, Homo sapiens
agatacaggaaaagctgctg

SEQ ID NO: 4692257 - DNA, 24 bp, Homo sapiens
agatacagggtgctccttgtcaat

SEQ ID NO: 4692258 - DNA, 19 bp, Homo sapiens
agataccagcgaggaggct

SEQ ID NO: 4692259 - DNA, 18 bp, Homo sapiens
agatactaaggacgttgt

SEQ ID NO: 4692260 - DNA, 16 bp, Homo sapiens
agatactcaagcaggt

SEQ ID NO: 4692261 - DNA, 20 bp, Homo sapiens
agatagataggtcagtgcaa

SEQ ID NO: 4692262 - DNA, 19 bp, Homo sapiens
agatatatttaagccttat

SEQ ID NO: 4692263 - DNA, 14 bp, Homo sapiens
agatatctatgact

SEQ ID NO: 4692264 - DNA, 15 bp, Homo sapiens
agatatgaaagctga

SEQ ID NO: 4692265 - DNA, 20 bp, Homo sapiens
agatatttaaaagacaaaca

SEQ ID NO: 4692266 - DNA, 13 bp, Homo sapiens
agatatttatgta

SEQ ID NO: 4692267 - DNA, 21 bp, Homo sapiens
agatcaaccccttcgctcctg

SEQ ID NO: 4692268 - DNA, 14 bp, Homo sapiens
agatcactgtgctt

SEQ ID NO: 4692269 - DNA, 22 bp, Homo sapiens
agatcactgtgcttattttgtt

SEQ ID NO: 4692270 - DNA, 18 bp, Homo sapiens
agatcccaacatggtcct

SEQ ID NO: 4692271 - DNA, 18 bp, Homo sapiens
agatcctacttctctgag

SEQ ID NO: 4692272 - DNA, 17 bp, Homo sapiens
agatctctattatatct

SEQ ID NO: 4692273 - DNA, 23 bp, Homo sapiens
agatgaaaacctgcatttttaaa

SEQ ID NO: 4692274 - DNA, 17 bp, Homo sapiens
agatgaaacacaaacaa

SEQ ID NO: 4692275 - DNA, 20 bp, Homo sapiens
agatgaaatcttacagctgg

SEQ ID NO: 4692276 - DNA, 12 bp, Homo sapiens
agatgcagagag

SEQ ID NO: 4692277 - DNA, 14 bp, Homo sapiens
agatgcagagagcc

SEQ ID NO: 4692278 - DNA, 15 bp, Homo sapiens
agatgcagagagcca

SEQ ID NO: 4692279 - DNA, 17 bp, Homo sapiens
agatgcagagagccatt

SEQ ID NO: 4692280 - DNA, 17 bp, Homo sapiens
agatgccatgtgcaggt

SEQ ID NO: 4692281 - DNA, 15 bp, Homo sapiens
agatgctccttgggc

SEQ ID NO: 4692282 - DNA, 16 bp, Homo sapiens
agatggaaaaatgtga

SEQ ID NO: 4692283 - DNA, 18 bp, Homo sapiens
agatgggggaaagcacag

SEQ ID NO: 4692284 - DNA, 20 bp, Homo sapiens
agatgggtgcttggaggaag

SEQ ID NO: 4692285 - DNA, 17 bp, Homo sapiens
agatgtatgctttgaat

SEQ ID NO: 4692286 - DNA, 17 bp, Homo sapiens
agatgtgtgttgatact

SEQ ID NO: 4692287 - DNA, 18 bp, Homo sapiens
agatgtgtgttgatactg

SEQ ID NO: 4692288 - DNA, 20 bp, Homo sapiens
agatgtgtgttgatactgtt

SEQ ID NO: 4692289 - DNA, 22 bp, Homo sapiens
agatgtgtgttgatactgttgc

SEQ ID NO: 4692290 - DNA, 24 bp, Homo sapiens
agatgtgtgttgatactgttgcac

SEQ ID NO: 4692291 - DNA, 22 bp, Homo sapiens
agatgttctaagtctttccatt

SEQ ID NO: 4692292 - DNA, 16 bp, Homo sapiens
agatgtttatttcagg

SEQ ID NO: 4692293 - DNA, 16 bp, Homo sapiens
agattaacactcattt

SEQ ID NO: 4692294 - DNA, 20 bp, Homo sapiens
agattaacactcatttccaa

SEQ ID NO: 4692295 - DNA, 18 bp, Homo sapiens
agattatggcctttttaa

SEQ ID NO: 4692296 - DNA, 20 bp, Homo sapiens
agattatggcctttttaagt

SEQ ID NO: 4692297 - DNA, 21 bp, Homo sapiens
agattatggcctttttaagta

SEQ ID NO: 4692298 - DNA, 19 bp, Homo sapiens
agattcacacatgccacta

SEQ ID NO: 4692299 - DNA, 16 bp, Homo sapiens
agattcactcagaaga

SEQ ID NO: 4692300 - DNA, 14 bp, Homo sapiens
agattctttcctga

SEQ ID NO: 4692301 - DNA, 21 bp, Homo sapiens
agattctttcctgaggctggg

SEQ ID NO: 4692302 - DNA, 14 bp, Homo sapiens
agattggctcacac

SEQ ID NO: 4692303 - DNA, 19 bp, Homo sapiens
agattggctcacactgaga

SEQ ID NO: 4692304 - DNA, 13 bp, Homo sapiens
agatttcatctgc

SEQ ID NO: 4692305 - DNA, 19 bp, Homo sapiens
agatttcatctgctctcct

SEQ ID NO: 4692306 - DNA, 21 bp, Homo sapiens
agatttcatctgctctccttc

SEQ ID NO: 4692307 - DNA, 23 bp, Homo sapiens
agatttcatctgctctccttcct

SEQ ID NO: 4692308 - DNA, 20 bp, Homo sapiens
agatttctcatttgccaata

SEQ ID NO: 4692309 - DNA, 13 bp, Homo sapiens
agatttgggctgg

SEQ ID NO: 4692310 - DNA, 19 bp, Homo sapiens
agattttagcatgatgaaa

SEQ ID NO: 4692311 - DNA, 17 bp, Homo sapiens
agattttcctcctttcc

SEQ ID NO: 4692312 - DNA, 21 bp, Homo sapiens
agatttttgaaaatcctgaat

SEQ ID NO: 4692313 - DNA, 14 bp, Homo sapiens
agcaacaagctatt

SEQ ID NO: 4692314 - DNA, 15 bp, Homo sapiens
agcaacaagctattt

SEQ ID NO: 4692315 - DNA, 16 bp, Homo sapiens
agcaaccctgtgatac

SEQ ID NO: 4692316 - DNA, 20 bp, Homo sapiens
agcaagacgctgtgctgccc

SEQ ID NO: 4692317 - DNA, 21 bp, Homo sapiens
agcaagacgctgtgctgccct

SEQ ID NO: 4692318 - DNA, 15 bp, Homo sapiens
agcccagaggagggc

SEQ ID NO: 4692319 - DNA, 13 bp, Homo sapiens
agcccagaggtaa

SEQ ID NO: 4692320 - DNA, 16 bp, Homo sapiens
agcccagaggtaacag

SEQ ID NO: 4692321 - DNA, 17 bp, Homo sapiens
agcccagaggtaacaga

SEQ ID NO: 4692322 - DNA, 21 bp, Homo sapiens
agcccagaggtaacagaacag

SEQ ID NO: 4692323 - DNA, 14 bp, Homo sapiens
agcccagctctgaa

SEQ ID NO: 4692324 - DNA, 18 bp, Homo sapiens
agcccaggaaaggctcca

SEQ ID NO: 4692325 - DNA, 13 bp, Homo sapiens
aggaaaggctcca

SEQ ID NO: 4692326 - DNA, 14 bp, Homo sapiens
aggaaaggctccag

SEQ ID NO: 4692327 - DNA, 18 bp, Homo sapiens
aggaaaggctccaggagc

SEQ ID NO: 4692328 - DNA, 23 bp, Homo sapiens
aggaaaggctccaggagcagcca

SEQ ID NO: 4692329 - DNA, 16 bp, Homo sapiens
aggaaatattgctggg

SEQ ID NO: 4692330 - DNA, 14 bp, Homo sapiens
aggaaatccagggt

SEQ ID NO: 4692331 - DNA, 15 bp, Homo sapiens
aggaaatccagggtg

SEQ ID NO: 4692332 - DNA, 12 bp, Homo sapiens
aggaacactcct

SEQ ID NO: 4692333 - DNA, 22 bp, Homo sapiens
aggaagaacggggctcttctca

SEQ ID NO: 4692334 - DNA, 15 bp, Homo sapiens
aggaagccacagctg

SEQ ID NO: 4692335 - DNA, 18 bp, Homo sapiens
aggaagccgctggggcca

SEQ ID NO: 4692336 - DNA, 16 bp, Homo sapiens
aggaagctcagggcct

SEQ ID NO: 4692337 - DNA, 17 bp, Homo sapiens
aggaagctcagggcctg

SEQ ID NO: 4692338 - DNA, 13 bp, Homo sapiens
agctaatgggaca

SEQ ID NO: 4692339 - DNA, 21 bp, Homo sapiens
agctacttcttattcactttt

SEQ ID NO: 4692340 - DNA, 14 bp, Homo sapiens
agctacttgggcca

SEQ ID NO: 4692341 - DNA, 22 bp, Homo sapiens
agctacttgggccatagctcct

SEQ ID NO: 4692342 - DNA, 19 bp, Homo sapiens
agctactttccatttggta

SEQ ID NO: 4692343 - DNA, 15 bp, Homo sapiens
agctagaacctggag

SEQ ID NO: 4692344 - DNA, 16 bp, Homo sapiens
agctagaacctggagg

SEQ ID NO: 4692345 - DNA, 19 bp, Homo sapiens
agctagaactttgaaggac

SEQ ID NO: 4692346 - DNA, 19 bp, Homo sapiens
agctagctatttctatgta

SEQ ID NO: 4692347 - DNA, 21 bp, Homo sapiens
agctagctcccctcctctccc

SEQ ID NO: 4692348 - DNA, 22 bp, Homo sapiens
attctcatgcctcagcctcctg

SEQ ID NO: 4692349 - DNA, 13 bp, Homo sapiens
attctccacctgc

SEQ ID NO: 4692350 - DNA, 16 bp, Homo sapiens
attctccacctgccag

SEQ ID NO: 4692351 - DNA, 11 bp, Homo sapiens
attctcctgcc

SEQ ID NO: 4692352 - DNA, 12 bp, Homo sapiens
attctcctgcct

SEQ ID NO: 4692353 - DNA, 15 bp, Homo sapiens
attctcctgcctcag

SEQ ID NO: 4692354 - DNA, 17 bp, Homo sapiens
attctcctgcctcagcc

SEQ ID NO: 4692355 - DNA, 19 bp, Homo sapiens
attctcctgcctcagcctc

SEQ ID NO: 4692356 - DNA, 20 bp, Homo sapiens
attctcctgcctcagcctcc

SEQ ID NO: 4692357 - DNA, 23 bp, Homo sapiens
attctccttcagccctcacccct

SEQ ID NO: 4692358 - DNA, 19 bp, Homo sapiens
attctctctcactcacatt

SEQ ID NO: 4692359 - DNA, 17 bp, Homo sapiens
attctctgagctgtgca

SEQ ID NO: 4692360 - DNA, 14 bp, Homo sapiens
attctctgtctcat

SEQ ID NO: 4692361 - DNA, 17 bp, Homo sapiens
attctctgtctcatcca

SEQ ID NO: 4692362 - DNA, 18 bp, Homo sapiens
attctctgtctcatccat

SEQ ID NO: 4692363 - DNA, 15 bp, Homo sapiens
attctgataatgtat

SEQ ID NO: 4692364 - DNA, 18 bp, Homo sapiens
attctgataatgtattgc

SEQ ID NO: 4692365 - DNA, 11 bp, Homo sapiens
attctgcctgc

SEQ ID NO: 4692366 - DNA, 16 bp, Homo sapiens
attctgcctgcccagg

SEQ ID NO: 4692367 - DNA, 20 bp, Homo sapiens
attctgctcacatatctgtc

SEQ ID NO: 4692368 - DNA, 21 bp, Homo sapiens
attctgctcacatatctgtca

SEQ ID NO: 4692369 - DNA, 20 bp, Homo sapiens
attctgtctttcaaaaggta

SEQ ID NO: 4692370 - DNA, 10 bp, Homo sapiens
attctgtgac

SEQ ID NO: 4692371 - DNA, 11 bp, Homo sapiens
attctgtgacc

SEQ ID NO: 4692372 - DNA, 14 bp, Homo sapiens
attctgttggccag

SEQ ID NO: 4692373 - DNA, 21 bp, Homo sapiens
attctgttggccagtgtgaca

SEQ ID NO: 4692374 - DNA, 17 bp, Homo sapiens
attcttacaaacatgtg

SEQ ID NO: 4692375 - DNA, 21 bp, Homo sapiens
attcttacaaacatgtggtta

SEQ ID NO: 4692376 - DNA, 17 bp, Homo sapiens
attcttatttttaattt

SEQ ID NO: 4692377 - DNA, 11 bp, Homo sapiens
attcttctgct

SEQ ID NO: 4692378 - DNA, 20 bp, Homo sapiens
attcttgttgctgtacaaaa

SEQ ID NO: 4692379 - DNA, 15 bp, Homo sapiens
attctttaatgattc

SEQ ID NO: 4692380 - DNA, 21 bp, Homo sapiens
attctttcccaattcacatct

SEQ ID NO: 4692381 - DNA, 11 bp, Homo sapiens
attctttcctg

SEQ ID NO: 4692382 - DNA, 20 bp, Homo sapiens
attctttcttggtgcattcg

SEQ ID NO: 4692383 - DNA, 21 bp, Homo sapiens
attcttttgtttatattgttt

SEQ ID NO: 4692384 - DNA, 22 bp, Homo sapiens
attgaaaaaatagagcctgagg

SEQ ID NO: 4692385 - DNA, 21 bp, Homo sapiens
attgaaaaattatcagttata

SEQ ID NO: 4692386 - DNA, 14 bp, Homo sapiens
atgtataaattaat

SEQ ID NO: 4692387 - DNA, 17 bp, Homo sapiens
atgtataaattaataca

SEQ ID NO: 4692388 - DNA, 23 bp, Homo sapiens
atgtataatatttttaattaaat

SEQ ID NO: 4692389 - DNA, 17 bp, Homo sapiens
atgtatattaaaaaaga

SEQ ID NO: 4692390 - DNA, 13 bp, Homo sapiens
atgtatatttgca

SEQ ID NO: 4692391 - DNA, 18 bp, Homo sapiens
atgtatgaggtacaacct

SEQ ID NO: 4692392 - DNA, 18 bp, Homo sapiens
atgtatgctttgaatgca

SEQ ID NO: 4692393 - DNA, 21 bp, Homo sapiens
atgtatgtggatacagtcatt

SEQ ID NO: 4692394 - DNA, 21 bp, Homo sapiens
atgtattgcagtgcggctcac

SEQ ID NO: 4692395 - DNA, 17 bp, Homo sapiens
atgtcaactgacctaaa

SEQ ID NO: 4692396 - DNA, 14 bp, Homo sapiens
atgtcacaggcagg

SEQ ID NO: 4692397 - DNA, 22 bp, Homo sapiens
atgtcatattttgccactgcct

SEQ ID NO: 4692398 - DNA, 16 bp, Homo sapiens
atgtcattatttgata

SEQ ID NO: 4692399 - DNA, 22 bp, Homo sapiens
atgtcattatttgataacattt

SEQ ID NO: 4692400 - DNA, 13 bp, Homo sapiens
atgtccctattta

SEQ ID NO: 4692401 - DNA, 19 bp, Homo sapiens
atgtccctgaagtcttgca

SEQ ID NO: 4692402 - DNA, 19 bp, Homo sapiens
atgtcctatattggctaaa

SEQ ID NO: 4692403 - DNA, 23 bp, Homo sapiens
atgtcctatgtatatcttctaca

SEQ ID NO: 4692404 - DNA, 22 bp, Homo sapiens
atgtcgctgggtcctctgcagt

SEQ ID NO: 4692405 - DNA, 15 bp, Homo sapiens
atgtctagaaagtaa

SEQ ID NO: 4692406 - DNA, 15 bp, Homo sapiens
atgtctcgtggtagg

SEQ ID NO: 4692407 - DNA, 16 bp, Homo sapiens
atgtgaaaaaaattat

SEQ ID NO: 4692408 - DNA, 18 bp, Homo sapiens
atgtgaaaccttttttaa

SEQ ID NO: 4692409 - DNA, 19 bp, Homo sapiens
atgtgaaaccttttttaag

SEQ ID NO: 4692410 - DNA, 20 bp, Homo sapiens
atgtgaaaccttttttaaga

SEQ ID NO: 4692411 - DNA, 22 bp, Homo sapiens
atgtgaaaccttttttaagatt

SEQ ID NO: 4692412 - DNA, 17 bp, Homo sapiens
atgtgataatatattgc

SEQ ID NO: 4692413 - DNA, 17 bp, Homo sapiens
atgtgatcatctttgct

SEQ ID NO: 4692414 - DNA, 18 bp, Homo sapiens
atgtgatccttttggagt

SEQ ID NO: 4692415 - DNA, 16 bp, Homo sapiens
atgtgatgtggcagga

SEQ ID NO: 4692416 - DNA, 17 bp, Homo sapiens
atgtgcaaaaaaagaaa

SEQ ID NO: 4692417 - DNA, 19 bp, Homo sapiens
atgtgcacatctgttttgt

SEQ ID NO: 4692418 - DNA, 16 bp, Homo sapiens
atgtgcatctggtgta

SEQ ID NO: 4692419 - DNA, 14 bp, Homo sapiens
atgtgcctgggtgg

SEQ ID NO: 4692420 - DNA, 14 bp, Homo sapiens
atgtggagaaggtg

SEQ ID NO: 4692421 - DNA, 15 bp, Homo sapiens
caaaaaaaagtctat

SEQ ID NO: 4692422 - DNA, 21 bp, Homo sapiens
caaaaacagctggacttattt

SEQ ID NO: 4692423 - DNA, 14 bp, Homo sapiens
caaaaactaaaatc

SEQ ID NO: 4692424 - DNA, 21 bp, Homo sapiens
caaaaatttctgtaaaacagg

SEQ ID NO: 4692425 - DNA, 23 bp, Homo sapiens
caaaacatagctggttaaccttg

SEQ ID NO: 4692426 - DNA, 16 bp, Homo sapiens
caaaactagaattgtt

SEQ ID NO: 4692427 - DNA, 16 bp, Homo sapiens
caaaactctcctctgc

SEQ ID NO: 4692428 - DNA, 20 bp, Homo sapiens
caaaactctcctctgctgct

SEQ ID NO: 4692429 - DNA, 22 bp, Homo sapiens
caaaagaaatttagagtcaatt

SEQ ID NO: 4692430 - DNA, 15 bp, Homo sapiens
caaaagcacttactt

SEQ ID NO: 4692431 - DNA, 23 bp, Homo sapiens
caaaagctgtgtctctgtatata

SEQ ID NO: 4692432 - DNA, 16 bp, Homo sapiens
caaaataaagtgtgtg

SEQ ID NO: 4692433 - DNA, 17 bp, Homo sapiens
caaaatcaagcaagcct

SEQ ID NO: 4692434 - DNA, 12 bp, Homo sapiens
caaaatcccctt

SEQ ID NO: 4692435 - DNA, 16 bp, Homo sapiens
caaaatgttctattta

SEQ ID NO: 4692436 - DNA, 14 bp, Homo sapiens
caaacaaaatttct

SEQ ID NO: 4692437 - DNA, 15 bp, Homo sapiens
caaacaaaatttcta

SEQ ID NO: 4692438 - DNA, 18 bp, Homo sapiens
caaacatgaaaacattga

SEQ ID NO: 4692439 - DNA, 19 bp, Homo sapiens
caaacatgaaaacattgat

SEQ ID NO: 4692440 - DNA, 18 bp, Homo sapiens
caaacatggaaaacagag

SEQ ID NO: 4692441 - DNA, 21 bp, Homo sapiens
caaacatgtgcaactcttgta

SEQ ID NO: 4692442 - DNA, 20 bp, Homo sapiens
caaacctagccccttagccc

SEQ ID NO: 4692443 - DNA, 14 bp, Homo sapiens
caaactcagcctca

SEQ ID NO: 4692444 - DNA, 11 bp, Homo sapiens
caaactcatct

SEQ ID NO: 4692445 - DNA, 19 bp, Homo sapiens
caaactcttgacctcaggt

SEQ ID NO: 4692446 - DNA, 23 bp, Homo sapiens
caaactgtagttgttttggcgat

SEQ ID NO: 4692447 - DNA, 19 bp, Homo sapiens
caaactgtgggattctgat

SEQ ID NO: 4692448 - DNA, 15 bp, Homo sapiens
caaactttaacaggt

SEQ ID NO: 4692449 - DNA, 16 bp, Homo sapiens
caaagaaaatgaaatg

SEQ ID NO: 4692450 - DNA, 16 bp, Homo sapiens
caaagaaacaaagatg

SEQ ID NO: 4692451 - DNA, 18 bp, Homo sapiens
caaagaggtgactgggcc

SEQ ID NO: 4692452 - DNA, 16 bp, Homo sapiens
caaagagtgtggaatt

SEQ ID NO: 4692453 - DNA, 18 bp, Homo sapiens
caaagagtttgatgaggc

SEQ ID NO: 4692454 - DNA, 20 bp, Homo sapiens
caaagccaaagctaggcctg

SEQ ID NO: 4692455 - DNA, 20 bp, Homo sapiens
caaagccagcgtcctcctct

SEQ ID NO: 4692456 - DNA, 23 bp, Homo sapiens
caaagccagcgtcctcctctgtg

SEQ ID NO: 4692457 - DNA, 13 bp, Homo sapiens
caaagctaggcct

SEQ ID NO: 4692458 - DNA, 15 bp, Homo sapiens
caaagctaggcctgg

SEQ ID NO: 4692459 - DNA, 17 bp, Homo sapiens
caaaggaaaatgtctgt

SEQ ID NO: 4692460 - DNA, 16 bp, Homo sapiens
caaaggagtagaaaga

SEQ ID NO: 4692461 - DNA, 13 bp, Homo sapiens
caaaggccatgga

SEQ ID NO: 4692462 - DNA, 18 bp, Homo sapiens
caaagggtatcaggtgct

SEQ ID NO: 4692463 - DNA, 16 bp, Homo sapiens
caaagtaaactgtgta

SEQ ID NO: 4692464 - DNA, 21 bp, Homo sapiens
caaagtagaaactactaattt

SEQ ID NO: 4692465 - DNA, 22 bp, Homo sapiens
caaagtagaaactactaatttt

SEQ ID NO: 4692466 - DNA, 16 bp, Homo sapiens
caaagtcattaaagac

SEQ ID NO: 4692467 - DNA, 23 bp, Homo sapiens
caaagtctgctctcatataagac

SEQ ID NO: 4692468 - DNA, 19 bp, Homo sapiens
caaagtgctgggattacag

SEQ ID NO: 4692469 - DNA, 11 bp, Homo sapiens
caaagtggaac

SEQ ID NO: 4692470 - DNA, 21 bp, Homo sapiens
caaagttaattgtatttatgt

SEQ ID NO: 4692471 - DNA, 14 bp, Homo sapiens
caaagttccagttt

SEQ ID NO: 4692472 - DNA, 17 bp, Homo sapiens
caaagtttgtggtaatt

SEQ ID NO: 4692473 - DNA, 18 bp, Homo sapiens
caaagttttgaaaagcta

SEQ ID NO: 4692474 - DNA, 21 bp, Homo sapiens
caaagttttgaaaagctatta

SEQ ID NO: 4692475 - DNA, 14 bp, Homo sapiens
caaataaaccttgt

SEQ ID NO: 4692476 - DNA, 18 bp, Homo sapiens
caaataaaccttgtttct

SEQ ID NO: 4692477 - DNA, 17 bp, Homo sapiens
caaataaataattttca

SEQ ID NO: 4692478 - DNA, 17 bp, Homo sapiens
caaatactatccaaata

SEQ ID NO: 4692479 - DNA, 18 bp, Homo sapiens
caaatactgtatattcag

SEQ ID NO: 4692480 - DNA, 13 bp, Homo sapiens
caaatattccaga

SEQ ID NO: 4692481 - DNA, 13 bp, Homo sapiens
caaatcaaagcag

SEQ ID NO: 4692482 - DNA, 13 bp, Homo sapiens
caaatcctctcca

SEQ ID NO: 4692483 - DNA, 14 bp, Homo sapiens
caaatctgacatat

SEQ ID NO: 4692484 - DNA, 15 bp, Homo sapiens
caaatctgacatatt

SEQ ID NO: 4692485 - DNA, 19 bp, Homo sapiens
caaatgcattcatgtttta

SEQ ID NO: 4692486 - DNA, 18 bp, Homo sapiens
cagatagtgtagctgagg

SEQ ID NO: 4692487 - DNA, 19 bp, Homo sapiens
cagatatattaagtgactg

SEQ ID NO: 4692488 - DNA, 14 bp, Homo sapiens
cagatccccaagcc

SEQ ID NO: 4692489 - DNA, 15 bp, Homo sapiens
cagatccccaagcct

SEQ ID NO: 4692490 - DNA, 20 bp, Homo sapiens
cagatcctccatttttgttg

SEQ ID NO: 4692491 - DNA, 19 bp, Homo sapiens
cagatgaatgactccagga

SEQ ID NO: 4692492 - DNA, 16 bp, Homo sapiens
cagatgcaccagccct

SEQ ID NO: 4692493 - DNA, 18 bp, Homo sapiens
cagatgcagagagccatt

SEQ ID NO: 4692494 - DNA, 20 bp, Homo sapiens
cagatgcagagagccatttt

SEQ ID NO: 4692495 - DNA, 12 bp, Homo sapiens
cagatgcccacg

SEQ ID NO: 4692496 - DNA, 18 bp, Homo sapiens
cagatgctggtcatgtgt

SEQ ID NO: 4692497 - DNA, 14 bp, Homo sapiens
cagatgggggaaag

SEQ ID NO: 4692498 - DNA, 18 bp, Homo sapiens
cagatgggtgcttggagg

SEQ ID NO: 4692499 - DNA, 22 bp, Homo sapiens
cagatgtcgctgggtcctctgc

SEQ ID NO: 4692500 - DNA, 17 bp, Homo sapiens
cagattctttcctgagg

SEQ ID NO: 4692501 - DNA, 18 bp, Homo sapiens
cagattctttcctgaggc

SEQ ID NO: 4692502 - DNA, 21 bp, Homo sapiens
cagattgcaacaggctgggct

SEQ ID NO: 4692503 - DNA, 13 bp, Homo sapiens
cagatttgagctc

SEQ ID NO: 4692504 - DNA, 14 bp, Homo sapiens
cagatttgagctca

SEQ ID NO: 4692505 - DNA, 16 bp, Homo sapiens
cagatttgagctcagc

SEQ ID NO: 4692506 - DNA, 14 bp, Homo sapiens
cagatttgatattt

SEQ ID NO: 4692507 - DNA, 15 bp, Homo sapiens
cagatttgggctgga

SEQ ID NO: 4692508 - DNA, 20 bp, Homo sapiens
cagcaactatcagactaagc

SEQ ID NO: 4692509 - DNA, 21 bp, Homo sapiens
cagcaactatcagactaagcc

SEQ ID NO: 4692510 - DNA, 18 bp, Homo sapiens
cagcaaggaggctggctg

SEQ ID NO: 4692511 - DNA, 22 bp, Homo sapiens
cagcaaggaggctggctggggc

SEQ ID NO: 4692512 - DNA, 15 bp, Homo sapiens
cagcaagtgagagct

SEQ ID NO: 4692513 - DNA, 19 bp, Homo sapiens
cagcaattctcctgcctca

SEQ ID NO: 4692514 - DNA, 22 bp, Homo sapiens
cagcaccggaccagcctggccc

SEQ ID NO: 4692515 - DNA, 15 bp, Homo sapiens
cagcacctacagtgt

SEQ ID NO: 4692516 - DNA, 20 bp, Homo sapiens
cagcacctacagtgtacagt

SEQ ID NO: 4692517 - DNA, 18 bp, Homo sapiens
cagcacgggggccaagga

SEQ ID NO: 4692518 - DNA, 15 bp, Homo sapiens
cagcactcctcggca

SEQ ID NO: 4692519 - DNA, 17 bp, Homo sapiens
cagcactgactggaagg

SEQ ID NO: 4692520 - DNA, 16 bp, Homo sapiens
cagcactgcttgagga

SEQ ID NO: 4692521 - DNA, 13 bp, Homo sapiens
cagcagaaggggg

SEQ ID NO: 4692522 - DNA, 18 bp, Homo sapiens
cagcagagacttgggaca

SEQ ID NO: 4692523 - DNA, 21 bp, Homo sapiens
cagcagagacttgggacattg

SEQ ID NO: 4692524 - DNA, 23 bp, Homo sapiens
cagcaggtgctgctaccctccct

SEQ ID NO: 4692525 - DNA, 17 bp, Homo sapiens
cagcagtgtgaggccag

SEQ ID NO: 4692526 - DNA, 19 bp, Homo sapiens
cagcagtgtgaggccaggg

SEQ ID NO: 4692527 - DNA, 16 bp, Homo sapiens
cagcatattcaggaag

SEQ ID NO: 4692528 - DNA, 17 bp, Homo sapiens
cagcatattcaggaagc

SEQ ID NO: 4692529 - DNA, 23 bp, Homo sapiens
cagcatattcaggaagctcaggg

SEQ ID NO: 4692530 - DNA, 13 bp, Homo sapiens
cagcatcaaacat

SEQ ID NO: 4692531 - DNA, 21 bp, Homo sapiens
cagcatcaaacatgaaaacat

SEQ ID NO: 4692532 - DNA, 22 bp, Homo sapiens
cagcatcaaacatgaaaacatt

SEQ ID NO: 4692533 - DNA, 22 bp, Homo sapiens
cagcatcccttgaccaggcctg

SEQ ID NO: 4692534 - DNA, 17 bp, Homo sapiens
cagcatcctggcacccg

SEQ ID NO: 4692535 - DNA, 20 bp, Homo sapiens
cagcatcctggcacccggcc

SEQ ID NO: 4692536 - DNA, 20 bp, Homo sapiens
cagcatgggcccaggaatgc

SEQ ID NO: 4692537 - DNA, 14 bp, Homo sapiens
cagccacattcctg

SEQ ID NO: 4692538 - DNA, 13 bp, Homo sapiens
cagccaccctcac

SEQ ID NO: 4692539 - DNA, 22 bp, Homo sapiens
atttaaactatgataaattatg

SEQ ID NO: 4692540 - DNA, 18 bp, Homo sapiens
atttaaagtattctccat

SEQ ID NO: 4692541 - DNA, 13 bp, Homo sapiens
atttaaatgtact

SEQ ID NO: 4692542 - DNA, 24 bp, Homo sapiens
atttaaccataaatcaattcatgt

SEQ ID NO: 4692543 - DNA, 16 bp, Homo sapiens
atttaacctatttcca

SEQ ID NO: 4692544 - DNA, 23 bp, Homo sapiens
atttaacttttcttttggacttt

SEQ ID NO: 4692545 - DNA, 17 bp, Homo sapiens
atttaagccttataaac

SEQ ID NO: 4692546 - DNA, 13 bp, Homo sapiens
atttaataacatt

SEQ ID NO: 4692547 - DNA, 14 bp, Homo sapiens
atttaataacatta

SEQ ID NO: 4692548 - DNA, 16 bp, Homo sapiens
atttaataatgtatgt

SEQ ID NO: 4692549 - DNA, 15 bp, Homo sapiens
atttaattctttcta

SEQ ID NO: 4692550 - DNA, 13 bp, Homo sapiens
atttaatttgaag

SEQ ID NO: 4692551 - DNA, 23 bp, Homo sapiens
atttacaaaaatataaaatatga

SEQ ID NO: 4692552 - DNA, 22 bp, Homo sapiens
atttacatttatctattaaaat

SEQ ID NO: 4692553 - DNA, 14 bp, Homo sapiens
atttaccttttaag

SEQ ID NO: 4692554 - DNA, 15 bp, Homo sapiens
atttaccttttaaga

SEQ ID NO: 4692555 - DNA, 20 bp, Homo sapiens
atttaccttttaagacattt

SEQ ID NO: 4692556 - DNA, 22 bp, Homo sapiens
atttaccttttaagacattttc

SEQ ID NO: 4692557 - DNA, 16 bp, Homo sapiens
atttacgtttttgtaa

SEQ ID NO: 4692558 - DNA, 18 bp, Homo sapiens
atttactttttaaacagt

SEQ ID NO: 4692559 - DNA, 15 bp, Homo sapiens
atttagagtcaattt

SEQ ID NO: 4692560 - DNA, 19 bp, Homo sapiens
atttagagtcaatttgctg

SEQ ID NO: 4692561 - DNA, 16 bp, Homo sapiens
atttagcaatgctgtg

SEQ ID NO: 4692562 - DNA, 18 bp, Homo sapiens
atttagcaatgctgtgaa

SEQ ID NO: 4692563 - DNA, 14 bp, Homo sapiens
atttagcacatttt

SEQ ID NO: 4692564 - DNA, 22 bp, Homo sapiens
atttagcgcacccagagaaaat

SEQ ID NO: 4692565 - DNA, 14 bp, Homo sapiens
atttaggagaagtt

SEQ ID NO: 4692566 - DNA, 22 bp, Homo sapiens
atttagtttgattattcagtgt

SEQ ID NO: 4692567 - DNA, 13 bp, Homo sapiens
atttataaagcaa

SEQ ID NO: 4692568 - DNA, 16 bp, Homo sapiens
atttataaggaaattt

SEQ ID NO: 4692569 - DNA, 16 bp, Homo sapiens
atttatacctttgaaa

SEQ ID NO: 4692570 - DNA, 16 bp, Homo sapiens
atttatattcatcaaa

SEQ ID NO: 4692571 - DNA, 19 bp, Homo sapiens
atttatgatttaataaaat

SEQ ID NO: 4692572 - DNA, 11 bp, Homo sapiens
atttattaatt

SEQ ID NO: 4692573 - DNA, 14 bp, Homo sapiens
atttattaatttga

SEQ ID NO: 4692574 - DNA, 16 bp, Homo sapiens
atttattaatttgaaa

SEQ ID NO: 4692575 - DNA, 13 bp, Homo sapiens
atttattatgtcc

SEQ ID NO: 4692576 - DNA, 20 bp, Homo sapiens
atttattgaattattttgtt

SEQ ID NO: 4692577 - DNA, 21 bp, Homo sapiens
atttatttttctcatgaatct

SEQ ID NO: 4692578 - DNA, 16 bp, Homo sapiens
atttcaagatccaaat

SEQ ID NO: 4692579 - DNA, 19 bp, Homo sapiens
atttcaagatccaaatgct

SEQ ID NO: 4692580 - DNA, 13 bp, Homo sapiens
cagggcagggccc

SEQ ID NO: 4692581 - DNA, 17 bp, Homo sapiens
cagggcctggaagacag

SEQ ID NO: 4692582 - DNA, 18 bp, Homo sapiens
cagggcctggaagacaga

SEQ ID NO: 4692583 - DNA, 16 bp, Homo sapiens
cagggctaccctgagc

SEQ ID NO: 4692584 - DNA, 22 bp, Homo sapiens
cagggctaccctgagctgaggc

SEQ ID NO: 4692585 - DNA, 23 bp, Homo sapiens
cagggctcagcggggacagctcc

SEQ ID NO: 4692586 - DNA, 12 bp, Homo sapiens
cagggctctgac

SEQ ID NO: 4692587 - DNA, 14 bp, Homo sapiens
cagggctggactga

SEQ ID NO: 4692588 - DNA, 17 bp, Homo sapiens
cagggctggactgaggc

SEQ ID NO: 4692589 - DNA, 20 bp, Homo sapiens
cagggctggactgaggcctg

SEQ ID NO: 4692590 - DNA, 23 bp, Homo sapiens
cagggctggactgaggcctgagc

SEQ ID NO: 4692591 - DNA, 17 bp, Homo sapiens
caggggcaggcacagca

SEQ ID NO: 4692592 - DNA, 18 bp, Homo sapiens
caggggctgcccgctccc

SEQ ID NO: 4692593 - DNA, 21 bp, Homo sapiens
caggggtgggacaccctgtga

SEQ ID NO: 4692594 - DNA, 14 bp, Homo sapiens
cagggtccctggtg

SEQ ID NO: 4692595 - DNA, 23 bp, Homo sapiens
cagggtctcactatgttgcccag

SEQ ID NO: 4692596 - DNA, 15 bp, Homo sapiens
cagggtctctgctgc

SEQ ID NO: 4692597 - DNA, 19 bp, Homo sapiens
cagggttgaccccagagga

SEQ ID NO: 4692598 - DNA, 12 bp, Homo sapiens
cagggttggccc

SEQ ID NO: 4692599 - DNA, 14 bp, Homo sapiens
caggtaacaggcag

SEQ ID NO: 4692600 - DNA, 17 bp, Homo sapiens
caggtaacaggcagata

SEQ ID NO: 4692601 - DNA, 20 bp, Homo sapiens
caggtaacaggcagatacag

SEQ ID NO: 4692602 - DNA, 19 bp, Homo sapiens
caggtagaacacaaggtca

SEQ ID NO: 4692603 - DNA, 20 bp, Homo sapiens
caggtctccatgaagaagct

SEQ ID NO: 4692604 - DNA, 18 bp, Homo sapiens
caggtcttgaactcctgg

SEQ ID NO: 4692605 - DNA, 21 bp, Homo sapiens
caggtcttgaactcctggcct

SEQ ID NO: 4692606 - DNA, 23 bp, Homo sapiens
caggtcttgaactcctggcctca

SEQ ID NO: 4692607 - DNA, 17 bp, Homo sapiens
caggtgagcccatggcc

SEQ ID NO: 4692608 - DNA, 17 bp, Homo sapiens
caggtgatccacccacc

SEQ ID NO: 4692609 - DNA, 20 bp, Homo sapiens
caggtgatccacccacctca

SEQ ID NO: 4692610 - DNA, 21 bp, Homo sapiens
caggtgatccacccacctcag

SEQ ID NO: 4692611 - DNA, 22 bp, Homo sapiens
caggtgatccacccacctcagc

SEQ ID NO: 4692612 - DNA, 18 bp, Homo sapiens
caggtgcacaagctccaa

SEQ ID NO: 4692613 - DNA, 21 bp, Homo sapiens
caggtgctacacccttttcca

SEQ ID NO: 4692614 - DNA, 20 bp, Homo sapiens
caggtgctaggaacactcct

SEQ ID NO: 4692615 - DNA, 13 bp, Homo sapiens
caggtgctgccat

SEQ ID NO: 4692616 - DNA, 13 bp, Homo sapiens
caggtgctgctac

SEQ ID NO: 4692617 - DNA, 20 bp, Homo sapiens
caggtgctgctaccctccct

SEQ ID NO: 4692618 - DNA, 22 bp, Homo sapiens
caggtgctgctaccctccctgc

SEQ ID NO: 4692619 - DNA, 15 bp, Homo sapiens
caggtgctgtgacac

SEQ ID NO: 4692620 - DNA, 21 bp, Homo sapiens
caggtgggcgggcagcacagc

SEQ ID NO: 4692621 - DNA, 13 bp, Homo sapiens
cctagctgtgtca

SEQ ID NO: 4692622 - DNA, 13 bp, Homo sapiens
cctaggcaggaca

SEQ ID NO: 4692623 - DNA, 23 bp, Homo sapiens
cctaggcaggacatgctgaagcc

SEQ ID NO: 4692624 - DNA, 22 bp, Homo sapiens
cctagggaagggtggtggagcc

SEQ ID NO: 4692625 - DNA, 17 bp, Homo sapiens
cctagggccactgaaga

SEQ ID NO: 4692626 - DNA, 13 bp, Homo sapiens
cctagtcccttcc

SEQ ID NO: 4692627 - DNA, 19 bp, Homo sapiens
cctagtcccttccacaccc

SEQ ID NO: 4692628 - DNA, 23 bp, Homo sapiens
cctagtgaaggcttctctctgtg

SEQ ID NO: 4692629 - DNA, 15 bp, Homo sapiens
cctagtggctgtcca

SEQ ID NO: 4692630 - DNA, 18 bp, Homo sapiens
cctagtggctgtccagtg

SEQ ID NO: 4692631 - DNA, 19 bp, Homo sapiens
cctagtggctgtccagtgc

SEQ ID NO: 4692632 - DNA, 14 bp, Homo sapiens
cctctgacacacag

SEQ ID NO: 4692633 - DNA, 12 bp, Homo sapiens
cctctgactcag

SEQ ID NO: 4692634 - DNA, 11 bp, Homo sapiens
cctctgagcct

SEQ ID NO: 4692635 - DNA, 14 bp, Homo sapiens
cctctgcactcccc

SEQ ID NO: 4692636 - DNA, 16 bp, Homo sapiens
cctctgcactcccctg

SEQ ID NO: 4692637 - DNA, 17 bp, Homo sapiens
cctctgcactcccctgc

SEQ ID NO: 4692638 - DNA, 20 bp, Homo sapiens
cctctgcactcccctgctgg

SEQ ID NO: 4692639 - DNA, 23 bp, Homo sapiens
cctctgcactcccctgctgggtg

SEQ ID NO: 4692640 - DNA, 19 bp, Homo sapiens
cctctgcagtgtggcaagc

SEQ ID NO: 4692641 - DNA, 17 bp, Homo sapiens
cctctgcccactccctg

SEQ ID NO: 4692642 - DNA, 21 bp, Homo sapiens
cctctgcctctgacacacagc

SEQ ID NO: 4692643 - DNA, 21 bp, Homo sapiens
cctctgcctgaagtcacacag

SEQ ID NO: 4692644 - DNA, 22 bp, Homo sapiens
cctctgcctgaagtcacacagt

SEQ ID NO: 4692645 - DNA, 17 bp, Homo sapiens
cctctgctgctggctgg

SEQ ID NO: 4692646 - DNA, 16 bp, Homo sapiens
cctctggctccagctg

SEQ ID NO: 4692647 - DNA, 15 bp, Homo sapiens
cctctgtacagagcc

SEQ ID NO: 4692648 - DNA, 15 bp, Homo sapiens
cctctgtccaggcac

SEQ ID NO: 4692649 - DNA, 17 bp, Homo sapiens
cctctgtccccttctct

SEQ ID NO: 4692650 - DNA, 19 bp, Homo sapiens
cctctgtccccttctctca

SEQ ID NO: 4692651 - DNA, 21 bp, Homo sapiens
cctctgtccccttctctcatc

SEQ ID NO: 4692652 - DNA, 11 bp, Homo sapiens
cctctgtcctg

SEQ ID NO: 4692653 - DNA, 11 bp, Homo sapiens
cctctgtgaaa

SEQ ID NO: 4692654 - DNA, 12 bp, Homo sapiens
cctctgtgaaat

SEQ ID NO: 4692655 - DNA, 19 bp, Homo sapiens
cctctgtgaccaatgtctt

SEQ ID NO: 4692656 - DNA, 14 bp, Homo sapiens
cctctgtgtcactg

SEQ ID NO: 4692657 - DNA, 22 bp, Homo sapiens
cctctgtgtcactggctgcctc

SEQ ID NO: 4692658 - DNA, 21 bp, Homo sapiens
cctctgttctgcacacagcac

SEQ ID NO: 4692659 - DNA, 16 bp, Homo sapiens
cctctgtttgacaaac

SEQ ID NO: 4692660 - DNA, 14 bp, Homo sapiens
cctcttatgggctg

SEQ ID NO: 4692661 - DNA, 11 bp, Homo sapiens
cctcttcctga

SEQ ID NO: 4692662 - DNA, 15 bp, Homo sapiens
cctcttgccccaacc

SEQ ID NO: 4692663 - DNA, 21 bp, Homo sapiens
cctcttgccccaacccccagc

SEQ ID NO: 4692664 - DNA, 13 bp, Homo sapiens
cctcttgggttca

SEQ ID NO: 4692665 - DNA, 15 bp, Homo sapiens
cctcttttcacattt

SEQ ID NO: 4692666 - DNA, 17 bp, Homo sapiens
cctcttttcacattttt

SEQ ID NO: 4692667 - DNA, 18 bp, Homo sapiens
cctgaaaacactgtgcac

SEQ ID NO: 4692668 - DNA, 12 bp, Homo sapiens
cctgaaattaat

SEQ ID NO: 4692669 - DNA, 23 bp, Homo sapiens
cctgaaattaatttgtgaatttg

SEQ ID NO: 4692670 - DNA, 16 bp, Homo sapiens
cctgaactctgcaact

SEQ ID NO: 4692671 - DNA, 18 bp, Homo sapiens
cctgaaggccccgcccag

SEQ ID NO: 4692672 - DNA, 14 bp, Homo sapiens
cctgacaacactca

SEQ ID NO: 4692673 - DNA, 16 bp, Homo sapiens
cctgacaacactcatt

SEQ ID NO: 4692674 - DNA, 23 bp, Homo sapiens
cctgacaacactcattgacctga

SEQ ID NO: 4692675 - DNA, 19 bp, Homo sapiens
cctgacaacagcctgagaa

SEQ ID NO: 4692676 - DNA, 12 bp, Homo sapiens
cctgacagcact

SEQ ID NO: 4692677 - DNA, 18 bp, Homo sapiens
cctgacccctcatagccc

SEQ ID NO: 4692678 - DNA, 21 bp, Homo sapiens
cctgaccttgaggagtcttgt

SEQ ID NO: 4692679 - DNA, 23 bp, Homo sapiens
cctgaccttgaggagtcttgtgt

SEQ ID NO: 4692680 - DNA, 19 bp, Homo sapiens
cctgacttcaggggctgcc

SEQ ID NO: 4692681 - DNA, 16 bp, Homo sapiens
cctgagcgctcctgcc

SEQ ID NO: 4692682 - DNA, 23 bp, Homo sapiens
cctgagcgctcctgccgcagagc

SEQ ID NO: 4692683 - DNA, 11 bp, Homo sapiens
cctgagctaga

SEQ ID NO: 4692684 - DNA, 18 bp, Homo sapiens
cctgaggaacccttacag

SEQ ID NO: 4692685 - DNA, 16 bp, Homo sapiens
cctgaggcccagaggg

SEQ ID NO: 4692686 - DNA, 12 bp, Homo sapiens
cctgaggggcct

SEQ ID NO: 4692687 - DNA, 21 bp, Homo sapiens
cctgagtagctgggattacag

SEQ ID NO: 4692688 - DNA, 14 bp, Homo sapiens
cctgagtgcctggc

SEQ ID NO: 4692689 - DNA, 13 bp, Homo sapiens
cctgatcagagcc

SEQ ID NO: 4692690 - DNA, 15 bp, Homo sapiens
cctgatcctgtgaag

SEQ ID NO: 4692691 - DNA, 14 bp, Homo sapiens
cctgatgaaaataa

SEQ ID NO: 4692692 - DNA, 17 bp, Homo sapiens
cctgatgaaaataaaga

SEQ ID NO: 4692693 - DNA, 18 bp, Homo sapiens
cctgatgaaaataaagaa

SEQ ID NO: 4692694 - DNA, 21 bp, Homo sapiens
cctgatgaaaataaagaatgg

SEQ ID NO: 4692695 - DNA, 14 bp, Homo sapiens
cctgatgacctggg

SEQ ID NO: 4692696 - DNA, 15 bp, Homo sapiens
cctgatgatttttat

SEQ ID NO: 4692697 - DNA, 19 bp, Homo sapiens
cctgatgcttcttcagaga

SEQ ID NO: 4692698 - DNA, 17 bp, Homo sapiens
cctgatggacctgtcac

SEQ ID NO: 4692699 - DNA, 23 bp, Homo sapiens
cctgatggcaggatggcctggcc

SEQ ID NO: 4692700 - DNA, 19 bp, Homo sapiens
cctgattcggctgtctcag

SEQ ID NO: 4692701 - DNA, 19 bp, Homo sapiens
cctgattgtgtctcttggt

SEQ ID NO: 4692702 - DNA, 23 bp, Homo sapiens
cctgattgtgtctcttggtcctg

SEQ ID NO: 4692703 - DNA, 17 bp, Homo sapiens
cctgatttgctgggcag

SEQ ID NO: 4692704 - DNA, 22 bp, Homo sapiens
cctgatttgctgggcagttttt

SEQ ID NO: 4692705 - DNA, 19 bp, Homo sapiens
cctgcaaaaggactctcag

SEQ ID NO: 4692706 - DNA, 12 bp, Homo sapiens
cctgcactgtcc

SEQ ID NO: 4692707 - DNA, 13 bp, Homo sapiens
cctgcactgtcct

SEQ ID NO: 4692708 - DNA, 21 bp, Homo sapiens
cctgcactgtcctgctccaca

SEQ ID NO: 4692709 - DNA, 17 bp, Homo sapiens
cctgcaggaaggagctg

SEQ ID NO: 4692710 - DNA, 21 bp, Homo sapiens
cctgcaggaaggagctgcctg

SEQ ID NO: 4692711 - DNA, 16 bp, Homo sapiens
cctgcaggttgggcca

SEQ ID NO: 4692712 - DNA, 17 bp, Homo sapiens
cctgcaggttgggccat

SEQ ID NO: 4692713 - DNA, 21 bp, Homo sapiens
cctgcatatctctagtccctg

SEQ ID NO: 4692714 - DNA, 18 bp, Homo sapiens
cctgcattggaactggag

SEQ ID NO: 4692715 - DNA, 10 bp, Homo sapiens
cctgcatttt

SEQ ID NO: 4692716 - DNA, 15 bp, Homo sapiens
cctgccaccacgccc

SEQ ID NO: 4692717 - DNA, 19 bp, Homo sapiens
cctgccaccacgcccggct

SEQ ID NO: 4692718 - DNA, 13 bp, Homo sapiens
cctgccaccctgg

SEQ ID NO: 4692719 - DNA, 17 bp, Homo sapiens
cctgccacctcctgcct

SEQ ID NO: 4692720 - DNA, 17 bp, Homo sapiens
cctgccacctggacccc

SEQ ID NO: 4692721 - DNA, 21 bp, Homo sapiens
cctgccacctggacccctgca

SEQ ID NO: 4692722 - DNA, 15 bp, Homo sapiens
cctgccagggacaga

SEQ ID NO: 4692723 - DNA, 16 bp, Homo sapiens
cctgccagggacagag

SEQ ID NO: 4692724 - DNA, 13 bp, Homo sapiens
cctgccagggcag

SEQ ID NO: 4692725 - DNA, 13 bp, Homo sapiens
cctgcccacctgg

SEQ ID NO: 4692726 - DNA, 22 bp, Homo sapiens
cctgcccagttgcactcaggtg

SEQ ID NO: 4692727 - DNA, 16 bp, Homo sapiens
cctgcccccaatccat

SEQ ID NO: 4692728 - DNA, 12 bp, Homo sapiens
cctgcccccagg

SEQ ID NO: 4692729 - DNA, 17 bp, Homo sapiens
cctgcccccaggactgg

SEQ ID NO: 4692730 - DNA, 19 bp, Homo sapiens
cctgcccccaggactgggc

SEQ ID NO: 4692731 - DNA, 20 bp, Homo sapiens
cctgcccccaggactgggcc

SEQ ID NO: 4692732 - DNA, 22 bp, Homo sapiens
cctgcccccaggactgggccac

SEQ ID NO: 4692733 - DNA, 16 bp, Homo sapiens
cctgccccctgcagga

SEQ ID NO: 4692734 - DNA, 19 bp, Homo sapiens
cctgccccctgcaggaagg

SEQ ID NO: 4692735 - DNA, 13 bp, Homo sapiens
ccccaagcctggc

SEQ ID NO: 4692736 - DNA, 13 bp, Homo sapiens
ccccacagcccac

SEQ ID NO: 4692737 - DNA, 14 bp, Homo sapiens
ccccacccaagggc

SEQ ID NO: 4692738 - DNA, 14 bp, Homo sapiens
ccccacccacttct

SEQ ID NO: 4692739 - DNA, 14 bp, Homo sapiens
ccccaccccagggc

SEQ ID NO: 4692740 - DNA, 20 bp, Homo sapiens
ccccaccccagggcagccag

SEQ ID NO: 4692741 - DNA, 18 bp, Homo sapiens
ccccaccccttgctctca

SEQ ID NO: 4692742 - DNA, 22 bp, Homo sapiens
ccccacccggtggttcttcctg

SEQ ID NO: 4692743 - DNA, 15 bp, Homo sapiens
ccccaccgcagacag

SEQ ID NO: 4692744 - DNA, 12 bp, Homo sapiens
ccccactctgtg

SEQ ID NO: 4692745 - DNA, 14 bp, Homo sapiens
ccccactggtgaca

SEQ ID NO: 4692746 - DNA, 15 bp, Homo sapiens
ccccactttctttct

SEQ ID NO: 4692747 - DNA, 22 bp, Homo sapiens
ccccagattgcaacaggctggg

SEQ ID NO: 4692748 - DNA, 13 bp, Homo sapiens
ccccagcactgag

SEQ ID NO: 4692749 - DNA, 16 bp, Homo sapiens
ccccagcactgaggaa

SEQ ID NO: 4692750 - DNA, 12 bp, Homo sapiens
ccccagccccaa

SEQ ID NO: 4692751 - DNA, 11 bp, Homo sapiens
ccccagcctaa

SEQ ID NO: 4692752 - DNA, 13 bp, Homo sapiens
ccccagcctgcta

SEQ ID NO: 4692753 - DNA, 22 bp, Homo sapiens
cagtgatatggcagaagacacc

SEQ ID NO: 4692754 - DNA, 23 bp, Homo sapiens
cagtgatatggtactaaggagaa

SEQ ID NO: 4692755 - DNA, 16 bp, Homo sapiens
cagtgatttacatgct

SEQ ID NO: 4692756 - DNA, 20 bp, Homo sapiens
cagtgccagcccctgctggc

SEQ ID NO: 4692757 - DNA, 12 bp, Homo sapiens
cagtgcccacag

SEQ ID NO: 4692758 - DNA, 19 bp, Homo sapiens
cagtgccgccgcctcgccc

SEQ ID NO: 4692759 - DNA, 15 bp, Homo sapiens
cagtgcctattgata

SEQ ID NO: 4692760 - DNA, 13 bp, Homo sapiens
cagtgctgcatgc

SEQ ID NO: 4692761 - DNA, 18 bp, Homo sapiens
cagtgcttgccacagagc

SEQ ID NO: 4692762 - DNA, 14 bp, Homo sapiens
cagtggcagctgct

SEQ ID NO: 4692763 - DNA, 16 bp, Homo sapiens
cagtggcagctgcttt

SEQ ID NO: 4692764 - DNA, 13 bp, Homo sapiens
cagtggctgctgc

SEQ ID NO: 4692765 - DNA, 18 bp, Homo sapiens
cagtggctgctgcccagg

SEQ ID NO: 4692766 - DNA, 17 bp, Homo sapiens
cagtgggtcccacttcc

SEQ ID NO: 4692767 - DNA, 16 bp, Homo sapiens
cagtgggttaattttg

SEQ ID NO: 4692768 - DNA, 17 bp, Homo sapiens
cagtgtacccccgccca

SEQ ID NO: 4692769 - DNA, 22 bp, Homo sapiens
cagtgtccaaagcagggtctgg

SEQ ID NO: 4692770 - DNA, 23 bp, Homo sapiens
cagtgtctgtgttttgaaagaat

SEQ ID NO: 4692771 - DNA, 16 bp, Homo sapiens
cagtgtcttcctgtgg

SEQ ID NO: 4692772 - DNA, 17 bp, Homo sapiens
cagtgtcttcctgtggg

SEQ ID NO: 4692773 - DNA, 14 bp, Homo sapiens
cagtgtgacaagga

SEQ ID NO: 4692774 - DNA, 19 bp, Homo sapiens
cagtgtgaggccagggcag

SEQ ID NO: 4692775 - DNA, 17 bp, Homo sapiens
cagtgtgccccccatcc

SEQ ID NO: 4692776 - DNA, 20 bp, Homo sapiens
cagtgtgccccccatcctgg

SEQ ID NO: 4692777 - DNA, 17 bp, Homo sapiens
cagtgtgtggtcaacat

SEQ ID NO: 4692778 - DNA, 13 bp, Homo sapiens
cagtgtttatgac

SEQ ID NO: 4692779 - DNA, 17 bp, Homo sapiens
cagtgtttgatttttat

SEQ ID NO: 4692780 - DNA, 12 bp, Homo sapiens
cagtgtttgtat

SEQ ID NO: 4692781 - DNA, 15 bp, Homo sapiens
cagtgtttgtatacc

SEQ ID NO: 4692782 - DNA, 21 bp, Homo sapiens
cagtgtttttagacctgtgtt

SEQ ID NO: 4692783 - DNA, 15 bp, Homo sapiens
cagttaaaaaaaatt

SEQ ID NO: 4692784 - DNA, 15 bp, Homo sapiens
cagttcataaatttg

SEQ ID NO: 4692785 - DNA, 20 bp, Homo sapiens
cagttctgctctaagaagct

SEQ ID NO: 4692786 - DNA, 21 bp, Homo sapiens
cagttcttcccccttcacata

SEQ ID NO: 4692787 - DNA, 16 bp, Homo sapiens
cagttcttgtgtggtt

SEQ ID NO: 4692788 - DNA, 19 bp, Homo sapiens
cagttggtcccccttccat

SEQ ID NO: 4692789 - DNA, 21 bp, Homo sapiens
cagttggtcccccttccatgg

SEQ ID NO: 4692790 - DNA, 15 bp, Homo sapiens
cagtttctgtcctgc

SEQ ID NO: 4692791 - DNA, 18 bp, Homo sapiens
cagtttcttagcttttta

SEQ ID NO: 4692792 - DNA, 21 bp, Homo sapiens
ccagcaagtgagagctgggtg

SEQ ID NO: 4692793 - DNA, 17 bp, Homo sapiens
ccagcacccgggctcag

SEQ ID NO: 4692794 - DNA, 18 bp, Homo sapiens
ccagcacccgggctcagg

SEQ ID NO: 4692795 - DNA, 21 bp, Homo sapiens
ccagcaccggaccagcctggc

SEQ ID NO: 4692796 - DNA, 15 bp, Homo sapiens
ccagcactgaggaag

SEQ ID NO: 4692797 - DNA, 15 bp, Homo sapiens
ccagcactgcttgag

SEQ ID NO: 4692798 - DNA, 12 bp, Homo sapiens
ccagcagagcac

SEQ ID NO: 4692799 - DNA, 23 bp, Homo sapiens
ccagcagagcaccttagacagtc

SEQ ID NO: 4692800 - DNA, 15 bp, Homo sapiens
ccagcatcccttgac

SEQ ID NO: 4692801 - DNA, 12 bp, Homo sapiens
ccagccactgga

SEQ ID NO: 4692802 - DNA, 19 bp, Homo sapiens
ccagccccaaaactctcct

SEQ ID NO: 4692803 - DNA, 14 bp, Homo sapiens
ccagccccacagcc

SEQ ID NO: 4692804 - DNA, 19 bp, Homo sapiens
ccagccccacagcccacgt

SEQ ID NO: 4692805 - DNA, 21 bp, Homo sapiens
ccagccccacagcccacgtcc

SEQ ID NO: 4692806 - DNA, 22 bp, Homo sapiens
ccagccccacagcccacgtcct

SEQ ID NO: 4692807 - DNA, 16 bp, Homo sapiens
ccagccccagtgccca

SEQ ID NO: 4692808 - DNA, 15 bp, Homo sapiens
ccagccccatcctct

SEQ ID NO: 4692809 - DNA, 15 bp, Homo sapiens
ccagcccctgctggc

SEQ ID NO: 4692810 - DNA, 18 bp, Homo sapiens
ccagcccctggatgcagc

SEQ ID NO: 4692811 - DNA, 16 bp, Homo sapiens
ccagccccttctgacc

SEQ ID NO: 4692812 - DNA, 18 bp, Homo sapiens
ccagccccttctgaccca

SEQ ID NO: 4692813 - DNA, 14 bp, Homo sapiens
ccagccctcatccc

SEQ ID NO: 4692814 - DNA, 21 bp, Homo sapiens
ccagccctggctgaaggactg

SEQ ID NO: 4692815 - DNA, 17 bp, Homo sapiens
ccagcccttagcaggga

SEQ ID NO: 4692816 - DNA, 20 bp, Homo sapiens
ccacacccccaccccttgct

SEQ ID NO: 4692817 - DNA, 13 bp, Homo sapiens
ccacacctgcggc

SEQ ID NO: 4692818 - DNA, 15 bp, Homo sapiens
ccacagacctgctct

SEQ ID NO: 4692819 - DNA, 18 bp, Homo sapiens
ccacagacctgctctgga

SEQ ID NO: 4692820 - DNA, 20 bp, Homo sapiens
ccacagcaaggcacctgcag

SEQ ID NO: 4692821 - DNA, 17 bp, Homo sapiens
ccacagcccacgtcctg

SEQ ID NO: 4692822 - DNA, 21 bp, Homo sapiens
ccacagcccacgtcctgtcag

SEQ ID NO: 4692823 - DNA, 20 bp, Homo sapiens
ccacagcctcccctgccagg

SEQ ID NO: 4692824 - DNA, 14 bp, Homo sapiens
ccacagctgctcaa

SEQ ID NO: 4692825 - DNA, 17 bp, Homo sapiens
ccacaggaagtgaagaa

SEQ ID NO: 4692826 - DNA, 21 bp, Homo sapiens
ccacaggacatttctctaaga

SEQ ID NO: 4692827 - DNA, 14 bp, Homo sapiens
ccacaggcctgaga

SEQ ID NO: 4692828 - DNA, 21 bp, Homo sapiens
ccacagtgactcgggctcctg

SEQ ID NO: 4692829 - DNA, 23 bp, Homo sapiens
ccacagtgactcgggctcctgtg

SEQ ID NO: 4692830 - DNA, 20 bp, Homo sapiens
ccacagtggaaccagcccag

SEQ ID NO: 4692831 - DNA, 13 bp, Homo sapiens
ccacatcctccac

SEQ ID NO: 4692832 - DNA, 17 bp, Homo sapiens
ccacatcttgctctgct

SEQ ID NO: 4692833 - DNA, 20 bp, Homo sapiens
ccacatcttgctctgctgac

SEQ ID NO: 4692834 - DNA, 19 bp, Homo sapiens
ccacatgccaagcactgtg

SEQ ID NO: 4692835 - DNA, 19 bp, Homo sapiens
ccacatttagtcctgtact

SEQ ID NO: 4692836 - DNA, 22 bp, Homo sapiens
ccaccacctgctcactggtcaa

SEQ ID NO: 4692837 - DNA, 16 bp, Homo sapiens
ccaccagaagcaggcc

SEQ ID NO: 4692838 - DNA, 13 bp, Homo sapiens
ccaccatcaagcc

SEQ ID NO: 4692839 - DNA, 21 bp, Homo sapiens
ccacccaagggcctggcctga

SEQ ID NO: 4692840 - DNA, 18 bp, Homo sapiens
ccaccccagggcagccag

SEQ ID NO: 4692841 - DNA, 17 bp, Homo sapiens
ctgctgggtgtggcgca

SEQ ID NO: 4692842 - DNA, 21 bp, Homo sapiens
ctgctggttaacttgtttggc

SEQ ID NO: 4692843 - DNA, 18 bp, Homo sapiens
ctgctgtcccctcttgcc

SEQ ID NO: 4692844 - DNA, 20 bp, Homo sapiens
ctgctgtcccctcttgcccc

SEQ ID NO: 4692845 - DNA, 22 bp, Homo sapiens
ctgctgtcccctcttgccccaa

SEQ ID NO: 4692846 - DNA, 23 bp, Homo sapiens
ctgcttaaaaggtataattaaac

SEQ ID NO: 4692847 - DNA, 12 bp, Homo sapiens
ctgcttgaggaa

SEQ ID NO: 4692848 - DNA, 13 bp, Homo sapiens
ctgcttgaggaaa

SEQ ID NO: 4692849 - DNA, 17 bp, Homo sapiens
ctgcttttcattagcag

SEQ ID NO: 4692850 - DNA, 18 bp, Homo sapiens
ctgcttttcattagcagt

SEQ ID NO: 4692851 - DNA, 23 bp, Homo sapiens
ctgcttttcattagcagttgctc

SEQ ID NO: 4692852 - DNA, 15 bp, Homo sapiens
ctgcttttggtctgt

SEQ ID NO: 4692853 - DNA, 20 bp, Homo sapiens
ctggaaccaggcttgcctgg

SEQ ID NO: 4692854 - DNA, 21 bp, Homo sapiens
ctggaactcagtgtgactcct

SEQ ID NO: 4692855 - DNA, 13 bp, Homo sapiens
ctggaagacagag

SEQ ID NO: 4692856 - DNA, 21 bp, Homo sapiens
ctggaagacagagacctcctg

SEQ ID NO: 4692857 - DNA, 14 bp, Homo sapiens
ctggaagcacagct

SEQ ID NO: 4692858 - DNA, 22 bp, Homo sapiens
ctggaaggcagcttgtggaggc

SEQ ID NO: 4692859 - DNA, 20 bp, Homo sapiens
ctggaaggtggggacaggga

SEQ ID NO: 4692860 - DNA, 15 bp, Homo sapiens
ctggaagtgactttg

SEQ ID NO: 4692861 - DNA, 23 bp, Homo sapiens
ctggaataatcctaaacatatga

SEQ ID NO: 4692862 - DNA, 19 bp, Homo sapiens
ctggaatctggagagctag

SEQ ID NO: 4692863 - DNA, 18 bp, Homo sapiens
ctggacaccacccagagc

SEQ ID NO: 4692864 - DNA, 17 bp, Homo sapiens
ctggacaggcatgttct

SEQ ID NO: 4692865 - DNA, 23 bp, Homo sapiens
ctggacatgaagattctttccca

SEQ ID NO: 4692866 - DNA, 20 bp, Homo sapiens
ctggacccgttcatggggga

SEQ ID NO: 4692867 - DNA, 13 bp, Homo sapiens
ctggactcaggaa

SEQ ID NO: 4692868 - DNA, 19 bp, Homo sapiens
ctggactctcagtctctga

SEQ ID NO: 4692869 - DNA, 13 bp, Homo sapiens
ctggactgaggcc

SEQ ID NO: 4692870 - DNA, 18 bp, Homo sapiens
ctggacttggcccctgcc

SEQ ID NO: 4692871 - DNA, 18 bp, Homo sapiens
ctggagactcctaggcag

SEQ ID NO: 4692872 - DNA, 23 bp, Homo sapiens
ctggagagccagaacctggaggg

SEQ ID NO: 4692873 - DNA, 16 bp, Homo sapiens
ctggagagtggcaaaa

SEQ ID NO: 4692874 - DNA, 18 bp, Homo sapiens
ctggagccactaactaga

SEQ ID NO: 4692875 - DNA, 21 bp, Homo sapiens
ctggagcccagaggagggcag

SEQ ID NO: 4692876 - DNA, 21 bp, Homo sapiens
ctggaggactagaacctggag

SEQ ID NO: 4692877 - DNA, 14 bp, Homo sapiens
ctggaggagcccag

SEQ ID NO: 4692878 - DNA, 19 bp, Homo sapiens
ctggaggagcccaggccag

SEQ ID NO: 4692879 - DNA, 19 bp, Homo sapiens
ctggagggaatgaacctgg

SEQ ID NO: 4692880 - DNA, 19 bp, Homo sapiens
ctggagggctagaatctgg

SEQ ID NO: 4692881 - DNA, 21 bp, Homo sapiens
ctggaggggctagaacctaga

SEQ ID NO: 4692882 - DNA, 17 bp, Homo sapiens
ctggaggggtgttgtat

SEQ ID NO: 4692883 - DNA, 20 bp, Homo sapiens
ctggagtcatgccaagcatt

SEQ ID NO: 4692884 - DNA, 20 bp, Homo sapiens
ctggagtgcagtgagccgag

SEQ ID NO: 4692885 - DNA, 16 bp, Homo sapiens
ctggatgcagcctcac

SEQ ID NO: 4692886 - DNA, 17 bp, Homo sapiens
ctggatgcagcctcaca

SEQ ID NO: 4692887 - DNA, 22 bp, Homo sapiens
ctggatgcagcctcacagtcct

SEQ ID NO: 4692888 - DNA, 16 bp, Homo sapiens
ctggatggggctgcac

SEQ ID NO: 4692889 - DNA, 15 bp, Homo sapiens
ctggatgggggctct

SEQ ID NO: 4692890 - DNA, 14 bp, Homo sapiens
ctggattcccagga

SEQ ID NO: 4692891 - DNA, 12 bp, Homo sapiens
ctggattttgaa

SEQ ID NO: 4692892 - DNA, 18 bp, Homo sapiens
ctggcaaggacacagatg

SEQ ID NO: 4692893 - DNA, 18 bp, Homo sapiens
ctggcacccggcccctgc

SEQ ID NO: 4692894 - DNA, 19 bp, Homo sapiens
ctggcacccggcccctgct

SEQ ID NO: 4692895 - DNA, 21 bp, Homo sapiens
ctggcacccggcccctgctgg

SEQ ID NO: 4692896 - DNA, 14 bp, Homo sapiens
ctggcactgcttcc

SEQ ID NO: 4692897 - DNA, 15 bp, Homo sapiens
ctggcactgcttcca

SEQ ID NO: 4692898 - DNA, 17 bp, Homo sapiens
ctggcactgcttccagt

SEQ ID NO: 4692899 - DNA, 18 bp, Homo sapiens
ctggcactgcttccagtg

SEQ ID NO: 4692900 - DNA, 20 bp, Homo sapiens
ctggcactgcttccagtgag

SEQ ID NO: 4692901 - DNA, 12 bp, Homo sapiens
ctggcagctcag

SEQ ID NO: 4692902 - DNA, 13 bp, Homo sapiens
ctggcagctcaga

SEQ ID NO: 4692903 - DNA, 16 bp, Homo sapiens
ctggcagctcagagag

SEQ ID NO: 4692904 - DNA, 17 bp, Homo sapiens
ctggcagctcagagagg

SEQ ID NO: 4692905 - DNA, 19 bp, Homo sapiens
ctggcagtggaactaagaa

SEQ ID NO: 4692906 - DNA, 18 bp, Homo sapiens
ctggccaacatggcgaaa

SEQ ID NO: 4692907 - DNA, 20 bp, Homo sapiens
ctggccaccaccccccactc

SEQ ID NO: 4692908 - DNA, 18 bp, Homo sapiens
ctggccagatgtcgctgg

SEQ ID NO: 4692909 - DNA, 18 bp, Homo sapiens
ctggccagccccacagcc

SEQ ID NO: 4692910 - DNA, 20 bp, Homo sapiens
ctggccagccccacagccca

SEQ ID NO: 4692911 - DNA, 15 bp, Homo sapiens
ctggccagggcctgg

SEQ ID NO: 4692912 - DNA, 13 bp, Homo sapiens
ctggcccagctcc

SEQ ID NO: 4692913 - DNA, 14 bp, Homo sapiens
ctggcccagctccc

SEQ ID NO: 4692914 - DNA, 22 bp, Homo sapiens
ctggcccagctcccccgggagg

SEQ ID NO: 4692915 - DNA, 13 bp, Homo sapiens
ctggcccctcagg

SEQ ID NO: 4692916 - DNA, 17 bp, Homo sapiens
ctggcccctcagggtcc

SEQ ID NO: 4692917 - DNA, 18 bp, Homo sapiens
ctggcccctcagggtccc

SEQ ID NO: 4692918 - DNA, 21 bp, Homo sapiens
ctggcccctcagggtccctgg

SEQ ID NO: 4692919 - DNA, 22 bp, Homo sapiens
ctggcccctcagggtccctggt

SEQ ID NO: 4692920 - DNA, 16 bp, Homo sapiens
ctggccctcaaggcct

SEQ ID NO: 4692921 - DNA, 22 bp, Homo sapiens
ctggccctcaaggcctcccaca

SEQ ID NO: 4692922 - DNA, 22 bp, Homo sapiens
ctggccgggaccccgagcctgg

SEQ ID NO: 4692923 - DNA, 16 bp, Homo sapiens
ctggccgggagcctga

SEQ ID NO: 4692924 - DNA, 23 bp, Homo sapiens
ctggcctagtcccttccacaccc

SEQ ID NO: 4692925 - DNA, 23 bp, Homo sapiens
ctggcctcaagtgattctcctgc

SEQ ID NO: 4692926 - DNA, 14 bp, Homo sapiens
ctggcctcccccac

SEQ ID NO: 4692927 - DNA, 15 bp, Homo sapiens
ctggcctcccccact

SEQ ID NO: 4692928 - DNA, 16 bp, Homo sapiens
ctggcctctctgacat

SEQ ID NO: 4692929 - DNA, 16 bp, Homo sapiens
cctgcccggctgcgga

SEQ ID NO: 4692930 - DNA, 14 bp, Homo sapiens
cctgccctgtgggc

SEQ ID NO: 4692931 - DNA, 15 bp, Homo sapiens
cctgccctgtgggcc

SEQ ID NO: 4692932 - DNA, 12 bp, Homo sapiens
cctgcctccagg

SEQ ID NO: 4692933 - DNA, 17 bp, Homo sapiens
cctgcctccagggctgg

SEQ ID NO: 4692934 - DNA, 13 bp, Homo sapiens
cctgcctcctttg

SEQ ID NO: 4692935 - DNA, 21 bp, Homo sapiens
cctgcctcctttgtgaggaag

SEQ ID NO: 4692936 - DNA, 22 bp, Homo sapiens
cctgcctcctttgtgaggaagc

SEQ ID NO: 4692937 - DNA, 14 bp, Homo sapiens
cccggccacctgcg

SEQ ID NO: 4692938 - DNA, 20 bp, Homo sapiens
cccggctaatttttgtattt

SEQ ID NO: 4692939 - DNA, 13 bp, Homo sapiens
cccggctccaggc

SEQ ID NO: 4692940 - DNA, 12 bp, Homo sapiens
cccggctgccct

SEQ ID NO: 4692941 - DNA, 12 bp, Homo sapiens
cccggctgcgga

SEQ ID NO: 4692942 - DNA, 13 bp, Homo sapiens
cccggctgggccc

SEQ ID NO: 4692943 - DNA, 12 bp, Homo sapiens
cccgggaagggg

SEQ ID NO: 4692944 - DNA, 15 bp, Homo sapiens
cccgggaagggggct

SEQ ID NO: 4692945 - DNA, 18 bp, Homo sapiens
cccgggaagggggctggg

SEQ ID NO: 4692946 - DNA, 21 bp, Homo sapiens
cccgggaagggggctgggaca

SEQ ID NO: 4692947 - DNA, 22 bp, Homo sapiens
cccgggaagggggctgggacat

SEQ ID NO: 4692948 - DNA, 17 bp, Homo sapiens
cccgggaggggcccgct

SEQ ID NO: 4692949 - DNA, 17 bp, Homo sapiens
cccgtcgacgtagaacc

SEQ ID NO: 4692950 - DNA, 13 bp, Homo sapiens
cccgtggccccag

SEQ ID NO: 4692951 - DNA, 22 bp, Homo sapiens
cccgtggccccagcctggccca

SEQ ID NO: 4692952 - DNA, 20 bp, Homo sapiens
ccctaaggcatgtgtgaaac

SEQ ID NO: 4692953 - DNA, 16 bp, Homo sapiens
ctgggaaatattccct

SEQ ID NO: 4692954 - DNA, 11 bp, Homo sapiens
ctgggacacag

SEQ ID NO: 4692955 - DNA, 12 bp, Homo sapiens
ctgggacacagt

SEQ ID NO: 4692956 - DNA, 16 bp, Homo sapiens
ctgggactacaggcac

SEQ ID NO: 4692957 - DNA, 21 bp, Homo sapiens
ctgggactacaggcacccacc

SEQ ID NO: 4692958 - DNA, 17 bp, Homo sapiens
ctgggactacaggtgtg

SEQ ID NO: 4692959 - DNA, 18 bp, Homo sapiens
ctgggacttgcaaaaagg

SEQ ID NO: 4692960 - DNA, 15 bp, Homo sapiens
ctgggagaaagacca

SEQ ID NO: 4692961 - DNA, 22 bp, Homo sapiens
ctgggagaaagaccatgcattt

SEQ ID NO: 4692962 - DNA, 22 bp, Homo sapiens
ctgggagagacttggatgagga

SEQ ID NO: 4692963 - DNA, 13 bp, Homo sapiens
ctgggagccaggg

SEQ ID NO: 4692964 - DNA, 20 bp, Homo sapiens
ctgggatccctcatcctcat

SEQ ID NO: 4692965 - DNA, 24 bp, Homo sapiens
ctgggatgataataatgcctacct

SEQ ID NO: 4692966 - DNA, 14 bp, Homo sapiens
ctgggatgtttctg

SEQ ID NO: 4692967 - DNA, 16 bp, Homo sapiens
ctgggattacaggtgt

SEQ ID NO: 4692968 - DNA, 17 bp, Homo sapiens
ctgggatttacacttga

SEQ ID NO: 4692969 - DNA, 21 bp, Homo sapiens
ctgggcaaggaggccacgtga

SEQ ID NO: 4692970 - DNA, 18 bp, Homo sapiens
ctgggcagacattatgta

SEQ ID NO: 4692971 - DNA, 23 bp, Homo sapiens
ctgggcatagatgcaggtgagcc

SEQ ID NO: 4692972 - DNA, 19 bp, Homo sapiens
ctgggccccagttgtattt

SEQ ID NO: 4692973 - DNA, 15 bp, Homo sapiens
ctgggccctctctgc

SEQ ID NO: 4692974 - DNA, 20 bp, Homo sapiens
ctgggctcccttcccacctc

SEQ ID NO: 4692975 - DNA, 14 bp, Homo sapiens
ctgggctctgtggg

SEQ ID NO: 4692976 - DNA, 15 bp, Homo sapiens
ctgggctctgtgggc

SEQ ID NO: 4692977 - DNA, 20 bp, Homo sapiens
ctgggctctgtgggctgcac

SEQ ID NO: 4692978 - DNA, 13 bp, Homo sapiens
ctgggctgaggga

SEQ ID NO: 4692979 - DNA, 18 bp, Homo sapiens
ctgggctgagggagcctg

SEQ ID NO: 4692980 - DNA, 22 bp, Homo sapiens
ctgggcttcagtggcagctgct

SEQ ID NO: 4692981 - DNA, 15 bp, Homo sapiens
ctggggaacctgacc

SEQ ID NO: 4692982 - DNA, 13 bp, Homo sapiens
ctggggagaaagt

SEQ ID NO: 4692983 - DNA, 17 bp, Homo sapiens
ctggggcctatcagtgt

SEQ ID NO: 4692984 - DNA, 21 bp, Homo sapiens
ctggggcctatcagtgtgccc

SEQ ID NO: 4692985 - DNA, 22 bp, Homo sapiens
ctggggcctatcagtgtgcccc

SEQ ID NO: 4692986 - DNA, 16 bp, Homo sapiens
ctggggctgctggcct

SEQ ID NO: 4692987 - DNA, 13 bp, Homo sapiens
ctgggggcctcag

SEQ ID NO: 4692988 - DNA, 18 bp, Homo sapiens
ctgggggcctcagtgcca

SEQ ID NO: 4692989 - DNA, 18 bp, Homo sapiens
ctgggggcggccagccct

SEQ ID NO: 4692990 - DNA, 14 bp, Homo sapiens
ctgggggctcctca

SEQ ID NO: 4692991 - DNA, 19 bp, Homo sapiens
ctgggggtgccaggaccag

SEQ ID NO: 4692992 - DNA, 21 bp, Homo sapiens
ctggggtaccaagagactcct

SEQ ID NO: 4692993 - DNA, 21 bp, Homo sapiens
ctgggtacttgtggacacagc

SEQ ID NO: 4692994 - DNA, 23 bp, Homo sapiens
ctgggtacttgtggacacagctc

SEQ ID NO: 4692995 - DNA, 20 bp, Homo sapiens
ctgggtccaggcctggccat

SEQ ID NO: 4692996 - DNA, 14 bp, Homo sapiens
ctgggtcctctgca

SEQ ID NO: 4692997 - DNA, 15 bp, Homo sapiens
ctgggtggcactgcc

SEQ ID NO: 4692998 - DNA, 12 bp, Homo sapiens
ctgggtggccca

SEQ ID NO: 4692999 - DNA, 14 bp, Homo sapiens
ctgggtggcccatc

SEQ ID NO: 4693000 - DNA, 15 bp, Homo sapiens
ctgggtggggcagtg

SEQ ID NO: 4693001 - DNA, 21 bp, Homo sapiens
ctgggttagggtgtgtgttca

SEQ ID NO: 4693002 - DNA, 18 bp, Homo sapiens
ctgggttccttcctctga

SEQ ID NO: 4693003 - DNA, 22 bp, Homo sapiens
ctgggttccttcctctgagcct

SEQ ID NO: 4693004 - DNA, 15 bp, Homo sapiens
ctgggttggagggtg

SEQ ID NO: 4693005 - DNA, 16 bp, Homo sapiens
ctgggttggcgcaccc

SEQ ID NO: 4693006 - DNA, 23 bp, Homo sapiens
ctggtatctgcatgtaaaatctt

SEQ ID NO: 4693007 - DNA, 14 bp, Homo sapiens
ctggtattcctgcc

SEQ ID NO: 4693008 - DNA, 15 bp, Homo sapiens
ctggtattcctgcct

SEQ ID NO: 4693009 - DNA, 14 bp, Homo sapiens
ctggtattttatct

SEQ ID NO: 4693010 - DNA, 17 bp, Homo sapiens
ctggtccatagagagca

SEQ ID NO: 4693011 - DNA, 18 bp, Homo sapiens
ctggtccatagagagcaa

SEQ ID NO: 4693012 - DNA, 18 bp, Homo sapiens
ctggtcccactcagtcca

SEQ ID NO: 4693013 - DNA, 14 bp, Homo sapiens
ctggtctctaggct

SEQ ID NO: 4693014 - DNA, 17 bp, Homo sapiens
ctggtctctaggctggg

SEQ ID NO: 4693015 - DNA, 15 bp, Homo sapiens
ctggtgactttcctc

SEQ ID NO: 4693016 - DNA, 23 bp, Homo sapiens
ctggtgactttcctctttggtct

SEQ ID NO: 4693017 - DNA, 23 bp, Homo sapiens
ctggtgccctaacctctgagtca

SEQ ID NO: 4693018 - DNA, 15 bp, Homo sapiens
ctggtgcctgagccc

SEQ ID NO: 4693019 - DNA, 21 bp, Homo sapiens
ctggtgcctgagcccctcaga

SEQ ID NO: 4693020 - DNA, 14 bp, Homo sapiens
ctggtgctgcctct

SEQ ID NO: 4693021 - DNA, 17 bp, Homo sapiens
ctggtggatggtgactt

SEQ ID NO: 4693022 - DNA, 12 bp, Homo sapiens
ctggtggcagct

SEQ ID NO: 4693023 - DNA, 14 bp, Homo sapiens
ctggtggcagctca

SEQ ID NO: 4693024 - DNA, 17 bp, Homo sapiens
ctggtggcagctcacct

SEQ ID NO: 4693025 - DNA, 20 bp, Homo sapiens
ctggtggcagctcacctctc

SEQ ID NO: 4693026 - DNA, 14 bp, Homo sapiens
ctggtggcagtggg

SEQ ID NO: 4693027 - DNA, 24 bp, Homo sapiens
ctggtggggcccatggaggagaca

SEQ ID NO: 4693028 - DNA, 21 bp, Homo sapiens
ctggttagaggttccctttga

SEQ ID NO: 4693029 - DNA, 22 bp, Homo sapiens
ctggttagaggttccctttgac

SEQ ID NO: 4693030 - DNA, 12 bp, Homo sapiens
ctggttctcatc

SEQ ID NO: 4693031 - DNA, 15 bp, Homo sapiens
ctggttctcatcttt

SEQ ID NO: 4693032 - DNA, 23 bp, Homo sapiens
ctggttctgatgatgtgcctggg

SEQ ID NO: 4693033 - DNA, 13 bp, Homo sapiens
ctggtttcctgcc

SEQ ID NO: 4693034 - DNA, 14 bp, Homo sapiens
ctggtttttcagtt

SEQ ID NO: 4693035 - DNA, 15 bp, Homo sapiens
ctgtaaaacaggtta

SEQ ID NO: 4693036 - DNA, 12 bp, Homo sapiens
ctgtaaagatgt

SEQ ID NO: 4693037 - DNA, 21 bp, Homo sapiens
ctgtaaagatgtttatttcag

SEQ ID NO: 4693038 - DNA, 13 bp, Homo sapiens
ctgtaaatagtga

SEQ ID NO: 4693039 - DNA, 15 bp, Homo sapiens
ctgtaacctcttcag

SEQ ID NO: 4693040 - DNA, 19 bp, Homo sapiens
ctgtaacctcttcagaggc

SEQ ID NO: 4693041 - DNA, 20 bp, Homo sapiens
ctgtaacttccaaataaata

SEQ ID NO: 4693042 - DNA, 16 bp, Homo sapiens
ctgtaatattgtaaat

SEQ ID NO: 4693043 - DNA, 22 bp, Homo sapiens
ctgtaatattgtaaatactgga

SEQ ID NO: 4693044 - DNA, 14 bp, Homo sapiens
ctgtaccaaatctg

SEQ ID NO: 4693045 - DNA, 15 bp, Homo sapiens
ctgtacgtctgacag

SEQ ID NO: 4693046 - DNA, 24 bp, Homo sapiens
ctgtagggtaattagtaacatgtg

SEQ ID NO: 4693047 - DNA, 14 bp, Homo sapiens
ctgtataaatagga

SEQ ID NO: 4693048 - DNA, 16 bp, Homo sapiens
ctgtataaataggaga

SEQ ID NO: 4693049 - DNA, 14 bp, Homo sapiens
ctgtatattcagga

SEQ ID NO: 4693050 - DNA, 22 bp, Homo sapiens
ctgtatcaggacccagaggaag

SEQ ID NO: 4693051 - DNA, 23 bp, Homo sapiens
ctgtatcaggacccagaggaagg

SEQ ID NO: 4693052 - DNA, 20 bp, Homo sapiens
ctgtatcccatgagcctcag

SEQ ID NO: 4693053 - DNA, 21 bp, Homo sapiens
ctgtatcccatgagcctcagc

SEQ ID NO: 4693054 - DNA, 20 bp, Homo sapiens
ctgtattttgtattgtttca

SEQ ID NO: 4693055 - DNA, 14 bp, Homo sapiens
ctgtcaggattgcg

SEQ ID NO: 4693056 - DNA, 18 bp, Homo sapiens
ctgtcagtgccgccgcct

SEQ ID NO: 4693057 - DNA, 23 bp, Homo sapiens
ctgtcattcccaccaccctgagg

SEQ ID NO: 4693058 - DNA, 16 bp, Homo sapiens
ctgtcatttgagcagg

SEQ ID NO: 4693059 - DNA, 20 bp, Homo sapiens
ctgtcatttgagcagggctc

SEQ ID NO: 4693060 - DNA, 19 bp, Homo sapiens
ctgtcccaagctcccaaga

SEQ ID NO: 4693061 - DNA, 16 bp, Homo sapiens
ctgtcccctcttgccc

SEQ ID NO: 4693062 - DNA, 17 bp, Homo sapiens
ctgtcccctcttgcccc

SEQ ID NO: 4693063 - DNA, 19 bp, Homo sapiens
ctgtcccctcttgccccaa

SEQ ID NO: 4693064 - DNA, 23 bp, Homo sapiens
gacagcccgggctctgcctccca

SEQ ID NO: 4693065 - DNA, 16 bp, Homo sapiens
gacagccgggaggagc

SEQ ID NO: 4693066 - DNA, 20 bp, Homo sapiens
gacagcctccccctgtcccc

SEQ ID NO: 4693067 - DNA, 15 bp, Homo sapiens
gacagctccttctgt

SEQ ID NO: 4693068 - DNA, 19 bp, Homo sapiens
gacagctccttctgtccta

SEQ ID NO: 4693069 - DNA, 15 bp, Homo sapiens
gacagctgcctggga

SEQ ID NO: 4693070 - DNA, 16 bp, Homo sapiens
gacagctgcctgggat

SEQ ID NO: 4693071 - DNA, 18 bp, Homo sapiens
gacagctgcctgggatcc

SEQ ID NO: 4693072 - DNA, 14 bp, Homo sapiens
gacaggaccaggga

SEQ ID NO: 4693073 - DNA, 15 bp, Homo sapiens
gacaggaccagggat

SEQ ID NO: 4693074 - DNA, 18 bp, Homo sapiens
gacaggcaagcacctcct

SEQ ID NO: 4693075 - DNA, 13 bp, Homo sapiens
gacaggcagcaga

SEQ ID NO: 4693076 - DNA, 14 bp, Homo sapiens
gacaggcagcagag

SEQ ID NO: 4693077 - DNA, 13 bp, Homo sapiens
gacaggctggtgc

SEQ ID NO: 4693078 - DNA, 15 bp, Homo sapiens
gacaggctggtgcta

SEQ ID NO: 4693079 - DNA, 14 bp, Homo sapiens
gacagggatgagca

SEQ ID NO: 4693080 - DNA, 23 bp, Homo sapiens
gacagggatgagcatggagctgg

SEQ ID NO: 4693081 - DNA, 24 bp, Homo sapiens
gacagggcacaccgggcactcaga

SEQ ID NO: 4693082 - DNA, 14 bp, Homo sapiens
gacagtcaccccag

SEQ ID NO: 4693083 - DNA, 16 bp, Homo sapiens
gacagtcaccccagga

SEQ ID NO: 4693084 - DNA, 15 bp, Homo sapiens
gacagtccagcctgg

SEQ ID NO: 4693085 - DNA, 19 bp, Homo sapiens
gacagtccagcctggagat

SEQ ID NO: 4693086 - DNA, 14 bp, Homo sapiens
gacagtccctgcca

SEQ ID NO: 4693087 - DNA, 15 bp, Homo sapiens
gacagtccctgccaa

SEQ ID NO: 4693088 - DNA, 16 bp, Homo sapiens
gacagtcctctccacc

SEQ ID NO: 4693089 - DNA, 22 bp, Homo sapiens
gacagtctttgatcatcatgta

SEQ ID NO: 4693090 - DNA, 14 bp, Homo sapiens
gacagtgaaagaaa

SEQ ID NO: 4693091 - DNA, 20 bp, Homo sapiens
gacagtgttccccgatacca

SEQ ID NO: 4693092 - DNA, 21 bp, Homo sapiens
gacagtgttccccgataccat

SEQ ID NO: 4693093 - DNA, 14 bp, Homo sapiens
gacataacgttttt

SEQ ID NO: 4693094 - DNA, 22 bp, Homo sapiens
gacataacgtttttcctttaaa

SEQ ID NO: 4693095 - DNA, 23 bp, Homo sapiens
gacataacgtttttcctttaaaa

SEQ ID NO: 4693096 - DNA, 23 bp, Homo sapiens
gacatccatgttccgagaagaac

SEQ ID NO: 4693097 - DNA, 20 bp, Homo sapiens
gacatgaagattctttccca

SEQ ID NO: 4693098 - DNA, 14 bp, Homo sapiens
gacatgctgaagcc

SEQ ID NO: 4693099 - DNA, 19 bp, Homo sapiens
gacatgctgaagccaaagc

SEQ ID NO: 4693100 - DNA, 18 bp, Homo sapiens
gacatgggaaaggggaag

SEQ ID NO: 4693101 - DNA, 21 bp, Homo sapiens
gacatgtcttttcttgcatga

SEQ ID NO: 4693102 - DNA, 18 bp, Homo sapiens
gacatgtgaaaccttttt

SEQ ID NO: 4693103 - DNA, 23 bp, Homo sapiens
gacattaaaaatgttagtatttt

SEQ ID NO: 4693104 - DNA, 17 bp, Homo sapiens
gacattgcggacagcca

SEQ ID NO: 4693105 - DNA, 16 bp, Homo sapiens
gacatttctctaagag

SEQ ID NO: 4693106 - DNA, 11 bp, Homo sapiens
gacattttcat

SEQ ID NO: 4693107 - DNA, 18 bp, Homo sapiens
gacattttcatgcttcca

SEQ ID NO: 4693108 - DNA, 19 bp, Homo sapiens
gaccaaaatccccttctca

SEQ ID NO: 4693109 - DNA, 17 bp, Homo sapiens
gaccaaacctagcccct

SEQ ID NO: 4693110 - DNA, 21 bp, Homo sapiens
gaccaagggatgggacctgat

SEQ ID NO: 4693111 - DNA, 21 bp, Homo sapiens
gaccacagcaaggcacctgca

SEQ ID NO: 4693112 - DNA, 16 bp, Homo sapiens
gaccaccacctcagag

SEQ ID NO: 4693113 - DNA, 23 bp, Homo sapiens
gaccacctagtctgtaactcttt

SEQ ID NO: 4693114 - DNA, 21 bp, Homo sapiens
gaccagacaccttgacagggc

SEQ ID NO: 4693115 - DNA, 23 bp, Homo sapiens
gaccagacaccttgacagggcac

SEQ ID NO: 4693116 - DNA, 24 bp, Homo sapiens
gaccagacaccttgacagggcaca

SEQ ID NO: 4693117 - DNA, 18 bp, Homo sapiens
gaccagcctggccaacat

SEQ ID NO: 4693118 - DNA, 16 bp, Homo sapiens
gaccagcctggcccac

SEQ ID NO: 4693119 - DNA, 22 bp, Homo sapiens
gaccagcttttcccaaaagccc

SEQ ID NO: 4693120 - DNA, 13 bp, Homo sapiens
gaccaggcctggg

SEQ ID NO: 4693121 - DNA, 18 bp, Homo sapiens
gaccagtcaacctgggca

SEQ ID NO: 4693122 - DNA, 19 bp, Homo sapiens
gaccagtttaacctgatgc

SEQ ID NO: 4693123 - DNA, 15 bp, Homo sapiens
gaccatccctgaagg

SEQ ID NO: 4693124 - DNA, 16 bp, Homo sapiens
gaccatccctgaaggc

SEQ ID NO: 4693125 - DNA, 19 bp, Homo sapiens
gaccatccctgaaggcccc

SEQ ID NO: 4693126 - DNA, 20 bp, Homo sapiens
gaccattctccacctgccag

SEQ ID NO: 4693127 - DNA, 21 bp, Homo sapiens
gaccattctccacctgccagg

SEQ ID NO: 4693128 - DNA, 22 bp, Homo sapiens
gaccattctccacctgccaggg

SEQ ID NO: 4693129 - DNA, 13 bp, Homo sapiens
gacccaggagccg

SEQ ID NO: 4693130 - DNA, 14 bp, Homo sapiens
gacccaggctgggc

SEQ ID NO: 4693131 - DNA, 15 bp, Homo sapiens
gacccaggctgggca

SEQ ID NO: 4693132 - DNA, 13 bp, Homo sapiens
gacccagggccta

SEQ ID NO: 4693133 - DNA, 14 bp, Homo sapiens
gacccatgctgccc

SEQ ID NO: 4693134 - DNA, 15 bp, Homo sapiens
gacccatgctgccct

SEQ ID NO: 4693135 - DNA, 16 bp, Homo sapiens
gacccatgctgccctg

SEQ ID NO: 4693136 - DNA, 12 bp, Homo sapiens
gacccatgttca

SEQ ID NO: 4693137 - DNA, 16 bp, Homo sapiens
gaccccacccctcatc

SEQ ID NO: 4693138 - DNA, 18 bp, Homo sapiens
gaccccagatgtgagggc

SEQ ID NO: 4693139 - DNA, 18 bp, Homo sapiens
gaccccatctgcccagga

SEQ ID NO: 4693140 - DNA, 20 bp, Homo sapiens
gaccccgagcctggctccaa

SEQ ID NO: 4693141 - DNA, 14 bp, Homo sapiens
gacccctccatgtg

SEQ ID NO: 4693142 - DNA, 18 bp, Homo sapiens
gaccccttttcagcttct

SEQ ID NO: 4693143 - DNA, 12 bp, Homo sapiens
gacccggctgcg

SEQ ID NO: 4693144 - DNA, 13 bp, Homo sapiens
gacccggctgcgt

SEQ ID NO: 4693145 - DNA, 19 bp, Homo sapiens
gacccgttcatgggggagg

SEQ ID NO: 4693146 - DNA, 16 bp, Homo sapiens
gaccctaaatcttgac

SEQ ID NO: 4693147 - DNA, 17 bp, Homo sapiens
gaccctcgtttgatagt

SEQ ID NO: 4693148 - DNA, 20 bp, Homo sapiens
gaccctctcaggctgtccca

SEQ ID NO: 4693149 - DNA, 11 bp, Homo sapiens
gaccctgaggc

SEQ ID NO: 4693150 - DNA, 18 bp, Homo sapiens
gaccctgaggcccagagg

SEQ ID NO: 4693151 - DNA, 16 bp, Homo sapiens
gaccctgccctgtggg

SEQ ID NO: 4693152 - DNA, 19 bp, Homo sapiens
gacccttgccgtctacctg

SEQ ID NO: 4693153 - DNA, 14 bp, Homo sapiens
gacctacagtgctg

SEQ ID NO: 4693154 - DNA, 17 bp, Homo sapiens
gacctagctgttgtaaa

SEQ ID NO: 4693155 - DNA, 19 bp, Homo sapiens
gacctagctgttgtaaaga

SEQ ID NO: 4693156 - DNA, 19 bp, Homo sapiens
gacctcaggtgatccaccc

SEQ ID NO: 4693157 - DNA, 13 bp, Homo sapiens
gacctctcttgtg

SEQ ID NO: 4693158 - DNA, 11 bp, Homo sapiens
gacctgaggcc

SEQ ID NO: 4693159 - DNA, 21 bp, Homo sapiens
gacctgaggcccttctctcca

SEQ ID NO: 4693160 - DNA, 14 bp, Homo sapiens
gacctgatggagag

SEQ ID NO: 4693161 - DNA, 21 bp, Homo sapiens
gacctgcccctcctctctgcc

SEQ ID NO: 4693162 - DNA, 19 bp, Homo sapiens
gacctgcctcggcctccca

SEQ ID NO: 4693163 - DNA, 18 bp, Homo sapiens
gacctggcaaggacacag

SEQ ID NO: 4693164 - DNA, 19 bp, Homo sapiens
gacctgtggtgcaaaagca

SEQ ID NO: 4693165 - DNA, 15 bp, Homo sapiens
gaccttctccttcac

SEQ ID NO: 4693166 - DNA, 21 bp, Homo sapiens
gaccttctccttcacctttgt

SEQ ID NO: 4693167 - DNA, 17 bp, Homo sapiens
gaccttctgagaggggc

SEQ ID NO: 4693168 - DNA, 14 bp, Homo sapiens
gacgcagcctgaga

SEQ ID NO: 4693169 - DNA, 17 bp, Homo sapiens
gacgcaggcccctctcc

SEQ ID NO: 4693170 - DNA, 14 bp, Homo sapiens
gacgccacccagca

SEQ ID NO: 4693171 - DNA, 12 bp, Homo sapiens
gacgccatccca

SEQ ID NO: 4693172 - DNA, 18 bp, Homo sapiens
gacgccatcccagcccca

SEQ ID NO: 4693173 - DNA, 18 bp, Homo sapiens
gacgccgcgcactcagcc

SEQ ID NO: 4693174 - DNA, 15 bp, Homo sapiens
ctcttatgggctggg

SEQ ID NO: 4693175 - DNA, 13 bp, Homo sapiens
ctcttattgccca

SEQ ID NO: 4693176 - DNA, 15 bp, Homo sapiens
ctcttattgcccacg

SEQ ID NO: 4693177 - DNA, 15 bp, Homo sapiens
ctcttcataattcta

SEQ ID NO: 4693178 - DNA, 19 bp, Homo sapiens
ctcttctcatttcacccct

SEQ ID NO: 4693179 - DNA, 13 bp, Homo sapiens
ctcttctccaggc

SEQ ID NO: 4693180 - DNA, 16 bp, Homo sapiens
ctcttctccccagagt

SEQ ID NO: 4693181 - DNA, 21 bp, Homo sapiens
ctcttctgggagggcagcagg

SEQ ID NO: 4693182 - DNA, 14 bp, Homo sapiens
ctcttcttctttct

SEQ ID NO: 4693183 - DNA, 23 bp, Homo sapiens
ctcttgccccaacccccagcacc

SEQ ID NO: 4693184 - DNA, 21 bp, Homo sapiens
ctcttgggttcaagcgattct

SEQ ID NO: 4693185 - DNA, 13 bp, Homo sapiens
ctcttggtcctgc

SEQ ID NO: 4693186 - DNA, 18 bp, Homo sapiens
ctcttggtcctgctgcag

SEQ ID NO: 4693187 - DNA, 21 bp, Homo sapiens
ctcttgtaatccgaatctctt

SEQ ID NO: 4693188 - DNA, 18 bp, Homo sapiens
ctctttaatgtcacaggc

SEQ ID NO: 4693189 - DNA, 21 bp, Homo sapiens
ctctttaatgtcacaggcagg

SEQ ID NO: 4693190 - DNA, 23 bp, Homo sapiens
ctctttaatgtcacaggcaggtc

SEQ ID NO: 4693191 - DNA, 14 bp, Homo sapiens
ctctttgtttttct

SEQ ID NO: 4693192 - DNA, 23 bp, Homo sapiens
ctgaaaacccaggccacaaatgt

SEQ ID NO: 4693193 - DNA, 13 bp, Homo sapiens
ctgaaaatataac

SEQ ID NO: 4693194 - DNA, 16 bp, Homo sapiens
ctgaaaattaacactg

SEQ ID NO: 4693195 - DNA, 17 bp, Homo sapiens
ctgaaaattaacactgc

SEQ ID NO: 4693196 - DNA, 22 bp, Homo sapiens
ctgaaattaatttgtgaatttg

SEQ ID NO: 4693197 - DNA, 18 bp, Homo sapiens
ctgaaatttctcattagt

SEQ ID NO: 4693198 - DNA, 18 bp, Homo sapiens
ctgaactttcattggatt

SEQ ID NO: 4693199 - DNA, 18 bp, Homo sapiens
ctgaagaaatctttccag

SEQ ID NO: 4693200 - DNA, 23 bp, Homo sapiens
ctgaagacaccgttcattcaggc

SEQ ID NO: 4693201 - DNA, 21 bp, Homo sapiens
ctgaagaccccagatgtgagg

SEQ ID NO: 4693202 - DNA, 23 bp, Homo sapiens
ctgaagaccccagatgtgagggc

SEQ ID NO: 4693203 - DNA, 23 bp, Homo sapiens
ctgaagatataactattgcccag

SEQ ID NO: 4693204 - DNA, 22 bp, Homo sapiens
ctgaagatcccaacatggtcct

SEQ ID NO: 4693205 - DNA, 23 bp, Homo sapiens
ctgaagatcccaacatggtccta

SEQ ID NO: 4693206 - DNA, 21 bp, Homo sapiens
ctgaaggacattgcggacagc

SEQ ID NO: 4693207 - DNA, 14 bp, Homo sapiens
ctgaaggactgtga

SEQ ID NO: 4693208 - DNA, 15 bp, Homo sapiens
ctgaaggactgtgac

SEQ ID NO: 4693209 - DNA, 23 bp, Homo sapiens
ctgaaggactgtgacaggcagca

SEQ ID NO: 4693210 - DNA, 13 bp, Homo sapiens
ctgaaggagcccc

SEQ ID NO: 4693211 - DNA, 18 bp, Homo sapiens
ctgaaggccccgcccagg

SEQ ID NO: 4693212 - DNA, 17 bp, Homo sapiens
ctgaaggctgggttctg

SEQ ID NO: 4693213 - DNA, 14 bp, Homo sapiens
ctgaagtcacacag

SEQ ID NO: 4693214 - DNA, 16 bp, Homo sapiens
ctgaagtcacacagtg

SEQ ID NO: 4693215 - DNA, 16 bp, Homo sapiens
ctgaagtcttgcattg

SEQ ID NO: 4693216 - DNA, 18 bp, Homo sapiens
ctgaagtcttgcattgaa

SEQ ID NO: 4693217 - DNA, 19 bp, Homo sapiens
ctgaagtcttgcattgaat

SEQ ID NO: 4693218 - DNA, 13 bp, Homo sapiens
ctgaataaaccag

SEQ ID NO: 4693219 - DNA, 19 bp, Homo sapiens
ctgaatatgaggcatttgg

SEQ ID NO: 4693220 - DNA, 20 bp, Homo sapiens
ctgaatattaagaaacaatt

SEQ ID NO: 4693221 - DNA, 16 bp, Homo sapiens
ctgaatctccttgttg

SEQ ID NO: 4693222 - DNA, 17 bp, Homo sapiens
ctgaatctgctaccaaa

SEQ ID NO: 4693223 - DNA, 22 bp, Homo sapiens
ctgaatgaagccttctgacctg

SEQ ID NO: 4693224 - DNA, 22 bp, Homo sapiens
ctgaatgcttataggtggcctc

SEQ ID NO: 4693225 - DNA, 20 bp, Homo sapiens
ctgaatgtaaaagaaaattt

SEQ ID NO: 4693226 - DNA, 15 bp, Homo sapiens
ctgaatgtcattatt

SEQ ID NO: 4693227 - DNA, 20 bp, Homo sapiens
ctgaatgtcattatttgata

SEQ ID NO: 4693228 - DNA, 15 bp, Homo sapiens
ctgacaaatgtgtat

SEQ ID NO: 4693229 - DNA, 15 bp, Homo sapiens
ctgacaacagcctga

SEQ ID NO: 4693230 - DNA, 17 bp, Homo sapiens
ctgacaacagcctgaga

SEQ ID NO: 4693231 - DNA, 19 bp, Homo sapiens
ctgacaatgcgtggcacat

SEQ ID NO: 4693232 - DNA, 19 bp, Homo sapiens
ctgacacaaacctgcctgg

SEQ ID NO: 4693233 - DNA, 18 bp, Homo sapiens
ctgacacacagctctgtc

SEQ ID NO: 4693234 - DNA, 22 bp, Homo sapiens
ctgacacacagctctgtcctgg

SEQ ID NO: 4693235 - DNA, 17 bp, Homo sapiens
ctgacactcccttgggc

SEQ ID NO: 4693236 - DNA, 14 bp, Homo sapiens
ctgacagacacagg

SEQ ID NO: 4693237 - DNA, 17 bp, Homo sapiens
ctgacagacagccctcc

SEQ ID NO: 4693238 - DNA, 15 bp, Homo sapiens
ctgacagcactcctc

SEQ ID NO: 4693239 - DNA, 20 bp, Homo sapiens
ctgacaggcaatgctggctg

SEQ ID NO: 4693240 - DNA, 21 bp, Homo sapiens
ctgacagtcctctccacctag

SEQ ID NO: 4693241 - DNA, 16 bp, Homo sapiens
ctgacatattatgcct

SEQ ID NO: 4693242 - DNA, 22 bp, Homo sapiens
ctgacattgttggccaaagcca

SEQ ID NO: 4693243 - DNA, 21 bp, Homo sapiens
ctgacatttggagtgttcccc

SEQ ID NO: 4693244 - DNA, 23 bp, Homo sapiens
ctgaccagtttaacctgatgcag

SEQ ID NO: 4693245 - DNA, 17 bp, Homo sapiens
ctgacccacagcctcca

SEQ ID NO: 4693246 - DNA, 13 bp, Homo sapiens
ctgacccatgctg

SEQ ID NO: 4693247 - DNA, 18 bp, Homo sapiens
ctgacgcagcctgagaat

SEQ ID NO: 4693248 - DNA, 20 bp, Homo sapiens
ctgacgccgcgcactcagcc

SEQ ID NO: 4693249 - DNA, 14 bp, Homo sapiens
ctgactcagggctc

SEQ ID NO: 4693250 - DNA, 15 bp, Homo sapiens
ctgactcagggctcc

SEQ ID NO: 4693251 - DNA, 16 bp, Homo sapiens
ctgactcattctgaag

SEQ ID NO: 4693252 - DNA, 14 bp, Homo sapiens
ctgactccttctgc

SEQ ID NO: 4693253 - DNA, 17 bp, Homo sapiens
ctgactctaaaatatgg

SEQ ID NO: 4693254 - DNA, 17 bp, Homo sapiens
ctgagaatgtaagaact

SEQ ID NO: 4693255 - DNA, 16 bp, Homo sapiens
ctgagacagcccgggc

SEQ ID NO: 4693256 - DNA, 17 bp, Homo sapiens
ctgagactctcttagga

SEQ ID NO: 4693257 - DNA, 21 bp, Homo sapiens
ctgagagctgggctttcctct

SEQ ID NO: 4693258 - DNA, 17 bp, Homo sapiens
ctgagatgcaaatgtca

SEQ ID NO: 4693259 - DNA, 21 bp, Homo sapiens
ctgagatgcaaatgtcacagt

SEQ ID NO: 4693260 - DNA, 18 bp, Homo sapiens
ctgagatgttttaccatc

SEQ ID NO: 4693261 - DNA, 15 bp, Homo sapiens
ctgagatttcatctg

SEQ ID NO: 4693262 - DNA, 18 bp, Homo sapiens
ctgagatttcatctgctc

SEQ ID NO: 4693263 - DNA, 20 bp, Homo sapiens
ctgagatttcatctgctctc

SEQ ID NO: 4693264 - DNA, 22 bp, Homo sapiens
ctgagatttcatctgctctcct

SEQ ID NO: 4693265 - DNA, 16 bp, Homo sapiens
ctgagcctcagtctcc

SEQ ID NO: 4693266 - DNA, 21 bp, Homo sapiens
ctgagcctcagtctccctccc

SEQ ID NO: 4693267 - DNA, 20 bp, Homo sapiens
ctgagcgaggagatgctcct

SEQ ID NO: 4693268 - DNA, 19 bp, Homo sapiens
ctgagctagaagctggagg

SEQ ID NO: 4693269 - DNA, 22 bp, Homo sapiens
ctgagctgggatgattggaggg

SEQ ID NO: 4693270 - DNA, 13 bp, Homo sapiens
ctgagctgtgcag

SEQ ID NO: 4693271 - DNA, 14 bp, Homo sapiens
ctgagctgttatct

SEQ ID NO: 4693272 - DNA, 15 bp, Homo sapiens
ctgccacctggaccc

SEQ ID NO: 4693273 - DNA, 22 bp, Homo sapiens
ctgccacctggacccctgcatt

SEQ ID NO: 4693274 - DNA, 21 bp, Homo sapiens
ctgccagccccgccacgcttg

SEQ ID NO: 4693275 - DNA, 11 bp, Homo sapiens
ctgccagggac

SEQ ID NO: 4693276 - DNA, 12 bp, Homo sapiens
ctgccagggaca

SEQ ID NO: 4693277 - DNA, 23 bp, Homo sapiens
ctgccagggacagagggggtggc

SEQ ID NO: 4693278 - DNA, 11 bp, Homo sapiens
ctgccagggca

SEQ ID NO: 4693279 - DNA, 15 bp, Homo sapiens
ctgccagggcagggc

SEQ ID NO: 4693280 - DNA, 22 bp, Homo sapiens
ctgccatattctgttggccagt

SEQ ID NO: 4693281 - DNA, 15 bp, Homo sapiens
ctgccatgcagggcc

SEQ ID NO: 4693282 - DNA, 16 bp, Homo sapiens
ctgccatgcagggcct

SEQ ID NO: 4693283 - DNA, 17 bp, Homo sapiens
ctgccatgcagggcctc

SEQ ID NO: 4693284 - DNA, 19 bp, Homo sapiens
ctgcccaaattatgtgaaa

SEQ ID NO: 4693285 - DNA, 23 bp, Homo sapiens
gaaatggactgactgtaacgatt

SEQ ID NO: 4693286 - DNA, 21 bp, Homo sapiens
gaaatggaggatctctaaaga

SEQ ID NO: 4693287 - DNA, 24 bp, Homo sapiens
gaaatggaggatctctaaagagca

SEQ ID NO: 4693288 - DNA, 23 bp, Homo sapiens
gaaatggcttttcccaaccccca

SEQ ID NO: 4693289 - DNA, 14 bp, Homo sapiens
gaaatgggcagagc

SEQ ID NO: 4693290 - DNA, 16 bp, Homo sapiens
gaaatgggcagagcag

SEQ ID NO: 4693291 - DNA, 19 bp, Homo sapiens
gaaatgggcagagcagaga

SEQ ID NO: 4693292 - DNA, 15 bp, Homo sapiens
gaaattacctgtgga

SEQ ID NO: 4693293 - DNA, 19 bp, Homo sapiens
gaaattacctgtggatatt

SEQ ID NO: 4693294 - DNA, 22 bp, Homo sapiens
gaaattcccttcatctggaacc

SEQ ID NO: 4693295 - DNA, 15 bp, Homo sapiens
gaaattgattttgaa

SEQ ID NO: 4693296 - DNA, 21 bp, Homo sapiens
gaacaatgtgctatgtgaaga

SEQ ID NO: 4693297 - DNA, 16 bp, Homo sapiens
gaacactccttcacag

SEQ ID NO: 4693298 - DNA, 22 bp, Homo sapiens
gaacagactggaagcacagctt

SEQ ID NO: 4693299 - DNA, 14 bp, Homo sapiens
gaacagcttcaggt

SEQ ID NO: 4693300 - DNA, 19 bp, Homo sapiens
gaacagtctctggaagaag

SEQ ID NO: 4693301 - DNA, 18 bp, Homo sapiens
gaacatatcatttgtgaa

SEQ ID NO: 4693302 - DNA, 20 bp, Homo sapiens
gaacatcatcaaggcactgc

SEQ ID NO: 4693303 - DNA, 19 bp, Homo sapiens
gaacatgcagctctgcagc

SEQ ID NO: 4693304 - DNA, 23 bp, Homo sapiens
gaacatttaataatgtatgtaca

SEQ ID NO: 4693305 - DNA, 16 bp, Homo sapiens
gaaccaccacacccag

SEQ ID NO: 4693306 - DNA, 18 bp, Homo sapiens
gaaccaccacacccagcc

SEQ ID NO: 4693307 - DNA, 20 bp, Homo sapiens
gaaccaccacacccagccca

SEQ ID NO: 4693308 - DNA, 22 bp, Homo sapiens
gaaccaccacacccagcccact

SEQ ID NO: 4693309 - DNA, 23 bp, Homo sapiens
gaaccaccacacccagcccactt

SEQ ID NO: 4693310 - DNA, 13 bp, Homo sapiens
gaaccatttgcaa

SEQ ID NO: 4693311 - DNA, 15 bp, Homo sapiens
gaaccgctgaatatg

SEQ ID NO: 4693312 - DNA, 18 bp, Homo sapiens
gaacctacagttttaact

SEQ ID NO: 4693313 - DNA, 20 bp, Homo sapiens
gaacctgatgaaaataaaga

SEQ ID NO: 4693314 - DNA, 16 bp, Homo sapiens
gaacctggagggctag

SEQ ID NO: 4693315 - DNA, 21 bp, Homo sapiens
gaacctggagggctggaatct

SEQ ID NO: 4693316 - DNA, 13 bp, Homo sapiens
gaacctggagggg

SEQ ID NO: 4693317 - DNA, 16 bp, Homo sapiens
gaacctggaggggcta

SEQ ID NO: 4693318 - DNA, 19 bp, Homo sapiens
gaacggggctcttctcatt

SEQ ID NO: 4693319 - DNA, 22 bp, Homo sapiens
gaacggggctcttctcatttca

SEQ ID NO: 4693320 - DNA, 19 bp, Homo sapiens
gaactagccttatttctca

SEQ ID NO: 4693321 - DNA, 14 bp, Homo sapiens
gagtacgttaaaag

SEQ ID NO: 4693322 - DNA, 15 bp, Homo sapiens
gagtactacagtcct

SEQ ID NO: 4693323 - DNA, 18 bp, Homo sapiens
gagtactacagtcctccc

SEQ ID NO: 4693324 - DNA, 23 bp, Homo sapiens
gagtactacagtcctcccatctc

SEQ ID NO: 4693325 - DNA, 17 bp, Homo sapiens
gagtagaaagacagagc

SEQ ID NO: 4693326 - DNA, 20 bp, Homo sapiens
gagtagaaagacagagctgg

SEQ ID NO: 4693327 - DNA, 22 bp, Homo sapiens
gagtagaaagacagagctggga

SEQ ID NO: 4693328 - DNA, 16 bp, Homo sapiens
gagtataggccggtct

SEQ ID NO: 4693329 - DNA, 13 bp, Homo sapiens
gagtatttggtaa

SEQ ID NO: 4693330 - DNA, 13 bp, Homo sapiens
gagtcaatttgct

SEQ ID NO: 4693331 - DNA, 20 bp, Homo sapiens
gagtcccaccttggctgcag

SEQ ID NO: 4693332 - DNA, 21 bp, Homo sapiens
gagtcccaccttggctgcagg

SEQ ID NO: 4693333 - DNA, 18 bp, Homo sapiens
gagtcccaggctgagcct

SEQ ID NO: 4693334 - DNA, 23 bp, Homo sapiens
gagtcccctgtttgtttctgaaa

SEQ ID NO: 4693335 - DNA, 15 bp, Homo sapiens
gagtctgaaggctgg

SEQ ID NO: 4693336 - DNA, 12 bp, Homo sapiens
gagtctgtcctg

SEQ ID NO: 4693337 - DNA, 16 bp, Homo sapiens
gagtgacagaggcagc

SEQ ID NO: 4693338 - DNA, 17 bp, Homo sapiens
gagtgacagaggcagcc

SEQ ID NO: 4693339 - DNA, 19 bp, Homo sapiens
gagtgagactccacctcaa

SEQ ID NO: 4693340 - DNA, 14 bp, Homo sapiens
gagtgagactctgt

SEQ ID NO: 4693341 - DNA, 12 bp, Homo sapiens
gagtgagctggt

SEQ ID NO: 4693342 - DNA, 17 bp, Homo sapiens
gagtgcagtcctgatca

SEQ ID NO: 4693343 - DNA, 22 bp, Homo sapiens
gagtgcagtcctgatcagagcc

SEQ ID NO: 4693344 - DNA, 18 bp, Homo sapiens
gagtgcagtgagccgaga

SEQ ID NO: 4693345 - DNA, 14 bp, Homo sapiens
gagtgcgtgctcag

SEQ ID NO: 4693346 - DNA, 14 bp, Homo sapiens
gagtgctaaatttt

SEQ ID NO: 4693347 - DNA, 11 bp, Homo sapiens
gagtggcatgt

SEQ ID NO: 4693348 - DNA, 21 bp, Homo sapiens
gagtggttgggctgtgcctgg

SEQ ID NO: 4693349 - DNA, 15 bp, Homo sapiens
gagtgtagaagcatt

SEQ ID NO: 4693350 - DNA, 16 bp, Homo sapiens
gagtgtgtaaggtata

SEQ ID NO: 4693351 - DNA, 19 bp, Homo sapiens
gagtgttccccttccactg

SEQ ID NO: 4693352 - DNA, 16 bp, Homo sapiens
gagttaagaagctgtt

SEQ ID NO: 4693353 - DNA, 22 bp, Homo sapiens
gagttcagcctttaagatacct

SEQ ID NO: 4693354 - DNA, 18 bp, Homo sapiens
gagttccccatgcagaca

SEQ ID NO: 4693355 - DNA, 15 bp, Homo sapiens
gagttcgtgaagagg

SEQ ID NO: 4693356 - DNA, 22 bp, Homo sapiens
gagttctttgcaagcttattta

SEQ ID NO: 4693357 - DNA, 14 bp, Homo sapiens
gagttgatgtctcc

SEQ ID NO: 4693358 - DNA, 20 bp, Homo sapiens
gagtttgagaccagcctggc

SEQ ID NO: 4693359 - DNA, 12 bp, Homo sapiens
gagtttggtccc

SEQ ID NO: 4693360 - DNA, 12 bp, Homo sapiens
gagttttcttat

SEQ ID NO: 4693361 - DNA, 13 bp, Homo sapiens
gagttttcttata

SEQ ID NO: 4693362 - DNA, 22 bp, Homo sapiens
gataaaaacctgaactttcatt

SEQ ID NO: 4693363 - DNA, 21 bp, Homo sapiens
gataaaaagatgttcagtcat

SEQ ID NO: 4693364 - DNA, 16 bp, Homo sapiens
gataaagcagctcagg

SEQ ID NO: 4693365 - DNA, 17 bp, Homo sapiens
gataacaacctggagac

SEQ ID NO: 4693366 - DNA, 16 bp, Homo sapiens
gataaccttgaaaaaa

SEQ ID NO: 4693367 - DNA, 22 bp, Homo sapiens
gataagagtagaaactgcaggg

SEQ ID NO: 4693368 - DNA, 21 bp, Homo sapiens
gataaggaaacacttctattt

SEQ ID NO: 4693369 - DNA, 15 bp, Homo sapiens
gataatacagatttg

SEQ ID NO: 4693370 - DNA, 19 bp, Homo sapiens
gataatacagatttgtaac

SEQ ID NO: 4693371 - DNA, 19 bp, Homo sapiens
gataatattcattggttaa

SEQ ID NO: 4693372 - DNA, 15 bp, Homo sapiens
gataatcttttacat

SEQ ID NO: 4693373 - DNA, 13 bp, Homo sapiens
gataatgtattgc

SEQ ID NO: 4693374 - DNA, 11 bp, Homo sapiens
gataatgttaa

SEQ ID NO: 4693375 - DNA, 12 bp, Homo sapiens
gataatgttaaa

SEQ ID NO: 4693376 - DNA, 18 bp, Homo sapiens
gataattctagctttgag

SEQ ID NO: 4693377 - DNA, 18 bp, Homo sapiens
gatacaggaaaagctgct

SEQ ID NO: 4693378 - DNA, 19 bp, Homo sapiens
gatacaggaaaagctgctg

SEQ ID NO: 4693379 - DNA, 20 bp, Homo sapiens
gatacaggaaaagctgctga

SEQ ID NO: 4693380 - DNA, 21 bp, Homo sapiens
gatacaggaaaagctgctgac

SEQ ID NO: 4693381 - DNA, 23 bp, Homo sapiens
gatacaggaaaagctgctgacag

SEQ ID NO: 4693382 - DNA, 14 bp, Homo sapiens
gatacagtcattat

SEQ ID NO: 4693383 - DNA, 22 bp, Homo sapiens
gataccagcgaggaggctccag

SEQ ID NO: 4693384 - DNA, 17 bp, Homo sapiens
gatacgacaacttgcac

SEQ ID NO: 4693385 - DNA, 16 bp, Homo sapiens
gatacgatagttacat

SEQ ID NO: 4693386 - DNA, 13 bp, Homo sapiens
gatactaaggacg

SEQ ID NO: 4693387 - DNA, 15 bp, Homo sapiens
gatactgttgcacgt

SEQ ID NO: 4693388 - DNA, 18 bp, Homo sapiens
gatactgttgcacgtgtg

SEQ ID NO: 4693389 - DNA, 16 bp, Homo sapiens
gatagcacagaccctg

SEQ ID NO: 4693390 - DNA, 17 bp, Homo sapiens
gatagcacagaccctgc

SEQ ID NO: 4693391 - DNA, 18 bp, Homo sapiens
gatagcacagaccctgcc

SEQ ID NO: 4693392 - DNA, 20 bp, Homo sapiens
gatagcacagaccctgccct

SEQ ID NO: 4693393 - DNA, 21 bp, Homo sapiens
gatagggatacatgctcttag

SEQ ID NO: 4693394 - DNA, 17 bp, Homo sapiens
gataggtcagtgcaaat

SEQ ID NO: 4693395 - DNA, 12 bp, Homo sapiens
gatatagaacag

SEQ ID NO: 4693396 - DNA, 15 bp, Homo sapiens
gatatggcagaagac

SEQ ID NO: 4693397 - DNA, 22 bp, Homo sapiens
gatatgttaaatgtatagctgg

SEQ ID NO: 4693398 - DNA, 15 bp, Homo sapiens
gatattcagatgtat

SEQ ID NO: 4693399 - DNA, 17 bp, Homo sapiens
gatattcagatgtatgt

SEQ ID NO: 4693400 - DNA, 20 bp, Homo sapiens
gatatttaaaagacaaacac

SEQ ID NO: 4693401 - DNA, 18 bp, Homo sapiens
gatatttatgtatcttga

SEQ ID NO: 4693402 - DNA, 17 bp, Homo sapiens
gatatttgatatttggt

SEQ ID NO: 4693403 - DNA, 12 bp, Homo sapiens
gatcaaagatga

SEQ ID NO: 4693404 - DNA, 18 bp, Homo sapiens
gatcaaagatgaaaagta

SEQ ID NO: 4693405 - DNA, 17 bp, Homo sapiens
gatcaacatcttttctt

SEQ ID NO: 4693406 - DNA, 21 bp, Homo sapiens
gatcaaccccttcgctcctgt

SEQ ID NO: 4693407 - DNA, 23 bp, Homo sapiens
gatcaaccccttcgctcctgtgt

SEQ ID NO: 4693408 - DNA, 16 bp, Homo sapiens
gatcaaggagaggagg

SEQ ID NO: 4693409 - DNA, 13 bp, Homo sapiens
gatcacgccactg

SEQ ID NO: 4693410 - DNA, 14 bp, Homo sapiens
gatcacgccactgc

SEQ ID NO: 4693411 - DNA, 15 bp, Homo sapiens
gatcacgccactgca

SEQ ID NO: 4693412 - DNA, 16 bp, Homo sapiens
gatcacggctcactgc

SEQ ID NO: 4693413 - DNA, 20 bp, Homo sapiens
gatcacggctcactgcagcc

SEQ ID NO: 4693414 - DNA, 13 bp, Homo sapiens
gatcactgagcca

SEQ ID NO: 4693415 - DNA, 13 bp, Homo sapiens
gatcactgtgctt

SEQ ID NO: 4693416 - DNA, 17 bp, Homo sapiens
gatcaggcagtgtttaa

SEQ ID NO: 4693417 - DNA, 15 bp, Homo sapiens
gatcatcatgtagaa

SEQ ID NO: 4693418 - DNA, 13 bp, Homo sapiens
gatcatccactgt

SEQ ID NO: 4693419 - DNA, 17 bp, Homo sapiens
gatcatccactgtgcca

SEQ ID NO: 4693420 - DNA, 13 bp, Homo sapiens
gatcatctttgct

SEQ ID NO: 4693421 - DNA, 19 bp, Homo sapiens
gatcatctttgctgaatgt

SEQ ID NO: 4693422 - DNA, 18 bp, Homo sapiens
gatcatggtgtaataaga

SEQ ID NO: 4693423 - DNA, 21 bp, Homo sapiens
gatcatggtgtaataagacat

SEQ ID NO: 4693424 - DNA, 21 bp, Homo sapiens
gatccaagctggtcccactca

SEQ ID NO: 4693425 - DNA, 23 bp, Homo sapiens
gatccaataattttcctgtgaca

SEQ ID NO: 4693426 - DNA, 18 bp, Homo sapiens
gatccacccacctcagcc

SEQ ID NO: 4693427 - DNA, 21 bp, Homo sapiens
gatccacccacctcagcctcc

SEQ ID NO: 4693428 - DNA, 16 bp, Homo sapiens
gatccagtataagact

SEQ ID NO: 4693429 - DNA, 14 bp, Homo sapiens
gatccccagctgtt

SEQ ID NO: 4693430 - DNA, 15 bp, Homo sapiens
gatccctcatcctca

SEQ ID NO: 4693431 - DNA, 16 bp, Homo sapiens
gatccctcatcctcat

SEQ ID NO: 4693432 - DNA, 18 bp, Homo sapiens
gatccctcatctgtccct

SEQ ID NO: 4693433 - DNA, 21 bp, Homo sapiens
gacttctgcggggcctgaggc

SEQ ID NO: 4693434 - DNA, 13 bp, Homo sapiens
gacttgaaagaaa

SEQ ID NO: 4693435 - DNA, 18 bp, Homo sapiens
gacttgacagaacactgt

SEQ ID NO: 4693436 - DNA, 17 bp, Homo sapiens
gacttggggcctctgac

SEQ ID NO: 4693437 - DNA, 14 bp, Homo sapiens
gactttaaaaggat

SEQ ID NO: 4693438 - DNA, 21 bp, Homo sapiens
gactttaaaaggattaatctg

SEQ ID NO: 4693439 - DNA, 13 bp, Homo sapiens
gactttagggact

SEQ ID NO: 4693440 - DNA, 14 bp, Homo sapiens
gactttggaaagac

SEQ ID NO: 4693441 - DNA, 14 bp, Homo sapiens
gacttttccaaccc

SEQ ID NO: 4693442 - DNA, 19 bp, Homo sapiens
gacttttccaaccctcatc

SEQ ID NO: 4693443 - DNA, 23 bp, Homo sapiens
gacttttgaagaacaaaaggctt

SEQ ID NO: 4693444 - DNA, 23 bp, Homo sapiens
gagaaaagcaggcctttgcagat

SEQ ID NO: 4693445 - DNA, 16 bp, Homo sapiens
gagaaaatgaatttgg

SEQ ID NO: 4693446 - DNA, 22 bp, Homo sapiens
gagaaagaccatgcatttaaag

SEQ ID NO: 4693447 - DNA, 23 bp, Homo sapiens
gagaactcatccctaatgctgca

SEQ ID NO: 4693448 - DNA, 16 bp, Homo sapiens
gagaactttcattttt

SEQ ID NO: 4693449 - DNA, 13 bp, Homo sapiens
gagaagccacagg

SEQ ID NO: 4693450 - DNA, 17 bp, Homo sapiens
gagaagccacaggcctg

SEQ ID NO: 4693451 - DNA, 20 bp, Homo sapiens
gagaagccacaggcctgaga

SEQ ID NO: 4693452 - DNA, 21 bp, Homo sapiens
gagaagggctcagagaggaca

SEQ ID NO: 4693453 - DNA, 23 bp, Homo sapiens
gagaatgaaagggcccagagagg

SEQ ID NO: 4693454 - DNA, 14 bp, Homo sapiens
gagacagcccgggc

SEQ ID NO: 4693455 - DNA, 18 bp, Homo sapiens
gagacagcccgggctctg

SEQ ID NO: 4693456 - DNA, 18 bp, Homo sapiens
gagacagccgggaggagc

SEQ ID NO: 4693457 - DNA, 13 bp, Homo sapiens
gagacaggaagcc

SEQ ID NO: 4693458 - DNA, 18 bp, Homo sapiens
gagacaggaagcctcaag

SEQ ID NO: 4693459 - DNA, 16 bp, Homo sapiens
gagacagtcaccccag

SEQ ID NO: 4693460 - DNA, 13 bp, Homo sapiens
gagacatcagccc

SEQ ID NO: 4693461 - DNA, 18 bp, Homo sapiens
gagaccaggcaaagcaag

SEQ ID NO: 4693462 - DNA, 14 bp, Homo sapiens
gagaccatccctga

SEQ ID NO: 4693463 - DNA, 18 bp, Homo sapiens
gagacccagccctcatcc

SEQ ID NO: 4693464 - DNA, 11 bp, Homo sapiens
gagacctgccc

SEQ ID NO: 4693465 - DNA, 16 bp, Homo sapiens
gagacggagtcccacc

SEQ ID NO: 4693466 - DNA, 20 bp, Homo sapiens
gagactatgcgtttttataa

SEQ ID NO: 4693467 - DNA, 15 bp, Homo sapiens
gagactccacctcaa

SEQ ID NO: 4693468 - DNA, 22 bp, Homo sapiens
gagactcctgcaggcagccagg

SEQ ID NO: 4693469 - DNA, 20 bp, Homo sapiens
gagactcgagaactttcatt

SEQ ID NO: 4693470 - DNA, 13 bp, Homo sapiens
gagactctgtctc

SEQ ID NO: 4693471 - DNA, 14 bp, Homo sapiens
gagactctgtctca

SEQ ID NO: 4693472 - DNA, 20 bp, Homo sapiens
gagactgggctgagggagcc

SEQ ID NO: 4693473 - DNA, 19 bp, Homo sapiens
gagagagcttctgttgctg

SEQ ID NO: 4693474 - DNA, 22 bp, Homo sapiens
gagagagcttctgttgctgcct

SEQ ID NO: 4693475 - DNA, 12 bp, Homo sapiens
gagagatgtgtg

SEQ ID NO: 4693476 - DNA, 20 bp, Homo sapiens
gagagcacagtgatcaccag

SEQ ID NO: 4693477 - DNA, 23 bp, Homo sapiens
gagagcccagaggtaacagaaca

SEQ ID NO: 4693478 - DNA, 15 bp, Homo sapiens
gagagcccaggagct

SEQ ID NO: 4693479 - DNA, 20 bp, Homo sapiens
gagagcccaggagctcccct

SEQ ID NO: 4693480 - DNA, 13 bp, Homo sapiens
gagagccttccag

SEQ ID NO: 4693481 - DNA, 14 bp, Homo sapiens
gagagccttccagg

SEQ ID NO: 4693482 - DNA, 18 bp, Homo sapiens
gagagccttccaggggtg

SEQ ID NO: 4693483 - DNA, 19 bp, Homo sapiens
gagagctagaacccggcag

SEQ ID NO: 4693484 - DNA, 16 bp, Homo sapiens
gagagctagaacctgg

SEQ ID NO: 4693485 - DNA, 19 bp, Homo sapiens
gagagctagaacctggaga

SEQ ID NO: 4693486 - DNA, 20 bp, Homo sapiens
gagagctagaacctggagag

SEQ ID NO: 4693487 - DNA, 14 bp, Homo sapiens
gagagctggagcct

SEQ ID NO: 4693488 - DNA, 20 bp, Homo sapiens
gagaggaaatattgctgggg

SEQ ID NO: 4693489 - DNA, 15 bp, Homo sapiens
gagaggacaaaataa

SEQ ID NO: 4693490 - DNA, 17 bp, Homo sapiens
gagaggacaaaataaag

SEQ ID NO: 4693491 - DNA, 18 bp, Homo sapiens
gagaggacaaaataaagt

SEQ ID NO: 4693492 - DNA, 19 bp, Homo sapiens
gagaggacaaaataaagtg

SEQ ID NO: 4693493 - DNA, 13 bp, Homo sapiens
gagaggaggcaac

SEQ ID NO: 4693494 - DNA, 14 bp, Homo sapiens
gagaggatgagagc

SEQ ID NO: 4693495 - DNA, 21 bp, Homo sapiens
gagaggatgagagcccagagg

SEQ ID NO: 4693496 - DNA, 18 bp, Homo sapiens
gagaggggacgcaggccc

SEQ ID NO: 4693497 - DNA, 14 bp, Homo sapiens
gagagggtgggagt

SEQ ID NO: 4693498 - DNA, 20 bp, Homo sapiens
gagagggtgggagtgggccc

SEQ ID NO: 4693499 - DNA, 21 bp, Homo sapiens
gaggctagaaccaagaagggc

SEQ ID NO: 4693500 - DNA, 17 bp, Homo sapiens
gaggctccagagggcac

SEQ ID NO: 4693501 - DNA, 16 bp, Homo sapiens
gaggctgaggcaagag

SEQ ID NO: 4693502 - DNA, 12 bp, Homo sapiens
gaggctggctgg

SEQ ID NO: 4693503 - DNA, 13 bp, Homo sapiens
gaggctgggctcc

SEQ ID NO: 4693504 - DNA, 16 bp, Homo sapiens
gaggctgggctccctt

SEQ ID NO: 4693505 - DNA, 22 bp, Homo sapiens
gaggcttagctttgctctgcca

SEQ ID NO: 4693506 - DNA, 14 bp, Homo sapiens
gagggacgcctggg

SEQ ID NO: 4693507 - DNA, 19 bp, Homo sapiens
gagggagggctccagacac

SEQ ID NO: 4693508 - DNA, 14 bp, Homo sapiens
gagggaggtaagga

SEQ ID NO: 4693509 - DNA, 16 bp, Homo sapiens
gagggagtgacagagg

SEQ ID NO: 4693510 - DNA, 18 bp, Homo sapiens
gagggagtgacagaggca

SEQ ID NO: 4693511 - DNA, 22 bp, Homo sapiens
gagggagtgacagaggcagccc

SEQ ID NO: 4693512 - DNA, 16 bp, Homo sapiens
gagggatcattttctg

SEQ ID NO: 4693513 - DNA, 22 bp, Homo sapiens
gagggcagcagaagggggtggt

SEQ ID NO: 4693514 - DNA, 15 bp, Homo sapiens
gagggcagcagggct

SEQ ID NO: 4693515 - DNA, 19 bp, Homo sapiens
gagggcagcagggctaccc

SEQ ID NO: 4693516 - DNA, 14 bp, Homo sapiens
gagggcctgcaagg

SEQ ID NO: 4693517 - DNA, 17 bp, Homo sapiens
gagggcctgcaagggag

SEQ ID NO: 4693518 - DNA, 19 bp, Homo sapiens
gagggctagaacctggaga

SEQ ID NO: 4693519 - DNA, 12 bp, Homo sapiens
gagggctccaga

SEQ ID NO: 4693520 - DNA, 14 bp, Homo sapiens
gagggctccagaca

SEQ ID NO: 4693521 - DNA, 15 bp, Homo sapiens
gagggctccagacac

SEQ ID NO: 4693522 - DNA, 13 bp, Homo sapiens
gagggctggaatc

SEQ ID NO: 4693523 - DNA, 15 bp, Homo sapiens
gaggggacgcaggcc

SEQ ID NO: 4693524 - DNA, 13 bp, Homo sapiens
gaggggcaggccc

SEQ ID NO: 4693525 - DNA, 14 bp, Homo sapiens
gaggggcaggccct

SEQ ID NO: 4693526 - DNA, 17 bp, Homo sapiens
gaggggctgtgggcgtg

SEQ ID NO: 4693527 - DNA, 15 bp, Homo sapiens
gagggggaagtgaga

SEQ ID NO: 4693528 - DNA, 20 bp, Homo sapiens
gagggggaagtgagaagggc

SEQ ID NO: 4693529 - DNA, 22 bp, Homo sapiens
gaggggggaggtgggatcctcc

SEQ ID NO: 4693530 - DNA, 14 bp, Homo sapiens
gagggtggtgacct

SEQ ID NO: 4693531 - DNA, 23 bp, Homo sapiens
gagggttcatcatccctccctgc

SEQ ID NO: 4693532 - DNA, 14 bp, Homo sapiens
gagggttggagaag

SEQ ID NO: 4693533 - DNA, 14 bp, Homo sapiens
gaggtaacagaaca

SEQ ID NO: 4693534 - DNA, 18 bp, Homo sapiens
gaggtaacagaacagctt

SEQ ID NO: 4693535 - DNA, 21 bp, Homo sapiens
gaggtaacagaacagcttcag

SEQ ID NO: 4693536 - DNA, 24 bp, Homo sapiens
gaggtaaggaatacctgtccccct

SEQ ID NO: 4693537 - DNA, 13 bp, Homo sapiens
gaggtcagagcct

SEQ ID NO: 4693538 - DNA, 20 bp, Homo sapiens
gaggtccagccctggctgaa

SEQ ID NO: 4693539 - DNA, 23 bp, Homo sapiens
gaggtccagccctggctgaagga

SEQ ID NO: 4693540 - DNA, 22 bp, Homo sapiens
gaggtcgtataatttagtccct

SEQ ID NO: 4693541 - DNA, 20 bp, Homo sapiens
gaggtctcgctgatgctggg

SEQ ID NO: 4693542 - DNA, 23 bp, Homo sapiens
gaggtctcgctgatgctgggctg

SEQ ID NO: 4693543 - DNA, 12 bp, Homo sapiens
gaggtgggatcc

SEQ ID NO: 4693544 - DNA, 13 bp, Homo sapiens
gaggtgggatcct

SEQ ID NO: 4693545 - DNA, 15 bp, Homo sapiens
gaggtgggatcctcc

SEQ ID NO: 4693546 - DNA, 16 bp, Homo sapiens
gagtacaggtgaagca

SEQ ID NO: 4693547 - DNA, 23 bp, Homo sapiens
gtgtgaaccaccacacccagccc

SEQ ID NO: 4693548 - DNA, 22 bp, Homo sapiens
gtgtgacaaggattgctactgt

SEQ ID NO: 4693549 - DNA, 12 bp, Homo sapiens
gtgtgaggccag

SEQ ID NO: 4693550 - DNA, 18 bp, Homo sapiens
gtgtgagtcaccaagccc

SEQ ID NO: 4693551 - DNA, 16 bp, Homo sapiens
gtgtgcattgctgtga

SEQ ID NO: 4693552 - DNA, 16 bp, Homo sapiens
gtgtgccccccatcct

SEQ ID NO: 4693553 - DNA, 16 bp, Homo sapiens
gtgtgcgagtctgagt

SEQ ID NO: 4693554 - DNA, 17 bp, Homo sapiens
gtgtgctcttcttcttt

SEQ ID NO: 4693555 - DNA, 19 bp, Homo sapiens
gtgtggtgtttcctggcac

SEQ ID NO: 4693556 - DNA, 20 bp, Homo sapiens
gtgtgtactctgtgtgtgta

SEQ ID NO: 4693557 - DNA, 13 bp, Homo sapiens
gtgtgtagagtta

SEQ ID NO: 4693558 - DNA, 17 bp, Homo sapiens
gtgtgtagagttaagaa

SEQ ID NO: 4693559 - DNA, 11 bp, Homo sapiens
gtgtgtatgag

SEQ ID NO: 4693560 - DNA, 23 bp, Homo sapiens
gtgctgccctgcccacctggcct

SEQ ID NO: 4693561 - DNA, 15 bp, Homo sapiens
gtgctgctaccctcc

SEQ ID NO: 4693562 - DNA, 17 bp, Homo sapiens
gtgctgctaccctccct

SEQ ID NO: 4693563 - DNA, 23 bp, Homo sapiens
gtgctgctaccctccctgctgtc

SEQ ID NO: 4693564 - DNA, 15 bp, Homo sapiens
gtgctggagccacta

SEQ ID NO: 4693565 - DNA, 19 bp, Homo sapiens
gtgctggagccactaacta

SEQ ID NO: 4693566 - DNA, 16 bp, Homo sapiens
gtgctgtgtaccctgg

SEQ ID NO: 4693567 - DNA, 18 bp, Homo sapiens
gtgcttatgtatgaggta

SEQ ID NO: 4693568 - DNA, 13 bp, Homo sapiens
gtgcttcttgtaa

SEQ ID NO: 4693569 - DNA, 15 bp, Homo sapiens
gtgcttcttgtaata

SEQ ID NO: 4693570 - DNA, 13 bp, Homo sapiens
gtgcttggaggaa

SEQ ID NO: 4693571 - DNA, 16 bp, Homo sapiens
gtggaaaggattctaa

SEQ ID NO: 4693572 - DNA, 22 bp, Homo sapiens
gtggaacgtttttcctgttctt

SEQ ID NO: 4693573 - DNA, 20 bp, Homo sapiens
gtggaagacaatactccctt

SEQ ID NO: 4693574 - DNA, 16 bp, Homo sapiens
gtggaagcttggggaa

SEQ ID NO: 4693575 - DNA, 21 bp, Homo sapiens
gtctttctttgctgctgtgga

SEQ ID NO: 4693576 - DNA, 22 bp, Homo sapiens
gtctttctttgctgctgtggaa

SEQ ID NO: 4693577 - DNA, 15 bp, Homo sapiens
gtctttgatcatcat

SEQ ID NO: 4693578 - DNA, 18 bp, Homo sapiens
gtctttggaccctgaggc

SEQ ID NO: 4693579 - DNA, 16 bp, Homo sapiens
gtctttggtgaacatt

SEQ ID NO: 4693580 - DNA, 12 bp, Homo sapiens
gtctttgtaaga

SEQ ID NO: 4693581 - DNA, 22 bp, Homo sapiens
gtctttgtaagagtgtagaagc

SEQ ID NO: 4693582 - DNA, 16 bp, Homo sapiens
gtcttttacatacagt

SEQ ID NO: 4693583 - DNA, 19 bp, Homo sapiens
gtcttttcttgcatgaggc

SEQ ID NO: 4693584 - DNA, 15 bp, Homo sapiens
gtgaaaatggtccag

SEQ ID NO: 4693585 - DNA, 18 bp, Homo sapiens
gtgaaaccttttttaaga

SEQ ID NO: 4693586 - DNA, 14 bp, Homo sapiens
gtgaactccatcat

SEQ ID NO: 4693587 - DNA, 18 bp, Homo sapiens
gtgaagcaaacacagcat

SEQ ID NO: 4693588 - DNA, 19 bp, Homo sapiens
gtgaagtttaattgactta

SEQ ID NO: 4693589 - DNA, 18 bp, Homo sapiens
gtgaataaaaagaaagat

SEQ ID NO: 4693590 - DNA, 15 bp, Homo sapiens
gtgaatacctgctca

SEQ ID NO: 4693591 - DNA, 17 bp, Homo sapiens
gtgaatagattttagca

SEQ ID NO: 4693592 - DNA, 18 bp, Homo sapiens
gtgaatattgtggctccc

SEQ ID NO: 4693593 - DNA, 20 bp, Homo sapiens
gaagtgatttagttgtggaa

SEQ ID NO: 4693594 - DNA, 18 bp, Homo sapiens
gaagtggggaccccaccc

SEQ ID NO: 4693595 - DNA, 21 bp, Homo sapiens
gaagttgatatagaacagtgc

SEQ ID NO: 4693596 - DNA, 16 bp, Homo sapiens
gaagttgattcatatt

SEQ ID NO: 4693597 - DNA, 22 bp, Homo sapiens
gaagttggtcttactttgtgca

SEQ ID NO: 4693598 - DNA, 18 bp, Homo sapiens
gaagtttaattgacttat

SEQ ID NO: 4693599 - DNA, 21 bp, Homo sapiens
gaagtttccttggctggtgca

SEQ ID NO: 4693600 - DNA, 14 bp, Homo sapiens
gaagttttttctac

SEQ ID NO: 4693601 - DNA, 13 bp, Homo sapiens
gaataaaagaatt

SEQ ID NO: 4693602 - DNA, 13 bp, Homo sapiens
gaataatgggctt

SEQ ID NO: 4693603 - DNA, 13 bp, Homo sapiens
gaatacctgctca

SEQ ID NO: 4693604 - DNA, 13 bp, Homo sapiens
gaatacttgaagt

SEQ ID NO: 4693605 - DNA, 16 bp, Homo sapiens
gaatagatatgaaagc

SEQ ID NO: 4693606 - DNA, 15 bp, Homo sapiens
gaatagctgggacta

SEQ ID NO: 4693607 - DNA, 22 bp, Homo sapiens
gaatagctgggactacaggtgt

SEQ ID NO: 4693608 - DNA, 23 bp, Homo sapiens
gaatagctgggactacaggtgtg

SEQ ID NO: 4693609 - DNA, 17 bp, Homo sapiens
gaatagtctctgggttt

SEQ ID NO: 4693610 - DNA, 14 bp, Homo sapiens
gaatataaacacta

SEQ ID NO: 4693611 - DNA, 23 bp, Homo sapiens
gaatattccactatttgcagagg

SEQ ID NO: 4693612 - DNA, 21 bp, Homo sapiens
gaatcaggaaagagattagaa

SEQ ID NO: 4693613 - DNA, 20 bp, Homo sapiens
gaatcagtattgggagccgg

SEQ ID NO: 4693614 - DNA, 14 bp, Homo sapiens
gaatcattctgtaa

SEQ ID NO: 4693615 - DNA, 17 bp, Homo sapiens
gaatccactcccaggca

SEQ ID NO: 4693616 - DNA, 22 bp, Homo sapiens
gaatgaaccacatcttgctctg

SEQ ID NO: 4693617 - DNA, 16 bp, Homo sapiens
gaatgcacagtgggtg

SEQ ID NO: 4693618 - DNA, 18 bp, Homo sapiens
gaatgcctgagtgcctgg

SEQ ID NO: 4693619 - DNA, 22 bp, Homo sapiens
gaatgcttataggtggcctctc

SEQ ID NO: 4693620 - DNA, 11 bp, Homo sapiens
gaatgcttctg

SEQ ID NO: 4693621 - DNA, 14 bp, Homo sapiens
gaatgcttctgatt

SEQ ID NO: 4693622 - DNA, 21 bp, Homo sapiens
gaatggatttttctttaactg

SEQ ID NO: 4693623 - DNA, 23 bp, Homo sapiens
gaatggcaaataaacagtttgac

SEQ ID NO: 4693624 - DNA, 22 bp, Homo sapiens
gaatggcacagcccaaagaagg

SEQ ID NO: 4693625 - DNA, 18 bp, Homo sapiens
gaatgtaagaactacaaa

SEQ ID NO: 4693626 - DNA, 19 bp, Homo sapiens
gaatgtgatcatctttgct

SEQ ID NO: 4693627 - DNA, 21 bp, Homo sapiens
gaatgtgatcatctttgctga

SEQ ID NO: 4693628 - DNA, 17 bp, Homo sapiens
gaatgtgattttaaaga

SEQ ID NO: 4693629 - DNA, 19 bp, Homo sapiens
gaatgtgattttaaagagt

SEQ ID NO: 4693630 - DNA, 21 bp, Homo sapiens
gaattaagttagggaatggca

SEQ ID NO: 4693631 - DNA, 15 bp, Homo sapiens
gtacgatgacagtgt

SEQ ID NO: 4693632 - DNA, 21 bp, Homo sapiens
gtactggggtgggatcttgga

SEQ ID NO: 4693633 - DNA, 18 bp, Homo sapiens
gtacttctccaccctgct

SEQ ID NO: 4693634 - DNA, 19 bp, Homo sapiens
gtacttctccaccctgctc

SEQ ID NO: 4693635 - DNA, 22 bp, Homo sapiens
gtacttgccttattagagtgtc

SEQ ID NO: 4693636 - DNA, 16 bp, Homo sapiens
gtacttgtggacacag

SEQ ID NO: 4693637 - DNA, 17 bp, Homo sapiens
gtagaaattcttcatga

SEQ ID NO: 4693638 - DNA, 12 bp, Homo sapiens
gtagaagatggc

SEQ ID NO: 4693639 - DNA, 15 bp, Homo sapiens
gtagaagcattcctt

SEQ ID NO: 4693640 - DNA, 10 bp, Homo sapiens
gtagagccag

SEQ ID NO: 4693641 - DNA, 11 bp, Homo sapiens
gtagagccagg

SEQ ID NO: 4693642 - DNA, 15 bp, Homo sapiens
gtagagttaagaagc

SEQ ID NO: 4693643 - DNA, 17 bp, Homo sapiens
gtagatcagtggtctcc

SEQ ID NO: 4693644 - DNA, 15 bp, Homo sapiens
gtagcagggaaaata

SEQ ID NO: 4693645 - DNA, 18 bp, Homo sapiens
gtagctgggattacaggc

SEQ ID NO: 4693646 - DNA, 20 bp, Homo sapiens
gtaggagactgtttggaaat

SEQ ID NO: 4693647 - DNA, 17 bp, Homo sapiens
gtaggctcaactaggga

SEQ ID NO: 4693648 - DNA, 21 bp, Homo sapiens
gtagggaaaaaaatgcttctt

SEQ ID NO: 4693649 - DNA, 14 bp, Homo sapiens
gtagggcctgactc

SEQ ID NO: 4693650 - DNA, 19 bp, Homo sapiens
gtagggcctgactccttct

SEQ ID NO: 4693651 - DNA, 16 bp, Homo sapiens
gtagggggctggagga

SEQ ID NO: 4693652 - DNA, 22 bp, Homo sapiens
gtagggtaattagtaacatgtg

SEQ ID NO: 4693653 - DNA, 21 bp, Homo sapiens
gtccctgcacttgcagactct

SEQ ID NO: 4693654 - DNA, 17 bp, Homo sapiens
gtccctggtggcagctc

SEQ ID NO: 4693655 - DNA, 19 bp, Homo sapiens
gtccctggtggcagctcac

SEQ ID NO: 4693656 - DNA, 18 bp, Homo sapiens
gtcccttccacaccccca

SEQ ID NO: 4693657 - DNA, 20 bp, Homo sapiens
gtcccttccacacccccacc

SEQ ID NO: 4693658 - DNA, 18 bp, Homo sapiens
gtcccttgcccccctggc

SEQ ID NO: 4693659 - DNA, 22 bp, Homo sapiens
gtcctaacctcgggcctgctgc

SEQ ID NO: 4693660 - DNA, 15 bp, Homo sapiens
gtcctacccaccctc

SEQ ID NO: 4693661 - DNA, 16 bp, Homo sapiens
gtcctacccaccctcc

SEQ ID NO: 4693662 - DNA, 12 bp, Homo sapiens
gtcctactctgt

SEQ ID NO: 4693663 - DNA, 13 bp, Homo sapiens
gtcctactctgtg

SEQ ID NO: 4693664 - DNA, 21 bp, Homo sapiens
gtcctattatattcattcttt

SEQ ID NO: 4693665 - DNA, 14 bp, Homo sapiens
gtcctcaaagaagt

SEQ ID NO: 4693666 - DNA, 12 bp, Homo sapiens
gtcctcccatct

SEQ ID NO: 4693667 - DNA, 12 bp, Homo sapiens
gtcctcctctgt

SEQ ID NO: 4693668 - DNA, 13 bp, Homo sapiens
gtcctcctctgtg

SEQ ID NO: 4693669 - DNA, 12 bp, Homo sapiens
gtcctctccacc

SEQ ID NO: 4693670 - DNA, 21 bp, Homo sapiens
gtcctctccctcctggccaga

SEQ ID NO: 4693671 - DNA, 14 bp, Homo sapiens
gtcctcttttctga

SEQ ID NO: 4693672 - DNA, 21 bp, Homo sapiens
gtcctgacttcaggggctgcc

SEQ ID NO: 4693673 - DNA, 20 bp, Homo sapiens
gtcctgagggggaagtgaga

SEQ ID NO: 4693674 - DNA, 17 bp, Homo sapiens
gtcctgatcagagccgt

SEQ ID NO: 4693675 - DNA, 19 bp, Homo sapiens
gtcctgctgcagttgccag

SEQ ID NO: 4693676 - DNA, 15 bp, Homo sapiens
gtcctgggagtgagc

SEQ ID NO: 4693677 - DNA, 13 bp, Homo sapiens
gtcctgtactgta

SEQ ID NO: 4693678 - DNA, 19 bp, Homo sapiens
gtcctgtcagtgccgccgc

SEQ ID NO: 4693679 - DNA, 21 bp, Homo sapiens
gtcctgtcagtgccgccgcct

SEQ ID NO: 4693680 - DNA, 18 bp, Homo sapiens
gtccttaccagcagagca

SEQ ID NO: 4693681 - DNA, 19 bp, Homo sapiens
gtccttaccagcagagcac

SEQ ID NO: 4693682 - DNA, 14 bp, Homo sapiens
gtcgatagagctgt

SEQ ID NO: 4693683 - DNA, 14 bp, Homo sapiens
gtcgcccagtctgg

SEQ ID NO: 4693684 - DNA, 17 bp, Homo sapiens
gtcgcgctgcctgtgtg

SEQ ID NO: 4693685 - DNA, 21 bp, Homo sapiens
gtcgggagaggggacgcaggc

SEQ ID NO: 4693686 - DNA, 17 bp, Homo sapiens
gtcgttgactttaggga

SEQ ID NO: 4693687 - DNA, 19 bp, Homo sapiens
gtcgttgactttagggact

SEQ ID NO: 4693688 - DNA, 22 bp, Homo sapiens
gtctaaaacttcaaaaactaaa

SEQ ID NO: 4693689 - DNA, 22 bp, Homo sapiens
gtctaatgtttgtgagaagctt

SEQ ID NO: 4693690 - DNA, 14 bp, Homo sapiens
gtctacctgagggg

SEQ ID NO: 4693691 - DNA, 15 bp, Homo sapiens
gtctacctgaggggc

SEQ ID NO: 4693692 - DNA, 22 bp, Homo sapiens
gtctagaaagtaagaaaacaat

SEQ ID NO: 4693693 - DNA, 19 bp, Homo sapiens
gtctaggaactccctcaga

SEQ ID NO: 4693694 - DNA, 18 bp, Homo sapiens
gtctcactatgttgccca

SEQ ID NO: 4693695 - DNA, 19 bp, Homo sapiens
gtctcactctgtcgcccag

SEQ ID NO: 4693696 - DNA, 24 bp, Homo sapiens
gtctcagactctttttgtacctgg

SEQ ID NO: 4693697 - DNA, 15 bp, Homo sapiens
gtctcatccatcatc

SEQ ID NO: 4693698 - DNA, 23 bp, Homo sapiens
gtctcccactgcaacttgtgaac

SEQ ID NO: 4693699 - DNA, 12 bp, Homo sapiens
gtctcctccacc

SEQ ID NO: 4693700 - DNA, 22 bp, Homo sapiens
gtctccttaacactgagctgtc

SEQ ID NO: 4693701 - DNA, 19 bp, Homo sapiens
gtctcctttactgaatgta

SEQ ID NO: 4693702 - DNA, 13 bp, Homo sapiens
gtctcgaactcct

SEQ ID NO: 4693703 - DNA, 18 bp, Homo sapiens
gtctcgaactcctgacct

SEQ ID NO: 4693704 - DNA, 18 bp, Homo sapiens
gtctcgctgatgctgggc

SEQ ID NO: 4693705 - DNA, 21 bp, Homo sapiens
gtctcgctgatgctgggctgg

SEQ ID NO: 4693706 - DNA, 13 bp, Homo sapiens
gtctctaggctgg

SEQ ID NO: 4693707 - DNA, 13 bp, Homo sapiens
gtctctgagcatt

SEQ ID NO: 4693708 - DNA, 12 bp, Homo sapiens
gtctctgctgcc

SEQ ID NO: 4693709 - DNA, 15 bp, Homo sapiens
gtctctgtgagactc

SEQ ID NO: 4693710 - DNA, 20 bp, Homo sapiens
gtctcttggtcctgctgcag

SEQ ID NO: 4693711 - DNA, 13 bp, Homo sapiens
gtctcttgtaatc

SEQ ID NO: 4693712 - DNA, 18 bp, Homo sapiens
gtctctttaatgtcacag

SEQ ID NO: 4693713 - DNA, 22 bp, Homo sapiens
gtctctttaatgtcacaggcag

SEQ ID NO: 4693714 - DNA, 23 bp, Homo sapiens
gtctgagactctcttaggagcag

SEQ ID NO: 4693715 - DNA, 19 bp, Homo sapiens
gtctgaggaatccagaccc

SEQ ID NO: 4693716 - DNA, 19 bp, Homo sapiens
gtctgattcccaagctctg

SEQ ID NO: 4693717 - DNA, 17 bp, Homo sapiens
gtctgctcgggcccagg

SEQ ID NO: 4693718 - DNA, 22 bp, Homo sapiens
gtctgctcgggcccaggccatc

SEQ ID NO: 4693719 - DNA, 15 bp, Homo sapiens
gtctggaatgcagtg

SEQ ID NO: 4693720 - DNA, 16 bp, Homo sapiens
gtctggaatgcagtgg

SEQ ID NO: 4693721 - DNA, 19 bp, Homo sapiens
gtctggcaaacatgtgcaa

SEQ ID NO: 4693722 - DNA, 17 bp, Homo sapiens
gtctggtttcaccgagg

SEQ ID NO: 4693723 - DNA, 22 bp, Homo sapiens
gtctggtttcaccgaggacatg

SEQ ID NO: 4693724 - DNA, 14 bp, Homo sapiens
gtctgtcctggaac

SEQ ID NO: 4693725 - DNA, 17 bp, Homo sapiens
gtctgtgtgtgcctgtg

SEQ ID NO: 4693726 - DNA, 17 bp, Homo sapiens
gtctgtgttttgaaaga

SEQ ID NO: 4693727 - DNA, 17 bp, Homo sapiens
gtcttaaactaaatgtg

SEQ ID NO: 4693728 - DNA, 17 bp, Homo sapiens
gtcttactttgtgcaaa

SEQ ID NO: 4693729 - DNA, 15 bp, Homo sapiens
gtcttatcaagcagc

SEQ ID NO: 4693730 - DNA, 14 bp, Homo sapiens
gtcttatgcttcca

SEQ ID NO: 4693731 - DNA, 14 bp, Homo sapiens
gtcttcctgtgggg

SEQ ID NO: 4693732 - DNA, 14 bp, Homo sapiens
gtcttctatttatt

SEQ ID NO: 4693733 - DNA, 17 bp, Homo sapiens
gtcttgaactcctggcc

SEQ ID NO: 4693734 - DNA, 18 bp, Homo sapiens
gtcttgaactcctggcct

SEQ ID NO: 4693735 - DNA, 17 bp, Homo sapiens
gtcttgacctgaactct

SEQ ID NO: 4693736 - DNA, 18 bp, Homo sapiens
gtcttgacctgaactctg

SEQ ID NO: 4693737 - DNA, 17 bp, Homo sapiens
gtcttgcaatggcagcc

SEQ ID NO: 4693738 - DNA, 19 bp, Homo sapiens
gtcttgcaatggcagcctt

SEQ ID NO: 4693739 - DNA, 16 bp, Homo sapiens
gtcttggttagagaag

SEQ ID NO: 4693740 - DNA, 20 bp, Homo sapiens
gtcttgtgtttctttagttt

SEQ ID NO: 4693741 - DNA, 18 bp, Homo sapiens
gtctttccacggagccac

SEQ ID NO: 4693742 - DNA, 20 bp, Homo sapiens
gtctttccattggatctcat

SEQ ID NO: 4693743 - DNA, 17 bp, Homo sapiens
gtctttctttgctgctg

SEQ ID NO: 4693744 - DNA, 14 bp, Homo sapiens
gatccggaaagaag

SEQ ID NO: 4693745 - DNA, 20 bp, Homo sapiens
gatcctacttctctgagtca

SEQ ID NO: 4693746 - DNA, 18 bp, Homo sapiens
gatcctagttccaccatc

SEQ ID NO: 4693747 - DNA, 11 bp, Homo sapiens
gatcctccagg

SEQ ID NO: 4693748 - DNA, 17 bp, Homo sapiens
gatcctcccacctcagc

SEQ ID NO: 4693749 - DNA, 18 bp, Homo sapiens
gatcctcccacctcagcc

SEQ ID NO: 4693750 - DNA, 19 bp, Homo sapiens
gatcctcccacctcagcct

SEQ ID NO: 4693751 - DNA, 20 bp, Homo sapiens
gatcgcaagagccatgtaga

SEQ ID NO: 4693752 - DNA, 20 bp, Homo sapiens
gatctaaaatgatactgtgt

SEQ ID NO: 4693753 - DNA, 13 bp, Homo sapiens
gatctaggtcttg

SEQ ID NO: 4693754 - DNA, 13 bp, Homo sapiens
gatctatttgtag

SEQ ID NO: 4693755 - DNA, 21 bp, Homo sapiens
gatctcattggacccttccat

SEQ ID NO: 4693756 - DNA, 18 bp, Homo sapiens
gatctgggttcactgcaa

SEQ ID NO: 4693757 - DNA, 14 bp, Homo sapiens
gatctgttgcaaac

SEQ ID NO: 4693758 - DNA, 16 bp, Homo sapiens
gatctttgcagacagg

SEQ ID NO: 4693759 - DNA, 21 bp, Homo sapiens
gatctttggacagaagcagct

SEQ ID NO: 4693760 - DNA, 11 bp, Homo sapiens
gatgaaaataa

SEQ ID NO: 4693761 - DNA, 18 bp, Homo sapiens
gatgaaaataaagaatgg

SEQ ID NO: 4693762 - DNA, 17 bp, Homo sapiens
gatgaaaccgtccctga

SEQ ID NO: 4693763 - DNA, 10 bp, Homo sapiens
gatgaaatca

SEQ ID NO: 4693764 - DNA, 15 bp, Homo sapiens
gatgaaatgaggtca

SEQ ID NO: 4693765 - DNA, 22 bp, Homo sapiens
gatgaatgtcagttgttattta

SEQ ID NO: 4693766 - DNA, 15 bp, Homo sapiens
gatgagagcccagag

SEQ ID NO: 4693767 - DNA, 21 bp, Homo sapiens
gatgagagcccagaggtaaca

SEQ ID NO: 4693768 - DNA, 16 bp, Homo sapiens
gatgagcatcccagga

SEQ ID NO: 4693769 - DNA, 15 bp, Homo sapiens
gatgagcatggagct

SEQ ID NO: 4693770 - DNA, 15 bp, Homo sapiens
gatgaggccctccac

SEQ ID NO: 4693771 - DNA, 21 bp, Homo sapiens
gatgatctaggaagactttgg

SEQ ID NO: 4693772 - DNA, 14 bp, Homo sapiens
gatgatgtgcctgg

SEQ ID NO: 4693773 - DNA, 17 bp, Homo sapiens
gatgatgtgcctgggtg

SEQ ID NO: 4693774 - DNA, 17 bp, Homo sapiens
gatgattcttccagata

SEQ ID NO: 4693775 - DNA, 22 bp, Homo sapiens
gatgattggaggggggaggtgg

SEQ ID NO: 4693776 - DNA, 22 bp, Homo sapiens
gatgatttcttgaaaagggtgt

SEQ ID NO: 4693777 - DNA, 15 bp, Homo sapiens
gatgcaccagccctt

SEQ ID NO: 4693778 - DNA, 18 bp, Homo sapiens
gatgcaggtttgaccagg

SEQ ID NO: 4693779 - DNA, 19 bp, Homo sapiens
gatgcaggtttgaccagga

SEQ ID NO: 4693780 - DNA, 21 bp, Homo sapiens
gatgcattcttggttggctgg

SEQ ID NO: 4693781 - DNA, 19 bp, Homo sapiens
gatgccacaccaagctgtg

SEQ ID NO: 4693782 - DNA, 21 bp, Homo sapiens
gatgccagtaggctcaactag

SEQ ID NO: 4693783 - DNA, 16 bp, Homo sapiens
gatgccccgtccccct

SEQ ID NO: 4693784 - DNA, 15 bp, Homo sapiens
gatgcctgattgcca

SEQ ID NO: 4693785 - DNA, 15 bp, Homo sapiens
gatgcctggtggcag

SEQ ID NO: 4693786 - DNA, 23 bp, Homo sapiens
gatgcgggcattttgaatgtgat

SEQ ID NO: 4693787 - DNA, 14 bp, Homo sapiens
gatgctgggctggg

SEQ ID NO: 4693788 - DNA, 17 bp, Homo sapiens
gatgctgggctgggtgc

SEQ ID NO: 4693789 - DNA, 20 bp, Homo sapiens
gatgcttcttcagagactcc

SEQ ID NO: 4693790 - DNA, 16 bp, Homo sapiens
gatgcttttatagctg

SEQ ID NO: 4693791 - DNA, 22 bp, Homo sapiens
gatggcaggatggcctggccag

SEQ ID NO: 4693792 - DNA, 14 bp, Homo sapiens
gatggcctggccag

SEQ ID NO: 4693793 - DNA, 20 bp, Homo sapiens
gatgggcaacccccagcctg

SEQ ID NO: 4693794 - DNA, 22 bp, Homo sapiens
gatggggccctgcctcctttgt

SEQ ID NO: 4693795 - DNA, 19 bp, Homo sapiens
gatgggtgcttggaggaag

SEQ ID NO: 4693796 - DNA, 19 bp, Homo sapiens
gatggtgacattgaaacta

SEQ ID NO: 4693797 - DNA, 14 bp, Homo sapiens
gatggtggagggcc

SEQ ID NO: 4693798 - DNA, 18 bp, Homo sapiens
gatgtaaaagactttttt

SEQ ID NO: 4693799 - DNA, 14 bp, Homo sapiens
gatgtcctcctctg

SEQ ID NO: 4693800 - DNA, 22 bp, Homo sapiens
gatgtcctcctctgtgaaactg

SEQ ID NO: 4693801 - DNA, 16 bp, Homo sapiens
gatgtcgctgggtcct

SEQ ID NO: 4693802 - DNA, 21 bp, Homo sapiens
tcagtaacttacccttaggga

SEQ ID NO: 4693803 - DNA, 17 bp, Homo sapiens
tcagtaagtatctggag

SEQ ID NO: 4693804 - DNA, 23 bp, Homo sapiens
tcagtaagttatctttgaatatg

SEQ ID NO: 4693805 - DNA, 22 bp, Homo sapiens
tcagtatatttggtttctagat

SEQ ID NO: 4693806 - DNA, 22 bp, Homo sapiens
tcagtctcccagctaattgaga

SEQ ID NO: 4693807 - DNA, 13 bp, Homo sapiens
tcagtctctgagc

SEQ ID NO: 4693808 - DNA, 20 bp, Homo sapiens
tcagtctctgagcagtgaat

SEQ ID NO: 4693809 - DNA, 17 bp, Homo sapiens
tcagtctgattcccaag

SEQ ID NO: 4693810 - DNA, 12 bp, Homo sapiens
tcagtgaatttg

SEQ ID NO: 4693811 - DNA, 16 bp, Homo sapiens
tcagtgaatttgtcca

SEQ ID NO: 4693812 - DNA, 17 bp, Homo sapiens
tcagtgaatttgtccat

SEQ ID NO: 4693813 - DNA, 21 bp, Homo sapiens
tcagtgaatttgtccattgta

SEQ ID NO: 4693814 - DNA, 22 bp, Homo sapiens
tcagtgccaataaaatttagga

SEQ ID NO: 4693815 - DNA, 13 bp, Homo sapiens
tcagtgccagccc

SEQ ID NO: 4693816 - DNA, 18 bp, Homo sapiens
tcagtgccatttgttaaa

SEQ ID NO: 4693817 - DNA, 15 bp, Homo sapiens
tcagtgcttcgcaga

SEQ ID NO: 4693818 - DNA, 11 bp, Homo sapiens
tcagtggcagc

SEQ ID NO: 4693819 - DNA, 13 bp, Homo sapiens
tcagtggcagctg

SEQ ID NO: 4693820 - DNA, 16 bp, Homo sapiens
tcagtgggttaatttt

SEQ ID NO: 4693821 - DNA, 20 bp, Homo sapiens
tcagtgtacccccgcccagg

SEQ ID NO: 4693822 - DNA, 21 bp, Homo sapiens
tcagtgtacccccgcccaggc

SEQ ID NO: 4693823 - DNA, 23 bp, Homo sapiens
tcagtgtacccccgcccaggctg

SEQ ID NO: 4693824 - DNA, 16 bp, Homo sapiens
tcagtgtccaaagcag

SEQ ID NO: 4693825 - DNA, 12 bp, Homo sapiens
tcagtgtgatgg

SEQ ID NO: 4693826 - DNA, 22 bp, Homo sapiens
tcagtgtgccccccatcctggc

SEQ ID NO: 4693827 - DNA, 20 bp, Homo sapiens
tcagttcagaatcacttctg

SEQ ID NO: 4693828 - DNA, 15 bp, Homo sapiens
tcagttgttatttat

SEQ ID NO: 4693829 - DNA, 15 bp, Homo sapiens
tcagtttaattctgt

SEQ ID NO: 4693830 - DNA, 16 bp, Homo sapiens
tcagttttcaggagtg

SEQ ID NO: 4693831 - DNA, 15 bp, Homo sapiens
tcagtttttgtgaaa

SEQ ID NO: 4693832 - DNA, 13 bp, Homo sapiens
tcataactagaac

SEQ ID NO: 4693833 - DNA, 16 bp, Homo sapiens
tcataataagttgcat

SEQ ID NO: 4693834 - DNA, 20 bp, Homo sapiens
tcataatggtgaatgttcaa

SEQ ID NO: 4693835 - DNA, 12 bp, Homo sapiens
tcataattctaa

SEQ ID NO: 4693836 - DNA, 13 bp, Homo sapiens
tcatacacagaaa

SEQ ID NO: 4693837 - DNA, 21 bp, Homo sapiens
tcatacccacccccacccaag

SEQ ID NO: 4693838 - DNA, 21 bp, Homo sapiens
tcatactgaaattattttctc

SEQ ID NO: 4693839 - DNA, 15 bp, Homo sapiens
tcatactgattttta

SEQ ID NO: 4693840 - DNA, 19 bp, Homo sapiens
tcatactgtgctggagcca

SEQ ID NO: 4693841 - DNA, 20 bp, Homo sapiens
tcatactgtgctggagccac

SEQ ID NO: 4693842 - DNA, 21 bp, Homo sapiens
tcatagtatggtggctgggtt

SEQ ID NO: 4693843 - DNA, 13 bp, Homo sapiens
tcatataaacatt

SEQ ID NO: 4693844 - DNA, 17 bp, Homo sapiens
tcatatagtcaatgtaa

SEQ ID NO: 4693845 - DNA, 16 bp, Homo sapiens
tcatcaaaaagaaaaa

SEQ ID NO: 4693846 - DNA, 15 bp, Homo sapiens
tcatcaaggcactgc

SEQ ID NO: 4693847 - DNA, 18 bp, Homo sapiens
tcatcaaggcactgcctg

SEQ ID NO: 4693848 - DNA, 14 bp, Homo sapiens
tcatcactcccctc

SEQ ID NO: 4693849 - DNA, 21 bp, Homo sapiens
tcatcactttgacctaaatta

SEQ ID NO: 4693850 - DNA, 20 bp, Homo sapiens
tcatcagggaggaaagtttc

SEQ ID NO: 4693851 - DNA, 14 bp, Homo sapiens
tcatcagtaagtat

SEQ ID NO: 4693852 - DNA, 17 bp, Homo sapiens
tcatcatccctccctgc

SEQ ID NO: 4693853 - DNA, 18 bp, Homo sapiens
tcatcatccctccctgcc

SEQ ID NO: 4693854 - DNA, 14 bp, Homo sapiens
tcatcattctctgt

SEQ ID NO: 4693855 - DNA, 14 bp, Homo sapiens
tcatccactgtgcc

SEQ ID NO: 4693856 - DNA, 17 bp, Homo sapiens
tcatccactgtgccatg

SEQ ID NO: 4693857 - DNA, 21 bp, Homo sapiens
tcatccactgtgccatgtgcc

SEQ ID NO: 4693858 - DNA, 23 bp, Homo sapiens
tcatccactgtgccatgtgccag

SEQ ID NO: 4693859 - DNA, 11 bp, Homo sapiens
tcatccatcat

SEQ ID NO: 4693860 - DNA, 15 bp, Homo sapiens
tcatccatcatcatg

SEQ ID NO: 4693861 - DNA, 17 bp, Homo sapiens
tcatccatcatcatgtg

SEQ ID NO: 4693862 - DNA, 18 bp, Homo sapiens
tcatcctcatacccaccc

SEQ ID NO: 4693863 - DNA, 20 bp, Homo sapiens
tcatctccagtatcctgctg

SEQ ID NO: 4693864 - DNA, 22 bp, Homo sapiens
tcatctccagtatcctgctggt

SEQ ID NO: 4693865 - DNA, 23 bp, Homo sapiens
tcatctcctgccttcctcctggg

SEQ ID NO: 4693866 - DNA, 16 bp, Homo sapiens
tcatctctctttaata

SEQ ID NO: 4693867 - DNA, 13 bp, Homo sapiens
tcatctcttagct

SEQ ID NO: 4693868 - DNA, 12 bp, Homo sapiens
tcatctgctctc

SEQ ID NO: 4693869 - DNA, 18 bp, Homo sapiens
tcatctgctctccttcct

SEQ ID NO: 4693870 - DNA, 18 bp, Homo sapiens
tcatctggaaccatcaga

SEQ ID NO: 4693871 - DNA, 16 bp, Homo sapiens
tcatgaatctgcaatg

SEQ ID NO: 4693872 - DNA, 19 bp, Homo sapiens
tcatgactgagtctggcaa

SEQ ID NO: 4693873 - DNA, 17 bp, Homo sapiens
tcatgcaaaggctggga

SEQ ID NO: 4693874 - DNA, 19 bp, Homo sapiens
tcatgcataaatatgcagt

SEQ ID NO: 4693875 - DNA, 21 bp, Homo sapiens
tcatgccctgccaagcagcag

SEQ ID NO: 4693876 - DNA, 13 bp, Homo sapiens
tcatgcctggctt

SEQ ID NO: 4693877 - DNA, 22 bp, Homo sapiens
tcatggcagaaggcaaacccat

SEQ ID NO: 4693878 - DNA, 16 bp, Homo sapiens
tcatggtgtaataaga

SEQ ID NO: 4693879 - DNA, 18 bp, Homo sapiens
tcatgtagaatatggcta

SEQ ID NO: 4693880 - DNA, 14 bp, Homo sapiens
tcatgtgtgctctt

SEQ ID NO: 4693881 - DNA, 16 bp, Homo sapiens
tcatgtgtgctcttct

SEQ ID NO: 4693882 - DNA, 16 bp, Homo sapiens
tcatgtgtgtccacga

SEQ ID NO: 4693883 - DNA, 21 bp, Homo sapiens
tcatgtgtgtccacgactgtc

SEQ ID NO: 4693884 - DNA, 23 bp, Homo sapiens
tcatgtgtgtccacgactgtctc

SEQ ID NO: 4693885 - DNA, 18 bp, Homo sapiens
tcatgttttaaaagtttg

SEQ ID NO: 4693886 - DNA, 15 bp, Homo sapiens
tcattaaaatccagt

SEQ ID NO: 4693887 - DNA, 15 bp, Homo sapiens
tcattaaagacagga

SEQ ID NO: 4693888 - DNA, 15 bp, Homo sapiens
tcattaattcaatga

SEQ ID NO: 4693889 - DNA, 18 bp, Homo sapiens
tcattactttaccacccc

SEQ ID NO: 4693890 - DNA, 20 bp, Homo sapiens
tcattactttaccaccccca

SEQ ID NO: 4693891 - DNA, 14 bp, Homo sapiens
tcattacttttaaa

SEQ ID NO: 4693892 - DNA, 23 bp, Homo sapiens
tcattagttttgaagattctatg

SEQ ID NO: 4693893 - DNA, 17 bp, Homo sapiens
tcattatgttaatattt

SEQ ID NO: 4693894 - DNA, 16 bp, Homo sapiens
tcattccattctggaa

SEQ ID NO: 4693895 - DNA, 19 bp, Homo sapiens
tcattccattctggaagtg

SEQ ID NO: 4693896 - DNA, 16 bp, Homo sapiens
tcattcctaatgcatt

SEQ ID NO: 4693897 - DNA, 17 bp, Homo sapiens
tcattcctaatgcatta

SEQ ID NO: 4693898 - DNA, 23 bp, Homo sapiens
tcattcctcccaccccaagcaaa

SEQ ID NO: 4693899 - DNA, 22 bp, Homo sapiens
tcattctcacctaaaccctctg

SEQ ID NO: 4693900 - DNA, 19 bp, Homo sapiens
tcattctctgtctcatcca

SEQ ID NO: 4693901 - DNA, 20 bp, Homo sapiens
tcattcttactaaaaagtat

SEQ ID NO: 4693902 - DNA, 12 bp, Homo sapiens
tcattcttctgt

SEQ ID NO: 4693903 - DNA, 19 bp, Homo sapiens
tcattgacctgaggccctt

SEQ ID NO: 4693904 - DNA, 18 bp, Homo sapiens
tccaggtgcacaagctcc

SEQ ID NO: 4693905 - DNA, 21 bp, Homo sapiens
tccaggtggggtgaggcagtg

SEQ ID NO: 4693906 - DNA, 23 bp, Homo sapiens
tccagtagggaaaatagggtcct

SEQ ID NO: 4693907 - DNA, 21 bp, Homo sapiens
tccagtataagactactgaat

SEQ ID NO: 4693908 - DNA, 17 bp, Homo sapiens
tccagtattatattatc

SEQ ID NO: 4693909 - DNA, 21 bp, Homo sapiens
tccagtctcatctatgtcata

SEQ ID NO: 4693910 - DNA, 19 bp, Homo sapiens
tccagtgaggctctgccct

SEQ ID NO: 4693911 - DNA, 22 bp, Homo sapiens
tccagttaaaaaaaattttaat

SEQ ID NO: 4693912 - DNA, 17 bp, Homo sapiens
tccatagagagcaagac

SEQ ID NO: 4693913 - DNA, 17 bp, Homo sapiens
tccatcagttagagctg

SEQ ID NO: 4693914 - DNA, 13 bp, Homo sapiens
tccatcattcatc

SEQ ID NO: 4693915 - DNA, 19 bp, Homo sapiens
taaaaacactacttttgct

SEQ ID NO: 4693916 - DNA, 22 bp, Homo sapiens
taaaaagggaaagttttgttct

SEQ ID NO: 4693917 - DNA, 16 bp, Homo sapiens
taaaaagggcagccct

SEQ ID NO: 4693918 - DNA, 18 bp, Homo sapiens
taaaaagggcagccctcc

SEQ ID NO: 4693919 - DNA, 13 bp, Homo sapiens
taaaaataatcag

SEQ ID NO: 4693920 - DNA, 19 bp, Homo sapiens
taaaaatacttaaatttgg

SEQ ID NO: 4693921 - DNA, 23 bp, Homo sapiens
taaaaatggcagggggtggaatt

SEQ ID NO: 4693922 - DNA, 12 bp, Homo sapiens
taaaaattgtta

SEQ ID NO: 4693923 - DNA, 21 bp, Homo sapiens
taaaaatttttacaaaactgc

SEQ ID NO: 4693924 - DNA, 14 bp, Homo sapiens
tcaaagttttgaaa

SEQ ID NO: 4693925 - DNA, 19 bp, Homo sapiens
tcaaagttttgaaaagcta

SEQ ID NO: 4693926 - DNA, 22 bp, Homo sapiens
tcaaagttttgaaaagctatta

SEQ ID NO: 4693927 - DNA, 20 bp, Homo sapiens
tcaaataaaccttgtttctt

SEQ ID NO: 4693928 - DNA, 11 bp, Homo sapiens
tcctggccaga

SEQ ID NO: 4693929 - DNA, 11 bp, Homo sapiens
tcctggcccat

SEQ ID NO: 4693930 - DNA, 13 bp, Homo sapiens
tcctggcccatca

SEQ ID NO: 4693931 - DNA, 14 bp, Homo sapiens
tcctggcccatcag

SEQ ID NO: 4693932 - DNA, 17 bp, Homo sapiens
tcctggcccatcagtgt

SEQ ID NO: 4693933 - DNA, 12 bp, Homo sapiens
tcctggcctcaa

SEQ ID NO: 4693934 - DNA, 14 bp, Homo sapiens
tcctgggagtgagc

SEQ ID NO: 4693935 - DNA, 23 bp, Homo sapiens
tcctgggccctctctgctctgcg

SEQ ID NO: 4693936 - DNA, 20 bp, Homo sapiens
tcctgggttttgtattctct

SEQ ID NO: 4693937 - DNA, 23 bp, Homo sapiens
tcctgggttttgtattctctgag

SEQ ID NO: 4693938 - DNA, 16 bp, Homo sapiens
tcctgtaccaaatctg

SEQ ID NO: 4693939 - DNA, 13 bp, Homo sapiens
tcctgtcagtgcc

SEQ ID NO: 4693940 - DNA, 11 bp, Homo sapiens
tcctgtgacac

SEQ ID NO: 4693941 - DNA, 18 bp, Homo sapiens
tcctgtgatcctttgatg

SEQ ID NO: 4693942 - DNA, 19 bp, Homo sapiens
tcctgtgatcctttgatgg

SEQ ID NO: 4693943 - DNA, 14 bp, Homo sapiens
tcctgttctgtgac

SEQ ID NO: 4693944 - DNA, 18 bp, Homo sapiens
tcctgtttcctagctgtg

SEQ ID NO: 4693945 - DNA, 22 bp, Homo sapiens
tccttcacctttgtccccaccg

SEQ ID NO: 4693946 - DNA, 19 bp, Homo sapiens
tccttcatgacagcctcca

SEQ ID NO: 4693947 - DNA, 15 bp, Homo sapiens
tccttccacctcagt

SEQ ID NO: 4693948 - DNA, 20 bp, Homo sapiens
tccttcctggagcccagagg

SEQ ID NO: 4693949 - DNA, 17 bp, Homo sapiens
tccttctgccagttccc

SEQ ID NO: 4693950 - DNA, 13 bp, Homo sapiens
tccttctttgata

SEQ ID NO: 4693951 - DNA, 19 bp, Homo sapiens
tccttctttgataatgtta

SEQ ID NO: 4693952 - DNA, 22 bp, Homo sapiens
tccttgaaaacactgttctctg

SEQ ID NO: 4693953 - DNA, 16 bp, Homo sapiens
tccttgaaacagaaaa

SEQ ID NO: 4693954 - DNA, 22 bp, Homo sapiens
tccttgcccatcgggaccagaa

SEQ ID NO: 4693955 - DNA, 14 bp, Homo sapiens
tccttgctttacaa

SEQ ID NO: 4693956 - DNA, 14 bp, Homo sapiens
tccttgggcccttt

SEQ ID NO: 4693957 - DNA, 20 bp, Homo sapiens
tccttgtcaatactgagcca

SEQ ID NO: 4693958 - DNA, 13 bp, Homo sapiens
tccttgtccccac

SEQ ID NO: 4693959 - DNA, 17 bp, Homo sapiens
tccttgtccccacactc

SEQ ID NO: 4693960 - DNA, 19 bp, Homo sapiens
tccttgtccccacactcct

SEQ ID NO: 4693961 - DNA, 21 bp, Homo sapiens
tcctttaaaaaaatttaagtg

SEQ ID NO: 4693962 - DNA, 16 bp, Homo sapiens
tcctttactgaatgta

SEQ ID NO: 4693963 - DNA, 15 bp, Homo sapiens
tcctttcaccacatg

SEQ ID NO: 4693964 - DNA, 17 bp, Homo sapiens
tcctttgtgaggaagcc

SEQ ID NO: 4693965 - DNA, 12 bp, Homo sapiens
tcgaaaagaagg

SEQ ID NO: 4693966 - DNA, 16 bp, Homo sapiens
tcgaaataacaatgtt

SEQ ID NO: 4693967 - DNA, 19 bp, Homo sapiens
tcgaaataacaatgttaag

SEQ ID NO: 4693968 - DNA, 13 bp, Homo sapiens
tcgaaatttcatt

SEQ ID NO: 4693969 - DNA, 15 bp, Homo sapiens
tcgaactcctgacct

SEQ ID NO: 4693970 - DNA, 20 bp, Homo sapiens
tcgaagaaaataattctcta

SEQ ID NO: 4693971 - DNA, 11 bp, Homo sapiens
tcgaatgtaat

SEQ ID NO: 4693972 - DNA, 15 bp, Homo sapiens
tcgaatgtaattgga

SEQ ID NO: 4693973 - DNA, 20 bp, Homo sapiens
tcgaatttttattatttgtt

SEQ ID NO: 4693974 - DNA, 14 bp, Homo sapiens
tcgagaactttcat

SEQ ID NO: 4693975 - DNA, 20 bp, Homo sapiens
tcgagcagggtgctgtgggt

SEQ ID NO: 4693976 - DNA, 14 bp, Homo sapiens
tcgagcatgcctgg

SEQ ID NO: 4693977 - DNA, 15 bp, Homo sapiens
tcgagcatgcctgga

SEQ ID NO: 4693978 - DNA, 17 bp, Homo sapiens
tcgaggcggatctttgg

SEQ ID NO: 4693979 - DNA, 17 bp, Homo sapiens
tcgatgtcctcctctgt

SEQ ID NO: 4693980 - DNA, 19 bp, Homo sapiens
tcgatgtcctcctctgtga

SEQ ID NO: 4693981 - DNA, 20 bp, Homo sapiens
tcgatgtcctcctctgtgaa

SEQ ID NO: 4693982 - DNA, 16 bp, Homo sapiens
tcgcacacacagtgat

SEQ ID NO: 4693983 - DNA, 16 bp, Homo sapiens
tcgcccaccgcatgcc

SEQ ID NO: 4693984 - DNA, 23 bp, Homo sapiens
tcgcccagtctggaatgcagtgg

SEQ ID NO: 4693985 - DNA, 15 bp, Homo sapiens
tcgcctggcctgagg

SEQ ID NO: 4693986 - DNA, 23 bp, Homo sapiens
tcgcctttcccaggtgctacacc

SEQ ID NO: 4693987 - DNA, 18 bp, Homo sapiens
tcgcgagcacatgttcat

SEQ ID NO: 4693988 - DNA, 12 bp, Homo sapiens
tcgcgctgcctg

SEQ ID NO: 4693989 - DNA, 13 bp, Homo sapiens
tcgcgctgcctgt

SEQ ID NO: 4693990 - DNA, 16 bp, Homo sapiens
tcgcgctgcctgtgtg

SEQ ID NO: 4693991 - DNA, 14 bp, Homo sapiens
tcgctcctgtgtct

SEQ ID NO: 4693992 - DNA, 16 bp, Homo sapiens
tcgctgatgctgggct

SEQ ID NO: 4693993 - DNA, 17 bp, Homo sapiens
tcgctgatgctgggctg

SEQ ID NO: 4693994 - DNA, 18 bp, Homo sapiens
tcgctgatgctgggctgg

SEQ ID NO: 4693995 - DNA, 22 bp, Homo sapiens
tcgctggactctcagtctctga

SEQ ID NO: 4693996 - DNA, 16 bp, Homo sapiens
tcgctgggtcctctgc

SEQ ID NO: 4693997 - DNA, 15 bp, Homo sapiens
tcggaaatcttaaac

SEQ ID NO: 4693998 - DNA, 10 bp, Homo sapiens
tcggaccagc

SEQ ID NO: 4693999 - DNA, 22 bp, Homo sapiens
tcggcctcccaaagtgctggga

SEQ ID NO: 4694000 - DNA, 15 bp, Homo sapiens
tcgggagaggggacg

SEQ ID NO: 4694001 - DNA, 21 bp, Homo sapiens
tcgggagaggggacgcaggcc

SEQ ID NO: 4694002 - DNA, 12 bp, Homo sapiens
tcgggctcctgt

SEQ ID NO: 4694003 - DNA, 19 bp, Homo sapiens
tcgtgaagagggaagccag

SEQ ID NO: 4694004 - DNA, 21 bp, Homo sapiens
tcgtgaagagggaagccagga

SEQ ID NO: 4694005 - DNA, 20 bp, Homo sapiens
tcgtgccagtcgcgctgcct

SEQ ID NO: 4694006 - DNA, 22 bp, Homo sapiens
tcgtgccagtcgcgctgcctgt

SEQ ID NO: 4694007 - DNA, 17 bp, Homo sapiens
tcgtgcgtgggcttctt

SEQ ID NO: 4694008 - DNA, 20 bp, Homo sapiens
tcgtgggatctgcccctccc

SEQ ID NO: 4694009 - DNA, 14 bp, Homo sapiens
tcgtggtaggactg

SEQ ID NO: 4694010 - DNA, 15 bp, Homo sapiens
tcgtggtaggactgt

SEQ ID NO: 4694011 - DNA, 20 bp, Homo sapiens
tcgtggtaggactgtagaaa

SEQ ID NO: 4694012 - DNA, 19 bp, Homo sapiens
tcgttacattgtgtcctgc

SEQ ID NO: 4694013 - DNA, 16 bp, Homo sapiens
tcgttgactttaggga

SEQ ID NO: 4694014 - DNA, 17 bp, Homo sapiens
tcgttgactttagggac

SEQ ID NO: 4694015 - DNA, 17 bp, Homo sapiens
tcgttgttcccactgaa

SEQ ID NO: 4694016 - DNA, 14 bp, Homo sapiens
tctaaaacttcaaa

SEQ ID NO: 4694017 - DNA, 16 bp, Homo sapiens
tctaaactgccccctc

SEQ ID NO: 4694018 - DNA, 22 bp, Homo sapiens
tctaaactgccccctctgccct

SEQ ID NO: 4694019 - DNA, 23 bp, Homo sapiens
tctaaactgccccctctgccctg

SEQ ID NO: 4694020 - DNA, 21 bp, Homo sapiens
tctaaatggtgctgcagattt

SEQ ID NO: 4694021 - DNA, 15 bp, Homo sapiens
tctaaattgatcatt

SEQ ID NO: 4694022 - DNA, 17 bp, Homo sapiens
tctaaattgatcattca

SEQ ID NO: 4694023 - DNA, 18 bp, Homo sapiens
tctaacctcatcttcttc

SEQ ID NO: 4694024 - DNA, 18 bp, Homo sapiens
tctaagaactctttgcct

SEQ ID NO: 4694025 - DNA, 18 bp, Homo sapiens
tctaagattaatagcatt

SEQ ID NO: 4694026 - DNA, 14 bp, Homo sapiens
tctaatagagagat

SEQ ID NO: 4694027 - DNA, 14 bp, Homo sapiens
tctaatatgtaaca

SEQ ID NO: 4694028 - DNA, 17 bp, Homo sapiens
tctaatattcacatgtt

SEQ ID NO: 4694029 - DNA, 15 bp, Homo sapiens
tctaatcataacata

SEQ ID NO: 4694030 - DNA, 22 bp, Homo sapiens
tctaatggctgtggcattgttg

SEQ ID NO: 4694031 - DNA, 13 bp, Homo sapiens
tctaatgtttgtg

SEQ ID NO: 4694032 - DNA, 14 bp, Homo sapiens
tctaattggtcatt

SEQ ID NO: 4694033 - DNA, 24 bp, Homo sapiens
tctaattggtcattcctaatgcat

SEQ ID NO: 4694034 - DNA, 17 bp, Homo sapiens
tctaattgtcagtgatt

SEQ ID NO: 4694035 - DNA, 15 bp, Homo sapiens
tctaattttggataa

SEQ ID NO: 4694036 - DNA, 16 bp, Homo sapiens
tctacagagcttccct

SEQ ID NO: 4694037 - DNA, 18 bp, Homo sapiens
tctacagagcttccctga

SEQ ID NO: 4694038 - DNA, 19 bp, Homo sapiens
tctacccagcgagccctgg

SEQ ID NO: 4694039 - DNA, 14 bp, Homo sapiens
tctacccaggtgct

SEQ ID NO: 4694040 - DNA, 22 bp, Homo sapiens
tccctctacagagcttccctga

SEQ ID NO: 4694041 - DNA, 16 bp, Homo sapiens
tccctgaaggccccgc

SEQ ID NO: 4694042 - DNA, 22 bp, Homo sapiens
tccctgaaggccccgcccaggc

SEQ ID NO: 4694043 - DNA, 21 bp, Homo sapiens
tccctgaggactgatttcaga

SEQ ID NO: 4694044 - DNA, 21 bp, Homo sapiens
tccctgataacaacctggaga

SEQ ID NO: 4694045 - DNA, 13 bp, Homo sapiens
tccctgcacttgc

SEQ ID NO: 4694046 - DNA, 14 bp, Homo sapiens
tccctgcacttgca

SEQ ID NO: 4694047 - DNA, 20 bp, Homo sapiens
tccctgcacttgcagactct

SEQ ID NO: 4694048 - DNA, 20 bp, Homo sapiens
tccctgcctccacccacagt

SEQ ID NO: 4694049 - DNA, 17 bp, Homo sapiens
tccctgctgtcccctct

SEQ ID NO: 4694050 - DNA, 22 bp, Homo sapiens
tccctgctgtcccctcttgccc

SEQ ID NO: 4694051 - DNA, 15 bp, Homo sapiens
tccctggtggcagct

SEQ ID NO: 4694052 - DNA, 16 bp, Homo sapiens
tccctggtggcagctc

SEQ ID NO: 4694053 - DNA, 17 bp, Homo sapiens
tccctggtggcagctca

SEQ ID NO: 4694054 - DNA, 20 bp, Homo sapiens
tccctgtcttctttccatcc

SEQ ID NO: 4694055 - DNA, 13 bp, Homo sapiens
tccctgtgttctg

SEQ ID NO: 4694056 - DNA, 18 bp, Homo sapiens
tcccttcatgcatggaaa

SEQ ID NO: 4694057 - DNA, 18 bp, Homo sapiens
tcccttccacacccccac

SEQ ID NO: 4694058 - DNA, 17 bp, Homo sapiens
tcccttcccacctctct

SEQ ID NO: 4694059 - DNA, 21 bp, Homo sapiens
tcccttgaccaggcctgggcc

SEQ ID NO: 4694060 - DNA, 17 bp, Homo sapiens
tcccttgccctttccat

SEQ ID NO: 4694061 - DNA, 20 bp, Homo sapiens
tcccttggattgtccccgac

SEQ ID NO: 4694062 - DNA, 23 bp, Homo sapiens
tccctttctcccctgcccccagg

SEQ ID NO: 4694063 - DNA, 22 bp, Homo sapiens
tccctttgacgccatcccagcc

SEQ ID NO: 4694064 - DNA, 23 bp, Homo sapiens
tccctttgacgccatcccagccc

SEQ ID NO: 4694065 - DNA, 17 bp, Homo sapiens
tcccttttctttaagtt

SEQ ID NO: 4694066 - DNA, 20 bp, Homo sapiens
tccctttttcataaattatt

SEQ ID NO: 4694067 - DNA, 14 bp, Homo sapiens
tccctttttccttg

SEQ ID NO: 4694068 - DNA, 19 bp, Homo sapiens
tcccttttttggctgctga

SEQ ID NO: 4694069 - DNA, 17 bp, Homo sapiens
tccgaccagacaccttg

SEQ ID NO: 4694070 - DNA, 16 bp, Homo sapiens
tccgctttctacccag

SEQ ID NO: 4694071 - DNA, 20 bp, Homo sapiens
tccgctttctacccagcgag

SEQ ID NO: 4694072 - DNA, 19 bp, Homo sapiens
tccggcatggacaatggac

SEQ ID NO: 4694073 - DNA, 23 bp, Homo sapiens
tcctaaaataagggcagagtcac

SEQ ID NO: 4694074 - DNA, 18 bp, Homo sapiens
tcctaaatattggtttgt

SEQ ID NO: 4694075 - DNA, 18 bp, Homo sapiens
tcctaattccacagctgc

SEQ ID NO: 4694076 - DNA, 14 bp, Homo sapiens
tcctacaaccaggt

SEQ ID NO: 4694077 - DNA, 14 bp, Homo sapiens
tcctacatacagca

SEQ ID NO: 4694078 - DNA, 21 bp, Homo sapiens
tcctaccccaattccttgtag

SEQ ID NO: 4694079 - DNA, 12 bp, Homo sapiens
tcctacccctcc

SEQ ID NO: 4694080 - DNA, 13 bp, Homo sapiens
tcctaccgtcttt

SEQ ID NO: 4694081 - DNA, 13 bp, Homo sapiens
tcctactctgtgt

SEQ ID NO: 4694082 - DNA, 14 bp, Homo sapiens
tcctactctgtgtc

SEQ ID NO: 4694083 - DNA, 18 bp, Homo sapiens
tcctacttgcagtacatc

SEQ ID NO: 4694084 - DNA, 17 bp, Homo sapiens
tcctacttttaaagaat

SEQ ID NO: 4694085 - DNA, 18 bp, Homo sapiens
tcctacttttaaagaatt

SEQ ID NO: 4694086 - DNA, 22 bp, Homo sapiens
tcctagttccaccatcaagcca

SEQ ID NO: 4694087 - DNA, 18 bp, Homo sapiens
tcctatacgcagcgtgct

SEQ ID NO: 4694088 - DNA, 21 bp, Homo sapiens
tcctcaaggggccatcctgtc

SEQ ID NO: 4694089 - DNA, 14 bp, Homo sapiens
tcctcaatccagct

SEQ ID NO: 4694090 - DNA, 20 bp, Homo sapiens
tcctcacaacatggtgtctg

SEQ ID NO: 4694091 - DNA, 22 bp, Homo sapiens
tcctcatagtatggtggctggg

SEQ ID NO: 4694092 - DNA, 23 bp, Homo sapiens
tcctcatggtgcatataaatata

SEQ ID NO: 4694093 - DNA, 19 bp, Homo sapiens
tcctccaatcaaaatcacc

SEQ ID NO: 4694094 - DNA, 23 bp, Homo sapiens
tcctccaccgccatggcttccaa

SEQ ID NO: 4694095 - DNA, 21 bp, Homo sapiens
tcctccacgttctgctcatca

SEQ ID NO: 4694096 - DNA, 13 bp, Homo sapiens
tcctccaggtgca

SEQ ID NO: 4694097 - DNA, 18 bp, Homo sapiens
tcctccaggtgcacaagc

SEQ ID NO: 4694098 - DNA, 20 bp, Homo sapiens
tcctccaggtgcacaagctc

SEQ ID NO: 4694099 - DNA, 22 bp, Homo sapiens
tcctccaggtgcacaagctcca

SEQ ID NO: 4694100 - DNA, 20 bp, Homo sapiens
tcctcccacctcagcctccc

SEQ ID NO: 4694101 - DNA, 12 bp, Homo sapiens
tcctcctccagg

SEQ ID NO: 4694102 - DNA, 11 bp, Homo sapiens
tcctcctctgt

SEQ ID NO: 4694103 - DNA, 15 bp, Homo sapiens
tcctcctctgtgaaa

SEQ ID NO: 4694104 - DNA, 14 bp, Homo sapiens
tcctcctgggccct

SEQ ID NO: 4694105 - DNA, 17 bp, Homo sapiens
tcctctactaacaatca

SEQ ID NO: 4694106 - DNA, 14 bp, Homo sapiens
tcctctatttcttt

SEQ ID NO: 4694107 - DNA, 11 bp, Homo sapiens
tcctctcccct

SEQ ID NO: 4694108 - DNA, 18 bp, Homo sapiens
tcctctcccctaccactg

SEQ ID NO: 4694109 - DNA, 13 bp, Homo sapiens
tcctctctgccct

SEQ ID NO: 4694110 - DNA, 15 bp, Homo sapiens
tcctctctgccctaa

SEQ ID NO: 4694111 - DNA, 16 bp, Homo sapiens
tcctctgactcagggc

SEQ ID NO: 4694112 - DNA, 17 bp, Homo sapiens
tcctctgactcagggct

SEQ ID NO: 4694113 - DNA, 18 bp, Homo sapiens
tcctctgactcagggctc

SEQ ID NO: 4694114 - DNA, 21 bp, Homo sapiens
tcctctgagctgttatcttgt

SEQ ID NO: 4694115 - DNA, 10 bp, Homo sapiens
tcctctgcct

SEQ ID NO: 4694116 - DNA, 12 bp, Homo sapiens
tcctctgctgct

SEQ ID NO: 4694117 - DNA, 17 bp, Homo sapiens
tcctctgctgctggctg

SEQ ID NO: 4694118 - DNA, 17 bp, Homo sapiens
tcctctgcttaaaaact

SEQ ID NO: 4694119 - DNA, 19 bp, Homo sapiens
tcctctgtacagagcccac

SEQ ID NO: 4694120 - DNA, 23 bp, Homo sapiens
tcctctgtacagagcccacgccc

SEQ ID NO: 4694121 - DNA, 11 bp, Homo sapiens
tcctctgtgaa

SEQ ID NO: 4694122 - DNA, 23 bp, Homo sapiens
tcctctttggtctacactgtgct

SEQ ID NO: 4694123 - DNA, 15 bp, Homo sapiens
tcctgacagcactcc

SEQ ID NO: 4694124 - DNA, 11 bp, Homo sapiens
tcctgacttca

SEQ ID NO: 4694125 - DNA, 15 bp, Homo sapiens
tcctgaggctgggct

SEQ ID NO: 4694126 - DNA, 16 bp, Homo sapiens
tcctgaggctgggctc

SEQ ID NO: 4694127 - DNA, 16 bp, Homo sapiens
tcctgagggggaagtg

SEQ ID NO: 4694128 - DNA, 20 bp, Homo sapiens
tcctgagtagctgggattac

SEQ ID NO: 4694129 - DNA, 14 bp, Homo sapiens
tcctgatcagagcc

SEQ ID NO: 4694130 - DNA, 14 bp, Homo sapiens
tcctgatgattttt

SEQ ID NO: 4694131 - DNA, 19 bp, Homo sapiens
tcctgatgcttcttcagag

SEQ ID NO: 4694132 - DNA, 20 bp, Homo sapiens
tcctgatgcttcttcagaga

SEQ ID NO: 4694133 - DNA, 14 bp, Homo sapiens
tcctgcaggcagcc

SEQ ID NO: 4694134 - DNA, 15 bp, Homo sapiens
tcctgcaggcagcca

SEQ ID NO: 4694135 - DNA, 17 bp, Homo sapiens
tcctgcaggcagccagg

SEQ ID NO: 4694136 - DNA, 18 bp, Homo sapiens
tcctgcaggtaaacagtt

SEQ ID NO: 4694137 - DNA, 21 bp, Homo sapiens
tcctgccccagatggctttgt

SEQ ID NO: 4694138 - DNA, 10 bp, Homo sapiens
tcctgccctg

SEQ ID NO: 4694139 - DNA, 20 bp, Homo sapiens
tcctgccgcagagctggccg

SEQ ID NO: 4694140 - DNA, 14 bp, Homo sapiens
tcctgcctccgcct

SEQ ID NO: 4694141 - DNA, 16 bp, Homo sapiens
tcctgccttcctcctg

SEQ ID NO: 4694142 - DNA, 23 bp, Homo sapiens
tcctgccttcctcctgggccctc

SEQ ID NO: 4694143 - DNA, 15 bp, Homo sapiens
tcctgctcacatctg

SEQ ID NO: 4694144 - DNA, 15 bp, Homo sapiens
tcctgctccacagtg

SEQ ID NO: 4694145 - DNA, 17 bp, Homo sapiens
tcctgctgcaccaaccc

SEQ ID NO: 4694146 - DNA, 18 bp, Homo sapiens
tcctgctgcagaggggca

SEQ ID NO: 4694147 - DNA, 15 bp, Homo sapiens
tcctggagcccagag

SEQ ID NO: 4694148 - DNA, 19 bp, Homo sapiens
tcctggaggggtgttgtat

SEQ ID NO: 4694149 - DNA, 19 bp, Homo sapiens
tcctggcacccggcccctg

SEQ ID NO: 4694150 - DNA, 16 bp, Homo sapiens
tcctggcactgcttcc

SEQ ID NO: 4694151 - DNA, 20 bp, Homo sapiens
tgaaccacatcttgctctgc

SEQ ID NO: 4694152 - DNA, 20 bp, Homo sapiens
tgaaccaccacacccagccc

SEQ ID NO: 4694153 - DNA, 21 bp, Homo sapiens
tgaaccaccacacccagccca

SEQ ID NO: 4694154 - DNA, 18 bp, Homo sapiens
tgaaccctagctgtgtca

SEQ ID NO: 4694155 - DNA, 16 bp, Homo sapiens
tgaaccgctgaatatg

SEQ ID NO: 4694156 - DNA, 23 bp, Homo sapiens
tgaacctgatgaaaataaagaat

SEQ ID NO: 4694157 - DNA, 22 bp, Homo sapiens
tgaaccttgctatcaagaaatg

SEQ ID NO: 4694158 - DNA, 14 bp, Homo sapiens
tgaactccatcatt

SEQ ID NO: 4694159 - DNA, 23 bp, Homo sapiens
tgaactccatcattcatccagga

SEQ ID NO: 4694160 - DNA, 15 bp, Homo sapiens
tgaactcctgacctc

SEQ ID NO: 4694161 - DNA, 12 bp, Homo sapiens
tgaactcctggc

SEQ ID NO: 4694162 - DNA, 11 bp, Homo sapiens
tgaactttgct

SEQ ID NO: 4694163 - DNA, 15 bp, Homo sapiens
tgaactttgctgagc

SEQ ID NO: 4694164 - DNA, 12 bp, Homo sapiens
tgaagaaaacaa

SEQ ID NO: 4694165 - DNA, 13 bp, Homo sapiens
tgaagaaagttat

SEQ ID NO: 4694166 - DNA, 11 bp, Homo sapiens
tgaagaagaga

SEQ ID NO: 4694167 - DNA, 15 bp, Homo sapiens
tgaagaatgtctgta

SEQ ID NO: 4694168 - DNA, 20 bp, Homo sapiens
tgaagaattattcagtgaat

SEQ ID NO: 4694169 - DNA, 14 bp, Homo sapiens
tgaagacagaggca

SEQ ID NO: 4694170 - DNA, 21 bp, Homo sapiens
tgaagattctatgttaatatt

SEQ ID NO: 4694171 - DNA, 17 bp, Homo sapiens
tgaagcaccaagctcaa

SEQ ID NO: 4694172 - DNA, 15 bp, Homo sapiens
tgaagccaaagccaa

SEQ ID NO: 4694173 - DNA, 18 bp, Homo sapiens
tgaagccttctgacctgg

SEQ ID NO: 4694174 - DNA, 10 bp, Homo sapiens
tgaaggactg

SEQ ID NO: 4694175 - DNA, 14 bp, Homo sapiens
tgaaggactgtgac

SEQ ID NO: 4694176 - DNA, 22 bp, Homo sapiens
tgaaggagccccattcctggga

SEQ ID NO: 4694177 - DNA, 15 bp, Homo sapiens
tgaaggatccatctt

SEQ ID NO: 4694178 - DNA, 15 bp, Homo sapiens
tgaaggccccgccca

SEQ ID NO: 4694179 - DNA, 17 bp, Homo sapiens
tgaaggccccgcccagg

SEQ ID NO: 4694180 - DNA, 19 bp, Homo sapiens
tgaaggccccgcccaggct

SEQ ID NO: 4694181 - DNA, 21 bp, Homo sapiens
tgaaggctcgagcatgcctgg

SEQ ID NO: 4694182 - DNA, 21 bp, Homo sapiens
tgaaggctgggttctgatcct

SEQ ID NO: 4694183 - DNA, 19 bp, Homo sapiens
tgaaggcttctctctgtgg

SEQ ID NO: 4694184 - DNA, 24 bp, Homo sapiens
tgaagggattttagtcacacgtgg

SEQ ID NO: 4694185 - DNA, 16 bp, Homo sapiens
tgaagggtcatttctc

SEQ ID NO: 4694186 - DNA, 18 bp, Homo sapiens
tgaaggtagaatgttttc

SEQ ID NO: 4694187 - DNA, 18 bp, Homo sapiens
tgaaggtttctgaaaatt

SEQ ID NO: 4694188 - DNA, 14 bp, Homo sapiens
tgaagtaagcaaag

SEQ ID NO: 4694189 - DNA, 22 bp, Homo sapiens
tgaagtattagacttctaaata

SEQ ID NO: 4694190 - DNA, 16 bp, Homo sapiens
tgaagtcgttgtgagg

SEQ ID NO: 4694191 - DNA, 17 bp, Homo sapiens
tgaagtgactgttgtac

SEQ ID NO: 4694192 - DNA, 16 bp, Homo sapiens
tgaagttgattcatat

SEQ ID NO: 4694193 - DNA, 20 bp, Homo sapiens
tgaagttgattcatattgca

SEQ ID NO: 4694194 - DNA, 13 bp, Homo sapiens
tgaataaaaagaa

SEQ ID NO: 4694195 - DNA, 11 bp, Homo sapiens
tgaataaaata

SEQ ID NO: 4694196 - DNA, 16 bp, Homo sapiens
tgaatataaacactat

SEQ ID NO: 4694197 - DNA, 22 bp, Homo sapiens
tgaatatgaggcatttggcatt

SEQ ID NO: 4694198 - DNA, 16 bp, Homo sapiens
tgaatattaagaaaca

SEQ ID NO: 4694199 - DNA, 19 bp, Homo sapiens
tgaatattgtggctccctg

SEQ ID NO: 4694200 - DNA, 23 bp, Homo sapiens
tgaatcacgtaaagctagaaatg

SEQ ID NO: 4694201 - DNA, 15 bp, Homo sapiens
tgaatgactccagga

SEQ ID NO: 4694202 - DNA, 17 bp, Homo sapiens
tgaatgaggaacaatca

SEQ ID NO: 4694203 - DNA, 21 bp, Homo sapiens
tgaatgaggaacaatcacaaa

SEQ ID NO: 4694204 - DNA, 22 bp, Homo sapiens
tgaatgagggccatatccctgt

SEQ ID NO: 4694205 - DNA, 15 bp, Homo sapiens
tgaatgcaaaagaaa

SEQ ID NO: 4694206 - DNA, 19 bp, Homo sapiens
tgaatgcttataggtggcc

SEQ ID NO: 4694207 - DNA, 17 bp, Homo sapiens
tgaatggattggattat

SEQ ID NO: 4694208 - DNA, 22 bp, Homo sapiens
tgaatggattggattatttaat

SEQ ID NO: 4694209 - DNA, 14 bp, Homo sapiens
tgaatgggttgtta

SEQ ID NO: 4694210 - DNA, 16 bp, Homo sapiens
tgaatgtaaaagaaaa

SEQ ID NO: 4694211 - DNA, 12 bp, Homo sapiens
tgaatgtatttt

SEQ ID NO: 4694212 - DNA, 21 bp, Homo sapiens
tgaatgtattttggttgctga

SEQ ID NO: 4694213 - DNA, 14 bp, Homo sapiens
tgaatgtcattatt

SEQ ID NO: 4694214 - DNA, 13 bp, Homo sapiens
tgaattattttgt

SEQ ID NO: 4694215 - DNA, 19 bp, Homo sapiens
tgaattattttgttactgt

SEQ ID NO: 4694216 - DNA, 21 bp, Homo sapiens
tgaattcttggttgaggaaac

SEQ ID NO: 4694217 - DNA, 22 bp, Homo sapiens
tgaattcttggttgaggaaaca

SEQ ID NO: 4694218 - DNA, 17 bp, Homo sapiens
tgaatttaagcatgagt

SEQ ID NO: 4694219 - DNA, 13 bp, Homo sapiens
tgaatttagtcat

SEQ ID NO: 4694220 - DNA, 24 bp, Homo sapiens
tgaatttgtccattgtaaatctga

SEQ ID NO: 4694221 - DNA, 20 bp, Homo sapiens
tgaattttcccactgcaccc

SEQ ID NO: 4694222 - DNA, 13 bp, Homo sapiens
tgaatttttctaa

SEQ ID NO: 4694223 - DNA, 15 bp, Homo sapiens
tgaatttttctaaac

SEQ ID NO: 4694224 - DNA, 17 bp, Homo sapiens
tgacaaaggcaagcact

SEQ ID NO: 4694225 - DNA, 17 bp, Homo sapiens
tgacaaatgtaaacatt

SEQ ID NO: 4694226 - DNA, 13 bp, Homo sapiens
tgacaaatgtgta

SEQ ID NO: 4694227 - DNA, 13 bp, Homo sapiens
tgacaacactcat

SEQ ID NO: 4694228 - DNA, 17 bp, Homo sapiens
tgacaacagcctgagaa

SEQ ID NO: 4694229 - DNA, 19 bp, Homo sapiens
tgacaactggaatagtttt

SEQ ID NO: 4694230 - DNA, 13 bp, Homo sapiens
tgacaataaaaca

SEQ ID NO: 4694231 - DNA, 16 bp, Homo sapiens
tgacaataaaacatta

SEQ ID NO: 4694232 - DNA, 17 bp, Homo sapiens
tgacaataatctcacaa

SEQ ID NO: 4694233 - DNA, 19 bp, Homo sapiens
tgacacacagctctgtcct

SEQ ID NO: 4694234 - DNA, 21 bp, Homo sapiens
tgacacacagctctgtcctgg

SEQ ID NO: 4694235 - DNA, 17 bp, Homo sapiens
tgacaccaaaatgaacc

SEQ ID NO: 4694236 - DNA, 16 bp, Homo sapiens
tgacaccaataaatgt

SEQ ID NO: 4694237 - DNA, 18 bp, Homo sapiens
tgacaccaataaatgttt

SEQ ID NO: 4694238 - DNA, 20 bp, Homo sapiens
tgacaccaataaatgtttgt

SEQ ID NO: 4694239 - DNA, 21 bp, Homo sapiens
tgacaccaataaatgtttgtt

SEQ ID NO: 4694240 - DNA, 23 bp, Homo sapiens
tgacaccaataaatgtttgttat

SEQ ID NO: 4694241 - DNA, 20 bp, Homo sapiens
tgacactggtattcctgcct

SEQ ID NO: 4694242 - DNA, 14 bp, Homo sapiens
tgacagaacactgt

SEQ ID NO: 4694243 - DNA, 16 bp, Homo sapiens
tgacagaacactgtct

SEQ ID NO: 4694244 - DNA, 22 bp, Homo sapiens
tgacagaatggctatcaaaaga

SEQ ID NO: 4694245 - DNA, 14 bp, Homo sapiens
tgacagacacaggc

SEQ ID NO: 4694246 - DNA, 16 bp, Homo sapiens
tgacagacacaggccc

SEQ ID NO: 4694247 - DNA, 18 bp, Homo sapiens
tgacagacacaggcccgg

SEQ ID NO: 4694248 - DNA, 13 bp, Homo sapiens
tgacagaggcagc

SEQ ID NO: 4694249 - DNA, 14 bp, Homo sapiens
tgacagaggcagcc

SEQ ID NO: 4694250 - DNA, 17 bp, Homo sapiens
tgacagaggcagcccca

SEQ ID NO: 4694251 - DNA, 18 bp, Homo sapiens
tgacagaggcagccccat

SEQ ID NO: 4694252 - DNA, 23 bp, Homo sapiens
tgacagaggcagccccattctgc

SEQ ID NO: 4694253 - DNA, 17 bp, Homo sapiens
tgacaggcaatgctggc

SEQ ID NO: 4694254 - DNA, 14 bp, Homo sapiens
tgacaggcagcaga

SEQ ID NO: 4694255 - DNA, 11 bp, Homo sapiens
tgacagggcac

SEQ ID NO: 4694256 - DNA, 21 bp, Homo sapiens
tgacagggcacaccgggcact

SEQ ID NO: 4694257 - DNA, 22 bp, Homo sapiens
tgacagggcacaccgggcactc

SEQ ID NO: 4694258 - DNA, 18 bp, Homo sapiens
tgacagtcctctccacct

SEQ ID NO: 4694259 - DNA, 22 bp, Homo sapiens
tgacataacaccaaacttcatt

SEQ ID NO: 4694260 - DNA, 17 bp, Homo sapiens
tgacatattatgcctga

SEQ ID NO: 4694261 - DNA, 20 bp, Homo sapiens
tctcctccaccgccatggct

SEQ ID NO: 4694262 - DNA, 16 bp, Homo sapiens
tctcctccatgggaga

SEQ ID NO: 4694263 - DNA, 14 bp, Homo sapiens
tctcctctccatct

SEQ ID NO: 4694264 - DNA, 16 bp, Homo sapiens
tctcctctgctgctgg

SEQ ID NO: 4694265 - DNA, 17 bp, Homo sapiens
tctcctctgctgctggc

SEQ ID NO: 4694266 - DNA, 18 bp, Homo sapiens
tctcctctgctgctggct

SEQ ID NO: 4694267 - DNA, 20 bp, Homo sapiens
tctcctctgctgctggctgg

SEQ ID NO: 4694268 - DNA, 17 bp, Homo sapiens
tctcctgcctcagcctc

SEQ ID NO: 4694269 - DNA, 17 bp, Homo sapiens
tctcctgccttcctcct

SEQ ID NO: 4694270 - DNA, 18 bp, Homo sapiens
tctcctgtgatgtcccag

SEQ ID NO: 4694271 - DNA, 15 bp, Homo sapiens
tctccttagaagtgg

SEQ ID NO: 4694272 - DNA, 15 bp, Homo sapiens
tctccttcacctttg

SEQ ID NO: 4694273 - DNA, 16 bp, Homo sapiens
tctccttcacctttgt

SEQ ID NO: 4694274 - DNA, 15 bp, Homo sapiens
tctccttcagccctc

SEQ ID NO: 4694275 - DNA, 14 bp, Homo sapiens
tctccttgtggcct

SEQ ID NO: 4694276 - DNA, 15 bp, Homo sapiens
tctcgaatgtaattg

SEQ ID NO: 4694277 - DNA, 20 bp, Homo sapiens
tctcgctattgtcaccaggg

SEQ ID NO: 4694278 - DNA, 14 bp, Homo sapiens
tctctaggctgggg

SEQ ID NO: 4694279 - DNA, 15 bp, Homo sapiens
tctctcactccttga

SEQ ID NO: 4694280 - DNA, 22 bp, Homo sapiens
tctctccaaggtgtttctagat

SEQ ID NO: 4694281 - DNA, 19 bp, Homo sapiens
tgagttattcataaagaga

SEQ ID NO: 4694282 - DNA, 17 bp, Homo sapiens
tgagttcataccctgtt

SEQ ID NO: 4694283 - DNA, 14 bp, Homo sapiens
tgataaaaactcag

SEQ ID NO: 4694284 - DNA, 21 bp, Homo sapiens
tgataatgttaaatttgtaag

SEQ ID NO: 4694285 - DNA, 22 bp, Homo sapiens
tgataatgttaaatttgtaagt

SEQ ID NO: 4694286 - DNA, 19 bp, Homo sapiens
tgatacgatagttacataa

SEQ ID NO: 4694287 - DNA, 20 bp, Homo sapiens
tgatacgatagttacataat

SEQ ID NO: 4694288 - DNA, 11 bp, Homo sapiens
tgatactgttg

SEQ ID NO: 4694289 - DNA, 13 bp, Homo sapiens
tgatagcacagac

SEQ ID NO: 4694290 - DNA, 18 bp, Homo sapiens
tgatagcacagaccctgc

SEQ ID NO: 4694291 - DNA, 21 bp, Homo sapiens
tgatagcacagaccctgccct

SEQ ID NO: 4694292 - DNA, 20 bp, Homo sapiens
tgatagggatacatgctctt

SEQ ID NO: 4694293 - DNA, 17 bp, Homo sapiens
tgatagtgcttcttgta

SEQ ID NO: 4694294 - DNA, 22 bp, Homo sapiens
tgatatagaacagtgcttgcca

SEQ ID NO: 4694295 - DNA, 21 bp, Homo sapiens
tgatatggtactaaggagaat

SEQ ID NO: 4694296 - DNA, 17 bp, Homo sapiens
tgatattgaccatgtga

SEQ ID NO: 4694297 - DNA, 19 bp, Homo sapiens
tgatatttattatattttt

SEQ ID NO: 4694298 - DNA, 23 bp, Homo sapiens
tgatatttccctcccctggggac

SEQ ID NO: 4694299 - DNA, 14 bp, Homo sapiens
tgatcaacatcttt

SEQ ID NO: 4694300 - DNA, 14 bp, Homo sapiens
tgatcacagcagct

SEQ ID NO: 4694301 - DNA, 21 bp, Homo sapiens
tgatcacggctcactgcagcc

SEQ ID NO: 4694302 - DNA, 21 bp, Homo sapiens
tgatcactgagccatcatttc

SEQ ID NO: 4694303 - DNA, 22 bp, Homo sapiens
tgatcactgagccatcatttcc

SEQ ID NO: 4694304 - DNA, 21 bp, Homo sapiens
tgatcagagccgtggtccttt

SEQ ID NO: 4694305 - DNA, 16 bp, Homo sapiens
tgatcatcatgtagaa

SEQ ID NO: 4694306 - DNA, 13 bp, Homo sapiens
tgatcatccactg

SEQ ID NO: 4694307 - DNA, 24 bp, Homo sapiens
tgatcatccactgtgccatgtgcc

SEQ ID NO: 4694308 - DNA, 14 bp, Homo sapiens
tgatcatctttgct

SEQ ID NO: 4694309 - DNA, 15 bp, Homo sapiens
tgatcctcccacctc

SEQ ID NO: 4694310 - DNA, 20 bp, Homo sapiens
tgatcctcccacctcagcct

SEQ ID NO: 4694311 - DNA, 22 bp, Homo sapiens
tgatcctcccacctcagcctcc

SEQ ID NO: 4694312 - DNA, 14 bp, Homo sapiens
tgatcctgtgaagt

SEQ ID NO: 4694313 - DNA, 20 bp, Homo sapiens
tgatctacttctgtaattgt

SEQ ID NO: 4694314 - DNA, 21 bp, Homo sapiens
tgatctacttctgtaattgtg

SEQ ID NO: 4694315 - DNA, 13 bp, Homo sapiens
tgatctaggaaga

SEQ ID NO: 4694316 - DNA, 15 bp, Homo sapiens
tgatctatttgtaga

SEQ ID NO: 4694317 - DNA, 20 bp, Homo sapiens
tgatctgctagtgctgtaat

SEQ ID NO: 4694318 - DNA, 18 bp, Homo sapiens
tgatctggtggttattta

SEQ ID NO: 4694319 - DNA, 16 bp, Homo sapiens
tgatctttgcagacag

SEQ ID NO: 4694320 - DNA, 18 bp, Homo sapiens
tgatctttgcagacaggc

SEQ ID NO: 4694321 - DNA, 23 bp, Homo sapiens
tgatctttgcagacaggcaagca

SEQ ID NO: 4694322 - DNA, 12 bp, Homo sapiens
tgatgaaaataa

SEQ ID NO: 4694323 - DNA, 13 bp, Homo sapiens
tgatgaaatcatt

SEQ ID NO: 4694324 - DNA, 15 bp, Homo sapiens
tgatgaatgaggaac

SEQ ID NO: 4694325 - DNA, 19 bp, Homo sapiens
tgatgacaactggaatagt

SEQ ID NO: 4694326 - DNA, 22 bp, Homo sapiens
tgatgatctttgcagacaggca

SEQ ID NO: 4694327 - DNA, 20 bp, Homo sapiens
tgatgatgaaatgaggtcag

SEQ ID NO: 4694328 - DNA, 20 bp, Homo sapiens
tgatgcatggagtgtttgac

SEQ ID NO: 4694329 - DNA, 20 bp, Homo sapiens
tgatgctacaggatttgaaa

SEQ ID NO: 4694330 - DNA, 18 bp, Homo sapiens
tgatgcttcttcagagac

SEQ ID NO: 4694331 - DNA, 21 bp, Homo sapiens
tgatgcttcttcagagactcc

SEQ ID NO: 4694332 - DNA, 22 bp, Homo sapiens
tgatgcttcttcagagactcct

SEQ ID NO: 4694333 - DNA, 23 bp, Homo sapiens
tgatgcttcttcagagactcctg

SEQ ID NO: 4694334 - DNA, 15 bp, Homo sapiens
tgatggcttctccag

SEQ ID NO: 4694335 - DNA, 21 bp, Homo sapiens
tgatgggcaacccccagcctg

SEQ ID NO: 4694336 - DNA, 15 bp, Homo sapiens
tgatggggccctgcc

SEQ ID NO: 4694337 - DNA, 19 bp, Homo sapiens
tgatggggccctgcctcct

SEQ ID NO: 4694338 - DNA, 22 bp, Homo sapiens
tgatggggccctgcctcctttg

SEQ ID NO: 4694339 - DNA, 22 bp, Homo sapiens
tgatggtaggtagcacagtgga

SEQ ID NO: 4694340 - DNA, 17 bp, Homo sapiens
tgatggtgatgaaatgt

SEQ ID NO: 4694341 - DNA, 17 bp, Homo sapiens
tgatgtctttttattaa

SEQ ID NO: 4694342 - DNA, 13 bp, Homo sapiens
tgatgtgcctggg

SEQ ID NO: 4694343 - DNA, 21 bp, Homo sapiens
tgatgttcagacatttatgtg

SEQ ID NO: 4694344 - DNA, 14 bp, Homo sapiens
tgatgttggctggg

SEQ ID NO: 4694345 - DNA, 17 bp, Homo sapiens
tgatgttgggaagctat

SEQ ID NO: 4694346 - DNA, 17 bp, Homo sapiens
tgattatggacatcgat

SEQ ID NO: 4694347 - DNA, 22 bp, Homo sapiens
tgattatggacatcgatatgaa

SEQ ID NO: 4694348 - DNA, 12 bp, Homo sapiens
tgattcaattca

SEQ ID NO: 4694349 - DNA, 21 bp, Homo sapiens
tgattcaattcaacactccct

SEQ ID NO: 4694350 - DNA, 22 bp, Homo sapiens
tgattcacccccaaacagtgac

SEQ ID NO: 4694351 - DNA, 18 bp, Homo sapiens
tgattcagacagctgcct

SEQ ID NO: 4694352 - DNA, 20 bp, Homo sapiens
tgattcagacagctgcctgg

SEQ ID NO: 4694353 - DNA, 23 bp, Homo sapiens
tgattcagacagctgcctgggat

SEQ ID NO: 4694354 - DNA, 24 bp, Homo sapiens
tgattcagtgttaaatgtgatgaa

SEQ ID NO: 4694355 - DNA, 15 bp, Homo sapiens
tgattcatattgcat

SEQ ID NO: 4694356 - DNA, 18 bp, Homo sapiens
tgattcccaagctctgct

SEQ ID NO: 4694357 - DNA, 11 bp, Homo sapiens
tgattctcagg

SEQ ID NO: 4694358 - DNA, 17 bp, Homo sapiens
tgccttcctcctgggcc

SEQ ID NO: 4694359 - DNA, 11 bp, Homo sapiens
tgccttctcag

SEQ ID NO: 4694360 - DNA, 15 bp, Homo sapiens
tgccttgaaatacct

SEQ ID NO: 4694361 - DNA, 14 bp, Homo sapiens
tgccttgacaaact

SEQ ID NO: 4694362 - DNA, 18 bp, Homo sapiens
tgccttggaagttgcatg

SEQ ID NO: 4694363 - DNA, 13 bp, Homo sapiens
tgcctttgacctg

SEQ ID NO: 4694364 - DNA, 15 bp, Homo sapiens
tgcctttgagacagt

SEQ ID NO: 4694365 - DNA, 17 bp, Homo sapiens
tgcctttgagacagttt

SEQ ID NO: 4694366 - DNA, 21 bp, Homo sapiens
tgcctttgagacagtttctta

SEQ ID NO: 4694367 - DNA, 23 bp, Homo sapiens
tgcctttgagacagtttcttagc

SEQ ID NO: 4694368 - DNA, 15 bp, Homo sapiens
tgcctttttgtttac

SEQ ID NO: 4694369 - DNA, 14 bp, Homo sapiens
tgcgaccccatctg

SEQ ID NO: 4694370 - DNA, 18 bp, Homo sapiens
tgcgaccccatctgccca

SEQ ID NO: 4694371 - DNA, 14 bp, Homo sapiens
tgcgagagatgtgt

SEQ ID NO: 4694372 - DNA, 14 bp, Homo sapiens
tgcgagtctgagtc

SEQ ID NO: 4694373 - DNA, 14 bp, Homo sapiens
tgcgatctgggttc

SEQ ID NO: 4694374 - DNA, 15 bp, Homo sapiens
tgcgatctgggttca

SEQ ID NO: 4694375 - DNA, 21 bp, Homo sapiens
tgcgatctgggttcactgcaa

SEQ ID NO: 4694376 - DNA, 21 bp, Homo sapiens
tgcgcaaactttaacaggttt

SEQ ID NO: 4694377 - DNA, 16 bp, Homo sapiens
tgcgcaggctggccct

SEQ ID NO: 4694378 - DNA, 19 bp, Homo sapiens
tgcgcaggctggccctgcc

SEQ ID NO: 4694379 - DNA, 22 bp, Homo sapiens
tgcgcaggctggccctgccctg

SEQ ID NO: 4694380 - DNA, 18 bp, Homo sapiens
tgcggacagccacggcca

SEQ ID NO: 4694381 - DNA, 20 bp, Homo sapiens
tgcggacagccacggccagg

SEQ ID NO: 4694382 - DNA, 21 bp, Homo sapiens
tgcggacagccacggccaggc

SEQ ID NO: 4694383 - DNA, 22 bp, Homo sapiens
tgcggacagccacggccaggcc

SEQ ID NO: 4694384 - DNA, 15 bp, Homo sapiens
tgcggagaacaaatg

SEQ ID NO: 4694385 - DNA, 14 bp, Homo sapiens
tgcgggtcacagga

SEQ ID NO: 4694386 - DNA, 17 bp, Homo sapiens
tgcgggtcacaggaggg

SEQ ID NO: 4694387 - DNA, 15 bp, Homo sapiens
tgcggtccacccagg

SEQ ID NO: 4694388 - DNA, 17 bp, Homo sapiens
tgcggtccacccaggag

SEQ ID NO: 4694389 - DNA, 17 bp, Homo sapiens
tgcggtgctatctcccc

SEQ ID NO: 4694390 - DNA, 21 bp, Homo sapiens
tgcggtgctatctcccccagc

SEQ ID NO: 4694391 - DNA, 23 bp, Homo sapiens
tgcggtgctatctcccccagccc

SEQ ID NO: 4694392 - DNA, 21 bp, Homo sapiens
tgcgtctgtgtgtgcctgtgt

SEQ ID NO: 4694393 - DNA, 17 bp, Homo sapiens
tgcgtgacaataaaaca

SEQ ID NO: 4694394 - DNA, 22 bp, Homo sapiens
tgcgtggcacatctaaattgat

SEQ ID NO: 4694395 - DNA, 20 bp, Homo sapiens
tgcgtgtgtagagttaagaa

SEQ ID NO: 4694396 - DNA, 16 bp, Homo sapiens
tgcgtgtgtctgtgtt

SEQ ID NO: 4694397 - DNA, 19 bp, Homo sapiens
tgctaaatttttaactgcc

SEQ ID NO: 4694398 - DNA, 15 bp, Homo sapiens
tgctaacccccaaat

SEQ ID NO: 4694399 - DNA, 16 bp, Homo sapiens
tgctaaccttgtagca

SEQ ID NO: 4694400 - DNA, 21 bp, Homo sapiens
tgctaccctccctgctgtccc

SEQ ID NO: 4694401 - DNA, 21 bp, Homo sapiens
tgctactgtcctacccaccct

SEQ ID NO: 4694402 - DNA, 22 bp, Homo sapiens
tgctactgtcctacccaccctc

SEQ ID NO: 4694403 - DNA, 18 bp, Homo sapiens
tgctactttgtatcctct

SEQ ID NO: 4694404 - DNA, 14 bp, Homo sapiens
tgctagctaaaaga

SEQ ID NO: 4694405 - DNA, 17 bp, Homo sapiens
tgctaggaacactcctt

SEQ ID NO: 4694406 - DNA, 22 bp, Homo sapiens
tgctaggaacactccttcacag

SEQ ID NO: 4694407 - DNA, 20 bp, Homo sapiens
tgctaggggttttaggtctc

SEQ ID NO: 4694408 - DNA, 14 bp, Homo sapiens
tgctatcaagaaat

SEQ ID NO: 4694409 - DNA, 14 bp, Homo sapiens
tgctatctccccca

SEQ ID NO: 4694410 - DNA, 19 bp, Homo sapiens
tgctatctcccccagcccc

SEQ ID NO: 4694411 - DNA, 12 bp, Homo sapiens
tgctcacaggca

SEQ ID NO: 4694412 - DNA, 14 bp, Homo sapiens
tgctcacaggcagg

SEQ ID NO: 4694413 - DNA, 15 bp, Homo sapiens
tgctcacatatctgt

SEQ ID NO: 4694414 - DNA, 16 bp, Homo sapiens
tgctcacatgtctttg

SEQ ID NO: 4694415 - DNA, 23 bp, Homo sapiens
tgctcagttcagaatcacttctg

SEQ ID NO: 4694416 - DNA, 21 bp, Homo sapiens
tgctcatagcgggcgctgcca

SEQ ID NO: 4694417 - DNA, 17 bp, Homo sapiens
tgctcatcattctctgt

SEQ ID NO: 4694418 - DNA, 23 bp, Homo sapiens
tgctcatcattctctgtctcatc

SEQ ID NO: 4694419 - DNA, 17 bp, Homo sapiens
tgctcatctgcagcctc

SEQ ID NO: 4694420 - DNA, 16 bp, Homo sapiens
tgctcattgctttcta

SEQ ID NO: 4694421 - DNA, 13 bp, Homo sapiens
tgctccacagtgt

SEQ ID NO: 4694422 - DNA, 13 bp, Homo sapiens
tgctccagcctga

SEQ ID NO: 4694423 - DNA, 14 bp, Homo sapiens
tgctccattttctt

SEQ ID NO: 4694424 - DNA, 18 bp, Homo sapiens
tgctccctggttctgatg

SEQ ID NO: 4694425 - DNA, 14 bp, Homo sapiens
tgctcctctcccca

SEQ ID NO: 4694426 - DNA, 16 bp, Homo sapiens
tgctccttgggccctt

SEQ ID NO: 4694427 - DNA, 23 bp, Homo sapiens
tgctcgggcccaggccatcttcc

SEQ ID NO: 4694428 - DNA, 19 bp, Homo sapiens
tgctctaagaagctgcaat

SEQ ID NO: 4694429 - DNA, 17 bp, Homo sapiens
tgctctccttcctggag

SEQ ID NO: 4694430 - DNA, 23 bp, Homo sapiens
tgctctccttcctggagcccaga

SEQ ID NO: 4694431 - DNA, 19 bp, Homo sapiens
tgctctgatcatccactgt

SEQ ID NO: 4694432 - DNA, 22 bp, Homo sapiens
tgctctgatcatccactgtgcc

SEQ ID NO: 4694433 - DNA, 23 bp, Homo sapiens
tgctctgcgtgtcacctgtgctt

SEQ ID NO: 4694434 - DNA, 15 bp, Homo sapiens
tgctctgctgacaga

SEQ ID NO: 4694435 - DNA, 15 bp, Homo sapiens
tgctctggacacttg

SEQ ID NO: 4694436 - DNA, 15 bp, Homo sapiens
tgctctggacaggca

SEQ ID NO: 4694437 - DNA, 16 bp, Homo sapiens
tgctctggacaggcat

SEQ ID NO: 4694438 - DNA, 12 bp, Homo sapiens
tgctgaaggctc

SEQ ID NO: 4694439 - DNA, 17 bp, Homo sapiens
tgctgaatgtaaaagaa

SEQ ID NO: 4694440 - DNA, 16 bp, Homo sapiens
tgctgaatgtcattat

SEQ ID NO: 4694441 - DNA, 15 bp, Homo sapiens
tgctgacagacacag

SEQ ID NO: 4694442 - DNA, 19 bp, Homo sapiens
tgctgacagacacaggccc

SEQ ID NO: 4694443 - DNA, 15 bp, Homo sapiens
tgctgagtctgaagg

SEQ ID NO: 4694444 - DNA, 23 bp, Homo sapiens
tgctgagtctgaaggctgggttc

SEQ ID NO: 4694445 - DNA, 18 bp, Homo sapiens
tgctgagttccggggtgc

SEQ ID NO: 4694446 - DNA, 21 bp, Homo sapiens
tgctgatcgccttatttatat

SEQ ID NO: 4694447 - DNA, 15 bp, Homo sapiens
tgctgatctttgtct

SEQ ID NO: 4694448 - DNA, 14 bp, Homo sapiens
tgctgcaccaaccc

SEQ ID NO: 4694449 - DNA, 20 bp, Homo sapiens
tgctgcaccaacccagccgc

SEQ ID NO: 4694450 - DNA, 22 bp, Homo sapiens
tgctgcaccaacccagccgctg

SEQ ID NO: 4694451 - DNA, 21 bp, Homo sapiens
tgctgcagaggggcaggccct

SEQ ID NO: 4694452 - DNA, 15 bp, Homo sapiens
tgctgcagttgccag

SEQ ID NO: 4694453 - DNA, 15 bp, Homo sapiens
tgctgccatccaggt

SEQ ID NO: 4694454 - DNA, 18 bp, Homo sapiens
tgctgccccatcagtgct

SEQ ID NO: 4694455 - DNA, 15 bp, Homo sapiens
tgctgcccctccctg

SEQ ID NO: 4694456 - DNA, 19 bp, Homo sapiens
tgctgccgccccacccaga

SEQ ID NO: 4694457 - DNA, 13 bp, Homo sapiens
tgctgcctcatgc

SEQ ID NO: 4694458 - DNA, 15 bp, Homo sapiens
tgctgctaccctccc

SEQ ID NO: 4694459 - DNA, 17 bp, Homo sapiens
tgctgctaccctccctg

SEQ ID NO: 4694460 - DNA, 23 bp, Homo sapiens
tgctgctaccctccctgctgtcc

SEQ ID NO: 4694461 - DNA, 21 bp, Homo sapiens
tgctggctggtgcctgagccc

SEQ ID NO: 4694462 - DNA, 16 bp, Homo sapiens
tgctggctggttagag

SEQ ID NO: 4694463 - DNA, 18 bp, Homo sapiens
tgctggctgttggctggg

SEQ ID NO: 4694464 - DNA, 21 bp, Homo sapiens
tgctgggattacaagcgtgag

SEQ ID NO: 4694465 - DNA, 20 bp, Homo sapiens
tgctgtcccctcttgcccca

SEQ ID NO: 4694466 - DNA, 21 bp, Homo sapiens
tgctgtcccctcttgccccaa

SEQ ID NO: 4694467 - DNA, 19 bp, Homo sapiens
tgctgtgaataaaaagaaa

SEQ ID NO: 4694468 - DNA, 19 bp, Homo sapiens
tgctgtgaattagctcact

SEQ ID NO: 4694469 - DNA, 14 bp, Homo sapiens
tgtgaggccagggc

SEQ ID NO: 4694470 - DNA, 16 bp, Homo sapiens
tgtgaggccagggcag

SEQ ID NO: 4694471 - DNA, 18 bp, Homo sapiens
tgtgagtactacagtcct

SEQ ID NO: 4694472 - DNA, 20 bp, Homo sapiens
tgtgagtactacagtcctcc

SEQ ID NO: 4694473 - DNA, 17 bp, Homo sapiens
tgtgagtcaccaagccc

SEQ ID NO: 4694474 - DNA, 21 bp, Homo sapiens
tgtgagtcaccaagcccagtt

SEQ ID NO: 4694475 - DNA, 19 bp, Homo sapiens
tgtgatactattaccacca

SEQ ID NO: 4694476 - DNA, 16 bp, Homo sapiens
tgtgatgaatactgta

SEQ ID NO: 4694477 - DNA, 16 bp, Homo sapiens
tgtgatggggccctgc

SEQ ID NO: 4694478 - DNA, 17 bp, Homo sapiens
tgtgatggggccctgcc

SEQ ID NO: 4694479 - DNA, 18 bp, Homo sapiens
tgtgatggggccctgcct

SEQ ID NO: 4694480 - DNA, 20 bp, Homo sapiens
tgtgatggggccctgcctcc

SEQ ID NO: 4694481 - DNA, 22 bp, Homo sapiens
tgtgatttcccgtggccccagc

SEQ ID NO: 4694482 - DNA, 14 bp, Homo sapiens
tgtgcaaaagcagg

SEQ ID NO: 4694483 - DNA, 13 bp, Homo sapiens
tgtgcaaacagtg

SEQ ID NO: 4694484 - DNA, 24 bp, Homo sapiens
tgtgcaactcttgtattgctccat

SEQ ID NO: 4694485 - DNA, 23 bp, Homo sapiens
tgtgcaccagtgtgacaggaaag

SEQ ID NO: 4694486 - DNA, 14 bp, Homo sapiens
tgtgcacgtacaca

SEQ ID NO: 4694487 - DNA, 19 bp, Homo sapiens
tgtgcatagagccacgtat

SEQ ID NO: 4694488 - DNA, 14 bp, Homo sapiens
tgtgccaccctggg

SEQ ID NO: 4694489 - DNA, 22 bp, Homo sapiens
tgtgccaccctgggctctgtgg

SEQ ID NO: 4694490 - DNA, 20 bp, Homo sapiens
tgtgccaggtttttggtctg

SEQ ID NO: 4694491 - DNA, 14 bp, Homo sapiens
tgtgcccatgggca

SEQ ID NO: 4694492 - DNA, 20 bp, Homo sapiens
tgtgccccccatcctggccc

SEQ ID NO: 4694493 - DNA, 15 bp, Homo sapiens
tgtgcccttctctta

SEQ ID NO: 4694494 - DNA, 15 bp, Homo sapiens
tgtgccgacagaagg

SEQ ID NO: 4694495 - DNA, 14 bp, Homo sapiens
tgtgcctaatgtgt

SEQ ID NO: 4694496 - DNA, 17 bp, Homo sapiens
tgtgcctaatgtgtttg

SEQ ID NO: 4694497 - DNA, 22 bp, Homo sapiens
tgtgcctgtgtgcgagtctgag

SEQ ID NO: 4694498 - DNA, 14 bp, Homo sapiens
tgtgcgagtctgag

SEQ ID NO: 4694499 - DNA, 22 bp, Homo sapiens
tgtgctctgatcatccactgtg

SEQ ID NO: 4694500 - DNA, 16 bp, Homo sapiens
tgtgctctggacaggc

SEQ ID NO: 4694501 - DNA, 18 bp, Homo sapiens
tgtgctctggacaggcat

SEQ ID NO: 4694502 - DNA, 14 bp, Homo sapiens
tgtgctgccctgcc

SEQ ID NO: 4694503 - DNA, 20 bp, Homo sapiens
tgtgctgccctgcccacctg

SEQ ID NO: 4694504 - DNA, 13 bp, Homo sapiens
tgtgctggagcca

SEQ ID NO: 4694505 - DNA, 19 bp, Homo sapiens
tgtgctggagccactaact

SEQ ID NO: 4694506 - DNA, 20 bp, Homo sapiens
tgtgctggagccactaacta

SEQ ID NO: 4694507 - DNA, 19 bp, Homo sapiens
tgtgctgggagcaggactg

SEQ ID NO: 4694508 - DNA, 16 bp, Homo sapiens
tgtggacacagctctt

SEQ ID NO: 4694509 - DNA, 14 bp, Homo sapiens
tgtggaggaaggat

SEQ ID NO: 4694510 - DNA, 17 bp, Homo sapiens
tgtggaggaaggattgt

SEQ ID NO: 4694511 - DNA, 19 bp, Homo sapiens
tgtggaggccgagtctgtc

SEQ ID NO: 4694512 - DNA, 15 bp, Homo sapiens
tgtggattcagcttc

SEQ ID NO: 4694513 - DNA, 14 bp, Homo sapiens
tgtggattctttaa

SEQ ID NO: 4694514 - DNA, 24 bp, Homo sapiens
tgtggcaagcaagagctcttgtga

SEQ ID NO: 4694515 - DNA, 11 bp, Homo sapiens
tgtggcaggag

SEQ ID NO: 4694516 - DNA, 18 bp, Homo sapiens
tgtggccaagttcttagt

SEQ ID NO: 4694517 - DNA, 22 bp, Homo sapiens
tgtggcctaccttgtgagggag

SEQ ID NO: 4694518 - DNA, 16 bp, Homo sapiens
tgtggcctgggcctcc

SEQ ID NO: 4694519 - DNA, 20 bp, Homo sapiens
tgtgggcgtgagacctgccc

SEQ ID NO: 4694520 - DNA, 22 bp, Homo sapiens
tgtgggcgtgagacctgcccct

SEQ ID NO: 4694521 - DNA, 14 bp, Homo sapiens
tgtgggctgcactc

SEQ ID NO: 4694522 - DNA, 20 bp, Homo sapiens
tgtgggctgcactctgtgcc

SEQ ID NO: 4694523 - DNA, 16 bp, Homo sapiens
tgtggtgtttcctggc

SEQ ID NO: 4694524 - DNA, 20 bp, Homo sapiens
tgtggtgtttcctggcactg

SEQ ID NO: 4694525 - DNA, 14 bp, Homo sapiens
tgtggttaatgcca

SEQ ID NO: 4694526 - DNA, 22 bp, Homo sapiens
tgtggttcagctactttccatt

SEQ ID NO: 4694527 - DNA, 21 bp, Homo sapiens
tgtggtttcagttctgtgtac

SEQ ID NO: 4694528 - DNA, 22 bp, Homo sapiens
tgtggtttcagttctgtgtaca

SEQ ID NO: 4694529 - DNA, 14 bp, Homo sapiens
tgtgtaaatgttat

SEQ ID NO: 4694530 - DNA, 15 bp, Homo sapiens
tgtgtaaatgttatg

SEQ ID NO: 4694531 - DNA, 17 bp, Homo sapiens
tgtgtaaatgttatgac

SEQ ID NO: 4694532 - DNA, 22 bp, Homo sapiens
tgtgtaagaaaacaaactaaat

SEQ ID NO: 4694533 - DNA, 22 bp, Homo sapiens
tgtgtagagtggcgattgaatg

SEQ ID NO: 4694534 - DNA, 21 bp, Homo sapiens
tgtgtagagttaagaagctgt

SEQ ID NO: 4694535 - DNA, 16 bp, Homo sapiens
tgtgtataattttaaa

SEQ ID NO: 4694536 - DNA, 19 bp, Homo sapiens
tgtgtatagtgccaccaca

SEQ ID NO: 4694537 - DNA, 12 bp, Homo sapiens
tgtgtatgagaa

SEQ ID NO: 4694538 - DNA, 21 bp, Homo sapiens
tgtgtatgagaagtactttgt

SEQ ID NO: 4694539 - DNA, 22 bp, Homo sapiens
tgtgtatgagaagtactttgtg

SEQ ID NO: 4694540 - DNA, 13 bp, Homo sapiens
tgtgtcactggct

SEQ ID NO: 4694541 - DNA, 22 bp, Homo sapiens
tgtgtcactggctgcctccact

SEQ ID NO: 4694542 - DNA, 23 bp, Homo sapiens
tgtgtcactggctgcctccactc

SEQ ID NO: 4694543 - DNA, 19 bp, Homo sapiens
tgtgtccacgactgtctcc

SEQ ID NO: 4694544 - DNA, 15 bp, Homo sapiens
tgtgtcccagtgaac

SEQ ID NO: 4694545 - DNA, 16 bp, Homo sapiens
tgtgtccccctctgtc

SEQ ID NO: 4694546 - DNA, 23 bp, Homo sapiens
tgtgtctggtccaggagaagtat

SEQ ID NO: 4694547 - DNA, 18 bp, Homo sapiens
tgtgtgctcttcttcttt

SEQ ID NO: 4694548 - DNA, 14 bp, Homo sapiens
tgtgtggtcaacat

SEQ ID NO: 4694549 - DNA, 17 bp, Homo sapiens
tgtgtggttcagctact

SEQ ID NO: 4694550 - DNA, 18 bp, Homo sapiens
tgtgtgtatctgtgggtc

SEQ ID NO: 4694551 - DNA, 22 bp, Homo sapiens
tgtgtgtccacgactgtctcca

SEQ ID NO: 4694552 - DNA, 20 bp, Homo sapiens
tgtgtgtgcttatgtatgag

SEQ ID NO: 4694553 - DNA, 13 bp, Homo sapiens
tgtgtgttcacct

SEQ ID NO: 4694554 - DNA, 22 bp, Homo sapiens
tgtgtgttcaccttcaaaatgt

SEQ ID NO: 4694555 - DNA, 15 bp, Homo sapiens
tgtgtgttgatactg

SEQ ID NO: 4694556 - DNA, 20 bp, Homo sapiens
tgtgttgatactgttgcacg

SEQ ID NO: 4694557 - DNA, 21 bp, Homo sapiens
tgtgttgatactgttgcacgt

SEQ ID NO: 4694558 - DNA, 22 bp, Homo sapiens
tgtgttgatactgttgcacgtg

SEQ ID NO: 4694559 - DNA, 16 bp, Homo sapiens
tgtgttgcataaacaa

SEQ ID NO: 4694560 - DNA, 16 bp, Homo sapiens
tgtgtttttctattaa

SEQ ID NO: 4694561 - DNA, 19 bp, Homo sapiens
tgtgtttttctattaaaag

SEQ ID NO: 4694562 - DNA, 14 bp, Homo sapiens
tgttaaatttgtaa

SEQ ID NO: 4694563 - DNA, 16 bp, Homo sapiens
tgttaaatttgtaagt

SEQ ID NO: 4694564 - DNA, 17 bp, Homo sapiens
tgttaaatttgtaagtt

SEQ ID NO: 4694565 - DNA, 18 bp, Homo sapiens
tgttaaatttgtaagttt

SEQ ID NO: 4694566 - DNA, 14 bp, Homo sapiens
tgttaactatgaca

SEQ ID NO: 4694567 - DNA, 22 bp, Homo sapiens
tgttaactatgacagatatatt

SEQ ID NO: 4694568 - DNA, 18 bp, Homo sapiens
tgttaactgttaactatg

SEQ ID NO: 4694569 - DNA, 19 bp, Homo sapiens
tgttaactgttaactatga

SEQ ID NO: 4694570 - DNA, 14 bp, Homo sapiens
tgttaaggaaactc

SEQ ID NO: 4694571 - DNA, 15 bp, Homo sapiens
tgttaaggaaactct

SEQ ID NO: 4694572 - DNA, 18 bp, Homo sapiens
tgttaataaaagtacatg

SEQ ID NO: 4694573 - DNA, 14 bp, Homo sapiens
tgttaatcaaacaa

SEQ ID NO: 4694574 - DNA, 16 bp, Homo sapiens
tgttaatcaaacaagt

SEQ ID NO: 4694575 - DNA, 19 bp, Homo sapiens
tgttaattttcctcatttt

SEQ ID NO: 4694576 - DNA, 15 bp, Homo sapiens
tgttacctgaaaaca

SEQ ID NO: 4694577 - DNA, 16 bp, Homo sapiens
tgttacctgaaaacac

SEQ ID NO: 4694578 - DNA, 18 bp, Homo sapiens
tgttaccttttacagaat

SEQ ID NO: 4694579 - DNA, 20 bp, Homo sapiens
tgttactaaaaaaaagatga

SEQ ID NO: 4694580 - DNA, 13 bp, Homo sapiens
tgttactgtctgt

SEQ ID NO: 4694581 - DNA, 18 bp, Homo sapiens
tgttagaataattttatt

SEQ ID NO: 4694582 - DNA, 15 bp, Homo sapiens
tgttagtattttaat

SEQ ID NO: 4694583 - DNA, 22 bp, Homo sapiens
tgttatcaccttccaaacaaaa

SEQ ID NO: 4694584 - DNA, 12 bp, Homo sapiens
tgttatcttgtg

SEQ ID NO: 4694585 - DNA, 22 bp, Homo sapiens
tgttatgacagccctaggaaac

SEQ ID NO: 4694586 - DNA, 21 bp, Homo sapiens
tgttattagagattacctcct

SEQ ID NO: 4694587 - DNA, 16 bp, Homo sapiens
tgttattcttttccag

SEQ ID NO: 4694588 - DNA, 19 bp, Homo sapiens
tgttatttacactggtcta

SEQ ID NO: 4694589 - DNA, 15 bp, Homo sapiens
tgttatttattgaaa

SEQ ID NO: 4694590 - DNA, 18 bp, Homo sapiens
tgttcaatctgtgtaaga

SEQ ID NO: 4694591 - DNA, 21 bp, Homo sapiens
tgttcaatctgtgtaagaaaa

SEQ ID NO: 4694592 - DNA, 23 bp, Homo sapiens
tgttcaatctgtgtaagaaaaca

SEQ ID NO: 4694593 - DNA, 20 bp, Homo sapiens
tgttcaccttcaaaatgttc

SEQ ID NO: 4694594 - DNA, 21 bp, Homo sapiens
tgttcaccttcaaaatgttct

SEQ ID NO: 4694595 - DNA, 17 bp, Homo sapiens
tgttcacttttgacaaa

SEQ ID NO: 4694596 - DNA, 18 bp, Homo sapiens
tgttcagctccagctcac

SEQ ID NO: 4694597 - DNA, 21 bp, Homo sapiens
tgttcagctccagctcaccag

SEQ ID NO: 4694598 - DNA, 22 bp, Homo sapiens
tgttcatatagtcaatgtaaaa

SEQ ID NO: 4694599 - DNA, 12 bp, Homo sapiens
tgttccaaatgt

SEQ ID NO: 4694600 - DNA, 15 bp, Homo sapiens
tgttccccctgtgca

SEQ ID NO: 4694601 - DNA, 13 bp, Homo sapiens
tgttcccctcctc

SEQ ID NO: 4694602 - DNA, 20 bp, Homo sapiens
tgttccccttccactgaggg

SEQ ID NO: 4694603 - DNA, 20 bp, Homo sapiens
tgttctacttgatatttcct

SEQ ID NO: 4694604 - DNA, 21 bp, Homo sapiens
tgttctatttcagtgccaata

SEQ ID NO: 4694605 - DNA, 13 bp, Homo sapiens
tgttctctgccct

SEQ ID NO: 4694606 - DNA, 15 bp, Homo sapiens
tgttctgctttcctc

SEQ ID NO: 4694607 - DNA, 17 bp, Homo sapiens
tgttctggctcttccag

SEQ ID NO: 4694608 - DNA, 16 bp, Homo sapiens
tgttctgggacacagt

SEQ ID NO: 4694609 - DNA, 16 bp, Homo sapiens
tgttctgtcccttgcc

SEQ ID NO: 4694610 - DNA, 16 bp, Homo sapiens
tgttcttaagacgtga

SEQ ID NO: 4694611 - DNA, 13 bp, Homo sapiens
tgttcttgaattt

SEQ ID NO: 4694612 - DNA, 18 bp, Homo sapiens
tgttgacttctatcctgt

SEQ ID NO: 4694613 - DNA, 15 bp, Homo sapiens
tgttgatactgttgc

SEQ ID NO: 4694614 - DNA, 21 bp, Homo sapiens
tgttgcacgtgtgtttttcta

SEQ ID NO: 4694615 - DNA, 16 bp, Homo sapiens
tgttgcactgaaaacc

SEQ ID NO: 4694616 - DNA, 15 bp, Homo sapiens
tgttgcccaggcagg

SEQ ID NO: 4694617 - DNA, 17 bp, Homo sapiens
tgttgcccaggcaggtc

SEQ ID NO: 4694618 - DNA, 19 bp, Homo sapiens
tgttgcccaggcaggtctt

SEQ ID NO: 4694619 - DNA, 13 bp, Homo sapiens
tgttgctgcctca

SEQ ID NO: 4694620 - DNA, 19 bp, Homo sapiens
tgttgctgtacaaaagcaa

SEQ ID NO: 4694621 - DNA, 17 bp, Homo sapiens
tgttggatttttgtctt

SEQ ID NO: 4694622 - DNA, 15 bp, Homo sapiens
tgttggccaaagcca

SEQ ID NO: 4694623 - DNA, 16 bp, Homo sapiens
tgttggccaggctggt

SEQ ID NO: 4694624 - DNA, 17 bp, Homo sapiens
tgttggctgggggcctc

SEQ ID NO: 4694625 - DNA, 23 bp, Homo sapiens
tgttggtgcaattaactctggac

SEQ ID NO: 4694626 - DNA, 15 bp, Homo sapiens
tgttgtacatttatg

SEQ ID NO: 4694627 - DNA, 14 bp, Homo sapiens
tgttgtcatgtgta

SEQ ID NO: 4694628 - DNA, 18 bp, Homo sapiens
tgtttaagcatcacatta

SEQ ID NO: 4694629 - DNA, 12 bp, Homo sapiens
tgtttacaaaca

SEQ ID NO: 4694630 - DNA, 23 bp, Homo sapiens
tgtttacaaacatggaaaacaga

SEQ ID NO: 4694631 - DNA, 17 bp, Homo sapiens
tgtttacagatccccaa

SEQ ID NO: 4694632 - DNA, 13 bp, Homo sapiens
tgtttactaggga

SEQ ID NO: 4694633 - DNA, 15 bp, Homo sapiens
tgtttagatgaatgt

SEQ ID NO: 4694634 - DNA, 16 bp, Homo sapiens
tgtttagctatttaat

SEQ ID NO: 4694635 - DNA, 20 bp, Homo sapiens
tgtttagctatttaatacta

SEQ ID NO: 4694636 - DNA, 16 bp, Homo sapiens
tgtttatacctttgcc

SEQ ID NO: 4694637 - DNA, 22 bp, Homo sapiens
tgtttatgttgtttataataaa

SEQ ID NO: 4694638 - DNA, 23 bp, Homo sapiens
tgtttcctggcactgcttccagt

SEQ ID NO: 4694639 - DNA, 13 bp, Homo sapiens
tgtttggagacag

SEQ ID NO: 4694640 - DNA, 15 bp, Homo sapiens
tgtttggaggagcaa

SEQ ID NO: 4694641 - DNA, 15 bp, Homo sapiens
tgtttggggatgaga

SEQ ID NO: 4694642 - DNA, 19 bp, Homo sapiens
tgtttggggatgagaaagg

SEQ ID NO: 4694643 - DNA, 16 bp, Homo sapiens
tgtttgtcttctcccc

SEQ ID NO: 4694644 - DNA, 17 bp, Homo sapiens
tgtttgtcttctcccca

SEQ ID NO: 4694645 - DNA, 14 bp, Homo sapiens
tgtttgtgctgtgg

SEQ ID NO: 4694646 - DNA, 19 bp, Homo sapiens
tgtttgttatttacactgg

SEQ ID NO: 4694647 - DNA, 17 bp, Homo sapiens
tgttttaagaggcaggg

SEQ ID NO: 4694648 - DNA, 13 bp, Homo sapiens
tgttttaattgta

SEQ ID NO: 4694649 - DNA, 15 bp, Homo sapiens
tgttttccagctcct

SEQ ID NO: 4694650 - DNA, 20 bp, Homo sapiens
tgttttccatgagtcccctg

SEQ ID NO: 4694651 - DNA, 18 bp, Homo sapiens
tgttttgcacagccaaat

SEQ ID NO: 4694652 - DNA, 17 bp, Homo sapiens
tgttttgtttggagaca

SEQ ID NO: 4694653 - DNA, 14 bp, Homo sapiens
tgtttttctattaa

SEQ ID NO: 4694654 - DNA, 14 bp, Homo sapiens
tgtttttgtgtaga

SEQ ID NO: 4694655 - DNA, 15 bp, Homo sapiens
ttaaaaaagagacat

SEQ ID NO: 4694656 - DNA, 20 bp, Homo sapiens
ttaaaaatgtagaaattctt

SEQ ID NO: 4694657 - DNA, 23 bp, Homo sapiens
ttaaaacctggaccttttctgga

SEQ ID NO: 4694658 - DNA, 13 bp, Homo sapiens
ttaaaagactcat

SEQ ID NO: 4694659 - DNA, 16 bp, Homo sapiens
ttaaaaggtataatta

SEQ ID NO: 4694660 - DNA, 19 bp, Homo sapiens
ttaaaaggtataattaaac

SEQ ID NO: 4694661 - DNA, 13 bp, Homo sapiens
ttaaaatccagta

SEQ ID NO: 4694662 - DNA, 12 bp, Homo sapiens
ttaaaatcctca

SEQ ID NO: 4694663 - DNA, 13 bp, Homo sapiens
ttaaaatcctcaa

SEQ ID NO: 4694664 - DNA, 11 bp, Homo sapiens
ttaaaatgctg

SEQ ID NO: 4694665 - DNA, 22 bp, Homo sapiens
ttaaaatggatttaatccattt

SEQ ID NO: 4694666 - DNA, 18 bp, Homo sapiens
ttaaaatgttggtgcaat

SEQ ID NO: 4694667 - DNA, 19 bp, Homo sapiens
ttaaacaatataagaagga

SEQ ID NO: 4694668 - DNA, 14 bp, Homo sapiens
ttaaactaaatgtg

SEQ ID NO: 4694669 - DNA, 16 bp, Homo sapiens
ttaaactgtattttat

SEQ ID NO: 4694670 - DNA, 14 bp, Homo sapiens
ttaaagcaaaggag

SEQ ID NO: 4694671 - DNA, 16 bp, Homo sapiens
ttaaagcaattgcata

SEQ ID NO: 4694672 - DNA, 15 bp, Homo sapiens
ttaaaggacaaacag

SEQ ID NO: 4694673 - DNA, 17 bp, Homo sapiens
ttaaaggacaaacagtg

SEQ ID NO: 4694674 - DNA, 16 bp, Homo sapiens
ttaaagtaatttctaa

SEQ ID NO: 4694675 - DNA, 21 bp, Homo sapiens
ttaaagttgtataaaaacatg

SEQ ID NO: 4694676 - DNA, 13 bp, Homo sapiens
ttaaatgcccagc

SEQ ID NO: 4694677 - DNA, 14 bp, Homo sapiens
ttaaatgcccagcc

SEQ ID NO: 4694678 - DNA, 17 bp, Homo sapiens
ttaaatgtatcacattg

SEQ ID NO: 4694679 - DNA, 14 bp, Homo sapiens
ttaaattctctcta

SEQ ID NO: 4694680 - DNA, 17 bp, Homo sapiens
ttaaattgtgtacactt

SEQ ID NO: 4694681 - DNA, 23 bp, Homo sapiens
ttaaatttggtttgttaattctt

SEQ ID NO: 4694682 - DNA, 17 bp, Homo sapiens
ttaaatttgtaagtttc

SEQ ID NO: 4694683 - DNA, 15 bp, Homo sapiens
ttaacaactgggtca

SEQ ID NO: 4694684 - DNA, 16 bp, Homo sapiens
ttaacactcatttcca

SEQ ID NO: 4694685 - DNA, 17 bp, Homo sapiens
ttaacactgtaatatct

SEQ ID NO: 4694686 - DNA, 17 bp, Homo sapiens
ttaaccaagttgtttat

SEQ ID NO: 4694687 - DNA, 19 bp, Homo sapiens
ttaactgccgtaatttaac

SEQ ID NO: 4694688 - DNA, 12 bp, Homo sapiens
ttaactgccttt

SEQ ID NO: 4694689 - DNA, 12 bp, Homo sapiens
ttaactgtggat

SEQ ID NO: 4694690 - DNA, 20 bp, Homo sapiens
ttaacttaacccagatttta

SEQ ID NO: 4694691 - DNA, 22 bp, Homo sapiens
tggcccatcccccctcaccagg

SEQ ID NO: 4694692 - DNA, 12 bp, Homo sapiens
tggccccagcct

SEQ ID NO: 4694693 - DNA, 17 bp, Homo sapiens
tggccccagcctggccc

SEQ ID NO: 4694694 - DNA, 18 bp, Homo sapiens
tggccccagcctggccca

SEQ ID NO: 4694695 - DNA, 19 bp, Homo sapiens
tggccccagcctggcccag

SEQ ID NO: 4694696 - DNA, 21 bp, Homo sapiens
tggccccagcctggcccagct

SEQ ID NO: 4694697 - DNA, 13 bp, Homo sapiens
tggcccctcaggg

SEQ ID NO: 4694698 - DNA, 20 bp, Homo sapiens
tggcccctcagggtccctgg

SEQ ID NO: 4694699 - DNA, 20 bp, Homo sapiens
tggcccctgcccggctgcgg

SEQ ID NO: 4694700 - DNA, 20 bp, Homo sapiens
tggccctcaaggcctcccac

SEQ ID NO: 4694701 - DNA, 22 bp, Homo sapiens
tggccctcaaggcctcccacag

SEQ ID NO: 4694702 - DNA, 18 bp, Homo sapiens
tggccctctcccctgccc

SEQ ID NO: 4694703 - DNA, 13 bp, Homo sapiens
tggccctgccctg

SEQ ID NO: 4694704 - DNA, 23 bp, Homo sapiens
tggccgcgccaaataatgtctct

SEQ ID NO: 4694705 - DNA, 22 bp, Homo sapiens
tggccgttgatgttggctggga

SEQ ID NO: 4694706 - DNA, 23 bp, Homo sapiens
tggcctccaagtccacagtggaa

SEQ ID NO: 4694707 - DNA, 14 bp, Homo sapiens
tggcctcccaactc

SEQ ID NO: 4694708 - DNA, 21 bp, Homo sapiens
tggcctcccaactcaccccag

SEQ ID NO: 4694709 - DNA, 14 bp, Homo sapiens
tggcctcgcctggc

SEQ ID NO: 4694710 - DNA, 15 bp, Homo sapiens
tggcctcgcctggcc

SEQ ID NO: 4694711 - DNA, 18 bp, Homo sapiens
tggcctctctgacatatg

SEQ ID NO: 4694712 - DNA, 15 bp, Homo sapiens
tggcgacaagagtga

SEQ ID NO: 4694713 - DNA, 13 bp, Homo sapiens
tggcgcaccctcc

SEQ ID NO: 4694714 - DNA, 15 bp, Homo sapiens
tggcgcaccctcccc

SEQ ID NO: 4694715 - DNA, 16 bp, Homo sapiens
tggcgcaccctcccct

SEQ ID NO: 4694716 - DNA, 19 bp, Homo sapiens
tggcgtcctctccctcctg

SEQ ID NO: 4694717 - DNA, 21 bp, Homo sapiens
tggcgtcctctccctcctggc

SEQ ID NO: 4694718 - DNA, 23 bp, Homo sapiens
tggcgtcctctccctcctggcca

SEQ ID NO: 4694719 - DNA, 24 bp, Homo sapiens
tggctatcaaaagaaatagaaaag

SEQ ID NO: 4694720 - DNA, 14 bp, Homo sapiens
tggctcacactgag

SEQ ID NO: 4694721 - DNA, 15 bp, Homo sapiens
tggctcacactgaga

SEQ ID NO: 4694722 - DNA, 21 bp, Homo sapiens
tggctcactatggtgccaatg

SEQ ID NO: 4694723 - DNA, 13 bp, Homo sapiens
tggctgaactcat

SEQ ID NO: 4694724 - DNA, 11 bp, Homo sapiens
tggctgaagga

SEQ ID NO: 4694725 - DNA, 12 bp, Homo sapiens
tggctgaaggac

SEQ ID NO: 4694726 - DNA, 12 bp, Homo sapiens
tggctgcaaagg

SEQ ID NO: 4694727 - DNA, 12 bp, Homo sapiens
tggctgcatgcg

SEQ ID NO: 4694728 - DNA, 13 bp, Homo sapiens
tggctgctgaagg

SEQ ID NO: 4694729 - DNA, 14 bp, Homo sapiens
tggctgctgaaggc

SEQ ID NO: 4694730 - DNA, 11 bp, Homo sapiens
tggctgctgcc

SEQ ID NO: 4694731 - DNA, 14 bp, Homo sapiens
tggctgctgcccag

SEQ ID NO: 4694732 - DNA, 21 bp, Homo sapiens
tggctggccttccacttggct

SEQ ID NO: 4694733 - DNA, 20 bp, Homo sapiens
tggctggggcctatcagtgt

SEQ ID NO: 4694734 - DNA, 12 bp, Homo sapiens
tggctgggggcc

SEQ ID NO: 4694735 - DNA, 15 bp, Homo sapiens
tggctgggggcctca

SEQ ID NO: 4694736 - DNA, 17 bp, Homo sapiens
tggctgggggcctcagt

SEQ ID NO: 4694737 - DNA, 20 bp, Homo sapiens
tggctgggggcctcagtgcc

SEQ ID NO: 4694738 - DNA, 16 bp, Homo sapiens
tggggcagcttgaggg

SEQ ID NO: 4694739 - DNA, 23 bp, Homo sapiens
tggggctaggaaatccagggtgg

SEQ ID NO: 4694740 - DNA, 20 bp, Homo sapiens
tggggctgcaccggctggcc

SEQ ID NO: 4694741 - DNA, 23 bp, Homo sapiens
tggggctgcaccggctggcctgg

SEQ ID NO: 4694742 - DNA, 13 bp, Homo sapiens
tggggctgctggc

SEQ ID NO: 4694743 - DNA, 14 bp, Homo sapiens
tggggtacccactg

SEQ ID NO: 4694744 - DNA, 19 bp, Homo sapiens
tggggtacccactgctctg

SEQ ID NO: 4694745 - DNA, 15 bp, Homo sapiens
tggggtggagtccca

SEQ ID NO: 4694746 - DNA, 15 bp, Homo sapiens
tgggtaaatgcagcg

SEQ ID NO: 4694747 - DNA, 17 bp, Homo sapiens
tgggtacttgtggacac

SEQ ID NO: 4694748 - DNA, 18 bp, Homo sapiens
tgggtacttgtggacaca

SEQ ID NO: 4694749 - DNA, 18 bp, Homo sapiens
tgggtccaggcctggcca

SEQ ID NO: 4694750 - DNA, 20 bp, Homo sapiens
tgggtccaggcctggccatg

SEQ ID NO: 4694751 - DNA, 14 bp, Homo sapiens
tgggtccatgggca

SEQ ID NO: 4694752 - DNA, 16 bp, Homo sapiens
tgggtgatttctagaa

SEQ ID NO: 4694753 - DNA, 20 bp, Homo sapiens
tgggtgatttctagaatggt

SEQ ID NO: 4694754 - DNA, 23 bp, Homo sapiens
tgggtgcgaccccatctgcccag

SEQ ID NO: 4694755 - DNA, 15 bp, Homo sapiens
tgggtgcttggagga

SEQ ID NO: 4694756 - DNA, 14 bp, Homo sapiens
tgggtggcccatcc

SEQ ID NO: 4694757 - DNA, 19 bp, Homo sapiens
tgggtgggccctgccggga

SEQ ID NO: 4694758 - DNA, 14 bp, Homo sapiens
tgggtgtggcgcag

SEQ ID NO: 4694759 - DNA, 23 bp, Homo sapiens
tgggttcaagcgattcttctgct

SEQ ID NO: 4694760 - DNA, 22 bp, Homo sapiens
tgggttccttcctctgagcctt

SEQ ID NO: 4694761 - DNA, 15 bp, Homo sapiens
tgggttctacccagg

SEQ ID NO: 4694762 - DNA, 23 bp, Homo sapiens
tgggttggcgcaccctcccctcc

SEQ ID NO: 4694763 - DNA, 18 bp, Homo sapiens
tgggtttacaacaaacac

SEQ ID NO: 4694764 - DNA, 20 bp, Homo sapiens
tgggtttacaacaaacactg

SEQ ID NO: 4694765 - DNA, 22 bp, Homo sapiens
tgggtttacaacaaacactgtg

SEQ ID NO: 4694766 - DNA, 22 bp, Homo sapiens
tggtaagatgtcttgaaaacat

SEQ ID NO: 4694767 - DNA, 13 bp, Homo sapiens
tggtacaaatgtg

SEQ ID NO: 4694768 - DNA, 18 bp, Homo sapiens
tggtaccaggtctcctcc

SEQ ID NO: 4694769 - DNA, 19 bp, Homo sapiens
tggtagccagttgaattta

SEQ ID NO: 4694770 - DNA, 17 bp, Homo sapiens
tggtaggactgtagaaa

SEQ ID NO: 4694771 - DNA, 15 bp, Homo sapiens
tggtagttttacagt

SEQ ID NO: 4694772 - DNA, 13 bp, Homo sapiens
tggtatagaaatg

SEQ ID NO: 4694773 - DNA, 15 bp, Homo sapiens
tggtatgttgggata

SEQ ID NO: 4694774 - DNA, 15 bp, Homo sapiens
tggtattacacagtc

SEQ ID NO: 4694775 - DNA, 12 bp, Homo sapiens
tggtccaggaga

SEQ ID NO: 4694776 - DNA, 19 bp, Homo sapiens
tggtccatagagagcaaga

SEQ ID NO: 4694777 - DNA, 22 bp, Homo sapiens
tggtccatgggccatatgaaaa

SEQ ID NO: 4694778 - DNA, 14 bp, Homo sapiens
tggtcccaccccac

SEQ ID NO: 4694779 - DNA, 13 bp, Homo sapiens
tggtcccactcag

SEQ ID NO: 4694780 - DNA, 15 bp, Homo sapiens
tggtctaatgtttgt

SEQ ID NO: 4694781 - DNA, 16 bp, Homo sapiens
tggtctacactgtgct

SEQ ID NO: 4694782 - DNA, 17 bp, Homo sapiens
tggtctacactgtgctg

SEQ ID NO: 4694783 - DNA, 21 bp, Homo sapiens
tggtctcgaactcctgacctt

SEQ ID NO: 4694784 - DNA, 14 bp, Homo sapiens
tggtctctaggctg

SEQ ID NO: 4694785 - DNA, 12 bp, Homo sapiens
tggtctgtgtga

SEQ ID NO: 4694786 - DNA, 13 bp, Homo sapiens
tggtctttgtaag

SEQ ID NO: 4694787 - DNA, 23 bp, Homo sapiens
tggtctttgtaagagtgtagaag

SEQ ID NO: 4694788 - DNA, 20 bp, Homo sapiens
ttaagaaacaatttaaattg

SEQ ID NO: 4694789 - DNA, 13 bp, Homo sapiens
ttaagaagctgtt

SEQ ID NO: 4694790 - DNA, 16 bp, Homo sapiens
ttaagaagctgttgta

SEQ ID NO: 4694791 - DNA, 18 bp, Homo sapiens
ttaagaagctgttgtaca

SEQ ID NO: 4694792 - DNA, 20 bp, Homo sapiens
ttaagaagctgttgtacatt

SEQ ID NO: 4694793 - DNA, 15 bp, Homo sapiens
ttaagacattttcat

SEQ ID NO: 4694794 - DNA, 13 bp, Homo sapiens
ttaagaggcaggg

SEQ ID NO: 4694795 - DNA, 18 bp, Homo sapiens
ttaagagtgctaaatttt

SEQ ID NO: 4694796 - DNA, 15 bp, Homo sapiens
ttaagatttttctca

SEQ ID NO: 4694797 - DNA, 17 bp, Homo sapiens
ttaagatttttctcaaa

SEQ ID NO: 4694798 - DNA, 20 bp, Homo sapiens
ttaagatttttctcaaagtt

SEQ ID NO: 4694799 - DNA, 11 bp, Homo sapiens
ttaagcatcac

SEQ ID NO: 4694800 - DNA, 18 bp, Homo sapiens
ttaagcatgagtggcctt

SEQ ID NO: 4694801 - DNA, 21 bp, Homo sapiens
ttaagccacttaaaatgttca

SEQ ID NO: 4694802 - DNA, 14 bp, Homo sapiens
ttaaggctgtgtga

SEQ ID NO: 4694803 - DNA, 15 bp, Homo sapiens
ttaagtctcgaatgt

SEQ ID NO: 4694804 - DNA, 13 bp, Homo sapiens
ttaagttcacttt

SEQ ID NO: 4694805 - DNA, 14 bp, Homo sapiens
ttaagttcactttt

SEQ ID NO: 4694806 - DNA, 16 bp, Homo sapiens
ttaagtttgtgaatgt

SEQ ID NO: 4694807 - DNA, 16 bp, Homo sapiens
ttaataaaataattct

SEQ ID NO: 4694808 - DNA, 20 bp, Homo sapiens
ttaataaaataattctaaag

SEQ ID NO: 4694809 - DNA, 15 bp, Homo sapiens
ttaatatattttttg

SEQ ID NO: 4694810 - DNA, 22 bp, Homo sapiens
ttaatatggggatgcagcatta

SEQ ID NO: 4694811 - DNA, 18 bp, Homo sapiens
ttaatcttttcacaaata

SEQ ID NO: 4694812 - DNA, 14 bp, Homo sapiens
ttaatgaagaaagt

SEQ ID NO: 4694813 - DNA, 19 bp, Homo sapiens
ttaatggtagttttacagt

SEQ ID NO: 4694814 - DNA, 17 bp, Homo sapiens
ttaattaccttattgga

SEQ ID NO: 4694815 - DNA, 17 bp, Homo sapiens
ttaattcaatgaaatgg

SEQ ID NO: 4694816 - DNA, 21 bp, Homo sapiens
ttaattgacttatttatataa

SEQ ID NO: 4694817 - DNA, 22 bp, Homo sapiens
ttaattgttgtttctttctagt

SEQ ID NO: 4694818 - DNA, 14 bp, Homo sapiens
ttaatttacaaaaa

SEQ ID NO: 4694819 - DNA, 15 bp, Homo sapiens
ttaatttctatgaag

SEQ ID NO: 4694820 - DNA, 22 bp, Homo sapiens
ttaatttgtgaaaatgtaatta

SEQ ID NO: 4694821 - DNA, 12 bp, Homo sapiens
ttaattttcact

SEQ ID NO: 4694822 - DNA, 15 bp, Homo sapiens
ttaattttcctcatt

SEQ ID NO: 4694823 - DNA, 23 bp, Homo sapiens
ttaatttttgtactttgcttctt

SEQ ID NO: 4694824 - DNA, 13 bp, Homo sapiens
ttacaaaactgcc

SEQ ID NO: 4694825 - DNA, 17 bp, Homo sapiens
ttacaaaccaaccattt

SEQ ID NO: 4694826 - DNA, 14 bp, Homo sapiens
ttacaacaaacact

SEQ ID NO: 4694827 - DNA, 20 bp, Homo sapiens
ttacaagcgtgagccactgc

SEQ ID NO: 4694828 - DNA, 20 bp, Homo sapiens
ttacacagtcaaatttacat

SEQ ID NO: 4694829 - DNA, 12 bp, Homo sapiens
ttacagaaaata

SEQ ID NO: 4694830 - DNA, 24 bp, Homo sapiens
ttacaggcgtgagccaccgtgcct

SEQ ID NO: 4694831 - DNA, 14 bp, Homo sapiens
ttacataatcagta

SEQ ID NO: 4694832 - DNA, 14 bp, Homo sapiens
ttacatacagtgat

SEQ ID NO: 4694833 - DNA, 22 bp, Homo sapiens
ttacatacagtgatatggtact

SEQ ID NO: 4694834 - DNA, 16 bp, Homo sapiens
ttacatctctaatttt

SEQ ID NO: 4694835 - DNA, 13 bp, Homo sapiens
ttacattaaactc

SEQ ID NO: 4694836 - DNA, 13 bp, Homo sapiens
ttacatttatcta

SEQ ID NO: 4694837 - DNA, 12 bp, Homo sapiens
ttaccaccccca

SEQ ID NO: 4694838 - DNA, 15 bp, Homo sapiens
ttaccacccccacac

SEQ ID NO: 4694839 - DNA, 22 bp, Homo sapiens
tttcacagtgtgtggtcaacat

SEQ ID NO: 4694840 - DNA, 22 bp, Homo sapiens
tttcacattttttttctttttc

SEQ ID NO: 4694841 - DNA, 22 bp, Homo sapiens
tttcaccatttgattatgtagc

SEQ ID NO: 4694842 - DNA, 12 bp, Homo sapiens
tttcactcacat

SEQ ID NO: 4694843 - DNA, 24 bp, Homo sapiens
tttcactcttattgcccacgctgg

SEQ ID NO: 4694844 - DNA, 23 bp, Homo sapiens
tttcactgactttttttgtgggg

SEQ ID NO: 4694845 - DNA, 16 bp, Homo sapiens
tttcagaatgttgaag

SEQ ID NO: 4694846 - DNA, 15 bp, Homo sapiens
tttcagcagctgcag

SEQ ID NO: 4694847 - DNA, 12 bp, Homo sapiens
tttcagcatcaa

SEQ ID NO: 4694848 - DNA, 17 bp, Homo sapiens
tttcagcatcaaacatg

SEQ ID NO: 4694849 - DNA, 20 bp, Homo sapiens
tttcagcttctgctgggctg

SEQ ID NO: 4694850 - DNA, 19 bp, Homo sapiens
tttcaggttttagttttta

SEQ ID NO: 4694851 - DNA, 22 bp, Homo sapiens
tttcagttctgtgtacatttta

SEQ ID NO: 4694852 - DNA, 19 bp, Homo sapiens
tttcatctgctctccttcc

SEQ ID NO: 4694853 - DNA, 20 bp, Homo sapiens
tttcatctgctctccttcct

SEQ ID NO: 4694854 - DNA, 13 bp, Homo sapiens
tttcatgcttcca

SEQ ID NO: 4694855 - DNA, 17 bp, Homo sapiens
tttcattggatttttgt

SEQ ID NO: 4694856 - DNA, 21 bp, Homo sapiens
tttcattggatttttgttaat

SEQ ID NO: 4694857 - DNA, 15 bp, Homo sapiens
tttcatttttttcca

SEQ ID NO: 4694858 - DNA, 20 bp, Homo sapiens
tttcatttttttccaggctg

SEQ ID NO: 4694859 - DNA, 13 bp, Homo sapiens
tttccaagagctg

SEQ ID NO: 4694860 - DNA, 17 bp, Homo sapiens
tttccactcaggtctgt

SEQ ID NO: 4694861 - DNA, 19 bp, Homo sapiens
tttccaggaaaaagaactt

SEQ ID NO: 4694862 - DNA, 18 bp, Homo sapiens
tttccatgagtcccctgt

SEQ ID NO: 4694863 - DNA, 23 bp, Homo sapiens
tttccatgcaccctcatacacag

SEQ ID NO: 4694864 - DNA, 23 bp, Homo sapiens
tttcccaacccccagcccccacc

SEQ ID NO: 4694865 - DNA, 15 bp, Homo sapiens
tttcccactctgaag

SEQ ID NO: 4694866 - DNA, 18 bp, Homo sapiens
tttcccactgcaccccct

SEQ ID NO: 4694867 - DNA, 17 bp, Homo sapiens
tttcccatttcgtgtaa

SEQ ID NO: 4694868 - DNA, 20 bp, Homo sapiens
tttcccgtggccccagcctg

SEQ ID NO: 4694869 - DNA, 19 bp, Homo sapiens
tttcccttgccctttccat

SEQ ID NO: 4694870 - DNA, 23 bp, Homo sapiens
tttcctaataaagttctgtactc

SEQ ID NO: 4694871 - DNA, 21 bp, Homo sapiens
tttcctcattttgaattatgt

SEQ ID NO: 4694872 - DNA, 16 bp, Homo sapiens
tttcctctgagctgtt

SEQ ID NO: 4694873 - DNA, 12 bp, Homo sapiens
tttcctgtgaca

SEQ ID NO: 4694874 - DNA, 12 bp, Homo sapiens
tttcctgtgtct

SEQ ID NO: 4694875 - DNA, 15 bp, Homo sapiens
tttctaatagagaga

SEQ ID NO: 4694876 - DNA, 18 bp, Homo sapiens
tttctaatagagagatta

SEQ ID NO: 4694877 - DNA, 22 bp, Homo sapiens
tttctacccagcgagccctggt

SEQ ID NO: 4694878 - DNA, 15 bp, Homo sapiens
tttctacctcccaga

SEQ ID NO: 4694879 - DNA, 22 bp, Homo sapiens
tttctactttgaagtcatacca

SEQ ID NO: 4694880 - DNA, 23 bp, Homo sapiens
tttctatgaaggatccatctttg

SEQ ID NO: 4694881 - DNA, 16 bp, Homo sapiens
tttctattaaaagact

SEQ ID NO: 4694882 - DNA, 17 bp, Homo sapiens
tttctattaaaagactc

SEQ ID NO: 4694883 - DNA, 23 bp, Homo sapiens
tttctattaaaagactcatccgt

SEQ ID NO: 4694884 - DNA, 15 bp, Homo sapiens
tttctattttcacaa

SEQ ID NO: 4694885 - DNA, 16 bp, Homo sapiens
tttctcaaagaaattt

SEQ ID NO: 4694886 - DNA, 14 bp, Homo sapiens
tttctcaaagtttt

SEQ ID NO: 4694887 - DNA, 22 bp, Homo sapiens
tttctcaaagttttgaaaagct

SEQ ID NO: 4694888 - DNA, 13 bp, Homo sapiens
tttctcatgttga

SEQ ID NO: 4694889 - DNA, 14 bp, Homo sapiens
tttctcccctgccc

SEQ ID NO: 4694890 - DNA, 16 bp, Homo sapiens
tttctcccctgccccc

SEQ ID NO: 4694891 - DNA, 22 bp, Homo sapiens
tttctcccctgcccccaggact

SEQ ID NO: 4694892 - DNA, 24 bp, Homo sapiens
tttctcccctgcccccaggactgg

SEQ ID NO: 4694893 - DNA, 14 bp, Homo sapiens
tttctcctccatgg

SEQ ID NO: 4694894 - DNA, 22 bp, Homo sapiens
tttctctgcatttaaaaaaatc

SEQ ID NO: 4694895 - DNA, 20 bp, Homo sapiens
tttctctgtgtggttcagct

SEQ ID NO: 4694896 - DNA, 21 bp, Homo sapiens
tttctcttcagtgtgttgact

SEQ ID NO: 4694897 - DNA, 19 bp, Homo sapiens
tttctgaaaattaacactg

SEQ ID NO: 4694898 - DNA, 20 bp, Homo sapiens
tttctgcccaactttcattg

SEQ ID NO: 4694899 - DNA, 15 bp, Homo sapiens
tttctgccttccttg

SEQ ID NO: 4694900 - DNA, 20 bp, Homo sapiens
tttctgccttccttgctaat

SEQ ID NO: 4694901 - DNA, 17 bp, Homo sapiens
tttctggaatggaattg

SEQ ID NO: 4694902 - DNA, 15 bp, Homo sapiens
tttctggatttcata

SEQ ID NO: 4694903 - DNA, 23 bp, Homo sapiens
tttctgggcaccggggcctcgga

SEQ ID NO: 4694904 - DNA, 14 bp, Homo sapiens
tttctgtaaatgaa

SEQ ID NO: 4694905 - DNA, 22 bp, Homo sapiens
tttctgtgtttagctatttaat

SEQ ID NO: 4694906 - DNA, 21 bp, Homo sapiens
tttcttaaaatgtcctatgta

SEQ ID NO: 4694907 - DNA, 12 bp, Homo sapiens
tttcttagcttt

SEQ ID NO: 4694908 - DNA, 16 bp, Homo sapiens
tttcttgaacatactt

SEQ ID NO: 4694909 - DNA, 22 bp, Homo sapiens
tttcttgcaagcaacaagctat

SEQ ID NO: 4694910 - DNA, 12 bp, Homo sapiens
tttcttgcctct

SEQ ID NO: 4694911 - DNA, 13 bp, Homo sapiens
tttctttgtggct

SEQ ID NO: 4694912 - DNA, 16 bp, Homo sapiens
tttcttttgttcttga

SEQ ID NO: 4694913 - DNA, 19 bp, Homo sapiens
tttgaaaagctattagcca

SEQ ID NO: 4694914 - DNA, 18 bp, Homo sapiens
tttgaaattaacctctca

SEQ ID NO: 4694915 - DNA, 18 bp, Homo sapiens
tttgaatcatcaagtctt

SEQ ID NO: 4694916 - DNA, 15 bp, Homo sapiens
tttgaatgcaaaaga

SEQ ID NO: 4694917 - DNA, 14 bp, Homo sapiens
tttgacgaagaaac

SEQ ID NO: 4694918 - DNA, 13 bp, Homo sapiens
tttgagacagagt

SEQ ID NO: 4694919 - DNA, 21 bp, Homo sapiens
tttgagggtgtatattttctg

SEQ ID NO: 4694920 - DNA, 12 bp, Homo sapiens
tttgaggtcttt

SEQ ID NO: 4694921 - DNA, 15 bp, Homo sapiens
tttgataatgttaaa

SEQ ID NO: 4694922 - DNA, 19 bp, Homo sapiens
tttgataatgttaaatttg

SEQ ID NO: 4694923 - DNA, 23 bp, Homo sapiens
tttgataatgttaaatttgtaag

SEQ ID NO: 4694924 - DNA, 13 bp, Homo sapiens
tttgatagtgctt

SEQ ID NO: 4694925 - DNA, 17 bp, Homo sapiens
tttgatatttgcattga

SEQ ID NO: 4694926 - DNA, 12 bp, Homo sapiens
tttgcaaggaag

SEQ ID NO: 4694927 - DNA, 18 bp, Homo sapiens
tttgcattcttattcatc

SEQ ID NO: 4694928 - DNA, 20 bp, Homo sapiens
tttgcctacgtgacaacaca

SEQ ID NO: 4694929 - DNA, 12 bp, Homo sapiens
tttgctctgcca

SEQ ID NO: 4694930 - DNA, 13 bp, Homo sapiens
tttgctgtagaag

SEQ ID NO: 4694931 - DNA, 21 bp, Homo sapiens
tttgctgtagaagatggcact

SEQ ID NO: 4694932 - DNA, 14 bp, Homo sapiens
tttgctttgtttaa

SEQ ID NO: 4694933 - DNA, 20 bp, Homo sapiens
tttggatttaaaagcctgct

SEQ ID NO: 4694934 - DNA, 17 bp, Homo sapiens
tttggcaatgccatcat

SEQ ID NO: 4694935 - DNA, 17 bp, Homo sapiens
tttggcaggaagatgta

SEQ ID NO: 4694936 - DNA, 21 bp, Homo sapiens
tttggcatctaattcttattt

SEQ ID NO: 4694937 - DNA, 23 bp, Homo sapiens
tttggccatctctggatgcctga

SEQ ID NO: 4694938 - DNA, 14 bp, Homo sapiens
tttgggctaacatt

SEQ ID NO: 4694939 - DNA, 21 bp, Homo sapiens
tttgggggggaataagattat

SEQ ID NO: 4694940 - DNA, 17 bp, Homo sapiens
tttggggttcggcctgt

SEQ ID NO: 4694941 - DNA, 21 bp, Homo sapiens
tttggtccttcaaaggcttgt

SEQ ID NO: 4694942 - DNA, 17 bp, Homo sapiens
tttggtctacactgtgc

SEQ ID NO: 4694943 - DNA, 16 bp, Homo sapiens
tttggtgagatctcta

SEQ ID NO: 4694944 - DNA, 19 bp, Homo sapiens
tttgtaaagttgcctttat

SEQ ID NO: 4694945 - DNA, 18 bp, Homo sapiens
tttgtaagagtgtagaag

SEQ ID NO: 4694946 - DNA, 19 bp, Homo sapiens
tttgtagattaggattaaa

SEQ ID NO: 4694947 - DNA, 17 bp, Homo sapiens
tttgtataccatgatgc

SEQ ID NO: 4694948 - DNA, 14 bp, Homo sapiens
tttgtattctctga

SEQ ID NO: 4694949 - DNA, 16 bp, Homo sapiens
tgtcctacccaccctc

SEQ ID NO: 4694950 - DNA, 12 bp, Homo sapiens
tgtcctataatt

SEQ ID NO: 4694951 - DNA, 18 bp, Homo sapiens
tgtcctatgtatatcttc

SEQ ID NO: 4694952 - DNA, 17 bp, Homo sapiens
tgtcctcctctgtgaaa

SEQ ID NO: 4694953 - DNA, 18 bp, Homo sapiens
tgtcctgctccacagtgt

SEQ ID NO: 4694954 - DNA, 24 bp, Homo sapiens
tgtcctggaaccaggcttgcctgg

SEQ ID NO: 4694955 - DNA, 19 bp, Homo sapiens
tgtcctgggagtgagctgg

SEQ ID NO: 4694956 - DNA, 23 bp, Homo sapiens
tgtcgtgagtgtctcttgtctaa

SEQ ID NO: 4694957 - DNA, 17 bp, Homo sapiens
tgtctaggcaggacctg

SEQ ID NO: 4694958 - DNA, 19 bp, Homo sapiens
tgtctaggcaggacctgtg

SEQ ID NO: 4694959 - DNA, 16 bp, Homo sapiens
tgtctcatccatcatc

SEQ ID NO: 4694960 - DNA, 13 bp, Homo sapiens
tgtctcatgtgtg

SEQ ID NO: 4694961 - DNA, 17 bp, Homo sapiens
tgtctccaaccccccag

SEQ ID NO: 4694962 - DNA, 20 bp, Homo sapiens
tgtctccaaccccccagcac

SEQ ID NO: 4694963 - DNA, 14 bp, Homo sapiens
tgtctccctggccc

SEQ ID NO: 4694964 - DNA, 15 bp, Homo sapiens
tgtctccctggccct

SEQ ID NO: 4694965 - DNA, 17 bp, Homo sapiens
tgtctccttaacactga

SEQ ID NO: 4694966 - DNA, 18 bp, Homo sapiens
tgtctccttaacactgag

SEQ ID NO: 4694967 - DNA, 19 bp, Homo sapiens
tgtctcgtggtaggactgt

SEQ ID NO: 4694968 - DNA, 13 bp, Homo sapiens
tgtctctggcctg

SEQ ID NO: 4694969 - DNA, 19 bp, Homo sapiens
tgtctcttggtcctgctgc

SEQ ID NO: 4694970 - DNA, 20 bp, Homo sapiens
tgtctcttggtcctgctgca

SEQ ID NO: 4694971 - DNA, 22 bp, Homo sapiens
tgtctcttggtcctgctgcagt

SEQ ID NO: 4694972 - DNA, 22 bp, Homo sapiens
tgtctctttaatgtcacaggca

SEQ ID NO: 4694973 - DNA, 22 bp, Homo sapiens
tgtctgcaacatggattccaaa

SEQ ID NO: 4694974 - DNA, 15 bp, Homo sapiens
tgtctggattcccag

SEQ ID NO: 4694975 - DNA, 11 bp, Homo sapiens
tgtctgggctg

SEQ ID NO: 4694976 - DNA, 13 bp, Homo sapiens
tgtctgtagtgtt

SEQ ID NO: 4694977 - DNA, 17 bp, Homo sapiens
tgtcttctttccatccc

SEQ ID NO: 4694978 - DNA, 21 bp, Homo sapiens
tgtcttgcaatggcagccttg

SEQ ID NO: 4694979 - DNA, 16 bp, Homo sapiens
tgtctttcaaaaggta

SEQ ID NO: 4694980 - DNA, 13 bp, Homo sapiens
tgtctttctttgc

SEQ ID NO: 4694981 - DNA, 14 bp, Homo sapiens
tgtctttggaccct

SEQ ID NO: 4694982 - DNA, 17 bp, Homo sapiens
tgtctttggaccctgag

SEQ ID NO: 4694983 - DNA, 19 bp, Homo sapiens
tgtctttggaccctgaggc

SEQ ID NO: 4694984 - DNA, 23 bp, Homo sapiens
tgtctttggaccctgaggcccag

SEQ ID NO: 4694985 - DNA, 16 bp, Homo sapiens
tgtgaaaaaaattatt

SEQ ID NO: 4694986 - DNA, 18 bp, Homo sapiens
tgtgaaaatggtccagga

SEQ ID NO: 4694987 - DNA, 22 bp, Homo sapiens
tgtgaaaatggtccaggagaag

SEQ ID NO: 4694988 - DNA, 16 bp, Homo sapiens
tgtgaaaatgtgtgtg

SEQ ID NO: 4694989 - DNA, 17 bp, Homo sapiens
tgtgaaaatgtgtgtgt

SEQ ID NO: 4694990 - DNA, 14 bp, Homo sapiens
tgtgaaaggaaaga

SEQ ID NO: 4694991 - DNA, 20 bp, Homo sapiens
tgtgaaatcatcaaaaagaa

SEQ ID NO: 4694992 - DNA, 21 bp, Homo sapiens
tgtgaaatcatcaaaaagaaa

SEQ ID NO: 4694993 - DNA, 23 bp, Homo sapiens
tgtgaacaagcttcagtaagtta

SEQ ID NO: 4694994 - DNA, 17 bp, Homo sapiens
tgtgaaccaccacaccc

SEQ ID NO: 4694995 - DNA, 19 bp, Homo sapiens
tgtgaaccaccacacccag

SEQ ID NO: 4694996 - DNA, 16 bp, Homo sapiens
tgtgaactccatcatt

SEQ ID NO: 4694997 - DNA, 14 bp, Homo sapiens
tgtgaagaaaaaga

SEQ ID NO: 4694998 - DNA, 16 bp, Homo sapiens
tgtgaataaaaagaaa

SEQ ID NO: 4694999 - DNA, 15 bp, Homo sapiens
tgtgaatagatttta

SEQ ID NO: 4695000 - DNA, 17 bp, Homo sapiens
tgtgaatattgtggctc

SEQ ID NO: 4695001 - DNA, 16 bp, Homo sapiens
tgtgacaggcagcaga

SEQ ID NO: 4695002 - DNA, 13 bp, Homo sapiens
tgtgaggaagccg

SEQ ID NO: 4695003 - DNA, 20 bp, Homo sapiens
tgtgaggaagccgctggggc

SEQ ID NO: 4695004 - DNA, 15 bp, Homo sapiens
ttagtaaatatgtga

SEQ ID NO: 4695005 - DNA, 20 bp, Homo sapiens
ttagtaaatatgtgaagaaa

SEQ ID NO: 4695006 - DNA, 23 bp, Homo sapiens
ttagtaacatgtgttaagtattt

SEQ ID NO: 4695007 - DNA, 14 bp, Homo sapiens
ttagtagagacagg

SEQ ID NO: 4695008 - DNA, 15 bp, Homo sapiens
ttagtattttaatcc

SEQ ID NO: 4695009 - DNA, 17 bp, Homo sapiens
ttagtgcttatctaatt

SEQ ID NO: 4695010 - DNA, 14 bp, Homo sapiens
ttagtggtgtatat

SEQ ID NO: 4695011 - DNA, 14 bp, Homo sapiens
ttagttttatacta

SEQ ID NO: 4695012 - DNA, 22 bp, Homo sapiens
ttagttttgtgcttagttaaat

SEQ ID NO: 4695013 - DNA, 16 bp, Homo sapiens
ttataaaagtgttcat

SEQ ID NO: 4695014 - DNA, 18 bp, Homo sapiens
ttataaaatattgttaat

SEQ ID NO: 4695015 - DNA, 16 bp, Homo sapiens
ttataaacctctaatt

SEQ ID NO: 4695016 - DNA, 14 bp, Homo sapiens
ttataaactgagag

SEQ ID NO: 4695017 - DNA, 19 bp, Homo sapiens
ttataaagtggaagtatgt

SEQ ID NO: 4695018 - DNA, 23 bp, Homo sapiens
ttataaatgtaccagagagagtt

SEQ ID NO: 4695019 - DNA, 16 bp, Homo sapiens
ttataacttattagca

SEQ ID NO: 4695020 - DNA, 22 bp, Homo sapiens
ttataagagattcactcagaag

SEQ ID NO: 4695021 - DNA, 17 bp, Homo sapiens
ttataaggaaattttac

SEQ ID NO: 4695022 - DNA, 13 bp, Homo sapiens
ttataattcataa

SEQ ID NO: 4695023 - DNA, 12 bp, Homo sapiens
ttataatttaaa

SEQ ID NO: 4695024 - DNA, 19 bp, Homo sapiens
ttataattttagtttatat

SEQ ID NO: 4695025 - DNA, 20 bp, Homo sapiens
ttataattttagtttatatt

SEQ ID NO: 4695026 - DNA, 21 bp, Homo sapiens
ttatacccttgacttaacttt

SEQ ID NO: 4695027 - DNA, 14 bp, Homo sapiens
ttatacctttgaaa

SEQ ID NO: 4695028 - DNA, 15 bp, Homo sapiens
ttatagatttgacct

SEQ ID NO: 4695029 - DNA, 22 bp, Homo sapiens
ttatatacttgttgtttaatgt

SEQ ID NO: 4695030 - DNA, 17 bp, Homo sapiens
ttatattaagaaaaata

SEQ ID NO: 4695031 - DNA, 15 bp, Homo sapiens
ttatattcttatgtt

SEQ ID NO: 4695032 - DNA, 15 bp, Homo sapiens
ttatattgataacag

SEQ ID NO: 4695033 - DNA, 19 bp, Homo sapiens
ttatattgttttgtctcct

SEQ ID NO: 4695034 - DNA, 16 bp, Homo sapiens
ttatattttgctgttt

SEQ ID NO: 4695035 - DNA, 18 bp, Homo sapiens
ttatcaaaaagtataaat

SEQ ID NO: 4695036 - DNA, 20 bp, Homo sapiens
ttatcaaaatagtctaaggc

SEQ ID NO: 4695037 - DNA, 23 bp, Homo sapiens
ttatcaaaatagtctaaggccat

SEQ ID NO: 4695038 - DNA, 18 bp, Homo sapiens
ttatcaccgtgggctccc

SEQ ID NO: 4695039 - DNA, 15 bp, Homo sapiens
ttatcaccttccaaa

SEQ ID NO: 4695040 - DNA, 19 bp, Homo sapiens
ttatcgaaataacaatgtt

SEQ ID NO: 4695041 - DNA, 21 bp, Homo sapiens
ttatcgaaataacaatgttaa

SEQ ID NO: 4695042 - DNA, 22 bp, Homo sapiens
ttatcgaaataacaatgttaag

SEQ ID NO: 4695043 - DNA, 19 bp, Homo sapiens
ttatctcagtcatgcataa

SEQ ID NO: 4695044 - DNA, 20 bp, Homo sapiens
ttatctcagtcatgcataaa

SEQ ID NO: 4695045 - DNA, 20 bp, Homo sapiens
ttatctgggcatagatgcag

SEQ ID NO: 4695046 - DNA, 22 bp, Homo sapiens
ttatgacagccctaggaaacta

SEQ ID NO: 4695047 - DNA, 13 bp, Homo sapiens
ttatgagaacatg

SEQ ID NO: 4695048 - DNA, 19 bp, Homo sapiens
ttatgatctatttgtagat

SEQ ID NO: 4695049 - DNA, 15 bp, Homo sapiens
ttatgatttaataaa

SEQ ID NO: 4695050 - DNA, 17 bp, Homo sapiens
ttatgatttaataaaat

SEQ ID NO: 4695051 - DNA, 16 bp, Homo sapiens
ttatgatttttaaaga

SEQ ID NO: 4695052 - DNA, 19 bp, Homo sapiens
tttttgtagagccagggtc

SEQ ID NO: 4695053 - DNA, 20 bp, Homo sapiens
tttttgtagagccagggtct

SEQ ID NO: 4695054 - DNA, 12 bp, Homo sapiens
ttttttccaaag

SEQ ID NO: 4695055 - DNA, 19 bp, Homo sapiens
tttatactatatttgtgct

SEQ ID NO: 4695056 - DNA, 15 bp, Homo sapiens
tttatagttaataat

SEQ ID NO: 4695057 - DNA, 14 bp, Homo sapiens
tttatatacgttta

SEQ ID NO: 4695058 - DNA, 14 bp, Homo sapiens
tttatatctttatt

SEQ ID NO: 4695059 - DNA, 16 bp, Homo sapiens
tttatattcttatgtt

SEQ ID NO: 4695060 - DNA, 14 bp, Homo sapiens
tttatccttgaact

SEQ ID NO: 4695061 - DNA, 20 bp, Homo sapiens
tttatctacccagtcatgta

SEQ ID NO: 4695062 - DNA, 22 bp, Homo sapiens
tttatgacgagacctcagatgt

SEQ ID NO: 4695063 - DNA, 18 bp, Homo sapiens
tttatgatcttttcagtg

SEQ ID NO: 4695064 - DNA, 20 bp, Homo sapiens
tttatgggtttcttccagca

SEQ ID NO: 4695065 - DNA, 21 bp, Homo sapiens
tttattaaaatatttcaggtt

SEQ ID NO: 4695066 - DNA, 15 bp, Homo sapiens
tttattaaacatttt

SEQ ID NO: 4695067 - DNA, 14 bp, Homo sapiens
tttattaatttgaa

SEQ ID NO: 4695068 - DNA, 20 bp, Homo sapiens
tttattcagaactttagtat

SEQ ID NO: 4695069 - DNA, 23 bp, Homo sapiens
tttattgaattattttgttactg

SEQ ID NO: 4695070 - DNA, 15 bp, Homo sapiens
tttatttatatcttt

SEQ ID NO: 4695071 - DNA, 11 bp, Homo sapiens
tttattttatg

SEQ ID NO: 4695072 - DNA, 13 bp, Homo sapiens
tttattttttggg

SEQ ID NO: 4695073 - DNA, 16 bp, Homo sapiens
tttattttttgggaaa

SEQ ID NO: 4695074 - DNA, 14 bp, Homo sapiens
tttcaaatgttctc

SEQ ID NO: 4695075 - DNA, 21 bp, Homo sapiens
tttcaaattggagcttcatgg

SEQ ID NO: 4695076 - DNA, 15 bp, Homo sapiens
tttcaacggaaagtg

SEQ ID NO: 4695077 - DNA, 14 bp, Homo sapiens
tttcaatacttaca

SEQ ID NO: 4695078 - DNA, 21 bp, Homo sapiens
tttcaatacttacatatctga

SEQ ID NO: 4695079 - DNA, 13 bp, Homo sapiens
tttcaatttactt

SEQ ID NO: 4695080 - DNA, 23 bp, Homo sapiens
tttcaatttactttttaaacagt

SEQ ID NO: 4695081 - DNA, 13 bp, Homo sapiens
tttcacaaataaa

SEQ ID NO: 4695082 - DNA, 22 bp, Homo sapiens
tttcacataagcccaaactgat

SEQ ID NO: 4695083 - DNA, 18 bp, Homo sapiens
tttcacccctccctttct

SEQ ID NO: 4695084 - DNA, 22 bp, Homo sapiens
tttcacccctccctttctcccc

SEQ ID NO: 4695085 - DNA, 18 bp, Homo sapiens
tttcagactccagctgtg

SEQ ID NO: 4695086 - DNA, 16 bp, Homo sapiens
tttcagatataaaaga

SEQ ID NO: 4695087 - DNA, 20 bp, Homo sapiens
tttcagcatcaaacatgaaa

SEQ ID NO: 4695088 - DNA, 19 bp, Homo sapiens
tttcaggcattggatattt

SEQ ID NO: 4695089 - DNA, 13 bp, Homo sapiens
tttcaggtgacat

SEQ ID NO: 4695090 - DNA, 16 bp, Homo sapiens
tttcaggtgacatgtg

SEQ ID NO: 4695091 - DNA, 19 bp, Homo sapiens
tttcaggtgacatgtgaaa

SEQ ID NO: 4695092 - DNA, 14 bp, Homo sapiens
tttcaggttttagt

SEQ ID NO: 4695093 - DNA, 17 bp, Homo sapiens
tttcagttctgtgtaca

SEQ ID NO: 4695094 - DNA, 18 bp, Homo sapiens
tttcataagtatttcaaa

SEQ ID NO: 4695095 - DNA, 11 bp, Homo sapiens
tttcatctgct

SEQ ID NO: 4695096 - DNA, 17 bp, Homo sapiens
tttcatctgctctcctt

SEQ ID NO: 4695097 - DNA, 18 bp, Homo sapiens
tttcatctgctctccttc

SEQ ID NO: 4695098 - DNA, 22 bp, Homo sapiens
tttcatctgctctccttcctgg

SEQ ID NO: 4695099 - DNA, 20 bp, Homo sapiens
tttcattacttttaaaaatg

SEQ ID NO: 4695100 - DNA, 22 bp, Homo sapiens
tttcattagcagttgctcacat

SEQ ID NO: 4695101 - DNA, 14 bp, Homo sapiens
tttccaagagctga

SEQ ID NO: 4695102 - DNA, 21 bp, Homo sapiens
tttccactaagaacacctgca

SEQ ID NO: 4695103 - DNA, 21 bp, Homo sapiens
tttccagaaagaaaatgaatt

SEQ ID NO: 4695104 - DNA, 12 bp, Homo sapiens
tttcccactctg

SEQ ID NO: 4695105 - DNA, 12 bp, Homo sapiens
tttcccactgca

SEQ ID NO: 4695106 - DNA, 16 bp, Homo sapiens
tttcccgtggccccag

SEQ ID NO: 4695107 - DNA, 18 bp, Homo sapiens
tttcccgtggccccagcc

SEQ ID NO: 4695108 - DNA, 19 bp, Homo sapiens
tttcccgtggccccagcct

SEQ ID NO: 4695109 - DNA, 22 bp, Homo sapiens
tttcctcttagtcgagccaagt

SEQ ID NO: 4695110 - DNA, 19 bp, Homo sapiens
tttcctggcactgcttcca

SEQ ID NO: 4695111 - DNA, 21 bp, Homo sapiens
tttcctttaaaaaaatttaag

SEQ ID NO: 4695112 - DNA, 19 bp, Homo sapiens
tttcctttcatttactgtg

SEQ ID NO: 4695113 - DNA, 16 bp, Homo sapiens
tttcgtaacacagcat

SEQ ID NO: 4695114 - DNA, 20 bp, Homo sapiens
tttcgtgtaatattctctga

SEQ ID NO: 4695115 - DNA, 21 bp, Homo sapiens
tttcgttacattgtgtcctgc

SEQ ID NO: 4695116 - DNA, 23 bp, Homo sapiens
tttctaaacaagaaccatttgca

SEQ ID NO: 4695117 - DNA, 12 bp, Homo sapiens
tttctaaagact

SEQ ID NO: 4695118 - DNA, 18 bp, Homo sapiens
tttctacccagcgagccc

SEQ ID NO: 4695119 - DNA, 14 bp, Homo sapiens
tttctacctcccag

SEQ ID NO: 4695120 - DNA, 14 bp, Homo sapiens
tttctagtggtctt

SEQ ID NO: 4695121 - DNA, 17 bp, Homo sapiens
tttctagtggtctttgt

SEQ ID NO: 4695122 - DNA, 14 bp, Homo sapiens
tttctattaaaaga

SEQ ID NO: 4695123 - DNA, 18 bp, Homo sapiens
tttctattaaaagactca

SEQ ID NO: 4695124 - DNA, 19 bp, Homo sapiens
tttctattaaaagactcat

SEQ ID NO: 4695125 - DNA, 22 bp, Homo sapiens
tttctattaaattaaattttgt

SEQ ID NO: 4695126 - DNA, 14 bp, Homo sapiens
tttctcaaagaaat

SEQ ID NO: 4695127 - DNA, 16 bp, Homo sapiens
tttctcaaagttttga

SEQ ID NO: 4695128 - DNA, 18 bp, Homo sapiens
tttctcaaagttttgaaa

SEQ ID NO: 4695129 - DNA, 14 bp, Homo sapiens
tttctccaaataaa

SEQ ID NO: 4695130 - DNA, 17 bp, Homo sapiens
tttctcccctgccccca

SEQ ID NO: 4695131 - DNA, 15 bp, Homo sapiens
tttctctaatgcttg

SEQ ID NO: 4695132 - DNA, 19 bp, Homo sapiens
tttctcttcagtgtgttga

SEQ ID NO: 4695133 - DNA, 16 bp, Homo sapiens
tttctgaaaatataac

SEQ ID NO: 4695134 - DNA, 15 bp, Homo sapiens
tttctgactctaaaa

SEQ ID NO: 4695135 - DNA, 23 bp, Homo sapiens
tttctgatctgatgcaagcaaga

SEQ ID NO: 4695136 - DNA, 20 bp, Homo sapiens
tttctggaagggcagcatat

SEQ ID NO: 4695137 - DNA, 18 bp, Homo sapiens
tttctggcagctgtggta

SEQ ID NO: 4695138 - DNA, 12 bp, Homo sapiens
tttctgttgaag

SEQ ID NO: 4695139 - DNA, 20 bp, Homo sapiens
tttctgttgaagattaacac

SEQ ID NO: 4695140 - DNA, 13 bp, Homo sapiens
tttcttaaaatgt

SEQ ID NO: 4695141 - DNA, 18 bp, Homo sapiens
tttcttaaaatgtcctat

SEQ ID NO: 4695142 - DNA, 16 bp, Homo sapiens
tttcttaaacaaatgt

SEQ ID NO: 4695143 - DNA, 20 bp, Homo sapiens
tttcttagctttttaattgt

SEQ ID NO: 4695144 - DNA, 22 bp, Homo sapiens
tttcttagctttttaattgttg

SEQ ID NO: 4695145 - DNA, 22 bp, Homo sapiens
tttcttatgtgggtcttatgct

SEQ ID NO: 4695146 - DNA, 16 bp, Homo sapiens
tttcttcctatttctg

SEQ ID NO: 4695147 - DNA, 21 bp, Homo sapiens
tttcttgcctctgtccccttc

SEQ ID NO: 4695148 - DNA, 12 bp, Homo sapiens
tttctttaactg

SEQ ID NO: 4695149 - DNA, 21 bp, Homo sapiens
tttctttagtttttgtgaagt

SEQ ID NO: 4695150 - DNA, 19 bp, Homo sapiens
tttctttgctgctgtggaa

SEQ ID NO: 4695151 - DNA, 20 bp, Homo sapiens
tttgaaaatagttattcagt

SEQ ID NO: 4695152 - DNA, 21 bp, Homo sapiens
tttgaaagtgggtttcaattt

SEQ ID NO: 4695153 - DNA, 22 bp, Homo sapiens
tttgaaagtgggtttcaattta

SEQ ID NO: 4695154 - DNA, 19 bp, Homo sapiens
tttgaatatgtagtatcta

SEQ ID NO: 4695155 - DNA, 22 bp, Homo sapiens
tttgaatgtgattttaaagagt

SEQ ID NO: 4695156 - DNA, 23 bp, Homo sapiens
tttgacacaatgttgcactgaaa

SEQ ID NO: 4695157 - DNA, 13 bp, Homo sapiens
tttgacagtgttt

SEQ ID NO: 4695158 - DNA, 18 bp, Homo sapiens
tttgaccatggaaagaaa

SEQ ID NO: 4695159 - DNA, 20 bp, Homo sapiens
tttgaccatggaaagaaata

SEQ ID NO: 4695160 - DNA, 14 bp, Homo sapiens
tttgacgccatccc

SEQ ID NO: 4695161 - DNA, 16 bp, Homo sapiens
tttgacgccatcccag

SEQ ID NO: 4695162 - DNA, 20 bp, Homo sapiens
tttgacgccatcccagcccc

SEQ ID NO: 4695163 - DNA, 16 bp, Homo sapiens
tttgagacagtttctt

SEQ ID NO: 4695164 - DNA, 21 bp, Homo sapiens
ttctagtggtctttgtaagag

SEQ ID NO: 4695165 - DNA, 14 bp, Homo sapiens
ttctataatttaaa

SEQ ID NO: 4695166 - DNA, 13 bp, Homo sapiens
ttctatgtatgtg

SEQ ID NO: 4695167 - DNA, 13 bp, Homo sapiens
ttctattaaaaga

SEQ ID NO: 4695168 - DNA, 15 bp, Homo sapiens
ttctattaaaagact

SEQ ID NO: 4695169 - DNA, 21 bp, Homo sapiens
ttctattaaaagactcatccg

SEQ ID NO: 4695170 - DNA, 21 bp, Homo sapiens
ttctatttatttatttattca

SEQ ID NO: 4695171 - DNA, 15 bp, Homo sapiens
ttctattttttgttt

SEQ ID NO: 4695172 - DNA, 15 bp, Homo sapiens
ttctcaaagaaattt

SEQ ID NO: 4695173 - DNA, 14 bp, Homo sapiens
ttctcaaagttaaa

SEQ ID NO: 4695174 - DNA, 17 bp, Homo sapiens
ttctcaaagttttgaaa

SEQ ID NO: 4695175 - DNA, 18 bp, Homo sapiens
ttctcaaagttttgaaaa

SEQ ID NO: 4695176 - DNA, 21 bp, Homo sapiens
ttctcaaagttttgaaaagct

SEQ ID NO: 4695177 - DNA, 20 bp, Homo sapiens
ttctcacctaaaccctctgt

SEQ ID NO: 4695178 - DNA, 22 bp, Homo sapiens
ttctcacctaaaccctctgtga

SEQ ID NO: 4695179 - DNA, 14 bp, Homo sapiens
ttctcagctcttct

SEQ ID NO: 4695180 - DNA, 18 bp, Homo sapiens
ttctcagggtctctgctg

SEQ ID NO: 4695181 - DNA, 17 bp, Homo sapiens
ttctcatcactcccctc

SEQ ID NO: 4695182 - DNA, 15 bp, Homo sapiens
ttctcatctttcttg

SEQ ID NO: 4695183 - DNA, 11 bp, Homo sapiens
ttctcatgcct

SEQ ID NO: 4695184 - DNA, 21 bp, Homo sapiens
ttctcatgcctcagcctcctg

SEQ ID NO: 4695185 - DNA, 22 bp, Homo sapiens
ttctcatgttgaaactttaaga

SEQ ID NO: 4695186 - DNA, 20 bp, Homo sapiens
ttctcatttgccaataataa

SEQ ID NO: 4695187 - DNA, 14 bp, Homo sapiens
ttctccacctgcca

SEQ ID NO: 4695188 - DNA, 15 bp, Homo sapiens
ttctccacctgccag

SEQ ID NO: 4695189 - DNA, 17 bp, Homo sapiens
ttctcccccccggggct

SEQ ID NO: 4695190 - DNA, 21 bp, Homo sapiens
ttctcccccccggggctgggt

SEQ ID NO: 4695191 - DNA, 23 bp, Homo sapiens
ttctcccccccggggctgggttg

SEQ ID NO: 4695192 - DNA, 18 bp, Homo sapiens
ttctcccctgcccccagg

SEQ ID NO: 4695193 - DNA, 14 bp, Homo sapiens
ttctcctgcctcag

SEQ ID NO: 4695194 - DNA, 19 bp, Homo sapiens
ttctcctgtgatgtcccag

SEQ ID NO: 4695195 - DNA, 22 bp, Homo sapiens
ttctcctgtttatgggtttctt

SEQ ID NO: 4695196 - DNA, 19 bp, Homo sapiens
ttctctaagagaacaatgt

SEQ ID NO: 4695197 - DNA, 24 bp, Homo sapiens
ttctctaagagaacaatgtgctat

SEQ ID NO: 4695198 - DNA, 18 bp, Homo sapiens
ttctctaatgcttgattt

SEQ ID NO: 4695199 - DNA, 17 bp, Homo sapiens
ttctctgagctgtgcag

SEQ ID NO: 4695200 - DNA, 18 bp, Homo sapiens
ttctctgagctgtgcagg

SEQ ID NO: 4695201 - DNA, 16 bp, Homo sapiens
ttctctgagtcagctg

SEQ ID NO: 4695202 - DNA, 12 bp, Homo sapiens
ttctctgccctc

SEQ ID NO: 4695203 - DNA, 24 bp, Homo sapiens
ttctctggacactgccactctccc

SEQ ID NO: 4695204 - DNA, 18 bp, Homo sapiens
ttgcacgtgtgtttttct

SEQ ID NO: 4695205 - DNA, 21 bp, Homo sapiens
ttgcacgtgtgtttttctatt

SEQ ID NO: 4695206 - DNA, 22 bp, Homo sapiens
ttgcagccctgctgctgcctgc

SEQ ID NO: 4695207 - DNA, 18 bp, Homo sapiens
ttgcagcgattaataaca

SEQ ID NO: 4695208 - DNA, 13 bp, Homo sapiens
ttgcagtacatca

SEQ ID NO: 4695209 - DNA, 17 bp, Homo sapiens
ttgcataaacaatccaa

SEQ ID NO: 4695210 - DNA, 19 bp, Homo sapiens
ttgcataacaattcctcta

SEQ ID NO: 4695211 - DNA, 16 bp, Homo sapiens
ttgcattcttattcat

SEQ ID NO: 4695212 - DNA, 21 bp, Homo sapiens
ttgcattgaggaaatattaat

SEQ ID NO: 4695213 - DNA, 14 bp, Homo sapiens
ttgccaagaaatcg

SEQ ID NO: 4695214 - DNA, 12 bp, Homo sapiens
ttgccacattta

SEQ ID NO: 4695215 - DNA, 21 bp, Homo sapiens
ttgccatgttggccaggctgg

SEQ ID NO: 4695216 - DNA, 13 bp, Homo sapiens
ttgcccaggcagg

SEQ ID NO: 4695217 - DNA, 14 bp, Homo sapiens
ttgcccaggcaggt

SEQ ID NO: 4695218 - DNA, 15 bp, Homo sapiens
ttgccgtctacctga

SEQ ID NO: 4695219 - DNA, 19 bp, Homo sapiens
ttgccgtctacctgagggg

SEQ ID NO: 4695220 - DNA, 22 bp, Homo sapiens
ttgcctcggctcctgctgcacc

SEQ ID NO: 4695221 - DNA, 22 bp, Homo sapiens
ttgcctttagtgatcacagcag

SEQ ID NO: 4695222 - DNA, 16 bp, Homo sapiens
ttgcgagagatgtgtg

SEQ ID NO: 4695223 - DNA, 17 bp, Homo sapiens
ttgcgagagatgtgtgt

SEQ ID NO: 4695224 - DNA, 13 bp, Homo sapiens
ttgctatcaagaa

SEQ ID NO: 4695225 - DNA, 16 bp, Homo sapiens
ttgctatcaagaaatg

SEQ ID NO: 4695226 - DNA, 16 bp, Homo sapiens
ttgctccagcctgaca

SEQ ID NO: 4695227 - DNA, 20 bp, Homo sapiens
ttgctccattttcttgtcaa

SEQ ID NO: 4695228 - DNA, 19 bp, Homo sapiens
ttgctgatgtttataaact

SEQ ID NO: 4695229 - DNA, 13 bp, Homo sapiens
ttgctgctgtgga

SEQ ID NO: 4695230 - DNA, 16 bp, Homo sapiens
ttgctggctgtgaaac

SEQ ID NO: 4695231 - DNA, 20 bp, Homo sapiens
ttgctgggcagtttttctgt

SEQ ID NO: 4695232 - DNA, 17 bp, Homo sapiens
ttgctgtacaaaagcaa

SEQ ID NO: 4695233 - DNA, 13 bp, Homo sapiens
ttgctgttaactg

SEQ ID NO: 4695234 - DNA, 21 bp, Homo sapiens
ttgctgtttatgatctatttg

SEQ ID NO: 4695235 - DNA, 14 bp, Homo sapiens
ttgctttgcccagc

SEQ ID NO: 4695236 - DNA, 16 bp, Homo sapiens
ttggaaaagaaatcaa

SEQ ID NO: 4695237 - DNA, 20 bp, Homo sapiens
ttggaaaagaaatcaatttt

SEQ ID NO: 4695238 - DNA, 21 bp, Homo sapiens
ttggaaaagaaatcaattttt

SEQ ID NO: 4695239 - DNA, 14 bp, Homo sapiens
ttggaatcttcacc

SEQ ID NO: 4695240 - DNA, 17 bp, Homo sapiens
ttggaatgggcagctca

SEQ ID NO: 4695241 - DNA, 18 bp, Homo sapiens
ttggaatgggcagctcat

SEQ ID NO: 4695242 - DNA, 16 bp, Homo sapiens
ttggacagaagcagct

SEQ ID NO: 4695243 - DNA, 15 bp, Homo sapiens
ttggacattttatgt

SEQ ID NO: 4695244 - DNA, 20 bp, Homo sapiens
ttggacattttatgtctttc

SEQ ID NO: 4695245 - DNA, 16 bp, Homo sapiens
ttggacccttccatgg

SEQ ID NO: 4695246 - DNA, 19 bp, Homo sapiens
ttggagatgtctctgtgtg

SEQ ID NO: 4695247 - DNA, 15 bp, Homo sapiens
ttggagggatcattt

SEQ ID NO: 4695248 - DNA, 19 bp, Homo sapiens
ttggagtgttccccttcca

SEQ ID NO: 4695249 - DNA, 22 bp, Homo sapiens
ttggagtgttccccttccactg

SEQ ID NO: 4695250 - DNA, 15 bp, Homo sapiens
ttggattatttaata

SEQ ID NO: 4695251 - DNA, 17 bp, Homo sapiens
ttggattatttaataac

SEQ ID NO: 4695252 - DNA, 19 bp, Homo sapiens
ttggattatttaataacat

SEQ ID NO: 4695253 - DNA, 18 bp, Homo sapiens
ttggatttttgtcttgtg

SEQ ID NO: 4695254 - DNA, 22 bp, Homo sapiens
ttggcagcaggtgctgctaccc

SEQ ID NO: 4695255 - DNA, 14 bp, Homo sapiens
ttggccaggctggt

SEQ ID NO: 4695256 - DNA, 15 bp, Homo sapiens
ttggcgcaccctccc

SEQ ID NO: 4695257 - DNA, 23 bp, Homo sapiens
ttggctattagagatcaacccct

SEQ ID NO: 4695258 - DNA, 17 bp, Homo sapiens
ttggctatttaaaactt

SEQ ID NO: 4695259 - DNA, 16 bp, Homo sapiens
ttggctcacactgaga

SEQ ID NO: 4695260 - DNA, 21 bp, Homo sapiens
ttggctgggggcctcagtgcc

SEQ ID NO: 4695261 - DNA, 21 bp, Homo sapiens
ttgggagagccatacataaaa

SEQ ID NO: 4695262 - DNA, 16 bp, Homo sapiens
ttgggccatactggcc

SEQ ID NO: 4695263 - DNA, 20 bp, Homo sapiens
ttgggggtcctcctccaggg

SEQ ID NO: 4695264 - DNA, 19 bp, Homo sapiens
ttgggggttaccaaaaata

SEQ ID NO: 4695265 - DNA, 19 bp, Homo sapiens
ttggggttcggcctgtgtc

SEQ ID NO: 4695266 - DNA, 16 bp, Homo sapiens
ttggtaattaaaagac

SEQ ID NO: 4695267 - DNA, 16 bp, Homo sapiens
ttggtcccccttccat

SEQ ID NO: 4695268 - DNA, 17 bp, Homo sapiens
ttggtcttactttgtgc

SEQ ID NO: 4695269 - DNA, 19 bp, Homo sapiens
ttggtgcaattaactctgg

SEQ ID NO: 4695270 - DNA, 12 bp, Homo sapiens
ttggtgcattcg

SEQ ID NO: 4695271 - DNA, 13 bp, Homo sapiens
ttggtgttgacat

SEQ ID NO: 4695272 - DNA, 17 bp, Homo sapiens
ttggttagagaagtaag

SEQ ID NO: 4695273 - DNA, 23 bp, Homo sapiens
ttggttatgatggaaaggaagaa

SEQ ID NO: 4695274 - DNA, 15 bp, Homo sapiens
ttggttctgtgaaca

SEQ ID NO: 4695275 - DNA, 20 bp, Homo sapiens
ttggtttggccatctctgga

SEQ ID NO: 4695276 - DNA, 18 bp, Homo sapiens
ttggtttttaaaacccag

SEQ ID NO: 4695277 - DNA, 16 bp, Homo sapiens
ttgtaaaggaatttaa

SEQ ID NO: 4695278 - DNA, 20 bp, Homo sapiens
ttgtaaatactggactcagg

SEQ ID NO: 4695279 - DNA, 21 bp, Homo sapiens
ttgtaaatactggactcagga

SEQ ID NO: 4695280 - DNA, 14 bp, Homo sapiens
ttgtaaattaatct

SEQ ID NO: 4695281 - DNA, 21 bp, Homo sapiens
ttgtaactgtttagatgaatg

SEQ ID NO: 4695282 - DNA, 22 bp, Homo sapiens
ttgtaagtttcaggtgacatgt

SEQ ID NO: 4695283 - DNA, 21 bp, Homo sapiens
ttgtaatatttcttcaagtga

SEQ ID NO: 4695284 - DNA, 12 bp, Homo sapiens
ttgtaattattg

SEQ ID NO: 4695285 - DNA, 23 bp, Homo sapiens
ttgtaatttttttaatttacaaa

SEQ ID NO: 4695286 - DNA, 17 bp, Homo sapiens
ttgtacaactcataaat

SEQ ID NO: 4695287 - DNA, 16 bp, Homo sapiens
ttgtacagtttaaaat

SEQ ID NO: 4695288 - DNA, 13 bp, Homo sapiens
ttgtacagttttt

SEQ ID NO: 4695289 - DNA, 19 bp, Homo sapiens
ttgtacataaaattttcta

SEQ ID NO: 4695290 - DNA, 17 bp, Homo sapiens
ttgtacatttatgattt

SEQ ID NO: 4695291 - DNA, 23 bp, Homo sapiens
ttgtacatttatgatttaataaa

SEQ ID NO: 4695292 - DNA, 23 bp, Homo sapiens
ttgtactttttgttccagagctg

SEQ ID NO: 4695293 - DNA, 15 bp, Homo sapiens
ttgtagagccagggt

SEQ ID NO: 4695294 - DNA, 13 bp, Homo sapiens
ttgtagcatgtga

SEQ ID NO: 4695295 - DNA, 16 bp, Homo sapiens
ttgtagcctctctttg

SEQ ID NO: 4695296 - DNA, 13 bp, Homo sapiens
ttgtataaaaaca

SEQ ID NO: 4695297 - DNA, 23 bp, Homo sapiens
ttgtataaaaacatgagttattc

SEQ ID NO: 4695298 - DNA, 23 bp, Homo sapiens
ttgtataccatgatgcatggagt

SEQ ID NO: 4695299 - DNA, 20 bp, Homo sapiens
ttgtatgatcctaatgaatg

SEQ ID NO: 4695300 - DNA, 14 bp, Homo sapiens
ttgtattacaaatc

SEQ ID NO: 4695301 - DNA, 13 bp, Homo sapiens
ttgtattgtacat

SEQ ID NO: 4695302 - DNA, 15 bp, Homo sapiens
ttgtattgtttcaat

SEQ ID NO: 4695303 - DNA, 16 bp, Homo sapiens
ttgtattgtttcaatt

SEQ ID NO: 4695304 - DNA, 22 bp, Homo sapiens
ttgtatttattaatttgaaacc

SEQ ID NO: 4695305 - DNA, 20 bp, Homo sapiens
ttgtattttactaataaaat

SEQ ID NO: 4695306 - DNA, 14 bp, Homo sapiens
ttgtcaaaattaat

SEQ ID NO: 4695307 - DNA, 14 bp, Homo sapiens
ttgtcaatactgag

SEQ ID NO: 4695308 - DNA, 21 bp, Homo sapiens
ttgtccaattaatgaagttga

SEQ ID NO: 4695309 - DNA, 19 bp, Homo sapiens
ttgtccattgtaaatctga

SEQ ID NO: 4695310 - DNA, 22 bp, Homo sapiens
ttgtcgttgactttagggactc

SEQ ID NO: 4695311 - DNA, 19 bp, Homo sapiens
ttgtctccctggccctcaa

SEQ ID NO: 4695312 - DNA, 23 bp, Homo sapiens
ttgtctttattagattttcctcc

SEQ ID NO: 4695313 - DNA, 17 bp, Homo sapiens
ttgtctttctttgctgc

SEQ ID NO: 4695314 - DNA, 19 bp, Homo sapiens
ttgtctttggtgaacattg

SEQ ID NO: 4695315 - DNA, 19 bp, Homo sapiens
ttgtgaagaattattcagt

SEQ ID NO: 4695316 - DNA, 22 bp, Homo sapiens
ttgtgaatattgtggctccctg

SEQ ID NO: 4695317 - DNA, 21 bp, Homo sapiens
ttgtgaatggattggattatt

SEQ ID NO: 4695318 - DNA, 14 bp, Homo sapiens
ttgtgagggagaga

SEQ ID NO: 4695319 - DNA, 21 bp, Homo sapiens
ttgtgatattgaccatgtgat

SEQ ID NO: 4695320 - DNA, 11 bp, Homo sapiens
ttgtgcagaga

SEQ ID NO: 4695321 - DNA, 19 bp, Homo sapiens
ttgtgcctcactggacttg

SEQ ID NO: 4695322 - DNA, 16 bp, Homo sapiens
ttgtgctcagagacac

SEQ ID NO: 4695323 - DNA, 23 bp, Homo sapiens
ttgtggaaagataataaattgat

SEQ ID NO: 4695324 - DNA, 22 bp, Homo sapiens
ttgtggaggagctcaggacact

SEQ ID NO: 4695325 - DNA, 14 bp, Homo sapiens
ttgtggctccctgg

SEQ ID NO: 4695326 - DNA, 17 bp, Homo sapiens
ttgtggtaatttgttat

SEQ ID NO: 4695327 - DNA, 18 bp, Homo sapiens
ttgtgtggtttggccctt

SEQ ID NO: 4695328 - DNA, 11 bp, Homo sapiens
ttgtgttgtac

SEQ ID NO: 4695329 - DNA, 14 bp, Homo sapiens
ttgttaataaaagt

SEQ ID NO: 4695330 - DNA, 19 bp, Homo sapiens
ttgttaatggtttgaatat

SEQ ID NO: 4695331 - DNA, 14 bp, Homo sapiens
ttgttactgtctgt

SEQ ID NO: 4695332 - DNA, 21 bp, Homo sapiens
ttgttactgtctgtagtgttt

SEQ ID NO: 4695333 - DNA, 22 bp, Homo sapiens
ttgttattttgcaacctcgctg

SEQ ID NO: 4695334 - DNA, 13 bp, Homo sapiens
ttgttccagagct

SEQ ID NO: 4695335 - DNA, 16 bp, Homo sapiens
ttgttcccactgaaat

SEQ ID NO: 4695336 - DNA, 19 bp, Homo sapiens
ttgttccccatcatctgtg

SEQ ID NO: 4695337 - DNA, 19 bp, Homo sapiens
ttgttcccctcctccactc

SEQ ID NO: 4695338 - DNA, 12 bp, Homo sapiens
ttgttcttgata

SEQ ID NO: 4695339 - DNA, 13 bp, Homo sapiens
ttgttggtaacta

SEQ ID NO: 4695340 - DNA, 21 bp, Homo sapiens
ttgttgtacaactcataaata

SEQ ID NO: 4695341 - DNA, 19 bp, Homo sapiens
ttgtttaagcatcacatta

SEQ ID NO: 4695342 - DNA, 18 bp, Homo sapiens
ttgtttatacctttgcct

SEQ ID NO: 4695343 - DNA, 14 bp, Homo sapiens
ttgtttattccaaa

SEQ ID NO: 4695344 - DNA, 23 bp, Homo sapiens
ttgtttcctcccctatctgtatt

SEQ ID NO: 4695345 - DNA, 14 bp, Homo sapiens
ttgtttctacctcc

SEQ ID NO: 4695346 - DNA, 17 bp, Homo sapiens
ttgtttctacctcccag

SEQ ID NO: 4695347 - DNA, 20 bp, Homo sapiens
ttgtttggggatgagaaagg

SEQ ID NO: 4695348 - DNA, 16 bp, Homo sapiens
ttgttttgtgcagaga

SEQ ID NO: 4695349 - DNA, 21 bp, Homo sapiens
ttgtttttgtatttattaatt

SEQ ID NO: 4695350 - DNA, 16 bp, Homo sapiens
tttaaaaaaatttaag

SEQ ID NO: 4695351 - DNA, 18 bp, Homo sapiens
tttaaaaaaatttaagtg

SEQ ID NO: 4695352 - DNA, 12 bp, Homo sapiens
tttaaaaattgt

SEQ ID NO: 4695353 - DNA, 13 bp, Homo sapiens
tttaaaagcctgc

SEQ ID NO: 4695354 - DNA, 23 bp, Homo sapiens
tttaaaagttttgttcttttata

SEQ ID NO: 4695355 - DNA, 19 bp, Homo sapiens
tttaaaatttcttagaaaa

SEQ ID NO: 4695356 - DNA, 17 bp, Homo sapiens
tttaaagaaaagttttg

SEQ ID NO: 4695357 - DNA, 19 bp, Homo sapiens
tttaaagcaattgcataat

SEQ ID NO: 4695358 - DNA, 17 bp, Homo sapiens
tttaaagtattctccat

SEQ ID NO: 4695359 - DNA, 18 bp, Homo sapiens
tttaaatatatgctaagt

SEQ ID NO: 4695360 - DNA, 21 bp, Homo sapiens
tttaaatatatgctaagtctt

SEQ ID NO: 4695361 - DNA, 13 bp, Homo sapiens
tttaaatgaaagt

SEQ ID NO: 4695362 - DNA, 20 bp, Homo sapiens
tttaacaggttttcttctaa

SEQ ID NO: 4695363 - DNA, 19 bp, Homo sapiens
tttaaccaagttgtttatt

SEQ ID NO: 4695364 - DNA, 21 bp, Homo sapiens
tttaaccataaatcaattcat

SEQ ID NO: 4695365 - DNA, 19 bp, Homo sapiens
tttaactactgtattccca

SEQ ID NO: 4695366 - DNA, 24 bp, Homo sapiens
tttaactcaatattttccatgaaa

SEQ ID NO: 4695367 - DNA, 19 bp, Homo sapiens
tttaactctataatgtgtt

SEQ ID NO: 4695368 - DNA, 19 bp, Homo sapiens
tttaactctggattttgaa

SEQ ID NO: 4695369 - DNA, 15 bp, Homo sapiens
tttaactgtggatat

SEQ ID NO: 4695370 - DNA, 17 bp, Homo sapiens
tttaagatttttctcaa

SEQ ID NO: 4695371 - DNA, 22 bp, Homo sapiens
tttaagcatgagtggccttaat

SEQ ID NO: 4695372 - DNA, 12 bp, Homo sapiens
tttaagccttat

SEQ ID NO: 4695373 - DNA, 17 bp, Homo sapiens
tttaagctctgagctgt

SEQ ID NO: 4695374 - DNA, 13 bp, Homo sapiens
tttaagcttcatt

SEQ ID NO: 4695375 - DNA, 21 bp, Homo sapiens
tttaagtctcctttactgaat

SEQ ID NO: 4695376 - DNA, 21 bp, Homo sapiens
tttaagtgcgtgtgtagagtt

SEQ ID NO: 4695377 - DNA, 18 bp, Homo sapiens
tttaagttacacattttt

SEQ ID NO: 4695378 - DNA, 16 bp, Homo sapiens
tttaagttttatttaa

SEQ ID NO: 4695379 - DNA, 16 bp, Homo sapiens
tttaataaaataattc

SEQ ID NO: 4695380 - DNA, 20 bp, Homo sapiens
tttaataaaataattctaaa

SEQ ID NO: 4695381 - DNA, 19 bp, Homo sapiens
tttaataatgtatgtacag

SEQ ID NO: 4695382 - DNA, 19 bp, Homo sapiens
tttaatcacagtcatcttt

SEQ ID NO: 4695383 - DNA, 14 bp, Homo sapiens
tttaatccattttt

SEQ ID NO: 4695384 - DNA, 15 bp, Homo sapiens
tttaatcctgtacca

SEQ ID NO: 4695385 - DNA, 17 bp, Homo sapiens
tttaatctgttgtttga

SEQ ID NO: 4695386 - DNA, 20 bp, Homo sapiens
tgtgaaccaccacacccagc

SEQ ID NO: 4695387 - DNA, 20 bp, Homo sapiens
tgtgaaccctagctgtgtca

SEQ ID NO: 4695388 - DNA, 10 bp, Homo sapiens
tgtgaagaaa

SEQ ID NO: 4695389 - DNA, 10 bp, Homo sapiens
tgtgaagaat

SEQ ID NO: 4695390 - DNA, 17 bp, Homo sapiens
tgtgaagaatgtctgta

SEQ ID NO: 4695391 - DNA, 15 bp, Homo sapiens
tgtgaagagactctg

SEQ ID NO: 4695392 - DNA, 21 bp, Homo sapiens
tgtgaatacctgctcacgtca

SEQ ID NO: 4695393 - DNA, 13 bp, Homo sapiens
tgtgaatgcttct

SEQ ID NO: 4695394 - DNA, 15 bp, Homo sapiens
tgtgaatggattgga

SEQ ID NO: 4695395 - DNA, 16 bp, Homo sapiens
tgtgaatggattggat

SEQ ID NO: 4695396 - DNA, 19 bp, Homo sapiens
tgtgaatggattggattat

SEQ ID NO: 4695397 - DNA, 22 bp, Homo sapiens
tgtgaatggcaaataaacagtt

SEQ ID NO: 4695398 - DNA, 15 bp, Homo sapiens
tgtgaatgtgactac

SEQ ID NO: 4695399 - DNA, 20 bp, Homo sapiens
tgtgaattagctcacttggt

SEQ ID NO: 4695400 - DNA, 18 bp, Homo sapiens
tgtgaatttgcaacagta

SEQ ID NO: 4695401 - DNA, 15 bp, Homo sapiens
tgtgacaggcagcag

SEQ ID NO: 4695402 - DNA, 15 bp, Homo sapiens
tgtgaccaatgtctt

SEQ ID NO: 4695403 - DNA, 18 bp, Homo sapiens
tgtgaggaagccgctggg

SEQ ID NO: 4695404 - DNA, 19 bp, Homo sapiens
tgtgagtactacagtcctc

SEQ ID NO: 4695405 - DNA, 16 bp, Homo sapiens
tgtgatactattacca

SEQ ID NO: 4695406 - DNA, 19 bp, Homo sapiens
tgtgatattgaccatgtga

SEQ ID NO: 4695407 - DNA, 22 bp, Homo sapiens
tgtgatattgaccatgtgatta

SEQ ID NO: 4695408 - DNA, 14 bp, Homo sapiens
tgtgatgaatactg

SEQ ID NO: 4695409 - DNA, 18 bp, Homo sapiens
tgtgatgaatactgtatt

SEQ ID NO: 4695410 - DNA, 15 bp, Homo sapiens
tgtgatggggccctg

SEQ ID NO: 4695411 - DNA, 19 bp, Homo sapiens
tgtgatggggccctgcctc

SEQ ID NO: 4695412 - DNA, 14 bp, Homo sapiens
tgtgatgtggcagg

SEQ ID NO: 4695413 - DNA, 19 bp, Homo sapiens
tgtgatttcccgtggcccc

SEQ ID NO: 4695414 - DNA, 20 bp, Homo sapiens
tgtgatttcccgtggcccca

SEQ ID NO: 4695415 - DNA, 18 bp, Homo sapiens
tgtgcaaacagtgtaagc

SEQ ID NO: 4695416 - DNA, 16 bp, Homo sapiens
tgtgcaactcttgtat

SEQ ID NO: 4695417 - DNA, 23 bp, Homo sapiens
tgtgcaactcttgtattgctcca

SEQ ID NO: 4695418 - DNA, 17 bp, Homo sapiens
tgtgcacatctgtgtct

SEQ ID NO: 4695419 - DNA, 15 bp, Homo sapiens
tgtgcacatctgttt

SEQ ID NO: 4695420 - DNA, 17 bp, Homo sapiens
tgtgcacttatttatga

SEQ ID NO: 4695421 - DNA, 19 bp, Homo sapiens
tgtgcagccgctgagcgag

SEQ ID NO: 4695422 - DNA, 16 bp, Homo sapiens
tgtgcaggtggggaga

SEQ ID NO: 4695423 - DNA, 14 bp, Homo sapiens
tgtgcattgctgtg

SEQ ID NO: 4695424 - DNA, 15 bp, Homo sapiens
tgtgccaccctgggc

SEQ ID NO: 4695425 - DNA, 16 bp, Homo sapiens
tgtgccaccctgggct

SEQ ID NO: 4695426 - DNA, 17 bp, Homo sapiens
tgtgccaccctgggctc

SEQ ID NO: 4695427 - DNA, 12 bp, Homo sapiens
tgtgccatgtgc

SEQ ID NO: 4695428 - DNA, 13 bp, Homo sapiens
tgtgccccccatc

SEQ ID NO: 4695429 - DNA, 22 bp, Homo sapiens
tgtgccccccatcctggcccat

SEQ ID NO: 4695430 - DNA, 23 bp, Homo sapiens
tgtgccccccatcctggcccatc

SEQ ID NO: 4695431 - DNA, 23 bp, Homo sapiens
tgtgcctgtgtgcgagtctgagt

SEQ ID NO: 4695432 - DNA, 15 bp, Homo sapiens
tgtgcgagtctgagt

SEQ ID NO: 4695433 - DNA, 19 bp, Homo sapiens
tgtgcgcctacaggagtga

SEQ ID NO: 4695434 - DNA, 19 bp, Homo sapiens
tgtgctagctaaaagacaa

SEQ ID NO: 4695435 - DNA, 21 bp, Homo sapiens
tgtgctccctggttctgatga

SEQ ID NO: 4695436 - DNA, 23 bp, Homo sapiens
tgtgctctgatcatccactgtgc

SEQ ID NO: 4695437 - DNA, 18 bp, Homo sapiens
tgtgctgagtctgaaggc

SEQ ID NO: 4695438 - DNA, 19 bp, Homo sapiens
tgtgctgagtctgaaggct

SEQ ID NO: 4695439 - DNA, 21 bp, Homo sapiens
tgtgctgccctgcccacctgg

SEQ ID NO: 4695440 - DNA, 14 bp, Homo sapiens
tgtgctggagccac

SEQ ID NO: 4695441 - DNA, 13 bp, Homo sapiens
tgtggaaaggatt

SEQ ID NO: 4695442 - DNA, 13 bp, Homo sapiens
tgtggaagtccct

SEQ ID NO: 4695443 - DNA, 13 bp, Homo sapiens
tgtggacacagct

SEQ ID NO: 4695444 - DNA, 15 bp, Homo sapiens
tgtggacacagctct

SEQ ID NO: 4695445 - DNA, 15 bp, Homo sapiens
tgtggaggaaggatt

SEQ ID NO: 4695446 - DNA, 16 bp, Homo sapiens
tgtggaggaaggattg

SEQ ID NO: 4695447 - DNA, 15 bp, Homo sapiens
tgtggagtactggac

SEQ ID NO: 4695448 - DNA, 16 bp, Homo sapiens
tgtggcaagcaagagc

SEQ ID NO: 4695449 - DNA, 18 bp, Homo sapiens
tgtggcacagatgcccac

SEQ ID NO: 4695450 - DNA, 19 bp, Homo sapiens
tgtggcaggagggcagtgg

SEQ ID NO: 4695451 - DNA, 16 bp, Homo sapiens
tgtgggctgcactctg

SEQ ID NO: 4695452 - DNA, 13 bp, Homo sapiens
tgtggtcccaccc

SEQ ID NO: 4695453 - DNA, 18 bp, Homo sapiens
tgtgtaaatgttatgact

SEQ ID NO: 4695454 - DNA, 19 bp, Homo sapiens
tgtgtaaatgttatgactc

SEQ ID NO: 4695455 - DNA, 16 bp, Homo sapiens
tgtgtaagaaaacaaa

SEQ ID NO: 4695456 - DNA, 23 bp, Homo sapiens
tgtgtaatagaataaaggcctgc

SEQ ID NO: 4695457 - DNA, 13 bp, Homo sapiens
tgtgtacatttta

SEQ ID NO: 4695458 - DNA, 18 bp, Homo sapiens
tgtgtatgcgtgtgtgtg

SEQ ID NO: 4695459 - DNA, 19 bp, Homo sapiens
tgtgtatggatatgtgtaa

SEQ ID NO: 4695460 - DNA, 17 bp, Homo sapiens
tgtgtcaaaactggttt

SEQ ID NO: 4695461 - DNA, 15 bp, Homo sapiens
tgtgtcactggctgc

SEQ ID NO: 4695462 - DNA, 17 bp, Homo sapiens
tgtgtcaggtggggcag

SEQ ID NO: 4695463 - DNA, 20 bp, Homo sapiens
tgtgtcaggtggggcagctt

SEQ ID NO: 4695464 - DNA, 18 bp, Homo sapiens
tgtgtccccctctgtcca

SEQ ID NO: 4695465 - DNA, 20 bp, Homo sapiens
tgtgtctaggcaggacctgt

SEQ ID NO: 4695466 - DNA, 12 bp, Homo sapiens
tgtgtctctgta

SEQ ID NO: 4695467 - DNA, 17 bp, Homo sapiens
tgtgtctcttggtcctg

SEQ ID NO: 4695468 - DNA, 22 bp, Homo sapiens
tgtgtctcttggtcctgctgca

SEQ ID NO: 4695469 - DNA, 21 bp, Homo sapiens
tgtgtcttgcaatggcagcct

SEQ ID NO: 4695470 - DNA, 13 bp, Homo sapiens
tgtgtgaacgtgt

SEQ ID NO: 4695471 - DNA, 19 bp, Homo sapiens
tgtgtgcacgtacacacac

SEQ ID NO: 4695472 - DNA, 20 bp, Homo sapiens
tgtgtggcaaattaaacaat

SEQ ID NO: 4695473 - DNA, 10 bp, Homo sapiens
tgtgtgtact

SEQ ID NO: 4695474 - DNA, 13 bp, Homo sapiens
tgtgtgtctctga

SEQ ID NO: 4695475 - DNA, 12 bp, Homo sapiens
tgtgtgttcacc

SEQ ID NO: 4695476 - DNA, 20 bp, Homo sapiens
tgtgtgttgatactgttgca

SEQ ID NO: 4695477 - DNA, 21 bp, Homo sapiens
tgtgtgttgatactgttgcac

SEQ ID NO: 4695478 - DNA, 14 bp, Homo sapiens
tgtgttatgaagca

SEQ ID NO: 4695479 - DNA, 13 bp, Homo sapiens
tgtgttccctcat

SEQ ID NO: 4695480 - DNA, 16 bp, Homo sapiens
tgtgttgatactgttg

SEQ ID NO: 4695481 - DNA, 15 bp, Homo sapiens
tgtgtttagctattt

SEQ ID NO: 4695482 - DNA, 19 bp, Homo sapiens
tgtgtttagctatttaata

SEQ ID NO: 4695483 - DNA, 22 bp, Homo sapiens
tgtgtttttctattaaaagact

SEQ ID NO: 4695484 - DNA, 15 bp, Homo sapiens
tgttaaatttgtaag

SEQ ID NO: 4695485 - DNA, 14 bp, Homo sapiens
tgttaacactgtaa

SEQ ID NO: 4695486 - DNA, 19 bp, Homo sapiens
tgttaacactgtaatatct

SEQ ID NO: 4695487 - DNA, 16 bp, Homo sapiens
tgttaactatgacaga

SEQ ID NO: 4695488 - DNA, 22 bp, Homo sapiens
tgttaactgaagatattccaac

SEQ ID NO: 4695489 - DNA, 17 bp, Homo sapiens
tgttaaggaaactctta

SEQ ID NO: 4695490 - DNA, 21 bp, Homo sapiens
tgttaaggaaactcttatctc

SEQ ID NO: 4695491 - DNA, 15 bp, Homo sapiens
tgttaagtattttca

SEQ ID NO: 4695492 - DNA, 17 bp, Homo sapiens
tgttaagtattttcata

SEQ ID NO: 4695493 - DNA, 17 bp, Homo sapiens
tgttaatggtttgaata

SEQ ID NO: 4695494 - DNA, 15 bp, Homo sapiens
tgttaattttcctca

SEQ ID NO: 4695495 - DNA, 22 bp, Homo sapiens
tgttacctgaaaacactgtgca

SEQ ID NO: 4695496 - DNA, 17 bp, Homo sapiens
ttactgaagaaatcttt

SEQ ID NO: 4695497 - DNA, 21 bp, Homo sapiens
ttactgatcttacctttatga

SEQ ID NO: 4695498 - DNA, 21 bp, Homo sapiens
ttactgggttggaagaaatat

SEQ ID NO: 4695499 - DNA, 16 bp, Homo sapiens
ttactgtctgtagtgt

SEQ ID NO: 4695500 - DNA, 23 bp, Homo sapiens
ttactgtggaggaaggattgtaa

SEQ ID NO: 4695501 - DNA, 16 bp, Homo sapiens
ttactgtggcttctta

SEQ ID NO: 4695502 - DNA, 21 bp, Homo sapiens
ttactgtttgtcttctcccca

SEQ ID NO: 4695503 - DNA, 11 bp, Homo sapiens
ttacttctgct

SEQ ID NO: 4695504 - DNA, 16 bp, Homo sapiens
ttacttgcctatctga

SEQ ID NO: 4695505 - DNA, 18 bp, Homo sapiens
ttacttgcctatctgact

SEQ ID NO: 4695506 - DNA, 18 bp, Homo sapiens
ttactttaaaaggagcca

SEQ ID NO: 4695507 - DNA, 15 bp, Homo sapiens
ttactttaccacccc

SEQ ID NO: 4695508 - DNA, 14 bp, Homo sapiens
ttactttgtgcaaa

SEQ ID NO: 4695509 - DNA, 14 bp, Homo sapiens
ttactttgtgttca

SEQ ID NO: 4695510 - DNA, 14 bp, Homo sapiens
ttactttttaaaca

SEQ ID NO: 4695511 - DNA, 23 bp, Homo sapiens
ttagaaaaacaaatgattagtta

SEQ ID NO: 4695512 - DNA, 17 bp, Homo sapiens
ttagaaattataatttt

SEQ ID NO: 4695513 - DNA, 22 bp, Homo sapiens
ttagaacatttaataatgtatg

SEQ ID NO: 4695514 - DNA, 18 bp, Homo sapiens
ttagaagatattagtctt

SEQ ID NO: 4695515 - DNA, 23 bp, Homo sapiens
ttagaagatattagtcttggggc

SEQ ID NO: 4695516 - DNA, 16 bp, Homo sapiens
ttagaattctaattgt

SEQ ID NO: 4695517 - DNA, 20 bp, Homo sapiens
ttagacagagtctcactgtt

SEQ ID NO: 4695518 - DNA, 13 bp, Homo sapiens
ttagacagtccct

SEQ ID NO: 4695519 - DNA, 16 bp, Homo sapiens
ttagacctgtgttact

SEQ ID NO: 4695520 - DNA, 22 bp, Homo sapiens
ttagactcaaagaatataatct

SEQ ID NO: 4695521 - DNA, 23 bp, Homo sapiens
ttagatggaaaaatgtgaaaaaa

SEQ ID NO: 4695522 - DNA, 13 bp, Homo sapiens
ttagatgttctaa

SEQ ID NO: 4695523 - DNA, 15 bp, Homo sapiens
ttagattatttctgt

SEQ ID NO: 4695524 - DNA, 22 bp, Homo sapiens
ttagcataattttgtgttgtac

SEQ ID NO: 4695525 - DNA, 14 bp, Homo sapiens
ttagcggagacgga

SEQ ID NO: 4695526 - DNA, 13 bp, Homo sapiens
ttagctatttaat

SEQ ID NO: 4695527 - DNA, 15 bp, Homo sapiens
ttagctttgctctgc

SEQ ID NO: 4695528 - DNA, 12 bp, Homo sapiens
ttaggcctggca

SEQ ID NO: 4695529 - DNA, 14 bp, Homo sapiens
ttagggaaaacatt

SEQ ID NO: 4695530 - DNA, 15 bp, Homo sapiens
ttagggaaaacattc

SEQ ID NO: 4695531 - DNA, 17 bp, Homo sapiens
ttagggaaaacattcca

SEQ ID NO: 4695532 - DNA, 14 bp, Homo sapiens
ttagggaagggcct

SEQ ID NO: 4695533 - DNA, 13 bp, Homo sapiens
ttagtagagacag

SEQ ID NO: 4695534 - DNA, 15 bp, Homo sapiens
ttagttgctgtatgt

SEQ ID NO: 4695535 - DNA, 15 bp, Homo sapiens
ttagtttctccaagc

SEQ ID NO: 4695536 - DNA, 14 bp, Homo sapiens
ttagttttgtgctt

SEQ ID NO: 4695537 - DNA, 21 bp, Homo sapiens
ttagtttttgtgaagtttaat

SEQ ID NO: 4695538 - DNA, 20 bp, Homo sapiens
ttataaaaaatggtgcctga

SEQ ID NO: 4695539 - DNA, 23 bp, Homo sapiens
ttataaacctctaatttattttg

SEQ ID NO: 4695540 - DNA, 18 bp, Homo sapiens
ttataactgtaaagatgt

SEQ ID NO: 4695541 - DNA, 18 bp, Homo sapiens
ttataagtatcttcatgt

SEQ ID NO: 4695542 - DNA, 15 bp, Homo sapiens
ttatacactgtaatg

SEQ ID NO: 4695543 - DNA, 16 bp, Homo sapiens
ttatagccgaaatgat

SEQ ID NO: 4695544 - DNA, 21 bp, Homo sapiens
ttatagtgatgtaatcttgaa

SEQ ID NO: 4695545 - DNA, 12 bp, Homo sapiens
ttatattcatca

SEQ ID NO: 4695546 - DNA, 11 bp, Homo sapiens
ttatatttcca

SEQ ID NO: 4695547 - DNA, 20 bp, Homo sapiens
ttatattttgctgtttatga

SEQ ID NO: 4695548 - DNA, 21 bp, Homo sapiens
ttatcaattgcaaaatgcgta

SEQ ID NO: 4695549 - DNA, 21 bp, Homo sapiens
ttatcaccgtgggctccctga

SEQ ID NO: 4695550 - DNA, 13 bp, Homo sapiens
ttatcagttatat

SEQ ID NO: 4695551 - DNA, 15 bp, Homo sapiens
ttatccagaagtatt

SEQ ID NO: 4695552 - DNA, 23 bp, Homo sapiens
ttatccagaagtattgtttacat

SEQ ID NO: 4695553 - DNA, 15 bp, Homo sapiens
ttatcgaaataacaa

SEQ ID NO: 4695554 - DNA, 20 bp, Homo sapiens
ttatctacccagtcatgtac

SEQ ID NO: 4695555 - DNA, 12 bp, Homo sapiens
ttatctattaaa

SEQ ID NO: 4695556 - DNA, 19 bp, Homo sapiens
ttatctattaaaattgcca

SEQ ID NO: 4695557 - DNA, 15 bp, Homo sapiens
ttatctcctaattgt

SEQ ID NO: 4695558 - DNA, 22 bp, Homo sapiens
ttatctcctaattgtatgttag

SEQ ID NO: 4695559 - DNA, 23 bp, Homo sapiens
ttatctcctaattgtatgttaga

SEQ ID NO: 4695560 - DNA, 14 bp, Homo sapiens
ttatctcctgtgat

SEQ ID NO: 4695561 - DNA, 16 bp, Homo sapiens
ttatcttgtgtatgga

SEQ ID NO: 4695562 - DNA, 15 bp, Homo sapiens
ttatgagaacatggt

SEQ ID NO: 4695563 - DNA, 22 bp, Homo sapiens
ttatgagaacatggtgtgtgtc

SEQ ID NO: 4695564 - DNA, 15 bp, Homo sapiens
ttatgatctatttgt

SEQ ID NO: 4695565 - DNA, 20 bp, Homo sapiens
ttatgatgtgggtcaaggaa

SEQ ID NO: 4695566 - DNA, 21 bp, Homo sapiens
ttatgatgtgggtcaaggaat

SEQ ID NO: 4695567 - DNA, 11 bp, Homo sapiens
ttatgcatctg

SEQ ID NO: 4695568 - DNA, 16 bp, Homo sapiens
ttatgcggtctaggga

SEQ ID NO: 4695569 - DNA, 22 bp, Homo sapiens
ttatgggctgggttctacccag

SEQ ID NO: 4695570 - DNA, 20 bp, Homo sapiens
ttatgtatgtaaatagattt

SEQ ID NO: 4695571 - DNA, 20 bp, Homo sapiens
ttatgtgaaatgcttatgct

SEQ ID NO: 4695572 - DNA, 19 bp, Homo sapiens
ttatgttatcaccttccaa

SEQ ID NO: 4695573 - DNA, 20 bp, Homo sapiens
ttatgttatcaccttccaaa

SEQ ID NO: 4695574 - DNA, 22 bp, Homo sapiens
ttattaaaacagaaattaatct

SEQ ID NO: 4695575 - DNA, 14 bp, Homo sapiens
ttattactttttaa

SEQ ID NO: 4695576 - DNA, 14 bp, Homo sapiens
ttattcagaacttt

SEQ ID NO: 4695577 - DNA, 15 bp, Homo sapiens
ttattcagaacttta

SEQ ID NO: 4695578 - DNA, 20 bp, Homo sapiens
ttattcaggaaaagcctctg

SEQ ID NO: 4695579 - DNA, 21 bp, Homo sapiens
ttattcaggaaaagcctctgt

SEQ ID NO: 4695580 - DNA, 22 bp, Homo sapiens
ttattcaggaaaagcctctgtg

SEQ ID NO: 4695581 - DNA, 18 bp, Homo sapiens
ttattcagttcttacaca

SEQ ID NO: 4695582 - DNA, 16 bp, Homo sapiens
ttattcttttccagaa

SEQ ID NO: 4695583 - DNA, 16 bp, Homo sapiens
ttattgaatatatgat

SEQ ID NO: 4695584 - DNA, 15 bp, Homo sapiens
ttattgatgttttca

SEQ ID NO: 4695585 - DNA, 19 bp, Homo sapiens
ttattgcagcgattaataa

SEQ ID NO: 4695586 - DNA, 16 bp, Homo sapiens
ttattgtgatttcccg

SEQ ID NO: 4695587 - DNA, 13 bp, Homo sapiens
ttatttaaagcac

SEQ ID NO: 4695588 - DNA, 13 bp, Homo sapiens
ttatttaaatgta

SEQ ID NO: 4695589 - DNA, 15 bp, Homo sapiens
ttatttaaatgtact

SEQ ID NO: 4695590 - DNA, 12 bp, Homo sapiens
ttatttaacttt

SEQ ID NO: 4695591 - DNA, 15 bp, Homo sapiens
ttatttaagactaaa

SEQ ID NO: 4695592 - DNA, 13 bp, Homo sapiens
ttatttaataaca

SEQ ID NO: 4695593 - DNA, 14 bp, Homo sapiens
ttatttaataacat

SEQ ID NO: 4695594 - DNA, 15 bp, Homo sapiens
ttatttaataacatt

SEQ ID NO: 4695595 - DNA, 19 bp, Homo sapiens
ttatttaataacattacct

SEQ ID NO: 4695596 - DNA, 14 bp, Homo sapiens
ttatttaatttgta

SEQ ID NO: 4695597 - DNA, 16 bp, Homo sapiens
ttatttaccttttaag

SEQ ID NO: 4695598 - DNA, 19 bp, Homo sapiens
ttatttcatgattagaaat

SEQ ID NO: 4695599 - DNA, 11 bp, Homo sapiens
ttatttgcata

SEQ ID NO: 4695600 - DNA, 14 bp, Homo sapiens
ttattttgtaatta

SEQ ID NO: 4695601 - DNA, 18 bp, Homo sapiens
ttattttgtaattattgt

SEQ ID NO: 4695602 - DNA, 21 bp, Homo sapiens
ttattttgtaattattgtgat

SEQ ID NO: 4695603 - DNA, 21 bp, Homo sapiens
ttattttgttactgtctgtag

SEQ ID NO: 4695604 - DNA, 14 bp, Homo sapiens
ttattttgtttcaa

SEQ ID NO: 4695605 - DNA, 23 bp, Homo sapiens
ttatttttggcgtggctgactta

SEQ ID NO: 4695606 - DNA, 17 bp, Homo sapiens
ttcaaaaccttttgaaa

SEQ ID NO: 4695607 - DNA, 16 bp, Homo sapiens
ttcaaacacaatggag

SEQ ID NO: 4695608 - DNA, 21 bp, Homo sapiens
ttcaacaaagaaacaaagatg

SEQ ID NO: 4695609 - DNA, 21 bp, Homo sapiens
ttcaagcgattcttctgcttc

SEQ ID NO: 4695610 - DNA, 20 bp, Homo sapiens
ttcaagtgattctcatgcct

SEQ ID NO: 4695611 - DNA, 22 bp, Homo sapiens
ttcaagtgattctcatgcctca

SEQ ID NO: 4695612 - DNA, 22 bp, Homo sapiens
ttcaatctgtgtaagaaaacaa

SEQ ID NO: 4695613 - DNA, 20 bp, Homo sapiens
ttcaatggtttgcaaggaag

SEQ ID NO: 4695614 - DNA, 23 bp, Homo sapiens
ttcaatggtttgcaaggaagcca

SEQ ID NO: 4695615 - DNA, 11 bp, Homo sapiens
ttcacaaataa

SEQ ID NO: 4695616 - DNA, 19 bp, Homo sapiens
ttcacagatgctgtgtaac

SEQ ID NO: 4695617 - DNA, 20 bp, Homo sapiens
ttcacagatgctgtgtaaca

SEQ ID NO: 4695618 - DNA, 17 bp, Homo sapiens
ttcacagctaagatgcc

SEQ ID NO: 4695619 - DNA, 19 bp, Homo sapiens
ttcacagtacccaaactgc

SEQ ID NO: 4695620 - DNA, 20 bp, Homo sapiens
ttcacatttcaagatccaaa

SEQ ID NO: 4695621 - DNA, 17 bp, Homo sapiens
ttcacccctccctttct

SEQ ID NO: 4695622 - DNA, 14 bp, Homo sapiens
ttcacctttgtccc

SEQ ID NO: 4695623 - DNA, 12 bp, Homo sapiens
ttcactatttaa

SEQ ID NO: 4695624 - DNA, 13 bp, Homo sapiens
ttcacttgcacat

SEQ ID NO: 4695625 - DNA, 14 bp, Homo sapiens
ttcacttgcacatc

SEQ ID NO: 4695626 - DNA, 20 bp, Homo sapiens
ttcacttttgacaaaggcaa

SEQ ID NO: 4695627 - DNA, 15 bp, Homo sapiens
ttcagaaagaagtgg

SEQ ID NO: 4695628 - DNA, 17 bp, Homo sapiens
ttcagaacagtgtttga

SEQ ID NO: 4695629 - DNA, 21 bp, Homo sapiens
ttcagaatcacttctgagaac

SEQ ID NO: 4695630 - DNA, 16 bp, Homo sapiens
ttcagacagctgcctg

SEQ ID NO: 4695631 - DNA, 15 bp, Homo sapiens
ttcagagactcctgc

SEQ ID NO: 4695632 - DNA, 23 bp, Homo sapiens
ttcagagctgacacaggatgaag

SEQ ID NO: 4695633 - DNA, 18 bp, Homo sapiens
ttcagatacagggtgctc

SEQ ID NO: 4695634 - DNA, 13 bp, Homo sapiens
ttcagatgtatgt

SEQ ID NO: 4695635 - DNA, 23 bp, Homo sapiens
ttcagcacctacagtgtacagtc

SEQ ID NO: 4695636 - DNA, 16 bp, Homo sapiens
ttcagcatcaaacatg

SEQ ID NO: 4695637 - DNA, 18 bp, Homo sapiens
ttcagcatcaaacatgaa

SEQ ID NO: 4695638 - DNA, 14 bp, Homo sapiens
ttcagctcactgca

SEQ ID NO: 4695639 - DNA, 22 bp, Homo sapiens
ttcagctccagctcaccagccc

SEQ ID NO: 4695640 - DNA, 20 bp, Homo sapiens
ttcagctggtggatggtgac

SEQ ID NO: 4695641 - DNA, 22 bp, Homo sapiens
ttcagctggtggatggtgactt

SEQ ID NO: 4695642 - DNA, 22 bp, Homo sapiens
ttcagcttctgctgggctgggg

SEQ ID NO: 4695643 - DNA, 18 bp, Homo sapiens
ttcaggaaaagcctctgt

SEQ ID NO: 4695644 - DNA, 16 bp, Homo sapiens
ttcaggaagataaaaa

SEQ ID NO: 4695645 - DNA, 16 bp, Homo sapiens
ttcaggaagctcaggg

SEQ ID NO: 4695646 - DNA, 22 bp, Homo sapiens
ttcaggggctgcccgctcccag

SEQ ID NO: 4695647 - DNA, 23 bp, Homo sapiens
ttcaggggctgcccgctcccagt

SEQ ID NO: 4695648 - DNA, 17 bp, Homo sapiens
ttcagggttggcccctg

SEQ ID NO: 4695649 - DNA, 16 bp, Homo sapiens
ttcaggtgacatgtga

SEQ ID NO: 4695650 - DNA, 17 bp, Homo sapiens
ttcaggtgacatgtgaa

SEQ ID NO: 4695651 - DNA, 21 bp, Homo sapiens
ttcaggtgacatgtgaaacct

SEQ ID NO: 4695652 - DNA, 20 bp, Homo sapiens
ttcaggttatcgaaataaca

SEQ ID NO: 4695653 - DNA, 14 bp, Homo sapiens
ttcagtcaattctg

SEQ ID NO: 4695654 - DNA, 13 bp, Homo sapiens
ttcagtgaatttg

SEQ ID NO: 4695655 - DNA, 15 bp, Homo sapiens
ttcagtggcagctgc

SEQ ID NO: 4695656 - DNA, 12 bp, Homo sapiens
ttcagtgttaaa

SEQ ID NO: 4695657 - DNA, 16 bp, Homo sapiens
ttcagttctgtgtaca

SEQ ID NO: 4695658 - DNA, 18 bp, Homo sapiens
ttcagttctgtgtacatt

SEQ ID NO: 4695659 - DNA, 20 bp, Homo sapiens
ttcagttctgtgtacatttt

SEQ ID NO: 4695660 - DNA, 18 bp, Homo sapiens
ttcataaagagaaaatga

SEQ ID NO: 4695661 - DNA, 19 bp, Homo sapiens
ttcataaagagaaaatgat

SEQ ID NO: 4695662 - DNA, 14 bp, Homo sapiens
ttcataaattattt

SEQ ID NO: 4695663 - DNA, 18 bp, Homo sapiens
ttcatagagaatataaaa

SEQ ID NO: 4695664 - DNA, 20 bp, Homo sapiens
ttcatatagtcaatgtaaaa

SEQ ID NO: 4695665 - DNA, 20 bp, Homo sapiens
ttcatatttaatttgaaggt

SEQ ID NO: 4695666 - DNA, 20 bp, Homo sapiens
ttcatcaaataaaccttgtt

SEQ ID NO: 4695667 - DNA, 14 bp, Homo sapiens
ttcatcaagactgg

SEQ ID NO: 4695668 - DNA, 16 bp, Homo sapiens
ttcatctgctctcctt

SEQ ID NO: 4695669 - DNA, 17 bp, Homo sapiens
ttcatctggaaccatca

SEQ ID NO: 4695670 - DNA, 13 bp, Homo sapiens
ttcatgcatggaa

SEQ ID NO: 4695671 - DNA, 15 bp, Homo sapiens
ttcatgcatggaaat

SEQ ID NO: 4695672 - DNA, 19 bp, Homo sapiens
ttcatgtaaactgtgcacc

SEQ ID NO: 4695673 - DNA, 15 bp, Homo sapiens
ttcatgtctaagaac

SEQ ID NO: 4695674 - DNA, 23 bp, Homo sapiens
ttcattaattaccctactttcat

SEQ ID NO: 4695675 - DNA, 20 bp, Homo sapiens
ttcattacttttaaaaatgt

SEQ ID NO: 4695676 - DNA, 14 bp, Homo sapiens
ttcattagttttga

SEQ ID NO: 4695677 - DNA, 19 bp, Homo sapiens
ttcattagttttgaagatt

SEQ ID NO: 4695678 - DNA, 9 bp, Homo sapiens
ttcattcag

SEQ ID NO: 4695679 - DNA, 18 bp, Homo sapiens
ttcattctccctttcact

SEQ ID NO: 4695680 - DNA, 12 bp, Homo sapiens
ttcattctgtga

SEQ ID NO: 4695681 - DNA, 13 bp, Homo sapiens
ttcattctgtgac

SEQ ID NO: 4695682 - DNA, 13 bp, Homo sapiens
ttcatttactgtg

SEQ ID NO: 4695683 - DNA, 19 bp, Homo sapiens
ttcatttactgtggcttct

SEQ ID NO: 4695684 - DNA, 22 bp, Homo sapiens
ttcatttcctctgagctgttat

SEQ ID NO: 4695685 - DNA, 20 bp, Homo sapiens
ttcattttttatgtattgtt

SEQ ID NO: 4695686 - DNA, 15 bp, Homo sapiens
ttccaaacaaaagca

SEQ ID NO: 4695687 - DNA, 18 bp, Homo sapiens
ttccaaagagtgtggaat

SEQ ID NO: 4695688 - DNA, 20 bp, Homo sapiens
ttccaaagtgtaagtttgtg

SEQ ID NO: 4695689 - DNA, 14 bp, Homo sapiens
ttccaaataaataa

SEQ ID NO: 4695690 - DNA, 17 bp, Homo sapiens
ttccaaatgtgtataat

SEQ ID NO: 4695691 - DNA, 12 bp, Homo sapiens
ttccaagagctg

SEQ ID NO: 4695692 - DNA, 13 bp, Homo sapiens
ttccacaccccca

SEQ ID NO: 4695693 - DNA, 15 bp, Homo sapiens
ttccacacccccacc

SEQ ID NO: 4695694 - DNA, 21 bp, Homo sapiens
ttccacggagccactcctctg

SEQ ID NO: 4695695 - DNA, 22 bp, Homo sapiens
ttccacggagccactcctctga

SEQ ID NO: 4695696 - DNA, 14 bp, Homo sapiens
ttccacgtgtatgc

SEQ ID NO: 4695697 - DNA, 12 bp, Homo sapiens
ttccacttggct

SEQ ID NO: 4695698 - DNA, 19 bp, Homo sapiens
ttccacttgttcattctgt

SEQ ID NO: 4695699 - DNA, 22 bp, Homo sapiens
ttccagaaagaaaatgaatttg

SEQ ID NO: 4695700 - DNA, 18 bp, Homo sapiens
ttccagagctctgaccca

SEQ ID NO: 4695701 - DNA, 21 bp, Homo sapiens
ttccagagctgcttctgtctg

SEQ ID NO: 4695702 - DNA, 21 bp, Homo sapiens
ttccagcaattctcctgcctc

SEQ ID NO: 4695703 - DNA, 23 bp, Homo sapiens
ttccagcaattctcctgcctcag

SEQ ID NO: 4695704 - DNA, 16 bp, Homo sapiens
ttccagccagggctgc

SEQ ID NO: 4695705 - DNA, 17 bp, Homo sapiens
ttccaggtaaaaacaga

SEQ ID NO: 4695706 - DNA, 19 bp, Homo sapiens
ttccagtgaggctctgccc

SEQ ID NO: 4695707 - DNA, 13 bp, Homo sapiens
ttccagtgcagag

SEQ ID NO: 4695708 - DNA, 14 bp, Homo sapiens
ttccagtgcagaga

SEQ ID NO: 4695709 - DNA, 14 bp, Homo sapiens
ttccatcaaagaga

SEQ ID NO: 4695710 - DNA, 20 bp, Homo sapiens
ttccatcccctagaaatcct

SEQ ID NO: 4695711 - DNA, 24 bp, Homo sapiens
ttccatgaaaatgcaacaacatgt

SEQ ID NO: 4695712 - DNA, 14 bp, Homo sapiens
ttccatggactttg

SEQ ID NO: 4695713 - DNA, 18 bp, Homo sapiens
ttccattgcctcttttca

SEQ ID NO: 4695714 - DNA, 22 bp, Homo sapiens
ttccattgcctcttttcacatt

SEQ ID NO: 4695715 - DNA, 19 bp, Homo sapiens
ttcccaacccccagccccc

SEQ ID NO: 4695716 - DNA, 15 bp, Homo sapiens
tgccctgggaggcag

SEQ ID NO: 4695717 - DNA, 16 bp, Homo sapiens
tgccctggtggccctc

SEQ ID NO: 4695718 - DNA, 17 bp, Homo sapiens
tgccctggtttcctgcc

SEQ ID NO: 4695719 - DNA, 19 bp, Homo sapiens
tgccctggtttcctgccct

SEQ ID NO: 4695720 - DNA, 23 bp, Homo sapiens
tgccctggtttcctgccctggga

SEQ ID NO: 4695721 - DNA, 18 bp, Homo sapiens
tgccctgtgggcccccaa

SEQ ID NO: 4695722 - DNA, 17 bp, Homo sapiens
tgccctgttctctacca

SEQ ID NO: 4695723 - DNA, 19 bp, Homo sapiens
tgccctgttctctaccaag

SEQ ID NO: 4695724 - DNA, 20 bp, Homo sapiens
tgcccttacacttactgttg

SEQ ID NO: 4695725 - DNA, 17 bp, Homo sapiens
tgcccttgctccagcct

SEQ ID NO: 4695726 - DNA, 17 bp, Homo sapiens
tgccctttccatattta

SEQ ID NO: 4695727 - DNA, 15 bp, Homo sapiens
tgccctttctgggca

SEQ ID NO: 4695728 - DNA, 22 bp, Homo sapiens
tgccgcaatggccatgtgggga

SEQ ID NO: 4695729 - DNA, 15 bp, Homo sapiens
tgccgcagagctggc

SEQ ID NO: 4695730 - DNA, 15 bp, Homo sapiens
tgccgccccacccag

SEQ ID NO: 4695731 - DNA, 20 bp, Homo sapiens
tgccgccgcctcgcccaccg

SEQ ID NO: 4695732 - DNA, 15 bp, Homo sapiens
tgcctaccatttcac

SEQ ID NO: 4695733 - DNA, 14 bp, Homo sapiens
tgcctccactccca

SEQ ID NO: 4695734 - DNA, 15 bp, Homo sapiens
tgcctccactcccac

SEQ ID NO: 4695735 - DNA, 12 bp, Homo sapiens
tgcctccagggc

SEQ ID NO: 4695736 - DNA, 17 bp, Homo sapiens
tgcctccagggctggac

SEQ ID NO: 4695737 - DNA, 14 bp, Homo sapiens
tgcctcccatcacc

SEQ ID NO: 4695738 - DNA, 19 bp, Homo sapiens
tgcctcccatcacccgcta

SEQ ID NO: 4695739 - DNA, 16 bp, Homo sapiens
tgcctcccttcatgca

SEQ ID NO: 4695740 - DNA, 19 bp, Homo sapiens
tgcctccgcctcagtaaga

SEQ ID NO: 4695741 - DNA, 18 bp, Homo sapiens
tgcctcgaactggctgca

SEQ ID NO: 4695742 - DNA, 15 bp, Homo sapiens
tgcctcggctcctgc

SEQ ID NO: 4695743 - DNA, 17 bp, Homo sapiens
tgcctcggctcctgctg

SEQ ID NO: 4695744 - DNA, 14 bp, Homo sapiens
tgcctctgacacac

SEQ ID NO: 4695745 - DNA, 21 bp, Homo sapiens
tgcctctgacacacagctctg

SEQ ID NO: 4695746 - DNA, 11 bp, Homo sapiens
tgcctctgcct

SEQ ID NO: 4695747 - DNA, 14 bp, Homo sapiens
tgcctctgcctctg

SEQ ID NO: 4695748 - DNA, 20 bp, Homo sapiens
tgcctctgcctctgacacac

SEQ ID NO: 4695749 - DNA, 15 bp, Homo sapiens
tgcctctgtcccctt

SEQ ID NO: 4695750 - DNA, 20 bp, Homo sapiens
tgcctctgtccccttctctc

SEQ ID NO: 4695751 - DNA, 21 bp, Homo sapiens
tgcctctgtccccttctctca

SEQ ID NO: 4695752 - DNA, 16 bp, Homo sapiens
tgcctctgtttgacaa

SEQ ID NO: 4695753 - DNA, 16 bp, Homo sapiens
tgcctcttctgggagg

SEQ ID NO: 4695754 - DNA, 19 bp, Homo sapiens
tgcctcttctgggagggca

SEQ ID NO: 4695755 - DNA, 17 bp, Homo sapiens
tgcctgagcccctcaga

SEQ ID NO: 4695756 - DNA, 16 bp, Homo sapiens
tgcctgagtgcctggc

SEQ ID NO: 4695757 - DNA, 20 bp, Homo sapiens
tgcctgattcggctgtctca

SEQ ID NO: 4695758 - DNA, 20 bp, Homo sapiens
tgcctgcccaggcccctgcc

SEQ ID NO: 4695759 - DNA, 22 bp, Homo sapiens
tgcctgcccaggcccctgccac

SEQ ID NO: 4695760 - DNA, 11 bp, Homo sapiens
tgcctggaccc

SEQ ID NO: 4695761 - DNA, 14 bp, Homo sapiens
tgcctggatggggc

SEQ ID NO: 4695762 - DNA, 16 bp, Homo sapiens
tgcctggatggggctg

SEQ ID NO: 4695763 - DNA, 22 bp, Homo sapiens
tgcctggcttcgcaaaatgttt

SEQ ID NO: 4695764 - DNA, 20 bp, Homo sapiens
tgcctgggagccagggtgag

SEQ ID NO: 4695765 - DNA, 14 bp, Homo sapiens
tgcctggtggcagc

SEQ ID NO: 4695766 - DNA, 15 bp, Homo sapiens
tgcctggtggcagct

SEQ ID NO: 4695767 - DNA, 19 bp, Homo sapiens
tgcctggtggcagctgcgg

SEQ ID NO: 4695768 - DNA, 19 bp, Homo sapiens
tgcctgtaatcccagcact

SEQ ID NO: 4695769 - DNA, 21 bp, Homo sapiens
tgcctgtgtgcgagtctgagt

SEQ ID NO: 4695770 - DNA, 15 bp, Homo sapiens
tgcctgttcagctcc

SEQ ID NO: 4695771 - DNA, 16 bp, Homo sapiens
tgcctgttcagctcca

SEQ ID NO: 4695772 - DNA, 18 bp, Homo sapiens
tgcctgttcagctccagc

SEQ ID NO: 4695773 - DNA, 21 bp, Homo sapiens
tgcctgttcagctccagctca

SEQ ID NO: 4695774 - DNA, 20 bp, Homo sapiens
tgccttcctcctgggccctc

SEQ ID NO: 4695775 - DNA, 21 bp, Homo sapiens
tgccttgacaaacttctttca

SEQ ID NO: 4695776 - DNA, 18 bp, Homo sapiens
tgcctttatttgctgtta

SEQ ID NO: 4695777 - DNA, 21 bp, Homo sapiens
tgcctttatttgctgttaact

SEQ ID NO: 4695778 - DNA, 18 bp, Homo sapiens
tgcctttcagaagtgatt

SEQ ID NO: 4695779 - DNA, 19 bp, Homo sapiens
tgcctttcagaagtgattt

SEQ ID NO: 4695780 - DNA, 17 bp, Homo sapiens
tgcctttgacctgcctc

SEQ ID NO: 4695781 - DNA, 12 bp, Homo sapiens
tgcctttgagac

SEQ ID NO: 4695782 - DNA, 20 bp, Homo sapiens
tgcctttgagacagtttctt

SEQ ID NO: 4695783 - DNA, 15 bp, Homo sapiens
tgcgaccccatctgc

SEQ ID NO: 4695784 - DNA, 20 bp, Homo sapiens
tgcgaccccatctgcccagg

SEQ ID NO: 4695785 - DNA, 16 bp, Homo sapiens
tgcgagagatgtgtgt

SEQ ID NO: 4695786 - DNA, 17 bp, Homo sapiens
tgcgagagatgtgtgtt

SEQ ID NO: 4695787 - DNA, 16 bp, Homo sapiens
tgcttttcttcctagt

SEQ ID NO: 4695788 - DNA, 18 bp, Homo sapiens
tgcttttggtctgtgtga

SEQ ID NO: 4695789 - DNA, 14 bp, Homo sapiens
tggaaaacagagta

SEQ ID NO: 4695790 - DNA, 18 bp, Homo sapiens
tggaaaacatcctgactt

SEQ ID NO: 4695791 - DNA, 23 bp, Homo sapiens
tggaaactaccagtgggcatgta

SEQ ID NO: 4695792 - DNA, 18 bp, Homo sapiens
tggaaaggattctaaaca

SEQ ID NO: 4695793 - DNA, 21 bp, Homo sapiens
tggaaaggattctaaacagat

SEQ ID NO: 4695794 - DNA, 18 bp, Homo sapiens
tggaaatgggcagagcag

SEQ ID NO: 4695795 - DNA, 17 bp, Homo sapiens
tggaaattgattttgaa

SEQ ID NO: 4695796 - DNA, 20 bp, Homo sapiens
tggaacagattcacactgtc

SEQ ID NO: 4695797 - DNA, 14 bp, Homo sapiens
tggaacatccttgg

SEQ ID NO: 4695798 - DNA, 17 bp, Homo sapiens
tggaaccacattgaaga

SEQ ID NO: 4695799 - DNA, 17 bp, Homo sapiens
tggaactggaggcaggg

SEQ ID NO: 4695800 - DNA, 20 bp, Homo sapiens
tggaagacagagacctcctg

SEQ ID NO: 4695801 - DNA, 20 bp, Homo sapiens
tggaagctagctcccctcct

SEQ ID NO: 4695802 - DNA, 22 bp, Homo sapiens
tggaagctagctcccctcctct

SEQ ID NO: 4695803 - DNA, 13 bp, Homo sapiens
tggaaggtgggga

SEQ ID NO: 4695804 - DNA, 22 bp, Homo sapiens
tggaagtatgtatattaaaaaa

SEQ ID NO: 4695805 - DNA, 15 bp, Homo sapiens
tggaagtccctcaga

SEQ ID NO: 4695806 - DNA, 20 bp, Homo sapiens
tggaagtccctcagaggcct

SEQ ID NO: 4695807 - DNA, 21 bp, Homo sapiens
tggaagtgtgtgatctgtggg

SEQ ID NO: 4695808 - DNA, 11 bp, Homo sapiens
tggaagttatt

SEQ ID NO: 4695809 - DNA, 13 bp, Homo sapiens
tggaatagttttt

SEQ ID NO: 4695810 - DNA, 15 bp, Homo sapiens
tggaatattgtccat

SEQ ID NO: 4695811 - DNA, 20 bp, Homo sapiens
tggaatattgtccattgtcc

SEQ ID NO: 4695812 - DNA, 12 bp, Homo sapiens
tggaatctggag

SEQ ID NO: 4695813 - DNA, 22 bp, Homo sapiens
tggaatcttcacctcagagtgg

SEQ ID NO: 4695814 - DNA, 22 bp, Homo sapiens
tggaattcttagtcacaaaata

SEQ ID NO: 4695815 - DNA, 14 bp, Homo sapiens
tggacaaggaggtc

SEQ ID NO: 4695816 - DNA, 13 bp, Homo sapiens
tggacacagctct

SEQ ID NO: 4695817 - DNA, 16 bp, Homo sapiens
tggacacagctcttct

SEQ ID NO: 4695818 - DNA, 18 bp, Homo sapiens
tggacacagctcttctcc

SEQ ID NO: 4695819 - DNA, 22 bp, Homo sapiens
tggacacagctcttctccaggc

SEQ ID NO: 4695820 - DNA, 17 bp, Homo sapiens
tggacaccacccagagc

SEQ ID NO: 4695821 - DNA, 12 bp, Homo sapiens
tggacagaagaa

SEQ ID NO: 4695822 - DNA, 15 bp, Homo sapiens
tggacagaagcagct

SEQ ID NO: 4695823 - DNA, 18 bp, Homo sapiens
tggacagaagcagctctt

SEQ ID NO: 4695824 - DNA, 21 bp, Homo sapiens
tggacagtctttgatcatcat

SEQ ID NO: 4695825 - DNA, 16 bp, Homo sapiens
tggacatcgatatgaa

SEQ ID NO: 4695826 - DNA, 21 bp, Homo sapiens
tggacatgaagattctttccc

SEQ ID NO: 4695827 - DNA, 22 bp, Homo sapiens
tggacatgaagattctttccca

SEQ ID NO: 4695828 - DNA, 16 bp, Homo sapiens
tggacattttatgtct

SEQ ID NO: 4695829 - DNA, 17 bp, Homo sapiens
tggacattttatgtctt

SEQ ID NO: 4695830 - DNA, 13 bp, Homo sapiens
tggacccctgcat

SEQ ID NO: 4695831 - DNA, 22 bp, Homo sapiens
tggaccctactattcatgtttt

SEQ ID NO: 4695832 - DNA, 20 bp, Homo sapiens
tggaccctgaggcccagagg

SEQ ID NO: 4695833 - DNA, 13 bp, Homo sapiens
tggacccttccat

SEQ ID NO: 4695834 - DNA, 15 bp, Homo sapiens
tggaccggagagtgg

SEQ ID NO: 4695835 - DNA, 22 bp, Homo sapiens
tggacggtgctccaggcaggct

SEQ ID NO: 4695836 - DNA, 14 bp, Homo sapiens
tggactatgcacac

SEQ ID NO: 4695837 - DNA, 15 bp, Homo sapiens
tggactcaggaactt

SEQ ID NO: 4695838 - DNA, 22 bp, Homo sapiens
tggactctcagtctctgagcag

SEQ ID NO: 4695839 - DNA, 16 bp, Homo sapiens
tggactgaggcctgag

SEQ ID NO: 4695840 - DNA, 16 bp, Homo sapiens
tggacttggggcctct

SEQ ID NO: 4695841 - DNA, 22 bp, Homo sapiens
tggactttgttagtttctccaa

SEQ ID NO: 4695842 - DNA, 24 bp, Homo sapiens
tggactttgttagtttctccaagc

SEQ ID NO: 4695843 - DNA, 13 bp, Homo sapiens
tggagaaaatggg

SEQ ID NO: 4695844 - DNA, 18 bp, Homo sapiens
tggagaactagaacctgg

SEQ ID NO: 4695845 - DNA, 20 bp, Homo sapiens
tggagaactagaacctggag

SEQ ID NO: 4695846 - DNA, 19 bp, Homo sapiens
tggagaagccacaggcctg

SEQ ID NO: 4695847 - DNA, 22 bp, Homo sapiens
tggagactcctaggcaggacat

SEQ ID NO: 4695848 - DNA, 12 bp, Homo sapiens
tggagagaaggc

SEQ ID NO: 4695849 - DNA, 18 bp, Homo sapiens
tggagagccagaacctgg

SEQ ID NO: 4695850 - DNA, 18 bp, Homo sapiens
tggagagctagaacctgg

SEQ ID NO: 4695851 - DNA, 20 bp, Homo sapiens
tggagagctagaacctggag

SEQ ID NO: 4695852 - DNA, 13 bp, Homo sapiens
tggagagctggag

SEQ ID NO: 4695853 - DNA, 17 bp, Homo sapiens
tggagagctggagcctg

SEQ ID NO: 4695854 - DNA, 13 bp, Homo sapiens
tggagagtgagag

SEQ ID NO: 4695855 - DNA, 17 bp, Homo sapiens
tggagagtgagagcatg

SEQ ID NO: 4695856 - DNA, 12 bp, Homo sapiens
tggagcagaggg

SEQ ID NO: 4695857 - DNA, 20 bp, Homo sapiens
tggaggaaggattgtaaaaa

SEQ ID NO: 4695858 - DNA, 18 bp, Homo sapiens
tggaggagcaaaggctga

SEQ ID NO: 4695859 - DNA, 20 bp, Homo sapiens
tggaggagcagtgcaggcac

SEQ ID NO: 4695860 - DNA, 12 bp, Homo sapiens
tggaggagccca

SEQ ID NO: 4695861 - DNA, 13 bp, Homo sapiens
tggaggagcccag

SEQ ID NO: 4695862 - DNA, 19 bp, Homo sapiens
tggaggagcccaggccagg

SEQ ID NO: 4695863 - DNA, 22 bp, Homo sapiens
tggaggagcccaggccaggact

SEQ ID NO: 4695864 - DNA, 23 bp, Homo sapiens
tggaggagcccaggccaggactc

SEQ ID NO: 4695865 - DNA, 19 bp, Homo sapiens
tggaggagctcaggacact

SEQ ID NO: 4695866 - DNA, 15 bp, Homo sapiens
tggaggaggcctggg

SEQ ID NO: 4695867 - DNA, 18 bp, Homo sapiens
tggaggaggcctgggggc

SEQ ID NO: 4695868 - DNA, 23 bp, Homo sapiens
tggaggaggcctgggggcaggga

SEQ ID NO: 4695869 - DNA, 19 bp, Homo sapiens
tggaggccgagtctgtcct

SEQ ID NO: 4695870 - DNA, 20 bp, Homo sapiens
tggaggccgagtctgtcctg

SEQ ID NO: 4695871 - DNA, 21 bp, Homo sapiens
tggaggccgagtctgtcctgg

SEQ ID NO: 4695872 - DNA, 19 bp, Homo sapiens
tggagggaatgaacctgga

SEQ ID NO: 4695873 - DNA, 23 bp, Homo sapiens
tggagggctagaacctggagagc

SEQ ID NO: 4695874 - DNA, 21 bp, Homo sapiens
tggagggctagaacctggagg

SEQ ID NO: 4695875 - DNA, 20 bp, Homo sapiens
tggagggctagaactggaga

SEQ ID NO: 4695876 - DNA, 21 bp, Homo sapiens
tggagggctggaatctggaga

SEQ ID NO: 4695877 - DNA, 23 bp, Homo sapiens
tggaggggggaggtgggatcctc

SEQ ID NO: 4695878 - DNA, 17 bp, Homo sapiens
tggagggttggagaagg

SEQ ID NO: 4695879 - DNA, 21 bp, Homo sapiens
tggaggtttcacttgcacatc

SEQ ID NO: 4695880 - DNA, 19 bp, Homo sapiens
tggagtcagacagatgtgg

SEQ ID NO: 4695881 - DNA, 18 bp, Homo sapiens
tggagttgaaactgctat

SEQ ID NO: 4695882 - DNA, 15 bp, Homo sapiens
tggataaatttgaac

SEQ ID NO: 4695883 - DNA, 19 bp, Homo sapiens
tggataatattcattggtt

SEQ ID NO: 4695884 - DNA, 15 bp, Homo sapiens
tggatacatatttca

SEQ ID NO: 4695885 - DNA, 19 bp, Homo sapiens
tggatacgacaacttgcac

SEQ ID NO: 4695886 - DNA, 14 bp, Homo sapiens
tggatatgtgtaaa

SEQ ID NO: 4695887 - DNA, 19 bp, Homo sapiens
tggatatgtgtaaatgtta

SEQ ID NO: 4695888 - DNA, 14 bp, Homo sapiens
tggatattgttacg

SEQ ID NO: 4695889 - DNA, 22 bp, Homo sapiens
tggatgcatgttttccagctcc

SEQ ID NO: 4695890 - DNA, 23 bp, Homo sapiens
tggatgcctggtggcagctgcgg

SEQ ID NO: 4695891 - DNA, 13 bp, Homo sapiens
tggatggaagggg

SEQ ID NO: 4695892 - DNA, 15 bp, Homo sapiens
tggatggaaggggct

SEQ ID NO: 4695893 - DNA, 21 bp, Homo sapiens
tggatgggggaaatggtgcct

SEQ ID NO: 4695894 - DNA, 20 bp, Homo sapiens
tggatgggggctctgcaccc

SEQ ID NO: 4695895 - DNA, 17 bp, Homo sapiens
tggatggtgacttttga

SEQ ID NO: 4695896 - DNA, 19 bp, Homo sapiens
tggccagccccacagccca

SEQ ID NO: 4695897 - DNA, 20 bp, Homo sapiens
tggccaggctgctcttgaac

SEQ ID NO: 4695898 - DNA, 14 bp, Homo sapiens
tggccatctctgga

SEQ ID NO: 4695899 - DNA, 19 bp, Homo sapiens
tggcccaagtggcagagct

SEQ ID NO: 4695900 - DNA, 12 bp, Homo sapiens
tggcccatcccc

SEQ ID NO: 4695901 - DNA, 23 bp, Homo sapiens
tggccccagccctactctgtgta

SEQ ID NO: 4695902 - DNA, 22 bp, Homo sapiens
tggcccctcagggtccctggtg

SEQ ID NO: 4695903 - DNA, 19 bp, Homo sapiens
tggccctcaaggcctccca

SEQ ID NO: 4695904 - DNA, 21 bp, Homo sapiens
tggccctcaaggcctcccaca

SEQ ID NO: 4695905 - DNA, 21 bp, Homo sapiens
tggccctcccagtacctcctg

SEQ ID NO: 4695906 - DNA, 21 bp, Homo sapiens
tggccctctcccctgccccct

SEQ ID NO: 4695907 - DNA, 14 bp, Homo sapiens
tggccctgccctgg

SEQ ID NO: 4695908 - DNA, 17 bp, Homo sapiens
tggccgggaccccgagc

SEQ ID NO: 4695909 - DNA, 16 bp, Homo sapiens
tggccgtcctgagggg

SEQ ID NO: 4695910 - DNA, 19 bp, Homo sapiens
tggccgtgggcctggggta

SEQ ID NO: 4695911 - DNA, 22 bp, Homo sapiens
tggcctaccttgtgagggagag

SEQ ID NO: 4695912 - DNA, 13 bp, Homo sapiens
tggcctccaagtc

SEQ ID NO: 4695913 - DNA, 19 bp, Homo sapiens
tggcctcccaactcacccc

SEQ ID NO: 4695914 - DNA, 22 bp, Homo sapiens
tggcctcccaactcaccccagc

SEQ ID NO: 4695915 - DNA, 17 bp, Homo sapiens
tggcctcgcctggcctg

SEQ ID NO: 4695916 - DNA, 20 bp, Homo sapiens
tggcctctgcactcccctgc

SEQ ID NO: 4695917 - DNA, 18 bp, Homo sapiens
tggcctgagctgggatga

SEQ ID NO: 4695918 - DNA, 16 bp, Homo sapiens
tggcctggcaaaataa

SEQ ID NO: 4695919 - DNA, 21 bp, Homo sapiens
tggcctggcccctcagggtcc

SEQ ID NO: 4695920 - DNA, 15 bp, Homo sapiens
tggcctttttaagta

SEQ ID NO: 4695921 - DNA, 22 bp, Homo sapiens
tggcgcagcatattcaggaagc

SEQ ID NO: 4695922 - DNA, 23 bp, Homo sapiens
tggcgcagcatattcaggaagct

SEQ ID NO: 4695923 - DNA, 15 bp, Homo sapiens
tggctagtccttgtt

SEQ ID NO: 4695924 - DNA, 23 bp, Homo sapiens
tggctatcaaaagaaatagaaaa

SEQ ID NO: 4695925 - DNA, 15 bp, Homo sapiens
tggctatttaaaact

SEQ ID NO: 4695926 - DNA, 18 bp, Homo sapiens
tggctcaagtcctctttt

SEQ ID NO: 4695927 - DNA, 13 bp, Homo sapiens
tggctcacactga

SEQ ID NO: 4695928 - DNA, 22 bp, Homo sapiens
tggctcaggtggggtcactctg

SEQ ID NO: 4695929 - DNA, 10 bp, Homo sapiens
tggctccctg

SEQ ID NO: 4695930 - DNA, 13 bp, Homo sapiens
tggctctggggtc

SEQ ID NO: 4695931 - DNA, 13 bp, Homo sapiens
tggctcttccagg

SEQ ID NO: 4695932 - DNA, 19 bp, Homo sapiens
tggctctttggagatcaag

SEQ ID NO: 4695933 - DNA, 16 bp, Homo sapiens
tggctgaaggactgtg

SEQ ID NO: 4695934 - DNA, 23 bp, Homo sapiens
tggctgcaaagggtatcaggtgc

SEQ ID NO: 4695935 - DNA, 17 bp, Homo sapiens
tggctgcctccactccc

SEQ ID NO: 4695936 - DNA, 16 bp, Homo sapiens
tggctgggggcctcag

SEQ ID NO: 4695937 - DNA, 18 bp, Homo sapiens
tggctggtgcctgagccc

SEQ ID NO: 4695938 - DNA, 18 bp, Homo sapiens
tggctgtggcattgttga

SEQ ID NO: 4695939 - DNA, 22 bp, Homo sapiens
tggctgtggcattgttgatgct

SEQ ID NO: 4695940 - DNA, 16 bp, Homo sapiens
tggctgttggctgggg

SEQ ID NO: 4695941 - DNA, 18 bp, Homo sapiens
tggctgttggctgggggc

SEQ ID NO: 4695942 - DNA, 23 bp, Homo sapiens
tggctgttggctgggggcctcag

SEQ ID NO: 4695943 - DNA, 17 bp, Homo sapiens
tggcttaaaacaacact

SEQ ID NO: 4695944 - DNA, 18 bp, Homo sapiens
tgggaaacaaaaggataa

SEQ ID NO: 4695945 - DNA, 17 bp, Homo sapiens
tgggaactcacctgggg

SEQ ID NO: 4695946 - DNA, 14 bp, Homo sapiens
tgggaagtgactta

SEQ ID NO: 4695947 - DNA, 16 bp, Homo sapiens
tgggacatgggaaagg

SEQ ID NO: 4695948 - DNA, 16 bp, Homo sapiens
tgggaccaaacctagc

SEQ ID NO: 4695949 - DNA, 19 bp, Homo sapiens
tgggaccacgtgagatcat

SEQ ID NO: 4695950 - DNA, 14 bp, Homo sapiens
tgggacctgatgac

SEQ ID NO: 4695951 - DNA, 15 bp, Homo sapiens
tgggactacaggcac

SEQ ID NO: 4695952 - DNA, 16 bp, Homo sapiens
tgggactacaggtgtg

SEQ ID NO: 4695953 - DNA, 18 bp, Homo sapiens
tgggactcaatgcactga

SEQ ID NO: 4695954 - DNA, 13 bp, Homo sapiens
tgggagaaagacc

SEQ ID NO: 4695955 - DNA, 22 bp, Homo sapiens
tgggagatgaaaacctgcattt

SEQ ID NO: 4695956 - DNA, 14 bp, Homo sapiens
tgggagccgggtct

SEQ ID NO: 4695957 - DNA, 18 bp, Homo sapiens
tgggagccgggtctgcct

SEQ ID NO: 4695958 - DNA, 21 bp, Homo sapiens
tgggagctgcctgttcagctc

SEQ ID NO: 4695959 - DNA, 15 bp, Homo sapiens
tgtatgctttgaatg

SEQ ID NO: 4695960 - DNA, 13 bp, Homo sapiens
tgtatggaaacac

SEQ ID NO: 4695961 - DNA, 19 bp, Homo sapiens
tgtatggaaacactgattt

SEQ ID NO: 4695962 - DNA, 20 bp, Homo sapiens
tgtatggaaacactgatttt

SEQ ID NO: 4695963 - DNA, 13 bp, Homo sapiens
tgtattacaaatc

SEQ ID NO: 4695964 - DNA, 22 bp, Homo sapiens
tgtattacaaatccaatgaaat

SEQ ID NO: 4695965 - DNA, 17 bp, Homo sapiens
tgtattagccagtcatt

SEQ ID NO: 4695966 - DNA, 20 bp, Homo sapiens
tgtattagccagtcattgta

SEQ ID NO: 4695967 - DNA, 14 bp, Homo sapiens
tgtattctctgagc

SEQ ID NO: 4695968 - DNA, 21 bp, Homo sapiens
tgtattctctgagctgtgcag

SEQ ID NO: 4695969 - DNA, 15 bp, Homo sapiens
tgtatttaaatgaaa

SEQ ID NO: 4695970 - DNA, 15 bp, Homo sapiens
tgtattttatgttat

SEQ ID NO: 4695971 - DNA, 20 bp, Homo sapiens
tgtcaaccccaagttagttc

SEQ ID NO: 4695972 - DNA, 17 bp, Homo sapiens
tgtcaactttcatttga

SEQ ID NO: 4695973 - DNA, 19 bp, Homo sapiens
tgtcaagagggtctgagga

SEQ ID NO: 4695974 - DNA, 13 bp, Homo sapiens
tgtcaatactgag

SEQ ID NO: 4695975 - DNA, 17 bp, Homo sapiens
tgtcaatggaagaaacc

SEQ ID NO: 4695976 - DNA, 21 bp, Homo sapiens
tgtcacactaaaatttaattg

SEQ ID NO: 4695977 - DNA, 16 bp, Homo sapiens
tgtcacagctcttgtt

SEQ ID NO: 4695978 - DNA, 14 bp, Homo sapiens
tgtcacaggcaggt

SEQ ID NO: 4695979 - DNA, 15 bp, Homo sapiens
tgtcacaggcaggtc

SEQ ID NO: 4695980 - DNA, 17 bp, Homo sapiens
tgtcacaggcaggtcca

SEQ ID NO: 4695981 - DNA, 15 bp, Homo sapiens
tgtcacagtaatgca

SEQ ID NO: 4695982 - DNA, 16 bp, Homo sapiens
tgtcacgattgtcatc

SEQ ID NO: 4695983 - DNA, 14 bp, Homo sapiens
tgtcactggctgcc

SEQ ID NO: 4695984 - DNA, 16 bp, Homo sapiens
tgtcactggctgcctc

SEQ ID NO: 4695985 - DNA, 18 bp, Homo sapiens
tgtcactggctgcctcca

SEQ ID NO: 4695986 - DNA, 21 bp, Homo sapiens
tgtcactggctgcctccactc

SEQ ID NO: 4695987 - DNA, 20 bp, Homo sapiens
tgtcacttgctggctgtgaa

SEQ ID NO: 4695988 - DNA, 21 bp, Homo sapiens
tgtcacttgctggctgtgaaa

SEQ ID NO: 4695989 - DNA, 14 bp, Homo sapiens
tgtcagattcacac

SEQ ID NO: 4695990 - DNA, 19 bp, Homo sapiens
tgtcaggattgcgagagat

SEQ ID NO: 4695991 - DNA, 22 bp, Homo sapiens
tgtcagggaacatatttaagga

SEQ ID NO: 4695992 - DNA, 16 bp, Homo sapiens
tgtcaggtggggcagc

SEQ ID NO: 4695993 - DNA, 23 bp, Homo sapiens
tgtcagtgccgccgcctcgccca

SEQ ID NO: 4695994 - DNA, 18 bp, Homo sapiens
tgtcagttgttatttatt

SEQ ID NO: 4695995 - DNA, 12 bp, Homo sapiens
tgtcatgtgtat

SEQ ID NO: 4695996 - DNA, 13 bp, Homo sapiens
tgtcattatttga

SEQ ID NO: 4695997 - DNA, 13 bp, Homo sapiens
tgtcatttctcat

SEQ ID NO: 4695998 - DNA, 19 bp, Homo sapiens
tgtcatttgagcagggctc

SEQ ID NO: 4695999 - DNA, 21 bp, Homo sapiens
tgtcatttgagcagggctcag

SEQ ID NO: 4696000 - DNA, 17 bp, Homo sapiens
tgtccaaaccagcaaac

SEQ ID NO: 4696001 - DNA, 15 bp, Homo sapiens
tgtccaagaagccca

SEQ ID NO: 4696002 - DNA, 16 bp, Homo sapiens
tgtccaagaagcccag

SEQ ID NO: 4696003 - DNA, 13 bp, Homo sapiens
tgtccaattaatg

SEQ ID NO: 4696004 - DNA, 23 bp, Homo sapiens
tgtccattgtaaatctgaagaaa

SEQ ID NO: 4696005 - DNA, 14 bp, Homo sapiens
tgtccattgtccaa

SEQ ID NO: 4696006 - DNA, 23 bp, Homo sapiens
tgtcccaagctcccaagagcttc

SEQ ID NO: 4696007 - DNA, 11 bp, Homo sapiens
tgtccccacac

SEQ ID NO: 4696008 - DNA, 15 bp, Homo sapiens
tgtccccacactcct

SEQ ID NO: 4696009 - DNA, 18 bp, Homo sapiens
tgtccccaccgcagacag

SEQ ID NO: 4696010 - DNA, 18 bp, Homo sapiens
ctgggaaatattccctag

SEQ ID NO: 4696011 - DNA, 22 bp, Homo sapiens
ctgggacatgggaaaggggaag

SEQ ID NO: 4696012 - DNA, 14 bp, Homo sapiens
ctgggaccacgtga

SEQ ID NO: 4696013 - DNA, 15 bp, Homo sapiens
ctgggactacaggca

SEQ ID NO: 4696014 - DNA, 12 bp, Homo sapiens
ctgggagagact

SEQ ID NO: 4696015 - DNA, 21 bp, Homo sapiens
ctgggagagccttccaggggt

SEQ ID NO: 4696016 - DNA, 11 bp, Homo sapiens
ctgggagggca

SEQ ID NO: 4696017 - DNA, 17 bp, Homo sapiens
ctgggagggcagcaggg

SEQ ID NO: 4696018 - DNA, 19 bp, Homo sapiens
ctgggagggcagcagggct

SEQ ID NO: 4696019 - DNA, 13 bp, Homo sapiens
ctgggagtgagct

SEQ ID NO: 4696020 - DNA, 19 bp, Homo sapiens
ctgggatgtttctgtcaca

SEQ ID NO: 4696021 - DNA, 22 bp, Homo sapiens
ctgggattacaggctcctgcca

SEQ ID NO: 4696022 - DNA, 17 bp, Homo sapiens
ctgggattacaggtgtg

SEQ ID NO: 4696023 - DNA, 20 bp, Homo sapiens
ctgggattacaggtgtgaac

SEQ ID NO: 4696024 - DNA, 15 bp, Homo sapiens
ctgggcaaagcctag

SEQ ID NO: 4696025 - DNA, 15 bp, Homo sapiens
ctgggcaaggaggcc

SEQ ID NO: 4696026 - DNA, 12 bp, Homo sapiens
ctgggcccaagt

SEQ ID NO: 4696027 - DNA, 19 bp, Homo sapiens
ctgggctcccttcccacct

SEQ ID NO: 4696028 - DNA, 21 bp, Homo sapiens
ctgggctcccttcccacctct

SEQ ID NO: 4696029 - DNA, 21 bp, Homo sapiens
ctgggctcctaaccttcctgt

SEQ ID NO: 4696030 - DNA, 16 bp, Homo sapiens
ctgggctgagggagcc

SEQ ID NO: 4696031 - DNA, 19 bp, Homo sapiens
ctgggctgagggagcctgg

SEQ ID NO: 4696032 - DNA, 23 bp, Homo sapiens
ctgggctgagggagcctggcccc

SEQ ID NO: 4696033 - DNA, 15 bp, Homo sapiens
ctgggctggggcctg

SEQ ID NO: 4696034 - DNA, 21 bp, Homo sapiens
ctgggcttcagtggcagctgc

SEQ ID NO: 4696035 - DNA, 16 bp, Homo sapiens
ctggggacagcaaggg

SEQ ID NO: 4696036 - DNA, 14 bp, Homo sapiens
ctggggctgctggc

SEQ ID NO: 4696037 - DNA, 14 bp, Homo sapiens
ctgggggtgccagg

SEQ ID NO: 4696038 - DNA, 15 bp, Homo sapiens
ctgggggtgccagga

SEQ ID NO: 4696039 - DNA, 16 bp, Homo sapiens
ctggggtaccaagaga

SEQ ID NO: 4696040 - DNA, 14 bp, Homo sapiens
ctgggtacttgtgg

SEQ ID NO: 4696041 - DNA, 16 bp, Homo sapiens
ctgggtacttgtggac

SEQ ID NO: 4696042 - DNA, 18 bp, Homo sapiens
ctgggtacttgtggacac

SEQ ID NO: 4696043 - DNA, 17 bp, Homo sapiens
ctgggtgacagagtgag

SEQ ID NO: 4696044 - DNA, 23 bp, Homo sapiens
ctgggtgcgaccccatctgccca

SEQ ID NO: 4696045 - DNA, 13 bp, Homo sapiens
ctgggtggcccat

SEQ ID NO: 4696046 - DNA, 21 bp, Homo sapiens
ctgggtggcccatcccccctc

SEQ ID NO: 4696047 - DNA, 17 bp, Homo sapiens
ctgggtgggagcatagg

SEQ ID NO: 4696048 - DNA, 14 bp, Homo sapiens
ctgggttcactgca

SEQ ID NO: 4696049 - DNA, 15 bp, Homo sapiens
ctgggttcactgcaa

SEQ ID NO: 4696050 - DNA, 22 bp, Homo sapiens
ctgggttccagcaattctcctg

SEQ ID NO: 4696051 - DNA, 14 bp, Homo sapiens
ctgggttctaccca

SEQ ID NO: 4696052 - DNA, 15 bp, Homo sapiens
ctgggttctacccag

SEQ ID NO: 4696053 - DNA, 17 bp, Homo sapiens
ctgggttgcctttattt

SEQ ID NO: 4696054 - DNA, 20 bp, Homo sapiens
ctgggttggcgcaccctccc

SEQ ID NO: 4696055 - DNA, 22 bp, Homo sapiens
ctgggttggcgcaccctcccct

SEQ ID NO: 4696056 - DNA, 23 bp, Homo sapiens
ctgggttggcgcaccctcccctc

SEQ ID NO: 4696057 - DNA, 18 bp, Homo sapiens
ctgggtttaaggggagag

SEQ ID NO: 4696058 - DNA, 16 bp, Homo sapiens
ctgggtttacaacaaa

SEQ ID NO: 4696059 - DNA, 22 bp, Homo sapiens
ctgggtttacaacaaacactgt

SEQ ID NO: 4696060 - DNA, 23 bp, Homo sapiens
ctgggtttacaacaaacactgtg

SEQ ID NO: 4696061 - DNA, 22 bp, Homo sapiens
ctgggttttgtattctctgagc

SEQ ID NO: 4696062 - DNA, 14 bp, Homo sapiens
ctggtaaaatacat

SEQ ID NO: 4696063 - DNA, 15 bp, Homo sapiens
ctggtccatagagag

SEQ ID NO: 4696064 - DNA, 14 bp, Homo sapiens
ctggtcccactcag

SEQ ID NO: 4696065 - DNA, 15 bp, Homo sapiens
ctggtctaatgtttg

SEQ ID NO: 4696066 - DNA, 23 bp, Homo sapiens
ctggtctcaaactcttgacctca

SEQ ID NO: 4696067 - DNA, 13 bp, Homo sapiens
ctggtctccccca

SEQ ID NO: 4696068 - DNA, 14 bp, Homo sapiens
ctggtctcccccag

SEQ ID NO: 4696069 - DNA, 16 bp, Homo sapiens
ctggtctcgaactcct

SEQ ID NO: 4696070 - DNA, 16 bp, Homo sapiens
ctggtctctaggctgg

SEQ ID NO: 4696071 - DNA, 20 bp, Homo sapiens
ctggtctctaggctggggaa

SEQ ID NO: 4696072 - DNA, 23 bp, Homo sapiens
ctggtgaccccttttcagcttct

SEQ ID NO: 4696073 - DNA, 19 bp, Homo sapiens
ctggtgctgcctctacctg

SEQ ID NO: 4696074 - DNA, 16 bp, Homo sapiens
ctggtggatggtgact

SEQ ID NO: 4696075 - DNA, 18 bp, Homo sapiens
ctggtggatggtgacttt

SEQ ID NO: 4696076 - DNA, 16 bp, Homo sapiens
ctggtggcagctcacc

SEQ ID NO: 4696077 - DNA, 18 bp, Homo sapiens
ctggtggcagctcacctc

SEQ ID NO: 4696078 - DNA, 13 bp, Homo sapiens
ctggtggcagctg

SEQ ID NO: 4696079 - DNA, 23 bp, Homo sapiens
ctggtggcagtgggagctgcctg

SEQ ID NO: 4696080 - DNA, 16 bp, Homo sapiens
ctggtggttatttaac

SEQ ID NO: 4696081 - DNA, 15 bp, Homo sapiens
ctggtgtaggaagtt

SEQ ID NO: 4696082 - DNA, 17 bp, Homo sapiens
ctggttggagagctaga

SEQ ID NO: 4696083 - DNA, 16 bp, Homo sapiens
ctggtttcctgccctg

SEQ ID NO: 4696084 - DNA, 18 bp, Homo sapiens
ctggtttcctgccctggg

SEQ ID NO: 4696085 - DNA, 17 bp, Homo sapiens
ctgtaaaataaaaggtc

SEQ ID NO: 4696086 - DNA, 22 bp, Homo sapiens
ctgtaaacccctttagtggctt

SEQ ID NO: 4696087 - DNA, 21 bp, Homo sapiens
ctgtaaagtctgagtaagaaa

SEQ ID NO: 4696088 - DNA, 21 bp, Homo sapiens
ctgtaaatgaacacatggcag

SEQ ID NO: 4696089 - DNA, 22 bp, Homo sapiens
ctgtaaatgaacacatggcaga

SEQ ID NO: 4696090 - DNA, 22 bp, Homo sapiens
ctgtaaatgaagggtcatttct

SEQ ID NO: 4696091 - DNA, 15 bp, Homo sapiens
ctgtaacattcagga

SEQ ID NO: 4696092 - DNA, 23 bp, Homo sapiens
ctgtaacctcttcagaggccctc

SEQ ID NO: 4696093 - DNA, 16 bp, Homo sapiens
ctgtaacttccaaata

SEQ ID NO: 4696094 - DNA, 19 bp, Homo sapiens
ctgtaacttccaaataaat

SEQ ID NO: 4696095 - DNA, 12 bp, Homo sapiens
ctgtaataatag

SEQ ID NO: 4696096 - DNA, 13 bp, Homo sapiens
ctgtaatatcttt

SEQ ID NO: 4696097 - DNA, 20 bp, Homo sapiens
ctgtaatgaaccgctgaata

SEQ ID NO: 4696098 - DNA, 15 bp, Homo sapiens
ctgtacagagcccac

SEQ ID NO: 4696099 - DNA, 23 bp, Homo sapiens
ctgtacagagcccacgcccccac

SEQ ID NO: 4696100 - DNA, 21 bp, Homo sapiens
ctgtaccaaatctgacatatt

SEQ ID NO: 4696101 - DNA, 19 bp, Homo sapiens
ctgtacgtctgacaggcaa

SEQ ID NO: 4696102 - DNA, 22 bp, Homo sapiens
ctgtagggaaaaaaatgcttct

SEQ ID NO: 4696103 - DNA, 23 bp, Homo sapiens
ctgtagggaaaaaaatgcttctt

SEQ ID NO: 4696104 - DNA, 13 bp, Homo sapiens
ctgtagtgttttg

SEQ ID NO: 4696105 - DNA, 17 bp, Homo sapiens
ctgtagtgttttgtgga

SEQ ID NO: 4696106 - DNA, 20 bp, Homo sapiens
ctgtataaataggagaggat

SEQ ID NO: 4696107 - DNA, 21 bp, Homo sapiens
ctgtataaataggagaggatg

SEQ ID NO: 4696108 - DNA, 15 bp, Homo sapiens
ctgtatattttgtta

SEQ ID NO: 4696109 - DNA, 17 bp, Homo sapiens
ctgtatattttgttacc

SEQ ID NO: 4696110 - DNA, 14 bp, Homo sapiens
ctgtatccattcta

SEQ ID NO: 4696111 - DNA, 14 bp, Homo sapiens
ctgtatcccatgag

SEQ ID NO: 4696112 - DNA, 15 bp, Homo sapiens
ctgtatcccatgagc

SEQ ID NO: 4696113 - DNA, 23 bp, Homo sapiens
ctgtatcccatgagcctcagcat

SEQ ID NO: 4696114 - DNA, 15 bp, Homo sapiens
ctgtatggaaacact

SEQ ID NO: 4696115 - DNA, 15 bp, Homo sapiens
ctgtattaagccact

SEQ ID NO: 4696116 - DNA, 17 bp, Homo sapiens
ctgtattagtcacagag

SEQ ID NO: 4696117 - DNA, 18 bp, Homo sapiens
ctgtatttttaaagcatg

SEQ ID NO: 4696118 - DNA, 21 bp, Homo sapiens
ctgtcacttgctggctgtgaa

SEQ ID NO: 4696119 - DNA, 12 bp, Homo sapiens
aaaaaaaacagt

SEQ ID NO: 4696120 - DNA, 12 bp, Homo sapiens
aaaaaaactatt

SEQ ID NO: 4696121 - DNA, 11 bp, Homo sapiens
aaaaaaattta

SEQ ID NO: 4696122 - DNA, 16 bp, Homo sapiens
aaaaaatgtatatgca

SEQ ID NO: 4696123 - DNA, 14 bp, Homo sapiens
aaaaacacaaaagt

SEQ ID NO: 4696124 - DNA, 23 bp, Homo sapiens
aaaaacactacttttgctttttt

SEQ ID NO: 4696125 - DNA, 17 bp, Homo sapiens
aaaaacagaaaaataag

SEQ ID NO: 4696126 - DNA, 15 bp, Homo sapiens
aaaaagactgttatt

SEQ ID NO: 4696127 - DNA, 22 bp, Homo sapiens
aaaaagttgtaatttgaataag

SEQ ID NO: 4696128 - DNA, 18 bp, Homo sapiens
aaaaatgcctttgagaca

SEQ ID NO: 4696129 - DNA, 19 bp, Homo sapiens
aaaaatgcctttgagacag

SEQ ID NO: 4696130 - DNA, 21 bp, Homo sapiens
aaaaatgcctttgagacagtt

SEQ ID NO: 4696131 - DNA, 22 bp, Homo sapiens
aaaaatgcctttgagacagttt

SEQ ID NO: 4696132 - DNA, 15 bp, Homo sapiens
aaaaatggtgcctga

SEQ ID NO: 4696133 - DNA, 12 bp, Homo sapiens
aaaaatgtagga

SEQ ID NO: 4696134 - DNA, 12 bp, Homo sapiens
aaaaattaactg

SEQ ID NO: 4696135 - DNA, 14 bp, Homo sapiens
aaaaattatcagtt

SEQ ID NO: 4696136 - DNA, 15 bp, Homo sapiens
aaaacaaactaaatg

SEQ ID NO: 4696137 - DNA, 13 bp, Homo sapiens
aaaacactgtgca

SEQ ID NO: 4696138 - DNA, 19 bp, Homo sapiens
aaaacactgttctctgccc

SEQ ID NO: 4696139 - DNA, 15 bp, Homo sapiens
aaaacaggcaaattc

SEQ ID NO: 4696140 - DNA, 23 bp, Homo sapiens
aaaacaggcactgccctggtggc

SEQ ID NO: 4696141 - DNA, 15 bp, Homo sapiens
aaaacatcctgactt

SEQ ID NO: 4696142 - DNA, 15 bp, Homo sapiens
aaaacatgagttatt

SEQ ID NO: 4696143 - DNA, 14 bp, Homo sapiens
aaaaccagcctcat

SEQ ID NO: 4696144 - DNA, 14 bp, Homo sapiens
aaaaccttttgaaa

SEQ ID NO: 4696145 - DNA, 17 bp, Homo sapiens
aaaactaaaatcattgt

SEQ ID NO: 4696146 - DNA, 19 bp, Homo sapiens
aaaagaaaatatacatttg

SEQ ID NO: 4696147 - DNA, 22 bp, Homo sapiens
aaaagaaatttagagtcaattt

SEQ ID NO: 4696148 - DNA, 12 bp, Homo sapiens
aaaagaacttcc

SEQ ID NO: 4696149 - DNA, 13 bp, Homo sapiens
aaaagactcatcc

SEQ ID NO: 4696150 - DNA, 23 bp, Homo sapiens
aaaagcctttcataccagtcagt

SEQ ID NO: 4696151 - DNA, 13 bp, Homo sapiens
aaaagctgtgtct

SEQ ID NO: 4696152 - DNA, 22 bp, Homo sapiens
aaaagggaaagttttgttctgt

SEQ ID NO: 4696153 - DNA, 18 bp, Homo sapiens
aaaagggaactgaacatt

SEQ ID NO: 4696154 - DNA, 18 bp, Homo sapiens
aaaagggcagccctcctt

SEQ ID NO: 4696155 - DNA, 15 bp, Homo sapiens
aaaagtagtaaattt

SEQ ID NO: 4696156 - DNA, 21 bp, Homo sapiens
aaaagtagtaaattttgtgat

SEQ ID NO: 4696157 - DNA, 13 bp, Homo sapiens
aaaagtcataaat

SEQ ID NO: 4696158 - DNA, 23 bp, Homo sapiens
aaaagtttgtcctttaactatca

SEQ ID NO: 4696159 - DNA, 19 bp, Homo sapiens
aaaataaaattaaagctga

SEQ ID NO: 4696160 - DNA, 13 bp, Homo sapiens
aaaataaagaatg

SEQ ID NO: 4696161 - DNA, 15 bp, Homo sapiens
aaaataaagtgtgtg

SEQ ID NO: 4696162 - DNA, 12 bp, Homo sapiens
aaaataattatc

SEQ ID NO: 4696163 - DNA, 19 bp, Homo sapiens
aaaatacatataaagatta

SEQ ID NO: 4696164 - DNA, 10 bp, Homo sapiens
aaaatataac

SEQ ID NO: 4696165 - DNA, 13 bp, Homo sapiens
aaaatatcccttt

SEQ ID NO: 4696166 - DNA, 18 bp, Homo sapiens
aaaatatccctttttcac

SEQ ID NO: 4696167 - DNA, 12 bp, Homo sapiens
aaaatatctctt

SEQ ID NO: 4696168 - DNA, 14 bp, Homo sapiens
aaaatatcttttga

SEQ ID NO: 4696169 - DNA, 17 bp, Homo sapiens
aaaatatcttttgacct

SEQ ID NO: 4696170 - DNA, 13 bp, Homo sapiens
aaaatattttaga

SEQ ID NO: 4696171 - DNA, 16 bp, Homo sapiens
aaaatccaatattgta

SEQ ID NO: 4696172 - DNA, 18 bp, Homo sapiens
aaaatcctgaataaacca

SEQ ID NO: 4696173 - DNA, 16 bp, Homo sapiens
aaaatctgtggtggtc

SEQ ID NO: 4696174 - DNA, 23 bp, Homo sapiens
aaaatctgttgttccaaatgtgt

SEQ ID NO: 4696175 - DNA, 14 bp, Homo sapiens
aaaatgaaagctac

SEQ ID NO: 4696176 - DNA, 15 bp, Homo sapiens
aaaatgaatttggga

SEQ ID NO: 4696177 - DNA, 11 bp, Homo sapiens
aaaatgccttt

SEQ ID NO: 4696178 - DNA, 23 bp, Homo sapiens
aaaatgcctttgagacagtttct

SEQ ID NO: 4696179 - DNA, 23 bp, Homo sapiens
aaaatgctgtattagtcacagag

SEQ ID NO: 4696180 - DNA, 17 bp, Homo sapiens
aaaatgctgttaatgta

SEQ ID NO: 4696181 - DNA, 19 bp, Homo sapiens
aaaatgcttctttctactt

SEQ ID NO: 4696182 - DNA, 14 bp, Homo sapiens
aaaatgtatatgca

SEQ ID NO: 4696183 - DNA, 17 bp, Homo sapiens
aaaatgtatatgcactt

SEQ ID NO: 4696184 - DNA, 19 bp, Homo sapiens
aaaatgtgaaaaaaattat

SEQ ID NO: 4696185 - DNA, 21 bp, Homo sapiens
aaaatgtgtctgcaacatgga

SEQ ID NO: 4696186 - DNA, 22 bp, Homo sapiens
aaaatgtgtctgcaacatggat

SEQ ID NO: 4696187 - DNA, 11 bp, Homo sapiens
aaaatgttcta

SEQ ID NO: 4696188 - DNA, 18 bp, Homo sapiens
aaaattcactattggctg

SEQ ID NO: 4696189 - DNA, 16 bp, Homo sapiens
aaaattgccattttat

SEQ ID NO: 4696190 - DNA, 17 bp, Homo sapiens
aaaattgccattttatt

SEQ ID NO: 4696191 - DNA, 13 bp, Homo sapiens
aaaattgttattt

SEQ ID NO: 4696192 - DNA, 12 bp, Homo sapiens
aaaattgtttca

SEQ ID NO: 4696193 - DNA, 18 bp, Homo sapiens
aaaatttaatttctgaaa

SEQ ID NO: 4696194 - DNA, 15 bp, Homo sapiens
aaaatttgaagtatt

SEQ ID NO: 4696195 - DNA, 14 bp, Homo sapiens
aaacaaaatttcta

SEQ ID NO: 4696196 - DNA, 15 bp, Homo sapiens
aaacaaaatttctat

SEQ ID NO: 4696197 - DNA, 22 bp, Homo sapiens
aaacaacaatttctactttgaa

SEQ ID NO: 4696198 - DNA, 18 bp, Homo sapiens
aaacactgttctctgccc

SEQ ID NO: 4696199 - DNA, 17 bp, Homo sapiens
aaacagctaatgggaca

SEQ ID NO: 4696200 - DNA, 19 bp, Homo sapiens
aaacagctggacttattta

SEQ ID NO: 4696201 - DNA, 16 bp, Homo sapiens
aaacaggcactgccct

SEQ ID NO: 4696202 - DNA, 13 bp, Homo sapiens
aaacagtgtttat

SEQ ID NO: 4696203 - DNA, 14 bp, Homo sapiens
aaacataataaatc

SEQ ID NO: 4696204 - DNA, 17 bp, Homo sapiens
aaacataccaacatgtt

SEQ ID NO: 4696205 - DNA, 16 bp, Homo sapiens
aaacatattttacatc

SEQ ID NO: 4696206 - DNA, 16 bp, Homo sapiens
aaacatgaaaacattg

SEQ ID NO: 4696207 - DNA, 21 bp, Homo sapiens
aaacatgagttattcataaag

SEQ ID NO: 4696208 - DNA, 15 bp, Homo sapiens
aaacatggaaaacag

SEQ ID NO: 4696209 - DNA, 19 bp, Homo sapiens
aaacatgttagtcaaggac

SEQ ID NO: 4696210 - DNA, 10 bp, Homo sapiens
aaaccacttt

SEQ ID NO: 4696211 - DNA, 13 bp, Homo sapiens
aaaccatgtagaa

SEQ ID NO: 4696212 - DNA, 12 bp, Homo sapiens
aaacccagctct

SEQ ID NO: 4696213 - DNA, 20 bp, Homo sapiens
aacatatcatttgtgaagaa

SEQ ID NO: 4696214 - DNA, 15 bp, Homo sapiens
aacatatttaagaaa

SEQ ID NO: 4696215 - DNA, 16 bp, Homo sapiens
aacatatttaaggaac

SEQ ID NO: 4696216 - DNA, 13 bp, Homo sapiens
aacatattttaca

SEQ ID NO: 4696217 - DNA, 22 bp, Homo sapiens
aacatcctacaagacacagtga

SEQ ID NO: 4696218 - DNA, 16 bp, Homo sapiens
aacatcctgaaaattc

SEQ ID NO: 4696219 - DNA, 12 bp, Homo sapiens
aacatgaaaaca

SEQ ID NO: 4696220 - DNA, 15 bp, Homo sapiens
aacatgaaaacattg

SEQ ID NO: 4696221 - DNA, 13 bp, Homo sapiens
aacatgcagctct

SEQ ID NO: 4696222 - DNA, 18 bp, Homo sapiens
aacatgcagctctgcagc

SEQ ID NO: 4696223 - DNA, 17 bp, Homo sapiens
aacatggattccaaagc

SEQ ID NO: 4696224 - DNA, 20 bp, Homo sapiens
aacatggattccaaagcatt

SEQ ID NO: 4696225 - DNA, 20 bp, Homo sapiens
aacatggtgtgtgtctctga

SEQ ID NO: 4696226 - DNA, 21 bp, Homo sapiens
aacatggtgtgtgtctctgac

SEQ ID NO: 4696227 - DNA, 12 bp, Homo sapiens
aacatgtatgtg

SEQ ID NO: 4696228 - DNA, 19 bp, Homo sapiens
aacattaaggcagtatgat

SEQ ID NO: 4696229 - DNA, 15 bp, Homo sapiens
aacattgatgaatga

SEQ ID NO: 4696230 - DNA, 14 bp, Homo sapiens
aacattgcaataga

SEQ ID NO: 4696231 - DNA, 17 bp, Homo sapiens
aacattgcaatagaaat

SEQ ID NO: 4696232 - DNA, 20 bp, Homo sapiens
aacatttaggagaagttggt

SEQ ID NO: 4696233 - DNA, 22 bp, Homo sapiens
aacattttcatgcacagtagat

SEQ ID NO: 4696234 - DNA, 15 bp, Homo sapiens
aaccaaccatttcta

SEQ ID NO: 4696235 - DNA, 13 bp, Homo sapiens
aaccaacccatgt

SEQ ID NO: 4696236 - DNA, 14 bp, Homo sapiens
aaccaagaagggct

SEQ ID NO: 4696237 - DNA, 14 bp, Homo sapiens
aaccaagcctctgg

SEQ ID NO: 4696238 - DNA, 16 bp, Homo sapiens
aaccaagcctctggaa

SEQ ID NO: 4696239 - DNA, 13 bp, Homo sapiens
aaccaatcctgga

SEQ ID NO: 4696240 - DNA, 14 bp, Homo sapiens
aaccacagctgctg

SEQ ID NO: 4696241 - DNA, 16 bp, Homo sapiens
aaccacagctgctgga

SEQ ID NO: 4696242 - DNA, 14 bp, Homo sapiens
aaccacattgaaga

SEQ ID NO: 4696243 - DNA, 22 bp, Homo sapiens
aaccacattgaagaatgttaga

SEQ ID NO: 4696244 - DNA, 21 bp, Homo sapiens
aaccaccaacagagaaaagca

SEQ ID NO: 4696245 - DNA, 13 bp, Homo sapiens
aaccacgctggac

SEQ ID NO: 4696246 - DNA, 22 bp, Homo sapiens
aaccactggaaagtttatggtt

SEQ ID NO: 4696247 - DNA, 21 bp, Homo sapiens
aaccagcctcatgctctgatt

SEQ ID NO: 4696248 - DNA, 11 bp, Homo sapiens
aaccatggcac

SEQ ID NO: 4696249 - DNA, 14 bp, Homo sapiens
aaccatttctagag

SEQ ID NO: 4696250 - DNA, 13 bp, Homo sapiens
aacccagatttta

SEQ ID NO: 4696251 - DNA, 15 bp, Homo sapiens
aacccagttgccatc

SEQ ID NO: 4696252 - DNA, 15 bp, Homo sapiens
aacccccagcctgct

SEQ ID NO: 4696253 - DNA, 14 bp, Homo sapiens
aaccccccagcact

SEQ ID NO: 4696254 - DNA, 14 bp, Homo sapiens
aacccgggaggcag

SEQ ID NO: 4696255 - DNA, 21 bp, Homo sapiens
aaccctctcaggtgaccaaaa

SEQ ID NO: 4696256 - DNA, 12 bp, Homo sapiens
aaccctctgtga

SEQ ID NO: 4696257 - DNA, 17 bp, Homo sapiens
aaccgaacatatcattt

SEQ ID NO: 4696258 - DNA, 22 bp, Homo sapiens
aaccgaacatatcatttgtgaa

SEQ ID NO: 4696259 - DNA, 12 bp, Homo sapiens
aacctagcccct

SEQ ID NO: 4696260 - DNA, 17 bp, Homo sapiens
aacctccgcctcttggg

SEQ ID NO: 4696261 - DNA, 13 bp, Homo sapiens
aacctcctttctc

SEQ ID NO: 4696262 - DNA, 21 bp, Homo sapiens
aacctcgaggtttctcaaaga

SEQ ID NO: 4696263 - DNA, 14 bp, Homo sapiens
aacctcgctggact

SEQ ID NO: 4696264 - DNA, 19 bp, Homo sapiens
aacctctaatttattttgt

SEQ ID NO: 4696265 - DNA, 20 bp, Homo sapiens
aacctgatgaaaataaagaa

SEQ ID NO: 4696266 - DNA, 18 bp, Homo sapiens
aacctgattgtgtctctt

SEQ ID NO: 4696267 - DNA, 10 bp, Homo sapiens
aacctggagg

SEQ ID NO: 4696268 - DNA, 20 bp, Homo sapiens
aacctggaggggctagaacc

SEQ ID NO: 4696269 - DNA, 23 bp, Homo sapiens
aaccttagatgttctaagtcttt

SEQ ID NO: 4696270 - DNA, 17 bp, Homo sapiens
aaccttttttaagattt

SEQ ID NO: 4696271 - DNA, 21 bp, Homo sapiens
aaccttttttaagatttttct

SEQ ID NO: 4696272 - DNA, 23 bp, Homo sapiens
aaccttttttaagatttttctca

SEQ ID NO: 4696273 - DNA, 16 bp, Homo sapiens
aacgaaatatcaaagt

SEQ ID NO: 4696274 - DNA, 12 bp, Homo sapiens
aacgtgaaaatg

SEQ ID NO: 4696275 - DNA, 17 bp, Homo sapiens
aacgtttttcctgttct

SEQ ID NO: 4696276 - DNA, 15 bp, Homo sapiens
aactaaaatgttcta

SEQ ID NO: 4696277 - DNA, 21 bp, Homo sapiens
aactaaggaaccctggaaact

SEQ ID NO: 4696278 - DNA, 11 bp, Homo sapiens
aactaatttct

SEQ ID NO: 4696279 - DNA, 15 bp, Homo sapiens
aactacaaacaaaat

SEQ ID NO: 4696280 - DNA, 21 bp, Homo sapiens
aactacgtgacctctgcaaga

SEQ ID NO: 4696281 - DNA, 14 bp, Homo sapiens
aactactaattttt

SEQ ID NO: 4696282 - DNA, 17 bp, Homo sapiens
aactagaactgaatttt

SEQ ID NO: 4696283 - DNA, 21 bp, Homo sapiens
aactagaattgttgcatccct

SEQ ID NO: 4696284 - DNA, 17 bp, Homo sapiens
aactagggctagtcttc

SEQ ID NO: 4696285 - DNA, 13 bp, Homo sapiens
aactatgacagat

SEQ ID NO: 4696286 - DNA, 19 bp, Homo sapiens
aactatgacagatatattt

SEQ ID NO: 4696287 - DNA, 24 bp, Homo sapiens
aactattgtgctcagagacactgt

SEQ ID NO: 4696288 - DNA, 13 bp, Homo sapiens
aactcaatatttt

SEQ ID NO: 4696289 - DNA, 18 bp, Homo sapiens
aactcaccccagccccaa

SEQ ID NO: 4696290 - DNA, 15 bp, Homo sapiens
aactcacctggggct

SEQ ID NO: 4696291 - DNA, 15 bp, Homo sapiens
aactcaggcaaagaa

SEQ ID NO: 4696292 - DNA, 22 bp, Homo sapiens
aactcatactgtgctggagcca

SEQ ID NO: 4696293 - DNA, 22 bp, Homo sapiens
aactcctactgcttcctctgaa

SEQ ID NO: 4696294 - DNA, 12 bp, Homo sapiens
aactcctggcct

SEQ ID NO: 4696295 - DNA, 22 bp, Homo sapiens
aactctcctctgctgctggctg

SEQ ID NO: 4696296 - DNA, 17 bp, Homo sapiens
aactgaaatgagcatgc

SEQ ID NO: 4696297 - DNA, 14 bp, Homo sapiens
aactgaagatattc

SEQ ID NO: 4696298 - DNA, 15 bp, Homo sapiens
aactgaattttgtct

SEQ ID NO: 4696299 - DNA, 21 bp, Homo sapiens
aactgatccagtataagacta

SEQ ID NO: 4696300 - DNA, 23 bp, Homo sapiens
aactgcacaataaaaccaagcct

SEQ ID NO: 4696301 - DNA, 23 bp, Homo sapiens
aactgcagggaaaattatttgca

SEQ ID NO: 4696302 - DNA, 19 bp, Homo sapiens
aactgccccctctgccctg

SEQ ID NO: 4696303 - DNA, 21 bp, Homo sapiens
aactgccccctctgccctgcg

SEQ ID NO: 4696304 - DNA, 14 bp, Homo sapiens
aactgtaaagatgt

SEQ ID NO: 4696305 - DNA, 21 bp, Homo sapiens
aactgtgaatgcttctgattt

SEQ ID NO: 4696306 - DNA, 20 bp, Homo sapiens
aactgtgggattctgatttg

SEQ ID NO: 4696307 - DNA, 21 bp, Homo sapiens
aactgtgggattctgatttgt

SEQ ID NO: 4696308 - DNA, 23 bp, Homo sapiens
aacttattatcactttggggttc

SEQ ID NO: 4696309 - DNA, 17 bp, Homo sapiens
aacttcagtactcaaat

SEQ ID NO: 4696310 - DNA, 23 bp, Homo sapiens
aacttccccatacaaataagcat

SEQ ID NO: 4696311 - DNA, 15 bp, Homo sapiens
aacttcctgcaggta

SEQ ID NO: 4696312 - DNA, 23 bp, Homo sapiens
aacttcctgcaggtaaacagttc

SEQ ID NO: 4696313 - DNA, 12 bp, Homo sapiens
aacttgggaact

SEQ ID NO: 4696314 - DNA, 15 bp, Homo sapiens
aacttgtaaatgtgg

SEQ ID NO: 4696315 - DNA, 22 bp, Homo sapiens
aacttgtctttggaccctgagg

SEQ ID NO: 4696316 - DNA, 23 bp, Homo sapiens
aacttgtgaactccatcattcat

SEQ ID NO: 4696317 - DNA, 23 bp, Homo sapiens
aactttaacaggttttcttctaa

SEQ ID NO: 4696318 - DNA, 21 bp, Homo sapiens
aactttaagaactaaaatgtt

SEQ ID NO: 4696319 - DNA, 17 bp, Homo sapiens
aactttcaatatcttta

SEQ ID NO: 4696320 - DNA, 17 bp, Homo sapiens
aactttcatttttttcc

SEQ ID NO: 4696321 - DNA, 20 bp, Homo sapiens
aacttttcttttggactttt

SEQ ID NO: 4696322 - DNA, 16 bp, Homo sapiens
aagaaaagttttgtaa

SEQ ID NO: 4696323 - DNA, 19 bp, Homo sapiens
aagtgatcctcccacctca

SEQ ID NO: 4696324 - DNA, 17 bp, Homo sapiens
aagtgattctcatgcct

SEQ ID NO: 4696325 - DNA, 17 bp, Homo sapiens
aagtgattctcctgcct

SEQ ID NO: 4696326 - DNA, 19 bp, Homo sapiens
aagtgattctcctgcctca

SEQ ID NO: 4696327 - DNA, 17 bp, Homo sapiens
aagtgcgtgtgtagagt

SEQ ID NO: 4696328 - DNA, 21 bp, Homo sapiens
aagtgcgtgtgtagagttaag

SEQ ID NO: 4696329 - DNA, 12 bp, Homo sapiens
aagtgctgggat

SEQ ID NO: 4696330 - DNA, 16 bp, Homo sapiens
aagtggctctggggtc

SEQ ID NO: 4696331 - DNA, 18 bp, Homo sapiens
aagtggggaccccacccc

SEQ ID NO: 4696332 - DNA, 17 bp, Homo sapiens
aagtgggtttcaattta

SEQ ID NO: 4696333 - DNA, 17 bp, Homo sapiens
aagtggtatagaaatgc

SEQ ID NO: 4696334 - DNA, 15 bp, Homo sapiens
aagtgtaagtttgtg

SEQ ID NO: 4696335 - DNA, 14 bp, Homo sapiens
aagtgttcattgtt

SEQ ID NO: 4696336 - DNA, 19 bp, Homo sapiens
aagtgtttttgtgcagctg

SEQ ID NO: 4696337 - DNA, 13 bp, Homo sapiens
aagttaaaattgt

SEQ ID NO: 4696338 - DNA, 23 bp, Homo sapiens
aagttaagaatgttcttatgttg

SEQ ID NO: 4696339 - DNA, 13 bp, Homo sapiens
aagttatctttga

SEQ ID NO: 4696340 - DNA, 22 bp, Homo sapiens
aagttatctttgaatatgtagt

SEQ ID NO: 4696341 - DNA, 21 bp, Homo sapiens
aagttcaccagactctataaa

SEQ ID NO: 4696342 - DNA, 11 bp, Homo sapiens
aagttcacttt

SEQ ID NO: 4696343 - DNA, 17 bp, Homo sapiens
aagttccagttttgttt

SEQ ID NO: 4696344 - DNA, 15 bp, Homo sapiens
aagttcttagttgct

SEQ ID NO: 4696345 - DNA, 20 bp, Homo sapiens
aagttgatatagaacagtgc

SEQ ID NO: 4696346 - DNA, 21 bp, Homo sapiens
aagttgattcatattgcatca

SEQ ID NO: 4696347 - DNA, 21 bp, Homo sapiens
aagttgcctttatttgctgtt

SEQ ID NO: 4696348 - DNA, 23 bp, Homo sapiens
aagttgtgtctgaaaatatctct

SEQ ID NO: 4696349 - DNA, 15 bp, Homo sapiens
aagttgttaataaaa

SEQ ID NO: 4696350 - DNA, 16 bp, Homo sapiens
aagtttcaggtgacat

SEQ ID NO: 4696351 - DNA, 22 bp, Homo sapiens
aagtttcaggtgacatgtgaaa

SEQ ID NO: 4696352 - DNA, 23 bp, Homo sapiens
aagtttcattctccctttcacta

SEQ ID NO: 4696353 - DNA, 16 bp, Homo sapiens
aagtttccttggctgg

SEQ ID NO: 4696354 - DNA, 18 bp, Homo sapiens
aagtttccttggctggtg

SEQ ID NO: 4696355 - DNA, 12 bp, Homo sapiens
aagttttgaaaa

SEQ ID NO: 4696356 - DNA, 15 bp, Homo sapiens
aagttttgaaaagct

SEQ ID NO: 4696357 - DNA, 16 bp, Homo sapiens
aagttttgaaaagcta

SEQ ID NO: 4696358 - DNA, 18 bp, Homo sapiens
aagttttgaaaagctatt

SEQ ID NO: 4696359 - DNA, 14 bp, Homo sapiens
aagttttgttctgt

SEQ ID NO: 4696360 - DNA, 17 bp, Homo sapiens
aagttttgttctgtata

SEQ ID NO: 4696361 - DNA, 18 bp, Homo sapiens
aagttttgttctgtatat

SEQ ID NO: 4696362 - DNA, 13 bp, Homo sapiens
aagttttgttctt

SEQ ID NO: 4696363 - DNA, 14 bp, Homo sapiens
aagttttgttcttt

SEQ ID NO: 4696364 - DNA, 16 bp, Homo sapiens
aataaaaagaaagatt

SEQ ID NO: 4696365 - DNA, 12 bp, Homo sapiens
aataaaaataat

SEQ ID NO: 4696366 - DNA, 15 bp, Homo sapiens
aataaaaatatattt

SEQ ID NO: 4696367 - DNA, 16 bp, Homo sapiens
aataaaataattctaa

SEQ ID NO: 4696368 - DNA, 15 bp, Homo sapiens
aataaaccttgtttc

SEQ ID NO: 4696369 - DNA, 12 bp, Homo sapiens
aataaagaatgg

SEQ ID NO: 4696370 - DNA, 17 bp, Homo sapiens
aataaagaatggaaagc

SEQ ID NO: 4696371 - DNA, 13 bp, Homo sapiens
aataaagtgacaa

SEQ ID NO: 4696372 - DNA, 19 bp, Homo sapiens
aataaagtgacaaaagctc

SEQ ID NO: 4696373 - DNA, 13 bp, Homo sapiens
aataaagtgtgtg

SEQ ID NO: 4696374 - DNA, 14 bp, Homo sapiens
aataaagtgtgtgt

SEQ ID NO: 4696375 - DNA, 21 bp, Homo sapiens
aataaatatagttgtctttct

SEQ ID NO: 4696376 - DNA, 14 bp, Homo sapiens
aataaatcacacat

SEQ ID NO: 4696377 - DNA, 14 bp, Homo sapiens
aataaattgatttg

SEQ ID NO: 4696378 - DNA, 22 bp, Homo sapiens
aataaattttttataaaagtgt

SEQ ID NO: 4696379 - DNA, 14 bp, Homo sapiens
aataacaatgttaa

SEQ ID NO: 4696380 - DNA, 15 bp, Homo sapiens
aataacacacagcta

SEQ ID NO: 4696381 - DNA, 22 bp, Homo sapiens
aataagaaacaactctttgaga

SEQ ID NO: 4696382 - DNA, 14 bp, Homo sapiens
aataagattatatg

SEQ ID NO: 4696383 - DNA, 14 bp, Homo sapiens
aataatagactgta

SEQ ID NO: 4696384 - DNA, 20 bp, Homo sapiens
aataatgggcttagagcagt

SEQ ID NO: 4696385 - DNA, 21 bp, Homo sapiens
aataattttattagaataatt

SEQ ID NO: 4696386 - DNA, 18 bp, Homo sapiens
aataattttcattttgca

SEQ ID NO: 4696387 - DNA, 21 bp, Homo sapiens
aatacagtcttccatttgcaa

SEQ ID NO: 4696388 - DNA, 17 bp, Homo sapiens
aatacatataaagatta

SEQ ID NO: 4696389 - DNA, 17 bp, Homo sapiens
aatacatgacatttatt

SEQ ID NO: 4696390 - DNA, 12 bp, Homo sapiens
aatacctgctca

SEQ ID NO: 4696391 - DNA, 15 bp, Homo sapiens
aatacctgtccccct

SEQ ID NO: 4696392 - DNA, 14 bp, Homo sapiens
aatactggactcag

SEQ ID NO: 4696393 - DNA, 19 bp, Homo sapiens
aatactggactcaggaact

SEQ ID NO: 4696394 - DNA, 11 bp, Homo sapiens
aatactggtct

SEQ ID NO: 4696395 - DNA, 13 bp, Homo sapiens
aatactggtctca

SEQ ID NO: 4696396 - DNA, 20 bp, Homo sapiens
aatactttgtttattgtaaa

SEQ ID NO: 4696397 - DNA, 17 bp, Homo sapiens
aatagaaatggggaact

SEQ ID NO: 4696398 - DNA, 13 bp, Homo sapiens
aatagaacacagt

SEQ ID NO: 4696399 - DNA, 14 bp, Homo sapiens
aatagaaggtgatg

SEQ ID NO: 4696400 - DNA, 22 bp, Homo sapiens
aatagattttaagcttcattat

SEQ ID NO: 4696401 - DNA, 13 bp, Homo sapiens
aataggagaggat

SEQ ID NO: 4696402 - DNA, 18 bp, Homo sapiens
aataggcgtaactaattt

SEQ ID NO: 4696403 - DNA, 14 bp, Homo sapiens
aatagtatatctaa

SEQ ID NO: 4696404 - DNA, 22 bp, Homo sapiens
aatagtctctgggtttacaaca

SEQ ID NO: 4696405 - DNA, 13 bp, Homo sapiens
aatagttggctag

SEQ ID NO: 4696406 - DNA, 13 bp, Homo sapiens
aatataaacacta

SEQ ID NO: 4696407 - DNA, 19 bp, Homo sapiens
aatatacatttgttggtaa

SEQ ID NO: 4696408 - DNA, 20 bp, Homo sapiens
aatatagtaggggttgaaga

SEQ ID NO: 4696409 - DNA, 18 bp, Homo sapiens
aatatagttgtctttctt

SEQ ID NO: 4696410 - DNA, 21 bp, Homo sapiens
aatatagttgtctttctttgc

SEQ ID NO: 4696411 - DNA, 14 bp, Homo sapiens
aatatattttttga

SEQ ID NO: 4696412 - DNA, 14 bp, Homo sapiens
aatatcaaagtcat

SEQ ID NO: 4696413 - DNA, 21 bp, Homo sapiens
aatatcaaagtcattaaagac

SEQ ID NO: 4696414 - DNA, 19 bp, Homo sapiens
aatatcaagtactacattt

SEQ ID NO: 4696415 - DNA, 13 bp, Homo sapiens
aatatcatataaa

SEQ ID NO: 4696416 - DNA, 17 bp, Homo sapiens
aatatctcttgtgcttt

SEQ ID NO: 4696417 - DNA, 19 bp, Homo sapiens
aatatgattcactatttaa

SEQ ID NO: 4696418 - DNA, 20 bp, Homo sapiens
aatatggctagttttcaact

SEQ ID NO: 4696419 - DNA, 12 bp, Homo sapiens
aatatgtgaaga

SEQ ID NO: 4696420 - DNA, 23 bp, Homo sapiens
aatatgttggggtttttttaaga

SEQ ID NO: 4696421 - DNA, 14 bp, Homo sapiens
aatattcacatgtt

SEQ ID NO: 4696422 - DNA, 15 bp, Homo sapiens
aatattccctagaaa

SEQ ID NO: 4696423 - DNA, 17 bp, Homo sapiens
aatattctctgatgttt

SEQ ID NO: 4696424 - DNA, 18 bp, Homo sapiens
aatattctgataatgtat

SEQ ID NO: 4696425 - DNA, 19 bp, Homo sapiens
aatattggtaattaaaaga

SEQ ID NO: 4696426 - DNA, 20 bp, Homo sapiens
aatattggtaattaaaagac

SEQ ID NO: 4696427 - DNA, 17 bp, Homo sapiens
aatattgtaaatactgg

SEQ ID NO: 4696428 - DNA, 15 bp, Homo sapiens
aatattgtacagttt

SEQ ID NO: 4696429 - DNA, 22 bp, Homo sapiens
aatatttattgaattattttgt

SEQ ID NO: 4696430 - DNA, 16 bp, Homo sapiens
aatatttcttcaagtg

SEQ ID NO: 4696431 - DNA, 21 bp, Homo sapiens
aatattttaggtgtaaaataa

SEQ ID NO: 4696432 - DNA, 13 bp, Homo sapiens
aatcacaaaagct

SEQ ID NO: 4696433 - DNA, 22 bp, Homo sapiens
aatcacaaaagctgtgtctctg

SEQ ID NO: 4696434 - DNA, 15 bp, Homo sapiens
acaacagcctgagaa

SEQ ID NO: 4696435 - DNA, 16 bp, Homo sapiens
acaacagcctgagaaa

SEQ ID NO: 4696436 - DNA, 14 bp, Homo sapiens
acaacatgtatgtg

SEQ ID NO: 4696437 - DNA, 22 bp, Homo sapiens
acaactagcctcatctccagta

SEQ ID NO: 4696438 - DNA, 18 bp, Homo sapiens
acaactatgatttggaaa

SEQ ID NO: 4696439 - DNA, 20 bp, Homo sapiens
acaactcctagggccactga

SEQ ID NO: 4696440 - DNA, 14 bp, Homo sapiens
acaagaaccatttg

SEQ ID NO: 4696441 - DNA, 13 bp, Homo sapiens
acaagacacagtg

SEQ ID NO: 4696442 - DNA, 15 bp, Homo sapiens
acaagaccctctcag

SEQ ID NO: 4696443 - DNA, 19 bp, Homo sapiens
acaagacccttgtggtccc

SEQ ID NO: 4696444 - DNA, 18 bp, Homo sapiens
acaagcgtgagccactgc

SEQ ID NO: 4696445 - DNA, 20 bp, Homo sapiens
acaagcgtgagccactgcac

SEQ ID NO: 4696446 - DNA, 15 bp, Homo sapiens
acaagctccaagctc

SEQ ID NO: 4696447 - DNA, 16 bp, Homo sapiens
acaagcttcagtaagt

SEQ ID NO: 4696448 - DNA, 17 bp, Homo sapiens
acaaggaaggtggtggg

SEQ ID NO: 4696449 - DNA, 18 bp, Homo sapiens
acaaggactagggtcctg

SEQ ID NO: 4696450 - DNA, 19 bp, Homo sapiens
acaaggactagggtcctgg

SEQ ID NO: 4696451 - DNA, 20 bp, Homo sapiens
acaaggatgatctaggaaga

SEQ ID NO: 4696452 - DNA, 20 bp, Homo sapiens
acaaggtcaagagatagaga

SEQ ID NO: 4696453 - DNA, 19 bp, Homo sapiens
acaagtgggaaaacatggt

SEQ ID NO: 4696454 - DNA, 19 bp, Homo sapiens
acaataaaaccaagcctct

SEQ ID NO: 4696455 - DNA, 20 bp, Homo sapiens
acaataaaaccaagcctctg

SEQ ID NO: 4696456 - DNA, 18 bp, Homo sapiens
acaatagtaacctgggta

SEQ ID NO: 4696457 - DNA, 18 bp, Homo sapiens
acaatcagctccttcctg

SEQ ID NO: 4696458 - DNA, 18 bp, Homo sapiens
acaatccaaatgcattca

SEQ ID NO: 4696459 - DNA, 23 bp, Homo sapiens
acaatggaccggagagtgggggt

SEQ ID NO: 4696460 - DNA, 18 bp, Homo sapiens
acaatggcagaacaggtg

SEQ ID NO: 4696461 - DNA, 22 bp, Homo sapiens
acaatgtacaaggtatgtacag

SEQ ID NO: 4696462 - DNA, 11 bp, Homo sapiens
acaatgttaag

SEQ ID NO: 4696463 - DNA, 20 bp, Homo sapiens
acaatgttaaggaaactctt

SEQ ID NO: 4696464 - DNA, 20 bp, Homo sapiens
acaatgttgcactgaaaacc

SEQ ID NO: 4696465 - DNA, 22 bp, Homo sapiens
acaattaagttacaattacatc

SEQ ID NO: 4696466 - DNA, 20 bp, Homo sapiens
acaatttaaagcaaaggagt

SEQ ID NO: 4696467 - DNA, 15 bp, Homo sapiens
acacaaacctgcctg

SEQ ID NO: 4696468 - DNA, 18 bp, Homo sapiens
acacaaatttgggagggt

SEQ ID NO: 4696469 - DNA, 18 bp, Homo sapiens
acacaatggagtgtgtaa

SEQ ID NO: 4696470 - DNA, 23 bp, Homo sapiens
acacaatgggtatctaataaata

SEQ ID NO: 4696471 - DNA, 11 bp, Homo sapiens
acacacacata

SEQ ID NO: 4696472 - DNA, 22 bp, Homo sapiens
acacacacgcgtgcacacacca

SEQ ID NO: 4696473 - DNA, 20 bp, Homo sapiens
acacacagctaacacacagc

SEQ ID NO: 4696474 - DNA, 11 bp, Homo sapiens
acacacagctc

SEQ ID NO: 4696475 - DNA, 12 bp, Homo sapiens
acacacagctcc

SEQ ID NO: 4696476 - DNA, 22 bp, Homo sapiens
acacacagtgattccctcctcc

SEQ ID NO: 4696477 - DNA, 14 bp, Homo sapiens
acacaccagagccc

SEQ ID NO: 4696478 - DNA, 15 bp, Homo sapiens
acacaccagagccca

SEQ ID NO: 4696479 - DNA, 20 bp, Homo sapiens
acacaccagagcccaccttg

SEQ ID NO: 4696480 - DNA, 16 bp, Homo sapiens
acacaccccaacatgc

SEQ ID NO: 4696481 - DNA, 14 bp, Homo sapiens
acacagaaaccaat

SEQ ID NO: 4696482 - DNA, 14 bp, Homo sapiens
acacagaaatgtgt

SEQ ID NO: 4696483 - DNA, 21 bp, Homo sapiens
acacagacactaacgaaatat

SEQ ID NO: 4696484 - DNA, 14 bp, Homo sapiens
acacagatgaaaca

SEQ ID NO: 4696485 - DNA, 18 bp, Homo sapiens
acacagcattgtatatgt

SEQ ID NO: 4696486 - DNA, 20 bp, Homo sapiens
acacagcattgtatatgtga

SEQ ID NO: 4696487 - DNA, 14 bp, Homo sapiens
acacagctctgtcc

SEQ ID NO: 4696488 - DNA, 20 bp, Homo sapiens
acacagctctgtcctgggag

SEQ ID NO: 4696489 - DNA, 16 bp, Homo sapiens
acacagctcttctcca

SEQ ID NO: 4696490 - DNA, 18 bp, Homo sapiens
acacagctcttctccagg

SEQ ID NO: 4696491 - DNA, 19 bp, Homo sapiens
acacagctcttctccaggc

SEQ ID NO: 4696492 - DNA, 20 bp, Homo sapiens
acacagctcttctccaggct

SEQ ID NO: 4696493 - DNA, 20 bp, Homo sapiens
acacaggcccggctccaggc

SEQ ID NO: 4696494 - DNA, 22 bp, Homo sapiens
acacagtattacttctgctaca

SEQ ID NO: 4696495 - DNA, 13 bp, Homo sapiens
acacagtgagtcg

SEQ ID NO: 4696496 - DNA, 13 bp, Homo sapiens
acacatacacaca

SEQ ID NO: 4696497 - DNA, 13 bp, Homo sapiens
acacatggcagaa

SEQ ID NO: 4696498 - DNA, 18 bp, Homo sapiens
acacatgtccaagaagcc

SEQ ID NO: 4696499 - DNA, 19 bp, Homo sapiens
acacatgtccaagaagccc

SEQ ID NO: 4696500 - DNA, 21 bp, Homo sapiens
acacatgtccaagaagcccag

SEQ ID NO: 4696501 - DNA, 11 bp, Homo sapiens
acacatttttg

SEQ ID NO: 4696502 - DNA, 16 bp, Homo sapiens
acaccaagctgtgcca

SEQ ID NO: 4696503 - DNA, 17 bp, Homo sapiens
acaccaagctgtgccac

SEQ ID NO: 4696504 - DNA, 21 bp, Homo sapiens
acaccaagctgtgccaccctg

SEQ ID NO: 4696505 - DNA, 18 bp, Homo sapiens
acaccaataaatgtttgt

SEQ ID NO: 4696506 - DNA, 20 bp, Homo sapiens
acaccaataaatgtttgtta

SEQ ID NO: 4696507 - DNA, 13 bp, Homo sapiens
acaccagagcaga

SEQ ID NO: 4696508 - DNA, 17 bp, Homo sapiens
acaccagagcagatgca

SEQ ID NO: 4696509 - DNA, 22 bp, Homo sapiens
acaccagagcagatgcagagag

SEQ ID NO: 4696510 - DNA, 18 bp, Homo sapiens
acaccagagcccaccttg

SEQ ID NO: 4696511 - DNA, 20 bp, Homo sapiens
acaccagtttgactgtgcta

SEQ ID NO: 4696512 - DNA, 14 bp, Homo sapiens
acacccccacccct

SEQ ID NO: 4696513 - DNA, 18 bp, Homo sapiens
acaccgttcattcaggca

SEQ ID NO: 4696514 - DNA, 15 bp, Homo sapiens
acacctaactcacct

SEQ ID NO: 4696515 - DNA, 14 bp, Homo sapiens
acacctctggctgt

SEQ ID NO: 4696516 - DNA, 17 bp, Homo sapiens
acacctgagccagcctg

SEQ ID NO: 4696517 - DNA, 15 bp, Homo sapiens
acaccttgacagggc

SEQ ID NO: 4696518 - DNA, 16 bp, Homo sapiens
acaccttgacagggca

SEQ ID NO: 4696519 - DNA, 17 bp, Homo sapiens
acacctttattcagaac

SEQ ID NO: 4696520 - DNA, 15 bp, Homo sapiens
acacgcgtgcacaca

SEQ ID NO: 4696521 - DNA, 17 bp, Homo sapiens
acacggcagctgctggc

SEQ ID NO: 4696522 - DNA, 22 bp, Homo sapiens
acacggtttgaagcctggaaca

SEQ ID NO: 4696523 - DNA, 14 bp, Homo sapiens
acactaaccacgct

SEQ ID NO: 4696524 - DNA, 16 bp, Homo sapiens
acactaaccacgctgg

SEQ ID NO: 4696525 - DNA, 20 bp, Homo sapiens
acactaatgagtatttggta

SEQ ID NO: 4696526 - DNA, 18 bp, Homo sapiens
acactacttttgcttttt

SEQ ID NO: 4696527 - DNA, 15 bp, Homo sapiens
acactagaggccagg

SEQ ID NO: 4696528 - DNA, 15 bp, Homo sapiens
acactatatatttta

SEQ ID NO: 4696529 - DNA, 17 bp, Homo sapiens
acactatatattttatg

SEQ ID NO: 4696530 - DNA, 20 bp, Homo sapiens
acactcacatttattctgct

SEQ ID NO: 4696531 - DNA, 17 bp, Homo sapiens
acactcattgacctgag

SEQ ID NO: 4696532 - DNA, 15 bp, Homo sapiens
acactccagcctggg

SEQ ID NO: 4696533 - DNA, 11 bp, Homo sapiens
acactccttca

SEQ ID NO: 4696534 - DNA, 13 bp, Homo sapiens
acactgattttgt

SEQ ID NO: 4696535 - DNA, 16 bp, Homo sapiens
acactgcaggcatcac

SEQ ID NO: 4696536 - DNA, 18 bp, Homo sapiens
acactggtattcctgcct

SEQ ID NO: 4696537 - DNA, 19 bp, Homo sapiens
acactggtattcctgcctc

SEQ ID NO: 4696538 - DNA, 18 bp, Homo sapiens
acactggtctaatgtttg

SEQ ID NO: 4696539 - DNA, 20 bp, Homo sapiens
acactggtctaatgtttgtg

SEQ ID NO: 4696540 - DNA, 17 bp, Homo sapiens
acactgtaatatcttta

SEQ ID NO: 4696541 - DNA, 18 bp, Homo sapiens
acactgtaatatctttaa

SEQ ID NO: 4696542 - DNA, 13 bp, Homo sapiens
acactgtcttgaa

SEQ ID NO: 4696543 - DNA, 14 bp, Homo sapiens
acactgttctctgc

SEQ ID NO: 4696544 - DNA, 12 bp, Homo sapiens
accacagctgct

SEQ ID NO: 4696545 - DNA, 20 bp, Homo sapiens
accacagtttcttctgtaaa

SEQ ID NO: 4696546 - DNA, 18 bp, Homo sapiens
accacatcttgctctgct

SEQ ID NO: 4696547 - DNA, 21 bp, Homo sapiens
accacatgaactacgtgacct

SEQ ID NO: 4696548 - DNA, 18 bp, Homo sapiens
accacatgcggagaacaa

SEQ ID NO: 4696549 - DNA, 20 bp, Homo sapiens
accaccacacccagcccact

SEQ ID NO: 4696550 - DNA, 14 bp, Homo sapiens
accaccacctgctc

SEQ ID NO: 4696551 - DNA, 23 bp, Homo sapiens
accacccactctcctctgcctca

SEQ ID NO: 4696552 - DNA, 19 bp, Homo sapiens
accacctggagcggctcat

SEQ ID NO: 4696553 - DNA, 22 bp, Homo sapiens
accacctttgtttctcccccat

SEQ ID NO: 4696554 - DNA, 14 bp, Homo sapiens
accacgcccggcta

SEQ ID NO: 4696555 - DNA, 20 bp, Homo sapiens
accacgcccggctaattttt

SEQ ID NO: 4696556 - DNA, 13 bp, Homo sapiens
accactttttgca

SEQ ID NO: 4696557 - DNA, 19 bp, Homo sapiens
accagaaacctgggagaga

SEQ ID NO: 4696558 - DNA, 16 bp, Homo sapiens
accagagcagatgcag

SEQ ID NO: 4696559 - DNA, 14 bp, Homo sapiens
accagagcccacct

SEQ ID NO: 4696560 - DNA, 17 bp, Homo sapiens
accagagcccaccttgg

SEQ ID NO: 4696561 - DNA, 13 bp, Homo sapiens
accagcctggccc

SEQ ID NO: 4696562 - DNA, 15 bp, Homo sapiens
accaggggcaggcac

SEQ ID NO: 4696563 - DNA, 16 bp, Homo sapiens
accaggggcaggcaca

SEQ ID NO: 4696564 - DNA, 17 bp, Homo sapiens
accaggggcaggcacag

SEQ ID NO: 4696565 - DNA, 20 bp, Homo sapiens
accaggggcaggcacagcac

SEQ ID NO: 4696566 - DNA, 20 bp, Homo sapiens
accagggttgaccccagagg

SEQ ID NO: 4696567 - DNA, 19 bp, Homo sapiens
accaggtctcctccaccgc

SEQ ID NO: 4696568 - DNA, 22 bp, Homo sapiens
accagtgtgacaggaaagattc

SEQ ID NO: 4696569 - DNA, 22 bp, Homo sapiens
accagtgttagggaagggcctg

SEQ ID NO: 4696570 - DNA, 22 bp, Homo sapiens
accataagtgacaccaataaat

SEQ ID NO: 4696571 - DNA, 13 bp, Homo sapiens
accatactaatta

SEQ ID NO: 4696572 - DNA, 22 bp, Homo sapiens
accatccctgaaggccccgccc

SEQ ID NO: 4696573 - DNA, 22 bp, Homo sapiens
accatgagtggcatggccacca

SEQ ID NO: 4696574 - DNA, 16 bp, Homo sapiens
accatgcatttaaagt

SEQ ID NO: 4696575 - DNA, 17 bp, Homo sapiens
accatgtagaaaatttg

SEQ ID NO: 4696576 - DNA, 18 bp, Homo sapiens
accatgttggccaggctg

SEQ ID NO: 4696577 - DNA, 19 bp, Homo sapiens
accattctttcttggtgca

SEQ ID NO: 4696578 - DNA, 22 bp, Homo sapiens
acccaaaagctcagccagcccc

SEQ ID NO: 4696579 - DNA, 14 bp, Homo sapiens
acccaaatcctctc

SEQ ID NO: 4696580 - DNA, 13 bp, Homo sapiens
acccaagggcctg

SEQ ID NO: 4696581 - DNA, 16 bp, Homo sapiens
acccaagggcctggcc

SEQ ID NO: 4696582 - DNA, 18 bp, Homo sapiens
acccaagggcctggcctg

SEQ ID NO: 4696583 - DNA, 13 bp, Homo sapiens
acccacagcctcc

SEQ ID NO: 4696584 - DNA, 17 bp, Homo sapiens
acccacccccacccaag

SEQ ID NO: 4696585 - DNA, 13 bp, Homo sapiens
acccacctcagcc

SEQ ID NO: 4696586 - DNA, 14 bp, Homo sapiens
acccacctcagcct

SEQ ID NO: 4696587 - DNA, 18 bp, Homo sapiens
acccactctcctctgcct

SEQ ID NO: 4696588 - DNA, 20 bp, Homo sapiens
acccactctcctctgcctca

SEQ ID NO: 4696589 - DNA, 13 bp, Homo sapiens
acccactgctctg

SEQ ID NO: 4696590 - DNA, 14 bp, Homo sapiens
acccactggactca

SEQ ID NO: 4696591 - DNA, 15 bp, Homo sapiens
acccacttctgcact

SEQ ID NO: 4696592 - DNA, 17 bp, Homo sapiens
acccacttctgcacttg

SEQ ID NO: 4696593 - DNA, 22 bp, Homo sapiens
acccagaggaaggggccagagg

SEQ ID NO: 4696594 - DNA, 19 bp, Homo sapiens
acccagagtttttatgtag

SEQ ID NO: 4696595 - DNA, 15 bp, Homo sapiens
acccagcccacttct

SEQ ID NO: 4696596 - DNA, 16 bp, Homo sapiens
acccagcccacttctg

SEQ ID NO: 4696597 - DNA, 21 bp, Homo sapiens
acccagccccaaggggtggcc

SEQ ID NO: 4696598 - DNA, 15 bp, Homo sapiens
acccagccctcatcc

SEQ ID NO: 4696599 - DNA, 14 bp, Homo sapiens
acccagccgctgcc

SEQ ID NO: 4696600 - DNA, 16 bp, Homo sapiens
acccagccgctgcccg

SEQ ID NO: 4696601 - DNA, 16 bp, Homo sapiens
acccagcgagccctgg

SEQ ID NO: 4696602 - DNA, 13 bp, Homo sapiens
acccaggagcccc

SEQ ID NO: 4696603 - DNA, 13 bp, Homo sapiens
acccaggctgggc

SEQ ID NO: 4696604 - DNA, 18 bp, Homo sapiens
acccagttgccatctgcg

SEQ ID NO: 4696605 - DNA, 15 bp, Homo sapiens
acccatcaacaaaaa

SEQ ID NO: 4696606 - DNA, 13 bp, Homo sapiens
acccatctgggct

SEQ ID NO: 4696607 - DNA, 13 bp, Homo sapiens
acccatgctgccc

SEQ ID NO: 4696608 - DNA, 16 bp, Homo sapiens
acccattccttcccag

SEQ ID NO: 4696609 - DNA, 15 bp, Homo sapiens
accccaattccttgt

SEQ ID NO: 4696610 - DNA, 18 bp, Homo sapiens
accccacccctcatcagg

SEQ ID NO: 4696611 - DNA, 13 bp, Homo sapiens
accccagccccaa

SEQ ID NO: 4696612 - DNA, 22 bp, Homo sapiens
accccagccccaaaactctcct

SEQ ID NO: 4696613 - DNA, 15 bp, Homo sapiens
accccagggcagcca

SEQ ID NO: 4696614 - DNA, 16 bp, Homo sapiens
accccagggcagccag

SEQ ID NO: 4696615 - DNA, 13 bp, Homo sapiens
accccatctgccc

SEQ ID NO: 4696616 - DNA, 17 bp, Homo sapiens
accccatctgcccagga

SEQ ID NO: 4696617 - DNA, 13 bp, Homo sapiens
acccccacagacc

SEQ ID NO: 4696618 - DNA, 12 bp, Homo sapiens
acccccacccaa

SEQ ID NO: 4696619 - DNA, 13 bp, Homo sapiens
acccccagcaccc

SEQ ID NO: 4696620 - DNA, 18 bp, Homo sapiens
acccccagcacccgggct

SEQ ID NO: 4696621 - DNA, 15 bp, Homo sapiens
acccccagcccccac

SEQ ID NO: 4696622 - DNA, 12 bp, Homo sapiens
acccccagcctg

SEQ ID NO: 4696623 - DNA, 13 bp, Homo sapiens
acccccagcctgc

SEQ ID NO: 4696624 - DNA, 19 bp, Homo sapiens
accccccactctgtgcctg

SEQ ID NO: 4696625 - DNA, 19 bp, Homo sapiens
accccccagcactgaggaa

SEQ ID NO: 4696626 - DNA, 16 bp, Homo sapiens
acccccgcccaggctg

SEQ ID NO: 4696627 - DNA, 14 bp, Homo sapiens
accccctcctgctg

SEQ ID NO: 4696628 - DNA, 15 bp, Homo sapiens
accccctcctgctgc

SEQ ID NO: 4696629 - DNA, 16 bp, Homo sapiens
accccctcctgctgca

SEQ ID NO: 4696630 - DNA, 12 bp, Homo sapiens
acccctcccagc

SEQ ID NO: 4696631 - DNA, 15 bp, Homo sapiens
acccctcctcccttt

SEQ ID NO: 4696632 - DNA, 22 bp, Homo sapiens
acccctgcattggaactggagg

SEQ ID NO: 4696633 - DNA, 16 bp, Homo sapiens
accccttcgctcctgt

SEQ ID NO: 4696634 - DNA, 19 bp, Homo sapiens
accccttcgctcctgtgtc

SEQ ID NO: 4696635 - DNA, 15 bp, Homo sapiens
acccgccggatgaca

SEQ ID NO: 4696636 - DNA, 15 bp, Homo sapiens
acccggcccctgctg

SEQ ID NO: 4696637 - DNA, 20 bp, Homo sapiens
acccgggaagggggctggga

SEQ ID NO: 4696638 - DNA, 12 bp, Homo sapiens
acccgggctcag

SEQ ID NO: 4696639 - DNA, 15 bp, Homo sapiens
accctagctgtgtca

SEQ ID NO: 4696640 - DNA, 20 bp, Homo sapiens
accctcactgggactttgta

SEQ ID NO: 4696641 - DNA, 13 bp, Homo sapiens
accctcatgctgt

SEQ ID NO: 4696642 - DNA, 20 bp, Homo sapiens
accctcatgctgtgtgactc

SEQ ID NO: 4696643 - DNA, 11 bp, Homo sapiens
accctccaaat

SEQ ID NO: 4696644 - DNA, 20 bp, Homo sapiens
accctccctgctgtcccctc

SEQ ID NO: 4696645 - DNA, 21 bp, Homo sapiens
accctccctgctgtcccctct

SEQ ID NO: 4696646 - DNA, 18 bp, Homo sapiens
accctcgaggcggatctt

SEQ ID NO: 4696647 - DNA, 23 bp, Homo sapiens
accctctctccaaggtgtttcta

SEQ ID NO: 4696648 - DNA, 23 bp, Homo sapiens
accctgaggcccagagggcctgc

SEQ ID NO: 4696649 - DNA, 18 bp, Homo sapiens
accctgctcacaggcagg

SEQ ID NO: 4696650 - DNA, 20 bp, Homo sapiens
accctgggctctgtgggctg

SEQ ID NO: 4696651 - DNA, 20 bp, Homo sapiens
accctgggtgggagcatagg

SEQ ID NO: 4696652 - DNA, 16 bp, Homo sapiens
accctgtgatggggcc

SEQ ID NO: 4696653 - DNA, 20 bp, Homo sapiens
accctgtgatggggccctgc

SEQ ID NO: 4696654 - DNA, 21 bp, Homo sapiens
accctgtgatggggccctgcc

SEQ ID NO: 4696655 - DNA, 14 bp, Homo sapiens
actctcccccaccc

SEQ ID NO: 4696656 - DNA, 18 bp, Homo sapiens
actctcctctgctgctgg

SEQ ID NO: 4696657 - DNA, 21 bp, Homo sapiens
actctcctctgctgctggctg

SEQ ID NO: 4696658 - DNA, 19 bp, Homo sapiens
actctcttagttcttacct

SEQ ID NO: 4696659 - DNA, 23 bp, Homo sapiens
actctcttagttcttaccttttg

SEQ ID NO: 4696660 - DNA, 21 bp, Homo sapiens
actctgcaactgaatacttga

SEQ ID NO: 4696661 - DNA, 12 bp, Homo sapiens
actctgcagcct

SEQ ID NO: 4696662 - DNA, 17 bp, Homo sapiens
actctgcagcctcagag

SEQ ID NO: 4696663 - DNA, 19 bp, Homo sapiens
actctggacctctcttgtg

SEQ ID NO: 4696664 - DNA, 21 bp, Homo sapiens
actctgtgcccatgggcactg

SEQ ID NO: 4696665 - DNA, 23 bp, Homo sapiens
actcttatctcagtcatgcataa

SEQ ID NO: 4696666 - DNA, 15 bp, Homo sapiens
actcttgacctcagg

SEQ ID NO: 4696667 - DNA, 16 bp, Homo sapiens
actcttgacctcaggt

SEQ ID NO: 4696668 - DNA, 11 bp, Homo sapiens
actctttcaaa

SEQ ID NO: 4696669 - DNA, 13 bp, Homo sapiens
actctttgagaaa

SEQ ID NO: 4696670 - DNA, 16 bp, Homo sapiens
actctttgcctaacta

SEQ ID NO: 4696671 - DNA, 13 bp, Homo sapiens
actgaaaaagcaa

SEQ ID NO: 4696672 - DNA, 13 bp, Homo sapiens
actgaaaaggaaa

SEQ ID NO: 4696673 - DNA, 16 bp, Homo sapiens
actgaacattccagag

SEQ ID NO: 4696674 - DNA, 21 bp, Homo sapiens
actgaactttgctgagcctgt

SEQ ID NO: 4696675 - DNA, 17 bp, Homo sapiens
actgaagatattccaac

SEQ ID NO: 4696676 - DNA, 22 bp, Homo sapiens
actgacattgttggccaaagcc

SEQ ID NO: 4696677 - DNA, 23 bp, Homo sapiens
actgacattgttggccaaagcca

SEQ ID NO: 4696678 - DNA, 19 bp, Homo sapiens
actgagaatgtaagaacta

SEQ ID NO: 4696679 - DNA, 17 bp, Homo sapiens
actgagatgcaaatgtc

SEQ ID NO: 4696680 - DNA, 18 bp, Homo sapiens
actgagatgttttaccat

SEQ ID NO: 4696681 - DNA, 15 bp, Homo sapiens
actgagcatctccag

SEQ ID NO: 4696682 - DNA, 22 bp, Homo sapiens
actgaggaagaacggggctctt

SEQ ID NO: 4696683 - DNA, 23 bp, Homo sapiens
actgaggatattcagatgtatgt

SEQ ID NO: 4696684 - DNA, 21 bp, Homo sapiens
actgagtctggcaaacatgtg

SEQ ID NO: 4696685 - DNA, 20 bp, Homo sapiens
actgatcttacctttatgag

SEQ ID NO: 4696686 - DNA, 12 bp, Homo sapiens
actgatgggcaa

SEQ ID NO: 4696687 - DNA, 22 bp, Homo sapiens
actgatgggcaacccccagcct

SEQ ID NO: 4696688 - DNA, 14 bp, Homo sapiens
actgattttgtaaa

SEQ ID NO: 4696689 - DNA, 16 bp, Homo sapiens
actgcaacctccgcct

SEQ ID NO: 4696690 - DNA, 23 bp, Homo sapiens
actgcaaccttcgccacctgggt

SEQ ID NO: 4696691 - DNA, 21 bp, Homo sapiens
actgcaacttgtgaactccat

SEQ ID NO: 4696692 - DNA, 21 bp, Homo sapiens
actgcacaataaaaccaagcc

SEQ ID NO: 4696693 - DNA, 18 bp, Homo sapiens
actgcacactcagttctg

SEQ ID NO: 4696694 - DNA, 17 bp, Homo sapiens
actgcaccccctcctgc

SEQ ID NO: 4696695 - DNA, 18 bp, Homo sapiens
actgcaccccctcctgct

SEQ ID NO: 4696696 - DNA, 20 bp, Homo sapiens
actgcaccccctcctgctgc

SEQ ID NO: 4696697 - DNA, 21 bp, Homo sapiens
actgcaccccctcctgctgca

SEQ ID NO: 4696698 - DNA, 16 bp, Homo sapiens
actgcaccgggccaca

SEQ ID NO: 4696699 - DNA, 19 bp, Homo sapiens
actgcagcctcaacctcct

SEQ ID NO: 4696700 - DNA, 22 bp, Homo sapiens
actgcagcctcaacctcctggg

SEQ ID NO: 4696701 - DNA, 19 bp, Homo sapiens
actgcaggcatcacagcta

SEQ ID NO: 4696702 - DNA, 10 bp, Homo sapiens
actgcaggga

SEQ ID NO: 4696703 - DNA, 20 bp, Homo sapiens
actgcatcctccgcctcccg

SEQ ID NO: 4696704 - DNA, 16 bp, Homo sapiens
actgccatgcagggcc

SEQ ID NO: 4696705 - DNA, 16 bp, Homo sapiens
actgccccctctgccc

SEQ ID NO: 4696706 - DNA, 17 bp, Homo sapiens
actgctgggtggcccat

SEQ ID NO: 4696707 - DNA, 20 bp, Homo sapiens
actgctgggtggcccatccc

SEQ ID NO: 4696708 - DNA, 17 bp, Homo sapiens
actgcttccagtgaggc

SEQ ID NO: 4696709 - DNA, 19 bp, Homo sapiens
actgcttcctctgaatatt

SEQ ID NO: 4696710 - DNA, 14 bp, Homo sapiens
actgcttgaggaaa

SEQ ID NO: 4696711 - DNA, 14 bp, Homo sapiens
actgcttttggtct

SEQ ID NO: 4696712 - DNA, 15 bp, Homo sapiens
actggaagcacagct

SEQ ID NO: 4696713 - DNA, 16 bp, Homo sapiens
actggcctcgcctggc

SEQ ID NO: 4696714 - DNA, 18 bp, Homo sapiens
actggcctcgcctggcct

SEQ ID NO: 4696715 - DNA, 23 bp, Homo sapiens
actggcctcgcctggcctgaggt

SEQ ID NO: 4696716 - DNA, 19 bp, Homo sapiens
actggcgacacgtagcagc

SEQ ID NO: 4696717 - DNA, 14 bp, Homo sapiens
actggctgcctcca

SEQ ID NO: 4696718 - DNA, 17 bp, Homo sapiens
actggctgcctccactc

SEQ ID NO: 4696719 - DNA, 14 bp, Homo sapiens
actgggctgaggga

SEQ ID NO: 4696720 - DNA, 21 bp, Homo sapiens
actggtggttgattggtttta

SEQ ID NO: 4696721 - DNA, 17 bp, Homo sapiens
actgtaaaataataact

SEQ ID NO: 4696722 - DNA, 15 bp, Homo sapiens
actgtaacattcagg

SEQ ID NO: 4696723 - DNA, 22 bp, Homo sapiens
actgtaactgtgtcatgattca

SEQ ID NO: 4696724 - DNA, 23 bp, Homo sapiens
actgtaatgaaccgctgaatatg

SEQ ID NO: 4696725 - DNA, 12 bp, Homo sapiens
actgtataaata

SEQ ID NO: 4696726 - DNA, 13 bp, Homo sapiens
actgtataaatag

SEQ ID NO: 4696727 - DNA, 13 bp, Homo sapiens
actgtatccattc

SEQ ID NO: 4696728 - DNA, 14 bp, Homo sapiens
actgtatggaaaca

SEQ ID NO: 4696729 - DNA, 17 bp, Homo sapiens
actgtcctacccaccct

SEQ ID NO: 4696730 - DNA, 18 bp, Homo sapiens
actgtcctacccaccctc

SEQ ID NO: 4696731 - DNA, 16 bp, Homo sapiens
actgtcctattatatt

SEQ ID NO: 4696732 - DNA, 12 bp, Homo sapiens
actgtcctgctc

SEQ ID NO: 4696733 - DNA, 16 bp, Homo sapiens
actgtcctgctccaca

SEQ ID NO: 4696734 - DNA, 20 bp, Homo sapiens
actgtcctgctccacagtgt

SEQ ID NO: 4696735 - DNA, 13 bp, Homo sapiens
actgtgacaggca

SEQ ID NO: 4696736 - DNA, 15 bp, Homo sapiens
actgtgacaggcagc

SEQ ID NO: 4696737 - DNA, 16 bp, Homo sapiens
actgtgacaggcagca

SEQ ID NO: 4696738 - DNA, 19 bp, Homo sapiens
actgtgacaggcagcagag

SEQ ID NO: 4696739 - DNA, 23 bp, Homo sapiens
actgtgatgttgggaagctattt

SEQ ID NO: 4696740 - DNA, 18 bp, Homo sapiens
actgtgcaccaagcagga

SEQ ID NO: 4696741 - DNA, 22 bp, Homo sapiens
actgtgctggagccactaacta

SEQ ID NO: 4696742 - DNA, 17 bp, Homo sapiens
actgtggaagtccctca

SEQ ID NO: 4696743 - DNA, 18 bp, Homo sapiens
actgtggaggaaggattg

SEQ ID NO: 4696744 - DNA, 15 bp, Homo sapiens
actgtggatattgtt

SEQ ID NO: 4696745 - DNA, 21 bp, Homo sapiens
actgtgtttaatagtatatct

SEQ ID NO: 4696746 - DNA, 23 bp, Homo sapiens
actgttaactatgacagatatat

SEQ ID NO: 4696747 - DNA, 18 bp, Homo sapiens
actgttctctgccctcca

SEQ ID NO: 4696748 - DNA, 20 bp, Homo sapiens
actgttctctgccctccaag

SEQ ID NO: 4696749 - DNA, 12 bp, Homo sapiens
actgttgcacgt

SEQ ID NO: 4696750 - DNA, 13 bp, Homo sapiens
actgttgcacgtg

SEQ ID NO: 4696751 - DNA, 15 bp, Homo sapiens
actgttgcacgtgtg

SEQ ID NO: 4696752 - DNA, 16 bp, Homo sapiens
actgttgcacgtgtgt

SEQ ID NO: 4696753 - DNA, 22 bp, Homo sapiens
actgttgcacgtgtgtttttct

SEQ ID NO: 4696754 - DNA, 14 bp, Homo sapiens
actgttgcccaggc

SEQ ID NO: 4696755 - DNA, 12 bp, Homo sapiens
actgttggaatg

SEQ ID NO: 4696756 - DNA, 21 bp, Homo sapiens
actgttggaatggatttttct

SEQ ID NO: 4696757 - DNA, 14 bp, Homo sapiens
actgtttagatgaa

SEQ ID NO: 4696758 - DNA, 15 bp, Homo sapiens
actgtttgtcttctc

SEQ ID NO: 4696759 - DNA, 20 bp, Homo sapiens
actgtttgtcttctccccag

SEQ ID NO: 4696760 - DNA, 15 bp, Homo sapiens
acttaactttttaac

SEQ ID NO: 4696761 - DNA, 14 bp, Homo sapiens
acttaatagaaaca

SEQ ID NO: 4696762 - DNA, 23 bp, Homo sapiens
acttactttttttggaagttatt

SEQ ID NO: 4696763 - DNA, 18 bp, Homo sapiens
acttagatctccaggaga

SEQ ID NO: 4696764 - DNA, 16 bp, Homo sapiens
acttagattgtgttcc

SEQ ID NO: 4696765 - DNA, 20 bp, Homo sapiens
agagacactgttgataaaaa

SEQ ID NO: 4696766 - DNA, 13 bp, Homo sapiens
agagacatcagcc

SEQ ID NO: 4696767 - DNA, 15 bp, Homo sapiens
agagacatcagccct

SEQ ID NO: 4696768 - DNA, 13 bp, Homo sapiens
agagaccatccct

SEQ ID NO: 4696769 - DNA, 14 bp, Homo sapiens
agagaccatccctg

SEQ ID NO: 4696770 - DNA, 15 bp, Homo sapiens
agagaccatccctga

SEQ ID NO: 4696771 - DNA, 18 bp, Homo sapiens
agagaccatccctgaagg

SEQ ID NO: 4696772 - DNA, 15 bp, Homo sapiens
agagacctcctgcct

SEQ ID NO: 4696773 - DNA, 14 bp, Homo sapiens
agagactcctgcag

SEQ ID NO: 4696774 - DNA, 19 bp, Homo sapiens
agagactcctgcaggcagc

SEQ ID NO: 4696775 - DNA, 22 bp, Homo sapiens
agagactgaatagatatgaaag

SEQ ID NO: 4696776 - DNA, 15 bp, Homo sapiens
agagacttggatgag

SEQ ID NO: 4696777 - DNA, 14 bp, Homo sapiens
agagagactgtgtg

SEQ ID NO: 4696778 - DNA, 23 bp, Homo sapiens
agagagcaagacgctgtgctgcc

SEQ ID NO: 4696779 - DNA, 23 bp, Homo sapiens
agagagcagcttctgccacttcc

SEQ ID NO: 4696780 - DNA, 13 bp, Homo sapiens
agagagccatttt

SEQ ID NO: 4696781 - DNA, 20 bp, Homo sapiens
agagagcttctgttgctgcc

SEQ ID NO: 4696782 - DNA, 15 bp, Homo sapiens
agagagggcaggcat

SEQ ID NO: 4696783 - DNA, 15 bp, Homo sapiens
agagatcaaagatga

SEQ ID NO: 4696784 - DNA, 22 bp, Homo sapiens
agagatcaaccccttcgctcct

SEQ ID NO: 4696785 - DNA, 20 bp, Homo sapiens
agagatcctacttctctgag

SEQ ID NO: 4696786 - DNA, 23 bp, Homo sapiens
agagatcctacttctctgagtca

SEQ ID NO: 4696787 - DNA, 15 bp, Homo sapiens
agagatgtgtgttga

SEQ ID NO: 4696788 - DNA, 17 bp, Homo sapiens
agagatgtgtgttgata

SEQ ID NO: 4696789 - DNA, 20 bp, Homo sapiens
agagatgtgtgttgatactg

SEQ ID NO: 4696790 - DNA, 21 bp, Homo sapiens
agagatgtgtgttgatactgt

SEQ ID NO: 4696791 - DNA, 22 bp, Homo sapiens
agagattggaatgggcagctca

SEQ ID NO: 4696792 - DNA, 19 bp, Homo sapiens
agagcaagacgctgtgctg

SEQ ID NO: 4696793 - DNA, 13 bp, Homo sapiens
agagcacagccct

SEQ ID NO: 4696794 - DNA, 15 bp, Homo sapiens
agagcacagccctcc

SEQ ID NO: 4696795 - DNA, 16 bp, Homo sapiens
agagcacagccctccc

SEQ ID NO: 4696796 - DNA, 17 bp, Homo sapiens
agagcaccctctggttg

SEQ ID NO: 4696797 - DNA, 22 bp, Homo sapiens
agagcaccttagacagtccctg

SEQ ID NO: 4696798 - DNA, 12 bp, Homo sapiens
agagcagagacc

SEQ ID NO: 4696799 - DNA, 15 bp, Homo sapiens
agagcagatgcagag

SEQ ID NO: 4696800 - DNA, 18 bp, Homo sapiens
agagcagatgcagagagc

SEQ ID NO: 4696801 - DNA, 13 bp, Homo sapiens
agagcagcttctg

SEQ ID NO: 4696802 - DNA, 19 bp, Homo sapiens
agagcaggcgttcagctca

SEQ ID NO: 4696803 - DNA, 18 bp, Homo sapiens
agagcataatttaaaaat

SEQ ID NO: 4696804 - DNA, 14 bp, Homo sapiens
agagcatgtgaggg

SEQ ID NO: 4696805 - DNA, 15 bp, Homo sapiens
agagccaccaagagg

SEQ ID NO: 4696806 - DNA, 13 bp, Homo sapiens
agagccagggtct

SEQ ID NO: 4696807 - DNA, 18 bp, Homo sapiens
agagccatgtagaagctg

SEQ ID NO: 4696808 - DNA, 20 bp, Homo sapiens
agagccatgtagaagctgca

SEQ ID NO: 4696809 - DNA, 17 bp, Homo sapiens
agagccattttgtgaat

SEQ ID NO: 4696810 - DNA, 13 bp, Homo sapiens
agagcccaggagc

SEQ ID NO: 4696811 - DNA, 16 bp, Homo sapiens
agagcccaggagctcc

SEQ ID NO: 4696812 - DNA, 17 bp, Homo sapiens
agagcccaggagctccc

SEQ ID NO: 4696813 - DNA, 13 bp, Homo sapiens
agagccttccagg

SEQ ID NO: 4696814 - DNA, 16 bp, Homo sapiens
agagctacttgggcca

SEQ ID NO: 4696815 - DNA, 21 bp, Homo sapiens
agagctacttgggccatagct

SEQ ID NO: 4696816 - DNA, 22 bp, Homo sapiens
agagctagaacctggagaacta

SEQ ID NO: 4696817 - DNA, 18 bp, Homo sapiens
agagctagaacctggagg

SEQ ID NO: 4696818 - DNA, 14 bp, Homo sapiens
agagctctgaccca

SEQ ID NO: 4696819 - DNA, 15 bp, Homo sapiens
agagctctgacccac

SEQ ID NO: 4696820 - DNA, 23 bp, Homo sapiens
agagctctgacccacagcctcca

SEQ ID NO: 4696821 - DNA, 23 bp, Homo sapiens
agagctgacacaaacctgcctgg

SEQ ID NO: 4696822 - DNA, 23 bp, Homo sapiens
agagctgacacaggatgaaggca

SEQ ID NO: 4696823 - DNA, 17 bp, Homo sapiens
agagctgtattaagcca

SEQ ID NO: 4696824 - DNA, 20 bp, Homo sapiens
agagcttccctgactcattc

SEQ ID NO: 4696825 - DNA, 17 bp, Homo sapiens
agagcttgatgccagta

SEQ ID NO: 4696826 - DNA, 13 bp, Homo sapiens
agagcttggactg

SEQ ID NO: 4696827 - DNA, 23 bp, Homo sapiens
agagcttggactggatgcatgtt

SEQ ID NO: 4696828 - DNA, 20 bp, Homo sapiens
agaggaaatattgctggggt

SEQ ID NO: 4696829 - DNA, 15 bp, Homo sapiens
agaggaaggggccag

SEQ ID NO: 4696830 - DNA, 23 bp, Homo sapiens
agaggaaggggccagaggctcgt

SEQ ID NO: 4696831 - DNA, 16 bp, Homo sapiens
agaggacaaaataaag

SEQ ID NO: 4696832 - DNA, 23 bp, Homo sapiens
agaggacaaaataaagtgtgtgt

SEQ ID NO: 4696833 - DNA, 20 bp, Homo sapiens
agaggagtacaggtgaagca

SEQ ID NO: 4696834 - DNA, 16 bp, Homo sapiens
agaggagtgactgagc

SEQ ID NO: 4696835 - DNA, 17 bp, Homo sapiens
agaggatgagagcccag

SEQ ID NO: 4696836 - DNA, 13 bp, Homo sapiens
agaggcagcccca

SEQ ID NO: 4696837 - DNA, 24 bp, Homo sapiens
agaggcagccccattctgcctgcc

SEQ ID NO: 4696838 - DNA, 19 bp, Homo sapiens
agaggccatgggcctcctg

SEQ ID NO: 4696839 - DNA, 15 bp, Homo sapiens
agagggaagccagga

SEQ ID NO: 4696840 - DNA, 16 bp, Homo sapiens
agagggcactctgctt

SEQ ID NO: 4696841 - DNA, 16 bp, Homo sapiens
agagggctacaaagga

SEQ ID NO: 4696842 - DNA, 22 bp, Homo sapiens
agaggggaacagactggaagca

SEQ ID NO: 4696843 - DNA, 17 bp, Homo sapiens
agaggggacgcaggccc

SEQ ID NO: 4696844 - DNA, 15 bp, Homo sapiens
agaggggcaggccct

SEQ ID NO: 4696845 - DNA, 14 bp, Homo sapiens
agaggggcctgcca

SEQ ID NO: 4696846 - DNA, 16 bp, Homo sapiens
agaggtcacaaagaat

SEQ ID NO: 4696847 - DNA, 17 bp, Homo sapiens
agagtacgttaaaagca

SEQ ID NO: 4696848 - DNA, 13 bp, Homo sapiens
agagtatggagct

SEQ ID NO: 4696849 - DNA, 14 bp, Homo sapiens
agagtatggagctc

SEQ ID NO: 4696850 - DNA, 11 bp, Homo sapiens
agagtatttct

SEQ ID NO: 4696851 - DNA, 20 bp, Homo sapiens
agagtcacacgggggcagct

SEQ ID NO: 4696852 - DNA, 22 bp, Homo sapiens
agagtcacagttccctttattt

SEQ ID NO: 4696853 - DNA, 17 bp, Homo sapiens
agagtggggttttcttg

SEQ ID NO: 4696854 - DNA, 16 bp, Homo sapiens
agagtgtagaagcatt

SEQ ID NO: 4696855 - DNA, 14 bp, Homo sapiens
agagtgtctttcca

SEQ ID NO: 4696856 - DNA, 12 bp, Homo sapiens
agagttaagaag

SEQ ID NO: 4696857 - DNA, 13 bp, Homo sapiens
agagttaagaagc

SEQ ID NO: 4696858 - DNA, 17 bp, Homo sapiens
agagttaagaagctgtt

SEQ ID NO: 4696859 - DNA, 21 bp, Homo sapiens
agagttaagaagctgttgtac

SEQ ID NO: 4696860 - DNA, 15 bp, Homo sapiens
agagttcgtgaagag

SEQ ID NO: 4696861 - DNA, 13 bp, Homo sapiens
agagttctttgca

SEQ ID NO: 4696862 - DNA, 20 bp, Homo sapiens
agagtttgatgaggccctcc

SEQ ID NO: 4696863 - DNA, 21 bp, Homo sapiens
agataaaaacctgaactttca

SEQ ID NO: 4696864 - DNA, 23 bp, Homo sapiens
agataaacagaaatgctctgatt

SEQ ID NO: 4696865 - DNA, 19 bp, Homo sapiens
agataataaattgatttgt

SEQ ID NO: 4696866 - DNA, 19 bp, Homo sapiens
agataatcttttacattga

SEQ ID NO: 4696867 - DNA, 18 bp, Homo sapiens
agatacagaactctttca

SEQ ID NO: 4696868 - DNA, 14 bp, Homo sapiens
agataccagcgagg

SEQ ID NO: 4696869 - DNA, 21 bp, Homo sapiens
agataccagcgaggaggctcc

SEQ ID NO: 4696870 - DNA, 23 bp, Homo sapiens
agataccagcgaggaggctccag

SEQ ID NO: 4696871 - DNA, 21 bp, Homo sapiens
agataggtcagtgcaaatact

SEQ ID NO: 4696872 - DNA, 20 bp, Homo sapiens
agatataactattgcccagg

SEQ ID NO: 4696873 - DNA, 20 bp, Homo sapiens
agatatattaagtgactgtt

SEQ ID NO: 4696874 - DNA, 21 bp, Homo sapiens
agatatatttaagccttataa

SEQ ID NO: 4696875 - DNA, 19 bp, Homo sapiens
agcccctggatgcagcctc

SEQ ID NO: 4696876 - DNA, 14 bp, Homo sapiens
agccccttagcccc

SEQ ID NO: 4696877 - DNA, 19 bp, Homo sapiens
agccccttctgacccatgc

SEQ ID NO: 4696878 - DNA, 20 bp, Homo sapiens
agccccttctgacccatgct

SEQ ID NO: 4696879 - DNA, 15 bp, Homo sapiens
agcccgaatacaaac

SEQ ID NO: 4696880 - DNA, 17 bp, Homo sapiens
agcccgggctctgcctc

SEQ ID NO: 4696881 - DNA, 20 bp, Homo sapiens
agcccgggctctgcctccca

SEQ ID NO: 4696882 - DNA, 19 bp, Homo sapiens
agccctgctgctgcctgcc

SEQ ID NO: 4696883 - DNA, 18 bp, Homo sapiens
agccctggctgaaggact

SEQ ID NO: 4696884 - DNA, 14 bp, Homo sapiens
agccctggtggcag

SEQ ID NO: 4696885 - DNA, 14 bp, Homo sapiens
agcccttgggggtc

SEQ ID NO: 4696886 - DNA, 21 bp, Homo sapiens
agcccttgggggtcctcctcc

SEQ ID NO: 4696887 - DNA, 19 bp, Homo sapiens
agccgagatcacgccactg

SEQ ID NO: 4696888 - DNA, 21 bp, Homo sapiens
agccgagatcacgccactgca

SEQ ID NO: 4696889 - DNA, 20 bp, Homo sapiens
agccggacacttctcaggaa

SEQ ID NO: 4696890 - DNA, 22 bp, Homo sapiens
agccggacacttctcaggaaat

SEQ ID NO: 4696891 - DNA, 16 bp, Homo sapiens
agccgtggtcctttgg

SEQ ID NO: 4696892 - DNA, 21 bp, Homo sapiens
agcctaacccccagcccctcc

SEQ ID NO: 4696893 - DNA, 19 bp, Homo sapiens
agcctaagcggctgtttac

SEQ ID NO: 4696894 - DNA, 20 bp, Homo sapiens
agcctagtgaaggcttctct

SEQ ID NO: 4696895 - DNA, 23 bp, Homo sapiens
agcctagtgaaggcttctctctg

SEQ ID NO: 4696896 - DNA, 20 bp, Homo sapiens
agcctcaacctcctgggcta

SEQ ID NO: 4696897 - DNA, 16 bp, Homo sapiens
agcctcagcatcctgg

SEQ ID NO: 4696898 - DNA, 21 bp, Homo sapiens
agcctcagcatcctggcaccc

SEQ ID NO: 4696899 - DNA, 16 bp, Homo sapiens
agcctcagtctccctc

SEQ ID NO: 4696900 - DNA, 16 bp, Homo sapiens
agcctccagtccaagg

SEQ ID NO: 4696901 - DNA, 22 bp, Homo sapiens
agcctccagtccaaggaaacca

SEQ ID NO: 4696902 - DNA, 15 bp, Homo sapiens
agcctcccctgccag

SEQ ID NO: 4696903 - DNA, 22 bp, Homo sapiens
agcctcccctgccagggcaggg

SEQ ID NO: 4696904 - DNA, 19 bp, Homo sapiens
agcctcccgagtagctggg

SEQ ID NO: 4696905 - DNA, 22 bp, Homo sapiens
agcctcccgagtagctgggact

SEQ ID NO: 4696906 - DNA, 23 bp, Homo sapiens
agcctcgatgtcctcctctgtga

SEQ ID NO: 4696907 - DNA, 18 bp, Homo sapiens
agcctctagggacccctc

SEQ ID NO: 4696908 - DNA, 20 bp, Homo sapiens
agcctctgtgtcactggctg

SEQ ID NO: 4696909 - DNA, 23 bp, Homo sapiens
agcctctgtgtcactggctgcct

SEQ ID NO: 4696910 - DNA, 15 bp, Homo sapiens
agcctgacaacagcc

SEQ ID NO: 4696911 - DNA, 19 bp, Homo sapiens
agcctgacaacagcctgag

SEQ ID NO: 4696912 - DNA, 21 bp, Homo sapiens
agcctgacaacagcctgagaa

SEQ ID NO: 4696913 - DNA, 22 bp, Homo sapiens
agcctgacaacagcctgagaaa

SEQ ID NO: 4696914 - DNA, 20 bp, Homo sapiens
agcctggccaacatggcgaa

SEQ ID NO: 4696915 - DNA, 12 bp, Homo sapiens
agcctggcccag

SEQ ID NO: 4696916 - DNA, 14 bp, Homo sapiens
agcctggcccagct

SEQ ID NO: 4696917 - DNA, 15 bp, Homo sapiens
agcctggcccagctc

SEQ ID NO: 4696918 - DNA, 17 bp, Homo sapiens
agcctgggggctcctca

SEQ ID NO: 4696919 - DNA, 21 bp, Homo sapiens
agccttataaaccaatcttaa

SEQ ID NO: 4696920 - DNA, 18 bp, Homo sapiens
agccttgaccattctcca

SEQ ID NO: 4696921 - DNA, 21 bp, Homo sapiens
agccttgaccattctccacct

SEQ ID NO: 4696922 - DNA, 23 bp, Homo sapiens
agccttgaccattctccacctgc

SEQ ID NO: 4696923 - DNA, 16 bp, Homo sapiens
agccttggcatctaga

SEQ ID NO: 4696924 - DNA, 20 bp, Homo sapiens
agccttgttttctctgtgtg

SEQ ID NO: 4696925 - DNA, 20 bp, Homo sapiens
agcgaggagatgctccttgg

SEQ ID NO: 4696926 - DNA, 19 bp, Homo sapiens
agcgattcttctgcttcag

SEQ ID NO: 4696927 - DNA, 22 bp, Homo sapiens
agcgattcttctgcttcagcct

SEQ ID NO: 4696928 - DNA, 16 bp, Homo sapiens
agcgctggccgggacc

SEQ ID NO: 4696929 - DNA, 21 bp, Homo sapiens
agcgctgtcaggattgcgaga

SEQ ID NO: 4696930 - DNA, 19 bp, Homo sapiens
agcggggacagctccttct

SEQ ID NO: 4696931 - DNA, 19 bp, Homo sapiens
agcgtcctcctctgtgacc

SEQ ID NO: 4696932 - DNA, 15 bp, Homo sapiens
agcgtgagccactgc

SEQ ID NO: 4696933 - DNA, 16 bp, Homo sapiens
agcgtgagccactgca

SEQ ID NO: 4696934 - DNA, 17 bp, Homo sapiens
agcgtgagccactgcac

SEQ ID NO: 4696935 - DNA, 23 bp, Homo sapiens
agctaaaagcatggccctgctgc

SEQ ID NO: 4696936 - DNA, 19 bp, Homo sapiens
agctaacacacagctccca

SEQ ID NO: 4696937 - DNA, 14 bp, Homo sapiens
agctaatgggacac

SEQ ID NO: 4696938 - DNA, 15 bp, Homo sapiens
agctaatgggacact

SEQ ID NO: 4696939 - DNA, 16 bp, Homo sapiens
agctagaacctggaga

SEQ ID NO: 4696940 - DNA, 15 bp, Homo sapiens
agctagctatttcta

SEQ ID NO: 4696941 - DNA, 16 bp, Homo sapiens
agctagctatttctat

SEQ ID NO: 4696942 - DNA, 23 bp, Homo sapiens
agctagctatttctatgtatgtg

SEQ ID NO: 4696943 - DNA, 14 bp, Homo sapiens
agctagctcccctc

SEQ ID NO: 4696944 - DNA, 20 bp, Homo sapiens
agctagctcccctcctctcc

SEQ ID NO: 4696945 - DNA, 16 bp, Homo sapiens
agctaggcctggccag

SEQ ID NO: 4696946 - DNA, 21 bp, Homo sapiens
agctaggcctggccagatgca

SEQ ID NO: 4696947 - DNA, 18 bp, Homo sapiens
agctatttcctttgcgca

SEQ ID NO: 4696948 - DNA, 22 bp, Homo sapiens
agctatttttatttgtttgtgc

SEQ ID NO: 4696949 - DNA, 21 bp, Homo sapiens
agctcaagggaccctgggtgg

SEQ ID NO: 4696950 - DNA, 13 bp, Homo sapiens
agctcaccagccc

SEQ ID NO: 4696951 - DNA, 19 bp, Homo sapiens
agctcaccagccccagtgc

SEQ ID NO: 4696952 - DNA, 20 bp, Homo sapiens
agctcaccagccccagtgcc

SEQ ID NO: 4696953 - DNA, 18 bp, Homo sapiens
agctcacctctcccttgg

SEQ ID NO: 4696954 - DNA, 16 bp, Homo sapiens
agctcaggcttttcca

SEQ ID NO: 4696955 - DNA, 12 bp, Homo sapiens
agctcagggcct

SEQ ID NO: 4696956 - DNA, 16 bp, Homo sapiens
agctcagggcctggct

SEQ ID NO: 4696957 - DNA, 18 bp, Homo sapiens
agctcagggcctggctca

SEQ ID NO: 4696958 - DNA, 19 bp, Homo sapiens
agctcagggcctggctcag

SEQ ID NO: 4696959 - DNA, 20 bp, Homo sapiens
agctcaggtgtccctgcact

SEQ ID NO: 4696960 - DNA, 16 bp, Homo sapiens
agctccaagctcccag

SEQ ID NO: 4696961 - DNA, 18 bp, Homo sapiens
agctccaagctcccaggc

SEQ ID NO: 4696962 - DNA, 19 bp, Homo sapiens
agctccagctcaccagccc

SEQ ID NO: 4696963 - DNA, 13 bp, Homo sapiens
agctccagttcga

SEQ ID NO: 4696964 - DNA, 18 bp, Homo sapiens
agctcccaagggatggtg

SEQ ID NO: 4696965 - DNA, 13 bp, Homo sapiens
agctccccagagt

SEQ ID NO: 4696966 - DNA, 18 bp, Homo sapiens
agctccccagagtcctct

SEQ ID NO: 4696967 - DNA, 20 bp, Homo sapiens
agctccgctttctacccagc

SEQ ID NO: 4696968 - DNA, 14 bp, Homo sapiens
agctccgtggagca

SEQ ID NO: 4696969 - DNA, 15 bp, Homo sapiens
agctcctcatccagg

SEQ ID NO: 4696970 - DNA, 19 bp, Homo sapiens
agctcctcatccagggctc

SEQ ID NO: 4696971 - DNA, 21 bp, Homo sapiens
agctcctcatccagggctctg

SEQ ID NO: 4696972 - DNA, 15 bp, Homo sapiens
agctccttcctggag

SEQ ID NO: 4696973 - DNA, 13 bp, Homo sapiens
agctccttctgtc

SEQ ID NO: 4696974 - DNA, 23 bp, Homo sapiens
agctctagtatttccacaaatag

SEQ ID NO: 4696975 - DNA, 22 bp, Homo sapiens
agctctatcaccaaggagccaa

SEQ ID NO: 4696976 - DNA, 16 bp, Homo sapiens
agctctatctgcaatg

SEQ ID NO: 4696977 - DNA, 10 bp, Homo sapiens
agctctgagc

SEQ ID NO: 4696978 - DNA, 12 bp, Homo sapiens
agctctgagctg

SEQ ID NO: 4696979 - DNA, 13 bp, Homo sapiens
agctctgagctgt

SEQ ID NO: 4696980 - DNA, 16 bp, Homo sapiens
agctctgagctgtcaa

SEQ ID NO: 4696981 - DNA, 22 bp, Homo sapiens
agctctgctcctctccccagca

SEQ ID NO: 4696982 - DNA, 12 bp, Homo sapiens
agctctggtcca

SEQ ID NO: 4696983 - DNA, 12 bp, Homo sapiens
agctctgtatca

SEQ ID NO: 4696984 - DNA, 13 bp, Homo sapiens
agggcagccctcc

SEQ ID NO: 4696985 - DNA, 14 bp, Homo sapiens
agggcaggaagggg

SEQ ID NO: 4696986 - DNA, 12 bp, Homo sapiens
agggcagggccc

SEQ ID NO: 4696987 - DNA, 17 bp, Homo sapiens
agggcagggccccaggc

SEQ ID NO: 4696988 - DNA, 13 bp, Homo sapiens
agggcataaagta

SEQ ID NO: 4696989 - DNA, 19 bp, Homo sapiens
agggcataaagtaaataca

SEQ ID NO: 4696990 - DNA, 14 bp, Homo sapiens
agggcatgggtcgg

SEQ ID NO: 4696991 - DNA, 20 bp, Homo sapiens
agggccacatgggaggctca

SEQ ID NO: 4696992 - DNA, 13 bp, Homo sapiens
agggcccagagag

SEQ ID NO: 4696993 - DNA, 21 bp, Homo sapiens
agggcctgactccttctgcca

SEQ ID NO: 4696994 - DNA, 13 bp, Homo sapiens
agggcctggcctg

SEQ ID NO: 4696995 - DNA, 16 bp, Homo sapiens
agggcctggcctgagc

SEQ ID NO: 4696996 - DNA, 14 bp, Homo sapiens
agggcctggctcag

SEQ ID NO: 4696997 - DNA, 20 bp, Homo sapiens
agggctacaaaggaggacaa

SEQ ID NO: 4696998 - DNA, 15 bp, Homo sapiens
agggctaccctgagc

SEQ ID NO: 4696999 - DNA, 18 bp, Homo sapiens
agggctagaacctggaag

SEQ ID NO: 4697000 - DNA, 20 bp, Homo sapiens
agggctagaacctggagagc

SEQ ID NO: 4697001 - DNA, 22 bp, Homo sapiens
agggctagaacctggagggcta

SEQ ID NO: 4697002 - DNA, 23 bp, Homo sapiens
agggctagaacctggaggggcta

SEQ ID NO: 4697003 - DNA, 18 bp, Homo sapiens
agggctagaacctggcag

SEQ ID NO: 4697004 - DNA, 16 bp, Homo sapiens
agggctcagagaggac

SEQ ID NO: 4697005 - DNA, 12 bp, Homo sapiens
agggctccagac

SEQ ID NO: 4697006 - DNA, 12 bp, Homo sapiens
agggctcctggg

SEQ ID NO: 4697007 - DNA, 18 bp, Homo sapiens
agggctggactgaggcct

SEQ ID NO: 4697008 - DNA, 18 bp, Homo sapiens
agggctttgttttgcaca

SEQ ID NO: 4697009 - DNA, 13 bp, Homo sapiens
aggggaatgtttg

SEQ ID NO: 4697010 - DNA, 16 bp, Homo sapiens
aggggacgcaggcccc

SEQ ID NO: 4697011 - DNA, 17 bp, Homo sapiens
aggggacgcaggcccct

SEQ ID NO: 4697012 - DNA, 22 bp, Homo sapiens
aggggacgcaggcccctctcct

SEQ ID NO: 4697013 - DNA, 19 bp, Homo sapiens
aggggcaggccctgcactg

SEQ ID NO: 4697014 - DNA, 13 bp, Homo sapiens
aggggccagaggc

SEQ ID NO: 4697015 - DNA, 14 bp, Homo sapiens
aggggccagaggct

SEQ ID NO: 4697016 - DNA, 15 bp, Homo sapiens
aggggccagaggctc

SEQ ID NO: 4697017 - DNA, 16 bp, Homo sapiens
aggggcccgcttgcct

SEQ ID NO: 4697018 - DNA, 21 bp, Homo sapiens
aggggcccgttgtctccctgg

SEQ ID NO: 4697019 - DNA, 20 bp, Homo sapiens
aggggcctgccacctggacc

SEQ ID NO: 4697020 - DNA, 20 bp, Homo sapiens
aggggctgcccgctcccagt

SEQ ID NO: 4697021 - DNA, 15 bp, Homo sapiens
agggggaaggcaggg

SEQ ID NO: 4697022 - DNA, 17 bp, Homo sapiens
agggggaagtgagaagg

SEQ ID NO: 4697023 - DNA, 12 bp, Homo sapiens
agggggctggag

SEQ ID NO: 4697024 - DNA, 18 bp, Homo sapiens
agggggctggaggagccc

SEQ ID NO: 4697025 - DNA, 13 bp, Homo sapiens
agggggctgggac

SEQ ID NO: 4697026 - DNA, 17 bp, Homo sapiens
agggggtggcctcccaa

SEQ ID NO: 4697027 - DNA, 17 bp, Homo sapiens
aggggtcatccttgccc

SEQ ID NO: 4697028 - DNA, 16 bp, Homo sapiens
aggggtggccgtcctg

SEQ ID NO: 4697029 - DNA, 19 bp, Homo sapiens
aggggtggccgtcctgagg

SEQ ID NO: 4697030 - DNA, 21 bp, Homo sapiens
aggggtggccgtcctgagggg

SEQ ID NO: 4697031 - DNA, 18 bp, Homo sapiens
aggggtgggacaccctgt

SEQ ID NO: 4697032 - DNA, 15 bp, Homo sapiens
agggtatctggtgac

SEQ ID NO: 4697033 - DNA, 21 bp, Homo sapiens
agggtatctggtgactttcct

SEQ ID NO: 4697034 - DNA, 11 bp, Homo sapiens
agggtccctgg

SEQ ID NO: 4697035 - DNA, 14 bp, Homo sapiens
agggtccctggtgg

SEQ ID NO: 4697036 - DNA, 22 bp, Homo sapiens
agggtccctggtggcagctcac

SEQ ID NO: 4697037 - DNA, 21 bp, Homo sapiens
agggtcctggggaacctgacc

SEQ ID NO: 4697038 - DNA, 23 bp, Homo sapiens
agggtcctggggaacctgacccc

SEQ ID NO: 4697039 - DNA, 23 bp, Homo sapiens
agggtctcactatgttgcccagg

SEQ ID NO: 4697040 - DNA, 22 bp, Homo sapiens
agggtctcactctgtcgcccag

SEQ ID NO: 4697041 - DNA, 13 bp, Homo sapiens
agggtctctgctg

SEQ ID NO: 4697042 - DNA, 16 bp, Homo sapiens
agggtctctgctgccg

SEQ ID NO: 4697043 - DNA, 19 bp, Homo sapiens
agggtgagacactgcacag

SEQ ID NO: 4697044 - DNA, 15 bp, Homo sapiens
agggtgggagtgggc

SEQ ID NO: 4697045 - DNA, 17 bp, Homo sapiens
agggtggtgacctctgc

SEQ ID NO: 4697046 - DNA, 19 bp, Homo sapiens
agggtggtgacctctgcct

SEQ ID NO: 4697047 - DNA, 17 bp, Homo sapiens
agggtgtgtgttcacct

SEQ ID NO: 4697048 - DNA, 19 bp, Homo sapiens
agggttcatcatccctccc

SEQ ID NO: 4697049 - DNA, 18 bp, Homo sapiens
agggttgaccccagagga

SEQ ID NO: 4697050 - DNA, 15 bp, Homo sapiens
agggttgcttcaatg

SEQ ID NO: 4697051 - DNA, 14 bp, Homo sapiens
agggttggagaagg

SEQ ID NO: 4697052 - DNA, 17 bp, Homo sapiens
agggttggcccctgccc

SEQ ID NO: 4697053 - DNA, 18 bp, Homo sapiens
agggttggcccctgcccg

SEQ ID NO: 4697054 - DNA, 17 bp, Homo sapiens
agggttgggctggtgtc

SEQ ID NO: 4697055 - DNA, 23 bp, Homo sapiens
agggttttgccatgttggccagg

SEQ ID NO: 4697056 - DNA, 13 bp, Homo sapiens
aggtaacaggcag

SEQ ID NO: 4697057 - DNA, 19 bp, Homo sapiens
aggtaagcaggaggaggtg

SEQ ID NO: 4697058 - DNA, 21 bp, Homo sapiens
aggtaatccaagatattttaa

SEQ ID NO: 4697059 - DNA, 21 bp, Homo sapiens
aggtaatcgacctgcctcggc

SEQ ID NO: 4697060 - DNA, 22 bp, Homo sapiens
aggtactgtcatgggctaggca

SEQ ID NO: 4697061 - DNA, 18 bp, Homo sapiens
aggtagattaaggtatct

SEQ ID NO: 4697062 - DNA, 15 bp, Homo sapiens
aggtatctggtatct

SEQ ID NO: 4697063 - DNA, 22 bp, Homo sapiens
aggtatgaccttctaggaagct

SEQ ID NO: 4697064 - DNA, 15 bp, Homo sapiens
aggtcagagcctgca

SEQ ID NO: 4697065 - DNA, 15 bp, Homo sapiens
aggtcagtgcaaata

SEQ ID NO: 4697066 - DNA, 21 bp, Homo sapiens
aggtcatacaatccattctta

SEQ ID NO: 4697067 - DNA, 18 bp, Homo sapiens
aggtccagccctggctga

SEQ ID NO: 4697068 - DNA, 23 bp, Homo sapiens
aggtccagccctggctgaaggac

SEQ ID NO: 4697069 - DNA, 12 bp, Homo sapiens
aggtctcctcca

SEQ ID NO: 4697070 - DNA, 20 bp, Homo sapiens
aggtctcgctgatgctgggc

SEQ ID NO: 4697071 - DNA, 21 bp, Homo sapiens
aggtctcgctgatgctgggct

SEQ ID NO: 4697072 - DNA, 15 bp, Homo sapiens
aggtctcttcccctc

SEQ ID NO: 4697073 - DNA, 16 bp, Homo sapiens
aggtctcttcccctct

SEQ ID NO: 4697074 - DNA, 18 bp, Homo sapiens
aggtcttgaactcctggc

SEQ ID NO: 4697075 - DNA, 22 bp, Homo sapiens
aggtcttgaactcctggcctca

SEQ ID NO: 4697076 - DNA, 23 bp, Homo sapiens
aggtcttgaactcctggcctcaa

SEQ ID NO: 4697077 - DNA, 13 bp, Homo sapiens
aggtgacagagtg

SEQ ID NO: 4697078 - DNA, 15 bp, Homo sapiens
aggtgacagagtgag

SEQ ID NO: 4697079 - DNA, 19 bp, Homo sapiens
aggtgactgggccctgcct

SEQ ID NO: 4697080 - DNA, 15 bp, Homo sapiens
aggtgcacaagctcc

SEQ ID NO: 4697081 - DNA, 21 bp, Homo sapiens
aggtgcacaagctccaagctc

SEQ ID NO: 4697082 - DNA, 19 bp, Homo sapiens
aggtgctaggaacactcct

SEQ ID NO: 4697083 - DNA, 16 bp, Homo sapiens
aggtggcaaggctgtg

SEQ ID NO: 4697084 - DNA, 16 bp, Homo sapiens
aggtgggatcctccag

SEQ ID NO: 4697085 - DNA, 17 bp, Homo sapiens
aggtgggatcctccagg

SEQ ID NO: 4697086 - DNA, 18 bp, Homo sapiens
aggtgggcgggcagcaca

SEQ ID NO: 4697087 - DNA, 22 bp, Homo sapiens
aggtgggcgggcagcacagcaa

SEQ ID NO: 4697088 - DNA, 13 bp, Homo sapiens
aggtggggacagg

SEQ ID NO: 4697089 - DNA, 17 bp, Homo sapiens
aggtggggacagggatg

SEQ ID NO: 4697090 - DNA, 13 bp, Homo sapiens
aggtggggcagct

SEQ ID NO: 4697091 - DNA, 19 bp, Homo sapiens
aggtggggtcactctggca

SEQ ID NO: 4697092 - DNA, 23 bp, Homo sapiens
aggtggggtcactctggcagctc

SEQ ID NO: 4697093 - DNA, 16 bp, Homo sapiens
aggtgtccctgcactt

SEQ ID NO: 4697094 - DNA, 23 bp, Homo sapiens
attcccggagggaaactgtgaat

SEQ ID NO: 4697095 - DNA, 21 bp, Homo sapiens
attccctagaaacttccaaat

SEQ ID NO: 4697096 - DNA, 12 bp, Homo sapiens
attccctcccca

SEQ ID NO: 4697097 - DNA, 20 bp, Homo sapiens
attcctgccccagatggctt

SEQ ID NO: 4697098 - DNA, 21 bp, Homo sapiens
attccttctttgataatgtta

SEQ ID NO: 4697099 - DNA, 21 bp, Homo sapiens
attcggtgtgcaccagggttg

SEQ ID NO: 4697100 - DNA, 19 bp, Homo sapiens
attctaacttttttgctat

SEQ ID NO: 4697101 - DNA, 18 bp, Homo sapiens
attctatgttaatatttt

SEQ ID NO: 4697102 - DNA, 14 bp, Homo sapiens
attctcaaagttaa

SEQ ID NO: 4697103 - DNA, 19 bp, Homo sapiens
attctcaaagttaaaagta

SEQ ID NO: 4697104 - DNA, 18 bp, Homo sapiens
attctcagggtctctgct

SEQ ID NO: 4697105 - DNA, 20 bp, Homo sapiens
attctcagggtctctgctgc

SEQ ID NO: 4697106 - DNA, 21 bp, Homo sapiens
attctcagggtctctgctgcc

SEQ ID NO: 4697107 - DNA, 15 bp, Homo sapiens
attctcatgcctcag

SEQ ID NO: 4697108 - DNA, 18 bp, Homo sapiens
attctccacctgccaggg

SEQ ID NO: 4697109 - DNA, 19 bp, Homo sapiens
attctccacctgccaggga

SEQ ID NO: 4697110 - DNA, 13 bp, Homo sapiens
attctctgagctg

SEQ ID NO: 4697111 - DNA, 19 bp, Homo sapiens
attctctgtctcatccatc

SEQ ID NO: 4697112 - DNA, 17 bp, Homo sapiens
attctgagccacactga

SEQ ID NO: 4697113 - DNA, 13 bp, Homo sapiens
attctgcctgccc

SEQ ID NO: 4697114 - DNA, 19 bp, Homo sapiens
attctgcctgcccaggccc

SEQ ID NO: 4697115 - DNA, 21 bp, Homo sapiens
attctgcctgcccaggcccct

SEQ ID NO: 4697116 - DNA, 19 bp, Homo sapiens
attctgctcacatatctgt

SEQ ID NO: 4697117 - DNA, 16 bp, Homo sapiens
attcttacaaacatgt

SEQ ID NO: 4697118 - DNA, 17 bp, Homo sapiens
attcttactaaaaagta

SEQ ID NO: 4697119 - DNA, 15 bp, Homo sapiens
attcttatttttaat

SEQ ID NO: 4697120 - DNA, 20 bp, Homo sapiens
attcttccctatctttgcca

SEQ ID NO: 4697121 - DNA, 21 bp, Homo sapiens
attcttccctatctttgccac

SEQ ID NO: 4697122 - DNA, 12 bp, Homo sapiens
attcttctgctt

SEQ ID NO: 4697123 - DNA, 22 bp, Homo sapiens
attcttctgtacgtctgacagg

SEQ ID NO: 4697124 - DNA, 19 bp, Homo sapiens
attcttgttgctgtacaaa

SEQ ID NO: 4697125 - DNA, 22 bp, Homo sapiens
attcttgttgctgtacaaaagc

SEQ ID NO: 4697126 - DNA, 17 bp, Homo sapiens
attctttcctgaggctg

SEQ ID NO: 4697127 - DNA, 21 bp, Homo sapiens
attcttttccagaaagaaaat

SEQ ID NO: 4697128 - DNA, 16 bp, Homo sapiens
attctttttgaaatgt

SEQ ID NO: 4697129 - DNA, 14 bp, Homo sapiens
attgaaaaaataga

SEQ ID NO: 4697130 - DNA, 18 bp, Homo sapiens
attgaaaaaatagagcct

SEQ ID NO: 4697131 - DNA, 19 bp, Homo sapiens
attgaaaaaatagagcctg

SEQ ID NO: 4697132 - DNA, 14 bp, Homo sapiens
attgaaagaactta

SEQ ID NO: 4697133 - DNA, 23 bp, Homo sapiens
attgaattattttgttactgtct

SEQ ID NO: 4697134 - DNA, 16 bp, Homo sapiens
attgaccatgtgatta

SEQ ID NO: 4697135 - DNA, 17 bp, Homo sapiens
attgacctgaggccctt

SEQ ID NO: 4697136 - DNA, 15 bp, Homo sapiens
attgagttttcagtg

SEQ ID NO: 4697137 - DNA, 16 bp, Homo sapiens
attgagttttcagtgg

SEQ ID NO: 4697138 - DNA, 19 bp, Homo sapiens
attgataaccttgaaaaaa

SEQ ID NO: 4697139 - DNA, 22 bp, Homo sapiens
attgataagagggcacacactg

SEQ ID NO: 4697140 - DNA, 15 bp, Homo sapiens
attgatcattcataa

SEQ ID NO: 4697141 - DNA, 14 bp, Homo sapiens
attgatgaaatcat

SEQ ID NO: 4697142 - DNA, 17 bp, Homo sapiens
attgatgttttcataga

SEQ ID NO: 4697143 - DNA, 21 bp, Homo sapiens
attgcaaaatgcgtatttgca

SEQ ID NO: 4697144 - DNA, 19 bp, Homo sapiens
attgcaacaggctgggctt

SEQ ID NO: 4697145 - DNA, 17 bp, Homo sapiens
attgcactccagcctgg

SEQ ID NO: 4697146 - DNA, 20 bp, Homo sapiens
attgcactccagcctgggtg

SEQ ID NO: 4697147 - DNA, 21 bp, Homo sapiens
attgcagtgcggctcacatca

SEQ ID NO: 4697148 - DNA, 19 bp, Homo sapiens
attgcatgagaagccatac

SEQ ID NO: 4697149 - DNA, 21 bp, Homo sapiens
attgcccacgctggagtgcag

SEQ ID NO: 4697150 - DNA, 14 bp, Homo sapiens
attgccccatgaga

SEQ ID NO: 4697151 - DNA, 20 bp, Homo sapiens
attgcctcttttcacatttt

SEQ ID NO: 4697152 - DNA, 23 bp, Homo sapiens
attgcctttagtgatcacagcag

SEQ ID NO: 4697153 - DNA, 14 bp, Homo sapiens
attgcgagagatgt

SEQ ID NO: 4697154 - DNA, 17 bp, Homo sapiens
attgcgagagatgtgtg

SEQ ID NO: 4697155 - DNA, 18 bp, Homo sapiens
attgcgagagatgtgtgt

SEQ ID NO: 4697156 - DNA, 20 bp, Homo sapiens
attgctactgtcctacccac

SEQ ID NO: 4697157 - DNA, 22 bp, Homo sapiens
attgctactgtcctacccaccc

SEQ ID NO: 4697158 - DNA, 20 bp, Homo sapiens
attgctccattttcttgtca

SEQ ID NO: 4697159 - DNA, 16 bp, Homo sapiens
attgcttgttggattt

SEQ ID NO: 4697160 - DNA, 14 bp, Homo sapiens
attggaactggagg

SEQ ID NO: 4697161 - DNA, 17 bp, Homo sapiens
attggaatcttcacctc

SEQ ID NO: 4697162 - DNA, 19 bp, Homo sapiens
attggaatcttcacctcag

SEQ ID NO: 4697163 - DNA, 20 bp, Homo sapiens
attggaatcttcacctcaga

SEQ ID NO: 4697164 - DNA, 15 bp, Homo sapiens
attggacccttccat

SEQ ID NO: 4697165 - DNA, 17 bp, Homo sapiens
attggagatagggaaag

SEQ ID NO: 4697166 - DNA, 14 bp, Homo sapiens
attggatatttgat

SEQ ID NO: 4697167 - DNA, 22 bp, Homo sapiens
attggatattttttactttaga

SEQ ID NO: 4697168 - DNA, 14 bp, Homo sapiens
attggattatttaa

SEQ ID NO: 4697169 - DNA, 18 bp, Homo sapiens
attggattatttaataac

SEQ ID NO: 4697170 - DNA, 16 bp, Homo sapiens
attggatttttgttaa

SEQ ID NO: 4697171 - DNA, 18 bp, Homo sapiens
attggcagcaggtgctgc

SEQ ID NO: 4697172 - DNA, 19 bp, Homo sapiens
attggcagcaggtgctgct

SEQ ID NO: 4697173 - DNA, 17 bp, Homo sapiens
attggctatttaaaact

SEQ ID NO: 4697174 - DNA, 22 bp, Homo sapiens
attggctgaactcatgagaagt

SEQ ID NO: 4697175 - DNA, 17 bp, Homo sapiens
attggtaattaaaagac

SEQ ID NO: 4697176 - DNA, 23 bp, Homo sapiens
attggtaattaaaagactccaca

SEQ ID NO: 4697177 - DNA, 21 bp, Homo sapiens
attgtaaaaaaaaatgccttt

SEQ ID NO: 4697178 - DNA, 15 bp, Homo sapiens
attgtaaaaatggca

SEQ ID NO: 4697179 - DNA, 15 bp, Homo sapiens
attgtaaatactgga

SEQ ID NO: 4697180 - DNA, 18 bp, Homo sapiens
attgtaaatactggactc

SEQ ID NO: 4697181 - DNA, 21 bp, Homo sapiens
attgtaaatactggactcagg

SEQ ID NO: 4697182 - DNA, 22 bp, Homo sapiens
attgtaaatactggactcagga

SEQ ID NO: 4697183 - DNA, 14 bp, Homo sapiens
attgtaaatctgaa

SEQ ID NO: 4697184 - DNA, 13 bp, Homo sapiens
attgtaactgttc

SEQ ID NO: 4697185 - DNA, 13 bp, Homo sapiens
attgtacagtttt

SEQ ID NO: 4697186 - DNA, 15 bp, Homo sapiens
attgtacagttttta

SEQ ID NO: 4697187 - DNA, 15 bp, Homo sapiens
attgtacataaaatt

SEQ ID NO: 4697188 - DNA, 18 bp, Homo sapiens
attgtcaaaattaatatg

SEQ ID NO: 4697189 - DNA, 16 bp, Homo sapiens
attgtcagtgattttg

SEQ ID NO: 4697190 - DNA, 14 bp, Homo sapiens
attgtccagtttgt

SEQ ID NO: 4697191 - DNA, 23 bp, Homo sapiens
attgtccagtttgtcttggatat

SEQ ID NO: 4697192 - DNA, 19 bp, Homo sapiens
attgtccccgacccttgcc

SEQ ID NO: 4697193 - DNA, 23 bp, Homo sapiens
attgtgatttcccgtggccccag

SEQ ID NO: 4697194 - DNA, 14 bp, Homo sapiens
attgtggctccctg

SEQ ID NO: 4697195 - DNA, 12 bp, Homo sapiens
attgtggtgcca

SEQ ID NO: 4697196 - DNA, 14 bp, Homo sapiens
attgtgtacacttt

SEQ ID NO: 4697197 - DNA, 14 bp, Homo sapiens
attgtgtctcttgg

SEQ ID NO: 4697198 - DNA, 21 bp, Homo sapiens
attgtgtctcttggtcctgct

SEQ ID NO: 4697199 - DNA, 22 bp, Homo sapiens
attgttaatgcctataactttt

SEQ ID NO: 4697200 - DNA, 12 bp, Homo sapiens
attgttatcaaa

SEQ ID NO: 4697201 - DNA, 23 bp, Homo sapiens
attgttgcatccctcaattgaat

SEQ ID NO: 4697202 - DNA, 12 bp, Homo sapiens
attgttgtttct

SEQ ID NO: 4697203 - DNA, 21 bp, Homo sapiens
attttactttaaaaggagcca

SEQ ID NO: 4697204 - DNA, 18 bp, Homo sapiens
attttagactcaaagaat

SEQ ID NO: 4697205 - DNA, 20 bp, Homo sapiens
attttagatgttattatgct

SEQ ID NO: 4697206 - DNA, 21 bp, Homo sapiens
attttagatgttattatgcta

SEQ ID NO: 4697207 - DNA, 23 bp, Homo sapiens
attttagatgttattatgctaat

SEQ ID NO: 4697208 - DNA, 19 bp, Homo sapiens
attttagcatgatgaaact

SEQ ID NO: 4697209 - DNA, 23 bp, Homo sapiens
attttagtcacacgtggtctttc

SEQ ID NO: 4697210 - DNA, 13 bp, Homo sapiens
attttatctttga

SEQ ID NO: 4697211 - DNA, 15 bp, Homo sapiens
attttatctttgatt

SEQ ID NO: 4697212 - DNA, 23 bp, Homo sapiens
attttatctttgattctccttca

SEQ ID NO: 4697213 - DNA, 13 bp, Homo sapiens
attttatgtcttt

SEQ ID NO: 4697214 - DNA, 16 bp, Homo sapiens
attttatgttatttat

SEQ ID NO: 4697215 - DNA, 18 bp, Homo sapiens
attttatgttatttatag

SEQ ID NO: 4697216 - DNA, 20 bp, Homo sapiens
attttatgttatttatagct

SEQ ID NO: 4697217 - DNA, 14 bp, Homo sapiens
attttatttatagt

SEQ ID NO: 4697218 - DNA, 22 bp, Homo sapiens
attttcagttattatatttaca

SEQ ID NO: 4697219 - DNA, 19 bp, Homo sapiens
attttcatgcacagtagat

SEQ ID NO: 4697220 - DNA, 17 bp, Homo sapiens
attttcccactgcaccc

SEQ ID NO: 4697221 - DNA, 21 bp, Homo sapiens
attttcctaataaagttctgt

SEQ ID NO: 4697222 - DNA, 14 bp, Homo sapiens
attttcctcatttt

SEQ ID NO: 4697223 - DNA, 15 bp, Homo sapiens
attttcctcattttg

SEQ ID NO: 4697224 - DNA, 22 bp, Homo sapiens
attttccttcagaatatcttaa

SEQ ID NO: 4697225 - DNA, 14 bp, Homo sapiens
attttctaaagact

SEQ ID NO: 4697226 - DNA, 16 bp, Homo sapiens
attttctgtaaatgaa

SEQ ID NO: 4697227 - DNA, 12 bp, Homo sapiens
attttgaatgtg

SEQ ID NO: 4697228 - DNA, 14 bp, Homo sapiens
attttgaatgtgat

SEQ ID NO: 4697229 - DNA, 15 bp, Homo sapiens
attttgaatgtgatc

SEQ ID NO: 4697230 - DNA, 18 bp, Homo sapiens
attttgagcaaagaaact

SEQ ID NO: 4697231 - DNA, 16 bp, Homo sapiens
attttggttttgttcc

SEQ ID NO: 4697232 - DNA, 17 bp, Homo sapiens
attttgtagcctctctt

SEQ ID NO: 4697233 - DNA, 18 bp, Homo sapiens
attttgtatatttgtatt

SEQ ID NO: 4697234 - DNA, 12 bp, Homo sapiens
attttgtcttta

SEQ ID NO: 4697235 - DNA, 12 bp, Homo sapiens
attttgtgaatg

SEQ ID NO: 4697236 - DNA, 20 bp, Homo sapiens
attttgtgttgtacaattaa

SEQ ID NO: 4697237 - DNA, 17 bp, Homo sapiens
attttgttactgtctgt

SEQ ID NO: 4697238 - DNA, 12 bp, Homo sapiens
attttgtttaca

SEQ ID NO: 4697239 - DNA, 14 bp, Homo sapiens
atttttaaagcatg

SEQ ID NO: 4697240 - DNA, 21 bp, Homo sapiens
atttttaaaggacaaacagtg

SEQ ID NO: 4697241 - DNA, 23 bp, Homo sapiens
atttttaactctggattttgaat

SEQ ID NO: 4697242 - DNA, 18 bp, Homo sapiens
atttttacaaaactgcca

SEQ ID NO: 4697243 - DNA, 17 bp, Homo sapiens
atttttccaatcacagt

SEQ ID NO: 4697244 - DNA, 15 bp, Homo sapiens
atttttctaaagaaa

SEQ ID NO: 4697245 - DNA, 17 bp, Homo sapiens
atttttctcaaagtttt

SEQ ID NO: 4697246 - DNA, 22 bp, Homo sapiens
atttttgaaaatcctgaataaa

SEQ ID NO: 4697247 - DNA, 22 bp, Homo sapiens
atttttgtgattttgtgattga

SEQ ID NO: 4697248 - DNA, 18 bp, Homo sapiens
attttttaaattgaattc

SEQ ID NO: 4697249 - DNA, 18 bp, Homo sapiens
atttttttaatttacaaa

SEQ ID NO: 4697250 - DNA, 16 bp, Homo sapiens
atttttttgagacaga

SEQ ID NO: 4697251 - DNA, 19 bp, Homo sapiens
attttttttaagttcactt

SEQ ID NO: 4697252 - DNA, 19 bp, Homo sapiens
attttttttcaaaaatgct

SEQ ID NO: 4697253 - DNA, 21 bp, Homo sapiens
atttttttttaagctctgagc

SEQ ID NO: 4697254 - DNA, 16 bp, Homo sapiens
caaaaagaaaaatcaa

SEQ ID NO: 4697255 - DNA, 18 bp, Homo sapiens
caaaaatagttaaaatgc

SEQ ID NO: 4697256 - DNA, 21 bp, Homo sapiens
caaaaccatcttctgtgttta

SEQ ID NO: 4697257 - DNA, 23 bp, Homo sapiens
caaaaccatcttctgtgtttatg

SEQ ID NO: 4697258 - DNA, 15 bp, Homo sapiens
caaaactagaattgt

SEQ ID NO: 4697259 - DNA, 19 bp, Homo sapiens
caaaactctcctctgctgc

SEQ ID NO: 4697260 - DNA, 19 bp, Homo sapiens
caaaagcaggcttgtgctt

SEQ ID NO: 4697261 - DNA, 17 bp, Homo sapiens
caaaagctgtgtctctg

SEQ ID NO: 4697262 - DNA, 14 bp, Homo sapiens
caaaagtttctctt

SEQ ID NO: 4697263 - DNA, 12 bp, Homo sapiens
caaaataaagtg

SEQ ID NO: 4697264 - DNA, 20 bp, Homo sapiens
caaaatagcttattatagaa

SEQ ID NO: 4697265 - DNA, 22 bp, Homo sapiens
caaaatatattttgtttacaaa

SEQ ID NO: 4697266 - DNA, 17 bp, Homo sapiens
caaaatatttttataga

SEQ ID NO: 4697267 - DNA, 16 bp, Homo sapiens
caaaatccccttctca

SEQ ID NO: 4697268 - DNA, 21 bp, Homo sapiens
caaaatgcctttttgtttacc

SEQ ID NO: 4697269 - DNA, 18 bp, Homo sapiens
caaaatgcgtatttgcat

SEQ ID NO: 4697270 - DNA, 18 bp, Homo sapiens
caaaatgttctatttaac

SEQ ID NO: 4697271 - DNA, 19 bp, Homo sapiens
caaaatgttctatttaaca

SEQ ID NO: 4697272 - DNA, 18 bp, Homo sapiens
caaaatttctgatgagat

SEQ ID NO: 4697273 - DNA, 19 bp, Homo sapiens
caaacacaatggagtgtgt

SEQ ID NO: 4697274 - DNA, 20 bp, Homo sapiens
caaacactgcaggcatcaca

SEQ ID NO: 4697275 - DNA, 18 bp, Homo sapiens
caaacactgtgatgttgg

SEQ ID NO: 4697276 - DNA, 22 bp, Homo sapiens
caaacagtgaatttaagcatga

SEQ ID NO: 4697277 - DNA, 14 bp, Homo sapiens
caaacatgaaaaca

SEQ ID NO: 4697278 - DNA, 21 bp, Homo sapiens
caaacatgaccctaaatcttg

SEQ ID NO: 4697279 - DNA, 14 bp, Homo sapiens
caaacatgtgcaac

SEQ ID NO: 4697280 - DNA, 18 bp, Homo sapiens
caaacatgtggttaatgc

SEQ ID NO: 4697281 - DNA, 17 bp, Homo sapiens
caaaccttgaggagaag

SEQ ID NO: 4697282 - DNA, 13 bp, Homo sapiens
caaactagggcca

SEQ ID NO: 4697283 - DNA, 13 bp, Homo sapiens
caaagaaaaacaa

SEQ ID NO: 4697284 - DNA, 18 bp, Homo sapiens
caaagaaaatgaaatgca

SEQ ID NO: 4697285 - DNA, 21 bp, Homo sapiens
caaagaaaatgaaatgcatat

SEQ ID NO: 4697286 - DNA, 17 bp, Homo sapiens
caaagaaacaaagatgt

SEQ ID NO: 4697287 - DNA, 13 bp, Homo sapiens
caaagaagtggtt

SEQ ID NO: 4697288 - DNA, 15 bp, Homo sapiens
caaagcaaggaaact

SEQ ID NO: 4697289 - DNA, 21 bp, Homo sapiens
caaagccaaagctaggcctgg

SEQ ID NO: 4697290 - DNA, 22 bp, Homo sapiens
caaagccaaagctaggcctggc

SEQ ID NO: 4697291 - DNA, 18 bp, Homo sapiens
caaagctaggcctggcca

SEQ ID NO: 4697292 - DNA, 18 bp, Homo sapiens
caaaggaggacaagaccc

SEQ ID NO: 4697293 - DNA, 15 bp, Homo sapiens
caaaggcaagcactt

SEQ ID NO: 4697294 - DNA, 19 bp, Homo sapiens
caaaggccatggagagctg

SEQ ID NO: 4697295 - DNA, 20 bp, Homo sapiens
caaaggccatggagagctgg

SEQ ID NO: 4697296 - DNA, 14 bp, Homo sapiens
caaaggctgagaac

SEQ ID NO: 4697297 - DNA, 12 bp, Homo sapiens
caaaggctggga

SEQ ID NO: 4697298 - DNA, 16 bp, Homo sapiens
caaagggtatcaggtg

SEQ ID NO: 4697299 - DNA, 14 bp, Homo sapiens
caaagtatcaaaga

SEQ ID NO: 4697300 - DNA, 16 bp, Homo sapiens
caaagtatcaaagaaa

SEQ ID NO: 4697301 - DNA, 20 bp, Homo sapiens
caaagtcatgcaaaggctgg

SEQ ID NO: 4697302 - DNA, 21 bp, Homo sapiens
caaagtcatgcaaaggctggg

SEQ ID NO: 4697303 - DNA, 20 bp, Homo sapiens
caaagtctgctctcatataa

SEQ ID NO: 4697304 - DNA, 23 bp, Homo sapiens
caaagtgctgggattacaggtgt

SEQ ID NO: 4697305 - DNA, 14 bp, Homo sapiens
caaagtggaacgaa

SEQ ID NO: 4697306 - DNA, 22 bp, Homo sapiens
caaagtgtattaggaagtgttt

SEQ ID NO: 4697307 - DNA, 15 bp, Homo sapiens
caaagttaaaagtaa

SEQ ID NO: 4697308 - DNA, 17 bp, Homo sapiens
caaagttaaaattgtta

SEQ ID NO: 4697309 - DNA, 13 bp, Homo sapiens
caaagttccagtt

SEQ ID NO: 4697310 - DNA, 20 bp, Homo sapiens
caaagttttgaaaagctatt

SEQ ID NO: 4697311 - DNA, 15 bp, Homo sapiens
caaataaaaataaca

SEQ ID NO: 4697312 - DNA, 23 bp, Homo sapiens
cacaccaagctgtgccaccctgg

SEQ ID NO: 4697313 - DNA, 14 bp, Homo sapiens
cacacccagcccac

SEQ ID NO: 4697314 - DNA, 17 bp, Homo sapiens
cacacctgagccagcct

SEQ ID NO: 4697315 - DNA, 19 bp, Homo sapiens
cacacgcacgcacacacac

SEQ ID NO: 4697316 - DNA, 13 bp, Homo sapiens
cacactaaaattt

SEQ ID NO: 4697317 - DNA, 17 bp, Homo sapiens
cacactcagttctgctc

SEQ ID NO: 4697318 - DNA, 18 bp, Homo sapiens
cacagaccctgccctgtg

SEQ ID NO: 4697319 - DNA, 12 bp, Homo sapiens
cacagagaaagt

SEQ ID NO: 4697320 - DNA, 17 bp, Homo sapiens
cacagatgaaacacaaa

SEQ ID NO: 4697321 - DNA, 14 bp, Homo sapiens
cacagatgggtgct

SEQ ID NO: 4697322 - DNA, 20 bp, Homo sapiens
cacagatgggtgcttggagg

SEQ ID NO: 4697323 - DNA, 16 bp, Homo sapiens
cacagatttgagctca

SEQ ID NO: 4697324 - DNA, 18 bp, Homo sapiens
cacagatttgagctcagc

SEQ ID NO: 4697325 - DNA, 18 bp, Homo sapiens
cacagcaaggaggctggc

SEQ ID NO: 4697326 - DNA, 22 bp, Homo sapiens
cacagcaaggaggctggctggg

SEQ ID NO: 4697327 - DNA, 17 bp, Homo sapiens
cacagcaaggcacctgc

SEQ ID NO: 4697328 - DNA, 16 bp, Homo sapiens
cacagcaattcctcag

SEQ ID NO: 4697329 - DNA, 23 bp, Homo sapiens
cacagcatcgtgatcactgagcc

SEQ ID NO: 4697330 - DNA, 16 bp, Homo sapiens
cacagcattgtatatg

SEQ ID NO: 4697331 - DNA, 16 bp, Homo sapiens
cacagccaaatttaaa

SEQ ID NO: 4697332 - DNA, 19 bp, Homo sapiens
cacagccatcccagccttg

SEQ ID NO: 4697333 - DNA, 20 bp, Homo sapiens
cacagccatcccagccttgg

SEQ ID NO: 4697334 - DNA, 15 bp, Homo sapiens
cacagccctcccgcc

SEQ ID NO: 4697335 - DNA, 17 bp, Homo sapiens
cacagccctcccgcccc

SEQ ID NO: 4697336 - DNA, 18 bp, Homo sapiens
cacagccctcccgcccct

SEQ ID NO: 4697337 - DNA, 17 bp, Homo sapiens
cacagcctcccctgcca

SEQ ID NO: 4697338 - DNA, 19 bp, Homo sapiens
cacagcctcccctgccagg

SEQ ID NO: 4697339 - DNA, 21 bp, Homo sapiens
cacagcctcccctgccagggc

SEQ ID NO: 4697340 - DNA, 21 bp, Homo sapiens
cacagctaacaattgtgaagt

SEQ ID NO: 4697341 - DNA, 14 bp, Homo sapiens
cacagctctgtcct

SEQ ID NO: 4697342 - DNA, 17 bp, Homo sapiens
cacagctcttctccagg

SEQ ID NO: 4697343 - DNA, 20 bp, Homo sapiens
cacagctcttctccaggctg

SEQ ID NO: 4697344 - DNA, 15 bp, Homo sapiens
cacagctgctggaga

SEQ ID NO: 4697345 - DNA, 20 bp, Homo sapiens
cacagctgctggagactcct

SEQ ID NO: 4697346 - DNA, 22 bp, Homo sapiens
cacagcttcatttcctgtgtct

SEQ ID NO: 4697347 - DNA, 19 bp, Homo sapiens
cacaggagggagggggaag

SEQ ID NO: 4697348 - DNA, 21 bp, Homo sapiens
cacaggagggagggggaaggc

SEQ ID NO: 4697349 - DNA, 17 bp, Homo sapiens
cacaggatcagtctgat

SEQ ID NO: 4697350 - DNA, 14 bp, Homo sapiens
cacaggcccggctc

SEQ ID NO: 4697351 - DNA, 20 bp, Homo sapiens
cacaggcccggctccaggct

SEQ ID NO: 4697352 - DNA, 23 bp, Homo sapiens
cacaggcccggctccaggctcct

SEQ ID NO: 4697353 - DNA, 15 bp, Homo sapiens
cacaggcctgagatt

SEQ ID NO: 4697354 - DNA, 19 bp, Homo sapiens
cacaggcctgagatttcat

SEQ ID NO: 4697355 - DNA, 19 bp, Homo sapiens
cacagggtttggcccaagt

SEQ ID NO: 4697356 - DNA, 18 bp, Homo sapiens
cacaggtgggcttcccag

SEQ ID NO: 4697357 - DNA, 19 bp, Homo sapiens
cacagtacgaacctacagt

SEQ ID NO: 4697358 - DNA, 13 bp, Homo sapiens
cacagtccttacc

SEQ ID NO: 4697359 - DNA, 23 bp, Homo sapiens
cacagtccttaccagcagagcac

SEQ ID NO: 4697360 - DNA, 19 bp, Homo sapiens
cacagtgagtcgaggacag

SEQ ID NO: 4697361 - DNA, 20 bp, Homo sapiens
cacagtgagtcgaggacagg

SEQ ID NO: 4697362 - DNA, 22 bp, Homo sapiens
cacagtgagtcgaggacaggga

SEQ ID NO: 4697363 - DNA, 17 bp, Homo sapiens
cacagtgtctgggctga

SEQ ID NO: 4697364 - DNA, 21 bp, Homo sapiens
cacagtgtctgggctgactgg

SEQ ID NO: 4697365 - DNA, 22 bp, Homo sapiens
cacagttccctttatttcacat

SEQ ID NO: 4697366 - DNA, 14 bp, Homo sapiens
cacagttccttgca

SEQ ID NO: 4697367 - DNA, 20 bp, Homo sapiens
cacatatgataaaaaagtgt

SEQ ID NO: 4697368 - DNA, 17 bp, Homo sapiens
cacatctaaattgatca

SEQ ID NO: 4697369 - DNA, 12 bp, Homo sapiens
cacatctgtgtc

SEQ ID NO: 4697370 - DNA, 16 bp, Homo sapiens
cacatctgtgtcttgt

SEQ ID NO: 4697371 - DNA, 17 bp, Homo sapiens
cacatctgtgtcttgtt

SEQ ID NO: 4697372 - DNA, 17 bp, Homo sapiens
cacatcttgctctgctg

SEQ ID NO: 4697373 - DNA, 19 bp, Homo sapiens
cacatcttgctctgctgac

SEQ ID NO: 4697374 - DNA, 20 bp, Homo sapiens
cacatcttgctctgctgaca

SEQ ID NO: 4697375 - DNA, 16 bp, Homo sapiens
cacatctttactcagg

SEQ ID NO: 4697376 - DNA, 14 bp, Homo sapiens
cacatgtgcacatg

SEQ ID NO: 4697377 - DNA, 17 bp, Homo sapiens
cacatgtgcacatgcac

SEQ ID NO: 4697378 - DNA, 18 bp, Homo sapiens
cacatgtggagaaggtga

SEQ ID NO: 4697379 - DNA, 12 bp, Homo sapiens
cacatgttcata

SEQ ID NO: 4697380 - DNA, 13 bp, Homo sapiens
cacattaaagtta

SEQ ID NO: 4697381 - DNA, 13 bp, Homo sapiens
cacattgaagaat

SEQ ID NO: 4697382 - DNA, 23 bp, Homo sapiens
cacattgaagaatgttagagtaa

SEQ ID NO: 4697383 - DNA, 17 bp, Homo sapiens
cacatttattctgctca

SEQ ID NO: 4697384 - DNA, 18 bp, Homo sapiens
cacatttttcagatataa

SEQ ID NO: 4697385 - DNA, 17 bp, Homo sapiens
caccaacatactcccat

SEQ ID NO: 4697386 - DNA, 13 bp, Homo sapiens
caccaacccagcc

SEQ ID NO: 4697387 - DNA, 17 bp, Homo sapiens
caccaacccagccgctg

SEQ ID NO: 4697388 - DNA, 16 bp, Homo sapiens
caccaacgtctgtgcc

SEQ ID NO: 4697389 - DNA, 16 bp, Homo sapiens
caccaagctcaaagcg

SEQ ID NO: 4697390 - DNA, 18 bp, Homo sapiens
caccaagctgtgccaccc

SEQ ID NO: 4697391 - DNA, 23 bp, Homo sapiens
caccaagctgtgccaccctgggc

SEQ ID NO: 4697392 - DNA, 21 bp, Homo sapiens
caccaattggataaagcagct

SEQ ID NO: 4697393 - DNA, 20 bp, Homo sapiens
caccacagcttatggcatct

SEQ ID NO: 4697394 - DNA, 19 bp, Homo sapiens
caccacatgtgcacatgca

SEQ ID NO: 4697395 - DNA, 18 bp, Homo sapiens
caccaccacggtggtcac

SEQ ID NO: 4697396 - DNA, 13 bp, Homo sapiens
caccacctcagag

SEQ ID NO: 4697397 - DNA, 14 bp, Homo sapiens
caccacctgctcac

SEQ ID NO: 4697398 - DNA, 17 bp, Homo sapiens
caccagagcccaccttg

SEQ ID NO: 4697399 - DNA, 18 bp, Homo sapiens
caccagagcccaccttgg

SEQ ID NO: 4697400 - DNA, 20 bp, Homo sapiens
caccagagcccaccttggct

SEQ ID NO: 4697401 - DNA, 22 bp, Homo sapiens
caccagagcccaccttggctca

SEQ ID NO: 4697402 - DNA, 17 bp, Homo sapiens
caccagccccagtgccc

SEQ ID NO: 4697403 - DNA, 21 bp, Homo sapiens
caccagcccttagcagggaaa

SEQ ID NO: 4697404 - DNA, 12 bp, Homo sapiens
caccaggggcag

SEQ ID NO: 4697405 - DNA, 13 bp, Homo sapiens
caccaggggcagg

SEQ ID NO: 4697406 - DNA, 18 bp, Homo sapiens
caccaggggcaggcacag

SEQ ID NO: 4697407 - DNA, 19 bp, Homo sapiens
caccaggggcaggcacagc

SEQ ID NO: 4697408 - DNA, 21 bp, Homo sapiens
caccaggggcaggcacagcac

SEQ ID NO: 4697409 - DNA, 17 bp, Homo sapiens
caccataatccctgtct

SEQ ID NO: 4697410 - DNA, 16 bp, Homo sapiens
caccatcaagccacca

SEQ ID NO: 4697411 - DNA, 24 bp, Homo sapiens
caccatcaagccaccaacatactc

SEQ ID NO: 4697412 - DNA, 15 bp, Homo sapiens
caccatcatgtctgg

SEQ ID NO: 4697413 - DNA, 18 bp, Homo sapiens
caccatcatgtctggcta

SEQ ID NO: 4697414 - DNA, 21 bp, Homo sapiens
caccatgcagtgcccctagct

SEQ ID NO: 4697415 - DNA, 15 bp, Homo sapiens
cacccaagggcctgg

SEQ ID NO: 4697416 - DNA, 17 bp, Homo sapiens
cacccacctcagcctcc

SEQ ID NO: 4697417 - DNA, 18 bp, Homo sapiens
cacccacctcagcctccc

SEQ ID NO: 4697418 - DNA, 21 bp, Homo sapiens
cacccactctcctctgcctca

SEQ ID NO: 4697419 - DNA, 15 bp, Homo sapiens
cacccacttctgcac

SEQ ID NO: 4697420 - DNA, 12 bp, Homo sapiens
cacccagcccac

SEQ ID NO: 4697421 - DNA, 16 bp, Homo sapiens
cagacgcctgaggaac

SEQ ID NO: 4697422 - DNA, 18 bp, Homo sapiens
cagactaagccagcaccg

SEQ ID NO: 4697423 - DNA, 16 bp, Homo sapiens
cagactccagctgtga

SEQ ID NO: 4697424 - DNA, 18 bp, Homo sapiens
cagactccagctgtgaag

SEQ ID NO: 4697425 - DNA, 17 bp, Homo sapiens
cagactctacagaggcc

SEQ ID NO: 4697426 - DNA, 17 bp, Homo sapiens
cagactggaagcacagc

SEQ ID NO: 4697427 - DNA, 18 bp, Homo sapiens
cagactggaagcacagct

SEQ ID NO: 4697428 - DNA, 20 bp, Homo sapiens
cagactttttttaaatagta

SEQ ID NO: 4697429 - DNA, 15 bp, Homo sapiens
cagagaaaagcaggc

SEQ ID NO: 4697430 - DNA, 18 bp, Homo sapiens
cagagaaaatgaatttgg

SEQ ID NO: 4697431 - DNA, 13 bp, Homo sapiens
cagagaaaattaa

SEQ ID NO: 4697432 - DNA, 13 bp, Homo sapiens
cagagaaagagga

SEQ ID NO: 4697433 - DNA, 19 bp, Homo sapiens
cagagaatgaaagggccca

SEQ ID NO: 4697434 - DNA, 21 bp, Homo sapiens
cagagacactgttgataaaaa

SEQ ID NO: 4697435 - DNA, 21 bp, Homo sapiens
cagagaccatccctgaaggcc

SEQ ID NO: 4697436 - DNA, 16 bp, Homo sapiens
cagagactcctgcagg

SEQ ID NO: 4697437 - DNA, 18 bp, Homo sapiens
cagagactcctgcaggca

SEQ ID NO: 4697438 - DNA, 22 bp, Homo sapiens
cagagactcctgcaggcagcca

SEQ ID NO: 4697439 - DNA, 18 bp, Homo sapiens
cagagacttgggacattg

SEQ ID NO: 4697440 - DNA, 20 bp, Homo sapiens
cagagacttgggacattgcc

SEQ ID NO: 4697441 - DNA, 20 bp, Homo sapiens
cagagaggacaaaataaagt

SEQ ID NO: 4697442 - DNA, 17 bp, Homo sapiens
cagagagggtggtgacc

SEQ ID NO: 4697443 - DNA, 23 bp, Homo sapiens
cagagagggtggtgacctctgcc

SEQ ID NO: 4697444 - DNA, 21 bp, Homo sapiens
cagagatcctacttctctgag

SEQ ID NO: 4697445 - DNA, 22 bp, Homo sapiens
cagagattggaatgggcagctc

SEQ ID NO: 4697446 - DNA, 23 bp, Homo sapiens
cagagattggaatgggcagctca

SEQ ID NO: 4697447 - DNA, 12 bp, Homo sapiens
cagagcagagac

SEQ ID NO: 4697448 - DNA, 13 bp, Homo sapiens
cagagcagagacc

SEQ ID NO: 4697449 - DNA, 17 bp, Homo sapiens
cagagcagagaccatcc

SEQ ID NO: 4697450 - DNA, 14 bp, Homo sapiens
cagagcagatgcag

SEQ ID NO: 4697451 - DNA, 15 bp, Homo sapiens
cagagcagatgcaga

SEQ ID NO: 4697452 - DNA, 20 bp, Homo sapiens
cagagcagatgcagagagcc

SEQ ID NO: 4697453 - DNA, 21 bp, Homo sapiens
cagagcccacgcccccactgg

SEQ ID NO: 4697454 - DNA, 23 bp, Homo sapiens
cagagcccacgcccccactggtg

SEQ ID NO: 4697455 - DNA, 20 bp, Homo sapiens
cagagccgtggtcctttggg

SEQ ID NO: 4697456 - DNA, 14 bp, Homo sapiens
cagagctctctgag

SEQ ID NO: 4697457 - DNA, 14 bp, Homo sapiens
cagagctctgaccc

SEQ ID NO: 4697458 - DNA, 17 bp, Homo sapiens
cagagctctgacccaca

SEQ ID NO: 4697459 - DNA, 13 bp, Homo sapiens
cagagctgcttct

SEQ ID NO: 4697460 - DNA, 15 bp, Homo sapiens
cagagctgcttctgt

SEQ ID NO: 4697461 - DNA, 14 bp, Homo sapiens
cagagcttccctga

SEQ ID NO: 4697462 - DNA, 18 bp, Homo sapiens
cagagcttccctgactca

SEQ ID NO: 4697463 - DNA, 23 bp, Homo sapiens
cagagcttccctgactcattctg

SEQ ID NO: 4697464 - DNA, 19 bp, Homo sapiens
cagagcttggactggatgc

SEQ ID NO: 4697465 - DNA, 18 bp, Homo sapiens
cagaggaaggggccagag

SEQ ID NO: 4697466 - DNA, 14 bp, Homo sapiens
cagaggagggcagc

SEQ ID NO: 4697467 - DNA, 22 bp, Homo sapiens
cagaggagggcagcagaagggg

SEQ ID NO: 4697468 - DNA, 17 bp, Homo sapiens
cagaggagtacaggtga

SEQ ID NO: 4697469 - DNA, 21 bp, Homo sapiens
cagaggattgctgccccatca

SEQ ID NO: 4697470 - DNA, 18 bp, Homo sapiens
cagaggcagccccattct

SEQ ID NO: 4697471 - DNA, 19 bp, Homo sapiens
cagaggcagccccattctg

SEQ ID NO: 4697472 - DNA, 19 bp, Homo sapiens
cagaggccatgggcctcct

SEQ ID NO: 4697473 - DNA, 21 bp, Homo sapiens
cagaggccatgggcctcctgt

SEQ ID NO: 4697474 - DNA, 16 bp, Homo sapiens
cagagggagtgacaga

SEQ ID NO: 4697475 - DNA, 18 bp, Homo sapiens
cagagggagtgacagagg

SEQ ID NO: 4697476 - DNA, 14 bp, Homo sapiens
cagagggcactctg

SEQ ID NO: 4697477 - DNA, 15 bp, Homo sapiens
cagagggcctgcaag

SEQ ID NO: 4697478 - DNA, 18 bp, Homo sapiens
cagaggggcaggccctgc

SEQ ID NO: 4697479 - DNA, 22 bp, Homo sapiens
cagaggggcaggccctgcactg

SEQ ID NO: 4697480 - DNA, 21 bp, Homo sapiens
cagaggggcctgccacctgga

SEQ ID NO: 4697481 - DNA, 23 bp, Homo sapiens
cagaggggcctgccacctggacc

SEQ ID NO: 4697482 - DNA, 13 bp, Homo sapiens
cagagggggtggc

SEQ ID NO: 4697483 - DNA, 20 bp, Homo sapiens
cagagggggtggcctcccaa

SEQ ID NO: 4697484 - DNA, 22 bp, Homo sapiens
cagagggggtggcctcccaact

SEQ ID NO: 4697485 - DNA, 23 bp, Homo sapiens
cagagggggtggcctcccaactc

SEQ ID NO: 4697486 - DNA, 13 bp, Homo sapiens
cagaggtaacaga

SEQ ID NO: 4697487 - DNA, 15 bp, Homo sapiens
cagaggtaacagaac

SEQ ID NO: 4697488 - DNA, 19 bp, Homo sapiens
cagaggtaacagaacagct

SEQ ID NO: 4697489 - DNA, 22 bp, Homo sapiens
cagaggtaacagaacagcttca

SEQ ID NO: 4697490 - DNA, 23 bp, Homo sapiens
cagaggtaacagaacagcttcag

SEQ ID NO: 4697491 - DNA, 21 bp, Homo sapiens
cagaggttatctgtcccaggt

SEQ ID NO: 4697492 - DNA, 13 bp, Homo sapiens
cagagtatttctg

SEQ ID NO: 4697493 - DNA, 21 bp, Homo sapiens
cagagtcacacgggggcagct

SEQ ID NO: 4697494 - DNA, 13 bp, Homo sapiens
cagagtctcactg

SEQ ID NO: 4697495 - DNA, 20 bp, Homo sapiens
cagagtctcactgttgccca

SEQ ID NO: 4697496 - DNA, 22 bp, Homo sapiens
cagagtctcactgttgcccagg

SEQ ID NO: 4697497 - DNA, 15 bp, Homo sapiens
cagagtgagacccag

SEQ ID NO: 4697498 - DNA, 20 bp, Homo sapiens
cagagtgagacccagccctc

SEQ ID NO: 4697499 - DNA, 23 bp, Homo sapiens
cagagtggagttgaaactgctat

SEQ ID NO: 4697500 - DNA, 23 bp, Homo sapiens
cagatacaggaaaagctgctgac

SEQ ID NO: 4697501 - DNA, 20 bp, Homo sapiens
cagatagtgtagctgaggag

SEQ ID NO: 4697502 - DNA, 17 bp, Homo sapiens
cagatatatttaagcct

SEQ ID NO: 4697503 - DNA, 22 bp, Homo sapiens
cagatatcatactgatttttaa

SEQ ID NO: 4697504 - DNA, 18 bp, Homo sapiens
cagatatttatgtatctt

SEQ ID NO: 4697505 - DNA, 17 bp, Homo sapiens
cagatcaggcagtgttt

SEQ ID NO: 4697506 - DNA, 20 bp, Homo sapiens
cagatcaggcagtgtttaaa

SEQ ID NO: 4697507 - DNA, 19 bp, Homo sapiens
cagatccccaagcctggca

SEQ ID NO: 4697508 - DNA, 23 bp, Homo sapiens
cagatcctccatttttgttggga

SEQ ID NO: 4697509 - DNA, 18 bp, Homo sapiens
cagatcggatctgttgca

SEQ ID NO: 4697510 - DNA, 19 bp, Homo sapiens
cagatctaccccttactta

SEQ ID NO: 4697511 - DNA, 14 bp, Homo sapiens
cagatgcaccagcc

SEQ ID NO: 4697512 - DNA, 23 bp, Homo sapiens
cagatgggtgcttggaggaagga

SEQ ID NO: 4697513 - DNA, 14 bp, Homo sapiens
cagatgtccctgaa

SEQ ID NO: 4697514 - DNA, 20 bp, Homo sapiens
cagatgtccctgaagtcttg

SEQ ID NO: 4697515 - DNA, 22 bp, Homo sapiens
cagatgtccctgaagtcttgca

SEQ ID NO: 4697516 - DNA, 19 bp, Homo sapiens
cagatgtgagggcaccacc

SEQ ID NO: 4697517 - DNA, 20 bp, Homo sapiens
cagatgtgagggcaccacca

SEQ ID NO: 4697518 - DNA, 22 bp, Homo sapiens
cagattgagttttcttctgtga

SEQ ID NO: 4697519 - DNA, 18 bp, Homo sapiens
cagattgcaacaggctgg

SEQ ID NO: 4697520 - DNA, 19 bp, Homo sapiens
cagattgcaacaggctggg

SEQ ID NO: 4697521 - DNA, 20 bp, Homo sapiens
cagattgcaacaggctgggc

SEQ ID NO: 4697522 - DNA, 20 bp, Homo sapiens
cagattggctcacactgaga

SEQ ID NO: 4697523 - DNA, 21 bp, Homo sapiens
cagattttatttatatcttta

SEQ ID NO: 4697524 - DNA, 23 bp, Homo sapiens
cagcaactatcagactaagccag

SEQ ID NO: 4697525 - DNA, 19 bp, Homo sapiens
cagcaaggaggctggctgg

SEQ ID NO: 4697526 - DNA, 16 bp, Homo sapiens
cagcaaggcacctgca

SEQ ID NO: 4697527 - DNA, 21 bp, Homo sapiens
cagcaagtgagagctgggtgt

SEQ ID NO: 4697528 - DNA, 15 bp, Homo sapiens
cagcaatattctgat

SEQ ID NO: 4697529 - DNA, 13 bp, Homo sapiens
caggctacactga

SEQ ID NO: 4697530 - DNA, 15 bp, Homo sapiens
caggctagaacctgg

SEQ ID NO: 4697531 - DNA, 16 bp, Homo sapiens
caggctctgagacaca

SEQ ID NO: 4697532 - DNA, 17 bp, Homo sapiens
caggctgagcctcagtc

SEQ ID NO: 4697533 - DNA, 12 bp, Homo sapiens
caggctgctctt

SEQ ID NO: 4697534 - DNA, 13 bp, Homo sapiens
caggctggccagc

SEQ ID NO: 4697535 - DNA, 19 bp, Homo sapiens
caggctggccagccccaca

SEQ ID NO: 4697536 - DNA, 18 bp, Homo sapiens
caggctggccctgccctg

SEQ ID NO: 4697537 - DNA, 14 bp, Homo sapiens
caggctgggagagc

SEQ ID NO: 4697538 - DNA, 15 bp, Homo sapiens
caggctgggagagcc

SEQ ID NO: 4697539 - DNA, 19 bp, Homo sapiens
caggctgggagagccttcc

SEQ ID NO: 4697540 - DNA, 21 bp, Homo sapiens
caggctgggagagccttccag

SEQ ID NO: 4697541 - DNA, 19 bp, Homo sapiens
caggctgggcttcagtggc

SEQ ID NO: 4697542 - DNA, 22 bp, Homo sapiens
caggctgggcttcagtggcagc

SEQ ID NO: 4697543 - DNA, 22 bp, Homo sapiens
caggctgtatcccatgagcctc

SEQ ID NO: 4697544 - DNA, 23 bp, Homo sapiens
caggctgtatcccatgagcctca

SEQ ID NO: 4697545 - DNA, 13 bp, Homo sapiens
caggctgtcccaa

SEQ ID NO: 4697546 - DNA, 23 bp, Homo sapiens
caggctgtcccaagctcccaaga

SEQ ID NO: 4697547 - DNA, 21 bp, Homo sapiens
caggcttagtcactgagacag

SEQ ID NO: 4697548 - DNA, 19 bp, Homo sapiens
caggcttttccaggaagat

SEQ ID NO: 4697549 - DNA, 20 bp, Homo sapiens
cagggaaaattatttgcata

SEQ ID NO: 4697550 - DNA, 20 bp, Homo sapiens
cagggaacatatttaaggaa

SEQ ID NO: 4697551 - DNA, 15 bp, Homo sapiens
cagggaaggggacaa

SEQ ID NO: 4697552 - DNA, 13 bp, Homo sapiens
cagggacagaggg

SEQ ID NO: 4697553 - DNA, 14 bp, Homo sapiens
cagggacagagggg

SEQ ID NO: 4697554 - DNA, 23 bp, Homo sapiens
cagggacagagggggtggcctcc

SEQ ID NO: 4697555 - DNA, 20 bp, Homo sapiens
cagggaccacagcaaggcac

SEQ ID NO: 4697556 - DNA, 14 bp, Homo sapiens
cagggagagcccag

SEQ ID NO: 4697557 - DNA, 15 bp, Homo sapiens
cagggagagcccagg

SEQ ID NO: 4697558 - DNA, 23 bp, Homo sapiens
cagggagaggagtgactgagctt

SEQ ID NO: 4697559 - DNA, 21 bp, Homo sapiens
cagggatgagcatggagctgg

SEQ ID NO: 4697560 - DNA, 15 bp, Homo sapiens
cagggcacaccgggc

SEQ ID NO: 4697561 - DNA, 17 bp, Homo sapiens
cagggcacaccgggcac

SEQ ID NO: 4697562 - DNA, 21 bp, Homo sapiens
cagggcacaccgggcactcag

SEQ ID NO: 4697563 - DNA, 22 bp, Homo sapiens
cagggcacaccgggcactcaga

SEQ ID NO: 4697564 - DNA, 13 bp, Homo sapiens
cagggcagagtga

SEQ ID NO: 4697565 - DNA, 19 bp, Homo sapiens
cagggcagagtgagaccca

SEQ ID NO: 4697566 - DNA, 13 bp, Homo sapiens
cagggcagccagg

SEQ ID NO: 4697567 - DNA, 15 bp, Homo sapiens
cagggcagccaggga

SEQ ID NO: 4697568 - DNA, 22 bp, Homo sapiens
cagggcagccagggagagccca

SEQ ID NO: 4697569 - DNA, 13 bp, Homo sapiens
cagggcctaggac

SEQ ID NO: 4697570 - DNA, 13 bp, Homo sapiens
cagggcctggctc

SEQ ID NO: 4697571 - DNA, 14 bp, Homo sapiens
cagggcctggctca

SEQ ID NO: 4697572 - DNA, 18 bp, Homo sapiens
cagggctaccctgagctg

SEQ ID NO: 4697573 - DNA, 19 bp, Homo sapiens
cagggctaccctgagctga

SEQ ID NO: 4697574 - DNA, 20 bp, Homo sapiens
cagggctcagcggggacagc

SEQ ID NO: 4697575 - DNA, 21 bp, Homo sapiens
cagggctcagcggggacagct

SEQ ID NO: 4697576 - DNA, 12 bp, Homo sapiens
cagggctcctgg

SEQ ID NO: 4697577 - DNA, 18 bp, Homo sapiens
cagggctgctagacggag

SEQ ID NO: 4697578 - DNA, 14 bp, Homo sapiens
caggggcaggcaca

SEQ ID NO: 4697579 - DNA, 15 bp, Homo sapiens
caggggcaggcacag

SEQ ID NO: 4697580 - DNA, 16 bp, Homo sapiens
caggggcaggcacagc

SEQ ID NO: 4697581 - DNA, 20 bp, Homo sapiens
caggggtgggacaccctgtg

SEQ ID NO: 4697582 - DNA, 22 bp, Homo sapiens
cagggtccacaggaagtgaaga

SEQ ID NO: 4697583 - DNA, 22 bp, Homo sapiens
cagggtccctggtggcagctca

SEQ ID NO: 4697584 - DNA, 23 bp, Homo sapiens
cagggtccctggtggcagctcac

SEQ ID NO: 4697585 - DNA, 22 bp, Homo sapiens
cagggtctcactatgttgccca

SEQ ID NO: 4697586 - DNA, 17 bp, Homo sapiens
cagggtctcactctgtc

SEQ ID NO: 4697587 - DNA, 18 bp, Homo sapiens
cagggtctcactctgtcg

SEQ ID NO: 4697588 - DNA, 13 bp, Homo sapiens
cagggtctctgct

SEQ ID NO: 4697589 - DNA, 16 bp, Homo sapiens
cagggtctctgctgcc

SEQ ID NO: 4697590 - DNA, 18 bp, Homo sapiens
cagggtctctgctgccgc

SEQ ID NO: 4697591 - DNA, 14 bp, Homo sapiens
cagggtctgggcag

SEQ ID NO: 4697592 - DNA, 15 bp, Homo sapiens
cagggttggcccctg

SEQ ID NO: 4697593 - DNA, 21 bp, Homo sapiens
cagggttggcccctgcccggc

SEQ ID NO: 4697594 - DNA, 17 bp, Homo sapiens
caggtaatcgacctgcc

SEQ ID NO: 4697595 - DNA, 19 bp, Homo sapiens
caggtctcctccaccgcca

SEQ ID NO: 4697596 - DNA, 20 bp, Homo sapiens
caggtcttgaactcctggcc

SEQ ID NO: 4697597 - DNA, 12 bp, Homo sapiens
caggtgacatgt

SEQ ID NO: 4697598 - DNA, 17 bp, Homo sapiens
caggtgacatgtgaaac

SEQ ID NO: 4697599 - DNA, 15 bp, Homo sapiens
caggtgagcccatgg

SEQ ID NO: 4697600 - DNA, 23 bp, Homo sapiens
caggtgatccacccacctcagcc

SEQ ID NO: 4697601 - DNA, 15 bp, Homo sapiens
caggtgcacaagctc

SEQ ID NO: 4697602 - DNA, 17 bp, Homo sapiens
caggtgcacaagctcca

SEQ ID NO: 4697603 - DNA, 21 bp, Homo sapiens
caggtgcacaagctccaagct

SEQ ID NO: 4697604 - DNA, 18 bp, Homo sapiens
caggtgcagcccccactg

SEQ ID NO: 4697605 - DNA, 20 bp, Homo sapiens
caggtgctaatttgttttgg

SEQ ID NO: 4697606 - DNA, 12 bp, Homo sapiens
caggtgctgtga

SEQ ID NO: 4697607 - DNA, 22 bp, Homo sapiens
caggtgggcgggcagcacagca

SEQ ID NO: 4697608 - DNA, 22 bp, Homo sapiens
caggtgggcttcccagtggctg

SEQ ID NO: 4697609 - DNA, 19 bp, Homo sapiens
caggtggggagactgggct

SEQ ID NO: 4697610 - DNA, 20 bp, Homo sapiens
caggtggggagactgggctg

SEQ ID NO: 4697611 - DNA, 14 bp, Homo sapiens
caggtggggcagct

SEQ ID NO: 4697612 - DNA, 15 bp, Homo sapiens
caggtggggcagctt

SEQ ID NO: 4697613 - DNA, 17 bp, Homo sapiens
caggtggggcagcttga

SEQ ID NO: 4697614 - DNA, 23 bp, Homo sapiens
caggtggggtcactctggcagct

SEQ ID NO: 4697615 - DNA, 14 bp, Homo sapiens
caggtgtccctgca

SEQ ID NO: 4697616 - DNA, 15 bp, Homo sapiens
caggtgtccctgcac

SEQ ID NO: 4697617 - DNA, 18 bp, Homo sapiens
caggtgtccctgcacttg

SEQ ID NO: 4697618 - DNA, 19 bp, Homo sapiens
caggtgtccctgcacttgc

SEQ ID NO: 4697619 - DNA, 21 bp, Homo sapiens
caggtgtgagccaccacgccc

SEQ ID NO: 4697620 - DNA, 16 bp, Homo sapiens
caggtgtgagtcacca

SEQ ID NO: 4697621 - DNA, 20 bp, Homo sapiens
caggtgtgagtcaccaagcc

SEQ ID NO: 4697622 - DNA, 22 bp, Homo sapiens
caggtgtgagtcaccaagccca

SEQ ID NO: 4697623 - DNA, 15 bp, Homo sapiens
caggttataacagtg

SEQ ID NO: 4697624 - DNA, 16 bp, Homo sapiens
caggttataacagtgt

SEQ ID NO: 4697625 - DNA, 17 bp, Homo sapiens
caggttataacagtgtt

SEQ ID NO: 4697626 - DNA, 23 bp, Homo sapiens
caggttatcgaaataacaatgtt

SEQ ID NO: 4697627 - DNA, 16 bp, Homo sapiens
caggttatctgggcat

SEQ ID NO: 4697628 - DNA, 18 bp, Homo sapiens
caggttggaaaagaaatc

SEQ ID NO: 4697629 - DNA, 19 bp, Homo sapiens
caggttggaaaagaaatca

SEQ ID NO: 4697630 - DNA, 17 bp, Homo sapiens
caggtttctggtctcta

SEQ ID NO: 4697631 - DNA, 20 bp, Homo sapiens
caggttttcttctaatcata

SEQ ID NO: 4697632 - DNA, 24 bp, Homo sapiens
caggttttcttctaatcataacat

SEQ ID NO: 4697633 - DNA, 16 bp, Homo sapiens
cagtaaacagaggagt

SEQ ID NO: 4697634 - DNA, 19 bp, Homo sapiens
cagtaagtagcaaccctgt

SEQ ID NO: 4697635 - DNA, 18 bp, Homo sapiens
cagtaagtatctggagga

SEQ ID NO: 4697636 - DNA, 15 bp, Homo sapiens
cagtaagttatcttt

SEQ ID NO: 4697637 - DNA, 15 bp, Homo sapiens
cagtacccttggcct

SEQ ID NO: 4697638 - DNA, 13 bp, Homo sapiens
catctgcagcctc

SEQ ID NO: 4697639 - DNA, 12 bp, Homo sapiens
catctgcccagg

SEQ ID NO: 4697640 - DNA, 17 bp, Homo sapiens
catctgctactgtgtca

SEQ ID NO: 4697641 - DNA, 14 bp, Homo sapiens
catctgctctcctt

SEQ ID NO: 4697642 - DNA, 18 bp, Homo sapiens
catctgctctccttcctg

SEQ ID NO: 4697643 - DNA, 12 bp, Homo sapiens
catctggaacca

SEQ ID NO: 4697644 - DNA, 23 bp, Homo sapiens
catctggccgttgatgttggctg

SEQ ID NO: 4697645 - DNA, 11 bp, Homo sapiens
catctgggctc

SEQ ID NO: 4697646 - DNA, 23 bp, Homo sapiens
catctggtgtaggaagttttttc

SEQ ID NO: 4697647 - DNA, 17 bp, Homo sapiens
catctgtccctccggga

SEQ ID NO: 4697648 - DNA, 18 bp, Homo sapiens
catctgtccctccgggac

SEQ ID NO: 4697649 - DNA, 18 bp, Homo sapiens
catctgtgaaaggaaaga

SEQ ID NO: 4697650 - DNA, 15 bp, Homo sapiens
catctgtgcacgcag

SEQ ID NO: 4697651 - DNA, 11 bp, Homo sapiens
catctgtgtct

SEQ ID NO: 4697652 - DNA, 13 bp, Homo sapiens
catctgtgtcttg

SEQ ID NO: 4697653 - DNA, 15 bp, Homo sapiens
catcttaagagatgc

SEQ ID NO: 4697654 - DNA, 16 bp, Homo sapiens
catcttccaggtgggg

SEQ ID NO: 4697655 - DNA, 13 bp, Homo sapiens
catcttccctggc

SEQ ID NO: 4697656 - DNA, 20 bp, Homo sapiens
catcttgctctgctgacaga

SEQ ID NO: 4697657 - DNA, 17 bp, Homo sapiens
catctttgtatatttac

SEQ ID NO: 4697658 - DNA, 18 bp, Homo sapiens
catctttgtatatttaca

SEQ ID NO: 4697659 - DNA, 14 bp, Homo sapiens
catcttttcttgcc

SEQ ID NO: 4697660 - DNA, 21 bp, Homo sapiens
catcttttcttgcctctgtcc

SEQ ID NO: 4697661 - DNA, 13 bp, Homo sapiens
catgaaaacattg

SEQ ID NO: 4697662 - DNA, 14 bp, Homo sapiens
catgaaaacattga

SEQ ID NO: 4697663 - DNA, 22 bp, Homo sapiens
catgaaaatgcaacaacatgta

SEQ ID NO: 4697664 - DNA, 14 bp, Homo sapiens
catgaaactccacc

SEQ ID NO: 4697665 - DNA, 15 bp, Homo sapiens
catgaaactccacct

SEQ ID NO: 4697666 - DNA, 13 bp, Homo sapiens
catgaaataaaat

SEQ ID NO: 4697667 - DNA, 14 bp, Homo sapiens
catgaaataaaata

SEQ ID NO: 4697668 - DNA, 18 bp, Homo sapiens
catgaactacgtgacctc

SEQ ID NO: 4697669 - DNA, 13 bp, Homo sapiens
catgaagatattt

SEQ ID NO: 4697670 - DNA, 15 bp, Homo sapiens
catgaatctgcaatg

SEQ ID NO: 4697671 - DNA, 14 bp, Homo sapiens
catgaccacataga

SEQ ID NO: 4697672 - DNA, 17 bp, Homo sapiens
catgacccaggctgggc

SEQ ID NO: 4697673 - DNA, 22 bp, Homo sapiens
catgactgagtctggcaaacat

SEQ ID NO: 4697674 - DNA, 18 bp, Homo sapiens
catgagcatcaggccagg

SEQ ID NO: 4697675 - DNA, 20 bp, Homo sapiens
catgagcatcaggccaggcc

SEQ ID NO: 4697676 - DNA, 18 bp, Homo sapiens
catgagcctcagcatcct

SEQ ID NO: 4697677 - DNA, 19 bp, Homo sapiens
catgagcctcagcatcctg

SEQ ID NO: 4697678 - DNA, 22 bp, Homo sapiens
catgagcctcagcatcctggca

SEQ ID NO: 4697679 - DNA, 14 bp, Homo sapiens
catgagtcccctgt

SEQ ID NO: 4697680 - DNA, 15 bp, Homo sapiens
catgagtcccctgtt

SEQ ID NO: 4697681 - DNA, 18 bp, Homo sapiens
catgagtgcgtgctcagt

SEQ ID NO: 4697682 - DNA, 12 bp, Homo sapiens
catgagttattc

SEQ ID NO: 4697683 - DNA, 15 bp, Homo sapiens
catgatgctgggatt

SEQ ID NO: 4697684 - DNA, 14 bp, Homo sapiens
catgcaaaggctgg

SEQ ID NO: 4697685 - DNA, 21 bp, Homo sapiens
catgcacagtagattcaagtt

SEQ ID NO: 4697686 - DNA, 19 bp, Homo sapiens
catgcactgttccccctgt

SEQ ID NO: 4697687 - DNA, 13 bp, Homo sapiens
catgcataaatat

SEQ ID NO: 4697688 - DNA, 17 bp, Homo sapiens
catgcataaatatgcag

SEQ ID NO: 4697689 - DNA, 18 bp, Homo sapiens
catgcataaatatgcagt

SEQ ID NO: 4697690 - DNA, 22 bp, Homo sapiens
catgcatataatgaataaatca

SEQ ID NO: 4697691 - DNA, 23 bp, Homo sapiens
catgcctggatggggctgcaccg

SEQ ID NO: 4697692 - DNA, 13 bp, Homo sapiens
catgcctggcttc

SEQ ID NO: 4697693 - DNA, 22 bp, Homo sapiens
catgctctcatatatattttaa

SEQ ID NO: 4697694 - DNA, 17 bp, Homo sapiens
catgctcttagaaaatt

SEQ ID NO: 4697695 - DNA, 15 bp, Homo sapiens
catgctgccctgtga

SEQ ID NO: 4697696 - DNA, 16 bp, Homo sapiens
catgcttcacaatgtt

SEQ ID NO: 4697697 - DNA, 22 bp, Homo sapiens
catgcttggttttcttttttct

SEQ ID NO: 4697698 - DNA, 20 bp, Homo sapiens
catgcttttcttcctagtta

SEQ ID NO: 4697699 - DNA, 21 bp, Homo sapiens
catggaaattcccttcatctg

SEQ ID NO: 4697700 - DNA, 18 bp, Homo sapiens
catggacaatggaccgga

SEQ ID NO: 4697701 - DNA, 15 bp, Homo sapiens
catggacagaagaag

SEQ ID NO: 4697702 - DNA, 21 bp, Homo sapiens
catggacagaagaaggcagca

SEQ ID NO: 4697703 - DNA, 11 bp, Homo sapiens
catggactttg

SEQ ID NO: 4697704 - DNA, 14 bp, Homo sapiens
catggagagctaga

SEQ ID NO: 4697705 - DNA, 14 bp, Homo sapiens
catggagagctgga

SEQ ID NO: 4697706 - DNA, 12 bp, Homo sapiens
catggagctggc

SEQ ID NO: 4697707 - DNA, 13 bp, Homo sapiens
catggagctggcc

SEQ ID NO: 4697708 - DNA, 12 bp, Homo sapiens
catggcagtggg

SEQ ID NO: 4697709 - DNA, 19 bp, Homo sapiens
catggcatcacctccacca

SEQ ID NO: 4697710 - DNA, 15 bp, Homo sapiens
catggcccctgtgag

SEQ ID NO: 4697711 - DNA, 22 bp, Homo sapiens
catggccctcccagtacctcct

SEQ ID NO: 4697712 - DNA, 14 bp, Homo sapiens
catggccctgctgc

SEQ ID NO: 4697713 - DNA, 17 bp, Homo sapiens
catggccctgctgcccc

SEQ ID NO: 4697714 - DNA, 19 bp, Homo sapiens
catggccctgctgcccctc

SEQ ID NO: 4697715 - DNA, 13 bp, Homo sapiens
catggctggtgcc

SEQ ID NO: 4697716 - DNA, 13 bp, Homo sapiens
catgggagccggg

SEQ ID NO: 4697717 - DNA, 22 bp, Homo sapiens
catgggagccgggtctgcctct

SEQ ID NO: 4697718 - DNA, 16 bp, Homo sapiens
catgggcactgctggg

SEQ ID NO: 4697719 - DNA, 18 bp, Homo sapiens
catgggcctcctgtgtgt

SEQ ID NO: 4697720 - DNA, 13 bp, Homo sapiens
catgggcttcact

SEQ ID NO: 4697721 - DNA, 18 bp, Homo sapiens
catggggaggaggagggt

SEQ ID NO: 4697722 - DNA, 19 bp, Homo sapiens
catgggtcgggagagggga

SEQ ID NO: 4697723 - DNA, 16 bp, Homo sapiens
catggtcagccctagg

SEQ ID NO: 4697724 - DNA, 13 bp, Homo sapiens
catggtgtaataa

SEQ ID NO: 4697725 - DNA, 16 bp, Homo sapiens
catggtgtaataagac

SEQ ID NO: 4697726 - DNA, 18 bp, Homo sapiens
catggtgtaataagacat

SEQ ID NO: 4697727 - DNA, 19 bp, Homo sapiens
catggtgtaataagacata

SEQ ID NO: 4697728 - DNA, 22 bp, Homo sapiens
catggtgtaataagacataacg

SEQ ID NO: 4697729 - DNA, 17 bp, Homo sapiens
catggtgtgtgtctctg

SEQ ID NO: 4697730 - DNA, 18 bp, Homo sapiens
catggtgtgtgtctctga

SEQ ID NO: 4697731 - DNA, 20 bp, Homo sapiens
catggttgtgcacatgcttc

SEQ ID NO: 4697732 - DNA, 14 bp, Homo sapiens
catgtaaaatcttc

SEQ ID NO: 4697733 - DNA, 16 bp, Homo sapiens
catgtaaaatcttcag

SEQ ID NO: 4697734 - DNA, 22 bp, Homo sapiens
catgtaaaatcttcagctggtg

SEQ ID NO: 4697735 - DNA, 23 bp, Homo sapiens
catgtaaaatcttcagctggtgg

SEQ ID NO: 4697736 - DNA, 15 bp, Homo sapiens
catgtaaactgtgca

SEQ ID NO: 4697737 - DNA, 16 bp, Homo sapiens
catgtaaactgtgcac

SEQ ID NO: 4697738 - DNA, 15 bp, Homo sapiens
catgtaatggactat

SEQ ID NO: 4697739 - DNA, 21 bp, Homo sapiens
catgtatgtggatacagtcat

SEQ ID NO: 4697740 - DNA, 18 bp, Homo sapiens
catgtctatgctccctct

SEQ ID NO: 4697741 - DNA, 23 bp, Homo sapiens
catgtcttttcttgcatgaggct

SEQ ID NO: 4697742 - DNA, 13 bp, Homo sapiens
catgtgaaacctt

SEQ ID NO: 4697743 - DNA, 17 bp, Homo sapiens
catgtgcatctggtgta

SEQ ID NO: 4697744 - DNA, 22 bp, Homo sapiens
catgtgccaggtttttggtctg

SEQ ID NO: 4697745 - DNA, 21 bp, Homo sapiens
catgtgggttgtgatattgac

SEQ ID NO: 4697746 - DNA, 13 bp, Homo sapiens
catgtgtatgaga

SEQ ID NO: 4697747 - DNA, 21 bp, Homo sapiens
catgtgtgtccacgactgtct

SEQ ID NO: 4697748 - DNA, 23 bp, Homo sapiens
catgttcatatagtcaatgtaaa

SEQ ID NO: 4697749 - DNA, 19 bp, Homo sapiens
ccacccccacccaagggcc

SEQ ID NO: 4697750 - DNA, 13 bp, Homo sapiens
ccaccctgctctc

SEQ ID NO: 4697751 - DNA, 18 bp, Homo sapiens
ccaccctgggctctgtgg

SEQ ID NO: 4697752 - DNA, 23 bp, Homo sapiens
ccaccctgggctctgtgggctgc

SEQ ID NO: 4697753 - DNA, 14 bp, Homo sapiens
ccaccgcagacagg

SEQ ID NO: 4697754 - DNA, 13 bp, Homo sapiens
ccaccgcatgccc

SEQ ID NO: 4697755 - DNA, 13 bp, Homo sapiens
ccaccgccatggc

SEQ ID NO: 4697756 - DNA, 19 bp, Homo sapiens
ccaccgtagggcctgactc

SEQ ID NO: 4697757 - DNA, 21 bp, Homo sapiens
ccaccgtagggcctgactcct

SEQ ID NO: 4697758 - DNA, 15 bp, Homo sapiens
ccacctagtggctgt

SEQ ID NO: 4697759 - DNA, 21 bp, Homo sapiens
ccacctagtggctgtccagtg

SEQ ID NO: 4697760 - DNA, 22 bp, Homo sapiens
ccacctagtggctgtccagtgc

SEQ ID NO: 4697761 - DNA, 13 bp, Homo sapiens
ccacctcagcctc

SEQ ID NO: 4697762 - DNA, 15 bp, Homo sapiens
ccacctcagcctccc

SEQ ID NO: 4697763 - DNA, 17 bp, Homo sapiens
ccacctccttctctgtc

SEQ ID NO: 4697764 - DNA, 12 bp, Homo sapiens
ccacctgccagg

SEQ ID NO: 4697765 - DNA, 15 bp, Homo sapiens
ccacctgccagggac

SEQ ID NO: 4697766 - DNA, 22 bp, Homo sapiens
ccacctgcggtgctatctcccc

SEQ ID NO: 4697767 - DNA, 11 bp, Homo sapiens
ccacctggacc

SEQ ID NO: 4697768 - DNA, 18 bp, Homo sapiens
ccacctggacccctgcat

SEQ ID NO: 4697769 - DNA, 19 bp, Homo sapiens
ccacctggacccctgcatt

SEQ ID NO: 4697770 - DNA, 18 bp, Homo sapiens
ccacctggcctctgcact

SEQ ID NO: 4697771 - DNA, 15 bp, Homo sapiens
ccaccttggctcaag

SEQ ID NO: 4697772 - DNA, 19 bp, Homo sapiens
ccaccttggctgcagggag

SEQ ID NO: 4697773 - DNA, 14 bp, Homo sapiens
ccacgactgtctcc

SEQ ID NO: 4697774 - DNA, 16 bp, Homo sapiens
ccacgactgtctccat

SEQ ID NO: 4697775 - DNA, 18 bp, Homo sapiens
ccacgcagctggcagaga

SEQ ID NO: 4697776 - DNA, 16 bp, Homo sapiens
ccacgcccccactggt

SEQ ID NO: 4697777 - DNA, 17 bp, Homo sapiens
ccacgcccccactggtg

SEQ ID NO: 4697778 - DNA, 24 bp, Homo sapiens
ccacgcggccacctcaccctctcc

SEQ ID NO: 4697779 - DNA, 18 bp, Homo sapiens
ccacgctggaccttgaac

SEQ ID NO: 4697780 - DNA, 13 bp, Homo sapiens
ccacgctggagtg

SEQ ID NO: 4697781 - DNA, 13 bp, Homo sapiens
ccacggccaggcc

SEQ ID NO: 4697782 - DNA, 14 bp, Homo sapiens
ccacggccaggcca

SEQ ID NO: 4697783 - DNA, 15 bp, Homo sapiens
ccacggccaggccag

SEQ ID NO: 4697784 - DNA, 18 bp, Homo sapiens
ccacgtcctgtcagtgcc

SEQ ID NO: 4697785 - DNA, 18 bp, Homo sapiens
ccactaagaacacctgca

SEQ ID NO: 4697786 - DNA, 15 bp, Homo sapiens
ccactagacccactg

SEQ ID NO: 4697787 - DNA, 21 bp, Homo sapiens
ccactcccacttccctgacac

SEQ ID NO: 4697788 - DNA, 15 bp, Homo sapiens
ccactccctgcaacc

SEQ ID NO: 4697789 - DNA, 13 bp, Homo sapiens
ccactgcaccccc

SEQ ID NO: 4697790 - DNA, 21 bp, Homo sapiens
ccactgcaccccctcctgctg

SEQ ID NO: 4697791 - DNA, 13 bp, Homo sapiens
ccactgcaccggg

SEQ ID NO: 4697792 - DNA, 14 bp, Homo sapiens
ccactgcaccgggc

SEQ ID NO: 4697793 - DNA, 19 bp, Homo sapiens
ccactgcactatagcctag

SEQ ID NO: 4697794 - DNA, 20 bp, Homo sapiens
ccactgcactatagcctagg

SEQ ID NO: 4697795 - DNA, 13 bp, Homo sapiens
ccactgctctggt

SEQ ID NO: 4697796 - DNA, 15 bp, Homo sapiens
ccactgctctggtta

SEQ ID NO: 4697797 - DNA, 23 bp, Homo sapiens
ccactggtgacatgtcttttctt

SEQ ID NO: 4697798 - DNA, 14 bp, Homo sapiens
ccactgtcttcttc

SEQ ID NO: 4697799 - DNA, 20 bp, Homo sapiens
ccactgtggaagtccctcag

SEQ ID NO: 4697800 - DNA, 15 bp, Homo sapiens
ccactgttgggtggg

SEQ ID NO: 4697801 - DNA, 14 bp, Homo sapiens
ccacttcccctcct

SEQ ID NO: 4697802 - DNA, 13 bp, Homo sapiens
ccacttctgcact

SEQ ID NO: 4697803 - DNA, 18 bp, Homo sapiens
ccacttggcatcagctgg

SEQ ID NO: 4697804 - DNA, 21 bp, Homo sapiens
ccacttggctacacagggatg

SEQ ID NO: 4697805 - DNA, 13 bp, Homo sapiens
ccactttttgcag

SEQ ID NO: 4697806 - DNA, 14 bp, Homo sapiens
ccactttttgcagc

SEQ ID NO: 4697807 - DNA, 16 bp, Homo sapiens
ccactttttgcagctt

SEQ ID NO: 4697808 - DNA, 17 bp, Homo sapiens
ccactttttgcagcttt

SEQ ID NO: 4697809 - DNA, 15 bp, Homo sapiens
ccagaaacctgggag

SEQ ID NO: 4697810 - DNA, 17 bp, Homo sapiens
ccagaaacctgggagag

SEQ ID NO: 4697811 - DNA, 19 bp, Homo sapiens
ccagaaacctgggagagac

SEQ ID NO: 4697812 - DNA, 16 bp, Homo sapiens
ccagaaagaaaatgaa

SEQ ID NO: 4697813 - DNA, 20 bp, Homo sapiens
ccagacacatgtccaagaag

SEQ ID NO: 4697814 - DNA, 16 bp, Homo sapiens
ccagactacttgggag

SEQ ID NO: 4697815 - DNA, 14 bp, Homo sapiens
ccagagaccttctg

SEQ ID NO: 4697816 - DNA, 20 bp, Homo sapiens
ccagagcagatgcagagagc

SEQ ID NO: 4697817 - DNA, 23 bp, Homo sapiens
ccagagcagatgcagagagccat

SEQ ID NO: 4697818 - DNA, 16 bp, Homo sapiens
ccagagcccaccttgg

SEQ ID NO: 4697819 - DNA, 20 bp, Homo sapiens
ccagagcctcaaatgagaaa

SEQ ID NO: 4697820 - DNA, 23 bp, Homo sapiens
ccagagcctcaaatgagaaaatg

SEQ ID NO: 4697821 - DNA, 23 bp, Homo sapiens
ccagagctctgacccacagcctc

SEQ ID NO: 4697822 - DNA, 17 bp, Homo sapiens
ccagaggaaggggccag

SEQ ID NO: 4697823 - DNA, 12 bp, Homo sapiens
ccagaggagggc

SEQ ID NO: 4697824 - DNA, 20 bp, Homo sapiens
ccagagggagtgacagaggc

SEQ ID NO: 4697825 - DNA, 13 bp, Homo sapiens
ccagagggcctgc

SEQ ID NO: 4697826 - DNA, 15 bp, Homo sapiens
ccagagggcctgcaa

SEQ ID NO: 4697827 - DNA, 19 bp, Homo sapiens
ccagaggtaacagaacagc

SEQ ID NO: 4697828 - DNA, 23 bp, Homo sapiens
ccagaggtaacagaacagcttca

SEQ ID NO: 4697829 - DNA, 19 bp, Homo sapiens
ccagagttccccatgcaga

SEQ ID NO: 4697830 - DNA, 16 bp, Homo sapiens
ccagatgggggaaagc

SEQ ID NO: 4697831 - DNA, 20 bp, Homo sapiens
ccagatgtcgctgggtcctc

SEQ ID NO: 4697832 - DNA, 23 bp, Homo sapiens
ccagatgtcgctgggtcctctgc

SEQ ID NO: 4697833 - DNA, 24 bp, Homo sapiens
ccagatgtcgctgggtcctctgca

SEQ ID NO: 4697834 - DNA, 21 bp, Homo sapiens
ccagatgtgagggcaccacca

SEQ ID NO: 4697835 - DNA, 19 bp, Homo sapiens
ccagattctttcctgaggc

SEQ ID NO: 4697836 - DNA, 21 bp, Homo sapiens
ccagattctttcctgaggctg

SEQ ID NO: 4697837 - DNA, 16 bp, Homo sapiens
ccagattgcaacaggc

SEQ ID NO: 4697838 - DNA, 21 bp, Homo sapiens
ccagattgcaacaggctgggc

SEQ ID NO: 4697839 - DNA, 23 bp, Homo sapiens
ccagattgcaacaggctgggctt

SEQ ID NO: 4697840 - DNA, 21 bp, Homo sapiens
ccagattggctcacactgaga

SEQ ID NO: 4697841 - DNA, 17 bp, Homo sapiens
ccagcaagtgagagctg

SEQ ID NO: 4697842 - DNA, 18 bp, Homo sapiens
ccagcaagtgagagctgg

SEQ ID NO: 4697843 - DNA, 22 bp, Homo sapiens
ccagcaagtgagagctgggtgt

SEQ ID NO: 4697844 - DNA, 21 bp, Homo sapiens
ccagcaattctcctgcctcag

SEQ ID NO: 4697845 - DNA, 23 bp, Homo sapiens
ccagcacccgggctcagggacca

SEQ ID NO: 4697846 - DNA, 18 bp, Homo sapiens
ccagcaccggaccagcct

SEQ ID NO: 4697847 - DNA, 19 bp, Homo sapiens
ccagcaccggaccagcctg

SEQ ID NO: 4697848 - DNA, 20 bp, Homo sapiens
ccagcaccggaccagcctgg

SEQ ID NO: 4697849 - DNA, 13 bp, Homo sapiens
ccagcactgagga

SEQ ID NO: 4697850 - DNA, 19 bp, Homo sapiens
ccagcactgcttgaggaaa

SEQ ID NO: 4697851 - DNA, 15 bp, Homo sapiens
ccagcacttggagag

SEQ ID NO: 4697852 - DNA, 13 bp, Homo sapiens
ccagcagagcacc

SEQ ID NO: 4697853 - DNA, 13 bp, Homo sapiens
ccagcattctcag

SEQ ID NO: 4697854 - DNA, 13 bp, Homo sapiens
ccagccagggctg

SEQ ID NO: 4697855 - DNA, 14 bp, Homo sapiens
ccagccagggctgc

SEQ ID NO: 4697856 - DNA, 17 bp, Homo sapiens
ccagcccacttctgcca

SEQ ID NO: 4697857 - DNA, 23 bp, Homo sapiens
ccagccccaaaactctcctctgc

SEQ ID NO: 4697858 - DNA, 18 bp, Homo sapiens
ccagccccaaggggtggc

SEQ ID NO: 4697859 - DNA, 21 bp, Homo sapiens
cccacgctggagtgcagtgag

SEQ ID NO: 4697860 - DNA, 17 bp, Homo sapiens
cccacgtcctgtcagtg

SEQ ID NO: 4697861 - DNA, 15 bp, Homo sapiens
cccactcattccttc

SEQ ID NO: 4697862 - DNA, 16 bp, Homo sapiens
cccactcattccttct

SEQ ID NO: 4697863 - DNA, 12 bp, Homo sapiens
cccactgcaccc

SEQ ID NO: 4697864 - DNA, 20 bp, Homo sapiens
cccactgcaccccctcctgc

SEQ ID NO: 4697865 - DNA, 12 bp, Homo sapiens
cccactgctctg

SEQ ID NO: 4697866 - DNA, 17 bp, Homo sapiens
cccacttcccctcctac

SEQ ID NO: 4697867 - DNA, 19 bp, Homo sapiens
cccacttccctgacactgc

SEQ ID NO: 4697868 - DNA, 16 bp, Homo sapiens
cccacttctgcacttg

SEQ ID NO: 4697869 - DNA, 22 bp, Homo sapiens
cccagaggaaggggccagaggc

SEQ ID NO: 4697870 - DNA, 14 bp, Homo sapiens
cccagagggcctgc

SEQ ID NO: 4697871 - DNA, 18 bp, Homo sapiens
cccagagggcctgcaagg

SEQ ID NO: 4697872 - DNA, 15 bp, Homo sapiens
cccagaggggcctgc

SEQ ID NO: 4697873 - DNA, 23 bp, Homo sapiens
cccagaggggcctgccacctgga

SEQ ID NO: 4697874 - DNA, 21 bp, Homo sapiens
cccagagtttttatgtagcag

SEQ ID NO: 4697875 - DNA, 22 bp, Homo sapiens
cccagatgtgagggcaccacca

SEQ ID NO: 4697876 - DNA, 23 bp, Homo sapiens
cccagattgcaacaggctgggct

SEQ ID NO: 4697877 - DNA, 17 bp, Homo sapiens
cccagattggctcacac

SEQ ID NO: 4697878 - DNA, 16 bp, Homo sapiens
cccagcaagtgagagc

SEQ ID NO: 4697879 - DNA, 21 bp, Homo sapiens
cccagcaagtgagagctgggt

SEQ ID NO: 4697880 - DNA, 18 bp, Homo sapiens
cccagccccaaggggtgg

SEQ ID NO: 4697881 - DNA, 20 bp, Homo sapiens
cccagccccaaggggtggcc

SEQ ID NO: 4697882 - DNA, 13 bp, Homo sapiens
cccagccccatcc

SEQ ID NO: 4697883 - DNA, 15 bp, Homo sapiens
cccagccccatcctc

SEQ ID NO: 4697884 - DNA, 19 bp, Homo sapiens
cccagccctcatcccgagc

SEQ ID NO: 4697885 - DNA, 17 bp, Homo sapiens
cccagccgctgcccggc

SEQ ID NO: 4697886 - DNA, 15 bp, Homo sapiens
cccagcctctaggga

SEQ ID NO: 4697887 - DNA, 14 bp, Homo sapiens
cccagcgagccctg

SEQ ID NO: 4697888 - DNA, 17 bp, Homo sapiens
cccagcgagccctggtg

SEQ ID NO: 4697889 - DNA, 23 bp, Homo sapiens
cccagcgagccctggtggcagtg

SEQ ID NO: 4697890 - DNA, 19 bp, Homo sapiens
cccagctaattgagaccac

SEQ ID NO: 4697891 - DNA, 19 bp, Homo sapiens
cccagctcccccgggaggg

SEQ ID NO: 4697892 - DNA, 12 bp, Homo sapiens
cccagctctggt

SEQ ID NO: 4697893 - DNA, 14 bp, Homo sapiens
cccagctctggtcc

SEQ ID NO: 4697894 - DNA, 17 bp, Homo sapiens
cccagctgacagtcctc

SEQ ID NO: 4697895 - DNA, 21 bp, Homo sapiens
cccagctgacagtcctctcca

SEQ ID NO: 4697896 - DNA, 23 bp, Homo sapiens
cccagctgtgctctggacaggca

SEQ ID NO: 4697897 - DNA, 21 bp, Homo sapiens
cccagcttcaaagcttaaaaa

SEQ ID NO: 4697898 - DNA, 15 bp, Homo sapiens
cccaggaaaggctcc

SEQ ID NO: 4697899 - DNA, 22 bp, Homo sapiens
cccaggaaaggctccaggagca

SEQ ID NO: 4697900 - DNA, 14 bp, Homo sapiens
cccaggactgggcc

SEQ ID NO: 4697901 - DNA, 18 bp, Homo sapiens
cccaggagcatccacctc

SEQ ID NO: 4697902 - DNA, 22 bp, Homo sapiens
cccaggagcatccacctccttc

SEQ ID NO: 4697903 - DNA, 13 bp, Homo sapiens
cccaggagccccg

SEQ ID NO: 4697904 - DNA, 14 bp, Homo sapiens
cccaggagccccga

SEQ ID NO: 4697905 - DNA, 12 bp, Homo sapiens
cccaggagctcc

SEQ ID NO: 4697906 - DNA, 14 bp, Homo sapiens
cccaggaggccagc

SEQ ID NO: 4697907 - DNA, 22 bp, Homo sapiens
cccaggagtggaggaggcctgg

SEQ ID NO: 4697908 - DNA, 13 bp, Homo sapiens
cccaggcaggtct

SEQ ID NO: 4697909 - DNA, 18 bp, Homo sapiens
cccaggcattccccagga

SEQ ID NO: 4697910 - DNA, 21 bp, Homo sapiens
cccaggcattgccaagggctt

SEQ ID NO: 4697911 - DNA, 13 bp, Homo sapiens
cccaggccaggac

SEQ ID NO: 4697912 - DNA, 14 bp, Homo sapiens
cccaggccatcttc

SEQ ID NO: 4697913 - DNA, 20 bp, Homo sapiens
cccaggccatcttccaggtg

SEQ ID NO: 4697914 - DNA, 21 bp, Homo sapiens
cccaggcccctgccaccctgg

SEQ ID NO: 4697915 - DNA, 22 bp, Homo sapiens
cccaggcccctgccaccctggg

SEQ ID NO: 4697916 - DNA, 14 bp, Homo sapiens
cccaggctgagcct

SEQ ID NO: 4697917 - DNA, 16 bp, Homo sapiens
cccaggctgagcctca

SEQ ID NO: 4697918 - DNA, 18 bp, Homo sapiens
cccaggctggcgtgcagt

SEQ ID NO: 4697919 - DNA, 19 bp, Homo sapiens
cccaggctggcgtgcagtg

SEQ ID NO: 4697920 - DNA, 21 bp, Homo sapiens
cccaggctggcgtgcagtggt

SEQ ID NO: 4697921 - DNA, 13 bp, Homo sapiens
cccaggctgggca

SEQ ID NO: 4697922 - DNA, 13 bp, Homo sapiens
cccagggcagcca

SEQ ID NO: 4697923 - DNA, 15 bp, Homo sapiens
cccagggcagccagg

SEQ ID NO: 4697924 - DNA, 14 bp, Homo sapiens
cccaggtaagcagg

SEQ ID NO: 4697925 - DNA, 19 bp, Homo sapiens
cccaggtttctggtctcta

SEQ ID NO: 4697926 - DNA, 22 bp, Homo sapiens
cccaggtttctggtctctaggc

SEQ ID NO: 4697927 - DNA, 21 bp, Homo sapiens
cccagtacctcctgtctctgg

SEQ ID NO: 4697928 - DNA, 22 bp, Homo sapiens
cccagtacctcctgtctctggc

SEQ ID NO: 4697929 - DNA, 10 bp, Homo sapiens
cccagtctgg

SEQ ID NO: 4697930 - DNA, 20 bp, Homo sapiens
cccagtctggaatgcagtgg

SEQ ID NO: 4697931 - DNA, 14 bp, Homo sapiens
cccagtggctgctg

SEQ ID NO: 4697932 - DNA, 17 bp, Homo sapiens
cccagtgtcttcctgtg

SEQ ID NO: 4697933 - DNA, 18 bp, Homo sapiens
cccagtgtcttcctgtgg

SEQ ID NO: 4697934 - DNA, 19 bp, Homo sapiens
cccagttgcactcaggtga

SEQ ID NO: 4697935 - DNA, 20 bp, Homo sapiens
cccagttgcactcaggtgac

SEQ ID NO: 4697936 - DNA, 17 bp, Homo sapiens
cccagttgccatctgcg

SEQ ID NO: 4697937 - DNA, 13 bp, Homo sapiens
cccatcagtgcca

SEQ ID NO: 4697938 - DNA, 21 bp, Homo sapiens
cccatcagtgccagcccctgc

SEQ ID NO: 4697939 - DNA, 23 bp, Homo sapiens
cccatcagtgctccctcacatgt

SEQ ID NO: 4697940 - DNA, 14 bp, Homo sapiens
cccatcccccctca

SEQ ID NO: 4697941 - DNA, 13 bp, Homo sapiens
cccatcctctgta

SEQ ID NO: 4697942 - DNA, 14 bp, Homo sapiens
cccatcctggccca

SEQ ID NO: 4697943 - DNA, 18 bp, Homo sapiens
cccatcctggcccatcag

SEQ ID NO: 4697944 - DNA, 13 bp, Homo sapiens
cccatctcacaca

SEQ ID NO: 4697945 - DNA, 14 bp, Homo sapiens
cccatctcttctgg

SEQ ID NO: 4697946 - DNA, 12 bp, Homo sapiens
cccatctgccca

SEQ ID NO: 4697947 - DNA, 13 bp, Homo sapiens
cccatctgcccag

SEQ ID NO: 4697948 - DNA, 15 bp, Homo sapiens
cccatgaagatattt

SEQ ID NO: 4697949 - DNA, 14 bp, Homo sapiens
cccatgagcctcag

SEQ ID NO: 4697950 - DNA, 15 bp, Homo sapiens
cccatgagcctcagc

SEQ ID NO: 4697951 - DNA, 13 bp, Homo sapiens
cccatgctgccct

SEQ ID NO: 4697952 - DNA, 17 bp, Homo sapiens
cccatgggcactgctgg

SEQ ID NO: 4697953 - DNA, 14 bp, Homo sapiens
cccattcctcacct

SEQ ID NO: 4697954 - DNA, 18 bp, Homo sapiens
cccattccttcccagagg

SEQ ID NO: 4697955 - DNA, 20 bp, Homo sapiens
cccattctgcctgcccaggc

SEQ ID NO: 4697956 - DNA, 20 bp, Homo sapiens
ccccaaaactctcctctgct

SEQ ID NO: 4697957 - DNA, 23 bp, Homo sapiens
ccccaaaactctcctctgctgct

SEQ ID NO: 4697958 - DNA, 22 bp, Homo sapiens
ccccaaatggaaatgggcagag

SEQ ID NO: 4697959 - DNA, 12 bp, Homo sapiens
ccccacactcct

SEQ ID NO: 4697960 - DNA, 16 bp, Homo sapiens
ccccacagcccacgtc

SEQ ID NO: 4697961 - DNA, 19 bp, Homo sapiens
ccccacagcccacgtcctg

SEQ ID NO: 4697962 - DNA, 21 bp, Homo sapiens
ccccacagcccacgtcctgtc

SEQ ID NO: 4697963 - DNA, 20 bp, Homo sapiens
ccccacccaagggcctggcc

SEQ ID NO: 4697964 - DNA, 16 bp, Homo sapiens
ccccacccacttctgc

SEQ ID NO: 4697965 - DNA, 13 bp, Homo sapiens
ccccaccccttgc

SEQ ID NO: 4697966 - DNA, 18 bp, Homo sapiens
ccccacccggtggttctt

SEQ ID NO: 4697967 - DNA, 15 bp, Homo sapiens
ccccagattgcaaca

SEQ ID NO: 4697968 - DNA, 23 bp, Homo sapiens
ccccagattgcaacaggctgggc

SEQ ID NO: 4697969 - DNA, 22 bp, Homo sapiens
cccttttttggctgctgaaggc

SEQ ID NO: 4697970 - DNA, 21 bp, Homo sapiens
ccgaacgctctgcaccttctg

SEQ ID NO: 4697971 - DNA, 13 bp, Homo sapiens
ccgaccagacacc

SEQ ID NO: 4697972 - DNA, 17 bp, Homo sapiens
ccgaccagacaccttga

SEQ ID NO: 4697973 - DNA, 16 bp, Homo sapiens
ccgacccttgccgtct

SEQ ID NO: 4697974 - DNA, 17 bp, Homo sapiens
ccgcacacctctggctg

SEQ ID NO: 4697975 - DNA, 15 bp, Homo sapiens
ccgcagacaggacca

SEQ ID NO: 4697976 - DNA, 13 bp, Homo sapiens
ccgcagagctggc

SEQ ID NO: 4697977 - DNA, 12 bp, Homo sapiens
ccgcatgccccc

SEQ ID NO: 4697978 - DNA, 22 bp, Homo sapiens
ccgcatgccccctcgtgccagt

SEQ ID NO: 4697979 - DNA, 15 bp, Homo sapiens
ccgccatggcttcca

SEQ ID NO: 4697980 - DNA, 12 bp, Homo sapiens
ccgcccaggctt

SEQ ID NO: 4697981 - DNA, 20 bp, Homo sapiens
ccgcccaggcttagtcactg

SEQ ID NO: 4697982 - DNA, 23 bp, Homo sapiens
ccgcccattctgacccagggcct

SEQ ID NO: 4697983 - DNA, 14 bp, Homo sapiens
ccgccgcctcgccc

SEQ ID NO: 4697984 - DNA, 15 bp, Homo sapiens
ccgccgcctcgccca

SEQ ID NO: 4697985 - DNA, 12 bp, Homo sapiens
ccgccggatgac

SEQ ID NO: 4697986 - DNA, 14 bp, Homo sapiens
ccgcctcgcccacc

SEQ ID NO: 4697987 - DNA, 18 bp, Homo sapiens
ccgcctcgcccaccgcat

SEQ ID NO: 4697988 - DNA, 18 bp, Homo sapiens
ccgcggctggatgggggc

SEQ ID NO: 4697989 - DNA, 22 bp, Homo sapiens
ccgcggctggatgggggctctg

SEQ ID NO: 4697990 - DNA, 21 bp, Homo sapiens
ccgctaagagggagggagggc

SEQ ID NO: 4697991 - DNA, 15 bp, Homo sapiens
ccgctcccagtgtct

SEQ ID NO: 4697992 - DNA, 13 bp, Homo sapiens
ccgctgattctca

SEQ ID NO: 4697993 - DNA, 19 bp, Homo sapiens
ccgctgcccggcgccctct

SEQ ID NO: 4697994 - DNA, 22 bp, Homo sapiens
ccgctgcccggcgccctctgtc

SEQ ID NO: 4697995 - DNA, 23 bp, Homo sapiens
ccgctgcccggcgccctctgtcc

SEQ ID NO: 4697996 - DNA, 13 bp, Homo sapiens
ccgcttgcctcgg

SEQ ID NO: 4697997 - DNA, 16 bp, Homo sapiens
ccggacacttctcagg

SEQ ID NO: 4697998 - DNA, 14 bp, Homo sapiens
ccggaccagcctgg

SEQ ID NO: 4697999 - DNA, 15 bp, Homo sapiens
ccggaccagcctggc

SEQ ID NO: 4698000 - DNA, 18 bp, Homo sapiens
ccggaccagcctggccca

SEQ ID NO: 4698001 - DNA, 20 bp, Homo sapiens
ccggagggaaactgtgaatg

SEQ ID NO: 4698002 - DNA, 13 bp, Homo sapiens
ccggcactgcatg

SEQ ID NO: 4698003 - DNA, 23 bp, Homo sapiens
ccggcactgcatgttcctggaca

SEQ ID NO: 4698004 - DNA, 18 bp, Homo sapiens
ccggcatggacaatggac

SEQ ID NO: 4698005 - DNA, 17 bp, Homo sapiens
ccggccacctgcggtgc

SEQ ID NO: 4698006 - DNA, 13 bp, Homo sapiens
ccggccaggtggg

SEQ ID NO: 4698007 - DNA, 14 bp, Homo sapiens
ccggcccctgctgg

SEQ ID NO: 4698008 - DNA, 14 bp, Homo sapiens
ccggcgccctctgt

SEQ ID NO: 4698009 - DNA, 19 bp, Homo sapiens
ccggctaatttttgtattt

SEQ ID NO: 4698010 - DNA, 21 bp, Homo sapiens
ccggctccaggctcctttagc

SEQ ID NO: 4698011 - DNA, 17 bp, Homo sapiens
ccggctggcctggcccc

SEQ ID NO: 4698012 - DNA, 21 bp, Homo sapiens
ccgggaccctgctcacaggca

SEQ ID NO: 4698013 - DNA, 23 bp, Homo sapiens
ccgggagcctgatcacctgccct

SEQ ID NO: 4698014 - DNA, 17 bp, Homo sapiens
ccgggaggagcctgggg

SEQ ID NO: 4698015 - DNA, 16 bp, Homo sapiens
ccgggaggggcccgct

SEQ ID NO: 4698016 - DNA, 20 bp, Homo sapiens
ccgggctcagggaccacagc

SEQ ID NO: 4698017 - DNA, 13 bp, Homo sapiens
ccgggctctgcct

SEQ ID NO: 4698018 - DNA, 12 bp, Homo sapiens
ccgtaatttaac

SEQ ID NO: 4698019 - DNA, 22 bp, Homo sapiens
ccgtcactccacgcagctggca

SEQ ID NO: 4698020 - DNA, 13 bp, Homo sapiens
ccgtcctgagggg

SEQ ID NO: 4698021 - DNA, 15 bp, Homo sapiens
ccgtctacctgaggg

SEQ ID NO: 4698022 - DNA, 11 bp, Homo sapiens
ccgtggcacat

SEQ ID NO: 4698023 - DNA, 13 bp, Homo sapiens
ccgtggccccagc

SEQ ID NO: 4698024 - DNA, 17 bp, Homo sapiens
ccgtggccccagcctgg

SEQ ID NO: 4698025 - DNA, 23 bp, Homo sapiens
ccgtggccccagcctggcccagc

SEQ ID NO: 4698026 - DNA, 21 bp, Homo sapiens
ccgtgtgttctccgtccctgc

SEQ ID NO: 4698027 - DNA, 15 bp, Homo sapiens
ccgttcatgggggag

SEQ ID NO: 4698028 - DNA, 16 bp, Homo sapiens
ccgttcatgggggagg

SEQ ID NO: 4698029 - DNA, 21 bp, Homo sapiens
ccgttgtctccctggccctca

SEQ ID NO: 4698030 - DNA, 13 bp, Homo sapiens
cctaaaacaaaag

SEQ ID NO: 4698031 - DNA, 16 bp, Homo sapiens
cctaaaccctctgtga

SEQ ID NO: 4698032 - DNA, 18 bp, Homo sapiens
cctaaaccctctgtgaaa

SEQ ID NO: 4698033 - DNA, 18 bp, Homo sapiens
cctaactcatactgtgct

SEQ ID NO: 4698034 - DNA, 12 bp, Homo sapiens
cctaaggaagct

SEQ ID NO: 4698035 - DNA, 12 bp, Homo sapiens
cctaatgctgca

SEQ ID NO: 4698036 - DNA, 12 bp, Homo sapiens
cctaatgtgttt

SEQ ID NO: 4698037 - DNA, 13 bp, Homo sapiens
cctaatgtgttta

SEQ ID NO: 4698038 - DNA, 13 bp, Homo sapiens
cctaattccacag

SEQ ID NO: 4698039 - DNA, 14 bp, Homo sapiens
cctaattccacagc

SEQ ID NO: 4698040 - DNA, 15 bp, Homo sapiens
cctacaagacacagt

SEQ ID NO: 4698041 - DNA, 16 bp, Homo sapiens
cctacagtgctgtgta

SEQ ID NO: 4698042 - DNA, 14 bp, Homo sapiens
cctaccacatgcca

SEQ ID NO: 4698043 - DNA, 13 bp, Homo sapiens
cctactctgtgta

SEQ ID NO: 4698044 - DNA, 13 bp, Homo sapiens
cctacttcccctt

SEQ ID NO: 4698045 - DNA, 19 bp, Homo sapiens
cctacttctccagcctaga

SEQ ID NO: 4698046 - DNA, 23 bp, Homo sapiens
cctacttctttgctttgcccagc

SEQ ID NO: 4698047 - DNA, 22 bp, Homo sapiens
cctagccccttagcccccaccc

SEQ ID NO: 4698048 - DNA, 19 bp, Homo sapiens
cctagccttagaagtcaca

SEQ ID NO: 4698049 - DNA, 22 bp, Homo sapiens
cctaggagagtttactgatgaa

SEQ ID NO: 4698050 - DNA, 18 bp, Homo sapiens
cctaggcaggacatgctg

SEQ ID NO: 4698051 - DNA, 22 bp, Homo sapiens
cctagggtctatttgtgtggca

SEQ ID NO: 4698052 - DNA, 18 bp, Homo sapiens
cctaggtgacagagtgag

SEQ ID NO: 4698053 - DNA, 18 bp, Homo sapiens
cctagtcccttccacacc

SEQ ID NO: 4698054 - DNA, 19 bp, Homo sapiens
cctagtgaaggcttctctc

SEQ ID NO: 4698055 - DNA, 23 bp, Homo sapiens
cctagtggctgtccagtgcccat

SEQ ID NO: 4698056 - DNA, 23 bp, Homo sapiens
cctagttccaccatcaagccacc

SEQ ID NO: 4698057 - DNA, 14 bp, Homo sapiens
cctataaatctaat

SEQ ID NO: 4698058 - DNA, 22 bp, Homo sapiens
cctatacgcagcgtgctttaaa

SEQ ID NO: 4698059 - DNA, 17 bp, Homo sapiens
cctatcagtgtgccccc

SEQ ID NO: 4698060 - DNA, 18 bp, Homo sapiens
cctatcagtgtgcccccc

SEQ ID NO: 4698061 - DNA, 12 bp, Homo sapiens
cctatctgactt

SEQ ID NO: 4698062 - DNA, 13 bp, Homo sapiens
cctatctgacttc

SEQ ID NO: 4698063 - DNA, 12 bp, Homo sapiens
cctatctttgcc

SEQ ID NO: 4698064 - DNA, 15 bp, Homo sapiens
cctatctttgccacc

SEQ ID NO: 4698065 - DNA, 19 bp, Homo sapiens
cctatctttgccaccctca

SEQ ID NO: 4698066 - DNA, 17 bp, Homo sapiens
cctatgtatatcttcta

SEQ ID NO: 4698067 - DNA, 17 bp, Homo sapiens
cctcaaacactgcaggc

SEQ ID NO: 4698068 - DNA, 18 bp, Homo sapiens
cctcaaacactgcaggca

SEQ ID NO: 4698069 - DNA, 15 bp, Homo sapiens
cctcaataagccttg

SEQ ID NO: 4698070 - DNA, 20 bp, Homo sapiens
cctcacagtccttaccagca

SEQ ID NO: 4698071 - DNA, 22 bp, Homo sapiens
cctcacagtccttaccagcaga

SEQ ID NO: 4698072 - DNA, 13 bp, Homo sapiens
cctcaccaggggc

SEQ ID NO: 4698073 - DNA, 23 bp, Homo sapiens
cctcacccctggttctcatcttt

SEQ ID NO: 4698074 - DNA, 13 bp, Homo sapiens
cctcaccgcggct

SEQ ID NO: 4698075 - DNA, 19 bp, Homo sapiens
cctcaccgcggctggatgg

SEQ ID NO: 4698076 - DNA, 23 bp, Homo sapiens
cctcaccgcggctggatgggggc

SEQ ID NO: 4698077 - DNA, 19 bp, Homo sapiens
cctcaccttttcccgggga

SEQ ID NO: 4698078 - DNA, 16 bp, Homo sapiens
cctcagagacatcagc

SEQ ID NO: 4698079 - DNA, 14 bp, Homo sapiens
ccttcgctcctgtg

SEQ ID NO: 4698080 - DNA, 15 bp, Homo sapiens
ccttcgctcctgtgt

SEQ ID NO: 4698081 - DNA, 18 bp, Homo sapiens
ccttcgctcctgtgtctt

SEQ ID NO: 4698082 - DNA, 16 bp, Homo sapiens
ccttctccatccacat

SEQ ID NO: 4698083 - DNA, 16 bp, Homo sapiens
ccttctcccccccggg

SEQ ID NO: 4698084 - DNA, 16 bp, Homo sapiens
ccttctccctcatttc

SEQ ID NO: 4698085 - DNA, 15 bp, Homo sapiens
ccttctccttcacct

SEQ ID NO: 4698086 - DNA, 14 bp, Homo sapiens
ccttctctcatctc

SEQ ID NO: 4698087 - DNA, 13 bp, Homo sapiens
ccttctctccagc

SEQ ID NO: 4698088 - DNA, 18 bp, Homo sapiens
ccttctctccagcccctg

SEQ ID NO: 4698089 - DNA, 19 bp, Homo sapiens
ccttctctccagcccctgg

SEQ ID NO: 4698090 - DNA, 14 bp, Homo sapiens
ccttctctgaagga

SEQ ID NO: 4698091 - DNA, 17 bp, Homo sapiens
ccttctctgtctcatgt

SEQ ID NO: 4698092 - DNA, 16 bp, Homo sapiens
ccttctgacccatgct

SEQ ID NO: 4698093 - DNA, 17 bp, Homo sapiens
ccttctgacccatgctg

SEQ ID NO: 4698094 - DNA, 21 bp, Homo sapiens
ccttctgacccatgctgccct

SEQ ID NO: 4698095 - DNA, 14 bp, Homo sapiens
ccttctgacctggg

SEQ ID NO: 4698096 - DNA, 20 bp, Homo sapiens
ccttctgacgcagcctgaga

SEQ ID NO: 4698097 - DNA, 21 bp, Homo sapiens
ccttctgacgcagcctgagaa

SEQ ID NO: 4698098 - DNA, 21 bp, Homo sapiens
ccttctgtcctactctgtgtc

SEQ ID NO: 4698099 - DNA, 18 bp, Homo sapiens
ccttctttgataatgtta

SEQ ID NO: 4698100 - DNA, 17 bp, Homo sapiens
ccttgaaaaaaaacagt

SEQ ID NO: 4698101 - DNA, 21 bp, Homo sapiens
ccttgaaatacctgtttcttt

SEQ ID NO: 4698102 - DNA, 14 bp, Homo sapiens
ccttgacagggcac

SEQ ID NO: 4698103 - DNA, 15 bp, Homo sapiens
ccttgacagggcaca

SEQ ID NO: 4698104 - DNA, 17 bp, Homo sapiens
ccttgacagggcacacc

SEQ ID NO: 4698105 - DNA, 18 bp, Homo sapiens
ccttgaggagtcttgtgt

SEQ ID NO: 4698106 - DNA, 17 bp, Homo sapiens
ccttgcccccctggcct

SEQ ID NO: 4698107 - DNA, 21 bp, Homo sapiens
ccttgcccccctggcctcccc

SEQ ID NO: 4698108 - DNA, 20 bp, Homo sapiens
ccttgctccagcctgacaac

SEQ ID NO: 4698109 - DNA, 16 bp, Homo sapiens
ccttggctgcagggag

SEQ ID NO: 4698110 - DNA, 14 bp, Homo sapiens
ccttggctggtgca

SEQ ID NO: 4698111 - DNA, 12 bp, Homo sapiens
ccttgggacccc

SEQ ID NO: 4698112 - DNA, 12 bp, Homo sapiens
ccttgggctccc

SEQ ID NO: 4698113 - DNA, 14 bp, Homo sapiens
ccttgtccccacac

SEQ ID NO: 4698114 - DNA, 21 bp, Homo sapiens
ccttgtccccacactcctaca

SEQ ID NO: 4698115 - DNA, 14 bp, Homo sapiens
ccttgtccccatga

SEQ ID NO: 4698116 - DNA, 21 bp, Homo sapiens
ccttgtcgttgactttaggga

SEQ ID NO: 4698117 - DNA, 20 bp, Homo sapiens
ccttgtggtcccaccccaca

SEQ ID NO: 4698118 - DNA, 13 bp, Homo sapiens
ccttgtttaatgg

SEQ ID NO: 4698119 - DNA, 14 bp, Homo sapiens
ccttgtttctttct

SEQ ID NO: 4698120 - DNA, 20 bp, Homo sapiens
cctttagcgcccagttgggt

SEQ ID NO: 4698121 - DNA, 15 bp, Homo sapiens
cctttagcttaagag

SEQ ID NO: 4698122 - DNA, 21 bp, Homo sapiens
cctttatttttggcgtggctg

SEQ ID NO: 4698123 - DNA, 22 bp, Homo sapiens
cctttcatttactgtggcttct

SEQ ID NO: 4698124 - DNA, 13 bp, Homo sapiens
cctttccatattt

SEQ ID NO: 4698125 - DNA, 19 bp, Homo sapiens
cctttcccaggtgctacac

SEQ ID NO: 4698126 - DNA, 18 bp, Homo sapiens
cctttctcccctgccccc

SEQ ID NO: 4698127 - DNA, 19 bp, Homo sapiens
cctttctcccctgccccca

SEQ ID NO: 4698128 - DNA, 15 bp, Homo sapiens
cctttctcctgttta

SEQ ID NO: 4698129 - DNA, 23 bp, Homo sapiens
cctttgacgccatcccagcccca

SEQ ID NO: 4698130 - DNA, 17 bp, Homo sapiens
cctttgagacagtttct

SEQ ID NO: 4698131 - DNA, 19 bp, Homo sapiens
cctttgagacagtttctta

SEQ ID NO: 4698132 - DNA, 21 bp, Homo sapiens
cctttgattaaagactccagt

SEQ ID NO: 4698133 - DNA, 19 bp, Homo sapiens
cctttgcagatatgatgga

SEQ ID NO: 4698134 - DNA, 19 bp, Homo sapiens
cctttggcaggtgcagccc

SEQ ID NO: 4698135 - DNA, 14 bp, Homo sapiens
cctttgggaagggg

SEQ ID NO: 4698136 - DNA, 15 bp, Homo sapiens
cctttgtgaggaagc

SEQ ID NO: 4698137 - DNA, 17 bp, Homo sapiens
cctttgtgaggaagccg

SEQ ID NO: 4698138 - DNA, 20 bp, Homo sapiens
ccttttcagcttctgctggg

SEQ ID NO: 4698139 - DNA, 13 bp, Homo sapiens
cctttttccttgt

SEQ ID NO: 4698140 - DNA, 20 bp, Homo sapiens
ccttttttaagatttttctc

SEQ ID NO: 4698141 - DNA, 15 bp, Homo sapiens
ccttttttggctgct

SEQ ID NO: 4698142 - DNA, 17 bp, Homo sapiens
ccttttttggctgctga

SEQ ID NO: 4698143 - DNA, 13 bp, Homo sapiens
cctttttttctct

SEQ ID NO: 4698144 - DNA, 18 bp, Homo sapiens
cgaaaagaaggtattttt

SEQ ID NO: 4698145 - DNA, 23 bp, Homo sapiens
cgaaagggacttggaagctccgc

SEQ ID NO: 4698146 - DNA, 16 bp, Homo sapiens
cgaaataacaatgtta

SEQ ID NO: 4698147 - DNA, 14 bp, Homo sapiens
cgaagaaacaaaaa

SEQ ID NO: 4698148 - DNA, 16 bp, Homo sapiens
cgaatagctgggacta

SEQ ID NO: 4698149 - DNA, 18 bp, Homo sapiens
cgaatgtaattggaatct

SEQ ID NO: 4698150 - DNA, 19 bp, Homo sapiens
cgaatgtaattggaatctt

SEQ ID NO: 4698151 - DNA, 20 bp, Homo sapiens
cgacaagagtgagactccac

SEQ ID NO: 4698152 - DNA, 17 bp, Homo sapiens
cgaccccatctgcccag

SEQ ID NO: 4698153 - DNA, 11 bp, Homo sapiens
cgactgtctcc

SEQ ID NO: 4698154 - DNA, 18 bp, Homo sapiens
cgacttgaattttcccac

SEQ ID NO: 4698155 - DNA, 21 bp, Homo sapiens
cgacttgaattttcccactgc

SEQ ID NO: 4698156 - DNA, 16 bp, Homo sapiens
cgagaactttcatttt

SEQ ID NO: 4698157 - DNA, 18 bp, Homo sapiens
cgagatcacgccactgca

SEQ ID NO: 4698158 - DNA, 13 bp, Homo sapiens
cgagcacctccac

SEQ ID NO: 4698159 - DNA, 18 bp, Homo sapiens
cgagcagggtgctgtggg

SEQ ID NO: 4698160 - DNA, 18 bp, Homo sapiens
cgagcatgcctggatggg

SEQ ID NO: 4698161 - DNA, 15 bp, Homo sapiens
cgagccctggtggca

SEQ ID NO: 4698162 - DNA, 16 bp, Homo sapiens
cgagccctggtggcag

SEQ ID NO: 4698163 - DNA, 14 bp, Homo sapiens
cgaggacagggagg

SEQ ID NO: 4698164 - DNA, 21 bp, Homo sapiens
cgaggacatgaaactccacct

SEQ ID NO: 4698165 - DNA, 21 bp, Homo sapiens
cgaggtttctcaaagaaattt

SEQ ID NO: 4698166 - DNA, 17 bp, Homo sapiens
cgagtttggtccctggg

SEQ ID NO: 4698167 - DNA, 18 bp, Homo sapiens
cgatatgaaaaataaata

SEQ ID NO: 4698168 - DNA, 23 bp, Homo sapiens
cgatctccactgttgggtgggtg

SEQ ID NO: 4698169 - DNA, 19 bp, Homo sapiens
cgatctgggttcactgcaa

SEQ ID NO: 4698170 - DNA, 21 bp, Homo sapiens
cgcacacgcacgcacacacac

SEQ ID NO: 4698171 - DNA, 14 bp, Homo sapiens
cgcacgcacacaca

SEQ ID NO: 4698172 - DNA, 23 bp, Homo sapiens
cgcacgcacacacacatacagag

SEQ ID NO: 4698173 - DNA, 14 bp, Homo sapiens
cgcagacaggacca

SEQ ID NO: 4698174 - DNA, 14 bp, Homo sapiens
cgcagagctggccg

SEQ ID NO: 4698175 - DNA, 20 bp, Homo sapiens
cgcagcatattcaggaagct

SEQ ID NO: 4698176 - DNA, 14 bp, Homo sapiens
cgcagcctgagaat

SEQ ID NO: 4698177 - DNA, 15 bp, Homo sapiens
cgcagctggcagaga

SEQ ID NO: 4698178 - DNA, 18 bp, Homo sapiens
cgcaggcctgccttctca

SEQ ID NO: 4698179 - DNA, 19 bp, Homo sapiens
cgcaggcctgccttctcag

SEQ ID NO: 4698180 - DNA, 19 bp, Homo sapiens
cgcaggctggccctgccct

SEQ ID NO: 4698181 - DNA, 21 bp, Homo sapiens
cgcaggctggccctgccctgg

SEQ ID NO: 4698182 - DNA, 19 bp, Homo sapiens
cgccaaataatgtctctgt

SEQ ID NO: 4698183 - DNA, 17 bp, Homo sapiens
cgccagattctttcctg

SEQ ID NO: 4698184 - DNA, 19 bp, Homo sapiens
cgccagattctttcctgag

SEQ ID NO: 4698185 - DNA, 21 bp, Homo sapiens
cgcccaccgcatgccccctcg

SEQ ID NO: 4698186 - DNA, 22 bp, Homo sapiens
cgcccagttgggtggatgcctg

SEQ ID NO: 4698187 - DNA, 20 bp, Homo sapiens
cgcccatcagtgccagcccc

SEQ ID NO: 4698188 - DNA, 15 bp, Homo sapiens
cgcccccactggtga

SEQ ID NO: 4698189 - DNA, 17 bp, Homo sapiens
cgtgggctccctgactg

SEQ ID NO: 4698190 - DNA, 23 bp, Homo sapiens
cgtggggccatgctgagagctgg

SEQ ID NO: 4698191 - DNA, 18 bp, Homo sapiens
cgtggtgcgagtgcgtga

SEQ ID NO: 4698192 - DNA, 16 bp, Homo sapiens
cgtgtcacctgtgctt

SEQ ID NO: 4698193 - DNA, 22 bp, Homo sapiens
cgtgtcccctatcctacttccc

SEQ ID NO: 4698194 - DNA, 22 bp, Homo sapiens
cgtgtgtagagttaagaagctg

SEQ ID NO: 4698195 - DNA, 11 bp, Homo sapiens
cgtgtgtgtgt

SEQ ID NO: 4698196 - DNA, 21 bp, Homo sapiens
cgttcatgggggagggggcag

SEQ ID NO: 4698197 - DNA, 17 bp, Homo sapiens
cgttgatgttggctggg

SEQ ID NO: 4698198 - DNA, 18 bp, Homo sapiens
cgttgatgttggctggga

SEQ ID NO: 4698199 - DNA, 15 bp, Homo sapiens
ctaaaaaaaagatga

SEQ ID NO: 4698200 - DNA, 20 bp, Homo sapiens
ctaaaacaaaagctcatcca

SEQ ID NO: 4698201 - DNA, 16 bp, Homo sapiens
ctaaaatattttagat

SEQ ID NO: 4698202 - DNA, 12 bp, Homo sapiens
ctaaactccagg

SEQ ID NO: 4698203 - DNA, 18 bp, Homo sapiens
ctaaactccaggatttat

SEQ ID NO: 4698204 - DNA, 19 bp, Homo sapiens
ctaaactccaggatttata

SEQ ID NO: 4698205 - DNA, 15 bp, Homo sapiens
ctaaagtgagctcta

SEQ ID NO: 4698206 - DNA, 21 bp, Homo sapiens
ctaaatattggtttgttattc

SEQ ID NO: 4698207 - DNA, 22 bp, Homo sapiens
ctaaatgaaaatcgtgacaaca

SEQ ID NO: 4698208 - DNA, 15 bp, Homo sapiens
ctaaatggtgctgca

SEQ ID NO: 4698209 - DNA, 14 bp, Homo sapiens
ctaaattatttact

SEQ ID NO: 4698210 - DNA, 15 bp, Homo sapiens
ctaaattatttactg

SEQ ID NO: 4698211 - DNA, 19 bp, Homo sapiens
ctaaattgatcattcataa

SEQ ID NO: 4698212 - DNA, 19 bp, Homo sapiens
ctaaattgttgtaattgca

SEQ ID NO: 4698213 - DNA, 15 bp, Homo sapiens
ctaaatttcttccta

SEQ ID NO: 4698214 - DNA, 22 bp, Homo sapiens
ctaacaatcagctccttcctgg

SEQ ID NO: 4698215 - DNA, 15 bp, Homo sapiens
ctaacacacagctcc

SEQ ID NO: 4698216 - DNA, 16 bp, Homo sapiens
ctaacacacagctccc

SEQ ID NO: 4698217 - DNA, 12 bp, Homo sapiens
ctaacatcagaa

SEQ ID NO: 4698218 - DNA, 12 bp, Homo sapiens
ctaacctcatct

SEQ ID NO: 4698219 - DNA, 14 bp, Homo sapiens
ctaacttgtctttg

SEQ ID NO: 4698220 - DNA, 22 bp, Homo sapiens
ctaacttgtctttggaccctga

SEQ ID NO: 4698221 - DNA, 22 bp, Homo sapiens
ctaagaaagcccttaggaagaa

SEQ ID NO: 4698222 - DNA, 17 bp, Homo sapiens
ctaagaagctgcaataa

SEQ ID NO: 4698223 - DNA, 22 bp, Homo sapiens
ctaagagggagggagggctcca

SEQ ID NO: 4698224 - DNA, 17 bp, Homo sapiens
ctaaggcgtggagctgc

SEQ ID NO: 4698225 - DNA, 19 bp, Homo sapiens
ctaaggcgtggagctgcct

SEQ ID NO: 4698226 - DNA, 20 bp, Homo sapiens
ctaagggaggcacttcctcc

SEQ ID NO: 4698227 - DNA, 22 bp, Homo sapiens
ctaagtgatcctcccacctcag

SEQ ID NO: 4698228 - DNA, 20 bp, Homo sapiens
ctaataaaatttaaaagtct

SEQ ID NO: 4698229 - DNA, 12 bp, Homo sapiens
ctaatacaccag

SEQ ID NO: 4698230 - DNA, 15 bp, Homo sapiens
ctaatattcacatgt

SEQ ID NO: 4698231 - DNA, 19 bp, Homo sapiens
ctaatattcacatgttcta

SEQ ID NO: 4698232 - DNA, 20 bp, Homo sapiens
ctaatattcacatgttctaa

SEQ ID NO: 4698233 - DNA, 16 bp, Homo sapiens
ctaatgagtatttggt

SEQ ID NO: 4698234 - DNA, 17 bp, Homo sapiens
ctaatgagtatttggta

SEQ ID NO: 4698235 - DNA, 23 bp, Homo sapiens
ctaatgcgcaggctggccctgcc

SEQ ID NO: 4698236 - DNA, 16 bp, Homo sapiens
ctaatgttatttttta

SEQ ID NO: 4698237 - DNA, 13 bp, Homo sapiens
ctaattctttaat

SEQ ID NO: 4698238 - DNA, 17 bp, Homo sapiens
ctaattggtcattccta

SEQ ID NO: 4698239 - DNA, 14 bp, Homo sapiens
ctaatttattttgt

SEQ ID NO: 4698240 - DNA, 15 bp, Homo sapiens
ctacaaccaggtctt

SEQ ID NO: 4698241 - DNA, 22 bp, Homo sapiens
ctacaaccaggtcttgacctga

SEQ ID NO: 4698242 - DNA, 15 bp, Homo sapiens
ctacaagacacagtg

SEQ ID NO: 4698243 - DNA, 16 bp, Homo sapiens
ctacaatttaaagcaa

SEQ ID NO: 4698244 - DNA, 15 bp, Homo sapiens
ctacacaacatgtat

SEQ ID NO: 4698245 - DNA, 18 bp, Homo sapiens
ctacacaacatgtatgtg

SEQ ID NO: 4698246 - DNA, 14 bp, Homo sapiens
ctacacagggatgt

SEQ ID NO: 4698247 - DNA, 21 bp, Homo sapiens
ctacacagggatgtacaaggc

SEQ ID NO: 4698248 - DNA, 16 bp, Homo sapiens
ctacacccttttccag

SEQ ID NO: 4698249 - DNA, 18 bp, Homo sapiens
ctacacccttttccagct

SEQ ID NO: 4698250 - DNA, 16 bp, Homo sapiens
ctacactgacactggt

SEQ ID NO: 4698251 - DNA, 17 bp, Homo sapiens
ctacactgtgctgagtc

SEQ ID NO: 4698252 - DNA, 16 bp, Homo sapiens
ctacagagcttccctg

SEQ ID NO: 4698253 - DNA, 18 bp, Homo sapiens
ctacagagcttccctgac

SEQ ID NO: 4698254 - DNA, 17 bp, Homo sapiens
ctacagaggccatgggc

SEQ ID NO: 4698255 - DNA, 22 bp, Homo sapiens
ctacagaggccatgggcctcct

SEQ ID NO: 4698256 - DNA, 21 bp, Homo sapiens
ctacagctttgggtcattttt

SEQ ID NO: 4698257 - DNA, 18 bp, Homo sapiens
ctacagtcaggaaaggaa

SEQ ID NO: 4698258 - DNA, 15 bp, Homo sapiens
ctacagtcctcccat

SEQ ID NO: 4698259 - DNA, 16 bp, Homo sapiens
ctacagtcctcccatc

SEQ ID NO: 4698260 - DNA, 13 bp, Homo sapiens
ctacagtgctgtg

SEQ ID NO: 4698261 - DNA, 17 bp, Homo sapiens
ctacagtgtacagtctt

SEQ ID NO: 4698262 - DNA, 15 bp, Homo sapiens
ctacagttttaactg

SEQ ID NO: 4698263 - DNA, 16 bp, Homo sapiens
ctacatcttttataca

SEQ ID NO: 4698264 - DNA, 22 bp, Homo sapiens
ctacattataaatgtctcttta

SEQ ID NO: 4698265 - DNA, 21 bp, Homo sapiens
ctacatttagcccctctctta

SEQ ID NO: 4698266 - DNA, 18 bp, Homo sapiens
ctaccactgtcttcttca

SEQ ID NO: 4698267 - DNA, 15 bp, Homo sapiens
ctacccagcgagccc

SEQ ID NO: 4698268 - DNA, 20 bp, Homo sapiens
ctacccagcgagccctggtg

SEQ ID NO: 4698269 - DNA, 17 bp, Homo sapiens
ctaccccaattccttgt

SEQ ID NO: 4698270 - DNA, 11 bp, Homo sapiens
ctacccctccc

SEQ ID NO: 4698271 - DNA, 15 bp, Homo sapiens
ctacccctcccagct

SEQ ID NO: 4698272 - DNA, 17 bp, Homo sapiens
ctacccctcccagctga

SEQ ID NO: 4698273 - DNA, 12 bp, Homo sapiens
ctaccctgagct

SEQ ID NO: 4698274 - DNA, 17 bp, Homo sapiens
ctaccctgagctgaggc

SEQ ID NO: 4698275 - DNA, 18 bp, Homo sapiens
ctaccctgagctgaggca

SEQ ID NO: 4698276 - DNA, 18 bp, Homo sapiens
ctacctctccagcctcag

SEQ ID NO: 4698277 - DNA, 19 bp, Homo sapiens
ctacctgacactcccttgg

SEQ ID NO: 4698278 - DNA, 11 bp, Homo sapiens
ctacctgaggg

SEQ ID NO: 4698279 - DNA, 15 bp, Homo sapiens
ctacctgaggggcct

SEQ ID NO: 4698280 - DNA, 23 bp, Homo sapiens
ctacctgaggggcctcttatggg

SEQ ID NO: 4698281 - DNA, 17 bp, Homo sapiens
ctacgtacatgtgaggc

SEQ ID NO: 4698282 - DNA, 23 bp, Homo sapiens
ctactaacaatcagctccttcct

SEQ ID NO: 4698283 - DNA, 13 bp, Homo sapiens
ctactattcatgt

SEQ ID NO: 4698284 - DNA, 18 bp, Homo sapiens
ctactattcatgttttga

SEQ ID NO: 4698285 - DNA, 14 bp, Homo sapiens
ctactcagttatta

SEQ ID NO: 4698286 - DNA, 12 bp, Homo sapiens
ctactctgtgta

SEQ ID NO: 4698287 - DNA, 12 bp, Homo sapiens
ctactctgtgtc

SEQ ID NO: 4698288 - DNA, 21 bp, Homo sapiens
ctactctgtgtcaggtggggc

SEQ ID NO: 4698289 - DNA, 19 bp, Homo sapiens
ctactgtcctacccaccct

SEQ ID NO: 4698290 - DNA, 20 bp, Homo sapiens
ctactgtcctacccaccctc

SEQ ID NO: 4698291 - DNA, 13 bp, Homo sapiens
ctacttgggccat

SEQ ID NO: 4698292 - DNA, 13 bp, Homo sapiens
ctactttccattt

SEQ ID NO: 4698293 - DNA, 22 bp, Homo sapiens
ctacttttaaagaatttcttta

SEQ ID NO: 4698294 - DNA, 13 bp, Homo sapiens
ctagaaaaaaaga

SEQ ID NO: 4698295 - DNA, 16 bp, Homo sapiens
ctagaaacttccaaat

SEQ ID NO: 4698296 - DNA, 17 bp, Homo sapiens
ctagaaatacacttttt

SEQ ID NO: 4698297 - DNA, 18 bp, Homo sapiens
ctagaacctggaagggct

SEQ ID NO: 4698298 - DNA, 22 bp, Homo sapiens
ctagaagggctagaacctggag

SEQ ID NO: 4698299 - DNA, 14 bp, Homo sapiens
ctccagcccctgga

SEQ ID NO: 4698300 - DNA, 16 bp, Homo sapiens
ctccagcccctggatg

SEQ ID NO: 4698301 - DNA, 12 bp, Homo sapiens
ctccagcctcag

SEQ ID NO: 4698302 - DNA, 12 bp, Homo sapiens
ctccagcctgac

SEQ ID NO: 4698303 - DNA, 14 bp, Homo sapiens
ctccagcctgacaa

SEQ ID NO: 4698304 - DNA, 14 bp, Homo sapiens
ctccagctcaccag

SEQ ID NO: 4698305 - DNA, 23 bp, Homo sapiens
ctccagctggccgggagcctgat

SEQ ID NO: 4698306 - DNA, 20 bp, Homo sapiens
ctccaggatttataaagcaa

SEQ ID NO: 4698307 - DNA, 11 bp, Homo sapiens
ctccaggcagg

SEQ ID NO: 4698308 - DNA, 12 bp, Homo sapiens
ctccagggctgg

SEQ ID NO: 4698309 - DNA, 13 bp, Homo sapiens
ctccagggctgga

SEQ ID NO: 4698310 - DNA, 14 bp, Homo sapiens
ctccagggctggac

SEQ ID NO: 4698311 - DNA, 16 bp, Homo sapiens
ctccagggctggactg

SEQ ID NO: 4698312 - DNA, 20 bp, Homo sapiens
ctccagggctggactgaggc

SEQ ID NO: 4698313 - DNA, 18 bp, Homo sapiens
ctccaggtgcacaagctc

SEQ ID NO: 4698314 - DNA, 22 bp, Homo sapiens
ctccaggtgcacaagctccaag

SEQ ID NO: 4698315 - DNA, 22 bp, Homo sapiens
ctccagtcattatgttaatatt

SEQ ID NO: 4698316 - DNA, 19 bp, Homo sapiens
ctccatcagttagagctga

SEQ ID NO: 4698317 - DNA, 15 bp, Homo sapiens
ctccatggccctgcc

SEQ ID NO: 4698318 - DNA, 20 bp, Homo sapiens
ctccatggccctgccatgct

SEQ ID NO: 4698319 - DNA, 14 bp, Homo sapiens
ctccatgtgggcta

SEQ ID NO: 4698320 - DNA, 15 bp, Homo sapiens
ctccattttcttgtc

SEQ ID NO: 4698321 - DNA, 23 bp, Homo sapiens
ctcccaaagtgctgggattacag

SEQ ID NO: 4698322 - DNA, 14 bp, Homo sapiens
ctcccaactcaccc

SEQ ID NO: 4698323 - DNA, 15 bp, Homo sapiens
ctcccaactcacccc

SEQ ID NO: 4698324 - DNA, 21 bp, Homo sapiens
ctcccaagagcttccagagct

SEQ ID NO: 4698325 - DNA, 14 bp, Homo sapiens
ctcccaagggatgg

SEQ ID NO: 4698326 - DNA, 18 bp, Homo sapiens
ctcccaagggatggtgcc

SEQ ID NO: 4698327 - DNA, 14 bp, Homo sapiens
ctcccacagtgact

SEQ ID NO: 4698328 - DNA, 20 bp, Homo sapiens
ctcccacagtgactcgggct

SEQ ID NO: 4698329 - DNA, 19 bp, Homo sapiens
ctcccaccataatccctgt

SEQ ID NO: 4698330 - DNA, 12 bp, Homo sapiens
ctcccacctcag

SEQ ID NO: 4698331 - DNA, 14 bp, Homo sapiens
ctcccacctcagcc

SEQ ID NO: 4698332 - DNA, 16 bp, Homo sapiens
ctcccacctcagcctc

SEQ ID NO: 4698333 - DNA, 18 bp, Homo sapiens
ctcccacttccctgacac

SEQ ID NO: 4698334 - DNA, 17 bp, Homo sapiens
ctcccagctaattgaga

SEQ ID NO: 4698335 - DNA, 18 bp, Homo sapiens
ctcccagctgacagtcct

SEQ ID NO: 4698336 - DNA, 21 bp, Homo sapiens
ctcccagctgacagtcctctc

SEQ ID NO: 4698337 - DNA, 23 bp, Homo sapiens
ctcccagctgacagtcctctcca

SEQ ID NO: 4698338 - DNA, 23 bp, Homo sapiens
ctcccaggaaccgaacatatcat

SEQ ID NO: 4698339 - DNA, 22 bp, Homo sapiens
ctcccaggcattccccaggagg

SEQ ID NO: 4698340 - DNA, 14 bp, Homo sapiens
ctcccatctcacac

SEQ ID NO: 4698341 - DNA, 21 bp, Homo sapiens
ctcccatctcacacatgagca

SEQ ID NO: 4698342 - DNA, 21 bp, Homo sapiens
ctccccagcaagtgagagctg

SEQ ID NO: 4698343 - DNA, 21 bp, Homo sapiens
ctccccagggttcagtcctca

SEQ ID NO: 4698344 - DNA, 13 bp, Homo sapiens
ctcccccactttc

SEQ ID NO: 4698345 - DNA, 20 bp, Homo sapiens
ctcccccagccccatcctct

SEQ ID NO: 4698346 - DNA, 22 bp, Homo sapiens
ctcccccagccccatcctctgt

SEQ ID NO: 4698347 - DNA, 13 bp, Homo sapiens
ctcccccccgggg

SEQ ID NO: 4698348 - DNA, 18 bp, Homo sapiens
ctcccccccggggctggg

SEQ ID NO: 4698349 - DNA, 21 bp, Homo sapiens
ctcccccccggggctgggttg

SEQ ID NO: 4698350 - DNA, 13 bp, Homo sapiens
ctcccccgggagg

SEQ ID NO: 4698351 - DNA, 16 bp, Homo sapiens
ctcccctcctctcccc

SEQ ID NO: 4698352 - DNA, 13 bp, Homo sapiens
ctcccctgccccc

SEQ ID NO: 4698353 - DNA, 16 bp, Homo sapiens
ctcccctgcccccagg

SEQ ID NO: 4698354 - DNA, 17 bp, Homo sapiens
ctcccctgcccccagga

SEQ ID NO: 4698355 - DNA, 23 bp, Homo sapiens
ctcccctgcccccaggactgggc

SEQ ID NO: 4698356 - DNA, 23 bp, Homo sapiens
ctcccctgccccctgcaggaagg

SEQ ID NO: 4698357 - DNA, 12 bp, Homo sapiens
ctcccctgctgg

SEQ ID NO: 4698358 - DNA, 23 bp, Homo sapiens
ctcccctggggacagcaagggct

SEQ ID NO: 4698359 - DNA, 23 bp, Homo sapiens
ctcccgaatagctgggactacag

SEQ ID NO: 4698360 - DNA, 16 bp, Homo sapiens
ctcccgagtagctggg

SEQ ID NO: 4698361 - DNA, 13 bp, Homo sapiens
ctccctcctggcc

SEQ ID NO: 4698362 - DNA, 16 bp, Homo sapiens
ctccctcctggccaga

SEQ ID NO: 4698363 - DNA, 13 bp, Homo sapiens
ctccctgcctcca

SEQ ID NO: 4698364 - DNA, 11 bp, Homo sapiens
ctccctgctgt

SEQ ID NO: 4698365 - DNA, 16 bp, Homo sapiens
ctccctgctgtcccct

SEQ ID NO: 4698366 - DNA, 19 bp, Homo sapiens
ctccctgctgtcccctctt

SEQ ID NO: 4698367 - DNA, 20 bp, Homo sapiens
ctccctgctgtcccctcttg

SEQ ID NO: 4698368 - DNA, 12 bp, Homo sapiens
ctccctggccct

SEQ ID NO: 4698369 - DNA, 22 bp, Homo sapiens
ctccctgggggcggccagccct

SEQ ID NO: 4698370 - DNA, 19 bp, Homo sapiens
ctccctgtaacctcttcag

SEQ ID NO: 4698371 - DNA, 14 bp, Homo sapiens
ctcccttcccacct

SEQ ID NO: 4698372 - DNA, 15 bp, Homo sapiens
ctcccttcccacctc

SEQ ID NO: 4698373 - DNA, 17 bp, Homo sapiens
ctcccttcccacctctc
